United States Patent 12,624,385 (RIBOREGULATORS AND METHODS OF USE THEREOF) - sequence listing, part 10

SEQ ID NO: 153843 - DNA, 103 bp, Artificial Sequence
  Synthetic Polynucleotide
taatacgactcactatagggagtcgttgacgtactcgatggccagcgggcaacagaggagagcccgcatgccatcgagtaacctggcggcagcgcaaaagatg

SEQ ID NO: 153844 - DNA, 103 bp, Artificial Sequence
  Synthetic Polynucleotide
taatacgactcactatagggcgcccgcgaagcccgggccgcggaaagcctaacagaggagaaggcttatggcggcccggaacctggcggcagcgcaaaagatg

SEQ ID NO: 153845 - DNA, 103 bp, Artificial Sequence
  Synthetic Polynucleotide
taatacgactcactataggggctccgccgccgcccgcgaagcccgggccgaacagaggagacggcccatgcttcgcgggaacctggcggcagcgcaaaagatg

SEQ ID NO: 153846 - DNA, 103 bp, Artificial Sequence
  Synthetic Polynucleotide
taatacgactcactatagggcatgtcgtccgctccgccgccgcccgcgaaaacagaggagattcgcgatgggcggcggaaacctggcggcagcgcaaaagatg

SEQ ID NO: 153847 - DNA, 103 bp, Artificial Sequence
  Synthetic Polynucleotide
taatacgactcactatagggggccggcgcccatgtcgtccgctccgccgcaacagaggagagcggcgatgcggacgacaaacctggcggcagcgcaaaagatg

SEQ ID NO: 153848 - DNA, 103 bp, Artificial Sequence
  Synthetic Polynucleotide
taatacgactcactatagggccgtggtggtggccggcgcccatgtcgtccaacagaggagaggacgaatggggcgccggaacctggcggcagcgcaaaagatg

SEQ ID NO: 153849 - DNA, 103 bp, Artificial Sequence
  Synthetic Polynucleotide
taatacgactcactataggggtggtgcgcgccgtggtggtggccggcgccaacagaggagaggcgccatgcaccaccacaacctggcggcagcgcaaaagatg

SEQ ID NO: 153850 - DNA, 103 bp, Artificial Sequence
  Synthetic Polynucleotide
taatacgactcactatagggggtgggcggcgtggtgcgcgccgtggtggtaacagaggagaaccaccatggcgcgcaccaacctggcggcagcgcaaaagatg

SEQ ID NO: 153851 - DNA, 103 bp, Artificial Sequence
  Synthetic Polynucleotide
taatacgactcactataggggcgtggtgatggtgggcggcgtggtgcgcgaacagaggagacgcgcaatgcgccgcccaaacctggcggcagcgcaaaagatg

SEQ ID NO: 153852 - DNA, 103 bp, Artificial Sequence
  Synthetic Polynucleotide
taatacgactcactataggggtggtgggcggcgtggtgatggtgggcggcaacagaggagagccgccatgcatcaccacaacctggcggcagcgcaaaagatg

SEQ ID NO: 153853 - DNA, 103 bp, Artificial Sequence
  Synthetic Polynucleotide
taatacgactcactatagggggtggtggtggtggtgggcggcgtggtgataacagaggagaatcaccatgccgcccaccaacctggcggcagcgcaaaagatg

SEQ ID NO: 153854 - DNA, 103 bp, Artificial Sequence
  Synthetic Polynucleotide
taatacgactcactatagggatcaggtcgaagtcgttgacgtactcgatgaacagaggagacatcgaatgcgtcaacgaaacctggcggcagcgcaaaagatg

SEQ ID NO: 153855 - DNA, 103 bp, Artificial Sequence
  Synthetic Polynucleotide
taatacgactcactatagggtggtggtggtggtggtggtggtggtgggcgaacagaggagacgcccaatgccaccaccaaacctggcggcagcgcaaaagatg

SEQ ID NO: 153856 - DNA, 103 bp, Artificial Sequence
  Synthetic Polynucleotide
taatacgactcactataggggccgccatggtggtggtggtggtggtggtgaacagaggagacaccacatgcaccaccacaacctggcggcagcgcaaaagatg

SEQ ID NO: 153857 - DNA, 103 bp, Artificial Sequence
  Synthetic Polynucleotide
taatacgactcactatagggcgtgtcccgcgccgccatggtggtggtggtaacagaggagaaccaccatgaccatggcgaacctggcggcagcgcaaaagatg

SEQ ID NO: 153858 - DNA, 103 bp, Artificial Sequence
  Synthetic Polynucleotide
taatacgactcactataggggcgccaccgccgtgtcccgcgccgccatggaacagaggagaccatggatgcgcgggacaaacctggcggcagcgcaaaagatg

SEQ ID NO: 153859 - DNA, 103 bp, Artificial Sequence
  Synthetic Polynucleotide
taatacgactcactataggggtggtggcccgcgccaccgccgtgtcccgcaacagaggagagcgggaatgggcggtggcaacctggcggcagcgcaaaagatg

SEQ ID NO: 153860 - DNA, 103 bp, Artificial Sequence
  Synthetic Polynucleotide
taatacgactcactatagggccaggcgcacgtggtggcccgcgccaccgcaacagaggagagcggtgatgcgggccaccaacctggcggcagcgcaaaagatg

SEQ ID NO: 153861 - DNA, 103 bp, Artificial Sequence
  Synthetic Polynucleotide
taatacgactcactatagggaagcgctcctccaggcgcacgtggtggcccaacagaggagagggccaatgcgtgcgcctaacctggcggcagcgcaaaagatg

SEQ ID NO: 153862 - DNA, 103 bp, Artificial Sequence
  Synthetic Polynucleotide
taatacgactcactataggggtcgtcggagaagcgctcctccaggcgcacaacagaggagagtgcgcatggaggagcgcaacctggcggcagcgcaaaagatg

SEQ ID NO: 153863 - DNA, 103 bp, Artificial Sequence
  Synthetic Polynucleotide
taatacgactcactatagggacaccagctggtcgtcggagaagcgctcctaacagaggagaaggagcatgtctccgacgaacctggcggcagcgcaaaagatg

SEQ ID NO: 153864 - DNA, 103 bp, Artificial Sequence
  Synthetic Polynucleotide
taatacgactcactatagggaccgacatggacaccagctggtcgtcggagaacagaggagactccgaatgccagctggtaacctggcggcagcgcaaaagatg

SEQ ID NO: 153865 - DNA, 103 bp, Artificial Sequence
  Synthetic Polynucleotide
taatacgactcactatagggctcgaacttcatcaggtcgaagtcgttgacaacagaggagagtcaacatgttcgacctgaacctggcggcagcgcaaaagatg

SEQ ID NO: 153866 - DNA, 103 bp, Artificial Sequence
  Synthetic Polynucleotide
taatacgactcactatagggcagctcgcgcaccgacatggacaccagctgaacagaggagacagctgatgtccatgtcgaacctggcggcagcgcaaaagatg

SEQ ID NO: 153867 - DNA, 103 bp, Artificial Sequence
  Synthetic Polynucleotide
taatacgactcactataggggctgccggttcagctcgcgcaccgacatggaacagaggagaccatgtatgtgcgcgagcaacctggcggcagcgcaaaagatg

SEQ ID NO: 153868 - DNA, 103 bp, Artificial Sequence
  Synthetic Polynucleotide
taatacgactcactatagggaagccgcggagctgccggttcagctcgcgcaacagaggagagcgcgaatggaaccggcaaacctggcggcagcgcaaaagatg

SEQ ID NO: 153869 - DNA, 103 bp, Artificial Sequence
  Synthetic Polynucleotide
taatacgactcactatagggctccttgctgaagccgcggagctgccggttaacagaggagaaaccggatgctccgcggcaacctggcggcagcgcaaaagatg

SEQ ID NO: 153870 - DNA, 103 bp, Artificial Sequence
  Synthetic Polynucleotide
taatacgactcactatagggggatgacctcctccttgctgaagccgcggaaacagaggagatccgcgatgtcagcaaggaacctggcggcagcgcaaaagatg

SEQ ID NO: 153871 - DNA, 103 bp, Artificial Sequence
  Synthetic Polynucleotide
taatacgactcactatagggtgcttgagccggatgacctcctccttgctgaacagaggagacagcaaatgggaggtcataacctggcggcagcgcaaaagatg

SEQ ID NO: 153872 - DNA, 103 bp, Artificial Sequence
  Synthetic Polynucleotide
taatacgactcactataggggcgccgcttctgcttgagccggatgacctcaacagaggagagaggtcatgcggctcaagaacctggcggcagcgcaaaagatg

SEQ ID NO: 153873 - DNA, 103 bp, Artificial Sequence
  Synthetic Polynucleotide
taatacgactcactatagggtcttgagcgtgcgccgcttctgcttgagccaacagaggagaggctcaatgagaagcggcaacctggcggcagcgcaaaagatg

SEQ ID NO: 153874 - DNA, 103 bp, Artificial Sequence
  Synthetic Polynucleotide
taatacgactcactatagggtagccgcggttcttgagcgtgcgccgcttcaacagaggagagaagcgatgcacgctcaaaacctggcggcagcgcaaaagatg

SEQ ID NO: 153875 - DNA, 103 bp, Artificial Sequence
  Synthetic Polynucleotide
taatacgactcactatagggggactgcgcgtagccgcggttcttgagcgtaacagaggagaacgctcatgaaccgcggcaacctggcggcagcgcaaaagatg

SEQ ID NO: 153876 - DNA, 103 bp, Artificial Sequence
  Synthetic Polynucleotide
taatacgactcactatagggccttcttcacctcgaacttcatcaggtcgaaacagaggagatcgaccatgtgaagttcgaacctggcggcagcgcaaaagatg

SEQ ID NO: 153877 - DNA, 103 bp, Artificial Sequence
  Synthetic Polynucleotide
taatacgactcactatagggtgaagcggcaggactgcgcgtagccgcggtaacagaggagaaccgcgatgacgcgcagtaacctggcggcagcgcaaaagatg

SEQ ID NO: 153878 - DNA, 103 bp, Artificial Sequence
  Synthetic Polynucleotide
taatacgactcactatagggtgcacccgcttgaagcggcaggactgcgcgaacagaggagacgcgcaatgctgccgcttaacctggcggcagcgcaaaagatg

SEQ ID NO: 153879 - DNA, 103 bp, Artificial Sequence
  Synthetic Polynucleotide
taatacgactcactataggggtgccgctgctgcacccgcttgaagcggcaaacagaggagatgccgcatgaagcgggtgaacctggcggcagcgcaaaagatg

SEQ ID NO: 153880 - DNA, 103 bp, Artificial Sequence
  Synthetic Polynucleotide
taatacgactcactatagggtctccagaatgtgccgctgctgcacccgctaacagaggagaagcgggatgagcagcggcaacctggcggcagcgcaaaagatg

SEQ ID NO: 153881 - DNA, 103 bp, Artificial Sequence
  Synthetic Polynucleotide
taatacgactcactatagggcacttctcgctctccagaatgtgccgctgcaacagaggagagcagcgatgcattctggaaacctggcggcagcgcaaaagatg

SEQ ID NO: 153882 - DNA, 103 bp, Artificial Sequence
  Synthetic Polynucleotide
taatacgactcactatagggctggagttggcacttctcgctctccagaataacagaggagaattctgatgagcgagaagaacctggcggcagcgcaaaagatg

SEQ ID NO: 153883 - DNA, 103 bp, Artificial Sequence
  Synthetic Polynucleotide
taatacgactcactatagggccacctggctctggagttggcacttctcgcaacagaggagagcgagaatggccaactccaacctggcggcagcgcaaaagatg

SEQ ID NO: 153884 - DNA, 103 bp, Artificial Sequence
  Synthetic Polynucleotide
taatacgactcactatagggttcagctgctccacctggctctggagttggaacagaggagaccaactatggagccaggtaacctggcggcagcgcaaaagatg

SEQ ID NO: 153885 - DNA, 103 bp, Artificial Sequence
  Synthetic Polynucleotide
taatacgactcactatagggcacctccagcttcagctgctccacctggctaacagaggagaagccagatggagcagctgaacctggcggcagcgcaaaagatg

SEQ ID NO: 153886 - DNA, 103 bp, Artificial Sequence
  Synthetic Polynucleotide
taatacgactcactatagggccaggcgccccacctccagcttcagctgctaacagaggagaagcagcatgagctggaggaacctggcggcagcgcaaaagatg

SEQ ID NO: 153887 - DNA, 103 bp, Artificial Sequence
  Synthetic Polynucleotide
taatacgactcactatagggtcgggaggctccttcttcacctcgaacttcaacagaggagagaagttatgggtgaagaaaacctggcggcagcgcaaaagatg

SEQ ID NO: 153888 - DNA, 103 bp, Artificial Sequence
  Synthetic Polynucleotide
taatacgactcactatagggcgctctttggccaggcgccccacctccagcaacagaggagagctggaatgggggcgcctaacctggcggcagcgcaaaagatg

SEQ ID NO: 153889 - DNA, 103 bp, Artificial Sequence
  Synthetic Polynucleotide
taatacgactcactataggggtacaggtcccgctctttggccaggcgcccaacagaggagagggcgcatggccaaagagaacctggcggcagcgcaaaagatg

SEQ ID NO: 153890 - DNA, 103 bp, Artificial Sequence
  Synthetic Polynucleotide
taatacgactcactatagggatttctccttgtacaggtcccgctctttggaacagaggagaccaaagatggggacctgtaacctggcggcagcgcaaaagatg

SEQ ID NO: 153891 - DNA, 103 bp, Artificial Sequence
  Synthetic Polynucleotide
taatacgactcactatagggagcttctcgtatttctccttgtacaggtccaacagaggagaggacctatgcaaggagaaaacctggcggcagcgcaaaagatg

SEQ ID NO: 153892 - DNA, 103 bp, Artificial Sequence
  Synthetic Polynucleotide
taatacgactcactatagggccggcccgccagcttctcgtatttctccttaacagaggagaaaggagatgtacgagaagaacctggcggcagcgcaaaagatg

SEQ ID NO: 153893 - DNA, 103 bp, Artificial Sequence
  Synthetic Polynucleotide
taatacgactcactatagggcggggccgccccggcccgccagcttctcgtaacagaggagaacgagaatgtggcgggccaacctggcggcagcgcaaaagatg

SEQ ID NO: 153894 - DNA, 103 bp, Artificial Sequence
  Synthetic Polynucleotide
taatacgactcactatagggcccgcgctcccggggccgccccggcccgccaacagaggagaggcgggatggggcggcccaacctggcggcagcgcaaaagatg

SEQ ID NO: 153895 - DNA, 103 bp, Artificial Sequence
  Synthetic Polynucleotide
taatacgactcactatagggaccggccccgcccgcgctcccggggccgccaacagaggagaggcggcatggggagcgcgaacctggcggcagcgcaaaagatg

SEQ ID NO: 153896 - DNA, 103 bp, Artificial Sequence
  Synthetic Polynucleotide
taatacgactcactatagggcccgcgggaaaccggccccgcccgcgctccaacagaggagaggagcgatggcggggccgaacctggcggcagcgcaaaagatg

SEQ ID NO: 153897 - DNA, 103 bp, Artificial Sequence
  Synthetic Polynucleotide
taatacgactcactatagggggcgaaggctcccgcgggaaaccggccccgaacagaggagacggggcatgtttcccgcgaacctggcggcagcgcaaaagatg

SEQ ID NO: 153898 - DNA, 103 bp, Artificial Sequence
  Synthetic Polynucleotide
taatacgactcactatagggctctggccccatgctcagctccgcggccataacagaggagaatggccatggagctgagcaacctggcggcagcgcaaaagatg

SEQ ID NO: 153899 - DNA, 103 bp, Artificial Sequence
  Synthetic Polynucleotide
taatacgactcactatagggctccgcgcgccccagtggctccttcttcacaacagaggagagtgaagatggagccactgaacctggcggcagcgcaaaagatg

SEQ ID NO: 153900 - DNA, 103 bp, Artificial Sequence
  Synthetic Polynucleotide
taatacgactcactatagggtgcccggacgctccgcgcgccccagtggctaacagaggagaagccacatgggcgcgcggaacctggcggcagcgcaaaagatg

SEQ ID NO: 153901 - DNA, 103 bp, Artificial Sequence
  Synthetic Polynucleotide
taatacgactcactataggggtgcagggcctgcccggacgctccgcgcgcaacagaggagagcgcgcatggcgtccgggaacctggcggcagcgcaaaagatg

SEQ ID NO: 153902 - DNA, 103 bp, Artificial Sequence
  Synthetic Polynucleotide
taatacgactcactatagggctgcaggcgtgtgcagggcctgcccggacgaacagaggagacgtccgatgaggccctgcaacctggcggcagcgcaaaagatg

SEQ ID NO: 153903 - DNA, 103 bp, Artificial Sequence
  Synthetic Polynucleotide
taatacgactcactatagggagccggctggctgcaggcgtgtgcagggccaacagaggagaggccctatgcacgcctgcaacctggcggcagcgcaaaagatg

SEQ ID NO: 153904 - DNA, 103 bp, Artificial Sequence
  Synthetic Polynucleotide
taatacgactcactataggggaggacaccgagccggctggctgcaggcgtaacagaggagaacgcctatggccagccggaacctggcggcagcgcaaaagatg

SEQ ID NO: 153905 - DNA, 103 bp, Artificial Sequence
  Synthetic Polynucleotide
taatacgactcactataggggagcggtgtggaggacaccgagccggctggaacagaggagaccagccatgtcggtgtccaacctggcggcagcgcaaaagatg

SEQ ID NO: 153906 - DNA, 103 bp, Artificial Sequence
  Synthetic Polynucleotide
taatacgactcactatagggacggagtgctgagcggtgtggaggacaccgaacagaggagacggtgtatgccacaccgcaacctggcggcagcgcaaaagatg

SEQ ID NO: 153907 - DNA, 103 bp, Artificial Sequence
  Synthetic Polynucleotide
taatacgactcactatagggacggagctacacggagtgctgagcggtgtgaacagaggagacacaccatgcagcactccaacctggcggcagcgcaaaagatg

SEQ ID NO: 153908 - DNA, 103 bp, Artificial Sequence
  Synthetic Polynucleotide
taatacgactcactatagggcgacgagggcacggagctacacggagtgctaacagaggagaagcactatgtgtagctccaacctggcggcagcgcaaaagatg

SEQ ID NO: 153909 - DNA, 103 bp, Artificial Sequence
  Synthetic Polynucleotide
taatacgactcactatagggtggtgggcagctctggccccatgctcagctaacagaggagaagctgaatgtggggccagaacctggcggcagcgcaaaagatg

SEQ ID NO: 153910 - DNA, 103 bp, Artificial Sequence
  Synthetic Polynucleotide
taatacgactcactatagggtgaagctgggcgacgagggcacggagctacaacagaggagagtagctatgtgccctcgtaacctggcggcagcgcaaaagatg

SEQ ID NO: 153911 - DNA, 103 bp, Artificial Sequence
  Synthetic Polynucleotide
taatacgactcactatagggtcggtcgggctgaagctgggcgacgagggcaacagaggagagccctcatggcccagcttaacctggcggcagcgcaaaagatg

SEQ ID NO: 153912 - DNA, 103 bp, Artificial Sequence
  Synthetic Polynucleotide
taatacgactcactatagggtgtcttctgttcggtcgggctgaagctgggaacagaggagacccagcatgagcccgaccaacctggcggcagcgcaaaagatg

SEQ ID NO: 153913 - DNA, 103 bp, Artificial Sequence
  Synthetic Polynucleotide
taatacgactcactatagggcctcgaggtgtgtcttctgttcggtcgggcaacagaggagagcccgaatgaacagaagaaacctggcggcagcgcaaaagatg

SEQ ID NO: 153914 - DNA, 103 bp, Artificial Sequence
  Synthetic Polynucleotide
taatacgactcactatagggcagtacagatcctcgaggtgtgtcttctgtaacagaggagaacagaaatgacacctcgaaacctggcggcagcgcaaaagatg

SEQ ID NO: 153915 - DNA, 103 bp, Artificial Sequence
  Synthetic Polynucleotide
taatacgactcactataggggctcgccatccagtacagatcctcgaggtgaacagaggagacacctcatggatctgtacaacctggcggcagcgcaaaagatg

SEQ ID NO: 153916 - DNA, 103 bp, Artificial Sequence
  Synthetic Polynucleotide
taatacgactcactataggggctggtagttgctcgccatccagtacagataacagaggagaatctgtatgggatggcgaaacctggcggcagcgcaaaagatg

SEQ ID NO: 153917 - DNA, 103 bp, Artificial Sequence
  Synthetic Polynucleotide
taatacgactcactataggggggttcatctgctggtagttgctcgccatcaacagaggagagatggcatgcaactaccaaacctggcggcagcgcaaaagatg

SEQ ID NO: 153918 - DNA, 103 bp, Artificial Sequence
  Synthetic Polynucleotide
taatacgactcactataggggagcgcctcggggttcatctgctggtagttaacagaggagaaactacatgcagatgaacaacctggcggcagcgcaaaagatg

SEQ ID NO: 153919 - DNA, 103 bp, Artificial Sequence
  Synthetic Polynucleotide
taatacgactcactataggggcgtcaggttgagcgcctcggggttcatctaacagaggagaagatgaatgccgaggcgcaacctggcggcagcgcaaaagatg

SEQ ID NO: 153920 - DNA, 103 bp, Artificial Sequence
  Synthetic Polynucleotide
taatacgactcactataggggccagcgggctggtgggcagctctggccccaacagaggagaggggccatggctgcccacaacctggcggcagcgcaaaagatg

SEQ ID NO: 153921 - DNA, 103 bp, Artificial Sequence
  Synthetic Polynucleotide
taatacgactcactataggggcgtcctcgggcgtcaggttgagcgcctcgaacagaggagacgaggcatgcaacctgacaacctggcggcagcgcaaaagatg

SEQ ID NO: 153922 - DNA, 103 bp, Artificial Sequence
  Synthetic Polynucleotide
taatacgactcactatagggcgcttccaccgcgtcctcgggcgtcaggttaacagaggagaaacctgatgcccgaggacaacctggcggcagcgcaaaagatg

SEQ ID NO: 153923 - DNA, 103 bp, Artificial Sequence
  Synthetic Polynucleotide
taatacgactcactatagggagccgatgagcgcttccaccgcgtcctcggaacagaggagaccgaggatgcggtggaagaacctggcggcagcgcaaaagatg

SEQ ID NO: 153924 - DNA, 103 bp, Artificial Sequence
  Synthetic Polynucleotide
taatacgactcactatagggactgggtgcgagccgatgagcgcttccaccaacagaggagaggtggaatggctcatcggaacctggcggcagcgcaaaagatg

SEQ ID NO: 153925 - DNA, 103 bp, Artificial Sequence
  Synthetic Polynucleotide
taatacgactcactatagggcggctgtggcactgggtgcgagccgatgagaacagaggagactcatcatgtcgcacccaaacctggcggcagcgcaaaagatg

SEQ ID NO: 153926 - DNA, 103 bp, Artificial Sequence
  Synthetic Polynucleotide
taatacgactcactatagggagctttgcagcggctgtggcactgggtgcgaacagaggagacgcaccatgtgccacagcaacctggcggcagcgcaaaagatg

SEQ ID NO: 153927 - DNA, 103 bp, Artificial Sequence
  Synthetic Polynucleotide
taatacgactcactatagggaagctgtcgaagctttgcagcggctgtggcaacagaggagagccacaatggctgcaaagaacctggcggcagcgcaaaagatg

SEQ ID NO: 153928 - DNA, 103 bp, Artificial Sequence
  Synthetic Polynucleotide
taatacgactcactatagggagcgccgcgaaagctgtcgaagctttgcagaacagaggagactgcaaatgttcgacagcaacctggcggcagcgcaaaagatg

SEQ ID NO: 153929 - DNA, 103 bp, Artificial Sequence
  Synthetic Polynucleotide
taatacgactcactatagggggtggtggtgagcgccgcgaaagctgtcgaaacagaggagatcgacaatgttcgcggcgaacctggcggcagcgcaaaagatg

SEQ ID NO: 153930 - DNA, 103 bp, Artificial Sequence
  Synthetic Polynucleotide
taatacgactcactatagggtggtgatggtggtggtggtgagcgccgcgaaacagaggagatcgcggatgtcaccaccaaacctggcggcagcgcaaaagatg

SEQ ID NO: 153931 - DNA, 103 bp, Artificial Sequence
  Synthetic Polynucleotide
taatacgactcactatagggatactccatggccagcgggctggtgggcagaacagaggagactgcccatgagcccgctgaacctggcggcagcgcaaaagatg

SEQ ID NO: 153932 - DNA, 103 bp, Artificial Sequence
  Synthetic Polynucleotide
taatacgactcactataggggtgagggtggtggtgatggtggtggtggtgaacagaggagacaccacatgcaccatcacaacctggcggcagcgcaaaagatg

SEQ ID NO: 153933 - DNA, 103 bp, Artificial Sequence
  Synthetic Polynucleotide
taatacgactcactatagggcgtggtgcgggtgagggtggtggtgatggtaacagaggagaaccatcatgaccaccctcaacctggcggcagcgcaaaagatg

SEQ ID NO: 153934 - DNA, 103 bp, Artificial Sequence
  Synthetic Polynucleotide
taatacgactcactatagggcccgggtacgcgtggtgcgggtgagggtggaacagaggagaccacccatgcccgcaccaaacctggcggcagcgcaaaagatg

SEQ ID NO: 153935 - DNA, 103 bp, Artificial Sequence
  Synthetic Polynucleotide
taatacgactcactatagggcacgccggcgcccgggtacgcgtggtgcggaacagaggagaccgcacatggcgtacccgaacctggcggcagcgcaaaagatg

SEQ ID NO: 153936 - DNA, 103 bp, Artificial Sequence
  Synthetic Polynucleotide
taatacgactcactatagggcgtcgtgggccacgccggcgcccgggtacgaacagaggagacgtaccatggcgccggcgaacctggcggcagcgcaaaagatg

SEQ ID NO: 153937 - DNA, 103 bp, Artificial Sequence
  Synthetic Polynucleotide
taatacgactcactataggggggcccagctcgtcgtgggccacgccggcgaacagaggagacgccggatgggcccacgaaacctggcggcagcgcaaaagatg

SEQ ID NO: 153938 - DNA, 103 bp, Artificial Sequence
  Synthetic Polynucleotide
taatacgactcactataggggtgagcgtgcgggcccagctcgtcgtgggcaacagaggagagcccacatggagctgggcaacctggcggcagcgcaaaagatg

SEQ ID NO: 153939 - DNA, 103 bp, Artificial Sequence
  Synthetic Polynucleotide
taatacgactcactataggggatggtgcgggtgagcgtgcgggcccagctaacagaggagaagctggatgcgcacgctcaacctggcggcagcgcaaaagatg

SEQ ID NO: 153940 - DNA, 103 bp, Artificial Sequence
  Synthetic Polynucleotide
taatacgactcactatagggtgatgatggtgatggtgcgggtgagcgtgcaacagaggagagcacgcatgcccgcaccaaacctggcggcagcgcaaaagatg

SEQ ID NO: 153941 - DNA, 103 bp, Artificial Sequence
  Synthetic Polynucleotide
taatacgactcactatagggcgacgcttggtgatgatggtgatggtgcggaacagaggagaccgcacatgcaccatcataacctggcggcagcgcaaaagatg

SEQ ID NO: 153942 - DNA, 103 bp, Artificial Sequence
  Synthetic Polynucleotide
taatacgactcactatagggagtcgttgacatactccatggccagcgggcaacagaggagagcccgcatgccatggagtaacctggcggcagcgcaaaagatg

SEQ ID NO: 153943 - DNA, 103 bp, Artificial Sequence
  Synthetic Polynucleotide
taatacgactcactatagggacggcggcggcgacgcttggtgatgatggtaacagaggagaaccatcatgaccaagcgtaacctggcggcagcgcaaaagatg

SEQ ID NO: 153944 - DNA, 103 bp, Artificial Sequence
  Synthetic Polynucleotide
taatacgactcactataggggcggcgctggacggcggcggcgacgcttggaacagaggagaccaagcatggccgccgccaacctggcggcagcgcaaaagatg

SEQ ID NO: 153945 - DNA, 103 bp, Artificial Sequence
  Synthetic Polynucleotide
taatacgactcactatagggcgccgggctagcggcgctggacggcggcggaacagaggagaccgccgatgtccagcgccaacctggcggcagcgcaaaagatg

SEQ ID NO: 153946 - DNA, 103 bp, Artificial Sequence
  Synthetic Polynucleotide
taatacgactcactataggggcagctgttgcgccgggctagcggcgctggaacagaggagaccagcgatgctagcccggaacctggcggcagcgcaaaagatg

SEQ ID NO: 153947 - DNA, 103 bp, Artificial Sequence
  Synthetic Polynucleotide
taatacgactcactatagggtggctagtgggcagctgttgcgccgggctaaacagaggagatagcccatggcaacagctaacctggcggcagcgcaaaagatg

SEQ ID NO: 153948 - DNA, 103 bp, Artificial Sequence
  Synthetic Polynucleotide
taatacgactcactataggggggcccggggtggctagtgggcagctgttgaacagaggagacaacagatgcccactagcaacctggcggcagcgcaaaagatg

SEQ ID NO: 153949 - DNA, 103 bp, Artificial Sequence
  Synthetic Polynucleotide
taatacgactcactatagggcgtgcggcccgggcccggggtggctagtggaacagaggagaccactaatgaccccgggcaacctggcggcagcgcaaaagatg

SEQ ID NO: 153950 - DNA, 103 bp, Artificial Sequence
  Synthetic Polynucleotide
taatacgactcactataggggaggccgtcgcgtgcggcccgggcccggggaacagaggagaccccggatgcgggccgcaaacctggcggcagcgcaaaagatg

SEQ ID NO: 153951 - DNA, 103 bp, Artificial Sequence
  Synthetic Polynucleotide
taatacgactcactatagggcgccgtcgccgaggccgtcgcgtgcggcccaacagaggagagggccgatggcgacggccaacctggcggcagcgcaaaagatg

SEQ ID NO: 153952 - DNA, 103 bp, Artificial Sequence
  Synthetic Polynucleotide
taatacgactcactatagggtgccgcccgccgccgtcgccgaggccgtcgaacagaggagacgacggatgcggcgacggaacctggcggcagcgcaaaagatg

SEQ ID NO: 153953 - DNA, 103 bp, Artificial Sequence
  Synthetic Polynucleotide
taatacgactcactatagggagcaggtcgaagtcgttgacatactccatgaacagaggagacatggaatgtgtcaacgaaacctggcggcagcgcaaaagatg

SEQ ID NO: 153954 - DNA, 103 bp, Artificial Sequence
  Synthetic Polynucleotide
taatacgactcactatagggacgctgccgttgccgcccgccgccgtcgccaacagaggagaggcgacatgggcgggcggaacctggcggcagcgcaaaagatg

SEQ ID NO: 153955 - DNA, 103 bp, Artificial Sequence
  Synthetic Polynucleotide
taatacgactcactataggggcggtcctccacgctgccgttgccgcccgcaacagaggagagcgggcatgaacggcagcaacctggcggcagcgcaaaagatg

SEQ ID NO: 153956 - DNA, 103 bp, Artificial Sequence
  Synthetic Polynucleotide
taatacgactcactatagggcgtcggagaagcggtcctccacgctgccgtaacagaggagaacggcaatgtggaggaccaacctggcggcagcgcaaaagatg

SEQ ID NO: 153957 - DNA, 103 bp, Artificial Sequence
  Synthetic Polynucleotide
taatacgactcactatagggacgagctggtcgtcggagaagcggtcctccaacagaggagaggaggaatgcttctccgaaacctggcggcagcgcaaaagatg

SEQ ID NO: 153958 - DNA, 103 bp, Artificial Sequence
  Synthetic Polynucleotide
taatacgactcactatagggggacatggacacgagctggtcgtcggagaaaacagaggagattctccatggaccagctcaacctggcggcagcgcaaaagatg

SEQ ID NO: 153959 - DNA, 103 bp, Artificial Sequence
  Synthetic Polynucleotide
taatacgactcactataggggctcgcgcacggacatggacacgagctggtaacagaggagaaccagcatgtgtccatgtaacctggcggcagcgcaaaagatg

SEQ ID NO: 153960 - DNA, 103 bp, Artificial Sequence
  Synthetic Polynucleotide
taatacgactcactatagggtggcggttcagctcgcgcacggacatggacaacagaggagagtccatatgcgtgcgcgaaacctggcggcagcgcaaaagatg

SEQ ID NO: 153961 - DNA, 103 bp, Artificial Sequence
  Synthetic Polynucleotide
taatacgactcactataggggccccgcaggtggcggttcagctcgcgcacaacagaggagagtgcgcatgctgaaccgcaacctggcggcagcgcaaaagatg

SEQ ID NO: 153962 - DNA, 103 bp, Artificial Sequence
  Synthetic Polynucleotide
taatacgactcactatagggccttggtgaagccccgcaggtggcggttcaaacagaggagatgaaccatgacctgcgggaacctggcggcagcgcaaaagatg

SEQ ID NO: 153963 - DNA, 103 bp, Artificial Sequence
  Synthetic Polynucleotide
taatacgactcactatagggatcacctcgtccttggtgaagccccgcaggaacagaggagacctgcgatgcttcaccaaaacctggcggcagcgcaaaagatg

SEQ ID NO: 153964 - DNA, 103 bp, Artificial Sequence
  Synthetic Polynucleotide
taatacgactcactataggggtcgaacttgagcaggtcgaagtcgttgacaacagaggagagtcaacatgttcgacctgaacctggcggcagcgcaaaagatg

SEQ ID NO: 153965 - DNA, 103 bp, Artificial Sequence
  Synthetic Polynucleotide
taatacgactcactatagggcttcaggcggatcacctcgtccttggtgaaaacagaggagattcaccatggacgaggtgaacctggcggcagcgcaaaagatg

SEQ ID NO: 153966 - DNA, 103 bp, Artificial Sequence
  Synthetic Polynucleotide
taatacgactcactataggggccgcttctgcttcaggcggatcacctcgtaacagaggagaacgaggatgtccgcctgaaacctggcggcagcgcaaaagatg

SEQ ID NO: 153967 - DNA, 103 bp, Artificial Sequence
  Synthetic Polynucleotide
taatacgactcactatagggttcagggtccgccgcttctgcttcaggcggaacagaggagaccgcctatggcagaagcgaacctggcggcagcgcaaaagatg

SEQ ID NO: 153968 - DNA, 103 bp, Artificial Sequence
  Synthetic Polynucleotide
taatacgactcactataggggccccggttcttcagggtccgccgcttctgaacagaggagacagaagatgcggaccctgaacctggcggcagcgcaaaagatg

SEQ ID NO: 153969 - DNA, 103 bp, Artificial Sequence
  Synthetic Polynucleotide
taatacgactcactatagggactgggcgtagccccggttcttcagggtccaacagaggagaggacccatgagaaccgggaacctggcggcagcgcaaaagatg

SEQ ID NO: 153970 - DNA, 103 bp, Artificial Sequence
  Synthetic Polynucleotide
taatacgactcactatagggtacctgcaagactgggcgtagccccggttcaacagaggagagaaccgatgctacgcccaaacctggcggcagcgcaaaagatg

SEQ ID NO: 153971 - DNA, 103 bp, Artificial Sequence
  Synthetic Polynucleotide
taatacgactcactataggggacgcgtttatacctgcaagactgggcgtaaacagaggagatacgccatgtcttgcaggaacctggcggcagcgcaaaagatg

SEQ ID NO: 153972 - DNA, 103 bp, Artificial Sequence
  Synthetic Polynucleotide
taatacgactcactataggggcttctgctggacgcgtttatacctgcaagaacagaggagacttgcaatgataaacgcgaacctggcggcagcgcaaaagatg

SEQ ID NO: 153973 - DNA, 103 bp, Artificial Sequence
  Synthetic Polynucleotide
taatacgactcactatagggtccaggtggtgcttctgctggacgcgtttaaacagaggagataaacgatgccagcagaaaacctggcggcagcgcaaaagatg

SEQ ID NO: 153974 - DNA, 103 bp, Artificial Sequence
  Synthetic Polynucleotide
taatacgactcactatagggcttctcattctccaggtggtgcttctgctgaacagaggagacagcagatgcaccacctgaacctggcggcagcgcaaaagatg

SEQ ID NO: 153975 - DNA, 103 bp, Artificial Sequence
  Synthetic Polynucleotide
taatacgactcactatagggccttcttcacgtcgaacttgagcaggtcgaaacagaggagatcgaccatgtcaagttcgaacctggcggcagcgcaaaagatg

SEQ ID NO: 153976 - DNA, 103 bp, Artificial Sequence
  Synthetic Polynucleotide
taatacgactcactatagggtgagctgcgtcttctcattctccaggtggtaacagaggagaaccaccatgagaatgagaaacctggcggcagcgcaaaagatg

SEQ ID NO: 153977 - DNA, 103 bp, Artificial Sequence
  Synthetic Polynucleotide
taatacgactcactatagggacctgctgaatgagctgcgtcttctcattcaacagaggagagaatgaatggacgcagctaacctggcggcagcgcaaaagatg

SEQ ID NO: 153978 - DNA, 103 bp, Artificial Sequence
  Synthetic Polynucleotide
taatacgactcactatagggaagctgctccacctgctgaatgagctgcgtaacagaggagaacgcagatgattcagcagaacctggcggcagcgcaaaagatg

SEQ ID NO: 153979 - DNA, 103 bp, Artificial Sequence
  Synthetic Polynucleotide
taatacgactcactatagggcctcctgcttaagctgctccacctgctgaaaacagaggagattcagcatgtggagcagcaacctggcggcagcgcaaaagatg

SEQ ID NO: 153980 - DNA, 103 bp, Artificial Sequence
  Synthetic Polynucleotide
taatacgactcactatagggagccgggacacctcctgcttaagctgctccaacagaggagaggagcaatgtaagcaggaaacctggcggcagcgcaaaagatg

SEQ ID NO: 153981 - DNA, 103 bp, Artificial Sequence
  Synthetic Polynucleotide
taatacgactcactatagggctcgcgggccagccgggacacctcctgcttaacagaggagaaagcagatggtgtcccggaacctggcggcagcgcaaaagatg

SEQ ID NO: 153982 - DNA, 103 bp, Artificial Sequence
  Synthetic Polynucleotide
taatacgactcactatagggaggcgtctctctcgcgggccagccgggacaaacagaggagatgtcccatgtggcccgcgaacctggcggcagcgcaaaagatg

SEQ ID NO: 153983 - DNA, 103 bp, Artificial Sequence
  Synthetic Polynucleotide
taatacgactcactatagggttgaccttgtaggcgtctctctcgcgggccaacagaggagaggcccgatggagagacgcaacctggcggcagcgcaaaagatg

SEQ ID NO: 153984 - DNA, 103 bp, Artificial Sequence
  Synthetic Polynucleotide
taatacgactcactatagggtttctcgcacttgaccttgtaggcgtctctaacagaggagaagagacatgtacaaggtcaacctggcggcagcgcaaaagatg

SEQ ID NO: 153985 - DNA, 103 bp, Artificial Sequence
  Synthetic Polynucleotide
taatacgactcactatagggagttggcgagtttctcgcacttgaccttgtaacagaggagaacaaggatgagtgcgagaaacctggcggcagcgcaaaagatg

SEQ ID NO: 153986 - DNA, 103 bp, Artificial Sequence
  Synthetic Polynucleotide
taatacgactcactatagggcccagtggctccttcttcacgtcgaacttgaacagaggagacaagttatgcgtgaagaaaacctggcggcagcgcaaaagatg

SEQ ID NO: 153987 - DNA, 103 bp, Artificial Sequence
  Synthetic Polynucleotide
taatacgactcactatagggctgaagccggagttggcgagtttctcgcacaacagaggagagtgcgaatgactcgccaaaacctggcggcagcgcaaaagatg

SEQ ID NO: 153988 - DNA, 103 bp, Artificial Sequence
  Synthetic Polynucleotide
taatacgactcactataggggcccgcctccctgaagccggagttggcgagaacagaggagactcgccatgtccggcttcaacctggcggcagcgcaaaagatg

SEQ ID NO: 153989 - DNA, 103 bp, Artificial Sequence
  Synthetic Polynucleotide
taatacgactcactatagggcgctggtggagcccgcctccctgaagccggaacagaggagaccggctatggggaggcggaacctggcggcagcgcaaaagatg

SEQ ID NO: 153990 - DNA, 103 bp, Artificial Sequence
  Synthetic Polynucleotide
taatacgactcactataggggaggggctgtcgctggtggagcccgcctccaacagaggagaggaggcatgctccaccagaacctggcggcagcgcaaaagatg

SEQ ID NO: 153991 - DNA, 103 bp, Artificial Sequence
  Synthetic Polynucleotide
taatacgactcactatagggctcgggagaggaggggctgtcgctggtggaaacagaggagatccaccatggacagccccaacctggcggcagcgcaaaagatg

SEQ ID NO: 153992 - DNA, 103 bp, Artificial Sequence
  Synthetic Polynucleotide
taatacgactcactatagggacagaaagaactcgggagaggaggggctgtaacagaggagaacagccatgcctctcccgaacctggcggcagcgcaaaagatg

SEQ ID NO: 153993 - DNA, 103 bp, Artificial Sequence
  Synthetic Polynucleotide
taatacgactcactatagggagctttgctggataggggatccacagacataacagaggagaatgtctatggatcccctaaacctggcggcagcgcaaaagatg

SEQ ID NO: 153994 - DNA, 103 bp, Artificial Sequence
  Synthetic Polynucleotide
taatacgactcactatagggatgccggttcagctcgcgcaccgacagcccaacagaggagagggctgatggtgcgcgagaacctggcggcagcgcaaaagatg

SEQ ID NO: 153995 - DNA, 103 bp, Artificial Sequence
  Synthetic Polynucleotide
taatacgactcactataggggcccgcgcagatgccggttcagctcgcgcaaacagaggagatgcgcgatgtgaaccggcaacctggcggcagcgcaaaagatg

SEQ ID NO: 153996 - DNA, 103 bp, Artificial Sequence
  Synthetic Polynucleotide
taatacgactcactatagggtcggcggagagcccgcgcagatgccggttcaacagaggagagaaccgatgtctgcgcggaacctggcggcagcgcaaaagatg

SEQ ID NO: 153997 - DNA, 103 bp, Artificial Sequence
  Synthetic Polynucleotide
taatacgactcactatagggtgtcacctcctcggcggagagcccgcgcagaacagaggagactgcgcatgctctccgccaacctggcggcagcgcaaaagatg

SEQ ID NO: 153998 - DNA, 103 bp, Artificial Sequence
  Synthetic Polynucleotide
taatacgactcactataggggcttgagccgtgtcacctcctcggcggagaaacagaggagatctccgatgaggaggtgaaacctggcggcagcgcaaaagatg

SEQ ID NO: 153999 - DNA, 103 bp, Artificial Sequence
  Synthetic Polynucleotide
taatacgactcactatagggcggcgccgctgcttgagccgtgtcacctccaacagaggagaggaggtatgacggctcaaaacctggcggcagcgcaaaagatg

SEQ ID NO: 154000 - DNA, 103 bp, Artificial Sequence
  Synthetic Polynucleotide
taatacgactcactatagggtttgagtgtgcggcgccgctgcttgagccgaacagaggagacggctcatgcagcggcgcaacctggcggcagcgcaaaagatg

SEQ ID NO: 154001 - DNA, 103 bp, Artificial Sequence
  Synthetic Polynucleotide
taatacgactcactatagggagccacggtttttgagtgtgcggcgccgctaacagaggagaagcggcatggcacactcaaacctggcggcagcgcaaaagatg

SEQ ID NO: 154002 - DNA, 103 bp, Artificial Sequence
  Synthetic Polynucleotide
taatacgactcactatagggctggcggcgtagccacggtttttgagtgtgaacagaggagacacactatgaaaccgtggaacctggcggcagcgcaaaagatg

SEQ ID NO: 154003 - DNA, 103 bp, Artificial Sequence
  Synthetic Polynucleotide
taatacgactcactatagggcacgcggcagctggcggcgtagccacggttaacagaggagaaaccgtatgtacgccgccaacctggcggcagcgcaaaagatg

SEQ ID NO: 154004 - DNA, 103 bp, Artificial Sequence
  Synthetic Polynucleotide
taatacgactcactatagggtgatctttagagctttgctggataggggataacagaggagaatccccatgccagcaaagaacctggcggcagcgcaaaagatg

SEQ ID NO: 154005 - DNA, 103 bp, Artificial Sequence
  Synthetic Polynucleotide
taatacgactcactatagggacacgcgcttcacgcggcagctggcggcgtaacagaggagaacgccgatggctgccgcgaacctggcggcagcgcaaaagatg

SEQ ID NO: 154006 - DNA, 103 bp, Artificial Sequence
  Synthetic Polynucleotide
taatacgactcactatagggtccttctggcacacgcgcttcacgcggcagaacagaggagactgccgatggaagcgcgtaacctggcggcagcgcaaaagatg

SEQ ID NO: 154007 - DNA, 103 bp, Artificial Sequence
  Synthetic Polynucleotide
taatacgactcactatagggctgcagctcctccttctggcacacgcgcttaacagaggagaaagcgcatgtgccagaagaacctggcggcagcgcaaaagatg

SEQ ID NO: 154008 - DNA, 103 bp, Artificial Sequence
  Synthetic Polynucleotide
taatacgactcactatagggacttctgcttctgcagctcctccttctggcaacagaggagagccagaatgaggagctgcaacctggcggcagcgcaaaagatg

SEQ ID NO: 154009 - DNA, 103 bp, Artificial Sequence
  Synthetic Polynucleotide
taatacgactcactatagggtccagctccgacttctgcttctgcagctccaacagaggagaggagctatggaagcagaaaacctggcggcagcgcaaaagatg

SEQ ID NO: 154010 - DNA, 103 bp, Artificial Sequence
  Synthetic Polynucleotide
taatacgactcactatagggcacctcgcgctccagctccgacttctgcttaacagaggagaaagcagatgtcggagctgaacctggcggcagcgcaaaagatg

SEQ ID NO: 154011 - DNA, 103 bp, Artificial Sequence
  Synthetic Polynucleotide
taatacgactcactatagggccagcttgtccacctcgcgctccagctccgaacagaggagacggagcatgagcgcgaggaacctggcggcagcgcaaaagatg

SEQ ID NO: 154012 - DNA, 103 bp, Artificial Sequence
  Synthetic Polynucleotide
taatacgactcactatagggttctcgcgcgccagcttgtccacctcgcgcaacagaggagagcgcgaatgggacaagctaacctggcggcagcgcaaaagatg

SEQ ID NO: 154013 - DNA, 103 bp, Artificial Sequence
  Synthetic Polynucleotide
taatacgactcactatagggcatggcggcgttctcgcgcgccagcttgtcaacagaggagagacaagatggcgcgcgagaacctggcggcagcgcaaaagatg

SEQ ID NO: 154014 - DNA, 103 bp, Artificial Sequence
  Synthetic Polynucleotide
taatacgactcactataggggctccaggcgcatggcggcgttctcgcgcgaacagaggagacgcgcgatgacgccgccaaacctggcggcagcgcaaaagatg

SEQ ID NO: 154015 - DNA, 103 bp, Artificial Sequence
  Synthetic Polynucleotide
taatacgactcactatagggagctctcgcttgatctttagagctttgctgaacagaggagacagcaaatgtctaaagataacctggcggcagcgcaaaagatg

SEQ ID NO: 154016 - DNA, 103 bp, Artificial Sequence
  Synthetic Polynucleotide
taatacgactcactatagggagcgcgtcgagctccaggcgcatggcggcgaacagaggagacgccgcatggcgcctggaaacctggcggcagcgcaaaagatg

SEQ ID NO: 154017 - DNA, 103 bp, Artificial Sequence
  Synthetic Polynucleotide
taatacgactcactatagggcttgccgcgcagcgcgtcgagctccaggcgaacagaggagacgcctgatgctcgacgcgaacctggcggcagcgcaaaagatg

SEQ ID NO: 154018 - DNA, 103 bp, Artificial Sequence
  Synthetic Polynucleotide
taatacgactcactataggggcgcctcgcacttgccgcgcagcgcgtcgaaacagaggagatcgacgatgtgcgcggcaaacctggcggcagcgcaaaagatg

SEQ ID NO: 154019 - DNA, 103 bp, Artificial Sequence
  Synthetic Polynucleotide
taatacgactcactatagggaagccctgcagcgcctcgcacttgccgcgcaacagaggagagcgcggatggtgcgaggcaacctggcggcagcgcaaaagatg

SEQ ID NO: 154020 - DNA, 103 bp, Artificial Sequence
  Synthetic Polynucleotide
taatacgactcactatagggggagcgcgcgaagccctgcagcgcctcgcaaacagaggagatgcgagatgctgcagggcaacctggcggcagcgcaaaagatg

SEQ ID NO: 154021 - DNA, 103 bp, Artificial Sequence
  Synthetic Polynucleotide
taatacgactcactatagggcggcggccacggagcgcgcgaagccctgcaaacagaggagatgcaggatgtcgcgcgctaacctggcggcagcgcaaaagatg

SEQ ID NO: 154022 - DNA, 103 bp, Artificial Sequence
  Synthetic Polynucleotide
taatacgactcactatagggggcccgcgggcggcggccacggagcgcgcgaacagaggagacgcgcgatgcgtggccgcaacctggcggcagcgcaaaagatg

SEQ ID NO: 154023 - DNA, 103 bp, Artificial Sequence
  Synthetic Polynucleotide
taatacgactcactataggggagcgtggcgggcccgcgggcggcggccacaacagaggagagtggccatggcccgcgggaacctggcggcagcgcaaaagatg

SEQ ID NO: 154024 - DNA, 103 bp, Artificial Sequence
  Synthetic Polynucleotide
taatacgactcactatagggccggcgccacgagcgtggcgggcccgcgggaacagaggagacccgcgatgccgccacgcaacctggcggcagcgcaaaagatg

SEQ ID NO: 154025 - DNA, 103 bp, Artificial Sequence
  Synthetic Polynucleotide
taatacgactcactatagggatgacgctggccggcgccacgagcgtggcgaacagaggagacgccacatgcgtggcgccaacctggcggcagcgcaaaagatg

SEQ ID NO: 154026 - DNA, 103 bp, Artificial Sequence
  Synthetic Polynucleotide
taatacgactcactataggggttctcgctcagctctcgcttgatctttagaacagaggagactaaagatgaagcgagagaacctggcggcagcgcaaaagatg

SEQ ID NO: 154027 - DNA, 103 bp, Artificial Sequence
  Synthetic Polynucleotide
taatacgactcactataggggacgatggtgatgacgctggccggcgccacaacagaggagagtggcgatggccagcgtcaacctggcggcagcgcaaaagatg

SEQ ID NO: 154028 - DNA, 103 bp, Artificial Sequence
  Synthetic Polynucleotide
taatacgactcactataggggggtggacttgacgatggtgatgacgctggaacagaggagaccagcgatgtcaccatcgaacctggcggcagcgcaaaagatg

SEQ ID NO: 154029 - DNA, 103 bp, Artificial Sequence
  Synthetic Polynucleotide
taatacgactcactatagggcccgagcccggggtggacttgacgatggtgaacagaggagacaccatatgcaagtccacaacctggcggcagcgcaaaagatg

SEQ ID NO: 154030 - DNA, 103 bp, Artificial Sequence
  Synthetic Polynucleotide
taatacgactcactatagggggggccagaccccgagcccggggtggacttaacagaggagaaagtccatgccgggctcgaacctggcggcagcgcaaaagatg

SEQ ID NO: 154031 - DNA, 103 bp, Artificial Sequence
  Synthetic Polynucleotide
taatacgactcactatagggggccgtgggcggggccagaccccgagcccgaacagaggagacgggctatgggtctggccaacctggcggcagcgcaaaagatg

SEQ ID NO: 154032 - DNA, 103 bp, Artificial Sequence
  Synthetic Polynucleotide
taatacgactcactataggggcggggtccgggccgtgggcggggccagacaacagaggagagtctggatgcgcccacggaacctggcggcagcgcaaaagatg

SEQ ID NO: 154033 - DNA, 103 bp, Artificial Sequence
  Synthetic Polynucleotide
taatacgactcactatagggcgggccgtgggcggggtccgggccgtgggcaacagaggagagcccacatgccggaccccaacctggcggcagcgcaaaagatg

SEQ ID NO: 154034 - DNA, 103 bp, Artificial Sequence
  Synthetic Polynucleotide
taatacgactcactatagggagcaggaggccgggccgtgggcggggtccgaacagaggagacggaccatgcccacggccaacctggcggcagcgcaaaagatg

SEQ ID NO: 154035 - DNA, 103 bp, Artificial Sequence
  Synthetic Polynucleotide
taatacgactcactatagggggtgcggcgtgttctcgctcagctctcgctaacagaggagaagcgagatgtgagcgagaaacctggcggcagcgcaaaagatg

SEQ ID NO: 154036 - DNA, 103 bp, Artificial Sequence
  Synthetic Polynucleotide
taatacgactcactatagggtcgtccgacaggtgcggcgtgttctcgctcaacagaggagagagcgaatgcacgccgcaaacctggcggcagcgcaaaagatg

SEQ ID NO: 154037 - DNA, 103 bp, Artificial Sequence
  Synthetic Polynucleotide
taatacgactcactatagggcatcagcgcctcgtccgacaggtgcggcgtaacagaggagaacgccgatgctgtcggacaacctggcggcagcgcaaaagatg

SEQ ID NO: 154038 - DNA, 103 bp, Artificial Sequence
  Synthetic Polynucleotide
taatacgactcactatagggccgacagccccatcagcgcctcgtccgacaaacagaggagatgtcggatgaggcgctgaaacctggcggcagcgcaaaagatg

SEQ ID NO: 154039 - DNA, 103 bp, Artificial Sequence
  Synthetic Polynucleotide
taatacgactcactatagggagctcgcgcaccgacagccccatcagcgccaacagaggagaggcgctatgggggctgtcaacctggcggcagcgcaaaagatg

SEQ ID NO: 154040 - DNA, 103 bp, Artificial Sequence
  Synthetic Polynucleotide
taatacgactcactatagggggccttgtttcctttattgggggtcgtcataacagaggagaatgacgatgcccaataaaaacctggcggcagcgcaaaagatg

SEQ ID NO: 154041 - DNA, 103 bp, Artificial Sequence
  Synthetic Polynucleotide
taatacgactcactataggggtgctggttcagctcccgcaccgacatggtaacagaggagaaccatgatggtgcgggagaacctggcggcagcgcaaaagatg

SEQ ID NO: 154042 - DNA, 103 bp, Artificial Sequence
  Synthetic Polynucleotide
taatacgactcactatagggggccccgcaggtgctggttcagctcccgcaaacagaggagatgcgggatgtgaaccagcaacctggcggcagcgcaaaagatg

SEQ ID NO: 154043 - DNA, 103 bp, Artificial Sequence
  Synthetic Polynucleotide
taatacgactcactatagggtccttggacaggccccgcaggtgctggttcaacagaggagagaaccaatgcctgcggggaacctggcggcagcgcaaaagatg

SEQ ID NO: 154044 - DNA, 103 bp, Artificial Sequence
  Synthetic Polynucleotide
taatacgactcactataggggacgatctcctccttggacaggccccgcagaacagaggagactgcggatgctgtccaagaacctggcggcagcgcaaaagatg

SEQ ID NO: 154045 - DNA, 103 bp, Artificial Sequence
  Synthetic Polynucleotide
taatacgactcactataggggcttcagctggacgatctcctccttggacaaacagaggagatgtccaatgaggagatcgaacctggcggcagcgcaaaagatg

SEQ ID NO: 154046 - DNA, 103 bp, Artificial Sequence
  Synthetic Polynucleotide
taatacgactcactatagggcgccggcgctgcttcagctggacgatctccaacagaggagaggagatatgccagctgaaaacctggcggcagcgcaaaagatg

SEQ ID NO: 154047 - DNA, 103 bp, Artificial Sequence
  Synthetic Polynucleotide
taatacgactcactatagggcttgagcgtgcgccggcgctgcttcagctgaacagaggagacagctgatgcagcgccggaacctggcggcagcgcaaaagatg

SEQ ID NO: 154048 - DNA, 103 bp, Artificial Sequence
  Synthetic Polynucleotide
taatacgactcactatagggagccgcggttcttgagcgtgcgccggcgctaacagaggagaagcgccatggcacgctcaaacctggcggcagcgcaaaagatg

SEQ ID NO: 154049 - DNA, 103 bp, Artificial Sequence
  Synthetic Polynucleotide
taatacgactcactatagggctggcagcgtagccgcggttcttgagcgtgaacagaggagacacgctatggaaccgcggaacctggcggcagcgcaaaagatg

SEQ ID NO: 154050 - DNA, 103 bp, Artificial Sequence
  Synthetic Polynucleotide
taatacgactcactatagggcacgcggcagctggcagcgtagccgcggttaacagaggagaaaccgcatgtacgctgccaacctggcggcagcgcaaaagatg

SEQ ID NO: 154051 - DNA, 103 bp, Artificial Sequence
  Synthetic Polynucleotide
taatacgactcactatagggtcaccttcaaggccttgtttcctttattggaacagaggagaccaataatggaaacaaggaacctggcggcagcgcaaaagatg

SEQ ID NO: 154052 - DNA, 103 bp, Artificial Sequence
  Synthetic Polynucleotide
taatacgactcactatagggtcacccgcttcacgcggcagctggcagcgtaacagaggagaacgctgatggctgccgcgaacctggcggcagcgcaaaagatg

SEQ ID NO: 154053 - DNA, 103 bp, Artificial Sequence
  Synthetic Polynucleotide
taatacgactcactatagggtccttctgcgtcacccgcttcacgcggcagaacagaggagactgccgatggaagcgggtaacctggcggcagcgcaaaagatg

SEQ ID NO: 154054 - DNA, 103 bp, Artificial Sequence
  Synthetic Polynucleotide
taatacgactcactatagggctccagctcctccttctgcgtcacccgcttaacagaggagaaagcggatgacgcagaagaacctggcggcagcgcaaaagatg

SEQ ID NO: 154055 - DNA, 103 bp, Artificial Sequence
  Synthetic Polynucleotide
taatacgactcactatagggccttctgcttctccagctcctccttctgcgaacagaggagacgcagaatgaggagctggaacctggcggcagcgcaaaagatg

SEQ ID NO: 154056 - DNA, 103 bp, Artificial Sequence
  Synthetic Polynucleotide
taatacgactcactatagggtgcagctccgccttctgcttctccagctccaacagaggagaggagctatggaagcagaaaacctggcggcagcgcaaaagatg

SEQ ID NO: 154057 - DNA, 103 bp, Artificial Sequence
  Synthetic Polynucleotide
taatacgactcactatagggcacctcctgctgcagctccgccttctgcttaacagaggagaaagcagatggcggagctgaacctggcggcagcgcaaaagatg

SEQ ID NO: 154058 - DNA, 103 bp, Artificial Sequence
  Synthetic Polynucleotide
taatacgactcactatagggccagcttctccacctcctgctgcagctccgaacagaggagacggagcatgagcaggaggaacctggcggcagcgcaaaagatg

SEQ ID NO: 154059 - DNA, 103 bp, Artificial Sequence
  Synthetic Polynucleotide
taatacgactcactatagggttctctgaggccagcttctccacctcctgcaacagaggagagcaggaatgggagaagctaacctggcggcagcgcaaaagatg

SEQ ID NO: 154060 - DNA, 103 bp, Artificial Sequence
  Synthetic Polynucleotide
taatacgactcactatagggcatgctggcgttctctgaggccagcttctcaacagaggagagagaagatggcctcagagaacctggcggcagcgcaaaagatg

SEQ ID NO: 154061 - DNA, 103 bp, Artificial Sequence
  Synthetic Polynucleotide
taatacgactcactataggggctccagcttcatgctggcgttctctgaggaacagaggagacctcagatgacgccagcaaacctggcggcagcgcaaaagatg

SEQ ID NO: 154062 - DNA, 103 bp, Artificial Sequence
  Synthetic Polynucleotide
taatacgactcactatagggggctcccgcttcaccttcaaggccttgtttaacagaggagaaaacaaatgcttgaaggtaacctggcggcagcgcaaaagatg

SEQ ID NO: 154063 - DNA, 103 bp, Artificial Sequence
  Synthetic Polynucleotide
taatacgactcactatagggagcgcgtcgagctccagcttcatgctggcgaacagaggagacgccagatggaagctggaaacctggcggcagcgcaaaagatg

SEQ ID NO: 154064 - DNA, 103 bp, Artificial Sequence
  Synthetic Polynucleotide
taatacgactcactatagggcttggagcgcagcgcgtcgagctccagcttaacagaggagaaagctgatgctcgacgcgaacctggcggcagcgcaaaagatg

SEQ ID NO: 154065 - DNA, 103 bp, Artificial Sequence
  Synthetic Polynucleotide
taatacgactcactataggggcgcctcgtacttggagcgcagcgcgtcgaaacagaggagatcgacgatgtgcgctccaaacctggcggcagcgcaaaagatg

SEQ ID NO: 154066 - DNA, 103 bp, Artificial Sequence
  Synthetic Polynucleotide
taatacgactcactatagggaaggtctgcagcgcctcgtacttggagcgcaacagaggagagcgctcatggtacgaggcaacctggcggcagcgcaaaagatg

SEQ ID NO: 154067 - DNA, 103 bp, Artificial Sequence
  Synthetic Polynucleotide
taatacgactcactatagggcgtccgggcgaaggtctgcagcgcctcgtaaacagaggagatacgagatgctgcagaccaacctggcggcagcgcaaaagatg

SEQ ID NO: 154068 - DNA, 103 bp, Artificial Sequence
  Synthetic Polynucleotide
taatacgactcactatagggtgcgggccaccgtccgggcgaaggtctgcaaacagaggagatgcagaatgtcgcccggaaacctggcggcagcgcaaaagatg

SEQ ID NO: 154069 - DNA, 103 bp, Artificial Sequence
  Synthetic Polynucleotide
taatacgactcactataggggccacggggctgcgggccaccgtccgggcgaacagaggagacgcccgatgggtggcccgaacctggcggcagcgcaaaagatg

SEQ ID NO: 154070 - DNA, 103 bp, Artificial Sequence
  Synthetic Polynucleotide
taatacgactcactatagggccgggctggcgccacggggctgcgggccacaacagaggagagtggccatgagccccgtgaacctggcggcagcgcaaaagatg

SEQ ID NO: 154071 - DNA, 103 bp, Artificial Sequence
  Synthetic Polynucleotide
taatacgactcactatagggcaagggggccccgggctggcgccacggggcaacagaggagagccccgatgcgccagcccaacctggcggcagcgcaaaagatg

SEQ ID NO: 154072 - DNA, 103 bp, Artificial Sequence
  Synthetic Polynucleotide
taatacgactcactatagggaggccggcggcaagggggccccgggctggcaacagaggagagccagcatggggccccctaacctggcggcagcgcaaaagatg

SEQ ID NO: 154073 - DNA, 103 bp, Artificial Sequence
  Synthetic Polynucleotide
taatacgactcactatagggattctcacccggctcccgcttcaccttcaaaacagaggagattgaagatgaagcgggagaacctggcggcagcgcaaaagatg

SEQ ID NO: 154074 - DNA, 103 bp, Artificial Sequence
  Synthetic Polynucleotide
taatacgactcactataggggaggggccccaggccggcggcaagggggccaacagaggagaggccccatggccgccggcaacctggcggcagcgcaaaagatg

SEQ ID NO: 154075 - DNA, 103 bp, Artificial Sequence
  Synthetic Polynucleotide
taatacgactcactatagggtgcctgggacgaggggccccaggccggcggaacagaggagaccgccgatgtggggccccaacctggcggcagcgcaaaagatg

SEQ ID NO: 154076 - DNA, 103 bp, Artificial Sequence
  Synthetic Polynucleotide
taatacgactcactataggggcggccaccttgcctgggacgaggggccccaacagaggagaggggccatgcgtcccaggaacctggcggcagcgcaaaagatg

SEQ ID NO: 154077 - DNA, 103 bp, Artificial Sequence
  Synthetic Polynucleotide
taatacgactcactataggggacgctggtggcggccaccttgcctgggacaacagaggagagtcccaatgaaggtggccaacctggcggcagcgcaaaagatg

SEQ ID NO: 154078 - DNA, 103 bp, Artificial Sequence
  Synthetic Polynucleotide
taatacgactcactatagggctattgtgatgacgctggtggcggccacctaacagaggagaaggtggatgccaccagcgaacctggcggcagcgcaaaagatg

SEQ ID NO: 154079 - DNA, 103 bp, Artificial Sequence
  Synthetic Polynucleotide
taatacgactcactatagggttggactttactattgtgatgacgctggtgaacagaggagacaccagatgcatcacaataacctggcggcagcgcaaaagatg

SEQ ID NO: 154080 - DNA, 103 bp, Artificial Sequence
  Synthetic Polynucleotide
taatacgactcactatagggggcatccgtcttggactttactattgtgataacagaggagaatcacaatggtaaagtccaacctggcggcagcgcaaaagatg

SEQ ID NO: 154081 - DNA, 103 bp, Artificial Sequence
  Synthetic Polynucleotide
taatacgactcactatagggggctggtgccattctcacccggctcccgctaacagaggagaagcgggatgcgggtgagaaacctggcggcagcgcaaaagatg

SEQ ID NO: 154082 - DNA, 103 bp, Artificial Sequence
  Synthetic Polynucleotide
taatacgactcactatagggtcatccgtcaggctggtgccattctcacccaacagaggagagggtgaatgtggcaccagaacctggcggcagcgcaaaagatg

SEQ ID NO: 154083 - DNA, 103 bp, Artificial Sequence
  Synthetic Polynucleotide
taatacgactcactatagggcaccagctcctcatccgtcaggctggtgccaacagaggagaggcaccatgctgacggataacctggcggcagcgcaaaagatg

SEQ ID NO: 154084 - DNA, 103 bp, Artificial Sequence
  Synthetic Polynucleotide
taatacgactcactatagggccgacatggtcaccagctcctcatccgtcaaacagaggagatgacggatgaggagctggaacctggcggcagcgcaaaagatg

SEQ ID NO: 154085 - DNA, 103 bp, Artificial Sequence
  Synthetic Polynucleotide
taatacgactcactatagggagctcccgcaccgacatggtcaccagctccaacagaggagaggagctatggaccatgtcaacctggcggcagcgcaaaagatg

SEQ ID NO: 154086 - DNA, 103 bp, Artificial Sequence
  Synthetic Polynucleotide
taatacgactcactatagggtgccttattcggtttgggattagtcgtcataacagaggagaatgacgatgaatcccaaaaacctggcggcagcgcaaaagatg

SEQ ID NO: 154087 - DNA, 103 bp, Artificial Sequence
  Synthetic Polynucleotide
taatacgactcactataggggtgctggttcagctcccgcaccgacatggaaacagaggagatccatgatggtgcgggagaacctggcggcagcgcaaaagatg

SEQ ID NO: 154088 - DNA, 103 bp, Artificial Sequence
  Synthetic Polynucleotide
taatacgactcactataggggaccccgcaggtgctggttcagctcccgcaaacagaggagatgcgggatgtgaaccagcaacctggcggcagcgcaaaagatg

SEQ ID NO: 154089 - DNA, 103 bp, Artificial Sequence
  Synthetic Polynucleotide
taatacgactcactatagggtccttggtgagaccccgcaggtgctggttcaacagaggagagaaccaatgcctgcggggaacctggcggcagcgcaaaagatg

SEQ ID NO: 154090 - DNA, 103 bp, Artificial Sequence
  Synthetic Polynucleotide
taatacgactcactatagggggtcacctcctccttggtgagaccccgcagaacagaggagactgcggatgctcaccaagaacctggcggcagcgcaaaagatg

SEQ ID NO: 154091 - DNA, 103 bp, Artificial Sequence
  Synthetic Polynucleotide
taatacgactcactataggggcttcaggcgggtcacctcctccttggtgaaacagaggagatcaccaatgaggaggtgaaacctggcggcagcgcaaaagatg

SEQ ID NO: 154092 - DNA, 103 bp, Artificial Sequence
  Synthetic Polynucleotide
taatacgactcactatagggcgccgacgctgcttcaggcgggtcacctccaacagaggagaggaggtatgccgcctgaaaacctggcggcagcgcaaaagatg

SEQ ID NO: 154093 - DNA, 103 bp, Artificial Sequence
  Synthetic Polynucleotide
taatacgactcactatagggcttgagtgtgcgccgacgctgcttcaggcgaacagaggagacgcctgatgcagcgtcggaacctggcggcagcgcaaaagatg

SEQ ID NO: 154094 - DNA, 103 bp, Artificial Sequence
  Synthetic Polynucleotide
taatacgactcactatagggagccgcggttcttgagtgtgcgccgacgctaacagaggagaagcgtcatggcacactcaaacctggcggcagcgcaaaagatg

SEQ ID NO: 154095 - DNA, 103 bp, Artificial Sequence
  Synthetic Polynucleotide
taatacgactcactatagggctggccgcgtagccgcggttcttgagtgtgaacagaggagacacactatggaaccgcggaacctggcggcagcgcaaaagatg

SEQ ID NO: 154096 - DNA, 103 bp, Artificial Sequence
  Synthetic Polynucleotide
taatacgactcactataggggatgcggcagctggccgcgtagccgcggttaacagaggagaaaccgcatgtacgcggccaacctggcggcagcgcaaaagatg

SEQ ID NO: 154097 - DNA, 103 bp, Artificial Sequence
  Synthetic Polynucleotide
taatacgactcactatagggtgacctttaatgccttattcggtttgggataacagaggagaatcccaatgcgaataaggaacctggcggcagcgcaaaagatg

SEQ ID NO: 154098 - DNA, 103 bp, Artificial Sequence
  Synthetic Polynucleotide
taatacgactcactatagggtcacccgcttgatgcggcagctggccgcgtaacagaggagaacgcggatggctgccgcaaacctggcggcagcgcaaaagatg

SEQ ID NO: 154099 - DNA, 103 bp, Artificial Sequence
  Synthetic Polynucleotide
taatacgactcactatagggtccttctgcgtcacccgcttgatgcggcagaacagaggagactgccgatgcaagcgggtaacctggcggcagcgcaaaagatg

SEQ ID NO: 154100 - DNA, 103 bp, Artificial Sequence; identical to SEQ ID NO: 154054
  Synthetic Polynucleotide

SEQ ID NO: 154101 - DNA, 103 bp, Artificial Sequence
  Synthetic Polynucleotide
taatacgactcactatagggcgcgctgccgctccagctcctccttctgcgaacagaggagacgcagaatgaggagctggaacctggcggcagcgcaaaagatg

SEQ ID NO: 154102 - DNA, 103 bp, Artificial Sequence
  Synthetic Polynucleotide
taatacgactcactatagggtgcagctccacgcgctgccgctccagctccaacagaggagaggagctatggcggcagcgaacctggcggcagcgcaaaagatg

SEQ ID NO: 154103 - DNA, 103 bp, Artificial Sequence
  Synthetic Polynucleotide
taatacgactcactatagggcacctcctgctgcagctccacgcgctgccgaacagaggagacggcagatggtggagctgaacctggcggcagcgcaaaagatg

SEQ ID NO: 154104 - DNA, 103 bp, Artificial Sequence
  Synthetic Polynucleotide
taatacgactcactatagggccagcttctccacctcctgctgcagctccaaacagaggagatggagcatgagcaggaggaacctggcggcagcgcaaaagatg

SEQ ID NO: 154105 - DNA, 103 bp, Artificial Sequence
  Synthetic Polynucleotide
taatacgactcactatagggttctcacgcgccagcttctccacctcctgcaacagaggagagcaggaatgggagaagctaacctggcggcagcgcaaaagatg

SEQ ID NO: 154106 - DNA, 103 bp, Artificial Sequence
  Synthetic Polynucleotide
taatacgactcactatagggcatgctgctgttctcacgcgccagcttctcaacagaggagagagaagatggcgcgtgagaacctggcggcagcgcaaaagatg

SEQ ID NO: 154107 - DNA, 103 bp, Artificial Sequence
  Synthetic Polynucleotide
taatacgactcactataggggctccagccgcatgctgctgttctcacgcgaacagaggagacgcgtgatgacagcagcaaacctggcggcagcgcaaaagatg

SEQ ID NO: 154108 - DNA, 103 bp, Artificial Sequence
  Synthetic Polynucleotide
taatacgactcactataggggcctccttcttgacctttaatgccttattcaacagaggagagaataaatgattaaaggtaacctggcggcagcgcaaaagatg

SEQ ID NO: 154109 - DNA, 103 bp, Artificial Sequence
  Synthetic Polynucleotide
taatacgactcactatagggagggcgtccagctccagccgcatgctgctgaacagaggagacagcagatggcggctggaaacctggcggcagcgcaaaagatg

SEQ ID NO: 154110 - DNA, 103 bp, Artificial Sequence
  Synthetic Polynucleotide
taatacgactcactatagggcttggagcgcagggcgtccagctccagccgaacagaggagacggctgatgctggacgccaacctggcggcagcgcaaaagatg

SEQ ID NO: 154111 - DNA, 103 bp, Artificial Sequence
  Synthetic Polynucleotide
taatacgactcactataggggcgcctcgtacttggagcgcagggcgtccaaacagaggagatggacgatgtgcgctccaaacctggcggcagcgcaaaagatg

SEQ ID NO: 154112 - DNA, 103 bp, Artificial Sequence; identical to SEQ ID NO: 154066
  Synthetic Polynucleotide

SEQ ID NO: 154113 - DNA, 103 bp, Artificial Sequence
  Synthetic Polynucleotide
taatacgactcactatagggggtgcgcgcgaaggtctgcagcgcctcgtaaacagaggagatacgagatgctgcagaccaacctggcggcagcgcaaaagatg

SEQ ID NO: 154114 - DNA, 103 bp, Artificial Sequence
  Synthetic Polynucleotide
taatacgactcactatagggcccgggccacggtgcgcgcgaaggtctgcaaacagaggagatgcagaatgtcgcgcgcaaacctggcggcagcgcaaaagatg

SEQ ID NO: 154115 - DNA, 103 bp, Artificial Sequence
  Synthetic Polynucleotide
taatacgactcactataggggccacaggtccccgggccacggtgcgcgcgaacagaggagacgcgcgatgcgtggcccgaacctggcggcagcgcaaaagatg

SEQ ID NO: 154116 - DNA, 103 bp, Artificial Sequence
  Synthetic Polynucleotide
taatacgactcactatagggcttggagggcgccacaggtccccgggccacaacagaggagagtggccatgggacctgtgaacctggcggcagcgcaaaagatg

SEQ ID NO: 154117 - DNA, 103 bp, Artificial Sequence
  Synthetic Polynucleotide
taatacgactcactatagggtggtggccaccttggagggcgccacaggtcaacagaggagagacctgatgcgccctccaaacctggcggcagcgcaaaagatg

SEQ ID NO: 154118 - DNA, 103 bp, Artificial Sequence
  Synthetic Polynucleotide
taatacgactcactatagggatgacgctggtggtggccaccttggagggcaacagaggagagccctcatgggtggccacaacctggcggcagcgcaaaagatg

SEQ ID NO: 154119 - DNA, 103 bp, Artificial Sequence
  Synthetic Polynucleotide
taatacgactcactataggggttctcgcccgcctccttcttgacctttaaaacagaggagattaaagatgaagaaggagaacctggcggcagcgcaaaagatg

SEQ ID NO: 154120 - DNA, 103 bp, Artificial Sequence
  Synthetic Polynucleotide
taatacgactcactataggggacgatggtgatgacgctggtggtggccacaacagaggagagtggccatgaccagcgtcaacctggcggcagcgcaaaagatg

SEQ ID NO: 154121 - DNA, 103 bp, Artificial Sequence
  Synthetic Polynucleotide
taatacgactcactatagggcggtggacttgacgatggtgatgacgctggaacagaggagaccagcgatgtcaccatcgaacctggcggcagcgcaaaagatg

SEQ ID NO: 154122 - DNA, 103 bp, Artificial Sequence
  Synthetic Polynucleotide
taatacgactcactataggggaggagagctcggtggacttgacgatggtgaacagaggagacaccatatgcaagtccacaacctggcggcagcgcaaaagatg

SEQ ID NO: 154123 - DNA, 103 bp, Artificial Sequence
  Synthetic Polynucleotide
taatacgactcactatagggcacggaggtggaggagagctcggtggacttaacagaggagaaagtccatggagctctccaacctggcggcagcgcaaaagatg

SEQ ID NO: 154124 - DNA, 103 bp, Artificial Sequence
  Synthetic Polynucleotide
taatacgactcactatagggccgagaagggcacggaggtggaggagagctaacagaggagaagctctatgccacctccgaacctggcggcagcgcaaaagatg

SEQ ID NO: 154125 - DNA, 103 bp, Artificial Sequence
  Synthetic Polynucleotide
taatacgactcactatagggtaggatgcagccgagaagggcacggaggtgaacagaggagacacctcatggcccttctcaacctggcggcagcgcaaaagatg

SEQ ID NO: 154126 - DNA, 103 bp, Artificial Sequence
  Synthetic Polynucleotide
taatacgactcactataggggcaccggggcgttctcgcccgcctccttctaacagaggagaagaaggatgcgggcgagaaacctggcggcagcgcaaaagatg

SEQ ID NO: 154127 - DNA, 103 bp, Artificial Sequence
  Synthetic Polynucleotide
taatacgactcactatagggtcatcgctgagcaccggggcgttctcgcccaacagaggagagggcgaatgcgccccggtaacctggcggcagcgcaaaagatg

SEQ ID NO: 154128 - DNA, 103 bp, Artificial Sequence
  Synthetic Polynucleotide
taatacgactcactatagggcaccagctcatcatcgctgagcaccggggcaacagaggagagccccgatgctcagcgataacctggcggcagcgcaaaagatg

SEQ ID NO: 154129 - DNA, 103 bp, Artificial Sequence
  Synthetic Polynucleotide
taatacgactcactatagggccgacatggacaccagctcatcatcgctgaaacagaggagatcagcgatgatgagctggaacctggcggcagcgcaaaagatg

SEQ ID NO: 154130 - DNA, 103 bp, Artificial Sequence
  Synthetic Polynucleotide
taatacgactcactatagggagctcccgcaccgacatggacaccagctcaaacagaggagatgagctatggtccatgtcaacctggcggcagcgcaaaagatg

SEQ ID NO: 154131 - DNA, 103 bp, Artificial Sequence
  Synthetic Polynucleotide
taatacgactcactatagggctccacctcgatgtcatcgttatcgctcataacagaggagaatgagcatgaacgatgacaacctggcggcagcgcaaaagatg

SEQ ID NO: 154132 - DNA, 103 bp, Artificial Sequence
  Synthetic Polynucleotide
taatacgactcactatagggtttgatgtggtccctacgttttcgttccagaacagaggagactggaaatgaaacgtaggaacctggcggcagcgcaaaagatg

SEQ ID NO: 154133 - DNA, 103 bp, Artificial Sequence
  Synthetic Polynucleotide
taatacgactcactataggggaaagctgtctttgatgtggtccctacgttaacagaggagaaacgtaatgaccacatcaaacctggcggcagcgcaaaagatg

SEQ ID NO: 154134 - DNA, 103 bp, Artificial Sequence
  Synthetic Polynucleotide
taatacgactcactatagggcgcaaactgtgaaagctgtctttgatgtggaacagaggagaccacatatgagacagcttaacctggcggcagcgcaaaagatg

SEQ ID NO: 154135 - DNA, 103 bp, Artificial Sequence
  Synthetic Polynucleotide
taatacgactcactataggggactgagtcccgcaaactgtgaaagctgtcaacagaggagagacagcatgcacagtttgaacctggcggcagcgcaaaagatg

SEQ ID NO: 154136 - DNA, 103 bp, Artificial Sequence
  Synthetic Polynucleotide
taatacgactcactatagggggagtgatgggactgagtcccgcaaactgtaacagaggagaacagttatggggactcagaacctggcggcagcgcaaaagatg

SEQ ID NO: 154137 - DNA, 103 bp, Artificial Sequence
  Synthetic Polynucleotide
taatacgactcactatagggttctctccttggagtgatgggactgagtccaacagaggagaggactcatgcccatcactaacctggcggcagcgcaaaagatg

SEQ ID NO: 154138 - DNA, 103 bp, Artificial Sequence
  Synthetic Polynucleotide
taatacgactcactataggggaaatagagcttctctccttggagtgatggaacagaggagaccatcaatgcaaggagagaacctggcggcagcgcaaaagatg

SEQ ID NO: 154139 - DNA, 103 bp, Artificial Sequence
  Synthetic Polynucleotide
taatacgactcactatagggtccaaaagaggaaatagagcttctctccttaacagaggagaaaggagatgagctctattaacctggcggcagcgcaaaagatg

SEQ ID NO: 154140 - DNA, 103 bp, Artificial Sequence
  Synthetic Polynucleotide
taatacgactcactataggggtacacaatttccaaaagaggaaatagagcaacagaggagagctctaatgcctcttttgaacctggcggcagcgcaaaagatg

SEQ ID NO: 154141 - DNA, 103 bp, Artificial Sequence
  Synthetic Polynucleotide
taatacgactcactatagggaaggacaggagtacacaatttccaaaagagaacagaggagactctttatgaaattgtgtaacctggcggcagcgcaaaagatg

SEQ ID NO: 154142 - DNA, 103 bp, Artificial Sequence
  Synthetic Polynucleotide
taatacgactcactatagggcttcgtcgctctccacctcgatgtcatcgtaacagaggagaacgatgatgtcgaggtggaacctggcggcagcgcaaaagatg

SEQ ID NO: 154143 - DNA, 103 bp, Artificial Sequence
  Synthetic Polynucleotide
taatacgactcactatagggtttgacgatgaaggacaggagtacacaattaacagaggagaaattgtatgctcctgtccaacctggcggcagcgcaaaagatg

SEQ ID NO: 154144 - DNA, 103 bp, Artificial Sequence
  Synthetic Polynucleotide
taatacgactcactatagggtgcatcaaactttgacgatgaaggacaggaaacagaggagatcctgtatgtcatcgtcaaacctggcggcagcgcaaaagatg

SEQ ID NO: 154145 - DNA, 103 bp, Artificial Sequence
  Synthetic Polynucleotide
taatacgactcactataggggtggcatttctgcatcaaactttgacgatgaacagaggagacatcgtatgagtttgatgaacctggcggcagcgcaaaagatg

SEQ ID NO: 154146 - DNA, 103 bp, Artificial Sequence
  Synthetic Polynucleotide
taatacgactcactatagggaaatgaaggtgtggcatttctgcatcaaacaacagaggagagtttgaatgagaaatgccaacctggcggcagcgcaaaagatg

SEQ ID NO: 154147 - DNA, 103 bp, Artificial Sequence
  Synthetic Polynucleotide
taatacgactcactatagggtggtagcttgaaatgaaggtgtggcatttcaacagaggagagaaatgatgcaccttcataacctggcggcagcgcaaaagatg

SEQ ID NO: 154148 - DNA, 103 bp, Artificial Sequence
  Synthetic Polynucleotide
taatacgactcactatagggcttgtgcacttggtagcttgaaatgaaggtaacagaggagaaccttcatgtcaagctacaacctggcggcagcgcaaaagatg

SEQ ID NO: 154149 - DNA, 103 bp, Artificial Sequence
  Synthetic Polynucleotide
taatacgactcactatagggattcttttttcttgtgcacttggtagcttgaacagaggagacaagctatgaagtgcacaaacctggcggcagcgcaaaagatg

SEQ ID NO: 154150 - DNA, 103 bp, Artificial Sequence
  Synthetic Polynucleotide
taatacgactcactatagggtaaatcttgcattcttttttcttgtgcactaacagaggagaagtgcaatggaaaaaagaaacctggcggcagcgcaaaagatg

SEQ ID NO: 154151 - DNA, 103 bp, Artificial Sequence
  Synthetic Polynucleotide
taatacgactcactatagggctcggttgctcttcgtcgctctccacctcgaacagaggagacgaggtatggagcgacgaaacctggcggcagcgcaaaagatg

SEQ ID NO: 154152 - DNA, 103 bp, Artificial Sequence
  Synthetic Polynucleotide
taatacgactcactatagggagattgaaacctcggttgctcttcgtcgctaacagaggagaagcgacatggagcaaccgaacctggcggcagcgcaaaagatg

SEQ ID NO: 154153 - DNA, 103 bp, Artificial Sequence
  Synthetic Polynucleotide
taatacgactcactatagggtgtcagccgcagattgaaacctcggttgctaacagaggagaagcaacatgggtttcaataacctggcggcagcgcaaaagatg

SEQ ID NO: 154154 - DNA, 103 bp, Artificial Sequence
  Synthetic Polynucleotide
taatacgactcactatagggtgagcccgtttgtcagccgcagattgaaacaacagaggagagtttcaatgtgcggctgaaacctggcggcagcgcaaaagatg

SEQ ID NO: 154155 - DNA, 103 bp, Artificial Sequence
  Synthetic Polynucleotide
taatacgactcactatagggtgcattatgatgagcccgtttgtcagccgcaacagaggagagcggctatgaaacgggctaacctggcggcagcgcaaaagatg

SEQ ID NO: 154156 - DNA, 103 bp, Artificial Sequence
  Synthetic Polynucleotide
taatacgactcactatagggttcgttccagtgcattatgatgagcccgttaacagaggagaaacgggatgatcataatgaacctggcggcagcgcaaaagatg

SEQ ID NO: 154157 - DNA, 103 bp, Artificial Sequence
  Synthetic Polynucleotide
taatacgactcactatagggtccctacgttttcgttccagtgcattatgaaacagaggagatcataaatgactggaacgaacctggcggcagcgcaaaagatg

SEQ ID NO: 154158 - DNA, 103 bp, Artificial Sequence
  Synthetic Polynucleotide
taatacgactcactatagggcagcagcgtgcaaggaaacaccgggaacataacagaggagaatgttcatggtgtttcctaacctggcggcagcgcaaaagatg

SEQ ID NO: 154159 - DNA, 103 bp, Artificial Sequence
  Synthetic Polynucleotide
taatacgactcactataggggttctgggcgtgaccctgaggtggcgggaaaacagaggagattcccgatgcctcagggtaacctggcggcagcgcaaaagatg

SEQ ID NO: 154160 - DNA, 103 bp, Artificial Sequence
  Synthetic Polynucleotide
taatacgactcactatagggggagcagttgtagggcttgtgcacagcgccaacagaggagaggcgctatgcacaagcccaacctggcggcagcgcaaaagatg

SEQ ID NO: 154161 - DNA, 103 bp, Artificial Sequence
  Synthetic Polynucleotide
taatacgactcactatagggtgccacagtgggagcagttgtagggcttgtaacagaggagaacaagcatgacaactgctaacctggcggcagcgcaaaagatg

SEQ ID NO: 154162 - DNA, 103 bp, Artificial Sequence
  Synthetic Polynucleotide
taatacgactcactataggggagaagctcttgccacagtgggagcagttgaacagaggagacaactgatgccactgtggaacctggcggcagcgcaaaagatg

SEQ ID NO: 154163 - DNA, 103 bp, Artificial Sequence
  Synthetic Polynucleotide
taatacgactcactatagggatccggccgggagaagctcttgccacagtgaacagaggagacactgtatgaagagcttcaacctggcggcagcgcaaaagatg

SEQ ID NO: 154164 - DNA, 103 bp, Artificial Sequence
  Synthetic Polynucleotide
taatacgactcactatagggtgttgaggtgatccggccgggagaagctctaacagaggagaagagctatgcccggccggaacctggcggcagcgcaaaagatg

SEQ ID NO: 154165 - DNA, 103 bp, Artificial Sequence
  Synthetic Polynucleotide
taatacgactcactatagggctgacgtgactgttgaggtgatccggccggaacagaggagaccggccatgtcacctcaaaacctggcggcagcgcaaaagatg

SEQ ID NO: 154166 - DNA, 103 bp, Artificial Sequence
  Synthetic Polynucleotide
taatacgactcactataggggtgcacttgtctgacgtgactgttgaggtgaacagaggagacacctcatgagtcacgtcaacctggcggcagcgcaaaagatg

SEQ ID NO: 154167 - DNA, 103 bp, Artificial Sequence
  Synthetic Polynucleotide
taatacgactcactataggggttctgttgagtgcacttgtctgacgtgacaacagaggagagtcacgatggacaagtgcaacctggcggcagcgcaaaagatg

SEQ ID NO: 154168 - DNA, 103 bp, Artificial Sequence
  Synthetic Polynucleotide
taatacgactcactatagggttgaagggccgttctgttgagtgcacttgtaacagaggagaacaagtatgctcaacagaaacctggcggcagcgcaaaagatg

SEQ ID NO: 154169 - DNA, 103 bp, Artificial Sequence
  Synthetic Polynucleotide
taatacgactcactatagggtttctcacatttgaagggccgttctgttgaaacagaggagatcaacaatgcggcccttcaacctggcggcagcgcaaaagatg

SEQ ID NO: 154170 - DNA, 103 bp, Artificial Sequence
  Synthetic Polynucleotide
taatacgactcactatagggcctgcagggggttctgggcgtgaccctgagaacagaggagactcaggatgacgcccagaaacctggcggcagcgcaaaagatg

SEQ ID NO: 154171 - DNA, 103 bp, Artificial Sequence
  Synthetic Polynucleotide
taatacgactcactatagggctgcctcacatttctcacatttgaagggccaacagaggagaggccctatgaatgtgagaaacctggcggcagcgcaaaagatg

SEQ ID NO: 154172 - DNA, 103 bp, Artificial Sequence
  Synthetic Polynucleotide
taatacgactcactataggggtggcgaaagctgcctcacatttctcacataacagaggagaatgtgaatgatgtgaggcaacctggcggcagcgcaaaagatg

SEQ ID NO: 154173 - DNA, 103 bp, Artificial Sequence
  Synthetic Polynucleotide
taatacgactcactatagggccgatccttcgtggcgaaagctgcctcacaaacagaggagatgtgagatggctttcgccaacctggcggcagcgcaaaagatg

SEQ ID NO: 154174 - DNA, 103 bp, Artificial Sequence
  Synthetic Polynucleotide
taatacgactcactataggggcgcccgcagccgatccttcgtggcgaaagaacagaggagactttcgatgcgaaggatcaacctggcggcagcgcaaaagatg

SEQ ID NO: 154175 - DNA, 103 bp, Artificial Sequence
  Synthetic Polynucleotide
taatacgactcactatagggcgtactgtgtgcgcccgcagccgatccttcaacagaggagagaaggaatggctgcgggcaacctggcggcagcgcaaaagatg

SEQ ID NO: 154176 - DNA, 103 bp, Artificial Sequence
  Synthetic Polynucleotide
taatacgactcactatagggctcctcgtgtcgtactgtgtgcgcccgcagaacagaggagactgcggatgcacacagtaaacctggcggcagcgcaaaagatg

SEQ ID NO: 154177 - DNA, 103 bp, Artificial Sequence
  Synthetic Polynucleotide
taatacgactcactatagggatggcactttctcctcgtgtcgtactgtgtaacagaggagaacacagatggacacgaggaacctggcggcagcgcaaaagatg

SEQ ID NO: 154178 - DNA, 103 bp, Artificial Sequence
  Synthetic Polynucleotide
taatacgactcactatagggcacacgtgacatggcactttctcctcgtgtaacagaggagaacacgaatggaaagtgccaacctggcggcagcgcaaaagatg

SEQ ID NO: 154179 - DNA, 103 bp, Artificial Sequence
  Synthetic Polynucleotide
taatacgactcactatagggcatcttgccacacacgtgacatggcactttaacagaggagaaaagtgatgtgtcacgtgaacctggcggcagcgcaaaagatg

SEQ ID NO: 154180 - DNA, 103 bp, Artificial Sequence
  Synthetic Polynucleotide
taatacgactcactatagggccgagctcagcatcttgccacacacgtgacaacagaggagagtcacgatggtggcaagaaacctggcggcagcgcaaaagatg

SEQ ID NO: 154181 - DNA, 103 bp, Artificial Sequence
  Synthetic Polynucleotide
taatacgactcactatagggtcagccccgacctgcagggggttctgggcgaacagaggagacgcccaatgccccctgcaaacctggcggcagcgcaaaagatg

SEQ ID NO: 154182 - DNA, 103 bp, Artificial Sequence
  Synthetic Polynucleotide
taatacgactcactataggggaaatataagccgagctcagcatcttgccaaacagaggagatggcaaatggctgagctcaacctggcggcagcgcaaaagatg

SEQ ID NO: 154183 - DNA, 103 bp, Artificial Sequence
  Synthetic Polynucleotide
taatacgactcactatagggcatgtggtccgaaatataagccgagctcagaacagaggagactgagcatggcttatattaacctggcggcagcgcaaaagatg

SEQ ID NO: 154184 - DNA, 103 bp, Artificial Sequence
  Synthetic Polynucleotide
taatacgactcactatagggtgtgcaccttcatgtggtccgaaatataagaacagaggagacttataatgcggaccacaaacctggcggcagcgcaaaagatg

SEQ ID NO: 154185 - DNA, 103 bp, Artificial Sequence
  Synthetic Polynucleotide
taatacgactcactatagggggaccctggctgtgcaccttcatgtggtccaacagaggagaggaccaatggaaggtgcaaacctggcggcagcgcaaaagatg

SEQ ID NO: 154186 - DNA, 103 bp, Artificial Sequence
  Synthetic Polynucleotide
taatacgactcactataggggacatggtgaggaccctggctgtgcaccttaacagaggagaaaggtgatgagccagggtaacctggcggcagcgcaaaagatg

SEQ ID NO: 154187 - DNA, 103 bp, Artificial Sequence
  Synthetic Polynucleotide
taatacgactcactatagggagagctcacagacatggtgaggaccctggcaacagaggagagccaggatgctcaccatgaacctggcggcagcgcaaaagatg

SEQ ID NO: 154188 - DNA, 103 bp, Artificial Sequence
  Synthetic Polynucleotide
taatacgactcactatagggcctttgttgcagagctcacagacatggtgaaacagaggagatcaccaatgctgtgagctaacctggcggcagcgcaaaagatg

SEQ ID NO: 154189 - DNA, 103 bp, Artificial Sequence
  Synthetic Polynucleotide
taatacgactcactatagggcgtggtgaagcctttgttgcagagctcacaaacagaggagatgtgagatgtgcaacaaaaacctggcggcagcgcaaaagatg

SEQ ID NO: 154190 - DNA, 103 bp, Artificial Sequence
  Synthetic Polynucleotide
taatacgactcactatagggggtatgctgccgtggtgaagcctttgttgcaacagaggagagcaacaatggcttcaccaaacctggcggcagcgcaaaagatg

SEQ ID NO: 154191 - DNA, 103 bp, Artificial Sequence
  Synthetic Polynucleotide
taatacgactcactatagggtggatgcgcaggtatgctgccgtggtgaagaacagaggagacttcacatgggcagcataaacctggcggcagcgcaaaagatg

SEQ ID NO: 154192 - DNA, 103 bp, Artificial Sequence
  Synthetic Polynucleotide
taatacgactcactatagggggactggagctcagccccgacctgcaggggaacagaggagacccctgatggtcggggctaacctggcggcagcgcaaaagatg

SEQ ID NO: 154193 - DNA, 103 bp, Artificial Sequence
  Synthetic Polynucleotide
taatacgactcactatagggcttcaccgcgtggatgcgcaggtatgctgcaacagaggagagcagcaatgctgcgcatcaacctggcggcagcgcaaaagatg

SEQ ID NO: 154194 - DNA, 103 bp, Artificial Sequence
  Synthetic Polynucleotide
taatacgactcactataggggcccgtggtccttcaccgcgtggatgcgcaaacagaggagatgcgcaatgacgcggtgaaacctggcggcagcgcaaaagatg

SEQ ID NO: 154195 - DNA, 103 bp, Artificial Sequence
  Synthetic Polynucleotide
taatacgactcactatagggggggcctggagcccgtggtccttcaccgcgaacagaggagacgcggtatgggaccacggaacctggcggcagcgcaaaagatg

SEQ ID NO: 154196 - DNA, 103 bp, Artificial Sequence
  Synthetic Polynucleotide
taatacgactcactataggggtcagcccgcggggcctggagcccgtggtcaacagaggagagaccacatgctccaggccaacctggcggcagcgcaaaagatg

SEQ ID NO: 154197 - DNA, 103 bp, Artificial Sequence
  Synthetic Polynucleotide
taatacgactcactatagggacaggatgcggtcagcccgcggggcctggaaacagaggagatccaggatgcgcgggctgaacctggcggcagcgcaaaagatg

SEQ ID NO: 154198 - DNA, 103 bp, Artificial Sequence
  Synthetic Polynucleotide
taatacgactcactatagggcacagcttgcacaggatgcggtcagcccgcaacagaggagagcgggcatgccgcatcctaacctggcggcagcgcaaaagatg

SEQ ID NO: 154199 - DNA, 103 bp, Artificial Sequence
  Synthetic Polynucleotide
taatacgactcactataggggtgcacgctgcacagcttgcacaggatgcgaacagaggagacgcatcatgtgcaagctgaacctggcggcagcgcaaaagatg

SEQ ID NO: 154200 - DNA, 103 bp, Artificial Sequence
  Synthetic Polynucleotide
taatacgactcactataggggggtcttgcagtgcacgctgcacagcttgcaacagaggagagcaagcatggcagcgtgcaacctggcggcagcgcaaaagatg

SEQ ID NO: 154201 - DNA, 103 bp, Artificial Sequence
  Synthetic Polynucleotide
taatacgactcactatagggagctgggcaggggtcttgcagtgcacgctgaacagaggagacagcgtatgctgcaagacaacctggcggcagcgcaaaagatg

SEQ ID NO: 154202 - DNA, 103 bp, Artificial Sequence
  Synthetic Polynucleotide
taatacgactcactataggggtggccggccagctgggcaggggtcttgcaaacagaggagatgcaagatgcctgcccagaacctggcggcagcgcaaaagatg

SEQ ID NO: 154203 - DNA, 103 bp, Artificial Sequence
  Synthetic Polynucleotide
taatacgactcactatagggcaaagaagcgggactggagctcagccccgaaacagaggagatcggggatgagctccagtaacctggcggcagcgcaaaagatg

SEQ ID NO: 154204 - DNA, 103 bp, Artificial Sequence
  Synthetic Polynucleotide
taatacgactcactataggggggtctgcatgtggccggccagctgggcagaacagaggagactgcccatgtggccggccaacctggcggcagcgcaaaagatg

SEQ ID NO: 154205 - DNA, 103 bp, Artificial Sequence
  Synthetic Polynucleotide
taatacgactcactatagggccccccagatgggtctgcatgtggccggccaacagaggagaggccggatgcatgcagacaacctggcggcagcgcaaaagatg

SEQ ID NO: 154206 - DNA, 103 bp, Artificial Sequence
  Synthetic Polynucleotide
taatacgactcactataggggggggcggccccccccagatgggtctgcataacagaggagaatgcagatgcatctggggaacctggcggcagcgcaaaagatg

SEQ ID NO: 154207 - DNA, 103 bp, Artificial Sequence
  Synthetic Polynucleotide
taatacgactcactatagggccgggacagggggggcggccccccccagataacagaggagaatctggatggggccgcccaacctggcggcagcgcaaaagatg

SEQ ID NO: 154208 - DNA, 103 bp, Artificial Sequence
  Synthetic Polynucleotide
taatacgactcactatagggggggcgtctcccgggacagggggggcggccaacagaggagaggccgcatgccctgtcccaacctggcggcagcgcaaaagatg

SEQ ID NO: 154209 - DNA, 103 bp, Artificial Sequence
  Synthetic Polynucleotide
taatacgactcactatagggctgtggctggggggcgtctcccgggacaggaacagaggagacctgtcatgggagacgccaacctggcggcagcgcaaaagatg

SEQ ID NO: 154210 - DNA, 103 bp, Artificial Sequence
  Synthetic Polynucleotide
taatacgactcactatagggagcaggtgggctgtggctggggggcgtctcaacagaggagagagacgatgcccagccacaacctggcggcagcgcaaaagatg

SEQ ID NO: 154211 - DNA, 103 bp, Artificial Sequence
  Synthetic Polynucleotide
taatacgactcactatagggccctgggaggcaaagaagcgggactggagcaacagaggagagctccaatgccgcttcttaacctggcggcagcgcaaaagatg

SEQ ID NO: 154212 - DNA, 103 bp, Artificial Sequence
  Synthetic Polynucleotide
taatacgactcactatagggctgggcgcagccctgggaggcaaagaagcgaacagaggagacgcttcatggcctcccagaacctggcggcagcgcaaaagatg

SEQ ID NO: 154213 - DNA, 103 bp, Artificial Sequence
  Synthetic Polynucleotide
taatacgactcactatagggggaatggactctgggcgcagccctgggaggaacagaggagacctcccatggctgcgcccaacctggcggcagcgcaaaagatg

SEQ ID NO: 154214 - DNA, 103 bp, Artificial Sequence
  Synthetic Polynucleotide
taatacgactcactatagggggcgcggcctggaatggactctgggcgcagaacagaggagactgcgcatggagtccattaacctggcggcagcgcaaaagatg

SEQ ID NO: 154215 - DNA, 103 bp, Artificial Sequence
  Synthetic Polynucleotide
taatacgactcactatagggcgggggcgccggcgcggcctggaatggactaacagaggagaagtccaatgcaggccgcgaacctggcggcagcgcaaaagatg

SEQ ID NO: 154216 - DNA, 103 bp, Artificial Sequence
  Synthetic Polynucleotide
taatacgactcactatagggaggggggggccagcagcgtgcaaggaaacaaacagaggagatgtttcatggcacgctgcaacctggcggcagcgcaaaagatg

SEQ ID NO: 154217 - DNA, 103 bp, Artificial Sequence
  Synthetic Polynucleotide
taatacgactcactatagggggggcgtgggcgggggcgccggcgcggcctaacagaggagaaggccgatgcggcgccccaacctggcggcagcgcaaaagatg

SEQ ID NO: 154218 - DNA, 103 bp, Artificial Sequence
  Synthetic Polynucleotide
taatacgactcactataggggccggggcctggggcgtgggcgggggcgccaacagaggagaggcgccatggcccacgccaacctggcggcagcgcaaaagatg

SEQ ID NO: 154219 - DNA, 103 bp, Artificial Sequence
  Synthetic Polynucleotide
taatacgactcactataggggggctcggccgccggggcctggggcgtgggaacagaggagacccacgatgcaggccccgaacctggcggcagcgcaaaagatg

SEQ ID NO: 154220 - DNA, 103 bp, Artificial Sequence
  Synthetic Polynucleotide
taatacgactcactatagggccacctggaggggctcggccgccggggcctaacagaggagaaggcccatgcggccgagcaacctggcggcagcgcaaaagatg

SEQ ID NO: 154221 - DNA, 103 bp, Artificial Sequence
  Synthetic Polynucleotide
taatacgactcactataggggggagcaagtccacctggaggggctcggccaacagaggagaggccgaatgcctccaggtaacctggcggcagcgcaaaagatg

SEQ ID NO: 154222 - DNA, 103 bp, Artificial Sequence
  Synthetic Polynucleotide
taatacgactcactatagggggcgagcaccgggagcaagtccacctggagaacagaggagactccagatggacttgctcaacctggcggcagcgcaaaagatg

SEQ ID NO: 154223 - DNA, 103 bp, Artificial Sequence
  Synthetic Polynucleotide
taatacgactcactatagggcctgggcggcggcgagcaccgggagcaagtaacagaggagaacttgcatgcggtgctcgaacctggcggcagcgcaaaagatg

SEQ ID NO: 154224 - DNA, 103 bp, Artificial Sequence
  Synthetic Polynucleotide
taatacgactcactataggggcggcggactcctgggcggcggcgagcaccaacagaggagaggtgctatgcgccgcccaaacctggcggcagcgcaaaagatg

SEQ ID NO: 154225 - DNA, 103 bp, Artificial Sequence
  Synthetic Polynucleotide
taatacgactcactatagggcgcagcagccgcggcggactcctgggcggcaacagaggagagccgccatggagtccgccaacctggcggcagcgcaaaagatg

SEQ ID NO: 154226 - DNA, 103 bp, Artificial Sequence
  Synthetic Polynucleotide
taatacgactcactatagggcggcagcggccgcagcagccgcggcggactaacagaggagaagtccgatgcggctgctgaacctggcggcagcgcaaaagatg

SEQ ID NO: 154227 - DNA, 103 bp, Artificial Sequence
  Synthetic Polynucleotide
taatacgactcactatagggagcacggggaaggggggggccagcagcgtgaacagaggagacacgctatgggcccccccaacctggcggcagcgcaaaagatg

SEQ ID NO: 154228 - DNA, 103 bp, Artificial Sequence
  Synthetic Polynucleotide
taatacgactcactataggggcagcagcggcggcagcggccgcagcagccaacagaggagaggctgcatgggccgctgcaacctggcggcagcgcaaaagatg

SEQ ID NO: 154229 - DNA, 103 bp, Artificial Sequence
  Synthetic Polynucleotide
taatacgactcactatagggagcgacggcggcagcagcggcggcagcggcaacagaggagagccgctatggccgctgctaacctggcggcagcgcaaaagatg

SEQ ID NO: 154230 - DNA, 103 bp, Artificial Sequence
  Synthetic Polynucleotide
taatacgactcactatagggggggcgcggcagcgacggcggcagcagcggaacagaggagaccgctgatgccgccgtcgaacctggcggcagcgcaaaagatg

SEQ ID NO: 154231 - DNA, 103 bp, Artificial Sequence
  Synthetic Polynucleotide
taatacgactcactataggggcaggggccgggggcgcggcagcgacggcgaacagaggagacgccgtatgtgccgcgccaacctggcggcagcgcaaaagatg

SEQ ID NO: 154232 - DNA, 103 bp, Artificial Sequence
  Synthetic Polynucleotide
taatacgactcactatagggagaggcggcggcaggggccgggggcgcggcaacagaggagagccgcgatgccggcccctaacctggcggcagcgcaaaagatg

SEQ ID NO: 154233 - DNA, 103 bp, Artificial Sequence
  Synthetic Polynucleotide
taatacgactcactatagggtgtccaccgtagaggcggcggcaggggccgaacagaggagacggcccatgccgccgcctaacctggcggcagcgcaaaagatg

SEQ ID NO: 154234 - DNA, 103 bp, Artificial Sequence
  Synthetic Polynucleotide
taatacgactcactatagggagggccgctgtgtccaccgtagaggcggcgaacagaggagacgccgcatgtacggtggaaacctggcggcagcgcaaaagatg

SEQ ID NO: 154235 - DNA, 103 bp, Artificial Sequence
  Synthetic Polynucleotide
taatacgactcactatagggaggctgcttcagggccgctgtgtccaccgtaacagaggagaacggtgatgacagcggccaacctggcggcagcgcaaaagatg

SEQ ID NO: 154236 - DNA, 103 bp, Artificial Sequence
  Synthetic Polynucleotide
taatacgactcactatagggggggcgccggaggctgcttcagggccgctgaacagaggagacagcggatgtgaagcagcaacctggcggcagcgcaaaagatg

SEQ ID NO: 154237 - DNA, 103 bp, Artificial Sequence
  Synthetic Polynucleotide
taatacgactcactatagggggtggcggagggggcgccggaggctgcttcaacagaggagagaagcaatgtccggcgccaacctggcggcagcgcaaaagatg

SEQ ID NO: 154238 - DNA, 103 bp, Artificial Sequence
  Synthetic Polynucleotide
taatacgactcactataggggtccaggcccagcacggggaaggggggggcaacagaggagagcccccatgttccccgtgaacctggcggcagcgcaaaagatg

SEQ ID NO: 154239 - DNA, 103 bp, Artificial Sequence
  Synthetic Polynucleotide
taatacgactcactatagggcactggcgggggtggcggagggggcgccggaacagaggagaccggcgatgcctccgccaaacctggcggcagcgcaaaagatg

SEQ ID NO: 154240 - DNA, 103 bp, Artificial Sequence
  Synthetic Polynucleotide
taatacgactcactatagggcgggcgccgacactggcgggggtggcggagaacagaggagactccgcatgccccgccagaacctggcggcagcgcaaaagatg

SEQ ID NO: 154241 - DNA, 103 bp, Artificial Sequence
  Synthetic Polynucleotide
taatacgactcactataggggcctcggccgcgggcgccgacactggcgggaacagaggagacccgccatggtcggcgccaacctggcggcagcgcaaaagatg

SEQ ID NO: 154242 - DNA, 103 bp, Artificial Sequence
  Synthetic Polynucleotide
taatacgactcactatagggggggggcgcggcctcggccgcgggcgccgaaacagaggagatcggcgatggcggccgagaacctggcggcagcgcaaaagatg

SEQ ID NO: 154243 - DNA, 103 bp, Artificial Sequence
  Synthetic Polynucleotide
taatacgactcactatagggcggcggaggcggggggcgcggcctcggccgaacagaggagacggccgatgccgcgccccaacctggcggcagcgcaaaagatg

SEQ ID NO: 154244 - DNA, 103 bp, Artificial Sequence
  Synthetic Polynucleotide
taatacgactcactataggggcgatagtggcggcggaggcggggggcgcgaacagaggagacgcgccatgcgcctccgcaacctggcggcagcgcaaaagatg

SEQ ID NO: 154245 - DNA, 103 bp, Artificial Sequence
  Synthetic Polynucleotide
taatacgactcactatagggcgccgccgcggcgatagtggcggcggaggcaacagaggagagcctccatggccactatcaacctggcggcagcgcaaaagatg

SEQ ID NO: 154246 - DNA, 103 bp, Artificial Sequence
  Synthetic Polynucleotide
taatacgactcactatagggcggcggtggccgccgccgcggcgatagtggaacagaggagaccactaatgccgcggcggaacctggcggcagcgcaaaagatg

SEQ ID NO: 154247 - DNA, 103 bp, Artificial Sequence
  Synthetic Polynucleotide
taatacgactcactatagggggggctacgacggcggtggccgccgccgcgaacagaggagacgcggcatgggccaccgcaacctggcggcagcgcaaaagatg

SEQ ID NO: 154248 - DNA, 103 bp, Artificial Sequence
  Synthetic Polynucleotide
taatacgactcactatagggcgtcgaggttggggctacgacggcggtggcaacagaggagagccaccatggtcgtagccaacctggcggcagcgcaaaagatg

SEQ ID NO: 154249 - DNA, 103 bp, Artificial Sequence
  Synthetic Polynucleotide
taatacgactcactatagggccccccgggagtccaggcccagcacggggaaacagaggagatccccgatgtgggcctggaacctggcggcagcgcaaaagatg

SEQ ID NO: 154250 - DNA, 103 bp, Artificial Sequence
  Synthetic Polynucleotide
taatacgactcactatagggccacggcgaccgtcgaggttggggctacgaaacagaggagatcgtagatgcaacctcgaaacctggcggcagcgcaaaagatg

SEQ ID NO: 154251 - DNA, 103 bp, Artificial Sequence
  Synthetic Polynucleotide
taatacgactcactataggggcgaccggggccacggcgaccgtcgaggttaacagaggagaaacctcatgggtcgccgtaacctggcggcagcgcaaaagatg

SEQ ID NO: 154252 - DNA, 103 bp, Artificial Sequence
  Synthetic Polynucleotide
taatacgactcactatagggcaaggcagacgcgaccggggccacggcgacaacagaggagagtcgccatggccccggtcaacctggcggcagcgcaaaagatg

SEQ ID NO: 154253 - DNA, 103 bp, Artificial Sequence
  Synthetic Polynucleotide
taatacgactcactatagggtcttcttctccaaggcagacgcgaccggggaacagaggagaccccggatgcgtctgcctaacctggcggcagcgcaaaagatg

SEQ ID NO: 154254 - DNA, 103 bp, Artificial Sequence
  Synthetic Polynucleotide
taatacgactcactatagggttgctctttgtcttcttctccaaggcagacaacagaggagagtctgcatgggagaagaaaacctggcggcagcgcaaaagatg

SEQ ID NO: 154255 - DNA, 103 bp, Artificial Sequence
  Synthetic Polynucleotide
taatacgactcactataggggtagggccccttgctctttgtcttcttctcaacagaggagagagaagatgacaaagagcaacctggcggcagcgcaaaagatg

SEQ ID NO: 154256 - DNA, 103 bp, Artificial Sequence
  Synthetic Polynucleotide
taatacgactcactataggggagcgcagatgtagggccccttgctctttgaacagaggagacaaagaatgaggggccctaacctggcggcagcgcaaaagatg

SEQ ID NO: 154257 - DNA, 103 bp, Artificial Sequence
  Synthetic Polynucleotide
taatacgactcactatagggttggcgcacagagcgcagatgtagggccccaacagaggagaggggccatgcatctgcgcaacctggcggcagcgcaaaagatg

SEQ ID NO: 154258 - DNA, 103 bp, Artificial Sequence
  Synthetic Polynucleotide
taatacgactcactatagggcttgaactccttggcgcacagagcgcagataacagaggagaatctgcatgctgtgcgccaacctggcggcagcgcaaaagatg

SEQ ID NO: 154259 - DNA, 103 bp, Artificial Sequence
  Synthetic Polynucleotide
taatacgactcactatagggtgtagccgttcttgaactccttggcgcacaaacagaggagatgtgcgatgaggagttcaaacctggcggcagcgcaaaagatg

SEQ ID NO: 154260 - DNA, 103 bp, Artificial Sequence
  Synthetic Polynucleotide
taatacgactcactatagggaggccgcccaccccccgggagtccaggcccaacagaggagagggcctatgctcccggggaacctggcggcagcgcaaaagatg

SEQ ID NO: 154261 - DNA, 103 bp, Artificial Sequence
  Synthetic Polynucleotide
taatacgactcactatagggctccggagattgtagccgttcttgaactccaacagaggagaggagttatggaacggctaaacctggcggcagcgcaaaagatg

SEQ ID NO: 154262 - DNA, 103 bp, Artificial Sequence
  Synthetic Polynucleotide
taatacgactcactatagggggcttcgtgcctccggagattgtagccgttaacagaggagaaacggcatgaatctccggaacctggcggcagcgcaaaagatg

SEQ ID NO: 154263 - DNA, 103 bp, Artificial Sequence
  Synthetic Polynucleotide
taatacgactcactatagggccgtgtggatggcttcgtgcctccggagataacagaggagaatctccatgggcacgaagaacctggcggcagcgcaaaagatg

SEQ ID NO: 154264 - DNA, 103 bp, Artificial Sequence
  Synthetic Polynucleotide
taatacgactcactataggggccttggctcccgtgtggatggcttcgtgcaacagaggagagcacgaatgcatccacacaacctggcggcagcgcaaaagatg

SEQ ID NO: 154265 - DNA, 103 bp, Artificial Sequence
  Synthetic Polynucleotide
taatacgactcactataggggacccggccggccttggctcccgtgtggataacagaggagaatccacatgggagccaagaacctggcggcagcgcaaaagatg

SEQ ID NO: 154266 - DNA, 103 bp, Artificial Sequence
  Synthetic Polynucleotide
taatacgactcactatagggcacccgaggggacccggccggccttggctcaacagaggagagagccaatgccggccgggaacctggcggcagcgcaaaagatg

SEQ ID NO: 154267 - DNA, 103 bp, Artificial Sequence
  Synthetic Polynucleotide
taatacgactcactatagggatcttcatagcacccgaggggacccggccgaacagaggagacggccgatgcccctcgggaacctggcggcagcgcaaaagatg

SEQ ID NO: 154268 - DNA, 103 bp, Artificial Sequence
  Synthetic Polynucleotide
taatacgactcactatagggcatggtcggcatcttcatagcacccgagggaacagaggagaccctcgatggctatgaagaacctggcggcagcgcaaaagatg

SEQ ID NO: 154269 - DNA, 103 bp, Artificial Sequence
  Synthetic Polynucleotide
taatacgactcactatagggtcaggggcaccatggtcggcatcttcatagaacagaggagactatgaatgtgccgaccaaacctggcggcagcgcaaaagatg

SEQ ID NO: 154270 - DNA, 103 bp, Artificial Sequence
  Synthetic Polynucleotide
taatacgactcactatagggctcaggaggctcaggggcaccatggtcggcaacagaggagagccgacatgggtgcccctaacctggcggcagcgcaaaagatg

SEQ ID NO: 154271 - DNA, 103 bp, Artificial Sequence
  Synthetic Polynucleotide
taatacgactcactatagggggagttcatgaggccgcccaccccccgggaaacagaggagatcccggatggtgggcggcaacctggcggcagcgcaaaagatg

SEQ ID NO: 154272 - DNA, 103 bp, Artificial Sequence
  Synthetic Polynucleotide
taatacgactcactatagggctggggcacgctcaggaggctcaggggcacaacagaggagagtgcccatgagcctcctgaacctggcggcagcgcaaaagatg

SEQ ID NO: 154273 - DNA, 103 bp, Artificial Sequence
  Synthetic Polynucleotide
taatacgactcactatagggctccgctcagctggggcacgctcaggaggcaacagaggagagcctccatggcgtgccccaacctggcggcagcgcaaaagatg

SEQ ID NO: 154274 - DNA, 103 bp, Artificial Sequence
  Synthetic Polynucleotide
taatacgactcactatagggcccccgccggctccgctcagctggggcacgaacagaggagacgtgccatggctgagcggaacctggcggcagcgcaaaagatg

SEQ ID NO: 154275 - DNA, 103 bp, Artificial Sequence
  Synthetic Polynucleotide
taatacgactcactatagggctctccccctcccccgccggctccgctcagaacagaggagactgagcatggccggcgggaacctggcggcagcgcaaaagatg

SEQ ID NO: 154276 - DNA, 103 bp, Artificial Sequence
  Synthetic Polynucleotide
taatacgactcactatagggcggcacccgcctctccccctcccccgccggaacagaggagaccggcgatggagggggagaacctggcggcagcgcaaaagatg

SEQ ID NO: 154277 - DNA, 103 bp, Artificial Sequence
  Synthetic Polynucleotide
taatacgactcactataggggcgccgccgccggcacccgcctctccccctaacagaggagaagggggatgggcgggtgcaacctggcggcagcgcaaaagatg

SEQ ID NO: 154278 - DNA, 103 bp, Artificial Sequence
  Synthetic Polynucleotide
taatacgactcactatagggcactgcggcagcgccgccgccggcacccgcaacagaggagagcgggtatgggcggcggcaacctggcggcagcgcaaaagatg

SEQ ID NO: 154279 - DNA, 103 bp, Artificial Sequence
  Synthetic Polynucleotide
taatacgactcactatagggcaccggcggccactgcggcagcgccgccgcaacagaggagagcggcgatgctgccgcagaacctggcggcagcgcaaaagatg

SEQ ID NO: 154280 - DNA, 103 bp, Artificial Sequence
  Synthetic Polynucleotide
taatacgactcactataggggtcaccacgccaccggcggccactgcggcaaacagaggagatgccgcatgggccgccggaacctggcggcagcgcaaaagatg

SEQ ID NO: 154281 - DNA, 103 bp, Artificial Sequence
  Synthetic Polynucleotide
taatacgactcactatagggggcggtcgtggtcaccacgccaccggcggcaacagaggagagccgccatgggcgtggtgaacctggcggcagcgcaaaagatg

SEQ ID NO: 154282 - DNA, 103 bp, Artificial Sequence
  Synthetic Polynucleotide
taatacgactcactataggggtggcgggaaggagttcatgaggccgcccaaacagaggagatgggcgatgtcatgaactaacctggcggcagcgcaaaagatg

SEQ ID NO: 154283 - DNA, 103 bp, Artificial Sequence
  Synthetic Polynucleotide
taatacgactcactataggggcttccccgaggcggtcgtggtcaccacgcaacagaggagagcgtggatgccacgaccgaacctggcggcagcgcaaaagatg

SEQ ID NO: 154284 - DNA, 103 bp, Artificial Sequence
  Synthetic Polynucleotide
taatacgactcactatagggttccggatgcgcttccccgaggcggtcgtgaacagaggagacacgacatgctcggggaaaacctggcggcagcgcaaaagatg

SEQ ID NO: 154285 - DNA, 103 bp, Artificial Sequence
  Synthetic Polynucleotide
taatacgactcactatagggggcatggttcttccggatgcgcttccccgaaacagaggagatcggggatgcgcatccggaacctggcggcagcgcaaaagatg

SEQ ID NO: 154286 - DNA, 103 bp, Artificial Sequence
  Synthetic Polynucleotide
taatacgactcactatagggacatctcgcaggcatggttcttccggatgcaacagaggagagcatccatgagaaccatgaacctggcggcagcgcaaaagatg

SEQ ID NO: 154287 - DNA, 103 bp, Artificial Sequence
  Synthetic Polynucleotide
taatacgactcactataggggccttgccacacatctcgcaggcatggttcaacagaggagagaaccaatgctgcgagataacctggcggcagcgcaaaagatg

SEQ ID NO: 154288 - DNA, 103 bp, Artificial Sequence
  Synthetic Polynucleotide
taatacgactcactataggggtcgcggaaggccttgccacacatctcgcaaacagaggagatgcgagatgtgtggcaagaacctggcggcagcgcaaaagatg

SEQ ID NO: 154289 - DNA, 103 bp, Artificial Sequence
  Synthetic Polynucleotide
taatacgactcactatagggggtggtagacgtcgcggaaggccttgccacaacagaggagagtggcaatgccttccgcgaacctggcggcagcgcaaaagatg

SEQ ID NO: 154290 - DNA, 103 bp, Artificial Sequence
  Synthetic Polynucleotide
taatacgactcactatagggtgtcggttcaggtggtagacgtcgcggaagaacagaggagacttccgatgcgtctaccaaacctggcggcagcgcaaaagatg

SEQ ID NO: 154291 - DNA, 103 bp, Artificial Sequence
  Synthetic Polynucleotide
taatacgactcactatagggcgacagcttgtgtcggttcaggtggtagacaacagaggagagtctacatgctgaaccgaaacctggcggcagcgcaaaagatg

SEQ ID NO: 154292 - DNA, 103 bp, Artificial Sequence
  Synthetic Polynucleotide
taatacgactcactatagggcgtccgagtgcgacagcttgtgtcggttcaaacagaggagatgaaccatgacaagctgtaacctggcggcagcgcaaaagatg

SEQ ID NO: 154293 - DNA, 103 bp, Artificial Sequence
  Synthetic Polynucleotide
taatacgactcactatagggtgaccctgaggtggcgggaaggagttcatgaacagaggagacatgaaatgcttcccgccaacctggcggcagcgcaaaagatg

SEQ ID NO: 154294 - DNA, 103 bp, Artificial Sequence
  Synthetic Polynucleotide
taatacgactcactatagggtagggcttctcgtccgagtgcgacagcttgaacagaggagacaagctatggcactcggaaacctggcggcagcgcaaaagatg

SEQ ID NO: 154295 - DNA, 103 bp, Artificial Sequence
  Synthetic Polynucleotide
taatacgactcactatagggcgggcactggtagggcttctcgtccgagtgaacagaggagacactcgatggagaagcccaacctggcggcagcgcaaaagatg

SEQ ID NO: 154296 - DNA, 103 bp, Artificial Sequence
  Synthetic Polynucleotide
taatacgactcactataggggctggcacaccgggcactggtagggcttctaacagaggagaagaagcatgaccagtgccaacctggcggcagcgcaaaagatg

SEQ ID NO: 154297 - DNA, 103 bp, Artificial Sequence
  Synthetic Polynucleotide
taatacgactcactatagggttgaagcgctgctggcacaccgggcactggaacagaggagaccagtgatgggtgtgccaaacctggcggcagcgcaaaagatg

SEQ ID NO: 154298 - DNA, 103 bp, Artificial Sequence
  Synthetic Polynucleotide
taatacgactcactataggggtccttgcgcttgaagcgctgctggcacacaacagaggagagtgtgcatgcagcgcttcaacctggcggcagcgcaaaagatg

SEQ ID NO: 154299 - DNA, 103 bp, Artificial Sequence
  Synthetic Polynucleotide
taatacgactcactatagggagctcatgcggtccttgcgcttgaagcgctaacagaggagaagcgctatgagcgcaaggaacctggcggcagcgcaaaagatg

SEQ ID NO: 154300 - DNA, 103 bp, Artificial Sequence
  Synthetic Polynucleotide
taatacgactcactatagggcgcacgtggtagctcatgcggtccttgcgcaacagaggagagcgcaaatgccgcatgagaacctggcggcagcgcaaaagatg

SEQ ID NO: 154301 - DNA, 103 bp, Artificial Sequence
  Synthetic Polynucleotide
taatacgactcactataggggtcatgtgagcgcacgtggtagctcatgcgaacagaggagacgcatgatgtaccacgtgaacctggcggcagcgcaaaagatg

SEQ ID NO: 154302 - DNA, 103 bp, Artificial Sequence
  Synthetic Polynucleotide
taatacgactcactataggggcacagcgccgtcatgtgagcgcacgtggtaacagaggagaaccacgatggctcacatgaacctggcggcagcgcaaaagatg

SEQ ID NO: 154303 - DNA, 103 bp, Artificial Sequence
  Synthetic Polynucleotide
taatacgactcactatagggtagggcttgtgcacagcgccgtcatgtgagaacagaggagactcacaatgcggcgctgtaacctggcggcagcgcaaaagatg

SEQ ID NO: 154304 - DNA, 103 bp, Artificial Sequence
  Synthetic Polynucleotide
taatacgactcactataggggcagcggcctccccccgggtgcgcgcgcataacagaggagaatgcgcatgcacccggggaacctggcggcagcgcaaaagatg

SEQ ID NO: 154305 - DNA, 103 bp, Artificial Sequence
  Synthetic Polynucleotide
taatacgactcactatagggcgcgctgccctggcccccctgctctatggcaacagaggagagccataatgcaggggggcaacctggcggcagcgcaaaagatg

SEQ ID NO: 154306 - DNA, 103 bp, Artificial Sequence
  Synthetic Polynucleotide
taatacgactcactataggggacttgccctgtgattggcgcagagcttgtaacagaggagaacaagcatggcgccaatcaacctggcggcagcgcaaaagatg

SEQ ID NO: 154307 - DNA, 103 bp, Artificial Sequence
  Synthetic Polynucleotide
taatacgactcactatagggcagcagcggagacttgccctgtgattggcgaacagaggagacgccaaatgcagggcaagaacctggcggcagcgcaaaagatg

SEQ ID NO: 154308 - DNA, 103 bp, Artificial Sequence
  Synthetic Polynucleotide
taatacgactcactatagggttcttttccacagcagcggagacttgccctaacagaggagaagggcaatgctccgctgcaacctggcggcagcgcaaaagatg

SEQ ID NO: 154309 - DNA, 103 bp, Artificial Sequence
  Synthetic Polynucleotide
taatacgactcactatagggaacagcagggttcttttccacagcagcggaaacagaggagatccgctatggtggaaaagaacctggcggcagcgcaaaagatg

SEQ ID NO: 154310 - DNA, 103 bp, Artificial Sequence
  Synthetic Polynucleotide
taatacgactcactatagggtgttaagccaaacagcagggttcttttccaaacagaggagatggaaaatgaccctgctgaacctggcggcagcgcaaaagatg

SEQ ID NO: 154311 - DNA, 103 bp, Artificial Sequence
  Synthetic Polynucleotide
taatacgactcactatagggggttgagatgtgttaagccaaacagcagggaacagaggagaccctgcatgttggcttaaaacctggcggcagcgcaaaagatg

SEQ ID NO: 154312 - DNA, 103 bp, Artificial Sequence
  Synthetic Polynucleotide
taatacgactcactatagggtttgcagaggggttgagatgtgttaagccaaacagaggagatggcttatgacatctcaaaacctggcggcagcgcaaaagatg

SEQ ID NO: 154313 - DNA, 103 bp, Artificial Sequence
  Synthetic Polynucleotide
taatacgactcactatagggcaataaaagctttgcagaggggttgagatgaacagaggagacatctcatgccctctgcaaacctggcggcagcgcaaaagatg

SEQ ID NO: 154314 - DNA, 103 bp, Artificial Sequence
  Synthetic Polynucleotide
taatacgactcactatagggtcatctgtgacaataaaagctttgcagaggaacagaggagacctctgatgagcttttataacctggcggcagcgcaaaagatg

SEQ ID NO: 154315 - DNA, 103 bp, Artificial Sequence
  Synthetic Polynucleotide
taatacgactcactatagggcctgatgtcttcatctgtgacaataaaagcaacagaggagagcttttatggtcacagataacctggcggcagcgcaaaagatg

SEQ ID NO: 154316 - DNA, 103 bp, Artificial Sequence
  Synthetic Polynucleotide
taatacgactcactatagggacggggcgagcgcgctgccctggcccccctaacagaggagaagggggatgagggcagcgaacctggcggcagcgcaaaagatg

SEQ ID NO: 154317 - DNA, 103 bp, Artificial Sequence
  Synthetic Polynucleotide
taatacgactcactatagggcttcctgtttcctgatgtcttcatctgtgaaacagaggagatcacagatgaagacatcaaacctggcggcagcgcaaaagatg

SEQ ID NO: 154318 - DNA, 103 bp, Artificial Sequence
  Synthetic Polynucleotide
taatacgactcactatagggtgtactcgctcttcctgtttcctgatgtctaacagaggagaagacatatggaaacaggaaacctggcggcagcgcaaaagatg

SEQ ID NO: 154319 - DNA, 103 bp, Artificial Sequence
  Synthetic Polynucleotide
taatacgactcactataggggcgtacttgctgtactcgctcttcctgtttaacagaggagaaaacagatggagcgagtaaacctggcggcagcgcaaaagatg

SEQ ID NO: 154320 - DNA, 103 bp, Artificial Sequence
  Synthetic Polynucleotide
taatacgactcactatagggccaatttcttgcgtacttgctgtactcgctaacagaggagaagcgagatgagcaagtacaacctggcggcagcgcaaaagatg

SEQ ID NO: 154321 - DNA, 103 bp, Artificial Sequence
  Synthetic Polynucleotide
taatacgactcactatagggagtgcttcttccaatttcttgcgtacttgcaacagaggagagcaagtatgcaagaaattaacctggcggcagcgcaaaagatg

SEQ ID NO: 154322 - DNA, 103 bp, Artificial Sequence
  Synthetic Polynucleotide
taatacgactcactataggggtctgccatcagtgcttcttccaatttcttaacagaggagaaagaaaatggaagaagcaaacctggcggcagcgcaaaagatg

SEQ ID NO: 154323 - DNA, 103 bp, Artificial Sequence
  Synthetic Polynucleotide
taatacgactcactataggggcgacaagatgtctgccatcagtgcttcttaacagaggagaaagaagatgtgatggcagaacctggcggcagcgcaaaagatg

SEQ ID NO: 154324 - DNA, 103 bp, Artificial Sequence
  Synthetic Polynucleotide
taatacgactcactatagggtcagcagctcgcgacaagatgtctgccatcaacagaggagagatggcatgcatcttgtcaacctggcggcagcgcaaaagatg

SEQ ID NO: 154325 - DNA, 103 bp, Artificial Sequence
  Synthetic Polynucleotide
taatacgactcactatagggctcttctgtatcagcagctcgcgacaagataacagaggagaatcttgatgcgagctgctaacctggcggcagcgcaaaagatg

SEQ ID NO: 154326 - DNA, 103 bp, Artificial Sequence
  Synthetic Polynucleotide
taatacgactcactatagggcaatatccatctcttctgtatcagcagctcaacagaggagagagctgatgatacagaagaacctggcggcagcgcaaaagatg

SEQ ID NO: 154327 - DNA, 103 bp, Artificial Sequence
  Synthetic Polynucleotide
taatacgactcactatagggctcaccggggacggggcgagcgcgctgcccaacagaggagagggcagatggctcgccccaacctggcggcagcgcaaaagatg

SEQ ID NO: 154328 - DNA, 103 bp, Artificial Sequence
  Synthetic Polynucleotide
taatacgactcactatagggctgtccatttcaatatccatctcttctgtaaacagaggagatacagaatggatggatataacctggcggcagcgcaaaagatg

SEQ ID NO: 154329 - DNA, 103 bp, Artificial Sequence
  Synthetic Polynucleotide
taatacgactcactatagggttcatctccactgtccatttcaatatccataacagaggagaatggatatggaaatggacaacctggcggcagcgcaaaagatg

SEQ ID NO: 154330 - DNA, 103 bp, Artificial Sequence
  Synthetic Polynucleotide
taatacgactcactataggggcgcacgccgctcaccggggacggggcgagaacagaggagactcgccatgtccccggtgaacctggcggcagcgcaaaagatg

SEQ ID NO: 154331 - DNA, 103 bp, Artificial Sequence
  Synthetic Polynucleotide
taatacgactcactatagggcgccttccctgcgcacgccgctcaccggggaacagaggagaccccggatggcggcgtgcaacctggcggcagcgcaaaagatg

SEQ ID NO: 154332 - DNA, 103 bp, Artificial Sequence
  Synthetic Polynucleotide
taatacgactcactatagggccgccccgagcgccttccctgcgcacgccgaacagaggagacggcgtatgcagggaaggaacctggcggcagcgcaaaagatg

SEQ ID NO: 154333 - DNA, 103 bp, Artificial Sequence
  Synthetic Polynucleotide
taatacgactcactataggggccacggccgccgccccgagcgccttccctaacagaggagaagggaaatggctcggggcaacctggcggcagcgcaaaagatg

SEQ ID NO: 154334 - DNA, 103 bp, Artificial Sequence
  Synthetic Polynucleotide
taatacgactcactatagggaccgcccccggccacggccgccgccccgagaacagaggagactcgggatggcggccgtgaacctggcggcagcgcaaaagatg

SEQ ID NO: 154335 - DNA, 103 bp, Artificial Sequence
  Synthetic Polynucleotide
taatacgactcactataggggcctgcttccaccgcccccggccacggccgaacagaggagacggccgatgccgggggcgaacctggcggcagcgcaaaagatg

SEQ ID NO: 154336 - DNA, 103 bp, Artificial Sequence
  Synthetic Polynucleotide
taatacgactcactataggggccccggcccgcctgcttccaccgcccccgaacagaggagacgggggatgtggaagcagaacctggcggcagcgcaaaagatg

SEQ ID NO: 154337 - DNA, 103 bp, Artificial Sequence
  Synthetic Polynucleotide
taatacgactcactataggggctccgggcagcagcggcctccccccgggtaacagaggagaacccggatggaggccgctaacctggcggcagcgcaaaagatg

SEQ ID NO: 154338 - DNA, 103 bp, Artificial Sequence
  Synthetic Polynucleotide
taatacgactcactatagggagacgccgccgccccggcccgcctgcttccaacagaggagaggaagcatgcgggccgggaacctggcggcagcgcaaaagatg

SEQ ID NO: 154339 - DNA, 103 bp, Artificial Sequence
  Synthetic Polynucleotide
taatacgactcactatagggccacggccacagacgccgccgccccggcccaacagaggagagggccgatgcggcggcgtaacctggcggcagcgcaaaagatg

SEQ ID NO: 154340 - DNA, 103 bp, Artificial Sequence
  Synthetic Polynucleotide
taatacgactcactatagggccggccccggccacggccacagacgccgccaacagaggagaggcggcatgtgtggccgtaacctggcggcagcgcaaaagatg

SEQ ID NO: 154341 - DNA, 103 bp, Artificial Sequence
  Synthetic Polynucleotide
taatacgactcactatagggggccacggccccggccccggccacggccacaacagaggagagtggccatggccggggccaacctggcggcagcgcaaaagatg

SEQ ID NO: 154342 - DNA, 103 bp, Artificial Sequence
  Synthetic Polynucleotide
taatacgactcactatagggccccgtccccggccacggccccggccccggaacagaggagaccggggatggggccgtggaacctggcggcagcgcaaaagatg

SEQ ID NO: 154343 - DNA, 103 bp, Artificial Sequence
  Synthetic Polynucleotide
taatacgactcactatagggccggccccgtccccgtccccggccacggccaacagaggagaggccgtatgcggggacggaacctggcggcagcgcaaaagatg

SEQ ID NO: 154344 - DNA, 103 bp, Artificial Sequence
  Synthetic Polynucleotide
taatacgactcactatagggggccccggccccggccccgtccccgtccccaacagaggagaggggacatggacggggccaacctggcggcagcgcaaaagatg

SEQ ID NO: 154345 - DNA, 103 bp, Artificial Sequence
  Synthetic Polynucleotide
taatacgactcactatagggggacggccgcggccccggccccggccccgtaacagaggagaacggggatggggccggggaacctggcggcagcgcaaaagatg

SEQ ID NO: 154346 - DNA, 103 bp, Artificial Sequence
  Synthetic Polynucleotide
taatacgactcactataggggccactcgggggacggccgcggccccggccaacagaggagaggccggatgcgcggccgtaacctggcggcagcgcaaaagatg

SEQ ID NO: 154347 - DNA, 103 bp, Artificial Sequence
  Synthetic Polynucleotide
taatacgactcactatagggggccgctgccgccactcgggggacggccgcaacagaggagagcggccatgccccgagtgaacctggcggcagcgcaaaagatg

SEQ ID NO: 154348 - DNA, 103 bp, Artificial Sequence
  Synthetic Polynucleotide
taatacgactcactatagggccctcctcctgctccgggcagcagcggcctaacagaggagaaggccgatgctgcccggaaacctggcggcagcgcaaaagatg

SEQ ID NO: 154349 - DNA, 103 bp, Artificial Sequence
  Synthetic Polynucleotide
taatacgactcactatagggtcgccgccaaggccgctgccgccactcgggaacagaggagacccgagatgcggcagcggaacctggcggcagcgcaaaagatg

SEQ ID NO: 154350 - DNA, 103 bp, Artificial Sequence
  Synthetic Polynucleotide
taatacgactcactataggggccgccgccgtcgccgccaaggccgctgccaacagaggagaggcagcatgcttggcggcaacctggcggcagcgcaaaagatg

SEQ ID NO: 154351 - DNA, 103 bp, Artificial Sequence
  Synthetic Polynucleotide
taatacgactcactatagggcgccgccgcagccgccgccgtcgccgccaaaacagaggagattggcgatgacggcggcgaacctggcggcagcgcaaaagatg

SEQ ID NO: 154352 - DNA, 103 bp, Artificial Sequence
  Synthetic Polynucleotide
taatacgactcactatagggccgctgccgccgccgccgcagccgccgccgaacagaggagacggcggatgctgcggcggaacctggcggcagcgcaaaagatg

SEQ ID NO: 154353 - DNA, 103 bp, Artificial Sequence
  Synthetic Polynucleotide
taatacgactcactataggggccgccgccaccgctgccgccgccgccgcaaacagaggagatgcggcatgggcggcagcaacctggcggcagcgcaaaagatg

SEQ ID NO: 154354 - DNA, 103 bp, Artificial Sequence
  Synthetic Polynucleotide
taatacgactcactataggggccggggggcgccgccgccaccgctgccgcaacagaggagagcggcaatggtggcggcgaacctggcggcagcgcaaaagatg

SEQ ID NO: 154355 - DNA, 103 bp, Artificial Sequence
  Synthetic Polynucleotide
taatacgactcactatagggaccggctcccgccggggggcgccgccgccaaacagaggagatggcggatgcgccccccgaacctggcggcagcgcaaaagatg

SEQ ID NO: 154356 - DNA, 103 bp, Artificial Sequence
  Synthetic Polynucleotide
taatacgactcactatagggcgggaaagggaccggctcccgccggggggcaacagaggagagcccccatgcgggagccgaacctggcggcagcgcaaaagatg

SEQ ID NO: 154357 - DNA, 103 bp, Artificial Sequence
  Synthetic Polynucleotide
taatacgactcactatagggcgctccccgacgggaaagggaccggctcccaacagaggagagggagcatgtccctttccaacctggcggcagcgcaaaagatg

SEQ ID NO: 154358 - DNA, 103 bp, Artificial Sequence
  Synthetic Polynucleotide
taatacgactcactatagggcccggccccgcgctccccgacgggaaagggaacagaggagaccctttatggtcggggagaacctggcggcagcgcaaaagatg

SEQ ID NO: 154359 - DNA, 103 bp, Artificial Sequence
  Synthetic Polynucleotide
taatacgactcactatagggcgcactctccccctcctcctgctccgggcaaacagaggagatgcccgatgcaggaggagaacctggcggcagcgcaaaagatg

SEQ ID NO: 154360 - DNA, 103 bp, Artificial Sequence
  Synthetic Polynucleotide
taatacgactcactatagggtcccctgggccccggccccgcgctccccgaaacagaggagatcggggatggcggggccgaacctggcggcagcgcaaaagatg

SEQ ID NO: 154361 - DNA, 103 bp, Artificial Sequence
  Synthetic Polynucleotide
taatacgactcactatagggtggcccggggtcccctgggccccggccccgaacagaggagacggggcatgggcccagggaacctggcggcagcgcaaaagatg

SEQ ID NO: 154362 - DNA, 103 bp, Artificial Sequence
  Synthetic Polynucleotide
taatacgactcactatagggccgctctccgtggcccggggtcccctgggcaacagaggagagcccagatgaccccgggcaacctggcggcagcgcaaaagatg

SEQ ID NO: 154363 - DNA, 103 bp, Artificial Sequence
  Synthetic Polynucleotide
taatacgactcactatagggcatcctcttcccgctctccgtggcccggggaacagaggagaccccggatgacggagagcaacctggcggcagcgcaaaagatg

SEQ ID NO: 154364 - DNA, 103 bp, Artificial Sequence
  Synthetic Polynucleotide
taatacgactcactatagggccgggcaatccatcctcttcccgctctccgaacagaggagacggagaatgggaagaggaaacctggcggcagcgcaaaagatg

SEQ ID NO: 154365 - DNA, 103 bp, Artificial Sequence
  Synthetic Polynucleotide
taatacgactcactatagggggggggagggccgggcaatccatcctcttcaacagaggagagaagagatgggattgcccaacctggcggcagcgcaaaagatg

SEQ ID NO: 154366 - DNA, 103 bp, Artificial Sequence
  Synthetic Polynucleotide
taatacgactcactatagggcttccatccgggggggagggccgggcaatcaacagaggagagattgcatggccctccccaacctggcggcagcgcaaaagatg

SEQ ID NO: 154367 - DNA, 103 bp, Artificial Sequence
  Synthetic Polynucleotide
taatacgactcactatagggcttcctccttcttccatccgggggggagggaacagaggagaccctccatgccggatggaaacctggcggcagcgcaaaagatg

SEQ ID NO: 154368 - DNA, 103 bp, Artificial Sequence
  Synthetic Polynucleotide
taatacgactcactatagggtttcggatcacttcctccttcttccatccgaacagaggagacggatgatggaaggaggaaacctggcggcagcgcaaaagatg

SEQ ID NO: 154369 - DNA, 103 bp, Artificial Sequence
  Synthetic Polynucleotide
taatacgactcactatagggtagcccagattttcggatcacttcctccttaacagaggagaaaggagatggtgatccgaaacctggcggcagcgcaaaagatg

SEQ ID NO: 154370 - DNA, 103 bp, Artificial Sequence
  Synthetic Polynucleotide
taatacgactcactatagggtgccgcccgccgcactctccccctcctcctaacagaggagaaggaggatggggagagtgaacctggcggcagcgcaaaagatg

SEQ ID NO: 154371 - DNA, 103 bp, Artificial Sequence
  Synthetic Polynucleotide
taatacgactcactatagggtgccagcacttagcccagattttcggatcaaacagaggagatgatccatgaatctgggcaacctggcggcagcgcaaaagatg

SEQ ID NO: 154372 - DNA, 103 bp, Artificial Sequence
  Synthetic Polynucleotide
taatacgactcactatagggacatcgctcttgccagcacttagcccagataacagaggagaatctggatgaagtgctggaacctggcggcagcgcaaaagatg

SEQ ID NO: 154373 - DNA, 103 bp, Artificial Sequence
  Synthetic Polynucleotide
taatacgactcactataggggaagtagtagacatcgctcttgccagcactaacagaggagaagtgctatgaagagcgataacctggcggcagcgcaaaagatg

SEQ ID NO: 154374 - DNA, 103 bp, Artificial Sequence
  Synthetic Polynucleotide
taatacgactcactatagggcacttggactgaagtagtagacatcgctctaacagaggagaagagcgatgtctactactaacctggcggcagcgcaaaagatg

SEQ ID NO: 154375 - DNA, 103 bp, Artificial Sequence
  Synthetic Polynucleotide
taatacgactcactatagggaacttcttaccacttggactgaagtagtagaacagaggagactactaatgcagtccaagaacctggcggcagcgcaaaagatg

SEQ ID NO: 154376 - DNA, 103 bp, Artificial Sequence
  Synthetic Polynucleotide
taatacgactcactatagggcttgcttctgaacttcttaccacttggactaacagaggagaagtccaatgggtaagaagaacctggcggcagcgcaaaagatg

SEQ ID NO: 154377 - DNA, 103 bp, Artificial Sequence
  Synthetic Polynucleotide
taatacgactcactatagggccaactgaggcttgcttctgaacttcttacaacagaggagagtaagaatgtcagaagcaaacctggcggcagcgcaaaagatg

SEQ ID NO: 154378 - DNA, 103 bp, Artificial Sequence
  Synthetic Polynucleotide
taatacgactcactatagggaggtaccttgccaactgaggcttgcttctgaacagaggagacagaagatggcctcagttaacctggcggcagcgcaaaagatg

SEQ ID NO: 154379 - DNA, 103 bp, Artificial Sequence
  Synthetic Polynucleotide
taatacgactcactatagggagtatttcccaggtaccttgccaactgaggaacagaggagacctcagatggcaaggtacaacctggcggcagcgcaaaagatg

SEQ ID NO: 154380 - DNA, 103 bp, Artificial Sequence
  Synthetic Polynucleotide
taatacgactcactatagggtgagatcaacagtatttcccaggtaccttgaacagaggagacaaggtatgtgggaaataaacctggcggcagcgcaaaagatg

SEQ ID NO: 154381 - DNA, 103 bp, Artificial Sequence
  Synthetic Polynucleotide
taatacgactcactatagggccagcgccgctgccgcccgccgcactctccaacagaggagaggagagatgggcgggcggaacctggcggcagcgcaaaagatg

SEQ ID NO: 154382 - DNA, 103 bp, Artificial Sequence
  Synthetic Polynucleotide
taatacgactcactatagggtcaaaactgctgagatcaacagtatttcccaacagaggagagggaaaatgtgttgatctaacctggcggcagcgcaaaagatg

SEQ ID NO: 154383 - DNA, 103 bp, Artificial Sequence
  Synthetic Polynucleotide
taatacgactcactatagggagttctgaagtcaaaactgctgagatcaacaacagaggagagttgatatgagcagttttaacctggcggcagcgcaaaagatg

SEQ ID NO: 154384 - DNA, 103 bp, Artificial Sequence
  Synthetic Polynucleotide
taatacgactcactatagggtcatctttccagttctgaagtcaaaactgcaacagaggagagcagttatgacttcagaaaacctggcggcagcgcaaaagatg

SEQ ID NO: 154385 - DNA, 103 bp, Artificial Sequence
  Synthetic Polynucleotide
taatacgactcactatagggttactaggcatcatctttccagttctgaagaacagaggagacttcagatgtggaaagataacctggcggcagcgcaaaagatg

SEQ ID NO: 154386 - DNA, 103 bp, Artificial Sequence
  Synthetic Polynucleotide
taatacgactcactatagggcttctgtaatttactaggcatcatctttccaacagaggagaggaaagatgatgcctagtaacctggcggcagcgcaaaagatg

SEQ ID NO: 154387 - DNA, 103 bp, Artificial Sequence
  Synthetic Polynucleotide
taatacgactcactatagggtctgtttgttcttctgtaatttactaggcaaacagaggagatgcctaatgaattacagaaacctggcggcagcgcaaaagatg

SEQ ID NO: 154388 - DNA, 103 bp, Artificial Sequence
  Synthetic Polynucleotide
taatacgactcactatagggtttcgcagtctctgtttgttcttctgtaataacagaggagaattacaatggaacaaacaaacctggcggcagcgcaaaagatg

SEQ ID NO: 154389 - DNA, 103 bp, Artificial Sequence
  Synthetic Polynucleotide
taatacgactcactataggggagaggatcgtttcgcagtctctgtttgttaacagaggagaaacaaaatgagactgcgaaacctggcggcagcgcaaaagatg

SEQ ID NO: 154390 - DNA, 103 bp, Artificial Sequence
  Synthetic Polynucleotide
taatacgactcactatagggtattttgattgagaggatcgtttcgcagtcaacagaggagagactgcatgacgatcctcaacctggcggcagcgcaaaagatg

SEQ ID NO: 154391 - DNA, 103 bp, Artificial Sequence
  Synthetic Polynucleotide
taatacgactcactatagggggtttacccttattttgattgagaggatcgaacagaggagacgatccatgcaatcaaaaaacctggcggcagcgcaaaagatg

SEQ ID NO: 154392 - DNA, 103 bp, Artificial Sequence
  Synthetic Polynucleotide
taatacgactcactatagggggagtcgccgccagcgccgctgccgcccgcaacagaggagagcgggcatgagcggcgctaacctggcggcagcgcaaaagatg

SEQ ID NO: 154393 - DNA, 103 bp, Artificial Sequence
  Synthetic Polynucleotide
taatacgactcactatagggattcaagtctggtttacccttattttgattaacagaggagaaatcaaatgaagggtaaaaacctggcggcagcgcaaaagatg

SEQ ID NO: 154394 - DNA, 103 bp, Artificial Sequence
  Synthetic Polynucleotide
taatacgactcactataggggcaatgttgtattcaagtctggtttaccctaacagaggagaagggtaatgcagacttgaaacctggcggcagcgcaaaagatg

SEQ ID NO: 154395 - DNA, 103 bp, Artificial Sequence
  Synthetic Polynucleotide
taatacgactcactatagggtgtctaattggcaatgttgtattcaagtctaacagaggagaagacttatgtacaacattaacctggcggcagcgcaaaagatg

SEQ ID NO: 154396 - DNA, 103 bp, Artificial Sequence
  Synthetic Polynucleotide
taatacgactcactatagggtgatgctgtttgtctaattggcaatgttgtaacagaggagaacaacaatgccaattagaaacctggcggcagcgcaaaagatg

SEQ ID NO: 154397 - DNA, 103 bp, Artificial Sequence
  Synthetic Polynucleotide
taatacgactcactataggggtttgaaaattgatgctgtttgtctaattgaacagaggagacaattaatgaaacagcataacctggcggcagcgcaaaagatg

SEQ ID NO: 154398 - DNA, 103 bp, Artificial Sequence
  Synthetic Polynucleotide
taatacgactcactataggggttaccggttgtttgaaaattgatgctgttaacagaggagaaacagcatgaattttcaaaacctggcggcagcgcaaaagatg

SEQ ID NO: 154399 - DNA, 103 bp, Artificial Sequence
  Synthetic Polynucleotide
taatacgactcactatagggtgtgactttggttaccggttgtttgaaaataacagaggagaattttcatgcaaccggtaaacctggcggcagcgcaaaagatg

SEQ ID NO: 154400 - DNA, 103 bp, Artificial Sequence
  Synthetic Polynucleotide
taatacgactcactatagggtaggatgatttgtgactttggttaccggttaacagaggagaaaccggatgccaaagtcaaacctggcggcagcgcaaaagatg

SEQ ID NO: 154401 - DNA, 103 bp, Artificial Sequence
  Synthetic Polynucleotide
taatacgactcactatagggactttattactaggatgatttgtgactttgaacagaggagacaaagtatgaaatcatccaacctggcggcagcgcaaaagatg

SEQ ID NO: 154402 - DNA, 103 bp, Artificial Sequence
  Synthetic Polynucleotide
taatacgactcactataggggtctgatttcactttattactaggatgattaacagaggagaaatcatatgagtaataaaaacctggcggcagcgcaaaagatg

SEQ ID NO: 154403 - DNA, 103 bp, Artificial Sequence
  Synthetic Polynucleotide
taatacgactcactataggggctctatggcggagtcgccgccagcgccgcaacagaggagagcggcgatggcggcgactaacctggcggcagcgcaaaagatg

SEQ ID NO: 154404 - DNA, 103 bp, Artificial Sequence
  Synthetic Polynucleotide
taatacgactcactatagggttcgttgtgggtctgatttcactttattacaacagaggagagtaataatgtgaaatcagaacctggcggcagcgcaaaagatg

SEQ ID NO: 154405 - DNA, 103 bp, Artificial Sequence
  Synthetic Polynucleotide
taatacgactcactatagggtgttcattcattcgttgtgggtctgatttcaacagaggagagaaatcatgcccacaacgaacctggcggcagcgcaaaagatg

SEQ ID NO: 154406 - DNA, 103 bp, Artificial Sequence
  Synthetic Polynucleotide
taatacgactcactatagggctgacgtggctgttcattcattcgttgtggaacagaggagaccacaaatgatgaatgaaaacctggcggcagcgcaaaagatg

SEQ ID NO: 154407 - DNA, 103 bp, Artificial Sequence
  Synthetic Polynucleotide
taatacgactcactatagggcccagaaaagctgacgtggctgttcattcaaacagaggagatgaatgatgagccacgtcaacctggcggcagcgcaaaagatg

SEQ ID NO: 154408 - DNA, 103 bp, Artificial Sequence
  Synthetic Polynucleotide
taatacgactcactatagggagcctcttctcccagaaaagctgacgtggcaacagaggagagccacgatggcttttctgaacctggcggcagcgcaaaagatg

SEQ ID NO: 154409 - DNA, 103 bp, Artificial Sequence
  Synthetic Polynucleotide
taatacgactcactatagggaagtccttgtagcctcttctcccagaaaagaacagaggagacttttcatggagaagaggaacctggcggcagcgcaaaagatg

SEQ ID NO: 154410 - DNA, 103 bp, Artificial Sequence
  Synthetic Polynucleotide
taatacgactcactatagggctgatgcactaagtccttgtagcctcttctaacagaggagaagaagaatgtacaaggacaacctggcggcagcgcaaaagatg

SEQ ID NO: 154411 - DNA, 103 bp, Artificial Sequence
  Synthetic Polynucleotide
taatacgactcactatagggtctgttacatctgatgcactaagtccttgtaacagaggagaacaaggatgtagtgcatcaacctggcggcagcgcaaaagatg

SEQ ID NO: 154412 - DNA, 103 bp, Artificial Sequence
  Synthetic Polynucleotide
taatacgactcactatagggtataatttgttctgttacatctgatgcactaacagaggagaagtgcaatggatgtaacaaacctggcggcagcgcaaaagatg

SEQ ID NO: 154413 - DNA, 103 bp, Artificial Sequence
  Synthetic Polynucleotide
taatacgactcactatagggccatggtttttataatttgttctgttacataacagaggagaatgtaaatgaacaaattaaacctggcggcagcgcaaaagatg

SEQ ID NO: 154414 - DNA, 103 bp, Artificial Sequence
  Synthetic Polynucleotide
taatacgactcactatagggtggcccccctgctctatggcggagtcgccgaacagaggagacggcgaatgcgccatagaaacctggcggcagcgcaaaagatg

SEQ ID NO: 154415 - DNA, 103 bp, Artificial Sequence
  Synthetic Polynucleotide
taatacgactcactatagggttgggtagttccatggtttttataatttgtaacagaggagaacaaatatgaaaaaccataacctggcggcagcgcaaaagatg

SEQ ID NO: 154416 - DNA, 103 bp, Artificial Sequence
  Synthetic Polynucleotide
taatacgactcactatagggttgaagacctttgggtagttccatggttttaacagaggagaaaaaccatggaactacccaacctggcggcagcgcaaaagatg

SEQ ID NO: 154417 - DNA, 103 bp, Artificial Sequence
  Synthetic Polynucleotide
taatacgactcactataggggaccaactccttgaagacctttgggtagttaacagaggagaaactacatgaaggtcttcaacctggcggcagcgcaaaagatg

SEQ ID NO: 154418 - DNA, 103 bp, Artificial Sequence
  Synthetic Polynucleotide
taatacgactcactatagggttgctacctggaccaactccttgaagacctaacagaggagaaggtctatgaggagttggaacctggcggcagcgcaaaagatg

SEQ ID NO: 154419 - DNA, 103 bp, Artificial Sequence
  Synthetic Polynucleotide
taatacgactcactatagggggtctcatcattgctacctggaccaactccaacagaggagaggagttatgccaggtagcaacctggcggcagcgcaaaagatg

SEQ ID NO: 154420 - DNA, 103 bp, Artificial Sequence
  Synthetic Polynucleotide
taatacgactcactatagggcagataaaagggtctcatcattgctacctgaacagaggagacaggtaatgatgatgagaaacctggcggcagcgcaaaagatg

SEQ ID NO: 154421 - DNA, 103 bp, Artificial Sequence
  Synthetic Polynucleotide
taatacgactcactatagggctggcaacagcagataaaagggtctcatcaaacagaggagatgatgaatgccttttatcaacctggcggcagcgcaaaagatg

SEQ ID NO: 154422 - DNA, 103 bp, Artificial Sequence
  Synthetic Polynucleotide
taatacgactcactataggggtgcaaagcactggcaacagcagataaaagaacagaggagacttttaatggctgttgccaacctggcggcagcgcaaaagatg

SEQ ID NO: 154423 - DNA, 103 bp, Artificial Sequence
  Synthetic Polynucleotide
taatacgactcactatagggcagagcttgtgtgcaaagcactggcaacagaacagaggagactgttgatggtgctttgcaacctggcggcagcgcaaaagatg

SEQ ID NO: 154424 - DNA, 103 bp, Artificial Sequence
  Synthetic Polynucleotide
taatacgactcactataggggtgattggcgcagagcttgtgtgcaaagcaaacagaggagatgctttatgcacaagctcaacctggcggcagcgcaaaagatg

SEQ ID NO: 154425 - DNA, 103 bp, Artificial Sequence
  Synthetic Polynucleotide
taatacgactcactatagggcttcttcccgctcgggctcttccgctccataacagaggagaatggagatgaagagcccgaacctggcggcagcgcaaaagatg

SEQ ID NO: 154426 - DNA, 103 bp, Artificial Sequence
  Synthetic Polynucleotide
taatacgactcactataggggctcatcagcatcttgcccgtgcggaagtcaacagaggagagacttcatgacgggcaagaacctggcggcagcgcaaaagatg

SEQ ID NO: 154427 - DNA, 103 bp, Artificial Sequence
  Synthetic Polynucleotide
taatacgactcactatagggtgttcatcttgctcatcagcatcttgcccgaacagaggagacgggcaatgtgctgatgaaacctggcggcagcgcaaaagatg

SEQ ID NO: 154428 - DNA, 103 bp, Artificial Sequence
  Synthetic Polynucleotide
taatacgactcactatagggtggcggctcttgttcatcttgctcatcagcaacagaggagagctgatatgcaagatgaaaacctggcggcagcgcaaaagatg

SEQ ID NO: 154429 - DNA, 103 bp, Artificial Sequence
  Synthetic Polynucleotide
taatacgactcactataggggcgcacgcgctggcggctcttgttcatcttaacagaggagaaagatgatgaagagccgcaacctggcggcagcgcaaaagatg

SEQ ID NO: 154430 - DNA, 103 bp, Artificial Sequence
  Synthetic Polynucleotide
taatacgactcactatagggaggagtcgtagcgcacgcgctggcggctctaacagaggagaagagccatgagcgcgtgcaacctggcggcagcgcaaaagatg

SEQ ID NO: 154431 - DNA, 103 bp, Artificial Sequence
  Synthetic Polynucleotide
taatacgactcactatagggacctggttggaggagtcgtagcgcacgcgcaacagaggagagcgcgtatgctacgactcaacctggcggcagcgcaaaagatg

SEQ ID NO: 154432 - DNA, 103 bp, Artificial Sequence
  Synthetic Polynucleotide
taatacgactcactatagggcttgcccttgacctggttggaggagtcgtaaacagaggagatacgacatgtccaaccagaacctggcggcagcgcaaaagatg

SEQ ID NO: 154433 - DNA, 103 bp, Artificial Sequence
  Synthetic Polynucleotide
taatacgactcactatagggtcaggtcgggcttgcccttgacctggttggaacagaggagaccaaccatgtcaagggcaaacctggcggcagcgcaaaagatg

SEQ ID NO: 154434 - DNA, 103 bp, Artificial Sequence
  Synthetic Polynucleotide
taatacgactcactatagggagcgccgtgttcaggtcgggcttgcccttgaacagaggagacaagggatggcccgacctaacctggcggcagcgcaaaagatg

SEQ ID NO: 154435 - DNA, 103 bp, Artificial Sequence
  Synthetic Polynucleotide
taatacgactcactataggggcgcacgggcagcgccgtgttcaggtcgggaacagaggagacccgacatgaacacggcgaacctggcggcagcgcaaaagatg

SEQ ID NO: 154436 - DNA, 103 bp, Artificial Sequence
  Synthetic Polynucleotide
taatacgactcactatagggtgctgcggaacttcttcccgctcgggctctaacagaggagaagagccatggcgggaagaaacctggcggcagcgcaaaagatg

SEQ ID NO: 154437 - DNA, 103 bp, Artificial Sequence
  Synthetic Polynucleotide
taatacgactcactatagggacgccgtctggcgcacgggcagcgccgtgtaacagaggagaacacggatgtgcccgtgcaacctggcggcagcgcaaaagatg

SEQ ID NO: 154438 - DNA, 103 bp, Artificial Sequence
  Synthetic Polynucleotide
taatacgactcactatagggttgaagatggacgccgtctggcgcacgggcaacagaggagagcccgtatgccagacggcaacctggcggcagcgcaaaagatg

SEQ ID NO: 154439 - DNA, 103 bp, Artificial Sequence
  Synthetic Polynucleotide
taatacgactcactatagggcaccggctgcttgaagatggacgccgtctgaacagaggagacagacgatgtccatcttcaacctggcggcagcgcaaaagatg

SEQ ID NO: 154440 - DNA, 103 bp, Artificial Sequence
  Synthetic Polynucleotide
taatacgactcactatagggtaatcttggtcaccggctgcttgaagatggaacagaggagaccatctatgagcagccggaacctggcggcagcgcaaaagatg

SEQ ID NO: 154441 - DNA, 103 bp, Artificial Sequence
  Synthetic Polynucleotide
taatacgactcactataggggggtggttggtaatcttggtcaccggctgcaacagaggagagcagccatggaccaagataacctggcggcagcgcaaaagatg

SEQ ID NO: 154442 - DNA, 103 bp, Artificial Sequence
  Synthetic Polynucleotide
taatacgactcactatagggcttgttgctggggtggttggtaatcttggtaacagaggagaaccaagatgaccaaccacaacctggcggcagcgcaaaagatg

SEQ ID NO: 154443 - DNA, 103 bp, Artificial Sequence
  Synthetic Polynucleotide
taatacgactcactatagggcgctcttgaccttgttgctggggtggttggaacagaggagaccaaccatgccagcaacaaacctggcggcagcgcaaaagatg

SEQ ID NO: 154444 - DNA, 103 bp, Artificial Sequence
  Synthetic Polynucleotide
taatacgactcactatagggttctgcgggtcgctcttgaccttgttgctgaacagaggagacagcaaatgggtcaagagaacctggcggcagcgcaaaagatg

SEQ ID NO: 154445 - DNA, 103 bp, Artificial Sequence
  Synthetic Polynucleotide
taatacgactcactataggggtccaccgccttctgcgggtcgctcttgacaacagaggagagtcaagatggacccgcagaacctggcggcagcgcaaaagatg

SEQ ID NO: 154446 - DNA, 103 bp, Artificial Sequence
  Synthetic Polynucleotide
taatacgactcactatagggggcgcggctggtccaccgccttctgcgggtaacagaggagaacccgcatgaggcggtggaacctggcggcagcgcaaaagatg

SEQ ID NO: 154447 - DNA, 103 bp, Artificial Sequence
  Synthetic Polynucleotide
taatacgactcactatagggagctgcggcttgctgcggaacttcttcccgaacagaggagacgggaaatggttccgcagaacctggcggcagcgcaaaagatg

SEQ ID NO: 154448 - DNA, 103 bp, Artificial Sequence
  Synthetic Polynucleotide
taatacgactcactatagggcagaagagctggcgcggctggtccaccgccaacagaggagaggcggtatgccagccgcgaacctggcggcagcgcaaaagatg

SEQ ID NO: 154449 - DNA, 103 bp, Artificial Sequence
  Synthetic Polynucleotide
taatacgactcactatagggcttcttctcccagaagagctggcgcggctgaacagaggagacagccgatgcagctcttcaacctggcggcagcgcaaaagatg

SEQ ID NO: 154450 - DNA, 103 bp, Artificial Sequence
  Synthetic Polynucleotide
taatacgactcactatagggggccgctcagcttcttctcccagaagagctaacagaggagaagctctatggggagaagaaacctggcggcagcgcaaaagatg

SEQ ID NO: 154451 - DNA, 103 bp, Artificial Sequence
  Synthetic Polynucleotide
taatacgactcactatagggaaggcgttcaggccgctcagcttcttctccaacagaggagaggagaaatggctgagcggaacctggcggcagcgcaaaagatg

SEQ ID NO: 154452 - DNA, 103 bp, Artificial Sequence
  Synthetic Polynucleotide
taatacgactcactatagggagcaatgtcgaaggcgttcaggccgctcagaacagaggagactgagcatgctgaacgccaacctggcggcagcgcaaaagatg

SEQ ID NO: 154453 - DNA, 103 bp, Artificial Sequence
  Synthetic Polynucleotide
taatacgactcactatagggccagctcctcagcaatgtcgaaggcgttcaaacagaggagatgaacgatgtcgacattgaacctggcggcagcgcaaaagatg

SEQ ID NO: 154454 - DNA, 103 bp, Artificial Sequence
  Synthetic Polynucleotide
taatacgactcactatagggatggtcttgaccagctcctcagcaatgtcgaacagaggagacgacatatgtgaggagctaacctggcggcagcgcaaaagatg

SEQ ID NO: 154455 - DNA, 103 bp, Artificial Sequence
  Synthetic Polynucleotide
taatacgactcactatagggggggaggtccatggtcttgaccagctcctcaacagaggagagaggagatggtcaagaccaacctggcggcagcgcaaaagatg

SEQ ID NO: 154456 - DNA, 103 bp, Artificial Sequence
  Synthetic Polynucleotide
taatacgactcactataggggcaggcccttggggaggtccatggtcttgaaacagaggagatcaagaatgtggacctccaacctggcggcagcgcaaaagatg

SEQ ID NO: 154457 - DNA, 103 bp, Artificial Sequence
  Synthetic Polynucleotide
taatacgactcactatagggcccaccccctgcaggcccttggggaggtccaacagaggagaggacctatgcaagggcctaacctggcggcagcgcaaaagatg

SEQ ID NO: 154458 - DNA, 103 bp, Artificial Sequence
  Synthetic Polynucleotide
taatacgactcactataggggtagcgcgccagctgcggcttgctgcggaaaacagaggagattccgcatgaagccgcagaacctggcggcagcgcaaaagatg

SEQ ID NO: 154459 - DNA, 103 bp, Artificial Sequence
  Synthetic Polynucleotide
taatacgactcactataggggcagccaggtcccaccccctgcaggcccttaacagaggagaaagggcatgcagggggtgaacctggcggcagcgcaaaagatg

SEQ ID NO: 154460 - DNA, 103 bp, Artificial Sequence
  Synthetic Polynucleotide
taatacgactcactatagggtctcatccgtgcagccaggtcccaccccctaacagaggagaagggggatggacctggctaacctggcggcagcgcaaaagatg

SEQ ID NO: 154461 - DNA, 103 bp, Artificial Sequence
  Synthetic Polynucleotide
taatacgactcactataggggacagcagcgtctcatccgtgcagccaggtaacagaggagaacctggatgcacggatgaaacctggcggcagcgcaaaagatg

SEQ ID NO: 154462 - DNA, 103 bp, Artificial Sequence
  Synthetic Polynucleotide
taatacgactcactatagggggcgatggccgacagcagcgtctcatccgtaacagaggagaacggatatgacgctgctgaacctggcggcagcgcaaaagatg

SEQ ID NO: 154463 - DNA, 103 bp, Artificial Sequence
  Synthetic Polynucleotide
taatacgactcactataggggcagggcgctggcgatggccgacagcagcgaacagaggagacgctgcatgcggccatcgaacctggcggcagcgcaaaagatg

SEQ ID NO: 154464 - DNA, 103 bp, Artificial Sequence
  Synthetic Polynucleotide
taatacgactcactataggggtgctagtgtgcagggcgctggcgatggccaacagaggagaggccatatgcagcgccctaacctggcggcagcgcaaaagatg

SEQ ID NO: 154465 - DNA, 103 bp, Artificial Sequence
  Synthetic Polynucleotide
taatacgactcactataggggatgggcatggtgctagtgtgcagggcgctaacagaggagaagcgccatgcacactagcaacctggcggcagcgcaaaagatg

SEQ ID NO: 154466 - DNA, 103 bp, Artificial Sequence
  Synthetic Polynucleotide
taatacgactcactataggggctgtcccgtgatgggcatggtgctagtgtaacagaggagaacactaatgccatgcccaaacctggcggcagcgcaaaagatg

SEQ ID NO: 154467 - DNA, 103 bp, Artificial Sequence
  Synthetic Polynucleotide
taatacgactcactataggggcggccgagagctgtcccgtgatgggcatgaacagaggagacatgccatgcacgggacaaacctggcggcagcgcaaaagatg

SEQ ID NO: 154468 - DNA, 103 bp, Artificial Sequence
  Synthetic Polynucleotide
taatacgactcactatagggcttctccacggcggccgagagctgtcccgtaacagaggagaacgggaatgctctcggccaacctggcggcagcgcaaaagatg

SEQ ID NO: 154469 - DNA, 103 bp, Artificial Sequence
  Synthetic Polynucleotide
taatacgactcactatagggagccgcccaggtagcgcgccagctgcggctaacagaggagaagccgcatgtggcgcgctaacctggcggcagcgcaaaagatg

SEQ ID NO: 154470 - DNA, 103 bp, Artificial Sequence
  Synthetic Polynucleotide
taatacgactcactatagggcgccggggttcttctccacggcggccgagaaacagaggagatctcggatgccgtggagaaacctggcggcagcgcaaaagatg

SEQ ID NO: 154471 - DNA, 103 bp, Artificial Sequence
  Synthetic Polynucleotide
taatacgactcactatagggttgagccatacgccggggttcttctccacgaacagaggagacgtggaatggaaccccggaacctggcggcagcgcaaaagatg

SEQ ID NO: 154472 - DNA, 103 bp, Artificial Sequence
  Synthetic Polynucleotide
taatacgactcactatagggctgcgtggtgttgagccatacgccggggttaacagaggagaaaccccatggtatggctcaacctggcggcagcgcaaaagatg

SEQ ID NO: 154473 - DNA, 103 bp, Artificial Sequence
  Synthetic Polynucleotide
taatacgactcactatagggtgcacaggggctgcgtggtgttgagccataaacagaggagatatggcatgacaccacgcaacctggcggcagcgcaaaagatg

SEQ ID NO: 154474 - DNA, 103 bp, Artificial Sequence
  Synthetic Polynucleotide
taatacgactcactatagggatgaaggctttgcacaggggctgcgtggtgaacagaggagacaccacatggcccctgtgaacctggcggcagcgcaaaagatg

SEQ ID NO: 154475 - DNA, 103 bp, Artificial Sequence
  Synthetic Polynucleotide
taatacgactcactataggggtcggtcaccatgaaggctttgcacaggggaacagaggagacccctgatgaaagccttcaacctggcggcagcgcaaaagatg

SEQ ID NO: 154476 - DNA, 103 bp, Artificial Sequence
  Synthetic Polynucleotide
taatacgactcactatagggtgatgtcctcgtcggtcaccatgaaggcttaacagaggagaaagcctatgtggtgaccgaacctggcggcagcgcaaaagatg

SEQ ID NO: 154477 - DNA, 103 bp, Artificial Sequence
  Synthetic Polynucleotide
taatacgactcactatagggtcctgcttcctgatgtcctcgtcggtcaccaacagaggagaggtgacatgcgaggacataacctggcggcagcgcaaaagatg

SEQ ID NO: 154478 - DNA, 103 bp, Artificial Sequence
  Synthetic Polynucleotide
taatacgactcactatagggcaccagctcttcctgcttcctgatgtcctcaacagaggagagaggacatgaggaagcagaacctggcggcagcgcaaaagatg

SEQ ID NO: 154479 - DNA, 103 bp, Artificial Sequence
  Synthetic Polynucleotide
taatacgactcactataggggcacctgctgcaccagctcttcctgcttccaacagaggagaggaagcatgaagagctggaacctggcggcagcgcaaaagatg

SEQ ID NO: 154480 - DNA, 103 bp, Artificial Sequence
  Synthetic Polynucleotide
taatacgactcactatagggaggtccatggagccgcccaggtagcgcgccaacagaggagaggcgcgatgcctgggcggaacctggcggcagcgcaaaagatg

SEQ ID NO: 154481 - DNA, 103 bp, Artificial Sequence
  Synthetic Polynucleotide
taatacgactcactatagggagccgcttccgcacctgctgcaccagctctaacagaggagaagagctatggcagcaggtaacctggcggcagcgcaaaagatg

SEQ ID NO: 154482 - DNA, 103 bp, Artificial Sequence
  Synthetic Polynucleotide
taatacgactcactatagggcgcctcctccagccgcttccgcacctgctgaacagaggagacagcagatgcggaagcggaacctggcggcagcgcaaaagatg

SEQ ID NO: 154483 - DNA, 103 bp, Artificial Sequence
  Synthetic Polynucleotide
taatacgactcactatagggcggccatcagcgcctcctccagccgcttccaacagaggagaggaagcatgtggaggaggaacctggcggcagcgcaaaagatg

SEQ ID NO: 154484 - DNA, 103 bp, Artificial Sequence
  Synthetic Polynucleotide
taatacgactcactataggggccagcatgtcggccatcagcgcctcctccaacagaggagaggaggaatggctgatggcaacctggcggcagcgcaaaagatg

SEQ ID NO: 154485 - DNA, 103 bp, Artificial Sequence
  Synthetic Polynucleotide
taatacgactcactatagggctccacgtgcgccagcatgtcggccatcagaacagaggagactgatgatggacatgctgaacctggcggcagcgcaaaagatg

SEQ ID NO: 154486 - DNA, 103 bp, Artificial Sequence
  Synthetic Polynucleotide
taatacgactcactataggggggccagctcctccacgtgcgccagcatgtaacagaggagaacatgcatgcgcacgtggaacctggcggcagcgcaaaagatg

SEQ ID NO: 154487 - DNA, 103 bp, Artificial Sequence
  Synthetic Polynucleotide
taatacgactcactatagggtccccgtcacgggccagctcctccacgtgcaacagaggagagcacgtatgggagctggcaacctggcggcagcgcaaaagatg

SEQ ID NO: 154488 - DNA, 103 bp, Artificial Sequence
  Synthetic Polynucleotide
taatacgactcactatagggcagcggcgcctccccgtcacgggccagctcaacagaggagagagctgatgcgtgacgggaacctggcggcagcgcaaaagatg

SEQ ID NO: 154489 - DNA, 103 bp, Artificial Sequence
  Synthetic Polynucleotide
taatacgactcactatagggaggccttgtccagcggcgcctccccgtcacaacagaggagagtgacgatgaggcgccgcaacctggcggcagcgcaaaagatg

SEQ ID NO: 154490 - DNA, 103 bp, Artificial Sequence
  Synthetic Polynucleotide
taatacgactcactatagggtcctcagcgcaggccttgtccagcggcgccaacagaggagaggcgccatgggacaaggcaacctggcggcagcgcaaaagatg

SEQ ID NO: 154491 - DNA, 103 bp, Artificial Sequence
  Synthetic Polynucleotide
taatacgactcactataggggaaggtgctcaggtccatggagccgcccagaacagaggagactgggcatgtccatggacaacctggcggcagcgcaaaagatg

SEQ ID NO: 154492 - DNA, 103 bp, Artificial Sequence
  Synthetic Polynucleotide
taatacgactcactatagggctcgtcgtcgtcctcagcgcaggccttgtcaacagaggagagacaagatgtgcgctgagaacctggcggcagcgcaaaagatg

SEQ ID NO: 154493 - DNA, 103 bp, Artificial Sequence
  Synthetic Polynucleotide
taatacgactcactatagggcctcgtcttcctcgtcgtcgtcctcagcgcaacagaggagagcgctgatgacgacgacgaacctggcggcagcgcaaaagatg

SEQ ID NO: 154494 - DNA, 103 bp, Artificial Sequence
  Synthetic Polynucleotide
taatacgactcactatagggtcctcctcctcctcgtcttcctcgtcgtcgaacagaggagacgacgaatgggaagacgaaacctggcggcagcgcaaaagatg

SEQ ID NO: 154495 - DNA, 103 bp, Artificial Sequence
  Synthetic Polynucleotide
taatacgactcactataggggggctcctcctcctcctcctcctcgtcttcaacagaggagagaagacatggaggaggagaacctggcggcagcgcaaaagatg

SEQ ID NO: 154496 - DNA, 103 bp, Artificial Sequence
  Synthetic Polynucleotide
taatacgactcactatagggggtccgggtcgggctcctcctcctcctcctaacagaggagaaggaggatgaggaggagcaacctggcggcagcgcaaaagatg

SEQ ID NO: 154497 - DNA, 103 bp, Artificial Sequence
  Synthetic Polynucleotide
taatacgactcactatagggtccatctccgggtccgggtcgggctcctccaacagaggagaggaggaatgcgacccggaaacctggcggcagcgcaaaagatg

SEQ ID NO: 154498 - DNA, 103 bp, Artificial Sequence
  Synthetic Polynucleotide
taatacgactcactatagggctagacgtgctccatctccgggtccgggtcaacagaggagagacccgatgccggagatgaacctggcggcagcgcaaaagatg

SEQ ID NO: 154499 - DNA, 103 bp, Artificial Sequence
  Synthetic Polynucleotide
taatacgactcactatagggtgcggaagtcgaaggtgctcaggtccatggaacagaggagaccatggatgtgagcacctaacctggcggcagcgcaaaagatg

SEQ ID NO: 154500 - DNA, 103 bp, Artificial Sequence
  Synthetic Polynucleotide
taatacgactcactatagggatcttgcccgtgcggaagtcgaaggtgctcaacagaggagagagcacatgcgacttccgaacctggcggcagcgcaaaagatg

SEQ ID NO: 154501 - DNA, 103 bp, Artificial Sequence
  Synthetic Polynucleotide
taatacgactcactatagggtgactcctcggtttccccctgagctttcataacagaggagaatgaaaatgcagggggaaaacctggcggcagcgcaaaagatg

SEQ ID NO: 154502 - DNA, 103 bp, Artificial Sequence
  Synthetic Polynucleotide
taatacgactcactatagggcacaagcttaatggtttcactccagggtctaacagaggagaagacccatgagtgaaaccaacctggcggcagcgcaaaagatg

SEQ ID NO: 154503 - DNA, 103 bp, Artificial Sequence
  Synthetic Polynucleotide
taatacgactcactatagggatacaggggtgcataagttggttgagtttcaacagaggagagaaactatgccaacttataacctggcggcagcgcaaaagatg

SEQ ID NO: 154504 - DNA, 103 bp, Artificial Sequence
  Synthetic Polynucleotide
taatacgactcactatagggtgatcagttcatacaggggtgcataagttgaacagaggagacaacttatgcacccctgtaacctggcggcagcgcaaaagatg

SEQ ID NO: 154505 - DNA, 103 bp, Artificial Sequence
  Synthetic Polynucleotide
taatacgactcactatagggtcaaactgagtgatcagttcatacaggggtaacagaggagaacccctatgtgaactgataacctggcggcagcgcaaaagatg

SEQ ID NO: 154506 - DNA, 103 bp, Artificial Sequence
  Synthetic Polynucleotide
taatacgactcactatagggctttgatagctcaaactgagtgatcagttcaacagaggagagaactgatgactcagtttaacctggcggcagcgcaaaagatg

SEQ ID NO: 154507 - DNA, 103 bp, Artificial Sequence
  Synthetic Polynucleotide
taatacgactcactatagggggtcagggtcctttgatagctcaaactgagaacagaggagactcagtatgagctatcaaaacctggcggcagcgcaaaagatg

SEQ ID NO: 154508 - DNA, 103 bp, Artificial Sequence
  Synthetic Polynucleotide
taatacgactcactatagggaaaggtatggggtcagggtcctttgatagcaacagaggagagctatcatgggaccctgaaacctggcggcagcgcaaaagatg

SEQ ID NO: 154509 - DNA, 103 bp, Artificial Sequence
  Synthetic Polynucleotide
taatacgactcactataggggttgtgattcaaaggtatggggtcagggtcaacagaggagagaccctatgcccatacctaacctggcggcagcgcaaaagatg

SEQ ID NO: 154510 - DNA, 103 bp, Artificial Sequence
  Synthetic Polynucleotide
taatacgactcactatagggaaaatctcatgttgtgattcaaaggtatggaacagaggagaccatacatgtgaatcacaaacctggcggcagcgcaaaagatg

SEQ ID NO: 154511 - DNA, 103 bp, Artificial Sequence
  Synthetic Polynucleotide
taatacgactcactatagggagagcagcataaaatctcatgttgtgattcaacagaggagagaatcaatgcatgagattaacctggcggcagcgcaaaagatg

SEQ ID NO: 154512 - DNA, 103 bp, Artificial Sequence
  Synthetic Polynucleotide
taatacgactcactatagggctgaccaggaagagcagcataaaatctcataacagaggagaatgagaatgtatgctgctaacctggcggcagcgcaaaagatg

SEQ ID NO: 154513 - DNA, 103 bp, Artificial Sequence
  Synthetic Polynucleotide
taatacgactcactatagggtgacttgacgcacaagcttaatggtttcacaacagaggagagtgaaaatgttaagcttgaacctggcggcagcgcaaaagatg

SEQ ID NO: 154514 - DNA, 103 bp, Artificial Sequence
  Synthetic Polynucleotide
taatacgactcactatagggagcagtgctgctgaccaggaagagcagcataacagaggagaatgctgatgttcctggtcaacctggcggcagcgcaaaagatg

SEQ ID NO: 154515 - DNA, 103 bp, Artificial Sequence
  Synthetic Polynucleotide
taatacgactcactatagggttgaggaaatagcagtgctgctgaccaggaaacagaggagatcctggatggcagcactgaacctggcggcagcgcaaaagatg

SEQ ID NO: 154516 - DNA, 103 bp, Artificial Sequence
  Synthetic Polynucleotide
taatacgactcactatagggagcatccttgttgaggaaatagcagtgctgaacagaggagacagcacatgtatttcctcaacctggcggcagcgcaaaagatg

SEQ ID NO: 154517 - DNA, 103 bp, Artificial Sequence
  Synthetic Polynucleotide
taatacgactcactatagggctggaagaggagcatccttgttgaggaaataacagaggagaatttccatgacaaggatgaacctggcggcagcgcaaaagatg

SEQ ID NO: 154518 - DNA, 103 bp, Artificial Sequence
  Synthetic Polynucleotide
taatacgactcactatagggcttcggccatctggaagaggagcatccttgaacagaggagacaaggaatgtcctcttccaacctggcggcagcgcaaaagatg

SEQ ID NO: 154519 - DNA, 103 bp, Artificial Sequence
  Synthetic Polynucleotide
taatacgactcactatagggtccctgtagacttcggccatctggaagaggaacagaggagacctcttatggatggccgaaacctggcggcagcgcaaaagatg

SEQ ID NO: 154520 - DNA, 103 bp, Artificial Sequence
  Synthetic Polynucleotide
taatacgactcactatagggtaacaagggttccctgtagacttcggccataacagaggagaatggccatggtctacaggaacctggcggcagcgcaaaagatg

SEQ ID NO: 154521 - DNA, 103 bp, Artificial Sequence
  Synthetic Polynucleotide
taatacgactcactataggggtgattttgctaacaagggttccctgtagaaacagaggagatctacaatgaacccttgtaacctggcggcagcgcaaaagatg

SEQ ID NO: 154522 - DNA, 103 bp, Artificial Sequence
  Synthetic Polynucleotide
taatacgactcactataggggtgctgaaaggtgattttgctaacaagggtaacagaggagaacccttatgagcaaaatcaacctggcggcagcgcaaaagatg

SEQ ID NO: 154523 - DNA, 103 bp, Artificial Sequence
  Synthetic Polynucleotide
taatacgactcactatagggctcggccagggtgctgaaaggtgattttgcaacagaggagagcaaaaatgcctttcagcaacctggcggcagcgcaaaagatg

SEQ ID NO: 154524 - DNA, 103 bp, Artificial Sequence
  Synthetic Polynucleotide
taatacgactcactatagggctcttctccatgacttgacgcacaagcttaaacagaggagataagctatggcgtcaagtaacctggcggcagcgcaaaagatg

SEQ ID NO: 154525 - DNA, 103 bp, Artificial Sequence
  Synthetic Polynucleotide
taatacgactcactatagggataagaggaactcggccagggtgctgaaagaacagaggagactttcaatgccctggccgaacctggcggcagcgcaaaagatg

SEQ ID NO: 154526 - DNA, 103 bp, Artificial Sequence
  Synthetic Polynucleotide
taatacgactcactatagggcagatttaggataagaggaactcggccaggaacagaggagacctggcatggttcctcttaacctggcggcagcgcaaaagatg

SEQ ID NO: 154527 - DNA, 103 bp, Artificial Sequence
  Synthetic Polynucleotide
taatacgactcactatagggggtgtctgatcagatttaggataagaggaaaacagaggagattcctcatgtcctaaatcaacctggcggcagcgcaaaagatg

SEQ ID NO: 154528 - DNA, 103 bp, Artificial Sequence
  Synthetic Polynucleotide
taatacgactcactatagggtaggccacttggtgtctgatcagatttaggaacagaggagacctaaaatggatcagacaaacctggcggcagcgcaaaagatg

SEQ ID NO: 154529 - DNA, 103 bp, Artificial Sequence
  Synthetic Polynucleotide
taatacgactcactataggggagggtgttataggccacttggtgtctgataacagaggagaatcagaatgcaagtggccaacctggcggcagcgcaaaagatg

SEQ ID NO: 154530 - DNA, 103 bp, Artificial Sequence
  Synthetic Polynucleotide
taatacgactcactatagggagcttccaatgagggtgttataggccacttaacagaggagaaagtggatgataacacccaacctggcggcagcgcaaaagatg

SEQ ID NO: 154531 - DNA, 103 bp, Artificial Sequence
  Synthetic Polynucleotide
taatacgactcactatagggcttttgacacagcttccaatgagggtgttaaacagaggagataacacatgcattggaagaacctggcggcagcgcaaaagatg

SEQ ID NO: 154532 - DNA, 103 bp, Artificial Sequence
  Synthetic Polynucleotide
taatacgactcactatagggcagaatagttcttttgacacagcttccaataacagaggagaattggaatgtgtgtcaaaaacctggcggcagcgcaaaagatg

SEQ ID NO: 154533 - DNA, 103 bp, Artificial Sequence
  Synthetic Polynucleotide
taatacgactcactatagggaatcttctttcagaatagttcttttgacacaacagaggagagtgtcaatggaactattcaacctggcggcagcgcaaaagatg

SEQ ID NO: 154534 - DNA, 103 bp, Artificial Sequence
  Synthetic Polynucleotide
taatacgactcactatagggagcccaggagaatcttctttcagaatagttaacagaggagaaactatatggaaagaagaaacctggcggcagcgcaaaagatg

SEQ ID NO: 154535 - DNA, 103 bp, Artificial Sequence
  Synthetic Polynucleotide
taatacgactcactatagggcatcacaaccctcttctccatgacttgacgaacagaggagacgtcaaatgatggagaagaacctggcggcagcgcaaaagatg

SEQ ID NO: 154536 - DNA, 103 bp, Artificial Sequence
  Synthetic Polynucleotide
taatacgactcactatagggaaattggagaagcccaggagaatcttctttaacagaggagaaaagaaatgtctcctgggaacctggcggcagcgcaaaagatg

SEQ ID NO: 154537 - DNA, 103 bp, Artificial Sequence
  Synthetic Polynucleotide
taatacgactcactataggggacacacttcaaattggagaagcccaggagaacagaggagactcctgatgttctccaataacctggcggcagcgcaaaagatg

SEQ ID NO: 154538 - DNA, 103 bp, Artificial Sequence
  Synthetic Polynucleotide
taatacgactcactatagggtctgagagaggacacacttcaaattggagaaacagaggagatctccaatgtgaagtgtgaacctggcggcagcgcaaaagatg

SEQ ID NO: 154539 - DNA, 103 bp, Artificial Sequence
  Synthetic Polynucleotide
taatacgactcactataggggaaacgagactctgagagaggacacacttcaacagaggagagaagtgatgcctctctcaaacctggcggcagcgcaaaagatg

SEQ ID NO: 154540 - DNA, 103 bp, Artificial Sequence
  Synthetic Polynucleotide
taatacgactcactatagggaagatacgctgaaacgagactctgagagagaacagaggagactctctatgagtctcgttaacctggcggcagcgcaaaagatg

SEQ ID NO: 154541 - DNA, 103 bp, Artificial Sequence
  Synthetic Polynucleotide
taatacgactcactataggggggtgctgaaaagatacgctgaaacgagacaacagaggagagtctcgatgcagcgtatcaacctggcggcagcgcaaaagatg

SEQ ID NO: 154542 - DNA, 103 bp, Artificial Sequence
  Synthetic Polynucleotide
taatacgactcactataggggtcattcacagggtgctgaaaagatacgctaacagaggagaagcgtaatgtttcagcacaacctggcggcagcgcaaaagatg

SEQ ID NO: 154543 - DNA, 103 bp, Artificial Sequence
  Synthetic Polynucleotide
taatacgactcactatagggacaccagggagtcattcacagggtgctgaaaacagaggagattcagcatgctgtgaatgaacctggcggcagcgcaaaagatg

SEQ ID NO: 154544 - DNA, 103 bp, Artificial Sequence
  Synthetic Polynucleotide
taatacgactcactatagggattaccacacacaccagggagtcattcacaaacagaggagatgtgaaatgctccctggtaacctggcggcagcgcaaaagatg

SEQ ID NO: 154545 - DNA, 103 bp, Artificial Sequence
  Synthetic Polynucleotide
taatacgactcactatagggctgcacatccattaccacacacaccagggaaacagaggagatccctgatgtgtgtggtaaacctggcggcagcgcaaaagatg

SEQ ID NO: 154546 - DNA, 103 bp, Artificial Sequence
  Synthetic Polynucleotide
taatacgactcactatagggctccagaactcatcacaaccctcttctccaaacagaggagatggagaatggggttgtgaaacctggcggcagcgcaaaagatg

SEQ ID NO: 154547 - DNA, 103 bp, Artificial Sequence
  Synthetic Polynucleotide
taatacgactcactataggggtgttgagtcctgcacatccattaccacacaacagaggagagtgtggatgtggatgtgcaacctggcggcagcgcaaaagatg

SEQ ID NO: 154548 - DNA, 103 bp, Artificial Sequence
  Synthetic Polynucleotide
taatacgactcactatagggcagctcacatgtgttgagtcctgcacatccaacagaggagaggatgtatgggactcaacaacctggcggcagcgcaaaagatg

SEQ ID NO: 154549 - DNA, 103 bp, Artificial Sequence
  Synthetic Polynucleotide
taatacgactcactataggggtagagtttacagctcacatgtgttgagtcaacagaggagagactcaatgcatgtgagcaacctggcggcagcgcaaaagatg

SEQ ID NO: 154550 - DNA, 103 bp, Artificial Sequence
  Synthetic Polynucleotide
taatacgactcactatagggacagccctttgtagagtttacagctcacataacagaggagaatgtgaatggtaaactctaacctggcggcagcgcaaaagatg

SEQ ID NO: 154551 - DNA, 103 bp, Artificial Sequence
  Synthetic Polynucleotide
taatacgactcactatagggagtgcatccgacagccctttgtagagtttaaacagaggagataaactatgcaaagggctaacctggcggcagcgcaaaagatg

SEQ ID NO: 154552 - DNA, 103 bp, Artificial Sequence
  Synthetic Polynucleotide
taatacgactcactatagggtgtgcagatcagtgcatccgacagccctttaacagaggagaaaagggatgtcggatgcaaacctggcggcagcgcaaaagatg

SEQ ID NO: 154553 - DNA, 103 bp, Artificial Sequence
  Synthetic Polynucleotide
taatacgactcactatagggtgaagtcatctgtgcagatcagtgcatccgaacagaggagacggatgatgtgatctgcaaacctggcggcagcgcaaaagatg

SEQ ID NO: 154554 - DNA, 103 bp, Artificial Sequence
  Synthetic Polynucleotide
taatacgactcactatagggactttggcaatgaagtcatctgtgcagatcaacagaggagagatctgatgagatgacttaacctggcggcagcgcaaaagatg

SEQ ID NO: 154555 - DNA, 103 bp, Artificial Sequence
  Synthetic Polynucleotide
taatacgactcactatagggtctttgaacaactttggcaatgaagtcatcaacagaggagagatgacatgattgccaaaaacctggcggcagcgcaaaagatg

SEQ ID NO: 154556 - DNA, 103 bp, Artificial Sequence
  Synthetic Polynucleotide
taatacgactcactatagggtggacatacatctttgaacaactttggcaaaacagaggagattgccaatgttgttcaaaaacctggcggcagcgcaaaagatg

SEQ ID NO: 154557 - DNA, 103 bp, Artificial Sequence
  Synthetic Polynucleotide
taatacgactcactatagggtgttgatgccctccagaactcatcacaaccaacagaggagaggttgtatggagttctggaacctggcggcagcgcaaaagatg

SEQ ID NO: 154558 - DNA, 103 bp, Artificial Sequence
  Synthetic Polynucleotide
taatacgactcactataggggtcacagggatggacatacatctttgaacaaacagaggagatgttcaatgatgtatgtcaacctggcggcagcgcaaaagatg

SEQ ID NO: 154559 - DNA, 103 bp, Artificial Sequence
  Synthetic Polynucleotide
taatacgactcactatagggagccctcatcgtcacagggatggacatacaaacagaggagatgtatgatgatccctgtgaacctggcggcagcgcaaaagatg

SEQ ID NO: 154560 - DNA, 103 bp, Artificial Sequence
  Synthetic Polynucleotide
taatacgactcactatagggtcctccgaatagccctcatcgtcacagggaaacagaggagatccctgatgcgatgagggaacctggcggcagcgcaaaagatg

SEQ ID NO: 154561 - DNA, 103 bp, Artificial Sequence
  Synthetic Polynucleotide
taatacgactcactataggggtttcagctttcctccgaatagccctcatcaacagaggagagatgagatgtattcggagaacctggcggcagcgcaaaagatg

SEQ ID NO: 154562 - DNA, 103 bp, Artificial Sequence
  Synthetic Polynucleotide
taatacgactcactatagggggcttgaatggtttcagctttcctccgaataacagaggagaattcggatgaaagctgaaaacctggcggcagcgcaaaagatg

SEQ ID NO: 154563 - DNA, 103 bp, Artificial Sequence
  Synthetic Polynucleotide
taatacgactcactatagggctggggtgtcggcttgaatggtttcagcttaacagaggagaaagctgatgccattcaagaacctggcggcagcgcaaaagatg

SEQ ID NO: 154564 - DNA, 103 bp, Artificial Sequence
  Synthetic Polynucleotide
taatacgactcactatagggagggacagtgctggggtgtcggcttgaatgaacagaggagacattcaatgcgacaccccaacctggcggcagcgcaaaagatg

SEQ ID NO: 154565 - DNA, 103 bp, Artificial Sequence
  Synthetic Polynucleotide
taatacgactcactatagggctctgcaatgagggacagtgctggggtgtcaacagaggagagacaccatggcactgtccaacctggcggcagcgcaaaagatg

SEQ ID NO: 154566 - DNA, 103 bp, Artificial Sequence
  Synthetic Polynucleotide
taatacgactcactatagggcttcaactgtctctgcaatgagggacagtgaacagaggagacactgtatgtcattgcagaacctggcggcagcgcaaaagatg

SEQ ID NO: 154567 - DNA, 103 bp, Artificial Sequence
  Synthetic Polynucleotide
taatacgactcactatagggttcaccatgtcttcaactgtctctgcaatgaacagaggagacattgcatggacagttgaaacctggcggcagcgcaaaagatg

SEQ ID NO: 154568 - DNA, 103 bp, Artificial Sequence
  Synthetic Polynucleotide
taatacgactcactataggggctgaccaaatgttgatgccctccagaactaacagaggagaagttctatggggcatcaaaacctggcggcagcgcaaaagatg

SEQ ID NO: 154569 - DNA, 103 bp, Artificial Sequence
  Synthetic Polynucleotide
taatacgactcactatagggcaggttctttttcaccatgtcttcaactgtaacagaggagaacagttatggacatggtgaacctggcggcagcgcaaaagatg

SEQ ID NO: 154570 - DNA, 103 bp, Artificial Sequence
  Synthetic Polynucleotide
taatacgactcactatagggtagccgggggcaggttctttttcaccatgtaacagaggagaacatggatgaaaagaaccaacctggcggcagcgcaaaagatg

SEQ ID NO: 154571 - DNA, 103 bp, Artificial Sequence
  Synthetic Polynucleotide
taatacgactcactatagggcctgggctgctagccgggggcaggttctttaacagaggagaaaagaaatggcccccggcaacctggcggcagcgcaaaagatg

SEQ ID NO: 154572 - DNA, 103 bp, Artificial Sequence
  Synthetic Polynucleotide
taatacgactcactatagggcatgccataccctgggctgctagccgggggaacagaggagacccccgatgagcagcccaaacctggcggcagcgcaaaagatg

SEQ ID NO: 154573 - DNA, 103 bp, Artificial Sequence
  Synthetic Polynucleotide
taatacgactcactatagggtgcctgtggtcatgccataccctgggctgcaacagaggagagcagccatgggtatggcaaacctggcggcagcgcaaaagatg

SEQ ID NO: 154574 - DNA, 103 bp, Artificial Sequence
  Synthetic Polynucleotide
taatacgactcactatagggattgggttgttgcctgtggtcatgccatacaacagaggagagtatggatggaccacaggaacctggcggcagcgcaaaagatg

SEQ ID NO: 154575 - DNA, 103 bp, Artificial Sequence
  Synthetic Polynucleotide
taatacgactcactatagggggtaccactcattgggttgttgcctgtggtaacagaggagaaccacaatgaacaacccaaacctggcggcagcgcaaaagatg

SEQ ID NO: 154576 - DNA, 103 bp, Artificial Sequence
  Synthetic Polynucleotide
taatacgactcactatagggttggtgtagtggtaccactcattgggttgtaacagaggagaacaaccatgtgagtggtaaacctggcggcagcgcaaaagatg

SEQ ID NO: 154577 - DNA, 103 bp, Artificial Sequence
  Synthetic Polynucleotide
taatacgactcactatagggaaggtgttggttggtgtagtggtaccactcaacagaggagagagtggatgcactacaccaacctggcggcagcgcaaaagatg

SEQ ID NO: 154578 - DNA, 103 bp, Artificial Sequence
  Synthetic Polynucleotide
taatacgactcactatagggaccccccggaaaggtgttggttggtgtagtaacagaggagaactacaatgaccaacaccaacctggcggcagcgcaaaagatg

SEQ ID NO: 154579 - DNA, 103 bp, Artificial Sequence
  Synthetic Polynucleotide
taatacgactcactatagggtctccaaacagctgaccaaatgttgatgccaacagaggagaggcatcatgatttggtcaaacctggcggcagcgcaaaagatg

SEQ ID NO: 154580 - DNA, 103 bp, Artificial Sequence
  Synthetic Polynucleotide
taatacgactcactatagggtggtaatgggaccccccggaaaggtgttggaacagaggagaccaacaatgttccgggggaacctggcggcagcgcaaaagatg

SEQ ID NO: 154581 - DNA, 103 bp, Artificial Sequence
  Synthetic Polynucleotide
taatacgactcactatagggttaaacaaggtggtaatgggaccccccggaaacagaggagatccgggatgtcccattacaacctggcggcagcgcaaaagatg

SEQ ID NO: 154582 - DNA, 103 bp, Artificial Sequence
  Synthetic Polynucleotide
taatacgactcactatagggcatgctcatattaaacaaggtggtaatgggaacagaggagacccattatgaccttgtttaacctggcggcagcgcaaaagatg

SEQ ID NO: 154583 - DNA, 103 bp, Artificial Sequence
  Synthetic Polynucleotide
taatacgactcactatagggctttgatgctcatgctcatattaaacaaggaacagaggagaccttgtatgatatgagcaaacctggcggcagcgcaaaagatg

SEQ ID NO: 154584 - DNA, 103 bp, Artificial Sequence
  Synthetic Polynucleotide
taatacgactcactatagggtcatgccgatctttgatgctcatgctcataaacagaggagatatgagatggagcatcaaaacctggcggcagcgcaaaagatg

SEQ ID NO: 154585 - DNA, 103 bp, Artificial Sequence
  Synthetic Polynucleotide
taatacgactcactataggggcccaccgactcatgccgatctttgatgctaacagaggagaagcatcatggatcggcataacctggcggcagcgcaaaagatg

SEQ ID NO: 154586 - DNA, 103 bp, Artificial Sequence
  Synthetic Polynucleotide
taatacgactcactatagggcctccccatggcccaccgactcatgccgataacagaggagaatcggcatgagtcggtggaacctggcggcagcgcaaaagatg

SEQ ID NO: 154587 - DNA, 103 bp, Artificial Sequence
  Synthetic Polynucleotide
taatacgactcactatagggttgctgaagtcctccccatggcccaccgacaacagaggagagtcggtatgccatggggaaacctggcggcagcgcaaaagatg

SEQ ID NO: 154588 - DNA, 103 bp, Artificial Sequence
  Synthetic Polynucleotide
taatacgactcactatagggctgagacaccttgctgaagtcctccccatgaacagaggagacatgggatggacttcagcaacctggcggcagcgcaaaagatg

SEQ ID NO: 154589 - DNA, 103 bp, Artificial Sequence
  Synthetic Polynucleotide
taatacgactcactataggggaattgggttctgagacaccttgctgaagtaacagaggagaacttcaatgaggtgtctcaacctggcggcagcgcaaaagatg

SEQ ID NO: 154590 - DNA, 103 bp, Artificial Sequence
  Synthetic Polynucleotide
taatacgactcactatagggttctgcaatgtctccaaacagctgaccaaaaacagaggagatttggtatgctgtttggaaacctggcggcagcgcaaaagatg

SEQ ID NO: 154591 - DNA, 103 bp, Artificial Sequence
  Synthetic Polynucleotide
taatacgactcactatagggaaactggtaagaattgggttctgagacaccaacagaggagaggtgtcatggaacccaataacctggcggcagcgcaaaagatg

SEQ ID NO: 154592 - DNA, 103 bp, Artificial Sequence
  Synthetic Polynucleotide
taatacgactcactataggggatttgcaacaaactggtaagaattgggttaacagaggagaaacccaatgcttaccagtaacctggcggcagcgcaaaagatg

SEQ ID NO: 154593 - DNA, 103 bp, Artificial Sequence
  Synthetic Polynucleotide
taatacgactcactatagggcgttccctgtgatttgcaacaaactggtaaaacagaggagattaccaatgtgttgcaaaaacctggcggcagcgcaaaagatg

SEQ ID NO: 154594 - DNA, 103 bp, Artificial Sequence
  Synthetic Polynucleotide
taatacgactcactataggggtagaccccccgttccctgtgatttgcaacaacagaggagagttgcaatgcacagggaaaacctggcggcagcgcaaaagatg

SEQ ID NO: 154595 - DNA, 103 bp, Artificial Sequence
  Synthetic Polynucleotide
taatacgactcactatagggcgagccaatggtagaccccccgttccctgtaacagaggagaacagggatgggggggtctaacctggcggcagcgcaaaagatg

SEQ ID NO: 154596 - DNA, 103 bp, Artificial Sequence
  Synthetic Polynucleotide
taatacgactcactataggggggtcggactcgagccaatggtagacccccaacagaggagagggggtatgccattggctaacctggcggcagcgcaaaagatg

SEQ ID NO: 154597 - DNA, 103 bp, Artificial Sequence
  Synthetic Polynucleotide
taatacgactcactatagggtgatgaggaggggtcggactcgagccaatgaacagaggagacattggatggagtccgacaacctggcggcagcgcaaaagatg

SEQ ID NO: 154598 - DNA, 103 bp, Artificial Sequence
  Synthetic Polynucleotide
taatacgactcactatagggtggcggcgtgtgatgaggaggggtcggactaacagaggagaagtccgatgcctcctcataacctggcggcagcgcaaaagatg

SEQ ID NO: 154599 - DNA, 103 bp, Artificial Sequence
  Synthetic Polynucleotide
taatacgactcactatagggaagagacaggtggcggcgtgtgatgaggagaacagaggagactcctcatgacacgccgcaacctggcggcagcgcaaaagatg

SEQ ID NO: 154600 - DNA, 103 bp, Artificial Sequence
  Synthetic Polynucleotide
taatacgactcactatagggccggccatcgaagagacaggtggcggcgtgaacagaggagacacgccatgacctgtctcaacctggcggcagcgcaaaagatg

SEQ ID NO: 154601 - DNA, 103 bp, Artificial Sequence
  Synthetic Polynucleotide
taatacgactcactatagggtttgagagccttctgcaatgtctccaaacaaacagaggagatgtttgatgacattgcagaacctggcggcagcgcaaaagatg

SEQ ID NO: 154602 - DNA, 103 bp, Artificial Sequence
  Synthetic Polynucleotide
taatacgactcactatagggcttggtgttgccggccatcgaagagacaggaacagaggagacctgtcatgtcgatggccaacctggcggcagcgcaaaagatg

SEQ ID NO: 154603 - DNA, 103 bp, Artificial Sequence
  Synthetic Polynucleotide
taatacgactcactatagggtcgggtggttcttggtgttgccggccatcgaacagaggagacgatggatggcaacaccaaacctggcggcagcgcaaaagatg

SEQ ID NO: 154604 - DNA, 103 bp, Artificial Sequence
  Synthetic Polynucleotide
taatacgactcactatagggttcatgagcatcgggtggttcttggtgttgaacagaggagacaacacatggaaccacccaacctggcggcagcgcaaaagatg

SEQ ID NO: 154605 - DNA, 103 bp, Artificial Sequence
  Synthetic Polynucleotide
taatacgactcactatagggtttaagaaggttcatgagcatcgggtggttaacagaggagaaaccacatgatgctcatgaacctggcggcagcgcaaaagatg

SEQ ID NO: 154606 - DNA, 103 bp, Artificial Sequence
  Synthetic Polynucleotide
taatacgactcactatagggcaggattatctttaagaaggttcatgagcaaacagaggagatgctcaatgaccttcttaaacctggcggcagcgcaaaagatg

SEQ ID NO: 154607 - DNA, 103 bp, Artificial Sequence
  Synthetic Polynucleotide
taatacgactcactatagggaaatcctgggcaggattatctttaagaaggaacagaggagaccttctatgagataatccaacctggcggcagcgcaaaagatg

SEQ ID NO: 154608 - DNA, 103 bp, Artificial Sequence
  Synthetic Polynucleotide
taatacgactcactatagggaagggttgagaaatcctgggcaggattatcaacagaggagagataatatggcccaggataacctggcggcagcgcaaaagatg

SEQ ID NO: 154609 - DNA, 103 bp, Artificial Sequence
  Synthetic Polynucleotide
taatacgactcactatagggtgcttccataaagggttgagaaatcctgggaacagaggagacccaggatgtctcaacccaacctggcggcagcgcaaaagatg

SEQ ID NO: 154610 - DNA, 103 bp, Artificial Sequence
  Synthetic Polynucleotide
taatacgactcactatagggtctaaagggctgcttccataaagggttgagaacagaggagactcaacatgttatggaagaacctggcggcagcgcaaaagatg

SEQ ID NO: 154611 - DNA, 103 bp, Artificial Sequence
  Synthetic Polynucleotide
taatacgactcactataggggttctgcctttctaaagggctgcttccataaacagaggagatatggaatgagccctttaaacctggcggcagcgcaaaagatg

SEQ ID NO: 154612 - DNA, 103 bp, Artificial Sequence
  Synthetic Polynucleotide
taatacgactcactatagggtcagcttttctgactcctcggtttccccctaacagaggagaagggggatgccgaggagtaacctggcggcagcgcaaaagatg

SEQ ID NO: 154613 - DNA, 103 bp, Artificial Sequence
  Synthetic Polynucleotide
taatacgactcactatagggaagatgttactttgagagccttctgcaatgaacagaggagacattgcatgaggctctcaaacctggcggcagcgcaaaagatg

SEQ ID NO: 154614 - DNA, 103 bp, Artificial Sequence
  Synthetic Polynucleotide
taatacgactcactatagggcggaagaggagttctgcctttctaaagggcaacagaggagagcccttatgaaaggcagaaacctggcggcagcgcaaaagatg

SEQ ID NO: 154615 - DNA, 103 bp, Artificial Sequence
  Synthetic Polynucleotide
taatacgactcactatagggcggggtgagccggaagaggagttctgccttaacagaggagaaaggcaatgctcctcttcaacctggcggcagcgcaaaagatg

SEQ ID NO: 154616 - DNA, 103 bp, Artificial Sequence
  Synthetic Polynucleotide
taatacgactcactatagggtatttccatgcggggtgagccggaagaggaaacagaggagatcctctatgggctcacccaacctggcggcagcgcaaaagatg

SEQ ID NO: 154617 - DNA, 103 bp, Artificial Sequence
  Synthetic Polynucleotide
taatacgactcactatagggtccccgagcatatttccatgcggggtgagcaacagaggagagctcacatggcatggaaaaacctggcggcagcgcaaaagatg

SEQ ID NO: 154618 - DNA, 103 bp, Artificial Sequence
  Synthetic Polynucleotide
taatacgactcactataggggtcttgttgctccccgagcatatttccatgaacagaggagacatggaatgatgctcgggaacctggcggcagcgcaaaagatg

SEQ ID NO: 154619 - DNA, 103 bp, Artificial Sequence
  Synthetic Polynucleotide
taatacgactcactatagggctttttcttggtcttgttgctccccgagcaaacagaggagatgctcgatgagcaacaagaacctggcggcagcgcaaaagatg

SEQ ID NO: 154620 - DNA, 103 bp, Artificial Sequence
  Synthetic Polynucleotide
taatacgactcactatagggttgatgacttctttttcttggtcttgttgcaacagaggagagcaacaatgccaagaaaaaacctggcggcagcgcaaaagatg

SEQ ID NO: 154621 - DNA, 103 bp, Artificial Sequence
  Synthetic Polynucleotide
taatacgactcactatagggggtggtaatcttgatgacttctttttcttgaacagaggagacaagaaatggaagtcatcaacctggcggcagcgcaaaagatg

SEQ ID NO: 154622 - DNA, 103 bp, Artificial Sequence
  Synthetic Polynucleotide
taatacgactcactatagggtggtttctcaggtggtaatcttgatgacttaacagaggagaaagtcaatgagattaccaaacctggcggcagcgcaaaagatg

SEQ ID NO: 154623 - DNA, 103 bp, Artificial Sequence
  Synthetic Polynucleotide
taatacgactcactatagggtctggtgctttggtttctcaggtggtaatcaacagaggagagattacatgctgagaaacaacctggcggcagcgcaaaagatg

SEQ ID NO: 154624 - DNA, 103 bp, Artificial Sequence
  Synthetic Polynucleotide
taatacgactcactatagggattgctggtaaagatgttactttgagagccaacagaggagaggctctatgagtaacatcaacctggcggcagcgcaaaagatg

SEQ ID NO: 154625 - DNA, 103 bp, Artificial Sequence
  Synthetic Polynucleotide
taatacgactcactatagggtcatcttcagtctggtgctttggtttctcaaacagaggagatgagaaatgaaagcaccaaacctggcggcagcgcaaaagatg

SEQ ID NO: 154626 - DNA, 103 bp, Artificial Sequence
  Synthetic Polynucleotide
taatacgactcactatagggcctctgaaagtcatcttcagtctggtgcttaacagaggagaaagcacatgactgaagataacctggcggcagcgcaaaagatg

SEQ ID NO: 154627 - DNA, 103 bp, Artificial Sequence
  Synthetic Polynucleotide
taatacgactcactatagggaaaatagctccctctgaaagtcatcttcagaacagaggagactgaagatgactttcagaaacctggcggcagcgcaaaagatg

SEQ ID NO: 154628 - DNA, 103 bp, Artificial Sequence
  Synthetic Polynucleotide
taatacgactcactatagggacatccattgaaaatagctccctctgaaagaacagaggagactttcaatgggagctattaacctggcggcagcgcaaaagatg

SEQ ID NO: 154629 - DNA, 103 bp, Artificial Sequence
  Synthetic Polynucleotide
taatacgactcactatagggctgtgagtcaacatccattgaaaatagctcaacagaggagagagctaatgtcaatggataacctggcggcagcgcaaaagatg

SEQ ID NO: 154630 - DNA, 103 bp, Artificial Sequence
  Synthetic Polynucleotide
taatacgactcactatagggagatagggttctgtgagtcaacatccattgaacagaggagacaatggatgttgactcacaacctggcggcagcgcaaaagatg

SEQ ID NO: 154631 - DNA, 103 bp, Artificial Sequence
  Synthetic Polynucleotide
taatacgactcactatagggttgacatcaaagatagggttctgtgagtcaaacagaggagatgactcatggaaccctataacctggcggcagcgcaaaagatg

SEQ ID NO: 154632 - DNA, 103 bp, Artificial Sequence
  Synthetic Polynucleotide
taatacgactcactatagggagctgtcatgttgacatcaaagatagggttaacagaggagaaaccctatgtttgatgtcaacctggcggcagcgcaaaagatg

SEQ ID NO: 154633 - DNA, 103 bp, Artificial Sequence
  Synthetic Polynucleotide
taatacgactcactatagggccagcgtgtcagctgtcatgttgacatcaaaacagaggagattgatgatgacatgacagaacctggcggcagcgcaaaagatg

SEQ ID NO: 154634 - DNA, 103 bp, Artificial Sequence
  Synthetic Polynucleotide
taatacgactcactatagggtgtggcgtatccagcgtgtcagctgtcatgaacagaggagacatgacatgtgacacgctaacctggcggcagcgcaaaagatg

SEQ ID NO: 154635 - DNA, 103 bp, Artificial Sequence
  Synthetic Polynucleotide
taatacgactcactatagggacgatcagtcattgctggtaaagatgttacaacagaggagagtaacaatgttaccagcaaacctggcggcagcgcaaaagatg

SEQ ID NO: 154636 - DNA, 103 bp, Artificial Sequence
  Synthetic Polynucleotide
taatacgactcactatagggtggagtgatgtgtggcgtatccagcgtgtcaacagaggagagacacgatggatacgccaaacctggcggcagcgcaaaagatg

SEQ ID NO: 154637 - DNA, 103 bp, Artificial Sequence
  Synthetic Polynucleotide
taatacgactcactatagggggcttggagctggagtgatgtgtggcgtataacagaggagaatacgcatgacatcactcaacctggcggcagcgcaaaagatg

SEQ ID NO: 154638 - DNA, 103 bp, Artificial Sequence
  Synthetic Polynucleotide
taatacgactcactataggggtgctacactggcttggagctggagtgatgaacagaggagacatcacatgagctccaagaacctggcggcagcgcaaaagatg

SEQ ID NO: 154639 - DNA, 103 bp, Artificial Sequence
  Synthetic Polynucleotide
taatacgactcactatagggtgttgggggagtgctacactggcttggagcaacagaggagagctccaatgcagtgtagcaacctggcggcagcgcaaaagatg

SEQ ID NO: 154640 - DNA, 103 bp, Artificial Sequence
  Synthetic Polynucleotide
taatacgactcactataggggtgggtaagttgttgggggagtgctacactaacagaggagaagtgtaatgctcccccaaaacctggcggcagcgcaaaagatg

SEQ ID NO: 154641 - DNA, 103 bp, Artificial Sequence
  Synthetic Polynucleotide
taatacgactcactatagggggtactggttgtgggtaagttgttgggggaaacagaggagatcccccatgaacttacccaacctggcggcagcgcaaaagatg

SEQ ID NO: 154642 - DNA, 103 bp, Artificial Sequence
  Synthetic Polynucleotide
taatacgactcactatagggttgggggtgaggtactggttgtgggtaagtaacagaggagaacttacatgcaaccagtaaacctggcggcagcgcaaaagatg

SEQ ID NO: 154643 - DNA, 103 bp, Artificial Sequence
  Synthetic Polynucleotide
taatacgactcactataggggaatactgggttgggggtgaggtactggttaacagaggagaaaccagatgctcacccccaacctggcggcagcgcaaaagatg

SEQ ID NO: 154644 - DNA, 103 bp, Artificial Sequence
  Synthetic Polynucleotide
taatacgactcactatagggaccatcctttgaatactgggttgggggtgaaacagaggagatcacccatgacccagtataacctggcggcagcgcaaaagatg

SEQ ID NO: 154645 - DNA, 103 bp, Artificial Sequence
  Synthetic Polynucleotide
taatacgactcactatagggggatagtcggaccatcctttgaatactgggaacagaggagacccagtatgcaaaggatgaacctggcggcagcgcaaaagatg

SEQ ID NO: 154646 - DNA, 103 bp, Artificial Sequence
  Synthetic Polynucleotide
taatacgactcactatagggtggactccaaacgatcagtcattgctggtaaacagaggagataccagatgtgactgatcaacctggcggcagcgcaaaagatg

SEQ ID NO: 154647 - DNA, 103 bp, Artificial Sequence
  Synthetic Polynucleotide
taatacgactcactatagggtgtctgaactggatagtcggaccatcctttaacagaggagaaaaggaatgtccgactataacctggcggcagcgcaaaagatg

SEQ ID NO: 154648 - DNA, 103 bp, Artificial Sequence
  Synthetic Polynucleotide
taatacgactcactataggggggccaatgctgtctgaactggatagtcggaacagaggagaccgactatgcagttcagaaacctggcggcagcgcaaaagatg

SEQ ID NO: 154649 - DNA, 103 bp, Artificial Sequence
  Synthetic Polynucleotide
taatacgactcactatagggagttacatctgggccaatgctgtctgaactaacagaggagaagttcaatgagcattggcaacctggcggcagcgcaaaagatg

SEQ ID NO: 154650 - DNA, 103 bp, Artificial Sequence
  Synthetic Polynucleotide
taatacgactcactatagggaaaggatgtcagttacatctgggccaatgcaacagaggagagcattgatgcagatgtaaaacctggcggcagcgcaaaagatg

SEQ ID NO: 154651 - DNA, 103 bp, Artificial Sequence
  Synthetic Polynucleotide
taatacgactcactataggggcaatgtctgaaaggatgtcagttacatctaacagaggagaagatgtatgtgacatcctaacctggcggcagcgcaaaagatg

SEQ ID NO: 154652 - DNA, 103 bp, Artificial Sequence
  Synthetic Polynucleotide
taatacgactcactatagggagcttcttctgcaatgtctgaaaggatgtcaacagaggagagacatcatgtcagacattaacctggcggcagcgcaaaagatg

SEQ ID NO: 154653 - DNA, 103 bp, Artificial Sequence
  Synthetic Polynucleotide
taatacgactcactataggggaagtttagaagcttcttctgcaatgtctgaacagaggagacagacaatgcagaagaagaacctggcggcagcgcaaaagatg

SEQ ID NO: 154654 - DNA, 103 bp, Artificial Sequence
  Synthetic Polynucleotide
taatacgactcactatagggctagtgctgggaagtttagaagcttcttctaacagaggagaagaagaatgttctaaactaacctggcggcagcgcaaaagatg

SEQ ID NO: 154655 - DNA, 103 bp, Artificial Sequence
  Synthetic Polynucleotide
taatacgactcactataggggcaatcatcactagtgctgggaagtttagaaacagaggagatctaaaatgcccagcactaacctggcggcagcgcaaaagatg

SEQ ID NO: 154656 - DNA, 103 bp, Artificial Sequence
  Synthetic Polynucleotide
taatacgactcactatagggcaatggctgggcaatcatcactagtgctggaacagaggagaccagcaatggtgatgattaacctggcggcagcgcaaaagatg

SEQ ID NO: 154657 - DNA, 103 bp, Artificial Sequence
  Synthetic Polynucleotide
taatacgactcactatagggtgtcttgctatggactccaaacgatcagtcaacagaggagagactgaatgtttggagtcaacctggcggcagcgcaaaagatg

SEQ ID NO: 154658 - DNA, 103 bp, Artificial Sequence
  Synthetic Polynucleotide
taatacgactcactatagggagaggggtgccaatggctgggcaatcatcaaacagaggagatgatgaatgcccagccataacctggcggcagcgcaaaagatg

SEQ ID NO: 154659 - DNA, 103 bp, Artificial Sequence
  Synthetic Polynucleotide
taatacgactcactatagggagaatctcgaagaggggtgccaatggctggaacagaggagaccagccatgggcacccctaacctggcggcagcgcaaaagatg

SEQ ID NO: 154660 - DNA, 103 bp, Artificial Sequence
  Synthetic Polynucleotide
taatacgactcactatagggcagagcttgaagaatctcgaagaggggtgcaacagaggagagcacccatgttcgagattaacctggcggcagcgcaaaagatg

SEQ ID NO: 154661 - DNA, 103 bp, Artificial Sequence
  Synthetic Polynucleotide
taatacgactcactatagggtgagaatgcccagagcttgaagaatctcgaaacagaggagatcgagaatgttcaagctcaacctggcggcagcgcaaaagatg

SEQ ID NO: 154662 - DNA, 103 bp, Artificial Sequence
  Synthetic Polynucleotide
taatacgactcactatagggcagggtactctgagaatgcccagagcttgaaacagaggagatcaagcatggggcattctaacctggcggcagcgcaaaagatg

SEQ ID NO: 154663 - DNA, 103 bp, Artificial Sequence
  Synthetic Polynucleotide
taatacgactcactatagggcagagtcaaacagggtactctgagaatgccaacagaggagaggcattatgagagtacccaacctggcggcagcgcaaaagatg

SEQ ID NO: 154664 - DNA, 103 bp, Artificial Sequence
  Synthetic Polynucleotide
taatacgactcactatagggtgaaagacatcagagtcaaacagggtactcaacagaggagagagtacatggtttgactcaacctggcggcagcgcaaaagatg

SEQ ID NO: 154665 - DNA, 103 bp, Artificial Sequence
  Synthetic Polynucleotide
taatacgactcactatagggattgttagtttgaaagacatcagagtcaaaaacagaggagatttgacatggatgtctttaacctggcggcagcgcaaaagatg

SEQ ID NO: 154666 - DNA, 103 bp, Artificial Sequence
  Synthetic Polynucleotide
taatacgactcactataggggattttcattattgttagtttgaaagacataacagaggagaatgtctatgaaactaacaaacctggcggcagcgcaaaagatg

SEQ ID NO: 154667 - DNA, 103 bp, Artificial Sequence
  Synthetic Polynucleotide
taatacgactcactatagggtcagtgtatggattttcattattgttagttaacagaggagaaactaaatgtaatgaaaaaacctggcggcagcgcaaaagatg

SEQ ID NO: 154668 - DNA, 103 bp, Artificial Sequence
  Synthetic Polynucleotide
taatacgactcactatagggcagtccattctgtcttgctatggactccaaaacagaggagattggagatgatagcaagaaacctggcggcagcgcaaaagatg

SEQ ID NO: 154669 - DNA, 103 bp, Artificial Sequence
  Synthetic Polynucleotide
taatacgactcactatagggatcagctggatcagtgtatggattttcattaacagaggagaaatgaaatgccatacactaacctggcggcagcgcaaaagatg

SEQ ID NO: 154670 - DNA, 103 bp, Artificial Sequence
  Synthetic Polynucleotide
taatacgactcactatagggctgcaataagatcagctggatcagtgtatgaacagaggagacatacaatgatccagctgaacctggcggcagcgcaaaagatg

SEQ ID NO: 154671 - DNA, 103 bp, Artificial Sequence
  Synthetic Polynucleotide
taatacgactcactatagggccagcagcatctgcaataagatcagctggaaacagaggagatccagcatgtcttattgcaacctggcggcagcgcaaaagatg

SEQ ID NO: 154672 - DNA, 103 bp, Artificial Sequence
  Synthetic Polynucleotide
taatacgactcactatagggactggggcttccagcagcatctgcaataagaacagaggagacttattatggatgctgctaacctggcggcagcgcaaaagatg

SEQ ID NO: 154673 - DNA, 103 bp, Artificial Sequence
  Synthetic Polynucleotide
taatacgactcactataggggagagtcactactggggcttccagcagcataacagaggagaatgctgatggaagccccaaacctggcggcagcgcaaaagatg

SEQ ID NO: 154674 - DNA, 103 bp, Artificial Sequence
  Synthetic Polynucleotide
taatacgactcactatagggtgattggtaggagagtcactactggggcttaacagaggagaaagcccatgtagtgactcaacctggcggcagcgcaaaagatg

SEQ ID NO: 154675 - DNA, 103 bp, Artificial Sequence
  Synthetic Polynucleotide
taatacgactcactatagggatgaaaaaaatgattggtaggagagtcactaacagaggagaagtgacatgcctaccaataacctggcggcagcgcaaaagatg

SEQ ID NO: 154676 - DNA, 103 bp, Artificial Sequence
  Synthetic Polynucleotide
taatacgactcactatagggctactccatcatgaaaaaaatgattggtagaacagaggagactaccaatgatttttttcaacctggcggcagcgcaaaagatg

SEQ ID NO: 154677 - DNA, 103 bp, Artificial Sequence
  Synthetic Polynucleotide
taatacgactcactatagggggattgaaatctactccatcatgaaaaaaaaacagaggagattttttatgtgatggagtaacctggcggcagcgcaaaagatg

SEQ ID NO: 154678 - DNA, 103 bp, Artificial Sequence
  Synthetic Polynucleotide
taatacgactcactatagggcaataaatcaggattgaaatctactccatcaacagaggagagatggaatggatttcaataacctggcggcagcgcaaaagatg

SEQ ID NO: 154679 - DNA, 103 bp, Artificial Sequence
  Synthetic Polynucleotide
taatacgactcactataggggatgagagcccagtccattctgtcttgctaaacagaggagatagcaaatgagaatggacaacctggcggcagcgcaaaagatg

SEQ ID NO: 154680 - DNA, 103 bp, Artificial Sequence
  Synthetic Polynucleotide
taatacgactcactatagggtctggctgttcaataaatcaggattgaaataacagaggagaatttcaatgctgatttataacctggcggcagcgcaaaagatg

SEQ ID NO: 154681 - DNA, 103 bp, Artificial Sequence
  Synthetic Polynucleotide
taatacgactcactatagggccactttggctctggctgttcaataaatcaaacagaggagatgatttatggaacagccaaacctggcggcagcgcaaaagatg

SEQ ID NO: 154682 - DNA, 103 bp, Artificial Sequence
  Synthetic Polynucleotide
taatacgactcactatagggttctccaaaaccactttggctctggctgttaacagaggagaaacagcatgagccaaagtaacctggcggcagcgcaaaagatg

SEQ ID NO: 154683 - DNA, 103 bp, Artificial Sequence
  Synthetic Polynucleotide
taatacgactcactatagggcaaaatattcttctccaaaaccactttggcaacagaggagagccaaaatggttttggagaacctggcggcagcgcaaaagatg

SEQ ID NO: 154684 - DNA, 103 bp, Artificial Sequence
  Synthetic Polynucleotide
taatacgactcactatagggctgctttcatcaaaatattcttctccaaaaaacagaggagattttggatgagaatatttaacctggcggcagcgcaaaagatg

SEQ ID NO: 154685 - DNA, 103 bp, Artificial Sequence
  Synthetic Polynucleotide
taatacgactcactatagggcccactttggctgctttcatcaaaatattcaacagaggagagaatatatggatgaaagcaacctggcggcagcgcaaaagatg

SEQ ID NO: 154686 - DNA, 103 bp, Artificial Sequence
  Synthetic Polynucleotide
taatacgactcactatagggcatcattatccccactttggctgctttcataacagaggagaatgaaaatggccaaagtgaacctggcggcagcgcaaaagatg

SEQ ID NO: 154687 - DNA, 103 bp, Artificial Sequence
  Synthetic Polynucleotide
taatacgactcactatagggcctttgaaatcatcattatccccactttggaacagaggagaccaaagatgggataatgaaacctggcggcagcgcaaaagatg

SEQ ID NO: 154688 - DNA, 103 bp, Artificial Sequence
  Synthetic Polynucleotide
taatacgactcactatagggagatgcaaatcctttgaaatcatcattatcaacagaggagagataatatggatttcaaaaacctggcggcagcgcaaaagatg

SEQ ID NO: 154689 - DNA, 103 bp, Artificial Sequence
  Synthetic Polynucleotide
taatacgactcactatagggttagtgcctgagatgcaaatcctttgaaataacagaggagaatttcaatggatttgcataacctggcggcagcgcaaaagatg

SEQ ID NO: 154690 - DNA, 103 bp, Artificial Sequence
  Synthetic Polynucleotide
taatacgactcactatagggctggcactgagatgagagcccagtccattcaacagaggagagaatggatggggctctcaaacctggcggcagcgcaaaagatg

SEQ ID NO: 154691 - DNA, 103 bp, Artificial Sequence
  Synthetic Polynucleotide
taatacgactcactatagggcccaaagtatttagtgcctgagatgcaaataacagaggagaatttgcatgtcaggcactaacctggcggcagcgcaaaagatg

SEQ ID NO: 154692 - DNA, 103 bp, Artificial Sequence
  Synthetic Polynucleotide
taatacgactcactatagggcattggcacccccaaagtatttagtgcctgaacagaggagacaggcaatgaatactttgaacctggcggcagcgcaaaagatg

SEQ ID NO: 154693 - DNA, 103 bp, Artificial Sequence
  Synthetic Polynucleotide
taatacgactcactatagggcacctccaagcattggcacccccaaagtataacagaggagaatacttatggggtgccaaaacctggcggcagcgcaaaagatg

SEQ ID NO: 154694 - DNA, 103 bp, Artificial Sequence
  Synthetic Polynucleotide
taatacgactcactatagggtccccattatcacctccaagcattggcaccaacagaggagaggtgccatggcttggaggaacctggcggcagcgcaaaagatg

SEQ ID NO: 154695 - DNA, 103 bp, Artificial Sequence
  Synthetic Polynucleotide
taatacgactcactatagggaaacttggtctccccattatcacctccaagaacagaggagacttggaatggataatgggaacctggcggcagcgcaaaagatg

SEQ ID NO: 154696 - DNA, 103 bp, Artificial Sequence
  Synthetic Polynucleotide
taatacgactcactatagggtattgcccttaaacttggtctccccattataacagaggagaataatgatgagaccaagtaacctggcggcagcgcaaaagatg

SEQ ID NO: 154697 - DNA, 103 bp, Artificial Sequence
  Synthetic Polynucleotide
taatacgactcactatagggtcggcttggttattgcccttaaacttggtcaacagaggagagaccaaatgtaagggcaaaacctggcggcagcgcaaaagatg

SEQ ID NO: 154698 - DNA, 103 bp, Artificial Sequence
  Synthetic Polynucleotide
taatacgactcactatagggatcaactgtgtcggcttggttattgcccttaacagaggagaaagggcatgaaccaagccaacctggcggcagcgcaaaagatg

SEQ ID NO: 154699 - DNA, 103 bp, Artificial Sequence
  Synthetic Polynucleotide
taatacgactcactatagggtaatactgaaatcaactgtgtcggcttggtaacagaggagaaccaagatgacacagttgaacctggcggcagcgcaaaagatg

SEQ ID NO: 154700 - DNA, 103 bp, Artificial Sequence
  Synthetic Polynucleotide
taatacgactcactataggggctactgaaataatactgaaatcaactgtgaacagaggagacacagtatgtttcagtataacctggcggcagcgcaaaagatg

SEQ ID NO: 154701 - DNA, 103 bp, Artificial Sequence
  Synthetic Polynucleotide
taatacgactcactatagggttcagtgccactggcactgagatgagagccaacagaggagaggctctatgctcagtgccaacctggcggcagcgcaaaagatg

SEQ ID NO: 154702 - DNA, 103 bp, Artificial Sequence
  Synthetic Polynucleotide
taatacgactcactatagggagctttgccggctactgaaataatactgaaaacagaggagattcagtatgatttcagtaaacctggcggcagcgcaaaagatg

SEQ ID NO: 154703 - DNA, 103 bp, Artificial Sequence
  Synthetic Polynucleotide
taatacgactcactatagggcaggagctaaagctttgccggctactgaaaaacagaggagatttcagatgccggcaaagaacctggcggcagcgcaaaagatg

SEQ ID NO: 154704 - DNA, 103 bp, Artificial Sequence
  Synthetic Polynucleotide
taatacgactcactatagggataagatctgcaggagctaaagctttgccgaacagaggagacggcaaatgtttagctccaacctggcggcagcgcaaaagatg

SEQ ID NO: 154705 - DNA, 103 bp, Artificial Sequence
  Synthetic Polynucleotide
taatacgactcactataggggtgatgctccataagatctgcaggagctaaaacagaggagattagctatggcagatcttaacctggcggcagcgcaaaagatg

SEQ ID NO: 154706 - DNA, 103 bp, Artificial Sequence
  Synthetic Polynucleotide
taatacgactcactataggggactaccactgtgatgctccataagatctgaacagaggagacagatcatgtggagcatcaacctggcggcagcgcaaaagatg

SEQ ID NO: 154707 - DNA, 103 bp, Artificial Sequence
  Synthetic Polynucleotide
taatacgactcactatagggaaaggaccctgactaccactgtgatgctccaacagaggagaggagcaatgcagtggtagaacctggcggcagcgcaaaagatg

SEQ ID NO: 154708 - DNA, 103 bp, Artificial Sequence
  Synthetic Polynucleotide
taatacgactcactatagggagtggtcagtaaaggaccctgactaccactaacagaggagaagtggtatgcagggtcctaacctggcggcagcgcaaaagatg

SEQ ID NO: 154709 - DNA, 103 bp, Artificial Sequence
  Synthetic Polynucleotide
taatacgactcactatagggctaagtccccagtggtcagtaaaggaccctaacagaggagaagggtcatgtactgaccaaacctggcggcagcgcaaaagatg

SEQ ID NO: 154710 - DNA, 103 bp, Artificial Sequence
  Synthetic Polynucleotide
taatacgactcactatagggttttctttccctaagtccccagtggtcagtaacagaggagaactgacatgtggggacttaacctggcggcagcgcaaaagatg

SEQ ID NO: 154711 - DNA, 103 bp, Artificial Sequence
  Synthetic Polynucleotide
taatacgactcactatagggcttttgagtcttttctttccctaagtccccaacagaggagaggggacatggggaaagaaaacctggcggcagcgcaaaagatg

SEQ ID NO: 154712 - DNA, 103 bp, Artificial Sequence
  Synthetic Polynucleotide
taatacgactcactatagggtgatgtaacattcagtgccactggcactgaaacagaggagatcagtgatggtggcactgaacctggcggcagcgcaaaagatg

SEQ ID NO: 154713 - DNA, 103 bp, Artificial Sequence
  Synthetic Polynucleotide
taatacgactcactatagggcctttaccctcttttgagtcttttctttccaacagaggagaggaaagatgagactcaaaaacctggcggcagcgcaaaagatg

SEQ ID NO: 154714 - DNA, 103 bp, Artificial Sequence
  Synthetic Polynucleotide
taatacgactcactatagggccattgccttcctttaccctcttttgagtcaacagaggagagactcaatggagggtaaaaacctggcggcagcgcaaaagatg

SEQ ID NO: 154715 - DNA, 103 bp, Artificial Sequence
  Synthetic Polynucleotide
taatacgactcactatagggattactggtgccattgccttcctttaccctaacagaggagaagggtaatggaaggcaataacctggcggcagcgcaaaagatg

SEQ ID NO: 154716 - DNA, 103 bp, Artificial Sequence
  Synthetic Polynucleotide
taatacgactcactatagggagagagtactattactggtgccattgccttaacagaggagaaaggcaatggcaccagtaaacctggcggcagcgcaaaagatg

SEQ ID NO: 154717 - DNA, 103 bp, Artificial Sequence
  Synthetic Polynucleotide
taatacgactcactatagggccgggccccgagagagtactattactggtgaacagaggagacaccagatgtagtactctaacctggcggcagcgcaaaagatg

SEQ ID NO: 154718 - DNA, 103 bp, Artificial Sequence
  Synthetic Polynucleotide
taatacgactcactataggggctgtctaatccgggccccgagagagtactaacagaggagaagtactatgtcggggcccaacctggcggcagcgcaaaagatg

SEQ ID NO: 154719 - DNA, 103 bp, Artificial Sequence
  Synthetic Polynucleotide
taatacgactcactatagggtccctggtttgctgtctaatccgggccccgaacagaggagacggggcatggattagacaaacctggcggcagcgcaaaagatg

SEQ ID NO: 154720 - DNA, 103 bp, Artificial Sequence
  Synthetic Polynucleotide
taatacgactcactatagggcgactgcgcttccctggtttgctgtctaataacagaggagaattagaatgcaaaccaggaacctggcggcagcgcaaaagatg

SEQ ID NO: 154721 - DNA, 103 bp, Artificial Sequence
  Synthetic Polynucleotide
taatacgactcactatagggagaaggggtccgactgcgcttccctggtttaacagaggagaaaaccaatgaagcgcagtaacctggcggcagcgcaaaagatg

SEQ ID NO: 154722 - DNA, 103 bp, Artificial Sequence
  Synthetic Polynucleotide
taatacgactcactatagggtcccatcattagaaggggtccgactgcgctaacagaggagaagcgcaatgggaccccttaacctggcggcagcgcaaaagatg

SEQ ID NO: 154723 - DNA, 103 bp, Artificial Sequence
  Synthetic Polynucleotide
taatacgactcactatagggctcatcttactcagcttttctgactcctcgaacagaggagacgaggaatgagaaaagctaacctggcggcagcgcaaaagatg

SEQ ID NO: 154724 - DNA, 103 bp, Artificial Sequence
  Synthetic Polynucleotide
taatacgactcactatagggatatctgacgtgatgtaacattcagtgccaaacagaggagatggcacatgatgttacataacctggcggcagcgcaaaagatg

SEQ ID NO: 154725 - DNA, 103 bp, Artificial Sequence
  Synthetic Polynucleotide
taatacgactcactatagggtctttgcttttcccatcattagaaggggtcaacagaggagagaccccatgtaatgatggaacctggcggcagcgcaaaagatg

SEQ ID NO: 154726 - DNA, 103 bp, Artificial Sequence
  Synthetic Polynucleotide
taatacgactcactatagggtggaggcttatctttgcttttcccatcattaacagaggagaaatgatatgaaaagcaaaaacctggcggcagcgcaaaagatg

SEQ ID NO: 154727 - DNA, 103 bp, Artificial Sequence
  Synthetic Polynucleotide
taatacgactcactatagggtcttccgctttggaggcttatctttgctttaacagaggagaaaagcaatgataagcctcaacctggcggcagcgcaaaagatg

SEQ ID NO: 154728 - DNA, 103 bp, Artificial Sequence
  Synthetic Polynucleotide
taatacgactcactataggggtgtctgccttcttccgctttggaggcttaaacagaggagataagccatgaaagcggaaaacctggcggcagcgcaaaagatg

SEQ ID NO: 154729 - DNA, 103 bp, Artificial Sequence
  Synthetic Polynucleotide
taatacgactcactatagggctttccctcagtgtctgccttcttccgcttaacagaggagaaagcggatgaaggcagacaacctggcggcagcgcaaaagatg

SEQ ID NO: 154730 - DNA, 103 bp, Artificial Sequence
  Synthetic Polynucleotide
taatacgactcactataggggagatggagactttccctcagtgtctgcctaacagaggagaaggcagatgctgagggaaaacctggcggcagcgcaaaagatg

SEQ ID NO: 154731 - DNA, 103 bp, Artificial Sequence
  Synthetic Polynucleotide
taatacgactcactataggggaagaactatgagatggagactttccctcaaacagaggagatgagggatggtctccatcaacctggcggcagcgcaaaagatg

SEQ ID NO: 154732 - DNA, 103 bp, Artificial Sequence
  Synthetic Polynucleotide
taatacgactcactatagggaggtctgttagaagaactatgagatggagaaacagaggagatctccaatgcatagttctaacctggcggcagcgcaaaagatg

SEQ ID NO: 154733 - DNA, 103 bp, Artificial Sequence
  Synthetic Polynucleotide
taatacgactcactataggggtggggtaaaaggtctgttagaagaactataacagaggagaatagttatgctaacagacaacctggcggcagcgcaaaagatg

SEQ ID NO: 154734 - DNA, 103 bp, Artificial Sequence
  Synthetic Polynucleotide
taatacgactcactataggggtactggtaggtggggtaaaaggtctgttaaacagaggagataacagatgttttaccccaacctggcggcagcgcaaaagatg

SEQ ID NO: 154735 - DNA, 103 bp, Artificial Sequence
  Synthetic Polynucleotide
taatacgactcactatagggcacatagaacatatctgacgtgatgtaacaaacagaggagatgttacatgacgtcagataacctggcggcagcgcaaaagatg

SEQ ID NO: 154736 - DNA, 103 bp, Artificial Sequence
  Synthetic Polynucleotide
taatacgactcactatagggagatccacctgtactggtaggtggggtaaaaacagaggagatttaccatgcctaccagtaacctggcggcagcgcaaaagatg

SEQ ID NO: 154737 - DNA, 103 bp, Artificial Sequence
  Synthetic Polynucleotide
taatacgactcactatagggctggcgatttagatccacctgtactggtagaacagaggagactaccaatgcaggtggataacctggcggcagcgcaaaagatg

SEQ ID NO: 154738 - DNA, 103 bp, Artificial Sequence
  Synthetic Polynucleotide
taatacgactcactatagggcctgcactgcctggcgatttagatccacctaacagaggagaaggtggatgtaaatcgccaacctggcggcagcgcaaaagatg

SEQ ID NO: 154739 - DNA, 103 bp, Artificial Sequence
  Synthetic Polynucleotide
taatacgactcactatagggctgagatcttcctgcactgcctggcgatttaacagaggagaaaatcgatgggcagtgcaaacctggcggcagcgcaaaagatg

SEQ ID NO: 154740 - DNA, 103 bp, Artificial Sequence
  Synthetic Polynucleotide
taatacgactcactatagggctgggggagtctgagatcttcctgcactgcaacagaggagagcagtgatggaagatctcaacctggcggcagcgcaaaagatg

SEQ ID NO: 154741 - DNA, 103 bp, Artificial Sequence
  Synthetic Polynucleotide
taatacgactcactataggggtggcaacacctgggggagtctgagatcttaacagaggagaaagatcatggactcccccaacctggcggcagcgcaaaagatg

SEQ ID NO: 154742 - DNA, 103 bp, Artificial Sequence
  Synthetic Polynucleotide
taatacgactcactatagggaatgggtggtgtggcaacacctgggggagtaacagaggagaactcccatgggtgttgccaacctggcggcagcgcaaaagatg

SEQ ID NO: 154743 - DNA, 103 bp, Artificial Sequence
  Synthetic Polynucleotide
taatacgactcactatagggtgattttgggaatgggtggtgtggcaacacaacagaggagagtgttgatgcaccacccaaacctggcggcagcgcaaaagatg

SEQ ID NO: 154744 - DNA, 103 bp, Artificial Sequence
  Synthetic Polynucleotide
taatacgactcactatagggatctgaatagtgattttgggaatgggtggtaacagaggagaaccaccatgtcccaaaataacctggcggcagcgcaaaagatg

SEQ ID NO: 154745 - DNA, 103 bp, Artificial Sequence
  Synthetic Polynucleotide
taatacgactcactatagggtcccttaggaatctgaatagtgattttgggaacagaggagacccaaaatgactattcagaacctggcggcagcgcaaaagatg

SEQ ID NO: 154746 - DNA, 103 bp, Artificial Sequence
  Synthetic Polynucleotide
taatacgactcactatagggactgcacttccacatagaacatatctgacgaacagaggagacgtcagatgtgttctatgaacctggcggcagcgcaaaagatg

SEQ ID NO: 154747 - DNA, 103 bp, Artificial Sequence
  Synthetic Polynucleotide
taatacgactcactatagggccatcactgttcccttaggaatctgaatagaacagaggagactattcatgttcctaaggaacctggcggcagcgcaaaagatg

SEQ ID NO: 154748 - DNA, 103 bp, Artificial Sequence
  Synthetic Polynucleotide
taatacgactcactatagggggcttgcccaccatcactgttcccttaggaaacagaggagatcctaaatgaacagtgataacctggcggcagcgcaaaagatg

SEQ ID NO: 154749 - DNA, 103 bp, Artificial Sequence
  Synthetic Polynucleotide
taatacgactcactataggggtgagaggaaggcttgcccaccatcactgtaacagaggagaacagtgatggtgggcaagaacctggcggcagcgcaaaagatg

SEQ ID NO: 154750 - DNA, 103 bp, Artificial Sequence
  Synthetic Polynucleotide
taatacgactcactatagggtatactgactgtgagaggaaggcttgcccaaacagaggagatgggcaatgcttcctctcaacctggcggcagcgcaaaagatg

SEQ ID NO: 154751 - DNA, 103 bp, Artificial Sequence
  Synthetic Polynucleotide
taatacgactcactatagggccactgctggtatactgactgtgagaggaaaacagaggagattcctcatgcagtcagtaaacctggcggcagcgcaaaagatg

SEQ ID NO: 154752 - DNA, 103 bp, Artificial Sequence
  Synthetic Polynucleotide
taatacgactcactatagggagacacagaaccactgctggtatactgactaacagaggagaagtcagatgaccagcagtaacctggcggcagcgcaaaagatg

SEQ ID NO: 154753 - DNA, 103 bp, Artificial Sequence
  Synthetic Polynucleotide
taatacgactcactatagggtgcctgaggaagacacagaaccactgctggaacagaggagaccagcaatggttctgtgtaacctggcggcagcgcaaaagatg

SEQ ID NO: 154754 - DNA, 103 bp, Artificial Sequence
  Synthetic Polynucleotide
taatacgactcactatagggtggcttttgctgcctgaggaagacacagaaaacagaggagattctgtatgttcctcaggaacctggcggcagcgcaaaagatg

SEQ ID NO: 154755 - DNA, 103 bp, Artificial Sequence
  Synthetic Polynucleotide
taatacgactcactatagggatggctatggtggcttttgctgcctgaggaaacagaggagatcctcaatgagcaaaagcaacctggcggcagcgcaaaagatg

SEQ ID NO: 154756 - DNA, 103 bp, Artificial Sequence
  Synthetic Polynucleotide
taatacgactcactatagggaggaggaagaatggctatggtggcttttgcaacagaggagagcaaaaatgaccatagccaacctggcggcagcgcaaaagatg

SEQ ID NO: 154757 - DNA, 103 bp, Artificial Sequence
  Synthetic Polynucleotide
taatacgactcactataggggcaggatctaactgcacttccacatagaacaacagaggagagttctaatgggaagtgcaaacctggcggcagcgcaaaagatg

SEQ ID NO: 154758 - DNA, 103 bp, Artificial Sequence
  Synthetic Polynucleotide
taatacgactcactataggggatgaggaagaggaggaagaatggctatggaacagaggagaccatagatgttcttcctcaacctggcggcagcgcaaaagatg

SEQ ID NO: 154759 - DNA, 103 bp, Artificial Sequence
  Synthetic Polynucleotide
taatacgactcactatagggggtggaagcagatgaggaagaggaggaagaaacagaggagatcttccatgtcttcctcaaacctggcggcagcgcaaaagatg

SEQ ID NO: 154760 - DNA, 103 bp, Artificial Sequence
  Synthetic Polynucleotide
taatacgactcactatagggtcttccctgaggtggaagcagatgaggaagaacagaggagacttcctatgctgcttccaaacctggcggcagcgcaaaagatg

SEQ ID NO: 154761 - DNA, 103 bp, Artificial Sequence
  Synthetic Polynucleotide
taatacgactcactatagggctgcttttcatcttccctgaggtggaagcaaacagaggagatgcttcatgctcagggaaaacctggcggcagcgcaaaagatg

SEQ ID NO: 154762 - DNA, 103 bp, Artificial Sequence
  Synthetic Polynucleotide
taatacgactcactatagggttctgatttactgcttttcatcttccctgaaacagaggagatcagggatgatgaaaagcaacctggcggcagcgcaaaagatg

SEQ ID NO: 154763 - DNA, 103 bp, Artificial Sequence
  Synthetic Polynucleotide
taatacgactcactatagggttgatgaaccttctgatttactgcttttcaaacagaggagatgaaaaatggtaaatcagaacctggcggcagcgcaaaagatg

SEQ ID NO: 154764 - DNA, 103 bp, Artificial Sequence
  Synthetic Polynucleotide
taatacgactcactatagggaacttggaacttgatgaaccttctgatttaaacagaggagataaatcatgaggttcatcaacctggcggcagcgcaaaagatg

SEQ ID NO: 154765 - DNA, 103 bp, Artificial Sequence
  Synthetic Polynucleotide
taatacgactcactatagggactgctacttaacttggaacttgatgaaccaacagaggagaggttcaatgagttccaagaacctggcggcagcgcaaaagatg

SEQ ID NO: 154766 - DNA, 103 bp, Artificial Sequence
  Synthetic Polynucleotide
taatacgactcactatagggtagaatacatactgctacttaacttggaacaacagaggagagttccaatgtaagtagcaaacctggcggcagcgcaaaagatg

SEQ ID NO: 154767 - DNA, 103 bp, Artificial Sequence
  Synthetic Polynucleotide
taatacgactcactataggggacccctggctagaatacatactgctacttaacagaggagaaagtagatgtatgtattcaacctggcggcagcgcaaaagatg

SEQ ID NO: 154768 - DNA, 103 bp, Artificial Sequence
  Synthetic Polynucleotide
taatacgactcactatagggaagctgtcctgcaggatctaactgcacttcaacagaggagagaagtgatgttagatcctaacctggcggcagcgcaaaagatg

SEQ ID NO: 154769 - DNA, 103 bp, Artificial Sequence
  Synthetic Polynucleotide
taatacgactcactatagggagatccagaagacccctggctagaatacataacagaggagaatgtatatgagccaggggaacctggcggcagcgcaaaagatg

SEQ ID NO: 154770 - DNA, 103 bp, Artificial Sequence
  Synthetic Polynucleotide
taatacgactcactatagggtggactggctagatccagaagacccctggcaacagaggagagccaggatgcttctggataacctggcggcagcgcaaaagatg

SEQ ID NO: 154771 - DNA, 103 bp, Artificial Sequence
  Synthetic Polynucleotide
taatacgactcactataggggatgaatttttggactggctagatccagaaaacagaggagattctggatgtagccagtcaacctggcggcagcgcaaaagatg

SEQ ID NO: 154772 - DNA, 103 bp, Artificial Sequence
  Synthetic Polynucleotide
taatacgactcactatagggcccagactgggatgaatttttggactggctaacagaggagaagccagatgaaaaattcaaacctggcggcagcgcaaaagatg

SEQ ID NO: 154773 - DNA, 103 bp, Artificial Sequence
  Synthetic Polynucleotide
taatacgactcactatagggctggcttccccccagactgggatgaattttaacagaggagaaaaattatgcccagtctgaacctggcggcagcgcaaaagatg

SEQ ID NO: 154774 - DNA, 103 bp, Artificial Sequence
  Synthetic Polynucleotide
taatacgactcactatagggggagaggagcctggcttccccccagactggaacagaggagaccagtcatgggggaagccaacctggcggcagcgcaaaagatg

SEQ ID NO: 154775 - DNA, 103 bp, Artificial Sequence
  Synthetic Polynucleotide
taatacgactcactatagggcttggttatgggagaggagcctggcttcccaacagaggagagggaagatgggctcctctaacctggcggcagcgcaaaagatg

SEQ ID NO: 154776 - DNA, 103 bp, Artificial Sequence
  Synthetic Polynucleotide
taatacgactcactatagggtcagtccatgcttggttatgggagaggagcaacagaggagagctcctatgccataaccaaacctggcggcagcgcaaaagatg

SEQ ID NO: 154777 - DNA, 103 bp, Artificial Sequence
  Synthetic Polynucleotide
taatacgactcactataggggagccactgctcagtccatgcttggttatgaacagaggagacataacatggcatggactaacctggcggcagcgcaaaagatg

SEQ ID NO: 154778 - DNA, 103 bp, Artificial Sequence
  Synthetic Polynucleotide
taatacgactcactatagggggtgctgctagagccactgctcagtccatgaacagaggagacatggaatgagcagtggcaacctggcggcagcgcaaaagatg

SEQ ID NO: 154779 - DNA, 103 bp, Artificial Sequence
  Synthetic Polynucleotide
taatacgactcactatagggttacatcacaaagctgtcctgcaggatctaaacagaggagatagatcatgcaggacagcaacctggcggcagcgcaaaagatg

SEQ ID NO: 154780 - DNA, 103 bp, Artificial Sequence
  Synthetic Polynucleotide
taatacgactcactataggggtttcatcttggtgctgctagagccactgcaacagaggagagcagtgatgctagcagcaaacctggcggcagcgcaaaagatg

SEQ ID NO: 154781 - DNA, 103 bp, Artificial Sequence
  Synthetic Polynucleotide
taatacgactcactatagggtttccttgaggtttcatcttggtgctgctaaacagaggagatagcagatgcaagatgaaaacctggcggcagcgcaaaagatg

SEQ ID NO: 154782 - DNA, 103 bp, Artificial Sequence
  Synthetic Polynucleotide
taatacgactcactatagggtgatgatggctttccttgaggtttcatcttaacagaggagaaagatgatgcctcaaggaaacctggcggcagcgcaaaagatg

SEQ ID NO: 154783 - DNA, 103 bp, Artificial Sequence
  Synthetic Polynucleotide
taatacgactcactataggggattcataagtgatgatggctttccttgagaacagaggagactcaagatgagccatcataacctggcggcagcgcaaaagatg

SEQ ID NO: 154784 - DNA, 103 bp, Artificial Sequence
  Synthetic Polynucleotide
taatacgactcactatagggcttaaagaaggattcataagtgatgatggcaacagaggagagccatcatgacttatgaaaacctggcggcagcgcaaaagatg

SEQ ID NO: 154785 - DNA, 103 bp, Artificial Sequence
  Synthetic Polynucleotide
taatacgactcactataggggtttggtttacttaaagaaggattcataagaacagaggagacttatgatgccttctttaaacctggcggcagcgcaaaagatg

SEQ ID NO: 154786 - DNA, 103 bp, Artificial Sequence
  Synthetic Polynucleotide
taatacgactcactatagggaaggggatatgtttggtttacttaaagaagaacagaggagacttcttatggtaaaccaaaacctggcggcagcgcaaaagatg

SEQ ID NO: 154787 - DNA, 103 bp, Artificial Sequence
  Synthetic Polynucleotide
taatacgactcactatagggcttgaatgagaaggggatatgtttggtttaaacagaggagataaaccatgcatatccccaacctggcggcagcgcaaaagatg

SEQ ID NO: 154788 - DNA, 103 bp, Artificial Sequence
  Synthetic Polynucleotide
taatacgactcactatagggtccaggtggccttgaatgagaaggggatataacagaggagaatatccatgtctcattcaaacctggcggcagcgcaaaagatg

SEQ ID NO: 154789 - DNA, 103 bp, Artificial Sequence
  Synthetic Polynucleotide
taatacgactcactatagggtgtcagagcctccaggtggccttgaatgagaacagaggagactcattatgggccacctgaacctggcggcagcgcaaaagatg

SEQ ID NO: 154790 - DNA, 103 bp, Artificial Sequence
  Synthetic Polynucleotide
taatacgactcactatagggtgagccacttttacatcacaaagctgtcctaacagaggagaaggacaatgttgtgatgtaacctggcggcagcgcaaaagatg

SEQ ID NO: 154791 - DNA, 103 bp, Artificial Sequence
  Synthetic Polynucleotide
taatacgactcactataggggaggcaagcttgtcagagcctccaggtggcaacagaggagagccaccatgaggctctgaaacctggcggcagcgcaaaagatg

SEQ ID NO: 154792 - DNA, 103 bp, Artificial Sequence
  Synthetic Polynucleotide
taatacgactcactatagggcttcattggagaggcaagcttgtcagagccaacagaggagaggctctatgaagcttgccaacctggcggcagcgcaaaagatg

SEQ ID NO: 154793 - DNA, 103 bp, Artificial Sequence
  Synthetic Polynucleotide
taatacgactcactatagggcaggaacaggcttcattggagaggcaagctaacagaggagaagcttgatgctccaatgaaacctggcggcagcgcaaaagatg

SEQ ID NO: 154794 - DNA, 103 bp, Artificial Sequence
  Synthetic Polynucleotide
taatacgactcactatagggggaggagttccaggaacaggcttcattggaaacagaggagatccaatatggcctgttccaacctggcggcagcgcaaaagatg

SEQ ID NO: 154795 - DNA, 103 bp, Artificial Sequence
  Synthetic Polynucleotide
taatacgactcactatagggtttagaggatggaggagttccaggaacaggaacagaggagacctgttatgggaactcctaacctggcggcagcgcaaaagatg

SEQ ID NO: 154796 - DNA, 103 bp, Artificial Sequence
  Synthetic Polynucleotide
taatacgactcactataggggggacttggctttagaggatggaggagttcaacagaggagagaactcatgcatcctctaaacctggcggcagcgcaaaagatg

SEQ ID NO: 154797 - DNA, 103 bp, Artificial Sequence
  Synthetic Polynucleotide
taatacgactcactataggggaactgataggggacttggctttagaggataacagaggagaatcctcatgagccaagtcaacctggcggcagcgcaaaagatg

SEQ ID NO: 154798 - DNA, 103 bp, Artificial Sequence
  Synthetic Polynucleotide
taatacgactcactatagggaccagaacctgaactgataggggacttggcaacagaggagagccaagatgcctatcagtaacctggcggcagcgcaaaagatg

SEQ ID NO: 154799 - DNA, 103 bp, Artificial Sequence
  Synthetic Polynucleotide
taatacgactcactatagggtatgagaaccaccagaacctgaactgatagaacagaggagactatcaatgcaggttctgaacctggcggcagcgcaaaagatg

SEQ ID NO: 154800 - DNA, 103 bp, Artificial Sequence
  Synthetic Polynucleotide
taatacgactcactataggggttccagacatatgagaaccaccagaacctaacagaggagaaggttcatgtggttctcaaacctggcggcagcgcaaaagatg

SEQ ID NO: 154801 - DNA, 103 bp, Artificial Sequence
  Synthetic Polynucleotide
taatacgactcactatagggctccccatggtgagccacttttacatcacaaacagaggagatgtgatatgaaagtggctaacctggcggcagcgcaaaagatg

SEQ ID NO: 154802 - DNA, 103 bp, Artificial Sequence
  Synthetic Polynucleotide
taatacgactcactataggggcttgaactagttccagacatatgagaaccaacagaggagaggttctatgatgtctggaaacctggcggcagcgcaaaagatg

SEQ ID NO: 154803 - DNA, 103 bp, Artificial Sequence
  Synthetic Polynucleotide
taatacgactcactatagggtcatgccagagcttgaactagttccagacaaacagaggagatgtctgatgctagttcaaaacctggcggcagcgcaaaagatg

SEQ ID NO: 154804 - DNA, 103 bp, Artificial Sequence
  Synthetic Polynucleotide
taatacgactcactataggggaagatgacttcatgccagagcttgaactaaacagaggagatagttcatgctctggcataacctggcggcagcgcaaaagatg

SEQ ID NO: 154805 - DNA, 103 bp, Artificial Sequence
  Synthetic Polynucleotide
taatacgactcactatagggtcctaaccctgaagatgacttcatgccagaaacagaggagatctggcatgaagtcatctaacctggcggcagcgcaaaagatg

SEQ ID NO: 154806 - DNA, 103 bp, Artificial Sequence
  Synthetic Polynucleotide
taatacgactcactatagggagcctgaggatcctaaccctgaagatgactaacagaggagaagtcatatgcagggttagaacctggcggcagcgcaaaagatg

SEQ ID NO: 154807 - DNA, 103 bp, Artificial Sequence
  Synthetic Polynucleotide
taatacgactcactatagggtgggacaacgagcctgaggatcctaaccctaacagaggagaagggttatgatcctcaggaacctggcggcagcgcaaaagatg

SEQ ID NO: 154808 - DNA, 103 bp, Artificial Sequence
  Synthetic Polynucleotide
taatacgactcactataggggggagttttctgggacaacgagcctgaggaaacagaggagatcctcaatgtcgttgtccaacctggcggcagcgcaaaagatg

SEQ ID NO: 154809 - DNA, 103 bp, Artificial Sequence
  Synthetic Polynucleotide
taatacgactcactatagggtagatgatgggggagttttctgggacaacgaacagaggagacgttgtatgagaaaactcaacctggcggcagcgcaaaagatg

SEQ ID NO: 154810 - DNA, 103 bp, Artificial Sequence
  Synthetic Polynucleotide
taatacgactcactataggggtacaggaattagatgatgggggagttttcaacagaggagagaaaacatgcccatcatcaacctggcggcagcgcaaaagatg

SEQ ID NO: 154811 - DNA, 103 bp, Artificial Sequence
  Synthetic Polynucleotide
taatacgactcactatagggggaagatgccgtacaggaattagatgatggaacagaggagaccatcaatgaattcctgtaacctggcggcagcgcaaaagatg

SEQ ID NO: 154812 - DNA, 103 bp, Artificial Sequence
  Synthetic Polynucleotide
taatacgactcactatagggtcacaggattctccccatggtgagccacttaacagaggagaaagtggatgaccatggggaacctggcggcagcgcaaaagatg

SEQ ID NO: 154813 - DNA, 103 bp, Artificial Sequence
  Synthetic Polynucleotide
taatacgactcactatagggaaaaggaggaggaagatgccgtacaggaataacagaggagaattcctatgcggcatcttaacctggcggcagcgcaaaagatg

SEQ ID NO: 154814 - DNA, 103 bp, Artificial Sequence
  Synthetic Polynucleotide
taatacgactcactatagggccacttgaggaaaaggaggaggaagatgccaacagaggagaggcatcatgctcctccttaacctggcggcagcgcaaaagatg

SEQ ID NO: 154815 - DNA, 103 bp, Artificial Sequence
  Synthetic Polynucleotide
taatacgactcactatagggcatggaagagccacttgaggaaaaggaggaaacagaggagatcctccatgtcctcaagtaacctggcggcagcgcaaaagatg

SEQ ID NO: 154816 - DNA, 103 bp, Artificial Sequence
  Synthetic Polynucleotide
taatacgactcactataggggagaggatgacatggaagagccacttgaggaacagaggagacctcaaatggctcttccaaacctggcggcagcgcaaaagatg

SEQ ID NO: 154817 - DNA, 103 bp, Artificial Sequence
  Synthetic Polynucleotide
taatacgactcactatagggtgctggttctgagaggatgacatggaagagaacagaggagactcttcatggtcatcctcaacctggcggcagcgcaaaagatg

SEQ ID NO: 154818 - DNA, 103 bp, Artificial Sequence
  Synthetic Polynucleotide
taatacgactcactatagggagaactcccatgctggttctgagaggatgaaacagaggagatcatccatgcagaaccagaacctggcggcagcgcaaaagatg

SEQ ID NO: 154819 - DNA, 103 bp, Artificial Sequence
  Synthetic Polynucleotide
taatacgactcactatagggattttcctttagaactcccatgctggttctaacagaggagaagaaccatgatgggagttaacctggcggcagcgcaaaagatg

SEQ ID NO: 154820 - DNA, 103 bp, Artificial Sequence
  Synthetic Polynucleotide
taatacgactcactatagggctgctgggagattttcctttagaactcccaaacagaggagatgggagatgtaaaggaaaaacctggcggcagcgcaaaagatg

SEQ ID NO: 154821 - DNA, 103 bp, Artificial Sequence
  Synthetic Polynucleotide
taatacgactcactatagggcttcttgtttctgctgggagattttcctttaacagaggagaaaaggaatgtctcccagcaacctggcggcagcgcaaaagatg

SEQ ID NO: 154822 - DNA, 103 bp, Artificial Sequence
  Synthetic Polynucleotide
taatacgactcactatagggtcaaggacggcttcttgtttctgctgggagaacagaggagactcccaatggaaacaagaaacctggcggcagcgcaaaagatg

SEQ ID NO: 154823 - DNA, 103 bp, Artificial Sequence
  Synthetic Polynucleotide
taatacgactcactatagggtccggacagctcacaggattctccccatggaacagaggagaccatggatggaatcctgtaacctggcggcagcgcaaaagatg

SEQ ID NO: 154824 - DNA, 103 bp, Artificial Sequence
  Synthetic Polynucleotide
taatacgactcactatagggatgacagctgtcaaggacggcttcttgtttaacagaggagaaaacaaatggccgtccttaacctggcggcagcgcaaaagatg

SEQ ID NO: 154825 - DNA, 103 bp, Artificial Sequence
  Synthetic Polynucleotide
taatacgactcactatagggcagtttatctatgacagctgtcaaggacggaacagaggagaccgtccatgacagctgtcaacctggcggcagcgcaaaagatg

SEQ ID NO: 154826 - DNA, 103 bp, Artificial Sequence
  Synthetic Polynucleotide
taatacgactcactatagggccccatgcttcagtttatctatgacagctgaacagaggagacagctgatgtagataaacaacctggcggcagcgcaaaagatg

SEQ ID NO: 154827 - DNA, 103 bp, Artificial Sequence
  Synthetic Polynucleotide
taatacgactcactatagggctggtgacaaccccatgcttcagtttatctaacagaggagaagataaatggaagcatggaacctggcggcagcgcaaaagatg

SEQ ID NO: 154828 - DNA, 103 bp, Artificial Sequence
  Synthetic Polynucleotide
taatacgactcactatagggcccagggccactggtgacaaccccatgcttaacagaggagaaagcatatggttgtcaccaacctggcggcagcgcaaaagatg

SEQ ID NO: 154829 - DNA, 103 bp, Artificial Sequence
  Synthetic Polynucleotide
taatacgactcactatagggggtcttcacccccagggccactggtgacaaaacagaggagattgtcaatggtggccctgaacctggcggcagcgcaaaagatg

SEQ ID NO: 154830 - DNA, 103 bp, Artificial Sequence
  Synthetic Polynucleotide
taatacgactcactatagggccgtccagtgggtcttcacccccagggccaaacagaggagatggcccatggggtgaagaaacctggcggcagcgcaaaagatg

SEQ ID NO: 154831 - DNA, 103 bp, Artificial Sequence
  Synthetic Polynucleotide
taatacgactcactatagggccccatctggccgtccagtgggtcttcaccaacagaggagaggtgaaatgccactggacaacctggcggcagcgcaaaagatg

SEQ ID NO: 154832 - DNA, 103 bp, Artificial Sequence
  Synthetic Polynucleotide
taatacgactcactatagggttgtgctcacccccatctggccgtccagtgaacagaggagacactggatggccagatggaacctggcggcagcgcaaaagatg

SEQ ID NO: 154833 - DNA, 103 bp, Artificial Sequence
  Synthetic Polynucleotide
taatacgactcactatagggctggaagaatttgtgctcacccccatctggaacagaggagaccagatatgggtgagcacaacctggcggcagcgcaaaagatg

SEQ ID NO: 154834 - DNA, 103 bp, Artificial Sequence
  Synthetic Polynucleotide
taatacgactcactatagggcaggagagaactcatcttactcagcttttcaacagaggagagaaaagatgagtaagatgaacctggcggcagcgcaaaagatg

SEQ ID NO: 154835 - DNA, 103 bp, Artificial Sequence
  Synthetic Polynucleotide
taatacgactcactatagggctgtacaagctccggacagctcacaggattaacagaggagaaatcctatgagctgtccgaacctggcggcagcgcaaaagatg

SEQ ID NO: 154836 - DNA, 103 bp, Artificial Sequence
  Synthetic Polynucleotide
taatacgactcactatagggcataggatggctggaagaatttgtgctcacaacagaggagagtgagcatgaattcttccaacctggcggcagcgcaaaagatg

SEQ ID NO: 154837 - DNA, 103 bp, Artificial Sequence
  Synthetic Polynucleotide
taatacgactcactataggggtttggaggacataggatggctggaagaataacagaggagaattcttatggccatcctaaacctggcggcagcgcaaaagatg

SEQ ID NO: 154838 - DNA, 103 bp, Artificial Sequence
  Synthetic Polynucleotide
taatacgactcactataggggacatgttatgtttggaggacataggatggaacagaggagaccatccatggtcctccaaaacctggcggcagcgcaaaagatg

SEQ ID NO: 154839 - DNA, 103 bp, Artificial Sequence
  Synthetic Polynucleotide
taatacgactcactatagggctctcctcctgacatgttatgtttggaggaaacagaggagatcctccatgcataacatgaacctggcggcagcgcaaaagatg

SEQ ID NO: 154840 - DNA, 103 bp, Artificial Sequence
  Synthetic Polynucleotide
taatacgactcactatagggtgccctgaaactctcctcctgacatgttataacagaggagaataacaatgcaggaggagaacctggcggcagcgcaaaagatg

SEQ ID NO: 154841 - DNA, 103 bp, Artificial Sequence
  Synthetic Polynucleotide
taatacgactcactatagggttctcacgcttgccctgaaactctcctcctaacagaggagaaggaggatggtttcagggaacctggcggcagcgcaaaagatg

SEQ ID NO: 154842 - DNA, 103 bp, Artificial Sequence
  Synthetic Polynucleotide
taatacgactcactatagggtttatcacttttctcacgcttgccctgaaaaacagaggagatttcagatgaagcgtgagaacctggcggcagcgcaaaagatg

SEQ ID NO: 154843 - DNA, 103 bp, Artificial Sequence
  Synthetic Polynucleotide
taatacgactcactatagggttgatttgtctttatcacttttctcacgctaacagaggagaagcgtgatgaaagtgataaacctggcggcagcgcaaaagatg

SEQ ID NO: 154844 - DNA, 103 bp, Artificial Sequence
  Synthetic Polynucleotide
taatacgactcactataggggtggaaacctttgatttgtctttatcacttaacagaggagaaagtgaatgagacaaatcaacctggcggcagcgcaaaagatg

SEQ ID NO: 154845 - DNA, 103 bp, Artificial Sequence
  Synthetic Polynucleotide
taatacgactcactatagggactcccggaggtggaaacctttgatttgtcaacagaggagagacaaaatgaaggtttccaacctggcggcagcgcaaaagatg

SEQ ID NO: 154846 - DNA, 103 bp, Artificial Sequence
  Synthetic Polynucleotide
taatacgactcactatagggcccttagctgctgtacaagctccggacagcaacagaggagagctgtcatgagcttgtacaacctggcggcagcgcaaaagatg

SEQ ID NO: 154847 - DNA, 103 bp, Artificial Sequence
  Synthetic Polynucleotide
taatacgactcactatagggaatccactgaactcccggaggtggaaacctaacagaggagaaggtttatgcctccgggaaacctggcggcagcgcaaaagatg

SEQ ID NO: 154848 - DNA, 103 bp, Artificial Sequence
  Synthetic Polynucleotide
taatacgactcactatagggttcttagaagaatccactgaactcccggagaacagaggagactccggatgttcagtggaaacctggcggcagcgcaaaagatg

SEQ ID NO: 154849 - DNA, 103 bp, Artificial Sequence
  Synthetic Polynucleotide
taatacgactcactatagggctctgaggtcttcttagaagaatccactgaaacagaggagatcagtgatgtcttctaagaacctggcggcagcgcaaaagatg

SEQ ID NO: 154850 - DNA, 103 bp, Artificial Sequence
  Synthetic Polynucleotide
taatacgactcactatagggcattttttgactctgaggtcttcttagaagaacagaggagacttctaatgagacctcagaacctggcggcagcgcaaaagatg

SEQ ID NO: 154851 - DNA, 103 bp, Artificial Sequence
  Synthetic Polynucleotide
taatacgactcactataggggtgctccccacattttttgactctgaggtcaacagaggagagacctcatggtcaaaaaaaacctggcggcagcgcaaaagatg

SEQ ID NO: 154852 - DNA, 103 bp, Artificial Sequence
  Synthetic Polynucleotide
taatacgactcactatagggtgccacacctgtgctccccacattttttgaaacagaggagatcaaaaatggtggggagcaacctggcggcagcgcaaaagatg

SEQ ID NO: 154853 - DNA, 103 bp, Artificial Sequence
  Synthetic Polynucleotide
taatacgactcactatagggtgataatttttgccacacctgtgctccccaaacagaggagatggggaatgcaggtgtggaacctggcggcagcgcaaaagatg

SEQ ID NO: 154854 - DNA, 103 bp, Artificial Sequence
  Synthetic Polynucleotide
taatacgactcactatagggtgcttactgatgataatttttgccacacctaacagaggagaaggtgtatgaaaaattataacctggcggcagcgcaaaagatg

SEQ ID NO: 154855 - DNA, 103 bp, Artificial Sequence
  Synthetic Polynucleotide
taatacgactcactataggggcctccatcatgcttactgatgataattttaacagaggagaaaaattatgatcagtaagaacctggcggcagcgcaaaagatg

SEQ ID NO: 154856 - DNA, 103 bp, Artificial Sequence
  Synthetic Polynucleotide
taatacgactcactatagggtgctaggggagcctccatcatgcttactgaaacagaggagatcagtaatgatgatggagaacctggcggcagcgcaaaagatg

SEQ ID NO: 154857 - DNA, 103 bp, Artificial Sequence
  Synthetic Polynucleotide
taatacgactcactatagggaaatttttttcccttagctgctgtacaagcaacagaggagagcttgtatggcagctaagaacctggcggcagcgcaaaagatg

SEQ ID NO: 154858 - DNA, 103 bp, Artificial Sequence
  Synthetic Polynucleotide
taatacgactcactatagggttggctttaatgctaggggagcctccatcaaacagaggagatgatggatgctcccctagaacctggcggcagcgcaaaagatg

SEQ ID NO: 154859 - DNA, 103 bp, Artificial Sequence
  Synthetic Polynucleotide
taatacgactcactatagggcaaagtcactttggctttaatgctaggggaaacagaggagatcccctatgattaaagccaacctggcggcagcgcaaaagatg

SEQ ID NO: 154860 - DNA, 103 bp, Artificial Sequence
  Synthetic Polynucleotide
taatacgactcactatagggcaggtttctgcaaagtcactttggctttaaaacagaggagattaaagatgaagtgacttaacctggcggcagcgcaaaagatg

SEQ ID NO: 154861 - DNA, 103 bp, Artificial Sequence
  Synthetic Polynucleotide
taatacgactcactatagggctactttccccaggtttctgcaaagtcactaacagaggagaagtgacatggcagaaaccaacctggcggcagcgcaaaagatg

SEQ ID NO: 154862 - DNA, 103 bp, Artificial Sequence
  Synthetic Polynucleotide
taatacgactcactatagggcccttctccactactttccccaggtttctgaacagaggagacagaaaatgggggaaagtaacctggcggcagcgcaaaagatg

SEQ ID NO: 154863 - DNA, 103 bp, Artificial Sequence
  Synthetic Polynucleotide
taatacgactcactataggggaggcctaagcccttctccactactttcccaacagaggagagggaaaatggtggagaagaacctggcggcagcgcaaaagatg

SEQ ID NO: 154864 - DNA, 103 bp, Artificial Sequence
  Synthetic Polynucleotide
taatacgactcactataggggaagccatttgaggcctaagcccttctccaaacagaggagatggagaatggcttaggccaacctggcggcagcgcaaaagatg

SEQ ID NO: 154865 - DNA, 103 bp, Artificial Sequence
  Synthetic Polynucleotide
taatacgactcactataggggtttttagaagaagccatttgaggcctaagaacagaggagacttaggatgcaaatggctaacctggcggcagcgcaaaagatg

SEQ ID NO: 154866 - DNA, 103 bp, Artificial Sequence
  Synthetic Polynucleotide
taatacgactcactataggggagagccatagtttttagaagaagccatttaacagaggagaaaatggatgcttctaaaaaacctggcggcagcgcaaaagatg

SEQ ID NO: 154867 - DNA, 103 bp, Artificial Sequence
  Synthetic Polynucleotide
taatacgactcactatagggctgatgagtggagagccatagtttttagaaaacagaggagattctaaatgctatggctcaacctggcggcagcgcaaaagatg

SEQ ID NO: 154868 - DNA, 103 bp, Artificial Sequence
  Synthetic Polynucleotide
taatacgactcactatagggaaattcatcaaaatttttttcccttagctgaacagaggagacagctaatggaaaaaaataacctggcggcagcgcaaaagatg

SEQ ID NO: 154869 - DNA, 103 bp, Artificial Sequence
  Synthetic Polynucleotide
taatacgactcactatagggagtggaaccactgatgagtggagagccataaacagaggagatatggcatgccactcatcaacctggcggcagcgcaaaagatg

SEQ ID NO: 154870 - DNA, 103 bp, Artificial Sequence
  Synthetic Polynucleotide
taatacgactcactatagggcatgctttggagtggaaccactgatgagtgaacagaggagacactcaatggtggttccaaacctggcggcagcgcaaaagatg

SEQ ID NO: 154871 - DNA, 103 bp, Artificial Sequence
  Synthetic Polynucleotide
taatacgactcactataggggagccacgctcatgctttggagtggaaccaaacagaggagatggttcatgtccaaagcaaacctggcggcagcgcaaaagatg

SEQ ID NO: 154872 - DNA, 103 bp, Artificial Sequence
  Synthetic Polynucleotide
taatacgactcactatagggatggctgggagagccacgctcatgctttggaacagaggagaccaaagatggagcgtggcaacctggcggcagcgcaaaagatg

SEQ ID NO: 154873 - DNA, 103 bp, Artificial Sequence
  Synthetic Polynucleotide
taatacgactcactataggggtgacttactatggctgggagagccacgctaacagaggagaagcgtgatgctcccagccaacctggcggcagcgcaaaagatg

SEQ ID NO: 154874 - DNA, 103 bp, Artificial Sequence
  Synthetic Polynucleotide
taatacgactcactataggggtatatgctggtgacttactatggctgggaaacagaggagatcccagatgtagtaagtcaacctggcggcagcgcaaaagatg

SEQ ID NO: 154875 - DNA, 103 bp, Artificial Sequence
  Synthetic Polynucleotide
taatacgactcactatagggattctggggggtatatgctggtgacttactaacagaggagaagtaagatgccagcatataacctggcggcagcgcaaaagatg

SEQ ID NO: 154876 - DNA, 103 bp, Artificial Sequence
  Synthetic Polynucleotide
taatacgactcactatagggcactgtccagattctggggggtatatgctgaacagaggagacagcatatgccccccagaaacctggcggcagcgcaaaagatg

SEQ ID NO: 154877 - DNA, 103 bp, Artificial Sequence
  Synthetic Polynucleotide
taatacgactcactataggggactcactttcactgtccagattctgggggaacagaggagacccccaatgtctggacagaacctggcggcagcgcaaaagatg

SEQ ID NO: 154878 - DNA, 103 bp, Artificial Sequence
  Synthetic Polynucleotide
taatacgactcactatagggggaggagcctgactcactttcactgtccagaacagaggagactggacatggaaagtgagaacctggcggcagcgcaaaagatg

SEQ ID NO: 154879 - DNA, 103 bp, Artificial Sequence
  Synthetic Polynucleotide
taatacgactcactatagggggtgcttagaaaattcatcaaaatttttttaacagaggagaaaaaaaatgttgatgaataacctggcggcagcgcaaaagatg

SEQ ID NO: 154880 - DNA, 103 bp, Artificial Sequence
  Synthetic Polynucleotide
taatacgactcactatagggtctctgctatggaggagcctgactcactttaacagaggagaaaagtgatgcaggctcctaacctggcggcagcgcaaaagatg

SEQ ID NO: 154881 - DNA, 103 bp, Artificial Sequence
  Synthetic Polynucleotide
taatacgactcactatagggtgataagatttctctgctatggaggagcctaacagaggagaaggctcatgcatagcagaaacctggcggcagcgcaaaagatg

SEQ ID NO: 154882 - DNA, 103 bp, Artificial Sequence
  Synthetic Polynucleotide
taatacgactcactataggggggactattctgataagatttctctgctataacagaggagaatagcaatgaaatcttataacctggcggcagcgcaaaagatg

SEQ ID NO: 154883 - DNA, 103 bp, Artificial Sequence
  Synthetic Polynucleotide
taatacgactcactatagggcgtctgagctgggactattctgataagattaacagaggagaaatcttatgagaatagtcaacctggcggcagcgcaaaagatg

SEQ ID NO: 154884 - DNA, 103 bp, Artificial Sequence
  Synthetic Polynucleotide
taatacgactcactatagggcggataccatcgtctgagctgggactattcaacagaggagagaatagatgcagctcagaaacctggcggcagcgcaaaagatg

SEQ ID NO: 154885 - DNA, 103 bp, Artificial Sequence
  Synthetic Polynucleotide
taatacgactcactatagggtggaagtggtcggataccatcgtctgagctaacagaggagaagctcaatggatggtatcaacctggcggcagcgcaaaagatg

SEQ ID NO: 154886 - DNA, 103 bp, Artificial Sequence
  Synthetic Polynucleotide
taatacgactcactatagggtgctgtattctggaagtggtcggataccataacagaggagaatggtaatggaccacttcaacctggcggcagcgcaaaagatg

SEQ ID NO: 154887 - DNA, 103 bp, Artificial Sequence
  Synthetic Polynucleotide
taatacgactcactatagggtgtttctctgtgctgtattctggaagtggtaacagaggagaaccactatgagaatacagaacctggcggcagcgcaaaagatg

SEQ ID NO: 154888 - DNA, 103 bp, Artificial Sequence
  Synthetic Polynucleotide
taatacgactcactataggggtgcttcttatgtttctctgtgctgtattcaacagaggagagaatacatgacagagaaaaacctggcggcagcgcaaaagatg

SEQ ID NO: 154889 - DNA, 103 bp, Artificial Sequence
  Synthetic Polynucleotide
taatacgactcactatagggtttcctttttgtgcttcttatgtttctctgaacagaggagacagagaatgataagaagcaacctggcggcagcgcaaaagatg

SEQ ID NO: 154890 - DNA, 103 bp, Artificial Sequence
  Synthetic Polynucleotide
taatacgactcactatagggaggcccttaaggtgcttagaaaattcatcaaacagaggagatgatgaatgttctaagcaaacctggcggcagcgcaaaagatg

SEQ ID NO: 154891 - DNA, 103 bp, Artificial Sequence
  Synthetic Polynucleotide
taatacgactcactatagggactttcttcttttcctttttgtgcttcttaaacagaggagataagaaatgcaaaaaggaaacctggcggcagcgcaaaagatg

SEQ ID NO: 154892 - DNA, 103 bp, Artificial Sequence
  Synthetic Polynucleotide
taatacgactcactatagggtttgtcttttactttcttcttttcctttttaacagaggagaaaaaagatgaagaagaaaaacctggcggcagcgcaaaagatg

SEQ ID NO: 154893 - DNA, 103 bp, Artificial Sequence
  Synthetic Polynucleotide
taatacgactcactatagggggtccctatctttgtcttttactttcttctaacagaggagaagaagaatgtaaaagacaaacctggcggcagcgcaaaagatg

SEQ ID NO: 154894 - DNA, 103 bp, Artificial Sequence
  Synthetic Polynucleotide
taatacgactcactatagggtcccggtctcggtccctatctttgtcttttaacagaggagaaaaagaatgagatagggaaacctggcggcagcgcaaaagatg

SEQ ID NO: 154895 - DNA, 103 bp, Artificial Sequence
  Synthetic Polynucleotide
taatacgactcactatagggtcggtctttgtcccggtctcggtccctatcaacagaggagagataggatgcgagaccggaacctggcggcagcgcaaaagatg

SEQ ID NO: 154896 - DNA, 103 bp, Artificial Sequence
  Synthetic Polynucleotide
taatacgactcactatagggttttcttgtctcggtctttgtcccggtctcaacagaggagagagaccatgacaaagaccaacctggcggcagcgcaaaagatg

SEQ ID NO: 154897 - DNA, 103 bp, Artificial Sequence
  Synthetic Polynucleotide
taatacgactcactatagggctatgagattttttcttgtctcggtctttgaacagaggagacaaagaatgagacaagaaaacctggcggcagcgcaaaagatg

SEQ ID NO: 154898 - DNA, 103 bp, Artificial Sequence
  Synthetic Polynucleotide
taatacgactcactatagggtggcttgatgctatgagattttttcttgtcaacagaggagagacaagatgaaatctcataacctggcggcagcgcaaaagatg

SEQ ID NO: 154899 - DNA, 103 bp, Artificial Sequence
  Synthetic Polynucleotide
taatacgactcactatagggaccaactctctggcttgatgctatgagattaacagaggagaaatctcatggcatcaagcaacctggcggcagcgcaaaagatg

SEQ ID NO: 154900 - DNA, 103 bp, Artificial Sequence
  Synthetic Polynucleotide
taatacgactcactatagggggtgatttggaccaactctctggcttgatgaacagaggagacatcaaatgagagagttgaacctggcggcagcgcaaaagatg

SEQ ID NO: 154901 - DNA, 103 bp, Artificial Sequence
  Synthetic Polynucleotide
taatacgactcactatagggcagattaacaaggcccttaaggtgcttagaaacagaggagatctaagatgcttaagggcaacctggcggcagcgcaaaagatg

SEQ ID NO: 154902 - DNA, 103 bp, Artificial Sequence
  Synthetic Polynucleotide
taatacgactcactatagggtgaagagatgggtgatttggaccaactctcaacagaggagagagagtatgtccaaatcaaacctggcggcagcgcaaaagatg

SEQ ID NO: 154903 - DNA, 103 bp, Artificial Sequence
  Synthetic Polynucleotide
taatacgactcactatagggaggactggtctgaagagatgggtgatttggaacagaggagaccaaatatgccatctcttaacctggcggcagcgcaaaagatg

SEQ ID NO: 154904 - DNA, 103 bp, Artificial Sequence
  Synthetic Polynucleotide
taatacgactcactataggggtcatagacaaggactggtctgaagagatgaacagaggagacatctcatgagaccagtcaacctggcggcagcgcaaaagatg

SEQ ID NO: 154905 - DNA, 103 bp, Artificial Sequence
  Synthetic Polynucleotide
taatacgactcactatagggtgtgttacttgtcatagacaaggactggtcaacagaggagagaccagatgttgtctatgaacctggcggcagcgcaaaagatg

SEQ ID NO: 154906 - DNA, 103 bp, Artificial Sequence
  Synthetic Polynucleotide
taatacgactcactatagggcagataagattgtgttacttgtcatagacaaacagaggagatgtctaatgcaagtaacaaacctggcggcagcgcaaaagatg

SEQ ID NO: 154907 - DNA, 103 bp, Artificial Sequence
  Synthetic Polynucleotide
taatacgactcactatagggggtctgtctgcagataagattgtgttacttaacagaggagaaagtaaatgaatcttatcaacctggcggcagcgcaaaagatg

SEQ ID NO: 154908 - DNA, 103 bp, Artificial Sequence
  Synthetic Polynucleotide
taatacgactcactataggggagccttgagggtctgtctgcagataagataacagaggagaatcttaatggcagacagaaacctggcggcagcgcaaaagatg

SEQ ID NO: 154909 - DNA, 103 bp, Artificial Sequence
  Synthetic Polynucleotide
taatacgactcactatagggagtctgggctgagccttgagggtctgtctgaacagaggagacagacaatgcctcaaggcaacctggcggcagcgcaaaagatg

SEQ ID NO: 154910 - DNA, 103 bp, Artificial Sequence
  Synthetic Polynucleotide
taatacgactcactatagggccaatcataaagtctgggctgagccttgagaacagaggagactcaagatgcagcccagaaacctggcggcagcgcaaaagatg

SEQ ID NO: 154911 - DNA, 103 bp, Artificial Sequence
  Synthetic Polynucleotide
taatacgactcactatagggatcttcctccccaatcataaagtctgggctaacagaggagaagcccaatgtttatgattaacctggcggcagcgcaaaagatg

SEQ ID NO: 154912 - DNA, 103 bp, Artificial Sequence
  Synthetic Polynucleotide
taatacgactcactataggggaaggttatacagattaacaaggcccttaaaacagaggagattaaggatgttgttaatcaacctggcggcagcgcaaaagatg

SEQ ID NO: 154913 - DNA, 103 bp, Artificial Sequence
  Synthetic Polynucleotide
taatacgactcactatagggtaagatcatcatcttcctccccaatcataaaacagaggagattatgaatggggaggaagaacctggcggcagcgcaaaagatg

SEQ ID NO: 154914 - DNA, 103 bp, Artificial Sequence
  Synthetic Polynucleotide
taatacgactcactataggggccacatccataagatcatcatcttcctccaacagaggagaggaggaatgtgatgatctaacctggcggcagcgcaaaagatg

SEQ ID NO: 154915 - DNA, 103 bp, Artificial Sequence
  Synthetic Polynucleotide
taatacgactcactatagggcccaatcagggccacatccataagatcatcaacagaggagagatgatatgatggatgtgaacctggcggcagcgcaaaagatg

SEQ ID NO: 154916 - DNA, 103 bp, Artificial Sequence
  Synthetic Polynucleotide
taatacgactcactatagggttgtcccctggaaggttatacagattaacaaacagaggagatgttaaatggtataacctaacctggcggcagcgcaaaagatg

SEQ ID NO: 154917 - DNA, 103 bp, Artificial Sequence
  Synthetic Polynucleotide
taatacgactcactatagggcttcagtttgttgtcccctggaaggttataaacagaggagatataacatgccaggggacaacctggcggcagcgcaaaagatg

SEQ ID NO: 154918 - DNA, 103 bp, Artificial Sequence
  Synthetic Polynucleotide
taatacgactcactatagggggagccgttccaggagagaactcatcttacaacagaggagagtaagaatggttctctccaacctggcggcagcgcaaaagatg

SEQ ID NO: 154919 - DNA, 103 bp, Artificial Sequence
  Synthetic Polynucleotide
taatacgactcactatagggacattttagtcttcagtttgttgtcccctgaacagaggagacaggggatgacaaactgaaacctggcggcagcgcaaaagatg

SEQ ID NO: 154920 - DNA, 103 bp, Artificial Sequence
  Synthetic Polynucleotide
taatacgactcactatagggagagccaagtacattttagtcttcagtttgaacagaggagacaaactatggactaaaataacctggcggcagcgcaaaagatg

SEQ ID NO: 154921 - DNA, 103 bp, Artificial Sequence
  Synthetic Polynucleotide
taatacgactcactatagggtaaggattggagagccaagtacattttagtaacagaggagaactaaaatgtacttggctaacctggcggcagcgcaaaagatg

SEQ ID NO: 154922 - DNA, 103 bp, Artificial Sequence
  Synthetic Polynucleotide
taatacgactcactataggggatcttgttctaaggattggagagccaagtaacagaggagaacttggatgtccaatcctaacctggcggcagcgcaaaagatg

SEQ ID NO: 154923 - DNA, 103 bp, Artificial Sequence
  Synthetic Polynucleotide
taatacgactcactatagggattttagaaagatcttgttctaaggattggaacagaggagaccaatcatgagaacaagaaacctggcggcagcgcaaaagatg

SEQ ID NO: 154924 - DNA, 103 bp, Artificial Sequence
  Synthetic Polynucleotide
taatacgactcactatagggcataattgccattttagaaagatcttgttcaacagaggagagaacaaatgctttctaaaaacctggcggcagcgcaaaagatg

SEQ ID NO: 154925 - DNA, 103 bp, Artificial Sequence
  Synthetic Polynucleotide
taatacgactcactatagggctttccagtacataattgccattttagaaaaacagaggagatttctaatgtggcaattaaacctggcggcagcgcaaaagatg

SEQ ID NO: 154926 - DNA, 103 bp, Artificial Sequence
  Synthetic Polynucleotide
taatacgactcactataggggcattagttgctttccagtacataattgccaacagaggagaggcaatatggtactggaaaacctggcggcagcgcaaaagatg

SEQ ID NO: 154927 - DNA, 103 bp, Artificial Sequence
  Synthetic Polynucleotide
taatacgactcactatagggcaagggaccagcattagttgctttccagtaaacagaggagatactggatggcaactaataacctggcggcagcgcaaaagatg

SEQ ID NO: 154928 - DNA, 103 bp, Artificial Sequence
  Synthetic Polynucleotide
taatacgactcactataggggaatcttatccaagggaccagcattagttgaacagaggagacaactaatgctggtccctaacctggcggcagcgcaaaagatg

SEQ ID NO: 154929 - DNA, 103 bp, Artificial Sequence
  Synthetic Polynucleotide
taatacgactcactatagggaattttgcatggagccgttccaggagagaaaacagaggagattctctatgggaacggctaacctggcggcagcgcaaaagatg

SEQ ID NO: 154930 - DNA, 103 bp, Artificial Sequence
  Synthetic Polynucleotide
taatacgactcactatagggcttccatgaagaatcttatccaagggaccaaacagaggagatggtccatgggataagataacctggcggcagcgcaaaagatg

SEQ ID NO: 154931 - DNA, 103 bp, Artificial Sequence
  Synthetic Polynucleotide
taatacgactcactatagggatagccaacacttccatgaagaatcttatcaacagaggagagataagatgcttcatggaaacctggcggcagcgcaaaagatg

SEQ ID NO: 154932 - DNA, 103 bp, Artificial Sequence
  Synthetic Polynucleotide
taatacgactcactatagggttggtgtgagatagccaacacttccatgaaaacagaggagattcatgatggtgttggctaacctggcggcagcgcaaaagatg

SEQ ID NO: 154933 - DNA, 103 bp, Artificial Sequence
  Synthetic Polynucleotide
taatacgactcactatagggcccccactccttggtgtgagatagccaacaaacagaggagatgttggatgtctcacaccaacctggcggcagcgcaaaagatg

SEQ ID NO: 154934 - DNA, 103 bp, Artificial Sequence
  Synthetic Polynucleotide
taatacgactcactatagggcattaaatgacccccactccttggtgtgagaacagaggagactcacaatgaggagtgggaacctggcggcagcgcaaaagatg

SEQ ID NO: 154935 - DNA, 103 bp, Artificial Sequence
  Synthetic Polynucleotide
taatacgactcactatagggacttcaggttcattaaatgacccccactccaacagaggagaggagtgatggtcatttaaaacctggcggcagcgcaaaagatg

SEQ ID NO: 154936 - DNA, 103 bp, Artificial Sequence
  Synthetic Polynucleotide
taatacgactcactataggggagacatagtacttcaggttcattaaatgaaacagaggagatcatttatggaacctgaaaacctggcggcagcgcaaaagatg

SEQ ID NO: 154937 - DNA, 103 bp, Artificial Sequence
  Synthetic Polynucleotide
taatacgactcactataggggtcagaaggagagacatagtacttcaggttaacagaggagaaacctgatgtactatgtcaacctggcggcagcgcaaaagatg

SEQ ID NO: 154938 - DNA, 103 bp, Artificial Sequence
  Synthetic Polynucleotide
taatacgactcactatagggcatccagtaggtcagaaggagagacatagtaacagaggagaactatgatgctccttctgaacctggcggcagcgcaaaagatg

SEQ ID NO: 154939 - DNA, 103 bp, Artificial Sequence
  Synthetic Polynucleotide
taatacgactcactataggggcagtcttgtcatccagtaggtcagaaggaaacagaggagatccttcatgcctactggaaacctggcggcagcgcaaaagatg

SEQ ID NO: 154940 - DNA, 103 bp, Artificial Sequence
  Synthetic Polynucleotide
taatacgactcactatagggattttggttaaattttgcatggagccgttcaacagaggagagaacggatgcatgcaaaaaacctggcggcagcgcaaaagatg

SEQ ID NO: 154941 - DNA, 103 bp, Artificial Sequence
  Synthetic Polynucleotide
taatacgactcactataggggatgggagatgcagtcttgtcatccagtagaacagaggagactactgatggacaagactaacctggcggcagcgcaaaagatg

SEQ ID NO: 154942 - DNA, 103 bp, Artificial Sequence
  Synthetic Polynucleotide
taatacgactcactatagggcatgcaaaatgatgggagatgcagtcttgtaacagaggagaacaagaatgcatctcccaaacctggcggcagcgcaaaagatg

SEQ ID NO: 154943 - DNA, 103 bp, Artificial Sequence
  Synthetic Polynucleotide
taatacgactcactatagggacattattctcatgcaaaatgatgggagataacagaggagaatctccatgcattttgcaaacctggcggcagcgcaaaagatg

SEQ ID NO: 154944 - DNA, 103 bp, Artificial Sequence
  Synthetic Polynucleotide
taatacgactcactatagggagatcgagaaacattattctcatgcaaaataacagaggagaattttgatggagaataataacctggcggcagcgcaaaagatg

SEQ ID NO: 154945 - DNA, 103 bp, Artificial Sequence
  Synthetic Polynucleotide
taatacgactcactatagggtcatgcccaaagatcgagaaacattattctaacagaggagaagaataatgtttctcgataacctggcggcagcgcaaaagatg

SEQ ID NO: 154946 - DNA, 103 bp, Artificial Sequence
  Synthetic Polynucleotide
taatacgactcactatagggactgatgcattcatgcccaaagatcgagaaaacagaggagattctcgatgtttgggcataacctggcggcagcgcaaaagatg

SEQ ID NO: 154947 - DNA, 103 bp, Artificial Sequence
  Synthetic Polynucleotide
taatacgactcactatagggttcaattgtcactgatgcattcatgcccaaaacagaggagattgggcatgaatgcatcaaacctggcggcagcgcaaaagatg

SEQ ID NO: 154948 - DNA, 103 bp, Artificial Sequence
  Synthetic Polynucleotide
taatacgactcactatagggcagatgttccttcaattgtcactgatgcataacagaggagaatgcatatgtgacaattgaacctggcggcagcgcaaaagatg

SEQ ID NO: 154949 - DNA, 103 bp, Artificial Sequence
  Synthetic Polynucleotide
taatacgactcactatagggttgtacacagcagatgttccttcaattgtcaacagaggagagacaatatgaggaacatcaacctggcggcagcgcaaaagatg

SEQ ID NO: 154950 - DNA, 103 bp, Artificial Sequence
  Synthetic Polynucleotide
taatacgactcactatagggaattgggagtttgtacacagcagatgttccaacagaggagaggaacaatggctgtgtacaacctggcggcagcgcaaaagatg

SEQ ID NO: 154951 - DNA, 103 bp, Artificial Sequence
  Synthetic Polynucleotide
taatacgactcactatagggtccagggtctattttggttaaattttgcataacagaggagaatgcaaatgttaaccaaaaacctggcggcagcgcaaaagatg

SEQ ID NO: 154952 - DNA, 103 bp, Artificial Sequence
  Synthetic Polynucleotide
taatacgactcactatagggttaatggtgcaattgggagtttgtacacagaacagaggagactgtgtatgaactcccaaaacctggcggcagcgcaaaagatg

SEQ ID NO: 154953 - DNA, 103 bp, Artificial Sequence
  Synthetic Polynucleotide
taatacgactcactataggggaccccataattaatggtgcaattgggagtaacagaggagaactcccatgtgcaccattaacctggcggcagcgcaaaagatg

SEQ ID NO: 154954 - DNA, 103 bp, Artificial Sequence
  Synthetic Polynucleotide
taatacgactcactatagggaactggatgtgaccccataattaatggtgcaacagaggagagcaccaatgattatggggaacctggcggcagcgcaaaagatg

SEQ ID NO: 154955 - DNA, 103 bp, Artificial Sequence
  Synthetic Polynucleotide
taatacgactcactatagggatttattgtcaactggatgtgaccccataaaacagaggagattatggatgcacatccagaacctggcggcagcgcaaaagatg

SEQ ID NO: 154956 - DNA, 103 bp, Artificial Sequence
  Synthetic Polynucleotide
taatacgactcactataggggaaggggtccatttattgtcaactggatgtaacagaggagaacatccatgtgacaataaaacctggcggcagcgcaaaagatg

SEQ ID NO: 154957 - DNA, 103 bp, Artificial Sequence
  Synthetic Polynucleotide
taatacgactcactatagggtgaggagaaggaaggggtccatttattgtcaacagaggagagacaatatgtggacccctaacctggcggcagcgcaaaagatg

SEQ ID NO: 154958 - DNA, 103 bp, Artificial Sequence
  Synthetic Polynucleotide
taatacgactcactatagggcactggtgattgaggagaaggaaggggtccaacagaggagaggacccatgccttctcctaacctggcggcagcgcaaaagatg

SEQ ID NO: 154959 - DNA, 103 bp, Artificial Sequence
  Synthetic Polynucleotide
taatacgactcactatagggacactgttggcactggtgattgaggagaagaacagaggagacttctcatgaatcaccagaacctggcggcagcgcaaaagatg

SEQ ID NO: 154960 - DNA, 103 bp, Artificial Sequence
  Synthetic Polynucleotide
taatacgactcactatagggaggaagatcaacactgttggcactggtgataacagaggagaatcaccatggccaacagtaacctggcggcagcgcaaaagatg

SEQ ID NO: 154961 - DNA, 103 bp, Artificial Sequence
  Synthetic Polynucleotide
taatacgactcactatagggagaaacaggcaggaagatcaacactgttggaacagaggagaccaacaatgttgatcttcaacctggcggcagcgcaaaagatg

SEQ ID NO: 154962 - DNA, 103 bp, Artificial Sequence
  Synthetic Polynucleotide
taatacgactcactatagggatggtttcactccagggtctattttggttaaacagaggagataaccaatgtagaccctgaacctggcggcagcgcaaaagatg

SEQ ID NO: 154963 - DNA, 103 bp, Artificial Sequence
  Synthetic Polynucleotide
taatacgactcactatagggaatttcaagaagaaacaggcaggaagatcaaacagaggagatgatctatgtgcctgtttaacctggcggcagcgcaaaagatg

SEQ ID NO: 154964 - DNA, 103 bp, Artificial Sequence
  Synthetic Polynucleotide
taatacgactcactatagggtggctggggaaatttcaagaagaaacaggcaacagaggagagcctgtatgttcttgaaaaacctggcggcagcgcaaaagatg

SEQ ID NO: 154965 - DNA, 103 bp, Artificial Sequence
  Synthetic Polynucleotide
taatacgactcactatagggatactgggattggctggggaaatttcaagaaacagaggagatcttgaatgttccccagcaacctggcggcagcgcaaaagatg

SEQ ID NO: 154966 - DNA, 103 bp, Artificial Sequence
  Synthetic Polynucleotide
taatacgactcactatagggaatgctctagatactgggattggctggggaaacagaggagatccccaatgaatcccagtaacctggcggcagcgcaaaagatg

SEQ ID NO: 154967 - DNA, 103 bp, Artificial Sequence
  Synthetic Polynucleotide
taatacgactcactatagggtttctgaacaaatgctctagatactgggataacagaggagaatcccaatgtctagagcaaacctggcggcagcgcaaaagatg

SEQ ID NO: 154968 - DNA, 103 bp, Artificial Sequence
  Synthetic Polynucleotide
taatacgactcactatagggagttctgcagtttctgaacaaatgctctagaacagaggagactagagatgttgttcagaaacctggcggcagcgcaaaagatg

SEQ ID NO: 154969 - DNA, 103 bp, Artificial Sequence
  Synthetic Polynucleotide
taatacgactcactatagggattcctgtgcagttctgcagtttctgaacaaacagaggagatgttcaatgactgcagaaaacctggcggcagcgcaaaagatg

SEQ ID NO: 154970 - DNA, 103 bp, Artificial Sequence
  Synthetic Polynucleotide
taatacgactcactatagggaaacaatggaattcctgtgcagttctgcagaacagaggagactgcagatgtgcacaggaaacctggcggcagcgcaaaagatg

SEQ ID NO: 154971 - DNA, 103 bp, Artificial Sequence
  Synthetic Polynucleotide
taatacgactcactataggggttgagtttcaaacaatggaattcctgtgcaacagaggagagcacagatgttccattgtaacctggcggcagcgcaaaagatg

SEQ ID NO: 154972 - DNA, 103 bp, Artificial Sequence
  Synthetic Polynucleotide
taatacgactcactataggggcataagttggttgagtttcaaacaatggaaacagaggagatccattatgtgaaactcaaacctggcggcagcgcaaaagatg

SEQ ID NO: 154973 - DNA, 103 bp, Artificial Sequence
  Synthetic Polynucleotide
taatacgactcactatagggttcgtagctcaagatcccgaaggccgccataacagaggagaatggcgatgttcgggatcaacctggcggcagcgcaaaagatg

SEQ ID NO: 154974 - DNA, 103 bp, Artificial Sequence
  Synthetic Polynucleotide
taatacgactcactatagggattcaaggccgtcagttcatcctccttctgaacagaggagacagaagatggatgaactgaacctggcggcagcgcaaaagatg

SEQ ID NO: 154975 - DNA, 103 bp, Artificial Sequence
  Synthetic Polynucleotide
taatacgactcactataggggctgctagttgggggctgaggagcaggggtaacagaggagaacccctatgcctcagcccaacctggcggcagcgcaaaagatg

SEQ ID NO: 154976 - DNA, 103 bp, Artificial Sequence
  Synthetic Polynucleotide
taatacgactcactatagggtcgagggtgtgctgctagttgggggctgagaacagaggagactcagcatgcaactagcaaacctggcggcagcgcaaaagatg

SEQ ID NO: 154977 - DNA, 103 bp, Artificial Sequence
  Synthetic Polynucleotide
taatacgactcactatagggctaaagggagtcgagggtgtgctgctagttaacagaggagaaactagatgcacaccctcaacctggcggcagcgcaaaagatg

SEQ ID NO: 154978 - DNA, 103 bp, Artificial Sequence
  Synthetic Polynucleotide
taatacgactcactatagggaagcaggtcactaaagggagtcgagggtgtaacagaggagaacacccatgactccctttaacctggcggcagcgcaaaagatg

SEQ ID NO: 154979 - DNA, 103 bp, Artificial Sequence
  Synthetic Polynucleotide
taatacgactcactataggggagggcacataagcaggtcactaaagggagaacagaggagactccctatggtgacctgcaacctggcggcagcgcaaaagatg

SEQ ID NO: 154980 - DNA, 103 bp, Artificial Sequence
  Synthetic Polynucleotide
taatacgactcactatagggggccggtgctgagggcacataagcaggtcaaacagaggagatgacctatgtatgtgcccaacctggcggcagcgcaaaagatg

SEQ ID NO: 154981 - DNA, 103 bp, Artificial Sequence
  Synthetic Polynucleotide
taatacgactcactatagggaaaaaccaggggccggtgctgagggcacataacagaggagaatgtgcatgcagcaccggaacctggcggcagcgcaaaagatg

SEQ ID NO: 154982 - DNA, 103 bp, Artificial Sequence
  Synthetic Polynucleotide
taatacgactcactatagggagctgaggccaaaaaccaggggccggtgctaacagaggagaagcaccatgccctggtttaacctggcggcagcgcaaaagatg

SEQ ID NO: 154983 - DNA, 103 bp, Artificial Sequence
  Synthetic Polynucleotide
taatacgactcactatagggtgtaggatacagctgaggccaaaaaccaggaacagaggagacctggtatgtggcctcagaacctggcggcagcgcaaaagatg

SEQ ID NO: 154984 - DNA, 103 bp, Artificial Sequence
  Synthetic Polynucleotide
taatacgactcactataggggaggatggtctgtaggatacagctgaggccaacagaggagaggcctcatgtgtatcctaaacctggcggcagcgcaaaagatg

SEQ ID NO: 154985 - DNA, 103 bp, Artificial Sequence
  Synthetic Polynucleotide
taatacgactcactatagggcttgttttacattcaaggccgtcagttcataacagaggagaatgaacatgcggccttgaaacctggcggcagcgcaaaagatg

SEQ ID NO: 154986 - DNA, 103 bp, Artificial Sequence
  Synthetic Polynucleotide
taatacgactcactataggggacagcacaggaggatggtctgtaggatacaacagaggagagtatccatgagaccatccaacctggcggcagcgcaaaagatg

SEQ ID NO: 154987 - DNA, 103 bp, Artificial Sequence
  Synthetic Polynucleotide
taatacgactcactatagggaaggcactaggacagcacaggaggatggtcaacagaggagagaccatatgcctgtgctgaacctggcggcagcgcaaaagatg

SEQ ID NO: 154988 - DNA, 103 bp, Artificial Sequence
  Synthetic Polynucleotide
taatacgactcactataggggtgccaaaccaaggcactaggacagcacagaacagaggagactgtgcatgcctagtgccaacctggcggcagcgcaaaagatg

SEQ ID NO: 154989 - DNA, 103 bp, Artificial Sequence
  Synthetic Polynucleotide
taatacgactcactatagggtcagtgagtagtgccaaaccaaggcactagaacagaggagactagtgatgtggtttggcaacctggcggcagcgcaaaagatg

SEQ ID NO: 154990 - DNA, 103 bp, Artificial Sequence
  Synthetic Polynucleotide
taatacgactcactatagggctgctatcagtcagtgagtagtgccaaaccaacagaggagaggtttgatgctactcactaacctggcggcagcgcaaaagatg

SEQ ID NO: 154991 - DNA, 103 bp, Artificial Sequence
  Synthetic Polynucleotide
taatacgactcactatagggggtcttaattctgctatcagtcagtgagtaaacagaggagatactcaatgactgatagcaacctggcggcagcgcaaaagatg

SEQ ID NO: 154992 - DNA, 103 bp, Artificial Sequence
  Synthetic Polynucleotide
taatacgactcactataggggtggtgagccggtcttaattctgctatcagaacagaggagactgataatggaattaagaaacctggcggcagcgcaaaagatg

SEQ ID NO: 154993 - DNA, 103 bp, Artificial Sequence
  Synthetic Polynucleotide
taatacgactcactatagggaagtggtcaagtggtgagccggtcttaattaacagaggagaaattaaatgcggctcaccaacctggcggcagcgcaaaagatg

SEQ ID NO: 154994 - DNA, 103 bp, Artificial Sequence
  Synthetic Polynucleotide
taatacgactcactatagggggcaataggcaagtggtcaagtggtgagccaacagaggagaggctcaatgcttgaccacaacctggcggcagcgcaaaagatg

SEQ ID NO: 154995 - DNA, 103 bp, Artificial Sequence
  Synthetic Polynucleotide
taatacgactcactatagggggttggacggggcaataggcaagtggtcaaaacagaggagattgaccatgtgcctattgaacctggcggcagcgcaaaagatg

SEQ ID NO: 154996 - DNA, 103 bp, Artificial Sequence
  Synthetic Polynucleotide
taatacgactcactatagggttattgaaaccttgttttacattcaaggccaacagaggagaggccttatgtgtaaaacaaacctggcggcagcgcaaaagatg

SEQ ID NO: 154997 - DNA, 103 bp, Artificial Sequence
  Synthetic Polynucleotide
taatacgactcactatagggggcatgggcaggttggacggggcaataggcaacagaggagagcctatatgcccgtccaaaacctggcggcagcgcaaaagatg

SEQ ID NO: 154998 - DNA, 103 bp, Artificial Sequence
  Synthetic Polynucleotide
taatacgactcactataggggttaccctctggcatgggcaggttggacggaacagaggagaccgtccatgctgcccatgaacctggcggcagcgcaaaagatg

SEQ ID NO: 154999 - DNA, 103 bp, Artificial Sequence
  Synthetic Polynucleotide
taatacgactcactatagggtgaaggcactgttaccctctggcatgggcaaacagaggagatgcccaatgcagagggtaaacctggcggcagcgcaaaagatg

SEQ ID NO: 155000 - DNA, 103 bp, Artificial Sequence
  Synthetic Polynucleotide
taatacgactcactatagggacctgctgagtgaaggcactgttaccctctaacagaggagaagagggatgcagtgccttaacctggcggcagcgcaaaagatg

SEQ ID NO: 155001 - DNA, 103 bp, Artificial Sequence
  Synthetic Polynucleotide
taatacgactcactatagggctttgcacggacctgctgagtgaaggcactaacagaggagaagtgccatgactcagcagaacctggcggcagcgcaaaagatg

SEQ ID NO: 155002 - DNA, 103 bp, Artificial Sequence
  Synthetic Polynucleotide
taatacgactcactatagggtctcccgcaactttgcacggacctgctgagaacagaggagactcagcatgtccgtgcaaaacctggcggcagcgcaaaagatg

SEQ ID NO: 155003 - DNA, 103 bp, Artificial Sequence
  Synthetic Polynucleotide
taatacgactcactatagggtgctgctcgatctcccgcaactttgcacggaacagaggagaccgtgcatggttgcgggaaacctggcggcagcgcaaaagatg

SEQ ID NO: 155004 - DNA, 103 bp, Artificial Sequence
  Synthetic Polynucleotide
taatacgactcactatagggctccttgatctgctgctcgatctcccgcaaaacagaggagattgcggatgatcgagcagaacctggcggcagcgcaaaagatg

SEQ ID NO: 155005 - DNA, 103 bp, Artificial Sequence
  Synthetic Polynucleotide
taatacgactcactatagggcctgtccccgctccttgatctgctgctcgaaacagaggagatcgagcatgagatcaaggaacctggcggcagcgcaaaagatg

SEQ ID NO: 155006 - DNA, 103 bp, Artificial Sequence
  Synthetic Polynucleotide
taatacgactcactatagggacttcaactgcctgtccccgctccttgatcaacagaggagagatcaaatggcggggacaaacctggcggcagcgcaaaagatg

SEQ ID NO: 155007 - DNA, 103 bp, Artificial Sequence
  Synthetic Polynucleotide
taatacgactcactatagggagcaggctggttattgaaaccttgttttacaacagaggagagtaaaaatgggtttcaataacctggcggcagcgcaaaagatg

SEQ ID NO: 155008 - DNA, 103 bp, Artificial Sequence
  Synthetic Polynucleotide
taatacgactcactatagggagaccagcgaacttcaactgcctgtccccgaacagaggagacggggaatggcagttgaaaacctggcggcagcgcaaaagatg

SEQ ID NO: 155009 - DNA, 103 bp, Artificial Sequence
  Synthetic Polynucleotide
taatacgactcactatagggatttatcgaaagaccagcgaacttcaactgaacagaggagacagttgatgttcgctggtaacctggcggcagcgcaaaagatg

SEQ ID NO: 155010 - DNA, 103 bp, Artificial Sequence
  Synthetic Polynucleotide
taatacgactcactataggggcttcctggcatttatcgaaagaccagcgaaacagaggagatcgctgatgtttcgataaaacctggcggcagcgcaaaagatg

SEQ ID NO: 155011 - DNA, 103 bp, Artificial Sequence
  Synthetic Polynucleotide
taatacgactcactataggggcctgcagtagcttcctggcatttatcgaaaacagaggagattcgatatgtgccaggaaaacctggcggcagcgcaaaagatg

SEQ ID NO: 155012 - DNA, 103 bp, Artificial Sequence
  Synthetic Polynucleotide
taatacgactcactatagggcaatggtgaagcctgcagtagcttcctggcaacagaggagagccaggatgctactgcagaacctggcggcagcgcaaaagatg

SEQ ID NO: 155013 - DNA, 103 bp, Artificial Sequence
  Synthetic Polynucleotide
taatacgactcactatagggagtacccgtccaatggtgaagcctgcagtaaacagaggagatactgcatgcttcaccataacctggcggcagcgcaaaagatg

SEQ ID NO: 155014 - DNA, 103 bp, Artificial Sequence
  Synthetic Polynucleotide
taatacgactcactatagggcaaagtatgaagtacccgtccaatggtgaaaacagaggagattcaccatgggacgggtaaacctggcggcagcgcaaaagatg

SEQ ID NO: 155015 - DNA, 103 bp, Artificial Sequence
  Synthetic Polynucleotide
taatacgactcactatagggccagcacttccaaagtatgaagtacccgtcaacagaggagagacgggatgttcatacttaacctggcggcagcgcaaaagatg

SEQ ID NO: 155016 - DNA, 103 bp, Artificial Sequence
  Synthetic Polynucleotide
taatacgactcactatagggctatggctgtccagcacttccaaagtatgaaacagaggagatcatacatgggaagtgctaacctggcggcagcgcaaaagatg

SEQ ID NO: 155017 - DNA, 103 bp, Artificial Sequence
  Synthetic Polynucleotide
taatacgactcactataggggcgttcaaaactatggctgtccagcacttcaacagaggagagaagtgatggacagccataacctggcggcagcgcaaaagatg

SEQ ID NO: 155018 - DNA, 103 bp, Artificial Sequence
  Synthetic Polynucleotide
taatacgactcactatagggccccagagacagcaggctggttattgaaacaacagaggagagtttcaatgaccagcctgaacctggcggcagcgcaaaagatg

SEQ ID NO: 155019 - DNA, 103 bp, Artificial Sequence
  Synthetic Polynucleotide
taatacgactcactatagggtgaagtcagagcgttcaaaactatggctgtaacagaggagaacagccatggttttgaacaacctggcggcagcgcaaaagatg

SEQ ID NO: 155020 - DNA, 103 bp, Artificial Sequence
  Synthetic Polynucleotide
taatacgactcactatagggagagagttgctgaagtcagagcgttcaaaaaacagaggagattttgaatgctctgacttaacctggcggcagcgcaaaagatg

SEQ ID NO: 155021 - DNA, 103 bp, Artificial Sequence
  Synthetic Polynucleotide
taatacgactcactatagggaagggagtcaagagagttgctgaagtcagaaacagaggagatctgacatgagcaactctaacctggcggcagcgcaaaagatg

SEQ ID NO: 155022 - DNA, 103 bp, Artificial Sequence
  Synthetic Polynucleotide
taatacgactcactatagggttcggttacaaagggagtcaagagagttgcaacagaggagagcaactatgttgactcccaacctggcggcagcgcaaaagatg

SEQ ID NO: 155023 - DNA, 103 bp, Artificial Sequence
  Synthetic Polynucleotide
taatacgactcactatagggaatccaaagattcggttacaaagggagtcaaacagaggagatgactcatgttgtaaccgaacctggcggcagcgcaaaagatg

SEQ ID NO: 155024 - DNA, 103 bp, Artificial Sequence
  Synthetic Polynucleotide
taatacgactcactataggggctaggtcccaatccaaagattcggttacaaacagaggagatgtaacatgatctttggaaacctggcggcagcgcaaaagatg

SEQ ID NO: 155025 - DNA, 103 bp, Artificial Sequence
  Synthetic Polynucleotide
taatacgactcactataggggcccatccttgctaggtcccaatccaaagaaacagaggagatctttgatgtgggacctaaacctggcggcagcgcaaaagatg

SEQ ID NO: 155026 - DNA, 103 bp, Artificial Sequence
  Synthetic Polynucleotide
taatacgactcactataggggagatctcatgcccatccttgctaggtcccaacagaggagagggaccatgcaaggatggaacctggcggcagcgcaaaagatg

SEQ ID NO: 155027 - DNA, 103 bp, Artificial Sequence
  Synthetic Polynucleotide
taatacgactcactatagggatcatctgaggagatctcatgcccatccttaacagaggagaaaggatatgcatgagatcaacctggcggcagcgcaaaagatg

SEQ ID NO: 155028 - DNA, 103 bp, Artificial Sequence
  Synthetic Polynucleotide
taatacgactcactatagggccacagcatcatcatctgaggagatctcataacagaggagaatgagaatgcctcagatgaacctggcggcagcgcaaaagatg

SEQ ID NO: 155029 - DNA, 103 bp, Artificial Sequence
  Synthetic Polynucleotide
taatacgactcactatagggccatgctcatccccagagacagcaggctggaacagaggagaccagccatgtgtctctggaacctggcggcagcgcaaaagatg

SEQ ID NO: 155030 - DNA, 103 bp, Artificial Sequence
  Synthetic Polynucleotide
taatacgactcactatagggagcaatgacaccacagcatcatcatctgagaacagaggagactcagaatgtgatgctgtaacctggcggcagcgcaaaagatg

SEQ ID NO: 155031 - DNA, 103 bp, Artificial Sequence
  Synthetic Polynucleotide
taatacgactcactatagggccattcacatagcaatgacaccacagcatcaacagaggagagatgctatggtgtcattgaacctggcggcagcgcaaaagatg

SEQ ID NO: 155032 - DNA, 103 bp, Artificial Sequence
  Synthetic Polynucleotide
taatacgactcactatagggagctgacagcccattcacatagcaatgacaaacagaggagatgtcatatgtatgtgaataacctggcggcagcgcaaaagatg

SEQ ID NO: 155033 - DNA, 103 bp, Artificial Sequence
  Synthetic Polynucleotide
taatacgactcactataggggaacgcttgcagctgacagcccattcacataacagaggagaatgtgaatgggctgtcagaacctggcggcagcgcaaaagatg

SEQ ID NO: 155034 - DNA, 103 bp, Artificial Sequence
  Synthetic Polynucleotide
taatacgactcactatagggatgccgaccagaacgcttgcagctgacagcaacagaggagagctgtcatgtgcaagcgtaacctggcggcagcgcaaaagatg

SEQ ID NO: 155035 - DNA, 103 bp, Artificial Sequence
  Synthetic Polynucleotide
taatacgactcactatagggccatagcacgatgccgaccagaacgcttgcaacagaggagagcaagcatgctggtcggcaacctggcggcagcgcaaaagatg

SEQ ID NO: 155036 - DNA, 103 bp, Artificial Sequence
  Synthetic Polynucleotide
taatacgactcactatagggttggctaccaccatagcacgatgccgaccaaacagaggagatggtcgatgtcgtgctataacctggcggcagcgcaaaagatg

SEQ ID NO: 155037 - DNA, 103 bp, Artificial Sequence
  Synthetic Polynucleotide
taatacgactcactatagggctccaggagcttggctaccaccatagcacgaacagaggagacgtgctatggtggtagccaacctggcggcagcgcaaaagatg

SEQ ID NO: 155038 - DNA, 103 bp, Artificial Sequence
  Synthetic Polynucleotide
taatacgactcactatagggcctgtctcttctccaggagcttggctaccaaacagaggagatggtagatgagctcctggaacctggcggcagcgcaaaagatg

SEQ ID NO: 155039 - DNA, 103 bp, Artificial Sequence
  Synthetic Polynucleotide
taatacgactcactatagggtcaatctccgcctgtctcttctccaggagcaacagaggagagctcctatggaagagacaaacctggcggcagcgcaaaagatg

SEQ ID NO: 155040 - DNA, 103 bp, Artificial Sequence
  Synthetic Polynucleotide
taatacgactcactatagggcttggcactgccatgctcatccccagagacaacagaggagagtctctatggatgagcataacctggcggcagcgcaaaagatg

SEQ ID NO: 155041 - DNA, 103 bp, Artificial Sequence
  Synthetic Polynucleotide
taatacgactcactatagggacgctcagcctcaatctccgcctgtctcttaacagaggagaaagagaatggcggagattaacctggcggcagcgcaaaagatg

SEQ ID NO: 155042 - DNA, 103 bp, Artificial Sequence
  Synthetic Polynucleotide
taatacgactcactatagggattctccacaacgctcagcctcaatctccgaacagaggagacggagaatgaggctgagcaacctggcggcagcgcaaaagatg

SEQ ID NO: 155043 - DNA, 103 bp, Artificial Sequence
  Synthetic Polynucleotide
taatacgactcactataggggcggcttctgattctccacaacgctcagccaacagaggagaggctgaatgttgtggagaaacctggcggcagcgcaaaagatg

SEQ ID NO: 155044 - DNA, 103 bp, Artificial Sequence
  Synthetic Polynucleotide
taatacgactcactatagggcttctcatctgcggcttctgattctccacaaacagaggagatgtggaatgtcagaagccaacctggcggcagcgcaaaagatg

SEQ ID NO: 155045 - DNA, 103 bp, Artificial Sequence
  Synthetic Polynucleotide
taatacgactcactatagggcgatggaacccttctcatctgcggcttctgaacagaggagacagaagatgcagatgagaaacctggcggcagcgcaaaagatg

SEQ ID NO: 155046 - DNA, 103 bp, Artificial Sequence
  Synthetic Polynucleotide
taatacgactcactataggggagccagaggcgatggaacccttctcatctaacagaggagaagatgaatggggttccataacctggcggcagcgcaaaagatg

SEQ ID NO: 155047 - DNA, 103 bp, Artificial Sequence
  Synthetic Polynucleotide
taatacgactcactatagggagcagaaagggagccagaggcgatggaaccaacagaggagaggttccatggcctctggcaacctggcggcagcgcaaaagatg

SEQ ID NO: 155048 - DNA, 103 bp, Artificial Sequence
  Synthetic Polynucleotide
taatacgactcactataggggagcactgggagcagaaagggagccagaggaacagaggagacctctgatgccctttctgaacctggcggcagcgcaaaagatg

SEQ ID NO: 155049 - DNA, 103 bp, Artificial Sequence
  Synthetic Polynucleotide
taatacgactcactatagggtggaaaatgggagcactgggagcagaaaggaacagaggagacctttcatgtcccagtgcaacctggcggcagcgcaaaagatg

SEQ ID NO: 155050 - DNA, 103 bp, Artificial Sequence
  Synthetic Polynucleotide
taatacgactcactataggggaggacatcctggaaaatgggagcactgggaacagaggagacccagtatgcccattttcaacctggcggcagcgcaaaagatg

SEQ ID NO: 155051 - DNA, 103 bp, Artificial Sequence
  Synthetic Polynucleotide
taatacgactcactatagggagctgacgttcttggcactgccatgctcataacagaggagaatgagcatggcagtgccaaacctggcggcagcgcaaaagatg

SEQ ID NO: 155052 - DNA, 103 bp, Artificial Sequence
  Synthetic Polynucleotide
taatacgactcactataggggaaactgcaggaggacatcctggaaaatggaacagaggagaccatttatgaggatgtccaacctggcggcagcgcaaaagatg

SEQ ID NO: 155053 - DNA, 103 bp, Artificial Sequence
  Synthetic Polynucleotide
taatacgactcactatagggtgtgtatccagaaactgcaggaggacatccaacagaggagaggatgtatgcctgcagttaacctggcggcagcgcaaaagatg

SEQ ID NO: 155054 - DNA, 103 bp, Artificial Sequence
  Synthetic Polynucleotide
taatacgactcactatagggcatgggagcctgtgtatccagaaactgcagaacagaggagactgcagatgctggatacaaacctggcggcagcgcaaaagatg

SEQ ID NO: 155055 - DNA, 103 bp, Artificial Sequence
  Synthetic Polynucleotide
taatacgactcactatagggggtccgtcagcatgggagcctgtgtatccaaacagaggagatggataatgaggctcccaaacctggcggcagcgcaaaagatg

SEQ ID NO: 155056 - DNA, 103 bp, Artificial Sequence
  Synthetic Polynucleotide
taatacgactcactatagggtcacttcgagggtccgtcagcatgggagccaacagaggagaggctccatggctgacggaaacctggcggcagcgcaaaagatg

SEQ ID NO: 155057 - DNA, 103 bp, Artificial Sequence
  Synthetic Polynucleotide
taatacgactcactatagggccgctcactctcacttcgagggtccgtcagaacagaggagactgacgatgcctcgaagtaacctggcggcagcgcaaaagatg

SEQ ID NO: 155058 - DNA, 103 bp, Artificial Sequence
  Synthetic Polynucleotide
taatacgactcactatagggagaattccacccgctcactctcacttcgagaacagaggagactcgaaatgagagtgagcaacctggcggcagcgcaaaagatg

SEQ ID NO: 155059 - DNA, 103 bp, Artificial Sequence
  Synthetic Polynucleotide
taatacgactcactatagggactaagttaaagaattccacccgctcactcaacagaggagagagtgaatgggtggaattaacctggcggcagcgcaaaagatg

SEQ ID NO: 155060 - DNA, 103 bp, Artificial Sequence
  Synthetic Polynucleotide
taatacgactcactataggggaacagcagtactaagttaaagaattccacaacagaggagagtggaaatgtttaacttaaacctggcggcagcgcaaaagatg

SEQ ID NO: 155061 - DNA, 103 bp, Artificial Sequence
  Synthetic Polynucleotide
taatacgactcactatagggtcagttcacagaacagcagtactaagttaaaacagaggagattaactatgtactgctgtaacctggcggcagcgcaaaagatg

SEQ ID NO: 155062 - DNA, 103 bp, Artificial Sequence
  Synthetic Polynucleotide
taatacgactcactataggggcaggattgaagctgacgttcttggcactgaacagaggagacagtgcatggaacgtcagaacctggcggcagcgcaaaagatg

SEQ ID NO: 155063 - DNA, 103 bp, Artificial Sequence
  Synthetic Polynucleotide
taatacgactcactatagggtcatgtcgaatcagttcacagaacagcagtaacagaggagaactgctatgctgtgaactaacctggcggcagcgcaaaagatg

SEQ ID NO: 155064 - DNA, 103 bp, Artificial Sequence
  Synthetic Polynucleotide
taatacgactcactatagggggagaaaacatcatgtcgaatcagttcacaaacagaggagatgtgaaatgattcgacataacctggcggcagcgcaaaagatg

SEQ ID NO: 155065 - DNA, 103 bp, Artificial Sequence
  Synthetic Polynucleotide
taatacgactcactatagggacatgttgtgggagaaaacatcatgtcgaaaacagaggagattcgacatgatgttttctaacctggcggcagcgcaaaagatg

SEQ ID NO: 155066 - DNA, 103 bp, Artificial Sequence
  Synthetic Polynucleotide
taatacgactcactataggggtgcaagtatacatgttgtgggagaaaacaaacagaggagatgttttatgccacaacataacctggcggcagcgcaaaagatg

SEQ ID NO: 155067 - DNA, 103 bp, Artificial Sequence
  Synthetic Polynucleotide
taatacgactcactatagggggagatgagagtgcaagtatacatgttgtgaacagaggagacacaacatgtatacttgcaacctggcggcagcgcaaaagatg

SEQ ID NO: 155068 - DNA, 103 bp, Artificial Sequence
  Synthetic Polynucleotide
taatacgactcactatagggggtcccctcgggagatgagagtgcaagtataacagaggagaatacttatgctctcatctaacctggcggcagcgcaaaagatg

SEQ ID NO: 155069 - DNA, 103 bp, Artificial Sequence
  Synthetic Polynucleotide
taatacgactcactatagggccaaaggcaaggtcccctcgggagatgagaaacagaggagatctcatatgccgaggggaaacctggcggcagcgcaaaagatg

SEQ ID NO: 155070 - DNA, 103 bp, Artificial Sequence
  Synthetic Polynucleotide
taatacgactcactatagggaccaggggctccaaaggcaaggtcccctcgaacagaggagacgagggatgcttgcctttaacctggcggcagcgcaaaagatg

SEQ ID NO: 155071 - DNA, 103 bp, Artificial Sequence
  Synthetic Polynucleotide
taatacgactcactataggggaggccggggaccaggggctccaaaggcaaaacagaggagattgcctatggagcccctgaacctggcggcagcgcaaaagatg

SEQ ID NO: 155072 - DNA, 103 bp, Artificial Sequence
  Synthetic Polynucleotide
taatacgactcactatagggaagggagagggaggccggggaccaggggctaacagaggagaagccccatgtccccggccaacctggcggcagcgcaaaagatg

SEQ ID NO: 155073 - DNA, 103 bp, Artificial Sequence
  Synthetic Polynucleotide
taatacgactcactatagggactgatcttggcaggattgaagctgacgttaacagaggagaaacgtcatgttcaatcctaacctggcggcagcgcaaaagatg

SEQ ID NO: 155074 - DNA, 103 bp, Artificial Sequence
  Synthetic Polynucleotide
taatacgactcactatagggaggatcatcaaagggagagggaggccggggaacagaggagaccccggatgccctctcccaacctggcggcagcgcaaaagatg

SEQ ID NO: 155075 - DNA, 103 bp, Artificial Sequence
  Synthetic Polynucleotide
taatacgactcactatagggggtcatcggcaggatcatcaaagggagaggaacagaggagacctctcatgttgatgatcaacctggcggcagcgcaaaagatg

SEQ ID NO: 155076 - DNA, 103 bp, Artificial Sequence
  Synthetic Polynucleotide
taatacgactcactatagggttgtgctctgggtcatcggcaggatcatcaaacagaggagatgatgaatgtgccgatgaaacctggcggcagcgcaaaagatg

SEQ ID NO: 155077 - DNA, 103 bp, Artificial Sequence
  Synthetic Polynucleotide
taatacgactcactatagggttcagcctccttgtgctctgggtcatcggcaacagaggagagccgatatgccagagcacaacctggcggcagcgcaaaagatg

SEQ ID NO: 155078 - DNA, 103 bp, Artificial Sequence
  Synthetic Polynucleotide
taatacgactcactatagggtgctgctgccttcagcctccttgtgctctgaacagaggagacagagcatgaggaggctgaacctggcggcagcgcaaaagatg

SEQ ID NO: 155079 - DNA, 103 bp, Artificial Sequence
  Synthetic Polynucleotide
taatacgactcactatagggagcttgctgctgctgctgccttcagcctccaacagaggagaggaggcatgaggcagcagaacctggcggcagcgcaaaagatg

SEQ ID NO: 155080 - DNA, 103 bp, Artificial Sequence
  Synthetic Polynucleotide
taatacgactcactatagggtggatcttccagcttgctgctgctgctgccaacagaggagaggcagcatgagcagcaagaacctggcggcagcgcaaaagatg

SEQ ID NO: 155081 - DNA, 103 bp, Artificial Sequence
  Synthetic Polynucleotide
taatacgactcactatagggctgagagccctggatcttccagcttgctgcaacagaggagagcagcaatgtggaagatcaacctggcggcagcgcaaaagatg

SEQ ID NO: 155082 - DNA, 103 bp, Artificial Sequence
  Synthetic Polynucleotide
taatacgactcactatagggtccatagattctgagagccctggatcttccaacagaggagaggaagaatgagggctctcaacctggcggcagcgcaaaagatg

SEQ ID NO: 155083 - DNA, 103 bp, Artificial Sequence
  Synthetic Polynucleotide
taatacgactcactatagggagggtcaatgtccatagattctgagagcccaacagaggagagggctcatggaatctatgaacctggcggcagcgcaaaagatg

SEQ ID NO: 155084 - DNA, 103 bp, Artificial Sequence
  Synthetic Polynucleotide
taatacgactcactatagggggggccggtgttcgtagctcaagatcccgaaacagaggagatcgggaatgtgagctacgaacctggcggcagcgcaaaagatg

SEQ ID NO: 155085 - DNA, 103 bp, Artificial Sequence
  Synthetic Polynucleotide
taatacgactcactatagggtgaagttggaactgatcttggcaggattgaaacagaggagatcaatcatgccaagatcaaacctggcggcagcgcaaaagatg

SEQ ID NO: 155086 - DNA, 103 bp, Artificial Sequence
  Synthetic Polynucleotide
taatacgactcactatagggcactggaactagggtcaatgtccatagattaacagaggagaaatctaatgacattgaccaacctggcggcagcgcaaaagatg

SEQ ID NO: 155087 - DNA, 103 bp, Artificial Sequence
  Synthetic Polynucleotide
taatacgactcactatagggtcaaagagaacactggaactagggtcaatgaacagaggagacattgaatgtagttccagaacctggcggcagcgcaaaagatg

SEQ ID NO: 155088 - DNA, 103 bp, Artificial Sequence
  Synthetic Polynucleotide
taatacgactcactatagggctccatgtcctcaaagagaacactggaactaacagaggagaagttccatggttctctttaacctggcggcagcgcaaaagatg

SEQ ID NO: 155089 - DNA, 103 bp, Artificial Sequence
  Synthetic Polynucleotide
taatacgactcactatagggaatcaggcttctccatgtcctcaaagagaaaacagaggagattctctatgaggacatggaacctggcggcagcgcaaaagatg

SEQ ID NO: 155090 - DNA, 103 bp, Artificial Sequence
  Synthetic Polynucleotide
taatacgactcactatagggaacaatgagaaatcaggcttctccatgtccaacagaggagaggacatatggaagcctgaaacctggcggcagcgcaaaagatg

SEQ ID NO: 155091 - DNA, 103 bp, Artificial Sequence
  Synthetic Polynucleotide
taatacgactcactatagggagtaggggagaacaatgagaaatcaggcttaacagaggagaaagcctatgttctcattgaacctggcggcagcgcaaaagatg

SEQ ID NO: 155092 - DNA, 103 bp, Artificial Sequence
  Synthetic Polynucleotide
taatacgactcactatagggcacagggcatagtaggggagaacaatgagaaacagaggagatctcatatgtctcccctaaacctggcggcagcgcaaaagatg

SEQ ID NO: 155093 - DNA, 103 bp, Artificial Sequence
  Synthetic Polynucleotide
taatacgactcactatagggcccttcccctcacagggcatagtaggggagaacagaggagactccccatgtatgccctgaacctggcggcagcgcaaaagatg

SEQ ID NO: 155094 - DNA, 103 bp, Artificial Sequence
  Synthetic Polynucleotide
taatacgactcactatagggggatggactgcccttcccctcacagggcataacagaggagaatgcccatggaggggaagaacctggcggcagcgcaaaagatg

SEQ ID NO: 155095 - DNA, 103 bp, Artificial Sequence
  Synthetic Polynucleotide
taatacgactcactataggggcttctcaggggatggactgcccttcccctaacagaggagaaggggaatggcagtccataacctggcggcagcgcaaaagatg

SEQ ID NO: 155096 - DNA, 103 bp, Artificial Sequence
  Synthetic Polynucleotide
taatacgactcactatagggataatgctgctgaagttggaactgatcttgaacagaggagacaagatatgttccaacttaacctggcggcagcgcaaaagatg

SEQ ID NO: 155097 - DNA, 103 bp, Artificial Sequence
  Synthetic Polynucleotide
taatacgactcactatagggtcgacatctggcttctcaggggatggactgaacagaggagacagtccatgccctgagaaaacctggcggcagcgcaaaagatg

SEQ ID NO: 155098 - DNA, 103 bp, Artificial Sequence
  Synthetic Polynucleotide
taatacgactcactatagggcacctccttctcgacatctggcttctcaggaacagaggagacctgagatgccagatgtcaacctggcggcagcgcaaaagatg

SEQ ID NO: 155099 - DNA, 103 bp, Artificial Sequence
  Synthetic Polynucleotide
taatacgactcactataggggtgggggcttcacctccttctcgacatctgaacagaggagacagatgatgagaaggaggaacctggcggcagcgcaaaagatg

SEQ ID NO: 155100 - DNA, 103 bp, Artificial Sequence
  Synthetic Polynucleotide
taatacgactcactatagggttctccttgggtgggggcttcacctccttcaacagaggagagaaggaatggaagcccccaacctggcggcagcgcaaaagatg

SEQ ID NO: 155101 - DNA, 103 bp, Artificial Sequence
  Synthetic Polynucleotide
taatacgactcactatagggcccttcaatcttctccttgggtgggggcttaacagaggagaaagcccatgcccaaggagaacctggcggcagcgcaaaagatg

SEQ ID NO: 155102 - DNA, 103 bp, Artificial Sequence
  Synthetic Polynucleotide
taatacgactcactatagggccccaagggtcccttcaatcttctccttggaacagaggagaccaaggatgagattgaagaacctggcggcagcgcaaaagatg

SEQ ID NO: 155103 - DNA, 103 bp, Artificial Sequence
  Synthetic Polynucleotide
taatacgactcactatagggtcgtaaagaaccccaagggtcccttcaatcaacagaggagagattgaatggacccttggaacctggcggcagcgcaaaagatg

SEQ ID NO: 155104 - DNA, 103 bp, Artificial Sequence
  Synthetic Polynucleotide
taatacgactcactatagggtcgtggctggtcgtaaagaaccccaagggtaacagaggagaacccttatggttctttacaacctggcggcagcgcaaaagatg

SEQ ID NO: 155105 - DNA, 103 bp, Artificial Sequence
  Synthetic Polynucleotide
taatacgactcactatagggactgcacgtgtcgtggctggtcgtaaagaaaacagaggagattctttatgaccagccacaacctggcggcagcgcaaaagatg

SEQ ID NO: 155106 - DNA, 103 bp, Artificial Sequence
  Synthetic Polynucleotide
taatacgactcactatagggtgggtggcgtactgcacgtgtcgtggctggaacagaggagaccagccatgacacgtgcaaacctggcggcagcgcaaaagatg

SEQ ID NO: 155107 - DNA, 103 bp, Artificial Sequence
  Synthetic Polynucleotide
taatacgactcactatagggtttctctgcaataatgctgctgaagttggaaacagaggagatccaacatgagcagcattaacctggcggcagcgcaaaagatg

SEQ ID NO: 155108 - DNA, 103 bp, Artificial Sequence
  Synthetic Polynucleotide
taatacgactcactataggggatgggaaaatgggtggcgtactgcacgtgaacagaggagacacgtgatgtacgccaccaacctggcggcagcgcaaaagatg

SEQ ID NO: 155109 - DNA, 103 bp, Artificial Sequence
  Synthetic Polynucleotide
taatacgactcactatagggcctcctgggggatgggaaaatgggtggcgtaacagaggagaacgccaatgattttcccaaacctggcggcagcgcaaaagatg

SEQ ID NO: 155110 - DNA, 103 bp, Artificial Sequence
  Synthetic Polynucleotide
taatacgactcactatagggctgcatgactcctcctgggggatgggaaaaaacagaggagattttccatgcccccaggaaacctggcggcagcgcaaaagatg

SEQ ID NO: 155111 - DNA, 103 bp, Artificial Sequence
  Synthetic Polynucleotide
taatacgactcactataggggcactcatggctgcatgactcctcctggggaacagaggagaccccagatggagtcatgcaacctggcggcagcgcaaaagatg

SEQ ID NO: 155112 - DNA, 103 bp, Artificial Sequence
  Synthetic Polynucleotide
taatacgactcactatagggaccgctggttgcactcatggctgcatgactaacagaggagaagtcatatggccatgagtaacctggcggcagcgcaaaagatg

SEQ ID NO: 155113 - DNA, 103 bp, Artificial Sequence
  Synthetic Polynucleotide
taatacgactcactatagggagtacgaccaaccgctggttgcactcatggaacagaggagaccatgaatgcaaccagcgaacctggcggcagcgcaaaagatg

SEQ ID NO: 155114 - DNA, 103 bp, Artificial Sequence
  Synthetic Polynucleotide
taatacgactcactatagggcaccccaaacagtacgaccaaccgctggttaacagaggagaaaccagatgttggtcgtaaacctggcggcagcgcaaaagatg

SEQ ID NO: 155115 - DNA, 103 bp, Artificial Sequence
  Synthetic Polynucleotide
taatacgactcactataggggctgctttcccaccccaaacagtacgaccaaacagaggagatggtcgatgtgtttggggaacctggcggcagcgcaaaagatg

SEQ ID NO: 155116 - DNA, 103 bp, Artificial Sequence
  Synthetic Polynucleotide
taatacgactcactataggggcatcatctcgctgctttcccaccccaaacaacagaggagagtttggatggggaaagcaaacctggcggcagcgcaaaagatg

SEQ ID NO: 155117 - DNA, 103 bp, Artificial Sequence
  Synthetic Polynucleotide
taatacgactcactatagggggcatggcgggcatcatctcgctgctttccaacagaggagaggaaagatgcgagatgataacctggcggcagcgcaaaagatg

SEQ ID NO: 155118 - DNA, 103 bp, Artificial Sequence
  Synthetic Polynucleotide
taatacgactcactatagggtacaacgtaatttctctgcaataatgctgcaacagaggagagcagcaatgttgcagagaaacctggcggcagcgcaaaagatg

SEQ ID NO: 155119 - DNA, 103 bp, Artificial Sequence
  Synthetic Polynucleotide
taatacgactcactatagggttttcttgatggcatggcgggcatcatctcaacagaggagagagatgatgcccgccatgaacctggcggcagcgcaaaagatg

SEQ ID NO: 155120 - DNA, 103 bp, Artificial Sequence
  Synthetic Polynucleotide
taatacgactcactatagggtccttggtgattttcttgatggcatggcggaacagaggagaccgccaatgcatcaagaaaacctggcggcagcgcaaaagatg

SEQ ID NO: 155121 - DNA, 103 bp, Artificial Sequence
  Synthetic Polynucleotide
taatacgactcactatagggcttcaagatatccttggtgattttcttgataacagaggagaatcaagatgatcaccaagaacctggcggcagcgcaaaagatg

SEQ ID NO: 155122 - DNA, 103 bp, Artificial Sequence
  Synthetic Polynucleotide
taatacgactcactatagggggttcagaaccttcaagatatccttggtgaaacagaggagatcaccaatgatatcttgaaacctggcggcagcgcaaaagatg

SEQ ID NO: 155123 - DNA, 103 bp, Artificial Sequence
  Synthetic Polynucleotide
taatacgactcactataggggtccctttgcggttcagaaccttcaagataaacagaggagatatcttatgggttctgaaaacctggcggcagcgcaaaagatg

SEQ ID NO: 155124 - DNA, 103 bp, Artificial Sequence
  Synthetic Polynucleotide
taatacgactcactatagggagtttctgctgtccctttgcggttcagaacaacagaggagagttctgatgcgcaaagggaacctggcggcagcgcaaaagatg

SEQ ID NO: 155125 - DNA, 103 bp, Artificial Sequence
  Synthetic Polynucleotide
taatacgactcactatagggcaagctggtcagtttctgctgtccctttgcaacagaggagagcaaagatgcagcagaaaaacctggcggcagcgcaaaagatg

SEQ ID NO: 155126 - DNA, 103 bp, Artificial Sequence
  Synthetic Polynucleotide
taatacgactcactatagggacaataggagcaagctggtcagtttctgctaacagaggagaagcagaatgtgaccagctaacctggcggcagcgcaaaagatg

SEQ ID NO: 155127 - DNA, 103 bp, Artificial Sequence
  Synthetic Polynucleotide
taatacgactcactatagggattcagaggcacaataggagcaagctggtcaacagaggagagaccagatggctcctattaacctggcggcagcgcaaaagatg

SEQ ID NO: 155128 - DNA, 103 bp, Artificial Sequence
  Synthetic Polynucleotide
taatacgactcactatagggggtctccaggattcagaggcacaataggagaacagaggagactcctaatgtgcctctgaaacctggcggcagcgcaaaagatg

SEQ ID NO: 155129 - DNA, 103 bp, Artificial Sequence
  Synthetic Polynucleotide
taatacgactcactatagggggaagggtattacaacgtaatttctctgcaaacagaggagatgcagaatgattacgttgaacctggcggcagcgcaaaagatg

SEQ ID NO: 155130 - DNA, 103 bp, Artificial Sequence
  Synthetic Polynucleotide
taatacgactcactatagggaagaatgtcaggtctccaggattcagaggcaacagaggagagcctctatgtcctggagaaacctggcggcagcgcaaaagatg

SEQ ID NO: 155131 - DNA, 103 bp, Artificial Sequence
  Synthetic Polynucleotide
taatacgactcactatagggctccccacctaagaatgtcaggtctccaggaacagaggagacctggaatgctgacattcaacctggcggcagcgcaaaagatg

SEQ ID NO: 155132 - DNA, 103 bp, Artificial Sequence
  Synthetic Polynucleotide
taatacgactcactatagggtctgcccatcctccccacctaagaatgtcaaacagaggagatgacatatgtaggtggggaacctggcggcagcgcaaaagatg

SEQ ID NO: 155133 - DNA, 103 bp, Artificial Sequence
  Synthetic Polynucleotide
taatacgactcactatagggcgtcgccgcttctgcccatcctccccacctaacagaggagaaggtggatgggatgggcaaacctggcggcagcgcaaaagatg

SEQ ID NO: 155134 - DNA, 103 bp, Artificial Sequence
  Synthetic Polynucleotide
taatacgactcactatagggaggccggttgcgtcgccgcttctgcccatcaacagaggagagatgggatgaagcggcgaaacctggcggcagcgcaaaagatg

SEQ ID NO: 155135 - DNA, 103 bp, Artificial Sequence
  Synthetic Polynucleotide
taatacgactcactatagggggaaggcttcaggccggttgcgtcgccgctaacagaggagaagcggcatggcaaccggcaacctggcggcagcgcaaaagatg

SEQ ID NO: 155136 - DNA, 103 bp, Artificial Sequence
  Synthetic Polynucleotide
taatacgactcactatagggtcagcagtggggaaggcttcaggccggttgaacagaggagacaaccgatgtgaagccttaacctggcggcagcgcaaaagatg

SEQ ID NO: 155137 - DNA, 103 bp, Artificial Sequence
  Synthetic Polynucleotide
taatacgactcactatagggaaagatatcttcagcagtggggaaggcttcaacagaggagagaagccatgcccactgctaacctggcggcagcgcaaaagatg

SEQ ID NO: 155138 - DNA, 103 bp, Artificial Sequence
  Synthetic Polynucleotide
taatacgactcactatagggggaacttagcaaagatatcttcagcagtggaacagaggagaccactgatgaagatatctaacctggcggcagcgcaaaagatg

SEQ ID NO: 155139 - DNA, 103 bp, Artificial Sequence
  Synthetic Polynucleotide
taatacgactcactataggggaaaggtgctggaacttagcaaagatatctaacagaggagaagatatatgtgctaagttaacctggcggcagcgcaaaagatg

SEQ ID NO: 155140 - DNA, 103 bp, Artificial Sequence
  Synthetic Polynucleotide
taatacgactcactatagggaccagtgtcaggaagggtattacaacgtaaaacagaggagattacgtatgaatacccttaacctggcggcagcgcaaaagatg

SEQ ID NO: 155141 - DNA, 103 bp, Artificial Sequence
  Synthetic Polynucleotide
taatacgactcactataggggtcataatgtgaaaggtgctggaacttagcaacagaggagagctaagatgcagcaccttaacctggcggcagcgcaaaagatg

SEQ ID NO: 155142 - DNA, 103 bp, Artificial Sequence
  Synthetic Polynucleotide
taatacgactcactatagggcctggtgttggtcataatgtgaaaggtgctaacagaggagaagcaccatgcacattatgaacctggcggcagcgcaaaagatg

SEQ ID NO: 155143 - DNA, 103 bp, Artificial Sequence
  Synthetic Polynucleotide
taatacgactcactatagggtgagccgtgacctggtgttggtcataatgtaacagaggagaacattaatgccaacaccaaacctggcggcagcgcaaaagatg

SEQ ID NO: 155144 - DNA, 103 bp, Artificial Sequence
  Synthetic Polynucleotide
taatacgactcactatagggccgggagacctgagccgtgacctggtgttgaacagaggagacaacacatggtcacggctaacctggcggcagcgcaaaagatg

SEQ ID NO: 155145 - DNA, 103 bp, Artificial Sequence
  Synthetic Polynucleotide
taatacgactcactatagggccagaacattccgggagacctgagccgtgaaacagaggagatcacggatgaggtctcccaacctggcggcagcgcaaaagatg

SEQ ID NO: 155146 - DNA, 103 bp, Artificial Sequence
  Synthetic Polynucleotide
taatacgactcactataggggtgatctgctccagaacattccgggagaccaacagaggagaggtctcatggaatgttctaacctggcggcagcgcaaaagatg

SEQ ID NO: 155147 - DNA, 103 bp, Artificial Sequence
  Synthetic Polynucleotide
taatacgactcactatagggggcaaagctcgtgatctgctccagaacattaacagaggagaaatgttatggagcagatcaacctggcggcagcgcaaaagatg

SEQ ID NO: 155148 - DNA, 103 bp, Artificial Sequence
  Synthetic Polynucleotide
taatacgactcactatagggacatgccaagggcaaagctcgtgatctgctaacagaggagaagcagaatgcgagctttgaacctggcggcagcgcaaaagatg

SEQ ID NO: 155149 - DNA, 103 bp, Artificial Sequence
  Synthetic Polynucleotide
taatacgactcactatagggaagtggtatgacatgccaagggcaaagctcaacagaggagagagcttatgccttggcataacctggcggcagcgcaaaagatg

SEQ ID NO: 155150 - DNA, 103 bp, Artificial Sequence
  Synthetic Polynucleotide
taatacgactcactatagggcaccagaggcaagtggtatgacatgccaagaacagaggagacttggcatgtcataccacaacctggcggcagcgcaaaagatg

SEQ ID NO: 155151 - DNA, 103 bp, Artificial Sequence
  Synthetic Polynucleotide
taatacgactcactataggggcttcctgcgaccagtgtcaggaagggtataacagaggagaatacccatgctgacactgaacctggcggcagcgcaaaagatg

SEQ ID NO: 155152 - DNA, 103 bp, Artificial Sequence
  Synthetic Polynucleotide
taatacgactcactataggggcacatgctgcaccagaggcaagtggtatgaacagaggagacataccatgtgcctctggaacctggcggcagcgcaaaagatg

SEQ ID NO: 155153 - DNA, 103 bp, Artificial Sequence
  Synthetic Polynucleotide
taatacgactcactatagggaagatgaactgcacatgctgcaccagaggcaacagaggagagcctctatggcagcatgtaacctggcggcagcgcaaaagatg

SEQ ID NO: 155154 - DNA, 103 bp, Artificial Sequence
  Synthetic Polynucleotide
taatacgactcactatagggcatgaggtcgaagatgaactgcacatgctgaacagaggagacagcatatgcagttcatcaacctggcggcagcgcaaaagatg

SEQ ID NO: 155155 - DNA, 103 bp, Artificial Sequence
  Synthetic Polynucleotide
taatacgactcactataggggtgaatattccatgaggtcgaagatgaactaacagaggagaagttcaatgtcgacctcaaacctggcggcagcgcaaaagatg

SEQ ID NO: 155156 - DNA, 103 bp, Artificial Sequence
  Synthetic Polynucleotide
taatacgactcactatagggctgatgctgagtgaatattccatgaggtcgaacagaggagacgacctatgggaatattcaacctggcggcagcgcaaaagatg

SEQ ID NO: 155157 - DNA, 103 bp, Artificial Sequence
  Synthetic Polynucleotide
taatacgactcactataggggatgaggccactgatgctgagtgaatattcaacagaggagagaatatatgctcagcatcaacctggcggcagcgcaaaagatg

SEQ ID NO: 155158 - DNA, 103 bp, Artificial Sequence
  Synthetic Polynucleotide
taatacgactcactatagggtggcaaagtcgatgaggccactgatgctgaaacagaggagatcagcaatggtggcctcaaacctggcggcagcgcaaaagatg

SEQ ID NO: 155159 - DNA, 103 bp, Artificial Sequence
  Synthetic Polynucleotide
taatacgactcactatagggagcagctgaatggcaaagtcgatgaggccaaacagaggagatggcctatgcgactttgcaacctggcggcagcgcaaaagatg

SEQ ID NO: 155160 - DNA, 103 bp, Artificial Sequence
  Synthetic Polynucleotide
taatacgactcactatagggcagttcattcagcagctgaatggcaaagtcaacagaggagagactttatgattcagctgaacctggcggcagcgcaaaagatg

SEQ ID NO: 155161 - DNA, 103 bp, Artificial Sequence
  Synthetic Polynucleotide
taatacgactcactatagggcaactacactcagttcattcagcagctgaaaacagaggagattcagcatgtgaatgaacaacctggcggcagcgcaaaagatg

SEQ ID NO: 155162 - DNA, 103 bp, Artificial Sequence
  Synthetic Polynucleotide
taatacgactcactatagggttcacttggggcttcctgcgaccagtgtcaaacagaggagatgacacatgtcgcaggaaaacctggcggcagcgcaaaagatg

SEQ ID NO: 155163 - DNA, 103 bp, Artificial Sequence
  Synthetic Polynucleotide
taatacgactcactatagggagctcagcctcaactacactcagttcattcaacagaggagagaatgaatggagtgtagtaacctggcggcagcgcaaaagatg

SEQ ID NO: 155164 - DNA, 103 bp, Artificial Sequence
  Synthetic Polynucleotide
taatacgactcactatagggtttgagaagcagctcagcctcaactacactaacagaggagaagtgtaatggaggctgagaacctggcggcagcgcaaaagatg

SEQ ID NO: 155165 - DNA, 103 bp, Artificial Sequence
  Synthetic Polynucleotide
taatacgactcactataggggatccgaggatttgagaagcagctcagcctaacagaggagaaggctgatgtgcttctcaaacctggcggcagcgcaaaagatg

SEQ ID NO: 155166 - DNA, 103 bp, Artificial Sequence
  Synthetic Polynucleotide
taatacgactcactatagggctgcccaccagatccgaggatttgagaagcaacagaggagagcttctatgatcctcggaaacctggcggcagcgcaaaagatg

SEQ ID NO: 155167 - DNA, 103 bp, Artificial Sequence
  Synthetic Polynucleotide
taatacgactcactatagggagtagtgtagctgcccaccagatccgaggaaacagaggagatcctcgatgctggtgggcaacctggcggcagcgcaaaagatg

SEQ ID NO: 155168 - DNA, 103 bp, Artificial Sequence
  Synthetic Polynucleotide
taatacgactcactatagggggcacaggctagtagtgtagctgcccaccaaacagaggagatggtggatggctacactaaacctggcggcagcgcaaaagatg

SEQ ID NO: 155169 - DNA, 103 bp, Artificial Sequence
  Synthetic Polynucleotide
taatacgactcactatagggacgatgcacaggcacaggctagtagtgtagaacagaggagactacacatgtagcctgtgaacctggcggcagcgcaaaagatg

SEQ ID NO: 155170 - DNA, 103 bp, Artificial Sequence
  Synthetic Polynucleotide
taatacgactcactatagggcaggacagccacgatgcacaggcacaggctaacagaggagaagcctgatgctgtgcatcaacctggcggcagcgcaaaagatg

SEQ ID NO: 155171 - DNA, 103 bp, Artificial Sequence
  Synthetic Polynucleotide
taatacgactcactataggggatagtgccgcaggacagccacgatgcacaaacagaggagatgtgcaatgtggctgtccaacctggcggcagcgcaaaagatg

SEQ ID NO: 155172 - DNA, 103 bp, Artificial Sequence
  Synthetic Polynucleotide
taatacgactcactatagggaggcaggcatgatagtgccgcaggacagccaacagaggagaggctgtatggcggcactaaacctggcggcagcgcaaaagatg

SEQ ID NO: 155173 - DNA, 103 bp, Artificial Sequence
  Synthetic Polynucleotide
taatacgactcactatagggatccttctggttcacttggggcttcctgcgaacagaggagacgcaggatgccccaagtgaacctggcggcagcgcaaaagatg

SEQ ID NO: 155174 - DNA, 103 bp, Artificial Sequence
  Synthetic Polynucleotide
taatacgactcactataggggttgaggatgaggcaggcatgatagtgccgaacagaggagacggcacatgcatgcctgcaacctggcggcagcgcaaaagatg

SEQ ID NO: 155175 - DNA, 103 bp, Artificial Sequence
  Synthetic Polynucleotide
taatacgactcactatagggtctggtcctggttgaggatgaggcaggcataacagaggagaatgcctatgtcatcctcaaacctggcggcagcgcaaaagatg

SEQ ID NO: 155176 - DNA, 103 bp, Artificial Sequence
  Synthetic Polynucleotide
taatacgactcactatagggacctgtgccatctggtcctggttgaggatgaacagaggagacatcctatgccaggaccaaacctggcggcagcgcaaaagatg

SEQ ID NO: 155177 - DNA, 103 bp, Artificial Sequence
  Synthetic Polynucleotide
taatacgactcactatagggcccctcaaagacctgtgccatctggtcctgaacagaggagacaggacatgatggcacagaacctggcggcagcgcaaaagatg

SEQ ID NO: 155178 - DNA, 103 bp, Artificial Sequence
  Synthetic Polynucleotide
taatacgactcactatagggcgccacacagcccctcaaagacctgtgccaaacagaggagatggcacatgtctttgaggaacctggcggcagcgcaaaagatg

SEQ ID NO: 155179 - DNA, 103 bp, Artificial Sequence
  Synthetic Polynucleotide
taatacgactcactatagggtgcttcacgacgccacacagcccctcaaagaacagaggagactttgaatggctgtgtggaacctggcggcagcgcaaaagatg

SEQ ID NO: 155180 - DNA, 103 bp, Artificial Sequence
  Synthetic Polynucleotide
taatacgactcactataggggttcatcccatgcttcacgacgccacacagaacagaggagactgtgtatggtcgtgaagaacctggcggcagcgcaaaagatg

SEQ ID NO: 155181 - DNA, 103 bp, Artificial Sequence
  Synthetic Polynucleotide
taatacgactcactatagggcatcggaccggttcatcccatgcttcacgaaacagaggagatcgtgaatgatgggatgaaacctggcggcagcgcaaaagatg

SEQ ID NO: 155182 - DNA, 103 bp, Artificial Sequence
  Synthetic Polynucleotide
taatacgactcactataggggcagaggagccatcggaccggttcatcccaaacagaggagatgggatatgccggtccgaaacctggcggcagcgcaaaagatg

SEQ ID NO: 155183 - DNA, 103 bp, Artificial Sequence
  Synthetic Polynucleotide
taatacgactcactatagggacagcgctctgcagaggagccatcggaccgaacagaggagacggtccatgggctcctctaacctggcggcagcgcaaaagatg

SEQ ID NO: 155184 - DNA, 103 bp, Artificial Sequence
  Synthetic Polynucleotide
taatacgactcactataggggccagaagttatccttctggttcacttgggaacagaggagacccaagatgaccagaaggaacctggcggcagcgcaaaagatg

SEQ ID NO: 155185 - DNA, 103 bp, Artificial Sequence
  Synthetic Polynucleotide
taatacgactcactatagggaagcaaggatacagcgctctgcagaggagcaacagaggagagctcctatgcagagcgctaacctggcggcagcgcaaaagatg

SEQ ID NO: 155186 - DNA, 103 bp, Artificial Sequence
  Synthetic Polynucleotide
taatacgactcactatagggtcatagagataagcaaggatacagcgctctaacagaggagaagagcgatgtatccttgcaacctggcggcagcgcaaaagatg

SEQ ID NO: 155187 - DNA, 103 bp, Artificial Sequence
  Synthetic Polynucleotide
taatacgactcactatagggggtgtacagatcatagagataagcaaggataacagaggagaatccttatgtatctctataacctggcggcagcgcaaaagatg

SEQ ID NO: 155188 - DNA, 103 bp, Artificial Sequence
  Synthetic Polynucleotide
taatacgactcactatagggggctacaggaggtgtacagatcatagagataacagaggagaatctctatgatctgtacaaacctggcggcagcgcaaaagatg

SEQ ID NO: 155189 - DNA, 103 bp, Artificial Sequence
  Synthetic Polynucleotide
taatacgactcactatagggttctttaaatggctacaggaggtgtacagaaacagaggagatctgtaatgctcctgtagaacctggcggcagcgcaaaagatg

SEQ ID NO: 155190 - DNA, 103 bp, Artificial Sequence
  Synthetic Polynucleotide
taatacgactcactatagggcccaaatttgttctttaaatggctacaggaaacagaggagatcctgtatgcatttaaagaacctggcggcagcgcaaaagatg

SEQ ID NO: 155191 - DNA, 103 bp, Artificial Sequence
  Synthetic Polynucleotide
taatacgactcactatagggtgaagagctccccaaatttgttctttaaataacagaggagaatttaaatgacaaatttgaacctggcggcagcgcaaaagatg

SEQ ID NO: 155192 - DNA, 103 bp, Artificial Sequence
  Synthetic Polynucleotide
taatacgactcactatagggcaaaagtcgctgaagagctccccaaatttgaacagaggagacaaattatgggagctcttaacctggcggcagcgcaaaagatg

SEQ ID NO: 155193 - DNA, 103 bp, Artificial Sequence
  Synthetic Polynucleotide
taatacgactcactatagggcacctttgagcaaaagtcgctgaagagctcaacagaggagagagctcatgagcgactttaacctggcggcagcgcaaaagatg

SEQ ID NO: 155194 - DNA, 103 bp, Artificial Sequence
  Synthetic Polynucleotide
taatacgactcactatagggtggtgttcttcacctttgagcaaaagtcgcaacagaggagagcgactatggctcaaaggaacctggcggcagcgcaaaagatg

SEQ ID NO: 155195 - DNA, 103 bp, Artificial Sequence
  Synthetic Polynucleotide
taatacgactcactatagggggccgcttcaggggccggtgttcgtagctcaacagaggagagagctaatgacaccggccaacctggcggcagcgcaaaagatg

SEQ ID NO: 155196 - DNA, 103 bp, Artificial Sequence
  Synthetic Polynucleotide
taatacgactcactataggggcagtcaccagccagaagttatccttctggaacagaggagaccagaaatgtaacttctgaacctggcggcagcgcaaaagatg

SEQ ID NO: 155197 - DNA, 103 bp, Artificial Sequence
  Synthetic Polynucleotide
taatacgactcactatagggttgcagtagatggtgttcttcacctttgagaacagaggagactcaaaatggaagaacacaacctggcggcagcgcaaaagatg

SEQ ID NO: 155198 - DNA, 103 bp, Artificial Sequence
  Synthetic Polynucleotide
taatacgactcactatagggtggctccacgttgcagtagatggtgttcttaacagaggagaaagaacatgatctactgcaacctggcggcagcgcaaaagatg

SEQ ID NO: 155199 - DNA, 103 bp, Artificial Sequence
  Synthetic Polynucleotide
taatacgactcactatagggttgattccgatggctccacgttgcagtagaaacagaggagatctactatgacgtggagcaacctggcggcagcgcaaaagatg

SEQ ID NO: 155200 - DNA, 103 bp, Artificial Sequence
  Synthetic Polynucleotide
taatacgactcactatagggcagcgcatatttgattccgatggctccacgaacagaggagacgtggaatgatcggaatcaacctggcggcagcgcaaaagatg

SEQ ID NO: 155201 - DNA, 103 bp, Artificial Sequence
  Synthetic Polynucleotide
taatacgactcactatagggctcaggtgcccagcgcatatttgattccgaaacagaggagatcggaaatgaatatgcgcaacctggcggcagcgcaaaagatg

SEQ ID NO: 155202 - DNA, 103 bp, Artificial Sequence
  Synthetic Polynucleotide
taatacgactcactatagggcgatcatgaactcaggtgcccagcgcatataacagaggagaatatgcatggggcacctgaacctggcggcagcgcaaaagatg

SEQ ID NO: 155203 - DNA, 103 bp, Artificial Sequence
  Synthetic Polynucleotide
taatacgactcactatagggtctagagtgtcgatcatgaactcaggtgccaacagaggagaggcaccatggttcatgataacctggcggcagcgcaaaagatg

SEQ ID NO: 155204 - DNA, 103 bp, Artificial Sequence
  Synthetic Polynucleotide
taatacgactcactatagggtgcagggttctctagagtgtcgatcatgaaaacagaggagattcatgatggacactctaaacctggcggcagcgcaaaagatg

SEQ ID NO: 155205 - DNA, 103 bp, Artificial Sequence
  Synthetic Polynucleotide
taatacgactcactatagggaggtgtgagctgcagggttctctagagtgtaacagaggagaacactcatgagaaccctgaacctggcggcagcgcaaaagatg

SEQ ID NO: 155206 - DNA, 103 bp, Artificial Sequence
  Synthetic Polynucleotide
taatacgactcactataggggtgtaggtgaaggtgtgagctgcagggttcaacagaggagagaacccatgagctcacacaacctggcggcagcgcaaaagatg

SEQ ID NO: 155207 - DNA, 103 bp, Artificial Sequence
  Synthetic Polynucleotide
taatacgactcactatagggctgggatcgtgcagtcaccagccagaagttaacagaggagaaacttcatgctggtgactaacctggcggcagcgcaaaagatg

SEQ ID NO: 155208 - DNA, 103 bp, Artificial Sequence
  Synthetic Polynucleotide
taatacgactcactataggggcctagccccgtgtaggtgaaggtgtgagcaacagaggagagctcacatgttcacctacaacctggcggcagcgcaaaagatg

SEQ ID NO: 155209 - DNA, 103 bp, Artificial Sequence
  Synthetic Polynucleotide
taatacgactcactatagggtaagactcttgcctagccccgtgtaggtgaaacagaggagatcacctatgcggggctagaacctggcggcagcgcaaaagatg

SEQ ID NO: 155210 - DNA, 103 bp, Artificial Sequence
  Synthetic Polynucleotide
taatacgactcactataggggggttctcactaagactcttgcctagccccaacagaggagaggggctatgcaagagtctaacctggcggcagcgcaaaagatg

SEQ ID NO: 155211 - DNA, 103 bp, Artificial Sequence
  Synthetic Polynucleotide
taatacgactcactataggggcggttagcagggttctcactaagactcttaacagaggagaaagagtatgagtgagaacaacctggcggcagcgcaaaagatg

SEQ ID NO: 155212 - DNA, 103 bp, Artificial Sequence
  Synthetic Polynucleotide
taatacgactcactatagggcaaagctgtagcggttagcagggttctcacaacagaggagagtgagaatgctgctaaccaacctggcggcagcgcaaaagatg

SEQ ID NO: 155213 - DNA, 103 bp, Artificial Sequence
  Synthetic Polynucleotide
taatacgactcactataggggcattgcagacaaagctgtagcggttagcaaacagaggagatgctaaatgctacagcttaacctggcggcagcgcaaaagatg

SEQ ID NO: 155214 - DNA, 103 bp, Artificial Sequence
  Synthetic Polynucleotide
taatacgactcactataggggtgcataagggcattgcagacaaagctgtaaacagaggagatacagcatggtctgcaataacctggcggcagcgcaaaagatg

SEQ ID NO: 155215 - DNA, 103 bp, Artificial Sequence
  Synthetic Polynucleotide
taatacgactcactatagggccacacagacgtgcataagggcattgcagaaacagaggagatctgcaatgcccttatgcaacctggcggcagcgcaaaagatg

SEQ ID NO: 155216 - DNA, 103 bp, Artificial Sequence
  Synthetic Polynucleotide
taatacgactcactatagggtcatggtgccccacacagacgtgcataaggaacagaggagaccttatatgcgtctgtgtaacctggcggcagcgcaaaagatg

SEQ ID NO: 155217 - DNA, 103 bp, Artificial Sequence
  Synthetic Polynucleotide
taatacgactcactatagggcctatcgggatcatggtgccccacacagacaacagaggagagtctgtatggggcaccataacctggcggcagcgcaaaagatg

SEQ ID NO: 155218 - DNA, 103 bp, Artificial Sequence
  Synthetic Polynucleotide
taatacgactcactatagggtaatggcactctgggatcgtgcagtcaccaaacagaggagatggtgaatgcacgatcccaacctggcggcagcgcaaaagatg

SEQ ID NO: 155219 - DNA, 103 bp, Artificial Sequence
  Synthetic Polynucleotide
taatacgactcactatagggtgtcattcaccctatcgggatcatggtgccaacagaggagaggcaccatgatcccgataaacctggcggcagcgcaaaagatg

SEQ ID NO: 155220 - DNA, 103 bp, Artificial Sequence
  Synthetic Polynucleotide
taatacgactcactatagggaggattgcgatgtcattcaccctatcgggaaacagaggagatcccgaatgggtgaatgaaacctggcggcagcgcaaaagatg

SEQ ID NO: 155221 - DNA, 103 bp, Artificial Sequence
  Synthetic Polynucleotide
taatacgactcactatagggctctgcacacaggattgcgatgtcattcacaacagaggagagtgaatatgatcgcaatcaacctggcggcagcgcaaaagatg

SEQ ID NO: 155222 - DNA, 103 bp, Artificial Sequence
  Synthetic Polynucleotide
taatacgactcactatagggagccggtcagctctgcacacaggattgcgaaacagaggagatcgcaaatgtgtgtgcagaacctggcggcagcgcaaaagatg

SEQ ID NO: 155223 - DNA, 103 bp, Artificial Sequence
  Synthetic Polynucleotide
taatacgactcactataggggacttgcaatagccggtcagctctgcacacaacagaggagagtgtgcatggctgaccggaacctggcggcagcgcaaaagatg

SEQ ID NO: 155224 - DNA, 103 bp, Artificial Sequence
  Synthetic Polynucleotide
taatacgactcactatagggtgcactcagtgacttgcaatagccggtcagaacagaggagactgaccatgtattgcaagaacctggcggcagcgcaaaagatg

SEQ ID NO: 155225 - DNA, 103 bp, Artificial Sequence
  Synthetic Polynucleotide
taatacgactcactatagggctagccattctgcactcagtgacttgcaataacagaggagaattgcaatgcactgagtgaacctggcggcagcgcaaaagatg

SEQ ID NO: 155226 - DNA, 103 bp, Artificial Sequence
  Synthetic Polynucleotide
taatacgactcactatagggttaagcactcctagccattctgcactcagtaacagaggagaactgagatgagaatggctaacctggcggcagcgcaaaagatg

SEQ ID NO: 155227 - DNA, 103 bp, Artificial Sequence
  Synthetic Polynucleotide
taatacgactcactataggggcacaaggccttaagcactcctagccattcaacagaggagagaatggatgggagtgcttaacctggcggcagcgcaaaagatg

SEQ ID NO: 155228 - DNA, 103 bp, Artificial Sequence
  Synthetic Polynucleotide
taatacgactcactatagggtagaggagcagcacaaggccttaagcactcaacagaggagagagtgcatgaggccttgtaacctggcggcagcgcaaaagatg

SEQ ID NO: 155229 - DNA, 103 bp, Artificial Sequence
  Synthetic Polynucleotide
taatacgactcactatagggaaccaagtgttaatggcactctgggatcgtaacagaggagaacgatcatggagtgccataacctggcggcagcgcaaaagatg

SEQ ID NO: 155230 - DNA, 103 bp, Artificial Sequence
  Synthetic Polynucleotide
taatacgactcactataggggtgccattgttagaggagcagcacaaggccaacagaggagaggccttatgctgctcctcaacctggcggcagcgcaaaagatg

SEQ ID NO: 155231 - DNA, 103 bp, Artificial Sequence
  Synthetic Polynucleotide
taatacgactcactataggggaaaccacaagtgccattgttagaggagcaaacagaggagatgctccatgaacaatggcaacctggcggcagcgcaaaagatg

SEQ ID NO: 155232 - DNA, 103 bp, Artificial Sequence
  Synthetic Polynucleotide
taatacgactcactatagggggagatcgttgaaaccacaagtgccattgtaacagaggagaacaatgatgcttgtggttaacctggcggcagcgcaaaagatg

SEQ ID NO: 155233 - DNA, 103 bp, Artificial Sequence
  Synthetic Polynucleotide
taatacgactcactatagggacattgcagaggagatcgttgaaaccacaaaacagaggagattgtggatgcaacgatctaacctggcggcagcgcaaaagatg

SEQ ID NO: 155234 - DNA, 103 bp, Artificial Sequence
  Synthetic Polynucleotide
taatacgactcactatagggactgacatcaacattgcagaggagatcgttaacagaggagaaacgatatgctctgcaataacctggcggcagcgcaaaagatg

SEQ ID NO: 155235 - DNA, 103 bp, Artificial Sequence
  Synthetic Polynucleotide
taatacgactcactatagggaagataggtcactgacatcaacattgcagaaacagaggagatctgcaatgttgatgtcaaacctggcggcagcgcaaaagatg

SEQ ID NO: 155236 - DNA, 103 bp, Artificial Sequence
  Synthetic Polynucleotide
taatacgactcactataggggagtcatgaaaagataggtcactgacatcaaacagaggagatgatgtatgtgacctatcaacctggcggcagcgcaaaagatg

SEQ ID NO: 155237 - DNA, 103 bp, Artificial Sequence
  Synthetic Polynucleotide
taatacgactcactatagggagtagccagcgagtcatgaaaagataggtcaacagaggagagacctaatgtttcatgacaacctggcggcagcgcaaaagatg

SEQ ID NO: 155238 - DNA, 103 bp, Artificial Sequence
  Synthetic Polynucleotide
taatacgactcactatagggtggcaacaaaagtagccagcgagtcatgaaaacagaggagattcatgatgcgctggctaaacctggcggcagcgcaaaagatg

SEQ ID NO: 155239 - DNA, 103 bp, Artificial Sequence
  Synthetic Polynucleotide
taatacgactcactataggggcgatgaggatggcaacaaaagtagccagcaacagaggagagctggcatgttttgttgcaacctggcggcagcgcaaaagatg

SEQ ID NO: 155240 - DNA, 103 bp, Artificial Sequence
  Synthetic Polynucleotide
taatacgactcactatagggcaagtcagtgaaccaagtgttaatggcactaacagaggagaagtgccatgaacacttggaacctggcggcagcgcaaaagatg

SEQ ID NO: 155241 - DNA, 103 bp, Artificial Sequence
  Synthetic Polynucleotide
taatacgactcactatagggacactgccgagcgatgaggatggcaacaaaaacagaggagatttgttatgatcctcatcaacctggcggcagcgcaaaagatg

SEQ ID NO: 155242 - DNA, 103 bp, Artificial Sequence
  Synthetic Polynucleotide
taatacgactcactatagggccaggagcaaacactgccgagcgatgaggaaacagaggagatcctcaatgctcggcagtaacctggcggcagcgcaaaagatg

SEQ ID NO: 155243 - DNA, 103 bp, Artificial Sequence
  Synthetic Polynucleotide
taatacgactcactatagggatcagatcttccaggagcaaacactgccgaaacagaggagatcggcaatgtttgctcctaacctggcggcagcgcaaaagatg

SEQ ID NO: 155244 - DNA, 103 bp, Artificial Sequence
  Synthetic Polynucleotide
taatacgactcactatagggagcacagcgaatcagatcttccaggagcaaaacagaggagattgctcatggaagatctgaacctggcggcagcgcaaaagatg

SEQ ID NO: 155245 - DNA, 103 bp, Artificial Sequence
  Synthetic Polynucleotide
taatacgactcactatagggaagggatggcagcacagcgaatcagatcttaacagaggagaaagatcatgttcgctgtgaacctggcggcagcgcaaaagatg

SEQ ID NO: 155246 - DNA, 103 bp, Artificial Sequence
  Synthetic Polynucleotide
taatacgactcactatagggttaaggagtgaagggatggcagcacagcgaaacagaggagatcgctgatgtgccatcccaacctggcggcagcgcaaaagatg

SEQ ID NO: 155247 - DNA, 103 bp, Artificial Sequence
  Synthetic Polynucleotide
taatacgactcactatagggacaagcagcattaaggagtgaagggatggcaacagaggagagccatcatgtcactccttaacctggcggcagcgcaaaagatg

SEQ ID NO: 155248 - DNA, 103 bp, Artificial Sequence
  Synthetic Polynucleotide
taatacgactcactatagggcctgttcactacaagcagcattaaggagtgaacagaggagacactccatgatgctgcttaacctggcggcagcgcaaaagatg

SEQ ID NO: 155249 - DNA, 103 bp, Artificial Sequence
  Synthetic Polynucleotide
taatacgactcactatagggggctcagagtcctgttcactacaagcagcaaacagaggagatgctgcatgtagtgaacaaacctggcggcagcgcaaaagatg

SEQ ID NO: 155250 - DNA, 103 bp, Artificial Sequence
  Synthetic Polynucleotide
taatacgactcactatagggccgggcccctggctcagagtcctgttcactaacagaggagaagtgaaatggactctgagaacctggcggcagcgcaaaagatg

SEQ ID NO: 155251 - DNA, 103 bp, Artificial Sequence
  Synthetic Polynucleotide
taatacgactcactatagggtggtgccagccaagtcagtgaaccaagtgtaacagaggagaacacttatgtcactgactaacctggcggcagcgcaaaagatg

SEQ ID NO: 155252 - DNA, 103 bp, Artificial Sequence
  Synthetic Polynucleotide
taatacgactcactatagggggcaggtaagccgggcccctggctcagagtaacagaggagaactctgatgcaggggcccaacctggcggcagcgcaaaagatg

SEQ ID NO: 155253 - DNA, 103 bp, Artificial Sequence
  Synthetic Polynucleotide
taatacgactcactatagggaggaggatgcggcaggtaagccgggcccctaacagaggagaaggggcatggcttacctgaacctggcggcagcgcaaaagatg

SEQ ID NO: 155254 - DNA, 103 bp, Artificial Sequence
  Synthetic Polynucleotide
taatacgactcactataggggaaaaggtgaaggaggatgcggcaggtaagaacagaggagacttaccatgcgcatcctcaacctggcggcagcgcaaaagatg

SEQ ID NO: 155255 - DNA, 103 bp, Artificial Sequence
  Synthetic Polynucleotide
taatacgactcactataggggcggtgtcttgaaaaggtgaaggaggatgcaacagaggagagcatccatgttcacctttaacctggcggcagcgcaaaagatg

SEQ ID NO: 155256 - DNA, 103 bp, Artificial Sequence
  Synthetic Polynucleotide
taatacgactcactatagggggattgagctgcggtgtcttgaaaaggtgaaacagaggagatcacctatgcaagacaccaacctggcggcagcgcaaaagatg

SEQ ID NO: 155257 - DNA, 103 bp, Artificial Sequence
  Synthetic Polynucleotide
taatacgactcactatagggagactggcaaggattgagctgcggtgtcttaacagaggagaaagacaatgcagctcaataacctggcggcagcgcaaaagatg

SEQ ID NO: 155258 - DNA, 103 bp, Artificial Sequence
  Synthetic Polynucleotide
taatacgactcactatagggtgtttccatcagactggcaaggattgagctaacagaggagaagctcaatgcttgccagtaacctggcggcagcgcaaaagatg

SEQ ID NO: 155259 - DNA, 103 bp, Artificial Sequence
  Synthetic Polynucleotide
taatacgactcactatagggactgtaggcttgtttccatcagactggcaaaacagaggagattgccaatgtgatggaaaaacctggcggcagcgcaaaagatg

SEQ ID NO: 155260 - DNA, 103 bp, Artificial Sequence
  Synthetic Polynucleotide
taatacgactcactataggggcggattcctactgtaggcttgtttccatcaacagaggagagatggaatgaagcctacaaacctggcggcagcgcaaaagatg

SEQ ID NO: 155261 - DNA, 103 bp, Artificial Sequence
  Synthetic Polynucleotide
taatacgactcactatagggcgcaggaggagcggattcctactgtaggctaacagaggagaagcctaatgtaggaatccaacctggcggcagcgcaaaagatg

SEQ ID NO: 155262 - DNA, 103 bp, Artificial Sequence
  Synthetic Polynucleotide
taatacgactcactataggggtgagtggcttggtgccagccaagtcagtgaacagaggagacactgaatgggctggcacaacctggcggcagcgcaaaagatg

SEQ ID NO: 155263 - DNA, 103 bp, Artificial Sequence
  Synthetic Polynucleotide
taatacgactcactatagggaggtggcggtcgcaggaggagcggattcctaacagaggagaaggaatatgctcctcctgaacctggcggcagcgcaaaagatg

SEQ ID NO: 155264 - DNA, 103 bp, Artificial Sequence
  Synthetic Polynucleotide
taatacgactcactatagggggcagccagcaggtggcggtcgcaggaggaaacagaggagatcctccatggaccgccacaacctggcggcagcgcaaaagatg

SEQ ID NO: 155265 - DNA, 103 bp, Artificial Sequence
  Synthetic Polynucleotide
taatacgactcactatagggggttctgggaggcagccagcaggtggcggtaacagaggagaaccgccatgtgctggctgaacctggcggcagcgcaaaagatg

SEQ ID NO: 155266 - DNA, 103 bp, Artificial Sequence
  Synthetic Polynucleotide
taatacgactcactatagggtccacgatgcggttctgggaggcagccagcaacagaggagagctggcatgctcccagaaaacctggcggcagcgcaaaagatg

SEQ ID NO: 155267 - DNA, 103 bp, Artificial Sequence
  Synthetic Polynucleotide
taatacgactcactatagggcacggctccatccacgatgcggttctgggaaacagaggagatcccagatgcgcatcgtgaacctggcggcagcgcaaaagatg

SEQ ID NO: 155268 - DNA, 103 bp, Artificial Sequence
  Synthetic Polynucleotide
taatacgactcactataggggaacagcaaacacggctccatccacgatgcaacagaggagagcatcgatgatggagccgaacctggcggcagcgcaaaagatg

SEQ ID NO: 155269 - DNA, 103 bp, Artificial Sequence
  Synthetic Polynucleotide
taatacgactcactatagggacagccttgagaacagcaaacacggctccaaacagaggagatggagcatggtttgctgtaacctggcggcagcgcaaaagatg

SEQ ID NO: 155270 - DNA, 103 bp, Artificial Sequence
  Synthetic Polynucleotide
taatacgactcactatagggaagtacaaacacagccttgagaacagcaaaaacagaggagatttgctatgctcaaggctaacctggcggcagcgcaaaagatg

SEQ ID NO: 155271 - DNA, 103 bp, Artificial Sequence
  Synthetic Polynucleotide
taatacgactcactatagggccgcatccccaagtacaaacacagccttgaaacagaggagatcaaggatgtgtttgtacaacctggcggcagcgcaaaagatg

SEQ ID NO: 155272 - DNA, 103 bp, Artificial Sequence
  Synthetic Polynucleotide
taatacgactcactatagggcctttcagttccgcatccccaagtacaaacaacagaggagagtttgtatgtggggatgcaacctggcggcagcgcaaaagatg

SEQ ID NO: 155273 - DNA, 103 bp, Artificial Sequence
  Synthetic Polynucleotide
taatacgactcactatagggggctagttgcgtgagtggcttggtgccagcaacagaggagagctggcatgaagccactcaacctggcggcagcgcaaaagatg

SEQ ID NO: 155274 - DNA, 103 bp, Artificial Sequence
  Synthetic Polynucleotide
taatacgactcactataggggaagcctgaacctttcagttccgcatccccaacagaggagaggggatatggaactgaaaaacctggcggcagcgcaaaagatg

SEQ ID NO: 155275 - DNA, 103 bp, Artificial Sequence
  Synthetic Polynucleotide
taatacgactcactatagggctgtcacagtgaagcctgaacctttcagttaacagaggagaaactgaatggttcaggctaacctggcggcagcgcaaaagatg

SEQ ID NO: 155276 - DNA, 103 bp, Artificial Sequence
  Synthetic Polynucleotide
taatacgactcactatagggtctgttcctcctgtcacagtgaagcctgaaaacagaggagattcaggatgcactgtgacaacctggcggcagcgcaaaagatg

SEQ ID NO: 155277 - DNA, 103 bp, Artificial Sequence
  Synthetic Polynucleotide
taatacgactcactatagggtggaagttcttctgttcctcctgtcacagtaacagaggagaactgtgatgggaggaacaaacctggcggcagcgcaaaagatg

SEQ ID NO: 155278 - DNA, 103 bp, Artificial Sequence
  Synthetic Polynucleotide
taatacgactcactatagggcctcctcctctggaagttcttctgttcctcaacagaggagagaggaaatgaagaacttcaacctggcggcagcgcaaaagatg

SEQ ID NO: 155279 - DNA, 103 bp, Artificial Sequence
  Synthetic Polynucleotide
taatacgactcactatagggccacctcctccctcctcctctggaagttctaacagaggagaagaactatgagaggaggaaacctggcggcagcgcaaaagatg

SEQ ID NO: 155280 - DNA, 103 bp, Artificial Sequence
  Synthetic Polynucleotide
taatacgactcactatagggaccaccactgccacctcctccctcctcctcaacagaggagagaggagatgggaggaggtaacctggcggcagcgcaaaagatg

SEQ ID NO: 155281 - DNA, 103 bp, Artificial Sequence
  Synthetic Polynucleotide
taatacgactcactatagggcctgcctccgaccaccactgccacctcctcaacagaggagagaggagatggcagtggtgaacctggcggcagcgcaaaagatg

SEQ ID NO: 155282 - DNA, 103 bp, Artificial Sequence
  Synthetic Polynucleotide
taatacgactcactatagggttgcggccaccctgcctccgaccaccactgaacagaggagacagtggatgtcggaggcaaacctggcggcagcgcaaaagatg

SEQ ID NO: 155283 - DNA, 103 bp, Artificial Sequence
  Synthetic Polynucleotide
taatacgactcactatagggcacagagatgttgcggccaccctgcctccgaacagaggagacggaggatgggtggccgcaacctggcggcagcgcaaaagatg

SEQ ID NO: 155284 - DNA, 103 bp, Artificial Sequence
  Synthetic Polynucleotide
taatacgactcactatagggggacctttttggctagttgcgtgagtggctaacagaggagaagccacatgcgcaactagaacctggcggcagcgcaaaagatg

SEQ ID NO: 155285 - DNA, 103 bp, Artificial Sequence
  Synthetic Polynucleotide
taatacgactcactatagggtggctgtctccacagagatgttgcggccacaacagaggagagtggccatgacatctctgaacctggcggcagcgcaaaagatg

SEQ ID NO: 155286 - DNA, 103 bp, Artificial Sequence
  Synthetic Polynucleotide
taatacgactcactatagggacatccagactggctgtctccacagagatgaacagaggagacatctcatgggagacagcaacctggcggcagcgcaaaagatg

SEQ ID NO: 155287 - DNA, 103 bp, Artificial Sequence
  Synthetic Polynucleotide
taatacgactcactatagggcttggcatagacatccagactggctgtctcaacagaggagagagacaatgagtctggataacctggcggcagcgcaaaagatg

SEQ ID NO: 155288 - DNA, 103 bp, Artificial Sequence
  Synthetic Polynucleotide
taatacgactcactataggggcagcacgtacttggcatagacatccagacaacagaggagagtctggatgtctatgccaaacctggcggcagcgcaaaagatg

SEQ ID NO: 155289 - DNA, 103 bp, Artificial Sequence
  Synthetic Polynucleotide
taatacgactcactatagggcagatgctgcgcagcacgtacttggcatagaacagaggagactatgcatggtacgtgctaacctggcggcagcgcaaaagatg

SEQ ID NO: 155290 - DNA, 103 bp, Artificial Sequence
  Synthetic Polynucleotide
taatacgactcactatagggttcctgttggcagatgctgcgcagcacgtaaacagaggagatacgtgatgcgcagcatcaacctggcggcagcgcaaaagatg

SEQ ID NO: 155291 - DNA, 103 bp, Artificial Sequence
  Synthetic Polynucleotide
taatacgactcactatagggctcctacccattcctgttggcagatgctgcaacagaggagagcagcaatggccaacaggaacctggcggcagcgcaaaagatg

SEQ ID NO: 155292 - DNA, 103 bp, Artificial Sequence
  Synthetic Polynucleotide
taatacgactcactatagggaggcaacgttctcctacccattcctgttggaacagaggagaccaacaatgatgggtaggaacctggcggcagcgcaaaagatg

SEQ ID NO: 155293 - DNA, 103 bp, Artificial Sequence
  Synthetic Polynucleotide
taatacgactcactatagggcagagacttaaggcaacgttctcctacccaaacagaggagatgggtaatggaacgttgcaacctggcggcagcgcaaaagatg

SEQ ID NO: 155294 - DNA, 103 bp, Artificial Sequence
  Synthetic Polynucleotide
taatacgactcactatagggtgtcctcacacagagacttaaggcaacgttaacagaggagaaacgttatgttaagtctcaacctggcggcagcgcaaaagatg

SEQ ID NO: 155295 - DNA, 103 bp, Artificial Sequence
  Synthetic Polynucleotide
taatacgactcactatagggctgaaaatggggacctttttggctagttgcaacagaggagagcaactatgcaaaaaggtaacctggcggcagcgcaaaagatg

SEQ ID NO: 155296 - DNA, 103 bp, Artificial Sequence
  Synthetic Polynucleotide
taatacgactcactatagggaggtcattgctgtcctcacacagagacttaaacagaggagataagtcatggtgtgaggaaacctggcggcagcgcaaaagatg

SEQ ID NO: 155297 - DNA, 103 bp, Artificial Sequence
  Synthetic Polynucleotide
taatacgactcactatagggtgggtcttgcaggtcattgctgtcctcacaaacagaggagatgtgagatgagcaatgacaacctggcggcagcgcaaaagatg

SEQ ID NO: 155298 - DNA, 103 bp, Artificial Sequence
  Synthetic Polynucleotide
taatacgactcactatagggtactcaacactgggtcttgcaggtcattgcaacagaggagagcaatgatgtgcaagaccaacctggcggcagcgcaaaagatg

SEQ ID NO: 155299 - DNA, 103 bp, Artificial Sequence
  Synthetic Polynucleotide
taatacgactcactataggggcctgggcactactcaacactgggtcttgcaacagaggagagcaagaatgagtgttgagaacctggcggcagcgcaaaagatg

SEQ ID NO: 155300 - DNA, 103 bp, Artificial Sequence
  Synthetic Polynucleotide
taatacgactcactataggggaggcgctgcgcctgggcactactcaacacaacagaggagagtgttgatgagtgcccagaacctggcggcagcgcaaaagatg

SEQ ID NO: 155301 - DNA, 103 bp, Artificial Sequence
  Synthetic Polynucleotide
taatacgactcactatagggtgagctgcatgaggcgctgcgcctgggcacaacagaggagagtgcccatgcgcagcgccaacctggcggcagcgcaaaagatg

SEQ ID NO: 155302 - DNA, 103 bp, Artificial Sequence
  Synthetic Polynucleotide
taatacgactcactatagggggatagcaaatgagctgcatgaggcgctgcaacagaggagagcagcgatgcatgcagctaacctggcggcagcgcaaaagatg

SEQ ID NO: 155303 - DNA, 103 bp, Artificial Sequence
  Synthetic Polynucleotide
taatacgactcactatagggcagtcgatgtggatagcaaatgagctgcataacagaggagaatgcagatgatttgctataacctggcggcagcgcaaaagatg

SEQ ID NO: 155304 - DNA, 103 bp, Artificial Sequence
  Synthetic Polynucleotide
taatacgactcactatagggcattgtccagcagtcgatgtggatagcaaaaacagaggagatttgctatgcacatcgacaacctggcggcagcgcaaaagatg

SEQ ID NO: 155305 - DNA, 103 bp, Artificial Sequence
  Synthetic Polynucleotide
taatacgactcactatagggtccccatcctcattgtccagcagtcgatgtaacagaggagaacatcgatggctggacaaaacctggcggcagcgcaaaagatg

SEQ ID NO: 155306 - DNA, 103 bp, Artificial Sequence
  Synthetic Polynucleotide
taatacgactcactatagggccccagccgcggccgcttcaggggccggtgaacagaggagacaccggatgctgaagcggaacctggcggcagcgcaaaagatg

SEQ ID NO: 155307 - DNA, 103 bp, Artificial Sequence
  Synthetic Polynucleotide
taatacgactcactatagggttccttcttactgaaaatggggacctttttaacagaggagaaaaaagatgcccattttcaacctggcggcagcgcaaaagatg

SEQ ID NO: 155308 - DNA, 103 bp, Artificial Sequence
  Synthetic Polynucleotide
taatacgactcactatagggctgggggttttccccatcctcattgtccagaacagaggagactggacatggaggatgggaacctggcggcagcgcaaaagatg

SEQ ID NO: 155309 - DNA, 103 bp, Artificial Sequence
  Synthetic Polynucleotide
taatacgactcactatagggtgcgctgccgctgggggttttccccatcctaacagaggagaaggatgatgaaaacccccaacctggcggcagcgcaaaagatg

SEQ ID NO: 155310 - DNA, 103 bp, Artificial Sequence
  Synthetic Polynucleotide
taatacgactcactatagggatgcgctttatgcgctgccgctgggggtttaacagaggagaaaacccatggcggcagcgaacctggcggcagcgcaaaagatg

SEQ ID NO: 155311 - DNA, 103 bp, Artificial Sequence
  Synthetic Polynucleotide
taatacgactcactataggggttctggagaatgcgctttatgcgctgccgaacagaggagacggcagatgataaagcgcaacctggcggcagcgcaaaagatg

SEQ ID NO: 155312 - DNA, 103 bp, Artificial Sequence
  Synthetic Polynucleotide
taatacgactcactatagggactggtccaagttctggagaatgcgctttaaacagaggagataaagcatgttctccagaaacctggcggcagcgcaaaagatg

SEQ ID NO: 155313 - DNA, 103 bp, Artificial Sequence
  Synthetic Polynucleotide
taatacgactcactatagggcgcatggtccactggtccaagttctggagaaacagaggagatctccaatgcttggaccaaacctggcggcagcgcaaaagatg

SEQ ID NO: 155314 - DNA, 103 bp, Artificial Sequence
  Synthetic Polynucleotide
taatacgactcactatagggggaagactggcgcatggtccactggtccaaaacagaggagattggacatgtggaccatgaacctggcggcagcgcaaaagatg

SEQ ID NO: 155315 - DNA, 103 bp, Artificial Sequence
  Synthetic Polynucleotide
taatacgactcactataggggcagctccaaggaagactggcgcatggtccaacagaggagaggaccaatggccagtcttaacctggcggcagcgcaaaagatg

SEQ ID NO: 155316 - DNA, 103 bp, Artificial Sequence
  Synthetic Polynucleotide
taatacgactcactatagggatcatgagctgcagctccaaggaagactggaacagaggagaccagtcatgcttggagctaacctggcggcagcgcaaaagatg

SEQ ID NO: 155317 - DNA, 103 bp, Artificial Sequence
  Synthetic Polynucleotide
taatacgactcactatagggggtctgcttgatcatgagctgcagctccaaaacagaggagattggagatgcagctcatgaacctggcggcagcgcaaaagatg

SEQ ID NO: 155318 - DNA, 103 bp, Artificial Sequence
  Synthetic Polynucleotide
taatacgactcactatagggcaaacacctcttccttcttactgaaaatggaacagaggagaccatttatggtaagaaggaacctggcggcagcgcaaaagatg

SEQ ID NO: 155319 - DNA, 103 bp, Artificial Sequence
  Synthetic Polynucleotide
taatacgactcactatagggcattgttaggggtctgcttgatcatgagctaacagaggagaagctcaatgtcaagcagaaacctggcggcagcgcaaaagatg

SEQ ID NO: 155320 - DNA, 103 bp, Artificial Sequence
  Synthetic Polynucleotide
taatacgactcactataggggagttcatctcattgttaggggtctgcttgaacagaggagacaagcaatgccctaacaaaacctggcggcagcgcaaaagatg

SEQ ID NO: 155321 - DNA, 103 bp, Artificial Sequence
  Synthetic Polynucleotide
taatacgactcactatagggctccaagagggagttcatctcattgttaggaacagaggagacctaacatggagatgaacaacctggcggcagcgcaaaagatg

SEQ ID NO: 155322 - DNA, 103 bp, Artificial Sequence
  Synthetic Polynucleotide
taatacgactcactatagggtggcgatgttctccaagagggagttcatctaacagaggagaagatgaatgccctcttggaacctggcggcagcgcaaaagatg

SEQ ID NO: 155323 - DNA, 103 bp, Artificial Sequence
  Synthetic Polynucleotide
taatacgactcactatagggattgtggccttggcgatgttctccaagaggaacagaggagacctcttatggaacatcgcaacctggcggcagcgcaaaagatg

SEQ ID NO: 155324 - DNA, 103 bp, Artificial Sequence
  Synthetic Polynucleotide
taatacgactcactataggggaaaacctcgattgtggccttggcgatgttaacagaggagaaacatcatgaaggccacaaacctggcggcagcgcaaaagatg

SEQ ID NO: 155325 - DNA, 103 bp, Artificial Sequence
  Synthetic Polynucleotide
taatacgactcactatagggctgactgttggaaaacctcgattgtggcctaacagaggagaaggccaatgtcgaggtttaacctggcggcagcgcaaaagatg

SEQ ID NO: 155326 - DNA, 103 bp, Artificial Sequence
  Synthetic Polynucleotide
taatacgactcactatagggcctgtctctgctgactgttggaaaacctcgaacagaggagacgaggtatgccaacagtcaacctggcggcagcgcaaaagatg

SEQ ID NO: 155327 - DNA, 103 bp, Artificial Sequence
  Synthetic Polynucleotide
taatacgactcactatagggagaagatgaccctgtctctgctgactgttgaacagaggagacaacagatggcagagacaaacctggcggcagcgcaaaagatg

SEQ ID NO: 155328 - DNA, 103 bp, Artificial Sequence
  Synthetic Polynucleotide
taatacgactcactatagggcagtacttccagaagatgaccctgtctctgaacagaggagacagagaatgggtcatcttaacctggcggcagcgcaaaagatg

SEQ ID NO: 155329 - DNA, 103 bp, Artificial Sequence
  Synthetic Polynucleotide
taatacgactcactataggggctaagtacccaaacacctcttccttcttaaacagaggagataagaaatgagaggtgttaacctggcggcagcgcaaaagatg

SEQ ID NO: 155330 - DNA, 103 bp, Artificial Sequence
  Synthetic Polynucleotide
taatacgactcactatagggatgttgcttgcagtacttccagaagatgacaacagaggagagtcatcatgtggaagtacaacctggcggcagcgcaaaagatg

SEQ ID NO: 155331 - DNA, 103 bp, Artificial Sequence
  Synthetic Polynucleotide
taatacgactcactataggggctgctgggcatgttgcttgcagtacttccaacagaggagaggaagtatggcaagcaacaacctggcggcagcgcaaaagatg

SEQ ID NO: 155332 - DNA, 103 bp, Artificial Sequence
  Synthetic Polynucleotide
taatacgactcactatagggtggtcttgctgctgctgggcatgttgcttgaacagaggagacaagcaatgtgcccagcaaacctggcggcagcgcaaaagatg

SEQ ID NO: 155333 - DNA, 103 bp, Artificial Sequence
  Synthetic Polynucleotide
taatacgactcactatagggagcacaggcttggtcttgctgctgctgggcaacagaggagagcccagatgcagcaagacaacctggcggcagcgcaaaagatg

SEQ ID NO: 155334 - DNA, 103 bp, Artificial Sequence
  Synthetic Polynucleotide
taatacgactcactatagggtagagagctgagcacaggcttggtcttgctaacagaggagaagcaagatgaagcctgtgaacctggcggcagcgcaaaagatg

SEQ ID NO: 155335 - DNA, 103 bp, Artificial Sequence
  Synthetic Polynucleotide
taatacgactcactatagggcagagcgctctagagagctgagcacaggctaacagaggagaagcctgatgtcagctctcaacctggcggcagcgcaaaagatg

SEQ ID NO: 155336 - DNA, 103 bp, Artificial Sequence
  Synthetic Polynucleotide
taatacgactcactatagggagccatacaccagagcgctctagagagctgaacagaggagacagctcatgagagcgctcaacctggcggcagcgcaaaagatg

SEQ ID NO: 155337 - DNA, 103 bp, Artificial Sequence
  Synthetic Polynucleotide
taatacgactcactataggggggggccaccagccatacaccagagcgctcaacagaggagagagcgcatgggtgtatggaacctggcggcagcgcaaaagatg

SEQ ID NO: 155338 - DNA, 103 bp, Artificial Sequence
  Synthetic Polynucleotide
taatacgactcactatagggtagcaatgaggggggccaccagccatacacaacagaggagagtgtatatgtggtggcccaacctggcggcagcgcaaaagatg

SEQ ID NO: 155339 - DNA, 103 bp, Artificial Sequence
  Synthetic Polynucleotide
taatacgactcactataggggtgggcagtttagcaatgaggggggccaccaacagaggagaggtggcatgcctcattgcaacctggcggcagcgcaaaagatg

SEQ ID NO: 155340 - DNA, 103 bp, Artificial Sequence
  Synthetic Polynucleotide
taatacgactcactatagggtgtgtatttggctaagtacccaaacacctcaacagaggagagaggtgatggggtacttaaacctggcggcagcgcaaaagatg

SEQ ID NO: 155341 - DNA, 103 bp, Artificial Sequence
  Synthetic Polynucleotide
taatacgactcactatagggctggactgaggtgggcagtttagcaatgagaacagaggagactcattatgaaactgcccaacctggcggcagcgcaaaagatg

SEQ ID NO: 155342 - DNA, 103 bp, Artificial Sequence
  Synthetic Polynucleotide
taatacgactcactatagggacacatgtccctggactgaggtgggcagttaacagaggagaaactgcatgcctcagtccaacctggcggcagcgcaaaagatg

SEQ ID NO: 155343 - DNA, 103 bp, Artificial Sequence
  Synthetic Polynucleotide
taatacgactcactataggggcagcctttaacacatgtccctggactgagaacagaggagactcagtatggggacatgtaacctggcggcagcgcaaaagatg

SEQ ID NO: 155344 - DNA, 103 bp, Artificial Sequence
  Synthetic Polynucleotide
taatacgactcactatagggttcttccccagcagcctttaacacatgtccaacagaggagaggacatatgttaaaggctaacctggcggcagcgcaaaagatg

SEQ ID NO: 155345 - DNA, 103 bp, Artificial Sequence
  Synthetic Polynucleotide
taatacgactcactatagggccttctccaattcttccccagcagcctttaaacagaggagataaaggatgctggggaagaacctggcggcagcgcaaaagatg

SEQ ID NO: 155346 - DNA, 103 bp, Artificial Sequence
  Synthetic Polynucleotide
taatacgactcactatagggaggtgctgacccttctccaattcttccccaaacagaggagatggggaatgattggagaaaacctggcggcagcgcaaaagatg

SEQ ID NO: 155347 - DNA, 103 bp, Artificial Sequence
  Synthetic Polynucleotide
taatacgactcactatagggagaggaacccaggtgctgacccttctccaaaacagaggagattggagatgggtcagcacaacctggcggcagcgcaaaagatg

SEQ ID NO: 155348 - DNA, 103 bp, Artificial Sequence
  Synthetic Polynucleotide
taatacgactcactatagggctttgcgtgaagaggaacccaggtgctgacaacagaggagagtcagcatgtgggttcctaacctggcggcagcgcaaaagatg

SEQ ID NO: 155349 - DNA, 103 bp, Artificial Sequence
  Synthetic Polynucleotide
taatacgactcactatagggcgatcacgttctttgcgtgaagaggaacccaacagaggagagggttcatgttcacgcaaaacctggcggcagcgcaaaagatg

SEQ ID NO: 155350 - DNA, 103 bp, Artificial Sequence
  Synthetic Polynucleotide
taatacgactcactatagggctgcttttgtcgatcacgttctttgcgtgaaacagaggagatcacgcatggaacgtgataacctggcggcagcgcaaaagatg

SEQ ID NO: 155351 - DNA, 103 bp, Artificial Sequence
  Synthetic Polynucleotide
taatacgactcactatagggtcacaggcactgtgtatttggctaagtaccaacagaggagaggtactatgccaaatacaaacctggcggcagcgcaaaagatg

SEQ ID NO: 155352 - DNA, 103 bp, Artificial Sequence
  Synthetic Polynucleotide
taatacgactcactatagggacatgctcttctgcttttgtcgatcacgttaacagaggagaaacgtgatggacaaaagcaacctggcggcagcgcaaaagatg

SEQ ID NO: 155353 - DNA, 103 bp, Artificial Sequence
  Synthetic Polynucleotide
taatacgactcactatagggctcaatagggacatgctcttctgcttttgtaacagaggagaacaaaaatggaagagcataacctggcggcagcgcaaaagatg

SEQ ID NO: 155354 - DNA, 103 bp, Artificial Sequence
  Synthetic Polynucleotide
taatacgactcactataggggggctgctggctcaatagggacatgctcttaacagaggagaaagagcatgtccctattgaacctggcggcagcgcaaaagatg

SEQ ID NO: 155355 - DNA, 103 bp, Artificial Sequence
  Synthetic Polynucleotide
taatacgactcactataggggcgataagaagggctgctggctcaatagggaacagaggagaccctatatggccagcagcaacctggcggcagcgcaaaagatg

SEQ ID NO: 155356 - DNA, 103 bp, Artificial Sequence
  Synthetic Polynucleotide
taatacgactcactataggggttagcaccagcgataagaagggctgctggaacagaggagaccagcaatgcttcttatcaacctggcggcagcgcaaaagatg

SEQ ID NO: 155357 - DNA, 103 bp, Artificial Sequence
  Synthetic Polynucleotide
taatacgactcactatagggtttcagacatgttagcaccagcgataagaaaacagaggagattcttaatgctggtgctaaacctggcggcagcgcaaaagatg

SEQ ID NO: 155358 - DNA, 103 bp, Artificial Sequence
  Synthetic Polynucleotide
taatacgactcactatagggcatcctgccctttcagacatgttagcaccaaacagaggagatggtgcatgcatgtctgaaacctggcggcagcgcaaaagatg

SEQ ID NO: 155359 - DNA, 103 bp, Artificial Sequence
  Synthetic Polynucleotide
taatacgactcactatagggtcgcgttgttcatcctgccctttcagacataacagaggagaatgtctatgagggcaggaaacctggcggcagcgcaaaagatg

SEQ ID NO: 155360 - DNA, 103 bp, Artificial Sequence
  Synthetic Polynucleotide
taatacgactcactatagggaaggagtccctcgcgttgttcatcctgcccaacagaggagagggcagatggaacaacgcaacctggcggcagcgcaaaagatg

SEQ ID NO: 155361 - DNA, 103 bp, Artificial Sequence
  Synthetic Polynucleotide
taatacgactcactatagggagagggaggtaaggagtccctcgcgttgttaacagaggagaaacaacatgagggactccaacctggcggcagcgcaaaagatg

SEQ ID NO: 155362 - DNA, 103 bp, Artificial Sequence
  Synthetic Polynucleotide
taatacgactcactataggggcagcccgcatcacaggcactgtgtatttgaacagaggagacaaataatgagtgcctgtaacctggcggcagcgcaaaagatg

SEQ ID NO: 155363 - DNA, 103 bp, Artificial Sequence
  Synthetic Polynucleotide
taatacgactcactatagggacctggctgtagagggaggtaaggagtcccaacagaggagagggactatgtacctccctaacctggcggcagcgcaaaagatg

SEQ ID NO: 155364 - DNA, 103 bp, Artificial Sequence
  Synthetic Polynucleotide
taatacgactcactatagggaatctggtgcacctggctgtagagggaggtaacagaggagaacctccatgtacagccagaacctggcggcagcgcaaaagatg

SEQ ID NO: 155365 - DNA, 103 bp, Artificial Sequence
  Synthetic Polynucleotide
taatacgactcactatagggaattattcacaatctggtgcacctggctgtaacagaggagaacagccatgtgcaccagaaacctggcggcagcgcaaaagatg

SEQ ID NO: 155366 - DNA, 103 bp, Artificial Sequence
  Synthetic Polynucleotide
taatacgactcactatagggtcatctcgccaattattcacaatctggtgcaacagaggagagcaccaatgtgtgaataaaacctggcggcagcgcaaaagatg

SEQ ID NO: 155367 - DNA, 103 bp, Artificial Sequence
  Synthetic Polynucleotide
taatacgactcactatagggtaagtactggtcatctcgccaattattcacaacagaggagagtgaatatgtggcgagataacctggcggcagcgcaaaagatg

SEQ ID NO: 155368 - DNA, 103 bp, Artificial Sequence
  Synthetic Polynucleotide
taatacgactcactatagggtgcaatcatctaagtactggtcatctcgccaacagaggagaggcgagatgaccagtactaacctggcggcagcgcaaaagatg

SEQ ID NO: 155369 - DNA, 103 bp, Artificial Sequence
  Synthetic Polynucleotide
taatacgactcactatagggtgctttggtttgcaatcatctaagtactggaacagaggagaccagtaatgagatgattgaacctggcggcagcgcaaaagatg

SEQ ID NO: 155370 - DNA, 103 bp, Artificial Sequence
  Synthetic Polynucleotide
taatacgactcactatagggatgcataagctgctttggtttgcaatcatcaacagaggagagatgatatgaaaccaaagaacctggcggcagcgcaaaagatg

SEQ ID NO: 155371 - DNA, 103 bp, Artificial Sequence
  Synthetic Polynucleotide
taatacgactcactatagggtgagtgcctcatgcataagctgctttggttaacagaggagaaaccaaatgagcttatgcaacctggcggcagcgcaaaagatg

SEQ ID NO: 155372 - DNA, 103 bp, Artificial Sequence
  Synthetic Polynucleotide
taatacgactcactatagggagccgcagtttgagtgcctcatgcataagcaacagaggagagcttatatgtgaggcactaacctggcggcagcgcaaaagatg

SEQ ID NO: 155373 - DNA, 103 bp, Artificial Sequence
  Synthetic Polynucleotide
taatacgactcactatagggaatgagccaggcagcccgcatcacaggcacaacagaggagagtgcctatgatgcgggctaacctggcggcagcgcaaaagatg

SEQ ID NO: 155374 - DNA, 103 bp, Artificial Sequence
  Synthetic Polynucleotide
taatacgactcactatagggcaccaggttgagccgcagtttgagtgcctcaacagaggagagaggcaatgaaactgcggaacctggcggcagcgcaaaagatg

SEQ ID NO: 155375 - DNA, 103 bp, Artificial Sequence
  Synthetic Polynucleotide
taatacgactcactatagggacatgccccccaccaggttgagccgcagttaacagaggagaaactgcatgtcaacctggaacctggcggcagcgcaaaagatg

SEQ ID NO: 155376 - DNA, 103 bp, Artificial Sequence
  Synthetic Polynucleotide
taatacgactcactatagggaccgtgtcaaacatgccccccaccaggttgaacagaggagacaacctatgggggggcataacctggcggcagcgcaaaagatg

SEQ ID NO: 155377 - DNA, 103 bp, Artificial Sequence
  Synthetic Polynucleotide
taatacgactcactataggggctgcgctgcaccgtgtcaaacatgcccccaacagaggagagggggcatgtttgacacgaacctggcggcagcgcaaaagatg

SEQ ID NO: 155378 - DNA, 103 bp, Artificial Sequence
  Synthetic Polynucleotide
taatacgactcactatagggtctgctgggtgctgcgctgcaccgtgtcaaaacagaggagattgacaatgtgcagcgcaaacctggcggcagcgcaaaagatg

SEQ ID NO: 155379 - DNA, 103 bp, Artificial Sequence
  Synthetic Polynucleotide
taatacgactcactatagggcactccgtggtctgctgggtgctgcgctgcaacagaggagagcagcgatgcacccagcaaacctggcggcagcgcaaaagatg

SEQ ID NO: 155380 - DNA, 103 bp, Artificial Sequence
  Synthetic Polynucleotide
taatacgactcactataggggagcatggcccactccgtggtctgctgggtaacagaggagaacccagatgaccacggagaacctggcggcagcgcaaaagatg

SEQ ID NO: 155381 - DNA, 103 bp, Artificial Sequence
  Synthetic Polynucleotide
taatacgactcactatagggtctccaggaggagcatggcccactccgtggaacagaggagaccacggatggggccatgcaacctggcggcagcgcaaaagatg

SEQ ID NO: 155382 - DNA, 103 bp, Artificial Sequence
  Synthetic Polynucleotide
taatacgactcactatagggctgatgatgatctccaggaggagcatggccaacagaggagaggccatatgcctcctggaaacctggcggcagcgcaaaagatg

SEQ ID NO: 155383 - DNA, 103 bp, Artificial Sequence
  Synthetic Polynucleotide
taatacgactcactataggggacagtgccgctgatgatgatctccaggagaacagaggagactcctgatgatcatcatcaacctggcggcagcgcaaaagatg

SEQ ID NO: 155384 - DNA, 103 bp, Artificial Sequence
  Synthetic Polynucleotide
taatacgactcactatagggaggtcatcttaatgagccaggcagcccgcaaacagaggagatgcgggatgcctggctcaaacctggcggcagcgcaaaagatg

SEQ ID NO: 155385 - DNA, 103 bp, Artificial Sequence
  Synthetic Polynucleotide
taatacgactcactatagggactgcatgtcgacagtgccgctgatgatgaaacagaggagatcatcaatggcggcactgaacctggcggcagcgcaaaagatg

SEQ ID NO: 155386 - DNA, 103 bp, Artificial Sequence
  Synthetic Polynucleotide
taatacgactcactatagggtcattgttggactgcatgtcgacagtgccgaacagaggagacggcacatgcgacatgcaaacctggcggcagcgcaaaagatg

SEQ ID NO: 155387 - DNA, 103 bp, Artificial Sequence
  Synthetic Polynucleotide
taatacgactcactatagggagtgaagagctcattgttggactgcatgtcaacagaggagagacatgatgtccaacaataacctggcggcagcgcaaaagatg

SEQ ID NO: 155388 - DNA, 103 bp, Artificial Sequence
  Synthetic Polynucleotide
taatacgactcactatagggccaacacagtagtgaagagctcattgttggaacagaggagaccaacaatgagctcttcaaacctggcggcagcgcaaaagatg

SEQ ID NO: 155389 - DNA, 103 bp, Artificial Sequence
  Synthetic Polynucleotide
taatacgactcactatagggctcagcatgtccaacacagtagtgaagagcaacagaggagagctcttatgtactgtgttaacctggcggcagcgcaaaagatg

SEQ ID NO: 155390 - DNA, 103 bp, Artificial Sequence
  Synthetic Polynucleotide
taatacgactcactataggggatgagcacgctcagcatgtccaacacagtaacagaggagaactgtgatggacatgctgaacctggcggcagcgcaaaagatg

SEQ ID NO: 155391 - DNA, 103 bp, Artificial Sequence
  Synthetic Polynucleotide
taatacgactcactatagggatgtcccattgatgagcacgctcagcatgtaacagaggagaacatgcatggcgtgctcaaacctggcggcagcgcaaaagatg

SEQ ID NO: 155392 - DNA, 103 bp, Artificial Sequence
  Synthetic Polynucleotide
taatacgactcactatagggtctgcagccaatgtcccattgatgagcacgaacagaggagacgtgctatgcaatgggacaacctggcggcagcgcaaaagatg

SEQ ID NO: 155393 - DNA, 103 bp, Artificial Sequence
  Synthetic Polynucleotide
taatacgactcactataggggctagacatgtctgcagccaatgtcccattaacagaggagaaatgggatgttggctgcaaacctggcggcagcgcaaaagatg

SEQ ID NO: 155394 - DNA, 103 bp, Artificial Sequence
  Synthetic Polynucleotide
taatacgactcactatagggcttgcgagatgctagacatgtctgcagccaaacagaggagatggctgatgacatgtctaaacctggcggcagcgcaaaagatg

SEQ ID NO: 155395 - DNA, 103 bp, Artificial Sequence
  Synthetic Polynucleotide
taatacgactcactatagggtagtaggcacaggtcatcttaatgagccagaacagaggagactggctatgtaagatgacaacctggcggcagcgcaaaagatg

SEQ ID NO: 155396 - DNA, 103 bp, Artificial Sequence
  Synthetic Polynucleotide
taatacgactcactatagggtccatgctaccttgcgagatgctagacatgaacagaggagacatgtcatgcatctcgcaaacctggcggcagcgcaaaagatg

SEQ ID NO: 155397 - DNA, 103 bp, Artificial Sequence
  Synthetic Polynucleotide
taatacgactcactatagggcttgttttcctccatgctaccttgcgagataacagaggagaatctcgatgggtagcatgaacctggcggcagcgcaaaagatg

SEQ ID NO: 155398 - DNA, 103 bp, Artificial Sequence
  Synthetic Polynucleotide
taatacgactcactatagggtgtatgcacgcttgttttcctccatgctacaacagaggagagtagcaatgaggaaaacaaacctggcggcagcgcaaaagatg

SEQ ID NO: 155399 - DNA, 103 bp, Artificial Sequence
  Synthetic Polynucleotide
taatacgactcactataggggccaggttcatgtatgcacgcttgttttccaacagaggagaggaaaaatggcgtgcataaacctggcggcagcgcaaaagatg

SEQ ID NO: 155400 - DNA, 103 bp, Artificial Sequence
  Synthetic Polynucleotide
taatacgactcactatagggcaacttcttcgccaggttcatgtatgcacgaacagaggagacgtgcaatgatgaacctgaacctggcggcagcgcaaaagatg

SEQ ID NO: 155401 - DNA, 103 bp, Artificial Sequence
  Synthetic Polynucleotide
taatacgactcactatagggactccttctgcaacttcttcgccaggttcaaacagaggagatgaaccatgcgaagaagtaacctggcggcagcgcaaaagatg

SEQ ID NO: 155402 - DNA, 103 bp, Artificial Sequence
  Synthetic Polynucleotide
taatacgactcactatagggcgctcccccaactccttctgcaacttcttcaacagaggagagaagaaatggcagaaggaaacctggcggcagcgcaaaagatg

SEQ ID NO: 155403 - DNA, 103 bp, Artificial Sequence
  Synthetic Polynucleotide
taatacgactcactataggggtctgactggcgctcccccaactccttctgaacagaggagacagaagatgttgggggagaacctggcggcagcgcaaaagatg

SEQ ID NO: 155404 - DNA, 103 bp, Artificial Sequence
  Synthetic Polynucleotide
taatacgactcactatagggtttccagactgtctgactggcgctcccccaaacagaggagatgggggatggccagtcagaacctggcggcagcgcaaaagatg

SEQ ID NO: 155405 - DNA, 103 bp, Artificial Sequence
  Synthetic Polynucleotide
taatacgactcactatagggtggcgaaccttttccagactgtctgactggaacagaggagaccagtcatgcagtctggaaacctggcggcagcgcaaaagatg

SEQ ID NO: 155406 - DNA, 103 bp, Artificial Sequence
  Synthetic Polynucleotide
taatacgactcactataggggattgctgcatagtaggcacaggtcatcttaacagaggagaaagatgatgtgtgcctacaacctggcggcagcgcaaaagatg

SEQ ID NO: 155407 - DNA, 103 bp, Artificial Sequence
  Synthetic Polynucleotide
taatacgactcactatagggtggcagcagctggcgaaccttttccagactaacagaggagaagtctgatgaaggttcgcaacctggcggcagcgcaaaagatg

SEQ ID NO: 155408 - DNA, 103 bp, Artificial Sequence
  Synthetic Polynucleotide
taatacgactcactataggggcttgggcagtggcagcagctggcgaacctaacagaggagaaggttcatgagctgctgcaacctggcggcagcgcaaaagatg

SEQ ID NO: 155409 - DNA, 103 bp, Artificial Sequence
  Synthetic Polynucleotide
taatacgactcactatagggtctcgggtctgcttgggcagtggcagcagcaacagaggagagctgctatgactgcccaaaacctggcggcagcgcaaaagatg

SEQ ID NO: 155410 - DNA, 103 bp, Artificial Sequence
  Synthetic Polynucleotide
taatacgactcactatagggcgtgatgacatctcgggtctgcttgggcagaacagaggagactgcccatgcagacccgaaacctggcggcagcgcaaaagatg

SEQ ID NO: 155411 - DNA, 103 bp, Artificial Sequence
  Synthetic Polynucleotide
taatacgactcactataggggtggctcacacgtgatgacatctcgggtctaacagaggagaagacccatgatgtcatcaaacctggcggcagcgcaaaagatg

SEQ ID NO: 155412 - DNA, 103 bp, Artificial Sequence
  Synthetic Polynucleotide
taatacgactcactatagggagggagccctgtggctcacacgtgatgacaaacagaggagatgtcatatggtgtgagccaacctggcggcagcgcaaaagatg

SEQ ID NO: 155413 - DNA, 103 bp, Artificial Sequence
  Synthetic Polynucleotide
taatacgactcactatagggggtatcgataagggagccctgtggctcacaaacagaggagatgtgagatgcagggctccaacctggcggcagcgcaaaagatg

SEQ ID NO: 155414 - DNA, 103 bp, Artificial Sequence
  Synthetic Polynucleotide
taatacgactcactatagggtgttgcccttggtatcgataagggagccctaacagaggagaagggctatgttatcgataaacctggcggcagcgcaaaagatg

SEQ ID NO: 155415 - DNA, 103 bp, Artificial Sequence
  Synthetic Polynucleotide
taatacgactcactatagggccagcaatcttgttgcccttggtatcgataaacagaggagatatcgaatgcaagggcaaaacctggcggcagcgcaaaagatg

SEQ ID NO: 155416 - DNA, 103 bp, Artificial Sequence
  Synthetic Polynucleotide
taatacgactcactatagggggaatcgaagccagcaatcttgttgcccttaacagaggagaaagggcatgaagattgctaacctggcggcagcgcaaaagatg

SEQ ID NO: 155417 - DNA, 103 bp, Artificial Sequence
  Synthetic Polynucleotide
taatacgactcactatagggcatcgggaggccccagccgcggccgcttcaaacagaggagatgaagcatgcgcggctggaacctggcggcagcgcaaaagatg

SEQ ID NO: 155418 - DNA, 103 bp, Artificial Sequence
  Synthetic Polynucleotide
taatacgactcactatagggtggtctcagagattgctgcatagtaggcacaacagaggagagtgcctatgatgcagcaaaacctggcggcagcgcaaaagatg

SEQ ID NO: 155419 - DNA, 103 bp, Artificial Sequence
  Synthetic Polynucleotide
taatacgactcactatagggtcttgaagatggaatcgaagccagcaatctaacagaggagaagattgatggcttcgattaacctggcggcagcgcaaaagatg

SEQ ID NO: 155420 - DNA, 103 bp, Artificial Sequence
  Synthetic Polynucleotide
taatacgactcactatagggagaccctccttcttgaagatggaatcgaagaacagaggagacttcgaatgcatcttcaaaacctggcggcagcgcaaaagatg

SEQ ID NO: 155421 - DNA, 103 bp, Artificial Sequence
  Synthetic Polynucleotide
taatacgactcactatagggggaaacctgtagaccctccttcttgaagataacagaggagaatcttcatgaaggagggtaacctggcggcagcgcaaaagatg

SEQ ID NO: 155422 - DNA, 103 bp, Artificial Sequence
  Synthetic Polynucleotide
taatacgactcactatagggtctgtttggtggaaacctgtagaccctcctaacagaggagaaggaggatgtacaggtttaacctggcggcagcgcaaaagatg

SEQ ID NO: 155423 - DNA, 103 bp, Artificial Sequence
  Synthetic Polynucleotide
taatacgactcactatagggggcgagatcttctgtttggtggaaacctgtaacagaggagaacaggtatgcaccaaacaaacctggcggcagcgcaaaagatg

SEQ ID NO: 155424 - DNA, 103 bp, Artificial Sequence
  Synthetic Polynucleotide
taatacgactcactatagggaagatcccagggcgagatcttctgtttggtaacagaggagaaccaaaatgaagatctcgaacctggcggcagcgcaaaagatg

SEQ ID NO: 155425 - DNA, 103 bp, Artificial Sequence
  Synthetic Polynucleotide
taatacgactcactatagggacccctcaaaaagatcccagggcgagatctaacagaggagaagatctatgcctgggatcaacctggcggcagcgcaaaagatg

SEQ ID NO: 155426 - DNA, 103 bp, Artificial Sequence
  Synthetic Polynucleotide
taatacgactcactataggggacggcttcaacccctcaaaaagatcccagaacagaggagactgggaatgttttgagggaacctggcggcagcgcaaaagatg

SEQ ID NO: 155427 - DNA, 103 bp, Artificial Sequence
  Synthetic Polynucleotide
taatacgactcactataggggagtggtgctgacggcttcaacccctcaaaaacagaggagatttgagatgttgaagccgaacctggcggcagcgcaaaagatg

SEQ ID NO: 155428 - DNA, 103 bp, Artificial Sequence
  Synthetic Polynucleotide
taatacgactcactatagggagccccaagagagtggtgctgacggcttcaaacagaggagatgaagcatgcagcaccacaacctggcggcagcgcaaaagatg

SEQ ID NO: 155429 - DNA, 103 bp, Artificial Sequence
  Synthetic Polynucleotide
taatacgactcactatagggttcttaaccttggtctcagagattgctgcaaacagaggagatgcagcatgctctgagacaacctggcggcagcgcaaaagatg

SEQ ID NO: 155430 - DNA, 103 bp, Artificial Sequence
  Synthetic Polynucleotide
taatacgactcactataggggttccaaaccagccccaagagagtggtgctaacagaggagaagcaccatgctcttggggaacctggcggcagcgcaaaagatg

SEQ ID NO: 155431 - DNA, 103 bp, Artificial Sequence
  Synthetic Polynucleotide
taatacgactcactatagggcactcggactgttccaaaccagccccaagaaacagaggagatcttggatgtggtttggaaacctggcggcagcgcaaaagatg

SEQ ID NO: 155432 - DNA, 103 bp, Artificial Sequence
  Synthetic Polynucleotide
taatacgactcactatagggctcgccggtccactcggactgttccaaaccaacagaggagaggtttgatgcagtccgagaacctggcggcagcgcaaaagatg

SEQ ID NO: 155433 - DNA, 103 bp, Artificial Sequence
  Synthetic Polynucleotide
taatacgactcactatagggcctcgagccactcgccggtccactcggactaacagaggagaagtccgatgggaccggcgaacctggcggcagcgcaaaagatg

SEQ ID NO: 155434 - DNA, 103 bp, Artificial Sequence
  Synthetic Polynucleotide
taatacgactcactatagggctgctcctctcctcgagccactcgccggtcaacagaggagagaccggatggtggctcgaaacctggcggcagcgcaaaagatg

SEQ ID NO: 155435 - DNA, 103 bp, Artificial Sequence
  Synthetic Polynucleotide
taatacgactcactataggggcaaccgctgctgctcctctcctcgagccaaacagaggagatggctcatggagaggagcaacctggcggcagcgcaaaagatg

SEQ ID NO: 155436 - DNA, 103 bp, Artificial Sequence
  Synthetic Polynucleotide
taatacgactcactatagggtggtagagcagcaaccgctgctgctcctctaacagaggagaagaggaatggcagcggttaacctggcggcagcgcaaaagatg

SEQ ID NO: 155437 - DNA, 103 bp, Artificial Sequence
  Synthetic Polynucleotide
taatacgactcactatagggcaggtgtgtgtggtagagcagcaaccgctgaacagaggagacagcggatgctgctctacaacctggcggcagcgcaaaagatg

SEQ ID NO: 155438 - DNA, 103 bp, Artificial Sequence
  Synthetic Polynucleotide
taatacgactcactataggggccggggcctcaggtgtgtgtggtagagcaaacagaggagatgctctatgacacacaccaacctggcggcagcgcaaaagatg

SEQ ID NO: 155439 - DNA, 103 bp, Artificial Sequence
  Synthetic Polynucleotide
taatacgactcactatagggtaggcgcggggccggggcctcaggtgtgtgaacagaggagacacacaatggaggccccgaacctggcggcagcgcaaaagatg

SEQ ID NO: 155440 - DNA, 103 bp, Artificial Sequence
  Synthetic Polynucleotide
taatacgactcactatagggaacatgtctcttcttaaccttggtctcagaaacagaggagatctgagatgaaggttaagaacctggcggcagcgcaaaagatg

SEQ ID NO: 155441 - DNA, 103 bp, Artificial Sequence
  Synthetic Polynucleotide
taatacgactcactatagggctccaggtaataggcgcggggccggggcctaacagaggagaaggcccatgccccgcgccaacctggcggcagcgcaaaagatg

SEQ ID NO: 155442 - DNA, 103 bp, Artificial Sequence
  Synthetic Polynucleotide
taatacgactcactataggggtggcagtggctccaggtaataggcgcgggaacagaggagacccgcgatgattacctggaacctggcggcagcgcaaaagatg

SEQ ID NO: 155443 - DNA, 103 bp, Artificial Sequence
  Synthetic Polynucleotide
taatacgactcactatagggtctgggggcagtggcagtggctccaggtaaaacagaggagattacctatggccactgccaacctggcggcagcgcaaaagatg

SEQ ID NO: 155444 - DNA, 103 bp, Artificial Sequence
  Synthetic Polynucleotide
taatacgactcactatagggctcctcatcttctgggggcagtggcagtggaacagaggagaccactgatgctgcccccaaacctggcggcagcgcaaaagatg

SEQ ID NO: 155445 - DNA, 103 bp, Artificial Sequence
  Synthetic Polynucleotide
taatacgactcactataggggagcaggcggctcctcatcttctgggggcaaacagaggagatgccccatgaagatgaggaacctggcggcagcgcaaaagatg

SEQ ID NO: 155446 - DNA, 103 bp, Artificial Sequence
  Synthetic Polynucleotide
taatacgactcactatagggagcagggtaggagcaggcggctcctcatctaacagaggagaagatgaatggccgcctgcaacctggcggcagcgcaaaagatg

SEQ ID NO: 155447 - DNA, 103 bp, Artificial Sequence
  Synthetic Polynucleotide
taatacgactcactatagggctcaggctctagcagggtaggagcaggcggaacagaggagaccgcctatgcctaccctgaacctggcggcagcgcaaaagatg

SEQ ID NO: 155448 - DNA, 103 bp, Artificial Sequence
  Synthetic Polynucleotide
taatacgactcactataggggagcctttttctcaggctctagcagggtagaacagaggagactacccatgtagagcctgaacctggcggcagcgcaaaagatg

SEQ ID NO: 155449 - DNA, 103 bp, Artificial Sequence
  Synthetic Polynucleotide
taatacgactcactataggggggggctctggagcctttttctcaggctctaacagaggagaagagccatggaaaaaggcaacctggcggcagcgcaaaagatg

SEQ ID NO: 155450 - DNA, 103 bp, Artificial Sequence
  Synthetic Polynucleotide
taatacgactcactataggggtcagttttggggggctctggagcctttttaacagaggagaaaaaagatgccagagcccaacctggcggcagcgcaaaagatg

SEQ ID NO: 155451 - DNA, 103 bp, Artificial Sequence
  Synthetic Polynucleotide
taatacgactcactatagggtgaaagggtcaacatgtctcttcttaacctaacagaggagaaggttaatgagagacatgaacctggcggcagcgcaaaagatg

SEQ ID NO: 155452 - DNA, 103 bp, Artificial Sequence
  Synthetic Polynucleotide
taatacgactcactatagggcccccggtttgtcagttttggggggctctgaacagaggagacagagcatgccaaaactgaacctggcggcagcgcaaaagatg

SEQ ID NO: 155453 - DNA, 103 bp, Artificial Sequence
  Synthetic Polynucleotide
taatacgactcactatagggggtggagcagcccccggtttgtcagttttgaacagaggagacaaaacatgcaaaccgggaacctggcggcagcgcaaaagatg

SEQ ID NO: 155454 - DNA, 103 bp, Artificial Sequence
  Synthetic Polynucleotide
taatacgactcactatagggctcagtactgggtggagcagcccccggtttaacagaggagaaaaccgatggctgctccaaacctggcggcagcgcaaaagatg

SEQ ID NO: 155455 - DNA, 103 bp, Artificial Sequence
  Synthetic Polynucleotide
taatacgactcactatagggtcttgcgttcctcagtactgggtggagcagaacagaggagactgctcatgccagtactgaacctggcggcagcgcaaaagatg

SEQ ID NO: 155456 - DNA, 103 bp, Artificial Sequence
  Synthetic Polynucleotide
taatacgactcactataggggtggacttcttcttgcgttcctcagtactgaacagaggagacagtacatgggaacgcaaaacctggcggcagcgcaaaagatg

SEQ ID NO: 155457 - DNA, 103 bp, Artificial Sequence
  Synthetic Polynucleotide
taatacgactcactatagggcttgcccttggtggacttcttcttgcgttcaacagaggagagaacgcatgaagaagtccaacctggcggcagcgcaaaagatg

SEQ ID NO: 155458 - DNA, 103 bp, Artificial Sequence
  Synthetic Polynucleotide
taatacgactcactatagggggctgcgtttcttgcccttggtggacttctaacagaggagaagaagtatgccaagggcaaacctggcggcagcgcaaaagatg

SEQ ID NO: 155459 - DNA, 103 bp, Artificial Sequence
  Synthetic Polynucleotide
taatacgactcactataggggtagctggctggctgcgtttcttgcccttgaacagaggagacaagggatggaaacgcagaacctggcggcagcgcaaaagatg

SEQ ID NO: 155460 - DNA, 103 bp, Artificial Sequence
  Synthetic Polynucleotide
taatacgactcactatagggctctgtcttggtagctggctggctgcgtttaacagaggagaaaacgcatgcagccagctaacctggcggcagcgcaaaagatg

SEQ ID NO: 155461 - DNA, 103 bp, Artificial Sequence
  Synthetic Polynucleotide
taatacgactcactatagggttccatagtcctctgtcttggtagctggctaacagaggagaagccagatgccaagacagaacctggcggcagcgcaaaagatg

SEQ ID NO: 155462 - DNA, 103 bp, Artificial Sequence
  Synthetic Polynucleotide
taatacgactcactataggggtccattccatgaaagggtcaacatgtctcaacagaggagagagacaatgtgaccctttaacctggcggcagcgcaaaagatg

SEQ ID NO: 155463 - DNA, 103 bp, Artificial Sequence
  Synthetic Polynucleotide
taatacgactcactatagggcccgggcccattccatagtcctctgtcttgaacagaggagacaagacatgggactatggaacctggcggcagcgcaaaagatg

SEQ ID NO: 155464 - DNA, 103 bp, Artificial Sequence
  Synthetic Polynucleotide
taatacgactcactataggggccgctccgacccgggcccattccatagtcaacagaggagagactatatgatgggcccgaacctggcggcagcgcaaaagatg

SEQ ID NO: 155465 - DNA, 103 bp, Artificial Sequence
  Synthetic Polynucleotide
taatacgactcactatagggcaccataagggccgctccgacccgggcccaaacagaggagatgggccatggtcggagcgaacctggcggcagcgcaaaagatg

SEQ ID NO: 155466 - DNA, 103 bp, Artificial Sequence
  Synthetic Polynucleotide
taatacgactcactatagggggcactgtcacaccataagggccgctccgaaacagaggagatcggagatgcccttatggaacctggcggcagcgcaaaagatg

SEQ ID NO: 155467 - DNA, 103 bp, Artificial Sequence
  Synthetic Polynucleotide
taatacgactcactataggggaggtccggaggcactgtcacaccataaggaacagaggagaccttatatggtgacagtgaacctggcggcagcgcaaaagatg

SEQ ID NO: 155468 - DNA, 103 bp, Artificial Sequence
  Synthetic Polynucleotide
taatacgactcactatagggggtggtgcaggaggtccggaggcactgtcaaacagaggagatgacagatgctccggaccaacctggcggcagcgcaaaagatg

SEQ ID NO: 155469 - DNA, 103 bp, Artificial Sequence
  Synthetic Polynucleotide
taatacgactcactatagggccagggtttgggtggtgcaggaggtccggaaacagaggagatccggaatgcctgcaccaaacctggcggcagcgcaaaagatg

SEQ ID NO: 155470 - DNA, 103 bp, Artificial Sequence
  Synthetic Polynucleotide
taatacgactcactatagggtgttatagaaccagggtttgggtggtgcagaacagaggagactgcacatgccaaaccctaacctggcggcagcgcaaaagatg

SEQ ID NO: 155471 - DNA, 103 bp, Artificial Sequence
  Synthetic Polynucleotide
taatacgactcactatagggagttaaggtgtgttatagaaccagggtttgaacagaggagacaaaccatggttctataaaacctggcggcagcgcaaaagatg

SEQ ID NO: 155472 - DNA, 103 bp, Artificial Sequence
  Synthetic Polynucleotide
taatacgactcactatagggccttgcctgtagttaaggtgtgttatagaaaacagaggagattctatatgacaccttaaaacctggcggcagcgcaaaagatg

SEQ ID NO: 155473 - DNA, 103 bp, Artificial Sequence
  Synthetic Polynucleotide
taatacgactcactataggggatgatctgagtccattccatgaaagggtcaacagaggagagaccctatgatggaatggaacctggcggcagcgcaaaagatg

SEQ ID NO: 155474 - DNA, 103 bp, Artificial Sequence
  Synthetic Polynucleotide
taatacgactcactataggggcctatggagccttgcctgtagttaaggtgaacagaggagacaccttatgtacaggcaaaacctggcggcagcgcaaaagatg

SEQ ID NO: 155475 - DNA, 103 bp, Artificial Sequence
  Synthetic Polynucleotide
taatacgactcactataggggggtgtacaggcctatggagccttgcctgtaacagaggagaacaggcatggctccatagaacctggcggcagcgcaaaagatg

SEQ ID NO: 155476 - DNA, 103 bp, Artificial Sequence
  Synthetic Polynucleotide
taatacgactcactatagggggctggttctgggtgtacaggcctatggagaacagaggagactccatatgcctgtacacaacctggcggcagcgcaaaagatg

SEQ ID NO: 155477 - DNA, 103 bp, Artificial Sequence
  Synthetic Polynucleotide
taatacgactcactatagggtgcaggtagtggctggttctgggtgtacagaacagaggagactgtacatgcagaaccagaacctggcggcagcgcaaaagatg

SEQ ID NO: 155478 - DNA, 103 bp, Artificial Sequence
  Synthetic Polynucleotide
taatacgactcactataggggagggccacctgcaggtagtggctggttctaacagaggagaagaaccatgcactacctgaacctggcggcagcgcaaaagatg

SEQ ID NO: 155479 - DNA, 103 bp, Artificial Sequence
  Synthetic Polynucleotide
taatacgactcactataggggggtccacacgagggccacctgcaggtagtaacagaggagaactaccatgaggtggcccaacctggcggcagcgcaaaagatg

SEQ ID NO: 155480 - DNA, 103 bp, Artificial Sequence
  Synthetic Polynucleotide
taatacgactcactatagggaggacggtatgggtccacacgagggccaccaacagaggagaggtggcatgcgtgtggacaacctggcggcagcgcaaaagatg

SEQ ID NO: 155481 - DNA, 103 bp, Artificial Sequence
  Synthetic Polynucleotide
taatacgactcactataggggtaagcgcacaggacggtatgggtccacacaacagaggagagtgtggatgcataccgtcaacctggcggcagcgcaaaagatg

SEQ ID NO: 155482 - DNA, 103 bp, Artificial Sequence
  Synthetic Polynucleotide
taatacgactcactatagggttctgcattggtaagcgcacaggacggtataacagaggagaataccgatgtgtgcgcttaacctggcggcagcgcaaaagatg

SEQ ID NO: 155483 - DNA, 103 bp, Artificial Sequence
  Synthetic Polynucleotide
taatacgactcactatagggggtgggcagcttctgcattggtaagcgcacaacagaggagagtgcgcatgccaatgcagaacctggcggcagcgcaaaagatg

SEQ ID NO: 155484 - DNA, 103 bp, Artificial Sequence
  Synthetic Polynucleotide
taatacgactcactatagggagtacttggtgatgatctgagtccattccaaacagaggagatggaatatgctcagatcaaacctggcggcagcgcaaaagatg

SEQ ID NO: 155485 - DNA, 103 bp, Artificial Sequence
  Synthetic Polynucleotide
taatacgactcactatagggaagttggtcgggtgggcagcttctgcattgaacagaggagacaatgcatgagctgcccaaacctggcggcagcgcaaaagatg

SEQ ID NO: 155486 - DNA, 103 bp, Artificial Sequence
  Synthetic Polynucleotide
taatacgactcactatagggactccagggtaagttggtcgggtgggcagcaacagaggagagctgccatgccgaccaacaacctggcggcagcgcaaaagatg

SEQ ID NO: 155487 - DNA, 103 bp, Artificial Sequence
  Synthetic Polynucleotide
taatacgactcactatagggtgtgggcagcactccagggtaagttggtcgaacagaggagacgaccaatgtaccctggaaacctggcggcagcgcaaaagatg

SEQ ID NO: 155488 - DNA, 103 bp, Artificial Sequence
  Synthetic Polynucleotide
taatacgactcactatagggcagtcatggttgtgggcagcactccagggtaacagaggagaaccctgatgtgctgcccaaacctggcggcagcgcaaaagatg

SEQ ID NO: 155489 - DNA, 103 bp, Artificial Sequence
  Synthetic Polynucleotide
taatacgactcactatagggcccatgacgccagtcatggttgtgggcagcaacagaggagagctgccatgaaccatgacaacctggcggcagcgcaaaagatg

SEQ ID NO: 155490 - DNA, 103 bp, Artificial Sequence
  Synthetic Polynucleotide
taatacgactcactataggggggttctaaacccatgacgccagtcatggtaacagaggagaaccatgatgggcgtcatgaacctggcggcagcgcaaaagatg

SEQ ID NO: 155491 - DNA, 103 bp, Artificial Sequence
  Synthetic Polynucleotide
taatacgactcactatagggtataagaggagggttctaaacccatgacgcaacagaggagagcgtcaatggtttagaacaacctggcggcagcgcaaaagatg

SEQ ID NO: 155492 - DNA, 103 bp, Artificial Sequence
  Synthetic Polynucleotide
taatacgactcactatagggacagaggtcttataagaggagggttctaaaaacagaggagatttagaatgctcctcttaaacctggcggcagcgcaaaagatg

SEQ ID NO: 155493 - DNA, 103 bp, Artificial Sequence
  Synthetic Polynucleotide
taatacgactcactatagggctgccggtacacagaggtcttataagaggaaacagaggagatcctctatgaagacctctaacctggcggcagcgcaaaagatg

SEQ ID NO: 155494 - DNA, 103 bp, Artificial Sequence
  Synthetic Polynucleotide
taatacgactcactatagggcaggttgctgctgccggtacacagaggtctaacagaggagaagacctatgtgtaccggcaacctggcggcagcgcaaaagatg

SEQ ID NO: 155495 - DNA, 103 bp, Artificial Sequence
  Synthetic Polynucleotide
taatacgactcactatagggtgctcccataagtacttggtgatgatctgaaacagaggagatcagatatgcaccaagtaaacctggcggcagcgcaaaagatg

SEQ ID NO: 155496 - DNA, 103 bp, Artificial Sequence
  Synthetic Polynucleotide
taatacgactcactatagggtggggcaccgcaggttgctgctgccggtacaacagaggagagtaccgatggcagcaaccaacctggcggcagcgcaaaagatg

SEQ ID NO: 155497 - DNA, 103 bp, Artificial Sequence
  Synthetic Polynucleotide
taatacgactcactataggggcgctgtccttggggcaccgcaggttgctgaacagaggagacagcaaatggcggtgcccaacctggcggcagcgcaaaagatg

SEQ ID NO: 155498 - DNA, 103 bp, Artificial Sequence
  Synthetic Polynucleotide
taatacgactcactataggggttggcgaaggcgctgtccttggggcaccgaacagaggagacggtgcatgaaggacagcaacctggcggcagcgcaaaagatg

SEQ ID NO: 155499 - DNA, 103 bp, Artificial Sequence
  Synthetic Polynucleotide
taatacgactcactatagggtgctggagctgttggcgaaggcgctgtcctaacagaggagaaggacaatgccttcgccaaacctggcggcagcgcaaaagatg

SEQ ID NO: 155500 - DNA, 103 bp, Artificial Sequence
  Synthetic Polynucleotide
taatacgactcactataggggccctgactctgctggagctgttggcgaagaacagaggagacttcgcatgcagctccagaacctggcggcagcgcaaaagatg

SEQ ID NO: 155501 - DNA, 103 bp, Artificial Sequence
  Synthetic Polynucleotide
taatacgactcactataggggtcccaacatgccctgactctgctggagctaacagaggagaagctccatgagagtcaggaacctggcggcagcgcaaaagatg

SEQ ID NO: 155502 - DNA, 103 bp, Artificial Sequence
  Synthetic Polynucleotide
taatacgactcactatagggacagatgactgtcccaacatgccctgactcaacagaggagagagtcaatgcatgttgggaacctggcggcagcgcaaaagatg

SEQ ID NO: 155503 - DNA, 103 bp, Artificial Sequence
  Synthetic Polynucleotide
taatacgactcactatagggcatctgatggacagatgactgtcccaacataacagaggagaatgttgatgcagtcatctaacctggcggcagcgcaaaagatg

SEQ ID NO: 155504 - DNA, 103 bp, Artificial Sequence
  Synthetic Polynucleotide
taatacgactcactatagggagctgggagtcatctgatggacagatgactaacagaggagaagtcatatgtccatcagaaacctggcggcagcgcaaaagatg

SEQ ID NO: 155505 - DNA, 103 bp, Artificial Sequence
  Synthetic Polynucleotide
taatacgactcactatagggccgtaggaagagctgggagtcatctgatggaacagaggagaccatcaatggactcccagaacctggcggcagcgcaaaagatg

SEQ ID NO: 155506 - DNA, 103 bp, Artificial Sequence
  Synthetic Polynucleotide
taatacgactcactatagggcttctgtaactgctcccataagtacttggtaacagaggagaaccaagatgttatgggagaacctggcggcagcgcaaaagatg

SEQ ID NO: 155507 - DNA, 103 bp, Artificial Sequence
  Synthetic Polynucleotide
taatacgactcactatagggagtctgcaaaccgtaggaagagctgggagtaacagaggagaactcccatgtcttcctacaacctggcggcagcgcaaaagatg

SEQ ID NO: 155508 - DNA, 103 bp, Artificial Sequence
  Synthetic Polynucleotide
taatacgactcactatagggagccctgggaagtctgcaaaccgtaggaagaacagaggagacttcctatggtttgcagaaacctggcggcagcgcaaaagatg

SEQ ID NO: 155509 - DNA, 103 bp, Artificial Sequence
  Synthetic Polynucleotide
taatacgactcactatagggtaaggagtatagccctgggaagtctgcaaaaacagaggagatttgcaatgttcccagggaacctggcggcagcgcaaaagatg

SEQ ID NO: 155510 - DNA, 103 bp, Artificial Sequence
  Synthetic Polynucleotide
taatacgactcactatagggatgagaaacataaggagtatagccctgggaaacagaggagatcccagatgtatactcctaacctggcggcagcgcaaaagatg

SEQ ID NO: 155511 - DNA, 103 bp, Artificial Sequence
  Synthetic Polynucleotide
taatacgactcactataggggcaatcccacatgagaaacataaggagtataacagaggagaatactcatgatgtttctcaacctggcggcagcgcaaaagatg

SEQ ID NO: 155512 - DNA, 103 bp, Artificial Sequence
  Synthetic Polynucleotide
taatacgactcactataggggtgtgttgctgcaatcccacatgagaaacaaacagaggagatgtttcatgtgtgggattaacctggcggcagcgcaaaagatg

SEQ ID NO: 155513 - DNA, 103 bp, Artificial Sequence
  Synthetic Polynucleotide
taatacgactcactatagggtgcagggcctgtgtgttgctgcaatcccacaacagaggagagtgggaatgcagcaacacaacctggcggcagcgcaaaagatg

SEQ ID NO: 155514 - DNA, 103 bp, Artificial Sequence
  Synthetic Polynucleotide
taatacgactcactatagggccatggtacctgcagggcctgtgtgttgctaacagaggagaagcaacatgcaggccctgaacctggcggcagcgcaaaagatg

SEQ ID NO: 155515 - DNA, 103 bp, Artificial Sequence
  Synthetic Polynucleotide
taatacgactcactatagggctggggggcaccatggtacctgcagggcctaacagaggagaaggcccatgaggtaccataacctggcggcagcgcaaaagatg

SEQ ID NO: 155516 - DNA, 103 bp, Artificial Sequence
  Synthetic Polynucleotide
taatacgactcactataggggctggagtagctggggggcaccatggtaccaacagaggagaggtaccatggtgccccccaacctggcggcagcgcaaaagatg

SEQ ID NO: 155517 - DNA, 103 bp, Artificial Sequence
  Synthetic Polynucleotide
taatacgactcactatagggattcagccatcttctgtaactgctcccataaacagaggagatatgggatgagttacagaaacctggcggcagcgcaaaagatg

SEQ ID NO: 155518 - DNA, 103 bp, Artificial Sequence
  Synthetic Polynucleotide
taatacgactcactatagggggtaaggctggctggagtagctggggggcaaacagaggagatgccccatggctactccaaacctggcggcagcgcaaaagatg

SEQ ID NO: 155519 - DNA, 103 bp, Artificial Sequence
  Synthetic Polynucleotide
taatacgactcactatagggtgggtgctctggtaaggctggctggagtagaacagaggagactactcatgccagccttaaacctggcggcagcgcaaaagatg

SEQ ID NO: 155520 - DNA, 103 bp, Artificial Sequence
  Synthetic Polynucleotide
taatacgactcactatagggggtagaagggtgggtgctctggtaaggctgaacagaggagacagcctatgcagagcaccaacctggcggcagcgcaaaagatg

SEQ ID NO: 155521 - DNA, 103 bp, Artificial Sequence
  Synthetic Polynucleotide
taatacgactcactataggggagtaggattggtagaagggtgggtgctctaacagaggagaagagcaatgacccttctaaacctggcggcagcgcaaaagatg

SEQ ID NO: 155522 - DNA, 103 bp, Artificial Sequence
  Synthetic Polynucleotide
taatacgactcactatagggggatctacaagagtaggattggtagaagggaacagaggagacccttcatgcaatcctacaacctggcggcagcgcaaaagatg

SEQ ID NO: 155523 - DNA, 103 bp, Artificial Sequence
  Synthetic Polynucleotide
taatacgactcactataggggtggcgggtaggatctacaagagtaggattaacagaggagaaatcctatgcttgtagataacctggcggcagcgcaaaagatg

SEQ ID NO: 155524 - DNA, 103 bp, Artificial Sequence
  Synthetic Polynucleotide
taatacgactcactataggggctgttgcaggtggcgggtaggatctacaaaacagaggagattgtagatgctacccgccaacctggcggcagcgcaaaagatg

SEQ ID NO: 155525 - DNA, 103 bp, Artificial Sequence
  Synthetic Polynucleotide
taatacgactcactatagggccactgggccgctgttgcaggtggcgggtaaacagaggagatacccgatgcctgcaacaaacctggcggcagcgcaaaagatg

SEQ ID NO: 155526 - DNA, 103 bp, Artificial Sequence
  Synthetic Polynucleotide
taatacgactcactataggggtgcacatagccactgggccgctgttgcagaacagaggagactgcaaatgcggcccagtaacctggcggcagcgcaaaagatg

SEQ ID NO: 155527 - DNA, 103 bp, Artificial Sequence
  Synthetic Polynucleotide
taatacgactcactataggggggcctgctggtgcacatagccactgggccaacagaggagaggcccaatggctatgtgcaacctggcggcagcgcaaaagatg

SEQ ID NO: 155528 - DNA, 103 bp, Artificial Sequence
  Synthetic Polynucleotide
taatacgactcactatagggtgagggtaaacatcgggaggccccagccgcaacagaggagagcggctatggcctcccgaaacctggcggcagcgcaaaagatg

SEQ ID NO: 155529 - DNA, 103 bp, Artificial Sequence
  Synthetic Polynucleotide
taatacgactcactatagggggccggtagtattcagccatcttctgtaacaacagaggagagttacaatggatggctgaaacctggcggcagcgcaaaagatg

SEQ ID NO: 155530 - DNA, 103 bp, Artificial Sequence
  Synthetic Polynucleotide
taatacgactcactatagggccataggtgggggcctgctggtgcacatagaacagaggagactatgtatgccagcaggcaacctggcggcagcgcaaaagatg

SEQ ID NO: 155531 - DNA, 103 bp, Artificial Sequence
  Synthetic Polynucleotide
taatacgactcactatagggcagtccatgtccataggtgggggcctgctgaacagaggagacagcagatgcccacctataacctggcggcagcgcaaaagatg

SEQ ID NO: 155532 - DNA, 103 bp, Artificial Sequence
  Synthetic Polynucleotide
taatacgactcactataggggagtggaggtcagtccatgtccataggtggaacagaggagaccacctatggacatggacaacctggcggcagcgcaaaagatg

SEQ ID NO: 155533 - DNA, 103 bp, Artificial Sequence
  Synthetic Polynucleotide
taatacgactcactataggggaaaacctttgagtggaggtcagtccatgtaacagaggagaacatggatggacctccacaacctggcggcagcgcaaaagatg

SEQ ID NO: 155534 - DNA, 103 bp, Artificial Sequence
  Synthetic Polynucleotide
taatacgactcactatagggtgtctggtgtgaaaacctttgagtggaggtaacagaggagaacctccatgcaaaggtttaacctggcggcagcgcaaaagatg

SEQ ID NO: 155535 - DNA, 103 bp, Artificial Sequence
  Synthetic Polynucleotide
taatacgactcactatagggtctgctgcagtgtctggtgtgaaaacctttaacagaggagaaaaggtatgcacaccagaaacctggcggcagcgcaaaagatg

SEQ ID NO: 155536 - DNA, 103 bp, Artificial Sequence
  Synthetic Polynucleotide
taatacgactcactatagggatcatgggtgtctgctgcagtgtctggtgtaacagaggagaacaccaatgactgcagcaaacctggcggcagcgcaaaagatg

SEQ ID NO: 155537 - DNA, 103 bp, Artificial Sequence
  Synthetic Polynucleotide
taatacgactcactatagggcatggtacttatcatgggtgtctgctgcagaacagaggagactgcagatgacacccatgaacctggcggcagcgcaaaagatg

SEQ ID NO: 155538 - DNA, 103 bp, Artificial Sequence
  Synthetic Polynucleotide
taatacgactcactatagggtcattggagtcatggtacttatcatgggtgaacagaggagacacccaatgtaagtaccaaacctggcggcagcgcaaaagatg

SEQ ID NO: 155539 - DNA, 103 bp, Artificial Sequence
  Synthetic Polynucleotide
taatacgactcactatagggccctgggcactcattggagtcatggtacttaacagaggagaaagtacatggactccaataacctggcggcagcgcaaaagatg

SEQ ID NO: 155540 - DNA, 103 bp, Artificial Sequence
  Synthetic Polynucleotide
taatacgactcactatagggtgcaggccctggccggtagtattcagccataacagaggagaatggctatgtactaccggaacctggcggcagcgcaaaagatg

SEQ ID NO: 155541 - DNA, 103 bp, Artificial Sequence
  Synthetic Polynucleotide
taatacgactcactatagggtgcctggacgccctgggcactcattggagtaacagaggagaactccaatgagtgcccagaacctggcggcagcgcaaaagatg

SEQ ID NO: 155542 - DNA, 103 bp, Artificial Sequence
  Synthetic Polynucleotide
taatacgactcactatagggaacggacgcctgcctggacgccctgggcacaacagaggagagtgcccatggcgtccaggaacctggcggcagcgcaaaagatg

SEQ ID NO: 155543 - DNA, 103 bp, Artificial Sequence
  Synthetic Polynucleotide
taatacgactcactatagggatggctgttgaacggacgcctgcctggacgaacagaggagacgtccaatgaggcgtccgaacctggcggcagcgcaaaagatg

SEQ ID NO: 155544 - DNA, 103 bp, Artificial Sequence
  Synthetic Polynucleotide
taatacgactcactatagggctcaggtaggatggctgttgaacggacgccaacagaggagaggcgtcatgtcaacagccaacctggcggcagcgcaaaagatg

SEQ ID NO: 155545 - DNA, 103 bp, Artificial Sequence
  Synthetic Polynucleotide
taatacgactcactataggggctgctgctgctcaggtaggatggctgttgaacagaggagacaacagatgtcctacctgaacctggcggcagcgcaaaagatg

SEQ ID NO: 155546 - DNA, 103 bp, Artificial Sequence
  Synthetic Polynucleotide
taatacgactcactatagggtgttgctgctgctgctgctgctcaggtaggaacagaggagacctaccatggcagcagcaaacctggcggcagcgcaaaagatg

SEQ ID NO: 155547 - DNA, 103 bp, Artificial Sequence
  Synthetic Polynucleotide
taatacgactcactatagggctgttgctgctgttgctgctgctgctgctgaacagaggagacagcagatgcagcagcaaaacctggcggcagcgcaaaagatg

SEQ ID NO: 155548 - DNA, 103 bp, Artificial Sequence
  Synthetic Polynucleotide
taatacgactcactataggggctgctgttgctgttgctgctgttgctgctaacagaggagaagcagcatgagcagcaacaacctggcggcagcgcaaaagatg

SEQ ID NO: 155549 - DNA, 103 bp, Artificial Sequence
  Synthetic Polynucleotide
taatacgactcactatagggtgctgctgctgctgctgttgctgttgctgcaacagaggagagcagcaatggcaacagcaaacctggcggcagcgcaaaagatg

SEQ ID NO: 155550 - DNA, 103 bp, Artificial Sequence
  Synthetic Polynucleotide
taatacgactcactatagggctgttgctgttgctgctgctgctgctgttgaacagaggagacaacagatgcagcagcagaacctggcggcagcgcaaaagatg

SEQ ID NO: 155551 - DNA, 103 bp, Artificial Sequence
  Synthetic Polynucleotide
taatacgactcactatagggccccacttcctgcaggccctggccggtagtaacagaggagaactaccatgcagggcctgaacctggcggcagcgcaaaagatg

SEQ ID NO: 155552 - DNA, 103 bp, Artificial Sequence
  Synthetic Polynucleotide
taatacgactcactataggggctgctgctgctgttgctgttgctgctgctaacagaggagaagcagcatgaacagcaacaacctggcggcagcgcaaaagatg

SEQ ID NO: 155553 - DNA, 103 bp, Artificial Sequence
  Synthetic Polynucleotide
taatacgactcactatagggtactgctgctgctgctgctgctgttgctgtaacagaggagaacagcaatggcagcagcaaacctggcggcagcgcaaaagatg

SEQ ID NO: 155554 - DNA, 103 bp, Artificial Sequence
  Synthetic Polynucleotide
taatacgactcactatagggccggatgtggtactgctgctgctgctgctgaacagaggagacagcagatgcagcagcagaacctggcggcagcgcaaaagatg

SEQ ID NO: 155555 - DNA, 103 bp, Artificial Sequence
  Synthetic Polynucleotide
taatacgactcactataggggctgctgctgccggatgtggtactgctgctaacagaggagaagcagcatgaccacatccaacctggcggcagcgcaaaagatg

SEQ ID NO: 155556 - DNA, 103 bp, Artificial Sequence
  Synthetic Polynucleotide
taatacgactcactatagggatctgctgctgctgctgctgccggatgtggaacagaggagaccacatatggcagcagcaaacctggcggcagcgcaaaagatg

SEQ ID NO: 155557 - DNA, 103 bp, Artificial Sequence
  Synthetic Polynucleotide
taatacgactcactatagggctgccgcaggatctgctgctgctgctgctgaacagaggagacagcagatgcagcagcagaacctggcggcagcgcaaaagatg

SEQ ID NO: 155558 - DNA, 103 bp, Artificial Sequence
  Synthetic Polynucleotide
taatacgactcactataggggttgctgctgctgccgcaggatctgctgctaacagaggagaagcagcatgtcctgcggcaacctggcggcagcgcaaaagatg

SEQ ID NO: 155559 - DNA, 103 bp, Artificial Sequence
  Synthetic Polynucleotide
taatacgactcactatagggtgctgttgctgttgctgctgctgccgcaggaacagaggagacctgcgatggcagcagcaaacctggcggcagcgcaaaagatg

SEQ ID NO: 155560 - DNA, 103 bp, Artificial Sequence
  Synthetic Polynucleotide
taatacgactcactatagggctgctgctgctgctgttgctgttgctgctgaacagaggagacagcagatgcagcaacagaacctggcggcagcgcaaaagatg

SEQ ID NO: 155561 - DNA, 103 bp, Artificial Sequence
  Synthetic Polynucleotide
taatacgactcactataggggttgctgctgctgctgctgctgctgttgctaacagaggagaagcaacatgagcagcagcaacctggcggcagcgcaaaagatg

SEQ ID NO: 155562 - DNA, 103 bp, Artificial Sequence
  Synthetic Polynucleotide
taatacgactcactataggggaaccacagcccccacttcctgcaggccctaacagaggagaagggccatgaggaagtggaacctggcggcagcgcaaaagatg

SEQ ID NO: 155563 - DNA, 103 bp, Artificial Sequence
  Synthetic Polynucleotide
taatacgactcactatagggtgctgttgctgttgctgctgctgctgctgcaacagaggagagcagcaatggcagcagcaaacctggcggcagcgcaaaagatg

SEQ ID NO: 155564 - DNA, 103 bp, Artificial Sequence
  Synthetic Polynucleotide
taatacgactcactatagggttgctgctgctgctgttgctgttgctgctgaacagaggagacagcagatgcagcaacagaacctggcggcagcgcaaaagatg

SEQ ID NO: 155565 - DNA, 103 bp, Artificial Sequence
  Synthetic Polynucleotide
taatacgactcactataggggttgttgctgttgctgctgctgctgttgctaacagaggagaagcaacatgagcagcagcaacctggcggcagcgcaaaagatg

SEQ ID NO: 155566 - DNA, 103 bp, Artificial Sequence
  Synthetic Polynucleotide
taatacgactcactatagggtggtgttgctgttgttgctgttgctgctgcaacagaggagagcagcaatgacagcaacaaacctggcggcagcgcaaaagatg

SEQ ID NO: 155567 - DNA, 103 bp, Artificial Sequence
  Synthetic Polynucleotide
taatacgactcactatagggctgttgctgctggtgttgctgttgttgctgaacagaggagacagcaaatgcagcaacacaacctggcggcagcgcaaaagatg

SEQ ID NO: 155568 - DNA, 103 bp, Artificial Sequence
  Synthetic Polynucleotide
taatacgactcactatagggcctgttgctgctgttgctgctggtgttgctaacagaggagaagcaacatgagcagcaacaacctggcggcagcgcaaaagatg

SEQ ID NO: 155569 - DNA, 103 bp, Artificial Sequence
  Synthetic Polynucleotide
taatacgactcactatagggggaggagccgcctgttgctgctgttgctgcaacagaggagagcagcaatggcagcaacaaacctggcggcagcgcaaaagatg

SEQ ID NO: 155570 - DNA, 103 bp, Artificial Sequence
  Synthetic Polynucleotide
taatacgactcactatagggctggggttggggaggagccgcctgttgctgaacagaggagacagcaaatggcggctcctaacctggcggcagcgcaaaagatg

SEQ ID NO: 155571 - DNA, 103 bp, Artificial Sequence
  Synthetic Polynucleotide
taatacgactcactataggggggactggggctggggttggggaggagccgaacagaggagacggctcatgcccaaccccaacctggcggcagcgcaaaagatg

SEQ ID NO: 155572 - DNA, 103 bp, Artificial Sequence
  Synthetic Polynucleotide
taatacgactcactatagggaactggggctgggactggggctggggttggaacagaggagaccaaccatggccccagtcaacctggcggcagcgcaaaagatg

SEQ ID NO: 155573 - DNA, 103 bp, Artificial Sequence
  Synthetic Polynucleotide
taatacgactcactatagggccctatcgtggaaccacagcccccacttccaacagaggagaggaagtatgggctgtggtaacctggcggcagcgcaaaagatg

SEQ ID NO: 155574 - DNA, 103 bp, Artificial Sequence
  Synthetic Polynucleotide
taatacgactcactatagggctggcgctggaactggggctgggactggggaacagaggagaccccagatgcagccccagaacctggcggcagcgcaaaagatg

SEQ ID NO: 155575 - DNA, 103 bp, Artificial Sequence
  Synthetic Polynucleotide
taatacgactcactataggggctgaagcccctggcgctggaactggggctaacagaggagaagccccatgtccagcgccaacctggcggcagcgcaaaagatg

SEQ ID NO: 155576 - DNA, 103 bp, Artificial Sequence
  Synthetic Polynucleotide
taatacgactcactatagggtgctgggtctgctgaagcccctggcgctggaacagaggagaccagcgatgggggcttcaaacctggcggcagcgcaaaagatg

SEQ ID NO: 155577 - DNA, 103 bp, Artificial Sequence
  Synthetic Polynucleotide
taatacgactcactatagggctgttgctgctgctgggtctgctgaagcccaacagaggagagggcttatgcagacccagaacctggcggcagcgcaaaagatg

SEQ ID NO: 155578 - DNA, 103 bp, Artificial Sequence
  Synthetic Polynucleotide
taatacgactcactatagggaagctgctgtctgttgctgctgctgggtctaacagaggagaagacccatgagcagcaacaacctggcggcagcgcaaaagatg

SEQ ID NO: 155579 - DNA, 103 bp, Artificial Sequence
  Synthetic Polynucleotide
taatacgactcactatagggtgccggaccaaagctgctgtctgttgctgcaacagaggagagcagcaatggacagcagcaacctggcggcagcgcaaaagatg

SEQ ID NO: 155580 - DNA, 103 bp, Artificial Sequence
  Synthetic Polynucleotide
taatacgactcactatagggttgttgaagttgccggaccaaagctgctgtaacagaggagaacagcaatgttggtccggaacctggcggcagcgcaaaagatg

SEQ ID NO: 155581 - DNA, 103 bp, Artificial Sequence
  Synthetic Polynucleotide
taatacgactcactatagggtagagagctgttgttgaagttgccggaccaaacagaggagatggtccatgaacttcaacaacctggcggcagcgcaaaagatg

SEQ ID NO: 155582 - DNA, 103 bp, Artificial Sequence
  Synthetic Polynucleotide
taatacgactcactatagggggctgggtattagagagctgttgttgaagtaacagaggagaacttcaatgacagctctcaacctggcggcagcgcaaaagatg

SEQ ID NO: 155583 - DNA, 103 bp, Artificial Sequence
  Synthetic Polynucleotide
taatacgactcactatagggactgggctgtggctgggtattagagagctgaacagaggagacagctcatgaatacccagaacctggcggcagcgcaaaagatg

SEQ ID NO: 155584 - DNA, 103 bp, Artificial Sequence
  Synthetic Polynucleotide
taatacgactcactatagggggggcaagggccctatcgtggaaccacagcaacagaggagagctgtgatgccacgatagaacctggcggcagcgcaaaagatg

SEQ ID NO: 155585 - DNA, 103 bp, Artificial Sequence
  Synthetic Polynucleotide
taatacgactcactatagggatatgttggtactgggctgtggctgggtataacagaggagaatacccatgcacagcccaaacctggcggcagcgcaaaagatg

SEQ ID NO: 155586 - DNA, 103 bp, Artificial Sequence
  Synthetic Polynucleotide
taatacgactcactatagggtagcgtccaaatatgttggtactgggctgtaacagaggagaacagccatgtaccaacataacctggcggcagcgcaaaagatg

SEQ ID NO: 155587 - DNA, 103 bp, Artificial Sequence
  Synthetic Polynucleotide
taatacgactcactatagggtctacatcatggggcaagggccctatcgtgaacagaggagacacgatatggcccttgccaacctggcggcagcgcaaaagatg

SEQ ID NO: 155588 - DNA, 103 bp, Artificial Sequence
  Synthetic Polynucleotide
taatacgactcactataggggattgccacctctacatcatggggcaagggaacagaggagacccttgatgcatgatgtaaacctggcggcagcgcaaaagatg

SEQ ID NO: 155589 - DNA, 103 bp, Artificial Sequence
  Synthetic Polynucleotide
taatacgactcactatagggcccactgccggattgccacctctacatcataacagaggagaatgatgatgaggtggcaaaacctggcggcagcgcaaaagatg

SEQ ID NO: 155590 - DNA, 103 bp, Artificial Sequence
  Synthetic Polynucleotide
taatacgactcactatagggtcggtgtaatcccactgccggattgccaccaacagaggagaggtggcatgccggcagtgaacctggcggcagcgcaaaagatg

SEQ ID NO: 155591 - DNA, 103 bp, Artificial Sequence
  Synthetic Polynucleotide
taatacgactcactatagggtttggggtcctgagggtaaacatcgggaggaacagaggagacctcccatggtttaccctaacctggcggcagcgcaaaagatg

SEQ ID NO: 155592 - DNA, 103 bp, Artificial Sequence
  Synthetic Polynucleotide
taatacgactcactatagggggccagcttctcggtgtaatcccactgccgaacagaggagacggcagatggattacaccaacctggcggcagcgcaaaagatg

SEQ ID NO: 155593 - DNA, 103 bp, Artificial Sequence
  Synthetic Polynucleotide
taatacgactcactatagggacatgaacatggccagcttctcggtgtaataacagaggagaattacaatgagaagctggaacctggcggcagcgcaaaagatg

SEQ ID NO: 155594 - DNA, 103 bp, Artificial Sequence
  Synthetic Polynucleotide
taatacgactcactatagggccatcctgaaacatgaacatggccagcttcaacagaggagagaagctatgcatgttcataacctggcggcagcgcaaaagatg

SEQ ID NO: 155595 - DNA, 103 bp, Artificial Sequence
  Synthetic Polynucleotide
taatacgactcactataggggtccagcattccatcctgaaacatgaacataacagaggagaatgttcatgtttcaggataacctggcggcagcgcaaaagatg

SEQ ID NO: 155596 - DNA, 103 bp, Artificial Sequence
  Synthetic Polynucleotide
taatacgactcactatagggactcatgtctgtccagcattccatcctgaaaacagaggagattcaggatggaatgctggaacctggcggcagcgcaaaagatg

SEQ ID NO: 155597 - DNA, 103 bp, Artificial Sequence
  Synthetic Polynucleotide
taatacgactcactatagggcaggtcaggaactcatgtctgtccagcattaacagaggagaaatgctatgcagacatgaaacctggcggcagcgcaaaagatg

SEQ ID NO: 155598 - DNA, 103 bp, Artificial Sequence
  Synthetic Polynucleotide
taatacgactcactatagggctcaagcacccaggtcaggaactcatgtctaacagaggagaagacatatgttcctgaccaacctggcggcagcgcaaaagatg

SEQ ID NO: 155599 - DNA, 103 bp, Artificial Sequence
  Synthetic Polynucleotide
taatacgactcactatagggtctcaaaacactcaagcacccaggtcaggaaacagaggagatcctgaatggggtgcttgaacctggcggcagcgcaaaagatg

SEQ ID NO: 155600 - DNA, 103 bp, Artificial Sequence
  Synthetic Polynucleotide
taatacgactcactataggggggcggatcttctcaaaacactcaagcaccaacagaggagaggtgctatggtgttttgaaacctggcggcagcgcaaaagatg

SEQ ID NO: 155601 - DNA, 103 bp, Artificial Sequence
  Synthetic Polynucleotide
taatacgactcactatagggatcctctccagggcggatcttctcaaaacaaacagaggagatgttttatgaagatccgcaacctggcggcagcgcaaaagatg

SEQ ID NO: 155602 - DNA, 103 bp, Artificial Sequence
  Synthetic Polynucleotide
taatacgactcactatagggcctccttctgtttggggtcctgagggtaaaaacagaggagatttaccatgaggaccccaaacctggcggcagcgcaaaagatg

SEQ ID NO: 155603 - DNA, 103 bp, Artificial Sequence
  Synthetic Polynucleotide
taatacgactcactatagggtaagcaattcatcctctccagggcggatctaacagaggagaagatccatgctggagaggaacctggcggcagcgcaaaagatg

SEQ ID NO: 155604 - DNA, 103 bp, Artificial Sequence
  Synthetic Polynucleotide
taatacgactcactatagggagcagcagtttaagcaattcatcctctccaaacagaggagatggagaatgtgaattgctaacctggcggcagcgcaaaagatg

SEQ ID NO: 155605 - DNA, 103 bp, Artificial Sequence
  Synthetic Polynucleotide
taatacgactcactatagggaagcagaggcagcagcagtttaagcaattcaacagaggagagaattgatgaaactgctgaacctggcggcagcgcaaaagatg

SEQ ID NO: 155606 - DNA, 103 bp, Artificial Sequence
  Synthetic Polynucleotide
taatacgactcactatagggagtatcggagaagcagaggcagcagcagttaacagaggagaaactgcatgtgcctctgcaacctggcggcagcgcaaaagatg

SEQ ID NO: 155607 - DNA, 103 bp, Artificial Sequence
  Synthetic Polynucleotide
taatacgactcactatagggaattccccagagtatcggagaagcagaggcaacagaggagagcctctatgtctccgataaacctggcggcagcgcaaaagatg

SEQ ID NO: 155608 - DNA, 103 bp, Artificial Sequence
  Synthetic Polynucleotide
taatacgactcactatagggagactgaacaaattccccagagtatcggagaacagaggagactccgaatgtctggggaaaacctggcggcagcgcaaaagatg

SEQ ID NO: 155609 - DNA, 103 bp, Artificial Sequence
  Synthetic Polynucleotide
taatacgactcactatagggacaggtatgcagactgaacaaattccccagaacagaggagactggggatgttgttcagtaacctggcggcagcgcaaaagatg

SEQ ID NO: 155610 - DNA, 103 bp, Artificial Sequence
  Synthetic Polynucleotide
taatacgactcactatagggagccggcgggacaggtatgcagactgaacaaacagaggagatgttcaatgtgcatacctaacctggcggcagcgcaaaagatg

SEQ ID NO: 155611 - DNA, 103 bp, Artificial Sequence
  Synthetic Polynucleotide
taatacgactcactataggggaagtaggcaagccggcgggacaggtatgcaacagaggagagcatacatgtcccgccggaacctggcggcagcgcaaaagatg

SEQ ID NO: 155612 - DNA, 103 bp, Artificial Sequence
  Synthetic Polynucleotide
taatacgactcactatagggtccgtgtacagaagtaggcaagccggcgggaacagaggagacccgccatgttgcctactaacctggcggcagcgcaaaagatg

SEQ ID NO: 155613 - DNA, 103 bp, Artificial Sequence
  Synthetic Polynucleotide
taatacgactcactataggggtcagttcatcctccttctgtttggggtccaacagaggagaggacccatgacagaaggaaacctggcggcagcgcaaaagatg

SEQ ID NO: 155614 - DNA, 103 bp, Artificial Sequence
  Synthetic Polynucleotide
taatacgactcactatagggagggccagtctccgtgtacagaagtaggcaaacagaggagatgcctaatgctgtacacgaacctggcggcagcgcaaaagatg

SEQ ID NO: 155615 - DNA, 103 bp, Artificial Sequence
  Synthetic Polynucleotide
taatacgactcactatagggatccagctgcagggccagtctccgtgtacaaacagaggagatgtacaatgagactggccaacctggcggcagcgcaaaagatg

SEQ ID NO: 155616 - DNA, 103 bp, Artificial Sequence
  Synthetic Polynucleotide
taatacgactcactatagggtgctcacaccatccagctgcagggccagtcaacagaggagagactggatgtgcagctggaacctggcggcagcgcaaaagatg

SEQ ID NO: 155617 - DNA, 103 bp, Artificial Sequence
  Synthetic Polynucleotide
taatacgactcactataggggatgagtgactgctcacaccatccagctgcaacagaggagagcagctatgtggtgtgagaacctggcggcagcgcaaaagatg

SEQ ID NO: 155618 - DNA, 103 bp, Artificial Sequence
  Synthetic Polynucleotide
taatacgactcactatagggtataacatgagatgagtgactgctcacaccaacagaggagaggtgtgatgagtcactcaaacctggcggcagcgcaaaagatg

SEQ ID NO: 155619 - DNA, 103 bp, Artificial Sequence
  Synthetic Polynucleotide
taatacgactcactatagggactgagcagatataacatgagatgagtgacaacagaggagagtcactatgctcatgttaaacctggcggcagcgcaaaagatg

SEQ ID NO: 155620 - DNA, 103 bp, Artificial Sequence
  Synthetic Polynucleotide
taatacgactcactataggggtgcttgttgactgagcagatataacatgaaacagaggagatcatgtatgatctgctcaaacctggcggcagcgcaaaagatg

SEQ ID NO: 155621 - DNA, 103 bp, Artificial Sequence
  Synthetic Polynucleotide
taatacgactcactatagggggtgggtagcgtgcttgttgactgagcagaaacagaggagatctgctatgtcaacaagcaacctggcggcagcgcaaaagatg

SEQ ID NO: 155622 - DNA, 103 bp, Artificial Sequence
  Synthetic Polynucleotide
taatacgactcactataggggagcaggggtggtgggtagcgtgcttgttgaacagaggagacaacaaatgcgctacccaaacctggcggcagcgcaaaagatg

SEQ ID NO: 155623 - DNA, 103 bp, Artificial Sequence
  Synthetic Polynucleotide
taatacgactcactataggggggggctgaggagcaggggtggtgggtagcaacagaggagagctaccatgcacccctgcaacctggcggcagcgcaaaagatg

SEQ ID NO: 155624 - DNA, 103 bp, Artificial Sequence
  Synthetic Polynucleotide
taatacgactcactatagggtgcctcaagctgcttctcctctctctgcataacagaggagaatgcagatggaggagaagaacctggcggcagcgcaaaagatg

SEQ ID NO: 155625 - DNA, 103 bp, Artificial Sequence
  Synthetic Polynucleotide
taatacgactcactatagggcagccggccatactcgttctccaacttgcaaacagaggagatgcaagatggagaacgagaacctggcggcagcgcaaaagatg

SEQ ID NO: 155626 - DNA, 103 bp, Artificial Sequence
  Synthetic Polynucleotide
taatacgactcactatagggatggccaggtcagccggccatactcgttctaacagaggagaagaacgatgatggccggcaacctggcggcagcgcaaaagatg

SEQ ID NO: 155627 - DNA, 103 bp, Artificial Sequence
  Synthetic Polynucleotide
taatacgactcactatagggtccaggacagatggccaggtcagccggccaaacagaggagatggccgatggacctggccaacctggcggcagcgcaaaagatg

SEQ ID NO: 155628 - DNA, 103 bp, Artificial Sequence
  Synthetic Polynucleotide
taatacgactcactatagggggcaaagctgtccaggacagatggccaggtaacagaggagaacctggatgtctgtcctgaacctggcggcagcgcaaaagatg

SEQ ID NO: 155629 - DNA, 103 bp, Artificial Sequence
  Synthetic Polynucleotide
taatacgactcactatagggcagaaagcaaggcaaagctgtccaggacagaacagaggagactgtccatgacagctttgaacctggcggcagcgcaaaagatg

SEQ ID NO: 155630 - DNA, 103 bp, Artificial Sequence
  Synthetic Polynucleotide
taatacgactcactatagggttcagctgtccagaaagcaaggcaaagctgaacagaggagacagcttatgcttgctttcaacctggcggcagcgcaaaagatg

SEQ ID NO: 155631 - DNA, 103 bp, Artificial Sequence
  Synthetic Polynucleotide
taatacgactcactataggggttcagagtgttcagctgtccagaaagcaaaacagaggagattgcttatgggacagctgaacctggcggcagcgcaaaagatg

SEQ ID NO: 155632 - DNA, 103 bp, Artificial Sequence
  Synthetic Polynucleotide
taatacgactcactatagggtcaagaccttgttcagagtgttcagctgtcaacagaggagagacagcatgacactctgaaacctggcggcagcgcaaaagatg

SEQ ID NO: 155633 - DNA, 103 bp, Artificial Sequence
  Synthetic Polynucleotide
taatacgactcactatagggttttcatgcttcaagaccttgttcagagtgaacagaggagacactctatgcaaggtcttaacctggcggcagcgcaaaagatg

SEQ ID NO: 155634 - DNA, 103 bp, Artificial Sequence
  Synthetic Polynucleotide
taatacgactcactatagggcagcggtgttttttcatgcttcaagaccttaacagaggagaaaggtcatgaagcatgaaaacctggcggcagcgcaaaagatg

SEQ ID NO: 155635 - DNA, 103 bp, Artificial Sequence
  Synthetic Polynucleotide
taatacgactcactatagggcatctaatgatgcctcaagctgcttctcctaacagaggagaaggagaatgagcttgaggaacctggcggcagcgcaaaagatg

SEQ ID NO: 155636 - DNA, 103 bp, Artificial Sequence
  Synthetic Polynucleotide
taatacgactcactatagggggttacggaacagcggtgttttttcatgctaacagaggagaagcatgatgaaacaccgcaacctggcggcagcgcaaaagatg

SEQ ID NO: 155637 - DNA, 103 bp, Artificial Sequence
  Synthetic Polynucleotide
taatacgactcactatagggatgatgacctggttacggaacagcggtgttaacagaggagaaacaccatggttccgtaaaacctggcggcagcgcaaaagatg

SEQ ID NO: 155638 - DNA, 103 bp, Artificial Sequence
  Synthetic Polynucleotide
taatacgactcactatagggcaccagaggaatgatgacctggttacggaaaacagaggagattccgtatgcaggtcatcaacctggcggcagcgcaaaagatg

SEQ ID NO: 155639 - DNA, 103 bp, Artificial Sequence
  Synthetic Polynucleotide
taatacgactcactatagggctggagacaacaccagaggaatgatgacctaacagaggagaaggtcaatgttcctctggaacctggcggcagcgcaaaagatg

SEQ ID NO: 155640 - DNA, 103 bp, Artificial Sequence
  Synthetic Polynucleotide
taatacgactcactatagggtcatctcggtctggagacaacaccagaggaaacagaggagatcctctatggttgtctccaacctggcggcagcgcaaaagatg

SEQ ID NO: 155641 - DNA, 103 bp, Artificial Sequence
  Synthetic Polynucleotide
taatacgactcactatagggcatgagatcttcatctcggtctggagacaaaacagaggagattgtctatggaccgagataacctggcggcagcgcaaaagatg

SEQ ID NO: 155642 - DNA, 103 bp, Artificial Sequence
  Synthetic Polynucleotide
taatacgactcactatagggcagtctgccgcatgagatcttcatctcggtaacagaggagaaccgagatgaagatctcaaacctggcggcagcgcaaaagatg

SEQ ID NO: 155643 - DNA, 103 bp, Artificial Sequence
  Synthetic Polynucleotide
taatacgactcactatagggacccgtccttcagtctgccgcatgagatctaacagaggagaagatctatggcggcagacaacctggcggcagcgcaaaagatg

SEQ ID NO: 155644 - DNA, 103 bp, Artificial Sequence
  Synthetic Polynucleotide
taatacgactcactataggggaaaacaggcacccgtccttcagtctgccgaacagaggagacggcagatggaaggacggaacctggcggcagcgcaaaagatg

SEQ ID NO: 155645 - DNA, 103 bp, Artificial Sequence
  Synthetic Polynucleotide
taatacgactcactatagggcctcatggctgaaaacaggcacccgtccttaacagaggagaaaggacatgtgcctgtttaacctggcggcagcgcaaaagatg

SEQ ID NO: 155646 - DNA, 103 bp, Artificial Sequence
  Synthetic Polynucleotide
taatacgactcactatagggctcagcagtgcatctaatgatgcctcaagcaacagaggagagcttgaatgatcattagaaacctggcggcagcgcaaaagatg

SEQ ID NO: 155647 - DNA, 103 bp, Artificial Sequence
  Synthetic Polynucleotide
taatacgactcactatagggtcagggactacctcatggctgaaaacaggcaacagaggagagcctgtatgcagccatgaaacctggcggcagcgcaaaagatg

SEQ ID NO: 155648 - DNA, 103 bp, Artificial Sequence
  Synthetic Polynucleotide
taatacgactcactatagggtctcagatggtcagggactacctcatggctaacagaggagaagccatatggtagtccctaacctggcggcagcgcaaaagatg

SEQ ID NO: 155649 - DNA, 103 bp, Artificial Sequence
  Synthetic Polynucleotide
taatacgactcactatagggcaggcttggttctcagatggtcagggactaaacagaggagatagtccatgaccatctgaaacctggcggcagcgcaaaagatg

SEQ ID NO: 155650 - DNA, 103 bp, Artificial Sequence
  Synthetic Polynucleotide
taatacgactcactatagggacttcagggtcaggcttggttctcagatggaacagaggagaccatctatgaaccaagccaacctggcggcagcgcaaaagatg

SEQ ID NO: 155651 - DNA, 103 bp, Artificial Sequence
  Synthetic Polynucleotide
taatacgactcactatagggctgttcttccacttcagggtcaggcttggtaacagaggagaaccaagatggaccctgaaaacctggcggcagcgcaaaagatg

SEQ ID NO: 155652 - DNA, 103 bp, Artificial Sequence
  Synthetic Polynucleotide
taatacgactcactataggggttgcttctcctgttcttccacttcagggtaacagaggagaaccctgatgtggaagaacaacctggcggcagcgcaaaagatg

SEQ ID NO: 155653 - DNA, 103 bp, Artificial Sequence
  Synthetic Polynucleotide
taatacgactcactatagggtctgtcgtcagttgcttctcctgttcttccaacagaggagaggaagaatgggagaagcaaacctggcggcagcgcaaaagatg

SEQ ID NO: 155654 - DNA, 103 bp, Artificial Sequence
  Synthetic Polynucleotide
taatacgactcactataggggcgggcagcatctgtcgtcagttgcttctcaacagaggagagagaagatgctgacgacaaacctggcggcagcgcaaaagatg

SEQ ID NO: 155655 - DNA, 103 bp, Artificial Sequence
  Synthetic Polynucleotide
taatacgactcactatagggctgcaccaatgcgggcagcatctgtcgtcaaacagaggagatgacgaatgatgctgcccaacctggcggcagcgcaaaagatg

SEQ ID NO: 155656 - DNA, 103 bp, Artificial Sequence
  Synthetic Polynucleotide
taatacgactcactatagggtgggctgcatctgcaccaatgcgggcagcaaacagaggagatgctgcatgcattggtgcaacctggcggcagcgcaaaagatg

SEQ ID NO: 155657 - DNA, 103 bp, Artificial Sequence
  Synthetic Polynucleotide
taatacgactcactatagggagccacttgactcagcagtgcatctaatgaaacagaggagatcattaatggcactgctgaacctggcggcagcgcaaaagatg

SEQ ID NO: 155658 - DNA, 103 bp, Artificial Sequence
  Synthetic Polynucleotide
taatacgactcactataggggatctgcttctgggctgcatctgcaccaataacagaggagaattggtatggatgcagccaacctggcggcagcgcaaaagatg

SEQ ID NO: 155659 - DNA, 103 bp, Artificial Sequence
  Synthetic Polynucleotide
taatacgactcactatagggtcaagctctggatctgcttctgggctgcataacagaggagaatgcagatgagaagcagaaacctggcggcagcgcaaaagatg

SEQ ID NO: 155660 - DNA, 103 bp, Artificial Sequence
  Synthetic Polynucleotide
taatacgactcactatagggcacattttattcaagctctggatctgcttcaacagaggagagaagcaatgccagagcttaacctggcggcagcgcaaaagatg

SEQ ID NO: 155661 - DNA, 103 bp, Artificial Sequence
  Synthetic Polynucleotide
taatacgactcactatagggaaggtttgaacacattttattcaagctctgaacagaggagacagagcatgaataaaatgaacctggcggcagcgcaaaagatg

SEQ ID NO: 155662 - DNA, 103 bp, Artificial Sequence
  Synthetic Polynucleotide
taatacgactcactatagggttttctccagaaggtttgaacacattttataacagaggagaataaaaatggttcaaaccaacctggcggcagcgcaaaagatg

SEQ ID NO: 155663 - DNA, 103 bp, Artificial Sequence
  Synthetic Polynucleotide
taatacgactcactatagggtctttgctgattttctccagaaggtttgaaaacagaggagattcaaaatgtctggagaaaacctggcggcagcgcaaaagatg

SEQ ID NO: 155664 - DNA, 103 bp, Artificial Sequence
  Synthetic Polynucleotide
taatacgactcactatagggttctcgctcctctttgctgattttctccagaacagaggagactggagatgatcagcaaaaacctggcggcagcgcaaaagatg

SEQ ID NO: 155665 - DNA, 103 bp, Artificial Sequence
  Synthetic Polynucleotide
taatacgactcactatagggcactctctgattctcgctcctctttgctgaaacagaggagatcagcaatgaggagcgagaacctggcggcagcgcaaaagatg

SEQ ID NO: 155666 - DNA, 103 bp, Artificial Sequence
  Synthetic Polynucleotide
taatacgactcactatagggcggagacctccactctctgattctcgctccaacagaggagaggagcgatgatcagagagaacctggcggcagcgcaaaagatg

SEQ ID NO: 155667 - DNA, 103 bp, Artificial Sequence
  Synthetic Polynucleotide
taatacgactcactatagggcttgttcggccggagacctccactctctgaaacagaggagatcagagatgggaggtctcaacctggcggcagcgcaaaagatg

SEQ ID NO: 155668 - DNA, 103 bp, Artificial Sequence
  Synthetic Polynucleotide
taatacgactcactatagggtcttcagatcagccacttgactcagcagtgaacagaggagacactgcatggtcaagtggaacctggcggcagcgcaaaagatg

SEQ ID NO: 155669 - DNA, 103 bp, Artificial Sequence
  Synthetic Polynucleotide
taatacgactcactatagggtaaaggtctgcttgttcggccggagacctcaacagaggagagaggtcatgggccgaacaaacctggcggcagcgcaaaagatg

SEQ ID NO: 155670 - DNA, 103 bp, Artificial Sequence
  Synthetic Polynucleotide
taatacgactcactatagggtctgtagggttaaaggtctgcttgttcggcaacagaggagagccgaaatggcagaccttaacctggcggcagcgcaaaagatg

SEQ ID NO: 155671 - DNA, 103 bp, Artificial Sequence
  Synthetic Polynucleotide
taatacgactcactatagggggcattagtgtctgtagggttaaaggtctgaacagaggagacagaccatgaaccctacaaacctggcggcagcgcaaaagatg

SEQ ID NO: 155672 - DNA, 103 bp, Artificial Sequence
  Synthetic Polynucleotide
taatacgactcactatagggctgccaccaaggcattagtgtctgtagggtaacagaggagaaccctaatgacactaatgaacctggcggcagcgcaaaagatg

SEQ ID NO: 155673 - DNA, 103 bp, Artificial Sequence
  Synthetic Polynucleotide
taatacgactcactatagggaaggcaacagctgccaccaaggcattagtgaacagaggagacactaaatgcttggtggcaacctggcggcagcgcaaaagatg

SEQ ID NO: 155674 - DNA, 103 bp, Artificial Sequence
  Synthetic Polynucleotide
taatacgactcactatagggtcctttcccaaaggcaacagctgccaccaaaacagaggagattggtgatggctgttgccaacctggcggcagcgcaaaagatg

SEQ ID NO: 155675 - DNA, 103 bp, Artificial Sequence
  Synthetic Polynucleotide
taatacgactcactatagggaattagatagtcctttcccaaaggcaacagaacagaggagactgttgatgttgggaaagaacctggcggcagcgcaaaagatg

SEQ ID NO: 155676 - DNA, 103 bp, Artificial Sequence
  Synthetic Polynucleotide
taatacgactcactataggggaaggtctccaattagatagtcctttcccaaacagaggagatgggaaatgactatctaaaacctggcggcagcgcaaaagatg

SEQ ID NO: 155677 - DNA, 103 bp, Artificial Sequence
  Synthetic Polynucleotide
taatacgactcactatagggactgctgcctgaaggtctccaattagatagaacagaggagactatctatgtggagacctaacctggcggcagcgcaaaagatg

SEQ ID NO: 155678 - DNA, 103 bp, Artificial Sequence
  Synthetic Polynucleotide
taatacgactcactatagggggccaggaccactgctgcctgaaggtctccaacagaggagaggagacatgcaggcagcaaacctggcggcagcgcaaaagatg

SEQ ID NO: 155679 - DNA, 103 bp, Artificial Sequence
  Synthetic Polynucleotide
taatacgactcactatagggcccagagagttcttcagatcagccacttgaaacagaggagatcaagtatgtgatctgaaaacctggcggcagcgcaaaagatg

SEQ ID NO: 155680 - DNA, 103 bp, Artificial Sequence
  Synthetic Polynucleotide
taatacgactcactatagggtggcctgcctggccaggaccactgctgcctaacagaggagaaggcagatgtggtcctggaacctggcggcagcgcaaaagatg

SEQ ID NO: 155681 - DNA, 103 bp, Artificial Sequence
  Synthetic Polynucleotide
taatacgactcactatagggagctcctggctggcctgcctggccaggaccaacagaggagaggtcctatgcaggcaggcaacctggcggcagcgcaaaagatg

SEQ ID NO: 155682 - DNA, 103 bp, Artificial Sequence
  Synthetic Polynucleotide
taatacgactcactatagggggatcgtcccagctcctggctggcctgcctaacagaggagaaggcagatgagccaggagaacctggcggcagcgcaaaagatg

SEQ ID NO: 155683 - DNA, 103 bp, Artificial Sequence
  Synthetic Polynucleotide
taatacgactcactataggggttcctgcaaggatcgtcccagctcctggcaacagaggagagccaggatgtgggacgataacctggcggcagcgcaaaagatg

SEQ ID NO: 155684 - DNA, 103 bp, Artificial Sequence
  Synthetic Polynucleotide
taatacgactcactatagggtaatcctgaggttcctgcaaggatcgtcccaacagaggagagggacgatgcttgcaggaaacctggcggcagcgcaaaagatg

SEQ ID NO: 155685 - DNA, 103 bp, Artificial Sequence
  Synthetic Polynucleotide
taatacgactcactataggggcacctgctgtaatcctgaggttcctgcaaaacagaggagattgcagatgcctcaggataacctggcggcagcgcaaaagatg

SEQ ID NO: 155686 - DNA, 103 bp, Artificial Sequence
  Synthetic Polynucleotide
taatacgactcactatagggcctgccatctgcacctgctgtaatcctgagaacagaggagactcaggatgacagcaggtaacctggcggcagcgcaaaagatg

SEQ ID NO: 155687 - DNA, 103 bp, Artificial Sequence
  Synthetic Polynucleotide
taatacgactcactataggggcttggagctcctgccatctgcacctgctgaacagaggagacagcagatgcagatggcaaacctggcggcagcgcaaaagatg

SEQ ID NO: 155688 - DNA, 103 bp, Artificial Sequence
  Synthetic Polynucleotide
taatacgactcactataggggctgctgctggcttggagctcctgccatctaacagaggagaagatggatggagctccaaaacctggcggcagcgcaaaagatg

SEQ ID NO: 155689 - DNA, 103 bp, Artificial Sequence
  Synthetic Polynucleotide
taatacgactcactatagggctgagcattggctgctgctggcttggagctaacagaggagaagctccatgccagcagcaaacctggcggcagcgcaaaagatg

SEQ ID NO: 155690 - DNA, 103 bp, Artificial Sequence
  Synthetic Polynucleotide
taatacgactcactatagggaatgaaactccccagagagttcttcagatcaacagaggagagatctgatgaactctctgaacctggcggcagcgcaaaagatg

SEQ ID NO: 155691 - DNA, 103 bp, Artificial Sequence
  Synthetic Polynucleotide
taatacgactcactatagggttgtaccccactgagcattggctgctgctgaacagaggagacagcagatgccaatgctcaacctggcggcagcgcaaaagatg

SEQ ID NO: 155692 - DNA, 103 bp, Artificial Sequence
  Synthetic Polynucleotide
taatacgactcactatagggcctgagccatttgtaccccactgagcattgaacagaggagacaatgcatggtggggtacaacctggcggcagcgcaaaagatg

SEQ ID NO: 155693 - DNA, 103 bp, Artificial Sequence
  Synthetic Polynucleotide
taatacgactcactatagggggttgacctgcctgagccatttgtaccccaaacagaggagatggggtatgaatggctcaaacctggcggcagcgcaaaagatg

SEQ ID NO: 155694 - DNA, 103 bp, Artificial Sequence
  Synthetic Polynucleotide
taatacgactcactatagggcattttccctggttgacctgcctgagccataacagaggagaatggctatggcaggtcaaaacctggcggcagcgcaaaagatg

SEQ ID NO: 155695 - DNA, 103 bp, Artificial Sequence
  Synthetic Polynucleotide
taatacgactcactatagggttccacttggcattttccctggttgacctgaacagaggagacaggtcatgcagggaaaaaacctggcggcagcgcaaaagatg

SEQ ID NO: 155696 - DNA, 103 bp, Artificial Sequence
  Synthetic Polynucleotide
taatacgactcactatagggttggtttttattccacttggcattttccctaacagaggagaagggaaatggccaagtggaacctggcggcagcgcaaaagatg

SEQ ID NO: 155697 - DNA, 103 bp, Artificial Sequence
  Synthetic Polynucleotide
taatacgactcactatagggcgacttgatgttggtttttattccacttggaacagaggagaccaagtatgataaaaaccaacctggcggcagcgcaaaagatg

SEQ ID NO: 155698 - DNA, 103 bp, Artificial Sequence
  Synthetic Polynucleotide
taatacgactcactataggggcatggaagccgacttgatgttggtttttaaacagaggagataaaaaatgacatcaagtaacctggcggcagcgcaaaagatg

SEQ ID NO: 155699 - DNA, 103 bp, Artificial Sequence
  Synthetic Polynucleotide
taatacgactcactatagggtggtagggatgcatggaagccgacttgatgaacagaggagacatcaaatgggcttccataacctggcggcagcgcaaaagatg

SEQ ID NO: 155700 - DNA, 103 bp, Artificial Sequence
  Synthetic Polynucleotide
taatacgactcactatagggggagggccgctggtagggatgcatggaagcaacagaggagagcttccatgcatccctacaacctggcggcagcgcaaaagatg

SEQ ID NO: 155701 - DNA, 103 bp, Artificial Sequence
  Synthetic Polynucleotide
taatacgactcactatagggccaacttgcaaatgaaactccccagagagtaacagaggagaactctcatgggagtttcaaacctggcggcagcgcaaaagatg

SEQ ID NO: 155702 - DNA, 103 bp, Artificial Sequence
  Synthetic Polynucleotide
taatacgactcactatagggaacccaggcaggagggccgctggtagggataacagaggagaatccctatgagcggccctaacctggcggcagcgcaaaagatg

SEQ ID NO: 155703 - DNA, 103 bp, Artificial Sequence
  Synthetic Polynucleotide
taatacgactcactataggggccagaatgaaacccaggcaggagggccgcaacagaggagagcggccatgctgcctgggaacctggcggcagcgcaaaagatg

SEQ ID NO: 155704 - DNA, 103 bp, Artificial Sequence
  Synthetic Polynucleotide
taatacgactcactatagggtagagggatagccagaatgaaacccaggcaaacagaggagatgcctgatgttcattctgaacctggcggcagcgcaaaagatg

SEQ ID NO: 155705 - DNA, 103 bp, Artificial Sequence
  Synthetic Polynucleotide
taatacgactcactatagggccttgcgccttagagggatagccagaatgaaacagaggagatcattcatgctatccctcaacctggcggcagcgcaaaagatg

SEQ ID NO: 155706 - DNA, 103 bp, Artificial Sequence
  Synthetic Polynucleotide
taatacgactcactatagggagcttcttcaccttgcgccttagagggataaacagaggagatatcccatgaaggcgcaaaacctggcggcagcgcaaaagatg

SEQ ID NO: 155707 - DNA, 103 bp, Artificial Sequence
  Synthetic Polynucleotide
taatacgactcactatagggctggcccagaagcttcttcaccttgcgcctaacagaggagaaggcgcatggtgaagaagaacctggcggcagcgcaaaagatg

SEQ ID NO: 155708 - DNA, 103 bp, Artificial Sequence
  Synthetic Polynucleotide
taatacgactcactatagggtttttccttcctggcccagaagcttcttcaaacagaggagatgaagaatgttctgggccaacctggcggcagcgcaaaagatg

SEQ ID NO: 155709 - DNA, 103 bp, Artificial Sequence
  Synthetic Polynucleotide
taatacgactcactatagggtgggcatttttttttccttcctggcccagaaacagaggagatctgggatgggaaggaaaaacctggcggcagcgcaaaagatg

SEQ ID NO: 155710 - DNA, 103 bp, Artificial Sequence
  Synthetic Polynucleotide
taatacgactcactataggggagctgcaggtgggcatttttttttccttcaacagaggagagaaggaatgaaaaatgccaacctggcggcagcgcaaaagatg

SEQ ID NO: 155711 - DNA, 103 bp, Artificial Sequence
  Synthetic Polynucleotide
taatacgactcactatagggtactcgttctccaacttgcaaatgaaactcaacagaggagagagtttatgttgcaagttaacctggcggcagcgcaaaagatg

SEQ ID NO: 155712 - DNA, 103 bp, Artificial Sequence
  Synthetic Polynucleotide
taatacgactcactataggggcgtgtgatttgtattttcttccgccccataacagaggagaatggggatgaagaaaataaacctggcggcagcgcaaaagatg

SEQ ID NO: 155713 - DNA, 103 bp, Artificial Sequence
  Synthetic Polynucleotide
taatacgactcactataggggtcacagagcacactaagttcataggctttaacagaggagaaaagccatggaacttagtaacctggcggcagcgcaaaagatg

SEQ ID NO: 155714 - DNA, 103 bp, Artificial Sequence
  Synthetic Polynucleotide
taatacgactcactatagggaagggctgacaggtcagcgctggtcagtgaaacagaggagatcactgatgagcgctgacaacctggcggcagcgcaaaagatg

SEQ ID NO: 155715 - DNA, 103 bp, Artificial Sequence
  Synthetic Polynucleotide
taatacgactcactatagggtgaagccttgaagggctgacaggtcagcgcaacagaggagagcgctgatgtgtcagcccaacctggcggcagcgcaaaagatg

SEQ ID NO: 155716 - DNA, 103 bp, Artificial Sequence
  Synthetic Polynucleotide
taatacgactcactatagggcctggcgagttgaagccttgaagggctgacaacagaggagagtcagcatgtcaaggcttaacctggcggcagcgcaaaagatg

SEQ ID NO: 155717 - DNA, 103 bp, Artificial Sequence
  Synthetic Polynucleotide
taatacgactcactatagggcgacagcattcctggcgagttgaagccttgaacagaggagacaaggcatgaactcgccaaacctggcggcagcgcaaaagatg

SEQ ID NO: 155718 - DNA, 103 bp, Artificial Sequence
  Synthetic Polynucleotide
taatacgactcactatagggcctgtcccagcgacagcattcctggcgagtaacagaggagaactcgcatggaatgctgtaacctggcggcagcgcaaaagatg

SEQ ID NO: 155719 - DNA, 103 bp, Artificial Sequence
  Synthetic Polynucleotide
taatacgactcactatagggcaggccgacacctgtcccagcgacagcattaacagaggagaaatgctatggctgggacaaacctggcggcagcgcaaaagatg

SEQ ID NO: 155720 - DNA, 103 bp, Artificial Sequence
  Synthetic Polynucleotide
taatacgactcactataggggtgctgctgccaggccgacacctgtcccagaacagaggagactgggaatggtgtcggccaacctggcggcagcgcaaaagatg

SEQ ID NO: 155721 - DNA, 103 bp, Artificial Sequence
  Synthetic Polynucleotide
taatacgactcactataggggtcctaggtggtgctgctgccaggccgacaaacagaggagatgtcggatgggcagcagcaacctggcggcagcgcaaaagatg

SEQ ID NO: 155722 - DNA, 103 bp, Artificial Sequence
  Synthetic Polynucleotide
taatacgactcactatagggagggctgcttgtcctaggtggtgctgctgcaacagaggagagcagcaatgccacctaggaacctggcggcagcgcaaaagatg

SEQ ID NO: 155723 - DNA, 103 bp, Artificial Sequence
  Synthetic Polynucleotide
taatacgactcactatagggaagagagctgagggctgcttgtcctaggtgaacagaggagacacctaatgcaagcagccaacctggcggcagcgcaaaagatg

SEQ ID NO: 155724 - DNA, 103 bp, Artificial Sequence
  Synthetic Polynucleotide
taatacgactcactatagggctatttcacagtcacagagcacactaagttaacagaggagaaacttaatgtgctctgtgaacctggcggcagcgcaaaagatg

SEQ ID NO: 155725 - DNA, 103 bp, Artificial Sequence
  Synthetic Polynucleotide
taatacgactcactatagggctccagcaacaagagagctgagggctgcttaacagaggagaaagcagatgtcagctctcaacctggcggcagcgcaaaagatg

SEQ ID NO: 155726 - DNA, 103 bp, Artificial Sequence
  Synthetic Polynucleotide
taatacgactcactataggggataactgccctccagcaacaagagagctgaacagaggagacagctcatgtgttgctggaacctggcggcagcgcaaaagatg

SEQ ID NO: 155727 - DNA, 103 bp, Artificial Sequence
  Synthetic Polynucleotide
taatacgactcactatagggggaaccctgagataactgccctccagcaacaacagaggagagttgctatggggcagttaaacctggcggcagcgcaaaagatg

SEQ ID NO: 155728 - DNA, 103 bp, Artificial Sequence
  Synthetic Polynucleotide
taatacgactcactatagggtggataaattggaaccctgagataactgccaacagaggagaggcagtatgctcagggttaacctggcggcagcgcaaaagatg

SEQ ID NO: 155729 - DNA, 103 bp, Artificial Sequence
  Synthetic Polynucleotide
taatacgactcactatagggttggtattaatggataaattggaaccctgaaacagaggagatcagggatgcaatttatcaacctggcggcagcgcaaaagatg

SEQ ID NO: 155730 - DNA, 103 bp, Artificial Sequence
  Synthetic Polynucleotide
taatacgactcactataggggatgttttggttggtattaatggataaattaacagaggagaaatttaatgattaataccaacctggcggcagcgcaaaagatg

SEQ ID NO: 155731 - DNA, 103 bp, Artificial Sequence
  Synthetic Polynucleotide
taatacgactcactatagggacttgatgctgatgttttggttggtattaaaacagaggagattaataatgaccaaaacaaacctggcggcagcgcaaaagatg

SEQ ID NO: 155732 - DNA, 103 bp, Artificial Sequence
  Synthetic Polynucleotide
taatacgactcactatagggatcggttcggacttgatgctgatgttttggaacagaggagaccaaaaatgcagcatcaaaacctggcggcagcgcaaaagatg

SEQ ID NO: 155733 - DNA, 103 bp, Artificial Sequence
  Synthetic Polynucleotide
taatacgactcactatagggaggaggtgaaatcggttcggacttgatgctaacagaggagaagcatcatgtccgaaccgaacctggcggcagcgcaaaagatg

SEQ ID NO: 155734 - DNA, 103 bp, Artificial Sequence
  Synthetic Polynucleotide
taatacgactcactatagggtacgatcccgaggaggtgaaatcggttcggaacagaggagaccgaacatgtttcacctcaacctggcggcagcgcaaaagatg

SEQ ID NO: 155735 - DNA, 103 bp, Artificial Sequence
  Synthetic Polynucleotide
taatacgactcactatagggatgatgagtgctatttcacagtcacagagcaacagaggagagctctgatgctgtgaaataacctggcggcagcgcaaaagatg

SEQ ID NO: 155736 - DNA, 103 bp, Artificial Sequence
  Synthetic Polynucleotide
taatacgactcactataggggatggggtcatacgatcccgaggaggtgaaaacagaggagattcaccatgtcgggatcgaacctggcggcagcgcaaaagatg

SEQ ID NO: 155737 - DNA, 103 bp, Artificial Sequence
  Synthetic Polynucleotide
taatacgactcactatagggctggaagcccgatggggtcatacgatcccgaacagaggagacgggatatgatgaccccaaacctggcggcagcgcaaaagatg

SEQ ID NO: 155738 - DNA, 103 bp, Artificial Sequence
  Synthetic Polynucleotide
taatacgactcactataggggctgctgctgctggaagcccgatggggtcaaacagaggagatgacccatgcgggcttccaacctggcggcagcgcaaaagatg

SEQ ID NO: 155739 - DNA, 103 bp, Artificial Sequence
  Synthetic Polynucleotide
taatacgactcactatagggtgctgctgctgctgctgctgctggaagcccaacagaggagagggcttatggcagcagcaaacctggcggcagcgcaaaagatg

SEQ ID NO: 155740 - DNA, 103 bp, Artificial Sequence; identical to SEQ ID NO: 88564
  Synthetic Polynucleotide

SEQ ID NO: 155741 - DNA, 103 bp, Artificial Sequence
  Synthetic Polynucleotide
taatacgactcactataggggtggcggcggctgctgctgctgctgctgctaacagaggagaagcagcatgagcagcagcaacctggcggcagcgcaaaagatg

SEQ ID NO: 155742 - DNA, 103 bp, Artificial Sequence
  Synthetic Polynucleotide
taatacgactcactatagggggctgcggtggtggcggcggctgctgctgcaacagaggagagcagcaatggccgccgccaacctggcggcagcgcaaaagatg

SEQ ID NO: 155743 - DNA, 103 bp, Artificial Sequence
  Synthetic Polynucleotide
taatacgactcactatagggttgtggctggggctgcggtggtggcggcggaacagaggagaccgccgatgccaccgcagaacctggcggcagcgcaaaagatg

SEQ ID NO: 155744 - DNA, 103 bp, Artificial Sequence
  Synthetic Polynucleotide
taatacgactcactataggggctgcgggggttgtggctggggctgcggtgaacagaggagacaccgcatgcccagccacaacctggcggcagcgcaaaagatg

SEQ ID NO: 155745 - DNA, 103 bp, Artificial Sequence
  Synthetic Polynucleotide
taatacgactcactatagggcggggctggggctgcgggggttgtggctggaacagaggagaccagccatgacccccgcaaacctggcggcagcgcaaaagatg

SEQ ID NO: 155746 - DNA, 103 bp, Artificial Sequence
  Synthetic Polynucleotide
taatacgactcactataggggctgttgaaaatgatgagtgctatttcacaaacagaggagatgtgaaatggcactcatcaacctggcggcagcgcaaaagatg

SEQ ID NO: 155747 - DNA, 103 bp, Artificial Sequence
  Synthetic Polynucleotide
taatacgactcactatagggcatttcctgtcggggctggggctgcgggggaacagaggagacccccgatgccccagcccaacctggcggcagcgcaaaagatg

SEQ ID NO: 155748 - DNA, 103 bp, Artificial Sequence
  Synthetic Polynucleotide
taatacgactcactataggggggagcgccccatttcctgtcggggctgggaacagaggagacccagcatggacaggaaaaacctggcggcagcgcaaaagatg

SEQ ID NO: 155749 - DNA, 103 bp, Artificial Sequence
  Synthetic Polynucleotide
taatacgactcactatagggctgtccacaggggagcgccccatttcctgtaacagaggagaacaggaatgggggcgctcaacctggcggcagcgcaaaagatg

SEQ ID NO: 155750 - DNA, 103 bp, Artificial Sequence
  Synthetic Polynucleotide
taatacgactcactataggggctgctcagactgtccacaggggagcgcccaacagaggagagggcgcatgcctgtggacaacctggcggcagcgcaaaagatg

SEQ ID NO: 155751 - DNA, 103 bp, Artificial Sequence
  Synthetic Polynucleotide
taatacgactcactatagggagctactagagctgctcagactgtccacagaacagaggagactgtggatggtctgagcaaacctggcggcagcgcaaaagatg

SEQ ID NO: 155752 - DNA, 103 bp, Artificial Sequence
  Synthetic Polynucleotide
taatacgactcactatagggccatcataggagctactagagctgctcagaaacagaggagatctgagatgctctagtagaacctggcggcagcgcaaaagatg

SEQ ID NO: 155753 - DNA, 103 bp, Artificial Sequence
  Synthetic Polynucleotide
taatacgactcactatagggccgatcactgccatcataggagctactagaaacagaggagatctagtatgtcctatgataacctggcggcagcgcaaaagatg

SEQ ID NO: 155754 - DNA, 103 bp, Artificial Sequence
  Synthetic Polynucleotide
taatacgactcactataggggtggatcctcccgatcactgccatcataggaacagaggagacctatgatggcagtgatcaacctggcggcagcgcaaaagatg

SEQ ID NO: 155755 - DNA, 103 bp, Artificial Sequence
  Synthetic Polynucleotide
taatacgactcactatagggaagtcgccccgtggatcctcccgatcactgaacagaggagacagtgaatgggaggatccaacctggcggcagcgcaaaagatg

SEQ ID NO: 155756 - DNA, 103 bp, Artificial Sequence
  Synthetic Polynucleotide
taatacgactcactatagggtggagaatggaagtcgccccgtggatcctcaacagaggagagaggatatgcggggcgacaacctggcggcagcgcaaaagatg

SEQ ID NO: 155757 - DNA, 103 bp, Artificial Sequence
  Synthetic Polynucleotide
taatacgactcactataggggtttgttagagctgttgaaaatgatgagtgaacagaggagacactcaatgttttcaacaaacctggcggcagcgcaaaagatg

SEQ ID NO: 155758 - DNA, 103 bp, Artificial Sequence
  Synthetic Polynucleotide
taatacgactcactatagggcaagcacaattggagaatggaagtcgccccaacagaggagaggggcgatgtccattctcaacctggcggcagcgcaaaagatg

SEQ ID NO: 155759 - DNA, 103 bp, Artificial Sequence
  Synthetic Polynucleotide
taatacgactcactataggggggggtcggccaagcacaattggagaatggaacagaggagaccattcatgaattgtgctaacctggcggcagcgcaaaagatg

SEQ ID NO: 155760 - DNA, 103 bp, Artificial Sequence
  Synthetic Polynucleotide
taatacgactcactatagggctcagtgtttgggggtcggccaagcacaataacagaggagaattgtgatgggccgacccaacctggcggcagcgcaaaagatg

SEQ ID NO: 155761 - DNA, 103 bp, Artificial Sequence
  Synthetic Polynucleotide
taatacgactcactatagggtttctctgtcctcagtgtttgggggtcggcaacagaggagagccgacatgcaaacactgaacctggcggcagcgcaaaagatg

SEQ ID NO: 155762 - DNA, 103 bp, Artificial Sequence
  Synthetic Polynucleotide
taatacgactcactatagggacagaagggctttctctgtcctcagtgtttaacagaggagaaaacacatgggacagagaaacctggcggcagcgcaaaagatg

SEQ ID NO: 155763 - DNA, 103 bp, Artificial Sequence
  Synthetic Polynucleotide
taatacgactcactatagggcattcgctttacagaagggctttctctgtcaacagaggagagacagaatgagcccttctaacctggcggcagcgcaaaagatg

SEQ ID NO: 155764 - DNA, 103 bp, Artificial Sequence
  Synthetic Polynucleotide
taatacgactcactatagggcgtccatcctcattcgctttacagaagggcaacagaggagagcccttatgtaaagcgaaaacctggcggcagcgcaaaagatg

SEQ ID NO: 155765 - DNA, 103 bp, Artificial Sequence
  Synthetic Polynucleotide
taatacgactcactataggggtcacccacgcgtccatcctcattcgctttaacagaggagaaaagcgatggaggatggaaacctggcggcagcgcaaaagatg

SEQ ID NO: 155766 - DNA, 103 bp, Artificial Sequence
  Synthetic Polynucleotide
taatacgactcactatagggtattgaaacagtttgttagagctgttgaaaaacagaggagatttcaaatgctctaacaaaacctggcggcagcgcaaaagatg

SEQ ID NO: 155767 - DNA, 103 bp, Artificial Sequence
  Synthetic Polynucleotide
taatacgactcactatagggagtgctagcatattgaaacagtttgttagaaacagaggagatctaacatgctgtttcaaaacctggcggcagcgcaaaagatg

SEQ ID NO: 155768 - DNA, 103 bp, Artificial Sequence
  Synthetic Polynucleotide
taatacgactcactatagggtgtccatatcagtgctagcatattgaaacaaacagaggagatgtttcatgatgctagcaaacctggcggcagcgcaaaagatg

SEQ ID NO: 155769 - DNA, 103 bp, Artificial Sequence
  Synthetic Polynucleotide
taatacgactcactatagggagaagaactttgtccatatcagtgctagcaaacagaggagatgctagatgtgatatggaaacctggcggcagcgcaaaagatg

SEQ ID NO: 155770 - DNA, 103 bp, Artificial Sequence
  Synthetic Polynucleotide
taatacgactcactatagggtgtatacttgagaagaactttgtccatatcaacagaggagagatatgatgaaagttcttaacctggcggcagcgcaaaagatg

SEQ ID NO: 155771 - DNA, 103 bp, Artificial Sequence
  Synthetic Polynucleotide
taatacgactcactatagggcatccattatgcgtgtgatttgtattttctaacagaggagaagaaaaatgaaatcacacaacctggcggcagcgcaaaagatg

SEQ ID NO: 155772 - DNA, 103 bp, Artificial Sequence
  Synthetic Polynucleotide
taatacgactcactatagggcattatattctgtatacttgagaagaacttaacagaggagaaagttcatgtcaagtataaacctggcggcagcgcaaaagatg

SEQ ID NO: 155773 - DNA, 103 bp, Artificial Sequence
  Synthetic Polynucleotide
taatacgactcactatagggtcatgaggttcattatattctgtatacttgaacagaggagacaagtaatgagaatataaaacctggcggcagcgcaaaagatg

SEQ ID NO: 155774 - DNA, 103 bp, Artificial Sequence
  Synthetic Polynucleotide
taatacgactcactatagggggttctgctttcatgaggttcattatattcaacagaggagagaatatatggaacctcataacctggcggcagcgcaaaagatg

SEQ ID NO: 155775 - DNA, 103 bp, Artificial Sequence
  Synthetic Polynucleotide
taatacgactcactatagggtatccgagttggttctgctttcatgaggttaacagaggagaaacctcatgaaagcagaaaacctggcggcagcgcaaaagatg

SEQ ID NO: 155776 - DNA, 103 bp, Artificial Sequence
  Synthetic Polynucleotide
taatacgactcactataggggtctcaacaatatccgagttggttctgcttaacagaggagaaagcagatgcaactcggaaacctggcggcagcgcaaaagatg

SEQ ID NO: 155777 - DNA, 103 bp, Artificial Sequence
  Synthetic Polynucleotide
taatacgactcactatagggctttcttaaagtctcaacaatatccgagttaacagaggagaaactcgatgattgttgagaacctggcggcagcgcaaaagatg

SEQ ID NO: 155778 - DNA, 103 bp, Artificial Sequence
  Synthetic Polynucleotide
taatacgactcactatagggtaaggcctttctttcttaaagtctcaacaaaacagaggagattgttgatgctttaagaaaacctggcggcagcgcaaaagatg

SEQ ID NO: 155779 - DNA, 103 bp, Artificial Sequence
  Synthetic Polynucleotide
taatacgactcactatagggtcacaaccattaaggcctttctttcttaaaaacagaggagatttaagatggaaaggcctaacctggcggcagcgcaaaagatg

SEQ ID NO: 155780 - DNA, 103 bp, Artificial Sequence
  Synthetic Polynucleotide
taatacgactcactatagggatcagggctctcacaaccattaaggcctttaacagaggagaaaaggcatgaatggttgtaacctggcggcagcgcaaaagatg

SEQ ID NO: 155781 - DNA, 103 bp, Artificial Sequence
  Synthetic Polynucleotide
taatacgactcactatagggaatcgtcagcatcagggctctcacaaccataacagaggagaatggttatgagagccctgaacctggcggcagcgcaaaagatg

SEQ ID NO: 155782 - DNA, 103 bp, Artificial Sequence
  Synthetic Polynucleotide
taatacgactcactatagggcggttcctttcatccattatgcgtgtgattaacagaggagaaatcacatgcataatggaaacctggcggcagcgcaaaagatg

SEQ ID NO: 155783 - DNA, 103 bp, Artificial Sequence
  Synthetic Polynucleotide
taatacgactcactatagggtgctcaaagtaatcgtcagcatcagggctcaacagaggagagagcccatgtgctgacgaaacctggcggcagcgcaaaagatg

SEQ ID NO: 155784 - DNA, 103 bp, Artificial Sequence
  Synthetic Polynucleotide
taatacgactcactataggggagtggactgtgctcaaagtaatcgtcagcaacagaggagagctgacatgtactttgagaacctggcggcagcgcaaaagatg

SEQ ID NO: 155785 - DNA, 103 bp, Artificial Sequence
  Synthetic Polynucleotide
taatacgactcactatagggtgtcctccgagagtggactgtgctcaaagtaacagaggagaactttgatgacagtccacaacctggcggcagcgcaaaagatg

SEQ ID NO: 155786 - DNA, 103 bp, Artificial Sequence
  Synthetic Polynucleotide
taatacgactcactatagggttgctgaatctgtcctccgagagtggactgaacagaggagacagtccatgctcggaggaaacctggcggcagcgcaaaagatg

SEQ ID NO: 155787 - DNA, 103 bp, Artificial Sequence
  Synthetic Polynucleotide
taatacgactcactatagggttcatttagtttgctgaatctgtcctccgaaacagaggagatcggagatgagattcagcaacctggcggcagcgcaaaagatg

SEQ ID NO: 155788 - DNA, 103 bp, Artificial Sequence
  Synthetic Polynucleotide
taatacgactcactatagggaatcactatcttcatttagtttgctgaatcaacagaggagagattcaatgaactaaatgaacctggcggcagcgcaaaagatg

SEQ ID NO: 155789 - DNA, 103 bp, Artificial Sequence
  Synthetic Polynucleotide
taatacgactcactatagggttgaaaataaaatcactatcttcatttagtaacagaggagaactaaaatgagatagtgaaacctggcggcagcgcaaaagatg

SEQ ID NO: 155790 - DNA, 103 bp, Artificial Sequence
  Synthetic Polynucleotide
taatacgactcactatagggagggcctcgtttgaaaataaaatcactatcaacagaggagagatagtatgtttattttcaacctggcggcagcgcaaaagatg

SEQ ID NO: 155791 - DNA, 103 bp, Artificial Sequence
  Synthetic Polynucleotide
taatacgactcactataggggcagaccaggagggcctcgtttgaaaataaaacagaggagattatttatgaacgaggccaacctggcggcagcgcaaaagatg

SEQ ID NO: 155792 - DNA, 103 bp, Artificial Sequence
  Synthetic Polynucleotide
taatacgactcactatagggttctgaggtggcagaccaggagggcctcgtaacagaggagaacgaggatgtcctggtctaacctggcggcagcgcaaaagatg

SEQ ID NO: 155793 - DNA, 103 bp, Artificial Sequence
  Synthetic Polynucleotide
taatacgactcactatagggagtgacctgtcggttcctttcatccattataacagaggagaataatgatggaaaggaacaacctggcggcagcgcaaaagatg

SEQ ID NO: 155794 - DNA, 103 bp, Artificial Sequence
  Synthetic Polynucleotide
taatacgactcactatagggcattgaaaagttctgaggtggcagaccaggaacagaggagacctggtatgccacctcagaacctggcggcagcgcaaaagatg

SEQ ID NO: 155795 - DNA, 103 bp, Artificial Sequence
  Synthetic Polynucleotide
taatacgactcactatagggctgtgacagacattgaaaagttctgaggtgaacagaggagacacctcatgacttttcaaaacctggcggcagcgcaaaagatg

SEQ ID NO: 155796 - DNA, 103 bp, Artificial Sequence
  Synthetic Polynucleotide
taatacgactcactataggggtcactggaactgtgacagacattgaaaagaacagaggagacttttcatggtctgtcacaacctggcggcagcgcaaaagatg

SEQ ID NO: 155797 - DNA, 103 bp, Artificial Sequence
  Synthetic Polynucleotide
taatacgactcactatagggattggggctggtcactggaactgtgacagaaacagaggagatctgtcatggttccagtgaacctggcggcagcgcaaaagatg

SEQ ID NO: 155798 - DNA, 103 bp, Artificial Sequence
  Synthetic Polynucleotide
taatacgactcactatagggaggacaaagcattggggctggtcactggaaaacagaggagattccagatgccagccccaaacctggcggcagcgcaaaagatg

SEQ ID NO: 155799 - DNA, 103 bp, Artificial Sequence
  Synthetic Polynucleotide
taatacgactcactataggggggttagtgtaggacaaagcattggggctgaacagaggagacagcccatgtgctttgtcaacctggcggcagcgcaaaagatg

SEQ ID NO: 155800 - DNA, 103 bp, Artificial Sequence
  Synthetic Polynucleotide
taatacgactcactatagggtgaactccctgggttagtgtaggacaaagcaacagaggagagctttgatgtacactaacaacctggcggcagcgcaaaagatg

SEQ ID NO: 155801 - DNA, 103 bp, Artificial Sequence
  Synthetic Polynucleotide
taatacgactcactataggggggacaccagtgaactccctgggttagtgtaacagaggagaacactaatgcagggagttaacctggcggcagcgcaaaagatg

SEQ ID NO: 155802 - DNA, 103 bp, Artificial Sequence
  Synthetic Polynucleotide
taatacgactcactataggggccaaagatggggacaccagtgaactccctaacagaggagaagggagatgactggtgtcaacctggcggcagcgcaaaagatg

SEQ ID NO: 155803 - DNA, 103 bp, Artificial Sequence
  Synthetic Polynucleotide
taatacgactcactatagggtgagctggctgccaaagatggggacaccagaacagaggagactggtgatgccatctttgaacctggcggcagcgcaaaagatg

SEQ ID NO: 155804 - DNA, 103 bp, Artificial Sequence
  Synthetic Polynucleotide
taatacgactcactatagggtctttgtaaaagtgacctgtcggttcctttaacagaggagaaaaggaatggacaggtcaaacctggcggcagcgcaaaagatg

SEQ ID NO: 155805 - DNA, 103 bp, Artificial Sequence
  Synthetic Polynucleotide
taatacgactcactatagggctgttaacgttgagctggctgccaaagatgaacagaggagacatcttatgcagccagctaacctggcggcagcgcaaaagatg

SEQ ID NO: 155806 - DNA, 103 bp, Artificial Sequence
  Synthetic Polynucleotide
taatacgactcactatagggatgcttgaatctgttaacgttgagctggctaacagaggagaagccagatgaacgttaacaacctggcggcagcgcaaaagatg

SEQ ID NO: 155807 - DNA, 103 bp, Artificial Sequence
  Synthetic Polynucleotide
taatacgactcactatagggtggagagagcatgcttgaatctgttaacgtaacagaggagaacgttaatggattcaagcaacctggcggcagcgcaaaagatg

SEQ ID NO: 155808 - DNA, 103 bp, Artificial Sequence
  Synthetic Polynucleotide
taatacgactcactatagggtggtttgaggtggagagagcatgcttgaataacagaggagaattcaaatgtgctctctcaacctggcggcagcgcaaaagatg

SEQ ID NO: 155809 - DNA, 103 bp, Artificial Sequence
  Synthetic Polynucleotide
taatacgactcactatagggctatgtaatgtggtttgaggtggagagagcaacagaggagagctctcatgacctcaaacaacctggcggcagcgcaaaagatg

SEQ ID NO: 155810 - DNA, 103 bp, Artificial Sequence
  Synthetic Polynucleotide
taatacgactcactatagggagacacatttctatgtaatgtggtttgaggaacagaggagacctcaaatgacattacataacctggcggcagcgcaaaagatg

SEQ ID NO: 155811 - DNA, 103 bp, Artificial Sequence
  Synthetic Polynucleotide
taatacgactcactataggggagctccaggagacacatttctatgtaatgaacagaggagacattacatggaaatgtgtaacctggcggcagcgcaaaagatg

SEQ ID NO: 155812 - DNA, 103 bp, Artificial Sequence
  Synthetic Polynucleotide
taatacgactcactatagggggtctctgaggagctccaggagacacatttaacagaggagaaaatgtatgtcctggagcaacctggcggcagcgcaaaagatg

SEQ ID NO: 155813 - DNA, 103 bp, Artificial Sequence
  Synthetic Polynucleotide
taatacgactcactatagggagtacttggtggtctctgaggagctccaggaacagaggagacctggaatgcctcagagaaacctggcggcagcgcaaaagatg

SEQ ID NO: 155814 - DNA, 103 bp, Artificial Sequence
  Synthetic Polynucleotide
taatacgactcactatagggctgcattgccagtacttggtggtctctgagaacagaggagactcagaatgcaccaagtaaacctggcggcagcgcaaaagatg

SEQ ID NO: 155815 - DNA, 103 bp, Artificial Sequence
  Synthetic Polynucleotide
taatacgactcactatagggccaaactttctctttgtaaaagtgacctgtaacagaggagaacaggtatgttttacaaaaacctggcggcagcgcaaaagatg

SEQ ID NO: 155816 - DNA, 103 bp, Artificial Sequence
  Synthetic Polynucleotide
taatacgactcactatagggaacatcccacctgcattgccagtacttggtaacagaggagaaccaagatgtggcaatgcaacctggcggcagcgcaaaagatg

SEQ ID NO: 155817 - DNA, 103 bp, Artificial Sequence
  Synthetic Polynucleotide
taatacgactcactatagggtgtagtgctcaacatcccacctgcattgccaacagaggagaggcaatatgggtgggatgaacctggcggcagcgcaaaagatg

SEQ ID NO: 155818 - DNA, 103 bp, Artificial Sequence
  Synthetic Polynucleotide
taatacgactcactatagggctgtgaggtctgtagtgctcaacatcccacaacagaggagagtgggaatgtgagcactaaacctggcggcagcgcaaaagatg

SEQ ID NO: 155819 - DNA, 103 bp, Artificial Sequence
  Synthetic Polynucleotide
taatacgactcactatagggccatttggcactgtgaggtctgtagtgctcaacagaggagagagcacatgagacctcacaacctggcggcagcgcaaaagatg

SEQ ID NO: 155820 - DNA, 103 bp, Artificial Sequence
  Synthetic Polynucleotide
taatacgactcactataggggcttccagctccatttggcactgtgaggtcaacagaggagagacctcatggtgccaaataacctggcggcagcgcaaaagatg

SEQ ID NO: 155821 - DNA, 103 bp, Artificial Sequence
  Synthetic Polynucleotide
taatacgactcactatagggccactggactgcttccagctccatttggcaaacagaggagatgccaaatggagctggaaaacctggcggcagcgcaaaagatg

SEQ ID NO: 155822 - DNA, 103 bp, Artificial Sequence
  Synthetic Polynucleotide
taatacgactcactatagggaatccattccccactggactgcttccagctaacagaggagaagctggatgcagtccagtaacctggcggcagcgcaaaagatg

SEQ ID NO: 155823 - DNA, 103 bp, Artificial Sequence
  Synthetic Polynucleotide
taatacgactcactatagggtgagtttacaaatccattccccactggactaacagaggagaagtccaatggggaatggaaacctggcggcagcgcaaaagatg

SEQ ID NO: 155824 - DNA, 103 bp, Artificial Sequence
  Synthetic Polynucleotide
taatacgactcactataggggagaagctcttgagtttacaaatccattccaacagaggagaggaatgatgttgtaaactaacctggcggcagcgcaaaagatg

SEQ ID NO: 155825 - DNA, 103 bp, Artificial Sequence
  Synthetic Polynucleotide
taatacgactcactatagggatcaaatttggagaagctcttgagtttacaaacagaggagatgtaaaatgaagagcttcaacctggcggcagcgcaaaagatg

SEQ ID NO: 155826 - DNA, 103 bp, Artificial Sequence
  Synthetic Polynucleotide
taatacgactcactatagggcttcattaatccaaactttctctttgtaaaaacagaggagatttacaatgagaaagtttaacctggcggcagcgcaaaagatg

SEQ ID NO: 155827 - DNA, 103 bp, Artificial Sequence
  Synthetic Polynucleotide
taatacgactcactatagggagtagctccaatcaaatttggagaagctctaacagaggagaagagctatgccaaatttgaacctggcggcagcgcaaaagatg

SEQ ID NO: 155828 - DNA, 103 bp, Artificial Sequence
  Synthetic Polynucleotide
taatacgactcactatagggtatttgcaccagtagctccaatcaaatttgaacagaggagacaaattatgttggagctaaacctggcggcagcgcaaaagatg

SEQ ID NO: 155829 - DNA, 103 bp, Artificial Sequence
  Synthetic Polynucleotide
taatacgactcactatagggttgcctaagctatttgcaccagtagctccaaacagaggagatggagcatgtggtgcaaaaacctggcggcagcgcaaaagatg

SEQ ID NO: 155830 - DNA, 103 bp, Artificial Sequence
  Synthetic Polynucleotide
taatacgactcactatagggaggcatgactttgcctaagctatttgcaccaacagaggagaggtgcaatgagcttaggcaacctggcggcagcgcaaaagatg

SEQ ID NO: 155831 - DNA, 103 bp, Artificial Sequence
  Synthetic Polynucleotide
taatacgactcactataggggagactttgtaggcatgactttgcctaagcaacagaggagagcttagatgaagtcatgcaacctggcggcagcgcaaaagatg

SEQ ID NO: 155832 - DNA, 103 bp, Artificial Sequence
  Synthetic Polynucleotide
taatacgactcactatagggggtggagggggagactttgtaggcatgactaacagaggagaagtcatatgtacaaagtcaacctggcggcagcgcaaaagatg

SEQ ID NO: 155833 - DNA, 103 bp, Artificial Sequence
  Synthetic Polynucleotide
taatacgactcactatagggaccaccacctggtggagggggagactttgtaacagaggagaacaaagatgccccctccaaacctggcggcagcgcaaaagatg

SEQ ID NO: 155834 - DNA, 103 bp, Artificial Sequence
  Synthetic Polynucleotide
taatacgactcactatagggttccaagattaccaccacctggtggaggggaacagaggagacccctcatgcaggtggtgaacctggcggcagcgcaaaagatg

SEQ ID NO: 155835 - DNA, 103 bp, Artificial Sequence
  Synthetic Polynucleotide
taatacgactcactatagggctactgttcattccaagattaccaccacctaacagaggagaaggtggatgtaatcttggaacctggcggcagcgcaaaagatg

SEQ ID NO: 155836 - DNA, 103 bp, Artificial Sequence
  Synthetic Polynucleotide
taatacgactcactatagggatctggtttcctactgttcattccaagattaacagaggagaaatcttatgatgaacagtaacctggcggcagcgcaaaagatg

SEQ ID NO: 155837 - DNA, 103 bp, Artificial Sequence
  Synthetic Polynucleotide
taatacgactcactatagggcataggctttcttcattaatccaaactttcaacagaggagagaaagtatggattaatgaaacctggcggcagcgcaaaagatg

SEQ ID NO: 155838 - DNA, 103 bp, Artificial Sequence
  Synthetic Polynucleotide
taatacgactcactatagggcaactcgaagatctggtttcctactgttcaaacagaggagatgaacaatgggaaaccagaacctggcggcagcgcaaaagatg

SEQ ID NO: 155839 - DNA, 103 bp, Artificial Sequence
  Synthetic Polynucleotide
taatacgactcactatagggggggggatgacaactcgaagatctggtttcaacagaggagagaaaccatgtcttcgagtaacctggcggcagcgcaaaagatg

SEQ ID NO: 155840 - DNA, 103 bp, Artificial Sequence
  Synthetic Polynucleotide
taatacgactcactatagggcttgcttgaaggggggatgacaactcgaagaacagaggagacttcgaatggtcatccccaacctggcggcagcgcaaaagatg

SEQ ID NO: 155841 - DNA, 103 bp, Artificial Sequence
  Synthetic Polynucleotide
taatacgactcactataggggcatcatgcccttgcttgaaggggggatgaaacagaggagatcatccatgcttcaagcaaacctggcggcagcgcaaaagatg

SEQ ID NO: 155842 - DNA, 103 bp, Artificial Sequence
  Synthetic Polynucleotide
taatacgactcactatagggtttagtggaggcatcatgcccttgcttgaaaacagaggagattcaagatggggcatgataacctggcggcagcgcaaaagatg

SEQ ID NO: 155843 - DNA, 103 bp, Artificial Sequence
  Synthetic Polynucleotide
taatacgactcactatagggcctctgggtatttagtggaggcatcatgccaacagaggagaggcatgatgcctccactaaacctggcggcagcgcaaaagatg

SEQ ID NO: 155844 - DNA, 103 bp, Artificial Sequence
  Synthetic Polynucleotide
taatacgactcactatagggaactactgatcctctgggtatttagtggagaacagaggagactccacatgatacccagaaacctggcggcagcgcaaaagatg

SEQ ID NO: 155845 - DNA, 103 bp, Artificial Sequence
  Synthetic Polynucleotide
taatacgactcactataggggtggcttgagaactactgatcctctgggtaaacagaggagatacccaatggatcagtagaacctggcggcagcgcaaaagatg

SEQ ID NO: 155846 - DNA, 103 bp, Artificial Sequence
  Synthetic Polynucleotide
taatacgactcactatagggaagaggttgagtggcttgagaactactgataacagaggagaatcagtatgtctcaagccaacctggcggcagcgcaaaagatg

SEQ ID NO: 155847 - DNA, 103 bp, Artificial Sequence
  Synthetic Polynucleotide
taatacgactcactatagggctggggtagcaagaggttgagtggcttgagaacagaggagactcaagatgctcaacctcaacctggcggcagcgcaaaagatg

SEQ ID NO: 155848 - DNA, 103 bp, Artificial Sequence
  Synthetic Polynucleotide
taatacgactcactatagggacactaagttcataggctttcttcattaataacagaggagaattaatatggaaagcctaaacctggcggcagcgcaaaagatg

SEQ ID NO: 155849 - DNA, 103 bp, Artificial Sequence
  Synthetic Polynucleotide
taatacgactcactatagggacagacacgactggggtagcaagaggttgaaacagaggagatcaaccatgtgctaccccaacctggcggcagcgcaaaagatg

SEQ ID NO: 155850 - DNA, 103 bp, Artificial Sequence
  Synthetic Polynucleotide
taatacgactcactatagggtggggttgtcacagacacgactggggtagcaacagaggagagctaccatggtcgtgtctaacctggcggcagcgcaaaagatg

SEQ ID NO: 155851 - DNA, 103 bp, Artificial Sequence
  Synthetic Polynucleotide
taatacgactcactataggggaggcaagcttggggttgtcacagacacgaaacagaggagatcgtgtatgtgacaacccaacctggcggcagcgcaaaagatg

SEQ ID NO: 155852 - DNA, 103 bp, Artificial Sequence
  Synthetic Polynucleotide
taatacgactcactatagggagtccttgcggaggcaagcttggggttgtcaacagaggagagacaacatgaagcttgccaacctggcggcagcgcaaaagatg

SEQ ID NO: 155853 - DNA, 103 bp, Artificial Sequence
  Synthetic Polynucleotide
taatacgactcactatagggtgagtacacaagtccttgcggaggcaagctaacagaggagaagcttgatgccgcaaggaaacctggcggcagcgcaaaagatg

SEQ ID NO: 155854 - DNA, 103 bp, Artificial Sequence
  Synthetic Polynucleotide
taatacgactcactatagggtcggcattgctgagtacacaagtccttgcgaacagaggagacgcaagatgttgtgtactaacctggcggcagcgcaaaagatg

SEQ ID NO: 155855 - DNA, 103 bp, Artificial Sequence
  Synthetic Polynucleotide
taatacgactcactatagggttgtaggcagtcggcattgctgagtacacaaacagaggagatgtgtaatgagcaatgccaacctggcggcagcgcaaaagatg

SEQ ID NO: 155856 - DNA, 103 bp, Artificial Sequence
  Synthetic Polynucleotide
taatacgactcactatagggataatcagtgttgtaggcagtcggcattgcaacagaggagagcaatgatgactgcctacaacctggcggcagcgcaaaagatg

SEQ ID NO: 155857 - DNA, 103 bp, Artificial Sequence
  Synthetic Polynucleotide
taatacgactcactatagggtggtcagtgaataatcagtgttgtaggcagaacagaggagactgcctatgacactgattaacctggcggcagcgcaaaagatg

SEQ ID NO: 155858 - DNA, 103 bp, Artificial Sequence
  Synthetic Polynucleotide
taatacgactcactatagggaggtcagcgctggtcagtgaataatcagtgaacagaggagacactgaatgttcactgacaacctggcggcagcgcaaaagatg

SEQ ID NO: 155859 - DNA, 103 bp, Artificial Sequence; identical to SEQ ID NO: 97222
  Synthetic Polynucleotide

SEQ ID NO: 155860 - DNA, 103 bp, Artificial Sequence; identical to SEQ ID NO: 97223
  Synthetic Polynucleotide

SEQ ID NO: 155861 - DNA, 103 bp, Artificial Sequence
  Synthetic Polynucleotide
taatacgactcactatagggaaagtcgccggggcccccgggggccggagaaacagaggagatctccgatgcccgggggcaacctggcggcagcgcaaaagatg

SEQ ID NO: 155862 - DNA, 103 bp, Artificial Sequence
  Synthetic Polynucleotide
taatacgactcactatagggaggtcttaggaaagtcgccggggcccccggaacagaggagaccggggatgccggcgactaacctggcggcagcgcaaaagatg

SEQ ID NO: 155863 - DNA, 103 bp, Artificial Sequence
  Synthetic Polynucleotide
taatacgactcactatagggggataggggaaggtcttaggaaagtcgccgaacagaggagacggcgaatgtcctaagacaacctggcggcagcgcaaaagatg

SEQ ID NO: 155864 - DNA, 103 bp, Artificial Sequence
  Synthetic Polynucleotide
taatacgactcactataggggaggagcaagggataggggaaggtcttaggaacagaggagacctaagatgttcccctataacctggcggcagcgcaaaagatg

SEQ ID NO: 155865 - DNA, 103 bp, Artificial Sequence
  Synthetic Polynucleotide
taatacgactcactataggggggaccgggcgaggagcaagggataggggaaacagaggagatcccctatgccttgctccaacctggcggcagcgcaaaagatg

SEQ ID NO: 155866 - DNA, 103 bp, Artificial Sequence
  Synthetic Polynucleotide
taatacgactcactatagggggctctgccagggaccgggcgaggagcaagaacagaggagacttgctatgcgcccggtcaacctggcggcagcgcaaaagatg

SEQ ID NO: 155867 - DNA, 103 bp, Artificial Sequence
  Synthetic Polynucleotide
taatacgactcactatagggaggccgcagaggctctgccagggaccgggcaacagaggagagcccggatgctggcagagaacctggcggcagcgcaaaagatg

SEQ ID NO: 155868 - DNA, 103 bp, Artificial Sequence
  Synthetic Polynucleotide
taatacgactcactataggggggcgggcccaggccgcagaggctctgccaaacagaggagatggcagatgctctgcggcaacctggcggcagcgcaaaagatg

SEQ ID NO: 155869 - DNA, 103 bp, Artificial Sequence
  Synthetic Polynucleotide
taatacgactcactatagggagccggcgcagggcgggcccaggccgcagaaacagaggagatctgcgatgtgggcccgcaacctggcggcagcgcaaaagatg

SEQ ID NO: 155870 - DNA, 103 bp, Artificial Sequence
  Synthetic Polynucleotide
taatacgactcactatagggggccaagggcagccggcgcagggcgggcccaacagaggagagggcccatgctgcgccggaacctggcggcagcgcaaaagatg

SEQ ID NO: 155871 - DNA, 103 bp, Artificial Sequence; identical to SEQ ID NO: 97232
  Synthetic Polynucleotide

SEQ ID NO: 155872 - DNA, 103 bp, Artificial Sequence
  Synthetic Polynucleotide
taatacgactcactataggggccagccgtcggccaagggcagccggcgcaaacagaggagatgcgccatgtgcccttggaacctggcggcagcgcaaaagatg

SEQ ID NO: 155873 - DNA, 103 bp, Artificial Sequence; identical to SEQ ID NO: 97233
  Synthetic Polynucleotide

SEQ ID NO: 155874 - DNA, 103 bp, Artificial Sequence; identical to SEQ ID NO: 97234
  Synthetic Polynucleotide

SEQ ID NO: 155875 - DNA, 103 bp, Artificial Sequence; identical to SEQ ID NO: 97235
  Synthetic Polynucleotide

SEQ ID NO: 155876 - DNA, 103 bp, Artificial Sequence; identical to SEQ ID NO: 97236
  Synthetic Polynucleotide

SEQ ID NO: 155877 - DNA, 103 bp, Artificial Sequence; identical to SEQ ID NO: 97237
  Synthetic Polynucleotide

SEQ ID NO: 155878 - DNA, 103 bp, Artificial Sequence; identical to SEQ ID NO: 97238
  Synthetic Polynucleotide

SEQ ID NO: 155879 - DNA, 103 bp, Artificial Sequence; identical to SEQ ID NO: 97239
  Synthetic Polynucleotide

SEQ ID NO: 155880 - DNA, 103 bp, Artificial Sequence; identical to SEQ ID NO: 97240
  Synthetic Polynucleotide

SEQ ID NO: 155881 - DNA, 103 bp, Artificial Sequence; identical to SEQ ID NO: 97241
  Synthetic Polynucleotide

SEQ ID NO: 155882 - DNA, 103 bp, Artificial Sequence; identical to SEQ ID NO: 97242
  Synthetic Polynucleotide

SEQ ID NO: 155883 - DNA, 103 bp, Artificial Sequence; identical to SEQ ID NO: 97243
  Synthetic Polynucleotide

SEQ ID NO: 155884 - DNA, 103 bp, Artificial Sequence; identical to SEQ ID NO: 97244
  Synthetic Polynucleotide

SEQ ID NO: 155885 - DNA, 103 bp, Artificial Sequence; identical to SEQ ID NO: 97245
  Synthetic Polynucleotide

SEQ ID NO: 155886 - DNA, 103 bp, Artificial Sequence; identical to SEQ ID NO: 97246
  Synthetic Polynucleotide

SEQ ID NO: 155887 - DNA, 103 bp, Artificial Sequence; identical to SEQ ID NO: 97247
  Synthetic Polynucleotide

SEQ ID NO: 155888 - DNA, 103 bp, Artificial Sequence; identical to SEQ ID NO: 97248
  Synthetic Polynucleotide

SEQ ID NO: 155889 - DNA, 103 bp, Artificial Sequence; identical to SEQ ID NO: 97249
  Synthetic Polynucleotide

SEQ ID NO: 155890 - DNA, 103 bp, Artificial Sequence; identical to SEQ ID NO: 97250
  Synthetic Polynucleotide

SEQ ID NO: 155891 - DNA, 103 bp, Artificial Sequence; identical to SEQ ID NO: 97251
  Synthetic Polynucleotide

SEQ ID NO: 155892 - DNA, 103 bp, Artificial Sequence; identical to SEQ ID NO: 97252
  Synthetic Polynucleotide

SEQ ID NO: 155893 - DNA, 103 bp, Artificial Sequence; identical to SEQ ID NO: 97253
  Synthetic Polynucleotide

SEQ ID NO: 155894 - DNA, 103 bp, Artificial Sequence; identical to SEQ ID NO: 97254
  Synthetic Polynucleotide

SEQ ID NO: 155895 - DNA, 103 bp, Artificial Sequence; identical to SEQ ID NO: 97255
  Synthetic Polynucleotide

SEQ ID NO: 155896 - DNA, 103 bp, Artificial Sequence; identical to SEQ ID NO: 97256
  Synthetic Polynucleotide

SEQ ID NO: 155897 - DNA, 103 bp, Artificial Sequence; identical to SEQ ID NO: 97257
  Synthetic Polynucleotide

SEQ ID NO: 155898 - DNA, 103 bp, Artificial Sequence; identical to SEQ ID NO: 97258
  Synthetic Polynucleotide

SEQ ID NO: 155899 - DNA, 103 bp, Artificial Sequence; identical to SEQ ID NO: 97259
  Synthetic Polynucleotide

SEQ ID NO: 155900 - DNA, 103 bp, Artificial Sequence; identical to SEQ ID NO: 97260
  Synthetic Polynucleotide

SEQ ID NO: 155901 - DNA, 103 bp, Artificial Sequence; identical to SEQ ID NO: 97261
  Synthetic Polynucleotide

SEQ ID NO: 155902 - DNA, 103 bp, Artificial Sequence; identical to SEQ ID NO: 97262
  Synthetic Polynucleotide

SEQ ID NO: 155903 - DNA, 103 bp, Artificial Sequence; identical to SEQ ID NO: 97263
  Synthetic Polynucleotide

SEQ ID NO: 155904 - DNA, 103 bp, Artificial Sequence; identical to SEQ ID NO: 97264
  Synthetic Polynucleotide

SEQ ID NO: 155905 - DNA, 103 bp, Artificial Sequence; identical to SEQ ID NO: 97265
  Synthetic Polynucleotide

SEQ ID NO: 155906 - DNA, 103 bp, Artificial Sequence; identical to SEQ ID NO: 97266
  Synthetic Polynucleotide

SEQ ID NO: 155907 - DNA, 103 bp, Artificial Sequence; identical to SEQ ID NO: 97267
  Synthetic Polynucleotide

SEQ ID NO: 155908 - DNA, 103 bp, Artificial Sequence; identical to SEQ ID NO: 97268
  Synthetic Polynucleotide

SEQ ID NO: 155909 - DNA, 103 bp, Artificial Sequence; identical to SEQ ID NO: 97269
  Synthetic Polynucleotide

SEQ ID NO: 155910 - DNA, 103 bp, Artificial Sequence; identical to SEQ ID NO: 97270
  Synthetic Polynucleotide

SEQ ID NO: 155911 - DNA, 103 bp, Artificial Sequence; identical to SEQ ID NO: 97271
  Synthetic Polynucleotide

SEQ ID NO: 155912 - DNA, 103 bp, Artificial Sequence; identical to SEQ ID NO: 97272
  Synthetic Polynucleotide

SEQ ID NO: 155913 - DNA, 103 bp, Artificial Sequence; identical to SEQ ID NO: 97273
  Synthetic Polynucleotide

SEQ ID NO: 155914 - DNA, 103 bp, Artificial Sequence; identical to SEQ ID NO: 97274
  Synthetic Polynucleotide

SEQ ID NO: 155915 - DNA, 103 bp, Artificial Sequence; identical to SEQ ID NO: 97275
  Synthetic Polynucleotide

SEQ ID NO: 155916 - DNA, 103 bp, Artificial Sequence; identical to SEQ ID NO: 97276
  Synthetic Polynucleotide

SEQ ID NO: 155917 - DNA, 103 bp, Artificial Sequence; identical to SEQ ID NO: 97277
  Synthetic Polynucleotide

SEQ ID NO: 155918 - DNA, 103 bp, Artificial Sequence; identical to SEQ ID NO: 97278
  Synthetic Polynucleotide

SEQ ID NO: 155919 - DNA, 103 bp, Artificial Sequence; identical to SEQ ID NO: 97279
  Synthetic Polynucleotide

SEQ ID NO: 155920 - DNA, 103 bp, Artificial Sequence; identical to SEQ ID NO: 97280
  Synthetic Polynucleotide

SEQ ID NO: 155921 - DNA, 103 bp, Artificial Sequence; identical to SEQ ID NO: 97281
  Synthetic Polynucleotide

SEQ ID NO: 155922 - DNA, 103 bp, Artificial Sequence; identical to SEQ ID NO: 97282
  Synthetic Polynucleotide

SEQ ID NO: 155923 - DNA, 103 bp, Artificial Sequence; identical to SEQ ID NO: 97283
  Synthetic Polynucleotide

SEQ ID NO: 155924 - DNA, 103 bp, Artificial Sequence; identical to SEQ ID NO: 97284
  Synthetic Polynucleotide

SEQ ID NO: 155925 - DNA, 103 bp, Artificial Sequence; identical to SEQ ID NO: 97285
  Synthetic Polynucleotide

SEQ ID NO: 155926 - DNA, 103 bp, Artificial Sequence; identical to SEQ ID NO: 97286
  Synthetic Polynucleotide

SEQ ID NO: 155927 - DNA, 103 bp, Artificial Sequence; identical to SEQ ID NO: 97287
  Synthetic Polynucleotide

SEQ ID NO: 155928 - DNA, 103 bp, Artificial Sequence; identical to SEQ ID NO: 97288
  Synthetic Polynucleotide

SEQ ID NO: 155929 - DNA, 103 bp, Artificial Sequence; identical to SEQ ID NO: 97289
  Synthetic Polynucleotide

SEQ ID NO: 155930 - DNA, 103 bp, Artificial Sequence; identical to SEQ ID NO: 97290
  Synthetic Polynucleotide

SEQ ID NO: 155931 - DNA, 103 bp, Artificial Sequence; identical to SEQ ID NO: 97291
  Synthetic Polynucleotide

SEQ ID NO: 155932 - DNA, 103 bp, Artificial Sequence; identical to SEQ ID NO: 97292
  Synthetic Polynucleotide

SEQ ID NO: 155933 - DNA, 103 bp, Artificial Sequence; identical to SEQ ID NO: 97293
  Synthetic Polynucleotide

SEQ ID NO: 155934 - DNA, 103 bp, Artificial Sequence; identical to SEQ ID NO: 97294
  Synthetic Polynucleotide

SEQ ID NO: 155935 - DNA, 103 bp, Artificial Sequence; identical to SEQ ID NO: 97295
  Synthetic Polynucleotide

SEQ ID NO: 155936 - DNA, 103 bp, Artificial Sequence; identical to SEQ ID NO: 97296
  Synthetic Polynucleotide

SEQ ID NO: 155937 - DNA, 103 bp, Artificial Sequence; identical to SEQ ID NO: 97297
  Synthetic Polynucleotide

SEQ ID NO: 155938 - DNA, 103 bp, Artificial Sequence; identical to SEQ ID NO: 97298
  Synthetic Polynucleotide

SEQ ID NO: 155939 - DNA, 103 bp, Artificial Sequence; identical to SEQ ID NO: 97299
  Synthetic Polynucleotide

SEQ ID NO: 155940 - DNA, 103 bp, Artificial Sequence; identical to SEQ ID NO: 97300
  Synthetic Polynucleotide

SEQ ID NO: 155941 - DNA, 103 bp, Artificial Sequence; identical to SEQ ID NO: 97301
  Synthetic Polynucleotide

SEQ ID NO: 155942 - DNA, 103 bp, Artificial Sequence
  Synthetic Polynucleotide
taatacgactcactataggggctggggggcctccggggaggaaggggaagaacagaggagacttcccatgcctccccggaacctggcggcagcgcaaaagatg

SEQ ID NO: 155943 - DNA, 103 bp, Artificial Sequence
  Synthetic Polynucleotide
taatacgactcactatagggggaattgggggctggggggcctccggggagaacagaggagactccccatgggccccccaaacctggcggcagcgcaaaagatg

SEQ ID NO: 155944 - DNA, 103 bp, Artificial Sequence
  Synthetic Polynucleotide
taatacgactcactatagggctggtgggcaggaattgggggctggggggcaacagaggagagcccccatgcccccaattaacctggcggcagcgcaaaagatg

SEQ ID NO: 155945 - DNA, 103 bp, Artificial Sequence
  Synthetic Polynucleotide
taatacgactcactatagggaggccatattctggtgggcaggaattggggaacagaggagaccccaaatgctgcccaccaacctggcggcagcgcaaaagatg

SEQ ID NO: 155946 - DNA, 103 bp, Artificial Sequence
  Synthetic Polynucleotide
taatacgactcactatagggagggtctcccaggccatattctggtgggcaaacagaggagatgcccaatggaatatggcaacctggcggcagcgcaaaagatg

SEQ ID NO: 155947 - DNA, 103 bp, Artificial Sequence; identical to SEQ ID NO: 97307
  Synthetic Polynucleotide

SEQ ID NO: 155948 - DNA, 103 bp, Artificial Sequence
  Synthetic Polynucleotide
taatacgactcactatagggggggcggtggagggtctcccaggccatattaacagaggagaaatatgatgtgggagaccaacctggcggcagcgcaaaagatg

SEQ ID NO: 155949 - DNA, 103 bp, Artificial Sequence
  Synthetic Polynucleotide
taatacgactcactatagggaacaagccagggggcggtggagggtctcccaacagaggagagggagaatgtccaccgccaacctggcggcagcgcaaaagatg

SEQ ID NO: 155950 - DNA, 103 bp, Artificial Sequence
  Synthetic Polynucleotide
taatacgactcactatagggggggggctgcaacaagccagggggcggtggaacagaggagaccaccgatgcctggcttgaacctggcggcagcgcaaaagatg

SEQ ID NO: 155951 - DNA, 103 bp, Artificial Sequence
  Synthetic Polynucleotide
taatacgactcactataggggggccagggtggggggctgcaacaagccagaacagaggagactggctatgtgcagccccaacctggcggcagcgcaaaagatg

SEQ ID NO: 155952 - DNA, 103 bp, Artificial Sequence
  Synthetic Polynucleotide
taatacgactcactatagggggctgccagggggccagggtggggggctgcaacagaggagagcagccatgcaccctggcaacctggcggcagcgcaaaagatg

SEQ ID NO: 155953 - DNA, 103 bp, Artificial Sequence
  Synthetic Polynucleotide
taatacgactcactatagggacccctcgagggctgccagggggccagggtaacagaggagaaccctgatgccctggcagaacctggcggcagcgcaaaagatg

SEQ ID NO: 155954 - DNA, 103 bp, Artificial Sequence
  Synthetic Polynucleotide
taatacgactcactatagggggggcccatcacccctcgagggctgccaggaacagaggagacctggcatgcctcgagggaacctggcggcagcgcaaaagatg

SEQ ID NO: 155955 - DNA, 103 bp, Artificial Sequence
  Synthetic Polynucleotide
taatacgactcactataggggacacggcggggggcccatcacccctcgagaacagaggagactcgagatgtgatgggccaacctggcggcagcgcaaaagatg

SEQ ID NO: 155956 - DNA, 103 bp, Artificial Sequence
  Synthetic Polynucleotide
taatacgactcactataggggggctgggaggacacggcggggggcccatcaacagaggagagatgggatgcccgccgtgaacctggcggcagcgcaaaagatg

SEQ ID NO: 155957 - DNA, 103 bp, Artificial Sequence
  Synthetic Polynucleotide
taatacgactcactatagggggcccccactgggctgggaggacacggcggaacagaggagaccgccgatgcctcccagcaacctggcggcagcgcaaaagatg

SEQ ID NO: 155958 - DNA, 103 bp, Artificial Sequence; identical to SEQ ID NO: 97318
  Synthetic Polynucleotide

SEQ ID NO: 155959 - DNA, 103 bp, Artificial Sequence
  Synthetic Polynucleotide
taatacgactcactatagggcccaggcttcggcccccactgggctgggagaacagaggagactcccaatgcagtgggggaacctggcggcagcgcaaaagatg

SEQ ID NO: 155960 - DNA, 103 bp, Artificial Sequence
  Synthetic Polynucleotide
taatacgactcactatagggaccctcctcgcccaggcttcggcccccactaacagaggagaagtgggatgcgaagcctgaacctggcggcagcgcaaaagatg

SEQ ID NO: 155961 - DNA, 103 bp, Artificial Sequence
  Synthetic Polynucleotide
taatacgactcactataggggggttgggggaccctcctcgcccaggcttcaacagaggagagaagccatggcgaggaggaacctggcggcagcgcaaaagatg

SEQ ID NO: 155962 - DNA, 103 bp, Artificial Sequence
  Synthetic Polynucleotide
taatacgactcactataggggaggcgccgcgggttgggggaccctcctcgaacagaggagacgaggaatgtcccccaacaacctggcggcagcgcaaaagatg

SEQ ID NO: 155963 - DNA, 103 bp, Artificial Sequence
  Synthetic Polynucleotide
taatacgactcactatagggggtcggcggggaggcgccgcgggttgggggaacagaggagacccccaatgcgcggcgccaacctggcggcagcgcaaaagatg

SEQ ID NO: 155964 - DNA, 103 bp, Artificial Sequence
  Synthetic Polynucleotide
taatacgactcactatagggtgactgggggggtcggcggggaggcgccgcaacagaggagagcggcgatgccccgccgaaacctggcggcagcgcaaaagatg

SEQ ID NO: 155965 - DNA, 103 bp, Artificial Sequence
  Synthetic Polynucleotide
taatacgactcactataggggacttgatgctgactgggggggtcggcgggaacagaggagacccgccatgccccccagtaacctggcggcagcgcaaaagatg

SEQ ID NO: 155966 - DNA, 103 bp, Artificial Sequence
  Synthetic Polynucleotide
taatacgactcactataggggaggcgctcagacttgatgctgactgggggaacagaggagacccccaatgagcatcaagaacctggcggcagcgcaaaagatg

SEQ ID NO: 155967 - DNA, 103 bp, Artificial Sequence
  Synthetic Polynucleotide
taatacgactcactataggggggccggagagaggcgctcagacttgatgcaacagaggagagcatcaatgctgagcgccaacctggcggcagcgcaaaagatg

SEQ ID NO: 155968 - DNA, 103 bp, Artificial Sequence
  Synthetic Polynucleotide
taatacgactcactataggggggcccccgggggccggagagaggcgctcaaacagaggagatgagcgatgctctccggcaacctggcggcagcgcaaaagatg

SEQ ID NO: 155969 - DNA, 103 bp, Artificial Sequence
  Synthetic Polynucleotide
taatacgactcactatagggcctcgtaatctgaatcttttttctccccataacagaggagaatggggatgaaaaagattaacctggcggcagcgcaaaagatg

SEQ ID NO: 155970 - DNA, 103 bp, Artificial Sequence
  Synthetic Polynucleotide
taatacgactcactataggggtcacacagcacgctcagctcataagccttaacagaggagaaaggctatggagctgagcaacctggcggcagcgcaaaagatg

SEQ ID NO: 155971 - DNA, 103 bp, Artificial Sequence
  Synthetic Polynucleotide
taatacgactcactatagggcaggtctgcactactcagagagtactcggtaacagaggagaaccgagatgtctctgagtaacctggcggcagcgcaaaagatg

SEQ ID NO: 155972 - DNA, 103 bp, Artificial Sequence
  Synthetic Polynucleotide
taatacgactcactatagggacagagatgacaggtctgcactactcagagaacagaggagactctgaatggtgcagaccaacctggcggcagcgcaaaagatg

SEQ ID NO: 155973 - DNA, 103 bp, Artificial Sequence
  Synthetic Polynucleotide
taatacgactcactatagggttaaacccagacagagatgacaggtctgcaaacagaggagatgcagaatggtcatctctaacctggcggcagcgcaaaagatg

SEQ ID NO: 155974 - DNA, 103 bp, Artificial Sequence
  Synthetic Polynucleotide
taatacgactcactataggggctggcggtgttaaacccagacagagatgaaacagaggagatcatctatgtctgggtttaacctggcggcagcgcaaaagatg

SEQ ID NO: 155975 - DNA, 103 bp, Artificial Sequence
  Synthetic Polynucleotide
taatacgactcactatagggggtgaagagcgctggcggtgttaaacccagaacagaggagactgggtatgacaccgccaaacctggcggcagcgcaaaagatg

SEQ ID NO: 155976 - DNA, 103 bp, Artificial Sequence
  Synthetic Polynucleotide
taatacgactcactatagggactgaaccaaggtgaagagcgctggcggtgaacagaggagacaccgcatgcgctcttcaaacctggcggcagcgcaaaagatg

SEQ ID NO: 155977 - DNA, 103 bp, Artificial Sequence
  Synthetic Polynucleotide
taatacgactcactatagggccagccagttactgaaccaaggtgaagagcaacagaggagagctcttatgcttggttcaaacctggcggcagcgcaaaagatg

SEQ ID NO: 155978 - DNA, 103 bp, Artificial Sequence
  Synthetic Polynucleotide
taatacgactcactataggggttgctgttgccagccagttactgaaccaaaacagaggagattggttatgtaactggctaacctggcggcagcgcaaaagatg

SEQ ID NO: 155979 - DNA, 103 bp, Artificial Sequence
  Synthetic Polynucleotide
taatacgactcactatagggttatgtaggtgttgctgttgccagccagttaacagaggagaaactggatggcaacagcaaacctggcggcagcgcaaaagatg

SEQ ID NO: 155980 - DNA, 103 bp, Artificial Sequence
  Synthetic Polynucleotide
taatacgactcactatagggtggtggcatgttatgtaggtgttgctgttgaacagaggagacaacagatgcacctacataacctggcggcagcgcaaaagatg

SEQ ID NO: 155981 - DNA, 103 bp, Artificial Sequence
  Synthetic Polynucleotide
taatacgactcactatagggcaatctcacagtcacacagcacgctcagctaacagaggagaagctgaatgtgctgtgtgaacctggcggcagcgcaaaagatg

SEQ ID NO: 155982 - DNA, 103 bp, Artificial Sequence
  Synthetic Polynucleotide
taatacgactcactatagggtgagggcagatggtggcatgttatgtaggtaacagaggagaacctacatgacatgccacaacctggcggcagcgcaaaagatg

SEQ ID NO: 155983 - DNA, 103 bp, Artificial Sequence
  Synthetic Polynucleotide
taatacgactcactatagggcccaactgactgagggcagatggtggcatgaacagaggagacatgccatgatctgccctaacctggcggcagcgcaaaagatg

SEQ ID NO: 155984 - DNA, 103 bp, Artificial Sequence
  Synthetic Polynucleotide
taatacgactcactatagggagtgcaagctcccaactgactgagggcagaaacagaggagatctgccatgagtcagttgaacctggcggcagcgcaaaagatg

SEQ ID NO: 155985 - DNA, 103 bp, Artificial Sequence
  Synthetic Polynucleotide
taatacgactcactatagggaatgagtgctagtgcaagctcccaactgacaacagaggagagtcagtatggagcttgcaaacctggcggcagcgcaaaagatg

SEQ ID NO: 155986 - DNA, 103 bp, Artificial Sequence
  Synthetic Polynucleotide
taatacgactcactatagggctctgagataaatgagtgctagtgcaagctaacagaggagaagcttgatgtagcactcaaacctggcggcagcgcaaaagatg

SEQ ID NO: 155987 - DNA, 103 bp, Artificial Sequence
  Synthetic Polynucleotide
taatacgactcactataggggagatttgaactctgagataaatgagtgctaacagaggagaagcactatgttatctcagaacctggcggcagcgcaaaagatg

SEQ ID NO: 155988 - DNA, 103 bp, Artificial Sequence
  Synthetic Polynucleotide
taatacgactcactatagggaaggcagggagagatttgaactctgagataaacagaggagatatctcatggttcaaatcaacctggcggcagcgcaaaagatg

SEQ ID NO: 155989 - DNA, 103 bp, Artificial Sequence
  Synthetic Polynucleotide
taatacgactcactatagggctttgagtagaaggcagggagagatttgaaaacagaggagattcaaaatgctccctgccaacctggcggcagcgcaaaagatg

SEQ ID NO: 155990 - DNA, 103 bp, Artificial Sequence
  Synthetic Polynucleotide
taatacgactcactataggggatgttgaggctttgagtagaaggcagggaaacagaggagatccctgatgtctactcaaaacctggcggcagcgcaaaagatg

SEQ ID NO: 155991 - DNA, 103 bp, Artificial Sequence
  Synthetic Polynucleotide
taatacgactcactataggggttctgacttgatgttgaggctttgagtagaacagaggagactactcatggcctcaacaaacctggcggcagcgcaaaagatg

SEQ ID NO: 155992 - DNA, 103 bp, Artificial Sequence
  Synthetic Polynucleotide
taatacgactcactatagggatgatcagcgcaatctcacagtcacacagcaacagaggagagctgtgatgctgtgagataacctggcggcagcgcaaaagatg

SEQ ID NO: 155993 - DNA, 103 bp, Artificial Sequence
  Synthetic Polynucleotide
taatacgactcactatagggggagaaacaggttctgacttgatgttgaggaacagaggagacctcaaatgcaagtcagaaacctggcggcagcgcaaaagatg

SEQ ID NO: 155994 - DNA, 103 bp, Artificial Sequence
  Synthetic Polynucleotide
taatacgactcactataggggtctctaggaggagaaacaggttctgacttaacagaggagaaagtcaatgcctgtttctaacctggcggcagcgcaaaagatg

SEQ ID NO: 155995 - DNA, 103 bp, Artificial Sequence
  Synthetic Polynucleotide
taatacgactcactatagggtggtggtacggtctctaggaggagaaacagaacagaggagactgtttatgctcctagagaacctggcggcagcgcaaaagatg

SEQ ID NO: 155996 - DNA, 103 bp, Artificial Sequence
  Synthetic Polynucleotide
taatacgactcactatagggctcgaaggggtggtggtacggtctctaggaaacagaggagatcctagatgccgtaccacaacctggcggcagcgcaaaagatg

SEQ ID NO: 155997 - DNA, 103 bp, Artificial Sequence
  Synthetic Polynucleotide
taatacgactcactatagggttgtgggtatctcgaaggggtggtggtacgaacagaggagacgtaccatgaccccttcgaacctggcggcagcgcaaaagatg

SEQ ID NO: 155998 - DNA, 103 bp, Artificial Sequence
  Synthetic Polynucleotide
taatacgactcactatagggggcgcgtgtgttgtgggtatctcgaaggggaacagaggagaccccttatggatacccacaacctggcggcagcgcaaaagatg

SEQ ID NO: 155999 - DNA, 103 bp, Artificial Sequence
  Synthetic Polynucleotide
taatacgactcactatagggcccgcctcgtggcgcgtgtgttgtgggtataacagaggagaatacccatgacacacgcgaacctggcggcagcgcaaaagatg

SEQ ID NO: 156000 - DNA, 103 bp, Artificial Sequence
  Synthetic Polynucleotide
taatacgactcactatagggaggagatctccccgcctcgtggcgcgtgtgaacagaggagacacacgatgcacgaggcgaacctggcggcagcgcaaaagatg

SEQ ID NO: 156001 - DNA, 103 bp, Artificial Sequence
  Synthetic Polynucleotide
taatacgactcactatagggagctgtcaacaggagatctccccgcctcgtaacagaggagaacgaggatgggagatctcaacctggcggcagcgcaaaagatg

SEQ ID NO: 156002 - DNA, 103 bp, Artificial Sequence
  Synthetic Polynucleotide
taatacgactcactatagggcagctgctcaagctgtcaacaggagatctcaacagaggagagagatcatgtgttgacagaacctggcggcagcgcaaaagatg

SEQ ID NO: 156003 - DNA, 103 bp, Artificial Sequence
  Synthetic Polynucleotide
taatacgactcactataggggctgttgaagatgatcagcgcaatctcacaaacagaggagatgtgagatggcgctgatcaacctggcggcagcgcaaaagatg

SEQ ID NO: 156004 - DNA, 103 bp, Artificial Sequence
  Synthetic Polynucleotide
taatacgactcactatagggcgaactgctacagctgctcaagctgtcaacaacagaggagagttgacatgttgagcagcaacctggcggcagcgcaaaagatg

SEQ ID NO: 156005 - DNA, 103 bp, Artificial Sequence
  Synthetic Polynucleotide
taatacgactcactatagggtcccgtcgtacgaactgctacagctgctcaaacagaggagatgagcaatggtagcagttaacctggcggcagcgcaaaagatg

SEQ ID NO: 156006 - DNA, 103 bp, Artificial Sequence
  Synthetic Polynucleotide
taatacgactcactatagggtctcggtcgctcccgtcgtacgaactgctaaacagaggagatagcagatggtacgacggaacctggcggcagcgcaaaagatg

SEQ ID NO: 156007 - DNA, 103 bp, Artificial Sequence
  Synthetic Polynucleotide
taatacgactcactatagggccggtgatcctctcggtcgctcccgtcgtaaacagaggagatacgacatgagcgaccgaaacctggcggcagcgcaaaagatg

SEQ ID NO: 156008 - DNA, 103 bp, Artificial Sequence
  Synthetic Polynucleotide
taatacgactcactatagggggaattcgttccggtgatcctctcggtcgcaacagaggagagcgaccatgaggatcaccaacctggcggcagcgcaaaagatg

SEQ ID NO: 156009 - DNA, 103 bp, Artificial Sequence
  Synthetic Polynucleotide
taatacgactcactatagggatgggggagtggaattcgttccggtgatccaacagaggagaggatcaatggaacgaattaacctggcggcagcgcaaaagatg

SEQ ID NO: 156010 - DNA, 103 bp, Artificial Sequence
  Synthetic Polynucleotide
taatacgactcactatagggggtgagtccaatgggggagtggaattcgttaacagaggagaaacgaaatgcactcccccaacctggcggcagcgcaaaagatg

SEQ ID NO: 156011 - DNA, 103 bp, Artificial Sequence
  Synthetic Polynucleotide
taatacgactcactataggggcgaaggtctggtgagtccaatgggggagtaacagaggagaactcccatgttggactcaaacctggcggcagcgcaaaagatg

SEQ ID NO: 156012 - DNA, 103 bp, Artificial Sequence
  Synthetic Polynucleotide
taatacgactcactatagggctttcgtccggcgaaggtctggtgagtccaaacagaggagatggactatgcagaccttcaacctggcggcagcgcaaaagatg

SEQ ID NO: 156013 - DNA, 103 bp, Artificial Sequence
  Synthetic Polynucleotide
taatacgactcactataggggggactttccctttcgtccggcgaaggtctaacagaggagaagacctatgccggacgaaaacctggcggcagcgcaaaagatg

SEQ ID NO: 156014 - DNA, 103 bp, Artificial Sequence
  Synthetic Polynucleotide
taatacgactcactataggggcttgttggtgctgttgaagatgatcagcgaacagaggagacgctgaatgtcttcaacaaacctggcggcagcgcaaaagatg

SEQ ID NO: 156015 - DNA, 103 bp, Artificial Sequence
  Synthetic Polynucleotide
taatacgactcactataggggcttgactgagggactttccctttcgtccgaacagaggagacggacgatggggaaagtcaacctggcggcagcgcaaaagatg

SEQ ID NO: 156016 - DNA, 103 bp, Artificial Sequence
  Synthetic Polynucleotide
taatacgactcactatagggagtcgcatgcgcttgactgagggactttccaacagaggagaggaaagatgctcagtcaaaacctggcggcagcgcaaaagatg

SEQ ID NO: 156017 - DNA, 103 bp, Artificial Sequence
  Synthetic Polynucleotide
taatacgactcactatagggtccttcagaaagtcgcatgcgcttgactgaaacagaggagatcagtcatgcgcatgcgaaacctggcggcagcgcaaaagatg

SEQ ID NO: 156018 - DNA, 103 bp, Artificial Sequence
  Synthetic Polynucleotide
taatacgactcactatagggatgttgcccatccttcagaaagtcgcatgcaacagaggagagcatgcatgtttctgaagaacctggcggcagcgcaaaagatg

SEQ ID NO: 156019 - DNA, 103 bp, Artificial Sequence
  Synthetic Polynucleotide
taatacgactcactatagggtactggaacagcttgttggtgctgttgaagaacagaggagacttcaaatgcaccaacaaaacctggcggcagcgcaaaagatg

SEQ ID NO: 156020 - DNA, 103 bp, Artificial Sequence
  Synthetic Polynucleotide
taatacgactcactatagggggtgctggcatactggaacagcttgttggtaacagaggagaaccaacatgctgttccagaacctggcggcagcgcaaaagatg

SEQ ID NO: 156021 - DNA, 103 bp, Artificial Sequence
  Synthetic Polynucleotide
taatacgactcactatagggtgtccatgtcggtgctggcatactggaacaaacagaggagatgttccatgatgccagcaaacctggcggcagcgcaaaagatg

SEQ ID NO: 156022 - DNA, 103 bp, Artificial Sequence
  Synthetic Polynucleotide
taatacgactcactatagggagaagcactttgtccatgtcggtgctggcaaacagaggagatgccagatgcgacatggaaacctggcggcagcgcaaaagatg

SEQ ID NO: 156023 - DNA, 103 bp, Artificial Sequence
  Synthetic Polynucleotide
taatacgactcactatagggcgtgtacttgagaagcactttgtccatgtcaacagaggagagacatgatgaaagtgcttaacctggcggcagcgcaaaagatg

SEQ ID NO: 156024 - DNA, 103 bp, Artificial Sequence
  Synthetic Polynucleotide
taatacgactcactatagggcatccataatcctcgtaatctgaatcttttaacagaggagaaaaagaatgagattacgaaacctggcggcagcgcaaaagatg

SEQ ID NO: 156025 - DNA, 103 bp, Artificial Sequence
  Synthetic Polynucleotide
taatacgactcactatagggcgttgtactccgtgtacttgagaagcacttaacagaggagaaagtgcatgtcaagtacaaacctggcggcagcgcaaaagatg

SEQ ID NO: 156026 - DNA, 103 bp, Artificial Sequence
  Synthetic Polynucleotide
taatacgactcactatagggtcatgcggctcgttgtactccgtgtacttgaacagaggagacaagtaatgggagtacaaaacctggcggcagcgcaaaagatg

SEQ ID NO: 156027 - DNA, 103 bp, Artificial Sequence
  Synthetic Polynucleotide
taatacgactcactatagggtgtccggctctcatgcggctcgttgtactcaacagaggagagagtacatggagccgcataacctggcggcagcgcaaaagatg

SEQ ID NO: 156028 - DNA, 103 bp, Artificial Sequence
  Synthetic Polynucleotide
taatacgactcactatagggtgtctgagtttgtccggctctcatgcggctaacagaggagaagccgcatgagagccggaaacctggcggcagcgcaaaagatg

SEQ ID NO: 156029 - DNA, 103 bp, Artificial Sequence
  Synthetic Polynucleotide
taatacgactcactataggggtctccacgatgtctgagtttgtccggctcaacagaggagagagccgatgaaactcagaaacctggcggcagcgcaaaagatg

SEQ ID NO: 156030 - DNA, 103 bp, Artificial Sequence
  Synthetic Polynucleotide
taatacgactcactatagggctttctcaacgtctccacgatgtctgagttaacagaggagaaactcaatgatcgtggagaacctggcggcagcgcaaaagatg

SEQ ID NO: 156031 - DNA, 103 bp, Artificial Sequence
  Synthetic Polynucleotide
taatacgactcactatagggtaaggcccttctttctcaacgtctccacgaaacagaggagatcgtggatgcgttgagaaaacctggcggcagcgcaaaagatg

SEQ ID NO: 156032 - DNA, 103 bp, Artificial Sequence
  Synthetic Polynucleotide
taatacgactcactatagggtcacagccattaaggcccttctttctcaacaacagaggagagttgagatggaagggcctaacctggcggcagcgcaaaagatg

SEQ ID NO: 156033 - DNA, 103 bp, Artificial Sequence
  Synthetic Polynucleotide
taatacgactcactataggggtctgggctgtcacagccattaaggcccttaacagaggagaaagggcatgaatggctgtaacctggcggcagcgcaaaagatg

SEQ ID NO: 156034 - DNA, 103 bp, Artificial Sequence
  Synthetic Polynucleotide
taatacgactcactatagggccgcatcggggtctgggctgtcacagccataacagaggagaatggctatgacagcccagaacctggcggcagcgcaaaagatg

SEQ ID NO: 156035 - DNA, 103 bp, Artificial Sequence
  Synthetic Polynucleotide
taatacgactcactatagggctgttacgttcatccataatcctcgtaatcaacagaggagagattacatggattatggaaacctggcggcagcgcaaaagatg

SEQ ID NO: 156036 - DNA, 103 bp, Artificial Sequence
  Synthetic Polynucleotide
taatacgactcactataggggcggaatcgtccgcatcggggtctgggctgaacagaggagacagcccatgccccgatgcaacctggcggcagcgcaaaagatg

SEQ ID NO: 156037 - DNA, 103 bp, Artificial Sequence
  Synthetic Polynucleotide
taatacgactcactatagggcttgttcaatgcggaatcgtccgcatcgggaacagaggagacccgatatggacgattccaacctggcggcagcgcaaaagatg

SEQ ID NO: 156038 - DNA, 103 bp, Artificial Sequence
  Synthetic Polynucleotide
taatacgactcactatagggtgttttctttcttgttcaatgcggaatcgtaacagaggagaacgattatgcattgaacaaacctggcggcagcgcaaaagatg

SEQ ID NO: 156039 - DNA, 103 bp, Artificial Sequence
  Synthetic Polynucleotide
taatacgactcactatagggtcacagcctttgttttctttcttgttcaataacagaggagaattgaaatggaaagaaaaaacctggcggcagcgcaaaagatg

SEQ ID NO: 156040 - DNA, 103 bp, Artificial Sequence
  Synthetic Polynucleotide
taatacgactcactatagggatcggggctttcacagcctttgttttctttaacagaggagaaaagaaatgaaaggctgtaacctggcggcagcgcaaaagatg

SEQ ID NO: 156041 - DNA, 103 bp, Artificial Sequence
  Synthetic Polynucleotide
taatacgactcactatagggaggagtcgggatcggggctttcacagccttaacagaggagaaaggctatgaaagccccgaacctggcggcagcgcaaaagatg

SEQ ID NO: 156042 - DNA, 103 bp, Artificial Sequence
  Synthetic Polynucleotide
taatacgactcactatagggagtgcataagaggagtcgggatcggggcttaacagaggagaaagcccatgtcccgactcaacctggcggcagcgcaaaagatg

SEQ ID NO: 156043 - DNA, 103 bp, Artificial Sequence
  Synthetic Polynucleotide
taatacgactcactataggggcgtggggtgagtgcataagaggagtcgggaacagaggagacccgacatgtcttatgcaaacctggcggcagcgcaaaagatg

SEQ ID NO: 156044 - DNA, 103 bp, Artificial Sequence
  Synthetic Polynucleotide
taatacgactcactatagggtttcttcagtgcgtggggtgagtgcataagaacagaggagacttatgatgtcaccccacaacctggcggcagcgcaaaagatg

SEQ ID NO: 156045 - DNA, 103 bp, Artificial Sequence
  Synthetic Polynucleotide
taatacgactcactatagggtttttgtatttttcttcagtgcgtggggtgaacagaggagacaccccatgcactgaagaaacctggcggcagcgcaaaagatg

SEQ ID NO: 156046 - DNA, 103 bp, Artificial Sequence
  Synthetic Polynucleotide
taatacgactcactatagggtgtcacctgtctgttacgttcatccataataacagaggagaattatgatggaacgtaacaacctggcggcagcgcaaaagatg

SEQ ID NO: 156047 - DNA, 103 bp, Artificial Sequence
  Synthetic Polynucleotide
taatacgactcactatagggttcattaatttttttgtatttttcttcagtaacagaggagaactgaaatgaaatacaaaaacctggcggcagcgcaaaagatg

SEQ ID NO: 156048 - DNA, 103 bp, Artificial Sequence
  Synthetic Polynucleotide
taatacgactcactatagggtatcaaattcttcattaatttttttgtattaacagaggagaaatacaatgaaattaatgaacctggcggcagcgcaaaagatg

SEQ ID NO: 156049 - DNA, 103 bp, Artificial Sequence
  Synthetic Polynucleotide
taatacgactcactatagggttgatcatattatcaaattcttcattaattaacagaggagaaattaaatgagaatttgaaacctggcggcagcgcaaaagatg

SEQ ID NO: 156050 - DNA, 103 bp, Artificial Sequence
  Synthetic Polynucleotide
taatacgactcactatagggtttatgactcttgatcatattatcaaattcaacagaggagagaatttatgaatatgatcaacctggcggcagcgcaaaagatg

SEQ ID NO: 156051 - DNA, 103 bp, Artificial Sequence
  Synthetic Polynucleotide
taatacgactcactatagggcagcaggaattttatgactcttgatcatataacagaggagaatatgaatgagagtcataaacctggcggcagcgcaaaagatg

SEQ ID NO: 156052 - DNA, 103 bp, Artificial Sequence
  Synthetic Polynucleotide
taatacgactcactatagggggaggtggaacagcaggaattttatgactcaacagaggagagagtcaatgaattcctgcaacctggcggcagcgcaaaagatg

SEQ ID NO: 156053 - DNA, 103 bp, Artificial Sequence
  Synthetic Polynucleotide
taatacgactcactatagggctcgaagttgggaggtggaacagcaggaataacagaggagaattcctatggttccacctaacctggcggcagcgcaaaagatg

SEQ ID NO: 156054 - DNA, 103 bp, Artificial Sequence
  Synthetic Polynucleotide
taatacgactcactatagggagactggcatctcgaagttgggaggtggaaaacagaggagattccacatgccaacttcgaacctggcggcagcgcaaaagatg

SEQ ID NO: 156055 - DNA, 103 bp, Artificial Sequence
  Synthetic Polynucleotide
taatacgactcactatagggactgggatggagactggcatctcgaagttgaacagaggagacaacttatggatgccagtaacctggcggcagcgcaaaagatg

SEQ ID NO: 156056 - DNA, 103 bp, Artificial Sequence
  Synthetic Polynucleotide
taatacgactcactataggggtggctggacactgggatggagactggcataacagaggagaatgccaatgtccatcccaaacctggcggcagcgcaaaagatg

SEQ ID NO: 156057 - DNA, 103 bp, Artificial Sequence
  Synthetic Polynucleotide
taatacgactcactatagggtctttgtaaatgtcacctgtctgttacgttaacagaggagaaacgtaatggacaggtgaaacctggcggcagcgcaaaagatg

SEQ ID NO: 156058 - DNA, 103 bp, Artificial Sequence
  Synthetic Polynucleotide
taatacgactcactatagggccaaactgttgtggctggacactgggatggaacagaggagaccatccatgtgtccagccaacctggcggcagcgcaaaagatg

SEQ ID NO: 156059 - DNA, 103 bp, Artificial Sequence
  Synthetic Polynucleotide
taatacgactcactatagggttgctgtacaccaaactgttgtggctggacaacagaggagagtccagatgcaacagtttaacctggcggcagcgcaaaagatg

SEQ ID NO: 156060 - DNA, 103 bp, Artificial Sequence
  Synthetic Polynucleotide
taatacgactcactataggggctgacagggttgctgtacaccaaactgttaacagaggagaaacagtatggtgtacagcaacctggcggcagcgcaaaagatg

SEQ ID NO: 156061 - DNA, 103 bp, Artificial Sequence
  Synthetic Polynucleotide
taatacgactcactatagggttcccagtgagctgacagggttgctgtacaaacagaggagatgtacaatgaccctgtcaaacctggcggcagcgcaaaagatg

SEQ ID NO: 156062 - DNA, 103 bp, Artificial Sequence
  Synthetic Polynucleotide
taatacgactcactatagggaggttggggtttcccagtgagctgacagggaacagaggagaccctgtatgctcactgggaacctggcggcagcgcaaaagatg

SEQ ID NO: 156063 - DNA, 103 bp, Artificial Sequence
  Synthetic Polynucleotide
taatacgactcactatagggcagtggcaataggttggggtttcccagtgaaacagaggagatcactgatgaaccccaacaacctggcggcagcgcaaaagatg

SEQ ID NO: 156064 - DNA, 103 bp, Artificial Sequence
  Synthetic Polynucleotide
taatacgactcactatagggaagggtgagccagtggcaataggttggggtaacagaggagaaccccaatgtattgccacaacctggcggcagcgcaaaagatg

SEQ ID NO: 156065 - DNA, 103 bp, Artificial Sequence
  Synthetic Polynucleotide
taatacgactcactatagggctctgcagagaagggtgagccagtggcaataacagaggagaattgccatgggctcacccaacctggcggcagcgcaaaagatg

SEQ ID NO: 156066 - DNA, 103 bp, Artificial Sequence
  Synthetic Polynucleotide
taatacgactcactatagggcatactattcctctgcagagaagggtgagcaacagaggagagctcacatgtctctgcagaacctggcggcagcgcaaaagatg

SEQ ID NO: 156067 - DNA, 103 bp, Artificial Sequence
  Synthetic Polynucleotide
taatacgactcactatagggcaccaggagacatactattcctctgcagagaacagaggagactctgcatgggaatagtaaacctggcggcagcgcaaaagatg

SEQ ID NO: 156068 - DNA, 103 bp, Artificial Sequence
  Synthetic Polynucleotide
taatacgactcactatagggccaaatttcctctttgtaaatgtcacctgtaacagaggagaacaggtatgatttacaaaaacctggcggcagcgcaaaagatg

SEQ ID NO: 156069 - DNA, 103 bp, Artificial Sequence
  Synthetic Polynucleotide
taatacgactcactatagggcgatgtgttacaccaggagacatactattcaacagaggagagaatagatggtctcctggaacctggcggcagcgcaaaagatg

SEQ ID NO: 156070 - DNA, 103 bp, Artificial Sequence
  Synthetic Polynucleotide
taatacgactcactatagggacttggaggtcgatgtgttacaccaggagaaacagaggagatctcctatggtaacacataacctggcggcagcgcaaaagatg

SEQ ID NO: 156071 - DNA, 103 bp, Artificial Sequence
  Synthetic Polynucleotide
taatacgactcactatagggtgttacctgcacttggaggtcgatgtgttaaacagaggagataacacatggacctccaaaacctggcggcagcgcaaaagatg

SEQ ID NO: 156072 - DNA, 103 bp, Artificial Sequence
  Synthetic Polynucleotide
taatacgactcactatagggagaccacctgtgttacctgcacttggaggtaacagaggagaacctccatgtgcaggtaaaacctggcggcagcgcaaaagatg

SEQ ID NO: 156073 - DNA, 103 bp, Artificial Sequence
  Synthetic Polynucleotide
taatacgactcactatagggtccacccatcagaccacctgtgttacctgcaacagaggagagcaggtatgacaggtggtaacctggcggcagcgcaaaagatg

SEQ ID NO: 156074 - DNA, 103 bp, Artificial Sequence
  Synthetic Polynucleotide
taatacgactcactatagggacgtgaggtctccacccatcagaccacctgaacagaggagacaggtgatgtgatgggtgaacctggcggcagcgcaaaagatg

SEQ ID NO: 156075 - DNA, 103 bp, Artificial Sequence
  Synthetic Polynucleotide
taatacgactcactatagggcctgcaccagacgtgaggtctccacccatcaacagaggagagatgggatgagacctcacaacctggcggcagcgcaaaagatg

SEQ ID NO: 156076 - DNA, 103 bp, Artificial Sequence
  Synthetic Polynucleotide
taatacgactcactatagggtgcactggtgcctgcaccagacgtgaggtcaacagaggagagacctcatgtctggtgcaaacctggcggcagcgcaaaagatg

SEQ ID NO: 156077 - DNA, 103 bp, Artificial Sequence
  Synthetic Polynucleotide
taatacgactcactatagggacccgttccctgcactggtgcctgcaccagaacagaggagactggtgatggcaccagtgaacctggcggcagcgcaaaagatg

SEQ ID NO: 156078 - DNA, 103 bp, Artificial Sequence
  Synthetic Polynucleotide
taatacgactcactatagggggattgccatacccgttccctgcactggtgaacagaggagacaccagatgagggaacggaacctggcggcagcgcaaaagatg

SEQ ID NO: 156079 - DNA, 103 bp, Artificial Sequence
  Synthetic Polynucleotide
taatacgactcactatagggcttcatcaacccaaatttcctctttgtaaaaacagaggagatttacaatgaggaaatttaacctggcggcagcgcaaaagatg

SEQ ID NO: 156080 - DNA, 103 bp, Artificial Sequence
  Synthetic Polynucleotide
taatacgactcactatagggtgagtttcggggattgccatacccgttcccaacagaggagagggaacatgtatggcaataacctggcggcagcgcaaaagatg

SEQ ID NO: 156081 - DNA, 103 bp, Artificial Sequence
  Synthetic Polynucleotide
taatacgactcactataggggcagacctggtgagtttcggggattgccataacagaggagaatggcaatgcccgaaactaacctggcggcagcgcaaaagatg

SEQ ID NO: 156082 - DNA, 103 bp, Artificial Sequence
  Synthetic Polynucleotide
taatacgactcactatagggggtgagaccagcagacctggtgagtttcggaacagaggagaccgaaaatgaccaggtctaacctggcggcagcgcaaaagatg

SEQ ID NO: 156083 - DNA, 103 bp, Artificial Sequence
  Synthetic Polynucleotide
taatacgactcactatagggcaagttaccaggtgagaccagcagacctggaacagaggagaccaggtatgctggtctcaaacctggcggcagcgcaaaagatg

SEQ ID NO: 156084 - DNA, 103 bp, Artificial Sequence
  Synthetic Polynucleotide
taatacgactcactatagggtattcttgttcaagttaccaggtgagaccaaacagaggagatggtctatgctggtaactaacctggcggcagcgcaaaagatg

SEQ ID NO: 156085 - DNA, 103 bp, Artificial Sequence
  Synthetic Polynucleotide
taatacgactcactatagggtttgcttgcatattcttgttcaagttaccaaacagaggagatggtaaatggaacaagaaaacctggcggcagcgcaaaagatg

SEQ ID NO: 156086 - DNA, 103 bp, Artificial Sequence
  Synthetic Polynucleotide
taatacgactcactataggggggaggagattttgcttgcatattcttgttaacagaggagaaacaagatgatgcaagcaaacctggcggcagcgcaaaagatg

SEQ ID NO: 156087 - DNA, 103 bp, Artificial Sequence
  Synthetic Polynucleotide
taatacgactcactatagggaattcattgggggaggagattttgcttgcaaacagaggagatgcaagatgaatctcctcaacctggcggcagcgcaaaagatg

SEQ ID NO: 156088 - DNA, 103 bp, Artificial Sequence
  Synthetic Polynucleotide
taatacgactcactatagggttcattcctaaattcattgggggaggagataacagaggagaatctccatgcccaatgaaaacctggcggcagcgcaaaagatg

SEQ ID NO: 156089 - DNA, 103 bp, Artificial Sequence
  Synthetic Polynucleotide
taatacgactcactatagggtttacggttattcattcctaaattcattggaacagaggagaccaatgatgttaggaatgaacctggcggcagcgcaaaagatg

SEQ ID NO: 156090 - DNA, 103 bp, Artificial Sequence
  Synthetic Polynucleotide
taatacgactcactatagggcataagccttcttcatcaacccaaatttccaacagaggagaggaaatatgggttgatgaaacctggcggcagcgcaaaagatg

SEQ ID NO: 156091 - DNA, 103 bp, Artificial Sequence
  Synthetic Polynucleotide
taatacgactcactatagggggagatctggtttacggttattcattcctaaacagaggagataggaaatgataaccgtaaacctggcggcagcgcaaaagatg

SEQ ID NO: 156092 - DNA, 103 bp, Artificial Sequence
  Synthetic Polynucleotide
taatacgactcactatagggataagaactcggagatctggtttacggttaaacagaggagataaccgatgaccagatctaacctggcggcagcgcaaaagatg

SEQ ID NO: 156093 - DNA, 103 bp, Artificial Sequence
  Synthetic Polynucleotide
taatacgactcactataggggcctggtggaataagaactcggagatctggaacagaggagaccagatatgcgagttcttaacctggcggcagcgcaaaagatg

SEQ ID NO: 156094 - DNA, 103 bp, Artificial Sequence
  Synthetic Polynucleotide
taatacgactcactatagggtattcttgctgcctggtggaataagaactcaacagaggagagagttcatgttccaccagaacctggcggcagcgcaaaagatg

SEQ ID NO: 156095 - DNA, 103 bp, Artificial Sequence
  Synthetic Polynucleotide
taatacgactcactataggggatggcatcgtattcttgctgcctggtggaaacagaggagatccaccatgcagcaagaaaacctggcggcagcgcaaaagatg

SEQ ID NO: 156096 - DNA, 103 bp, Artificial Sequence
  Synthetic Polynucleotide
taatacgactcactatagggttgattcactgatggcatcgtattcttgctaacagaggagaagcaagatgacgatgccaaacctggcggcagcgcaaaagatg

SEQ ID NO: 156097 - DNA, 103 bp, Artificial Sequence
  Synthetic Polynucleotide
taatacgactcactatagggtatttatcctttgattcactgatggcatcgaacagaggagacgatgcatgcagtgaatcaacctggcggcagcgcaaaagatg

SEQ ID NO: 156098 - DNA, 103 bp, Artificial Sequence
  Synthetic Polynucleotide
taatacgactcactataggggactgggagttatttatcctttgattcactaacagaggagaagtgaaatgaaggataaaaacctggcggcagcgcaaaagatg

SEQ ID NO: 156099 - DNA, 103 bp, Artificial Sequence
  Synthetic Polynucleotide
taatacgactcactatagggtgactgagccgactgggagttatttatcctaacagaggagaaggataatgaactcccagaacctggcggcagcgcaaaagatg

SEQ ID NO: 156100 - DNA, 103 bp, Artificial Sequence
  Synthetic Polynucleotide
taatacgactcactataggggggtagccaatgactgagccgactgggagtaacagaggagaactcccatgcggctcagtaacctggcggcagcgcaaaagatg

SEQ ID NO: 156101 - DNA, 103 bp, Artificial Sequence
  Synthetic Polynucleotide
taatacgactcactatagggacgctcagctcataagccttcttcatcaacaacagaggagagttgatatggaaggcttaaacctggcggcagcgcaaaagatg

SEQ ID NO: 156102 - DNA, 103 bp, Artificial Sequence
  Synthetic Polynucleotide
taatacgactcactataggggaaaccactggggtagccaatgactgagccaacagaggagaggctcaatgattggctacaacctggcggcagcgcaaaagatg

SEQ ID NO: 156103 - DNA, 103 bp, Artificial Sequence
  Synthetic Polynucleotide
taatacgactcactatagggagttgctacggaaaccactggggtagccaaaacagaggagattggctatgccagtggttaacctggcggcagcgcaaaagatg

SEQ ID NO: 156104 - DNA, 103 bp, Artificial Sequence
  Synthetic Polynucleotide
taatacgactcactataggggtaaagtaggagttgctacggaaaccactgaacagaggagacagtggatgccgtagcaaaacctggcggcagcgcaaaagatg

SEQ ID NO: 156105 - DNA, 103 bp, Artificial Sequence
  Synthetic Polynucleotide
taatacgactcactatagggccttgtcctggtaaagtaggagttgctacgaacagaggagacgtagcatgtcctactttaacctggcggcagcgcaaaagatg

SEQ ID NO: 156106 - DNA, 103 bp, Artificial Sequence
  Synthetic Polynucleotide
taatacgactcactatagggtcctcccattccttgtcctggtaaagtaggaacagaggagacctactatgccaggacaaaacctggcggcagcgcaaaagatg

SEQ ID NO: 156107 - DNA, 103 bp, Artificial Sequence
  Synthetic Polynucleotide
taatacgactcactatagggctgatggatatcctcccattccttgtcctgaacagaggagacaggacatggaatgggagaacctggcggcagcgcaaaagatg

SEQ ID NO: 156108 - DNA, 103 bp, Artificial Sequence
  Synthetic Polynucleotide
taatacgactcactataggggttgaaatggctgatggatatcctcccattaacagaggagaaatgggatgatatccatcaacctggcggcagcgcaaaagatg

SEQ ID NO: 156109 - DNA, 103 bp, Artificial Sequence
  Synthetic Polynucleotide
taatacgactcactatagggaccatatgttgttgaaatggctgatggataaacagaggagatatccaatggccatttcaaacctggcggcagcgcaaaagatg

SEQ ID NO: 156110 - DNA, 103 bp, Artificial Sequence
  Synthetic Polynucleotide
taatacgactcactatagggagtactcggtaccatatgttgttgaaatggaacagaggagaccatttatgcaacatatgaacctggcggcagcgcaaaagatg

SEQ ID NO: 156111 - DNA, 103 bp, Artificial Sequence
  Synthetic Polynucleotide
taatacgactcactatagggctactcagagagtactcggtaccatatgttaacagaggagaaacataatgtaccgagtaaacctggcggcagcgcaaaagatg

SEQ ID NO: 156112 - DNA, 103 bp, Artificial Sequence
  Synthetic Polynucleotide
taatacgactcactatagggtcgctggatctgaatctttttcctccccataacagaggagaatggggatgaaaaagattaacctggcggcagcgcaaaagatg

SEQ ID NO: 156113 - DNA, 103 bp, Artificial Sequence
  Synthetic Polynucleotide
taatacgactcactataggggtcacatagcacgctcagctcatacgccttaacagaggagaaaggcgatggagctgagcaacctggcggcagcgcaaaagatg

SEQ ID NO: 156114 - DNA, 103 bp, Artificial Sequence
  Synthetic Polynucleotide
taatacgactcactatagggggtcaactggtaatctgtgttgtaggcagtaacagaggagaactgccatgaacacagataacctggcggcagcgcaaaagatg

SEQ ID NO: 156115 - DNA, 103 bp, Artificial Sequence
  Synthetic Polynucleotide
taatacgactcactataggggctctgcactggtcaactggtaatctgtgtaacagaggagaacacagatgaccagttgaaacctggcggcagcgcaaaagatg

SEQ ID NO: 156116 - DNA, 103 bp, Artificial Sequence
  Synthetic Polynucleotide
taatacgactcactatagggaaggaggagagctctgcactggtcaactggaacagaggagaccagttatgcagtgcagaaacctggcggcagcgcaaaagatg

SEQ ID NO: 156117 - DNA, 103 bp, Artificial Sequence
  Synthetic Polynucleotide
taatacgactcactatagggaaaggctggtaaggaggagagctctgcactaacagaggagaagtgcaatgctctcctccaacctggcggcagcgcaaaagatg

SEQ ID NO: 156118 - DNA, 103 bp, Artificial Sequence
  Synthetic Polynucleotide
taatacgactcactatagggcaggtgaactaaaggctggtaaggaggagaaacagaggagatctcctatgtaccagcctaacctggcggcagcgcaaaagatg

SEQ ID NO: 156119 - DNA, 103 bp, Artificial Sequence
  Synthetic Polynucleotide
taatacgactcactataggggacagccccccaggtgaactaaaggctggtaacagaggagaaccagcatgtagttcaccaacctggcggcagcgcaaaagatg

SEQ ID NO: 156120 - DNA, 103 bp, Artificial Sequence
  Synthetic Polynucleotide
taatacgactcactatagggattgcctagcgacagccccccaggtgaactaacagaggagaagttcaatgggggggctgaacctggcggcagcgcaaaagatg

SEQ ID NO: 156121 - DNA, 103 bp, Artificial Sequence
  Synthetic Polynucleotide
taatacgactcactatagggaggcagtgacattgcctagcgacagcccccaacagaggagagggggcatgcgctaggcaaacctggcggcagcgcaaaagatg

SEQ ID NO: 156122 - DNA, 103 bp, Artificial Sequence
  Synthetic Polynucleotide
taatacgactcactatagggggctgttgccaggcagtgacattgcctagcaacagaggagagctaggatgtgtcactgcaacctggcggcagcgcaaaagatg

SEQ ID NO: 156123 - DNA, 103 bp, Artificial Sequence
  Synthetic Polynucleotide
taatacgactcactataggggggctgctgtggctgttgccaggcagtgacaacagaggagagtcactatgtggcaacagaacctggcggcagcgcaaaagatg

SEQ ID NO: 156124 - DNA, 103 bp, Artificial Sequence
  Synthetic Polynucleotide
taatacgactcactatagggcgatctcgcagtcacatagcacgctcagctaacagaggagaagctgaatgtgctatgtgaacctggcggcagcgcaaaagatg

SEQ ID NO: 156125 - DNA, 103 bp, Artificial Sequence
  Synthetic Polynucleotide
taatacgactcactataggggcggctgctggggctgctgtggctgttgccaacagaggagaggcaacatgcacagcagcaacctggcggcagcgcaaaagatg

SEQ ID NO: 156126 - DNA, 103 bp, Artificial Sequence
  Synthetic Polynucleotide
taatacgactcactatagggtgtggctgctgcggctgctggggctgctgtaacagaggagaacagcaatgccagcagccaacctggcggcagcgcaaaagatg

SEQ ID NO: 156127 - DNA, 103 bp, Artificial Sequence
  Synthetic Polynucleotide
taatacgactcactatagggctgtggaggctgtggctgctgcggctgctgaacagaggagacagcagatgcagcagccaaacctggcggcagcgcaaaagatg

SEQ ID NO: 156128 - DNA, 103 bp, Artificial Sequence
  Synthetic Polynucleotide
taatacgactcactataggggtggctgctgctgtggaggctgtggctgctaacagaggagaagcagcatgagcctccacaacctggcggcagcgcaaaagatg

SEQ ID NO: 156129 - DNA, 103 bp, Artificial Sequence
  Synthetic Polynucleotide
taatacgactcactatagggtgtggctgcggtggctgctgctgtggaggcaacagaggagagcctccatggcagcagccaacctggcggcagcgcaaaagatg

SEQ ID NO: 156130 - DNA, 103 bp, Artificial Sequence
  Synthetic Polynucleotide
taatacgactcactatagggctgtggctgctgtggctgcggtggctgctgaacagaggagacagcagatgccgcagccaaacctggcggcagcgcaaaagatg

SEQ ID NO: 156131 - DNA, 103 bp, Artificial Sequence
  Synthetic Polynucleotide
taatacgactcactataggggctgctgtggctgtggctgctgtggctgcgaacagaggagacgcagcatgagcagccacaacctggcggcagcgcaaaagatg

SEQ ID NO: 156132 - DNA, 103 bp, Artificial Sequence
  Synthetic Polynucleotide
taatacgactcactatagggggctgctgaggctgctgtggctgtggctgcaacagaggagagcagccatggccacagcaaacctggcggcagcgcaaaagatg

SEQ ID NO: 156133 - DNA, 103 bp, Artificial Sequence
  Synthetic Polynucleotide
taatacgactcactatagggtggctgttgcggctgctgaggctgctgtggaacagaggagaccacagatgcctcagcagaacctggcggcagcgcaaaagatg

SEQ ID NO: 156134 - DNA, 103 bp, Artificial Sequence
  Synthetic Polynucleotide
taatacgactcactataggggttgctgaggtggctgttgcggctgctgagaacagaggagactcagcatgcgcaacagcaacctggcggcagcgcaaaagatg

SEQ ID NO: 156135 - DNA, 103 bp, Artificial Sequence
  Synthetic Polynucleotide
taatacgactcactatagggatgatgagtgcgatctcgcagtcacatagcaacagaggagagctatgatgctgcgagataacctggcggcagcgcaaaagatg

SEQ ID NO: 156136 - DNA, 103 bp, Artificial Sequence
  Synthetic Polynucleotide
taatacgactcactatagggaggtgggactgttgctgaggtggctgttgcaacagaggagagcaacaatgacctcagcaaacctggcggcagcgcaaaagatg

SEQ ID NO: 156137 - DNA, 103 bp, Artificial Sequence
  Synthetic Polynucleotide
taatacgactcactatagggtacagggaccaggtgggactgttgctgaggaacagaggagacctcagatgcagtcccacaacctggcggcagcgcaaaagatg

SEQ ID NO: 156138 - DNA, 103 bp, Artificial Sequence
  Synthetic Polynucleotide
taatacgactcactatagggtgctgagagatacagggaccaggtgggactaacagaggagaagtcccatgtggtccctgaacctggcggcagcgcaaaagatg

SEQ ID NO: 156139 - DNA, 103 bp, Artificial Sequence
  Synthetic Polynucleotide
taatacgactcactataggggggatgaggttgctgagagatacagggaccaacagaggagaggtcccatgatctctcagaacctggcggcagcgcaaaagatg

SEQ ID NO: 156140 - DNA, 103 bp, Artificial Sequence
  Synthetic Polynucleotide
taatacgactcactatagggggggctgcccgggatgaggttgctgagagaaacagaggagatctctcatgaacctcatcaacctggcggcagcgcaaaagatg

SEQ ID NO: 156141 - DNA, 103 bp, Artificial Sequence
  Synthetic Polynucleotide
taatacgactcactatagggcgtggggcagggggctgcccgggatgaggtaacagaggagaacctcaatgcgggcagccaacctggcggcagcgcaaaagatg

SEQ ID NO: 156142 - DNA, 103 bp, Artificial Sequence
  Synthetic Polynucleotide
taatacgactcactataggggcagcacccacgtggggcagggggctgcccaacagaggagagggcagatgcctgccccaaacctggcggcagcgcaaaagatg

SEQ ID NO: 156143 - DNA, 103 bp, Artificial Sequence
  Synthetic Polynucleotide
taatacgactcactataggggactgtgagggcagcacccacgtggggcagaacagaggagactgcccatggtgggtgctaacctggcggcagcgcaaaagatg

SEQ ID NO: 156144 - DNA, 103 bp, Artificial Sequence
  Synthetic Polynucleotide
taatacgactcactatagggggtgggtggtgactgtgagggcagcacccaaacagaggagatgggtgatgccctcacagaacctggcggcagcgcaaaagatg

SEQ ID NO: 156145 - DNA, 103 bp, Artificial Sequence
  Synthetic Polynucleotide
taatacgactcactatagggctgatgtgggggtgggtggtgactgtgaggaacagaggagacctcacatgcaccacccaaacctggcggcagcgcaaaagatg

SEQ ID NO: 156146 - DNA, 103 bp, Artificial Sequence
  Synthetic Polynucleotide
taatacgactcactataggggtggttgaagatgatgagtgcgatctcgcaaacagaggagatgcgagatggcactcatcaacctggcggcagcgcaaaagatg

SEQ ID NO: 156147 - DNA, 103 bp, Artificial Sequence
  Synthetic Polynucleotide
taatacgactcactatagggtgacttgatgctgatgtgggggtgggtggtaacagaggagaaccaccatgccccacatcaacctggcggcagcgcaaaagatg

SEQ ID NO: 156148 - DNA, 103 bp, Artificial Sequence
  Synthetic Polynucleotide
taatacgactcactatagggacaccggttctgacttgatgctgatgtgggaacagaggagacccacaatggcatcaagtaacctggcggcagcgcaaaagatg

SEQ ID NO: 156149 - DNA, 103 bp, Artificial Sequence
  Synthetic Polynucleotide
taatacgactcactatagggcggcttggggacaccggttctgacttgatgaacagaggagacatcaaatgagaaccggtaacctggcggcagcgcaaaagatg

SEQ ID NO: 156150 - DNA, 103 bp, Artificial Sequence
  Synthetic Polynucleotide
taatacgactcactataggggctgcgctcacggcttggggacaccggttcaacagaggagagaaccgatgtccccaagcaacctggcggcagcgcaaaagatg

SEQ ID NO: 156151 - DNA, 103 bp, Artificial Sequence
  Synthetic Polynucleotide
taatacgactcactataggggaggcgcagggctgcgctcacggcttggggaacagaggagaccccaaatggtgagcgcaaacctggcggcagcgcaaaagatg

SEQ ID NO: 156152 - DNA, 103 bp, Artificial Sequence
  Synthetic Polynucleotide
taatacgactcactataggggctggagggggaggcgcagggctgcgctcaaacagaggagatgagcgatgccctgcgccaacctggcggcagcgcaaaagatg

SEQ ID NO: 156153 - DNA, 103 bp, Artificial Sequence
  Synthetic Polynucleotide
taatacgactcactatagggtgggaacacagctggagggggaggcgcaggaacagaggagacctgcgatgccccctccaaacctggcggcagcgcaaaagatg

SEQ ID NO: 156154 - DNA, 103 bp, Artificial Sequence
  Synthetic Polynucleotide
taatacgactcactatagggggcgggcagctgggaacacagctggaggggaacagaggagacccctcatgctgtgttccaacctggcggcagcgcaaaagatg

SEQ ID NO: 156155 - DNA, 103 bp, Artificial Sequence
  Synthetic Polynucleotide
taatacgactcactatagggccaggctcagggcgggcagctgggaacacaaacagaggagatgtgttatgagctgcccgaacctggcggcagcgcaaaagatg

SEQ ID NO: 156156 - DNA, 103 bp, Artificial Sequence
  Synthetic Polynucleotide
taatacgactcactataggggagaccatcgccaggctcagggcgggcagcaacagaggagagctgccatgcctgagcctaacctggcggcagcgcaaaagatg

SEQ ID NO: 156157 - DNA, 103 bp, Artificial Sequence
  Synthetic Polynucleotide
taatacgactcactataggggcttgttggagtggttgaagatgatgagtgaacagaggagacactcaatgtcttcaaccaacctggcggcagcgcaaaagatg

SEQ ID NO: 156158 - DNA, 103 bp, Artificial Sequence
  Synthetic Polynucleotide
taatacgactcactatagggctgggctgctgagaccatcgccaggctcagaacagaggagactgagcatggcgatggtcaacctggcggcagcgcaaaagatg

SEQ ID NO: 156159 - DNA, 103 bp, Artificial Sequence
  Synthetic Polynucleotide
taatacgactcactataggggatcccccggctgggctgctgagaccatcgaacagaggagacgatggatgcagcagcccaacctggcggcagcgcaaaagatg

SEQ ID NO: 156160 - DNA, 103 bp, Artificial Sequence
  Synthetic Polynucleotide
taatacgactcactatagggcgtctcataggatcccccggctgggctgctaacagaggagaagcagcatggccgggggaaacctggcggcagcgcaaaagatg

SEQ ID NO: 156161 - DNA, 103 bp, Artificial Sequence
  Synthetic Polynucleotide
taatacgactcactatagggcccggtctcccgtctcataggatcccccggaacagaggagaccggggatgcctatgagaaacctggcggcagcgcaaaagatg

SEQ ID NO: 156162 - DNA, 103 bp, Artificial Sequence
  Synthetic Polynucleotide
taatacgactcactatagggcgtccgtcatcccggtctcccgtctcatagaacagaggagactatgaatggggagaccgaacctggcggcagcgcaaaagatg

SEQ ID NO: 156163 - DNA, 103 bp, Artificial Sequence
  Synthetic Polynucleotide
taatacgactcactataggggaagtccccccgtccgtcatcccggtctccaacagaggagaggagacatggatgacggaaacctggcggcagcgcaaaagatg

SEQ ID NO: 156164 - DNA, 103 bp, Artificial Sequence
  Synthetic Polynucleotide
taatacgactcactataggggtgtgggcccgaagtccccccgtccgtcataacagaggagaatgacgatgggggggactaacctggcggcagcgcaaaagatg

SEQ ID NO: 156165 - DNA, 103 bp, Artificial Sequence
  Synthetic Polynucleotide
taatacgactcactatagggagcaggcccagtgtgggcccgaagtcccccaacagaggagagggggaatgcgggcccacaacctggcggcagcgcaaaagatg

SEQ ID NO: 156166 - DNA, 103 bp, Artificial Sequence
  Synthetic Polynucleotide
taatacgactcactatagggggctgggcgcagcaggcccagtgtgggcccaacagaggagagggcccatgctgggcctgaacctggcggcagcgcaaaagatg

SEQ ID NO: 156167 - DNA, 103 bp, Artificial Sequence
  Synthetic Polynucleotide
taatacgactcactatagggcaggctctggggctgggcgcagcaggcccaaacagaggagatgggccatgtgcgcccagaacctggcggcagcgcaaaagatg

SEQ ID NO: 156168 - DNA, 103 bp, Artificial Sequence
  Synthetic Polynucleotide
taatacgactcactatagggtactggaacagcttgttggagtggttgaagaacagaggagacttcaaatgctccaacaaaacctggcggcagcgcaaaagatg

SEQ ID NO: 156169 - DNA, 103 bp, Artificial Sequence
  Synthetic Polynucleotide
taatacgactcactatagggccctcagcctcaggctctggggctgggcgcaacagaggagagcgcccatgcccagagccaacctggcggcagcgcaaaagatg

SEQ ID NO: 156170 - DNA, 103 bp, Artificial Sequence
  Synthetic Polynucleotide
taatacgactcactatagggcacagctgagccctcagcctcaggctctggaacagaggagaccagagatggaggctgagaacctggcggcagcgcaaaagatg

SEQ ID NO: 156171 - DNA, 103 bp, Artificial Sequence
  Synthetic Polynucleotide
taatacgactcactataggggcatcctcttcacagctgagccctcagcctaacagaggagaaggctgatggctcagctgaacctggcggcagcgcaaaagatg

SEQ ID NO: 156172 - DNA, 103 bp, Artificial Sequence
  Synthetic Polynucleotide
taatacgactcactataggggtatcaagccgcatcctcttcacagctgagaacagaggagactcagcatggaagaggataacctggcggcagcgcaaaagatg

SEQ ID NO: 156173 - DNA, 103 bp, Artificial Sequence
  Synthetic Polynucleotide
taatacgactcactatagggtaatgtccaggtatcaagccgcatcctcttaacagaggagaaagaggatgcggcttgataacctggcggcagcgcaaaagatg

SEQ ID NO: 156174 - DNA, 103 bp, Artificial Sequence
  Synthetic Polynucleotide
taatacgactcactatagggggtgctggcgtactggaacagcttgttggaaacagaggagatccaacatgctgttccagaacctggcggcagcgcaaaagatg

SEQ ID NO: 156175 - DNA, 103 bp, Artificial Sequence
  Synthetic Polynucleotide
taatacgactcactatagggtgtccatgtcggtgctggcgtactggaacaaacagaggagatgttccatgacgccagcaaacctggcggcagcgcaaaagatg

SEQ ID NO: 156176 - DNA, 103 bp, Artificial Sequence
  Synthetic Polynucleotide
taatacgactcactatagggagcagcaccttgtccatgtcggtgctggcgaacagaggagacgccagatgcgacatggaaacctggcggcagcgcaaaagatg

SEQ ID NO: 156177 - DNA, 103 bp, Artificial Sequence
  Synthetic Polynucleotide
taatacgactcactatagggcgtgtacttgagcagcaccttgtccatgtcaacagaggagagacatgatgaaggtgctgaacctggcggcagcgcaaaagatg

SEQ ID NO: 156178 - DNA, 103 bp, Artificial Sequence
  Synthetic Polynucleotide
taatacgactcactatagggcgtcggtgattcgctggatctgaatcttttaacagaggagaaaaagaatgagatccagcaacctggcggcagcgcaaaagatg

SEQ ID NO: 156179 - DNA, 103 bp, Artificial Sequence
  Synthetic Polynucleotide
taatacgactcactatagggcattgtactccgtgtacttgagcagcacctaacagaggagaaggtgcatgtcaagtacaaacctggcggcagcgcaaaagatg

SEQ ID NO: 156180 - DNA, 103 bp, Artificial Sequence
  Synthetic Polynucleotide
taatacgactcactatagggtcgtgtggctcattgtactccgtgtacttgaacagaggagacaagtaatgggagtacaaaacctggcggcagcgcaaaagatg

SEQ ID NO: 156181 - DNA, 103 bp, Artificial Sequence
  Synthetic Polynucleotide
taatacgactcactatagggggtgcggctctcgtgtggctcattgtactcaacagaggagagagtacatggagccacacaacctggcggcagcgcaaaagatg

SEQ ID NO: 156182 - DNA, 103 bp, Artificial Sequence
  Synthetic Polynucleotide
taatacgactcactatagggtgtcggcgttggtgcggctctcgtgtggctaacagaggagaagccacatgagagccgcaaacctggcggcagcgcaaaagatg

SEQ ID NO: 156183 - DNA, 103 bp, Artificial Sequence
  Synthetic Polynucleotide
taatacgactcactataggggtctcgatgatgtcggcgttggtgcggctcaacagaggagagagccgatgcaacgccgaaacctggcggcagcgcaaaagatg

SEQ ID NO: 156184 - DNA, 103 bp, Artificial Sequence
  Synthetic Polynucleotide
taatacgactcactatagggcttcctcagggtctcgatgatgtcggcgttaacagaggagaaacgccatgatcatcgagaacctggcggcagcgcaaaagatg

SEQ ID NO: 156185 - DNA, 103 bp, Artificial Sequence
  Synthetic Polynucleotide
taatacgactcactatagggtgaagcccttcttcctcagggtctcgatgaaacagaggagatcatcgatgccctgaggaaacctggcggcagcgcaaaagatg

SEQ ID NO: 156186 - DNA, 103 bp, Artificial Sequence
  Synthetic Polynucleotide
taatacgactcactatagggtcgcagccgttgaagcccttcttcctcaggaacagaggagacctgagatggaagggcttaacctggcggcagcgcaaaagatg

SEQ ID NO: 156187 - DNA, 103 bp, Artificial Sequence
  Synthetic Polynucleotide
taatacgactcactatagggctcggggctgtcgcagccgttgaagcccttaacagaggagaaagggcatgaacggctgcaacctggcggcagcgcaaaagatg

SEQ ID NO: 156188 - DNA, 103 bp, Artificial Sequence
  Synthetic Polynucleotide
taatacgactcactatagggccccgtcgggctcggggctgtcgcagccgtaacagaggagaacggctatgacagccccgaacctggcggcagcgcaaaagatg

SEQ ID NO: 156189 - DNA, 103 bp, Artificial Sequence
  Synthetic Polynucleotide
taatacgactcactatagggcggttccgctcgtcggtgattcgctggatcaacagaggagagatccaatgaatcaccgaaacctggcggcagcgcaaaagatg

SEQ ID NO: 156190 - DNA, 103 bp, Artificial Sequence
  Synthetic Polynucleotide
taatacgactcactatagggagcgagtcctccccgtcgggctcggggctgaacagaggagacagcccatggcccgacggaacctggcggcagcgcaaaagatg

SEQ ID NO: 156191 - DNA, 103 bp, Artificial Sequence
  Synthetic Polynucleotide
taatacgactcactataggggctctgttccagcgagtcctccccgtcgggaacagaggagacccgacatggaggactcgaacctggcggcagcgcaaaagatg

SEQ ID NO: 156192 - DNA, 103 bp, Artificial Sequence
  Synthetic Polynucleotide
taatacgactcactatagggccagcagggggctctgttccagcgagtcctaacagaggagaaggactatgtggaacagaaacctggcggcagcgcaaaagatg

SEQ ID NO: 156193 - DNA, 103 bp, Artificial Sequence
  Synthetic Polynucleotide
taatacgactcactatagggtacttgtcctccagcagggggctctgttccaacagaggagaggaacaatgccccctgctaacctggcggcagcgcaaaagatg

SEQ ID NO: 156194 - DNA, 103 bp, Artificial Sequence
  Synthetic Polynucleotide
taatacgactcactatagggggcgcgtcggtacttgtcctccagcaggggaacagaggagacccctgatggaggacaagaacctggcggcagcgcaaaagatg

SEQ ID NO: 156195 - DNA, 103 bp, Artificial Sequence
  Synthetic Polynucleotide
taatacgactcactataggggctcctcgctggcgcgtcggtacttgtcctaacagaggagaaggacaatgaccgacgcgaacctggcggcagcgcaaaagatg

SEQ ID NO: 156196 - DNA, 103 bp, Artificial Sequence
  Synthetic Polynucleotide
taatacgactcactatagggagcccgtcgagctcctcgctggcgcgtcggaacagaggagaccgacgatgcagcgaggaaacctggcggcagcgcaaaagatg

SEQ ID NO: 156197 - DNA, 103 bp, Artificial Sequence
  Synthetic Polynucleotide
taatacgactcactataggggcgccggaagagcccgtcgagctcctcgctaacagaggagaagcgagatgctcgacgggaacctggcggcagcgcaaaagatg

SEQ ID NO: 156198 - DNA, 103 bp, Artificial Sequence
  Synthetic Polynucleotide
taatacgactcactatagggttgacccatagcgccggaagagcccgtcgaaacagaggagatcgacgatgtcttccggcaacctggcggcagcgcaaaagatg

SEQ ID NO: 156199 - DNA, 103 bp, Artificial Sequence
  Synthetic Polynucleotide
taatacgactcactataggggccgggacagttgacccatagcgccggaagaacagaggagacttccgatgctatgggtcaacctggcggcagcgcaaaagatg

SEQ ID NO: 156200 - DNA, 103 bp, Artificial Sequence
  Synthetic Polynucleotide
taatacgactcactatagggagtcacctgtcggttccgctcgtcggtgataacagaggagaatcaccatggagcggaacaacctggcggcagcgcaaaagatg

SEQ ID NO: 156201 - DNA, 103 bp, Artificial Sequence
  Synthetic Polynucleotide
taatacgactcactatagggaaagttgggggccgggacagttgacccataaacagaggagatatgggatgactgtcccgaacctggcggcagcgcaaaagatg

SEQ ID NO: 156202 - DNA, 103 bp, Artificial Sequence
  Synthetic Polynucleotide
taatacgactcactatagggcaggcatggcaaagttgggggccgggacagaacagaggagactgtccatgcccccaactaacctggcggcagcgcaaaagatg

SEQ ID NO: 156203 - DNA, 103 bp, Artificial Sequence
  Synthetic Polynucleotide
taatacgactcactatagggggcaccgtgacaggcatggcaaagttggggaacagaggagaccccaaatgtgccatgccaacctggcggcagcgcaaaagatg

SEQ ID NO: 156204 - DNA, 103 bp, Artificial Sequence
  Synthetic Polynucleotide
taatacgactcactatagggattggacacgggcaccgtgacaggcatggcaacagaggagagccatgatggtcacggtgaacctggcggcagcgcaaaagatg

SEQ ID NO: 156205 - DNA, 103 bp, Artificial Sequence
  Synthetic Polynucleotide
taatacgactcactataggggtgagctctgattggacacgggcaccgtgaaacagaggagatcacggatgccgtgtccaaacctggcggcagcgcaaaagatg

SEQ ID NO: 156206 - DNA, 103 bp, Artificial Sequence
  Synthetic Polynucleotide
taatacgactcactatagggctgaactgcagtgagctctgattggacacgaacagaggagacgtgtcatgtcagagctcaacctggcggcagcgcaaaagatg

SEQ ID NO: 156207 - DNA, 103 bp, Artificial Sequence
  Synthetic Polynucleotide
taatacgactcactataggggctgggattgctgaactgcagtgagctctgaacagaggagacagagcatgctgcagttcaacctggcggcagcgcaaaagatg

SEQ ID NO: 156208 - DNA, 103 bp, Artificial Sequence
  Synthetic Polynucleotide
taatacgactcactatagggccagggagccgctgggattgctgaactgcaaacagaggagatgcagtatggcaatcccaaacctggcggcagcgcaaaagatg

SEQ ID NO: 156209 - DNA, 103 bp, Artificial Sequence
  Synthetic Polynucleotide
taatacgactcactataggggaaggggtgaccagggagccgctgggattgaacagaggagacaatccatgcggctccctaacctggcggcagcgcaaaagatg

SEQ ID NO: 156210 - DNA, 103 bp, Artificial Sequence
  Synthetic Polynucleotide
taatacgactcactatagggtgtcaccagggaaggggtgaccagggagccaacagaggagaggctccatggtcacccctaacctggcggcagcgcaaaagatg

SEQ ID NO: 156211 - DNA, 103 bp, Artificial Sequence
  Synthetic Polynucleotide
taatacgactcactataggggcttggtgaaagtcacctgtcggttccgctaacagaggagaagcggaatggacaggtgaaacctggcggcagcgcaaaagatg

SEQ ID NO: 156212 - DNA, 103 bp, Artificial Sequence
  Synthetic Polynucleotide
taatacgactcactatagggtgagggatgatgtcaccagggaaggggtgaaacagaggagatcacccatgccctggtgaaacctggcggcagcgcaaaagatg

SEQ ID NO: 156213 - DNA, 103 bp, Artificial Sequence
  Synthetic Polynucleotide
taatacgactcactatagggcgcgggtccgtgagggatgatgtcaccaggaacagaggagacctggtatgatcatccctaacctggcggcagcgcaaaagatg

SEQ ID NO: 156214 - DNA, 103 bp, Artificial Sequence
  Synthetic Polynucleotide
taatacgactcactatagggggacaggagccgcgggtccgtgagggatgaaacagaggagatcatccatgacggacccgaacctggcggcagcgcaaaagatg

SEQ ID NO: 156215 - DNA, 103 bp, Artificial Sequence
  Synthetic Polynucleotide
taatacgactcactataggggctgctggggggacaggagccgcgggtccgaacagaggagacggaccatgggctcctgtaacctggcggcagcgcaaaagatg

SEQ ID NO: 156216 - DNA, 103 bp, Artificial Sequence
  Synthetic Polynucleotide
taatacgactcactatagggtgtagtgctggctgctggggggacaggagcaacagaggagagctcctatgcccccagcaaacctggcggcagcgcaaaagatg

SEQ ID NO: 156217 - DNA, 103 bp, Artificial Sequence
  Synthetic Polynucleotide
taatacgactcactatagggactgttcctctgtagtgctggctgctggggaacagaggagaccccagatgccagcactaaacctggcggcagcgcaaaagatg

SEQ ID NO: 156218 - DNA, 103 bp, Artificial Sequence
  Synthetic Polynucleotide
taatacgactcactatagggcaggagacacactgttcctctgtagtgctgaacagaggagacagcacatgagaggaacaaacctggcggcagcgcaaaagatg

SEQ ID NO: 156219 - DNA, 103 bp, Artificial Sequence
  Synthetic Polynucleotide
taatacgactcactatagggtggggcaggccaggagacacactgttcctcaacagaggagagaggaaatgtgtgtctccaacctggcggcagcgcaaaagatg

SEQ ID NO: 156220 - DNA, 103 bp, Artificial Sequence
  Synthetic Polynucleotide
taatacgactcactatagggagctggccgctggggcaggccaggagacacaacagaggagagtgtctatgggcctgcccaacctggcggcagcgcaaaagatg

SEQ ID NO: 156221 - DNA, 103 bp, Artificial Sequence
  Synthetic Polynucleotide
taatacgactcactatagggcccccgcactagctggccgctggggcaggcaacagaggagagcctgcatgagcggccagaacctggcggcagcgcaaaagatg

SEQ ID NO: 156222 - DNA, 103 bp, Artificial Sequence
  Synthetic Polynucleotide
taatacgactcactatagggccaaacttccgcttggtgaaagtcacctgtaacagaggagaacaggtatgtttcaccaaaacctggcggcagcgcaaaagatg

SEQ ID NO: 156223 - DNA, 103 bp, Artificial Sequence
  Synthetic Polynucleotide
taatacgactcactatagggcccagcatggcccccgcactagctggccgcaacagaggagagcggccatgtagtgcgggaacctggcggcagcgcaaaagatg

SEQ ID NO: 156224 - DNA, 103 bp, Artificial Sequence
  Synthetic Polynucleotide
taatacgactcactatagggcaggtcaccccccagcatggcccccgcactaacagaggagaagtgcgatggccatgctgaacctggcggcagcgcaaaagatg

SEQ ID NO: 156225 - DNA, 103 bp, Artificial Sequence
  Synthetic Polynucleotide
taatacgactcactatagggtagcactgttcaggtcaccccccagcatggaacagaggagaccatgcatgggggtgaccaacctggcggcagcgcaaaagatg

SEQ ID NO: 156226 - DNA, 103 bp, Artificial Sequence
  Synthetic Polynucleotide
taatacgactcactatagggcaggctccgttagcactgttcaggtcacccaacagaggagagggtgaatggaacagtgcaacctggcggcagcgcaaaagatg

SEQ ID NO: 156227 - DNA, 103 bp, Artificial Sequence
  Synthetic Polynucleotide
taatacgactcactatagggagggctggggcaggctccgttagcactgttaacagaggagaaacagtatgaacggagccaacctggcggcagcgcaaaagatg

SEQ ID NO: 156228 - DNA, 103 bp, Artificial Sequence
  Synthetic Polynucleotide
taatacgactcactatagggcattcccaacagggctggggcaggctccgtaacagaggagaacggagatggccccagccaacctggcggcagcgcaaaagatg

SEQ ID NO: 156229 - DNA, 103 bp, Artificial Sequence
  Synthetic Polynucleotide
taatacgactcactatagggctgacgtagccattcccaacagggctggggaacagaggagaccccagatgtgttgggaaaacctggcggcagcgcaaaagatg

SEQ ID NO: 156230 - DNA, 103 bp, Artificial Sequence
  Synthetic Polynucleotide
taatacgactcactatagggagcccgagcactgacgtagccattcccaacaacagaggagagttgggatgggctacgtcaacctggcggcagcgcaaaagatg

SEQ ID NO: 156231 - DNA, 103 bp, Artificial Sequence
  Synthetic Polynucleotide
taatacgactcactatagggggccaggggaagcccgagcactgacgtagcaacagaggagagctacgatggtgctcgggaacctggcggcagcgcaaaagatg

SEQ ID NO: 156232 - DNA, 103 bp, Artificial Sequence
  Synthetic Polynucleotide
taatacgactcactatagggacagggaggaggccaggggaagcccgagcaaacagaggagatgctcgatgttcccctggaacctggcggcagcgcaaaagatg

SEQ ID NO: 156233 - DNA, 103 bp, Artificial Sequence
  Synthetic Polynucleotide
taatacgactcactatagggcttcatcaggccaaacttccgcttggtgaaaacagaggagattcaccatgcggaagtttaacctggcggcagcgcaaaagatg

SEQ ID NO: 156234 - DNA, 103 bp, Artificial Sequence
  Synthetic Polynucleotide
taatacgactcactataggggccattggccacagggaggaggccaggggaaacagaggagatcccctatgctcctccctaacctggcggcagcgcaaaagatg

SEQ ID NO: 156235 - DNA, 103 bp, Artificial Sequence
  Synthetic Polynucleotide
taatacgactcactatagggttaggctgttgccattggccacagggaggaaacagaggagatcctccatgtggccaatgaacctggcggcagcgcaaaagatg

SEQ ID NO: 156236 - DNA, 103 bp, Artificial Sequence
  Synthetic Polynucleotide
taatacgactcactatagggatgaccttgtttaggctgttgccattggccaacagaggagaggccaaatgcaacagcctaacctggcggcagcgcaaaagatg

SEQ ID NO: 156237 - DNA, 103 bp, Artificial Sequence
  Synthetic Polynucleotide
taatacgactcactatagggcttggcagggatgaccttgtttaggctgttaacagaggagaaacagcatgaacaaggtcaacctggcggcagcgcaaaagatg

SEQ ID NO: 156238 - DNA, 103 bp, Artificial Sequence
  Synthetic Polynucleotide
taatacgactcactatagggggggtggagacttggcagggatgaccttgtaacagaggagaacaaggatgtccctgccaaacctggcggcagcgcaaaagatg

SEQ ID NO: 156239 - DNA, 103 bp, Artificial Sequence
  Synthetic Polynucleotide
taatacgactcactatagggtgggtaggtgggggtggagacttggcagggaacagaggagaccctgcatggtctccaccaacctggcggcagcgcaaaagatg

SEQ ID NO: 156240 - DNA, 103 bp, Artificial Sequence
  Synthetic Polynucleotide
taatacgactcactatagggctgggtgctgtgggtaggtgggggtggagaaacagaggagatctccaatgccacctaccaacctggcggcagcgcaaaagatg

SEQ ID NO: 156241 - DNA, 103 bp, Artificial Sequence
  Synthetic Polynucleotide
taatacgactcactataggggggctccaagctgggtgctgtgggtaggtgaacagaggagacacctaatgacagcacccaacctggcggcagcgcaaaagatg

SEQ ID NO: 156242 - DNA, 103 bp, Artificial Sequence
  Synthetic Polynucleotide
taatacgactcactatagggttgcggctgggggctccaagctgggtgctgaacagaggagacagcacatggcttggagcaacctggcggcagcgcaaaagatg

SEQ ID NO: 156243 - DNA, 103 bp, Artificial Sequence
  Synthetic Polynucleotide
taatacgactcactatagggcaggtcgggcttgcggctgggggctccaagaacagaggagacttggaatgcccagccgcaacctggcggcagcgcaaaagatg

SEQ ID NO: 156244 - DNA, 103 bp, Artificial Sequence
  Synthetic Polynucleotide
taatacgactcactatagggcatacgccttcttcatcaggccaaacttccaacagaggagaggaagtatggcctgatgaaacctggcggcagcgcaaaagatg

SEQ ID NO: 156245 - DNA, 103 bp, Artificial Sequence
  Synthetic Polynucleotide
taatacgactcactatagggtgatgactcgcaggtcgggcttgcggctggaacagaggagaccagccatgagcccgaccaacctggcggcagcgcaaaagatg

SEQ ID NO: 156246 - DNA, 103 bp, Artificial Sequence
  Synthetic Polynucleotide
taatacgactcactataggggcctgggaagtgatgactcgcaggtcgggcaacagaggagagcccgaatggcgagtcataacctggcggcagcgcaaaagatg

SEQ ID NO: 156247 - DNA, 103 bp, Artificial Sequence
  Synthetic Polynucleotide
taatacgactcactatagggcccctttcctgcctgggaagtgatgactcgaacagaggagacgagtcatgacttcccagaacctggcggcagcgcaaaagatg

SEQ ID NO: 156248 - DNA, 103 bp, Artificial Sequence
  Synthetic Polynucleotide
taatacgactcactataggggatgcattaacccctttcctgcctgggaagaacagaggagacttcccatgcaggaaaggaacctggcggcagcgcaaaagatg

SEQ ID NO: 156249 - DNA, 103 bp, Artificial Sequence
  Synthetic Polynucleotide
taatacgactcactatagggtcagtcaagtgatgcattaacccctttcctaacagaggagaaggaaaatggttaatgcaaacctggcggcagcgcaaaagatg

SEQ ID NO: 156250 - DNA, 103 bp, Artificial Sequence
  Synthetic Polynucleotide
taatacgactcactatagggtaaatggtcctcagtcaagtgatgcattaaaacagaggagattaatgatgcacttgactaacctggcggcagcgcaaaagatg

SEQ ID NO: 156251 - DNA, 103 bp, Artificial Sequence
  Synthetic Polynucleotide
taatacgactcactatagggtgttcagatctaaatggtcctcagtcaagtaacagaggagaacttgaatgaggaccattaacctggcggcagcgcaaaagatg

SEQ ID NO: 156252 - DNA, 103 bp, Artificial Sequence
  Synthetic Polynucleotide
taatacgactcactatagggcgctgggcattgttcagatctaaatggtccaacagaggagaggaccaatgagatctgaaaacctggcggcagcgcaaaagatg

SEQ ID NO: 156253 - DNA, 103 bp, Artificial Sequence
  Synthetic Polynucleotide
taatacgactcactataggggaccccaaggcgctgggcattgttcagatcaacagaggagagatctgatgaatgcccagaacctggcggcagcgcaaaagatg

SEQ ID NO: 156254 - DNA, 103 bp, Artificial Sequence
  Synthetic Polynucleotide
taatacgactcactatagggtagactgggagaccccaaggcgctgggcataacagaggagaatgcccatggccttggggaacctggcggcagcgcaaaagatg

SEQ ID NO: 156255 - DNA, 103 bp, Artificial Sequence
  Synthetic Polynucleotide
taatacgactcactatagggacgctcagctcatacgccttcttcatcaggaacagaggagacctgatatggaaggcgtaaacctggcggcagcgcaaaagatg

SEQ ID NO: 156256 - DNA, 103 bp, Artificial Sequence
  Synthetic Polynucleotide
taatacgactcactatagggagcgaatgagtagactgggagaccccaaggaacagaggagaccttggatgctcccagtcaacctggcggcagcgcaaaagatg

SEQ ID NO: 156257 - DNA, 103 bp, Artificial Sequence
  Synthetic Polynucleotide
taatacgactcactatagggtggggtggtgagcgaatgagtagactgggaaacagaggagatcccagatgactcattcgaacctggcggcagcgcaaaagatg

SEQ ID NO: 156258 - DNA, 103 bp, Artificial Sequence
  Synthetic Polynucleotide
taatacgactcactatagggcagaaaccactggggtggtgagcgaatgagaacagaggagactcattatgtcaccacccaacctggcggcagcgcaaaagatg

SEQ ID NO: 156259 - DNA, 103 bp, Artificial Sequence
  Synthetic Polynucleotide
taatacgactcactatagggggcgttgccacagaaaccactggggtggtgaacagaggagacaccacatgagtggtttcaacctggcggcagcgcaaaagatg

SEQ ID NO: 156260 - DNA, 103 bp, Artificial Sequence
  Synthetic Polynucleotide
taatacgactcactataggggagtaaactcggcgttgccacagaaaccacaacagaggagagtggttatggtggcaacgaacctggcggcagcgcaaaagatg

SEQ ID NO: 156261 - DNA, 103 bp, Artificial Sequence
  Synthetic Polynucleotide
taatacgactcactatagggggccctggctgagtaaactcggcgttgccaaacagaggagatggcaaatgcgagtttacaacctggcggcagcgcaaaagatg

SEQ ID NO: 156262 - DNA, 103 bp, Artificial Sequence
  Synthetic Polynucleotide
taatacgactcactataggggagaaggggaggccctggctgagtaaactcaacagaggagagagtttatgcagccagggaacctggcggcagcgcaaaagatg

SEQ ID NO: 156263 - DNA, 103 bp, Artificial Sequence
  Synthetic Polynucleotide
taatacgactcactataggggggcatggaagagaaggggaggccctggctaacagaggagaagccagatgctccccttcaacctggcggcagcgcaaaagatg

SEQ ID NO: 156264 - DNA, 103 bp, Artificial Sequence
  Synthetic Polynucleotide
taatacgactcactatagggtgtaggcagtgggcatggaagagaaggggaaacagaggagatcccctatgcttccatgcaacctggcggcagcgcaaaagatg

SEQ ID NO: 156265 - DNA, 103 bp, Artificial Sequence
  Synthetic Polynucleotide
taatacgactcactatagggtaatctgtgttgtaggcagtgggcatggaaaacagaggagattccatatgcactgcctaaacctggcggcagcgcaaaagatg

SEQ ID NO: 156266 - DNA, 103 bp, Artificial Sequence
  Synthetic Polynucleotide
taatacgactcactatagggatggggtagatcgtcgtacctttgcgccataacagaggagaatggcgatgaggtacgacaacctggcggcagcgcaaaagatg

SEQ ID NO: 156267 - DNA, 103 bp, Artificial Sequence
  Synthetic Polynucleotide
taatacgactcactataggggttcaggtggtggaccggctgcatggacctaacagaggagaaggtccatgcagccggtcaacctggcggcagcgcaaaagatg

SEQ ID NO: 156268 - DNA, 103 bp, Artificial Sequence
  Synthetic Polynucleotide
taatacgactcactatagggtcggttggactggtctatcatgggctgcacaacagaggagagtgcagatgatgatagacaacctggcggcagcgcaaaagatg

SEQ ID NO: 156269 - DNA, 103 bp, Artificial Sequence
  Synthetic Polynucleotide
taatacgactcactataggggacttactgctcggttggactggtctatcaaacagaggagatgatagatgagtccaaccaacctggcggcagcgcaaaagatg

SEQ ID NO: 156270 - DNA, 103 bp, Artificial Sequence
  Synthetic Polynucleotide
taatacgactcactatagggggtgttccttgacttactgctcggttggacaacagaggagagtccaaatgagcagtaagaacctggcggcagcgcaaaagatg

SEQ ID NO: 156271 - DNA, 103 bp, Artificial Sequence
  Synthetic Polynucleotide
taatacgactcactatagggaggattataaggtgttccttgacttactgcaacagaggagagcagtaatgcaaggaacaaacctggcggcagcgcaaaagatg

SEQ ID NO: 156272 - DNA, 103 bp, Artificial Sequence
  Synthetic Polynucleotide
taatacgactcactataggggctgtccatcaggattataaggtgttccttaacagaggagaaaggaaatgcttataatcaacctggcggcagcgcaaaagatg

SEQ ID NO: 156273 - DNA, 103 bp, Artificial Sequence
  Synthetic Polynucleotide
taatacgactcactatagggcctcccatgggctgtccatcaggattataaaacagaggagattataaatgtgatggacaaacctggcggcagcgcaaaagatg

SEQ ID NO: 156274 - DNA, 103 bp, Artificial Sequence
  Synthetic Polynucleotide
taatacgactcactatagggcattacgaaacctcccatgggctgtccatcaacagaggagagatggaatgcccatgggaaacctggcggcagcgcaaaagatg

SEQ ID NO: 156275 - DNA, 103 bp, Artificial Sequence
  Synthetic Polynucleotide
taatacgactcactataggggctgaccgtccattacgaaacctcccatggaacagaggagaccatggatggtttcgtaaaacctggcggcagcgcaaaagatg

SEQ ID NO: 156276 - DNA, 103 bp, Artificial Sequence
  Synthetic Polynucleotide
taatacgactcactatagggcccatatgttgctgaccgtccattacgaaaaacagaggagatttcgtatgggacggtcaaacctggcggcagcgcaaaagatg

SEQ ID NO: 156277 - DNA, 103 bp, Artificial Sequence
  Synthetic Polynucleotide
taatacgactcactatagggtgctctaattcccatatgttgctgaccgtcaacagaggagagacggtatgcaacatatgaacctggcggcagcgcaaaagatg

SEQ ID NO: 156278 - DNA, 103 bp, Artificial Sequence
  Synthetic Polynucleotide
taatacgactcactataggggaggcccgtggttcaggtggtggaccggctaacagaggagaagccggatgaccacctgaaacctggcggcagcgcaaaagatg

SEQ ID NO: 156279 - DNA, 103 bp, Artificial Sequence
  Synthetic Polynucleotide
taatacgactcactatagggtaggtcctggtgctctaattcccatatgttaacagaggagaaacataatggaattagagaacctggcggcagcgcaaaagatg

SEQ ID NO: 156280 - DNA, 103 bp, Artificial Sequence
  Synthetic Polynucleotide
taatacgactcactatagggattccactcataggtcctggtgctctaattaacagaggagaaattagatgaccaggaccaacctggcggcagcgcaaaagatg

SEQ ID NO: 156281 - DNA, 103 bp, Artificial Sequence
  Synthetic Polynucleotide
taatacgactcactatagggattcatgcccattccactcataggtcctggaacagaggagaccaggaatgatgagtggaaacctggcggcagcgcaaaagatg

SEQ ID NO: 156282 - DNA, 103 bp, Artificial Sequence
  Synthetic Polynucleotide
taatacgactcactatagggccatgcccatattcatgcccattccactcaaacagaggagatgagtgatgtgggcatgaaacctggcggcagcgcaaaagatg

SEQ ID NO: 156283 - DNA, 103 bp, Artificial Sequence
  Synthetic Polynucleotide
taatacgactcactatagggcactgcccctccatgcccatattcatgcccaacagaggagagggcatatgtatgggcataacctggcggcagcgcaaaagatg

SEQ ID NO: 156284 - DNA, 103 bp, Artificial Sequence
  Synthetic Polynucleotide
taatacgactcactatagggcatgtagtgccactgcccctccatgcccataacagaggagaatgggcatggaggggcagaacctggcggcagcgcaaaagatg

SEQ ID NO: 156285 - DNA, 103 bp, Artificial Sequence
  Synthetic Polynucleotide
taatacgactcactataggggagtgcagaggaggcccgtggttcaggtggaacagaggagaccacctatgccacgggccaacctggcggcagcgcaaaagatg

SEQ ID NO: 156286 - DNA, 103 bp, Artificial Sequence
  Synthetic Polynucleotide
taatacgactcactataggggtactgatgcgagtgcagaggaggcccgtgaacagaggagacacgggatgcctctgcacaacctggcggcagcgcaaaagatg

SEQ ID NO: 156287 - DNA, 103 bp, Artificial Sequence
  Synthetic Polynucleotide
taatacgactcactatagggctgtgtgcgggtactgatgcgagtgcagagaacagaggagactctgcatgcgcatcagtaacctggcggcagcgcaaaagatg

SEQ ID NO: 156288 - DNA, 103 bp, Artificial Sequence
  Synthetic Polynucleotide
taatacgactcactatagggttggtatgagctgtgtgcgggtactgatgcaacagaggagagcatcaatgcccgcacacaacctggcggcagcgcaaaagatg

SEQ ID NO: 156289 - DNA, 103 bp, Artificial Sequence
  Synthetic Polynucleotide
taatacgactcactatagggggccatggcgttggtatgagctgtgtgcggaacagaggagaccgcacatggctcataccaacctggcggcagcgcaaaagatg

SEQ ID NO: 156290 - DNA, 103 bp, Artificial Sequence
  Synthetic Polynucleotide
taatacgactcactatagggccatgctgggggccatggcgttggtatgagaacagaggagactcataatgacgccatggaacctggcggcagcgcaaaagatg

SEQ ID NO: 156291 - DNA, 103 bp, Artificial Sequence
  Synthetic Polynucleotide
taatacgactcactatagggacagaggagcccatgctgggggccatggcgaacagaggagacgccatatgccccagcataacctggcggcagcgcaaaagatg

SEQ ID NO: 156292 - DNA, 103 bp, Artificial Sequence
  Synthetic Polynucleotide
taatacgactcactatagggagcgtcattgacagaggagcccatgctgggaacagaggagacccagcatgggctcctctaacctggcggcagcgcaaaagatg

SEQ ID NO: 156293 - DNA, 103 bp, Artificial Sequence
  Synthetic Polynucleotide
taatacgactcactatagggtgcccccgtaatggggtagatcgtcgtaccaacagaggagaggtacgatgatctaccccaacctggcggcagcgcaaaagatg

SEQ ID NO: 156294 - DNA, 103 bp, Artificial Sequence
  Synthetic Polynucleotide
taatacgactcactatagggctctctttaaagcgtcattgacagaggagcaacagaggagagctcctatgtcaatgacgaacctggcggcagcgcaaaagatg

SEQ ID NO: 156295 - DNA, 103 bp, Artificial Sequence
  Synthetic Polynucleotide
taatacgactcactataggggcatctttatctctctttaaagcgtcattgaacagaggagacaatgaatgtttaaagagaacctggcggcagcgcaaaagatg

SEQ ID NO: 156296 - DNA, 103 bp, Artificial Sequence
  Synthetic Polynucleotide
taatacgactcactatagggtccataaatggcatctttatctctctttaaaacagaggagattaaagatggataaagataacctggcggcagcgcaaaagatg

SEQ ID NO: 156297 - DNA, 103 bp, Artificial Sequence
  Synthetic Polynucleotide
taatacgactcactatagggagagggggtgtccataaatggcatctttataacagaggagaataaagatgccatttatgaacctggcggcagcgcaaaagatg

SEQ ID NO: 156298 - DNA, 103 bp, Artificial Sequence
  Synthetic Polynucleotide
taatacgactcactatagggaagagagggaagagggggtgtccataaatgaacagaggagacatttaatgacaccccctaacctggcggcagcgcaaaagatg

SEQ ID NO: 156299 - DNA, 103 bp, Artificial Sequence
  Synthetic Polynucleotide
taatacgactcactatagggaatcagtgctaagagagggaagagggggtgaacagaggagacaccccatgttccctctcaacctggcggcagcgcaaaagatg

SEQ ID NO: 156300 - DNA, 103 bp, Artificial Sequence
  Synthetic Polynucleotide
taatacgactcactatagggatttctcaaaaatcagtgctaagagagggaaacagaggagatccctcatgtagcactgaaacctggcggcagcgcaaaagatg

SEQ ID NO: 156301 - DNA, 103 bp, Artificial Sequence
  Synthetic Polynucleotide
taatacgactcactataggggctaattcacatttctcaaaaatcagtgctaacagaggagaagcactatgttttgagaaaacctggcggcagcgcaaaagatg

SEQ ID NO: 156302 - DNA, 103 bp, Artificial Sequence
  Synthetic Polynucleotide
taatacgactcactatagggggtacaagtagctaattcacatttctcaaaaacagaggagatttgagatgtgtgaattaaacctggcggcagcgcaaaagatg

SEQ ID NO: 156303 - DNA, 103 bp, Artificial Sequence
  Synthetic Polynucleotide
taatacgactcactataggggctcgcggggggtacaagtagctaattcacaacagaggagagtgaatatgctacttgtaaacctggcggcagcgcaaaagatg

SEQ ID NO: 156304 - DNA, 103 bp, Artificial Sequence
  Synthetic Polynucleotide
taatacgactcactatagggactccatccatgcccccgtaatggggtagaaacagaggagatctaccatgttacgggggaacctggcggcagcgcaaaagatg

SEQ ID NO: 156305 - DNA, 103 bp, Artificial Sequence
  Synthetic Polynucleotide
taatacgactcactataggggccacccccggctcgcggggggtacaagtaaacagaggagatacttgatgcccccgcgaaacctggcggcagcgcaaaagatg

SEQ ID NO: 156306 - DNA, 103 bp, Artificial Sequence
  Synthetic Polynucleotide
taatacgactcactataggggtccccgcccgccacccccggctcgcggggaacagaggagaccccgcatgccgggggtgaacctggcggcagcgcaaaagatg

SEQ ID NO: 156307 - DNA, 103 bp, Artificial Sequence
  Synthetic Polynucleotide
taatacgactcactatagggacgagcagacgtccccgcccgccacccccgaacagaggagacgggggatgcgggcggggaacctggcggcagcgcaaaagatg

SEQ ID NO: 156308 - DNA, 103 bp, Artificial Sequence
  Synthetic Polynucleotide
taatacgactcactatagggaatgactctgacgagcagacgtccccgcccaacagaggagagggcggatgcgtctgctcaacctggcggcagcgcaaaagatg

SEQ ID NO: 156309 - DNA, 103 bp, Artificial Sequence
  Synthetic Polynucleotide
taatacgactcactatagggatcttcattgaatgactctgacgagcagacaacagaggagagtctgcatgtcagagtcaaacctggcggcagcgcaaaagatg

SEQ ID NO: 156310 - DNA, 103 bp, Artificial Sequence
  Synthetic Polynucleotide
taatacgactcactatagggacacggctatatcttcattgaatgactctgaacagaggagacagagtatgtcaatgaagaacctggcggcagcgcaaaagatg

SEQ ID NO: 156311 - DNA, 103 bp, Artificial Sequence
  Synthetic Polynucleotide
taatacgactcactatagggtgtttggcgaacacggctatatcttcattgaacagaggagacaatgaatgtatagccgtaacctggcggcagcgcaaaagatg

SEQ ID NO: 156312 - DNA, 103 bp, Artificial Sequence
  Synthetic Polynucleotide
taatacgactcactatagggtgcgcgaatctgtttggcgaacacggctataacagaggagaatagccatgttcgccaaaaacctggcggcagcgcaaaagatg

SEQ ID NO: 156313 - DNA, 103 bp, Artificial Sequence
  Synthetic Polynucleotide
taatacgactcactataggggaggtttttctgcgcgaatctgtttggcgaaacagaggagatcgccaatgagattcgcgaacctggcggcagcgcaaaagatg

SEQ ID NO: 156314 - DNA, 103 bp, Artificial Sequence
  Synthetic Polynucleotide
taatacgactcactataggggaagaaaatagaggtttttctgcgcgaatcaacagaggagagattcgatgagaaaaaccaacctggcggcagcgcaaaagatg

SEQ ID NO: 156315 - DNA, 103 bp, Artificial Sequence
  Synthetic Polynucleotide
taatacgactcactatagggggggatgcctactccatccatgcccccgtaaacagaggagatacgggatgatggatggaaacctggcggcagcgcaaaagatg

SEQ ID NO: 156316 - DNA, 103 bp, Artificial Sequence
  Synthetic Polynucleotide
taatacgactcactatagggttctggattagaagaaaatagaggtttttcaacagaggagagaaaaaatgctattttctaacctggcggcagcgcaaaagatg

SEQ ID NO: 156317 - DNA, 103 bp, Artificial Sequence
  Synthetic Polynucleotide
taatacgactcactatagggagttatccagttctggattagaagaaaataaacagaggagatattttatgctaatccagaacctggcggcagcgcaaaagatg

SEQ ID NO: 156318 - DNA, 103 bp, Artificial Sequence
  Synthetic Polynucleotide
taatacgactcactatagggtgaatcatcaagttatccagttctggattaaacagaggagataatccatgactggataaaacctggcggcagcgcaaaagatg

SEQ ID NO: 156319 - DNA, 103 bp, Artificial Sequence
  Synthetic Polynucleotide
taatacgactcactatagggttgtatggcttgaatcatcaagttatccagaacagaggagactggatatgttgatgattaacctggcggcagcgcaaaagatg

SEQ ID NO: 156320 - DNA, 103 bp, Artificial Sequence
  Synthetic Polynucleotide
taatacgactcactatagggaccttaatacttgtatggcttgaatcatcaaacagaggagatgatgaatgaagccatacaacctggcggcagcgcaaaagatg

SEQ ID NO: 156321 - DNA, 103 bp, Artificial Sequence
  Synthetic Polynucleotide
taatacgactcactatagggaatagatgaaaccttaatacttgtatggctaacagaggagaagccatatgagtattaagaacctggcggcagcgcaaaagatg

SEQ ID NO: 156322 - DNA, 103 bp, Artificial Sequence
  Synthetic Polynucleotide
taatacgactcactatagggctctaattccaatagatgaaaccttaatacaacagaggagagtattaatgtttcatctaaacctggcggcagcgcaaaagatg

SEQ ID NO: 156323 - DNA, 103 bp, Artificial Sequence
  Synthetic Polynucleotide
taatacgactcactatagggcgtgtaccttctctaattccaatagatgaaaacagaggagattcatcatgtggaattagaacctggcggcagcgcaaaagatg

SEQ ID NO: 156324 - DNA, 103 bp, Artificial Sequence
  Synthetic Polynucleotide
taatacgactcactatagggtcacataattcgtgtaccttctctaattccaacagaggagaggaattatggaaggtacaaacctggcggcagcgcaaaagatg

SEQ ID NO: 156325 - DNA, 103 bp, Artificial Sequence
  Synthetic Polynucleotide
taatacgactcactataggggcagaaattgtcacataattcgtgtaccttaacagaggagaaaggtaatggaattatgtaacctggcggcagcgcaaaagatg

SEQ ID NO: 156326 - DNA, 103 bp, Artificial Sequence
  Synthetic Polynucleotide
taatacgactcactatagggacatcgtggaggggatgcctactccatccaaacagaggagatggatgatgtaggcatccaacctggcggcagcgcaaaagatg

SEQ ID NO: 156327 - DNA, 103 bp, Artificial Sequence
  Synthetic Polynucleotide
taatacgactcactatagggtataccggtggcagaaattgtcacataattaacagaggagaaattatatgacaatttctaacctggcggcagcgcaaaagatg

SEQ ID NO: 156328 - DNA, 103 bp, Artificial Sequence
  Synthetic Polynucleotide
taatacgactcactatagggaaacagctaatataccggtggcagaaattgaacagaggagacaatttatgccaccggtaaacctggcggcagcgcaaaagatg

SEQ ID NO: 156329 - DNA, 103 bp, Artificial Sequence
  Synthetic Polynucleotide
taatacgactcactatagggtttccctttcaaacagctaatataccggtgaacagaggagacaccggatgattagctgtaacctggcggcagcgcaaaagatg

SEQ ID NO: 156330 - DNA, 103 bp, Artificial Sequence
  Synthetic Polynucleotide
taatacgactcactatagggcgataggcattttccctttcaaacagctaaaacagaggagattagctatgtgaaagggaaacctggcggcagcgcaaaagatg

SEQ ID NO: 156331 - DNA, 103 bp, Artificial Sequence
  Synthetic Polynucleotide
taatacgactcactatagggatcaccaaatcgataggcattttccctttcaacagaggagagaaaggatgaatgcctataacctggcggcagcgcaaaagatg

SEQ ID NO: 156332 - DNA, 103 bp, Artificial Sequence
  Synthetic Polynucleotide
taatacgactcactatagggtctatcgtctatcaccaaatcgataggcataacagaggagaatgcctatggatttggtgaacctggcggcagcgcaaaagatg

SEQ ID NO: 156333 - DNA, 103 bp, Artificial Sequence
  Synthetic Polynucleotide
taatacgactcactatagggatcctccttctctatcgtctatcaccaaataacagaggagaatttggatgtagacgataaacctggcggcagcgcaaaagatg

SEQ ID NO: 156334 - DNA, 103 bp, Artificial Sequence
  Synthetic Polynucleotide
taatacgactcactatagggtctgattttgatcctccttctctatcgtctaacagaggagaagacgaatgagaaggaggaacctggcggcagcgcaaaagatg

SEQ ID NO: 156335 - DNA, 103 bp, Artificial Sequence
  Synthetic Polynucleotide
taatacgactcactatagggatcttcactgtctgattttgatcctccttcaacagaggagagaaggaatgtcaaaatcaaacctggcggcagcgcaaaagatg

SEQ ID NO: 156336 - DNA, 103 bp, Artificial Sequence
  Synthetic Polynucleotide
taatacgactcactatagggatcttgttatatcttcactgtctgattttgaacagaggagacaaaatatgacagtgaagaacctggcggcagcgcaaaagatg

SEQ ID NO: 156337 - DNA, 103 bp, Artificial Sequence
  Synthetic Polynucleotide
taatacgactcactataggggggtccccatacatcgtggaggggatgcctaacagaggagaaggcatatgctccacgataacctggcggcagcgcaaaagatg

SEQ ID NO: 156338 - DNA, 103 bp, Artificial Sequence
  Synthetic Polynucleotide
taatacgactcactatagggagatttgctgatcttgttatatcttcactgaacagaggagacagtgaatgtataacaagaacctggcggcagcgcaaaagatg

SEQ ID NO: 156339 - DNA, 103 bp, Artificial Sequence
  Synthetic Polynucleotide
taatacgactcactatagggctggtcagttagatttgctgatcttgttataacagaggagaataacaatgtcagcaaataacctggcggcagcgcaaaagatg

SEQ ID NO: 156340 - DNA, 103 bp, Artificial Sequence
  Synthetic Polynucleotide
taatacgactcactatagggtccaagagggctggtcagttagatttgctgaacagaggagacagcaaatgtaactgaccaacctggcggcagcgcaaaagatg

SEQ ID NO: 156341 - DNA, 103 bp, Artificial Sequence
  Synthetic Polynucleotide
taatacgactcactatagggtgatctctgttccaagagggctggtcagttaacagaggagaaactgaatggccctcttgaacctggcggcagcgcaaaagatg

SEQ ID NO: 156342 - DNA, 103 bp, Artificial Sequence
  Synthetic Polynucleotide
taatacgactcactatagggcgtgtcatcatgatctctgttccaagagggaacagaggagaccctctatgaacagagataacctggcggcagcgcaaaagatg

SEQ ID NO: 156343 - DNA, 103 bp, Artificial Sequence
  Synthetic Polynucleotide
taatacgactcactataggggagtagatgccgtgtcatcatgatctctgtaacagaggagaacagagatgatgatgacaaacctggcggcagcgcaaaagatg

SEQ ID NO: 156344 - DNA, 103 bp, Artificial Sequence
  Synthetic Polynucleotide
taatacgactcactatagggcctcctgaacgagtagatgccgtgtcatcaaacagaggagatgatgaatgggcatctacaacctggcggcagcgcaaaagatg

SEQ ID NO: 156345 - DNA, 103 bp, Artificial Sequence
  Synthetic Polynucleotide
taatacgactcactataggggcctggggttcctcctgaacgagtagatgcaacagaggagagcatctatgcgttcaggaaacctggcggcagcgcaaaagatg

SEQ ID NO: 156346 - DNA, 103 bp, Artificial Sequence
  Synthetic Polynucleotide
taatacgactcactatagggcgctggaagggcctggggttcctcctgaacaacagaggagagttcagatggaaccccagaacctggcggcagcgcaaaagatg

SEQ ID NO: 156347 - DNA, 103 bp, Artificial Sequence
  Synthetic Polynucleotide
taatacgactcactataggggtgtggccaccgctggaagggcctggggttaacagaggagaaaccccatgcccttccagaacctggcggcagcgcaaaagatg

SEQ ID NO: 156348 - DNA, 103 bp, Artificial Sequence
  Synthetic Polynucleotide
taatacgactcactatagggggctgcatgcgggtccccatacatcgtggaaacagaggagatccacgatgtatggggacaacctggcggcagcgcaaaagatg

SEQ ID NO: 156349 - DNA, 103 bp, Artificial Sequence
  Synthetic Polynucleotide
taatacgactcactatagggactgtgtgacgtgtggccaccgctggaaggaacagaggagaccttccatgggtggccacaacctggcggcagcgcaaaagatg

SEQ ID NO: 156350 - DNA, 103 bp, Artificial Sequence
  Synthetic Polynucleotide
taatacgactcactatagggtgttgtccccactgtgtgacgtgtggccacaacagaggagagtggccatgcgtcacacaaacctggcggcagcgcaaaagatg

SEQ ID NO: 156351 - DNA, 103 bp, Artificial Sequence
  Synthetic Polynucleotide
taatacgactcactatagggtgctcactgctgttgtccccactgtgtgacaacagaggagagtcacaatgtggggacaaaacctggcggcagcgcaaaagatg

SEQ ID NO: 156352 - DNA, 103 bp, Artificial Sequence
  Synthetic Polynucleotide
taatacgactcactataggggccatcaccttgctcactgctgttgtccccaacagaggagaggggacatgagcagtgagaacctggcggcagcgcaaaagatg

SEQ ID NO: 156353 - DNA, 103 bp, Artificial Sequence
  Synthetic Polynucleotide
taatacgactcactatagggtgttgtccaagccatcaccttgctcactgcaacagaggagagcagtgatgaaggtgatgaacctggcggcagcgcaaaagatg

SEQ ID NO: 156354 - DNA, 103 bp, Artificial Sequence
  Synthetic Polynucleotide
taatacgactcactataggggaagctacactgttgtccaagccatcacctaacagaggagaaggtgaatgcttggacaaaacctggcggcagcgcaaaagatg

SEQ ID NO: 156355 - DNA, 103 bp, Artificial Sequence
  Synthetic Polynucleotide
taatacgactcactatagggtgtgctgggggaagctacactgttgtccaaaacagaggagattggacatgagtgtagctaacctggcggcagcgcaaaagatg

SEQ ID NO: 156356 - DNA, 103 bp, Artificial Sequence
  Synthetic Polynucleotide
taatacgactcactatagggcatcgtcacctgtgctgggggaagctacacaacagaggagagtgtagatgcccccagcaaacctggcggcagcgcaaaagatg

SEQ ID NO: 156357 - DNA, 103 bp, Artificial Sequence
  Synthetic Polynucleotide
taatacgactcactatagggtcagggtcatcatcgtcacctgtgctggggaacagaggagaccccagatgaggtgacgaaacctggcggcagcgcaaaagatg

SEQ ID NO: 156358 - DNA, 103 bp, Artificial Sequence
  Synthetic Polynucleotide
taatacgactcactatagggtttgtccttatcagggtcatcatcgtcaccaacagaggagaggtgacatggatgaccctaacctggcggcagcgcaaaagatg

SEQ ID NO: 156359 - DNA, 103 bp, Artificial Sequence
  Synthetic Polynucleotide
taatacgactcactataggggcatggacctggctgcatgcgggtccccataacagaggagaatggggatgcgcatgcagaacctggcggcagcgcaaaagatg

SEQ ID NO: 156360 - DNA, 103 bp, Artificial Sequence
  Synthetic Polynucleotide
taatacgactcactatagggtgtgacgctttttgtccttatcagggtcataacagaggagaatgaccatgataaggacaaacctggcggcagcgcaaaagatg

SEQ ID NO: 156361 - DNA, 103 bp, Artificial Sequence
  Synthetic Polynucleotide
taatacgactcactatagggccacgctttttgtgacgctttttgtccttaaacagaggagataaggaatgaaagcgtcaaacctggcggcagcgcaaaagatg

SEQ ID NO: 156362 - DNA, 103 bp, Artificial Sequence
  Synthetic Polynucleotide
taatacgactcactataggggggaaagatgccacgctttttgtgacgcttaacagaggagaaagcgtatgaaaaagcgtaacctggcggcagcgcaaaagatg

SEQ ID NO: 156363 - DNA, 103 bp, Artificial Sequence
  Synthetic Polynucleotide
taatacgactcactatagggtggctactttgggaaagatgccacgcttttaacagaggagaaaaagcatggcatctttcaacctggcggcagcgcaaaagatg

SEQ ID NO: 156364 - DNA, 103 bp, Artificial Sequence
  Synthetic Polynucleotide
taatacgactcactatagggatgatatttgtggctactttgggaaagatgaacagaggagacatcttatgcaaagtagcaacctggcggcagcgcaaaagatg

SEQ ID NO: 156365 - DNA, 103 bp, Artificial Sequence
  Synthetic Polynucleotide
taatacgactcactatagggccacgccctcatgatatttgtggctactttaacagaggagaaaagtaatgacaaatatcaacctggcggcagcgcaaaagatg

SEQ ID NO: 156366 - DNA, 103 bp, Artificial Sequence
  Synthetic Polynucleotide
taatacgactcactataggggctggaacagccacgccctcatgatatttgaacagaggagacaaataatgtgagggcgtaacctggcggcagcgcaaaagatg

SEQ ID NO: 156367 - DNA, 103 bp, Artificial Sequence
  Synthetic Polynucleotide
taatacgactcactatagggtgtgttagatgctggaacagccacgccctcaacagaggagagagggcatggctgttccaaacctggcggcagcgcaaaagatg

SEQ ID NO: 156368 - DNA, 103 bp, Artificial Sequence
  Synthetic Polynucleotide
taatacgactcactatagggagggtaagggtgtgttagatgctggaacagaacagaggagactgttcatgcatctaacaaacctggcggcagcgcaaaagatg

SEQ ID NO: 156369 - DNA, 103 bp, Artificial Sequence
  Synthetic Polynucleotide
taatacgactcactataggggttcttcagaagggtaagggtgtgttagataacagaggagaatctaaatgacccttaccaacctggcggcagcgcaaaagatg

SEQ ID NO: 156370 - DNA, 103 bp, Artificial Sequence
  Synthetic Polynucleotide
taatacgactcactatagggtggaccggctgcatggacctggctgcatgcaacagaggagagcatgcatgcaggtccataacctggcggcagcgcaaaagatg

SEQ ID NO: 156371 - DNA, 103 bp, Artificial Sequence
  Synthetic Polynucleotide
taatacgactcactatagggtgctttttctgttcttcagaagggtaagggaacagaggagacccttaatgttctgaagaaacctggcggcagcgcaaaagatg

SEQ ID NO: 156372 - DNA, 103 bp, Artificial Sequence
  Synthetic Polynucleotide
taatacgactcactatagggttgtgccaactgctttttctgttcttcagaaacagaggagatctgaaatgcagaaaaagaacctggcggcagcgcaaaagatg

SEQ ID NO: 156373 - DNA, 103 bp, Artificial Sequence
  Synthetic Polynucleotide
taatacgactcactataggggtcccgtgtcttgtgccaactgctttttctaacagaggagaagaaaaatgagttggcacaacctggcggcagcgcaaaagatg

SEQ ID NO: 156374 - DNA, 103 bp, Artificial Sequence
  Synthetic Polynucleotide
taatacgactcactatagggaggatggtgagtcccgtgtcttgtgccaacaacagaggagagttggcatgagacacgggaacctggcggcagcgcaaaagatg

SEQ ID NO: 156375 - DNA, 103 bp, Artificial Sequence
  Synthetic Polynucleotide
taatacgactcactataggggttcacttgaaggatggtgagtcccgtgtcaacagaggagagacacgatgctcaccatcaacctggcggcagcgcaaaagatg

SEQ ID NO: 156376 - DNA, 103 bp, Artificial Sequence
  Synthetic Polynucleotide
taatacgactcactatagggtaaaccaattgttcacttgaaggatggtgaaacagaggagatcaccaatgttcaagtgaaacctggcggcagcgcaaaagatg

SEQ ID NO: 156377 - DNA, 103 bp, Artificial Sequence
  Synthetic Polynucleotide
taatacgactcactatagggcgggcattaataaaccaattgttcacttgaaacagaggagatcaagtatgcaattggttaacctggcggcagcgcaaaagatg

SEQ ID NO: 156378 - DNA, 103 bp, Artificial Sequence
  Synthetic Polynucleotide
taatacgactcactatagggtattcttctccgggcattaataaaccaattaacagaggagaaattggatgattaatgccaacctggcggcagcgcaaaagatg

SEQ ID NO: 156379 - DNA, 103 bp, Artificial Sequence
  Synthetic Polynucleotide
taatacgactcactatagggtgggctgcactattcttctccgggcattaaaacagaggagattaatgatgggagaagaaaacctggcggcagcgcaaaagatg

SEQ ID NO: 156380 - DNA, 103 bp, Artificial Sequence
  Synthetic Polynucleotide
taatacgactcactatagggtggtctatcatgggctgcactattcttctcaacagaggagagagaagatgagtgcagccaacctggcggcagcgcaaaagatg

SEQ ID NO: 156381 - DNA, 103 bp, Artificial Sequence
  Synthetic Polynucleotide
taatacgactcactatagggatggggcagctcatcgtacctttgcgccataacagaggagaatggcgatgaggtacgataacctggcggcagcgcaaaagatg

SEQ ID NO: 156382 - DNA, 103 bp, Artificial Sequence
  Synthetic Polynucleotide
taatacgactcactataggggttcaggtggtgaaccggggggatcggccgaacagaggagacggccgatgcccccggttaacctggcggcagcgcaaaagatg

SEQ ID NO: 156383 - DNA, 103 bp, Artificial Sequence
  Synthetic Polynucleotide
taatacgactcactataggggcggcccgtggttcaggtggtgaaccggggaacagaggagaccccggatgaccacctgaaacctggcggcagcgcaaaagatg

SEQ ID NO: 156384 - DNA, 103 bp, Artificial Sequence
  Synthetic Polynucleotide
taatacgactcactataggggcgtggagcggcggcccgtggttcaggtggaacagaggagaccacctatgccacgggccaacctggcggcagcgcaaaagatg

SEQ ID NO: 156385 - DNA, 103 bp, Artificial Sequence
  Synthetic Polynucleotide
taatacgactcactataggggtgctgtgtggcgtggagcggcggcccgtgaacagaggagacacgggatgccgctccacaacctggcggcagcgcaaaagatg

SEQ ID NO: 156386 - DNA, 103 bp, Artificial Sequence
  Synthetic Polynucleotide
taatacgactcactataggggcgcgccgtagtgctgtgtggcgtggagcgaacagaggagacgctccatgccacacagcaacctggcggcagcgcaaaagatg

SEQ ID NO: 156387 - DNA, 103 bp, Artificial Sequence
  Synthetic Polynucleotide
taatacgactcactatagggtgcggggcgtgcgcgccgtagtgctgtgtgaacagaggagacacacaatgctacggcgcaacctggcggcagcgcaaaagatg

SEQ ID NO: 156388 - DNA, 103 bp, Artificial Sequence
  Synthetic Polynucleotide
taatacgactcactataggggacattggggtgcggggcgtgcgcgccgtaaacagaggagatacggcatgcacgccccgaacctggcggcagcgcaaaagatg

SEQ ID NO: 156389 - DNA, 103 bp, Artificial Sequence
  Synthetic Polynucleotide
taatacgactcactatagggtggccggcatgacattggggtgcggggcgtaacagaggagaacgcccatgaccccaatgaacctggcggcagcgcaaaagatg

SEQ ID NO: 156390 - DNA, 103 bp, Artificial Sequence
  Synthetic Polynucleotide
taatacgactcactataggggatcccatactggccggcatgacattggggaacagaggagaccccaaatgcatgccggcaacctggcggcagcgcaaaagatg

SEQ ID NO: 156391 - DNA, 103 bp, Artificial Sequence
  Synthetic Polynucleotide
taatacgactcactataggggttgacagcggatcccatactggccggcataacagaggagaatgccgatgagtatgggaaacctggcggcagcgcaaaagatg

SEQ ID NO: 156392 - DNA, 103 bp, Artificial Sequence
  Synthetic Polynucleotide
taatacgactcactatagggtcccgccgtaatggggcagctcatcgtaccaacagaggagaggtacgatgagctgccccaacctggcggcagcgcaaaagatg

SEQ ID NO: 156393 - DNA, 103 bp, Artificial Sequence
  Synthetic Polynucleotide
taatacgactcactatagggtcaaggcgtcgttgacagcggatcccatacaacagaggagagtatggatgccgctgtcaaacctggcggcagcgcaaaagatg

SEQ ID NO: 156394 - DNA, 103 bp, Artificial Sequence
  Synthetic Polynucleotide
taatacgactcactatagggttgtcccgcttcaaggcgtcgttgacagcgaacagaggagacgctgtatgcgacgccttaacctggcggcagcgcaaaagatg

SEQ ID NO: 156395 - DNA, 103 bp, Artificial Sequence
  Synthetic Polynucleotide
taatacgactcactataggggatcgcgtccttgtcccgcttcaaggcgtcaacagaggagagacgccatgaagcgggacaacctggcggcagcgcaaaagatg

SEQ ID NO: 156396 - DNA, 103 bp, Artificial Sequence
  Synthetic Polynucleotide
taatacgactcactatagggggtgcccatagatcgcgtccttgtcccgctaacagaggagaagcgggatgaggacgcgaaacctggcggcagcgcaaaagatg

SEQ ID NO: 156397 - DNA, 103 bp, Artificial Sequence
  Synthetic Polynucleotide
taatacgactcactatagggggaaacaacgggtgcccatagatcgcgtccaacagaggagaggacgcatgctatgggcaaacctggcggcagcgcaaaagatg

SEQ ID NO: 156398 - DNA, 103 bp, Artificial Sequence
  Synthetic Polynucleotide
taatacgactcactatagggagctaacagaggaaacaacgggtgcccataaacagaggagatatgggatgccgttgtttaacctggcggcagcgcaaaagatg

SEQ ID NO: 156399 - DNA, 103 bp, Artificial Sequence
  Synthetic Polynucleotide
taatacgactcactatagggcaaagaccagagctaacagaggaaacaacgaacagaggagacgttgtatgctctgttagaacctggcggcagcgcaaaagatg

SEQ ID NO: 156400 - DNA, 103 bp, Artificial Sequence
  Synthetic Polynucleotide
taatacgactcactatagggtcgcacttctcaaagaccagagctaacagaaacagaggagatctgttatgtctggtcttaacctggcggcagcgcaaaagatg

SEQ ID NO: 156401 - DNA, 103 bp, Artificial Sequence
  Synthetic Polynucleotide
taatacgactcactatagggggtcgccagctcgcacttctcaaagaccagaacagaggagactggtcatggagaagtgcaacctggcggcagcgcaaaagatg

SEQ ID NO: 156402 - DNA, 103 bp, Artificial Sequence
  Synthetic Polynucleotide
taatacgactcactatagggggggagtgcaggtcgccagctcgcacttctaacagaggagaagaagtatgagctggcgaaacctggcggcagcgcaaaagatg

SEQ ID NO: 156403 - DNA, 103 bp, Artificial Sequence
  Synthetic Polynucleotide
taatacgactcactatagggactccgtccatcccgccgtaatggggcagcaacagaggagagctgccatgttacggcggaacctggcggcagcgcaaaagatg

SEQ ID NO: 156404 - DNA, 103 bp, Artificial Sequence
  Synthetic Polynucleotide
taatacgactcactatagggccaggttcccggggagtgcaggtcgccagcaacagaggagagctggcatgctgcactccaacctggcggcagcgcaaaagatg

SEQ ID NO: 156405 - DNA, 103 bp, Artificial Sequence
  Synthetic Polynucleotide
taatacgactcactataggggccagccactccaggttcccggggagtgcaaacagaggagatgcactatgcgggaacctaacctggcggcagcgcaaaagatg

SEQ ID NO: 156406 - DNA, 103 bp, Artificial Sequence
  Synthetic Polynucleotide
taatacgactcactatagggagacgtctccgccagccactccaggttcccaacagaggagagggaacatggagtggctgaacctggcggcagcgcaaaagatg

SEQ ID NO: 156407 - DNA, 103 bp, Artificial Sequence
  Synthetic Polynucleotide
taatacgactcactatagggtcggaggagcagacgtctccgccagccactaacagaggagaagtggcatgcggagacgtaacctggcggcagcgcaaaagatg

SEQ ID NO: 156408 - DNA, 103 bp, Artificial Sequence
  Synthetic Polynucleotide
taatacgactcactataggggttgaaggagtcggaggagcagacgtctccaacagaggagaggagacatgtgctcctccaacctggcggcagcgcaaaagatg

SEQ ID NO: 156409 - DNA, 103 bp, Artificial Sequence
  Synthetic Polynucleotide
taatacgactcactatagggcgatgtcctcgttgaaggagtcggaggagcaacagaggagagctcctatgactccttcaaacctggcggcagcgcaaaagatg

SEQ ID NO: 156410 - DNA, 103 bp, Artificial Sequence
  Synthetic Polynucleotide
taatacgactcactataggggcgaagaccgcgatgtcctcgttgaaggagaacagaggagactccttatgcgaggacataacctggcggcagcgcaaaagatg

SEQ ID NO: 156411 - DNA, 103 bp, Artificial Sequence
  Synthetic Polynucleotide
taatacgactcactatagggaacctgcttggcgaagaccgcgatgtcctcaacagaggagagaggacatggcggtcttcaacctggcggcagcgcaaaagatg

SEQ ID NO: 156412 - DNA, 103 bp, Artificial Sequence
  Synthetic Polynucleotide
taatacgactcactatagggtttcggcgcgaacctgcttggcgaagaccgaacagaggagacggtctatgccaagcaggaacctggcggcagcgcaaaagatg

SEQ ID NO: 156413 - DNA, 103 bp, Artificial Sequence
  Synthetic Polynucleotide
taatacgactcactatagggaaaagtggcttttcggcgcgaacctgcttgaacagaggagacaagcaatgtcgcgccgaaacctggcggcagcgcaaaagatg

SEQ ID NO: 156414 - DNA, 103 bp, Artificial Sequence
  Synthetic Polynucleotide
taatacgactcactataggggggaacccctactccgtccatcccgccgtaaacagaggagatacggcatgatggacggaaacctggcggcagcgcaaaagatg

SEQ ID NO: 156415 - DNA, 103 bp, Artificial Sequence
  Synthetic Polynucleotide
taatacgactcactatagggatttgaggaaaaaagtggcttttcggcgcgaacagaggagacgcgccatgaagccacttaacctggcggcagcgcaaaagatg

SEQ ID NO: 156416 - DNA, 103 bp, Artificial Sequence
  Synthetic Polynucleotide
taatacgactcactatagggccagctctggatttgaggaaaaaagtggctaacagaggagaagccacatgtttcctcaaaacctggcggcagcgcaaaagatg

SEQ ID NO: 156417 - DNA, 103 bp, Artificial Sequence
  Synthetic Polynucleotide
taatacgactcactatagggatcaaattgtccagctctggatttgaggaaaacagaggagattcctcatgtccagagctaacctggcggcagcgcaaaagatg

SEQ ID NO: 156418 - DNA, 103 bp, Artificial Sequence
  Synthetic Polynucleotide
taatacgactcactatagggtgcttgtatcatcaaattgtccagctctggaacagaggagaccagagatggacaatttgaacctggcggcagcgcaaaagatg

SEQ ID NO: 156419 - DNA, 103 bp, Artificial Sequence
  Synthetic Polynucleotide
taatacgactcactataggggtacttgtattgcttgtatcatcaaattgtaacagaggagaacaattatgtgatacaagaacctggcggcagcgcaaaagatg

SEQ ID NO: 156420 - DNA, 103 bp, Artificial Sequence
  Synthetic Polynucleotide
taatacgactcactatagggtgaaaccttagtacttgtattgcttgtatcaacagaggagagatacaatgaatacaagtaacctggcggcagcgcaaaagatg

SEQ ID NO: 156421 - DNA, 103 bp, Artificial Sequence
  Synthetic Polynucleotide
taatacgactcactatagggctccaaaagatgaaaccttagtacttgtataacagaggagaatacaaatgctaaggtttaacctggcggcagcgcaaaagatg

SEQ ID NO: 156422 - DNA, 103 bp, Artificial Sequence
  Synthetic Polynucleotide
taatacgactcactatagggccttttctaactccaaaagatgaaaccttaaacagaggagataaggtatgatcttttggaacctggcggcagcgcaaaagatg

SEQ ID NO: 156423 - DNA, 103 bp, Artificial Sequence
  Synthetic Polynucleotide
taatacgactcactatagggagttcgtggaccttttctaactccaaaagaaacagaggagatcttttatggttagaaaaaacctggcggcagcgcaaaagatg

SEQ ID NO: 156424 - DNA, 103 bp, Artificial Sequence
  Synthetic Polynucleotide
taatacgactcactataggggttatcgcacagttcgtggaccttttctaaaacagaggagattagaaatggtccacgaaaacctggcggcagcgcaaaagatg

SEQ ID NO: 156425 - DNA, 103 bp, Artificial Sequence
  Synthetic Polynucleotide
taatacgactcactatagggacatggaagcgggaacccctactccgtccaaacagaggagatggacgatgtaggggttcaacctggcggcagcgcaaaagatg

SEQ ID NO: 156426 - DNA, 103 bp, Artificial Sequence
  Synthetic Polynucleotide
taatacgactcactatagggggtggcagaagttatcgcacagttcgtggaaacagaggagatccacgatgtgtgcgataaacctggcggcagcgcaaaagatg

SEQ ID NO: 156427 - DNA, 103 bp, Artificial Sequence
  Synthetic Polynucleotide
taatacgactcactatagggctaatgtatcggtggcagaagttatcgcacaacagaggagagtgcgaatgcttctgccaaacctggcggcagcgcaaaagatg

SEQ ID NO: 156428 - DNA, 103 bp, Artificial Sequence
  Synthetic Polynucleotide
taatacgactcactatagggcttcaaacagctaatgtatcggtggcagaaaacagaggagattctgcatgcgatacattaacctggcggcagcgcaaaagatg

SEQ ID NO: 156429 - DNA, 103 bp, Artificial Sequence
  Synthetic Polynucleotide
taatacgactcactataggggcattttccccttcaaacagctaatgtatcaacagaggagagatacaatggctgtttgaaacctggcggcagcgcaaaagatg

SEQ ID NO: 156430 - DNA, 103 bp, Artificial Sequence
  Synthetic Polynucleotide
taatacgactcactatagggaggtcgatgggcattttccccttcaaacagaacagaggagactgtttatgggggaaaataacctggcggcagcgcaaaagatg

SEQ ID NO: 156431 - DNA, 103 bp, Artificial Sequence
  Synthetic Polynucleotide
taatacgactcactatagggatcaatgacgaggtcgatgggcattttcccaacagaggagagggaaaatgcccatcgacaacctggcggcagcgcaaaagatg

SEQ ID NO: 156432 - DNA, 103 bp, Artificial Sequence
  Synthetic Polynucleotide
taatacgactcactatagggcgtctctttcatcaatgacgaggtcgatggaacagaggagaccatcgatgtcgtcattgaacctggcggcagcgcaaaagatg

SEQ ID NO: 156433 - DNA, 103 bp, Artificial Sequence
  Synthetic Polynucleotide
taatacgactcactatagggttggagctgccgtctctttcatcaatgacgaacagaggagacgtcatatgtgaaagagaaacctggcggcagcgcaaaagatg

SEQ ID NO: 156434 - DNA, 103 bp, Artificial Sequence
  Synthetic Polynucleotide
taatacgactcactatagggatgatctgacttggagctgccgtctctttcaacagaggagagaaagaatgggcagctccaacctggcggcagcgcaaaagatg

SEQ ID NO: 156435 - DNA, 103 bp, Artificial Sequence
  Synthetic Polynucleotide
taatacgactcactatagggaaagttcttcatgatctgacttggagctgcaacagaggagagcagctatgagtcagatcaacctggcggcagcgcaaaagatg

SEQ ID NO: 156436 - DNA, 103 bp, Artificial Sequence
  Synthetic Polynucleotide
taatacgactcactataggggggtctccgtacatggaagcgggaacccctaacagaggagaaggggtatgcgcttccataacctggcggcagcgcaaaagatg

SEQ ID NO: 156437 - DNA, 103 bp, Artificial Sequence
  Synthetic Polynucleotide
taatacgactcactataggggaggagcctgaaagttcttcatgatctgacaacagaggagagtcagaatgtgaagaactaacctggcggcagcgcaaaagatg

SEQ ID NO: 156438 - DNA, 103 bp, Artificial Sequence
  Synthetic Polynucleotide
taatacgactcactataggggagatttgtggaggagcctgaaagttcttcaacagaggagagaagaaatgtcaggctccaacctggcggcagcgcaaaagatg

SEQ ID NO: 156439 - DNA, 103 bp, Artificial Sequence
  Synthetic Polynucleotide
taatacgactcactatagggtatggtcagcgagatttgtggaggagcctgaacagaggagacaggctatgccacaaatcaacctggcggcagcgcaaaagatg

SEQ ID NO: 156440 - DNA, 103 bp, Artificial Sequence
  Synthetic Polynucleotide
taatacgactcactataggggaagaagggttatggtcagcgagatttgtgaacagaggagacacaaaatgcgctgaccaaacctggcggcagcgcaaaagatg

SEQ ID NO: 156441 - DNA, 103 bp, Artificial Sequence
  Synthetic Polynucleotide
taatacgactcactataggggtctcgccaagaagaagggttatggtcagcaacagaggagagctgacatgaacccttctaacctggcggcagcgcaaaagatg

SEQ ID NO: 156442 - DNA, 103 bp, Artificial Sequence
  Synthetic Polynucleotide
taatacgactcactatagggcatcatcgtggtctcgccaagaagaagggtaacagaggagaacccttatgcttggcgagaacctggcggcagcgcaaaagatg

SEQ ID NO: 156443 - DNA, 103 bp, Artificial Sequence
  Synthetic Polynucleotide
taatacgactcactataggggttgaggttgcatcatcgtggtctcgccaaaacagaggagattggcgatgccacgatgaaacctggcggcagcgcaaaagatg

SEQ ID NO: 156444 - DNA, 103 bp, Artificial Sequence
  Synthetic Polynucleotide
taatacgactcactatagggtgctgagtgggttgaggttgcatcatcgtgaacagaggagacacgatatggcaacctcaaacctggcggcagcgcaaaagatg

SEQ ID NO: 156445 - DNA, 103 bp, Artificial Sequence
  Synthetic Polynucleotide
taatacgactcactatagggctggggtgcctgctgagtgggttgaggttgaacagaggagacaacctatgcccactcagaacctggcggcagcgcaaaagatg

SEQ ID NO: 156446 - DNA, 103 bp, Artificial Sequence
  Synthetic Polynucleotide
taatacgactcactatagggctggagggccctggggtgcctgctgagtggaacagaggagaccactcatgaggcaccccaacctggcggcagcgcaaaagatg

SEQ ID NO: 156447 - DNA, 103 bp, Artificial Sequence
  Synthetic Polynucleotide
taatacgactcactatagggcggcgcgtgagggtctccgtacatggaagcaacagaggagagcttccatgtacggagacaacctggcggcagcgcaaaagatg

SEQ ID NO: 156448 - DNA, 103 bp, Artificial Sequence
  Synthetic Polynucleotide
taatacgactcactatagggatggcccccactggagggccctggggtgccaacagaggagaggcaccatggggccctccaacctggcggcagcgcaaaagatg

SEQ ID NO: 156449 - DNA, 103 bp, Artificial Sequence
  Synthetic Polynucleotide
taatacgactcactatagggtctgggaagcatggcccccactggagggccaacagaggagaggccctatggtgggggccaacctggcggcagcgcaaaagatg

SEQ ID NO: 156450 - DNA, 103 bp, Artificial Sequence
  Synthetic Polynucleotide
taatacgactcactatagggttgtctccgctctgggaagcatggcccccaaacagaggagatgggggatgtgcttcccaaacctggcggcagcgcaaaagatg

SEQ ID NO: 156451 - DNA, 103 bp, Artificial Sequence
  Synthetic Polynucleotide
taatacgactcactatagggctcactgctgttgtctccgctctgggaagcaacagaggagagcttccatgagcggagacaacctggcggcagcgcaaaagatg

SEQ ID NO: 156452 - DNA, 103 bp, Artificial Sequence
  Synthetic Polynucleotide
taatacgactcactatagggcatccccttgctcactgctgttgtctccgcaacagaggagagcggagatgacagcagtgaacctggcggcagcgcaaaagatg

SEQ ID NO: 156453 - DNA, 103 bp, Artificial Sequence
  Synthetic Polynucleotide
taatacgactcactatagggttgtctaaaccatccccttgctcactgctgaacagaggagacagcagatggcaaggggaaacctggcggcagcgcaaaagatg

SEQ ID NO: 156454 - DNA, 103 bp, Artificial Sequence
  Synthetic Polynucleotide
taatacgactcactatagggagctacactgttgtctaaaccatccccttgaacagaggagacaagggatgggtttagacaacctggcggcagcgcaaaagatg

SEQ ID NO: 156455 - DNA, 103 bp, Artificial Sequence
  Synthetic Polynucleotide
taatacgactcactatagggtaccaggtgaagctacactgttgtctaaacaacagaggagagtttagatgacagtgtagaacctggcggcagcgcaaaagatg

SEQ ID NO: 156456 - DNA, 103 bp, Artificial Sequence
  Synthetic Polynucleotide
taatacgactcactatagggtcgtcacctgtaccaggtgaagctacactgaacagaggagacagtgtatgttcacctggaacctggcggcagcgcaaaagatg

SEQ ID NO: 156457 - DNA, 103 bp, Artificial Sequence
  Synthetic Polynucleotide
taatacgactcactatagggcggatcatcatcgtcacctgtaccaggtgaaacagaggagatcacctatgacaggtgacaacctggcggcagcgcaaaagatg

SEQ ID NO: 156458 - DNA, 103 bp, Artificial Sequence
  Synthetic Polynucleotide
taatacgactcactatagggggatcggccgcggcgcgtgagggtctccgtaacagaggagaacggagatgctcacgcgcaacctggcggcagcgcaaaagatg

SEQ ID NO: 156459 - DNA, 103 bp, Artificial Sequence
  Synthetic Polynucleotide
taatacgactcactatagggtgtccttatccggatcatcatcgtcacctgaacagaggagacaggtgatgatgatgatcaacctggcggcagcgcaaaagatg

SEQ ID NO: 156460 - DNA, 103 bp, Artificial Sequence
  Synthetic Polynucleotide
taatacgactcactatagggtggcgttttttgtccttatccggatcatcaaacagaggagatgatgaatgggataaggaaacctggcggcagcgcaaaagatg

SEQ ID NO: 156461 - DNA, 103 bp, Artificial Sequence
  Synthetic Polynucleotide
taatacgactcactatagggtcttttcttctggcgttttttgtccttatcaacagaggagagataagatgaaaaaacgcaacctggcggcagcgcaaaagatg

SEQ ID NO: 156462 - DNA, 103 bp, Artificial Sequence
  Synthetic Polynucleotide
taatacgactcactatagggggaaaatgcctcttttcttctggcgtttttaacagaggagaaaaaacatgagaagaaaaaacctggcggcagcgcaaaagatg

SEQ ID NO: 156463 - DNA, 103 bp, Artificial Sequence
  Synthetic Polynucleotide
taatacgactcactataggggctactttggggaaaatgcctcttttcttcaacagaggagagaagaaatgaggcattttaacctggcggcagcgcaaaagatg

SEQ ID NO: 156464 - DNA, 103 bp, Artificial Sequence
  Synthetic Polynucleotide
taatacgactcactataggggatatttgttgctactttggggaaaatgccaacagaggagaggcattatgcccaaagtaaacctggcggcagcgcaaaagatg

SEQ ID NO: 156465 - DNA, 103 bp, Artificial Sequence
  Synthetic Polynucleotide
taatacgactcactatagggatgctctcatgatatttgttgctactttggaacagaggagaccaaagatgcaacaaataaacctggcggcagcgcaaaagatg

SEQ ID NO: 156466 - DNA, 103 bp, Artificial Sequence
  Synthetic Polynucleotide
taatacgactcactatagggtggaagagccatgctctcatgatatttgttaacagaggagaaacaaaatgcatgagagcaacctggcggcagcgcaaaagatg

SEQ ID NO: 156467 - DNA, 103 bp, Artificial Sequence
  Synthetic Polynucleotide
taatacgactcactatagggtgtgagatgctggaagagccatgctctcataacagaggagaatgagaatgtggctcttcaacctggcggcagcgcaaaagatg

SEQ ID NO: 156468 - DNA, 103 bp, Artificial Sequence
  Synthetic Polynucleotide
taatacgactcactatagggtgaaccggggggatcggccgcggcgcgtgaaacagaggagatcacgcatggcggccgataacctggcggcagcgcaaaagatg

SEQ ID NO: 156469 - DNA, 103 bp, Artificial Sequence
  Synthetic Polynucleotide
taatacgactcactatagggcagcgtcttctgggcggccttcagccccataacagaggagaatggggatgaaggccgccaacctggcggcagcgcaaaagatg

SEQ ID NO: 156470 - DNA, 103 bp, Artificial Sequence
  Synthetic Polynucleotide
taatacgactcactatagggcaccaaggaaaggagcaccaggtccggctcaacagaggagagagccgatgctggtgctcaacctggcggcagcgcaaaagatg

SEQ ID NO: 156471 - DNA, 103 bp, Artificial Sequence
  Synthetic Polynucleotide
taatacgactcactatagggccgcacattgcggttgcgacagtggtagccaacagaggagaggctacatgtgtcgcaacaacctggcggcagcgcaaaagatg

SEQ ID NO: 156472 - DNA, 103 bp, Artificial Sequence
  Synthetic Polynucleotide
taatacgactcactataggggcagggcttcccgcacattgcggttgcgacaacagaggagagtcgcaatggcaatgtgcaacctggcggcagcgcaaaagatg

SEQ ID NO: 156473 - DNA, 103 bp, Artificial Sequence
  Synthetic Polynucleotide
taatacgactcactataggggcccaggcctgcagggcttcccgcacattgaacagaggagacaatgtatgggaagccctaacctggcggcagcgcaaaagatg

SEQ ID NO: 156474 - DNA, 103 bp, Artificial Sequence
  Synthetic Polynucleotide
taatacgactcactatagggggccgtgtccgcccaggcctgcagggcttcaacagaggagagaagccatgcaggcctggaacctggcggcagcgcaaaagatg

SEQ ID NO: 156475 - DNA, 103 bp, Artificial Sequence
  Synthetic Polynucleotide
taatacgactcactatagggggatgacagtggccgtgtccgcccaggcctaacagaggagaaggcctatgcggacacggaacctggcggcagcgcaaaagatg

SEQ ID NO: 156476 - DNA, 103 bp, Artificial Sequence
  Synthetic Polynucleotide
taatacgactcactatagggttgtagtcctggatgacagtggccgtgtccaacagaggagaggacacatgcactgtcataacctggcggcagcgcaaaagatg

SEQ ID NO: 156477 - DNA, 103 bp, Artificial Sequence
  Synthetic Polynucleotide
taatacgactcactatagggccggcagtagttgtagtcctggatgacagtaacagaggagaactgtcatgcaggactacaacctggcggcagcgcaaaagatg

SEQ ID NO: 156478 - DNA, 103 bp, Artificial Sequence
  Synthetic Polynucleotide
taatacgactcactatagggcctcgtcttcccggcagtagttgtagtcctaacagaggagaaggactatgactactgccaacctggcggcagcgcaaaagatg

SEQ ID NO: 156479 - DNA, 103 bp, Artificial Sequence
  Synthetic Polynucleotide
taatacgactcactatagggttgtagatctcctcgtcttcccggcagtagaacagaggagactactgatgggaagacgaaacctggcggcagcgcaaaagatg

SEQ ID NO: 156480 - DNA, 103 bp, Artificial Sequence
  Synthetic Polynucleotide
taatacgactcactatagggaaagaactccttgtagatctcctcgtcttcaacagaggagagaagacatggagatctacaacctggcggcagcgcaaaagatg

SEQ ID NO: 156481 - DNA, 103 bp, Artificial Sequence
  Synthetic Polynucleotide
taatacgactcactatagggcgaagcccagcaccaaggaaaggagcaccaaacagaggagatggtgcatgtttccttggaacctggcggcagcgcaaaagatg

SEQ ID NO: 156482 - DNA, 103 bp, Artificial Sequence
  Synthetic Polynucleotide
taatacgactcactatagggtggctacttcaaagaactccttgtagatctaacagaggagaagatctatgaggagttctaacctggcggcagcgcaaaagatg

SEQ ID NO: 156483 - DNA, 103 bp, Artificial Sequence
  Synthetic Polynucleotide
taatacgactcactatagggatgacatcattggctacttcaaagaactccaacagaggagaggagttatgtgaagtagcaacctggcggcagcgcaaaagatg

SEQ ID NO: 156484 - DNA, 103 bp, Artificial Sequence
  Synthetic Polynucleotide
taatacgactcactatagggcaggttggggatgacatcattggctacttcaacagaggagagaagtaatgaatgatgtcaacctggcggcagcgcaaaagatg

SEQ ID NO: 156485 - DNA, 103 bp, Artificial Sequence
  Synthetic Polynucleotide
taatacgactcactatagggcctccttcagcaggttggggatgacatcataacagaggagaatgatgatgtccccaaccaacctggcggcagcgcaaaagatg

SEQ ID NO: 156486 - DNA, 103 bp, Artificial Sequence
  Synthetic Polynucleotide
taatacgactcactatagggaagctggctgcctccttcagcaggttggggaacagaggagaccccaaatggctgaaggaaacctggcggcagcgcaaaagatg

SEQ ID NO: 156487 - DNA, 103 bp, Artificial Sequence
  Synthetic Polynucleotide
taatacgactcactatagggcgcctccagcaagctggctgcctccttcagaacagaggagactgaagatggcagccagcaacctggcggcagcgcaaaagatg

SEQ ID NO: 156488 - DNA, 103 bp, Artificial Sequence
  Synthetic Polynucleotide
taatacgactcactataggggctcctcgcccgcctccagcaagctggctgaacagaggagacagccaatgtgctggaggaacctggcggcagcgcaaaagatg

SEQ ID NO: 156489 - DNA, 103 bp, Artificial Sequence
  Synthetic Polynucleotide
taatacgactcactatagggtcccccggccgctcctcgcccgcctccagcaacagaggagagctggaatggggcgaggaaacctggcggcagcgcaaaagatg

SEQ ID NO: 156490 - DNA, 103 bp, Artificial Sequence
  Synthetic Polynucleotide
taatacgactcactatagggctggctttgctcccccggccgctcctcgccaacagaggagaggcgagatgcggccggggaacctggcggcagcgcaaaagatg

SEQ ID NO: 156491 - DNA, 103 bp, Artificial Sequence
  Synthetic Polynucleotide
taatacgactcactatagggtctgggtgccctggctttgctcccccggccaacagaggagaggccggatgagcaaagccaacctggcggcagcgcaaaagatg

SEQ ID NO: 156492 - DNA, 103 bp, Artificial Sequence
  Synthetic Polynucleotide
taatacgactcactatagggaaatgctccacgaagcccagcaccaaggaaaacagaggagattccttatggctgggcttaacctggcggcagcgcaaaagatg

SEQ ID NO: 156493 - DNA, 103 bp, Artificial Sequence
  Synthetic Polynucleotide
taatacgactcactataggggaaccttggctctgggtgccctggctttgcaacagaggagagcaaagatggggcacccaaacctggcggcagcgcaaaagatg

SEQ ID NO: 156494 - DNA, 103 bp, Artificial Sequence
  Synthetic Polynucleotide
taatacgactcactatagggctggagggcggaaccttggctctgggtgccaacagaggagaggcaccatgagccaaggtaacctggcggcagcgcaaaagatg

SEQ ID NO: 156495 - DNA, 103 bp, Artificial Sequence
  Synthetic Polynucleotide
taatacgactcactatagggactcagggtcctggagggcggaaccttggcaacagaggagagccaagatgccgccctccaacctggcggcagcgcaaaagatg

SEQ ID NO: 156496 - DNA, 103 bp, Artificial Sequence
  Synthetic Polynucleotide
taatacgactcactatagggtgggcgaagcactcagggtcctggagggcgaacagaggagacgccctatgggaccctgaaacctggcggcagcgcaaaagatg

SEQ ID NO: 156497 - DNA, 103 bp, Artificial Sequence
  Synthetic Polynucleotide
taatacgactcactatagggtcgcagcaggtgggcgaagcactcagggtcaacagaggagagaccctatgtgcttcgccaacctggcggcagcgcaaaagatg

SEQ ID NO: 156498 - DNA, 103 bp, Artificial Sequence
  Synthetic Polynucleotide
taatacgactcactatagggcgtcgtagaatcgcagcaggtgggcgaagcaacagaggagagcttcgatgacctgctgcaacctggcggcagcgcaaaagatg

SEQ ID NO: 156499 - DNA, 103 bp, Artificial Sequence
  Synthetic Polynucleotide
taatacgactcactatagggttgcagatgccgtcgtagaatcgcagcaggaacagaggagacctgctatgattctacgaaacctggcggcagcgcaaaagatg

SEQ ID NO: 156500 - DNA, 103 bp, Artificial Sequence
  Synthetic Polynucleotide
taatacgactcactatagggctcctcccatttgcagatgccgtcgtagaaaacagaggagattctacatgggcatctgcaacctggcggcagcgcaaaagatg

SEQ ID NO: 156501 - DNA, 103 bp, Artificial Sequence
  Synthetic Polynucleotide
taatacgactcactatagggtgggactgccctcctcccatttgcagatgcaacagaggagagcatctatgaatgggaggaacctggcggcagcgcaaaagatg

SEQ ID NO: 156502 - DNA, 103 bp, Artificial Sequence
  Synthetic Polynucleotide
taatacgactcactatagggagcacaggcgtgggactgccctcctcccataacagaggagaatgggaatggggcagtccaacctggcggcagcgcaaaagatg

SEQ ID NO: 156503 - DNA, 103 bp, Artificial Sequence
  Synthetic Polynucleotide
taatacgactcactataggggacagccagaaaatgctccacgaagcccagaacagaggagactgggcatggtggagcataacctggcggcagcgcaaaagatg

SEQ ID NO: 156504 - DNA, 103 bp, Artificial Sequence
  Synthetic Polynucleotide
taatacgactcactataggggcccacatgcagcacaggcgtgggactgccaacagaggagaggcagtatgacgcctgtgaacctggcggcagcgcaaaagatg

SEQ ID NO: 156505 - DNA, 103 bp, Artificial Sequence
  Synthetic Polynucleotide
taatacgactcactatagggaggtggcccagcccacatgcagcacaggcgaacagaggagacgcctgatgtgcatgtggaacctggcggcagcgcaaaagatg

SEQ ID NO: 156506 - DNA, 103 bp, Artificial Sequence
  Synthetic Polynucleotide
taatacgactcactatagggtgcacaagaaaggtggcccagcccacatgcaacagaggagagcatgtatgctgggccacaacctggcggcagcgcaaaagatg

SEQ ID NO: 156507 - DNA, 103 bp, Artificial Sequence
  Synthetic Polynucleotide
taatacgactcactataggggcctagggactgcacaagaaaggtggcccaaacagaggagatgggccatgtttcttgtgaacctggcggcagcgcaaaagatg

SEQ ID NO: 156508 - DNA, 103 bp, Artificial Sequence
  Synthetic Polynucleotide
taatacgactcactatagggcctcaaaacggcctagggactgcacaagaaaacagaggagattcttgatgagtccctagaacctggcggcagcgcaaaagatg

SEQ ID NO: 156509 - DNA, 103 bp, Artificial Sequence
  Synthetic Polynucleotide
taatacgactcactatagggcgcacctgtccctcaaaacggcctagggacaacagaggagagtccctatgccgttttgaaacctggcggcagcgcaaaagatg

SEQ ID NO: 156510 - DNA, 103 bp, Artificial Sequence
  Synthetic Polynucleotide
taatacgactcactatagggcaccttctgccgcacctgtccctcaaaacgaacagaggagacgttttatgggacaggtgaacctggcggcagcgcaaaagatg

SEQ ID NO: 156511 - DNA, 103 bp, Artificial Sequence
  Synthetic Polynucleotide
taatacgactcactatagggtcactatgcgcaccttctgccgcacctgtcaacagaggagagacaggatgggcagaaggaacctggcggcagcgcaaaagatg

SEQ ID NO: 156512 - DNA, 103 bp, Artificial Sequence
  Synthetic Polynucleotide
taatacgactcactataggggcctctcggctcactatgcgcaccttctgcaacagaggagagcagaaatggcgcatagtaacctggcggcagcgcaaaagatg

SEQ ID NO: 156513 - DNA, 103 bp, Artificial Sequence
  Synthetic Polynucleotide
taatacgactcactatagggggccgcctcggcctctcggctcactatgcgaacagaggagacgcataatgagccgagagaacctggcggcagcgcaaaagatg

SEQ ID NO: 156514 - DNA, 103 bp, Artificial Sequence
  Synthetic Polynucleotide
taatacgactcactatagggtgacgcggttgacagccagaaaatgctccaaacagaggagatggagcatgttctggctgaacctggcggcagcgcaaaagatg

SEQ ID NO: 156515 - DNA, 103 bp, Artificial Sequence
  Synthetic Polynucleotide
taatacgactcactatagggcctcggcctcggccgcctcggcctctcggcaacagaggagagccgagatgccgaggcggaacctggcggcagcgcaaaagatg

SEQ ID NO: 156516 - DNA, 103 bp, Artificial Sequence
  Synthetic Polynucleotide
taatacgactcactatagggccccacggctcctcggcctcggccgcctcgaacagaggagacgaggcatgcgaggccgaaacctggcggcagcgcaaaagatg

SEQ ID NO: 156517 - DNA, 103 bp, Artificial Sequence
  Synthetic Polynucleotide
taatacgactcactatagggggcttcctcgccccacggctcctcggcctcaacagaggagagaggccatggagccgtggaacctggcggcagcgcaaaagatg

SEQ ID NO: 156518 - DNA, 103 bp, Artificial Sequence
  Synthetic Polynucleotide
taatacgactcactatagggggccttcccgggcttcctcgccccacggctaacagaggagaagccgtatggcgaggaagaacctggcggcagcgcaaaagatg

SEQ ID NO: 156519 - DNA, 103 bp, Artificial Sequence
  Synthetic Polynucleotide
taatacgactcactatagggccccgccgccggccttcccgggcttcctcgaacagaggagacgaggaatgccgggaaggaacctggcggcagcgcaaaagatg

SEQ ID NO: 156520 - DNA, 103 bp, Artificial Sequence
  Synthetic Polynucleotide
taatacgactcactatagggccgccgtgggccccgccgccggccttcccgaacagaggagacgggaaatgcggcggcggaacctggcggcagcgcaaaagatg

SEQ ID NO: 156521 - DNA, 103 bp, Artificial Sequence
  Synthetic Polynucleotide
taatacgactcactataggggcttggactcccgccgtgggccccgccgccaacagaggagaggcggcatggcccacggcaacctggcggcagcgcaaaagatg

SEQ ID NO: 156522 - DNA, 103 bp, Artificial Sequence
  Synthetic Polynucleotide
taatacgactcactatagggggctcctctggcttggactcccgccgtgggaacagaggagacccacgatgggagtccaaaacctggcggcagcgcaaaagatg

SEQ ID NO: 156523 - DNA, 103 bp, Artificial Sequence
  Synthetic Polynucleotide
taatacgactcactataggggggcggcgggggctcctctggcttggactcaacagaggagagagtccatgccagaggagaacctggcggcagcgcaaaagatg

SEQ ID NO: 156524 - DNA, 103 bp, Artificial Sequence
  Synthetic Polynucleotide
taatacgactcactatagggctggcttcttgggcggcgggggctcctctgaacagaggagacagaggatgccccgccgcaacctggcggcagcgcaaaagatg

SEQ ID NO: 156525 - DNA, 103 bp, Artificial Sequence
  Synthetic Polynucleotide
taatacgactcactatagggttggtagggatgacgcggttgacagccagaaacagaggagatctggcatgcaaccgcgtaacctggcggcagcgcaaaagatg

SEQ ID NO: 156526 - DNA, 103 bp, Artificial Sequence
  Synthetic Polynucleotide
taatacgactcactatagggttgtccagtgctggcttcttgggcggcgggaacagaggagacccgccatgcaagaagccaacctggcggcagcgcaaaagatg

SEQ ID NO: 156527 - DNA, 103 bp, Artificial Sequence
  Synthetic Polynucleotide
taatacgactcactataggggcccaggcccttgtccagtgctggcttcttaacagaggagaaagaagatggcactggacaacctggcggcagcgcaaaagatg

SEQ ID NO: 156528 - DNA, 103 bp, Artificial Sequence
  Synthetic Polynucleotide
taatacgactcactatagggcctggccggtgcccaggcccttgtccagtgaacagaggagacactggatgagggcctggaacctggcggcagcgcaaaagatg

SEQ ID NO: 156529 - DNA, 103 bp, Artificial Sequence
  Synthetic Polynucleotide
taatacgactcactataggggacactgcaccctggccggtgcccaggcccaacagaggagagggcctatgcaccggccaaacctggcggcagcgcaaaagatg

SEQ ID NO: 156530 - DNA, 103 bp, Artificial Sequence
  Synthetic Polynucleotide
taatacgactcactatagggggggggtcctgacactgcaccctggccggtaacagaggagaaccggcatgggtgcagtgaacctggcggcagcgcaaaagatg

SEQ ID NO: 156531 - DNA, 103 bp, Artificial Sequence
  Synthetic Polynucleotide
taatacgactcactataggggaggcttccgggggggtcctgacactgcacaacagaggagagtgcagatgcaggaccccaacctggcggcagcgcaaaagatg

SEQ ID NO: 156532 - DNA, 103 bp, Artificial Sequence
  Synthetic Polynucleotide
taatacgactcactatagggacagtcccaggaggcttccgggggggtcctaacagaggagaaggaccatgccggaagccaacctggcggcagcgcaaaagatg

SEQ ID NO: 156533 - DNA, 103 bp, Artificial Sequence
  Synthetic Polynucleotide
taatacgactcactatagggtgtgccagcgacagtcccaggaggcttccgaacagaggagacggaagatgcctgggactaacctggcggcagcgcaaaagatg

SEQ ID NO: 156534 - DNA, 103 bp, Artificial Sequence
  Synthetic Polynucleotide
taatacgactcactatagggggcctcgggctgtgccagcgacagtcccagaacagaggagactgggaatgtcgctggcaaacctggcggcagcgcaaaagatg

SEQ ID NO: 156535 - DNA, 103 bp, Artificial Sequence
  Synthetic Polynucleotide
taatacgactcactatagggccaccttcagggcctcgggctgtgccagcgaacagaggagacgctggatgagcccgaggaacctggcggcagcgcaaaagatg

SEQ ID NO: 156536 - DNA, 103 bp, Artificial Sequence
  Synthetic Polynucleotide
taatacgactcactatagggctcgggaacgttggtagggatgacgcggttaacagaggagaaaccgcatgatccctaccaacctggcggcagcgcaaaagatg

SEQ ID NO: 156537 - DNA, 103 bp, Artificial Sequence
  Synthetic Polynucleotide
taatacgactcactatagggagccgtgctgccaccttcagggcctcgggcaacagaggagagcccgaatgcctgaaggtaacctggcggcagcgcaaaagatg

SEQ ID NO: 156538 - DNA, 103 bp, Artificial Sequence
  Synthetic Polynucleotide
taatacgactcactatagggctggcacctgagccgtgctgccaccttcagaacagaggagactgaagatggcagcacggaacctggcggcagcgcaaaagatg

SEQ ID NO: 156539 - DNA, 103 bp, Artificial Sequence
  Synthetic Polynucleotide
taatacgactcactataggggctgtgggtgctggcacctgagccgtgctgaacagaggagacagcacatgtcaggtgccaacctggcggcagcgcaaaagatg

SEQ ID NO: 156540 - DNA, 103 bp, Artificial Sequence
  Synthetic Polynucleotide
taatacgactcactatagggcggtggtgatgctgtgggtgctggcacctgaacagaggagacaggtgatggcacccacaaacctggcggcagcgcaaaagatg

SEQ ID NO: 156541 - DNA, 103 bp, Artificial Sequence
  Synthetic Polynucleotide
taatacgactcactataggggaccctccggcggtggtgatgctgtgggtgaacagaggagacacccaatgcatcaccacaacctggcggcagcgcaaaagatg

SEQ ID NO: 156542 - DNA, 103 bp, Artificial Sequence
  Synthetic Polynucleotide
taatacgactcactataggggtgagcactggaccctccggcggtggtgataacagaggagaatcaccatggccggagggaacctggcggcagcgcaaaagatg

SEQ ID NO: 156543 - DNA, 103 bp, Artificial Sequence
  Synthetic Polynucleotide
taatacgactcactatagggactctggaaagtgagcactggaccctccggaacagaggagaccggagatgccagtgctcaacctggcggcagcgcaaaagatg

SEQ ID NO: 156544 - DNA, 103 bp, Artificial Sequence
  Synthetic Polynucleotide
taatacgactcactatagggtcatcttctcactctggaaagtgagcactgaacagaggagacagtgcatgctttccagaaacctggcggcagcgcaaaagatg

SEQ ID NO: 156545 - DNA, 103 bp, Artificial Sequence
  Synthetic Polynucleotide
taatacgactcactatagggttcatgcccttcatcttctcactctggaaaaacagaggagatttccaatgtgagaagataacctggcggcagcgcaaaagatg

SEQ ID NO: 156546 - DNA, 103 bp, Artificial Sequence
  Synthetic Polynucleotide
taatacgactcactatagggcagcagctccttcatgcccttcatcttctcaacagaggagagagaagatgaagggcatgaacctggcggcagcgcaaaagatg

SEQ ID NO: 156547 - DNA, 103 bp, Artificial Sequence
  Synthetic Polynucleotide
taatacgactcactatagggggaaggtgagctcgggaacgttggtagggaaacagaggagatccctaatgacgttcccgaacctggcggcagcgcaaaagatg

SEQ ID NO: 156548 - DNA, 103 bp, Artificial Sequence
  Synthetic Polynucleotide
taatacgactcactatagggtggtggccaccagcagctccttcatgccctaacagaggagaagggcaatgaggagctgcaacctggcggcagcgcaaaagatg

SEQ ID NO: 156549 - DNA, 103 bp, Artificial Sequence
  Synthetic Polynucleotide
taatacgactcactataggggagttgatcttggtggccaccagcagctccaacagaggagaggagctatgggtggccacaacctggcggcagcgcaaaagatg

SEQ ID NO: 156550 - DNA, 103 bp, Artificial Sequence
  Synthetic Polynucleotide
taatacgactcactataggggatggcgctcgagttgatcttggtggccacaacagaggagagtggccatgaagatcaacaacctggcggcagcgcaaaagatg

SEQ ID NO: 156551 - DNA, 103 bp, Artificial Sequence
  Synthetic Polynucleotide
taatacgactcactataggggttgcagcttgatggcgctcgagttgatctaacagaggagaagatcaatgcgagcgccaaacctggcggcagcgcaaaagatg

SEQ ID NO: 156552 - DNA, 103 bp, Artificial Sequence
  Synthetic Polynucleotide
taatacgactcactatagggtgtgccgtgagttgcagcttgatggcgctcaacagaggagagagcgcatgcaagctgcaaacctggcggcagcgcaaaagatg

SEQ ID NO: 156553 - DNA, 103 bp, Artificial Sequence
  Synthetic Polynucleotide
taatacgactcactatagggcacttgcgactgtgccgtgagttgcagcttaacagaggagaaagctgatgctcacggcaaacctggcggcagcgcaaaagatg

SEQ ID NO: 156554 - DNA, 103 bp, Artificial Sequence
  Synthetic Polynucleotide
taatacgactcactatagggtcttcatctgcacttgcgactgtgccgtgaaacagaggagatcacggatgagtcgcaagaacctggcggcagcgcaaaagatg

SEQ ID NO: 156555 - DNA, 103 bp, Artificial Sequence
  Synthetic Polynucleotide
taatacgactcactatagggactttctgcttcttcatctgcacttgcgacaacagaggagagtcgcaatggcagatgaaaacctggcggcagcgcaaaagatg

SEQ ID NO: 156556 - DNA, 103 bp, Artificial Sequence
  Synthetic Polynucleotide
taatacgactcactatagggaggggtggacactttctgcttcttcatctgaacagaggagacagatgatgaagcagaaaaacctggcggcagcgcaaaagatg

SEQ ID NO: 156557 - DNA, 103 bp, Artificial Sequence
  Synthetic Polynucleotide
taatacgactcactatagggtgtagtcactaggggtggacactttctgctaacagaggagaagcagaatgtgtccacccaacctggcggcagcgcaaaagatg

SEQ ID NO: 156558 - DNA, 103 bp, Artificial Sequence
  Synthetic Polynucleotide
taatacgactcactataggggggctgggctggaaggtgagctcgggaacgaacagaggagacgttccatggctcaccttaacctggcggcagcgcaaaagatg

SEQ ID NO: 156559 - DNA, 103 bp, Artificial Sequence
  Synthetic Polynucleotide
taatacgactcactatagggaaagacagagtgtagtcactaggggtggacaacagaggagagtccacatgtagtgactaaacctggcggcagcgcaaaagatg

SEQ ID NO: 156560 - DNA, 103 bp, Artificial Sequence
  Synthetic Polynucleotide
taatacgactcactatagggccgcttgaggaaagacagagtgtagtcactaacagaggagaagtgacatgactctgtctaacctggcggcagcgcaaaagatg

SEQ ID NO: 156561 - DNA, 103 bp, Artificial Sequence
  Synthetic Polynucleotide
taatacgactcactatagggctttgcgctgccgcttgaggaaagacagagaacagaggagactctgtatgtcctcaagcaacctggcggcagcgcaaaagatg

SEQ ID NO: 156562 - DNA, 103 bp, Artificial Sequence
  Synthetic Polynucleotide
taatacgactcactataggggtcgggggcggggctgggctggaaggtgagaacagaggagactcaccatgcagcccagcaacctggcggcagcgcaaaagatg

SEQ ID NO: 156563 - DNA, 103 bp, Artificial Sequence
  Synthetic Polynucleotide
taatacgactcactataggggcagcgggaacagcgtcttctgggcggcctaacagaggagaaggccgatgagaagacgcaacctggcggcagcgcaaaagatg

SEQ ID NO: 156564 - DNA, 103 bp, Artificial Sequence
  Synthetic Polynucleotide
taatacgactcactatagggcgccaggcgggtcgggggcggggctgggctaacagaggagaagcccaatgccgcccccgaacctggcggcagcgcaaaagatg

SEQ ID NO: 156565 - DNA, 103 bp, Artificial Sequence
  Synthetic Polynucleotide
taatacgactcactatagggtaggtgaggccgccaggcgggtcgggggcgaacagaggagacgccccatgcccgcctggaacctggcggcagcgcaaaagatg

SEQ ID NO: 156566 - DNA, 103 bp, Artificial Sequence
  Synthetic Polynucleotide
taatacgactcactatagggcacgggaaagtaggtgaggccgccaggcggaacagaggagaccgcctatgggcctcaccaacctggcggcagcgcaaaagatg

SEQ ID NO: 156567 - DNA, 103 bp, Artificial Sequence
  Synthetic Polynucleotide
taatacgactcactatagggacaggtcggccacgggaaagtaggtgaggcaacagaggagagcctcaatgactttcccgaacctggcggcagcgcaaaagatg

SEQ ID NO: 156568 - DNA, 103 bp, Artificial Sequence
  Synthetic Polynucleotide
taatacgactcactataggggcgatgatagacaggtcggccacgggaaagaacagaggagactttccatgggccgacctaacctggcggcagcgcaaaagatg

SEQ ID NO: 156569 - DNA, 103 bp, Artificial Sequence
  Synthetic Polynucleotide
taatacgactcactatagggatagagggcggcgatgatagacaggtcggcaacagaggagagccgacatgtctatcatcaacctggcggcagcgcaaaagatg

SEQ ID NO: 156570 - DNA, 103 bp, Artificial Sequence
  Synthetic Polynucleotide
taatacgactcactatagggtgaagcgggcatagagggcggcgatgatagaacagaggagactatcaatgccgccctctaacctggcggcagcgcaaaagatg

SEQ ID NO: 156571 - DNA, 103 bp, Artificial Sequence
  Synthetic Polynucleotide
taatacgactcactatagggatctgggcggtgaagcgggcatagagggcgaacagaggagacgccctatgtgcccgcttaacctggcggcagcgcaaaagatg

SEQ ID NO: 156572 - DNA, 103 bp, Artificial Sequence
  Synthetic Polynucleotide
taatacgactcactatagggggcgcctcggatctgggcggtgaagcgggcaacagaggagagcccgcatgaccgcccagaacctggcggcagcgcaaaagatg

SEQ ID NO: 156573 - DNA, 103 bp, Artificial Sequence
  Synthetic Polynucleotide
taatacgactcactatagggacaggtcgacggcgcctcggatctgggcggaacagaggagaccgcccatgtccgaggcgaacctggcggcagcgcaaaagatg

SEQ ID NO: 156574 - DNA, 103 bp, Artificial Sequence
  Synthetic Polynucleotide
taatacgactcactatagggtcgatggagcgcagcgggaacagcgtcttcaacagaggagagaagacatggttcccgctaacctggcggcagcgcaaaagatg

SEQ ID NO: 156575 - DNA, 103 bp, Artificial Sequence
  Synthetic Polynucleotide
taatacgactcactatagggggatagagggacaggtcgacggcgcctcggaacagaggagaccgaggatgcgtcgacctaacctggcggcagcgcaaaagatg

SEQ ID NO: 156576 - DNA, 103 bp, Artificial Sequence
  Synthetic Polynucleotide
taatacgactcactatagggcccttctcgaggatagagggacaggtcgacaacagaggagagtcgacatgtccctctataacctggcggcagcgcaaaagatg

SEQ ID NO: 156577 - DNA, 103 bp, Artificial Sequence
  Synthetic Polynucleotide
taatacgactcactatagggtggagacacccccttctcgaggatagagggaacagaggagaccctctatgctcgagaagaacctggcggcagcgcaaaagatg

SEQ ID NO: 156578 - DNA, 103 bp, Artificial Sequence
  Synthetic Polynucleotide
taatacgactcactatagggagctcacggctggagacacccccttctcgaaacagaggagatcgagaatggggtgtctcaacctggcggcagcgcaaaagatg

SEQ ID NO: 156579 - DNA, 103 bp, Artificial Sequence
  Synthetic Polynucleotide
taatacgactcactatagggcttcttcaccagctcacggctggagacaccaacagaggagaggtgtcatgagccgtgagaacctggcggcagcgcaaaagatg

SEQ ID NO: 156580 - DNA, 103 bp, Artificial Sequence
  Synthetic Polynucleotide
taatacgactcactatagggcatcggagaccttcttcaccagctcacggcaacagaggagagccgtgatgtggtgaagaaacctggcggcagcgcaaaagatg

SEQ ID NO: 156581 - DNA, 103 bp, Artificial Sequence
  Synthetic Polynucleotide
taatacgactcactatagggttccatatgacatcggagaccttcttcaccaacagaggagaggtgaaatgggtctccgaaacctggcggcagcgcaaaagatg

SEQ ID NO: 156582 - DNA, 103 bp, Artificial Sequence
  Synthetic Polynucleotide
taatacgactcactataggggctgaggctgttccatatgacatcggagacaacagaggagagtctccatggtcatatggaacctggcggcagcgcaaaagatg

SEQ ID NO: 156583 - DNA, 103 bp, Artificial Sequence
  Synthetic Polynucleotide
taatacgactcactatagggagtaggagcggctgaggctgttccatatgaaacagaggagatcatatatgacagcctcaaacctggcggcagcgcaaaagatg

SEQ ID NO: 156584 - DNA, 103 bp, Artificial Sequence
  Synthetic Polynucleotide
taatacgactcactatagggcgatccttgaagtaggagcggctgaggctgaacagaggagacagcctatgccgctcctaaacctggcggcagcgcaaaagatg

SEQ ID NO: 156585 - DNA, 103 bp, Artificial Sequence
  Synthetic Polynucleotide
taatacgactcactatagggcaccacgtcgtcgatggagcgcagcgggaaaacagaggagattcccgatgcgctccatcaacctggcggcagcgcaaaagatg

SEQ ID NO: 156586 - DNA, 103 bp, Artificial Sequence
  Synthetic Polynucleotide
taatacgactcactataggggatgtgggcccgatccttgaagtaggagcgaacagaggagacgctccatgttcaaggataacctggcggcagcgcaaaagatg

SEQ ID NO: 156587 - DNA, 103 bp, Artificial Sequence
  Synthetic Polynucleotide
taatacgactcactatagggagagggactggatgtgggcccgatccttgaaacagaggagatcaaggatggggcccacaaacctggcggcagcgcaaaagatg

SEQ ID NO: 156588 - DNA, 103 bp, Artificial Sequence
  Synthetic Polynucleotide
taatacgactcactatagggatgaagctgaagagggactggatgtgggccaacagaggagaggcccaatgccagtccctaacctggcggcagcgcaaaagatg

SEQ ID NO: 156589 - DNA, 103 bp, Artificial Sequence
  Synthetic Polynucleotide
taatacgactcactatagggccaacctgtgatgaagctgaagagggactgaacagaggagacagtccatgttcagcttcaacctggcggcagcgcaaaagatg

SEQ ID NO: 156590 - DNA, 103 bp, Artificial Sequence
  Synthetic Polynucleotide
taatacgactcactatagggctactgggctccaacctgtgatgaagctgaaacagaggagatcagctatgtcacaggttaacctggcggcagcgcaaaagatg

SEQ ID NO: 156591 - DNA, 103 bp, Artificial Sequence
  Synthetic Polynucleotide
taatacgactcactatagggaatttggtgcctactgggctccaacctgtgaacagaggagacacaggatggagcccagtaacctggcggcagcgcaaaagatg

SEQ ID NO: 156592 - DNA, 103 bp, Artificial Sequence
  Synthetic Polynucleotide
taatacgactcactatagggggagctgtccaatttggtgcctactgggctaacagaggagaagcccaatgggcaccaaaaacctggcggcagcgcaaaagatg

SEQ ID NO: 156593 - DNA, 103 bp, Artificial Sequence
  Synthetic Polynucleotide
taatacgactcactatagggaggccacaccggagctgtccaatttggtgcaacagaggagagcaccaatgtggacagctaacctggcggcagcgcaaaagatg

SEQ ID NO: 156594 - DNA, 103 bp, Artificial Sequence
  Synthetic Polynucleotide
taatacgactcactatagggaccacagcaaaggccacaccggagctgtccaacagaggagaggacagatgcggtgtggcaacctggcggcagcgcaaaagatg

SEQ ID NO: 156595 - DNA, 103 bp, Artificial Sequence
  Synthetic Polynucleotide
taatacgactcactataggggcaggccccaaccacagcaaaggccacaccaacagaggagaggtgtgatgtttgctgtgaacctggcggcagcgcaaaagatg

SEQ ID NO: 156596 - DNA, 103 bp, Artificial Sequence
  Synthetic Polynucleotide
taatacgactcactatagggcaaacaggcgcaccacgtcgtcgatggagcaacagaggagagctccaatgacgacgtggaacctggcggcagcgcaaaagatg

SEQ ID NO: 156597 - DNA, 103 bp, Artificial Sequence
  Synthetic Polynucleotide
taatacgactcactatagggccagggcctggcaggccccaaccacagcaaaacagaggagattgctgatgttggggcctaacctggcggcagcgcaaaagatg

SEQ ID NO: 156598 - DNA, 103 bp, Artificial Sequence
  Synthetic Polynucleotide
taatacgactcactatagggtcccggagacccagggcctggcaggccccaaacagaggagatggggcatgccaggccctaacctggcggcagcgcaaaagatg

SEQ ID NO: 156599 - DNA, 103 bp, Artificial Sequence
  Synthetic Polynucleotide
taatacgactcactataggggaggtggacatcccggagacccagggcctgaacagaggagacaggccatgggtctccggaacctggcggcagcgcaaaagatg

SEQ ID NO: 156600 - DNA, 103 bp, Artificial Sequence
  Synthetic Polynucleotide
taatacgactcactatagggcagacagggcgaggtggacatcccggagacaacagaggagagtctccatgatgtccaccaacctggcggcagcgcaaaagatg

SEQ ID NO: 156601 - DNA, 103 bp, Artificial Sequence
  Synthetic Polynucleotide
taatacgactcactataggggcatgatcctcagacagggcgaggtggacaaacagaggagatgtccaatgcgccctgtcaacctggcggcagcgcaaaagatg

SEQ ID NO: 156602 - DNA, 103 bp, Artificial Sequence
  Synthetic Polynucleotide
taatacgactcactatagggcactacccaggcatgatcctcagacagggcaacagaggagagccctgatggaggatcataacctggcggcagcgcaaaagatg

SEQ ID NO: 156603 - DNA, 103 bp, Artificial Sequence
  Synthetic Polynucleotide
taatacgactcactatagggtgggcccaaacactacccaggcatgatcctaacagaggagaaggatcatgcctgggtagaacctggcggcagcgcaaaagatg

SEQ ID NO: 156604 - DNA, 103 bp, Artificial Sequence
  Synthetic Polynucleotide
taatacgactcactatagggtgctccccattgggcccaaacactacccagaacagaggagactgggtatggtttgggccaacctggcggcagcgcaaaagatg

SEQ ID NO: 156605 - DNA, 103 bp, Artificial Sequence
  Synthetic Polynucleotide
taatacgactcactatagggctcagctgtctgctccccattgggcccaaaaacagaggagatttgggatgaatggggagaacctggcggcagcgcaaaagatg

SEQ ID NO: 156606 - DNA, 103 bp, Artificial Sequence
  Synthetic Polynucleotide
taatacgactcactataggggccaggtgacctcagctgtctgctccccataacagaggagaatggggatgagacagctgaacctggcggcagcgcaaaagatg

SEQ ID NO: 156607 - DNA, 103 bp, Artificial Sequence
  Synthetic Polynucleotide
taatacgactcactatagggagctcggcagcaaacaggcgcaccacgtcgaacagaggagacgacgtatggcgcctgttaacctggcggcagcgcaaaagatg

SEQ ID NO: 156608 - DNA, 103 bp, Artificial Sequence
  Synthetic Polynucleotide
taatacgactcactatagggcccttgccgtgccaggtgacctcagctgtcaacagaggagagacagcatgggtcacctgaacctggcggcagcgcaaaagatg

SEQ ID NO: 156609 - DNA, 103 bp, Artificial Sequence
  Synthetic Polynucleotide
taatacgactcactataggggtcctcgttgcccttgccgtgccaggtgacaacagaggagagtcaccatgcacggcaagaacctggcggcagcgcaaaagatg

SEQ ID NO: 156610 - DNA, 103 bp, Artificial Sequence
  Synthetic Polynucleotide
taatacgactcactatagggggcccctgcggtcctcgttgcccttgccgtaacagaggagaacggcaatggcaacgaggaacctggcggcagcgcaaaagatg

SEQ ID NO: 156611 - DNA, 103 bp, Artificial Sequence
  Synthetic Polynucleotide
taatacgactcactatagggttgactgtctggcccctgcggtcctcgttgaacagaggagacaacgaatgccgcaggggaacctggcggcagcgcaaaagatg

SEQ ID NO: 156612 - DNA, 103 bp, Artificial Sequence
  Synthetic Polynucleotide
taatacgactcactatagggcacaccggcattgactgtctggcccctgcgaacagaggagacgcaggatgcagacagtcaacctggcggcagcgcaaaagatg

SEQ ID NO: 156613 - DNA, 103 bp, Artificial Sequence
  Synthetic Polynucleotide
taatacgactcactatagggtccgctcagccacaccggcattgactgtctaacagaggagaagacagatgatgccggtgaacctggcggcagcgcaaaagatg

SEQ ID NO: 156614 - DNA, 103 bp, Artificial Sequence
  Synthetic Polynucleotide
taatacgactcactatagggtacagccagctccgctcagccacaccggcaaacagaggagatgccggatgggctgagcgaacctggcggcagcgcaaaagatg

SEQ ID NO: 156615 - DNA, 103 bp, Artificial Sequence
  Synthetic Polynucleotide
taatacgactcactatagggtcctttcaggtacagccagctccgctcagcaacagaggagagctgagatgagctggctgaacctggcggcagcgcaaaagatg

SEQ ID NO: 156616 - DNA, 103 bp, Artificial Sequence
  Synthetic Polynucleotide
taatacgactcactataggggcatgtatgatcctttcaggtacagccagcaacagaggagagctggcatgacctgaaagaacctggcggcagcgcaaaagatg

SEQ ID NO: 156617 - DNA, 103 bp, Artificial Sequence
  Synthetic Polynucleotide
taatacgactcactatagggcggtcacagcgcatgtatgatcctttcaggaacagaggagacctgaaatgatcatacataacctggcggcagcgcaaaagatg

SEQ ID NO: 156618 - DNA, 103 bp, Artificial Sequence
  Synthetic Polynucleotide
taatacgactcactatagggctctcggcccagctcggcagcaaacaggcgaacagaggagacgcctgatggctgccgagaacctggcggcagcgcaaaagatg

SEQ ID NO: 156619 - DNA, 103 bp, Artificial Sequence
  Synthetic Polynucleotide
taatacgactcactatagggctccatcttgcggtcacagcgcatgtatgaaacagaggagatcatacatgcgctgtgacaacctggcggcagcgcaaaagatg

SEQ ID NO: 156620 - DNA, 103 bp, Artificial Sequence
  Synthetic Polynucleotide
taatacgactcactatagggtgaacgccacctccatcttgcggtcacagcaacagaggagagctgtgatggcaagatggaacctggcggcagcgcaaaagatg

SEQ ID NO: 156621 - DNA, 103 bp, Artificial Sequence
  Synthetic Polynucleotide
taatacgactcactataggggcacacaccatgaacgccacctccatcttgaacagaggagacaagatatgggtggcgttaacctggcggcagcgcaaaagatg

SEQ ID NO: 156622 - DNA, 103 bp, Artificial Sequence
  Synthetic Polynucleotide
taatacgactcactatagggagggttgatggcacacaccatgaacgccacaacagaggagagtggcgatgatggtgtgtaacctggcggcagcgcaaaagatg

SEQ ID NO: 156623 - DNA, 103 bp, Artificial Sequence
  Synthetic Polynucleotide
taatacgactcactatagggggtcaatggaagggttgatggcacacaccaaacagaggagatggtgtatgccatcaaccaacctggcggcagcgcaaaagatg

SEQ ID NO: 156624 - DNA, 103 bp, Artificial Sequence
  Synthetic Polynucleotide
taatacgactcactatagggtcggtgtgcaggtcaatggaagggttgatgaacagaggagacatcaaatgttccattgaaacctggcggcagcgcaaaagatg

SEQ ID NO: 156625 - DNA, 103 bp, Artificial Sequence
  Synthetic Polynucleotide
taatacgactcactatagggctccagcgagtcggtgtgcaggtcaatggaaacagaggagatccattatgctgcacaccaacctggcggcagcgcaaaagatg

SEQ ID NO: 156626 - DNA, 103 bp, Artificial Sequence
  Synthetic Polynucleotide
taatacgactcactataggggctgcagaagctccagcgagtcggtgtgcaaacagaggagatgcacaatgactcgctggaacctggcggcagcgcaaaagatg

SEQ ID NO: 156627 - DNA, 103 bp, Artificial Sequence
  Synthetic Polynucleotide
taatacgactcactatagggttctgctgcagctgcagaagctccagcgagaacagaggagactcgctatggcttctgcaaacctggcggcagcgcaaaagatg

SEQ ID NO: 156628 - DNA, 103 bp, Artificial Sequence
  Synthetic Polynucleotide
taatacgactcactatagggccagagcagcttctgctgcagctgcagaagaacagaggagacttctgatgctgcagcagaacctggcggcagcgcaaaagatg

SEQ ID NO: 156629 - DNA, 103 bp, Artificial Sequence
  Synthetic Polynucleotide
taatacgactcactatagggggtccggctcctctcggcccagctcggcagaacagaggagactgccgatgtgggccgagaacctggcggcagcgcaaaagatg

SEQ ID NO: 156630 - DNA, 103 bp, Artificial Sequence
  Synthetic Polynucleotide
taatacgactcactatagggcatagagcagccagagcagcttctgctgcaaacagaggagatgcagcatgagctgctctaacctggcggcagcgcaaaagatg

SEQ ID NO: 156631 - DNA, 103 bp, Artificial Sequence
  Synthetic Polynucleotide
taatacgactcactatagggtgtcccaggtcatagagcagccagagcagcaacagaggagagctgctatggctgctctaaacctggcggcagcgcaaaagatg

SEQ ID NO: 156632 - DNA, 103 bp, Artificial Sequence
  Synthetic Polynucleotide
taatacgactcactatagggcctttccagatgtcccaggtcatagagcagaacagaggagactgctcatggacctgggaaacctggcggcagcgcaaaagatg

SEQ ID NO: 156633 - DNA, 103 bp, Artificial Sequence
  Synthetic Polynucleotide
taatacgactcactatagggccatggggtacctttccagatgtcccaggtaacagaggagaacctggatgatctggaaaaacctggcggcagcgcaaaagatg

SEQ ID NO: 156634 - DNA, 103 bp, Artificial Sequence
  Synthetic Polynucleotide
taatacgactcactatagggttccctaaggccatggggtacctttccagaaacagaggagatctggaatggtaccccataacctggcggcagcgcaaaagatg

SEQ ID NO: 156635 - DNA, 103 bp, Artificial Sequence
  Synthetic Polynucleotide
taatacgactcactatagggatctgccaggttccctaaggccatggggtaaacagaggagataccccatggccttagggaacctggcggcagcgcaaaagatg

SEQ ID NO: 156636 - DNA, 103 bp, Artificial Sequence
  Synthetic Polynucleotide
taatacgactcactataggggctcctctagatctgccaggttccctaaggaacagaggagaccttagatgacctggcagaacctggcggcagcgcaaaagatg

SEQ ID NO: 156637 - DNA, 103 bp, Artificial Sequence
  Synthetic Polynucleotide
taatacgactcactataggggtgggctccagctcctctagatctgccaggaacagaggagacctggcatgtctagaggaaacctggcggcagcgcaaaagatg

SEQ ID NO: 156638 - DNA, 103 bp, Artificial Sequence
  Synthetic Polynucleotide
taatacgactcactatagggccggccaggggtgggctccagctcctctagaacagaggagactagagatgctggagcccaacctggcggcagcgcaaaagatg

SEQ ID NO: 156639 - DNA, 103 bp, Artificial Sequence
  Synthetic Polynucleotide
taatacgactcactataggggtgggtctggccggccaggggtgggctccaaacagaggagatggagcatgcccctggccaacctggcggcagcgcaaaagatg

SEQ ID NO: 156640 - DNA, 103 bp, Artificial Sequence
  Synthetic Polynucleotide
taatacgactcactatagggaggagcaccaggtccggctcctctcggcccaacagaggagagggccgatgggagccggaaacctggcggcagcgcaaaagatg

SEQ ID NO: 156641 - DNA, 103 bp, Artificial Sequence
  Synthetic Polynucleotide
taatacgactcactatagggtagagggtgagtgggtctggccggccagggaacagaggagaccctggatggccagacccaacctggcggcagcgcaaaagatg

SEQ ID NO: 156642 - DNA, 103 bp, Artificial Sequence
  Synthetic Polynucleotide
taatacgactcactataggggcccttgtggtagagggtgagtgggtctggaacagaggagaccagacatgctcaccctcaacctggcggcagcgcaaaagatg

SEQ ID NO: 156643 - DNA, 103 bp, Artificial Sequence
  Synthetic Polynucleotide
taatacgactcactatagggctgaggcaatgcccttgtggtagagggtgaaacagaggagatcacccatgaccacaaggaacctggcggcagcgcaaaagatg

SEQ ID NO: 156644 - DNA, 103 bp, Artificial Sequence
  Synthetic Polynucleotide
taatacgactcactatagggtaggtcttggctgaggcaatgcccttgtggaacagaggagaccacaaatgcattgcctcaacctggcggcagcgcaaaagatg

SEQ ID NO: 156645 - DNA, 103 bp, Artificial Sequence
  Synthetic Polynucleotide
taatacgactcactatagggatcccgatagtaggtcttggctgaggcaataacagaggagaattgccatggccaagaccaacctggcggcagcgcaaaagatg

SEQ ID NO: 156646 - DNA, 103 bp, Artificial Sequence
  Synthetic Polynucleotide
taatacgactcactatagggagatgtgttcatcccgatagtaggtcttggaacagaggagaccaagaatgactatcgggaacctggcggcagcgcaaaagatg

SEQ ID NO: 156647 - DNA, 103 bp, Artificial Sequence
  Synthetic Polynucleotide
taatacgactcactatagggatgtaggggtagatgtgttcatcccgatagaacagaggagactatcgatgtgaacacataacctggcggcagcgcaaaagatg

SEQ ID NO: 156648 - DNA, 103 bp, Artificial Sequence
  Synthetic Polynucleotide
taatacgactcactatagggagccaggtacatgtaggggtagatgtgttcaacagaggagagaacacatgtacccctacaacctggcggcagcgcaaaagatg

SEQ ID NO: 156649 - DNA, 103 bp, Artificial Sequence
  Synthetic Polynucleotide
taatacgactcactatagggagtggtagccagccaggtacatgtaggggtaacagaggagaacccctatgtgtacctggaacctggcggcagcgcaaaagatg

SEQ ID NO: 156650 - DNA, 103 bp, Artificial Sequence
  Synthetic Polynucleotide
taatacgactcactatagggcggttgcgacagtggtagccagccaggtacaacagaggagagtacctatgtggctaccaaacctggcggcagcgcaaaagatg

SEQ ID NO: 156651 - DNA, 103 bp, Artificial Sequence
  Synthetic Polynucleotide
taatacgactcactatagggcctcatgcagctgctggccgcgggatccataacagaggagaatggatatggcggccagcaacctggcggcagcgcaaaagatg

SEQ ID NO: 156652 - DNA, 103 bp, Artificial Sequence
  Synthetic Polynucleotide
taatacgactcactataggggggcgggtagtggggtagccctgaggccccaacagaggagaggggccatggggctacccaacctggcggcagcgcaaaagatg

SEQ ID NO: 156653 - DNA, 103 bp, Artificial Sequence
  Synthetic Polynucleotide
taatacgactcactatagggagaacggggtgggcgggtagtggggtagccaacagaggagaggctacatgactacccgcaacctggcggcagcgcaaaagatg

SEQ ID NO: 156654 - DNA, 103 bp, Artificial Sequence
  Synthetic Polynucleotide
taatacgactcactatagggtggtggaaggagaacggggtgggcgggtagaacagaggagactacccatgcaccccgttaacctggcggcagcgcaaaagatg

SEQ ID NO: 156655 - DNA, 103 bp, Artificial Sequence
  Synthetic Polynucleotide
taatacgactcactataggggtctggtttctggtggaaggagaacggggtaacagaggagaaccccgatgtccttccacaacctggcggcagcgcaaaagatg

SEQ ID NO: 156656 - DNA, 103 bp, Artificial Sequence
  Synthetic Polynucleotide
taatacgactcactatagggtcgccaggaagtctggtttctggtggaaggaacagaggagaccttccatgagaaaccagaacctggcggcagcgcaaaagatg

SEQ ID NO: 156657 - DNA, 103 bp, Artificial Sequence
  Synthetic Polynucleotide
taatacgactcactataggggccgtcgctgtcgccaggaagtctggtttcaacagaggagagaaaccatgcttcctggcaacctggcggcagcgcaaaagatg

SEQ ID NO: 156658 - DNA, 103 bp, Artificial Sequence
  Synthetic Polynucleotide
taatacgactcactatagggagggtacgctgccgtcgctgtcgccaggaaaacagaggagattcctgatgacagcgacgaacctggcggcagcgcaaaagatg

SEQ ID NO: 156659 - DNA, 103 bp, Artificial Sequence
  Synthetic Polynucleotide
taatacgactcactatagggctgagaagtcagggtacgctgccgtcgctgaacagaggagacagcgaatgcagcgtaccaacctggcggcagcgcaaaagatg

SEQ ID NO: 156660 - DNA, 103 bp, Artificial Sequence
  Synthetic Polynucleotide
taatacgactcactatagggaggcaggaggctgagaagtcagggtacgctaacagaggagaagcgtaatgtgacttctcaacctggcggcagcgcaaaagatg

SEQ ID NO: 156661 - DNA, 103 bp, Artificial Sequence
  Synthetic Polynucleotide
taatacgactcactatagggggtggctgccaggcaggaggctgagaagtcaacagaggagagacttcatggcctcctgcaacctggcggcagcgcaaaagatg

SEQ ID NO: 156662 - DNA, 103 bp, Artificial Sequence
  Synthetic Polynucleotide
taatacgactcactataggggctggaggctcctcatgcagctgctggccgaacagaggagacggccaatggctgcatgaaacctggcggcagcgcaaaagatg

SEQ ID NO: 156663 - DNA, 103 bp, Artificial Sequence
  Synthetic Polynucleotide
taatacgactcactatagggggctgtgtggggtggctgccaggcaggaggaacagaggagacctcctatgtggcagccaaacctggcggcagcgcaaaagatg

SEQ ID NO: 156664 - DNA, 103 bp, Artificial Sequence
  Synthetic Polynucleotide
taatacgactcactatagggtcctggggcaggctgtgtggggtggctgccaacagaggagaggcagcatgcccacacagaacctggcggcagcgcaaaagatg

SEQ ID NO: 156665 - DNA, 103 bp, Artificial Sequence
  Synthetic Polynucleotide
taatacgactcactataggggatgtgctcctcctggggcaggctgtgtggaacagaggagaccacacatgctgccccagaacctggcggcagcgcaaaagatg

SEQ ID NO: 156666 - DNA, 103 bp, Artificial Sequence
  Synthetic Polynucleotide
taatacgactcactataggggctcagtgaagatgtgctcctcctggggcaaacagaggagatgccccatgaggagcacaaacctggcggcagcgcaaaagatg

SEQ ID NO: 156667 - DNA, 103 bp, Artificial Sequence
  Synthetic Polynucleotide
taatacgactcactataggggcggggtgctgctcagtgaagatgtgctccaacagaggagaggagcaatgcttcactgaaacctggcggcagcgcaaaagatg

SEQ ID NO: 156668 - DNA, 103 bp, Artificial Sequence
  Synthetic Polynucleotide
taatacgactcactatagggctgtgggaaagcggggtgctgctcagtgaaaacagaggagattcactatgcagcaccccaacctggcggcagcgcaaaagatg

SEQ ID NO: 156669 - DNA, 103 bp, Artificial Sequence
  Synthetic Polynucleotide
taatacgactcactatagggagttgggggactgtgggaaagcggggtgctaacagaggagaagcaccatgctttcccacaacctggcggcagcgcaaaagatg

SEQ ID NO: 156670 - DNA, 103 bp, Artificial Sequence
  Synthetic Polynucleotide
taatacgactcactataggggggaagtgccagttgggggactgtgggaaaaacagaggagatttcccatggtcccccaaaacctggcggcagcgcaaaagatg

SEQ ID NO: 156671 - DNA, 103 bp, Artificial Sequence
  Synthetic Polynucleotide
taatacgactcactataggggtctgagacagggaagtgccagttgggggaaacagaggagatcccccatgtggcacttcaacctggcggcagcgcaaaagatg

SEQ ID NO: 156672 - DNA, 103 bp, Artificial Sequence
  Synthetic Polynucleotide
taatacgactcactatagggtgcgccgggcgtctgagacagggaagtgccaacagaggagaggcactatgctgtctcagaacctggcggcagcgcaaaagatg

SEQ ID NO: 156673 - DNA, 103 bp, Artificial Sequence
  Synthetic Polynucleotide
taatacgactcactatagggggggctgggggctggaggctcctcatgcagaacagaggagactgcatatggagcctccaaacctggcggcagcgcaaaagatg

SEQ ID NO: 156674 - DNA, 103 bp, Artificial Sequence
  Synthetic Polynucleotide
taatacgactcactataggggagttgggcctgcgccgggcgtctgagacaaacagaggagatgtctcatgcgcccggcgaacctggcggcagcgcaaaagatg

SEQ ID NO: 156675 - DNA, 103 bp, Artificial Sequence
  Synthetic Polynucleotide
taatacgactcactatagggtgccgggcctgagttgggcctgcgccgggcaacagaggagagcccggatgaggcccaacaacctggcggcagcgcaaaagatg

SEQ ID NO: 156676 - DNA, 103 bp, Artificial Sequence
  Synthetic Polynucleotide
taatacgactcactatagggtggaaccccctgccgggcctgagttgggccaacagaggagaggcccaatgcaggcccggaacctggcggcagcgcaaaagatg

SEQ ID NO: 156677 - DNA, 103 bp, Artificial Sequence
  Synthetic Polynucleotide
taatacgactcactatagggcccatttccttggaaccccctgccgggcctaacagaggagaaggcccatgagggggttcaacctggcggcagcgcaaaagatg

SEQ ID NO: 156678 - DNA, 103 bp, Artificial Sequence
  Synthetic Polynucleotide
taatacgactcactataggggctgctggtccccatttccttggaacccccaacagaggagagggggtatgaaggaaatgaacctggcggcagcgcaaaagatg

SEQ ID NO: 156679 - DNA, 103 bp, Artificial Sequence
  Synthetic Polynucleotide
taatacgactcactatagggccaggcccaggctgctggtccccatttcctaacagaggagaaggaaaatgggaccagcaaacctggcggcagcgcaaaagatg

SEQ ID NO: 156680 - DNA, 103 bp, Artificial Sequence
  Synthetic Polynucleotide
taatacgactcactataggggtggtgtccaccaggcccaggctgctggtcaacagaggagagaccagatgcctgggcctaacctggcggcagcgcaaaagatg

SEQ ID NO: 156681 - DNA, 103 bp, Artificial Sequence
  Synthetic Polynucleotide
taatacgactcactatagggtgggcctcctgtggtgtccaccaggcccagaacagaggagactgggcatggtggacaccaacctggcggcagcgcaaaagatg

SEQ ID NO: 156682 - DNA, 103 bp, Artificial Sequence
  Synthetic Polynucleotide
taatacgactcactatagggagtcatcgcctgggcctcctgtggtgtccaaacagaggagatggacaatgcaggaggccaacctggcggcagcgcaaaagatg

SEQ ID NO: 156683 - DNA, 103 bp, Artificial Sequence
  Synthetic Polynucleotide
taatacgactcactatagggagcaccccgtagtcatcgcctgggcctcctaacagaggagaaggaggatgaggcgatgaaacctggcggcagcgcaaaagatg

SEQ ID NO: 156684 - DNA, 103 bp, Artificial Sequence
  Synthetic Polynucleotide
taatacgactcactataggggccccagacaggggctgggggctggaggctaacagaggagaagcctcatgcccccagccaacctggcggcagcgcaaaagatg

SEQ ID NO: 156685 - DNA, 103 bp, Artificial Sequence
  Synthetic Polynucleotide
taatacgactcactatagggagtgctcccaagcaccccgtagtcatcgccaacagaggagaggcgatatgtacggggtgaacctggcggcagcgcaaaagatg

SEQ ID NO: 156686 - DNA, 103 bp, Artificial Sequence
  Synthetic Polynucleotide
taatacgactcactatagggtctcattggcagtgctcccaagcaccccgtaacagaggagaacggggatgttgggagcaaacctggcggcagcgcaaaagatg

SEQ ID NO: 156687 - DNA, 103 bp, Artificial Sequence
  Synthetic Polynucleotide
taatacgactcactatagggttcttctctgtctcattggcagtgctcccaaacagaggagatgggagatgtgccaatgaaacctggcggcagcgcaaaagatg

SEQ ID NO: 156688 - DNA, 103 bp, Artificial Sequence
  Synthetic Polynucleotide
taatacgactcactatagggcctggatgatttcttctctgtctcattggcaacagaggagagccaatatgacagagaagaacctggcggcagcgcaaaagatg

SEQ ID NO: 156689 - DNA, 103 bp, Artificial Sequence
  Synthetic Polynucleotide
taatacgactcactatagggcctttctccgcctggatgatttcttctctgaacagaggagacagagaatgaatcatccaaacctggcggcagcgcaaaagatg

SEQ ID NO: 156690 - DNA, 103 bp, Artificial Sequence
  Synthetic Polynucleotide
taatacgactcactatagggtctgaactctcctttctccgcctggatgataacagaggagaatcatcatggcggagaaaaacctggcggcagcgcaaaagatg

SEQ ID NO: 156691 - DNA, 103 bp, Artificial Sequence
  Synthetic Polynucleotide
taatacgactcactatagggctcctggttgtctgaactctcctttctccgaacagaggagacggagaatggagagttcaaacctggcggcagcgcaaaagatg

SEQ ID NO: 156692 - DNA, 103 bp, Artificial Sequence
  Synthetic Polynucleotide
taatacgactcactatagggtccctctgttctcctggttgtctgaactctaacagaggagaagagttatgacaaccaggaacctggcggcagcgcaaaagatg

SEQ ID NO: 156693 - DNA, 103 bp, Artificial Sequence
  Synthetic Polynucleotide
taatacgactcactatagggccctccggcttccctctgttctcctggttgaacagaggagacaaccaatggaacagaggaacctggcggcagcgcaaaagatg

SEQ ID NO: 156694 - DNA, 103 bp, Artificial Sequence
  Synthetic Polynucleotide
taatacgactcactatagggtttgctgctgccctccggcttccctctgttaacagaggagaaacagaatgaagccggagaacctggcggcagcgcaaaagatg

SEQ ID NO: 156695 - DNA, 103 bp, Artificial Sequence
  Synthetic Polynucleotide
taatacgactcactatagggttcgaaggcagccccagacaggggctggggaacagaggagaccccagatgctgtctgggaacctggcggcagcgcaaaagatg

SEQ ID NO: 156696 - DNA, 103 bp, Artificial Sequence
  Synthetic Polynucleotide
taatacgactcactatagggccttgcgggctttgctgctgccctccggctaacagaggagaagccggatggcagcagcaaacctggcggcagcgcaaaagatg

SEQ ID NO: 156697 - DNA, 103 bp, Artificial Sequence
  Synthetic Polynucleotide
taatacgactcactataggggccgtcctctccttgcgggctttgctgctgaacagaggagacagcagatgagcccgcaaaacctggcggcagcgcaaaagatg

SEQ ID NO: 156698 - DNA, 103 bp, Artificial Sequence
  Synthetic Polynucleotide
taatacgactcactatagggcttggtgaaggccgtcctctccttgcgggcaacagaggagagcccgcatggagaggacgaacctggcggcagcgcaaaagatg

SEQ ID NO: 156699 - DNA, 103 bp, Artificial Sequence
  Synthetic Polynucleotide
taatacgactcactataggggcagctgctccttggtgaaggccgtcctctaacagaggagaagaggaatgccttcaccaaacctggcggcagcgcaaaagatg

SEQ ID NO: 156700 - DNA, 103 bp, Artificial Sequence
  Synthetic Polynucleotide
taatacgactcactatagggtccagctctcgcagctgctccttggtgaagaacagaggagacttcacatgggagcagctaacctggcggcagcgcaaaagatg

SEQ ID NO: 156701 - DNA, 103 bp, Artificial Sequence
  Synthetic Polynucleotide
taatacgactcactatagggaaactctgcctccagctctcgcagctgctcaacagaggagagagcagatgcgagagctgaacctggcggcagcgcaaaagatg

SEQ ID NO: 156702 - DNA, 103 bp, Artificial Sequence
  Synthetic Polynucleotide
taatacgactcactatagggtatgatgggcaaactctgcctccagctctcaacagaggagagagagcatgaggcagagtaacctggcggcagcgcaaaagatg

SEQ ID NO: 156703 - DNA, 103 bp, Artificial Sequence
  Synthetic Polynucleotide
taatacgactcactataggggtcaggtagttatgatgggcaaactctgccaacagaggagaggcagaatgtgcccatcaaacctggcggcagcgcaaaagatg

SEQ ID NO: 156704 - DNA, 103 bp, Artificial Sequence
  Synthetic Polynucleotide
taatacgactcactataggggcggagccgagtcaggtagttatgatgggcaacagaggagagcccatatgaactacctgaacctggcggcagcgcaaaagatg

SEQ ID NO: 156705 - DNA, 103 bp, Artificial Sequence
  Synthetic Polynucleotide
taatacgactcactatagggtctcatatctgcggagccgagtcaggtagtaacagaggagaactaccatgctcggctccaacctggcggcagcgcaaaagatg

SEQ ID NO: 156706 - DNA, 103 bp, Artificial Sequence
  Synthetic Polynucleotide
taatacgactcactataggggagtgggggtttcgaaggcagccccagacaaacagaggagatgtctgatgctgccttcgaacctggcggcagcgcaaaagatg

SEQ ID NO: 156707 - DNA, 103 bp, Artificial Sequence
  Synthetic Polynucleotide
taatacgactcactatagggtttaccgcaatctcatatctgcggagccgaaacagaggagatcggctatgcagatatgaaacctggcggcagcgcaaaagatg

SEQ ID NO: 156708 - DNA, 103 bp, Artificial Sequence
  Synthetic Polynucleotide
taatacgactcactataggggaggtccaggtttaccgcaatctcatatctaacagaggagaagatatatgattgcggtaaacctggcggcagcgcaaaagatg

SEQ ID NO: 156709 - DNA, 103 bp, Artificial Sequence
  Synthetic Polynucleotide
taatacgactcactatagggggcgctcagagaggtccaggtttaccgcaaaacagaggagattgcggatgacctggaccaacctggcggcagcgcaaaagatg

SEQ ID NO: 156710 - DNA, 103 bp, Artificial Sequence
  Synthetic Polynucleotide
taatacgactcactatagggactttgacctggcgctcagagaggtccaggaacagaggagacctggaatgctctgagcgaacctggcggcagcgcaaaagatg

SEQ ID NO: 156711 - DNA, 103 bp, Artificial Sequence
  Synthetic Polynucleotide
taatacgactcactatagggctggaaccacactttgacctggcgctcagaaacagaggagatctgagatgcaggtcaaaaacctggcggcagcgcaaaagatg

SEQ ID NO: 156712 - DNA, 103 bp, Artificial Sequence
  Synthetic Polynucleotide
taatacgactcactatagggtccttcggttctggaaccacactttgacctaacagaggagaaggtcaatgtgtggttccaacctggcggcagcgcaaaagatg

SEQ ID NO: 156713 - DNA, 103 bp, Artificial Sequence
  Synthetic Polynucleotide
taatacgactcactatagggttccacttcatccttcggttctggaaccacaacagaggagagtggttatggaaccgaagaacctggcggcagcgcaaaagatg

SEQ ID NO: 156714 - DNA, 103 bp, Artificial Sequence
  Synthetic Polynucleotide
taatacgactcactatagggcttcacacgcttccacttcatccttcggttaacagaggagaaaccgaatgatgaagtggaacctggcggcagcgcaaaagatg

SEQ ID NO: 156715 - DNA, 103 bp, Artificial Sequence
  Synthetic Polynucleotide
taatacgactcactataggggctgacctcccttcacacgcttccacttcaaacagaggagatgaagtatgagcgtgtgaaacctggcggcagcgcaaaagatg

SEQ ID NO: 156716 - DNA, 103 bp, Artificial Sequence
  Synthetic Polynucleotide
taatacgactcactatagggggggagatgggctgacctcccttcacacgcaacagaggagagcgtgtatggggaggtcaaacctggcggcagcgcaaaagatg

SEQ ID NO: 156717 - DNA, 103 bp, Artificial Sequence
  Synthetic Polynucleotide
taatacgactcactatagggattgccttccgagtgggggtttcgaaggcaaacagaggagatgccttatgaacccccacaacctggcggcagcgcaaaagatg

SEQ ID NO: 156718 - DNA, 103 bp, Artificial Sequence
  Synthetic Polynucleotide
taatacgactcactatagggctgcccattgggggagatgggctgacctccaacagaggagaggaggtatgcccatctccaacctggcggcagcgcaaaagatg

SEQ ID NO: 156719 - DNA, 103 bp, Artificial Sequence
  Synthetic Polynucleotide
taatacgactcactatagggcctcagggtcctgcccattgggggagatggaacagaggagaccatctatgccaatgggcaacctggcggcagcgcaaaagatg

SEQ ID NO: 156720 - DNA, 103 bp, Artificial Sequence
  Synthetic Polynucleotide
taatacgactcactataggggagtccccatcctcagggtcctgcccattgaacagaggagacaatggatgggaccctgaaacctggcggcagcgcaaaagatg

SEQ ID NO: 156721 - DNA, 103 bp, Artificial Sequence
  Synthetic Polynucleotide
taatacgactcactatagggagaggctgtggagtccccatcctcagggtcaacagaggagagaccctatggatggggacaacctggcggcagcgcaaaagatg

SEQ ID NO: 156722 - DNA, 103 bp, Artificial Sequence
  Synthetic Polynucleotide
taatacgactcactatagggctgaacttggagaggctgtggagtccccataacagaggagaatggggatgccacagcctaacctggcggcagcgcaaaagatg

SEQ ID NO: 156723 - DNA, 103 bp, Artificial Sequence
  Synthetic Polynucleotide
taatacgactcactatagggctgaggccccattgccttccgagtgggggtaacagaggagaacccccatgcggaaggcaaacctggcggcagcgcaaaagatg

SEQ ID NO: 156724 - DNA, 103 bp, Artificial Sequence
  Synthetic Polynucleotide
taatacgactcactatagggtggggtagccctgaggccccattgccttccaacagaggagaggaaggatgtggggcctcaacctggcggcagcgcaaaagatg

SEQ ID NO: 156725 - DNA, 103 bp, Artificial Sequence
  Synthetic Polynucleotide
taatacgactcactataggggcgcaggcagccaaagagcgggtgttccataacagaggagaatggaaatgccgctctttaacctggcggcagcgcaaaagatg

SEQ ID NO: 156726 - DNA, 103 bp, Artificial Sequence
  Synthetic Polynucleotide
taatacgactcactatagggctcggggtaagacatatggtcagatcttccaacagaggagaggaagaatggaccatatgaacctggcggcagcgcaaaagatg

SEQ ID NO: 156727 - DNA, 103 bp, Artificial Sequence
  Synthetic Polynucleotide
taatacgactcactatagggaagtagagagctcggggtaagacatatggtaacagaggagaaccataatgcttaccccgaacctggcggcagcgcaaaagatg

SEQ ID NO: 156728 - DNA, 103 bp, Artificial Sequence
  Synthetic Polynucleotide
taatacgactcactataggggatgaggaagaagtagagagctcggggtaaaacagaggagattacccatggctctctacaacctggcggcagcgcaaaagatg

SEQ ID NO: 156729 - DNA, 103 bp, Artificial Sequence
  Synthetic Polynucleotide
taatacgactcactataggggattatgcaagatgaggaagaagtagagagaacagaggagactctctatgtcttcctcaaacctggcggcagcgcaaaagatg

SEQ ID NO: 156730 - DNA, 103 bp, Artificial Sequence
  Synthetic Polynucleotide
taatacgactcactatagggggtatcccgcgattatgcaagatgaggaagaacagaggagacttcctatgcttgcataaaacctggcggcagcgcaaaagatg

SEQ ID NO: 156731 - DNA, 103 bp, Artificial Sequence
  Synthetic Polynucleotide
taatacgactcactatagggtcttcgttggggtatcccgcgattatgcaaaacagaggagattgcatatgcgcgggataaacctggcggcagcgcaaaagatg

SEQ ID NO: 156732 - DNA, 103 bp, Artificial Sequence
  Synthetic Polynucleotide
taatacgactcactatagggaaacatgccctcttcgttggggtatcccgcaacagaggagagcgggaatgcccaacgaaaacctggcggcagcgcaaaagatg

SEQ ID NO: 156733 - DNA, 103 bp, Artificial Sequence
  Synthetic Polynucleotide
taatacgactcactataggggctggctggcaaacatgccctcttcgttggaacagaggagaccaacgatgagggcatgtaacctggcggcagcgcaaaagatg

SEQ ID NO: 156734 - DNA, 103 bp, Artificial Sequence
  Synthetic Polynucleotide
taatacgactcactatagggcccctgtgatgctggctggcaaacatgcccaacagaggagagggcatatgtgccagccaaacctggcggcagcgcaaaagatg

SEQ ID NO: 156735 - DNA, 103 bp, Artificial Sequence
  Synthetic Polynucleotide
taatacgactcactataggggtggtggtgccccctgtgatgctggctggcaacagaggagagccagcatgcatcacaggaacctggcggcagcgcaaaagatg

SEQ ID NO: 156736 - DNA, 103 bp, Artificial Sequence
  Synthetic Polynucleotide
taatacgactcactatagggcgtgagggctgcgcaggcagccaaagagcgaacagaggagacgctctatggctgcctgcaacctggcggcagcgcaaaagatg

SEQ ID NO: 156737 - DNA, 103 bp, Artificial Sequence
  Synthetic Polynucleotide
taatacgactcactatagggggtggtggtggtggtggtgccccctgtgataacagaggagaatcacaatgggcaccaccaacctggcggcagcgcaaaagatg

SEQ ID NO: 156738 - DNA, 103 bp, Artificial Sequence
  Synthetic Polynucleotide
taatacgactcactatagggtggtggtggtggtggtggtggtggtggtgcaacagaggagagcaccaatgccaccaccaaacctggcggcagcgcaaaagatg

SEQ ID NO: 156739 - DNA, 103 bp, Artificial Sequence
  Synthetic Polynucleotide
taatacgactcactatagggatggtggtgatggtggtggtggtggtggtgaacagaggagacaccacatgcaccaccacaacctggcggcagcgcaaaagatg

SEQ ID NO: 156740 - DNA, 103 bp, Artificial Sequence
  Synthetic Polynucleotide
taatacgactcactataggggctgctgctgatggtggtgatggtggtggtaacagaggagaaccaccatgatcaccaccaacctggcggcagcgcaaaagatg

SEQ ID NO: 156741 - DNA, 103 bp, Artificial Sequence
  Synthetic Polynucleotide
taatacgactcactataggggcctggtgctgctgctgctgatggtggtgaaacagaggagatcaccaatgtcagcagcaaacctggcggcagcgcaaaagatg

SEQ ID NO: 156742 - DNA, 103 bp, Artificial Sequence
  Synthetic Polynucleotide
taatacgactcactatagggggtttgcagagcctggtgctgctgctgctgaacagaggagacagcagatgcagcaccagaacctggcggcagcgcaaaagatg

SEQ ID NO: 156743 - DNA, 103 bp, Artificial Sequence
  Synthetic Polynucleotide
taatacgactcactatagggggtgccagttggtttgcagagcctggtgctaacagaggagaagcaccatgctctgcaaaaacctggcggcagcgcaaaagatg

SEQ ID NO: 156744 - DNA, 103 bp, Artificial Sequence
  Synthetic Polynucleotide
taatacgactcactatagggatctgcgggaggtgccagttggtttgcagaaacagaggagatctgcaatgcaactggcaaacctggcggcagcgcaaaagatg

SEQ ID NO: 156745 - DNA, 103 bp, Artificial Sequence
  Synthetic Polynucleotide
taatacgactcactatagggtggggaagacatctgcgggaggtgccagttaacagaggagaaactggatgctcccgcagaacctggcggcagcgcaaaagatg

SEQ ID NO: 156746 - DNA, 103 bp, Artificial Sequence
  Synthetic Polynucleotide
taatacgactcactatagggccgcactcggtggggaagacatctgcgggaaacagaggagatcccgcatgtgtcttcccaacctggcggcagcgcaaaagatg

SEQ ID NO: 156747 - DNA, 103 bp, Artificial Sequence
  Synthetic Polynucleotide
taatacgactcactatagggtgcgccgtggcgtgagggctgcgcaggcagaacagaggagactgcctatgcagccctcaaacctggcggcagcgcaaaagatg

SEQ ID NO: 156748 - DNA, 103 bp, Artificial Sequence
  Synthetic Polynucleotide
taatacgactcactatagggctgtgccgagccgcactcggtggggaagacaacagaggagagtcttcatgaccgagtgcaacctggcggcagcgcaaaagatg

SEQ ID NO: 156749 - DNA, 103 bp, Artificial Sequence
  Synthetic Polynucleotide
taatacgactcactataggggaggcagaggctgtgccgagccgcactcggaacagaggagaccgagtatggctcggcacaacctggcggcagcgcaaaagatg

SEQ ID NO: 156750 - DNA, 103 bp, Artificial Sequence
  Synthetic Polynucleotide
taatacgactcactatagggagtcgggctggaggcagaggctgtgccgagaacagaggagactcggcatggcctctgccaacctggcggcagcgcaaaagatg

SEQ ID NO: 156751 - DNA, 103 bp, Artificial Sequence
  Synthetic Polynucleotide
taatacgactcactatagggggccctccagagtcgggctggaggcagaggaacagaggagacctctgatgccagcccgaaacctggcggcagcgcaaaagatg

SEQ ID NO: 156752 - DNA, 103 bp, Artificial Sequence
  Synthetic Polynucleotide
taatacgactcactatagggcaactctgggggccctccagagtcgggctgaacagaggagacagcccatgtctggagggaacctggcggcagcgcaaaagatg

SEQ ID NO: 156753 - DNA, 103 bp, Artificial Sequence
  Synthetic Polynucleotide
taatacgactcactatagggggctgctccccaactctgggggccctccagaacagaggagactggagatgccccagagtaacctggcggcagcgcaaaagatg

SEQ ID NO: 156754 - DNA, 103 bp, Artificial Sequence
  Synthetic Polynucleotide
taatacgactcactatagggaggacgggcgggctgctccccaactctgggaacagaggagacccagaatgggggagcagaacctggcggcagcgcaaaagatg

SEQ ID NO: 156755 - DNA, 103 bp, Artificial Sequence
  Synthetic Polynucleotide
taatacgactcactataggggttggagcacaggacgggcgggctgctcccaacagaggagagggagcatgccgcccgtcaacctggcggcagcgcaaaagatg

SEQ ID NO: 156756 - DNA, 103 bp, Artificial Sequence
  Synthetic Polynucleotide
taatacgactcactatagggagctggaagagttggagcacaggacgggcgaacagaggagacgcccgatgtgtgctccaaacctggcggcagcgcaaaagatg

SEQ ID NO: 156757 - DNA, 103 bp, Artificial Sequence
  Synthetic Polynucleotide
taatacgactcactatagggctggagcccaagctggaagagttggagcacaacagaggagagtgctcatgctcttccagaacctggcggcagcgcaaaagatg

SEQ ID NO: 156758 - DNA, 103 bp, Artificial Sequence
  Synthetic Polynucleotide
taatacgactcactataggggtgcaagccttgcgccgtggcgtgagggctaacagaggagaagccctatggccacggcgaacctggcggcagcgcaaaagatg

SEQ ID NO: 156759 - DNA, 103 bp, Artificial Sequence
  Synthetic Polynucleotide
taatacgactcactatagggagtcggggtgctggagcccaagctggaagaaacagaggagatcttccatgttgggctccaacctggcggcagcgcaaaagatg

SEQ ID NO: 156760 - DNA, 103 bp, Artificial Sequence
  Synthetic Polynucleotide
taatacgactcactatagggacgcggccccagtcggggtgctggagcccaaacagaggagatgggctatggcaccccgaaacctggcggcagcgcaaaagatg

SEQ ID NO: 156761 - DNA, 103 bp, Artificial Sequence
  Synthetic Polynucleotide
taatacgactcactatagggcccggcgcgcacgcggccccagtcggggtgaacagaggagacaccccatgtggggccgcaacctggcggcagcgcaaaagatg

SEQ ID NO: 156762 - DNA, 103 bp, Artificial Sequence
  Synthetic Polynucleotide
taatacgactcactataggggccgtagtcccccggcgcgcacgcggccccaacagaggagaggggccatgtgcgcgccgaacctggcggcagcgcaaaagatg

SEQ ID NO: 156763 - DNA, 103 bp, Artificial Sequence
  Synthetic Polynucleotide
taatacgactcactataggggtgcctggcggccgtagtcccccggcgcgcaacagaggagagcgcgcatggggactacgaacctggcggcagcgcaaaagatg

SEQ ID NO: 156764 - DNA, 103 bp, Artificial Sequence
  Synthetic Polynucleotide
taatacgactcactataggggcaggtgacagtgcctggcggccgtagtccaacagaggagaggactaatgccgccaggcaacctggcggcagcgcaaaagatg

SEQ ID NO: 156765 - DNA, 103 bp, Artificial Sequence
  Synthetic Polynucleotide
taatacgactcactatagggctccgcctccgcaggtgacagtgcctggcgaacagaggagacgccagatgctgtcacctaacctggcggcagcgcaaaagatg

SEQ ID NO: 156766 - DNA, 103 bp, Artificial Sequence
  Synthetic Polynucleotide
taatacgactcactatagggcgcttcgcttctccgcctccgcaggtgacaaacagaggagatgtcacatgcggaggcggaacctggcggcagcgcaaaagatg

SEQ ID NO: 156767 - DNA, 103 bp, Artificial Sequence
  Synthetic Polynucleotide
taatacgactcactatagggctcttgccgccgcttcgcttctccgcctccaacagaggagaggaggcatggaagcgaagaacctggcggcagcgcaaaagatg

SEQ ID NO: 156768 - DNA, 103 bp, Artificial Sequence
  Synthetic Polynucleotide
taatacgactcactataggggtcgcttttcctcttgccgccgcttcgcttaacagaggagaaagcgaatgggcggcaagaacctggcggcagcgcaaaagatg

SEQ ID NO: 156769 - DNA, 103 bp, Artificial Sequence
  Synthetic Polynucleotide
taatacgactcactataggggggagaacgggtgcaagccttgcgccgtggaacagaggagaccacggatgaaggcttgcaacctggcggcagcgcaaaagatg

SEQ ID NO: 156770 - DNA, 103 bp, Artificial Sequence
  Synthetic Polynucleotide
taatacgactcactatagggagtctgagctgtcgcttttcctcttgccgcaacagaggagagcggcaatgggaaaagcgaacctggcggcagcgcaaaagatg

SEQ ID NO: 156771 - DNA, 103 bp, Artificial Sequence
  Synthetic Polynucleotide
taatacgactcactatagggccttcctgggagtctgagctgtcgcttttcaacagaggagagaaaagatgcagctcagaaacctggcggcagcgcaaaagatg

SEQ ID NO: 156772 - DNA, 103 bp, Artificial Sequence
  Synthetic Polynucleotide
taatacgactcactatagggcttgtaatttccttcctgggagtctgagctaacagaggagaagctcaatgtcccaggaaaacctggcggcagcgcaaaagatg

SEQ ID NO: 156773 - DNA, 103 bp, Artificial Sequence
  Synthetic Polynucleotide
taatacgactcactatagggtgacttctgacttgtaatttccttcctgggaacagaggagacccaggatggaaattacaaacctggcggcagcgcaaaagatg

SEQ ID NO: 156774 - DNA, 103 bp, Artificial Sequence
  Synthetic Polynucleotide
taatacgactcactatagggggtttgctgttgacttctgacttgtaatttaacagaggagaaaattaatggtcagaagtaacctggcggcagcgcaaaagatg

SEQ ID NO: 156775 - DNA, 103 bp, Artificial Sequence
  Synthetic Polynucleotide
taatacgactcactatagggttctttcctgggtttgctgttgacttctgaaacagaggagatcagaaatgaacagcaaaaacctggcggcagcgcaaaagatg

SEQ ID NO: 156776 - DNA, 103 bp, Artificial Sequence
  Synthetic Polynucleotide
taatacgactcactatagggatgctgtcctttctttcctgggtttgctgtaacagaggagaacagcaatgccaggaaagaacctggcggcagcgcaaaagatg

SEQ ID NO: 156777 - DNA, 103 bp, Artificial Sequence
  Synthetic Polynucleotide
taatacgactcactatagggtctttggtaaatgctgtcctttctttcctgaacagaggagacaggaaatgaaggacagcaacctggcggcagcgcaaaagatg

SEQ ID NO: 156778 - DNA, 103 bp, Artificial Sequence
  Synthetic Polynucleotide
taatacgactcactatagggtctgatttgctctttggtaaatgctgtcctaacagaggagaaggacaatgtttaccaaaaacctggcggcagcgcaaaagatg

SEQ ID NO: 156779 - DNA, 103 bp, Artificial Sequence
  Synthetic Polynucleotide
taatacgactcactatagggcttcaagttctctgatttgctctttggtaaaacagaggagattaccaatgagcaaatcaaacctggcggcagcgcaaaagatg

SEQ ID NO: 156780 - DNA, 103 bp, Artificial Sequence
  Synthetic Polynucleotide
taatacgactcactatagggagagaggattgggagaacgggtgcaagcctaacagaggagaaggcttatgcccgttctcaacctggcggcagcgcaaaagatg

SEQ ID NO: 156781 - DNA, 103 bp, Artificial Sequence
  Synthetic Polynucleotide
taatacgactcactataggggcaaattctgcttcaagttctctgatttgcaacagaggagagcaaatatgagaacttgaaacctggcggcagcgcaaaagatg

SEQ ID NO: 156782 - DNA, 103 bp, Artificial Sequence
  Synthetic Polynucleotide
taatacgactcactatagggattatgatgggcaaattctgcttcaagttcaacagaggagagaacttatggcagaatttaacctggcggcagcgcaaaagatg

SEQ ID NO: 156783 - DNA, 103 bp, Artificial Sequence
  Synthetic Polynucleotide
taatacgactcactatagggtggtgagataattatgatgggcaaattctgaacagaggagacagaatatgcccatcataaacctggcggcagcgcaaaagatg

SEQ ID NO: 156784 - DNA, 103 bp, Artificial Sequence
  Synthetic Polynucleotide
taatacgactcactatagggcgcctcagtctggtgagataattatgatggaacagaggagaccatcaatgttatctcacaacctggcggcagcgcaaaagatg

SEQ ID NO: 156785 - DNA, 103 bp, Artificial Sequence
  Synthetic Polynucleotide
taatacgactcactatagggtatctcgtatcgcctcagtctggtgagataaacagaggagatatctcatgagactgaggaacctggcggcagcgcaaaagatg

SEQ ID NO: 156786 - DNA, 103 bp, Artificial Sequence
  Synthetic Polynucleotide
taatacgactcactataggggattcactgctatctcgtatcgcctcagtcaacagaggagagactgaatggatacgagaaacctggcggcagcgcaaaagatg

SEQ ID NO: 156787 - DNA, 103 bp, Artificial Sequence
  Synthetic Polynucleotide
taatacgactcactataggggtgagatccagattcactgctatctcgtataacagaggagaatacgaatgagcagtgaaaacctggcggcagcgcaaaagatg

SEQ ID NO: 156788 - DNA, 103 bp, Artificial Sequence
  Synthetic Polynucleotide
taatacgactcactatagggctgtctttcagtgagatccagattcactgcaacagaggagagcagtgatgctggatctcaacctggcggcagcgcaaaagatg

SEQ ID NO: 156789 - DNA, 103 bp, Artificial Sequence
  Synthetic Polynucleotide
taatacgactcactatagggagactttcacctgtctttcagtgagatccaaacagaggagatggatcatgctgaaagacaacctggcggcagcgcaaaagatg

SEQ ID NO: 156790 - DNA, 103 bp, Artificial Sequence
  Synthetic Polynucleotide
taatacgactcactatagggttttggaaccagactttcacctgtctttcaaacagaggagatgaaagatgggtgaaagtaacctggcggcagcgcaaaagatg

SEQ ID NO: 156791 - DNA, 103 bp, Artificial Sequence
  Synthetic Polynucleotide
taatacgactcactatagggatggagggcgagagaggattgggagaacggaacagaggagaccgttcatgcaatcctctaacctggcggcagcgcaaaagatg

SEQ ID NO: 156792 - DNA, 103 bp, Artificial Sequence
  Synthetic Polynucleotide
taatacgactcactatagggcatccgcctgttttggaaccagactttcacaacagaggagagtgaaaatgtggttccaaaacctggcggcagcgcaaaagatg

SEQ ID NO: 156793 - DNA, 103 bp, Artificial Sequence
  Synthetic Polynucleotide
taatacgactcactatagggtcttccacttcatccgcctgttttggaaccaacagaggagaggttccatgacaggcggaaacctggcggcagcgcaaaagatg

SEQ ID NO: 156794 - DNA, 103 bp, Artificial Sequence
  Synthetic Polynucleotide
taatacgactcactatagggccctttaccctcttccacttcatccgcctgaacagaggagacaggcgatggaagtggaaaacctggcggcagcgcaaaagatg

SEQ ID NO: 156795 - DNA, 103 bp, Artificial Sequence
  Synthetic Polynucleotide
taatacgactcactatagggttgctgtccaccctttaccctcttccacttaacagaggagaaagtggatgagggtaaagaacctggcggcagcgcaaaagatg

SEQ ID NO: 156796 - DNA, 103 bp, Artificial Sequence
  Synthetic Polynucleotide
taatacgactcactatagggccgcagctccttgctgtccaccctttacccaacagaggagagggtaaatggtggacagcaacctggcggcagcgcaaaagatg

SEQ ID NO: 156797 - DNA, 103 bp, Artificial Sequence
  Synthetic Polynucleotide
taatacgactcactatagggttttcccgagccgcagctccttgctgtccaaacagaggagatggacaatgaggagctgcaacctggcggcagcgcaaaagatg

SEQ ID NO: 156798 - DNA, 103 bp, Artificial Sequence
  Synthetic Polynucleotide
taatacgactcactatagggcaccagttccttttcccgagccgcagctccaacagaggagaggagctatggctcgggaaaacctggcggcagcgcaaaagatg

SEQ ID NO: 156799 - DNA, 103 bp, Artificial Sequence
  Synthetic Polynucleotide
taatacgactcactatagggttttcacattcaccagttccttttcccgagaacagaggagactcgggatgaggaactggaacctggcggcagcgcaaaagatg

SEQ ID NO: 156800 - DNA, 103 bp, Artificial Sequence
  Synthetic Polynucleotide
taatacgactcactatagggagtgttccctttttcacattcaccagttccaacagaggagaggaactatggaatgtgaaaacctggcggcagcgcaaaagatg

SEQ ID NO: 156801 - DNA, 103 bp, Artificial Sequence
  Synthetic Polynucleotide
taatacgactcactatagggtgatgggagaagtgttccctttttcacattaacagaggagaaatgtgatgaagggaacaaacctggcggcagcgcaaaagatg

SEQ ID NO: 156802 - DNA, 103 bp, Artificial Sequence
  Synthetic Polynucleotide
taatacgactcactatagggcagatcttccatggagggcgagagaggattaacagaggagaaatcctatgtcgccctccaacctggcggcagcgcaaaagatg

SEQ ID NO: 156803 - DNA, 103 bp, Artificial Sequence
  Synthetic Polynucleotide
taatacgactcactatagggccgacagctctgatgggagaagtgttccctaacagaggagaagggaaatgttctcccataacctggcggcagcgcaaaagatg

SEQ ID NO: 156804 - DNA, 103 bp, Artificial Sequence
  Synthetic Polynucleotide
taatacgactcactataggggcaccaattcccgacagctctgatgggagaaacagaggagatctcccatgagagctgtcaacctggcggcagcgcaaaagatg

SEQ ID NO: 156805 - DNA, 103 bp, Artificial Sequence
  Synthetic Polynucleotide
taatacgactcactataggggagggtggctgcaccaattcccgacagctcaacagaggagagagctgatgggaattggtaacctggcggcagcgcaaaagatg

SEQ ID NO: 156806 - DNA, 103 bp, Artificial Sequence
  Synthetic Polynucleotide
taatacgactcactatagggctgtttgctggagggtggctgcaccaattcaacagaggagagaattgatgcagccacccaacctggcggcagcgcaaaagatg

SEQ ID NO: 156807 - DNA, 103 bp, Artificial Sequence
  Synthetic Polynucleotide
taatacgactcactatagggatagagtcccctgtttgctggagggtggctaacagaggagaagccacatgccagcaaacaacctggcggcagcgcaaaagatg

SEQ ID NO: 156808 - DNA, 103 bp, Artificial Sequence
  Synthetic Polynucleotide
taatacgactcactatagggttcatttgctatagagtcccctgtttgctgaacagaggagacagcaaatgggggactctaacctggcggcagcgcaaaagatg

SEQ ID NO: 156809 - DNA, 103 bp, Artificial Sequence
  Synthetic Polynucleotide
taatacgactcactatagggcgtgactgtcttcatttgctatagagtcccaacagaggagagggactatgtagcaaatgaacctggcggcagcgcaaaagatg

SEQ ID NO: 156810 - DNA, 103 bp, Artificial Sequence
  Synthetic Polynucleotide
taatacgactcactatagggtggtcactgtcgtgactgtcttcatttgctaacagaggagaagcaaaatgagacagtcaaacctggcggcagcgcaaaagatg

SEQ ID NO: 156811 - DNA, 103 bp, Artificial Sequence
  Synthetic Polynucleotide
taatacgactcactatagggctctgagctgtggtcactgtcgtgactgtcaacagaggagagacagtatggacagtgacaacctggcggcagcgcaaaagatg

SEQ ID NO: 156812 - DNA, 103 bp, Artificial Sequence
  Synthetic Polynucleotide
taatacgactcactatagggagtgcgcatgctctgagctgtggtcactgtaacagaggagaacagtgatgacagctcagaacctggcggcagcgcaaaagatg

SEQ ID NO: 156813 - DNA, 103 bp, Artificial Sequence
  Synthetic Polynucleotide
taatacgactcactataggggacatatggtcagatcttccatggagggcgaacagaggagacgccctatgtggaagatcaacctggcggcagcgcaaaagatg

SEQ ID NO: 156814 - DNA, 103 bp, Artificial Sequence
  Synthetic Polynucleotide
taatacgactcactatagggggagagcggcgggcacaggggctgggccataacagaggagaatggccatgcccctgtgcaacctggcggcagcgcaaaagatg

SEQ ID NO: 156815 - DNA, 103 bp, Artificial Sequence
  Synthetic Polynucleotide
taatacgactcactatagggtggggacgagacgagggagcggccgcagtcaacagaggagagactgcatgcgctccctcaacctggcggcagcgcaaaagatg

SEQ ID NO: 156816 - DNA, 103 bp, Artificial Sequence
  Synthetic Polynucleotide
taatacgactcactatagggcccatgagtctggggacgagacgagggagcaacagaggagagctcccatgtctcgtcccaacctggcggcagcgcaaaagatg

SEQ ID NO: 156817 - DNA, 103 bp, Artificial Sequence
  Synthetic Polynucleotide
taatacgactcactatagggggggtgctgccccatgagtctggggacgagaacagaggagactcgtcatgagactcatgaacctggcggcagcgcaaaagatg

SEQ ID NO: 156818 - DNA, 103 bp, Artificial Sequence
  Synthetic Polynucleotide
taatacgactcactataggggctgtcggctggggtgctgccccatgagtcaacagaggagagactcaatgggcagcaccaacctggcggcagcgcaaaagatg

SEQ ID NO: 156819 - DNA, 103 bp, Artificial Sequence
  Synthetic Polynucleotide
taatacgactcactatagggtcgccacggggctgtcggctggggtgctgcaacagaggagagcagcaatgcagccgacaaacctggcggcagcgcaaaagatg

SEQ ID NO: 156820 - DNA, 103 bp, Artificial Sequence
  Synthetic Polynucleotide
taatacgactcactatagggcgcgcggggctcgccacggggctgtcggctaacagaggagaagccgaatgccccgtggcaacctggcggcagcgcaaaagatg

SEQ ID NO: 156821 - DNA, 103 bp, Artificial Sequence
  Synthetic Polynucleotide
taatacgactcactatagggggtgcctggccgcgcggggctcgccacgggaacagaggagacccgtgatgagccccgcgaacctggcggcagcgcaaaagatg

SEQ ID NO: 156822 - DNA, 103 bp, Artificial Sequence
  Synthetic Polynucleotide
taatacgactcactatagggggtcccggagggtgcctggccgcgcggggcaacagaggagagccccgatgggccaggcaaacctggcggcagcgcaaaagatg

SEQ ID NO: 156823 - DNA, 103 bp, Artificial Sequence
  Synthetic Polynucleotide
taatacgactcactatagggggggcgcgggggtcccggagggtgcctggcaacagaggagagccaggatgcctccgggaaacctggcggcagcgcaaaagatg

SEQ ID NO: 156824 - DNA, 103 bp, Artificial Sequence
  Synthetic Polynucleotide
taatacgactcactatagggacctacggagggggcgcgggggtcccggagaacagaggagactccggatgccccgcgccaacctggcggcagcgcaaaagatg

SEQ ID NO: 156825 - DNA, 103 bp, Artificial Sequence
  Synthetic Polynucleotide
taatacgactcactatagggtccaggactcggagagcggcgggcacagggaacagaggagaccctgtatgcgccgctctaacctggcggcagcgcaaaagatg

SEQ ID NO: 156826 - DNA, 103 bp, Artificial Sequence
  Synthetic Polynucleotide
taatacgactcactatagggcgccgcgcctacctacggagggggcgcgggaacagaggagacccgcgatgcctccgtagaacctggcggcagcgcaaaagatg

SEQ ID NO: 156827 - DNA, 103 bp, Artificial Sequence
  Synthetic Polynucleotide
taatacgactcactatagggctgctgcgcgcgccgcgcctacctacggagaacagaggagactccgtatgtaggcgcggaacctggcggcagcgcaaaagatg

SEQ ID NO: 156828 - DNA, 103 bp, Artificial Sequence
  Synthetic Polynucleotide
taatacgactcactataggggcccaggcggctgctgcgcgcgccgcgcctaacagaggagaaggcgcatggcgcgcagcaacctggcggcagcgcaaaagatg

SEQ ID NO: 156829 - DNA, 103 bp, Artificial Sequence
  Synthetic Polynucleotide
taatacgactcactatagggtctgcccgctgcccaggcggctgctgcgcgaacagaggagacgcgcaatggccgcctggaacctggcggcagcgcaaaagatg

SEQ ID NO: 156830 - DNA, 103 bp, Artificial Sequence
  Synthetic Polynucleotide
taatacgactcactataggggcgctctgcctctgcccgctgcccaggcggaacagaggagaccgcctatgcagcgggcaaacctggcggcagcgcaaaagatg

SEQ ID NO: 156831 - DNA, 103 bp, Artificial Sequence
  Synthetic Polynucleotide
taatacgactcactatagggccgctcactggcgctctgcctctgcccgctaacagaggagaagcgggatgaggcagagcaacctggcggcagcgcaaaagatg

SEQ ID NO: 156832 - DNA, 103 bp, Artificial Sequence
  Synthetic Polynucleotide
taatacgactcactataggggcagtttctcccgctcactggcgctctgccaacagaggagaggcagaatgccagtgagcaacctggcggcagcgcaaaagatg

SEQ ID NO: 156833 - DNA, 103 bp, Artificial Sequence
  Synthetic Polynucleotide
taatacgactcactataggggtgcgcatgcgcagtttctcccgctcactgaacagaggagacagtgaatgggagaaactaacctggcggcagcgcaaaagatg

SEQ ID NO: 156834 - DNA, 103 bp, Artificial Sequence
  Synthetic Polynucleotide
taatacgactcactataggggcgggccagcgtgcgcatgcgcagtttctcaacagaggagagagaaaatgcgcatgcgcaacctggcggcagcgcaaaagatg

SEQ ID NO: 156835 - DNA, 103 bp, Artificial Sequence
  Synthetic Polynucleotide
taatacgactcactatagggcgtgcagggcgcgggccagcgtgcgcatgcaacagaggagagcatgcatgcgctggcccaacctggcggcagcgcaaaagatg

SEQ ID NO: 156836 - DNA, 103 bp, Artificial Sequence
  Synthetic Polynucleotide
taatacgactcactataggggcagagagcatccaggactcggagagcggcaacagaggagagccgctatgcgagtcctgaacctggcggcagcgcaaaagatg

SEQ ID NO: 156837 - DNA, 103 bp, Artificial Sequence
  Synthetic Polynucleotide
taatacgactcactatagggcggcgcagctcgtgcagggcgcgggccagcaacagaggagagctggcatgcgccctgcaaacctggcggcagcgcaaaagatg

SEQ ID NO: 156838 - DNA, 103 bp, Artificial Sequence
  Synthetic Polynucleotide
taatacgactcactatagggcggtagaaagcggcgcagctcgtgcagggcaacagaggagagccctgatggagctgcgcaacctggcggcagcgcaaaagatg

SEQ ID NO: 156839 - DNA, 103 bp, Artificial Sequence
  Synthetic Polynucleotide
taatacgactcactatagggccacggacggcggtagaaagcggcgcagctaacagaggagaagctgcatggctttctacaacctggcggcagcgcaaaagatg

SEQ ID NO: 156840 - DNA, 103 bp, Artificial Sequence
  Synthetic Polynucleotide
taatacgactcactatagggcccgcgggcgccacggacggcggtagaaagaacagaggagactttctatggccgtccgtaacctggcggcagcgcaaaagatg

SEQ ID NO: 156841 - DNA, 103 bp, Artificial Sequence
  Synthetic Polynucleotide
taatacgactcactatagggcaggctctggcccgcgggcgccacggacggaacagaggagaccgtccatggcgcccgcgaacctggcggcagcgcaaaagatg

SEQ ID NO: 156842 - DNA, 103 bp, Artificial Sequence
  Synthetic Polynucleotide
taatacgactcactatagggcgatcttggtcaggctctggcccgcgggcgaacagaggagacgcccgatggccagagccaacctggcggcagcgcaaaagatg

SEQ ID NO: 156843 - DNA, 103 bp, Artificial Sequence
  Synthetic Polynucleotide
taatacgactcactatagggcgcagcgtctcgatcttggtcaggctctggaacagaggagaccagagatggaccaagataacctggcggcagcgcaaaagatg

SEQ ID NO: 156844 - DNA, 103 bp, Artificial Sequence
  Synthetic Polynucleotide
taatacgactcactataggggatagccaggcgcagcgtctcgatcttggtaacagaggagaaccaagatggagacgctgaacctggcggcagcgcaaaagatg

SEQ ID NO: 156845 - DNA, 103 bp, Artificial Sequence
  Synthetic Polynucleotide
taatacgactcactatagggcgatatagcggatagccaggcgcagcgtctaacagaggagaagacgcatggcctggctaaacctggcggcagcgcaaaagatg

SEQ ID NO: 156846 - DNA, 103 bp, Artificial Sequence
  Synthetic Polynucleotide
taatacgactcactataggggacaggtggccgatatagcggatagccaggaacagaggagacctggcatgccgctatataacctggcggcagcgcaaaagatg

SEQ ID NO: 156847 - DNA, 103 bp, Artificial Sequence
  Synthetic Polynucleotide
taatacgactcactataggggccccaggccgcagagagcatccaggactcaacagaggagagagtccatgatgctctctaacctggcggcagcgcaaaagatg

SEQ ID NO: 156848 - DNA, 103 bp, Artificial Sequence
  Synthetic Polynucleotide
taatacgactcactatagggtagcacggccgacaggtggccgatatagcgaacagaggagacgctatatgggccacctgaacctggcggcagcgcaaaagatg

SEQ ID NO: 156849 - DNA, 103 bp, Artificial Sequence
  Synthetic Polynucleotide
taatacgactcactatagggcgctgaggcctagcacggccgacaggtggcaacagaggagagccaccatgcggccgtgcaacctggcggcagcgcaaaagatg

SEQ ID NO: 156850 - DNA, 103 bp, Artificial Sequence
  Synthetic Polynucleotide
taatacgactcactatagggagactctcctcgctgaggcctagcacggccaacagaggagaggccgtatgaggcctcagaacctggcggcagcgcaaaagatg

SEQ ID NO: 156851 - DNA, 103 bp, Artificial Sequence
  Synthetic Polynucleotide
taatacgactcactatagggccggcgctggagactctcctcgctgaggccaacagaggagaggcctcatggaggagagtaacctggcggcagcgcaaaagatg

SEQ ID NO: 156852 - DNA, 103 bp, Artificial Sequence
  Synthetic Polynucleotide
taatacgactcactataggggctgccggcaccggcgctggagactctcctaacagaggagaaggagaatgtccagcgccaacctggcggcagcgcaaaagatg

SEQ ID NO: 156853 - DNA, 103 bp, Artificial Sequence
  Synthetic Polynucleotide
taatacgactcactataggggcgtcaccgcgctgccggcaccggcgctggaacagaggagaccagcgatggtgccggcaaacctggcggcagcgcaaaagatg

SEQ ID NO: 156854 - DNA, 103 bp, Artificial Sequence
  Synthetic Polynucleotide
taatacgactcactatagggaggggaccccgcgtcaccgcgctgccggcaaacagaggagatgccggatgcgcggtgacaacctggcggcagcgcaaaagatg

SEQ ID NO: 156855 - DNA, 103 bp, Artificial Sequence
  Synthetic Polynucleotide
taatacgactcactatagggggcagccccgaggggaccccgcgtcaccgcaacagaggagagcggtgatgcggggtcccaacctggcggcagcgcaaaagatg

SEQ ID NO: 156856 - DNA, 103 bp, Artificial Sequence
  Synthetic Polynucleotide
taatacgactcactataggggggcacagcgggcagccccgaggggaccccaacagaggagaggggtcatgtcggggctgaacctggcggcagcgcaaaagatg

SEQ ID NO: 156857 - DNA, 103 bp, Artificial Sequence
  Synthetic Polynucleotide
taatacgactcactataggggcagtcgtcggggcacagcgggcagccccgaacagaggagacggggcatgccgctgtgcaacctggcggcagcgcaaaagatg

SEQ ID NO: 156858 - DNA, 103 bp, Artificial Sequence
  Synthetic Polynucleotide
taatacgactcactataggggccgagttgggccccaggccgcagagagcaaacagaggagatgctctatgcggcctgggaacctggcggcagcgcaaaagatg

SEQ ID NO: 156859 - DNA, 103 bp, Artificial Sequence
  Synthetic Polynucleotide
taatacgactcactatagggtctgcgcggggcagtcgtcggggcacagcgaacagaggagacgctgtatgccgacgactaacctggcggcagcgcaaaagatg

SEQ ID NO: 156860 - DNA, 103 bp, Artificial Sequence
  Synthetic Polynucleotide
taatacgactcactatagggcgtgtctgcatctgcgcggggcagtcgtcgaacagaggagacgacgaatgccccgcgcaaacctggcggcagcgcaaaagatg

SEQ ID NO: 156861 - DNA, 103 bp, Artificial Sequence
  Synthetic Polynucleotide
taatacgactcactatagggagcctgcgtccgtgtctgcatctgcgcgggaacagaggagacccgcgatgatgcagacaaacctggcggcagcgcaaaagatg

SEQ ID NO: 156862 - DNA, 103 bp, Artificial Sequence
  Synthetic Polynucleotide
taatacgactcactatagggcctgcccctcagcctgcgtccgtgtctgcaaacagaggagatgcagaatgggacgcaggaacctggcggcagcgcaaaagatg

SEQ ID NO: 156863 - DNA, 103 bp, Artificial Sequence
  Synthetic Polynucleotide
taatacgactcactatagggcgcccctgcccctgcccctcagcctgcgtcaacagaggagagacgcaatgtgaggggcaaacctggcggcagcgcaaaagatg

SEQ ID NO: 156864 - DNA, 103 bp, Artificial Sequence
  Synthetic Polynucleotide
taatacgactcactataggggcccagcccgcgcccctgcccctgcccctcaacagaggagagaggggatggggcaggggaacctggcggcagcgcaaaagatg

SEQ ID NO: 156865 - DNA, 103 bp, Artificial Sequence
  Synthetic Polynucleotide
taatacgactcactatagggcggataccaggcccagcccgcgcccctgccaacagaggagaggcaggatggcgggctggaacctggcggcagcgcaaaagatg

SEQ ID NO: 156866 - DNA, 103 bp, Artificial Sequence
  Synthetic Polynucleotide
taatacgactcactataggggcgcggacggcggataccaggcccagcccgaacagaggagacgggctatgcctggtatcaacctggcggcagcgcaaaagatg

SEQ ID NO: 156867 - DNA, 103 bp, Artificial Sequence
  Synthetic Polynucleotide
taatacgactcactatagggggacgccccggcgcggacggcggataccagaacagaggagactggtaatggccgtccgcaacctggcggcagcgcaaaagatg

SEQ ID NO: 156868 - DNA, 103 bp, Artificial Sequence
  Synthetic Polynucleotide
taatacgactcactataggggggatccccaggacgccccggcgcggacggaacagaggagaccgtccatgccggggcgtaacctggcggcagcgcaaaagatg

SEQ ID NO: 156869 - DNA, 103 bp, Artificial Sequence
  Synthetic Polynucleotide
taatacgactcactatagggggcggcggccgccgagttgggccccaggccaacagaggagaggcctgatgcccaactcgaacctggcggcagcgcaaaagatg

SEQ ID NO: 156870 - DNA, 103 bp, Artificial Sequence
  Synthetic Polynucleotide
taatacgactcactatagggcaggcaggcggggatccccaggacgccccgaacagaggagacggggcatgctggggatcaacctggcggcagcgcaaaagatg

SEQ ID NO: 156871 - DNA, 103 bp, Artificial Sequence
  Synthetic Polynucleotide
taatacgactcactatagggggctccggggcaggcaggcggggatccccaaacagaggagatggggaatgccgcctgccaacctggcggcagcgcaaaagatg

SEQ ID NO: 156872 - DNA, 103 bp, Artificial Sequence
  Synthetic Polynucleotide
taatacgactcactataggggtgcagctcgggctccggggcaggcaggcgaacagaggagacgcctgatggccccggagaacctggcggcagcgcaaaagatg

SEQ ID NO: 156873 - DNA, 103 bp, Artificial Sequence
  Synthetic Polynucleotide
taatacgactcactatagggcgcggctcgggtgcagctcgggctccggggaacagaggagaccccggatgccgagctgcaacctggcggcagcgcaaaagatg

SEQ ID NO: 156874 - DNA, 103 bp, Artificial Sequence
  Synthetic Polynucleotide
taatacgactcactatagggaggcgggtcgcgcggctcgggtgcagctcgaacagaggagacgagctatgcccgagccgaacctggcggcagcgcaaaagatg

SEQ ID NO: 156875 - DNA, 103 bp, Artificial Sequence
  Synthetic Polynucleotide
taatacgactcactatagggcgaacagcgcaggcgggtcgcgcggctcggaacagaggagaccgagcatggcgacccgcaacctggcggcagcgcaaaagatg

SEQ ID NO: 156876 - DNA, 103 bp, Artificial Sequence
  Synthetic Polynucleotide
taatacgactcactataggggccgcctcggcgaacagcgcaggcgggtcgaacagaggagacgacccatgtgcgctgttaacctggcggcagcgcaaaagatg

SEQ ID NO: 156877 - DNA, 103 bp, Artificial Sequence
  Synthetic Polynucleotide
taatacgactcactatagggttcagggcacgccgcctcggcgaacagcgcaacagaggagagcgctgatggccgaggcgaacctggcggcagcgcaaaagatg

SEQ ID NO: 156878 - DNA, 103 bp, Artificial Sequence
  Synthetic Polynucleotide
taatacgactcactatagggtcgcctgcccttcagggcacgccgcctcggaacagaggagaccgaggatgcgtgccctgaacctggcggcagcgcaaaagatg

SEQ ID NO: 156879 - DNA, 103 bp, Artificial Sequence
  Synthetic Polynucleotide
taatacgactcactatagggcttggctccatcgcctgcccttcagggcacaacagaggagagtgcccatgagggcaggcaacctggcggcagcgcaaaagatg

SEQ ID NO: 156880 - DNA, 103 bp, Artificial Sequence
  Synthetic Polynucleotide
taatacgactcactatagggcttgtcggagggcggcggccgccgagttggaacagaggagaccaactatgcggccgccgaacctggcggcagcgcaaaagatg

SEQ ID NO: 156881 - DNA, 103 bp, Artificial Sequence
  Synthetic Polynucleotide
taatacgactcactatagggggacggtgggcttggctccatcgcctgcccaacagaggagagggcagatgatggagccaaacctggcggcagcgcaaaagatg

SEQ ID NO: 156882 - DNA, 103 bp, Artificial Sequence
  Synthetic Polynucleotide
taatacgactcactataggggaaggagcggggacggtgggcttggctccaaacagaggagatggagcatggcccaccgtaacctggcggcagcgcaaaagatg

SEQ ID NO: 156883 - DNA, 103 bp, Artificial Sequence
  Synthetic Polynucleotide
taatacgactcactatagggacgtcgcccggaaggagcggggacggtgggaacagaggagacccaccatgcccgctcctaacctggcggcagcgcaaaagatg

SEQ ID NO: 156884 - DNA, 103 bp, Artificial Sequence
  Synthetic Polynucleotide
taatacgactcactatagggcagagccagcacgtcgcccggaaggagcggaacagaggagaccgctcatgccgggcgacaacctggcggcagcgcaaaagatg

SEQ ID NO: 156885 - DNA, 103 bp, Artificial Sequence
  Synthetic Polynucleotide
taatacgactcactatagggaggtctccaacagagccagcacgtcgcccgaacagaggagacgggcgatgtgctggctcaacctggcggcagcgcaaaagatg

SEQ ID NO: 156886 - DNA, 103 bp, Artificial Sequence
  Synthetic Polynucleotide
taatacgactcactatagggaggggcatccaggtctccaacagagccagcaacagaggagagctggcatggttggagacaacctggcggcagcgcaaaagatg

SEQ ID NO: 156887 - DNA, 103 bp, Artificial Sequence
  Synthetic Polynucleotide
taatacgactcactatagggcagaggcgagaggggcatccaggtctccaaaacagaggagattggagatgtggatgcccaacctggcggcagcgcaaaagatg

SEQ ID NO: 156888 - DNA, 103 bp, Artificial Sequence
  Synthetic Polynucleotide
taatacgactcactataggggcagccactccagaggcgagaggggcatccaacagaggagaggatgcatgtctcgcctcaacctggcggcagcgcaaaagatg

SEQ ID NO: 156889 - DNA, 103 bp, Artificial Sequence
  Synthetic Polynucleotide
taatacgactcactatagggggctcctcaggcagccactccagaggcgagaacagaggagactcgccatgggagtggctaacctggcggcagcgcaaaagatg

SEQ ID NO: 156890 - DNA, 103 bp, Artificial Sequence
  Synthetic Polynucleotide
taatacgactcactatagggggccgcagtccttgtcggagggcggcggccaacagaggagaggccgcatgcctccgacaaacctggcggcagcgcaaaagatg

SEQ ID NO: 156891 - DNA, 103 bp, Artificial Sequence
  Synthetic Polynucleotide
taatacgactcactatagggacgagggagcggccgcagtccttgtcggagaacagaggagactccgaatgggactgcggaacctggcggcagcgcaaaagatg

SEQ ID NO: 156892 - DNA, 103 bp, Artificial Sequence
  Synthetic Polynucleotide
taatacgactcactataggggaggctctgcggaggaggcgactgggccataacagaggagaatggccatgtcgcctcctaacctggcggcagcgcaaaagatg

SEQ ID NO: 156893 - DNA, 103 bp, Artificial Sequence
  Synthetic Polynucleotide
taatacgactcactatagggcgacgaatcggaggaggaggccggggacgtaacagaggagaacgtccatggcctcctccaacctggcggcagcgcaaaagatg

SEQ ID NO: 156894 - DNA, 103 bp, Artificial Sequence
  Synthetic Polynucleotide
taatacgactcactatagggcccgggggtctgaggctgcagtctctggcaaacagaggagatgccagatgctgcagcctaacctggcggcagcgcaaaagatg

SEQ ID NO: 156895 - DNA, 103 bp, Artificial Sequence
  Synthetic Polynucleotide
taatacgactcactatagggtccagcacctcccgggggtctgaggctgcaaacagaggagatgcagcatgagacccccgaacctggcggcagcgcaaaagatg

SEQ ID NO: 156896 - DNA, 103 bp, Artificial Sequence
  Synthetic Polynucleotide
taatacgactcactataggggcactgtggctccagcacctcccgggggtcaacagaggagagaccccatggaggtgctgaacctggcggcagcgcaaaagatg

SEQ ID NO: 156897 - DNA, 103 bp, Artificial Sequence
  Synthetic Polynucleotide
taatacgactcactatagggcaccacctctgcactgtggctccagcacctaacagaggagaaggtgcatgagccacagtaacctggcggcagcgcaaaagatg

SEQ ID NO: 156898 - DNA, 103 bp, Artificial Sequence
  Synthetic Polynucleotide
taatacgactcactatagggctgagttgggcaccacctctgcactgtggcaacagaggagagccacaatgcagaggtggaacctggcggcagcgcaaaagatg

SEQ ID NO: 156899 - DNA, 103 bp, Artificial Sequence
  Synthetic Polynucleotide
taatacgactcactatagggccctggtcctctgagttgggcaccacctctaacagaggagaagaggtatggcccaactcaacctggcggcagcgcaaaagatg

SEQ ID NO: 156900 - DNA, 103 bp, Artificial Sequence
  Synthetic Polynucleotide
taatacgactcactatagggggcgcccggtccctggtcctctgagttgggaacagaggagacccaacatggaggaccagaacctggcggcagcgcaaaagatg

SEQ ID NO: 156901 - DNA, 103 bp, Artificial Sequence
  Synthetic Polynucleotide
taatacgactcactataggggctggaaggcggcgcccggtccctggtcctaacagaggagaaggaccatggaccgggcgaacctggcggcagcgcaaaagatg

SEQ ID NO: 156902 - DNA, 103 bp, Artificial Sequence
  Synthetic Polynucleotide
taatacgactcactataggggcttcactgagctggaaggcggcgcccggtaacagaggagaaccgggatgcgccttccaaacctggcggcagcgcaaaagatg

SEQ ID NO: 156903 - DNA, 103 bp, Artificial Sequence
  Synthetic Polynucleotide
taatacgactcactataggggggagggcttgcttcactgagctggaaggcaacagaggagagccttcatgctcagtgaaaacctggcggcagcgcaaaagatg

SEQ ID NO: 156904 - DNA, 103 bp, Artificial Sequence
  Synthetic Polynucleotide
taatacgactcactatagggggcacgaacccgacgaatcggaggaggaggaacagaggagacctcctatgccgattcgtaacctggcggcagcgcaaaagatg

SEQ ID NO: 156905 - DNA, 103 bp, Artificial Sequence
  Synthetic Polynucleotide
taatacgactcactatagggctgagctctggggagggcttgcttcactgaaacagaggagatcagtgatgcaagccctcaacctggcggcagcgcaaaagatg

SEQ ID NO: 156906 - DNA, 103 bp, Artificial Sequence
  Synthetic Polynucleotide
taatacgactcactatagggaaccgcaggcctgagctctggggagggcttaacagaggagaaagcccatgccagagctcaacctggcggcagcgcaaaagatg

SEQ ID NO: 156907 - DNA, 103 bp, Artificial Sequence
  Synthetic Polynucleotide
taatacgactcactataggggcagccactgaaccgcaggcctgagctctgaacagaggagacagagcatgggcctgcggaacctggcggcagcgcaaaagatg

SEQ ID NO: 156908 - DNA, 103 bp, Artificial Sequence
  Synthetic Polynucleotide
taatacgactcactatagggaaagttcagggcagccactgaaccgcaggcaacagaggagagcctgcatgtcagtggctaacctggcggcagcgcaaaagatg

SEQ ID NO: 156909 - DNA, 103 bp, Artificial Sequence
  Synthetic Polynucleotide
taatacgactcactatagggtcttcttgccaaagttcagggcagccactgaacagaggagacagtggatgccctgaactaacctggcggcagcgcaaaagatg

SEQ ID NO: 156910 - DNA, 103 bp, Artificial Sequence
  Synthetic Polynucleotide
taatacgactcactatagggcccctccagatcttcttgccaaagttcaggaacagaggagacctgaaatgtggcaagaaaacctggcggcagcgcaaaagatg

SEQ ID NO: 156911 - DNA, 103 bp, Artificial Sequence
  Synthetic Polynucleotide
taatacgactcactatagggccaggcgggccccctccagatcttcttgccaacagaggagaggcaagatgatctggaggaacctggcggcagcgcaaaagatg

SEQ ID NO: 156912 - DNA, 103 bp, Artificial Sequence
  Synthetic Polynucleotide
taatacgactcactatagggtagaagatgcccaggcgggccccctccagaaacagaggagatctggaatgggcccgcctaacctggcggcagcgcaaaagatg

SEQ ID NO: 156913 - DNA, 103 bp, Artificial Sequence
  Synthetic Polynucleotide
taatacgactcactatagggccgtcgcaggggcacgaacccgacgaatcgaacagaggagacgattcatggggttcgtgaacctggcggcagcgcaaaagatg

SEQ ID NO: 156914 - DNA, 103 bp, Artificial Sequence
  Synthetic Polynucleotide
taatacgactcactatagggtccgcgggcgccgtcgcaggggcacgaaccaacagaggagaggttcgatgccctgcgacaacctggcggcagcgcaaaagatg

SEQ ID NO: 156915 - DNA, 103 bp, Artificial Sequence
  Synthetic Polynucleotide
taatacgactcactataggggctgcgggagtccgcgggcgccgtcgcaggaacagaggagacctgcgatggcgcccgcgaacctggcggcagcgcaaaagatg

SEQ ID NO: 156916 - DNA, 103 bp, Artificial Sequence
  Synthetic Polynucleotide
taatacgactcactatagggggaggctgtggctgcgggagtccgcgggcgaacagaggagacgcccgatgactcccgcaaacctggcggcagcgcaaaagatg

SEQ ID NO: 156917 - DNA, 103 bp, Artificial Sequence
  Synthetic Polynucleotide
taatacgactcactataggggctgcagctcggaggctgtggctgcgggagaacagaggagactcccgatgccacagcctaacctggcggcagcgcaaaagatg

SEQ ID NO: 156918 - DNA, 103 bp, Artificial Sequence
  Synthetic Polynucleotide
taatacgactcactatagggcggctcgggagctgcagctcggaggctgtgaacagaggagacacagcatgcgagctgcaaacctggcggcagcgcaaaagatg

SEQ ID NO: 156919 - DNA, 103 bp, Artificial Sequence
  Synthetic Polynucleotide
taatacgactcactataggggctgcctctgcggctcgggagctgcagctcaacagaggagagagctgatgctcccgagcaacctggcggcagcgcaaaagatg

SEQ ID NO: 156920 - DNA, 103 bp, Artificial Sequence
  Synthetic Polynucleotide
taatacgactcactatagggcgtcgtcgcggctgcctctgcggctcgggaaacagaggagatcccgaatggcagaggcaaacctggcggcagcgcaaaagatg

SEQ ID NO: 156921 - DNA, 103 bp, Artificial Sequence
  Synthetic Polynucleotide
taatacgactcactatagggcgtggccgaggaggctctgcggaggaggcgaacagaggagacgcctcatgcgcagagccaacctggcggcagcgcaaaagatg

SEQ ID NO: 156922 - DNA, 103 bp, Artificial Sequence
  Synthetic Polynucleotide
taatacgactcactatagggctcgtctgggcgtcgtcgcggctgcctctgaacagaggagacagaggatgccgcgacgaaacctggcggcagcgcaaaagatg

SEQ ID NO: 156923 - DNA, 103 bp, Artificial Sequence
  Synthetic Polynucleotide
taatacgactcactatagggccggtgcgcgctcgtctgggcgtcgtcgcgaacagaggagacgcgacatggcccagacgaacctggcggcagcgcaaaagatg

SEQ ID NO: 156924 - DNA, 103 bp, Artificial Sequence
  Synthetic Polynucleotide
taatacgactcactataggggcccgctggtccggtgcgcgctcgtctgggaacagaggagacccagaatggcgcgcaccaacctggcggcagcgcaaaagatg

SEQ ID NO: 156925 - DNA, 103 bp, Artificial Sequence
  Synthetic Polynucleotide
taatacgactcactataggggccgctgtccgcccgctggtccggtgcgcgaacagaggagacgcgcaatggaccagcggaacctggcggcagcgcaaaagatg

SEQ ID NO: 156926 - DNA, 103 bp, Artificial Sequence
  Synthetic Polynucleotide
taatacgactcactatagggctggcgctctgccgctgtccgcccgctggtaacagaggagaaccagcatgcggacagcgaacctggcggcagcgcaaaagatg

SEQ ID NO: 156927 - DNA, 103 bp, Artificial Sequence
  Synthetic Polynucleotide
taatacgactcactatagggctcccgctcgctggcgctctgccgctgtccaacagaggagaggacagatgcagagcgccaacctggcggcagcgcaaaagatg

SEQ ID NO: 156928 - DNA, 103 bp, Artificial Sequence
  Synthetic Polynucleotide
taatacgactcactatagggtgcgcagtttctcccgctcgctggcgctctaacagaggagaagagcgatggcgagcgggaacctggcggcagcgcaaaagatg

SEQ ID NO: 156929 - DNA, 103 bp, Artificial Sequence
  Synthetic Polynucleotide
taatacgactcactatagggagcgtgcgcatgcgcagtttctcccgctcgaacagaggagacgagcgatggaaactgcgaacctggcggcagcgcaaaagatg

SEQ ID NO: 156930 - DNA, 103 bp, Artificial Sequence
  Synthetic Polynucleotide
taatacgactcactatagggggcgcgggccagcgtgcgcatgcgcagtttaacagaggagaaaactgatgatgcgcacgaacctggcggcagcgcaaaagatg

SEQ ID NO: 156931 - DNA, 103 bp, Artificial Sequence
  Synthetic Polynucleotide
taatacgactcactatagggactcgtgcagggcgcgggccagcgtgcgcaaacagaggagatgcgcaatgtggcccgcgaacctggcggcagcgcaaaagatg

SEQ ID NO: 156932 - DNA, 103 bp, Artificial Sequence
  Synthetic Polynucleotide
taatacgactcactatagggatccagtggtcgtggccgaggaggctctgcaacagaggagagcagagatgcctcggccaaacctggcggcagcgcaaaagatg

SEQ ID NO: 156933 - DNA, 103 bp, Artificial Sequence
  Synthetic Polynucleotide
taatacgactcactatagggaagcggcgcaactcgtgcagggcgcgggccaacagaggagaggcccgatgcctgcacgaaacctggcggcagcgcaaaagatg

SEQ ID NO: 156934 - DNA, 103 bp, Artificial Sequence
  Synthetic Polynucleotide
taatacgactcactataggggggaggcagaaagcggcgcaactcgtgcagaacagaggagactgcacatgttgcgccgcaacctggcggcagcgcaaaagatg

SEQ ID NO: 156935 - DNA, 103 bp, Artificial Sequence
  Synthetic Polynucleotide
taatacgactcactataggggcgccaaggagggaggcagaaagcggcgcaaacagaggagatgcgccatgttctgcctcaacctggcggcagcgcaaaagatg

SEQ ID NO: 156936 - DNA, 103 bp, Artificial Sequence
  Synthetic Polynucleotide
taatacgactcactatagggtggccggccggcgccaaggagggaggcagaaacagaggagatctgccatgctccttggcaacctggcggcagcgcaaaagatg

SEQ ID NO: 156937 - DNA, 103 bp, Artificial Sequence
  Synthetic Polynucleotide
taatacgactcactatagggggtcaggctctggccggccggcgccaaggaaacagaggagatccttgatgccggccggcaacctggcggcagcgcaaaagatg

SEQ ID NO: 156938 - DNA, 103 bp, Artificial Sequence
  Synthetic Polynucleotide
taatacgactcactatagggtctcgatcttggtcaggctctggccggccgaacagaggagacggccgatgagagcctgaaacctggcggcagcgcaaaagatg

SEQ ID NO: 156939 - DNA, 103 bp, Artificial Sequence
  Synthetic Polynucleotide
taatacgactcactatagggaggcgcagcgtctcgatcttggtcaggctcaacagaggagagagcctatgcaagatcgaaacctggcggcagcgcaaaagatg

SEQ ID NO: 156940 - DNA, 103 bp, Artificial Sequence
  Synthetic Polynucleotide
taatacgactcactataggggcggatggccaggcgcagcgtctcgatcttaacagaggagaaagatcatgacgctgcgcaacctggcggcagcgcaaaagatg

SEQ ID NO: 156941 - DNA, 103 bp, Artificial Sequence
  Synthetic Polynucleotide
taatacgactcactatagggggccgatgtagcggatggccaggcgcagcgaacagaggagacgctgcatgtggccatccaacctggcggcagcgcaaaagatg

SEQ ID NO: 156942 - DNA, 103 bp, Artificial Sequence
  Synthetic Polynucleotide
taatacgactcactataggggccgataggtggccgatgtagcggatggccaacagaggagaggccatatgctacatcggaacctggcggcagcgcaaaagatg

SEQ ID NO: 156943 - DNA, 103 bp, Artificial Sequence
  Synthetic Polynucleotide
taatacgactcactatagggctgggcgaagatccagtggtcgtggccgagaacagaggagactcggcatggaccactggaacctggcggcagcgcaaaagatg

SEQ ID NO: 156944 - DNA, 103 bp, Artificial Sequence
  Synthetic Polynucleotide
taatacgactcactatagggacccagcacggccgataggtggccgatgtaaacagaggagatacatcatgcacctatcgaacctggcggcagcgcaaaagatg

SEQ ID NO: 156945 - DNA, 103 bp, Artificial Sequence
  Synthetic Polynucleotide
taatacgactcactatagggcctcgctgagacccagcacggccgataggtaacagaggagaacctatatgccgtgctggaacctggcggcagcgcaaaagatg

SEQ ID NO: 156946 - DNA, 103 bp, Artificial Sequence
  Synthetic Polynucleotide
taatacgactcactatagggtgcagactctcctcgctgagacccagcacgaacagaggagacgtgctatgtctcagcgaaacctggcggcagcgcaaaagatg

SEQ ID NO: 156947 - DNA, 103 bp, Artificial Sequence
  Synthetic Polynucleotide
taatacgactcactataggggcgccggcactgcagactctcctcgctgagaacagaggagactcagcatggagagtctgaacctggcggcagcgcaaaagatg

SEQ ID NO: 156948 - DNA, 103 bp, Artificial Sequence
  Synthetic Polynucleotide
taatacgactcactatagggcgcgctgcctgcgccggcactgcagactctaacagaggagaagagtcatgagtgccggcaacctggcggcagcgcaaaagatg

SEQ ID NO: 156949 - DNA, 103 bp, Artificial Sequence
  Synthetic Polynucleotide
taatacgactcactatagggcccgcgtccccgcgctgcctgcgccggcacaacagaggagagtgccgatgcaggcagcgaacctggcggcagcgcaaaagatg

SEQ ID NO: 156950 - DNA, 103 bp, Artificial Sequence
  Synthetic Polynucleotide
taatacgactcactatagggccaaggggaccccgcgtccccgcgctgcctaacagaggagaaggcagatgggggacgcgaacctggcggcagcgcaaaagatg

SEQ ID NO: 156951 - DNA, 103 bp, Artificial Sequence
  Synthetic Polynucleotide
taatacgactcactataggggcgggcagccccaaggggaccccgcgtcccaacagaggagagggacgatgggtccccttaacctggcggcagcgcaaaagatg

SEQ ID NO: 156952 - DNA, 103 bp, Artificial Sequence
  Synthetic Polynucleotide
taatacgactcactatagggtcggggcacagcgggcagccccaaggggacaacagaggagagtccccatggggctgcccaacctggcggcagcgcaaaagatg

SEQ ID NO: 156953 - DNA, 103 bp, Artificial Sequence
  Synthetic Polynucleotide
taatacgactcactatagggggggccacggtcggggcacagcgggcagccaacagaggagaggctgcatgctgtgccccaacctggcggcagcgcaaaagatg

SEQ ID NO: 156954 - DNA, 103 bp, Artificial Sequence
  Synthetic Polynucleotide
taatacgactcactatagggagccccagccctgggcgaagatccagtggtaacagaggagaaccactatgtcttcgcccaacctggcggcagcgcaaaagatg

SEQ ID NO: 156955 - DNA, 103 bp, Artificial Sequence
  Synthetic Polynucleotide
taatacgactcactataggggcgcctctgcggggccacggtcggggcacaaacagaggagatgtgccatgaccgtggccaacctggcggcagcgcaaaagatg

SEQ ID NO: 156956 - DNA, 103 bp, Artificial Sequence
  Synthetic Polynucleotide
taatacgactcactataggggcctgcgtctgcgcctctgcggggccacggaacagaggagaccgtggatgcgcagaggcaacctggcggcagcgcaaaagatg

SEQ ID NO: 156957 - DNA, 103 bp, Artificial Sequence
  Synthetic Polynucleotide
taatacgactcactatagggctgcccctccgcctgcgtctgcgcctctgcaacagaggagagcagagatgcagacgcagaacctggcggcagcgcaaaagatg

SEQ ID NO: 156958 - DNA, 103 bp, Artificial Sequence
  Synthetic Polynucleotide
taatacgactcactataggggcccttgcccctgcccctccgcctgcgtctaacagaggagaagacgcatgcggaggggcaacctggcggcagcgcaaaagatg

SEQ ID NO: 156959 - DNA, 103 bp, Artificial Sequence
  Synthetic Polynucleotide
taatacgactcactatagggccctgcccctgcccttgcccctgcccctccaacagaggagaggagggatgggggcaaggaacctggcggcagcgcaaaagatg

SEQ ID NO: 156960 - DNA, 103 bp, Artificial Sequence
  Synthetic Polynucleotide
taatacgactcactatagggttgcccctgcccctgcccctgcccttgcccaacagaggagagggcaaatgcaggggcagaacctggcggcagcgcaaaagatg

SEQ ID NO: 156961 - DNA, 103 bp, Artificial Sequence
  Synthetic Polynucleotide
taatacgactcactataggggcccctgcccttgcccctgcccctgcccctaacagaggagaaggggcatgggcaggggcaacctggcggcagcgcaaaagatg

SEQ ID NO: 156962 - DNA, 103 bp, Artificial Sequence
  Synthetic Polynucleotide
taatacgactcactatagggccctgtccttgcccctgcccttgcccctgcaacagaggagagcagggatgagggcagggaacctggcggcagcgcaaaagatg

SEQ ID NO: 156963 - DNA, 103 bp, Artificial Sequence
  Synthetic Polynucleotide
taatacgactcactatagggctgtccttgcccctgtccttgcccctgcccaacagaggagagggcagatgcaaggacagaacctggcggcagcgcaaaagatg

SEQ ID NO: 156964 - DNA, 103 bp, Artificial Sequence
  Synthetic Polynucleotide
taatacgactcactataggggcccttgcccctgtccttgcccctgtccttaacagaggagaaaggacatgggcaaggacaacctggcggcagcgcaaaagatg

SEQ ID NO: 156965 - DNA, 103 bp, Artificial Sequence
  Synthetic Polynucleotide
taatacgactcactatagggtggccggcccagccccagccctgggcgaagaacagaggagacttcgcatggggctggggaacctggcggcagcgcaaaagatg

SEQ ID NO: 156966 - DNA, 103 bp, Artificial Sequence
  Synthetic Polynucleotide
taatacgactcactatagggctgcgcccctgcccttgcccctgtccttgcaacagaggagagcaaggatgggggcaaggaacctggcggcagcgcaaaagatg

SEQ ID NO: 156967 - DNA, 103 bp, Artificial Sequence
  Synthetic Polynucleotide
taatacgactcactatagggcaggcccggcctgcgcccctgcccttgcccaacagaggagagggcaaatgcaggggcgcaacctggcggcagcgcaaaagatg

SEQ ID NO: 156968 - DNA, 103 bp, Artificial Sequence
  Synthetic Polynucleotide
taatacgactcactatagggcggcggagaccaggcccggcctgcgcccctaacagaggagaaggggcatgggccgggccaacctggcggcagcgcaaaagatg

SEQ ID NO: 156969 - DNA, 103 bp, Artificial Sequence
  Synthetic Polynucleotide
taatacgactcactatagggtcggcgaggacggcggagaccaggcccggcaacagaggagagccgggatgggtctccgcaacctggcggcagcgcaaaagatg

SEQ ID NO: 156970 - DNA, 103 bp, Artificial Sequence
  Synthetic Polynucleotide
taatacgactcactatagggccaggacgcctcggcgaggacggcggagacaacagaggagagtctccatggtcctcgccaacctggcggcagcgcaaaagatg

SEQ ID NO: 156971 - DNA, 103 bp, Artificial Sequence
  Synthetic Polynucleotide
taatacgactcactatagggacggggatccccaggacgcctcggcgaggaaacagaggagatcctcgatgaggcgtcctaacctggcggcagcgcaaaagatg

SEQ ID NO: 156972 - DNA, 103 bp, Artificial Sequence
  Synthetic Polynucleotide
taatacgactcactataggggggcaggcggacggggatccccaggacgccaacagaggagaggcgtcatggggatccccaacctggcggcagcgcaaaagatg

SEQ ID NO: 156973 - DNA, 103 bp, Artificial Sequence
  Synthetic Polynucleotide
taatacgactcactatagggttgggctccggggcaggcggacggggatccaacagaggagaggatccatgtccgcctgcaacctggcggcagcgcaaaagatg

SEQ ID NO: 156974 - DNA, 103 bp, Artificial Sequence
  Synthetic Polynucleotide
taatacgactcactatagggcgggtgcggcttgggctccggggcaggcggaacagaggagaccgcctatgccggagcccaacctggcggcagcgcaaaagatg

SEQ ID NO: 156975 - DNA, 103 bp, Artificial Sequence
  Synthetic Polynucleotide
taatacgactcactatagggcccaggcgctcgggtgcggcttgggctccgaacagaggagacggagcatgagccgcaccaacctggcggcagcgcaaaagatg

SEQ ID NO: 156976 - DNA, 103 bp, Artificial Sequence
  Synthetic Polynucleotide
taatacgactcactatagggggagtcccagtggccggcccagccccagccaacagaggagaggctggatgtgggccggcaacctggcggcagcgcaaaagatg

SEQ ID NO: 156977 - DNA, 103 bp, Artificial Sequence
  Synthetic Polynucleotide
taatacgactcactataggggacccccctccccaggcgctcgggtgcggcaacagaggagagccgcaatggagcgcctgaacctggcggcagcgcaaaagatg

SEQ ID NO: 156978 - DNA, 103 bp, Artificial Sequence
  Synthetic Polynucleotide
taatacgactcactatagggccgtgtcgtggacccccctccccaggcgctaacagaggagaagcgccatgggaggggggaacctggcggcagcgcaaaagatg

SEQ ID NO: 156979 - DNA, 103 bp, Artificial Sequence
  Synthetic Polynucleotide
taatacgactcactataggggcccagggatccgtgtcgtggacccccctcaacagaggagagaggggatgccacgacacaacctggcggcagcgcaaaagatg

SEQ ID NO: 156980 - DNA, 103 bp, Artificial Sequence
  Synthetic Polynucleotide
taatacgactcactatagggagggggtgttgcccagggatccgtgtcgtgaacagaggagacacgacatggatccctggaacctggcggcagcgcaaaagatg

SEQ ID NO: 156981 - DNA, 103 bp, Artificial Sequence
  Synthetic Polynucleotide
taatacgactcactatagggtggggcagtaagggggtgttgcccagggataacagaggagaatccctatgcaacaccccaacctggcggcagcgcaaaagatg

SEQ ID NO: 156982 - DNA, 103 bp, Artificial Sequence
  Synthetic Polynucleotide
taatacgactcactataggggactgtatcttggggcagtaagggggtgttaacagaggagaaacaccatgttactgcccaacctggcggcagcgcaaaagatg

SEQ ID NO: 156983 - DNA, 103 bp, Artificial Sequence
  Synthetic Polynucleotide
taatacgactcactatagggatacgggggcgactgtatcttggggcagtaaacagaggagatactgcatgaagatacagaacctggcggcagcgcaaaagatg

SEQ ID NO: 156984 - DNA, 103 bp, Artificial Sequence
  Synthetic Polynucleotide
taatacgactcactatagggcttgggacgaatacgggggcgactgtatctaacagaggagaagatacatgcgcccccgtaacctggcggcagcgcaaaagatg

SEQ ID NO: 156985 - DNA, 103 bp, Artificial Sequence
  Synthetic Polynucleotide
taatacgactcactataggggaggttgtcccttgggacgaatacgggggcaacagaggagagcccccatgttcgtcccaaacctggcggcagcgcaaaagatg

SEQ ID NO: 156986 - DNA, 103 bp, Artificial Sequence
  Synthetic Polynucleotide
taatacgactcactatagggagacgcgtcggaggttgtcccttgggacgaaacagaggagatcgtccatggggacaaccaacctggcggcagcgcaaaagatg

SEQ ID NO: 156987 - DNA, 103 bp, Artificial Sequence
  Synthetic Polynucleotide
taatacgactcactatagggccggggacgtggagtcccagtggccggcccaacagaggagagggccgatgactgggactaacctggcggcagcgcaaaagatg

SEQ ID NO: 156988 - DNA, 103 bp, Artificial Sequence
  Synthetic Polynucleotide
taatacgactcactataggggcgtccaaagagacgcgtcggaggttgtccaacagaggagaggacaaatgccgacgcgtaacctggcggcagcgcaaaagatg

SEQ ID NO: 156989 - DNA, 103 bp, Artificial Sequence
  Synthetic Polynucleotide
taatacgactcactatagggccttggggtggcgtccaaagagacgcgtcgaacagaggagacgacgcatgtctttggacaacctggcggcagcgcaaaagatg

SEQ ID NO: 156990 - DNA, 103 bp, Artificial Sequence
  Synthetic Polynucleotide
taatacgactcactatagggccagggacagccttggggtggcgtccaaagaacagaggagactttggatgccaccccaaaacctggcggcagcgcaaaagatg

SEQ ID NO: 156991 - DNA, 103 bp, Artificial Sequence
  Synthetic Polynucleotide
taatacgactcactatagggacgactgcgtccagggacagccttggggtgaacagaggagacaccccatggctgtccctaacctggcggcagcgcaaaagatg

SEQ ID NO: 156992 - DNA, 103 bp, Artificial Sequence
  Synthetic Polynucleotide
taatacgactcactatagggggctctggggacgactgcgtccagggacagaacagaggagactgtccatggacgcagtcaacctggcggcagcgcaaaagatg

SEQ ID NO: 156993 - DNA, 103 bp, Artificial Sequence
  Synthetic Polynucleotide
taatacgactcactatagggtgggttccggggctctggggacgactgcgtaacagaggagaacgcagatgtccccagagaacctggcggcagcgcaaaagatg

SEQ ID NO: 156994 - DNA, 103 bp, Artificial Sequence
  Synthetic Polynucleotide
taatacgactcactatagggagggcactggtgggttccggggctctggggaacagaggagaccccagatgcccggaaccaacctggcggcagcgcaaaagatg

SEQ ID NO: 156995 - DNA, 103 bp, Artificial Sequence
  Synthetic Polynucleotide
taatacgactcactataggggccgccgtccagggcactggtgggttccggaacagaggagaccggaaatgaccagtgccaacctggcggcagcgcaaaagatg

SEQ ID NO: 156996 - DNA, 103 bp, Artificial Sequence
  Synthetic Polynucleotide
taatacgactcactatagggagttgctggggccgccgtccagggcactggaacagaggagaccagtgatgtggacggcgaacctggcggcagcgcaaaagatg

SEQ ID NO: 156997 - DNA, 103 bp, Artificial Sequence
  Synthetic Polynucleotide
taatacgactcactatagggccagctccaaagttgctggggccgccgtccaacagaggagaggacggatgccccagcaaaacctggcggcagcgcaaaagatg

SEQ ID NO: 156998 - DNA, 103 bp, Artificial Sequence
  Synthetic Polynucleotide
taatacgactcactataggggaggaggaggccggggacgtggagtcccagaacagaggagactgggaatgcacgtccccaacctggcggcagcgcaaaagatg

SEQ ID NO: 156999 - DNA, 103 bp, Artificial Sequence
  Synthetic Polynucleotide
taatacgactcactatagggtacactgcggccagctccaaagttgctgggaacagaggagacccagcatgtttggagctaacctggcggcagcgcaaaagatg

SEQ ID NO: 157000 - DNA, 103 bp, Artificial Sequence
  Synthetic Polynucleotide
taatacgactcactataggggagaccctggtacactgcggccagctccaaaacagaggagattggagatggccgcagtgaacctggcggcagcgcaaaagatg

SEQ ID NO: 157001 - DNA, 103 bp, Artificial Sequence
  Synthetic Polynucleotide
taatacgactcactataggggagacacagagagaccctggtacactgcggaacagaggagaccgcagatgaccagggtcaacctggcggcagcgcaaaagatg

SEQ ID NO: 157002 - DNA, 103 bp, Artificial Sequence
  Synthetic Polynucleotide
taatacgactcactatagggcagggctctggagacacagagagaccctggaacagaggagaccagggatgctctgtgtcaacctggcggcagcgcaaaagatg

SEQ ID NO: 157003 - DNA, 103 bp, Artificial Sequence
  Synthetic Polynucleotide
taatacgactcactatagggcagcgacagacagggctctggagacacagaaacagaggagatctgtgatgccagagcccaacctggcggcagcgcaaaagatg

SEQ ID NO: 157004 - DNA, 103 bp, Artificial Sequence
  Synthetic Polynucleotide
taatacgactcactatagggatggagctcccagcgacagacagggctctgaacagaggagacagagcatggtctgtcgcaacctggcggcagcgcaaaagatg

SEQ ID NO: 157005 - DNA, 103 bp, Artificial Sequence
  Synthetic Polynucleotide
taatacgactcactatagggggcaggagagatggagctcccagcgacagaaacagaggagatctgtcatggggagctccaacctggcggcagcgcaaaagatg

SEQ ID NO: 157006 - DNA, 103 bp, Artificial Sequence
  Synthetic Polynucleotide
taatacgactcactatagggtgatgggtggggcaggagagatggagctccaacagaggagaggagctatgtctctcctgaacctggcggcagcgcaaaagatg

SEQ ID NO: 157007 - DNA, 103 bp, Artificial Sequence
  Synthetic Polynucleotide
taatacgactcactataggggtctctggcatgatgggtggggcaggagagaacagaggagactctccatgcccacccataacctggcggcagcgcaaaagatg

SEQ ID NO: 157008 - DNA, 103 bp, Artificial Sequence
  Synthetic Polynucleotide
taatacgactcactatagggtgaggctgcagtctctggcatgatgggtggaacagaggagaccacccatgatgccagagaacctggcggcagcgcaaaagatg

SEQ ID NO: 157009 - DNA, 103 bp, Artificial Sequence
  Synthetic Polynucleotide
taatacgactcactatagggaaccactgaagtattttcaaggtgtcccataacagaggagaatgggaatgcttgaaaataacctggcggcagcgcaaaagatg

SEQ ID NO: 157010 - DNA, 103 bp, Artificial Sequence
  Synthetic Polynucleotide
taatacgactcactatagggaggatgctcggcggaactgcttcttgaaaaaacagaggagattttcaatgagcagttccaacctggcggcagcgcaaaagatg

SEQ ID NO: 157011 - DNA, 103 bp, Artificial Sequence
  Synthetic Polynucleotide
taatacgactcactataggggcgcatgtctggatcatttgacttgggaataacagaggagaattcccatgtcaaatgataacctggcggcagcgcaaaagatg

SEQ ID NO: 157012 - DNA, 103 bp, Artificial Sequence
  Synthetic Polynucleotide
taatacgactcactatagggccttgttccagcgcatgtctggatcatttgaacagaggagacaaatgatgcagacatgcaacctggcggcagcgcaaaagatg

SEQ ID NO: 157013 - DNA, 103 bp, Artificial Sequence
  Synthetic Polynucleotide
taatacgactcactatagggaagatggttcccttgttccagcgcatgtctaacagaggagaagacatatgctggaacaaaacctggcggcagcgcaaaagatg

SEQ ID NO: 157014 - DNA, 103 bp, Artificial Sequence
  Synthetic Polynucleotide
taatacgactcactatagggggatgcttttaagatggttcccttgttccaaacagaggagatggaacatgggaaccatcaacctggcggcagcgcaaaagatg

SEQ ID NO: 157015 - DNA, 103 bp, Artificial Sequence
  Synthetic Polynucleotide
taatacgactcactatagggtatagtccacggatgcttttaagatggttcaacagaggagagaaccaatgtaaaagcataacctggcggcagcgcaaaagatg

SEQ ID NO: 157016 - DNA, 103 bp, Artificial Sequence
  Synthetic Polynucleotide
taatacgactcactatagggaactttcggatatagtccacggatgcttttaacagaggagaaaaagcatgcgtggactaaacctggcggcagcgcaaaagatg

SEQ ID NO: 157017 - DNA, 103 bp, Artificial Sequence
  Synthetic Polynucleotide
taatacgactcactatagggttctcgttgcaactttcggatatagtccacaacagaggagagtggacatgatccgaaagaacctggcggcagcgcaaaagatg

SEQ ID NO: 157018 - DNA, 103 bp, Artificial Sequence
  Synthetic Polynucleotide
taatacgactcactatagggcgcgttgctgttctcgttgcaactttcggaaacagaggagatccgaaatgtgcaacgagaacctggcggcagcgcaaaagatg

SEQ ID NO: 157019 - DNA, 103 bp, Artificial Sequence
  Synthetic Polynucleotide
taatacgactcactatagggagttcttttgcgcgttgctgttctcgttgcaacagaggagagcaacgatgacagcaacgaacctggcggcagcgcaaaagatg

SEQ ID NO: 157020 - DNA, 103 bp, Artificial Sequence
  Synthetic Polynucleotide
taatacgactcactatagggtcggttttcaagttcttttgcgcgttgctgaacagaggagacagcaaatggcaaaagaaaacctggcggcagcgcaaaagatg

SEQ ID NO: 157021 - DNA, 103 bp, Artificial Sequence
  Synthetic Polynucleotide
taatacgactcactatagggtggaggccccaggatgctcggcggaactgcaacagaggagagcagttatgccgagcatcaacctggcggcagcgcaaaagatg

SEQ ID NO: 157022 - DNA, 103 bp, Artificial Sequence
  Synthetic Polynucleotide
taatacgactcactataggggtttcttctgtcggttttcaagttcttttgaacagaggagacaaaagatgttgaaaaccaacctggcggcagcgcaaaagatg

SEQ ID NO: 157023 - DNA, 103 bp, Artificial Sequence
  Synthetic Polynucleotide
taatacgactcactataggggcgtgctccagtttcttctgtcggttttcaaacagaggagatgaaaaatgacagaagaaaacctggcggcagcgcaaaagatg

SEQ ID NO: 157024 - DNA, 103 bp, Artificial Sequence
  Synthetic Polynucleotide
taatacgactcactatagggatgccggttggcgtgctccagtttcttctgaacagaggagacagaagatgctggagcacaacctggcggcagcgcaaaagatg

SEQ ID NO: 157025 - DNA, 103 bp, Artificial Sequence
  Synthetic Polynucleotide
taatacgactcactatagggtgagcaacaaatgccggttggcgtgctccaaacagaggagatggagcatgccaaccggcaacctggcggcagcgcaaaagatg

SEQ ID NO: 157026 - DNA, 103 bp, Artificial Sequence
  Synthetic Polynucleotide
taatacgactcactatagggtcctgtattctgagcaacaaatgccggttgaacagaggagacaaccgatgtttgttgctaacctggcggcagcgcaaaagatg

SEQ ID NO: 157027 - DNA, 103 bp, Artificial Sequence
  Synthetic Polynucleotide
taatacgactcactatagggcatttcaagttcctgtattctgagcaacaaaacagaggagattgttgatgagaatacagaacctggcggcagcgcaaaagatg

SEQ ID NO: 157028 - DNA, 103 bp, Artificial Sequence
  Synthetic Polynucleotide
taatacgactcactatagggctcgagcctgcatttcaagttcctgtattcaacagaggagagaatacatgaacttgaaaaacctggcggcagcgcaaaagatg

SEQ ID NO: 157029 - DNA, 103 bp, Artificial Sequence
  Synthetic Polynucleotide
taatacgactcactatagggagtccatgagctcgagcctgcatttcaagtaacagaggagaacttgaatggcaggctcgaacctggcggcagcgcaaaagatg

SEQ ID NO: 157030 - DNA, 103 bp, Artificial Sequence
  Synthetic Polynucleotide
taatacgactcactatagggaataagggaaagtccatgagctcgagcctgaacagaggagacaggctatggctcatggaaacctggcggcagcgcaaaagatg

SEQ ID NO: 157031 - DNA, 103 bp, Artificial Sequence
  Synthetic Polynucleotide
taatacgactcactatagggccgtggatggaataagggaaagtccatgagaacagaggagactcatgatgtttcccttaaacctggcggcagcgcaaaagatg

SEQ ID NO: 157032 - DNA, 103 bp, Artificial Sequence
  Synthetic Polynucleotide
taatacgactcactatagggatcggaggcttggaggccccaggatgctcgaacagaggagacgagcaatgtggggcctcaacctggcggcagcgcaaaagatg

SEQ ID NO: 157033 - DNA, 103 bp, Artificial Sequence
  Synthetic Polynucleotide
taatacgactcactataggggagcagagacccgtggatggaataagggaaaacagaggagattccctatgtccatccacaacctggcggcagcgcaaaagatg

SEQ ID NO: 157034 - DNA, 103 bp, Artificial Sequence
  Synthetic Polynucleotide
taatacgactcactatagggcaaatctggagagcagagacccgtggatggaacagaggagaccatccatgggtctctgcaacctggcggcagcgcaaaagatg

SEQ ID NO: 157035 - DNA, 103 bp, Artificial Sequence
  Synthetic Polynucleotide
taatacgactcactatagggtccgattcaccaaatctggagagcagagacaacagaggagagtctctatgctccagattaacctggcggcagcgcaaaagatg

SEQ ID NO: 157036 - DNA, 103 bp, Artificial Sequence
  Synthetic Polynucleotide
taatacgactcactatagggtgcttgatgatccgattcaccaaatctggaaacagaggagatccagaatgggtgaatcgaacctggcggcagcgcaaaagatg

SEQ ID NO: 157037 - DNA, 103 bp, Artificial Sequence
  Synthetic Polynucleotide
taatacgactcactatagggaacgggttcttgcttgatgatccgattcacaacagaggagagtgaatatgatcatcaagaacctggcggcagcgcaaaagatg

SEQ ID NO: 157038 - DNA, 103 bp, Artificial Sequence
  Synthetic Polynucleotide
taatacgactcactatagggagttctcaagaacgggttcttgcttgatgaaacagaggagatcatcaatgaagaacccgaacctggcggcagcgcaaaagatg

SEQ ID NO: 157039 - DNA, 103 bp, Artificial Sequence
  Synthetic Polynucleotide
taatacgactcactatagggtcttggctgcagttctcaagaacgggttctaacagaggagaagaaccatgtcttgagaaaacctggcggcagcgcaaaagatg

SEQ ID NO: 157040 - DNA, 103 bp, Artificial Sequence
  Synthetic Polynucleotide
taatacgactcactatagggctgaaggaggtcttggctgcagttctcaagaacagaggagacttgagatgtgcagccaaaacctggcggcagcgcaaaagatg

SEQ ID NO: 157041 - DNA, 103 bp, Artificial Sequence
  Synthetic Polynucleotide
taatacgactcactatagggctgcatgatgctgaaggaggtcttggctgcaacagaggagagcagccatgacctccttcaacctggcggcagcgcaaaagatg

SEQ ID NO: 157042 - DNA, 103 bp, Artificial Sequence
  Synthetic Polynucleotide
taatacgactcactatagggcaggttaggtctgcatgatgctgaaggaggaacagaggagacctcctatggcatcatgcaacctggcggcagcgcaaaagatg

SEQ ID NO: 157043 - DNA, 103 bp, Artificial Sequence
  Synthetic Polynucleotide
taatacgactcactatagggggaggagcttatcggaggcttggaggccccaacagaggagaggggccatgaagcctccgaacctggcggcagcgcaaaagatg

SEQ ID NO: 157044 - DNA, 103 bp, Artificial Sequence
  Synthetic Polynucleotide
taatacgactcactatagggagttgttgtacaggttaggtctgcatgatgaacagaggagacatcatatggacctaaccaacctggcggcagcgcaaaagatg

SEQ ID NO: 157045 - DNA, 103 bp, Artificial Sequence
  Synthetic Polynucleotide
taatacgactcactatagggtgagatcgagagttgttgtacaggttaggtaacagaggagaacctaaatggtacaacaaaacctggcggcagcgcaaaagatg

SEQ ID NO: 157046 - DNA, 103 bp, Artificial Sequence
  Synthetic Polynucleotide
taatacgactcactataggggtgccatccgtgagatcgagagttgttgtaaacagaggagatacaacatgtctcgatctaacctggcggcagcgcaaaagatg

SEQ ID NO: 157047 - DNA, 103 bp, Artificial Sequence
  Synthetic Polynucleotide
taatacgactcactataggggaaggtgatggtgccatccgtgagatcgagaacagaggagactcgatatgacggatggcaacctggcggcagcgcaaaagatg

SEQ ID NO: 157048 - DNA, 103 bp, Artificial Sequence
  Synthetic Polynucleotide
taatacgactcactatagggggttgttgttgaaggtgatggtgccatccgaacagaggagacggatgatgccatcacctaacctggcggcagcgcaaaagatg

SEQ ID NO: 157049 - DNA, 103 bp, Artificial Sequence
  Synthetic Polynucleotide
taatacgactcactatagggccagttccgaggttgttgttgaaggtgatgaacagaggagacatcacatgcaacaacaaaacctggcggcagcgcaaaagatg

SEQ ID NO: 157050 - DNA, 103 bp, Artificial Sequence
  Synthetic Polynucleotide
taatacgactcactatagggggcctcagtcccagttccgaggttgttgttaacagaggagaaacaacatgctcggaactaacctggcggcagcgcaaaagatg

SEQ ID NO: 157051 - DNA, 103 bp, Artificial Sequence
  Synthetic Polynucleotide
taatacgactcactatagggaggcttggttggcctcagtcccagttccgaaacagaggagatcggaaatgggactgaggaacctggcggcagcgcaaaagatg

SEQ ID NO: 157052 - DNA, 103 bp, Artificial Sequence
  Synthetic Polynucleotide
taatacgactcactataggggggacactataggcttggttggcctcagtcaacagaggagagactgaatgcaaccaagcaacctggcggcagcgcaaaagatg

SEQ ID NO: 157053 - DNA, 103 bp, Artificial Sequence
  Synthetic Polynucleotide
taatacgactcactatagggcatttttgtggggacactataggcttggttaacagaggagaaaccaaatgtatagtgtcaacctggcggcagcgcaaaagatg

SEQ ID NO: 157054 - DNA, 103 bp, Artificial Sequence
  Synthetic Polynucleotide
taatacgactcactatagggatgtcatactggaggagcttatcggaggctaacagaggagaagcctcatgtaagctcctaacctggcggcagcgcaaaagatg

SEQ ID NO: 157055 - DNA, 103 bp, Artificial Sequence
  Synthetic Polynucleotide
taatacgactcactataggggtttggatcccatttttgtggggacactataacagaggagaatagtgatgccacaaaaaaacctggcggcagcgcaaaagatg

SEQ ID NO: 157056 - DNA, 103 bp, Artificial Sequence
  Synthetic Polynucleotide
taatacgactcactatagggatgtcttccagtttggatcccatttttgtgaacagaggagacacaaaatggggatccaaaacctggcggcagcgcaaaagatg

SEQ ID NO: 157057 - DNA, 103 bp, Artificial Sequence
  Synthetic Polynucleotide
taatacgactcactataggggtccatcaggatgtcttccagtttggatccaacagaggagaggatccatgctggaagacaacctggcggcagcgcaaaagatg

SEQ ID NO: 157058 - DNA, 103 bp, Artificial Sequence
  Synthetic Polynucleotide
taatacgactcactatagggaaagggtgtcgtccatcaggatgtcttccaaacagaggagatggaagatgtcctgatggaacctggcggcagcgcaaaagatg

SEQ ID NO: 157059 - DNA, 103 bp, Artificial Sequence
  Synthetic Polynucleotide
taatacgactcactatagggccgacgggagaaagggtgtcgtccatcaggaacagaggagacctgatatgcgacaccctaacctggcggcagcgcaaaagatg

SEQ ID NO: 157060 - DNA, 103 bp, Artificial Sequence
  Synthetic Polynucleotide
taatacgactcactatagggatcagtgacaccgacgggagaaagggtgtcaacagaggagagacaccatgtctcccgtcaacctggcggcagcgcaaaagatg

SEQ ID NO: 157061 - DNA, 103 bp, Artificial Sequence
  Synthetic Polynucleotide
taatacgactcactatagggaaaggagtggatcagtgacaccgacgggagaacagaggagactcccgatggtgtcactgaacctggcggcagcgcaaaagatg

SEQ ID NO: 157062 - DNA, 103 bp, Artificial Sequence
  Synthetic Polynucleotide
taatacgactcactataggggacactgaggaaaggagtggatcagtgacaaacagaggagatgtcacatgtccactcctaacctggcggcagcgcaaaagatg

SEQ ID NO: 157063 - DNA, 103 bp, Artificial Sequence
  Synthetic Polynucleotide
taatacgactcactatagggagctccgggggacactgaggaaaggagtggaacagaggagaccactcatgtcctcagtgaacctggcggcagcgcaaaagatg

SEQ ID NO: 157064 - DNA, 103 bp, Artificial Sequence
  Synthetic Polynucleotide
taatacgactcactatagggttgttttggaagctccgggggacactgaggaacagaggagacctcagatgcccccggagaacctggcggcagcgcaaaagatg

SEQ ID NO: 157065 - DNA, 103 bp, Artificial Sequence
  Synthetic Polynucleotide
taatacgactcactatagggaagatgcgtgatgtcatactggaggagcttaacagaggagaaagctcatgcagtatgacaacctggcggcagcgcaaaagatg

SEQ ID NO: 157066 - DNA, 103 bp, Artificial Sequence
  Synthetic Polynucleotide
taatacgactcactatagggctccggctgcttgttttggaagctccggggaacagaggagaccccggatgttccaaaacaacctggcggcagcgcaaaagatg

SEQ ID NO: 157067 - DNA, 103 bp, Artificial Sequence
  Synthetic Polynucleotide
taatacgactcactatagggcatactgctcctccggctgcttgttttggaaacagaggagatccaaaatgagcagccggaacctggcggcagcgcaaaagatg

SEQ ID NO: 157068 - DNA, 103 bp, Artificial Sequence
  Synthetic Polynucleotide
taatacgactcactatagggcttccatgctcatactgctcctccggctgcaacagaggagagcagccatgggagcagtaaacctggcggcagcgcaaaagatg

SEQ ID NO: 157069 - DNA, 103 bp, Artificial Sequence
  Synthetic Polynucleotide
taatacgactcactatagggtgctccgtctcttccatgctcatactgctcaacagaggagagagcagatggagcatggaaacctggcggcagcgcaaaagatg

SEQ ID NO: 157070 - DNA, 103 bp, Artificial Sequence
  Synthetic Polynucleotide
taatacgactcactatagggctaacaagtgtgctccgtctcttccatgctaacagaggagaagcatgatggagacggagaacctggcggcagcgcaaaagatg

SEQ ID NO: 157071 - DNA, 103 bp, Artificial Sequence
  Synthetic Polynucleotide
taatacgactcactatagggctggcgtagcaagatgcgtgatgtcatactaacagaggagaagtatgatgtcacgcatcaacctggcggcagcgcaaaagatg

SEQ ID NO: 157072 - DNA, 103 bp, Artificial Sequence
  Synthetic Polynucleotide
taatacgactcactataggggcatgagttgctggcgtagcaagatgcgtgaacagaggagacacgcaatgtgctacgccaacctggcggcagcgcaaaagatg

SEQ ID NO: 157073 - DNA, 103 bp, Artificial Sequence
  Synthetic Polynucleotide
taatacgactcactatagggatctgctcacgcatgagttgctggcgtagcaacagaggagagctacgatggcaactcataacctggcggcagcgcaaaagatg

SEQ ID NO: 157074 - DNA, 103 bp, Artificial Sequence
  Synthetic Polynucleotide
taatacgactcactatagggctgctcctgcatctgctcacgcatgagttgaacagaggagacaactcatgcgtgagcagaacctggcggcagcgcaaaagatg

SEQ ID NO: 157075 - DNA, 103 bp, Artificial Sequence
  Synthetic Polynucleotide
taatacgactcactatagggctcgtgggaaaaccactgaagtattttcaaaacagaggagattgaaaatgcttcagtggaacctggcggcagcgcaaaagatg

SEQ ID NO: 157076 - DNA, 103 bp, Artificial Sequence
  Synthetic Polynucleotide
taatacgactcactatagggccctgcgctcctgctcctgcatctgctcacaacagaggagagtgagcatgtgcaggagcaacctggcggcagcgcaaaagatg

SEQ ID NO: 157077 - DNA, 103 bp, Artificial Sequence
  Synthetic Polynucleotide
taatacgactcactatagggtgctgctgctccctgcgctcctgctcctgcaacagaggagagcaggaatgggagcgcagaacctggcggcagcgcaaaagatg

SEQ ID NO: 157078 - DNA, 103 bp, Artificial Sequence
  Synthetic Polynucleotide
taatacgactcactatagggctgcagcttctgctgctgctccctgcgctcaacagaggagagagcgcatggagcagcagaacctggcggcagcgcaaaagatg

SEQ ID NO: 157079 - DNA, 103 bp, Artificial Sequence
  Synthetic Polynucleotide
taatacgactcactatagggactgggccgcctgcagcttctgctgctgctaacagaggagaagcagcatgagaagctgcaacctggcggcagcgcaaaagatg

SEQ ID NO: 157080 - DNA, 103 bp, Artificial Sequence
  Synthetic Polynucleotide
taatacgactcactatagggtgttgcatgaactgggccgcctgcagcttcaacagaggagagaagctatgggcggcccaaacctggcggcagcgcaaaagatg

SEQ ID NO: 157081 - DNA, 103 bp, Artificial Sequence
  Synthetic Polynucleotide
taatacgactcactataggggggcactctctgttgcatgaactgggccgcaacagaggagagcggccatgttcatgcaaaacctggcggcagcgcaaaagatg

SEQ ID NO: 157082 - DNA, 103 bp, Artificial Sequence
  Synthetic Polynucleotide
taatacgactcactatagggtctgactcacgggcactctctgttgcatgaaacagaggagatcatgcatgagagagtgcaacctggcggcagcgcaaaagatg

SEQ ID NO: 157083 - DNA, 103 bp, Artificial Sequence
  Synthetic Polynucleotide
taatacgactcactatagggatggctggtgtctgactcacgggcactctcaacagaggagagagagtatgcgtgagtcaaacctggcggcagcgcaaaagatg

SEQ ID NO: 157084 - DNA, 103 bp, Artificial Sequence
  Synthetic Polynucleotide
taatacgactcactatagggactgacgtttatggctggtgtctgactcacaacagaggagagtgagtatgacaccagccaacctggcggcagcgcaaaagatg

SEQ ID NO: 157085 - DNA, 103 bp, Artificial Sequence
  Synthetic Polynucleotide
taatacgactcactatagggtggtgggcacactgacgtttatggctggtgaacagaggagacaccagatgtaaacgtcaaacctggcggcagcgcaaaagatg

SEQ ID NO: 157086 - DNA, 103 bp, Artificial Sequence
  Synthetic Polynucleotide
taatacgactcactataggggagaaaatagctcgtgggaaaaccactgaaaacagaggagattcagtatgtttcccacgaacctggcggcagcgcaaaagatg

SEQ ID NO: 157087 - DNA, 103 bp, Artificial Sequence
  Synthetic Polynucleotide
taatacgactcactataggggagggaagggtggtgggcacactgacgtttaacagaggagaaaacgtatgtgtgcccacaacctggcggcagcgcaaaagatg

SEQ ID NO: 157088 - DNA, 103 bp, Artificial Sequence
  Synthetic Polynucleotide
taatacgactcactatagggctgcgtggcagagggaagggtggtgggcacaacagaggagagtgcccatgacccttcccaacctggcggcagcgcaaaagatg

SEQ ID NO: 157089 - DNA, 103 bp, Artificial Sequence
  Synthetic Polynucleotide
taatacgactcactatagggccatcggcacctgcgtggcagagggaagggaacagaggagacccttcatgctgccacgcaacctggcggcagcgcaaaagatg

SEQ ID NO: 157090 - DNA, 103 bp, Artificial Sequence
  Synthetic Polynucleotide
taatacgactcactatagggttaaggacttccatcggcacctgcgtggcaaacagaggagatgccacatgggtgccgataacctggcggcagcgcaaaagatg

SEQ ID NO: 157091 - DNA, 103 bp, Artificial Sequence
  Synthetic Polynucleotide
taatacgactcactatagggggtctgcaccttaaggacttccatcggcacaacagaggagagtgccgatggaagtccttaacctggcggcagcgcaaaagatg

SEQ ID NO: 157092 - DNA, 103 bp, Artificial Sequence
  Synthetic Polynucleotide
taatacgactcactatagggtttcgaggtgggtctgcaccttaaggacttaacagaggagaaagtccatgaggtgcagaaacctggcggcagcgcaaaagatg

SEQ ID NO: 157093 - DNA, 103 bp, Artificial Sequence
  Synthetic Polynucleotide
taatacgactcactatagggttggtggggttttcgaggtgggtctgcaccaacagaggagaggtgcaatgccacctcgaaacctggcggcagcgcaaaagatg

SEQ ID NO: 157094 - DNA, 103 bp, Artificial Sequence
  Synthetic Polynucleotide
taatacgactcactatagggtatgtggtacttggtggggttttcgaggtgaacagaggagacacctcatgaaccccaccaacctggcggcagcgcaaaagatg

SEQ ID NO: 157095 - DNA, 103 bp, Artificial Sequence
  Synthetic Polynucleotide
taatacgactcactataggggggcttgctgtatgtggtacttggtggggtaacagaggagaaccccaatgagtaccacaaacctggcggcagcgcaaaagatg

SEQ ID NO: 157096 - DNA, 103 bp, Artificial Sequence
  Synthetic Polynucleotide
taatacgactcactatagggtgctgccgttgggcttgctgtatgtggtacaacagaggagagtaccaatgacagcaagcaacctggcggcagcgcaaaagatg

SEQ ID NO: 157097 - DNA, 103 bp, Artificial Sequence
  Synthetic Polynucleotide
taatacgactcactatagggttcacagagagagaaaatagctcgtgggaaaacagaggagattcccaatggctattttcaacctggcggcagcgcaaaagatg

SEQ ID NO: 157098 - DNA, 103 bp, Artificial Sequence
  Synthetic Polynucleotide
taatacgactcactatagggctgctttacctgctgccgttgggcttgctgaacagaggagacagcaaatgcaacggcagaacctggcggcagcgcaaaagatg

SEQ ID NO: 157099 - DNA, 103 bp, Artificial Sequence
  Synthetic Polynucleotide
taatacgactcactatagggtagaaaggtactgctttacctgctgccgttaacagaggagaaacggcatgaggtaaagcaacctggcggcagcgcaaaagatg

SEQ ID NO: 157100 - DNA, 103 bp, Artificial Sequence
  Synthetic Polynucleotide
taatacgactcactataggggctaaagtggtagaaaggtactgctttaccaacagaggagaggtaaaatggtacctttcaacctggcggcagcgcaaaagatg

SEQ ID NO: 157101 - DNA, 103 bp, Artificial Sequence
  Synthetic Polynucleotide
taatacgactcactatagggatgtttatttgctaaagtggtagaaaggtaaacagaggagataccttatgaccactttaaacctggcggcagcgcaaaagatg

SEQ ID NO: 157102 - DNA, 103 bp, Artificial Sequence
  Synthetic Polynucleotide
taatacgactcactatagggcttggttggcatgtttatttgctaaagtggaacagaggagaccacttatgcaaataaacaacctggcggcagcgcaaaagatg

SEQ ID NO: 157103 - DNA, 103 bp, Artificial Sequence
  Synthetic Polynucleotide
taatacgactcactatagggaagctcaggacttggttggcatgtttatttaacagaggagaaaataaatgtgccaaccaaacctggcggcagcgcaaaagatg

SEQ ID NO: 157104 - DNA, 103 bp, Artificial Sequence
  Synthetic Polynucleotide
taatacgactcactatagggtggacatggcaagctcaggacttggttggcaacagaggagagccaacatggtcctgagcaacctggcggcagcgcaaaagatg

SEQ ID NO: 157105 - DNA, 103 bp, Artificial Sequence
  Synthetic Polynucleotide
taatacgactcactatagggcaggctggtttggacatggcaagctcaggaaacagaggagatcctgaatgtgccatgtcaacctggcggcagcgcaaaagatg

SEQ ID NO: 157106 - DNA, 103 bp, Artificial Sequence
  Synthetic Polynucleotide
taatacgactcactatagggacatgatcgccaggctggtttggacatggcaacagaggagagccatgatgaaaccagccaacctggcggcagcgcaaaagatg

SEQ ID NO: 157107 - DNA, 103 bp, Artificial Sequence
  Synthetic Polynucleotide
taatacgactcactatagggcggtggcatgacatgatcgccaggctggttaacagaggagaaaccagatgggcgatcataacctggcggcagcgcaaaagatg

SEQ ID NO: 157108 - DNA, 103 bp, Artificial Sequence
  Synthetic Polynucleotide
taatacgactcactatagggtggtttccttttcacagagagagaaaatagaacagaggagactatttatgctctctgtgaacctggcggcagcgcaaaagatg

SEQ ID NO: 157109 - DNA, 103 bp, Artificial Sequence
  Synthetic Polynucleotide
taatacgactcactatagggtccccggcaccggtggcatgacatgatcgcaacagaggagagcgatcatgtcatgccacaacctggcggcagcgcaaaagatg

SEQ ID NO: 157110 - DNA, 103 bp, Artificial Sequence
  Synthetic Polynucleotide
taatacgactcactatagggggtgcgctgctccccggcaccggtggcatgaacagaggagacatgccatgggtgccgggaacctggcggcagcgcaaaagatg

SEQ ID NO: 157111 - DNA, 103 bp, Artificial Sequence
  Synthetic Polynucleotide
taatacgactcactatagggggggctgttgggtgcgctgctccccggcacaacagaggagagtgccgatgagcagcgcaaacctggcggcagcgcaaaagatg

SEQ ID NO: 157112 - DNA, 103 bp, Artificial Sequence
  Synthetic Polynucleotide
taatacgactcactataggggcatagccatggggctgttgggtgcgctgcaacagaggagagcagcgatgccaacagccaacctggcggcagcgcaaaagatg

SEQ ID NO: 157113 - DNA, 103 bp, Artificial Sequence
  Synthetic Polynucleotide
taatacgactcactatagggttaagcgtaagcatagccatggggctgttgaacagaggagacaacagatgcatggctataacctggcggcagcgcaaaagatg

SEQ ID NO: 157114 - DNA, 103 bp, Artificial Sequence
  Synthetic Polynucleotide
taatacgactcactatagggacagttggagttaagcgtaagcatagccataacagaggagaatggctatgcttacgcttaacctggcggcagcgcaaaagatg

SEQ ID NO: 157115 - DNA, 103 bp, Artificial Sequence
  Synthetic Polynucleotide
taatacgactcactatagggcctctttttcacagttggagttaagcgtaaaacagaggagattacgcatgactccaactaacctggcggcagcgcaaaagatg

SEQ ID NO: 157116 - DNA, 103 bp, Artificial Sequence
  Synthetic Polynucleotide
taatacgactcactatagggttataaaatccctctttttcacagttggagaacagaggagactccaaatgtgaaaaagaaacctggcggcagcgcaaaagatg

SEQ ID NO: 157117 - DNA, 103 bp, Artificial Sequence
  Synthetic Polynucleotide
taatacgactcactatagggctcttcaaacttataaaatccctctttttcaacagaggagagaaaaaatgggattttataacctggcggcagcgcaaaagatg

SEQ ID NO: 157118 - DNA, 103 bp, Artificial Sequence
  Synthetic Polynucleotide
taatacgactcactatagggccctgttttgctcttcaaacttataaaatcaacagaggagagattttatgagtttgaagaacctggcggcagcgcaaaagatg

SEQ ID NO: 157119 - DNA, 103 bp, Artificial Sequence
  Synthetic Polynucleotide
taatacgactcactataggggtcaatttcctggtttccttttcacagagaaacagaggagatctctgatgaaaggaaacaacctggcggcagcgcaaaagatg

SEQ ID NO: 157120 - DNA, 103 bp, Artificial Sequence
  Synthetic Polynucleotide
taatacgactcactatagggtcgctctctgccctgttttgctcttcaaacaacagaggagagtttgaatggcaaaacagaacctggcggcagcgcaaaagatg

SEQ ID NO: 157121 - DNA, 103 bp, Artificial Sequence
  Synthetic Polynucleotide
taatacgactcactataggggcctgggcactcgctctctgccctgttttgaacagaggagacaaaacatggcagagagcaacctggcggcagcgcaaaagatg

SEQ ID NO: 157122 - DNA, 103 bp, Artificial Sequence
  Synthetic Polynucleotide
taatacgactcactataggggtgtgttcatgcctgggcactcgctctctgaacagaggagacagagaatgagtgcccagaacctggcggcagcgcaaaagatg

SEQ ID NO: 157123 - DNA, 103 bp, Artificial Sequence
  Synthetic Polynucleotide
taatacgactcactataggggctcgtgaatgtgtgttcatgcctgggcacaacagaggagagtgcccatgcatgaacacaacctggcggcagcgcaaaagatg

SEQ ID NO: 157124 - DNA, 103 bp, Artificial Sequence
  Synthetic Polynucleotide
taatacgactcactatagggcatacaggacgctcgtgaatgtgtgttcataacagaggagaatgaacatgcattcacgaaacctggcggcagcgcaaaagatg

SEQ ID NO: 157125 - DNA, 103 bp, Artificial Sequence
  Synthetic Polynucleotide
taatacgactcactatagggcatccatctgcatacaggacgctcgtgaataacagaggagaattcacatgcgtcctgtaaacctggcggcagcgcaaaagatg

SEQ ID NO: 157126 - DNA, 103 bp, Artificial Sequence
  Synthetic Polynucleotide
taatacgactcactatagggtcgattacatcatccatctgcatacaggacaacagaggagagtcctgatggcagatggaaacctggcggcagcgcaaaagatg

SEQ ID NO: 157127 - DNA, 103 bp, Artificial Sequence
  Synthetic Polynucleotide
taatacgactcactatagggaatgatgtcatcgattacatcatccatctgaacagaggagacagatgatggatgtaatcaacctggcggcagcgcaaaagatg

SEQ ID NO: 157128 - DNA, 103 bp, Artificial Sequence
  Synthetic Polynucleotide
taatacgactcactatagggattctaggctaatgatgtcatcgattacataacagaggagaatgtaaatgatgacatcaaacctggcggcagcgcaaaagatg

SEQ ID NO: 157129 - DNA, 103 bp, Artificial Sequence
  Synthetic Polynucleotide
taatacgactcactatagggttataacttgattctaggctaatgatgtcaaacagaggagatgacatatgtagcctagaaacctggcggcagcgcaaaagatg

SEQ ID NO: 157130 - DNA, 103 bp, Artificial Sequence
  Synthetic Polynucleotide
taatacgactcactatagggcaggcacagagtcaatttcctggtttccttaacagaggagaaaggaaatgaggaaattgaacctggcggcagcgcaaaagatg

SEQ ID NO: 157131 - DNA, 103 bp, Artificial Sequence
  Synthetic Polynucleotide
taatacgactcactataggggatttcctcattataacttgattctaggctaacagaggagaagcctaatgtcaagttataacctggcggcagcgcaaaagatg

SEQ ID NO: 157132 - DNA, 103 bp, Artificial Sequence
  Synthetic Polynucleotide
taatacgactcactatagggtcaagcccaagatttcctcattataacttgaacagaggagacaagttatgatgaggaaaaacctggcggcagcgcaaaagatg

SEQ ID NO: 157133 - DNA, 103 bp, Artificial Sequence
  Synthetic Polynucleotide
taatacgactcactataggggcaggatccatcaagcccaagatttcctcaaacagaggagatgaggaatgcttgggcttaacctggcggcagcgcaaaagatg

SEQ ID NO: 157134 - DNA, 103 bp, Artificial Sequence
  Synthetic Polynucleotide
taatacgactcactatagggcatttgcaaagcaggatccatcaagcccaaaacagaggagattgggcatgatggatcctaacctggcggcagcgcaaaagatg

SEQ ID NO: 157135 - DNA, 103 bp, Artificial Sequence
  Synthetic Polynucleotide
taatacgactcactatagggacgtatttgccatttgcaaagcaggatccaaacagaggagatggatcatgctttgcaaaaacctggcggcagcgcaaaagatg

SEQ ID NO: 157136 - DNA, 103 bp, Artificial Sequence
  Synthetic Polynucleotide
taatacgactcactataggggagacaggcaacgtatttgccatttgcaaaaacagaggagatttgcaatgggcaaatacaacctggcggcagcgcaaaagatg

SEQ ID NO: 157137 - DNA, 103 bp, Artificial Sequence
  Synthetic Polynucleotide
taatacgactcactatagggcaagtttcccgagacaggcaacgtatttgcaacagaggagagcaaatatgttgcctgtcaacctggcggcagcgcaaaagatg

SEQ ID NO: 157138 - DNA, 103 bp, Artificial Sequence
  Synthetic Polynucleotide
taatacgactcactatagggaaagatcaatcaagtttcccgagacaggcaaacagaggagatgcctgatgcgggaaactaacctggcggcagcgcaaaagatg

SEQ ID NO: 157139 - DNA, 103 bp, Artificial Sequence
  Synthetic Polynucleotide
taatacgactcactatagggtggtttccataaagatcaatcaagtttcccaacagaggagagggaaaatggattgatctaacctggcggcagcgcaaaagatg

SEQ ID NO: 157140 - DNA, 103 bp, Artificial Sequence
  Synthetic Polynucleotide
taatacgactcactataggggggcagaccttggtttccataaagatcaataacagaggagaattgatatgtatggaaacaacctggcggcagcgcaaaagatg

SEQ ID NO: 157141 - DNA, 103 bp, Artificial Sequence
  Synthetic Polynucleotide
taatacgactcactatagggttcttgaaaacaggcacagagtcaatttccaacagaggagaggaaatatgctctgtgccaacctggcggcagcgcaaaagatg

SEQ ID NO: 157142 - DNA, 103 bp, Artificial Sequence
  Synthetic Polynucleotide
taatacgactcactatagggggcctggtgggggcagaccttggtttccataacagaggagaatggaaatgaaggtctgcaacctggcggcagcgcaaaagatg

SEQ ID NO: 157143 - DNA, 103 bp, Artificial Sequence
  Synthetic Polynucleotide
taatacgactcactatagggctgatggtgaggcctggtgggggcagacctaacagaggagaaggtctatgcccaccaggaacctggcggcagcgcaaaagatg

SEQ ID NO: 157144 - DNA, 103 bp, Artificial Sequence
  Synthetic Polynucleotide
taatacgactcactatagggacaggagttgctgatggtgaggcctggtggaacagaggagaccaccaatgctcaccatcaacctggcggcagcgcaaaagatg

SEQ ID NO: 157145 - DNA, 103 bp, Artificial Sequence
  Synthetic Polynucleotide
taatacgactcactatagggggttggctggacaggagttgctgatggtgaaacagaggagatcaccaatggcaactcctaacctggcggcagcgcaaaagatg

SEQ ID NO: 157146 - DNA, 103 bp, Artificial Sequence
  Synthetic Polynucleotide
taatacgactcactatagggatgttgggaaggttggctggacaggagttgaacagaggagacaactcatgtccagccaaaacctggcggcagcgcaaaagatg

SEQ ID NO: 157147 - DNA, 103 bp, Artificial Sequence
  Synthetic Polynucleotide
taatacgactcactatagggctccctttttatgttgggaaggttggctggaacagaggagaccagccatgcttcccaacaacctggcggcagcgcaaaagatg

SEQ ID NO: 157148 - DNA, 103 bp, Artificial Sequence
  Synthetic Polynucleotide
taatacgactcactatagggactctgtgagctccctttttatgttgggaaaacagaggagattcccaatgtaaaaagggaacctggcggcagcgcaaaagatg

SEQ ID NO: 157149 - DNA, 103 bp, Artificial Sequence
  Synthetic Polynucleotide
taatacgactcactatagggcttgcttcagactctgtgagctccctttttaacagaggagaaaaaagatggctcacagaaacctggcggcagcgcaaaagatg

SEQ ID NO: 157150 - DNA, 103 bp, Artificial Sequence
  Synthetic Polynucleotide
taatacgactcactatagggggccagtgctcttgcttcagactctgtgagaacagaggagactcacaatgtctgaagcaaacctggcggcagcgcaaaagatg

SEQ ID NO: 157151 - DNA, 103 bp, Artificial Sequence
  Synthetic Polynucleotide
taatacgactcactataggggcctctctttggccagtgctcttgcttcagaacagaggagactgaagatggagcactggaacctggcggcagcgcaaaagatg

SEQ ID NO: 157152 - DNA, 103 bp, Artificial Sequence
  Synthetic Polynucleotide
taatacgactcactataggggcggaactgcttcttgaaaacaggcacagaaacagaggagatctgtgatggttttcaagaacctggcggcagcgcaaaagatg

SEQ ID NO: 157153 - DNA, 103 bp, Artificial Sequence
  Synthetic Polynucleotide
taatacgactcactatagggtcctttttctgcctctctttggccagtgctaacagaggagaagcactatgcaaagagagaacctggcggcagcgcaaaagatg

SEQ ID NO: 157154 - DNA, 103 bp, Artificial Sequence
  Synthetic Polynucleotide
taatacgactcactataggggttgtgattgtcctttttctgcctctctttaacagaggagaaaagagatgcagaaaaagaacctggcggcagcgcaaaagatg

SEQ ID NO: 157155 - DNA, 103 bp, Artificial Sequence
  Synthetic Polynucleotide
taatacgactcactataggggttcaatcaggttgtgattgtcctttttctaacagaggagaagaaaaatgacaatcacaaacctggcggcagcgcaaaagatg

SEQ ID NO: 157156 - DNA, 103 bp, Artificial Sequence
  Synthetic Polynucleotide
taatacgactcactatagggcttcttcttcgttcaatcaggttgtgattgaacagaggagacaatcaatgcctgattgaaacctggcggcagcgcaaaagatg

SEQ ID NO: 157157 - DNA, 103 bp, Artificial Sequence
  Synthetic Polynucleotide
taatacgactcactatagggtatgttaaatcttcttcttcgttcaatcagaacagaggagactgattatgcgaagaagaaacctggcggcagcgcaaaagatg

SEQ ID NO: 157158 - DNA, 103 bp, Artificial Sequence
  Synthetic Polynucleotide
taatacgactcactatagggtgcggtcatttatgttaaatcttcttcttcaacagaggagagaagaaatggatttaacaaacctggcggcagcgcaaaagatg

SEQ ID NO: 157159 - DNA, 103 bp, Artificial Sequence
  Synthetic Polynucleotide
taatacgactcactatagggagttctttaatgcggtcatttatgttaaataacagaggagaatttaaatgaaatgaccgaacctggcggcagcgcaaaagatg

SEQ ID NO: 157160 - DNA, 103 bp, Artificial Sequence
  Synthetic Polynucleotide
taatacgactcactatagggcaaagtacctagttctttaatgcggtcattaacagaggagaaatgacatgattaaagaaaacctggcggcagcgcaaaagatg

SEQ ID NO: 157161 - DNA, 103 bp, Artificial Sequence
  Synthetic Polynucleotide
taatacgactcactatagggacttgggaatcaaagtacctagttctttaaaacagaggagattaaagatgtaggtacttaacctggcggcagcgcaaaagatg

SEQ ID NO: 157162 - DNA, 103 bp, Artificial Sequence
  Synthetic Polynucleotide
taatacgactcactatagggggatcatttgacttgggaatcaaagtacctaacagaggagaaggtacatggattcccaaaacctggcggcagcgcaaaagatg

SEQ ID NO: 157163 - DNA, 103 bp, Artificial Sequence
  Synthetic Polynucleotide
taatacgactcactatagggctggagcgcacgggactcggctgtggccataacagaggagaatggccatggccgagtccaacctggcggcagcgcaaaagatg

SEQ ID NO: 157164 - DNA, 103 bp, Artificial Sequence
  Synthetic Polynucleotide
taatacgactcactataggggagcagggctgccgcagggctcgggggcggaacagaggagaccgcccatgagccctgcgaacctggcggcagcgcaaaagatg

SEQ ID NO: 157165 - DNA, 103 bp, Artificial Sequence
  Synthetic Polynucleotide
taatacgactcactataggggcggcgcagggagcagggctgccgcagggcaacagaggagagccctgatgcagccctgcaacctggcggcagcgcaaaagatg

SEQ ID NO: 157166 - DNA, 103 bp, Artificial Sequence
  Synthetic Polynucleotide
taatacgactcactataggggggcccgcgggcggcgcagggagcagggctaacagaggagaagccctatgccctgcgccaacctggcggcagcgcaaaagatg

SEQ ID NO: 157167 - DNA, 103 bp, Artificial Sequence
  Synthetic Polynucleotide
taatacgactcactatagggcgctgggccggggcccgcgggcggcgcaggaacagaggagacctgcgatgcccgcgggcaacctggcggcagcgcaaaagatg

SEQ ID NO: 157168 - DNA, 103 bp, Artificial Sequence
  Synthetic Polynucleotide
taatacgactcactatagggccgcaaaggtcgctgggccggggcccgcggaacagaggagaccgcggatgccggcccagaacctggcggcagcgcaaaagatg

SEQ ID NO: 157169 - DNA, 103 bp, Artificial Sequence
  Synthetic Polynucleotide
taatacgactcactatagggccgaggaagcccgcaaaggtcgctgggccgaacagaggagacggcccatggacctttgcaacctggcggcagcgcaaaagatg

SEQ ID NO: 157170 - DNA, 103 bp, Artificial Sequence
  Synthetic Polynucleotide
taatacgactcactatagggggggtcccggccgaggaagcccgcaaaggtaacagaggagaacctttatgggcttcctcaacctggcggcagcgcaaaagatg

SEQ ID NO: 157171 - DNA, 103 bp, Artificial Sequence
  Synthetic Polynucleotide
taatacgactcactataggggggccggcccggggtcccggccgaggaagcaacagaggagagcttccatggccgggaccaacctggcggcagcgcaaaagatg

SEQ ID NO: 157172 - DNA, 103 bp, Artificial Sequence
  Synthetic Polynucleotide
taatacgactcactataggggggggcggcggggccggcccggggtcccggaacagaggagaccgggaatgcgggccggcaacctggcggcagcgcaaaagatg

SEQ ID NO: 157173 - DNA, 103 bp, Artificial Sequence
  Synthetic Polynucleotide
taatacgactcactatagggcaggctggcggggggcggcggggccggcccaacagaggagagggccgatgccgccgcccaacctggcggcagcgcaaaagatg

SEQ ID NO: 157174 - DNA, 103 bp, Artificial Sequence
  Synthetic Polynucleotide
taatacgactcactatagggcctcggcaaactggagcgcacgggactcggaacagaggagaccgagtatggtgcgctccaacctggcggcagcgcaaaagatg

SEQ ID NO: 157175 - DNA, 103 bp, Artificial Sequence
  Synthetic Polynucleotide
taatacgactcactatagggcaggcgagcccaggctggcggggggcggcgaacagaggagacgccgcatgccgccagccaacctggcggcagcgcaaaagatg

SEQ ID NO: 157176 - DNA, 103 bp, Artificial Sequence
  Synthetic Polynucleotide
taatacgactcactatagggttggggggcgcaggcgagcccaggctggcgaacagaggagacgccagatggggctcgccaacctggcggcagcgcaaaagatg

SEQ ID NO: 157177 - DNA, 103 bp, Artificial Sequence
  Synthetic Polynucleotide
taatacgactcactatagggggccgcgcctttggggggcgcaggcgagccaacagaggagaggctcgatggcgccccccaacctggcggcagcgcaaaagatg

SEQ ID NO: 157178 - DNA, 103 bp, Artificial Sequence
  Synthetic Polynucleotide
taatacgactcactatagggccgacggggcggccgcgcctttggggggcgaacagaggagacgccccatgaaggcgcggaacctggcggcagcgcaaaagatg

SEQ ID NO: 157179 - DNA, 103 bp, Artificial Sequence
  Synthetic Polynucleotide
taatacgactcactatagggcgctgcgacgccgacggggcggccgcgcctaacagaggagaaggcgcatgcgccccgtcaacctggcggcagcgcaaaagatg

SEQ ID NO: 157180 - DNA, 103 bp, Artificial Sequence
  Synthetic Polynucleotide
taatacgactcactataggggcgcttgcggcgctgcgacgccgacggggcaacagaggagagccccgatggcgtcgcagaacctggcggcagcgcaaaagatg

SEQ ID NO: 157181 - DNA, 103 bp, Artificial Sequence
  Synthetic Polynucleotide
taatacgactcactatagggtgaaagacgtgcgcttgcggcgctgcgacgaacagaggagacgtcgcatggccgcaagcaacctggcggcagcgcaaaagatg

SEQ ID NO: 157182 - DNA, 103 bp, Artificial Sequence
  Synthetic Polynucleotide
taatacgactcactatagggtgttcggcgctgaaagacgtgcgcttgcggaacagaggagaccgcaaatgcacgtctttaacctggcggcagcgcaaaagatg

SEQ ID NO: 157183 - DNA, 103 bp, Artificial Sequence
  Synthetic Polynucleotide
taatacgactcactatagggcagctgcagctgttcggcgctgaaagacgtaacagaggagaacgtctatgagcgccgaaaacctggcggcagcgcaaaagatg

SEQ ID NO: 157184 - DNA, 103 bp, Artificial Sequence
  Synthetic Polynucleotide
taatacgactcactatagggcgagctccagcagctgcagctgttcggcgcaacagaggagagcgccgatgagctgcagcaacctggcggcagcgcaaaagatg

SEQ ID NO: 157185 - DNA, 103 bp, Artificial Sequence
  Synthetic Polynucleotide
taatacgactcactatagggaacgcggcgccctcggcaaactggagcgcaaacagaggagatgcgctatggtttgccgaaacctggcggcagcgcaaaagatg

SEQ ID NO: 157186 - DNA, 103 bp, Artificial Sequence
  Synthetic Polynucleotide
taatacgactcactatagggcggcggaagacgagctccagcagctgcagcaacagaggagagctgcaatggctggagctaacctggcggcagcgcaaaagatg

SEQ ID NO: 157187 - DNA, 103 bp, Artificial Sequence
  Synthetic Polynucleotide
taatacgactcactataggggtaccgggtccggcggaagacgagctccagaacagaggagactggagatggtcttccgcaacctggcggcagcgcaaaagatg

SEQ ID NO: 157188 - DNA, 103 bp, Artificial Sequence
  Synthetic Polynucleotide
taatacgactcactatagggggatgtcggggtaccgggtccggcggaagaaacagaggagatcttccatgggacccggtaacctggcggcagcgcaaaagatg

SEQ ID NO: 157189 - DNA, 103 bp, Artificial Sequence
  Synthetic Polynucleotide
taatacgactcactatagggtcgcgcaagtggatgtcggggtaccgggtcaacagaggagagacccgatgccccgacataacctggcggcagcgcaaaagatg

SEQ ID NO: 157190 - DNA, 103 bp, Artificial Sequence
  Synthetic Polynucleotide
taatacgactcactatagggggccaggcgctcgcgcaagtggatgtcgggaacagaggagacccgacatgcacttgcgcaacctggcggcagcgcaaaagatg

SEQ ID NO: 157191 - DNA, 103 bp, Artificial Sequence
  Synthetic Polynucleotide
taatacgactcactataggggggtgagcgcggccaggcgctcgcgcaagtaacagaggagaacttgcatgagcgcctggaacctggcggcagcgcaaaagatg

SEQ ID NO: 157192 - DNA, 103 bp, Artificial Sequence
  Synthetic Polynucleotide
taatacgactcactatagggtcggggagcagggtgagcgcggccaggcgcaacagaggagagcgcctatgcgcgctcacaacctggcggcagcgcaaaagatg

SEQ ID NO: 157193 - DNA, 103 bp, Artificial Sequence
  Synthetic Polynucleotide
taatacgactcactataggggatcctggactcggggagcagggtgagcgcaacagaggagagcgctcatgctgctccccaacctggcggcagcgcaaaagatg

SEQ ID NO: 157194 - DNA, 103 bp, Artificial Sequence
  Synthetic Polynucleotide
taatacgactcactatagggaccatacctggatcctggactcggggagcaaacagaggagatgctccatgagtccaggaaacctggcggcagcgcaaaagatg

SEQ ID NO: 157195 - DNA, 103 bp, Artificial Sequence
  Synthetic Polynucleotide
taatacgactcactatagggctgttctggaaccatacctggatcctggacaacagaggagagtccagatgccaggtatgaacctggcggcagcgcaaaagatg

SEQ ID NO: 157196 - DNA, 103 bp, Artificial Sequence
  Synthetic Polynucleotide
taatacgactcactataggggtacgctggaaacgcggcgccctcggcaaaaacagaggagatttgccatgggcgccgcgaacctggcggcagcgcaaaagatg

SEQ ID NO: 157197 - DNA, 103 bp, Artificial Sequence
  Synthetic Polynucleotide
taatacgactcactatagggcttggcacgcctgttctggaaccatacctgaacagaggagacaggtaatgttccagaacaacctggcggcagcgcaaaagatg

SEQ ID NO: 157198 - DNA, 103 bp, Artificial Sequence
  Synthetic Polynucleotide
taatacgactcactataggggacgccgagacttggcacgcctgttctggaaacagaggagatccagaatgggcgtgccaaacctggcggcagcgcaaaagatg

SEQ ID NO: 157199 - DNA, 103 bp, Artificial Sequence
  Synthetic Polynucleotide
taatacgactcactatagggttcccactctgacgccgagacttggcacgcaacagaggagagcgtgcatggtctcggcgaacctggcggcagcgcaaaagatg

SEQ ID NO: 157200 - DNA, 103 bp, Artificial Sequence
  Synthetic Polynucleotide
taatacgactcactatagggttggaaggatttcccactctgacgccgagaaacagaggagatctcggatgcagagtgggaacctggcggcagcgcaaaagatg

SEQ ID NO: 157201 - DNA, 103 bp, Artificial Sequence
  Synthetic Polynucleotide
taatacgactcactatagggtagccaaaggttggaaggatttcccactctaacagaggagaagagtgatgaatccttccaacctggcggcagcgcaaaagatg

SEQ ID NO: 157202 - DNA, 103 bp, Artificial Sequence
  Synthetic Polynucleotide
taatacgactcactatagggatctccggcctagccaaaggttggaaggataacagaggagaatccttatgacctttggcaacctggcggcagcgcaaaagatg

SEQ ID NO: 157203 - DNA, 103 bp, Artificial Sequence
  Synthetic Polynucleotide
taatacgactcactataggggttgaggataatctccggcctagccaaaggaacagaggagacctttgatgaggccggagaacctggcggcagcgcaaaagatg

SEQ ID NO: 157204 - DNA, 103 bp, Artificial Sequence
  Synthetic Polynucleotide
taatacgactcactataggggagcacagtggttgaggataatctccggccaacagaggagaggccggatgttatcctcaaacctggcggcagcgcaaaagatg

SEQ ID NO: 157205 - DNA, 103 bp, Artificial Sequence
  Synthetic Polynucleotide
taatacgactcactatagggtcagttccaggagcacagtggttgaggataaacagaggagatatcctatgccactgtgcaacctggcggcagcgcaaaagatg

SEQ ID NO: 157206 - DNA, 103 bp, Artificial Sequence
  Synthetic Polynucleotide
taatacgactcactatagggacatttcgtttcagttccaggagcacagtgaacagaggagacactgtatgcctggaactaacctggcggcagcgcaaaagatg

SEQ ID NO: 157207 - DNA, 103 bp, Artificial Sequence
  Synthetic Polynucleotide
taatacgactcactatagggggggggcccggtacgctggaaacgcggcgcaacagaggagagcgccgatgttccagcgtaacctggcggcagcgcaaaagatg

SEQ ID NO: 157208 - DNA, 103 bp, Artificial Sequence
  Synthetic Polynucleotide
taatacgactcactatagggggggcttcagacatttcgtttcagttccagaacagaggagactggaaatgaaacgaaataacctggcggcagcgcaaaagatg

SEQ ID NO: 157209 - DNA, 103 bp, Artificial Sequence
  Synthetic Polynucleotide
taatacgactcactatagggagaggcagctggggcttcagacatttcgttaacagaggagaaacgaaatgtctgaagccaacctggcggcagcgcaaaagatg

SEQ ID NO: 157210 - DNA, 103 bp, Artificial Sequence
  Synthetic Polynucleotide
taatacgactcactatagggatctacctcaagaggcagctggggcttcagaacagaggagactgaagatgcagctgcctaacctggcggcagcgcaaaagatg

SEQ ID NO: 157211 - DNA, 103 bp, Artificial Sequence
  Synthetic Polynucleotide
taatacgactcactatagggggcagttcacatctacctcaagaggcagctaacagaggagaagctgcatgttgaggtagaacctggcggcagcgcaaaagatg

SEQ ID NO: 157212 - DNA, 103 bp, Artificial Sequence
  Synthetic Polynucleotide
taatacgactcactatagggggttcgggcaggcagttcacatctacctcaaacagaggagatgaggtatgtgtgaactgaacctggcggcagcgcaaaagatg

SEQ ID NO: 157213 - DNA, 103 bp, Artificial Sequence
  Synthetic Polynucleotide
taatacgactcactatagggaaccccgtttggttcgggcaggcagttcacaacagaggagagtgaacatgctgcccgaaaacctggcggcagcgcaaaagatg

SEQ ID NO: 157214 - DNA, 103 bp, Artificial Sequence
  Synthetic Polynucleotide
taatacgactcactatagggtgccccctccaaccccgtttggttcgggcaaacagaggagatgcccgatgcaaacggggaacctggcggcagcgcaaaagatg

SEQ ID NO: 157215 - DNA, 103 bp, Artificial Sequence
  Synthetic Polynucleotide
taatacgactcactataggggagtcagagatgccccctccaaccccgtttaacagaggagaaaacggatgtggagggggaacctggcggcagcgcaaaagatg

SEQ ID NO: 157216 - DNA, 103 bp, Artificial Sequence
  Synthetic Polynucleotide
taatacgactcactatagggttgggagctagagtcagagatgccccctccaacagaggagaggagggatgatctctgacaacctggcggcagcgcaaaagatg

SEQ ID NO: 157217 - DNA, 103 bp, Artificial Sequence
  Synthetic Polynucleotide
taatacgactcactatagggaattctgaccttgggagctagagtcagagaaacagaggagatctctgatgctagctcccaacctggcggcagcgcaaaagatg

SEQ ID NO: 157218 - DNA, 103 bp, Artificial Sequence
  Synthetic Polynucleotide
taatacgactcactatagggccgccggcgtggggggcccggtacgctggaaacagaggagatccagcatgccgggccccaacctggcggcagcgcaaaagatg

SEQ ID NO: 157219 - DNA, 103 bp, Artificial Sequence
  Synthetic Polynucleotide
taatacgactcactatagggcaggtttcaaaattctgaccttgggagctaaacagaggagatagctcatgaggtcagaaaacctggcggcagcgcaaaagatg

SEQ ID NO: 157220 - DNA, 103 bp, Artificial Sequence
  Synthetic Polynucleotide
taatacgactcactataggggagaggggaacaggtttcaaaattctgaccaacagaggagaggtcagatgtttgaaaccaacctggcggcagcgcaaaagatg

SEQ ID NO: 157221 - DNA, 103 bp, Artificial Sequence
  Synthetic Polynucleotide
taatacgactcactatagggtgtcttcagagagaggggaacaggtttcaaaacagaggagattgaaaatggttcccctcaacctggcggcagcgcaaaagatg

SEQ ID NO: 157222 - DNA, 103 bp, Artificial Sequence
  Synthetic Polynucleotide
taatacgactcactatagggtttgaaccaatgtcttcagagagaggggaaaacagaggagattccccatgctctgaagaaacctggcggcagcgcaaaagatg

SEQ ID NO: 157223 - DNA, 103 bp, Artificial Sequence
  Synthetic Polynucleotide
taatacgactcactatagggtgagtccagctttgaaccaatgtcttcagaaacagaggagatctgaaatgattggttcaaacctggcggcagcgcaaaagatg

SEQ ID NO: 157224 - DNA, 103 bp, Artificial Sequence
  Synthetic Polynucleotide
taatacgactcactataggggttcctcccatgagtccagctttgaaccaaaacagaggagattggttatgagctggactaacctggcggcagcgcaaaagatg

SEQ ID NO: 157225 - DNA, 103 bp, Artificial Sequence
  Synthetic Polynucleotide
taatacgactcactataggggaaaagatgtgttcctcccatgagtccagcaacagaggagagctggaatgatgggaggaaacctggcggcagcgcaaaagatg

SEQ ID NO: 157226 - DNA, 103 bp, Artificial Sequence
  Synthetic Polynucleotide
taatacgactcactatagggaccaaaggcagaaaagatgtgttcctcccaaacagaggagatgggagatgcacatctttaacctggcggcagcgcaaaagatg

SEQ ID NO: 157227 - DNA, 103 bp, Artificial Sequence
  Synthetic Polynucleotide
taatacgactcactatagggcaggagcgccccgccggcgtggggggcccgaacagaggagacgggccatgcacgccggcaacctggcggcagcgcaaaagatg

SEQ ID NO: 157228 - DNA, 103 bp, Artificial Sequence
  Synthetic Polynucleotide
taatacgactcactatagggtcgggggcggcaggagcgccccgccggcgtaacagaggagaacgccgatggggcgctccaacctggcggcagcgcaaaagatg

SEQ ID NO: 157229 - DNA, 103 bp, Artificial Sequence
  Synthetic Polynucleotide
taatacgactcactataggggccgcagggctcgggggcggcaggagcgccaacagaggagaggcgctatggccgcccccaacctggcggcagcgcaaaagatg

SEQ ID NO: 157230 - DNA, 103 bp, Artificial Sequence
  Synthetic Polynucleotide
taatacgactcactataggggtcctcgggagaggcgcccggctccgtcataacagaggagaatgacgatgccgggcgccaacctggcggcagcgcaaaagatg

SEQ ID NO: 157231 - DNA, 103 bp, Artificial Sequence
  Synthetic Polynucleotide
taatacgactcactatagggccctcgtcttccggcccccctacgtgcacgaacagaggagacgtgcaatgaggggggccaacctggcggcagcgcaaaagatg

SEQ ID NO: 157232 - DNA, 103 bp, Artificial Sequence
  Synthetic Polynucleotide
taatacgactcactatagggggagggaagcccctcgtcttccggccccccaacagaggagaggggggatggaagacgagaacctggcggcagcgcaaaagatg

SEQ ID NO: 157233 - DNA, 103 bp, Artificial Sequence
  Synthetic Polynucleotide
taatacgactcactatagggtttggggacaggagggaagcccctcgtcttaacagaggagaaagacgatgggcttccctaacctggcggcagcgcaaaagatg

SEQ ID NO: 157234 - DNA, 103 bp, Artificial Sequence
  Synthetic Polynucleotide
taatacgactcactatagggcgtgggggactttggggacaggagggaagcaacagaggagagcttccatgctgtccccaaacctggcggcagcgcaaaagatg

SEQ ID NO: 157235 - DNA, 103 bp, Artificial Sequence
  Synthetic Polynucleotide
taatacgactcactataggggcacggagagcgtgggggactttggggacaaacagaggagatgtcccatgagtcccccaaacctggcggcagcgcaaaagatg

SEQ ID NO: 157236 - DNA, 103 bp, Artificial Sequence
  Synthetic Polynucleotide
taatacgactcactatagggcagccccggggcacggagagcgtgggggacaacagaggagagtccccatggctctccgtaacctggcggcagcgcaaaagatg

SEQ ID NO: 157237 - DNA, 103 bp, Artificial Sequence
  Synthetic Polynucleotide
taatacgactcactataggggtcttctctgcagccccggggcacggagagaacagaggagactctccatgccccggggcaacctggcggcagcgcaaaagatg

SEQ ID NO: 157238 - DNA, 103 bp, Artificial Sequence
  Synthetic Polynucleotide
taatacgactcactatagggggtgagagctgtcttctctgcagccccgggaacagaggagacccgggatggcagagaagaacctggcggcagcgcaaaagatg

SEQ ID NO: 157239 - DNA, 103 bp, Artificial Sequence
  Synthetic Polynucleotide
taatacgactcactataggggcacacgcggggtgagagctgtcttctctgaacagaggagacagagaatgcagctctcaaacctggcggcagcgcaaaagatg

SEQ ID NO: 157240 - DNA, 103 bp, Artificial Sequence
  Synthetic Polynucleotide
taatacgactcactatagggctccaccttggcacacgcggggtgagagctaacagaggagaagctctatgcccgcgtgtaacctggcggcagcgcaaaagatg

SEQ ID NO: 157241 - DNA, 103 bp, Artificial Sequence
  Synthetic Polynucleotide
taatacgactcactatagggtgacccaagggtcctcgggagaggcgcccgaacagaggagacgggcgatgctcccgaggaacctggcggcagcgcaaaagatg

SEQ ID NO: 157242 - DNA, 103 bp, Artificial Sequence
  Synthetic Polynucleotide
taatacgactcactatagggtgtaggcatactccaccttggcacacgcggaacagaggagaccgcgtatgccaaggtggaacctggcggcagcgcaaaagatg

SEQ ID NO: 157243 - DNA, 103 bp, Artificial Sequence
  Synthetic Polynucleotide
taatacgactcactatagggctgttgtcgctgtaggcatactccaccttgaacagaggagacaaggtatggtatgcctaaacctggcggcagcgcaaaagatg

SEQ ID NO: 157244 - DNA, 103 bp, Artificial Sequence
  Synthetic Polynucleotide
taatacgactcactatagggggggtccaggctgttgtcgctgtaggcataaacagaggagatatgccatgagcgacaacaacctggcggcagcgcaaaagatg

SEQ ID NO: 157245 - DNA, 103 bp, Artificial Sequence
  Synthetic Polynucleotide
taatacgactcactatagggcaaaaagcccggggtccaggctgttgtcgcaacagaggagagcgacaatggcctggaccaacctggcggcagcgcaaaagatg

SEQ ID NO: 157246 - DNA, 103 bp, Artificial Sequence
  Synthetic Polynucleotide
taatacgactcactataggggtgctttctacaaaaagcccggggtccaggaacagaggagacctggaatgcgggcttttaacctggcggcagcgcaaaagatg

SEQ ID NO: 157247 - DNA, 103 bp, Artificial Sequence
  Synthetic Polynucleotide
taatacgactcactatagggccccttgcgggtgctttctacaaaaagcccaacagaggagagggcttatggtagaaagcaacctggcggcagcgcaaaagatg

SEQ ID NO: 157248 - DNA, 103 bp, Artificial Sequence
  Synthetic Polynucleotide
taatacgactcactatagggacactacactccccttgcgggtgctttctaaacagaggagatagaaaatgcccgcaaggaacctggcggcagcgcaaaagatg

SEQ ID NO: 157249 - DNA, 103 bp, Artificial Sequence
  Synthetic Polynucleotide
taatacgactcactatagggttagctctggacactacactccccttgcggaacagaggagaccgcaaatggagtgtagtaacctggcggcagcgcaaaagatg

SEQ ID NO: 157250 - DNA, 103 bp, Artificial Sequence
  Synthetic Polynucleotide
taatacgactcactatagggaccgatgctattagctctggacactacactaacagaggagaagtgtaatgtccagagctaacctggcggcagcgcaaaagatg

SEQ ID NO: 157251 - DNA, 103 bp, Artificial Sequence
  Synthetic Polynucleotide
taatacgactcactatagggcactggtggaaccgatgctattagctctggaacagaggagaccagagatgatagcatcgaacctggcggcagcgcaaaagatg

SEQ ID NO: 157252 - DNA, 103 bp, Artificial Sequence
  Synthetic Polynucleotide
taatacgactcactataggggggcttgccttgacccaagggtcctcgggaaacagaggagatcccgaatgcccttgggtaacctggcggcagcgcaaaagatg

SEQ ID NO: 157253 - DNA, 103 bp, Artificial Sequence
  Synthetic Polynucleotide
taatacgactcactatagggacagaagaggcactggtggaaccgatgctaaacagaggagatagcatatgttccaccagaacctggcggcagcgcaaaagatg

SEQ ID NO: 157254 - DNA, 103 bp, Artificial Sequence
  Synthetic Polynucleotide
taatacgactcactatagggtgtgttggggacagaagaggcactggtggaaacagaggagatccaccatggcctcttctaacctggcggcagcgcaaaagatg

SEQ ID NO: 157255 - DNA, 103 bp, Artificial Sequence
  Synthetic Polynucleotide
taatacgactcactatagggcctcatcatctgtgttggggacagaagaggaacagaggagacctcttatgtccccaacaaacctggcggcagcgcaaaagatg

SEQ ID NO: 157256 - DNA, 103 bp, Artificial Sequence
  Synthetic Polynucleotide
taatacgactcactatagggtaatcactgtcctcatcatctgtgttggggaacagaggagaccccaaatgagatgatgaaacctggcggcagcgcaaaagatg

SEQ ID NO: 157257 - DNA, 103 bp, Artificial Sequence
  Synthetic Polynucleotide
taatacgactcactatagggctcctggtggtaatcactgtcctcatcatcaacagaggagagatgatatggacagtgataacctggcggcagcgcaaaagatg

SEQ ID NO: 157258 - DNA, 103 bp, Artificial Sequence
  Synthetic Polynucleotide
taatacgactcactatagggccttgtaggcctcctggtggtaatcactgtaacagaggagaacagtgatgaccaccaggaacctggcggcagcgcaaaagatg

SEQ ID NO: 157259 - DNA, 103 bp, Artificial Sequence
  Synthetic Polynucleotide
taatacgactcactatagggttgtaggactccttgtaggcctcctggtggaacagaggagaccaccaatgggcctacaaaacctggcggcagcgcaaaagatg

SEQ ID NO: 157260 - DNA, 103 bp, Artificial Sequence
  Synthetic Polynucleotide
taatacgactcactatagggccgccggtctttgtaggactccttgtaggcaacagaggagagcctacatggagtcctacaacctggcggcagcgcaaaagatg

SEQ ID NO: 157261 - DNA, 103 bp, Artificial Sequence
  Synthetic Polynucleotide
taatacgactcactataggggtgcgcgccgccgccggtctttgtaggactaacagaggagaagtcctatgaagaccggcaacctggcggcagcgcaaaagatg

SEQ ID NO: 157262 - DNA, 103 bp, Artificial Sequence
  Synthetic Polynucleotide
taatacgactcactataggggcctgagtgtgtgcgcgccgccgccggtctaacagaggagaagaccgatggcggcgcgcaacctggcggcagcgcaaaagatg

SEQ ID NO: 157263 - DNA, 103 bp, Artificial Sequence
  Synthetic Polynucleotide
taatacgactcactatagggcgcgcccacggggcttgccttgacccaaggaacagaggagaccttggatgaaggcaagcaacctggcggcagcgcaaaagatg

SEQ ID NO: 157264 - DNA, 103 bp, Artificial Sequence
  Synthetic Polynucleotide
taatacgactcactatagggcttctgctcagcctgagtgtgtgcgcgccgaacagaggagacggcgcatgcacactcagaacctggcggcagcgcaaaagatg

SEQ ID NO: 157265 - DNA, 103 bp, Artificial Sequence
  Synthetic Polynucleotide
taatacgactcactatagggcgtccctcctcttctgctcagcctgagtgtaacagaggagaacactcatgctgagcagaaacctggcggcagcgcaaaagatg

SEQ ID NO: 157266 - DNA, 103 bp, Artificial Sequence
  Synthetic Polynucleotide
taatacgactcactatagggctcttgatggcgtccctcctcttctgctcaaacagaggagatgagcaatggaggagggaaacctggcggcagcgcaaaagatg

SEQ ID NO: 157267 - DNA, 103 bp, Artificial Sequence
  Synthetic Polynucleotide
taatacgactcactatagggatcatagcctctcttgatggcgtccctcctaacagaggagaaggaggatggccatcaagaacctggcggcagcgcaaaagatg

SEQ ID NO: 157268 - DNA, 103 bp, Artificial Sequence
  Synthetic Polynucleotide
taatacgactcactatagggtctgaaggtcatcatagcctctcttgatggaacagaggagaccatcaatggaggctatgaacctggcggcagcgcaaaagatg

SEQ ID NO: 157269 - DNA, 103 bp, Artificial Sequence
  Synthetic Polynucleotide
taatacgactcactataggggggacgatggtctgaaggtcatcatagcctaacagaggagaaggctaatgtgaccttcaaacctggcggcagcgcaaaagatg

SEQ ID NO: 157270 - DNA, 103 bp, Artificial Sequence
  Synthetic Polynucleotide
taatacgactcactatagggctggcaagtggggacgatggtctgaaggtcaacagaggagagaccttatgaccatcgtcaacctggcggcagcgcaaaagatg

SEQ ID NO: 157271 - DNA, 103 bp, Artificial Sequence
  Synthetic Polynucleotide
taatacgactcactatagggagtcctgctgctggcaagtggggacgatggaacagaggagaccatcgatgccacttgccaacctggcggcagcgcaaaagatg

SEQ ID NO: 157272 - DNA, 103 bp, Artificial Sequence
  Synthetic Polynucleotide
taatacgactcactatagggccaatggagaagtcctgctgctggcaagtgaacagaggagacacttgatggcagcaggaaacctggcggcagcgcaaaagatg

SEQ ID NO: 157273 - DNA, 103 bp, Artificial Sequence
  Synthetic Polynucleotide
taatacgactcactatagggcttttgggagccaatggagaagtcctgctgaacagaggagacagcagatgttctccattaacctggcggcagcgcaaaagatg

SEQ ID NO: 157274 - DNA, 103 bp, Artificial Sequence
  Synthetic Polynucleotide
taatacgactcactatagggcgccggcgtgcgcgcccacggggcttgcctaacagaggagaaggcaaatgccgtgggcgaacctggcggcagcgcaaaagatg

SEQ ID NO: 157275 - DNA, 103 bp, Artificial Sequence
  Synthetic Polynucleotide
taatacgactcactatagggctttgctgagcttttgggagccaatggagaaacagaggagatctccaatggctcccaaaaacctggcggcagcgcaaaagatg

SEQ ID NO: 157276 - DNA, 103 bp, Artificial Sequence
  Synthetic Polynucleotide
taatacgactcactatagggagaacgatggctttgctgagcttttgggagaacagaggagactcccaatggctcagcaaaacctggcggcagcgcaaaagatg

SEQ ID NO: 157277 - DNA, 103 bp, Artificial Sequence
  Synthetic Polynucleotide
taatacgactcactatagggggtcttttgtagaacgatggctttgctgagaacagaggagactcagcatggccatcgttaacctggcggcagcgcaaaagatg

SEQ ID NO: 157278 - DNA, 103 bp, Artificial Sequence
  Synthetic Polynucleotide
taatacgactcactatagggtgtagtcaatggtcttttgtagaacgatggaacagaggagaccatcgatgtacaaaagaaacctggcggcagcgcaaaagatg

SEQ ID NO: 157279 - DNA, 103 bp, Artificial Sequence
  Synthetic Polynucleotide
taatacgactcactatagggaaaaactgaatgtagtcaatggtcttttgtaacagaggagaacaaaaatgcattgactaaacctggcggcagcgcaaaagatg

SEQ ID NO: 157280 - DNA, 103 bp, Artificial Sequence
  Synthetic Polynucleotide
taatacgactcactatagggctccttgtgcaaaaactgaatgtagtcaataacagaggagaattgacatgattcagtttaacctggcggcagcgcaaaagatg

SEQ ID NO: 157281 - DNA, 103 bp, Artificial Sequence
  Synthetic Polynucleotide
taatacgactcactataggggctttttcttctccttgtgcaaaaactgaaaacagaggagattcagtatgtgcacaaggaacctggcggcagcgcaaaagatg

SEQ ID NO: 157282 - DNA, 103 bp, Artificial Sequence
  Synthetic Polynucleotide
taatacgactcactatagggtcctcctcctgctttttcttctccttgtgcaacagaggagagcacaaatggaagaaaaaaacctggcggcagcgcaaaagatg

SEQ ID NO: 157283 - DNA, 103 bp, Artificial Sequence
  Synthetic Polynucleotide
taatacgactcactatagggcgtggacacctcctcctcctgctttttcttaacagaggagaaagaaaatgcaggaggagaacctggcggcagcgcaaaagatg

SEQ ID NO: 157284 - DNA, 103 bp, Artificial Sequence
  Synthetic Polynucleotide
taatacgactcactatagggccttgcgtaacgtggacacctcctcctcctaacagaggagaaggaggatgaggtgtccaaacctggcggcagcgcaaaagatg

SEQ ID NO: 157285 - DNA, 103 bp, Artificial Sequence
  Synthetic Polynucleotide
taatacgactcactataggggccctcccctcgccggcgtgcgcgcccacgaacagaggagacgtgggatggcacgccggaacctggcggcagcgcaaaagatg

SEQ ID NO: 157286 - DNA, 103 bp, Artificial Sequence
  Synthetic Polynucleotide
taatacgactcactataggggcggtgacatccttgcgtaacgtggacaccaacagaggagaggtgtcatggttacgcaaaacctggcggcagcgcaaaagatg

SEQ ID NO: 157287 - DNA, 103 bp, Artificial Sequence
  Synthetic Polynucleotide
taatacgactcactataggggatctttagggcggtgacatccttgcgtaaaacagaggagattacgcatggatgtcaccaacctggcggcagcgcaaaagatg

SEQ ID NO: 157288 - DNA, 103 bp, Artificial Sequence
  Synthetic Polynucleotide
taatacgactcactatagggtcactttcatgatctttagggcggtgacataacagaggagaatgtcaatgccctaaagaaacctggcggcagcgcaaaagatg

SEQ ID NO: 157289 - DNA, 103 bp, Artificial Sequence
  Synthetic Polynucleotide
taatacgactcactatagggtgctcatagttcactttcatgatctttaggaacagaggagacctaaaatgcatgaaagtaacctggcggcagcgcaaaagatg

SEQ ID NO: 157290 - DNA, 103 bp, Artificial Sequence
  Synthetic Polynucleotide
taatacgactcactatagggcttcacaatctgctcatagttcactttcataacagaggagaatgaaaatgaactatgagaacctggcggcagcgcaaaagatg

SEQ ID NO: 157291 - DNA, 103 bp, Artificial Sequence
  Synthetic Polynucleotide
taatacgactcactatagggcctggtgtgccttcacaatctgctcatagtaacagaggagaactatgatgagattgtgaaacctggcggcagcgcaaaagatg

SEQ ID NO: 157292 - DNA, 103 bp, Artificial Sequence
  Synthetic Polynucleotide
taatacgactcactatagggtgggggttgtcctggtgtgccttcacaatcaacagaggagagattgtatgggcacaccaaacctggcggcagcgcaaaagatg

SEQ ID NO: 157293 - DNA, 103 bp, Artificial Sequence
  Synthetic Polynucleotide
taatacgactcactatagggctccccttcatgggggttgtcctggtgtgcaacagaggagagcacacatggacaaccccaacctggcggcagcgcaaaagatg

SEQ ID NO: 157294 - DNA, 103 bp, Artificial Sequence
  Synthetic Polynucleotide
taatacgactcactatagggagacctggtcctccccttcatgggggttgtaacagaggagaacaaccatgatgaaggggaacctggcggcagcgcaaaagatg

SEQ ID NO: 157295 - DNA, 103 bp, Artificial Sequence
  Synthetic Polynucleotide
taatacgactcactatagggacctggtcagagacctggtcctccccttcaaacagaggagatgaaggatgggaccaggtaacctggcggcagcgcaaaagatg

SEQ ID NO: 157296 - DNA, 103 bp, Artificial Sequence
  Synthetic Polynucleotide
taatacgactcactatagggagcccgacccgccctcccctcgccggcgtgaacagaggagacacgccatggaggggaggaacctggcggcagcgcaaaagatg

SEQ ID NO: 157297 - DNA, 103 bp, Artificial Sequence
  Synthetic Polynucleotide
taatacgactcactataggggttgaacttgacctggtcagagacctggtcaacagaggagagaccagatgtctgaccagaacctggcggcagcgcaaaagatg

SEQ ID NO: 157298 - DNA, 103 bp, Artificial Sequence
  Synthetic Polynucleotide
taatacgactcactatagggcttgaaacacgttgaacttgacctggtcagaacagaggagactgaccatgtcaagttcaaacctggcggcagcgcaaaagatg

SEQ ID NO: 157299 - DNA, 103 bp, Artificial Sequence
  Synthetic Polynucleotide
taatacgactcactatagggtccatgatgccttgaaacacgttgaacttgaacagaggagacaagttatgcgtgtttcaaacctggcggcagcgcaaaagatg

SEQ ID NO: 157300 - DNA, 103 bp, Artificial Sequence
  Synthetic Polynucleotide
taatacgactcactataggggaacagggaatccatgatgccttgaaacacaacagaggagagtgtttatgggcatcatgaacctggcggcagcgcaaaagatg

SEQ ID NO: 157301 - DNA, 103 bp, Artificial Sequence
  Synthetic Polynucleotide
taatacgactcactatagggtgaaggactggaacagggaatccatgatgcaacagaggagagcatcaatgattccctgtaacctggcggcagcgcaaaagatg

SEQ ID NO: 157302 - DNA, 103 bp, Artificial Sequence
  Synthetic Polynucleotide
taatacgactcactatagggatggaggcattgaaggactggaacagggaaaacagaggagattccctatgccagtccttaacctggcggcagcgcaaaagatg

SEQ ID NO: 157303 - DNA, 103 bp, Artificial Sequence
  Synthetic Polynucleotide
taatacgactcactatagggggccactgagatggaggcattgaaggactgaacagaggagacagtccatgaatgcctccaacctggcggcagcgcaaaagatg

SEQ ID NO: 157304 - DNA, 103 bp, Artificial Sequence
  Synthetic Polynucleotide
taatacgactcactatagggcctggaagctggccactgagatggaggcataacagaggagaatgcctatgtctcagtggaacctggcggcagcgcaaaagatg

SEQ ID NO: 157305 - DNA, 103 bp, Artificial Sequence
  Synthetic Polynucleotide
taatacgactcactataggggctgacagctcctggaagctggccactgagaacagaggagactcagtatgcagcttccaaacctggcggcagcgcaaaagatg

SEQ ID NO: 157306 - DNA, 103 bp, Artificial Sequence
  Synthetic Polynucleotide
taatacgactcactataggggaagacacacgctgacagctcctggaagctaacagaggagaagcttcatggagctgtcaaacctggcggcagcgcaaaagatg

SEQ ID NO: 157307 - DNA, 103 bp, Artificial Sequence
  Synthetic Polynucleotide
taatacgactcactatagggtacgtgcacgagcccgacccgccctcccctaacagaggagaaggggaatgcgggtcgggaacctggcggcagcgcaaaagatg

SEQ ID NO: 157308 - DNA, 103 bp, Artificial Sequence
  Synthetic Polynucleotide
taatacgactcactatagggcgatccagctgaagacacacgctgacagctaacagaggagaagctgtatgcgtgtgtctaacctggcggcagcgcaaaagatg

SEQ ID NO: 157309 - DNA, 103 bp, Artificial Sequence
  Synthetic Polynucleotide
taatacgactcactatagggcagtgctcctcgatccagctgaagacacacaacagaggagagtgtgtatgcagctggataacctggcggcagcgcaaaagatg

SEQ ID NO: 157310 - DNA, 103 bp, Artificial Sequence
  Synthetic Polynucleotide
taatacgactcactatagggctgaggcttacagtgctcctcgatccagctaacagaggagaagctggatggaggagcacaacctggcggcagcgcaaaagatg

SEQ ID NO: 157311 - DNA, 103 bp, Artificial Sequence
  Synthetic Polynucleotide
taatacgactcactatagggcccgcagggtctgaggcttacagtgctcctaacagaggagaaggagcatggtaagcctcaacctggcggcagcgcaaaagatg

SEQ ID NO: 157312 - DNA, 103 bp, Artificial Sequence
  Synthetic Polynucleotide
taatacgactcactatagggatcacaatctcccgcagggtctgaggcttaaacagaggagataagccatggaccctgcgaacctggcggcagcgcaaaagatg

SEQ ID NO: 157313 - DNA, 103 bp, Artificial Sequence
  Synthetic Polynucleotide
taatacgactcactatagggcaggacgccaatcacaatctcccgcagggtaacagaggagaaccctgatggagattgtgaacctggcggcagcgcaaaagatg

SEQ ID NO: 157314 - DNA, 103 bp, Artificial Sequence
  Synthetic Polynucleotide
taatacgactcactatagggtcaattggtgcaggacgccaatcacaatctaacagaggagaagattgatgttggcgtccaacctggcggcagcgcaaaagatg

SEQ ID NO: 157315 - DNA, 103 bp, Artificial Sequence
  Synthetic Polynucleotide
taatacgactcactatagggagctggtttttcaattggtgcaggacgccaaacagaggagatggcgtatggcaccaattaacctggcggcagcgcaaaagatg

SEQ ID NO: 157316 - DNA, 103 bp, Artificial Sequence
  Synthetic Polynucleotide
taatacgactcactatagggccggcccccctacgtgcacgagcccgacccaacagaggagagggtcgatgtcgtgcacgaacctggcggcagcgcaaaagatg

SEQ ID NO: 157317 - DNA, 103 bp, Artificial Sequence
  Synthetic Polynucleotide
taatacgactcactatagggcggggagcacatgaagacgtcggcggccataacagaggagaatggccatggacgtcttcaacctggcggcagcgcaaaagatg

SEQ ID NO: 157318 - DNA, 103 bp, Artificial Sequence
  Synthetic Polynucleotide
taatacgactcactatagggcggggacggctcatccgtgtccgagtcgtcaacagaggagagacgacatggacacggataacctggcggcagcgcaaaagatg

SEQ ID NO: 157319 - DNA, 103 bp, Artificial Sequence
  Synthetic Polynucleotide
taatacgactcactataggggcggctagaagagaagaggtcctggaaaggaacagaggagacctttcatggacctcttcaacctggcggcagcgcaaaagatg

SEQ ID NO: 157320 - DNA, 103 bp, Artificial Sequence
  Synthetic Polynucleotide
taatacgactcactatagggcaaaaatggagcggctagaagagaagaggtaacagaggagaacctctatgcttctagccaacctggcggcagcgcaaaagatg

SEQ ID NO: 157321 - DNA, 103 bp, Artificial Sequence
  Synthetic Polynucleotide
taatacgactcactatagggagcatggagccaaaaatggagcggctagaaaacagaggagattctagatgctccattttaacctggcggcagcgcaaaagatg

SEQ ID NO: 157322 - DNA, 103 bp, Artificial Sequence
  Synthetic Polynucleotide
taatacgactcactatagggagatgcaggtagcatggagccaaaaatggaaacagaggagatccattatgggctccatgaacctggcggcagcgcaaaagatg

SEQ ID NO: 157323 - DNA, 103 bp, Artificial Sequence
  Synthetic Polynucleotide
taatacgactcactataggggtgctgaggcagatgcaggtagcatggagcaacagaggagagctccaatgtacctgcataacctggcggcagcgcaaaagatg

SEQ ID NO: 157324 - DNA, 103 bp, Artificial Sequence
  Synthetic Polynucleotide
taatacgactcactatagggtctggtacaggtgctgaggcagatgcaggtaacagaggagaacctgcatgtgcctcagcaacctggcggcagcgcaaaagatg

SEQ ID NO: 157325 - DNA, 103 bp, Artificial Sequence
  Synthetic Polynucleotide
taatacgactcactataggggttgttgggatctggtacaggtgctgaggcaacagaggagagcctcaatgcctgtaccaaacctggcggcagcgcaaaagatg

SEQ ID NO: 157326 - DNA, 103 bp, Artificial Sequence
  Synthetic Polynucleotide
taatacgactcactataggggtgcaggtgggttgttgggatctggtacagaacagaggagactgtacatgatcccaacaaacctggcggcagcgcaaaagatg

SEQ ID NO: 157327 - DNA, 103 bp, Artificial Sequence
  Synthetic Polynucleotide
taatacgactcactatagggatgctctcctgtgcaggtgggttgttgggaaacagaggagatcccaaatgcccacctgcaacctggcggcagcgcaaaagatg

SEQ ID NO: 157328 - DNA, 103 bp, Artificial Sequence
  Synthetic Polynucleotide
taatacgactcactatagggggtcggcaggatgctctcctgtgcaggtggaacagaggagaccacctatgcaggagagcaacctggcggcagcgcaaaagatg

SEQ ID NO: 157329 - DNA, 103 bp, Artificial Sequence
  Synthetic Polynucleotide
taatacgactcactatagggaggcgggcggcggggacggctcatccgtgtaacagaggagaacacggatgagccgtcccaacctggcggcagcgcaaaagatg

SEQ ID NO: 157330 - DNA, 103 bp, Artificial Sequence
  Synthetic Polynucleotide
taatacgactcactatagggggagggctgtggtcggcaggatgctctcctaacagaggagaaggagaatgtcctgccgaaacctggcggcagcgcaaaagatg

SEQ ID NO: 157331 - DNA, 103 bp, Artificial Sequence
  Synthetic Polynucleotide
taatacgactcactatagggctcacagtggggagggctgtggtcggcaggaacagaggagacctgccatgcacagccctaacctggcggcagcgcaaaagatg

SEQ ID NO: 157332 - DNA, 103 bp, Artificial Sequence
  Synthetic Polynucleotide
taatacgactcactataggggtcaggaaggctcacagtggggagggctgtaacagaggagaacagccatgcccactgtgaacctggcggcagcgcaaaagatg

SEQ ID NO: 157333 - DNA, 103 bp, Artificial Sequence
  Synthetic Polynucleotide
taatacgactcactatagggcgatgaggctgtcaggaaggctcacagtggaacagaggagaccactgatggccttcctgaacctggcggcagcgcaaaagatg

SEQ ID NO: 157334 - DNA, 103 bp, Artificial Sequence
  Synthetic Polynucleotide
taatacgactcactataggggtagggggcgcgatgaggctgtcaggaaggaacagaggagaccttccatgcagcctcataacctggcggcagcgcaaaagatg

SEQ ID NO: 157335 - DNA, 103 bp, Artificial Sequence
  Synthetic Polynucleotide
taatacgactcactatagggggatggggcggtagggggcgcgatgaggctaacagaggagaagcctcatggcgccccctaacctggcggcagcgcaaaagatg

SEQ ID NO: 157336 - DNA, 103 bp, Artificial Sequence
  Synthetic Polynucleotide
taatacgactcactatagggtgtgagccagggatggggcggtagggggcgaacagaggagacgccccatgccgccccataacctggcggcagcgcaaaagatg

SEQ ID NO: 157337 - DNA, 103 bp, Artificial Sequence
  Synthetic Polynucleotide
taatacgactcactatagggtgctcatccatgtgagccagggatggggcgaacagaggagacgccccatgcctggctcaaacctggcggcagcgcaaaagatg

SEQ ID NO: 157338 - DNA, 103 bp, Artificial Sequence
  Synthetic Polynucleotide
taatacgactcactatagggttcacagccctgctcatccatgtgagccagaacagaggagactggctatgatggatgagaacctggcggcagcgcaaaagatg

SEQ ID NO: 157339 - DNA, 103 bp, Artificial Sequence
  Synthetic Polynucleotide
taatacgactcactataggggggaggtgtgttcacagccctgctcatccaaacagaggagatggatgatgagggctgtgaacctggcggcagcgcaaaagatg

SEQ ID NO: 157340 - DNA, 103 bp, Artificial Sequence
  Synthetic Polynucleotide
taatacgactcactataggggccgcgccggaggcgggcggcggggacggcaacagaggagagccgtcatggccgcccgcaacctggcggcagcgcaaaagatg

SEQ ID NO: 157341 - DNA, 103 bp, Artificial Sequence
  Synthetic Polynucleotide
taatacgactcactatagggtcctcagtccgggaggtgtgttcacagcccaacagaggagagggctgatgacacacctcaacctggcggcagcgcaaaagatg

SEQ ID NO: 157342 - DNA, 103 bp, Artificial Sequence
  Synthetic Polynucleotide
taatacgactcactataggggataaacgggtcctcagtccgggaggtgtgaacagaggagacacaccatgcggactgagaacctggcggcagcgcaaaagatg

SEQ ID NO: 157343 - DNA, 103 bp, Artificial Sequence
  Synthetic Polynucleotide
taatacgactcactatagggccgtgggctggataaacgggtcctcagtccaacagaggagaggactgatgacccgtttaaacctggcggcagcgcaaaagatg

SEQ ID NO: 157344 - DNA, 103 bp, Artificial Sequence
  Synthetic Polynucleotide
taatacgactcactatagggggaccgaagtccgtgggctggataaacgggaacagaggagacccgttatgccagcccacaacctggcggcagcgcaaaagatg

SEQ ID NO: 157345 - DNA, 103 bp, Artificial Sequence
  Synthetic Polynucleotide
taatacgactcactatagggcggctctgagggaccgaagtccgtgggctgaacagaggagacagcccatggacttcggtaacctggcggcagcgcaaaagatg

SEQ ID NO: 157346 - DNA, 103 bp, Artificial Sequence
  Synthetic Polynucleotide
taatacgactcactatagggcactcagtggcggctctgagggaccgaagtaacagaggagaacttcgatgcctcagagcaacctggcggcagcgcaaaagatg

SEQ ID NO: 157347 - DNA, 103 bp, Artificial Sequence
  Synthetic Polynucleotide
taatacgactcactatagggggctgcgggacactcagtggcggctctgagaacagaggagactcagaatggccactgagaacctggcggcagcgcaaaagatg

SEQ ID NO: 157348 - DNA, 103 bp, Artificial Sequence
  Synthetic Polynucleotide
taatacgactcactatagggagggaggaagggctgcgggacactcagtggaacagaggagaccactgatggtcccgcagaacctggcggcagcgcaaaagatg

SEQ ID NO: 157349 - DNA, 103 bp, Artificial Sequence
  Synthetic Polynucleotide
taatacgactcactatagggtggtgaagacagggaggaagggctgcgggaaacagaggagatcccgcatgccttcctccaacctggcggcagcgcaaaagatg

SEQ ID NO: 157350 - DNA, 103 bp, Artificial Sequence
  Synthetic Polynucleotide
taatacgactcactatagggagcaggggcatggtgaagacagggaggaagaacagaggagacttcctatgtgtcttcacaacctggcggcagcgcaaaagatg

SEQ ID NO: 157351 - DNA, 103 bp, Artificial Sequence
  Synthetic Polynucleotide
taatacgactcactatagggggccggggtggccgcgccggaggcgggcggaacagaggagaccgcccatgtccggcgcgaacctggcggcagcgcaaaagatg

SEQ ID NO: 157352 - DNA, 103 bp, Artificial Sequence
  Synthetic Polynucleotide
taatacgactcactataggggctgggagacagcaggggcatggtgaagacaacagaggagagtcttcatgatgcccctgaacctggcggcagcgcaaaagatg

SEQ ID NO: 157353 - DNA, 103 bp, Artificial Sequence
  Synthetic Polynucleotide
taatacgactcactataggggtggggcggggctgggagacagcaggggcaaacagaggagatgccccatgtgtctcccaaacctggcggcagcgcaaaagatg

SEQ ID NO: 157354 - DNA, 103 bp, Artificial Sequence
  Synthetic Polynucleotide
taatacgactcactataggggagatgggcggtggggcggggctgggagacaacagaggagagtctccatgccccgccccaacctggcggcagcgcaaaagatg

SEQ ID NO: 157355 - DNA, 103 bp, Artificial Sequence
  Synthetic Polynucleotide
taatacgactcactatagggtaacacgggggagatgggcggtggggcgggaacagaggagacccgccatgccgcccatcaacctggcggcagcgcaaaagatg

SEQ ID NO: 157356 - DNA, 103 bp, Artificial Sequence
  Synthetic Polynucleotide
taatacgactcactataggggaactaatggtaacacgggggagatgggcgaacagaggagacgcccaatgcccccgtgtaacctggcggcagcgcaaaagatg

SEQ ID NO: 157357 - DNA, 103 bp, Artificial Sequence
  Synthetic Polynucleotide
taatacgactcactataggggcaggaggaggaactaatggtaacacggggaacagaggagaccccgtatgaccattagtaacctggcggcagcgcaaaagatg

SEQ ID NO: 157358 - DNA, 103 bp, Artificial Sequence
  Synthetic Polynucleotide
taatacgactcactatagggcagggcagtggcaggaggaggaactaatggaacagaggagaccattaatgcctcctcctaacctggcggcagcgcaaaagatg

SEQ ID NO: 157359 - DNA, 103 bp, Artificial Sequence
  Synthetic Polynucleotide
taatacgactcactatagggccggggggttcagggcagtggcaggaggagaacagaggagactcctcatgccactgcccaacctggcggcagcgcaaaagatg

SEQ ID NO: 157360 - DNA, 103 bp, Artificial Sequence
  Synthetic Polynucleotide
taatacgactcactataggggtgggtggagccggggggttcagggcagtgaacagaggagacactgcatggaaccccccaacctggcggcagcgcaaaagatg

SEQ ID NO: 157361 - DNA, 103 bp, Artificial Sequence
  Synthetic Polynucleotide
taatacgactcactatagggctgatggaaggtgggtggagccggggggttaacagaggagaaaccccatggctccacccaacctggcggcagcgcaaaagatg

SEQ ID NO: 157362 - DNA, 103 bp, Artificial Sequence
  Synthetic Polynucleotide
taatacgactcactatagggcgtgggcccgggccggggtggccgcgccggaacagaggagaccggcgatgccaccccggaacctggcggcagcgcaaaagatg

SEQ ID NO: 157363 - DNA, 103 bp, Artificial Sequence
  Synthetic Polynucleotide
taatacgactcactatagggacttctgtggctgatggaaggtgggtggagaacagaggagactccacatgccttccatcaacctggcggcagcgcaaaagatg

SEQ ID NO: 157364 - DNA, 103 bp, Artificial Sequence
  Synthetic Polynucleotide
taatacgactcactatagggactccagcaaacttctgtggctgatggaagaacagaggagacttccaatggccacagaaaacctggcggcagcgcaaaagatg

SEQ ID NO: 157365 - DNA, 103 bp, Artificial Sequence
  Synthetic Polynucleotide
taatacgactcactatagggcgctttgttgactccagcaaacttctgtggaacagaggagaccacagatgtttgctggaaacctggcggcagcgcaaaagatg

SEQ ID NO: 157366 - DNA, 103 bp, Artificial Sequence
  Synthetic Polynucleotide
taatacgactcactatagggtgacagacggcgctttgttgactccagcaaaacagaggagattgctgatgtcaacaaagaacctggcggcagcgcaaaagatg

SEQ ID NO: 157367 - DNA, 103 bp, Artificial Sequence
  Synthetic Polynucleotide
taatacgactcactataggggtgtgggtgatgacagacggcgctttgttgaacagaggagacaacaaatggccgtctgtaacctggcggcagcgcaaaagatg

SEQ ID NO: 157368 - DNA, 103 bp, Artificial Sequence
  Synthetic Polynucleotide
taatacgactcactatagggggcagaggccgtgtgggtgatgacagacggaacagaggagaccgtctatgatcacccacaacctggcggcagcgcaaaagatg

SEQ ID NO: 157369 - DNA, 103 bp, Artificial Sequence
  Synthetic Polynucleotide
taatacgactcactataggggggtgagggtggcagaggccgtgtgggtgaaacagaggagatcacccatgcggcctctgaacctggcggcagcgcaaaagatg

SEQ ID NO: 157370 - DNA, 103 bp, Artificial Sequence
  Synthetic Polynucleotide
taatacgactcactatagggggggcatcgtgggtgagggtggcagaggccaacagaggagaggcctcatgcaccctcacaacctggcggcagcgcaaaagatg

SEQ ID NO: 157371 - DNA, 103 bp, Artificial Sequence
  Synthetic Polynucleotide
taatacgactcactatagggggtggtggcgggggcatcgtgggtgagggtaacagaggagaaccctcatgcacgatgccaacctggcggcagcgcaaaagatg

SEQ ID NO: 157372 - DNA, 103 bp, Artificial Sequence
  Synthetic Polynucleotide
taatacgactcactatagggtctggctaaaggtggtggcgggggcatcgtaacagaggagaacgatgatgccgccaccaaacctggcggcagcgcaaaagatg

SEQ ID NO: 157373 - DNA, 103 bp, Artificial Sequence
  Synthetic Polynucleotide
taatacgactcactataggggcggcgctcgcgtgggcccgggccggggtgaacagaggagacaccccatgccgggcccaaacctggcggcagcgcaaaagatg

SEQ ID NO: 157374 - DNA, 103 bp, Artificial Sequence
  Synthetic Polynucleotide
taatacgactcactatagggaggccctgactctggctaaaggtggtggcgaacagaggagacgccacatgctttagccaaacctggcggcagcgcaaaagatg

SEQ ID NO: 157375 - DNA, 103 bp, Artificial Sequence
  Synthetic Polynucleotide
taatacgactcactatagggggtgatcacaaggccctgactctggctaaaaacagaggagatttagcatgagtcagggcaacctggcggcagcgcaaaagatg

SEQ ID NO: 157376 - DNA, 103 bp, Artificial Sequence
  Synthetic Polynucleotide
taatacgactcactatagggggtgatgggtggtgatcacaaggccctgacaacagaggagagtcaggatgttgtgatcaaacctggcggcagcgcaaaagatg

SEQ ID NO: 157377 - DNA, 103 bp, Artificial Sequence
  Synthetic Polynucleotide
taatacgactcactataggggacggggcagggtgatgggtggtgatcacaaacagaggagatgtgatatgcacccatcaaacctggcggcagcgcaaaagatg

SEQ ID NO: 157378 - DNA, 103 bp, Artificial Sequence
  Synthetic Polynucleotide
taatacgactcactatagggaggggccgctgacggggcagggtgatgggtaacagaggagaacccatatgcctgccccgaacctggcggcagcgcaaaagatg

SEQ ID NO: 157379 - DNA, 103 bp, Artificial Sequence
  Synthetic Polynucleotide
taatacgactcactatagggccagcccacaaggggccgctgacggggcagaacagaggagactgcccatgcagcggcccaacctggcggcagcgcaaaagatg

SEQ ID NO: 157380 - DNA, 103 bp, Artificial Sequence
  Synthetic Polynucleotide
taatacgactcactatagggggagacagtgccagcccacaaggggccgctaacagaggagaagcggcatgttgtgggctaacctggcggcagcgcaaaagatg

SEQ ID NO: 157381 - DNA, 103 bp, Artificial Sequence
  Synthetic Polynucleotide
taatacgactcactatagggccgggtgacaggagacagtgccagcccacaaacagaggagatgtgggatggcactgtctaacctggcggcagcgcaaaagatg

SEQ ID NO: 157382 - DNA, 103 bp, Artificial Sequence
  Synthetic Polynucleotide
taatacgactcactataggggctggggaggccgggtgacaggagacagtgaacagaggagacactgtatgctgtcacccaacctggcggcagcgcaaaagatg

SEQ ID NO: 157383 - DNA, 103 bp, Artificial Sequence
  Synthetic Polynucleotide
taatacgactcactataggggttaaccgtggctggggaggccgggtgacaaacagaggagatgtcacatggcctccccaaacctggcggcagcgcaaaagatg

SEQ ID NO: 157384 - DNA, 103 bp, Artificial Sequence
  Synthetic Polynucleotide
taatacgactcactatagggcggcggtggcgcggcgctcgcgtgggcccgaacagaggagacgggccatggcgagcgccaacctggcggcagcgcaaaagatg

SEQ ID NO: 157385 - DNA, 103 bp, Artificial Sequence
  Synthetic Polynucleotide
taatacgactcactataggggtgcacaaaagttaaccgtggctggggaggaacagaggagacctcccatgccacggttaaacctggcggcagcgcaaaagatg

SEQ ID NO: 157386 - DNA, 103 bp, Artificial Sequence
  Synthetic Polynucleotide
taatacgactcactatagggcaggtttggggtgcacaaaagttaaccgtgaacagaggagacacggtatgcttttgtgcaacctggcggcagcgcaaaagatg

SEQ ID NO: 157387 - DNA, 103 bp, Artificial Sequence
  Synthetic Polynucleotide
taatacgactcactataggggtcaaggatacaggtttggggtgcacaaaaaacagaggagattttgtatgccccaaaccaacctggcggcagcgcaaaagatg

SEQ ID NO: 157388 - DNA, 103 bp, Artificial Sequence
  Synthetic Polynucleotide
taatacgactcactatagggcctgcccccagtcaaggatacaggtttgggaacagaggagacccaaaatggtatccttgaacctggcggcagcgcaaaagatg

SEQ ID NO: 157389 - DNA, 103 bp, Artificial Sequence
  Synthetic Polynucleotide
taatacgactcactataggggctgcttaggcctgcccccagtcaaggataaacagaggagatatcctatgctgggggcaaacctggcggcagcgcaaaagatg

SEQ ID NO: 157390 - DNA, 103 bp, Artificial Sequence
  Synthetic Polynucleotide
taatacgactcactatagggattttgtggggctgcttaggcctgcccccaaacagaggagatgggggatggcctaagcaaacctggcggcagcgcaaaagatg

SEQ ID NO: 157391 - DNA, 103 bp, Artificial Sequence
  Synthetic Polynucleotide
taatacgactcactatagggagcaggcactattttgtggggctgcttaggaacagaggagacctaagatgccccacaaaaacctggcggcagcgcaaaagatg

SEQ ID NO: 157392 - DNA, 103 bp, Artificial Sequence
  Synthetic Polynucleotide
taatacgactcactatagggctggtttgggagcaggcactattttgtgggaacagaggagacccacaatgtagtgcctgaacctggcggcagcgcaaaagatg

SEQ ID NO: 157393 - DNA, 103 bp, Artificial Sequence
  Synthetic Polynucleotide
taatacgactcactataggggacacgggctctggtttgggagcaggcactaacagaggagaagtgccatgtcccaaaccaacctggcggcagcgcaaaagatg

SEQ ID NO: 157394 - DNA, 103 bp, Artificial Sequence
  Synthetic Polynucleotide
taatacgactcactatagggcaacaccaaggacacgggctctggtttgggaacagaggagacccaaaatggagcccgtgaacctggcggcagcgcaaaagatg

SEQ ID NO: 157395 - DNA, 103 bp, Artificial Sequence
  Synthetic Polynucleotide
taatacgactcactatagggcggcccgaggcggcggtggcgcggcgctcgaacagaggagacgagcgatgcgccaccgcaacctggcggcagcgcaaaagatg

SEQ ID NO: 157396 - DNA, 103 bp, Artificial Sequence
  Synthetic Polynucleotide
taatacgactcactataggggggcattcttcaacaccaaggacacgggctaacagaggagaagcccgatgccttggtgtaacctggcggcagcgcaaaagatg

SEQ ID NO: 157397 - DNA, 103 bp, Artificial Sequence
  Synthetic Polynucleotide
taatacgactcactatagggggggcgatacgggcattcttcaacaccaagaacagaggagacttggtatggaagaatgcaacctggcggcagcgcaaaagatg

SEQ ID NO: 157398 - DNA, 103 bp, Artificial Sequence
  Synthetic Polynucleotide
taatacgactcactatagggaaaggcagctggggcgatacgggcattcttaacagaggagaaagaatatgcgtatcgccaacctggcggcagcgcaaaagatg

SEQ ID NO: 157399 - DNA, 103 bp, Artificial Sequence
  Synthetic Polynucleotide
taatacgactcactataggggttggcctgaaaaggcagctggggcgatacaacagaggagagtatcgatgcagctgcctaacctggcggcagcgcaaaagatg

SEQ ID NO: 157400 - DNA, 103 bp, Artificial Sequence
  Synthetic Polynucleotide
taatacgactcactatagggaccgcttgtggttggcctgaaaaggcagctaacagaggagaagctgcatgttcaggccaaacctggcggcagcgcaaaagatg

SEQ ID NO: 157401 - DNA, 103 bp, Artificial Sequence
  Synthetic Polynucleotide
taatacgactcactatagggcgtcatgatcaccgcttgtggttggcctgaaacagaggagatcaggcatgccacaagcgaacctggcggcagcgcaaaagatg

SEQ ID NO: 157402 - DNA, 103 bp, Artificial Sequence
  Synthetic Polynucleotide
taatacgactcactataggggaggccctgacgtcatgatcaccgcttgtgaacagaggagacacaagatgtgatcatgaaacctggcggcagcgcaaaagatg

SEQ ID NO: 157403 - DNA, 103 bp, Artificial Sequence
  Synthetic Polynucleotide
taatacgactcactatagggtctctcttcagaggccctgacgtcatgatcaacagaggagagatcatatggtcagggccaacctggcggcagcgcaaaagatg

SEQ ID NO: 157404 - DNA, 103 bp, Artificial Sequence
  Synthetic Polynucleotide
taatacgactcactatagggcaacatcccttctctcttcagaggccctgaaacagaggagatcagggatgctgaagagaaacctggcggcagcgcaaaagatg

SEQ ID NO: 157405 - DNA, 103 bp, Artificial Sequence
  Synthetic Polynucleotide
taatacgactcactatagggcggtggaggccaacatcccttctctcttcaaacagaggagatgaagaatgaagggatgtaacctggcggcagcgcaaaagatg

SEQ ID NO: 157406 - DNA, 103 bp, Artificial Sequence
  Synthetic Polynucleotide
taatacgactcactatagggcggcccggcccggcccgaggcggcggtggcaacagaggagagccaccatggcctcgggcaacctggcggcagcgcaaaagatg

SEQ ID NO: 157407 - DNA, 103 bp, Artificial Sequence
  Synthetic Polynucleotide
taatacgactcactataggggactgggacacggtggaggccaacatccctaacagaggagaagggatatgggcctccacaacctggcggcagcgcaaaagatg

SEQ ID NO: 157408 - DNA, 103 bp, Artificial Sequence
  Synthetic Polynucleotide
taatacgactcactataggggaccacgttggactgggacacggtggaggcaacagaggagagcctccatggtgtcccagaacctggcggcagcgcaaaagatg

SEQ ID NO: 157409 - DNA, 103 bp, Artificial Sequence
  Synthetic Polynucleotide
taatacgactcactatagggcaggcgcaatgaccacgttggactgggacaaacagaggagatgtcccatgccaacgtggaacctggcggcagcgcaaaagatg

SEQ ID NO: 157410 - DNA, 103 bp, Artificial Sequence
  Synthetic Polynucleotide
taatacgactcactataggggcgatggcagcaggcgcaatgaccacgttgaacagaggagacaacgtatgcattgcgccaacctggcggcagcgcaaaagatg

SEQ ID NO: 157411 - DNA, 103 bp, Artificial Sequence
  Synthetic Polynucleotide
taatacgactcactatagggaggagccctggcgatggcagcaggcgcaataacagaggagaattgcgatggctgccatcaacctggcggcagcgcaaaagatg

SEQ ID NO: 157412 - DNA, 103 bp, Artificial Sequence
  Synthetic Polynucleotide
taatacgactcactatagggccgggaccccaggagccctggcgatggcagaacagaggagactgccaatgccagggctcaacctggcggcagcgcaaaagatg

SEQ ID NO: 157413 - DNA, 103 bp, Artificial Sequence
  Synthetic Polynucleotide
taatacgactcactatagggctgtggaactccgggaccccaggagccctgaacagaggagacagggcatgtggggtcccaacctggcggcagcgcaaaagatg

SEQ ID NO: 157414 - DNA, 103 bp, Artificial Sequence
  Synthetic Polynucleotide
taatacgactcactatagggcaggatgctgctgtggaactccgggaccccaacagaggagaggggtcatggagttccacaacctggcggcagcgcaaaagatg

SEQ ID NO: 157415 - DNA, 103 bp, Artificial Sequence
  Synthetic Polynucleotide
taatacgactcactataggggatctgtcaccaggatgctgctgtggaactaacagaggagaagttccatggcagcatccaacctggcggcagcgcaaaagatg

SEQ ID NO: 157416 - DNA, 103 bp, Artificial Sequence
  Synthetic Polynucleotide
taatacgactcactatagggccatggccgagatctgtcaccaggatgctgaacagaggagacagcatatgggtgacagaaacctggcggcagcgcaaaagatg

SEQ ID NO: 157417 - DNA, 103 bp, Artificial Sequence
  Synthetic Polynucleotide
taatacgactcactatagggaggttcctcgcggcccggcccggcccgaggaacagaggagacctcggatggggccgggcaacctggcggcagcgcaaaagatg

SEQ ID NO: 157418 - DNA, 103 bp, Artificial Sequence
  Synthetic Polynucleotide
taatacgactcactataggggctgctcgtgccatggccgagatctgtcacaacagaggagagtgacaatgctcggccataacctggcggcagcgcaaaagatg

SEQ ID NO: 157419 - DNA, 103 bp, Artificial Sequence
  Synthetic Polynucleotide
taatacgactcactataggggggcaggcgggctgctcgtgccatggccgaaacagaggagatcggccatggcacgagcaaacctggcggcagcgcaaaagatg

SEQ ID NO: 157420 - DNA, 103 bp, Artificial Sequence
  Synthetic Polynucleotide
taatacgactcactatagggcgggagacgggggcaggcgggctgctcgtgaacagaggagacacgagatgcccgcctgcaacctggcggcagcgcaaaagatg

SEQ ID NO: 157421 - DNA, 103 bp, Artificial Sequence
  Synthetic Polynucleotide
taatacgactcactatagggtgggaagagccgggagacgggggcaggcggaacagaggagaccgcctatgcccgtctccaacctggcggcagcgcaaaagatg

SEQ ID NO: 157422 - DNA, 103 bp, Artificial Sequence
  Synthetic Polynucleotide
taatacgactcactataggggcgctgtgcttgggaagagccgggagacggaacagaggagaccgtctatgggctcttccaacctggcggcagcgcaaaagatg

SEQ ID NO: 157423 - DNA, 103 bp, Artificial Sequence
  Synthetic Polynucleotide
taatacgactcactatagggagggggtcttgcgctgtgcttgggaagagcaacagaggagagctcttatgaagcacagcaacctggcggcagcgcaaaagatg

SEQ ID NO: 157424 - DNA, 103 bp, Artificial Sequence
  Synthetic Polynucleotide
taatacgactcactataggggcccttccccagggggtcttgcgctgtgctaacagaggagaagcacaatgcaagaccccaacctggcggcagcgcaaaagatg

SEQ ID NO: 157425 - DNA, 103 bp, Artificial Sequence
  Synthetic Polynucleotide
taatacgactcactatagggggacctgctcgcccttccccagggggtcttaacagaggagaaagaccatgtggggaaggaacctggcggcagcgcaaaagatg

SEQ ID NO: 157426 - DNA, 103 bp, Artificial Sequence
  Synthetic Polynucleotide
taatacgactcactatagggccatgcagcgggacctgctcgcccttccccaacagaggagaggggaaatgcgagcaggtaacctggcggcagcgcaaaagatg

SEQ ID NO: 157427 - DNA, 103 bp, Artificial Sequence
  Synthetic Polynucleotide
taatacgactcactatagggggggctgcccccatgcagcgggacctgctcaacagaggagagagcagatgccgctgcataacctggcggcagcgcaaaagatg

SEQ ID NO: 157428 - DNA, 103 bp, Artificial Sequence
  Synthetic Polynucleotide
taatacgactcactataggggaggccggcgcggggagcacatgaagacgtaacagaggagaacgtctatgtgtgctcccaacctggcggcagcgcaaaagatg

SEQ ID NO: 157429 - DNA, 103 bp, Artificial Sequence
  Synthetic Polynucleotide
taatacgactcactatagggggcggcgcggaggttcctcgcggcccggccaacagaggagaggccggatggcgaggaacaacctggcggcagcgcaaaagatg

SEQ ID NO: 157430 - DNA, 103 bp, Artificial Sequence
  Synthetic Polynucleotide
taatacgactcactatagggcagtgacctgggggctgcccccatgcagcgaacagaggagacgctgcatgggggcagccaacctggcggcagcgcaaaagatg

SEQ ID NO: 157431 - DNA, 103 bp, Artificial Sequence
  Synthetic Polynucleotide
taatacgactcactatagggggccctgtgacagtgacctgggggctgcccaacagaggagagggcagatgccaggtcacaacctggcggcagcgcaaaagatg

SEQ ID NO: 157432 - DNA, 103 bp, Artificial Sequence
  Synthetic Polynucleotide
taatacgactcactataggggtcccgactgggccctgtgacagtgacctgaacagaggagacaggtcatggtcacagggaacctggcggcagcgcaaaagatg

SEQ ID NO: 157433 - DNA, 103 bp, Artificial Sequence
  Synthetic Polynucleotide
taatacgactcactatagggagtttgggcagtcccgactgggccctgtgaaacagaggagatcacagatgccagtcgggaacctggcggcagcgcaaaagatg

SEQ ID NO: 157434 - DNA, 103 bp, Artificial Sequence
  Synthetic Polynucleotide
taatacgactcactataggggcctgccctgagtttgggcagtcccgactgaacagaggagacagtcgatgctgcccaaaaacctggcggcagcgcaaaagatg

SEQ ID NO: 157435 - DNA, 103 bp, Artificial Sequence
  Synthetic Polynucleotide
taatacgactcactatagggacacggagaggcctgccctgagtttgggcaaacagaggagatgcccaatgtcagggcagaacctggcggcagcgcaaaagatg

SEQ ID NO: 157436 - DNA, 103 bp, Artificial Sequence
  Synthetic Polynucleotide
taatacgactcactataggggctccgatgcacacggagaggcctgccctgaacagaggagacagggcatgcctctccgtaacctggcggcagcgcaaaagatg

SEQ ID NO: 157437 - DNA, 103 bp, Artificial Sequence
  Synthetic Polynucleotide
taatacgactcactatagggctggggctctgctccgatgcacacggagagaacagaggagactctccatgtgcatcggaaacctggcggcagcgcaaaagatg

SEQ ID NO: 157438 - DNA, 103 bp, Artificial Sequence
  Synthetic Polynucleotide
taatacgactcactatagggagattgaggactggggctctgctccgatgcaacagaggagagcatcgatgcagagccccaacctggcggcagcgcaaaagatg

SEQ ID NO: 157439 - DNA, 103 bp, Artificial Sequence
  Synthetic Polynucleotide
taatacgactcactatagggtgttctggggagattgaggactggggctctaacagaggagaagagccatggtcctcaataacctggcggcagcgcaaaagatg

SEQ ID NO: 157440 - DNA, 103 bp, Artificial Sequence
  Synthetic Polynucleotide
taatacgactcactatagggatgatctgctggcggcgcggaggttcctcgaacagaggagacgaggaatgtccgcgccgaacctggcggcagcgcaaaagatg

SEQ ID NO: 157441 - DNA, 103 bp, Artificial Sequence
  Synthetic Polynucleotide
taatacgactcactatagggcctgagcagttgttctggggagattgaggaaacagaggagatcctcaatgtccccagaaaacctggcggcagcgcaaaagatg

SEQ ID NO: 157442 - DNA, 103 bp, Artificial Sequence
  Synthetic Polynucleotide
taatacgactcactataggggtcggatttccctgagcagttgttctggggaacagaggagaccccagatgaactgctcaaacctggcggcagcgcaaaagatg

SEQ ID NO: 157443 - DNA, 103 bp, Artificial Sequence
  Synthetic Polynucleotide
taatacgactcactatagggcatttttggggtcggatttccctgagcagtaacagaggagaactgctatgggaaatccgaacctggcggcagcgcaaaagatg

SEQ ID NO: 157444 - DNA, 103 bp, Artificial Sequence
  Synthetic Polynucleotide
taatacgactcactatagggagtgcagccacatttttggggtcggatttcaacagaggagagaaatcatgccccaaaaaaacctggcggcagcgcaaaagatg

SEQ ID NO: 157445 - DNA, 103 bp, Artificial Sequence
  Synthetic Polynucleotide
taatacgactcactatagggccggttctttagtgcagccacatttttgggaacagaggagacccaaaatggtggctgcaaacctggcggcagcgcaaaagatg

SEQ ID NO: 157446 - DNA, 103 bp, Artificial Sequence
  Synthetic Polynucleotide
taatacgactcactataggggcttcatctgccggttctttagtgcagccaaacagaggagatggctgatgtaaagaaccaacctggcggcagcgcaaaagatg

SEQ ID NO: 157447 - DNA, 103 bp, Artificial Sequence
  Synthetic Polynucleotide
taatacgactcactataggggctgagatgtgcttcatctgccggttctttaacagaggagaaaagaaatggcagatgaaaacctggcggcagcgcaaaagatg

SEQ ID NO: 157448 - DNA, 103 bp, Artificial Sequence
  Synthetic Polynucleotide
taatacgactcactatagggtttctgctcagctgagatgtgcttcatctgaacagaggagacagatgatgcacatctcaaacctggcggcagcgcaaaagatg

SEQ ID NO: 157449 - DNA, 103 bp, Artificial Sequence
  Synthetic Polynucleotide
taatacgactcactatagggtgaagcgccttttctgctcagctgagatgtaacagaggagaacatctatgctgagcagaaacctggcggcagcgcaaaagatg

SEQ ID NO: 157450 - DNA, 103 bp, Artificial Sequence
  Synthetic Polynucleotide
taatacgactcactatagggatcttgatgttgaagcgccttttctgctcaaacagaggagatgagcaatgaaggcgcttaacctggcggcagcgcaaaagatg

SEQ ID NO: 157451 - DNA, 103 bp, Artificial Sequence
  Synthetic Polynucleotide
taatacgactcactataggggccgctgtggatgatctgctggcggcgcggaacagaggagaccgcgcatgcagcagatcaacctggcggcagcgcaaaagatg

SEQ ID NO: 157452 - DNA, 103 bp, Artificial Sequence
  Synthetic Polynucleotide
taatacgactcactataggggtcgaagcacatcttgatgttgaagcgcctaacagaggagaaggcgcatgaacatcaagaacctggcggcagcgcaaaagatg

SEQ ID NO: 157453 - DNA, 103 bp, Artificial Sequence
  Synthetic Polynucleotide
taatacgactcactatagggtgttgagcatgtcgaagcacatcttgatgtaacagaggagaacatcaatgtgtgcttcgaacctggcggcagcgcaaaagatg

SEQ ID NO: 157454 - DNA, 103 bp, Artificial Sequence
  Synthetic Polynucleotide
taatacgactcactataggggagatgaggctgttgagcatgtcgaagcacaacagaggagagtgcttatgcatgctcaaaacctggcggcagcgcaaaagatg

SEQ ID NO: 157455 - DNA, 103 bp, Artificial Sequence
  Synthetic Polynucleotide
taatacgactcactatagggggaattgttggagatgaggctgttgagcataacagaggagaatgctcatgagcctcatcaacctggcggcagcgcaaaagatg

SEQ ID NO: 157456 - DNA, 103 bp, Artificial Sequence
  Synthetic Polynucleotide
taatacgactcactatagggtggtcagcttggaattgttggagatgaggcaacagaggagagcctcaatgccaacaattaacctggcggcagcgcaaaagatg

SEQ ID NO: 157457 - DNA, 103 bp, Artificial Sequence
  Synthetic Polynucleotide
taatacgactcactatagggatggcgtgactggtcagcttggaattgttgaacagaggagacaacaaatgcaagctgacaacctggcggcagcgcaaaagatg

SEQ ID NO: 157458 - DNA, 103 bp, Artificial Sequence
  Synthetic Polynucleotide
taatacgactcactatagggctgcagtgtgatggcgtgactggtcagcttaacagaggagaaagctgatgagtcacgccaacctggcggcagcgcaaaagatg

SEQ ID NO: 157459 - DNA, 103 bp, Artificial Sequence
  Synthetic Polynucleotide
taatacgactcactatagggccacagtcttctgcagtgtgatggcgtgacaacagaggagagtcacgatgtcacactgcaacctggcggcagcgcaaaagatg

SEQ ID NO: 157460 - DNA, 103 bp, Artificial Sequence
  Synthetic Polynucleotide
taatacgactcactataggggtgatgtactccacagtcttctgcagtgtgaacagaggagacacactatggaagactgtaacctggcggcagcgcaaaagatg

SEQ ID NO: 157461 - DNA, 103 bp, Artificial Sequence
  Synthetic Polynucleotide
taatacgactcactatagggctgcagcttggtgatgtactccacagtcttaacagaggagaaagactatggagtacatcaacctggcggcagcgcaaaagatg

SEQ ID NO: 157462 - DNA, 103 bp, Artificial Sequence
  Synthetic Polynucleotide
taatacgactcactatagggccatgaagtggccgctgtggatgatctgctaacagaggagaagcagaatgtccacagcgaacctggcggcagcgcaaaagatg

SEQ ID NO: 157463 - DNA, 103 bp, Artificial Sequence
  Synthetic Polynucleotide
taatacgactcactatagggctctctcctgctgcagcttggtgatgtactaacagaggagaagtacaatgccaagctgcaacctggcggcagcgcaaaagatg

SEQ ID NO: 157464 - DNA, 103 bp, Artificial Sequence
  Synthetic Polynucleotide
taatacgactcactatagggtgcatctggcctctctcctgctgcagcttgaacagaggagacaagctatggcaggagagaacctggcggcagcgcaaaagatg

SEQ ID NO: 157465 - DNA, 103 bp, Artificial Sequence
  Synthetic Polynucleotide
taatacgactcactatagggggcctcctcctgcatctggcctctctcctgaacagaggagacaggagatgggccagatgaacctggcggcagcgcaaaagatg

SEQ ID NO: 157466 - DNA, 103 bp, Artificial Sequence
  Synthetic Polynucleotide
taatacgactcactataggggcagccgccgggcctcctcctgcatctggcaacagaggagagccagaatgaggaggaggaacctggcggcagcgcaaaagatg

SEQ ID NO: 157467 - DNA, 103 bp, Artificial Sequence
  Synthetic Polynucleotide
taatacgactcactatagggatctcctcccgcagccgccgggcctcctccaacagaggagaggaggaatgccggcggctaacctggcggcagcgcaaaagatg

SEQ ID NO: 157468 - DNA, 103 bp, Artificial Sequence
  Synthetic Polynucleotide
taatacgactcactataggggagctcctcgatctcctcccgcagccgccgaacagaggagacggcggatgcgggaggagaacctggcggcagcgcaaaagatg

SEQ ID NO: 157469 - DNA, 103 bp, Artificial Sequence
  Synthetic Polynucleotide
taatacgactcactatagggtggtggcattgagctcctcgatctcctcccaacagaggagagggaggatgtcgaggagcaacctggcggcagcgcaaaagatg

SEQ ID NO: 157470 - DNA, 103 bp, Artificial Sequence
  Synthetic Polynucleotide
taatacgactcactatagggcaggagatgatggtggcattgagctcctcgaacagaggagacgaggaatgcaatgccacaacctggcggcagcgcaaaagatg

SEQ ID NO: 157471 - DNA, 103 bp, Artificial Sequence
  Synthetic Polynucleotide
taatacgactcactatagggcagctgctggcaggagatgatggtggcattaacagaggagaaatgccatgatcatctccaacctggcggcagcgcaaaagatg

SEQ ID NO: 157472 - DNA, 103 bp, Artificial Sequence
  Synthetic Polynucleotide
taatacgactcactatagggtggcagggagcagctgctggcaggagatgaaacagaggagatcatctatggccagcagcaacctggcggcagcgcaaaagatg

SEQ ID NO: 157473 - DNA, 103 bp, Artificial Sequence
  Synthetic Polynucleotide
taatacgactcactatagggggcgacgacaccatgaagtggccgctgtggaacagaggagaccacagatgccacttcataacctggcggcagcgcaaaagatg

SEQ ID NO: 157474 - DNA, 103 bp, Artificial Sequence
  Synthetic Polynucleotide
taatacgactcactataggggggactcccgtggcagggagcagctgctggaacagaggagaccagcaatggctccctgcaacctggcggcagcgcaaaagatg

SEQ ID NO: 157475 - DNA, 103 bp, Artificial Sequence
  Synthetic Polynucleotide
taatacgactcactatagggccgggtaacggggactcccgtggcagggagaacagaggagactccctatgacgggagtcaacctggcggcagcgcaaaagatg

SEQ ID NO: 157476 - DNA, 103 bp, Artificial Sequence
  Synthetic Polynucleotide
taatacgactcactatagggcaaactggcgccgggtaacggggactcccgaacagaggagacgggagatgccgttacccaacctggcggcagcgcaaaagatg

SEQ ID NO: 157477 - DNA, 103 bp, Artificial Sequence
  Synthetic Polynucleotide
taatacgactcactatagggttcatgtgatcaaactggcgccgggtaacgaacagaggagacgttacatggcgccagttaacctggcggcagcgcaaaagatg

SEQ ID NO: 157478 - DNA, 103 bp, Artificial Sequence
  Synthetic Polynucleotide
taatacgactcactatagggaaacatgtctttcatgtgatcaaactggcgaacagaggagacgccagatggatcacatgaacctggcggcagcgcaaaagatg

SEQ ID NO: 157479 - DNA, 103 bp, Artificial Sequence
  Synthetic Polynucleotide
taatacgactcactatagggcgtattcgtcaaacatgtctttcatgtgataacagaggagaatcacaatgaagacatgtaacctggcggcagcgcaaaagatg

SEQ ID NO: 157480 - DNA, 103 bp, Artificial Sequence
  Synthetic Polynucleotide
taatacgactcactatagggcgggttttcacgtattcgtcaaacatgtctaacagaggagaagacatatgtgacgaataaacctggcggcagcgcaaaagatg

SEQ ID NO: 157481 - DNA, 103 bp, Artificial Sequence
  Synthetic Polynucleotide
taatacgactcactatagggctgcaaggtccgggttttcacgtattcgtcaacagaggagagacgaaatggtgaaaaccaacctggcggcagcgcaaaagatg

SEQ ID NO: 157482 - DNA, 103 bp, Artificial Sequence
  Synthetic Polynucleotide
taatacgactcactatagggacttccaattctgcaaggtccgggttttcaaacagaggagatgaaaaatgggaccttgcaacctggcggcagcgcaaaagatg

SEQ ID NO: 157483 - DNA, 103 bp, Artificial Sequence
  Synthetic Polynucleotide
taatacgactcactatagggaaaatccagaacttccaattctgcaaggtcaacagaggagagaccttatggaattggaaaacctggcggcagcgcaaaagatg

SEQ ID NO: 157484 - DNA, 103 bp, Artificial Sequence
  Synthetic Polynucleotide
taatacgactcactatagggctctcggtgcggcgacgacaccatgaagtgaacagaggagacacttcatggtgtcgtcgaacctggcggcagcgcaaaagatg

SEQ ID NO: 157485 - DNA, 103 bp, Artificial Sequence
  Synthetic Polynucleotide
taatacgactcactataggggatgatgctgaaaatccagaacttccaattaacagaggagaaattggatgttctggattaacctggcggcagcgcaaaagatg

SEQ ID NO: 157486 - DNA, 103 bp, Artificial Sequence
  Synthetic Polynucleotide
taatacgactcactataggggcggcttgatgatgatgctgaaaatccagaaacagaggagatctggaatgtcagcatcaaacctggcggcagcgcaaaagatg

SEQ ID NO: 157487 - DNA, 103 bp, Artificial Sequence
  Synthetic Polynucleotide
taatacgactcactataggggactcaaacagcggcttgatgatgatgctgaacagaggagacagcatatgcatcaagccaacctggcggcagcgcaaaagatg

SEQ ID NO: 157488 - DNA, 103 bp, Artificial Sequence
  Synthetic Polynucleotide
taatacgactcactataggggcccttgaacgactcaaacagcggcttgataacagaggagaatcaagatgctgtttgagaacctggcggcagcgcaaaagatg

SEQ ID NO: 157489 - DNA, 103 bp, Artificial Sequence
  Synthetic Polynucleotide
taatacgactcactatagggtggacaccatgcccttgaacgactcaaacaaacagaggagatgtttgatgcgttcaaggaacctggcggcagcgcaaaagatg

SEQ ID NO: 157490 - DNA, 103 bp, Artificial Sequence
  Synthetic Polynucleotide
taatacgactcactatagggaggctgctggtggacaccatgcccttgaacaacagaggagagttcaaatgcatggtgtcaacctggcggcagcgcaaaagatg

SEQ ID NO: 157491 - DNA, 103 bp, Artificial Sequence
  Synthetic Polynucleotide
taatacgactcactatagggcagctcctccaggctgctggtggacaccataacagaggagaatggtgatgaccagcagcaacctggcggcagcgcaaaagatg

SEQ ID NO: 157492 - DNA, 103 bp, Artificial Sequence
  Synthetic Polynucleotide
taatacgactcactatagggccgtccggtgcagctcctccaggctgctggaacagaggagaccagcaatgtggaggagcaacctggcggcagcgcaaaagatg

SEQ ID NO: 157493 - DNA, 103 bp, Artificial Sequence
  Synthetic Polynucleotide
taatacgactcactatagggcaggagagcgccgtccggtgcagctcctccaacagaggagaggaggaatggcaccggacaacctggcggcagcgcaaaagatg

SEQ ID NO: 157494 - DNA, 103 bp, Artificial Sequence
  Synthetic Polynucleotide
taatacgactcactatagggctggtccagccaggagagcgccgtccggtgaacagaggagacaccggatggcgctctccaacctggcggcagcgcaaaagatg

SEQ ID NO: 157495 - DNA, 103 bp, Artificial Sequence
  Synthetic Polynucleotide
taatacgactcactatagggtgggcgggtgctctcggtgcggcgacgacaaacagaggagatgtcgtatgcgcaccgagaacctggcggcagcgcaaaagatg

SEQ ID NO: 157496 - DNA, 103 bp, Artificial Sequence
  Synthetic Polynucleotide
taatacgactcactataggggggagcagtgctggtccagccaggagagcgaacagaggagacgctctatgggctggaccaacctggcggcagcgcaaaagatg

SEQ ID NO: 157497 - DNA, 103 bp, Artificial Sequence
  Synthetic Polynucleotide
taatacgactcactatagggaggatgggcagggagcagtgctggtccagcaacagaggagagctggaatggcactgctcaacctggcggcagcgcaaaagatg

SEQ ID NO: 157498 - DNA, 103 bp, Artificial Sequence
  Synthetic Polynucleotide
taatacgactcactatagggcatcggcctgaggatgggcagggagcagtgaacagaggagacactgcatgctgcccatcaacctggcggcagcgcaaaagatg

SEQ ID NO: 157499 - DNA, 103 bp, Artificial Sequence
  Synthetic Polynucleotide
taatacgactcactatagggtgctcaataccatcggcctgaggatgggcaaacagaggagatgcccaatgtcaggccgaaacctggcggcagcgcaaaagatg

SEQ ID NO: 157500 - DNA, 103 bp, Artificial Sequence
  Synthetic Polynucleotide
taatacgactcactatagggtgccgcagcgtgctcaataccatcggcctgaacagaggagacaggccatgggtattgagaacctggcggcagcgcaaaagatg

SEQ ID NO: 157501 - DNA, 103 bp, Artificial Sequence
  Synthetic Polynucleotide
taatacgactcactatagggggtgctcagctgccgcagcgtgctcaatacaacagaggagagtattgatgacgctgcggaacctggcggcagcgcaaaagatg

SEQ ID NO: 157502 - DNA, 103 bp, Artificial Sequence
  Synthetic Polynucleotide
taatacgactcactatagggtggaggtggaggtgctcagctgccgcagcgaacagaggagacgctgcatgagctgagcaaacctggcggcagcgcaaaagatg

SEQ ID NO: 157503 - DNA, 103 bp, Artificial Sequence
  Synthetic Polynucleotide
taatacgactcactatagggtctgtgaggatggaggtggaggtgctcagcaacagaggagagctgagatgctccacctcaacctggcggcagcgcaaaagatg

SEQ ID NO: 157504 - DNA, 103 bp, Artificial Sequence
  Synthetic Polynucleotide
taatacgactcactatagggctgtgccgggtctgtgaggatggaggtggaaacagaggagatccaccatgatcctcacaaacctggcggcagcgcaaaagatg

SEQ ID NO: 157505 - DNA, 103 bp, Artificial Sequence
  Synthetic Polynucleotide
taatacgactcactataggggctctggcagctgtgccgggtctgtgaggaaacagaggagatcctcaatgacccggcacaacctggcggcagcgcaaaagatg

SEQ ID NO: 157506 - DNA, 103 bp, Artificial Sequence
  Synthetic Polynucleotide
taatacgactcactatagggtagcccttcttgggcgggtgctctcggtgcaacagaggagagcaccgatggcacccgccaacctggcggcagcgcaaaagatg

SEQ ID NO: 157507 - DNA, 103 bp, Artificial Sequence
  Synthetic Polynucleotide
taatacgactcactatagggttggacgcctgctctggcagctgtgccgggaacagaggagacccggcatggctgccagaaacctggcggcagcgcaaaagatg

SEQ ID NO: 157508 - DNA, 103 bp, Artificial Sequence
  Synthetic Polynucleotide
taatacgactcactatagggggtgacagccttggacgcctgctctggcagaacagaggagactgccaatgcaggcgtccaacctggcggcagcgcaaaagatg

SEQ ID NO: 157509 - DNA, 103 bp, Artificial Sequence
  Synthetic Polynucleotide
taatacgactcactatagggtgccaatcctggtgacagccttggacgcctaacagaggagaaggcgtatgaggctgtcaaacctggcggcagcgcaaaagatg

SEQ ID NO: 157510 - DNA, 103 bp, Artificial Sequence
  Synthetic Polynucleotide
taatacgactcactatagggcccaatctcttgccaatcctggtgacagccaacagaggagaggctgtatgcaggattggaacctggcggcagcgcaaaagatg

SEQ ID NO: 157511 - DNA, 103 bp, Artificial Sequence
  Synthetic Polynucleotide
taatacgactcactatagggctaggactctcccaatctcttgccaatcctaacagaggagaaggattatgaagagattgaacctggcggcagcgcaaaagatg

SEQ ID NO: 157512 - DNA, 103 bp, Artificial Sequence
  Synthetic Polynucleotide
taatacgactcactataggggtcgaaatcgtagcccttcttgggcgggtgaacagaggagacacccgatgaagaagggcaacctggcggcagcgcaaaagatg

SEQ ID NO: 157513 - DNA, 103 bp, Artificial Sequence
  Synthetic Polynucleotide
taatacgactcactatagggtgttgaccgtgtcgaaatcgtagcccttctaacagaggagaagaaggatgacgatttcgaacctggcggcagcgcaaaagatg

SEQ ID NO: 157514 - DNA, 103 bp, Artificial Sequence
  Synthetic Polynucleotide
taatacgactcactatagggccccggctgcgaggccggcgcggggagcacaacagaggagagtgctcatggcgccggccaacctggcggcagcgcaaaagatg

SEQ ID NO: 157515 - DNA, 103 bp, Artificial Sequence
  Synthetic Polynucleotide
taatacgactcactatagggcacgtctgtttgttgaccgtgtcgaaatcgaacagaggagacgatttatgcacggtcaaaacctggcggcagcgcaaaagatg

SEQ ID NO: 157516 - DNA, 103 bp, Artificial Sequence
  Synthetic Polynucleotide
taatacgactcactataggggtaggtctggcacgtctgtttgttgaccgtaacagaggagaacggtcatgaaacagacgaacctggcggcagcgcaaaagatg

SEQ ID NO: 157517 - DNA, 103 bp, Artificial Sequence
  Synthetic Polynucleotide
taatacgactcactatagggtgccgaagctgtaggtctggcacgtctgttaacagaggagaaacagaatggccagacctaacctggcggcagcgcaaaagatg

SEQ ID NO: 157518 - DNA, 103 bp, Artificial Sequence
  Synthetic Polynucleotide
taatacgactcactataggggagctagtcttgccgaagctgtaggtctggaacagaggagaccagacatgcagcttcggaacctggcggcagcgcaaaagatg

SEQ ID NO: 157519 - DNA, 103 bp, Artificial Sequence
  Synthetic Polynucleotide
taatacgactcactatagggcaggtggcaggagctagtcttgccgaagctaacagaggagaagcttcatgaagactagcaacctggcggcagcgcaaaagatg

SEQ ID NO: 157520 - DNA, 103 bp, Artificial Sequence
  Synthetic Polynucleotide
taatacgactcactatagggcgtcgatggacaggtggcaggagctagtctaacagaggagaagactaatgcctgccaccaacctggcggcagcgcaaaagatg

SEQ ID NO: 157521 - DNA, 103 bp, Artificial Sequence
  Synthetic Polynucleotide
taatacgactcactataggggtgagcgaggcgtcgatggacaggtggcagaacagaggagactgccaatggtccatcgaaacctggcggcagcgcaaaagatg

SEQ ID NO: 157522 - DNA, 103 bp, Artificial Sequence
  Synthetic Polynucleotide
taatacgactcactataggggaagagcttggtgagcgaggcgtcgatggaaacagaggagatccatcatggcctcgctcaacctggcggcagcgcaaaagatg

SEQ ID NO: 157523 - DNA, 103 bp, Artificial Sequence
  Synthetic Polynucleotide
taatacgactcactatagggtcatgcactcgaagagcttggtgagcgaggaacagaggagacctcgcatgccaagctctaacctggcggcagcgcaaaagatg

SEQ ID NO: 157524 - DNA, 103 bp, Artificial Sequence
  Synthetic Polynucleotide
taatacgactcactatagggtaggccaaagtcatgcactcgaagagcttgaacagaggagacaagctatgcgagtgcataacctggcggcagcgcaaaagatg

SEQ ID NO: 157525 - DNA, 103 bp, Artificial Sequence
  Synthetic Polynucleotide
taatacgactcactatagggcacctggcggccccggctgcgaggccggcgaacagaggagacgccggatgcgcagccggaacctggcggcagcgcaaaagatg

SEQ ID NO: 157526 - DNA, 103 bp, Artificial Sequence
  Synthetic Polynucleotide
taatacgactcactatagggcttcccactgtaggccaaagtcatgcactcaacagaggagagagtgcatgactttggccaacctggcggcagcgcaaaagatg

SEQ ID NO: 157527 - DNA, 103 bp, Artificial Sequence
  Synthetic Polynucleotide
taatacgactcactataggggagacaccaacttcccactgtaggccaaagaacagaggagactttggatgacagtgggaaacctggcggcagcgcaaaagatg

SEQ ID NO: 157528 - DNA, 103 bp, Artificial Sequence
  Synthetic Polynucleotide
taatacgactcactatagggttccactttggagacaccaacttcccactgaacagaggagacagtggatggttggtgtcaacctggcggcagcgcaaaagatg

SEQ ID NO: 157529 - DNA, 103 bp, Artificial Sequence
  Synthetic Polynucleotide
taatacgactcactatagggcttgaaattcttccactttggagacaccaaaacagaggagattggtgatgccaaagtggaacctggcggcagcgcaaaagatg

SEQ ID NO: 157530 - DNA, 103 bp, Artificial Sequence
  Synthetic Polynucleotide
taatacgactcactataggggcttcaggcccttgaaattcttccactttgaacagaggagacaaagtatgagaatttcaaacctggcggcagcgcaaaagatg

SEQ ID NO: 157531 - DNA, 103 bp, Artificial Sequence
  Synthetic Polynucleotide
taatacgactcactatagggctccactgtagcttcaggcccttgaaattcaacagaggagagaatttatggggcctgaaaacctggcggcagcgcaaaagatg

SEQ ID NO: 157532 - DNA, 103 bp, Artificial Sequence
  Synthetic Polynucleotide
taatacgactcactataggggatcttgtctctccactgtagcttcaggccaacagaggagaggcctgatgctacagtggaacctggcggcagcgcaaaagatg

SEQ ID NO: 157533 - DNA, 103 bp, Artificial Sequence
  Synthetic Polynucleotide
taatacgactcactatagggtattgagccggatcttgtctctccactgtaaacagaggagatacagtatggagacaagaaacctggcggcagcgcaaaagatg

SEQ ID NO: 157534 - DNA, 103 bp, Artificial Sequence
  Synthetic Polynucleotide
taatacgactcactatagggcagatggcattattgagccggatcttgtctaacagaggagaagacaaatgccggctcaaaacctggcggcagcgcaaaagatg

SEQ ID NO: 157535 - DNA, 103 bp, Artificial Sequence
  Synthetic Polynucleotide
taatacgactcactatagggccaggcccgccagatggcattattgagccgaacagaggagacggctcatgaatgccatcaacctggcggcagcgcaaaagatg

SEQ ID NO: 157536 - DNA, 103 bp, Artificial Sequence
  Synthetic Polynucleotide
taatacgactcactataggggcttgagcagcacctggcggccccggctgcaacagaggagagcagccatggccgccaggaacctggcggcagcgcaaaagatg

SEQ ID NO: 157537 - DNA, 103 bp, Artificial Sequence
  Synthetic Polynucleotide
taatacgactcactatagggactgcatgtaccaggcccgccagatggcataacagaggagaatgccaatgggcgggcctaacctggcggcagcgcaaaagatg

SEQ ID NO: 157538 - DNA, 103 bp, Artificial Sequence
  Synthetic Polynucleotide
taatacgactcactatagggttctccagatactgcatgtaccaggcccgcaacagaggagagcgggcatggtacatgcaaacctggcggcagcgcaaaagatg

SEQ ID NO: 157539 - DNA, 103 bp, Artificial Sequence
  Synthetic Polynucleotide
taatacgactcactatagggattcttgcgcttctccagatactgcatgtaaacagaggagatacatgatgtatctggagaacctggcggcagcgcaaaagatg

SEQ ID NO: 157540 - DNA, 103 bp, Artificial Sequence
  Synthetic Polynucleotide
taatacgactcactatagggggcacacaggattcttgcgcttctccagataacagaggagaatctggatgagcgcaagaaacctggcggcagcgcaaaagatg

SEQ ID NO: 157541 - DNA, 103 bp, Artificial Sequence
  Synthetic Polynucleotide
taatacgactcactataggggtcacaaagtggcacacaggattcttgcgcaacagaggagagcgcaaatgtcctgtgtgaacctggcggcagcgcaaaagatg

SEQ ID NO: 157542 - DNA, 103 bp, Artificial Sequence
  Synthetic Polynucleotide
taatacgactcactataggggtccaggggtgtcacaaagtggcacacaggaacagaggagacctgtgatgcactttgtgaacctggcggcagcgcaaaagatg

SEQ ID NO: 157543 - DNA, 103 bp, Artificial Sequence
  Synthetic Polynucleotide
taatacgactcactatagggccacagagccgtccaggggtgtcacaaagtaacagaggagaactttgatgcacccctggaacctggcggcagcgcaaaagatg

SEQ ID NO: 157544 - DNA, 103 bp, Artificial Sequence
  Synthetic Polynucleotide
taatacgactcactatagggtcgtctacgtccacagagccgtccaggggtaacagaggagaacccctatgcggctctgtaacctggcggcagcgcaaaagatg

SEQ ID NO: 157545 - DNA, 103 bp, Artificial Sequence
  Synthetic Polynucleotide
taatacgactcactatagggccggcggtgctcgtctacgtccacagagccaacagaggagaggctctatggacgtagacaacctggcggcagcgcaaaagatg

SEQ ID NO: 157546 - DNA, 103 bp, Artificial Sequence
  Synthetic Polynucleotide
taatacgactcactatagggtggcctccggccggcggtgctcgtctacgtaacagaggagaacgtagatgagcaccgccaacctggcggcagcgcaaaagatg

SEQ ID NO: 157547 - DNA, 103 bp, Artificial Sequence
  Synthetic Polynucleotide
taatacgactcactataggggacacctggggcttgagcagcacctggcggaacagaggagaccgccaatggctgctcaaaacctggcggcagcgcaaaagatg

SEQ ID NO: 157548 - DNA, 103 bp, Artificial Sequence
  Synthetic Polynucleotide
taatacgactcactatagggtccgtggtgatggcctccggccggcggtgcaacagaggagagcaccgatggccggaggcaacctggcggcagcgcaaaagatg

SEQ ID NO: 157549 - DNA, 103 bp, Artificial Sequence
  Synthetic Polynucleotide
taatacgactcactataggggtacttcccttccgtggtgatggcctccggaacagaggagaccggagatgatcaccacgaacctggcggcagcgcaaaagatg

SEQ ID NO: 157550 - DNA, 103 bp, Artificial Sequence
  Synthetic Polynucleotide
taatacgactcactatagggggctcttccagtacttcccttccgtggtgaaacagaggagatcaccaatgaagggaagtaacctggcggcagcgcaaaagatg

SEQ ID NO: 157551 - DNA, 103 bp, Artificial Sequence
  Synthetic Polynucleotide
taatacgactcactatagggatctcgatgcggctcttccagtacttccctaacagaggagaagggaaatgctggaagagaacctggcggcagcgcaaaagatg

SEQ ID NO: 157552 - DNA, 103 bp, Artificial Sequence
  Synthetic Polynucleotide
taatacgactcactatagggccggatcacaatctcgatgcggctcttccaaacagaggagatggaagatgcgcatcgagaacctggcggcagcgcaaaagatg

SEQ ID NO: 157553 - DNA, 103 bp, Artificial Sequence
  Synthetic Polynucleotide
taatacgactcactatagggtgtgatactcccggatcacaatctcgatgcaacagaggagagcatcgatgttgtgatccaacctggcggcagcgcaaaagatg

SEQ ID NO: 157554 - DNA, 103 bp, Artificial Sequence
  Synthetic Polynucleotide
taatacgactcactataggggttctccacttgtgatactcccggatcacaaacagaggagatgtgatatgggagtatcaaacctggcggcagcgcaaaagatg

SEQ ID NO: 157555 - DNA, 103 bp, Artificial Sequence
  Synthetic Polynucleotide
taatacgactcactatagggcttgaagtaggttctccacttgtgatactcaacagaggagagagtatatgaagtggagaaacctggcggcagcgcaaaagatg

SEQ ID NO: 157556 - DNA, 103 bp, Artificial Sequence
  Synthetic Polynucleotide
taatacgactcactataggggtagccttttcttgaagtaggttctccactaacagaggagaagtggaatgcctacttcaaacctggcggcagcgcaaaagatg

SEQ ID NO: 157557 - DNA, 103 bp, Artificial Sequence
  Synthetic Polynucleotide
taatacgactcactatagggttgtgctgctgtagccttttcttgaagtagaacagaggagactacttatggaaaaggctaacctggcggcagcgcaaaagatg

SEQ ID NO: 157558 - DNA, 103 bp, Artificial Sequence
  Synthetic Polynucleotide
taatacgactcactataggggtcgtcctcggacacctggggcttgagcagaacagaggagactgctcatgccccaggtgaacctggcggcagcgcaaaagatg

SEQ ID NO: 157559 - DNA, 103 bp, Artificial Sequence
  Synthetic Polynucleotide
taatacgactcactataggggtcctcatccttgtgctgctgtagccttttaacagaggagaaaaaggatgcagcagcacaacctggcggcagcgcaaaagatg

SEQ ID NO: 157560 - DNA, 103 bp, Artificial Sequence
  Synthetic Polynucleotide
taatacgactcactatagggggctggagaggtcctcatccttgtgctgctaacagaggagaagcagcatgaggatgaggaacctggcggcagcgcaaaagatg

SEQ ID NO: 157561 - DNA, 103 bp, Artificial Sequence
  Synthetic Polynucleotide
taatacgactcactatagggtcctggaccaggctggagaggtcctcatccaacagaggagaggatgaatgcctctccagaacctggcggcagcgcaaaagatg

SEQ ID NO: 157562 - DNA, 103 bp, Artificial Sequence
  Synthetic Polynucleotide
taatacgactcactatagggcatgtcatcgtcctggaccaggctggagagaacagaggagactctccatgctggtccagaacctggcggcagcgcaaaagatg

SEQ ID NO: 157563 - DNA, 103 bp, Artificial Sequence
  Synthetic Polynucleotide
taatacgactcactataggggccaatacagcatgtcatcgtcctggaccaaacagaggagatggtccatgacgatgacaaacctggcggcagcgcaaaagatg

SEQ ID NO: 157564 - DNA, 103 bp, Artificial Sequence
  Synthetic Polynucleotide
taatacgactcactatagggccgtgcttgtgccaatacagcatgtcatcgaacagaggagacgatgaatggctgtattgaacctggcggcagcgcaaaagatg

SEQ ID NO: 157565 - DNA, 103 bp, Artificial Sequence
  Synthetic Polynucleotide
taatacgactcactatagggccatccatccccgtgcttgtgccaatacagaacagaggagactgtatatgcacaagcacaacctggcggcagcgcaaaagatg

SEQ ID NO: 157566 - DNA, 103 bp, Artificial Sequence
  Synthetic Polynucleotide
taatacgactcactatagggcgggggtcttccatccatccccgtgcttgtaacagaggagaacaagcatggggatggataacctggcggcagcgcaaaagatg

SEQ ID NO: 157567 - DNA, 103 bp, Artificial Sequence
  Synthetic Polynucleotide
taatacgactcactatagggtccatggggacgggggtcttccatccatccaacagaggagaggatggatggaagaccccaacctggcggcagcgcaaaagatg

SEQ ID NO: 157568 - DNA, 103 bp, Artificial Sequence
  Synthetic Polynucleotide
taatacgactcactataggggggatcctcctccatggggacgggggtcttaacagaggagaaagaccatggtccccatgaacctggcggcagcgcaaaagatg

SEQ ID NO: 157569 - DNA, 103 bp, Artificial Sequence
  Synthetic Polynucleotide
taatacgactcactatagggccgagtcgtcgtcgtcctcggacacctgggaacagaggagacccaggatgccgaggacgaacctggcggcagcgcaaaagatg

SEQ ID NO: 157570 - DNA, 103 bp, Artificial Sequence
  Synthetic Polynucleotide
taatacgactcactatagggtgtccagcaggggatcctcctccatggggaaacagaggagatccccaatgaggaggatcaacctggcggcagcgcaaaagatg

SEQ ID NO: 157571 - DNA, 103 bp, Artificial Sequence
  Synthetic Polynucleotide
taatacgactcactatagggagcatgtctgtgtccagcaggggatcctccaacagaggagaggaggaatgcctgctggaaacctggcggcagcgcaaaagatg

SEQ ID NO: 157572 - DNA, 103 bp, Artificial Sequence
  Synthetic Polynucleotide
taatacgactcactatagggttccgacatgagcatgtctgtgtccagcagaacagaggagactgctgatgacagacatgaacctggcggcagcgcaaaagatg

SEQ ID NO: 157573 - DNA, 103 bp, Artificial Sequence
  Synthetic Polynucleotide
taatacgactcactatagggtgtcgctgaattccgacatgagcatgtctgaacagaggagacagacaatgtcatgtcggaacctggcggcagcgcaaaagatg

SEQ ID NO: 157574 - DNA, 103 bp, Artificial Sequence
  Synthetic Polynucleotide
taatacgactcactataggggagaagagggtgtcgctgaattccgacatgaacagaggagacatgtcatgattcagcgaaacctggcggcagcgcaaaagatg

SEQ ID NO: 157575 - DNA, 103 bp, Artificial Sequence
  Synthetic Polynucleotide
taatacgactcactatagggagaaagtgtggagaagagggtgtcgctgaaaacagaggagattcagcatgaccctcttcaacctggcggcagcgcaaaagatg

SEQ ID NO: 157576 - DNA, 103 bp, Artificial Sequence
  Synthetic Polynucleotide
taatacgactcactataggggctggtgtgaagaaagtgtggagaagagggaacagaggagaccctctatgccacactttaacctggcggcagcgcaaaagatg

SEQ ID NO: 157577 - DNA, 103 bp, Artificial Sequence
  Synthetic Polynucleotide
taatacgactcactatagggcaggccaccggctggtgtgaagaaagtgtgaacagaggagacacactatgttcacaccaaacctggcggcagcgcaaaagatg

SEQ ID NO: 157578 - DNA, 103 bp, Artificial Sequence
  Synthetic Polynucleotide
taatacgactcactataggggggattgggccaggccaccggctggtgtgaaacagaggagatcacacatgccggtggccaacctggcggcagcgcaaaagatg

SEQ ID NO: 157579 - DNA, 103 bp, Artificial Sequence
  Synthetic Polynucleotide
taatacgactcactatagggctatttcccggggattgggccaggccaccgaacagaggagacggtggatgggcccaatcaacctggcggcagcgcaaaagatg

SEQ ID NO: 157580 - DNA, 103 bp, Artificial Sequence
  Synthetic Polynucleotide
taatacgactcactatagggtcatccgtgtccgagtcgtcgtcgtcctcgaacagaggagacgaggaatgcgacgactcaacctggcggcagcgcaaaagatg

SEQ ID NO: 157581 - DNA, 103 bp, Artificial Sequence
  Synthetic Polynucleotide
taatacgactcactatagggcccagatgtgctatttcccggggattgggcaacagaggagagcccaaatgccgggaaataacctggcggcagcgcaaaagatg

SEQ ID NO: 157582 - DNA, 103 bp, Artificial Sequence
  Synthetic Polynucleotide
taatacgactcactataggggtctgcatttcccagatgtgctatttcccgaacagaggagacgggaaatggcacatctgaacctggcggcagcgcaaaagatg

SEQ ID NO: 157583 - DNA, 103 bp, Artificial Sequence
  Synthetic Polynucleotide
taatacgactcactataggggctggatcatgtctgcatttcccagatgtgaacagaggagacacatcatggaaatgcagaacctggcggcagcgcaaaagatg

SEQ ID NO: 157584 - DNA, 103 bp, Artificial Sequence
  Synthetic Polynucleotide
taatacgactcactatagggatcagtcccggctggatcatgtctgcatttaacagaggagaaaatgcatgcatgatccaaacctggcggcagcgcaaaagatg

SEQ ID NO: 157585 - DNA, 103 bp, Artificial Sequence
  Synthetic Polynucleotide
taatacgactcactatagggctgcaaaggaatcagtcccggctggatcataacagaggagaatgatcatgccgggactgaacctggcggcagcgcaaaagatg

SEQ ID NO: 157586 - DNA, 103 bp, Artificial Sequence
  Synthetic Polynucleotide
taatacgactcactatagggccaggttaggctgcaaaggaatcagtcccgaacagaggagacgggacatgttcctttgcaacctggcggcagcgcaaaagatg

SEQ ID NO: 157587 - DNA, 103 bp, Artificial Sequence
  Synthetic Polynucleotide
taatacgactcactatagggtccatgaagtccaggttaggctgcaaaggaaacagaggagatcctttatggcctaacctaacctggcggcagcgcaaaagatg

SEQ ID NO: 157588 - DNA, 103 bp, Artificial Sequence
  Synthetic Polynucleotide
taatacgactcactatagggctcaaaggtgtccatgaagtccaggttaggaacagaggagacctaacatggacttcatgaacctggcggcagcgcaaaagatg

SEQ ID NO: 157589 - DNA, 103 bp, Artificial Sequence
  Synthetic Polynucleotide
taatacgactcactatagggcctggaaaggctcaaaggtgtccatgaagtaacagaggagaacttcaatgacacctttgaacctggcggcagcgcaaaagatg

SEQ ID NO: 157590 - DNA, 103 bp, Artificial Sequence
  Synthetic Polynucleotide
taatacgactcactataggggagaagaggtcctggaaaggctcaaaggtgaacagaggagacaccttatggcctttccaaacctggcggcagcgcaaaagatg

SEQ ID NO: 157591 - DNA, 103 bp, Artificial Sequence
  Synthetic Polynucleotide
taatacgactcactatagggcgcggccagacctgccagcgcgccggccataacagaggagaatggccatggcgctggcaaacctggcggcagcgcaaaagatg

SEQ ID NO: 157592 - DNA, 103 bp, Artificial Sequence
  Synthetic Polynucleotide
taatacgactcactataggggccgcccgcgctgcgccggagactcgggtcaacagaggagagacccgatgctccggcgcaacctggcggcagcgcaaaagatg

SEQ ID NO: 157593 - DNA, 103 bp, Artificial Sequence
  Synthetic Polynucleotide
taatacgactcactatagggcacctctgggcccagggtcccactgctgaaaacagaggagattcagcatggggaccctgaacctggcggcagcgcaaaagatg

SEQ ID NO: 157594 - DNA, 103 bp, Artificial Sequence
  Synthetic Polynucleotide
taatacgactcactatagggaagccgggggcacctctgggcccagggtccaacagaggagaggacccatggcccagaggaacctggcggcagcgcaaaagatg

SEQ ID NO: 157595 - DNA, 103 bp, Artificial Sequence
  Synthetic Polynucleotide
taatacgactcactatagggatggccgaggaagccgggggcacctctgggaacagaggagacccagaatggcccccggcaacctggcggcagcgcaaaagatg

SEQ ID NO: 157596 - DNA, 103 bp, Artificial Sequence
  Synthetic Polynucleotide
taatacgactcactataggggaggtgggtcatggccgaggaagccgggggaacagaggagacccccgatgtcctcggccaacctggcggcagcgcaaaagatg

SEQ ID NO: 157597 - DNA, 103 bp, Artificial Sequence
  Synthetic Polynucleotide
taatacgactcactatagggtgtgtccagagaggtgggtcatggccgaggaacagaggagacctcggatgtgacccaccaacctggcggcagcgcaaaagatg

SEQ ID NO: 157598 - DNA, 103 bp, Artificial Sequence
  Synthetic Polynucleotide
taatacgactcactatagggtgcagacggctgtgtccagagaggtgggtcaacagaggagagacccaatgctctggacaaacctggcggcagcgcaaaagatg

SEQ ID NO: 157599 - DNA, 103 bp, Artificial Sequence
  Synthetic Polynucleotide
taatacgactcactataggggttccgagcctgcagacggctgtgtccagaaacagaggagatctggaatgagccgtctgaacctggcggcagcgcaaaagatg

SEQ ID NO: 157600 - DNA, 103 bp, Artificial Sequence
  Synthetic Polynucleotide
taatacgactcactatagggcagggcagctgttccgagcctgcagacggcaacagaggagagccgtcatgaggctcggaaacctggcggcagcgcaaaagatg

SEQ ID NO: 157601 - DNA, 103 bp, Artificial Sequence
  Synthetic Polynucleotide
taatacgactcactatagggtccaaggggccagggcagctgttccgagccaacagaggagaggctcgatgcagctgcccaacctggcggcagcgcaaaagatg

SEQ ID NO: 157602 - DNA, 103 bp, Artificial Sequence
  Synthetic Polynucleotide
taatacgactcactatagggggcgctggagtccaaggggccagggcagctaacagaggagaagctgcatgggccccttgaacctggcggcagcgcaaaagatg

SEQ ID NO: 157603 - DNA, 103 bp, Artificial Sequence
  Synthetic Polynucleotide
taatacgactcactatagggagcggagcaagccgcccgcgctgcgccggaaacagaggagatccggcatggcgcgggcgaacctggcggcagcgcaaaagatg

SEQ ID NO: 157604 - DNA, 103 bp, Artificial Sequence
  Synthetic Polynucleotide
taatacgactcactatagggaactcaggaaggcgctggagtccaaggggcaacagaggagagcccctatgactccagcgaacctggcggcagcgcaaaagatg

SEQ ID NO: 157605 - DNA, 103 bp, Artificial Sequence
  Synthetic Polynucleotide
taatacgactcactatagggaggaaatcagaactcaggaaggcgctggagaacagaggagactccagatgcttcctgagaacctggcggcagcgcaaaagatg

SEQ ID NO: 157606 - DNA, 103 bp, Artificial Sequence
  Synthetic Polynucleotide
taatacgactcactatagggttcaggaaggaggaaatcagaactcaggaaaacagaggagattcctgatgtctgatttcaacctggcggcagcgcaaaagatg

SEQ ID NO: 157607 - DNA, 103 bp, Artificial Sequence
  Synthetic Polynucleotide
taatacgactcactataggggcttggggtcttcaggaaggaggaaatcagaacagaggagactgattatgtccttcctgaacctggcggcagcgcaaaagatg

SEQ ID NO: 157608 - DNA, 103 bp, Artificial Sequence
  Synthetic Polynucleotide
taatacgactcactataggggggagccggggcttggggtcttcaggaaggaacagaggagaccttccatgagaccccaaaacctggcggcagcgcaaaagatg

SEQ ID NO: 157609 - DNA, 103 bp, Artificial Sequence
  Synthetic Polynucleotide
taatacgactcactatagggaggagggggtgggagccggggcttggggtcaacagaggagagaccccatgccccggctcaacctggcggcagcgcaaaagatg

SEQ ID NO: 157610 - DNA, 103 bp, Artificial Sequence
  Synthetic Polynucleotide
taatacgactcactataggggtgggggtacaggagggggtgggagccgggaacagaggagacccggcatgcaccccctcaacctggcggcagcgcaaaagatg

SEQ ID NO: 157611 - DNA, 103 bp, Artificial Sequence
  Synthetic Polynucleotide
taatacgactcactatagggtgcagcagaggtgggggtacaggagggggtaacagaggagaacccccatgtgtacccccaacctggcggcagcgcaaaagatg

SEQ ID NO: 157612 - DNA, 103 bp, Artificial Sequence
  Synthetic Polynucleotide
taatacgactcactataggggggagggtaatgcagcagaggtgggggtacaacagaggagagtacccatgcctctgctgaacctggcggcagcgcaaaagatg

SEQ ID NO: 157613 - DNA, 103 bp, Artificial Sequence
  Synthetic Polynucleotide
taatacgactcactatagggccttggcagggggagggtaatgcagcagagaacagaggagactctgcatgattaccctcaacctggcggcagcgcaaaagatg

SEQ ID NO: 157614 - DNA, 103 bp, Artificial Sequence
  Synthetic Polynucleotide
taatacgactcactatagggatgacctgcgagcggagcaagccgcccgcgaacagaggagacgcgggatgcttgctccgaacctggcggcagcgcaaaagatg

SEQ ID NO: 157615 - DNA, 103 bp, Artificial Sequence
  Synthetic Polynucleotide
taatacgactcactatagggaggcctggcaccttggcagggggagggtaaaacagaggagattacccatgccctgccaaaacctggcggcagcgcaaaagatg

SEQ ID NO: 157616 - DNA, 103 bp, Artificial Sequence
  Synthetic Polynucleotide
taatacgactcactataggggcagggctccaggcctggcaccttggcaggaacagaggagacctgccatggtgccaggcaacctggcggcagcgcaaaagatg

SEQ ID NO: 157617 - DNA, 103 bp, Artificial Sequence
  Synthetic Polynucleotide
taatacgactcactataggggaggtggggggcagggctccaggcctggcaaacagaggagatgccagatgtggagccctaacctggcggcagcgcaaaagatg

SEQ ID NO: 157618 - DNA, 103 bp, Artificial Sequence
  Synthetic Polynucleotide
taatacgactcactatagggggagggaagggaggtggggggcagggctccaacagaggagaggagccatgccccccaccaacctggcggcagcgcaaaagatg

SEQ ID NO: 157619 - DNA, 103 bp, Artificial Sequence
  Synthetic Polynucleotide
taatacgactcactatagggtggtgccatgggagggaagggaggtgggggaacagaggagacccccaatgcccttccctaacctggcggcagcgcaaaagatg

SEQ ID NO: 157620 - DNA, 103 bp, Artificial Sequence
  Synthetic Polynucleotide
taatacgactcactatagggaagcagtgggtggtgccatgggagggaaggaacagaggagaccttccatgccatggcacaacctggcggcagcgcaaaagatg

SEQ ID NO: 157621 - DNA, 103 bp, Artificial Sequence
  Synthetic Polynucleotide
taatacgactcactatagggtcctgcagcaaagcagtgggtggtgccatgaacagaggagacatggcatgacccactgcaacctggcggcagcgcaaaagatg

SEQ ID NO: 157622 - DNA, 103 bp, Artificial Sequence
  Synthetic Polynucleotide
taatacgactcactataggggagaggctcttcctgcagcaaagcagtgggaacagaggagacccactatgttgctgcagaacctggcggcagcgcaaaagatg

SEQ ID NO: 157623 - DNA, 103 bp, Artificial Sequence
  Synthetic Polynucleotide
taatacgactcactatagggtgggagagaagagaggctcttcctgcagcaaacagaggagatgctgcatgaagagcctcaacctggcggcagcgcaaaagatg

SEQ ID NO: 157624 - DNA, 103 bp, Artificial Sequence
  Synthetic Polynucleotide
taatacgactcactatagggaagggaaacctgggagagaagagaggctctaacagaggagaagagccatgcttctctccaacctggcggcagcgcaaaagatg

SEQ ID NO: 157625 - DNA, 103 bp, Artificial Sequence
  Synthetic Polynucleotide
taatacgactcactatagggaccgctgtggatgacctgcgagcggagcaaaacagaggagattgctcatgtcgcaggtcaacctggcggcagcgcaaaagatg

SEQ ID NO: 157626 - DNA, 103 bp, Artificial Sequence
  Synthetic Polynucleotide
taatacgactcactataggggacggtggggaagggaaacctgggagagaaaacagaggagattctctatgaggtttcccaacctggcggcagcgcaaaagatg

SEQ ID NO: 157627 - DNA, 103 bp, Artificial Sequence
  Synthetic Polynucleotide
taatacgactcactataggggggcaggagggacggtggggaagggaaaccaacagaggagaggtttcatgtccccaccgaacctggcggcagcgcaaaagatg

SEQ ID NO: 157628 - DNA, 103 bp, Artificial Sequence
  Synthetic Polynucleotide
taatacgactcactataggggacactcctggggcaggagggacggtggggaacagaggagaccccacatgccctcctgcaacctggcggcagcgcaaaagatg

SEQ ID NO: 157629 - DNA, 103 bp, Artificial Sequence
  Synthetic Polynucleotide
taatacgactcactatagggaggcagcggagacactcctggggcaggaggaacagaggagacctcctatgccaggagtgaacctggcggcagcgcaaaagatg

SEQ ID NO: 157630 - DNA, 103 bp, Artificial Sequence
  Synthetic Polynucleotide
taatacgactcactatagggctgcaggagcaggcagcggagacactcctgaacagaggagacaggagatgctccgctgcaacctggcggcagcgcaaaagatg

SEQ ID NO: 157631 - DNA, 103 bp, Artificial Sequence
  Synthetic Polynucleotide
taatacgactcactatagggggtgggaaggctgcaggagcaggcagcggaaacagaggagatccgctatgtgctcctgcaacctggcggcagcgcaaaagatg

SEQ ID NO: 157632 - DNA, 103 bp, Artificial Sequence
  Synthetic Polynucleotide
taatacgactcactatagggctgtggggtgggtgggaaggctgcaggagcaacagaggagagctcctatggccttcccaaacctggcggcagcgcaaaagatg

SEQ ID NO: 157633 - DNA, 103 bp, Artificial Sequence
  Synthetic Polynucleotide
taatacgactcactatagggtggggacagactgtggggtgggtgggaaggaacagaggagaccttccatgccaccccacaacctggcggcagcgcaaaagatg

SEQ ID NO: 157634 - DNA, 103 bp, Artificial Sequence
  Synthetic Polynucleotide
taatacgactcactatagggggggctgggctggggacagactgtggggtgaacagaggagacaccccatggtctgtcccaacctggcggcagcgcaaaagatg

SEQ ID NO: 157635 - DNA, 103 bp, Artificial Sequence
  Synthetic Polynucleotide
taatacgactcactataggggaagggggtgggggctgggctggggacagaaacagaggagatctgtcatgagcccagccaacctggcggcagcgcaaaagatg

SEQ ID NO: 157636 - DNA, 103 bp, Artificial Sequence
  Synthetic Polynucleotide
taatacgactcactatagggccatgaagtgaccgctgtggatgacctgcgaacagaggagacgcaggatgtccacagcgaacctggcggcagcgcaaaagatg

SEQ ID NO: 157637 - DNA, 103 bp, Artificial Sequence
  Synthetic Polynucleotide
taatacgactcactataggggctctatggggaagggggtgggggctgggcaacagaggagagcccagatgccaccccctaacctggcggcagcgcaaaagatg

SEQ ID NO: 157638 - DNA, 103 bp, Artificial Sequence
  Synthetic Polynucleotide
taatacgactcactatagggaagggtagaagctctatggggaagggggtgaacagaggagacaccccatgccccatagaaacctggcggcagcgcaaaagatg

SEQ ID NO: 157639 - DNA, 103 bp, Artificial Sequence
  Synthetic Polynucleotide
taatacgactcactatagggcgaataccccaagggtagaagctctatgggaacagaggagacccataatgcttctacccaacctggcggcagcgcaaaagatg

SEQ ID NO: 157640 - DNA, 103 bp, Artificial Sequence
  Synthetic Polynucleotide
taatacgactcactatagggaggcaggctccgaataccccaagggtagaaaacagaggagattctacatgtggggtattaacctggcggcagcgcaaaagatg

SEQ ID NO: 157641 - DNA, 103 bp, Artificial Sequence
  Synthetic Polynucleotide
taatacgactcactatagggcaaggcccaaaggcaggctccgaataccccaacagaggagaggggtaatgggagcctgcaacctggcggcagcgcaaaagatg

SEQ ID NO: 157642 - DNA, 103 bp, Artificial Sequence
  Synthetic Polynucleotide
taatacgactcactatagggcatggagaagcaaggcccaaaggcaggctcaacagaggagagagcctatgtttgggcctaacctggcggcagcgcaaaagatg

SEQ ID NO: 157643 - DNA, 103 bp, Artificial Sequence
  Synthetic Polynucleotide
taatacgactcactatagggtgcctctgggcatggagaagcaaggcccaaaacagaggagattgggcatggcttctccaaacctggcggcagcgcaaaagatg

SEQ ID NO: 157644 - DNA, 103 bp, Artificial Sequence
  Synthetic Polynucleotide
taatacgactcactataggggcggggggcttgcctctgggcatggagaagaacagaggagacttctcatggcccagaggaacctggcggcagcgcaaaagatg

SEQ ID NO: 157645 - DNA, 103 bp, Artificial Sequence
  Synthetic Polynucleotide
taatacgactcactatagggaggggatggggcggggggcttgcctctgggaacagaggagacccagaatgaagccccccaacctggcggcagcgcaaaagatg

SEQ ID NO: 157646 - DNA, 103 bp, Artificial Sequence
  Synthetic Polynucleotide
taatacgactcactatagggtctgtcccctaggggatggggcggggggctaacagaggagaagccccatgccccatcccaacctggcggcagcgcaaaagatg

SEQ ID NO: 157647 - DNA, 103 bp, Artificial Sequence
  Synthetic Polynucleotide
taatacgactcactatagggggcgacgacaccatgaagtgaccgctgtggaacagaggagaccacagatgtcacttcataacctggcggcagcgcaaaagatg

SEQ ID NO: 157648 - DNA, 103 bp, Artificial Sequence
  Synthetic Polynucleotide
taatacgactcactataggggggctggctttctgtcccctaggggatgggaacagaggagacccatcatgtaggggacaaacctggcggcagcgcaaaagatg

SEQ ID NO: 157649 - DNA, 103 bp, Artificial Sequence
  Synthetic Polynucleotide
taatacgactcactatagggtaaggtaggggggctggctttctgtcccctaacagaggagaaggggaatgaaagccagcaacctggcggcagcgcaaaagatg

SEQ ID NO: 157650 - DNA, 103 bp, Artificial Sequence
  Synthetic Polynucleotide
taatacgactcactatagggtggcaggggctaaggtaggggggctggcttaacagaggagaaagccaatgcccctacctaacctggcggcagcgcaaaagatg

SEQ ID NO: 157651 - DNA, 103 bp, Artificial Sequence
  Synthetic Polynucleotide
taatacgactcactatagggggactggcagtggcaggggctaaggtagggaacagaggagaccctacatgagcccctgcaacctggcggcagcgcaaaagatg

SEQ ID NO: 157652 - DNA, 103 bp, Artificial Sequence
  Synthetic Polynucleotide
taatacgactcactatagggagtggtggggggactggcagtggcaggggcaacagaggagagcccctatgactgccagtaacctggcggcagcgcaaaagatg

SEQ ID NO: 157653 - DNA, 103 bp, Artificial Sequence
  Synthetic Polynucleotide
taatacgactcactatagggtgctccccgcagtggtggggggactggcagaacagaggagactgccaatgcccccaccaaacctggcggcagcgcaaaagatg

SEQ ID NO: 157654 - DNA, 103 bp, Artificial Sequence
  Synthetic Polynucleotide
taatacgactcactatagggcaggggttgttgctccccgcagtggtggggaacagaggagaccccacatgtgcggggagaacctggcggcagcgcaaaagatg

SEQ ID NO: 157655 - DNA, 103 bp, Artificial Sequence
  Synthetic Polynucleotide
taatacgactcactatagggctgtgtgaggcaggggttgttgctccccgcaacagaggagagcggggatgaacaaccccaacctggcggcagcgcaaaagatg

SEQ ID NO: 157656 - DNA, 103 bp, Artificial Sequence
  Synthetic Polynucleotide
taatacgactcactatagggctgtgagcagctgtgtgaggcaggggttgtaacagaggagaacaaccatggcctcacacaacctggcggcagcgcaaaagatg

SEQ ID NO: 157657 - DNA, 103 bp, Artificial Sequence
  Synthetic Polynucleotide
taatacgactcactatagggggcttagctgctgtgagcagctgtgtgaggaacagaggagacctcacatggctgctcacaacctggcggcagcgcaaaagatg

SEQ ID NO: 157658 - DNA, 103 bp, Artificial Sequence
  Synthetic Polynucleotide
taatacgactcactataggggtcgctgtgcggcgacgacaccatgaagtgaacagaggagacacttcatggtgtcgtcgaacctggcggcagcgcaaaagatg

SEQ ID NO: 157659 - DNA, 103 bp, Artificial Sequence
  Synthetic Polynucleotide
taatacgactcactatagggggcttgctccggcttagctgctgtgagcagaacagaggagactgctcatggcagctaagaacctggcggcagcgcaaaagatg

SEQ ID NO: 157660 - DNA, 103 bp, Artificial Sequence
  Synthetic Polynucleotide
taatacgactcactataggggtggctccagggcttgctccggcttagctgaacagaggagacagctaatgcggagcaagaacctggcggcagcgcaaaagatg

SEQ ID NO: 157661 - DNA, 103 bp, Artificial Sequence
  Synthetic Polynucleotide
taatacgactcactataggggatacaagtggtggctccagggcttgctccaacagaggagaggagcaatgcctggagccaacctggcggcagcgcaaaagatg

SEQ ID NO: 157662 - DNA, 103 bp, Artificial Sequence
  Synthetic Polynucleotide
taatacgactcactataggggagggtgctggatacaagtggtggctccagaacagaggagactggagatgccacttgtaaacctggcggcagcgcaaaagatg

SEQ ID NO: 157663 - DNA, 103 bp, Artificial Sequence
  Synthetic Polynucleotide
taatacgactcactataggggggaccggaggagggtgctggatacaagtgaacagaggagacacttgatgccagcacccaacctggcggcagcgcaaaagatg

SEQ ID NO: 157664 - DNA, 103 bp, Artificial Sequence
  Synthetic Polynucleotide
taatacgactcactatagggggggaccctggggaccggaggagggtgctgaacagaggagacagcacatgcctccggtcaacctggcggcagcgcaaaagatg

SEQ ID NO: 157665 - DNA, 103 bp, Artificial Sequence
  Synthetic Polynucleotide
taatacgactcactataggggttcactgccggggaccctggggaccggagaacagaggagactccggatgccagggtccaacctggcggcagcgcaaaagatg

SEQ ID NO: 157666 - DNA, 103 bp, Artificial Sequence
  Synthetic Polynucleotide
taatacgactcactataggggacagccgccgttcactgccggggaccctgaacagaggagacagggtatgcggcagtgaaacctggcggcagcgcaaaagatg

SEQ ID NO: 157667 - DNA, 103 bp, Artificial Sequence
  Synthetic Polynucleotide
taatacgactcactataggggaggtcccctgacagccgccgttcactgccaacagaggagaggcagtatgcggcggctgaacctggcggcagcgcaaaagatg

SEQ ID NO: 157668 - DNA, 103 bp, Artificial Sequence
  Synthetic Polynucleotide
taatacgactcactataggggcatggagctgaggtcccctgacagccgccaacagaggagaggcggcatgcaggggaccaacctggcggcagcgcaaaagatg

SEQ ID NO: 157669 - DNA, 103 bp, Artificial Sequence
  Synthetic Polynucleotide
taatacgactcactatagggggggcagcgagtcgctgtgcggcgacgacaaacagaggagatgtcgtatgcgcacagcgaacctggcggcagcgcaaaagatg

SEQ ID NO: 157670 - DNA, 103 bp, Artificial Sequence
  Synthetic Polynucleotide
taatacgactcactatagggccagggcctggcatggagctgaggtcccctaacagaggagaaggggaatgcagctccataacctggcggcagcgcaaaagatg

SEQ ID NO: 157671 - DNA, 103 bp, Artificial Sequence
  Synthetic Polynucleotide
taatacgactcactatagggtcgcgccgccggggcagcgagtcgctgtgcaacagaggagagcacagatgctcgctgccaacctggcggcagcgcaaaagatg

SEQ ID NO: 157672 - DNA, 103 bp, Artificial Sequence
  Synthetic Polynucleotide
taatacgactcactatagggcccctcctggtcgcgccgccggggcagcgaaacagaggagatcgctgatgcggcggcgcaacctggcggcagcgcaaaagatg

SEQ ID NO: 157673 - DNA, 103 bp, Artificial Sequence
  Synthetic Polynucleotide
taatacgactcactatagggcctgcaagcccgcggccagacctgccagcgaacagaggagacgctggatggtctggccgaacctggcggcagcgcaaaagatg

SEQ ID NO: 157674 - DNA, 103 bp, Artificial Sequence
  Synthetic Polynucleotide
taatacgactcactataggggccccacggacccctcctggtcgcgccgccaacagaggagaggcggcatgaccaggaggaacctggcggcagcgcaaaagatg

SEQ ID NO: 157675 - DNA, 103 bp, Artificial Sequence
  Synthetic Polynucleotide
taatacgactcactatagggaagtcggagggccccacggacccctcctggaacagaggagaccaggaatggtccgtgggaacctggcggcagcgcaaaagatg

SEQ ID NO: 157676 - DNA, 103 bp, Artificial Sequence
  Synthetic Polynucleotide
taatacgactcactataggggcgcggcccgaagtcggagggccccacggaaacagaggagatccgtgatgccctccgacaacctggcggcagcgcaaaagatg

SEQ ID NO: 157677 - DNA, 103 bp, Artificial Sequence
  Synthetic Polynucleotide
taatacgactcactatagggggtcgatactgcgcggcccgaagtcggaggaacagaggagacctccgatgtcgggccgcaacctggcggcagcgcaaaagatg

SEQ ID NO: 157678 - DNA, 103 bp, Artificial Sequence
  Synthetic Polynucleotide
taatacgactcactataggggtgagtgtggggtcgatactgcgcggcccgaacagaggagacgggccatgcagtatcgaaacctggcggcagcgcaaaagatg

SEQ ID NO: 157679 - DNA, 103 bp, Artificial Sequence
  Synthetic Polynucleotide
taatacgactcactataggggaagaggcgtgtgagtgtggggtcgatactaacagaggagaagtatcatgcccacactcaacctggcggcagcgcaaaagatg

SEQ ID NO: 157680 - DNA, 103 bp, Artificial Sequence
  Synthetic Polynucleotide
taatacgactcactatagggtcaagcactcgaagaggcgtgtgagtgtggaacagaggagaccacacatgcacgcctctaacctggcggcagcgcaaaagatg

SEQ ID NO: 157681 - DNA, 103 bp, Artificial Sequence
  Synthetic Polynucleotide
taatacgactcactatagggtaggccaggctcaagcactcgaagaggcgtaacagaggagaacgcctatgcgagtgcttaacctggcggcagcgcaaaagatg

SEQ ID NO: 157682 - DNA, 103 bp, Artificial Sequence
  Synthetic Polynucleotide
taatacgactcactatagggcttgccactgtaggccaggctcaagcactcaacagaggagagagtgcatgagcctggccaacctggcggcagcgcaaaagatg

SEQ ID NO: 157683 - DNA, 103 bp, Artificial Sequence
  Synthetic Polynucleotide
taatacgactcactataggggagacaccagcttgccactgtaggccaggcaacagaggagagcctggatgacagtggcaaacctggcggcagcgcaaaagatg

SEQ ID NO: 157684 - DNA, 103 bp, Artificial Sequence
  Synthetic Polynucleotide
taatacgactcactatagggacccgcgggacctgcaagcccgcggccagaaacagaggagatctggcatggggcttgcaaacctggcggcagcgcaaaagatg

SEQ ID NO: 157685 - DNA, 103 bp, Artificial Sequence
  Synthetic Polynucleotide
taatacgactcactatagggttccacttgggagacaccagcttgccactgaacagaggagacagtggatggctggtgtcaacctggcggcagcgcaaaagatg

SEQ ID NO: 157686 - DNA, 103 bp, Artificial Sequence
  Synthetic Polynucleotide
taatacgactcactatagggtttgaaattcttccacttgggagacaccagaacagaggagactggtgatgcccaagtggaacctggcggcagcgcaaaagatg

SEQ ID NO: 157687 - DNA, 103 bp, Artificial Sequence
  Synthetic Polynucleotide
taatacgactcactataggggcttgaggcctttgaaattcttccacttggaacagaggagaccaagtatgagaatttcaaacctggcggcagcgcaaaagatg

SEQ ID NO: 157688 - DNA, 103 bp, Artificial Sequence
  Synthetic Polynucleotide
taatacgactcactatagggctgcagagcagcttgaggcctttgaaattcaacagaggagagaatttatgaggcctcaaaacctggcggcagcgcaaaagatg

SEQ ID NO: 157689 - DNA, 103 bp, Artificial Sequence
  Synthetic Polynucleotide
taatacgactcactataggggatcttgtctctgcagagcagcttgaggccaacagaggagaggcctcatgctgctctgcaacctggcggcagcgcaaaagatg

SEQ ID NO: 157690 - DNA, 103 bp, Artificial Sequence
  Synthetic Polynucleotide
taatacgactcactatagggtgttcaggcggatcttgtctctgcagagcaaacagaggagatgctctatggagacaagaaacctggcggcagcgcaaaagatg

SEQ ID NO: 157691 - DNA, 103 bp, Artificial Sequence
  Synthetic Polynucleotide
taatacgactcactatagggcagatggcgttgttcaggcggatcttgtctaacagaggagaagacaaatgccgcctgaaaacctggcggcagcgcaaaagatg

SEQ ID NO: 157692 - DNA, 103 bp, Artificial Sequence
  Synthetic Polynucleotide
taatacgactcactatagggccaggccctccagatggcgttgttcaggcgaacagaggagacgcctgatgaacgccatcaacctggcggcagcgcaaaagatg

SEQ ID NO: 157693 - DNA, 103 bp, Artificial Sequence
  Synthetic Polynucleotide
taatacgactcactatagggactggatataccaggccctccagatggcgtaacagaggagaacgccaatgggagggcctaacctggcggcagcgcaaaagatg

SEQ ID NO: 157694 - DNA, 103 bp, Artificial Sequence
  Synthetic Polynucleotide
taatacgactcactatagggcgcttcacatactggatataccaggccctcaacagaggagagagggcatggtatatccaaacctggcggcagcgcaaaagatg

SEQ ID NO: 157695 - DNA, 103 bp, Artificial Sequence
  Synthetic Polynucleotide
taatacgactcactataggggctgggcgcgacccgcgggacctgcaagccaacagaggagaggcttgatggtcccgcggaacctggcggcagcgcaaaagatg

SEQ ID NO: 157696 - DNA, 103 bp, Artificial Sequence
  Synthetic Polynucleotide
taatacgactcactataggggctcttcctccgcttcacatactggatataaacagaggagatatatcatgtatgtgaagaacctggcggcagcgcaaaagatg

SEQ ID NO: 157697 - DNA, 103 bp, Artificial Sequence
  Synthetic Polynucleotide
taatacgactcactatagggcacacacggggctcttcctccgcttcacataacagaggagaatgtgaatgggaggaagaaacctggcggcagcgcaaaagatg

SEQ ID NO: 157698 - DNA, 103 bp, Artificial Sequence
  Synthetic Polynucleotide
taatacgactcactataggggtcacgaagccacacacggggctcttcctcaacagaggagagaggaaatgccccgtgtgaacctggcggcagcgcaaaagatg

SEQ ID NO: 157699 - DNA, 103 bp, Artificial Sequence
  Synthetic Polynucleotide
taatacgactcactatagggctgcaggggggtcacgaagccacacacgggaacagaggagacccgtgatgggcttcgtgaacctggcggcagcgcaaaagatg

SEQ ID NO: 157700 - DNA, 103 bp, Artificial Sequence
  Synthetic Polynucleotide
taatacgactcactatagggcctcaggcccctgcaggggggtcacgaagcaacagaggagagcttcgatgcccccctgcaacctggcggcagcgcaaaagatg

SEQ ID NO: 157701 - DNA, 103 bp, Artificial Sequence
  Synthetic Polynucleotide
taatacgactcactatagggtgcgcatcagcctcaggcccctgcagggggaacagaggagaccccctatgggggcctgaaacctggcggcagcgcaaaagatg

SEQ ID NO: 157702 - DNA, 103 bp, Artificial Sequence
  Synthetic Polynucleotide
taatacgactcactatagggcggcttccggtgcgcatcagcctcaggcccaacagaggagagggcctatggctgatgcgaacctggcggcagcgcaaaagatg

SEQ ID NO: 157703 - DNA, 103 bp, Artificial Sequence
  Synthetic Polynucleotide
taatacgactcactatagggccacggcctccggcttccggtgcgcatcagaacagaggagactgatgatgaccggaagcaacctggcggcagcgcaaaagatg

SEQ ID NO: 157704 - DNA, 103 bp, Artificial Sequence
  Synthetic Polynucleotide
taatacgactcactatagggccctccaggaccacggcctccggcttccggaacagaggagaccggaaatgggaggccgtaacctggcggcagcgcaaaagatg

SEQ ID NO: 157705 - DNA, 103 bp, Artificial Sequence
  Synthetic Polynucleotide
taatacgactcactatagggccagtagttcccctccaggaccacggcctcaacagaggagagaggccatggtcctggagaacctggcggcagcgcaaaagatg

SEQ ID NO: 157706 - DNA, 103 bp, Artificial Sequence
  Synthetic Polynucleotide
taatacgactcactatagggccgagtctgggctgggcgcgacccgcgggaaacagaggagatcccgcatgtcgcgcccaaacctggcggcagcgcaaaagatg

SEQ ID NO: 157707 - DNA, 103 bp, Artificial Sequence
  Synthetic Polynucleotide
taatacgactcactatagggtgcgccgcttccagtagttcccctccaggaaacagaggagatcctggatgggaactactaacctggcggcagcgcaaaagatg

SEQ ID NO: 157708 - DNA, 103 bp, Artificial Sequence
  Synthetic Polynucleotide
taatacgactcactatagggaccacctcgatgcgccgcttccagtagttcaacagaggagagaactaatggaagcggcgaacctggcggcagcgcaaaagatg

SEQ ID NO: 157709 - DNA, 103 bp, Artificial Sequence
  Synthetic Polynucleotide
taatacgactcactatagggttcccgcatcaccacctcgatgcgccgcttaacagaggagaaagcggatgatcgaggtgaacctggcggcagcgcaaaagatg

SEQ ID NO: 157710 - DNA, 103 bp, Artificial Sequence
  Synthetic Polynucleotide
taatacgactcactatagggacttgtggtattcccgcatcaccacctcgaaacagaggagatcgaggatgtgatgcgggaacctggcggcagcgcaaaagatg

SEQ ID NO: 157711 - DNA, 103 bp, Artificial Sequence
  Synthetic Polynucleotide
taatacgactcactatagggtagatgcgccacttgtggtattcccgcatcaacagaggagagatgcgatgataccacaaaacctggcggcagcgcaaaagatg

SEQ ID NO: 157712 - DNA, 103 bp, Artificial Sequence
  Synthetic Polynucleotide
taatacgactcactatagggcttcttgtagtagatgcgccacttgtggtaaacagaggagataccacatgtggcgcatcaacctggcggcagcgcaaaagatg

SEQ ID NO: 157713 - DNA, 103 bp, Artificial Sequence
  Synthetic Polynucleotide
taatacgactcactatagggtacggagccgcttcttgtagtagatgcgccaacagaggagaggcgcaatgactacaagaaacctggcggcagcgcaaaagatg

SEQ ID NO: 157714 - DNA, 103 bp, Artificial Sequence
  Synthetic Polynucleotide
taatacgactcactatagggctgctgggcttacggagccgcttcttgtagaacagaggagactacaaatggcggctccgaacctggcggcagcgcaaaagatg

SEQ ID NO: 157715 - DNA, 103 bp, Artificial Sequence
  Synthetic Polynucleotide
taatacgactcactataggggtcatcttccctgctgggcttacggagccgaacagaggagacggctcatgaagcccagcaacctggcggcagcgcaaaagatg

SEQ ID NO: 157716 - DNA, 103 bp, Artificial Sequence
  Synthetic Polynucleotide
taatacgactcactataggggggccaggaggtcatcttccctgctgggctaacagaggagaagcccaatggggaagatgaacctggcggcagcgcaaaagatg

SEQ ID NO: 157717 - DNA, 103 bp, Artificial Sequence
  Synthetic Polynucleotide
taatacgactcactataggggtgtccgagtccgagtctgggctgggcgcgaacagaggagacgcgccatgcccagactcaacctggcggcagcgcaaaagatg

SEQ ID NO: 157718 - DNA, 103 bp, Artificial Sequence
  Synthetic Polynucleotide
taatacgactcactataggggcctgcttaggggccaggaggtcatcttccaacagaggagaggaagaatgcctcctggcaacctggcggcagcgcaaaagatg

SEQ ID NO: 157719 - DNA, 103 bp, Artificial Sequence
  Synthetic Polynucleotide
taatacgactcactatagggcctgccttccgcctgcttaggggccaggagaacagaggagactcctgatgcctaagcagaacctggcggcagcgcaaaagatg

SEQ ID NO: 157720 - DNA, 103 bp, Artificial Sequence
  Synthetic Polynucleotide
taatacgactcactataggggcggcggccacctgccttccgcctgcttagaacagaggagactaagcatgcggaaggcaaacctggcggcagcgcaaaagatg

SEQ ID NO: 157721 - DNA, 103 bp, Artificial Sequence
  Synthetic Polynucleotide
taatacgactcactatagggcattgctccggcggcggccacctgccttccaacagaggagaggaaggatggtggccgccaacctggcggcagcgcaaaagatg

SEQ ID NO: 157722 - DNA, 103 bp, Artificial Sequence
  Synthetic Polynucleotide
taatacgactcactatagggctgtttgcaccattgctccggcggcggccaaacagaggagatggccgatgccggagcaaaacctggcggcagcgcaaaagatg

SEQ ID NO: 157723 - DNA, 103 bp, Artificial Sequence
  Synthetic Polynucleotide
taatacgactcactatagggtggagaagagctgtttgcaccattgctccgaacagaggagacggagcatgggtgcaaacaacctggcggcagcgcaaaagatg

SEQ ID NO: 157724 - DNA, 103 bp, Artificial Sequence
  Synthetic Polynucleotide
taatacgactcactataggggggaccacactggagaagagctgtttgcacaacagaggagagtgcaaatggctcttctcaacctggcggcagcgcaaaagatg

SEQ ID NO: 157725 - DNA, 103 bp, Artificial Sequence
  Synthetic Polynucleotide
taatacgactcactatagggcagcagcacggggaccacactggagaagagaacagaggagactcttcatgagtgtggtcaacctggcggcagcgcaaaagatg

SEQ ID NO: 157726 - DNA, 103 bp, Artificial Sequence
  Synthetic Polynucleotide
taatacgactcactatagggctgggtcccccagcagcacggggaccacacaacagaggagagtgtggatgccgtgctgcaacctggcggcagcgcaaaagatg

SEQ ID NO: 157727 - DNA, 103 bp, Artificial Sequence
  Synthetic Polynucleotide
taatacgactcactatagggggctcctcctctgggtcccccagcagcacgaacagaggagacgtgctatggggggacccaacctggcggcagcgcaaaagatg

SEQ ID NO: 157728 - DNA, 103 bp, Artificial Sequence
  Synthetic Polynucleotide
taatacgactcactatagggctccgagtctgtgtccgagtccgagtctggaacagaggagaccagacatggactcggacaacctggcggcagcgcaaaagatg

SEQ ID NO: 157729 - DNA, 103 bp, Artificial Sequence
  Synthetic Polynucleotide
taatacgactcactatagggccgcccacccggctcctcctctgggtccccaacagaggagaggggacatggaggaggagaacctggcggcagcgcaaaagatg

SEQ ID NO: 157730 - DNA, 103 bp, Artificial Sequence
  Synthetic Polynucleotide
taatacgactcactatagggccaggagctgccgcccacccggctcctcctaacagaggagaaggaggatgcgggtgggcaacctggcggcagcgcaaaagatg

SEQ ID NO: 157731 - DNA, 103 bp, Artificial Sequence
  Synthetic Polynucleotide
taatacgactcactatagggcaattgaggtccaggagctgccgcccacccaacagaggagagggtggatggcagctcctaacctggcggcagcgcaaaagatg

SEQ ID NO: 157732 - DNA, 103 bp, Artificial Sequence
  Synthetic Polynucleotide
taatacgactcactatagggggacaaaaagcaattgaggtccaggagctgaacagaggagacagctcatggacctcaataacctggcggcagcgcaaaagatg

SEQ ID NO: 157733 - DNA, 103 bp, Artificial Sequence
  Synthetic Polynucleotide
taatacgactcactatagggctgagatgtcggacaaaaagcaattgaggtaacagaggagaacctcaatggctttttgtaacctggcggcagcgcaaaagatg

SEQ ID NO: 157734 - DNA, 103 bp, Artificial Sequence
  Synthetic Polynucleotide
taatacgactcactatagggaagagagtgtctgagatgtcggacaaaaagaacagaggagactttttatgcgacatctcaacctggcggcagcgcaaaagatg

SEQ ID NO: 157735 - DNA, 103 bp, Artificial Sequence
  Synthetic Polynucleotide
taatacgactcactatagggagtcatggtgaagagagtgtctgagatgtcaacagaggagagacatcatggacactctcaacctggcggcagcgcaaaagatg

SEQ ID NO: 157736 - DNA, 103 bp, Artificial Sequence
  Synthetic Polynucleotide
taatacgactcactatagggggccggactgagtcatggtgaagagagtgtaacagaggagaacactcatgtcaccatgaaacctggcggcagcgcaaaagatg

SEQ ID NO: 157737 - DNA, 103 bp, Artificial Sequence
  Synthetic Polynucleotide
taatacgactcactatagggaggggcgaagggccggactgagtcatggtgaacagaggagacaccatatgtcagtccggaacctggcggcagcgcaaaagatg

SEQ ID NO: 157738 - DNA, 103 bp, Artificial Sequence
  Synthetic Polynucleotide
taatacgactcactatagggcggcagctgcaggggcgaagggccggactgaacagaggagacagtccatgccttcgcccaacctggcggcagcgcaaaagatg

SEQ ID NO: 157739 - DNA, 103 bp, Artificial Sequence
  Synthetic Polynucleotide
taatacgactcactataggggactcgggtcctccgagtctgtgtccgagtaacagaggagaactcggatgcagactcggaacctggcggcagcgcaaaagatg

SEQ ID NO: 157740 - DNA, 103 bp, Artificial Sequence
  Synthetic Polynucleotide
taatacgactcactatagggcatcctcaggcggcagctgcaggggcgaagaacagaggagacttcgcatgtgcagctgcaacctggcggcagcgcaaaagatg

SEQ ID NO: 157741 - DNA, 103 bp, Artificial Sequence
  Synthetic Polynucleotide
taatacgactcactatagggccgacgtaggcatcctcaggcggcagctgcaacagaggagagcagctatggcctgaggaaacctggcggcagcgcaaaagatg

SEQ ID NO: 157742 - DNA, 103 bp, Artificial Sequence
  Synthetic Polynucleotide
taatacgactcactataggggtcagcattgccgacgtaggcatcctcaggaacagaggagacctgagatggcctacgtcaacctggcggcagcgcaaaagatg

SEQ ID NO: 157743 - DNA, 103 bp, Artificial Sequence
  Synthetic Polynucleotide
taatacgactcactataggggctggatcatgtcagcattgccgacgtaggaacagaggagacctacgatggcaatgctgaacctggcggcagcgcaaaagatg

SEQ ID NO: 157744 - DNA, 103 bp, Artificial Sequence
  Synthetic Polynucleotide
taatacgactcactataggggtcaggtccggctggatcatgtcagcattgaacagaggagacaatgcatgcatgatccaaacctggcggcagcgcaaaagatg

SEQ ID NO: 157745 - DNA, 103 bp, Artificial Sequence
  Synthetic Polynucleotide
taatacgactcactatagggctgcagtggcgtcaggtccggctggatcataacagaggagaatgatcatgccggacctgaacctggcggcagcgcaaaagatg

SEQ ID NO: 157746 - DNA, 103 bp, Artificial Sequence
  Synthetic Polynucleotide
taatacgactcactatagggccaggcttggctgcagtggcgtcaggtccgaacagaggagacggaccatgcgccactgcaacctggcggcagcgcaaaagatg

SEQ ID NO: 157747 - DNA, 103 bp, Artificial Sequence
  Synthetic Polynucleotide
taatacgactcactatagggatgaagtcatccaggcttggctgcagtggcaacagaggagagccactatggccaagcctaacctggcggcagcgcaaaagatg

SEQ ID NO: 157748 - DNA, 103 bp, Artificial Sequence
  Synthetic Polynucleotide
taatacgactcactatagggtgagatgtccatgaagtcatccaggcttggaacagaggagaccaagcatggatgacttcaacctggcggcagcgcaaaagatg

SEQ ID NO: 157749 - DNA, 103 bp, Artificial Sequence
  Synthetic Polynucleotide
taatacgactcactatagggtaaagaaatctgagatgtccatgaagtcataacagaggagaatgactatgtggacatctaacctggcggcagcgcaaaagatg

SEQ ID NO: 157750 - DNA, 103 bp, Artificial Sequence
  Synthetic Polynucleotide
taatacgactcactatagggctgcgccggagactcgggtcctccgagtctaacagaggagaagactcatgggacccgagaacctggcggcagcgcaaaagatg

SEQ ID NO: 157751 - DNA, 103 bp, Artificial Sequence
  Synthetic Polynucleotide
taatacgactcactatagggcgggagttggtaaagaaatctgagatgtccaacagaggagaggacatatgagatttcttaacctggcggcagcgcaaaagatg

SEQ ID NO: 157752 - DNA, 103 bp, Artificial Sequence
  Synthetic Polynucleotide
taatacgactcactatagggctgtgggaggcgggagttggtaaagaaatcaacagaggagagatttcatgaccaactccaacctggcggcagcgcaaaagatg

SEQ ID NO: 157753 - DNA, 103 bp, Artificial Sequence
  Synthetic Polynucleotide
taatacgactcactataggggcatgggcggctgtgggaggcgggagttggaacagaggagaccaactatggcctcccacaacctggcggcagcgcaaaagatg

SEQ ID NO: 157754 - DNA, 103 bp, Artificial Sequence
  Synthetic Polynucleotide
taatacgactcactatagggaagtttgaaggcatgggcggctgtgggaggaacagaggagacctcccatggccgcccataacctggcggcagcgcaaaagatg

SEQ ID NO: 157755 - DNA, 103 bp, Artificial Sequence
  Synthetic Polynucleotide
taatacgactcactataggggggctctgggaagtttgaaggcatgggcggaacagaggagaccgcccatgccttcaaacaacctggcggcagcgcaaaagatg

SEQ ID NO: 157756 - DNA, 103 bp, Artificial Sequence
  Synthetic Polynucleotide
taatacgactcactatagggtgaagctggggggctctgggaagtttgaagaacagaggagacttcaaatgtcccagagcaacctggcggcagcgcaaaagatg

SEQ ID NO: 157757 - DNA, 103 bp, Artificial Sequence
  Synthetic Polynucleotide
taatacgactcactatagggaccacggggctgaagctggggggctctgggaacagaggagacccagaatgccccagcttaacctggcggcagcgcaaaagatg

SEQ ID NO: 157758 - DNA, 103 bp, Artificial Sequence
  Synthetic Polynucleotide
taatacgactcactataggggagggagtcaaccacggggctgaagctgggaacagaggagacccagcatgagccccgtgaacctggcggcagcgcaaaagatg

SEQ ID NO: 157759 - DNA, 103 bp, Artificial Sequence
  Synthetic Polynucleotide
taatacgactcactatagggcactgctgaagagggagtcaaccacggggcaacagaggagagccccgatgttgactcccaacctggcggcagcgcaaaagatg

SEQ ID NO: 157760 - DNA, 103 bp, Artificial Sequence
  Synthetic Polynucleotide
taatacgactcactatagggcccagggtcccactgctgaagagggagtcaaacagaggagatgactcatgcttcagcagaacctggcggcagcgcaaaagatg

SEQ ID NO: 157761 - DNA, 103 bp, Artificial Sequence
  Synthetic Polynucleotide
taatacgactcactatagggctgcaggagcagtattagaagaaacttcataacagaggagaatgaagatgcttctaataaacctggcggcagcgcaaaagatg

SEQ ID NO: 157762 - DNA, 103 bp, Artificial Sequence
  Synthetic Polynucleotide
taatacgactcactatagggaaatttttctaagtatctttcaccaaatagaacagaggagactatttatggaaagatacaacctggcggcagcgcaaaagatg

SEQ ID NO: 157763 - DNA, 103 bp, Artificial Sequence
  Synthetic Polynucleotide
taatacgactcactatagggggcttcaatttcataagcagcttcaatgccaacagaggagaggcattatggctgcttataacctggcggcagcgcaaaagatg

SEQ ID NO: 157764 - DNA, 103 bp, Artificial Sequence
  Synthetic Polynucleotide
taatacgactcactatagggcttgatttctggcttcaatttcataagcagaacagaggagactgcttatgaaattgaagaacctggcggcagcgcaaaagatg

SEQ ID NO: 157765 - DNA, 103 bp, Artificial Sequence
  Synthetic Polynucleotide
taatacgactcactatagggaaaagaaaaacttgatttctggcttcaattaacagaggagaaattgaatgcagaaatcaaacctggcggcagcgcaaaagatg

SEQ ID NO: 157766 - DNA, 103 bp, Artificial Sequence
  Synthetic Polynucleotide
taatacgactcactataggggtcatctttaaaaagaaaaacttgatttctaacagaggagaagaaatatggtttttcttaacctggcggcagcgcaaaagatg

SEQ ID NO: 157767 - DNA, 103 bp, Artificial Sequence
  Synthetic Polynucleotide
taatacgactcactatagggaccagtatttgtcatctttaaaaagaaaaaaacagaggagatttttcatgttaaagatgaacctggcggcagcgcaaaagatg

SEQ ID NO: 157768 - DNA, 103 bp, Artificial Sequence
  Synthetic Polynucleotide
taatacgactcactatagggttgctaattaaccagtatttgtcatctttaaacagaggagataaagaatgcaaatactgaacctggcggcagcgcaaaagatg

SEQ ID NO: 157769 - DNA, 103 bp, Artificial Sequence
  Synthetic Polynucleotide
taatacgactcactatagggtggtcttaaattgctaattaaccagtatttaacagaggagaaaatacatgttaattagcaacctggcggcagcgcaaaagatg

SEQ ID NO: 157770 - DNA, 103 bp, Artificial Sequence
  Synthetic Polynucleotide
taatacgactcactatagggaatttggctctggtcttaaattgctaattaaacagaggagataattaatgatttaagacaacctggcggcagcgcaaaagatg

SEQ ID NO: 157771 - DNA, 103 bp, Artificial Sequence
  Synthetic Polynucleotide
taatacgactcactatagggctcttgggataatttggctctggtcttaaaaacagaggagatttaagatgagagccaaaaacctggcggcagcgcaaaagatg

SEQ ID NO: 157772 - DNA, 103 bp, Artificial Sequence
  Synthetic Polynucleotide
taatacgactcactatagggagaatgtatgctcttgggataatttggctcaacagaggagagagccaatgtatcccaagaacctggcggcagcgcaaaagatg

SEQ ID NO: 157773 - DNA, 103 bp, Artificial Sequence
  Synthetic Polynucleotide
taatacgactcactatagggcaaggccataaaatttttctaagtatctttaacagaggagaaaagatatgtagaaaaataacctggcggcagcgcaaaagatg

SEQ ID NO: 157774 - DNA, 103 bp, Artificial Sequence
  Synthetic Polynucleotide
taatacgactcactataggggaaaaccaaaagaatgtatgctcttgggataacagaggagaatcccaatggcatacattaacctggcggcagcgcaaaagatg

SEQ ID NO: 157775 - DNA, 103 bp, Artificial Sequence
  Synthetic Polynucleotide
taatacgactcactatagggacaaagttaggaaaaccaaaagaatgtatgaacagaggagacatacaatgttttggtttaacctggcggcagcgcaaaagatg

SEQ ID NO: 157776 - DNA, 103 bp, Artificial Sequence
  Synthetic Polynucleotide
taatacgactcactatagggaatttttttcacaaagttaggaaaaccaaaaacagaggagatttggtatgcctaactttaacctggcggcagcgcaaaagatg

SEQ ID NO: 157777 - DNA, 103 bp, Artificial Sequence
  Synthetic Polynucleotide
taatacgactcactatagggcagctgcatcaatttttttcacaaagttagaacagaggagactaactatgtgaaaaaaaaacctggcggcagcgcaaaagatg

SEQ ID NO: 157778 - DNA, 103 bp, Artificial Sequence
  Synthetic Polynucleotide
taatacgactcactataggggggttaaaaacagctgcatcaatttttttcaacagaggagagaaaaaatgtgatgcagcaacctggcggcagcgcaaaagatg

SEQ ID NO: 157779 - DNA, 103 bp, Artificial Sequence
  Synthetic Polynucleotide
taatacgactcactatagggataaaaacgtgggttaaaaacagctgcatcaacagaggagagatgcaatggtttttaacaacctggcggcagcgcaaaagatg

SEQ ID NO: 157780 - DNA, 103 bp, Artificial Sequence
  Synthetic Polynucleotide
taatacgactcactatagggagtaggtcctataaaaacgtgggttaaaaaaacagaggagatttttaatgcacgtttttaacctggcggcagcgcaaaagatg

SEQ ID NO: 157781 - DNA, 103 bp, Artificial Sequence
  Synthetic Polynucleotide
taatacgactcactatagggtctacaaagaagtaggtcctataaaaacgtaacagaggagaacgtttatgtaggacctaaacctggcggcagcgcaaaagatg

SEQ ID NO: 157782 - DNA, 103 bp, Artificial Sequence
  Synthetic Polynucleotide
taatacgactcactatagggatactggttatctacaaagaagtaggtcctaacagaggagaaggaccatgttctttgtaaacctggcggcagcgcaaaagatg

SEQ ID NO: 157783 - DNA, 103 bp, Artificial Sequence
  Synthetic Polynucleotide
taatacgactcactatagggcatacctccaatactggttatctacaaagaaacagaggagatctttgatgataaccagtaacctggcggcagcgcaaaagatg

SEQ ID NO: 157784 - DNA, 103 bp, Artificial Sequence
  Synthetic Polynucleotide
taatacgactcactatagggttgtttatctcaaggccataaaatttttctaacagaggagaagaaaaatgttatggcctaacctggcggcagcgcaaaagatg

SEQ ID NO: 157785 - DNA, 103 bp, Artificial Sequence
  Synthetic Polynucleotide
taatacgactcactatagggctcctttcatcatacctccaatactggttaaacagaggagataaccaatgttggaggtaaacctggcggcagcgcaaaagatg

SEQ ID NO: 157786 - DNA, 103 bp, Artificial Sequence
  Synthetic Polynucleotide
taatacgactcactatagggcatcatctgtctcctttcatcatacctccaaacagaggagatggaggatggatgaaaggaacctggcggcagcgcaaaagatg

SEQ ID NO: 157787 - DNA, 103 bp, Artificial Sequence
  Synthetic Polynucleotide
taatacgactcactatagggaaccagggtccatcatctgtctcctttcataacagaggagaatgaaaatggacagatgaaacctggcggcagcgcaaaagatg

SEQ ID NO: 157788 - DNA, 103 bp, Artificial Sequence
  Synthetic Polynucleotide
taatacgactcactatagggagtttgggataaccagggtccatcatctgtaacagaggagaacagatatgggaccctggaacctggcggcagcgcaaaagatg

SEQ ID NO: 157789 - DNA, 103 bp, Artificial Sequence
  Synthetic Polynucleotide
taatacgactcactatagggcttggtaatcagtttgggataaccagggtcaacagaggagagaccctatgtatcccaaaaacctggcggcagcgcaaaagatg

SEQ ID NO: 157790 - DNA, 103 bp, Artificial Sequence
  Synthetic Polynucleotide
taatacgactcactatagggcttggaagttcttggtaatcagtttgggataacagaggagaatcccaatgtgattaccaaacctggcggcagcgcaaaagatg

SEQ ID NO: 157791 - DNA, 103 bp, Artificial Sequence
  Synthetic Polynucleotide
taatacgactcactatagggggcccgattccttggaagttcttggtaatcaacagaggagagattacatggaacttccaaacctggcggcagcgcaaaagatg

SEQ ID NO: 157792 - DNA, 103 bp, Artificial Sequence
  Synthetic Polynucleotide
taatacgactcactatagggatcaattttaggcccgattccttggaagttaacagaggagaaacttcatgggaatcgggaacctggcggcagcgcaaaagatg

SEQ ID NO: 157793 - DNA, 103 bp, Artificial Sequence
  Synthetic Polynucleotide
taatacgactcactatagggagaagactgcatcaattttaggcccgattcaacagaggagagaatcgatgctaaaattgaacctggcggcagcgcaaaagatg

SEQ ID NO: 157794 - DNA, 103 bp, Artificial Sequence
  Synthetic Polynucleotide
taatacgactcactatagggtttttagagtagaagactgcatcaattttaaacagaggagataaaatatgtgcagtcttaacctggcggcagcgcaaaagatg

SEQ ID NO: 157795 - DNA, 103 bp, Artificial Sequence
  Synthetic Polynucleotide
taatacgactcactatagggcactggaagtttgtttatctcaaggccataaacagaggagatatggcatggagataaacaacctggcggcagcgcaaaagatg

SEQ ID NO: 157796 - DNA, 103 bp, Artificial Sequence
  Synthetic Polynucleotide
taatacgactcactataggggtagtatttgtttttagagtagaagactgcaacagaggagagcagtcatgtactctaaaaacctggcggcagcgcaaaagatg

SEQ ID NO: 157797 - DNA, 103 bp, Artificial Sequence
  Synthetic Polynucleotide
taatacgactcactatagggggaagaaatagtagtatttgtttttagagtaacagaggagaactctaatgacaaatactaacctggcggcagcgcaaaagatg

SEQ ID NO: 157798 - DNA, 103 bp, Artificial Sequence
  Synthetic Polynucleotide
taatacgactcactatagggttagatccttggaagaaatagtagtatttgaacagaggagacaaataatgctatttcttaacctggcggcagcgcaaaagatg

SEQ ID NO: 157799 - DNA, 103 bp, Artificial Sequence
  Synthetic Polynucleotide
taatacgactcactatagggttcaaattggttagatccttggaagaaataaacagaggagatatttcatgcaaggatctaacctggcggcagcgcaaaagatg

SEQ ID NO: 157800 - DNA, 103 bp, Artificial Sequence
  Synthetic Polynucleotide
taatacgactcactatagggggaagtcatattcaaattggttagatccttaacagaggagaaaggatatgaccaatttgaacctggcggcagcgcaaaagatg

SEQ ID NO: 157801 - DNA, 103 bp, Artificial Sequence
  Synthetic Polynucleotide
taatacgactcactatagggcgttggagtaggaagtcatattcaaattggaacagaggagaccaattatgatatgacttaacctggcggcagcgcaaaagatg

SEQ ID NO: 157802 - DNA, 103 bp, Artificial Sequence
  Synthetic Polynucleotide
taatacgactcactatagggtttggtgatacgttggagtaggaagtcataaacagaggagatatgacatgctactccaaaacctggcggcagcgcaaaagatg

SEQ ID NO: 157803 - DNA, 103 bp, Artificial Sequence
  Synthetic Polynucleotide
taatacgactcactatagggttttcagtgttttggtgatacgttggagtaaacagaggagatactccatggtatcaccaaacctggcggcagcgcaaaagatg

SEQ ID NO: 157804 - DNA, 103 bp, Artificial Sequence
  Synthetic Polynucleotide
taatacgactcactatagggcagctattgcttttcagtgttttggtgataaacagaggagatatcacatgaacactgaaaacctggcggcagcgcaaaagatg

SEQ ID NO: 157805 - DNA, 103 bp, Artificial Sequence
  Synthetic Polynucleotide
taatacgactcactatagggacaaccaaaccagctattgcttttcagtgtaacagaggagaacactgatgagcaatagcaacctggcggcagcgcaaaagatg

SEQ ID NO: 157806 - DNA, 103 bp, Artificial Sequence
  Synthetic Polynucleotide
taatacgactcactatagggtcatttttgtcactggaagtttgtttatctaacagaggagaagataaatgaacttccagaacctggcggcagcgcaaaagatg

SEQ ID NO: 157807 - DNA, 103 bp, Artificial Sequence
  Synthetic Polynucleotide
taatacgactcactatagggccactatatttcatttttgtcactggaagtaacagaggagaacttccatggacaaaaataacctggcggcagcgcaaaagatg

SEQ ID NO: 157808 - DNA, 103 bp, Artificial Sequence
  Synthetic Polynucleotide
taatacgactcactatagggcattaagtttccactatatttcatttttgtaacagaggagaacaaaaatgaaatatagtaacctggcggcagcgcaaaagatg

SEQ ID NO: 157809 - DNA, 103 bp, Artificial Sequence
  Synthetic Polynucleotide
taatacgactcactatagggttttttccttcattaagtttccactatattaacagaggagaaatataatggaaacttaaaacctggcggcagcgcaaaagatg

SEQ ID NO: 157810 - DNA, 103 bp, Artificial Sequence
  Synthetic Polynucleotide
taatacgactcactatagggatttcttggattttttccttcattaagtttaacagaggagaaaacttatggaaggaaaaaacctggcggcagcgcaaaagatg

SEQ ID NO: 157811 - DNA, 103 bp, Artificial Sequence
  Synthetic Polynucleotide
taatacgactcactataggggaagtgctgcatttcttggattttttccttaacagaggagaaaggaaatgatccaagaaaacctggcggcagcgcaaaagatg

SEQ ID NO: 157812 - DNA, 103 bp, Artificial Sequence
  Synthetic Polynucleotide
taatacgactcactatagggaagcagtggcctgcaggagcagtattagaaaacagaggagattctaaatgtgctcctgcaacctggcggcagcgcaaaagatg

SEQ ID NO: 157813 - DNA, 103 bp, Artificial Sequence
  Synthetic Polynucleotide
taatacgactcactatagggtcagacccaagaagtgctgcatttcttggaaacagaggagatccaagatgtgcagcactaacctggcggcagcgcaaaagatg

SEQ ID NO: 157814 - DNA, 103 bp, Artificial Sequence
  Synthetic Polynucleotide
taatacgactcactatagggccggtcactttcagacccaagaagtgctgcaacagaggagagcagcaatgcttgggtctaacctggcggcagcgcaaaagatg

SEQ ID NO: 157815 - DNA, 103 bp, Artificial Sequence
  Synthetic Polynucleotide
taatacgactcactataggggtccagttgcccggtcactttcagacccaaaacagaggagattgggtatgaaagtgaccaacctggcggcagcgcaaaagatg

SEQ ID NO: 157816 - DNA, 103 bp, Artificial Sequence
  Synthetic Polynucleotide
taatacgactcactataggggggtagatgtgtccagttgcccggtcacttaacagaggagaaagtgaatgggcaactggaacctggcggcagcgcaaaagatg

SEQ ID NO: 157817 - DNA, 103 bp, Artificial Sequence
  Synthetic Polynucleotide
taatacgactcactatagggatcatctccagggtagatgtgtccagttgcaacagaggagagcaactatgcacatctacaacctggcggcagcgcaaaagatg

SEQ ID NO: 157818 - DNA, 103 bp, Artificial Sequence
  Synthetic Polynucleotide
taatacgactcactatagggaggtgcgtgcatcatctccagggtagatgtaacagaggagaacatctatgctggagatgaacctggcggcagcgcaaaagatg

SEQ ID NO: 157819 - DNA, 103 bp, Artificial Sequence
  Synthetic Polynucleotide
taatacgactcactatagggctccacatcgaggtgcgtgcatcatctccaaacagaggagatggagaatgtgcacgcacaacctggcggcagcgcaaaagatg

SEQ ID NO: 157820 - DNA, 103 bp, Artificial Sequence
  Synthetic Polynucleotide
taatacgactcactatagggacatcggggactccacatcgaggtgcgtgcaacagaggagagcacgcatgtcgatgtggaacctggcggcagcgcaaaagatg

SEQ ID NO: 157821 - DNA, 103 bp, Artificial Sequence
  Synthetic Polynucleotide
taatacgactcactataggggaaatgatggacatcggggactccacatcgaacagaggagacgatgtatggtccccgataacctggcggcagcgcaaaagatg

SEQ ID NO: 157822 - DNA, 103 bp, Artificial Sequence
  Synthetic Polynucleotide
taatacgactcactataggggcatttccctgaaatgatggacatcggggaaacagaggagatccccgatgtccatcattaacctggcggcagcgcaaaagatg

SEQ ID NO: 157823 - DNA, 103 bp, Artificial Sequence
  Synthetic Polynucleotide
taatacgactcactatagggagagctccagaagcagtggcctgcaggagcaacagaggagagctcctatgggccactgcaacctggcggcagcgcaaaagatg

SEQ ID NO: 157824 - DNA, 103 bp, Artificial Sequence
  Synthetic Polynucleotide
taatacgactcactatagggggcccccctggcatttccctgaaatgatggaacagaggagaccatcaatgcagggaaataacctggcggcagcgcaaaagatg

SEQ ID NO: 157825 - DNA, 103 bp, Artificial Sequence
  Synthetic Polynucleotide
taatacgactcactatagggcctccatacgggcccccctggcatttccctaacagaggagaagggaaatgccaggggggaacctggcggcagcgcaaaagatg

SEQ ID NO: 157826 - DNA, 103 bp, Artificial Sequence
  Synthetic Polynucleotide
taatacgactcactatagggtataatgtttcctccatacgggcccccctgaacagaggagacaggggatgccgtatggaaacctggcggcagcgcaaaagatg

SEQ ID NO: 157827 - DNA, 103 bp, Artificial Sequence
  Synthetic Polynucleotide
taatacgactcactatagggctgtaggtgatataatgtttcctccatacgaacagaggagacgtatgatggaaacattaaacctggcggcagcgcaaaagatg

SEQ ID NO: 157828 - DNA, 103 bp, Artificial Sequence
  Synthetic Polynucleotide
taatacgactcactatagggattattgattctgtaggtgatataatgtttaacagaggagaaaacatatgatcacctacaacctggcggcagcgcaaaagatg

SEQ ID NO: 157829 - DNA, 103 bp, Artificial Sequence
  Synthetic Polynucleotide
taatacgactcactatagggcaggtgtgtaattattgattctgtaggtgaaacagaggagatcacctatggaatcaataaacctggcggcagcgcaaaagatg

SEQ ID NO: 157830 - DNA, 103 bp, Artificial Sequence
  Synthetic Polynucleotide
taatacgactcactatagggcggttcatgtcaggtgtgtaattattgattaacagaggagaaatcaaatgttacacaccaacctggcggcagcgcaaaagatg

SEQ ID NO: 157831 - DNA, 103 bp, Artificial Sequence
  Synthetic Polynucleotide
taatacgactcactatagggaacatcctcacggttcatgtcaggtgtgtaaacagaggagatacacaatggacatgaacaacctggcggcagcgcaaaagatg

SEQ ID NO: 157832 - DNA, 103 bp, Artificial Sequence
  Synthetic Polynucleotide
taatacgactcactatagggttgcgtagtcaacatcctcacggttcatgtaacagaggagaacatgaatggtgaggatgaacctggcggcagcgcaaaagatg

SEQ ID NO: 157833 - DNA, 103 bp, Artificial Sequence
  Synthetic Polynucleotide
taatacgactcactataggggctttccggattgcgtagtcaacatcctcaaacagaggagatgaggaatgtgactacgcaacctggcggcagcgcaaaagatg

SEQ ID NO: 157834 - DNA, 103 bp, Artificial Sequence
  Synthetic Polynucleotide
taatacgactcactataggggttcaggggaagagctccagaagcagtggcaacagaggagagccactatgtctggagctaacctggcggcagcgcaaaagatg

SEQ ID NO: 157835 - DNA, 103 bp, Artificial Sequence
  Synthetic Polynucleotide
taatacgactcactatagggtacttggaaagctttccggattgcgtagtcaacagaggagagactacatgatccggaaaaacctggcggcagcgcaaaagatg

SEQ ID NO: 157836 - DNA, 103 bp, Artificial Sequence
  Synthetic Polynucleotide
taatacgactcactatagggcattactccatacttggaaagctttccggaaacagaggagatccggaatgctttccaagaacctggcggcagcgcaaaagatg

SEQ ID NO: 157837 - DNA, 103 bp, Artificial Sequence
  Synthetic Polynucleotide
taatacgactcactatagggaagggggtaacattactccatacttggaaaaacagaggagatttccaatgatggagtaaaacctggcggcagcgcaaaagatg

SEQ ID NO: 157838 - DNA, 103 bp, Artificial Sequence
  Synthetic Polynucleotide
taatacgactcactataggggctgaatttcaagggggtaacattactccaaacagaggagatggagtatggttacccccaacctggcggcagcgcaaaagatg

SEQ ID NO: 157839 - DNA, 103 bp, Artificial Sequence
  Synthetic Polynucleotide
taatacgactcactatagggtgttaatcttgctgaatttcaagggggtaaaacagaggagattacccatgtgaaattcaaacctggcggcagcgcaaaagatg

SEQ ID NO: 157840 - DNA, 103 bp, Artificial Sequence
  Synthetic Polynucleotide
taatacgactcactataggggccatgcctgtgttaatcttgctgaatttcaacagaggagagaaattatgcaagattaaaacctggcggcagcgcaaaagatg

SEQ ID NO: 157841 - DNA, 103 bp, Artificial Sequence
  Synthetic Polynucleotide
taatacgactcactatagggcaaaatgtcagccatgcctgtgttaatcttaacagaggagaaagattatgacaggcatgaacctggcggcagcgcaaaagatg

SEQ ID NO: 157842 - DNA, 103 bp, Artificial Sequence
  Synthetic Polynucleotide
taatacgactcactatagggcaaaaaccaccaaaatgtcagccatgcctgaacagaggagacaggcaatgctgacatttaacctggcggcagcgcaaaagatg

SEQ ID NO: 157843 - DNA, 103 bp, Artificial Sequence
  Synthetic Polynucleotide
taatacgactcactataggggctccacgggcaaaaaccaccaaaatgtcaaacagaggagatgacatatgggtggttttaacctggcggcagcgcaaaagatg

SEQ ID NO: 157844 - DNA, 103 bp, Artificial Sequence
  Synthetic Polynucleotide
taatacgactcactataggggtctccatgagctccacgggcaaaaaccacaacagaggagagtggttatggcccgtggaaacctggcggcagcgcaaaagatg

SEQ ID NO: 157845 - DNA, 103 bp, Artificial Sequence
  Synthetic Polynucleotide
taatacgactcactatagggttgtagagctgttcaggggaagagctccagaacagaggagactggagatgttcccctgaaacctggcggcagcgcaaaagatg

SEQ ID NO: 157846 - DNA, 103 bp, Artificial Sequence
  Synthetic Polynucleotide
taatacgactcactatagggaagcatggaagtctccatgagctccacgggaacagaggagacccgtgatgctcatggagaacctggcggcagcgcaaaagatg

SEQ ID NO: 157847 - DNA, 103 bp, Artificial Sequence
  Synthetic Polynucleotide
taatacgactcactatagggttgccatcaaaagcatggaagtctccatgaaacagaggagatcatggatgcttccatgcaacctggcggcagcgcaaaagatg

SEQ ID NO: 157848 - DNA, 103 bp, Artificial Sequence
  Synthetic Polynucleotide
taatacgactcactataggggattccacctttgccatcaaaagcatggaaaacagaggagattccatatgtttgatggcaacctggcggcagcgcaaaagatg

SEQ ID NO: 157849 - DNA, 103 bp, Artificial Sequence
  Synthetic Polynucleotide
taatacgactcactatagggcatgggctaggattccacctttgccatcaaaacagaggagattgatgatgaaggtggaaaacctggcggcagcgcaaaagatg

SEQ ID NO: 157850 - DNA, 103 bp, Artificial Sequence
  Synthetic Polynucleotide
taatacgactcactatagggggtccaaaagcatgggctaggattccacctaacagaggagaaggtggatgcctagcccaaacctggcggcagcgcaaaagatg

SEQ ID NO: 157851 - DNA, 103 bp, Artificial Sequence
  Synthetic Polynucleotide
taatacgactcactataggggccagatccaggtccaaaagcatgggctagaacagaggagactagccatggcttttggaaacctggcggcagcgcaaaagatg

SEQ ID NO: 157852 - DNA, 103 bp, Artificial Sequence
  Synthetic Polynucleotide
taatacgactcactatagggcccctccaatgccagatccaggtccaaaagaacagaggagacttttgatgctggatctgaacctggcggcagcgcaaaagatg

SEQ ID NO: 157853 - DNA, 103 bp, Artificial Sequence
  Synthetic Polynucleotide
taatacgactcactatagggaaatgtgcatcccctccaatgccagatccaaacagaggagatggatcatgcattggaggaacctggcggcagcgcaaaagatg

SEQ ID NO: 157854 - DNA, 103 bp, Artificial Sequence
  Synthetic Polynucleotide
taatacgactcactataggggtcctcatcgaaatgtgcatcccctccaataacagaggagaattggaatggatgcacataacctggcggcagcgcaaaagatg

SEQ ID NO: 157855 - DNA, 103 bp, Artificial Sequence
  Synthetic Polynucleotide
taatacgactcactatagggtccagaattcgtcctcatcgaaatgtgcataacagaggagaatgcacatgtcgatgaggaacctggcggcagcgcaaaagatg

SEQ ID NO: 157856 - DNA, 103 bp, Artificial Sequence
  Synthetic Polynucleotide
taatacgactcactatagggttttccaggcttgtagagctgttcaggggaaacagaggagatcccctatgcagctctacaacctggcggcagcgcaaaagatg

SEQ ID NO: 157857 - DNA, 103 bp, Artificial Sequence
  Synthetic Polynucleotide
taatacgactcactataggggaatgtgtagtccagaattcgtcctcatcgaacagaggagacgatgaatgcgaattctgaacctggcggcagcgcaaaagatg

SEQ ID NO: 157858 - DNA, 103 bp, Artificial Sequence
  Synthetic Polynucleotide
taatacgactcactatagggtgtgcctcctgaatgtgtagtccagaattcaacagaggagagaattcatgactacacataacctggcggcagcgcaaaagatg

SEQ ID NO: 157859 - DNA, 103 bp, Artificial Sequence
  Synthetic Polynucleotide
taatacgactcactatagggggaacaagtttgtgcctcctgaatgtgtagaacagaggagactacacatgcaggaggcaaacctggcggcagcgcaaaagatg

SEQ ID NO: 157860 - DNA, 103 bp, Artificial Sequence
  Synthetic Polynucleotide
taatacgactcactatagggacagcagtgaggaacaagtttgtgcctcctaacagaggagaaggaggatgaaacttgttaacctggcggcagcgcaaaagatg

SEQ ID NO: 157861 - DNA, 103 bp, Artificial Sequence
  Synthetic Polynucleotide
taatacgactcactatagggaatctcgtgaacagcagtgaggaacaagttaacagaggagaaacttgatgctcactgctaacctggcggcagcgcaaaagatg

SEQ ID NO: 157862 - DNA, 103 bp, Artificial Sequence
  Synthetic Polynucleotide
taatacgactcactatagggaggaatggccaatctcgtgaacagcagtgaaacagaggagatcactgatgttcacgagaaacctggcggcagcgcaaaagatg

SEQ ID NO: 157863 - DNA, 103 bp, Artificial Sequence
  Synthetic Polynucleotide
taatacgactcactatagggccaagacctaaggaatggccaatctcgtgaaacagaggagatcacgaatgtggccattcaacctggcggcagcgcaaaagatg

SEQ ID NO: 157864 - DNA, 103 bp, Artificial Sequence
  Synthetic Polynucleotide
taatacgactcactatagggactagaatggccaagacctaaggaatggccaacagaggagaggccatatgttaggtcttaacctggcggcagcgcaaaagatg

SEQ ID NO: 157865 - DNA, 103 bp, Artificial Sequence
  Synthetic Polynucleotide
taatacgactcactatagggcctttggatcactagaatggccaagacctaaacagaggagataggtcatggccattctaaacctggcggcagcgcaaaagatg

SEQ ID NO: 157866 - DNA, 103 bp, Artificial Sequence
  Synthetic Polynucleotide
taatacgactcactatagggaacattacggcctttggatcactagaatggaacagaggagaccattcatgtgatccaaaaacctggcggcagcgcaaaagatg

SEQ ID NO: 157867 - DNA, 103 bp, Artificial Sequence
  Synthetic Polynucleotide
taatacgactcactatagggcacattatttttttccaggcttgtagagctaacagaggagaagctctatgagcctggaaaacctggcggcagcgcaaaagatg

SEQ ID NO: 157868 - DNA, 103 bp, Artificial Sequence
  Synthetic Polynucleotide
taatacgactcactataggggtaggtggggaacattacggcctttggatcaacagaggagagatccaatggccgtaatgaacctggcggcagcgcaaaagatg

SEQ ID NO: 157869 - DNA, 103 bp, Artificial Sequence
  Synthetic Polynucleotide
taatacgactcactatagggcaacatatttgtaggtggggaacattacggaacagaggagaccgtaaatgtccccacctaacctggcggcagcgcaaaagatg

SEQ ID NO: 157870 - DNA, 103 bp, Artificial Sequence
  Synthetic Polynucleotide
taatacgactcactataggggtgttgatgtcaacatatttgtaggtggggaacagaggagaccccacatgcaaatatgtaacctggcggcagcgcaaaagatg

SEQ ID NO: 157871 - DNA, 103 bp, Artificial Sequence
  Synthetic Polynucleotide
taatacgactcactataggggaggcgaaatgtgttgatgtcaacatatttaacagaggagaaaatatatggacatcaacaacctggcggcagcgcaaaagatg

SEQ ID NO: 157872 - DNA, 103 bp, Artificial Sequence
  Synthetic Polynucleotide
taatacgactcactatagggcatcagcagagaggcgaaatgtgttgatgtaacagaggagaacatcaatgcatttcgccaacctggcggcagcgcaaaagatg

SEQ ID NO: 157873 - DNA, 103 bp, Artificial Sequence
  Synthetic Polynucleotide
taatacgactcactatagggccacgtatgtcatcagcagagaggcgaaataacagaggagaatttcgatgctctgctgaaacctggcggcagcgcaaaagatg

SEQ ID NO: 157874 - DNA, 103 bp, Artificial Sequence
  Synthetic Polynucleotide
taatacgactcactatagggggactgaatgccacgtatgtcatcagcagaaacagaggagatctgctatggacatacgtaacctggcggcagcgcaaaagatg

SEQ ID NO: 157875 - DNA, 103 bp, Artificial Sequence
  Synthetic Polynucleotide
taatacgactcactatagggctccatacagggactgaatgccacgtatgtaacagaggagaacatacatggcattcagtaacctggcggcagcgcaaaagatg

SEQ ID NO: 157876 - DNA, 103 bp, Artificial Sequence
  Synthetic Polynucleotide
taatacgactcactatagggtcttttgggtctccatacagggactgaatgaacagaggagacattcaatgcctgtatggaacctggcggcagcgcaaaagatg

SEQ ID NO: 157877 - DNA, 103 bp, Artificial Sequence
  Synthetic Polynucleotide
taatacgactcactataggggcgttggttctcttttgggtctccatacagaacagaggagactgtatatggacccaaaaaacctggcggcagcgcaaaagatg

SEQ ID NO: 157878 - DNA, 103 bp, Artificial Sequence
  Synthetic Polynucleotide
taatacgactcactatagggcaccaaatagcacattatttttttccaggcaacagaggagagcctggatgaaaataatgaacctggcggcagcgcaaaagatg

SEQ ID NO: 157879 - DNA, 103 bp, Artificial Sequence
  Synthetic Polynucleotide
taatacgactcactataggggatttggcaagcgttggttctcttttgggtaacagaggagaacccaaatgagaaccaacaacctggcggcagcgcaaaagatg

SEQ ID NO: 157880 - DNA, 103 bp, Artificial Sequence
  Synthetic Polynucleotide
taatacgactcactataggggaattgtcaggatttggcaagcgttggttcaacagaggagagaaccaatgcttgccaaaaacctggcggcagcgcaaaagatg

SEQ ID NO: 157881 - DNA, 103 bp, Artificial Sequence
  Synthetic Polynucleotide
taatacgactcactatagggagctggttctgaattgtcaggatttggcaaaacagaggagattgccaatgcctgacaataacctggcggcagcgcaaaagatg

SEQ ID NO: 157882 - DNA, 103 bp, Artificial Sequence
  Synthetic Polynucleotide
taatacgactcactatagggggtcacagagagctggttctgaattgtcagaacagaggagactgacaatgcagaaccagaacctggcggcagcgcaaaagatg

SEQ ID NO: 157883 - DNA, 103 bp, Artificial Sequence
  Synthetic Polynucleotide
taatacgactcactatagggctcaaattggggtcacagagagctggttctaacagaggagaagaaccatgtctctgtgaaacctggcggcagcgcaaaagatg

SEQ ID NO: 157884 - DNA, 103 bp, Artificial Sequence
  Synthetic Polynucleotide
taatacgactcactatagggagcatcaaaactcaaattggggtcacagagaacagaggagactctgtatgcccaatttgaacctggcggcagcgcaaaagatg

SEQ ID NO: 157885 - DNA, 103 bp, Artificial Sequence
  Synthetic Polynucleotide
taatacgactcactatagggcggtagtgacagcatcaaaactcaaattggaacagaggagaccaattatggttttgatgaacctggcggcagcgcaaaagatg

SEQ ID NO: 157886 - DNA, 103 bp, Artificial Sequence
  Synthetic Polynucleotide
taatacgactcactatagggttatttcccacggtagtgacagcatcaaaaaacagaggagattttgaatgtgtcactacaacctggcggcagcgcaaaagatg

SEQ ID NO: 157887 - DNA, 103 bp, Artificial Sequence
  Synthetic Polynucleotide
taatacgactcactataggggaaaaagatcttatttcccacggtagtgacaacagaggagagtcactatggtgggaaataacctggcggcagcgcaaaagatg

SEQ ID NO: 157888 - DNA, 103 bp, Artificial Sequence
  Synthetic Polynucleotide
taatacgactcactatagggtgtctttgaagaaaaagatcttatttcccaaacagaggagatgggaaatgagatcttttaacctggcggcagcgcaaaagatg

SEQ ID NO: 157889 - DNA, 103 bp, Artificial Sequence
  Synthetic Polynucleotide
taatacgactcactatagggaagtatctttcaccaaatagcacattatttaacagaggagaaaataaatggctatttggaacctggcggcagcgcaaaagatg

SEQ ID NO: 157890 - DNA, 103 bp, Artificial Sequence
  Synthetic Polynucleotide
taatacgactcactatagggcagaagaacctgtctttgaagaaaaagatcaacagaggagagatcttatgcttcaaagaaacctggcggcagcgcaaaagatg

SEQ ID NO: 157891 - DNA, 103 bp, Artificial Sequence
  Synthetic Polynucleotide
taatacgactcactatagggaaccttcagccagaagaacctgtctttgaaaacagaggagattcaaaatgaggttcttcaacctggcggcagcgcaaaagatg

SEQ ID NO: 157892 - DNA, 103 bp, Artificial Sequence
  Synthetic Polynucleotide
taatacgactcactataggggtctctcagaaaccttcagccagaagaaccaacagaggagaggttctatgggctgaaggaacctggcggcagcgcaaaagatg

SEQ ID NO: 157893 - DNA, 103 bp, Artificial Sequence
  Synthetic Polynucleotide
taatacgactcactatagggctggtctttggtctctcagaaaccttcagcaacagaggagagctgaaatgttctgagagaacctggcggcagcgcaaaagatg

SEQ ID NO: 157894 - DNA, 103 bp, Artificial Sequence
  Synthetic Polynucleotide
taatacgactcactatagggtaaattaacactggtctttggtctctcagaaacagaggagatctgagatgccaaagaccaacctggcggcagcgcaaaagatg

SEQ ID NO: 157895 - DNA, 103 bp, Artificial Sequence
  Synthetic Polynucleotide
taatacgactcactatagggaggaagaaattaaattaacactggtctttgaacagaggagacaaagaatggtgttaattaacctggcggcagcgcaaaagatg

SEQ ID NO: 157896 - DNA, 103 bp, Artificial Sequence
  Synthetic Polynucleotide
taatacgactcactataggggttggccataaggaagaaattaaattaacaaacagaggagatgttaaatgaatttcttcaacctggcggcagcgcaaaagatg

SEQ ID NO: 157897 - DNA, 103 bp, Artificial Sequence
  Synthetic Polynucleotide
taatacgactcactatagggagatggcaaggttggccataaggaagaaataacagaggagaatttctatgttatggccaaacctggcggcagcgcaaaagatg

SEQ ID NO: 157898 - DNA, 103 bp, Artificial Sequence
  Synthetic Polynucleotide
taatacgactcactatagggcttcaatgccagatggcaaggttggccataaacagaggagatatggcatgccttgccataacctggcggcagcgcaaaagatg

SEQ ID NO: 157899 - DNA, 103 bp, Artificial Sequence
  Synthetic Polynucleotide
taatacgactcactatagggtcataagcagcttcaatgccagatggcaagaacagaggagacttgccatgtggcattgaaacctggcggcagcgcaaaagatg

SEQ ID NO: 157900 - DNA, 103 bp, Artificial Sequence
  Synthetic Polynucleotide
taatacgactcactatagggggccgcctccagtagcgtctctatgctcataacagaggagaatgagcatggagacgctaaacctggcggcagcgcaaaagatg

SEQ ID NO: 157901 - DNA, 103 bp, Artificial Sequence
  Synthetic Polynucleotide
taatacgactcactatagggctgttcctgctctcgctcctgctccaagcgaacagaggagacgcttgatgcaggagcgaaacctggcggcagcgcaaaagatg

SEQ ID NO: 157902 - DNA, 103 bp, Artificial Sequence
  Synthetic Polynucleotide
taatacgactcactataggggtctatgttgtcctcaccctcagaggcggtaacagaggagaaccgccatggagggtgagaacctggcggcagcgcaaaagatg

SEQ ID NO: 157903 - DNA, 103 bp, Artificial Sequence
  Synthetic Polynucleotide
taatacgactcactatagggccatatcctcgtctatgttgtcctcaccctaacagaggagaagggtgatgacaacatagaacctggcggcagcgcaaaagatg

SEQ ID NO: 157904 - DNA, 103 bp, Artificial Sequence
  Synthetic Polynucleotide
taatacgactcactatagggcggtcctcctccatatcctcgtctatgttgaacagaggagacaacatatgcgaggatataacctggcggcagcgcaaaagatg

SEQ ID NO: 157905 - DNA, 103 bp, Artificial Sequence
  Synthetic Polynucleotide
taatacgactcactatagggcaggcccgcccggtcctcctccatatcctcaacagaggagagaggatatggaggaggacaacctggcggcagcgcaaaagatg

SEQ ID NO: 157906 - DNA, 103 bp, Artificial Sequence
  Synthetic Polynucleotide
taatacgactcactatagggtaggtgggcccaggcccgcccggtcctcctaacagaggagaaggaggatggggcgggccaacctggcggcagcgcaaaagatg

SEQ ID NO: 157907 - DNA, 103 bp, Artificial Sequence
  Synthetic Polynucleotide
taatacgactcactatagggtggctcagcttaggtgggcccaggcccgccaacagaggagaggcgggatggggcccaccaacctggcggcagcgcaaaagatg

SEQ ID NO: 157908 - DNA, 103 bp, Artificial Sequence
  Synthetic Polynucleotide
taatacgactcactatagggctggggacgatggctcagcttaggtgggccaacagaggagaggcccaatgaagctgagcaacctggcggcagcgcaaaagatg

SEQ ID NO: 157909 - DNA, 103 bp, Artificial Sequence
  Synthetic Polynucleotide
taatacgactcactataggggcagctccggctggggacgatggctcagctaacagaggagaagctgaatgatcgtccccaacctggcggcagcgcaaaagatg

SEQ ID NO: 157910 - DNA, 103 bp, Artificial Sequence
  Synthetic Polynucleotide
taatacgactcactataggggtggacttcagcagctccggctggggacgaaacagaggagatcgtccatggccggagctaacctggcggcagcgcaaaagatg

SEQ ID NO: 157911 - DNA, 103 bp, Artificial Sequence
  Synthetic Polynucleotide
taatacgactcactataggggggtggcagggtggacttcagcagctccggaacagaggagaccggagatgctgaagtccaacctggcggcagcgcaaaagatg

SEQ ID NO: 157912 - DNA, 103 bp, Artificial Sequence
  Synthetic Polynucleotide
taatacgactcactatagggtggccttcttctgttcctgctctcgctcctaacagaggagaaggagcatgagcaggaacaacctggcggcagcgcaaaagatg

SEQ ID NO: 157913 - DNA, 103 bp, Artificial Sequence
  Synthetic Polynucleotide
taatacgactcactatagggtggtgctggggggtggcagggtggacttcaaacagaggagatgaagtatgccctgccacaacctggcggcagcgcaaaagatg

SEQ ID NO: 157914 - DNA, 103 bp, Artificial Sequence
  Synthetic Polynucleotide
taatacgactcactatagggggcgcaggggtggtgctggggggtggcaggaacagaggagacctgccatgccccagcacaacctggcggcagcgcaaaagatg

SEQ ID NO: 157915 - DNA, 103 bp, Artificial Sequence
  Synthetic Polynucleotide
taatacgactcactatagggtggaggcagaggcgcaggggtggtgctgggaacagaggagacccagcatgacccctgcgaacctggcggcagcgcaaaagatg

SEQ ID NO: 157916 - DNA, 103 bp, Artificial Sequence
  Synthetic Polynucleotide
taatacgactcactatagggggtgtgggtgtggaggcagaggcgcaggggaacagaggagacccctgatgctctgcctcaacctggcggcagcgcaaaagatg

SEQ ID NO: 157917 - DNA, 103 bp, Artificial Sequence
  Synthetic Polynucleotide
taatacgactcactatagggtgggggtgagggtgtgggtgtggaggcagaaacagaggagatctgccatgacacccacaaacctggcggcagcgcaaaagatg

SEQ ID NO: 157918 - DNA, 103 bp, Artificial Sequence
  Synthetic Polynucleotide
taatacgactcactatagggggccacggagtgggggtgagggtgtgggtgaacagaggagacacccaatgcctcaccccaacctggcggcagcgcaaaagatg

SEQ ID NO: 157919 - DNA, 103 bp, Artificial Sequence
  Synthetic Polynucleotide
taatacgactcactatagggcaggaggtagggccacggagtgggggtgagaacagaggagactcaccatgactccgtggaacctggcggcagcgcaaaagatg

SEQ ID NO: 157920 - DNA, 103 bp, Artificial Sequence
  Synthetic Polynucleotide
taatacgactcactataggggggaggtgggcaggaggtagggccacggagaacagaggagactccgtatgcctacctccaacctggcggcagcgcaaaagatg

SEQ ID NO: 157921 - DNA, 103 bp, Artificial Sequence
  Synthetic Polynucleotide
taatacgactcactatagggctgctgcacggggaggtgggcaggaggtagaacagaggagactacctatggcccacctcaacctggcggcagcgcaaaagatg

SEQ ID NO: 157922 - DNA, 103 bp, Artificial Sequence
  Synthetic Polynucleotide
taatacgactcactataggggtggctgctgctgctgcacggggaggtgggaacagaggagacccaccatgccgtgcagcaacctggcggcagcgcaaaagatg

SEQ ID NO: 157923 - DNA, 103 bp, Artificial Sequence
  Synthetic Polynucleotide
taatacgactcactataggggccaggctattggccttcttctgttcctgcaacagaggagagcaggaatggaagaaggcaacctggcggcagcgcaaaagatg

SEQ ID NO: 157924 - DNA, 103 bp, Artificial Sequence
  Synthetic Polynucleotide
taatacgactcactataggggtcttctgctgtggctgctgctgctgcacgaacagaggagacgtgcaatggcagcagccaacctggcggcagcgcaaaagatg

SEQ ID NO: 157925 - DNA, 103 bp, Artificial Sequence
  Synthetic Polynucleotide
taatacgactcactatagggtggcagaggggtcttctgctgtggctgctgaacagaggagacagcagatgcagcagaagaacctggcggcagcgcaaaagatg

SEQ ID NO: 157926 - DNA, 103 bp, Artificial Sequence
  Synthetic Polynucleotide
taatacgactcactataggggaggaggggctggcagaggggtcttctgctaacagaggagaagcagaatgcccctctgcaacctggcggcagcgcaaaagatg

SEQ ID NO: 157927 - DNA, 103 bp, Artificial Sequence
  Synthetic Polynucleotide
taatacgactcactataggggccggtgggggaggaggggctggcagagggaacagaggagaccctctatgagcccctccaacctggcggcagcgcaaaagatg

SEQ ID NO: 157928 - DNA, 103 bp, Artificial Sequence
  Synthetic Polynucleotide
taatacgactcactatagggggcaggggcagccggtgggggaggaggggcaacagaggagagcccctatgcccccaccgaacctggcggcagcgcaaaagatg

SEQ ID NO: 157929 - DNA, 103 bp, Artificial Sequence
  Synthetic Polynucleotide
taatacgactcactatagggccagtgtctgggcaggggcagccggtggggaacagaggagaccccacatgctgcccctgaacctggcggcagcgcaaaagatg

SEQ ID NO: 157930 - DNA, 103 bp, Artificial Sequence
  Synthetic Polynucleotide
taatacgactcactatagggggagctggcaccagtgtctgggcaggggcaaacagaggagatgccccatgccagacactaacctggcggcagcgcaaaagatg

SEQ ID NO: 157931 - DNA, 103 bp, Artificial Sequence
  Synthetic Polynucleotide
taatacgactcactatagggcagatgggctggagctggcaccagtgtctgaacagaggagacagacaatggtgccagctaacctggcggcagcgcaaaagatg

SEQ ID NO: 157932 - DNA, 103 bp, Artificial Sequence
  Synthetic Polynucleotide
taatacgactcactatagggccgtcgccaccagatgggctggagctggcaaacagaggagatgccagatgcagcccatcaacctggcggcagcgcaaaagatg

SEQ ID NO: 157933 - DNA, 103 bp, Artificial Sequence
  Synthetic Polynucleotide
taatacgactcactatagggccacccccagccgtcgccaccagatgggctaacagaggagaagcccaatgggtggcgacaacctggcggcagcgcaaaagatg

SEQ ID NO: 157934 - DNA, 103 bp, Artificial Sequence
  Synthetic Polynucleotide
taatacgactcactatagggtgccagcctggccaggctattggccttcttaacagaggagaaagaagatgaatagcctgaacctggcggcagcgcaaaagatg

SEQ ID NO: 157935 - DNA, 103 bp, Artificial Sequence
  Synthetic Polynucleotide
taatacgactcactataggggaccgtggagccacccccagccgtcgccacaacagaggagagtggcgatggctgggggtaacctggcggcagcgcaaaagatg

SEQ ID NO: 157936 - DNA, 103 bp, Artificial Sequence
  Synthetic Polynucleotide
taatacgactcactatagggtgtgggcgatgaccgtggagccacccccagaacagaggagactggggatggctccacggaacctggcggcagcgcaaaagatg

SEQ ID NO: 157937 - DNA, 103 bp, Artificial Sequence
  Synthetic Polynucleotide
taatacgactcactataggggtggtggctgtgtgggcgatgaccgtggagaacagaggagactccacatgcatcgcccaaacctggcggcagcgcaaaagatg

SEQ ID NO: 157938 - DNA, 103 bp, Artificial Sequence
  Synthetic Polynucleotide
taatacgactcactatagggtgaagcgtgagtggtggctgtgtgggcgataacagaggagaatcgccatgacagccaccaacctggcggcagcgcaaaagatg

SEQ ID NO: 157939 - DNA, 103 bp, Artificial Sequence
  Synthetic Polynucleotide
taatacgactcactatagggtctggatgactgaagcgtgagtggtggctgaacagaggagacagccaatgctcacgcttaacctggcggcagcgcaaaagatg

SEQ ID NO: 157940 - DNA, 103 bp, Artificial Sequence
  Synthetic Polynucleotide
taatacgactcactatagggtggttcacagtctggatgactgaagcgtgaaacagaggagatcacgcatgagtcatccaaacctggcggcagcgcaaaagatg

SEQ ID NO: 157941 - DNA, 103 bp, Artificial Sequence
  Synthetic Polynucleotide
taatacgactcactatagggctgcagaacgtggttcacagtctggatgacaacagaggagagtcatcatgactgtgaacaacctggcggcagcgcaaaagatg

SEQ ID NO: 157942 - DNA, 103 bp, Artificial Sequence
  Synthetic Polynucleotide
taatacgactcactatagggcgcctggcccctgcagaacgtggttcacagaacagaggagactgtgaatgacgttctgcaacctggcggcagcgcaaaagatg

SEQ ID NO: 157943 - DNA, 103 bp, Artificial Sequence
  Synthetic Polynucleotide
taatacgactcactatagggatgtgcttgccgcctggcccctgcagaacgaacagaggagacgttctatgggggccaggaacctggcggcagcgcaaaagatg

SEQ ID NO: 157944 - DNA, 103 bp, Artificial Sequence
  Synthetic Polynucleotide
taatacgactcactataggggatgtgggcgatgtgcttgccgcctggcccaacagaggagagggccaatgggcaagcacaacctggcggcagcgcaaaagatg

SEQ ID NO: 157945 - DNA, 103 bp, Artificial Sequence
  Synthetic Polynucleotide
taatacgactcactataggggaagggtatgtgccagcctggccaggctataacagaggagaatagccatgccaggctggaacctggcggcagcgcaaaagatg

SEQ ID NO: 157946 - DNA, 103 bp, Artificial Sequence
  Synthetic Polynucleotide
taatacgactcactatagggccgagggggcgatgtgggcgatgtgcttgcaacagaggagagcaagcatgtcgcccacaaacctggcggcagcgcaaaagatg

SEQ ID NO: 157947 - DNA, 103 bp, Artificial Sequence
  Synthetic Polynucleotide
taatacgactcactataggggggctgggggccgagggggcgatgtgggcgaacagaggagacgcccaatgcgccccctcaacctggcggcagcgcaaaagatg

SEQ ID NO: 157948 - DNA, 103 bp, Artificial Sequence
  Synthetic Polynucleotide
taatacgactcactatagggttgcaccgcagggctgggggccgagggggcaacagaggagagcccccatggcccccagcaacctggcggcagcgcaaaagatg

SEQ ID NO: 157949 - DNA, 103 bp, Artificial Sequence
  Synthetic Polynucleotide
taatacgactcactatagggcaggcgccagttgcaccgcagggctgggggaacagaggagacccccaatgctgcggtgcaacctggcggcagcgcaaaagatg

SEQ ID NO: 157950 - DNA, 103 bp, Artificial Sequence
  Synthetic Polynucleotide
taatacgactcactataggggggggtgtggcaggcgccagttgcaccgcaaacagaggagatgcggtatgactggcgccaacctggcggcagcgcaaaagatg

SEQ ID NO: 157951 - DNA, 103 bp, Artificial Sequence
  Synthetic Polynucleotide
taatacgactcactataggggtgcccaatggggggtgtggcaggcgccagaacagaggagactggcgatggccacacccaacctggcggcagcgcaaaagatg

SEQ ID NO: 157952 - DNA, 103 bp, Artificial Sequence
  Synthetic Polynucleotide
taatacgactcactataggggcacagtgatgtgcccaatggggggtgtggaacagaggagaccacacatgccattgggcaacctggcggcagcgcaaaagatg

SEQ ID NO: 157953 - DNA, 103 bp, Artificial Sequence
  Synthetic Polynucleotide
taatacgactcactataggggtggcagggtgcacagtgatgtgcccaatgaacagaggagacattggatgcatcactgtaacctggcggcagcgcaaaagatg

SEQ ID NO: 157954 - DNA, 103 bp, Artificial Sequence
  Synthetic Polynucleotide
taatacgactcactatagggatggttgagggtggcagggtgcacagtgataacagaggagaatcactatgcaccctgccaacctggcggcagcgcaaaagatg

SEQ ID NO: 157955 - DNA, 103 bp, Artificial Sequence
  Synthetic Polynucleotide
taatacgactcactatagggggtgggccacatggttgagggtggcagggtaacagaggagaaccctgatgccctcaaccaacctggcggcagcgcaaaagatg

SEQ ID NO: 157956 - DNA, 103 bp, Artificial Sequence
  Synthetic Polynucleotide
taatacgactcactatagggtcctccacaggaagggtatgtgccagcctgaacagaggagacaggctatgacataccctaacctggcggcagcgcaaaagatg

SEQ ID NO: 157957 - DNA, 103 bp, Artificial Sequence
  Synthetic Polynucleotide
taatacgactcactatagggtgggagcccaggtgggccacatggttgaggaacagaggagacctcaaatgtgtggcccaaacctggcggcagcgcaaaagatg

SEQ ID NO: 157958 - DNA, 103 bp, Artificial Sequence
  Synthetic Polynucleotide
taatacgactcactatagggcaagggcagctgggagcccaggtgggccacaacagaggagagtggccatgctgggctccaacctggcggcagcgcaaaagatg

SEQ ID NO: 157959 - DNA, 103 bp, Artificial Sequence
  Synthetic Polynucleotide
taatacgactcactataggggctgcgggtacaagggcagctgggagcccaaacagaggagatgggctatgagctgccctaacctggcggcagcgcaaaagatg

SEQ ID NO: 157960 - DNA, 103 bp, Artificial Sequence
  Synthetic Polynucleotide
taatacgactcactatagggactgccacgggctgcgggtacaagggcagcaacagaggagagctgccatggtacccgcaaacctggcggcagcgcaaaagatg

SEQ ID NO: 157961 - DNA, 103 bp, Artificial Sequence
  Synthetic Polynucleotide
taatacgactcactataggggatgtggctcactgccacgggctgcgggtaaacagaggagatacccgatgcccgtggcaaacctggcggcagcgcaaaagatg

SEQ ID NO: 157962 - DNA, 103 bp, Artificial Sequence
  Synthetic Polynucleotide
taatacgactcactataggggggtgtgggcgatgtggctcactgccacggaacagaggagaccgtggatgtgagccacaaacctggcggcagcgcaaaagatg

SEQ ID NO: 157963 - DNA, 103 bp, Artificial Sequence
  Synthetic Polynucleotide
taatacgactcactatagggtggtgcgagagggtgtgggcgatgtggctcaacagaggagagagccaatgcgcccacacaacctggcggcagcgcaaaagatg

SEQ ID NO: 157964 - DNA, 103 bp, Artificial Sequence
  Synthetic Polynucleotide
taatacgactcactataggggttgacttgctggtgcgagagggtgtgggcaacagaggagagcccacatgctctcgcacaacctggcggcagcgcaaaagatg

SEQ ID NO: 157965 - DNA, 103 bp, Artificial Sequence
  Synthetic Polynucleotide
taatacgactcactatagggcggccgtgccgttgacttgctggtgcgagaaacagaggagatctcgcatgagcaagtcaaacctggcggcagcgcaaaagatg

SEQ ID NO: 157966 - DNA, 103 bp, Artificial Sequence
  Synthetic Polynucleotide
taatacgactcactatagggggccccaggccggccgtgccgttgacttgcaacagaggagagcaagtatgcggcacggcaacctggcggcagcgcaaaagatg

SEQ ID NO: 157967 - DNA, 103 bp, Artificial Sequence
  Synthetic Polynucleotide
taatacgactcactatagggcatgcggggttcctccacaggaagggtatgaacagaggagacataccatgcctgtggagaacctggcggcagcgcaaaagatg

SEQ ID NO: 157968 - DNA, 103 bp, Artificial Sequence
  Synthetic Polynucleotide
taatacgactcactatagggagtagccgggggccccaggccggccgtgccaacagaggagaggcacgatgggcctggggaacctggcggcagcgcaaaagatg

SEQ ID NO: 157969 - DNA, 103 bp, Artificial Sequence
  Synthetic Polynucleotide
taatacgactcactatagggttgccatgacagtagccgggggccccaggcaacagaggagagcctggatgccccggctaaacctggcggcagcgcaaaagatg

SEQ ID NO: 157970 - DNA, 103 bp, Artificial Sequence
  Synthetic Polynucleotide
taatacgactcactatagggacggccggctttgccatgacagtagccgggaacagaggagacccggcatgtgtcatggcaacctggcggcagcgcaaaagatg

SEQ ID NO: 157971 - DNA, 103 bp, Artificial Sequence
  Synthetic Polynucleotide
taatacgactcactatagggctgagcccccacggccggctttgccatgacaacagaggagagtcatgatgaagccggccaacctggcggcagcgcaaaagatg

SEQ ID NO: 157972 - DNA, 103 bp, Artificial Sequence
  Synthetic Polynucleotide
taatacgactcactatagggggtgcaccacctgagcccccacggccggctaacagaggagaagccggatgtgggggctcaacctggcggcagcgcaaaagatg

SEQ ID NO: 157973 - DNA, 103 bp, Artificial Sequence
  Synthetic Polynucleotide
taatacgactcactatagggagctgggggtggtgcaccacctgagcccccaacagaggagagggggcatgggtggtgcaaacctggcggcagcgcaaaagatg

SEQ ID NO: 157974 - DNA, 103 bp, Artificial Sequence
  Synthetic Polynucleotide
taatacgactcactatagggctggcccaccagctgggggtggtgcaccacaacagaggagagtggtgatgcacccccagaacctggcggcagcgcaaaagatg

SEQ ID NO: 157975 - DNA, 103 bp, Artificial Sequence
  Synthetic Polynucleotide
taatacgactcactatagggtgagcacggtctggcccaccagctgggggtaacagaggagaacccccatgtggtgggccaacctggcggcagcgcaaaagatg

SEQ ID NO: 157976 - DNA, 103 bp, Artificial Sequence
  Synthetic Polynucleotide
taatacgactcactataggggtcacagggttgagcacggtctggcccaccaacagaggagaggtgggatggaccgtgctaacctggcggcagcgcaaaagatg

SEQ ID NO: 157977 - DNA, 103 bp, Artificial Sequence
  Synthetic Polynucleotide
taatacgactcactatagggggtgaccatggtcacagggttgagcacggtaacagaggagaaccgtgatgaaccctgtgaacctggcggcagcgcaaaagatg

SEQ ID NO: 157978 - DNA, 103 bp, Artificial Sequence
  Synthetic Polynucleotide
taatacgactcactataggggtggcgcctccatgcggggttcctccacagaacagaggagactgtggatgaaccccgcaaacctggcggcagcgcaaaagatg

SEQ ID NO: 157979 - DNA, 103 bp, Artificial Sequence
  Synthetic Polynucleotide
taatacgactcactatagggaggagggcatggtgaccatggtcacagggtaacagaggagaaccctgatgccatggtcaaacctggcggcagcgcaaaagatg

SEQ ID NO: 157980 - DNA, 103 bp, Artificial Sequence
  Synthetic Polynucleotide
taatacgactcactatagggctgactgggaaggagggcatggtgaccatgaacagaggagacatggtatgcatgccctcaacctggcggcagcgcaaaagatg

SEQ ID NO: 157981 - DNA, 103 bp, Artificial Sequence
  Synthetic Polynucleotide
taatacgactcactatagggcttgagtgtgctgactgggaaggagggcataacagaggagaatgcccatgttcccagtcaacctggcggcagcgcaaaagatg

SEQ ID NO: 157982 - DNA, 103 bp, Artificial Sequence
  Synthetic Polynucleotide
taatacgactcactatagggagaggcaggggtggcgcctccatgcggggtaacagaggagaaccccgatgggaggcgccaacctggcggcagcgcaaaagatg

SEQ ID NO: 157983 - DNA, 103 bp, Artificial Sequence
  Synthetic Polynucleotide
taatacgactcactatagggcggtggagacagaggcaggggtggcgcctcaacagaggagagaggcgatgcccctgcctaacctggcggcagcgcaaaagatg

SEQ ID NO: 157984 - DNA, 103 bp, Artificial Sequence
  Synthetic Polynucleotide
taatacgactcactatagggccaggaagcgggccgcctccagtagcgtctaacagaggagaagacgcatgtggaggcggaacctggcggcagcgcaaaagatg

SEQ ID NO: 157985 - DNA, 103 bp, Artificial Sequence
  Synthetic Polynucleotide
taatacgactcactataggggcgggggagccggtggagacagaggcagggaacagaggagaccctgcatgtgtctccacaacctggcggcagcgcaaaagatg

SEQ ID NO: 157986 - DNA, 103 bp, Artificial Sequence
  Synthetic Polynucleotide
taatacgactcactataggggggggtgccggcgggggagccggtggagacaacagaggagagtctccatgggctcccccaacctggcggcagcgcaaaagatg

SEQ ID NO: 157987 - DNA, 103 bp, Artificial Sequence
  Synthetic Polynucleotide
taatacgactcactatagggaagtggtggtgggggtgccggcgggggagcaacagaggagagctcccatgccggcacccaacctggcggcagcgcaaaagatg

SEQ ID NO: 157988 - DNA, 103 bp, Artificial Sequence
  Synthetic Polynucleotide
taatacgactcactatagggcaggggtggcaagtggtggtgggggtgccgaacagaggagacggcacatgcaccaccacaacctggcggcagcgcaaaagatg

SEQ ID NO: 157989 - DNA, 103 bp, Artificial Sequence
  Synthetic Polynucleotide
taatacgactcactataggggtcagtggggcaggggtggcaagtggtggtaacagaggagaaccaccatgtgccaccccaacctggcggcagcgcaaaagatg

SEQ ID NO: 157990 - DNA, 103 bp, Artificial Sequence
  Synthetic Polynucleotide
taatacgactcactatagggagggatgacagtcagtggggcaggggtggcaacagaggagagccaccatggccccactgaacctggcggcagcgcaaaagatg

SEQ ID NO: 157991 - DNA, 103 bp, Artificial Sequence
  Synthetic Polynucleotide
taatacgactcactatagggccacagggatagggatgacagtcagtggggaacagaggagaccccacatgctgtcatccaacctggcggcagcgcaaaagatg

SEQ ID NO: 157992 - DNA, 103 bp, Artificial Sequence
  Synthetic Polynucleotide
taatacgactcactataggggagttggtcaccacagggatagggatgacaaacagaggagatgtcatatgtatccctgtaacctggcggcagcgcaaaagatg

SEQ ID NO: 157993 - DNA, 103 bp, Artificial Sequence
  Synthetic Polynucleotide
taatacgactcactatagggaggctgaggggagttggtcaccacagggataacagaggagaatccctatggtgaccaacaacctggcggcagcgcaaaagatg

SEQ ID NO: 157994 - DNA, 103 bp, Artificial Sequence
  Synthetic Polynucleotide
taatacgactcactataggggtgggggtagaggctgaggggagttggtcaaacagaggagatgaccaatgcccctcagcaacctggcggcagcgcaaaagatg

SEQ ID NO: 157995 - DNA, 103 bp, Artificial Sequence
  Synthetic Polynucleotide
taatacgactcactataggggcttgccattccaggaagcgggccgcctccaacagaggagaggaggcatgccgcttcctaacctggcggcagcgcaaaagatg

SEQ ID NO: 157996 - DNA, 103 bp, Artificial Sequence
  Synthetic Polynucleotide
taatacgactcactatagggaagggtgggggtgggggtagaggctgagggaacagaggagaccctcaatgtctacccccaacctggcggcagcgcaaaagatg

SEQ ID NO: 157997 - DNA, 103 bp, Artificial Sequence
  Synthetic Polynucleotide
taatacgactcactatagggtgccgcgggcaagggtgggggtgggggtagaacagaggagactacccatgcccccacccaacctggcggcagcgcaaaagatg

SEQ ID NO: 157998 - DNA, 103 bp, Artificial Sequence
  Synthetic Polynucleotide
taatacgactcactataggggaggctgggctgccgcgggcaagggtggggaacagaggagaccccacatgtgcccgcggaacctggcggcagcgcaaaagatg

SEQ ID NO: 157999 - DNA, 103 bp, Artificial Sequence
  Synthetic Polynucleotide
taatacgactcactataggggccaggggcagaggctgggctgccgcgggcaacagaggagagcccgcatgagcccagccaacctggcggcagcgcaaaagatg

SEQ ID NO: 158000 - DNA, 103 bp, Artificial Sequence
  Synthetic Polynucleotide
taatacgactcactatagggctgacgaggcgccaggggcagaggctgggcaacagaggagagcccagatgctgcccctgaacctggcggcagcgcaaaagatg

SEQ ID NO: 158001 - DNA, 103 bp, Artificial Sequence
  Synthetic Polynucleotide
taatacgactcactatagggccagggccggctgacgaggcgccaggggcaaacagaggagatgccccatgcgcctcgtcaacctggcggcagcgcaaaagatg

SEQ ID NO: 158002 - DNA, 103 bp, Artificial Sequence
  Synthetic Polynucleotide
taatacgactcactatagggggggcgccaaccagggccggctgacgaggcaacagaggagagcctcgatggccggccctaacctggcggcagcgcaaaagatg

SEQ ID NO: 158003 - DNA, 103 bp, Artificial Sequence
  Synthetic Polynucleotide
taatacgactcactataggggctgagtccgggggcgccaaccagggccggaacagaggagaccggccatggttggcgccaacctggcggcagcgcaaaagatg

SEQ ID NO: 158004 - DNA, 103 bp, Artificial Sequence
  Synthetic Polynucleotide
taatacgactcactataggggctccttaatgctgagtccgggggcgccaaaacagaggagattggcgatgccggactcaaacctggcggcagcgcaaaagatg

SEQ ID NO: 158005 - DNA, 103 bp, Artificial Sequence
  Synthetic Polynucleotide
taatacgactcactatagggaggggggcaggctccttaatgctgagtccgaacagaggagacggactatgcattaaggaaacctggcggcagcgcaaaagatg

SEQ ID NO: 158006 - DNA, 103 bp, Artificial Sequence
  Synthetic Polynucleotide
taatacgactcactatagggttgttgctgcgcttgccattccaggaagcgaacagaggagacgcttcatggaatggcaaaacctggcggcagcgcaaaagatg

SEQ ID NO: 158007 - DNA, 103 bp, Artificial Sequence
  Synthetic Polynucleotide
taatacgactcactatagggcctgctgggcaggggggcaggctccttaataacagaggagaattaagatgcctgcccccaacctggcggcagcgcaaaagatg

SEQ ID NO: 158008 - DNA, 103 bp, Artificial Sequence
  Synthetic Polynucleotide
taatacgactcactataggggcacctgcggcctgctgggcaggggggcagaacagaggagactgcccatgtgcccagcaaacctggcggcagcgcaaaagatg

SEQ ID NO: 158009 - DNA, 103 bp, Artificial Sequence
  Synthetic Polynucleotide
taatacgactcactataggggcaggggtgggcacctgcggcctgctgggcaacagaggagagcccagatggccgcaggtaacctggcggcagcgcaaaagatg

SEQ ID NO: 158010 - DNA, 103 bp, Artificial Sequence
  Synthetic Polynucleotide
taatacgactcactatagggcagtaggggagcaggggtgggcacctgcggaacagaggagaccgcagatgcccacccctaacctggcggcagcgcaaaagatg

SEQ ID NO: 158011 - DNA, 103 bp, Artificial Sequence
  Synthetic Polynucleotide
taatacgactcactatagggtcgagtccggcagtaggggagcaggggtggaacagaggagaccacccatgctcccctacaacctggcggcagcgcaaaagatg

SEQ ID NO: 158012 - DNA, 103 bp, Artificial Sequence
  Synthetic Polynucleotide
taatacgactcactatagggatggtggccttcgagtccggcagtaggggaaacagaggagatcccctatggccggactcaacctggcggcagcgcaaaagatg

SEQ ID NO: 158013 - DNA, 103 bp, Artificial Sequence
  Synthetic Polynucleotide
taatacgactcactatagggattgggtggaatggtggccttcgagtccggaacagaggagaccggacatgaaggccaccaacctggcggcagcgcaaaagatg

SEQ ID NO: 158014 - DNA, 103 bp, Artificial Sequence
  Synthetic Polynucleotide
taatacgactcactatagggtggggctgccattgggtggaatggtggcctaacagaggagaaggccaatgttccacccaaacctggcggcagcgcaaaagatg

SEQ ID NO: 158015 - DNA, 103 bp, Artificial Sequence
  Synthetic Polynucleotide
taatacgactcactatagggtgcaaaggcttggggctgccattgggtggaaacagaggagatccaccatgtggcagcccaacctggcggcagcgcaaaagatg

SEQ ID NO: 158016 - DNA, 103 bp, Artificial Sequence
  Synthetic Polynucleotide
taatacgactcactatagggggggaggggctgcaaaggcttggggctgccaacagaggagaggcagcatgaagcctttgaacctggcggcagcgcaaaagatg

SEQ ID NO: 158017 - DNA, 103 bp, Artificial Sequence
  Synthetic Polynucleotide
taatacgactcactataggggtgctctctgttgttgctgcgcttgccattaacagaggagaaatggcatgcgcagcaacaacctggcggcagcgcaaaagatg

SEQ ID NO: 158018 - DNA, 103 bp, Artificial Sequence
  Synthetic Polynucleotide
taatacgactcactatagggggacaggcgtggggaggggctgcaaaggctaacagaggagaagccttatgagcccctccaacctggcggcagcgcaaaagatg

SEQ ID NO: 158019 - DNA, 103 bp, Artificial Sequence
  Synthetic Polynucleotide
taatacgactcactataggggctatggtcaggacaggcgtggggaggggcaacagaggagagcccctatgcacgcctgtaacctggcggcagcgcaaaagatg

SEQ ID NO: 158020 - DNA, 103 bp, Artificial Sequence
  Synthetic Polynucleotide
taatacgactcactatagggagggtgtggcgctatggtcaggacaggcgtaacagaggagaacgcctatgctgaccataaacctggcggcagcgcaaaagatg

SEQ ID NO: 158021 - DNA, 103 bp, Artificial Sequence
  Synthetic Polynucleotide
taatacgactcactataggggctggactccagggtgtggcgctatggtcaaacagaggagatgaccaatgcgccacaccaacctggcggcagcgcaaaagatg

SEQ ID NO: 158022 - DNA, 103 bp, Artificial Sequence
  Synthetic Polynucleotide
taatacgactcactataggggccagctgaggctggactccagggtgtggcaacagaggagagccacaatgtggagtccaaacctggcggcagcgcaaaagatg

SEQ ID NO: 158023 - DNA, 103 bp, Artificial Sequence
  Synthetic Polynucleotide
taatacgactcactatagggctgctggggggccagctgaggctggactccaacagaggagaggagtcatgcctcagctgaacctggcggcagcgcaaaagatg

SEQ ID NO: 158024 - DNA, 103 bp, Artificial Sequence
  Synthetic Polynucleotide
taatacgactcactataggggtgggggcggctgctggggggccagctgagaacagaggagactcagcatgccccccagcaacctggcggcagcgcaaaagatg

SEQ ID NO: 158025 - DNA, 103 bp, Artificial Sequence
  Synthetic Polynucleotide
taatacgactcactatagggcccagcgtgggtgggggcggctgctgggggaacagaggagacccccaatggccgcccccaacctggcggcagcgcaaaagatg

SEQ ID NO: 158026 - DNA, 103 bp, Artificial Sequence
  Synthetic Polynucleotide
taatacgactcactatagggcttcagggtccccagcgtgggtgggggcggaacagaggagaccgcccatgcccacgctgaacctggcggcagcgcaaaagatg

SEQ ID NO: 158027 - DNA, 103 bp, Artificial Sequence
  Synthetic Polynucleotide
taatacgactcactatagggctggtgccaacttcagggtccccagcgtggaacagaggagaccacgcatgggaccctgaaacctggcggcagcgcaaaagatg

SEQ ID NO: 158028 - DNA, 103 bp, Artificial Sequence
  Synthetic Polynucleotide
taatacgactcactatagggtgctcctcacgtgctctctgttgttgctgcaacagaggagagcagcaatgacagagagcaacctggcggcagcgcaaaagatg

SEQ ID NO: 158029 - DNA, 103 bp, Artificial Sequence
  Synthetic Polynucleotide
taatacgactcactatagggacttcttcagctggtgccaacttcagggtcaacagaggagagaccctatggttggcaccaacctggcggcagcgcaaaagatg

SEQ ID NO: 158030 - DNA, 103 bp, Artificial Sequence
  Synthetic Polynucleotide
taatacgactcactatagggactggatttgacttcttcagctggtgccaaaacagaggagattggcaatggctgaagaaaacctggcggcagcgcaaaagatg

SEQ ID NO: 158031 - DNA, 103 bp, Artificial Sequence
  Synthetic Polynucleotide
taatacgactcactatagggtcttctgttcactggatttgacttcttcagaacagaggagactgaagatgtcaaatccaaacctggcggcagcgcaaaagatg

SEQ ID NO: 158032 - DNA, 103 bp, Artificial Sequence
  Synthetic Polynucleotide
taatacgactcactatagggccgggcctcttcttctgttcactggatttgaacagaggagacaaatcatgtgaacagaaaacctggcggcagcgcaaaagatg

SEQ ID NO: 158033 - DNA, 103 bp, Artificial Sequence
  Synthetic Polynucleotide
taatacgactcactatagggtccgatccccccgggcctcttcttctgttcaacagaggagagaacagatgaagaggcccaacctggcggcagcgcaaaagatg

SEQ ID NO: 158034 - DNA, 103 bp, Artificial Sequence
  Synthetic Polynucleotide
taatacgactcactatagggcttctctggttccgatccccccgggcctctaacagaggagaagaggcatggggggatcgaacctggcggcagcgcaaaagatg

SEQ ID NO: 158035 - DNA, 103 bp, Artificial Sequence
  Synthetic Polynucleotide
taatacgactcactatagggttgttgtggacttctctggttccgatccccaacagaggagaggggatatgaaccagagaaacctggcggcagcgcaaaagatg

SEQ ID NO: 158036 - DNA, 103 bp, Artificial Sequence
  Synthetic Polynucleotide
taatacgactcactatagggcttctccaatttgttgtggacttctctggtaacagaggagaaccagaatggtccacaacaacctggcggcagcgcaaaagatg

SEQ ID NO: 158037 - DNA, 103 bp, Artificial Sequence
  Synthetic Polynucleotide
taatacgactcactatagggccctcctgttcttctccaatttgttgtggaaacagaggagatccacaatgaattggagaaacctggcggcagcgcaaaagatg

SEQ ID NO: 158038 - DNA, 103 bp, Artificial Sequence
  Synthetic Polynucleotide
taatacgactcactatagggttcagatgggccctcctgttcttctccaataacagaggagaattggaatggaacaggagaacctggcggcagcgcaaaagatg

SEQ ID NO: 158039 - DNA, 103 bp, Artificial Sequence
  Synthetic Polynucleotide
taatacgactcactatagggaagccgctcctgctcctcacgtgctctctgaacagaggagacagagaatgcgtgaggagaacctggcggcagcgcaaaagatg

SEQ ID NO: 158040 - DNA, 103 bp, Artificial Sequence
  Synthetic Polynucleotide
taatacgactcactatagggaaagcactctttcagatgggccctcctgttaacagaggagaaacaggatggcccatctgaacctggcggcagcgcaaaagatg

SEQ ID NO: 158041 - DNA, 103 bp, Artificial Sequence
  Synthetic Polynucleotide
taatacgactcactatagggtcagggtctcaaagcactctttcagatgggaacagaggagacccatcatgaagagtgctaacctggcggcagcgcaaaagatg

SEQ ID NO: 158042 - DNA, 103 bp, Artificial Sequence
  Synthetic Polynucleotide
taatacgactcactatagggatgttccgcttcagggtctcaaagcactctaacagaggagaagagtgatgtgagaccctaacctggcggcagcgcaaaagatg

SEQ ID NO: 158043 - DNA, 103 bp, Artificial Sequence
  Synthetic Polynucleotide
taatacgactcactatagggcacgttggggatgttccgcttcagggtctcaacagaggagagagaccatgaagcggaacaacctggcggcagcgcaaaagatg

SEQ ID NO: 158044 - DNA, 103 bp, Artificial Sequence
  Synthetic Polynucleotide
taatacgactcactatagggtcttgtcatccacgttggggatgttccgctaacagaggagaagcggaatgtccccaacgaacctggcggcagcgcaaaagatg

SEQ ID NO: 158045 - DNA, 103 bp, Artificial Sequence
  Synthetic Polynucleotide
taatacgactcactatagggttggacgtcttcttgtcatccacgttggggaacagaggagaccccaaatgggatgacaaaacctggcggcagcgcaaaagatg

SEQ ID NO: 158046 - DNA, 103 bp, Artificial Sequence
  Synthetic Polynucleotide
taatacgactcactatagggcacgctcagattggacgtcttcttgtcatcaacagaggagagatgacatgaagacgtccaacctggcggcagcgcaaaagatg

SEQ ID NO: 158047 - DNA, 103 bp, Artificial Sequence
  Synthetic Polynucleotide
taatacgactcactatagggccgtccgcagcacgctcagattggacgtctaacagaggagaagacgtatgatctgagcgaacctggcggcagcgcaaaagatg

SEQ ID NO: 158048 - DNA, 103 bp, Artificial Sequence
  Synthetic Polynucleotide
taatacgactcactatagggtaccgcagcgccgtccgcagcacgctcagaaacagaggagatctgagatggctgcggacaacctggcggcagcgcaaaagatg

SEQ ID NO: 158049 - DNA, 103 bp, Artificial Sequence
  Synthetic Polynucleotide
taatacgactcactatagggggactggatgtaccgcagcgccgtccgcagaacagaggagactgcggatggcgctgcggaacctggcggcagcgcaaaagatg

SEQ ID NO: 158050 - DNA, 103 bp, Artificial Sequence
  Synthetic Polynucleotide
taatacgactcactataggggctccaagcgaagccgctcctgctcctcacaacagaggagagtgaggatgaggagcggcaacctggcggcagcgcaaaagatg

SEQ ID NO: 158051 - DNA, 103 bp, Artificial Sequence
  Synthetic Polynucleotide
taatacgactcactatagggtcctcttcagggactggatgtaccgcagcgaacagaggagacgctgcatgacatccagtaacctggcggcagcgcaaaagatg

SEQ ID NO: 158052 - DNA, 103 bp, Artificial Sequence
  Synthetic Polynucleotide
taatacgactcactatagggtccttctccttcctcttcagggactggatgaacagaggagacatccaatgcctgaagagaacctggcggcagcgcaaaagatg

SEQ ID NO: 158053 - DNA, 103 bp, Artificial Sequence
  Synthetic Polynucleotide
taatacgactcactatagggatgctcatattccttctccttcctcttcagaacagaggagactgaagatgaaggagaagaacctggcggcagcgcaaaagatg

SEQ ID NO: 158054 - DNA, 103 bp, Artificial Sequence
  Synthetic Polynucleotide
taatacgactcactataggggctccatttcatgctcatattccttctcctaacagaggagaaggagaatgaatatgagcaacctggcggcagcgcaaaagatg

SEQ ID NO: 158055 - DNA, 103 bp, Artificial Sequence
  Synthetic Polynucleotide
taatacgactcactatagggcgtgccagccgctccatttcatgctcatataacagaggagaatatgaatgtgaaatggaaacctggcggcagcgcaaaagatg

SEQ ID NO: 158056 - DNA, 103 bp, Artificial Sequence
  Synthetic Polynucleotide
taatacgactcactatagggaatcttctcacgtgccagccgctccatttcaacagaggagagaaatgatgcggctggcaaacctggcggcagcgcaaaagatg

SEQ ID NO: 158057 - DNA, 103 bp, Artificial Sequence
  Synthetic Polynucleotide
taatacgactcactataggggctgcgtggcaatcttctcacgtgccagccaacagaggagaggctggatggtgagaagaaacctggcggcagcgcaaaagatg

SEQ ID NO: 158058 - DNA, 103 bp, Artificial Sequence
  Synthetic Polynucleotide
taatacgactcactataggggccagccgctgctgcgtggcaatcttctcaaacagaggagatgagaaatgtgccacgcaaacctggcggcagcgcaaaagatg

SEQ ID NO: 158059 - DNA, 103 bp, Artificial Sequence
  Synthetic Polynucleotide
taatacgactcactatagggcttgagctctgccagccgctgctgcgtggcaacagaggagagccacgatgcagcggctgaacctggcggcagcgcaaaagatg

SEQ ID NO: 158060 - DNA, 103 bp, Artificial Sequence
  Synthetic Polynucleotide
taatacgactcactatagggtcagctcgtgcttgagctctgccagccgctaacagaggagaagcggcatgcagagctcaaacctggcggcagcgcaaaagatg

SEQ ID NO: 158061 - DNA, 103 bp, Artificial Sequence
  Synthetic Polynucleotide
taatacgactcactatagggtctcgctcctgctccaagcgaagccgctccaacagaggagaggagcgatgtcgcttggaaacctggcggcagcgcaaaagatg

SEQ ID NO: 158062 - DNA, 103 bp, Artificial Sequence
  Synthetic Polynucleotide
taatacgactcactatagggatccactggctcagctcgtgcttgagctctaacagaggagaagagctatggcacgagctaacctggcggcagcgcaaaagatg

SEQ ID NO: 158063 - DNA, 103 bp, Artificial Sequence
  Synthetic Polynucleotide
taatacgactcactatagggcagtacgtccatccactggctcagctcgtgaacagaggagacacgagatgagccagtggaacctggcggcagcgcaaaagatg

SEQ ID NO: 158064 - DNA, 103 bp, Artificial Sequence
  Synthetic Polynucleotide
taatacgactcactatagggggtcaatctccagtacgtccatccactggcaacagaggagagccagtatgtggacgtacaacctggcggcagcgcaaaagatg

SEQ ID NO: 158065 - DNA, 103 bp, Artificial Sequence
  Synthetic Polynucleotide
taatacgactcactatagggcgcagcacgcggtcaatctccagtacgtccaacagaggagaggacgtatgggagattgaaacctggcggcagcgcaaaagatg

SEQ ID NO: 158066 - DNA, 103 bp, Artificial Sequence
  Synthetic Polynucleotide
taatacgactcactataggggcccgtctgccgcagcacgcggtcaatctcaacagaggagagagattatgcgcgtgctgaacctggcggcagcgcaaaagatg

SEQ ID NO: 158067 - DNA, 103 bp, Artificial Sequence
  Synthetic Polynucleotide
taatacgactcactatagggcctcgggctggcccgtctgccgcagcacgcaacagaggagagcgtgcatgggcagacggaacctggcggcagcgcaaaagatg

SEQ ID NO: 158068 - DNA, 103 bp, Artificial Sequence
  Synthetic Polynucleotide
taatacgactcactataggggcctggtcatcctcgggctggcccgtctgcaacagaggagagcagacatgccagcccgaaacctggcggcagcgcaaaagatg

SEQ ID NO: 158069 - DNA, 103 bp, Artificial Sequence
  Synthetic Polynucleotide
taatacgactcactatagggggaggtggaggcctggtcatcctcgggctgaacagaggagacagcccatggatgaccagaacctggcggcagcgcaaaagatg

SEQ ID NO: 158070 - DNA, 103 bp, Artificial Sequence
  Synthetic Polynucleotide
taatacgactcactatagggcagaggcggtggaggtggaggcctggtcataacagaggagaatgaccatgcctccacctaacctggcggcagcgcaaaagatg

SEQ ID NO: 158071 - DNA, 103 bp, Artificial Sequence
  Synthetic Polynucleotide
taatacgactcactatagggtcctcaccctcagaggcggtggaggtggagaacagaggagactccacatgcaccgcctcaacctggcggcagcgcaaaagatg

SEQ ID NO: 158072 - DNA, 103 bp, Artificial Sequence
  Synthetic Polynucleotide
taatacgactcactatagggcattaacatctcaggttccagtagagtcataacagaggagaatgactatgctggaacctaacctggcggcagcgcaaaagatg

SEQ ID NO: 158073 - DNA, 103 bp, Artificial Sequence
  Synthetic Polynucleotide
taatacgactcactatagggtttcaaaggcggcatgatcccttggctcacaacagaggagagtgagcatggggatcatgaacctggcggcagcgcaaaagatg

SEQ ID NO: 158074 - DNA, 103 bp, Artificial Sequence
  Synthetic Polynucleotide
taatacgactcactatagggggtcccgctgcttcccagggcctcgcctgcaacagaggagagcaggcatggccctgggaaacctggcggcagcgcaaaagatg

SEQ ID NO: 158075 - DNA, 103 bp, Artificial Sequence
  Synthetic Polynucleotide
taatacgactcactataggggtactgggggggtcccgctgcttcccagggaacagaggagaccctggatggcagcgggaaacctggcggcagcgcaaaagatg

SEQ ID NO: 158076 - DNA, 103 bp, Artificial Sequence
  Synthetic Polynucleotide
taatacgactcactataggggagaggctgcgtactgggggggtcccgctgaacagaggagacagcggatgccccccagtaacctggcggcagcgcaaaagatg

SEQ ID NO: 158077 - DNA, 103 bp, Artificial Sequence
  Synthetic Polynucleotide
taatacgactcactatagggattggtagtggagaggctgcgtactgggggaacagaggagacccccaatgcgcagcctcaacctggcggcagcgcaaaagatg

SEQ ID NO: 158078 - DNA, 103 bp, Artificial Sequence
  Synthetic Polynucleotide
taatacgactcactatagggtggagctgctattggtagtggagaggctgcaacagaggagagcagccatgccactaccaaacctggcggcagcgcaaaagatg

SEQ ID NO: 158079 - DNA, 103 bp, Artificial Sequence
  Synthetic Polynucleotide
taatacgactcactataggggcgcccgagctggagctgctattggtagtgaacagaggagacactacatgtagcagctcaacctggcggcagcgcaaaagatg

SEQ ID NO: 158080 - DNA, 103 bp, Artificial Sequence
  Synthetic Polynucleotide
taatacgactcactataggggggcccaggggcgcccgagctggagctgctaacagaggagaagcagcatgagctcgggcaacctggcggcagcgcaaaagatg

SEQ ID NO: 158081 - DNA, 103 bp, Artificial Sequence
  Synthetic Polynucleotide
taatacgactcactatagggccagcccacagggcccaggggcgcccgagcaacagaggagagctcggatgcccctgggcaacctggcggcagcgcaaaagatg

SEQ ID NO: 158082 - DNA, 103 bp, Artificial Sequence
  Synthetic Polynucleotide
taatacgactcactatagggttctgacgtgccagcccacagggcccagggaacagaggagaccctggatgctgtgggctaacctggcggcagcgcaaaagatg

SEQ ID NO: 158083 - DNA, 103 bp, Artificial Sequence
  Synthetic Polynucleotide
taatacgactcactatagggtgaggtgctgttctgacgtgccagcccacaaacagaggagatgtgggatggcacgtcagaacctggcggcagcgcaaaagatg

SEQ ID NO: 158084 - DNA, 103 bp, Artificial Sequence
  Synthetic Polynucleotide
taatacgactcactatagggcggctggacttttcaaaggcggcatgatccaacagaggagaggatcaatgcgcctttgaaacctggcggcagcgcaaaagatg

SEQ ID NO: 158085 - DNA, 103 bp, Artificial Sequence
  Synthetic Polynucleotide
taatacgactcactatagggtgccagtcagtgaggtgctgttctgacgtgaacagaggagacacgtcatgacagcacctaacctggcggcagcgcaaaagatg

SEQ ID NO: 158086 - DNA, 103 bp, Artificial Sequence
  Synthetic Polynucleotide
taatacgactcactataggggctcccggcttgccagtcagtgaggtgctgaacagaggagacagcacatgactgactggaacctggcggcagcgcaaaagatg

SEQ ID NO: 158087 - DNA, 103 bp, Artificial Sequence
  Synthetic Polynucleotide
taatacgactcactatagggggccggcagggctcccggcttgccagtcagaacagaggagactgactatgaagccgggaaacctggcggcagcgcaaaagatg

SEQ ID NO: 158088 - DNA, 103 bp, Artificial Sequence
  Synthetic Polynucleotide
taatacgactcactatagggcgtccaggttggccggcagggctcccggctaacagaggagaagccggatgccctgccggaacctggcggcagcgcaaaagatg

SEQ ID NO: 158089 - DNA, 103 bp, Artificial Sequence
  Synthetic Polynucleotide
taatacgactcactatagggaccttcatgtcgtccaggttggccggcaggaacagaggagacctgccatgcaacctggaaacctggcggcagcgcaaaagatg

SEQ ID NO: 158090 - DNA, 103 bp, Artificial Sequence
  Synthetic Polynucleotide
taatacgactcactatagggcagctctgccaccttcatgtcgtccaggttaacagaggagaaacctgatggacatgaagaacctggcggcagcgcaaaagatg

SEQ ID NO: 158091 - DNA, 103 bp, Artificial Sequence
  Synthetic Polynucleotide
taatacgactcactataggggctcctgcttcagctctgccaccttcatgtaacagaggagaacatgaatgtggcagagcaacctggcggcagcgcaaaagatg

SEQ ID NO: 158092 - DNA, 103 bp, Artificial Sequence
  Synthetic Polynucleotide
taatacgactcactatagggcgcaacttcagctcctgcttcagctctgccaacagaggagaggcagaatggaagcaggaaacctggcggcagcgcaaaagatg

SEQ ID NO: 158093 - DNA, 103 bp, Artificial Sequence
  Synthetic Polynucleotide
taatacgactcactatagggaggcagtgatcgcaacttcagctcctgcttaacagaggagaaagcagatgctgaagttgaacctggcggcagcgcaaaagatg

SEQ ID NO: 158094 - DNA, 103 bp, Artificial Sequence
  Synthetic Polynucleotide
taatacgactcactatagggtgcccgagacaggcagtgatcgcaacttcaaacagaggagatgaagtatggatcactgcaacctggcggcagcgcaaaagatg

SEQ ID NO: 158095 - DNA, 103 bp, Artificial Sequence
  Synthetic Polynucleotide
taatacgactcactatagggtcatgaaatgcggctggacttttcaaaggcaacagaggagagcctttatgaagtccagcaacctggcggcagcgcaaaagatg

SEQ ID NO: 158096 - DNA, 103 bp, Artificial Sequence
  Synthetic Polynucleotide
taatacgactcactatagggtcagttttggtgcccgagacaggcagtgataacagaggagaatcactatgtgtctcgggaacctggcggcagcgcaaaagatg

SEQ ID NO: 158097 - DNA, 103 bp, Artificial Sequence
  Synthetic Polynucleotide
taatacgactcactatagggctcaatcagctcagttttggtgcccgagacaacagaggagagtctcgatgaccaaaactaacctggcggcagcgcaaaagatg

SEQ ID NO: 158098 - DNA, 103 bp, Artificial Sequence
  Synthetic Polynucleotide
taatacgactcactatagggctcgaaggcgctcaatcagctcagttttggaacagaggagaccaaaaatgagctgattgaacctggcggcagcgcaaaagatg

SEQ ID NO: 158099 - DNA, 103 bp, Artificial Sequence
  Synthetic Polynucleotide
taatacgactcactatagggtcttgataggctcgaaggcgctcaatcagcaacagaggagagctgatatggcgccttcgaacctggcggcagcgcaaaagatg

SEQ ID NO: 158100 - DNA, 103 bp, Artificial Sequence
  Synthetic Polynucleotide
taatacgactcactataggggctgatttggtcttgataggctcgaaggcgaacagaggagacgccttatggcctatcaaaacctggcggcagcgcaaaagatg

SEQ ID NO: 158101 - DNA, 103 bp, Artificial Sequence
  Synthetic Polynucleotide
taatacgactcactatagggctggcacagggctgatttggtcttgataggaacagaggagacctatcatgaccaaatcaaacctggcggcagcgcaaaagatg

SEQ ID NO: 158102 - DNA, 103 bp, Artificial Sequence
  Synthetic Polynucleotide
taatacgactcactatagggttgggggctcctggcacagggctgatttggaacagaggagaccaaatatgccctgtgccaacctggcggcagcgcaaaagatg

SEQ ID NO: 158103 - DNA, 103 bp, Artificial Sequence
  Synthetic Polynucleotide
taatacgactcactatagggggcaggggccttgggggctcctggcacaggaacagaggagacctgtgatgggagcccccaacctggcggcagcgcaaaagatg

SEQ ID NO: 158104 - DNA, 103 bp, Artificial Sequence
  Synthetic Polynucleotide
taatacgactcactatagggtagaggtggcggcaggggccttgggggctcaacagaggagagagcccatgaggcccctgaacctggcggcagcgcaaaagatg

SEQ ID NO: 158105 - DNA, 103 bp, Artificial Sequence
  Synthetic Polynucleotide
taatacgactcactatagggttgtgcaggatagaggtggcggcaggggccaacagaggagaggccccatgcgccacctcaacctggcggcagcgcaaaagatg

SEQ ID NO: 158106 - DNA, 103 bp, Artificial Sequence
  Synthetic Polynucleotide
taatacgactcactatagggccttctctgctcatgaaatgcggctggactaacagaggagaagtccaatggcatttcataacctggcggcagcgcaaaagatg

SEQ ID NO: 158107 - DNA, 103 bp, Artificial Sequence
  Synthetic Polynucleotide
taatacgactcactatagggctcgccagccttgtgcaggatagaggtggcaacagaggagagccaccatgatcctgcacaacctggcggcagcgcaaaagatg

SEQ ID NO: 158108 - DNA, 103 bp, Artificial Sequence
  Synthetic Polynucleotide
taatacgactcactatagggctaccaccacctcgccagccttgtgcaggaaacagaggagatcctgcatgaggctggcgaacctggcggcagcgcaaaagatg

SEQ ID NO: 158109 - DNA, 103 bp, Artificial Sequence
  Synthetic Polynucleotide
taatacgactcactataggggctgggaaggctaccaccacctcgccagccaacagaggagaggctggatgggtggtggtaacctggcggcagcgcaaaagatg

SEQ ID NO: 158110 - DNA, 103 bp, Artificial Sequence
  Synthetic Polynucleotide
taatacgactcactatagggcagccgggccgctgggaaggctaccaccacaacagaggagagtggtgatggccttcccaaacctggcggcagcgcaaaagatg

SEQ ID NO: 158111 - DNA, 103 bp, Artificial Sequence
  Synthetic Polynucleotide
taatacgactcactataggggccccgtgctcagccgggccgctgggaaggaacagaggagaccttccatgcggcccggcaacctggcggcagcgcaaaagatg

SEQ ID NO: 158112 - DNA, 103 bp, Artificial Sequence
  Synthetic Polynucleotide
taatacgactcactatagggaccagggctggccccgtgctcagccgggccaacagaggagaggcccgatggagcacgggaacctggcggcagcgcaaaagatg

SEQ ID NO: 158113 - DNA, 103 bp, Artificial Sequence
  Synthetic Polynucleotide
taatacgactcactataggggcctgctgccaccagggctggccccgtgctaacagaggagaagcacgatgccagccctgaacctggcggcagcgcaaaagatg

SEQ ID NO: 158114 - DNA, 103 bp, Artificial Sequence
  Synthetic Polynucleotide
taatacgactcactatagggctggagccaggcctgctgccaccagggctgaacagaggagacagcccatgtggcagcagaacctggcggcagcgcaaaagatg

SEQ ID NO: 158115 - DNA, 103 bp, Artificial Sequence
  Synthetic Polynucleotide
taatacgactcactatagggaccacctcagctggagccaggcctgctgccaacagaggagaggcagcatgcctggctccaacctggcggcagcgcaaaagatg

SEQ ID NO: 158116 - DNA, 103 bp, Artificial Sequence
  Synthetic Polynucleotide
taatacgactcactatagggcgtggccaccaccacctcagctggagccagaacagaggagactggctatggctgaggtgaacctggcggcagcgcaaaagatg

SEQ ID NO: 158117 - DNA, 103 bp, Artificial Sequence
  Synthetic Polynucleotide
taatacgactcactataggggctccaagctccttctctgctcatgaaatgaacagaggagacatttcatgagcagagaaaacctggcggcagcgcaaaagatg

SEQ ID NO: 158118 - DNA, 103 bp, Artificial Sequence
  Synthetic Polynucleotide
taatacgactcactatagggtgctggccaccgtggccaccaccacctcagaacagaggagactgaggatgtggtggccaaacctggcggcagcgcaaaagatg

SEQ ID NO: 158119 - DNA, 103 bp, Artificial Sequence
  Synthetic Polynucleotide
taatacgactcactatagggaccaccccactgctggccaccgtggccaccaacagaggagaggtggcatgggtggccagaacctggcggcagcgcaaaagatg

SEQ ID NO: 158120 - DNA, 103 bp, Artificial Sequence
  Synthetic Polynucleotide
taatacgactcactataggggccaaacttcaccaccccactgctggccacaacagaggagagtggccatgagtggggtgaacctggcggcagcgcaaaagatg

SEQ ID NO: 158121 - DNA, 103 bp, Artificial Sequence
  Synthetic Polynucleotide
taatacgactcactatagggagcccgtgctgccaaacttcaccaccccacaacagaggagagtggggatgtgaagtttgaacctggcggcagcgcaaaagatg

SEQ ID NO: 158122 - DNA, 103 bp, Artificial Sequence
  Synthetic Polynucleotide
taatacgactcactataggggggggcgtggagcccgtgctgccaaacttcaacagaggagagaagttatgcagcacgggaacctggcggcagcgcaaaagatg

SEQ ID NO: 158123 - DNA, 103 bp, Artificial Sequence
  Synthetic Polynucleotide
taatacgactcactataggggggagacacggggggcgtggagcccgtgctaacagaggagaagcacgatgtccacgcccaacctggcggcagcgcaaaagatg

SEQ ID NO: 158124 - DNA, 103 bp, Artificial Sequence
  Synthetic Polynucleotide
taatacgactcactatagggccgagggggtgggagacacggggggcgtggaacagaggagaccacgcatgccgtgtctcaacctggcggcagcgcaaaagatg

SEQ ID NO: 158125 - DNA, 103 bp, Artificial Sequence
  Synthetic Polynucleotide
taatacgactcactatagggagtgagcgctccgagggggtgggagacacgaacagaggagacgtgtcatgcaccccctcaacctggcggcagcgcaaaagatg

SEQ ID NO: 158126 - DNA, 103 bp, Artificial Sequence
  Synthetic Polynucleotide
taatacgactcactatagggcgtgctgagcagtgagcgctccgagggggtaacagaggagaacccccatggagcgctcaaacctggcggcagcgcaaaagatg

SEQ ID NO: 158127 - DNA, 103 bp, Artificial Sequence
  Synthetic Polynucleotide
taatacgactcactatagggtttcatcgcccgtgctgagcagtgagcgctaacagaggagaagcgctatgtgctcagcaaacctggcggcagcgcaaaagatg

SEQ ID NO: 158128 - DNA, 103 bp, Artificial Sequence
  Synthetic Polynucleotide
taatacgactcactataggggtcctggcccgctccaagctccttctctgcaacagaggagagcagagatggagcttggaaacctggcggcagcgcaaaagatg

SEQ ID NO: 158129 - DNA, 103 bp, Artificial Sequence
  Synthetic Polynucleotide
taatacgactcactatagggggggtggagttttcatcgcccgtgctgagcaacagaggagagctcagatggggcgatgaaacctggcggcagcgcaaaagatg

SEQ ID NO: 158130 - DNA, 103 bp, Artificial Sequence
  Synthetic Polynucleotide
taatacgactcactatagggggtgtccccgggggtggagttttcatcgccaacagaggagaggcgatatgaactccaccaacctggcggcagcgcaaaagatg

SEQ ID NO: 158131 - DNA, 103 bp, Artificial Sequence
  Synthetic Polynucleotide
taatacgactcactatagggtctcaccaaaggtgtccccgggggtggagtaacagaggagaactccaatgccggggacaaacctggcggcagcgcaaaagatg

SEQ ID NO: 158132 - DNA, 103 bp, Artificial Sequence
  Synthetic Polynucleotide
taatacgactcactataggggatgtcaccatctcaccaaaggtgtccccgaacagaggagacggggaatgctttggtgaaacctggcggcagcgcaaaagatg

SEQ ID NO: 158133 - DNA, 103 bp, Artificial Sequence
  Synthetic Polynucleotide
taatacgactcactatagggcgtcagaggtgatgtcaccatctcaccaaaaacagaggagatttggtatgatggtgacaaacctggcggcagcgcaaaagatg

SEQ ID NO: 158134 - DNA, 103 bp, Artificial Sequence
  Synthetic Polynucleotide
taatacgactcactataggggggtcagctgcgtcagaggtgatgtcaccaaacagaggagatggtgaatgcacctctgaaacctggcggcagcgcaaaagatg

SEQ ID NO: 158135 - DNA, 103 bp, Artificial Sequence
  Synthetic Polynucleotide
taatacgactcactataggggaggcctgcagggtcagctgcgtcagaggtaacagaggagaacctctatggcagctgacaacctggcggcagcgcaaaagatg

SEQ ID NO: 158136 - DNA, 103 bp, Artificial Sequence
  Synthetic Polynucleotide
taatacgactcactatagggctgcagtggcgaggcctgcagggtcagctgaacagaggagacagctgatgctgcaggccaacctggcggcagcgcaaaagatg

SEQ ID NO: 158137 - DNA, 103 bp, Artificial Sequence
  Synthetic Polynucleotide
taatacgactcactatagggtcacgaggatctgcagtggcgaggcctgcaaacagaggagatgcaggatgcgccactgcaacctggcggcagcgcaaaagatg

SEQ ID NO: 158138 - DNA, 103 bp, Artificial Sequence
  Synthetic Polynucleotide
taatacgactcactatagggccctcctccttcacgaggatctgcagtggcaacagaggagagccactatggatcctcgtaacctggcggcagcgcaaaagatg

SEQ ID NO: 158139 - DNA, 103 bp, Artificial Sequence
  Synthetic Polynucleotide
taatacgactcactatagggatagtcctctgtcctggcccgctccaagctaacagaggagaagcttgatgcgggccaggaacctggcggcagcgcaaaagatg

SEQ ID NO: 158140 - DNA, 103 bp, Artificial Sequence
  Synthetic Polynucleotide
taatacgactcactatagggggcccgggggccctcctccttcacgaggataacagaggagaatcctcatgaaggaggagaacctggcggcagcgcaaaagatg

SEQ ID NO: 158141 - DNA, 103 bp, Artificial Sequence
  Synthetic Polynucleotide
taatacgactcactatagggaacaggacccggcccgggggccctcctcctaacagaggagaaggaggatggcccccgggaacctggcggcagcgcaaaagatg

SEQ ID NO: 158142 - DNA, 103 bp, Artificial Sequence
  Synthetic Polynucleotide
taatacgactcactataggggggctcaggcaacaggacccggcccgggggaacagaggagacccccgatgcgggtcctgaacctggcggcagcgcaaaagatg

SEQ ID NO: 158143 - DNA, 103 bp, Artificial Sequence
  Synthetic Polynucleotide
taatacgactcactatagggccgccccccagggctcaggcaacaggacccaacagaggagagggtccatgtgcctgagcaacctggcggcagcgcaaaagatg

SEQ ID NO: 158144 - DNA, 103 bp, Artificial Sequence
  Synthetic Polynucleotide
taatacgactcactatagggctagctccgcccgccccccagggctcaggcaacagaggagagcctgaatgctggggggcaacctggcggcagcgcaaaagatg

SEQ ID NO: 158145 - DNA, 103 bp, Artificial Sequence
  Synthetic Polynucleotide
taatacgactcactatagggtcgcgcccctctagctccgcccgccccccaaacagaggagatgggggatgggcggagctaacctggcggcagcgcaaaagatg

SEQ ID NO: 158146 - DNA, 103 bp, Artificial Sequence
  Synthetic Polynucleotide
taatacgactcactatagggctggtccttgtcgcgcccctctagctccgcaacagaggagagcggagatggaggggcgcaacctggcggcagcgcaaaagatg

SEQ ID NO: 158147 - DNA, 103 bp, Artificial Sequence
  Synthetic Polynucleotide
taatacgactcactatagggcctgcagcatctggtccttgtcgcgcccctaacagaggagaaggggcatgacaaggaccaacctggcggcagcgcaaaagatg

SEQ ID NO: 158148 - DNA, 103 bp, Artificial Sequence
  Synthetic Polynucleotide
taatacgactcactatagggttgtctttctcctgcagcatctggtccttgaacagaggagacaaggaatggatgctgcaaacctggcggcagcgcaaaagatg

SEQ ID NO: 158149 - DNA, 103 bp, Artificial Sequence
  Synthetic Polynucleotide
taatacgactcactatagggctcgatctgcttgtctttctcctgcagcataacagaggagaatgctgatggagaaagacaacctggcggcagcgcaaaagatg

SEQ ID NO: 158150 - DNA, 103 bp, Artificial Sequence
  Synthetic Polynucleotide
taatacgactcactatagggtccgtttgagatagtcctctgtcctggcccaacagaggagagggccaatgcagaggactaacctggcggcagcgcaaaagatg

SEQ ID NO: 158151 - DNA, 103 bp, Artificial Sequence
  Synthetic Polynucleotide
taatacgactcactataggggcgtcagcgcctcgatctgcttgtctttctaacagaggagaagaaagatgagcagatcgaacctggcggcagcgcaaaagatg

SEQ ID NO: 158152 - DNA, 103 bp, Artificial Sequence
  Synthetic Polynucleotide
taatacgactcactatagggcggagcatgcgcgtcagcgcctcgatctgcaacagaggagagcagatatgggcgctgacaacctggcggcagcgcaaaagatg

SEQ ID NO: 158153 - DNA, 103 bp, Artificial Sequence
  Synthetic Polynucleotide
taatacgactcactatagggctgcttctgccggagcatgcgcgtcagcgcaacagaggagagcgctgatgcgcatgctcaacctggcggcagcgcaaaagatg

SEQ ID NO: 158154 - DNA, 103 bp, Artificial Sequence
  Synthetic Polynucleotide
taatacgactcactatagggccaccagctgctgcttctgccggagcatgcaacagaggagagcatgcatgggcagaagcaacctggcggcagcgcaaaagatg

SEQ ID NO: 158155 - DNA, 103 bp, Artificial Sequence
  Synthetic Polynucleotide
taatacgactcactatagggttgagccgctccaccagctgctgcttctgcaacagaggagagcagaaatggcagctggtaacctggcggcagcgcaaaagatg

SEQ ID NO: 158156 - DNA, 103 bp, Artificial Sequence
  Synthetic Polynucleotide
taatacgactcactatagggcagctgcagcttgagccgctccaccagctgaacagaggagacagctgatggagcggctcaacctggcggcagcgcaaaagatg

SEQ ID NO: 158157 - DNA, 103 bp, Artificial Sequence
  Synthetic Polynucleotide
taatacgactcactatagggtctcctgctccagctgcagcttgagccgctaacagaggagaagcggcatgagctgcagcaacctggcggcagcgcaaaagatg

SEQ ID NO: 158158 - DNA, 103 bp, Artificial Sequence
  Synthetic Polynucleotide
taatacgactcactatagggtgggctcgcttctcctgctccagctgcagcaacagaggagagctgcaatgggagcaggaaacctggcggcagcgcaaaagatg

SEQ ID NO: 158159 - DNA, 103 bp, Artificial Sequence
  Synthetic Polynucleotide
taatacgactcactatagggggcgggctgctgggctcgcttctcctgctcaacagaggagagagcagatgaagcgagccaacctggcggcagcgcaaaagatg

SEQ ID NO: 158160 - DNA, 103 bp, Artificial Sequence
  Synthetic Polynucleotide
taatacgactcactatagggcgggggcgggggcgggctgctgggctcgctaacagaggagaagcgagatgagcagcccgaacctggcggcagcgcaaaagatg

SEQ ID NO: 158161 - DNA, 103 bp, Artificial Sequence
  Synthetic Polynucleotide
taatacgactcactataggggaacgaatcttccgtttgagatagtcctctaacagaggagaagaggaatgtctcaaacgaacctggcggcagcgcaaaagatg

SEQ ID NO: 158162 - DNA, 103 bp, Artificial Sequence
  Synthetic Polynucleotide
taatacgactcactatagggccgaggggggcgggggcgggggcgggctgcaacagaggagagcagccatgccccgccccaacctggcggcagcgcaaaagatg

SEQ ID NO: 158163 - DNA, 103 bp, Artificial Sequence
  Synthetic Polynucleotide
taatacgactcactatagggcacgggggtgccgaggggggcgggggcgggaacagaggagacccgccatggcccccctcaacctggcggcagcgcaaaagatg

SEQ ID NO: 158164 - DNA, 103 bp, Artificial Sequence
  Synthetic Polynucleotide
taatacgactcactatagggtctcctgcttcacgggggtgccgaggggggaacagaggagaccccccatggcacccccgaacctggcggcagcgcaaaagatg

SEQ ID NO: 158165 - DNA, 103 bp, Artificial Sequence
  Synthetic Polynucleotide
taatacgactcactataggggagaagctgttctcctgcttcacgggggtgaacagaggagacaccccatggaagcaggaaacctggcggcagcgcaaaagatg

SEQ ID NO: 158166 - DNA, 103 bp, Artificial Sequence
  Synthetic Polynucleotide
taatacgactcactatagggctggcagctggagaagctgttctcctgcttaacagaggagaaagcagatgaacagcttcaacctggcggcagcgcaaaagatg

SEQ ID NO: 158167 - DNA, 103 bp, Artificial Sequence
  Synthetic Polynucleotide
taatacgactcactataggggctggctcagctggcagctggagaagctgtaacagaggagaacagctatgccagctgccaacctggcggcagcgcaaaagatg

SEQ ID NO: 158168 - DNA, 103 bp, Artificial Sequence
  Synthetic Polynucleotide
taatacgactcactatagggcccaggggctgctggctcagctggcagctgaacagaggagacagctgatggctgagccaaacctggcggcagcgcaaaagatg

SEQ ID NO: 158169 - DNA, 103 bp, Artificial Sequence
  Synthetic Polynucleotide
taatacgactcactataggggtgagcggggcccaggggctgctggctcagaacagaggagactgagcatgcagcccctgaacctggcggcagcgcaaaagatg

SEQ ID NO: 158170 - DNA, 103 bp, Artificial Sequence
  Synthetic Polynucleotide
taatacgactcactatagggggttgaatgggtgagcggggcccaggggctaacagaggagaagccccatggccccgctcaacctggcggcagcgcaaaagatg

SEQ ID NO: 158171 - DNA, 103 bp, Artificial Sequence
  Synthetic Polynucleotide
taatacgactcactataggggccaggctggggttgaatgggtgagcggggaacagaggagaccccgcatgcccattcaaaacctggcggcagcgcaaaagatg

SEQ ID NO: 158172 - DNA, 103 bp, Artificial Sequence
  Synthetic Polynucleotide
taatacgactcactatagggctccggccgggaacgaatcttccgtttgagaacagaggagactcaaaatgaagattcgtaacctggcggcagcgcaaaagatg

SEQ ID NO: 158173 - DNA, 103 bp, Artificial Sequence
  Synthetic Polynucleotide
taatacgactcactatagggggctggggccgccaggctggggttgaatggaacagaggagaccattcatgcccagcctgaacctggcggcagcgcaaaagatg

SEQ ID NO: 158174 - DNA, 103 bp, Artificial Sequence
  Synthetic Polynucleotide
taatacgactcactatagggtgtggttggtggctggggccgccaggctggaacagaggagaccagccatgcggccccagaacctggcggcagcgcaaaagatg

SEQ ID NO: 158175 - DNA, 103 bp, Artificial Sequence
  Synthetic Polynucleotide
taatacgactcactatagggcaagggtctatgtggttggtggctggggccaacagaggagaggccccatgcaccaaccaaacctggcggcagcgcaaaagatg

SEQ ID NO: 158176 - DNA, 103 bp, Artificial Sequence
  Synthetic Polynucleotide
taatacgactcactatagggggccacagcacaagggtctatgtggttggtaacagaggagaaccaacatgatagaccctaacctggcggcagcgcaaaagatg

SEQ ID NO: 158177 - DNA, 103 bp, Artificial Sequence
  Synthetic Polynucleotide
taatacgactcactatagggggggccccggggccacagcacaagggtctaaacagaggagatagaccatggtgctgtggaacctggcggcagcgcaaaagatg

SEQ ID NO: 158178 - DNA, 103 bp, Artificial Sequence
  Synthetic Polynucleotide
taatacgactcactatagggaccacggacgggggccccggggccacagcaaacagaggagatgctgtatgcccggggccaacctggcggcagcgcaaaagatg

SEQ ID NO: 158179 - DNA, 103 bp, Artificial Sequence
  Synthetic Polynucleotide
taatacgactcactatagggctgcttcaccaccacggacgggggccccggaacagaggagaccggggatgccgtccgtgaacctggcggcagcgcaaaagatg

SEQ ID NO: 158180 - DNA, 103 bp, Artificial Sequence
  Synthetic Polynucleotide
taatacgactcactataggggcaaggcttcctgcttcaccaccacggacgaacagaggagacgtccgatgtggtgaagcaacctggcggcagcgcaaaagatg

SEQ ID NO: 158181 - DNA, 103 bp, Artificial Sequence
  Synthetic Polynucleotide
taatacgactcactatagggggctcaggctgcaaggcttcctgcttcaccaacagaggagaggtgaaatgggaagccttaacctggcggcagcgcaaaagatg

SEQ ID NO: 158182 - DNA, 103 bp, Artificial Sequence
  Synthetic Polynucleotide
taatacgactcactataggggaccggctcgggctcaggctgcaaggcttcaacagaggagagaagccatgcagcctgagaacctggcggcagcgcaaaagatg

SEQ ID NO: 158183 - DNA, 103 bp, Artificial Sequence
  Synthetic Polynucleotide
taatacgactcactataggggtactgccatcattaacatctcaggttccaaacagaggagatggaacatgagatgttaaaacctggcggcagcgcaaaagatg

SEQ ID NO: 158184 - DNA, 103 bp, Artificial Sequence
  Synthetic Polynucleotide
taatacgactcactataggggctccgatctctccggccgggaacgaatctaacagaggagaagattcatgcccggccggaacctggcggcagcgcaaaagatg

SEQ ID NO: 158185 - DNA, 103 bp, Artificial Sequence
  Synthetic Polynucleotide
taatacgactcactatagggggggggcggggaccggctcgggctcaggctaacagaggagaagcctgatgccgagccggaacctggcggcagcgcaaaagatg

SEQ ID NO: 158186 - DNA, 103 bp, Artificial Sequence
  Synthetic Polynucleotide
taatacgactcactatagggagaagcaactggggggcggggaccggctcgaacagaggagacgagccatgccccgccccaacctggcggcagcgcaaaagatg

SEQ ID NO: 158187 - DNA, 103 bp, Artificial Sequence
  Synthetic Polynucleotide
taatacgactcactatagggctgaggccccagaagcaactggggggcgggaacagaggagacccgccatgcagttgcttaacctggcggcagcgcaaaagatg

SEQ ID NO: 158188 - DNA, 103 bp, Artificial Sequence
  Synthetic Polynucleotide
taatacgactcactatagggggctggggccctgaggccccagaagcaactaacagaggagaagttgcatgtggggcctcaacctggcggcagcgcaaaagatg

SEQ ID NO: 158189 - DNA, 103 bp, Artificial Sequence
  Synthetic Polynucleotide
taatacgactcactatagggcccttgatgaggctggggccctgaggccccaacagaggagaggggccatggggccccagaacctggcggcagcgcaaaagatg

SEQ ID NO: 158190 - DNA, 103 bp, Artificial Sequence
  Synthetic Polynucleotide
taatacgactcactatagggaggtgcaacccccttgatgaggctggggccaacagaggagaggccccatgctcatcaagaacctggcggcagcgcaaaagatg

SEQ ID NO: 158191 - DNA, 103 bp, Artificial Sequence
  Synthetic Polynucleotide
taatacgactcactatagggtgagggtgggaggtgcaacccccttgatgaaacagaggagatcatcaatggggttgcacaacctggcggcagcgcaaaagatg

SEQ ID NO: 158192 - DNA, 103 bp, Artificial Sequence
  Synthetic Polynucleotide
taatacgactcactataggggagtcggtgatgagggtgggaggtgcaaccaacagaggagaggttgcatgtcccaccctaacctggcggcagcgcaaaagatg

SEQ ID NO: 158193 - DNA, 103 bp, Artificial Sequence
  Synthetic Polynucleotide
taatacgactcactatagggggtccctgtggagtcggtgatgagggtgggaacagaggagacccaccatgatcaccgacaacctggcggcagcgcaaaagatg

SEQ ID NO: 158194 - DNA, 103 bp, Artificial Sequence
  Synthetic Polynucleotide
taatacgactcactatagggggacaaggtgggtccctgtggagtcggtgaaacagaggagatcaccgatgccacagggaaacctggcggcagcgcaaaagatg

SEQ ID NO: 158195 - DNA, 103 bp, Artificial Sequence
  Synthetic Polynucleotide
taatacgactcactatagggatcctgaccagctccgatctctccggccggaacagaggagaccggccatggagatcggaaacctggcggcagcgcaaaagatg

SEQ ID NO: 158196 - DNA, 103 bp, Artificial Sequence
  Synthetic Polynucleotide
taatacgactcactataggggtcacggtgaggacaaggtgggtccctgtgaacagaggagacacaggatgccaccttgtaacctggcggcagcgcaaaagatg

SEQ ID NO: 158197 - DNA, 103 bp, Artificial Sequence
  Synthetic Polynucleotide
taatacgactcactatagggattcttattggtcacggtgaggacaaggtgaacagaggagacaccttatgctcaccgtgaacctggcggcagcgcaaaagatg

SEQ ID NO: 158198 - DNA, 103 bp, Artificial Sequence
  Synthetic Polynucleotide
taatacgactcactatagggggctgtctgcattcttattggtcacggtgaaacagaggagatcaccgatgccaataagaaacctggcggcagcgcaaaagatg

SEQ ID NO: 158199 - DNA, 103 bp, Artificial Sequence
  Synthetic Polynucleotide
taatacgactcactataggggacaggccagggctgtctgcattcttattgaacagaggagacaataaatgtgcagacagaacctggcggcagcgcaaaagatg

SEQ ID NO: 158200 - DNA, 103 bp, Artificial Sequence
  Synthetic Polynucleotide
taatacgactcactataggggctcccactggacaggccagggctgtctgcaacagaggagagcagacatgcctggcctgaacctggcggcagcgcaaaagatg

SEQ ID NO: 158201 - DNA, 103 bp, Artificial Sequence
  Synthetic Polynucleotide
taatacgactcactataggggctgctgggggctcccactggacaggccagaacagaggagactggccatgccagtgggaaacctggcggcagcgcaaaagatg

SEQ ID NO: 158202 - DNA, 103 bp, Artificial Sequence
  Synthetic Polynucleotide
taatacgactcactatagggtgggacgagggctgctgggggctcccactgaacagaggagacagtggatgcccccagcaaacctggcggcagcgcaaaagatg

SEQ ID NO: 158203 - DNA, 103 bp, Artificial Sequence
  Synthetic Polynucleotide
taatacgactcactatagggagagccaggctgggacgagggctgctggggaacagaggagaccccagatgccctcgtccaacctggcggcagcgcaaaagatg

SEQ ID NO: 158204 - DNA, 103 bp, Artificial Sequence
  Synthetic Polynucleotide
taatacgactcactatagggcaggcgctggagagccaggctgggacgaggaacagaggagacctcgtatgagcctggctaacctggcggcagcgcaaaagatg

SEQ ID NO: 158205 - DNA, 103 bp, Artificial Sequence
  Synthetic Polynucleotide
taatacgactcactataggggcagagggggcaggcgctggagagccaggcaacagaggagagcctggatgtccagcgccaacctggcggcagcgcaaaagatg

SEQ ID NO: 158206 - DNA, 103 bp, Artificial Sequence
  Synthetic Polynucleotide
taatacgactcactatagggcaaaatgtgcatcctgaccagctccgatctaacagaggagaagatcgatgctggtcaggaacctggcggcagcgcaaaagatg

SEQ ID NO: 158207 - DNA, 103 bp, Artificial Sequence
  Synthetic Polynucleotide
taatacgactcactataggggtccatctgggcagagggggcaggcgctggaacagaggagaccagcgatggccccctctaacctggcggcagcgcaaaagatg

SEQ ID NO: 158208 - DNA, 103 bp, Artificial Sequence
  Synthetic Polynucleotide
taatacgactcactatagggggtgctccaggtccatctgggcagagggggaacagaggagaccccctatgcccagatggaacctggcggcagcgcaaaagatg

SEQ ID NO: 158209 - DNA, 103 bp, Artificial Sequence
  Synthetic Polynucleotide
taatacgactcactatagggggctgcagtgggtgctccaggtccatctggaacagaggagaccagatatgcctggagcaaacctggcggcagcgcaaaagatg

SEQ ID NO: 158210 - DNA, 103 bp, Artificial Sequence
  Synthetic Polynucleotide
taatacgactcactatagggcccaaagaggggctgcagtgggtgctccagaacagaggagactggagatgccactgcagaacctggcggcagcgcaaaagatg

SEQ ID NO: 158211 - DNA, 103 bp, Artificial Sequence
  Synthetic Polynucleotide
taatacgactcactatagggaagtgggggtcccaaagaggggctgcagtgaacagaggagacactgcatgccctctttgaacctggcggcagcgcaaaagatg

SEQ ID NO: 158212 - DNA, 103 bp, Artificial Sequence
  Synthetic Polynucleotide
taatacgactcactatagggttcagcagagaagtgggggtcccaaagaggaacagaggagacctcttatggacccccacaacctggcggcagcgcaaaagatg

SEQ ID NO: 158213 - DNA, 103 bp, Artificial Sequence
  Synthetic Polynucleotide
taatacgactcactatagggtggttccttcttcagcagagaagtgggggtaacagaggagaacccccatgtctctgctgaacctggcggcagcgcaaaagatg

SEQ ID NO: 158214 - DNA, 103 bp, Artificial Sequence
  Synthetic Polynucleotide
taatacgactcactatagggcatagccaggtggttccttcttcagcagagaacagaggagactctgcatgagaaggaacaacctggcggcagcgcaaaagatg

SEQ ID NO: 158215 - DNA, 103 bp, Artificial Sequence
  Synthetic Polynucleotide
taatacgactcactatagggatggcttcctcatagccaggtggttccttcaacagaggagagaaggaatgacctggctaaacctggcggcagcgcaaaagatg

SEQ ID NO: 158216 - DNA, 103 bp, Artificial Sequence
  Synthetic Polynucleotide
taatacgactcactatagggctgctggctcatggcttcctcatagccaggaacagaggagacctggcatggaggaagccaacctggcggcagcgcaaaagatg

SEQ ID NO: 158217 - DNA, 103 bp, Artificial Sequence
  Synthetic Polynucleotide
taatacgactcactatagggaggtctcttccaaaatgtgcatcctgaccaaacagaggagatggtcaatgtgcacatttaacctggcggcagcgcaaaagatg

SEQ ID NO: 158218 - DNA, 103 bp, Artificial Sequence
  Synthetic Polynucleotide
taatacgactcactataggggctgtttgggctgctggctcatggcttcctaacagaggagaaggaagatgtgagccagcaacctggcggcagcgcaaaagatg

SEQ ID NO: 158219 - DNA, 103 bp, Artificial Sequence
  Synthetic Polynucleotide
taatacgactcactatagggccattttcctgctgtttgggctgctggctcaacagaggagagagccaatggcccaaacaaacctggcggcagcgcaaaagatg

SEQ ID NO: 158220 - DNA, 103 bp, Artificial Sequence
  Synthetic Polynucleotide
taatacgactcactataggggcttgaggaaccattttcctgctgtttgggaacagaggagacccaaaatgcaggaaaataacctggcggcagcgcaaaagatg

SEQ ID NO: 158221 - DNA, 103 bp, Artificial Sequence
  Synthetic Polynucleotide
taatacgactcactatagggccatctgctggcttgaggaaccattttcctaacagaggagaaggaaaatggttcctcaaaacctggcggcagcgcaaaagatg

SEQ ID NO: 158222 - DNA, 103 bp, Artificial Sequence
  Synthetic Polynucleotide
taatacgactcactatagggaacaggtcgtccatctgctggcttgaggaaaacagaggagattcctcatgccagcagataacctggcggcagcgcaaaagatg

SEQ ID NO: 158223 - DNA, 103 bp, Artificial Sequence
  Synthetic Polynucleotide
taatacgactcactataggggagaatgtcaaacaggtcgtccatctgctgaacagaggagacagcagatggacgacctgaacctggcggcagcgcaaaagatg

SEQ ID NO: 158224 - DNA, 103 bp, Artificial Sequence
  Synthetic Polynucleotide
taatacgactcactatagggcgctctgaatgagaatgtcaaacaggtcgtaacagaggagaacgaccatgttgacattcaacctggcggcagcgcaaaagatg

SEQ ID NO: 158225 - DNA, 103 bp, Artificial Sequence
  Synthetic Polynucleotide
taatacgactcactataggggaaatttctccgctctgaatgagaatgtcaaacagaggagatgacatatgcattcagagaacctggcggcagcgcaaaagatg

SEQ ID NO: 158226 - DNA, 103 bp, Artificial Sequence
  Synthetic Polynucleotide
taatacgactcactataggggaaatctgctgaaatttctccgctctgaataacagaggagaattcagatgggagaaattaacctggcggcagcgcaaaagatg

SEQ ID NO: 158227 - DNA, 103 bp, Artificial Sequence
  Synthetic Polynucleotide
taatacgactcactataggggcggctccttgaaatctgctgaaatttctcaacagaggagagagaaaatgcagcagattaacctggcggcagcgcaaaagatg

SEQ ID NO: 158228 - DNA, 103 bp, Artificial Sequence
  Synthetic Polynucleotide
taatacgactcactatagggggctcagccgaggtctcttccaaaatgtgcaacagaggagagcacatatgggaagagacaacctggcggcagcgcaaaagatg

SEQ ID NO: 158229 - DNA, 103 bp, Artificial Sequence
  Synthetic Polynucleotide
taatacgactcactatagggggcagggatggcggctccttgaaatctgctaacagaggagaagcagaatgcaaggagccaacctggcggcagcgcaaaagatg

SEQ ID NO: 158230 - DNA, 103 bp, Artificial Sequence
  Synthetic Polynucleotide
taatacgactcactatagggctccttccctggcagggatggcggctccttaacagaggagaaaggagatgccatccctgaacctggcggcagcgcaaaagatg

SEQ ID NO: 158231 - DNA, 103 bp, Artificial Sequence
  Synthetic Polynucleotide
taatacgactcactataggggggatggcttctccttccctggcagggatgaacagaggagacatcccatgcagggaaggaacctggcggcagcgcaaaagatg

SEQ ID NO: 158232 - DNA, 103 bp, Artificial Sequence
  Synthetic Polynucleotide
taatacgactcactatagggactgtcttcggggatggcttctccttccctaacagaggagaagggaaatggaagccatcaacctggcggcagcgcaaaagatg

SEQ ID NO: 158233 - DNA, 103 bp, Artificial Sequence
  Synthetic Polynucleotide
taatacgactcactatagggggacccacagactgtcttcggggatggcttaacagaggagaaagccaatgccgaagacaaacctggcggcagcgcaaaagatg

SEQ ID NO: 158234 - DNA, 103 bp, Artificial Sequence
  Synthetic Polynucleotide
taatacgactcactatagggctgccaggggggacccacagactgtcttcgaacagaggagacgaagaatgtctgtgggtaacctggcggcagcgcaaaagatg

SEQ ID NO: 158235 - DNA, 103 bp, Artificial Sequence
  Synthetic Polynucleotide
taatacgactcactataggggatggctgtgctgccaggggggacccacagaacagaggagactgtggatgccccctggcaacctggcggcagcgcaaaagatg

SEQ ID NO: 158236 - DNA, 103 bp, Artificial Sequence
  Synthetic Polynucleotide
taatacgactcactatagggagcagaaggtgatggctgtgctgccaggggaacagaggagacccctgatggcacagccaaacctggcggcagcgcaaaagatg

SEQ ID NO: 158237 - DNA, 103 bp, Artificial Sequence
  Synthetic Polynucleotide
taatacgactcactataggggggggagctcagcagaaggtgatggctgtgaacagaggagacacagcatgcaccttctgaacctggcggcagcgcaaaagatg

SEQ ID NO: 158238 - DNA, 103 bp, Artificial Sequence
  Synthetic Polynucleotide
taatacgactcactatagggggggcagcctgggggagctcagcagaaggtaacagaggagaaccttcatgtgagctcccaacctggcggcagcgcaaaagatg

SEQ ID NO: 158239 - DNA, 103 bp, Artificial Sequence
  Synthetic Polynucleotide
taatacgactcactatagggctggagggatggctcagccgaggtctcttcaacagaggagagaagagatgtcggctgagaacctggcggcagcgcaaaagatg

SEQ ID NO: 158240 - DNA, 103 bp, Artificial Sequence
  Synthetic Polynucleotide
taatacgactcactatagggtggaggaggtggggcagcctgggggagctcaacagaggagagagctcatgcaggctgccaacctggcggcagcgcaaaagatg

SEQ ID NO: 158241 - DNA, 103 bp, Artificial Sequence
  Synthetic Polynucleotide
taatacgactcactatagggagggtgagcctggaggaggtggggcagcctaacagaggagaaggctgatgcacctcctcaacctggcggcagcgcaaaagatg

SEQ ID NO: 158242 - DNA, 103 bp, Artificial Sequence
  Synthetic Polynucleotide
taatacgactcactatagggccagggagggagggtgagcctggaggaggtaacagaggagaacctccatgaggctcaccaacctggcggcagcgcaaaagatg

SEQ ID NO: 158243 - DNA, 103 bp, Artificial Sequence
  Synthetic Polynucleotide
taatacgactcactatagggctccaggcgtccagggagggagggtgagccaacagaggagaggctcaatgtccctccctaacctggcggcagcgcaaaagatg

SEQ ID NO: 158244 - DNA, 103 bp, Artificial Sequence
  Synthetic Polynucleotide
taatacgactcactatagggccaggaagtcctccaggcgtccagggagggaacagaggagaccctccatggacgcctggaacctggcggcagcgcaaaagatg

SEQ ID NO: 158245 - DNA, 103 bp, Artificial Sequence
  Synthetic Polynucleotide
taatacgactcactataggggtgctgctctccaggaagtcctccaggcgtaacagaggagaacgcctatgggacttcctaacctggcggcagcgcaaaagatg

SEQ ID NO: 158246 - DNA, 103 bp, Artificial Sequence
  Synthetic Polynucleotide
taatacgactcactataggggggcagccccgtgctgctctccaggaagtcaacagaggagagacttcatggagagcagcaacctggcggcagcgcaaaagatg

SEQ ID NO: 158247 - DNA, 103 bp, Artificial Sequence
  Synthetic Polynucleotide
taatacgactcactatagggtggtcagcaggggcagccccgtgctgctctaacagaggagaagagcaatgcggggctgcaacctggcggcagcgcaaaagatg

SEQ ID NO: 158248 - DNA, 103 bp, Artificial Sequence
  Synthetic Polynucleotide
taatacgactcactatagggtcatgcccactggtcagcaggggcagccccaacagaggagaggggctatgcctgctgacaacctggcggcagcgcaaaagatg

SEQ ID NO: 158249 - DNA, 103 bp, Artificial Sequence
  Synthetic Polynucleotide
taatacgactcactatagggctctggcccgtcatgcccactggtcagcagaacagaggagactgctgatgagtgggcataacctggcggcagcgcaaaagatg

SEQ ID NO: 158250 - DNA, 103 bp, Artificial Sequence
  Synthetic Polynucleotide
taatacgactcactataggggctgcttggcctggagggatggctcagccgaacagaggagacggctgatgcatccctccaacctggcggcagcgcaaaagatg

SEQ ID NO: 158251 - DNA, 103 bp, Artificial Sequence
  Synthetic Polynucleotide
taatacgactcactataggggggaaaggggctctggcccgtcatgcccacaacagaggagagtgggcatgacgggccagaacctggcggcagcgcaaaagatg

SEQ ID NO: 158252 - DNA, 103 bp, Artificial Sequence
  Synthetic Polynucleotide
taatacgactcactatagggtcgtcaatgagggaaaggggctctggcccgaacagaggagacgggccatggcccctttcaacctggcggcagcgcaaaagatg

SEQ ID NO: 158253 - DNA, 103 bp, Artificial Sequence
  Synthetic Polynucleotide
taatacgactcactataggggctatggaggtcgtcaatgagggaaaggggaacagaggagaccccttatgctcattgacaacctggcggcagcgcaaaagatg

SEQ ID NO: 158254 - DNA, 103 bp, Artificial Sequence
  Synthetic Polynucleotide
taatacgactcactatagggtcagcatctggctatggaggtcgtcaatgaaacagaggagatcattgatgacctccataaacctggcggcagcgcaaaagatg

SEQ ID NO: 158255 - DNA, 103 bp, Artificial Sequence
  Synthetic Polynucleotide
taatacgactcactataggggcagtgctgctcagcatctggctatggaggaacagaggagacctccaatgccagatgctaacctggcggcagcgcaaaagatg

SEQ ID NO: 158256 - DNA, 103 bp, Artificial Sequence
  Synthetic Polynucleotide
taatacgactcactataggggtccaggatggcagtgctgctcagcatctgaacagaggagacagatgatgagcagcactaacctggcggcagcgcaaaagatg

SEQ ID NO: 158257 - DNA, 103 bp, Artificial Sequence
  Synthetic Polynucleotide
taatacgactcactatagggacggggggtggtccaggatggcagtgctgcaacagaggagagcagcaatgccatcctggaacctggcggcagcgcaaaagatg

SEQ ID NO: 158258 - DNA, 103 bp, Artificial Sequence
  Synthetic Polynucleotide
taatacgactcactatagggtccatgggtgacggggggtggtccaggatgaacagaggagacatcctatgccaccccccaacctggcggcagcgcaaaagatg

SEQ ID NO: 158259 - DNA, 103 bp, Artificial Sequence
  Synthetic Polynucleotide
taatacgactcactatagggttccgaggtgtccatgggtgacggggggtgaacagaggagacaccccatgtcacccatgaacctggcggcagcgcaaaagatg

SEQ ID NO: 158260 - DNA, 103 bp, Artificial Sequence
  Synthetic Polynucleotide
taatacgactcactatagggcaaagtgcaattccgaggtgtccatgggtgaacagaggagacacccaatgacacctcggaacctggcggcagcgcaaaagatg

SEQ ID NO: 158261 - DNA, 103 bp, Artificial Sequence
  Synthetic Polynucleotide
taatacgactcactatagggttcagcttcagctgcttggcctggagggataacagaggagaatccctatgggccaagcaaacctggcggcagcgcaaaagatg

SEQ ID NO: 158262 - DNA, 103 bp, Artificial Sequence
  Synthetic Polynucleotide
taatacgactcactatagggggctcaggaacaaagtgcaattccgaggtgaacagaggagacacctcatgattgcacttaacctggcggcagcgcaaaagatg

SEQ ID NO: 158263 - DNA, 103 bp, Artificial Sequence
  Synthetic Polynucleotide
taatacgactcactatagggggtgctgctgggctcaggaacaaagtgcaaaacagaggagattgcacatggttcctgagaacctggcggcagcgcaaaagatg

SEQ ID NO: 158264 - DNA, 103 bp, Artificial Sequence
  Synthetic Polynucleotide
taatacgactcactatagggccaggcccatggtgctgctgggctcaggaaaacagaggagattcctgatgccagcagcaaacctggcggcagcgcaaaagatg

SEQ ID NO: 158265 - DNA, 103 bp, Artificial Sequence
  Synthetic Polynucleotide
taatacgactcactatagggtcagccaggtccaggcccatggtgctgctgaacagaggagacagcagatgcatgggcctaacctggcggcagcgcaaaagatg

SEQ ID NO: 158266 - DNA, 103 bp, Artificial Sequence
  Synthetic Polynucleotide
taatacgactcactatagggcaggtggccatcagccaggtccaggcccataacagaggagaatgggcatggacctggctaacctggcggcagcgcaaaagatg

SEQ ID NO: 158267 - DNA, 103 bp, Artificial Sequence
  Synthetic Polynucleotide
taatacgactcactatagggccatgctgtccaggtggccatcagccaggtaacagaggagaacctggatgatggccaccaacctggcggcagcgcaaaagatg

SEQ ID NO: 158268 - DNA, 103 bp, Artificial Sequence
  Synthetic Polynucleotide
taatacgactcactatagggtccagccagtccatgctgtccaggtggccaaacagaggagatggccaatgggacagcataacctggcggcagcgcaaaagatg

SEQ ID NO: 158269 - DNA, 103 bp, Artificial Sequence
  Synthetic Polynucleotide
taatacgactcactatagggtgacgacagctccagccagtccatgctgtcaacagaggagagacagcatggactggctgaacctggcggcagcgcaaaagatg

SEQ ID NO: 158270 - DNA, 103 bp, Artificial Sequence
  Synthetic Polynucleotide
taatacgactcactatagggcgggaccacctgacgacagctccagccagtaacagaggagaactggcatgagctgtcgtaacctggcggcagcgcaaaagatg

SEQ ID NO: 158271 - DNA, 103 bp, Artificial Sequence
  Synthetic Polynucleotide
taatacgactcactatagggaggctcagcacgggaccacctgacgacagcaacagaggagagctgtcatgaggtggtccaacctggcggcagcgcaaaagatg

SEQ ID NO: 158272 - DNA, 103 bp, Artificial Sequence
  Synthetic Polynucleotide
taatacgactcactatagggtctggctctcttcagcttcagctgcttggcaacagaggagagccaagatgctgaagctgaacctggcggcagcgcaaaagatg

SEQ ID NO: 158273 - DNA, 103 bp, Artificial Sequence
  Synthetic Polynucleotide
taatacgactcactataggggaggggggctaggctcagcacgggaccaccaacagaggagaggtggtatggtgctgagcaacctggcggcagcgcaaaagatg

SEQ ID NO: 158274 - DNA, 103 bp, Artificial Sequence
  Synthetic Polynucleotide
taatacgactcactatagggctgtggtgctgaggggggctaggctcagcaaacagaggagatgctgaatgtagccccccaacctggcggcagcgcaaaagatg

SEQ ID NO: 158275 - DNA, 103 bp, Artificial Sequence
  Synthetic Polynucleotide
taatacgactcactatagggaggctgggggctgtggtgctgaggggggctaacagaggagaagccccatgcagcaccacaacctggcggcagcgcaaaagatg

SEQ ID NO: 158276 - DNA, 103 bp, Artificial Sequence
  Synthetic Polynucleotide
taatacgactcactatagggtgtggagaagaggctgggggctgtggtgctaacagaggagaagcaccatggcccccagcaacctggcggcagcgcaaaagatg

SEQ ID NO: 158277 - DNA, 103 bp, Artificial Sequence
  Synthetic Polynucleotide
taatacgactcactatagggcgaggaagtctgtggagaagaggctgggggaacagaggagacccccaatgtcttctccaaacctggcggcagcgcaaaagatg

SEQ ID NO: 158278 - DNA, 103 bp, Artificial Sequence
  Synthetic Polynucleotide
taatacgactcactatagggtcatggccatcgaggaagtctgtggagaagaacagaggagacttctcatgagacttcctaacctggcggcagcgcaaaagatg

SEQ ID NO: 158279 - DNA, 103 bp, Artificial Sequence
  Synthetic Polynucleotide
taatacgactcactatagggcagctgcaaatcatggccatcgaggaagtcaacagaggagagacttcatggatggccataacctggcggcagcgcaaaagatg

SEQ ID NO: 158280 - DNA, 103 bp, Artificial Sequence
  Synthetic Polynucleotide
taatacgactcactatagggaatcccagtgcagctgcaaatcatggccataacagaggagaatggccatgatttgcagcaacctggcggcagcgcaaaagatg

SEQ ID NO: 158281 - DNA, 103 bp, Artificial Sequence
  Synthetic Polynucleotide
taatacgactcactatagggtacaagcaggaatcccagtgcagctgcaaaaacagaggagatttgcaatggcactgggaaacctggcggcagcgcaaaagatg

SEQ ID NO: 158282 - DNA, 103 bp, Artificial Sequence
  Synthetic Polynucleotide
taatacgactcactatagggcatcggctagtctggctctcttcagcttcaaacagaggagatgaagcatgagagagccaaacctggcggcagcgcaaaagatg

SEQ ID NO: 158283 - DNA, 103 bp, Artificial Sequence
  Synthetic Polynucleotide
taatacgactcactatagggagcactgactgtactgccatcattaacatcaacagaggagagatgttatggatggcagtaacctggcggcagcgcaaaagatg

SEQ ID NO: 158284 - DNA, 103 bp, Artificial Sequence
  Synthetic Polynucleotide
taatacgactcactatagggtcattgaggtcatcggctagtctggctctcaacagaggagagagagcatgactagccgaaacctggcggcagcgcaaaagatg

SEQ ID NO: 158285 - DNA, 103 bp, Artificial Sequence
  Synthetic Polynucleotide
taatacgactcactatagggtgcaatcttctcattgaggtcatcggctagaacagaggagactagccatggacctcaataacctggcggcagcgcaaaagatg

SEQ ID NO: 158286 - DNA, 103 bp, Artificial Sequence
  Synthetic Polynucleotide
taatacgactcactatagggcaggcctctgtgcaatcttctcattgaggtaacagaggagaacctcaatgagaagattgaacctggcggcagcgcaaaagatg

SEQ ID NO: 158287 - DNA, 103 bp, Artificial Sequence
  Synthetic Polynucleotide
taatacgactcactatagggtccatggggccaggcctctgtgcaatcttcaacagaggagagaagatatgacagaggccaacctggcggcagcgcaaaagatg

SEQ ID NO: 158288 - DNA, 103 bp, Artificial Sequence
  Synthetic Polynucleotide
taatacgactcactatagggctccaccagctccatggggccaggcctctgaacagaggagacagaggatgggccccatgaacctggcggcagcgcaaaagatg

SEQ ID NO: 158289 - DNA, 103 bp, Artificial Sequence
  Synthetic Polynucleotide
taatacgactcactatagggggatgttcttctccaccagctccatggggcaacagaggagagccccaatgagctggtggaacctggcggcagcgcaaaagatg

SEQ ID NO: 158290 - DNA, 103 bp, Artificial Sequence
  Synthetic Polynucleotide
taatacgactcactatagggtcaacaggaaggatgttcttctccaccagcaacagaggagagctggtatggaagaacataacctggcggcagcgcaaaagatg

SEQ ID NO: 158291 - DNA, 103 bp, Artificial Sequence
  Synthetic Polynucleotide
taatacgactcactatagggcaggctggactcaacaggaaggatgttcttaacagaggagaaagaacatgcttcctgttaacctggcggcagcgcaaaagatg

SEQ ID NO: 158292 - DNA, 103 bp, Artificial Sequence
  Synthetic Polynucleotide
taatacgactcactatagggtggcttccttcaggctggactcaacaggaaaacagaggagattcctgatgagtccagccaacctggcggcagcgcaaaagatg

SEQ ID NO: 158293 - DNA, 103 bp, Artificial Sequence
  Synthetic Polynucleotide
taatacgactcactatagggcccacaatgatggcttccttcaggctggacaacagaggagagtccagatggaaggaagcaacctggcggcagcgcaaaagatg

SEQ ID NO: 158294 - DNA, 103 bp, Artificial Sequence
  Synthetic Polynucleotide
taatacgactcactatagggtttcaactgtagcactgactgtactgccataacagaggagaatggcaatgcagtcagtgaacctggcggcagcgcaaaagatg

SEQ ID NO: 158295 - DNA, 103 bp, Artificial Sequence
  Synthetic Polynucleotide
taatacgactcactataggggttcacctggcccacaatgatggcttccttaacagaggagaaaggaaatgatcattgtgaacctggcggcagcgcaaaagatg

SEQ ID NO: 158296 - DNA, 103 bp, Artificial Sequence
  Synthetic Polynucleotide
taatacgactcactatagggctttgggatagttcacctggcccacaatgaaacagaggagatcattgatggccaggtgaaacctggcggcagcgcaaaagatg

SEQ ID NO: 158297 - DNA, 103 bp, Artificial Sequence
  Synthetic Polynucleotide
taatacgactcactatagggctgtctgctactttgggatagttcacctggaacagaggagaccaggtatgctatcccaaaacctggcggcagcgcaaaagatg

SEQ ID NO: 158298 - DNA, 103 bp, Artificial Sequence
  Synthetic Polynucleotide
taatacgactcactataggggaaggaagagctgtctgctactttgggataaacagaggagatatcccatggtagcagacaacctggcggcagcgcaaaagatg

SEQ ID NO: 158299 - DNA, 103 bp, Artificial Sequence
  Synthetic Polynucleotide
taatacgactcactatagggtgtcctcatcgaaggaagagctgtctgctaaacagaggagatagcagatggctcttcctaacctggcggcagcgcaaaagatg

SEQ ID NO: 158300 - DNA, 103 bp, Artificial Sequence
  Synthetic Polynucleotide
taatacgactcactataggggcatcgctgctgtcctcatcgaaggaagagaacagaggagactcttcatgcgatgaggaaacctggcggcagcgcaaaagatg

SEQ ID NO: 158301 - DNA, 103 bp, Artificial Sequence
  Synthetic Polynucleotide
taatacgactcactataggggggggataaggcatcgctgctgtcctcatcaacagaggagagatgagatgagcagcgataacctggcggcagcgcaaaagatg

SEQ ID NO: 158302 - DNA, 103 bp, Artificial Sequence
  Synthetic Polynucleotide
taatacgactcactatagggcaggctgctcgggggataaggcatcgctgcaacagaggagagcagcgatgccttatcccaacctggcggcagcgcaaaagatg

SEQ ID NO: 158303 - DNA, 103 bp, Artificial Sequence
  Synthetic Polynucleotide
taatacgactcactatagggtcatggctggcaggctgctcgggggataagaacagaggagacttatcatgcgagcagccaacctggcggcagcgcaaaagatg

SEQ ID NO: 158304 - DNA, 103 bp, Artificial Sequence
  Synthetic Polynucleotide
taatacgactcactatagggaccctgggactcatggctggcaggctgctcaacagaggagagagcagatggccagccataacctggcggcagcgcaaaagatg

SEQ ID NO: 158305 - DNA, 103 bp, Artificial Sequence
  Synthetic Polynucleotide
taatacgactcactataggggctgctggagtttcaactgtagcactgactaacagaggagaagtcagatgtacagttgaaacctggcggcagcgcaaaagatg

SEQ ID NO: 158306 - DNA, 103 bp, Artificial Sequence
  Synthetic Polynucleotide
taatacgactcactatagggacggcacagaaccctgggactcatggctggaacagaggagaccagccatgagtcccaggaacctggcggcagcgcaaaagatg

SEQ ID NO: 158307 - DNA, 103 bp, Artificial Sequence
  Synthetic Polynucleotide
taatacgactcactatagggtccaggggtgacggcacagaaccctgggacaacagaggagagtcccaatgttctgtgccaacctggcggcagcgcaaaagatg

SEQ ID NO: 158308 - DNA, 103 bp, Artificial Sequence
  Synthetic Polynucleotide
taatacgactcactataggggactcgggcctccaggggtgacggcacagaaacagaggagatctgtgatgtcacccctgaacctggcggcagcgcaaaagatg

SEQ ID NO: 158309 - DNA, 103 bp, Artificial Sequence
  Synthetic Polynucleotide
taatacgactcactataggggtggttcgctgactcgggcctccaggggtgaacagaggagacaccccatgaggcccgagaacctggcggcagcgcaaaagatg

SEQ ID NO: 158310 - DNA, 103 bp, Artificial Sequence
  Synthetic Polynucleotide
taatacgactcactataggggcactgagcagtggttcgctgactcgggccaacagaggagaggcccgatgcagcgaaccaacctggcggcagcgcaaaagatg

SEQ ID NO: 158311 - DNA, 103 bp, Artificial Sequence
  Synthetic Polynucleotide
taatacgactcactatagggtgcagaggtggcactgagcagtggttcgctaacagaggagaagcgaaatgctgctcagtaacctggcggcagcgcaaaagatg

SEQ ID NO: 158312 - DNA, 103 bp, Artificial Sequence
  Synthetic Polynucleotide
taatacgactcactataggggggtgggggatgcagaggtggcactgagcaaacagaggagatgctcaatgccacctctgaacctggcggcagcgcaaaagatg

SEQ ID NO: 158313 - DNA, 103 bp, Artificial Sequence
  Synthetic Polynucleotide
taatacgactcactataggggacacaacctgggtgggggatgcagaggtgaacagaggagacacctcatgatcccccacaacctggcggcagcgcaaaagatg

SEQ ID NO: 158314 - DNA, 103 bp, Artificial Sequence
  Synthetic Polynucleotide
taatacgactcactatagggcggaagttgagacacaacctgggtgggggaaacagaggagatcccccatgcaggttgtgaacctggcggcagcgcaaaagatg

SEQ ID NO: 158315 - DNA, 103 bp, Artificial Sequence
  Synthetic Polynucleotide
taatacgactcactatagggcccggcccatcggaagttgagacacaacctaacagaggagaaggttgatgctcaacttcaacctggcggcagcgcaaaagatg

SEQ ID NO: 158316 - DNA, 103 bp, Artificial Sequence
  Synthetic Polynucleotide
taatacgactcactatagggcgggtccggcgctgctggagtttcaactgtaacagaggagaacagttatgactccagcaaacctggcggcagcgcaaaagatg

SEQ ID NO: 158317 - DNA, 103 bp, Artificial Sequence
  Synthetic Polynucleotide
taatacgactcactatagggtctctggaatcccggcccatcggaagttgaaacagaggagatcaactatggatgggccgaacctggcggcagcgcaaaagatg

SEQ ID NO: 158318 - DNA, 103 bp, Artificial Sequence
  Synthetic Polynucleotide
taatacgactcactataggggaaaagcatttctctggaatcccggcccataacagaggagaatgggcatggattccagaaacctggcggcagcgcaaaagatg

SEQ ID NO: 158319 - DNA, 103 bp, Artificial Sequence
  Synthetic Polynucleotide
taatacgactcactataggggctctgccaggaaaagcatttctctggaataacagaggagaattccaatgaaatgctttaacctggcggcagcgcaaaagatg

SEQ ID NO: 158320 - DNA, 103 bp, Artificial Sequence
  Synthetic Polynucleotide
taatacgactcactatagggagaggaggctgctctgccaggaaaagcattaacagaggagaaatgctatgcctggcagaaacctggcggcagcgcaaaagatg

SEQ ID NO: 158321 - DNA, 103 bp, Artificial Sequence
  Synthetic Polynucleotide
taatacgactcactatagggtgggggaggcagaggaggctgctctgccagaacagaggagactggcaatgcagcctcctaacctggcggcagcgcaaaagatg

SEQ ID NO: 158322 - DNA, 103 bp, Artificial Sequence
  Synthetic Polynucleotide
taatacgactcactataggggcagcagaggtgggggaggcagaggaggctaacagaggagaagcctcatgtgcctccccaacctggcggcagcgcaaaagatg

SEQ ID NO: 158323 - DNA, 103 bp, Artificial Sequence
  Synthetic Polynucleotide
taatacgactcactatagggaggctgggaggcagcagaggtgggggaggcaacagaggagagcctccatgacctctgctaacctggcggcagcgcaaaagatg

SEQ ID NO: 158324 - DNA, 103 bp, Artificial Sequence
  Synthetic Polynucleotide
taatacgactcactatagggtccattggtgaggctgggaggcagcagaggaacagaggagacctctgatgcctcccagcaacctggcggcagcgcaaaagatg

SEQ ID NO: 158325 - DNA, 103 bp, Artificial Sequence
  Synthetic Polynucleotide
taatacgactcactatagggggatagtggttccattggtgaggctgggagaacagaggagactcccaatgtcaccaatgaacctggcggcagcgcaaaagatg

SEQ ID NO: 158326 - DNA, 103 bp, Artificial Sequence
  Synthetic Polynucleotide
taatacgactcactatagggttggcagtggggatagtggttccattggtgaacagaggagacaccaaatgaaccactataacctggcggcagcgcaaaagatg

SEQ ID NO: 158327 - DNA, 103 bp, Artificial Sequence
  Synthetic Polynucleotide
taatacgactcactatagggcagttcttcccgggtccggcgctgctggagaacagaggagactccagatgcgccggaccaacctggcggcagcgcaaaagatg

SEQ ID NO: 158328 - DNA, 103 bp, Artificial Sequence
  Synthetic Polynucleotide
taatacgactcactataggggggggtggacttggcagtggggatagtggtaacagaggagaaccactatgcccactgccaacctggcggcagcgcaaaagatg

SEQ ID NO: 158329 - DNA, 103 bp, Artificial Sequence
  Synthetic Polynucleotide
taatacgactcactatagggtaatgagtgtgggggtggacttggcagtggaacagaggagaccactgatgagtccacccaacctggcggcagcgcaaaagatg

SEQ ID NO: 158330 - DNA, 103 bp, Artificial Sequence
  Synthetic Polynucleotide
taatacgactcactatagggtggctttgcttaatgagtgtgggggtggacaacagaggagagtccacatgcacactcataacctggcggcagcgcaaaagatg

SEQ ID NO: 158331 - DNA, 103 bp, Artificial Sequence
  Synthetic Polynucleotide
taatacgactcactatagggagacttgggttggctttgcttaatgagtgtaacagaggagaacactcatgaagcaaagcaacctggcggcagcgcaaaagatg

SEQ ID NO: 158332 - DNA, 103 bp, Artificial Sequence
  Synthetic Polynucleotide
taatacgactcactatagggtctcactggcagacttgggttggctttgctaacagaggagaagcaaaatgaacccaagtaacctggcggcagcgcaaaagatg

SEQ ID NO: 158333 - DNA, 103 bp, Artificial Sequence
  Synthetic Polynucleotide
taatacgactcactatagggcgctgtgacttctcactggcagacttgggtaacagaggagaacccaaatgtgccagtgaaacctggcggcagcgcaaaagatg

SEQ ID NO: 158334 - DNA, 103 bp, Artificial Sequence
  Synthetic Polynucleotide
taatacgactcactatagggcttcttgctgcgctgtgacttctcactggcaacagaggagagccagtatgaagtcacagaacctggcggcagcgcaaaagatg

SEQ ID NO: 158335 - DNA, 103 bp, Artificial Sequence
  Synthetic Polynucleotide
taatacgactcactataggggctccttggccttcttgctgcgctgtgactaacagaggagaagtcacatggcagcaagaaacctggcggcagcgcaaaagatg

SEQ ID NO: 158336 - DNA, 103 bp, Artificial Sequence
  Synthetic Polynucleotide
taatacgactcactatagggtttggcttcagctccttggccttcttgctgaacagaggagacagcaaatgggccaaggaaacctggcggcagcgcaaaagatg

SEQ ID NO: 158337 - DNA, 103 bp, Artificial Sequence
  Synthetic Polynucleotide
taatacgactcactatagggcttcttcacctttggcttcagctccttggcaacagaggagagccaagatgctgaagccaaacctggcggcagcgcaaaagatg

SEQ ID NO: 158338 - DNA, 103 bp, Artificial Sequence
  Synthetic Polynucleotide
taatacgactcactatagggcttggctcaccagttcttcccgggtccggcaacagaggagagccggaatggggaagaacaacctggcggcagcgcaaaagatg

SEQ ID NO: 158339 - DNA, 103 bp, Artificial Sequence
  Synthetic Polynucleotide
taatacgactcactatagggggtacttgagcttcttcacctttggcttcaaacagaggagatgaagcatgaggtgaagaaacctggcggcagcgcaaaagatg

SEQ ID NO: 158340 - DNA, 103 bp, Artificial Sequence
  Synthetic Polynucleotide
taatacgactcactatagggatgtactggtggtacttgagcttcttcaccaacagaggagaggtgaaatggctcaagtaaacctggcggcagcgcaaaagatg

SEQ ID NO: 158341 - DNA, 103 bp, Artificial Sequence
  Synthetic Polynucleotide
taatacgactcactataggggtccggggggatgtactggtggtacttgagaacagaggagactcaagatgcaccagtacaacctggcggcagcgcaaaagatg

SEQ ID NO: 158342 - DNA, 103 bp, Artificial Sequence
  Synthetic Polynucleotide
taatacgactcactatagggcctgcttctggtccggggggatgtactggtaacagaggagaaccagtatgtccccccggaacctggcggcagcgcaaaagatg

SEQ ID NO: 158343 - DNA, 103 bp, Artificial Sequence
  Synthetic Polynucleotide
taatacgactcactataggggcccccctgtcctgcttctggtccggggggaacagaggagaccccccatgccagaagcaaacctggcggcagcgcaaaagatg

SEQ ID NO: 158344 - DNA, 103 bp, Artificial Sequence
  Synthetic Polynucleotide
taatacgactcactatagggcatggggggtgcccccctgtcctgcttctgaacagaggagacagaagatggacagggggaacctggcggcagcgcaaaagatg

SEQ ID NO: 158345 - DNA, 103 bp, Artificial Sequence
  Synthetic Polynucleotide
taatacgactcactatagggaggatgagtccatggggggtgcccccctgtaacagaggagaacagggatgcaccccccaaacctggcggcagcgcaaaagatg

SEQ ID NO: 158346 - DNA, 103 bp, Artificial Sequence
  Synthetic Polynucleotide
taatacgactcactatagggatcttggcgtaggatgagtccatggggggtaacagaggagaacccccatgggactcatcaacctggcggcagcgcaaaagatg

SEQ ID NO: 158347 - DNA, 103 bp, Artificial Sequence
  Synthetic Polynucleotide
taatacgactcactatagggctgctgcaggatcttggcgtaggatgagtcaacagaggagagactcaatgtacgccaagaacctggcggcagcgcaaaagatg

SEQ ID NO: 158348 - DNA, 103 bp, Artificial Sequence
  Synthetic Polynucleotide
taatacgactcactatagggagagctgctgctgctgcaggatcttggcgtaacagaggagaacgccaatgtcctgcagcaacctggcggcagcgcaaaagatg

SEQ ID NO: 158349 - DNA, 103 bp, Artificial Sequence
  Synthetic Polynucleotide
taatacgactcactatagggggcatgatcccttggctcaccagttcttccaacagaggagaggaagaatgggtgagccaaacctggcggcagcgcaaaagatg

SEQ ID NO: 158350 - DNA, 103 bp, Artificial Sequence
  Synthetic Polynucleotide
taatacgactcactatagggagctggaggaagagctgctgctgctgcaggaacagaggagacctgcaatggcagcagctaacctggcggcagcgcaaaagatg

SEQ ID NO: 158351 - DNA, 103 bp, Artificial Sequence
  Synthetic Polynucleotide
taatacgactcactataggggaggatctgcagctggaggaagagctgctgaacagaggagacagcagatgttcctccagaacctggcggcagcgcaaaagatg

SEQ ID NO: 158352 - DNA, 103 bp, Artificial Sequence
  Synthetic Polynucleotide
taatacgactcactataggggctgctggttgaggatctgcagctggaggaaacagaggagatcctccatgtgcagatccaacctggcggcagcgcaaaagatg

SEQ ID NO: 158353 - DNA, 103 bp, Artificial Sequence
  Synthetic Polynucleotide
taatacgactcactatagggtgctgctgctgctgctggttgaggatctgcaacagaggagagcagatatgcaaccagcaaacctggcggcagcgcaaaagatg

SEQ ID NO: 158354 - DNA, 103 bp, Artificial Sequence
  Synthetic Polynucleotide
taatacgactcactataggggtagttgtggtgctgctgctgctgctggttaacagaggagaaaccagatgcagcagcagaacctggcggcagcgcaaaagatg

SEQ ID NO: 158355 - DNA, 103 bp, Artificial Sequence
  Synthetic Polynucleotide
taatacgactcactatagggggatggcctggtagttgtggtgctgctgctaacagaggagaagcagcatgaccacaactaacctggcggcagcgcaaaagatg

SEQ ID NO: 158356 - DNA, 103 bp, Artificial Sequence
  Synthetic Polynucleotide
taatacgactcactatagggggggcaggcaggatggcctggtagttgtggaacagaggagaccacaaatgccaggccataacctggcggcagcgcaaaagatg

SEQ ID NO: 158357 - DNA, 103 bp, Artificial Sequence
  Synthetic Polynucleotide
taatacgactcactatagggtgactttggcggggcaggcaggatggcctgaacagaggagacaggccatgctgcctgccaacctggcggcagcgcaaaagatg

SEQ ID NO: 158358 - DNA, 103 bp, Artificial Sequence
  Synthetic Polynucleotide
taatacgactcactatagggcctcgcctgctgactttggcggggcaggcaaacagaggagatgcctgatgcgccaaagtaacctggcggcagcgcaaaagatg

SEQ ID NO: 158359 - DNA, 103 bp, Artificial Sequence
  Synthetic Polynucleotide
taatacgactcactatagggcttcccagggcctcgcctgctgactttggcaacagaggagagccaaaatgagcaggcgaaacctggcggcagcgcaaaagatg

SEQ ID NO: 158360 - DNA, 103 bp, Artificial Sequence
  Synthetic Polynucleotide
taatacgactcactatagggctccggatcactcaccgagcccgtggacataacagaggagaatgtccatgggctcggtgaacctggcggcagcgcaaaagatg

SEQ ID NO: 158361 - DNA, 103 bp, Artificial Sequence
  Synthetic Polynucleotide
taatacgactcactatagggcgaggcgtagctgcgctctacgccgcggagaacagaggagactccgcatggtagagcgcaacctggcggcagcgcaaaagatg

SEQ ID NO: 158362 - DNA, 103 bp, Artificial Sequence
  Synthetic Polynucleotide
taatacgactcactatagggtgtcactgggcgaggcgtagctgcgctctaaacagaggagatagagcatggctacgcctaacctggcggcagcgcaaaagatg

SEQ ID NO: 158363 - DNA, 103 bp, Artificial Sequence
  Synthetic Polynucleotide
taatacgactcactataggggccgacgagttgtcactgggcgaggcgtagaacagaggagactacgcatggcccagtgaaacctggcggcagcgcaaaagatg

SEQ ID NO: 158364 - DNA, 103 bp, Artificial Sequence
  Synthetic Polynucleotide
taatacgactcactatagggctcctcctctgccgacgagttgtcactgggaacagaggagacccagtatgaactcgtcgaacctggcggcagcgcaaaagatg

SEQ ID NO: 158365 - DNA, 103 bp, Artificial Sequence
  Synthetic Polynucleotide
taatacgactcactatagggcgtcggggtcctcctcctctgccgacgagtaacagaggagaactcgtatgcagaggaggaacctggcggcagcgcaaaagatg

SEQ ID NO: 158366 - DNA, 103 bp, Artificial Sequence
  Synthetic Polynucleotide
taatacgactcactatagggtcctcctcgccgtcggggtcctcctcctctaacagaggagaagaggaatgggaccccgaaacctggcggcagcgcaaaagatg

SEQ ID NO: 158367 - DNA, 103 bp, Artificial Sequence
  Synthetic Polynucleotide
taatacgactcactatagggagcgcagcgctcctcctcgccgtcggggtcaacagaggagagaccccatgggcgaggagaacctggcggcagcgcaaaagatg

SEQ ID NO: 158368 - DNA, 103 bp, Artificial Sequence
  Synthetic Polynucleotide
taatacgactcactatagggctgtgcccagagcgcagcgctcctcctcgcaacagaggagagcgaggatgagcgctgcgaacctggcggcagcgcaaaagatg

SEQ ID NO: 158369 - DNA, 103 bp, Artificial Sequence
  Synthetic Polynucleotide
taatacgactcactataggggcgctgccggctgtgcccagagcgcagcgcaacagaggagagcgctgatgtctgggcacaacctggcggcagcgcaaaagatg

SEQ ID NO: 158370 - DNA, 103 bp, Artificial Sequence
  Synthetic Polynucleotide
taatacgactcactataggggcagccttccgcgctgccggctgtgcccagaacagaggagactgggcatggccggcagcaacctggcggcagcgcaaaagatg

SEQ ID NO: 158371 - DNA, 103 bp, Artificial Sequence
  Synthetic Polynucleotide
taatacgactcactataggggctccatctcctccggatcactcaccgagcaacagaggagagctcggatggtgatccggaacctggcggcagcgcaaaagatg

SEQ ID NO: 158372 - DNA, 103 bp, Artificial Sequence
  Synthetic Polynucleotide
taatacgactcactataggggcttcctcttgcagccttccgcgctgccggaacagaggagaccggcaatgcggaaggctaacctggcggcagcgcaaaagatg

SEQ ID NO: 158373 - DNA, 103 bp, Artificial Sequence
  Synthetic Polynucleotide
taatacgactcactatagggacacggggccgcttcctcttgcagccttccaacagaggagaggaaggatgcaagaggaaaacctggcggcagcgcaaaagatg

SEQ ID NO: 158374 - DNA, 103 bp, Artificial Sequence
  Synthetic Polynucleotide
taatacgactcactataggggcccccagccacacggggccgcttcctcttaacagaggagaaagaggatgcggccccgtaacctggcggcagcgcaaaagatg

SEQ ID NO: 158375 - DNA, 103 bp, Artificial Sequence
  Synthetic Polynucleotide
taatacgactcactatagggctgcgccgccgcccccagccacacggggccaacagaggagaggccccatgtggctggggaacctggcggcagcgcaaaagatg

SEQ ID NO: 158376 - DNA, 103 bp, Artificial Sequence
  Synthetic Polynucleotide
taatacgactcactataggggcgctaccacctgcgccgccgcccccagccaacagaggagaggctggatgcggcggcgcaacctggcggcagcgcaaaagatg

SEQ ID NO: 158377 - DNA, 103 bp, Artificial Sequence
  Synthetic Polynucleotide
taatacgactcactatagggaccaccgcccgcgctaccacctgcgccgccaacagaggagaggcggcatgggtggtagcaacctggcggcagcgcaaaagatg

SEQ ID NO: 158378 - DNA, 103 bp, Artificial Sequence
  Synthetic Polynucleotide
taatacgactcactataggggcttcttgccaccaccgcccgcgctaccacaacagaggagagtggtaatgcgggcggtgaacctggcggcagcgcaaaagatg

SEQ ID NO: 158379 - DNA, 103 bp, Artificial Sequence
  Synthetic Polynucleotide
taatacgactcactataggggccgggaggggcttcttgccaccaccgcccaacagaggagagggcggatgtggcaagaaaacctggcggcagcgcaaaagatg

SEQ ID NO: 158380 - DNA, 103 bp, Artificial Sequence
  Synthetic Polynucleotide
taatacgactcactatagggtgagcccttggccgggaggggcttcttgccaacagaggagaggcaagatgcccctcccgaacctggcggcagcgcaaaagatg

SEQ ID NO: 158381 - DNA, 103 bp, Artificial Sequence
  Synthetic Polynucleotide
taatacgactcactatagggactctgcggctgagcccttggccgggagggaacagaggagaccctccatgccaagggctaacctggcggcagcgcaaaagatg

SEQ ID NO: 158382 - DNA, 103 bp, Artificial Sequence
  Synthetic Polynucleotide
taatacgactcactatagggagcccccgaagctccatctcctccggatcaaacagaggagatgatccatgggagatggaaacctggcggcagcgcaaaagatg

SEQ ID NO: 158383 - DNA, 103 bp, Artificial Sequence
  Synthetic Polynucleotide
taatacgactcactataggggactgcttgcactctgcggctgagcccttgaacagaggagacaagggatgagccgcagaaacctggcggcagcgcaaaagatg

SEQ ID NO: 158384 - DNA, 103 bp, Artificial Sequence
  Synthetic Polynucleotide
taatacgactcactataggggttccgctgcgactgcttgcactctgcggcaacagaggagagccgcaatgtgcaagcagaacctggcggcagcgcaaaagatg

SEQ ID NO: 158385 - DNA, 103 bp, Artificial Sequence
  Synthetic Polynucleotide
taatacgactcactatagggcgttggccgcgttccgctgcgactgcttgcaacagaggagagcaagcatgcgcagcggaaacctggcggcagcgcaaaagatg

SEQ ID NO: 158386 - DNA, 103 bp, Artificial Sequence
  Synthetic Polynucleotide
taatacgactcactatagggcgctcacgggcgttggccgcgttccgctgcaacagaggagagcagcgatgcgcggccaaaacctggcggcagcgcaaaagatg

SEQ ID NO: 158387 - DNA, 103 bp, Artificial Sequence
  Synthetic Polynucleotide
taatacgactcactatagggcatccgggcacgctcacgggcgttggccgcaacagaggagagcggccatggcccgtgagaacctggcggcagcgcaaaagatg

SEQ ID NO: 158388 - DNA, 103 bp, Artificial Sequence
  Synthetic Polynucleotide
taatacgactcactatagggtcagcacgcgcatccgggcacgctcacgggaacagaggagacccgtgatggtgcccggaaacctggcggcagcgcaaaagatg

SEQ ID NO: 158389 - DNA, 103 bp, Artificial Sequence
  Synthetic Polynucleotide
taatacgactcactatagggaaggctttgctcagcacgcgcatccgggcaaacagaggagatgcccgatggcgcgtgctaacctggcggcagcgcaaaagatg

SEQ ID NO: 158390 - DNA, 103 bp, Artificial Sequence
  Synthetic Polynucleotide
taatacgactcactataggggagcctggagaaggctttgctcagcacgcgaacagaggagacgcgtgatgagcaaagccaacctggcggcagcgcaaaagatg

SEQ ID NO: 158391 - DNA, 103 bp, Artificial Sequence
  Synthetic Polynucleotide
taatacgactcactatagggggctggtcttgagcctggagaaggctttgcaacagaggagagcaaagatgtctccaggcaacctggcggcagcgcaaaagatg

SEQ ID NO: 158392 - DNA, 103 bp, Artificial Sequence
  Synthetic Polynucleotide
taatacgactcactatagggacccagggcaggctggtcttgagcctggagaacagaggagactccagatgcaagaccagaacctggcggcagcgcaaaagatg

SEQ ID NO: 158393 - DNA, 103 bp, Artificial Sequence
  Synthetic Polynucleotide
taatacgactcactatagggctcccgctgcagcccccgaagctccatctcaacagaggagagagatgatgcttcgggggaacctggcggcagcgcaaaagatg

SEQ ID NO: 158394 - DNA, 103 bp, Artificial Sequence
  Synthetic Polynucleotide
taatacgactcactataggggtcggggggcacccagggcaggctggtcttaacagaggagaaagaccatgctgccctggaacctggcggcagcgcaaaagatg

SEQ ID NO: 158395 - DNA, 103 bp, Artificial Sequence
  Synthetic Polynucleotide
taatacgactcactatagggagagcttagtgtcggggggcacccagggcaaacagaggagatgccctatgtgccccccgaacctggcggcagcgcaaaagatg

SEQ ID NO: 158396 - DNA, 103 bp, Artificial Sequence
  Synthetic Polynucleotide
taatacgactcactatagggtccagcttggagagcttagtgtcggggggcaacagaggagagcccccatgcactaagctaacctggcggcagcgcaaaagatg

SEQ ID NO: 158397 - DNA, 103 bp, Artificial Sequence
  Synthetic Polynucleotide
taatacgactcactatagggccggagcgtgtccagcttggagagcttagtaacagaggagaactaagatgtccaagctgaacctggcggcagcgcaaaagatg

SEQ ID NO: 158398 - DNA, 103 bp, Artificial Sequence
  Synthetic Polynucleotide
taatacgactcactatagggtggaagccagccggagcgtgtccagcttggaacagaggagaccaagcatgacacgctccaacctggcggcagcgcaaaagatg

SEQ ID NO: 158399 - DNA, 103 bp, Artificial Sequence
  Synthetic Polynucleotide
taatacgactcactataggggcgatgtaactggaagccagccggagcgtgaacagaggagacacgctatggctggcttcaacctggcggcagcgcaaaagatg

SEQ ID NO: 158400 - DNA, 103 bp, Artificial Sequence
  Synthetic Polynucleotide
taatacgactcactatagggccgcaggtgagcgatgtaactggaagccagaacagaggagactggctatgagttacatcaacctggcggcagcgcaaaagatg

SEQ ID NO: 158401 - DNA, 103 bp, Artificial Sequence
  Synthetic Polynucleotide
taatacgactcactataggggcaacagctgccgcaggtgagcgatgtaacaacagaggagagttacaatgctcacctgcaacctggcggcagcgcaaaagatg

SEQ ID NO: 158402 - DNA, 103 bp, Artificial Sequence
  Synthetic Polynucleotide
taatacgactcactatagggcggtcctcctgcaacagctgccgcaggtgaaacagaggagatcacctatggcagctgttaacctggcggcagcgcaaaagatg

SEQ ID NO: 158403 - DNA, 103 bp, Artificial Sequence
  Synthetic Polynucleotide
taatacgactcactataggggttctcatagcggtcctcctgcaacagctgaacagaggagacagctgatgcaggaggacaacctggcggcagcgcaaaagatg

SEQ ID NO: 158404 - DNA, 103 bp, Artificial Sequence
  Synthetic Polynucleotide
taatacgactcactatagggggaccgggtactcccgctgcagcccccgaaaacagaggagattcgggatgtgcagcgggaacctggcggcagcgcaaaagatg

SEQ ID NO: 158405 - DNA, 103 bp, Artificial Sequence
  Synthetic Polynucleotide
taatacgactcactataggggcacgtagccgttctcatagcggtcctcctaacagaggagaaggaggatggctatgagaaacctggcggcagcgcaaaagatg

SEQ ID NO: 158406 - DNA, 103 bp, Artificial Sequence
  Synthetic Polynucleotide
taatacgactcactatagggttcactgggtgcacgtagccgttctcatagaacagaggagactatgaatgcggctacgtaacctggcggcagcgcaaaagatg

SEQ ID NO: 158407 - DNA, 103 bp, Artificial Sequence
  Synthetic Polynucleotide
taatacgactcactatagggccatgtcaggttcactgggtgcacgtagccaacagaggagaggctacatgcacccagtgaacctggcggcagcgcaaaagatg

SEQ ID NO: 158408 - DNA, 103 bp, Artificial Sequence
  Synthetic Polynucleotide
taatacgactcactatagggccacgaatggccatgtcaggttcactgggtaacagaggagaacccagatgacctgacataacctggcggcagcgcaaaagatg

SEQ ID NO: 158409 - DNA, 103 bp, Artificial Sequence
  Synthetic Polynucleotide
taatacgactcactatagggcttcccgagaccacgaatggccatgtcaggaacagaggagacctgacatggccattcgtaacctggcggcagcgcaaaagatg

SEQ ID NO: 158410 - DNA, 103 bp, Artificial Sequence
  Synthetic Polynucleotide
taatacgactcactatagggagagtccggtcttcccgagaccacgaatggaacagaggagaccattcatggtctcgggaaacctggcggcagcgcaaaagatg

SEQ ID NO: 158411 - DNA, 103 bp, Artificial Sequence
  Synthetic Polynucleotide
taatacgactcactatagggctttggtgtcagagtccggtcttcccgagaaacagaggagatctcggatggaccggactaacctggcggcagcgcaaaagatg

SEQ ID NO: 158412 - DNA, 103 bp, Artificial Sequence
  Synthetic Polynucleotide
taatacgactcactataggggcggaaacttctttggtgtcagagtccggtaacagaggagaaccggaatgtgacaccaaaacctggcggcagcgcaaaagatg

SEQ ID NO: 158413 - DNA, 103 bp, Artificial Sequence
  Synthetic Polynucleotide
taatacgactcactatagggtctgttggctgcggaaacttctttggtgtcaacagaggagagacaccatggaagtttccaacctggcggcagcgcaaaagatg

SEQ ID NO: 158414 - DNA, 103 bp, Artificial Sequence
  Synthetic Polynucleotide
taatacgactcactatagggttccacatagtctgttggctgcggaaacttaacagaggagaaagtttatgcagccaacaaacctggcggcagcgcaaaagatg

SEQ ID NO: 158415 - DNA, 103 bp, Artificial Sequence
  Synthetic Polynucleotide
taatacgactcactatagggttggaggcggggaccgggtactcccgctgcaacagaggagagcagcgatggtacccggtaacctggcggcagcgcaaaagatg

SEQ ID NO: 158416 - DNA, 103 bp, Artificial Sequence
  Synthetic Polynucleotide
taatacgactcactatagggtaagcggtggttccacatagtctgttggctaacagaggagaagccaaatgactatgtggaacctggcggcagcgcaaaagatg

SEQ ID NO: 158417 - DNA, 103 bp, Artificial Sequence
  Synthetic Polynucleotide
taatacgactcactataggggggcggcctcttggaggcggggaccgggtaaacagaggagatacccgatgcccgcctccaacctggcggcagcgcaaaagatg

SEQ ID NO: 158418 - DNA, 103 bp, Artificial Sequence
  Synthetic Polynucleotide
taatacgactcactatagggcgccgcggaggggcggcctcttggaggcggaacagaggagaccgcctatgagaggccgcaacctggcggcagcgcaaaagatg

SEQ ID NO: 158419 - DNA, 103 bp, Artificial Sequence
  Synthetic Polynucleotide
taatacgactcactatagggctgcgctctacgccgcggaggggcggcctcaacagaggagagaggccatgcctccgcggaacctggcggcagcgcaaaagatg

SEQ ID NO: 158420 - DNA, 103 bp, Artificial Sequence
  Synthetic Polynucleotide
taatacgactcactataggggctgaggaaagtctcgcgcaggttgtccataacagaggagaatggacatgctgcgcgagaacctggcggcagcgcaaaagatg

SEQ ID NO: 158421 - DNA, 103 bp, Artificial Sequence
  Synthetic Polynucleotide
taatacgactcactatagggctgattcagctcaaagggccctgccctgtcaacagaggagagacaggatggggccctttaacctggcggcagcgcaaaagatg

SEQ ID NO: 158422 - DNA, 103 bp, Artificial Sequence
  Synthetic Polynucleotide
taatacgactcactatagggagggggaggcctgattcagctcaaagggccaacagaggagaggccctatgagctgaatcaacctggcggcagcgcaaaagatg

SEQ ID NO: 158423 - DNA, 103 bp, Artificial Sequence
  Synthetic Polynucleotide
taatacgactcactatagggaggctctgagagggggaggcctgattcagcaacagaggagagctgaaatgggcctccccaacctggcggcagcgcaaaagatg

SEQ ID NO: 158424 - DNA, 103 bp, Artificial Sequence
  Synthetic Polynucleotide
taatacgactcactatagggagccggggaaaggctctgagagggggaggcaacagaggagagcctccatgtctcagagcaacctggcggcagcgcaaaagatg

SEQ ID NO: 158425 - DNA, 103 bp, Artificial Sequence
  Synthetic Polynucleotide
taatacgactcactatagggccagcgatggagccggggaaaggctctgagaacagaggagactcagaatgtttccccggaacctggcggcagcgcaaaagatg

SEQ ID NO: 158426 - DNA, 103 bp, Artificial Sequence
  Synthetic Polynucleotide
taatacgactcactataggggaataggattccagcgatggagccggggaaaacagaggagattccccatgtccatcgctaacctggcggcagcgcaaaagatg

SEQ ID NO: 158427 - DNA, 103 bp, Artificial Sequence
  Synthetic Polynucleotide
taatacgactcactataggggggagaagaagaataggattccagcgatggaacagaggagaccatcgatggaatcctataacctggcggcagcgcaaaagatg

SEQ ID NO: 158428 - DNA, 103 bp, Artificial Sequence
  Synthetic Polynucleotide
taatacgactcactatagggcagctggacagggagaagaagaataggattaacagaggagaaatcctatgcttcttctcaacctggcggcagcgcaaaagatg

SEQ ID NO: 158429 - DNA, 103 bp, Artificial Sequence
  Synthetic Polynucleotide
taatacgactcactatagggagcccagccacagctggacagggagaagaaaacagaggagattcttcatgctgtccagcaacctggcggcagcgcaaaagatg

SEQ ID NO: 158430 - DNA, 103 bp, Artificial Sequence
  Synthetic Polynucleotide
taatacgactcactatagggctcacagggcagcccagccacagctggacaaacagaggagatgtccaatggtggctgggaacctggcggcagcgcaaaagatg

SEQ ID NO: 158431 - DNA, 103 bp, Artificial Sequence
  Synthetic Polynucleotide
taatacgactcactatagggcatcctcgaggctgaggaaagtctcgcgcaaacagaggagatgcgcgatgctttcctcaaacctggcggcagcgcaaaagatg

SEQ ID NO: 158432 - DNA, 103 bp, Artificial Sequence
  Synthetic Polynucleotide
taatacgactcactatagggccccgccgtgctcacagggcagcccagccaaacagaggagatggctgatgtgccctgtgaacctggcggcagcgcaaaagatg

SEQ ID NO: 158433 - DNA, 103 bp, Artificial Sequence
  Synthetic Polynucleotide
taatacgactcactatagggccactgctggccccgccgtgctcacagggcaacagaggagagccctgatggcacggcggaacctggcggcagcgcaaaagatg

SEQ ID NO: 158434 - DNA, 103 bp, Artificial Sequence
  Synthetic Polynucleotide
taatacgactcactatagggttcgctgcccccactgctggccccgccgtgaacagaggagacacggcatggccagcagtaacctggcggcagcgcaaaagatg

SEQ ID NO: 158435 - DNA, 103 bp, Artificial Sequence
  Synthetic Polynucleotide
taatacgactcactatagggcactgcagccttcgctgcccccactgctggaacagaggagaccagcaatgggggcagcgaacctggcggcagcgcaaaagatg

SEQ ID NO: 158436 - DNA, 103 bp, Artificial Sequence
  Synthetic Polynucleotide
taatacgactcactataggggccccaccgacactgcagccttcgctgcccaacagaggagagggcagatgaggctgcagaacctggcggcagcgcaaaagatg

SEQ ID NO: 158437 - DNA, 103 bp, Artificial Sequence
  Synthetic Polynucleotide
taatacgactcactatagggcaggccactggccccaccgacactgcagccaacagaggagaggctgcatggtcggtgggaacctggcggcagcgcaaaagatg

SEQ ID NO: 158438 - DNA, 103 bp, Artificial Sequence
  Synthetic Polynucleotide
taatacgactcactatagggccacctctaccaggccactggccccaccgaaacagaggagatcggtgatgccagtggccaacctggcggcagcgcaaaagatg

SEQ ID NO: 158439 - DNA, 103 bp, Artificial Sequence
  Synthetic Polynucleotide
taatacgactcactatagggatattgtagtccacctctaccaggccactgaacagaggagacagtggatgggtagaggtaacctggcggcagcgcaaaagatg

SEQ ID NO: 158440 - DNA, 103 bp, Artificial Sequence
  Synthetic Polynucleotide
taatacgactcactataggggaaagctaacatattgtagtccacctctacaacagaggagagtagagatggactacaataacctggcggcagcgcaaaagatg

SEQ ID NO: 158441 - DNA, 103 bp, Artificial Sequence
  Synthetic Polynucleotide
taatacgactcactataggggggtgggctggaaagctaacatattgtagtaacagaggagaactacaatgtgttagcttaacctggcggcagcgcaaaagatg

SEQ ID NO: 158442 - DNA, 103 bp, Artificial Sequence
  Synthetic Polynucleotide
taatacgactcactataggggagcccaagccatcctcgaggctgaggaaaaacagaggagatttcctatgcctcgaggaaacctggcggcagcgcaaaagatg

SEQ ID NO: 158443 - DNA, 103 bp, Artificial Sequence
  Synthetic Polynucleotide
taatacgactcactatagggccctgaaggtgggtgggctggaaagctaacaacagaggagagttagcatgccagcccacaacctggcggcagcgcaaaagatg

SEQ ID NO: 158444 - DNA, 103 bp, Artificial Sequence
  Synthetic Polynucleotide
taatacgactcactataggggccaccaccgccctgaaggtgggtgggctgaacagaggagacagcccatgcaccttcagaacctggcggcagcgcaaaagatg

SEQ ID NO: 158445 - DNA, 103 bp, Artificial Sequence
  Synthetic Polynucleotide
taatacgactcactataggggggccttggggccaccaccgccctgaaggtaacagaggagaaccttcatggcggtggtgaacctggcggcagcgcaaaagatg

SEQ ID NO: 158446 - DNA, 103 bp, Artificial Sequence
  Synthetic Polynucleotide
taatacgactcactataggggtgcccttctgggccttggggccaccaccgaacagaggagacggtggatgccccaaggcaacctggcggcagcgcaaaagatg

SEQ ID NO: 158447 - DNA, 103 bp, Artificial Sequence
  Synthetic Polynucleotide
taatacgactcactatagggcctgactttggtgcccttctgggccttgggaacagaggagacccaagatgcagaagggcaacctggcggcagcgcaaaagatg

SEQ ID NO: 158448 - DNA, 103 bp, Artificial Sequence
  Synthetic Polynucleotide
taatacgactcactatagggggacagacatcctgactttggtgcccttctaacagaggagaagaaggatgccaaagtcaaacctggcggcagcgcaaaagatg

SEQ ID NO: 158449 - DNA, 103 bp, Artificial Sequence
  Synthetic Polynucleotide
taatacgactcactatagggcgcctccgctggacagacatcctgactttgaacagaggagacaaagtatggatgtctgtaacctggcggcagcgcaaaagatg

SEQ ID NO: 158450 - DNA, 103 bp, Artificial Sequence
  Synthetic Polynucleotide
taatacgactcactataggggctggctttccgcctccgctggacagacataacagaggagaatgtctatgcagcggaggaacctggcggcagcgcaaaagatg

SEQ ID NO: 158451 - DNA, 103 bp, Artificial Sequence
  Synthetic Polynucleotide
taatacgactcactatagggtctccctctcgctggctttccgcctccgctaacagaggagaagcggaatgggaaagccaaacctggcggcagcgcaaaagatg

SEQ ID NO: 158452 - DNA, 103 bp, Artificial Sequence
  Synthetic Polynucleotide
taatacgactcactatagggatcctgagcttctccctctcgctggctttcaacagaggagagaaagcatgcgagagggaaacctggcggcagcgcaaaagatg

SEQ ID NO: 158453 - DNA, 103 bp, Artificial Sequence
  Synthetic Polynucleotide
taatacgactcactataggggctgtcagaggagcccaagccatcctcgagaacagaggagactcgagatgggcttgggcaacctggcggcagcgcaaaagatg

SEQ ID NO: 158454 - DNA, 103 bp, Artificial Sequence
  Synthetic Polynucleotide
taatacgactcactatagggcaaggtcctcatcctgagcttctccctctcaacagaggagagagaggatgaagctcaggaacctggcggcagcgcaaaagatg

SEQ ID NO: 158455 - DNA, 103 bp, Artificial Sequence
  Synthetic Polynucleotide
taatacgactcactataggggggcatctgccaaggtcctcatcctgagctaacagaggagaagctcaatgtgaggacctaacctggcggcagcgcaaaagatg

SEQ ID NO: 158456 - DNA, 103 bp, Artificial Sequence
  Synthetic Polynucleotide
taatacgactcactatagggagggtgtgcagggcatctgccaaggtcctcaacagaggagagaggacatgggcagatgcaacctggcggcagcgcaaaagatg

SEQ ID NO: 158457 - DNA, 103 bp, Artificial Sequence
  Synthetic Polynucleotide
taatacgactcactataggggtaattccggagggtgtgcagggcatctgcaacagaggagagcagatatgctgcacaccaacctggcggcagcgcaaaagatg

SEQ ID NO: 158458 - DNA, 103 bp, Artificial Sequence
  Synthetic Polynucleotide
taatacgactcactatagggcaggtggcaggtaattccggagggtgtgcaaacagaggagatgcacaatgtccggaattaacctggcggcagcgcaaaagatg

SEQ ID NO: 158459 - DNA, 103 bp, Artificial Sequence
  Synthetic Polynucleotide
taatacgactcactatagggtggctgtagacaggtggcaggtaattccggaacagaggagaccggaaatgcctgccaccaacctggcggcagcgcaaaagatg

SEQ ID NO: 158460 - DNA, 103 bp, Artificial Sequence
  Synthetic Polynucleotide
taatacgactcactatagggctggcctctctggctgtagacaggtggcagaacagaggagactgccaatggtctacagcaacctggcggcagcgcaaaagatg

SEQ ID NO: 158461 - DNA, 103 bp, Artificial Sequence
  Synthetic Polynucleotide
taatacgactcactatagggtggtgagaggctggcctctctggctgtagaaacagaggagatctacaatgagagaggccaacctggcggcagcgcaaaagatg

SEQ ID NO: 158462 - DNA, 103 bp, Artificial Sequence
  Synthetic Polynucleotide
taatacgactcactataggggtctggatcttggtgagaggctggcctctcaacagaggagagagaggatggcctctcacaacctggcggcagcgcaaaagatg

SEQ ID NO: 158463 - DNA, 103 bp, Artificial Sequence
  Synthetic Polynucleotide
taatacgactcactataggggtacttgagtgtctggatcttggtgagaggaacagaggagacctctcatgaagatccagaacctggcggcagcgcaaaagatg

SEQ ID NO: 158464 - DNA, 103 bp, Artificial Sequence
  Synthetic Polynucleotide
taatacgactcactataggggcaggccagggctgtcagaggagcccaagcaacagaggagagcttggatgcctctgacaaacctggcggcagcgcaaaagatg

SEQ ID NO: 158465 - DNA, 103 bp, Artificial Sequence
  Synthetic Polynucleotide
taatacgactcactatagggacttgatggtgtacttgagtgtctggatctaacagaggagaagatccatgcactcaagtaacctggcggcagcgcaaaagatg

SEQ ID NO: 158466 - DNA, 103 bp, Artificial Sequence
  Synthetic Polynucleotide
taatacgactcactatagggtccccgatgtacttgatggtgtacttgagtaacagaggagaactcaaatgcaccatcaaaacctggcggcagcgcaaaagatg

SEQ ID NO: 158467 - DNA, 103 bp, Artificial Sequence
  Synthetic Polynucleotide
taatacgactcactataggggtctgtgagttccccgatgtacttgatggtaacagaggagaaccatcatgtacatcgggaacctggcggcagcgcaaaagatg

SEQ ID NO: 158468 - DNA, 103 bp, Artificial Sequence
  Synthetic Polynucleotide
taatacgactcactatagggggttaaggaggtctgtgagttccccgatgtaacagaggagaacatcgatgaactcacagaacctggcggcagcgcaaaagatg

SEQ ID NO: 158469 - DNA, 103 bp, Artificial Sequence
  Synthetic Polynucleotide
taatacgactcactatagggtctctgccgcggttaaggaggtctgtgagtaacagaggagaactcacatgcctccttaaaacctggcggcagcgcaaaagatg

SEQ ID NO: 158470 - DNA, 103 bp, Artificial Sequence
  Synthetic Polynucleotide
taatacgactcactatagggggctctgggctctctgccgcggttaaggagaacagaggagactccttatgcgcggcagaaacctggcggcagcgcaaaagatg

SEQ ID NO: 158471 - DNA, 103 bp, Artificial Sequence
  Synthetic Polynucleotide
taatacgactcactatagggacgcgctctgggctctgggctctctgccgcaacagaggagagcggcaatgagcccagagaacctggcggcagcgcaaaagatg

SEQ ID NO: 158472 - DNA, 103 bp, Artificial Sequence
  Synthetic Polynucleotide
taatacgactcactatagggcaggaagacagcaggccagggctgtcagagaacagaggagactctgaatgccctggcctaacctggcggcagcgcaaaagatg

SEQ ID NO: 158473 - DNA, 103 bp, Artificial Sequence
  Synthetic Polynucleotide
taatacgactcactatagggcttccagtcccaggaagacagcaggccaggaacagaggagacctggcatgctgtcttccaacctggcggcagcgcaaaagatg

SEQ ID NO: 158474 - DNA, 103 bp, Artificial Sequence
  Synthetic Polynucleotide
taatacgactcactatagggctgccctgtccttccagtcccaggaagacaaacagaggagatgtcttatggggactggaaacctggcggcagcgcaaaagatg

SEQ ID NO: 158475 - DNA, 103 bp, Artificial Sequence
  Synthetic Polynucleotide
taatacgactcactatagggtcaaagggccctgccctgtccttccagtccaacagaggagaggactgatgggacagggcaacctggcggcagcgcaaaagatg

SEQ ID NO: 158476 - DNA, 103 bp, Artificial Sequence
  Synthetic Polynucleotide
taatacgactcactatagggcaaagaagtcatgtcagcagccggggccataacagaggagaatggccatggctgctgacaacctggcggcagcgcaaaagatg

SEQ ID NO: 158477 - DNA, 103 bp, Artificial Sequence
  Synthetic Polynucleotide
taatacgactcactatagggtgccgtggccgcggcggcgctgggggcctgaacagaggagacaggccatgagcgccgccaacctggcggcagcgcaaaagatg

SEQ ID NO: 158478 - DNA, 103 bp, Artificial Sequence
  Synthetic Polynucleotide
taatacgactcactatagggccatggcggctgccgtggccgcggcggcgcaacagaggagagcgccgatgcggccacggaacctggcggcagcgcaaaagatg

SEQ ID NO: 158479 - DNA, 103 bp, Artificial Sequence
  Synthetic Polynucleotide
taatacgactcactatagggtcgtccgcgcccatggcggctgccgtggccaacagaggagaggccacatgagccgccataacctggcggcagcgcaaaagatg

SEQ ID NO: 158480 - DNA, 103 bp, Artificial Sequence
  Synthetic Polynucleotide
taatacgactcactatagggggccccctcctcgtccgcgcccatggcggcaacagaggagagccgccatgggcgcggacaacctggcggcagcgcaaaagatg

SEQ ID NO: 158481 - DNA, 103 bp, Artificial Sequence
  Synthetic Polynucleotide
taatacgactcactatagggctttgggcttggccccctcctcgtccgcgcaacagaggagagcgcggatgaggagggggaacctggcggcagcgcaaaagatg

SEQ ID NO: 158482 - DNA, 103 bp, Artificial Sequence
  Synthetic Polynucleotide
taatacgactcactataggggaaggggacactttgggcttggccccctccaacagaggagaggagggatgcaagcccaaaacctggcggcagcgcaaaagatg

SEQ ID NO: 158483 - DNA, 103 bp, Artificial Sequence
  Synthetic Polynucleotide
taatacgactcactataggggggcaggagcgaaggggacactttgggcttaacagaggagaaagcccatggtgtcccctaacctggcggcagcgcaaaagatg

SEQ ID NO: 158484 - DNA, 103 bp, Artificial Sequence
  Synthetic Polynucleotide
taatacgactcactatagggccacgctgaagggcaggagcgaaggggacaaacagaggagatgtcccatgcgctcctgcaacctggcggcagcgcaaaagatg

SEQ ID NO: 158485 - DNA, 103 bp, Artificial Sequence
  Synthetic Polynucleotide
taatacgactcactatagggatgagcgcctccacgctgaagggcaggagcaacagaggagagctcctatgcttcagcgtaacctggcggcagcgcaaaagatg

SEQ ID NO: 158486 - DNA, 103 bp, Artificial Sequence
  Synthetic Polynucleotide
taatacgactcactataggggtggtcggccatgagcgcctccacgctgaaaacagaggagattcagcatggaggcgctcaacctggcggcagcgcaaaagatg

SEQ ID NO: 158487 - DNA, 103 bp, Artificial Sequence
  Synthetic Polynucleotide
taatacgactcactatagggcaccgagtggcaaagaagtcatgtcagcagaacagaggagactgctgatgtgacttcttaacctggcggcagcgcaaaagatg

SEQ ID NO: 158488 - DNA, 103 bp, Artificial Sequence
  Synthetic Polynucleotide
taatacgactcactatagggccggcttcctgtggtcggccatgagcgcctaacagaggagaaggcgcatgtggccgaccaacctggcggcagcgcaaaagatg

SEQ ID NO: 158489 - DNA, 103 bp, Artificial Sequence
  Synthetic Polynucleotide
taatacgactcactatagggtccttggcccccggcttcctgtggtcggccaacagaggagaggccgaatgcaggaagccaacctggcggcagcgcaaaagatg

SEQ ID NO: 158490 - DNA, 103 bp, Artificial Sequence
  Synthetic Polynucleotide
taatacgactcactatagggcagggcgctctccttggcccccggcttcctaacagaggagaaggaagatgggggccaagaacctggcggcagcgcaaaagatg

SEQ ID NO: 158491 - DNA, 103 bp, Artificial Sequence
  Synthetic Polynucleotide
taatacgactcactatagggcggagggcgccagggcgctctccttggcccaacagaggagagggccaatgagagcgcccaacctggcggcagcgcaaaagatg

SEQ ID NO: 158492 - DNA, 103 bp, Artificial Sequence
  Synthetic Polynucleotide
taatacgactcactatagggtgcacgccctcggagggcgccagggcgctcaacagaggagagagcgcatgggcgccctcaacctggcggcagcgcaaaagatg

SEQ ID NO: 158493 - DNA, 103 bp, Artificial Sequence
  Synthetic Polynucleotide
taatacgactcactatagggacccgccgcctgcacgccctcggagggcgcaacagaggagagcgcccatggagggcgtgaacctggcggcagcgcaaaagatg

SEQ ID NO: 158494 - DNA, 103 bp, Artificial Sequence
  Synthetic Polynucleotide
taatacgactcactataggggcgccgagccacccgccgcctgcacgccctaacagaggagaagggcgatgaggcggcggaacctggcggcagcgcaaaagatg

SEQ ID NO: 158495 - DNA, 103 bp, Artificial Sequence
  Synthetic Polynucleotide
taatacgactcactatagggcccagtggctgcgccgagccacccgccgccaacagaggagaggcggcatgtggctcggcaacctggcggcagcgcaaaagatg

SEQ ID NO: 158496 - DNA, 103 bp, Artificial Sequence
  Synthetic Polynucleotide
taatacgactcactatagggcggcgggacgcccagtggctgcgccgagccaacagaggagaggctcgatgcagccactgaacctggcggcagcgcaaaagatg

SEQ ID NO: 158497 - DNA, 103 bp, Artificial Sequence
  Synthetic Polynucleotide
taatacgactcactatagggccagcgaccccggcgggacgcccagtggctaacagaggagaagccacatggcgtcccgcaacctggcggcagcgcaaaagatg

SEQ ID NO: 158498 - DNA, 103 bp, Artificial Sequence
  Synthetic Polynucleotide
taatacgactcactatagggtccactttgacaccgagtggcaaagaagtcaacagaggagagacttcatggccactcggaacctggcggcagcgcaaaagatg

SEQ ID NO: 158499 - DNA, 103 bp, Artificial Sequence
  Synthetic Polynucleotide
taatacgactcactatagggtccggggctcccagcgaccccggcgggacgaacagaggagacgtcccatgggggtcgctaacctggcggcagcgcaaaagatg

SEQ ID NO: 158500 - DNA, 103 bp, Artificial Sequence
  Synthetic Polynucleotide
taatacgactcactatagggagagggcgcgtccggggctcccagcgacccaacagaggagagggtcgatgggagccccgaacctggcggcagcgcaaaagatg

SEQ ID NO: 158501 - DNA, 103 bp, Artificial Sequence
  Synthetic Polynucleotide
taatacgactcactataggggccgcggcgaagagggcgcgtccggggctcaacagaggagagagcccatgacgcgccctaacctggcggcagcgcaaaagatg

SEQ ID NO: 158502 - DNA, 103 bp, Artificial Sequence
  Synthetic Polynucleotide
taatacgactcactatagggtggccgagcggccgcggcgaagagggcgcgaacagaggagacgcgccatgttcgccgcgaacctggcggcagcgcaaaagatg

SEQ ID NO: 158503 - DNA, 103 bp, Artificial Sequence
  Synthetic Polynucleotide
taatacgactcactatagggcaccgagaaatggccgagcggccgcggcgaaacagaggagatcgccgatgccgctcggcaacctggcggcagcgcaaaagatg

SEQ ID NO: 158504 - DNA, 103 bp, Artificial Sequence
  Synthetic Polynucleotide
taatacgactcactatagggggagtccccccaccgagaaatggccgagcgaacagaggagacgctcgatgatttctcggaacctggcggcagcgcaaaagatg

SEQ ID NO: 158505 - DNA, 103 bp, Artificial Sequence
  Synthetic Polynucleotide
taatacgactcactatagggggcagcttgaggagtccccccaccgagaaaaacagaggagatttctcatgggggggactaacctggcggcagcgcaaaagatg

SEQ ID NO: 158506 - DNA, 103 bp, Artificial Sequence
  Synthetic Polynucleotide
taatacgactcactatagggcgcatcttctggcagcttgaggagtcccccaacagaggagagggggaatgctcaagctgaacctggcggcagcgcaaaagatg

SEQ ID NO: 158507 - DNA, 103 bp, Artificial Sequence
  Synthetic Polynucleotide
taatacgactcactatagggctttgacgagcgcatcttctggcagcttgaaacagaggagatcaagcatgcagaagatgaacctggcggcagcgcaaaagatg

SEQ ID NO: 158508 - DNA, 103 bp, Artificial Sequence
  Synthetic Polynucleotide
taatacgactcactataggggggctctcggctttgacgagcgcatcttctaacagaggagaagaagaatggctcgtcaaaacctggcggcagcgcaaaagatg

SEQ ID NO: 158509 - DNA, 103 bp, Artificial Sequence
  Synthetic Polynucleotide
taatacgactcactatagggggcggagtcctccactttgacaccgagtggaacagaggagaccactcatggtcaaagtgaacctggcggcagcgcaaaagatg

SEQ ID NO: 158510 - DNA, 103 bp, Artificial Sequence
  Synthetic Polynucleotide
taatacgactcactataggggggcttctcggggctctcggctttgacgagaacagaggagactcgtcatggccgagagcaacctggcggcagcgcaaaagatg

SEQ ID NO: 158511 - DNA, 103 bp, Artificial Sequence
  Synthetic Polynucleotide
taatacgactcactataggggggtcctctcgggcttctcggggctctcggaacagaggagaccgagaatgccgagaagcaacctggcggcagcgcaaaagatg

SEQ ID NO: 158512 - DNA, 103 bp, Artificial Sequence
  Synthetic Polynucleotide
taatacgactcactatagggtgcatccacggggtcctctcgggcttctcgaacagaggagacgagaaatgcgagaggacaacctggcggcagcgcaaaagatg

SEQ ID NO: 158513 - DNA, 103 bp, Artificial Sequence
  Synthetic Polynucleotide
taatacgactcactataggggcgggggctctgcatccacggggtcctctcaacagaggagagagaggatgccgtggatgaacctggcggcagcgcaaaagatg

SEQ ID NO: 158514 - DNA, 103 bp, Artificial Sequence
  Synthetic Polynucleotide
taatacgactcactataggggcggggagaagcgggggctctgcatccacgaacagaggagacgtggaatgagagcccccaacctggcggcagcgcaaaagatg

SEQ ID NO: 158515 - DNA, 103 bp, Artificial Sequence
  Synthetic Polynucleotide
taatacgactcactatagggctggccggcggcggggagaagcgggggctcaacagaggagagagcccatgcttctccccaacctggcggcagcgcaaaagatg

SEQ ID NO: 158516 - DNA, 103 bp, Artificial Sequence
  Synthetic Polynucleotide
taatacgactcactataggggctcagccgcctggccggcggcggggagaaaacagaggagattctccatgccgccggccaacctggcggcagcgcaaaagatg

SEQ ID NO: 158517 - DNA, 103 bp, Artificial Sequence
  Synthetic Polynucleotide
taatacgactcactatagggaggctggggggctcagccgcctggccggcgaacagaggagacgccggatgggcggctgaaacctggcggcagcgcaaaagatg

SEQ ID NO: 158518 - DNA, 103 bp, Artificial Sequence
  Synthetic Polynucleotide
taatacgactcactatagggcggagggtgcaggctggggggctcagccgcaacagaggagagcggctatgccccccagcaacctggcggcagcgcaaaagatg

SEQ ID NO: 158519 - DNA, 103 bp, Artificial Sequence
  Synthetic Polynucleotide
taatacgactcactatagggcttgtgtttgcggagggtgcaggctgggggaacagaggagacccccaatgtgcaccctcaacctggcggcagcgcaaaagatg

SEQ ID NO: 158520 - DNA, 103 bp, Artificial Sequence
  Synthetic Polynucleotide
taatacgactcactataggggcttgccgaaggcggagtcctccactttgaaacagaggagatcaaagatgaggactccgaacctggcggcagcgcaaaagatg

SEQ ID NO: 158521 - DNA, 103 bp, Artificial Sequence
  Synthetic Polynucleotide
taatacgactcactatagggtacggttcgtcttgtgtttgcggagggtgcaacagaggagagcacccatggcaaacacaaacctggcggcagcgcaaaagatg

SEQ ID NO: 158522 - DNA, 103 bp, Artificial Sequence
  Synthetic Polynucleotide
taatacgactcactataggggtccgcggcttacggttcgtcttgtgtttgaacagaggagacaaacaatggacgaaccgaacctggcggcagcgcaaaagatg

SEQ ID NO: 158523 - DNA, 103 bp, Artificial Sequence
  Synthetic Polynucleotide
taatacgactcactatagggggtgaagggcgtccgcggcttacggttcgtaacagaggagaacgaacatgaagccgcggaacctggcggcagcgcaaaagatg

SEQ ID NO: 158524 - DNA, 103 bp, Artificial Sequence
  Synthetic Polynucleotide
taatacgactcactataggggctgcgcggtggtgaagggcgtccgcggctaacagaggagaagccgcatgcgcccttcaaacctggcggcagcgcaaaagatg

SEQ ID NO: 158525 - DNA, 103 bp, Artificial Sequence
  Synthetic Polynucleotide
taatacgactcactatagggagcgccagcagctgcgcggtggtgaagggcaacagaggagagcccttatgcaccgcgcaaacctggcggcagcgcaaaagatg

SEQ ID NO: 158526 - DNA, 103 bp, Artificial Sequence
  Synthetic Polynucleotide
taatacgactcactatagggcttgcgctccagcgccagcagctgcgcggtaacagaggagaaccgcgatgctgctggcgaacctggcggcagcgcaaaagatg

SEQ ID NO: 158527 - DNA, 103 bp, Artificial Sequence
  Synthetic Polynucleotide
taatacgactcactatagggtctggcggaacttgcgctccagcgccagcaaacagaggagatgctggatgtggagcgcaaacctggcggcagcgcaaaagatg

SEQ ID NO: 158528 - DNA, 103 bp, Artificial Sequence
  Synthetic Polynucleotide
taatacgactcactatagggaggtactgcttctggcggaacttgcgctccaacagaggagaggagcgatggttccgccaaacctggcggcagcgcaaaagatg

SEQ ID NO: 158529 - DNA, 103 bp, Artificial Sequence
  Synthetic Polynucleotide
taatacgactcactatagggggcgatggacaggtactgcttctggcggaaaacagaggagattccgcatgaagcagtacaacctggcggcagcgcaaaagatg

SEQ ID NO: 158530 - DNA, 103 bp, Artificial Sequence
  Synthetic Polynucleotide
taatacgactcactatagggccgcgcgctcggcgatggacaggtactgctaacagaggagaagcagtatgtgtccatcgaacctggcggcagcgcaaaagatg

SEQ ID NO: 158531 - DNA, 103 bp, Artificial Sequence
  Synthetic Polynucleotide
taatacgactcactatagggccccccgccggcttgccgaaggcggagtccaacagaggagaggactcatgcttcggcaaaacctggcggcagcgcaaaagatg

SEQ ID NO: 158532 - DNA, 103 bp, Artificial Sequence
  Synthetic Polynucleotide
taatacgactcactatagggctggagaactccgcgcgctcggcgatggacaacagaggagagtccatatgcgagcgcgcaacctggcggcagcgcaaaagatg

SEQ ID NO: 158533 - DNA, 103 bp, Artificial Sequence
  Synthetic Polynucleotide
taatacgactcactataggggctgagcgagctggagaactccgcgcgctcaacagaggagagagcgcatggagttctccaacctggcggcagcgcaaaagatg

SEQ ID NO: 158534 - DNA, 103 bp, Artificial Sequence
  Synthetic Polynucleotide
taatacgactcactatagggtctcagtgaggctgagcgagctggagaactaacagaggagaagttctatggctcgctcaaacctggcggcagcgcaaaagatg

SEQ ID NO: 158535 - DNA, 103 bp, Artificial Sequence
  Synthetic Polynucleotide
taatacgactcactatagggttcacctgcgtctcagtgaggctgagcgagaacagaggagactcgctatgcctcactgaaacctggcggcagcgcaaaagatg

SEQ ID NO: 158536 - DNA, 103 bp, Artificial Sequence
  Synthetic Polynucleotide
taatacgactcactataggggaaccatatcttcacctgcgtctcagtgagaacagaggagactcactatgacgcaggtgaacctggcggcagcgcaaaagatg

SEQ ID NO: 158537 - DNA, 103 bp, Artificial Sequence
  Synthetic Polynucleotide
taatacgactcactatagggggcggttctggaaccatatcttcacctgcgaacagaggagacgcaggatgagatatggtaacctggcggcagcgcaaaagatg

SEQ ID NO: 158538 - DNA, 103 bp, Artificial Sequence
  Synthetic Polynucleotide
taatacgactcactataggggccttggcgcggcggttctggaaccatatcaacagaggagagatatgatgccagaaccgaacctggcggcagcgcaaaagatg

SEQ ID NO: 158539 - DNA, 103 bp, Artificial Sequence
  Synthetic Polynucleotide
taatacgactcactatagggtagtctctttgccttggcgcggcggttctgaacagaggagacagaacatgcgcgccaagaacctggcggcagcgcaaaagatg

SEQ ID NO: 158540 - DNA, 103 bp, Artificial Sequence
  Synthetic Polynucleotide
taatacgactcactatagggctgcctcttgtagtctctttgccttggcgcaacagaggagagcgccaatgcaaagagacaacctggcggcagcgcaaaagatg

SEQ ID NO: 158541 - DNA, 103 bp, Artificial Sequence
  Synthetic Polynucleotide
taatacgactcactatagggttctccagctctgcctcttgtagtctctttaacagaggagaaaagagatgacaagaggcaacctggcggcagcgcaaaagatg

SEQ ID NO: 158542 - DNA, 103 bp, Artificial Sequence
  Synthetic Polynucleotide
taatacgactcactataggggcccgcgcctccccccgccggcttgccgaaaacagaggagattcggcatgccggcggggaacctggcggcagcgcaaaagatg

SEQ ID NO: 158543 - DNA, 103 bp, Artificial Sequence
  Synthetic Polynucleotide
taatacgactcactatagggcatcttcagcttctccagctctgcctcttgaacagaggagacaagagatggagctggagaacctggcggcagcgcaaaagatg

SEQ ID NO: 158544 - DNA, 103 bp, Artificial Sequence
  Synthetic Polynucleotide
taatacgactcactataggggcttggcggccatcttcagcttctccagctaacagaggagaagctggatgagctgaagaaacctggcggcagcgcaaaagatg

SEQ ID NO: 158545 - DNA, 103 bp, Artificial Sequence
  Synthetic Polynucleotide
taatacgactcactatagggggcagcatgggcttggcggccatcttcagcaacagaggagagctgaaatgggccgccaaaacctggcggcagcgcaaaagatg

SEQ ID NO: 158546 - DNA, 103 bp, Artificial Sequence
  Synthetic Polynucleotide
taatacgactcactatagggggcagccggtggcagcatgggcttggcggcaacagaggagagccgccatgcccatgctgaacctggcggcagcgcaaaagatg

SEQ ID NO: 158547 - DNA, 103 bp, Artificial Sequence
  Synthetic Polynucleotide
taatacgactcactatagggagaggccgaaggcagccggtggcagcatggaacagaggagaccatgcatgcaccggctgaacctggcggcagcgcaaaagatg

SEQ ID NO: 158548 - DNA, 103 bp, Artificial Sequence
  Synthetic Polynucleotide
taatacgactcactatagggagagggaaggagaggccgaaggcagccggtaacagaggagaaccggcatgcttcggcctaacctggcggcagcgcaaaagatg

SEQ ID NO: 158549 - DNA, 103 bp, Artificial Sequence
  Synthetic Polynucleotide
taatacgactcactatagggggggccgccgagagggaaggagaggccgaaaacagaggagattcggcatgtccttccctaacctggcggcagcgcaaaagatg

SEQ ID NO: 158550 - DNA, 103 bp, Artificial Sequence
  Synthetic Polynucleotide
taatacgactcactatagggctacagctgcggggccgccgagagggaaggaacagaggagaccttccatgtcggcggccaacctggcggcagcgcaaaagatg

SEQ ID NO: 158551 - DNA, 103 bp, Artificial Sequence
  Synthetic Polynucleotide
taatacgactcactataggggccgcggccgctacagctgcggggccgccgaacagaggagacggcggatgcgcagctgtaacctggcggcagcgcaaaagatg

SEQ ID NO: 158552 - DNA, 103 bp, Artificial Sequence
  Synthetic Polynucleotide
taatacgactcactatagggcgaggcacccgccgcggccgctacagctgcaacagaggagagcagctatggcggccgcgaacctggcggcagcgcaaaagatg

SEQ ID NO: 158553 - DNA, 103 bp, Artificial Sequence
  Synthetic Polynucleotide
taatacgactcactatagggtgggggcctggcccgcgcctccccccgccgaacagaggagacggcggatggaggcgcggaacctggcggcagcgcaaaagatg

SEQ ID NO: 158554 - DNA, 103 bp, Artificial Sequence
  Synthetic Polynucleotide
taatacgactcactatagggcaccgtagagcgaggcacccgccgcggccgaacagaggagacggccgatgcgggtgcctaacctggcggcagcgcaaaagatg

SEQ ID NO: 158555 - DNA, 103 bp, Artificial Sequence
  Synthetic Polynucleotide
taatacgactcactataggggggccagaggcaccgtagagcgaggcacccaacagaggagagggtgcatggctctacggaacctggcggcagcgcaaaagatg

SEQ ID NO: 158556 - DNA, 103 bp, Artificial Sequence
  Synthetic Polynucleotide
taatacgactcactataggggcgctggaaggggccagaggcaccgtagagaacagaggagactctacatggcctctggcaacctggcggcagcgcaaaagatg

SEQ ID NO: 158557 - DNA, 103 bp, Artificial Sequence
  Synthetic Polynucleotide
taatacgactcactataggggcagcgcggcgcgctggaaggggccagaggaacagaggagacctctgatgccttccagcaacctggcggcagcgcaaaagatg

SEQ ID NO: 158558 - DNA, 103 bp, Artificial Sequence
  Synthetic Polynucleotide
taatacgactcactatagggggcgccacaggcagcgcggcgcgctggaagaacagaggagacttccaatgcgccgcgctaacctggcggcagcgcaaaagatg

SEQ ID NO: 158559 - DNA, 103 bp, Artificial Sequence
  Synthetic Polynucleotide
taatacgactcactataggggagtcccacgggcgccacaggcagcgcggcaacagaggagagccgcgatgcctgtggcgaacctggcggcagcgcaaaagatg

SEQ ID NO: 158560 - DNA, 103 bp, Artificial Sequence
  Synthetic Polynucleotide
taatacgactcactataggggggccgtgtagagtcccacgggcgccacagaacagaggagactgtggatgccgtgggacaacctggcggcagcgcaaaagatg

SEQ ID NO: 158561 - DNA, 103 bp, Artificial Sequence
  Synthetic Polynucleotide
taatacgactcactatagggtagcccacatgggccgtgtagagtcccacgaacagaggagacgtgggatgctacacggcaacctggcggcagcgcaaaagatg

SEQ ID NO: 158562 - DNA, 103 bp, Artificial Sequence
  Synthetic Polynucleotide
taatacgactcactataggggtacatgctgtagcccacatgggccgtgtaaacagaggagatacacgatgcatgtgggcaacctggcggcagcgcaaaagatg

SEQ ID NO: 158563 - DNA, 103 bp, Artificial Sequence
  Synthetic Polynucleotide
taatacgactcactatagggatgtcaggtggtacatgctgtagcccacataacagaggagaatgtggatgacagcatgtaacctggcggcagcgcaaaagatg

SEQ ID NO: 158564 - DNA, 103 bp, Artificial Sequence
  Synthetic Polynucleotide
taatacgactcactataggggcggcggcgctgggggcctggcccgcgcctaacagaggagaaggcgcatgccaggccccaacctggcggcagcgcaaaagatg

SEQ ID NO: 158565 - DNA, 103 bp, Artificial Sequence
  Synthetic Polynucleotide
taatacgactcactatagggcaagtcattgcctttggacggagaagccataacagaggagaatggctatgccgtccaaaaacctggcggcagcgcaaaagatg

SEQ ID NO: 158566 - DNA, 103 bp, Artificial Sequence
  Synthetic Polynucleotide
taatacgactcactataggggacgcggcgctcctccgcggccccctcggcaacagaggagagccgagatggccgcggagaacctggcggcagcgcaaaagatg

SEQ ID NO: 158567 - DNA, 103 bp, Artificial Sequence
  Synthetic Polynucleotide
taatacgactcactatagggtggagaccttgacgcggcgctcctccgcggaacagaggagaccgcggatgagcgccgcgaacctggcggcagcgcaaaagatg

SEQ ID NO: 158568 - DNA, 103 bp, Artificial Sequence
  Synthetic Polynucleotide
taatacgactcactatagggaagggcaggctggagaccttgacgcggcgcaacagaggagagcgccgatgcaaggtctcaacctggcggcagcgcaaaagatg

SEQ ID NO: 158569 - DNA, 103 bp, Artificial Sequence
  Synthetic Polynucleotide
taatacgactcactatagggctccacgctgaagggcaggctggagaccttaacagaggagaaaggtcatgagcctgcccaacctggcggcagcgcaaaagatg

SEQ ID NO: 158570 - DNA, 103 bp, Artificial Sequence
  Synthetic Polynucleotide
taatacgactcactatagggacatgagcgcctccacgctgaagggcaggcaacagaggagagcctgcatgtcagcgtggaacctggcggcagcgcaaaagatg

SEQ ID NO: 158571 - DNA, 103 bp, Artificial Sequence
  Synthetic Polynucleotide
taatacgactcactatagggttcttgtcggacatgagcgcctccacgctgaacagaggagacagcgtatgggcgctcataacctggcggcagcgcaaaagatg

SEQ ID NO: 158572 - DNA, 103 bp, Artificial Sequence
  Synthetic Polynucleotide
taatacgactcactatagggcttgggcggcttcttgtcggacatgagcgcaacagaggagagcgctcatgtccgacaagaacctggcggcagcgcaaaagatg

SEQ ID NO: 158573 - DNA, 103 bp, Artificial Sequence
  Synthetic Polynucleotide
taatacgactcactataggggggacgcctccttgggcggcttcttgtcggaacagaggagaccgacaatgagccgcccaaacctggcggcagcgcaaaagatg

SEQ ID NO: 158574 - DNA, 103 bp, Artificial Sequence
  Synthetic Polynucleotide
taatacgactcactataggggccggcagcggggacgcctccttgggcggcaacagaggagagccgccatgggaggcgtcaacctggcggcagcgcaaaagatg

SEQ ID NO: 158575 - DNA, 103 bp, Artificial Sequence
  Synthetic Polynucleotide
taatacgactcactatagggggcgctttcggccggcagcggggacgcctcaacagaggagagaggcgatgccgctgccgaacctggcggcagcgcaaaagatg

SEQ ID NO: 158576 - DNA, 103 bp, Artificial Sequence
  Synthetic Polynucleotide
taatacgactcactatagggcgggcgaaaacaagtcattgcctttggacgaacagaggagacgtccaatggcaatgactaacctggcggcagcgcaaaagatg

SEQ ID NO: 158577 - DNA, 103 bp, Artificial Sequence
  Synthetic Polynucleotide
taatacgactcactatagggccccggccgaggcgctttcggccggcagcgaacagaggagacgctgcatgccgaaagcgaacctggcggcagcgcaaaagatg

SEQ ID NO: 158578 - DNA, 103 bp, Artificial Sequence
  Synthetic Polynucleotide
taatacgactcactatagggcgcagggtggccccggccgaggcgctttcgaacagaggagacgaaagatgctcggccggaacctggcggcagcgcaaaagatg

SEQ ID NO: 158579 - DNA, 103 bp, Artificial Sequence
  Synthetic Polynucleotide
taatacgactcactatagggcagcagtggccgcagggtggccccggccgaaacagaggagatcggccatggccaccctgaacctggcggcagcgcaaaagatg

SEQ ID NO: 158580 - DNA, 103 bp, Artificial Sequence
  Synthetic Polynucleotide
taatacgactcactataggggccccgacagcagcagtggccgcagggtggaacagaggagaccacccatgggccactgcaacctggcggcagcgcaaaagatg

SEQ ID NO: 158581 - DNA, 103 bp, Artificial Sequence
  Synthetic Polynucleotide
taatacgactcactatagggcgagcgccgtgccccgacagcagcagtggcaacagaggagagccactatggctgtcgggaacctggcggcagcgcaaaagatg

SEQ ID NO: 158582 - DNA, 103 bp, Artificial Sequence
  Synthetic Polynucleotide
taatacgactcactataggggtgcgcttcccgagcgccgtgccccgacagaacagaggagactgtcgatgcacggcgctaacctggcggcagcgcaaaagatg

SEQ ID NO: 158583 - DNA, 103 bp, Artificial Sequence
  Synthetic Polynucleotide
taatacgactcactataggggcccggggctgtgcgcttcccgagcgccgtaacagaggagaacggcgatggggaagcgcaacctggcggcagcgcaaaagatg

SEQ ID NO: 158584 - DNA, 103 bp, Artificial Sequence
  Synthetic Polynucleotide
taatacgactcactatagggttcaccagcggcccggggctgtgcgcttccaacagaggagaggaagcatgcagccccggaacctggcggcagcgcaaaagatg

SEQ ID NO: 158585 - DNA, 103 bp, Artificial Sequence
  Synthetic Polynucleotide
taatacgactcactatagggctcgaagggcttcaccagcggcccggggctaacagaggagaagccccatgccgctggtgaacctggcggcagcgcaaaagatg

SEQ ID NO: 158586 - DNA, 103 bp, Artificial Sequence
  Synthetic Polynucleotide
taatacgactcactatagggccgaggcggtctcgaagggcttcaccagcgaacagaggagacgctggatgagcccttcgaacctggcggcagcgcaaaagatg

SEQ ID NO: 158587 - DNA, 103 bp, Artificial Sequence
  Synthetic Polynucleotide
taatacgactcactatagggccctcctcgtcgggcgaaaacaagtcattgaacagaggagacaatgaatggttttcgccaacctggcggcagcgcaaaagatg

SEQ ID NO: 158588 - DNA, 103 bp, Artificial Sequence
  Synthetic Polynucleotide
taatacgactcactatagggtccgacttgaccgaggcggtctcgaagggcaacagaggagagcccttatggaccgcctcaacctggcggcagcgcaaaagatg

SEQ ID NO: 158589 - DNA, 103 bp, Artificial Sequence
  Synthetic Polynucleotide
taatacgactcactatagggttctgaattttccgacttgaccgaggcggtaacagaggagaaccgccatggtcaagtcgaacctggcggcagcgcaaaagatg

SEQ ID NO: 158590 - DNA, 103 bp, Artificial Sequence
  Synthetic Polynucleotide
taatacgactcactatagggccgctccatcttctgaattttccgacttgaaacagaggagatcaagtatgaaaattcagaacctggcggcagcgcaaaagatg

SEQ ID NO: 158591 - DNA, 103 bp, Artificial Sequence
  Synthetic Polynucleotide
taatacgactcactatagggtgcatccacgccgctccatcttctgaatttaacagaggagaaaattcatgagatggagcaacctggcggcagcgcaaaagatg

SEQ ID NO: 158592 - DNA, 103 bp, Artificial Sequence
  Synthetic Polynucleotide
taatacgactcactataggggccgggttcctgcatccacgccgctccatcaacagaggagagatggaatggcgtggatgaacctggcggcagcgcaaaagatg

SEQ ID NO: 158593 - DNA, 103 bp, Artificial Sequence
  Synthetic Polynucleotide
taatacgactcactataggggcgaatatcggccgggttcctgcatccacgaacagaggagacgtggaatgaggaacccgaacctggcggcagcgcaaaagatg

SEQ ID NO: 158594 - DNA, 103 bp, Artificial Sequence
  Synthetic Polynucleotide
taatacgactcactatagggcttggcggcggcgaatatcggccgggttccaacagaggagaggaaccatgccgatattcaacctggcggcagcgcaaaagatg

SEQ ID NO: 158595 - DNA, 103 bp, Artificial Sequence
  Synthetic Polynucleotide
taatacgactcactataggggctcatatgtcttggcggcggcgaatatcgaacagaggagacgatatatgccgccgccaaacctggcggcagcgcaaaagatg

SEQ ID NO: 158596 - DNA, 103 bp, Artificial Sequence
  Synthetic Polynucleotide
taatacgactcactatagggaggtggtagggctcatatgtcttggcggcgaacagaggagacgccgcatggacatatgaaacctggcggcagcgcaaaagatg

SEQ ID NO: 158597 - DNA, 103 bp, Artificial Sequence
  Synthetic Polynucleotide
taatacgactcactatagggctcagggtgcaggtggtagggctcatatgtaacagaggagaacatatatgccctaccacaacctggcggcagcgcaaaagatg

SEQ ID NO: 158598 - DNA, 103 bp, Artificial Sequence
  Synthetic Polynucleotide
taatacgactcactatagggcactgctgggccctcctcgtcgggcgaaaaaacagaggagattttcgatggacgaggagaacctggcggcagcgcaaaagatg

SEQ ID NO: 158599 - DNA, 103 bp, Artificial Sequence
  Synthetic Polynucleotide
taatacgactcactatagggcttgtgtttcctcagggtgcaggtggtaggaacagaggagacctaccatgtgcaccctgaacctggcggcagcgcaaaagatg

SEQ ID NO: 158600 - DNA, 103 bp, Artificial Sequence
  Synthetic Polynucleotide
taatacgactcactatagggtccgattggtcttgtgtttcctcagggtgcaacagaggagagcacccatgggaaacacaaacctggcggcagcgcaaaagatg

SEQ ID NO: 158601 - DNA, 103 bp, Artificial Sequence
  Synthetic Polynucleotide
taatacgactcactataggggtgcgcggcttccgattggtcttgtgtttcaacagaggagagaaacaatggaccaatcgaacctggcggcagcgcaaaagatg

SEQ ID NO: 158602 - DNA, 103 bp, Artificial Sequence
  Synthetic Polynucleotide
taatacgactcactatagggggtaaagggcgtgcgcggcttccgattggtaacagaggagaaccaatatgaagccgcgcaacctggcggcagcgcaaaagatg

SEQ ID NO: 158603 - DNA, 103 bp, Artificial Sequence
  Synthetic Polynucleotide
taatacgactcactataggggctgggatgtggtaaagggcgtgcgcggctaacagaggagaagccgcatgcgccctttaaacctggcggcagcgcaaaagatg

SEQ ID NO: 158604 - DNA, 103 bp, Artificial Sequence
  Synthetic Polynucleotide
taatacgactcactatagggagggcgaggagctgggatgtggtaaagggcaacagaggagagcccttatgcacatcccaaacctggcggcagcgcaaaagatg

SEQ ID NO: 158605 - DNA, 103 bp, Artificial Sequence
  Synthetic Polynucleotide
taatacgactcactatagggcttgcgctccagggcgaggagctgggatgtaacagaggagaacatccatgctcctcgccaacctggcggcagcgcaaaagatg

SEQ ID NO: 158606 - DNA, 103 bp, Artificial Sequence
  Synthetic Polynucleotide
taatacgactcactatagggtctgacggaacttgcgctccagggcgaggaaacagaggagatcctcgatgtggagcgcaaacctggcggcagcgcaaaagatg

SEQ ID NO: 158607 - DNA, 103 bp, Artificial Sequence
  Synthetic Polynucleotide
taatacgactcactatagggaggtactgtttctgacggaacttgcgctccaacagaggagaggagcgatggttccgtcaaacctggcggcagcgcaaaagatg

SEQ ID NO: 158608 - DNA, 103 bp, Artificial Sequence
  Synthetic Polynucleotide
taatacgactcactatagggtgcaatggagaggtactgtttctgacggaaaacagaggagattccgtatgaaacagtacaacctggcggcagcgcaaaagatg

SEQ ID NO: 158609 - DNA, 103 bp, Artificial Sequence
  Synthetic Polynucleotide
taatacgactcactataggggtccggccaccactgctgggccctcctcgtaacagaggagaacgaggatggcccagcagaacctggcggcagcgcaaaagatg

SEQ ID NO: 158610 - DNA, 103 bp, Artificial Sequence
  Synthetic Polynucleotide
taatacgactcactatagggctgcacgctctgcaatggagaggtactgttaacagaggagaaacagtatgtctccattgaacctggcggcagcgcaaaagatg

SEQ ID NO: 158611 - DNA, 103 bp, Artificial Sequence
  Synthetic Polynucleotide
taatacgactcactatagggctggagaactctgcacgctctgcaatggagaacagaggagactccatatgagagcgtgcaacctggcggcagcgcaaaagatg

SEQ ID NO: 158612 - DNA, 103 bp, Artificial Sequence
  Synthetic Polynucleotide
taatacgactcactataggggttcagagagctggagaactctgcacgctcaacagaggagagagcgtatggagttctccaacctggcggcagcgcaaaagatg

SEQ ID NO: 158613 - DNA, 103 bp, Artificial Sequence
  Synthetic Polynucleotide
taatacgactcactatagggtctctgtgaggttcagagagctggagaactaacagaggagaagttctatggctctctgaaacctggcggcagcgcaaaagatg

SEQ ID NO: 158614 - DNA, 103 bp, Artificial Sequence
  Synthetic Polynucleotide
taatacgactcactatagggttgacctgggtctctgtgaggttcagagagaacagaggagactctctatgcctcacagaaacctggcggcagcgcaaaagatg

SEQ ID NO: 158615 - DNA, 103 bp, Artificial Sequence
  Synthetic Polynucleotide
taatacgactcactataggggaaccagattttgacctgggtctctgtgagaacagaggagactcacaatgacccaggtcaacctggcggcagcgcaaaagatg

SEQ ID NO: 158616 - DNA, 103 bp, Artificial Sequence
  Synthetic Polynucleotide
taatacgactcactatagggttcggttctggaaccagattttgacctgggaacagaggagacccaggatgaaatctggtaacctggcggcagcgcaaaagatg

SEQ ID NO: 158617 - DNA, 103 bp, Artificial Sequence
  Synthetic Polynucleotide
taatacgactcactataggggccttggcccttcggttctggaaccagattaacagaggagaaatctgatgccagaaccgaacctggcggcagcgcaaaagatg

SEQ ID NO: 158618 - DNA, 103 bp, Artificial Sequence
  Synthetic Polynucleotide
taatacgactcactatagggcagtcttttcgccttggcccttcggttctgaacagaggagacagaacatgagggccaagaacctggcggcagcgcaaaagatg

SEQ ID NO: 158619 - DNA, 103 bp, Artificial Sequence
  Synthetic Polynucleotide
taatacgactcactatagggctgcctcctgcagtcttttcgccttggcccaacagaggagagggccaatgcgaaaagacaacctggcggcagcgcaaaagatg

SEQ ID NO: 158620 - DNA, 103 bp, Artificial Sequence
  Synthetic Polynucleotide
taatacgactcactatagggcccgggcctggtccggccaccactgctgggaacagaggagacccagcatgggtggccggaacctggcggcagcgcaaaagatg

SEQ ID NO: 158621 - DNA, 103 bp, Artificial Sequence
  Synthetic Polynucleotide
taatacgactcactatagggttttccagttctgcctcctgcagtcttttcaacagaggagagaaaagatggcaggaggcaacctggcggcagcgcaaaagatg

SEQ ID NO: 158622 - DNA, 103 bp, Artificial Sequence
  Synthetic Polynucleotide
taatacgactcactatagggcattttcagcttttccagttctgcctcctgaacagaggagacaggagatggaactggaaaacctggcggcagcgcaaaagatg

SEQ ID NO: 158623 - DNA, 103 bp, Artificial Sequence
  Synthetic Polynucleotide
taatacgactcactataggggttttgcagccattttcagcttttccagttaacagaggagaaactggatgagctgaaaaaacctggcggcagcgcaaaagatg

SEQ ID NO: 158624 - DNA, 103 bp, Artificial Sequence
  Synthetic Polynucleotide
taatacgactcactatagggggcagcataggttttgcagccattttcagcaacagaggagagctgaaatgggctgcaaaaacctggcggcagcgcaaaagatg

SEQ ID NO: 158625 - DNA, 103 bp, Artificial Sequence
  Synthetic Polynucleotide
taatacgactcactataggggaagctggagggcagcataggttttgcagcaacagaggagagctgcaatgcctatgctgaacctggcggcagcgcaaaagatg

SEQ ID NO: 158626 - DNA, 103 bp, Artificial Sequence
  Synthetic Polynucleotide
taatacgactcactatagggaagggagactgaagctggagggcagcatagaacagaggagactatgcatgcctccagctaacctggcggcagcgcaaaagatg

SEQ ID NO: 158627 - DNA, 103 bp, Artificial Sequence
  Synthetic Polynucleotide
taatacgactcactatagggctgatggggaaagggagactgaagctggagaacagaggagactccagatgcagtctcccaacctggcggcagcgcaaaagatg

SEQ ID NO: 158628 - DNA, 103 bp, Artificial Sequence
  Synthetic Polynucleotide
taatacgactcactatagggcaggggcgagctgatggggaaagggagactaacagaggagaagtctcatgttccccatcaacctggcggcagcgcaaaagatg

SEQ ID NO: 158629 - DNA, 103 bp, Artificial Sequence
  Synthetic Polynucleotide
taatacgactcactatagggacgctgcctgcaggggcgagctgatggggaaacagaggagatccccaatggctcgccccaacctggcggcagcgcaaaagatg

SEQ ID NO: 158630 - DNA, 103 bp, Artificial Sequence
  Synthetic Polynucleotide
taatacgactcactatagggccatatatggacgctgcctgcaggggcgagaacagaggagactcgccatggcaggcagcaacctggcggcagcgcaaaagatg

SEQ ID NO: 158631 - DNA, 103 bp, Artificial Sequence
  Synthetic Polynucleotide
taatacgactcactataggggcccccaggccccgggcctggtccggccacaacagaggagagtggccatgccaggcccgaacctggcggcagcgcaaaagatg

SEQ ID NO: 158632 - DNA, 103 bp, Artificial Sequence
  Synthetic Polynucleotide
taatacgactcactataggggtaggatgctccatatatggacgctgcctgaacagaggagacaggcaatgtccatatataacctggcggcagcgcaaaagatg

SEQ ID NO: 158633 - DNA, 103 bp, Artificial Sequence
  Synthetic Polynucleotide
taatacgactcactatagggtatggaacgggtaggatgctccatatatggaacagaggagaccatatatggagcatcctaacctggcggcagcgcaaaagatg

SEQ ID NO: 158634 - DNA, 103 bp, Artificial Sequence
  Synthetic Polynucleotide
taatacgactcactatagggagcacaggtctatggaacgggtaggatgctaacagaggagaagcatcatgcccgttccaaacctggcggcagcgcaaaagatg

SEQ ID NO: 158635 - DNA, 103 bp, Artificial Sequence
  Synthetic Polynucleotide
taatacgactcactatagggcgggatgggaagcacaggtctatggaacggaacagaggagaccgttcatgagacctgtgaacctggcggcagcgcaaaagatg

SEQ ID NO: 158636 - DNA, 103 bp, Artificial Sequence
  Synthetic Polynucleotide
taatacgactcactataggggtcccacaggcgggatgggaagcacaggtcaacagaggagagacctgatgttcccatccaacctggcggcagcgcaaaagatg

SEQ ID NO: 158637 - DNA, 103 bp, Artificial Sequence
  Synthetic Polynucleotide
taatacgactcactataggggtggcatagagtcccacaggcgggatgggaaacagaggagatcccatatggcctgtgggaacctggcggcagcgcaaaagatg

SEQ ID NO: 158638 - DNA, 103 bp, Artificial Sequence
  Synthetic Polynucleotide
taatacgactcactatagggtcccactggcgtggcatagagtcccacaggaacagaggagacctgtgatgctctatgccaacctggcggcagcgcaaaagatg

SEQ ID NO: 158639 - DNA, 103 bp, Artificial Sequence
  Synthetic Polynucleotide
taatacgactcactatagggacatgccatatcccactggcgtggcatagaaacagaggagatctatgatgcgccagtggaacctggcggcagcgcaaaagatg

SEQ ID NO: 158640 - DNA, 103 bp, Artificial Sequence
  Synthetic Polynucleotide
taatacgactcactataggggacaggtggtacatgccatatcccactggcaacagaggagagccagtatgatatggcataacctggcggcagcgcaaaagatg

SEQ ID NO: 158641 - DNA, 103 bp, Artificial Sequence
  Synthetic Polynucleotide
taatacgactcactatagggccccctcggcgcccccaggccccgggcctgaacagaggagacaggccatgggcctggggaacctggcggcagcgcaaaagatg

SEQ ID NO: 158642 - DNA, 103 bp, Artificial Sequence
  Synthetic Polynucleotide
taatacgactcactatagggtcctccgcggccccctcggcgcccccaggcaacagaggagagcctggatgcgccgagggaacctggcggcagcgcaaaagatg

SEQ ID NO: 158643 - DNA, 103 bp, Artificial Sequence
  Synthetic Polynucleotide
taatacgactcactataggggtctccgaccctgtacatgttggcggccataacagaggagaatggccatgaacatgtacaacctggcggcagcgcaaaagatg

SEQ ID NO: 158644 - DNA, 103 bp, Artificial Sequence
  Synthetic Polynucleotide
taatacgactcactatagggggcctccacgttcccattggccgtcttgttaacagaggagaaacaagatggccaatgggaacctggcggcagcgcaaaagatg

SEQ ID NO: 158645 - DNA, 103 bp, Artificial Sequence
  Synthetic Polynucleotide
taatacgactcactatagggtttctgctgcacgtatctgtcggtggtcttaacagaggagaaagaccatggacagatacaacctggcggcagcgcaaaagatg

SEQ ID NO: 158646 - DNA, 103 bp, Artificial Sequence
  Synthetic Polynucleotide
taatacgactcactatagggctttcaagcgtttctgctgcacgtatctgtaacagaggagaacagatatgtgcagcagaaacctggcggcagcgcaaaagatg

SEQ ID NO: 158647 - DNA, 103 bp, Artificial Sequence
  Synthetic Polynucleotide
taatacgactcactataggggcttcagctgctttcaagcgtttctgctgcaacagaggagagcagcaatgacgcttgaaaacctggcggcagcgcaaaagatg

SEQ ID NO: 158648 - DNA, 103 bp, Artificial Sequence
  Synthetic Polynucleotide
taatacgactcactatagggcttgctctcagcttcagctgctttcaagcgaacagaggagacgcttgatggcagctgaaaacctggcggcagcgcaaaagatg

SEQ ID NO: 158649 - DNA, 103 bp, Artificial Sequence
  Synthetic Polynucleotide
taatacgactcactatagggcttgctttaacttgctctcagcttcagctgaacagaggagacagctgatgctgagagcaaacctggcggcagcgcaaaagatg

SEQ ID NO: 158650 - DNA, 103 bp, Artificial Sequence
  Synthetic Polynucleotide
taatacgactcactatagggggaatataaacttgctttaacttgctctcaaacagaggagatgagagatggttaaagcaaacctggcggcagcgcaaaagatg

SEQ ID NO: 158651 - DNA, 103 bp, Artificial Sequence
  Synthetic Polynucleotide
taatacgactcactataggggttatagttgggaatataaacttgctttaaaacagaggagattaaagatggtttatattaacctggcggcagcgcaaaagatg

SEQ ID NO: 158652 - DNA, 103 bp, Artificial Sequence
  Synthetic Polynucleotide
taatacgactcactataggggatttggcttgttatagttgggaatataaaaacagaggagatttataatgccaactataaacctggcggcagcgcaaaagatg

SEQ ID NO: 158653 - DNA, 103 bp, Artificial Sequence
  Synthetic Polynucleotide
taatacgactcactatagggatttggttcggatttggcttgttatagttgaacagaggagacaactaatgcaagccaaaaacctggcggcagcgcaaaagatg

SEQ ID NO: 158654 - DNA, 103 bp, Artificial Sequence
  Synthetic Polynucleotide
taatacgactcactataggggttgacgctgatttggttcggatttggcttaacagaggagaaagccaatgccgaaccaaaacctggcggcagcgcaaaagatg

SEQ ID NO: 158655 - DNA, 103 bp, Artificial Sequence
  Synthetic Polynucleotide
taatacgactcactatagggacaccactttggcctccacgttcccattggaacagaggagaccaatgatgacgtggaggaacctggcggcagcgcaaaagatg

SEQ ID NO: 158656 - DNA, 103 bp, Artificial Sequence
  Synthetic Polynucleotide
taatacgactcactatagggccttgacgttgttgacgctgatttggttcgaacagaggagacgaaccatgtcagcgtcaaacctggcggcagcgcaaaagatg

SEQ ID NO: 158657 - DNA, 103 bp, Artificial Sequence
  Synthetic Polynucleotide
taatacgactcactatagggaccacaccggccttgacgttgttgacgctgaacagaggagacagcgtatgcaacgtcaaaacctggcggcagcgcaaaagatg

SEQ ID NO: 158658 - DNA, 103 bp, Artificial Sequence
  Synthetic Polynucleotide
taatacgactcactatagggcgtgccgttcaccacaccggccttgacgttaacagaggagaaacgtcatggccggtgtgaacctggcggcagcgcaaaagatg

SEQ ID NO: 158659 - DNA, 103 bp, Artificial Sequence
  Synthetic Polynucleotide
taatacgactcactatagggccggcgcccccgtgccgttcaccacaccggaacagaggagaccggtgatgtgaacggcaaacctggcggcagcgcaaaagatg

SEQ ID NO: 158660 - DNA, 103 bp, Artificial Sequence
  Synthetic Polynucleotide
taatacgactcactataggggggctctggcccggcgcccccgtgccgttcaacagaggagagaacggatggggggcgccaacctggcggcagcgcaaaagatg

SEQ ID NO: 158661 - DNA, 103 bp, Artificial Sequence
  Synthetic Polynucleotide
taatacgactcactataggggccagccccagggctctggcccggcgccccaacagaggagaggggcgatgggccagagcaacctggcggcagcgcaaaagatg

SEQ ID NO: 158662 - DNA, 103 bp, Artificial Sequence
  Synthetic Polynucleotide
taatacgactcactatagggcgcaggcccggccagccccagggctctggcaacagaggagagccagaatgctggggctgaacctggcggcagcgcaaaagatg

SEQ ID NO: 158663 - DNA, 103 bp, Artificial Sequence
  Synthetic Polynucleotide
taatacgactcactatagggtaacagctctcgcaggcccggccagccccaaacagaggagatggggcatgccgggcctgaacctggcggcagcgcaaaagatg

SEQ ID NO: 158664 - DNA, 103 bp, Artificial Sequence
  Synthetic Polynucleotide
taatacgactcactatagggctgtgtggtgtaacagctctcgcaggcccgaacagaggagacgggccatggagagctgtaacctggcggcagcgcaaaagatg

SEQ ID NO: 158665 - DNA, 103 bp, Artificial Sequence
  Synthetic Polynucleotide
taatacgactcactatagggactggtaagactgtgtggtgtaacagctctaacagaggagaagagctatgacaccacacaacctggcggcagcgcaaaagatg

SEQ ID NO: 158666 - DNA, 103 bp, Artificial Sequence
  Synthetic Polynucleotide
taatacgactcactatagggcggtagaagcacaccactttggcctccacgaacagaggagacgtggaatgcaaagtggtaacctggcggcagcgcaaaagatg

SEQ ID NO: 158667 - DNA, 103 bp, Artificial Sequence
  Synthetic Polynucleotide
taatacgactcactatagggcaagaataccactggtaagactgtgtggtgaacagaggagacaccacatggtcttaccaaacctggcggcagcgcaaaagatg

SEQ ID NO: 158668 - DNA, 103 bp, Artificial Sequence
  Synthetic Polynucleotide
taatacgactcactatagggagggggaccccaagaataccactggtaagaaacagaggagatcttacatgtggtattctaacctggcggcagcgcaaaagatg

SEQ ID NO: 158669 - DNA, 103 bp, Artificial Sequence
  Synthetic Polynucleotide
taatacgactcactatagggactgcatgttagggggaccccaagaataccaacagaggagaggtattatgggggtccccaacctggcggcagcgcaaaagatg

SEQ ID NO: 158670 - DNA, 103 bp, Artificial Sequence
  Synthetic Polynucleotide
taatacgactcactatagggcagagacgacactgcatgttagggggacccaacagaggagagggtccatgtaacatgcaaacctggcggcagcgcaaaagatg

SEQ ID NO: 158671 - DNA, 103 bp, Artificial Sequence
  Synthetic Polynucleotide
taatacgactcactatagggacaagatgcgcagagacgacactgcatgttaacagaggagaaacatgatgtgtcgtctcaacctggcggcagcgcaaaagatg

SEQ ID NO: 158672 - DNA, 103 bp, Artificial Sequence
  Synthetic Polynucleotide
taatacgactcactatagggaatatgtccaacaagatgcgcagagacgacaacagaggagagtcgtcatggcgcatcttaacctggcggcagcgcaaaagatg

SEQ ID NO: 158673 - DNA, 103 bp, Artificial Sequence
  Synthetic Polynucleotide
taatacgactcactatagggtatttcttccaatatgtccaacaagatgcgaacagaggagacgcatcatgttggacataaacctggcggcagcgcaaaagatg

SEQ ID NO: 158674 - DNA, 103 bp, Artificial Sequence
  Synthetic Polynucleotide
taatacgactcactatagggcaagccaccatatttcttccaatatgtccaaacagaggagatggacaatgtggaagaaaaacctggcggcagcgcaaaagatg

SEQ ID NO: 158675 - DNA, 103 bp, Artificial Sequence
  Synthetic Polynucleotide
taatacgactcactatagggttggcattttcaagccaccatatttcttccaacagaggagaggaagaatgatggtggctaacctggcggcagcgcaaaagatg

SEQ ID NO: 158676 - DNA, 103 bp, Artificial Sequence
  Synthetic Polynucleotide
taatacgactcactatagggtctaaccgggttggcattttcaagccaccaaacagaggagatggtggatggaaaatgccaacctggcggcagcgcaaaagatg

SEQ ID NO: 158677 - DNA, 103 bp, Artificial Sequence
  Synthetic Polynucleotide
taatacgactcactataggggtcccgcctccggtagaagcacaccactttaacagaggagaaaagtgatgtgcttctacaacctggcggcagcgcaaaagatg

SEQ ID NO: 158678 - DNA, 103 bp, Artificial Sequence
  Synthetic Polynucleotide
taatacgactcactatagggcctctctccatctaaccgggttggcattttaacagaggagaaaaatgatgacccggttaaacctggcggcagcgcaaaagatg

SEQ ID NO: 158679 - DNA, 103 bp, Artificial Sequence
  Synthetic Polynucleotide
taatacgactcactatagggttggtcctggcctctctccatctaaccgggaacagaggagacccggtatgatggagagaaacctggcggcagcgcaaaagatg

SEQ ID NO: 158680 - DNA, 103 bp, Artificial Sequence
  Synthetic Polynucleotide
taatacgactcactatagggttactgcggtttggtcctggcctctctccaaacagaggagatggagaatggccaggaccaacctggcggcagcgcaaaagatg

SEQ ID NO: 158681 - DNA, 103 bp, Artificial Sequence
  Synthetic Polynucleotide
taatacgactcactataggggggactcatgttactgcggtttggtcctggaacagaggagaccaggaatgaaccgcagtaacctggcggcagcgcaaaagatg

SEQ ID NO: 158682 - DNA, 103 bp, Artificial Sequence
  Synthetic Polynucleotide
taatacgactcactatagggggaggccgtggggactcatgttactgcggtaacagaggagaaccgcaatgacatgagtcaacctggcggcagcgcaaaagatg

SEQ ID NO: 158683 - DNA, 103 bp, Artificial Sequence
  Synthetic Polynucleotide
taatacgactcactatagggctccgggctgggaggccgtggggactcatgaacagaggagacatgagatgccacggcctaacctggcggcagcgcaaaagatg

SEQ ID NO: 158684 - DNA, 103 bp, Artificial Sequence
  Synthetic Polynucleotide
taatacgactcactataggggctcccgctgctccgggctgggaggccgtgaacagaggagacacggcatgccagcccggaacctggcggcagcgcaaaagatg

SEQ ID NO: 158685 - DNA, 103 bp, Artificial Sequence
  Synthetic Polynucleotide
taatacgactcactatagggcaaacttggggctcccgctgctccgggctgaacagaggagacagcccatggcagcgggaaacctggcggcagcgcaaaagatg

SEQ ID NO: 158686 - DNA, 103 bp, Artificial Sequence
  Synthetic Polynucleotide
taatacgactcactataggggtcttcatggcaaacttggggctcccgctgaacagaggagacagcggatgccccaagttaacctggcggcagcgcaaaagatg

SEQ ID NO: 158687 - DNA, 103 bp, Artificial Sequence
  Synthetic Polynucleotide
taatacgactcactatagggagcctgcctggtcttcatggcaaacttgggaacagaggagacccaagatggccatgaagaacctggcggcagcgcaaaagatg

SEQ ID NO: 158688 - DNA, 103 bp, Artificial Sequence
  Synthetic Polynucleotide
taatacgactcactatagggtgctggagatgtcccgcctccggtagaagcaacagaggagagcttctatgggaggcgggaacctggcggcagcgcaaaagatg

SEQ ID NO: 158689 - DNA, 103 bp, Artificial Sequence
  Synthetic Polynucleotide
taatacgactcactataggggcagatagaaagcctgcctggtcttcatggaacagaggagaccatgaatgccaggcaggaacctggcggcagcgcaaaagatg

SEQ ID NO: 158690 - DNA, 103 bp, Artificial Sequence
  Synthetic Polynucleotide
taatacgactcactatagggttcgtcgtgtgcagatagaaagcctgcctgaacagaggagacaggcaatgtttctatctaacctggcggcagcgcaaaagatg

SEQ ID NO: 158691 - DNA, 103 bp, Artificial Sequence
  Synthetic Polynucleotide
taatacgactcactatagggccgcgtcagcttcgtcgtgtgcagatagaaaacagaggagattctatatgcacacgacgaacctggcggcagcgcaaaagatg

SEQ ID NO: 158692 - DNA, 103 bp, Artificial Sequence
  Synthetic Polynucleotide
taatacgactcactataggggccgggcgatccgcgtcagcttcgtcgtgtaacagaggagaacacgaatgagctgacgcaacctggcggcagcgcaaaagatg

SEQ ID NO: 158693 - DNA, 103 bp, Artificial Sequence
  Synthetic Polynucleotide
taatacgactcactatagggcggcacaggcgccgggcgatccgcgtcagcaacagaggagagctgacatggatcgcccgaacctggcggcagcgcaaaagatg

SEQ ID NO: 158694 - DNA, 103 bp, Artificial Sequence
  Synthetic Polynucleotide
taatacgactcactatagggcaggatctcacggcacaggcgccgggcgataacagaggagaatcgccatgcgcctgtgcaacctggcggcagcgcaaaagatg

SEQ ID NO: 158695 - DNA, 103 bp, Artificial Sequence
  Synthetic Polynucleotide
taatacgactcactataggggccacgggcgcaggatctcacggcacaggcaacagaggagagcctgtatggtgagatccaacctggcggcagcgcaaaagatg

SEQ ID NO: 158696 - DNA, 103 bp, Artificial Sequence
  Synthetic Polynucleotide
taatacgactcactatagggcgcgcagcgtgccacgggcgcaggatctcaaacagaggagatgagatatggcgcccgtgaacctggcggcagcgcaaaagatg

SEQ ID NO: 158697 - DNA, 103 bp, Artificial Sequence
  Synthetic Polynucleotide
taatacgactcactataggggtaggggtgccgcgcagcgtgccacgggcgaacagaggagacgcccgatgcacgctgcgaacctggcggcagcgcaaaagatg

SEQ ID NO: 158698 - DNA, 103 bp, Artificial Sequence
  Synthetic Polynucleotide
taatacgactcactatagggtgatgggcaggtaggggtgccgcgcagcgtaacagaggagaacgctgatgggcacccctaacctggcggcagcgcaaaagatg

SEQ ID NO: 158699 - DNA, 103 bp, Artificial Sequence
  Synthetic Polynucleotide
taatacgactcactataggggcgatgagggtgctggagatgtcccgcctcaacagaggagagaggcgatgcatctccagaacctggcggcagcgcaaaagatg

SEQ ID NO: 158700 - DNA, 103 bp, Artificial Sequence
  Synthetic Polynucleotide
taatacgactcactataggggccgcgctgttgatgggcaggtaggggtgcaacagaggagagcacccatgcctgcccataacctggcggcagcgcaaaagatg

SEQ ID NO: 158701 - DNA, 103 bp, Artificial Sequence
  Synthetic Polynucleotide
taatacgactcactatagggggccttgatggccgcgctgttgatgggcagaacagaggagactgcccatgaacagcgcgaacctggcggcagcgcaaaagatg

SEQ ID NO: 158702 - DNA, 103 bp, Artificial Sequence
  Synthetic Polynucleotide
taatacgactcactatagggccgtgcactcggccttgatggccgcgctgtaacagaggagaacagcgatgccatcaaggaacctggcggcagcgcaaaagatg

SEQ ID NO: 158703 - DNA, 103 bp, Artificial Sequence
  Synthetic Polynucleotide
taatacgactcactatagggggcagccgcgccgtgcactcggccttgatgaacagaggagacatcaaatgcgagtgcacaacctggcggcagcgcaaaagatg

SEQ ID NO: 158704 - DNA, 103 bp, Artificial Sequence
  Synthetic Polynucleotide
taatacgactcactatagggggaggcttcgggcagccgcgccgtgcactcaacagaggagagagtgcatggcgcggctgaacctggcggcagcgcaaaagatg

SEQ ID NO: 158705 - DNA, 103 bp, Artificial Sequence
  Synthetic Polynucleotide
taatacgactcactataggggcgggctctgggaggcttcgggcagccgcgaacagaggagacgcggcatgccgaagcctaacctggcggcagcgcaaaagatg

SEQ ID NO: 158706 - DNA, 103 bp, Artificial Sequence
  Synthetic Polynucleotide
taatacgactcactatagggttcagcaccagcgggctctgggaggcttcgaacagaggagacgaagcatgccagagcccaacctggcggcagcgcaaaagatg

SEQ ID NO: 158707 - DNA, 103 bp, Artificial Sequence
  Synthetic Polynucleotide
taatacgactcactatagggtaccgcctgcttcagcaccagcgggctctgaacagaggagacagagcatgctggtgctgaacctggcggcagcgcaaaagatg

SEQ ID NO: 158708 - DNA, 103 bp, Artificial Sequence
  Synthetic Polynucleotide
taatacgactcactataggggcggcttgcgtaccgcctgcttcagcaccaaacagaggagatggtgcatgagcaggcggaacctggcggcagcgcaaaagatg

SEQ ID NO: 158709 - DNA, 103 bp, Artificial Sequence
  Synthetic Polynucleotide
taatacgactcactatagggacggcttccagcggcttgcgtaccgcctgcaacagaggagagcaggcatgacgcaagccaacctggcggcagcgcaaaagatg

SEQ ID NO: 158710 - DNA, 103 bp, Artificial Sequence
  Synthetic Polynucleotide
taatacgactcactataggggtcggccagggcgatgagggtgctggagataacagaggagaatctccatgaccctcatcaacctggcggcagcgcaaaagatg

SEQ ID NO: 158711 - DNA, 103 bp, Artificial Sequence
  Synthetic Polynucleotide
taatacgactcactatagggataccgaagcacggcttccagcggcttgcgaacagaggagacgcaagatgctggaagccaacctggcggcagcgcaaaagatg

SEQ ID NO: 158712 - DNA, 103 bp, Artificial Sequence
  Synthetic Polynucleotide
taatacgactcactataggggggtctcaagataccgaagcacggcttccaaacagaggagatggaagatgtgcttcggtaacctggcggcagcgcaaaagatg

SEQ ID NO: 158713 - DNA, 103 bp, Artificial Sequence
  Synthetic Polynucleotide
taatacgactcactataggggggcgggggtgggtctcaagataccgaagcaacagaggagagcttcgatgtcttgagacaacctggcggcagcgcaaaagatg

SEQ ID NO: 158714 - DNA, 103 bp, Artificial Sequence
  Synthetic Polynucleotide
taatacgactcactatagggaggcttgggggggcgggggtgggtctcaagaacagaggagacttgagatgcacccccgcaacctggcggcagcgcaaaagatg

SEQ ID NO: 158715 - DNA, 103 bp, Artificial Sequence
  Synthetic Polynucleotide
taatacgactcactatagggtcacggggtcaggcttgggggggcgggggtaacagaggagaacccccatgcccccaagcaacctggcggcagcgcaaaagatg

SEQ ID NO: 158716 - DNA, 103 bp, Artificial Sequence
  Synthetic Polynucleotide
taatacgactcactataggggacacgcttttcacggggtcaggcttggggaacagaggagaccccaaatgtgaccccgtaacctggcggcagcgcaaaagatg

SEQ ID NO: 158717 - DNA, 103 bp, Artificial Sequence
  Synthetic Polynucleotide
taatacgactcactataggggagcacgctggacacgcttttcacggggtcaacagaggagagaccccatgaaaagcgtgaacctggcggcagcgcaaaagatg

SEQ ID NO: 158718 - DNA, 103 bp, Artificial Sequence
  Synthetic Polynucleotide
taatacgactcactatagggtcaggctgctgagcacgctggacacgctttaacagaggagaaaagcgatgccagcgtgcaacctggcggcagcgcaaaagatg

SEQ ID NO: 158719 - DNA, 103 bp, Artificial Sequence
  Synthetic Polynucleotide
taatacgactcactatagggttggcgggcgtcaggctgctgagcacgctgaacagaggagacagcgtatgcagcagcctaacctggcggcagcgcaaaagatg

SEQ ID NO: 158720 - DNA, 103 bp, Artificial Sequence
  Synthetic Polynucleotide
taatacgactcactataggggggggccaccttggcgggcgtcaggctgctaacagaggagaagcagcatgacgcccgccaacctggcggcagcgcaaaagatg

SEQ ID NO: 158721 - DNA, 103 bp, Artificial Sequence
  Synthetic Polynucleotide
taatacgactcactatagggttgcgtgcttgtcggccagggcgatgagggaacagaggagaccctcaatgccctggccgaacctggcggcagcgcaaaagatg

SEQ ID NO: 158722 - DNA, 103 bp, Artificial Sequence
  Synthetic Polynucleotide
taatacgactcactatagggtgttgatgacgggggccaccttggcgggcgaacagaggagacgcccgatgaggtggcccaacctggcggcagcgcaaaagatg

SEQ ID NO: 158723 - DNA, 103 bp, Artificial Sequence
  Synthetic Polynucleotide
taatacgactcactatagggggggagccgttgttgatgacgggggccaccaacagaggagaggtggcatgcgtcatcaaaacctggcggcagcgcaaaagatg

SEQ ID NO: 158724 - DNA, 103 bp, Artificial Sequence
  Synthetic Polynucleotide
taatacgactcactatagggcaggatggtgggggagccgttgttgatgacaacagaggagagtcatcatgaacggctccaacctggcggcagcgcaaaagatg

SEQ ID NO: 158725 - DNA, 103 bp, Artificial Sequence
  Synthetic Polynucleotide
taatacgactcactatagggtgcgcttgcccaggatggtgggggagccgtaacagaggagaacggctatgccaccatccaacctggcggcagcgcaaaagatg

SEQ ID NO: 158726 - DNA, 103 bp, Artificial Sequence
  Synthetic Polynucleotide
taatacgactcactatagggtgctcgtagctgcgcttgcccaggatggtgaacagaggagacaccatatggggcaagcgaacctggcggcagcgcaaaagatg

SEQ ID NO: 158727 - DNA, 103 bp, Artificial Sequence
  Synthetic Polynucleotide
taatacgactcactatagggcccgttgtgctgctcgtagctgcgcttgccaacagaggagaggcaagatgagctacgagaacctggcggcagcgcaaaagatg

SEQ ID NO: 158728 - DNA, 103 bp, Artificial Sequence
  Synthetic Polynucleotide
taatacgactcactatagggtgccgtccaccccgttgtgctgctcgtagcaacagaggagagctacgatgagcacaacgaacctggcggcagcgcaaaagatg

SEQ ID NO: 158729 - DNA, 103 bp, Artificial Sequence
  Synthetic Polynucleotide
taatacgactcactatagggttcttcatgttgccgtccaccccgttgtgcaacagaggagagcacaaatgggtggacggaacctggcggcagcgcaaaagatg

SEQ ID NO: 158730 - DNA, 103 bp, Artificial Sequence
  Synthetic Polynucleotide
taatacgactcactatagggcaagaggcgcttcttcatgttgccgtccacaacagaggagagtggacatgaacatgaagaacctggcggcagcgcaaaagatg

SEQ ID NO: 158731 - DNA, 103 bp, Artificial Sequence
  Synthetic Polynucleotide
taatacgactcactatagggtactgggcatcaagaggcgcttcttcatgtaacagaggagaacatgaatgagcgcctctaacctggcggcagcgcaaaagatg

SEQ ID NO: 158732 - DNA, 103 bp, Artificial Sequence
  Synthetic Polynucleotide
taatacgactcactatagggactgacagggttgcgtgcttgtcggccaggaacagaggagacctggcatgcaagcacgcaacctggcggcagcgcaaaagatg

SEQ ID NO: 158733 - DNA, 103 bp, Artificial Sequence
  Synthetic Polynucleotide
taatacgactcactataggggccagacccctactgggcatcaagaggcgcaacagaggagagcgcctatggatgcccagaacctggcggcagcgcaaaagatg

SEQ ID NO: 158734 - DNA, 103 bp, Artificial Sequence
  Synthetic Polynucleotide
taatacgactcactatagggtccgtggtttgccagacccctactgggcataacagaggagaatgcccatgaggggtctgaacctggcggcagcgcaaaagatg

SEQ ID NO: 158735 - DNA, 103 bp, Artificial Sequence
  Synthetic Polynucleotide
taatacgactcactataggggcctggcctgtccgtggtttgccagaccccaacagaggagaggggtcatgcaaaccacgaacctggcggcagcgcaaaagatg

SEQ ID NO: 158736 - DNA, 103 bp, Artificial Sequence
  Synthetic Polynucleotide
taatacgactcactatagggggtcccatgtgcctggcctgtccgtggtttaacagaggagaaaaccaatgacaggccagaacctggcggcagcgcaaaagatg

SEQ ID NO: 158737 - DNA, 103 bp, Artificial Sequence
  Synthetic Polynucleotide
taatacgactcactataggggttccggcttggtcccatgtgcctggcctgaacagaggagacaggccatgcacatgggaaacctggcggcagcgcaaaagatg

SEQ ID NO: 158738 - DNA, 103 bp, Artificial Sequence
  Synthetic Polynucleotide
taatacgactcactatagggtgagcaggaggttccggcttggtcccatgtaacagaggagaacatggatgcaagccggaaacctggcggcagcgcaaaagatg

SEQ ID NO: 158739 - DNA, 103 bp, Artificial Sequence
  Synthetic Polynucleotide
taatacgactcactataggggacttcccgttgagcaggaggttccggcttaacagaggagaaagccgatgcctcctgctaacctggcggcagcgcaaaagatg

SEQ ID NO: 158740 - DNA, 103 bp, Artificial Sequence
  Synthetic Polynucleotide
taatacgactcactatagggggtggggtaggacttcccgttgagcaggagaacagaggagactcctgatgaacgggaagaacctggcggcagcgcaaaagatg

SEQ ID NO: 158741 - DNA, 103 bp, Artificial Sequence
  Synthetic Polynucleotide
taatacgactcactatagggggcgcactttggtggggtaggacttcccgtaacagaggagaacgggaatgcctaccccaaacctggcggcagcgcaaaagatg

SEQ ID NO: 158742 - DNA, 103 bp, Artificial Sequence
  Synthetic Polynucleotide
taatacgactcactatagggccccggatcaggcgcactttggtggggtagaacagaggagactacccatgcaaagtgcgaacctggcggcagcgcaaaagatg

SEQ ID NO: 158743 - DNA, 103 bp, Artificial Sequence
  Synthetic Polynucleotide
taatacgactcactatagggcttatagcagactgacagggttgcgtgcttaacagaggagaaagcacatgaccctgtcaaacctggcggcagcgcaaaagatg

SEQ ID NO: 158744 - DNA, 103 bp, Artificial Sequence
  Synthetic Polynucleotide
taatacgactcactatagggcagggagcccccccggatcaggcgcactttaacagaggagaaaagtgatgctgatccggaacctggcggcagcgcaaaagatg

SEQ ID NO: 158745 - DNA, 103 bp, Artificial Sequence
  Synthetic Polynucleotide
taatacgactcactatagggtgactgggggcagggagcccccccggatcaaacagaggagatgatccatgggggctcccaacctggcggcagcgcaaaagatg

SEQ ID NO: 158746 - DNA, 103 bp, Artificial Sequence
  Synthetic Polynucleotide
taatacgactcactatagggcgccgccgcttgactgggggcagggagcccaacagaggagagggctcatggcccccagtaacctggcggcagcgcaaaagatg

SEQ ID NO: 158747 - DNA, 103 bp, Artificial Sequence
  Synthetic Polynucleotide
taatacgactcactatagggccagttcatccgccgccgcttgactgggggaacagaggagacccccaatgaagcggcggaacctggcggcagcgcaaaagatg

SEQ ID NO: 158748 - DNA, 103 bp, Artificial Sequence
  Synthetic Polynucleotide
taatacgactcactataggggggcgtcgatccagttcatccgccgccgctaacagaggagaagcggcatgggatgaactaacctggcggcagcgcaaaagatg

SEQ ID NO: 158749 - DNA, 103 bp, Artificial Sequence
  Synthetic Polynucleotide
taatacgactcactatagggacgtcatccggggcgtcgatccagttcatcaacagaggagagatgaaatggatcgacgcaacctggcggcagcgcaaaagatg

SEQ ID NO: 158750 - DNA, 103 bp, Artificial Sequence
  Synthetic Polynucleotide
taatacgactcactatagggcatgtagaacacgtcatccggggcgtcgataacagaggagaatcgacatgccggatgacaacctggcggcagcgcaaaagatg

SEQ ID NO: 158751 - DNA, 103 bp, Artificial Sequence
  Synthetic Polynucleotide
taatacgactcactatagggcctctgtggccatgtagaacacgtcatccgaacagaggagacggatgatgtgttctacaaacctggcggcagcgcaaaagatg

SEQ ID NO: 158752 - DNA, 103 bp, Artificial Sequence
  Synthetic Polynucleotide
taatacgactcactatagggttcctggtctcctctgtggccatgtagaacaacagaggagagttctaatgggccacagaaacctggcggcagcgcaaaagatg

SEQ ID NO: 158753 - DNA, 103 bp, Artificial Sequence
  Synthetic Polynucleotide
taatacgactcactatagggcttgcggatcttcctggtctcctctgtggcaacagaggagagccacaatggagaccaggaacctggcggcagcgcaaaagatg

SEQ ID NO: 158754 - DNA, 103 bp, Artificial Sequence
  Synthetic Polynucleotide
taatacgactcactatagggagtagacgtagtctccgaccctgtacatgtaacagaggagaacatgtatggggtcggagaacctggcggcagcgcaaaagatg

SEQ ID NO: 158755 - DNA, 103 bp, Artificial Sequence
  Synthetic Polynucleotide
taatacgactcactatagggccggtccggccttatagcagactgacagggaacagaggagaccctgtatgtctgctataaacctggcggcagcgcaaaagatg

SEQ ID NO: 158756 - DNA, 103 bp, Artificial Sequence
  Synthetic Polynucleotide
taatacgactcactatagggatgagagcagcttgcggatcttcctggtctaacagaggagaagaccaatgagatccgcaaacctggcggcagcgcaaaagatg

SEQ ID NO: 158757 - DNA, 103 bp, Artificial Sequence
  Synthetic Polynucleotide
taatacgactcactataggggtttccgaggatgagagcagcttgcggatcaacagaggagagatccgatggctgctctcaacctggcggcagcgcaaaagatg

SEQ ID NO: 158758 - DNA, 103 bp, Artificial Sequence
  Synthetic Polynucleotide
taatacgactcactatagggagcacgcttggtttccgaggatgagagcagaacagaggagactgctcatgtcctcggaaaacctggcggcagcgcaaaagatg

SEQ ID NO: 158759 - DNA, 103 bp, Artificial Sequence
  Synthetic Polynucleotide
taatacgactcactataggggccggcgggcagcacgcttggtttccgaggaacagaggagacctcggatgccaagcgtgaacctggcggcagcgcaaaagatg

SEQ ID NO: 158760 - DNA, 103 bp, Artificial Sequence
  Synthetic Polynucleotide
taatacgactcactatagggggcttgtagggccggcgggcagcacgcttgaacagaggagacaagcgatgtgcccgccgaacctggcggcagcgcaaaagatg

SEQ ID NO: 158761 - DNA, 103 bp, Artificial Sequence
  Synthetic Polynucleotide
taatacgactcactatagggcagggcgatgggcttgtagggccggcgggcaacagaggagagcccgcatgccctacaagaacctggcggcagcgcaaaagatg

SEQ ID NO: 158762 - DNA, 103 bp, Artificial Sequence
  Synthetic Polynucleotide
taatacgactcactatagggggctctggcgcagggcgatgggcttgtaggaacagaggagacctacaatgccatcgcccaacctggcggcagcgcaaaagatg

SEQ ID NO: 158763 - DNA, 103 bp, Artificial Sequence
  Synthetic Polynucleotide
taatacgactcactatagggggcagggcctggctctggcgcagggcgatgaacagaggagacatcgcatggcgccagagaacctggcggcagcgcaaaagatg

SEQ ID NO: 158764 - DNA, 103 bp, Artificial Sequence
  Synthetic Polynucleotide
taatacgactcactatagggtggccgcggcggcagggcctggctctggcgaacagaggagacgccagatgcaggccctgaacctggcggcagcgcaaaagatg

SEQ ID NO: 158765 - DNA, 103 bp, Artificial Sequence
  Synthetic Polynucleotide
taatacgactcactatagggcaggtggcggtggccgcggcggcagggcctaacagaggagaaggcccatgcgccgcggcaacctggcggcagcgcaaaagatg

SEQ ID NO: 158766 - DNA, 103 bp, Artificial Sequence
  Synthetic Polynucleotide
taatacgactcactatagggttgtccgcccccggtccggccttatagcagaacagaggagactgctaatgggccggaccaacctggcggcagcgcaaaagatg

SEQ ID NO: 158767 - DNA, 103 bp, Artificial Sequence
  Synthetic Polynucleotide
taatacgactcactatagggttgacgggcgcaggtggcggtggccgcggcaacagaggagagccgcgatgaccgccaccaacctggcggcagcgcaaaagatg

SEQ ID NO: 158768 - DNA, 103 bp, Artificial Sequence
  Synthetic Polynucleotide
taatacgactcactataggggggctcgtcgttgacgggcgcaggtggcggaacagaggagaccgccaatggcgcccgtcaacctggcggcagcgcaaaagatg

SEQ ID NO: 158769 - DNA, 103 bp, Artificial Sequence
  Synthetic Polynucleotide
taatacgactcactatagggcgatgacgatgggctcgtcgttgacgggcgaacagaggagacgcccgatgacgacgagcaacctggcggcagcgcaaaagatg

SEQ ID NO: 158770 - DNA, 103 bp, Artificial Sequence
  Synthetic Polynucleotide
taatacgactcactatagggttcctcgccgttgtccgcccccggtccggcaacagaggagagccggaatgggggcggacaacctggcggcagcgcaaaagatg

SEQ ID NO: 158771 - DNA, 103 bp, Artificial Sequence
  Synthetic Polynucleotide
taatacgactcactatagggctatttccccttcctcgccgttgtccgcccaacagaggagagggcggatgacggcgaggaacctggcggcagcgcaaaagatg

SEQ ID NO: 158772 - DNA, 103 bp, Artificial Sequence
  Synthetic Polynucleotide
taatacgactcactatagggatttcctcttctatttccccttcctcgccgaacagaggagacggcgaatgaggggaaataacctggcggcagcgcaaaagatg

SEQ ID NO: 158773 - DNA, 103 bp, Artificial Sequence
  Synthetic Polynucleotide
taatacgactcactatagggcgggttctccatttcctcttctatttccccaacagaggagaggggaaatggaagaggaaaacctggcggcagcgcaaaagatg

SEQ ID NO: 158774 - DNA, 103 bp, Artificial Sequence
  Synthetic Polynucleotide
taatacgactcactatagggccaccatttccgggttctccatttcctcttaacagaggagaaagaggatgtggagaaccaacctggcggcagcgcaaaagatg

SEQ ID NO: 158775 - DNA, 103 bp, Artificial Sequence
  Synthetic Polynucleotide
taatacgactcactatagggtcgggcaggtccaccatttccgggttctccaacagaggagaggagaaatgggaaatggtaacctggcggcagcgcaaaagatg

SEQ ID NO: 158776 - DNA, 103 bp, Artificial Sequence
  Synthetic Polynucleotide
taatacgactcactatagggctttagtttctcgggcaggtccaccatttcaacagaggagagaaatgatggacctgcccaacctggcggcagcgcaaaagatg

SEQ ID NO: 158777 - DNA, 103 bp, Artificial Sequence
  Synthetic Polynucleotide
taatacgactcactataggggcagctggtgctttagtttctcgggcaggtaacagaggagaacctgcatgagaaactaaaacctggcggcagcgcaaaagatg

SEQ ID NO: 158778 - DNA, 103 bp, Artificial Sequence
  Synthetic Polynucleotide
taatacgactcactataggggagttctcaaagtagacgtagtctccgaccaacagaggagaggtcggatgctacgtctaaacctggcggcagcgcaaaagatg

SEQ ID NO: 158779 - DNA, 103 bp, Artificial Sequence
  Synthetic Polynucleotide
taatacgactcactatagggtcccgatgccgcagctggtgctttagtttcaacagaggagagaaactatggcaccagctaacctggcggcagcgcaaaagatg

SEQ ID NO: 158780 - DNA, 103 bp, Artificial Sequence
  Synthetic Polynucleotide
taatacgactcactataggggaggaacagctcccgatgccgcagctggtgaacagaggagacaccagatgcggcatcggaacctggcggcagcgcaaaagatg

SEQ ID NO: 158781 - DNA, 103 bp, Artificial Sequence
  Synthetic Polynucleotide
taatacgactcactataggggctgccgggagaggaacagctcccgatgccaacagaggagaggcatcatgagctgttccaacctggcggcagcgcaaaagatg

SEQ ID NO: 158782 - DNA, 103 bp, Artificial Sequence
  Synthetic Polynucleotide
taatacgactcactatagggagagactccagctgccgggagaggaacagcaacagaggagagctgttatgctcccggcaaacctggcggcagcgcaaaagatg

SEQ ID NO: 158783 - DNA, 103 bp, Artificial Sequence
  Synthetic Polynucleotide
taatacgactcactatagggcgtggcgggcagagactccagctgccgggaaacagaggagatcccggatgctggagtctaacctggcggcagcgcaaaagatg

SEQ ID NO: 158784 - DNA, 103 bp, Artificial Sequence
  Synthetic Polynucleotide
taatacgactcactatagggccctgatgtgcgtggcgggcagagactccaaacagaggagatggagtatgtgcccgccaaacctggcggcagcgcaaaagatg

SEQ ID NO: 158785 - DNA, 103 bp, Artificial Sequence
  Synthetic Polynucleotide
taatacgactcactatagggctgcacttgcccctgatgtgcgtggcgggcaacagaggagagcccgcatggcacatcagaacctggcggcagcgcaaaagatg

SEQ ID NO: 158786 - DNA, 103 bp, Artificial Sequence
  Synthetic Polynucleotide
taatacgactcactatagggcagggtgacgctgcacttgcccctgatgtgaacagaggagacacatcatgggcaagtgcaacctggcggcagcgcaaaagatg

SEQ ID NO: 158787 - DNA, 103 bp, Artificial Sequence
  Synthetic Polynucleotide
taatacgactcactatagggtctcgttgagcagggtgacgctgcacttgcaacagaggagagcaagtatggcgtcacccaacctggcggcagcgcaaaagatg

SEQ ID NO: 158788 - DNA, 103 bp, Artificial Sequence
  Synthetic Polynucleotide
taatacgactcactatagggagcgactcggtctcgttgagcagggtgacgaacagaggagacgtcacatggctcaacgaaacctggcggcagcgcaaaagatg

SEQ ID NO: 158789 - DNA, 103 bp, Artificial Sequence
  Synthetic Polynucleotide
taatacgactcactataggggttgctggaggagttctcaaagtagacgtaaacagaggagatacgtcatgtttgagaacaacctggcggcagcgcaaaagatg

SEQ ID NO: 158790 - DNA, 103 bp, Artificial Sequence
  Synthetic Polynucleotide
taatacgactcactataggggtaggacttgagcgactcggtctcgttgagaacagaggagactcaacatgaccgagtcgaacctggcggcagcgcaaaagatg

SEQ ID NO: 158791 - DNA, 103 bp, Artificial Sequence
  Synthetic Polynucleotide
taatacgactcactatagggcccgctccaggtaggacttgagcgactcggaacagaggagaccgagtatgtcaagtcctaacctggcggcagcgcaaaagatg

SEQ ID NO: 158792 - DNA, 103 bp, Artificial Sequence
  Synthetic Polynucleotide
taatacgactcactatagggaagaaatcctcccgctccaggtaggacttgaacagaggagacaagtcatgcctggagcgaacctggcggcagcgcaaaagatg

SEQ ID NO: 158793 - DNA, 103 bp, Artificial Sequence
  Synthetic Polynucleotide
taatacgactcactatagggagaatagaagaagaaatcctcccgctccagaacagaggagactggagatggaggatttcaacctggcggcagcgcaaaagatg

SEQ ID NO: 158794 - DNA, 103 bp, Artificial Sequence
  Synthetic Polynucleotide
taatacgactcactatagggcgtagactagagaatagaagaagaaatcctaacagaggagaaggattatgtcttctattaacctggcggcagcgcaaaagatg

SEQ ID NO: 158795 - DNA, 103 bp, Artificial Sequence
  Synthetic Polynucleotide
taatacgactcactatagggtgctgtgggtcgtagactagagaatagaagaacagaggagacttctaatgtctagtctaaacctggcggcagcgcaaaagatg

SEQ ID NO: 158796 - DNA, 103 bp, Artificial Sequence
  Synthetic Polynucleotide
taatacgactcactatagggcagggtcttctgctgtgggtcgtagactagaacagaggagactagtcatggacccacagaacctggcggcagcgcaaaagatg

SEQ ID NO: 158797 - DNA, 103 bp, Artificial Sequence
  Synthetic Polynucleotide
taatacgactcactatagggtatctgccagcagggtcttctgctgtgggtaacagaggagaacccacatgagaagacccaacctggcggcagcgcaaaagatg

SEQ ID NO: 158798 - DNA, 103 bp, Artificial Sequence
  Synthetic Polynucleotide
taatacgactcactatagggatctctcctttatctgccagcagggtcttcaacagaggagagaagacatggctggcagaaacctggcggcagcgcaaaagatg

SEQ ID NO: 158799 - DNA, 103 bp, Artificial Sequence
  Synthetic Polynucleotide
taatacgactcactatagggtcctactcgaatctctcctttatctgccagaacagaggagactggcaatgaaaggagagaacctggcggcagcgcaaaagatg

SEQ ID NO: 158800 - DNA, 103 bp, Artificial Sequence
  Synthetic Polynucleotide
taatacgactcactatagggtcaggtatgggttgctggaggagttctcaaaacagaggagattgagaatgcctccagcaaacctggcggcagcgcaaaagatg

SEQ ID NO: 158801 - DNA, 103 bp, Artificial Sequence
  Synthetic Polynucleotide
taatacgactcactatagggggtaccggtttcctactcgaatctctccttaacagaggagaaaggagatgttcgagtagaacctggcggcagcgcaaaagatg

SEQ ID NO: 158802 - DNA, 103 bp, Artificial Sequence
  Synthetic Polynucleotide
taatacgactcactatagggatgtctgcctggtaccggtttcctactcgaaacagaggagatcgagtatgaaaccggtaaacctggcggcagcgcaaaagatg

SEQ ID NO: 158803 - DNA, 103 bp, Artificial Sequence
  Synthetic Polynucleotide
taatacgactcactatagggcaagtcggtgatgtctgcctggtaccggttaacagaggagaaaccggatgcaggcagacaacctggcggcagcgcaaaagatg

SEQ ID NO: 158804 - DNA, 103 bp, Artificial Sequence
  Synthetic Polynucleotide
taatacgactcactatagggcttcttttaacaagtcggtgatgtctgcctaacagaggagaaggcagatgtcaccgactaacctggcggcagcgcaaaagatg

SEQ ID NO: 158805 - DNA, 103 bp, Artificial Sequence
  Synthetic Polynucleotide
taatacgactcactatagggtcctcctcgccttcttttaacaagtcggtgaacagaggagacaccgaatggttaaaagaaacctggcggcagcgcaaaagatg

SEQ ID NO: 158806 - DNA, 103 bp, Artificial Sequence
  Synthetic Polynucleotide
taatacgactcactataggggtctcggccatcctcctcgccttcttttaaaacagaggagattaaaaatgggcgaggagaacctggcggcagcgcaaaagatg

SEQ ID NO: 158807 - DNA, 103 bp, Artificial Sequence
  Synthetic Polynucleotide
taatacgactcactatagggacctggactggtctcggccatcctcctcgcaacagaggagagcgaggatgatggccgagaacctggcggcagcgcaaaagatg

SEQ ID NO: 158808 - DNA, 103 bp, Artificial Sequence
  Synthetic Polynucleotide
taatacgactcactatagggtgggtctccaacctggactggtctcggccaaacagaggagatggccgatgccagtccagaacctggcggcagcgcaaaagatg

SEQ ID NO: 158809 - DNA, 103 bp, Artificial Sequence
  Synthetic Polynucleotide
taatacgactcactatagggctcccacacctgggtctccaacctggactgaacagaggagacagtccatgttggagaccaacctggcggcagcgcaaaagatg

SEQ ID NO: 158810 - DNA, 103 bp, Artificial Sequence
  Synthetic Polynucleotide
taatacgactcactatagggggttgtgcgcctcccacacctgggtctccaaacagaggagatggagaatgaggtgtgggaacctggcggcagcgcaaaagatg

SEQ ID NO: 158811 - DNA, 103 bp, Artificial Sequence
  Synthetic Polynucleotide
taatacgactcactatagggattctccggatcaggtatgggttgctggagaacagaggagactccagatgcccatacctaacctggcggcagcgcaaaagatg

SEQ ID NO: 158812 - DNA, 103 bp, Artificial Sequence
  Synthetic Polynucleotide
taatacgactcactatagggtctgtgagtgggttgtgcgcctcccacaccaacagaggagaggtgtgatgggcgcacaaaacctggcggcagcgcaaaagatg

SEQ ID NO: 158813 - DNA, 103 bp, Artificial Sequence
  Synthetic Polynucleotide
taatacgactcactataggggatctgcttgtctgtgagtgggttgtgcgcaacagaggagagcgcacatgccactcacaaacctggcggcagcgcaaaagatg

SEQ ID NO: 158814 - DNA, 103 bp, Artificial Sequence
  Synthetic Polynucleotide
taatacgactcactatagggggaactggtcgatctgcttgtctgtgagtgaacagaggagacactcaatgacaagcagaaacctggcggcagcgcaaaagatg

SEQ ID NO: 158815 - DNA, 103 bp, Artificial Sequence
  Synthetic Polynucleotide
taatacgactcactataggggccaccaccaggaactggtcgatctgcttgaacagaggagacaagcaatgcgaccagttaacctggcggcagcgcaaaagatg

SEQ ID NO: 158816 - DNA, 103 bp, Artificial Sequence
  Synthetic Polynucleotide
taatacgactcactatagggcacagagcgggccaccaccaggaactggtcaacagaggagagaccagatgctggtggtgaacctggcggcagcgcaaaagatg

SEQ ID NO: 158817 - DNA, 103 bp, Artificial Sequence
  Synthetic Polynucleotide
taatacgactcactatagggcgaaggtgcccacagagcgggccaccaccaaacagaggagatggtggatgcccgctctgaacctggcggcagcgcaaaagatg

SEQ ID NO: 158818 - DNA, 103 bp, Artificial Sequence
  Synthetic Polynucleotide
taatacgactcactatagggagggcccgtgcgaaggtgcccacagagcggaacagaggagaccgctcatggggcaccttaacctggcggcagcgcaaaagatg

SEQ ID NO: 158819 - DNA, 103 bp, Artificial Sequence
  Synthetic Polynucleotide
taatacgactcactataggggctgcagtccagggcccgtgcgaaggtgccaacagaggagaggcaccatggcacgggccaacctggcggcagcgcaaaagatg

SEQ ID NO: 158820 - DNA, 103 bp, Artificial Sequence
  Synthetic Polynucleotide
taatacgactcactatagggggacggagctgctgcagtccagggcccgtgaacagaggagacacgggatgtggactgcaaacctggcggcagcgcaaaagatg

SEQ ID NO: 158821 - DNA, 103 bp, Artificial Sequence
  Synthetic Polynucleotide
taatacgactcactatagggctgggctgtcggacggagctgctgcagtccaacagaggagaggactgatgcagctccgtaacctggcggcagcgcaaaagatg

SEQ ID NO: 158822 - DNA, 103 bp, Artificial Sequence
  Synthetic Polynucleotide
taatacgactcactataggggagctcctcgattctccggatcaggtatggaacagaggagaccatacatgatccggagaaacctggcggcagcgcaaaagatg

SEQ ID NO: 158823 - DNA, 103 bp, Artificial Sequence
  Synthetic Polynucleotide
taatacgactcactatagggcatgtgcaggctgggctgtcggacggagctaacagaggagaagctccatgcgacagcccaacctggcggcagcgcaaaagatg

SEQ ID NO: 158824 - DNA, 103 bp, Artificial Sequence
  Synthetic Polynucleotide
taatacgactcactatagggctgcggcgctcatgtgcaggctgggctgtcaacagaggagagacagcatggcctgcacaaacctggcggcagcgcaaaagatg

SEQ ID NO: 158825 - DNA, 103 bp, Artificial Sequence
  Synthetic Polynucleotide
taatacgactcactatagggcgggaggcagctgcggcgctcatgtgcaggaacagaggagacctgcaatggagcgccgcaacctggcggcagcgcaaaagatg

SEQ ID NO: 158826 - DNA, 103 bp, Artificial Sequence
  Synthetic Polynucleotide
taatacgactcactatagggggtgatgtctcgggaggcagctgcggcgctaacagaggagaagcgccatggctgcctccaacctggcggcagcgcaaaagatg

SEQ ID NO: 158827 - DNA, 103 bp, Artificial Sequence
  Synthetic Polynucleotide
taatacgactcactatagggcgtggaacagggtgatgtctcgggaggcagaacagaggagactgcctatggagacatcaaacctggcggcagcgcaaaagatg

SEQ ID NO: 158828 - DNA, 103 bp, Artificial Sequence
  Synthetic Polynucleotide
taatacgactcactataggggtatccatggcgtggaacagggtgatgtctaacagaggagaagacatatgcctgttccaaacctggcggcagcgcaaaagatg

SEQ ID NO: 158829 - DNA, 103 bp, Artificial Sequence
  Synthetic Polynucleotide
taatacgactcactatagggcttgtggagagtatccatggcgtggaacagaacagaggagactgttcatggccatggataacctggcggcagcgcaaaagatg

SEQ ID NO: 158830 - DNA, 103 bp, Artificial Sequence
  Synthetic Polynucleotide
taatacgactcactatagggcgtagatgttcttgtggagagtatccatggaacagaggagaccatggatgctctccacaaacctggcggcagcgcaaaagatg

SEQ ID NO: 158831 - DNA, 103 bp, Artificial Sequence
  Synthetic Polynucleotide
taatacgactcactatagggttggagatgtcgtagatgttcttgtggagaaacagaggagatctccaatggaacatctaaacctggcggcagcgcaaaagatg

SEQ ID NO: 158832 - DNA, 103 bp, Artificial Sequence
  Synthetic Polynucleotide
taatacgactcactatagggcgagatggccttggagatgtcgtagatgttaacagaggagaaacatcatggacatctccaacctggcggcagcgcaaaagatg

SEQ ID NO: 158833 - DNA, 103 bp, Artificial Sequence
  Synthetic Polynucleotide
taatacgactcactatagggccgtcttgttgagctcctcgattctccggaaacagaggagatccggaatgtcgaggagcaacctggcggcagcgcaaaagatg

SEQ ID NO: 158834 - DNA, 103 bp, Artificial Sequence
  Synthetic Polynucleotide
taatacgactcactataggggcaccagcgccgagatggccttggagatgtaacagaggagaacatctatgaggccatctaacctggcggcagcgcaaaagatg

SEQ ID NO: 158835 - DNA, 103 bp, Artificial Sequence
  Synthetic Polynucleotide
taatacgactcactatagggccgccctgcggcaccagcgccgagatggccaacagaggagaggccatatgggcgctggtaacctggcggcagcgcaaaagatg

SEQ ID NO: 158836 - DNA, 103 bp, Artificial Sequence
  Synthetic Polynucleotide
taatacgactcactataggggagcacgggcccgccctgcggcaccagcgcaacagaggagagcgctgatgccgcagggcaacctggcggcagcgcaaaagatg

SEQ ID NO: 158837 - DNA, 103 bp, Artificial Sequence
  Synthetic Polynucleotide
taatacgactcactatagggcgtccctgcagagcacgggcccgccctgcgaacagaggagacgcaggatgggcccgtgcaacctggcggcagcgcaaaagatg

SEQ ID NO: 158838 - DNA, 103 bp, Artificial Sequence
  Synthetic Polynucleotide
taatacgactcactatagggtcctccatctcgtccctgcagagcacgggcaacagaggagagcccgtatgctgcagggaaacctggcggcagcgcaaaagatg

SEQ ID NO: 158839 - DNA, 103 bp, Artificial Sequence
  Synthetic Polynucleotide
taatacgactcactatagggtgcagaccactcctccatctcgtccctgcaaacagaggagatgcaggatggagatggagaacctggcggcagcgcaaaagatg

SEQ ID NO: 158840 - DNA, 103 bp, Artificial Sequence
  Synthetic Polynucleotide
taatacgactcactatagggtggcctctgatgcagaccactcctccatctaacagaggagaagatggatgagtggtctgaacctggcggcagcgcaaaagatg

SEQ ID NO: 158841 - DNA, 103 bp, Artificial Sequence
  Synthetic Polynucleotide
taatacgactcactatagggtcgaaaaggttggcctctgatgcagaccacaacagaggagagtggtcatgatcagaggcaacctggcggcagcgcaaaagatg

SEQ ID NO: 158842 - DNA, 103 bp, Artificial Sequence
  Synthetic Polynucleotide
taatacgactcactatagggcagggcttcctcgaaaaggttggcctctgaaacagaggagatcagagatgaaccttttcaacctggcggcagcgcaaaagatg

SEQ ID NO: 158843 - DNA, 103 bp, Artificial Sequence
  Synthetic Polynucleotide
taatacgactcactatagggcatatttttccagggcttcctcgaaaaggtaacagaggagaacctttatgaggaagcccaacctggcggcagcgcaaaagatg

SEQ ID NO: 158844 - DNA, 103 bp, Artificial Sequence
  Synthetic Polynucleotide
taatacgactcactatagggttcccattggccgtcttgttgagctcctcgaacagaggagacgaggaatgcaacaagacaacctggcggcagcgcaaaagatg

SEQ ID NO: 158845 - DNA, 103 bp, Artificial Sequence
  Synthetic Polynucleotide
taatacgactcactatagggaaatccttcccatatttttccagggcttccaacagaggagaggaagcatgggaaaaataaacctggcggcagcgcaaaagatg

SEQ ID NO: 158846 - DNA, 103 bp, Artificial Sequence
  Synthetic Polynucleotide
taatacgactcactatagggaatgtccgtgaaatccttcccatatttttcaacagaggagagaaaaaatggggaaggataacctggcggcagcgcaaaagatg

SEQ ID NO: 158847 - DNA, 103 bp, Artificial Sequence
  Synthetic Polynucleotide
taatacgactcactatagggaatcttgctgaatgtccgtgaaatccttccaacagaggagaggaaggatgtcacggacaaacctggcggcagcgcaaaagatg

SEQ ID NO: 158848 - DNA, 103 bp, Artificial Sequence
  Synthetic Polynucleotide
taatacgactcactatagggcacgggagaaaatcttgctgaatgtccgtgaacagaggagacacggaatgtcagcaagaaacctggcggcagcgcaaaagatg

SEQ ID NO: 158849 - DNA, 103 bp, Artificial Sequence
  Synthetic Polynucleotide
taatacgactcactatagggcagcgacttccacgggagaaaatcttgctgaacagaggagacagcaaatgtttctcccgaacctggcggcagcgcaaaagatg

SEQ ID NO: 158850 - DNA, 103 bp, Artificial Sequence
  Synthetic Polynucleotide
taatacgactcactatagggtgatgctggtcagcgacttccacgggagaaaacagaggagattctccatgggaagtcgcaacctggcggcagcgcaaaagatg

SEQ ID NO: 158851 - DNA, 103 bp, Artificial Sequence
  Synthetic Polynucleotide
taatacgactcactatagggtagtactcaatgatgctggtcagcgacttcaacagaggagagaagtcatggaccagcataacctggcggcagcgcaaaagatg

SEQ ID NO: 158852 - DNA, 103 bp, Artificial Sequence
  Synthetic Polynucleotide
taatacgactcactatagggccacatgtagtagtactcaatgatgctggtaacagaggagaaccagcatgattgagtacaacctggcggcagcgcaaaagatg

SEQ ID NO: 158853 - DNA, 103 bp, Artificial Sequence
  Synthetic Polynucleotide
taatacgactcactatagggcggtggtcttccacatgtagtagtactcaaaacagaggagattgagtatgactacatgtaacctggcggcagcgcaaaagatg

SEQ ID NO: 158854 - DNA, 103 bp, Artificial Sequence
  Synthetic Polynucleotide
taatacgactcactatagggacgtatctgtcggtggtcttccacatgtagaacagaggagactacatatggaagaccacaacctggcggcagcgcaaaagatg

SEQ ID NO: 158855 - DNA, 103 bp, Artificial Sequence
  Synthetic Polynucleotide
taatacgactcactatagggatctcccacccggtacatgttggccgccataacagaggagaatggcgatgaacatgtacaacctggcggcagcgcaaaagatg

SEQ ID NO: 158856 - DNA, 103 bp, Artificial Sequence
  Synthetic Polynucleotide
taatacgactcactatagggtgcctccacatttccatttgcagtcttgttaacagaggagaaacaagatggcaaatggaaacctggcggcagcgcaaaagatg

SEQ ID NO: 158857 - DNA, 103 bp, Artificial Sequence
  Synthetic Polynucleotide
taatacgactcactatagggagtgtaggtgggaatgtagacctgtttcagaacagaggagactgaaaatggtctacattaacctggcggcagcgcaaaagatg

SEQ ID NO: 158858 - DNA, 103 bp, Artificial Sequence
  Synthetic Polynucleotide
taatacgactcactatagggggtttggcttagtgtaggtgggaatgtagaaacagaggagatctacaatgccacctacaaacctggcggcagcgcaaaagatg

SEQ ID NO: 158859 - DNA, 103 bp, Artificial Sequence
  Synthetic Polynucleotide
taatacgactcactatagggatctggttagggtttggcttagtgtaggtgaacagaggagacacctaatgtaagccaaaaacctggcggcagcgcaaaagatg

SEQ ID NO: 158860 - DNA, 103 bp, Artificial Sequence
  Synthetic Polynucleotide
taatacgactcactatagggcacagaaatgatctggttagggtttggcttaacagaggagaaagccaatgcctaaccagaacctggcggcagcgcaaaagatg

SEQ ID NO: 158861 - DNA, 103 bp, Artificial Sequence
  Synthetic Polynucleotide
taatacgactcactataggggttttgaacccacagaaatgatctggttagaacagaggagactaaccatgtcatttctgaacctggcggcagcgcaaaagatg

SEQ ID NO: 158862 - DNA, 103 bp, Artificial Sequence
  Synthetic Polynucleotide
taatacgactcactatagggttcatgccaggttttgaacccacagaaatgaacagaggagacatttcatggggttcaaaaacctggcggcagcgcaaaagatg

SEQ ID NO: 158863 - DNA, 103 bp, Artificial Sequence
  Synthetic Polynucleotide
taatacgactcactatagggtccagccccattcatgccaggttttgaaccaacagaggagaggttcaatgcctggcatgaacctggcggcagcgcaaaagatg

SEQ ID NO: 158864 - DNA, 103 bp, Artificial Sequence
  Synthetic Polynucleotide
taatacgactcactatagggccttctgaaatccagccccattcatgccagaacagaggagactggcaatgatggggctgaacctggcggcagcgcaaaagatg

SEQ ID NO: 158865 - DNA, 103 bp, Artificial Sequence
  Synthetic Polynucleotide
taatacgactcactatagggcaagtcaggcccttctgaaatccagccccaaacagaggagatggggcatgatttcagaaaacctggcggcagcgcaaaagatg

SEQ ID NO: 158866 - DNA, 103 bp, Artificial Sequence
  Synthetic Polynucleotide
taatacgactcactataggggcaactctcacaagtcaggcccttctgaaaaacagaggagatttcagatgggcctgactaacctggcggcagcgcaaaagatg

SEQ ID NO: 158867 - DNA, 103 bp, Artificial Sequence
  Synthetic Polynucleotide
taatacgactcactatagggagacaacctttgcctccacatttccatttgaacagaggagacaaatgatgatgtggaggaacctggcggcagcgcaaaagatg

SEQ ID NO: 158868 - DNA, 103 bp, Artificial Sequence
  Synthetic Polynucleotide
taatacgactcactataggggtgtggtgtggcaactctcacaagtcaggcaacagaggagagcctgaatggtgagagttaacctggcggcagcgcaaaagatg

SEQ ID NO: 158869 - DNA, 103 bp, Artificial Sequence
  Synthetic Polynucleotide
taatacgactcactatagggtgagcagactgtgtggtgtggcaactctcaaacagaggagatgagagatgccacaccacaacctggcggcagcgcaaaagatg

SEQ ID NO: 158870 - DNA, 103 bp, Artificial Sequence
  Synthetic Polynucleotide
taatacgactcactatagggggcataccactgagcagactgtgtggtgtgaacagaggagacacaccatgcagtctgctaacctggcggcagcgcaaaagatg

SEQ ID NO: 158871 - DNA, 103 bp, Artificial Sequence
  Synthetic Polynucleotide
taatacgactcactataggggtgggccccaggcataccactgagcagactaacagaggagaagtctgatgagtggtatgaacctggcggcagcgcaaaagatg

SEQ ID NO: 158872 - DNA, 103 bp, Artificial Sequence
  Synthetic Polynucleotide
taatacgactcactatagggtgcatgttaggtgggccccaggcataccacaacagaggagagtggtaatgctggggcccaacctggcggcagcgcaaaagatg

SEQ ID NO: 158873 - DNA, 103 bp, Artificial Sequence
  Synthetic Polynucleotide
taatacgactcactataggggaggcggcactgcatgttaggtgggccccaaacagaggagatggggcatgcctaacatgaacctggcggcagcgcaaaagatg

SEQ ID NO: 158874 - DNA, 103 bp, Artificial Sequence
  Synthetic Polynucleotide
taatacgactcactatagggaggaagcacagaggcggcactgcatgttagaacagaggagactaacaatgagtgccgccaacctggcggcagcgcaaaagatg

SEQ ID NO: 158875 - DNA, 103 bp, Artificial Sequence
  Synthetic Polynucleotide
taatacgactcactatagggtagatccaacaggaagcacagaggcggcacaacagaggagagtgccgatgctgtgcttcaacctggcggcagcgcaaaagatg

SEQ ID NO: 158876 - DNA, 103 bp, Artificial Sequence
  Synthetic Polynucleotide
taatacgactcactatagggcttcttccagtagatccaacaggaagcacaaacagaggagatgtgctatgtgttggatcaacctggcggcagcgcaaaagatg

SEQ ID NO: 158877 - DNA, 103 bp, Artificial Sequence
  Synthetic Polynucleotide
taatacgactcactataggggtcccccatacttcttccagtagatccaacaacagaggagagttggaatgactggaagaaacctggcggcagcgcaaaagatg

SEQ ID NO: 158878 - DNA, 103 bp, Artificial Sequence
  Synthetic Polynucleotide
taatacgactcactatagggcggaaaagacagacaacctttgcctccacaaacagaggagatgtggaatgaaaggttgtaacctggcggcagcgcaaaagatg

SEQ ID NO: 158879 - DNA, 103 bp, Artificial Sequence
  Synthetic Polynucleotide
taatacgactcactatagggggggtcttcagtcccccatacttcttccagaacagaggagactggaaatggtatgggggaacctggcggcagcgcaaaagatg

SEQ ID NO: 158880 - DNA, 103 bp, Artificial Sequence
  Synthetic Polynucleotide
taatacgactcactatagggaagctgagttggggtcttcagtcccccataaacagaggagatatgggatgctgaagaccaacctggcggcagcgcaaaagatg

SEQ ID NO: 158881 - DNA, 103 bp, Artificial Sequence
  Synthetic Polynucleotide
taatacgactcactatagggtggccccctcaagctgagttggggtcttcaaacagaggagatgaagaatgcaactcagcaacctggcggcagcgcaaaagatg

SEQ ID NO: 158882 - DNA, 103 bp, Artificial Sequence
  Synthetic Polynucleotide
taatacgactcactataggggtgccccgagtggccccctcaagctgagttaacagaggagaaactcaatgtgagggggcaacctggcggcagcgcaaaagatg

SEQ ID NO: 158883 - DNA, 103 bp, Artificial Sequence
  Synthetic Polynucleotide
taatacgactcactatagggtggctccgtggtgccccgagtggccccctcaacagaggagagaggggatgactcggggcaacctggcggcagcgcaaaagatg

SEQ ID NO: 158884 - DNA, 103 bp, Artificial Sequence
  Synthetic Polynucleotide
taatacgactcactatagggcccttgagtgtggctccgtggtgccccgagaacagaggagactcgggatgccacggagcaacctggcggcagcgcaaaagatg

SEQ ID NO: 158885 - DNA, 103 bp, Artificial Sequence
  Synthetic Polynucleotide
taatacgactcactataggggataaatgaccccttgagtgtggctccgtgaacagaggagacacggaatgacactcaagaacctggcggcagcgcaaaagatg

SEQ ID NO: 158886 - DNA, 103 bp, Artificial Sequence
  Synthetic Polynucleotide
taatacgactcactatagggttcaggtctggataaatgaccccttgagtgaacagaggagacactcaatgggtcatttaaacctggcggcagcgcaaaagatg

SEQ ID NO: 158887 - DNA, 103 bp, Artificial Sequence
  Synthetic Polynucleotide
taatacgactcactataggggactttgagcttcaggtctggataaatgacaacagaggagagtcattatgccagacctgaacctggcggcagcgcaaaagatg

SEQ ID NO: 158888 - DNA, 103 bp, Artificial Sequence
  Synthetic Polynucleotide
taatacgactcactatagggtaaggagagagactttgagcttcaggtctgaacagaggagacagaccatgagctcaaagaacctggcggcagcgcaaaagatg

SEQ ID NO: 158889 - DNA, 103 bp, Artificial Sequence
  Synthetic Polynucleotide
taatacgactcactataggggtccctgcgccggaaaagacagacaaccttaacagaggagaaaggttatgtgtcttttcaacctggcggcagcgcaaaagatg

SEQ ID NO: 158890 - DNA, 103 bp, Artificial Sequence
  Synthetic Polynucleotide
taatacgactcactataggggctggttgtgtaaggagagagactttgagcaacagaggagagctcaaatgctctctcctaacctggcggcagcgcaaaagatg

SEQ ID NO: 158891 - DNA, 103 bp, Artificial Sequence
  Synthetic Polynucleotide
taatacgactcactatagggccctgttggcgctggttgtgtaaggagagaaacagaggagatctctcatgacacaaccaaacctggcggcagcgcaaaagatg

SEQ ID NO: 158892 - DNA, 103 bp, Artificial Sequence
  Synthetic Polynucleotide
taatacgactcactatagggagtagcttggccctgttggcgctggttgtgaacagaggagacacaacatgcgccaacagaacctggcggcagcgcaaaagatg

SEQ ID NO: 158893 - DNA, 103 bp, Artificial Sequence
  Synthetic Polynucleotide
taatacgactcactataggggttcttagccagtagcttggccctgttggcaacagaggagagccaacatggccaagctaaacctggcggcagcgcaaaagatg

SEQ ID NO: 158894 - DNA, 103 bp, Artificial Sequence
  Synthetic Polynucleotide
taatacgactcactatagggaagtttgtctgttcttagccagtagcttggaacagaggagaccaagcatgtggctaagaaacctggcggcagcgcaaaagatg

SEQ ID NO: 158895 - DNA, 103 bp, Artificial Sequence
  Synthetic Polynucleotide
taatacgactcactatagggtgaagcaggaaagtttgtctgttcttagccaacagaggagaggctaaatgcagacaaacaacctggcggcagcgcaaaagatg

SEQ ID NO: 158896 - DNA, 103 bp, Artificial Sequence
  Synthetic Polynucleotide
taatacgactcactatagggctttgtggtctgaagcaggaaagtttgtctaacagaggagaagacaaatgttcctgcttaacctggcggcagcgcaaaagatg

SEQ ID NO: 158897 - DNA, 103 bp, Artificial Sequence
  Synthetic Polynucleotide
taatacgactcactataggggacgggtcagctttgtggtctgaagcaggaaacagaggagatcctgcatgagaccacaaaacctggcggcagcgcaaaagatg

SEQ ID NO: 158898 - DNA, 103 bp, Artificial Sequence
  Synthetic Polynucleotide
taatacgactcactatagggcgtctggcaagacgggtcagctttgtggtcaacagaggagagaccacatggctgacccgaacctggcggcagcgcaaaagatg

SEQ ID NO: 158899 - DNA, 103 bp, Artificial Sequence
  Synthetic Polynucleotide
taatacgactcactatagggcctgcacatgcgtctggcaagacgggtcagaacagaggagactgaccatgcttgccagaaacctggcggcagcgcaaaagatg

SEQ ID NO: 158900 - DNA, 103 bp, Artificial Sequence
  Synthetic Polynucleotide
taatacgactcactatagggtactagaaatgtccctgcgccggaaaagacaacagaggagagtctttatgggcgcagggaacctggcggcagcgcaaaagatg

SEQ ID NO: 158901 - DNA, 103 bp, Artificial Sequence
  Synthetic Polynucleotide
taatacgactcactataggggtaataggtccctgcacatgcgtctggcaaaacagaggagattgccaatggcatgtgcaaacctggcggcagcgcaaaagatg

SEQ ID NO: 158902 - DNA, 103 bp, Artificial Sequence
  Synthetic Polynucleotide
taatacgactcactatagggctccttggctgtaataggtccctgcacatgaacagaggagacatgtgatgggacctattaacctggcggcagcgcaaaagatg

SEQ ID NO: 158903 - DNA, 103 bp, Artificial Sequence
  Synthetic Polynucleotide
taatacgactcactatagggtcgggcggccctccttggctgtaataggtcaacagaggagagacctaatgcagccaaggaacctggcggcagcgcaaaagatg

SEQ ID NO: 158904 - DNA, 103 bp, Artificial Sequence
  Synthetic Polynucleotide
taatacgactcactatagggcataaggccgtcgggcggccctccttggctaacagaggagaagccaaatggggccgcccaacctggcggcagcgcaaaagatg

SEQ ID NO: 158905 - DNA, 103 bp, Artificial Sequence
  Synthetic Polynucleotide
taatacgactcactatagggttgataggagcataaggccgtcgggcggccaacagaggagaggccgcatgacggccttaaacctggcggcagcgcaaaagatg

SEQ ID NO: 158906 - DNA, 103 bp, Artificial Sequence
  Synthetic Polynucleotide
taatacgactcactatagggggcattggcattgataggagcataaggccgaacagaggagacggcctatggctcctatcaacctggcggcagcgcaaaagatg

SEQ ID NO: 158907 - DNA, 103 bp, Artificial Sequence
  Synthetic Polynucleotide
taatacgactcactatagggctgctttgatggcattggcattgataggagaacagaggagactcctaatgatgccaatgaacctggcggcagcgcaaaagatg

SEQ ID NO: 158908 - DNA, 103 bp, Artificial Sequence
  Synthetic Polynucleotide
taatacgactcactatagggatggagcactctgctttgatggcattggcaaacagaggagatgccaaatgcatcaaagcaacctggcggcagcgcaaaagatg

SEQ ID NO: 158909 - DNA, 103 bp, Artificial Sequence
  Synthetic Polynucleotide
taatacgactcactatagggaggaagtcgaatggagcactctgctttgataacagaggagaatcaaaatggagtgctccaacctggcggcagcgcaaaagatg

SEQ ID NO: 158910 - DNA, 103 bp, Artificial Sequence
  Synthetic Polynucleotide
taatacgactcactatagggtggcggccttaggaagtcgaatggagcactaacagaggagaagtgctatgttcgacttcaacctggcggcagcgcaaaagatg

SEQ ID NO: 158911 - DNA, 103 bp, Artificial Sequence
  Synthetic Polynucleotide
taatacgactcactatagggctgttgaggctactagaaatgtccctgcgcaacagaggagagcgcagatgcatttctagaacctggcggcagcgcaaaagatg

SEQ ID NO: 158912 - DNA, 103 bp, Artificial Sequence
  Synthetic Polynucleotide
taatacgactcactatagggaatggagtcttggcggccttaggaagtcgaaacagaggagatcgactatgtaaggccgcaacctggcggcagcgcaaaagatg

SEQ ID NO: 158913 - DNA, 103 bp, Artificial Sequence
  Synthetic Polynucleotide
taatacgactcactataggggtgaatcttcaatggagtcttggcggccttaacagaggagaaaggccatgaagactccaaacctggcggcagcgcaaaagatg

SEQ ID NO: 158914 - DNA, 103 bp, Artificial Sequence
  Synthetic Polynucleotide
taatacgactcactataggggcaccagagggtgaatcttcaatggagtctaacagaggagaagactcatgtgaagattcaacctggcggcagcgcaaaagatg

SEQ ID NO: 158915 - DNA, 103 bp, Artificial Sequence
  Synthetic Polynucleotide
taatacgactcactatagggaggggcagccgcaccagagggtgaatcttcaacagaggagagaagatatgccctctggtaacctggcggcagcgcaaaagatg

SEQ ID NO: 158916 - DNA, 103 bp, Artificial Sequence
  Synthetic Polynucleotide
taatacgactcactataggggatagttgccaggggcagccgcaccagaggaacagaggagacctctgatgcggctgcccaacctggcggcagcgcaaaagatg

SEQ ID NO: 158917 - DNA, 103 bp, Artificial Sequence
  Synthetic Polynucleotide
taatacgactcactataggggatctttgacgatagttgccaggggcagccaacagaggagaggctgcatgtggcaactaaacctggcggcagcgcaaaagatg

SEQ ID NO: 158918 - DNA, 103 bp, Artificial Sequence
  Synthetic Polynucleotide
taatacgactcactatagggtgggccaccagatctttgacgatagttgccaacagaggagaggcaacatgcgtcaaagaaacctggcggcagcgcaaaagatg

SEQ ID NO: 158919 - DNA, 103 bp, Artificial Sequence
  Synthetic Polynucleotide
taatacgactcactatagggcaggggtgcctgggccaccagatctttgacaacagaggagagtcaaaatgctggtggccaacctggcggcagcgcaaaagatg

SEQ ID NO: 158920 - DNA, 103 bp, Artificial Sequence
  Synthetic Polynucleotide
taatacgactcactatagggtttttggtttcaggggtgcctgggccaccaaacagaggagatggtggatgaggcaccccaacctggcggcagcgcaaaagatg

SEQ ID NO: 158921 - DNA, 103 bp, Artificial Sequence
  Synthetic Polynucleotide
taatacgactcactatagggccccgaggtgtttttggtttcaggggtgccaacagaggagaggcaccatggaaaccaaaaacctggcggcagcgcaaaagatg

SEQ ID NO: 158922 - DNA, 103 bp, Artificial Sequence
  Synthetic Polynucleotide
taatacgactcactatagggatcagccaggctgttgaggctactagaaataacagaggagaatttctatgagcctcaacaacctggcggcagcgcaaaagatg

SEQ ID NO: 158923 - DNA, 103 bp, Artificial Sequence
  Synthetic Polynucleotide
taatacgactcactatagggtgtcttggtaccccgaggtgtttttggtttaacagaggagaaaaccaatgacacctcggaacctggcggcagcgcaaaagatg

SEQ ID NO: 158924 - DNA, 103 bp, Artificial Sequence
  Synthetic Polynucleotide
taatacgactcactatagggtgttgatcggtgtcttggtaccccgaggtgaacagaggagacacctcatggtaccaagaaacctggcggcagcgcaaaagatg

SEQ ID NO: 158925 - DNA, 103 bp, Artificial Sequence
  Synthetic Polynucleotide
taatacgactcactatagggagctggtttctgttgatcggtgtcttggtaaacagaggagataccaaatgaccgatcaaaacctggcggcagcgcaaaagatg

SEQ ID NO: 158926 - DNA, 103 bp, Artificial Sequence
  Synthetic Polynucleotide
taatacgactcactataggggttctgggacagctggtttctgttgatcggaacagaggagaccgatcatgagaaaccagaacctggcggcagcgcaaaagatg

SEQ ID NO: 158927 - DNA, 103 bp, Artificial Sequence
  Synthetic Polynucleotide
taatacgactcactatagggccagtccccggttctgggacagctggtttcaacagaggagagaaaccatgtgtcccagaaacctggcggcagcgcaaaagatg

SEQ ID NO: 158928 - DNA, 103 bp, Artificial Sequence
  Synthetic Polynucleotide
taatacgactcactatagggataatgccccccagtccccggttctgggacaacagaggagagtcccaatgccggggactaacctggcggcagcgcaaaagatg

SEQ ID NO: 158929 - DNA, 103 bp, Artificial Sequence
  Synthetic Polynucleotide
taatacgactcactatagggccgtttcaccataatgccccccagtccccgaacagaggagacggggaatggggggcattaacctggcggcagcgcaaaagatg

SEQ ID NO: 158930 - DNA, 103 bp, Artificial Sequence
  Synthetic Polynucleotide
taatacgactcactatagggtctcataggcccgtttcaccataatgccccaacagaggagaggggcaatgtggtgaaacaacctggcggcagcgcaaaagatg

SEQ ID NO: 158931 - DNA, 103 bp, Artificial Sequence
  Synthetic Polynucleotide
taatacgactcactatagggcctgccatagtctcataggcccgtttcaccaacagaggagaggtgaaatgggcctatgaaacctggcggcagcgcaaaagatg

SEQ ID NO: 158932 - DNA, 103 bp, Artificial Sequence
  Synthetic Polynucleotide
taatacgactcactatagggaacccctgcccctgccatagtctcataggcaacagaggagagcctatatgactatggcaaacctggcggcagcgcaaaagatg

SEQ ID NO: 158933 - DNA, 103 bp, Artificial Sequence
  Synthetic Polynucleotide
taatacgactcactatagggtggcattactatcagccaggctgttgaggcaacagaggagagcctcaatggcctggctgaacctggcggcagcgcaaaagatg

SEQ ID NO: 158934 - DNA, 103 bp, Artificial Sequence
  Synthetic Polynucleotide
taatacgactcactatagggcagagaaaggaacccctgcccctgccatagaacagaggagactatggatggggcaggggaacctggcggcagcgcaaaagatg

SEQ ID NO: 158935 - DNA, 103 bp, Artificial Sequence
  Synthetic Polynucleotide
taatacgactcactatagggcttccattggcagagaaaggaacccctgccaacagaggagaggcaggatgtcctttctcaacctggcggcagcgcaaaagatg

SEQ ID NO: 158936 - DNA, 103 bp, Artificial Sequence
  Synthetic Polynucleotide
taatacgactcactatagggagccagaggccttccattggcagagaaaggaacagaggagacctttcatggccaatggaaacctggcggcagcgcaaaagatg

SEQ ID NO: 158937 - DNA, 103 bp, Artificial Sequence
  Synthetic Polynucleotide
taatacgactcactataggggaatccctgaagccagaggccttccattggaacagaggagaccaatgatgggcctctggaacctggcggcagcgcaaaagatg

SEQ ID NO: 158938 - DNA, 103 bp, Artificial Sequence
  Synthetic Polynucleotide
taatacgactcactataggggagcttgaacgaatccctgaagccagaggcaacagaggagagcctctatgttcagggataacctggcggcagcgcaaaagatg

SEQ ID NO: 158939 - DNA, 103 bp, Artificial Sequence
  Synthetic Polynucleotide
taatacgactcactatagggtgctggctgtgagcttgaacgaatccctgaaacagaggagatcagggatgcgttcaagcaacctggcggcagcgcaaaagatg

SEQ ID NO: 158940 - DNA, 103 bp, Artificial Sequence
  Synthetic Polynucleotide
taatacgactcactataggggacgcttggctgctggctgtgagcttgaacaacagaggagagttcaaatgcacagccagaacctggcggcagcgcaaaagatg

SEQ ID NO: 158941 - DNA, 103 bp, Artificial Sequence
  Synthetic Polynucleotide
taatacgactcactatagggtttagtttctgacgcttggctgctggctgtaacagaggagaacagccatgagccaagcgaacctggcggcagcgcaaaagatg

SEQ ID NO: 158942 - DNA, 103 bp, Artificial Sequence
  Synthetic Polynucleotide
taatacgactcactatagggatcagctgggtttagtttctgacgcttggcaacagaggagagccaagatgcagaaactaaacctggcggcagcgcaaaagatg

SEQ ID NO: 158943 - DNA, 103 bp, Artificial Sequence
  Synthetic Polynucleotide
taatacgactcactataggggattgggggcatcagctgggtttagtttctaacagaggagaagaaacatgacccagctgaacctggcggcagcgcaaaagatg

SEQ ID NO: 158944 - DNA, 103 bp, Artificial Sequence
  Synthetic Polynucleotide
taatacgactcactatagggtcaaactccctggcattactatcagccaggaacagaggagacctggcatgtagtaatgcaacctggcggcagcgcaaaagatg

SEQ ID NO: 158945 - DNA, 103 bp, Artificial Sequence
  Synthetic Polynucleotide
taatacgactcactatagggaacaccacaggattgggggcatcagctgggaacagaggagacccagcatgtgcccccaaaacctggcggcagcgcaaaagatg

SEQ ID NO: 158946 - DNA, 103 bp, Artificial Sequence
  Synthetic Polynucleotide
taatacgactcactatagggtgtggccacaaacaccacaggattgggggcaacagaggagagcccccatgcctgtggtgaacctggcggcagcgcaaaagatg

SEQ ID NO: 158947 - DNA, 103 bp, Artificial Sequence
  Synthetic Polynucleotide
taatacgactcactatagggtggtatcctttgtggccacaaacaccacagaacagaggagactgtggatgttgtggccaaacctggcggcagcgcaaaagatg

SEQ ID NO: 158948 - DNA, 103 bp, Artificial Sequence
  Synthetic Polynucleotide
taatacgactcactatagggcgtagggccctggtatcctttgtggccacaaacagaggagatgtggcatgaaaggatacaacctggcggcagcgcaaaagatg

SEQ ID NO: 158949 - DNA, 103 bp, Artificial Sequence
  Synthetic Polynucleotide
taatacgactcactatagggcagagccttccgtagggccctggtatccttaacagaggagaaaggatatgagggccctaaacctggcggcagcgcaaaagatg

SEQ ID NO: 158950 - DNA, 103 bp, Artificial Sequence
  Synthetic Polynucleotide
taatacgactcactatagggccagatgggtcagagccttccgtagggcccaacagaggagagggcccatgggaaggctcaacctggcggcagcgcaaaagatg

SEQ ID NO: 158951 - DNA, 103 bp, Artificial Sequence
  Synthetic Polynucleotide
taatacgactcactatagggcgccgcatttccagatgggtcagagccttcaacagaggagagaaggcatggacccatctaacctggcggcagcgcaaaagatg

SEQ ID NO: 158952 - DNA, 103 bp, Artificial Sequence
  Synthetic Polynucleotide
taatacgactcactataggggcgagcagctcgccgcatttccagatgggtaacagaggagaacccatatggaaatgcggaacctggcggcagcgcaaaagatg

SEQ ID NO: 158953 - DNA, 103 bp, Artificial Sequence
  Synthetic Polynucleotide
taatacgactcactatagggagttgggtcggcgagcagctcgccgcatttaacagaggagaaaatgcatggagctgctcaacctggcggcagcgcaaaagatg

SEQ ID NO: 158954 - DNA, 103 bp, Artificial Sequence
  Synthetic Polynucleotide
taatacgactcactatagggttcaggggcaagttgggtcggcgagcagctaacagaggagaagctgcatgccgacccaaaacctggcggcagcgcaaaagatg

SEQ ID NO: 158955 - DNA, 103 bp, Artificial Sequence
  Synthetic Polynucleotide
taatacgactcactatagggtgattcctcttcaaactccctggcattactaacagaggagaagtaatatgagggagtttaacctggcggcagcgcaaaagatg

SEQ ID NO: 158956 - DNA, 103 bp, Artificial Sequence
  Synthetic Polynucleotide
taatacgactcactatagggtggcttcaccttcaggggcaagttgggtcgaacagaggagacgacccatgttgcccctgaacctggcggcagcgcaaaagatg

SEQ ID NO: 158957 - DNA, 103 bp, Artificial Sequence
  Synthetic Polynucleotide
taatacgactcactatagggcaatcagcgttggcttcaccttcaggggcaaacagaggagatgccccatgaggtgaagcaacctggcggcagcgcaaaagatg

SEQ ID NO: 158958 - DNA, 103 bp, Artificial Sequence
  Synthetic Polynucleotide
taatacgactcactatagggggccgcactgcaatcagcgttggcttcaccaacagaggagaggtgaaatgaacgctgataacctggcggcagcgcaaaagatg

SEQ ID NO: 158959 - DNA, 103 bp, Artificial Sequence
  Synthetic Polynucleotide
taatacgactcactatagggagggacagggggccgcactgcaatcagcgtaacagaggagaacgctgatggcagtgcggaacctggcggcagcgcaaaagatg

SEQ ID NO: 158960 - DNA, 103 bp, Artificial Sequence
  Synthetic Polynucleotide
taatacgactcactataggggtgcaggtagagggacagggggccgcactgaacagaggagacagtgcatgcccctgtccaacctggcggcagcgcaaaagatg

SEQ ID NO: 158961 - DNA, 103 bp, Artificial Sequence
  Synthetic Polynucleotide
taatacgactcactatagggggatgtgagggtgcaggtagagggacagggaacagaggagaccctgtatgtctacctgcaacctggcggcagcgcaaaagatg

SEQ ID NO: 158962 - DNA, 103 bp, Artificial Sequence
  Synthetic Polynucleotide
taatacgactcactatagggggtgctggcaggatgtgagggtgcaggtagaacagaggagactacctatgccctcacataacctggcggcagcgcaaaagatg

SEQ ID NO: 158963 - DNA, 103 bp, Artificial Sequence
  Synthetic Polynucleotide
taatacgactcactatagggtaggctcattggtgctggcaggatgtgaggaacagaggagacctcacatgctgccagcaaacctggcggcagcgcaaaagatg

SEQ ID NO: 158964 - DNA, 103 bp, Artificial Sequence
  Synthetic Polynucleotide
taatacgactcactatagggtccaggacaataggctcattggtgctggcaaacagaggagatgccagatgcaatgagccaacctggcggcagcgcaaaagatg

SEQ ID NO: 158965 - DNA, 103 bp, Artificial Sequence
  Synthetic Polynucleotide
taatacgactcactatagggaatagacgtaatctcccacccggtacatgtaacagaggagaacatgtatggggtgggagaacctggcggcagcgcaaaagatg

SEQ ID NO: 158966 - DNA, 103 bp, Artificial Sequence
  Synthetic Polynucleotide
taatacgactcactatagggctggctgctttgattcctcttcaaactcccaacagaggagagggagtatgaagaggaataacctggcggcagcgcaaaagatg

SEQ ID NO: 158967 - DNA, 103 bp, Artificial Sequence
  Synthetic Polynucleotide
taatacgactcactatagggtcagacacccctggctgctttgattcctctaacagaggagaagaggaatgaaagcagccaacctggcggcagcgcaaaagatg

SEQ ID NO: 158968 - DNA, 103 bp, Artificial Sequence
  Synthetic Polynucleotide
taatacgactcactataggggcgctgctgctcagacacccctggctgcttaacagaggagaaagcagatgggggtgtctaacctggcggcagcgcaaaagatg

SEQ ID NO: 158969 - DNA, 103 bp, Artificial Sequence
  Synthetic Polynucleotide
taatacgactcactatagggtcagttgatggcgctgctgctcagacacccaacagaggagagggtgtatgagcagcagcaacctggcggcagcgcaaaagatg

SEQ ID NO: 158970 - DNA, 103 bp, Artificial Sequence
  Synthetic Polynucleotide
taatacgactcactatagggtcccggtgcttcagttgatggcgctgctgcaacagaggagagcagcaatgccatcaactaacctggcggcagcgcaaaagatg

SEQ ID NO: 158971 - DNA, 103 bp, Artificial Sequence
  Synthetic Polynucleotide
taatacgactcactatagggaagaaaaagttcccggtgcttcagttgatgaacagaggagacatcaaatgaagcaccggaacctggcggcagcgcaaaagatg

SEQ ID NO: 158972 - DNA, 103 bp, Artificial Sequence
  Synthetic Polynucleotide
taatacgactcactatagggattgccgagaaagaaaaagttcccggtgctaacagaggagaagcaccatgaactttttcaacctggcggcagcgcaaaagatg

SEQ ID NO: 158973 - DNA, 103 bp, Artificial Sequence
  Synthetic Polynucleotide
taatacgactcactatagggaatgattcaaattgccgagaaagaaaaagtaacagaggagaacttttatgttctcggcaaacctggcggcagcgcaaaagatg

SEQ ID NO: 158974 - DNA, 103 bp, Artificial Sequence
  Synthetic Polynucleotide
taatacgactcactatagggggtggctggtaatgattcaaattgccgagaaacagaggagatctcggatgtttgaatcaaacctggcggcagcgcaaaagatg

SEQ ID NO: 158975 - DNA, 103 bp, Artificial Sequence
  Synthetic Polynucleotide
taatacgactcactatagggcccgtatgtgggtggctggtaatgattcaaaacagaggagattgaatatgtaccagccaaacctggcggcagcgcaaaagatg

SEQ ID NO: 158976 - DNA, 103 bp, Artificial Sequence
  Synthetic Polynucleotide
taatacgactcactataggggagttctcaaaatagacgtaatctcccaccaacagaggagaggtgggatgttacgtctaaacctggcggcagcgcaaaagatg

SEQ ID NO: 158977 - DNA, 103 bp, Artificial Sequence
  Synthetic Polynucleotide
taatacgactcactatagggctgcatttcccccgtatgtgggtggctggtaacagaggagaaccagcatgccacatacgaacctggcggcagcgcaaaagatg

SEQ ID NO: 158978 - DNA, 103 bp, Artificial Sequence
  Synthetic Polynucleotide
taatacgactcactataggggagggtcacactgcatttcccccgtatgtgaacagaggagacacataatggggaaatgcaacctggcggcagcgcaaaagatg

SEQ ID NO: 158979 - DNA, 103 bp, Artificial Sequence
  Synthetic Polynucleotide
taatacgactcactatagggtctcattcaagagggtcacactgcatttccaacagaggagaggaaatatggtgtgacccaacctggcggcagcgcaaaagatg

SEQ ID NO: 158980 - DNA, 103 bp, Artificial Sequence
  Synthetic Polynucleotide
taatacgactcactatagggaagatatctgtctcattcaagagggtcacaaacagaggagatgtgacatgcttgaatgaaacctggcggcagcgcaaaagatg

SEQ ID NO: 158981 - DNA, 103 bp, Artificial Sequence
  Synthetic Polynucleotide
taatacgactcactataggggtactggctcaagatatctgtctcattcaaaacagaggagattgaatatgacagatatcaacctggcggcagcgcaaaagatg

SEQ ID NO: 158982 - DNA, 103 bp, Artificial Sequence
  Synthetic Polynucleotide
taatacgactcactatagggccttttccaggtactggctcaagatatctgaacagaggagacagataatgtgagccagtaacctggcggcagcgcaaaagatg

SEQ ID NO: 158983 - DNA, 103 bp, Artificial Sequence
  Synthetic Polynucleotide
taatacgactcactatagggaagcagtcctccttttccaggtactggctcaacagaggagagagccaatgcctggaaaaaacctggcggcagcgcaaaagatg

SEQ ID NO: 158984 - DNA, 103 bp, Artificial Sequence
  Synthetic Polynucleotide
taatacgactcactatagggtgagtaaaaaaagcagtcctccttttccagaacagaggagactggaaatggaggactgcaacctggcggcagcgcaaaagatg

SEQ ID NO: 158985 - DNA, 103 bp, Artificial Sequence
  Synthetic Polynucleotide
taatacgactcactatagggcaaacaccagtgagtaaaaaaagcagtcctaacagaggagaaggactatgttttttactaacctggcggcagcgcaaaagatg

SEQ ID NO: 158986 - DNA, 103 bp, Artificial Sequence
  Synthetic Polynucleotide
taatacgactcactatagggtgcacggggtcaaacaccagtgagtaaaaaaacagaggagatttttaatgactggtgttaacctggcggcagcgcaaaagatg

SEQ ID NO: 158987 - DNA, 103 bp, Artificial Sequence
  Synthetic Polynucleotide
taatacgactcactatagggattgctggaagagttctcaaaatagacgtaaacagaggagatacgtcatgtttgagaacaacctggcggcagcgcaaaagatg

SEQ ID NO: 158988 - DNA, 103 bp, Artificial Sequence
  Synthetic Polynucleotide
taatacgactcactatagggaagtgtcttctgcacggggtcaaacaccagaacagaggagactggtgatggaccccgtgaacctggcggcagcgcaaaagatg

SEQ ID NO: 158989 - DNA, 103 bp, Artificial Sequence
  Synthetic Polynucleotide
taatacgactcactataggggatcagcgagaagtgtcttctgcacggggtaacagaggagaaccccgatgagaagacacaacctggcggcagcgcaaaagatg

SEQ ID NO: 158990 - DNA, 103 bp, Artificial Sequence
  Synthetic Polynucleotide
taatacgactcactatagggatctcgccctgatcagcgagaagtgtcttcaacagaggagagaagacatgtctcgctgaaacctggcggcagcgcaaaagatg

SEQ ID NO: 158991 - DNA, 103 bp, Artificial Sequence
  Synthetic Polynucleotide
taatacgactcactatagggaccaactctaatctcgccctgatcagcgagaacagaggagactcgctatgcagggcgagaacctggcggcagcgcaaaagatg

SEQ ID NO: 158992 - DNA, 103 bp, Artificial Sequence
  Synthetic Polynucleotide
taatacgactcactatagggggtatttgcaaccaactctaatctcgccctaacagaggagaagggcgatgttagagttgaacctggcggcagcgcaaaagatg

SEQ ID NO: 158993 - DNA, 103 bp, Artificial Sequence
  Synthetic Polynucleotide
taatacgactcactatagggatctcagcttggtatttgcaaccaactctaaacagaggagatagagtatgttgcaaataaacctggcggcagcgcaaaagatg

SEQ ID NO: 158994 - DNA, 103 bp, Artificial Sequence
  Synthetic Polynucleotide
taatacgactcactataggggcgatctgggatctcagcttggtatttgcaaacagaggagatgcaaaatgcaagctgagaacctggcggcagcgcaaaagatg

SEQ ID NO: 158995 - DNA, 103 bp, Artificial Sequence
  Synthetic Polynucleotide
taatacgactcactatagggcctctactaggcgatctgggatctcagcttaacagaggagaaagctgatgtcccagatcaacctggcggcagcgcaaaagatg

SEQ ID NO: 158996 - DNA, 103 bp, Artificial Sequence
  Synthetic Polynucleotide
taatacgactcactatagggtcagattctccctctactaggcgatctgggaacagaggagacccagaatgcctagtagaaacctggcggcagcgcaaaagatg

SEQ ID NO: 158997 - DNA, 103 bp, Artificial Sequence
  Synthetic Polynucleotide
taatacgactcactataggggttccgattatcagattctccctctactagaacagaggagactagtaatgggagaatctaacctggcggcagcgcaaaagatg

SEQ ID NO: 158998 - DNA, 103 bp, Artificial Sequence
  Synthetic Polynucleotide
taatacgactcactatagggccaggtaaggattgctggaagagttctcaaaacagaggagattgagaatgcttccagcaaacctggcggcagcgcaaaagatg

SEQ ID NO: 158999 - DNA, 103 bp, Artificial Sequence
  Synthetic Polynucleotide
taatacgactcactatagggtcttctgctggttccgattatcagattctcaacagaggagagagaatatgataatcggaaacctggcggcagcgcaaaagatg

SEQ ID NO: 159000 - DNA, 103 bp, Artificial Sequence
  Synthetic Polynucleotide
taatacgactcactatagggttcatctccatcttctgctggttccgattaaacagaggagataatcgatgccagcagaaaacctggcggcagcgcaaaagatg

SEQ ID NO: 159001 - DNA, 103 bp, Artificial Sequence
  Synthetic Polynucleotide
taatacgactcactataggggtcccagaccttcatctccatcttctgctgaacagaggagacagcagatgatggagatgaacctggcggcagcgcaaaagatg

SEQ ID NO: 159002 - DNA, 103 bp, Artificial Sequence
  Synthetic Polynucleotide
taatacgactcactatagggggttgtctgggtcccagaccttcatctccaaacagaggagatggagaatgaggtctgggaacctggcggcagcgcaaaagatg

SEQ ID NO: 159003 - DNA, 103 bp, Artificial Sequence
  Synthetic Polynucleotide
taatacgactcactatagggtctgtgagagggttgtctgggtcccagaccaacagaggagaggtctgatgcccagacaaaacctggcggcagcgcaaaagatg

SEQ ID NO: 159004 - DNA, 103 bp, Artificial Sequence
  Synthetic Polynucleotide
taatacgactcactataggggatctgccggtctgtgagagggttgtctggaacagaggagaccagacatgcctctcacaaacctggcggcagcgcaaaagatg

SEQ ID NO: 159005 - DNA, 103 bp, Artificial Sequence
  Synthetic Polynucleotide
taatacgactcactataggggaaactggtcgatctgccggtctgtgagagaacagaggagactctcaatgaccggcagaaacctggcggcagcgcaaaagatg

SEQ ID NO: 159006 - DNA, 103 bp, Artificial Sequence
  Synthetic Polynucleotide
taatacgactcactataggggccaccacaagaaactggtcgatctgccggaacagaggagaccggcaatgcgaccagttaacctggcggcagcgcaaaagatg

SEQ ID NO: 159007 - DNA, 103 bp, Artificial Sequence
  Synthetic Polynucleotide
taatacgactcactatagggcacagctcgggccaccacaagaaactggtcaacagaggagagaccagatgcttgtggtgaacctggcggcagcgcaaaagatg

SEQ ID NO: 159008 - DNA, 103 bp, Artificial Sequence
  Synthetic Polynucleotide
taatacgactcactatagggcaaaggttcccacagctcgggccaccacaaaacagaggagattgtggatgcccgagctgaacctggcggcagcgcaaaagatg

SEQ ID NO: 159009 - DNA, 103 bp, Artificial Sequence
  Synthetic Polynucleotide
taatacgactcactatagggatccgtctaaccaggtaaggattgctggaaaacagaggagattccagatgtccttacctaacctggcggcagcgcaaaagatg

SEQ ID NO: 159010 - DNA, 103 bp, Artificial Sequence
  Synthetic Polynucleotide
taatacgactcactatagggagggctcttgcaaaggttcccacagctcggaacagaggagaccgagcatggggaaccttaacctggcggcagcgcaaaagatg

SEQ ID NO: 159011 - DNA, 103 bp, Artificial Sequence
  Synthetic Polynucleotide
taatacgactcactataggggctacaatctagggctcttgcaaaggttccaacagaggagaggaaccatggcaagagccaacctggcggcagcgcaaaagatg

SEQ ID NO: 159012 - DNA, 103 bp, Artificial Sequence
  Synthetic Polynucleotide
taatacgactcactataggggaatggagctgctacaatctagggctcttgaacagaggagacaagagatgtagattgtaaacctggcggcagcgcaaaagatg

SEQ ID NO: 159013 - DNA, 103 bp, Artificial Sequence
  Synthetic Polynucleotide
taatacgactcactatagggcttggctgccgaatggagctgctacaatctaacagaggagaagattgatgcagctccataacctggcggcagcgcaaaagatg

SEQ ID NO: 159014 - DNA, 103 bp, Artificial Sequence
  Synthetic Polynucleotide
taatacgactcactatagggcatgtgcaagcttggctgccgaatggagctaacagaggagaagctccatgcggcagccaaacctggcggcagcgcaaaagatg

SEQ ID NO: 159015 - DNA, 103 bp, Artificial Sequence
  Synthetic Polynucleotide
taatacgactcactatagggcagctgcactcatgtgcaagcttggctgccaacagaggagaggcagcatggcttgcacaaacctggcggcagcgcaaaagatg

SEQ ID NO: 159016 - DNA, 103 bp, Artificial Sequence
  Synthetic Polynucleotide
taatacgactcactatagggcgggaggcagcagctgcactcatgtgcaagaacagaggagacttgcaatggagtgcagcaacctggcggcagcgcaaaagatg

SEQ ID NO: 159017 - DNA, 103 bp, Artificial Sequence
  Synthetic Polynucleotide
taatacgactcactatagggagtgatatctcgggaggcagcagctgcactaacagaggagaagtgcaatggctgcctccaacctggcggcagcgcaaaagatg

SEQ ID NO: 159018 - DNA, 103 bp, Artificial Sequence
  Synthetic Polynucleotide
taatacgactcactatagggcgtgaaacagagtgatatctcgggaggcagaacagaggagactgcctatggagatatcaaacctggcggcagcgcaaaagatg

SEQ ID NO: 159019 - DNA, 103 bp, Artificial Sequence
  Synthetic Polynucleotide
taatacgactcactataggggtatccatggcgtgaaacagagtgatatctaacagaggagaagatatatgtctgtttcaaacctggcggcagcgcaaaagatg

SEQ ID NO: 159020 - DNA, 103 bp, Artificial Sequence
  Synthetic Polynucleotide
taatacgactcactataggggagctcctcaatccgtctaaccaggtaaggaacagaggagaccttacatggttagacggaacctggcggcagcgcaaaagatg

SEQ ID NO: 159021 - DNA, 103 bp, Artificial Sequence
  Synthetic Polynucleotide
taatacgactcactatagggcctttgcaaggtatccatggcgtgaaacagaacagaggagactgtttatggccatggataacctggcggcagcgcaaaagatg

SEQ ID NO: 159022 - DNA, 103 bp, Artificial Sequence
  Synthetic Polynucleotide
taatacgactcactatagggcgtagccgttcctttgcaaggtatccatggaacagaggagaccatggatgccttgcaaaaacctggcggcagcgcaaaagatg

SEQ ID NO: 159023 - DNA, 103 bp, Artificial Sequence
  Synthetic Polynucleotide
taatacgactcactatagggttagccaggtcgtagccgttcctttgcaagaacagaggagacttgcaatggaacggctaaacctggcggcagcgcaaaagatg

SEQ ID NO: 159024 - DNA, 103 bp, Artificial Sequence
  Synthetic Polynucleotide
taatacgactcactatagggcgacatggccttagccaggtcgtagccgttaacagaggagaaacggcatggacctggctaacctggcggcagcgcaaaagatg

SEQ ID NO: 159025 - DNA, 103 bp, Artificial Sequence
  Synthetic Polynucleotide
taatacgactcactataggggtaccagggtcgacatggccttagccaggtaacagaggagaacctggatgaggccatgtaacctggcggcagcgcaaaagatg

SEQ ID NO: 159026 - DNA, 103 bp, Artificial Sequence
  Synthetic Polynucleotide
taatacgactcactatagggcctccctggggtaccagggtcgacatggccaacagaggagaggccatatggaccctggtaacctggcggcagcgcaaaagatg

SEQ ID NO: 159027 - DNA, 103 bp, Artificial Sequence
  Synthetic Polynucleotide
taatacgactcactatagggcagcaccgggcctccctggggtaccagggtaacagaggagaaccctgatgccccagggaaacctggcggcagcgcaaaagatg

SEQ ID NO: 159028 - DNA, 103 bp, Artificial Sequence
  Synthetic Polynucleotide
taatacgactcactatagggcatcccgacacagcaccgggcctccctgggaacagaggagacccaggatggcccggtgcaacctggcggcagcgcaaaagatg

SEQ ID NO: 159029 - DNA, 103 bp, Artificial Sequence
  Synthetic Polynucleotide
taatacgactcactatagggtcctccatctcatcccgacacagcaccgggaacagaggagacccggtatggtgtcgggaaacctggcggcagcgcaaaagatg

SEQ ID NO: 159030 - DNA, 103 bp, Artificial Sequence
  Synthetic Polynucleotide
taatacgactcactatagggggctgaccattcctccatctcatcccgacaaacagaggagatgtcggatggagatggagaacctggcggcagcgcaaaagatg

SEQ ID NO: 159031 - DNA, 103 bp, Artificial Sequence
  Synthetic Polynucleotide
taatacgactcactatagggcagtcttgttgagctcctcaatccgtctaaaacagaggagattagacatgttgaggagcaacctggcggcagcgcaaaagatg

SEQ ID NO: 159032 - DNA, 103 bp, Artificial Sequence
  Synthetic Polynucleotide
taatacgactcactatagggtggcctctgaggctgaccattcctccatctaacagaggagaagatggatgaatggtcagaacctggcggcagcgcaaaagatg

SEQ ID NO: 159033 - DNA, 103 bp, Artificial Sequence
  Synthetic Polynucleotide
taatacgactcactatagggtcaaatagcatggcctctgaggctgaccataacagaggagaatggtcatgctcagaggcaacctggcggcagcgcaaaagatg

SEQ ID NO: 159034 - DNA, 103 bp, Artificial Sequence
  Synthetic Polynucleotide
taatacgactcactatagggtagggcctcctcaaatagcatggcctctgaaacagaggagatcagagatgatgctatttaacctggcggcagcgcaaaagatg

SEQ ID NO: 159035 - DNA, 103 bp, Artificial Sequence
  Synthetic Polynucleotide
taatacgactcactatagggcatacttctctagggcctcctcaaatagcaaacagaggagatgctatatgaggaggcccaacctggcggcagcgcaaaagatg

SEQ ID NO: 159036 - DNA, 103 bp, Artificial Sequence
  Synthetic Polynucleotide
taatacgactcactatagggaagtccttcccatacttctctagggcctccaacagaggagaggaggcatgagagaagtaaacctggcggcagcgcaaaagatg

SEQ ID NO: 159037 - DNA, 103 bp, Artificial Sequence
  Synthetic Polynucleotide
taatacgactcactatagggaatatcattgaagtccttcccatacttctcaacagaggagagagaagatggggaaggacaacctggcggcagcgcaaaagatg

SEQ ID NO: 159038 - DNA, 103 bp, Artificial Sequence
  Synthetic Polynucleotide
taatacgactcactatagggaatcctggcgaatatcattgaagtccttccaacagaggagaggaaggatgtcaatgataaacctggcggcagcgcaaaagatg

SEQ ID NO: 159039 - DNA, 103 bp, Artificial Sequence
  Synthetic Polynucleotide
taatacgactcactatagggcagggtagaaaatcctggcgaatatcattgaacagaggagacaatgaatgtcgccaggaaacctggcggcagcgcaaaagatg

SEQ ID NO: 159040 - DNA, 103 bp, Artificial Sequence
  Synthetic Polynucleotide
taatacgactcactatagggaagtgacttccagggtagaaaatcctggcgaacagaggagacgccagatgtttctacccaacctggcggcagcgcaaaagatg

SEQ ID NO: 159041 - DNA, 103 bp, Artificial Sequence
  Synthetic Polynucleotide
taatacgactcactatagggctatgctggcaagtgacttccagggtagaaaacagaggagattctacatgggaagtcacaacctggcggcagcgcaaaagatg

SEQ ID NO: 159042 - DNA, 103 bp, Artificial Sequence
  Synthetic Polynucleotide
taatacgactcactatagggtttccatttgcagtcttgttgagctcctcaaacagaggagatgaggaatgcaacaagacaacctggcggcagcgcaaaagatg

SEQ ID NO: 159043 - DNA, 103 bp, Artificial Sequence
  Synthetic Polynucleotide
taatacgactcactatagggtaaaactggactatgctggcaagtgacttcaacagaggagagaagtcatgtgccagcataacctggcggcagcgcaaaagatg

SEQ ID NO: 159044 - DNA, 103 bp, Artificial Sequence
  Synthetic Polynucleotide
taatacgactcactatagggccacatgtaataaaactggactatgctggcaacagaggagagccagcatggtccagtttaacctggcggcagcgcaaaagatg

SEQ ID NO: 159045 - DNA, 103 bp, Artificial Sequence
  Synthetic Polynucleotide
taatacgactcactatagggctgtggttttccacatgtaataaaactggaaacagaggagatccagtatgattacatgtaacctggcggcagcgcaaaagatg

SEQ ID NO: 159046 - DNA, 103 bp, Artificial Sequence
  Synthetic Polynucleotide
taatacgactcactatagggatataccggtctgtggttttccacatgtaaaacagaggagattacatatggaaaaccacaacctggcggcagcgcaaaagatg

SEQ ID NO: 159047 - DNA, 103 bp, Artificial Sequence
  Synthetic Polynucleotide
taatacgactcactatagggtttctgctgaatataccggtctgtggttttaacagaggagaaaaaccatggaccggtataacctggcggcagcgcaaaagatg

SEQ ID NO: 159048 - DNA, 103 bp, Artificial Sequence
  Synthetic Polynucleotide
taatacgactcactatagggctttcaaccttttctgctgaatataccggtaacagaggagaaccggtatgttcagcagaaacctggcggcagcgcaaaagatg

SEQ ID NO: 159049 - DNA, 103 bp, Artificial Sequence
  Synthetic Polynucleotide
taatacgactcactataggggcttcagcagctttcaaccttttctgctgaaacagaggagatcagcaatgaaggttgaaaacctggcggcagcgcaaaagatg

SEQ ID NO: 159050 - DNA, 103 bp, Artificial Sequence
  Synthetic Polynucleotide
taatacgactcactatagggtttgctgtctgcttcagcagctttcaacctaacagaggagaaggttgatggctgctgaaaacctggcggcagcgcaaaagatg

SEQ ID NO: 159051 - DNA, 103 bp, Artificial Sequence
  Synthetic Polynucleotide
taatacgactcactatagggcctgtttcagtttgctgtctgcttcagcagaacagaggagactgctgatgcagacagcaaacctggcggcagcgcaaaagatg

SEQ ID NO: 159052 - DNA, 103 bp, Artificial Sequence
  Synthetic Polynucleotide
taatacgactcactatagggggaatgtagacctgtttcagtttgctgtctaacagaggagaagacagatgactgaaacaaacctggcggcagcgcaaaagatg

SEQ ID NO: 159053 - DNA, 103 bp, Artificial Sequence
  Synthetic Polynucleotide
taatacgactcactatagggtctgggtatctgttgggctgacaaagccataacagaggagaatggctatgtcagcccaaaacctggcggcagcgcaaaagatg

SEQ ID NO: 159054 - DNA, 103 bp, Artificial Sequence
  Synthetic Polynucleotide
taatacgactcactataggggccatgtaacagtgttcttgctggtctagtaacagaggagaactagaatggcaagaacaaacctggcggcagcgcaaaagatg

SEQ ID NO: 159055 - DNA, 103 bp, Artificial Sequence
  Synthetic Polynucleotide
taatacgactcactatagggcacattgtgcacaaaatcaaacgtctcggtaacagaggagaaccgagatgtttgattttaacctggcggcagcgcaaaagatg

SEQ ID NO: 159056 - DNA, 103 bp, Artificial Sequence
  Synthetic Polynucleotide
taatacgactcactataggggaatgctcatcacattgtgcacaaaatcaaaacagaggagattgattatgtgcacaatgaacctggcggcagcgcaaaagatg

SEQ ID NO: 159057 - DNA, 103 bp, Artificial Sequence
  Synthetic Polynucleotide
taatacgactcactatagggatgtggtggggaatgctcatcacattgtgcaacagaggagagcacaaatggatgagcataacctggcggcagcgcaaaagatg

SEQ ID NO: 159058 - DNA, 103 bp, Artificial Sequence
  Synthetic Polynucleotide
taatacgactcactatagggcttgacaatgatgtggtggggaatgctcataacagaggagaatgagcatgccccaccacaacctggcggcagcgcaaaagatg

SEQ ID NO: 159059 - DNA, 103 bp, Artificial Sequence
  Synthetic Polynucleotide
taatacgactcactatagggcctgtgggaacttgacaatgatgtggtgggaacagaggagacccaccatgtcattgtcaaacctggcggcagcgcaaaagatg

SEQ ID NO: 159060 - DNA, 103 bp, Artificial Sequence
  Synthetic Polynucleotide
taatacgactcactataggggtattaaatacctgtgggaacttgacaatgaacagaggagacattgtatggttcccacaaacctggcggcagcgcaaaagatg

SEQ ID NO: 159061 - DNA, 103 bp, Artificial Sequence
  Synthetic Polynucleotide
taatacgactcactatagggaaacagccttgtattaaatacctgtgggaaaacagaggagattcccaatggtatttaataacctggcggcagcgcaaaagatg

SEQ ID NO: 159062 - DNA, 103 bp, Artificial Sequence
  Synthetic Polynucleotide
taatacgactcactatagggctttgaccttaaacagccttgtattaaataaacagaggagatatttaatgcaaggctgtaacctggcggcagcgcaaaagatg

SEQ ID NO: 159063 - DNA, 103 bp, Artificial Sequence
  Synthetic Polynucleotide
taatacgactcactatagggaagtgtctttctttgaccttaaacagccttaacagaggagaaaggctatgtaaggtcaaaacctggcggcagcgcaaaagatg

SEQ ID NO: 159064 - DNA, 103 bp, Artificial Sequence
  Synthetic Polynucleotide
taatacgactcactatagggggtaagaaacaagtgtctttctttgaccttaacagaggagaaaggtcatggaaagacacaacctggcggcagcgcaaaagatg

SEQ ID NO: 159065 - DNA, 103 bp, Artificial Sequence
  Synthetic Polynucleotide
taatacgactcactataggggagcagaaaagccatgtaacagtgttcttgaacagaggagacaagaaatgtgttacatgaacctggcggcagcgcaaaagatg

SEQ ID NO: 159066 - DNA, 103 bp, Artificial Sequence
  Synthetic Polynucleotide
taatacgactcactatagggttcctaaataggtaagaaacaagtgtctttaacagaggagaaaagacatgtgtttcttaaacctggcggcagcgcaaaagatg

SEQ ID NO: 159067 - DNA, 103 bp, Artificial Sequence
  Synthetic Polynucleotide
taatacgactcactatagggtactgtgctcttcctaaataggtaagaaacaacagaggagagtttctatgctatttaggaacctggcggcagcgcaaaagatg

SEQ ID NO: 159068 - DNA, 103 bp, Artificial Sequence
  Synthetic Polynucleotide
taatacgactcactatagggtgctggatcatactgtgctcttcctaaataaacagaggagatatttaatgagagcacagaacctggcggcagcgcaaaagatg

SEQ ID NO: 159069 - DNA, 103 bp, Artificial Sequence
  Synthetic Polynucleotide
taatacgactcactatagggagttaggttttgctggatcatactgtgctcaacagaggagagagcacatgatgatccagaacctggcggcagcgcaaaagatg

SEQ ID NO: 159070 - DNA, 103 bp, Artificial Sequence
  Synthetic Polynucleotide
taatacgactcactatagggaaagagatgtagttaggttttgctggatcaaacagaggagatgatccatgaaaacctaaaacctggcggcagcgcaaaagatg

SEQ ID NO: 159071 - DNA, 103 bp, Artificial Sequence
  Synthetic Polynucleotide
taatacgactcactatagggtagtttgtccaaagagatgtagttaggtttaacagaggagaaaacctatgtacatctctaacctggcggcagcgcaaaagatg

SEQ ID NO: 159072 - DNA, 103 bp, Artificial Sequence
  Synthetic Polynucleotide
taatacgactcactataggggaatagatactagtttgtccaaagagatgtaacagaggagaacatctatgtggacaaacaacctggcggcagcgcaaaagatg

SEQ ID NO: 159073 - DNA, 103 bp, Artificial Sequence
  Synthetic Polynucleotide
taatacgactcactatagggatttcatcaggaatagatactagtttgtccaacagaggagaggacaaatgagtatctataacctggcggcagcgcaaaagatg

SEQ ID NO: 159074 - DNA, 103 bp, Artificial Sequence
  Synthetic Polynucleotide
taatacgactcactatagggttcacaaaatatttcatcaggaatagatacaacagaggagagtatctatgcctgatgaaaacctggcggcagcgcaaaagatg

SEQ ID NO: 159075 - DNA, 103 bp, Artificial Sequence
  Synthetic Polynucleotide
taatacgactcactatagggtggcaatctcttcacaaaatatttcatcagaacagaggagactgatgatgtattttgtgaacctggcggcagcgcaaaagatg

SEQ ID NO: 159076 - DNA, 103 bp, Artificial Sequence
  Synthetic Polynucleotide
taatacgactcactatagggatctgaggctgagcagaaaagccatgtaacaacagaggagagttacaatgcttttctgcaacctggcggcagcgcaaaagatg

SEQ ID NO: 159077 - DNA, 103 bp, Artificial Sequence
  Synthetic Polynucleotide
taatacgactcactatagggactgatgctttggcaatctcttcacaaaataacagaggagaattttgatgagagattgcaacctggcggcagcgcaaaagatg

SEQ ID NO: 159078 - DNA, 103 bp, Artificial Sequence
  Synthetic Polynucleotide
taatacgactcactatagggaaagtcctgtactgatgctttggcaatctcaacagaggagagagattatgaaagcatcaaacctggcggcagcgcaaaagatg

SEQ ID NO: 159079 - DNA, 103 bp, Artificial Sequence
  Synthetic Polynucleotide
taatacgactcactatagggagaatttttcaaagtcctgtactgatgcttaacagaggagaaagcatatgtacaggactaacctggcggcagcgcaaaagatg

SEQ ID NO: 159080 - DNA, 103 bp, Artificial Sequence
  Synthetic Polynucleotide
taatacgactcactatagggagcgtttttaagaatttttcaaagtcctgtaacagaggagaacaggaatgtgaaaaattaacctggcggcagcgcaaaagatg

SEQ ID NO: 159081 - DNA, 103 bp, Artificial Sequence
  Synthetic Polynucleotide
taatacgactcactataggggtcagaggatatctgaggctgagcagaaaaaacagaggagattttctatgcagcctcagaacctggcggcagcgcaaaagatg

SEQ ID NO: 159082 - DNA, 103 bp, Artificial Sequence
  Synthetic Polynucleotide
taatacgactcactataggggaaagcaattgtcagaggatatctgaggctaacagaggagaagcctcatgtatcctctgaacctggcggcagcgcaaaagatg

SEQ ID NO: 159083 - DNA, 103 bp, Artificial Sequence
  Synthetic Polynucleotide
taatacgactcactatagggccccactggagaaagcaattgtcagaggataacagaggagaatcctcatgcaattgcttaacctggcggcagcgcaaaagatg

SEQ ID NO: 159084 - DNA, 103 bp, Artificial Sequence
  Synthetic Polynucleotide
taatacgactcactatagggagtcttaaatccccactggagaaagcaattaacagaggagaaattgcatgctccagtggaacctggcggcagcgcaaaagatg

SEQ ID NO: 159085 - DNA, 103 bp, Artificial Sequence
  Synthetic Polynucleotide
taatacgactcactatagggaagtcctgtaagtcttaaatccccactggaaacagaggagatccagtatggatttaagaaacctggcggcagcgcaaaagatg

SEQ ID NO: 159086 - DNA, 103 bp, Artificial Sequence
  Synthetic Polynucleotide
taatacgactcactatagggcataaggaggaagtcctgtaagtcttaaataacagaggagaatttaaatgttacaggacaacctggcggcagcgcaaaagatg

SEQ ID NO: 159087 - DNA, 103 bp, Artificial Sequence
  Synthetic Polynucleotide
taatacgactcactatagggggaactattccataaggaggaagtcctgtaaacagaggagatacaggatgtcctccttaaacctggcggcagcgcaaaagatg

SEQ ID NO: 159088 - DNA, 103 bp, Artificial Sequence
  Synthetic Polynucleotide
taatacgactcactatagggagttaaaccatctgggtatctgttgggctgaacagaggagacagcccatgagatacccaaacctggcggcagcgcaaaagatg

SEQ ID NO: 159089 - DNA, 103 bp, Artificial Sequence
  Synthetic Polynucleotide
taatacgactcactatagggtagtagactgggaactattccataaggaggaacagaggagacctcctatgggaatagttaacctggcggcagcgcaaaagatg

SEQ ID NO: 159090 - DNA, 103 bp, Artificial Sequence
  Synthetic Polynucleotide
taatacgactcactatagggctacttgagctagtagactgggaactattcaacagaggagagaatagatgccagtctacaacctggcggcagcgcaaaagatg

SEQ ID NO: 159091 - DNA, 103 bp, Artificial Sequence
  Synthetic Polynucleotide
taatacgactcactatagggattctcctgactacttgagctagtagactgaacagaggagacagtctatgagctcaagtaacctggcggcagcgcaaaagatg

SEQ ID NO: 159092 - DNA, 103 bp, Artificial Sequence
  Synthetic Polynucleotide
taatacgactcactataggggggcagaattattctcctgactacttgagcaacagaggagagctcaaatggtcaggagaaacctggcggcagcgcaaaagatg

SEQ ID NO: 159093 - DNA, 103 bp, Artificial Sequence
  Synthetic Polynucleotide
taatacgactcactatagggagactgctttgggcagaattattctcctgaaacagaggagatcaggaatgtaattctgcaacctggcggcagcgcaaaagatg

SEQ ID NO: 159094 - DNA, 103 bp, Artificial Sequence
  Synthetic Polynucleotide
taatacgactcactatagggggaaggaagcagactgctttgggcagaattaacagaggagaaattctatgcaaagcagtaacctggcggcagcgcaaaagatg

SEQ ID NO: 159095 - DNA, 103 bp, Artificial Sequence
  Synthetic Polynucleotide
taatacgactcactataggggttcattcatggaaggaagcagactgctttaacagaggagaaaagcaatgtgcttccttaacctggcggcagcgcaaaagatg

SEQ ID NO: 159096 - DNA, 103 bp, Artificial Sequence
  Synthetic Polynucleotide
taatacgactcactatagggttctgtgactgttcattcatggaaggaagcaacagaggagagcttccatgcatgaatgaaacctggcggcagcgcaaaagatg

SEQ ID NO: 159097 - DNA, 103 bp, Artificial Sequence
  Synthetic Polynucleotide
taatacgactcactatagggattttgtgtcttctgtgactgttcattcataacagaggagaatgaatatgcagtcacagaacctggcggcagcgcaaaagatg

SEQ ID NO: 159098 - DNA, 103 bp, Artificial Sequence
  Synthetic Polynucleotide
taatacgactcactatagggagctggatatattttgtgtcttctgtgactaacagaggagaagtcacatgagacacaaaaacctggcggcagcgcaaaagatg

SEQ ID NO: 159099 - DNA, 103 bp, Artificial Sequence
  Synthetic Polynucleotide
taatacgactcactatagggaacttaactgagttaaaccatctgggtatcaacagaggagagataccatgatggtttaaaacctggcggcagcgcaaaagatg

SEQ ID NO: 159100 - DNA, 103 bp, Artificial Sequence
  Synthetic Polynucleotide
taatacgactcactatagggtcagaatcaaagctggatatattttgtgtcaacagaggagagacacaatgtatatccagaacctggcggcagcgcaaaagatg

SEQ ID NO: 159101 - DNA, 103 bp, Artificial Sequence
  Synthetic Polynucleotide
taatacgactcactatagggtagaaacagctcagaatcaaagctggatataacagaggagaatatccatgtttgattctaacctggcggcagcgcaaaagatg

SEQ ID NO: 159102 - DNA, 103 bp, Artificial Sequence
  Synthetic Polynucleotide
taatacgactcactatagggccagttcttctagaaacagctcagaatcaaaacagaggagattgattatgagctgtttcaacctggcggcagcgcaaaagatg

SEQ ID NO: 159103 - DNA, 103 bp, Artificial Sequence
  Synthetic Polynucleotide
taatacgactcactatagggggcaattcatccagttcttctagaaacagcaacagaggagagctgttatgagaagaactaacctggcggcagcgcaaaagatg

SEQ ID NO: 159104 - DNA, 103 bp, Artificial Sequence
  Synthetic Polynucleotide
taatacgactcactatagggagacaatggaggcaattcatccagttcttcaacagaggagagaagaaatggatgaattgaacctggcggcagcgcaaaagatg

SEQ ID NO: 159105 - DNA, 103 bp, Artificial Sequence
  Synthetic Polynucleotide
taatacgactcactataggggctgcattggagacaatggaggcaattcataacagaggagaatgaatatgctccattgtaacctggcggcagcgcaaaagatg

SEQ ID NO: 159106 - DNA, 103 bp, Artificial Sequence
  Synthetic Polynucleotide
taatacgactcactatagggtctgaaattggctgcattggagacaatggaaacagaggagatccattatgtccaatgcaaacctggcggcagcgcaaaagatg

SEQ ID NO: 159107 - DNA, 103 bp, Artificial Sequence
  Synthetic Polynucleotide
taatacgactcactatagggagcctcttcctctgaaattggctgcattggaacagaggagaccaatgatgccaatttcaaacctggcggcagcgcaaaagatg

SEQ ID NO: 159108 - DNA, 103 bp, Artificial Sequence
  Synthetic Polynucleotide
taatacgactcactatagggtaatctgaatagcctcttcctctgaaattgaacagaggagacaatttatgaggaagaggaacctggcggcagcgcaaaagatg

SEQ ID NO: 159109 - DNA, 103 bp, Artificial Sequence
  Synthetic Polynucleotide
taatacgactcactataggggggtctgcaataatctgaatagcctcttccaacagaggagaggaagaatgtattcagataacctggcggcagcgcaaaagatg

SEQ ID NO: 159110 - DNA, 103 bp, Artificial Sequence
  Synthetic Polynucleotide
taatacgactcactataggggaggctcctcaacttaactgagttaaaccaaacagaggagatggtttatgtcagttaagaacctggcggcagcgcaaaagatg

SEQ ID NO: 159111 - DNA, 103 bp, Artificial Sequence
  Synthetic Polynucleotide
taatacgactcactatagggtggcaatggagggtctgcaataatctgaataacagaggagaattcagatgattgcagacaacctggcggcagcgcaaaagatg

SEQ ID NO: 159112 - DNA, 103 bp, Artificial Sequence
  Synthetic Polynucleotide
taatacgactcactatagggatgaagctggtggcaatggagggtctgcaaaacagaggagattgcagatgctccattgcaacctggcggcagcgcaaaagatg

SEQ ID NO: 159113 - DNA, 103 bp, Artificial Sequence
  Synthetic Polynucleotide
taatacgactcactatagggcgaagtgtgaatgaagctggtggcaatggaaacagaggagatccattatgaccagcttcaacctggcggcagcgcaaaagatg

SEQ ID NO: 159114 - DNA, 103 bp, Artificial Sequence
  Synthetic Polynucleotide
taatacgactcactatagggcacatagtctcgaagtgtgaatgaagctggaacagaggagaccagctatgttcacacttaacctggcggcagcgcaaaagatg

SEQ ID NO: 159115 - DNA, 103 bp, Artificial Sequence
  Synthetic Polynucleotide
taatacgactcactatagggcagaatgatccacatagtctcgaagtgtgaaacagaggagatcacacatggagactatgaacctggcggcagcgcaaaagatg

SEQ ID NO: 159116 - DNA, 103 bp, Artificial Sequence
  Synthetic Polynucleotide
taatacgactcactatagggtgcagagtctcagaatgatccacatagtctaacagaggagaagactaatgggatcattcaacctggcggcagcgcaaaagatg

SEQ ID NO: 159117 - DNA, 103 bp, Artificial Sequence
  Synthetic Polynucleotide
taatacgactcactatagggaaccaacttctgcagagtctcagaatgatcaacagaggagagatcatatggagactctgaacctggcggcagcgcaaaagatg

SEQ ID NO: 159118 - DNA, 103 bp, Artificial Sequence
  Synthetic Polynucleotide
taatacgactcactatagggcgcctagaagaaccaacttctgcagagtctaacagaggagaagactcatgagaagttggaacctggcggcagcgcaaaagatg

SEQ ID NO: 159119 - DNA, 103 bp, Artificial Sequence
  Synthetic Polynucleotide
taatacgactcactataggggacaaatccacgcctagaagaaccaacttcaacagaggagagaagttatgtcttctaggaacctggcggcagcgcaaaagatg

SEQ ID NO: 159120 - DNA, 103 bp, Artificial Sequence
  Synthetic Polynucleotide
taatacgactcactatagggttctatcttggacaaatccacgcctagaagaacagaggagacttctaatggtggatttgaacctggcggcagcgcaaaagatg

SEQ ID NO: 159121 - DNA, 103 bp, Artificial Sequence
  Synthetic Polynucleotide
taatacgactcactatagggcagcattaatgaggctcctcaacttaactgaacagaggagacagttaatgtgaggagccaacctggcggcagcgcaaaagatg

SEQ ID NO: 159122 - DNA, 103 bp, Artificial Sequence
  Synthetic Polynucleotide
taatacgactcactatagggctggatgtttttctatcttggacaaatccaaacagaggagatggattatgccaagatagaacctggcggcagcgcaaaagatg

SEQ ID NO: 159123 - DNA, 103 bp, Artificial Sequence
  Synthetic Polynucleotide
taatacgactcactatagggtttgctgcttctggatgtttttctatcttgaacagaggagacaagatatgaaaacatccaacctggcggcagcgcaaaagatg

SEQ ID NO: 159124 - DNA, 103 bp, Artificial Sequence
  Synthetic Polynucleotide
taatacgactcactatagggcagaaggaggtttgctgcttctggatgtttaacagaggagaaaacatatggaagcagcaaacctggcggcagcgcaaaagatg

SEQ ID NO: 159125 - DNA, 103 bp, Artificial Sequence
  Synthetic Polynucleotide
taatacgactcactatagggaatccagtctcagaaggaggtttgctgcttaacagaggagaaagcagatgacctccttcaacctggcggcagcgcaaaagatg

SEQ ID NO: 159126 - DNA, 103 bp, Artificial Sequence
  Synthetic Polynucleotide
taatacgactcactatagggtctttttcaaaatccagtctcagaaggaggaacagaggagacctcctatggagactggaaacctggcggcagcgcaaaagatg

SEQ ID NO: 159127 - DNA, 103 bp, Artificial Sequence
  Synthetic Polynucleotide
taatacgactcactatagggttgcttaatgtctttttcaaaatccagtctaacagaggagaagactgatgtttgaaaaaaacctggcggcagcgcaaaagatg

SEQ ID NO: 159128 - DNA, 103 bp, Artificial Sequence
  Synthetic Polynucleotide
taatacgactcactatagggacagaagcatttgcttaatgtctttttcaaaacagaggagattgaaaatgacattaagcaacctggcggcagcgcaaaagatg

SEQ ID NO: 159129 - DNA, 103 bp, Artificial Sequence
  Synthetic Polynucleotide
taatacgactcactatagggtctttaagaaacagaagcatttgcttaatgaacagaggagacattaaatgaatgcttctaacctggcggcagcgcaaaagatg

SEQ ID NO: 159130 - DNA, 103 bp, Artificial Sequence
  Synthetic Polynucleotide
taatacgactcactatagggtatacccacatctttaagaaacagaagcataacagaggagaatgcttatgtttcttaaaaacctggcggcagcgcaaaagatg

SEQ ID NO: 159131 - DNA, 103 bp, Artificial Sequence
  Synthetic Polynucleotide
taatacgactcactatagggggttatcctctatacccacatctttaagaaaacagaggagattcttaatgatgtgggtaaacctggcggcagcgcaaaagatg

SEQ ID NO: 159132 - DNA, 103 bp, Artificial Sequence
  Synthetic Polynucleotide
taatacgactcactataggggtgagttgtgcagcattaatgaggctcctcaacagaggagagaggagatgcattaatgcaacctggcggcagcgcaaaagatg

SEQ ID NO: 159133 - DNA, 103 bp, Artificial Sequence
  Synthetic Polynucleotide
taatacgactcactataggggctcccagttggttatcctctatacccacaaacagaggagatgtgggatgagaggataaaacctggcggcagcgcaaaagatg

SEQ ID NO: 159134 - DNA, 103 bp, Artificial Sequence
  Synthetic Polynucleotide
taatacgactcactatagggtgtcaggaatgctcccagttggttatcctcaacagaggagagaggatatgcaactgggaaacctggcggcagcgcaaaagatg

SEQ ID NO: 159135 - DNA, 103 bp, Artificial Sequence
  Synthetic Polynucleotide
taatacgactcactatagggcatgattttttgtcaggaatgctcccagttaacagaggagaaactggatgcattcctgaaacctggcggcagcgcaaaagatg

SEQ ID NO: 159136 - DNA, 103 bp, Artificial Sequence
  Synthetic Polynucleotide
taatacgactcactataggggagaaaattgcatgattttttgtcaggaataacagaggagaattcctatgaaaaaatcaaacctggcggcagcgcaaaagatg

SEQ ID NO: 159137 - DNA, 103 bp, Artificial Sequence
  Synthetic Polynucleotide
taatacgactcactatagggaaggtcttcagagaaaattgcatgatttttaacagaggagaaaaaatatggcaattttcaacctggcggcagcgcaaaagatg

SEQ ID NO: 159138 - DNA, 103 bp, Artificial Sequence
  Synthetic Polynucleotide
taatacgactcactatagggtcagattttcaaggtcttcagagaaaattgaacagaggagacaatttatgctgaagaccaacctggcggcagcgcaaaagatg

SEQ ID NO: 159139 - DNA, 103 bp, Artificial Sequence
  Synthetic Polynucleotide
taatacgactcactatagggaccctggtcttcagattttcaaggtcttcaaacagaggagatgaagaatgtgaaaatctaacctggcggcagcgcaaaagatg

SEQ ID NO: 159140 - DNA, 103 bp, Artificial Sequence
  Synthetic Polynucleotide
taatacgactcactatagggcagataagccaccctggtcttcagattttcaacagaggagagaaaatatgaagaccaggaacctggcggcagcgcaaaagatg

SEQ ID NO: 159141 - DNA, 103 bp, Artificial Sequence
  Synthetic Polynucleotide
taatacgactcactatagggtttttgaatgcagataagccaccctggtctaacagaggagaagaccaatgtggcttatcaacctggcggcagcgcaaaagatg

SEQ ID NO: 159142 - DNA, 103 bp, Artificial Sequence
  Synthetic Polynucleotide
taatacgactcactatagggttactgaaattttttgaatgcagataagccaacagaggagaggcttaatggcattcaaaaacctggcggcagcgcaaaagatg

SEQ ID NO: 159143 - DNA, 103 bp, Artificial Sequence
  Synthetic Polynucleotide
taatacgactcactatagggaaaacgttttgtgagttgtgcagcattaataacagaggagaattaatatggcacaactcaacctggcggcagcgcaaaagatg

SEQ ID NO: 159144 - DNA, 103 bp, Artificial Sequence
  Synthetic Polynucleotide
taatacgactcactatagggaacatctgctttactgaaattttttgaatgaacagaggagacattcaatgaatttcagtaacctggcggcagcgcaaaagatg

SEQ ID NO: 159145 - DNA, 103 bp, Artificial Sequence
  Synthetic Polynucleotide
taatacgactcactatagggccatctgtgcaacatctgctttactgaaataacagaggagaatttcaatgaagcagatgaacctggcggcagcgcaaaagatg

SEQ ID NO: 159146 - DNA, 103 bp, Artificial Sequence
  Synthetic Polynucleotide
taatacgactcactataggggcttttctgaccatctgtgcaacatctgctaacagaggagaagcagaatgtgcacagataacctggcggcagcgcaaaagatg

SEQ ID NO: 159147 - DNA, 103 bp, Artificial Sequence
  Synthetic Polynucleotide
taatacgactcactatagggcaaaaatggtgcttttctgaccatctgtgcaacagaggagagcacagatggtcagaaaaaacctggcggcagcgcaaaagatg

SEQ ID NO: 159148 - DNA, 103 bp, Artificial Sequence
  Synthetic Polynucleotide
taatacgactcactatagggaaaagttcagcaaaaatggtgcttttctgaaacagaggagatcagaaatgcaccattttaacctggcggcagcgcaaaagatg

SEQ ID NO: 159149 - DNA, 103 bp, Artificial Sequence
  Synthetic Polynucleotide
taatacgactcactatagggctttccactgaaaagttcagcaaaaatggtaacagaggagaaccattatggctgaacttaacctggcggcagcgcaaaagatg

SEQ ID NO: 159150 - DNA, 103 bp, Artificial Sequence
  Synthetic Polynucleotide
taatacgactcactataggggttatccagtctttccactgaaaagttcagaacagaggagactgaacatgtcagtggaaaacctggcggcagcgcaaaagatg

SEQ ID NO: 159151 - DNA, 103 bp, Artificial Sequence
  Synthetic Polynucleotide
taatacgactcactatagggatcccaatctgttatccagtctttccactgaacagaggagacagtggatggactggataaacctggcggcagcgcaaaagatg

SEQ ID NO: 159152 - DNA, 103 bp, Artificial Sequence
  Synthetic Polynucleotide
taatacgactcactatagggttctgaaaaaatcccaatctgttatccagtaacagaggagaactggaatgcagattgggaacctggcggcagcgcaaaagatg

SEQ ID NO: 159153 - DNA, 103 bp, Artificial Sequence
  Synthetic Polynucleotide
taatacgactcactatagggttcaagttctttctgaaaaaatcccaatctaacagaggagaagattgatgttttttcagaacctggcggcagcgcaaaagatg

SEQ ID NO: 159154 - DNA, 103 bp, Artificial Sequence
  Synthetic Polynucleotide
taatacgactcactatagggctggtctagtaaaacgttttgtgagttgtgaacagaggagacacaacatgcaaaacgttaacctggcggcagcgcaaaagatg

SEQ ID NO: 159155 - DNA, 103 bp, Artificial Sequence
  Synthetic Polynucleotide
taatacgactcactatagggtcacactaagttcaagttctttctgaaaaaaacagaggagatttttcatgaagaacttgaacctggcggcagcgcaaaagatg

SEQ ID NO: 159156 - DNA, 103 bp, Artificial Sequence
  Synthetic Polynucleotide
taatacgactcactatagggctagtcttcttcacactaagttcaagttctaacagaggagaagaactatgacttagtgtaacctggcggcagcgcaaaagatg

SEQ ID NO: 159157 - DNA, 103 bp, Artificial Sequence
  Synthetic Polynucleotide
taatacgactcactatagggtaccagatctctagtcttcttcacactaagaacagaggagacttagtatgaagaagactaacctggcggcagcgcaaaagatg

SEQ ID NO: 159158 - DNA, 103 bp, Artificial Sequence
  Synthetic Polynucleotide
taatacgactcactatagggggagacgaactaccagatctctagtcttctaacagaggagaagaagaatggagatctggaacctggcggcagcgcaaaagatg

SEQ ID NO: 159159 - DNA, 103 bp, Artificial Sequence
  Synthetic Polynucleotide
taatacgactcactatagggagcagccttgggagacgaactaccagatctaacagaggagaagatctatgagttcgtctaacctggcggcagcgcaaaagatg

SEQ ID NO: 159160 - DNA, 103 bp, Artificial Sequence
  Synthetic Polynucleotide
taatacgactcactatagggacttccagttagcagccttgggagacgaacaacagaggagagttcgtatgccaaggctgaacctggcggcagcgcaaaagatg

SEQ ID NO: 159161 - DNA, 103 bp, Artificial Sequence
  Synthetic Polynucleotide
taatacgactcactatagggcgggttccagacttccagttagcagccttgaacagaggagacaaggcatgtaactggaaaacctggcggcagcgcaaaagatg

SEQ ID NO: 159162 - DNA, 103 bp, Artificial Sequence
  Synthetic Polynucleotide
taatacgactcactatagggttttctttcacgggttccagacttccagttaacagaggagaaactggatgtctggaaccaacctggcggcagcgcaaaagatg

SEQ ID NO: 159163 - DNA, 103 bp, Artificial Sequence
  Synthetic Polynucleotide
taatacgactcactatagggaaccttcatattttctttcacgggttccagaacagaggagactggaaatggtgaaagaaaacctggcggcagcgcaaaagatg

SEQ ID NO: 159164 - DNA, 103 bp, Artificial Sequence
  Synthetic Polynucleotide
taatacgactcactatagggcaagacgataaaccttcatattttctttcaaacagaggagatgaaagatgatatgaaggaacctggcggcagcgcaaaagatg

SEQ ID NO: 159165 - DNA, 103 bp, Artificial Sequence
  Synthetic Polynucleotide
taatacgactcactatagggagtgttcttgctggtctagtaaaacgttttaacagaggagaaaaacgatgtactagaccaacctggcggcagcgcaaaagatg

SEQ ID NO: 159166 - DNA, 103 bp, Artificial Sequence
  Synthetic Polynucleotide
taatacgactcactatagggaaaccaagttcaagacgataaaccttcataaacagaggagatatgaaatgttatcgtctaacctggcggcagcgcaaaagatg

SEQ ID NO: 159167 - DNA, 103 bp, Artificial Sequence
  Synthetic Polynucleotide
taatacgactcactataggggttatgtttaaaaccaagttcaagacgataaacagaggagatatcgtatggaacttggtaacctggcggcagcgcaaaagatg

SEQ ID NO: 159168 - DNA, 103 bp, Artificial Sequence
  Synthetic Polynucleotide
taatacgactcactataggggttgaatttcgttatgtttaaaaccaagttaacagaggagaaacttgatgttaaacataaacctggcggcagcgcaaaagatg

SEQ ID NO: 159169 - DNA, 103 bp, Artificial Sequence
  Synthetic Polynucleotide
taatacgactcactataggggtgatcatatgttgaatttcgttatgtttaaacagaggagataaacaatgcgaaattcaaacctggcggcagcgcaaaagatg

SEQ ID NO: 159170 - DNA, 103 bp, Artificial Sequence
  Synthetic Polynucleotide
taatacgactcactatagggtgggattctggtgatcatatgttgaatttcaacagaggagagaaattatgcatatgatcaacctggcggcagcgcaaaagatg

SEQ ID NO: 159171 - DNA, 103 bp, Artificial Sequence
  Synthetic Polynucleotide
taatacgactcactatagggttaacatctttgggattctggtgatcatataacagaggagaatatgaatgccagaatccaacctggcggcagcgcaaaagatg

SEQ ID NO: 159172 - DNA, 103 bp, Artificial Sequence
  Synthetic Polynucleotide
taatacgactcactatagggttatttgcagttaacatctttgggattctgaacagaggagacagaatatgaaagatgttaacctggcggcagcgcaaaagatg

SEQ ID NO: 159173 - DNA, 103 bp, Artificial Sequence
  Synthetic Polynucleotide
taatacgactcactatagggaagtttcattttatttgcagttaacatcttaacagaggagaaagatgatgactgcaaataacctggcggcagcgcaaaagatg

SEQ ID NO: 159174 - DNA, 103 bp, Artificial Sequence
  Synthetic Polynucleotide
taatacgactcactatagggacgtctcggtaagtttcattttatttgcagaacagaggagactgcaaatgaaatgaaacaacctggcggcagcgcaaaagatg

SEQ ID NO: 159175 - DNA, 103 bp, Artificial Sequence
  Synthetic Polynucleotide
taatacgactcactatagggacaaaatcaaacgtctcggtaagtttcattaacagaggagaaatgaaatgtaccgagacaacctggcggcagcgcaaaagatg

SEQ ID NO: 159176 - DNA, 103 bp, Artificial Sequence
  Synthetic Polynucleotide
taatacgactcactataggggatgttgttgtctggactgtgttcccccataacagaggagaatggggatgcacagtccaaacctggcggcagcgcaaaagatg

SEQ ID NO: 159177 - DNA, 103 bp, Artificial Sequence
  Synthetic Polynucleotide
taatacgactcactatagggagatgaggaaggcaccagtccgtttttatcaacagaggagagataaaatgggactggtgaacctggcggcagcgcaaaagatg

SEQ ID NO: 159178 - DNA, 103 bp, Artificial Sequence
  Synthetic Polynucleotide
taatacgactcactataggggtcacttagacaaagtgagtgatttgtatcaacagaggagagatacaatgcactcacttaacctggcggcagcgcaaaagatg

SEQ ID NO: 159179 - DNA, 103 bp, Artificial Sequence
  Synthetic Polynucleotide
taatacgactcactataggggaaggctcaagtcacttagacaaagtgagtaacagaggagaactcacatggtctaagtgaacctggcggcagcgcaaaagatg

SEQ ID NO: 159180 - DNA, 103 bp, Artificial Sequence
  Synthetic Polynucleotide
taatacgactcactatagggtctgtggacagaaggctcaagtcacttagaaacagaggagatctaagatgcttgagcctaacctggcggcagcgcaaaagatg

SEQ ID NO: 159181 - DNA, 103 bp, Artificial Sequence
  Synthetic Polynucleotide
taatacgactcactatagggcaattcagaatctgtggacagaaggctcaaaacagaggagattgagcatgctgtccacaaacctggcggcagcgcaaaagatg

SEQ ID NO: 159182 - DNA, 103 bp, Artificial Sequence
  Synthetic Polynucleotide
taatacgactcactatagggaattttctcgcaattcagaatctgtggacaaacagaggagatgtccaatgattctgaataacctggcggcagcgcaaaagatg

SEQ ID NO: 159183 - DNA, 103 bp, Artificial Sequence
  Synthetic Polynucleotide
taatacgactcactataggggtcgtactggaattttctcgcaattcagaaaacagaggagattctgaatggcgagaaaaaacctggcggcagcgcaaaagatg

SEQ ID NO: 159184 - DNA, 103 bp, Artificial Sequence
  Synthetic Polynucleotide
taatacgactcactatagggctggccctgggtcgtactggaattttctcgaacagaggagacgagaaatgtccagtacgaacctggcggcagcgcaaaagatg

SEQ ID NO: 159185 - DNA, 103 bp, Artificial Sequence
  Synthetic Polynucleotide
taatacgactcactatagggtgctgaggtcctggccctgggtcgtactggaacagaggagaccagtaatgcccagggccaacctggcggcagcgcaaaagatg

SEQ ID NO: 159186 - DNA, 103 bp, Artificial Sequence
  Synthetic Polynucleotide
taatacgactcactatagggggtgaaattgtgctgaggtcctggccctggaacagaggagaccagggatgggacctcagaacctggcggcagcgcaaaagatg

SEQ ID NO: 159187 - DNA, 103 bp, Artificial Sequence
  Synthetic Polynucleotide
taatacgactcactataggggatgattgctggtgaaattgtgctgaggtcaacagaggagagacctcatgacaatttcaaacctggcggcagcgcaaaagatg

SEQ ID NO: 159188 - DNA, 103 bp, Artificial Sequence
  Synthetic Polynucleotide
taatacgactcactatagggaaacagttccagatgaggaaggcaccagtcaacagaggagagactggatgcttcctcataacctggcggcagcgcaaaagatg

SEQ ID NO: 159189 - DNA, 103 bp, Artificial Sequence
  Synthetic Polynucleotide
taatacgactcactatagggttgattcaaagatgattgctggtgaaattgaacagaggagacaatttatgcagcaatcaaacctggcggcagcgcaaaagatg

SEQ ID NO: 159190 - DNA, 103 bp, Artificial Sequence
  Synthetic Polynucleotide
taatacgactcactatagggttctggaacattgattcaaagatgattgctaacagaggagaagcaatatgctttgaatcaacctggcggcagcgcaaaagatg

SEQ ID NO: 159191 - DNA, 103 bp, Artificial Sequence
  Synthetic Polynucleotide
taatacgactcactatagggatcatctgaattctggaacattgattcaaaaacagaggagatttgaaatgatgttccagaacctggcggcagcgcaaaagatg

SEQ ID NO: 159192 - DNA, 103 bp, Artificial Sequence
  Synthetic Polynucleotide
taatacgactcactataggggaattgccgtatcatctgaattctggaacaaacagaggagatgttccatgattcagatgaacctggcggcagcgcaaaagatg

SEQ ID NO: 159193 - DNA, 103 bp, Artificial Sequence
  Synthetic Polynucleotide
taatacgactcactatagggggatcttcctgaattgccgtatcatctgaaaacagaggagattcagaatgtacggcaataacctggcggcagcgcaaaagatg

SEQ ID NO: 159194 - DNA, 103 bp, Artificial Sequence
  Synthetic Polynucleotide
taatacgactcactatagggtgtctgttgaggatcttcctgaattgccgtaacagaggagaacggcaatgcaggaagataacctggcggcagcgcaaaagatg

SEQ ID NO: 159195 - DNA, 103 bp, Artificial Sequence
  Synthetic Polynucleotide
taatacgactcactatagggtcaaggaagctgtctgttgaggatcttcctaacagaggagaaggaagatgctcaacagaaacctggcggcagcgcaaaagatg

SEQ ID NO: 159196 - DNA, 103 bp, Artificial Sequence
  Synthetic Polynucleotide
taatacgactcactatagggaaactttcagtcaaggaagctgtctgttgaaacagaggagatcaacaatgagcttccttaacctggcggcagcgcaaaagatg

SEQ ID NO: 159197 - DNA, 103 bp, Artificial Sequence
  Synthetic Polynucleotide
taatacgactcactatagggatcaccattaaaactttcagtcaaggaagcaacagaggagagcttccatgactgaaagtaacctggcggcagcgcaaaagatg

SEQ ID NO: 159198 - DNA, 103 bp, Artificial Sequence
  Synthetic Polynucleotide
taatacgactcactatagggctgactctgcatcaccattaaaactttcagaacagaggagactgaaaatgttaatggtgaacctggcggcagcgcaaaagatg

SEQ ID NO: 159199 - DNA, 103 bp, Artificial Sequence
  Synthetic Polynucleotide
taatacgactcactataggggtcctatcataaacagttccagatgaggaaaacagaggagattcctcatgtggaactgtaacctggcggcagcgcaaaagatg

SEQ ID NO: 159200 - DNA, 103 bp, Artificial Sequence
  Synthetic Polynucleotide
taatacgactcactatagggacatcactgactgactctgcatcaccattaaacagaggagataatggatgtgcagagtcaacctggcggcagcgcaaaagatg

SEQ ID NO: 159201 - DNA, 103 bp, Artificial Sequence
  Synthetic Polynucleotide
taatacgactcactatagggggatggcggaacatcactgactgactctgcaacagaggagagcagagatggtcagtgataacctggcggcagcgcaaaagatg

SEQ ID NO: 159202 - DNA, 103 bp, Artificial Sequence
  Synthetic Polynucleotide
taatacgactcactatagggaatttcctgtggatggcggaacatcactgaaacagaggagatcagtgatgttccgccataacctggcggcagcgcaaaagatg

SEQ ID NO: 159203 - DNA, 103 bp, Artificial Sequence
  Synthetic Polynucleotide
taatacgactcactatagggaaagatgctgaatttcctgtggatggcggaaacagaggagatccgccatgcacaggaaaaacctggcggcagcgcaaaagatg

SEQ ID NO: 159204 - DNA, 103 bp, Artificial Sequence
  Synthetic Polynucleotide
taatacgactcactatagggtggaagagataaagatgctgaatttcctgtaacagaggagaacaggaatgtcagcatctaacctggcggcagcgcaaaagatg

SEQ ID NO: 159205 - DNA, 103 bp, Artificial Sequence
  Synthetic Polynucleotide
taatacgactcactataggggcagtacaagtggaagagataaagatgctgaacagaggagacagcatatgtatctcttcaacctggcggcagcgcaaaagatg

SEQ ID NO: 159206 - DNA, 103 bp, Artificial Sequence
  Synthetic Polynucleotide
taatacgactcactatagggaggccaggttgcagtacaagtggaagagataacagaggagaatctctatgacttgtactaacctggcggcagcgcaaaagatg

SEQ ID NO: 159207 - DNA, 103 bp, Artificial Sequence
  Synthetic Polynucleotide
taatacgactcactatagggtggctcggagaggccaggttgcagtacaagaacagaggagacttgtaatgcaacctggcaacctggcggcagcgcaaaagatg

SEQ ID NO: 159208 - DNA, 103 bp, Artificial Sequence
  Synthetic Polynucleotide
taatacgactcactataggggaggctggggtggctcggagaggccaggttaacagaggagaaacctgatgtctccgagcaacctggcggcagcgcaaaagatg

SEQ ID NO: 159209 - DNA, 103 bp, Artificial Sequence
  Synthetic Polynucleotide
taatacgactcactataggggcaggtagtagaggctggggtggctcggagaacagaggagactccgaatgaccccagccaacctggcggcagcgcaaaagatg

SEQ ID NO: 159210 - DNA, 103 bp, Artificial Sequence
  Synthetic Polynucleotide
taatacgactcactatagggaagaacagtggtcctatcataaacagttccaacagaggagaggaactatgtatgataggaacctggcggcagcgcaaaagatg

SEQ ID NO: 159211 - DNA, 103 bp, Artificial Sequence
  Synthetic Polynucleotide
taatacgactcactatagggcggagctgaggcaggtagtagaggctggggaacagaggagaccccagatgctactacctaacctggcggcagcgcaaaagatg

SEQ ID NO: 159212 - DNA, 103 bp, Artificial Sequence
  Synthetic Polynucleotide
taatacgactcactataggggaggagcagacggagctgaggcaggtagtaaacagaggagatactacatgcctcagctcaacctggcggcagcgcaaaagatg

SEQ ID NO: 159213 - DNA, 103 bp, Artificial Sequence
  Synthetic Polynucleotide
taatacgactcactatagggggagcaggcggaggagcagacggagctgagaacagaggagactcagcatggtctgctccaacctggcggcagcgcaaaagatg

SEQ ID NO: 159214 - DNA, 103 bp, Artificial Sequence
  Synthetic Polynucleotide
taatacgactcactatagggtcctagggagggagcaggcggaggagcagaaacagaggagatctgctatgccgcctgctaacctggcggcagcgcaaaagatg

SEQ ID NO: 159215 - DNA, 103 bp, Artificial Sequence
  Synthetic Polynucleotide
taatacgactcactataggggggagccaggtcctagggagggagcaggcgaacagaggagacgcctgatgcctccctagaacctggcggcagcgcaaaagatg

SEQ ID NO: 159216 - DNA, 103 bp, Artificial Sequence
  Synthetic Polynucleotide
taatacgactcactataggggcagcttgctgggagccaggtcctagggagaacagaggagactccctatgacctggctcaacctggcggcagcgcaaaagatg

SEQ ID NO: 159217 - DNA, 103 bp, Artificial Sequence
  Synthetic Polynucleotide
taatacgactcactataggggttgccaaatgcagcttgctgggagccaggaacagaggagacctggcatgcagcaagctaacctggcggcagcgcaaaagatg

SEQ ID NO: 159218 - DNA, 103 bp, Artificial Sequence
  Synthetic Polynucleotide
taatacgactcactataggggagcaggggggttgccaaatgcagcttgctaacagaggagaagcaagatgcatttggcaaacctggcggcagcgcaaaagatg

SEQ ID NO: 159219 - DNA, 103 bp, Artificial Sequence
  Synthetic Polynucleotide
taatacgactcactatagggggttgtaagagagcaggggggttgccaaataacagaggagaatttggatgcccccctgcaacctggcggcagcgcaaaagatg

SEQ ID NO: 159220 - DNA, 103 bp, Artificial Sequence
  Synthetic Polynucleotide
taatacgactcactatagggcacttctggaggttgtaagagagcagggggaacagaggagaccccctatgctcttacaaaacctggcggcagcgcaaaagatg

SEQ ID NO: 159221 - DNA, 103 bp, Artificial Sequence
  Synthetic Polynucleotide
taatacgactcactatagggcctgctcaataagaacagtggtcctatcataacagaggagaatgataatgccactgttcaacctggcggcagcgcaaaagatg

SEQ ID NO: 159222 - DNA, 103 bp, Artificial Sequence
  Synthetic Polynucleotide
taatacgactcactatagggggggaacaggcacttctggaggttgtaagaaacagaggagatcttacatgctccagaagaacctggcggcagcgcaaaagatg

SEQ ID NO: 159223 - DNA, 103 bp, Artificial Sequence
  Synthetic Polynucleotide
taatacgactcactatagggtgtgtgctgtggggaacaggcacttctggaaacagaggagatccagaatggcctgttccaacctggcggcagcgcaaaagatg

SEQ ID NO: 159224 - DNA, 103 bp, Artificial Sequence
  Synthetic Polynucleotide
taatacgactcactatagggagcagcaaactgtgtgctgtggggaacaggaacagaggagacctgttatgcacagcacaaacctggcggcagcgcaaaagatg

SEQ ID NO: 159225 - DNA, 103 bp, Artificial Sequence
  Synthetic Polynucleotide
taatacgactcactatagggcttgatgattagcagcaaactgtgtgctgtaacagaggagaacagcaatgagtttgctgaacctggcggcagcgcaaaagatg

SEQ ID NO: 159226 - DNA, 103 bp, Artificial Sequence
  Synthetic Polynucleotide
taatacgactcactatagggggaagaaactcttgatgattagcagcaaacaacagaggagagtttgcatgtaatcatcaaacctggcggcagcgcaaaagatg

SEQ ID NO: 159227 - DNA, 103 bp, Artificial Sequence
  Synthetic Polynucleotide
taatacgactcactatagggctgggggtgcggaagaaactcttgatgattaacagaggagaaatcatatggagtttcttaacctggcggcagcgcaaaagatg

SEQ ID NO: 159228 - DNA, 103 bp, Artificial Sequence
  Synthetic Polynucleotide
taatacgactcactataggggctgcggtgcctgggggtgcggaagaaactaacagaggagaagtttcatgcgcacccccaacctggcggcagcgcaaaagatg

SEQ ID NO: 159229 - DNA, 103 bp, Artificial Sequence
  Synthetic Polynucleotide
taatacgactcactatagggggtacaatgggctgcggtgcctgggggtgcaacagaggagagcacccatgggcaccgcaaacctggcggcagcgcaaaagatg

SEQ ID NO: 159230 - DNA, 103 bp, Artificial Sequence
  Synthetic Polynucleotide
taatacgactcactatagggagaaagtcctggtacaatgggctgcggtgcaacagaggagagcaccgatgcccattgtaaacctggcggcagcgcaaaagatg

SEQ ID NO: 159231 - DNA, 103 bp, Artificial Sequence
  Synthetic Polynucleotide
taatacgactcactatagggcagcaacaacagaaagtcctggtacaatggaacagaggagaccattgatgcaggactttaacctggcggcagcgcaaaagatg

SEQ ID NO: 159232 - DNA, 103 bp, Artificial Sequence
  Synthetic Polynucleotide
taatacgactcactataggggtgccagggtcctgctcaataagaacagtgaacagaggagacactgtatgtattgagcaaacctggcggcagcgcaaaagatg

SEQ ID NO: 159233 - DNA, 103 bp, Artificial Sequence
  Synthetic Polynucleotide
taatacgactcactataggggcagaagccccagcaacaacagaaagtcctaacagaggagaaggactatgtgttgttgcaacctggcggcagcgcaaaagatg

SEQ ID NO: 159234 - DNA, 103 bp, Artificial Sequence
  Synthetic Polynucleotide
taatacgactcactatagggcgctgctgatgcagaagccccagcaacaacaacagaggagagttgttatgggggcttctaacctggcggcagcgcaaaagatg

SEQ ID NO: 159235 - DNA, 103 bp, Artificial Sequence
  Synthetic Polynucleotide
taatacgactcactatagggatgccactgccgctgctgatgcagaagcccaacagaggagagggcttatgcatcagcagaacctggcggcagcgcaaaagatg

SEQ ID NO: 159236 - DNA, 103 bp, Artificial Sequence
  Synthetic Polynucleotide
taatacgactcactataggggccacagctgatgccactgccgctgctgataacagaggagaatcagcatgggcagtggcaacctggcggcagcgcaaaagatg

SEQ ID NO: 159237 - DNA, 103 bp, Artificial Sequence
  Synthetic Polynucleotide
taatacgactcactatagggggctggtgctgccacagctgatgccactgcaacagaggagagcagtgatgtcagctgtgaacctggcggcagcgcaaaagatg

SEQ ID NO: 159238 - DNA, 103 bp, Artificial Sequence
  Synthetic Polynucleotide
taatacgactcactatagggtttgtggtggggctggtgctgccacagctgaacagaggagacagctgatgcagcaccagaacctggcggcagcgcaaaagatg

SEQ ID NO: 159239 - DNA, 103 bp, Artificial Sequence
  Synthetic Polynucleotide
taatacgactcactatagggtcagtagtactttgtggtggggctggtgctaacagaggagaagcaccatgcccaccacaaacctggcggcagcgcaaaagatg

SEQ ID NO: 159240 - DNA, 103 bp, Artificial Sequence
  Synthetic Polynucleotide
taatacgactcactatagggtggcaggggctcagtagtactttgtggtggaacagaggagaccaccaatgagtactactaacctggcggcagcgcaaaagatg

SEQ ID NO: 159241 - DNA, 103 bp, Artificial Sequence
  Synthetic Polynucleotide
taatacgactcactatagggggaccatggctggcaggggctcagtagtacaacagaggagagtactaatgagcccctgcaacctggcggcagcgcaaaagatg

SEQ ID NO: 159242 - DNA, 103 bp, Artificial Sequence
  Synthetic Polynucleotide
taatacgactcactatagggggcagagtctggaccatggctggcaggggcaacagaggagagcccctatgagccatggtaacctggcggcagcgcaaaagatg

SEQ ID NO: 159243 - DNA, 103 bp, Artificial Sequence
  Synthetic Polynucleotide
taatacgactcactatagggatcctccaaagtgccagggtcctgctcaataacagaggagaattgagatggaccctggcaacctggcggcagcgcaaaagatg

SEQ ID NO: 159244 - DNA, 103 bp, Artificial Sequence
  Synthetic Polynucleotide
taatacgactcactatagggggcacccaggggcagagtctggaccatggcaacagaggagagccatgatgcagactctgaacctggcggcagcgcaaaagatg

SEQ ID NO: 159245 - DNA, 103 bp, Artificial Sequence
  Synthetic Polynucleotide
taatacgactcactatagggggacagagttggcacccaggggcagagtctaacagaggagaagactcatgccctgggtgaacctggcggcagcgcaaaagatg

SEQ ID NO: 159246 - DNA, 103 bp, Artificial Sequence
  Synthetic Polynucleotide
taatacgactcactatagggttattagttaggacagagttggcacccaggaacagaggagacctgggatgcaactctgtaacctggcggcagcgcaaaagatg

SEQ ID NO: 159247 - DNA, 103 bp, Artificial Sequence
  Synthetic Polynucleotide
taatacgactcactatagggtattgtgggattattagttaggacagagttaacagaggagaaactctatgctaactaataacctggcggcagcgcaaaagatg

SEQ ID NO: 159248 - DNA, 103 bp, Artificial Sequence
  Synthetic Polynucleotide
taatacgactcactataggggggtgatggttattgtgggattattagttaaacagaggagataactaatgatcccacaaaacctggcggcagcgcaaaagatg

SEQ ID NO: 159249 - DNA, 103 bp, Artificial Sequence
  Synthetic Polynucleotide
taatacgactcactatagggttgggagttggggtgatggttattgtgggaaacagaggagatcccacatgaaccatcacaacctggcggcagcgcaaaagatg

SEQ ID NO: 159250 - DNA, 103 bp, Artificial Sequence
  Synthetic Polynucleotide
taatacgactcactataggggatagctgtgttgggagttggggtgatggtaacagaggagaaccatcatgccaactcccaacctggcggcagcgcaaaagatg

SEQ ID NO: 159251 - DNA, 103 bp, Artificial Sequence
  Synthetic Polynucleotide
taatacgactcactatagggtggactgcaggatagctgtgttgggagttgaacagaggagacaactcatgacacagctaaacctggcggcagcgcaaaagatg

SEQ ID NO: 159252 - DNA, 103 bp, Artificial Sequence
  Synthetic Polynucleotide
taatacgactcactatagggatgactaggctggactgcaggatagctgtgaacagaggagacacagcatgcctgcagtcaacctggcggcagcgcaaaagatg

SEQ ID NO: 159253 - DNA, 103 bp, Artificial Sequence
  Synthetic Polynucleotide
taatacgactcactatagggctgttctcccatgactaggctggactgcagaacagaggagactgcagatgagcctagtcaacctggcggcagcgcaaaagatg

SEQ ID NO: 159254 - DNA, 103 bp, Artificial Sequence
  Synthetic Polynucleotide
taatacgactcactatagggcgtcatcttcatcctccaaagtgccagggtaacagaggagaaccctgatgctttggaggaacctggcggcagcgcaaaagatg

SEQ ID NO: 159255 - DNA, 103 bp, Artificial Sequence
  Synthetic Polynucleotide
taatacgactcactatagggattgtaagttctgttctcccatgactaggcaacagaggagagcctagatgtgggagaacaacctggcggcagcgcaaaagatg

SEQ ID NO: 159256 - DNA, 103 bp, Artificial Sequence
  Synthetic Polynucleotide
taatacgactcactatagggtttaatatccattgtaagttctgttctcccaacagaggagagggagaatggaacttacaaacctggcggcagcgcaaaagatg

SEQ ID NO: 159257 - DNA, 103 bp, Artificial Sequence
  Synthetic Polynucleotide
taatacgactcactatagggggtggcaccatttaatatccattgtaagttaacagaggagaaacttaatgtggatattaaacctggcggcagcgcaaaagatg

SEQ ID NO: 159258 - DNA, 103 bp, Artificial Sequence
  Synthetic Polynucleotide
taatacgactcactataggggtggagaactggtggcaccatttaatatccaacagaggagaggatatatgatggtgccaaacctggcggcagcgcaaaagatg

SEQ ID NO: 159259 - DNA, 103 bp, Artificial Sequence
  Synthetic Polynucleotide
taatacgactcactatagggtcttggttttgtggagaactggtggcaccaaacagaggagatggtgcatgcagttctccaacctggcggcagcgcaaaagatg

SEQ ID NO: 159260 - DNA, 103 bp, Artificial Sequence
  Synthetic Polynucleotide
taatacgactcactatagggctgaatttgttcttggttttgtggagaactaacagaggagaagttctatgcaaaaccaaaacctggcggcagcgcaaaagatg

SEQ ID NO: 159261 - DNA, 103 bp, Artificial Sequence
  Synthetic Polynucleotide
taatacgactcactatagggtagatgcttgctgaatttgttcttggttttaacagaggagaaaaaccatgaacaaattcaacctggcggcagcgcaaaagatg

SEQ ID NO: 159262 - DNA, 103 bp, Artificial Sequence
  Synthetic Polynucleotide
taatacgactcactatagggttctcaactttagatgcttgctgaatttgtaacagaggagaacaaatatggcaagcatcaacctggcggcagcgcaaaagatg

SEQ ID NO: 159263 - DNA, 103 bp, Artificial Sequence
  Synthetic Polynucleotide
taatacgactcactatagggaaaaaacaccttctcaactttagatgcttgaacagaggagacaagcaatgaaagttgagaacctggcggcagcgcaaaagatg

SEQ ID NO: 159264 - DNA, 103 bp, Artificial Sequence
  Synthetic Polynucleotide
taatacgactcactatagggctgcagtggtaaaaaacaccttctcaacttaacagaggagaaagttgatgaggtgttttaacctggcggcagcgcaaaagatg

SEQ ID NO: 159265 - DNA, 103 bp, Artificial Sequence
  Synthetic Polynucleotide
taatacgactcactatagggcactgtccgtcgtcatcttcatcctccaaaaacagaggagatttggaatgtgaagatgaaacctggcggcagcgcaaaagatg

SEQ ID NO: 159266 - DNA, 103 bp, Artificial Sequence
  Synthetic Polynucleotide
taatacgactcactataggggctactggtactgcagtggtaaaaaacaccaacagaggagaggtgttatgtaccactgcaacctggcggcagcgcaaaagatg

SEQ ID NO: 159267 - DNA, 103 bp, Artificial Sequence
  Synthetic Polynucleotide
taatacgactcactatagggtgggctactggctactggtactgcagtggtaacagaggagaaccactatggtaccagtaaacctggcggcagcgcaaaagatg

SEQ ID NO: 159268 - DNA, 103 bp, Artificial Sequence
  Synthetic Polynucleotide
taatacgactcactatagggcagagctccctgggctactggctactggtaaacagaggagataccagatgccagtagccaacctggcggcagcgcaaaagatg

SEQ ID NO: 159269 - DNA, 103 bp, Artificial Sequence
  Synthetic Polynucleotide
taatacgactcactatagggatctgctggacagagctccctgggctactgaacagaggagacagtagatgagggagctcaacctggcggcagcgcaaaagatg

SEQ ID NO: 159270 - DNA, 103 bp, Artificial Sequence
  Synthetic Polynucleotide
taatacgactcactatagggactgaggccaatctgctggacagagctcccaacagaggagagggagcatggtccagcagaacctggcggcagcgcaaaagatg

SEQ ID NO: 159271 - DNA, 103 bp, Artificial Sequence
  Synthetic Polynucleotide
taatacgactcactatagggtcacaggaacactgaggccaatctgctggaaacagaggagatccagcatgttggcctcaaacctggcggcagcgcaaaagatg

SEQ ID NO: 159272 - DNA, 103 bp, Artificial Sequence
  Synthetic Polynucleotide
taatacgactcactatagggttgatgatgatcacaggaacactgaggccaaacagaggagatggcctatgtgttcctgtaacctggcggcagcgcaaaagatg

SEQ ID NO: 159273 - DNA, 103 bp, Artificial Sequence
  Synthetic Polynucleotide
taatacgactcactatagggctcttcttgtttgatgatgatcacaggaacaacagaggagagttcctatgatcatcatcaacctggcggcagcgcaaaagatg

SEQ ID NO: 159274 - DNA, 103 bp, Artificial Sequence
  Synthetic Polynucleotide
taatacgactcactatagggactgacatgcctcttcttgtttgatgatgaaacagaggagatcatcaatgaacaagaagaacctggcggcagcgcaaaagatg

SEQ ID NO: 159275 - DNA, 103 bp, Artificial Sequence
  Synthetic Polynucleotide
taatacgactcactataggggcacactgacactgacatgcctcttcttgtaacagaggagaacaagaatgggcatgtcaaacctggcggcagcgcaaaagatg

SEQ ID NO: 159276 - DNA, 103 bp, Artificial Sequence
  Synthetic Polynucleotide
taatacgactcactataggggtgttctccgcactgtccgtcgtcatcttcaacagaggagagaagatatggacggacagaacctggcggcagcgcaaaagatg

SEQ ID NO: 159277 - DNA, 103 bp, Artificial Sequence
  Synthetic Polynucleotide
taatacgactcactataggggtcccggcatgcacactgacactgacatgcaacagaggagagcatgtatgtgtcagtgtaacctggcggcagcgcaaaagatg

SEQ ID NO: 159278 - DNA, 103 bp, Artificial Sequence
  Synthetic Polynucleotide
taatacgactcactatagggcctttgcagagtcccggcatgcacactgacaacagaggagagtcagtatgcatgccgggaacctggcggcagcgcaaaagatg

SEQ ID NO: 159279 - DNA, 103 bp, Artificial Sequence
  Synthetic Polynucleotide
taatacgactcactataggggatgcccgctcctttgcagagtcccggcataacagaggagaatgccgatgctctgcaaaaacctggcggcagcgcaaaagatg

SEQ ID NO: 159280 - DNA, 103 bp, Artificial Sequence
  Synthetic Polynucleotide
taatacgactcactatagggtctcctgctggatgcccgctcctttgcagaaacagaggagatctgcaatggagcgggcaaacctggcggcagcgcaaaagatg

SEQ ID NO: 159281 - DNA, 103 bp, Artificial Sequence
  Synthetic Polynucleotide
taatacgactcactatagggagcagccctttctcctgctggatgcccgctaacagaggagaagcgggatgccagcaggaaacctggcggcagcgcaaaagatg

SEQ ID NO: 159282 - DNA, 103 bp, Artificial Sequence
  Synthetic Polynucleotide
taatacgactcactatagggggtggggaggagcagccctttctcctgctgaacagaggagacagcagatgaaagggctgaacctggcggcagcgcaaaagatg

SEQ ID NO: 159283 - DNA, 103 bp, Artificial Sequence
  Synthetic Polynucleotide
taatacgactcactatagggctctggagggggtggggaggagcagcccttaacagaggagaaagggcatgtcctccccaaacctggcggcagcgcaaaagatg

SEQ ID NO: 159284 - DNA, 103 bp, Artificial Sequence
  Synthetic Polynucleotide
taatacgactcactataggggggggctcggctctggagggggtggggaggaacagaggagacctcccatgcccctccagaacctggcggcagcgcaaaagatg

SEQ ID NO: 159285 - DNA, 103 bp, Artificial Sequence
  Synthetic Polynucleotide
taatacgactcactatagggtcaggagcctgggggctcggctctggagggaacagaggagaccctccatggccgagcccaacctggcggcagcgcaaaagatg

SEQ ID NO: 159286 - DNA, 103 bp, Artificial Sequence
  Synthetic Polynucleotide
taatacgactcactataggggctgggcccatcaggagcctgggggctcggaacagaggagaccgagcatgcaggctcctaacctggcggcagcgcaaaagatg

SEQ ID NO: 159287 - DNA, 103 bp, Artificial Sequence
  Synthetic Polynucleotide
taatacgactcactatagggcaaagtagatgatgttgttgtctggactgtaacagaggagaacagtcatgacaacaacaaacctggcggcagcgcaaaagatg

SEQ ID NO: 159288 - DNA, 103 bp, Artificial Sequence
  Synthetic Polynucleotide
taatacgactcactataggggaaaaggcaagtgttctccgcactgtccgtaacagaggagaacggacatggcggagaacaacctggcggcagcgcaaaagatg

SEQ ID NO: 159289 - DNA, 103 bp, Artificial Sequence
  Synthetic Polynucleotide
taatacgactcactatagggggagctgcaggctgggcccatcaggagcctaacagaggagaaggctcatgatgggcccaaacctggcggcagcgcaaaagatg

SEQ ID NO: 159290 - DNA, 103 bp, Artificial Sequence
  Synthetic Polynucleotide
taatacgactcactataggggtctgcgctgggagctgcaggctgggcccaaacagaggagatgggccatgcctgcagctaacctggcggcagcgcaaaagatg

SEQ ID NO: 159291 - DNA, 103 bp, Artificial Sequence
  Synthetic Polynucleotide
taatacgactcactatagggtgaagagaaagtctgcgctgggagctgcagaacagaggagactgcagatgccagcgcagaacctggcggcagcgcaaaagatg

SEQ ID NO: 159292 - DNA, 103 bp, Artificial Sequence
  Synthetic Polynucleotide
taatacgactcactataggggaacaggggctgaagagaaagtctgcgctgaacagaggagacagcgcatgctttctcttaacctggcggcagcgcaaaagatg

SEQ ID NO: 159293 - DNA, 103 bp, Artificial Sequence
  Synthetic Polynucleotide
taatacgactcactataggggatgacccgggaacaggggctgaagagaaaaacagaggagatttctcatgagcccctgtaacctggcggcagcgcaaaagatg

SEQ ID NO: 159294 - DNA, 103 bp, Artificial Sequence
  Synthetic Polynucleotide
taatacgactcactatagggggtagaggatgatgacccgggaacaggggcaacagaggagagcccctatgcccgggtcaaacctggcggcagcgcaaaagatg

SEQ ID NO: 159295 - DNA, 103 bp, Artificial Sequence
  Synthetic Polynucleotide
taatacgactcactatagggaggagggcaaggtagaggatgatgacccggaacagaggagaccgggtatgcatcctctaaacctggcggcagcgcaaaagatg

SEQ ID NO: 159296 - DNA, 103 bp, Artificial Sequence
  Synthetic Polynucleotide
taatacgactcactatagggtgctcacaggaggagggcaaggtagaggataacagaggagaatcctcatgcttgccctcaacctggcggcagcgcaaaagatg

SEQ ID NO: 159297 - DNA, 103 bp, Artificial Sequence
  Synthetic Polynucleotide
taatacgactcactatagggttgtcggctttgctcacaggaggagggcaaaacagaggagattgcccatgtcctgtgagaacctggcggcagcgcaaaagatg

SEQ ID NO: 159298 - DNA, 103 bp, Artificial Sequence
  Synthetic Polynucleotide
taatacgactcactataggggagtctctgcttgtcggctttgctcacaggaacagaggagacctgtgatgaaagccgacaacctggcggcagcgcaaaagatg

SEQ ID NO: 159299 - DNA, 103 bp, Artificial Sequence
  Synthetic Polynucleotide
taatacgactcactatagggccccctactagaaaaggcaagtgttctccgaacagaggagacggagaatgcttgcctttaacctggcggcagcgcaaaagatg

SEQ ID NO: 159300 - DNA, 103 bp, Artificial Sequence
  Synthetic Polynucleotide
taatacgactcactataggggggtctgaaggagtctctgcttgtcggcttaacagaggagaaagccgatgagcagagacaacctggcggcagcgcaaaagatg

SEQ ID NO: 159301 - DNA, 103 bp, Artificial Sequence
  Synthetic Polynucleotide
taatacgactcactatagggttctgtctgagggtctgaaggagtctctgcaacagaggagagcagagatgccttcagacaacctggcggcagcgcaaaagatg

SEQ ID NO: 159302 - DNA, 103 bp, Artificial Sequence
  Synthetic Polynucleotide
taatacgactcactatagggcacttaatgtttctgtctgagggtctgaagaacagaggagacttcagatgctcagacagaacctggcggcagcgcaaaagatg

SEQ ID NO: 159303 - DNA, 103 bp, Artificial Sequence
  Synthetic Polynucleotide
taatacgactcactatagggacatccatggcacttaatgtttctgtctgaaacagaggagatcagacatgaacattaagaacctggcggcagcgcaaaagatg

SEQ ID NO: 159304 - DNA, 103 bp, Artificial Sequence
  Synthetic Polynucleotide
taatacgactcactatagggaaactctgacacatccatggcacttaatgtaacagaggagaacattaatggccatggataacctggcggcagcgcaaaagatg

SEQ ID NO: 159305 - DNA, 103 bp, Artificial Sequence
  Synthetic Polynucleotide
taatacgactcactatagggggagggatagaaactctgacacatccatggaacagaggagaccatggatgtgtcagagtaacctggcggcagcgcaaaagatg

SEQ ID NO: 159306 - DNA, 103 bp, Artificial Sequence
  Synthetic Polynucleotide
taatacgactcactatagggtccaggctctggagggatagaaactctgacaacagaggagagtcagaatgtctatccctaacctggcggcagcgcaaaagatg

SEQ ID NO: 159307 - DNA, 103 bp, Artificial Sequence
  Synthetic Polynucleotide
taatacgactcactatagggggacggggtgtccaggctctggagggatagaacagaggagactatccatgcagagcctgaacctggcggcagcgcaaaagatg

SEQ ID NO: 159308 - DNA, 103 bp, Artificial Sequence
  Synthetic Polynucleotide
taatacgactcactataggggaatcagattggacggggtgtccaggctctaacagaggagaagagccatgacaccccgtaacctggcggcagcgcaaaagatg

SEQ ID NO: 159309 - DNA, 103 bp, Artificial Sequence
  Synthetic Polynucleotide
taatacgactcactataggggcttcaatgggaatcagattggacggggtgaacagaggagacaccccatgcaatctgataacctggcggcagcgcaaaagatg

SEQ ID NO: 159310 - DNA, 103 bp, Artificial Sequence
  Synthetic Polynucleotide
taatacgactcactataggggccctcttcaccccctactagaaaaggcaaaacagaggagattgcctatgctagtagggaacctggcggcagcgcaaaagatg

SEQ ID NO: 159311 - DNA, 103 bp, Artificial Sequence
  Synthetic Polynucleotide
taatacgactcactatagggctgcagtagtgcttcaatgggaatcagattaacagaggagaaatctgatgcccattgaaaacctggcggcagcgcaaaagatg

SEQ ID NO: 159312 - DNA, 103 bp, Artificial Sequence
  Synthetic Polynucleotide
taatacgactcactatagggcctcctccccctgcagtagtgcttcaatggaacagaggagaccattgatgcactactgcaacctggcggcagcgcaaaagatg

SEQ ID NO: 159313 - DNA, 103 bp, Artificial Sequence
  Synthetic Polynucleotide
taatacgactcactatagggaggcccatctcctcctccccctgcagtagtaacagaggagaactactatggggggaggaaacctggcggcagcgcaaaagatg

SEQ ID NO: 159314 - DNA, 103 bp, Artificial Sequence
  Synthetic Polynucleotide
taatacgactcactataggggctgctggtgaggcccatctcctcctccccaacagaggagaggggagatggagatgggcaacctggcggcagcgcaaaagatg

SEQ ID NO: 159315 - DNA, 103 bp, Artificial Sequence
  Synthetic Polynucleotide
taatacgactcactatagggacttggagaagctgctggtgaggcccatctaacagaggagaagatggatgtcaccagcaaacctggcggcagcgcaaaagatg

SEQ ID NO: 159316 - DNA, 103 bp, Artificial Sequence
  Synthetic Polynucleotide
taatacgactcactatagggtcaggtgaaagccctcttcaccccctactaaacagaggagatagtagatggtgaagaggaacctggcggcagcgcaaaagatg

SEQ ID NO: 159317 - DNA, 103 bp, Artificial Sequence
  Synthetic Polynucleotide
taatacgactcactatagggtcatgatctatcaggtgaaagccctcttcaaacagaggagatgaagaatgctttcacctaacctggcggcagcgcaaaagatg

SEQ ID NO: 159318 - DNA, 103 bp, Artificial Sequence
  Synthetic Polynucleotide
taatacgactcactatagggggacattgcttcatgatctatcaggtgaaaaacagaggagatttcacatgatagatcataacctggcggcagcgcaaaagatg

SEQ ID NO: 159319 - DNA, 103 bp, Artificial Sequence
  Synthetic Polynucleotide
taatacgactcactatagggcataaccctgggacattgcttcatgatctaaacagaggagatagatcatgaagcaatgtaacctggcggcagcgcaaaagatg

SEQ ID NO: 159320 - DNA, 103 bp, Artificial Sequence
  Synthetic Polynucleotide
taatacgactcactatagggatgtgctgcacataaccctgggacattgctaacagaggagaagcaatatgccagggttaaacctggcggcagcgcaaaagatg

SEQ ID NO: 159321 - DNA, 103 bp, Artificial Sequence
  Synthetic Polynucleotide
taatacgactcactatagggtggtgagataatgtgctgcacataaccctgaacagaggagacagggtatggtgcagcacaacctggcggcagcgcaaaagatg

SEQ ID NO: 159322 - DNA, 103 bp, Artificial Sequence
  Synthetic Polynucleotide
taatacgactcactataggggaatctgatctggtgagataatgtgctgcaaacagaggagatgcagcatgttatctcacaacctggcggcagcgcaaaagatg

SEQ ID NO: 159323 - DNA, 103 bp, Artificial Sequence
  Synthetic Polynucleotide
taatacgactcactatagggtcctctgcctcaaagtagatgatgttgttgaacagaggagacaacaaatgcatctacttaacctggcggcagcgcaaaagatg

SEQ ID NO: 159324 - DNA, 103 bp, Artificial Sequence
  Synthetic Polynucleotide
taatacgactcactatagggattgtcaaatgaatctgatctggtgagataaacagaggagatatctcatgagatcagataacctggcggcagcgcaaaagatg

SEQ ID NO: 159325 - DNA, 103 bp, Artificial Sequence
  Synthetic Polynucleotide
taatacgactcactatagggaccagggtttattgtcaaatgaatctgatcaacagaggagagatcagatgcatttgacaaacctggcggcagcgcaaaagatg

SEQ ID NO: 159326 - DNA, 103 bp, Artificial Sequence
  Synthetic Polynucleotide
taatacgactcactatagggtgggtgtggaaccagggtttattgtcaaataacagaggagaatttgaatgtaaaccctgaacctggcggcagcgcaaaagatg

SEQ ID NO: 159327 - DNA, 103 bp, Artificial Sequence
  Synthetic Polynucleotide
taatacgactcactatagggtttcttggcatgggtgtggaaccagggtttaacagaggagaaaacccatgttccacaccaacctggcggcagcgcaaaagatg

SEQ ID NO: 159328 - DNA, 103 bp, Artificial Sequence
  Synthetic Polynucleotide
taatacgactcactatagggaccttcaatatttcttggcatgggtgtggaaacagaggagatccacaatgatgccaagaaacctggcggcagcgcaaaagatg

SEQ ID NO: 159329 - DNA, 103 bp, Artificial Sequence
  Synthetic Polynucleotide
taatacgactcactatagggtgagggttgcaccttcaatatttcttggcaaacagaggagatgccaaatgatattgaagaacctggcggcagcgcaaaagatg

SEQ ID NO: 159330 - DNA, 103 bp, Artificial Sequence
  Synthetic Polynucleotide
taatacgactcactataggggactgcagagtgagggttgcaccttcaataaacagaggagatattgaatgtgcaaccctaacctggcggcagcgcaaaagatg

SEQ ID NO: 159331 - DNA, 103 bp, Artificial Sequence
  Synthetic Polynucleotide
taatacgactcactatagggcggacattccgactgcagagtgagggttgcaacagaggagagcaaccatgactctgcagaacctggcggcagcgcaaaagatg

SEQ ID NO: 159332 - DNA, 103 bp, Artificial Sequence
  Synthetic Polynucleotide
taatacgactcactataggggttttgtttccggacattccgactgcagagaacagaggagactctgcatgcggaatgtcaacctggcggcagcgcaaaagatg

SEQ ID NO: 159333 - DNA, 103 bp, Artificial Sequence
  Synthetic Polynucleotide
taatacgactcactatagggacttctttacgttttgtttccggacattccaacagaggagaggaatgatgggaaacaaaaacctggcggcagcgcaaaagatg

SEQ ID NO: 159334 - DNA, 103 bp, Artificial Sequence
  Synthetic Polynucleotide
taatacgactcactatagggcagctcatcttcctctgcctcaaagtagataacagaggagaatctacatggaggcagagaacctggcggcagcgcaaaagatg

SEQ ID NO: 159335 - DNA, 103 bp, Artificial Sequence
  Synthetic Polynucleotide
taatacgactcactataggggtaccgctttacttctttacgttttgtttcaacagaggagagaaacaatgcgtaaagaaaacctggcggcagcgcaaaagatg

SEQ ID NO: 159336 - DNA, 103 bp, Artificial Sequence
  Synthetic Polynucleotide
taatacgactcactatagggaggtacattggtaccgctttacttctttacaacagaggagagtaaagatgtaaagcggtaacctggcggcagcgcaaaagatg

SEQ ID NO: 159337 - DNA, 103 bp, Artificial Sequence
  Synthetic Polynucleotide
taatacgactcactatagggcagccctcaaaggtacattggtaccgctttaacagaggagaaaagcgatgccaatgtacaacctggcggcagcgcaaaagatg

SEQ ID NO: 159338 - DNA, 103 bp, Artificial Sequence
  Synthetic Polynucleotide
taatacgactcactatagggggtgcggggacagccctcaaaggtacattgaacagaggagacaatgtatgtttgagggcaacctggcggcagcgcaaaagatg

SEQ ID NO: 159339 - DNA, 103 bp, Artificial Sequence
  Synthetic Polynucleotide
taatacgactcactatagggctgtgctgtaggtgcggggacagccctcaaaacagaggagattgaggatggtccccgcaaacctggcggcagcgcaaaagatg

SEQ ID NO: 159340 - DNA, 103 bp, Artificial Sequence
  Synthetic Polynucleotide
taatacgactcactatagggaggttgcctgctgtgctgtaggtgcggggaaacagaggagatccccgatgctacagcacaacctggcggcagcgcaaaagatg

SEQ ID NO: 159341 - DNA, 103 bp, Artificial Sequence
  Synthetic Polynucleotide
taatacgactcactataggggtgggttcgcaggttgcctgctgtgctgtaaacagaggagatacagcatggcaggcaacaacctggcggcagcgcaaaagatg

SEQ ID NO: 159342 - DNA, 103 bp, Artificial Sequence
  Synthetic Polynucleotide
taatacgactcactataggggagtcttctggtgggttcgcaggttgcctgaacagaggagacaggcaatgtgcgaacccaacctggcggcagcgcaaaagatg

SEQ ID NO: 159343 - DNA, 103 bp, Artificial Sequence
  Synthetic Polynucleotide
taatacgactcactatagggtctcctcggtgagtcttctggtgggttcgcaacagaggagagcgaacatgccagaagacaacctggcggcagcgcaaaagatg

SEQ ID NO: 159344 - DNA, 103 bp, Artificial Sequence
  Synthetic Polynucleotide
taatacgactcactatagggaaaggtgtactctcctcggtgagtcttctgaacagaggagacagaagatgcaccgaggaaacctggcggcagcgcaaaagatg

SEQ ID NO: 159345 - DNA, 103 bp, Artificial Sequence
  Synthetic Polynucleotide
taatacgactcactatagggcatcgggggtcagctcatcttcctctgcctaacagaggagaaggcagatgaagatgagcaacctggcggcagcgcaaaagatg

SEQ ID NO: 159346 - DNA, 103 bp, Artificial Sequence
  Synthetic Polynucleotide
taatacgactcactataggggattacagacaaaggtgtactctcctcggtaacagaggagaaccgagatgagtacacctaacctggcggcagcgcaaaagatg

SEQ ID NO: 159347 - DNA, 103 bp, Artificial Sequence
  Synthetic Polynucleotide
taatacgactcactatagggcagccctcctgattacagacaaaggtgtacaacagaggagagtacacatgtgtctgtaaaacctggcggcagcgcaaaagatg

SEQ ID NO: 159348 - DNA, 103 bp, Artificial Sequence
  Synthetic Polynucleotide
taatacgactcactatagggggctttgccacagccctcctgattacagacaacagaggagagtctgtatgcaggagggcaacctggcggcagcgcaaaagatg

SEQ ID NO: 159349 - DNA, 103 bp, Artificial Sequence
  Synthetic Polynucleotide
taatacgactcactatagggaggtaaggaaggctttgccacagccctcctaacagaggagaaggaggatggtggcaaagaacctggcggcagcgcaaaagatg

SEQ ID NO: 159350 - DNA, 103 bp, Artificial Sequence
  Synthetic Polynucleotide
taatacgactcactatagggaggctgtaagaggtaaggaaggctttgccaaacagaggagatggcaaatgcttccttacaacctggcggcagcgcaaaagatg

SEQ ID NO: 159351 - DNA, 103 bp, Artificial Sequence
  Synthetic Polynucleotide
taatacgactcactataggggtggatcctgaggctgtaagaggtaaggaaaacagaggagattccttatgtcttacagcaacctggcggcagcgcaaaagatg

SEQ ID NO: 159352 - DNA, 103 bp, Artificial Sequence
  Synthetic Polynucleotide
taatacgactcactataggggcactcgcacgtggatcctgaggctgtaagaacagaggagacttacaatgtcaggatccaacctggcggcagcgcaaaagatg

SEQ ID NO: 159353 - DNA, 103 bp, Artificial Sequence
  Synthetic Polynucleotide
taatacgactcactatagggtccttcgtgtgcactcgcacgtggatcctgaacagaggagacaggatatgcgtgcgagtaacctggcggcagcgcaaaagatg

SEQ ID NO: 159354 - DNA, 103 bp, Artificial Sequence
  Synthetic Polynucleotide
taatacgactcactatagggaaatggcttctccttcgtgtgcactcgcacaacagaggagagtgcgaatgcacacgaagaacctggcggcagcgcaaaagatg

SEQ ID NO: 159355 - DNA, 103 bp, Artificial Sequence
  Synthetic Polynucleotide
taatacgactcactatagggcgtcacactcaaatggcttctccttcgtgtaacagaggagaacacgaatgagaagccataacctggcggcagcgcaaaagatg

SEQ ID NO: 159356 - DNA, 103 bp, Artificial Sequence
  Synthetic Polynucleotide
taatacgactcactatagggagcattttatcatcgggggtcagctcatctaacagaggagaagatgaatggacccccgaaacctggcggcagcgcaaaagatg

SEQ ID NO: 159357 - DNA, 103 bp, Artificial Sequence
  Synthetic Polynucleotide
taatacgactcactatagggcagccctgcacgtcacactcaaatggcttcaacagaggagagaagccatgtgagtgtgaaacctggcggcagcgcaaaagatg

SEQ ID NO: 159358 - DNA, 103 bp, Artificial Sequence
  Synthetic Polynucleotide
taatacgactcactatagggtgccttctcacagccctgcacgtcacactcaacagaggagagagtgtatggtgcagggcaacctggcggcagcgcaaaagatg

SEQ ID NO: 159359 - DNA, 103 bp, Artificial Sequence
  Synthetic Polynucleotide
taatacgactcactataggggtgtgttgaatgccttctcacagccctgcaaacagaggagatgcaggatggtgagaaggaacctggcggcagcgcaaaagatg

SEQ ID NO: 159360 - DNA, 103 bp, Artificial Sequence
  Synthetic Polynucleotide
taatacgactcactatagggagcctgtacagtgtgttgaatgccttctcaaacagaggagatgagaaatgattcaacacaacctggcggcagcgcaaaagatg

SEQ ID NO: 159361 - DNA, 103 bp, Artificial Sequence
  Synthetic Polynucleotide
taatacgactcactatagggatgtgctttcagcctgtacagtgtgttgaaaacagaggagattcaacatgctgtacaggaacctggcggcagcgcaaaagatg

SEQ ID NO: 159362 - DNA, 103 bp, Artificial Sequence
  Synthetic Polynucleotide
taatacgactcactataggggaagcctctgatgtgctttcagcctgtacaaacagaggagatgtacaatgtgaaagcacaacctggcggcagcgcaaaagatg

SEQ ID NO: 159363 - DNA, 103 bp, Artificial Sequence
  Synthetic Polynucleotide
taatacgactcactatagggttccctgtgtgaagcctctgatgtgctttcaacagaggagagaaagcatgtcagaggctaacctggcggcagcgcaaaagatg

SEQ ID NO: 159364 - DNA, 103 bp, Artificial Sequence
  Synthetic Polynucleotide
taatacgactcactataggggttaaacgttttccctgtgtgaagcctctgaacagaggagacagaggatgcacacagggaacctggcggcagcgcaaaagatg

SEQ ID NO: 159365 - DNA, 103 bp, Artificial Sequence
  Synthetic Polynucleotide
taatacgactcactatagggcagattcacagttaaacgttttccctgtgtaacagaggagaacacagatgaaacgtttaaacctggcggcagcgcaaaagatg

SEQ ID NO: 159366 - DNA, 103 bp, Artificial Sequence
  Synthetic Polynucleotide
taatacgactcactatagggctgcagccttcagattcacagttaaacgttaacagaggagaaacgttatgctgtgaatcaacctggcggcagcgcaaaagatg

SEQ ID NO: 159367 - DNA, 103 bp, Artificial Sequence
  Synthetic Polynucleotide
taatacgactcactatagggcacaaacctgagcattttatcatcgggggtaacagaggagaacccccatggataaaatgaacctggcggcagcgcaaaagatg

SEQ ID NO: 159368 - DNA, 103 bp, Artificial Sequence
  Synthetic Polynucleotide
taatacgactcactataggggaagtatttgctgcagccttcagattcacaaacagaggagatgtgaaatggaaggctgcaacctggcggcagcgcaaaagatg

SEQ ID NO: 159369 - DNA, 103 bp, Artificial Sequence
  Synthetic Polynucleotide
taatacgactcactatagggtgagtgtggtgaagtatttgctgcagccttaacagaggagaaaggctatggcaaatactaacctggcggcagcgcaaaagatg

SEQ ID NO: 159370 - DNA, 103 bp, Artificial Sequence
  Synthetic Polynucleotide
taatacgactcactatagggctcagatcactgagtgtggtgaagtatttgaacagaggagacaaataatgcaccacactaacctggcggcagcgcaaaagatg

SEQ ID NO: 159371 - DNA, 103 bp, Artificial Sequence
  Synthetic Polynucleotide
taatacgactcactatagggaatgtgcttcctcagatcactgagtgtggtaacagaggagaaccacaatgagtgatctgaacctggcggcagcgcaaaagatg

SEQ ID NO: 159372 - DNA, 103 bp, Artificial Sequence
  Synthetic Polynucleotide
taatacgactcactatagggtatgagttcgaatgtgcttcctcagatcacaacagaggagagtgatcatgggaagcacaaacctggcggcagcgcaaaagatg

SEQ ID NO: 159373 - DNA, 103 bp, Artificial Sequence
  Synthetic Polynucleotide
taatacgactcactatagggttttcccctgtatgagttcgaatgtgcttcaacagaggagagaagcaatgtcgaactcaaacctggcggcagcgcaaaagatg

SEQ ID NO: 159374 - DNA, 103 bp, Artificial Sequence
  Synthetic Polynucleotide
taatacgactcactatagggccgaaatggcttttcccctgtatgagttcgaacagaggagacgaactatgacaggggaaaacctggcggcagcgcaaaagatg

SEQ ID NO: 159375 - DNA, 103 bp, Artificial Sequence
  Synthetic Polynucleotide
taatacgactcactatagggcgtgatcgcaccgaaatggcttttcccctgaacagaggagacaggggatgagccatttcaacctggcggcagcgcaaaagatg

SEQ ID NO: 159376 - DNA, 103 bp, Artificial Sequence
  Synthetic Polynucleotide
taatacgactcactatagggccacagccatcgtgatcgcaccgaaatggcaacagaggagagccattatggtgcgatcaaacctggcggcagcgcaaaagatg

SEQ ID NO: 159377 - DNA, 103 bp, Artificial Sequence
  Synthetic Polynucleotide
taatacgactcactatagggaaatgcttttccacagccatcgtgatcgcaaacagaggagatgcgatatggatggctgtaacctggcggcagcgcaaaagatg

SEQ ID NO: 159378 - DNA, 103 bp, Artificial Sequence
  Synthetic Polynucleotide
taatacgactcactatagggcgtttttatccacaaacctgagcattttataacagaggagaataaaaatgtcaggtttgaacctggcggcagcgcaaaagatg

SEQ ID NO: 159379 - DNA, 103 bp, Artificial Sequence
  Synthetic Polynucleotide
taatacgactcactatagggggcttgctgcaaatgcttttccacagccataacagaggagaatggctatggaaaagcataacctggcggcagcgcaaaagatg

SEQ ID NO: 159380 - DNA, 103 bp, Artificial Sequence
  Synthetic Polynucleotide
taatacgactcactatagggttaaggtggtggcttgctgcaaatgcttttaacagaggagaaaaagcatgtgcagcaagaacctggcggcagcgcaaaagatg

SEQ ID NO: 159381 - DNA, 103 bp, Artificial Sequence
  Synthetic Polynucleotide
taatacgactcactatagggaacgtgagttttaaggtggtggcttgctgcaacagaggagagcagcaatgcaccaccttaacctggcggcagcgcaaaagatg

SEQ ID NO: 159382 - DNA, 103 bp, Artificial Sequence
  Synthetic Polynucleotide
taatacgactcactatagggtatgtgtacgaacgtgagttttaaggtggtaacagaggagaaccaccatgaaactcacgaacctggcggcagcgcaaaagatg

SEQ ID NO: 159383 - DNA, 103 bp, Artificial Sequence
  Synthetic Polynucleotide
taatacgactcactatagggctttcaccagtatgtgtacgaacgtgagttaacagaggagaaactcaatgtcgtacacaaacctggcggcagcgcaaaagatg

SEQ ID NO: 159384 - DNA, 103 bp, Artificial Sequence
  Synthetic Polynucleotide
taatacgactcactataggggaagaagggtctttcaccagtatgtgtacgaacagaggagacgtacaatgactggtgaaaacctggcggcagcgcaaaagatg

SEQ ID NO: 159385 - DNA, 103 bp, Artificial Sequence
  Synthetic Polynucleotide
taatacgactcactatagggtactggggcagaagaagggtctttcaccagaacagaggagactggtgatggacccttctaacctggcggcagcgcaaaagatg

SEQ ID NO: 159386 - DNA, 103 bp, Artificial Sequence
  Synthetic Polynucleotide
taatacgactcactatagggtcacagccattactggggcagaagaagggtaacagaggagaacccttatgctgccccagaacctggcggcagcgcaaaagatg

SEQ ID NO: 159387 - DNA, 103 bp, Artificial Sequence
  Synthetic Polynucleotide
taatacgactcactataggggaatgttttctcacagccattactggggcaaacagaggagatgccccatgaatggctgtaacctggcggcagcgcaaaagatg

SEQ ID NO: 159388 - DNA, 103 bp, Artificial Sequence
  Synthetic Polynucleotide
taatacgactcactatagggattgagtgctgaatgttttctcacagccataacagaggagaatggctatgagaaaacataacctggcggcagcgcaaaagatg

SEQ ID NO: 159389 - DNA, 103 bp, Artificial Sequence
  Synthetic Polynucleotide
taatacgactcactatagggggcaccagtccgtttttatccacaaacctgaacagaggagacaggttatgggataaaaaaacctggcggcagcgcaaaagatg

SEQ ID NO: 159390 - DNA, 103 bp, Artificial Sequence
  Synthetic Polynucleotide
taatacgactcactatagggttgagactgtattgagtgctgaatgttttcaacagaggagagaaaacatgcagcactcaaacctggcggcagcgcaaaagatg

SEQ ID NO: 159391 - DNA, 103 bp, Artificial Sequence
  Synthetic Polynucleotide
taatacgactcactatagggcatgtgacttttgagactgtattgagtgctaacagaggagaagcactatgtacagtctcaacctggcggcagcgcaaaagatg

SEQ ID NO: 159392 - DNA, 103 bp, Artificial Sequence
  Synthetic Polynucleotide
taatacgactcactatagggcatgacctttcatgtgacttttgagactgtaacagaggagaacagtcatgaaagtcacaaacctggcggcagcgcaaaagatg

SEQ ID NO: 159393 - DNA, 103 bp, Artificial Sequence
  Synthetic Polynucleotide
taatacgactcactatagggcctttgttatcatgacctttcatgtgacttaacagaggagaaagtcaatggaaaggtcaaacctggcggcagcgcaaaagatg

SEQ ID NO: 159394 - DNA, 103 bp, Artificial Sequence
  Synthetic Polynucleotide
taatacgactcactataggggtatgagtgtcctttgttatcatgacctttaacagaggagaaaaggtatggataacaaaaacctggcggcagcgcaaaagatg

SEQ ID NO: 159395 - DNA, 103 bp, Artificial Sequence
  Synthetic Polynucleotide
taatacgactcactataggggaagtgcattgtatgagtgtcctttgttataacagaggagaataacaatggacactcataacctggcggcagcgcaaaagatg

SEQ ID NO: 159396 - DNA, 103 bp, Artificial Sequence
  Synthetic Polynucleotide
taatacgactcactatagggttgtgttgtggaagtgcattgtatgagtgtaacagaggagaacactcatgcaatgcactaacctggcggcagcgcaaaagatg

SEQ ID NO: 159397 - DNA, 103 bp, Artificial Sequence
  Synthetic Polynucleotide
taatacgactcactatagggctctgatccattgtgttgtggaagtgcattaacagaggagaaatgcaatgccacaacacaacctggcggcagcgcaaaagatg

SEQ ID NO: 159398 - DNA, 103 bp, Artificial Sequence
  Synthetic Polynucleotide
taatacgactcactataggggatttgtatcctctgatccattgtgttgtgaacagaggagacacaacatgatggatcagaacctggcggcagcgcaaaagatg

SEQ ID NO: 159399 - DNA, 103 bp, Artificial Sequence
  Synthetic Polynucleotide
taatacgactcactatagggcaaagtgagtgatttgtatcctctgatccaaacagaggagatggatcatgggatacaaaaacctggcggcagcgcaaaagatg

SEQ ID NO: 159400 - DNA, 103 bp, Artificial Sequence
  Synthetic Polynucleotide
taatacgactcactatagggtgaattacctgcccctgtagagtctctcataacagaggagaatgagaatgtctacagggaacctggcggcagcgcaaaagatg

SEQ ID NO: 159401 - DNA, 103 bp, Artificial Sequence
  Synthetic Polynucleotide
taatacgactcactatagggtttggctttatgtccatcctgtaaagacagaacagaggagactgtctatgcaggatggaaacctggcggcagcgcaaaagatg

SEQ ID NO: 159402 - DNA, 103 bp, Artificial Sequence
  Synthetic Polynucleotide
taatacgactcactatagggcttcttctttatttctttcccagacataaaaacagaggagatttatgatggggaaagaaaacctggcggcagcgcaaaagatg

SEQ ID NO: 159403 - DNA, 103 bp, Artificial Sequence
  Synthetic Polynucleotide
taatacgactcactatagggacaaatgcttcttcttctttatttctttccaacagaggagaggaaagatgtaaagaagaaacctggcggcagcgcaaaagatg

SEQ ID NO: 159404 - DNA, 103 bp, Artificial Sequence
  Synthetic Polynucleotide
taatacgactcactatagggcgcaacccaaacaaatgcttcttcttctttaacagaggagaaaagaaatggaagcatttaacctggcggcagcgcaaaagatg

SEQ ID NO: 159405 - DNA, 103 bp, Artificial Sequence
  Synthetic Polynucleotide
taatacgactcactatagggaacacgaattcgcaacccaaacaaatgcttaacagaggagaaagcatatgtttgggttgaacctggcggcagcgcaaaagatg

SEQ ID NO: 159406 - DNA, 103 bp, Artificial Sequence
  Synthetic Polynucleotide
taatacgactcactataggggcacaggaggaacacgaattcgcaacccaaaacagaggagattgggtatggaattcgtgaacctggcggcagcgcaaaagatg

SEQ ID NO: 159407 - DNA, 103 bp, Artificial Sequence
  Synthetic Polynucleotide
taatacgactcactatagggacatttggtggcacaggaggaacacgaattaacagaggagaaattcgatgtcctcctgtaacctggcggcagcgcaaaagatg

SEQ ID NO: 159408 - DNA, 103 bp, Artificial Sequence
  Synthetic Polynucleotide
taatacgactcactatagggtttgaaagccacatttggtggcacaggaggaacagaggagacctcctatgccaccaaataacctggcggcagcgcaaaagatg

SEQ ID NO: 159409 - DNA, 103 bp, Artificial Sequence
  Synthetic Polynucleotide
taatacgactcactatagggctttctctgctttgaaagccacatttggtgaacagaggagacaccaaatgtggctttcaaacctggcggcagcgcaaaagatg

SEQ ID NO: 159410 - DNA, 103 bp, Artificial Sequence
  Synthetic Polynucleotide
taatacgactcactatagggccttcaggttctttctctgctttgaaagccaacagaggagaggctttatgagcagagaaaacctggcggcagcgcaaaagatg

SEQ ID NO: 159411 - DNA, 103 bp, Artificial Sequence
  Synthetic Polynucleotide
taatacgactcactatagggatgagatgttccttcaggttctttctctgcaacagaggagagcagagatggaacctgaaaacctggcggcagcgcaaaagatg

SEQ ID NO: 159412 - DNA, 103 bp, Artificial Sequence
  Synthetic Polynucleotide
taatacgactcactatagggatgctggctttttggctttatgtccatcctaacagaggagaaggatgatgataaagccaaacctggcggcagcgcaaaagatg

SEQ ID NO: 159413 - DNA, 103 bp, Artificial Sequence
  Synthetic Polynucleotide
taatacgactcactatagggttttaaattcatgagatgttccttcaggttaacagaggagaaacctgatggaacatctcaacctggcggcagcgcaaaagatg

SEQ ID NO: 159414 - DNA, 103 bp, Artificial Sequence
  Synthetic Polynucleotide
taatacgactcactatagggctgcctttaattttaaattcatgagatgttaacagaggagaaacatcatgtgaatttaaaacctggcggcagcgcaaaagatg

SEQ ID NO: 159415 - DNA, 103 bp, Artificial Sequence
  Synthetic Polynucleotide
taatacgactcactatagggggatgcctttctgcctttaattttaaattcaacagaggagagaatttatgattaaaggcaacctggcggcagcgcaaaagatg

SEQ ID NO: 159416 - DNA, 103 bp, Artificial Sequence
  Synthetic Polynucleotide
taatacgactcactatagggatataggtttggatgcctttctgcctttaaaacagaggagattaaagatggaaaggcataacctggcggcagcgcaaaagatg

SEQ ID NO: 159417 - DNA, 103 bp, Artificial Sequence
  Synthetic Polynucleotide
taatacgactcactatagggcttgaatcagatataggtttggatgcctttaacagaggagaaaaggcatgcaaacctataacctggcggcagcgcaaaagatg

SEQ ID NO: 159418 - DNA, 103 bp, Artificial Sequence
  Synthetic Polynucleotide
taatacgactcactataggggcttacttcccttgaatcagatataggtttaacagaggagaaaacctatgtctgattcaaacctggcggcagcgcaaaagatg

SEQ ID NO: 159419 - DNA, 103 bp, Artificial Sequence
  Synthetic Polynucleotide
taatacgactcactatagggctatgccattgcttacttcccttgaatcagaacagaggagactgattatggggaagtaaaacctggcggcagcgcaaaagatg

SEQ ID NO: 159420 - DNA, 103 bp, Artificial Sequence
  Synthetic Polynucleotide
taatacgactcactatagggccttttttttctatgccattgcttacttccaacagaggagaggaagtatgcaatggcataacctggcggcagcgcaaaagatg

SEQ ID NO: 159421 - DNA, 103 bp, Artificial Sequence
  Synthetic Polynucleotide
taatacgactcactatagggttttttctttccttttttttctatgccattaacagaggagaaatggcatggaaaaaaaaaacctggcggcagcgcaaaagatg

SEQ ID NO: 159422 - DNA, 103 bp, Artificial Sequence
  Synthetic Polynucleotide
taatacgactcactataggggacctacagattttttctttccttttttttaacagaggagaaaaaaaatggaaagaaaaaacctggcggcagcgcaaaagatg

SEQ ID NO: 159423 - DNA, 103 bp, Artificial Sequence
  Synthetic Polynucleotide
taatacgactcactatagggtcaaatttacatgctggctttttggctttaaacagaggagataaagcatgaaagccagcaacctggcggcagcgcaaaagatg

SEQ ID NO: 159424 - DNA, 103 bp, Artificial Sequence
  Synthetic Polynucleotide
taatacgactcactatagggccaggtggacgacctacagattttttctttaacagaggagaaaagaaatgatctgtaggaacctggcggcagcgcaaaagatg

SEQ ID NO: 159425 - DNA, 103 bp, Artificial Sequence
  Synthetic Polynucleotide
taatacgactcactatagggtgtatatgggccaggtggacgacctacagaaacagaggagatctgtaatgcgtccacctaacctggcggcagcgcaaaagatg

SEQ ID NO: 159426 - DNA, 103 bp, Artificial Sequence
  Synthetic Polynucleotide
taatacgactcactatagggtcatttttcttgtatatgggccaggtggacaacagaggagagtccacatggcccatataaacctggcggcagcgcaaaagatg

SEQ ID NO: 159427 - DNA, 103 bp, Artificial Sequence
  Synthetic Polynucleotide
taatacgactcactataggggttttttgaatcatttttcttgtatatgggaacagaggagacccataatgaagaaaaataacctggcggcagcgcaaaagatg

SEQ ID NO: 159428 - DNA, 103 bp, Artificial Sequence
  Synthetic Polynucleotide
taatacgactcactatagggtggctcagcagttttttgaatcatttttctaacagaggagaagaaaaatgattcaaaaaaacctggcggcagcgcaaaagatg

SEQ ID NO: 159429 - DNA, 103 bp, Artificial Sequence
  Synthetic Polynucleotide
taatacgactcactatagggtatccaaaagtggctcagcagttttttgaaaacagaggagattcaaaatgctgctgagcaacctggcggcagcgcaaaagatg

SEQ ID NO: 159430 - DNA, 103 bp, Artificial Sequence
  Synthetic Polynucleotide
taatacgactcactatagggattgattccttatccaaaagtggctcagcaaacagaggagatgctgaatgacttttggaaacctggcggcagcgcaaaagatg

SEQ ID NO: 159431 - DNA, 103 bp, Artificial Sequence
  Synthetic Polynucleotide
taatacgactcactatagggattctctgaaattgattccttatccaaaagaacagaggagacttttgatgaaggaatcaaacctggcggcagcgcaaaagatg

SEQ ID NO: 159432 - DNA, 103 bp, Artificial Sequence
  Synthetic Polynucleotide
taatacgactcactatagggccaaagtaggattctctgaaattgattcctaacagaggagaaggaatatgtttcagagaaacctggcggcagcgcaaaagatg

SEQ ID NO: 159433 - DNA, 103 bp, Artificial Sequence
  Synthetic Polynucleotide
taatacgactcactatagggcaaggtaaatccaaagtaggattctctgaaaacagaggagattcagaatgtcctactttaacctggcggcagcgcaaaagatg

SEQ ID NO: 159434 - DNA, 103 bp, Artificial Sequence
  Synthetic Polynucleotide
taatacgactcactatagggctgaccctcttcaaatttacatgctggcttaacagaggagaaagccaatgtgtaaatttaacctggcggcagcgcaaaagatg

SEQ ID NO: 159435 - DNA, 103 bp, Artificial Sequence
  Synthetic Polynucleotide
taatacgactcactatagggccctatagaacaaggtaaatccaaagtaggaacagaggagacctactatggatttacctaacctggcggcagcgcaaaagatg

SEQ ID NO: 159436 - DNA, 103 bp, Artificial Sequence
  Synthetic Polynucleotide
taatacgactcactatagggcctcagttctccctatagaacaaggtaaataacagaggagaatttacatggttctatagaacctggcggcagcgcaaaagatg

SEQ ID NO: 159437 - DNA, 103 bp, Artificial Sequence
  Synthetic Polynucleotide
taatacgactcactatagggtgtgcagttccctcagttctccctatagaaaacagaggagattctatatggagaactgaaacctggcggcagcgcaaaagatg

SEQ ID NO: 159438 - DNA, 103 bp, Artificial Sequence
  Synthetic Polynucleotide
taatacgactcactatagggattggatgaatgtgcagttccctcagttctaacagaggagaagaactatgggaactgcaaacctggcggcagcgcaaaagatg

SEQ ID NO: 159439 - DNA, 103 bp, Artificial Sequence
  Synthetic Polynucleotide
taatacgactcactatagggcatctgaggtattggatgaatgtgcagttcaacagaggagagaactgatgattcatccaaacctggcggcagcgcaaaagatg

SEQ ID NO: 159440 - DNA, 103 bp, Artificial Sequence
  Synthetic Polynucleotide
taatacgactcactataggggtgaaatccacatctgaggtattggatgaaaacagaggagattcatcatgtacctcagaaacctggcggcagcgcaaaagatg

SEQ ID NO: 159441 - DNA, 103 bp, Artificial Sequence
  Synthetic Polynucleotide
taatacgactcactatagggggaagcacccgtgaaatccacatctgaggtaacagaggagaacctcaatggtggatttcaacctggcggcagcgcaaaagatg

SEQ ID NO: 159442 - DNA, 103 bp, Artificial Sequence
  Synthetic Polynucleotide
taatacgactcactatagggcttttgcactggaagcacccgtgaaatccaaacagaggagatggattatgcgggtgcttaacctggcggcagcgcaaaagatg

SEQ ID NO: 159443 - DNA, 103 bp, Artificial Sequence
  Synthetic Polynucleotide
taatacgactcactataggggaggtagtttcttttgcactggaagcacccaacagaggagagggtgcatgcagtgcaaaaacctggcggcagcgcaaaagatg

SEQ ID NO: 159444 - DNA, 103 bp, Artificial Sequence
  Synthetic Polynucleotide
taatacgactcactatagggaatgctagacgaggtagtttcttttgcactaacagaggagaagtgcaatggaaactaccaacctggcggcagcgcaaaagatg

SEQ ID NO: 159445 - DNA, 103 bp, Artificial Sequence
  Synthetic Polynucleotide
taatacgactcactatagggctaggacatcctgaccctcttcaaatttacaacagaggagagtaaatatgaagagggtcaacctggcggcagcgcaaaagatg

SEQ ID NO: 159446 - DNA, 103 bp, Artificial Sequence
  Synthetic Polynucleotide
taatacgactcactatagggaatgcctggaaatgctagacgaggtagtttaacagaggagaaaactaatgcgtctagcaaacctggcggcagcgcaaaagatg

SEQ ID NO: 159447 - DNA, 103 bp, Artificial Sequence
  Synthetic Polynucleotide
taatacgactcactataggggataatccataatgcctggaaatgctagacaacagaggagagtctagatgttccaggcaaacctggcggcagcgcaaaagatg

SEQ ID NO: 159448 - DNA, 103 bp, Artificial Sequence
  Synthetic Polynucleotide
taatacgactcactatagggtctggagtcagataatccataatgcctggaaacagaggagatccaggatgtatggattaaacctggcggcagcgcaaaagatg

SEQ ID NO: 159449 - DNA, 103 bp, Artificial Sequence
  Synthetic Polynucleotide
taatacgactcactataggggcgttctttttctggagtcagataatccataacagaggagaatggatatgctgactccaaacctggcggcagcgcaaaagatg

SEQ ID NO: 159450 - DNA, 103 bp, Artificial Sequence
  Synthetic Polynucleotide
taatacgactcactatagggcttcctgtacgcgttctttttctggagtcaaacagaggagatgactcatgaaaaagaacaacctggcggcagcgcaaaagatg

SEQ ID NO: 159451 - DNA, 103 bp, Artificial Sequence
  Synthetic Polynucleotide
taatacgactcactatagggaggccaagatcttcctgtacgcgttcttttaacagaggagaaaaagaatgcgtacaggaaacctggcggcagcgcaaaagatg

SEQ ID NO: 159452 - DNA, 103 bp, Artificial Sequence
  Synthetic Polynucleotide
taatacgactcactataggggtattgcagcaggccaagatcttcctgtacaacagaggagagtacagatggatcttggcaacctggcggcagcgcaaaagatg

SEQ ID NO: 159453 - DNA, 103 bp, Artificial Sequence
  Synthetic Polynucleotide
taatacgactcactatagggcgcaaatgtggtattgcagcaggccaagataacagaggagaatcttgatgtgctgcaataacctggcggcagcgcaaaagatg

SEQ ID NO: 159454 - DNA, 103 bp, Artificial Sequence
  Synthetic Polynucleotide
taatacgactcactatagggtcttcttctccgcaaatgtggtattgcagcaacagaggagagctgcaatgccacatttgaacctggcggcagcgcaaaagatg

SEQ ID NO: 159455 - DNA, 103 bp, Artificial Sequence
  Synthetic Polynucleotide
taatacgactcactataggggaagacgacctcttcttctccgcaaatgtgaacagaggagacacattatgggagaagaaaacctggcggcagcgcaaaagatg

SEQ ID NO: 159456 - DNA, 103 bp, Artificial Sequence
  Synthetic Polynucleotide
taatacgactcactataggggaccatctagctaggacatcctgaccctctaacagaggagaagagggatgggatgtcctaacctggcggcagcgcaaaagatg

SEQ ID NO: 159457 - DNA, 103 bp, Artificial Sequence
  Synthetic Polynucleotide
taatacgactcactataggggctcttcttggaagacgacctcttcttctcaacagaggagagagaagatgaggtcgtctaacctggcggcagcgcaaaagatg

SEQ ID NO: 159458 - DNA, 103 bp, Artificial Sequence
  Synthetic Polynucleotide
taatacgactcactatagggagtctggagtgctcttcttggaagacgaccaacagaggagaggtcgtatgccaagaagaaacctggcggcagcgcaaaagatg

SEQ ID NO: 159459 - DNA, 103 bp, Artificial Sequence
  Synthetic Polynucleotide
taatacgactcactatagggctgagttctgagtctggagtgctcttcttgaacagaggagacaagaaatgcactccagaaacctggcggcagcgcaaaagatg

SEQ ID NO: 159460 - DNA, 103 bp, Artificial Sequence
  Synthetic Polynucleotide
taatacgactcactatagggtttacaatttctgagttctgagtctggagtaacagaggagaactccaatgtcagaactcaacctggcggcagcgcaaaagatg

SEQ ID NO: 159461 - DNA, 103 bp, Artificial Sequence
  Synthetic Polynucleotide
taatacgactcactatagggttcatcatcttttacaatttctgagttctgaacagaggagacagaacatggaaattgtaaacctggcggcagcgcaaaagatg

SEQ ID NO: 159462 - DNA, 103 bp, Artificial Sequence
  Synthetic Polynucleotide
taatacgactcactatagggcttctttgccttcatcatcttttacaatttaacagaggagaaaattgatgaagatgatgaacctggcggcagcgcaaaagatg

SEQ ID NO: 159463 - DNA, 103 bp, Artificial Sequence
  Synthetic Polynucleotide
taatacgactcactatagggaactgataatcttctttgccttcatcatctaacagaggagaagatgaatgaggcaaagaaacctggcggcagcgcaaaagatg

SEQ ID NO: 159464 - DNA, 103 bp, Artificial Sequence
  Synthetic Polynucleotide
taatacgactcactataggggagttcatcaaactgataatcttctttgccaacagaggagaggcaaaatggattatcagaacctggcggcagcgcaaaagatg

SEQ ID NO: 159465 - DNA, 103 bp, Artificial Sequence
  Synthetic Polynucleotide
taatacgactcactatagggtctctgtgttgagttcatcaaactgataataacagaggagaattatcatgttgatgaacaacctggcggcagcgcaaaagatg

SEQ ID NO: 159466 - DNA, 103 bp, Artificial Sequence
  Synthetic Polynucleotide
taatacgactcactatagggttattcagaatctctgtgttgagttcatcaaacagaggagatgatgaatgcaacacagaaacctggcggcagcgcaaaagatg

SEQ ID NO: 159467 - DNA, 103 bp, Artificial Sequence
  Synthetic Polynucleotide
taatacgactcactatagggcaagccatctgaccatctagctaggacatcaacagaggagagatgtcatggctagatggaacctggcggcagcgcaaaagatg

SEQ ID NO: 159468 - DNA, 103 bp, Artificial Sequence
  Synthetic Polynucleotide
taatacgactcactatagggatctgctaagttattcagaatctctgtgttaacagaggagaaacacaatgattctgaataacctggcggcagcgcaaaagatg

SEQ ID NO: 159469 - DNA, 103 bp, Artificial Sequence
  Synthetic Polynucleotide
taatacgactcactataggggtaactcctgatctgctaagttattcagaaaacagaggagattctgaatgacttagcagaacctggcggcagcgcaaaagatg

SEQ ID NO: 159470 - DNA, 103 bp, Artificial Sequence
  Synthetic Polynucleotide
taatacgactcactatagggtgattgagttgtaactcctgatctgctaagaacagaggagacttagcatgtcaggagttaacctggcggcagcgcaaaagatg

SEQ ID NO: 159471 - DNA, 103 bp, Artificial Sequence
  Synthetic Polynucleotide
taatacgactcactataggggttctttagatgattgagttgtaactcctgaacagaggagacaggagatgcaactcaataacctggcggcagcgcaaaagatg

SEQ ID NO: 159472 - DNA, 103 bp, Artificial Sequence
  Synthetic Polynucleotide
taatacgactcactatagggtggtaatggagttctttagatgattgagttaacagaggagaaactcaatgatctaaagaaacctggcggcagcgcaaaagatg

SEQ ID NO: 159473 - DNA, 103 bp, Artificial Sequence
  Synthetic Polynucleotide
taatacgactcactatagggccaaaataactggtaatggagttctttagaaacagaggagatctaaaatgctccattacaacctggcggcagcgcaaaagatg

SEQ ID NO: 159474 - DNA, 103 bp, Artificial Sequence
  Synthetic Polynucleotide
taatacgactcactatagggacctgcagcaccaaaataactggtaatggaaacagaggagatccattatgagttattttaacctggcggcagcgcaaaagatg

SEQ ID NO: 159475 - DNA, 103 bp, Artificial Sequence
  Synthetic Polynucleotide
taatacgactcactatagggatgctattctacctgcagcaccaaaataacaacagaggagagttattatggtgctgcagaacctggcggcagcgcaaaagatg

SEQ ID NO: 159476 - DNA, 103 bp, Artificial Sequence
  Synthetic Polynucleotide
taatacgactcactatagggttttcgccacatgctattctacctgcagcaaacagaggagatgctgcatgtagaatagcaacctggcggcagcgcaaaagatg

SEQ ID NO: 159477 - DNA, 103 bp, Artificial Sequence
  Synthetic Polynucleotide
taatacgactcactatagggaactcggtatttttcgccacatgctattctaacagaggagaagaataatgtgtggcgaaaacctggcggcagcgcaaaagatg

SEQ ID NO: 159478 - DNA, 103 bp, Artificial Sequence
  Synthetic Polynucleotide
taatacgactcactatagggcaagataaaacaagccatctgaccatctagaacagaggagactagatatgcagatggctaacctggcggcagcgcaaaagatg

SEQ ID NO: 159479 - DNA, 103 bp, Artificial Sequence
  Synthetic Polynucleotide
taatacgactcactataggggacgtgccaaaactcggtatttttcgccacaacagaggagagtggcgatgaataccgagaacctggcggcagcgcaaaagatg

SEQ ID NO: 159480 - DNA, 103 bp, Artificial Sequence
  Synthetic Polynucleotide
taatacgactcactatagggagtgtcacccgacgtgccaaaactcggtataacagaggagaataccgatgtttggcacgaacctggcggcagcgcaaaagatg

SEQ ID NO: 159481 - DNA, 103 bp, Artificial Sequence
  Synthetic Polynucleotide
taatacgactcactatagggctttccatcaagtgtcacccgacgtgccaaaacagaggagattggcaatgcgggtgacaaacctggcggcagcgcaaaagatg

SEQ ID NO: 159482 - DNA, 103 bp, Artificial Sequence
  Synthetic Polynucleotide
taatacgactcactataggggatactgcacctttccatcaagtgtcacccaacagaggagagggtgaatgttgatggaaaacctggcggcagcgcaaaagatg

SEQ ID NO: 159483 - DNA, 103 bp, Artificial Sequence
  Synthetic Polynucleotide
taatacgactcactatagggcattccacaagatactgcacctttccatcaaacagaggagatgatggatgggtgcagtaaacctggcggcagcgcaaaagatg

SEQ ID NO: 159484 - DNA, 103 bp, Artificial Sequence
  Synthetic Polynucleotide
taatacgactcactatagggtgctccttcccattccacaagatactgcacaacagaggagagtgcagatgcttgtggaaaacctggcggcagcgcaaaagatg

SEQ ID NO: 159485 - DNA, 103 bp, Artificial Sequence
  Synthetic Polynucleotide
taatacgactcactatagggaggatgcagttgctccttcccattccacaaaacagaggagattgtggatggggaaggagaacctggcggcagcgcaaaagatg

SEQ ID NO: 159486 - DNA, 103 bp, Artificial Sequence
  Synthetic Polynucleotide
taatacgactcactatagggttgatagtgccaagataaaacaagccatctaacagaggagaagatggatggttttatctaacctggcggcagcgcaaaagatg

SEQ ID NO: 159487 - DNA, 103 bp, Artificial Sequence
  Synthetic Polynucleotide
taatacgactcactataggggtttatctttttgatagtgccaagataaaaaacagaggagattttatatgggcactatcaacctggcggcagcgcaaaagatg

SEQ ID NO: 159488 - DNA, 103 bp, Artificial Sequence
  Synthetic Polynucleotide
taatacgactcactatagggtgtggaccagtgaattacctgcccctgtagaacagaggagactacagatgcaggtaattaacctggcggcagcgcaaaagatg

SEQ ID NO: 159489 - DNA, 103 bp, Artificial Sequence
  Synthetic Polynucleotide
taatacgactcactataggggtttcaatatgtttatctttttgatagtgcaacagaggagagcactaatgaaaagataaaacctggcggcagcgcaaaagatg

SEQ ID NO: 159490 - DNA, 103 bp, Artificial Sequence
  Synthetic Polynucleotide
taatacgactcactatagggaagcagctctgtttcaatatgtttatctttaacagaggagaaaagatatgcatattgaaaacctggcggcagcgcaaaagatg

SEQ ID NO: 159491 - DNA, 103 bp, Artificial Sequence
  Synthetic Polynucleotide
taatacgactcactatagggaaatatgatgaagcagctctgtttcaatataacagaggagaatattgatgcagagctgcaacctggcggcagcgcaaaagatg

SEQ ID NO: 159492 - DNA, 103 bp, Artificial Sequence
  Synthetic Polynucleotide
taatacgactcactatagggaactgtcttcaaatatgatgaagcagctctaacagaggagaagagctatgtcatcatataacctggcggcagcgcaaaagatg

SEQ ID NO: 159493 - DNA, 103 bp, Artificial Sequence
  Synthetic Polynucleotide
taatacgactcactatagggcaggatttagaactgtcttcaaatatgatgaacagaggagacatcatatgtgaagacagaacctggcggcagcgcaaaagatg

SEQ ID NO: 159494 - DNA, 103 bp, Artificial Sequence
  Synthetic Polynucleotide
taatacgactcactatagggccagagaacccaggatttagaactgtcttcaacagaggagagaagacatgtctaaatccaacctggcggcagcgcaaaagatg

SEQ ID NO: 159495 - DNA, 103 bp, Artificial Sequence
  Synthetic Polynucleotide
taatacgactcactataggggaatgtccttccagagaacccaggatttagaacagaggagactaaatatggggttctctaacctggcggcagcgcaaaagatg

SEQ ID NO: 159496 - DNA, 103 bp, Artificial Sequence
  Synthetic Polynucleotide
taatacgactcactataggggctcctgtttgaatgtccttccagagaaccaacagaggagaggttctatggaaggacataacctggcggcagcgcaaaagatg

SEQ ID NO: 159497 - DNA, 103 bp, Artificial Sequence
  Synthetic Polynucleotide
taatacgactcactatagggacttccagtggctcctgtttgaatgtccttaacagaggagaaaggacatgcaaacaggaaacctggcggcagcgcaaaagatg

SEQ ID NO: 159498 - DNA, 103 bp, Artificial Sequence
  Synthetic Polynucleotide
taatacgactcactatagggccatttccccacttccagtggctcctgtttaacagaggagaaaacagatgccactggaaaacctggcggcagcgcaaaagatg

SEQ ID NO: 159499 - DNA, 103 bp, Artificial Sequence
  Synthetic Polynucleotide
taatacgactcactatagggggagaccgcttgtggaccagtgaattacctaacagaggagaaggtaaatgactggtccaaacctggcggcagcgcaaaagatg

SEQ ID NO: 159500 - DNA, 103 bp, Artificial Sequence
  Synthetic Polynucleotide
taatacgactcactatagggattgtacagaccatttccccacttccagtgaacagaggagacactggatgtggggaaataacctggcggcagcgcaaaagatg

SEQ ID NO: 159501 - DNA, 103 bp, Artificial Sequence
  Synthetic Polynucleotide
taatacgactcactatagggttcttgacatattgtacagaccatttccccaacagaggagaggggaaatggtctgtacaaacctggcggcagcgcaaaagatg

SEQ ID NO: 159502 - DNA, 103 bp, Artificial Sequence
  Synthetic Polynucleotide
taatacgactcactatagggctgaatactcttcttgacatattgtacagaaacagaggagatctgtaatgtatgtcaagaacctggcggcagcgcaaaagatg

SEQ ID NO: 159503 - DNA, 103 bp, Artificial Sequence
  Synthetic Polynucleotide
taatacgactcactatagggttgggagcttctgaatactcttcttgacataacagaggagaatgtcaatgagagtattcaacctggcggcagcgcaaaagatg

SEQ ID NO: 159504 - DNA, 103 bp, Artificial Sequence
  Synthetic Polynucleotide
taatacgactcactatagggaaccatttcattgggagcttctgaatactcaacagaggagagagtatatggaagctcccaacctggcggcagcgcaaaagatg

SEQ ID NO: 159505 - DNA, 103 bp, Artificial Sequence
  Synthetic Polynucleotide
taatacgactcactatagggtgtcacatataaccatttcattgggagcttaacagaggagaaagctcatgatgaaatggaacctggcggcagcgcaaaagatg

SEQ ID NO: 159506 - DNA, 103 bp, Artificial Sequence
  Synthetic Polynucleotide
taatacgactcactatagggtggccacacttgtcacatataaccatttcaaacagaggagatgaaatatgtatatgtgaaacctggcggcagcgcaaaagatg

SEQ ID NO: 159507 - DNA, 103 bp, Artificial Sequence
  Synthetic Polynucleotide
taatacgactcactatagggatgatatccttggccacacttgtcacatataacagaggagaatatgtatgaagtgtggcaacctggcggcagcgcaaaagatg

SEQ ID NO: 159508 - DNA, 103 bp, Artificial Sequence
  Synthetic Polynucleotide
taatacgactcactataggggacacaactgatgatatccttggccacactaacagaggagaagtgtgatgaaggatatcaacctggcggcagcgcaaaagatg

SEQ ID NO: 159509 - DNA, 103 bp, Artificial Sequence
  Synthetic Polynucleotide
taatacgactcactatagggtgaggtgtgtgacacaactgatgatatcctaacagaggagaaggataatgtcagttgtgaacctggcggcagcgcaaaagatg

SEQ ID NO: 159510 - DNA, 103 bp, Artificial Sequence
  Synthetic Polynucleotide
taatacgactcactatagggtcgacgtaaaggagaccgcttgtggaccagaacagaggagactggtcatgaagcggtctaacctggcggcagcgcaaaagatg

SEQ ID NO: 159511 - DNA, 103 bp, Artificial Sequence
  Synthetic Polynucleotide
taatacgactcactatagggggaatcaatatgaggtgtgtgacacaactgaacagaggagacagttgatgcacacacctaacctggcggcagcgcaaaagatg

SEQ ID NO: 159512 - DNA, 103 bp, Artificial Sequence
  Synthetic Polynucleotide
taatacgactcactatagggcaatcacactggaatcaatatgaggtgtgtaacagaggagaacacacatgatattgattaacctggcggcagcgcaaaagatg

SEQ ID NO: 159513 - DNA, 103 bp, Artificial Sequence
  Synthetic Polynucleotide
taatacgactcactatagggtcatctgaatcaatcacactggaatcaataaacagaggagatattgaatgcagtgtgataacctggcggcagcgcaaaagatg

SEQ ID NO: 159514 - DNA, 103 bp, Artificial Sequence
  Synthetic Polynucleotide
taatacgactcactataggggagccatttttcatctgaatcaatcacactaacagaggagaagtgtgatggattcagataacctggcggcagcgcaaaagatg

SEQ ID NO: 159515 - DNA, 103 bp, Artificial Sequence
  Synthetic Polynucleotide
taatacgactcactatagggactgccgacagagccatttttcatctgaataacagaggagaattcagatgaaaaatggcaacctggcggcagcgcaaaagatg

SEQ ID NO: 159516 - DNA, 103 bp, Artificial Sequence
  Synthetic Polynucleotide
taatacgactcactataggggcaaaaacacactgccgacagagccattttaacagaggagaaaaatgatgctgtcggcaaacctggcggcagcgcaaaagatg

SEQ ID NO: 159517 - DNA, 103 bp, Artificial Sequence
  Synthetic Polynucleotide
taatacgactcactatagggtgttgttgttgcaaaaacacactgccgacaaacagaggagatgtcggatgtgtgtttttaacctggcggcagcgcaaaagatg

SEQ ID NO: 159518 - DNA, 103 bp, Artificial Sequence
  Synthetic Polynucleotide
taatacgactcactatagggcacccctctttgttgttgttgcaaaaacacaacagaggagagtgtttatgcaacaacaaaacctggcggcagcgcaaaagatg

SEQ ID NO: 159519 - DNA, 103 bp, Artificial Sequence
  Synthetic Polynucleotide
taatacgactcactatagggttaagtgcaccacccctctttgttgttgttaacagaggagaaacaacatgaaagaggggaacctggcggcagcgcaaaagatg

SEQ ID NO: 159520 - DNA, 103 bp, Artificial Sequence
  Synthetic Polynucleotide
taatacgactcactatagggtggtcctttcttaagtgcaccacccctcttaacagaggagaaagaggatgggtgcacttaacctggcggcagcgcaaaagatg

SEQ ID NO: 159521 - DNA, 103 bp, Artificial Sequence
  Synthetic Polynucleotide
taatacgactcactatagggtcttttggtttcgacgtaaaggagaccgctaacagaggagaagcggtatgctttacgtcaacctggcggcagcgcaaaagatg

SEQ ID NO: 159522 - DNA, 103 bp, Artificial Sequence
  Synthetic Polynucleotide
taatacgactcactatagggctttggcatttggtcctttcttaagtgcacaacagaggagagtgcacatgagaaaggacaacctggcggcagcgcaaaagatg

SEQ ID NO: 159523 - DNA, 103 bp, Artificial Sequence
  Synthetic Polynucleotide
taatacgactcactatagggacttgcaatgctttggcatttggtcctttcaacagaggagagaaaggatgaaatgccaaaacctggcggcagcgcaaaagatg

SEQ ID NO: 159524 - DNA, 103 bp, Artificial Sequence
  Synthetic Polynucleotide
taatacgactcactatagggctgcttcatgacttgcaatgctttggcattaacagaggagaaatgccatggcattgcaaaacctggcggcagcgcaaaagatg

SEQ ID NO: 159525 - DNA, 103 bp, Artificial Sequence
  Synthetic Polynucleotide
taatacgactcactatagggagggtaatgtctgcttcatgacttgcaatgaacagaggagacattgcatgtcatgaagcaacctggcggcagcgcaaaagatg

SEQ ID NO: 159526 - DNA, 103 bp, Artificial Sequence
  Synthetic Polynucleotide
taatacgactcactataggggccacactatagggtaatgtctgcttcatgaacagaggagacatgaaatggacattaccaacctggcggcagcgcaaaagatg

SEQ ID NO: 159527 - DNA, 103 bp, Artificial Sequence
  Synthetic Polynucleotide
taatacgactcactatagggttcaaggtctgccacactatagggtaatgtaacagaggagaacattaatgtatagtgtgaacctggcggcagcgcaaaagatg

SEQ ID NO: 159528 - DNA, 103 bp, Artificial Sequence
  Synthetic Polynucleotide
taatacgactcactatagggctgcatcccattcaaggtctgccacactataacagaggagaatagtgatgcagaccttgaacctggcggcagcgcaaaagatg

SEQ ID NO: 159529 - DNA, 103 bp, Artificial Sequence
  Synthetic Polynucleotide
taatacgactcactataggggttttatgacctgcatcccattcaaggtctaacagaggagaagacctatgatgggatgcaacctggcggcagcgcaaaagatg

SEQ ID NO: 159530 - DNA, 103 bp, Artificial Sequence
  Synthetic Polynucleotide
taatacgactcactatagggctggacattggttttatgacctgcatcccaaacagaggagatgggatatgggtcataaaaacctggcggcagcgcaaaagatg

SEQ ID NO: 159531 - DNA, 103 bp, Artificial Sequence
  Synthetic Polynucleotide
taatacgactcactatagggagtaacactgctggacattggttttatgacaacagaggagagtcataatgccaatgtccaacctggcggcagcgcaaaagatg

SEQ ID NO: 159532 - DNA, 103 bp, Artificial Sequence
  Synthetic Polynucleotide
taatacgactcactataggggatgttggggtcttttggtttcgacgtaaaaacagaggagatttacgatgaaaccaaaaaacctggcggcagcgcaaaagatg

SEQ ID NO: 159533 - DNA, 103 bp, Artificial Sequence
  Synthetic Polynucleotide
taatacgactcactatagggccacaatagcagtaacactgctggacattgaacagaggagacaatgtatggcagtgttaaacctggcggcagcgcaaaagatg

SEQ ID NO: 159534 - DNA, 103 bp, Artificial Sequence
  Synthetic Polynucleotide
taatacgactcactatagggtccagggcctccacaatagcagtaacactgaacagaggagacagtgtatgtgctattgtaacctggcggcagcgcaaaagatg

SEQ ID NO: 159535 - DNA, 103 bp, Artificial Sequence
  Synthetic Polynucleotide
taatacgactcactatagggaataccagtctccagggcctccacaatagcaacagaggagagctattatggaggccctgaacctggcggcagcgcaaaagatg

SEQ ID NO: 159536 - DNA, 103 bp, Artificial Sequence
  Synthetic Polynucleotide
taatacgactcactatagggagcatcttcaaataccagtctccagggcctaacagaggagaaggcccatgagactggtaaacctggcggcagcgcaaaagatg

SEQ ID NO: 159537 - DNA, 103 bp, Artificial Sequence
  Synthetic Polynucleotide
taatacgactcactataggggcagcactgtagcatcttcaaataccagtcaacagaggagagactggatgttgaagatgaacctggcggcagcgcaaaagatg

SEQ ID NO: 159538 - DNA, 103 bp, Artificial Sequence
  Synthetic Polynucleotide
taatacgactcactataggggcttacatttgcagcactgtagcatcttcaaacagaggagatgaagaatgtacagtgctaacctggcggcagcgcaaaagatg

SEQ ID NO: 159539 - DNA, 103 bp, Artificial Sequence
  Synthetic Polynucleotide
taatacgactcactatagggtgaaaccactgcttacatttgcagcactgtaacagaggagaacagtgatgcaaatgtaaaacctggcggcagcgcaaaagatg

SEQ ID NO: 159540 - DNA, 103 bp, Artificial Sequence
  Synthetic Polynucleotide
taatacgactcactatagggacaagcctcatgaaaccactgcttacatttaacagaggagaaaatgtatgcagtggtttaacctggcggcagcgcaaaagatg

SEQ ID NO: 159541 - DNA, 103 bp, Artificial Sequence
  Synthetic Polynucleotide
taatacgactcactatagggggcattgcacacaagcctcatgaaaccactaacagaggagaagtggtatgatgaggcttaacctggcggcagcgcaaaagatg

SEQ ID NO: 159542 - DNA, 103 bp, Artificial Sequence
  Synthetic Polynucleotide
taatacgactcactatagggggcttttgaaggcattgcacacaagcctcaaacagaggagatgaggcatgtgtgcaatgaacctggcggcagcgcaaaagatg

SEQ ID NO: 159543 - DNA, 103 bp, Artificial Sequence
  Synthetic Polynucleotide
taatacgactcactatagggcttggtcaaggatgttggggtcttttggttaacagaggagaaaccaaatgaccccaacaaacctggcggcagcgcaaaagatg

SEQ ID NO: 159544 - DNA, 103 bp, Artificial Sequence
  Synthetic Polynucleotide
taatacgactcactatagggaaatagcattggcttttgaaggcattgcacaacagaggagagtgcaaatgcttcaaaagaacctggcggcagcgcaaaagatg

SEQ ID NO: 159545 - DNA, 103 bp, Artificial Sequence
  Synthetic Polynucleotide
taatacgactcactatagggatctgtctccaaatagcattggcttttgaaaacagaggagattcaaaatgcaatgctataacctggcggcagcgcaaaagatg

SEQ ID NO: 159546 - DNA, 103 bp, Artificial Sequence
  Synthetic Polynucleotide
taatacgactcactatagggaacgtataaaatctgtctccaaatagcattaacagaggagaaatgctatgtggagacagaacctggcggcagcgcaaaagatg

SEQ ID NO: 159547 - DNA, 103 bp, Artificial Sequence
  Synthetic Polynucleotide
taatacgactcactatagggagagcatataaacgtataaaatctgtctccaacagaggagaggagacatgttttatacgaacctggcggcagcgcaaaagatg

SEQ ID NO: 159548 - DNA, 103 bp, Artificial Sequence
  Synthetic Polynucleotide
taatacgactcactatagggaactgcagacagagcatataaacgtataaaaacagaggagatttataatgttatatgctaacctggcggcagcgcaaaagatg

SEQ ID NO: 159549 - DNA, 103 bp, Artificial Sequence
  Synthetic Polynucleotide
taatacgactcactatagggtctggtccagaactgcagacagagcatataaacagaggagatatatgatgtgtctgcagaacctggcggcagcgcaaaagatg

SEQ ID NO: 159550 - DNA, 103 bp, Artificial Sequence
  Synthetic Polynucleotide
taatacgactcactatagggtttgaggtattctggtccagaactgcagacaacagaggagagtctgcatgtctggaccaaacctggcggcagcgcaaaagatg

SEQ ID NO: 159551 - DNA, 103 bp, Artificial Sequence
  Synthetic Polynucleotide
taatacgactcactatagggatggtagacgtttgaggtattctggtccagaacagaggagactggacatgaatacctcaaacctggcggcagcgcaaaagatg

SEQ ID NO: 159552 - DNA, 103 bp, Artificial Sequence
  Synthetic Polynucleotide
taatacgactcactatagggacccactgtaatggtagacgtttgaggtataacagaggagaatacctatgacgtctaccaacctggcggcagcgcaaaagatg

SEQ ID NO: 159553 - DNA, 103 bp, Artificial Sequence
  Synthetic Polynucleotide
taatacgactcactatagggtgctatatctacccactgtaatggtagacgaacagaggagacgtctaatgttacagtggaacctggcggcagcgcaaaagatg

SEQ ID NO: 159554 - DNA, 103 bp, Artificial Sequence
  Synthetic Polynucleotide
taatacgactcactataggggtaaagacagcttggtcaaggatgttggggaacagaggagaccccaaatgccttgaccaaacctggcggcagcgcaaaagatg

SEQ ID NO: 159555 - DNA, 103 bp, Artificial Sequence
  Synthetic Polynucleotide
taatacgactcactatagggggcataggtgtgctatatctacccactgtaaacagaggagatacagtatgtagatatagaacctggcggcagcgcaaaagatg

SEQ ID NO: 159556 - DNA, 103 bp, Artificial Sequence
  Synthetic Polynucleotide
taatacgactcactatagggaggttgtaaaggcataggtgtgctatatctaacagaggagaagatatatgacacctatgaacctggcggcagcgcaaaagatg

SEQ ID NO: 159557 - DNA, 103 bp, Artificial Sequence
  Synthetic Polynucleotide
taatacgactcactatagggaataacacttaggttgtaaaggcataggtgaacagaggagacacctaatgctttacaacaacctggcggcagcgcaaaagatg

SEQ ID NO: 159558 - DNA, 103 bp, Artificial Sequence
  Synthetic Polynucleotide
taatacgactcactatagggtcttcttatgaataacacttaggttgtaaaaacagaggagatttacaatgtaagtgttaaacctggcggcagcgcaaaagatg

SEQ ID NO: 159559 - DNA, 103 bp, Artificial Sequence
  Synthetic Polynucleotide
taatacgactcactatagggtcaaagtatttcttcttatgaataacacttaacagaggagaaagtgtatgtcataagaaaacctggcggcagcgcaaaagatg

SEQ ID NO: 159560 - DNA, 103 bp, Artificial Sequence
  Synthetic Polynucleotide
taatacgactcactatagggaagttcagaatcaaagtatttcttcttatgaacagaggagacataagatgaaatactttaacctggcggcagcgcaaaagatg

SEQ ID NO: 159561 - DNA, 103 bp, Artificial Sequence
  Synthetic Polynucleotide
taatacgactcactatagggtcataagctcaagttcagaatcaaagtattaacagaggagaaatactatgattctgaacaacctggcggcagcgcaaaagatg

SEQ ID NO: 159562 - DNA, 103 bp, Artificial Sequence
  Synthetic Polynucleotide
taatacgactcactatagggttaatgtatgtcataagctcaagttcagaaaacagaggagattctgaatgtgagcttataacctggcggcagcgcaaaagatg

SEQ ID NO: 159563 - DNA, 103 bp, Artificial Sequence
  Synthetic Polynucleotide
taatacgactcactatagggccagttttcattaatgtatgtcataagctcaacagaggagagagcttatgacatacattaacctggcggcagcgcaaaagatg

SEQ ID NO: 159564 - DNA, 103 bp, Artificial Sequence
  Synthetic Polynucleotide
taatacgactcactataggggcaatctatcccagttttcattaatgtatgaacagaggagacatacaatgatgaaaactaacctggcggcagcgcaaaagatg

SEQ ID NO: 159565 - DNA, 103 bp, Artificial Sequence
  Synthetic Polynucleotide
taatacgactcactatagggtgtccatcctgtaaagacagcttggtcaagaacagaggagacttgacatggctgtctttaacctggcggcagcgcaaaagatg

SEQ ID NO: 159566 - DNA, 103 bp, Artificial Sequence
  Synthetic Polynucleotide
taatacgactcactatagggtctccagggtgcaatctatcccagttttcaaacagaggagatgaaaaatgggatagattaacctggcggcagcgcaaaagatg

SEQ ID NO: 159567 - DNA, 103 bp, Artificial Sequence
  Synthetic Polynucleotide
taatacgactcactataggggtctgccagctctccagggtgcaatctatcaacagaggagagatagaatgcaccctggaaacctggcggcagcgcaaaagatg

SEQ ID NO: 159568 - DNA, 103 bp, Artificial Sequence
  Synthetic Polynucleotide
taatacgactcactatagggattttggtgtgtctgccagctctccagggtaacagaggagaaccctgatgagctggcagaacctggcggcagcgcaaaagatg

SEQ ID NO: 159569 - DNA, 103 bp, Artificial Sequence
  Synthetic Polynucleotide
taatacgactcactatagggtatctttcagattttggtgtgtctgccagcaacagaggagagctggcatgcacaccaaaaacctggcggcagcgcaaaagatg

SEQ ID NO: 159570 - DNA, 103 bp, Artificial Sequence
  Synthetic Polynucleotide
taatacgactcactatagggaacatgctcatatctttcagattttggtgtaacagaggagaacaccaatgtctgaaagaaacctggcggcagcgcaaaagatg

SEQ ID NO: 159571 - DNA, 103 bp, Artificial Sequence
  Synthetic Polynucleotide
taatacgactcactatagggatgcctccagaacatgctcatatctttcagaacagaggagactgaaaatgatgagcatgaacctggcggcagcgcaaaagatg

SEQ ID NO: 159572 - DNA, 103 bp, Artificial Sequence
  Synthetic Polynucleotide
taatacgactcactatagggtaatcatttaatgcctccagaacatgctcaaacagaggagatgagcaatgtctggaggcaacctggcggcagcgcaaaagatg

SEQ ID NO: 159573 - DNA, 103 bp, Artificial Sequence
  Synthetic Polynucleotide
taatacgactcactatagggcatggtcttgtaatcatttaatgcctccagaacagaggagactggagatgttaaatgataacctggcggcagcgcaaaagatg

SEQ ID NO: 159574 - DNA, 103 bp, Artificial Sequence
  Synthetic Polynucleotide
taatacgactcactatagggcagacataaacatggtcttgtaatcatttaaacagaggagataaatgatgacaagaccaaacctggcggcagcgcaaaagatg

SEQ ID NO: 159575 - DNA, 103 bp, Artificial Sequence
  Synthetic Polynucleotide
taatacgactcactatagggatttctttcccagacataaacatggtcttgaacagaggagacaagacatggtttatgtcaacctggcggcagcgcaaaagatg

SEQ ID NO: 159576 - DNA, 103 bp, Artificial Sequence
  Synthetic Polynucleotide
taatacgactcactatagggggtggcggcggcaggtccggttccaagcataacagaggagaatgcttatgaccggacctaacctggcggcagcgcaaaagatg

SEQ ID NO: 159577 - DNA, 103 bp, Artificial Sequence
  Synthetic Polynucleotide
taatacgactcactatagggggctttggccctggtttcctcattccggctaacagaggagaagccggatggaggaaaccaacctggcggcagcgcaaaagatg

SEQ ID NO: 159578 - DNA, 103 bp, Artificial Sequence
  Synthetic Polynucleotide
taatacgactcactatagggttggtgagagctgtaccccagcagccccacaacagaggagagtggggatgctggggtacaacctggcggcagcgcaaaagatg

SEQ ID NO: 159579 - DNA, 103 bp, Artificial Sequence
  Synthetic Polynucleotide
taatacgactcactatagggccatgaggccttggtgagagctgtaccccaaacagaggagatggggtatggctctcaccaacctggcggcagcgcaaaagatg

SEQ ID NO: 159580 - DNA, 103 bp, Artificial Sequence
  Synthetic Polynucleotide
taatacgactcactataggggtcccaaatcccatgaggccttggtgagagaacagaggagactctcaatgaggcctcataacctggcggcagcgcaaaagatg

SEQ ID NO: 159581 - DNA, 103 bp, Artificial Sequence
  Synthetic Polynucleotide
taatacgactcactatagggactgggggaggtcccaaatcccatgaggccaacagaggagaggcctcatgggatttgggaacctggcggcagcgcaaaagatg

SEQ ID NO: 159582 - DNA, 103 bp, Artificial Sequence
  Synthetic Polynucleotide
taatacgactcactatagggacttagctggactgggggaggtcccaaatcaacagaggagagatttgatgcctcccccaaacctggcggcagcgcaaaagatg

SEQ ID NO: 159583 - DNA, 103 bp, Artificial Sequence
  Synthetic Polynucleotide
taatacgactcactatagggaccagggtggacttagctggactgggggagaacagaggagactccccatgtccagctaaaacctggcggcagcgcaaaagatg

SEQ ID NO: 159584 - DNA, 103 bp, Artificial Sequence
  Synthetic Polynucleotide
taatacgactcactatagggccggctctccaccagggtggacttagctggaacagaggagaccagctatgtccaccctgaacctggcggcagcgcaaaagatg

SEQ ID NO: 159585 - DNA, 103 bp, Artificial Sequence
  Synthetic Polynucleotide
taatacgactcactatagggctctgcaacaccggctctccaccagggtggaacagaggagaccacccatgtggagagccaacctggcggcagcgcaaaagatg

SEQ ID NO: 159586 - DNA, 103 bp, Artificial Sequence
  Synthetic Polynucleotide
taatacgactcactatagggtccatcaagtctctgcaacaccggctctccaacagaggagaggagagatggtgttgcagaacctggcggcagcgcaaaagatg

SEQ ID NO: 159587 - DNA, 103 bp, Artificial Sequence
  Synthetic Polynucleotide
taatacgactcactatagggaaatttctcctccatcaagtctctgcaacaaacagaggagatgttgcatggacttgatgaacctggcggcagcgcaaaagatg

SEQ ID NO: 159588 - DNA, 103 bp, Artificial Sequence
  Synthetic Polynucleotide
taatacgactcactataggggctccttggcggctttggccctggtttcctaacagaggagaaggaaaatggggccaaagaacctggcggcagcgcaaaagatg

SEQ ID NO: 159589 - DNA, 103 bp, Artificial Sequence
  Synthetic Polynucleotide
taatacgactcactatagggacacctgatcaaatttctcctccatcaagtaacagaggagaacttgaatgaggagaaataacctggcggcagcgcaaaagatg

SEQ ID NO: 159590 - DNA, 103 bp, Artificial Sequence
  Synthetic Polynucleotide
taatacgactcactatagggacccactggcacacctgatcaaatttctccaacagaggagaggagaaatgtgatcaggtaacctggcggcagcgcaaaagatg

SEQ ID NO: 159591 - DNA, 103 bp, Artificial Sequence
  Synthetic Polynucleotide
taatacgactcactataggggcatttcagcacccactggcacacctgatcaacagaggagagatcagatgtgccagtggaacctggcggcagcgcaaaagatg

SEQ ID NO: 159592 - DNA, 103 bp, Artificial Sequence
  Synthetic Polynucleotide
taatacgactcactatagggtgctattcctgcatttcagcacccactggcaacagaggagagccagtatgtgctgaaataacctggcggcagcgcaaaagatg

SEQ ID NO: 159593 - DNA, 103 bp, Artificial Sequence
  Synthetic Polynucleotide
taatacgactcactatagggagcgagttcttgctattcctgcatttcagcaacagaggagagctgaaatgcaggaatagaacctggcggcagcgcaaaagatg

SEQ ID NO: 159594 - DNA, 103 bp, Artificial Sequence
  Synthetic Polynucleotide
taatacgactcactatagggcatttggatcagcgagttcttgctattcctaacagaggagaaggaatatgaagaactcgaacctggcggcagcgcaaaagatg

SEQ ID NO: 159595 - DNA, 103 bp, Artificial Sequence
  Synthetic Polynucleotide
taatacgactcactatagggtaaggattgtcatttggatcagcgagttctaacagaggagaagaactatgtgatccaaaaacctggcggcagcgcaaaagatg

SEQ ID NO: 159596 - DNA, 103 bp, Artificial Sequence
  Synthetic Polynucleotide
taatacgactcactatagggggcaacaaattaaggattgtcatttggatcaacagaggagagatccaatggacaatcctaacctggcggcagcgcaaaagatg

SEQ ID NO: 159597 - DNA, 103 bp, Artificial Sequence
  Synthetic Polynucleotide
taatacgactcactatagggagccaagcggggcaacaaattaaggattgtaacagaggagaacaatcatgaatttgttgaacctggcggcagcgcaaaagatg

SEQ ID NO: 159598 - DNA, 103 bp, Artificial Sequence
  Synthetic Polynucleotide
taatacgactcactataggggtcggaatgcagccaagcggggcaacaaataacagaggagaatttgtatgcccgcttggaacctggcggcagcgcaaaagatg

SEQ ID NO: 159599 - DNA, 103 bp, Artificial Sequence
  Synthetic Polynucleotide
taatacgactcactatagggtagtgctggagctccttggcggctttggccaacagaggagaggccaaatgcgccaaggaaacctggcggcagcgcaaaagatg

SEQ ID NO: 159600 - DNA, 103 bp, Artificial Sequence
  Synthetic Polynucleotide
taatacgactcactatagggaaggcagaaggtcggaatgcagccaagcggaacagaggagaccgcttatgtgcattccgaacctggcggcagcgcaaaagatg

SEQ ID NO: 159601 - DNA, 103 bp, Artificial Sequence
  Synthetic Polynucleotide
taatacgactcactatagggggtatctgtgaaggcagaaggtcggaatgcaacagaggagagcattcatgccttctgccaacctggcggcagcgcaaaagatg

SEQ ID NO: 159602 - DNA, 103 bp, Artificial Sequence
  Synthetic Polynucleotide
taatacgactcactatagggggagatactgggtatctgtgaaggcagaagaacagaggagacttctgatgtcacagataaacctggcggcagcgcaaaagatg

SEQ ID NO: 159603 - DNA, 103 bp, Artificial Sequence
  Synthetic Polynucleotide
taatacgactcactatagggatggtatcttggagatactgggtatctgtgaacagaggagacacagaatgccagtatctaacctggcggcagcgcaaaagatg

SEQ ID NO: 159604 - DNA, 103 bp, Artificial Sequence
  Synthetic Polynucleotide
taatacgactcactataggggacatggttcatggtatcttggagatactgaacagaggagacagtatatgcaagataccaacctggcggcagcgcaaaagatg

SEQ ID NO: 159605 - DNA, 103 bp, Artificial Sequence
  Synthetic Polynucleotide
taatacgactcactatagggcacagcttaggacatggttcatggtatcttaacagaggagaaagataatgtgaaccatgaacctggcggcagcgcaaaagatg

SEQ ID NO: 159606 - DNA, 103 bp, Artificial Sequence
  Synthetic Polynucleotide
taatacgactcactatagggtccttcttgacacagcttaggacatggttcaacagaggagagaaccaatgcctaagctgaacctggcggcagcgcaaaagatg

SEQ ID NO: 159607 - DNA, 103 bp, Artificial Sequence
  Synthetic Polynucleotide
taatacgactcactatagggacgttccttctccttcttgacacagcttagaacagaggagactaagcatggtcaagaagaacctggcggcagcgcaaaagatg

SEQ ID NO: 159608 - DNA, 103 bp, Artificial Sequence
  Synthetic Polynucleotide
taatacgactcactatagggaggccgctgtacgttccttctccttcttgaaacagaggagatcaagaatgagaaggaacaacctggcggcagcgcaaaagatg

SEQ ID NO: 159609 - DNA, 103 bp, Artificial Sequence
  Synthetic Polynucleotide
taatacgactcactatagggagggcttggaaggccgctgtacgttccttcaacagaggagagaaggaatgtacagcggcaacctggcggcagcgcaaaagatg

SEQ ID NO: 159610 - DNA, 103 bp, Artificial Sequence
  Synthetic Polynucleotide
taatacgactcactatagggcatggtgacatagtgctggagctccttggcaacagaggagagccaagatgctccagcacaacctggcggcagcgcaaaagatg

SEQ ID NO: 159611 - DNA, 103 bp, Artificial Sequence
  Synthetic Polynucleotide
taatacgactcactatagggaagtagccccagggcttggaaggccgctgtaacagaggagaacagcgatgttccaagccaacctggcggcagcgcaaaagatg

SEQ ID NO: 159612 - DNA, 103 bp, Artificial Sequence
  Synthetic Polynucleotide
taatacgactcactatagggcagccacagaaagtagccccagggcttggaaacagaggagatccaagatgtggggctacaacctggcggcagcgcaaaagatg

SEQ ID NO: 159613 - DNA, 103 bp, Artificial Sequence
  Synthetic Polynucleotide
taatacgactcactatagggtcagacctcacagccacagaaagtagccccaacagaggagaggggctatgttctgtggcaacctggcggcagcgcaaaagatg

SEQ ID NO: 159614 - DNA, 103 bp, Artificial Sequence
  Synthetic Polynucleotide
taatacgactcactataggggaccttaaactcagacctcacagccacagaaacagaggagatctgtgatggtgaggtctaacctggcggcagcgcaaaagatg

SEQ ID NO: 159615 - DNA, 103 bp, Artificial Sequence
  Synthetic Polynucleotide
taatacgactcactataggggaggcaaatagaccttaaactcagacctcaaacagaggagatgaggtatgagtttaaggaacctggcggcagcgcaaaagatg

SEQ ID NO: 159616 - DNA, 103 bp, Artificial Sequence
  Synthetic Polynucleotide
taatacgactcactatagggtccagcacgcgaggcaaatagaccttaaacaacagaggagagtttaaatgctatttgccaacctggcggcagcgcaaaagatg

SEQ ID NO: 159617 - DNA, 103 bp, Artificial Sequence
  Synthetic Polynucleotide
taatacgactcactatagggtcggatgatgtccagcacgcgaggcaaataaacagaggagatatttgatgcgcgtgctgaacctggcggcagcgcaaaagatg

SEQ ID NO: 159618 - DNA, 103 bp, Artificial Sequence
  Synthetic Polynucleotide
taatacgactcactataggggcagggccgctcggatgatgtccagcacgcaacagaggagagcgtgcatgacatcatccaacctggcggcagcgcaaaagatg

SEQ ID NO: 159619 - DNA, 103 bp, Artificial Sequence
  Synthetic Polynucleotide
taatacgactcactatagggtcctttgggggcagggccgctcggatgatgaacagaggagacatcatatgagcggccctaacctggcggcagcgcaaaagatg

SEQ ID NO: 159620 - DNA, 103 bp, Artificial Sequence
  Synthetic Polynucleotide
taatacgactcactatagggatgggcgaagtcctttgggggcagggccgcaacagaggagagcggccatgcccccaaagaacctggcggcagcgcaaaagatg

SEQ ID NO: 159621 - DNA, 103 bp, Artificial Sequence
  Synthetic Polynucleotide
taatacgactcactatagggctcggagttccatggtgacatagtgctggaaacagaggagatccagcatgatgtcaccaaacctggcggcagcgcaaaagatg

SEQ ID NO: 159622 - DNA, 103 bp, Artificial Sequence
  Synthetic Polynucleotide
taatacgactcactatagggtctgcctcttatgggcgaagtcctttggggaacagaggagaccccaaatgacttcgcccaacctggcggcagcgcaaaagatg

SEQ ID NO: 159623 - DNA, 103 bp, Artificial Sequence
  Synthetic Polynucleotide
taatacgactcactatagggtgcattgccttctgcctcttatgggcgaagaacagaggagacttcgcatgtaagaggcaaacctggcggcagcgcaaaagatg

SEQ ID NO: 159624 - DNA, 103 bp, Artificial Sequence
  Synthetic Polynucleotide
taatacgactcactatagggggcatccacctgcattgccttctgcctcttaacagaggagaaagaggatgaaggcaatgaacctggcggcagcgcaaaagatg

SEQ ID NO: 159625 - DNA, 103 bp, Artificial Sequence
  Synthetic Polynucleotide
taatacgactcactatagggtgaagactgtggcatccacctgcattgcctaacagaggagaaggcaaatgaggtggatgaacctggcggcagcgcaaaagatg

SEQ ID NO: 159626 - DNA, 103 bp, Artificial Sequence
  Synthetic Polynucleotide
taatacgactcactatagggctgatgcaagtgaagactgtggcatccaccaacagaggagaggtggaatgcacagtcttaacctggcggcagcgcaaaagatg

SEQ ID NO: 159627 - DNA, 103 bp, Artificial Sequence
  Synthetic Polynucleotide
taatacgactcactatagggagccagcatgctgatgcaagtgaagactgtaacagaggagaacagtcatgacttgcatcaacctggcggcagcgcaaaagatg

SEQ ID NO: 159628 - DNA, 103 bp, Artificial Sequence
  Synthetic Polynucleotide
taatacgactcactatagggccattgctcgagccagcatgctgatgcaagaacagaggagacttgcaatggcatgctggaacctggcggcagcgcaaaagatg

SEQ ID NO: 159629 - DNA, 103 bp, Artificial Sequence
  Synthetic Polynucleotide
taatacgactcactatagggatgcctggccccattgctcgagccagcatgaacagaggagacatgctatgtcgagcaataacctggcggcagcgcaaaagatg

SEQ ID NO: 159630 - DNA, 103 bp, Artificial Sequence
  Synthetic Polynucleotide
taatacgactcactatagggatcctgctggatgcctggccccattgctcgaacagaggagacgagcaatggggccaggcaacctggcggcagcgcaaaagatg

SEQ ID NO: 159631 - DNA, 103 bp, Artificial Sequence
  Synthetic Polynucleotide
taatacgactcactataggggctccttgatatcctgctggatgcctggccaacagaggagaggccagatgtccagcaggaacctggcggcagcgcaaaagatg

SEQ ID NO: 159632 - DNA, 103 bp, Artificial Sequence
  Synthetic Polynucleotide
taatacgactcactatagggtgactcatctctcggagttccatggtgacaaacagaggagatgtcacatgggaactccgaacctggcggcagcgcaaaagatg

SEQ ID NO: 159633 - DNA, 103 bp, Artificial Sequence
  Synthetic Polynucleotide
taatacgactcactatagggggctccagcagctccttgatatcctgctggaacagaggagaccagcaatgtatcaaggaaacctggcggcagcgcaaaagatg

SEQ ID NO: 159634 - DNA, 103 bp, Artificial Sequence
  Synthetic Polynucleotide
taatacgactcactatagggtgccagcatgggctccagcagctccttgataacagaggagaatcaagatgctgctggagaacctggcggcagcgcaaaagatg

SEQ ID NO: 159635 - DNA, 103 bp, Artificial Sequence
  Synthetic Polynucleotide
taatacgactcactatagggttagtcccactgccagcatgggctccagcaaacagaggagatgctggatgccatgctggaacctggcggcagcgcaaaagatg

SEQ ID NO: 159636 - DNA, 103 bp, Artificial Sequence
  Synthetic Polynucleotide
taatacgactcactatagggagggcagggcttagtcccactgccagcatgaacagaggagacatgctatgagtgggactaacctggcggcagcgcaaaagatg

SEQ ID NO: 159637 - DNA, 103 bp, Artificial Sequence
  Synthetic Polynucleotide
taatacgactcactatagggcactgcagtgagggcagggcttagtcccacaacagaggagagtgggaatgagccctgccaacctggcggcagcgcaaaagatg

SEQ ID NO: 159638 - DNA, 103 bp, Artificial Sequence
  Synthetic Polynucleotide
taatacgactcactatagggggtcgtagagcactgcagtgagggcagggcaacagaggagagccctgatgtcactgcagaacctggcggcagcgcaaaagatg

SEQ ID NO: 159639 - DNA, 103 bp, Artificial Sequence
  Synthetic Polynucleotide
taatacgactcactatagggtgacggctcaggtcgtagagcactgcagtgaacagaggagacactgcatggctctacgaaacctggcggcagcgcaaaagatg

SEQ ID NO: 159640 - DNA, 103 bp, Artificial Sequence
  Synthetic Polynucleotide
taatacgactcactatagggctgtggaatctgacggctcaggtcgtagagaacagaggagactctacatgctgagccgtaacctggcggcagcgcaaaagatg

SEQ ID NO: 159641 - DNA, 103 bp, Artificial Sequence
  Synthetic Polynucleotide
taatacgactcactatagggccttctttagctgtggaatctgacggctcaaacagaggagatgagccatgagattccacaacctggcggcagcgcaaaagatg

SEQ ID NO: 159642 - DNA, 103 bp, Artificial Sequence
  Synthetic Polynucleotide
taatacgactcactatagggtcttgaatgtccttctttagctgtggaatcaacagaggagagattccatggctaaagaaaacctggcggcagcgcaaaagatg

SEQ ID NO: 159643 - DNA, 103 bp, Artificial Sequence
  Synthetic Polynucleotide
taatacgactcactatagggagactcctcttgactcatctctcggagttcaacagaggagagaactcatggagatgagtaacctggcggcagcgcaaaagatg

SEQ ID NO: 159644 - DNA, 103 bp, Artificial Sequence
  Synthetic Polynucleotide
taatacgactcactatagggcagtagcccatcttgaatgtccttctttagaacagaggagactaaagatggacattcaaaacctggcggcagcgcaaaagatg

SEQ ID NO: 159645 - DNA, 103 bp, Artificial Sequence
  Synthetic Polynucleotide
taatacgactcactatagggacagcattttcagtagcccatcttgaatgtaacagaggagaacattcatgatgggctacaacctggcggcagcgcaaaagatg

SEQ ID NO: 159646 - DNA, 103 bp, Artificial Sequence
  Synthetic Polynucleotide
taatacgactcactatagggaggaccagggacagcattttcagtagcccaaacagaggagatgggctatggaaaatgctaacctggcggcagcgcaaaagatg

SEQ ID NO: 159647 - DNA, 103 bp, Artificial Sequence
  Synthetic Polynucleotide
taatacgactcactatagggtttgtgcataaggaccagggacagcattttaacagaggagaaaaatgatgtccctggtcaacctggcggcagcgcaaaagatg

SEQ ID NO: 159648 - DNA, 103 bp, Artificial Sequence
  Synthetic Polynucleotide
taatacgactcactatagggggcgaaggggtttgtgcataaggaccagggaacagaggagaccctggatgttatgcacaaacctggcggcagcgcaaaagatg

SEQ ID NO: 159649 - DNA, 103 bp, Artificial Sequence
  Synthetic Polynucleotide
taatacgactcactatagggatgcctgggtggcgaaggggtttgtgcataaacagaggagatatgcaatgaccccttcgaacctggcggcagcgcaaaagatg

SEQ ID NO: 159650 - DNA, 103 bp, Artificial Sequence
  Synthetic Polynucleotide
taatacgactcactataggggcccttgggcatgcctgggtggcgaaggggaacagaggagaccccttatgcacccaggcaacctggcggcagcgcaaaagatg

SEQ ID NO: 159651 - DNA, 103 bp, Artificial Sequence
  Synthetic Polynucleotide
taatacgactcactataggggatgggccaggcccttgggcatgcctgggtaacagaggagaacccagatgtgcccaaggaacctggcggcagcgcaaaagatg

SEQ ID NO: 159652 - DNA, 103 bp, Artificial Sequence
  Synthetic Polynucleotide
taatacgactcactataggggaggccagctgatgggccaggcccttgggcaacagaggagagcccaaatgcctggcccaaacctggcggcagcgcaaaagatg

SEQ ID NO: 159653 - DNA, 103 bp, Artificial Sequence
  Synthetic Polynucleotide
taatacgactcactataggggaggccaggagaggccagctgatgggccagaacagaggagactggccatgcagctggccaacctggcggcagcgcaaaagatg

SEQ ID NO: 159654 - DNA, 103 bp, Artificial Sequence
  Synthetic Polynucleotide
taatacgactcactatagggagaagcgagtagactcctcttgactcatctaacagaggagaagatgaatgaagaggagtaacctggcggcagcgcaaaagatg

SEQ ID NO: 159655 - DNA, 103 bp, Artificial Sequence
  Synthetic Polynucleotide
taatacgactcactatagggggagggtcgtgaggccaggagaggccagctaacagaggagaagctggatgctcctggccaacctggcggcagcgcaaaagatg

SEQ ID NO: 159656 - DNA, 103 bp, Artificial Sequence
  Synthetic Polynucleotide
taatacgactcactatagggctggcctcagggagggtcgtgaggccaggaaacagaggagatcctggatgcacgaccctaacctggcggcagcgcaaaagatg

SEQ ID NO: 159657 - DNA, 103 bp, Artificial Sequence
  Synthetic Polynucleotide
taatacgactcactataggggcccacatcgctggcctcagggagggtcgtaacagaggagaacgaccatgcctgaggccaacctggcggcagcgcaaaagatg

SEQ ID NO: 159658 - DNA, 103 bp, Artificial Sequence
  Synthetic Polynucleotide
taatacgactcactataggggagtgatgctgcccacatcgctggcctcagaacagaggagactgaggatggcgatgtggaacctggcggcagcgcaaaagatg

SEQ ID NO: 159659 - DNA, 103 bp, Artificial Sequence
  Synthetic Polynucleotide
taatacgactcactatagggcggagggcaagagtgatgctgcccacatcgaacagaggagacgatgtatgcagcatcacaacctggcggcagcgcaaaagatg

SEQ ID NO: 159660 - DNA, 103 bp, Artificial Sequence
  Synthetic Polynucleotide
taatacgactcactataggggccaagcgttcggagggcaagagtgatgctaacagaggagaagcatcatgcttgccctcaacctggcggcagcgcaaaagatg

SEQ ID NO: 159661 - DNA, 103 bp, Artificial Sequence
  Synthetic Polynucleotide
taatacgactcactatagggattcaaagctgccaagcgttcggagggcaaaacagaggagattgcccatggaacgcttgaacctggcggcagcgcaaaagatg

SEQ ID NO: 159662 - DNA, 103 bp, Artificial Sequence
  Synthetic Polynucleotide
taatacgactcactatagggtggccttcaaattcaaagctgccaagcgttaacagaggagaaacgctatgcagctttgaaacctggcggcagcgcaaaagatg

SEQ ID NO: 159663 - DNA, 103 bp, Artificial Sequence
  Synthetic Polynucleotide
taatacgactcactatagggggtcagagagtggccttcaaattcaaagctaacagaggagaagctttatgtttgaaggcaacctggcggcagcgcaaaagatg

SEQ ID NO: 159664 - DNA, 103 bp, Artificial Sequence
  Synthetic Polynucleotide
taatacgactcactataggggaacaaattgggtcagagagtggccttcaaaacagaggagattgaagatgactctctgaaacctggcggcagcgcaaaagatg

SEQ ID NO: 159665 - DNA, 103 bp, Artificial Sequence
  Synthetic Polynucleotide
taatacgactcactatagggagttggtcatagaagcgagtagactcctctaacagaggagaagaggaatgtactcgcttaacctggcggcagcgcaaaagatg

SEQ ID NO: 159666 - DNA, 103 bp, Artificial Sequence
  Synthetic Polynucleotide
taatacgactcactataggggcacagtggcgaacaaattgggtcagagagaacagaggagactctctatgccaatttgtaacctggcggcagcgcaaaagatg

SEQ ID NO: 159667 - DNA, 103 bp, Artificial Sequence
  Synthetic Polynucleotide
taatacgactcactataggggaaatgatccgcacagtggcgaacaaattgaacagaggagacaatttatgcgccactgtaacctggcggcagcgcaaaagatg

SEQ ID NO: 159668 - DNA, 103 bp, Artificial Sequence
  Synthetic Polynucleotide
taatacgactcactatagggcactgttcaggaaatgatccgcacagtggcaacagaggagagccactatgcggatcattaacctggcggcagcgcaaaagatg

SEQ ID NO: 159669 - DNA, 103 bp, Artificial Sequence
  Synthetic Polynucleotide
taatacgactcactatagggtccttgtgctcactgttcaggaaatgatccaacagaggagaggatcaatgcctgaacagaacctggcggcagcgcaaaagatg

SEQ ID NO: 159670 - DNA, 103 bp, Artificial Sequence
  Synthetic Polynucleotide
taatacgactcactatagggcatgcggatctccttgtgctcactgttcagaacagaggagactgaacatggagcacaagaacctggcggcagcgcaaaagatg

SEQ ID NO: 159671 - DNA, 103 bp, Artificial Sequence
  Synthetic Polynucleotide
taatacgactcactataggggggcagcctccatgcggatctccttgtgctaacagaggagaagcacaatgagatccgcaaacctggcggcagcgcaaaagatg

SEQ ID NO: 159672 - DNA, 103 bp, Artificial Sequence
  Synthetic Polynucleotide
taatacgactcactataggggagcaggtgcgggcagcctccatgcggatcaacagaggagagatccgatgggaggctgcaacctggcggcagcgcaaaagatg

SEQ ID NO: 159673 - DNA, 103 bp, Artificial Sequence
  Synthetic Polynucleotide
taatacgactcactataggggagcaggcgggagcaggtgcgggcagcctcaacagaggagagaggctatgcgcacctgcaacctggcggcagcgcaaaagatg

SEQ ID NO: 159674 - DNA, 103 bp, Artificial Sequence
  Synthetic Polynucleotide
taatacgactcactatagggtggagggtgtgagcaggcgggagcaggtgcaacagaggagagcacctatgcccgcctgcaacctggcggcagcgcaaaagatg

SEQ ID NO: 159675 - DNA, 103 bp, Artificial Sequence
  Synthetic Polynucleotide
taatacgactcactatagggatgaggtggatggagggtgtgagcaggcggaacagaggagaccgcctatgcacaccctcaacctggcggcagcgcaaaagatg

SEQ ID NO: 159676 - DNA, 103 bp, Artificial Sequence
  Synthetic Polynucleotide
taatacgactcactataggggtgatggttcagttggtcatagaagcgagtaacagaggagaactcgcatgtatgaccaaaacctggcggcagcgcaaaagatg

SEQ ID NO: 159677 - DNA, 103 bp, Artificial Sequence
  Synthetic Polynucleotide
taatacgactcactatagggatggccactgatgaggtggatggagggtgtaacagaggagaacacccatgatccacctcaacctggcggcagcgcaaaagatg

SEQ ID NO: 159678 - DNA, 103 bp, Artificial Sequence
  Synthetic Polynucleotide
taatacgactcactatagggccacatgagcatggccactgatgaggtggaaacagaggagatccaccatgtcagtggccaacctggcggcagcgcaaaagatg

SEQ ID NO: 159679 - DNA, 103 bp, Artificial Sequence
  Synthetic Polynucleotide
taatacgactcactataggggtctggctaaccacatgagcatggccactgaacagaggagacagtggatgtgctcatgtaacctggcggcagcgcaaaagatg

SEQ ID NO: 159680 - DNA, 103 bp, Artificial Sequence
  Synthetic Polynucleotide
taatacgactcactatagggttgcactgcggtctggctaaccacatgagcaacagaggagagctcatatggttagccagaacctggcggcagcgcaaaagatg

SEQ ID NO: 159681 - DNA, 103 bp, Artificial Sequence
  Synthetic Polynucleotide
taatacgactcactatagggctgccaccacttgcactgcggtctggctaaaacagaggagattagccatgccgcagtgcaacctggcggcagcgcaaaagatg

SEQ ID NO: 159682 - DNA, 103 bp, Artificial Sequence
  Synthetic Polynucleotide
taatacgactcactatagggctaagcacatctgccaccacttgcactgcgaacagaggagacgcagtatgagtggtggcaacctggcggcagcgcaaaagatg

SEQ ID NO: 159683 - DNA, 103 bp, Artificial Sequence
  Synthetic Polynucleotide
taatacgactcactataggggagcagtttgctaagcacatctgccaccacaacagaggagagtggtgatggatgtgcttaacctggcggcagcgcaaaagatg

SEQ ID NO: 159684 - DNA, 103 bp, Artificial Sequence
  Synthetic Polynucleotide
taatacgactcactatagggtcccaactacgagcagtttgctaagcacataacagaggagaatgtgcatggcaaactgcaacctggcggcagcgcaaaagatg

SEQ ID NO: 159685 - DNA, 103 bp, Artificial Sequence
  Synthetic Polynucleotide
taatacgactcactatagggggatctgttatcccaactacgagcagtttgaacagaggagacaaactatgcgtagttggaacctggcggcagcgcaaaagatg

SEQ ID NO: 159686 - DNA, 103 bp, Artificial Sequence
  Synthetic Polynucleotide
taatacgactcactataggggtcagggtcaggatctgttatcccaactacaacagaggagagtagttatgataacagataacctggcggcagcgcaaaagatg

SEQ ID NO: 159687 - DNA, 103 bp, Artificial Sequence
  Synthetic Polynucleotide
taatacgactcactatagggtggcagcggtggtggcggcggcaggtccggaacagaggagaccggacatgccgccgccaaacctggcggcagcgcaaaagatg

SEQ ID NO: 159688 - DNA, 103 bp, Artificial Sequence
  Synthetic Polynucleotide
taatacgactcactatagggattcaaaaatgtgatggttcagttggtcataacagaggagaatgaccatgtgaaccatcaacctggcggcagcgcaaaagatg

SEQ ID NO: 159689 - DNA, 103 bp, Artificial Sequence
  Synthetic Polynucleotide
taatacgactcactatagggagtagcgaatgtcagggtcaggatctgttaaacagaggagataacagatgctgaccctgaacctggcggcagcgcaaaagatg

SEQ ID NO: 159690 - DNA, 103 bp, Artificial Sequence
  Synthetic Polynucleotide
taatacgactcactataggggccaagacacagtagcgaatgtcagggtcaaacagaggagatgacccatgcattcgctaaacctggcggcagcgcaaaagatg

SEQ ID NO: 159691 - DNA, 103 bp, Artificial Sequence
  Synthetic Polynucleotide
taatacgactcactataggggtccagggacgccaagacacagtagcgaataacagaggagaattcgcatgtgtgtcttgaacctggcggcagcgcaaaagatg

SEQ ID NO: 159692 - DNA, 103 bp, Artificial Sequence
  Synthetic Polynucleotide
taatacgactcactatagggcaaagcgctcgtccagggacgccaagacacaacagaggagagtgtctatgcgtccctggaacctggcggcagcgcaaaagatg

SEQ ID NO: 159693 - DNA, 103 bp, Artificial Sequence
  Synthetic Polynucleotide
taatacgactcactatagggaggtgtgcatcaaagcgctcgtccagggacaacagaggagagtccctatgcgagcgcttaacctggcggcagcgcaaaagatg

SEQ ID NO: 159694 - DNA, 103 bp, Artificial Sequence
  Synthetic Polynucleotide
taatacgactcactatagggcgcctgggccaggtgtgcatcaaagcgctcaacagaggagagagcgcatggatgcacacaacctggcggcagcgcaaaagatg

SEQ ID NO: 159695 - DNA, 103 bp, Artificial Sequence
  Synthetic Polynucleotide
taatacgactcactataggggcaagttctccgcctgggccaggtgtgcataacagaggagaatgcacatgtggcccaggaacctggcggcagcgcaaaagatg

SEQ ID NO: 159696 - DNA, 103 bp, Artificial Sequence
  Synthetic Polynucleotide
taatacgactcactatagggaacaaggcctgcaagttctccgcctgggccaacagaggagaggcccaatgggagaacttaacctggcggcagcgcaaaagatg

SEQ ID NO: 159697 - DNA, 103 bp, Artificial Sequence
  Synthetic Polynucleotide
taatacgactcactatagggcagagccacaaacaaggcctgcaagttctcaacagaggagagagaacatgcaggccttgaacctggcggcagcgcaaaagatg

SEQ ID NO: 159698 - DNA, 103 bp, Artificial Sequence
  Synthetic Polynucleotide
taatacgactcactatagggcctggtcattcagagccacaaacaaggcctaacagaggagaaggcctatgttgtggctcaacctggcggcagcgcaaaagatg

SEQ ID NO: 159699 - DNA, 103 bp, Artificial Sequence
  Synthetic Polynucleotide
taatacgactcactatagggctggaaaccaattcaaaaatgtgatggttcaacagaggagagaaccaatgcatttttgaaacctggcggcagcgcaaaagatg

SEQ ID NO: 159700 - DNA, 103 bp, Artificial Sequence
  Synthetic Polynucleotide
taatacgactcactatagggatctcaaacacctggtcattcagagccacaaacagaggagatgtggcatggaatgaccaaacctggcggcagcgcaaaagatg

SEQ ID NO: 159701 - DNA, 103 bp, Artificial Sequence
  Synthetic Polynucleotide
taatacgactcactatagggcagctcccggatctcaaacacctggtcattaacagaggagaaatgacatggtgtttgagaacctggcggcagcgcaaaagatg

SEQ ID NO: 159702 - DNA, 103 bp, Artificial Sequence
  Synthetic Polynucleotide
taatacgactcactatagggtgcagatggccagctcccggatctcaaacaaacagaggagatgtttgatgtccgggagcaacctggcggcagcgcaaaagatg

SEQ ID NO: 159703 - DNA, 103 bp, Artificial Sequence
  Synthetic Polynucleotide
taatacgactcactatagggcggcccacagtgcagatggccagctcccggaacagaggagaccgggaatgggccatctgaacctggcggcagcgcaaaagatg

SEQ ID NO: 159704 - DNA, 103 bp, Artificial Sequence
  Synthetic Polynucleotide
taatacgactcactataggggctactgagtcggcccacagtgcagatggcaacagaggagagccatcatgactgtgggcaacctggcggcagcgcaaaagatg

SEQ ID NO: 159705 - DNA, 103 bp, Artificial Sequence
  Synthetic Polynucleotide
taatacgactcactatagggcagggttcatgctactgagtcggcccacagaacagaggagactgtggatggactcagtaaacctggcggcagcgcaaaagatg

SEQ ID NO: 159706 - DNA, 103 bp, Artificial Sequence
  Synthetic Polynucleotide
taatacgactcactatagggatgacaaaggcagggttcatgctactgagtaacagaggagaactcagatgcatgaacccaacctggcggcagcgcaaaagatg

SEQ ID NO: 159707 - DNA, 103 bp, Artificial Sequence
  Synthetic Polynucleotide
taatacgactcactatagggcaggaaaggcatgacaaaggcagggttcataacagaggagaatgaacatggcctttgtcaacctggcggcagcgcaaaagatg

SEQ ID NO: 159708 - DNA, 103 bp, Artificial Sequence
  Synthetic Polynucleotide
taatacgactcactataggggcatcttgcgcaggaaaggcatgacaaaggaacagaggagacctttgatgtgcctttccaacctggcggcagcgcaaaagatg

SEQ ID NO: 159709 - DNA, 103 bp, Artificial Sequence
  Synthetic Polynucleotide
taatacgactcactatagggatctggatgagcatcttgcgcaggaaaggcaacagaggagagcctttatggcgcaagataacctggcggcagcgcaaaagatg

SEQ ID NO: 159710 - DNA, 103 bp, Artificial Sequence
  Synthetic Polynucleotide
taatacgactcactatagggggcatctgagctggaaaccaattcaaaaataacagaggagaatttttatgttggtttccaacctggcggcagcgcaaaagatg

SEQ ID NO: 159711 - DNA, 103 bp, Artificial Sequence
  Synthetic Polynucleotide
taatacgactcactatagggctctgtcaaaatctggatgagcatcttgcgaacagaggagacgcaagatgctcatccagaacctggcggcagcgcaaaagatg

SEQ ID NO: 159712 - DNA, 103 bp, Artificial Sequence
  Synthetic Polynucleotide
taatacgactcactatagggtgtgctccaactctgtcaaaatctggatgaaacagaggagatcatccatgttttgacagaacctggcggcagcgcaaaagatg

SEQ ID NO: 159713 - DNA, 103 bp, Artificial Sequence
  Synthetic Polynucleotide
taatacgactcactatagggccaatcccactgtgctccaactctgtcaaaaacagaggagatttgacatggttggagcaaacctggcggcagcgcaaaagatg

SEQ ID NO: 159714 - DNA, 103 bp, Artificial Sequence
  Synthetic Polynucleotide
taatacgactcactatagggtttgattcttccaatcccactgtgctccaaaacagaggagattggagatgagtgggattaacctggcggcagcgcaaaagatg

SEQ ID NO: 159715 - DNA, 103 bp, Artificial Sequence
  Synthetic Polynucleotide
taatacgactcactatagggcactctgctctttgattcttccaatcccacaacagaggagagtgggaatggaagaatcaaacctggcggcagcgcaaaagatg

SEQ ID NO: 159716 - DNA, 103 bp, Artificial Sequence
  Synthetic Polynucleotide
taatacgactcactatagggagcatgcgggcactctgctctttgattcttaacagaggagaaagaatatgagagcagagaacctggcggcagcgcaaaagatg

SEQ ID NO: 159717 - DNA, 103 bp, Artificial Sequence
  Synthetic Polynucleotide
taatacgactcactatagggcaggtgccccagcatgcgggcactctgctcaacagaggagagagcagatggcccgcatgaacctggcggcagcgcaaaagatg

SEQ ID NO: 159718 - DNA, 103 bp, Artificial Sequence
  Synthetic Polynucleotide
taatacgactcactatagggcattggagaccaggtgccccagcatgcgggaacagaggagacccgcaatgtggggcaccaacctggcggcagcgcaaaagatg

SEQ ID NO: 159719 - DNA, 103 bp, Artificial Sequence
  Synthetic Polynucleotide
taatacgactcactatagggagtcggggggcattggagaccaggtgccccaacagaggagaggggcaatgggtctccaaaacctggcggcagcgcaaaagatg

SEQ ID NO: 159720 - DNA, 103 bp, Artificial Sequence
  Synthetic Polynucleotide
taatacgactcactatagggggggcggatgagtcggggggcattggagacaacagaggagagtctccatggccccccgaaacctggcggcagcgcaaaagatg

SEQ ID NO: 159721 - DNA, 103 bp, Artificial Sequence
  Synthetic Polynucleotide
taatacgactcactatagggtcctctcattggcatctgagctggaaaccaaacagaggagatggtttatggctcagatgaacctggcggcagcgcaaaagatg

SEQ ID NO: 159722 - DNA, 103 bp, Artificial Sequence
  Synthetic Polynucleotide
taatacgactcactataggggctccatgtaggggcggatgagtcggggggaacagaggagaccccccatgtcatccgccaacctggcggcagcgcaaaagatg

SEQ ID NO: 159723 - DNA, 103 bp, Artificial Sequence
  Synthetic Polynucleotide
taatacgactcactatagggttcagaataggctccatgtaggggcggatgaacagaggagacatccgatgctacatggaaacctggcggcagcgcaaaagatg

SEQ ID NO: 159724 - DNA, 103 bp, Artificial Sequence
  Synthetic Polynucleotide
taatacgactcactatagggaattaatgccttcagaataggctccatgtaaacagaggagatacatgatgcctattctgaacctggcggcagcgcaaaagatg

SEQ ID NO: 159725 - DNA, 103 bp, Artificial Sequence
  Synthetic Polynucleotide
taatacgactcactatagggtcagtttcaaaattaatgccttcagaatagaacagaggagactattcatgaggcattaaaacctggcggcagcgcaaaagatg

SEQ ID NO: 159726 - DNA, 103 bp, Artificial Sequence
  Synthetic Polynucleotide
taatacgactcactatagggtctggatctttcagtttcaaaattaatgccaacagaggagaggcattatgtttgaaactaacctggcggcagcgcaaaagatg

SEQ ID NO: 159727 - DNA, 103 bp, Artificial Sequence
  Synthetic Polynucleotide
taatacgactcactatagggtggatcagggtctggatctttcagtttcaaaacagaggagattgaaaatgaaagatccaaacctggcggcagcgcaaaagatg

SEQ ID NO: 159728 - DNA, 103 bp, Artificial Sequence
  Synthetic Polynucleotide
taatacgactcactatagggcacctgggtttggatcagggtctggatcttaacagaggagaaagatcatgaccctgatcaacctggcggcagcgcaaaagatg

SEQ ID NO: 159729 - DNA, 103 bp, Artificial Sequence
  Synthetic Polynucleotide
taatacgactcactatagggttattgatcacacctgggtttggatcagggaacagaggagaccctgaatgaaacccaggaacctggcggcagcgcaaaagatg

SEQ ID NO: 159730 - DNA, 103 bp, Artificial Sequence
  Synthetic Polynucleotide
taatacgactcactatagggtgccaggacattattgatcacacctgggttaacagaggagaaacccaatggtgatcaataacctggcggcagcgcaaaagatg

SEQ ID NO: 159731 - DNA, 103 bp, Artificial Sequence
  Synthetic Polynucleotide
taatacgactcactatagggctcctattgttgccaggacattattgatcaaacagaggagatgatcaatgatgtcctggaacctggcggcagcgcaaaagatg

SEQ ID NO: 159732 - DNA, 103 bp, Artificial Sequence
  Synthetic Polynucleotide
taatacgactcactatagggatgccacctttcctctcattggcatctgagaacagaggagactcagaatgcaatgagagaacctggcggcagcgcaaaagatg

SEQ ID NO: 159733 - DNA, 103 bp, Artificial Sequence
  Synthetic Polynucleotide
taatacgactcactatagggtgtgccaattctcctattgttgccaggacaaacagaggagatgtcctatgaacaataggaacctggcggcagcgcaaaagatg

SEQ ID NO: 159734 - DNA, 103 bp, Artificial Sequence
  Synthetic Polynucleotide
taatacgactcactataggggccactaacctgtgccaattctcctattgtaacagaggagaacaataatggaattggcaaacctggcggcagcgcaaaagatg

SEQ ID NO: 159735 - DNA, 103 bp, Artificial Sequence
  Synthetic Polynucleotide
taatacgactcactatagggtcatttccaggccactaacctgtgccaattaacagaggagaaattggatgaggttagtgaacctggcggcagcgcaaaagatg

SEQ ID NO: 159736 - DNA, 103 bp, Artificial Sequence
  Synthetic Polynucleotide
taatacgactcactatagggacccatttcctcatttccaggccactaaccaacagaggagaggttagatgcctggaaataacctggcggcagcgcaaaagatg

SEQ ID NO: 159737 - DNA, 103 bp, Artificial Sequence
  Synthetic Polynucleotide
taatacgactcactatagggaagttcatcaacccatttcctcatttccagaacagaggagactggaaatgaggaaatggaacctggcggcagcgcaaaagatg

SEQ ID NO: 159738 - DNA, 103 bp, Artificial Sequence
  Synthetic Polynucleotide
taatacgactcactatagggtgataataaaaagttcatcaacccatttccaacagaggagaggaaatatgttgatgaacaacctggcggcagcgcaaaagatg

SEQ ID NO: 159739 - DNA, 103 bp, Artificial Sequence
  Synthetic Polynucleotide
taatacgactcactatagggatgtccatgatgataataaaaagttcatcaaacagaggagatgatgaatgttttattataacctggcggcagcgcaaaagatg

SEQ ID NO: 159740 - DNA, 103 bp, Artificial Sequence
  Synthetic Polynucleotide
taatacgactcactatagggatcctggagcatgtccatgatgataataaaaacagaggagatttattatgatcatggacaacctggcggcagcgcaaaagatg

SEQ ID NO: 159741 - DNA, 103 bp, Artificial Sequence
  Synthetic Polynucleotide
taatacgactcactatagggacaaagaggaatcctggagcatgtccatgaaacagaggagatcatggatgtgctccaggaacctggcggcagcgcaaaagatg

SEQ ID NO: 159742 - DNA, 103 bp, Artificial Sequence
  Synthetic Polynucleotide
taatacgactcactatagggcttttggccaacaaagaggaatcctggagcaacagaggagagctccaatgttcctctttaacctggcggcagcgcaaaagatg

SEQ ID NO: 159743 - DNA, 103 bp, Artificial Sequence
  Synthetic Polynucleotide
taatacgactcactatagggtatggccaagatgccacctttcctctcattaacagaggagaaatgagatgaaaggtggcaacctggcggcagcgcaaaagatg

SEQ ID NO: 159744 - DNA, 103 bp, Artificial Sequence
  Synthetic Polynucleotide
taatacgactcactatagggagccacctgccttttggccaacaaagaggaaacagaggagatcctctatgttggccaaaaacctggcggcagcgcaaaagatg

SEQ ID NO: 159745 - DNA, 103 bp, Artificial Sequence
  Synthetic Polynucleotide
taatacgactcactataggggggtccacagagccacctgccttttggccaaacagaggagatggccaatgggcaggtggaacctggcggcagcgcaaaagatg

SEQ ID NO: 159746 - DNA, 103 bp, Artificial Sequence
  Synthetic Polynucleotide
taatacgactcactatagggaactgtcccagggtccacagagccacctgcaacagaggagagcaggtatgtctgtggacaacctggcggcagcgcaaaagatg

SEQ ID NO: 159747 - DNA, 103 bp, Artificial Sequence
  Synthetic Polynucleotide
taatacgactcactataggggctggccaccaactgtcccagggtccacagaacagaggagactgtggatgctgggacagaacctggcggcagcgcaaaagatg

SEQ ID NO: 159748 - DNA, 103 bp, Artificial Sequence
  Synthetic Polynucleotide
taatacgactcactatagggcatagccagtgctggccaccaactgtcccaaacagaggagatgggacatgtggtggccaaacctggcggcagcgcaaaagatg

SEQ ID NO: 159749 - DNA, 103 bp, Artificial Sequence
  Synthetic Polynucleotide
taatacgactcactatagggggctctactacatagccagtgctggccaccaacagaggagaggtggcatgcactggctaaacctggcggcagcgcaaaagatg

SEQ ID NO: 159750 - DNA, 103 bp, Artificial Sequence
  Synthetic Polynucleotide
taatacgactcactatagggcttcctgtagggctctactacatagccagtaacagaggagaactggcatggtagtagagaacctggcggcagcgcaaaagatg

SEQ ID NO: 159751 - DNA, 103 bp, Artificial Sequence
  Synthetic Polynucleotide
taatacgactcactatagggaagtagggtacttcctgtagggctctactaaacagaggagatagtagatgcctacaggaaacctggcggcagcgcaaaagatg

SEQ ID NO: 159752 - DNA, 103 bp, Artificial Sequence
  Synthetic Polynucleotide
taatacgactcactatagggacctcaagcaaagtagggtacttcctgtagaacagaggagactacagatggtaccctacaacctggcggcagcgcaaaagatg

SEQ ID NO: 159753 - DNA, 103 bp, Artificial Sequence
  Synthetic Polynucleotide
taatacgactcactatagggattcagtagcacctcaagcaaagtagggtaaacagaggagataccctatgttgcttgagaacctggcggcagcgcaaaagatg

SEQ ID NO: 159754 - DNA, 103 bp, Artificial Sequence
  Synthetic Polynucleotide
taatacgactcactatagggtgaggctagctatggccaagatgccaccttaacagaggagaaaggtgatgtcttggccaaacctggcggcagcgcaaaagatg

SEQ ID NO: 159755 - DNA, 103 bp, Artificial Sequence
  Synthetic Polynucleotide
taatacgactcactatagggtcttcagaaaattcagtagcacctcaagcaaacagaggagatgcttgatgtgctactgaaacctggcggcagcgcaaaagatg

SEQ ID NO: 159756 - DNA, 103 bp, Artificial Sequence
  Synthetic Polynucleotide
taatacgactcactatagggttctgctcagtcttcagaaaattcagtagcaacagaggagagctactatgttttctgaaaacctggcggcagcgcaaaagatg

SEQ ID NO: 159757 - DNA, 103 bp, Artificial Sequence
  Synthetic Polynucleotide
taatacgactcactatagggtgtaccctggttctgctcagtcttcagaaaaacagaggagatttctgatgactgagcagaacctggcggcagcgcaaaagatg

SEQ ID NO: 159758 - DNA, 103 bp, Artificial Sequence
  Synthetic Polynucleotide
taatacgactcactatagggcctctctgcgtgtaccctggttctgctcagaacagaggagactgagcatgaccagggtaaacctggcggcagcgcaaaagatg

SEQ ID NO: 159759 - DNA, 103 bp, Artificial Sequence
  Synthetic Polynucleotide
taatacgactcactatagggacacggatggcctctctgcgtgtaccctggaacagaggagaccagggatgacgcagagaaacctggcggcagcgcaaaagatg

SEQ ID NO: 159760 - DNA, 103 bp, Artificial Sequence
  Synthetic Polynucleotide
taatacgactcactatagggaagccctaacacacggatggcctctctgcgaacagaggagacgcagaatggccatccgtaacctggcggcagcgcaaaagatg

SEQ ID NO: 159761 - DNA, 103 bp, Artificial Sequence
  Synthetic Polynucleotide
taatacgactcactatagggaagcccctaaaagccctaacacacggatggaacagaggagaccatccatgtgttagggcaacctggcggcagcgcaaaagatg

SEQ ID NO: 159762 - DNA, 103 bp, Artificial Sequence
  Synthetic Polynucleotide
taatacgactcactatagggtaaggatccaaagcccctaaaagccctaacaacagaggagagttaggatgtttaggggcaacctggcggcagcgcaaaagatg

SEQ ID NO: 159763 - DNA, 103 bp, Artificial Sequence
  Synthetic Polynucleotide
taatacgactcactatagggtttgtgcttgtaaggatccaaagcccctaaaacagaggagattagggatgttggatcctaacctggcggcagcgcaaaagatg

SEQ ID NO: 159764 - DNA, 103 bp, Artificial Sequence
  Synthetic Polynucleotide
taatacgactcactatagggcaatgttcactttgtgcttgtaaggatccaaacagaggagatggatcatgacaagcacaaacctggcggcagcgcaaaagatg

SEQ ID NO: 159765 - DNA, 103 bp, Artificial Sequence
  Synthetic Polynucleotide
taatacgactcactatagggtccactcctatgaggctagctatggccaagaacagaggagacttggcatgagctagcctaacctggcggcagcgcaaaagatg

SEQ ID NO: 159766 - DNA, 103 bp, Artificial Sequence
  Synthetic Polynucleotide
taatacgactcactatagggtctatcatgccaatgttcactttgtgcttgaacagaggagacaagcaatgagtgaacataacctggcggcagcgcaaaagatg

SEQ ID NO: 159767 - DNA, 103 bp, Artificial Sequence
  Synthetic Polynucleotide
taatacgactcactatagggccgggactggtctatcatgccaatgttcacaacagaggagagtgaacatgggcatgataaacctggcggcagcgcaaaagatg

SEQ ID NO: 159768 - DNA, 103 bp, Artificial Sequence
  Synthetic Polynucleotide
taatacgactcactatagggcagaggcatcccgggactggtctatcatgcaacagaggagagcatgaatgaccagtcccaacctggcggcagcgcaaaagatg

SEQ ID NO: 159769 - DNA, 103 bp, Artificial Sequence
  Synthetic Polynucleotide
taatacgactcactatagggaggctgacagcagaggcatcccgggactggaacagaggagaccagtcatgggatgcctcaacctggcggcagcgcaaaagatg

SEQ ID NO: 159770 - DNA, 103 bp, Artificial Sequence
  Synthetic Polynucleotide
taatacgactcactatagggggattctgacaggctgacagcagaggcatcaacagaggagagatgccatggctgtcagcaacctggcggcagcgcaaaagatg

SEQ ID NO: 159771 - DNA, 103 bp, Artificial Sequence
  Synthetic Polynucleotide
taatacgactcactataggggacttgacttggattctgacaggctgacagaacagaggagactgtcaatgtgtcagaataacctggcggcagcgcaaaagatg

SEQ ID NO: 159772 - DNA, 103 bp, Artificial Sequence
  Synthetic Polynucleotide
taatacgactcactataggggaggaatcctgacttgacttggattctgacaacagaggagagtcagaatgcaagtcaagaacctggcggcagcgcaaaagatg

SEQ ID NO: 159773 - DNA, 103 bp, Artificial Sequence
  Synthetic Polynucleotide
taatacgactcactataggggctatagtcagaggaatcctgacttgacttaacagaggagaaagtcaatgcaggattccaacctggcggcagcgcaaaagatg

SEQ ID NO: 159774 - DNA, 103 bp, Artificial Sequence
  Synthetic Polynucleotide
taatacgactcactatagggtttcactagtgctatagtcagaggaatcctaacagaggagaaggattatgctgactataaacctggcggcagcgcaaaagatg

SEQ ID NO: 159775 - DNA, 103 bp, Artificial Sequence
  Synthetic Polynucleotide
taatacgactcactatagggttgaccagcatttcactagtgctatagtcaaacagaggagatgactaatgcactagtgaaacctggcggcagcgcaaaagatg

SEQ ID NO: 159776 - DNA, 103 bp, Artificial Sequence
  Synthetic Polynucleotide
taatacgactcactatagggattcccaccttccactcctatgaggctagcaacagaggagagctagcatgataggagtgaacctggcggcagcgcaaaagatg

SEQ ID NO: 159777 - DNA, 103 bp, Artificial Sequence
  Synthetic Polynucleotide
taatacgactcactataggggtttcccatgttgaccagcatttcactagtaacagaggagaactagtatgatgctggtcaacctggcggcagcgcaaaagatg

SEQ ID NO: 159778 - DNA, 103 bp, Artificial Sequence
  Synthetic Polynucleotide
taatacgactcactatagggccagaggcaagtttcccatgttgaccagcaaacagaggagatgctggatgacatgggaaaacctggcggcagcgcaaaagatg

SEQ ID NO: 159779 - DNA, 103 bp, Artificial Sequence
  Synthetic Polynucleotide
taatacgactcactatagggtagaactcatccagaggcaagtttcccatgaacagaggagacatgggatgcttgcctctaacctggcggcagcgcaaaagatg

SEQ ID NO: 159780 - DNA, 103 bp, Artificial Sequence
  Synthetic Polynucleotide
taatacgactcactatagggcacagctgggtagaactcatccagaggcaaaacagaggagattgcctatggatgagttcaacctggcggcagcgcaaaagatg

SEQ ID NO: 159781 - DNA, 103 bp, Artificial Sequence
  Synthetic Polynucleotide
taatacgactcactatagggccaccatggacacagctgggtagaactcataacagaggagaatgagtatgacccagctgaacctggcggcagcgcaaaagatg

SEQ ID NO: 159782 - DNA, 103 bp, Artificial Sequence
  Synthetic Polynucleotide
taatacgactcactatagggcgcatcagggccaccatggacacagctgggaacagaggagacccagcatggtccatggtaacctggcggcagcgcaaaagatg

SEQ ID NO: 159783 - DNA, 103 bp, Artificial Sequence
  Synthetic Polynucleotide
taatacgactcactatagggtcggaagatccgcatcagggccaccatggaaacagaggagatccatgatggccctgatgaacctggcggcagcgcaaaagatg

SEQ ID NO: 159784 - DNA, 103 bp, Artificial Sequence
  Synthetic Polynucleotide
taatacgactcactataggggtgactggtctcggaagatccgcatcagggaacagaggagaccctgaatgggatcttccaacctggcggcagcgcaaaagatg

SEQ ID NO: 159785 - DNA, 103 bp, Artificial Sequence
  Synthetic Polynucleotide
taatacgactcactatagggtgatgagagagtgactggtctcggaagatcaacagaggagagatcttatgagaccagtcaacctggcggcagcgcaaaagatg

SEQ ID NO: 159786 - DNA, 103 bp, Artificial Sequence
  Synthetic Polynucleotide
taatacgactcactatagggcatggtgtgatgatgagagagtgactggtcaacagaggagagaccagatgctctctcataacctggcggcagcgcaaaagatg

SEQ ID NO: 159787 - DNA, 103 bp, Artificial Sequence
  Synthetic Polynucleotide
taatacgactcactatagggttcgggtggcattcccaccttccactcctaaacagaggagataggagatgaaggtgggaaacctggcggcagcgcaaaagatg

SEQ ID NO: 159788 - DNA, 103 bp, Artificial Sequence
  Synthetic Polynucleotide
taatacgactcactatagggcctggacaaccatggtgtgatgatgagagaaacagaggagatctctcatgatcacaccaaacctggcggcagcgcaaaagatg

SEQ ID NO: 159789 - DNA, 103 bp, Artificial Sequence
  Synthetic Polynucleotide
taatacgactcactatagggaaggtgatggcctggacaaccatggtgtgaaacagaggagatcacacatgggttgtccaaacctggcggcagcgcaaaagatg

SEQ ID NO: 159790 - DNA, 103 bp, Artificial Sequence
  Synthetic Polynucleotide
taatacgactcactatagggcttgaagatgaaggtgatggcctggacaacaacagaggagagttgtcatggccatcaccaacctggcggcagcgcaaaagatg

SEQ ID NO: 159791 - DNA, 103 bp, Artificial Sequence
  Synthetic Polynucleotide
taatacgactcactataggggtcccagggacttgaagatgaaggtgatggaacagaggagaccatcaatgtcatcttcaaacctggcggcagcgcaaaagatg

SEQ ID NO: 159792 - DNA, 103 bp, Artificial Sequence
  Synthetic Polynucleotide
taatacgactcactatagggacacatttgagtcccagggacttgaagatgaacagaggagacatcttatggtccctgggaacctggcggcagcgcaaaagatg

SEQ ID NO: 159793 - DNA, 103 bp, Artificial Sequence
  Synthetic Polynucleotide
taatacgactcactatagggcaggaactgcacacatttgagtcccagggaaacagaggagatccctgatgctcaaatgtaacctggcggcagcgcaaaagatg

SEQ ID NO: 159794 - DNA, 103 bp, Artificial Sequence
  Synthetic Polynucleotide
taatacgactcactatagggtgacctggggcaggaactgcacacatttgaaacagaggagatcaaatatgtgcagttccaacctggcggcagcgcaaaagatg

SEQ ID NO: 159795 - DNA, 103 bp, Artificial Sequence
  Synthetic Polynucleotide
taatacgactcactatagggaacgtgggcatgacctggggcaggaactgcaacagaggagagcagttatggccccaggtaacctggcggcagcgcaaaagatg

SEQ ID NO: 159796 - DNA, 103 bp, Artificial Sequence
  Synthetic Polynucleotide
taatacgactcactataggggacgttaaggaacgtgggcatgacctggggaacagaggagaccccagatgatgcccacgaacctggcggcagcgcaaaagatg

SEQ ID NO: 159797 - DNA, 103 bp, Artificial Sequence
  Synthetic Polynucleotide
taatacgactcactatagggagactcgaatgacgttaaggaacgtgggcaaacagaggagatgcccaatgtccttaacgaacctggcggcagcgcaaaagatg

SEQ ID NO: 159798 - DNA, 103 bp, Artificial Sequence
  Synthetic Polynucleotide
taatacgactcactatagggctagatgtggtggcagcggtggtggcggcgaacagaggagacgccgcatgcaccgctgcaacctggcggcagcgcaaaagatg

SEQ ID NO: 159799 - DNA, 103 bp, Artificial Sequence
  Synthetic Polynucleotide
taatacgactcactatagggaatctgccaattcgggtggcattcccacctaacagaggagaaggtggatgtgccacccgaacctggcggcagcgcaaaagatg

SEQ ID NO: 159800 - DNA, 103 bp, Artificial Sequence
  Synthetic Polynucleotide
taatacgactcactataggggccccatcacagactcgaatgacgttaaggaacagaggagaccttaaatgcattcgagtaacctggcggcagcgcaaaagatg

SEQ ID NO: 159801 - DNA, 103 bp, Artificial Sequence
  Synthetic Polynucleotide
taatacgactcactatagggttcccggatggccccatcacagactcgaataacagaggagaattcgaatgtgtgatgggaacctggcggcagcgcaaaagatg

SEQ ID NO: 159802 - DNA, 103 bp, Artificial Sequence
  Synthetic Polynucleotide
taatacgactcactatagggggaacaaaaattcccggatggccccatcacaacagaggagagtgatgatgccatccgggaacctggcggcagcgcaaaagatg

SEQ ID NO: 159803 - DNA, 103 bp, Artificial Sequence
  Synthetic Polynucleotide
taatacgactcactatagggcccagctgctggaacaaaaattcccggatgaacagaggagacatccgatgatttttgttaacctggcggcagcgcaaaagatg

SEQ ID NO: 159804 - DNA, 103 bp, Artificial Sequence
  Synthetic Polynucleotide
taatacgactcactatagggcaccaacattcccagctgctggaacaaaaaaacagaggagatttttgatgcagcagctgaacctggcggcagcgcaaaagatg

SEQ ID NO: 159805 - DNA, 103 bp, Artificial Sequence
  Synthetic Polynucleotide
taatacgactcactatagggtcacaaaggacaccaacattcccagctgctaacagaggagaagcagcatggaatgttggaacctggcggcagcgcaaaagatg

SEQ ID NO: 159806 - DNA, 103 bp, Artificial Sequence
  Synthetic Polynucleotide
taatacgactcactatagggatgtggctcttcacaaaggacaccaacattaacagaggagaaatgttatggtcctttgtaacctggcggcagcgcaaaagatg

SEQ ID NO: 159807 - DNA, 103 bp, Artificial Sequence
  Synthetic Polynucleotide
taatacgactcactatagggataaggtctgatgtggctcttcacaaaggaaacagaggagatcctttatgaagagccacaacctggcggcagcgcaaaagatg

SEQ ID NO: 159808 - DNA, 103 bp, Artificial Sequence
  Synthetic Polynucleotide
taatacgactcactatagggtttcatccatataaggtctgatgtggctctaacagaggagaagagccatgtcagaccttaacctggcggcagcgcaaaagatg

SEQ ID NO: 159809 - DNA, 103 bp, Artificial Sequence
  Synthetic Polynucleotide
taatacgactcactatagggagggtgactatttcatccatataaggtctgaacagaggagacagaccatgtatggatgaaacctggcggcagcgcaaaagatg

SEQ ID NO: 159810 - DNA, 103 bp, Artificial Sequence
  Synthetic Polynucleotide
taatacgactcactatagggatagttggcaaatctgccaattcgggtggcaacagaggagagccaccatgattggcagaaacctggcggcagcgcaaaagatg

SEQ ID NO: 159811 - DNA, 103 bp, Artificial Sequence
  Synthetic Polynucleotide
taatacgactcactatagggttctctcatgagggtgactatttcatccataacagaggagaatggatatgatagtcaccaacctggcggcagcgcaaaagatg

SEQ ID NO: 159812 - DNA, 103 bp, Artificial Sequence
  Synthetic Polynucleotide
taatacgactcactatagggtgacccagaattctctcatgagggtgactaaacagaggagatagtcaatgtcatgagagaacctggcggcagcgcaaaagatg

SEQ ID NO: 159813 - DNA, 103 bp, Artificial Sequence
  Synthetic Polynucleotide
taatacgactcactataggggaggtgttcatgacccagaattctctcatgaacagaggagacatgagatgattctgggtaacctggcggcagcgcaaaagatg

SEQ ID NO: 159814 - DNA, 103 bp, Artificial Sequence
  Synthetic Polynucleotide
taatacgactcactataggggctctgaattgaggtgttcatgacccagaaaacagaggagattctggatgatgaacaccaacctggcggcagcgcaaaagatg

SEQ ID NO: 159815 - DNA, 103 bp, Artificial Sequence
  Synthetic Polynucleotide
taatacgactcactataggggaatgatcgtgctctgaattgaggtgttcaaacagaggagatgaacaatgcaattcagaaacctggcggcagcgcaaaagatg

SEQ ID NO: 159816 - DNA, 103 bp, Artificial Sequence
  Synthetic Polynucleotide
taatacgactcactatagggtcaatgagaagaatgatcgtgctctgaattaacagaggagaaattcaatgcacgatcataacctggcggcagcgcaaaagatg

SEQ ID NO: 159817 - DNA, 103 bp, Artificial Sequence
  Synthetic Polynucleotide
taatacgactcactatagggcacaatttgctcaatgagaagaatgatcgtaacagaggagaacgatcatgcttctcattaacctggcggcagcgcaaaagatg

SEQ ID NO: 159818 - DNA, 103 bp, Artificial Sequence
  Synthetic Polynucleotide
taatacgactcactatagggcaagagctaccacaatttgctcaatgagaaaacagaggagattctcaatgagcaaattgaacctggcggcagcgcaaaagatg

SEQ ID NO: 159819 - DNA, 103 bp, Artificial Sequence
  Synthetic Polynucleotide
taatacgactcactatagggaattcacccccaagagctaccacaatttgcaacagaggagagcaaatatgggtagctctaacctggcggcagcgcaaaagatg

SEQ ID NO: 159820 - DNA, 103 bp, Artificial Sequence
  Synthetic Polynucleotide
taatacgactcactataggggtagagcttaaattcacccccaagagctacaacagaggagagtagctatggggggtgaaaacctggcggcagcgcaaaagatg

SEQ ID NO: 159821 - DNA, 103 bp, Artificial Sequence
  Synthetic Polynucleotide
taatacgactcactatagggggttccgaagatagttggcaaatctgccaaaacagaggagattggcaatgttgccaactaacctggcggcagcgcaaaagatg

SEQ ID NO: 159822 - DNA, 103 bp, Artificial Sequence
  Synthetic Polynucleotide
taatacgactcactataggggctggggcaggtagagcttaaattcaccccaacagaggagaggggtgatgttaagctctaacctggcggcagcgcaaaagatg

SEQ ID NO: 159823 - DNA, 103 bp, Artificial Sequence
  Synthetic Polynucleotide
taatacgactcactatagggtgtgggatcagctggggcaggtagagcttaaacagaggagataagctatgcctgccccaaacctggcggcagcgcaaaagatg

SEQ ID NO: 159824 - DNA, 103 bp, Artificial Sequence
  Synthetic Polynucleotide
taatacgactcactatagggacgcagcatgtgtgggatcagctggggcagaacagaggagactgcccatgctgatcccaaacctggcggcagcgcaaaagatg

SEQ ID NO: 159825 - DNA, 103 bp, Artificial Sequence
  Synthetic Polynucleotide
taatacgactcactataggggcatgaagacacgcagcatgtgtgggatcaaacagaggagatgatccatgacatgctgcaacctggcggcagcgcaaaagatg

SEQ ID NO: 159826 - DNA, 103 bp, Artificial Sequence
  Synthetic Polynucleotide
taatacgactcactatagggctgttgtcatgcatgaagacacgcagcatgaacagaggagacatgctatgtgtcttcataacctggcggcagcgcaaaagatg

SEQ ID NO: 159827 - DNA, 103 bp, Artificial Sequence
  Synthetic Polynucleotide
taatacgactcactataggggcggcctgggctgttgtcatgcatgaagacaacagaggagagtcttcatgcatgacaacaacctggcggcagcgcaaaagatg

SEQ ID NO: 159828 - DNA, 103 bp, Artificial Sequence
  Synthetic Polynucleotide
taatacgactcactatagggtagagacaatgcggcctgggctgttgtcataacagaggagaatgacaatggcccaggccaacctggcggcagcgcaaaagatg

SEQ ID NO: 159829 - DNA, 103 bp, Artificial Sequence
  Synthetic Polynucleotide
taatacgactcactatagggagtaacttgatagagacaatgcggcctgggaacagaggagacccaggatgcattgtctcaacctggcggcagcgcaaaagatg

SEQ ID NO: 159830 - DNA, 103 bp, Artificial Sequence
  Synthetic Polynucleotide
taatacgactcactataggggattgcagccagtaacttgatagagacaataacagaggagaattgtcatgatcaagttaaacctggcggcagcgcaaaagatg

SEQ ID NO: 159831 - DNA, 103 bp, Artificial Sequence
  Synthetic Polynucleotide
taatacgactcactatagggcaaacagctggattgcagccagtaacttgaaacagaggagatcaagtatgtggctgcaaaacctggcggcagcgcaaaagatg

SEQ ID NO: 159832 - DNA, 103 bp, Artificial Sequence
  Synthetic Polynucleotide
taatacgactcactataggggaggggaggaggttccgaagatagttggcaaacagaggagatgccaaatgtcttcggaaaacctggcggcagcgcaaaagatg

SEQ ID NO: 159833 - DNA, 103 bp, Artificial Sequence
  Synthetic Polynucleotide
taatacgactcactatagggaggttggcgccaaacagctggattgcagccaacagaggagaggctgcatgccagctgttaacctggcggcagcgcaaaagatg

SEQ ID NO: 159834 - DNA, 103 bp, Artificial Sequence
  Synthetic Polynucleotide
taatacgactcactataggggtagtcatccaggttggcgccaaacagctgaacagaggagacagctgatgggcgccaacaacctggcggcagcgcaaaagatg

SEQ ID NO: 159835 - DNA, 103 bp, Artificial Sequence
  Synthetic Polynucleotide
taatacgactcactataggggtaaatgcaggtagtcatccaggttggcgcaacagaggagagcgccaatgtggatgactaacctggcggcagcgcaaaagatg

SEQ ID NO: 159836 - DNA, 103 bp, Artificial Sequence
  Synthetic Polynucleotide
taatacgactcactatagggggaggcagcagtaaatgcaggtagtcatccaacagaggagaggatgaatgcctgcatttaacctggcggcagcgcaaaagatg

SEQ ID NO: 159837 - DNA, 103 bp, Artificial Sequence
  Synthetic Polynucleotide
taatacgactcactatagggcttaacaataggaggcagcagtaaatgcagaacagaggagactgcatatgctgctgcctaacctggcggcagcgcaaaagatg

SEQ ID NO: 159838 - DNA, 103 bp, Artificial Sequence
  Synthetic Polynucleotide
taatacgactcactatagggcatcaaacaacttaacaataggaggcagcaaacagaggagatgctgcatgctattgttaaacctggcggcagcgcaaaagatg

SEQ ID NO: 159839 - DNA, 103 bp, Artificial Sequence
  Synthetic Polynucleotide
taatacgactcactataggggcttcaggggcatcaaacaacttaacaataaacagaggagatattgtatggttgtttgaaacctggcggcagcgcaaaagatg

SEQ ID NO: 159840 - DNA, 103 bp, Artificial Sequence
  Synthetic Polynucleotide
taatacgactcactatagggtggcagtggagcttcaggggcatcaaacaaaacagaggagattgtttatggcccctgaaaacctggcggcagcgcaaaagatg

SEQ ID NO: 159841 - DNA, 103 bp, Artificial Sequence
  Synthetic Polynucleotide
taatacgactcactatagggcctttcgagatggcagtggagcttcaggggaacagaggagacccctgatgctccactgcaacctggcggcagcgcaaaagatg

SEQ ID NO: 159842 - DNA, 103 bp, Artificial Sequence
  Synthetic Polynucleotide
taatacgactcactatagggtctagcgctgcctttcgagatggcagtggaaacagaggagatccactatgatctcgaaaaacctggcggcagcgcaaaagatg

SEQ ID NO: 159843 - DNA, 103 bp, Artificial Sequence
  Synthetic Polynucleotide
taatacgactcactatagggtgggtcattggaggggaggaggttccgaagaacagaggagacttcggatgctcctccccaacctggcggcagcgcaaaagatg

SEQ ID NO: 159844 - DNA, 103 bp, Artificial Sequence
  Synthetic Polynucleotide
taatacgactcactataggggtccacagtctctagcgctgcctttcgagaaacagaggagatctcgaatggcagcgctaaacctggcggcagcgcaaaagatg

SEQ ID NO: 159845 - DNA, 103 bp, Artificial Sequence
  Synthetic Polynucleotide
taatacgactcactatagggccgtcaggcggtccacagtctctagcgctgaacagaggagacagcgcatgagactgtggaacctggcggcagcgcaaaagatg

SEQ ID NO: 159846 - DNA, 103 bp, Artificial Sequence
  Synthetic Polynucleotide
taatacgactcactatagggtccagggactccgtcaggcggtccacagtcaacagaggagagactgtatgccgcctgacaacctggcggcagcgcaaaagatg

SEQ ID NO: 159847 - DNA, 103 bp, Artificial Sequence
  Synthetic Polynucleotide
taatacgactcactataggggtcagtgaaatccagggactccgtcaggcgaacagaggagacgcctgatggagtccctgaacctggcggcagcgcaaaagatg

SEQ ID NO: 159848 - DNA, 103 bp, Artificial Sequence
  Synthetic Polynucleotide
taatacgactcactataggggggaggcatagtcagtgaaatccagggactaacagaggagaagtcccatgatttcactgaacctggcggcagcgcaaaagatg

SEQ ID NO: 159849 - DNA, 103 bp, Artificial Sequence
  Synthetic Polynucleotide
taatacgactcactatagggtgaatgatccgggaggcatagtcagtgaaaaacagaggagatttcacatgctatgcctcaacctggcggcagcgcaaaagatg

SEQ ID NO: 159850 - DNA, 103 bp, Artificial Sequence
  Synthetic Polynucleotide
taatacgactcactatagggaacaatagggtgaatgatccgggaggcataaacagaggagatatgccatgcggatcattaacctggcggcagcgcaaaagatg

SEQ ID NO: 159851 - DNA, 103 bp, Artificial Sequence
  Synthetic Polynucleotide
taatacgactcactatagggccagtgttcgaacaatagggtgaatgatccaacagaggagaggatcaatgaccctattgaacctggcggcagcgcaaaagatg

SEQ ID NO: 159852 - DNA, 103 bp, Artificial Sequence
  Synthetic Polynucleotide
taatacgactcactataggggggctctggtccagtgttcgaacaatagggaacagaggagaccctatatgtcgaacactaacctggcggcagcgcaaaagatg

SEQ ID NO: 159853 - DNA, 103 bp, Artificial Sequence
  Synthetic Polynucleotide
taatacgactcactataggggcgcagttctgggctctggtccagtgttcgaacagaggagacgaacaatggaccagagcaacctggcggcagcgcaaaagatg

SEQ ID NO: 159854 - DNA, 103 bp, Artificial Sequence
  Synthetic Polynucleotide
taatacgactcactatagggccatgacaactgggtcattggaggggaggaaacagaggagatcctccatgccaatgaccaacctggcggcagcgcaaaagatg

SEQ ID NO: 159855 - DNA, 103 bp, Artificial Sequence
  Synthetic Polynucleotide
taatacgactcactatagggtggctgtggagcgcagttctgggctctggtaacagaggagaaccagaatgcagaactgcaacctggcggcagcgcaaaagatg

SEQ ID NO: 159856 - DNA, 103 bp, Artificial Sequence
  Synthetic Polynucleotide
taatacgactcactatagggagcgtgtccatggctgtggagcgcagttctaacagaggagaagaactatgctccacagcaacctggcggcagcgcaaaagatg

SEQ ID NO: 159857 - DNA, 103 bp, Artificial Sequence
  Synthetic Polynucleotide
taatacgactcactatagggaagtgaagacagcgtgtccatggctgtggaaacagaggagatccacaatgatggacacgaacctggcggcagcgcaaaagatg

SEQ ID NO: 159858 - DNA, 103 bp, Artificial Sequence
  Synthetic Polynucleotide
taatacgactcactataggggctgaaaaacaagtgaagacagcgtgtccaaacagaggagatggacaatgtgtcttcacaacctggcggcagcgcaaaagatg

SEQ ID NO: 159859 - DNA, 103 bp, Artificial Sequence
  Synthetic Polynucleotide
taatacgactcactatagggttcttccccagctgaaaaacaagtgaagacaacagaggagagtcttcatgtgtttttcaaacctggcggcagcgcaaaagatg

SEQ ID NO: 159860 - DNA, 103 bp, Artificial Sequence
  Synthetic Polynucleotide
taatacgactcactatagggaatttggtacttcttccccagctgaaaaacaacagaggagagtttttatgctggggaagaacctggcggcagcgcaaaagatg

SEQ ID NO: 159861 - DNA, 103 bp, Artificial Sequence
  Synthetic Polynucleotide
taatacgactcactatagggttggaatgaaaatttggtacttcttccccaaacagaggagatggggaatgagtaccaaaaacctggcggcagcgcaaaagatg

SEQ ID NO: 159862 - DNA, 103 bp, Artificial Sequence
  Synthetic Polynucleotide
taatacgactcactatagggttattcaccattggaatgaaaatttggtacaacagaggagagtaccaatgtttcattccaacctggcggcagcgcaaaagatg

SEQ ID NO: 159863 - DNA, 103 bp, Artificial Sequence
  Synthetic Polynucleotide
taatacgactcactatagggcaccagaactttattcaccattggaatgaaaacagaggagattcattatgatggtgaataacctggcggcagcgcaaaagatg

SEQ ID NO: 159864 - DNA, 103 bp, Artificial Sequence
  Synthetic Polynucleotide
taatacgactcactatagggttcggtgtcgcaccagaactttattcaccaaacagaggagatggtgaatgaagttctggaacctggcggcagcgcaaaagatg

SEQ ID NO: 159865 - DNA, 103 bp, Artificial Sequence
  Synthetic Polynucleotide
taatacgactcactataggggatgccatttccatgacaactgggtcattgaacagaggagacaatgaatgagttgtcataacctggcggcagcgcaaaagatg

SEQ ID NO: 159866 - DNA, 103 bp, Artificial Sequence
  Synthetic Polynucleotide
taatacgactcactatagggtgatgattgattcggtgtcgcaccagaactaacagaggagaagttctatggcgacaccgaacctggcggcagcgcaaaagatg

SEQ ID NO: 159867 - DNA, 103 bp, Artificial Sequence
  Synthetic Polynucleotide
taatacgactcactatagggatcatagcgctgatgattgattcggtgtcgaacagaggagacgacacatgatcaatcataacctggcggcagcgcaaaagatg

SEQ ID NO: 159868 - DNA, 103 bp, Artificial Sequence
  Synthetic Polynucleotide
taatacgactcactatagggagatgagcacatcatagcgctgatgattgaaacagaggagatcaatcatgagcgctatgaacctggcggcagcgcaaaagatg

SEQ ID NO: 159869 - DNA, 103 bp, Artificial Sequence
  Synthetic Polynucleotide
taatacgactcactatagggacaattctgcagatgagcacatcatagcgcaacagaggagagcgctaatgtgtgctcataacctggcggcagcgcaaaagatg

SEQ ID NO: 159870 - DNA, 103 bp, Artificial Sequence
  Synthetic Polynucleotide
taatacgactcactataggggtatcccttgacaattctgcagatgagcacaacagaggagagtgctcatgtgcagaattaacctggcggcagcgcaaaagatg

SEQ ID NO: 159871 - DNA, 103 bp, Artificial Sequence
  Synthetic Polynucleotide
taatacgactcactatagggcagcaagtgtgtatcccttgacaattctgcaacagaggagagcagaaatgtcaagggataacctggcggcagcgcaaaagatg

SEQ ID NO: 159872 - DNA, 103 bp, Artificial Sequence
  Synthetic Polynucleotide
taatacgactcactatagggtcctcttcatcagcaagtgtgtatcccttgaacagaggagacaagggatgcacacttgcaacctggcggcagcgcaaaagatg

SEQ ID NO: 159873 - DNA, 103 bp, Artificial Sequence
  Synthetic Polynucleotide
taatacgactcactatagggcaaaggatcctcctcttcatcagcaagtgtaacagaggagaacacttatggatgaagagaacctggcggcagcgcaaaagatg

SEQ ID NO: 159874 - DNA, 103 bp, Artificial Sequence
  Synthetic Polynucleotide
taatacgactcactataggggctggtaaatcaaaggatcctcctcttcataacagaggagaatgaagatgaggatccttaacctggcggcagcgcaaaagatg

SEQ ID NO: 159875 - DNA, 103 bp, Artificial Sequence
  Synthetic Polynucleotide
taatacgactcactatagggagcatccgatgctggtaaatcaaaggatccaacagaggagaggatccatggatttaccaaacctggcggcagcgcaaaagatg

SEQ ID NO: 159876 - DNA, 103 bp, Artificial Sequence
  Synthetic Polynucleotide
taatacgactcactatagggaatggccttggatgccatttccatgacaacaacagaggagagttgtcatggaaatggcaaacctggcggcagcgcaaaagatg

SEQ ID NO: 159877 - DNA, 103 bp, Artificial Sequence
  Synthetic Polynucleotide
taatacgactcactataggggccactcctaagcatccgatgctggtaaataacagaggagaatttacatgcatcggatgaacctggcggcagcgcaaaagatg

SEQ ID NO: 159878 - DNA, 103 bp, Artificial Sequence
  Synthetic Polynucleotide
taatacgactcactatagggcatccccttggccactcctaagcatccgataacagaggagaatcggaatgttaggagtgaacctggcggcagcgcaaaagatg

SEQ ID NO: 159879 - DNA, 103 bp, Artificial Sequence
  Synthetic Polynucleotide
taatacgactcactatagggctagccaatgcatccccttggccactcctaaacagaggagataggagatgccaaggggaaacctggcggcagcgcaaaagatg

SEQ ID NO: 159880 - DNA, 103 bp, Artificial Sequence
  Synthetic Polynucleotide
taatacgactcactatagggcactggtccactagccaatgcatccccttgaacagaggagacaagggatggcattggctaacctggcggcagcgcaaaagatg

SEQ ID NO: 159881 - DNA, 103 bp, Artificial Sequence
  Synthetic Polynucleotide
taatacgactcactataggggtcctgtttccactggtccactagccaatgaacagaggagacattggatggtggaccagaacctggcggcagcgcaaaagatg

SEQ ID NO: 159882 - DNA, 103 bp, Artificial Sequence
  Synthetic Polynucleotide
taatacgactcactatagggttcttcatgggtcctgtttccactggtccaaacagaggagatggaccatgggaaacaggaacctggcggcagcgcaaaagatg

SEQ ID NO: 159883 - DNA, 103 bp, Artificial Sequence
  Synthetic Polynucleotide
taatacgactcactataggggacgtgcagtttcttcatgggtcctgtttcaacagaggagagaaacaatgcccatgaagaacctggcggcagcgcaaaagatg

SEQ ID NO: 159884 - DNA, 103 bp, Artificial Sequence
  Synthetic Polynucleotide
taatacgactcactatagggtgatggtgctgacgtgcagtttcttcatggaacagaggagaccatgaatgaactgcacgaacctggcggcagcgcaaaagatg

SEQ ID NO: 159885 - DNA, 103 bp, Artificial Sequence
  Synthetic Polynucleotide
taatacgactcactatagggttttggaggttgatggtgctgacgtgcagtaacagaggagaactgcaatgcagcaccataacctggcggcagcgcaaaagatg

SEQ ID NO: 159886 - DNA, 103 bp, Artificial Sequence
  Synthetic Polynucleotide
taatacgactcactataggggccccaggccttttggaggttgatggtgctaacagaggagaagcaccatgaacctccaaaacctggcggcagcgcaaaagatg

SEQ ID NO: 159887 - DNA, 103 bp, Artificial Sequence
  Synthetic Polynucleotide
taatacgactcactatagggcaagacggccaatggccttggatgccatttaacagaggagaaaatggatgccaaggccaaacctggcggcagcgcaaaagatg

SEQ ID NO: 159888 - DNA, 103 bp, Artificial Sequence
  Synthetic Polynucleotide
taatacgactcactatagggtcctggcagcgccccaggccttttggaggtaacagaggagaacctccatgaggcctgggaacctggcggcagcgcaaaagatg

SEQ ID NO: 159889 - DNA, 103 bp, Artificial Sequence
  Synthetic Polynucleotide
taatacgactcactatagggttggagaccctcctggcagcgccccaggccaacagaggagaggcctgatgcgctgccagaacctggcggcagcgcaaaagatg

SEQ ID NO: 159890 - DNA, 103 bp, Artificial Sequence
  Synthetic Polynucleotide
taatacgactcactatagggccagtcatctttggagaccctcctggcagcaacagaggagagctgccatgagggtctccaacctggcggcagcgcaaaagatg

SEQ ID NO: 159891 - DNA, 103 bp, Artificial Sequence
  Synthetic Polynucleotide
taatacgactcactataggggccattccagccagtcatctttggagacccaacagaggagagggtctatgaagatgactaacctggcggcagcgcaaaagatg

SEQ ID NO: 159892 - DNA, 103 bp, Artificial Sequence
  Synthetic Polynucleotide
taatacgactcactatagggagccgtctcagccattccagccagtcatctaacagaggagaagatgaatggctggaatgaacctggcggcagcgcaaaagatg

SEQ ID NO: 159893 - DNA, 103 bp, Artificial Sequence
  Synthetic Polynucleotide
taatacgactcactatagggctccaggctcagccgtctcagccattccagaacagaggagactggaaatgctgagacggaacctggcggcagcgcaaaagatg

SEQ ID NO: 159894 - DNA, 103 bp, Artificial Sequence
  Synthetic Polynucleotide
taatacgactcactatagggccttcagcagctccaggctcagccgtctcaaacagaggagatgagacatgtgagcctggaacctggcggcagcgcaaaagatg

SEQ ID NO: 159895 - DNA, 103 bp, Artificial Sequence
  Synthetic Polynucleotide
taatacgactcactataggggatgatgagtccttcagcagctccaggctcaacagaggagagagcctatggctgctgaaaacctggcggcagcgcaaaagatg

SEQ ID NO: 159896 - DNA, 103 bp, Artificial Sequence
  Synthetic Polynucleotide
taatacgactcactatagggcagggagggcgatgatgagtccttcagcagaacagaggagactgctgatggactcatcaaacctggcggcagcgcaaaagatg

SEQ ID NO: 159897 - DNA, 103 bp, Artificial Sequence
  Synthetic Polynucleotide
taatacgactcactatagggagcaggagcgcagggagggcgatgatgagtaacagaggagaactcatatgcgccctcccaacctggcggcagcgcaaaagatg

SEQ ID NO: 159898 - DNA, 103 bp, Artificial Sequence
  Synthetic Polynucleotide
taatacgactcactatagggcctgccatggcaagacggccaatggccttgaacagaggagacaaggcatgtggccgtctaacctggcggcagcgcaaaagatg

SEQ ID NO: 159899 - DNA, 103 bp, Artificial Sequence
  Synthetic Polynucleotide
taatacgactcactataggggccagggcccagcaggagcgcagggagggcaacagaggagagccctcatggcgctcctgaacctggcggcagcgcaaaagatg

SEQ ID NO: 159900 - DNA, 103 bp, Artificial Sequence
  Synthetic Polynucleotide
taatacgactcactataggggtaggcctgtgccagggcccagcaggagcgaacagaggagacgctccatgtgggccctgaacctggcggcagcgcaaaagatg

SEQ ID NO: 159901 - DNA, 103 bp, Artificial Sequence
  Synthetic Polynucleotide
taatacgactcactatagggccatcgggttgtaggcctgtgccagggcccaacagaggagagggcccatgcacaggcctaacctggcggcagcgcaaaagatg

SEQ ID NO: 159902 - DNA, 103 bp, Artificial Sequence
  Synthetic Polynucleotide
taatacgactcactatagggagatccctggccatcgggttgtaggcctgtaacagaggagaacaggcatgcaacccgataacctggcggcagcgcaaaagatg

SEQ ID NO: 159903 - DNA, 103 bp, Artificial Sequence
  Synthetic Polynucleotide
taatacgactcactatagggagcattgaagagatccctggccatcgggttaacagaggagaaacccgatggccagggataacctggcggcagcgcaaaagatg

SEQ ID NO: 159904 - DNA, 103 bp, Artificial Sequence
  Synthetic Polynucleotide
taatacgactcactatagggacacaaatgcagcattgaagagatccctggaacagaggagaccagggatgtcttcaatgaacctggcggcagcgcaaaagatg

SEQ ID NO: 159905 - DNA, 103 bp, Artificial Sequence
  Synthetic Polynucleotide
taatacgactcactataggggaccagcaggacacaaatgcagcattgaagaacagaggagacttcaaatgtgcatttgtaacctggcggcagcgcaaaagatg

SEQ ID NO: 159906 - DNA, 103 bp, Artificial Sequence
  Synthetic Polynucleotide
taatacgactcactatagggattcagttcagaccagcaggacacaaatgcaacagaggagagcatttatgtcctgctggaacctggcggcagcgcaaaagatg

SEQ ID NO: 159907 - DNA, 103 bp, Artificial Sequence
  Synthetic Polynucleotide
taatacgactcactataggggttgatcttcattcagttcagaccagcaggaacagaggagacctgctatgctgaactgaaacctggcggcagcgcaaaagatg

SEQ ID NO: 159908 - DNA, 103 bp, Artificial Sequence
  Synthetic Polynucleotide
taatacgactcactatagggagctcatcctgttgatcttcattcagttcaaacagaggagatgaactatgtgaagatcaaacctggcggcagcgcaaaagatg

SEQ ID NO: 159909 - DNA, 103 bp, Artificial Sequence
  Synthetic Polynucleotide
taatacgactcactataggggctcacattgctagatgtggtggcagcggtaacagaggagaaccgctatgaccacatctaacctggcggcagcgcaaaagatg

SEQ ID NO: 159910 - DNA, 103 bp, Artificial Sequence
  Synthetic Polynucleotide
taatacgactcactatagggaaaagtgtcccctgccatggcaagacggccaacagaggagaggccgtatggccatggcaaacctggcggcagcgcaaaagatg

SEQ ID NO: 159911 - DNA, 103 bp, Artificial Sequence
  Synthetic Polynucleotide
taatacgactcactataggggcttctgatgagctcatcctgttgatcttcaacagaggagagaagatatgcaggatgagaacctggcggcagcgcaaaagatg

SEQ ID NO: 159912 - DNA, 103 bp, Artificial Sequence
  Synthetic Polynucleotide
taatacgactcactatagggccaactcgatgcttctgatgagctcatcctaacagaggagaaggatgatgtcatcagaaaacctggcggcagcgcaaaagatg

SEQ ID NO: 159913 - DNA, 103 bp, Artificial Sequence
  Synthetic Polynucleotide
taatacgactcactataggggaggtgagggccaactcgatgcttctgatgaacagaggagacatcagatgcatcgagttaacctggcggcagcgcaaaagatg

SEQ ID NO: 159914 - DNA, 103 bp, Artificial Sequence
  Synthetic Polynucleotide
taatacgactcactataggggatgtcttgtgaggtgagggccaactcgataacagaggagaatcgagatggccctcaccaacctggcggcagcgcaaaagatg

SEQ ID NO: 159915 - DNA, 103 bp, Artificial Sequence
  Synthetic Polynucleotide
taatacgactcactatagggtgacttcagcgatgtcttgtgaggtgagggaacagaggagaccctcaatgcacaagacaaacctggcggcagcgcaaaagatg

SEQ ID NO: 159916 - DNA, 103 bp, Artificial Sequence
  Synthetic Polynucleotide
taatacgactcactatagggagggtctgtgtgacttcagcgatgtcttgtaacagaggagaacaagaatgcgctgaagtaacctggcggcagcgcaaaagatg

SEQ ID NO: 159917 - DNA, 103 bp, Artificial Sequence
  Synthetic Polynucleotide
taatacgactcactatagggcaagtttaagagggtctgtgtgacttcagcaacagaggagagctgaaatgacacagaccaacctggcggcagcgcaaaagatg

SEQ ID NO: 159918 - DNA, 103 bp, Artificial Sequence
  Synthetic Polynucleotide
taatacgactcactatagggtgaattcagccaagtttaagagggtctgtgaacagaggagacacagaatgtcttaaactaacctggcggcagcgcaaaagatg

SEQ ID NO: 159919 - DNA, 103 bp, Artificial Sequence
  Synthetic Polynucleotide
taatacgactcactatagggctgtgttccatgaattcagccaagtttaagaacagaggagacttaaaatgggctgaattaacctggcggcagcgcaaaagatg

SEQ ID NO: 159920 - DNA, 103 bp, Artificial Sequence
  Synthetic Polynucleotide
taatacgactcactataggggcccttgtcactgtgttccatgaattcagcaacagaggagagctgaaatgatggaacacaacctggcggcagcgcaaaagatg

SEQ ID NO: 159921 - DNA, 103 bp, Artificial Sequence
  Synthetic Polynucleotide
taatacgactcactatagggactcagcggtaaaagtgtcccctgccatggaacagaggagaccatggatggggacacttaacctggcggcagcgcaaaagatg

SEQ ID NO: 159922 - DNA, 103 bp, Artificial Sequence
  Synthetic Polynucleotide
taatacgactcactataggggtggcagggggcccttgtcactgtgttccaaacagaggagatggaacatggtgacaaggaacctggcggcagcgcaaaagatg

SEQ ID NO: 159923 - DNA, 103 bp, Artificial Sequence
  Synthetic Polynucleotide
taatacgactcactatagggtcatctctcagtggcagggggcccttgtcaaacagaggagatgacaaatgccccctgccaacctggcggcagcgcaaaagatg

SEQ ID NO: 159924 - DNA, 103 bp, Artificial Sequence
  Synthetic Polynucleotide
taatacgactcactatagggaatgccattgtcatctctcagtggcaggggaacagaggagacccctgatgctgagagataacctggcggcagcgcaaaagatg

SEQ ID NO: 159925 - DNA, 103 bp, Artificial Sequence
  Synthetic Polynucleotide
taatacgactcactatagggccagcagaacaatgccattgtcatctctcaaacagaggagatgagagatgacaatggcaaacctggcggcagcgcaaaagatg

SEQ ID NO: 159926 - DNA, 103 bp, Artificial Sequence
  Synthetic Polynucleotide
taatacgactcactataggggctctctcacccagcagaacaatgccattgaacagaggagacaatggatgtgttctgctaacctggcggcagcgcaaaagatg

SEQ ID NO: 159927 - DNA, 103 bp, Artificial Sequence
  Synthetic Polynucleotide
taatacgactcactataggggcacttggcagctctctcacccagcagaacaacagaggagagttctgatgggtgagagaaacctggcggcagcgcaaaagatg

SEQ ID NO: 159928 - DNA, 103 bp, Artificial Sequence
  Synthetic Polynucleotide
taatacgactcactatagggcatatgctcggcacttggcagctctctcacaacagaggagagtgagaatgctgccaagtaacctggcggcagcgcaaaagatg

SEQ ID NO: 159929 - DNA, 103 bp, Artificial Sequence
  Synthetic Polynucleotide
taatacgactcactatagggagtgctttggcatatgctcggcacttggcaaacagaggagatgccaaatgccgagcataaacctggcggcagcgcaaaagatg

SEQ ID NO: 159930 - DNA, 103 bp, Artificial Sequence
  Synthetic Polynucleotide
taatacgactcactatagggtttgtagtgtagtgctttggcatatgctcgaacagaggagacgagcaatggccaaagcaaacctggcggcagcgcaaaagatg

SEQ ID NO: 159931 - DNA, 103 bp, Artificial Sequence
  Synthetic Polynucleotide
taatacgactcactatagggactccagttctttgtagtgtagtgctttggaacagaggagaccaaagatgtacactacaaacctggcggcagcgcaaaagatg

SEQ ID NO: 159932 - DNA, 103 bp, Artificial Sequence
  Synthetic Polynucleotide
taatacgactcactatagggaattccacgtactcagcggtaaaagtgtccaacagaggagaggacacatgtaccgctgaaacctggcggcagcgcaaaagatg

SEQ ID NO: 159933 - DNA, 103 bp, Artificial Sequence
  Synthetic Polynucleotide
taatacgactcactatagggcctttctggaactccagttctttgtagtgtaacagaggagaacactaatgagaactggaaacctggcggcagcgcaaaagatg

SEQ ID NO: 159934 - DNA, 103 bp, Artificial Sequence
  Synthetic Polynucleotide
taatacgactcactatagggaggggtggggcctttctggaactccagttcaacagaggagagaactgatgttccagaaaaacctggcggcagcgcaaaagatg

SEQ ID NO: 159935 - DNA, 103 bp, Artificial Sequence
  Synthetic Polynucleotide
taatacgactcactatagggctagaatggcaggggtggggcctttctggaaacagaggagatccagaatggccccacccaacctggcggcagcgcaaaagatg

SEQ ID NO: 159936 - DNA, 103 bp, Artificial Sequence
  Synthetic Polynucleotide
taatacgactcactatagggatgagagattctagaatggcaggggtggggaacagaggagaccccacatgtgccattctaacctggcggcagcgcaaaagatg

SEQ ID NO: 159937 - DNA, 103 bp, Artificial Sequence
  Synthetic Polynucleotide
taatacgactcactatagggattaatgctgatgagagattctagaatggcaacagaggagagccattatggaatctctcaacctggcggcagcgcaaaagatg

SEQ ID NO: 159938 - DNA, 103 bp, Artificial Sequence
  Synthetic Polynucleotide
taatacgactcactataggggtagcttattattaatgctgatgagagattaacagaggagaaatctcatgtcagcattaaacctggcggcagcgcaaaagatg

SEQ ID NO: 159939 - DNA, 103 bp, Artificial Sequence
  Synthetic Polynucleotide
taatacgactcactatagggtccggctgctgtagcttattattaatgctgaacagaggagacagcatatgtaataagctaacctggcggcagcgcaaaagatg

SEQ ID NO: 159940 - DNA, 103 bp, Artificial Sequence
  Synthetic Polynucleotide
taatacgactcactatagggggccgctgcctccggctgctgtagcttattaacagaggagaaataagatgcagcagccgaacctggcggcagcgcaaaagatg

SEQ ID NO: 159941 - DNA, 103 bp, Artificial Sequence
  Synthetic Polynucleotide
taatacgactcactatagggctaacactccggccgctgcctccggctgctaacagaggagaagcagcatgaggcagcggaacctggcggcagcgcaaaagatg

SEQ ID NO: 159942 - DNA, 103 bp, Artificial Sequence
  Synthetic Polynucleotide
taatacgactcactatagggatggcatattctaacactccggccgctgccaacagaggagaggcagcatgcggagtgttaacctggcggcagcgcaaaagatg

SEQ ID NO: 159943 - DNA, 103 bp, Artificial Sequence
  Synthetic Polynucleotide
taatacgactcactatagggcttcacctcaaattccacgtactcagcggtaacagaggagaaccgctatgtacgtggaaaacctggcggcagcgcaaaagatg

SEQ ID NO: 159944 - DNA, 103 bp, Artificial Sequence
  Synthetic Polynucleotide
taatacgactcactatagggaaagtgtttcatggcatattctaacactccaacagaggagaggagtgatggaatatgccaacctggcggcagcgcaaaagatg

SEQ ID NO: 159945 - DNA, 103 bp, Artificial Sequence
  Synthetic Polynucleotide
taatacgactcactatagggccagctctccaaagtgtttcatggcatattaacagaggagaaatatgatgtgaaacactaacctggcggcagcgcaaaagatg

SEQ ID NO: 159946 - DNA, 103 bp, Artificial Sequence
  Synthetic Polynucleotide
taatacgactcactataggggcctggatctccagctctccaaagtgtttcaacagaggagagaaacaatgtggagagctaacctggcggcagcgcaaaagatg

SEQ ID NO: 159947 - DNA, 103 bp, Artificial Sequence
  Synthetic Polynucleotide
taatacgactcactatagggataccaggtagcctggatctccagctctccaacagaggagaggagagatggagatccagaacctggcggcagcgcaaaagatg

SEQ ID NO: 159948 - DNA, 103 bp, Artificial Sequence
  Synthetic Polynucleotide
taatacgactcactataggggcagtttctcataccaggtagcctggatctaacagaggagaagatccatgctacctggtaacctggcggcagcgcaaaagatg

SEQ ID NO: 159949 - DNA, 103 bp, Artificial Sequence
  Synthetic Polynucleotide
taatacgactcactatagggtcccactcgtgcagtttctcataccaggtaaacagaggagatacctgatgtgagaaactaacctggcggcagcgcaaaagatg

SEQ ID NO: 159950 - DNA, 103 bp, Artificial Sequence
  Synthetic Polynucleotide
taatacgactcactatagggaagggcatcctcccactcgtgcagtttctcaacagaggagagagaaaatgcacgagtggaacctggcggcagcgcaaaagatg

SEQ ID NO: 159951 - DNA, 103 bp, Artificial Sequence
  Synthetic Polynucleotide
taatacgactcactatagggcataggccacaagggcatcctcccactcgtaacagaggagaacgagtatgaggatgcccaacctggcggcagcgcaaaagatg

SEQ ID NO: 159952 - DNA, 103 bp, Artificial Sequence
  Synthetic Polynucleotide
taatacgactcactatagggattttcttgtcataggccacaagggcatccaacagaggagaggatgcatgtgtggcctaaacctggcggcagcgcaaaagatg

SEQ ID NO: 159953 - DNA, 103 bp, Artificial Sequence
  Synthetic Polynucleotide
taatacgactcactataggggttggtgtccattttcttgtcataggccacaacagaggagagtggccatggacaagaaaaacctggcggcagcgcaaaagatg

SEQ ID NO: 159954 - DNA, 103 bp, Artificial Sequence
  Synthetic Polynucleotide
taatacgactcactatagggccagggctcgcttcacctcaaattccacgtaacagaggagaacgtggatgttgaggtgaaacctggcggcagcgcaaaagatg

SEQ ID NO: 159955 - DNA, 103 bp, Artificial Sequence
  Synthetic Polynucleotide
taatacgactcactatagggggtcgtccttgttggtgtccattttcttgtaacagaggagaacaagaatgtggacaccaaacctggcggcagcgcaaaagatg

SEQ ID NO: 159956 - DNA, 103 bp, Artificial Sequence
  Synthetic Polynucleotide
taatacgactcactatagggatcagctctgggtcgtccttgttggtgtccaacagaggagaggacacatgcaaggacgaaacctggcggcagcgcaaaagatg

SEQ ID NO: 159957 - DNA, 103 bp, Artificial Sequence
  Synthetic Polynucleotide
taatacgactcactataggggcggcccagcatcagctctgggtcgtccttaacagaggagaaaggacatgccagagctgaacctggcggcagcgcaaaagatg

SEQ ID NO: 159958 - DNA, 103 bp, Artificial Sequence
  Synthetic Polynucleotide
taatacgactcactatagggggcagcgcatgcggcccagcatcagctctgaacagaggagacagagcatgtgctgggccaacctggcggcagcgcaaaagatg

SEQ ID NO: 159959 - DNA, 103 bp, Artificial Sequence
  Synthetic Polynucleotide
taatacgactcactatagggaaggcctcgaggcagcgcatgcggcccagcaacagaggagagctgggatgcatgcgctgaacctggcggcagcgcaaaagatg

SEQ ID NO: 159960 - DNA, 103 bp, Artificial Sequence
  Synthetic Polynucleotide
taatacgactcactatagggccattcccccaaggcctcgaggcagcgcataacagaggagaatgcgcatgctcgaggccaacctggcggcagcgcaaaagatg

SEQ ID NO: 159961 - DNA, 103 bp, Artificial Sequence
  Synthetic Polynucleotide
taatacgactcactatagggggagttgaccccattcccccaaggcctcgaaacagaggagatcgaggatgtgggggaataacctggcggcagcgcaaaagatg

SEQ ID NO: 159962 - DNA, 103 bp, Artificial Sequence
  Synthetic Polynucleotide
taatacgactcactatagggcactgctggtggagttgaccccattcccccaacagaggagagggggaatggggtcaactaacctggcggcagcgcaaaagatg

SEQ ID NO: 159963 - DNA, 103 bp, Artificial Sequence
  Synthetic Polynucleotide
taatacgactcactatagggcttttcacagcactgctggtggagttgaccaacagaggagaggtcaaatgcaccagcagaacctggcggcagcgcaaaagatg

SEQ ID NO: 159964 - DNA, 103 bp, Artificial Sequence
  Synthetic Polynucleotide
taatacgactcactatagggccagggtccacttttcacagcactgctggtaacagaggagaaccagcatggctgtgaaaaacctggcggcagcgcaaaagatg

SEQ ID NO: 159965 - DNA, 103 bp, Artificial Sequence
  Synthetic Polynucleotide
taatacgactcactatagggcccagccattccagggctcgcttcacctcaaacagaggagatgaggtatggcgagccctaacctggcggcagcgcaaaagatg

SEQ ID NO: 159966 - DNA, 103 bp, Artificial Sequence
  Synthetic Polynucleotide
taatacgactcactatagggtcatcattaaccagggtccacttttcacagaacagaggagactgtgaatggtggaccctaacctggcggcagcgcaaaagatg

SEQ ID NO: 159967 - DNA, 103 bp, Artificial Sequence
  Synthetic Polynucleotide
taatacgactcactatagggggcttgggtctcatcattaaccagggtccaaacagaggagatggaccatggttaatgataacctggcggcagcgcaaaagatg

SEQ ID NO: 159968 - DNA, 103 bp, Artificial Sequence
  Synthetic Polynucleotide
taatacgactcactataggggggccatcttggcttgggtctcatcattaaaacagaggagattaatgatgagacccaagaacctggcggcagcgcaaaagatg

SEQ ID NO: 159969 - DNA, 103 bp, Artificial Sequence
  Synthetic Polynucleotide
taatacgactcactataggggcagccatccgggccatcttggcttgggtcaacagaggagagacccaatgcaagatggcaacctggcggcagcgcaaaagatg

SEQ ID NO: 159970 - DNA, 103 bp, Artificial Sequence
  Synthetic Polynucleotide
taatacgactcactatagggtgcagctgcagcagccatccgggccatcttaacagaggagaaagatgatgcggatggctaacctggcggcagcgcaaaagatg

SEQ ID NO: 159971 - DNA, 103 bp, Artificial Sequence
  Synthetic Polynucleotide
taatacgactcactatagggctaaaccccatgcagctgcagcagccatccaacagaggagaggatggatgctgcagctgaacctggcggcagcgcaaaagatg

SEQ ID NO: 159972 - DNA, 103 bp, Artificial Sequence
  Synthetic Polynucleotide
taatacgactcactatagggtcccactgacctaaaccccatgcagctgcaaacagaggagatgcagcatgatggggtttaacctggcggcagcgcaaaagatg

SEQ ID NO: 159973 - DNA, 103 bp, Artificial Sequence
  Synthetic Polynucleotide
taatacgactcactatagggttccatgctgtcccactgacctaaaccccaaacagaggagatggggtatgggtcagtggaacctggcggcagcgcaaaagatg

SEQ ID NO: 159974 - DNA, 103 bp, Artificial Sequence
  Synthetic Polynucleotide
taatacgactcactatagggaggtgtattcttccatgctgtcccactgacaacagaggagagtcagtatgacagcatggaacctggcggcagcgcaaaagatg

SEQ ID NO: 159975 - DNA, 103 bp, Artificial Sequence
  Synthetic Polynucleotide
taatacgactcactataggggggatcatacaggtgtattcttccatgctgaacagaggagacagcatatgagaatacacaacctggcggcagcgcaaaagatg

SEQ ID NO: 159976 - DNA, 103 bp, Artificial Sequence
  Synthetic Polynucleotide
taatacgactcactataggggcggtcagcacccagccattccagggctcgaacagaggagacgagccatggaatggctgaacctggcggcagcgcaaaagatg

SEQ ID NO: 159977 - DNA, 103 bp, Artificial Sequence
  Synthetic Polynucleotide
taatacgactcactatagggggtgtcccgagggatcatacaggtgtattcaacagaggagagaatacatgtgtatgatcaacctggcggcagcgcaaaagatg

SEQ ID NO: 159978 - DNA, 103 bp, Artificial Sequence
  Synthetic Polynucleotide
taatacgactcactatagggccccatcatgggtgtcccgagggatcatacaacagaggagagtatgaatgctcgggacaaacctggcggcagcgcaaaagatg

SEQ ID NO: 159979 - DNA, 103 bp, Artificial Sequence
  Synthetic Polynucleotide
taatacgactcactatagggctataaaatgccccatcatgggtgtcccgaaacagaggagatcgggaatgccatgatggaacctggcggcagcgcaaaagatg

SEQ ID NO: 159980 - DNA, 103 bp, Artificial Sequence
  Synthetic Polynucleotide
taatacgactcactatagggcagcacagctctataaaatgccccatcatgaacagaggagacatgatatggcattttataacctggcggcagcgcaaaagatg

SEQ ID NO: 159981 - DNA, 103 bp, Artificial Sequence
  Synthetic Polynucleotide
taatacgactcactataggggatgcagtgccagcacagctctataaaatgaacagaggagacattttatggagctgtgcaacctggcggcagcgcaaaagatg

SEQ ID NO: 159982 - DNA, 103 bp, Artificial Sequence
  Synthetic Polynucleotide
taatacgactcactatagggaagaggtcctgatgcagtgccagcacagctaacagaggagaagctgtatgggcactgcaaacctggcggcagcgcaaaagatg

SEQ ID NO: 159983 - DNA, 103 bp, Artificial Sequence
  Synthetic Polynucleotide
taatacgactcactatagggtgccaaggagaagaggtcctgatgcagtgcaacagaggagagcactgatgcaggacctcaacctggcggcagcgcaaaagatg

SEQ ID NO: 159984 - DNA, 103 bp, Artificial Sequence
  Synthetic Polynucleotide
taatacgactcactatagggtgcactgttgtgccaaggagaagaggtcctaacagaggagaaggaccatgtctccttggaacctggcggcagcgcaaaagatg

SEQ ID NO: 159985 - DNA, 103 bp, Artificial Sequence
  Synthetic Polynucleotide
taatacgactcactataggggccttgtcaatgcactgttgtgccaaggagaacagaggagactccttatgacaacagtgaacctggcggcagcgcaaaagatg

SEQ ID NO: 159986 - DNA, 103 bp, Artificial Sequence
  Synthetic Polynucleotide
taatacgactcactatagggcaggtccctggccttgtcaatgcactgttgaacagaggagacaacagatgattgacaagaacctggcggcagcgcaaaagatg

SEQ ID NO: 159987 - DNA, 103 bp, Artificial Sequence
  Synthetic Polynucleotide
taatacgactcactatagggggccctcattgcggtcagcacccagccattaacagaggagaaatggcatggtgctgaccaacctggcggcagcgcaaaagatg

SEQ ID NO: 159988 - DNA, 103 bp, Artificial Sequence
  Synthetic Polynucleotide
taatacgactcactatagggcagcatccagcaggtccctggccttgtcaaaacagaggagattgacaatgccagggaccaacctggcggcagcgcaaaagatg

SEQ ID NO: 159989 - DNA, 103 bp, Artificial Sequence
  Synthetic Polynucleotide
taatacgactcactataggggcagttaattcagcatccagcaggtccctgaacagaggagacagggaatggctggatgcaacctggcggcagcgcaaaagatg

SEQ ID NO: 159990 - DNA, 103 bp, Artificial Sequence
  Synthetic Polynucleotide
taatacgactcactatagggtcctgccatcgcagttaattcagcatccagaacagaggagactggatatggaattaactaacctggcggcagcgcaaaagatg

SEQ ID NO: 159991 - DNA, 103 bp, Artificial Sequence
  Synthetic Polynucleotide
taatacgactcactatagggtgtaactctctcctgccatcgcagttaattaacagaggagaaattaaatgcgatggcagaacctggcggcagcgcaaaagatg

SEQ ID NO: 159992 - DNA, 103 bp, Artificial Sequence
  Synthetic Polynucleotide
taatacgactcactatagggtatgcccgactgtaactctctcctgccatcaacagaggagagatggcatgagagagttaaacctggcggcagcgcaaaagatg

SEQ ID NO: 159993 - DNA, 103 bp, Artificial Sequence
  Synthetic Polynucleotide
taatacgactcactatagggcatggccccatatgcccgactgtaactctcaacagaggagagagagtatgagtcgggcaaacctggcggcagcgcaaaagatg

SEQ ID NO: 159994 - DNA, 103 bp, Artificial Sequence
  Synthetic Polynucleotide
taatacgactcactatagggggcaagaaaccatggccccatatgcccgacaacagaggagagtcgggatgatggggccaaacctggcggcagcgcaaaagatg

SEQ ID NO: 159995 - DNA, 103 bp, Artificial Sequence
  Synthetic Polynucleotide
taatacgactcactataggggacagcatgtggcaagaaaccatggccccaaacagaggagatggggcatgggtttcttgaacctggcggcagcgcaaaagatg

SEQ ID NO: 159996 - DNA, 103 bp, Artificial Sequence
  Synthetic Polynucleotide
taatacgactcactatagggctccagctcggacagcatgtggcaagaaacaacagaggagagtttctatgcacatgctgaacctggcggcagcgcaaaagatg

SEQ ID NO: 159997 - DNA, 103 bp, Artificial Sequence
  Synthetic Polynucleotide
taatacgactcactatagggggataacctcctccagctcggacagcatgtaacagaggagaacatgcatgccgagctggaacctggcggcagcgcaaaagatg

SEQ ID NO: 159998 - DNA, 103 bp, Artificial Sequence
  Synthetic Polynucleotide
taatacgactcactataggggcatgtctccggccctcattgcggtcagcaaacagaggagatgctgaatgcaatgagggaacctggcggcagcgcaaaagatg

SEQ ID NO: 159999 - DNA, 103 bp, Artificial Sequence
  Synthetic Polynucleotide
taatacgactcactatagggagtttgtactggataacctcctccagctcgaacagaggagacgagctatgggaggttataacctggcggcagcgcaaaagatg

SEQ ID NO: 160000 - DNA, 103 bp, Artificial Sequence
  Synthetic Polynucleotide
taatacgactcactatagggctcggggacaagtttgtactggataacctcaacagaggagagaggttatgcagtacaaaaacctggcggcagcgcaaaagatg

SEQ ID NO: 160001 - DNA, 103 bp, Artificial Sequence
  Synthetic Polynucleotide
taatacgactcactatagggtctctcgtcgctcggggacaagtttgtactaacagaggagaagtacaatgttgtccccgaacctggcggcagcgcaaaagatg

SEQ ID NO: 160002 - DNA, 103 bp, Artificial Sequence
  Synthetic Polynucleotide
taatacgactcactatagggtggcggatgatctctcgtcgctcggggacaaacagaggagatgtcccatggcgacgagaaacctggcggcagcgcaaaagatg

SEQ ID NO: 160003 - DNA, 103 bp, Artificial Sequence
  Synthetic Polynucleotide
taatacgactcactatagggccaccagatctggcggatgatctctcgtcgaacagaggagacgacgaatgatcatccgcaacctggcggcagcgcaaaagatg

SEQ ID NO: 160004 - DNA, 103 bp, Artificial Sequence
  Synthetic Polynucleotide
taatacgactcactataggggcagtctctcccaccagatctggcggatgaaacagaggagatcatccatgagatctggtaacctggcggcagcgcaaaagatg

SEQ ID NO: 160005 - DNA, 103 bp, Artificial Sequence
  Synthetic Polynucleotide
taatacgactcactatagggtggcagccctgcagtctctcccaccagatcaacagaggagagatctgatgggagagactaacctggcggcagcgcaaaagatg

SEQ ID NO: 160006 - DNA, 103 bp, Artificial Sequence
  Synthetic Polynucleotide
taatacgactcactatagggtacgatacgctggcagccctgcagtctctcaacagaggagagagagaatgcagggctgcaacctggcggcagcgcaaaagatg

SEQ ID NO: 160007 - DNA, 103 bp, Artificial Sequence
  Synthetic Polynucleotide
taatacgactcactataggggccagtcctctacgatacgctggcagccctaacagaggagaagggctatgagcgtatcgaacctggcggcagcgcaaaagatg

SEQ ID NO: 160008 - DNA, 103 bp, Artificial Sequence
  Synthetic Polynucleotide
taatacgactcactatagggaggattttctgccagtcctctacgatacgcaacagaggagagcgtatatgagaggactgaacctggcggcagcgcaaaagatg

SEQ ID NO: 160009 - DNA, 103 bp, Artificial Sequence
  Synthetic Polynucleotide
taatacgactcactatagggcaggacagctgcatgtctccggccctcattaacagaggagaaatgagatgcggagacataacctggcggcagcgcaaaagatg

SEQ ID NO: 160010 - DNA, 103 bp, Artificial Sequence
  Synthetic Polynucleotide
taatacgactcactatagggccgcaccataaggattttctgccagtcctcaacagaggagagaggacatgcagaaaatcaacctggcggcagcgcaaaagatg

SEQ ID NO: 160011 - DNA, 103 bp, Artificial Sequence
  Synthetic Polynucleotide
taatacgactcactatagggccacaagggaccgcaccataaggattttctaacagaggagaagaaaaatgttatggtgcaacctggcggcagcgcaaaagatg

SEQ ID NO: 160012 - DNA, 103 bp, Artificial Sequence
  Synthetic Polynucleotide
taatacgactcactatagggtgagggctgaccacaagggaccgcaccataaacagaggagatatggtatggtcccttgtaacctggcggcagcgcaaaagatg

SEQ ID NO: 160013 - DNA, 103 bp, Artificial Sequence
  Synthetic Polynucleotide
taatacgactcactatagggcatgtcttcatgagggctgaccacaagggaaacagaggagatcccttatggtcagccctaacctggcggcagcgcaaaagatg

SEQ ID NO: 160014 - DNA, 103 bp, Artificial Sequence
  Synthetic Polynucleotide
taatacgactcactataggggccaggttctcatgtcttcatgagggctgaaacagaggagatcagccatgatgaagacaaacctggcggcagcgcaaaagatg

SEQ ID NO: 160015 - DNA, 103 bp, Artificial Sequence
  Synthetic Polynucleotide
taatacgactcactataggggcatacttgagccaggttctcatgtcttcaaacagaggagatgaagaatggagaacctgaacctggcggcagcgcaaaagatg

SEQ ID NO: 160016 - DNA, 103 bp, Artificial Sequence
  Synthetic Polynucleotide
taatacgactcactataggggcacaggcttgcatacttgagccaggttctaacagaggagaagaaccatgctcaagtataacctggcggcagcgcaaaagatg

SEQ ID NO: 160017 - DNA, 103 bp, Artificial Sequence
  Synthetic Polynucleotide
taatacgactcactatagggcactcttgccgcacaggcttgcatacttgaaacagaggagatcaagtatgcaagcctgtaacctggcggcagcgcaaaagatg

SEQ ID NO: 160018 - DNA, 103 bp, Artificial Sequence
  Synthetic Polynucleotide
taatacgactcactataggggccagcctgccactcttgccgcacaggcttaacagaggagaaagcctatgcggcaagagaacctggcggcagcgcaaaagatg

SEQ ID NO: 160019 - DNA, 103 bp, Artificial Sequence
  Synthetic Polynucleotide
taatacgactcactatagggatgagcaagagccagcctgccactcttgccaacagaggagaggcaagatgggcaggctgaacctggcggcagcgcaaaagatg

SEQ ID NO: 160020 - DNA, 103 bp, Artificial Sequence
  Synthetic Polynucleotide
taatacgactcactataggggctgcaggacgctcacattgctagatgtggaacagaggagaccacatatggcaatgtgaaacctggcggcagcgcaaaagatg

SEQ ID NO: 160021 - DNA, 103 bp, Artificial Sequence
  Synthetic Polynucleotide
taatacgactcactatagggcacggagaaccaggacagctgcatgtctccaacagaggagaggagacatgcagctgtccaacctggcggcagcgcaaaagatg

SEQ ID NO: 160022 - DNA, 103 bp, Artificial Sequence
  Synthetic Polynucleotide
taatacgactcactatagggctaaagttttatgagcaagagccagcctgcaacagaggagagcaggcatgctcttgctcaacctggcggcagcgcaaaagatg

SEQ ID NO: 160023 - DNA, 103 bp, Artificial Sequence
  Synthetic Polynucleotide
taatacgactcactatagggaggagcaacactaaagttttatgagcaagaaacagaggagatcttgcatgtaaaactttaacctggcggcagcgcaaaagatg

SEQ ID NO: 160024 - DNA, 103 bp, Artificial Sequence
  Synthetic Polynucleotide
taatacgactcactatagggatcaactcccaggagcaacactaaagttttaacagaggagaaaaactatggtgttgctcaacctggcggcagcgcaaaagatg

SEQ ID NO: 160025 - DNA, 103 bp, Artificial Sequence
  Synthetic Polynucleotide
taatacgactcactataggggccgagacggatcaactcccaggagcaacaaacagaggagatgttgcatgtgggagttgaacctggcggcagcgcaaaagatg

SEQ ID NO: 160026 - DNA, 103 bp, Artificial Sequence
  Synthetic Polynucleotide
taatacgactcactatagggtggtcaagttgccgagacggatcaactcccaacagaggagagggagtatgtccgtctcgaacctggcggcagcgcaaaagatg

SEQ ID NO: 160027 - DNA, 103 bp, Artificial Sequence
  Synthetic Polynucleotide
taatacgactcactatagggtggcagaggatggtcaagttgccgagacggaacagaggagaccgtctatgcaacttgacaacctggcggcagcgcaaaagatg

SEQ ID NO: 160028 - DNA, 103 bp, Artificial Sequence
  Synthetic Polynucleotide
taatacgactcactatagggggtgaactgttggcagaggatggtcaagttaacagaggagaaacttgatgatcctctgcaacctggcggcagcgcaaaagatg

SEQ ID NO: 160029 - DNA, 103 bp, Artificial Sequence
  Synthetic Polynucleotide
taatacgactcactataggggtcacctgagggtgaactgttggcagaggaaacagaggagatcctctatgaacagttcaaacctggcggcagcgcaaaagatg

SEQ ID NO: 160030 - DNA, 103 bp, Artificial Sequence
  Synthetic Polynucleotide
taatacgactcactataggggtaggcataggtcacctgagggtgaactgtaacagaggagaacagttatgcctcaggtgaacctggcggcagcgcaaaagatg

SEQ ID NO: 160031 - DNA, 103 bp, Artificial Sequence
  Synthetic Polynucleotide
taatacgactcactatagggtgtttttcatgtaggcataggtcacctgagaacagaggagactcaggatgcctatgcctaacctggcggcagcgcaaaagatg

SEQ ID NO: 160032 - DNA, 103 bp, Artificial Sequence
  Synthetic Polynucleotide
taatacgactcactatagggatggccagctcacggagaaccaggacagctaacagaggagaagctgtatgggttctccgaacctggcggcagcgcaaaagatg

SEQ ID NO: 160033 - DNA, 103 bp, Artificial Sequence
  Synthetic Polynucleotide
taatacgactcactatagggctcttccacatgtttttcatgtaggcatagaacagaggagactatgcatgcatgaaaaaaacctggcggcagcgcaaaagatg

SEQ ID NO: 160034 - DNA, 103 bp, Artificial Sequence
  Synthetic Polynucleotide
taatacgactcactatagggcttgcgggcactcttccacatgtttttcataacagaggagaatgaaaatgatgtggaagaacctggcggcagcgcaaaagatg

SEQ ID NO: 160035 - DNA, 103 bp, Artificial Sequence
  Synthetic Polynucleotide
taatacgactcactatagggaggcatcgatcttgcgggcactcttccacaaacagaggagatgtggaatggtgcccgcaaacctggcggcagcgcaaaagatg

SEQ ID NO: 160036 - DNA, 103 bp, Artificial Sequence
  Synthetic Polynucleotide
taatacgactcactatagggatgtgctggaaggcatcgatcttgcgggcaaacagaggagatgcccgatggatcgatgcaacctggcggcagcgcaaaagatg

SEQ ID NO: 160037 - DNA, 103 bp, Artificial Sequence
  Synthetic Polynucleotide
taatacgactcactatagggaaaatgctgcatgtgctggaaggcatcgataacagaggagaatcgatatgttccagcacaacctggcggcagcgcaaaagatg

SEQ ID NO: 160038 - DNA, 103 bp, Artificial Sequence
  Synthetic Polynucleotide
taatacgactcactatagggtggtctggacaaaatgctgcatgtgctggaaacagaggagatccagcatgtgcagcattaacctggcggcagcgcaaaagatg

SEQ ID NO: 160039 - DNA, 103 bp, Artificial Sequence
  Synthetic Polynucleotide
taatacgactcactatagggtgttgctgcatggtctggacaaaatgctgcaacagaggagagcagcaatgtgtccagacaacctggcggcagcgcaaaagatg

SEQ ID NO: 160040 - DNA, 103 bp, Artificial Sequence
  Synthetic Polynucleotide
taatacgactcactatagggatgctgggcctgttgctgcatggtctggacaacagaggagagtccagatgatgcagcaaaacctggcggcagcgcaaaagatg

SEQ ID NO: 160041 - DNA, 103 bp, Artificial Sequence
  Synthetic Polynucleotide
taatacgactcactatagggtagcgatggcatgctgggcctgttgctgcaaacagaggagatgcagcatgaggcccagcaacctggcggcagcgcaaaagatg

SEQ ID NO: 160042 - DNA, 103 bp, Artificial Sequence
  Synthetic Polynucleotide
taatacgactcactatagggtggtcctcagtagcgatggcatgctgggccaacagaggagaggcccaatgtgccatcgcaacctggcggcagcgcaaaagatg

SEQ ID NO: 160043 - DNA, 103 bp, Artificial Sequence
  Synthetic Polynucleotide
taatacgactcactatagggagggacgctgatggccagctcacggagaacaacagaggagagttctcatggagctggccaacctggcggcagcgcaaaagatg

SEQ ID NO: 160044 - DNA, 103 bp, Artificial Sequence
  Synthetic Polynucleotide
taatacgactcactatagggcttatgctgctggtcctcagtagcgatggcaacagaggagagccatcatgactgaggacaacctggcggcagcgcaaaagatg

SEQ ID NO: 160045 - DNA, 103 bp, Artificial Sequence
  Synthetic Polynucleotide
taatacgactcactataggggcagttcctgcttatgctgctggtcctcagaacagaggagactgaggatgagcagcataaacctggcggcagcgcaaaagatg

SEQ ID NO: 160046 - DNA, 103 bp, Artificial Sequence
  Synthetic Polynucleotide
taatacgactcactatagggatgagcttgtgcagttcctgcttatgctgcaacagaggagagcagcaatggcaggaactaacctggcggcagcgcaaaagatg

SEQ ID NO: 160047 - DNA, 103 bp, Artificial Sequence
  Synthetic Polynucleotide
taatacgactcactataggggcatcgggccatgagcttgtgcagttcctgaacagaggagacaggaaatgcacaagctcaacctggcggcagcgcaaaagatg

SEQ ID NO: 160048 - DNA, 103 bp, Artificial Sequence
  Synthetic Polynucleotide
taatacgactcactataggggtttcaggaagcatcgggccatgagcttgtaacagaggagaacaagcatgtggcccgataacctggcggcagcgcaaaagatg

SEQ ID NO: 160049 - DNA, 103 bp, Artificial Sequence
  Synthetic Polynucleotide
taatacgactcactatagggcactctccaagtttcaggaagcatcgggccaacagaggagaggcccgatgcttcctgaaaacctggcggcagcgcaaaagatg

SEQ ID NO: 160050 - DNA, 103 bp, Artificial Sequence
  Synthetic Polynucleotide
taatacgactcactatagggattcagctgccactctccaagtttcaggaaaacagaggagattcctgatgcttggagagaacctggcggcagcgcaaaagatg

SEQ ID NO: 160051 - DNA, 103 bp, Artificial Sequence
  Synthetic Polynucleotide
taatacgactcactatagggtgccctgtagattcagctgccactctccaaaacagaggagattggagatgggcagctgaaacctggcggcagcgcaaaagatg

SEQ ID NO: 160052 - DNA, 103 bp, Artificial Sequence
  Synthetic Polynucleotide
taatacgactcactatagggctctcattgatgccctgtagattcagctgcaacagaggagagcagctatgtctacagggaacctggcggcagcgcaaaagatg

SEQ ID NO: 160053 - DNA, 103 bp, Artificial Sequence
  Synthetic Polynucleotide
taatacgactcactatagggggggattgtgctctcattgatgccctgtagaacagaggagactacagatgatcaatgagaacctggcggcagcgcaaaagatg

SEQ ID NO: 160054 - DNA, 103 bp, Artificial Sequence
  Synthetic Polynucleotide
taatacgactcactatagggagaagaaggtagggacgctgatggccagctaacagaggagaagctggatgtcagcgtccaacctggcggcagcgcaaaagatg

SEQ ID NO: 160055 - DNA, 103 bp, Artificial Sequence
  Synthetic Polynucleotide
taatacgactcactataggggcagcactttggggattgtgctctcattgaaacagaggagatcaatgatggcacaatccaacctggcggcagcgcaaaagatg

SEQ ID NO: 160056 - DNA, 103 bp, Artificial Sequence
  Synthetic Polynucleotide
taatacgactcactatagggctgtagtactgcagcactttggggattgtgaacagaggagacacaatatgcaaagtgctaacctggcggcagcgcaaaagatg

SEQ ID NO: 160057 - DNA, 103 bp, Artificial Sequence
  Synthetic Polynucleotide
taatacgactcactatagggtgtggcggcgctgtagtactgcagcactttaacagaggagaaaagtgatgcagtactacaacctggcggcagcgcaaaagatg

SEQ ID NO: 160058 - DNA, 103 bp, Artificial Sequence
  Synthetic Polynucleotide
taatacgactcactatagggggtcgtgctctgtggcggcgctgtagtactaacagaggagaagtactatggcgccgccaaacctggcggcagcgcaaaagatg

SEQ ID NO: 160059 - DNA, 103 bp, Artificial Sequence
  Synthetic Polynucleotide
taatacgactcactatagggtaccagctgcggtcgtgctctgtggcggcgaacagaggagacgccgcatgagagcacgaaacctggcggcagcgcaaaagatg

SEQ ID NO: 160060 - DNA, 103 bp, Artificial Sequence
  Synthetic Polynucleotide
taatacgactcactatagggccaggccttgtaccagctgcggtcgtgctcaacagaggagagagcacatgcgcagctggaacctggcggcagcgcaaaagatg

SEQ ID NO: 160061 - DNA, 103 bp, Artificial Sequence
  Synthetic Polynucleotide
taatacgactcactatagggcccacgcatgccaggccttgtaccagctgcaacagaggagagcagctatgacaaggcctaacctggcggcagcgcaaaagatg

SEQ ID NO: 160062 - DNA, 103 bp, Artificial Sequence
  Synthetic Polynucleotide
taatacgactcactatagggttcatcactgcccacgcatgccaggccttgaacagaggagacaaggcatggcatgcgtgaacctggcggcagcgcaaaagatg

SEQ ID NO: 160063 - DNA, 103 bp, Artificial Sequence
  Synthetic Polynucleotide
taatacgactcactatagggagcttcgaagttcatcactgcccacgcatgaacagaggagacatgcgatggcagtgatgaacctggcggcagcgcaaaagatg

SEQ ID NO: 160064 - DNA, 103 bp, Artificial Sequence
  Synthetic Polynucleotide
taatacgactcactatagggagtgtagcacagcttcgaagttcatcactgaacagaggagacagtgaatgacttcgaagaacctggcggcagcgcaaaagatg

SEQ ID NO: 160065 - DNA, 103 bp, Artificial Sequence
  Synthetic Polynucleotide
taatacgactcactatagggacttgctggaagaagaaggtagggacgctgaacagaggagacagcgtatgtaccttcttaacctggcggcagcgcaaaagatg

SEQ ID NO: 160066 - DNA, 103 bp, Artificial Sequence
  Synthetic Polynucleotide
taatacgactcactatagggtgatgtttgtagtgtagcacagcttcgaagaacagaggagacttcgaatgtgtgctacaaacctggcggcagcgcaaaagatg

SEQ ID NO: 160067 - DNA, 103 bp, Artificial Sequence
  Synthetic Polynucleotide
taatacgactcactatagggggcttggttctgatgtttgtagtgtagcacaacagaggagagtgctaatgtacaaacataacctggcggcagcgcaaaagatg

SEQ ID NO: 160068 - DNA, 103 bp, Artificial Sequence
  Synthetic Polynucleotide
taatacgactcactatagggtctcatcgcgggcttggttctgatgtttgtaacagaggagaacaaacatgagaaccaagaacctggcggcagcgcaaaagatg

SEQ ID NO: 160069 - DNA, 103 bp, Artificial Sequence
  Synthetic Polynucleotide
taatacgactcactatagggagtttcttcttctcatcgcgggcttggttcaacagaggagagaaccaatgccgcgatgaaacctggcggcagcgcaaaagatg

SEQ ID NO: 160070 - DNA, 103 bp, Artificial Sequence
  Synthetic Polynucleotide
taatacgactcactatagggggcatgacgcagtttcttcttctcatcgcgaacagaggagacgcgatatgaagaagaaaaacctggcggcagcgcaaaagatg

SEQ ID NO: 160071 - DNA, 103 bp, Artificial Sequence
  Synthetic Polynucleotide
taatacgactcactatagggtggccccgctggcatgacgcagtttcttctaacagaggagaagaagaatgtgcgtcatgaacctggcggcagcgcaaaagatg

SEQ ID NO: 160072 - DNA, 103 bp, Artificial Sequence
  Synthetic Polynucleotide
taatacgactcactatagggttggtgatgttggccccgctggcatgacgcaacagaggagagcgtcaatgcagcggggcaacctggcggcagcgcaaaagatg

SEQ ID NO: 160073 - DNA, 103 bp, Artificial Sequence
  Synthetic Polynucleotide
taatacgactcactatagggagtggtggcgttggtgatgttggccccgctaacagaggagaagcgggatgaacatcaccaacctggcggcagcgcaaaagatg

SEQ ID NO: 160074 - DNA, 103 bp, Artificial Sequence
  Synthetic Polynucleotide
taatacgactcactatagggtggtggcggcagtggtggcgttggtgatgtaacagaggagaacatcaatgacgccaccaaacctggcggcagcgcaaaagatg

SEQ ID NO: 160075 - DNA, 103 bp, Artificial Sequence
  Synthetic Polynucleotide
taatacgactcactataggggtggcggccgtggtggcggcagtggtggcgaacagaggagacgccacatgtgccgccacaacctggcggcagcgcaaaagatg

SEQ ID NO: 160076 - DNA, 103 bp, Artificial Sequence
  Synthetic Polynucleotide
taatacgactcactataggggaagggttgcacttgctggaagaagaaggtaacagaggagaaccttcatgttccagcaaaacctggcggcagcgcaaaagatg

SEQ ID NO: 160077 - DNA, 103 bp, Artificial Sequence
  Synthetic Polynucleotide
taatacgactcactatagggggtggtggcagtggcggccgtggtggcggcaacagaggagagccgccatgacggccgccaacctggcggcagcgcaaaagatg

SEQ ID NO: 160078 - DNA, 103 bp, Artificial Sequence
  Synthetic Polynucleotide
taatacgactcactatagggtgctggcagtggtggtggcagtggcggccgaacagaggagacggccgatgctgccaccaaacctggcggcagcgcaaaagatg

SEQ ID NO: 160079 - DNA, 103 bp, Artificial Sequence
  Synthetic Polynucleotide
taatacgactcactatagggctgccctcggtgctggcagtggtggtggcaaacagaggagatgccacatgcactgccagaacctggcggcagcgcaaaagatg

SEQ ID NO: 160080 - DNA, 103 bp, Artificial Sequence
  Synthetic Polynucleotide
taatacgactcactatagggctcactgttgctgccctcggtgctggcagtaacagaggagaactgccatgaccgagggcaacctggcggcagcgcaaaagatg

SEQ ID NO: 160081 - DNA, 103 bp, Artificial Sequence
  Synthetic Polynucleotide
taatacgactcactatagggcggcctcgctctcactgttgctgccctcggaacagaggagaccgaggatggcaacagtgaacctggcggcagcgcaaaagatg

SEQ ID NO: 160082 - DNA, 103 bp, Artificial Sequence
  Synthetic Polynucleotide
taatacgactcactatagggtcggtgctctcggcctcgctctcactgttgaacagaggagacaacagatggagcgaggcaacctggcggcagcgcaaaagatg

SEQ ID NO: 160083 - DNA, 103 bp, Artificial Sequence
  Synthetic Polynucleotide
taatacgactcactatagggggggctgttctcggtgctctcggcctcgctaacagaggagaagcgagatggagagcaccaacctggcggcagcgcaaaagatg

SEQ ID NO: 160084 - DNA, 103 bp, Artificial Sequence
  Synthetic Polynucleotide
taatacgactcactataggggcgatggggtggggctgttctcggtgctctaacagaggagaagagcaatgagaacagccaacctggcggcagcgcaaaagatg

SEQ ID NO: 160085 - DNA, 103 bp, Artificial Sequence
  Synthetic Polynucleotide
taatacgactcactatagggttctgcagcggcgatggggtggggctgttcaacagaggagagaacagatgcaccccatcaacctggcggcagcgcaaaagatg

SEQ ID NO: 160086 - DNA, 103 bp, Artificial Sequence
  Synthetic Polynucleotide
taatacgactcactatagggagtgaccttcttctgcagcggcgatggggtaacagaggagaaccccaatgccgctgcagaacctggcggcagcgcaaaagatg

SEQ ID NO: 160087 - DNA, 103 bp, Artificial Sequence
  Synthetic Polynucleotide
taatacgactcactatagggtgttgtcaaagaagggttgcacttgctggaaacagaggagatccagcatgtgcaaccctaacctggcggcagcgcaaaagatg

SEQ ID NO: 160088 - DNA, 103 bp, Artificial Sequence
  Synthetic Polynucleotide
taatacgactcactatagggacagatcctcagtgaccttcttctgcagcgaacagaggagacgctgcatgagaaggtcaaacctggcggcagcgcaaaagatg

SEQ ID NO: 160089 - DNA, 103 bp, Artificial Sequence
  Synthetic Polynucleotide
taatacgactcactatagggagggttttggacagatcctcagtgaccttcaacagaggagagaaggtatgtgaggatctaacctggcggcagcgcaaaagatg

SEQ ID NO: 160090 - DNA, 103 bp, Artificial Sequence
  Synthetic Polynucleotide
taatacgactcactataggggtacatcaggagggttttggacagatcctcaacagaggagagaggatatgtccaaaaccaacctggcggcagcgcaaaagatg

SEQ ID NO: 160091 - DNA, 103 bp, Artificial Sequence
  Synthetic Polynucleotide
taatacgactcactatagggcaggcaccgtgtacatcaggagggttttggaacagaggagaccaaaaatgtcctgatgtaacctggcggcagcgcaaaagatg

SEQ ID NO: 160092 - DNA, 103 bp, Artificial Sequence
  Synthetic Polynucleotide
taatacgactcactatagggccctggacggcaggcaccgtgtacatcaggaacagaggagacctgatatgcacggtgccaacctggcggcagcgcaaaagatg

SEQ ID NO: 160093 - DNA, 103 bp, Artificial Sequence
  Synthetic Polynucleotide
taatacgactcactatagggacggaagaagccctggacggcaggcaccgtaacagaggagaacggtgatggccgtccagaacctggcggcagcgcaaaagatg

SEQ ID NO: 160094 - DNA, 103 bp, Artificial Sequence
  Synthetic Polynucleotide
taatacgactcactatagggaggagatggaacggaagaagccctggacggaacagaggagaccgtccatggcttcttccaacctggcggcagcgcaaaagatg

SEQ ID NO: 160095 - DNA, 103 bp, Artificial Sequence
  Synthetic Polynucleotide
taatacgactcactatagggcctcgtgacaaggagatggaacggaagaagaacagaggagacttcttatgttccatctcaacctggcggcagcgcaaaagatg

SEQ ID NO: 160096 - DNA, 103 bp, Artificial Sequence
  Synthetic Polynucleotide
taatacgactcactataggggaggttgttgcctcgtgacaaggagatggaaacagaggagatccatcatgttgtcacgaaacctggcggcagcgcaaaagatg

SEQ ID NO: 160097 - DNA, 103 bp, Artificial Sequence
  Synthetic Polynucleotide
taatacgactcactataggggtgtatcctggaggttgttgcctcgtgacaaacagaggagatgtcacatggcaacaaccaacctggcggcagcgcaaaagatg

SEQ ID NO: 160098 - DNA, 103 bp, Artificial Sequence
  Synthetic Polynucleotide
taatacgactcactataggggccacaaaaatgttgtcaaagaagggttgcaacagaggagagcaaccatgctttgacaaaacctggcggcagcgcaaaagatg

SEQ ID NO: 160099 - DNA, 103 bp, Artificial Sequence
  Synthetic Polynucleotide
taatacgactcactatagggagaactctgagtgtatcctggaggttgttgaacagaggagacaacaaatgccaggatacaacctggcggcagcgcaaaagatg

SEQ ID NO: 160100 - DNA, 103 bp, Artificial Sequence
  Synthetic Polynucleotide
taatacgactcactatagggccataaggtgagaactctgagtgtatcctgaacagaggagacaggatatgctcagagttaacctggcggcagcgcaaaagatg

SEQ ID NO: 160101 - DNA, 103 bp, Artificial Sequence
  Synthetic Polynucleotide
taatacgactcactatagggcataatcaaaccataaggtgagaactctgaaacagaggagatcagagatgtcaccttataacctggcggcagcgcaaaagatg

SEQ ID NO: 160102 - DNA, 103 bp, Artificial Sequence
  Synthetic Polynucleotide
taatacgactcactatagggggccagtgaccataatcaaaccataaggtgaacagaggagacaccttatggtttgattaaacctggcggcagcgcaaaagatg

SEQ ID NO: 160103 - DNA, 103 bp, Artificial Sequence
  Synthetic Polynucleotide
taatacgactcactatagggattgacatctggccagtgaccataatcaaaaacagaggagatttgatatgggtcactggaacctggcggcagcgcaaaagatg

SEQ ID NO: 160104 - DNA, 103 bp, Artificial Sequence
  Synthetic Polynucleotide
taatacgactcactatagggctaaggcctcattgacatctggccagtgacaacagaggagagtcactatgcagatgtcaaacctggcggcagcgcaaaagatg

SEQ ID NO: 160105 - DNA, 103 bp, Artificial Sequence
  Synthetic Polynucleotide
taatacgactcactatagggaccccctccactaaggcctcattgacatctaacagaggagaagatgtatgtgaggccttaacctggcggcagcgcaaaagatg

SEQ ID NO: 160106 - DNA, 103 bp, Artificial Sequence
  Synthetic Polynucleotide
taatacgactcactataggggatggctttcaccccctccactaaggcctcaacagaggagagaggccatggtggaggggaacctggcggcagcgcaaaagatg

SEQ ID NO: 160107 - DNA, 103 bp, Artificial Sequence
  Synthetic Polynucleotide
taatacgactcactatagggtatcaatctggatggctttcaccccctccaaacagaggagatggaggatgtgaaagccaaacctggcggcagcgcaaaagatg

SEQ ID NO: 160108 - DNA, 103 bp, Artificial Sequence
  Synthetic Polynucleotide
taatacgactcactatagggtgtagccaggtatcaatctggatggctttcaacagaggagagaaagcatgccagattgaaacctggcggcagcgcaaaagatg

SEQ ID NO: 160109 - DNA, 103 bp, Artificial Sequence
  Synthetic Polynucleotide
taatacgactcactataggggtcccacacggccacaaaaatgttgtcaaaaacagaggagatttgacatgatttttgtgaacctggcggcagcgcaaaagatg

SEQ ID NO: 160110 - DNA, 103 bp, Artificial Sequence
  Synthetic Polynucleotide
taatacgactcactatagggaggtataacctgtagccaggtatcaatctgaacagaggagacagattatgacctggctaaacctggcggcagcgcaaaagatg

SEQ ID NO: 160111 - DNA, 103 bp, Artificial Sequence
  Synthetic Polynucleotide
taatacgactcactatagggcaatgagctgaggtataacctgtagccaggaacagaggagacctggcatgaggttatacaacctggcggcagcgcaaaagatg

SEQ ID NO: 160112 - DNA, 103 bp, Artificial Sequence
  Synthetic Polynucleotide
taatacgactcactatagggtcaattcttgcaatgagctgaggtataaccaacagaggagaggttatatgtcagctcataacctggcggcagcgcaaaagatg

SEQ ID NO: 160113 - DNA, 103 bp, Artificial Sequence
  Synthetic Polynucleotide
taatacgactcactatagggtctgggcgtatcaattcttgcaatgagctgaacagaggagacagctcatggcaagaattaacctggcggcagcgcaaaagatg

SEQ ID NO: 160114 - DNA, 103 bp, Artificial Sequence
  Synthetic Polynucleotide
taatacgactcactatagggccaccaagggtctgggcgtatcaattcttgaacagaggagacaagaaatgatacgcccaaacctggcggcagcgcaaaagatg

SEQ ID NO: 160115 - DNA, 103 bp, Artificial Sequence
  Synthetic Polynucleotide
taatacgactcactatagggatgagacgtcccaccaagggtctgggcgtaaacagaggagatacgccatgacccttggtaacctggcggcagcgcaaaagatg

SEQ ID NO: 160116 - DNA, 103 bp, Artificial Sequence
  Synthetic Polynucleotide
taatacgactcactatagggaagctggtgaatgagacgtcccaccaagggaacagaggagacccttgatgggacgtctcaacctggcggcagcgcaaaagatg

SEQ ID NO: 160117 - DNA, 103 bp, Artificial Sequence
  Synthetic Polynucleotide
taatacgactcactatagggtgtctgtgagaagctggtgaatgagacgtcaacagaggagagacgtcatgttcaccagcaacctggcggcagcgcaaaagatg

SEQ ID NO: 160118 - DNA, 103 bp, Artificial Sequence
  Synthetic Polynucleotide
taatacgactcactatagggtaccgaccaatgtctgtgagaagctggtgaaacagaggagatcaccaatgtctcacagaaacctggcggcagcgcaaaagatg

SEQ ID NO: 160119 - DNA, 103 bp, Artificial Sequence
  Synthetic Polynucleotide
taatacgactcactatagggctgggggtggtaccgaccaatgtctgtgagaacagaggagactcacaatgattggtcggaacctggcggcagcgcaaaagatg

SEQ ID NO: 160120 - DNA, 103 bp, Artificial Sequence
  Synthetic Polynucleotide
taatacgactcactatagggcctgtttggggtcccacacggccacaaaaaaacagaggagatttttgatgccgtgtgggaacctggcggcagcgcaaaagatg

SEQ ID NO: 160121 - DNA, 103 bp, Artificial Sequence
  Synthetic Polynucleotide
taatacgactcactatagggagatgagggcctgggggtggtaccgaccaaaacagaggagattggtcatgaccacccccaacctggcggcagcgcaaaagatg

SEQ ID NO: 160122 - DNA, 103 bp, Artificial Sequence
  Synthetic Polynucleotide
taatacgactcactataggggtcagtgggtagatgagggcctgggggtggaacagaggagaccacccatgggccctcataacctggcggcagcgcaaaagatg

SEQ ID NO: 160123 - DNA, 103 bp, Artificial Sequence
  Synthetic Polynucleotide
taatacgactcactatagggagaagccactgtcagtgggtagatgagggcaacagaggagagccctcatgtacccactgaacctggcggcagcgcaaaagatg

SEQ ID NO: 160124 - DNA, 103 bp, Artificial Sequence
  Synthetic Polynucleotide
taatacgactcactatagggtggtagacttagaagccactgtcagtgggtaacagaggagaacccacatgcagtggcttaacctggcggcagcgcaaaagatg

SEQ ID NO: 160125 - DNA, 103 bp, Artificial Sequence
  Synthetic Polynucleotide
taatacgactcactatagggcgggctgtcgtggtagacttagaagccactaacagaggagaagtggcatgtaagtctacaacctggcggcagcgcaaaagatg

SEQ ID NO: 160126 - DNA, 103 bp, Artificial Sequence
  Synthetic Polynucleotide
taatacgactcactatagggtgcattgtgccgggctgtcgtggtagacttaacagaggagaaagtctatgacgacagccaacctggcggcagcgcaaaagatg

SEQ ID NO: 160127 - DNA, 103 bp, Artificial Sequence
  Synthetic Polynucleotide
taatacgactcactatagggtcttgttggctgcattgtgccgggctgtcgaacagaggagacgacagatgggcacaatgaacctggcggcagcgcaaaagatg

SEQ ID NO: 160128 - DNA, 103 bp, Artificial Sequence
  Synthetic Polynucleotide
taatacgactcactatagggttcttcagaatcttgttggctgcattgtgcaacagaggagagcacaaatgagccaacaaaacctggcggcagcgcaaaagatg

SEQ ID NO: 160129 - DNA, 103 bp, Artificial Sequence
  Synthetic Polynucleotide
taatacgactcactatagggctcacacatgttcttcagaatcttgttggcaacagaggagagccaacatgattctgaagaacctggcggcagcgcaaaagatg

SEQ ID NO: 160130 - DNA, 103 bp, Artificial Sequence
  Synthetic Polynucleotide
taatacgactcactatagggtgttgctgtgctcacacatgttcttcagaaaacagaggagattctgaatgacatgtgtgaacctggcggcagcgcaaaagatg

SEQ ID NO: 160131 - DNA, 103 bp, Artificial Sequence
  Synthetic Polynucleotide
taatacgactcactatagggctggcaaactgctgcaggacgctcacattgaacagaggagacaatgtatgcgtcctgcaaacctggcggcagcgcaaaagatg

SEQ ID NO: 160132 - DNA, 103 bp, Artificial Sequence
  Synthetic Polynucleotide
taatacgactcactatagggtcacggatggcctgtttggggtcccacacgaacagaggagacgtgtgatgccccaaacaaacctggcggcagcgcaaaagatg

SEQ ID NO: 160133 - DNA, 103 bp, Artificial Sequence
  Synthetic Polynucleotide
taatacgactcactatagggtggaccagggtgttgctgtgctcacacatgaacagaggagacatgtgatggcacagcaaaacctggcggcagcgcaaaagatg

SEQ ID NO: 160134 - DNA, 103 bp, Artificial Sequence
  Synthetic Polynucleotide
taatacgactcactatagggcatggcctgctggaccagggtgttgctgtgaacagaggagacacagcatgaccctggtcaacctggcggcagcgcaaaagatg

SEQ ID NO: 160135 - DNA, 103 bp, Artificial Sequence
  Synthetic Polynucleotide
taatacgactcactatagggcgctcaccatcatggcctgctggaccagggaacagaggagaccctggatgagcaggccaaacctggcggcagcgcaaaagatg

SEQ ID NO: 160136 - DNA, 103 bp, Artificial Sequence
  Synthetic Polynucleotide
taatacgactcactatagggatcagctcctcgctcaccatcatggcctgcaacagaggagagcaggcatggatggtgagaacctggcggcagcgcaaaagatg

SEQ ID NO: 160137 - DNA, 103 bp, Artificial Sequence
  Synthetic Polynucleotide
taatacgactcactatagggggccactcggatcagctcctcgctcaccataacagaggagaatggtgatggaggagctgaacctggcggcagcgcaaaagatg

SEQ ID NO: 160138 - DNA, 103 bp, Artificial Sequence
  Synthetic Polynucleotide
taatacgactcactataggggccagaggatggccactcggatcagctcctaacagaggagaaggagcatgtccgagtggaacctggcggcagcgcaaaagatg

SEQ ID NO: 160139 - DNA, 103 bp, Artificial Sequence
  Synthetic Polynucleotide
taatacgactcactatagggcacatctcatgccagaggatggccactcggaacagaggagaccgagtatgcatcctctgaacctggcggcagcgcaaaagatg

SEQ ID NO: 160140 - DNA, 103 bp, Artificial Sequence
  Synthetic Polynucleotide
taatacgactcactataggggccttcatgccacatctcatgccagaggataacagaggagaatcctcatgcatgagatgaacctggcggcagcgcaaaagatg

SEQ ID NO: 160141 - DNA, 103 bp, Artificial Sequence
  Synthetic Polynucleotide
taatacgactcactatagggcctcttccaggccttcatgccacatctcataacagaggagaatgagaatgggcatgaagaacctggcggcagcgcaaaagatg

SEQ ID NO: 160142 - DNA, 103 bp, Artificial Sequence
  Synthetic Polynucleotide
taatacgactcactatagggaaacgagatgcctcttccaggccttcatgcaacagaggagagcatgaatgcctggaagaaacctggcggcagcgcaaaagatg

SEQ ID NO: 160143 - DNA, 103 bp, Artificial Sequence
  Synthetic Polynucleotide
taatacgactcactatagggtacagctccctcacggatggcctgtttgggaacagaggagacccaaaatggccatccgtaacctggcggcagcgcaaaagatg

SEQ ID NO: 160144 - DNA, 103 bp, Artificial Sequence
  Synthetic Polynucleotide
taatacgactcactatagggcccaaagtacaaacgagatgcctcttccagaacagaggagactggaaatggcatctcgtaacctggcggcagcgcaaaagatg

SEQ ID NO: 160145 - DNA, 103 bp, Artificial Sequence
  Synthetic Polynucleotide
taatacgactcactatagggcgttcctttccccaaagtacaaacgagatgaacagaggagacatctcatgtgtactttgaacctggcggcagcgcaaaagatg

SEQ ID NO: 160146 - DNA, 103 bp, Artificial Sequence
  Synthetic Polynucleotide
taatacgactcactatagggatgcctttcacgttcctttccccaaagtacaacagaggagagtacttatgggaaaggaaaacctggcggcagcgcaaaagatg

SEQ ID NO: 160147 - DNA, 103 bp, Artificial Sequence
  Synthetic Polynucleotide
taatacgactcactatagggcacctcaaacatgcctttcacgttcctttcaacagaggagagaaaggatggtgaaaggcaacctggcggcagcgcaaaagatg

SEQ ID NO: 160148 - DNA, 103 bp, Artificial Sequence
  Synthetic Polynucleotide
taatacgactcactatagggagggctccagcacctcaaacatgcctttcaaacagaggagatgaaagatgtgtttgaggaacctggcggcagcgcaaaagatg

SEQ ID NO: 160149 - DNA, 103 bp, Artificial Sequence
  Synthetic Polynucleotide
taatacgactcactatagggatagcatgcaagggctccagcacctcaaacaacagaggagagtttgaatggctggagccaacctggcggcagcgcaaaagatg

SEQ ID NO: 160150 - DNA, 103 bp, Artificial Sequence
  Synthetic Polynucleotide
taatacgactcactatagggccgttccatcatagcatgcaagggctccagaacagaggagactggagatgttgcatgctaacctggcggcagcgcaaaagatg

SEQ ID NO: 160151 - DNA, 103 bp, Artificial Sequence
  Synthetic Polynucleotide
taatacgactcactatagggtctgggggccccgttccatcatagcatgcaaacagaggagatgcatgatgtgatggaacaacctggcggcagcgcaaaagatg

SEQ ID NO: 160152 - DNA, 103 bp, Artificial Sequence
  Synthetic Polynucleotide
taatacgactcactatagggtccttcagagtctgggggccccgttccatcaacagaggagagatggaatggggcccccaaacctggcggcagcgcaaaagatg

SEQ ID NO: 160153 - DNA, 103 bp, Artificial Sequence
  Synthetic Polynucleotide
taatacgactcactatagggaaaggatgtttccttcagagtctgggggccaacagaggagaggccccatgactctgaagaacctggcggcagcgcaaaagatg

SEQ ID NO: 160154 - DNA, 103 bp, Artificial Sequence
  Synthetic Polynucleotide
taatacgactcactataggggaagggcggctacagctccctcacggatggaacagaggagaccatccatgagggagctgaacctggcggcagcgcaaaagatg

SEQ ID NO: 160155 - DNA, 103 bp, Artificial Sequence
  Synthetic Polynucleotide
taatacgactcactatagggaggcctgattaaaggatgtttccttcagagaacagaggagactctgaatgaaacatcctaacctggcggcagcgcaaaagatg

SEQ ID NO: 160156 - DNA, 103 bp, Artificial Sequence
  Synthetic Polynucleotide
taatacgactcactatagggtctcgaccataggcctgattaaaggatgttaacagaggagaaacatcatgtaatcaggcaacctggcggcagcgcaaaagatg

SEQ ID NO: 160157 - DNA, 103 bp, Artificial Sequence
  Synthetic Polynucleotide
taatacgactcactatagggctccattaaatctcgaccataggcctgattaacagaggagaaatcagatgtatggtcgaaacctggcggcagcgcaaaagatg

SEQ ID NO: 160158 - DNA, 103 bp, Artificial Sequence
  Synthetic Polynucleotide
taatacgactcactatagggactcttgggcctccattaaatctcgaccataacagaggagaatggtcatgatttaatggaacctggcggcagcgcaaaagatg

SEQ ID NO: 160159 - DNA, 103 bp, Artificial Sequence
  Synthetic Polynucleotide
taatacgactcactatagggttcctgcaccactcttgggcctccattaaaaacagaggagatttaatatgggcccaagaaacctggcggcagcgcaaaagatg

SEQ ID NO: 160160 - DNA, 103 bp, Artificial Sequence
  Synthetic Polynucleotide
taatacgactcactatagggtttcatgtacttcctgcaccactcttgggcaacagaggagagcccaaatgtggtgcaggaacctggcggcagcgcaaaagatg

SEQ ID NO: 160161 - DNA, 103 bp, Artificial Sequence
  Synthetic Polynucleotide
taatacgactcactatagggcattccctgatttcatgtacttcctgcaccaacagaggagaggtgcaatgagtacatgaaacctggcggcagcgcaaaagatg

SEQ ID NO: 160162 - DNA, 103 bp, Artificial Sequence
  Synthetic Polynucleotide
taatacgactcactatagggaggtccttgacattccctgatttcatgtacaacagaggagagtacatatgatcagggaaaacctggcggcagcgcaaaagatg

SEQ ID NO: 160163 - DNA, 103 bp, Artificial Sequence
  Synthetic Polynucleotide
taatacgactcactatagggggcttgggtgaggtccttgacattccctgaaacagaggagatcagggatggtcaaggacaacctggcggcagcgcaaaagatg

SEQ ID NO: 160164 - DNA, 103 bp, Artificial Sequence
  Synthetic Polynucleotide
taatacgactcactatagggagaggtcccaggcttgggtgaggtccttgaaacagaggagatcaaggatgtcacccaagaacctggcggcagcgcaaaagatg

SEQ ID NO: 160165 - DNA, 103 bp, Artificial Sequence
  Synthetic Polynucleotide
taatacgactcactatagggagacaggcacgaagggcggctacagctcccaacagaggagagggagcatgagccgccctaacctggcggcagcgcaaaagatg

SEQ ID NO: 160166 - DNA, 103 bp, Artificial Sequence
  Synthetic Polynucleotide
taatacgactcactatagggacatgataatagaggtcccaggcttgggtgaacagaggagacacccaatgctgggacctaacctggcggcagcgcaaaagatg

SEQ ID NO: 160167 - DNA, 103 bp, Artificial Sequence
  Synthetic Polynucleotide
taatacgactcactatagggtcgtcggaacacatgataatagaggtcccaaacagaggagatgggacatgtattatcataacctggcggcagcgcaaaagatg

SEQ ID NO: 160168 - DNA, 103 bp, Artificial Sequence
  Synthetic Polynucleotide
taatacgactcactataggggctttgagattcgtcggaacacatgataataacagaggagaattatcatgtgttccgacaacctggcggcagcgcaaaagatg

SEQ ID NO: 160169 - DNA, 103 bp, Artificial Sequence
  Synthetic Polynucleotide
taatacgactcactatagggtgaggcagctgctttgagattcgtcggaacaacagaggagagttccgatgaatctcaaaaacctggcggcagcgcaaaagatg

SEQ ID NO: 160170 - DNA, 103 bp, Artificial Sequence
  Synthetic Polynucleotide
taatacgactcactatagggggatgtgagctgaggcagctgctttgagataacagaggagaatctcaatgcagctgcctaacctggcggcagcgcaaaagatg

SEQ ID NO: 160171 - DNA, 103 bp, Artificial Sequence
  Synthetic Polynucleotide
taatacgactcactataggggcagctctaaggatgtgagctgaggcagctaacagaggagaagctgcatgagctcacataacctggcggcagcgcaaaagatg

SEQ ID NO: 160172 - DNA, 103 bp, Artificial Sequence
  Synthetic Polynucleotide
taatacgactcactataggggaaacatattgcagctctaaggatgtgagcaacagaggagagctcacatgcttagagctaacctggcggcagcgcaaaagatg

SEQ ID NO: 160173 - DNA, 103 bp, Artificial Sequence
  Synthetic Polynucleotide
taatacgactcactatagggaagttttggggaaacatattgcagctctaaaacagaggagattagagatgcaatatgttaacctggcggcagcgcaaaagatg

SEQ ID NO: 160174 - DNA, 103 bp, Artificial Sequence
  Synthetic Polynucleotide
taatacgactcactatagggggcacatcagaagttttggggaaacatattaacagaggagaaatatgatgccccaaaacaacctggcggcagcgcaaaagatg

SEQ ID NO: 160175 - DNA, 103 bp, Artificial Sequence
  Synthetic Polynucleotide
taatacgactcactatagggtcaaggtcccggcacatcagaagttttgggaacagaggagacccaaaatgtctgatgtgaacctggcggcagcgcaaaagatg

SEQ ID NO: 160176 - DNA, 103 bp, Artificial Sequence
  Synthetic Polynucleotide
taatacgactcactatagggtgtgagaatcagacaggcacgaagggcggcaacagaggagagccgccatgcgtgcctgtaacctggcggcagcgcaaaagatg

SEQ ID NO: 160177 - DNA, 103 bp, Artificial Sequence
  Synthetic Polynucleotide
taatacgactcactatagggcacagccaattcaaggtcccggcacatcagaacagaggagactgatgatgcgggaccttaacctggcggcagcgcaaaagatg

SEQ ID NO: 160178 - DNA, 103 bp, Artificial Sequence
  Synthetic Polynucleotide
taatacgactcactatagggatgttcctggcacagccaattcaaggtcccaacagaggagagggaccatgaattggctgaacctggcggcagcgcaaaagatg

SEQ ID NO: 160179 - DNA, 103 bp, Artificial Sequence
  Synthetic Polynucleotide
taatacgactcactatagggttggggtcatatgttcctggcacagccaataacagaggagaattggcatggccaggaacaacctggcggcagcgcaaaagatg

SEQ ID NO: 160180 - DNA, 103 bp, Artificial Sequence
  Synthetic Polynucleotide
taatacgactcactataggggattggctggttggggtcatatgttcctggaacagaggagaccaggaatgtatgaccccaacctggcggcagcgcaaaagatg

SEQ ID NO: 160181 - DNA, 103 bp, Artificial Sequence
  Synthetic Polynucleotide
taatacgactcactataggggaatgcgaatgattggctggttggggtcataacagaggagaatgaccatgaccagccaaaacctggcggcagcgcaaaagatg

SEQ ID NO: 160182 - DNA, 103 bp, Artificial Sequence
  Synthetic Polynucleotide
taatacgactcactataggggctatggactgaatgcgaatgattggctggaacagaggagaccagccatgcattcgcataacctggcggcagcgcaaaagatg

SEQ ID NO: 160183 - DNA, 103 bp, Artificial Sequence
  Synthetic Polynucleotide
taatacgactcactatagggcaaagacggtgctatggactgaatgcgaataacagaggagaattcgcatgcagtccataaacctggcggcagcgcaaaagatg

SEQ ID NO: 160184 - DNA, 103 bp, Artificial Sequence
  Synthetic Polynucleotide
taatacgactcactatagggtgatgacttgcaaagacggtgctatggactaacagaggagaagtccaatgcaccgtcttaacctggcggcagcgcaaaagatg

SEQ ID NO: 160185 - DNA, 103 bp, Artificial Sequence
  Synthetic Polynucleotide
taatacgactcactatagggtgcttggatgtgatgacttgcaaagacggtaacagaggagaaccgtcatggcaagtcataacctggcggcagcgcaaaagatg

SEQ ID NO: 160186 - DNA, 103 bp, Artificial Sequence
  Synthetic Polynucleotide
taatacgactcactatagggccggggcctctgcttggatgtgatgacttgaacagaggagacaagtcatgacatccaagaacctggcggcagcgcaaaagatg

SEQ ID NO: 160187 - DNA, 103 bp, Artificial Sequence
  Synthetic Polynucleotide
taatacgactcactatagggcacgctgggttgtgagaatcagacaggcacaacagaggagagtgcctatgtgattctcaaacctggcggcagcgcaaaagatg

SEQ ID NO: 160188 - DNA, 103 bp, Artificial Sequence
  Synthetic Polynucleotide
taatacgactcactataggggtgtcaatttccggggcctctgcttggatgaacagaggagacatccaatgagaggccccaacctggcggcagcgcaaaagatg

SEQ ID NO: 160189 - DNA, 103 bp, Artificial Sequence
  Synthetic Polynucleotide
taatacgactcactatagggctgcccataagtgtcaatttccggggcctcaacagaggagagaggccatggaaattgacaacctggcggcagcgcaaaagatg

SEQ ID NO: 160190 - DNA, 103 bp, Artificial Sequence
  Synthetic Polynucleotide
taatacgactcactatagggatgtccgttgctgcccataagtgtcaatttaacagaggagaaaattgatgcttatgggcaacctggcggcagcgcaaaagatg

SEQ ID NO: 160191 - DNA, 103 bp, Artificial Sequence
  Synthetic Polynucleotide
taatacgactcactatagggaaacaaactcatgtccgttgctgcccataaaacagaggagattatggatggcaacggacaacctggcggcagcgcaaaagatg

SEQ ID NO: 160192 - DNA, 103 bp, Artificial Sequence
  Synthetic Polynucleotide
taatacgactcactatagggtttagaaggaaaacaaactcatgtccgttgaacagaggagacaacggatgtgagtttgtaacctggcggcagcgcaaaagatg

SEQ ID NO: 160193 - DNA, 103 bp, Artificial Sequence
  Synthetic Polynucleotide
taatacgactcactatagggttcatggccttttagaaggaaaacaaactcaacagaggagagagtttatgttccttctaaacctggcggcagcgcaaaagatg

SEQ ID NO: 160194 - DNA, 103 bp, Artificial Sequence
  Synthetic Polynucleotide
taatacgactcactatagggggcgcagatcttcatggccttttagaaggaaacagaggagatccttcatgaaggccatgaacctggcggcagcgcaaaagatg

SEQ ID NO: 160195 - DNA, 103 bp, Artificial Sequence
  Synthetic Polynucleotide
taatacgactcactatagggcgctcatcctggcgcagatcttcatggcctaacagaggagaaggccaatgagatctgcgaacctggcggcagcgcaaaagatg

SEQ ID NO: 160196 - DNA, 103 bp, Artificial Sequence
  Synthetic Polynucleotide
taatacgactcactatagggctgcatcacacgctcatcctggcgcagatcaacagaggagagatctgatgcaggatgagaacctggcggcagcgcaaaagatg

SEQ ID NO: 160197 - DNA, 103 bp, Artificial Sequence
  Synthetic Polynucleotide
taatacgactcactatagggggccgaagagctgcatcacacgctcatcctaacagaggagaaggatgatggtgtgatgcaacctggcggcagcgcaaaagatg

SEQ ID NO: 160198 - DNA, 103 bp, Artificial Sequence
  Synthetic Polynucleotide
taatacgactcactatagggtccttcggctcacgctgggttgtgagaatcaacagaggagagattctatgaacccagcgaacctggcggcagcgcaaaagatg

SEQ ID NO: 160199 - DNA, 103 bp, Artificial Sequence
  Synthetic Polynucleotide
taatacgactcactataggggtgttaaccaggccgaagagctgcatcacaaacagaggagatgtgatatggctcttcggaacctggcggcagcgcaaaagatg

SEQ ID NO: 160200 - DNA, 103 bp, Artificial Sequence
  Synthetic Polynucleotide
taatacgactcactatagggggccagaagggtgttaaccaggccgaagagaacagaggagactcttcatgctggttaacaacctggcggcagcgcaaaagatg

SEQ ID NO: 160201 - DNA, 103 bp, Artificial Sequence
  Synthetic Polynucleotide
taatacgactcactatagggttgggtcattggccagaagggtgttaaccaaacagaggagatggttaatgcccttctggaacctggcggcagcgcaaaagatg

SEQ ID NO: 160202 - DNA, 103 bp, Artificial Sequence
  Synthetic Polynucleotide
taatacgactcactatagggcgaagagatgttgggtcattggccagaaggaacagaggagaccttctatgcaatgacccaacctggcggcagcgcaaaagatg

SEQ ID NO: 160203 - DNA, 103 bp, Artificial Sequence
  Synthetic Polynucleotide
taatacgactcactataggggaggtttttccgaagagatgttgggtcattaacagaggagaaatgacatgacatctcttaacctggcggcagcgcaaaagatg

SEQ ID NO: 160204 - DNA, 103 bp, Artificial Sequence
  Synthetic Polynucleotide
taatacgactcactatagggtctggatgctgaggtttttccgaagagatgaacagaggagacatctcatgggaaaaaccaacctggcggcagcgcaaaagatg

SEQ ID NO: 160205 - DNA, 103 bp, Artificial Sequence
  Synthetic Polynucleotide
taatacgactcactatagggacagcgtatctctggatgctgaggtttttcaacagaggagagaaaaaatgcagcatccaaacctggcggcagcgcaaaagatg

SEQ ID NO: 160206 - DNA, 103 bp, Artificial Sequence
  Synthetic Polynucleotide
taatacgactcactatagggtaaagggatgacagcgtatctctggatgctaacagaggagaagcatcatgagatacgctaacctggcggcagcgcaaaagatg

SEQ ID NO: 160207 - DNA, 103 bp, Artificial Sequence
  Synthetic Polynucleotide
taatacgactcactatagggagttggtcgataaagggatgacagcgtatcaacagaggagagatacgatgtcatcccttaacctggcggcagcgcaaaagatg

SEQ ID NO: 160208 - DNA, 103 bp, Artificial Sequence
  Synthetic Polynucleotide
taatacgactcactatagggatgaggcccgagttggtcgataaagggatgaacagaggagacatcccatgatcgaccaaaacctggcggcagcgcaaaagatg

SEQ ID NO: 160209 - DNA, 103 bp, Artificial Sequence
  Synthetic Polynucleotide
taatacgactcactatagggcttctgcatctccttcggctcacgctgggtaacagaggagaacccagatggagccgaagaacctggcggcagcgcaaaagatg

SEQ ID NO: 160210 - DNA, 103 bp, Artificial Sequence
  Synthetic Polynucleotide
taatacgactcactatagggaacccagccaatgaggcccgagttggtcgaaacagaggagatcgaccatgtcgggcctcaacctggcggcagcgcaaaagatg

SEQ ID NO: 160211 - DNA, 103 bp, Artificial Sequence
  Synthetic Polynucleotide
taatacgactcactatagggcacagtggggaacccagccaatgaggcccgaacagaggagacgggccatgttggctgggaacctggcggcagcgcaaaagatg

SEQ ID NO: 160212 - DNA, 103 bp, Artificial Sequence
  Synthetic Polynucleotide
taatacgactcactatagggtgcagtgtgtcacagtggggaacccagccaaacagaggagatggctgatgtccccactgaacctggcggcagcgcaaaagatg

SEQ ID NO: 160213 - DNA, 103 bp, Artificial Sequence
  Synthetic Polynucleotide
taatacgactcactataggggatgagggcgtgcagtgtgtcacagtggggaacagaggagaccccacatggacacactgaacctggcggcagcgcaaaagatg

SEQ ID NO: 160214 - DNA, 103 bp, Artificial Sequence
  Synthetic Polynucleotide
taatacgactcactatagggtgtagtcccggatgagggcgtgcagtgtgtaacagaggagaacacacatgacgccctcaaacctggcggcagcgcaaaagatg

SEQ ID NO: 160215 - DNA, 103 bp, Artificial Sequence
  Synthetic Polynucleotide
taatacgactcactatagggttcttctccctgtagtcccggatgagggcgaacagaggagacgccctatgccgggactaaacctggcggcagcgcaaaagatg

SEQ ID NO: 160216 - DNA, 103 bp, Artificial Sequence
  Synthetic Polynucleotide
taatacgactcactatagggaaggatcttcttcttctccctgtagtcccgaacagaggagacgggacatgagggagaagaacctggcggcagcgcaaaagatg

SEQ ID NO: 160217 - DNA, 103 bp, Artificial Sequence
  Synthetic Polynucleotide
taatacgactcactatagggcgatgttgagaaggatcttcttcttctcccaacagaggagagggagaatgagaagatccaacctggcggcagcgcaaaagatg

SEQ ID NO: 160218 - DNA, 103 bp, Artificial Sequence
  Synthetic Polynucleotide
taatacgactcactatagggatgcgatgctcgatgttgagaaggatcttcaacagaggagagaagatatgtctcaacataacctggcggcagcgcaaaagatg

SEQ ID NO: 160219 - DNA, 103 bp, Artificial Sequence
  Synthetic Polynucleotide
taatacgactcactatagggccgcaacatgatgcgatgctcgatgttgagaacagaggagactcaacatggagcatcgcaacctggcggcagcgcaaaagatg

SEQ ID NO: 160220 - DNA, 103 bp, Artificial Sequence
  Synthetic Polynucleotide
taatacgactcactatagggaccactgaggcttctgcatctccttcggctaacagaggagaagccgaatgagatgcagaaacctggcggcagcgcaaaagatg

SEQ ID NO: 160221 - DNA, 103 bp, Artificial Sequence
  Synthetic Polynucleotide
taatacgactcactatagggccggagccatccgcaacatgatgcgatgctaacagaggagaagcatcatgtcatgttgcaacctggcggcagcgcaaaagatg

SEQ ID NO: 160222 - DNA, 103 bp, Artificial Sequence
  Synthetic Polynucleotide
taatacgactcactatagggtggtcatagtccggagccatccgcaacatgaacagaggagacatgttatggatggctccaacctggcggcagcgcaaaagatg

SEQ ID NO: 160223 - DNA, 103 bp, Artificial Sequence
  Synthetic Polynucleotide
taatacgactcactatagggcagagtcaagtggtcatagtccggagccataacagaggagaatggctatggactatgacaacctggcggcagcgcaaaagatg

SEQ ID NO: 160224 - DNA, 103 bp, Artificial Sequence
  Synthetic Polynucleotide
taatacgactcactatagggccttctgcatcagagtcaagtggtcatagtaacagaggagaactatgatgacttgactcaacctggcggcagcgcaaaagatg

SEQ ID NO: 160225 - DNA, 103 bp, Artificial Sequence
  Synthetic Polynucleotide
taatacgactcactatagggaacacctccaccttctgcatcagagtcaagaacagaggagacttgacatggatgcagaaaacctggcggcagcgcaaaagatg

SEQ ID NO: 160226 - DNA, 103 bp, Artificial Sequence
  Synthetic Polynucleotide
taatacgactcactatagggggcatgctcaaacacctccaccttctgcataacagaggagaatgcagatggtggaggtgaacctggcggcagcgcaaaagatg

SEQ ID NO: 160227 - DNA, 103 bp, Artificial Sequence
  Synthetic Polynucleotide
taatacgactcactatagggtattattgacggcatgctcaaacacctccaaacagaggagatggaggatgttgagcatgaacctggcggcagcgcaaaagatg

SEQ ID NO: 160228 - DNA, 103 bp, Artificial Sequence
  Synthetic Polynucleotide
taatacgactcactatagggtccccagctgtattattgacggcatgctcaaacagaggagatgagcaatgcgtcaataaaacctggcggcagcgcaaaagatg

SEQ ID NO: 160229 - DNA, 103 bp, Artificial Sequence
  Synthetic Polynucleotide
taatacgactcactatagggggccaggtcgtccccagctgtattattgacaacagaggagagtcaatatgacagctgggaacctggcggcagcgcaaaagatg

SEQ ID NO: 160230 - DNA, 103 bp, Artificial Sequence
  Synthetic Polynucleotide
taatacgactcactatagggacagcagcttggccaggtcgtccccagctgaacagaggagacagctgatgacgacctggaacctggcggcagcgcaaaagatg

SEQ ID NO: 160231 - DNA, 103 bp, Artificial Sequence
  Synthetic Polynucleotide
taatacgactcactataggggtgtgcctgtaccactgaggcttctgcatcaacagaggagagatgcaatggcctcagtgaacctggcggcagcgcaaaagatg

SEQ ID NO: 160232 - DNA, 103 bp, Artificial Sequence
  Synthetic Polynucleotide
taatacgactcactatagggcttttcagccacagcagcttggccaggtcgaacagaggagacgacctatgcaagctgctaacctggcggcagcgcaaaagatg

SEQ ID NO: 160233 - DNA, 103 bp, Artificial Sequence
  Synthetic Polynucleotide
taatacgactcactatagggggagctggggcttttcagccacagcagcttaacagaggagaaagctgatgtggctgaaaaacctggcggcagcgcaaaagatg

SEQ ID NO: 160234 - DNA, 103 bp, Artificial Sequence
  Synthetic Polynucleotide
taatacgactcactatagggaccacacctcggagctggggcttttcagccaacagaggagaggctgaatggccccagctaacctggcggcagcgcaaaagatg

SEQ ID NO: 160235 - DNA, 103 bp, Artificial Sequence
  Synthetic Polynucleotide
taatacgactcactatagggcttcggtcaaaccacacctcggagctggggaacagaggagaccccagatgcgaggtgtgaacctggcggcagcgcaaaagatg

SEQ ID NO: 160236 - DNA, 103 bp, Artificial Sequence
  Synthetic Polynucleotide
taatacgactcactatagggataattggttcttcggtcaaaccacacctcaacagaggagagaggtgatgtttgaccgaaacctggcggcagcgcaaaagatg

SEQ ID NO: 160237 - DNA, 103 bp, Artificial Sequence
  Synthetic Polynucleotide
taatacgactcactatagggaagaacgggtataattggttcttcggtcaaaacagaggagattgaccatggaaccaattaacctggcggcagcgcaaaagatg

SEQ ID NO: 160238 - DNA, 103 bp, Artificial Sequence
  Synthetic Polynucleotide
taatacgactcactatagggatgaccgctaaagaacgggtataattggttaacagaggagaaaccaaatgtacccgttcaacctggcggcagcgcaaaagatg

SEQ ID NO: 160239 - DNA, 103 bp, Artificial Sequence
  Synthetic Polynucleotide
taatacgactcactatagggaaccattgacatgaccgctaaagaacgggtaacagaggagaacccgtatgttagcggtcaacctggcggcagcgcaaaagatg

SEQ ID NO: 160240 - DNA, 103 bp, Artificial Sequence
  Synthetic Polynucleotide
taatacgactcactatagggaaatatacccaaccattgacatgaccgctaaacagaggagatagcggatgtgtcaatggaacctggcggcagcgcaaaagatg

SEQ ID NO: 160241 - DNA, 103 bp, Artificial Sequence
  Synthetic Polynucleotide
taatacgactcactatagggcccaggcctaaaatatacccaaccattgacaacagaggagagtcaatatgtgggtatataacctggcggcagcgcaaaagatg

SEQ ID NO: 160242 - DNA, 103 bp, Artificial Sequence
  Synthetic Polynucleotide
taatacgactcactatagggctttaggccactggcaaactgctgcaggacaacagaggagagtcctgatgcagtttgccaacctggcggcagcgcaaaagatg

SEQ ID NO: 160243 - DNA, 103 bp, Artificial Sequence
  Synthetic Polynucleotide
taatacgactcactatagggttcttcaaatgtgtgcctgtaccactgaggaacagaggagacctcagatgtacaggcacaacctggcggcagcgcaaaagatg

SEQ ID NO: 160244 - DNA, 103 bp, Artificial Sequence
  Synthetic Polynucleotide
taatacgactcactataggggtgtctatctcccaggcctaaaatatacccaacagaggagagggtatatgttaggcctgaacctggcggcagcgcaaaagatg

SEQ ID NO: 160245 - DNA, 103 bp, Artificial Sequence
  Synthetic Polynucleotide
taatacgactcactatagggggttggatgggtgtctatctcccaggcctaaacagaggagataggccatggagatagacaacctggcggcagcgcaaaagatg

SEQ ID NO: 160246 - DNA, 103 bp, Artificial Sequence
  Synthetic Polynucleotide
taatacgactcactatagggtccagcatcaggttggatgggtgtctatctaacagaggagaagatagatgcccatccaaaacctggcggcagcgcaaaagatg

SEQ ID NO: 160247 - DNA, 103 bp, Artificial Sequence
  Synthetic Polynucleotide
taatacgactcactatagggactcagacggtccagcatcaggttggatggaacagaggagaccatccatgctgatgctgaacctggcggcagcgcaaaagatg

SEQ ID NO: 160248 - DNA, 103 bp, Artificial Sequence
  Synthetic Polynucleotide
taatacgactcactatagggggatcttcccactcagacggtccagcatcaaacagaggagatgatgcatgaccgtctgaaacctggcggcagcgcaaaagatg

SEQ ID NO: 160249 - DNA, 103 bp, Artificial Sequence
  Synthetic Polynucleotide
taatacgactcactatagggtcaatgtgcaggatcttcccactcagacggaacagaggagaccgtctatgtgggaagataacctggcggcagcgcaaaagatg

SEQ ID NO: 160250 - DNA, 103 bp, Artificial Sequence
  Synthetic Polynucleotide
taatacgactcactataggggtccccaaagtcaatgtgcaggatcttcccaacagaggagagggaagatgctgcacattaacctggcggcagcgcaaaagatg

SEQ ID NO: 160251 - DNA, 103 bp, Artificial Sequence
  Synthetic Polynucleotide
taatacgactcactatagggcctcaaagcagtccccaaagtcaatgtgcaaacagaggagatgcacaatgactttggggaacctggcggcagcgcaaaagatg

SEQ ID NO: 160252 - DNA, 103 bp, Artificial Sequence
  Synthetic Polynucleotide
taatacgactcactataggggtcatagcaacctcaaagcagtccccaaagaacagaggagactttggatgctgctttgaaacctggcggcagcgcaaaagatg

SEQ ID NO: 160253 - DNA, 103 bp, Artificial Sequence
  Synthetic Polynucleotide
taatacgactcactatagggcttctctcgggtcatagcaacctcaaagcaaacagaggagatgctttatggttgctatgaacctggcggcagcgcaaaagatg

SEQ ID NO: 160254 - DNA, 103 bp, Artificial Sequence
  Synthetic Polynucleotide
taatacgactcactatagggccttctctgcttcttcaaatgtgtgcctgtaacagaggagaacaggcatgcatttgaagaacctggcggcagcgcaaaagatg

SEQ ID NO: 160255 - DNA, 103 bp, Artificial Sequence
  Synthetic Polynucleotide
taatacgactcactatagggtctctggaaacttctctcgggtcatagcaaaacagaggagattgctaatgcccgagagaaacctggcggcagcgcaaaagatg

SEQ ID NO: 160256 - DNA, 103 bp, Artificial Sequence
  Synthetic Polynucleotide
taatacgactcactatagggaatggaatcttctctggaaacttctctcggaacagaggagaccgagaatggtttccagaaacctggcggcagcgcaaaagatg

SEQ ID NO: 160257 - DNA, 103 bp, Artificial Sequence
  Synthetic Polynucleotide
taatacgactcactatagggtgttagtctaaatggaatcttctctggaaaaacagaggagatttccaatgaagattccaaacctggcggcagcgcaaaagatg

SEQ ID NO: 160258 - DNA, 103 bp, Artificial Sequence
  Synthetic Polynucleotide
taatacgactcactatagggtcaacattcttgttagtctaaatggaatctaacagaggagaagattcatgttagactaaaacctggcggcagcgcaaaagatg

SEQ ID NO: 160259 - DNA, 103 bp, Artificial Sequence
  Synthetic Polynucleotide
taatacgactcactatagggatagcattggtcaacattcttgttagtctaaacagaggagatagactatgaagaatgttaacctggcggcagcgcaaaagatg

SEQ ID NO: 160260 - DNA, 103 bp, Artificial Sequence
  Synthetic Polynucleotide
taatacgactcactatagggtgtaacctccatagcattggtcaacattctaacagaggagaagaatgatgaccaatgctaacctggcggcagcgcaaaagatg

SEQ ID NO: 160261 - DNA, 103 bp, Artificial Sequence
  Synthetic Polynucleotide
taatacgactcactatagggcatccaggcctgtaacctccatagcattggaacagaggagaccaatgatgtggaggttaaacctggcggcagcgcaaaagatg

SEQ ID NO: 160262 - DNA, 103 bp, Artificial Sequence
  Synthetic Polynucleotide
taatacgactcactatagggctgtagttgccatccaggcctgtaacctccaacagaggagaggaggtatgaggcctggaaacctggcggcagcgcaaaagatg

SEQ ID NO: 160263 - DNA, 103 bp, Artificial Sequence
  Synthetic Polynucleotide
taatacgactcactataggggcatgtgattctgtagttgccatccaggccaacagaggagaggcctgatgggcaactacaacctggcggcagcgcaaaagatg

SEQ ID NO: 160264 - DNA, 103 bp, Artificial Sequence
  Synthetic Polynucleotide
taatacgactcactatagggtcactgtgtggcatgtgattctgtagttgcaacagaggagagcaactatggaatcacataacctggcggcagcgcaaaagatg

SEQ ID NO: 160265 - DNA, 103 bp, Artificial Sequence
  Synthetic Polynucleotide
taatacgactcactatagggtcatcaaatcccttctctgcttcttcaaataacagaggagaatttgaatgagcagagaaaacctggcggcagcgcaaaagatg

SEQ ID NO: 160266 - DNA, 103 bp, Artificial Sequence
  Synthetic Polynucleotide
taatacgactcactatagggagcacctccatcactgtgtggcatgtgattaacagaggagaaatcacatgccacacagtaacctggcggcagcgcaaaagatg

SEQ ID NO: 160267 - DNA, 103 bp, Artificial Sequence
  Synthetic Polynucleotide
taatacgactcactataggggtgctctcgcagcacctccatcactgtgtgaacagaggagacacacaatgatggaggtgaacctggcggcagcgcaaaagatg

SEQ ID NO: 160268 - DNA, 103 bp, Artificial Sequence
  Synthetic Polynucleotide
taatacgactcactatagggcactgtccttgtgctctcgcagcacctccaaacagaggagatggaggatgtgcgagagcaacctggcggcagcgcaaaagatg

SEQ ID NO: 160269 - DNA, 103 bp, Artificial Sequence
  Synthetic Polynucleotide
taatacgactcactatagggacggccatgacactgtccttgtgctctcgcaacagaggagagcgagaatgcaaggacagaacctggcggcagcgcaaaagatg

SEQ ID NO: 160270 - DNA, 103 bp, Artificial Sequence
  Synthetic Polynucleotide
taatacgactcactatagggggcttccagcacggccatgacactgtccttaacagaggagaaaggacatggtcatggccaacctggcggcagcgcaaaagatg

SEQ ID NO: 160271 - DNA, 103 bp, Artificial Sequence
  Synthetic Polynucleotide
taatacgactcactatagggcatagacaaaggcttccagcacggccatgaaacagaggagatcatggatgtgctggaagaacctggcggcagcgcaaaagatg

SEQ ID NO: 160272 - DNA, 103 bp, Artificial Sequence
  Synthetic Polynucleotide
taatacgactcactatagggagcaaggggtcatagacaaaggcttccagcaacagaggagagctggaatgctttgtctaaacctggcggcagcgcaaaagatg

SEQ ID NO: 160273 - DNA, 103 bp, Artificial Sequence
  Synthetic Polynucleotide
taatacgactcactatagggcctccagttcagcaaggggtcatagacaaaaacagaggagatttgtcatggaccccttgaacctggcggcagcgcaaaagatg

SEQ ID NO: 160274 - DNA, 103 bp, Artificial Sequence
  Synthetic Polynucleotide
taatacgactcactatagggtgtccatcagcctccagttcagcaaggggtaacagaggagaacccctatgtgaactggaaacctggcggcagcgcaaaagatg

SEQ ID NO: 160275 - DNA, 103 bp, Artificial Sequence
  Synthetic Polynucleotide
taatacgactcactatagggttggtatttgtgtccatcagcctccagttcaacagaggagagaactgatggctgatggaaacctggcggcagcgcaaaagatg

SEQ ID NO: 160276 - DNA, 103 bp, Artificial Sequence
  Synthetic Polynucleotide
taatacgactcactatagggggccaaggtctcatcaaatcccttctctgcaacagaggagagcagagatgggatttgataacctggcggcagcgcaaaagatg

SEQ ID NO: 160277 - DNA, 103 bp, Artificial Sequence
  Synthetic Polynucleotide
taatacgactcactatagggcttgttgcctttggtatttgtgtccatcagaacagaggagactgatgatgacaaataccaacctggcggcagcgcaaaagatg

SEQ ID NO: 160278 - DNA, 103 bp, Artificial Sequence
  Synthetic Polynucleotide
taatacgactcactatagggttcgggatcgcttgttgcctttggtatttgaacagaggagacaaataatgaaggcaacaaacctggcggcagcgcaaaagatg

SEQ ID NO: 160279 - DNA, 103 bp, Artificial Sequence
  Synthetic Polynucleotide
taatacgactcactatagggtccgtcctcgttcgggatcgcttgttgcctaacagaggagaaggcaaatggcgatcccgaacctggcggcagcgcaaaagatg

SEQ ID NO: 160280 - DNA, 103 bp, Artificial Sequence
  Synthetic Polynucleotide
taatacgactcactatagggagagtaggaatccgtcctcgttcgggatcgaacagaggagacgatccatgacgaggacgaacctggcggcagcgcaaaagatg

SEQ ID NO: 160281 - DNA, 103 bp, Artificial Sequence
  Synthetic Polynucleotide
taatacgactcactatagggactggccagcagagtaggaatccgtcctcgaacagaggagacgaggaatgattcctactaacctggcggcagcgcaaaagatg

SEQ ID NO: 160282 - DNA, 103 bp, Artificial Sequence
  Synthetic Polynucleotide
taatacgactcactatagggatttcgactgactggccagcagagtaggaaaacagaggagattcctaatgtgctggccaaacctggcggcagcgcaaaagatg

SEQ ID NO: 160283 - DNA, 103 bp, Artificial Sequence
  Synthetic Polynucleotide
taatacgactcactatagggaccgtccaaaatttcgactgactggccagcaacagaggagagctggcatgtcagtcgaaaacctggcggcagcgcaaaagatg

SEQ ID NO: 160284 - DNA, 103 bp, Artificial Sequence
  Synthetic Polynucleotide
taatacgactcactatagggcaagttccacaccgtccaaaatttcgactgaacagaggagacagtcgatgttttggacgaacctggcggcagcgcaaaagatg

SEQ ID NO: 160285 - DNA, 103 bp, Artificial Sequence
  Synthetic Polynucleotide
taatacgactcactataggggctggctctccaagttccacaccgtccaaaaacagaggagatttggaatgtgtggaactaacctggcggcagcgcaaaagatg

SEQ ID NO: 160286 - DNA, 103 bp, Artificial Sequence
  Synthetic Polynucleotide
taatacgactcactatagggtttcttatgggctggctctccaagttccacaacagaggagagtggaaatgggagagccaaacctggcggcagcgcaaaagatg

SEQ ID NO: 160287 - DNA, 103 bp, Artificial Sequence
  Synthetic Polynucleotide
taatacgactcactatagggccttctctttggccaaggtctcatcaaatcaacagaggagagatttgatgagaccttggaacctggcggcagcgcaaaagatg

SEQ ID NO: 160288 - DNA, 103 bp, Artificial Sequence
  Synthetic Polynucleotide
taatacgactcactatagggtggtccccgttttcttatgggctggctctcaacagaggagagagagcatgcccataagaaacctggcggcagcgcaaaagatg

SEQ ID NO: 160289 - DNA, 103 bp, Artificial Sequence
  Synthetic Polynucleotide
taatacgactcactatagggtctggcactgtggtccccgttttcttatggaacagaggagaccataaatgaacggggacaacctggcggcagcgcaaaagatg

SEQ ID NO: 160290 - DNA, 103 bp, Artificial Sequence
  Synthetic Polynucleotide
taatacgactcactatagggatgaatagattctggcactgtggtccccgtaacagaggagaacggggatgacagtgccaaacctggcggcagcgcaaaagatg

SEQ ID NO: 160291 - DNA, 103 bp, Artificial Sequence
  Synthetic Polynucleotide
taatacgactcactatagggcaatgaaagaatgaatagattctggcactgaacagaggagacagtgcatgaatctattcaacctggcggcagcgcaaaagatg

SEQ ID NO: 160292 - DNA, 103 bp, Artificial Sequence
  Synthetic Polynucleotide
taatacgactcactatagggaaaccgtctccaatgaaagaatgaatagataacagaggagaatctatatgttctttcataacctggcggcagcgcaaaagatg

SEQ ID NO: 160293 - DNA, 103 bp, Artificial Sequence
  Synthetic Polynucleotide
taatacgactcactatagggtggtttcaccaaaccgtctccaatgaaagaaacagaggagatctttcatgggagacggtaacctggcggcagcgcaaaagatg

SEQ ID NO: 160294 - DNA, 103 bp, Artificial Sequence
  Synthetic Polynucleotide
taatacgactcactatagggttagggcctctggtttcaccaaaccgtctcaacagaggagagagacgatgtggtgaaacaacctggcggcagcgcaaaagatg

SEQ ID NO: 160295 - DNA, 103 bp, Artificial Sequence
  Synthetic Polynucleotide
taatacgactcactataggggctttcttatttagggcctctggtttcaccaacagaggagaggtgaaatgagaggccctaacctggcggcagcgcaaaagatg

SEQ ID NO: 160296 - DNA, 103 bp, Artificial Sequence
  Synthetic Polynucleotide
taatacgactcactatagggaatctggatagctttcttatttagggcctcaacagaggagagaggccatgaataagaaaaacctggcggcagcgcaaaagatg

SEQ ID NO: 160297 - DNA, 103 bp, Artificial Sequence
  Synthetic Polynucleotide
taatacgactcactatagggccctgttaataatctggatagctttcttataacagaggagaataagaatgctatccagaaacctggcggcagcgcaaaagatg

SEQ ID NO: 160298 - DNA, 103 bp, Artificial Sequence
  Synthetic Polynucleotide
taatacgactcactatagggcgattcatgcccttctctttggccaaggtcaacagaggagagaccttatgcaaagagaaaacctggcggcagcgcaaaagatg

SEQ ID NO: 160299 - DNA, 103 bp, Artificial Sequence
  Synthetic Polynucleotide
taatacgactcactatagggttatctcgaaccctgttaataatctggataaacagaggagatatccaatgtattaacagaacctggcggcagcgcaaaagatg

SEQ ID NO: 160300 - DNA, 103 bp, Artificial Sequence
  Synthetic Polynucleotide
taatacgactcactatagggaccagtgagcttatctcgaaccctgttaataacagaggagaattaacatggttcgagataacctggcggcagcgcaaaagatg

SEQ ID NO: 160301 - DNA, 103 bp, Artificial Sequence
  Synthetic Polynucleotide
taatacgactcactatagggagaagtcccgaccagtgagcttatctcgaaaacagaggagattcgagatgagctcactgaacctggcggcagcgcaaaagatg

SEQ ID NO: 160302 - DNA, 103 bp, Artificial Sequence
  Synthetic Polynucleotide
taatacgactcactatagggtcatcatgagagaagtcccgaccagtgagcaacagaggagagctcacatgtcgggacttaacctggcggcagcgcaaaagatg

SEQ ID NO: 160303 - DNA, 103 bp, Artificial Sequence
  Synthetic Polynucleotide
taatacgactcactatagggatccaaagtgtcatcatgagagaagtcccgaacagaggagacgggacatgtctcatgataacctggcggcagcgcaaaagatg

SEQ ID NO: 160304 - DNA, 103 bp, Artificial Sequence
  Synthetic Polynucleotide
taatacgactcactataggggcgttggaacatccaaagtgtcatcatgagaacagaggagactcatgatgacactttggaacctggcggcagcgcaaaagatg

SEQ ID NO: 160305 - DNA, 103 bp, Artificial Sequence
  Synthetic Polynucleotide
taatacgactcactatagggagctcaacttgcgttggaacatccaaagtgaacagaggagacactttatgtgttccaacaacctggcggcagcgcaaaagatg

SEQ ID NO: 160306 - DNA, 103 bp, Artificial Sequence
  Synthetic Polynucleotide
taatacgactcactatagggtttgatgagcagctcaacttgcgttggaacaacagaggagagttccaatgcaagttgagaacctggcggcagcgcaaaagatg

SEQ ID NO: 160307 - DNA, 103 bp, Artificial Sequence
  Synthetic Polynucleotide
taatacgactcactatagggatgtcgcttgtttgatgagcagctcaacttaacagaggagaaagttgatgtgctcatcaaacctggcggcagcgcaaaagatg

SEQ ID NO: 160308 - DNA, 103 bp, Artificial Sequence
  Synthetic Polynucleotide
taatacgactcactatagggttttcatgggatgtcgcttgtttgatgagcaacagaggagagctcatatgacaagcgacaacctggcggcagcgcaaaagatg

SEQ ID NO: 160309 - DNA, 103 bp, Artificial Sequence
  Synthetic Polynucleotide
taatacgactcactatagggccgatcatcccgattcatgcccttctctttaacagaggagaaaagagatgggcatgaataacctggcggcagcgcaaaagatg

SEQ ID NO: 160310 - DNA, 103 bp, Artificial Sequence
  Synthetic Polynucleotide
taatacgactcactatagggctggcagaggttttcatgggatgtcgcttgaacagaggagacaagcgatgtcccatgaaaacctggcggcagcgcaaaagatg

SEQ ID NO: 160311 - DNA, 103 bp, Artificial Sequence
  Synthetic Polynucleotide
taatacgactcactatagggcaatatagcactggcagaggttttcatgggaacagaggagacccatgatgacctctgccaacctggcggcagcgcaaaagatg

SEQ ID NO: 160312 - DNA, 103 bp, Artificial Sequence
  Synthetic Polynucleotide
taatacgactcactataggggggcaccagccaatatagcactggcagaggaacagaggagacctctgatggtgctatataacctggcggcagcgcaaaagatg

SEQ ID NO: 160313 - DNA, 103 bp, Artificial Sequence
  Synthetic Polynucleotide
taatacgactcactatagggttaccagaaagggcaccagccaatatagcaaacagaggagatgctatatgggctggtgcaacctggcggcagcgcaaaagatg

SEQ ID NO: 160314 - DNA, 103 bp, Artificial Sequence
  Synthetic Polynucleotide
taatacgactcactatagggctccatggatccgatcatcccgattcatgcaacagaggagagcatgaatggggatgatcaacctggcggcagcgcaaaagatg

SEQ ID NO: 160315 - DNA, 103 bp, Artificial Sequence
  Synthetic Polynucleotide
taatacgactcactatagggatcaacaaggctccatggatccgatcatccaacagaggagaggatgaatggatccatggaacctggcggcagcgcaaaagatg

SEQ ID NO: 160316 - DNA, 103 bp, Artificial Sequence
  Synthetic Polynucleotide
taatacgactcactatagggctcgttaaggatcaacaaggctccatggataacagaggagaatccatatggccttgttgaacctggcggcagcgcaaaagatg

SEQ ID NO: 160317 - DNA, 103 bp, Artificial Sequence
  Synthetic Polynucleotide
taatacgactcactatagggcattccggctctttaggccactggcaaactaacagaggagaagtttgatggtggcctaaaacctggcggcagcgcaaaagatg

SEQ ID NO: 160318 - DNA, 103 bp, Artificial Sequence
  Synthetic Polynucleotide
taatacgactcactatagggttcggaccagctcgttaaggatcaacaaggaacagaggagaccttgtatgtccttaacgaacctggcggcagcgcaaaagatg

SEQ ID NO: 160319 - DNA, 103 bp, Artificial Sequence
  Synthetic Polynucleotide
taatacgactcactatagggatgctgctgattcggaccagctcgttaaggaacagaggagaccttaaatggctggtccgaacctggcggcagcgcaaaagatg

SEQ ID NO: 160320 - DNA, 103 bp, Artificial Sequence
  Synthetic Polynucleotide
taatacgactcactatagggctctccctccatgctgctgattcggaccagaacagaggagactggtcatgatcagcagcaacctggcggcagcgcaaaagatg

SEQ ID NO: 160321 - DNA, 103 bp, Artificial Sequence
  Synthetic Polynucleotide
taatacgactcactatagggctctcagacgctctccctccatgctgctgaaacagaggagatcagcaatgtggagggagaacctggcggcagcgcaaaagatg

SEQ ID NO: 160322 - DNA, 103 bp, Artificial Sequence
  Synthetic Polynucleotide
taatacgactcactatagggtccatttcttctctcagacgctctccctccaacagaggagaggagggatggcgtctgagaacctggcggcagcgcaaaagatg

SEQ ID NO: 160323 - DNA, 103 bp, Artificial Sequence
  Synthetic Polynucleotide
taatacgactcactatagggtgtgatttcttccatttcttctctcagacgaacagaggagacgtctgatggaagaaatgaacctggcggcagcgcaaaagatg

SEQ ID NO: 160324 - DNA, 103 bp, Artificial Sequence
  Synthetic Polynucleotide
taatacgactcactataggggctgctgctgtgtgatttcttccatttcttaacagaggagaaagaaaatgaagaaatcaaacctggcggcagcgcaaaagatg

SEQ ID NO: 160325 - DNA, 103 bp, Artificial Sequence
  Synthetic Polynucleotide
taatacgactcactatagggtcgtgtaccagctgctgctgtgtgatttctaacagaggagaagaaatatgacagcagcaaacctggcggcagcgcaaaagatg

SEQ ID NO: 160326 - DNA, 103 bp, Artificial Sequence
  Synthetic Polynucleotide
taatacgactcactataggggcagtacttgtcgtgtaccagctgctgctgaacagaggagacagcagatgctggtacacaacctggcggcagcgcaaaagatg

SEQ ID NO: 160327 - DNA, 103 bp, Artificial Sequence
  Synthetic Polynucleotide
taatacgactcactatagggtgagatctttgcagtacttgtcgtgtaccaaacagaggagatggtacatgacaagtactaacctggcggcagcgcaaaagatg

SEQ ID NO: 160328 - DNA, 103 bp, Artificial Sequence
  Synthetic Polynucleotide
taatacgactcactatagggctggtttcctcattccggctctttaggccaaacagaggagatggcctatggagccggaaaacctggcggcagcgcaaaagatg

SEQ ID NO: 160329 - DNA, 103 bp, Artificial Sequence
  Synthetic Polynucleotide
taatacgactcactatagggccgaagcccatgagatctttgcagtacttgaacagaggagacaagtaatgcaaagatctaacctggcggcagcgcaaaagatg

SEQ ID NO: 160330 - DNA, 103 bp, Artificial Sequence
  Synthetic Polynucleotide
taatacgactcactatagggaggttttgttccgaagcccatgagatctttaacagaggagaaaagatatgatgggcttcaacctggcggcagcgcaaaagatg

SEQ ID NO: 160331 - DNA, 103 bp, Artificial Sequence
  Synthetic Polynucleotide
taatacgactcactatagggtaatgtgacgaggttttgttccgaagcccaaacagaggagatgggctatggaacaaaacaacctggcggcagcgcaaaagatg

SEQ ID NO: 160332 - DNA, 103 bp, Artificial Sequence
  Synthetic Polynucleotide
taatacgactcactataggggtgaagggggtaatgtgacgaggttttgttaacagaggagaaacaaaatgtcgtcacataacctggcggcagcgcaaaagatg

SEQ ID NO: 160333 - DNA, 103 bp, Artificial Sequence
  Synthetic Polynucleotide
taatacgactcactatagggctggaaactggtgaagggggtaatgtgacgaacagaggagacgtcacatgacccccttcaacctggcggcagcgcaaaagatg

SEQ ID NO: 160334 - DNA, 103 bp, Artificial Sequence
  Synthetic Polynucleotide
taatacgactcactataggggctgtacagcctggaaactggtgaagggggaacagaggagaccccctatgccagtttccaacctggcggcagcgcaaaagatg

SEQ ID NO: 160335 - DNA, 103 bp, Artificial Sequence
  Synthetic Polynucleotide
taatacgactcactataggggactgctggggctgtacagcctggaaactgaacagaggagacagtttatgggctgtacaaacctggcggcagcgcaaaagatg

SEQ ID NO: 160336 - DNA, 103 bp, Artificial Sequence
  Synthetic Polynucleotide
taatacgactcactatagggcaaggcatttgactgctggggctgtacagcaacagaggagagctgtaatgccccagcagaacctggcggcagcgcaaaagatg

SEQ ID NO: 160337 - DNA, 103 bp, Artificial Sequence
  Synthetic Polynucleotide
taatacgactcactataggggcagccccaccaaggcatttgactgctgggaacagaggagacccagcatgcaaatgcctaacctggcggcagcgcaaaagatg

SEQ ID NO: 160338 - DNA, 103 bp, Artificial Sequence
  Synthetic Polynucleotide
taatacgactcactatagggctgtaccccagcagccccaccaaggcatttaacagaggagaaaatgcatgggtggggctaacctggcggcagcgcaaaagatg

SEQ ID NO: 160339 - DNA, 103 bp, Artificial Sequence
  Synthetic Polynucleotide
taatacgactcactataggggaagaaaggagactgggtgcccggtgtcataacagaggagaatgacaatgggcacccagaacctggcggcagcgcaaaagatg

SEQ ID NO: 160340 - DNA, 103 bp, Artificial Sequence
  Synthetic Polynucleotide
taatacgactcactatagggggtagccgaagtctccttttctccacctggaacagaggagaccaggtatggaaaaggagaacctggcggcagcgcaaaagatg

SEQ ID NO: 160341 - DNA, 103 bp, Artificial Sequence
  Synthetic Polynucleotide
taatacgactcactatagggaacttctctgggtagccgaagtctccttttaacagaggagaaaaaggatgcttcggctaaacctggcggcagcgcaaaagatg

SEQ ID NO: 160342 - DNA, 103 bp, Artificial Sequence
  Synthetic Polynucleotide
taatacgactcactatagggctgggcactgaacttctctgggtagccgaaaacagaggagattcggcatgccagagaagaacctggcggcagcgcaaaagatg

SEQ ID NO: 160343 - DNA, 103 bp, Artificial Sequence
  Synthetic Polynucleotide
taatacgactcactatagggctcagtagagctgggcactgaacttctctgaacagaggagacagagaatgtcagtgcccaacctggcggcagcgcaaaagatg

SEQ ID NO: 160344 - DNA, 103 bp, Artificial Sequence
  Synthetic Polynucleotide
taatacgactcactatagggaagcattcttctcagtagagctgggcactgaacagaggagacagtgcatggctctactgaacctggcggcagcgcaaaagatg

SEQ ID NO: 160345 - DNA, 103 bp, Artificial Sequence
  Synthetic Polynucleotide
taatacgactcactatagggccagtagacaaagcattcttctcagtagagaacagaggagactctacatggaagaatgcaacctggcggcagcgcaaaagatg

SEQ ID NO: 160346 - DNA, 103 bp, Artificial Sequence
  Synthetic Polynucleotide
taatacgactcactataggggaaagagaccccagtagacaaagcattcttaacagaggagaaagaatatgttgtctactaacctggcggcagcgcaaaagatg

SEQ ID NO: 160347 - DNA, 103 bp, Artificial Sequence
  Synthetic Polynucleotide
taatacgactcactatagggacaggaaaaagaaagagaccccagtagacaaacagaggagatgtctaatggggtctcttaacctggcggcagcgcaaaagatg

SEQ ID NO: 160348 - DNA, 103 bp, Artificial Sequence
  Synthetic Polynucleotide
taatacgactcactatagggatgtgaaaagacaggaaaaagaaagagaccaacagaggagaggtctcatgctttttcctaacctggcggcagcgcaaaagatg

SEQ ID NO: 160349 - DNA, 103 bp, Artificial Sequence
  Synthetic Polynucleotide
taatacgactcactataggggaggtttgaaatgtgaaaagacaggaaaaaaacagaggagatttttcatgtcttttcacaacctggcggcagcgcaaaagatg

SEQ ID NO: 160350 - DNA, 103 bp, Artificial Sequence
  Synthetic Polynucleotide
taatacgactcactataggggcagcagcaggaagaaaggagactgggtgcaacagaggagagcacccatgctcctttctaacctggcggcagcgcaaaagatg

SEQ ID NO: 160351 - DNA, 103 bp, Artificial Sequence
  Synthetic Polynucleotide
taatacgactcactatagggaattaaactggaggtttgaaatgtgaaaagaacagaggagacttttcatgtttcaaaccaacctggcggcagcgcaaaagatg

SEQ ID NO: 160352 - DNA, 103 bp, Artificial Sequence
  Synthetic Polynucleotide
taatacgactcactatagggtccagagaggaattaaactggaggtttgaaaacagaggagattcaaaatgccagtttaaaacctggcggcagcgcaaaagatg

SEQ ID NO: 160353 - DNA, 103 bp, Artificial Sequence
  Synthetic Polynucleotide
taatacgactcactataggggctgggatcttccagagaggaattaaactgaacagaggagacagtttatgtcctctctgaacctggcggcagcgcaaaagatg

SEQ ID NO: 160354 - DNA, 103 bp, Artificial Sequence
  Synthetic Polynucleotide
taatacgactcactatagggagtagtcggtgctgggatcttccagagaggaacagaggagacctctcatgaagatcccaaacctggcggcagcgcaaaagatg

SEQ ID NO: 160355 - DNA, 103 bp, Artificial Sequence
  Synthetic Polynucleotide
taatacgactcactatagggagctcttggtagtagtcggtgctgggatctaacagaggagaagatccatgcaccgactaaacctggcggcagcgcaaaagatg

SEQ ID NO: 160356 - DNA, 103 bp, Artificial Sequence
  Synthetic Polynucleotide
taatacgactcactataggggtctctctgcagctcttggtagtagtcggtaacagaggagaaccgacatgtaccaagagaacctggcggcagcgcaaaagatg

SEQ ID NO: 160357 - DNA, 103 bp, Artificial Sequence
  Synthetic Polynucleotide
taatacgactcactatagggtttcagaaatgtctctctgcagctcttggtaacagaggagaaccaagatgtgcagagagaacctggcggcagcgcaaaagatg

SEQ ID NO: 160358 - DNA, 103 bp, Artificial Sequence
  Synthetic Polynucleotide
taatacgactcactatagggtgcaaaaacatttcagaaatgtctctctgcaacagaggagagcagagatgcatttctgaaacctggcggcagcgcaaaagatg

SEQ ID NO: 160359 - DNA, 103 bp, Artificial Sequence
  Synthetic Polynucleotide
taatacgactcactatagggtttataaatctgcaaaaacatttcagaaataacagaggagaatttctatgatgtttttgaacctggcggcagcgcaaaagatg

SEQ ID NO: 160360 - DNA, 103 bp, Artificial Sequence
  Synthetic Polynucleotide
taatacgactcactatagggaacccccttgtttataaatctgcaaaaacaaacagaggagatgttttatgagatttataaacctggcggcagcgcaaaagatg

SEQ ID NO: 160361 - DNA, 103 bp, Artificial Sequence
  Synthetic Polynucleotide
taatacgactcactatagggactgtgaggagcagcagcaggaagaaaggaaacagaggagatcctttatgcctgctgctaacctggcggcagcgcaaaagatg

SEQ ID NO: 160362 - DNA, 103 bp, Artificial Sequence
  Synthetic Polynucleotide
taatacgactcactatagggaggcccagaaaacccccttgtttataaatcaacagaggagagatttaatgacaagggggaacctggcggcagcgcaaaagatg

SEQ ID NO: 160363 - DNA, 103 bp, Artificial Sequence
  Synthetic Polynucleotide
taatacgactcactatagggaatattggagaggcccagaaaacccccttgaacagaggagacaagggatgtttctgggcaacctggcggcagcgcaaaagatg

SEQ ID NO: 160364 - DNA, 103 bp, Artificial Sequence
  Synthetic Polynucleotide
taatacgactcactataggggcctgaacttaatattggagaggcccagaaaacagaggagattctggatgtctccaataaacctggcggcagcgcaaaagatg

SEQ ID NO: 160365 - DNA, 103 bp, Artificial Sequence
  Synthetic Polynucleotide
taatacgactcactatagggacagatcctggcctgaacttaatattggagaacagaggagactccaaatgtaagttcagaacctggcggcagcgcaaaagatg

SEQ ID NO: 160366 - DNA, 103 bp, Artificial Sequence
  Synthetic Polynucleotide
taatacgactcactatagggttgtaccaccacagatcctggcctgaacttaacagaggagaaagttcatgccaggatctaacctggcggcagcgcaaaagatg

SEQ ID NO: 160367 - DNA, 103 bp, Artificial Sequence
  Synthetic Polynucleotide
taatacgactcactatagggccagagtcaattgtaccaccacagatcctgaacagaggagacaggatatgtggtggtacaacctggcggcagcgcaaaagatg

SEQ ID NO: 160368 - DNA, 103 bp, Artificial Sequence
  Synthetic Polynucleotide
taatacgactcactatagggtctcggaaggccagagtcaattgtaccaccaacagaggagaggtggtatgattgactctaacctggcggcagcgcaaaagatg

SEQ ID NO: 160369 - DNA, 103 bp, Artificial Sequence
  Synthetic Polynucleotide
taatacgactcactataggggatggtaccttctcggaaggccagagtcaaaacagaggagattgactatggccttccgaaacctggcggcagcgcaaaagatg

SEQ ID NO: 160370 - DNA, 103 bp, Artificial Sequence
  Synthetic Polynucleotide
taatacgactcactatagggcgtggacattgatggtaccttctcggaaggaacagaggagaccttccatgaaggtaccaaacctggcggcagcgcaaaagatg

SEQ ID NO: 160371 - DNA, 103 bp, Artificial Sequence
  Synthetic Polynucleotide
taatacgactcactataggggtctccacgtcgtggacattgatggtacctaacagaggagaaggtacatgcaatgtccaaacctggcggcagcgcaaaagatg

SEQ ID NO: 160372 - DNA, 103 bp, Artificial Sequence
  Synthetic Polynucleotide
taatacgactcactatagggaactgtaagcactgtgaggagcagcagcagaacagaggagactgctgatgctcctcacaaacctggcggcagcgcaaaagatg

SEQ ID NO: 160373 - DNA, 103 bp, Artificial Sequence
  Synthetic Polynucleotide
taatacgactcactatagggattgaactgtgtctccacgtcgtggacattaacagaggagaaatgtcatggacgtggagaacctggcggcagcgcaaaagatg

SEQ ID NO: 160374 - DNA, 103 bp, Artificial Sequence
  Synthetic Polynucleotide
taatacgactcactatagggttttatactgattgaactgtgtctccacgtaacagaggagaacgtggatgcacagttcaaacctggcggcagcgcaaaagatg

SEQ ID NO: 160375 - DNA, 103 bp, Artificial Sequence
  Synthetic Polynucleotide
taatacgactcactataggggctgcttccgttttatactgattgaactgtaacagaggagaacagttatgtcagtataaaacctggcggcagcgcaaaagatg

SEQ ID NO: 160376 - DNA, 103 bp, Artificial Sequence
  Synthetic Polynucleotide
taatacgactcactatagggatatcgagaggctgcttccgttttatactgaacagaggagacagtatatgacggaagcaaacctggcggcagcgcaaaagatg

SEQ ID NO: 160377 - DNA, 103 bp, Artificial Sequence
  Synthetic Polynucleotide
taatacgactcactatagggtcgtcaggttatatcgagaggctgcttccgaacagaggagacggaagatgcctctcgataacctggcggcagcgcaaaagatg

SEQ ID NO: 160378 - DNA, 103 bp, Artificial Sequence
  Synthetic Polynucleotide
taatacgactcactatagggacgtctgagatcgtcaggttatatcgagagaacagaggagactctcgatgtaacctgacaacctggcggcagcgcaaaagatg

SEQ ID NO: 160379 - DNA, 103 bp, Artificial Sequence
  Synthetic Polynucleotide
taatacgactcactatagggactcacgctgacgtctgagatcgtcaggttaacagaggagaaacctgatgatctcagacaacctggcggcagcgcaaaagatg

SEQ ID NO: 160380 - DNA, 103 bp, Artificial Sequence
  Synthetic Polynucleotide
taatacgactcactatagggatggcacatcactcacgctgacgtctgagaaacagaggagatctcagatgtcagcgtgaaacctggcggcagcgcaaaagatg

SEQ ID NO: 160381 - DNA, 103 bp, Artificial Sequence
  Synthetic Polynucleotide
taatacgactcactataggggagaaaggaaatggcacatcactcacgctgaacagaggagacagcgtatgtgatgtgccaacctggcggcagcgcaaaagatg

SEQ ID NO: 160382 - DNA, 103 bp, Artificial Sequence
  Synthetic Polynucleotide
taatacgactcactatagggagactgggcagagaaaggaaatggcacatcaacagaggagagatgtgatgtttcctttcaacctggcggcagcgcaaaagatg

SEQ ID NO: 160383 - DNA, 103 bp, Artificial Sequence
  Synthetic Polynucleotide
taatacgactcactatagggaacccgtaacaactgtaagcactgtgaggaaacagaggagatcctcaatgtgcttacagaacctggcggcagcgcaaaagatg

SEQ ID NO: 160384 - DNA, 103 bp, Artificial Sequence
  Synthetic Polynucleotide
taatacgactcactatagggccccagccccagactgggcagagaaaggaaaacagaggagattccttatgctgcccagtaacctggcggcagcgcaaaagatg

SEQ ID NO: 160385 - DNA, 103 bp, Artificial Sequence
  Synthetic Polynucleotide
taatacgactcactatagggcagcctggcaccccagccccagactgggcaaacagaggagatgcccaatgtggggctggaacctggcggcagcgcaaaagatg

SEQ ID NO: 160386 - DNA, 103 bp, Artificial Sequence
  Synthetic Polynucleotide
taatacgactcactatagggcgcgatgccccagcctggcaccccagccccaacagaggagaggggctatggtgccaggcaacctggcggcagcgcaaaagatg

SEQ ID NO: 160387 - DNA, 103 bp, Artificial Sequence
  Synthetic Polynucleotide
taatacgactcactataggggcaccagcagcgcgatgccccagcctggcaaacagaggagatgccagatgggggcatcgaacctggcggcagcgcaaaagatg

SEQ ID NO: 160388 - DNA, 103 bp, Artificial Sequence
  Synthetic Polynucleotide
taatacgactcactatagggacacagaccagcaccagcagcgcgatgcccaacagaggagagggcatatggctgctggtaacctggcggcagcgcaaaagatg

SEQ ID NO: 160389 - DNA, 103 bp, Artificial Sequence
  Synthetic Polynucleotide
taatacgactcactatagggcgcaaccagaacacagaccagcaccagcagaacagaggagactgctgatgctggtctgtaacctggcggcagcgcaaaagatg

SEQ ID NO: 160390 - DNA, 103 bp, Artificial Sequence
  Synthetic Polynucleotide
taatacgactcactatagggcaatggccagcgcaaccagaacacagaccaaacagaggagatggtctatgttctggttgaacctggcggcagcgcaaaagatg

SEQ ID NO: 160391 - DNA, 103 bp, Artificial Sequence
  Synthetic Polynucleotide
taatacgactcactatagggatgagatagacaatggccagcgcaaccagaaacagaggagatctggtatggctggccataacctggcggcagcgcaaaagatg

SEQ ID NO: 160392 - DNA, 103 bp, Artificial Sequence
  Synthetic Polynucleotide
taatacgactcactatagggagccaaggcaatgagatagacaatggccagaacagaggagactggccatggtctatctcaacctggcggcagcgcaaaagatg

SEQ ID NO: 160393 - DNA, 103 bp, Artificial Sequence
  Synthetic Polynucleotide
taatacgactcactatagggactgacagacagccaaggcaatgagatagaaacagaggagatctatcatgttgccttggaacctggcggcagcgcaaaagatg

SEQ ID NO: 160394 - DNA, 103 bp, Artificial Sequence
  Synthetic Polynucleotide
taatacgactcactataggggcatgaccagaacccgtaacaactgtaagcaacagaggagagcttacatgtgttacgggaacctggcggcagcgcaaaagatg

SEQ ID NO: 160395 - DNA, 103 bp, Artificial Sequence
  Synthetic Polynucleotide
taatacgactcactatagggtttcggcggcactgacagacagccaaggcaaacagaggagatgccttatgtgtctgtcaaacctggcggcagcgcaaaagatg

SEQ ID NO: 160396 - DNA, 103 bp, Artificial Sequence
  Synthetic Polynucleotide
taatacgactcactatagggcccgtagttctttcggcggcactgacagacaacagaggagagtctgtatgtgccgccgaaacctggcggcagcgcaaaagatg

SEQ ID NO: 160397 - DNA, 103 bp, Artificial Sequence
  Synthetic Polynucleotide
taatacgactcactatagggtgtccagctgcccgtagttctttcggcggcaacagaggagagccgccatgagaactacgaacctggcggcagcgcaaaagatg

SEQ ID NO: 160398 - DNA, 103 bp, Artificial Sequence
  Synthetic Polynucleotide
taatacgactcactataggggctggaaagatgtccagctgcccgtagttcaacagaggagagaactaatggcagctggaaacctggcggcagcgcaaaagatg

SEQ ID NO: 160399 - DNA, 103 bp, Artificial Sequence
  Synthetic Polynucleotide
taatacgactcactatagggggtatcccgggctggaaagatgtccagctgaacagaggagacagctgatgatctttccaaacctggcggcagcgcaaaagatg

SEQ ID NO: 160400 - DNA, 103 bp, Artificial Sequence
  Synthetic Polynucleotide
taatacgactcactatagggtaggatggtaggtatcccgggctggaaagaaacagaggagatctttcatgcccgggataaacctggcggcagcgcaaaagatg

SEQ ID NO: 160401 - DNA, 103 bp, Artificial Sequence
  Synthetic Polynucleotide
taatacgactcactatagggtactcgctcataggatggtaggtatcccggaacagaggagaccgggaatgctaccatccaacctggcggcagcgcaaaagatg

SEQ ID NO: 160402 - DNA, 103 bp, Artificial Sequence
  Synthetic Polynucleotide
taatacgactcactataggggtaggtggggtactcgctcataggatggtaaacagaggagataccatatgatgagcgagaacctggcggcagcgcaaaagatg

SEQ ID NO: 160403 - DNA, 103 bp, Artificial Sequence
  Synthetic Polynucleotide
taatacgactcactatagggcatgggtgtggtaggtggggtactcgctcaaacagaggagatgagcgatgaccccacctaacctggcggcagcgcaaaagatg

SEQ ID NO: 160404 - DNA, 103 bp, Artificial Sequence
  Synthetic Polynucleotide
taatacgactcactatagggacatagcgcccatgggtgtggtaggtggggaacagaggagaccccacatgccacacccaaacctggcggcagcgcaaaagatg

SEQ ID NO: 160405 - DNA, 103 bp, Artificial Sequence
  Synthetic Polynucleotide
taatacgactcactatagggggtagagcttgcatgaccagaacccgtaacaacagaggagagttacgatgtctggtcataacctggcggcagcgcaaaagatg

SEQ ID NO: 160406 - DNA, 103 bp, Artificial Sequence
  Synthetic Polynucleotide
taatacgactcactataggggctagggggcacatagcgcccatgggtgtgaacagaggagacacaccatggggcgctataacctggcggcagcgcaaaagatg

SEQ ID NO: 160407 - DNA, 103 bp, Artificial Sequence
  Synthetic Polynucleotide
taatacgactcactataggggatcggtactgctagggggcacatagcgccaacagaggagaggcgctatgtgccccctaaacctggcggcagcgcaaaagatg

SEQ ID NO: 160408 - DNA, 103 bp, Artificial Sequence
  Synthetic Polynucleotide
taatacgactcactatagggtaggggctacgatcggtactgctagggggcaacagaggagagcccccatgcagtaccgaaacctggcggcagcgcaaaagatg

SEQ ID NO: 160409 - DNA, 103 bp, Artificial Sequence
  Synthetic Polynucleotide
taatacgactcactatagggaaccttctcataggggctacgatcggtactaacagaggagaagtaccatgcgtagccccaacctggcggcagcgcaaaagatg

SEQ ID NO: 160410 - DNA, 103 bp, Artificial Sequence
  Synthetic Polynucleotide
taatacgactcactatagggtacctgcagaaaccttctcataggggctacaacagaggagagtagccatgatgagaaggaacctggcggcagcgcaaaagatg

SEQ ID NO: 160411 - DNA, 103 bp, Artificial Sequence
  Synthetic Polynucleotide
taatacgactcactatagggctgccaccattacctgcagaaaccttctcaaacagaggagatgagaaatgttctgcaggaacctggcggcagcgcaaaagatg

SEQ ID NO: 160412 - DNA, 103 bp, Artificial Sequence
  Synthetic Polynucleotide
taatacgactcactatagggagagaggctgctgccaccattacctgcagaaacagaggagatctgcaatgaatggtggcaacctggcggcagcgcaaaagatg

SEQ ID NO: 160413 - DNA, 103 bp, Artificial Sequence
  Synthetic Polynucleotide
taatacgactcactatagggggtttgtgtaagagaggctgctgccaccataacagaggagaatggtgatggcagcctctaacctggcggcagcgcaaaagatg

SEQ ID NO: 160414 - DNA, 103 bp, Artificial Sequence
  Synthetic Polynucleotide
taatacgactcactataggggccactgctgggtttgtgtaagagaggctgaacagaggagacagcctatgttacacaaaaacctggcggcagcgcaaaagatg

SEQ ID NO: 160415 - DNA, 103 bp, Artificial Sequence
  Synthetic Polynucleotide
taatacgactcactatagggagaagtggctgccactgctgggtttgtgtaaacagaggagatacacaatgccagcagtgaacctggcggcagcgcaaaagatg

SEQ ID NO: 160416 - DNA, 103 bp, Artificial Sequence
  Synthetic Polynucleotide
taatacgactcactatagggctccacctggggtagagcttgcatgaccagaacagaggagactggtcatgcaagctctaaacctggcggcagcgcaaaagatg

SEQ ID NO: 160417 - DNA, 103 bp, Artificial Sequence
  Synthetic Polynucleotide
taatacgactcactatagggacaagttggcagaagtggctgccactgctgaacagaggagacagcagatgcagccacttaacctggcggcagcgcaaaagatg

SEQ ID NO: 160418 - DNA, 103 bp, Artificial Sequence
  Synthetic Polynucleotide
taatacgactcactataggggtctccttttctccacctggggtagagcttaacagaggagaaagctcatgcccaggtggaacctggcggcagcgcaaaagatg

SEQ ID NO: 160419 - DNA, 103 bp, Artificial Sequence
  Synthetic Polynucleotide
taatacgactcactatagggctggatgttcatccgaaccgccgccgccataacagaggagaatggcgatggcggttcggaacctggcggcagcgcaaaagatg

SEQ ID NO: 160420 - DNA, 103 bp, Artificial Sequence
  Synthetic Polynucleotide
taatacgactcactataggggtccttgttattgtatggtaacatggaggcaacagaggagagcctccatgttaccatacaacctggcggcagcgcaaaagatg

SEQ ID NO: 160421 - DNA, 103 bp, Artificial Sequence
  Synthetic Polynucleotide
taatacgactcactatagggaggcatctctgtccttgttattgtatggtaaacagaggagataccatatgataacaaggaacctggcggcagcgcaaaagatg

SEQ ID NO: 160422 - DNA, 103 bp, Artificial Sequence
  Synthetic Polynucleotide
taatacgactcactatagggctccgttttaaggcatctctgtccttgttaaacagaggagataacaaatgcagagatgcaacctggcggcagcgcaaaagatg

SEQ ID NO: 160423 - DNA, 103 bp, Artificial Sequence
  Synthetic Polynucleotide
taatacgactcactatagggggatttgttcctccgttttaaggcatctctaacagaggagaagagatatgttaaaacggaacctggcggcagcgcaaaagatg

SEQ ID NO: 160424 - DNA, 103 bp, Artificial Sequence
  Synthetic Polynucleotide
taatacgactcactatagggtattctttttggatttgttcctccgttttaaacagaggagataaaacatgggaacaaataacctggcggcagcgcaaaagatg

SEQ ID NO: 160425 - DNA, 103 bp, Artificial Sequence
  Synthetic Polynucleotide
taatacgactcactatagggctactgctgttattctttttggatttgttcaacagaggagagaacaaatgcaaaaagaaaacctggcggcagcgcaaaagatg

SEQ ID NO: 160426 - DNA, 103 bp, Artificial Sequence
  Synthetic Polynucleotide
taatacgactcactatagggagttgatctgctactgctgttattctttttaacagaggagaaaaaagatgaacagcagtaacctggcggcagcgcaaaagatg

SEQ ID NO: 160427 - DNA, 103 bp, Artificial Sequence
  Synthetic Polynucleotide
taatacgactcactatagggtttcattgtgagttgatctgctactgctgtaacagaggagaacagcaatggcagatcaaaacctggcggcagcgcaaaagatg

SEQ ID NO: 160428 - DNA, 103 bp, Artificial Sequence
  Synthetic Polynucleotide
taatacgactcactatagggttcttctccatttcattgtgagttgatctgaacagaggagacagatcatgtcacaatgaaacctggcggcagcgcaaaagatg

SEQ ID NO: 160429 - DNA, 103 bp, Artificial Sequence
  Synthetic Polynucleotide
taatacgactcactatagggagcccgtctattcttctccatttcattgtgaacagaggagacacaatatgatggagaagaacctggcggcagcgcaaaagatg

SEQ ID NO: 160430 - DNA, 103 bp, Artificial Sequence
  Synthetic Polynucleotide
taatacgactcactatagggccagcagcatctggatgttcatccgaaccgaacagaggagacggttcatgtgaacatccaacctggcggcagcgcaaaagatg

SEQ ID NO: 160431 - DNA, 103 bp, Artificial Sequence
  Synthetic Polynucleotide
taatacgactcactatagggagcgaagatgagcccgtctattcttctccaaacagaggagatggagaatgatagacgggaacctggcggcagcgcaaaagatg

SEQ ID NO: 160432 - DNA, 103 bp, Artificial Sequence
  Synthetic Polynucleotide
taatacgactcactatagggtccaggcacaagcgaagatgagcccgtctaaacagaggagatagacgatgtcatcttcgaacctggcggcagcgcaaaagatg

SEQ ID NO: 160433 - DNA, 103 bp, Artificial Sequence
  Synthetic Polynucleotide
taatacgactcactatagggcttcaacttctccaggcacaagcgaagatgaacagaggagacatcttatgttgtgcctgaacctggcggcagcgcaaaagatg

SEQ ID NO: 160434 - DNA, 103 bp, Artificial Sequence
  Synthetic Polynucleotide
taatacgactcactataggggcaccagccccttcaacttctccaggcacaaacagaggagatgtgccatgagaagttgaaacctggcggcagcgcaaaagatg

SEQ ID NO: 160435 - DNA, 103 bp, Artificial Sequence
  Synthetic Polynucleotide
taatacgactcactatagggggtccaagtggcaccagccccttcaacttcaacagaggagagaagttatgggggctggtaacctggcggcagcgcaaaagatg

SEQ ID NO: 160436 - DNA, 103 bp, Artificial Sequence
  Synthetic Polynucleotide
taatacgactcactatagggacttgattcgggtccaagtggcaccagcccaacagaggagagggctgatgccacttggaaacctggcggcagcgcaaaagatg

SEQ ID NO: 160437 - DNA, 103 bp, Artificial Sequence
  Synthetic Polynucleotide
taatacgactcactatagggtagtgtgtcgacttgattcgggtccaagtgaacagaggagacacttgatgccgaatcaaaacctggcggcagcgcaaaagatg

SEQ ID NO: 160438 - DNA, 103 bp, Artificial Sequence
  Synthetic Polynucleotide
taatacgactcactatagggaaactcaacgtagtgtgtcgacttgattcgaacagaggagacgaatcatgtcgacacacaacctggcggcagcgcaaaagatg

SEQ ID NO: 160439 - DNA, 103 bp, Artificial Sequence
  Synthetic Polynucleotide
taatacgactcactatagggttttgttaataaactcaacgtagtgtgtcgaacagaggagacgacacatgacgttgagtaacctggcggcagcgcaaaagatg

SEQ ID NO: 160440 - DNA, 103 bp, Artificial Sequence
  Synthetic Polynucleotide
taatacgactcactataggggcaatttggcttttgttaataaactcaacgaacagaggagacgttgaatgtattaacaaaacctggcggcagcgcaaaagatg

SEQ ID NO: 160441 - DNA, 103 bp, Artificial Sequence
  Synthetic Polynucleotide
taatacgactcactatagggtcggccgcctccagcagcatctggatgttcaacagaggagagaacatatggatgctgctaacctggcggcagcgcaaaagatg

SEQ ID NO: 160442 - DNA, 103 bp, Artificial Sequence
  Synthetic Polynucleotide
taatacgactcactatagggttctttatgtgcaatttggcttttgttaataacagaggagaattaacatgagccaaattaacctggcggcagcgcaaaagatg

SEQ ID NO: 160443 - DNA, 103 bp, Artificial Sequence
  Synthetic Polynucleotide
taatacgactcactatagggatcttcaagtttctttatgtgcaatttggcaacagaggagagccaaaatgcacataaagaacctggcggcagcgcaaaagatg

SEQ ID NO: 160444 - DNA, 103 bp, Artificial Sequence
  Synthetic Polynucleotide
taatacgactcactatagggttctgtcacaatcttcaagtttctttatgtaacagaggagaacataaatgaacttgaagaacctggcggcagcgcaaaagatg

SEQ ID NO: 160445 - DNA, 103 bp, Artificial Sequence
  Synthetic Polynucleotide
taatacgactcactatagggtgaacggcttttctgtcacaatcttcaagtaacagaggagaacttgaatgttgtgacagaacctggcggcagcgcaaaagatg

SEQ ID NO: 160446 - DNA, 103 bp, Artificial Sequence
  Synthetic Polynucleotide
taatacgactcactataggggtcgatttggtgaacggcttttctgtcacaaacagaggagatgtgacatgaaagccgttaacctggcggcagcgcaaaagatg

SEQ ID NO: 160447 - DNA, 103 bp, Artificial Sequence
  Synthetic Polynucleotide
taatacgactcactataggggctgaagctggtcgatttggtgaacggcttaacagaggagaaagccgatgaccaaatcgaacctggcggcagcgcaaaagatg

SEQ ID NO: 160448 - DNA, 103 bp, Artificial Sequence
  Synthetic Polynucleotide
taatacgactcactatagggcgctgctctcgctgaagctggtcgatttggaacagaggagaccaaatatgccagcttcaaacctggcggcagcgcaaaagatg

SEQ ID NO: 160449 - DNA, 103 bp, Artificial Sequence
  Synthetic Polynucleotide
taatacgactcactatagggcttcaggtgtcgctgctctcgctgaagctgaacagaggagacagcttatgcgagagcagaacctggcggcagcgcaaaagatg

SEQ ID NO: 160450 - DNA, 103 bp, Artificial Sequence
  Synthetic Polynucleotide
taatacgactcactatagggccagctgcctcttcaggtgtcgctgctctcaacagaggagagagagcatggacacctgaaacctggcggcagcgcaaaagatg

SEQ ID NO: 160451 - DNA, 103 bp, Artificial Sequence
  Synthetic Polynucleotide
taatacgactcactatagggcccagcttctccagctgcctcttcaggtgtaacagaggagaacacctatggaggcagctaacctggcggcagcgcaaaagatg

SEQ ID NO: 160452 - DNA, 103 bp, Artificial Sequence
  Synthetic Polynucleotide
taatacgactcactatagggctccagatagtcggccgcctccagcagcataacagaggagaatgctgatggaggcggccaacctggcggcagcgcaaaagatg

SEQ ID NO: 160453 - DNA, 103 bp, Artificial Sequence
  Synthetic Polynucleotide
taatacgactcactatagggcctctcaatgcccagcttctccagctgcctaacagaggagaaggcagatggagaagctgaacctggcggcagcgcaaaagatg

SEQ ID NO: 160454 - DNA, 103 bp, Artificial Sequence
  Synthetic Polynucleotide
taatacgactcactatagggccatccggatcctctcaatgcccagcttctaacagaggagaagaagcatggcattgagaaacctggcggcagcgcaaaagatg

SEQ ID NO: 160455 - DNA, 103 bp, Artificial Sequence
  Synthetic Polynucleotide
taatacgactcactatagggccgatgctgtccatccggatcctctcaatgaacagaggagacattgaatggatccggataacctggcggcagcgcaaaagatg

SEQ ID NO: 160456 - DNA, 103 bp, Artificial Sequence
  Synthetic Polynucleotide
taatacgactcactataggggacggtggagccgatgctgtccatccggataacagaggagaatccggatggacagcatcaacctggcggcagcgcaaaagatg

SEQ ID NO: 160457 - DNA, 103 bp, Artificial Sequence
  Synthetic Polynucleotide
taatacgactcactataggggctccgaggagacggtggagccgatgctgtaacagaggagaacagcaatggctccaccgaacctggcggcagcgcaaaagatg

SEQ ID NO: 160458 - DNA, 103 bp, Artificial Sequence
  Synthetic Polynucleotide
taatacgactcactataggggagtcggagcgctccgaggagacggtggagaacagaggagactccacatgctcctcggaaacctggcggcagcgcaaaagatg

SEQ ID NO: 160459 - DNA, 103 bp, Artificial Sequence
  Synthetic Polynucleotide
taatacgactcactatagggttccctgtcggagtcggagcgctccgaggaaacagaggagatcctcgatgcgctccgacaacctggcggcagcgcaaaagatg

SEQ ID NO: 160460 - DNA, 103 bp, Artificial Sequence
  Synthetic Polynucleotide
taatacgactcactatagggcgtcgatttcttccctgtcggagtcggagcaacagaggagagctccgatgccgacagggaacctggcggcagcgcaaaagatg

SEQ ID NO: 160461 - DNA, 103 bp, Artificial Sequence
  Synthetic Polynucleotide
taatacgactcactatagggtccacgtcaacgtcgatttcttccctgtcgaacagaggagacgacagatgagaaatcgaaacctggcggcagcgcaaaagatg

SEQ ID NO: 160462 - DNA, 103 bp, Artificial Sequence
  Synthetic Polynucleotide
taatacgactcactataggggtccgtgctctccacgtcaacgtcgatttcaacagaggagagaaatcatggttgacgtgaacctggcggcagcgcaaaagatg

SEQ ID NO: 160463 - DNA, 103 bp, Artificial Sequence
  Synthetic Polynucleotide
taatacgactcactatagggtctcccgccgctccagatagtcggccgcctaacagaggagaaggcggatgactatctggaacctggcggcagcgcaaaagatg

SEQ ID NO: 160464 - DNA, 103 bp, Artificial Sequence
  Synthetic Polynucleotide
taatacgactcactatagggctgtgagatagtccgtgctctccacgtcaaaacagaggagattgacgatgagagcacggaacctggcggcagcgcaaaagatg

SEQ ID NO: 160465 - DNA, 103 bp, Artificial Sequence
  Synthetic Polynucleotide
taatacgactcactatagggtccagatcacctgtgagatagtccgtgctcaacagaggagagagcacatgctatctcacaacctggcggcagcgcaaaagatg

SEQ ID NO: 160466 - DNA, 103 bp, Artificial Sequence
  Synthetic Polynucleotide
taatacgactcactataggggctgctccagtccagatcacctgtgagataaacagaggagatatctcatgggtgatctgaacctggcggcagcgcaaaagatg

SEQ ID NO: 160467 - DNA, 103 bp, Artificial Sequence
  Synthetic Polynucleotide
taatacgactcactatagggtcacactgctgctgctccagtccagatcacaacagaggagagtgatcatgactggagcaaacctggcggcagcgcaaaagatg

SEQ ID NO: 160468 - DNA, 103 bp, Artificial Sequence
  Synthetic Polynucleotide
taatacgactcactatagggtcagagtcgctcacactgctgctgctccagaacagaggagactggagatgcagcagtgtaacctggcggcagcgcaaaagatg

SEQ ID NO: 160469 - DNA, 103 bp, Artificial Sequence
  Synthetic Polynucleotide
taatacgactcactataggggccccgctcgtcagagtcgctcacactgctaacagaggagaagcagtatgagcgactctaacctggcggcagcgcaaaagatg

SEQ ID NO: 160470 - DNA, 103 bp, Artificial Sequence
  Synthetic Polynucleotide
taatacgactcactatagggtctgcatgctgccccgctcgtcagagtcgcaacagaggagagcgactatgacgagcgggaacctggcggcagcgcaaaagatg

SEQ ID NO: 160471 - DNA, 103 bp, Artificial Sequence
  Synthetic Polynucleotide
taatacgactcactatagggctgccgaggctctgcatgctgccccgctcgaacagaggagacgagcgatgcagcatgcaaacctggcggcagcgcaaaagatg

SEQ ID NO: 160472 - DNA, 103 bp, Artificial Sequence
  Synthetic Polynucleotide
taatacgactcactataggggccctcatcactgccgaggctctgcatgctaacagaggagaagcatgatgagcctcggcaacctggcggcagcgcaaaagatg

SEQ ID NO: 160473 - DNA, 103 bp, Artificial Sequence
  Synthetic Polynucleotide
taatacgactcactatagggtgctggaatagccctcatcactgccgaggcaacagaggagagcctcgatggtgatgaggaacctggcggcagcgcaaaagatg

SEQ ID NO: 160474 - DNA, 103 bp, Artificial Sequence
  Synthetic Polynucleotide
taatacgactcactatagggtcagcttctctctcccgccgctccagatagaacagaggagactatctatggcggcgggaaacctggcggcagcgcaaaagatg

SEQ ID NO: 160475 - DNA, 103 bp, Artificial Sequence
  Synthetic Polynucleotide
taatacgactcactatagggttgatgctggtgctggaatagccctcatcaaacagaggagatgatgaatgctattccagaacctggcggcagcgcaaaagatg

SEQ ID NO: 160476 - DNA, 103 bp, Artificial Sequence
  Synthetic Polynucleotide
taatacgactcactatagggctttattctcttgatgctggtgctggaataaacagaggagatattccatgaccagcatcaacctggcggcagcgcaaaagatg

SEQ ID NO: 160477 - DNA, 103 bp, Artificial Sequence
  Synthetic Polynucleotide
taatacgactcactatagggtgtcctgcagctttattctcttgatgctggaacagaggagaccagcaatgagagaataaaacctggcggcagcgcaaaagatg

SEQ ID NO: 160478 - DNA, 103 bp, Artificial Sequence
  Synthetic Polynucleotide
taatacgactcactataggggccttgtgactgtcctgcagctttattctcaacagaggagagagaatatggctgcaggaaacctggcggcagcgcaaaagatg

SEQ ID NO: 160479 - DNA, 103 bp, Artificial Sequence
  Synthetic Polynucleotide
taatacgactcactatagggaccaagacacgccttgtgactgtcctgcagaacagaggagactgcagatgagtcacaagaacctggcggcagcgcaaaagatg

SEQ ID NO: 160480 - DNA, 103 bp, Artificial Sequence
  Synthetic Polynucleotide
taatacgactcactatagggataaccatgttcagcttctctctcccgccgaacagaggagacggcggatgagagaagctaacctggcggcagcgcaaaagatg

SEQ ID NO: 160481 - DNA, 103 bp, Artificial Sequence
  Synthetic Polynucleotide
taatacgactcactatagggacatggaggcataaccatgttcagcttctcaacagaggagagagaagatgaacatggttaacctggcggcagcgcaaaagatg

SEQ ID NO: 160482 - DNA, 103 bp, Artificial Sequence
  Synthetic Polynucleotide
taatacgactcactatagggttgtatggtaacatggaggcataaccatgtaacagaggagaacatggatgtgcctccataacctggcggcagcgcaaaagatg

SEQ ID NO: 160483 - DNA, 103 bp, Artificial Sequence
  Synthetic Polynucleotide
taatacgactcactataggggacctggatgttgctggccaagggttccataacagaggagaatggaaatgttggccagcaacctggcggcagcgcaaaagatg

SEQ ID NO: 160484 - DNA, 103 bp, Artificial Sequence
  Synthetic Polynucleotide
taatacgactcactatagggggggcctggactgcgatgcgggcacagggaaacagaggagatccctgatgccgcatcgcaacctggcggcagcgcaaaagatg

SEQ ID NO: 160485 - DNA, 103 bp, Artificial Sequence
  Synthetic Polynucleotide
taatacgactcactatagggtcctgtggatggggcctggactgcgatgcgaacagaggagacgcatcatggtccaggccaacctggcggcagcgcaaaagatg

SEQ ID NO: 160486 - DNA, 103 bp, Artificial Sequence
  Synthetic Polynucleotide
taatacgactcactatagggcgcttcttcctcctgtggatggggcctggaaacagaggagatccaggatgcatccacagaacctggcggcagcgcaaaagatg

SEQ ID NO: 160487 - DNA, 103 bp, Artificial Sequence
  Synthetic Polynucleotide
taatacgactcactatagggctgggggggtcgcttcttcctcctgtggataacagaggagaatccacatgaggaagaagaacctggcggcagcgcaaaagatg

SEQ ID NO: 160488 - DNA, 103 bp, Artificial Sequence
  Synthetic Polynucleotide
taatacgactcactatagggcgccaggagcctgggggggtcgcttcttccaacagaggagaggaagaatggacccccccaacctggcggcagcgcaaaagatg

SEQ ID NO: 160489 - DNA, 103 bp, Artificial Sequence
  Synthetic Polynucleotide
taatacgactcactatagggctgtcctgcgcgccaggagcctgggggggtaacagaggagaacccccatgggctcctggaacctggcggcagcgcaaaagatg

SEQ ID NO: 160490 - DNA, 103 bp, Artificial Sequence
  Synthetic Polynucleotide
taatacgactcactatagggtgaccgcccgctgtcctgcgcgccaggagcaacagaggagagctcctatggcgcaggacaacctggcggcagcgcaaaagatg

SEQ ID NO: 160491 - DNA, 103 bp, Artificial Sequence
  Synthetic Polynucleotide
taatacgactcactatagggcattgtgcactgaccgcccgctgtcctgcgaacagaggagacgcaggatggcgggcggtaacctggcggcagcgcaaaagatg

SEQ ID NO: 160492 - DNA, 103 bp, Artificial Sequence
  Synthetic Polynucleotide
taatacgactcactatagggttctccagttcattgtgcactgaccgcccgaacagaggagacgggcgatgagtgcacaaaacctggcggcagcgcaaaagatg

SEQ ID NO: 160493 - DNA, 103 bp, Artificial Sequence
  Synthetic Polynucleotide
taatacgactcactatagggcctcctgcgcttctccagttcattgtgcacaacagaggagagtgcacatggaactggagaacctggcggcagcgcaaaagatg

SEQ ID NO: 160494 - DNA, 103 bp, Artificial Sequence
  Synthetic Polynucleotide
taatacgactcactatagggcctgcagcaggacctggatgttgctggccaaacagaggagatggccaatgacatccaggaacctggcggcagcgcaaaagatg

SEQ ID NO: 160495 - DNA, 103 bp, Artificial Sequence
  Synthetic Polynucleotide
taatacgactcactatagggtcaactgggccctcctgcgcttctccagttaacagaggagaaactggatgagcgcaggaaacctggcggcagcgcaaaagatg

SEQ ID NO: 160496 - DNA, 103 bp, Artificial Sequence
  Synthetic Polynucleotide
taatacgactcactatagggaggcaccgcttcaactgggccctcctgcgcaacagaggagagcgcagatgggcccagttaacctggcggcagcgcaaaagatg

SEQ ID NO: 160497 - DNA, 103 bp, Artificial Sequence
  Synthetic Polynucleotide
taatacgactcactatagggcagccgctccaggcaccgcttcaactgggcaacagaggagagcccagatgaagcggtgcaacctggcggcagcgcaaaagatg

SEQ ID NO: 160498 - DNA, 103 bp, Artificial Sequence
  Synthetic Polynucleotide
taatacgactcactatagggtctgctgcttcagccgctccaggcaccgctaacagaggagaagcggtatgtggagcggcaacctggcggcagcgcaaaagatg

SEQ ID NO: 160499 - DNA, 103 bp, Artificial Sequence
  Synthetic Polynucleotide
taatacgactcactatagggcccaggggcatctgctgcttcagccgctccaacagaggagaggagcgatggaagcagcaaacctggcggcagcgcaaaagatg

SEQ ID NO: 160500 - DNA, 103 bp, Artificial Sequence
  Synthetic Polynucleotide
taatacgactcactatagggacagtcggcccccaggggcatctgctgcttaacagaggagaaagcagatgatgcccctgaacctggcggcagcgcaaaagatg

SEQ ID NO: 160501 - DNA, 103 bp, Artificial Sequence
  Synthetic Polynucleotide
taatacgactcactatagggtgtaccgggcacagtcggcccccaggggcaaacagaggagatgccccatggggccgactaacctggcggcagcgcaaaagatg

SEQ ID NO: 160502 - DNA, 103 bp, Artificial Sequence
  Synthetic Polynucleotide
taatacgactcactatagggctcagcgtggtgtaccgggcacagtcggccaacagaggagaggccgaatgtgcccggtaaacctggcggcagcgcaaaagatg

SEQ ID NO: 160503 - DNA, 103 bp, Artificial Sequence
  Synthetic Polynucleotide
taatacgactcactataggggcgcagcaggctcagcgtggtgtaccgggcaacagaggagagcccggatgaccacgctgaacctggcggcagcgcaaaagatg

SEQ ID NO: 160504 - DNA, 103 bp, Artificial Sequence
  Synthetic Polynucleotide
taatacgactcactatagggtcctggcacggcgcagcaggctcagcgtggaacagaggagaccacgcatggcctgctgcaacctggcggcagcgcaaaagatg

SEQ ID NO: 160505 - DNA, 103 bp, Artificial Sequence
  Synthetic Polynucleotide
taatacgactcactatagggaactcggccgcctgcagcaggacctggatgaacagaggagacatccaatgcctgctgcaaacctggcggcagcgcaaaagatg

SEQ ID NO: 160506 - DNA, 103 bp, Artificial Sequence
  Synthetic Polynucleotide
taatacgactcactatagggtggatgtgcatcctggcacggcgcagcaggaacagaggagacctgctatgccgtgccagaacctggcggcagcgcaaaagatg

SEQ ID NO: 160507 - DNA, 103 bp, Artificial Sequence
  Synthetic Polynucleotide
taatacgactcactatagggctccagcttctggatgtgcatcctggcacgaacagaggagacgtgccatgatgcacatcaacctggcggcagcgcaaaagatg

SEQ ID NO: 160508 - DNA, 103 bp, Artificial Sequence
  Synthetic Polynucleotide
taatacgactcactataggggctcctgatcctccagcttctggatgtgcaaacagaggagatgcacaatgagaagctggaacctggcggcagcgcaaaagatg

SEQ ID NO: 160509 - DNA, 103 bp, Artificial Sequence
  Synthetic Polynucleotide
taatacgactcactatagggcgggcccgctgctcctgatcctccagcttcaacagaggagagaagctatgggatcaggaaacctggcggcagcgcaaaagatg

SEQ ID NO: 160510 - DNA, 103 bp, Artificial Sequence
  Synthetic Polynucleotide
taatacgactcactatagggcttgagctgtcgggcccgctgctcctgatcaacagaggagagatcagatgcagcgggccaacctggcggcagcgcaaaagatg

SEQ ID NO: 160511 - DNA, 103 bp, Artificial Sequence
  Synthetic Polynucleotide
taatacgactcactataggggcagcctctccttgagctgtcgggcccgctaacagaggagaagcgggatggacagctcaaacctggcggcagcgcaaaagatg

SEQ ID NO: 160512 - DNA, 103 bp, Artificial Sequence
  Synthetic Polynucleotide
taatacgactcactatagggtgcttgctgcgcagcctctccttgagctgtaacagaggagaacagctatgggagaggctaacctggcggcagcgcaaaagatg

SEQ ID NO: 160513 - DNA, 103 bp, Artificial Sequence
  Synthetic Polynucleotide
taatacgactcactatagggcaggctctgctgcttgctgcgcagcctctcaacagaggagagagaggatgcgcagcaagaacctggcggcagcgcaaaagatg

SEQ ID NO: 160514 - DNA, 103 bp, Artificial Sequence
  Synthetic Polynucleotide
taatacgactcactataggggctgccgctgcaggctctgctgcttgctgcaacagaggagagcagcaatgagcagagccaacctggcggcagcgcaaaagatg

SEQ ID NO: 160515 - DNA, 103 bp, Artificial Sequence
  Synthetic Polynucleotide
taatacgactcactatagggagctgctccagctgccgctgcaggctctgcaacagaggagagcagagatggcagcggcaaacctggcggcagcgcaaaagatg

SEQ ID NO: 160516 - DNA, 103 bp, Artificial Sequence
  Synthetic Polynucleotide
taatacgactcactataggggcgctccaggaactcggccgcctgcagcagaacagaggagactgctgatggcggccgagaacctggcggcagcgcaaaagatg

SEQ ID NO: 160517 - DNA, 103 bp, Artificial Sequence
  Synthetic Polynucleotide
taatacgactcactatagggcagcccccggagctgctccagctgccgctgaacagaggagacagcggatgctggagcagaacctggcggcagcgcaaaagatg

SEQ ID NO: 160518 - DNA, 103 bp, Artificial Sequence
  Synthetic Polynucleotide
taatacgactcactatagggccgcccctgccagcccccggagctgctccaaacagaggagatggagcatgtccgggggcaacctggcggcagcgcaaaagatg

SEQ ID NO: 160519 - DNA, 103 bp, Artificial Sequence
  Synthetic Polynucleotide
taatacgactcactatagggtcccgctcggccgcccctgccagcccccggaacagaggagaccggggatgggcaggggcaacctggcggcagcgcaaaagatg

SEQ ID NO: 160520 - DNA, 103 bp, Artificial Sequence
  Synthetic Polynucleotide
taatacgactcactatagggccgcagccgctcccgctcggccgcccctgcaacagaggagagcagggatggccgagcggaacctggcggcagcgcaaaagatg

SEQ ID NO: 160521 - DNA, 103 bp, Artificial Sequence
  Synthetic Polynucleotide
taatacgactcactataggggactgtccgcccgcagccgctcccgctcggaacagaggagaccgagcatgagcggctgcaacctggcggcagcgcaaaagatg

SEQ ID NO: 160522 - DNA, 103 bp, Artificial Sequence
  Synthetic Polynucleotide
taatacgactcactataggggaggagtccagactgtccgcccgcagccgcaacagaggagagcggctatgggcggacagaacctggcggcagcgcaaaagatg

SEQ ID NO: 160523 - DNA, 103 bp, Artificial Sequence
  Synthetic Polynucleotide
taatacgactcactatagggggagaggcctgaggagtccagactgtccgcaacagaggagagcggacatgctggactccaacctggcggcagcgcaaaagatg

SEQ ID NO: 160524 - DNA, 103 bp, Artificial Sequence
  Synthetic Polynucleotide
taatacgactcactatagggagcgctcagaggagaggcctgaggagtccaaacagaggagatggactatgcaggcctctaacctggcggcagcgcaaaagatg

SEQ ID NO: 160525 - DNA, 103 bp, Artificial Sequence
  Synthetic Polynucleotide
taatacgactcactatagggtctgagtctgagcgctcagaggagaggcctaacagaggagaaggcctatgctctgagcgaacctggcggcagcgcaaaagatg

SEQ ID NO: 160526 - DNA, 103 bp, Artificial Sequence
  Synthetic Polynucleotide
taatacgactcactatagggctcctcttggtctgagtctgagcgctcagaaacagaggagatctgagatgtcagactcaaacctggcggcagcgcaaaagatg

SEQ ID NO: 160527 - DNA, 103 bp, Artificial Sequence
  Synthetic Polynucleotide
taatacgactcactatagggctctctcacggcgctccaggaactcggccgaacagaggagacggccgatgtcctggagcaacctggcggcagcgcaaaagatg

SEQ ID NO: 160528 - DNA, 103 bp, Artificial Sequence
  Synthetic Polynucleotide
taatacgactcactatagggccacctccagctcctcttggtctgagtctgaacagaggagacagactatgaccaagaggaacctggcggcagcgcaaaagatg

SEQ ID NO: 160529 - DNA, 103 bp, Artificial Sequence
  Synthetic Polynucleotide
taatacgactcactatagggctctccacatccacctccagctcctcttggaacagaggagaccaagaatggctggaggtaacctggcggcagcgcaaaagatg

SEQ ID NO: 160530 - DNA, 103 bp, Artificial Sequence
  Synthetic Polynucleotide
taatacgactcactatagggaaacaccaggctctccacatccacctccagaacagaggagactggagatggatgtggagaacctggcggcagcgcaaaagatg

SEQ ID NO: 160531 - DNA, 103 bp, Artificial Sequence
  Synthetic Polynucleotide
taatacgactcactatagggcctcacccccaaacaccaggctctccacataacagaggagaatgtggatggcctggtgtaacctggcggcagcgcaaaagatg

SEQ ID NO: 160532 - DNA, 103 bp, Artificial Sequence
  Synthetic Polynucleotide
taatacgactcactatagggagcagctcggcctcacccccaaacaccaggaacagaggagacctggtatgtgggggtgaaacctggcggcagcgcaaaagatg

SEQ ID NO: 160533 - DNA, 103 bp, Artificial Sequence
  Synthetic Polynucleotide
taatacgactcactataggggaagccccgcagcagctcggcctcacccccaacagaggagagggggtatggccgagctgaacctggcggcagcgcaaaagatg

SEQ ID NO: 160534 - DNA, 103 bp, Artificial Sequence
  Synthetic Polynucleotide
taatacgactcactatagggggccggcgacgaagccccgcagcagctcggaacagaggagaccgagcatgtgcggggctaacctggcggcagcgcaaaagatg

SEQ ID NO: 160535 - DNA, 103 bp, Artificial Sequence
  Synthetic Polynucleotide
taatacgactcactatagggctgtgctcctggccggcgacgaagccccgcaacagaggagagcggggatgcgtcgccggaacctggcggcagcgcaaaagatg

SEQ ID NO: 160536 - DNA, 103 bp, Artificial Sequence
  Synthetic Polynucleotide
taatacgactcactataggggtgcgagtagctgtgctcctggccggcgacaacagaggagagtcgccatgcaggagcacaacctggcggcagcgcaaaagatg

SEQ ID NO: 160537 - DNA, 103 bp, Artificial Sequence
  Synthetic Polynucleotide
taatacgactcactatagggcgccgccgccgtgcgagtagctgtgctcctaacagaggagaaggagcatggctactcgcaacctggcggcagcgcaaaagatg

SEQ ID NO: 160538 - DNA, 103 bp, Artificial Sequence
  Synthetic Polynucleotide
taatacgactcactatagggtgctcggcctctctctcacggcgctccaggaacagaggagacctggaatgccgtgagagaacctggcggcagcgcaaaagatg

SEQ ID NO: 160539 - DNA, 103 bp, Artificial Sequence
  Synthetic Polynucleotide
taatacgactcactatagggcatagccaggcgccgccgccgtgcgagtagaacagaggagactactcatgcggcggcggaacctggcggcagcgcaaaagatg

SEQ ID NO: 160540 - DNA, 103 bp, Artificial Sequence
  Synthetic Polynucleotide
taatacgactcactatagggcgcataaccatgctcggcctctctctcacgaacagaggagacgtgagatggaggccgagaacctggcggcagcgcaaaagatg

SEQ ID NO: 160541 - DNA, 103 bp, Artificial Sequence
  Synthetic Polynucleotide
taatacgactcactatagggggcacagggacgcataaccatgctcggcctaacagaggagaaggccgatgatggttatgaacctggcggcagcgcaaaagatg

SEQ ID NO: 160542 - DNA, 103 bp, Artificial Sequence
  Synthetic Polynucleotide
taatacgactcactatagggctgcgatgcgggcacagggacgcataaccaaacagaggagatggttaatggtccctgtgaacctggcggcagcgcaaaagatg

SEQ ID NO: 160543 - DNA, 103 bp, Artificial Sequence
  Synthetic Polynucleotide
taatacgactcactatagggctgcacgttgatcatcttcacccgctccataacagaggagaatggagatggtgaagatgaacctggcggcagcgcaaaagatg

SEQ ID NO: 160544 - DNA, 103 bp, Artificial Sequence
  Synthetic Polynucleotide
taatacgactcactatagggggggctcggcatggacgggaatgaagaggcaacagaggagagcctctatgttcccgtccaacctggcggcagcgcaaaagatg

SEQ ID NO: 160545 - DNA, 103 bp, Artificial Sequence
  Synthetic Polynucleotide
taatacgactcactataggggctgcagtcgggggctcggcatggacgggaaacagaggagatcccgtatgtgccgagccaacctggcggcagcgcaaaagatg

SEQ ID NO: 160546 - DNA, 103 bp, Artificial Sequence
  Synthetic Polynucleotide
taatacgactcactatagggggctttgaatgctgcagtcgggggctcggcaacagaggagagccgagatgccgactgcaaacctggcggcagcgcaaaagatg

SEQ ID NO: 160547 - DNA, 103 bp, Artificial Sequence
  Synthetic Polynucleotide
taatacgactcactatagggcctccgtgggggctttgaatgctgcagtcgaacagaggagacgactgatgcattcaaagaacctggcggcagcgcaaaagatg

SEQ ID NO: 160548 - DNA, 103 bp, Artificial Sequence
  Synthetic Polynucleotide
taatacgactcactatagggcccggctcaacctccgtgggggctttgaataacagaggagaattcaaatgccccacggaaacctggcggcagcgcaaaagatg

SEQ ID NO: 160549 - DNA, 103 bp, Artificial Sequence
  Synthetic Polynucleotide
taatacgactcactatagggtgtttctgtgcccggctcaacctccgtgggaacagaggagacccacgatggttgagccgaacctggcggcagcgcaaaagatg

SEQ ID NO: 160550 - DNA, 103 bp, Artificial Sequence
  Synthetic Polynucleotide
taatacgactcactatagggcccgctgctgtgtttctgtgcccggctcaaaacagaggagattgagcatggcacagaaaaacctggcggcagcgcaaaagatg

SEQ ID NO: 160551 - DNA, 103 bp, Artificial Sequence
  Synthetic Polynucleotide
taatacgactcactatagggtgttgctgctcccgctgctgtgtttctgtgaacagaggagacacagaatgacagcagcgaacctggcggcagcgcaaaagatg

SEQ ID NO: 160552 - DNA, 103 bp, Artificial Sequence
  Synthetic Polynucleotide
taatacgactcactataggggcagtgctggtgttgctgctcccgctgctgaacagaggagacagcagatggagcagcaaaacctggcggcagcgcaaaagatg

SEQ ID NO: 160553 - DNA, 103 bp, Artificial Sequence
  Synthetic Polynucleotide
taatacgactcactatagggagatctgttggcagtgctggtgttgctgctaacagaggagaagcagcatgaccagcactaacctggcggcagcgcaaaagatg

SEQ ID NO: 160554 - DNA, 103 bp, Artificial Sequence
  Synthetic Polynucleotide
taatacgactcactatagggccagcagacgctgcacgttgatcatcttcaaacagaggagatgaagaatgtcaacgtgcaacctggcggcagcgcaaaagatg

SEQ ID NO: 160555 - DNA, 103 bp, Artificial Sequence
  Synthetic Polynucleotide
taatacgactcactatagggcattgtgtgtagatctgttggcagtgctggaacagaggagaccagcaatgccaacagataacctggcggcagcgcaaaagatg

SEQ ID NO: 160556 - DNA, 103 bp, Artificial Sequence
  Synthetic Polynucleotide
taatacgactcactatagggttttccagctcattgtgtgtagatctgttgaacagaggagacaacagatgtacacacaaaacctggcggcagcgcaaaagatg

SEQ ID NO: 160557 - DNA, 103 bp, Artificial Sequence
  Synthetic Polynucleotide
taatacgactcactatagggtcgtcgattcttttccagctcattgtgtgtaacagaggagaacacacatggagctggaaaacctggcggcagcgcaaaagatg

SEQ ID NO: 160558 - DNA, 103 bp, Artificial Sequence
  Synthetic Polynucleotide
taatacgactcactataggggcagatgagctcgtcgattcttttccagctaacagaggagaagctggatgagaatcgacaacctggcggcagcgcaaaagatg

SEQ ID NO: 160559 - DNA, 103 bp, Artificial Sequence
  Synthetic Polynucleotide
taatacgactcactatagggaaacaaaggcgcagatgagctcgtcgattcaacagaggagagaatcgatgagctcatctaacctggcggcagcgcaaaagatg

SEQ ID NO: 160560 - DNA, 103 bp, Artificial Sequence
  Synthetic Polynucleotide
taatacgactcactatagggtaagcgttctaaacaaaggcgcagatgagcaacagaggagagctcatatgcgcctttgtaacctggcggcagcgcaaaagatg

SEQ ID NO: 160561 - DNA, 103 bp, Artificial Sequence
  Synthetic Polynucleotide
taatacgactcactatagggtcagaacttttaagcgttctaaacaaaggcaacagaggagagcctttatgtagaacgctaacctggcggcagcgcaaaagatg

SEQ ID NO: 160562 - DNA, 103 bp, Artificial Sequence
  Synthetic Polynucleotide
taatacgactcactatagggcctagtggaatcagaacttttaagcgttctaacagaggagaagaacgatgaaaagttctaacctggcggcagcgcaaaagatg

SEQ ID NO: 160563 - DNA, 103 bp, Artificial Sequence
  Synthetic Polynucleotide
taatacgactcactataggggcagtctggtcctagtggaatcagaactttaacagaggagaaaagttatgattccactaaacctggcggcagcgcaaaagatg

SEQ ID NO: 160564 - DNA, 103 bp, Artificial Sequence
  Synthetic Polynucleotide
taatacgactcactatagggtgtgccgggtgcagtctggtcctagtggaaaacagaggagattccacatggaccagactaacctggcggcagcgcaaaagatg

SEQ ID NO: 160565 - DNA, 103 bp, Artificial Sequence
  Synthetic Polynucleotide
taatacgactcactatagggtcggcagcctccagcagacgctgcacgttgaacagaggagacaacgtatggcgtctgctaacctggcggcagcgcaaaagatg

SEQ ID NO: 160566 - DNA, 103 bp, Artificial Sequence
  Synthetic Polynucleotide
taatacgactcactatagggccaagtgttgtgtgccgggtgcagtctggtaacagaggagaaccagaatgcacccggcaaacctggcggcagcgcaaaagatg

SEQ ID NO: 160567 - DNA, 103 bp, Artificial Sequence
  Synthetic Polynucleotide
taatacgactcactataggggttgagcaaaccaagtgttgtgtgccgggtaacagaggagaacccggatgacaacacttaacctggcggcagcgcaaaagatg

SEQ ID NO: 160568 - DNA, 103 bp, Artificial Sequence
  Synthetic Polynucleotide
taatacgactcactatagggctttggctttgttgagcaaaccaagtgttgaacagaggagacaacacatggtttgctcaaacctggcggcagcgcaaaagatg

SEQ ID NO: 160569 - DNA, 103 bp, Artificial Sequence
  Synthetic Polynucleotide
taatacgactcactatagggttgatgtgtgctttggctttgttgagcaaaaacagaggagatttgctatgcaaagccaaaacctggcggcagcgcaaaagatg

SEQ ID NO: 160570 - DNA, 103 bp, Artificial Sequence
  Synthetic Polynucleotide
taatacgactcactatagggttcaagtttcttgatgtgtgctttggctttaacagaggagaaaagccatggcacacatcaacctggcggcagcgcaaaagatg

SEQ ID NO: 160571 - DNA, 103 bp, Artificial Sequence
  Synthetic Polynucleotide
taatacgactcactatagggtttcagcttcttcaagtttcttgatgtgtgaacagaggagacacacaatgagaaacttgaacctggcggcagcgcaaaagatg

SEQ ID NO: 160572 - DNA, 103 bp, Artificial Sequence
  Synthetic Polynucleotide
taatacgactcactatagggtggctttttctttcagcttcttcaagtttcaacagaggagagaaactatgagaagctgaaacctggcggcagcgcaaaagatg

SEQ ID NO: 160573 - DNA, 103 bp, Artificial Sequence
  Synthetic Polynucleotide
taatacgactcactataggggagctggtgctggctttttctttcagcttcaacagaggagagaagctatgagaaaaagcaacctggcggcagcgcaaaagatg

SEQ ID NO: 160574 - DNA, 103 bp, Artificial Sequence
  Synthetic Polynucleotide
taatacgactcactatagggccaaattctcgagctggtgctggctttttcaacagaggagagaaaaaatgagcaccagcaacctggcggcagcgcaaaagatg

SEQ ID NO: 160575 - DNA, 103 bp, Artificial Sequence
  Synthetic Polynucleotide
taatacgactcactatagggtgttctcgttccaaattctcgagctggtgcaacagaggagagcaccaatgcgagaatttaacctggcggcagcgcaaaagatg

SEQ ID NO: 160576 - DNA, 103 bp, Artificial Sequence
  Synthetic Polynucleotide
taatacgactcactatagggctccaaaaactcggcagcctccagcagacgaacagaggagacgtctgatggaggctgccaacctggcggcagcgcaaaagatg

SEQ ID NO: 160577 - DNA, 103 bp, Artificial Sequence
  Synthetic Polynucleotide
taatacgactcactatagggtaaaaatctctgttctcgttccaaattctcaacagaggagagagaatatggaacgagaaaacctggcggcagcgcaaaagatg

SEQ ID NO: 160578 - DNA, 103 bp, Artificial Sequence
  Synthetic Polynucleotide
taatacgactcactataggggtcgccactttaaaaatctctgttctcgttaacagaggagaaacgagatgagagattttaacctggcggcagcgcaaaagatg

SEQ ID NO: 160579 - DNA, 103 bp, Artificial Sequence
  Synthetic Polynucleotide
taatacgactcactatagggagctgttccagtcgccactttaaaaatctcaacagaggagagagattatgaaagtggcgaacctggcggcagcgcaaaagatg

SEQ ID NO: 160580 - DNA, 103 bp, Artificial Sequence
  Synthetic Polynucleotide
taatacgactcactatagggaggaccctgcagctgttccagtcgccacttaacagaggagaaagtggatgctggaacagaacctggcggcagcgcaaaagatg

SEQ ID NO: 160581 - DNA, 103 bp, Artificial Sequence
  Synthetic Polynucleotide
taatacgactcactatagggccatctcctgaggaccctgcagctgttccaaacagaggagatggaacatgtgcagggtcaacctggcggcagcgcaaaagatg

SEQ ID NO: 160582 - DNA, 103 bp, Artificial Sequence
  Synthetic Polynucleotide
taatacgactcactatagggcgtattcgttccatctcctgaggaccctgcaacagaggagagcagggatgtcaggagataacctggcggcagcgcaaaagatg

SEQ ID NO: 160583 - DNA, 103 bp, Artificial Sequence
  Synthetic Polynucleotide
taatacgactcactataggggctgtccattcgtattcgttccatctcctgaacagaggagacaggagatggaacgaataaacctggcggcagcgcaaaagatg

SEQ ID NO: 160584 - DNA, 103 bp, Artificial Sequence
  Synthetic Polynucleotide
taatacgactcactatagggttgatccaatgctgtccattcgtattcgttaacagaggagaaacgaaatggaatggacaaacctggcggcagcgcaaaagatg

SEQ ID NO: 160585 - DNA, 103 bp, Artificial Sequence
  Synthetic Polynucleotide
taatacgactcactataggggaagaaatagttgatccaatgctgtccattaacagaggagaaatggaatgcattggatcaacctggcggcagcgcaaaagatg

SEQ ID NO: 160586 - DNA, 103 bp, Artificial Sequence
  Synthetic Polynucleotide
taatacgactcactatagggagaacgatctgaagaaatagttgatccaataacagaggagaattggaatgactatttctaacctggcggcagcgcaaaagatg

SEQ ID NO: 160587 - DNA, 103 bp, Artificial Sequence
  Synthetic Polynucleotide
taatacgactcactataggggctcccggcgctccaaaaactcggcagcctaacagaggagaaggctgatgagtttttggaacctggcggcagcgcaaaagatg

SEQ ID NO: 160588 - DNA, 103 bp, Artificial Sequence
  Synthetic Polynucleotide
taatacgactcactataggggctctgaatcagaacgatctgaagaaatagaacagaggagactatttatgcagatcgttaacctggcggcagcgcaaaagatg

SEQ ID NO: 160589 - DNA, 103 bp, Artificial Sequence
  Synthetic Polynucleotide
taatacgactcactatagggatctcctctcgctctgaatcagaacgatctaacagaggagaagatcgatgtgattcagaaacctggcggcagcgcaaaagatg

SEQ ID NO: 160590 - DNA, 103 bp, Artificial Sequence
  Synthetic Polynucleotide
taatacgactcactatagggatccacttcaatctcctctcgctctgaatcaacagaggagagattcaatgcgagaggagaacctggcggcagcgcaaaagatg

SEQ ID NO: 160591 - DNA, 103 bp, Artificial Sequence
  Synthetic Polynucleotide
taatacgactcactatagggtgctttcaacatccacttcaatctcctctcaacagaggagagagaggatgttgaagtggaacctggcggcagcgcaaaagatg

SEQ ID NO: 160592 - DNA, 103 bp, Artificial Sequence
  Synthetic Polynucleotide
taatacgactcactataggggagaactctgtgctttcaacatccacttcaaacagaggagatgaagtatgtgttgaaagaacctggcggcagcgcaaaagatg

SEQ ID NO: 160593 - DNA, 103 bp, Artificial Sequence
  Synthetic Polynucleotide
taatacgactcactatagggttctccatgggagaactctgtgctttcaacaacagaggagagttgaaatgacagagttcaacctggcggcagcgcaaaagatg

SEQ ID NO: 160594 - DNA, 103 bp, Artificial Sequence
  Synthetic Polynucleotide
taatacgactcactatagggtattgtccacttctccatgggagaactctgaacagaggagacagagtatgcccatggagaacctggcggcagcgcaaaagatg

SEQ ID NO: 160595 - DNA, 103 bp, Artificial Sequence
  Synthetic Polynucleotide
taatacgactcactataggggtggtacttatattgtccacttctccatggaacagaggagaccatggatgagtggacaaaacctggcggcagcgcaaaagatg

SEQ ID NO: 160596 - DNA, 103 bp, Artificial Sequence
  Synthetic Polynucleotide
taatacgactcactatagggactgatgctggtggtacttatattgtccacaacagaggagagtggacatgataagtaccaacctggcggcagcgcaaaagatg

SEQ ID NO: 160597 - DNA, 103 bp, Artificial Sequence
  Synthetic Polynucleotide
taatacgactcactatagggcatcaatgtcactgatgctggtggtacttaaacagaggagataagtaatgccagcatcaaacctggcggcagcgcaaaagatg

SEQ ID NO: 160598 - DNA, 103 bp, Artificial Sequence
  Synthetic Polynucleotide
taatacgactcactatagggtcacactctcgctcccggcgctccaaaaacaacagaggagagtttttatggcgccgggaaacctggcggcagcgcaaaagatg

SEQ ID NO: 160599 - DNA, 103 bp, Artificial Sequence
  Synthetic Polynucleotide
taatacgactcactatagggctgctgtggtcatcaatgtcactgatgctgaacagaggagacagcatatgtgacattgaaacctggcggcagcgcaaaagatg

SEQ ID NO: 160600 - DNA, 103 bp, Artificial Sequence
  Synthetic Polynucleotide
taatacgactcactatagggactcggcaggctgctgtggtcatcaatgtcaacagaggagagacattatggaccacagcaacctggcggcagcgcaaaagatg

SEQ ID NO: 160601 - DNA, 103 bp, Artificial Sequence
  Synthetic Polynucleotide
taatacgactcactatagggcactcccaatactcggcaggctgctgtggtaacagaggagaaccacaatggcctgccgaaacctggcggcagcgcaaaagatg

SEQ ID NO: 160602 - DNA, 103 bp, Artificial Sequence
  Synthetic Polynucleotide
taatacgactcactatagggtaaccctcgtcactcccaatactcggcaggaacagaggagacctgccatgtattgggagaacctggcggcagcgcaaaagatg

SEQ ID NO: 160603 - DNA, 103 bp, Artificial Sequence
  Synthetic Polynucleotide
taatacgactcactatagggggcactggagtaaccctcgtcactcccaataacagaggagaattgggatggacgagggtaacctggcggcagcgcaaaagatg

SEQ ID NO: 160604 - DNA, 103 bp, Artificial Sequence
  Synthetic Polynucleotide
taatacgactcactataggggtttgacactggcactggagtaaccctcgtaacagaggagaacgaggatgactccagtgaacctggcggcagcgcaaaagatg

SEQ ID NO: 160605 - DNA, 103 bp, Artificial Sequence
  Synthetic Polynucleotide
taatacgactcactataggggtgaatgaaagtttgacactggcactggagaacagaggagactccagatgcagtgtcaaaacctggcggcagcgcaaaagatg

SEQ ID NO: 160606 - DNA, 103 bp, Artificial Sequence
  Synthetic Polynucleotide
taatacgactcactataggggtagccatgttcacactctcgctcccggcgaacagaggagacgccggatgcgagagtgtaacctggcggcagcgcaaaagatg

SEQ ID NO: 160607 - DNA, 103 bp, Artificial Sequence
  Synthetic Polynucleotide
taatacgactcactatagggatgaagaggcgtagccatgttcacactctcaacagaggagagagagtatgaacatggctaacctggcggcagcgcaaaagatg

SEQ ID NO: 160608 - DNA, 103 bp, Artificial Sequence
  Synthetic Polynucleotide
taatacgactcactatagggatggacgggaatgaagaggcgtagccatgtaacagaggagaacatggatgcgcctcttcaacctggcggcagcgcaaaagatg

SEQ ID NO: 160609 - DNA, 103 bp, Artificial Sequence
  Synthetic Polynucleotide
taatacgactcactatagggatatatgctgtgccggggtcttcgggccataacagaggagaatggccatgagaccccggaacctggcggcagcgcaaaagatg

SEQ ID NO: 160610 - DNA, 103 bp, Artificial Sequence
  Synthetic Polynucleotide
taatacgactcactatagggtttccccaagtgacgctttccagacttgggaacagaggagacccaagatgggaaagcgtaacctggcggcagcgcaaaagatg

SEQ ID NO: 160611 - DNA, 103 bp, Artificial Sequence
  Synthetic Polynucleotide
taatacgactcactatagggtccatgaggtctggtgtggtcggcaatggtaacagaggagaaccattatggaccacaccaacctggcggcagcgcaaaagatg

SEQ ID NO: 160612 - DNA, 103 bp, Artificial Sequence
  Synthetic Polynucleotide
taatacgactcactataggggtgcactgtctccatgaggtctggtgtggtaacagaggagaaccacaatggacctcatgaacctggcggcagcgcaaaagatg

SEQ ID NO: 160613 - DNA, 103 bp, Artificial Sequence
  Synthetic Polynucleotide
taatacgactcactatagggcaggaaacaggtgcactgtctccatgaggtaacagaggagaacctcaatgagacagtgcaacctggcggcagcgcaaaagatg

SEQ ID NO: 160614 - DNA, 103 bp, Artificial Sequence
  Synthetic Polynucleotide
taatacgactcactatagggttctcccaaacaggaaacaggtgcactgtcaacagaggagagacagtatgcctgtttccaacctggcggcagcgcaaaagatg

SEQ ID NO: 160615 - DNA, 103 bp, Artificial Sequence
  Synthetic Polynucleotide
taatacgactcactatagggtggagtggtgttctcccaaacaggaaacagaacagaggagactgtttatggtttgggagaacctggcggcagcgcaaaagatg

SEQ ID NO: 160616 - DNA, 103 bp, Artificial Sequence
  Synthetic Polynucleotide
taatacgactcactatagggagagatggagtggagtggtgttctcccaaaaacagaggagatttgggatgacaccactcaacctggcggcagcgcaaaagatg

SEQ ID NO: 160617 - DNA, 103 bp, Artificial Sequence
  Synthetic Polynucleotide
taatacgactcactatagggatccgctggcagagatggagtggagtggtgaacagaggagacaccacatgactccatctaacctggcggcagcgcaaaagatg

SEQ ID NO: 160618 - DNA, 103 bp, Artificial Sequence
  Synthetic Polynucleotide
taatacgactcactataggggggagccaggatccgctggcagagatggagaacagaggagactccatatgtgccagcggaacctggcggcagcgcaaaagatg

SEQ ID NO: 160619 - DNA, 103 bp, Artificial Sequence
  Synthetic Polynucleotide
taatacgactcactatagggtcttcaggtagggagccaggatccgctggcaacagaggagagccagcatgtcctggctcaacctggcggcagcgcaaaagatg

SEQ ID NO: 160620 - DNA, 103 bp, Artificial Sequence
  Synthetic Polynucleotide
taatacgactcactatagggcgaggcgctttcttcaggtagggagccaggaacagaggagacctggcatgctacctgaaaacctggcggcagcgcaaaagatg

SEQ ID NO: 160621 - DNA, 103 bp, Artificial Sequence
  Synthetic Polynucleotide
taatacgactcactatagggtccaccttgttttccccaagtgacgctttcaacagaggagagaaagcatgacttggggaaacctggcggcagcgcaaaagatg

SEQ ID NO: 160622 - DNA, 103 bp, Artificial Sequence
  Synthetic Polynucleotide
taatacgactcactatagggaccttgctggcgaggcgctttcttcaggtaaacagaggagatacctgatgaaagcgcctaacctggcggcagcgcaaaagatg

SEQ ID NO: 160623 - DNA, 103 bp, Artificial Sequence
  Synthetic Polynucleotide
taatacgactcactatagggacgatcatgcaccttgctggcgaggcgcttaacagaggagaaagcgcatggccagcaagaacctggcggcagcgcaaaagatg

SEQ ID NO: 160624 - DNA, 103 bp, Artificial Sequence
  Synthetic Polynucleotide
taatacgactcactataggggccctggtggacgatcatgcaccttgctggaacagaggagaccagcaatgtgcatgatcaacctggcggcagcgcaaaagatg

SEQ ID NO: 160625 - DNA, 103 bp, Artificial Sequence
  Synthetic Polynucleotide
taatacgactcactatagggccagaatggtgccctggtggacgatcatgcaacagaggagagcatgaatgtccaccaggaacctggcggcagcgcaaaagatg

SEQ ID NO: 160626 - DNA, 103 bp, Artificial Sequence
  Synthetic Polynucleotide
taatacgactcactatagggttaacattatccagaatggtgccctggtggaacagaggagaccaccaatgcaccattctaacctggcggcagcgcaaaagatg

SEQ ID NO: 160627 - DNA, 103 bp, Artificial Sequence
  Synthetic Polynucleotide
taatacgactcactatagggtaagaggttcttaacattatccagaatggtaacagaggagaaccattatggataatgttaacctggcggcagcgcaaaagatg

SEQ ID NO: 160628 - DNA, 103 bp, Artificial Sequence
  Synthetic Polynucleotide
taatacgactcactatagggctgcaaattctaagaggttcttaacattataacagaggagaataatgatgagaacctctaacctggcggcagcgcaaaagatg

SEQ ID NO: 160629 - DNA, 103 bp, Artificial Sequence
  Synthetic Polynucleotide
taatacgactcactatagggtggagtgtttctgcaaattctaagaggttcaacagaggagagaacctatgagaatttgcaacctggcggcagcgcaaaagatg

SEQ ID NO: 160630 - DNA, 103 bp, Artificial Sequence
  Synthetic Polynucleotide
taatacgactcactatagggatctataaattggagtgtttctgcaaattcaacagaggagagaatttatggaaacactcaacctggcggcagcgcaaaagatg

SEQ ID NO: 160631 - DNA, 103 bp, Artificial Sequence
  Synthetic Polynucleotide
taatacgactcactatagggaagaatcagaatctataaattggagtgtttaacagaggagaaaacacatgaatttatagaacctggcggcagcgcaaaagatg

SEQ ID NO: 160632 - DNA, 103 bp, Artificial Sequence
  Synthetic Polynucleotide
taatacgactcactatagggtcttcccgggtccaccttgttttccccaagaacagaggagacttgggatgaacaaggtgaacctggcggcagcgcaaaagatg

SEQ ID NO: 160633 - DNA, 103 bp, Artificial Sequence
  Synthetic Polynucleotide
taatacgactcactatagggcaccatgatgaagaatcagaatctataaataacagaggagaatttatatgttctgattcaacctggcggcagcgcaaaagatg

SEQ ID NO: 160634 - DNA, 103 bp, Artificial Sequence
  Synthetic Polynucleotide
taatacgactcactataggggctgagatcacaccatgatgaagaatcagaaacagaggagatctgatatgtcatcatggaacctggcggcagcgcaaaagatg

SEQ ID NO: 160635 - DNA, 103 bp, Artificial Sequence
  Synthetic Polynucleotide
taatacgactcactatagggattcaaaactgctgagatcacaccatgatgaacagaggagacatcatatggtgatctcaaacctggcggcagcgcaaaagatg

SEQ ID NO: 160636 - DNA, 103 bp, Artificial Sequence
  Synthetic Polynucleotide
taatacgactcactatagggtcttcaaagaattcaaaactgctgagatcaaacagaggagatgatctatgcagttttgaaacctggcggcagcgcaaaagatg

SEQ ID NO: 160637 - DNA, 103 bp, Artificial Sequence
  Synthetic Polynucleotide
taatacgactcactatagggaaaatctgcttcttcaaagaattcaaaactaacagaggagaagttttatgttctttgaaaacctggcggcagcgcaaaagatg

SEQ ID NO: 160638 - DNA, 103 bp, Artificial Sequence
  Synthetic Polynucleotide
taatacgactcactatagggggctaggtgaaaaatctgcttcttcaaagaaacagaggagatctttgatgaagcagattaacctggcggcagcgcaaaagatg

SEQ ID NO: 160639 - DNA, 103 bp, Artificial Sequence
  Synthetic Polynucleotide
taatacgactcactataggggtgtgatgttggctaggtgaaaaatctgctaacagaggagaagcagaatgttcacctagaacctggcggcagcgcaaaagatg

SEQ ID NO: 160640 - DNA, 103 bp, Artificial Sequence
  Synthetic Polynucleotide
taatacgactcactatagggggctttgcctgtgtgatgttggctaggtgaaacagaggagatcacctatgcaacatcacaacctggcggcagcgcaaaagatg

SEQ ID NO: 160641 - DNA, 103 bp, Artificial Sequence
  Synthetic Polynucleotide
taatacgactcactataggggaagctgtagggctttgcctgtgtgatgttaacagaggagaaacatcatgcaggcaaagaacctggcggcagcgcaaaagatg

SEQ ID NO: 160642 - DNA, 103 bp, Artificial Sequence
  Synthetic Polynucleotide
taatacgactcactatagggtctctttgctgaagctgtagggctttgcctaacagaggagaaggcaaatgcctacagctaacctggcggcagcgcaaaagatg

SEQ ID NO: 160643 - DNA, 103 bp, Artificial Sequence
  Synthetic Polynucleotide
taatacgactcactatagggtttttcatcctcttcccgggtccaccttgtaacagaggagaacaaggatgacccgggaaaacctggcggcagcgcaaaagatg

SEQ ID NO: 160644 - DNA, 103 bp, Artificial Sequence
  Synthetic Polynucleotide
taatacgactcactatagggcccattgccctctctttgctgaagctgtagaacagaggagactacagatgcagcaaagaaacctggcggcagcgcaaaagatg

SEQ ID NO: 160645 - DNA, 103 bp, Artificial Sequence
  Synthetic Polynucleotide
taatacgactcactatagggcaggtttagtcccattgccctctctttgctaacagaggagaagcaaaatgagggcaatgaacctggcggcagcgcaaaagatg

SEQ ID NO: 160646 - DNA, 103 bp, Artificial Sequence
  Synthetic Polynucleotide
taatacgactcactatagggggttctcctgcaggtttagtcccattgcccaacagaggagagggcaaatggactaaaccaacctggcggcagcgcaaaagatg

SEQ ID NO: 160647 - DNA, 103 bp, Artificial Sequence
  Synthetic Polynucleotide
taatacgactcactatagggccttgggctaggttctcctgcaggtttagtaacagaggagaactaaaatggcaggagaaaacctggcggcagcgcaaaagatg

SEQ ID NO: 160648 - DNA, 103 bp, Artificial Sequence
  Synthetic Polynucleotide
taatacgactcactataggggtttgttcacccttgggctaggttctcctgaacagaggagacaggagatgctagcccaaaacctggcggcagcgcaaaagatg

SEQ ID NO: 160649 - DNA, 103 bp, Artificial Sequence
  Synthetic Polynucleotide
taatacgactcactatagggctcaacatacgtttgttcacccttgggctaaacagaggagatagcccatgggtgaacaaaacctggcggcagcgcaaaagatg

SEQ ID NO: 160650 - DNA, 103 bp, Artificial Sequence
  Synthetic Polynucleotide
taatacgactcactatagggtgaactctcactcaacatacgtttgttcacaacagaggagagtgaacatgcgtatgttgaacctggcggcagcgcaaaagatg

SEQ ID NO: 160651 - DNA, 103 bp, Artificial Sequence
  Synthetic Polynucleotide
taatacgactcactataggggtgggtcaagtgaactctcactcaacatacaacagaggagagtatgtatggtgagagttaacctggcggcagcgcaaaagatg

SEQ ID NO: 160652 - DNA, 103 bp, Artificial Sequence
  Synthetic Polynucleotide
taatacgactcactatagggaagaccttgggtgggtcaagtgaactctcaaacagaggagatgagagatgacttgacccaacctggcggcagcgcaaaagatg

SEQ ID NO: 160653 - DNA, 103 bp, Artificial Sequence
  Synthetic Polynucleotide
taatacgactcactatagggtgcaggaggtaagaccttgggtgggtcaagaacagaggagacttgacatgcccaaggtcaacctggcggcagcgcaaaagatg

SEQ ID NO: 160654 - DNA, 103 bp, Artificial Sequence
  Synthetic Polynucleotide
taatacgactcactataggggcttcttcagtttttcatcctcttcccgggaacagaggagacccgggatgaggatgaaaaacctggcggcagcgcaaaagatg

SEQ ID NO: 160655 - DNA, 103 bp, Artificial Sequence
  Synthetic Polynucleotide
taatacgactcactatagggtgctgtgccttgcaggaggtaagaccttggaacagaggagaccaaggatgtacctcctgaacctggcggcagcgcaaaagatg

SEQ ID NO: 160656 - DNA, 103 bp, Artificial Sequence
  Synthetic Polynucleotide
taatacgactcactatagggagtggaattgtgctgtgccttgcaggaggtaacagaggagaacctccatgaaggcacagaacctggcggcagcgcaaaagatg

SEQ ID NO: 160657 - DNA, 103 bp, Artificial Sequence
  Synthetic Polynucleotide
taatacgactcactatagggaaggatgaccagtggaattgtgctgtgcctaacagaggagaaggcacatgacaattccaaacctggcggcagcgcaaaagatg

SEQ ID NO: 160658 - DNA, 103 bp, Artificial Sequence
  Synthetic Polynucleotide
taatacgactcactataggggtttttttcgaaggatgaccagtggaattgaacagaggagacaattcatgtggtcatccaacctggcggcagcgcaaaagatg

SEQ ID NO: 160659 - DNA, 103 bp, Artificial Sequence
  Synthetic Polynucleotide
taatacgactcactataggggcctggccccgtttttttcgaaggatgaccaacagaggagaggtcatatgtcgaaaaaaaacctggcggcagcgcaaaagatg

SEQ ID NO: 160660 - DNA, 103 bp, Artificial Sequence
  Synthetic Polynucleotide
taatacgactcactatagggtaaggggctggcctggccccgtttttttcgaacagaggagacgaaaaatgcggggccagaacctggcggcagcgcaaaagatg

SEQ ID NO: 160661 - DNA, 103 bp, Artificial Sequence
  Synthetic Polynucleotide
taatacgactcactatagggctccagtggctaaggggctggcctggccccaacagaggagaggggccatgccagcccctaacctggcggcagcgcaaaagatg

SEQ ID NO: 160662 - DNA, 103 bp, Artificial Sequence
  Synthetic Polynucleotide
taatacgactcactataggggagctacagtctccagtggctaaggggctgaacagaggagacagcccatgagccactggaacctggcggcagcgcaaaagatg

SEQ ID NO: 160663 - DNA, 103 bp, Artificial Sequence
  Synthetic Polynucleotide
taatacgactcactatagggaaatatgaaggagctacagtctccagtggcaacagaggagagccactatggactgtagcaacctggcggcagcgcaaaagatg

SEQ ID NO: 160664 - DNA, 103 bp, Artificial Sequence
  Synthetic Polynucleotide
taatacgactcactatagggtgacgtcagcaaatatgaaggagctacagtaacagaggagaactgtaatgccttcatataacctggcggcagcgcaaaagatg

SEQ ID NO: 160665 - DNA, 103 bp, Artificial Sequence
  Synthetic Polynucleotide
taatacgactcactatagggtgttccaccagcttcttcagtttttcatccaacagaggagaggatgaatgactgaagaaaacctggcggcagcgcaaaagatg

SEQ ID NO: 160666 - DNA, 103 bp, Artificial Sequence
  Synthetic Polynucleotide
taatacgactcactataggggttgaactgctgacgtcagcaaatatgaagaacagaggagacttcatatgtgctgacgtaacctggcggcagcgcaaaagatg

SEQ ID NO: 160667 - DNA, 103 bp, Artificial Sequence
  Synthetic Polynucleotide
taatacgactcactatagggacgcttgggagttgaactgctgacgtcagcaacagaggagagctgacatgagcagttcaaacctggcggcagcgcaaaagatg

SEQ ID NO: 160668 - DNA, 103 bp, Artificial Sequence
  Synthetic Polynucleotide
taatacgactcactatagggtgacaggggaacgcttgggagttgaactgcaacagaggagagcagttatgctcccaagcaacctggcggcagcgcaaaagatg

SEQ ID NO: 160669 - DNA, 103 bp, Artificial Sequence
  Synthetic Polynucleotide
taatacgactcactatagggggtaggcttttgacaggggaacgcttgggaaacagaggagatcccaaatgttcccctgtaacctggcggcagcgcaaaagatg

SEQ ID NO: 160670 - DNA, 103 bp, Artificial Sequence
  Synthetic Polynucleotide
taatacgactcactataggggggagagaagggtaggcttttgacaggggaaacagaggagatcccctatgaaaagcctaaacctggcggcagcgcaaaagatg

SEQ ID NO: 160671 - DNA, 103 bp, Artificial Sequence
  Synthetic Polynucleotide
taatacgactcactatagggagaactgcgagggagagaagggtaggctttaacagaggagaaaagccatgccttctctcaacctggcggcagcgcaaaagatg

SEQ ID NO: 160672 - DNA, 103 bp, Artificial Sequence
  Synthetic Polynucleotide
taatacgactcactataggggaagtgtttaagaactgcgagggagagaagaacagaggagacttctcatgctcgcagttaacctggcggcagcgcaaaagatg

SEQ ID NO: 160673 - DNA, 103 bp, Artificial Sequence
  Synthetic Polynucleotide
taatacgactcactatagggatggttactggaagtgtttaagaactgcgaaacagaggagatcgcagatgttaaacactaacctggcggcagcgcaaaagatg

SEQ ID NO: 160674 - DNA, 103 bp, Artificial Sequence
  Synthetic Polynucleotide
taatacgactcactatagggctgagttttcatggttactggaagtgtttaaacagaggagataaacaatgccagtaaccaacctggcggcagcgcaaaagatg

SEQ ID NO: 160675 - DNA, 103 bp, Artificial Sequence
  Synthetic Polynucleotide
taatacgactcactatagggatttccaagtctgagttttcatggttactgaacagaggagacagtaaatgtgaaaactcaacctggcggcagcgcaaaagatg

SEQ ID NO: 160676 - DNA, 103 bp, Artificial Sequence
  Synthetic Polynucleotide
taatacgactcactatagggtgttccattctgttccaccagcttcttcagaacagaggagactgaagatgctggtggaaaacctggcggcagcgcaaaagatg

SEQ ID NO: 160677 - DNA, 103 bp, Artificial Sequence
  Synthetic Polynucleotide
taatacgactcactatagggtaaagaaggcatttccaagtctgagttttcaacagaggagagaaaacatggacttggaaaacctggcggcagcgcaaaagatg

SEQ ID NO: 160678 - DNA, 103 bp, Artificial Sequence
  Synthetic Polynucleotide
taatacgactcactataggggggtggaagttaaagaaggcatttccaagtaacagaggagaacttggatgtgccttcttaacctggcggcagcgcaaaagatg

SEQ ID NO: 160679 - DNA, 103 bp, Artificial Sequence
  Synthetic Polynucleotide
taatacgactcactatagggccaatgaggggggtggaagttaaagaaggcaacagaggagagccttcatgaacttccacaacctggcggcagcgcaaaagatg

SEQ ID NO: 160680 - DNA, 103 bp, Artificial Sequence
  Synthetic Polynucleotide
taatacgactcactatagggcaatttgtgaccaatgaggggggtggaagtaacagaggagaacttccatgcccctcattaacctggcggcagcgcaaaagatg

SEQ ID NO: 160681 - DNA, 103 bp, Artificial Sequence
  Synthetic Polynucleotide
taatacgactcactatagggttgtaacagtcaatttgtgaccaatgagggaacagaggagaccctcaatggtcacaaataacctggcggcagcgcaaaagatg

SEQ ID NO: 160682 - DNA, 103 bp, Artificial Sequence
  Synthetic Polynucleotide
taatacgactcactatagggtgaaatggtgttgtaacagtcaatttgtgaaacagaggagatcacaaatggactgttacaacctggcggcagcgcaaaagatg

SEQ ID NO: 160683 - DNA, 103 bp, Artificial Sequence
  Synthetic Polynucleotide
taatacgactcactatagggctggtctctatgaaatggtgttgtaacagtaacagaggagaactgttatgacaccatttaacctggcggcagcgcaaaagatg

SEQ ID NO: 160684 - DNA, 103 bp, Artificial Sequence
  Synthetic Polynucleotide
taatacgactcactatagggttttcacagtctggtctctatgaaatggtgaacagaggagacaccatatgatagagaccaacctggcggcagcgcaaaagatg

SEQ ID NO: 160685 - DNA, 103 bp, Artificial Sequence
  Synthetic Polynucleotide
taatacgactcactatagggtccttttgagttttcacagtctggtctctaaacagaggagatagagaatggactgtgaaaacctggcggcagcgcaaaagatg

SEQ ID NO: 160686 - DNA, 103 bp, Artificial Sequence
  Synthetic Polynucleotide
taatacgactcactatagggaacagtattttccttttgagttttcacagtaacagaggagaactgtgatgactcaaaagaacctggcggcagcgcaaaagatg

SEQ ID NO: 160687 - DNA, 103 bp, Artificial Sequence
  Synthetic Polynucleotide
taatacgactcactatagggtccagtcatctgttccattctgttccaccaaacagaggagatggtggatgagaatggaaaacctggcggcagcgcaaaagatg

SEQ ID NO: 160688 - DNA, 103 bp, Artificial Sequence
  Synthetic Polynucleotide
taatacgactcactataggggggttctaaaaacagtattttccttttgagaacagaggagactcaaaatgaaaatactgaacctggcggcagcgcaaaagatg

SEQ ID NO: 160689 - DNA, 103 bp, Artificial Sequence
  Synthetic Polynucleotide
taatacgactcactatagggttgatagctggggttctaaaaacagtatttaacagaggagaaaatacatgttttagaacaacctggcggcagcgcaaaagatg

SEQ ID NO: 160690 - DNA, 103 bp, Artificial Sequence
  Synthetic Polynucleotide
taatacgactcactataggggattgaccttttgatagctggggttctaaaaacagaggagatttagaatgccagctatcaacctggcggcagcgcaaaagatg

SEQ ID NO: 160691 - DNA, 103 bp, Artificial Sequence
  Synthetic Polynucleotide
taatacgactcactatagggagctttctaagattgaccttttgatagctgaacagaggagacagctaatgaaaggtcaaaacctggcggcagcgcaaaagatg

SEQ ID NO: 160692 - DNA, 103 bp, Artificial Sequence
  Synthetic Polynucleotide
taatacgactcactataggggttcttggagagctttctaagattgaccttaacagaggagaaaggtcatgcttagaaagaacctggcggcagcgcaaaagatg

SEQ ID NO: 160693 - DNA, 103 bp, Artificial Sequence
  Synthetic Polynucleotide
taatacgactcactatagggtggtgtaggagttcttggagagctttctaaaacagaggagattagaaatgtctccaagaaacctggcggcagcgcaaaagatg

SEQ ID NO: 160694 - DNA, 103 bp, Artificial Sequence
  Synthetic Polynucleotide
taatacgactcactatagggcatgtttgaatggtgtaggagttcttggagaacagaggagactccaaatgctcctacacaacctggcggcagcgcaaaagatg

SEQ ID NO: 160695 - DNA, 103 bp, Artificial Sequence
  Synthetic Polynucleotide
taatacgactcactataggggctgcaagtgcatgtttgaatggtgtaggaaacagaggagatcctacatgattcaaacaaacctggcggcagcgcaaaagatg

SEQ ID NO: 160696 - DNA, 103 bp, Artificial Sequence
  Synthetic Polynucleotide
taatacgactcactatagggaatttcttgagctgcaagtgcatgtttgaaaacagaggagattcaaaatggcacttgcaaacctggcggcagcgcaaaagatg

SEQ ID NO: 160697 - DNA, 103 bp, Artificial Sequence
  Synthetic Polynucleotide
taatacgactcactataggggaccgtatttaatttcttgagctgcaagtgaacagaggagacacttgatgctcaagaaaaacctggcggcagcgcaaaagatg

SEQ ID NO: 160698 - DNA, 103 bp, Artificial Sequence
  Synthetic Polynucleotide
taatacgactcactataggggcaataactttccagtcatctgttccattcaacagaggagagaatggatgagatgactgaacctggcggcagcgcaaaagatg

SEQ ID NO: 160699 - DNA, 103 bp, Artificial Sequence
  Synthetic Polynucleotide
taatacgactcactatagggatcttcaggggaccgtatttaatttcttgaaacagaggagatcaagaatgtaaatacggaacctggcggcagcgcaaaagatg

SEQ ID NO: 160700 - DNA, 103 bp, Artificial Sequence
  Synthetic Polynucleotide
taatacgactcactatagggctgaggtagcatcttcaggggaccgtatttaacagaggagaaaatacatgcccctgaagaacctggcggcagcgcaaaagatg

SEQ ID NO: 160701 - DNA, 103 bp, Artificial Sequence
  Synthetic Polynucleotide
taatacgactcactataggggagagggtgtctgaggtagcatcttcagggaacagaggagaccctgaatgtgctacctcaacctggcggcagcgcaaaagatg

SEQ ID NO: 160702 - DNA, 103 bp, Artificial Sequence
  Synthetic Polynucleotide
taatacgactcactatagggtctactagatgagagggtgtctgaggtagcaacagaggagagctaccatggacaccctcaacctggcggcagcgcaaaagatg

SEQ ID NO: 160703 - DNA, 103 bp, Artificial Sequence
  Synthetic Polynucleotide
taatacgactcactatagggctgcagatcttctactagatgagagggtgtaacagaggagaacacccatgcatctagtaaacctggcggcagcgcaaaagatg

SEQ ID NO: 160704 - DNA, 103 bp, Artificial Sequence
  Synthetic Polynucleotide
taatacgactcactatagggtgatcacatcctgcagatcttctactagataacagaggagaatctagatgaagatctgcaacctggcggcagcgcaaaagatg

SEQ ID NO: 160705 - DNA, 103 bp, Artificial Sequence
  Synthetic Polynucleotide
taatacgactcactataggggattcctgtttgatcacatcctgcagatctaacagaggagaagatctatgggatgtgataacctggcggcagcgcaaaagatg

SEQ ID NO: 160706 - DNA, 103 bp, Artificial Sequence
  Synthetic Polynucleotide
taatacgactcactatagggagattcatcagattcctgtttgatcacatcaacagaggagagatgtgatgaaacaggaaaacctggcggcagcgcaaaagatg

SEQ ID NO: 160707 - DNA, 103 bp, Artificial Sequence
  Synthetic Polynucleotide
taatacgactcactatagggcaacaattccagattcatcagattcctgttaacagaggagaaacaggatgctgatgaataacctggcggcagcgcaaaagatg

SEQ ID NO: 160708 - DNA, 103 bp, Artificial Sequence
  Synthetic Polynucleotide
taatacgactcactatagggtgaaactcagcaacaattccagattcatcaaacagaggagatgatgaatgtggaattgtaacctggcggcagcgcaaaagatg

SEQ ID NO: 160709 - DNA, 103 bp, Artificial Sequence
  Synthetic Polynucleotide
taatacgactcactataggggagataattggcaataactttccagtcatcaacagaggagagatgacatgaaagttattaacctggcggcagcgcaaaagatg

SEQ ID NO: 160710 - DNA, 103 bp, Artificial Sequence
  Synthetic Polynucleotide
taatacgactcactatagggtccattttcttgaaactcagcaacaattccaacagaggagaggaattatggctgagtttaacctggcggcagcgcaaaagatg

SEQ ID NO: 160711 - DNA, 103 bp, Artificial Sequence
  Synthetic Polynucleotide
taatacgactcactataggggtaagggtggtccattttcttgaaactcagaacagaggagactgagtatgaagaaaatgaacctggcggcagcgcaaaagatg

SEQ ID NO: 160712 - DNA, 103 bp, Artificial Sequence
  Synthetic Polynucleotide
taatacgactcactatagggattttcttcagtaagggtggtccattttctaacagaggagaagaaaaatgaccacccttaacctggcggcagcgcaaaagatg

SEQ ID NO: 160713 - DNA, 103 bp, Artificial Sequence
  Synthetic Polynucleotide
taatacgactcactatagggctcttgtttgattttcttcagtaagggtggaacagaggagaccacccatgctgaagaaaaacctggcggcagcgcaaaagatg

SEQ ID NO: 160714 - DNA, 103 bp, Artificial Sequence
  Synthetic Polynucleotide
taatacgactcactataggggagattccacctcttgtttgattttcttcaaacagaggagatgaagaatgtcaaacaagaacctggcggcagcgcaaaagatg

SEQ ID NO: 160715 - DNA, 103 bp, Artificial Sequence
  Synthetic Polynucleotide
taatacgactcactatagggttatcagttggagattccacctcttgtttgaacagaggagacaaacaatgggtggaatcaacctggcggcagcgcaaaagatg

SEQ ID NO: 160716 - DNA, 103 bp, Artificial Sequence
  Synthetic Polynucleotide
taatacgactcactataggggtttcctgatttatcagttggagattccacaacagaggagagtggaaatgccaactgataacctggcggcagcgcaaaagatg

SEQ ID NO: 160717 - DNA, 103 bp, Artificial Sequence
  Synthetic Polynucleotide
taatacgactcactatagggagcagaagaagtttcctgatttatcagttgaacagaggagacaactgatgaatcaggaaaacctggcggcagcgcaaaagatg

SEQ ID NO: 160718 - DNA, 103 bp, Artificial Sequence
  Synthetic Polynucleotide
taatacgactcactatagggcagtggtgtgagcagaagaagtttcctgataacagaggagaatcaggatgcttcttctgaacctggcggcagcgcaaaagatg

SEQ ID NO: 160719 - DNA, 103 bp, Artificial Sequence
  Synthetic Polynucleotide
taatacgactcactataggggtccccttcccagtggtgtgagcagaagaaaacagaggagattcttcatgtcacaccacaacctggcggcagcgcaaaagatg

SEQ ID NO: 160720 - DNA, 103 bp, Artificial Sequence
  Synthetic Polynucleotide
taatacgactcactatagggcgtcactgctatatatgctgtgccggggtcaacagaggagagaccccatgacagcatataacctggcggcagcgcaaaagatg

SEQ ID NO: 160721 - DNA, 103 bp, Artificial Sequence
  Synthetic Polynucleotide
taatacgactcactatagggttcgattcgggagataattggcaataacttaacagaggagaaagttaatgccaattatcaacctggcggcagcgcaaaagatg

SEQ ID NO: 160722 - DNA, 103 bp, Artificial Sequence
  Synthetic Polynucleotide
taatacgactcactatagggtattcagactgtccccttcccagtggtgtgaacagaggagacacaccatggggaaggggaacctggcggcagcgcaaaagatg

SEQ ID NO: 160723 - DNA, 103 bp, Artificial Sequence
  Synthetic Polynucleotide
taatacgactcactatagggaacagttgggtattcagactgtccccttccaacagaggagaggaaggatgcagtctgaaaacctggcggcagcgcaaaagatg

SEQ ID NO: 160724 - DNA, 103 bp, Artificial Sequence
  Synthetic Polynucleotide
taatacgactcactatagggggtctgcgtgaacagttgggtattcagactaacagaggagaagtctgatgacccaactgaacctggcggcagcgcaaaagatg

SEQ ID NO: 160725 - DNA, 103 bp, Artificial Sequence
  Synthetic Polynucleotide
taatacgactcactatagggccacaggcgaggtctgcgtgaacagttgggaacagaggagacccaacatgtcacgcagaaacctggcggcagcgcaaaagatg

SEQ ID NO: 160726 - DNA, 103 bp, Artificial Sequence
  Synthetic Polynucleotide
taatacgactcactatagggggtgcatctgccacaggcgaggtctgcgtgaacagaggagacacgcaatgctcgcctgtaacctggcggcagcgcaaaagatg

SEQ ID NO: 160727 - DNA, 103 bp, Artificial Sequence
  Synthetic Polynucleotide
taatacgactcactatagggaagaatattcggtgcatctgccacaggcgaaacagaggagatcgcctatggcagatgcaaacctggcggcagcgcaaaagatg

SEQ ID NO: 160728 - DNA, 103 bp, Artificial Sequence
  Synthetic Polynucleotide
taatacgactcactatagggcggagcttgtaagaatattcggtgcatctgaacagaggagacagatgatgcgaatattcaacctggcggcagcgcaaaagatg

SEQ ID NO: 160729 - DNA, 103 bp, Artificial Sequence
  Synthetic Polynucleotide
taatacgactcactataggggccattaaaacggagcttgtaagaatattcaacagaggagagaatatatgtacaagctcaacctggcggcagcgcaaaagatg

SEQ ID NO: 160730 - DNA, 103 bp, Artificial Sequence
  Synthetic Polynucleotide
taatacgactcactatagggtgatgctggtgccattaaaacggagcttgtaacagaggagaacaagcatggttttaatgaacctggcggcagcgcaaaagatg

SEQ ID NO: 160731 - DNA, 103 bp, Artificial Sequence
  Synthetic Polynucleotide
taatacgactcactatagggcttcatcttctgatgctggtgccattaaaaaacagaggagattttaaatgcaccagcataacctggcggcagcgcaaaagatg

SEQ ID NO: 160732 - DNA, 103 bp, Artificial Sequence
  Synthetic Polynucleotide
taatacgactcactatagggtgcacatctgttcgattcgggagataattgaacagaggagacaattaatgcccgaatcgaacctggcggcagcgcaaaagatg

SEQ ID NO: 160733 - DNA, 103 bp, Artificial Sequence
  Synthetic Polynucleotide
taatacgactcactatagggagaacattgtcttcatcttctgatgctggtaacagaggagaaccagcatgagaagatgaaacctggcggcagcgcaaaagatg

SEQ ID NO: 160734 - DNA, 103 bp, Artificial Sequence
  Synthetic Polynucleotide
taatacgactcactatagggaaatgctttgagaacattgtcttcatcttcaacagaggagagaagatatggacaatgttaacctggcggcagcgcaaaagatg

SEQ ID NO: 160735 - DNA, 103 bp, Artificial Sequence
  Synthetic Polynucleotide
taatacgactcactatagggtaggtactgtaaatgctttgagaacattgtaacagaggagaacaatgatgtcaaagcataacctggcggcagcgcaaaagatg

SEQ ID NO: 160736 - DNA, 103 bp, Artificial Sequence
  Synthetic Polynucleotide
taatacgactcactataggggacctgtttttaggtactgtaaatgctttgaacagaggagacaaagcatgtacagtaccaacctggcggcagcgcaaaagatg

SEQ ID NO: 160737 - DNA, 103 bp, Artificial Sequence
  Synthetic Polynucleotide
taatacgactcactataggggctcgccagggacctgtttttaggtactgtaacagaggagaacagtaatgaaaaacaggaacctggcggcagcgcaaaagatg

SEQ ID NO: 160738 - DNA, 103 bp, Artificial Sequence
  Synthetic Polynucleotide
taatacgactcactataggggctgcaaggggctcgccagggacctgttttaacagaggagaaaaacaatgccctggcgaaacctggcggcagcgcaaaagatg

SEQ ID NO: 160739 - DNA, 103 bp, Artificial Sequence
  Synthetic Polynucleotide
taatacgactcactatagggctgctacaaggctgcaaggggctcgccaggaacagaggagacctggcatgccccttgcaaacctggcggcagcgcaaaagatg

SEQ ID NO: 160740 - DNA, 103 bp, Artificial Sequence
  Synthetic Polynucleotide
taatacgactcactatagggttcccaggtactgctacaaggctgcaagggaacagaggagacccttgatgccttgtagcaacctggcggcagcgcaaaagatg

SEQ ID NO: 160741 - DNA, 103 bp, Artificial Sequence
  Synthetic Polynucleotide
taatacgactcactatagggaggatgcaggttcccaggtactgctacaagaacagaggagacttgtaatggtacctgggaacctggcggcagcgcaaaagatg

SEQ ID NO: 160742 - DNA, 103 bp, Artificial Sequence
  Synthetic Polynucleotide
taatacgactcactatagggatctttccacaggatgcaggttcccaggtaaacagaggagatacctgatgacctgcatcaacctggcggcagcgcaaaagatg

SEQ ID NO: 160743 - DNA, 103 bp, Artificial Sequence
  Synthetic Polynucleotide
taatacgactcactataggggtgctggcactgcacatctgttcgattcggaacagaggagaccgaatatgacagatgtgaacctggcggcagcgcaaaagatg

SEQ ID NO: 160744 - DNA, 103 bp, Artificial Sequence
  Synthetic Polynucleotide
taatacgactcactatagggctgctcctccatctttccacaggatgcaggaacagaggagacctgcaatgtgtggaaagaacctggcggcagcgcaaaagatg

SEQ ID NO: 160745 - DNA, 103 bp, Artificial Sequence
  Synthetic Polynucleotide
taatacgactcactatagggaagatgtcatctgctcctccatctttccacaacagaggagagtggaaatgtggaggagcaacctggcggcagcgcaaaagatg

SEQ ID NO: 160746 - DNA, 103 bp, Artificial Sequence
  Synthetic Polynucleotide
taatacgactcactataggggcttgactggaagatgtcatctgctcctccaacagaggagaggaggaatggatgacatcaacctggcggcagcgcaaaagatg

SEQ ID NO: 160747 - DNA, 103 bp, Artificial Sequence
  Synthetic Polynucleotide
taatacgactcactataggggtatttacgagcttgactggaagatgtcataacagaggagaatgacaatgtccagtcaaaacctggcggcagcgcaaaagatg

SEQ ID NO: 160748 - DNA, 103 bp, Artificial Sequence
  Synthetic Polynucleotide
taatacgactcactatagggatgcattcacgtatttacgagcttgactggaacagaggagaccagtcatgctcgtaaataacctggcggcagcgcaaaagatg

SEQ ID NO: 160749 - DNA, 103 bp, Artificial Sequence
  Synthetic Polynucleotide
taatacgactcactatagggcgggctgagaatgcattcacgtatttacgaaacagaggagatcgtaaatgcgtgaatgcaacctggcggcagcgcaaaagatg

SEQ ID NO: 160750 - DNA, 103 bp, Artificial Sequence
  Synthetic Polynucleotide
taatacgactcactataggggaccagcgtccgggctgagaatgcattcacaacagaggagagtgaatatgttctcagccaacctggcggcagcgcaaaagatg

SEQ ID NO: 160751 - DNA, 103 bp, Artificial Sequence
  Synthetic Polynucleotide
taatacgactcactatagggtctgccatcggtgctggcactgcacatctgaacagaggagacagatgatgagtgccagcaacctggcggcagcgcaaaagatg

SEQ ID NO: 160752 - DNA, 103 bp, Artificial Sequence
  Synthetic Polynucleotide
taatacgactcactatagggtttagtactttctgccatcggtgctggcacaacagaggagagtgccaatgccgatggcaaacctggcggcagcgcaaaagatg

SEQ ID NO: 160753 - DNA, 103 bp, Artificial Sequence
  Synthetic Polynucleotide
taatacgactcactataggggagctcagggtttagtactttctgccatcgaacagaggagacgatggatgaaagtactaaacctggcggcagcgcaaaagatg

SEQ ID NO: 160754 - DNA, 103 bp, Artificial Sequence
  Synthetic Polynucleotide
taatacgactcactataggggacccttgatgagctcagggtttagtacttaacagaggagaaagtacatgaccctgagcaacctggcggcagcgcaaaagatg

SEQ ID NO: 160755 - DNA, 103 bp, Artificial Sequence
  Synthetic Polynucleotide
taatacgactcactatagggttggtccaaggacccttgatgagctcagggaacagaggagaccctgaatgcatcaagggaacctggcggcagcgcaaaagatg

SEQ ID NO: 160756 - DNA, 103 bp, Artificial Sequence
  Synthetic Polynucleotide
taatacgactcactatagggatcttcttctttggtccaaggacccttgataacagaggagaatcaagatgccttggaccaacctggcggcagcgcaaaagatg

SEQ ID NO: 160757 - DNA, 103 bp, Artificial Sequence
  Synthetic Polynucleotide
taatacgactcactatagggtcactctctgatcttcttctttggtccaagaacagaggagacttggaatgaagaagaagaacctggcggcagcgcaaaagatg

SEQ ID NO: 160758 - DNA, 103 bp, Artificial Sequence
  Synthetic Polynucleotide
taatacgactcactatagggtcatcatcctcgtcactgctatatatgctgaacagaggagacagcatatgtagcagtgaaacctggcggcagcgcaaaagatg

SEQ ID NO: 160759 - DNA, 103 bp, Artificial Sequence
  Synthetic Polynucleotide
taatacgactcactatagggacaagctctatcactctctgatcttcttctaacagaggagaagaagaatgtcagagagtaacctggcggcagcgcaaaagatg

SEQ ID NO: 160760 - DNA, 103 bp, Artificial Sequence
  Synthetic Polynucleotide
taatacgactcactataggggtatttctgtacaagctctatcactctctgaacagaggagacagagaatgatagagcttaacctggcggcagcgcaaaagatg

SEQ ID NO: 160761 - DNA, 103 bp, Artificial Sequence
  Synthetic Polynucleotide
taatacgactcactataggggtttcggaccgtatttctgtacaagctctaaacagaggagatagagcatgtacagaaataacctggcggcagcgcaaaagatg

SEQ ID NO: 160762 - DNA, 103 bp, Artificial Sequence
  Synthetic Polynucleotide
taatacgactcactatagggacagaccaacgtttcggaccgtatttctgtaacagaggagaacagaaatgcggtccgaaaacctggcggcagcgcaaaagatg

SEQ ID NO: 160763 - DNA, 103 bp, Artificial Sequence
  Synthetic Polynucleotide
taatacgactcactatagggcttggcaataacagaccaacgtttcggaccaacagaggagaggtccgatgcgttggtctaacctggcggcagcgcaaaagatg

SEQ ID NO: 160764 - DNA, 103 bp, Artificial Sequence
  Synthetic Polynucleotide
taatacgactcactatagggcctttaagtgcttggcaataacagaccaacaacagaggagagttggtatgttattgccaaacctggcggcagcgcaaaagatg

SEQ ID NO: 160765 - DNA, 103 bp, Artificial Sequence
  Synthetic Polynucleotide
taatacgactcactatagggccaattctcccctttaagtgcttggcaataaacagaggagatattgcatggcacttaaaaacctggcggcagcgcaaaagatg

SEQ ID NO: 160766 - DNA, 103 bp, Artificial Sequence
  Synthetic Polynucleotide
taatacgactcactatagggacattgttttccaattctcccctttaagtgaacagaggagacacttaatggggagaattaacctggcggcagcgcaaaagatg

SEQ ID NO: 160767 - DNA, 103 bp, Artificial Sequence
  Synthetic Polynucleotide
taatacgactcactatagggacctctccctacattgttttccaattctccaacagaggagaggagaaatggaaaacaataacctggcggcagcgcaaaagatg

SEQ ID NO: 160768 - DNA, 103 bp, Artificial Sequence
  Synthetic Polynucleotide
taatacgactcactatagggtggttatgccacctctccctacattgttttaacagaggagaaaaacaatgtagggagagaacctggcggcagcgcaaaagatg

SEQ ID NO: 160769 - DNA, 103 bp, Artificial Sequence
  Synthetic Polynucleotide
taatacgactcactatagggctcaaagtcctcatcatcctcgtcactgctaacagaggagaagcagtatggaggatgataacctggcggcagcgcaaaagatg

SEQ ID NO: 160770 - DNA, 103 bp, Artificial Sequence
  Synthetic Polynucleotide
taatacgactcactatagggtggattcaagtggttatgccacctctccctaacagaggagaagggagatgtggcataacaacctggcggcagcgcaaaagatg

SEQ ID NO: 160771 - DNA, 103 bp, Artificial Sequence
  Synthetic Polynucleotide
taatacgactcactatagggtcttaacttctggattcaagtggttatgccaacagaggagaggcataatgacttgaatcaacctggcggcagcgcaaaagatg

SEQ ID NO: 160772 - DNA, 103 bp, Artificial Sequence
  Synthetic Polynucleotide
taatacgactcactatagggcaggaggttttcttaacttctggattcaagaacagaggagacttgaaatgagaagttaaaacctggcggcagcgcaaaagatg

SEQ ID NO: 160773 - DNA, 103 bp, Artificial Sequence
  Synthetic Polynucleotide
taatacgactcactatagggctcttctgtccaggaggttttcttaacttcaacagaggagagaagttatgaaaacctccaacctggcggcagcgcaaaagatg

SEQ ID NO: 160774 - DNA, 103 bp, Artificial Sequence
  Synthetic Polynucleotide
taatacgactcactatagggttctgtcttcctcttctgtccaggaggtttaacagaggagaaaacctatgggacagaagaacctggcggcagcgcaaaagatg

SEQ ID NO: 160775 - DNA, 103 bp, Artificial Sequence
  Synthetic Polynucleotide
taatacgactcactatagggtggtaaataattctgtcttcctcttctgtcaacagaggagagacagaatgggaagacagaacctggcggcagcgcaaaagatg

SEQ ID NO: 160776 - DNA, 103 bp, Artificial Sequence
  Synthetic Polynucleotide
taatacgactcactatagggcttgtgtgcctggtaaataattctgtcttcaacagaggagagaagacatgattatttacaacctggcggcagcgcaaaagatg

SEQ ID NO: 160777 - DNA, 103 bp, Artificial Sequence
  Synthetic Polynucleotide
taatacgactcactatagggtccccagtctcttgtgtgcctggtaaataaaacagaggagattatttatgaggcacacaaacctggcggcagcgcaaaagatg

SEQ ID NO: 160778 - DNA, 103 bp, Artificial Sequence
  Synthetic Polynucleotide
taatacgactcactataggggcccatctgttccccagtctcttgtgtgccaacagaggagaggcacaatggagactgggaacctggcggcagcgcaaaagatg

SEQ ID NO: 160779 - DNA, 103 bp, Artificial Sequence
  Synthetic Polynucleotide
taatacgactcactatagggtgcgatttctgcccatctgttccccagtctaacagaggagaagactgatgaacagatggaacctggcggcagcgcaaaagatg

SEQ ID NO: 160780 - DNA, 103 bp, Artificial Sequence
  Synthetic Polynucleotide
taatacgactcactatagggggtcacacatctcaaagtcctcatcatcctaacagaggagaaggatgatgaggactttgaacctggcggcagcgcaaaagatg

SEQ ID NO: 160781 - DNA, 103 bp, Artificial Sequence
  Synthetic Polynucleotide
taatacgactcactataggggcagtagctttgcgatttctgcccatctgtaacagaggagaacagatatgcagaaatcgaacctggcggcagcgcaaaagatg

SEQ ID NO: 160782 - DNA, 103 bp, Artificial Sequence
  Synthetic Polynucleotide
taatacgactcactataggggttcgtccaggcagtagctttgcgatttctaacagaggagaagaaatatgaaagctactaacctggcggcagcgcaaaagatg

SEQ ID NO: 160783 - DNA, 103 bp, Artificial Sequence
  Synthetic Polynucleotide
taatacgactcactatagggagcattatcagttcgtccaggcagtagcttaacagaggagaaagctaatgcctggacgaaacctggcggcagcgcaaaagatg

SEQ ID NO: 160784 - DNA, 103 bp, Artificial Sequence
  Synthetic Polynucleotide
taatacgactcactatagggggttcttgatagcattatcagttcgtccagaacagaggagactggacatgctgataatgaacctggcggcagcgcaaaagatg

SEQ ID NO: 160785 - DNA, 103 bp, Artificial Sequence
  Synthetic Polynucleotide
taatacgactcactataggggaattccagtggttcttgatagcattatcaaacagaggagatgataaatgtatcaagaaaacctggcggcagcgcaaaagatg

SEQ ID NO: 160786 - DNA, 103 bp, Artificial Sequence
  Synthetic Polynucleotide
taatacgactcactatagggacgcattgtagaattccagtggttcttgataacagaggagaatcaagatgcactggaataacctggcggcagcgcaaaagatg

SEQ ID NO: 160787 - DNA, 103 bp, Artificial Sequence
  Synthetic Polynucleotide
taatacgactcactatagggcgaccttccgacgcattgtagaattccagtaacagaggagaactggaatgctacaatgcaacctggcggcagcgcaaaagatg

SEQ ID NO: 160788 - DNA, 103 bp, Artificial Sequence
  Synthetic Polynucleotide
taatacgactcactatagggccttcctgttcgaccttccgacgcattgtaaacagaggagatacaatatgtcggaaggtaacctggcggcagcgcaaaagatg

SEQ ID NO: 160789 - DNA, 103 bp, Artificial Sequence
  Synthetic Polynucleotide
taatacgactcactatagggctgcagataaccttcctgttcgaccttccgaacagaggagacggaagatggaacaggaaaacctggcggcagcgcaaaagatg

SEQ ID NO: 160790 - DNA, 103 bp, Artificial Sequence
  Synthetic Polynucleotide
taatacgactcactatagggttgaagactcctgcagataaccttcctgttaacagaggagaaacaggatggttatctgcaacctggcggcagcgcaaaagatg

SEQ ID NO: 160791 - DNA, 103 bp, Artificial Sequence
  Synthetic Polynucleotide
taatacgactcactatagggtcatagtcatggtcacacatctcaaagtccaacagaggagaggacttatggatgtgtgaaacctggcggcagcgcaaaagatg

SEQ ID NO: 160792 - DNA, 103 bp, Artificial Sequence
  Synthetic Polynucleotide
taatacgactcactatagggtggctggcttttgaagactcctgcagataaaacagaggagattatctatgggagtcttcaacctggcggcagcgcaaaagatg

SEQ ID NO: 160793 - DNA, 103 bp, Artificial Sequence
  Synthetic Polynucleotide
taatacgactcactatagggcactgctggctggctggcttttgaagactcaacagaggagagagtctatgaaagccagcaacctggcggcagcgcaaaagatg

SEQ ID NO: 160794 - DNA, 103 bp, Artificial Sequence
  Synthetic Polynucleotide
taatacgactcactatagggagcttgtggccactgctggctggctggcttaacagaggagaaagccaatgagccagcagaacctggcggcagcgcaaaagatg

SEQ ID NO: 160795 - DNA, 103 bp, Artificial Sequence
  Synthetic Polynucleotide
taatacgactcactatagggttcttctggaagcttgtggccactgctggcaacagaggagagccagcatgggccacaagaacctggcggcagcgcaaaagatg

SEQ ID NO: 160796 - DNA, 103 bp, Artificial Sequence
  Synthetic Polynucleotide
taatacgactcactatagggcaaatgactgttcttctggaagcttgtggcaacagaggagagccacaatgttccagaagaacctggcggcagcgcaaaagatg

SEQ ID NO: 160797 - DNA, 103 bp, Artificial Sequence
  Synthetic Polynucleotide
taatacgactcactatagggcaaaacccatcaaatgactgttcttctggaaacagaggagatccagaatgacagtcattaacctggcggcagcgcaaaagatg

SEQ ID NO: 160798 - DNA, 103 bp, Artificial Sequence
  Synthetic Polynucleotide
taatacgactcactatagggggagcctgagcaaaacccatcaaatgactgaacagaggagacagtcaatggatgggtttaacctggcggcagcgcaaaagatg

SEQ ID NO: 160799 - DNA, 103 bp, Artificial Sequence
  Synthetic Polynucleotide
taatacgactcactatagggagctgtaggcggagcctgagcaaaacccataacagaggagaatgggtatggctcaggctaacctggcggcagcgcaaaagatg

SEQ ID NO: 160800 - DNA, 103 bp, Artificial Sequence
  Synthetic Polynucleotide
taatacgactcactatagggcagggagttgagctgtaggcggagcctgagaacagaggagactcaggatgcgcctacagaacctggcggcagcgcaaaagatg

SEQ ID NO: 160801 - DNA, 103 bp, Artificial Sequence
  Synthetic Polynucleotide
taatacgactcactatagggtggccagtggcagggagttgagctgtaggcaacagaggagagcctacatgtcaactcccaacctggcggcagcgcaaaagatg

SEQ ID NO: 160802 - DNA, 103 bp, Artificial Sequence
  Synthetic Polynucleotide
taatacgactcactatagggaagcagcccatcatagtcatggtcacacataacagaggagaatgtgtatgcatgactataacctggcggcagcgcaaaagatg

SEQ ID NO: 160803 - DNA, 103 bp, Artificial Sequence
  Synthetic Polynucleotide
taatacgactcactatagggaacagtgggctggccagtggcagggagttgaacagaggagacaactcatggccactggcaacctggcggcagcgcaaaagatg

SEQ ID NO: 160804 - DNA, 103 bp, Artificial Sequence
  Synthetic Polynucleotide
taatacgactcactatagggagtcgttgttaacagtgggctggccagtggaacagaggagaccactgatgagcccactgaacctggcggcagcgcaaaagatg

SEQ ID NO: 160805 - DNA, 103 bp, Artificial Sequence
  Synthetic Polynucleotide
taatacgactcactatagggtaataggaatagtcgttgttaacagtgggcaacagaggagagcccacatgtaacaacgaaacctggcggcagcgcaaaagatg

SEQ ID NO: 160806 - DNA, 103 bp, Artificial Sequence
  Synthetic Polynucleotide
taatacgactcactatagggagaaatgtggtaataggaatagtcgttgttaacagaggagaaacaacatgtattcctataacctggcggcagcgcaaaagatg

SEQ ID NO: 160807 - DNA, 103 bp, Artificial Sequence
  Synthetic Polynucleotide
taatacgactcactatagggtttgtgcttcagaaatgtggtaataggaataacagaggagaattcctatgaccacatttaacctggcggcagcgcaaaagatg

SEQ ID NO: 160808 - DNA, 103 bp, Artificial Sequence
  Synthetic Polynucleotide
taatacgactcactatagggctggagacattttgtgcttcagaaatgtggaacagaggagaccacatatgtgaagcacaaacctggcggcagcgcaaaagatg

SEQ ID NO: 160809 - DNA, 103 bp, Artificial Sequence
  Synthetic Polynucleotide
taatacgactcactatagggtggaacatgactggagacattttgtgcttcaacagaggagagaagcaatgaatgtctccaacctggcggcagcgcaaaagatg

SEQ ID NO: 160810 - DNA, 103 bp, Artificial Sequence
  Synthetic Polynucleotide
taatacgactcactatagggctacagggtatggaacatgactggagacataacagaggagaatgtctatggtcatgttcaacctggcggcagcgcaaaagatg

SEQ ID NO: 160811 - DNA, 103 bp, Artificial Sequence
  Synthetic Polynucleotide
taatacgactcactatagggacatgtaacgctacagggtatggaacatgaaacagaggagatcatgtatgataccctgtaacctggcggcagcgcaaaagatg

SEQ ID NO: 160812 - DNA, 103 bp, Artificial Sequence
  Synthetic Polynucleotide
taatacgactcactataggggactatatttacatgtaacgctacagggtaaacagaggagataccctatggcgttacataacctggcggcagcgcaaaagatg

SEQ ID NO: 160813 - DNA, 103 bp, Artificial Sequence
  Synthetic Polynucleotide
taatacgactcactatagggcagacttgggaagcagcccatcatagtcataacagaggagaatgactatgatgggctgcaacctggcggcagcgcaaaagatg

SEQ ID NO: 160814 - DNA, 103 bp, Artificial Sequence
  Synthetic Polynucleotide
taatacgactcactataggggagggacattgactatatttacatgtaacgaacagaggagacgttacatgtaaatatagaacctggcggcagcgcaaaagatg

SEQ ID NO: 160815 - DNA, 103 bp, Artificial Sequence
  Synthetic Polynucleotide
taatacgactcactataggggcagctggctgagggacattgactatatttaacagaggagaaaatatatgcaatgtcccaacctggcggcagcgcaaaagatg

SEQ ID NO: 160816 - DNA, 103 bp, Artificial Sequence
  Synthetic Polynucleotide
taatacgactcactatagggaatggctgcggcagctggctgagggacattaacagaggagaaatgtcatgcagccagctaacctggcggcagcgcaaaagatg

SEQ ID NO: 160817 - DNA, 103 bp, Artificial Sequence
  Synthetic Polynucleotide
taatacgactcactatagggagtgtctctgaatggctgcggcagctggctaacagaggagaagccagatgccgcagccaaacctggcggcagcgcaaaagatg

SEQ ID NO: 160818 - DNA, 103 bp, Artificial Sequence
  Synthetic Polynucleotide
taatacgactcactatagggtcatcattatagtgtctctgaatggctgcgaacagaggagacgcagcatgtcagagacaaacctggcggcagcgcaaaagatg

SEQ ID NO: 160819 - DNA, 103 bp, Artificial Sequence
  Synthetic Polynucleotide
taatacgactcactatagggctcagggtcttcatcattatagtgtctctgaacagaggagacagagaatgtataatgataacctggcggcagcgcaaaagatg

SEQ ID NO: 160820 - DNA, 103 bp, Artificial Sequence
  Synthetic Polynucleotide
taatacgactcactataggggcttttccttctcagggtcttcatcattataacagaggagaataatgatgaagaccctgaacctggcggcagcgcaaaagatg

SEQ ID NO: 160821 - DNA, 103 bp, Artificial Sequence
  Synthetic Polynucleotide
taatacgactcactatagggtcctttattcgcttttccttctcagggtctaacagaggagaagacccatggaaggaaaaaacctggcggcagcgcaaaagatg

SEQ ID NO: 160822 - DNA, 103 bp, Artificial Sequence
  Synthetic Polynucleotide
taatacgactcactatagggcaattctaattcctttattcgcttttccttaacagaggagaaaggaaatgcgaataaagaacctggcggcagcgcaaaagatg

SEQ ID NO: 160823 - DNA, 103 bp, Artificial Sequence
  Synthetic Polynucleotide
taatacgactcactatagggacattaggagcaattctaattcctttattcaacagaggagagaataaatgaattagaataacctggcggcagcgcaaaagatg

SEQ ID NO: 160824 - DNA, 103 bp, Artificial Sequence
  Synthetic Polynucleotide
taatacgactcactatagggtgacgctttccagacttgggaagcagcccaaacagaggagatgggctatgtcccaagtcaacctggcggcagcgcaaaagatg

SEQ ID NO: 160825 - DNA, 103 bp, Artificial Sequence
  Synthetic Polynucleotide
taatacgactcactatagggttctcggttgacattaggagcaattctaataacagaggagaattagaatggctcctaataacctggcggcagcgcaaaagatg

SEQ ID NO: 160826 - DNA, 103 bp, Artificial Sequence
  Synthetic Polynucleotide
taatacgactcactatagggttttagctcattctcggttgacattaggagaacagaggagactcctaatgtcaaccgagaacctggcggcagcgcaaaagatg

SEQ ID NO: 160827 - DNA, 103 bp, Artificial Sequence
  Synthetic Polynucleotide
taatacgactcactatagggcctgctgtccttttagctcattctcggttgaacagaggagacaaccgatgatgagctaaaacctggcggcagcgcaaaagatg

SEQ ID NO: 160828 - DNA, 103 bp, Artificial Sequence
  Synthetic Polynucleotide
taatacgactcactataggggttggtagcacctgctgtccttttagctcaaacagaggagatgagctatgaggacagcaaacctggcggcagcgcaaaagatg

SEQ ID NO: 160829 - DNA, 103 bp, Artificial Sequence
  Synthetic Polynucleotide
taatacgactcactataggggtggttctgtgttggtagcacctgctgtccaacagaggagaggacagatggtgctaccaaacctggcggcagcgcaaaagatg

SEQ ID NO: 160830 - DNA, 103 bp, Artificial Sequence
  Synthetic Polynucleotide
taatacgactcactatagggagctgcatgtgtggttctgtgttggtagcaaacagaggagatgctacatgcacagaaccaacctggcggcagcgcaaaagatg

SEQ ID NO: 160831 - DNA, 103 bp, Artificial Sequence
  Synthetic Polynucleotide
taatacgactcactatagggcacccggggtagctgcatgtgtggttctgtaacagaggagaacagaaatgcacatgcagaacctggcggcagcgcaaaagatg

SEQ ID NO: 160832 - DNA, 103 bp, Artificial Sequence
  Synthetic Polynucleotide
taatacgactcactatagggggtgctgtgccacccggggtagctgcatgtaacagaggagaacatgcatgtaccccgggaacctggcggcagcgcaaaagatg

SEQ ID NO: 160833 - DNA, 103 bp, Artificial Sequence
  Synthetic Polynucleotide
taatacgactcactatagggcggcaatggtggtgctgtgccacccggggtaacagaggagaaccccgatgggcacagcaaacctggcggcagcgcaaaagatg

SEQ ID NO: 160834 - DNA, 103 bp, Artificial Sequence
  Synthetic Polynucleotide
taatacgactcactatagggctggtgtggtcggcaatggtggtgctgtgcaacagaggagagcacagatgcaccattgcaacctggcggcagcgcaaaagatg

SEQ ID NO: 160835 - DNA, 103 bp, Artificial Sequence
  Synthetic Polynucleotide
taatacgactcactatagggcatcggctgggcgggatcccggctctccataacagaggagaatggagatgcgggatcccaacctggcggcagcgcaaaagatg

SEQ ID NO: 160836 - DNA, 103 bp, Artificial Sequence
  Synthetic Polynucleotide
taatacgactcactatagggccagaagaagtccaagaactcgcgactgtgaacagaggagacacagtatggagttcttgaacctggcggcagcgcaaaagatg

SEQ ID NO: 160837 - DNA, 103 bp, Artificial Sequence
  Synthetic Polynucleotide
taatacgactcactatagggagcagtgcacacgtgctccccgtaatggcgaacagaggagacgccatatgggggagcacaacctggcggcagcgcaaaagatg

SEQ ID NO: 160838 - DNA, 103 bp, Artificial Sequence
  Synthetic Polynucleotide
taatacgactcactatagggttgggagcttagcagtgcacacgtgctcccaacagaggagagggagcatgtgtgcactgaacctggcggcagcgcaaaagatg

SEQ ID NO: 160839 - DNA, 103 bp, Artificial Sequence
  Synthetic Polynucleotide
taatacgactcactatagggttgaactgctttgggagcttagcagtgcacaacagaggagagtgcacatgtaagctcccaacctggcggcagcgcaaaagatg

SEQ ID NO: 160840 - DNA, 103 bp, Artificial Sequence
  Synthetic Polynucleotide
taatacgactcactatagggtggggcaaacttgaactgctttgggagcttaacagaggagaaagctcatgaagcagttcaacctggcggcagcgcaaaagatg

SEQ ID NO: 160841 - DNA, 103 bp, Artificial Sequence
  Synthetic Polynucleotide
taatacgactcactatagggcgtccatctctggggcaaacttgaactgctaacagaggagaagcagtatgagtttgcccaacctggcggcagcgcaaaagatg

SEQ ID NO: 160842 - DNA, 103 bp, Artificial Sequence
  Synthetic Polynucleotide
taatacgactcactatagggcccacgtaatcgtccatctctggggcaaacaacagaggagagtttgcatgagagatggaaacctggcggcagcgcaaaagatg

SEQ ID NO: 160843 - DNA, 103 bp, Artificial Sequence
  Synthetic Polynucleotide
taatacgactcactatagggtaggaaggtgcccacgtaatcgtccatctcaacagaggagagagatgatggattacgtgaacctggcggcagcgcaaaagatg

SEQ ID NO: 160844 - DNA, 103 bp, Artificial Sequence
  Synthetic Polynucleotide
taatacgactcactatagggggcacccctctaggaaggtgcccacgtaataacagaggagaattacgatggcaccttccaacctggcggcagcgcaaaagatg

SEQ ID NO: 160845 - DNA, 103 bp, Artificial Sequence
  Synthetic Polynucleotide
taatacgactcactataggggggtcatcctggcacccctctaggaaggtgaacagaggagacaccttatgagaggggtgaacctggcggcagcgcaaaagatg

SEQ ID NO: 160846 - DNA, 103 bp, Artificial Sequence
  Synthetic Polynucleotide
taatacgactcactatagggctgccgctcagggtcatcctggcacccctcaacagaggagagaggggatgcaggatgacaacctggcggcagcgcaaaagatg

SEQ ID NO: 160847 - DNA, 103 bp, Artificial Sequence
  Synthetic Polynucleotide
taatacgactcactatagggtcgcaatgtcccagaagaagtccaagaactaacagaggagaagttctatgacttcttctaacctggcggcagcgcaaaagatg

SEQ ID NO: 160848 - DNA, 103 bp, Artificial Sequence
  Synthetic Polynucleotide
taatacgactcactataggggcacggccagctgccgctcagggtcatcctaacagaggagaaggatgatgctgagcggcaacctggcggcagcgcaaaagatg

SEQ ID NO: 160849 - DNA, 103 bp, Artificial Sequence
  Synthetic Polynucleotide
taatacgactcactatagggaaggccactagcacggccagctgccgctcaaacagaggagatgagcgatggctggccgtaacctggcggcagcgcaaaagatg

SEQ ID NO: 160850 - DNA, 103 bp, Artificial Sequence
  Synthetic Polynucleotide
taatacgactcactataggggacagatgagaaggccactagcacggccagaacagaggagactggccatgctagtggccaacctggcggcagcgcaaaagatg

SEQ ID NO: 160851 - DNA, 103 bp, Artificial Sequence
  Synthetic Polynucleotide
taatacgactcactatagggcttggttggtgacagatgagaaggccactaaacagaggagatagtggatgtctcatctgaacctggcggcagcgcaaaagatg

SEQ ID NO: 160852 - DNA, 103 bp, Artificial Sequence
  Synthetic Polynucleotide
taatacgactcactatagggacagggaggccttggttggtgacagatgagaacagaggagactcatcatgcaccaaccaaacctggcggcagcgcaaaagatg

SEQ ID NO: 160853 - DNA, 103 bp, Artificial Sequence
  Synthetic Polynucleotide
taatacgactcactatagggagtaggcgtgacagggaggccttggttggtaacagaggagaaccaacatgggcctccctaacctggcggcagcgcaaaagatg

SEQ ID NO: 160854 - DNA, 103 bp, Artificial Sequence
  Synthetic Polynucleotide
taatacgactcactatagggcccgccagaaagtaggcgtgacagggaggcaacagaggagagcctccatgtcacgcctaaacctggcggcagcgcaaaagatg

SEQ ID NO: 160855 - DNA, 103 bp, Artificial Sequence
  Synthetic Polynucleotide
taatacgactcactatagggaaccgcacgacccgccagaaagtaggcgtgaacagaggagacacgccatgtttctggcgaacctggcggcagcgcaaaagatg

SEQ ID NO: 160856 - DNA, 103 bp, Artificial Sequence
  Synthetic Polynucleotide
taatacgactcactatagggagggctcaggaaccgcacgacccgccagaaaacagaggagattctggatggtcgtgcggaacctggcggcagcgcaaaagatg

SEQ ID NO: 160857 - DNA, 103 bp, Artificial Sequence
  Synthetic Polynucleotide
taatacgactcactataggggcagggccggagggctcaggaaccgcacgaaacagaggagatcgtgcatgtcctgagccaacctggcggcagcgcaaaagatg

SEQ ID NO: 160858 - DNA, 103 bp, Artificial Sequence
  Synthetic Polynucleotide
taatacgactcactatagggtgctcaggcttcgcaatgtcccagaagaagaacagaggagacttcttatgggacattgcaacctggcggcagcgcaaaagatg

SEQ ID NO: 160859 - DNA, 103 bp, Artificial Sequence
  Synthetic Polynucleotide
taatacgactcactatagggacatagccctgcagggccggagggctcaggaacagaggagacctgagatgtccggccctaacctggcggcagcgcaaaagatg

SEQ ID NO: 160860 - DNA, 103 bp, Artificial Sequence
  Synthetic Polynucleotide
taatacgactcactatagggcagccaggccacatagccctgcagggccggaacagaggagaccggccatgcagggctataacctggcggcagcgcaaaagatg

SEQ ID NO: 160861 - DNA, 103 bp, Artificial Sequence
  Synthetic Polynucleotide
taatacgactcactatagggacatggcccgcagccaggccacatagccctaacagaggagaagggctatgtggcctggcaacctggcggcagcgcaaaagatg

SEQ ID NO: 160862 - DNA, 103 bp, Artificial Sequence
  Synthetic Polynucleotide
taatacgactcactatagggggctggagaaacatggcccgcagccaggccaacagaggagaggcctgatggcgggccataacctggcggcagcgcaaaagatg

SEQ ID NO: 160863 - DNA, 103 bp, Artificial Sequence
  Synthetic Polynucleotide
taatacgactcactataggggtccaggtctggctggagaaacatggcccgaacagaggagacgggccatgtttctccagaacctggcggcagcgcaaaagatg

SEQ ID NO: 160864 - DNA, 103 bp, Artificial Sequence
  Synthetic Polynucleotide
taatacgactcactatagggcaaccaaggagtccaggtctggctggagaaaacagaggagattctccatgcagacctggaacctggcggcagcgcaaaagatg

SEQ ID NO: 160865 - DNA, 103 bp, Artificial Sequence
  Synthetic Polynucleotide
taatacgactcactataggggtgctgaagtcaaccaaggagtccaggtctaacagaggagaagacctatgctccttggtaacctggcggcagcgcaaaagatg

SEQ ID NO: 160866 - DNA, 103 bp, Artificial Sequence
  Synthetic Polynucleotide
taatacgactcactatagggctggttgttggtgctgaagtcaaccaaggaaacagaggagatccttgatggacttcagcaacctggcggcagcgcaaaagatg

SEQ ID NO: 160867 - DNA, 103 bp, Artificial Sequence
  Synthetic Polynucleotide
taatacgactcactataggggggctttcttctggttgttggtgctgaagtaacagaggagaacttcaatgccaacaaccaacctggcggcagcgcaaaagatg

SEQ ID NO: 160868 - DNA, 103 bp, Artificial Sequence
  Synthetic Polynucleotide
taatacgactcactataggggatgaatcctgggctttcttctggttgttgaacagaggagacaacaaatggaagaaagcaacctggcggcagcgcaaaagatg

SEQ ID NO: 160869 - DNA, 103 bp, Artificial Sequence
  Synthetic Polynucleotide
taatacgactcactatagggtcgcgtctcctgctcaggcttcgcaatgtcaacagaggagagacattatgaagcctgagaacctggcggcagcgcaaaagatg

SEQ ID NO: 160870 - DNA, 103 bp, Artificial Sequence
  Synthetic Polynucleotide
taatacgactcactatagggcatgtggagcgatgaatcctgggctttcttaacagaggagaaagaaaatgcaggattcaaacctggcggcagcgcaaaagatg

SEQ ID NO: 160871 - DNA, 103 bp, Artificial Sequence
  Synthetic Polynucleotide
taatacgactcactatagggctcgctcaggcatgtggagcgatgaatcctaacagaggagaaggattatgcgctccacaaacctggcggcagcgcaaaagatg

SEQ ID NO: 160872 - DNA, 103 bp, Artificial Sequence
  Synthetic Polynucleotide
taatacgactcactatagggcggaacacagctcgctcaggcatgtggagcaacagaggagagctccaatggcctgagcgaacctggcggcagcgcaaaagatg

SEQ ID NO: 160873 - DNA, 103 bp, Artificial Sequence
  Synthetic Polynucleotide
taatacgactcactatagggtttcctcagccggaacacagctcgctcaggaacagaggagacctgagatggctgtgttcaacctggcggcagcgcaaaagatg

SEQ ID NO: 160874 - DNA, 103 bp, Artificial Sequence
  Synthetic Polynucleotide
taatacgactcactatagggagatgatccatttcctcagccggaacacagaacagaggagactgtgtatgggctgaggaaacctggcggcagcgcaaaagatg

SEQ ID NO: 160875 - DNA, 103 bp, Artificial Sequence
  Synthetic Polynucleotide
taatacgactcactatagggaccaatcgaaagatgatccatttcctcagcaacagaggagagctgagatgatggatcataacctggcggcagcgcaaaagatg

SEQ ID NO: 160876 - DNA, 103 bp, Artificial Sequence
  Synthetic Polynucleotide
taatacgactcactatagggcacaatgctcaccaatcgaaagatgatccaaacagaggagatggatcatgtttcgattgaacctggcggcagcgcaaaagatg

SEQ ID NO: 160877 - DNA, 103 bp, Artificial Sequence
  Synthetic Polynucleotide
taatacgactcactataggggcaggctgtccacaatgctcaccaatcgaaaacagaggagattcgatatgtgagcattgaacctggcggcagcgcaaaagatg

SEQ ID NO: 160878 - DNA, 103 bp, Artificial Sequence
  Synthetic Polynucleotide
taatacgactcactatagggatctccaggtgcaggctgtccacaatgctcaacagaggagagagcatatgggacagcctaacctggcggcagcgcaaaagatg

SEQ ID NO: 160879 - DNA, 103 bp, Artificial Sequence
  Synthetic Polynucleotide
taatacgactcactatagggggcctcctccatctccaggtgcaggctgtcaacagaggagagacagcatgcacctggagaacctggcggcagcgcaaaagatg

SEQ ID NO: 160880 - DNA, 103 bp, Artificial Sequence
  Synthetic Polynucleotide
taatacgactcactatagggtggccgcaagtcgcgtctcctgctcaggctaacagaggagaagcctgatgaggagacgcaacctggcggcagcgcaaaagatg

SEQ ID NO: 160881 - DNA, 103 bp, Artificial Sequence
  Synthetic Polynucleotide
taatacgactcactataggggctcagtcaaggcctcctccatctccaggtaacagaggagaacctggatgtggaggaggaacctggcggcagcgcaaaagatg

SEQ ID NO: 160882 - DNA, 103 bp, Artificial Sequence
  Synthetic Polynucleotide
taatacgactcactatagggctggccacctgctcagtcaaggcctcctccaacagaggagaggaggaatgcttgactgaaacctggcggcagcgcaaaagatg

SEQ ID NO: 160883 - DNA, 103 bp, Artificial Sequence
  Synthetic Polynucleotide
taatacgactcactatagggcaaacaaaacctggccacctgctcagtcaaaacagaggagattgactatgcaggtggccaacctggcggcagcgcaaaagatg

SEQ ID NO: 160884 - DNA, 103 bp, Artificial Sequence
  Synthetic Polynucleotide
taatacgactcactatagggacgagtggaacaaacaaaacctggccacctaacagaggagaaggtggatgggttttgttaacctggcggcagcgcaaaagatg

SEQ ID NO: 160885 - DNA, 103 bp, Artificial Sequence
  Synthetic Polynucleotide
taatacgactcactataggggtgacaaagaacgagtggaacaaacaaaacaacagaggagagttttgatggttccactcaacctggcggcagcgcaaaagatg

SEQ ID NO: 160886 - DNA, 103 bp, Artificial Sequence
  Synthetic Polynucleotide
taatacgactcactataggggggcttctttgtgacaaagaacgagtggaaaacagaggagattccacatgttctttgtcaacctggcggcagcgcaaaagatg

SEQ ID NO: 160887 - DNA, 103 bp, Artificial Sequence
  Synthetic Polynucleotide
taatacgactcactatagggtctgggatgtgggcttctttgtgacaaagaaacagaggagatctttgatgcaaagaagcaacctggcggcagcgcaaaagatg

SEQ ID NO: 160888 - DNA, 103 bp, Artificial Sequence
  Synthetic Polynucleotide
taatacgactcactataggggtctcagggatctgggatgtgggcttctttaacagaggagaaaagaaatgcacatcccaaacctggcggcagcgcaaaagatg

SEQ ID NO: 160889 - DNA, 103 bp, Artificial Sequence
  Synthetic Polynucleotide
taatacgactcactatagggcgggtgctttgtctcagggatctgggatgtaacagaggagaacatccatgatccctgagaacctggcggcagcgcaaaagatg

SEQ ID NO: 160890 - DNA, 103 bp, Artificial Sequence
  Synthetic Polynucleotide
taatacgactcactatagggggaaggagaacgggtgctttgtctcagggaaacagaggagatccctgatgcaaagcaccaacctggcggcagcgcaaaagatg

SEQ ID NO: 160891 - DNA, 103 bp, Artificial Sequence
  Synthetic Polynucleotide
taatacgactcactatagggagcttctccgtggccgcaagtcgcgtctccaacagaggagaggagacatgacttgcggcaacctggcggcagcgcaaaagatg

SEQ ID NO: 160892 - DNA, 103 bp, Artificial Sequence
  Synthetic Polynucleotide
taatacgactcactatagggttttccaaagggaaggagaacgggtgctttaacagaggagaaaagcaatggttctccttaacctggcggcagcgcaaaagatg

SEQ ID NO: 160893 - DNA, 103 bp, Artificial Sequence
  Synthetic Polynucleotide
taatacgactcactatagggtcgggcctggttttccaaagggaaggagaaaacagaggagattctccatgcctttggaaaacctggcggcagcgcaaaagatg

SEQ ID NO: 160894 - DNA, 103 bp, Artificial Sequence
  Synthetic Polynucleotide
taatacgactcactatagggtgacagcctctcgggcctggttttccaaagaacagaggagactttggatgaccaggcccaacctggcggcagcgcaaaagatg

SEQ ID NO: 160895 - DNA, 103 bp, Artificial Sequence
  Synthetic Polynucleotide
taatacgactcactatagggaaggcactgctgacagcctctcgggcctggaacagaggagaccaggcatgagaggctgtaacctggcggcagcgcaaaagatg

SEQ ID NO: 160896 - DNA, 103 bp, Artificial Sequence
  Synthetic Polynucleotide
taatacgactcactatagggcagactgaagaaggcactgctgacagcctcaacagaggagagaggctatgagcagtgccaacctggcggcagcgcaaaagatg

SEQ ID NO: 160897 - DNA, 103 bp, Artificial Sequence
  Synthetic Polynucleotide
taatacgactcactataggggggtctgcaacagactgaagaaggcactgcaacagaggagagcagtgatgtcttcagtcaacctggcggcagcgcaaaagatg

SEQ ID NO: 160898 - DNA, 103 bp, Artificial Sequence
  Synthetic Polynucleotide
taatacgactcactatagggtgcgtgctgagggtctgcaacagactgaagaacagaggagacttcagatggttgcagacaacctggcggcagcgcaaaagatg

SEQ ID NO: 160899 - DNA, 103 bp, Artificial Sequence
  Synthetic Polynucleotide
taatacgactcactatagggctgcttgaactgcgtgctgagggtctgcaaaacagaggagattgcagatgctcagcacgaacctggcggcagcgcaaaagatg

SEQ ID NO: 160900 - DNA, 103 bp, Artificial Sequence
  Synthetic Polynucleotide
taatacgactcactatagggggcccggtgcctgcttgaactgcgtgctgaaacagaggagatcagcaatgagttcaagcaacctggcggcagcgcaaaagatg

SEQ ID NO: 160901 - DNA, 103 bp, Artificial Sequence
  Synthetic Polynucleotide
taatacgactcactatagggccctgggtctggcccggtgcctgcttgaacaacagaggagagttcaaatgggcaccgggaacctggcggcagcgcaaaagatg

SEQ ID NO: 160902 - DNA, 103 bp, Artificial Sequence
  Synthetic Polynucleotide
taatacgactcactatagggatactccagcagcttctccgtggccgcaagaacagaggagacttgcgatgacggagaagaacctggcggcagcgcaaaagatg

SEQ ID NO: 160903 - DNA, 103 bp, Artificial Sequence
  Synthetic Polynucleotide
taatacgactcactataggggggctgcccaccctgggtctggcccggtgcaacagaggagagcaccgatgcagacccagaacctggcggcagcgcaaaagatg

SEQ ID NO: 160904 - DNA, 103 bp, Artificial Sequence
  Synthetic Polynucleotide
taatacgactcactatagggggtaggtccagggctgcccaccctgggtctaacagaggagaagacccatggtgggcagcaacctggcggcagcgcaaaagatg

SEQ ID NO: 160905 - DNA, 103 bp, Artificial Sequence
  Synthetic Polynucleotide
taatacgactcactatagggtgcaccaggtggtaggtccagggctgcccaaacagaggagatgggcaatgctggacctaaacctggcggcagcgcaaaagatg

SEQ ID NO: 160906 - DNA, 103 bp, Artificial Sequence
  Synthetic Polynucleotide
taatacgactcactataggggtctgcgaactgcaccaggtggtaggtccaaacagaggagatggaccatgcacctggtgaacctggcggcagcgcaaaagatg

SEQ ID NO: 160907 - DNA, 103 bp, Artificial Sequence
  Synthetic Polynucleotide
taatacgactcactatagggtcaacaggaggtctgcgaactgcaccaggtaacagaggagaacctggatgagttcgcagaacctggcggcagcgcaaaagatg

SEQ ID NO: 160908 - DNA, 103 bp, Artificial Sequence
  Synthetic Polynucleotide
taatacgactcactatagggtggctgtgattcaacaggaggtctgcgaacaacagaggagagttcgcatgcctcctgttaacctggcggcagcgcaaaagatg

SEQ ID NO: 160909 - DNA, 103 bp, Artificial Sequence
  Synthetic Polynucleotide
taatacgactcactatagggggtcacgttgtggctgtgattcaacaggagaacagaggagactcctgatgaatcacagcaacctggcggcagcgcaaaagatg

SEQ ID NO: 160910 - DNA, 103 bp, Artificial Sequence
  Synthetic Polynucleotide
taatacgactcactataggggtgtcacggtggtcacgttgtggctgtgataacagaggagaatcacaatgacaacgtgaaacctggcggcagcgcaaaagatg

SEQ ID NO: 160911 - DNA, 103 bp, Artificial Sequence
  Synthetic Polynucleotide
taatacgactcactataggggcagtgaagggtgtcacggtggtcacgttgaacagaggagacaacgtatgcaccgtgacaacctggcggcagcgcaaaagatg

SEQ ID NO: 160912 - DNA, 103 bp, Artificial Sequence
  Synthetic Polynucleotide
taatacgactcactataggggcgctgctgcgcagtgaagggtgtcacggtaacagaggagaaccgtgatgcccttcactaacctggcggcagcgcaaaagatg

SEQ ID NO: 160913 - DNA, 103 bp, Artificial Sequence
  Synthetic Polynucleotide
taatacgactcactatagggtgccacgcagatactccagcagcttctccgaacagaggagacggagaatgtgctggagtaacctggcggcagcgcaaaagatg

SEQ ID NO: 160914 - DNA, 103 bp, Artificial Sequence
  Synthetic Polynucleotide
taatacgactcactatagggcccaggcctggcgctgctgcgcagtgaaggaacagaggagaccttcaatgcgcagcagcaacctggcggcagcgcaaaagatg

SEQ ID NO: 160915 - DNA, 103 bp, Artificial Sequence
  Synthetic Polynucleotide
taatacgactcactatagggagcatccggtcccaggcctggcgctgctgcaacagaggagagcagcaatgccaggcctgaacctggcggcagcgcaaaagatg

SEQ ID NO: 160916 - DNA, 103 bp, Artificial Sequence
  Synthetic Polynucleotide
taatacgactcactatagggcagagtctgcagcatccggtcccaggcctgaacagaggagacaggccatggaccggatgaacctggcggcagcgcaaaagatg

SEQ ID NO: 160917 - DNA, 103 bp, Artificial Sequence
  Synthetic Polynucleotide
taatacgactcactatagggccagctccttcagagtctgcagcatccggtaacagaggagaaccggaatgtgcagactcaacctggcggcagcgcaaaagatg

SEQ ID NO: 160918 - DNA, 103 bp, Artificial Sequence
  Synthetic Polynucleotide
taatacgactcactataggggagtgggcctccagctccttcagagtctgcaacagaggagagcagacatggaaggagctaacctggcggcagcgcaaaagatg

SEQ ID NO: 160919 - DNA, 103 bp, Artificial Sequence
  Synthetic Polynucleotide
taatacgactcactatagggggcctctgcggagtgggcctccagctccttaacagaggagaaaggagatggaggcccacaacctggcggcagcgcaaaagatg

SEQ ID NO: 160920 - DNA, 103 bp, Artificial Sequence
  Synthetic Polynucleotide
taatacgactcactatagggcagcagccctggcctctgcggagtgggcctaacagaggagaaggcccatgccgcagaggaacctggcggcagcgcaaaagatg

SEQ ID NO: 160921 - DNA, 103 bp, Artificial Sequence
  Synthetic Polynucleotide
taatacgactcactatagggtgctggaaggcagcagccctggcctctgcgaacagaggagacgcagaatgcagggctgcaacctggcggcagcgcaaaagatg

SEQ ID NO: 160922 - DNA, 103 bp, Artificial Sequence
  Synthetic Polynucleotide
taatacgactcactataggggagcagaaggtgctggaaggcagcagccctaacagaggagaagggctatggccttccagaacctggcggcagcgcaaaagatg

SEQ ID NO: 160923 - DNA, 103 bp, Artificial Sequence
  Synthetic Polynucleotide
taatacgactcactatagggtgcccacgaggagcagaaggtgctggaaggaacagaggagaccttccatgaccttctgcaacctggcggcagcgcaaaagatg

SEQ ID NO: 160924 - DNA, 103 bp, Artificial Sequence
  Synthetic Polynucleotide
taatacgactcactatagggcccttcggcctgccacgcagatactccagcaacagaggagagctggaatgtctgcgtggaacctggcggcagcgcaaaagatg

SEQ ID NO: 160925 - DNA, 103 bp, Artificial Sequence
  Synthetic Polynucleotide
taatacgactcactatagggaggaggtggatgcccacgaggagcagaaggaacagaggagaccttctatgcctcgtgggaacctggcggcagcgcaaaagatg

SEQ ID NO: 160926 - DNA, 103 bp, Artificial Sequence
  Synthetic Polynucleotide
taatacgactcactatagggaggggacttgaggaggtggatgcccacgagaacagaggagactcgtgatgatccacctcaacctggcggcagcgcaaaagatg

SEQ ID NO: 160927 - DNA, 103 bp, Artificial Sequence
  Synthetic Polynucleotide
taatacgactcactatagggagctctctgcaggggacttgaggaggtggaaacagaggagatccaccatgtcaagtcccaacctggcggcagcgcaaaagatg

SEQ ID NO: 160928 - DNA, 103 bp, Artificial Sequence
  Synthetic Polynucleotide
taatacgactcactatagggagcaggtcacagctctctgcaggggacttgaacagaggagacaagtcatgtgcagagagaacctggcggcagcgcaaaagatg

SEQ ID NO: 160929 - DNA, 103 bp, Artificial Sequence
  Synthetic Polynucleotide
taatacgactcactataggggatgtcacccagcaggtcacagctctctgcaacagaggagagcagagatgtgtgacctgaacctggcggcagcgcaaaagatg

SEQ ID NO: 160930 - DNA, 103 bp, Artificial Sequence
  Synthetic Polynucleotide
taatacgactcactatagggtgcaggtctggatgtcacccagcaggtcacaacagaggagagtgaccatgtgggtgacaaacctggcggcagcgcaaaagatg

SEQ ID NO: 160931 - DNA, 103 bp, Artificial Sequence
  Synthetic Polynucleotide
taatacgactcactatagggcttttcctgatgcaggtctggatgtcacccaacagaggagagggtgaatgccagacctgaacctggcggcagcgcaaaagatg

SEQ ID NO: 160932 - DNA, 103 bp, Artificial Sequence
  Synthetic Polynucleotide
taatacgactcactatagggctctcccagacttttcctgatgcaggtctgaacagaggagacagaccatgatcaggaaaaacctggcggcagcgcaaaagatg

SEQ ID NO: 160933 - DNA, 103 bp, Artificial Sequence
  Synthetic Polynucleotide
taatacgactcactatagggggcggggcttctctcccagacttttcctgaaacagaggagatcaggaatggtctgggagaacctggcggcagcgcaaaagatg

SEQ ID NO: 160934 - DNA, 103 bp, Artificial Sequence
  Synthetic Polynucleotide
taatacgactcactataggggtgcggctccggcggggcttctctcccagaaacagaggagatctgggatggaagccccgaacctggcggcagcgcaaaagatg

SEQ ID NO: 160935 - DNA, 103 bp, Artificial Sequence
  Synthetic Polynucleotide
taatacgactcactatagggcatctcggaccccttcggcctgccacgcagaacagaggagactgcgtatgaggccgaagaacctggcggcagcgcaaaagatg

SEQ ID NO: 160936 - DNA, 103 bp, Artificial Sequence
  Synthetic Polynucleotide
taatacgactcactataggggatggtcttggtgcggctccggcggggcttaacagaggagaaagcccatgcggagccgcaacctggcggcagcgcaaaagatg

SEQ ID NO: 160937 - DNA, 103 bp, Artificial Sequence
  Synthetic Polynucleotide
taatacgactcactatagggcctgggggtcgatggtcttggtgcggctccaacagaggagaggagccatgccaagaccaaacctggcggcagcgcaaaagatg

SEQ ID NO: 160938 - DNA, 103 bp, Artificial Sequence
  Synthetic Polynucleotide
taatacgactcactatagggcacgggggttcctgggggtcgatggtcttgaacagaggagacaagacatgcgacccccaaacctggcggcagcgcaaaagatg

SEQ ID NO: 160939 - DNA, 103 bp, Artificial Sequence
  Synthetic Polynucleotide
taatacgactcactatagggcacctctacccacgggggttcctgggggtcaacagaggagagaccccatggaacccccgaacctggcggcagcgcaaaagatg

SEQ ID NO: 160940 - DNA, 103 bp, Artificial Sequence
  Synthetic Polynucleotide
taatacgactcactatagggtctccaccagcacctctacccacgggggttaacagaggagaaaccccatggggtagaggaacctggcggcagcgcaaaagatg

SEQ ID NO: 160941 - DNA, 103 bp, Artificial Sequence
  Synthetic Polynucleotide
taatacgactcactataggggccagcaagatctccaccagcacctctaccaacagaggagaggtagaatggctggtggaaacctggcggcagcgcaaaagatg

SEQ ID NO: 160942 - DNA, 103 bp, Artificial Sequence
  Synthetic Polynucleotide
taatacgactcactatagggggccaacagggccagcaagatctccaccagaacagaggagactggtgatgatcttgctgaacctggcggcagcgcaaaagatg

SEQ ID NO: 160943 - DNA, 103 bp, Artificial Sequence
  Synthetic Polynucleotide
taatacgactcactatagggggctgggctgggccaacagggccagcaagaaacagaggagatcttgcatgccctgttggaacctggcggcagcgcaaaagatg

SEQ ID NO: 160944 - DNA, 103 bp, Artificial Sequence
  Synthetic Polynucleotide
taatacgactcactatagggcgcatgaggtggctgggctgggccaacaggaacagaggagacctgttatgccagcccagaacctggcggcagcgcaaaagatg

SEQ ID NO: 160945 - DNA, 103 bp, Artificial Sequence
  Synthetic Polynucleotide
taatacgactcactatagggggccacctggcgcatgaggtggctgggctgaacagaggagacagcccatgcacctcatgaacctggcggcagcgcaaaagatg

SEQ ID NO: 160946 - DNA, 103 bp, Artificial Sequence
  Synthetic Polynucleotide
taatacgactcactatagggctccaggcgacatcggctgggcgggatcccaacagaggagagggatcatgcccagccgaaacctggcggcagcgcaaaagatg

SEQ ID NO: 160947 - DNA, 103 bp, Artificial Sequence
  Synthetic Polynucleotide
taatacgactcactataggggggcatatttcatctcggaccccttcggccaacagaggagaggccgaatgggtccgagaaacctggcggcagcgcaaaagatg

SEQ ID NO: 160948 - DNA, 103 bp, Artificial Sequence
  Synthetic Polynucleotide
taatacgactcactatagggacacgctccgggccacctggcgcatgaggtaacagaggagaacctcaatggccaggtggaacctggcggcagcgcaaaagatg

SEQ ID NO: 160949 - DNA, 103 bp, Artificial Sequence
  Synthetic Polynucleotide
taatacgactcactatagggatgtggccaaacacgctccgggccacctggaacagaggagaccaggtatgccggagcgtaacctggcggcagcgcaaaagatg

SEQ ID NO: 160950 - DNA, 103 bp, Artificial Sequence
  Synthetic Polynucleotide
taatacgactcactataggggtgggagcagatgtggccaaacacgctccgaacagaggagacggagcatgtttggccacaacctggcggcagcgcaaaagatg

SEQ ID NO: 160951 - DNA, 103 bp, Artificial Sequence
  Synthetic Polynucleotide
taatacgactcactataggggcggggtcaggtgggagcagatgtggccaaaacagaggagattggccatgtctgctcccaacctggcggcagcgcaaaagatg

SEQ ID NO: 160952 - DNA, 103 bp, Artificial Sequence
  Synthetic Polynucleotide
taatacgactcactatagggtgcagggcacgcggggtcaggtgggagcagaacagaggagactgctcatgcctgaccccaacctggcggcagcgcaaaagatg

SEQ ID NO: 160953 - DNA, 103 bp, Artificial Sequence
  Synthetic Polynucleotide
taatacgactcactatagggcagaattagctgcagggcacgcggggtcagaacagaggagactgaccatgcgtgccctgaacctggcggcagcgcaaaagatg

SEQ ID NO: 160954 - DNA, 103 bp, Artificial Sequence
  Synthetic Polynucleotide
taatacgactcactatagggtcagcacatccagaattagctgcagggcacaacagaggagagtgcccatgagctaattcaacctggcggcagcgcaaaagatg

SEQ ID NO: 160955 - DNA, 103 bp, Artificial Sequence
  Synthetic Polynucleotide
taatacgactcactataggggtctcggggttcagcacatccagaattagcaacagaggagagctaatatgggatgtgctaacctggcggcagcgcaaaagatg

SEQ ID NO: 160956 - DNA, 103 bp, Artificial Sequence
  Synthetic Polynucleotide
taatacgactcactatagggatcctcactggtctcggggttcagcacatcaacagaggagagatgtgatgaaccccgagaacctggcggcagcgcaaaagatg

SEQ ID NO: 160957 - DNA, 103 bp, Artificial Sequence
  Synthetic Polynucleotide
taatacgactcactatagggggtcattctcatcctcactggtctcggggtaacagaggagaaccccgatgccagtgaggaacctggcggcagcgcaaaagatg

SEQ ID NO: 160958 - DNA, 103 bp, Artificial Sequence
  Synthetic Polynucleotide
taatacgactcactatagggagacgcttcagggcatatttcatctcggacaacagaggagagtccgaatggaaatatgcaacctggcggcagcgcaaaagatg

SEQ ID NO: 160959 - DNA, 103 bp, Artificial Sequence
  Synthetic Polynucleotide
taatacgactcactatagggaccaccacacggtcattctcatcctcactgaacagaggagacagtgaatgtgagaatgaaacctggcggcagcgcaaaagatg

SEQ ID NO: 160960 - DNA, 103 bp, Artificial Sequence
  Synthetic Polynucleotide
taatacgactcactatagggatcgtccgtcaccaccacacggtcattctcaacagaggagagagaatatgcgtgtggtgaacctggcggcagcgcaaaagatg

SEQ ID NO: 160961 - DNA, 103 bp, Artificial Sequence
  Synthetic Polynucleotide
taatacgactcactataggggctcatcagaatcgtccgtcaccaccacacaacagaggagagtgtggatgtgacggacgaacctggcggcagcgcaaaagatg

SEQ ID NO: 160962 - DNA, 103 bp, Artificial Sequence
  Synthetic Polynucleotide
taatacgactcactatagggttcagccgccgctcatcagaatcgtccgtcaacagaggagagacggaatgttctgatgaaacctggcggcagcgcaaaagatg

SEQ ID NO: 160963 - DNA, 103 bp, Artificial Sequence
  Synthetic Polynucleotide
taatacgactcactatagggctctgcacccttcagccgccgctcatcagaaacagaggagatctgatatgcggcggctgaacctggcggcagcgcaaaagatg

SEQ ID NO: 160964 - DNA, 103 bp, Artificial Sequence
  Synthetic Polynucleotide
taatacgactcactatagggcgctcttgtcctctgcacccttcagccgccaacagaggagaggcggcatgagggtgcagaacctggcggcagcgcaaaagatg

SEQ ID NO: 160965 - DNA, 103 bp, Artificial Sequence
  Synthetic Polynucleotide
taatacgactcactatagggtcaccttcctcgctcttgtcctctgcacccaacagaggagagggtgcatgggacaagagaacctggcggcagcgcaaaagatg

SEQ ID NO: 160966 - DNA, 103 bp, Artificial Sequence
  Synthetic Polynucleotide
taatacgactcactatagggtctgttgtcctcaccttcctcgctcttgtcaacagaggagagacaagatggaggaaggtaacctggcggcagcgcaaaagatg

SEQ ID NO: 160967 - DNA, 103 bp, Artificial Sequence
  Synthetic Polynucleotide
taatacgactcactatagggtctctgagcttctgttgtcctcaccttcctaacagaggagaaggaagatgaggacaacaaacctggcggcagcgcaaaagatg

SEQ ID NO: 160968 - DNA, 103 bp, Artificial Sequence
  Synthetic Polynucleotide
taatacgactcactatagggtcctcttcactctctgagcttctgttgtccaacagaggagaggacaaatgaagctcagaaacctggcggcagcgcaaaagatg

SEQ ID NO: 160969 - DNA, 103 bp, Artificial Sequence
  Synthetic Polynucleotide
taatacgactcactatagggtcccgtgattagacgcttcagggcatatttaacagaggagaaaatatatgctgaagcgtaacctggcggcagcgcaaaagatg

SEQ ID NO: 160970 - DNA, 103 bp, Artificial Sequence
  Synthetic Polynucleotide
taatacgactcactatagggcccctcgctctcctcttcactctctgagctaacagaggagaagctcaatgagtgaagagaacctggcggcagcgcaaaagatg

SEQ ID NO: 160971 - DNA, 103 bp, Artificial Sequence
  Synthetic Polynucleotide
taatacgactcactatagggcgctctcctccccctcgctctcctcttcacaacagaggagagtgaagatgagagcgaggaacctggcggcagcgcaaaagatg

SEQ ID NO: 160972 - DNA, 103 bp, Artificial Sequence
  Synthetic Polynucleotide
taatacgactcactatagggtcctcctcctcgctctcctccccctcgctcaacagaggagagagcgaatgggaggagagaacctggcggcagcgcaaaagatg

SEQ ID NO: 160973 - DNA, 103 bp, Artificial Sequence
  Synthetic Polynucleotide
taatacgactcactatagggcccgtcgcgctcctcctcctcgctctcctcaacagaggagagaggagatggaggaggagaacctggcggcagcgcaaaagatg

SEQ ID NO: 160974 - DNA, 103 bp, Artificial Sequence
  Synthetic Polynucleotide
taatacgactcactataggggatccacgtccccgtcgcgctcctcctcctaacagaggagaaggaggatgagcgcgacgaacctggcggcagcgcaaaagatg

SEQ ID NO: 160975 - DNA, 103 bp, Artificial Sequence
  Synthetic Polynucleotide
taatacgactcactatagggcggaagccctgatccacgtccccgtcgcgcaacagaggagagcgcgaatgggacgtggaaacctggcggcagcgcaaaagatg

SEQ ID NO: 160976 - DNA, 103 bp, Artificial Sequence
  Synthetic Polynucleotide
taatacgactcactatagggcagctgttcccggaagccctgatccacgtcaacagaggagagacgtgatgcagggcttcaacctggcggcagcgcaaaagatg

SEQ ID NO: 160977 - DNA, 103 bp, Artificial Sequence
  Synthetic Polynucleotide
taatacgactcactataggggcacggtcatcagctgttcccggaagccctaacagaggagaagggctatggggaacagcaacctggcggcagcgcaaaagatg

SEQ ID NO: 160978 - DNA, 103 bp, Artificial Sequence
  Synthetic Polynucleotide
taatacgactcactatagggccagcctgcagcacggtcatcagctgttccaacagaggagaggaacaatggatgaccgtaacctggcggcagcgcaaaagatg

SEQ ID NO: 160979 - DNA, 103 bp, Artificial Sequence
  Synthetic Polynucleotide
taatacgactcactatagggcagcgccttcccagcctgcagcacggtcataacagaggagaatgaccatgctgcaggctaacctggcggcagcgcaaaagatg

SEQ ID NO: 160980 - DNA, 103 bp, Artificial Sequence
  Synthetic Polynucleotide
taatacgactcactatagggcgaccccgagtcccgtgattagacgcttcaaacagaggagatgaagcatgtaatcacggaacctggcggcagcgcaaaagatg

SEQ ID NO: 160981 - DNA, 103 bp, Artificial Sequence
  Synthetic Polynucleotide
taatacgactcactatagggcctctccacccagcgccttcccagcctgcaaacagaggagatgcaggatgggaaggcgcaacctggcggcagcgcaaaagatg

SEQ ID NO: 160982 - DNA, 103 bp, Artificial Sequence
  Synthetic Polynucleotide
taatacgactcactatagggttctcactgtcctctccacccagcgccttcaacagaggagagaaggcatggggtggagaaacctggcggcagcgcaaaagatg

SEQ ID NO: 160983 - DNA, 103 bp, Artificial Sequence
  Synthetic Polynucleotide
taatacgactcactatagggctcctcctcgttctcactgtcctctccaccaacagaggagaggtggaatggacagtgagaacctggcggcagcgcaaaagatg

SEQ ID NO: 160984 - DNA, 103 bp, Artificial Sequence
  Synthetic Polynucleotide
taatacgactcactatagggcatcccccagctcctcctcgttctcactgtaacagaggagaacagtgatgacgaggaggaacctggcggcagcgcaaaagatg

SEQ ID NO: 160985 - DNA, 103 bp, Artificial Sequence
  Synthetic Polynucleotide
taatacgactcactatagggatcatggcctcatcccccagctcctcctcgaacagaggagacgaggaatggctgggggaaacctggcggcagcgcaaaagatg

SEQ ID NO: 160986 - DNA, 103 bp, Artificial Sequence
  Synthetic Polynucleotide
taatacgactcactataggggtccagggccatcatggcctcatcccccagaacagaggagactggggatggaggccatgaacctggcggcagcgcaaaagatg

SEQ ID NO: 160987 - DNA, 103 bp, Artificial Sequence
  Synthetic Polynucleotide
taatacgactcactatagggcgaggctctggtccagggccatcatggcctaacagaggagaaggccaatgtggccctggaacctggcggcagcgcaaaagatg

SEQ ID NO: 160988 - DNA, 103 bp, Artificial Sequence
  Synthetic Polynucleotide
taatacgactcactatagggaagaggctggcgaggctctggtccagggccaacagaggagaggccctatgccagagcctaacctggcggcagcgcaaaagatg

SEQ ID NO: 160989 - DNA, 103 bp, Artificial Sequence
  Synthetic Polynucleotide
taatacgactcactatagggctgctcggcaaagaggctggcgaggctctgaacagaggagacagagcatggccagcctcaacctggcggcagcgcaaaagatg

SEQ ID NO: 160990 - DNA, 103 bp, Artificial Sequence
  Synthetic Polynucleotide
taatacgactcactatagggtacgcagcttctgctcggcaaagaggctggaacagaggagaccagccatgttgccgagcaacctggcggcagcgcaaaagatg

SEQ ID NO: 160991 - DNA, 103 bp, Artificial Sequence
  Synthetic Polynucleotide
taatacgactcactataggggtttctcgcccgaccccgagtcccgtgattaacagaggagaaatcacatgactcggggtaacctggcggcagcgcaaaagatg

SEQ ID NO: 160992 - DNA, 103 bp, Artificial Sequence
  Synthetic Polynucleotide
taatacgactcactatagggcgggcctggatacgcagcttctgctcggcaaacagaggagatgccgaatggaagctgcgaacctggcggcagcgcaaaagatg

SEQ ID NO: 160993 - DNA, 103 bp, Artificial Sequence
  Synthetic Polynucleotide
taatacgactcactatagggctcgtctcgccgggcctggatacgcagcttaacagaggagaaagctgatgatccaggccaacctggcggcagcgcaaaagatg

SEQ ID NO: 160994 - DNA, 103 bp, Artificial Sequence
  Synthetic Polynucleotide
taatacgactcactataggggcttgttcttctcgtctcgccgggcctggaaacagaggagatccaggatgggcgagacgaacctggcggcagcgcaaaagatg

SEQ ID NO: 160995 - DNA, 103 bp, Artificial Sequence
  Synthetic Polynucleotide
taatacgactcactatagggtccttctgcagcttgttcttctcgtctcgcaacagaggagagcgagaatggaagaacaaaacctggcggcagcgcaaaagatg

SEQ ID NO: 160996 - DNA, 103 bp, Artificial Sequence
  Synthetic Polynucleotide
taatacgactcactatagggcagagccttctccttctgcagcttgttcttaacagaggagaaagaacatgctgcagaagaacctggcggcagcgcaaaagatg

SEQ ID NO: 160997 - DNA, 103 bp, Artificial Sequence
  Synthetic Polynucleotide
taatacgactcactatagggagtcgcgccgcagagccttctccttctgcaaacagaggagatgcagaatgagaaggctcaacctggcggcagcgcaaaagatg

SEQ ID NO: 160998 - DNA, 103 bp, Artificial Sequence
  Synthetic Polynucleotide
taatacgactcactatagggcggatctggaagtcgcgccgcagagccttcaacagaggagagaaggcatggcggcgcgaaacctggcggcagcgcaaaagatg

SEQ ID NO: 160999 - DNA, 103 bp, Artificial Sequence
  Synthetic Polynucleotide
taatacgactcactataggggtccagcacccggatctggaagtcgcgccgaacagaggagacggcgcatgttccagatcaacctggcggcagcgcaaaagatg

SEQ ID NO: 161000 - DNA, 103 bp, Artificial Sequence
  Synthetic Polynucleotide
taatacgactcactatagggcctccaccaggtccagcacccggatctggaaacagaggagatccagaatggggtgctggaacctggcggcagcgcaaaagatg

SEQ ID NO: 161001 - DNA, 103 bp, Artificial Sequence
  Synthetic Polynucleotide
taatacgactcactataggggtcactagcacctccaccaggtccagcaccaacagaggagaggtgctatgcctggtggaaacctggcggcagcgcaaaagatg

SEQ ID NO: 161002 - DNA, 103 bp, Artificial Sequence
  Synthetic Polynucleotide
taatacgactcactataggggggccgggctgtttctcgcccgaccccgagaacagaggagactcgggatggggcgagaaaacctggcggcagcgcaaaagatg

SEQ ID NO: 161003 - DNA, 103 bp, Artificial Sequence
  Synthetic Polynucleotide
taatacgactcactataggggggctgcttggtcactagcacctccaccagaacagaggagactggtgatggtgctagtgaacctggcggcagcgcaaaagatg

SEQ ID NO: 161004 - DNA, 103 bp, Artificial Sequence
  Synthetic Polynucleotide
taatacgactcactataggggggcattctcgggctgcttggtcactagcaaacagaggagatgctagatgccaagcagcaacctggcggcagcgcaaaagatg

SEQ ID NO: 161005 - DNA, 103 bp, Artificial Sequence
  Synthetic Polynucleotide
taatacgactcactatagggtccaggaccagggcattctcgggctgcttgaacagaggagacaagcaatgcgagaatgcaacctggcggcagcgcaaaagatg

SEQ ID NO: 161006 - DNA, 103 bp, Artificial Sequence
  Synthetic Polynucleotide
taatacgactcactatagggctccagcagctccaggaccagggcattctcaacagaggagagagaatatgctggtcctgaacctggcggcagcgcaaaagatg

SEQ ID NO: 161007 - DNA, 103 bp, Artificial Sequence
  Synthetic Polynucleotide
taatacgactcactatagggtcagcagcggctccagcagctccaggaccaaacagaggagatggtccatgagctgctggaacctggcggcagcgcaaaagatg

SEQ ID NO: 161008 - DNA, 103 bp, Artificial Sequence
  Synthetic Polynucleotide
taatacgactcactatagggcggatgatgctcagcagcggctccagcagcaacagaggagagctgctatggccgctgctaacctggcggcagcgcaaaagatg

SEQ ID NO: 161009 - DNA, 103 bp, Artificial Sequence
  Synthetic Polynucleotide
taatacgactcactatagggcaggctgcgccggatgatgctcagcagcggaacagaggagaccgctgatgagcatcatcaacctggcggcagcgcaaaagatg

SEQ ID NO: 161010 - DNA, 103 bp, Artificial Sequence
  Synthetic Polynucleotide
taatacgactcactatagggtgctgctgcgcaggctgcgccggatgatgcaacagaggagagcatcaatgggcgcagccaacctggcggcagcgcaaaagatg

SEQ ID NO: 161011 - DNA, 103 bp, Artificial Sequence
  Synthetic Polynucleotide
taatacgactcactatagggtgtttggagctgctgctgcgcaggctgcgcaacagaggagagcgcagatggcgcagcagaacctggcggcagcgcaaaagatg

SEQ ID NO: 161012 - DNA, 103 bp, Artificial Sequence
  Synthetic Polynucleotide
taatacgactcactataggggtcctgctcctgtttggagctgctgctgcgaacagaggagacgcagcatgagctccaaaaacctggcggcagcgcaaaagatg

SEQ ID NO: 161013 - DNA, 103 bp, Artificial Sequence
  Synthetic Polynucleotide
taatacgactcactatagggaactgtagcagggccgggctgtttctcgccaacagaggagaggcgagatgcagcccggcaacctggcggcagcgcaaaagatg

SEQ ID NO: 161014 - DNA, 103 bp, Artificial Sequence
  Synthetic Polynucleotide
taatacgactcactatagggtgtgcagaaggtcctgctcctgtttggagcaacagaggagagctccaatgaggagcaggaacctggcggcagcgcaaaagatg

SEQ ID NO: 161015 - DNA, 103 bp, Artificial Sequence
  Synthetic Polynucleotide
taatacgactcactatagggcgcgccgtcttgtgcagaaggtcctgctccaacagaggagaggagcaatgccttctgcaaacctggcggcagcgcaaaagatg

SEQ ID NO: 161016 - DNA, 103 bp, Artificial Sequence
  Synthetic Polynucleotide
taatacgactcactatagggcgtgaagatgcgcgccgtcttgtgcagaagaacagaggagacttctgatgaagacggcgaacctggcggcagcgcaaaagatg

SEQ ID NO: 161017 - DNA, 103 bp, Artificial Sequence
  Synthetic Polynucleotide
taatacgactcactatagggacaggtggtgcgtgaagatgcgcgccgtctaacagaggagaagacggatggcatcttcaaacctggcggcagcgcaaaagatg

SEQ ID NO: 161018 - DNA, 103 bp, Artificial Sequence
  Synthetic Polynucleotide
taatacgactcactatagggcgggcacggcacaggtggtgcgtgaagatgaacagaggagacatcttatggcaccacctaacctggcggcagcgcaaaagatg

SEQ ID NO: 161019 - DNA, 103 bp, Artificial Sequence
  Synthetic Polynucleotide
taatacgactcactataggggcagtagcgccgggcacggcacaggtggtgaacagaggagacaccacatgtgccgtgccaacctggcggcagcgcaaaagatg

SEQ ID NO: 161020 - DNA, 103 bp, Artificial Sequence
  Synthetic Polynucleotide
taatacgactcactatagggccaagtcgtggcagtagcgccgggcacggcaacagaggagagccgtgatgggcgctactaacctggcggcagcgcaaaagatg

SEQ ID NO: 161021 - DNA, 103 bp, Artificial Sequence
  Synthetic Polynucleotide
taatacgactcactataggggcgcgctcacccaagtcgtggcagtagcgcaacagaggagagcgctaatgccacgacttaacctggcggcagcgcaaaagatg

SEQ ID NO: 161022 - DNA, 103 bp, Artificial Sequence
  Synthetic Polynucleotide
taatacgactcactatagggcagggcccctgcgcgctcacccaagtcgtgaacagaggagacacgacatgggtgagcgcaacctggcggcagcgcaaaagatg

SEQ ID NO: 161023 - DNA, 103 bp, Artificial Sequence
  Synthetic Polynucleotide
taatacgactcactatagggcctgggcgtgcagggcccctgcgcgctcacaacagaggagagtgagcatgcaggggcccaacctggcggcagcgcaaaagatg

SEQ ID NO: 161024 - DNA, 103 bp, Artificial Sequence
  Synthetic Polynucleotide
taatacgactcactataggggccagggccaaactgtagcagggccgggctaacagaggagaagcccgatgctgctacagaacctggcggcagcgcaaaagatg

SEQ ID NO: 161025 - DNA, 103 bp, Artificial Sequence
  Synthetic Polynucleotide
taatacgactcactatagggaaccgctccacctgggcgtgcagggcccctaacagaggagaaggggcatggcacgcccaaacctggcggcagcgcaaaagatg

SEQ ID NO: 161026 - DNA, 103 bp, Artificial Sequence
  Synthetic Polynucleotide
taatacgactcactatagggctgctgcaccaaccgctccacctgggcgtgaacagaggagacacgccatggtggagcggaacctggcggcagcgcaaaagatg

SEQ ID NO: 161027 - DNA, 103 bp, Artificial Sequence
  Synthetic Polynucleotide
taatacgactcactatagggggcggccagcctgctgcaccaaccgctccaaacagaggagatggagcatgtggtgcagcaacctggcggcagcgcaaaagatg

SEQ ID NO: 161028 - DNA, 103 bp, Artificial Sequence
  Synthetic Polynucleotide
taatacgactcactataggggagtcgggctggcggccagcctgctgcaccaacagaggagaggtgcaatgggctggccgaacctggcggcagcgcaaaagatg

SEQ ID NO: 161029 - DNA, 103 bp, Artificial Sequence
  Synthetic Polynucleotide
taatacgactcactatagggggcggtgggggagtcgggctggcggccagcaacagaggagagctggcatgcagcccgacaacctggcggcagcgcaaaagatg

SEQ ID NO: 161030 - DNA, 103 bp, Artificial Sequence
  Synthetic Polynucleotide
taatacgactcactatagggagtggtagagggcggtgggggagtcgggctaacagaggagaagcccgatgcccccaccgaacctggcggcagcgcaaaagatg

SEQ ID NO: 161031 - DNA, 103 bp, Artificial Sequence
  Synthetic Polynucleotide
taatacgactcactataggggaggcgttgaagtggtagagggcggtggggaacagaggagaccccacatgcctctaccaaacctggcggcagcgcaaaagatg

SEQ ID NO: 161032 - DNA, 103 bp, Artificial Sequence
  Synthetic Polynucleotide
taatacgactcactatagggcaggtagagagaggcgttgaagtggtagagaacagaggagactctacatgttcaacgccaacctggcggcagcgcaaaagatg

SEQ ID NO: 161033 - DNA, 103 bp, Artificial Sequence
  Synthetic Polynucleotide
taatacgactcactatagggagacccggagcaggtagagagaggcgttgaaacagaggagatcaacgatgctctctaccaacctggcggcagcgcaaaagatg

SEQ ID NO: 161034 - DNA, 103 bp, Artificial Sequence
  Synthetic Polynucleotide
taatacgactcactatagggttgcccttcaagacccggagcaggtagagaaacagaggagatctctaatggctccgggtaacctggcggcagcgcaaaagatg

SEQ ID NO: 161035 - DNA, 103 bp, Artificial Sequence
  Synthetic Polynucleotide
taatacgactcactatagggtaacagctgtgccagggccaaactgtagcaaacagaggagatgctacatgttggccctgaacctggcggcagcgcaaaagatg

SEQ ID NO: 161036 - DNA, 103 bp, Artificial Sequence
  Synthetic Polynucleotide
taatacgactcactatagggctcagcagtgttgcccttcaagacccggagaacagaggagactccggatgttgaagggcaacctggcggcagcgcaaaagatg

SEQ ID NO: 161037 - DNA, 103 bp, Artificial Sequence
  Synthetic Polynucleotide
taatacgactcactataggggcacgcagccctcagcagtgttgcccttcaaacagaggagatgaaggatgacactgctgaacctggcggcagcgcaaaagatg

SEQ ID NO: 161038 - DNA, 103 bp, Artificial Sequence
  Synthetic Polynucleotide
taatacgactcactatagggtgtgtctcatgcacgcagccctcagcagtgaacagaggagacactgcatggggctgcgtaacctggcggcagcgcaaaagatg

SEQ ID NO: 161039 - DNA, 103 bp, Artificial Sequence
  Synthetic Polynucleotide
taatacgactcactatagggctgcttctcctgtgtctcatgcacgcagccaacagaggagaggctgcatgcatgagacaaacctggcggcagcgcaaaagatg

SEQ ID NO: 161040 - DNA, 103 bp, Artificial Sequence
  Synthetic Polynucleotide
taatacgactcactatagggtgccagctttctgcttctcctgtgtctcataacagaggagaatgagaatgaggagaagcaacctggcggcagcgcaaaagatg

SEQ ID NO: 161041 - DNA, 103 bp, Artificial Sequence
  Synthetic Polynucleotide
taatacgactcactatagggctggggtcagtgccagctttctgcttctccaacagaggagaggagaaatggaaagctggaacctggcggcagcgcaaaagatg

SEQ ID NO: 161042 - DNA, 103 bp, Artificial Sequence
  Synthetic Polynucleotide
taatacgactcactataggggggcatgtggctggggtcagtgccagctttaacagaggagaaaagctatgactgaccccaacctggcggcagcgcaaaagatg

SEQ ID NO: 161043 - DNA, 103 bp, Artificial Sequence
  Synthetic Polynucleotide
taatacgactcactataggggcgggcccgtgggcatgtggctggggtcagaacagaggagactgaccatggccacatgcaacctggcggcagcgcaaaagatg

SEQ ID NO: 161044 - DNA, 103 bp, Artificial Sequence
  Synthetic Polynucleotide
taatacgactcactatagggctggcagcctgcgggcccgtgggcatgtggaacagaggagaccacatatgcacgggcccaacctggcggcagcgcaaaagatg

SEQ ID NO: 161045 - DNA, 103 bp, Artificial Sequence
  Synthetic Polynucleotide
taatacgactcactataggggtccaagcagctggcagcctgcgggcccgtaacagaggagaacgggcatgcaggctgccaacctggcggcagcgcaaaagatg

SEQ ID NO: 161046 - DNA, 103 bp, Artificial Sequence
  Synthetic Polynucleotide
taatacgactcactatagggcaaaagactgtaacagctgtgccagggccaaacagaggagatggcccatgcacagctgtaacctggcggcagcgcaaaagatg

SEQ ID NO: 161047 - DNA, 103 bp, Artificial Sequence
  Synthetic Polynucleotide
taatacgactcactatagggccaggttcaagtccaagcagctggcagcctaacagaggagaaggctgatggctgcttggaacctggcggcagcgcaaaagatg

SEQ ID NO: 161048 - DNA, 103 bp, Artificial Sequence
  Synthetic Polynucleotide
taatacgactcactatagggacccgggtcaccaggttcaagtccaagcagaacagaggagactgcttatgcttgaacctaacctggcggcagcgcaaaagatg

SEQ ID NO: 161049 - DNA, 103 bp, Artificial Sequence
  Synthetic Polynucleotide
taatacgactcactatagggtgtcgagtacacccgggtcaccaggttcaaaacagaggagattgaacatggtgacccggaacctggcggcagcgcaaaagatg

SEQ ID NO: 161050 - DNA, 103 bp, Artificial Sequence
  Synthetic Polynucleotide
taatacgactcactatagggagctcagtgctgtcgagtacacccgggtcaaacagaggagatgacccatgtgtactcgaaacctggcggcagcgcaaaagatg

SEQ ID NO: 161051 - DNA, 103 bp, Artificial Sequence
  Synthetic Polynucleotide
taatacgactcactataggggtcaggaaggagctcagtgctgtcgagtacaacagaggagagtactcatgagcactgagaacctggcggcagcgcaaaagatg

SEQ ID NO: 161052 - DNA, 103 bp, Artificial Sequence
  Synthetic Polynucleotide
taatacgactcactataggggttgcgcttggtcaggaaggagctcagtgcaacagaggagagcactgatgtccttcctgaacctggcggcagcgcaaaagatg

SEQ ID NO: 161053 - DNA, 103 bp, Artificial Sequence
  Synthetic Polynucleotide
taatacgactcactatagggtgagggggctgttgcgcttggtcaggaaggaacagaggagaccttccatgccaagcgcaaacctggcggcagcgcaaaagatg

SEQ ID NO: 161054 - DNA, 103 bp, Artificial Sequence
  Synthetic Polynucleotide
taatacgactcactatagggatgggaactgtgagggggctgttgcgcttgaacagaggagacaagcgatgcagccccctaacctggcggcagcgcaaaagatg

SEQ ID NO: 161055 - DNA, 103 bp, Artificial Sequence
  Synthetic Polynucleotide
taatacgactcactataggggctgaggaacatgggaactgtgagggggctaacagaggagaagccccatgacagttcccaacctggcggcagcgcaaaagatg

SEQ ID NO: 161056 - DNA, 103 bp, Artificial Sequence
  Synthetic Polynucleotide
taatacgactcactataggggggagaagaggctgaggaacatgggaactgaacagaggagacagttcatgtgttcctcaaacctggcggcagcgcaaaagatg

SEQ ID NO: 161057 - DNA, 103 bp, Artificial Sequence
  Synthetic Polynucleotide
taatacgactcactatagggtgcgtcgcttctccaggcgacatcggctggaacagaggagaccagccatggtcgcctggaacctggcggcagcgcaaaagatg

SEQ ID NO: 161058 - DNA, 103 bp, Artificial Sequence
  Synthetic Polynucleotide
taatacgactcactataggggggaggtcttcaaaagactgtaacagctgtaacagaggagaacagctatgacagtctttaacctggcggcagcgcaaaagatg

SEQ ID NO: 161059 - DNA, 103 bp, Artificial Sequence
  Synthetic Polynucleotide
taatacgactcactatagggaccgggtgccgggagaagaggctgaggaacaacagaggagagttcctatgcctcttctcaacctggcggcagcgcaaaagatg

SEQ ID NO: 161060 - DNA, 103 bp, Artificial Sequence
  Synthetic Polynucleotide
taatacgactcactatagggctgacagagcaccgggtgccgggagaagagaacagaggagactcttcatgcggcacccgaacctggcggcagcgcaaaagatg

SEQ ID NO: 161061 - DNA, 103 bp, Artificial Sequence
  Synthetic Polynucleotide
taatacgactcactatagggggagcaggctctgacagagcaccgggtgccaacagaggagaggcaccatgtgctctgtcaacctggcggcagcgcaaaagatg

SEQ ID NO: 161062 - DNA, 103 bp, Artificial Sequence
  Synthetic Polynucleotide
taatacgactcactatagggaccaggatggggagcaggctctgacagagcaacagaggagagctctgatggagcctgctaacctggcggcagcgcaaaagatg

SEQ ID NO: 161063 - DNA, 103 bp, Artificial Sequence
  Synthetic Polynucleotide
taatacgactcactataggggatatgctggaccaggatggggagcaggctaacagaggagaagcctgatgcccatcctgaacctggcggcagcgcaaaagatg

SEQ ID NO: 161064 - DNA, 103 bp, Artificial Sequence
  Synthetic Polynucleotide
taatacgactcactatagggccgggcccgtgatatgctggaccaggatggaacagaggagaccatccatgtccagcataaacctggcggcagcgcaaaagatg

SEQ ID NO: 161065 - DNA, 103 bp, Artificial Sequence
  Synthetic Polynucleotide
taatacgactcactatagggcggggccgcaccgggcccgtgatatgctggaacagaggagaccagcaatgcacgggcccaacctggcggcagcgcaaaagatg

SEQ ID NO: 161066 - DNA, 103 bp, Artificial Sequence
  Synthetic Polynucleotide
taatacgactcactatagggggcctgatgacggggccgcaccgggcccgtaacagaggagaacgggcatggtgcggcccaacctggcggcagcgcaaaagatg

SEQ ID NO: 161067 - DNA, 103 bp, Artificial Sequence
  Synthetic Polynucleotide
taatacgactcactataggggcagcaggcaggcctgatgacggggccgcaaacagaggagatgcggcatggtcatcaggaacctggcggcagcgcaaaagatg

SEQ ID NO: 161068 - DNA, 103 bp, Artificial Sequence
  Synthetic Polynucleotide
taatacgactcactataggggtcttctggagcagcaggcaggcctgatgaaacagaggagatcatcaatgctgcctgctaacctggcggcagcgcaaaagatg

SEQ ID NO: 161069 - DNA, 103 bp, Artificial Sequence
  Synthetic Polynucleotide
taatacgactcactataggggctgcacaaggggaggtcttcaaaagactgaacagaggagacagtctatggaagacctcaacctggcggcagcgcaaaagatg

SEQ ID NO: 161070 - DNA, 103 bp, Artificial Sequence
  Synthetic Polynucleotide
taatacgactcactatagggcatggacagggtcttctggagcagcaggcaaacagaggagatgcctgatgctccagaagaacctggcggcagcgcaaaagatg

SEQ ID NO: 161071 - DNA, 103 bp, Artificial Sequence
  Synthetic Polynucleotide
taatacgactcactatagggtcacctcccgcatggacagggtcttctggaaacagaggagatccagaatgccctgtccaaacctggcggcagcgcaaaagatg

SEQ ID NO: 161072 - DNA, 103 bp, Artificial Sequence
  Synthetic Polynucleotide
taatacgactcactatagggaagcacgacctcacctcccgcatggacaggaacagaggagacctgtcatggcgggaggtaacctggcggcagcgcaaaagatg

SEQ ID NO: 161073 - DNA, 103 bp, Artificial Sequence
  Synthetic Polynucleotide
taatacgactcactatagggggggtcctcaaagcacgacctcacctcccgaacagaggagacgggagatgaggtcgtgcaacctggcggcagcgcaaaagatg

SEQ ID NO: 161074 - DNA, 103 bp, Artificial Sequence
  Synthetic Polynucleotide
taatacgactcactataggggcttccactcggggtcctcaaagcacgaccaacagaggagaggtcgtatgttgaggaccaacctggcggcagcgcaaaagatg

SEQ ID NO: 161075 - DNA, 103 bp, Artificial Sequence
  Synthetic Polynucleotide
taatacgactcactatagggcccatcagctgcttccactcggggtcctcaaacagaggagatgaggaatgcgagtggaaaacctggcggcagcgcaaaagatg

SEQ ID NO: 161076 - DNA, 103 bp, Artificial Sequence
  Synthetic Polynucleotide
taatacgactcactatagggtaggacctggcccatcagctgcttccactcaacagaggagagagtggatgcagctgatgaacctggcggcagcgcaaaagatg

SEQ ID NO: 161077 - DNA, 103 bp, Artificial Sequence
  Synthetic Polynucleotide
taatacgactcactatagggtgacctttgctaggacctggcccatcagctaacagaggagaagctgaatggccaggtccaacctggcggcagcgcaaaagatg

SEQ ID NO: 161078 - DNA, 103 bp, Artificial Sequence
  Synthetic Polynucleotide
taatacgactcactatagggaagttctcggtgacctttgctaggacctggaacagaggagaccaggtatgagcaaaggtaacctggcggcagcgcaaaagatg

SEQ ID NO: 161079 - DNA, 103 bp, Artificial Sequence
  Synthetic Polynucleotide
taatacgactcactatagggcagcacgcgcaagttctcggtgacctttgcaacagaggagagcaaagatgaccgagaacaacctggcggcagcgcaaaagatg

SEQ ID NO: 161080 - DNA, 103 bp, Artificial Sequence
  Synthetic Polynucleotide
taatacgactcactataggggctgcaggatgctgcacaaggggaggtcttaacagaggagaaagaccatgccttgtgcaaacctggcggcagcgcaaaagatg

SEQ ID NO: 161081 - DNA, 103 bp, Artificial Sequence
  Synthetic Polynucleotide
taatacgactcactataggggcgcctcccccagcacgcgcaagttctcggaacagaggagaccgagaatgtgcgcgtgcaacctggcggcagcgcaaaagatg

SEQ ID NO: 161082 - DNA, 103 bp, Artificial Sequence
  Synthetic Polynucleotide
taatacgactcactataggggccttggtctgcgcctcccccagcacgcgcaacagaggagagcgcgtatggggggaggcaacctggcggcagcgcaaaagatg

SEQ ID NO: 161083 - DNA, 103 bp, Artificial Sequence
  Synthetic Polynucleotide
taatacgactcactatagggctgatgctgcgccttggtctgcgcctccccaacagaggagaggggagatgcagaccaagaacctggcggcagcgcaaaagatg

SEQ ID NO: 161084 - DNA, 103 bp, Artificial Sequence
  Synthetic Polynucleotide
taatacgactcactatagggacagtgcctgctgatgctgcgccttggtctaacagaggagaagaccaatgcgcagcatcaacctggcggcagcgcaaaagatg

SEQ ID NO: 161085 - DNA, 103 bp, Artificial Sequence
  Synthetic Polynucleotide
taatacgactcactatagggtccagggaggacagtgcctgctgatgctgcaacagaggagagcagcaatggcaggcactaacctggcggcagcgcaaaagatg

SEQ ID NO: 161086 - DNA, 103 bp, Artificial Sequence
  Synthetic Polynucleotide
taatacgactcactataggggttgagcagctccagggaggacagtgcctgaacagaggagacaggcaatgtcctccctgaacctggcggcagcgcaaaagatg

SEQ ID NO: 161087 - DNA, 103 bp, Artificial Sequence
  Synthetic Polynucleotide
taatacgactcactatagggtgaagagaacgttgagcagctccagggaggaacagaggagacctcccatgagctgctcaaacctggcggcagcgcaaaagatg

SEQ ID NO: 161088 - DNA, 103 bp, Artificial Sequence
  Synthetic Polynucleotide
taatacgactcactatagggttgcaggtcctgaagagaacgttgagcagcaacagaggagagctgctatgcgttctcttaacctggcggcagcgcaaaagatg

SEQ ID NO: 161089 - DNA, 103 bp, Artificial Sequence
  Synthetic Polynucleotide
taatacgactcactatagggcttctcatgtttgcaggtcctgaagagaacaacagaggagagttctcatgaggacctgcaacctggcggcagcgcaaaagatg

SEQ ID NO: 161090 - DNA, 103 bp, Artificial Sequence
  Synthetic Polynucleotide
taatacgactcactatagggccaaggtcagcttctcatgtttgcaggtccaacagaggagaggacctatgaacatgagaaacctggcggcagcgcaaaagatg

SEQ ID NO: 161091 - DNA, 103 bp, Artificial Sequence
  Synthetic Polynucleotide
taatacgactcactatagggtcttgtatctgctgcaggatgctgcacaagaacagaggagacttgtgatgcatcctgcaaacctggcggcagcgcaaaagatg

SEQ ID NO: 161092 - DNA, 103 bp, Artificial Sequence
  Synthetic Polynucleotide
taatacgactcactatagggaccgtcaggtccaaggtcagcttctcatgtaacagaggagaacatgaatggctgaccttaacctggcggcagcgcaaaagatg

SEQ ID NO: 161093 - DNA, 103 bp, Artificial Sequence
  Synthetic Polynucleotide
taatacgactcactatagggacccaggagcaccgtcaggtccaaggtcagaacagaggagactgaccatggacctgacgaacctggcggcagcgcaaaagatg

SEQ ID NO: 161094 - DNA, 103 bp, Artificial Sequence
  Synthetic Polynucleotide
taatacgactcactatagggcctgcagcacacccaggagcaccgtcaggtaacagaggagaacctgaatgtgctcctggaacctggcggcagcgcaaaagatg

SEQ ID NO: 161095 - DNA, 103 bp, Artificial Sequence
  Synthetic Polynucleotide
taatacgactcactatagggtgctgttgcccctgcagcacacccaggagcaacagaggagagctcctatgtgtgctgcaaacctggcggcagcgcaaaagatg

SEQ ID NO: 161096 - DNA, 103 bp, Artificial Sequence
  Synthetic Polynucleotide
taatacgactcactatagggctgtaggctctgctgttgcccctgcagcacaacagaggagagtgctgatggggcaacagaacctggcggcagcgcaaaagatg

SEQ ID NO: 161097 - DNA, 103 bp, Artificial Sequence
  Synthetic Polynucleotide
taatacgactcactataggggtgccccctgctgtaggctctgctgttgccaacagaggagaggcaacatgagagcctacaacctggcggcagcgcaaaagatg

SEQ ID NO: 161098 - DNA, 103 bp, Artificial Sequence
  Synthetic Polynucleotide
taatacgactcactatagggccggtggagtgtgccccctgctgtaggctcaacagaggagagagcctatggcagggggcaacctggcggcagcgcaaaagatg

SEQ ID NO: 161099 - DNA, 103 bp, Artificial Sequence
  Synthetic Polynucleotide
taatacgactcactataggggcggctggagccggtggagtgtgccccctgaacagaggagacaggggatgcactccaccaacctggcggcagcgcaaaagatg

SEQ ID NO: 161100 - DNA, 103 bp, Artificial Sequence
  Synthetic Polynucleotide
taatacgactcactatagggggtcgtgcaggcggctggagccggtggagtaacagaggagaactccaatggctccagccaacctggcggcagcgcaaaagatg

SEQ ID NO: 161101 - DNA, 103 bp, Artificial Sequence
  Synthetic Polynucleotide
taatacgactcactatagggtgccagtagaggtcgtgcaggcggctggagaacagaggagactccagatgcctgcacgaaacctggcggcagcgcaaaagatg

SEQ ID NO: 161102 - DNA, 103 bp, Artificial Sequence
  Synthetic Polynucleotide
taatacgactcactataggggtcatatttttcttgtatctgctgcaggataacagaggagaatcctgatgcagatacaaaacctggcggcagcgcaaaagatg

SEQ ID NO: 161103 - DNA, 103 bp, Artificial Sequence
  Synthetic Polynucleotide
taatacgactcactatagggtttcatggcctgccagtagaggtcgtgcagaacagaggagactgcacatgctctactggaacctggcggcagcgcaaaagatg

SEQ ID NO: 161104 - DNA, 103 bp, Artificial Sequence
  Synthetic Polynucleotide
taatacgactcactatagggctcccagggttttcatggcctgccagtagaaacagaggagatctactatgaggccatgaaacctggcggcagcgcaaaagatg

SEQ ID NO: 161105 - DNA, 103 bp, Artificial Sequence
  Synthetic Polynucleotide
taatacgactcactataggggggcgctggactcccagggttttcatggccaacagaggagaggccatatgaaccctgggaacctggcggcagcgcaaaagatg

SEQ ID NO: 161106 - DNA, 103 bp, Artificial Sequence
  Synthetic Polynucleotide
taatacgactcactatagggctccaacttggggcgctggactcccagggtaacagaggagaaccctgatggtccagcgcaacctggcggcagcgcaaaagatg

SEQ ID NO: 161107 - DNA, 103 bp, Artificial Sequence
  Synthetic Polynucleotide
taatacgactcactatagggcatccttcttctccaacttggggcgctggaaacagaggagatccagcatgccaagttggaacctggcggcagcgcaaaagatg

SEQ ID NO: 161108 - DNA, 103 bp, Artificial Sequence
  Synthetic Polynucleotide
taatacgactcactatagggatctccttggcatccttcttctccaacttgaacagaggagacaagttatggaagaaggaaacctggcggcagcgcaaaagatg

SEQ ID NO: 161109 - DNA, 103 bp, Artificial Sequence
  Synthetic Polynucleotide
taatacgactcactatagggggcactggggatctccttggcatccttcttaacagaggagaaagaagatggccaaggagaacctggcggcagcgcaaaagatg

SEQ ID NO: 161110 - DNA, 103 bp, Artificial Sequence
  Synthetic Polynucleotide
taatacgactcactatagggggctctgggtggcactggggatctccttggaacagaggagaccaaggatgtccccagtgaacctggcggcagcgcaaaagatg

SEQ ID NO: 161111 - DNA, 103 bp, Artificial Sequence
  Synthetic Polynucleotide
taatacgactcactatagggttactgatggggctctgggtggcactggggaacagaggagaccccagatgcacccagagaacctggcggcagcgcaaaagatg

SEQ ID NO: 161112 - DNA, 103 bp, Artificial Sequence
  Synthetic Polynucleotide
taatacgactcactatagggcttccgcttcttactgatggggctctgggtaacagaggagaacccagatgcccatcagtaacctggcggcagcgcaaaagatg

SEQ ID NO: 161113 - DNA, 103 bp, Artificial Sequence
  Synthetic Polynucleotide
taatacgactcactatagggcctgatgcaggtcatatttttcttgtatctaacagaggagaagatacatgaaaaatatgaacctggcggcagcgcaaaagatg

SEQ ID NO: 161114 - DNA, 103 bp, Artificial Sequence
  Synthetic Polynucleotide
taatacgactcactatagggatccctttttcttccgcttcttactgatggaacagaggagaccatcaatgagaagcggaaacctggcggcagcgcaaaagatg

SEQ ID NO: 161115 - DNA, 103 bp, Artificial Sequence
  Synthetic Polynucleotide
taatacgactcactatagggtctggcaagaatccctttttcttccgcttcaacagaggagagaagcgatggaaaaagggaacctggcggcagcgcaaaagatg

SEQ ID NO: 161116 - DNA, 103 bp, Artificial Sequence
  Synthetic Polynucleotide
taatacgactcactatagggcttcttcgtctctggcaagaatccctttttaacagaggagaaaaaagatgttcttgccaaacctggcggcagcgcaaaagatg

SEQ ID NO: 161117 - DNA, 103 bp, Artificial Sequence
  Synthetic Polynucleotide
taatacgactcactataggggtttcttgcgcttcttcgtctctggcaagaaacagaggagatcttgcatgagacgaagaaacctggcggcagcgcaaaagatg

SEQ ID NO: 161118 - DNA, 103 bp, Artificial Sequence
  Synthetic Polynucleotide
taatacgactcactatagggtctgacttgcgtttcttgcgcttcttcgtcaacagaggagagacgaaatggcgcaagaaaacctggcggcagcgcaaaagatg

SEQ ID NO: 161119 - DNA, 103 bp, Artificial Sequence
  Synthetic Polynucleotide
taatacgactcactatagggcgtgccatcctctgacttgcgtttcttgcgaacagaggagacgcaagatgcgcaagtcaaacctggcggcagcgcaaaagatg

SEQ ID NO: 161120 - DNA, 103 bp, Artificial Sequence
  Synthetic Polynucleotide
taatacgactcactatagggcctccgctggcgtgccatcctctgacttgcaacagaggagagcaagtatgaggatggcaaacctggcggcagcgcaaaagatg

SEQ ID NO: 161121 - DNA, 103 bp, Artificial Sequence
  Synthetic Polynucleotide
taatacgactcactatagggggtgtgccatcctccgctggcgtgccatccaacagaggagaggatggatggccagcggaaacctggcggcagcgcaaaagatg

SEQ ID NO: 161122 - DNA, 103 bp, Artificial Sequence
  Synthetic Polynucleotide
taatacgactcactatagggggtggctgcaggtgtgccatcctccgctggaacagaggagaccagcgatggatggcacaaacctggcggcagcgcaaaagatg

SEQ ID NO: 161123 - DNA, 103 bp, Artificial Sequence
  Synthetic Polynucleotide
taatacgactcactatagggggctcccgccggtggctgcaggtgtgccataacagaggagaatggcaatgctgcagccaaacctggcggcagcgcaaaagatg

SEQ ID NO: 161124 - DNA, 103 bp, Artificial Sequence
  Synthetic Polynucleotide
taatacgactcactataggggccttcttcacctgatgcaggtcatattttaacagaggagaaaaataatgcctgcatcaaacctggcggcagcgcaaaagatg

SEQ ID NO: 161125 - DNA, 103 bp, Artificial Sequence
  Synthetic Polynucleotide
taatacgactcactatagggctggggggctggctcccgccggtggctgcaaacagaggagatgcagcatgcggcgggagaacctggcggcagcgcaaaagatg

SEQ ID NO: 161126 - DNA, 103 bp, Artificial Sequence
  Synthetic Polynucleotide
taatacgactcactatagggcctgcccatgctggggggctggctcccgccaacagaggagaggcgggatgcagccccccaacctggcggcagcgcaaaagatg

SEQ ID NO: 161127 - DNA, 103 bp, Artificial Sequence
  Synthetic Polynucleotide
taatacgactcactatagggtcctcttcttcctgcccatgctggggggctaacagaggagaagccccatggcatgggcaaacctggcggcagcgcaaaagatg

SEQ ID NO: 161128 - DNA, 103 bp, Artificial Sequence
  Synthetic Polynucleotide
taatacgactcactatagggtttgtcctgttcctcttcttcctgcccatgaacagaggagacatgggatggaagaagagaacctggcggcagcgcaaaagatg

SEQ ID NO: 161129 - DNA, 103 bp, Artificial Sequence
  Synthetic Polynucleotide
taatacgactcactataggggaccttagcctttgtcctgttcctcttcttaacagaggagaaagaagatgaacaggacaaacctggcggcagcgcaaaagatg

SEQ ID NO: 161130 - DNA, 103 bp, Artificial Sequence
  Synthetic Polynucleotide
taatacgactcactatagggcctgggctgggaccttagcctttgtcctgtaacagaggagaacaggaatgaggctaaggaacctggcggcagcgcaaaagatg

SEQ ID NO: 161131 - DNA, 103 bp, Artificial Sequence
  Synthetic Polynucleotide
taatacgactcactataggggtcccgtttgcctgggctgggaccttagccaacagaggagaggctaaatgcccagcccaaacctggcggcagcgcaaaagatg

SEQ ID NO: 161132 - DNA, 103 bp, Artificial Sequence
  Synthetic Polynucleotide
taatacgactcactatagggggtggttggcgtcccgtttgcctgggctggaacagaggagaccagccatggcaaacgggaacctggcggcagcgcaaaagatg

SEQ ID NO: 161133 - DNA, 103 bp, Artificial Sequence
  Synthetic Polynucleotide
taatacgactcactatagggctggactcttggtggttggcgtcccgtttgaacagaggagacaaacgatgcgccaaccaaacctggcggcagcgcaaaagatg

SEQ ID NO: 161134 - DNA, 103 bp, Artificial Sequence
  Synthetic Polynucleotide
taatacgactcactataggggcgccaggggctggactcttggtggttggcaacagaggagagccaacatgcaagagtccaacctggcggcagcgcaaaagatg

SEQ ID NO: 161135 - DNA, 103 bp, Artificial Sequence
  Synthetic Polynucleotide
taatacgactcactatagggtctcagcattgccttcttcacctgatgcagaacagaggagactgcatatggtgaagaagaacctggcggcagcgcaaaagatg

SEQ ID NO: 161136 - DNA, 103 bp, Artificial Sequence
  Synthetic Polynucleotide
taatacgactcactatagggccgggtgggggcgccaggggctggactcttaacagaggagaaagagtatggcccctggcaacctggcggcagcgcaaaagatg

SEQ ID NO: 161137 - DNA, 103 bp, Artificial Sequence
  Synthetic Polynucleotide
taatacgactcactatagggtgctggggctccgggtgggggcgccaggggaacagaggagacccctgatgcccccacccaacctggcggcagcgcaaaagatg

SEQ ID NO: 161138 - DNA, 103 bp, Artificial Sequence
  Synthetic Polynucleotide
taatacgactcactatagggttggcaggggtgctggggctccgggtggggaacagaggagaccccacatggagccccagaacctggcggcagcgcaaaagatg

SEQ ID NO: 161139 - DNA, 103 bp, Artificial Sequence
  Synthetic Polynucleotide
taatacgactcactatagggttttggggatttggcaggggtgctggggctaacagaggagaagccccatgacccctgccaacctggcggcagcgcaaaagatg

SEQ ID NO: 161140 - DNA, 103 bp, Artificial Sequence
  Synthetic Polynucleotide
taatacgactcactatagggtcttctgcagttttggggatttggcaggggaacagaggagacccctgatgaatccccaaaacctggcggcagcgcaaaagatg

SEQ ID NO: 161141 - DNA, 103 bp, Artificial Sequence
  Synthetic Polynucleotide
taatacgactcactatagggttctggtttttcttctgcagttttggggataacagaggagaatccccatgactgcagaaaacctggcggcagcgcaaaagatg

SEQ ID NO: 161142 - DNA, 103 bp, Artificial Sequence
  Synthetic Polynucleotide
taatacgactcactatagggctgggacggcttctggtttttcttctgcagaacagaggagactgcagatgaaaaaccagaacctggcggcagcgcaaaagatg

SEQ ID NO: 161143 - DNA, 103 bp, Artificial Sequence
  Synthetic Polynucleotide
taatacgactcactatagggctccattcacctgggacggcttctggttttaacagaggagaaaaaccatgagccgtcccaacctggcggcagcgcaaaagatg

SEQ ID NO: 161144 - DNA, 103 bp, Artificial Sequence
  Synthetic Polynucleotide
taatacgactcactataggggacccgggagctccattcacctgggacggcaacagaggagagccgtcatgggtgaatggaacctggcggcagcgcaaaagatg

SEQ ID NO: 161145 - DNA, 103 bp, Artificial Sequence
  Synthetic Polynucleotide
taatacgactcactatagggttccgtgggggacccgggagctccattcacaacagaggagagtgaatatggctcccgggaacctggcggcagcgcaaaagatg

SEQ ID NO: 161146 - DNA, 103 bp, Artificial Sequence
  Synthetic Polynucleotide
taatacgactcactatagggagagagcaggtctcagcattgccttcttcaaacagaggagatgaagaatgcaatgctgaaacctggcggcagcgcaaaagatg

SEQ ID NO: 161147 - DNA, 103 bp, Artificial Sequence
  Synthetic Polynucleotide
taatacgactcactatagggggcctgcaggttccgtgggggacccgggagaacagaggagactcccgatgcccccacggaacctggcggcagcgcaaaagatg

SEQ ID NO: 161148 - DNA, 103 bp, Artificial Sequence
  Synthetic Polynucleotide
taatacgactcactatagggtgctgcttttggcctgcaggttccgtggggaacagaggagaccccacatgacctgcaggaacctggcggcagcgcaaaagatg

SEQ ID NO: 161149 - DNA, 103 bp, Artificial Sequence
  Synthetic Polynucleotide
taatacgactcactatagggagccttctgatgctgcttttggcctgcaggaacagaggagacctgcaatgcaaaagcagaacctggcggcagcgcaaaagatg

SEQ ID NO: 161150 - DNA, 103 bp, Artificial Sequence
  Synthetic Polynucleotide
taatacgactcactatagggttttgggaagagccttctgatgctgcttttaacagaggagaaaaagcatgatcagaaggaacctggcggcagcgcaaaagatg

SEQ ID NO: 161151 - DNA, 103 bp, Artificial Sequence
  Synthetic Polynucleotide
taatacgactcactatagggaagaccccctttttgggaagagccttctgaaacagaggagatcagaaatgtcttcccaaaacctggcggcagcgcaaaagatg

SEQ ID NO: 161152 - DNA, 103 bp, Artificial Sequence
  Synthetic Polynucleotide
taatacgactcactatagggtgatttgcccaagaccccctttttgggaagaacagaggagacttcccatgaagggggtcaacctggcggcagcgcaaaagatg

SEQ ID NO: 161153 - DNA, 103 bp, Artificial Sequence
  Synthetic Polynucleotide
taatacgactcactatagggcggacagtggtgatttgcccaagaccccctaacagaggagaagggggatgtgggcaaataacctggcggcagcgcaaaagatg

SEQ ID NO: 161154 - DNA, 103 bp, Artificial Sequence
  Synthetic Polynucleotide
taatacgactcactatagggcgtgccagcgcggacagtggtgatttgcccaacagaggagagggcaaatgaccactgtcaacctggcggcagcgcaaaagatg

SEQ ID NO: 161155 - DNA, 103 bp, Artificial Sequence
  Synthetic Polynucleotide
taatacgactcactatagggtgcctttttccgtgccagcgcggacagtggaacagaggagaccactgatggcgctggcaaacctggcggcagcgcaaaagatg

SEQ ID NO: 161156 - DNA, 103 bp, Artificial Sequence
  Synthetic Polynucleotide
taatacgactcactatagggaagacagccttgcctttttccgtgccagcgaacagaggagacgctggatgggaaaaaggaacctggcggcagcgcaaaagatg

SEQ ID NO: 161157 - DNA, 103 bp, Artificial Sequence
  Synthetic Polynucleotide
taatacgactcactatagggaggtttgcaaagagagcaggtctcagcattaacagaggagaaatgctatgacctgctctaacctggcggcagcgcaaaagatg

SEQ ID NO: 161158 - DNA, 103 bp, Artificial Sequence
  Synthetic Polynucleotide
taatacgactcactatagggctgatgaccaaagacagccttgcctttttcaacagaggagagaaaaaatgaaggctgtcaacctggcggcagcgcaaaagatg

SEQ ID NO: 161159 - DNA, 103 bp, Artificial Sequence
  Synthetic Polynucleotide
taatacgactcactataggggctgggactcctgatgaccaaagacagcctaacagaggagaaggctgatgttggtcatcaacctggcggcagcgcaaaagatg

SEQ ID NO: 161160 - DNA, 103 bp, Artificial Sequence
  Synthetic Polynucleotide
taatacgactcactatagggtctgaagcaggctgggactcctgatgaccaaacagaggagatggtcaatgggagtcccaaacctggcggcagcgcaaaagatg

SEQ ID NO: 161161 - DNA, 103 bp, Artificial Sequence
  Synthetic Polynucleotide
taatacgactcactatagggttggccccactctgaagcaggctgggactcaacagaggagagagtccatgcctgcttcaaacctggcggcagcgcaaaagatg

SEQ ID NO: 161162 - DNA, 103 bp, Artificial Sequence
  Synthetic Polynucleotide
taatacgactcactatagggtgctttcttcttggccccactctgaagcagaacagaggagactgcttatgagtggggccaacctggcggcagcgcaaaagatg

SEQ ID NO: 161163 - DNA, 103 bp, Artificial Sequence
  Synthetic Polynucleotide
taatacgactcactatagggtcagagtctgtgctttcttcttggccccacaacagaggagagtggggatgagaagaaagaacctggcggcagcgcaaaagatg

SEQ ID NO: 161164 - DNA, 103 bp, Artificial Sequence
  Synthetic Polynucleotide
taatacgactcactatagggattgtgaatctcagagtctgtgctttcttcaacagaggagagaagaaatgacagactctaacctggcggcagcgcaaaagatg

SEQ ID NO: 161165 - DNA, 103 bp, Artificial Sequence
  Synthetic Polynucleotide
taatacgactcactatagggagagctgctgattgtgaatctcagagtctgaacagaggagacagactatgagattcacaaacctggcggcagcgcaaaagatg

SEQ ID NO: 161166 - DNA, 103 bp, Artificial Sequence
  Synthetic Polynucleotide
taatacgactcactatagggggcgccactctgcgtcgcttctccaggcgaaacagaggagatcgcctatggaagcgacgaacctggcggcagcgcaaaagatg

SEQ ID NO: 161167 - DNA, 103 bp, Artificial Sequence
  Synthetic Polynucleotide
taatacgactcactatagggcactccaaacaggtttgcaaagagagcaggaacagaggagacctgctatgtttgcaaacaacctggcggcagcgcaaaagatg

SEQ ID NO: 161168 - DNA, 103 bp, Artificial Sequence
  Synthetic Polynucleotide
taatacgactcactatagggagagggcgagcactccaaacaggtttgcaaaacagaggagattgcaaatgtgtttggagaacctggcggcagcgcaaaagatg

SEQ ID NO: 161169 - DNA, 103 bp, Artificial Sequence
  Synthetic Polynucleotide
taatacgactcactatagggcctgactgaaagagggcgagcactccaaacaacagaggagagtttggatggctcgccctaacctggcggcagcgcaaaagatg

SEQ ID NO: 161170 - DNA, 103 bp, Artificial Sequence
  Synthetic Polynucleotide
taatacgactcactatagggcaccagccgacctgactgaaagagggcgagaacagaggagactcgccatgtttcagtcaaacctggcggcagcgcaaaagatg

SEQ ID NO: 161171 - DNA, 103 bp, Artificial Sequence
  Synthetic Polynucleotide
taatacgactcactatagggcctggtccttcaccagccgacctgactgaaaacagaggagattcagtatggtcggctggaacctggcggcagcgcaaaagatg

SEQ ID NO: 161172 - DNA, 103 bp, Artificial Sequence
  Synthetic Polynucleotide
taatacgactcactatagggatcagtgcctcctggtccttcaccagccgaaacagaggagatcggctatggaaggaccaaacctggcggcagcgcaaaagatg

SEQ ID NO: 161173 - DNA, 103 bp, Artificial Sequence
  Synthetic Polynucleotide
taatacgactcactatagggcaccgacttcatcagtgcctcctggtccttaacagaggagaaaggacatggaggcactgaacctggcggcagcgcaaaagatg

SEQ ID NO: 161174 - DNA, 103 bp, Artificial Sequence
  Synthetic Polynucleotide
taatacgactcactataggggcagcagcttcaccgacttcatcagtgcctaacagaggagaaggcacatgtgaagtcggaacctggcggcagcgcaaaagatg

SEQ ID NO: 161175 - DNA, 103 bp, Artificial Sequence
  Synthetic Polynucleotide
taatacgactcactataggggccagggcctgcagcagcttcaccgacttcaacagaggagagaagtcatggaagctgctaacctggcggcagcgcaaaagatg

SEQ ID NO: 161176 - DNA, 103 bp, Artificial Sequence
  Synthetic Polynucleotide
taatacgactcactatagggttggtactgggccagggcctgcagcagcttaacagaggagaaagctgatgcaggccctgaacctggcggcagcgcaaaagatg

SEQ ID NO: 161177 - DNA, 103 bp, Artificial Sequence
  Synthetic Polynucleotide
taatacgactcactatagggcggcaggccgggcgccactctgcgtcgcttaacagaggagaaagcgaatgagagtggcgaacctggcggcagcgcaaaagatg

SEQ ID NO: 161178 - DNA, 103 bp, Artificial Sequence
  Synthetic Polynucleotide
taatacgactcactataggggcaagtggttttggtactgggccagggcctaacagaggagaaggcccatgcccagtaccaacctggcggcagcgcaaaagatg

SEQ ID NO: 161179 - DNA, 103 bp, Artificial Sequence
  Synthetic Polynucleotide
taatacgactcactatagggggctgctcctgcaagtggttttggtactggaacagaggagaccagtaatgaaaccacttaacctggcggcagcgcaaaagatg

SEQ ID NO: 161180 - DNA, 103 bp, Artificial Sequence
  Synthetic Polynucleotide
taatacgactcactatagggggccttccggggctgctcctgcaagtggttaacagaggagaaaccacatgcaggagcagaacctggcggcagcgcaaaagatg

SEQ ID NO: 161181 - DNA, 103 bp, Artificial Sequence
  Synthetic Polynucleotide
taatacgactcactatagggtgtccaccagggccttccggggctgctcctaacagaggagaaggagcatgcccggaaggaacctggcggcagcgcaaaagatg

SEQ ID NO: 161182 - DNA, 103 bp, Artificial Sequence
  Synthetic Polynucleotide
taatacgactcactatagggtcggagaggatgtccaccagggccttccggaacagaggagaccggaaatgcctggtggaaacctggcggcagcgcaaaagatg

SEQ ID NO: 161183 - DNA, 103 bp, Artificial Sequence
  Synthetic Polynucleotide
taatacgactcactatagggcttcgagacctcggagaggatgtccaccagaacagaggagactggtgatgatcctctccaacctggcggcagcgcaaaagatg

SEQ ID NO: 161184 - DNA, 103 bp, Artificial Sequence
  Synthetic Polynucleotide
taatacgactcactataggggcaatgtggccttcgagacctcggagaggaaacagaggagatcctctatgaggtctcgaaacctggcggcagcgcaaaagatg

SEQ ID NO: 161185 - DNA, 103 bp, Artificial Sequence
  Synthetic Polynucleotide
taatacgactcactatagggaggatctcctgcaatgtggccttcgagaccaacagaggagaggtctcatgggccacattaacctggcggcagcgcaaaagatg

SEQ ID NO: 161186 - DNA, 103 bp, Artificial Sequence
  Synthetic Polynucleotide
taatacgactcactataggggacctccggcaggatctcctgcaatgtggcaacagaggagagccacaatgcaggagatcaacctggcggcagcgcaaaagatg

SEQ ID NO: 161187 - DNA, 103 bp, Artificial Sequence
  Synthetic Polynucleotide
taatacgactcactatagggcggctttgaggacctccggcaggatctcctaacagaggagaaggagaatgtgccggaggaacctggcggcagcgcaaaagatg

SEQ ID NO: 161188 - DNA, 103 bp, Artificial Sequence
  Synthetic Polynucleotide
taatacgactcactatagggccatagcggtcggcaggccgggcgccactcaacagaggagagagtggatgccggcctgcaacctggcggcagcgcaaaagatg

SEQ ID NO: 161189 - DNA, 103 bp, Artificial Sequence
  Synthetic Polynucleotide
taatacgactcactatagggatattcaagtcggctttgaggacctccggcaacagaggagagccggaatgcctcaaagcaacctggcggcagcgcaaaagatg

SEQ ID NO: 161190 - DNA, 103 bp, Artificial Sequence
  Synthetic Polynucleotide
taatacgactcactataggggctgagtattatattcaagtcggctttgagaacagaggagactcaaaatggacttgaataacctggcggcagcgcaaaagatg

SEQ ID NO: 161191 - DNA, 103 bp, Artificial Sequence
  Synthetic Polynucleotide
taatacgactcactataggggttcaggggagctgagtattatattcaagtaacagaggagaacttgaatgtaatactcaaacctggcggcagcgcaaaagatg

SEQ ID NO: 161192 - DNA, 103 bp, Artificial Sequence
  Synthetic Polynucleotide
taatacgactcactatagggagctctagctgttcaggggagctgagtattaacagaggagaaatactatgctcccctgaaacctggcggcagcgcaaaagatg

SEQ ID NO: 161193 - DNA, 103 bp, Artificial Sequence
  Synthetic Polynucleotide
taatacgactcactatagggcaggaggaagagctctagctgttcaggggaaacagaggagatcccctatgcagctagagaacctggcggcagcgcaaaagatg

SEQ ID NO: 161194 - DNA, 103 bp, Artificial Sequence
  Synthetic Polynucleotide
taatacgactcactatagggtctgctgggccaggaggaagagctctagctaacagaggagaagctagatgtcttcctccaacctggcggcagcgcaaaagatg

SEQ ID NO: 161195 - DNA, 103 bp, Artificial Sequence
  Synthetic Polynucleotide
taatacgactcactataggggagggcaccttctgctgggccaggaggaagaacagaggagacttcctatgggcccagcaaacctggcggcagcgcaaaagatg

SEQ ID NO: 161196 - DNA, 103 bp, Artificial Sequence
  Synthetic Polynucleotide
taatacgactcactatagggcttgagcttggagggcaccttctgctgggcaacagaggagagcccagatgaaggtgcccaacctggcggcagcgcaaaagatg

SEQ ID NO: 161197 - DNA, 103 bp, Artificial Sequence
  Synthetic Polynucleotide
taatacgactcactatagggccaccagcttcttgagcttggagggcacctaacagaggagaaggtgcatgccaagctcaaacctggcggcagcgcaaaagatg

SEQ ID NO: 161198 - DNA, 103 bp, Artificial Sequence
  Synthetic Polynucleotide
taatacgactcactatagggttcacggatcccaccagcttcttgagcttgaacagaggagacaagctatggaagctggtaacctggcggcagcgcaaaagatg

SEQ ID NO: 161199 - DNA, 103 bp, Artificial Sequence
  Synthetic Polynucleotide
taatacgactcactatagggcttcaataggccatagcggtcggcaggccgaacagaggagacggcctatggaccgctataacctggcggcagcgcaaaagatg

SEQ ID NO: 161200 - DNA, 103 bp, Artificial Sequence
  Synthetic Polynucleotide
taatacgactcactatagggtgagaataggttcacggatcccaccagcttaacagaggagaaagctgatgggatccgtgaacctggcggcagcgcaaaagatg

SEQ ID NO: 161201 - DNA, 103 bp, Artificial Sequence
  Synthetic Polynucleotide
taatacgactcactatagggcattctcatctgagaataggttcacggatcaacagaggagagatccgatgacctattctaacctggcggcagcgcaaaagatg

SEQ ID NO: 161202 - DNA, 103 bp, Artificial Sequence
  Synthetic Polynucleotide
taatacgactcactatagggagcctggggacattctcatctgagaataggaacagaggagacctattatgagatgagaaaacctggcggcagcgcaaaagatg

SEQ ID NO: 161203 - DNA, 103 bp, Artificial Sequence
  Synthetic Polynucleotide
taatacgactcactatagggcacattcaccagcctggggacattctcatcaacagaggagagatgagatggtccccaggaacctggcggcagcgcaaaagatg

SEQ ID NO: 161204 - DNA, 103 bp, Artificial Sequence
  Synthetic Polynucleotide
taatacgactcactatagggccatcttcagcacattcaccagcctggggaaacagaggagatccccaatgtggtgaatgaacctggcggcagcgcaaaagatg

SEQ ID NO: 161205 - DNA, 103 bp, Artificial Sequence
  Synthetic Polynucleotide
taatacgactcactataggggaggaggcggccatcttcagcacattcaccaacagaggagaggtgaaatggctgaagataacctggcggcagcgcaaaagatg

SEQ ID NO: 161206 - DNA, 103 bp, Artificial Sequence
  Synthetic Polynucleotide
taatacgactcactatagggcttcttcacagaggaggcggccatcttcagaacagaggagactgaagatggccgcctccaacctggcggcagcgcaaaagatg

SEQ ID NO: 161207 - DNA, 103 bp, Artificial Sequence
  Synthetic Polynucleotide
taatacgactcactataggggcttgcggtccttcttcacagaggaggcggaacagaggagaccgcctatgctgtgaagaaacctggcggcagcgcaaaagatg

SEQ ID NO: 161208 - DNA, 103 bp, Artificial Sequence
  Synthetic Polynucleotide
taatacgactcactatagggatggcgggcagcttgcggtccttcttcacaaacagaggagatgtgaaatgggaccgcaaaacctggcggcagcgcaaaagatg

SEQ ID NO: 161209 - DNA, 103 bp, Artificial Sequence
  Synthetic Polynucleotide
taatacgactcactataggggtccagagcaatggcgggcagcttgcggtcaacagaggagagaccgcatgctgcccgccaacctggcggcagcgcaaaagatg

SEQ ID NO: 161210 - DNA, 103 bp, Artificial Sequence
  Synthetic Polynucleotide
taatacgactcactatagggcgcgactgtgcttcaataggccatagcggtaacagaggagaaccgctatggcctattgaaacctggcggcagcgcaaaagatg

SEQ ID NO: 161211 - DNA, 103 bp, Artificial Sequence
  Synthetic Polynucleotide
taatacgactcactatagggggcggagcaggtccagagcaatggcgggcaaacagaggagatgcccgatgttgctctggaacctggcggcagcgcaaaagatg

SEQ ID NO: 161212 - DNA, 103 bp, Artificial Sequence
  Synthetic Polynucleotide
taatacgactcactatagggttgagtgccaggcggagcaggtccagagcaaacagaggagatgctctatgcctgctccgaacctggcggcagcgcaaaagatg

SEQ ID NO: 161213 - DNA, 103 bp, Artificial Sequence
  Synthetic Polynucleotide
taatacgactcactatagggcttgtcttccttgagtgccaggcggagcagaacagaggagactgctcatgctggcactcaacctggcggcagcgcaaaagatg

SEQ ID NO: 161214 - DNA, 103 bp, Artificial Sequence
  Synthetic Polynucleotide
taatacgactcactatagggaccgtgggaacttgtcttccttgagtgccaaacagaggagatggcacatgaggaagacaaacctggcggcagcgcaaaagatg

SEQ ID NO: 161215 - DNA, 103 bp, Artificial Sequence
  Synthetic Polynucleotide
taatacgactcactatagggtccttccagaaccgtgggaacttgtcttccaacagaggagaggaagaatggttcccacgaacctggcggcagcgcaaaagatg

SEQ ID NO: 161216 - DNA, 103 bp, Artificial Sequence
  Synthetic Polynucleotide
taatacgactcactatagggttccaccacctccttccagaaccgtgggaaaacagaggagattcccaatgttctggaagaacctggcggcagcgcaaaagatg

SEQ ID NO: 161217 - DNA, 103 bp, Artificial Sequence
  Synthetic Polynucleotide
taatacgactcactataggggcagcccttgttccaccacctccttccagaaacagaggagatctggaatgaggtggtggaacctggcggcagcgcaaaagatg

SEQ ID NO: 161218 - DNA, 103 bp, Artificial Sequence
  Synthetic Polynucleotide
taatacgactcactatagggtgcatcttcagcagcccttgttccaccaccaacagaggagaggtggtatgacaagggctaacctggcggcagcgcaaaagatg

SEQ ID NO: 161219 - DNA, 103 bp, Artificial Sequence
  Synthetic Polynucleotide
taatacgactcactatagggtggccagaactgcatcttcagcagcccttgaacagaggagacaagggatgctgaagatgaacctggcggcagcgcaaaagatg

SEQ ID NO: 161220 - DNA, 103 bp, Artificial Sequence
  Synthetic Polynucleotide
taatacgactcactatagggggtagctggctggccagaactgcatcttcaaacagaggagatgaagaatgagttctggcaacctggcggcagcgcaaaagatg

SEQ ID NO: 161221 - DNA, 103 bp, Artificial Sequence
  Synthetic Polynucleotide
taatacgactcactatagggtccaagaactcgcgactgtgcttcaataggaacagaggagacctattatggcacagtcgaacctggcggcagcgcaaaagatg

SEQ ID NO: 161222 - DNA, 103 bp, Artificial Sequence
  Synthetic Polynucleotide
taatacgactcactatagggcggaaacacaggtagctggctggccagaacaacagaggagagttctgatgagccagctaaacctggcggcagcgcaaaagatg

SEQ ID NO: 161223 - DNA, 103 bp, Artificial Sequence
  Synthetic Polynucleotide
taatacgactcactataggggcccagcaggcggaaacacaggtagctggcaacagaggagagccagcatgctgtgtttcaacctggcggcagcgcaaaagatg

SEQ ID NO: 161224 - DNA, 103 bp, Artificial Sequence
  Synthetic Polynucleotide
taatacgactcactataggggcagggccgcgcccagcaggcggaaacacaaacagaggagatgtgttatggcctgctggaacctggcggcagcgcaaaagatg

SEQ ID NO: 161225 - DNA, 103 bp, Artificial Sequence
  Synthetic Polynucleotide
taatacgactcactataggggtcagcaggggcagggccgcgcccagcaggaacagaggagacctgctatgcgcggccctaacctggcggcagcgcaaaagatg

SEQ ID NO: 161226 - DNA, 103 bp, Artificial Sequence
  Synthetic Polynucleotide
taatacgactcactatagggctgctccttggtcagcaggggcagggccgcaacagaggagagcggccatgcccctgctgaacctggcggcagcgcaaaagatg

SEQ ID NO: 161227 - DNA, 103 bp, Artificial Sequence
  Synthetic Polynucleotide
taatacgactcactatagggccaggtgcagctgctccttggtcagcagggaacagaggagaccctgcatgccaaggagcaacctggcggcagcgcaaaagatg

SEQ ID NO: 161228 - DNA, 103 bp, Artificial Sequence
  Synthetic Polynucleotide
taatacgactcactatagggccctgcatcaccaggtgcagctgctccttgaacagaggagacaaggaatggctgcacctaacctggcggcagcgcaaaagatg

SEQ ID NO: 161229 - DNA, 103 bp, Artificial Sequence
  Synthetic Polynucleotide
taatacgactcactataggggatcacgtctccctgcatcaccaggtgcagaacagaggagactgcacatggtgatgcagaacctggcggcagcgcaaaagatg

SEQ ID NO: 161230 - DNA, 103 bp, Artificial Sequence
  Synthetic Polynucleotide
taatacgactcactatagggcgtaatggcggatcacgtctccctgcatcaaacagaggagatgatgcatggagacgtgaaacctggcggcagcgcaaaagatg

SEQ ID NO: 161231 - DNA, 103 bp, Artificial Sequence
  Synthetic Polynucleotide
taatacgactcactatagggacgtgctccccgtaatggcggatcacgtctaacagaggagaagacgtatgccgccattaaacctggcggcagcgcaaaagatg

SEQ ID NO: 161232 - DNA, 103 bp, Artificial Sequence
  Synthetic Polynucleotide
taatacgactcactatagggctcatcctcactgcgcgacctcttcgccataacagaggagaatggcgatgaggtcgcgcaacctggcggcagcgcaaaagatg

SEQ ID NO: 161233 - DNA, 103 bp, Artificial Sequence
  Synthetic Polynucleotide
taatacgactcactatagggccttgtccattttactctgttccagagtttaacagaggagaaaactcatgaacagagtaaacctggcggcagcgcaaaagatg

SEQ ID NO: 161234 - DNA, 103 bp, Artificial Sequence
  Synthetic Polynucleotide
taatacgactcactataggggaactttgtgggtgaattctgctgagcagaaacagaggagatctgctatgcagaattcaaacctggcggcagcgcaaaagatg

SEQ ID NO: 161235 - DNA, 103 bp, Artificial Sequence
  Synthetic Polynucleotide
taatacgactcactatagggccacggccaggaactttgtgggtgaattctaacagaggagaagaattatgccacaaagtaacctggcggcagcgcaaaagatg

SEQ ID NO: 161236 - DNA, 103 bp, Artificial Sequence
  Synthetic Polynucleotide
taatacgactcactataggggcgtttgcctccacggccaggaactttgtgaacagaggagacacaaaatgcctggccgtaacctggcggcagcgcaaaagatg

SEQ ID NO: 161237 - DNA, 103 bp, Artificial Sequence
  Synthetic Polynucleotide
taatacgactcactatagggggataacacagcgtttgcctccacggccagaacagaggagactggccatggaggcaaacaacctggcggcagcgcaaaagatg

SEQ ID NO: 161238 - DNA, 103 bp, Artificial Sequence
  Synthetic Polynucleotide
taatacgactcactatagggtctgcaaagaggataacacagcgtttgcctaacagaggagaaggcaaatgctgtgttataacctggcggcagcgcaaaagatg

SEQ ID NO: 161239 - DNA, 103 bp, Artificial Sequence
  Synthetic Polynucleotide
taatacgactcactatagggtctgggatggtctgcaaagaggataacacaaacagaggagatgtgttatgctctttgcaaacctggcggcagcgcaaaagatg

SEQ ID NO: 161240 - DNA, 103 bp, Artificial Sequence
  Synthetic Polynucleotide
taatacgactcactatagggctctgcaaattctgggatggtctgcaaagaaacagaggagatctttgatgaccatcccaaacctggcggcagcgcaaaagatg

SEQ ID NO: 161241 - DNA, 103 bp, Artificial Sequence
  Synthetic Polynucleotide
taatacgactcactataggggttctagagtctctgcaaattctgggatggaacagaggagaccatccatgaatttgcagaacctggcggcagcgcaaaagatg

SEQ ID NO: 161242 - DNA, 103 bp, Artificial Sequence
  Synthetic Polynucleotide
taatacgactcactataggggattcaataagttctagagtctctgcaaataacagaggagaatttgcatggactctagaaacctggcggcagcgcaaaagatg

SEQ ID NO: 161243 - DNA, 103 bp, Artificial Sequence
  Synthetic Polynucleotide
taatacgactcactatagggtacaggatcagattcaataagttctagagtaacagaggagaactctaatgcttattgaaaacctggcggcagcgcaaaagatg

SEQ ID NO: 161244 - DNA, 103 bp, Artificial Sequence
  Synthetic Polynucleotide
taatacgactcactatagggcatcctcgtcccttgtccattttactctgtaacagaggagaacagagatgaatggacaaaacctggcggcagcgcaaaagatg

SEQ ID NO: 161245 - DNA, 103 bp, Artificial Sequence
  Synthetic Polynucleotide
taatacgactcactatagggcactccatgctacaggatcagattcaataaaacagaggagattattgatgctgatcctgaacctggcggcagcgcaaaagatg

SEQ ID NO: 161246 - DNA, 103 bp, Artificial Sequence
  Synthetic Polynucleotide
taatacgactcactatagggctggtaacgtcactccatgctacaggatcaaacagaggagatgatccatgagcatggagaacctggcggcagcgcaaaagatg

SEQ ID NO: 161247 - DNA, 103 bp, Artificial Sequence
  Synthetic Polynucleotide
taatacgactcactatagggaatatcaaaactggtaacgtcactccatgcaacagaggagagcatggatggacgttaccaacctggcggcagcgcaaaagatg

SEQ ID NO: 161248 - DNA, 103 bp, Artificial Sequence
  Synthetic Polynucleotide
taatacgactcactatagggcagcatcagaaatatcaaaactggtaacgtaacagaggagaacgttaatggttttgataaacctggcggcagcgcaaaagatg

SEQ ID NO: 161249 - DNA, 103 bp, Artificial Sequence
  Synthetic Polynucleotide
taatacgactcactatagggggagaagcagcagcatcagaaatatcaaaaaacagaggagattttgaatgttctgatgcaacctggcggcagcgcaaaagatg

SEQ ID NO: 161250 - DNA, 103 bp, Artificial Sequence
  Synthetic Polynucleotide
taatacgactcactatagggggatttgataggagaagcagcagcatcagaaacagaggagatctgatatggctgcttctaacctggcggcagcgcaaaagatg

SEQ ID NO: 161251 - DNA, 103 bp, Artificial Sequence
  Synthetic Polynucleotide
taatacgactcactatagggtaactggggtggatttgataggagaagcagaacagaggagactgcttatgctatcaaataacctggcggcagcgcaaaagatg

SEQ ID NO: 161252 - DNA, 103 bp, Artificial Sequence
  Synthetic Polynucleotide
taatacgactcactatagggctcattaatttaactggggtggatttgataaacagaggagatatcaaatgcaccccagtaacctggcggcagcgcaaaagatg

SEQ ID NO: 161253 - DNA, 103 bp, Artificial Sequence
  Synthetic Polynucleotide
taatacgactcactataggggtgctgaattctcattaatttaactggggtaacagaggagaaccccaatgaaattaatgaacctggcggcagcgcaaaagatg

SEQ ID NO: 161254 - DNA, 103 bp, Artificial Sequence
  Synthetic Polynucleotide
taatacgactcactatagggctccttcattgtgctgaattctcattaattaacagaggagaaattaaatggaattcagcaacctggcggcagcgcaaaagatg

SEQ ID NO: 161255 - DNA, 103 bp, Artificial Sequence
  Synthetic Polynucleotide
taatacgactcactatagggtttaatttatcatcctcgtcccttgtccataacagaggagaatggacatgggacgaggaaacctggcggcagcgcaaaagatg

SEQ ID NO: 161256 - DNA, 103 bp, Artificial Sequence
  Synthetic Polynucleotide
taatacgactcactatagggcattccatggctccttcattgtgctgaattaacagaggagaaattcaatgcaatgaaggaacctggcggcagcgcaaaagatg

SEQ ID NO: 161257 - DNA, 103 bp, Artificial Sequence
  Synthetic Polynucleotide
taatacgactcactataggggttaaattggcattccatggctccttcattaacagaggagaaatgaaatggccatggaaaacctggcggcagcgcaaaagatg

SEQ ID NO: 161258 - DNA, 103 bp, Artificial Sequence
  Synthetic Polynucleotide
taatacgactcactatagggcaagactgacgttaaattggcattccatggaacagaggagaccatggatggccaatttaaacctggcggcagcgcaaaagatg

SEQ ID NO: 161259 - DNA, 103 bp, Artificial Sequence
  Synthetic Polynucleotide
taatacgactcactatagggccttcaagtacaagactgacgttaaattggaacagaggagaccaattatgcgtcagtctaacctggcggcagcgcaaaagatg

SEQ ID NO: 161260 - DNA, 103 bp, Artificial Sequence
  Synthetic Polynucleotide
taatacgactcactataggggttttttttcccttcaagtacaagactgacaacagaggagagtcagtatggtacttgaaaacctggcggcagcgcaaaagatg

SEQ ID NO: 161261 - DNA, 103 bp, Artificial Sequence
  Synthetic Polynucleotide
taatacgactcactatagggcattacaagtgttttttttcccttcaagtaaacagaggagatacttgatgggaaaaaaaaacctggcggcagcgcaaaagatg

SEQ ID NO: 161262 - DNA, 103 bp, Artificial Sequence
  Synthetic Polynucleotide
taatacgactcactatagggctgttgccaccattacaagtgttttttttcaacagaggagagaaaaaatgcacttgtaaaacctggcggcagcgcaaaagatg

SEQ ID NO: 161263 - DNA, 103 bp, Artificial Sequence
  Synthetic Polynucleotide
taatacgactcactatagggaacagcttcactgttgccaccattacaagtaacagaggagaacttgtatgggtggcaacaacctggcggcagcgcaaaagatg

SEQ ID NO: 161264 - DNA, 103 bp, Artificial Sequence
  Synthetic Polynucleotide
taatacgactcactatagggatgttaaaggaacagcttcactgttgccacaacagaggagagtggcaatggtgaagctgaacctggcggcagcgcaaaagatg

SEQ ID NO: 161265 - DNA, 103 bp, Artificial Sequence
  Synthetic Polynucleotide
taatacgactcactatagggatatttggggatgttaaaggaacagcttcaaacagaggagatgaagcatgtcctttaacaacctggcggcagcgcaaaagatg

SEQ ID NO: 161266 - DNA, 103 bp, Artificial Sequence
  Synthetic Polynucleotide
taatacgactcactatagggaaccaacttctttaatttatcatcctcgtcaacagaggagagacgagatggataaattaaacctggcggcagcgcaaaagatg

SEQ ID NO: 161267 - DNA, 103 bp, Artificial Sequence
  Synthetic Polynucleotide
taatacgactcactatagggaaacttggctatatttggggatgttaaaggaacagaggagacctttaatgtccccaaataacctggcggcagcgcaaaagatg

SEQ ID NO: 161268 - DNA, 103 bp, Artificial Sequence
  Synthetic Polynucleotide
taatacgactcactataggggtggagtgctaaacttggctatatttggggaacagaggagaccccaaatgtagccaagtaacctggcggcagcgcaaaagatg

SEQ ID NO: 161269 - DNA, 103 bp, Artificial Sequence
  Synthetic Polynucleotide
taatacgactcactatagggaggatggctggtggagtgctaaacttggctaacagaggagaagccaaatgtagcactccaacctggcggcagcgcaaaagatg

SEQ ID NO: 161270 - DNA, 103 bp, Artificial Sequence
  Synthetic Polynucleotide
taatacgactcactatagggcttctttctgaggatggctggtggagtgctaacagaggagaagcactatgccagccatcaacctggcggcagcgcaaaagatg

SEQ ID NO: 161271 - DNA, 103 bp, Artificial Sequence
  Synthetic Polynucleotide
taatacgactcactataggggcatttttctcttctttctgaggatggctgaacagaggagacagccaatgtcagaaagaaacctggcggcagcgcaaaagatg

SEQ ID NO: 161272 - DNA, 103 bp, Artificial Sequence
  Synthetic Polynucleotide
taatacgactcactatagggtgacccactcgcatttttctcttctttctgaacagaggagacagaaaatggagaaaaataacctggcggcagcgcaaaagatg

SEQ ID NO: 161273 - DNA, 103 bp, Artificial Sequence
  Synthetic Polynucleotide
taatacgactcactataggggcctggggaatgacccactcgcatttttctaacagaggagaagaaaaatgcgagtgggtaacctggcggcagcgcaaaagatg

SEQ ID NO: 161274 - DNA, 103 bp, Artificial Sequence
  Synthetic Polynucleotide
taatacgactcactatagggtaagttcgctgcctggggaatgacccactcaacagaggagagagtggatgattccccagaacctggcggcagcgcaaaagatg

SEQ ID NO: 161275 - DNA, 103 bp, Artificial Sequence
  Synthetic Polynucleotide
taatacgactcactataggggagccatccctaagttcgctgcctggggaaaacagaggagattccccatgcagcgaactaacctggcggcagcgcaaaagatg

SEQ ID NO: 161276 - DNA, 103 bp, Artificial Sequence
  Synthetic Polynucleotide
taatacgactcactatagggatcgttcaatgagccatccctaagttcgctaacagaggagaagcgaaatgagggatggcaacctggcggcagcgcaaaagatg

SEQ ID NO: 161277 - DNA, 103 bp, Artificial Sequence
  Synthetic Polynucleotide
taatacgactcactatagggcatgttgttcaaccaacttctttaatttataacagaggagaataaatatgagaagttggaacctggcggcagcgcaaaagatg

SEQ ID NO: 161278 - DNA, 103 bp, Artificial Sequence
  Synthetic Polynucleotide
taatacgactcactatagggtattaccaccatcgttcaatgagccatcccaacagaggagagggatgatgcattgaacgaacctggcggcagcgcaaaagatg

SEQ ID NO: 161279 - DNA, 103 bp, Artificial Sequence
  Synthetic Polynucleotide
taatacgactcactatagggtttagcgccatattaccaccatcgttcaataacagaggagaattgaaatgtggtggtaaaacctggcggcagcgcaaaagatg

SEQ ID NO: 161280 - DNA, 103 bp, Artificial Sequence
  Synthetic Polynucleotide
taatacgactcactatagggtggtgtatgttttagcgccatattaccaccaacagaggagaggtggtatgatggcgctaaacctggcggcagcgcaaaagatg

SEQ ID NO: 161281 - DNA, 103 bp, Artificial Sequence
  Synthetic Polynucleotide
taatacgactcactataggggtgttttcagtggtgtatgttttagcgccaaacagaggagatggcgcatgaacatacacaacctggcggcagcgcaaaagatg

SEQ ID NO: 161282 - DNA, 103 bp, Artificial Sequence
  Synthetic Polynucleotide
taatacgactcactataggggaaaatggtagtgttttcagtggtgtatgtaacagaggagaacatacatgactgaaaacaacctggcggcagcgcaaaagatg

SEQ ID NO: 161283 - DNA, 103 bp, Artificial Sequence
  Synthetic Polynucleotide
taatacgactcactatagggctgtgaaggagaaaatggtagtgttttcagaacagaggagactgaaaatgctaccatttaacctggcggcagcgcaaaagatg

SEQ ID NO: 161284 - DNA, 103 bp, Artificial Sequence
  Synthetic Polynucleotide
taatacgactcactatagggtgttgaaaaactgtgaaggagaaaatggtaaacagaggagataccatatgctccttcacaacctggcggcagcgcaaaagatg

SEQ ID NO: 161285 - DNA, 103 bp, Artificial Sequence
  Synthetic Polynucleotide
taatacgactcactatagggccaggacatgtgttgaaaaactgtgaaggaaacagaggagatccttcatggtttttcaaaacctggcggcagcgcaaaagatg

SEQ ID NO: 161286 - DNA, 103 bp, Artificial Sequence
  Synthetic Polynucleotide
taatacgactcactatagggttgttcattaccaggacatgtgttgaaaaaaacagaggagatttttcatgacatgtcctaacctggcggcagcgcaaaagatg

SEQ ID NO: 161287 - DNA, 103 bp, Artificial Sequence
  Synthetic Polynucleotide
taatacgactcactatagggctatattaagttgttcattaccaggacatgaacagaggagacatgtcatggtaatgaacaacctggcggcagcgcaaaagatg

SEQ ID NO: 161288 - DNA, 103 bp, Artificial Sequence
  Synthetic Polynucleotide
taatacgactcactatagggtcatcagttccatgttgttcaaccaacttcaacagaggagagaagttatgtgaacaacaaacctggcggcagcgcaaaagatg

SEQ ID NO: 161289 - DNA, 103 bp, Artificial Sequence
  Synthetic Polynucleotide
taatacgactcactataggggaaggattttctatattaagttgttcattaaacagaggagataatgaatgacttaatataacctggcggcagcgcaaaagatg

SEQ ID NO: 161290 - DNA, 103 bp, Artificial Sequence
  Synthetic Polynucleotide
taatacgactcactatagggtgatgtaaatgaaggattttctatattaagaacagaggagacttaatatggaaaatcctaacctggcggcagcgcaaaagatg

SEQ ID NO: 161291 - DNA, 103 bp, Artificial Sequence
  Synthetic Polynucleotide
taatacgactcactatagggaaataggggttgatgtaaatgaaggattttaacagaggagaaaaatcatgcatttacataacctggcggcagcgcaaaagatg

SEQ ID NO: 161292 - DNA, 103 bp, Artificial Sequence
  Synthetic Polynucleotide
taatacgactcactatagggttctgcccacaaataggggttgatgtaaataacagaggagaatttacatgaacccctataacctggcggcagcgcaaaagatg

SEQ ID NO: 161293 - DNA, 103 bp, Artificial Sequence
  Synthetic Polynucleotide
taatacgactcactatagggaatgagagctttctgcccacaaataggggtaacagaggagaacccctatgtgtgggcagaacctggcggcagcgcaaaagatg

SEQ ID NO: 161294 - DNA, 103 bp, Artificial Sequence
  Synthetic Polynucleotide
taatacgactcactataggggaggagttgtaatgagagctttctgcccacaacagaggagagtgggcatgaagctctcaaacctggcggcagcgcaaaagatg

SEQ ID NO: 161295 - DNA, 103 bp, Artificial Sequence
  Synthetic Polynucleotide
taatacgactcactatagggtccttatgaagaggagttgtaatgagagctaacagaggagaagctctatgtacaactccaacctggcggcagcgcaaaagatg

SEQ ID NO: 161296 - DNA, 103 bp, Artificial Sequence
  Synthetic Polynucleotide
taatacgactcactataggggggagttgtttccttatgaagaggagttgtaacagaggagaacaactatgcttcataagaacctggcggcagcgcaaaagatg

SEQ ID NO: 161297 - DNA, 103 bp, Artificial Sequence
  Synthetic Polynucleotide
taatacgactcactatagggtttgatctttgggagttgtttccttatgaaaacagaggagattcataatgaaacaactcaacctggcggcagcgcaaaagatg

SEQ ID NO: 161298 - DNA, 103 bp, Artificial Sequence
  Synthetic Polynucleotide
taatacgactcactatagggacattttccttttgatctttgggagttgttaacagaggagaaacaacatgcaaagatcaaacctggcggcagcgcaaaagatg

SEQ ID NO: 161299 - DNA, 103 bp, Artificial Sequence
  Synthetic Polynucleotide
taatacgactcactatagggtagagtccaatcatcagttccatgttgttcaacagaggagagaacaaatgggaactgataacctggcggcagcgcaaaagatg

SEQ ID NO: 161300 - DNA, 103 bp, Artificial Sequence
  Synthetic Polynucleotide
taatacgactcactatagggtctaaaccctacattttccttttgatctttaacagaggagaaaagatatgaaggaaaataacctggcggcagcgcaaaagatg

SEQ ID NO: 161301 - DNA, 103 bp, Artificial Sequence
  Synthetic Polynucleotide
taatacgactcactatagggtagtaggtgttctaaaccctacattttcctaacagaggagaaggaaaatgtagggtttaaacctggcggcagcgcaaaagatg

SEQ ID NO: 161302 - DNA, 103 bp, Artificial Sequence
  Synthetic Polynucleotide
taatacgactcactataggggatcttctaatagtaggtgttctaaaccctaacagaggagaagggttatgaacacctacaacctggcggcagcgcaaaagatg

SEQ ID NO: 161303 - DNA, 103 bp, Artificial Sequence
  Synthetic Polynucleotide
taatacgactcactatagggacccagtatagatcttctaatagtaggtgtaacagaggagaacacctatgattagaagaaacctggcggcagcgcaaaagatg

SEQ ID NO: 161304 - DNA, 103 bp, Artificial Sequence
  Synthetic Polynucleotide
taatacgactcactatagggttggtgtggtacccagtatagatcttctaaaacagaggagattagaaatgctatactggaacctggcggcagcgcaaaagatg

SEQ ID NO: 161305 - DNA, 103 bp, Artificial Sequence
  Synthetic Polynucleotide
taatacgactcactataggggtaggagttcttggtgtggtacccagtataaacagaggagatatactatgtaccacaccaacctggcggcagcgcaaaagatg

SEQ ID NO: 161306 - DNA, 103 bp, Artificial Sequence
  Synthetic Polynucleotide
taatacgactcactatagggcttaaaaggagtaggagttcttggtgtggtaacagaggagaaccacaatgagaactcctaacctggcggcagcgcaaaagatg

SEQ ID NO: 161307 - DNA, 103 bp, Artificial Sequence
  Synthetic Polynucleotide
taatacgactcactatagggcaagcgcattcttaaaaggagtaggagttcaacagaggagagaactcatgctccttttaaacctggcggcagcgcaaaagatg

SEQ ID NO: 161308 - DNA, 103 bp, Artificial Sequence
  Synthetic Polynucleotide
taatacgactcactatagggtcctgagcagcaagcgcattcttaaaaggaaacagaggagatcctttatggaatgcgctaacctggcggcagcgcaaaagatg

SEQ ID NO: 161309 - DNA, 103 bp, Artificial Sequence
  Synthetic Polynucleotide
taatacgactcactatagggatattttttctcctgagcagcaagcgcattaacagaggagaaatgcgatggctgctcagaacctggcggcagcgcaaaagatg

SEQ ID NO: 161310 - DNA, 103 bp, Artificial Sequence
  Synthetic Polynucleotide
taatacgactcactataggggactagcaattagagtccaatcatcagttcaacagaggagagaactgatgattggactcaacctggcggcagcgcaaaagatg

SEQ ID NO: 161311 - DNA, 103 bp, Artificial Sequence
  Synthetic Polynucleotide
taatacgactcactatagggtaagaggtccatattttttctcctgagcagaacagaggagactgctcatgagaaaaaataacctggcggcagcgcaaaagatg

SEQ ID NO: 161312 - DNA, 103 bp, Artificial Sequence
  Synthetic Polynucleotide
taatacgactcactataggggacacaattttaagaggtccatattttttcaacagaggagagaaaaaatgtggacctctaacctggcggcagcgcaaaagatg

SEQ ID NO: 161313 - DNA, 103 bp, Artificial Sequence
  Synthetic Polynucleotide
taatacgactcactatagggaagtggctgggacacaattttaagaggtccaacagaggagaggacctatgaaaattgtgaacctggcggcagcgcaaaagatg

SEQ ID NO: 161314 - DNA, 103 bp, Artificial Sequence
  Synthetic Polynucleotide
taatacgactcactatagggccaagaaagcaagtggctgggacacaatttaacagaggagaaaattgatgcccagccacaacctggcggcagcgcaaaagatg

SEQ ID NO: 161315 - DNA, 103 bp, Artificial Sequence
  Synthetic Polynucleotide
taatacgactcactatagggatatcttcttccaagaaagcaagtggctggaacagaggagaccagccatgtgctttcttaacctggcggcagcgcaaaagatg

SEQ ID NO: 161316 - DNA, 103 bp, Artificial Sequence
  Synthetic Polynucleotide
taatacgactcactatagggaacttcccgaatatcttcttccaagaaagcaacagaggagagctttcatggaagaagataacctggcggcagcgcaaaagatg

SEQ ID NO: 161317 - DNA, 103 bp, Artificial Sequence
  Synthetic Polynucleotide
taatacgactcactatagggcttcttttaaaacttcccgaatatcttcttaacagaggagaaagaagatgttcgggaagaacctggcggcagcgcaaaagatg

SEQ ID NO: 161318 - DNA, 103 bp, Artificial Sequence
  Synthetic Polynucleotide
taatacgactcactataggggttccagtttcttcttttaaaacttcccgaaacagaggagatcgggaatgtttaaaagaaacctggcggcagcgcaaaagatg

SEQ ID NO: 161319 - DNA, 103 bp, Artificial Sequence
  Synthetic Polynucleotide
taatacgactcactataggggaataggtctgttccagtttcttcttttaaaacagaggagattaaaaatggaaactggaaacctggcggcagcgcaaaagatg

SEQ ID NO: 161320 - DNA, 103 bp, Artificial Sequence
  Synthetic Polynucleotide
taatacgactcactatagggcctctttgaggaataggtctgttccagtttaacagaggagaaaactgatgcagacctataacctggcggcagcgcaaaagatg

SEQ ID NO: 161321 - DNA, 103 bp, Artificial Sequence
  Synthetic Polynucleotide
taatacgactcactatagggttttgaagatgactagcaattagagtccaaaacagaggagattggacatgaattgctagaacctggcggcagcgcaaaagatg

SEQ ID NO: 161322 - DNA, 103 bp, Artificial Sequence
  Synthetic Polynucleotide
taatacgactcactatagggggttcatcttcctctttgaggaataggtctaacagaggagaagacctatgcctcaaagaaacctggcggcagcgcaaaagatg

SEQ ID NO: 161323 - DNA, 103 bp, Artificial Sequence
  Synthetic Polynucleotide
taatacgactcactatagggtttgtaagcaggttcatcttcctctttgagaacagaggagactcaaaatggaagatgaaaacctggcggcagcgcaaaagatg

SEQ ID NO: 161324 - DNA, 103 bp, Artificial Sequence
  Synthetic Polynucleotide
taatacgactcactataggggtttgcagcttttgtaagcaggttcatcttaacagaggagaaagatgatgctgcttacaaacctggcggcagcgcaaaagatg

SEQ ID NO: 161325 - DNA, 103 bp, Artificial Sequence
  Synthetic Polynucleotide
taatacgactcactataggggtattctcttgtttgcagcttttgtaagcaaacagaggagatgcttaatgaagctgcaaaacctggcggcagcgcaaaagatg

SEQ ID NO: 161326 - DNA, 103 bp, Artificial Sequence
  Synthetic Polynucleotide
taatacgactcactatagggcccagaagcggtattctcttgtttgcagctaacagaggagaagctgcatgcaagagaataacctggcggcagcgcaaaagatg

SEQ ID NO: 161327 - DNA, 103 bp, Artificial Sequence
  Synthetic Polynucleotide
taatacgactcactatagggtgactttcttcccagaagcggtattctcttaacagaggagaaagagaatgccgcttctgaacctggcggcagcgcaaaagatg

SEQ ID NO: 161328 - DNA, 103 bp, Artificial Sequence
  Synthetic Polynucleotide
taatacgactcactatagggagtgattttctgactttcttcccagaagcgaacagaggagacgcttcatggaagaaagtaacctggcggcagcgcaaaagatg

SEQ ID NO: 161329 - DNA, 103 bp, Artificial Sequence
  Synthetic Polynucleotide
taatacgactcactatagggatctaagactagtgattttctgactttcttaacagaggagaaagaaaatgagaaaatcaaacctggcggcagcgcaaaagatg

SEQ ID NO: 161330 - DNA, 103 bp, Artificial Sequence
  Synthetic Polynucleotide
taatacgactcactatagggtttcccaattatctaagactagtgattttcaacagaggagagaaaatatgtagtcttagaacctggcggcagcgcaaaagatg

SEQ ID NO: 161331 - DNA, 103 bp, Artificial Sequence
  Synthetic Polynucleotide
taatacgactcactataggggattcttctttttcccaattatctaagactaacagaggagaagtcttatgtaattgggaaacctggcggcagcgcaaaagatg

SEQ ID NO: 161332 - DNA, 103 bp, Artificial Sequence
  Synthetic Polynucleotide
taatacgactcactatagggatcagagcgattttgaagatgactagcaataacagaggagaattgctatgcatcttcaaaacctggcggcagcgcaaaagatg

SEQ ID NO: 161333 - DNA, 103 bp, Artificial Sequence
  Synthetic Polynucleotide
taatacgactcactatagggttgagtgcctgattcttctttttcccaattaacagaggagaaattggatgaaagaagaaaacctggcggcagcgcaaaagatg

SEQ ID NO: 161334 - DNA, 103 bp, Artificial Sequence
  Synthetic Polynucleotide
taatacgactcactatagggcagtcaacagttgagtgcctgattcttcttaacagaggagaaagaagatgcaggcactcaacctggcggcagcgcaaaagatg

SEQ ID NO: 161335 - DNA, 103 bp, Artificial Sequence
  Synthetic Polynucleotide
taatacgactcactataggggaaatgtcttcagtcaacagttgagtgcctaacagaggagaaggcacatgactgttgacaacctggcggcagcgcaaaagatg

SEQ ID NO: 161336 - DNA, 103 bp, Artificial Sequence
  Synthetic Polynucleotide
taatacgactcactatagggctgcatgtctgaaatgtcttcagtcaacagaacagaggagactgttgatggaagacattaacctggcggcagcgcaaaagatg

SEQ ID NO: 161337 - DNA, 103 bp, Artificial Sequence
  Synthetic Polynucleotide
taatacgactcactatagggtattttctgactgcatgtctgaaatgtcttaacagaggagaaagacaatgcagacatgcaacctggcggcagcgcaaaagatg

SEQ ID NO: 161338 - DNA, 103 bp, Artificial Sequence
  Synthetic Polynucleotide
taatacgactcactataggggtagtaaatctattttctgactgcatgtctaacagaggagaagacatatggtcagaaaaaacctggcggcagcgcaaaagatg

SEQ ID NO: 161339 - DNA, 103 bp, Artificial Sequence
  Synthetic Polynucleotide
taatacgactcactatagggtaataaggatgtagtaaatctattttctgaaacagaggagatcagaaatgagatttactaacctggcggcagcgcaaaagatg

SEQ ID NO: 161340 - DNA, 103 bp, Artificial Sequence
  Synthetic Polynucleotide
taatacgactcactatagggatggtatcattaataaggatgtagtaaatcaacagaggagagatttaatgcatccttataacctggcggcagcgcaaaagatg

SEQ ID NO: 161341 - DNA, 103 bp, Artificial Sequence
  Synthetic Polynucleotide
taatacgactcactatagggatttccaataatggtatcattaataaggataacagaggagaatccttatgaatgataccaacctggcggcagcgcaaaagatg

SEQ ID NO: 161342 - DNA, 103 bp, Artificial Sequence
  Synthetic Polynucleotide
taatacgactcactatagggattgtcatgtatttccaataatggtatcataacagaggagaatgataatgttattggaaaacctggcggcagcgcaaaagatg

SEQ ID NO: 161343 - DNA, 103 bp, Artificial Sequence
  Synthetic Polynucleotide
taatacgactcactatagggggtcatcatcctcatcctcactgcgcgaccaacagaggagaggtcgcatggtgaggatgaacctggcggcagcgcaaaagatg

SEQ ID NO: 161344 - DNA, 103 bp, Artificial Sequence
  Synthetic Polynucleotide
taatacgactcactatagggggcactgaaaatcagagcgattttgaagataacagaggagaatcttcatgatcgctctgaacctggcggcagcgcaaaagatg

SEQ ID NO: 161345 - DNA, 103 bp, Artificial Sequence
  Synthetic Polynucleotide
taatacgactcactatagggagttgcacctattgtcatgtatttccaataaacagaggagatattggatgtacatgacaaacctggcggcagcgcaaaagatg

SEQ ID NO: 161346 - DNA, 103 bp, Artificial Sequence
  Synthetic Polynucleotide
taatacgactcactatagggtcaggaatcaagttgcacctattgtcatgtaacagaggagaacatgaatgtaggtgcaaaacctggcggcagcgcaaaagatg

SEQ ID NO: 161347 - DNA, 103 bp, Artificial Sequence
  Synthetic Polynucleotide
taatacgactcactatagggatcttgtttttcaggaatcaagttgcacctaacagaggagaaggtgcatgttgattcctaacctggcggcagcgcaaaagatg

SEQ ID NO: 161348 - DNA, 103 bp, Artificial Sequence
  Synthetic Polynucleotide
taatacgactcactatagggttgaatttatatcttgtttttcaggaatcaaacagaggagatgattcatgaaaaacaagaacctggcggcagcgcaaaagatg

SEQ ID NO: 161349 - DNA, 103 bp, Artificial Sequence
  Synthetic Polynucleotide
taatacgactcactataggggttttgttggttgaatttatatcttgttttaacagaggagaaaaacaatgtataaattcaacctggcggcagcgcaaaagatg

SEQ ID NO: 161350 - DNA, 103 bp, Artificial Sequence
  Synthetic Polynucleotide
taatacgactcactatagggaagtgtatatgttttgttggttgaatttataacagaggagaataaatatgaccaacaaaaacctggcggcagcgcaaaagatg

SEQ ID NO: 161351 - DNA, 103 bp, Artificial Sequence
  Synthetic Polynucleotide
taatacgactcactatagggtctttttagtaagtgtatatgttttgttggaacagaggagaccaacaatgcatatacacaacctggcggcagcgcaaaagatg

SEQ ID NO: 161352 - DNA, 103 bp, Artificial Sequence
  Synthetic Polynucleotide
taatacgactcactataggggggtttggtttctttttagtaagtgtatataacagaggagaatatacatgtactaaaaaaacctggcggcagcgcaaaagatg

SEQ ID NO: 161353 - DNA, 103 bp, Artificial Sequence
  Synthetic Polynucleotide
taatacgactcactatagggggaagtgttagggtttggtttctttttagtaacagaggagaactaaaatgaaaccaaacaacctggcggcagcgcaaaagatg

SEQ ID NO: 161354 - DNA, 103 bp, Artificial Sequence
  Synthetic Polynucleotide
taatacgactcactatagggtgacaactttggaagtgttagggtttggttaacagaggagaaaccaaatgctaacacttaacctggcggcagcgcaaaagatg

SEQ ID NO: 161355 - DNA, 103 bp, Artificial Sequence
  Synthetic Polynucleotide
taatacgactcactatagggcatcgatgctggcactgaaaatcagagcgaaacagaggagatcgctcatgttttcagtgaacctggcggcagcgcaaaagatg

SEQ ID NO: 161356 - DNA, 103 bp, Artificial Sequence
  Synthetic Polynucleotide
taatacgactcactatagggttttccaatttgacaactttggaagtgttaaacagaggagataacacatgcaaagttgtaacctggcggcagcgcaaaagatg

SEQ ID NO: 161357 - DNA, 103 bp, Artificial Sequence
  Synthetic Polynucleotide
taatacgactcactatagggctgaagattcttttccaatttgacaactttaacagaggagaaaagttatgaaattggaaaacctggcggcagcgcaaaagatg

SEQ ID NO: 161358 - DNA, 103 bp, Artificial Sequence
  Synthetic Polynucleotide
taatacgactcactatagggcacaatttgactgaagattcttttccaattaacagaggagaaattggatgagaatcttcaacctggcggcagcgcaaaagatg

SEQ ID NO: 161359 - DNA, 103 bp, Artificial Sequence
  Synthetic Polynucleotide
taatacgactcactataggggtttcccattcacaatttgactgaagattcaacagaggagagaatctatggtcaaattgaacctggcggcagcgcaaaagatg

SEQ ID NO: 161360 - DNA, 103 bp, Artificial Sequence
  Synthetic Polynucleotide
taatacgactcactatagggataaaccactgtttcccattcacaatttgaaacagaggagatcaaatatggaatgggaaaacctggcggcagcgcaaaagatg

SEQ ID NO: 161361 - DNA, 103 bp, Artificial Sequence
  Synthetic Polynucleotide
taatacgactcactatagggctgtcttcccataaaccactgtttcccattaacagaggagaaatgggatgcagtggtttaacctggcggcagcgcaaaagatg

SEQ ID NO: 161362 - DNA, 103 bp, Artificial Sequence
  Synthetic Polynucleotide
taatacgactcactatagggagttggtcttctgtcttcccataaaccactaacagaggagaagtggtatgtgggaagacaacctggcggcagcgcaaaagatg

SEQ ID NO: 161363 - DNA, 103 bp, Artificial Sequence
  Synthetic Polynucleotide
taatacgactcactatagggagtcataataagttggtcttctgtcttcccaacagaggagagggaagatggaagaccaaaacctggcggcagcgcaaaagatg

SEQ ID NO: 161364 - DNA, 103 bp, Artificial Sequence
  Synthetic Polynucleotide
taatacgactcactatagggttgcttgttcagtcataataagttggtcttaacagaggagaaagaccatgttattatgaaacctggcggcagcgcaaaagatg

SEQ ID NO: 161365 - DNA, 103 bp, Artificial Sequence
  Synthetic Polynucleotide
taatacgactcactatagggagatatcttcttgcttgttcagtcataataaacagaggagatattatatgtgaacaagcaacctggcggcagcgcaaaagatg

SEQ ID NO: 161366 - DNA, 103 bp, Artificial Sequence
  Synthetic Polynucleotide
taatacgactcactatagggaactttctgccatcgatgctggcactgaaaaacagaggagatttcagatgcagcatcgaaacctggcggcagcgcaaaagatg

SEQ ID NO: 161367 - DNA, 103 bp, Artificial Sequence
  Synthetic Polynucleotide
taatacgactcactataggggtaagtactcagatatcttcttgcttgttcaacagaggagagaacaaatgagaagatataacctggcggcagcgcaaaagatg

SEQ ID NO: 161368 - DNA, 103 bp, Artificial Sequence
  Synthetic Polynucleotide
taatacgactcactatagggtggtagctgtgtaagtactcagatatcttcaacagaggagagaagatatgtgagtacttaacctggcggcagcgcaaaagatg

SEQ ID NO: 161369 - DNA, 103 bp, Artificial Sequence
  Synthetic Polynucleotide
taatacgactcactataggggaagtactactggtagctgtgtaagtactcaacagaggagagagtacatgcacagctacaacctggcggcagcgcaaaagatg

SEQ ID NO: 161370 - DNA, 103 bp, Artificial Sequence
  Synthetic Polynucleotide
taatacgactcactataggggagagctcttgaagtactactggtagctgtaacagaggagaacagctatgagtagtactaacctggcggcagcgcaaaagatg

SEQ ID NO: 161371 - DNA, 103 bp, Artificial Sequence
  Synthetic Polynucleotide
taatacgactcactatagggcaggatttaaaactttctgccatcgatgctaacagaggagaagcatcatgggcagaaagaacctggcggcagcgcaaaagatg

SEQ ID NO: 161372 - DNA, 103 bp, Artificial Sequence
  Synthetic Polynucleotide
taatacgactcactatagggtttatcaattcaggatttaaaactttctgcaacagaggagagcagaaatgtttaaatccaacctggcggcagcgcaaaagatg

SEQ ID NO: 161373 - DNA, 103 bp, Artificial Sequence
  Synthetic Polynucleotide
taatacgactcactatagggccaaggaccctttatcaattcaggatttaaaacagaggagattaaatatggaattgataaacctggcggcagcgcaaaagatg

SEQ ID NO: 161374 - DNA, 103 bp, Artificial Sequence
  Synthetic Polynucleotide
taatacgactcactatagggcttctttagtccaaggaccctttatcaattaacagaggagaaattgaatgagggtccttaacctggcggcagcgcaaaagatg

SEQ ID NO: 161375 - DNA, 103 bp, Artificial Sequence
  Synthetic Polynucleotide
taatacgactcactatagggctctgatcttcttctttagtccaaggacccaacagaggagagggtccatggactaaagaaacctggcggcagcgcaaaagatg

SEQ ID NO: 161376 - DNA, 103 bp, Artificial Sequence
  Synthetic Polynucleotide
taatacgactcactatagggttcaataaccctctgatcttcttctttagtaacagaggagaactaaaatggaagatcagaacctggcggcagcgcaaaagatg

SEQ ID NO: 161377 - DNA, 103 bp, Artificial Sequence
  Synthetic Polynucleotide
taatacgactcactatagggtctgaactaattcaataaccctctgatcttaacagaggagaaagatcatggggttattgaacctggcggcagcgcaaaagatg

SEQ ID NO: 161378 - DNA, 103 bp, Artificial Sequence
  Synthetic Polynucleotide
taatacgactcactataggggcatactgaaggtcatcatcctcatcctcaaacagaggagatgaggaatgggatgatgaaacctggcggcagcgcaaaagatg

SEQ ID NO: 161379 - DNA, 103 bp, Artificial Sequence
  Synthetic Polynucleotide
taatacgactcactatagggggcccatatttctgaactaattcaataaccaacagaggagaggttatatgattagttcaaacctggcggcagcgcaaaagatg

SEQ ID NO: 161380 - DNA, 103 bp, Artificial Sequence
  Synthetic Polynucleotide
taatacgactcactatagggccatctttttggcccatatttctgaactaaaacagaggagattagttatgaaatatgggaacctggcggcagcgcaaaagatg

SEQ ID NO: 161381 - DNA, 103 bp, Artificial Sequence
  Synthetic Polynucleotide
taatacgactcactatagggcaattaaagaccatctttttggcccatattaacagaggagaaatatgatgcaaaaagataacctggcggcagcgcaaaagatg

SEQ ID NO: 161382 - DNA, 103 bp, Artificial Sequence
  Synthetic Polynucleotide
taatacgactcactatagggaaatgttttgcaattaaagaccatctttttaacagaggagaaaaaagatggtctttaataacctggcggcagcgcaaaagatg

SEQ ID NO: 161383 - DNA, 103 bp, Artificial Sequence
  Synthetic Polynucleotide
taatacgactcactatagggtcttccttttaaatgttttgcaattaaagaaacagaggagatctttaatggcaaaacataacctggcggcagcgcaaaagatg

SEQ ID NO: 161384 - DNA, 103 bp, Artificial Sequence
  Synthetic Polynucleotide
taatacgactcactataggggcttgcctattcttccttttaaatgttttgaacagaggagacaaaacatgtaaaaggaaaacctggcggcagcgcaaaagatg

SEQ ID NO: 161385 - DNA, 103 bp, Artificial Sequence
  Synthetic Polynucleotide
taatacgactcactatagggtctctacactgcttgcctattcttccttttaacagaggagaaaaaggatgaataggcaaaacctggcggcagcgcaaaagatg

SEQ ID NO: 161386 - DNA, 103 bp, Artificial Sequence
  Synthetic Polynucleotide
taatacgactcactatagggatgccatctttctctacactgcttgcctataacagaggagaataggcatgcagtgtagaaacctggcggcagcgcaaaagatg

SEQ ID NO: 161387 - DNA, 103 bp, Artificial Sequence
  Synthetic Polynucleotide
taatacgactcactatagggtcagatgattatgccatctttctctacactaacagaggagaagtgtaatgaaagatggcaacctggcggcagcgcaaaagatg

SEQ ID NO: 161388 - DNA, 103 bp, Artificial Sequence
  Synthetic Polynucleotide
taatacgactcactatagggacctcaggattcagatgattatgccatcttaacagaggagaaagatgatgtaatcatctaacctggcggcagcgcaaaagatg

SEQ ID NO: 161389 - DNA, 103 bp, Artificial Sequence
  Synthetic Polynucleotide
taatacgactcactatagggatcatgatcggcatactgaaggtcatcatcaacagaggagagatgatatgcttcagtataacctggcggcagcgcaaaagatg

SEQ ID NO: 161390 - DNA, 103 bp, Artificial Sequence
  Synthetic Polynucleotide
taatacgactcactatagggagatttctttacctcaggattcagatgattaacagaggagaaatcatatgaatcctgagaacctggcggcagcgcaaaagatg

SEQ ID NO: 161391 - DNA, 103 bp, Artificial Sequence
  Synthetic Polynucleotide
taatacgactcactatagggctgtccaggaagatttctttacctcaggataacagaggagaatcctgatgtaaagaaataacctggcggcagcgcaaaagatg

SEQ ID NO: 161392 - DNA, 103 bp, Artificial Sequence
  Synthetic Polynucleotide
taatacgactcactatagggtcctcctcttctgtccaggaagatttctttaacagaggagaaaagaaatgttcctggacaacctggcggcagcgcaaaagatg

SEQ ID NO: 161393 - DNA, 103 bp, Artificial Sequence
  Synthetic Polynucleotide
taatacgactcactataggggatgatcctgtcctcctcttctgtccaggaaacagaggagatcctggatggaagaggagaacctggcggcagcgcaaaagatg

SEQ ID NO: 161394 - DNA, 103 bp, Artificial Sequence
  Synthetic Polynucleotide
taatacgactcactataggggtgcttcatagatgatcctgtcctcctcttaacagaggagaaagaggatgacaggatcaaacctggcggcagcgcaaaagatg

SEQ ID NO: 161395 - DNA, 103 bp, Artificial Sequence
  Synthetic Polynucleotide
taatacgactcactatagggaaccgcttatgtgcttcatagatgatcctgaacagaggagacaggatatgctatgaagcaacctggcggcagcgcaaaagatg

SEQ ID NO: 161396 - DNA, 103 bp, Artificial Sequence
  Synthetic Polynucleotide
taatacgactcactatagggacgatttcccaaccgcttatgtgcttcataaacagaggagatatgaaatgcataagcggaacctggcggcagcgcaaaagatg

SEQ ID NO: 161397 - DNA, 103 bp, Artificial Sequence
  Synthetic Polynucleotide
taatacgactcactatagggtttctgcccaacgatttcccaaccgcttataacagaggagaataagcatgtgggaaatcaacctggcggcagcgcaaaagatg

SEQ ID NO: 161398 - DNA, 103 bp, Artificial Sequence
  Synthetic Polynucleotide
taatacgactcactatagggagtttggcaatttctgcccaacgatttcccaacagaggagagggaaaatgttgggcagaaacctggcggcagcgcaaaagatg

SEQ ID NO: 161399 - DNA, 103 bp, Artificial Sequence
  Synthetic Polynucleotide
taatacgactcactatagggtcctggaagtagtttggcaatttctgcccaaacagaggagatgggcaatgattgccaaaaacctggcggcagcgcaaaagatg

SEQ ID NO: 161400 - DNA, 103 bp, Artificial Sequence
  Synthetic Polynucleotide
taatacgactcactataggggtacttcataatcatgatcggcatactgaaaacagaggagattcagtatgccgatcatgaacctggcggcagcgcaaaagatg

SEQ ID NO: 161401 - DNA, 103 bp, Artificial Sequence
  Synthetic Polynucleotide
taatacgactcactatagggtatcagtccttcctggaagtagtttggcaaaacagaggagattgccaatgtacttccagaacctggcggcagcgcaaaagatg

SEQ ID NO: 161402 - DNA, 103 bp, Artificial Sequence
  Synthetic Polynucleotide
taatacgactcactatagggttgatagaattatcagtccttcctggaagtaacagaggagaacttccatgaaggactgaaacctggcggcagcgcaaaagatg

SEQ ID NO: 161403 - DNA, 103 bp, Artificial Sequence
  Synthetic Polynucleotide
taatacgactcactatagggccaatgatttttgatagaattatcagtcctaacagaggagaaggactatgaattctatcaacctggcggcagcgcaaaagatg

SEQ ID NO: 161404 - DNA, 103 bp, Artificial Sequence
  Synthetic Polynucleotide
taatacgactcactatagggtagtagaattccaatgatttttgatagaataacagaggagaattctaatgaaaatcattaacctggcggcagcgcaaaagatg

SEQ ID NO: 161405 - DNA, 103 bp, Artificial Sequence
  Synthetic Polynucleotide
taatacgactcactatagggtttcttcgcatagtagaattccaatgatttaacagaggagaaaatcaatggaattctacaacctggcggcagcgcaaaagatg

SEQ ID NO: 161406 - DNA, 103 bp, Artificial Sequence
  Synthetic Polynucleotide
taatacgactcactatagggctgttccacttttcttcgcatagtagaattaacagaggagaaattctatgatgcgaagaaacctggcggcagcgcaaaagatg

SEQ ID NO: 161407 - DNA, 103 bp, Artificial Sequence
  Synthetic Polynucleotide
taatacgactcactatagggaatagccctcctgttccacttttcttcgcaaacagaggagatgcgaaatgaagtggaacaacctggcggcagcgcaaaagatg

SEQ ID NO: 161408 - DNA, 103 bp, Artificial Sequence
  Synthetic Polynucleotide
taatacgactcactatagggccatcttgtaaatagccctcctgttccactaacagaggagaagtggaatgggagggctaaacctggcggcagcgcaaaagatg

SEQ ID NO: 161409 - DNA, 103 bp, Artificial Sequence
  Synthetic Polynucleotide
taatacgactcactatagggtgattttattccatcttgtaaatagccctcaacagaggagagagggcatgttacaagataacctggcggcagcgcaaaagatg

SEQ ID NO: 161410 - DNA, 103 bp, Artificial Sequence
  Synthetic Polynucleotide
taatacgactcactatagggaagatcgttctgattttattccatcttgtaaacagaggagatacaagatggaataaaataacctggcggcagcgcaaaagatg

SEQ ID NO: 161411 - DNA, 103 bp, Artificial Sequence
  Synthetic Polynucleotide
taatacgactcactatagggttttgttgtggtacttcataatcatgatcgaacagaggagacgatcaatgttatgaagtaacctggcggcagcgcaaaagatg

SEQ ID NO: 161412 - DNA, 103 bp, Artificial Sequence
  Synthetic Polynucleotide
taatacgactcactatagggagtttagatgaagatcgttctgattttattaacagaggagaaataaaatgagaacgatcaacctggcggcagcgcaaaagatg

SEQ ID NO: 161413 - DNA, 103 bp, Artificial Sequence
  Synthetic Polynucleotide
taatacgactcactatagggtttgtgttgaagtttagatgaagatcgttcaacagaggagagaacgaatgtcatctaaaaacctggcggcagcgcaaaagatg

SEQ ID NO: 161414 - DNA, 103 bp, Artificial Sequence
  Synthetic Polynucleotide
taatacgactcactatagggctgcacaaggtttgtgttgaagtttagatgaacagaggagacatctaatgttcaacacaaacctggcggcagcgcaaaagatg

SEQ ID NO: 161415 - DNA, 103 bp, Artificial Sequence
  Synthetic Polynucleotide
taatacgactcactatagggtgatccatagctgcacaaggtttgtgttgaaacagaggagatcaacaatgaccttgtgcaacctggcggcagcgcaaaagatg

SEQ ID NO: 161416 - DNA, 103 bp, Artificial Sequence
  Synthetic Polynucleotide
taatacgactcactatagggggtttgcatatgatccatagctgcacaaggaacagaggagaccttgtatggctatggataacctggcggcagcgcaaaagatg

SEQ ID NO: 161417 - DNA, 103 bp, Artificial Sequence
  Synthetic Polynucleotide
taatacgactcactatagggactgattctgggtttgcatatgatccatagaacagaggagactatggatgatatgcaaaaacctggcggcagcgcaaaagatg

SEQ ID NO: 161418 - DNA, 103 bp, Artificial Sequence
  Synthetic Polynucleotide
taatacgactcactatagggggtatgtaaaactgattctgggtttgcataaacagaggagatatgcaatgccagaatcaaacctggcggcagcgcaaaagatg

SEQ ID NO: 161419 - DNA, 103 bp, Artificial Sequence
  Synthetic Polynucleotide
taatacgactcactataggggatctgaacaggtatgtaaaactgattctgaacagaggagacagaatatgttttacataaacctggcggcagcgcaaaagatg

SEQ ID NO: 161420 - DNA, 103 bp, Artificial Sequence
  Synthetic Polynucleotide
taatacgactcactataggggatacccagggatctgaacaggtatgtaaaaacagaggagatttacaatgctgttcagaaacctggcggcagcgcaaaagatg

SEQ ID NO: 161421 - DNA, 103 bp, Artificial Sequence
  Synthetic Polynucleotide
taatacgactcactataggggacacatactgatacccagggatctgaacaaacagaggagatgttcaatgccctgggtaaacctggcggcagcgcaaaagatg

SEQ ID NO: 161422 - DNA, 103 bp, Artificial Sequence
  Synthetic Polynucleotide
taatacgactcactatagggcttcagtcctttttgttgtggtacttcataaacagaggagatatgaaatgccacaacaaaacctggcggcagcgcaaaagatg

SEQ ID NO: 161423 - DNA, 103 bp, Artificial Sequence
  Synthetic Polynucleotide
taatacgactcactataggggccttcaggtgacacatactgatacccaggaacagaggagacctgggatgcagtatgtgaacctggcggcagcgcaaaagatg

SEQ ID NO: 161424 - DNA, 103 bp, Artificial Sequence
  Synthetic Polynucleotide
taatacgactcactatagggctatacaattgccttcaggtgacacatactaacagaggagaagtatgatgcacctgaagaacctggcggcagcgcaaaagatg

SEQ ID NO: 161425 - DNA, 103 bp, Artificial Sequence
  Synthetic Polynucleotide
taatacgactcactatagggtgaacatgttctatacaattgccttcaggtaacagaggagaacctgaatgcaattgtataacctggcggcagcgcaaaagatg

SEQ ID NO: 161426 - DNA, 103 bp, Artificial Sequence
  Synthetic Polynucleotide
taatacgactcactatagggagaagtaggctgaacatgttctatacaattaacagaggagaaattgtatggaacatgttaacctggcggcagcgcaaaagatg

SEQ ID NO: 161427 - DNA, 103 bp, Artificial Sequence
  Synthetic Polynucleotide
taatacgactcactataggggaataaaggcagaagtaggctgaacatgttaacagaggagaaacatgatgagcctacttaacctggcggcagcgcaaaagatg

SEQ ID NO: 161428 - DNA, 103 bp, Artificial Sequence
  Synthetic Polynucleotide
taatacgactcactatagggaagggttgctgaataaaggcagaagtaggcaacagaggagagcctacatgtgcctttataacctggcggcagcgcaaaagatg

SEQ ID NO: 161429 - DNA, 103 bp, Artificial Sequence
  Synthetic Polynucleotide
taatacgactcactatagggttcatcaatgaagggttgctgaataaaggcaacagaggagagcctttatgcagcaacccaacctggcggcagcgcaaaagatg

SEQ ID NO: 161430 - DNA, 103 bp, Artificial Sequence
  Synthetic Polynucleotide
taatacgactcactatagggtatcaggatcttcatcaatgaagggttgctaacagaggagaagcaacatgtcattgatgaacctggcggcagcgcaaaagatg

SEQ ID NO: 161431 - DNA, 103 bp, Artificial Sequence
  Synthetic Polynucleotide
taatacgactcactatagggttcttttccttatcaggatcttcatcaatgaacagaggagacattgaatgagatcctgaaacctggcggcagcgcaaaagatg

SEQ ID NO: 161432 - DNA, 103 bp, Artificial Sequence
  Synthetic Polynucleotide
taatacgactcactatagggttcctttattttcttttccttatcaggatcaacagaggagagatcctatgaaggaaaagaacctggcggcagcgcaaaagatg

SEQ ID NO: 161433 - DNA, 103 bp, Artificial Sequence
  Synthetic Polynucleotide
taatacgactcactatagggtccagagtttcttcagtcctttttgttgtgaacagaggagacacaacatgaaggactgaaacctggcggcagcgcaaaagatg

SEQ ID NO: 161434 - DNA, 103 bp, Artificial Sequence
  Synthetic Polynucleotide
taatacgactcactataggggcatctcaagttcctttattttcttttcctaacagaggagaaggaaaatgaaataaaggaacctggcggcagcgcaaaagatg

SEQ ID NO: 161435 - DNA, 103 bp, Artificial Sequence
  Synthetic Polynucleotide
taatacgactcactataggggacataagaagcatctcaagttcctttattaacagaggagaaataaaatgacttgagataacctggcggcagcgcaaaagatg

SEQ ID NO: 161436 - DNA, 103 bp, Artificial Sequence
  Synthetic Polynucleotide
taatacgactcactatagggattctcagctgacataagaagcatctcaagaacagaggagacttgagatgcttcttatgaacctggcggcagcgcaaaagatg

SEQ ID NO: 161437 - DNA, 103 bp, Artificial Sequence
  Synthetic Polynucleotide
taatacgactcactatagggttctaacttcattctcagctgacataagaaaacagaggagattcttaatgcagctgagaaacctggcggcagcgcaaaagatg

SEQ ID NO: 161438 - DNA, 103 bp, Artificial Sequence
  Synthetic Polynucleotide
taatacgactcactatagggattcgctttcttctaacttcattctcagctaacagaggagaagctgaatgtgaagttagaacctggcggcagcgcaaaagatg

SEQ ID NO: 161439 - DNA, 103 bp, Artificial Sequence
  Synthetic Polynucleotide
taatacgactcactatagggctgtgatggaattcgctttcttctaacttcaacagaggagagaagttatgagaaagcgaaacctggcggcagcgcaaaagatg

SEQ ID NO: 161440 - DNA, 103 bp, Artificial Sequence
  Synthetic Polynucleotide
taatacgactcactatagggaacttccaggctgtgatggaattcgctttcaacagaggagagaaagcatgttccatcacaacctggcggcagcgcaaaagatg

SEQ ID NO: 161441 - DNA, 103 bp, Artificial Sequence
  Synthetic Polynucleotide
taatacgactcactatagggcagctagaaaaacttccaggctgtgatggaaacagaggagatccatcatggcctggaagaacctggcggcagcgcaaaagatg

SEQ ID NO: 161442 - DNA, 103 bp, Artificial Sequence
  Synthetic Polynucleotide
taatacgactcactatagggactaccagaccagctagaaaaacttccaggaacagaggagacctggaatgttttctagcaacctggcggcagcgcaaaagatg

SEQ ID NO: 161443 - DNA, 103 bp, Artificial Sequence
  Synthetic Polynucleotide
taatacgactcactatagggccatgaggaaactaccagaccagctagaaaaacagaggagatttctaatgggtctggtaaacctggcggcagcgcaaaagatg

SEQ ID NO: 161444 - DNA, 103 bp, Artificial Sequence
  Synthetic Polynucleotide
taatacgactcactatagggtttactctgttccagagtttcttcagtcctaacagaggagaaggactatggaaactctgaacctggcggcagcgcaaaagatg

SEQ ID NO: 161445 - DNA, 103 bp, Artificial Sequence
  Synthetic Polynucleotide
taatacgactcactatagggatgttatcatccatgaggaaactaccagacaacagaggagagtctggatgtttcctcataacctggcggcagcgcaaaagatg

SEQ ID NO: 161446 - DNA, 103 bp, Artificial Sequence
  Synthetic Polynucleotide
taatacgactcactatagggagtattagacatgttatcatccatgaggaaaacagaggagattcctcatggatgataacaacctggcggcagcgcaaaagatg

SEQ ID NO: 161447 - DNA, 103 bp, Artificial Sequence
  Synthetic Polynucleotide
taatacgactcactatagggggctatttagagtattagacatgttatcataacagaggagaatgataatgtgtctaataaacctggcggcagcgcaaaagatg

SEQ ID NO: 161448 - DNA, 103 bp, Artificial Sequence
  Synthetic Polynucleotide
taatacgactcactatagggtgctcgtcaaggctatttagagtattagacaacagaggagagtctaaatgtctaaatagaacctggcggcagcgcaaaagatg

SEQ ID NO: 161449 - DNA, 103 bp, Artificial Sequence
  Synthetic Polynucleotide
taatacgactcactatagggctcactagtgtgctcgtcaaggctatttagaacagaggagactaaatatgcttgacgagaacctggcggcagcgcaaaagatg

SEQ ID NO: 161450 - DNA, 103 bp, Artificial Sequence
  Synthetic Polynucleotide
taatacgactcactatagggtactgtaaaactcactagtgtgctcgtcaaaacagaggagattgacgatgacactagtgaacctggcggcagcgcaaaagatg

SEQ ID NO: 161451 - DNA, 103 bp, Artificial Sequence
  Synthetic Polynucleotide
taatacgactcactatagggttttcatccatactgtaaaactcactagtgaacagaggagacactagatggttttacagaacctggcggcagcgcaaaagatg

SEQ ID NO: 161452 - DNA, 103 bp, Artificial Sequence
  Synthetic Polynucleotide
taatacgactcactatagggcacaggctgattttcatccatactgtaaaaaacagaggagattttacatgatggatgaaaacctggcggcagcgcaaaagatg

SEQ ID NO: 161453 - DNA, 103 bp, Artificial Sequence
  Synthetic Polynucleotide
taatacgactcactataggggctgagcagacacaggctgattttcatccaaacagaggagatggatgatgatcagcctgaacctggcggcagcgcaaaagatg

SEQ ID NO: 161454 - DNA, 103 bp, Artificial Sequence
  Synthetic Polynucleotide
taatacgactcactatagggggtgaattctgctgagcagacacaggctgaaacagaggagatcagccatggtctgctcaaacctggcggcagcgcaaaagatg

SEQ ID NO: 161455 - DNA, 103 bp, Artificial Sequence
  Synthetic Polynucleotide
taatacgactcactatagggcagatcctcgcagcgcgtccgccgagacataacagaggagaatgtctatgcggacgcgcaacctggcggcagcgcaaaagatg

SEQ ID NO: 161456 - DNA, 103 bp, Artificial Sequence
  Synthetic Polynucleotide
taatacgactcactatagggctcgtcctcctcatgggtccatttgaccttaacagaggagaaaggtcatgtggacccataacctggcggcagcgcaaaagatg

SEQ ID NO: 161457 - DNA, 103 bp, Artificial Sequence
  Synthetic Polynucleotide
taatacgactcactataggggatactgtcctctgcagatggttcctcaggaacagaggagacctgagatgccatctgcaaacctggcggcagcgcaaaagatg

SEQ ID NO: 161458 - DNA, 103 bp, Artificial Sequence
  Synthetic Polynucleotide
taatacgactcactatagggggctgttgttgatactgtcctctgcagatgaacagaggagacatctgatgaggacagtaaacctggcggcagcgcaaaagatg

SEQ ID NO: 161459 - DNA, 103 bp, Artificial Sequence
  Synthetic Polynucleotide
taatacgactcactatagggagctgcactaggctgttgttgatactgtccaacagaggagaggacagatgcaacaacagaacctggcggcagcgcaaaagatg

SEQ ID NO: 161460 - DNA, 103 bp, Artificial Sequence
  Synthetic Polynucleotide
taatacgactcactatagggtgacgcttgcagctgcactaggctgttgttaacagaggagaaacaacatgctagtgcagaacctggcggcagcgcaaaagatg

SEQ ID NO: 161461 - DNA, 103 bp, Artificial Sequence
  Synthetic Polynucleotide
taatacgactcactataggggctgctgatgtgacgcttgcagctgcactaaacagaggagatagtgcatgtgcaagcgtaacctggcggcagcgcaaaagatg

SEQ ID NO: 161462 - DNA, 103 bp, Artificial Sequence
  Synthetic Polynucleotide
taatacgactcactatagggggcaggacttgctgctgatgtgacgcttgcaacagaggagagcaagcatgacatcagcaaacctggcggcagcgcaaaagatg

SEQ ID NO: 161463 - DNA, 103 bp, Artificial Sequence
  Synthetic Polynucleotide
taatacgactcactatagggctggcggggtggcaggacttgctgctgatgaacagaggagacatcagatgcaagtcctgaacctggcggcagcgcaaaagatg

SEQ ID NO: 161464 - DNA, 103 bp, Artificial Sequence
  Synthetic Polynucleotide
taatacgactcactataggggggcggaaggctggcggggtggcaggacttaacagaggagaaagtccatgcaccccgccaacctggcggcagcgcaaaagatg

SEQ ID NO: 161465 - DNA, 103 bp, Artificial Sequence
  Synthetic Polynucleotide
taatacgactcactatagggctgggcaccagggcggaaggctggcggggtaacagaggagaaccccgatggccttccgcaacctggcggcagcgcaaaagatg

SEQ ID NO: 161466 - DNA, 103 bp, Artificial Sequence
  Synthetic Polynucleotide
taatacgactcactatagggctcggtcacactgggcaccagggcggaaggaacagaggagaccttccatgctggtgcccaacctggcggcagcgcaaaagatg

SEQ ID NO: 161467 - DNA, 103 bp, Artificial Sequence
  Synthetic Polynucleotide
taatacgactcactatagggccctcagctgctcgtcctcctcatgggtccaacagaggagaggacccatgaggaggacgaacctggcggcagcgcaaaagatg

SEQ ID NO: 161468 - DNA, 103 bp, Artificial Sequence
  Synthetic Polynucleotide
taatacgactcactatagggccaggcggtactcggtcacactgggcaccaaacagaggagatggtgcatggtgtgaccgaacctggcggcagcgcaaaagatg

SEQ ID NO: 161469 - DNA, 103 bp, Artificial Sequence
  Synthetic Polynucleotide
taatacgactcactataggggtgtggccatccaggcggtactcggtcacaaacagaggagatgtgacatggtaccgcctaacctggcggcagcgcaaaagatg

SEQ ID NO: 161470 - DNA, 103 bp, Artificial Sequence
  Synthetic Polynucleotide
taatacgactcactataggggtctgagatggtgtggccatccaggcggtaaacagaggagataccgcatggatggccacaacctggcggcagcgcaaaagatg

SEQ ID NO: 161471 - DNA, 103 bp, Artificial Sequence
  Synthetic Polynucleotide
taatacgactcactatagggtccggctcaggtctgagatggtgtggccataacagaggagaatggccatgccatctcagaacctggcggcagcgcaaaagatg

SEQ ID NO: 161472 - DNA, 103 bp, Artificial Sequence
  Synthetic Polynucleotide
taatacgactcactatagggccccggctgctccggctcaggtctgagatgaacagaggagacatctcatgcctgagccgaacctggcggcagcgcaaaagatg

SEQ ID NO: 161473 - DNA, 103 bp, Artificial Sequence
  Synthetic Polynucleotide
taatacgactcactataggggatcagctcgccccggctgctccggctcagaacagaggagactgagcatgagcagccggaacctggcggcagcgcaaaagatg

SEQ ID NO: 161474 - DNA, 103 bp, Artificial Sequence
  Synthetic Polynucleotide
taatacgactcactataggggggagatggggatcagctcgccccggctgcaacagaggagagcagccatggcgagctgaaacctggcggcagcgcaaaagatg

SEQ ID NO: 161475 - DNA, 103 bp, Artificial Sequence
  Synthetic Polynucleotide
taatacgactcactatagggtcagtgctgggggagatggggatcagctcgaacagaggagacgagctatgccccatctcaacctggcggcagcgcaaaagatg

SEQ ID NO: 161476 - DNA, 103 bp, Artificial Sequence
  Synthetic Polynucleotide
taatacgactcactataggggcccccgacttcagtgctgggggagatgggaacagaggagacccatcatgcccagcactaacctggcggcagcgcaaaagatg

SEQ ID NO: 161477 - DNA, 103 bp, Artificial Sequence
  Synthetic Polynucleotide
taatacgactcactatagggcaatgccagagcccccgacttcagtgctggaacagaggagaccagcaatgaagtcggggaacctggcggcagcgcaaaagatg

SEQ ID NO: 161478 - DNA, 103 bp, Artificial Sequence
  Synthetic Polynucleotide
taatacgactcactatagggctcaccagggccctcagctgctcgtcctccaacagaggagaggaggaatggcagctgagaacctggcggcagcgcaaaagatg

SEQ ID NO: 161479 - DNA, 103 bp, Artificial Sequence
  Synthetic Polynucleotide
taatacgactcactatagggggcggtgtgccaatgccagagcccccgactaacagaggagaagtcggatgctctggcataacctggcggcagcgcaaaagatg

SEQ ID NO: 161480 - DNA, 103 bp, Artificial Sequence
  Synthetic Polynucleotide
taatacgactcactataggggagcacagagggcggtgtgccaatgccagaaacagaggagatctggcatgggcacaccgaacctggcggcagcgcaaaagatg

SEQ ID NO: 161481 - DNA, 103 bp, Artificial Sequence
  Synthetic Polynucleotide
taatacgactcactatagggtctgccgcttgagcacagagggcggtgtgcaacagaggagagcacacatgcctctgtgcaacctggcggcagcgcaaaagatg

SEQ ID NO: 161482 - DNA, 103 bp, Artificial Sequence
  Synthetic Polynucleotide
taatacgactcactatagggcgcctcttcctctgccgcttgagcacagagaacagaggagactctgtatgcaagcggcaaacctggcggcagcgcaaaagatg

SEQ ID NO: 161483 - DNA, 103 bp, Artificial Sequence
  Synthetic Polynucleotide
taatacgactcactatagggcagagccacacgcctcttcctctgccgcttaacagaggagaaagcggatgaggaagaggaacctggcggcagcgcaaaagatg

SEQ ID NO: 161484 - DNA, 103 bp, Artificial Sequence
  Synthetic Polynucleotide
taatacgactcactatagggtgacaggggacagagccacacgcctcttccaacagaggagaggaagaatggtgtggctcaacctggcggcagcgcaaaagatg

SEQ ID NO: 161485 - DNA, 103 bp, Artificial Sequence
  Synthetic Polynucleotide
taatacgactcactatagggctattctcagtgacaggggacagagccacaaacagaggagatgtggcatggtcccctgtaacctggcggcagcgcaaaagatg

SEQ ID NO: 161486 - DNA, 103 bp, Artificial Sequence
  Synthetic Polynucleotide
taatacgactcactatagggcagactggtgctattctcagtgacaggggaaacagaggagatcccctatgactgagaataacctggcggcagcgcaaaagatg

SEQ ID NO: 161487 - DNA, 103 bp, Artificial Sequence
  Synthetic Polynucleotide
taatacgactcactatagggccaggaaggacagactggtgctattctcagaacagaggagactgagaatggcaccagtcaacctggcggcagcgcaaaagatg

SEQ ID NO: 161488 - DNA, 103 bp, Artificial Sequence
  Synthetic Polynucleotide
taatacgactcactatagggttacaggaatccaggaaggacagactggtgaacagaggagacaccagatggtccttcctaacctggcggcagcgcaaaagatg

SEQ ID NO: 161489 - DNA, 103 bp, Artificial Sequence
  Synthetic Polynucleotide
taatacgactcactatagggtccaaactgcctcaccagggccctcagctgaacagaggagacagctgatggccctggtgaacctggcggcagcgcaaaagatg

SEQ ID NO: 161490 - DNA, 103 bp, Artificial Sequence
  Synthetic Polynucleotide
taatacgactcactatagggcgtgaggctgttacaggaatccaggaaggaaacagaggagatccttcatggattcctgtaacctggcggcagcgcaaaagatg

SEQ ID NO: 161491 - DNA, 103 bp, Artificial Sequence
  Synthetic Polynucleotide
taatacgactcactatagggtgctcttgggcgtgaggctgttacaggaataacagaggagaattcctatgacagcctcaaacctggcggcagcgcaaaagatg

SEQ ID NO: 161492 - DNA, 103 bp, Artificial Sequence
  Synthetic Polynucleotide
taatacgactcactatagggttaacaggtgtgctcttgggcgtgaggctgaacagaggagacagcctatggcccaagagaacctggcggcagcgcaaaagatg

SEQ ID NO: 161493 - DNA, 103 bp, Artificial Sequence
  Synthetic Polynucleotide
taatacgactcactataggggggcagggtcttaacaggtgtgctcttgggaacagaggagacccaagatgacacctgttaacctggcggcagcgcaaaagatg

SEQ ID NO: 161494 - DNA, 103 bp, Artificial Sequence
  Synthetic Polynucleotide
taatacgactcactatagggagggcgagaagggcagggtcttaacaggtgaacagaggagacacctgatgagaccctgcaacctggcggcagcgcaaaagatg

SEQ ID NO: 161495 - DNA, 103 bp, Artificial Sequence
  Synthetic Polynucleotide
taatacgactcactatagggagaaactgggagggcgagaagggcagggtcaacagaggagagaccctatgcttctcgccaacctggcggcagcgcaaaagatg

SEQ ID NO: 161496 - DNA, 103 bp, Artificial Sequence
  Synthetic Polynucleotide
taatacgactcactatagggccagaagttcagaaactgggagggcgagaaaacagaggagattctcgatgtcccagtttaacctggcggcagcgcaaaagatg

SEQ ID NO: 161497 - DNA, 103 bp, Artificial Sequence
  Synthetic Polynucleotide
taatacgactcactatagggcctgtttgttccagaagttcagaaactgggaacagaggagacccagtatgtgaacttctaacctggcggcagcgcaaaagatg

SEQ ID NO: 161498 - DNA, 103 bp, Artificial Sequence
  Synthetic Polynucleotide
taatacgactcactatagggtccaatgtgtcctgtttgttccagaagttcaacagaggagagaacttatggaacaaacaaacctggcggcagcgcaaaagatg

SEQ ID NO: 161499 - DNA, 103 bp, Artificial Sequence
  Synthetic Polynucleotide
taatacgactcactataggggctctccagctccaatgtgtcctgtttgttaacagaggagaaacaaaatggacacattgaacctggcggcagcgcaaaagatg

SEQ ID NO: 161500 - DNA, 103 bp, Artificial Sequence
  Synthetic Polynucleotide
taatacgactcactatagggagtcctgctgtccaaactgcctcaccagggaacagaggagaccctggatgggcagtttgaacctggcggcagcgcaaaagatg

SEQ ID NO: 161501 - DNA, 103 bp, Artificial Sequence
  Synthetic Polynucleotide
taatacgactcactatagggtcagcgaggggctctccagctccaatgtgtaacagaggagaacacatatgagctggagaaacctggcggcagcgcaaaagatg

SEQ ID NO: 161502 - DNA, 103 bp, Artificial Sequence
  Synthetic Polynucleotide
taatacgactcactatagggggggtggatgtcagcgaggggctctccagcaacagaggagagctggaatgcccctcgctaacctggcggcagcgcaaaagatg

SEQ ID NO: 161503 - DNA, 103 bp, Artificial Sequence
  Synthetic Polynucleotide
taatacgactcactataggggctgcacactggggtggatgtcagcgagggaacagaggagaccctcgatgacatccaccaacctggcggcagcgcaaaagatg

SEQ ID NO: 161504 - DNA, 103 bp, Artificial Sequence
  Synthetic Polynucleotide
taatacgactcactatagggccaccttctggctgcacactggggtggatgaacagaggagacatccaatgcagtgtgcaaacctggcggcagcgcaaaagatg

SEQ ID NO: 161505 - DNA, 103 bp, Artificial Sequence
  Synthetic Polynucleotide
taatacgactcactataggggtggtgaccaccaccttctggctgcacactaacagaggagaagtgtgatgccagaaggtaacctggcggcagcgcaaaagatg

SEQ ID NO: 161506 - DNA, 103 bp, Artificial Sequence
  Synthetic Polynucleotide
taatacgactcactataggggtgcagtggtgtggtgaccaccaccttctgaacagaggagacagaagatggtggtcaccaacctggcggcagcgcaaaagatg

SEQ ID NO: 161507 - DNA, 103 bp, Artificial Sequence
  Synthetic Polynucleotide
taatacgactcactatagggtcttgtcccggtgcagtggtgtggtgaccaaacagaggagatggtcaatgcaccactgcaacctggcggcagcgcaaaagatg

SEQ ID NO: 161508 - DNA, 103 bp, Artificial Sequence
  Synthetic Polynucleotide
taatacgactcactatagggtgcaggggtgtcttgtcccggtgcagtggtaacagaggagaaccactatgccgggacaaaacctggcggcagcgcaaaagatg

SEQ ID NO: 161509 - DNA, 103 bp, Artificial Sequence
  Synthetic Polynucleotide
taatacgactcactatagggatgtttctggtgcaggggtgtcttgtcccgaacagaggagacgggacatgacacccctgaacctggcggcagcgcaaaagatg

SEQ ID NO: 161510 - DNA, 103 bp, Artificial Sequence
  Synthetic Polynucleotide
taatacgactcactatagggcaaacgcagcatgtttctggtgcaggggtgaacagaggagacaccccatgaccagaaacaacctggcggcagcgcaaaagatg

SEQ ID NO: 161511 - DNA, 103 bp, Artificial Sequence
  Synthetic Polynucleotide
taatacgactcactatagggaggaacttccagtcctgctgtccaaactgcaacagaggagagcagttatgacagcaggaaacctggcggcagcgcaaaagatg

SEQ ID NO: 161512 - DNA, 103 bp, Artificial Sequence
  Synthetic Polynucleotide
taatacgactcactatagggtctggggttacaaacgcagcatgtttctggaacagaggagaccagaaatgtgctgcgttaacctggcggcagcgcaaaagatg

SEQ ID NO: 161513 - DNA, 103 bp, Artificial Sequence
  Synthetic Polynucleotide
taatacgactcactataggggtacttctgatctggggttacaaacgcagcaacagaggagagctgcgatggtaaccccaaacctggcggcagcgcaaaagatg

SEQ ID NO: 161514 - DNA, 103 bp, Artificial Sequence
  Synthetic Polynucleotide
taatacgactcactatagggtgtccatggagtacttctgatctggggttaaacagaggagataacccatgatcagaagtaacctggcggcagcgcaaaagatg

SEQ ID NO: 161515 - DNA, 103 bp, Artificial Sequence
  Synthetic Polynucleotide
taatacgactcactatagggtggggagtgttgtccatggagtacttctgaaacagaggagatcagaaatgctccatggaaacctggcggcagcgcaaaagatg

SEQ ID NO: 161516 - DNA, 103 bp, Artificial Sequence
  Synthetic Polynucleotide
taatacgactcactatagggggttggcgtgtggggagtgttgtccatggaaacagaggagatccatgatgaacactcccaacctggcggcagcgcaaaagatg

SEQ ID NO: 161517 - DNA, 103 bp, Artificial Sequence
  Synthetic Polynucleotide
taatacgactcactatagggtcttgaacggggttggcgtgtggggagtgtaacagaggagaacactcatgacacgccaaaacctggcggcagcgcaaaagatg

SEQ ID NO: 161518 - DNA, 103 bp, Artificial Sequence
  Synthetic Polynucleotide
taatacgactcactatagggtccagggcgttcttgaacggggttggcgtgaacagaggagacacgccatgcccgttcaaaacctggcggcagcgcaaaagatg

SEQ ID NO: 161519 - DNA, 103 bp, Artificial Sequence
  Synthetic Polynucleotide
taatacgactcactatagggtccgtacttctccagggcgttcttgaacggaacagaggagaccgttcatgaacgccctgaacctggcggcagcgcaaaagatg

SEQ ID NO: 161520 - DNA, 103 bp, Artificial Sequence
  Synthetic Polynucleotide
taatacgactcactataggggcttcaggggtccgtacttctccagggcgtaacagaggagaacgcccatgagaagtacgaacctggcggcagcgcaaaagatg

SEQ ID NO: 161521 - DNA, 103 bp, Artificial Sequence
  Synthetic Polynucleotide
taatacgactcactatagggtgtggcaggggcttcaggggtccgtacttcaacagaggagagaagtaatgacccctgaaaacctggcggcagcgcaaaagatg

SEQ ID NO: 161522 - DNA, 103 bp, Artificial Sequence
  Synthetic Polynucleotide
taatacgactcactataggggtggctggccaggaacttccagtcctgctgaacagaggagacagcagatgtggaagttcaacctggcggcagcgcaaaagatg

SEQ ID NO: 161523 - DNA, 103 bp, Artificial Sequence
  Synthetic Polynucleotide
taatacgactcactataggggtgcggggtctgtggcaggggcttcaggggaacagaggagacccctgatgcccctgccaaacctggcggcagcgcaaaagatg

SEQ ID NO: 161524 - DNA, 103 bp, Artificial Sequence
  Synthetic Polynucleotide
taatacgactcactatagggcctcctccaggtgcggggtctgtggcagggaacagaggagaccctgcatgagaccccgcaacctggcggcagcgcaaaagatg

SEQ ID NO: 161525 - DNA, 103 bp, Artificial Sequence
  Synthetic Polynucleotide
taatacgactcactatagggtccttcaagtcctcctccaggtgcggggtcaacagaggagagaccccatgcctggaggaaacctggcggcagcgcaaaagatg

SEQ ID NO: 161526 - DNA, 103 bp, Artificial Sequence
  Synthetic Polynucleotide
taatacgactcactatagggacgcagcacctccttcaagtcctcctccagaacagaggagactggagatggacttgaagaacctggcggcagcgcaaaagatg

SEQ ID NO: 161527 - DNA, 103 bp, Artificial Sequence
  Synthetic Polynucleotide
taatacgactcactatagggcagcctcagaacgcagcacctccttcaagtaacagaggagaacttgaatgaggtgctgcaacctggcggcagcgcaaaagatg

SEQ ID NO: 161528 - DNA, 103 bp, Artificial Sequence
  Synthetic Polynucleotide
taatacgactcactatagggagttcgatgccagcctcagaacgcagcaccaacagaggagaggtgctatgttctgaggcaacctggcggcagcgcaaaagatg

SEQ ID NO: 161529 - DNA, 103 bp, Artificial Sequence
  Synthetic Polynucleotide
taatacgactcactatagggctcgatgatgagttcgatgccagcctcagaaacagaggagatctgagatgggcatcgaaaacctggcggcagcgcaaaagatg

SEQ ID NO: 161530 - DNA, 103 bp, Artificial Sequence
  Synthetic Polynucleotide
taatacgactcactatagggtgatgtcgtcctcgatgatgagttcgatgcaacagaggagagcatcgatgtcatcatcgaacctggcggcagcgcaaaagatg

SEQ ID NO: 161531 - DNA, 103 bp, Artificial Sequence
  Synthetic Polynucleotide
taatacgactcactatagggttctcgggcctgatgtcgtcctcgatgatgaacagaggagacatcatatgggacgacataacctggcggcagcgcaaaagatg

SEQ ID NO: 161532 - DNA, 103 bp, Artificial Sequence
  Synthetic Polynucleotide
taatacgactcactatagggcctcttctgcttctcgggcctgatgtcgtcaacagaggagagacgacatgaggcccgagaacctggcggcagcgcaaaagatg

SEQ ID NO: 161533 - DNA, 103 bp, Artificial Sequence
  Synthetic Polynucleotide
taatacgactcactatagggggttagggaagtggctggccaggaacttccaacagaggagaggaagtatgtggccagccaacctggcggcagcgcaaaagatg

SEQ ID NO: 161534 - DNA, 103 bp, Artificial Sequence
  Synthetic Polynucleotide
taatacgactcactataggggcccaggcttcctcttctgcttctcgggccaacagaggagaggcccgatgagcagaagaaacctggcggcagcgcaaaagatg

SEQ ID NO: 161535 - DNA, 103 bp, Artificial Sequence
  Synthetic Polynucleotide
taatacgactcactatagggctccgccgcagcccaggcttcctcttctgcaacagaggagagcagaaatggaagcctggaacctggcggcagcgcaaaagatg

SEQ ID NO: 161536 - DNA, 103 bp, Artificial Sequence
  Synthetic Polynucleotide
taatacgactcactatagggcttgatggggctccgccgcagcccaggcttaacagaggagaaagcctatgctgcggcggaacctggcggcagcgcaaaagatg

SEQ ID NO: 161537 - DNA, 103 bp, Artificial Sequence
  Synthetic Polynucleotide
taatacgactcactatagggtccggactttcttgatggggctccgccgcaaacagaggagatgcggcatggccccatcaaacctggcggcagcgcaaaagatg

SEQ ID NO: 161538 - DNA, 103 bp, Artificial Sequence
  Synthetic Polynucleotide
taatacgactcactataggggccagagacttccggactttcttgatggggaacagaggagaccccatatggaaagtccgaacctggcggcagcgcaaaagatg

SEQ ID NO: 161539 - DNA, 103 bp, Artificial Sequence
  Synthetic Polynucleotide
taatacgactcactatagggaatgtcaagagccagagacttccggactttaacagaggagaaaagtcatgaagtctctgaacctggcggcagcgcaaaagatg

SEQ ID NO: 161540 - DNA, 103 bp, Artificial Sequence
  Synthetic Polynucleotide
taatacgactcactatagggcctcatccacaatgtcaagagccagagactaacagaggagaagtctcatgctcttgacaaacctggcggcagcgcaaaagatg

SEQ ID NO: 161541 - DNA, 103 bp, Artificial Sequence
  Synthetic Polynucleotide
taatacgactcactatagggagcttcacatcctcatccacaatgtcaagaaacagaggagatcttgaatgtgtggatgaaacctggcggcagcgcaaaagatg

SEQ ID NO: 161542 - DNA, 103 bp, Artificial Sequence
  Synthetic Polynucleotide
taatacgactcactatagggggacatcatcagcttcacatcctcatccacaacagaggagagtggatatggatgtgaagaacctggcggcagcgcaaaagatg

SEQ ID NO: 161543 - DNA, 103 bp, Artificial Sequence
  Synthetic Polynucleotide
taatacgactcactatagggtgggcagtgtggacatcatcagcttcacataacagaggagaatgtgaatgtgatgatgtaacctggcggcagcgcaaaagatg

SEQ ID NO: 161544 - DNA, 103 bp, Artificial Sequence
  Synthetic Polynucleotide
taatacgactcactatagggtggtcagtgcggttagggaagtggctggccaacagaggagaggccagatgcttccctaaaacctggcggcagcgcaaaagatg

SEQ ID NO: 161545 - DNA, 103 bp, Artificial Sequence
  Synthetic Polynucleotide
taatacgactcactataggggatagagacttgggcagtgtggacatcatcaacagaggagagatgatatgcacactgccaacctggcggcagcgcaaaagatg

SEQ ID NO: 161546 - DNA, 103 bp, Artificial Sequence
  Synthetic Polynucleotide
taatacgactcactatagggtgtcggcaaggatagagacttgggcagtgtaacagaggagaacactgatgaagtctctaaacctggcggcagcgcaaaagatg

SEQ ID NO: 161547 - DNA, 103 bp, Artificial Sequence
  Synthetic Polynucleotide
taatacgactcactatagggaaggggcagttgtcggcaaggatagagactaacagaggagaagtctcatgccttgccgaaacctggcggcagcgcaaaagatg

SEQ ID NO: 161548 - DNA, 103 bp, Artificial Sequence
  Synthetic Polynucleotide
taatacgactcactataggggaagagtttgaaggggcagttgtcggcaagaacagaggagacttgccatgaactgccccaacctggcggcagcgcaaaagatg

SEQ ID NO: 161549 - DNA, 103 bp, Artificial Sequence
  Synthetic Polynucleotide
taatacgactcactatagggggtgaggctggaagagtttgaaggggcagtaacagaggagaactgccatgtcaaactctaacctggcggcagcgcaaaagatg

SEQ ID NO: 161550 - DNA, 103 bp, Artificial Sequence
  Synthetic Polynucleotide
taatacgactcactatagggtacctgacagggtgaggctggaagagtttgaacagaggagacaaactatgccagcctcaaacctggcggcagcgcaaaagatg

SEQ ID NO: 161551 - DNA, 103 bp, Artificial Sequence
  Synthetic Polynucleotide
taatacgactcactatagggtcttctttgatacctgacagggtgaggctgaacagaggagacagcctatgcctgtcaggaacctggcggcagcgcaaaagatg

SEQ ID NO: 161552 - DNA, 103 bp, Artificial Sequence
  Synthetic Polynucleotide
taatacgactcactatagggcaagctgttgtcttctttgatacctgacagaacagaggagactgtcaatgatcaaagaaaacctggcggcagcgcaaaagatg

SEQ ID NO: 161553 - DNA, 103 bp, Artificial Sequence
  Synthetic Polynucleotide
taatacgactcactatagggcctggttgagcaagctgttgtcttctttgaaacagaggagatcaaagatgacaacagctaacctggcggcagcgcaaaagatg

SEQ ID NO: 161554 - DNA, 103 bp, Artificial Sequence
  Synthetic Polynucleotide
taatacgactcactatagggtgcaagaagccctggttgagcaagctgttgaacagaggagacaacagatggctcaaccaaacctggcggcagcgcaaaagatg

SEQ ID NO: 161555 - DNA, 103 bp, Artificial Sequence
  Synthetic Polynucleotide
taatacgactcactatagggctggcattgctggtcagtgcggttagggaaaacagaggagattccctatgcgcactgacaacctggcggcagcgcaaaagatg

SEQ ID NO: 161556 - DNA, 103 bp, Artificial Sequence
  Synthetic Polynucleotide
taatacgactcactataggggggcttggcctgcaagaagccctggttgagaacagaggagactcaacatgggcttcttgaacctggcggcagcgcaaaagatg

SEQ ID NO: 161557 - DNA, 103 bp, Artificial Sequence
  Synthetic Polynucleotide
taatacgactcactatagggctgccttctcgggcttggcctgcaagaagcaacagaggagagcttctatgaggccaagcaacctggcggcagcgcaaaagatg

SEQ ID NO: 161558 - DNA, 103 bp, Artificial Sequence
  Synthetic Polynucleotide
taatacgactcactatagggtgggccactgctgccttctcgggcttggccaacagaggagaggccaaatgcgagaaggcaacctggcggcagcgcaaaagatg

SEQ ID NO: 161559 - DNA, 103 bp, Artificial Sequence
  Synthetic Polynucleotide
taatacgactcactatagggtcggggcttctgggccactgctgccttctcaacagaggagagagaagatggcagtggccaacctggcggcagcgcaaaagatg

SEQ ID NO: 161560 - DNA, 103 bp, Artificial Sequence
  Synthetic Polynucleotide
taatacgactcactatagggtgaagtggcttcggggcttctgggccactgaacagaggagacagtggatgagaagccccaacctggcggcagcgcaaaagatg

SEQ ID NO: 161561 - DNA, 103 bp, Artificial Sequence
  Synthetic Polynucleotide
taatacgactcactataggggcaggtgtcgtgaagtggcttcggggcttcaacagaggagagaagccatgaagccacttaacctggcggcagcgcaaaagatg

SEQ ID NO: 161562 - DNA, 103 bp, Artificial Sequence
  Synthetic Polynucleotide
taatacgactcactatagggggacataggggcaggtgtcgtgaagtggctaacagaggagaagccacatgacgacacctaacctggcggcagcgcaaaagatg

SEQ ID NO: 161563 - DNA, 103 bp, Artificial Sequence
  Synthetic Polynucleotide
taatacgactcactatagggtccaggcactggacataggggcaggtgtcgaacagaggagacgacacatgcccctatgtaacctggcggcagcgcaaaagatg

SEQ ID NO: 161564 - DNA, 103 bp, Artificial Sequence
  Synthetic Polynucleotide
taatacgactcactataggggccaccgtcttccaggcactggacatagggaacagaggagaccctatatgcagtgcctgaacctggcggcagcgcaaaagatg

SEQ ID NO: 161565 - DNA, 103 bp, Artificial Sequence
  Synthetic Polynucleotide
taatacgactcactatagggccccccgcaggccaccgtcttccaggcactaacagaggagaagtgccatgaagacggtgaacctggcggcagcgcaaaagatg

SEQ ID NO: 161566 - DNA, 103 bp, Artificial Sequence
  Synthetic Polynucleotide
taatacgactcactataggggcagctcatccagatcctcgcagcgcgtccaacagaggagaggacgcatggcgaggatcaacctggcggcagcgcaaaagatg

SEQ ID NO: 161567 - DNA, 103 bp, Artificial Sequence
  Synthetic Polynucleotide
taatacgactcactataggggccacctgtactggcattgctggtcagtgcaacagaggagagcactgatgagcaatgccaacctggcggcagcgcaaaagatg

SEQ ID NO: 161568 - DNA, 103 bp, Artificial Sequence
  Synthetic Polynucleotide
taatacgactcactatagggggtccctggtccccccgcaggccaccgtctaacagaggagaagacggatgcctgcggggaacctggcggcagcgcaaaagatg

SEQ ID NO: 161569 - DNA, 103 bp, Artificial Sequence
  Synthetic Polynucleotide
taatacgactcactatagggatgaaaagctggtccctggtccccccgcagaacagaggagactgcggatggaccagggaaacctggcggcagcgcaaaagatg

SEQ ID NO: 161570 - DNA, 103 bp, Artificial Sequence
  Synthetic Polynucleotide
taatacgactcactatagggtttctcctgcatgaaaagctggtccctggtaacagaggagaaccaggatgcagcttttcaacctggcggcagcgcaaaagatg

SEQ ID NO: 161571 - DNA, 103 bp, Artificial Sequence
  Synthetic Polynucleotide
taatacgactcactataggggctgccgggctttctcctgcatgaaaagctaacagaggagaagctttatgtgcaggagaaacctggcggcagcgcaaaagatg

SEQ ID NO: 161572 - DNA, 103 bp, Artificial Sequence
  Synthetic Polynucleotide
taatacgactcactatagggcggcccaggagctgccgggctttctcctgcaacagaggagagcaggaatgagcccggcaaacctggcggcagcgcaaaagatg

SEQ ID NO: 161573 - DNA, 103 bp, Artificial Sequence
  Synthetic Polynucleotide
taatacgactcactataggggggcttcaggcggcccaggagctgccgggcaacagaggagagcccggatgctcctgggcaacctggcggcagcgcaaaagatg

SEQ ID NO: 161574 - DNA, 103 bp, Artificial Sequence
  Synthetic Polynucleotide
taatacgactcactatagggatgtgtggctgggcttcaggcggcccaggaaacagaggagatcctggatggcctgaagcaacctggcggcagcgcaaaagatg

SEQ ID NO: 161575 - DNA, 103 bp, Artificial Sequence
  Synthetic Polynucleotide
taatacgactcactatagggagggtccgagatgtgtggctgggcttcaggaacagaggagacctgaaatgcagccacacaacctggcggcagcgcaaaagatg

SEQ ID NO: 161576 - DNA, 103 bp, Artificial Sequence
  Synthetic Polynucleotide
taatacgactcactatagggggacaagatgagggtccgagatgtgtggctaacagaggagaagccacatgtctcggaccaacctggcggcagcgcaaaagatg

SEQ ID NO: 161577 - DNA, 103 bp, Artificial Sequence
  Synthetic Polynucleotide
taatacgactcactatagggaaaactctcagccacctgtactggcattgcaacagaggagagcaatgatggtacaggtgaacctggcggcagcgcaaaagatg

SEQ ID NO: 161578 - DNA, 103 bp, Artificial Sequence
  Synthetic Polynucleotide
taatacgactcactataggggtctggattcaaaactctcagccacctgtaaacagaggagatacaggatgctgagagttaacctggcggcagcgcaaaagatg

SEQ ID NO: 161579 - DNA, 103 bp, Artificial Sequence
  Synthetic Polynucleotide
taatacgactcactatagggccttgacaaggtctggattcaaaactctcaaacagaggagatgagagatgtgaatccagaacctggcggcagcgcaaaagatg

SEQ ID NO: 161580 - DNA, 103 bp, Artificial Sequence
  Synthetic Polynucleotide
taatacgactcactataggggtccatggccccttgacaaggtctggattcaacagaggagagaatccatgccttgtcaaaacctggcggcagcgcaaaagatg

SEQ ID NO: 161581 - DNA, 103 bp, Artificial Sequence
  Synthetic Polynucleotide
taatacgactcactatagggttcctctttggtccatggccccttgacaagaacagaggagacttgtcatggggccatggaacctggcggcagcgcaaaagatg

SEQ ID NO: 161582 - DNA, 103 bp, Artificial Sequence
  Synthetic Polynucleotide
taatacgactcactatagggctttttggtcttcctctttggtccatggccaacagaggagaggccatatgccaaagaggaacctggcggcagcgcaaaagatg

SEQ ID NO: 161583 - DNA, 103 bp, Artificial Sequence
  Synthetic Polynucleotide
taatacgactcactatagggagctcgatgactttttggtcttcctctttgaacagaggagacaaagaatgagaccaaaaaacctggcggcagcgcaaaagatg

SEQ ID NO: 161584 - DNA, 103 bp, Artificial Sequence
  Synthetic Polynucleotide
taatacgactcactatagggcttcttaaccagctcgatgactttttggtcaacagaggagagaccaaatggtcatcgagaacctggcggcagcgcaaaagatg

SEQ ID NO: 161585 - DNA, 103 bp, Artificial Sequence
  Synthetic Polynucleotide
taatacgactcactatagggttgtgccatacttcttaaccagctcgatgaaacagaggagatcatcgatgtggttaagaaacctggcggcagcgcaaaagatg

SEQ ID NO: 161586 - DNA, 103 bp, Artificial Sequence
  Synthetic Polynucleotide
taatacgactcactatagggtcctggtagtgcagctcatccagatcctcgaacagaggagacgaggaatgggatgagctaacctggcggcagcgcaaaagatg

SEQ ID NO: 161587 - DNA, 103 bp, Artificial Sequence
  Synthetic Polynucleotide
taatacgactcactataggggtccactgctttgtgccatacttcttaaccaacagaggagaggttaaatggtatggcacaacctggcggcagcgcaaaagatg

SEQ ID NO: 161588 - DNA, 103 bp, Artificial Sequence
  Synthetic Polynucleotide
taatacgactcactatagggggcaatcagtgtccactgctttgtgccataaacagaggagatatggcatgaagcagtggaacctggcggcagcgcaaaagatg

SEQ ID NO: 161589 - DNA, 103 bp, Artificial Sequence
  Synthetic Polynucleotide
taatacgactcactatagggtcaggtgcttggcaatcagtgtccactgctaacagaggagaagcagtatgcactgattgaacctggcggcagcgcaaaagatg

SEQ ID NO: 161590 - DNA, 103 bp, Artificial Sequence
  Synthetic Polynucleotide
taatacgactcactatagggagccggcccttcaggtgcttggcaatcagtaacagaggagaactgatatgcaagcacctaacctggcggcagcgcaaaagatg

SEQ ID NO: 161591 - DNA, 103 bp, Artificial Sequence
  Synthetic Polynucleotide
taatacgactcactatagggctgcttccccagccggcccttcaggtgcttaacagaggagaaagcacatgaagggccggaacctggcggcagcgcaaaagatg

SEQ ID NO: 161592 - DNA, 103 bp, Artificial Sequence
  Synthetic Polynucleotide
taatacgactcactataggggttcacggcactgcttccccagccggccctaacagaggagaagggccatgtggggaagcaacctggcggcagcgcaaaagatg

SEQ ID NO: 161593 - DNA, 103 bp, Artificial Sequence
  Synthetic Polynucleotide
taatacgactcactatagggttgtgccagcgttcacggcactgcttccccaacagaggagaggggaaatggtgccgtgaaacctggcggcagcgcaaaagatg

SEQ ID NO: 161594 - DNA, 103 bp, Artificial Sequence
  Synthetic Polynucleotide
taatacgactcactataggggttgaggtggttgtgccagcgttcacggcaaacagaggagatgccgtatgcgctggcacaacctggcggcagcgcaaaagatg

SEQ ID NO: 161595 - DNA, 103 bp, Artificial Sequence
  Synthetic Polynucleotide
taatacgactcactatagggtcacctcagggttgaggtggttgtgccagcaacagaggagagctggcatgaccacctcaaacctggcggcagcgcaaaagatg

SEQ ID NO: 161596 - DNA, 103 bp, Artificial Sequence
  Synthetic Polynucleotide
taatacgactcactatagggcaagacttcttcacctcagggttgaggtggaacagaggagaccacctatgccctgaggtaacctggcggcagcgcaaaagatg

SEQ ID NO: 161597 - DNA, 103 bp, Artificial Sequence
  Synthetic Polynucleotide
taatacgactcactatagggtgaatctgtgtcctggtagtgcagctcatcaacagaggagagatgagatgcactaccagaacctggcggcagcgcaaaagatg

SEQ ID NO: 161598 - DNA, 103 bp, Artificial Sequence
  Synthetic Polynucleotide
taatacgactcactatagggctcggtccagcaagacttcttcacctcaggaacagaggagacctgagatgaagaagtctaacctggcggcagcgcaaaagatg

SEQ ID NO: 161599 - DNA, 103 bp, Artificial Sequence
  Synthetic Polynucleotide
taatacgactcactatagggggtcctcctcctcggtccagcaagacttctaacagaggagaagaagtatggctggaccgaacctggcggcagcgcaaaagatg

SEQ ID NO: 161600 - DNA, 103 bp, Artificial Sequence
  Synthetic Polynucleotide
taatacgactcactatagggcagatgatgcggtcctcctcctcggtccagaacagaggagactggacatgggaggaggaaacctggcggcagcgcaaaagatg

SEQ ID NO: 161601 - DNA, 103 bp, Artificial Sequence
  Synthetic Polynucleotide
taatacgactcactataggggtgggcctcgcagatgatgcggtcctcctcaacagaggagagaggagatgcgcatcatcaacctggcggcagcgcaaaagatg

SEQ ID NO: 161602 - DNA, 103 bp, Artificial Sequence
  Synthetic Polynucleotide
taatacgactcactatagggccagcaccttgtgggcctcgcagatgatgcaacagaggagagcatcaatggcgaggcccaacctggcggcagcgcaaaagatg

SEQ ID NO: 161603 - DNA, 103 bp, Artificial Sequence
  Synthetic Polynucleotide
taatacgactcactatagggcagcggttgcccagcaccttgtgggcctcgaacagaggagacgaggcatgcaaggtgctaacctggcggcagcgcaaaagatg

SEQ ID NO: 161604 - DNA, 103 bp, Artificial Sequence
  Synthetic Polynucleotide
taatacgactcactataggggatctcggcccagcggttgcccagcaccttaacagaggagaaaggtgatgggcaaccgcaacctggcggcagcgcaaaagatg

SEQ ID NO: 161605 - DNA, 103 bp, Artificial Sequence
  Synthetic Polynucleotide
taatacgactcactatagggacatcttggcgatctcggcccagcggttgcaacagaggagagcaaccatggggccgagaaacctggcggcagcgcaaaagatg

SEQ ID NO: 161606 - DNA, 103 bp, Artificial Sequence
  Synthetic Polynucleotide
taatacgactcactatagggctccctggcaacatcttggcgatctcggccaacagaggagaggccgaatgcgccaagataacctggcggcagcgcaaaagatg

SEQ ID NO: 161607 - DNA, 103 bp, Artificial Sequence
  Synthetic Polynucleotide
taatacgactcactatagggattgtctgtcctccctggcaacatcttggcaacagaggagagccaagatgttgccagggaacctggcggcagcgcaaaagatg

SEQ ID NO: 161608 - DNA, 103 bp, Artificial Sequence
  Synthetic Polynucleotide
taatacgactcactatagggccggcacatctgaatctgtgtcctggtagtaacagaggagaactaccatgacacagattaacctggcggcagcgcaaaagatg

SEQ ID NO: 161609 - DNA, 103 bp, Artificial Sequence
  Synthetic Polynucleotide
taatacgactcactatagggtcttcacagcattgtctgtcctccctggcaaacagaggagatgccagatgggacagacaaacctggcggcagcgcaaaagatg

SEQ ID NO: 161610 - DNA, 103 bp, Artificial Sequence
  Synthetic Polynucleotide
taatacgactcactatagggttccagtgattcttcacagcattgtctgtcaacagaggagagacagaatgtgctgtgaaaacctggcggcagcgcaaaagatg

SEQ ID NO: 161611 - DNA, 103 bp, Artificial Sequence
  Synthetic Polynucleotide
taatacgactcactataggggatggtagagttccagtgattcttcacagcaacagaggagagctgtgatgaatcactggaacctggcggcagcgcaaaagatg

SEQ ID NO: 161612 - DNA, 103 bp, Artificial Sequence
  Synthetic Polynucleotide
taatacgactcactatagggccttccttttgatggtagagttccagtgataacagaggagaatcactatgactctaccaaacctggcggcagcgcaaaagatg

SEQ ID NO: 161613 - DNA, 103 bp, Artificial Sequence
  Synthetic Polynucleotide
taatacgactcactatagggcctgtgtccaccttccttttgatggtagagaacagaggagactctacatgcaaaaggaaaacctggcggcagcgcaaaagatg

SEQ ID NO: 161614 - DNA, 103 bp, Artificial Sequence
  Synthetic Polynucleotide
taatacgactcactatagggcaagaagcctcctgtgtccaccttccttttaacagaggagaaaaaggatggtggacacaaacctggcggcagcgcaaaagatg

SEQ ID NO: 161615 - DNA, 103 bp, Artificial Sequence
  Synthetic Polynucleotide
taatacgactcactatagggtggactcgctcaagaagcctcctgtgtccaaacagaggagatggacaatggaggcttctaacctggcggcagcgcaaaagatg

SEQ ID NO: 161616 - DNA, 103 bp, Artificial Sequence
  Synthetic Polynucleotide
taatacgactcactatagggttgcagtctttggactcgctcaagaagcctaacagaggagaaggcttatggagcgagtcaacctggcggcagcgcaaaagatg

SEQ ID NO: 161617 - DNA, 103 bp, Artificial Sequence
  Synthetic Polynucleotide
taatacgactcactatagggcactgggggcttgcagtctttggactcgctaacagaggagaagcgagatgaaagactgcaacctggcggcagcgcaaaagatg

SEQ ID NO: 161618 - DNA, 103 bp, Artificial Sequence
  Synthetic Polynucleotide
taatacgactcactataggggcagcaagtacactgggggcttgcagtcttaacagaggagaaagactatgagcccccagaacctggcggcagcgcaaaagatg

SEQ ID NO: 161619 - DNA, 103 bp, Artificial Sequence
  Synthetic Polynucleotide
taatacgactcactatagggtccctctgctccggcacatctgaatctgtgaacagaggagacacagaatgagatgtgccaacctggcggcagcgcaaaagatg

SEQ ID NO: 161620 - DNA, 103 bp, Artificial Sequence
  Synthetic Polynucleotide
taatacgactcactatagggtcgagctccagcagcaagtacactgggggcaacagaggagagcccccatggtacttgctaacctggcggcagcgcaaaagatg

SEQ ID NO: 161621 - DNA, 103 bp, Artificial Sequence
  Synthetic Polynucleotide
taatacgactcactataggggtccttgtcctcgagctccagcagcaagtaaacagaggagatacttgatgctggagctcaacctggcggcagcgcaaaagatg

SEQ ID NO: 161622 - DNA, 103 bp, Artificial Sequence
  Synthetic Polynucleotide
taatacgactcactatagggtctggaggccgtccttgtcctcgagctccaaacagaggagatggagcatgaggacaaggaacctggcggcagcgcaaaagatg

SEQ ID NO: 161623 - DNA, 103 bp, Artificial Sequence
  Synthetic Polynucleotide
taatacgactcactatagggggctgggcactctggaggccgtccttgtccaacagaggagaggacaaatgcggcctccaaacctggcggcagcgcaaaagatg

SEQ ID NO: 161624 - DNA, 103 bp, Artificial Sequence
  Synthetic Polynucleotide
taatacgactcactataggggccttccgtgggctgggcactctggaggccaacagaggagaggcctcatgagtgcccagaacctggcggcagcgcaaaagatg

SEQ ID NO: 161625 - DNA, 103 bp, Artificial Sequence
  Synthetic Polynucleotide
taatacgactcactataggggacttccctggccttccgtgggctgggcacaacagaggagagtgcccatgccacggaagaacctggcggcagcgcaaaagatg

SEQ ID NO: 161626 - DNA, 103 bp, Artificial Sequence
  Synthetic Polynucleotide
taatacgactcactatagggttggtcagaagacttccctggccttccgtgaacagaggagacacggaatgccagggaagaacctggcggcagcgcaaaagatg

SEQ ID NO: 161627 - DNA, 103 bp, Artificial Sequence
  Synthetic Polynucleotide
taatacgactcactatagggggagggccagttggtcagaagacttccctgaacagaggagacagggaatgcttctgaccaacctggcggcagcgcaaaagatg

SEQ ID NO: 161628 - DNA, 103 bp, Artificial Sequence
  Synthetic Polynucleotide
taatacgactcactatagggtaggagggacggagggccagttggtcagaaaacagaggagattctgaatgactggccctaacctggcggcagcgcaaaagatg

SEQ ID NO: 161629 - DNA, 103 bp, Artificial Sequence
  Synthetic Polynucleotide
taatacgactcactatagggtcctttatggtaggagggacggagggccagaacagaggagactggccatgcgtccctccaacctggcggcagcgcaaaagatg

SEQ ID NO: 161630 - DNA, 103 bp, Artificial Sequence
  Synthetic Polynucleotide
taatacgactcactataggggcacttgctatccctctgctccggcacatcaacagaggagagatgtgatggagcagaggaacctggcggcagcgcaaaagatg

SEQ ID NO: 161631 - DNA, 103 bp, Artificial Sequence
  Synthetic Polynucleotide
taatacgactcactataggggttttcctcctcctttatggtaggagggacaacagaggagagtccctatgaccataaagaacctggcggcagcgcaaaagatg

SEQ ID NO: 161632 - DNA, 103 bp, Artificial Sequence
  Synthetic Polynucleotide
taatacgactcactatagggcctcctcactgttttcctcctcctttatggaacagaggagaccataaatgaggaggaaaaacctggcggcagcgcaaaagatg

SEQ ID NO: 161633 - DNA, 103 bp, Artificial Sequence
  Synthetic Polynucleotide
taatacgactcactataggggctgcaagttcctcctcactgttttcctccaacagaggagaggaggaatgcagtgaggaaacctggcggcagcgcaaaagatg

SEQ ID NO: 161634 - DNA, 103 bp, Artificial Sequence
  Synthetic Polynucleotide
taatacgactcactatagggtgtggtggctgctgcaagttcctcctcactaacagaggagaagtgagatggaacttgcaaacctggcggcagcgcaaaagatg

SEQ ID NO: 161635 - DNA, 103 bp, Artificial Sequence
  Synthetic Polynucleotide
taatacgactcactataggggttccttcgatgtggtggctgctgcaagttaacagaggagaaacttgatgcagccaccaaacctggcggcagcgcaaaagatg

SEQ ID NO: 161636 - DNA, 103 bp, Artificial Sequence
  Synthetic Polynucleotide
taatacgactcactatagggatgggctcctgttccttcgatgtggtggctaacagaggagaagccacatgatcgaaggaaacctggcggcagcgcaaaagatg

SEQ ID NO: 161637 - DNA, 103 bp, Artificial Sequence
  Synthetic Polynucleotide
taatacgactcactatagggatctgtaccgatgggctcctgttccttcgaaacagaggagatcgaagatgcaggagcccaacctggcggcagcgcaaaagatg

SEQ ID NO: 161638 - DNA, 103 bp, Artificial Sequence
  Synthetic Polynucleotide
taatacgactcactatagggctgcgtccagatctgtaccgatgggctcctaacagaggagaaggagcatgtcggtacagaacctggcggcagcgcaaaagatg

SEQ ID NO: 161639 - DNA, 103 bp, Artificial Sequence
  Synthetic Polynucleotide
taatacgactcactatagggggtgttcgcactgcgtccagatctgtaccgaacagaggagacggtacatgtctggacgcaacctggcggcagcgcaaaagatg

SEQ ID NO: 161640 - DNA, 103 bp, Artificial Sequence
  Synthetic Polynucleotide
taatacgactcactatagggcaagggctctggtgttcgcactgcgtccagaacagaggagactggacatggtgcgaacaaacctggcggcagcgcaaaagatg

SEQ ID NO: 161641 - DNA, 103 bp, Artificial Sequence
  Synthetic Polynucleotide
taatacgactcactatagggatttgaccttgcacttgctatccctctgctaacagaggagaagcagaatgatagcaagtaacctggcggcagcgcaaaagatg

SEQ ID NO: 161642 - DNA, 103 bp, Artificial Sequence
  Synthetic Polynucleotide
taatacgactcactatagggggaattcctccaagggctctggtgttcgcaaacagaggagatgcgaaatgcagagccctaacctggcggcagcgcaaaagatg

SEQ ID NO: 161643 - DNA, 103 bp, Artificial Sequence
  Synthetic Polynucleotide
taatacgactcactatagggtcacgcttcgggaattcctccaagggctctaacagaggagaagagccatgggaggaattaacctggcggcagcgcaaaagatg

SEQ ID NO: 161644 - DNA, 103 bp, Artificial Sequence
  Synthetic Polynucleotide
taatacgactcactatagggttcctggtcctcacgcttcgggaattcctcaacagaggagagaggaaatgccgaagcgtaacctggcggcagcgcaaaagatg

SEQ ID NO: 161645 - DNA, 103 bp, Artificial Sequence
  Synthetic Polynucleotide
taatacgactcactataggggtggggagccttcctggtcctcacgcttcgaacagaggagacgaagcatgaggaccaggaacctggcggcagcgcaaaagatg

SEQ ID NO: 161646 - DNA, 103 bp, Artificial Sequence
  Synthetic Polynucleotide
taatacgactcactatagggctcgtttctggtggggagccttcctggtccaacagaggagaggaccaatgaggctccccaacctggcggcagcgcaaaagatg

SEQ ID NO: 161647 - DNA, 103 bp, Artificial Sequence
  Synthetic Polynucleotide
taatacgactcactataggggtaaggcaggctcgtttctggtggggagccaacagaggagaggctccatgccagaaacgaacctggcggcagcgcaaaagatg

SEQ ID NO: 161648 - DNA, 103 bp, Artificial Sequence
  Synthetic Polynucleotide
taatacgactcactatagggccacccacttgtaaggcaggctcgtttctgaacagaggagacagaaaatggcctgccttaacctggcggcagcgcaaaagatg

SEQ ID NO: 161649 - DNA, 103 bp, Artificial Sequence
  Synthetic Polynucleotide
taatacgactcactataggggctgcctccaccacccacttgtaaggcaggaacagaggagacctgccatgcaagtgggtaacctggcggcagcgcaaaagatg

SEQ ID NO: 161650 - DNA, 103 bp, Artificial Sequence
  Synthetic Polynucleotide
taatacgactcactataggggaggaggttagctgcctccaccacccacttaacagaggagaaagtggatggtggaggcaaacctggcggcagcgcaaaagatg

SEQ ID NO: 161651 - DNA, 103 bp, Artificial Sequence
  Synthetic Polynucleotide
taatacgactcactatagggcagcagggatgaggaggttagctgcctccaaacagaggagatggaggatgctaacctccaacctggcggcagcgcaaaagatg

SEQ ID NO: 161652 - DNA, 103 bp, Artificial Sequence
  Synthetic Polynucleotide
taatacgactcactatagggtcatgggtccatttgaccttgcacttgctaaacagaggagatagcaaatgcaaggtcaaaacctggcggcagcgcaaaagatg

SEQ ID NO: 161653 - DNA, 103 bp, Artificial Sequence
  Synthetic Polynucleotide
taatacgactcactatagggctagaacccacagcagggatgaggaggttaaacagaggagataacctatgcatccctgcaacctggcggcagcgcaaaagatg

SEQ ID NO: 161654 - DNA, 103 bp, Artificial Sequence
  Synthetic Polynucleotide
taatacgactcactatagggttcagagaggctagaacccacagcagggataacagaggagaatccctatggtgggttctaacctggcggcagcgcaaaagatg

SEQ ID NO: 161655 - DNA, 103 bp, Artificial Sequence
  Synthetic Polynucleotide
taatacgactcactatagggagtccagggcttcagagaggctagaacccaaacagaggagatgggttatggcctctctgaacctggcggcagcgcaaaagatg

SEQ ID NO: 161656 - DNA, 103 bp, Artificial Sequence
  Synthetic Polynucleotide
taatacgactcactataggggactcgatcaagtccagggcttcagagaggaacagaggagacctctcatgagccctggaaacctggcggcagcgcaaaagatg

SEQ ID NO: 161657 - DNA, 103 bp, Artificial Sequence
  Synthetic Polynucleotide
taatacgactcactatagggatcagggtccgactcgatcaagtccagggcaacagaggagagccctgatgttgatcgagaacctggcggcagcgcaaaagatg

SEQ ID NO: 161658 - DNA, 103 bp, Artificial Sequence
  Synthetic Polynucleotide
taatacgactcactatagggcacaccaagcatcagggtccgactcgatcaaacagaggagatgatcgatgcggaccctgaacctggcggcagcgcaaaagatg

SEQ ID NO: 161659 - DNA, 103 bp, Artificial Sequence
  Synthetic Polynucleotide
taatacgactcactatagggttactcaggtcacaccaagcatcagggtccaacagaggagaggacccatgtgcttggtgaacctggcggcagcgcaaaagatg

SEQ ID NO: 161660 - DNA, 103 bp, Artificial Sequence
  Synthetic Polynucleotide
taatacgactcactataggggaggtcaaatttactcaggtcacaccaagcaacagaggagagcttggatggacctgagtaacctggcggcagcgcaaaagatg

SEQ ID NO: 161661 - DNA, 103 bp, Artificial Sequence
  Synthetic Polynucleotide
taatacgactcactataggggttcctcagggaggtcaaatttactcaggtaacagaggagaacctgaatgaatttgaccaacctggcggcagcgcaaaagatg

SEQ ID NO: 161662 - DNA, 103 bp, Artificial Sequence
  Synthetic Polynucleotide
taatacgactcactatagggtctgcagatggttcctcagggaggtcaaataacagaggagaatttgaatgccctgaggaaacctggcggcagcgcaaaagatg

SEQ ID NO: 161663 - DNA, 103 bp, Artificial Sequence
  Synthetic Polynucleotide
taatacgactcactatagggcctgttggtgaagctaacgttgaggggcataacagaggagaatgcccatgaacgttagcaacctggcggcagcgcaaaagatg

SEQ ID NO: 161664 - DNA, 103 bp, Artificial Sequence
  Synthetic Polynucleotide
taatacgactcactatagggcagctcgctctgctgctgctgctggtagaaaacagaggagattctacatgcagcagcagaacctggcggcagcgcaaaagatg

SEQ ID NO: 161665 - DNA, 103 bp, Artificial Sequence
  Synthetic Polynucleotide
taatacgactcactatagggtcggttgttgctgatctgtctcaggactctaacagaggagaagagtcatgagacagatcaacctggcggcagcgcaaaagatg

SEQ ID NO: 161666 - DNA, 103 bp, Artificial Sequence
  Synthetic Polynucleotide
taatacgactcactatagggtggtgcattttcggttgttgctgatctgtcaacagaggagagacagaatggcaacaaccaacctggcggcagcgcaaaagatg

SEQ ID NO: 161667 - DNA, 103 bp, Artificial Sequence
  Synthetic Polynucleotide
taatacgactcactataggggacctggggctggtgcattttcggttgttgaacagaggagacaacaaatgaaaatgcacaacctggcggcagcgcaaaagatg

SEQ ID NO: 161668 - DNA, 103 bp, Artificial Sequence
  Synthetic Polynucleotide
taatacgactcactatagggggtgtccgaggacctggggctggtgcatttaacagaggagaaaatgcatgagccccaggaacctggcggcagcgcaaaagatg

SEQ ID NO: 161669 - DNA, 103 bp, Artificial Sequence
  Synthetic Polynucleotide
taatacgactcactatagggcattctcctcggtgtccgaggacctggggcaacagaggagagccccaatgcctcggacaaacctggcggcagcgcaaaagatg

SEQ ID NO: 161670 - DNA, 103 bp, Artificial Sequence
  Synthetic Polynucleotide
taatacgactcactatagggcgcctcttgacattctcctcggtgtccgagaacagaggagactcggaatgcgaggagaaaacctggcggcagcgcaaaagatg

SEQ ID NO: 161671 - DNA, 103 bp, Artificial Sequence
  Synthetic Polynucleotide
taatacgactcactataggggttgtgtgttcgcctcttgacattctcctcaacagaggagagaggagatggtcaagaggaacctggcggcagcgcaaaagatg

SEQ ID NO: 161672 - DNA, 103 bp, Artificial Sequence
  Synthetic Polynucleotide
taatacgactcactataggggctccaagacgttgtgtgttcgcctcttgaaacagaggagatcaagaatggaacacacaaacctggcggcagcgcaaaagatg

SEQ ID NO: 161673 - DNA, 103 bp, Artificial Sequence
  Synthetic Polynucleotide
taatacgactcactatagggctcctctggcgctccaagacgttgtgtgttaacagaggagaaacacaatgcgtcttggaaacctggcggcagcgcaaaagatg

SEQ ID NO: 161674 - DNA, 103 bp, Artificial Sequence
  Synthetic Polynucleotide
taatacgactcactatagggtagctcgttcctcctctggcgctccaagacaacagaggagagtcttgatgcgccagaggaacctggcggcagcgcaaaagatg

SEQ ID NO: 161675 - DNA, 103 bp, Artificial Sequence
  Synthetic Polynucleotide
taatacgactcactatagggccgggggctgcagctcgctctgctgctgctaacagaggagaagcagcatgagagcgagcaacctggcggcagcgcaaaagatg

SEQ ID NO: 161676 - DNA, 103 bp, Artificial Sequence
  Synthetic Polynucleotide
taatacgactcactatagggagctccgttttagctcgttcctcctctggcaacagaggagagccagaatgggaacgagcaacctggcggcagcgcaaaagatg

SEQ ID NO: 161677 - DNA, 103 bp, Artificial Sequence
  Synthetic Polynucleotide
taatacgactcactatagggagggcaaaaaagctccgttttagctcgttcaacagaggagagaacgaatgaaaacggagaacctggcggcagcgcaaaagatg

SEQ ID NO: 161678 - DNA, 103 bp, Artificial Sequence
  Synthetic Polynucleotide
taatacgactcactatagggctggtcacgcagggcaaaaaagctccgtttaacagaggagaaaacggatgttttttgccaacctggcggcagcgcaaaagatg

SEQ ID NO: 161679 - DNA, 103 bp, Artificial Sequence
  Synthetic Polynucleotide
taatacgactcactatagggactccgggatctggtcacgcagggcaaaaaaacagaggagatttttgatgtgcgtgaccaacctggcggcagcgcaaaagatg

SEQ ID NO: 161680 - DNA, 103 bp, Artificial Sequence
  Synthetic Polynucleotide
taatacgactcactatagggttgttttccaactccgggatctggtcacgcaacagaggagagcgtgaatggatcccggaaacctggcggcagcgcaaaagatg

SEQ ID NO: 161681 - DNA, 103 bp, Artificial Sequence
  Synthetic Polynucleotide
taatacgactcactatagggggccttttcattgttttccaactccgggataacagaggagaatcccgatgttggaaaacaacctggcggcagcgcaaaagatg

SEQ ID NO: 161682 - DNA, 103 bp, Artificial Sequence
  Synthetic Polynucleotide
taatacgactcactatagggctaccttgggggccttttcattgttttccaaacagaggagatggaaaatgatgaaaaggaacctggcggcagcgcaaaagatg

SEQ ID NO: 161683 - DNA, 103 bp, Artificial Sequence
  Synthetic Polynucleotide
taatacgactcactatagggttaaggataactaccttgggggccttttcaaacagaggagatgaaaaatgccccaaggtaacctggcggcagcgcaaaagatg

SEQ ID NO: 161684 - DNA, 103 bp, Artificial Sequence
  Synthetic Polynucleotide
taatacgactcactatagggtgtggcttttttaaggataactaccttgggaacagaggagacccaagatggttatccttaacctggcggcagcgcaaaagatg

SEQ ID NO: 161685 - DNA, 103 bp, Artificial Sequence
  Synthetic Polynucleotide
taatacgactcactatagggggatgtatgctgtggcttttttaaggataaaacagaggagattatccatgaaaaagccaaacctggcggcagcgcaaaagatg

SEQ ID NO: 161686 - DNA, 103 bp, Artificial Sequence
  Synthetic Polynucleotide
taatacgactcactatagggtcgctgggcgccgggggctgcagctcgctcaacagaggagagagcgaatggcagcccccaacctggcggcagcgcaaaagatg

SEQ ID NO: 161687 - DNA, 103 bp, Artificial Sequence
  Synthetic Polynucleotide
taatacgactcactatagggtggacggacaggatgtatgctgtggcttttaacagaggagaaaaagcatgagcatacataacctggcggcagcgcaaaagatg

SEQ ID NO: 161688 - DNA, 103 bp, Artificial Sequence
  Synthetic Polynucleotide
taatacgactcactatagggctcctctgcttggacggacaggatgtatgcaacagaggagagcatacatgctgtccgtcaacctggcggcagcgcaaaagatg

SEQ ID NO: 161689 - DNA, 103 bp, Artificial Sequence
  Synthetic Polynucleotide
taatacgactcactatagggtgagcttttgctcctctgcttggacggacaaacagaggagatgtccgatgaagcagaggaacctggcggcagcgcaaaagatg

SEQ ID NO: 161690 - DNA, 103 bp, Artificial Sequence
  Synthetic Polynucleotide
taatacgactcactatagggtcttcagaaatgagcttttgctcctctgctaacagaggagaagcagaatggcaaaagctaacctggcggcagcgcaaaagatg

SEQ ID NO: 161691 - DNA, 103 bp, Artificial Sequence
  Synthetic Polynucleotide
taatacgactcactatagggcaacaagtcctcttcagaaatgagcttttgaacagaggagacaaaagatgatttctgaaaacctggcggcagcgcaaaagatg

SEQ ID NO: 161692 - DNA, 103 bp, Artificial Sequence
  Synthetic Polynucleotide
taatacgactcactataggggtcgtttccgcaacaagtcctcttcagaaaaacagaggagatttctgatgaggacttgtaacctggcggcagcgcaaaagatg

SEQ ID NO: 161693 - DNA, 103 bp, Artificial Sequence
  Synthetic Polynucleotide
taatacgactcactatagggaactgttctcgtcgtttccgcaacaagtccaacagaggagaggacttatggcggaaacgaacctggcggcagcgcaaaagatg

SEQ ID NO: 161694 - DNA, 103 bp, Artificial Sequence
  Synthetic Polynucleotide
taatacgactcactatagggtttgtgtttcaactgttctcgtcgtttccgaacagaggagacggaaaatgcgagaacagaacctggcggcagcgcaaaagatg

SEQ ID NO: 161695 - DNA, 103 bp, Artificial Sequence
  Synthetic Polynucleotide
taatacgactcactataggggctgttcaagtttgtgtttcaactgttctcaacagaggagagagaacatgtgaaacacaaacctggcggcagcgcaaaagatg

SEQ ID NO: 161696 - DNA, 103 bp, Artificial Sequence
  Synthetic Polynucleotide
taatacgactcactataggggagttccgtagctgttcaagtttgtgtttcaacagaggagagaaacaatgacttgaacaaacctggcggcagcgcaaaagatg

SEQ ID NO: 161697 - DNA, 103 bp, Artificial Sequence
  Synthetic Polynucleotide
taatacgactcactatagggccagatatcctcgctgggcgccgggggctgaacagaggagacagcccatggcgcccagcaacctggcggcagcgcaaaagatg

SEQ ID NO: 161698 - DNA, 103 bp, Artificial Sequence
  Synthetic Polynucleotide
taatacgactcactatagggttacgcacaagagttccgtagctgttcaagaacagaggagacttgaaatgctacggaacaacctggcggcagcgcaaaagatg

SEQ ID NO: 161699 - DNA, 103 bp, Artificial Sequence
  Synthetic Polynucleotide
taatacgactcactatagggcgaatttcttccagatatcctcgctgggcgaacagaggagacgcccaatgaggatatctaacctggcggcagcgcaaaagatg

SEQ ID NO: 161700 - DNA, 103 bp, Artificial Sequence
  Synthetic Polynucleotide
taatacgactcactatagggggcagcagctcgaatttcttccagatatccaacagaggagaggatatatggaagaaattaacctggcggcagcgcaaaagatg

SEQ ID NO: 161701 - DNA, 103 bp, Artificial Sequence
  Synthetic Polynucleotide
taatacgactcactataggggggcggggtgggcagcagctcgaatttcttaacagaggagaaagaaaatggagctgctgaacctggcggcagcgcaaaagatg

SEQ ID NO: 161702 - DNA, 103 bp, Artificial Sequence
  Synthetic Polynucleotide
taatacgactcactatagggtaggggacaggggcggggtgggcagcagctaacagaggagaagctgcatgccaccccgcaacctggcggcagcgcaaaagatg

SEQ ID NO: 161703 - DNA, 103 bp, Artificial Sequence
  Synthetic Polynucleotide
taatacgactcactataggggagcggcggctaggggacaggggcggggtgaacagaggagacaccccatgcctgtccccaacctggcggcagcgcaaaagatg

SEQ ID NO: 161704 - DNA, 103 bp, Artificial Sequence
  Synthetic Polynucleotide
taatacgactcactataggggcagagcccggagcggcggctaggggacagaacagaggagactgtccatgagccgccgcaacctggcggcagcgcaaaagatg

SEQ ID NO: 161705 - DNA, 103 bp, Artificial Sequence
  Synthetic Polynucleotide
taatacgactcactatagggggtcatagttcctgttggtgaagctaacgtaacagaggagaacgttaatgtcaccaacaaacctggcggcagcgcaaaagatg

SEQ ID NO: 161706 - DNA, 103 bp, Artificial Sequence
  Synthetic Polynucleotide
taatacgactcactatagggaggagggcgagcagagcccggagcggcggcaacagaggagagccgccatgccgggctctaacctggcggcagcgcaaaagatg

SEQ ID NO: 161707 - DNA, 103 bp, Artificial Sequence
  Synthetic Polynucleotide
taatacgactcactatagggaccgcaacgtaggagggcgagcagagcccgaacagaggagacgggctatgctcgccctcaacctggcggcagcgcaaaagatg

SEQ ID NO: 161708 - DNA, 103 bp, Artificial Sequence
  Synthetic Polynucleotide
taatacgactcactataggggaagggtgtgaccgcaacgtaggagggcgaaacagaggagatcgcccatgtacgttgcgaacctggcggcagcgcaaaagatg

SEQ ID NO: 161709 - DNA, 103 bp, Artificial Sequence
  Synthetic Polynucleotide
taatacgactcactatagggcccgaagggagaagggtgtgaccgcaacgtaacagaggagaacgttgatgtcacaccctaacctggcggcagcgcaaaagatg

SEQ ID NO: 161710 - DNA, 103 bp, Artificial Sequence
  Synthetic Polynucleotide
taatacgactcactatagggtcgttgtctccccgaagggagaagggtgtgaacagaggagacacaccatgctcccttcgaacctggcggcagcgcaaaagatg

SEQ ID NO: 161711 - DNA, 103 bp, Artificial Sequence
  Synthetic Polynucleotide
taatacgactcactataggggccaccgccgtcgttgtctccccgaagggaaacagaggagatcccttatgggagacaacaacctggcggcagcgcaaaagatg

SEQ ID NO: 161712 - DNA, 103 bp, Artificial Sequence
  Synthetic Polynucleotide
taatacgactcactatagggagaagctcccgccaccgccgtcgttgtctcaacagaggagagagacaatgacggcggtgaacctggcggcagcgcaaaagatg

SEQ ID NO: 161713 - DNA, 103 bp, Artificial Sequence
  Synthetic Polynucleotide
taatacgactcactatagggtcggccgtggagaagctcccgccaccgccgaacagaggagacggcggatgcgggagcttaacctggcggcagcgcaaaagatg

SEQ ID NO: 161714 - DNA, 103 bp, Artificial Sequence
  Synthetic Polynucleotide
taatacgactcactatagggctccagctggtcggccgtggagaagctcccaacagaggagagggagcatgtccacggccaacctggcggcagcgcaaaagatg

SEQ ID NO: 161715 - DNA, 103 bp, Artificial Sequence
  Synthetic Polynucleotide
taatacgactcactatagggcggtcaccatctccagctggtcggccgtggaacagaggagaccacggatgaccagctggaacctggcggcagcgcaaaagatg

SEQ ID NO: 161716 - DNA, 103 bp, Artificial Sequence
  Synthetic Polynucleotide
taatacgactcactatagggtcgtagtcgaggtcatagttcctgttggtgaacagaggagacaccaaatggaactatgaaacctggcggcagcgcaaaagatg

SEQ ID NO: 161717 - DNA, 103 bp, Artificial Sequence
  Synthetic Polynucleotide
taatacgactcactatagggcccagcagctcggtcaccatctccagctggaacagaggagaccagctatggatggtgacaacctggcggcagcgcaaaagatg

SEQ ID NO: 161718 - DNA, 103 bp, Artificial Sequence
  Synthetic Polynucleotide
taatacgactcactatagggcatgtctcctcccagcagctcggtcaccataacagaggagaatggtgatggagctgctgaacctggcggcagcgcaaaagatg

SEQ ID NO: 161719 - DNA, 103 bp, Artificial Sequence
  Synthetic Polynucleotide
taatacgactcactatagggtctggttcaccatgtctcctcccagcagctaacagaggagaagctgcatggaggagacaaacctggcggcagcgcaaaagatg

SEQ ID NO: 161720 - DNA, 103 bp, Artificial Sequence
  Synthetic Polynucleotide
taatacgactcactatagggcagatgaaactctggttcaccatgtctcctaacagaggagaaggagaatgggtgaaccaaacctggcggcagcgcaaaagatg

SEQ ID NO: 161721 - DNA, 103 bp, Artificial Sequence
  Synthetic Polynucleotide
taatacgactcactataggggtccgggtcgcagatgaaactctggttcacaacagaggagagtgaacatgagtttcatcaacctggcggcagcgcaaaagatg

SEQ ID NO: 161722 - DNA, 103 bp, Artificial Sequence
  Synthetic Polynucleotide
taatacgactcactatagggaggtctcgtcgtccgggtcgcagatgaaacaacagaggagagtttcaatggcgacccggaacctggcggcagcgcaaaagatg

SEQ ID NO: 161723 - DNA, 103 bp, Artificial Sequence
  Synthetic Polynucleotide
taatacgactcactatagggtttttgatgaaggtctcgtcgtccgggtcgaacagaggagacgacccatgcgacgagacaacctggcggcagcgcaaaagatg

SEQ ID NO: 161724 - DNA, 103 bp, Artificial Sequence
  Synthetic Polynucleotide
taatacgactcactataggggatgatgatgtttttgatgaaggtctcgtcaacagaggagagacgagatgttcatcaaaaacctggcggcagcgcaaaagatg

SEQ ID NO: 161725 - DNA, 103 bp, Artificial Sequence
  Synthetic Polynucleotide
taatacgactcactatagggtacagtcctggatgatgatgtttttgatgaaacagaggagatcatcaatgacatcatcaaacctggcggcagcgcaaaagatg

SEQ ID NO: 161726 - DNA, 103 bp, Artificial Sequence
  Synthetic Polynucleotide
taatacgactcactatagggccgctccacatacagtcctggatgatgatgaacagaggagacatcatatgccaggactgaacctggcggcagcgcaaaagatg

SEQ ID NO: 161727 - DNA, 103 bp, Artificial Sequence
  Synthetic Polynucleotide
taatacgactcactatagggctgcaccgagtcgtagtcgaggtcatagttaacagaggagaaactatatgctcgactacaacctggcggcagcgcaaaagatg

SEQ ID NO: 161728 - DNA, 103 bp, Artificial Sequence
  Synthetic Polynucleotide
taatacgactcactatagggggccgagaagccgctccacatacagtcctgaacagaggagacaggacatgatgtggagcaacctggcggcagcgcaaaagatg

SEQ ID NO: 161729 - DNA, 103 bp, Artificial Sequence
  Synthetic Polynucleotide
taatacgactcactataggggcttggcggcggccgagaagccgctccacaaacagaggagatgtggaatggcttctcggaacctggcggcagcgcaaaagatg

SEQ ID NO: 161730 - DNA, 103 bp, Artificial Sequence
  Synthetic Polynucleotide
taatacgactcactatagggtctgagacgagcttggcggcggccgagaagaacagaggagacttctcatgcgccgccaaaacctggcggcagcgcaaaagatg

SEQ ID NO: 161731 - DNA, 103 bp, Artificial Sequence
  Synthetic Polynucleotide
taatacgactcactatagggggccagcttctctgagacgagcttggcggcaacagaggagagccgccatgctcgtctcaaacctggcggcagcgcaaaagatg

SEQ ID NO: 161732 - DNA, 103 bp, Artificial Sequence
  Synthetic Polynucleotide
taatacgactcactatagggcctggtaggaggccagcttctctgagacgaaacagaggagatcgtctatgagaagctggaacctggcggcagcgcaaaagatg

SEQ ID NO: 161733 - DNA, 103 bp, Artificial Sequence
  Synthetic Polynucleotide
taatacgactcactatagggttgcgcgcagcctggtaggaggccagcttcaacagaggagagaagctatgctcctaccaaacctggcggcagcgcaaaagatg

SEQ ID NO: 161734 - DNA, 103 bp, Artificial Sequence
  Synthetic Polynucleotide
taatacgactcactataggggccgctgtctttgcgcgcagcctggtaggaaacagaggagatcctacatggctgcgcgcaacctggcggcagcgcaaaagatg

SEQ ID NO: 161735 - DNA, 103 bp, Artificial Sequence
  Synthetic Polynucleotide
taatacgactcactatagggggttcgggctgccgctgtctttgcgcgcagaacagaggagactgcgcatgaagacagcgaacctggcggcagcgcaaaagatg

SEQ ID NO: 161736 - DNA, 103 bp, Artificial Sequence
  Synthetic Polynucleotide
taatacgactcactatagggccgcgggcggggttcgggctgccgctgtctaacagaggagaagacagatgcagcccgaaaacctggcggcagcgcaaaagatg

SEQ ID NO: 161737 - DNA, 103 bp, Artificial Sequence
  Synthetic Polynucleotide
taatacgactcactataggggacgctgtggccgcgggcggggttcgggctaacagaggagaagcccgatgcccgcccgcaacctggcggcagcgcaaaagatg

SEQ ID NO: 161738 - DNA, 103 bp, Artificial Sequence
  Synthetic Polynucleotide
taatacgactcactatagggagaaatacggctgcaccgagtcgtagtcgaaacagaggagatcgactatgactcggtgcaacctggcggcagcgcaaaagatg

SEQ ID NO: 161739 - DNA, 103 bp, Artificial Sequence
  Synthetic Polynucleotide
taatacgactcactatagggaggtggagcagacgctgtggccgcgggcggaacagaggagaccgcccatggccacagcgaacctggcggcagcgcaaaagatg

SEQ ID NO: 161740 - DNA, 103 bp, Artificial Sequence
  Synthetic Polynucleotide
taatacgactcactatagggtacaagctggaggtggagcagacgctgtggaacagaggagaccacagatgctgctccacaacctggcggcagcgcaaaagatg

SEQ ID NO: 161741 - DNA, 103 bp, Artificial Sequence
  Synthetic Polynucleotide
taatacgactcactatagggatcctgcaggtacaagctggaggtggagcaaacagaggagatgctccatgtccagcttgaacctggcggcagcgcaaaagatg

SEQ ID NO: 161742 - DNA, 103 bp, Artificial Sequence
  Synthetic Polynucleotide
taatacgactcactatagggcggcgctcagatcctgcaggtacaagctggaacagaggagaccagctatgacctgcaggaacctggcggcagcgcaaaagatg

SEQ ID NO: 161743 - DNA, 103 bp, Artificial Sequence
  Synthetic Polynucleotide
taatacgactcactatagggtctgaggcggcggcgctcagatcctgcaggaacagaggagacctgcaatgtctgagcgcaacctggcggcagcgcaaaagatg

SEQ ID NO: 161744 - DNA, 103 bp, Artificial Sequence
  Synthetic Polynucleotide
taatacgactcactataggggtcgatgcactctgaggcggcggcgctcagaacagaggagactgagcatggccgcctcaaacctggcggcagcgcaaaagatg

SEQ ID NO: 161745 - DNA, 103 bp, Artificial Sequence
  Synthetic Polynucleotide
taatacgactcactatagggccaccgaggggtcgatgcactctgaggcggaacagaggagaccgcctatgagtgcatcgaacctggcggcagcgcaaaagatg

SEQ ID NO: 161746 - DNA, 103 bp, Artificial Sequence
  Synthetic Polynucleotide
taatacgactcactatagggtaggggaagaccaccgaggggtcgatgcacaacagaggagagtgcatatgcccctcggtaacctggcggcagcgcaaaagatg

SEQ ID NO: 161747 - DNA, 103 bp, Artificial Sequence
  Synthetic Polynucleotide
taatacgactcactataggggttgagagggtaggggaagaccaccgagggaacagaggagaccctcgatggtcttccccaacctggcggcagcgcaaaagatg

SEQ ID NO: 161748 - DNA, 103 bp, Artificial Sequence
  Synthetic Polynucleotide
taatacgactcactatagggagctgctgtcgttgagagggtaggggaagaaacagaggagatcttccatgaccctctcaaacctggcggcagcgcaaaagatg

SEQ ID NO: 161749 - DNA, 103 bp, Artificial Sequence
  Synthetic Polynucleotide
taatacgactcactatagggtcgtcgcagtagaaatacggctgcaccgagaacagaggagactcggtatggccgtatttaacctggcggcagcgcaaaagatg

SEQ ID NO: 161750 - DNA, 103 bp, Artificial Sequence
  Synthetic Polynucleotide
taatacgactcactataggggacttgggcgagctgctgtcgttgagagggaacagaggagaccctctatgcgacagcagaacctggcggcagcgcaaaagatg

SEQ ID NO: 161751 - DNA, 103 bp, Artificial Sequence
  Synthetic Polynucleotide
taatacgactcactatagggcgaggcgcaggacttgggcgagctgctgtcaacagaggagagacagcatgtcgcccaagaacctggcggcagcgcaaaagatg

SEQ ID NO: 161752 - DNA, 103 bp, Artificial Sequence
  Synthetic Polynucleotide
taatacgactcactatagggtggagtcttgcgaggcgcaggacttgggcgaacagaggagacgcccaatgcctgcgcctaacctggcggcagcgcaaaagatg

SEQ ID NO: 161753 - DNA, 103 bp, Artificial Sequence
  Synthetic Polynucleotide
taatacgactcactataggggagaaggcgctggagtcttgcgaggcgcagaacagaggagactgcgcatggcaagactcaacctggcggcagcgcaaaagatg

SEQ ID NO: 161754 - DNA, 103 bp, Artificial Sequence
  Synthetic Polynucleotide
taatacgactcactatagggcgaggacggagagaaggcgctggagtcttgaacagaggagacaagacatgagcgccttcaacctggcggcagcgcaaaagatg

SEQ ID NO: 161755 - DNA, 103 bp, Artificial Sequence
  Synthetic Polynucleotide
taatacgactcactataggggcagagaatccgaggacggagagaaggcgcaacagaggagagcgcctatgctccgtcctaacctggcggcagcgcaaaagatg

SEQ ID NO: 161756 - DNA, 103 bp, Artificial Sequence
  Synthetic Polynucleotide
taatacgactcactataggggtcgaggagagcagagaatccgaggacggaaacagaggagatccgtcatgggattctctaacctggcggcagcgcaaaagatg

SEQ ID NO: 161757 - DNA, 103 bp, Artificial Sequence
  Synthetic Polynucleotide
taatacgactcactatagggggaggactccgtcgaggagagcagagaatcaacagaggagagattctatgctctcctcgaacctggcggcagcgcaaaagatg

SEQ ID NO: 161758 - DNA, 103 bp, Artificial Sequence
  Synthetic Polynucleotide
taatacgactcactatagggtgccctgcggggaggactccgtcgaggagaaacagaggagatctcctatgcggagtcctaacctggcggcagcgcaaaagatg

SEQ ID NO: 161759 - DNA, 103 bp, Artificial Sequence
  Synthetic Polynucleotide
taatacgactcactatagggggctcggggctgccctgcggggaggactccaacagaggagaggagtcatgcccgcagggaacctggcggcagcgcaaaagatg

SEQ ID NO: 161760 - DNA, 103 bp, Artificial Sequence
  Synthetic Polynucleotide
taatacgactcactataggggttctcctcctcgtcgcagtagaaatacggaacagaggagaccgtatatgtactgcgacaacctggcggcagcgcaaaagatg

SEQ ID NO: 161761 - DNA, 103 bp, Artificial Sequence
  Synthetic Polynucleotide
taatacgactcactataggggagcaccaggggctcggggctgccctgcggaacagaggagaccgcagatgagccccgagaacctggcggcagcgcaaaagatg

SEQ ID NO: 161762 - DNA, 103 bp, Artificial Sequence
  Synthetic Polynucleotide
taatacgactcactatagggtctcctcatggagcaccaggggctcggggcaacagaggagagccccgatgccctggtgcaacctggcggcagcgcaaaagatg

SEQ ID NO: 161763 - DNA, 103 bp, Artificial Sequence
  Synthetic Polynucleotide
taatacgactcactataggggtgggcggtgtctcctcatggagcaccaggaacagaggagacctggtatgccatgaggaaacctggcggcagcgcaaaagatg

SEQ ID NO: 161764 - DNA, 103 bp, Artificial Sequence
  Synthetic Polynucleotide
taatacgactcactataggggctgctggtggtgggcggtgtctcctcatgaacagaggagacatgagatgacaccgcccaacctggcggcagcgcaaaagatg

SEQ ID NO: 161765 - DNA, 103 bp, Artificial Sequence
  Synthetic Polynucleotide
taatacgactcactatagggcctcagagtcgctgctggtggtgggcggtgaacagaggagacaccgcatgccaccagcaaacctggcggcagcgcaaaagatg

SEQ ID NO: 161766 - DNA, 103 bp, Artificial Sequence
  Synthetic Polynucleotide
taatacgactcactatagggtcttgttcctcctcagagtcgctgctggtgaacagaggagacaccagatgcgactctgaaacctggcggcagcgcaaaagatg

SEQ ID NO: 161767 - DNA, 103 bp, Artificial Sequence
  Synthetic Polynucleotide
taatacgactcactatagggttcctcatcttcttgttcctcctcagagtcaacagaggagagactctatggaggaacaaaacctggcggcagcgcaaaagatg

SEQ ID NO: 161768 - DNA, 103 bp, Artificial Sequence
  Synthetic Polynucleotide
taatacgactcactatagggcatcgatttcttcctcatcttcttgttcctaacagaggagaaggaacatgaagatgaggaacctggcggcagcgcaaaagatg

SEQ ID NO: 161769 - DNA, 103 bp, Artificial Sequence
  Synthetic Polynucleotide
taatacgactcactatagggacagaaacaacatcgatttcttcctcatctaacagaggagaagatgaatgagaaatcgaaacctggcggcagcgcaaaagatg

SEQ ID NO: 161770 - DNA, 103 bp, Artificial Sequence
  Synthetic Polynucleotide
taatacgactcactatagggcctcttttccacagaaacaacatcgatttcaacagaggagagaaatcatggttgtttctaacctggcggcagcgcaaaagatg

SEQ ID NO: 161771 - DNA, 103 bp, Artificial Sequence
  Synthetic Polynucleotide
taatacgactcactataggggctggtagaagttctcctcctcgtcgcagtaacagaggagaactgcgatgaggaggagaaacctggcggcagcgcaaaagatg

SEQ ID NO: 161772 - DNA, 103 bp, Artificial Sequence
  Synthetic Polynucleotide
taatacgactcactatagggcaggagcctgcctcttttccacagaaacaaaacagaggagattgtttatgtggaaaagaaacctggcggcagcgcaaaagatg

SEQ ID NO: 161773 - DNA, 103 bp, Artificial Sequence
  Synthetic Polynucleotide
taatacgactcactataggggaccttttgccaggagcctgcctcttttccaacagaggagaggaaaaatggcaggctccaacctggcggcagcgcaaaagatg

SEQ ID NO: 161774 - DNA, 103 bp, Artificial Sequence
  Synthetic Polynucleotide
taatacgactcactatagggtccagactctgaccttttgccaggagcctgaacagaggagacaggctatgggcaaaaggaacctggcggcagcgcaaaagatg

SEQ ID NO: 161775 - DNA, 103 bp, Artificial Sequence
  Synthetic Polynucleotide
taatacgactcactatagggcagaaggtgatccagactctgaccttttgcaacagaggagagcaaaaatgcagagtctgaacctggcggcagcgcaaaagatg

SEQ ID NO: 161776 - DNA, 103 bp, Artificial Sequence
  Synthetic Polynucleotide
taatacgactcactatagggtggcctccagcagaaggtgatccagactctaacagaggagaagagtcatgatcaccttcaacctggcggcagcgcaaaagatg

SEQ ID NO: 161777 - DNA, 103 bp, Artificial Sequence
  Synthetic Polynucleotide
taatacgactcactatagggaggtttgctgtggcctccagcagaaggtgaaacagaggagatcacctatggctggaggcaacctggcggcagcgcaaaagatg

SEQ ID NO: 161778 - DNA, 103 bp, Artificial Sequence
  Synthetic Polynucleotide
taatacgactcactatagggggctgtgaggaggtttgctgtggcctccagaacagaggagactggagatgacagcaaacaacctggcggcagcgcaaaagatg

SEQ ID NO: 161779 - DNA, 103 bp, Artificial Sequence
  Synthetic Polynucleotide
taatacgactcactatagggaggaccagtgggctgtgaggaggtttgctgaacagaggagacagcaaatgtcctcacagaacctggcggcagcgcaaaagatg

SEQ ID NO: 161780 - DNA, 103 bp, Artificial Sequence
  Synthetic Polynucleotide
taatacgactcactataggggcacctcttgaggaccagtgggctgtgaggaacagaggagacctcacatgccactggtcaacctggcggcagcgcaaaagatg

SEQ ID NO: 161781 - DNA, 103 bp, Artificial Sequence
  Synthetic Polynucleotide
taatacgactcactatagggtggagacgtggcacctcttgaggaccagtgaacagaggagacactggatgtcaagaggtaacctggcggcagcgcaaaagatg

SEQ ID NO: 161782 - DNA, 103 bp, Artificial Sequence
  Synthetic Polynucleotide
taatacgactcactatagggtgctgctgctgctggtagaagttctcctccaacagaggagaggaggaatgcttctaccaaacctggcggcagcgcaaaagatg

SEQ ID NO: 161783 - DNA, 103 bp, Artificial Sequence
  Synthetic Polynucleotide
taatacgactcactatagggtgctgatgtgtggagacgtggcacctcttgaacagaggagacaagagatgccacgtctcaacctggcggcagcgcaaaagatg

SEQ ID NO: 161784 - DNA, 103 bp, Artificial Sequence
  Synthetic Polynucleotide
taatacgactcactatagggtgcgtagttgtgctgatgtgtggagacgtgaacagaggagacacgtcatgacacatcagaacctggcggcagcgcaaaagatg

SEQ ID NO: 161785 - DNA, 103 bp, Artificial Sequence
  Synthetic Polynucleotide
taatacgactcactatagggagggaggcgctgcgtagttgtgctgatgtgaacagaggagacacatcatgacaactacgaacctggcggcagcgcaaaagatg

SEQ ID NO: 161786 - DNA, 103 bp, Artificial Sequence
  Synthetic Polynucleotide
taatacgactcactatagggttccgagtggagggaggcgctgcgtagttgaacagaggagacaactaatgagcgcctccaacctggcggcagcgcaaaagatg

SEQ ID NO: 161787 - DNA, 103 bp, Artificial Sequence
  Synthetic Polynucleotide
taatacgactcactatagggaggatagtccttccgagtggagggaggcgcaacagaggagagcgcctatgtccactcggaacctggcggcagcgcaaaagatg

SEQ ID NO: 161788 - DNA, 103 bp, Artificial Sequence
  Synthetic Polynucleotide
taatacgactcactatagggtcttggcagcaggatagtccttccgagtggaacagaggagaccactcatgaggactatcaacctggcggcagcgcaaaagatg

SEQ ID NO: 161789 - DNA, 103 bp, Artificial Sequence
  Synthetic Polynucleotide
taatacgactcactatagggaacttgaccctcttggcagcaggatagtccaacagaggagaggactaatgtgctgccaaaacctggcggcagcgcaaaagatg

SEQ ID NO: 161790 - DNA, 103 bp, Artificial Sequence
  Synthetic Polynucleotide
taatacgactcactataggggacactgtccaacttgaccctcttggcagcaacagaggagagctgccatgagggtcaagaacctggcggcagcgcaaaagatg

SEQ ID NO: 161791 - DNA, 103 bp, Artificial Sequence
  Synthetic Polynucleotide
taatacgactcactatagggtcaggactctgacactgtccaacttgacccaacagaggagagggtcaatgtggacagtgaacctggcggcagcgcaaaagatg

SEQ ID NO: 161792 - DNA, 103 bp, Artificial Sequence
  Synthetic Polynucleotide
taatacgactcactatagggctgatctgtctcaggactctgacactgtccaacagaggagaggacagatgcagagtcctaacctggcggcagcgcaaaagatg

SEQ ID NO: 161793 - DNA, 103 bp, Artificial Sequence
  Synthetic Polynucleotide
taatacgactcactatagggcggcatggtggacgtggagcagctcggcataacagaggagaatgccgatgtgctccacgaacctggcggcagcgcaaaagatg

SEQ ID NO: 161794 - DNA, 103 bp, Artificial Sequence
  Synthetic Polynucleotide
taatacgactcactatagggggggccgccgaagtagaagtcatcttcgtcaacagaggagagacgaaatggacttctacaacctggcggcagcgcaaaagatg

SEQ ID NO: 161795 - DNA, 103 bp, Artificial Sequence
  Synthetic Polynucleotide
taatacgactcactatagggctccacgtagggagagggggcggcatagttaacagaggagaaactatatggccccctctaacctggcggcagcgcaaaagatg

SEQ ID NO: 161796 - DNA, 103 bp, Artificial Sequence
  Synthetic Polynucleotide
taatacgactcactatagggcatcctcactctccacgtagggagagggggaacagaggagaccccctatgcctacgtggaacctggcggcagcgcaaaagatg

SEQ ID NO: 161797 - DNA, 103 bp, Artificial Sequence
  Synthetic Polynucleotide
taatacgactcactatagggtgtgggggtgcatcctcactctccacgtagaacagaggagactacgtatggagtgaggaaacctggcggcagcgcaaaagatg

SEQ ID NO: 161798 - DNA, 103 bp, Artificial Sequence
  Synthetic Polynucleotide
taatacgactcactatagggtatcttcttctgtgggggtgcatcctcactaacagaggagaagtgagatggcacccccaaacctggcggcagcgcaaaagatg

SEQ ID NO: 161799 - DNA, 103 bp, Artificial Sequence
  Synthetic Polynucleotide
taatacgactcactatagggcctcgctctttatcttcttctgtgggggtgaacagaggagacaccccatgagaagaagaaacctggcggcagcgcaaaagatg

SEQ ID NO: 161800 - DNA, 103 bp, Artificial Sequence
  Synthetic Polynucleotide
taatacgactcactatagggcgtggggacgcctcgctctttatcttcttcaacagaggagagaagaaatgaaagagcgaaacctggcggcagcgcaaaagatg

SEQ ID NO: 161801 - DNA, 103 bp, Artificial Sequence
  Synthetic Polynucleotide
taatacgactcactatagggcttgagcggacgtggggacgcctcgctcttaacagaggagaaagagcatggcgtccccaaacctggcggcagcgcaaaagatg

SEQ ID NO: 161802 - DNA, 103 bp, Artificial Sequence
  Synthetic Polynucleotide
taatacgactcactatagggggatgacactcttgagcggacgtggggacgaacagaggagacgtcccatggtccgctcaaacctggcggcagcgcaaaagatg

SEQ ID NO: 161803 - DNA, 103 bp, Artificial Sequence
  Synthetic Polynucleotide
taatacgactcactataggggcctttggggggatgacactcttgagcggaaacagaggagatccgctatggagtgtcataacctggcggcagcgcaaaagatg

SEQ ID NO: 161804 - DNA, 103 bp, Artificial Sequence
  Synthetic Polynucleotide
taatacgactcactatagggcaagctcttagcctttggggggatgacactaacagaggagaagtgtcatgcccccaaagaacctggcggcagcgcaaaagatg

SEQ ID NO: 161805 - DNA, 103 bp, Artificial Sequence
  Synthetic Polynucleotide
taatacgactcactataggggggtcgagtcggggccgccgaagtagaagtaacagaggagaacttctatgtcggcggccaacctggcggcagcgcaaaagatg

SEQ ID NO: 161806 - DNA, 103 bp, Artificial Sequence
  Synthetic Polynucleotide
taatacgactcactatagggttcgggggctcaagctcttagcctttggggaacagaggagaccccaaatgctaagagctaacctggcggcagcgcaaaagatg

SEQ ID NO: 161807 - DNA, 103 bp, Artificial Sequence
  Synthetic Polynucleotide
taatacgactcactataggggagtcagagtttcgggggctcaagctcttaaacagaggagataagagatggagcccccgaacctggcggcagcgcaaaagatg

SEQ ID NO: 161808 - DNA, 103 bp, Artificial Sequence
  Synthetic Polynucleotide
taatacgactcactatagggactgtcctccgagtcagagtttcgggggctaacagaggagaagccccatgaactctgacaacctggcggcagcgcaaaagatg

SEQ ID NO: 161809 - DNA, 103 bp, Artificial Sequence
  Synthetic Polynucleotide
taatacgactcactatagggtgcgacgctcactgtcctccgagtcagagtaacagaggagaactctgatgcggaggacaaacctggcggcagcgcaaaagatg

SEQ ID NO: 161810 - DNA, 103 bp, Artificial Sequence
  Synthetic Polynucleotide
taatacgactcactatagggttgtggtttctgcgacgctcactgtcctccaacagaggagaggaggaatgtgagcgtcgaacctggcggcagcgcaaaagatg

SEQ ID NO: 161811 - DNA, 103 bp, Artificial Sequence
  Synthetic Polynucleotide
taatacgactcactatagggctccaggatgttgtggtttctgcgacgctcaacagaggagagagcgtatgagaaaccacaacctggcggcagcgcaaaagatg

SEQ ID NO: 161812 - DNA, 103 bp, Artificial Sequence
  Synthetic Polynucleotide
taatacgactcactatagggggcgctggcgctccaggatgttgtggtttcaacagaggagagaaaccatgacatcctggaacctggcggcagcgcaaaagatg

SEQ ID NO: 161813 - DNA, 103 bp, Artificial Sequence
  Synthetic Polynucleotide
taatacgactcactatagggaggtcgttgcggcgctggcgctccaggatgaacagaggagacatcctatggcgccagcgaacctggcggcagcgcaaaagatg

SEQ ID NO: 161814 - DNA, 103 bp, Artificial Sequence
  Synthetic Polynucleotide
taatacgactcactataggggctggaccgaaggtcgttgcggcgctggcgaacagaggagacgccagatgcgcaacgacaacctggcggcagcgcaaaagatg

SEQ ID NO: 161815 - DNA, 103 bp, Artificial Sequence
  Synthetic Polynucleotide
taatacgactcactataggggcgtgagaaagctggaccgaaggtcgttgcaacagaggagagcaacgatgttcggtccaaacctggcggcagcgcaaaagatg

SEQ ID NO: 161816 - DNA, 103 bp, Artificial Sequence
  Synthetic Polynucleotide
taatacgactcactatagggtcccccgggggggtcgagtcggggccgccgaacagaggagacggcggatgcgactcgacaacctggcggcagcgcaaaagatg

SEQ ID NO: 161817 - DNA, 103 bp, Artificial Sequence
  Synthetic Polynucleotide
taatacgactcactatagggtggtccctgagcgtgagaaagctggaccgaaacagaggagatcggtcatgctttctcacaacctggcggcagcgcaaaagatg

SEQ ID NO: 161818 - DNA, 103 bp, Artificial Sequence
  Synthetic Polynucleotide
taatacgactcactatagggctccggcacgtggtccctgagcgtgagaaaaacagaggagatttctcatgctcagggacaacctggcggcagcgcaaaagatg

SEQ ID NO: 161819 - DNA, 103 bp, Artificial Sequence
  Synthetic Polynucleotide
taatacgactcactatagggtctttaccaactccggcacgtggtccctgaaacagaggagatcagggatgacgtgccggaacctggcggcagcgcaaaagatg

SEQ ID NO: 161820 - DNA, 103 bp, Artificial Sequence
  Synthetic Polynucleotide
taatacgactcactataggggccttctcattctttaccaactccggcacgaacagaggagacgtgccatggttggtaaaaacctggcggcagcgcaaaagatg

SEQ ID NO: 161821 - DNA, 103 bp, Artificial Sequence
  Synthetic Polynucleotide
taatacgactcactatagggcaccttggcggccttctcattctttaccaaaacagaggagattggtaatgaatgagaagaacctggcggcagcgcaaaagatg

SEQ ID NO: 161822 - DNA, 103 bp, Artificial Sequence
  Synthetic Polynucleotide
taatacgactcactatagggtcaaaatgaccaccttggcggccttctcataacagaggagaatgagaatgccgccaaggaacctggcggcagcgcaaaagatg

SEQ ID NO: 161823 - DNA, 103 bp, Artificial Sequence
  Synthetic Polynucleotide
taatacgactcactataggggtggcctttttcaaaatgaccaccttggcgaacagaggagacgccaaatgggtcattttaacctggcggcagcgcaaaagatg

SEQ ID NO: 161824 - DNA, 103 bp, Artificial Sequence
  Synthetic Polynucleotide
taatacgactcactataggggacatactcagtggcctttttcaaaatgacaacagaggagagtcattatgaaaaaggccaacctggcggcagcgcaaaagatg

SEQ ID NO: 161825 - DNA, 103 bp, Artificial Sequence
  Synthetic Polynucleotide
taatacgactcactatagggggagggagtggacatactcagtggccttttaacagaggagaaaaaggatgctgagtatgaacctggcggcagcgcaaaagatg

SEQ ID NO: 161826 - DNA, 103 bp, Artificial Sequence
  Synthetic Polynucleotide
taatacgactcactatagggtcctcggcctggagggagtggacatactcaaacagaggagatgagtaatgccactccctaacctggcggcagcgcaaaagatg

SEQ ID NO: 161827 - DNA, 103 bp, Artificial Sequence
  Synthetic Polynucleotide
taatacgactcactatagggccagatgtcctcccccgggggggtcgagtcaacagaggagagactcgatgcccccggggaacctggcggcagcgcaaaagatg

SEQ ID NO: 161828 - DNA, 103 bp, Artificial Sequence
  Synthetic Polynucleotide
taatacgactcactatagggaagctggtgctcctcggcctggagggagtgaacagaggagacactccatgcaggccgagaacctggcggcagcgcaaaagatg

SEQ ID NO: 161829 - DNA, 103 bp, Artificial Sequence
  Synthetic Polynucleotide
taatacgactcactatagggtttccagcaaaagctggtgctcctcggcctaacagaggagaaggccgatgagcaccagcaacctggcggcagcgcaaaagatg

SEQ ID NO: 161830 - DNA, 103 bp, Artificial Sequence
  Synthetic Polynucleotide
taatacgactcactatagggaatttttccttttccagcaaaagctggtgcaacagaggagagcaccaatgtttgctggaaacctggcggcagcgcaaaagatg

SEQ ID NO: 161831 - DNA, 103 bp, Artificial Sequence
  Synthetic Polynucleotide
taatacgactcactatagggtcttgcctgcaatttttccttttccagcaaaacagaggagattgctgatgaaggaaaaaaacctggcggcagcgcaaaagatg

SEQ ID NO: 161832 - DNA, 103 bp, Artificial Sequence
  Synthetic Polynucleotide
taatacgactcactatagggactgctgctgtcttgcctgcaatttttcctaacagaggagaaggaaaatgtgcaggcaaaacctggcggcagcgcaaaagatg

SEQ ID NO: 161833 - DNA, 103 bp, Artificial Sequence
  Synthetic Polynucleotide
taatacgactcactatagggttctttagcaactgctgctgtcttgcctgcaacagaggagagcaggcatgacagcagcaaacctggcggcagcgcaaaagatg

SEQ ID NO: 161834 - DNA, 103 bp, Artificial Sequence
  Synthetic Polynucleotide
taatacgactcactataggggtgttcaattttctttagcaactgctgctgaacagaggagacagcagatgttgctaaagaacctggcggcagcgcaaaagatg

SEQ ID NO: 161835 - DNA, 103 bp, Artificial Sequence
  Synthetic Polynucleotide
taatacgactcactatagggaagtccgagcgtgttcaattttctttagcaaacagaggagatgctaaatgaaattgaacaacctggcggcagcgcaaaagatg

SEQ ID NO: 161836 - DNA, 103 bp, Artificial Sequence
  Synthetic Polynucleotide
taatacgactcactatagggcaaacttcttccagatgtcctcccccggggaacagaggagaccccggatgaggacatctaacctggcggcagcgcaaaagatg

SEQ ID NO: 161837 - DNA, 103 bp, Artificial Sequence
  Synthetic Polynucleotide
taatacgactcactatagggggcagcagctcaaacttcttccagatgtccaacagaggagaggacatatggaagaagttaacctggcggcagcgcaaaagatg

SEQ ID NO: 161838 - DNA, 103 bp, Artificial Sequence
  Synthetic Polynucleotide
taatacgactcactatagggcgggggcgtgggcagcagctcaaacttcttaacagaggagaaagaagatggagctgctgaacctggcggcagcgcaaaagatg

SEQ ID NO: 161839 - DNA, 103 bp, Artificial Sequence
  Synthetic Polynucleotide
taatacgactcactatagggtgggcgacagcgggggcgtgggcagcagctaacagaggagaagctgcatgccacgccccaacctggcggcagcgcaaaagatg

SEQ ID NO: 161840 - DNA, 103 bp, Artificial Sequence
  Synthetic Polynucleotide
taatacgactcactatagggaagccacggctgggcgacagcgggggcgtgaacagaggagacacgccatggctgtcgccaacctggcggcagcgcaaaagatg

SEQ ID NO: 161841 - DNA, 103 bp, Artificial Sequence
  Synthetic Polynucleotide
taatacgactcactataggggtgctccgcgaagccacggctgggcgacagaacagaggagactgtcgatgagccgtggcaacctggcggcagcgcaaaagatg

SEQ ID NO: 161842 - DNA, 103 bp, Artificial Sequence
  Synthetic Polynucleotide
taatacgactcactatagggagatcatgcccggcatggtggacgtggagcaacagaggagagctccaatgccaccatgcaacctggcggcagcgcaaaagatg

SEQ ID NO: 161843 - DNA, 103 bp, Artificial Sequence
  Synthetic Polynucleotide
taatacgactcactataggggctcggagctgtgctccgcgaagccacggcaacagaggagagccgtgatgtcgcggagcaacctggcggcagcgcaaaagatg

SEQ ID NO: 161844 - DNA, 103 bp, Artificial Sequence
  Synthetic Polynucleotide
taatacgactcactatagggcagctcgggggctcggagctgtgctccgcgaacagaggagacgcggaatgcagctccgaaacctggcggcagcgcaaaagatg

SEQ ID NO: 161845 - DNA, 103 bp, Artificial Sequence
  Synthetic Polynucleotide
taatacgactcactatagggctccgtgacccagctcgggggctcggagctaacagaggagaagctccatgcccccgagcaacctggcggcagcgcaaaagatg

SEQ ID NO: 161846 - DNA, 103 bp, Artificial Sequence
  Synthetic Polynucleotide
taatacgactcactatagggcaagcagcatctccgtgacccagctcggggaacagaggagaccccgaatggggtcacggaacctggcggcagcgcaaaagatg

SEQ ID NO: 161847 - DNA, 103 bp, Artificial Sequence
  Synthetic Polynucleotide
taatacgactcactatagggagctcgttctcaagcagcatctccgtgaccaacagaggagaggtcacatggatgctgctaacctggcggcagcgcaaaagatg

SEQ ID NO: 161848 - DNA, 103 bp, Artificial Sequence
  Synthetic Polynucleotide
taatacgactcactataggggctgccccacagctcgttctcaagcagcataacagaggagaatgctgatggagaacgagaacctggcggcagcgcaaaagatg

SEQ ID NO: 161849 - DNA, 103 bp, Artificial Sequence
  Synthetic Polynucleotide
taatacgactcactatagggcctcggccgggctgccccacagctcgttctaacagaggagaagaacgatgtgtggggcaaacctggcggcagcgcaaaagatg

SEQ ID NO: 161850 - DNA, 103 bp, Artificial Sequence
  Synthetic Polynucleotide
taatacgactcactatagggaacgcgtcctcctcggccgggctgccccacaacagaggagagtggggatgcccggccgaaacctggcggcagcgcaaaagatg

SEQ ID NO: 161851 - DNA, 103 bp, Artificial Sequence
  Synthetic Polynucleotide
taatacgactcactatagggccccaggccgaacgcgtcctcctcggccggaacagaggagaccggccatggaggacgcgaacctggcggcagcgcaaaagatg

SEQ ID NO: 161852 - DNA, 103 bp, Artificial Sequence
  Synthetic Polynucleotide
taatacgactcactatagggcacccagtccccccaggccgaacgcgtcctaacagaggagaaggacgatgtcggcctggaacctggcggcagcgcaaaagatg

SEQ ID NO: 161853 - DNA, 103 bp, Artificial Sequence
  Synthetic Polynucleotide
taatacgactcactataggggggttcttgcagatcatgcccggcatggtgaacagaggagacaccatatggggcatgataacctggcggcagcgcaaaagatg

SEQ ID NO: 161854 - DNA, 103 bp, Artificial Sequence
  Synthetic Polynucleotide
taatacgactcactatagggggggtgaggccacccagtccccccaggccgaacagaggagacggcctatggggactgggaacctggcggcagcgcaaaagatg

SEQ ID NO: 161855 - DNA, 103 bp, Artificial Sequence
  Synthetic Polynucleotide
taatacgactcactataggggaccgggttgggggtgaggccacccagtccaacagaggagaggactgatgggcctcaccaacctggcggcagcgcaaaagatg

SEQ ID NO: 161856 - DNA, 103 bp, Artificial Sequence
  Synthetic Polynucleotide
taatacgactcactatagggcctggaggatgaccgggttgggggtgaggcaacagaggagagcctcaatgccaacccggaacctggcggcagcgcaaaagatg

SEQ ID NO: 161857 - DNA, 103 bp, Artificial Sequence
  Synthetic Polynucleotide
taatacgactcactatagggcacatgcagtcctggaggatgaccgggttgaacagaggagacaacccatgcatcctccaaacctggcggcagcgcaaaagatg

SEQ ID NO: 161858 - DNA, 103 bp, Artificial Sequence
  Synthetic Polynucleotide
taatacgactcactataggggaagccgctccacatgcagtcctggaggataacagaggagaatcctcatggactgcatgaacctggcggcagcgcaaaagatg

SEQ ID NO: 161859 - DNA, 103 bp, Artificial Sequence
  Synthetic Polynucleotide
taatacgactcactatagggcgcgggcggagaagccgctccacatgcagtaacagaggagaactgcaatgggagcggctaacctggcggcagcgcaaaagatg

SEQ ID NO: 161860 - DNA, 103 bp, Artificial Sequence
  Synthetic Polynucleotide
taatacgactcactatagggtccagcttctcgcgggcggagaagccgctcaacagaggagagagcggatgctccgcccgaacctggcggcagcgcaaaagatg

SEQ ID NO: 161861 - DNA, 103 bp, Artificial Sequence
  Synthetic Polynucleotide
taatacgactcactatagggcacggcgcgctccagcttctcgcgggcggaaacagaggagatccgccatggagaagctgaacctggcggcagcgcaaaagatg

SEQ ID NO: 161862 - DNA, 103 bp, Artificial Sequence
  Synthetic Polynucleotide
taatacgactcactataggggcttctcgctcacggcgcgctccagcttctaacagaggagaagaagcatgagcgcgccgaacctggcggcagcgcaaaagatg

SEQ ID NO: 161863 - DNA, 103 bp, Artificial Sequence
  Synthetic Polynucleotide
taatacgactcactatagggccgtgctgcagcttctcgctcacggcgcgcaacagaggagagcgcgcatggagcgagaaaacctggcggcagcgcaaaagatg

SEQ ID NO: 161864 - DNA, 103 bp, Artificial Sequence
  Synthetic Polynucleotide
taatacgactcactatagggctcgaggtctgggttcttgcagatcatgccaacagaggagaggcatgatgtgcaagaacaacctggcggcagcgcaaaagatg

SEQ ID NO: 161865 - DNA, 103 bp, Artificial Sequence
  Synthetic Polynucleotide
taatacgactcactatagggcggcccgcggccgtgctgcagcttctcgctaacagaggagaagcgagatgctgcagcacaacctggcggcagcgcaaaagatg

SEQ ID NO: 161866 - DNA, 103 bp, Artificial Sequence
  Synthetic Polynucleotide
taatacgactcactatagggcggcggttggcggcccgcggccgtgctgcaaacagaggagatgcagcatggccgcgggcaacctggcggcagcgcaaaagatg

SEQ ID NO: 161867 - DNA, 103 bp, Artificial Sequence
  Synthetic Polynucleotide
taatacgactcactataggggcggtggaaccggcggttggcggcccgcggaacagaggagaccgcggatggccaaccgcaacctggcggcagcgcaaaagatg

SEQ ID NO: 161868 - DNA, 103 bp, Artificial Sequence
  Synthetic Polynucleotide
taatacgactcactatagggcggggactgggcggtggaaccggcggttggaacagaggagaccaaccatgggttccaccaacctggcggcagcgcaaaagatg

SEQ ID NO: 161869 - DNA, 103 bp, Artificial Sequence
  Synthetic Polynucleotide
taatacgactcactatagggcgccggctcccggggactgggcggtggaacaacagaggagagttccaatgcccagtcccaacctggcggcagcgcaaaagatg

SEQ ID NO: 161870 - DNA, 103 bp, Artificial Sequence
  Synthetic Polynucleotide
taatacgactcactataggggggctggcggcgccggctcccggggactggaacagaggagaccagtcatggggagccggaacctggcggcagcgcaaaagatg

SEQ ID NO: 161871 - DNA, 103 bp, Artificial Sequence
  Synthetic Polynucleotide
taatacgactcactataggggcgacccgcagggctggcggcgccggctccaacagaggagaggagccatggccgccagcaacctggcggcagcgcaaaagatg

SEQ ID NO: 161872 - DNA, 103 bp, Artificial Sequence
  Synthetic Polynucleotide
taatacgactcactatagggcgccgtgcccgcgacccgcagggctggcggaacagaggagaccgccaatgctgcgggtcaacctggcggcagcgcaaaagatg

SEQ ID NO: 161873 - DNA, 103 bp, Artificial Sequence
  Synthetic Polynucleotide
taatacgactcactatagggcccgcagccccgccgtgcccgcgacccgcaaacagaggagatgcgggatgcgggcacggaacctggcggcagcgcaaaagatg

SEQ ID NO: 161874 - DNA, 103 bp, Artificial Sequence
  Synthetic Polynucleotide
taatacgactcactataggggcggccggctcccgcagccccgccgtgcccaacagaggagagggcacatgggggctgcgaacctggcggcagcgcaaaagatg

SEQ ID NO: 161875 - DNA, 103 bp, Artificial Sequence
  Synthetic Polynucleotide
taatacgactcactataggggcgagtcaaactcgaggtctgggttcttgcaacagaggagagcaagaatgcagacctcgaacctggcggcagcgcaaaagatg

SEQ ID NO: 161876 - DNA, 103 bp, Artificial Sequence
  Synthetic Polynucleotide
taatacgactcactatagggcggccccggcgcggccggctcccgcagcccaacagaggagagggctgatggagccggccaacctggcggcagcgcaaaagatg

SEQ ID NO: 161877 - DNA, 103 bp, Artificial Sequence
  Synthetic Polynucleotide
taatacgactcactataggggcgggcagggcggccccggcgcggccggctaacagaggagaagccggatgcgccggggcaacctggcggcagcgcaaaagatg

SEQ ID NO: 161878 - DNA, 103 bp, Artificial Sequence
  Synthetic Polynucleotide
taatacgactcactatagggggcgagctcggcgggcagggcggccccggcaacagaggagagccgggatggccctgcccaacctggcggcagcgcaaaagatg

SEQ ID NO: 161879 - DNA, 103 bp, Artificial Sequence
  Synthetic Polynucleotide
taatacgactcactatagggcggccgggtgggcgagctcggcgggcagggaacagaggagaccctgcatgccgagctcgaacctggcggcagcgcaaaagatg

SEQ ID NO: 161880 - DNA, 103 bp, Artificial Sequence
  Synthetic Polynucleotide
taatacgactcactatagggacgcactcggcggccgggtgggcgagctcgaacagaggagacgagctatgccacccggcaacctggcggcagcgcaaaagatg

SEQ ID NO: 161881 - DNA, 103 bp, Artificial Sequence
  Synthetic Polynucleotide
taatacgactcactatagggggcgggatccacgcactcggcggccgggtgaacagaggagacacccgatggccgagtgcaacctggcggcagcgcaaaagatg

SEQ ID NO: 161882 - DNA, 103 bp, Artificial Sequence
  Synthetic Polynucleotide
taatacgactcactatagggggaagaccacggcgggatccacgcactcggaacagaggagaccgagtatgtggatcccgaacctggcggcagcgcaaaagatg

SEQ ID NO: 161883 - DNA, 103 bp, Artificial Sequence
  Synthetic Polynucleotide
taatacgactcactatagggacgggaaaggggaagaccacggcgggatccaacagaggagaggatccatgcgtggtcttaacctggcggcagcgcaaaagatg

SEQ ID NO: 161884 - DNA, 103 bp, Artificial Sequence
  Synthetic Polynucleotide
taatacgactcactataggggcgcttgttcacgggaaaggggaagaccacaacagaggagagtggtcatgccctttcccaacctggcggcagcgcaaaagatg

SEQ ID NO: 161885 - DNA, 103 bp, Artificial Sequence
  Synthetic Polynucleotide
taatacgactcactataggggcgctggctcgcgcttgttcacgggaaaggaacagaggagacctttcatgtgaacaagcaacctggcggcagcgcaaaagatg

SEQ ID NO: 161886 - DNA, 103 bp, Artificial Sequence
  Synthetic Polynucleotide
taatacgactcactatagggcagggctgtagcgagtcaaactcgaggtctaacagaggagaagacctatggtttgactcaacctggcggcagcgcaaaagatg

SEQ ID NO: 161887 - DNA, 103 bp, Artificial Sequence
  Synthetic Polynucleotide
taatacgactcactataggggcgggcacgggcgctggctcgcgcttgttcaacagaggagagaacaaatgcgagccagcaacctggcggcagcgcaaaagatg

SEQ ID NO: 161888 - DNA, 103 bp, Artificial Sequence
  Synthetic Polynucleotide
taatacgactcactatagggggccggggctgcgggcacgggcgctggctcaacagaggagagagccaatgcccgtgcccaacctggcggcagcgcaaaagatg

SEQ ID NO: 161889 - DNA, 103 bp, Artificial Sequence
  Synthetic Polynucleotide
taatacgactcactatagggccggggcactggccggggctgcgggcacggaacagaggagaccgtgcatgcagccccggaacctggcggcagcgcaaaagatg

SEQ ID NO: 161890 - DNA, 103 bp, Artificial Sequence
  Synthetic Polynucleotide
taatacgactcactataggggggcccgccgccggggcactggccggggctaacagaggagaagccccatgcagtgccccaacctggcggcagcgcaaaagatg

SEQ ID NO: 161891 - DNA, 103 bp, Artificial Sequence
  Synthetic Polynucleotide
taatacgactcactatagggggcgaccgcagggcccgccgccggggcactaacagaggagaagtgccatggcggcgggcaacctggcggcagcgcaaaagatg

SEQ ID NO: 161892 - DNA, 103 bp, Artificial Sequence
  Synthetic Polynucleotide
taatacgactcactatagggccgcccccgaggcgaccgcagggcccgccgaacagaggagacggcggatgctgcggtcgaacctggcggcagcgcaaaagatg

SEQ ID NO: 161893 - DNA, 103 bp, Artificial Sequence
  Synthetic Polynucleotide
taatacgactcactataggggcggcaatacccgcccccgaggcgaccgcaaacagaggagatgcggtatgctcgggggcaacctggcggcagcgcaaaagatg

SEQ ID NO: 161894 - DNA, 103 bp, Artificial Sequence
  Synthetic Polynucleotide
taatacgactcactatagggcccggctggggcggcaatacccgcccccgaaacagaggagatcggggatgggtattgccaacctggcggcagcgcaaaagatg

SEQ ID NO: 161895 - DNA, 103 bp, Artificial Sequence
  Synthetic Polynucleotide
taatacgactcactatagggcccccggggccccggctggggcggcaatacaacagaggagagtattgatgccccagccgaacctggcggcagcgcaaaagatg

SEQ ID NO: 161896 - DNA, 103 bp, Artificial Sequence
  Synthetic Polynucleotide
taatacgactcactatagggggaggggcgacccccggggccccggctgggaacagaggagacccagcatgggccccgggaacctggcggcagcgcaaaagatg

SEQ ID NO: 161897 - DNA, 103 bp, Artificial Sequence
  Synthetic Polynucleotide
taatacgactcactatagggcgggtagaagcagggctgtagcgagtcaaaaacagaggagatttgacatgctacagcccaacctggcggcagcgcaaaagatg

SEQ ID NO: 161898 - DNA, 103 bp, Artificial Sequence
  Synthetic Polynucleotide
taatacgactcactataggggcctgggcgcggaggggcgacccccggggcaacagaggagagccccgatggtcgcccctaacctggcggcagcgcaaaagatg

SEQ ID NO: 161899 - DNA, 103 bp, Artificial Sequence
  Synthetic Polynucleotide
taatacgactcactatagggtctggcggccgcctgggcgcggaggggcgaaacagaggagatcgcccatgcgcgcccagaacctggcggcagcgcaaaagatg

SEQ ID NO: 161900 - DNA, 103 bp, Artificial Sequence
  Synthetic Polynucleotide
taatacgactcactatagggccgccgctggtctggcggccgcctgggcgcaacagaggagagcgcccatgcggccgccaaacctggcggcagcgcaaaagatg

SEQ ID NO: 161901 - DNA, 103 bp, Artificial Sequence
  Synthetic Polynucleotide
taatacgactcactatagggcttgtggtcgccgccgctggtctggcggccaacagaggagaggccgcatgaccagcggcaacctggcggcagcgcaaaagatg

SEQ ID NO: 161902 - DNA, 103 bp, Artificial Sequence
  Synthetic Polynucleotide
taatacgactcactatagggtactgagggccttgtggtcgccgccgctggaacagaggagaccagcgatggcgaccacaaacctggcggcagcgcaaaagatg

SEQ ID NO: 161903 - DNA, 103 bp, Artificial Sequence
  Synthetic Polynucleotide
taatacgactcactatagggtctccggaggtactgagggccttgtggtcgaacagaggagacgaccaatgggccctcagaacctggcggcagcgcaaaagatg

SEQ ID NO: 161904 - DNA, 103 bp, Artificial Sequence
  Synthetic Polynucleotide
taatacgactcactatagggcagggtgtcctctccggaggtactgagggcaacagaggagagccctcatgacctccggaaacctggcggcagcgcaaaagatg

SEQ ID NO: 161905 - DNA, 103 bp, Artificial Sequence
  Synthetic Polynucleotide
taatacgactcactatagggctgaatcgctcagggtgtcctctccggaggaacagaggagacctccgatgaggacacccaacctggcggcagcgcaaaagatg

SEQ ID NO: 161906 - DNA, 103 bp, Artificial Sequence
  Synthetic Polynucleotide
taatacgactcactatagggtcttcatcatctgaatcgctcagggtgtccaacagaggagaggacacatggagcgattcaacctggcggcagcgcaaaagatg

SEQ ID NO: 161907 - DNA, 103 bp, Artificial Sequence
  Synthetic Polynucleotide
taatacgactcactatagggctcttcatcatcttcatcatctgaatcgctaacagaggagaagcgatatggatgatgaaaacctggcggcagcgcaaaagatg

SEQ ID NO: 161908 - DNA, 103 bp, Artificial Sequence
  Synthetic Polynucleotide
taatacgactcactatagggcatcttcgtccgggtagaagcagggctgtaaacagaggagatacagcatggcttctaccaacctggcggcagcgcaaaagatg

SEQ ID NO: 161909 - DNA, 103 bp, Artificial Sequence
  Synthetic Polynucleotide
taatacgactcactatagggcttcatcttcctcttcatcatcttcatcataacagaggagaatgatgatgatgatgaagaacctggcggcagcgcaaaagatg

SEQ ID NO: 161910 - DNA, 103 bp, Artificial Sequence
  Synthetic Polynucleotide
taatacgactcactatagggatttcttcctcttcatcttcctcttcatcaaacagaggagatgatgaatgggaagatgaaacctggcggcagcgcaaaagatg

SEQ ID NO: 161911 - DNA, 103 bp, Artificial Sequence
  Synthetic Polynucleotide
taatacgactcactataggggaccacgtcgatttcttcctcttcatcttcaacagaggagagaagatatggaggaagaaaacctggcggcagcgcaaaagatg

SEQ ID NO: 161912 - DNA, 103 bp, Artificial Sequence
  Synthetic Polynucleotide
taatacgactcactatagggtctccacagtgaccacgtcgatttcttcctaacagaggagaaggaagatgtcgacgtggaacctggcggcagcgcaaaagatg

SEQ ID NO: 161913 - DNA, 103 bp, Artificial Sequence
  Synthetic Polynucleotide
taatacgactcactataggggaacgccgcttctccacagtgaccacgtcgaacagaggagacgacgtatgcactgtggaaacctggcggcagcgcaaaagatg

SEQ ID NO: 161914 - DNA, 103 bp, Artificial Sequence
  Synthetic Polynucleotide
taatacgactcactataggggttggaggaggaacgccgcttctccacagtaacagaggagaactgtgatgaagcggcgtaacctggcggcagcgcaaaagatg

SEQ ID NO: 161915 - DNA, 103 bp, Artificial Sequence
  Synthetic Polynucleotide
taatacgactcactatagggcagccttggtgttggaggaggaacgccgctaacagaggagaagcggcatgcctcctccaaacctggcggcagcgcaaaagatg

SEQ ID NO: 161916 - DNA, 103 bp, Artificial Sequence
  Synthetic Polynucleotide
taatacgactcactatagggaatgtggtgacagccttggtgttggaggagaacagaggagactcctcatgcaccaaggcaacctggcggcagcgcaaaagatg

SEQ ID NO: 161917 - DNA, 103 bp, Artificial Sequence
  Synthetic Polynucleotide
taatacgactcactatagggagtgatggtgaatgtggtgacagccttggtaacagaggagaaccaagatggtcaccacaaacctggcggcagcgcaaaagatg

SEQ ID NO: 161918 - DNA, 103 bp, Artificial Sequence
  Synthetic Polynucleotide
taatacgactcactatagggtgggacgcacagtgatggtgaatgtggtgaaacagaggagatcaccaatgtcaccatcaaacctggcggcagcgcaaaagatg

SEQ ID NO: 161919 - DNA, 103 bp, Artificial Sequence
  Synthetic Polynucleotide
taatacgactcactatagggaagtagaagtcatcttcgtccgggtagaagaacagaggagacttctaatgggacgaagaaacctggcggcagcgcaaaagatg

SEQ ID NO: 161920 - DNA, 103 bp, Artificial Sequence
  Synthetic Polynucleotide
taatacgactcactataggggctgcgttcttgggacgcacagtgatggtgaacagaggagacaccatatgtgtgcgtccaacctggcggcagcgcaaaagatg

SEQ ID NO: 161921 - DNA, 103 bp, Artificial Sequence
  Synthetic Polynucleotide
taatacgactcactataggggggacccagggctgcgttcttgggacgcacaacagaggagagtgcgtatgaagaacgcaaacctggcggcagcgcaaaagatg

SEQ ID NO: 161922 - DNA, 103 bp, Artificial Sequence
  Synthetic Polynucleotide
taatacgactcactataggggagccctcccgggacccagggctgcgttctaacagaggagaagaacgatgccctgggtcaacctggcggcagcgcaaaagatg

SEQ ID NO: 161923 - DNA, 103 bp, Artificial Sequence
  Synthetic Polynucleotide
taatacgactcactatagggtcgctggactgagccctcccgggacccaggaacagaggagacctgggatgcgggagggcaacctggcggcagcgcaaaagatg

SEQ ID NO: 161924 - DNA, 103 bp, Artificial Sequence
  Synthetic Polynucleotide
taatacgactcactataggggaggatcagctcgctggactgagccctcccaacagaggagagggaggatgcagtccagcaacctggcggcagcgcaaaagatg

SEQ ID NO: 161925 - DNA, 103 bp, Artificial Sequence
  Synthetic Polynucleotide
taatacgactcactatagggggcatcgtttgaggatcagctcgctggactaacagaggagaagtccaatgagctgatccaacctggcggcagcgcaaaagatg

SEQ ID NO: 161926 - DNA, 103 bp, Artificial Sequence
  Synthetic Polynucleotide
taatacgactcactatagggtggatgggaaggcatcgtttgaggatcagcaacagaggagagctgatatgcaaacgatgaacctggcggcagcgcaaaagatg

SEQ ID NO: 161927 - DNA, 103 bp, Artificial Sequence
  Synthetic Polynucleotide
taatacgactcactataggggtgctgctggtggatgggaaggcatcgtttaacagaggagaaaacgaatgcttcccatcaacctggcggcagcgcaaaagatg

SEQ ID NO: 161928 - DNA, 103 bp, Artificial Sequence
  Synthetic Polynucleotide
taatacgactcactatagggcggcatagttgtgctgctggtggatgggaaaacagaggagattcccaatgaccagcagcaacctggcggcagcgcaaaagatg

SEQ ID NO: 161929 - DNA, 103 bp, Artificial Sequence
  Synthetic Polynucleotide
taatacgactcactatagggggagagggggcggcatagttgtgctgctggaacagaggagaccagcaatgcaactatgcaacctggcggcagcgcaaaagatg

SEQ ID NO: 161930 - DNA, 103 bp, Artificial Sequence
  Synthetic Polynucleotide
taatacgactcactataggggggcacctcggccttgttggcgtccgccataacagaggagaatggcgatggccaacaagaacctggcggcagcgcaaaagatg

SEQ ID NO: 161931 - DNA, 103 bp, Artificial Sequence
  Synthetic Polynucleotide
taatacgactcactatagggcttctccgcctccgcggggtgcggctctcgaacagaggagacgagagatgcaccccgcgaacctggcggcagcgcaaaagatg

SEQ ID NO: 161932 - DNA, 103 bp, Artificial Sequence
  Synthetic Polynucleotide
taatacgactcactataggggcggctgctgcttctccgcctccgcggggtaacagaggagaaccccgatgaggcggagaaacctggcggcagcgcaaaagatg

SEQ ID NO: 161933 - DNA, 103 bp, Artificial Sequence
  Synthetic Polynucleotide
taatacgactcactatagggctgctgtgctgcggctgctgcttctccgccaacagaggagaggcggaatggcagcagccaacctggcggcagcgcaaaagatg

SEQ ID NO: 161934 - DNA, 103 bp, Artificial Sequence
  Synthetic Polynucleotide
taatacgactcactatagggattggagctgctgctgtgctgcggctgctgaacagaggagacagcagatgcagcacagcaacctggcggcagcgcaaaagatg

SEQ ID NO: 161935 - DNA, 103 bp, Artificial Sequence
  Synthetic Polynucleotide
taatacgactcactatagggttttaacgccattggagctgctgctgtgctaacagaggagaagcacaatggcagctccaaacctggcggcagcgcaaaagatg

SEQ ID NO: 161936 - DNA, 103 bp, Artificial Sequence
  Synthetic Polynucleotide
taatacgactcactatagggtcattctccattttaacgccattggagctgaacagaggagacagctcatgtggcgttaaaacctggcggcagcgcaaaagatg

SEQ ID NO: 161937 - DNA, 103 bp, Artificial Sequence
  Synthetic Polynucleotide
taatacgactcactatagggtgctgattcatcattctccattttaacgccaacagaggagaggcgttatgatggagaataacctggcggcagcgcaaaagatg

SEQ ID NO: 161938 - DNA, 103 bp, Artificial Sequence
  Synthetic Polynucleotide
taatacgactcactatagggtctcttcttttgctgattcatcattctccaaacagaggagatggagaatgatgaatcagaacctggcggcagcgcaaaagatg

SEQ ID NO: 161939 - DNA, 103 bp, Artificial Sequence
  Synthetic Polynucleotide
taatacgactcactatagggaagtcagatttctcttcttttgctgattcaaacagaggagatgaatcatgaaaagaagaaacctggcggcagcgcaaaagatg

SEQ ID NO: 161940 - DNA, 103 bp, Artificial Sequence
  Synthetic Polynucleotide
taatacgactcactatagggtttttcctttaagtcagatttctcttctttaacagaggagaaaagaaatgaaatctgacaacctggcggcagcgcaaaagatg

SEQ ID NO: 161941 - DNA, 103 bp, Artificial Sequence
  Synthetic Polynucleotide
taatacgactcactatagggcagtggccccgggcacctcggccttgttggaacagaggagaccaacaatgccgaggtgcaacctggcggcagcgcaaaagatg

SEQ ID NO: 161942 - DNA, 103 bp, Artificial Sequence
  Synthetic Polynucleotide
taatacgactcactatagggttcctgtagatttttcctttaagtcagattaacagaggagaaatctgatgtaaaggaaaaacctggcggcagcgcaaaagatg

SEQ ID NO: 161943 - DNA, 103 bp, Artificial Sequence
  Synthetic Polynucleotide
taatacgactcactataggggccttcttacttcctgtagatttttcctttaacagaggagaaaaggaatgatctacaggaacctggcggcagcgcaaaagatg

SEQ ID NO: 161944 - DNA, 103 bp, Artificial Sequence
  Synthetic Polynucleotide
taatacgactcactatagggaaatctattggccttcttacttcctgtagaaacagaggagatctacaatgagtaagaagaacctggcggcagcgcaaaagatg

SEQ ID NO: 161945 - DNA, 103 bp, Artificial Sequence
  Synthetic Polynucleotide
taatacgactcactatagggaataaggatgaaatctattggccttcttacaacagaggagagtaagaatgccaatagataacctggcggcagcgcaaaagatg

SEQ ID NO: 161946 - DNA, 103 bp, Artificial Sequence
  Synthetic Polynucleotide
taatacgactcactatagggttgtcttttgaataaggatgaaatctattgaacagaggagacaatagatgtcatccttaaacctggcggcagcgcaaaagatg

SEQ ID NO: 161947 - DNA, 103 bp, Artificial Sequence
  Synthetic Polynucleotide
taatacgactcactataggggcccgaattcttgtcttttgaataaggatgaacagaggagacatcctatgtcaaaagacaacctggcggcagcgcaaaagatg

SEQ ID NO: 161948 - DNA, 103 bp, Artificial Sequence
  Synthetic Polynucleotide
taatacgactcactatagggtttctccagcgcccgaattcttgtcttttgaacagaggagacaaaagatgagaattcggaacctggcggcagcgcaaaagatg

SEQ ID NO: 161949 - DNA, 103 bp, Artificial Sequence
  Synthetic Polynucleotide
taatacgactcactatagggggacccttcttttctccagcgcccgaattcaacagaggagagaattcatgcgctggagaaacctggcggcagcgcaaaagatg

SEQ ID NO: 161950 - DNA, 103 bp, Artificial Sequence
  Synthetic Polynucleotide
taatacgactcactataggggttacgatttggacccttcttttctccagcaacagaggagagctggaatgaagaagggtaacctggcggcagcgcaaaagatg

SEQ ID NO: 161951 - DNA, 103 bp, Artificial Sequence
  Synthetic Polynucleotide
taatacgactcactatagggtgaaaactctgttacgatttggacccttctaacagaggagaagaaggatgcaaatcgtaaacctggcggcagcgcaaaagatg

SEQ ID NO: 161952 - DNA, 103 bp, Artificial Sequence
  Synthetic Polynucleotide
taatacgactcactatagggctgtcgccaccagtggccccgggcacctcgaacagaggagacgaggtatgcggggccacaacctggcggcagcgcaaaagatg

SEQ ID NO: 161953 - DNA, 103 bp, Artificial Sequence
  Synthetic Polynucleotide
taatacgactcactatagggatgttgctaatgaaaactctgttacgatttaacagaggagaaaatcgatgcagagttttaacctggcggcagcgcaaaagatg

SEQ ID NO: 161954 - DNA, 103 bp, Artificial Sequence
  Synthetic Polynucleotide
taatacgactcactataggggtcatatgggatgttgctaatgaaaactctaacagaggagaagagttatgattagcaacaacctggcggcagcgcaaaagatg

SEQ ID NO: 161955 - DNA, 103 bp, Artificial Sequence
  Synthetic Polynucleotide
taatacgactcactataggggccatttcatgtcatatgggatgttgctaaaacagaggagattagcaatgtcccatatgaacctggcggcagcgcaaaagatg

SEQ ID NO: 161956 - DNA, 103 bp, Artificial Sequence
  Synthetic Polynucleotide
taatacgactcactatagggttaatagcttgccatttcatgtcatatgggaacagaggagacccataatgcatgaaatgaacctggcggcagcgcaaaagatg

SEQ ID NO: 161957 - DNA, 103 bp, Artificial Sequence
  Synthetic Polynucleotide
taatacgactcactatagggcattagatctttaatagcttgccatttcataacagaggagaatgaaaatgcaagctattaacctggcggcagcgcaaaagatg

SEQ ID NO: 161958 - DNA, 103 bp, Artificial Sequence
  Synthetic Polynucleotide
taatacgactcactatagggctttctctctcattagatctttaatagcttaacagaggagaaagctaatgaagatctaaaacctggcggcagcgcaaaagatg

SEQ ID NO: 161959 - DNA, 103 bp, Artificial Sequence
  Synthetic Polynucleotide
taatacgactcactatagggcaccacaaccctttctctctcattagatctaacagaggagaagatctatggagagagaaaacctggcggcagcgcaaaagatg

SEQ ID NO: 161960 - DNA, 103 bp, Artificial Sequence
  Synthetic Polynucleotide
taatacgactcactatagggcaggtgcgggctgtcgccaccagtggccccaacagaggagaggggccatgggtggcgacaacctggcggcagcgcaaaagatg

SEQ ID NO: 161961 - DNA, 103 bp, Artificial Sequence
  Synthetic Polynucleotide
taatacgactcactatagggctgcgggctgcaggtgcgggctgtcgccacaacagaggagagtggcgatggcccgcaccaacctggcggcagcgcaaaagatg

SEQ ID NO: 161962 - DNA, 103 bp, Artificial Sequence
  Synthetic Polynucleotide
taatacgactcactatagggcccggcggctctgcgggctgcaggtgcgggaacagaggagacccgcaatggcagcccgcaacctggcggcagcgcaaaagatg

SEQ ID NO: 161963 - DNA, 103 bp, Artificial Sequence
  Synthetic Polynucleotide
taatacgactcactatagggccgcggctcgcccggcggctctgcgggctgaacagaggagacagcccatggagccgccgaacctggcggcagcgcaaaagatg

SEQ ID NO: 161964 - DNA, 103 bp, Artificial Sequence
  Synthetic Polynucleotide
taatacgactcactataggggcggctctcgccgcggctcgcccggcggctaacagaggagaagccgcatggcgagccgcaacctggcggcagcgcaaaagatg

SEQ ID NO: 161965 - DNA, 103 bp, Artificial Sequence
  Synthetic Polynucleotide
taatacgactcactatagggtccgcggggtgcggctctcgccgcggctcgaacagaggagacgagccatggcgagagccaacctggcggcagcgcaaaagatg

SEQ ID NO: 161966 - DNA, 103 bp, Artificial Sequence
  Synthetic Polynucleotide
taatacgactcactatagggtgagaactggcagccatccatcacgtccataacagaggagaatggacatgatggatggcaacctggcggcagcgcaaaagatg

SEQ ID NO: 161967 - DNA, 103 bp, Artificial Sequence
  Synthetic Polynucleotide
taatacgactcactatagggtccgaaggcagccactcgcggcacaaactcaacagaggagagagtttatgccgcgagtgaacctggcggcagcgcaaaagatg

SEQ ID NO: 161968 - DNA, 103 bp, Artificial Sequence
  Synthetic Polynucleotide
taatacgactcactatagggctttgtgcgctccgaaggcagccactcgcgaacagaggagacgcgagatgctgccttcgaacctggcggcagcgcaaaagatg

SEQ ID NO: 161969 - DNA, 103 bp, Artificial Sequence
  Synthetic Polynucleotide
taatacgactcactatagggtgcagctctgctttgtgcgctccgaaggcaaacagaggagatgccttatgagcgcacaaaacctggcggcagcgcaaaagatg

SEQ ID NO: 161970 - DNA, 103 bp, Artificial Sequence
  Synthetic Polynucleotide
taatacgactcactatagggatctgagccctgcagctctgctttgtgcgcaacagaggagagcgcacatggcagagctgaacctggcggcagcgcaaaagatg

SEQ ID NO: 161971 - DNA, 103 bp, Artificial Sequence
  Synthetic Polynucleotide
taatacgactcactataggggctcgtcctcatctgagccctgcagctctgaacagaggagacagagcatgagggctcagaacctggcggcagcgcaaaagatg

SEQ ID NO: 161972 - DNA, 103 bp, Artificial Sequence
  Synthetic Polynucleotide
taatacgactcactataggggctcgcacgtgctcgtcctcatctgagcccaacagaggagagggctcatgtgaggacgaaacctggcggcagcgcaaaagatg

SEQ ID NO: 161973 - DNA, 103 bp, Artificial Sequence
  Synthetic Polynucleotide
taatacgactcactataggggccggtaggcgctcgcacgtgctcgtcctcaacagaggagagaggacatgcacgtgcgaaacctggcggcagcgcaaaagatg

SEQ ID NO: 161974 - DNA, 103 bp, Artificial Sequence
  Synthetic Polynucleotide
taatacgactcactatagggcctggtggtggccggtaggcgctcgcacgtaacagaggagaacgtgcatgcgcctaccgaacctggcggcagcgcaaaagatg

SEQ ID NO: 161975 - DNA, 103 bp, Artificial Sequence
  Synthetic Polynucleotide
taatacgactcactatagggcagtgaccagcctggtggtggccggtaggcaacagaggagagcctacatgccaccaccaaacctggcggcagcgcaaaagatg

SEQ ID NO: 161976 - DNA, 103 bp, Artificial Sequence
  Synthetic Polynucleotide
taatacgactcactatagggccacatgaggcagtgaccagcctggtggtgaacagaggagacaccacatggctggtcacaacctggcggcagcgcaaaagatg

SEQ ID NO: 161977 - DNA, 103 bp, Artificial Sequence
  Synthetic Polynucleotide
taatacgactcactatagggactcagaaggtgagaactggcagccatccaaacagaggagatggatgatggccagttctaacctggcggcagcgcaaaagatg

SEQ ID NO: 161978 - DNA, 103 bp, Artificial Sequence
  Synthetic Polynucleotide
taatacgactcactatagggctttgcaggcccacatgaggcagtgaccagaacagaggagactggtcatggcctcatgtaacctggcggcagcgcaaaagatg

SEQ ID NO: 161979 - DNA, 103 bp, Artificial Sequence
  Synthetic Polynucleotide
taatacgactcactatagggctcttgcaggctttgcaggcccacatgaggaacagaggagacctcatatgggcctgcaaaacctggcggcagcgcaaaagatg

SEQ ID NO: 161980 - DNA, 103 bp, Artificial Sequence
  Synthetic Polynucleotide
taatacgactcactatagggggtggacttcctcttgcaggctttgcaggcaacagaggagagcctgcatggcctgcaagaacctggcggcagcgcaaaagatg

SEQ ID NO: 161981 - DNA, 103 bp, Artificial Sequence
  Synthetic Polynucleotide
taatacgactcactataggggatccatggtggtggacttcctcttgcaggaacagaggagacctgcaatgggaagtccaaacctggcggcagcgcaaaagatg

SEQ ID NO: 161982 - DNA, 103 bp, Artificial Sequence
  Synthetic Polynucleotide
taatacgactcactataggggccttccgccgatccatggtggtggacttcaacagaggagagaagtcatgcaccatggaaacctggcggcagcgcaaaagatg

SEQ ID NO: 161983 - DNA, 103 bp, Artificial Sequence
  Synthetic Polynucleotide
taatacgactcactatagggcatagtggctgccttccgccgatccatggtaacagaggagaaccatgatgcggcggaagaacctggcggcagcgcaaaagatg

SEQ ID NO: 161984 - DNA, 103 bp, Artificial Sequence
  Synthetic Polynucleotide
taatacgactcactatagggtccgctcgcgcatagtggctgccttccgccaacagaggagaggcggaatgcagccactaaacctggcggcagcgcaaaagatg

SEQ ID NO: 161985 - DNA, 103 bp, Artificial Sequence
  Synthetic Polynucleotide
taatacgactcactatagggttcaggcgcctccgctcgcgcatagtggctaacagaggagaagccacatggcgcgagcgaacctggcggcagcgcaaaagatg

SEQ ID NO: 161986 - DNA, 103 bp, Artificial Sequence
  Synthetic Polynucleotide
taatacgactcactataggggttgaccttcttcaggcgcctccgctcgcgaacagaggagacgcgagatgaggcgcctgaacctggcggcagcgcaaaagatg

SEQ ID NO: 161987 - DNA, 103 bp, Artificial Sequence
  Synthetic Polynucleotide
taatacgactcactatagggcgaaagcctggttgaccttcttcaggcgccaacagaggagaggcgccatgagaaggtcaaacctggcggcagcgcaaaagatg

SEQ ID NO: 161988 - DNA, 103 bp, Artificial Sequence
  Synthetic Polynucleotide
taatacgactcactatagggtcgtagaagtactcagaaggtgagaactggaacagaggagaccagttatgaccttctgaaacctggcggcagcgcaaaagatg

SEQ ID NO: 161989 - DNA, 103 bp, Artificial Sequence
  Synthetic Polynucleotide
taatacgactcactatagggttgagggtttcgaaagcctggttgaccttcaacagaggagagaaggtatgccaggctttaacctggcggcagcgcaaaagatg

SEQ ID NO: 161990 - DNA, 103 bp, Artificial Sequence
  Synthetic Polynucleotide
taatacgactcactatagggggtacacctcttgagggtttcgaaagcctgaacagaggagacaggctatggaaaccctcaacctggcggcagcgcaaaagatg

SEQ ID NO: 161991 - DNA, 103 bp, Artificial Sequence
  Synthetic Polynucleotide
taatacgactcactatagggggttggtcgtggtacacctcttgagggtttaacagaggagaaaacccatgagaggtgtaaacctggcggcagcgcaaaagatg

SEQ ID NO: 161992 - DNA, 103 bp, Artificial Sequence
  Synthetic Polynucleotide
taatacgactcactatagggctctggttggggttggtcgtggtacacctcaacagaggagagaggtgatgcacgaccaaaacctggcggcagcgcaaaagatg

SEQ ID NO: 161993 - DNA, 103 bp, Artificial Sequence
  Synthetic Polynucleotide
taatacgactcactatagggcttgggcagcctctggttggggttggtcgtaacagaggagaacgaccatgcccaaccagaacctggcggcagcgcaaaagatg

SEQ ID NO: 161994 - DNA, 103 bp, Artificial Sequence
  Synthetic Polynucleotide
taatacgactcactatagggggatctccaccttgggcagcctctggttggaacagaggagaccaaccatgggctgcccaaacctggcggcagcgcaaaagatg

SEQ ID NO: 161995 - DNA, 103 bp, Artificial Sequence
  Synthetic Polynucleotide
taatacgactcactataggggcattcctgaggatctccaccttgggcagcaacagaggagagctgccatgggtggagataacctggcggcagcgcaaaagatg

SEQ ID NO: 161996 - DNA, 103 bp, Artificial Sequence
  Synthetic Polynucleotide
taatacgactcactataggggtagcggatggcattcctgaggatctccacaacagaggagagtggagatgctcaggaataacctggcggcagcgcaaaagatg

SEQ ID NO: 161997 - DNA, 103 bp, Artificial Sequence
  Synthetic Polynucleotide
taatacgactcactatagggggctctcgatgtagcggatggcattcctgaaacagaggagatcaggaatgccatccgctaacctggcggcagcgcaaaagatg

SEQ ID NO: 161998 - DNA, 103 bp, Artificial Sequence
  Synthetic Polynucleotide
taatacgactcactatagggaactcctgcaggctctcgatgtagcggatgaacagaggagacatccgatgcatcgagagaacctggcggcagcgcaaaagatg

SEQ ID NO: 161999 - DNA, 103 bp, Artificial Sequence
  Synthetic Polynucleotide
taatacgactcactataggggcaggagccgtcgtagaagtactcagaaggaacagaggagaccttctatgtacttctacaacctggcggcagcgcaaaagatg

SEQ ID NO: 162000 - DNA, 103 bp, Artificial Sequence
  Synthetic Polynucleotide
taatacgactcactatagggctctctcagcaactcctgcaggctctcgataacagaggagaatcgagatgctgcaggagaacctggcggcagcgcaaaagatg

SEQ ID NO: 162001 - DNA, 103 bp, Artificial Sequence
  Synthetic Polynucleotide
taatacgactcactatagggtctccacctgctctctcagcaactcctgcaaacagaggagatgcaggatgtgctgagagaacctggcggcagcgcaaaagatg

SEQ ID NO: 162002 - DNA, 103 bp, Artificial Sequence
  Synthetic Polynucleotide
taatacgactcactatagggctatagtagttctccacctgctctctcagcaacagaggagagctgagatggcaggtggaaacctggcggcagcgcaaaagatg

SEQ ID NO: 162003 - DNA, 103 bp, Artificial Sequence
  Synthetic Polynucleotide
taatacgactcactatagggtcccggcaggctatagtagttctccacctgaacagaggagacaggtgatgaactactataacctggcggcagcgcaaaagatg

SEQ ID NO: 162004 - DNA, 103 bp, Artificial Sequence
  Synthetic Polynucleotide
taatacgactcactatagggagcagctctgtcccggcaggctatagtagtaacagaggagaactactatggcctgccggaacctggcggcagcgcaaaagatg

SEQ ID NO: 162005 - DNA, 103 bp, Artificial Sequence
  Synthetic Polynucleotide
taatacgactcactataggggtgggctccgagcagctctgtcccggcaggaacagaggagacctgccatgacagagctgaacctggcggcagcgcaaaagatg

SEQ ID NO: 162006 - DNA, 103 bp, Artificial Sequence
  Synthetic Polynucleotide
taatacgactcactatagggggtggggctggtgggctccgagcagctctgaacagaggagacagagcatgtcggagcccaacctggcggcagcgcaaaagatg

SEQ ID NO: 162007 - DNA, 103 bp, Artificial Sequence
  Synthetic Polynucleotide
taatacgactcactatagggagcagttggaggtggggctggtgggctccgaacagaggagacggagcatgccagccccaaacctggcggcagcgcaaaagatg

SEQ ID NO: 162008 - DNA, 103 bp, Artificial Sequence
  Synthetic Polynucleotide
taatacgactcactatagggatgccatcagagcagttggaggtggggctgaacagaggagacagcccatgctccaactgaacctggcggcagcgcaaaagatg

SEQ ID NO: 162009 - DNA, 103 bp, Artificial Sequence
  Synthetic Polynucleotide
taatacgactcactatagggacattcgggcatgccatcagagcagttggaaacagaggagatccaacatgtctgatggcaacctggcggcagcgcaaaagatg

SEQ ID NO: 162010 - DNA, 103 bp, Artificial Sequence
  Synthetic Polynucleotide
taatacgactcactataggggggacggtatgcaggagccgtcgtagaagtaacagaggagaacttctatgacggctcctaacctggcggcagcgcaaaagatg

SEQ ID NO: 162011 - DNA, 103 bp, Artificial Sequence
  Synthetic Polynucleotide
taatacgactcactatagggcaggactgttacattcgggcatgccatcagaacagaggagactgatgatgtgcccgaataacctggcggcagcgcaaaagatg

SEQ ID NO: 162012 - DNA, 103 bp, Artificial Sequence
  Synthetic Polynucleotide
taatacgactcactatagggctggaccagacaggactgttacattcgggcaacagaggagagcccgaatgtaacagtccaacctggcggcagcgcaaaagatg

SEQ ID NO: 162013 - DNA, 103 bp, Artificial Sequence
  Synthetic Polynucleotide
taatacgactcactatagggactgctctttctggaccagacaggactgttaacagaggagaaacagtatggtctggtccaacctggcggcagcgcaaaagatg

SEQ ID NO: 162014 - DNA, 103 bp, Artificial Sequence
  Synthetic Polynucleotide
taatacgactcactatagggtgtcaaaagtactgctctttctggaccagaaacagaggagatctggtatggaaagagcaaacctggcggcagcgcaaaagatg

SEQ ID NO: 162015 - DNA, 103 bp, Artificial Sequence
  Synthetic Polynucleotide
taatacgactcactatagggcagtagatgctgtcaaaagtactgctctttaacagaggagaaaagagatgtacttttgaaacctggcggcagcgcaaaagatg

SEQ ID NO: 162016 - DNA, 103 bp, Artificial Sequence
  Synthetic Polynucleotide
taatacgactcactatagggtacatcaggacagtagatgctgtcaaaagtaacagaggagaacttttatgagcatctacaacctggcggcagcgcaaaagatg

SEQ ID NO: 162017 - DNA, 103 bp, Artificial Sequence
  Synthetic Polynucleotide
taatacgactcactatagggatacatttgatacatcaggacagtagatgcaacagaggagagcatctatggtcctgatgaacctggcggcagcgcaaaagatg

SEQ ID NO: 162018 - DNA, 103 bp, Artificial Sequence
  Synthetic Polynucleotide
taatacgactcactatagggtctgtggcatatacatttgatacatcaggaaacagaggagatcctgaatgatcaaatgtaacctggcggcagcgcaaaagatg

SEQ ID NO: 162019 - DNA, 103 bp, Artificial Sequence
  Synthetic Polynucleotide
taatacgactcactatagggggagtttttatctgtggcatatacatttgaaacagaggagatcaaatatgtatgccacaaacctggcggcagcgcaaaagatg

SEQ ID NO: 162020 - DNA, 103 bp, Artificial Sequence
  Synthetic Polynucleotide
taatacgactcactatagggagctggataaggagtttttatctgtggcataacagaggagaatgccaatgataaaaactaacctggcggcagcgcaaaagatg

SEQ ID NO: 162021 - DNA, 103 bp, Artificial Sequence
  Synthetic Polynucleotide
taatacgactcactatagggtcaccctcgggggacggtatgcaggagccgaacagaggagacggctcatgcataccgtcaacctggcggcagcgcaaaagatg

SEQ ID NO: 162022 - DNA, 103 bp, Artificial Sequence
  Synthetic Polynucleotide
taatacgactcactatagggaagcaatccaagctggataaggagtttttaaacagaggagataaaaaatgcttatccagaacctggcggcagcgcaaaagatg

SEQ ID NO: 162023 - DNA, 103 bp, Artificial Sequence
  Synthetic Polynucleotide
taatacgactcactatagggtatgttggataagcaatccaagctggataaaacagaggagattatccatgttggattgcaacctggcggcagcgcaaaagatg

SEQ ID NO: 162024 - DNA, 103 bp, Artificial Sequence
  Synthetic Polynucleotide
taatacgactcactatagggtccggtccactatgttggataagcaatccaaacagaggagatggattatgtatccaacaaacctggcggcagcgcaaaagatg

SEQ ID NO: 162025 - DNA, 103 bp, Artificial Sequence
  Synthetic Polynucleotide
taatacgactcactataggggaggaggtgatccggtccactatgttggataacagaggagaatccaaatgagtggaccgaacctggcggcagcgcaaaagatg

SEQ ID NO: 162026 - DNA, 103 bp, Artificial Sequence
  Synthetic Polynucleotide
taatacgactcactatagggaggttgctctgaggaggtgatccggtccacaacagaggagagtggacatgatcacctccaacctggcggcagcgcaaaagatg

SEQ ID NO: 162027 - DNA, 103 bp, Artificial Sequence
  Synthetic Polynucleotide
taatacgactcactataggggaggcaacccaggttgctctgaggaggtgaaacagaggagatcacctatgcagagcaacaacctggcggcagcgcaaaagatg

SEQ ID NO: 162028 - DNA, 103 bp, Artificial Sequence
  Synthetic Polynucleotide
taatacgactcactatagggagatcctggagaggcaacccaggttgctctaacagaggagaagagcaatgtgggttgccaacctggcggcagcgcaaaagatg

SEQ ID NO: 162029 - DNA, 103 bp, Artificial Sequence
  Synthetic Polynucleotide
taatacgactcactataggggagagaagccagatcctggagaggcaacccaacagaggagagggttgatgctccaggataacctggcggcagcgcaaaagatg

SEQ ID NO: 162030 - DNA, 103 bp, Artificial Sequence
  Synthetic Polynucleotide
taatacgactcactatagggcaactggagagagagaagccagatcctggaaacagaggagatccaggatgtggcttctcaacctggcggcagcgcaaaagatg

SEQ ID NO: 162031 - DNA, 103 bp, Artificial Sequence
  Synthetic Polynucleotide
taatacgactcactatagggtcggtgctggcaactggagagagagaagccaacagaggagaggcttcatgctctccagtaacctggcggcagcgcaaaagatg

SEQ ID NO: 162032 - DNA, 103 bp, Artificial Sequence
  Synthetic Polynucleotide
taatacgactcactataggggtccccaaattcaccctcgggggacggtataacagaggagaataccgatgcccgagggtaacctggcggcagcgcaaaagatg

SEQ ID NO: 162033 - DNA, 103 bp, Artificial Sequence
  Synthetic Polynucleotide
taatacgactcactatagggaggctgtgaatcggtgctggcaactggagaaacagaggagatctccaatggccagcaccaacctggcggcagcgcaaaagatg

SEQ ID NO: 162034 - DNA, 103 bp, Artificial Sequence
  Synthetic Polynucleotide
taatacgactcactatagggctggagttgcaggctgtgaatcggtgctggaacagaggagaccagcaatgattcacagcaacctggcggcagcgcaaaagatg

SEQ ID NO: 162035 - DNA, 103 bp, Artificial Sequence
  Synthetic Polynucleotide
taatacgactcactatagggctagaagcccctggagttgcaggctgtgaaaacagaggagattcacaatgtgcaactccaacctggcggcagcgcaaaagatg

SEQ ID NO: 162036 - DNA, 103 bp, Artificial Sequence
  Synthetic Polynucleotide
taatacgactcactatagggaagcctggaactagaagcccctggagttgcaacagaggagagcaactatgggggcttctaacctggcggcagcgcaaaagatg

SEQ ID NO: 162037 - DNA, 103 bp, Artificial Sequence
  Synthetic Polynucleotide
taatacgactcactatagggcatgatagataagcctggaactagaagcccaacagaggagagggcttatggttccaggcaacctggcggcagcgcaaaagatg

SEQ ID NO: 162038 - DNA, 103 bp, Artificial Sequence
  Synthetic Polynucleotide
taatacgactcactataggggcacaaactcgtccccaaattcaccctcggaacagaggagaccgaggatgaatttggggaacctggcggcagcgcaaaagatg

SEQ ID NO: 162039 - DNA, 103 bp, Artificial Sequence
  Synthetic Polynucleotide
taatacgactcactataggggccactcgcggcacaaactcgtccccaaataacagaggagaatttggatgcgagtttgtaacctggcggcagcgcaaaagatg

SEQ ID NO: 162040 - DNA, 103 bp, Artificial Sequence
  Synthetic Polynucleotide
taatacgactcactatagggggagccagtttcaaaaaggtccatcatcataacagaggagaatgatgatggacctttttaacctggcggcagcgcaaaagatg

SEQ ID NO: 162041 - DNA, 103 bp, Artificial Sequence
  Synthetic Polynucleotide
taatacgactcactatagggggtaccatcactccctggatacaaaggagaaacagaggagatctcctatgtatccagggaacctggcggcagcgcaaaagatg

SEQ ID NO: 162042 - DNA, 103 bp, Artificial Sequence
  Synthetic Polynucleotide
taatacgactcactatagggagggggacaaggtaccatcactccctggataacagaggagaatccagatggtgatggtaaacctggcggcagcgcaaaagatg

SEQ ID NO: 162043 - DNA, 103 bp, Artificial Sequence
  Synthetic Polynucleotide
taatacgactcactatagggtggtcctggcagggggacaaggtaccatcaaacagaggagatgatggatgcttgtccccaacctggcggcagcgcaaaagatg

SEQ ID NO: 162044 - DNA, 103 bp, Artificial Sequence
  Synthetic Polynucleotide
taatacgactcactatagggcgggggcatttggtcctggcagggggacaaaacagaggagattgtccatgtgccaggacaacctggcggcagcgcaaaagatg

SEQ ID NO: 162045 - DNA, 103 bp, Artificial Sequence
  Synthetic Polynucleotide
taatacgactcactatagggtccccgcttccgggggcatttggtcctggcaacagaggagagccaggatgaaatgccccaacctggcggcagcgcaaaagatg

SEQ ID NO: 162046 - DNA, 103 bp, Artificial Sequence
  Synthetic Polynucleotide
taatacgactcactatagggctgctgtcgctccccgcttccgggggcattaacagaggagaaatgccatgggaagcgggaacctggcggcagcgcaaaagatg

SEQ ID NO: 162047 - DNA, 103 bp, Artificial Sequence
  Synthetic Polynucleotide
taatacgactcactatagggttcctctccgctgctgtcgctccccgcttcaacagaggagagaagcgatgagcgacagcaacctggcggcagcgcaaaagatg

SEQ ID NO: 162048 - DNA, 103 bp, Artificial Sequence
  Synthetic Polynucleotide
taatacgactcactatagggccaggacatgttcctctccgctgctgtcgcaacagaggagagcgacaatggcggagaggaacctggcggcagcgcaaaagatg

SEQ ID NO: 162049 - DNA, 103 bp, Artificial Sequence
  Synthetic Polynucleotide
taatacgactcactatagggcccgggggcgccaggacatgttcctctccgaacagaggagacggagaatgacatgtcctaacctggcggcagcgcaaaagatg

SEQ ID NO: 162050 - DNA, 103 bp, Artificial Sequence
  Synthetic Polynucleotide
taatacgactcactatagggaggctgcaggcccgggggcgccaggacatgaacagaggagacatgtcatggcgcccccgaacctggcggcagcgcaaaagatg

SEQ ID NO: 162051 - DNA, 103 bp, Artificial Sequence
  Synthetic Polynucleotide
taatacgactcactatagggagaagaaataggagccagtttcaaaaaggtaacagaggagaacctttatgaaactggctaacctggcggcagcgcaaaagatg

SEQ ID NO: 162052 - DNA, 103 bp, Artificial Sequence
  Synthetic Polynucleotide
taatacgactcactatagggggcagtgtggaggctgcaggcccgggggcgaacagaggagacgccccatggcctgcagcaacctggcggcagcgcaaaagatg

SEQ ID NO: 162053 - DNA, 103 bp, Artificial Sequence
  Synthetic Polynucleotide
taatacgactcactatagggcactggccggggcagtgtggaggctgcaggaacagaggagacctgcaatgtccacactgaacctggcggcagcgcaaaagatg

SEQ ID NO: 162054 - DNA, 103 bp, Artificial Sequence
  Synthetic Polynucleotide
taatacgactcactatagggccagatcagacactggccggggcagtgtggaacagaggagaccacacatgcccggccagaacctggcggcagcgcaaaagatg

SEQ ID NO: 162055 - DNA, 103 bp, Artificial Sequence
  Synthetic Polynucleotide
taatacgactcactatagggtcttgcaagcccagatcagacactggccggaacagaggagaccggccatggtctgatctaacctggcggcagcgcaaaagatg

SEQ ID NO: 162056 - DNA, 103 bp, Artificial Sequence
  Synthetic Polynucleotide
taatacgactcactatagggctcttgcaggtcttgcaagcccagatcagaaacagaggagatctgatatgggcttgcaaaacctggcggcagcgcaaaagatg

SEQ ID NO: 162057 - DNA, 103 bp, Artificial Sequence
  Synthetic Polynucleotide
taatacgactcactatagggggcagattttctcttgcaggtcttgcaagcaacagaggagagcttgcatgacctgcaagaacctggcggcagcgcaaaagatg

SEQ ID NO: 162058 - DNA, 103 bp, Artificial Sequence
  Synthetic Polynucleotide
taatacgactcactatagggggtcagtgggggcagattttctcttgcaggaacagaggagacctgcaatggaaaatctgaacctggcggcagcgcaaaagatg

SEQ ID NO: 162059 - DNA, 103 bp, Artificial Sequence
  Synthetic Polynucleotide
taatacgactcactataggggcttttcgccggtcagtgggggcagattttaacagaggagaaaaatcatgccccactgaaacctggcggcagcgcaaaagatg

SEQ ID NO: 162060 - DNA, 103 bp, Artificial Sequence
  Synthetic Polynucleotide
taatacgactcactatagggcagggtggcggcttttcgccggtcagtgggaacagaggagacccactatgcggcgaaaaaacctggcggcagcgcaaaagatg

SEQ ID NO: 162061 - DNA, 103 bp, Artificial Sequence
  Synthetic Polynucleotide
taatacgactcactatagggtcctttcgcgcagggtggcggcttttcgccaacagaggagaggcgaaatgccgccacccaacctggcggcagcgcaaaagatg

SEQ ID NO: 162062 - DNA, 103 bp, Artificial Sequence
  Synthetic Polynucleotide
taatacgactcactatagggccatccaagtagaagaaataggagccagttaacagaggagaaactggatgctatttcttaacctggcggcagcgcaaaagatg

SEQ ID NO: 162063 - DNA, 103 bp, Artificial Sequence
  Synthetic Polynucleotide
taatacgactcactatagggtttagcctcctcctttcgcgcagggtggcgaacagaggagacgccacatggcgcgaaagaacctggcggcagcgcaaaagatg

SEQ ID NO: 162064 - DNA, 103 bp, Artificial Sequence
  Synthetic Polynucleotide
taatacgactcactataggggttgattttctttagcctcctcctttcgcgaacagaggagacgcgaaatgaggaggctaaacctggcggcagcgcaaaagatg

SEQ ID NO: 162065 - DNA, 103 bp, Artificial Sequence
  Synthetic Polynucleotide
taatacgactcactatagggcgaaggcctcgttgattttctttagcctccaacagaggagaggaggcatgagaaaatcaaacctggcggcagcgcaaaagatg

SEQ ID NO: 162066 - DNA, 103 bp, Artificial Sequence
  Synthetic Polynucleotide
taatacgactcactatagggttcagtgcctcgaaggcctcgttgattttcaacagaggagagaaaatatgcgaggccttaacctggcggcagcgcaaaagatg

SEQ ID NO: 162067 - DNA, 103 bp, Artificial Sequence
  Synthetic Polynucleotide
taatacgactcactatagggagttcgccgcttcagtgcctcgaaggcctcaacagaggagagaggccatggaggcactgaacctggcggcagcgcaaaagatg

SEQ ID NO: 162068 - DNA, 103 bp, Artificial Sequence
  Synthetic Polynucleotide
taatacgactcactatagggggttggccacagttcgccgcttcagtgcctaacagaggagaaggcacatgagcggcgaaaacctggcggcagcgcaaaagatg

SEQ ID NO: 162069 - DNA, 103 bp, Artificial Sequence
  Synthetic Polynucleotide
taatacgactcactatagggctctggttggggttggccacagttcgccgcaacagaggagagcggcgatgtgtggccaaaacctggcggcagcgcaaaagatg

SEQ ID NO: 162070 - DNA, 103 bp, Artificial Sequence
  Synthetic Polynucleotide
taatacgactcactatagggcttgggcagcctctggttggggttggccacaacagaggagagtggccatgcccaaccagaacctggcggcagcgcaaaagatg

SEQ ID NO: 162071 - DNA, 103 bp, Artificial Sequence
  Synthetic Polynucleotide
taatacgactcactataggggaatctccaccttgggcagcctctggttggaacagaggagaccaaccatgggctgcccaaacctggcggcagcgcaaaagatg

SEQ ID NO: 162072 - DNA, 103 bp, Artificial Sequence
  Synthetic Polynucleotide
taatacgactcactataggggcgctccgcagaatctccaccttgggcagcaacagaggagagctgccatgggtggagataacctggcggcagcgcaaaagatg

SEQ ID NO: 162073 - DNA, 103 bp, Artificial Sequence
  Synthetic Polynucleotide
taatacgactcactatagggaacattttccccatccaagtagaagaaataaacagaggagatatttcatgtacttggataacctggcggcagcgcaaaagatg

SEQ ID NO: 162074 - DNA, 103 bp, Artificial Sequence
  Synthetic Polynucleotide
taatacgactcactatagggatagctgatggcgctccgcagaatctccacaacagaggagagtggagatgctgcggagcaacctggcggcagcgcaaaagatg

SEQ ID NO: 162075 - DNA, 103 bp, Artificial Sequence
  Synthetic Polynucleotide
taatacgactcactataggggccgctcaatatagctgatggcgctccgcaaacagaggagatgcggaatgccatcagctaacctggcggcagcgcaaaagatg

SEQ ID NO: 162076 - DNA, 103 bp, Artificial Sequence
  Synthetic Polynucleotide
taatacgactcactatagggaggtcctgcagccgctcaatatagctgatgaacagaggagacatcagatgtattgagcgaacctggcggcagcgcaaaagatg

SEQ ID NO: 162077 - DNA, 103 bp, Artificial Sequence
  Synthetic Polynucleotide
taatacgactcactatagggccggtgcagcaggtcctgcagccgctcaataacagaggagaattgagatgctgcaggacaacctggcggcagcgcaaaagatg

SEQ ID NO: 162078 - DNA, 103 bp, Artificial Sequence
  Synthetic Polynucleotide
taatacgactcactataggggctgatccagccggtgcagcaggtcctgcaaacagaggagatgcaggatgtgctgcaccaacctggcggcagcgcaaaagatg

SEQ ID NO: 162079 - DNA, 103 bp, Artificial Sequence
  Synthetic Polynucleotide
taatacgactcactatagggatcttctcctgctgatccagccggtgcagcaacagaggagagctgcaatggctggatcaaacctggcggcagcgcaaaagatg

SEQ ID NO: 162080 - DNA, 103 bp, Artificial Sequence
  Synthetic Polynucleotide
taatacgactcactatagggcagctcctgcatcttctcctgctgatccagaacagaggagactggatatgcaggagaagaacctggcggcagcgcaaaagatg

SEQ ID NO: 162081 - DNA, 103 bp, Artificial Sequence
  Synthetic Polynucleotide
taatacgactcactatagggggtccacccccagctcctgcatcttctcctaacagaggagaaggagaatgtgcaggagcaacctggcggcagcgcaaaagatg

SEQ ID NO: 162082 - DNA, 103 bp, Artificial Sequence
  Synthetic Polynucleotide
taatacgactcactatagggtagctgaaggggtccacccccagctcctgcaacagaggagagcaggaatggggggtggaaacctggcggcagcgcaaaagatg

SEQ ID NO: 162083 - DNA, 103 bp, Artificial Sequence
  Synthetic Polynucleotide
taatacgactcactatagggtttgggtctgtagctgaaggggtccaccccaacagaggagaggggtgatgcccttcagcaacctggcggcagcgcaaaagatg

SEQ ID NO: 162084 - DNA, 103 bp, Artificial Sequence
  Synthetic Polynucleotide
taatacgactcactataggggctgcagagtaacattttccccatccaagtaacagaggagaacttggatggggaaaatgaacctggcggcagcgcaaaagatg

SEQ ID NO: 162085 - DNA, 103 bp, Artificial Sequence
  Synthetic Polynucleotide
taatacgactcactataggggattttcttgtttgggtctgtagctgaaggaacagaggagaccttcaatgacagacccaaacctggcggcagcgcaaaagatg

SEQ ID NO: 162086 - DNA, 103 bp, Artificial Sequence
  Synthetic Polynucleotide
taatacgactcactataggggcaccctcaagattttcttgtttgggtctgaacagaggagacagaccatgacaagaaaaaacctggcggcagcgcaaaagatg

SEQ ID NO: 162087 - DNA, 103 bp, Artificial Sequence
  Synthetic Polynucleotide
taatacgactcactatagggcaggaaatccgcaccctcaagattttcttgaacagaggagacaagaaatgcttgagggtaacctggcggcagcgcaaaagatg

SEQ ID NO: 162088 - DNA, 103 bp, Artificial Sequence
  Synthetic Polynucleotide
taatacgactcactatagggtgcaggtgcgcaggaaatccgcaccctcaaaacagaggagattgaggatgcggatttccaacctggcggcagcgcaaaagatg

SEQ ID NO: 162089 - DNA, 103 bp, Artificial Sequence
  Synthetic Polynucleotide
taatacgactcactatagggcactgggagctgcaggtgcgcaggaaatccaacagaggagaggatttatggcgcacctgaacctggcggcagcgcaaaagatg

SEQ ID NO: 162090 - DNA, 103 bp, Artificial Sequence
  Synthetic Polynucleotide
taatacgactcactatagggaacacttggccactgggagctgcaggtgcgaacagaggagacgcaccatgagctcccagaacctggcggcagcgcaaaagatg

SEQ ID NO: 162091 - DNA, 103 bp, Artificial Sequence
  Synthetic Polynucleotide
taatacgactcactatagggaatgatcggaaacacttggccactgggagcaacagaggagagctcccatgggccaagtgaacctggcggcagcgcaaaagatg

SEQ ID NO: 162092 - DNA, 103 bp, Artificial Sequence
  Synthetic Polynucleotide
taatacgactcactatagggagccccctggaatgatcggaaacacttggcaacagaggagagccaagatgttccgatcaaacctggcggcagcgcaaaagatg

SEQ ID NO: 162093 - DNA, 103 bp, Artificial Sequence
  Synthetic Polynucleotide
taatacgactcactatagggcgttatcacgagccccctggaatgatcggaaacagaggagatccgatatgtccagggggaacctggcggcagcgcaaaagatg

SEQ ID NO: 162094 - DNA, 103 bp, Artificial Sequence
  Synthetic Polynucleotide
taatacgactcactatagggcttccttagccgttatcacgagccccctggaacagaggagaccagggatgtcgtgataaaacctggcggcagcgcaaaagatg

SEQ ID NO: 162095 - DNA, 103 bp, Artificial Sequence
  Synthetic Polynucleotide
taatacgactcactatagggacttctaatggctgcagagtaacattttccaacagaggagaggaaaaatgtactctgcaaacctggcggcagcgcaaaagatg

SEQ ID NO: 162096 - DNA, 103 bp, Artificial Sequence
  Synthetic Polynucleotide
taatacgactcactatagggcttgctcctccttccttagccgttatcacgaacagaggagacgtgatatgggctaaggaaacctggcggcagcgcaaaagatg

SEQ ID NO: 162097 - DNA, 103 bp, Artificial Sequence
  Synthetic Polynucleotide
taatacgactcactatagggcgaatcaatacttgctcctccttccttagcaacagaggagagctaagatgggaggagcaaacctggcggcagcgcaaaagatg

SEQ ID NO: 162098 - DNA, 103 bp, Artificial Sequence
  Synthetic Polynucleotide
taatacgactcactatagggtcgaggctgacgaatcaatacttgctcctcaacagaggagagaggagatggtattgattaacctggcggcagcgcaaaagatg

SEQ ID NO: 162099 - DNA, 103 bp, Artificial Sequence
  Synthetic Polynucleotide
taatacgactcactatagggcgaaggctactcgaggctgacgaatcaataaacagaggagatattgaatggtcagcctcaacctggcggcagcgcaaaagatg

SEQ ID NO: 162100 - DNA, 103 bp, Artificial Sequence
  Synthetic Polynucleotide
taatacgactcactatagggagaaaggcatcgaaggctactcgaggctgaaacagaggagatcagccatgagtagccttaacctggcggcagcgcaaaagatg

SEQ ID NO: 162101 - DNA, 103 bp, Artificial Sequence
  Synthetic Polynucleotide
taatacgactcactatagggccacgatggaagaaaggcatcgaaggctacaacagaggagagtagccatggatgcctttaacctggcggcagcgcaaaagatg

SEQ ID NO: 162102 - DNA, 103 bp, Artificial Sequence
  Synthetic Polynucleotide
taatacgactcactataggggaaatactgtccacgatggaagaaaggcataacagaggagaatgcctatgttccatcgtaacctggcggcagcgcaaaagatg

SEQ ID NO: 162103 - DNA, 103 bp, Artificial Sequence
  Synthetic Polynucleotide
taatacgactcactatagggttcctccgaggaaatactgtccacgatggaaacagaggagatccatcatggacagtattaacctggcggcagcgcaaaagatg

SEQ ID NO: 162104 - DNA, 103 bp, Artificial Sequence
  Synthetic Polynucleotide
taatacgactcactatagggggagtttgcgttcctccgaggaaatactgtaacagaggagaacagtaatgcctcggaggaacctggcggcagcgcaaaagatg

SEQ ID NO: 162105 - DNA, 103 bp, Artificial Sequence
  Synthetic Polynucleotide
taatacgactcactatagggtccacgcaggggagtttgcgttcctccgagaacagaggagactcggaatgacgcaaactaacctggcggcagcgcaaaagatg

SEQ ID NO: 162106 - DNA, 103 bp, Artificial Sequence
  Synthetic Polynucleotide
taatacgactcactataggggccttctgccacttctaatggctgcagagtaacagaggagaactctgatgccattagaaaacctggcggcagcgcaaaagatg

SEQ ID NO: 162107 - DNA, 103 bp, Artificial Sequence
  Synthetic Polynucleotide
taatacgactcactatagggcaccacttcctccacgcaggggagtttgcgaacagaggagacgcaaaatgccctgcgtgaacctggcggcagcgcaaaagatg

SEQ ID NO: 162108 - DNA, 103 bp, Artificial Sequence
  Synthetic Polynucleotide
taatacgactcactatagggacaaaggagagccttctgccacttctaatgaacagaggagacattagatgtggcagaagaacctggcggcagcgcaaaagatg

SEQ ID NO: 162109 - DNA, 103 bp, Artificial Sequence
  Synthetic Polynucleotide
taatacgactcactatagggctccctggatacaaaggagagccttctgccaacagaggagaggcagaatgctctcctttaacctggcggcagcgcaaaagatg

SEQ ID NO: 162110 - DNA, 103 bp, Artificial Sequence
  Synthetic Polynucleotide
taatacgactcactatagggcaaggaatgctcagaccccaggagtgtcataacagaggagaatgacaatgctggggtctaacctggcggcagcgcaaaagatg

SEQ ID NO: 162111 - DNA, 103 bp, Artificial Sequence
  Synthetic Polynucleotide
taatacgactcactatagggtggtattatgccttggttagccagttgttcaacagaggagagaacaaatggctaaccaaaacctggcggcagcgcaaaagatg

SEQ ID NO: 162112 - DNA, 103 bp, Artificial Sequence
  Synthetic Polynucleotide
taatacgactcactatagggtggcgttgaagaagagtttggatttctgacaacagaggagagtcagaatgccaaactctaacctggcggcagcgcaaaagatg

SEQ ID NO: 162113 - DNA, 103 bp, Artificial Sequence
  Synthetic Polynucleotide
taatacgactcactatagggtattgctcagtggcgttgaagaagagtttgaacagaggagacaaactatgcttcaacgcaacctggcggcagcgcaaaagatg

SEQ ID NO: 162114 - DNA, 103 bp, Artificial Sequence
  Synthetic Polynucleotide
taatacgactcactataggggacaagggggtattgctcagtggcgttgaaaacagaggagattcaacatgactgagcaaaacctggcggcagcgcaaaagatg

SEQ ID NO: 162115 - DNA, 103 bp, Artificial Sequence
  Synthetic Polynucleotide
taatacgactcactatagggtttgacaggagacaagggggtattgctcagaacagaggagactgagcatgacccccttgaacctggcggcagcgcaaaagatg

SEQ ID NO: 162116 - DNA, 103 bp, Artificial Sequence
  Synthetic Polynucleotide
taatacgactcactatagggaaaaactgtttttgacaggagacaagggggaacagaggagaccccctatgctcctgtcaaacctggcggcagcgcaaaagatg

SEQ ID NO: 162117 - DNA, 103 bp, Artificial Sequence
  Synthetic Polynucleotide
taatacgactcactataggggtttgtccagaaaaactgtttttgacaggaaacagaggagatcctgtatgaaacagtttaacctggcggcagcgcaaaagatg

SEQ ID NO: 162118 - DNA, 103 bp, Artificial Sequence
  Synthetic Polynucleotide
taatacgactcactatagggagagacaccagtttgtccagaaaaactgttaacagaggagaaacagtatgtctggacaaaacctggcggcagcgcaaaagatg

SEQ ID NO: 162119 - DNA, 103 bp, Artificial Sequence
  Synthetic Polynucleotide
taatacgactcactataggggtttgaaagaagagacaccagtttgtccagaacagaggagactggacatgctggtgtctaacctggcggcagcgcaaaagatg

SEQ ID NO: 162120 - DNA, 103 bp, Artificial Sequence
  Synthetic Polynucleotide
taatacgactcactatagggagtgggcctggtttgaaagaagagacaccaaacagaggagatggtgtatgttctttcaaaacctggcggcagcgcaaaagatg

SEQ ID NO: 162121 - DNA, 103 bp, Artificial Sequence
  Synthetic Polynucleotide
taatacgactcactataggggttaggtgggagtgggcctggtttgaaagaaacagaggagatctttcatgccaggcccaaacctggcggcagcgcaaaagatg

SEQ ID NO: 162122 - DNA, 103 bp, Artificial Sequence
  Synthetic Polynucleotide
taatacgactcactataggggtttcagtggtggtattatgccttggttagaacagaggagactaaccatggcataatacaacctggcggcagcgcaaaagatg

SEQ ID NO: 162123 - DNA, 103 bp, Artificial Sequence
  Synthetic Polynucleotide
taatacgactcactataggggatcatccaggttaggtgggagtgggcctgaacagaggagacaggccatgtcccacctaaacctggcggcagcgcaaaagatg

SEQ ID NO: 162124 - DNA, 103 bp, Artificial Sequence
  Synthetic Polynucleotide
taatacgactcactataggggagaccttcagatcatccaggttaggtgggaacagaggagacccaccatgcctggatgaaacctggcggcagcgcaaaagatg

SEQ ID NO: 162125 - DNA, 103 bp, Artificial Sequence
  Synthetic Polynucleotide
taatacgactcactatagggtcttaattcagagaccttcagatcatccagaacagaggagactggatatgctgaaggtcaacctggcggcagcgcaaaagatg

SEQ ID NO: 162126 - DNA, 103 bp, Artificial Sequence
  Synthetic Polynucleotide
taatacgactcactataggggaagctgttgtcttaattcagagaccttcaaacagaggagatgaaggatgctgaattaaaacctggcggcagcgcaaaagatg

SEQ ID NO: 162127 - DNA, 103 bp, Artificial Sequence
  Synthetic Polynucleotide
taatacgactcactatagggccccgaattcgaagctgttgtcttaattcaaacagaggagatgaattatgacaacagctaacctggcggcagcgcaaaagatg

SEQ ID NO: 162128 - DNA, 103 bp, Artificial Sequence
  Synthetic Polynucleotide
taatacgactcactatagggcacaggcaagccccgaattcgaagctgttgaacagaggagacaacagatgcgaattcggaacctggcggcagcgcaaaagatg

SEQ ID NO: 162129 - DNA, 103 bp, Artificial Sequence
  Synthetic Polynucleotide
taatacgactcactatagggtggtgcctgacacaggcaagccccgaattcaacagaggagagaattcatggcttgcctgaacctggcggcagcgcaaaagatg

SEQ ID NO: 162130 - DNA, 103 bp, Artificial Sequence
  Synthetic Polynucleotide
taatacgactcactatagggagagccgttttggtgcctgacacaggcaagaacagaggagacttgccatggtcaggcacaacctggcggcagcgcaaaagatg

SEQ ID NO: 162131 - DNA, 103 bp, Artificial Sequence
  Synthetic Polynucleotide
taatacgactcactatagggccggtccatgagagccgttttggtgcctgaaacagaggagatcaggcatgaaaacggctaacctggcggcagcgcaaaagatg

SEQ ID NO: 162132 - DNA, 103 bp, Artificial Sequence
  Synthetic Polynucleotide
taatacgactcactatagggagggtcgaagccggtccatgagagccgtttaacagaggagaaaacggatgtcatggaccaacctggcggcagcgcaaaagatg

SEQ ID NO: 162133 - DNA, 103 bp, Artificial Sequence
  Synthetic Polynucleotide
taatacgactcactatagggtcagctggacgtttcagtggtggtattatgaacagaggagacataatatgaccactgaaaacctggcggcagcgcaaaagatg

SEQ ID NO: 162134 - DNA, 103 bp, Artificial Sequence
  Synthetic Polynucleotide
taatacgactcactatagggcagtcctggaagggtcgaagccggtccatgaacagaggagacatggaatggcttcgaccaacctggcggcagcgcaaaagatg

SEQ ID NO: 162135 - DNA, 103 bp, Artificial Sequence
  Synthetic Polynucleotide
taatacgactcactataggggttgccagagcagtcctggaagggtcgaagaacagaggagacttcgaatgttccaggacaacctggcggcagcgcaaaagatg

SEQ ID NO: 162136 - DNA, 103 bp, Artificial Sequence
  Synthetic Polynucleotide
taatacgactcactatagggtcggcactgggttgccagagcagtcctggaaacagaggagatccaggatggctctggcaaacctggcggcagcgcaaaagatg

SEQ ID NO: 162137 - DNA, 103 bp, Artificial Sequence
  Synthetic Polynucleotide
taatacgactcactatagggtccccaaagttcggcactgggttgccagagaacagaggagactctggatgcccagtgccaacctggcggcagcgcaaaagatg

SEQ ID NO: 162138 - DNA, 103 bp, Artificial Sequence
  Synthetic Polynucleotide
taatacgactcactatagggagtcgttatatccccaaagttcggcactggaacagaggagaccagtgatgaactttgggaacctggcggcagcgcaaaagatg

SEQ ID NO: 162139 - DNA, 103 bp, Artificial Sequence
  Synthetic Polynucleotide
taatacgactcactataggggaaaagtgacagtcgttatatccccaaagtaacagaggagaactttgatgatataacgaaacctggcggcagcgcaaaagatg

SEQ ID NO: 162140 - DNA, 103 bp, Artificial Sequence
  Synthetic Polynucleotide
taatacgactcactatagggggtgtgacaggaaaagtgacagtcgttataaacagaggagatataacatgtgtcactttaacctggcggcagcgcaaaagatg

SEQ ID NO: 162141 - DNA, 103 bp, Artificial Sequence
  Synthetic Polynucleotide
taatacgactcactatagggcagcgtgttgggtgtgacaggaaaagtgacaacagaggagagtcactatgcctgtcacaaacctggcggcagcgcaaaagatg

SEQ ID NO: 162142 - DNA, 103 bp, Artificial Sequence
  Synthetic Polynucleotide
taatacgactcactatagggggtaattgggcagcgtgttgggtgtgacagaacagaggagactgtcaatgccaacacgcaacctggcggcagcgcaaaagatg

SEQ ID NO: 162143 - DNA, 103 bp, Artificial Sequence
  Synthetic Polynucleotide
taatacgactcactataggggaggaagactggtaattgggcagcgtgttgaacagaggagacaacacatggcccaattaaacctggcggcagcgcaaaagatg

SEQ ID NO: 162144 - DNA, 103 bp, Artificial Sequence
  Synthetic Polynucleotide
taatacgactcactatagggctcatggaattcagctggacgtttcagtggaacagaggagaccactgatgcgtccagctaacctggcggcagcgcaaaagatg

SEQ ID NO: 162145 - DNA, 103 bp, Artificial Sequence
  Synthetic Polynucleotide
taatacgactcactatagggactggtagaagaggaagactggtaattgggaacagaggagacccaatatgcagtcttccaacctggcggcagcgcaaaagatg

SEQ ID NO: 162146 - DNA, 103 bp, Artificial Sequence
  Synthetic Polynucleotide
taatacgactcactatagggtggacagggcactggtagaagaggaagactaacagaggagaagtcttatgcttctaccaaacctggcggcagcgcaaaagatg

SEQ ID NO: 162147 - DNA, 103 bp, Artificial Sequence
  Synthetic Polynucleotide
taatacgactcactatagggtagaagccgttggacagggcactggtagaaaacagaggagattctacatgtgccctgtcaacctggcggcagcgcaaaagatg

SEQ ID NO: 162148 - DNA, 103 bp, Artificial Sequence
  Synthetic Polynucleotide
taatacgactcactataggggccaaagtggtagaagccgttggacagggcaacagaggagagccctgatgaacggcttcaacctggcggcagcgcaaaagatg

SEQ ID NO: 162149 - DNA, 103 bp, Artificial Sequence
  Synthetic Polynucleotide
taatacgactcactatagggagctggtgctgccaaagtggtagaagccgtaacagaggagaacggctatgaccactttgaacctggcggcagcgcaaaagatg

SEQ ID NO: 162150 - DNA, 103 bp, Artificial Sequence
  Synthetic Polynucleotide
taatacgactcactatagggggggggctggagctggtgctgccaaagtggaacagaggagaccacttatgcagcaccagaacctggcggcagcgcaaaagatg

SEQ ID NO: 162151 - DNA, 103 bp, Artificial Sequence
  Synthetic Polynucleotide
taatacgactcactatagggtggggagatcggggggctggagctggtgctaacagaggagaagcaccatgtccagccccaacctggcggcagcgcaaaagatg

SEQ ID NO: 162152 - DNA, 103 bp, Artificial Sequence
  Synthetic Polynucleotide
taatacgactcactatagggcagaggaggctggggagatcggggggctggaacagaggagaccagccatgcgatctcccaacctggcggcagcgcaaaagatg

SEQ ID NO: 162153 - DNA, 103 bp, Artificial Sequence
  Synthetic Polynucleotide
taatacgactcactatagggactgacaggtcagaggaggctggggagatcaacagaggagagatctcatgagcctcctcaacctggcggcagcgcaaaagatg

SEQ ID NO: 162154 - DNA, 103 bp, Artificial Sequence
  Synthetic Polynucleotide
taatacgactcactatagggggacccagcgactgacaggtcagaggaggcaacagaggagagcctccatggacctgtcaaacctggcggcagcgcaaaagatg

SEQ ID NO: 162155 - DNA, 103 bp, Artificial Sequence
  Synthetic Polynucleotide
taatacgactcactataggggttttctttgctcatggaattcagctggacaacagaggagagtccagatgaattccatgaacctggcggcagcgcaaaagatg

SEQ ID NO: 162156 - DNA, 103 bp, Artificial Sequence
  Synthetic Polynucleotide
taatacgactcactatagggtgtccggcagggacccagcgactgacaggtaacagaggagaacctgtatgtcgctgggtaacctggcggcagcgcaaaagatg

SEQ ID NO: 162157 - DNA, 103 bp, Artificial Sequence
  Synthetic Polynucleotide
taatacgactcactatagggtcattgaaggtgtccggcagggacccagcgaacagaggagacgctggatgcctgccggaaacctggcggcagcgcaaaagatg

SEQ ID NO: 162158 - DNA, 103 bp, Artificial Sequence
  Synthetic Polynucleotide
taatacgactcactataggggggggaggcatcattgaaggtgtccggcagaacagaggagactgccgatgaccttcaataacctggcggcagcgcaaaagatg

SEQ ID NO: 162159 - DNA, 103 bp, Artificial Sequence
  Synthetic Polynucleotide
taatacgactcactatagggggccgaaggagggggaggcatcattgaaggaacagaggagaccttcaatgatgcctcccaacctggcggcagcgcaaaagatg

SEQ ID NO: 162160 - DNA, 103 bp, Artificial Sequence
  Synthetic Polynucleotide
taatacgactcactataggggacgggtgcaggccgaaggagggggaggcaaacagaggagatgcctcatgctccttcggaacctggcggcagcgcaaaagatg

SEQ ID NO: 162161 - DNA, 103 bp, Artificial Sequence
  Synthetic Polynucleotide
taatacgactcactataggggtggactggggacgggtgcaggccgaaggaaacagaggagatccttcatgctgcacccgaacctggcggcagcgcaaaagatg

SEQ ID NO: 162162 - DNA, 103 bp, Artificial Sequence
  Synthetic Polynucleotide
taatacgactcactatagggccgtgcacacgtggactggggacgggtgcaaacagaggagatgcaccatgccccagtccaacctggcggcagcgcaaaagatg

SEQ ID NO: 162163 - DNA, 103 bp, Artificial Sequence
  Synthetic Polynucleotide
taatacgactcactatagggagactttcctccgtgcacacgtggactgggaacagaggagacccagtatgcgtgtgcacaacctggcggcagcgcaaaagatg

SEQ ID NO: 162164 - DNA, 103 bp, Artificial Sequence
  Synthetic Polynucleotide
taatacgactcactataggggctgctcatgagactttcctccgtgcacacaacagaggagagtgtgcatggaggaaagtaacctggcggcagcgcaaaagatg

SEQ ID NO: 162165 - DNA, 103 bp, Artificial Sequence
  Synthetic Polynucleotide
taatacgactcactatagggccccattcaggctgctcatgagactttcctaacagaggagaaggaaaatgtcatgagcaaacctggcggcagcgcaaaagatg

SEQ ID NO: 162166 - DNA, 103 bp, Artificial Sequence
  Synthetic Polynucleotide
taatacgactcactatagggctatccaaatgttttctttgctcatggaataacagaggagaattccaatggcaaagaaaaacctggcggcagcgcaaaagatg

SEQ ID NO: 162167 - DNA, 103 bp, Artificial Sequence
  Synthetic Polynucleotide
taatacgactcactatagggggaacagagcccccattcaggctgctcatgaacagaggagacatgagatgcctgaatggaacctggcggcagcgcaaaagatg

SEQ ID NO: 162168 - DNA, 103 bp, Artificial Sequence
  Synthetic Polynucleotide
taatacgactcactatagggcagctcagaaggaacagagcccccattcagaacagaggagactgaatatgggctctgttaacctggcggcagcgcaaaagatg

SEQ ID NO: 162169 - DNA, 103 bp, Artificial Sequence
  Synthetic Polynucleotide
taatacgactcactatagggccagcccatccagctcagaaggaacagagcaacagaggagagctctgatgcttctgagcaacctggcggcagcgcaaaagatg

SEQ ID NO: 162170 - DNA, 103 bp, Artificial Sequence
  Synthetic Polynucleotide
taatacgactcactatagggttctcggagtccagcccatccagctcagaaaacagaggagattctgaatgggatgggctaacctggcggcagcgcaaaagatg

SEQ ID NO: 162171 - DNA, 103 bp, Artificial Sequence
  Synthetic Polynucleotide
taatacgactcactatagggcatcttgtccttctcggagtccagcccatcaacagaggagagatgggatggactccgagaacctggcggcagcgcaaaagatg

SEQ ID NO: 162172 - DNA, 103 bp, Artificial Sequence
  Synthetic Polynucleotide
taatacgactcactatagggtctccaccagcatcttgtccttctcggagtaacagaggagaactccgatgaggacaagaaacctggcggcagcgcaaaagatg

SEQ ID NO: 162173 - DNA, 103 bp, Artificial Sequence
  Synthetic Polynucleotide
taatacgactcactatagggaccttctgcttctccaccagcatcttgtccaacagaggagaggacaaatggctggtggaaacctggcggcagcgcaaaagatg

SEQ ID NO: 162174 - DNA, 103 bp, Artificial Sequence
  Synthetic Polynucleotide
taatacgactcactatagggttcattgatcaccttctgcttctccaccagaacagaggagactggtgatgaagcagaagaacctggcggcagcgcaaaagatg

SEQ ID NO: 162175 - DNA, 103 bp, Artificial Sequence
  Synthetic Polynucleotide
taatacgactcactatagggtccaggtgagttcattgatcaccttctgctaacagaggagaagcagaatgtgatcaatgaacctggcggcagcgcaaaagatg

SEQ ID NO: 162176 - DNA, 103 bp, Artificial Sequence
  Synthetic Polynucleotide
taatacgactcactatagggtgctggagtttccaggtgagttcattgatcaacagaggagagatcaaatgactcacctgaacctggcggcagcgcaaaagatg

SEQ ID NO: 162177 - DNA, 103 bp, Artificial Sequence
  Synthetic Polynucleotide
taatacgactcactatagggagccttgtcactatccaaatgttttctttgaacagaggagacaaagaatgcatttggataacctggcggcagcgcaaaagatg

SEQ ID NO: 162178 - DNA, 103 bp, Artificial Sequence
  Synthetic Polynucleotide
taatacgactcactatagggcctctgctcttgctggagtttccaggtgagaacagaggagactcaccatgaaactccagaacctggcggcagcgcaaaagatg

SEQ ID NO: 162179 - DNA, 103 bp, Artificial Sequence
  Synthetic Polynucleotide
taatacgactcactatagggcctccacctgcctctgctcttgctggagttaacagaggagaaactccatgaagagcagaaacctggcggcagcgcaaaagatg

SEQ ID NO: 162180 - DNA, 103 bp, Artificial Sequence
  Synthetic Polynucleotide
taatacgactcactatagggatcctcagctcctccacctgcctctgctctaacagaggagaagagcaatggcaggtggaaacctggcggcagcgcaaaagatg

SEQ ID NO: 162181 - DNA, 103 bp, Artificial Sequence
  Synthetic Polynucleotide
taatacgactcactatagggctgaagctgcatcctcagctcctccacctgaacagaggagacaggtgatggagctgaggaacctggcggcagcgcaaaagatg

SEQ ID NO: 162182 - DNA, 103 bp, Artificial Sequence
  Synthetic Polynucleotide
taatacgactcactatagggttttctgcttctgaagctgcatcctcagctaacagaggagaagctgaatgtgcagcttcaacctggcggcagcgcaaaagatg

SEQ ID NO: 162183 - DNA, 103 bp, Artificial Sequence
  Synthetic Polynucleotide
taatacgactcactatagggcagttattccttttctgcttctgaagctgcaacagaggagagcagctatggaagcagaaaacctggcggcagcgcaaaagatg

SEQ ID NO: 162184 - DNA, 103 bp, Artificial Sequence
  Synthetic Polynucleotide
taatacgactcactatagggcttctctgaacagttattccttttctgcttaacagaggagaaagcagatgaggaataacaacctggcggcagcgcaaaagatg

SEQ ID NO: 162185 - DNA, 103 bp, Artificial Sequence
  Synthetic Polynucleotide
taatacgactcactataggggcagcggcttcttctctgaacagttattccaacagaggagaggaataatggttcagagaaacctggcggcagcgcaaaagatg

SEQ ID NO: 162186 - DNA, 103 bp, Artificial Sequence
  Synthetic Polynucleotide
taatacgactcactataggggccaggaaaggcagcggcttcttctctgaaaacagaggagattcagaatggaagccgctaacctggcggcagcgcaaaagatg

SEQ ID NO: 162187 - DNA, 103 bp, Artificial Sequence
  Synthetic Polynucleotide
taatacgactcactataggggatggaggcagccaggaaaggcagcggcttaacagaggagaaagccgatgcctttcctgaacctggcggcagcgcaaaagatg

SEQ ID NO: 162188 - DNA, 103 bp, Artificial Sequence
  Synthetic Polynucleotide
taatacgactcactataggggggaatttttagccttgtcactatccaaataacagaggagaatttggatggtgacaaggaacctggcggcagcgcaaaagatg

SEQ ID NO: 162189 - DNA, 103 bp, Artificial Sequence
  Synthetic Polynucleotide
taatacgactcactatagggcttcctgcttgatggaggcagccaggaaagaacagaggagactttccatgctgcctccaaacctggcggcagcgcaaaagatg

SEQ ID NO: 162190 - DNA, 103 bp, Artificial Sequence
  Synthetic Polynucleotide
taatacgactcactataggggagacagcctcttcctgcttgatggaggcaaacagaggagatgcctcatgcaagcaggaaacctggcggcagcgcaaaagatg

SEQ ID NO: 162191 - DNA, 103 bp, Artificial Sequence
  Synthetic Polynucleotide
taatacgactcactatagggaggacagctggagacagcctcttcctgcttaacagaggagaaagcagatggaggctgtcaacctggcggcagcgcaaaagatg

SEQ ID NO: 162192 - DNA, 103 bp, Artificial Sequence
  Synthetic Polynucleotide
taatacgactcactataggggggatgcaaaaggacagctggagacagcctaacagaggagaaggctgatgccagctgtcaacctggcggcagcgcaaaagatg

SEQ ID NO: 162193 - DNA, 103 bp, Artificial Sequence
  Synthetic Polynucleotide
taatacgactcactatagggacaggtacttgggatgcaaaaggacagctgaacagaggagacagctgatgttttgcatcaacctggcggcagcgcaaaagatg

SEQ ID NO: 162194 - DNA, 103 bp, Artificial Sequence
  Synthetic Polynucleotide
taatacgactcactatagggttgtcttttcacaggtacttgggatgcaaaaacagaggagatttgcaatgcaagtacctaacctggcggcagcgcaaaagatg

SEQ ID NO: 162195 - DNA, 103 bp, Artificial Sequence
  Synthetic Polynucleotide
taatacgactcactatagggagctgctgctttgtcttttcacaggtacttaacagaggagaaagtacatgtgaaaagacaacctggcggcagcgcaaaagatg

SEQ ID NO: 162196 - DNA, 103 bp, Artificial Sequence
  Synthetic Polynucleotide
taatacgactcactatagggtgacactctgagctgctgctttgtcttttcaacagaggagagaaaagatgaagcagcagaacctggcggcagcgcaaaagatg

SEQ ID NO: 162197 - DNA, 103 bp, Artificial Sequence
  Synthetic Polynucleotide
taatacgactcactatagggagccggtgggtgacactctgagctgctgctaacagaggagaagcagcatgtcagagtgtaacctggcggcagcgcaaaagatg

SEQ ID NO: 162198 - DNA, 103 bp, Artificial Sequence
  Synthetic Polynucleotide
taatacgactcactatagggcagcttcacaagccggtgggtgacactctgaacagaggagacagagtatgacccaccggaacctggcggcagcgcaaaagatg

SEQ ID NO: 162199 - DNA, 103 bp, Artificial Sequence
  Synthetic Polynucleotide
taatacgactcactatagggttgcgcttcagggaatttttagccttgtcaaacagaggagatgacaaatgtaaaaattcaacctggcggcagcgcaaaagatg

SEQ ID NO: 162200 - DNA, 103 bp, Artificial Sequence
  Synthetic Polynucleotide
taatacgactcactatagggtggagttgagcagcttcacaagccggtgggaacagaggagacccaccatgttgtgaagcaacctggcggcagcgcaaaagatg

SEQ ID NO: 162201 - DNA, 103 bp, Artificial Sequence
  Synthetic Polynucleotide
taatacgactcactatagggtccaagaggctggagttgagcagcttcacaaacagaggagatgtgaaatggctcaactcaacctggcggcagcgcaaaagatg

SEQ ID NO: 162202 - DNA, 103 bp, Artificial Sequence
  Synthetic Polynucleotide
taatacgactcactatagggaatgagcatttccaagaggctggagttgagaacagaggagactcaacatgagcctcttgaacctggcggcagcgcaaaagatg

SEQ ID NO: 162203 - DNA, 103 bp, Artificial Sequence
  Synthetic Polynucleotide
taatacgactcactataggggactccacacaatgagcatttccaagaggcaacagaggagagcctctatgaaatgctcaaacctggcggcagcgcaaaagatg

SEQ ID NO: 162204 - DNA, 103 bp, Artificial Sequence
  Synthetic Polynucleotide
taatacgactcactatagggttgatctgaggactccacacaatgagcattaacagaggagaaatgctatgtgtgtggagaacctggcggcagcgcaaaagatg

SEQ ID NO: 162205 - DNA, 103 bp, Artificial Sequence
  Synthetic Polynucleotide
taatacgactcactataggggtacattggtttgatctgaggactccacacaacagaggagagtgtggatgcctcagatcaacctggcggcagcgcaaaagatg

SEQ ID NO: 162206 - DNA, 103 bp, Artificial Sequence
  Synthetic Polynucleotide
taatacgactcactataggggtggaagaaagtacattggtttgatctgagaacagaggagactcagaatgaaccaatgtaacctggcggcagcgcaaaagatg

SEQ ID NO: 162207 - DNA, 103 bp, Artificial Sequence
  Synthetic Polynucleotide
taatacgactcactataggggctgagaaatgtggaagaaagtacattggtaacagaggagaaccaatatgctttcttccaacctggcggcagcgcaaaagatg

SEQ ID NO: 162208 - DNA, 103 bp, Artificial Sequence
  Synthetic Polynucleotide
taatacgactcactatagggaacactgggggctgagaaatgtggaagaaaaacagaggagatttcttatgcatttctcaaacctggcggcagcgcaaaagatg

SEQ ID NO: 162209 - DNA, 103 bp, Artificial Sequence
  Synthetic Polynucleotide
taatacgactcactatagggtgctgaggggaacactgggggctgagaaataacagaggagaatttctatgcccccagtgaacctggcggcagcgcaaaagatg

SEQ ID NO: 162210 - DNA, 103 bp, Artificial Sequence
  Synthetic Polynucleotide
taatacgactcactataggggtttctggctttgcgcttcagggaatttttaacagaggagaaaaaatatgctgaagcgcaacctggcggcagcgcaaaagatg

SEQ ID NO: 162211 - DNA, 103 bp, Artificial Sequence
  Synthetic Polynucleotide
taatacgactcactatagggcagcggtgaatgctgaggggaacactggggaacagaggagaccccagatgtcccctcagaacctggcggcagcgcaaaagatg

SEQ ID NO: 162212 - DNA, 103 bp, Artificial Sequence
  Synthetic Polynucleotide
taatacgactcactatagggtcacagcccccagcggtgaatgctgaggggaacagaggagacccctcatgattcaccgcaacctggcggcagcgcaaaagatg

SEQ ID NO: 162213 - DNA, 103 bp, Artificial Sequence
  Synthetic Polynucleotide
taatacgactcactatagggtgtgggcttttcacagcccccagcggtgaaaacagaggagattcaccatggggggctgtaacctggcggcagcgcaaaagatg

SEQ ID NO: 162214 - DNA, 103 bp, Artificial Sequence
  Synthetic Polynucleotide
taatacgactcactatagggactgatgtgctgtgggcttttcacagccccaacagaggagaggggctatgaaaagcccaaacctggcggcagcgcaaaagatg

SEQ ID NO: 162215 - DNA, 103 bp, Artificial Sequence
  Synthetic Polynucleotide
taatacgactcactatagggatgggggcaaactgatgtgctgtgggctttaacagaggagaaaagccatgagcacatcaaacctggcggcagcgcaaaagatg

SEQ ID NO: 162216 - DNA, 103 bp, Artificial Sequence
  Synthetic Polynucleotide
taatacgactcactatagggttgttgggtgatgggggcaaactgatgtgcaacagaggagagcacatatgtttgcccccaacctggcggcagcgcaaaagatg

SEQ ID NO: 162217 - DNA, 103 bp, Artificial Sequence
  Synthetic Polynucleotide
taatacgactcactatagggaaagtgagggttgttgggtgatgggggcaaaacagaggagattgcccatgtcacccaacaacctggcggcagcgcaaaagatg

SEQ ID NO: 162218 - DNA, 103 bp, Artificial Sequence
  Synthetic Polynucleotide
taatacgactcactatagggatgagggcagaaagtgagggttgttgggtgaacagaggagacacccaatgaccctcactaacctggcggcagcgcaaaagatg

SEQ ID NO: 162219 - DNA, 103 bp, Artificial Sequence
  Synthetic Polynucleotide
taatacgactcactataggggccccggaggatgagggcagaaagtgagggaacagaggagaccctcaatgtctgccctcaacctggcggcagcgcaaaagatg

SEQ ID NO: 162220 - DNA, 103 bp, Artificial Sequence
  Synthetic Polynucleotide
taatacgactcactatagggttctccctgggccccggaggatgagggcagaacagaggagactgcccatgtcctccgggaacctggcggcagcgcaaaagatg

SEQ ID NO: 162221 - DNA, 103 bp, Artificial Sequence
  Synthetic Polynucleotide
taatacgactcactatagggtcctaatcagcaaggaatgctcagaccccaaacagaggagatggggtatgagcattcctaacctggcggcagcgcaaaagatg

SEQ ID NO: 162222 - DNA, 103 bp, Artificial Sequence
  Synthetic Polynucleotide
taatacgactcactatagggtgttgcacctgtttctggctttgcgcttcaaacagaggagatgaagcatgaagccagaaaacctggcggcagcgcaaaagatg

SEQ ID NO: 162223 - DNA, 103 bp, Artificial Sequence
  Synthetic Polynucleotide
taatacgactcactatagggccctgtgcccttctccctgggccccggaggaacagaggagacctccgatgcccagggagaacctggcggcagcgcaaaagatg

SEQ ID NO: 162224 - DNA, 103 bp, Artificial Sequence
  Synthetic Polynucleotide
taatacgactcactatagggggcgaggagaccctgtgcccttctccctggaacagaggagaccagggatgagggcacagaacctggcggcagcgcaaaagatg

SEQ ID NO: 162225 - DNA, 103 bp, Artificial Sequence
  Synthetic Polynucleotide
taatacgactcactataggggctgctgatgggcgaggagaccctgtgcccaacagaggagagggcacatggtctcctcgaacctggcggcagcgcaaaagatg

SEQ ID NO: 162226 - DNA, 103 bp, Artificial Sequence
  Synthetic Polynucleotide
taatacgactcactatagggtgcacacctggctgctgatgggcgaggagaaacagaggagatctcctatgccatcagcaaacctggcggcagcgcaaaagatg

SEQ ID NO: 162227 - DNA, 103 bp, Artificial Sequence
  Synthetic Polynucleotide
taatacgactcactatagggatctgtgcagtgcacacctggctgctgatgaacagaggagacatcagatgccaggtgtgaacctggcggcagcgcaaaagatg

SEQ ID NO: 162228 - DNA, 103 bp, Artificial Sequence
  Synthetic Polynucleotide
taatacgactcactatagggtaaaccagccatctgtgcagtgcacacctgaacagaggagacaggtgatgactgcacagaacctggcggcagcgcaaaagatg

SEQ ID NO: 162229 - DNA, 103 bp, Artificial Sequence
  Synthetic Polynucleotide
taatacgactcactatagggcagaagagtgtaaaccagccatctgtgcagaacagaggagactgcacatgtggctggttaacctggcggcagcgcaaaagatg

SEQ ID NO: 162230 - DNA, 103 bp, Artificial Sequence
  Synthetic Polynucleotide
taatacgactcactatagggcccaccttatcagaagagtgtaaaccagccaacagaggagaggctggatgacactcttcaacctggcggcagcgcaaaagatg

SEQ ID NO: 162231 - DNA, 103 bp, Artificial Sequence
  Synthetic Polynucleotide
taatacgactcactatagggaaactttggccccaccttatcagaagagtgaacagaggagacactctatggataaggtgaacctggcggcagcgcaaaagatg

SEQ ID NO: 162232 - DNA, 103 bp, Artificial Sequence
  Synthetic Polynucleotide
taatacgactcactatagggatggaattgaaaactttggccccaccttataacagaggagaataaggatgggccaaagtaacctggcggcagcgcaaaagatg

SEQ ID NO: 162233 - DNA, 103 bp, Artificial Sequence
  Synthetic Polynucleotide
taatacgactcactatagggaagtcggcactgttgcacctgtttctggctaacagaggagaagccagatgcaggtgcaaaacctggcggcagcgcaaaagatg

SEQ ID NO: 162234 - DNA, 103 bp, Artificial Sequence
  Synthetic Polynucleotide
taatacgactcactatagggaaagttggggatggaattgaaaactttggcaacagaggagagccaaaatgttcaattccaacctggcggcagcgcaaaagatg

SEQ ID NO: 162235 - DNA, 103 bp, Artificial Sequence
  Synthetic Polynucleotide
taatacgactcactatagggtgacttagaaaaagttggggatggaattgaaacagaggagatcaattatgtccccaactaacctggcggcagcgcaaaagatg

SEQ ID NO: 162236 - DNA, 103 bp, Artificial Sequence
  Synthetic Polynucleotide
taatacgactcactatagggttgctgaacttgacttagaaaaagttggggaacagaggagaccccaaatgtttctaagtaacctggcggcagcgcaaaagatg

SEQ ID NO: 162237 - DNA, 103 bp, Artificial Sequence
  Synthetic Polynucleotide
taatacgactcactatagggacctctgaaattgctgaacttgacttagaaaacagaggagattctaaatgaagttcagcaacctggcggcagcgcaaaagatg

SEQ ID NO: 162238 - DNA, 103 bp, Artificial Sequence
  Synthetic Polynucleotide
taatacgactcactatagggaggctgtgttacctctgaaattgctgaactaacagaggagaagttcaatgatttcagagaacctggcggcagcgcaaaagatg

SEQ ID NO: 162239 - DNA, 103 bp, Artificial Sequence
  Synthetic Polynucleotide
taatacgactcactatagggcataggatggaggctgtgttacctctgaaaaacagaggagatttcagatgtaacacagcaacctggcggcagcgcaaaagatg

SEQ ID NO: 162240 - DNA, 103 bp, Artificial Sequence
  Synthetic Polynucleotide
taatacgactcactatagggacggcatcttcataggatggaggctgtgttaacagaggagaaacacaatgtccatcctaaacctggcggcagcgcaaaagatg

SEQ ID NO: 162241 - DNA, 103 bp, Artificial Sequence
  Synthetic Polynucleotide
taatacgactcactatagggttgctgctttacggcatcttcataggatggaacagaggagaccatccatggaagatgccaacctggcggcagcgcaaaagatg

SEQ ID NO: 162242 - DNA, 103 bp, Artificial Sequence
  Synthetic Polynucleotide
taatacgactcactatagggtccgggtcatttgctgctttacggcatcttaacagaggagaaagatgatgtaaagcagcaacctggcggcagcgcaaaagatg

SEQ ID NO: 162243 - DNA, 103 bp, Artificial Sequence
  Synthetic Polynucleotide
taatacgactcactatagggatctgctgactccgggtcatttgctgctttaacagaggagaaaagcaatgaatgacccgaacctggcggcagcgcaaaagatg

SEQ ID NO: 162244 - DNA, 103 bp, Artificial Sequence
  Synthetic Polynucleotide
taatacgactcactatagggcatattaaccaagtcggcactgttgcacctaacagaggagaaggtgcatgagtgccgacaacctggcggcagcgcaaaagatg

SEQ ID NO: 162245 - DNA, 103 bp, Artificial Sequence
  Synthetic Polynucleotide
taatacgactcactataggggagttcatccatctgctgactccgggtcataacagaggagaatgaccatgagtcagcagaacctggcggcagcgcaaaagatg

SEQ ID NO: 162246 - DNA, 103 bp, Artificial Sequence
  Synthetic Polynucleotide
taatacgactcactataggggcacgtccaggagttcatccatctgctgacaacagaggagagtcagcatgtggatgaacaacctggcggcagcgcaaaagatg

SEQ ID NO: 162247 - DNA, 103 bp, Artificial Sequence
  Synthetic Polynucleotide
taatacgactcactatagggctttcaataagcacgtccaggagttcatccaacagaggagaggatgaatgcctggacgtaacctggcggcagcgcaaaagatg

SEQ ID NO: 162248 - DNA, 103 bp, Artificial Sequence
  Synthetic Polynucleotide
taatacgactcactatagggcatttctccgctttcaataagcacgtccagaacagaggagactggacatgcttattgaaaacctggcggcagcgcaaaagatg

SEQ ID NO: 162249 - DNA, 103 bp, Artificial Sequence
  Synthetic Polynucleotide
taatacgactcactatagggcgtctgctggcatttctccgctttcaataaaacagaggagattattgatggcggagaaaaacctggcggcagcgcaaaagatg

SEQ ID NO: 162250 - DNA, 103 bp, Artificial Sequence
  Synthetic Polynucleotide
taatacgactcactatagggtcctctctagcgtctgctggcatttctccgaacagaggagacggagaatggccagcagaaacctggcggcagcgcaaaagatg

SEQ ID NO: 162251 - DNA, 103 bp, Artificial Sequence
  Synthetic Polynucleotide
taatacgactcactatagggacatgagtgatcctctctagcgtctgctggaacagaggagaccagcaatggctagagagaacctggcggcagcgcaaaagatg

SEQ ID NO: 162252 - DNA, 103 bp, Artificial Sequence
  Synthetic Polynucleotide
taatacgactcactatagggctttttgaagacatgagtgatcctctctagaacagaggagactagagatgatcactcataacctggcggcagcgcaaaagatg

SEQ ID NO: 162253 - DNA, 103 bp, Artificial Sequence
  Synthetic Polynucleotide
taatacgactcactatagggatctttgggactttttgaagacatgagtgaaacagaggagatcactcatgtcttcaaaaaacctggcggcagcgcaaaagatg

SEQ ID NO: 162254 - DNA, 103 bp, Artificial Sequence
  Synthetic Polynucleotide
taatacgactcactatagggagatctgggtatctttgggactttttgaagaacagaggagacttcaaatggtcccaaagaacctggcggcagcgcaaaagatg

SEQ ID NO: 162255 - DNA, 103 bp, Artificial Sequence
  Synthetic Polynucleotide
taatacgactcactatagggggagtatgtgcatattaaccaagtcggcacaacagaggagagtgccgatgtggttaataaacctggcggcagcgcaaaagatg

SEQ ID NO: 162256 - DNA, 103 bp, Artificial Sequence
  Synthetic Polynucleotide
taatacgactcactataggggacttcgggaagatctgggtatctttgggaaacagaggagatcccaaatgtacccagataacctggcggcagcgcaaaagatg

SEQ ID NO: 162257 - DNA, 103 bp, Artificial Sequence
  Synthetic Polynucleotide
taatacgactcactatagggacagcagttggacttcgggaagatctgggtaacagaggagaacccagatgttcccgaagaacctggcggcagcgcaaaagatg

SEQ ID NO: 162258 - DNA, 103 bp, Artificial Sequence
  Synthetic Polynucleotide
taatacgactcactatagggcttggtgaggacagcagttggacttcgggaaacagaggagatcccgaatgccaactgctaacctggcggcagcgcaaaagatg

SEQ ID NO: 162259 - DNA, 103 bp, Artificial Sequence
  Synthetic Polynucleotide
taatacgactcactatagggaagccgagggcttggtgaggacagcagttgaacagaggagacaactgatgtcctcaccaaacctggcggcagcgcaaaagatg

SEQ ID NO: 162260 - DNA, 103 bp, Artificial Sequence
  Synthetic Polynucleotide
taatacgactcactatagggtgttcaaaggaagccgagggcttggtgaggaacagaggagacctcacatggccctcggcaacctggcggcagcgcaaaagatg

SEQ ID NO: 162261 - DNA, 103 bp, Artificial Sequence
  Synthetic Polynucleotide
taatacgactcactatagggtgaagaggcttgttcaaaggaagccgagggaacagaggagaccctcgatgtcctttgaaaacctggcggcagcgcaaaagatg

SEQ ID NO: 162262 - DNA, 103 bp, Artificial Sequence
  Synthetic Polynucleotide
taatacgactcactatagggtctggctgcctgaagaggcttgttcaaaggaacagaggagacctttgatgaagcctcttaacctggcggcagcgcaaaagatg

SEQ ID NO: 162263 - DNA, 103 bp, Artificial Sequence
  Synthetic Polynucleotide
taatacgactcactatagggtcaaaggggatctggctgcctgaagaggctaacagaggagaagcctcatgaggcagccaaacctggcggcagcgcaaaagatg

SEQ ID NO: 162264 - DNA, 103 bp, Artificial Sequence
  Synthetic Polynucleotide
taatacgactcactatagggggcatagggatcaaaggggatctggctgccaacagaggagaggcagcatgatcccctttaacctggcggcagcgcaaaagatg

SEQ ID NO: 162265 - DNA, 103 bp, Artificial Sequence
  Synthetic Polynucleotide
taatacgactcactatagggcactgtcggtggcatagggatcaaaggggaaacagaggagatcccctatgatccctatgaacctggcggcagcgcaaaagatg

SEQ ID NO: 162266 - DNA, 103 bp, Artificial Sequence
  Synthetic Polynucleotide
taatacgactcactataggggtggaagcttggagtatgtgcatattaaccaacagaggagaggttaaatggcacatactaacctggcggcagcgcaaaagatg

SEQ ID NO: 162267 - DNA, 103 bp, Artificial Sequence
  Synthetic Polynucleotide
taatacgactcactatagggagatgctcatcactgtcggtggcatagggaaacagaggagatccctaatgcaccgacagaacctggcggcagcgcaaaagatg

SEQ ID NO: 162268 - DNA, 103 bp, Artificial Sequence
  Synthetic Polynucleotide
taatacgactcactatagggtaagacttcaagatgctcatcactgtcggtaacagaggagaaccgacatggatgagcataacctggcggcagcgcaaaagatg

SEQ ID NO: 162269 - DNA, 103 bp, Artificial Sequence
  Synthetic Polynucleotide
taatacgactcactataggggggaatttaataagacttcaagatgctcataacagaggagaatgagcatgttgaagtctaacctggcggcagcgcaaaagatg

SEQ ID NO: 162270 - DNA, 103 bp, Artificial Sequence
  Synthetic Polynucleotide
taatacgactcactatagggagggggctctgggaatttaataagacttcaaacagaggagatgaagtatgattaaattcaacctggcggcagcgcaaaagatg

SEQ ID NO: 162271 - DNA, 103 bp, Artificial Sequence
  Synthetic Polynucleotide
taatacgactcactatagggcatctttcctagggggctctgggaatttaaaacagaggagattaaatatgcagagccccaacctggcggcagcgcaaaagatg

SEQ ID NO: 162272 - DNA, 103 bp, Artificial Sequence
  Synthetic Polynucleotide
taatacgactcactatagggtgacatcactcatctttcctagggggctctaacagaggagaagagccatgtaggaaagaaacctggcggcagcgcaaaagatg

SEQ ID NO: 162273 - DNA, 103 bp, Artificial Sequence
  Synthetic Polynucleotide
taatacgactcactatagggtttagaagggtgacatcactcatctttcctaacagaggagaaggaaaatggagtgatgtaacctggcggcagcgcaaaagatg

SEQ ID NO: 162274 - DNA, 103 bp, Artificial Sequence
  Synthetic Polynucleotide
taatacgactcactataggggctcccaatttttagaagggtgacatcactaacagaggagaagtgatatgacccttctaaacctggcggcagcgcaaaagatg

SEQ ID NO: 162275 - DNA, 103 bp, Artificial Sequence
  Synthetic Polynucleotide
taatacgactcactataggggaggctcttcgctcccaatttttagaagggaacagaggagacccttcatgaaattgggaaacctggcggcagcgcaaaagatg

SEQ ID NO: 162276 - DNA, 103 bp, Artificial Sequence
  Synthetic Polynucleotide
taatacgactcactatagggccatcaaagtgaggctcttcgctcccaattaacagaggagaaattggatgcgaagagccaacctggcggcagcgcaaaagatg

SEQ ID NO: 162277 - DNA, 103 bp, Artificial Sequence
  Synthetic Polynucleotide
taatacgactcactatagggcctctctgcagtggaagcttggagtatgtgaacagaggagacacataatgcaagcttccaacctggcggcagcgcaaaagatg

SEQ ID NO: 162278 - DNA, 103 bp, Artificial Sequence
  Synthetic Polynucleotide
taatacgactcactatagggatccattatcccatcaaagtgaggctcttcaacagaggagagaagagatgcactttgataacctggcggcagcgcaaaagatg

SEQ ID NO: 162279 - DNA, 103 bp, Artificial Sequence
  Synthetic Polynucleotide
taatacgactcactatagggcagagaatccatccattatcccatcaaagtaacagaggagaactttgatgggataatggaacctggcggcagcgcaaaagatg

SEQ ID NO: 162280 - DNA, 103 bp, Artificial Sequence
  Synthetic Polynucleotide
taatacgactcactataggggcagccttcccagagaatccatccattatcaacagaggagagataatatgtggattctcaacctggcggcagcgcaaaagatg

SEQ ID NO: 162281 - DNA, 103 bp, Artificial Sequence
  Synthetic Polynucleotide
taatacgactcactataggggaggtcttctgcagccttcccagagaatccaacagaggagaggattcatggggaaggctaacctggcggcagcgcaaaagatg

SEQ ID NO: 162282 - DNA, 103 bp, Artificial Sequence
  Synthetic Polynucleotide
taatacgactcactataggggtgcattgaagaggtcttctgcagccttccaacagaggagaggaaggatgcagaagaccaacctggcggcagcgcaaaagatg

SEQ ID NO: 162283 - DNA, 103 bp, Artificial Sequence
  Synthetic Polynucleotide
taatacgactcactatagggaagatctcatgtgcattgaagaggtcttctaacagaggagaagaagaatgcttcaatgcaacctggcggcagcgcaaaagatg

SEQ ID NO: 162284 - DNA, 103 bp, Artificial Sequence
  Synthetic Polynucleotide
taatacgactcactatagggggggcctggcaagatctcatgtgcattgaaaacagaggagattcaatatgcatgagatcaacctggcggcagcgcaaaagatg

SEQ ID NO: 162285 - DNA, 103 bp, Artificial Sequence
  Synthetic Polynucleotide
taatacgactcactatagggttggagagagggggcctggcaagatctcataacagaggagaatgagaatgtgccaggccaacctggcggcagcgcaaaagatg

SEQ ID NO: 162286 - DNA, 103 bp, Artificial Sequence
  Synthetic Polynucleotide
taatacgactcactatagggtgtgtctgcattggagagagggggcctggcaacagaggagagccaggatgcctctctccaacctggcggcagcgcaaaagatg

SEQ ID NO: 162287 - DNA, 103 bp, Artificial Sequence
  Synthetic Polynucleotide
taatacgactcactataggggggtgaaaactgtgtctgcattggagagagaacagaggagactctctatgatgcagacaaacctggcggcagcgcaaaagatg

SEQ ID NO: 162288 - DNA, 103 bp, Artificial Sequence
  Synthetic Polynucleotide
taatacgactcactatagggttggaatggacctctctgcagtggaagcttaacagaggagaaagcttatgctgcagagaaacctggcggcagcgcaaaagatg

SEQ ID NO: 162289 - DNA, 103 bp, Artificial Sequence
  Synthetic Polynucleotide
taatacgactcactatagggccacagaagagggtgaaaactgtgtctgcaaacagaggagatgcagaatgagttttcacaacctggcggcagcgcaaaagatg

SEQ ID NO: 162290 - DNA, 103 bp, Artificial Sequence
  Synthetic Polynucleotide
taatacgactcactatagggccattgctgtccacagaagagggtgaaaacaacagaggagagttttcatgctcttctgtaacctggcggcagcgcaaaagatg

SEQ ID NO: 162291 - DNA, 103 bp, Artificial Sequence
  Synthetic Polynucleotide
taatacgactcactatagggtaactgcagcccattgctgtccacagaagaaacagaggagatcttctatggacagcaataacctggcggcagcgcaaaagatg

SEQ ID NO: 162292 - DNA, 103 bp, Artificial Sequence
  Synthetic Polynucleotide
taatacgactcactatagggcagtgaagcttaactgcagcccattgctgtaacagaggagaacagcaatgggctgcagtaacctggcggcagcgcaaaagatg

SEQ ID NO: 162293 - DNA, 103 bp, Artificial Sequence
  Synthetic Polynucleotide
taatacgactcactatagggcagggagattcagtgaagcttaactgcagcaacagaggagagctgcaatgaagcttcacaacctggcggcagcgcaaaagatg

SEQ ID NO: 162294 - DNA, 103 bp, Artificial Sequence
  Synthetic Polynucleotide
taatacgactcactatagggcatggtttcccagggagattcagtgaagctaacagaggagaagcttcatggaatctcccaacctggcggcagcgcaaaagatg

SEQ ID NO: 162295 - DNA, 103 bp, Artificial Sequence
  Synthetic Polynucleotide
taatacgactcactatagggccagccactccatggtttcccagggagattaacagaggagaaatctcatggggaaaccaaacctggcggcagcgcaaaagatg

SEQ ID NO: 162296 - DNA, 103 bp, Artificial Sequence
  Synthetic Polynucleotide
taatacgactcactatagggggagtgaggtccagccactccatggtttccaacagaggagaggaaacatgggagtggctaacctggcggcagcgcaaaagatg

SEQ ID NO: 162297 - DNA, 103 bp, Artificial Sequence
  Synthetic Polynucleotide
taatacgactcactatagggggaatttggcggagtgaggtccagccactcaacagaggagagagtggatggacctcactaacctggcggcagcgcaaaagatg

SEQ ID NO: 162298 - DNA, 103 bp, Artificial Sequence
  Synthetic Polynucleotide
taatacgactcactatagggagcctggtgtggaatttggcggagtgaggtaacagaggagaacctcaatgcgccaaattaacctggcggcagcgcaaaagatg

SEQ ID NO: 162299 - DNA, 103 bp, Artificial Sequence
  Synthetic Polynucleotide
taatacgactcactatagggatctgagcagttggaatggacctctctgcaaacagaggagatgcagaatggtccattccaacctggcggcagcgcaaaagatg

SEQ ID NO: 162300 - DNA, 103 bp, Artificial Sequence
  Synthetic Polynucleotide
taatacgactcactatagggagggcgctaaagcctggtgtggaatttggcaacagaggagagccaaaatgcacaccaggaacctggcggcagcgcaaaagatg

SEQ ID NO: 162301 - DNA, 103 bp, Artificial Sequence
  Synthetic Polynucleotide
taatacgactcactataggggctggtggtgagggcgctaaagcctggtgtaacagaggagaacaccaatgtttagcgccaacctggcggcagcgcaaaagatg

SEQ ID NO: 162302 - DNA, 103 bp, Artificial Sequence
  Synthetic Polynucleotide
taatacgactcactatagggtgctggggctgctggtggtgagggcgctaaaacagaggagattagcgatgtcaccaccaaacctggcggcagcgcaaaagatg

SEQ ID NO: 162303 - DNA, 103 bp, Artificial Sequence
  Synthetic Polynucleotide
taatacgactcactatagggatgttgaagatgctggggctgctggtggtgaacagaggagacaccacatgcagccccagaacctggcggcagcgcaaaagatg

SEQ ID NO: 162304 - DNA, 103 bp, Artificial Sequence
  Synthetic Polynucleotide
taatacgactcactatagggcaggaaatcgatgttgaagatgctggggctaacagaggagaagccccatgatcttcaacaacctggcggcagcgcaaaagatg

SEQ ID NO: 162305 - DNA, 103 bp, Artificial Sequence
  Synthetic Polynucleotide
taatacgactcactatagggcagtgacatccaggaaatcgatgttgaagaaacagaggagatcttcaatgtcgatttccaacctggcggcagcgcaaaagatg

SEQ ID NO: 162306 - DNA, 103 bp, Artificial Sequence
  Synthetic Polynucleotide
taatacgactcactatagggaaattgagatcagtgacatccaggaaatcgaacagaggagacgatttatgggatgtcacaacctggcggcagcgcaaaagatg

SEQ ID NO: 162307 - DNA, 103 bp, Artificial Sequence
  Synthetic Polynucleotide
taatacgactcactatagggggaagaattcaaattgagatcagtgacatcaacagaggagagatgtcatggatctcaataacctggcggcagcgcaaaagatg

SEQ ID NO: 162308 - DNA, 103 bp, Artificial Sequence
  Synthetic Polynucleotide
taatacgactcactataggggaaggtccatggaagaattcaaattgagataacagaggagaatctcaatgtgaattcttaacctggcggcagcgcaaaagatg

SEQ ID NO: 162309 - DNA, 103 bp, Artificial Sequence
  Synthetic Polynucleotide
taatacgactcactatagggtgctgcaagtgaaggtccatggaagaattcaacagaggagagaattcatgcatggacctaacctggcggcagcgcaaaagatg

SEQ ID NO: 162310 - DNA, 103 bp, Artificial Sequence
  Synthetic Polynucleotide
taatacgactcactatagggtttcagcttcatctgagcagttggaatggaaacagaggagatccattatgactgctcagaacctggcggcagcgcaaaagatg

SEQ ID NO: 162311 - DNA, 103 bp, Artificial Sequence
  Synthetic Polynucleotide
taatacgactcactataggggtcgggctcttttcagcttcatctgagcagaacagaggagactgctcatgtgaagctgaaacctggcggcagcgcaaaagatg

SEQ ID NO: 162312 - DNA, 103 bp, Artificial Sequence
  Synthetic Polynucleotide
taatacgactcactatagggctgaacttgctcctaatcagcaaggaatgcaacagaggagagcattcatggctgattagaacctggcggcagcgcaaaagatg

SEQ ID NO: 162313 - DNA, 103 bp, Artificial Sequence
  Synthetic Polynucleotide
taatacgactcactatagggtcatcggcgagtcgggctcttttcagcttcaacagaggagagaagctatgaagagcccgaacctggcggcagcgcaaaagatg

SEQ ID NO: 162314 - DNA, 103 bp, Artificial Sequence
  Synthetic Polynucleotide
taatacgactcactatagggttcattgagatcatcggcgagtcgggctctaacagaggagaagagccatgctcgccgataacctggcggcagcgcaaaagatg

SEQ ID NO: 162315 - DNA, 103 bp, Artificial Sequence
  Synthetic Polynucleotide
taatacgactcactataggggagcaattttttcattgagatcatcggcgaaacagaggagatcgccgatgatctcaatgaacctggcggcagcgcaaaagatg

SEQ ID NO: 162316 - DNA, 103 bp, Artificial Sequence
  Synthetic Polynucleotide
taatacgactcactatagggcctggtcgtagagcaattttttcattgagaaacagaggagatctcaaatgaaaaattgcaacctggcggcagcgcaaaagatg

SEQ ID NO: 162317 - DNA, 103 bp, Artificial Sequence
  Synthetic Polynucleotide
taatacgactcactatagggctccagtggccctggtcgtagagcaattttaacagaggagaaaaattatgctacgaccaaacctggcggcagcgcaaaagatg

SEQ ID NO: 162318 - DNA, 103 bp, Artificial Sequence
  Synthetic Polynucleotide
taatacgactcactatagggtttccaccagctccagtggccctggtcgtaaacagaggagatacgacatgggccactggaacctggcggcagcgcaaaagatg

SEQ ID NO: 162319 - DNA, 103 bp, Artificial Sequence
  Synthetic Polynucleotide
taatacgactcactatagggagaatgtttttttccaccagctccagtggcaacagaggagagccactatggctggtggaaacctggcggcagcgcaaaagatg

SEQ ID NO: 162320 - DNA, 103 bp, Artificial Sequence
  Synthetic Polynucleotide
taatacgactcactatagggatccacaggaagaatgtttttttccaccagaacagaggagactggtgatgaaaaacattaacctggcggcagcgcaaaagatg

SEQ ID NO: 162321 - DNA, 103 bp, Artificial Sequence
  Synthetic Polynucleotide
taatacgactcactatagggtcacagcagaatccacaggaagaatgttttaacagaggagaaaaacaatgttcctgtggaacctggcggcagcgcaaaagatg

SEQ ID NO: 162322 - DNA, 103 bp, Artificial Sequence
  Synthetic Polynucleotide
taatacgactcactatagggatggcctctttcacagcagaatccacaggaaacagaggagatcctgtatgttctgctgtaacctggcggcagcgcaaaagatg

SEQ ID NO: 162323 - DNA, 103 bp, Artificial Sequence
  Synthetic Polynucleotide
taatacgactcactatagggtaaaactgatctgaacttgctcctaatcagaacagaggagactgattatgagcaagttcaacctggcggcagcgcaaaagatg

SEQ ID NO: 162324 - DNA, 103 bp, Artificial Sequence
  Synthetic Polynucleotide
taatacgactcactataggggttaccttttatggcctctttcacagcagaaacagaggagatctgctatgaaagaggccaacctggcggcagcgcaaaagatg

SEQ ID NO: 162325 - DNA, 103 bp, Artificial Sequence
  Synthetic Polynucleotide
taatacgactcactatagggaactcacctggttaccttttatggcctcttaacagaggagaaagaggatgtaaaaggtaaacctggcggcagcgcaaaagatg

SEQ ID NO: 162326 - DNA, 103 bp, Artificial Sequence
  Synthetic Polynucleotide
taatacgactcactataggggatttggagaaactcacctggttaccttttaacagaggagaaaaaggatgccaggtgagaacctggcggcagcgcaaaagatg

SEQ ID NO: 162327 - DNA, 103 bp, Artificial Sequence
  Synthetic Polynucleotide
taatacgactcactatagggagcatccgtggatttggagaaactcacctgaacagaggagacaggtgatgttctccaaaaacctggcggcagcgcaaaagatg

SEQ ID NO: 162328 - DNA, 103 bp, Artificial Sequence
  Synthetic Polynucleotide
taatacgactcactatagggcaaaggcaaaagcatccgtggatttggagaaacagaggagatctccaatgccacggatgaacctggcggcagcgcaaaagatg

SEQ ID NO: 162329 - DNA, 103 bp, Artificial Sequence
  Synthetic Polynucleotide
taatacgactcactatagggctgtcctcttcaaaggcaaaagcatccgtgaacagaggagacacggaatgttttgccttaacctggcggcagcgcaaaagatg

SEQ ID NO: 162330 - DNA, 103 bp, Artificial Sequence
  Synthetic Polynucleotide
taatacgactcactatagggatcgctgctgctgtcctcttcaaaggcaaaaacagaggagatttgccatggaagaggacaacctggcggcagcgcaaaagatg

SEQ ID NO: 162331 - DNA, 103 bp, Artificial Sequence
  Synthetic Polynucleotide
taatacgactcactataggggagaaagcccatcgctgctgctgtcctcttaacagaggagaaagaggatggcagcagcgaacctggcggcagcgcaaaagatg

SEQ ID NO: 162332 - DNA, 103 bp, Artificial Sequence
  Synthetic Polynucleotide
taatacgactcactataggggtctgatccggagaaagcccatcgctgctgaacagaggagacagcagatgtgggctttcaacctggcggcagcgcaaaagatg

SEQ ID NO: 162333 - DNA, 103 bp, Artificial Sequence
  Synthetic Polynucleotide
taatacgactcactatagggttcacttcgagtctgatccggagaaagcccaacagaggagagggcttatgccggatcagaacctggcggcagcgcaaaagatg

SEQ ID NO: 162334 - DNA, 103 bp, Artificial Sequence
  Synthetic Polynucleotide
taatacgactcactataggggtcttaactgtaaaactgatctgaacttgcaacagaggagagcaagtatggatcagtttaacctggcggcagcgcaaaagatg

SEQ ID NO: 162335 - DNA, 103 bp, Artificial Sequence
  Synthetic Polynucleotide
taatacgactcactatagggtttgggggtcttcacttcgagtctgatccgaacagaggagacggatcatgctcgaagtgaacctggcggcagcgcaaaagatg

SEQ ID NO: 162336 - DNA, 103 bp, Artificial Sequence
  Synthetic Polynucleotide
taatacgactcactatagggcccgctgagttttgggggtcttcacttcgaaacagaggagatcgaagatgagacccccaaacctggcggcagcgcaaaagatg

SEQ ID NO: 162337 - DNA, 103 bp, Artificial Sequence
  Synthetic Polynucleotide
taatacgactcactatagggtggcggggatcccgctgagttttgggggtcaacagaggagagaccccatgaactcagcgaacctggcggcagcgcaaaagatg

SEQ ID NO: 162338 - DNA, 103 bp, Artificial Sequence
  Synthetic Polynucleotide
taatacgactcactatagggctttagcgtctggcggggatcccgctgagtaacagaggagaactcagatggatccccgcaacctggcggcagcgcaaaagatg

SEQ ID NO: 162339 - DNA, 103 bp, Artificial Sequence
  Synthetic Polynucleotide
taatacgactcactataggggtatctgaggctttagcgtctggcggggataacagaggagaatccccatgagacgctaaaacctggcggcagcgcaaaagatg

SEQ ID NO: 162340 - DNA, 103 bp, Artificial Sequence
  Synthetic Polynucleotide
taatacgactcactatagggtgtcgaaggggtatctgaggctttagcgtcaacagaggagagacgctatggcctcagataacctggcggcagcgcaaaagatg

SEQ ID NO: 162341 - DNA, 103 bp, Artificial Sequence
  Synthetic Polynucleotide
taatacgactcactatagggccagagaacctgtcgaaggggtatctgaggaacagaggagacctcagatgccccttcgaaacctggcggcagcgcaaaagatg

SEQ ID NO: 162342 - DNA, 103 bp, Artificial Sequence
  Synthetic Polynucleotide
taatacgactcactatagggtggtttgtccccagagaacctgtcgaagggaacagaggagacccttcatgaggttctctaacctggcggcagcgcaaaagatg

SEQ ID NO: 162343 - DNA, 103 bp, Artificial Sequence
  Synthetic Polynucleotide
taatacgactcactatagggagcaagatcctggtttgtccccagagaaccaacagaggagaggttctatggggacaaacaacctggcggcagcgcaaaagatg

SEQ ID NO: 162344 - DNA, 103 bp, Artificial Sequence
  Synthetic Polynucleotide
taatacgactcactatagggctgagccagaagcaagatcctggtttgtccaacagaggagaggacaaatgaggatcttgaacctggcggcagcgcaaaagatg

SEQ ID NO: 162345 - DNA, 103 bp, Artificial Sequence
  Synthetic Polynucleotide
taatacgactcactatagggctttgttgaagtcttaactgtaaaactgataacagaggagaatcagtatgacagttaagaacctggcggcagcgcaaaagatg

SEQ ID NO: 162346 - DNA, 103 bp, Artificial Sequence
  Synthetic Polynucleotide
taatacgactcactatagggctgtcattttctgagccagaagcaagatccaacagaggagaggatctatgttctggctcaacctggcggcagcgcaaaagatg

SEQ ID NO: 162347 - DNA, 103 bp, Artificial Sequence
  Synthetic Polynucleotide
taatacgactcactatagggtgagtcatttctgtcattttctgagccagaaacagaggagatctggcatggaaaatgacaacctggcggcagcgcaaaagatg

SEQ ID NO: 162348 - DNA, 103 bp, Artificial Sequence
  Synthetic Polynucleotide
taatacgactcactataggggctgtgaggctgagtcatttctgtcattttaacagaggagaaaaatgatggaaatgactaacctggcggcagcgcaaaagatg

SEQ ID NO: 162349 - DNA, 103 bp, Artificial Sequence
  Synthetic Polynucleotide
taatacgactcactatagggtggtggctgggctgtgaggctgagtcatttaacagaggagaaaatgaatgagcctcacaaacctggcggcagcgcaaaagatg

SEQ ID NO: 162350 - DNA, 103 bp, Artificial Sequence
  Synthetic Polynucleotide
taatacgactcactatagggcgcatctgactggtggctgggctgtgaggcaacagaggagagcctcaatgcccagccacaacctggcggcagcgcaaaagatg

SEQ ID NO: 162351 - DNA, 103 bp, Artificial Sequence
  Synthetic Polynucleotide
taatacgactcactatagggcctgcttccccgcatctgactggtggctggaacagaggagaccagccatgagtcagatgaacctggcggcagcgcaaaagatg

SEQ ID NO: 162352 - DNA, 103 bp, Artificial Sequence
  Synthetic Polynucleotide
taatacgactcactataggggggccaagcccctgcttccccgcatctgacaacagaggagagtcagaatgggggaagcaaacctggcggcagcgcaaaagatg

SEQ ID NO: 162353 - DNA, 103 bp, Artificial Sequence
  Synthetic Polynucleotide
taatacgactcactatagggggtgctgggggggccaagcccctgcttcccaacagaggagagggaagatggggcttggcaacctggcggcagcgcaaaagatg

SEQ ID NO: 162354 - DNA, 103 bp, Artificial Sequence
  Synthetic Polynucleotide
taatacgactcactatagggcggctatgggggtgctgggggggccaagccaacagaggagaggcttgatgcccccagcaaacctggcggcagcgcaaaagatg

SEQ ID NO: 162355 - DNA, 103 bp, Artificial Sequence
  Synthetic Polynucleotide
taatacgactcactataggggcagcatgcacggctatgggggtgctggggaacagaggagaccccagatgccccatagcaacctggcggcagcgcaaaagatg

SEQ ID NO: 162356 - DNA, 103 bp, Artificial Sequence
  Synthetic Polynucleotide
taatacgactcactatagggctgggtccttctttgttgaagtcttaactgaacagaggagacagttaatgcttcaacaaaacctggcggcagcgcaaaagatg

SEQ ID NO: 162357 - DNA, 103 bp, Artificial Sequence
  Synthetic Polynucleotide
taatacgactcactatagggggactttacagcagcatgcacggctatgggaacagaggagacccataatggtgcatgctaacctggcggcagcgcaaaagatg

SEQ ID NO: 162358 - DNA, 103 bp, Artificial Sequence
  Synthetic Polynucleotide
taatacgactcactatagggccaaggatttggactttacagcagcatgcaaacagaggagatgcatgatgctgtaaagtaacctggcggcagcgcaaaagatg

SEQ ID NO: 162359 - DNA, 103 bp, Artificial Sequence
  Synthetic Polynucleotide
taatacgactcactatagggttactgtcacccaaggatttggactttacaaacagaggagatgtaaaatgcaaatccttaacctggcggcagcgcaaaagatg

SEQ ID NO: 162360 - DNA, 103 bp, Artificial Sequence
  Synthetic Polynucleotide
taatacgactcactataggggtggcggttcttactgtcacccaaggatttaacagaggagaaaatccatgggtgacagtaacctggcggcagcgcaaaagatg

SEQ ID NO: 162361 - DNA, 103 bp, Artificial Sequence
  Synthetic Polynucleotide
taatacgactcactatagggtgggctttttgtggcggttcttactgtcacaacagaggagagtgacaatgagaaccgccaacctggcggcagcgcaaaagatg

SEQ ID NO: 162362 - DNA, 103 bp, Artificial Sequence
  Synthetic Polynucleotide
taatacgactcactatagggttggggtccttgggctttttgtggcggttcaacagaggagagaaccgatgcaaaaagccaacctggcggcagcgcaaaagatg

SEQ ID NO: 162363 - DNA, 103 bp, Artificial Sequence
  Synthetic Polynucleotide
taatacgactcactatagggcacctttggcttggggtccttgggctttttaacagaggagaaaaaagatgaaggaccccaacctggcggcagcgcaaaagatg

SEQ ID NO: 162364 - DNA, 103 bp, Artificial Sequence
  Synthetic Polynucleotide
taatacgactcactatagggtaagcttcttcacctttggcttggggtcctaacagaggagaaggaccatgagccaaaggaacctggcggcagcgcaaaagatg

SEQ ID NO: 162365 - DNA, 103 bp, Artificial Sequence
  Synthetic Polynucleotide
taatacgactcactatagggtggtgatatttaagcttcttcacctttggcaacagaggagagccaaaatggaagaagctaacctggcggcagcgcaaaagatg

SEQ ID NO: 162366 - DNA, 103 bp, Artificial Sequence
  Synthetic Polynucleotide
taatacgactcactataggggggaatgtactggtgatatttaagcttcttaacagaggagaaagaagatgaaatatcacaacctggcggcagcgcaaaagatg

SEQ ID NO: 162367 - DNA, 103 bp, Artificial Sequence
  Synthetic Polynucleotide
taatacgactcactatagggccagttgttcctgggtccttctttgttgaaaacagaggagattcaacatggaaggacccaacctggcggcagcgcaaaagatg

SEQ ID NO: 162368 - DNA, 103 bp, Artificial Sequence
  Synthetic Polynucleotide
taatacgactcactatagggtctggtctgggggaatgtactggtgatattaacagaggagaaatatcatgagtacattcaacctggcggcagcgcaaaagatg

SEQ ID NO: 162369 - DNA, 103 bp, Artificial Sequence
  Synthetic Polynucleotide
taatacgactcactatagggttctctgccttctggtctgggggaatgtacaacagaggagagtacatatgcccagaccaaacctggcggcagcgcaaaagatg

SEQ ID NO: 162370 - DNA, 103 bp, Artificial Sequence
  Synthetic Polynucleotide
taatacgactcactatagggtggaggggacttctctgccttctggtctggaacagaggagaccagacatgaaggcagagaacctggcggcagcgcaaaagatg

SEQ ID NO: 162371 - DNA, 103 bp, Artificial Sequence
  Synthetic Polynucleotide
taatacgactcactatagggagtccataggtggaggggacttctctgcctaacagaggagaaggcagatgagtcccctcaacctggcggcagcgcaaaagatg

SEQ ID NO: 162372 - DNA, 103 bp, Artificial Sequence
  Synthetic Polynucleotide
taatacgactcactataggggcgtaggctgagtccataggtggaggggacaacagaggagagtccccatgacctatggaaacctggcggcagcgcaaaagatg

SEQ ID NO: 162373 - DNA, 103 bp, Artificial Sequence
  Synthetic Polynucleotide
taatacgactcactataggggagcagccgagcgtaggctgagtccataggaacagaggagacctatgatgtcagcctacaacctggcggcagcgcaaaagatg

SEQ ID NO: 162374 - DNA, 103 bp, Artificial Sequence
  Synthetic Polynucleotide
taatacgactcactataggggctgttgctggagcagccgagcgtaggctgaacagaggagacagcctatgctcggctgcaacctggcggcagcgcaaaagatg

SEQ ID NO: 162375 - DNA, 103 bp, Artificial Sequence
  Synthetic Polynucleotide
taatacgactcactatagggaggaacagctgctgttgctggagcagccgaaacagaggagatcggctatgccagcaacaaacctggcggcagcgcaaaagatg

SEQ ID NO: 162376 - DNA, 103 bp, Artificial Sequence
  Synthetic Polynucleotide
taatacgactcactatagggttggagctgcaggaacagctgctgttgctgaacagaggagacagcaaatgcagctgttcaacctggcggcagcgcaaaagatg

SEQ ID NO: 162377 - DNA, 103 bp, Artificial Sequence
  Synthetic Polynucleotide
taatacgactcactatagggggctgaggatttggagctgcaggaacagctaacagaggagaagctgtatgtgcagctccaacctggcggcagcgcaaaagatg

SEQ ID NO: 162378 - DNA, 103 bp, Artificial Sequence
  Synthetic Polynucleotide
taatacgactcactatagggccttggttagccagttgttcctgggtccttaacagaggagaaaggacatgggaacaactaacctggcggcagcgcaaaagatg

SEQ ID NO: 162379 - DNA, 103 bp, Artificial Sequence
  Synthetic Polynucleotide
taatacgactcactatagggtgctgctgctggctgaggatttggagctgcaacagaggagagcagctatgaatcctcagaacctggcggcagcgcaaaagatg

SEQ ID NO: 162380 - DNA, 103 bp, Artificial Sequence
  Synthetic Polynucleotide
taatacgactcactatagggttgctgctgctgctgctgctggctgaggataacagaggagaatcctcatgcagcagcagaacctggcggcagcgcaaaagatg

SEQ ID NO: 162381 - DNA, 103 bp, Artificial Sequence
  Synthetic Polynucleotide
taatacgactcactatagggtgaatcggtgttgctgctgctgctgctgctaacagaggagaagcagcatgagcagcagcaacctggcggcagcgcaaaagatg

SEQ ID NO: 162382 - DNA, 103 bp, Artificial Sequence
  Synthetic Polynucleotide
taatacgactcactatagggcctaggtagctgaatcggtgttgctgctgcaacagaggagagcagcaatgacaccgattaacctggcggcagcgcaaaagatg

SEQ ID NO: 162383 - DNA, 103 bp, Artificial Sequence
  Synthetic Polynucleotide
taatacgactcactatagggttggtgcatccctaggtagctgaatcggtgaacagaggagacaccgaatgagctacctaaacctggcggcagcgcaaaagatg

SEQ ID NO: 162384 - DNA, 103 bp, Artificial Sequence
  Synthetic Polynucleotide
taatacgactcactatagggtaagctgagcttggtgcatccctaggtagcaacagaggagagctaccatgggatgcaccaacctggcggcagcgcaaaagatg

SEQ ID NO: 162385 - DNA, 103 bp, Artificial Sequence
  Synthetic Polynucleotide
taatacgactcactatagggtttggttccttaagctgagcttggtgcatcaacagaggagagatgcaatgagctcagctaacctggcggcagcgcaaaagatg

SEQ ID NO: 162386 - DNA, 103 bp, Artificial Sequence
  Synthetic Polynucleotide
taatacgactcactatagggcatctgttcatttggttccttaagctgagcaacagaggagagctcagatgaaggaaccaaacctggcggcagcgcaaaagatg

SEQ ID NO: 162387 - DNA, 103 bp, Artificial Sequence
  Synthetic Polynucleotide
taatacgactcactataggggatttctgaccatctgttcatttggttcctaacagaggagaaggaacatgatgaacagaaacctggcggcagcgcaaaagatg

SEQ ID NO: 162388 - DNA, 103 bp, Artificial Sequence
  Synthetic Polynucleotide
taatacgactcactataggggaagagtttggatttctgaccatctgttcaaacagaggagatgaacaatgggtcagaaaaacctggcggcagcgcaaaagatg

SEQ ID NO: 162389 - DNA, 103 bp, Artificial Sequence
  Synthetic Polynucleotide
taatacgactcactataggggtcgcggagcggtggcgacagtagctccataacagaggagaatggagatgctgtcgccaaacctggcggcagcgcaaaagatg

SEQ ID NO: 162390 - DNA, 103 bp, Artificial Sequence
  Synthetic Polynucleotide
taatacgactcactatagggcaggtccggggagtcgaaacacgggtcgtcaacagaggagagacgacatgtgtttcgacaacctggcggcagcgcaaaagatg

SEQ ID NO: 162391 - DNA, 103 bp, Artificial Sequence
  Synthetic Polynucleotide
taatacgactcactatagggcgaagaagcgcaggtccggggagtcgaaacaacagaggagagtttcgatgccccggaccaacctggcggcagcgcaaaagatg

SEQ ID NO: 162392 - DNA, 103 bp, Artificial Sequence
  Synthetic Polynucleotide
taatacgactcactatagggtccaggtcttcgaagaagcgcaggtccgggaacagaggagacccggaatggcgcttcttaacctggcggcagcgcaaaagatg

SEQ ID NO: 162393 - DNA, 103 bp, Artificial Sequence
  Synthetic Polynucleotide
taatacgactcactatagggcaggcgcgggtccaggtcttcgaagaagcgaacagaggagacgcttcatggaagacctgaacctggcggcagcgcaaaagatg

SEQ ID NO: 162394 - DNA, 103 bp, Artificial Sequence
  Synthetic Polynucleotide
taatacgactcactatagggccacgtgcatcaggcgcgggtccaggtcttaacagaggagaaagaccatgacccgcgccaacctggcggcagcgcaaaagatg

SEQ ID NO: 162395 - DNA, 103 bp, Artificial Sequence
  Synthetic Polynucleotide
taatacgactcactatagggaggagcgcgcccacgtgcatcaggcgcgggaacagaggagacccgcgatggatgcacgtaacctggcggcagcgcaaaagatg

SEQ ID NO: 162396 - DNA, 103 bp, Artificial Sequence
  Synthetic Polynucleotide
taatacgactcactatagggttcgggtttcaggagcgcgcccacgtgcataacagaggagaatgcacatgggcgcgctcaacctggcggcagcgcaaaagatg

SEQ ID NO: 162397 - DNA, 103 bp, Artificial Sequence
  Synthetic Polynucleotide
taatacgactcactataggggcgagtgctcttcgggtttcaggagcgcgcaacagaggagagcgcgcatgtgaaacccgaacctggcggcagcgcaaaagatg

SEQ ID NO: 162398 - DNA, 103 bp, Artificial Sequence
  Synthetic Polynucleotide
taatacgactcactataggggcggggaagtgcgagtgctcttcgggtttcaacagaggagagaaaccatgagagcactcaacctggcggcagcgcaaaagatg

SEQ ID NO: 162399 - DNA, 103 bp, Artificial Sequence
  Synthetic Polynucleotide
taatacgactcactataggggtgcaccgccgcggggaagtgcgagtgctcaacagaggagagagcacatgcacttccccaacctggcggcagcgcaaaagatg

SEQ ID NO: 162400 - DNA, 103 bp, Artificial Sequence
  Synthetic Polynucleotide
taatacgactcactatagggtcaggtctacgtcgcggagcggtggcgacaaacagaggagatgtcgcatgcgctccgcgaacctggcggcagcgcaaaagatg

SEQ ID NO: 162401 - DNA, 103 bp, Artificial Sequence
  Synthetic Polynucleotide
taatacgactcactatagggccggggccgggtgcaccgccgcggggaagtaacagaggagaacttccatgcggcggtgcaacctggcggcagcgcaaaagatg

SEQ ID NO: 162402 - DNA, 103 bp, Artificial Sequence
  Synthetic Polynucleotide
taatacgactcactatagggtcacgtgcgcccggggccgggtgcaccgccaacagaggagaggcggtatgcccggccccaacctggcggcagcgcaaaagatg

SEQ ID NO: 162403 - DNA, 103 bp, Artificial Sequence
  Synthetic Polynucleotide
taatacgactcactatagggatgctcgtcctcacgtgcgcccggggccggaacagaggagaccggccatgggcgcacgtaacctggcggcagcgcaaaagatg

SEQ ID NO: 162404 - DNA, 103 bp, Artificial Sequence
  Synthetic Polynucleotide
taatacgactcactataggggcgcgcgcacatgctcgtcctcacgtgcgcaacagaggagagcgcacatgaggacgagcaacctggcggcagcgcaaaagatg

SEQ ID NO: 162405 - DNA, 103 bp, Artificial Sequence
  Synthetic Polynucleotide
taatacgactcactatagggtgcccgctgggcgcgcgcacatgctcgtccaacagaggagaggacgaatgtgtgcgcgcaacctggcggcagcgcaaaagatg

SEQ ID NO: 162406 - DNA, 103 bp, Artificial Sequence
  Synthetic Polynucleotide
taatacgactcactatagggcgcctggtggtgcccgctgggcgcgcgcacaacagaggagagtgcgcatgcccagcgggaacctggcggcagcgcaaaagatg

SEQ ID NO: 162407 - DNA, 103 bp, Artificial Sequence
  Synthetic Polynucleotide
taatacgactcactatagggggcagcggcccgcctggtggtgcccgctggaacagaggagaccagcgatgaccaccaggaacctggcggcagcgcaaaagatg

SEQ ID NO: 162408 - DNA, 103 bp, Artificial Sequence
  Synthetic Polynucleotide
taatacgactcactataggggcccacagtaggcagcggcccgcctggtggaacagaggagaccaccaatggggccgctgaacctggcggcagcgcaaaagatg

SEQ ID NO: 162409 - DNA, 103 bp, Artificial Sequence
  Synthetic Polynucleotide
taatacgactcactatagggcgccttgcaggcccacagtaggcagcggccaacagaggagaggccgcatgctactgtggaacctggcggcagcgcaaaagatg

SEQ ID NO: 162410 - DNA, 103 bp, Artificial Sequence
  Synthetic Polynucleotide
taatacgactcactatagggtgcgcttgcacgccttgcaggcccacagtaaacagaggagatactgtatgcctgcaaggaacctggcggcagcgcaaaagatg

SEQ ID NO: 162411 - DNA, 103 bp, Artificial Sequence
  Synthetic Polynucleotide
taatacgactcactatagggtcgggggccgtcaggtctacgtcgcggagcaacagaggagagctccgatgcgtagacctaacctggcggcagcgcaaaagatg

SEQ ID NO: 162412 - DNA, 103 bp, Artificial Sequence
  Synthetic Polynucleotide
taatacgactcactatagggttggtggtcttgcgcttgcacgccttgcagaacagaggagactgcaaatggtgcaagcgaacctggcggcagcgcaaaagatg

SEQ ID NO: 162413 - DNA, 103 bp, Artificial Sequence
  Synthetic Polynucleotide
taatacgactcactataggggcggtcggcgttggtggtcttgcgcttgcaaacagaggagatgcaagatgaagaccaccaacctggcggcagcgcaaaagatg

SEQ ID NO: 162414 - DNA, 103 bp, Artificial Sequence
  Synthetic Polynucleotide
taatacgactcactatagggcggccttgcggcggtcggcgttggtggtctaacagaggagaagaccaatgacgccgaccaacctggcggcagcgcaaaagatg

SEQ ID NO: 162415 - DNA, 103 bp, Artificial Sequence
  Synthetic Polynucleotide
taatacgactcactatagggcgcatggtggcggccttgcggcggtcggcgaacagaggagacgccgaatgccgcaaggcaacctggcggcagcgcaaaagatg

SEQ ID NO: 162416 - DNA, 103 bp, Artificial Sequence
  Synthetic Polynucleotide
taatacgactcactataggggcgccgctcgcgcatggtggcggccttgcgaacagaggagacgcaagatggccaccatgaacctggcggcagcgcaaaagatg

SEQ ID NO: 162417 - DNA, 103 bp, Artificial Sequence
  Synthetic Polynucleotide
taatacgactcactatagggtgctcaggcggcgccgctcgcgcatggtggaacagaggagaccaccaatggcgagcggcaacctggcggcagcgcaaaagatg

SEQ ID NO: 162418 - DNA, 103 bp, Artificial Sequence
  Synthetic Polynucleotide
taatacgactcactatagggtcatttactttgctcaggcggcgccgctcgaacagaggagacgagcgatgccgcctgagaacctggcggcagcgcaaaagatg

SEQ ID NO: 162419 - DNA, 103 bp, Artificial Sequence
  Synthetic Polynucleotide
taatacgactcactatagggctcaaaggcctcatttactttgctcaggcgaacagaggagacgcctgatgaaagtaaataacctggcggcagcgcaaaagatg

SEQ ID NO: 162420 - DNA, 103 bp, Artificial Sequence
  Synthetic Polynucleotide
taatacgactcactataggggcttgagtgtctcaaaggcctcatttacttaacagaggagaaagtaaatgaggcctttgaacctggcggcagcgcaaaagatg

SEQ ID NO: 162421 - DNA, 103 bp, Artificial Sequence
  Synthetic Polynucleotide
taatacgactcactataggggacgtgcagcgcttgagtgtctcaaaggccaacagaggagaggccttatggacactcaaaacctggcggcagcgcaaaagatg

SEQ ID NO: 162422 - DNA, 103 bp, Artificial Sequence
  Synthetic Polynucleotide
taatacgactcactataggggagagagccgtcgggggccgtcaggtctacaacagaggagagtagacatgacggcccccaacctggcggcagcgcaaaagatg

SEQ ID NO: 162423 - DNA, 103 bp, Artificial Sequence
  Synthetic Polynucleotide
taatacgactcactatagggtggattgctcgacgtgcagcgcttgagtgtaacagaggagaacactcatgcgctgcacgaacctggcggcagcgcaaaagatg

SEQ ID NO: 162424 - DNA, 103 bp, Artificial Sequence
  Synthetic Polynucleotide
taatacgactcactatagggaccgctggtttggattgctcgacgtgcagcaacagaggagagctgcaatgcgagcaatcaacctggcggcagcgcaaaagatg

SEQ ID NO: 162425 - DNA, 103 bp, Artificial Sequence
  Synthetic Polynucleotide
taatacgactcactatagggaccttgggcaaccgctggtttggattgctcaacagaggagagagcaaatgaaaccagcgaacctggcggcagcgcaaaagatg

SEQ ID NO: 162426 - DNA, 103 bp, Artificial Sequence
  Synthetic Polynucleotide
taatacgactcactatagggcaggatctccaccttgggcaaccgctggttaacagaggagaaaccagatgttgcccaagaacctggcggcagcgcaaaagatg

SEQ ID NO: 162427 - DNA, 103 bp, Artificial Sequence
  Synthetic Polynucleotide
taatacgactcactatagggtggcgttgcgcaggatctccaccttgggcaaacagaggagatgcccaatgtggagatccaacctggcggcagcgcaaaagatg

SEQ ID NO: 162428 - DNA, 103 bp, Artificial Sequence
  Synthetic Polynucleotide
taatacgactcactatagggatatagcggatggcgttgcgcaggatctccaacagaggagaggagatatggcgcaacgcaacctggcggcagcgcaaaagatg

SEQ ID NO: 162429 - DNA, 103 bp, Artificial Sequence
  Synthetic Polynucleotide
taatacgactcactatagggcaggccctcgatatagcggatggcgttgcgaacagaggagacgcaacatgatccgctataacctggcggcagcgcaaaagatg

SEQ ID NO: 162430 - DNA, 103 bp, Artificial Sequence
  Synthetic Polynucleotide
taatacgactcactataggggcagagcctgcaggccctcgatatagcggaaacagaggagatccgctatgtcgagggccaacctggcggcagcgcaaaagatg

SEQ ID NO: 162431 - DNA, 103 bp, Artificial Sequence
  Synthetic Polynucleotide
taatacgactcactatagggtggtcgcgcagcagagcctgcaggccctcgaacagaggagacgagggatggcaggctctaacctggcggcagcgcaaaagatg

SEQ ID NO: 162432 - DNA, 103 bp, Artificial Sequence
  Synthetic Polynucleotide
taatacgactcactatagggcgcggcgtcctggtcgcgcagcagagcctgaacagaggagacaggctatgctgcgcgacaacctggcggcagcgcaaaagatg

SEQ ID NO: 162433 - DNA, 103 bp, Artificial Sequence
  Synthetic Polynucleotide
taatacgactcactatagggcaaaggagcagagagagccgtcgggggccgaacagaggagacggcccatgacggctctcaacctggcggcagcgcaaaagatg

SEQ ID NO: 162434 - DNA, 103 bp, Artificial Sequence
  Synthetic Polynucleotide
taatacgactcactatagggcgccagggggcgcggcgtcctggtcgcgcaaacagaggagatgcgcgatgaggacgccgaacctggcggcagcgcaaaagatg

SEQ ID NO: 162435 - DNA, 103 bp, Artificial Sequence
  Synthetic Polynucleotide
taatacgactcactataggggcggctgcggcgccagggggcgcggcgtccaacagaggagaggacgcatggccccctggaacctggcggcagcgcaaaagatg

SEQ ID NO: 162436 - DNA, 103 bp, Artificial Sequence
  Synthetic Polynucleotide
taatacgactcactatagggcgcatagaaggcggctgcggcgccagggggaacagaggagaccccctatggccgcagccaacctggcggcagcgcaaaagatg

SEQ ID NO: 162437 - DNA, 103 bp, Artificial Sequence
  Synthetic Polynucleotide
taatacgactcactataggggcgggcccggcgcatagaaggcggctgcggaacagaggagaccgcagatgccttctatgaacctggcggcagcgcaaaagatg

SEQ ID NO: 162438 - DNA, 103 bp, Artificial Sequence
  Synthetic Polynucleotide
taatacgactcactatagggcccgggggcagcgggcccggcgcatagaagaacagaggagacttctaatggccgggcccaacctggcggcagcgcaaaagatg

SEQ ID NO: 162439 - DNA, 103 bp, Artificial Sequence
  Synthetic Polynucleotide
taatacgactcactataggggccgccgcggcccgggggcagcgggcccggaacagaggagaccgggcatgctgcccccgaacctggcggcagcgcaaaagatg

SEQ ID NO: 162440 - DNA, 103 bp, Artificial Sequence
  Synthetic Polynucleotide
taatacgactcactatagggtgtagtgctcgccgccgcggcccgggggcaaacagaggagatgccccatggccgcggcgaacctggcggcagcgcaaaagatg

SEQ ID NO: 162441 - DNA, 103 bp, Artificial Sequence
  Synthetic Polynucleotide
taatacgactcactataggggagtcgccgctgtagtgctcgccgccgcggaacagaggagaccgcggatgcgagcactaaacctggcggcagcgcaaaagatg

SEQ ID NO: 162442 - DNA, 103 bp, Artificial Sequence
  Synthetic Polynucleotide
taatacgactcactatagggggacgcgtcggagtcgccgctgtagtgctcaacagaggagagagcacatgagcggcgacaacctggcggcagcgcaaaagatg

SEQ ID NO: 162443 - DNA, 103 bp, Artificial Sequence
  Synthetic Polynucleotide
taatacgactcactatagggagcgcgggctggacgcgtcggagtcgccgcaacagaggagagcggcgatgccgacgcgtaacctggcggcagcgcaaaagatg

SEQ ID NO: 162444 - DNA, 103 bp, Artificial Sequence
  Synthetic Polynucleotide
taatacgactcactatagggtccgttgtggcaaaggagcagagagagccgaacagaggagacggctcatgctgctccttaacctggcggcagcgcaaaagatg

SEQ ID NO: 162445 - DNA, 103 bp, Artificial Sequence
  Synthetic Polynucleotide
taatacgactcactataggggagcagttggagcgcgggctggacgcgtcgaacagaggagacgacgcatgcagcccgcgaacctggcggcagcgcaaaagatg

SEQ ID NO: 162446 - DNA, 103 bp, Artificial Sequence
  Synthetic Polynucleotide
taatacgactcactatagggcatgccgtcggagcagttggagcgcgggctaacagaggagaagcccgatgtccaactgcaacctggcggcagcgcaaaagatg

SEQ ID NO: 162447 - DNA, 103 bp, Artificial Sequence
  Synthetic Polynucleotide
taatacgactcactatagggtgtagtccatcatgccgtcggagcagttggaacagaggagaccaactatgccgacggcaaacctggcggcagcgcaaaagatg

SEQ ID NO: 162448 - DNA, 103 bp, Artificial Sequence
  Synthetic Polynucleotide
taatacgactcactatagggggggggccgctgtagtccatcatgccgtcgaacagaggagacgacggatggatggactaaacctggcggcagcgcaaaagatg

SEQ ID NO: 162449 - DNA, 103 bp, Artificial Sequence
  Synthetic Polynucleotide
taatacgactcactatagggggcgccgctcggggggccgctgtagtccataacagaggagaatggacatgagcggccccaacctggcggcagcgcaaaagatg

SEQ ID NO: 162450 - DNA, 103 bp, Artificial Sequence
  Synthetic Polynucleotide
taatacgactcactatagggtccgccgccgggcgccgctcggggggccgcaacagaggagagcggccatgcgagcggcgaacctggcggcagcgcaaaagatg

SEQ ID NO: 162451 - DNA, 103 bp, Artificial Sequence
  Synthetic Polynucleotide
taatacgactcactatagggtcgtagcagttccgccgccgggcgccgctcaacagaggagagagcggatgccggcggcgaacctggcggcagcgcaaaagatg

SEQ ID NO: 162452 - DNA, 103 bp, Artificial Sequence
  Synthetic Polynucleotide
taatacgactcactataggggtaggcgccttcgtagcagttccgccgccgaacagaggagacggcggatgaactgctacaacctggcggcagcgcaaaagatg

SEQ ID NO: 162453 - DNA, 103 bp, Artificial Sequence
  Synthetic Polynucleotide
taatacgactcactatagggcctcgttgtagtaggcgccttcgtagcagtaacagaggagaactgctatgaaggcgcctaacctggcggcagcgcaaaagatg

SEQ ID NO: 162454 - DNA, 103 bp, Artificial Sequence
  Synthetic Polynucleotide
taatacgactcactatagggtcgctgggcgcctcgttgtagtaggcgcctaacagaggagaaggcgcatgctacaacgaaacctggcggcagcgcaaaagatg

SEQ ID NO: 162455 - DNA, 103 bp, Artificial Sequence
  Synthetic Polynucleotide
taatacgactcactatagggatagaagtcgtccgttgtggcaaaggagcaaacagaggagatgctccatggccacaacgaacctggcggcagcgcaaaagatg

SEQ ID NO: 162456 - DNA, 103 bp, Artificial Sequence
  Synthetic Polynucleotide
taatacgactcactataggggggcctgggttcgctgggcgcctcgttgtaaacagaggagatacaacatggcgcccagcaacctggcggcagcgcaaaagatg

SEQ ID NO: 162457 - DNA, 103 bp, Artificial Sequence
  Synthetic Polynucleotide
taatacgactcactatagggcactcttcccgggcctgggttcgctgggcgaacagaggagacgcccaatgaacccaggcaacctggcggcagcgcaaaagatg

SEQ ID NO: 162458 - DNA, 103 bp, Artificial Sequence
  Synthetic Polynucleotide
taatacgactcactataggggacaccgccgcactcttcccgggcctgggtaacagaggagaacccagatgcgggaagagaacctggcggcagcgcaaaagatg

SEQ ID NO: 162459 - DNA, 103 bp, Artificial Sequence
  Synthetic Polynucleotide
taatacgactcactataggggtctaggctcgacaccgccgcactcttcccaacagaggagagggaagatggcggcggtgaacctggcggcagcgcaaaagatg

SEQ ID NO: 162460 - DNA, 103 bp, Artificial Sequence
  Synthetic Polynucleotide
taatacgactcactatagggtggacaggcagtctaggctcgacaccgccgaacagaggagacggcggatgcgagcctagaacctggcggcagcgcaaaagatg

SEQ ID NO: 162461 - DNA, 103 bp, Artificial Sequence
  Synthetic Polynucleotide
taatacgactcactatagggtccacgatgctggacaggcagtctaggctcaacagaggagagagcctatgctgcctgtcaacctggcggcagcgcaaaagatg

SEQ ID NO: 162462 - DNA, 103 bp, Artificial Sequence
  Synthetic Polynucleotide
taatacgactcactatagggggagatgcgctccacgatgctggacaggcaaacagaggagatgcctgatgagcatcgtgaacctggcggcagcgcaaaagatg

SEQ ID NO: 162463 - DNA, 103 bp, Artificial Sequence
  Synthetic Polynucleotide
taatacgactcactatagggggctctcggtggagatgcgctccacgatgcaacagaggagagcatcgatgagcgcatctaacctggcggcagcgcaaaagatg

SEQ ID NO: 162464 - DNA, 103 bp, Artificial Sequence
  Synthetic Polynucleotide
taatacgactcactatagggggcgccgcagggctctcggtggagatgcgcaacagaggagagcgcatatgcaccgagagaacctggcggcagcgcaaaagatg

SEQ ID NO: 162465 - DNA, 103 bp, Artificial Sequence
  Synthetic Polynucleotide
taatacgactcactatagggcaggagggcgggcgccgcagggctctcggtaacagaggagaaccgagatgcctgcggcgaacctggcggcagcgcaaaagatg

SEQ ID NO: 162466 - DNA, 103 bp, Artificial Sequence
  Synthetic Polynucleotide
taatacgactcactatagggacgggtcgtcatagaagtcgtccgttgtggaacagaggagaccacaaatgacgacttctaacctggcggcagcgcaaaagatg

SEQ ID NO: 162467 - DNA, 103 bp, Artificial Sequence
  Synthetic Polynucleotide
taatacgactcactatagggcgtccgccagcaggagggcgggcgccgcagaacagaggagactgcggatgccgccctccaacctggcggcagcgcaaaagatg

SEQ ID NO: 162468 - DNA, 103 bp, Artificial Sequence
  Synthetic Polynucleotide
taatacgactcactatagggtcagaaggcacgtccgccagcaggagggcgaacagaggagacgccctatggctggcggaaacctggcggcagcgcaaaagatg

SEQ ID NO: 162469 - DNA, 103 bp, Artificial Sequence
  Synthetic Polynucleotide
taatacgactcactatagggcggaggcgactcagaaggcacgtccgccagaacagaggagactggcgatggtgccttctaacctggcggcagcgcaaaagatg

SEQ ID NO: 162470 - DNA, 103 bp, Artificial Sequence
  Synthetic Polynucleotide
taatacgactcactatagggcttgcctgcgcggaggcgactcagaaggcaaacagaggagatgccttatgagtcgcctcaacctggcggcagcgcaaaagatg

SEQ ID NO: 162471 - DNA, 103 bp, Artificial Sequence
  Synthetic Polynucleotide
taatacgactcactataggggcggcagcctcttgcctgcgcggaggcgacaacagaggagagtcgccatggcgcaggcaaacctggcggcagcgcaaaagatg

SEQ ID NO: 162472 - DNA, 103 bp, Artificial Sequence
  Synthetic Polynucleotide
taatacgactcactatagggctcgctgggggcggcagcctcttgcctgcgaacagaggagacgcaggatggaggctgccaacctggcggcagcgcaaaagatg

SEQ ID NO: 162473 - DNA, 103 bp, Artificial Sequence
  Synthetic Polynucleotide
taatacgactcactatagggtgctctctccctcgctgggggcggcagcctaacagaggagaaggctgatgcccccagcgaacctggcggcagcgcaaaagatg

SEQ ID NO: 162474 - DNA, 103 bp, Artificial Sequence
  Synthetic Polynucleotide
taatacgactcactataggggggtcgccgctgctctctccctcgctggggaacagaggagaccccagatggggagagagaacctggcggcagcgcaaaagatg

SEQ ID NO: 162475 - DNA, 103 bp, Artificial Sequence
  Synthetic Polynucleotide
taatacgactcactatagggtgactgggtggggtcgccgctgctctctccaacagaggagaggagagatgagcggcgacaacctggcggcagcgcaaaagatg

SEQ ID NO: 162476 - DNA, 103 bp, Artificial Sequence
  Synthetic Polynucleotide
taatacgactcactatagggcggcgtccggtgactgggtggggtcgccgcaacagaggagagcggcgatgccacccagtaacctggcggcagcgcaaaagatg

SEQ ID NO: 162477 - DNA, 103 bp, Artificial Sequence
  Synthetic Polynucleotide
taatacgactcactataggggagtcgaaacacgggtcgtcatagaagtcgaacagaggagacgacttatgtgacgacccaacctggcggcagcgcaaaagatg

SEQ ID NO: 162478 - DNA, 103 bp, Artificial Sequence
  Synthetic Polynucleotide
taatacgactcactatagggcactgcggggcggcgtccggtgactgggtgaacagaggagacacccaatgaccggacgcaacctggcggcagcgcaaaagatg

SEQ ID NO: 162479 - DNA, 103 bp, Artificial Sequence
  Synthetic Polynucleotide
taatacgactcactatagggacccgcagggcactgcggggcggcgtccggaacagaggagaccggacatggccccgcagaacctggcggcagcgcaaaagatg

SEQ ID NO: 162480 - DNA, 103 bp, Artificial Sequence
  Synthetic Polynucleotide
taatacgactcactatagggtggggttcgcacccgcagggcactgcggggaacagaggagaccccgcatggccctgcggaacctggcggcagcgcaaaagatg

SEQ ID NO: 162481 - DNA, 103 bp, Artificial Sequence
  Synthetic Polynucleotide
taatacgactcactatagggtatatcgggttggggttcgcacccgcagggaacagaggagaccctgcatgtgcgaacccaacctggcggcagcgcaaaagatg

SEQ ID NO: 162482 - DNA, 103 bp, Artificial Sequence
  Synthetic Polynucleotide
taatacgactcactataggggagcacctggtatatcgggttggggttcgcaacagaggagagcgaacatgaacccgataaacctggcggcagcgcaaaagatg

SEQ ID NO: 162483 - DNA, 103 bp, Artificial Sequence
  Synthetic Polynucleotide
taatacgactcactataggggaagtagggggatgtctcatacagctccataacagaggagaatggagatgtatgagacaaacctggcggcagcgcaaaagatg

SEQ ID NO: 162484 - DNA, 103 bp, Artificial Sequence
  Synthetic Polynucleotide
taatacgactcactataggggagctccgtccgctcgtagcctggtggttcaacagaggagagaaccaatgggctacgagaacctggcggcagcgcaaaagatg

SEQ ID NO: 162485 - DNA, 103 bp, Artificial Sequence
  Synthetic Polynucleotide
taatacgactcactatagggggctcagggtgagctccgtccgctcgtagcaacagaggagagctacgatgggacggagcaacctggcggcagcgcaaaagatg

SEQ ID NO: 162486 - DNA, 103 bp, Artificial Sequence
  Synthetic Polynucleotide
taatacgactcactatagggggggcctcggggctcagggtgagctccgtcaacagaggagagacggaatgcaccctgagaacctggcggcagcgcaaaagatg

SEQ ID NO: 162487 - DNA, 103 bp, Artificial Sequence
  Synthetic Polynucleotide
taatacgactcactatagggaaggggccctggggcctcggggctcagggtaacagaggagaaccctgatgcccgaggccaacctggcggcagcgcaaaagatg

SEQ ID NO: 162488 - DNA, 103 bp, Artificial Sequence
  Synthetic Polynucleotide
taatacgactcactatagggccttgtcctcaaggggccctggggcctcggaacagaggagaccgaggatgcagggccccaacctggcggcagcgcaaaagatg

SEQ ID NO: 162489 - DNA, 103 bp, Artificial Sequence
  Synthetic Polynucleotide
taatacgactcactataggggtccccagccccttgtcctcaaggggccctaacagaggagaagggccatgtgaggacaaaacctggcggcagcgcaaaagatg

SEQ ID NO: 162490 - DNA, 103 bp, Artificial Sequence
  Synthetic Polynucleotide
taatacgactcactataggggtgctcgggggtccccagccccttgtcctcaacagaggagagaggacatggggctggggaacctggcggcagcgcaaaagatg

SEQ ID NO: 162491 - DNA, 103 bp, Artificial Sequence
  Synthetic Polynucleotide
taatacgactcactatagggggcctggacagtgctcgggggtccccagccaacagaggagaggctggatgcccccgagcaacctggcggcagcgcaaaagatg

SEQ ID NO: 162492 - DNA, 103 bp, Artificial Sequence
  Synthetic Polynucleotide
taatacgactcactatagggggcaggcactggcctggacagtgctcggggaacagaggagaccccgaatgctgtccaggaacctggcggcagcgcaaaagatg

SEQ ID NO: 162493 - DNA, 103 bp, Artificial Sequence
  Synthetic Polynucleotide
taatacgactcactatagggacacgcccacggcaggcactggcctggacaaacagaggagatgtccaatgcagtgcctgaacctggcggcagcgcaaaagatg

SEQ ID NO: 162494 - DNA, 103 bp, Artificial Sequence
  Synthetic Polynucleotide
taatacgactcactataggggttcctggtagaagtagggggatgtctcataacagaggagaatgagaatgccccctactaacctggcggcagcgcaaaagatg

SEQ ID NO: 162495 - DNA, 103 bp, Artificial Sequence
  Synthetic Polynucleotide
taatacgactcactatagggtacacaccttacacgcccacggcaggcactaacagaggagaagtgccatgcgtgggcgtaacctggcggcagcgcaaaagatg

SEQ ID NO: 162496 - DNA, 103 bp, Artificial Sequence
  Synthetic Polynucleotide
taatacgactcactataggggacttcctcttacacaccttacacgcccacaacagaggagagtgggcatgtaaggtgtgaacctggcggcagcgcaaaagatg

SEQ ID NO: 162497 - DNA, 103 bp, Artificial Sequence
  Synthetic Polynucleotide
taatacgactcactatagggcacggacaccgacttcctcttacacaccttaacagaggagaaaggtgatgaagaggaagaacctggcggcagcgcaaaagatg

SEQ ID NO: 162498 - DNA, 103 bp, Artificial Sequence
  Synthetic Polynucleotide
taatacgactcactataggggccgccggtccacggacaccgacttcctctaacagaggagaagaggaatgcggtgtccgaacctggcggcagcgcaaaagatg

SEQ ID NO: 162499 - DNA, 103 bp, Artificial Sequence
  Synthetic Polynucleotide
taatacgactcactataggggtggccgcccgccgccggtccacggacaccaacagaggagaggtgtcatgggaccggcgaacctggcggcagcgcaaaagatg

SEQ ID NO: 162500 - DNA, 103 bp, Artificial Sequence
  Synthetic Polynucleotide
taatacgactcactatagggctccctcagtgtggccgcccgccgccggtcaacagaggagagaccggatgcgggcggccaacctggcggcagcgcaaaagatg

SEQ ID NO: 162501 - DNA, 103 bp, Artificial Sequence
  Synthetic Polynucleotide
taatacgactcactataggggcctgcgcttctccctcagtgtggccgcccaacagaggagagggcggatgcactgagggaacctggcggcagcgcaaaagatg

SEQ ID NO: 162502 - DNA, 103 bp, Artificial Sequence
  Synthetic Polynucleotide
taatacgactcactatagggaccttcttgagcctgcgcttctccctcagtaacagaggagaactgagatggaagcgcagaacctggcggcagcgcaaaagatg

SEQ ID NO: 162503 - DNA, 103 bp, Artificial Sequence
  Synthetic Polynucleotide
taatacgactcactatagggggcctcattcaccttcttgagcctgcgcttaacagaggagaaagcgcatgctcaagaagaacctggcggcagcgcaaaagatg

SEQ ID NO: 162504 - DNA, 103 bp, Artificial Sequence
  Synthetic Polynucleotide
taatacgactcactataggggggcctcgaaggcctcattcaccttcttgaaacagaggagatcaagaatgtgaatgaggaacctggcggcagcgcaaaagatg

SEQ ID NO: 162505 - DNA, 103 bp, Artificial Sequence
  Synthetic Polynucleotide
taatacgactcactatagggtagaagcggggttcctggtagaagtaggggaacagaggagacccctaatgctaccaggaaacctggcggcagcgcaaaagatg

SEQ ID NO: 162506 - DNA, 103 bp, Artificial Sequence
  Synthetic Polynucleotide
taatacgactcactatagggcttctcttcagggcctcgaaggcctcattcaacagaggagagaatgaatgcttcgaggcaacctggcggcagcgcaaaagatg

SEQ ID NO: 162507 - DNA, 103 bp, Artificial Sequence
  Synthetic Polynucleotide
taatacgactcactataggggagcagggtgcttctcttcagggcctcgaaaacagaggagattcgagatgctgaagagaaacctggcggcagcgcaaaagatg

SEQ ID NO: 162508 - DNA, 103 bp, Artificial Sequence
  Synthetic Polynucleotide
taatacgactcactatagggggttggggttgagcagggtgcttctcttcaaacagaggagatgaagaatggcaccctgcaacctggcggcagcgcaaaagatg

SEQ ID NO: 162509 - DNA, 103 bp, Artificial Sequence
  Synthetic Polynucleotide
taatacgactcactatagggggcagccgctggttggggttgagcagggtgaacagaggagacaccctatgcaaccccaaaacctggcggcagcgcaaaagatg

SEQ ID NO: 162510 - DNA, 103 bp, Artificial Sequence
  Synthetic Polynucleotide
taatacgactcactatagggctccaccttgggcagccgctggttggggttaacagaggagaaaccccatgcagcggctgaacctggcggcagcgcaaaagatg

SEQ ID NO: 162511 - DNA, 103 bp, Artificial Sequence
  Synthetic Polynucleotide
taatacgactcactatagggtgcgcaggatctccaccttgggcagccgctaacagaggagaagcggcatgccaaggtggaacctggcggcagcgcaaaagatg

SEQ ID NO: 162512 - DNA, 103 bp, Artificial Sequence
  Synthetic Polynucleotide
taatacgactcactatagggtggatggcactgcgcaggatctccaccttgaacagaggagacaaggtatggatcctgcgaacctggcggcagcgcaaaagatg

SEQ ID NO: 162513 - DNA, 103 bp, Artificial Sequence
  Synthetic Polynucleotide
taatacgactcactatagggctcgatgtactggatggcactgcgcaggataacagaggagaatcctgatgagtgccatcaacctggcggcagcgcaaaagatg

SEQ ID NO: 162514 - DNA, 103 bp, Artificial Sequence
  Synthetic Polynucleotide
taatacgactcactatagggcctggaggcgctcgatgtactggatggcacaacagaggagagtgccaatgagtacatcgaacctggcggcagcgcaaaagatg

SEQ ID NO: 162515 - DNA, 103 bp, Artificial Sequence
  Synthetic Polynucleotide
taatacgactcactatagggctgagcagggcctggaggcgctcgatgtacaacagaggagagtacatatggcgcctccaaacctggcggcagcgcaaaagatg

SEQ ID NO: 162516 - DNA, 103 bp, Artificial Sequence
  Synthetic Polynucleotide
taatacgactcactatagggttccccatcatagaagcggggttcctggtaaacagaggagataccagatgccccgcttcaacctggcggcagcgcaaaagatg

SEQ ID NO: 162517 - DNA, 103 bp, Artificial Sequence
  Synthetic Polynucleotide
taatacgactcactataggggttgagggagctgagcagggcctggaggcgaacagaggagacgcctcatggccctgctcaacctggcggcagcgcaaaagatg

SEQ ID NO: 162518 - DNA, 103 bp, Artificial Sequence
  Synthetic Polynucleotide
taatacgactcactataggggctcctcctggttgagggagctgagcagggaacagaggagaccctgcatggctccctcaaacctggcggcagcgcaaaagatg

SEQ ID NO: 162519 - DNA, 103 bp, Artificial Sequence
  Synthetic Polynucleotide
taatacgactcactatagggcggaggtcacgctcctcctggttgagggagaacagaggagactccctatgccaggaggaaacctggcggcagcgcaaaagatg

SEQ ID NO: 162520 - DNA, 103 bp, Artificial Sequence
  Synthetic Polynucleotide
taatacgactcactataggggccccggtagcggaggtcacgctcctcctgaacagaggagacaggagatgcgtgacctcaacctggcggcagcgcaaaagatg

SEQ ID NO: 162521 - DNA, 103 bp, Artificial Sequence
  Synthetic Polynucleotide
taatacgactcactataggggcccgcccccgccccggtagcggaggtcacaacagaggagagtgaccatggctaccgggaacctggcggcagcgcaaaagatg

SEQ ID NO: 162522 - DNA, 103 bp, Artificial Sequence
  Synthetic Polynucleotide
taatacgactcactatagggcctggctggggcccgcccccgccccggtagaacagaggagactaccgatgcgggggcggaacctggcggcagcgcaaaagatg

SEQ ID NO: 162523 - DNA, 103 bp, Artificial Sequence
  Synthetic Polynucleotide
taatacgactcactataggggctgggcacccctggctggggcccgcccccaacagaggagagggggcatgccccagccaaacctggcggcagcgcaaaagatg

SEQ ID NO: 162524 - DNA, 103 bp, Artificial Sequence
  Synthetic Polynucleotide
taatacgactcactatagggagctgcattcgctgggcacccctggctgggaacagaggagacccagcatggggtgcccaaacctggcggcagcgcaaaagatg

SEQ ID NO: 162525 - DNA, 103 bp, Artificial Sequence
  Synthetic Polynucleotide
taatacgactcactataggggcgctgtgagagctgcattcgctgggcaccaacagaggagaggtgccatgcgaatgcagaacctggcggcagcgcaaaagatg

SEQ ID NO: 162526 - DNA, 103 bp, Artificial Sequence
  Synthetic Polynucleotide
taatacgactcactatagggactgcaggaggcgctgtgagagctgcattcaacagaggagagaatgcatgtctcacagcaacctggcggcagcgcaaaagatg

SEQ ID NO: 162527 - DNA, 103 bp, Artificial Sequence
  Synthetic Polynucleotide
taatacgactcactataggggcaggtagttttccccatcatagaagcgggaacagaggagacccgctatgatgatggggaacctggcggcagcgcaaaagatg

SEQ ID NO: 162528 - DNA, 103 bp, Artificial Sequence
  Synthetic Polynucleotide
taatacgactcactatagggcccactctggactgcaggaggcgctgtgagaacagaggagactcacaatgcctcctgcaaacctggcggcagcgcaaaagatg

SEQ ID NO: 162529 - DNA, 103 bp, Artificial Sequence
  Synthetic Polynucleotide
taatacgactcactatagggagtgcactgccccactctggactgcaggagaacagaggagactcctgatgtccagagtgaacctggcggcagcgcaaaagatg

SEQ ID NO: 162530 - DNA, 103 bp, Artificial Sequence
  Synthetic Polynucleotide
taatacgactcactataggggctgaactccagtgcactgccccactctggaacagaggagaccagagatgggcagtgcaaacctggcggcagcgcaaaagatg

SEQ ID NO: 162531 - DNA, 103 bp, Artificial Sequence
  Synthetic Polynucleotide
taatacgactcactatagggctgggttggcgctgaactccagtgcactgcaacagaggagagcagtgatgtggagttcaaacctggcggcagcgcaaaagatg

SEQ ID NO: 162532 - DNA, 103 bp, Artificial Sequence
  Synthetic Polynucleotide
taatacgactcactatagggagatgatcccctgggttggcgctgaactccaacagaggagaggagttatgcgccaacccaacctggcggcagcgcaaaagatg

SEQ ID NO: 162533 - DNA, 103 bp, Artificial Sequence
  Synthetic Polynucleotide
taatacgactcactatagggagccgtgagcagatgatcccctgggttggcaacagaggagagccaacatgggggatcataacctggcggcagcgcaaaagatg

SEQ ID NO: 162534 - DNA, 103 bp, Artificial Sequence
  Synthetic Polynucleotide
taatacgactcactatagggctgtagggtcagccgtgagcagatgatcccaacagaggagagggatcatgtgctcacggaacctggcggcagcgcaaaagatg

SEQ ID NO: 162535 - DNA, 103 bp, Artificial Sequence
  Synthetic Polynucleotide
taatacgactcactatagggttgtgggcatctgtagggtcagccgtgagcaacagaggagagctcacatgtgaccctacaacctggcggcagcgcaaaagatg

SEQ ID NO: 162536 - DNA, 103 bp, Artificial Sequence
  Synthetic Polynucleotide
taatacgactcactatagggggagtgcaggttgtgggcatctgtagggtcaacagaggagagaccctatggatgcccacaacctggcggcagcgcaaaagatg

SEQ ID NO: 162537 - DNA, 103 bp, Artificial Sequence
  Synthetic Polynucleotide
taatacgactcactatagggtggaggtgagggagtgcaggttgtgggcataacagaggagaatgcccatgacctgcactaacctggcggcagcgcaaaagatg

SEQ ID NO: 162538 - DNA, 103 bp, Artificial Sequence
  Synthetic Polynucleotide
taatacgactcactatagggaggtggacaggcaggtagttttccccatcaaacagaggagatgatggatgaaactacctaacctggcggcagcgcaaaagatg

SEQ ID NO: 162539 - DNA, 103 bp, Artificial Sequence
  Synthetic Polynucleotide
taatacgactcactatagggctgtccacgatggaggtgagggagtgcaggaacagaggagacctgcaatgcctcacctcaacctggcggcagcgcaaaagatg

SEQ ID NO: 162540 - DNA, 103 bp, Artificial Sequence
  Synthetic Polynucleotide
taatacgactcactatagggcactgtgatgctgtccacgatggaggtgagaacagaggagactcaccatgatcgtggacaacctggcggcagcgcaaaagatg

SEQ ID NO: 162541 - DNA, 103 bp, Artificial Sequence
  Synthetic Polynucleotide
taatacgactcactatagggacacatcttccactgtgatgctgtccacgaaacagaggagatcgtggatggcatcacagaacctggcggcagcgcaaaagatg

SEQ ID NO: 162542 - DNA, 103 bp, Artificial Sequence
  Synthetic Polynucleotide
taatacgactcactatagggaaggccacagacacatcttccactgtgatgaacagaggagacatcacatgggaagatgtaacctggcggcagcgcaaaagatg

SEQ ID NO: 162543 - DNA, 103 bp, Artificial Sequence
  Synthetic Polynucleotide
taatacgactcactatagggttcatctgggaaggccacagacacatcttcaacagaggagagaagatatgtctgtggccaacctggcggcagcgcaaaagatg

SEQ ID NO: 162544 - DNA, 103 bp, Artificial Sequence
  Synthetic Polynucleotide
taatacgactcactatagggtgggcatggtttcatctgggaaggccacagaacagaggagactgtggatgtcccagatgaacctggcggcagcgcaaaagatg

SEQ ID NO: 162545 - DNA, 103 bp, Artificial Sequence
  Synthetic Polynucleotide
taatacgactcactataggggaagccctggaggtggacaggcaggtagttaacagaggagaaactacatgcctgtccacaacctggcggcagcgcaaaagatg

SEQ ID NO: 162546 - DNA, 103 bp, Artificial Sequence
  Synthetic Polynucleotide
taatacgactcactatagggctggtggttcgaagccctggaggtggacagaacagaggagactgtccatgtccagggctaacctggcggcagcgcaaaagatg

SEQ ID NO: 162547 - DNA, 103 bp, Artificial Sequence
  Synthetic Polynucleotide
taatacgactcactatagggcgctcgtagcctggtggttcgaagccctggaacagaggagaccagggatgcgaaccaccaacctggcggcagcgcaaaagatg

SEQ ID NO: 162548 - DNA, 103 bp, Artificial Sequence
  Synthetic Polynucleotide
taatacgactcactatagggctccgcttcgcccgccgccgccgaggccataacagaggagaatggccatggcggcggcgaacctggcggcagcgcaaaagatg

SEQ ID NO: 162549 - DNA, 103 bp, Artificial Sequence
  Synthetic Polynucleotide
taatacgactcactataggggtagagctgcgggtagtgggcgcgcacctcaacagaggagagaggtgatggcccactacaacctggcggcagcgcaaaagatg

SEQ ID NO: 162550 - DNA, 103 bp, Artificial Sequence
  Synthetic Polynucleotide
taatacgactcactatagggcacggacacgggctctggggtgatctccacaacagaggagagtggagatgaccccagagaacctggcggcagcgcaaaagatg

SEQ ID NO: 162551 - DNA, 103 bp, Artificial Sequence
  Synthetic Polynucleotide
taatacgactcactatagggcagcagccaccacggacacgggctctggggaacagaggagaccccagatgccgtgtccgaacctggcggcagcgcaaaagatg

SEQ ID NO: 162552 - DNA, 103 bp, Artificial Sequence
  Synthetic Polynucleotide
taatacgactcactatagggccgtccaccacagcagccaccacggacacgaacagaggagacgtgtcatgggtggctgcaacctggcggcagcgcaaaagatg

SEQ ID NO: 162553 - DNA, 103 bp, Artificial Sequence
  Synthetic Polynucleotide
taatacgactcactatagggcaccactgccccgtccaccacagcagccacaacagaggagagtggctatggtggtggacaacctggcggcagcgcaaaagatg

SEQ ID NO: 162554 - DNA, 103 bp, Artificial Sequence
  Synthetic Polynucleotide
taatacgactcactatagggccctggctgccaccactgccccgtccaccaaacagaggagatggtggatggggcagtggaacctggcggcagcgcaaaagatg

SEQ ID NO: 162555 - DNA, 103 bp, Artificial Sequence
  Synthetic Polynucleotide
taatacgactcactatagggatgatcactcccctggctgccaccactgccaacagaggagaggcagtatgggcagccagaacctggcggcagcgcaaaagatg

SEQ ID NO: 162556 - DNA, 103 bp, Artificial Sequence
  Synthetic Polynucleotide
taatacgactcactatagggccttggggcaatgatcactcccctggctgcaacagaggagagcagccatgggagtgatcaacctggcggcagcgcaaaagatg

SEQ ID NO: 162557 - DNA, 103 bp, Artificial Sequence
  Synthetic Polynucleotide
taatacgactcactatagggcctcctcgctccttggggcaatgatcactcaacagaggagagagtgaatgttgccccaaaacctggcggcagcgcaaaagatg

SEQ ID NO: 162558 - DNA, 103 bp, Artificial Sequence
  Synthetic Polynucleotide
taatacgactcactatagggcggggtgccccctcctcgctccttggggcaaacagaggagatgccccatggagcgaggaaacctggcggcagcgcaaaagatg

SEQ ID NO: 162559 - DNA, 103 bp, Artificial Sequence
  Synthetic Polynucleotide
taatacgactcactatagggtggggggggccggggtgccccctcctcgctaacagaggagaagcgagatgggggcacccaacctggcggcagcgcaaaagatg

SEQ ID NO: 162560 - DNA, 103 bp, Artificial Sequence
  Synthetic Polynucleotide
taatacgactcactatagggtctgcgcgccgtagagctgcgggtagtgggaacagaggagacccactatgcgcagctctaacctggcggcagcgcaaaagatg

SEQ ID NO: 162561 - DNA, 103 bp, Artificial Sequence
  Synthetic Polynucleotide
taatacgactcactatagggggagcggggctggggggggccggggtgcccaacagaggagagggcacatgggcccccccaacctggcggcagcgcaaaagatg

SEQ ID NO: 162562 - DNA, 103 bp, Artificial Sequence
  Synthetic Polynucleotide
taatacgactcactatagggtcgtgcggagggagcggggctggggggggcaacagaggagagcccccatgagccccgctaacctggcggcagcgcaaaagatg

SEQ ID NO: 162563 - DNA, 103 bp, Artificial Sequence
  Synthetic Polynucleotide
taatacgactcactatagggtgggggggagtcgtgcggagggagcggggcaacagaggagagccccgatgcctccgcacaacctggcggcagcgcaaaagatg

SEQ ID NO: 162564 - DNA, 103 bp, Artificial Sequence
  Synthetic Polynucleotide
taatacgactcactatagggtccgcttgtgtgggggggagtcgtgcggagaacagaggagactccgcatgactccccccaacctggcggcagcgcaaaagatg

SEQ ID NO: 162565 - DNA, 103 bp, Artificial Sequence
  Synthetic Polynucleotide
taatacgactcactatagggaaaccttttctccgcttgtgtgggggggagaacagaggagactccccatgacacaagcgaacctggcggcagcgcaaaagatg

SEQ ID NO: 162566 - DNA, 103 bp, Artificial Sequence
  Synthetic Polynucleotide
taatacgactcactatagggccgtgtagggaaaccttttctccgcttgtgaacagaggagacacaagatgagaaaaggtaacctggcggcagcgcaaaagatg

SEQ ID NO: 162567 - DNA, 103 bp, Artificial Sequence
  Synthetic Polynucleotide
taatacgactcactatagggcgcgccttttccgtgtagggaaaccttttcaacagaggagagaaaagatgtccctacacaacctggcggcagcgcaaaagatg

SEQ ID NO: 162568 - DNA, 103 bp, Artificial Sequence
  Synthetic Polynucleotide
taatacgactcactatagggttccatcggccgcgccttttccgtgtagggaacagaggagaccctacatggaaaaggcgaacctggcggcagcgcaaaagatg

SEQ ID NO: 162569 - DNA, 103 bp, Artificial Sequence
  Synthetic Polynucleotide
taatacgactcactatagggtcacggagatttccatcggccgcgccttttaacagaggagaaaaaggatgggccgatggaacctggcggcagcgcaaaagatg

SEQ ID NO: 162570 - DNA, 103 bp, Artificial Sequence
  Synthetic Polynucleotide
taatacgactcactatagggacccgacggctctgcgcgccgtagagctgcaacagaggagagcagctatgcggcgcgcaaacctggcggcagcgcaaaagatg

SEQ ID NO: 162571 - DNA, 103 bp, Artificial Sequence
  Synthetic Polynucleotide
taatacgactcactatagggtgccacgctcacccgacggctctgcgcgccaacagaggagaggcgcgatgagccgtcggaacctggcggcagcgcaaaagatg

SEQ ID NO: 162572 - DNA, 103 bp, Artificial Sequence
  Synthetic Polynucleotide
taatacgactcactataggggccgccgctctgccacgctcacccgacggcaacagaggagagccgtcatgtgagcgtggaacctggcggcagcgcaaaagatg

SEQ ID NO: 162573 - DNA, 103 bp, Artificial Sequence
  Synthetic Polynucleotide
taatacgactcactatagggtcccacacgcgccgccgctctgccacgctcaacagaggagagagcgtatgagagcggcgaacctggcggcagcgcaaaagatg

SEQ ID NO: 162574 - DNA, 103 bp, Artificial Sequence
  Synthetic Polynucleotide
taatacgactcactatagggggcgatgccgtcccacacgcgccgccgctcaacagaggagagagcggatgcgcgtgtggaacctggcggcagcgcaaaagatg

SEQ ID NO: 162575 - DNA, 103 bp, Artificial Sequence
  Synthetic Polynucleotide
taatacgactcactatagggtgatcttggcggcgatgccgtcccacacgcaacagaggagagcgtgtatgacggcatcgaacctggcggcagcgcaaaagatg

SEQ ID NO: 162576 - DNA, 103 bp, Artificial Sequence
  Synthetic Polynucleotide
taatacgactcactataggggtgataccgttgatcttggcggcgatgccgaacagaggagacggcatatgcgccaagataacctggcggcagcgcaaaagatg

SEQ ID NO: 162577 - DNA, 103 bp, Artificial Sequence
  Synthetic Polynucleotide
taatacgactcactatagggcttccagctggtgataccgttgatcttggcaacagaggagagccaagatgaacggtatcaacctggcggcagcgcaaaagatg

SEQ ID NO: 162578 - DNA, 103 bp, Artificial Sequence
  Synthetic Polynucleotide
taatacgactcactataggggggtggtttcctccgcttcgcccgccgccgaacagaggagacggcggatggcgaagcggaacctggcggcagcgcaaaagatg

SEQ ID NO: 162579 - DNA, 103 bp, Artificial Sequence
  Synthetic Polynucleotide
taatacgactcactatagggggcccgtgcgcttccagctggtgataccgtaacagaggagaacggtaatgccagctggaaacctggcggcagcgcaaaagatg

SEQ ID NO: 162580 - DNA, 103 bp, Artificial Sequence
  Synthetic Polynucleotide
taatacgactcactatagggtgcacctcctggcccgtgcgcttccagctgaacagaggagacagctgatggcgcacgggaacctggcggcagcgcaaaagatg

SEQ ID NO: 162581 - DNA, 103 bp, Artificial Sequence
  Synthetic Polynucleotide
taatacgactcactatagggccagcgcttctgcacctcctggcccgtgcgaacagaggagacgcacgatgcaggaggtgaacctggcggcagcgcaaaagatg

SEQ ID NO: 162582 - DNA, 103 bp, Artificial Sequence
  Synthetic Polynucleotide
taatacgactcactatagggtgaagtcgttccagcgcttctgcacctcctaacagaggagaaggaggatgagaagcgctaacctggcggcagcgcaaaagatg

SEQ ID NO: 162583 - DNA, 103 bp, Artificial Sequence
  Synthetic Polynucleotide
taatacgactcactataggggtgcggcgcttgaagtcgttccagcgcttcaacagaggagagaagcgatggaacgacttaacctggcggcagcgcaaaagatg

SEQ ID NO: 162584 - DNA, 103 bp, Artificial Sequence
  Synthetic Polynucleotide
taatacgactcactatagggcttctccttggtgcggcgcttgaagtcgttaacagaggagaaacgacatgaagcgccgcaacctggcggcagcgcaaaagatg

SEQ ID NO: 162585 - DNA, 103 bp, Artificial Sequence
  Synthetic Polynucleotide
taatacgactcactatagggcgcgagcgagcttctccttggtgcggcgctaacagaggagaagcgccatgccaaggagaaacctggcggcagcgcaaaagatg

SEQ ID NO: 162586 - DNA, 103 bp, Artificial Sequence
  Synthetic Polynucleotide
taatacgactcactataggggagtgcggcacgcgagcgagcttctccttgaacagaggagacaaggaatggctcgctcgaacctggcggcagcgcaaaagatg

SEQ ID NO: 162587 - DNA, 103 bp, Artificial Sequence
  Synthetic Polynucleotide
taatacgactcactataggggccctgcgtggagtgcggcacgcgagcgagaacagaggagactcgctatggtgccgcacaacctggcggcagcgcaaaagatg

SEQ ID NO: 162588 - DNA, 103 bp, Artificial Sequence
  Synthetic Polynucleotide
taatacgactcactatagggcgggcccggcgccctgcgtggagtgcggcaaacagaggagatgccgcatgccacgcaggaacctggcggcagcgcaaaagatg

SEQ ID NO: 162589 - DNA, 103 bp, Artificial Sequence
  Synthetic Polynucleotide
taatacgactcactatagggttgcgcaaccgggtggtttcctccgcttcgaacagaggagacgaagcatgggaaaccacaacctggcggcagcgcaaaagatg

SEQ ID NO: 162590 - DNA, 103 bp, Artificial Sequence
  Synthetic Polynucleotide
taatacgactcactatagggtcctccgcggcgggcccggcgccctgcgtgaacagaggagacacgcaatgcgccgggccaacctggcggcagcgcaaaagatg

SEQ ID NO: 162591 - DNA, 103 bp, Artificial Sequence
  Synthetic Polynucleotide
taatacgactcactatagggggagaaagcgtcctccgcggcgggcccggcaacagaggagagccgggatggccgcggagaacctggcggcagcgcaaaagatg

SEQ ID NO: 162592 - DNA, 103 bp, Artificial Sequence
  Synthetic Polynucleotide
taatacgactcactatagggcctcttccgcggagaaagcgtcctccgcggaacagaggagaccgcggatgacgctttctaacctggcggcagcgcaaaagatg

SEQ ID NO: 162593 - DNA, 103 bp, Artificial Sequence
  Synthetic Polynucleotide
taatacgactcactatagggaaaatggtctcctcttccgcggagaaagcgaacagaggagacgctttatgcgcggaagaaacctggcggcagcgcaaaagatg

SEQ ID NO: 162594 - DNA, 103 bp, Artificial Sequence
  Synthetic Polynucleotide
taatacgactcactatagggcaggatggcaaaaatggtctcctcttccgcaacagaggagagcggaaatggagaccattaacctggcggcagcgcaaaagatg

SEQ ID NO: 162595 - DNA, 103 bp, Artificial Sequence
  Synthetic Polynucleotide
taatacgactcactatagggcacctggccccaggatggcaaaaatggtctaacagaggagaagaccaatgttgccatccaacctggcggcagcgcaaaagatg

SEQ ID NO: 162596 - DNA, 103 bp, Artificial Sequence
  Synthetic Polynucleotide
taatacgactcactatagggggcgccgccacacctggccccaggatggcaaacagaggagatgccatatgggggccaggaacctggcggcagcgcaaaagatg

SEQ ID NO: 162597 - DNA, 103 bp, Artificial Sequence
  Synthetic Polynucleotide
taatacgactcactatagggacctgcccccggcgccgccacacctggcccaacagaggagagggccaatggtggcggcgaacctggcggcagcgcaaaagatg

SEQ ID NO: 162598 - DNA, 103 bp, Artificial Sequence
  Synthetic Polynucleotide
taatacgactcactatagggccgccccagcacctgcccccggcgccgccaaacagaggagatggcggatgcgggggcagaacctggcggcagcgcaaaagatg

SEQ ID NO: 162599 - DNA, 103 bp, Artificial Sequence
  Synthetic Polynucleotide
taatacgactcactataggggggggctcctccgccccagcacctgcccccaacagaggagagggggcatgtgctggggcaacctggcggcagcgcaaaagatg

SEQ ID NO: 162600 - DNA, 103 bp, Artificial Sequence
  Synthetic Polynucleotide
taatacgactcactataggggaagcgcggcttgcgcaaccgggtggtttcaacagaggagagaaaccatgcggttgcgcaacctggcggcagcgcaaaagatg

SEQ ID NO: 162601 - DNA, 103 bp, Artificial Sequence
  Synthetic Polynucleotide
taatacgactcactataggggggggccgcagggggctcctccgccccagcaacagaggagagctgggatggaggagcccaacctggcggcagcgcaaaagatg

SEQ ID NO: 162602 - DNA, 103 bp, Artificial Sequence
  Synthetic Polynucleotide
taatacgactcactataggggctgtgaagagggggccgcagggggctcctaacagaggagaaggagcatgctgcggcccaacctggcggcagcgcaaaagatg

SEQ ID NO: 162603 - DNA, 103 bp, Artificial Sequence
  Synthetic Polynucleotide
taatacgactcactataggggggggcggcggctgtgaagagggggccgcaaacagaggagatgcggcatgctcttcacaaacctggcggcagcgcaaaagatg

SEQ ID NO: 162604 - DNA, 103 bp, Artificial Sequence
  Synthetic Polynucleotide
taatacgactcactataggggcaggcgcttgggggcggcggctgtgaagaaacagaggagatcttcaatgccgccgcccaacctggcggcagcgcaaaagatg

SEQ ID NO: 162605 - DNA, 103 bp, Artificial Sequence
  Synthetic Polynucleotide
taatacgactcactatagggagcgctgagggcaggcgcttgggggcggcgaacagaggagacgccgcatgcaagcgcctaacctggcggcagcgcaaaagatg

SEQ ID NO: 162606 - DNA, 103 bp, Artificial Sequence
  Synthetic Polynucleotide
taatacgactcactataggggacaacacgtagcgctgagggcaggcgcttaacagaggagaaagcgcatgccctcagcgaacctggcggcagcgcaaaagatg

SEQ ID NO: 162607 - DNA, 103 bp, Artificial Sequence
  Synthetic Polynucleotide
taatacgactcactataggggcggtcttccgacaacacgtagcgctgaggaacagaggagacctcagatgtacgtgttgaacctggcggcagcgcaaaagatg

SEQ ID NO: 162608 - DNA, 103 bp, Artificial Sequence
  Synthetic Polynucleotide
taatacgactcactatagggggtcctcccggcggtcttccgacaacacgtaacagaggagaacgtgtatgcggaagaccaacctggcggcagcgcaaaagatg

SEQ ID NO: 162609 - DNA, 103 bp, Artificial Sequence
  Synthetic Polynucleotide
taatacgactcactatagggtctgcacgtcggtcctcccggcggtcttccaacagaggagaggaagaatgccgggaggaaacctggcggcagcgcaaaagatg

SEQ ID NO: 162610 - DNA, 103 bp, Artificial Sequence
  Synthetic Polynucleotide
taatacgactcactatagggggctgatgtatctgcacgtcggtcctcccgaacagaggagacgggagatgcgacgtgcaaacctggcggcagcgcaaaagatg

SEQ ID NO: 162611 - DNA, 103 bp, Artificial Sequence
  Synthetic Polynucleotide
taatacgactcactatagggcttcgaatgagaagcgcggcttgcgcaaccaacagaggagaggttgcatgagccgcgctaacctggcggcagcgcaaaagatg

SEQ ID NO: 162612 - DNA, 103 bp, Artificial Sequence
  Synthetic Polynucleotide
taatacgactcactatagggccttgctgtgggctgatgtatctgcacgtcaacagaggagagacgtgatgatacatcagaacctggcggcagcgcaaaagatg

SEQ ID NO: 162613 - DNA, 103 bp, Artificial Sequence
  Synthetic Polynucleotide
taatacgactcactatagggctggagcccgccttgctgtgggctgatgtaaacagaggagatacatcatgccacagcaaaacctggcggcagcgcaaaagatg

SEQ ID NO: 162614 - DNA, 103 bp, Artificial Sequence
  Synthetic Polynucleotide
taatacgactcactatagggctccgggctgctggagcccgccttgctgtgaacagaggagacacagcatggcgggctccaacctggcggcagcgcaaaagatg

SEQ ID NO: 162615 - DNA, 103 bp, Artificial Sequence
  Synthetic Polynucleotide
taatacgactcactataggggggcccatggctccgggctgctggagcccgaacagaggagacgggctatggcagcccggaacctggcggcagcgcaaaagatg

SEQ ID NO: 162616 - DNA, 103 bp, Artificial Sequence
  Synthetic Polynucleotide
taatacgactcactatagggcaggagggccgggcccatggctccgggctgaacagaggagacagcccatggccatgggcaacctggcggcagcgcaaaagatg

SEQ ID NO: 162617 - DNA, 103 bp, Artificial Sequence
  Synthetic Polynucleotide
taatacgactcactatagggctggggagtgcaggagggccgggcccatggaacagaggagaccatggatgcggccctccaacctggcggcagcgcaaaagatg

SEQ ID NO: 162618 - DNA, 103 bp, Artificial Sequence
  Synthetic Polynucleotide
taatacgactcactatagggagcccccttcctggggagtgcaggagggccaacagaggagaggccctatggcactccccaacctggcggcagcgcaaaagatg

SEQ ID NO: 162619 - DNA, 103 bp, Artificial Sequence
  Synthetic Polynucleotide
taatacgactcactatagggggccgtgggcagcccccttcctggggagtgaacagaggagacactccatgggaagggggaacctggcggcagcgcaaaagatg

SEQ ID NO: 162620 - DNA, 103 bp, Artificial Sequence
  Synthetic Polynucleotide
taatacgactcactatagggacgctccttgggccgtgggcagcccccttcaacagaggagagaagggatgtgcccacggaacctggcggcagcgcaaaagatg

SEQ ID NO: 162621 - DNA, 103 bp, Artificial Sequence
  Synthetic Polynucleotide
taatacgactcactataggggtggtgactcacgctccttgggccgtgggcaacagaggagagcccacatgccaaggagcaacctggcggcagcgcaaaagatg

SEQ ID NO: 162622 - DNA, 103 bp, Artificial Sequence
  Synthetic Polynucleotide
taatacgactcactatagggatctggttctcttcgaatgagaagcgcggcaacagaggagagccgcgatgctcattcgaaacctggcggcagcgcaaaagatg

SEQ ID NO: 162623 - DNA, 103 bp, Artificial Sequence
  Synthetic Polynucleotide
taatacgactcactataggggccgaagggggtggtgactcacgctccttgaacagaggagacaaggaatgtgagtcaccaacctggcggcagcgcaaaagatg

SEQ ID NO: 162624 - DNA, 103 bp, Artificial Sequence
  Synthetic Polynucleotide
taatacgactcactatagggcggctgcagggccgaagggggtggtgactcaacagaggagagagtcaatgcccccttcgaacctggcggcagcgcaaaagatg

SEQ ID NO: 162625 - DNA, 103 bp, Artificial Sequence
  Synthetic Polynucleotide
taatacgactcactataggggcagctggaccggctgcagggccgaaggggaacagaggagaccccttatgccctgcagcaacctggcggcagcgcaaaagatg

SEQ ID NO: 162626 - DNA, 103 bp, Artificial Sequence
  Synthetic Polynucleotide
taatacgactcactataggggccaggcgaggcagctggaccggctgcaggaacagaggagacctgcaatgggtccagctaacctggcggcagcgcaaaagatg

SEQ ID NO: 162627 - DNA, 103 bp, Artificial Sequence
  Synthetic Polynucleotide
taatacgactcactatagggtggagacaaggccaggcgaggcagctggacaacagaggagagtccagatgcctcgcctgaacctggcggcagcgcaaaagatg

SEQ ID NO: 162628 - DNA, 103 bp, Artificial Sequence
  Synthetic Polynucleotide
taatacgactcactatagggctgggggtggtggagacaaggccaggcgagaacagaggagactcgccatgccttgtctcaacctggcggcagcgcaaaagatg

SEQ ID NO: 162629 - DNA, 103 bp, Artificial Sequence
  Synthetic Polynucleotide
taatacgactcactatagggagtggaggggctgggggtggtggagacaagaacagaggagacttgtcatgaccacccccaacctggcggcagcgcaaaagatg

SEQ ID NO: 162630 - DNA, 103 bp, Artificial Sequence
  Synthetic Polynucleotide
taatacgactcactatagggtgggggtggcagtggaggggctgggggtggaacagaggagaccacccatggcccctccaaacctggcggcagcgcaaaagatg

SEQ ID NO: 162631 - DNA, 103 bp, Artificial Sequence
  Synthetic Polynucleotide
taatacgactcactatagggccagtggcggtgggggtggcagtggaggggaacagaggagacccctcatgtgccaccccaacctggcggcagcgcaaaagatg

SEQ ID NO: 162632 - DNA, 103 bp, Artificial Sequence
  Synthetic Polynucleotide
taatacgactcactataggggccacttgggccagtggcggtgggggtggcaacagaggagagccaccatgaccgccactaacctggcggcagcgcaaaagatg

SEQ ID NO: 162633 - DNA, 103 bp, Artificial Sequence
  Synthetic Polynucleotide
taatacgactcactataggggcggatcaggatctggttctcttcgaatgaaacagaggagatcattcatggagaaccagaacctggcggcagcgcaaaagatg

SEQ ID NO: 162634 - DNA, 103 bp, Artificial Sequence
  Synthetic Polynucleotide
taatacgactcactataggggggtgagggtgccacttgggccagtggcggaacagaggagaccgccaatggcccaagtgaacctggcggcagcgcaaaagatg

SEQ ID NO: 162635 - DNA, 103 bp, Artificial Sequence
  Synthetic Polynucleotide
taatacgactcactataggggggggctagggggtgagggtgccacttgggaacagaggagacccaagatgcaccctcacaacctggcggcagcgcaaaagatg

SEQ ID NO: 162636 - DNA, 103 bp, Artificial Sequence
  Synthetic Polynucleotide
taatacgactcactatagggggagggggtggggggctagggggtgagggtaacagaggagaaccctcatgccctagcccaacctggcggcagcgcaaaagatg

SEQ ID NO: 162637 - DNA, 103 bp, Artificial Sequence
  Synthetic Polynucleotide
taatacgactcactatagggtggaggccgaggagggggtggggggctaggaacagaggagacctagcatgccaccccctaacctggcggcagcgcaaaagatg

SEQ ID NO: 162638 - DNA, 103 bp, Artificial Sequence
  Synthetic Polynucleotide
taatacgactcactatagggagagcgtgggtggaggccgaggagggggtgaacagaggagacaccccatgctcggcctcaacctggcggcagcgcaaaagatg

SEQ ID NO: 162639 - DNA, 103 bp, Artificial Sequence
  Synthetic Polynucleotide
taatacgactcactatagggtctgaggccgagagcgtgggtggaggccgaaacagaggagatcggccatgacccacgctaacctggcggcagcgcaaaagatg

SEQ ID NO: 162640 - DNA, 103 bp, Artificial Sequence
  Synthetic Polynucleotide
taatacgactcactatagggcagggaggggtctgaggccgagagcgtgggaacagaggagacccacgatgtcggcctcaaacctggcggcagcgcaaaagatg

SEQ ID NO: 162641 - DNA, 103 bp, Artificial Sequence
  Synthetic Polynucleotide
taatacgactcactataggggcaggaagtccagggaggggtctgaggccgaacagaggagacggcctatgacccctcccaacctggcggcagcgcaaaagatg

SEQ ID NO: 162642 - DNA, 103 bp, Artificial Sequence
  Synthetic Polynucleotide
taatacgactcactatagggtgctgggcccgcaggaagtccagggaggggaacagaggagacccctcatgggacttcctaacctggcggcagcgcaaaagatg

SEQ ID NO: 162643 - DNA, 103 bp, Artificial Sequence
  Synthetic Polynucleotide
taatacgactcactatagggggcagtctcctgctgggcccgcaggaagtcaacagaggagagacttcatgcgggcccagaacctggcggcagcgcaaaagatg

SEQ ID NO: 162644 - DNA, 103 bp, Artificial Sequence
  Synthetic Polynucleotide
taatacgactcactatagggcgcgcacctcgcggatcaggatctggttctaacagaggagaagaaccatgtcctgatccaacctggcggcagcgcaaaagatg

SEQ ID NO: 162645 - DNA, 103 bp, Artificial Sequence
  Synthetic Polynucleotide
taatacgactcactatagggggatggcgttggcagtctcctgctgggcccaacagaggagagggcccatgaggagactgaacctggcggcagcgcaaaagatg

SEQ ID NO: 162646 - DNA, 103 bp, Artificial Sequence
  Synthetic Polynucleotide
taatacgactcactataggggccagctcccggatggcgttggcagtctccaacagaggagaggagacatgcaacgccataacctggcggcagcgcaaaagatg

SEQ ID NO: 162647 - DNA, 103 bp, Artificial Sequence
  Synthetic Polynucleotide
taatacgactcactatagggaagggtgccggccagctcccggatggcgttaacagaggagaaacgccatgcgggagctgaacctggcggcagcgcaaaagatg

SEQ ID NO: 162648 - DNA, 103 bp, Artificial Sequence
  Synthetic Polynucleotide
taatacgactcactataggggtccctgtcgaagggtgccggccagctcccaacagaggagagggagcatgccggcacccaacctggcggcagcgcaaaagatg

SEQ ID NO: 162649 - DNA, 103 bp, Artificial Sequence
  Synthetic Polynucleotide
taatacgactcactatagggagtttggccagtccctgtcgaagggtgccgaacagaggagacggcacatgtcgacagggaacctggcggcagcgcaaaagatg

SEQ ID NO: 162650 - DNA, 103 bp, Artificial Sequence
  Synthetic Polynucleotide
taatacgactcactatagggggcctcgctcagtttggccagtccctgtcgaacagaggagacgacagatgctggccaaaaacctggcggcagcgcaaaagatg

SEQ ID NO: 162651 - DNA, 103 bp, Artificial Sequence
  Synthetic Polynucleotide
taatacgactcactataggggagcgctgagggcctcgctcagtttggccaaacagaggagatggccaatgtgagcgaggaacctggcggcagcgcaaaagatg

SEQ ID NO: 162652 - DNA, 103 bp, Artificial Sequence
  Synthetic Polynucleotide
taatacgactcactatagggaggggcagcagagcgctgagggcctcgctcaacagaggagagagcgaatgcctcagcgcaacctggcggcagcgcaaaagatg

SEQ ID NO: 162653 - DNA, 103 bp, Artificial Sequence
  Synthetic Polynucleotide
taatacgactcactatagggtcctggcagaaggggcagcagagcgctgagaacagaggagactcagcatgctgctgcccaacctggcggcagcgcaaaagatg

SEQ ID NO: 162654 - DNA, 103 bp, Artificial Sequence
  Synthetic Polynucleotide
taatacgactcactatagggcaactggggttcctggcagaaggggcagcaaacagaggagatgctgcatgttctgccagaacctggcggcagcgcaaaagatg

SEQ ID NO: 162655 - DNA, 103 bp, Artificial Sequence
  Synthetic Polynucleotide
taatacgactcactataggggggtagtgggcgcgcacctcgcggatcaggaacagaggagacctgatatgcgaggtgcgaacctggcggcagcgcaaaagatg

SEQ ID NO: 162656 - DNA, 103 bp, Artificial Sequence
  Synthetic Polynucleotide
taatacgactcactatagggggcagggagtcaactggggttcctggcagaaacagaggagatctgccatgaaccccagtaacctggcggcagcgcaaaagatg

SEQ ID NO: 162657 - DNA, 103 bp, Artificial Sequence
  Synthetic Polynucleotide
taatacgactcactatagggcagaggtggaggcagggagtcaactggggtaacagaggagaaccccaatggactccctgaacctggcggcagcgcaaaagatg

SEQ ID NO: 162658 - DNA, 103 bp, Artificial Sequence
  Synthetic Polynucleotide
taatacgactcactatagggggggtgggggcagaggtggaggcagggagtaacagaggagaactcccatgctccacctcaacctggcggcagcgcaaaagatg

SEQ ID NO: 162659 - DNA, 103 bp, Artificial Sequence
  Synthetic Polynucleotide
taatacgactcactatagggggtgggggtgggggtgggggcagaggtggaaacagaggagatccaccatggcccccaccaacctggcggcagcgcaaaagatg

SEQ ID NO: 162660 - DNA, 103 bp, Artificial Sequence
  Synthetic Polynucleotide
taatacgactcactataggggggaggtggcggtgggggtgggggtgggggaacagaggagacccccaatgccacccccaaacctggcggcagcgcaaaagatg

SEQ ID NO: 162661 - DNA, 103 bp, Artificial Sequence
  Synthetic Polynucleotide
taatacgactcactatagggggacaggcctgggaggtggcggtgggggtgaacagaggagacaccccatgcgccacctcaacctggcggcagcgcaaaagatg

SEQ ID NO: 162662 - DNA, 103 bp, Artificial Sequence
  Synthetic Polynucleotide
taatacgactcactatagggggtgggggcaggacaggcctgggaggtggcaacagaggagagccaccatgcaggcctgtaacctggcggcagcgcaaaagatg

SEQ ID NO: 162663 - DNA, 103 bp, Artificial Sequence
  Synthetic Polynucleotide
taatacgactcactatagggcttgggggccggtgggggcaggacaggcctaacagaggagaaggcctatgctgcccccaaacctggcggcagcgcaaaagatg

SEQ ID NO: 162664 - DNA, 103 bp, Artificial Sequence
  Synthetic Polynucleotide
taatacgactcactatagggtgatctccaccttgggggccggtgggggcaaacagaggagatgccccatgcggcccccaaacctggcggcagcgcaaaagatg

SEQ ID NO: 162665 - DNA, 103 bp, Artificial Sequence
  Synthetic Polynucleotide
taatacgactcactatagggggctctggggtgatctccaccttgggggccaacagaggagaggccccatgggtggagataacctggcggcagcgcaaaagatg

SEQ ID NO: 162666 - DNA, 103 bp, Artificial Sequence
  Synthetic Polynucleotide
taatacgactcactatagggagctcgcttgtcttcattttctaagctcataacagaggagaatgagcatggaaaatgaaaacctggcggcagcgcaaaagatg

SEQ ID NO: 162667 - DNA, 103 bp, Artificial Sequence
  Synthetic Polynucleotide
taatacgactcactataggggtgccctgagcctgtgcatcctggggtgggaacagaggagacccaccatgggatgcacaaacctggcggcagcgcaaaagatg

SEQ ID NO: 162668 - DNA, 103 bp, Artificial Sequence
  Synthetic Polynucleotide
taatacgactcactataggggtactcaggcttgggactgggtgattctggaacagaggagaccagaaatgcccagtcccaacctggcggcagcgcaaaagatg

SEQ ID NO: 162669 - DNA, 103 bp, Artificial Sequence
  Synthetic Polynucleotide
taatacgactcactatagggcaataacagagtactcaggcttgggactggaacagaggagaccagtcatgagcctgagtaacctggcggcagcgcaaaagatg

SEQ ID NO: 162670 - DNA, 103 bp, Artificial Sequence
  Synthetic Polynucleotide
taatacgactcactatagggcggacctccacaataacagagtactcaggcaacagaggagagcctgaatgctctgttataacctggcggcagcgcaaaagatg

SEQ ID NO: 162671 - DNA, 103 bp, Artificial Sequence
  Synthetic Polynucleotide
taatacgactcactatagggatcatccgagcggacctccacaataacagaaacagaggagatctgttatggtggaggtcaacctggcggcagcgcaaaagatg

SEQ ID NO: 162672 - DNA, 103 bp, Artificial Sequence
  Synthetic Polynucleotide
taatacgactcactatagggcgtccttgtcatcatccgagcggacctccaaacagaggagatggaggatggctcggatgaacctggcggcagcgcaaaagatg

SEQ ID NO: 162673 - DNA, 103 bp, Artificial Sequence
  Synthetic Polynucleotide
taatacgactcactatagggtgggtgtcctcgtccttgtcatcatccgagaacagaggagactcggaatgtgacaaggaaacctggcggcagcgcaaaagatg

SEQ ID NO: 162674 - DNA, 103 bp, Artificial Sequence
  Synthetic Polynucleotide
taatacgactcactatagggcttccgggagtgggtgtcctcgtccttgtcaacagaggagagacaagatggaggacaccaacctggcggcagcgcaaaagatg

SEQ ID NO: 162675 - DNA, 103 bp, Artificial Sequence
  Synthetic Polynucleotide
taatacgactcactatagggtgactgttgacttccgggagtgggtgtcctaacagaggagaaggacaatgactcccggaaacctggcggcagcgcaaaagatg

SEQ ID NO: 162676 - DNA, 103 bp, Artificial Sequence
  Synthetic Polynucleotide
taatacgactcactataggggactcgtcagtgactgttgacttccgggagaacagaggagactcccgatggtcaacagtaacctggcggcagcgcaaaagatg

SEQ ID NO: 162677 - DNA, 103 bp, Artificial Sequence
  Synthetic Polynucleotide
taatacgactcactatagggctgcatctccgactcgtcagtgactgttgaaacagaggagatcaacaatgactgacgagaacctggcggcagcgcaaaagatg

SEQ ID NO: 162678 - DNA, 103 bp, Artificial Sequence
  Synthetic Polynucleotide
taatacgactcactatagggtgccccggacgtgccctgagcctgtgcatcaacagaggagagatgcaatggctcagggcaacctggcggcagcgcaaaagatg

SEQ ID NO: 162679 - DNA, 103 bp, Artificial Sequence
  Synthetic Polynucleotide
taatacgactcactatagggtcatcatgtcctgcatctccgactcgtcagaacagaggagactgacgatgcggagatgcaacctggcggcagcgcaaaagatg

SEQ ID NO: 162680 - DNA, 103 bp, Artificial Sequence
  Synthetic Polynucleotide
taatacgactcactatagggtttccccgggtcatcatgtcctgcatctccaacagaggagaggagatatgggacatgataacctggcggcagcgcaaaagatg

SEQ ID NO: 162681 - DNA, 103 bp, Artificial Sequence
  Synthetic Polynucleotide
taatacgactcactataggggaggcccaggtttccccgggtcatcatgtcaacagaggagagacatgatgacccggggaaacctggcggcagcgcaaaagatg

SEQ ID NO: 162682 - DNA, 103 bp, Artificial Sequence
  Synthetic Polynucleotide
taatacgactcactatagggcctgctccaggaggcccaggtttccccgggaacagaggagacccgggatgacctgggccaacctggcggcagcgcaaaagatg

SEQ ID NO: 162683 - DNA, 103 bp, Artificial Sequence
  Synthetic Polynucleotide
taatacgactcactatagggagggcgatggcctgctccaggaggcccaggaacagaggagacctgggatgcctggagcaaacctggcggcagcgcaaaagatg

SEQ ID NO: 162684 - DNA, 103 bp, Artificial Sequence
  Synthetic Polynucleotide
taatacgactcactatagggttcagccttcagggcgatggcctgctccagaacagaggagactggagatggccatcgccaacctggcggcagcgcaaaagatg

SEQ ID NO: 162685 - DNA, 103 bp, Artificial Sequence
  Synthetic Polynucleotide
taatacgactcactatagggtgcgcacctgttcagccttcagggcgatggaacagaggagaccatcgatgtgaaggctgaacctggcggcagcgcaaaagatg

SEQ ID NO: 162686 - DNA, 103 bp, Artificial Sequence
  Synthetic Polynucleotide
taatacgactcactatagggtcgcagactgtgcgcacctgttcagccttcaacagaggagagaaggcatgacaggtgcgaacctggcggcagcgcaaaagatg

SEQ ID NO: 162687 - DNA, 103 bp, Artificial Sequence
  Synthetic Polynucleotide
taatacgactcactataggggcagcccggctcgcagactgtgcgcacctgaacagaggagacaggtgatgacagtctgcaacctggcggcagcgcaaaagatg

SEQ ID NO: 162688 - DNA, 103 bp, Artificial Sequence
  Synthetic Polynucleotide
taatacgactcactatagggcggcaggcgggcagcccggctcgcagactgaacagaggagacagtctatgagccgggctaacctggcggcagcgcaaaagatg

SEQ ID NO: 162689 - DNA, 103 bp, Artificial Sequence
  Synthetic Polynucleotide
taatacgactcactatagggctggagtacttgccccggacgtgccctgagaacagaggagactcaggatgcgtccggggaacctggcggcagcgcaaaagatg

SEQ ID NO: 162690 - DNA, 103 bp, Artificial Sequence
  Synthetic Polynucleotide
taatacgactcactatagggtggctctgctcggcaggcgggcagcccggcaacagaggagagccgggatgcccgcctgcaacctggcggcagcgcaaaagatg

SEQ ID NO: 162691 - DNA, 103 bp, Artificial Sequence
  Synthetic Polynucleotide
taatacgactcactatagggcaggcccagctggctctgctcggcaggcggaacagaggagaccgcctatggagcagagcaacctggcggcagcgcaaaagatg

SEQ ID NO: 162692 - DNA, 103 bp, Artificial Sequence
  Synthetic Polynucleotide
taatacgactcactatagggctggctctcccaggcccagctggctctgctaacagaggagaagcagaatgagctgggccaacctggcggcagcgcaaaagatg

SEQ ID NO: 162693 - DNA, 103 bp, Artificial Sequence
  Synthetic Polynucleotide
taatacgactcactataggggctgccttccctggctctcccaggcccagcaacagaggagagctgggatggggagagccaacctggcggcagcgcaaaagatg

SEQ ID NO: 162694 - DNA, 103 bp, Artificial Sequence
  Synthetic Polynucleotide
taatacgactcactatagggcaggggctttgctgccttccctggctctccaacagaggagaggagagatggggaaggcaaacctggcggcagcgcaaaagatg

SEQ ID NO: 162695 - DNA, 103 bp, Artificial Sequence
  Synthetic Polynucleotide
taatacgactcactataggggcacagtgtccaggggctttgctgccttccaacagaggagaggaaggatgcaaagccccaacctggcggcagcgcaaaagatg

SEQ ID NO: 162696 - DNA, 103 bp, Artificial Sequence
  Synthetic Polynucleotide
taatacgactcactatagggtaactcttccgcacagtgtccaggggctttaacagaggagaaaagccatgggacactgtaacctggcggcagcgcaaaagatg

SEQ ID NO: 162697 - DNA, 103 bp, Artificial Sequence
  Synthetic Polynucleotide
taatacgactcactatagggtttactgtagtaactcttccgcacagtgtcaacagaggagagacactatgcggaagagtaacctggcggcagcgcaaaagatg

SEQ ID NO: 162698 - DNA, 103 bp, Artificial Sequence
  Synthetic Polynucleotide
taatacgactcactatagggttgaaggatctttactgtagtaactcttccaacagaggagaggaagaatgactacagtaaacctggcggcagcgcaaaagatg

SEQ ID NO: 162699 - DNA, 103 bp, Artificial Sequence
  Synthetic Polynucleotide
taatacgactcactatagggttctcagctcttgaaggatctttactgtagaacagaggagactacagatgagatccttcaacctggcggcagcgcaaaagatg

SEQ ID NO: 162700 - DNA, 103 bp, Artificial Sequence
  Synthetic Polynucleotide
taatacgactcactatagggacttcggtgcctggagtacttgccccggacaacagaggagagtccggatgaagtactccaacctggcggcagcgcaaaagatg

SEQ ID NO: 162701 - DNA, 103 bp, Artificial Sequence
  Synthetic Polynucleotide
taatacgactcactataggggatctcacgcttctcagctcttgaaggatcaacagaggagagatcctatgagagctgagaacctggcggcagcgcaaaagatg

SEQ ID NO: 162702 - DNA, 103 bp, Artificial Sequence
  Synthetic Polynucleotide
taatacgactcactatagggttggacacttgatctcacgcttctcagctcaacagaggagagagctgatgagcgtgagaaacctggcggcagcgcaaaagatg

SEQ ID NO: 162703 - DNA, 103 bp, Artificial Sequence
  Synthetic Polynucleotide
taatacgactcactatagggcagcctggtgttggacacttgatctcacgcaacagaggagagcgtgaatgcaagtgtccaacctggcggcagcgcaaaagatg

SEQ ID NO: 162704 - DNA, 103 bp, Artificial Sequence
  Synthetic Polynucleotide
taatacgactcactatagggagtgccatcacagcctggtgttggacacttaacagaggagaaagtgtatgacaccaggcaacctggcggcagcgcaaaagatg

SEQ ID NO: 162705 - DNA, 103 bp, Artificial Sequence
  Synthetic Polynucleotide
taatacgactcactatagggtaacgtggccagtgccatcacagcctggtgaacagaggagacaccagatggtgatggcaaacctggcggcagcgcaaaagatg

SEQ ID NO: 162706 - DNA, 103 bp, Artificial Sequence
  Synthetic Polynucleotide
taatacgactcactatagggtacaacccggtaacgtggccagtgccatcaaacagaggagatgatggatgtggccacgtaacctggcggcagcgcaaaagatg

SEQ ID NO: 162707 - DNA, 103 bp, Artificial Sequence
  Synthetic Polynucleotide
taatacgactcactataggggtggtgagggtacaacccggtaacgtggccaacagaggagaggccacatgaccgggttgaacctggcggcagcgcaaaagatg

SEQ ID NO: 162708 - DNA, 103 bp, Artificial Sequence
  Synthetic Polynucleotide
taatacgactcactatagggaaaggctgcggtggtgagggtacaacccggaacagaggagaccgggtatgaccctcaccaacctggcggcagcgcaaaagatg

SEQ ID NO: 162709 - DNA, 103 bp, Artificial Sequence
  Synthetic Polynucleotide
taatacgactcactatagggggacagccagaaaggctgcggtggtgagggaacagaggagaccctcaatgccgcagcctaacctggcggcagcgcaaaagatg

SEQ ID NO: 162710 - DNA, 103 bp, Artificial Sequence
  Synthetic Polynucleotide
taatacgactcactatagggatccttgtggggacagccagaaaggctgcgaacagaggagacgcagcatgtctggctgtaacctggcggcagcgcaaaagatg

SEQ ID NO: 162711 - DNA, 103 bp, Artificial Sequence
  Synthetic Polynucleotide
taatacgactcactatagggagctctgtaaacttcggtgcctggagtactaacagaggagaagtactatgggcaccgaaaacctggcggcagcgcaaaagatg

SEQ ID NO: 162712 - DNA, 103 bp, Artificial Sequence
  Synthetic Polynucleotide
taatacgactcactataggggggggatcctatccttgtggggacagccagaacagaggagactggctatgcccacaaggaacctggcggcagcgcaaaagatg

SEQ ID NO: 162713 - DNA, 103 bp, Artificial Sequence
  Synthetic Polynucleotide
taatacgactcactatagggaagatctctggggggatcctatccttgtggaacagaggagaccacaaatgtaggatcccaacctggcggcagcgcaaaagatg

SEQ ID NO: 162714 - DNA, 103 bp, Artificial Sequence
  Synthetic Polynucleotide
taatacgactcactatagggatgcatggctaagatctctggggggatcctaacagaggagaaggatcatgccagagatcaacctggcggcagcgcaaaagatg

SEQ ID NO: 162715 - DNA, 103 bp, Artificial Sequence
  Synthetic Polynucleotide
taatacgactcactataggggcacgttctcatgcatggctaagatctctgaacagaggagacagagaatgtagccatgcaacctggcggcagcgcaaaagatg

SEQ ID NO: 162716 - DNA, 103 bp, Artificial Sequence
  Synthetic Polynucleotide
taatacgactcactataggggggcacttcagcacgttctcatgcatggctaacagaggagaagccatatgtgagaacgtaacctggcggcagcgcaaaagatg

SEQ ID NO: 162717 - DNA, 103 bp, Artificial Sequence
  Synthetic Polynucleotide
taatacgactcactataggggccaggagtggggcacttcagcacgttctcaacagaggagagagaacatgctgaagtgcaacctggcggcagcgcaaaagatg

SEQ ID NO: 162718 - DNA, 103 bp, Artificial Sequence
  Synthetic Polynucleotide
taatacgactcactatagggggcctgtgcagccaggagtggggcacttcaaacagaggagatgaagtatgccactcctgaacctggcggcagcgcaaaagatg

SEQ ID NO: 162719 - DNA, 103 bp, Artificial Sequence
  Synthetic Polynucleotide
taatacgactcactatagggacgtgaccctggcctgtgcagccaggagtgaacagaggagacactccatgctgcacaggaacctggcggcagcgcaaaagatg

SEQ ID NO: 162720 - DNA, 103 bp, Artificial Sequence
  Synthetic Polynucleotide
taatacgactcactataggggttgctgttcacgtgaccctggcctgtgcaaacagaggagatgcacaatgcagggtcacaacctggcggcagcgcaaaagatg

SEQ ID NO: 162721 - DNA, 103 bp, Artificial Sequence
  Synthetic Polynucleotide
taatacgactcactataggggcgtgttgcggttgctgttcacgtgaccctaacagaggagaagggtcatgtgaacagcaaacctggcggcagcgcaaaagatg

SEQ ID NO: 162722 - DNA, 103 bp, Artificial Sequence
  Synthetic Polynucleotide
taatacgactcactataggggccagggggcagctctgtaaacttcggtgcaacagaggagagcaccgatgtttacagagaacctggcggcagcgcaaaagatg

SEQ ID NO: 162723 - DNA, 103 bp, Artificial Sequence
  Synthetic Polynucleotide
taatacgactcactatagggaaacttctgtgcgtgttgcggttgctgttcaacagaggagagaacagatgccgcaacacaacctggcggcagcgcaaaagatg

SEQ ID NO: 162724 - DNA, 103 bp, Artificial Sequence
  Synthetic Polynucleotide
taatacgactcactatagggacacccagacaaacttctgtgcgtgttgcgaacagaggagacgcaacatgcacagaagtaacctggcggcagcgcaaaagatg

SEQ ID NO: 162725 - DNA, 103 bp, Artificial Sequence
  Synthetic Polynucleotide
taatacgactcactatagggcagcaatgggacacccagacaaacttctgtaacagaggagaacagaaatgtgtctgggtaacctggcggcagcgcaaaagatg

SEQ ID NO: 162726 - DNA, 103 bp, Artificial Sequence
  Synthetic Polynucleotide
taatacgactcactatagggttttcggcggcagcaatgggacacccagacaacagaggagagtctggatgtcccattgcaacctggcggcagcgcaaaagatg

SEQ ID NO: 162727 - DNA, 103 bp, Artificial Sequence
  Synthetic Polynucleotide
taatacgactcactatagggtttggctaatttttcggcggcagcaatgggaacagaggagacccattatggccgccgaaaacctggcggcagcgcaaaagatg

SEQ ID NO: 162728 - DNA, 103 bp, Artificial Sequence
  Synthetic Polynucleotide
taatacgactcactatagggtctcatgggatttggctaatttttcggcggaacagaggagaccgccgatgaattagccaaacctggcggcagcgcaaaagatg

SEQ ID NO: 162729 - DNA, 103 bp, Artificial Sequence
  Synthetic Polynucleotide
taatacgactcactatagggggctgctgcttctcatgggatttggctaataacagaggagaattagcatgatcccatgaaacctggcggcagcgcaaaagatg

SEQ ID NO: 162730 - DNA, 103 bp, Artificial Sequence
  Synthetic Polynucleotide
taatacgactcactatagggtcctgtctgcggctgctgcttctcatgggaaacagaggagatcccatatgaagcagcagaacctggcggcagcgcaaaagatg

SEQ ID NO: 162731 - DNA, 103 bp, Artificial Sequence
  Synthetic Polynucleotide
taatacgactcactatagggtggaaggatctcctgtctgcggctgctgctaacagaggagaagcagcatgcgcagacagaacctggcggcagcgcaaaagatg

SEQ ID NO: 162732 - DNA, 103 bp, Artificial Sequence
  Synthetic Polynucleotide
taatacgactcactataggggagctactcttggaaggatctcctgtctgcaacagaggagagcagacatgagatccttcaacctggcggcagcgcaaaagatg

SEQ ID NO: 162733 - DNA, 103 bp, Artificial Sequence
  Synthetic Polynucleotide
taatacgactcactatagggcctcttcttggccagggggcagctctgtaaaacagaggagattacagatgtgccccctgaacctggcggcagcgcaaaagatg

SEQ ID NO: 162734 - DNA, 103 bp, Artificial Sequence
  Synthetic Polynucleotide
taatacgactcactatagggatcggaattggagctactcttggaaggatcaacagaggagagatcctatgaagagtagcaacctggcggcagcgcaaaagatg

SEQ ID NO: 162735 - DNA, 103 bp, Artificial Sequence
  Synthetic Polynucleotide
taatacgactcactatagggtgaggatccgatcggaattggagctactctaacagaggagaagagtaatgccaattccgaacctggcggcagcgcaaaagatg

SEQ ID NO: 162736 - DNA, 103 bp, Artificial Sequence
  Synthetic Polynucleotide
taatacgactcactatagggcacatgggcctgaggatccgatcggaattgaacagaggagacaattcatgtcggatcctaacctggcggcagcgcaaaagatg

SEQ ID NO: 162737 - DNA, 103 bp, Artificial Sequence
  Synthetic Polynucleotide
taatacgactcactatagggcttcacgaagcacatgggcctgaggatccgaacagaggagacggatcatgaggcccatgaacctggcggcagcgcaaaagatg

SEQ ID NO: 162738 - DNA, 103 bp, Artificial Sequence
  Synthetic Polynucleotide
taatacgactcactatagggcctcgagctgcttcacgaagcacatgggccaacagaggagaggcccaatggcttcgtgaaacctggcggcagcgcaaaagatg

SEQ ID NO: 162739 - DNA, 103 bp, Artificial Sequence
  Synthetic Polynucleotide
taatacgactcactatagggtatggagggacctcgagctgcttcacgaagaacagaggagacttcgtatggcagctcgaaacctggcggcagcgcaaaagatg

SEQ ID NO: 162740 - DNA, 103 bp, Artificial Sequence
  Synthetic Polynucleotide
taatacgactcactataggggtagctcccatatggagggacctcgagctgaacagaggagacagctcatggtccctccaaacctggcggcagcgcaaaagatg

SEQ ID NO: 162741 - DNA, 103 bp, Artificial Sequence
  Synthetic Polynucleotide
taatacgactcactatagggcgttgggccggtagctcccatatggagggaaacagaggagatccctcatgatgggagctaacctggcggcagcgcaaaagatg

SEQ ID NO: 162742 - DNA, 103 bp, Artificial Sequence
  Synthetic Polynucleotide
taatacgactcactataggggcgggggccacgttgggccggtagctcccaaacagaggagatgggagatgccggcccaaaacctggcggcagcgcaaaagatg

SEQ ID NO: 162743 - DNA, 103 bp, Artificial Sequence
  Synthetic Polynucleotide
taatacgactcactatagggcctgggtgtggcgggggccacgttgggccgaacagaggagacggcccatggtggcccccaacctggcggcagcgcaaaagatg

SEQ ID NO: 162744 - DNA, 103 bp, Artificial Sequence
  Synthetic Polynucleotide
taatacgactcactatagggcctccagcttcctcttcttggccagggggcaacagaggagagcccccatgccaagaagaaacctggcggcagcgcaaaagatg

SEQ ID NO: 162745 - DNA, 103 bp, Artificial Sequence
  Synthetic Polynucleotide
taatacgactcactatagggccaagttggccctgggtgtggcgggggccaaacagaggagatggcccatgccacacccaaacctggcggcagcgcaaaagatg

SEQ ID NO: 162746 - DNA, 103 bp, Artificial Sequence
  Synthetic Polynucleotide
taatacgactcactatagggagctccttggccaagttggccctgggtgtgaacagaggagacacaccatgggccaacttaacctggcggcagcgcaaaagatg

SEQ ID NO: 162747 - DNA, 103 bp, Artificial Sequence
  Synthetic Polynucleotide
taatacgactcactataggggaacttctccagctccttggccaagttggcaacagaggagagccaacatggccaaggagaacctggcggcagcgcaaaagatg

SEQ ID NO: 162748 - DNA, 103 bp, Artificial Sequence
  Synthetic Polynucleotide
taatacgactcactatagggtgaccttggagaacttctccagctccttggaacagaggagaccaaggatgtggagaagtaacctggcggcagcgcaaaagatg

SEQ ID NO: 162749 - DNA, 103 bp, Artificial Sequence
  Synthetic Polynucleotide
taatacgactcactatagggtagtcaaaggtgaccttggagaacttctccaacagaggagaggagaaatgctccaaggtaacctggcggcagcgcaaaagatg

SEQ ID NO: 162750 - DNA, 103 bp, Artificial Sequence
  Synthetic Polynucleotide
taatacgactcactataggggaaacttgcgtagtcaaaggtgaccttggaaacagaggagatccaagatgacctttgacaacctggcggcagcgcaaaagatg

SEQ ID NO: 162751 - DNA, 103 bp, Artificial Sequence
  Synthetic Polynucleotide
taatacgactcactatagggcctgagcatcgaaacttgcgtagtcaaaggaacagaggagacctttgatgacgcaagttaacctggcggcagcgcaaaagatg

SEQ ID NO: 162752 - DNA, 103 bp, Artificial Sequence
  Synthetic Polynucleotide
taatacgactcactatagggttgccaaaaacctgagcatcgaaacttgcgaacagaggagacgcaagatgcgatgctcaaacctggcggcagcgcaaaagatg

SEQ ID NO: 162753 - DNA, 103 bp, Artificial Sequence
  Synthetic Polynucleotide
taatacgactcactatagggaagcatgcgtttgccaaaaacctgagcatcaacagaggagagatgctatggtttttggcaacctggcggcagcgcaaaagatg

SEQ ID NO: 162754 - DNA, 103 bp, Artificial Sequence
  Synthetic Polynucleotide
taatacgactcactatagggtctttggggcaagcatgcgtttgccaaaaaaacagaggagatttttgatgaacgcatgcaacctggcggcagcgcaaaagatg

SEQ ID NO: 162755 - DNA, 103 bp, Artificial Sequence
  Synthetic Polynucleotide
taatacgactcactataggggcctcagcgccctccagcttcctcttcttgaacagaggagacaagaaatggaagctggaaacctggcggcagcgcaaaagatg

SEQ ID NO: 162756 - DNA, 103 bp, Artificial Sequence
  Synthetic Polynucleotide
taatacgactcactatagggctggtctgaatctttggggcaagcatgcgtaacagaggagaacgcatatgtgccccaaaaacctggcggcagcgcaaaagatg

SEQ ID NO: 162757 - DNA, 103 bp, Artificial Sequence
  Synthetic Polynucleotide
taatacgactcactatagggtgaggtttcgctggtctgaatctttggggcaacagaggagagccccaatgattcagaccaacctggcggcagcgcaaaagatg

SEQ ID NO: 162758 - DNA, 103 bp, Artificial Sequence
  Synthetic Polynucleotide
taatacgactcactatagggaggctttaggtgaggtttcgctggtctgaaaacagaggagattcagaatggcgaaacctaacctggcggcagcgcaaaagatg

SEQ ID NO: 162759 - DNA, 103 bp, Artificial Sequence
  Synthetic Polynucleotide
taatacgactcactatagggaagcattgaaaggctttaggtgaggtttcgaacagaggagacgaaacatgacctaaagcaacctggcggcagcgcaaaagatg

SEQ ID NO: 162760 - DNA, 103 bp, Artificial Sequence
  Synthetic Polynucleotide
taatacgactcactatagggcgagtagtcaaagcattgaaaggctttaggaacagaggagacctaaaatgtttcaatgcaacctggcggcagcgcaaaagatg

SEQ ID NO: 162761 - DNA, 103 bp, Artificial Sequence
  Synthetic Polynucleotide
taatacgactcactatagggcggcgtcctgcgagtagtcaaagcattgaaaacagaggagattcaatatgttgactactaacctggcggcagcgcaaaagatg

SEQ ID NO: 162762 - DNA, 103 bp, Artificial Sequence
  Synthetic Polynucleotide
taatacgactcactatagggtgtgcagcctcggcgtcctgcgagtagtcaaacagaggagatgactaatggcaggacgcaacctggcggcagcgcaaaagatg

SEQ ID NO: 162763 - DNA, 103 bp, Artificial Sequence
  Synthetic Polynucleotide
taatacgactcactatagggggcagccatgtgtgcagcctcggcgtcctgaacagaggagacaggacatggaggctgcaaacctggcggcagcgcaaaagatg

SEQ ID NO: 162764 - DNA, 103 bp, Artificial Sequence
  Synthetic Polynucleotide
taatacgactcactatagggggatggcagtggcagccatgtgtgcagcctaacagaggagaaggctgatgacatggctgaacctggcggcagcgcaaaagatg

SEQ ID NO: 162765 - DNA, 103 bp, Artificial Sequence
  Synthetic Polynucleotide
taatacgactcactataggggagaggttcaggatggcagtggcagccatgaacagaggagacatggcatgcactgccataacctggcggcagcgcaaaagatg

SEQ ID NO: 162766 - DNA, 103 bp, Artificial Sequence
  Synthetic Polynucleotide
taatacgactcactatagggcaggtgctcagcctcagcgccctccagcttaacagaggagaaagctgatgggcgctgagaacctggcggcagcgcaaaagatg

SEQ ID NO: 162767 - DNA, 103 bp, Artificial Sequence
  Synthetic Polynucleotide
taatacgactcactataggggcagcgcgtggagaggttcaggatggcagtaacagaggagaactgccatgctgaacctcaacctggcggcagcgcaaaagatg

SEQ ID NO: 162768 - DNA, 103 bp, Artificial Sequence
  Synthetic Polynucleotide
taatacgactcactataggggcatctcccagcagcgcgtggagaggttcaaacagaggagatgaaccatgccacgcgctaacctggcggcagcgcaaaagatg

SEQ ID NO: 162769 - DNA, 103 bp, Artificial Sequence
  Synthetic Polynucleotide
taatacgactcactatagggaggttctcaggcatctcccagcagcgcgtgaacagaggagacacgcgatgctgggagataacctggcggcagcgcaaaagatg

SEQ ID NO: 162770 - DNA, 103 bp, Artificial Sequence
  Synthetic Polynucleotide
taatacgactcactatagggcttcgtgctgaggttctcaggcatctcccaaacagaggagatgggagatgcctgagaacaacctggcggcagcgcaaaagatg

SEQ ID NO: 162771 - DNA, 103 bp, Artificial Sequence
  Synthetic Polynucleotide
taatacgactcactatagggggtcctgtggcttcgtgctgaggttctcagaacagaggagactgagaatgtcagcacgaaacctggcggcagcgcaaaagatg

SEQ ID NO: 162772 - DNA, 103 bp, Artificial Sequence
  Synthetic Polynucleotide
taatacgactcactatagggttgctggggaggtcctgtggcttcgtgctgaacagaggagacagcacatggccacaggaaacctggcggcagcgcaaaagatg

SEQ ID NO: 162773 - DNA, 103 bp, Artificial Sequence
  Synthetic Polynucleotide
taatacgactcactatagggatccacagacttgctggggaggtcctgtggaacagaggagaccacagatgctccccagcaacctggcggcagcgcaaaagatg

SEQ ID NO: 162774 - DNA, 103 bp, Artificial Sequence
  Synthetic Polynucleotide
taatacgactcactatagggctacctcgatatccacagacttgctggggaaacagaggagatccccaatgagtctgtggaacctggcggcagcgcaaaagatg

SEQ ID NO: 162775 - DNA, 103 bp, Artificial Sequence
  Synthetic Polynucleotide
taatacgactcactatagggccattttcgtctacctcgatatccacagacaacagaggagagtctgtatgtatcgaggtaacctggcggcagcgcaaaagatg

SEQ ID NO: 162776 - DNA, 103 bp, Artificial Sequence
  Synthetic Polynucleotide
taatacgactcactataggggtccagggttccattttcgtctacctcgataacagaggagaatcgagatggacgaaaataacctggcggcagcgcaaaagatg

SEQ ID NO: 162777 - DNA, 103 bp, Artificial Sequence
  Synthetic Polynucleotide
taatacgactcactatagggatcgggtgcgagctcgcttgtcttcattttaacagaggagaaaaatgatgacaagcgagaacctggcggcagcgcaaaagatg

SEQ ID NO: 162778 - DNA, 103 bp, Artificial Sequence
  Synthetic Polynucleotide
taatacgactcactatagggtcttggacaccaggtgctcagcctcagcgcaacagaggagagcgctgatgctgagcaccaacctggcggcagcgcaaaagatg

SEQ ID NO: 162779 - DNA, 103 bp, Artificial Sequence
  Synthetic Polynucleotide
taatacgactcactataggggcatgctcaagtccagggttccattttcgtaacagaggagaacgaaaatggaaccctggaacctggcggcagcgcaaaagatg

SEQ ID NO: 162780 - DNA, 103 bp, Artificial Sequence
  Synthetic Polynucleotide
taatacgactcactatagggcggtgtttgtgcatgctcaagtccagggttaacagaggagaaaccctatgcttgagcataacctggcggcagcgcaaaagatg

SEQ ID NO: 162781 - DNA, 103 bp, Artificial Sequence
  Synthetic Polynucleotide
taatacgactcactatagggttctcgtttgcggtgtttgtgcatgctcaaaacagaggagattgagcatgcacaaacacaacctggcggcagcgcaaaagatg

SEQ ID NO: 162782 - DNA, 103 bp, Artificial Sequence
  Synthetic Polynucleotide
taatacgactcactatagggggaaagcattttctcgtttgcggtgtttgtaacagaggagaacaaacatggcaaacgagaacctggcggcagcgcaaaagatg

SEQ ID NO: 162783 - DNA, 103 bp, Artificial Sequence
  Synthetic Polynucleotide
taatacgactcactatagggctgctgctggggaaagcattttctcgtttgaacagaggagacaaacgatgaaatgctttaacctggcggcagcgcaaaagatg

SEQ ID NO: 162784 - DNA, 103 bp, Artificial Sequence
  Synthetic Polynucleotide
taatacgactcactataggggctgcagctgctgctgctggggaaagcattaacagaggagaaatgctatgcccagcagcaacctggcggcagcgcaaaagatg

SEQ ID NO: 162785 - DNA, 103 bp, Artificial Sequence
  Synthetic Polynucleotide
taatacgactcactatagggcggggctgctgctgcagctgctgctgctggaacagaggagaccagcaatggcagctgcaaacctggcggcagcgcaaaagatg

SEQ ID NO: 162786 - DNA, 103 bp, Artificial Sequence
  Synthetic Polynucleotide
taatacgactcactataggggacttcacaccggggctgctgctgcagctgaacagaggagacagctgatgcagcagcccaacctggcggcagcgcaaaagatg

SEQ ID NO: 162787 - DNA, 103 bp, Artificial Sequence
  Synthetic Polynucleotide
taatacgactcactatagggggcgtcgggagacttcacaccggggctgctaacagaggagaagcagcatgggtgtgaagaacctggcggcagcgcaaaagatg

SEQ ID NO: 162788 - DNA, 103 bp, Artificial Sequence
  Synthetic Polynucleotide
taatacgactcactatagggggcgctgggaggcgtcgggagacttcacacaacagaggagagtgtgaatgctcccgacgaacctggcggcagcgcaaaagatg

SEQ ID NO: 162789 - DNA, 103 bp, Artificial Sequence
  Synthetic Polynucleotide
taatacgactcactatagggtgtgacttcctcttggacaccaggtgctcaaacagaggagatgagcaatgggtgtccaaaacctggcggcagcgcaaaagatg

SEQ ID NO: 162790 - DNA, 103 bp, Artificial Sequence
  Synthetic Polynucleotide
taatacgactcactataggggtgctgctgtggcgctgggaggcgtcgggaaacagaggagatcccgaatgctcccagcgaacctggcggcagcgcaaaagatg

SEQ ID NO: 162791 - DNA, 103 bp, Artificial Sequence
  Synthetic Polynucleotide
taatacgactcactataggggggggcgctggtgctgctgtggcgctgggaaacagaggagatcccagatgcacagcagcaacctggcggcagcgcaaaagatg

SEQ ID NO: 162792 - DNA, 103 bp, Artificial Sequence
  Synthetic Polynucleotide
taatacgactcactatagggtggagctgctgggggcgctggtgctgctgtaacagaggagaacagcaatgccagcgcccaacctggcggcagcgcaaaagatg

SEQ ID NO: 162793 - DNA, 103 bp, Artificial Sequence
  Synthetic Polynucleotide
taatacgactcactatagggggagaggtcatggagctgctgggggcgctgaacagaggagacagcgcatgcagcagctcaacctggcggcagcgcaaaagatg

SEQ ID NO: 162794 - DNA, 103 bp, Artificial Sequence
  Synthetic Polynucleotide
taatacgactcactataggggctggactggggagaggtcatggagctgctaacagaggagaagcagcatgatgacctctaacctggcggcagcgcaaaagatg

SEQ ID NO: 162795 - DNA, 103 bp, Artificial Sequence
  Synthetic Polynucleotide
taatacgactcactataggggggaggcctggctggactggggagaggtcaaacagaggagatgacctatgcccagtccaaacctggcggcagcgcaaaagatg

SEQ ID NO: 162796 - DNA, 103 bp, Artificial Sequence
  Synthetic Polynucleotide
taatacgactcactatagggtcgtcctggcgggaggcctggctggactggaacagaggagaccagtcatgccaggcctcaacctggcggcagcgcaaaagatg

SEQ ID NO: 162797 - DNA, 103 bp, Artificial Sequence
  Synthetic Polynucleotide
taatacgactcactatagggccggtcccactcgtcctggcgggaggcctgaacagaggagacaggccatgcgccaggacaacctggcggcagcgcaaaagatg

SEQ ID NO: 162798 - DNA, 103 bp, Artificial Sequence
  Synthetic Polynucleotide
taatacgactcactatagggagtccaggggccggtcccactcgtcctggcaacagaggagagccaggatgagtgggaccaacctggcggcagcgcaaaagatg

SEQ ID NO: 162799 - DNA, 103 bp, Artificial Sequence
  Synthetic Polynucleotide
taatacgactcactatagggggcttggtgtagtccaggggccggtcccacaacagaggagagtgggaatggcccctggaaacctggcggcagcgcaaaagatg

SEQ ID NO: 162800 - DNA, 103 bp, Artificial Sequence
  Synthetic Polynucleotide
taatacgactcactatagggcttcagggggtgtgacttcctcttggacacaacagaggagagtgtccatgaggaagtcaaacctggcggcagcgcaaaagatg

SEQ ID NO: 162801 - DNA, 103 bp, Artificial Sequence
  Synthetic Polynucleotide
taatacgactcactatagggcaggcggctaggcttggtgtagtccaggggaacagaggagacccctgatgtacaccaagaacctggcggcagcgcaaaagatg

SEQ ID NO: 162802 - DNA, 103 bp, Artificial Sequence
  Synthetic Polynucleotide
taatacgactcactatagggcctcctctctcaggcggctaggcttggtgtaacagaggagaacaccaatgctagccgccaacctggcggcagcgcaaaagatg

SEQ ID NO: 162803 - DNA, 103 bp, Artificial Sequence
  Synthetic Polynucleotide
taatacgactcactatagggtcctcaggttcctcctctctcaggcggctaaacagaggagatagccgatggagagaggaaacctggcggcagcgcaaaagatg

SEQ ID NO: 162804 - DNA, 103 bp, Artificial Sequence
  Synthetic Polynucleotide
taatacgactcactatagggtggctctgactcctcaggttcctcctctctaacagaggagaagagagatggaacctgagaacctggcggcagcgcaaaagatg

SEQ ID NO: 162805 - DNA, 103 bp, Artificial Sequence
  Synthetic Polynucleotide
taatacgactcactatagggaatgggctgctggctctgactcctcaggttaacagaggagaaacctgatgagtcagagcaacctggcggcagcgcaaaagatg

SEQ ID NO: 162806 - DNA, 103 bp, Artificial Sequence
  Synthetic Polynucleotide
taatacgactcactataggggaagcaaaagaatgggctgctggctctgacaacagaggagagtcagaatgagcagcccaaacctggcggcagcgcaaaagatg

SEQ ID NO: 162807 - DNA, 103 bp, Artificial Sequence
  Synthetic Polynucleotide
taatacgactcactatagggtgcttcagaagaagcaaaagaatgggctgcaacagaggagagcagccatgtcttttgctaacctggcggcagcgcaaaagatg

SEQ ID NO: 162808 - DNA, 103 bp, Artificial Sequence
  Synthetic Polynucleotide
taatacgactcactatagggcctggtcatctgcttcagaagaagcaaaagaacagaggagacttttgatgcttctgaagaacctggcggcagcgcaaaagatg

SEQ ID NO: 162809 - DNA, 103 bp, Artificial Sequence
  Synthetic Polynucleotide
taatacgactcactatagggtccgacacttcctggtcatctgcttcagaaaacagaggagattctgaatgagatgaccaaacctggcggcagcgcaaaagatg

SEQ ID NO: 162810 - DNA, 103 bp, Artificial Sequence
  Synthetic Polynucleotide
taatacgactcactatagggaaaattctcttccgacacttcctggtcatcaacagaggagagatgacatggaagtgtcgaacctggcggcagcgcaaaagatg

SEQ ID NO: 162811 - DNA, 103 bp, Artificial Sequence
  Synthetic Polynucleotide
taatacgactcactatagggccagagccagcttcagggggtgtgacttccaacagaggagaggaagtatgaccccctgaaacctggcggcagcgcaaaagatg

SEQ ID NO: 162812 - DNA, 103 bp, Artificial Sequence
  Synthetic Polynucleotide
taatacgactcactatagggtccgctcctcaaaattctcttccgacacttaacagaggagaaagtgtatgaagagaattaacctggcggcagcgcaaaagatg

SEQ ID NO: 162813 - DNA, 103 bp, Artificial Sequence
  Synthetic Polynucleotide
taatacgactcactatagggcccggatacttccgctcctcaaaattctctaacagaggagaagagaaatgtgaggagcgaacctggcggcagcgcaaaagatg

SEQ ID NO: 162814 - DNA, 103 bp, Artificial Sequence
  Synthetic Polynucleotide
taatacgactcactatagggggtgacttcccccggatacttccgctcctcaacagaggagagaggagatgaagtatccgaacctggcggcagcgcaaaagatg

SEQ ID NO: 162815 - DNA, 103 bp, Artificial Sequence
  Synthetic Polynucleotide
taatacgactcactatagggagttggtcagggtgacttcccccggatactaacagaggagaagtatcatggggaagtcaaacctggcggcagcgcaaaagatg

SEQ ID NO: 162816 - DNA, 103 bp, Artificial Sequence
  Synthetic Polynucleotide
taatacgactcactatagggttcagcttaaagttggtcagggtgacttccaacagaggagaggaagtatgcctgaccaaaacctggcggcagcgcaaaagatg

SEQ ID NO: 162817 - DNA, 103 bp, Artificial Sequence
  Synthetic Polynucleotide
taatacgactcactatagggggagagaaacttcagcttaaagttggtcagaacagaggagactgaccatgtttaagctgaacctggcggcagcgcaaaagatg

SEQ ID NO: 162818 - DNA, 103 bp, Artificial Sequence
  Synthetic Polynucleotide
taatacgactcactatagggttatgtccttggagagaaacttcagcttaaaacagaggagattaagcatgagtttctctaacctggcggcagcgcaaaagatg

SEQ ID NO: 162819 - DNA, 103 bp, Artificial Sequence
  Synthetic Polynucleotide
taatacgactcactatagggagctccttctttatgtccttggagagaaacaacagaggagagtttctatgcaaggacataacctggcggcagcgcaaaagatg

SEQ ID NO: 162820 - DNA, 103 bp, Artificial Sequence
  Synthetic Polynucleotide
taatacgactcactatagggacaggtgagcagctccttctttatgtccttaacagaggagaaaggacatgaagaaggagaacctggcggcagcgcaaaagatg

SEQ ID NO: 162821 - DNA, 103 bp, Artificial Sequence
  Synthetic Polynucleotide
taatacgactcactatagggcaggggtgggacaggtgagcagctccttctaacagaggagaagaaggatgtgctcacctaacctggcggcagcgcaaaagatg

SEQ ID NO: 162822 - DNA, 103 bp, Artificial Sequence
  Synthetic Polynucleotide
taatacgactcactatagggtagccctcgtccagagccagcttcagggggaacagaggagaccccctatggctggctctaacctggcggcagcgcaaaagatg

SEQ ID NO: 162823 - DNA, 103 bp, Artificial Sequence
  Synthetic Polynucleotide
taatacgactcactatagggccgtcacagccaggggtgggacaggtgagcaacagaggagagctcacatgtcccaccccaacctggcggcagcgcaaaagatg

SEQ ID NO: 162824 - DNA, 103 bp, Artificial Sequence
  Synthetic Polynucleotide
taatacgactcactataggggtggccgctgccgtcacagccaggggtgggaacagaggagacccaccatgggctgtgacaacctggcggcagcgcaaaagatg

SEQ ID NO: 162825 - DNA, 103 bp, Artificial Sequence
  Synthetic Polynucleotide
taatacgactcactatagggtcccggtgatgtggccgctgccgtcacagcaacagaggagagctgtgatggcagcggccaacctggcggcagcgcaaaagatg

SEQ ID NO: 162826 - DNA, 103 bp, Artificial Sequence
  Synthetic Polynucleotide
taatacgactcactataggggaggcgtagttcccggtgatgtggccgctgaacagaggagacagcggatgcatcaccggaacctggcggcagcgcaaaagatg

SEQ ID NO: 162827 - DNA, 103 bp, Artificial Sequence
  Synthetic Polynucleotide
taatacgactcactataggggctgcggtgggaggcgtagttcccggtgataacagaggagaatcaccatgaactacgccaacctggcggcagcgcaaaagatg

SEQ ID NO: 162828 - DNA, 103 bp, Artificial Sequence
  Synthetic Polynucleotide
taatacgactcactatagggaaccagagaggctgcggtgggaggcgtagtaacagaggagaactacgatgcccaccgcaaacctggcggcagcgcaaaagatg

SEQ ID NO: 162829 - DNA, 103 bp, Artificial Sequence
  Synthetic Polynucleotide
taatacgactcactataggggcaagagggcaaccagagaggctgcggtggaacagaggagaccaccgatgcctctctggaacctggcggcagcgcaaaagatg

SEQ ID NO: 162830 - DNA, 103 bp, Artificial Sequence
  Synthetic Polynucleotide
taatacgactcactataggggctcttgtcagcaagagggcaaccagagagaacagaggagactctctatgtgccctcttaacctggcggcagcgcaaaagatg

SEQ ID NO: 162831 - DNA, 103 bp, Artificial Sequence
  Synthetic Polynucleotide
taatacgactcactatagggggtttctgaggctcttgtcagcaagagggcaacagaggagagccctcatgctgacaagaaacctggcggcagcgcaaaagatg

SEQ ID NO: 162832 - DNA, 103 bp, Artificial Sequence
  Synthetic Polynucleotide
taatacgactcactataggggcagccatgaggtttctgaggctcttgtcaaacagaggagatgacaaatgcctcagaaaaacctggcggcagcgcaaaagatg

SEQ ID NO: 162833 - DNA, 103 bp, Artificial Sequence
  Synthetic Polynucleotide
taatacgactcactataggggtccacaccatagccctcgtccagagccagaacagaggagactggctatggacgagggcaacctggcggcagcgcaaaagatg

SEQ ID NO: 162834 - DNA, 103 bp, Artificial Sequence
  Synthetic Polynucleotide
taatacgactcactatagggagcagagtgggcagccatgaggtttctgagaacagaggagactcagaatgctcatggctaacctggcggcagcgcaaaagatg

SEQ ID NO: 162835 - DNA, 103 bp, Artificial Sequence
  Synthetic Polynucleotide
taatacgactcactatagggacttgaggtcagcagagtgggcagccatgaaacagaggagatcatggatgcccactctgaacctggcggcagcgcaaaagatg

SEQ ID NO: 162836 - DNA, 103 bp, Artificial Sequence
  Synthetic Polynucleotide
taatacgactcactatagggggcgtggggcacttgaggtcagcagagtggaacagaggagaccactcatgtgacctcaaaacctggcggcagcgcaaaagatg

SEQ ID NO: 162837 - DNA, 103 bp, Artificial Sequence
  Synthetic Polynucleotide
taatacgactcactataggggtcacagccgggcgtggggcacttgaggtcaacagaggagagacctcatgtgccccacgaacctggcggcagcgcaaaagatg

SEQ ID NO: 162838 - DNA, 103 bp, Artificial Sequence
  Synthetic Polynucleotide
taatacgactcactatagggggccagagccgtcacagccgggcgtggggcaacagaggagagccccaatgccggctgtgaacctggcggcagcgcaaaagatg

SEQ ID NO: 162839 - DNA, 103 bp, Artificial Sequence
  Synthetic Polynucleotide
taatacgactcactatagggcctgtgatgtggccagagccgtcacagccgaacagaggagacggctgatgcggctctggaacctggcggcagcgcaaaagatg

SEQ ID NO: 162840 - DNA, 103 bp, Artificial Sequence
  Synthetic Polynucleotide
taatacgactcactatagggagcgtagttccctgtgatgtggccagagccaacagaggagaggctctatgcacatcacaaacctggcggcagcgcaaaagatg

SEQ ID NO: 162841 - DNA, 103 bp, Artificial Sequence
  Synthetic Polynucleotide
taatacgactcactatagggtccggtgtgaagcgtagttccctgtgatgtaacagaggagaacatcaatgggaactacgaacctggcggcagcgcaaaagatg

SEQ ID NO: 162842 - DNA, 103 bp, Artificial Sequence
  Synthetic Polynucleotide
taatacgactcactatagggccggacaagctccggtgtgaagcgtagttcaacagaggagagaactaatgttcacaccgaacctggcggcagcgcaaaagatg

SEQ ID NO: 162843 - DNA, 103 bp, Artificial Sequence
  Synthetic Polynucleotide
taatacgactcactatagggacgagggcagccggacaagctccggtgtgaaacagaggagatcacacatgagcttgtccaacctggcggcagcgcaaaagatg

SEQ ID NO: 162844 - DNA, 103 bp, Artificial Sequence
  Synthetic Polynucleotide
taatacgactcactatagggtgccgtcgctgtccacaccatagccctcgtaacagaggagaacgaggatgatggtgtggaacctggcggcagcgcaaaagatg

SEQ ID NO: 162845 - DNA, 103 bp, Artificial Sequence
  Synthetic Polynucleotide
taatacgactcactatagggttttctttgcacgagggcagccggacaagcaacagaggagagcttgtatggctgccctcaacctggcggcagcgcaaaagatg

SEQ ID NO: 162846 - DNA, 103 bp, Artificial Sequence
  Synthetic Polynucleotide
taatacgactcactatagggttgactccacttttctttgcacgagggcagaacagaggagactgcccatgtgcaaagaaaacctggcggcagcgcaaaagatg

SEQ ID NO: 162847 - DNA, 103 bp, Artificial Sequence
  Synthetic Polynucleotide
taatacgactcactataggggggtgccaccttgactccacttttctttgcaacagaggagagcaaagatgagtggagtcaacctggcggcagcgcaaaagatg

SEQ ID NO: 162848 - DNA, 103 bp, Artificial Sequence
  Synthetic Polynucleotide
taatacgactcactatagggcgtccttggtgggtgccaccttgactccacaacagaggagagtggagatgaggtggcacaacctggcggcagcgcaaaagatg

SEQ ID NO: 162849 - DNA, 103 bp, Artificial Sequence
  Synthetic Polynucleotide
taatacgactcactatagggtcctccttgtcgtccttggtgggtgccaccaacagaggagaggtggcatgcaccaaggaaacctggcggcagcgcaaaagatg

SEQ ID NO: 162850 - DNA, 103 bp, Artificial Sequence
  Synthetic Polynucleotide
taatacgactcactatagggcagctcggggtcctccttgtcgtccttggtaacagaggagaaccaagatggacaaggagaacctggcggcagcgcaaaagatg

SEQ ID NO: 162851 - DNA, 103 bp, Artificial Sequence
  Synthetic Polynucleotide
taatacgactcactatagggggcacttcatcagctcggggtcctccttgtaacagaggagaacaaggatgaccccgagcaacctggcggcagcgcaaaagatg

SEQ ID NO: 162852 - DNA, 103 bp, Artificial Sequence
  Synthetic Polynucleotide
taatacgactcactatagggcctggaactgggcacttcatcagctcggggaacagaggagaccccgaatggatgaagtgaacctggcggcagcgcaaaagatg

SEQ ID NO: 162853 - DNA, 103 bp, Artificial Sequence
  Synthetic Polynucleotide
taatacgactcactatagggccccacacagcctggaactgggcacttcataacagaggagaatgaagatgccagttccaaacctggcggcagcgcaaaagatg

SEQ ID NO: 162854 - DNA, 103 bp, Artificial Sequence
  Synthetic Polynucleotide
taatacgactcactatagggtgtgaccgagccccacacagcctggaactgaacagaggagacagttcatggctgtgtggaacctggcggcagcgcaaaagatg

SEQ ID NO: 162855 - DNA, 103 bp, Artificial Sequence
  Synthetic Polynucleotide
taatacgactcactataggggtgtcctcactgccgtcgctgtccacaccaaacagaggagatggtgtatgcagcgacggaacctggcggcagcgcaaaagatg

SEQ ID NO: 162856 - DNA, 103 bp, Artificial Sequence
  Synthetic Polynucleotide
taatacgactcactatagggttcccgctgatgtgaccgagccccacacagaacagaggagactgtgtatggctcggtcaaacctggcggcagcgcaaaagatg

SEQ ID NO: 162857 - DNA, 103 bp, Artificial Sequence
  Synthetic Polynucleotide
taatacgactcactatagggagaggcgtatttcccgctgatgtgaccgagaacagaggagactcggtatgatcagcgggaacctggcggcagcgcaaaagatg

SEQ ID NO: 162858 - DNA, 103 bp, Artificial Sequence
  Synthetic Polynucleotide
taatacgactcactatagggcgctcctgtgagaggcgtatttcccgctgaaacagaggagatcagcgatgaatacgcctaacctggcggcagcgcaaaagatg

SEQ ID NO: 162859 - DNA, 103 bp, Artificial Sequence
  Synthetic Polynucleotide
taatacgactcactatagggcagccggatgcgctcctgtgagaggcgtataacagaggagaatacgcatgtcacaggagaacctggcggcagcgcaaaagatg

SEQ ID NO: 162860 - DNA, 103 bp, Artificial Sequence
  Synthetic Polynucleotide
taatacgactcactatagggggccagtgggcagccggatgcgctcctgtgaacagaggagacacaggatggcatccggcaacctggcggcagcgcaaaagatg

SEQ ID NO: 162861 - DNA, 103 bp, Artificial Sequence
  Synthetic Polynucleotide
taatacgactcactataggggcctgcgggcggccagtgggcagccggatgaacagaggagacatccgatggcccactggaacctggcggcagcgcaaaagatg

SEQ ID NO: 162862 - DNA, 103 bp, Artificial Sequence
  Synthetic Polynucleotide
taatacgactcactatagggccttccttctgcctgcgggcggccagtgggaacagaggagacccactatgcgcccgcagaacctggcggcagcgcaaaagatg

SEQ ID NO: 162863 - DNA, 103 bp, Artificial Sequence
  Synthetic Polynucleotide
taatacgactcactatagggattgagggacccttccttctgcctgcgggcaacagaggagagcccgcatgcagaaggaaaacctggcggcagcgcaaaagatg

SEQ ID NO: 162864 - DNA, 103 bp, Artificial Sequence
  Synthetic Polynucleotide
taatacgactcactatagggatgacgagccattgagggacccttccttctaacagaggagaagaaggatgggtccctcaaacctggcggcagcgcaaaagatg

SEQ ID NO: 162865 - DNA, 103 bp, Artificial Sequence
  Synthetic Polynucleotide
taatacgactcactatagggttccaggagaatgacgagccattgagggacaacagaggagagtccctatgtggctcgtcaacctggcggcagcgcaaaagatg

SEQ ID NO: 162866 - DNA, 103 bp, Artificial Sequence
  Synthetic Polynucleotide
taatacgactcactatagggcttcacctcagtgtcctcactgccgtcgctaacagaggagaagcgacatgagtgaggacaacctggcggcagcgcaaaagatg

SEQ ID NO: 162867 - DNA, 103 bp, Artificial Sequence
  Synthetic Polynucleotide
taatacgactcactatagggcttcagggacttccaggagaatgacgagccaacagaggagaggctcgatgttctcctggaacctggcggcagcgcaaaagatg

SEQ ID NO: 162868 - DNA, 103 bp, Artificial Sequence
  Synthetic Polynucleotide
taatacgactcactataggggtccttcattcttcagggacttccaggagaaacagaggagatctcctatgagtccctgaaacctggcggcagcgcaaaagatg

SEQ ID NO: 162869 - DNA, 103 bp, Artificial Sequence
  Synthetic Polynucleotide
taatacgactcactataggggggcaggtcggtccttcattcttcagggacaacagaggagagtccctatggaatgaaggaacctggcggcagcgcaaaagatg

SEQ ID NO: 162870 - DNA, 103 bp, Artificial Sequence
  Synthetic Polynucleotide
taatacgactcactataggggcccggggtggggcaggtcggtccttcattaacagaggagaaatgaaatgccgacctgcaacctggcggcagcgcaaaagatg

SEQ ID NO: 162871 - DNA, 103 bp, Artificial Sequence
  Synthetic Polynucleotide
taatacgactcactatagggagccgtcacagcccggggtggggcaggtcgaacagaggagacgacctatgccaccccggaacctggcggcagcgcaaaagatg

SEQ ID NO: 162872 - DNA, 103 bp, Artificial Sequence
  Synthetic Polynucleotide
taatacgactcactataggggcgtggccagagccgtcacagcccggggtgaacagaggagacaccccatgctgtgacggaacctggcggcagcgcaaaagatg

SEQ ID NO: 162873 - DNA, 103 bp, Artificial Sequence
  Synthetic Polynucleotide
taatacgactcactatagggactcccattggcgtggccagagccgtcacaaacagaggagatgtgacatgtctggccacaacctggcggcagcgcaaaagatg

SEQ ID NO: 162874 - DNA, 103 bp, Artificial Sequence
  Synthetic Polynucleotide
taatacgactcactataggggggtgaggaaactcccattggcgtggccagaacagaggagactggccatgccaatgggaaacctggcggcagcgcaaaagatg

SEQ ID NO: 162875 - DNA, 103 bp, Artificial Sequence
  Synthetic Polynucleotide
taatacgactcactatagggaaactccggtgggtgaggaaactcccattgaacagaggagacaatggatgtttcctcacaacctggcggcagcgcaaaagatg

SEQ ID NO: 162876 - DNA, 103 bp, Artificial Sequence
  Synthetic Polynucleotide
taatacgactcactatagggacagcctgacaaactccggtgggtgaggaaaacagaggagattcctcatgcaccggagtaacctggcggcagcgcaaaagatg

SEQ ID NO: 162877 - DNA, 103 bp, Artificial Sequence
  Synthetic Polynucleotide
taatacgactcactatagggcagaggcgtccttcacctcagtgtcctcacaacagaggagagtgaggatgctgaggtgaaacctggcggcagcgcaaaagatg

SEQ ID NO: 162878 - DNA, 103 bp, Artificial Sequence
  Synthetic Polynucleotide
taatacgactcactatagggttgctctgggacagcctgacaaactccggtaacagaggagaaccggaatgtgtcaggctaacctggcggcagcgcaaaagatg

SEQ ID NO: 162879 - DNA, 103 bp, Artificial Sequence
  Synthetic Polynucleotide
taatacgactcactatagggccagcaaaggttgctctgggacagcctgacaacagaggagagtcaggatgtcccagagcaacctggcggcagcgcaaaagatg

SEQ ID NO: 162880 - DNA, 103 bp, Artificial Sequence
  Synthetic Polynucleotide
taatacgactcactatagggtcccttctttccagcaaaggttgctctgggaacagaggagacccagaatgacctttgctaacctggcggcagcgcaaaagatg

SEQ ID NO: 162881 - DNA, 103 bp, Artificial Sequence
  Synthetic Polynucleotide
taatacgactcactatagggctgacagttttcccttctttccagcaaaggaacagaggagacctttgatggaaagaaggaacctggcggcagcgcaaaagatg

SEQ ID NO: 162882 - DNA, 103 bp, Artificial Sequence
  Synthetic Polynucleotide
taatacgactcactatagggacctcatcccctgacagttttcccttctttaacagaggagaaaagaaatgaaaactgtcaacctggcggcagcgcaaaagatg

SEQ ID NO: 162883 - DNA, 103 bp, Artificial Sequence
  Synthetic Polynucleotide
taatacgactcactatagggtggactgaggacctcatcccctgacagtttaacagaggagaaaactgatgggggatgagaacctggcggcagcgcaaaagatg

SEQ ID NO: 162884 - DNA, 103 bp, Artificial Sequence
  Synthetic Polynucleotide
taatacgactcactatagggtcttgaactttggactgaggacctcatcccaacagaggagagggatgatgtcctcagtcaacctggcggcagcgcaaaagatg

SEQ ID NO: 162885 - DNA, 103 bp, Artificial Sequence
  Synthetic Polynucleotide
taatacgactcactatagggacgtcgctagtcttgaactttggactgaggaacagaggagacctcagatgaaagttcaaaacctggcggcagcgcaaaagatg

SEQ ID NO: 162886 - DNA, 103 bp, Artificial Sequence
  Synthetic Polynucleotide
taatacgactcactatagggattctccaacacgtcgctagtcttgaacttaacagaggagaaagttcatgactagcgacaacctggcggcagcgcaaaagatg

SEQ ID NO: 162887 - DNA, 103 bp, Artificial Sequence
  Synthetic Polynucleotide
taatacgactcactatagggtctcctcatcattctccaacacgtcgctagaacagaggagactagcgatgtgttggagaaacctggcggcagcgcaaaagatg

SEQ ID NO: 162888 - DNA, 103 bp, Artificial Sequence
  Synthetic Polynucleotide
taatacgactcactatagggagggccttggatcgggtgcgagctcgcttgaacagaggagacaagcgatgtcgcacccgaacctggcggcagcgcaaaagatg

SEQ ID NO: 162889 - DNA, 103 bp, Artificial Sequence
  Synthetic Polynucleotide
taatacgactcactatagggtcatccgaaacagaggcgtccttcacctcaaacagaggagatgaggtatgggacgcctcaacctggcggcagcgcaaaagatg

SEQ ID NO: 162890 - DNA, 103 bp, Artificial Sequence
  Synthetic Polynucleotide
taatacgactcactatagggagctgcttgatctcctcatcattctccaacaacagaggagagttggaatgtgatgaggaaacctggcggcagcgcaaaagatg

SEQ ID NO: 162891 - DNA, 103 bp, Artificial Sequence
  Synthetic Polynucleotide
taatacgactcactatagggctcctggttcagctgcttgatctcctcatcaacagaggagagatgagatgatcaagcagaacctggcggcagcgcaaaagatg

SEQ ID NO: 162892 - DNA, 103 bp, Artificial Sequence
  Synthetic Polynucleotide
taatacgactcactatagggggtctcggatctcctggttcagctgcttgaaacagaggagatcaagcatgtgaaccaggaacctggcggcagcgcaaaagatg

SEQ ID NO: 162893 - DNA, 103 bp, Artificial Sequence
  Synthetic Polynucleotide
taatacgactcactataggggactcgttcaggtctcggatctcctggttcaacagaggagagaaccaatggatccgagaaacctggcggcagcgcaaaagatg

SEQ ID NO: 162894 - DNA, 103 bp, Artificial Sequence
  Synthetic Polynucleotide
taatacgactcactatagggctccgagttggactcgttcaggtctcggataacagaggagaatccgaatgctgaacgagaacctggcggcagcgcaaaagatg

SEQ ID NO: 162895 - DNA, 103 bp, Artificial Sequence
  Synthetic Polynucleotide
taatacgactcactatagggcagcctccatctccgagttggactcgttcaaacagaggagatgaacgatgccaactcggaacctggcggcagcgcaaaagatg

SEQ ID NO: 162896 - DNA, 103 bp, Artificial Sequence
  Synthetic Polynucleotide
taatacgactcactatagggtgcaccatggcagcctccatctccgagttgaacagaggagacaactcatggatggaggcaacctggcggcagcgcaaaagatg

SEQ ID NO: 162897 - DNA, 103 bp, Artificial Sequence
  Synthetic Polynucleotide
taatacgactcactatagggggactgcagctgcaccatggcagcctccataacagaggagaatggagatggccatggtgaacctggcggcagcgcaaaagatg

SEQ ID NO: 162898 - DNA, 103 bp, Artificial Sequence
  Synthetic Polynucleotide
taatacgactcactatagggaggagatctgggactgcagctgcaccatggaacagaggagaccatggatgagctgcagtaacctggcggcagcgcaaaagatg

SEQ ID NO: 162899 - DNA, 103 bp, Artificial Sequence
  Synthetic Polynucleotide
taatacgactcactatagggttctccatggaggagatctgggactgcagcaacagaggagagctgcaatgccagatctcaacctggcggcagcgcaaaagatg

SEQ ID NO: 162900 - DNA, 103 bp, Artificial Sequence
  Synthetic Polynucleotide
taatacgactcactatagggtccttccgattcatccgaaacagaggcgtcaacagaggagagacgccatggtttcggataacctggcggcagcgcaaaagatg

SEQ ID NO: 162901 - DNA, 103 bp, Artificial Sequence
  Synthetic Polynucleotide
taatacgactcactatagggcttcaggttcttctccatggaggagatctgaacagaggagacagatcatgtccatggagaacctggcggcagcgcaaaagatg

SEQ ID NO: 162902 - DNA, 103 bp, Artificial Sequence
  Synthetic Polynucleotide
taatacgactcactatagggcctcgatgttcttcaggttcttctccatggaacagaggagaccatggatgagaacctgaaacctggcggcagcgcaaaagatg

SEQ ID NO: 162903 - DNA, 103 bp, Artificial Sequence
  Synthetic Polynucleotide
taatacgactcactatagggttgttctcctcctcgatgttcttcaggttcaacagaggagagaacctatggaacatcgaaacctggcggcagcgcaaaagatg

SEQ ID NO: 162904 - DNA, 103 bp, Artificial Sequence
  Synthetic Polynucleotide
taatacgactcactatagggctcaatgagcttgttctcctcctcgatgttaacagaggagaaacatcatggaggagaacaacctggcggcagcgcaaaagatg

SEQ ID NO: 162905 - DNA, 103 bp, Artificial Sequence
  Synthetic Polynucleotide
taatacgactcactatagggcattctgctcctcaatgagcttgttctcctaacagaggagaaggagaatgagctcattgaacctggcggcagcgcaaaagatg

SEQ ID NO: 162906 - DNA, 103 bp, Artificial Sequence
  Synthetic Polynucleotide
taatacgactcactatagggaacagggcttcattctgctcctcaatgagcaacagaggagagctcatatgggagcagaaaacctggcggcagcgcaaaagatg

SEQ ID NO: 162907 - DNA, 103 bp, Artificial Sequence
  Synthetic Polynucleotide
taatacgactcactatagggcagctccagaaacagggcttcattctgctcaacagaggagagagcagatggaagccctgaacctggcggcagcgcaaaagatg

SEQ ID NO: 162908 - DNA, 103 bp, Artificial Sequence
  Synthetic Polynucleotide
taatacgactcactatagggtcaggccggacagctccagaaacagggcttaacagaggagaaagcccatgttctggagcaacctggcggcagcgcaaaagatg

SEQ ID NO: 162909 - DNA, 103 bp, Artificial Sequence
  Synthetic Polynucleotide
taatacgactcactatagggagggcctggctcaggccggacagctccagaaacagaggagatctggaatggtccggcctaacctggcggcagcgcaaaagatg

SEQ ID NO: 162910 - DNA, 103 bp, Artificial Sequence
  Synthetic Polynucleotide
taatacgactcactatagggactttggatgagggcctggctcaggccggaaacagaggagatccggcatgagccaggccaacctggcggcagcgcaaaagatg

SEQ ID NO: 162911 - DNA, 103 bp, Artificial Sequence
  Synthetic Polynucleotide
taatacgactcactatagggcctccagagttccttccgattcatccgaaaaacagaggagatttcggatgaatcggaagaacctggcggcagcgcaaaagatg

SEQ ID NO: 162912 - DNA, 103 bp, Artificial Sequence
  Synthetic Polynucleotide
taatacgactcactatagggtattggcgagactttggatgagggcctggcaacagaggagagccaggatgtcatccaaaaacctggcggcagcgcaaaagatg

SEQ ID NO: 162913 - DNA, 103 bp, Artificial Sequence
  Synthetic Polynucleotide
taatacgactcactatagggggaaggcggatattggcgagactttggatgaacagaggagacatccaatgtctcgccaaaacctggcggcagcgcaaaagatg

SEQ ID NO: 162914 - DNA, 103 bp, Artificial Sequence
  Synthetic Polynucleotide
taatacgactcactatagggctccatgtgcggaaggcggatattggcgagaacagaggagactcgccatgatccgccttaacctggcggcagcgcaaaagatg

SEQ ID NO: 162915 - DNA, 103 bp, Artificial Sequence
  Synthetic Polynucleotide
taatacgactcactatagggcgcatattggctccatgtgcggaaggcggaaacagaggagatccgccatgcgcacatggaacctggcggcagcgcaaaagatg

SEQ ID NO: 162916 - DNA, 103 bp, Artificial Sequence
  Synthetic Polynucleotide
taatacgactcactatagggaaattctgttcgcatattggctccatgtgcaacagaggagagcacatatggccaatatgaacctggcggcagcgcaaaagatg

SEQ ID NO: 162917 - DNA, 103 bp, Artificial Sequence
  Synthetic Polynucleotide
taatacgactcactatagggataggcatcgaaattctgttcgcatattggaacagaggagaccaataatggaacagaataacctggcggcagcgcaaaagatg

SEQ ID NO: 162918 - DNA, 103 bp, Artificial Sequence
  Synthetic Polynucleotide
taatacgactcactataggggggtgctcacataggcatcgaaattctgttaacagaggagaaacagaatgtcgatgcctaacctggcggcagcgcaaaagatg

SEQ ID NO: 162919 - DNA, 103 bp, Artificial Sequence
  Synthetic Polynucleotide
taatacgactcactatagggatgtcggtgagggtgctcacataggcatcgaacagaggagacgatgcatgtgtgagcacaacctggcggcagcgcaaaagatg

SEQ ID NO: 162920 - DNA, 103 bp, Artificial Sequence
  Synthetic Polynucleotide
taatacgactcactataggggttggagtacatgtcggtgagggtgctcacaacagaggagagtgagcatgctcaccgacaacctggcggcagcgcaaaagatg

SEQ ID NO: 162921 - DNA, 103 bp, Artificial Sequence
  Synthetic Polynucleotide
taatacgactcactatagggccgggtcctggttggagtacatgtcggtgaaacagaggagatcaccgatgtgtactccaaacctggcggcagcgcaaaagatg

SEQ ID NO: 162922 - DNA, 103 bp, Artificial Sequence
  Synthetic Polynucleotide
taatacgactcactataggggcctcggccccctccagagttccttccgataacagaggagaatcggaatgaactctggaaacctggcggcagcgcaaaagatg

SEQ ID NO: 162923 - DNA, 103 bp, Artificial Sequence
  Synthetic Polynucleotide
taatacgactcactatagggtccttgttctccgggtcctggttggagtacaacagaggagagtactcatgccaggacccaacctggcggcagcgcaaaagatg

SEQ ID NO: 162924 - DNA, 103 bp, Artificial Sequence
  Synthetic Polynucleotide
taatacgactcactatagggctccaggaggtccttgttctccgggtcctgaacagaggagacaggacatggagaacaagaacctggcggcagcgcaaaagatg

SEQ ID NO: 162925 - DNA, 103 bp, Artificial Sequence
  Synthetic Polynucleotide
taatacgactcactataggggcttgatgctctccaggaggtccttgttctaacagaggagaagaacaatgacctcctggaacctggcggcagcgcaaaagatg

SEQ ID NO: 162926 - DNA, 103 bp, Artificial Sequence
  Synthetic Polynucleotide
taatacgactcactatagggctcacagcctgcttgatgctctccaggaggaacagaggagacctcctatggagcatcaaaacctggcggcagcgcaaaagatg

SEQ ID NO: 162927 - DNA, 103 bp, Artificial Sequence
  Synthetic Polynucleotide
taatacgactcactatagggctggatgcccctcacagcctgcttgatgctaacagaggagaagcatcatgcaggctgtgaacctggcggcagcgcaaaagatg

SEQ ID NO: 162928 - DNA, 103 bp, Artificial Sequence
  Synthetic Polynucleotide
taatacgactcactatagggtgacgtctcagcctcggccccctccagagtaacagaggagaactctgatgggggccgagaacctggcggcagcgcaaaagatg

SEQ ID NO: 162929 - DNA, 103 bp, Artificial Sequence
  Synthetic Polynucleotide
taatacgactcactatagggcgtcctgtcctgacgtctcagcctcggcccaacagaggagagggccgatgctgagacgtaacctggcggcagcgcaaaagatg

SEQ ID NO: 162930 - DNA, 103 bp, Artificial Sequence
  Synthetic Polynucleotide
taatacgactcactatagggcgatgaatctcgtcctgtcctgacgtctcaaacagaggagatgagacatgaggacaggaaacctggcggcagcgcaaaagatg

SEQ ID NO: 162931 - DNA, 103 bp, Artificial Sequence
  Synthetic Polynucleotide
taatacgactcactatagggtgtctcggggcgatgaatctcgtcctgtccaacagaggagaggacagatggagattcataacctggcggcagcgcaaaagatg

SEQ ID NO: 162932 - DNA, 103 bp, Artificial Sequence
  Synthetic Polynucleotide
taatacgactcactatagggttccttcagctgtctcggggcgatgaatctaacagaggagaagattcatggccccgagaaacctggcggcagcgcaaaagatg

SEQ ID NO: 162933 - DNA, 103 bp, Artificial Sequence
  Synthetic Polynucleotide
taatacgactcactatagggacggggctccttccttcagctgtctcggggaacagaggagaccccgaatgagctgaaggaacctggcggcagcgcaaaagatg

SEQ ID NO: 162934 - DNA, 103 bp, Artificial Sequence
  Synthetic Polynucleotide
taatacgactcactataggggggtcctcgcagggccttggatcgggtgcgaacagaggagacgcaccatgtccaaggccaacctggcggcagcgcaaaagatg

SEQ ID NO: 162935 - DNA, 103 bp, Artificial Sequence
  Synthetic Polynucleotide
taatacgactcactatagggatgggacttgacggggctccttccttcagcaacagaggagagctgaaatgaggagccccaacctggcggcagcgcaaaagatg

SEQ ID NO: 162936 - DNA, 103 bp, Artificial Sequence
  Synthetic Polynucleotide
taatacgactcactatagggtggatccaaaatgggacttgacggggctccaacagaggagaggagccatgtcaagtcccaacctggcggcagcgcaaaagatg

SEQ ID NO: 162937 - DNA, 103 bp, Artificial Sequence
  Synthetic Polynucleotide
taatacgactcactatagggccgatggggttggatccaaaatgggacttgaacagaggagacaagtcatgttttggatcaacctggcggcagcgcaaaagatg

SEQ ID NO: 162938 - DNA, 103 bp, Artificial Sequence
  Synthetic Polynucleotide
taatacgactcactatagggagtggcgctgccgatggggttggatccaaaaacagaggagatttggaatgaaccccatcaacctggcggcagcgcaaaagatg

SEQ ID NO: 162939 - DNA, 103 bp, Artificial Sequence
  Synthetic Polynucleotide
taatacgactcactatagggtggaggaggcagtggcgctgccgatggggtaacagaggagaaccccaatggcagcgccaaacctggcggcagcgcaaaagatg

SEQ ID NO: 162940 - DNA, 103 bp, Artificial Sequence
  Synthetic Polynucleotide
taatacgactcactatagggtagctgcccttggaggaggcagtggcgctgaacagaggagacagcgcatgtgcctcctcaacctggcggcagcgcaaaagatg

SEQ ID NO: 162941 - DNA, 103 bp, Artificial Sequence
  Synthetic Polynucleotide
taatacgactcactataggggtagctgctgtagctgcccttggaggaggcaacagaggagagcctccatgaagggcagcaacctggcggcagcgcaaaagatg

SEQ ID NO: 162942 - DNA, 103 bp, Artificial Sequence
  Synthetic Polynucleotide
taatacgactcactatagggtgattccctggtagctgctgtagctgccctaacagaggagaagggcaatgacagcagctaacctggcggcagcgcaaaagatg

SEQ ID NO: 162943 - DNA, 103 bp, Artificial Sequence
  Synthetic Polynucleotide
taatacgactcactataggggaagttgcgatgattccctggtagctgctgaacagaggagacagcagatgccagggaataacctggcggcagcgcaaaagatg

SEQ ID NO: 162944 - DNA, 103 bp, Artificial Sequence
  Synthetic Polynucleotide
taatacgactcactataggggttcaggagagaagttgcgatgattccctgaacagaggagacagggaatgatcgcaactaacctggcggcagcgcaaaagatg

SEQ ID NO: 162945 - DNA, 103 bp, Artificial Sequence
  Synthetic Polynucleotide
taatacgactcactatagggtggtctctgggggtcctcgcagggccttggaacagaggagaccaaggatgtgcgaggacaacctggcggcagcgcaaaagatg

SEQ ID NO: 162946 - DNA, 103 bp, Artificial Sequence
  Synthetic Polynucleotide
taatacgactcactatagggtttgacccaagttcaggagagaagttgcgaaacagaggagatcgcaaatgctctcctgaaacctggcggcagcgcaaaagatg

SEQ ID NO: 162947 - DNA, 103 bp, Artificial Sequence
  Synthetic Polynucleotide
taatacgactcactatagggtcttcagcaatttgacccaagttcaggagaaacagaggagatctcctatgcttgggtcaaacctggcggcagcgcaaaagatg

SEQ ID NO: 162948 - DNA, 103 bp, Artificial Sequence
  Synthetic Polynucleotide
taatacgactcactatagggcaccagggtctcttcagcaatttgacccaaaacagaggagattgggtatgattgctgaaaacctggcggcagcgcaaaagatg

SEQ ID NO: 162949 - DNA, 103 bp, Artificial Sequence
  Synthetic Polynucleotide
taatacgactcactatagggagtcctcttccaccagggtctcttcagcaaaacagaggagattgctgatgagaccctggaacctggcggcagcgcaaaagatg

SEQ ID NO: 162950 - DNA, 103 bp, Artificial Sequence
  Synthetic Polynucleotide
taatacgactcactataggggcctggcccaagtcctcttccaccagggtcaacagaggagagaccctatgggaagaggaaacctggcggcagcgcaaaagatg

SEQ ID NO: 162951 - DNA, 103 bp, Artificial Sequence
  Synthetic Polynucleotide
taatacgactcactatagggtggcttggccgcctggcccaagtcctcttcaacagaggagagaagagatgttgggccagaacctggcggcagcgcaaaagatg

SEQ ID NO: 162952 - DNA, 103 bp, Artificial Sequence
  Synthetic Polynucleotide
taatacgactcactatagggtgccaggacctggcttggccgcctggcccaaacagaggagatgggccatgcggccaagcaacctggcggcagcgcaaaagatg

SEQ ID NO: 162953 - DNA, 103 bp, Artificial Sequence
  Synthetic Polynucleotide
taatacgactcactatagggaggtgcacaatgccaggacctggcttggccaacagaggagaggccaaatgaggtcctggaacctggcggcagcgcaaaagatg

SEQ ID NO: 162954 - DNA, 103 bp, Artificial Sequence
  Synthetic Polynucleotide
taatacgactcactatagggctcctgaagcaggtgcacaatgccaggaccaacagaggagaggtcctatgattgtgcacaacctggcggcagcgcaaaagatg

SEQ ID NO: 162955 - DNA, 103 bp, Artificial Sequence
  Synthetic Polynucleotide
taatacgactcactatagggcctctgcagcctcctgaagcaggtgcacaaaacagaggagattgtgcatgtgcttcaggaacctggcggcagcgcaaaagatg

SEQ ID NO: 162956 - DNA, 103 bp, Artificial Sequence
  Synthetic Polynucleotide
taatacgactcactatagggtctgcagctgtggtctctgggggtcctcgcaacagaggagagcgaggatgcccagagacaacctggcggcagcgcaaaagatg

SEQ ID NO: 162957 - DNA, 103 bp, Artificial Sequence
  Synthetic Polynucleotide
taatacgactcactatagggctggcagctccctctgcagcctcctgaagcaacagaggagagcttcaatgggctgcagaaacctggcggcagcgcaaaagatg

SEQ ID NO: 162958 - DNA, 103 bp, Artificial Sequence
  Synthetic Polynucleotide
taatacgactcactatagggaccctcctcgctggcagctccctctgcagcaacagaggagagctgcaatgggagctgccaacctggcggcagcgcaaaagatg

SEQ ID NO: 162959 - DNA, 103 bp, Artificial Sequence
  Synthetic Polynucleotide
taatacgactcactatagggggcccttttcaccctcctcgctggcagctcaacagaggagagagctgatggcgaggaggaacctggcggcagcgcaaaagatg

SEQ ID NO: 162960 - DNA, 103 bp, Artificial Sequence
  Synthetic Polynucleotide
taatacgactcactatagggtggatgaagaggcccttttcaccctcctcgaacagaggagacgaggaatgtgaaaagggaacctggcggcagcgcaaaagatg

SEQ ID NO: 162961 - DNA, 103 bp, Artificial Sequence
  Synthetic Polynucleotide
taatacgactcactatagggatcctctggctggatgaagaggcccttttcaacagaggagagaaaagatgctcttcatcaacctggcggcagcgcaaaagatg

SEQ ID NO: 162962 - DNA, 103 bp, Artificial Sequence
  Synthetic Polynucleotide
taatacgactcactatagggcctcctcggcatcctctggctggatgaagaaacagaggagatcttcaatgagccagaggaacctggcggcagcgcaaaagatg

SEQ ID NO: 162963 - DNA, 103 bp, Artificial Sequence
  Synthetic Polynucleotide
taatacgactcactatagggacttcgacgacctcctcggcatcctctggcaacagaggagagccagaatgtgccgaggaaacctggcggcagcgcaaaagatg

SEQ ID NO: 162964 - DNA, 103 bp, Artificial Sequence
  Synthetic Polynucleotide
taatacgactcactatagggctcggtggtgacttcgacgacctcctcggcaacagaggagagccgagatggtcgtcgaaaacctggcggcagcgcaaaagatg

SEQ ID NO: 162965 - DNA, 103 bp, Artificial Sequence
  Synthetic Polynucleotide
taatacgactcactatagggcctgggagcgctcggtggtgacttcgacgaaacagaggagatcgtcgatgtcaccaccgaacctggcggcagcgcaaaagatg

SEQ ID NO: 162966 - DNA, 103 bp, Artificial Sequence
  Synthetic Polynucleotide
taatacgactcactatagggggacacaggtcctgggagcgctcggtggtgaacagaggagacaccacatggcgctcccaaacctggcggcagcgcaaaagatg

SEQ ID NO: 162967 - DNA, 103 bp, Artificial Sequence
  Synthetic Polynucleotide
taatacgactcactataggggcagctgaggtctgcagctgtggtctctggaacagaggagaccagagatgacagctgcaaacctggcggcagcgcaaaagatg

SEQ ID NO: 162968 - DNA, 103 bp, Artificial Sequence
  Synthetic Polynucleotide
taatacgactcactatagggcagggactggggacacaggtcctgggagcgaacagaggagacgctccatggacctgtgtaacctggcggcagcgcaaaagatg

SEQ ID NO: 162969 - DNA, 103 bp, Artificial Sequence
  Synthetic Polynucleotide
taatacgactcactatagggctgcatcctccagggactggggacacaggtaacagaggagaacctgtatgcccagtcccaacctggcggcagcgcaaaagatg

SEQ ID NO: 162970 - DNA, 103 bp, Artificial Sequence
  Synthetic Polynucleotide
taatacgactcactatagggtcctcactggctgcatcctccagggactggaacagaggagaccagtcatgggaggatgcaacctggcggcagcgcaaaagatg

SEQ ID NO: 162971 - DNA, 103 bp, Artificial Sequence
  Synthetic Polynucleotide
taatacgactcactatagggcttgctggactcctcactggctgcatcctcaacagaggagagaggatatggccagtgagaacctggcggcagcgcaaaagatg

SEQ ID NO: 162972 - DNA, 103 bp, Artificial Sequence
  Synthetic Polynucleotide
taatacgactcactatagggtgcctttctgcttgctggactcctcactggaacagaggagaccagtgatgagtccagcaaacctggcggcagcgcaaaagatg

SEQ ID NO: 162973 - DNA, 103 bp, Artificial Sequence
  Synthetic Polynucleotide
taatacgactcactatagggtgactcaggatgcctttctgcttgctggacaacagaggagagtccagatggcagaaaggaacctggcggcagcgcaaaagatg

SEQ ID NO: 162974 - DNA, 103 bp, Artificial Sequence
  Synthetic Polynucleotide
taatacgactcactatagggctcctcttcgtgactcaggatgcctttctgaacagaggagacagaaaatgatcctgagtaacctggcggcagcgcaaaagatg

SEQ ID NO: 162975 - DNA, 103 bp, Artificial Sequence
  Synthetic Polynucleotide
taatacgactcactatagggcctcctcgtcctcctcttcgtgactcaggaaacagaggagatcctgaatgacgaagaggaacctggcggcagcgcaaaagatg

SEQ ID NO: 162976 - DNA, 103 bp, Artificial Sequence
  Synthetic Polynucleotide
taatacgactcactatagggtcctcctcctcctcctcgtcctcctcttcgaacagaggagacgaagaatgggacgaggaaacctggcggcagcgcaaaagatg

SEQ ID NO: 162977 - DNA, 103 bp, Artificial Sequence
  Synthetic Polynucleotide
taatacgactcactatagggctcctcttcctcctcctcctcctcctcgtcaacagaggagagacgagatggaggaggagaacctggcggcagcgcaaaagatg

SEQ ID NO: 162978 - DNA, 103 bp, Artificial Sequence
  Synthetic Polynucleotide
taatacgactcactatagggctggggtggggcagctgaggtctgcagctgaacagaggagacagctgatgacctcagctaacctggcggcagcgcaaaagatg

SEQ ID NO: 162979 - DNA, 103 bp, Artificial Sequence
  Synthetic Polynucleotide
taatacgactcactatagggcctcctcctcctcctcttcctcctcctcctaacagaggagaaggaggatgaggaagaggaacctggcggcagcgcaaaagatg

SEQ ID NO: 162980 - DNA, 103 bp, Artificial Sequence
  Synthetic Polynucleotide
taatacgactcactatagggtcttcttcatcctcctcctcctcctcttccaacagaggagaggaagaatgggaggaggaaacctggcggcagcgcaaaagatg

SEQ ID NO: 162981 - DNA, 103 bp, Artificial Sequence
  Synthetic Polynucleotide
taatacgactcactatagggttcctcttcctcttcttcatcctcctcctcaacagaggagagaggagatggatgaagaaaacctggcggcagcgcaaaagatg

SEQ ID NO: 162982 - DNA, 103 bp, Artificial Sequence
  Synthetic Polynucleotide
taatacgactcactatagggcctcctcctcttcctcttcctcttcttcataacagaggagaatgaagatgaggaagaggaacctggcggcagcgcaaaagatg

SEQ ID NO: 162983 - DNA, 103 bp, Artificial Sequence
  Synthetic Polynucleotide
taatacgactcactatagggtcttcctcttcctcctcctcttcctcttccaacagaggagaggaagaatgagaggaggaaacctggcggcagcgcaaaagatg

SEQ ID NO: 162984 - DNA, 103 bp, Artificial Sequence
  Synthetic Polynucleotide
taatacgactcactatagggctcctcctcctcttcctcttcctcctcctcaacagaggagagaggagatggaagaggaaaacctggcggcagcgcaaaagatg

SEQ ID NO: 162985 - DNA, 103 bp, Artificial Sequence
  Synthetic Polynucleotide
taatacgactcactatagggcttcctcttcctcctcctcctcttcctcttaacagaggagaaagaggatgaggaggaggaacctggcggcagcgcaaaagatg

SEQ ID NO: 162986 - DNA, 103 bp, Artificial Sequence
  Synthetic Polynucleotide
taatacgactcactatagggtcctcctcctcttcctcttcctcctcctccaacagaggagaggaggaatgggaagaggaaacctggcggcagcgcaaaagatg

SEQ ID NO: 162987 - DNA, 103 bp, Artificial Sequence
  Synthetic Polynucleotide
taatacgactcactatagggctcttcctcttcctcctcctcttcctcttcaacagaggagagaagagatggaggaggagaacctggcggcagcgcaaaagatg

SEQ ID NO: 162988 - DNA, 103 bp, Artificial Sequence
  Synthetic Polynucleotide
taatacgactcactatagggcctcctcttcctcttcctcttcctcctcctaacagaggagaaggaggatgaagaggaagaacctggcggcagcgcaaaagatg

SEQ ID NO: 162989 - DNA, 103 bp, Artificial Sequence
  Synthetic Polynucleotide
taatacgactcactatagggcctgtgcatcctggggtggggcagctgaggaacagaggagacctcagatgccccaccccaacctggcggcagcgcaaaagatg

SEQ ID NO: 162990 - DNA, 103 bp, Artificial Sequence
  Synthetic Polynucleotide
taatacgactcactataggggcctcctcctcctcctcttcctcttcctctaacagaggagaagaggaatgggaagaggaaacctggcggcagcgcaaaagatg

SEQ ID NO: 162991 - DNA, 103 bp, Artificial Sequence
  Synthetic Polynucleotide
taatacgactcactatagggatcaggagctgcctcctcctcctcctcttcaacagaggagagaagagatggaggaggagaacctggcggcagcgcaaaagatg

SEQ ID NO: 162992 - DNA, 103 bp, Artificial Sequence
  Synthetic Polynucleotide
taatacgactcactataggggaaagatcacatcaggagctgcctcctcctaacagaggagaaggaggatgcagctcctgaacctggcggcagcgcaaaagatg

SEQ ID NO: 162993 - DNA, 103 bp, Artificial Sequence
  Synthetic Polynucleotide
taatacgactcactataggggtgtcttcctgaaagatcacatcaggagctaacagaggagaagctccatgtgtgatcttaacctggcggcagcgcaaaagatg

SEQ ID NO: 162994 - DNA, 103 bp, Artificial Sequence
  Synthetic Polynucleotide
taatacgactcactatagggggtgtgagaggtgtcttcctgaaagatcacaacagaggagagtgatcatgcaggaagacaacctggcggcagcgcaaaagatg

SEQ ID NO: 162995 - DNA, 103 bp, Artificial Sequence
  Synthetic Polynucleotide
taatacgactcactatagggtctgggcagaggtgtgagaggtgtcttcctaacagaggagaaggaagatgcctctcacaaacctggcggcagcgcaaaagatg

SEQ ID NO: 162996 - DNA, 103 bp, Artificial Sequence
  Synthetic Polynucleotide
taatacgactcactatagggtcaggggccttctgggcagaggtgtgagagaacagaggagactctcaatgctctgcccaaacctggcggcagcgcaaaagatg

SEQ ID NO: 162997 - DNA, 103 bp, Artificial Sequence
  Synthetic Polynucleotide
taatacgactcactataggggccccggagctcaggggccttctgggcagaaacagaggagatctgccatgaaggcccctaacctggcggcagcgcaaaagatg

SEQ ID NO: 162998 - DNA, 103 bp, Artificial Sequence
  Synthetic Polynucleotide
taatacgactcactataggggtgattctgggccccggagctcaggggcctaacagaggagaaggcccatgagctccgggaacctggcggcagcgcaaaagatg

SEQ ID NO: 162999 - DNA, 103 bp, Artificial Sequence
  Synthetic Polynucleotide
taatacgactcactatagggttgggactgggtgattctgggccccggagcaacagaggagagctccgatgcccagaatcaacctggcggcagcgcaaaagatg

SEQ ID NO: 163000 - DNA, 103 bp, Artificial Sequence
  Synthetic Polynucleotide
taatacgactcactatagggatgccgcttctcctcggtgtccacctccataacagaggagaatggagatggacaccgagaacctggcggcagcgcaaaagatg

SEQ ID NO: 163001 - DNA, 103 bp, Artificial Sequence
  Synthetic Polynucleotide
taatacgactcactatagggaccactgccgtcacagccaggggtgggacaaacagaggagatgtcccatgcctggctgtaacctggcggcagcgcaaaagatg

SEQ ID NO: 163002 - DNA, 103 bp, Artificial Sequence
  Synthetic Polynucleotide
taatacgactcactatagggcttcctggccaggtcgaagcactgattcctaacagaggagaaggaatatgtgcttcgacaacctggcggcagcgcaaaagatg

SEQ ID NO: 163003 - DNA, 103 bp, Artificial Sequence
  Synthetic Polynucleotide
taatacgactcactatagggtctcactgagcttcctggccaggtcgaagcaacagaggagagcttcgatgtggccaggaaacctggcggcagcgcaaaagatg

SEQ ID NO: 163004 - DNA, 103 bp, Artificial Sequence
  Synthetic Polynucleotide
taatacgactcactatagggtgcgggttggtctcactgagcttcctggccaacagaggagaggccagatggctcagtgaaacctggcggcagcgcaaaagatg

SEQ ID NO: 163005 - DNA, 103 bp, Artificial Sequence
  Synthetic Polynucleotide
taatacgactcactatagggattcctctcctgcgggttggtctcactgagaacagaggagactcagtatgaccaacccgaacctggcggcagcgcaaaagatg

SEQ ID NO: 163006 - DNA, 103 bp, Artificial Sequence
  Synthetic Polynucleotide
taatacgactcactatagggtctgctgcggattcctctcctgcgggttggaacagaggagaccaaccatgaggagaggaaacctggcggcagcgcaaaagatg

SEQ ID NO: 163007 - DNA, 103 bp, Artificial Sequence
  Synthetic Polynucleotide
taatacgactcactatagggatgttcatgttctgctgcggattcctctccaacagaggagaggagagatgtccgcagcaaacctggcggcagcgcaaaagatg

SEQ ID NO: 163008 - DNA, 103 bp, Artificial Sequence
  Synthetic Polynucleotide
taatacgactcactatagggatgctgacggatgttcatgttctgctgcggaacagaggagaccgcagatgaacatgaacaacctggcggcagcgcaaaagatg

SEQ ID NO: 163009 - DNA, 103 bp, Artificial Sequence
  Synthetic Polynucleotide
taatacgactcactatagggctggccggacatgctgacggatgttcatgtaacagaggagaacatgaatgtccgtcagcaacctggcggcagcgcaaaagatg

SEQ ID NO: 163010 - DNA, 103 bp, Artificial Sequence
  Synthetic Polynucleotide
taatacgactcactatagggaagtcctcttctggccggacatgctgacggaacagaggagaccgtcaatgtgtccggccaacctggcggcagcgcaaaagatg

SEQ ID NO: 163011 - DNA, 103 bp, Artificial Sequence
  Synthetic Polynucleotide
taatacgactcactatagggccttccggggaagtcctcttctggccggacaacagaggagagtccggatggaagaggacaacctggcggcagcgcaaaagatg

SEQ ID NO: 163012 - DNA, 103 bp, Artificial Sequence
  Synthetic Polynucleotide
taatacgactcactatagggcactgacatgaccactgccgtcacagccagaacagaggagactggctatgacggcagtgaacctggcggcagcgcaaaagatg

SEQ ID NO: 163013 - DNA, 103 bp, Artificial Sequence
  Synthetic Polynucleotide
taatacgactcactatagggtgtccggcgtccttccggggaagtcctcttaacagaggagaaagaggatgtccccggaaaacctggcggcagcgcaaaagatg

SEQ ID NO: 163014 - DNA, 103 bp, Artificial Sequence
  Synthetic Polynucleotide
taatacgactcactataggggagtagtttctgtccggcgtccttccggggaacagaggagaccccggatggacgccggaaacctggcggcagcgcaaaagatg

SEQ ID NO: 163015 - DNA, 103 bp, Artificial Sequence
  Synthetic Polynucleotide
taatacgactcactatagggcagcatgtccgagtagtttctgtccggcgtaacagaggagaacgccgatgagaaactacaacctggcggcagcgcaaaagatg

SEQ ID NO: 163016 - DNA, 103 bp, Artificial Sequence
  Synthetic Polynucleotide
taatacgactcactataggggcatgaggttcagcatgtccgagtagtttcaacagaggagagaaactatgcggacatgcaacctggcggcagcgcaaaagatg

SEQ ID NO: 163017 - DNA, 103 bp, Artificial Sequence
  Synthetic Polynucleotide
taatacgactcactatagggtcctccagccgcatgaggttcagcatgtccaacagaggagaggacatatggaacctcataacctggcggcagcgcaaaagatg

SEQ ID NO: 163018 - DNA, 103 bp, Artificial Sequence
  Synthetic Polynucleotide
taatacgactcactataggggctcaactgctcctccagccgcatgaggttaacagaggagaaacctcatgcggctggagaacctggcggcagcgcaaaagatg

SEQ ID NO: 163019 - DNA, 103 bp, Artificial Sequence
  Synthetic Polynucleotide
taatacgactcactatagggtcgaccgggggctcaactgctcctccagccaacagaggagaggctggatgagcagttgaaacctggcggcagcgcaaaagatg

SEQ ID NO: 163020 - DNA, 103 bp, Artificial Sequence
  Synthetic Polynucleotide
taatacgactcactataggggcaaacactctcgaccgggggctcaactgcaacagaggagagcagttatgcccccggtcaacctggcggcagcgcaaaagatg

SEQ ID NO: 163021 - DNA, 103 bp, Artificial Sequence
  Synthetic Polynucleotide
taatacgactcactatagggcgcacagctggcaaacactctcgaccggggaacagaggagaccccggatgagagtgtttaacctggcggcagcgcaaaagatg

SEQ ID NO: 163022 - DNA, 103 bp, Artificial Sequence
  Synthetic Polynucleotide
taatacgactcactatagggcatcctccttcgcacagctggcaaacactcaacagaggagagagtgtatgccagctgtgaacctggcggcagcgcaaaagatg

SEQ ID NO: 163023 - DNA, 103 bp, Artificial Sequence
  Synthetic Polynucleotide
taatacgactcactataggggcatatttgccactgacatgaccactgccgaacagaggagacggcagatgtcatgtcagaacctggcggcagcgcaaaagatg

SEQ ID NO: 163024 - DNA, 103 bp, Artificial Sequence
  Synthetic Polynucleotide
taatacgactcactatagggtcatgacacccatcctccttcgcacagctgaacagaggagacagctgatggaaggaggaaacctggcggcagcgcaaaagatg

SEQ ID NO: 163025 - DNA, 103 bp, Artificial Sequence
  Synthetic Polynucleotide
taatacgactcactataggggtcgtcccgctcatgacacccatcctccttaacagaggagaaaggagatggggtgtcataacctggcggcagcgcaaaagatg

SEQ ID NO: 163026 - DNA, 103 bp, Artificial Sequence
  Synthetic Polynucleotide
taatacgactcactatagggaggtggtatcgtcgtcccgctcatgacaccaacagaggagaggtgtcatgagcgggacgaacctggcggcagcgcaaaagatg

SEQ ID NO: 163027 - DNA, 103 bp, Artificial Sequence
  Synthetic Polynucleotide
taatacgactcactataggggagttcacagaggtggtatcgtcgtcccgcaacagaggagagcgggaatgcgataccacaacctggcggcagcgcaaaagatg

SEQ ID NO: 163028 - DNA, 103 bp, Artificial Sequence
  Synthetic Polynucleotide
taatacgactcactatagggagacctgtccgagttcacagaggtggtatcaacagaggagagataccatgtctgtgaacaacctggcggcagcgcaaaagatg

SEQ ID NO: 163029 - DNA, 103 bp, Artificial Sequence
  Synthetic Polynucleotide
taatacgactcactatagggacacctcttcagacctgtccgagttcacagaacagaggagactgtgaatgcggacaggtaacctggcggcagcgcaaaagatg

SEQ ID NO: 163030 - DNA, 103 bp, Artificial Sequence
  Synthetic Polynucleotide
taatacgactcactataggggtcatgtcgaacacctcttcagacctgtccaacagaggagaggacagatgtgaagaggtaacctggcggcagcgcaaaagatg

SEQ ID NO: 163031 - DNA, 103 bp, Artificial Sequence
  Synthetic Polynucleotide
taatacgactcactataggggttccccttggtcatgtcgaacacctcttcaacagaggagagaagagatgttcgacatgaacctggcggcagcgcaaaagatg

SEQ ID NO: 163032 - DNA, 103 bp, Artificial Sequence
  Synthetic Polynucleotide
taatacgactcactataggggcagggtcaggttccccttggtcatgtcgaaacagaggagatcgacaatgccaaggggaaacctggcggcagcgcaaaagatg

SEQ ID NO: 163033 - DNA, 103 bp, Artificial Sequence
  Synthetic Polynucleotide
taatacgactcactataggggctttctccagcagggtcaggttccccttgaacagaggagacaagggatgcctgaccctaacctggcggcagcgcaaaagatg

SEQ ID NO: 163034 - DNA, 103 bp, Artificial Sequence
  Synthetic Polynucleotide
taatacgactcactatagggtctgtgtcttgcatatttgccactgacatgaacagaggagacatgtcatgggcaaatataacctggcggcagcgcaaaagatg

SEQ ID NO: 163035 - DNA, 103 bp, Artificial Sequence
  Synthetic Polynucleotide
taatacgactcactatagggcaaagcgatggctttctccagcagggtcagaacagaggagactgaccatgctggagaaaaacctggcggcagcgcaaaagatg

SEQ ID NO: 163036 - DNA, 103 bp, Artificial Sequence
  Synthetic Polynucleotide
taatacgactcactatagggtttccgtttccaaagcgatggctttctccaaacagaggagatggagaatgccatcgcttaacctggcggcagcgcaaaagatg

SEQ ID NO: 163037 - DNA, 103 bp, Artificial Sequence
  Synthetic Polynucleotide
taatacgactcactataggggcctttgctctttccgtttccaaagcgatgaacagaggagacatcgcatgggaaacggaaacctggcggcagcgcaaaagatg

SEQ ID NO: 163038 - DNA, 103 bp, Artificial Sequence
  Synthetic Polynucleotide
taatacgactcactatagggctccctcatggcctttgctctttccgtttcaacagaggagagaaacgatgagagcaaagaacctggcggcagcgcaaaagatg

SEQ ID NO: 163039 - DNA, 103 bp, Artificial Sequence
  Synthetic Polynucleotide
taatacgactcactatagggtggccatcttctccctcatggcctttgctcaacagaggagagagcaaatgccatgagggaacctggcggcagcgcaaaagatg

SEQ ID NO: 163040 - DNA, 103 bp, Artificial Sequence
  Synthetic Polynucleotide
taatacgactcactatagggccagcttccatggccatcttctccctcatgaacagaggagacatgagatggaagatggcaacctggcggcagcgcaaaagatg

SEQ ID NO: 163041 - DNA, 103 bp, Artificial Sequence
  Synthetic Polynucleotide
taatacgactcactataggggtccctcctcccagcttccatggccatcttaacagaggagaaagatgatgatggaagctaacctggcggcagcgcaaaagatg

SEQ ID NO: 163042 - DNA, 103 bp, Artificial Sequence
  Synthetic Polynucleotide
taatacgactcactatagggacctcatattgtccctcctcccagcttccaaacagaggagatggaagatgggaggagggaacctggcggcagcgcaaaagatg

SEQ ID NO: 163043 - DNA, 103 bp, Artificial Sequence
  Synthetic Polynucleotide
taatacgactcactatagggtcctcatatgacctcatattgtccctcctcaacagaggagagaggagatgcaatatgagaacctggcggcagcgcaaaagatg

SEQ ID NO: 163044 - DNA, 103 bp, Artificial Sequence
  Synthetic Polynucleotide
taatacgactcactatagggcggagactggtcctcatatgacctcatattaacagaggagaaatatgatgtcatatgagaacctggcggcagcgcaaaagatg

SEQ ID NO: 163045 - DNA, 103 bp, Artificial Sequence
  Synthetic Polynucleotide
taatacgactcactatagggcatatacacttctgtgtcttgcatatttgcaacagaggagagcaaatatgcaagacacaaacctggcggcagcgcaaaagatg

SEQ ID NO: 163046 - DNA, 103 bp, Artificial Sequence
  Synthetic Polynucleotide
taatacgactcactataggggaagttgtctcggagactggtcctcatatgaacagaggagacatatgatgaccagtctcaacctggcggcagcgcaaaagatg

SEQ ID NO: 163047 - DNA, 103 bp, Artificial Sequence
  Synthetic Polynucleotide
taatacgactcactatagggtcctccccgggaagttgtctcggagactggaacagaggagaccagtcatggagacaactaacctggcggcagcgcaaaagatg

SEQ ID NO: 163048 - DNA, 103 bp, Artificial Sequence
  Synthetic Polynucleotide
taatacgactcactatagggaggctttctgtcctccccgggaagttgtctaacagaggagaagacaaatgcccggggagaacctggcggcagcgcaaaagatg

SEQ ID NO: 163049 - DNA, 103 bp, Artificial Sequence
  Synthetic Polynucleotide
taatacgactcactatagggcactggatttaggctttctgtcctccccggaacagaggagaccggggatgacagaaagcaacctggcggcagcgcaaaagatg

SEQ ID NO: 163050 - DNA, 103 bp, Artificial Sequence
  Synthetic Polynucleotide
taatacgactcactatagggacatggctgtcactggatttaggctttctgaacagaggagacagaaaatgtaaatccagaacctggcggcagcgcaaaagatg

SEQ ID NO: 163051 - DNA, 103 bp, Artificial Sequence
  Synthetic Polynucleotide
taatacgactcactatagggtggctttttgacatggctgtcactggatttaacagaggagaaaatccatggacagccataacctggcggcagcgcaaaagatg

SEQ ID NO: 163052 - DNA, 103 bp, Artificial Sequence
  Synthetic Polynucleotide
taatacgactcactataggggatcatagtatggctttttgacatggctgtaacagaggagaacagccatgtcaaaaagcaacctggcggcagcgcaaaagatg

SEQ ID NO: 163053 - DNA, 103 bp, Artificial Sequence
  Synthetic Polynucleotide
taatacgactcactataggggttcttgagggatcatagtatggctttttgaacagaggagacaaaaaatgatactatgaaacctggcggcagcgcaaaagatg

SEQ ID NO: 163054 - DNA, 103 bp, Artificial Sequence
  Synthetic Polynucleotide
taatacgactcactatagggtttcttttctgttcttgagggatcatagtaaacagaggagatactatatgccctcaagaaacctggcggcagcgcaaaagatg

SEQ ID NO: 163055 - DNA, 103 bp, Artificial Sequence
  Synthetic Polynucleotide
taatacgactcactatagggacttgctctctttcttttctgttcttgaggaacagaggagacctcaaatgcagaaaagaaacctggcggcagcgcaaaagatg

SEQ ID NO: 163056 - DNA, 103 bp, Artificial Sequence
  Synthetic Polynucleotide
taatacgactcactatagggaagggacaaccatatacacttctgtgtcttaacagaggagaaagacaatgaagtgtataaacctggcggcagcgcaaaagatg

SEQ ID NO: 163057 - DNA, 103 bp, Artificial Sequence
  Synthetic Polynucleotide
taatacgactcactatagggggggttggacacttgctctctttcttttctaacagaggagaagaaaaatgagagagcaaaacctggcggcagcgcaaaagatg

SEQ ID NO: 163058 - DNA, 103 bp, Artificial Sequence
  Synthetic Polynucleotide
taatacgactcactatagggatcacacccgggggttggacacttgctctcaacagaggagagagagcatgtgtccaaccaacctggcggcagcgcaaaagatg

SEQ ID NO: 163059 - DNA, 103 bp, Artificial Sequence
  Synthetic Polynucleotide
taatacgactcactatagggggccggttccatcacacccgggggttggacaacagaggagagtccaaatgccgggtgtgaacctggcggcagcgcaaaagatg

SEQ ID NO: 163060 - DNA, 103 bp, Artificial Sequence
  Synthetic Polynucleotide
taatacgactcactatagggccagttacgtggccggttccatcacacccgaacagaggagacgggtgatgtggaaccggaacctggcggcagcgcaaaagatg

SEQ ID NO: 163061 - DNA, 103 bp, Artificial Sequence
  Synthetic Polynucleotide
taatacgactcactatagggtgggtacagcccagttacgtggccggttccaacagaggagaggaaccatgcacgtaactaacctggcggcagcgcaaaagatg

SEQ ID NO: 163062 - DNA, 103 bp, Artificial Sequence
  Synthetic Polynucleotide
taatacgactcactatagggtgcggtgatgtgggtacagcccagttacgtaacagaggagaacgtaaatgggctgtaccaacctggcggcagcgcaaaagatg

SEQ ID NO: 163063 - DNA, 103 bp, Artificial Sequence
  Synthetic Polynucleotide
taatacgactcactatagggccggacaggctgcggtgatgtgggtacagcaacagaggagagctgtaatgacatcaccgaacctggcggcagcgcaaaagatg

SEQ ID NO: 163064 - DNA, 103 bp, Artificial Sequence
  Synthetic Polynucleotide
taatacgactcactataggggtgcgggcatccggacaggctgcggtgatgaacagaggagacatcacatgagcctgtccaacctggcggcagcgcaaaagatg

SEQ ID NO: 163065 - DNA, 103 bp, Artificial Sequence
  Synthetic Polynucleotide
taatacgactcactatagggccctatctttgtgcgggcatccggacaggcaacagaggagagcctgtatggatgcccgcaacctggcggcagcgcaaaagatg

SEQ ID NO: 163066 - DNA, 103 bp, Artificial Sequence
  Synthetic Polynucleotide
taatacgactcactatagggtctggagggaccctatctttgtgcgggcataacagaggagaatgcccatgcaaagatagaacctggcggcagcgcaaaagatg

SEQ ID NO: 163067 - DNA, 103 bp, Artificial Sequence
  Synthetic Polynucleotide
taatacgactcactatagggttttttcgccaagggacaaccatatacactaacagaggagaagtgtaatgggttgtcccaacctggcggcagcgcaaaagatg

SEQ ID NO: 163068 - DNA, 103 bp, Artificial Sequence
  Synthetic Polynucleotide
taatacgactcactatagggggcaaggatttctggagggaccctatctttaacagaggagaaaagatatggtccctccaaacctggcggcagcgcaaaagatg

SEQ ID NO: 163069 - DNA, 103 bp, Artificial Sequence
  Synthetic Polynucleotide
taatacgactcactatagggtttcatgcatggcaaggatttctggagggaaacagaggagatccctcatgaaatccttgaacctggcggcagcgcaaaagatg

SEQ ID NO: 163070 - DNA, 103 bp, Artificial Sequence
  Synthetic Polynucleotide
taatacgactcactatagggttgaggacactttcatgcatggcaaggattaacagaggagaaatcctatgcatgcatgaaacctggcggcagcgcaaaagatg

SEQ ID NO: 163071 - DNA, 103 bp, Artificial Sequence
  Synthetic Polynucleotide
taatacgactcactatagggagtggggcacttgaggacactttcatgcataacagaggagaatgcatatgagtgtcctcaacctggcggcagcgcaaaagatg

SEQ ID NO: 163072 - DNA, 103 bp, Artificial Sequence
  Synthetic Polynucleotide
taatacgactcactatagggtgcagcccggagtggggcacttgaggacacaacagaggagagtgtccatgagtgccccaaacctggcggcagcgcaaaagatg

SEQ ID NO: 163073 - DNA, 103 bp, Artificial Sequence
  Synthetic Polynucleotide
taatacgactcactatagggccgcgccccgtgcagcccggagtggggcacaacagaggagagtgcccatgtccgggctgaacctggcggcagcgcaaaagatg

SEQ ID NO: 163074 - DNA, 103 bp, Artificial Sequence
  Synthetic Polynucleotide
taatacgactcactataggggttgacatgcccgcgccccgtgcagcccggaacagaggagaccgggcatgacggggcgcaacctggcggcagcgcaaaagatg

SEQ ID NO: 163075 - DNA, 103 bp, Artificial Sequence
  Synthetic Polynucleotide
taatacgactcactatagggtcctgttgctgttgacatgcccgcgccccgaacagaggagacggggcatgggcatgtcaaacctggcggcagcgcaaaagatg

SEQ ID NO: 163076 - DNA, 103 bp, Artificial Sequence
  Synthetic Polynucleotide
taatacgactcactatagggcggtgggagttcctgttgctgttgacatgcaacagaggagagcatgtatgcagcaacagaacctggcggcagcgcaaaagatg

SEQ ID NO: 163077 - DNA, 103 bp, Artificial Sequence
  Synthetic Polynucleotide
taatacgactcactatagggggagaggcttcggtgggagttcctgttgctaacagaggagaagcaacatgaactcccacaacctggcggcagcgcaaaagatg

SEQ ID NO: 163078 - DNA, 103 bp, Artificial Sequence
  Synthetic Polynucleotide
taatacgactcactataggggtgtttttctttttttcgccaagggacaacaacagaggagagttgtcatgtggcgaaaaaacctggcggcagcgcaaaagatg

SEQ ID NO: 163079 - DNA, 103 bp, Artificial Sequence
  Synthetic Polynucleotide
taatacgactcactatagggtcgggcatccggagaggcttcggtgggagtaacagaggagaactcccatggaagcctctaacctggcggcagcgcaaaagatg

SEQ ID NO: 163080 - DNA, 103 bp, Artificial Sequence
  Synthetic Polynucleotide
taatacgactcactataggggctgcagcgatcgggcatccggagaggcttaacagaggagaaagcctatgcggatgcccaacctggcggcagcgcaaaagatg

SEQ ID NO: 163081 - DNA, 103 bp, Artificial Sequence
  Synthetic Polynucleotide
taatacgactcactatagggcagtttctctgctgcagcgatcgggcatccaacagaggagaggatgcatgatcgctgcaaacctggcggcagcgcaaaagatg

SEQ ID NO: 163082 - DNA, 103 bp, Artificial Sequence
  Synthetic Polynucleotide
taatacgactcactataggggtgccttggccagtttctctgctgcagcgaaacagaggagatcgctgatgcagagaaacaacctggcggcagcgcaaaagatg

SEQ ID NO: 163083 - DNA, 103 bp, Artificial Sequence
  Synthetic Polynucleotide
taatacgactcactatagggtgcttttcctgtgccttggccagtttctctaacagaggagaagagaaatgggccaaggcaacctggcggcagcgcaaaagatg

SEQ ID NO: 163084 - DNA, 103 bp, Artificial Sequence
  Synthetic Polynucleotide
taatacgactcactataggggcagctctggtgcttttcctgtgccttggcaacagaggagagccaagatgcaggaaaagaacctggcggcagcgcaaaagatg

SEQ ID NO: 163085 - DNA, 103 bp, Artificial Sequence
  Synthetic Polynucleotide
taatacgactcactatagggtggacacgtcgcagctctggtgcttttcctaacagaggagaaggaaaatgaccagagctaacctggcggcagcgcaaaagatg

SEQ ID NO: 163086 - DNA, 103 bp, Artificial Sequence
  Synthetic Polynucleotide
taatacgactcactatagggtggctggacttggacacgtcgcagctctggaacagaggagaccagagatgcgacgtgtcaacctggcggcagcgcaaaagatg

SEQ ID NO: 163087 - DNA, 103 bp, Artificial Sequence
  Synthetic Polynucleotide
taatacgactcactataggggtccgaggcctggctggacttggacacgtcaacagaggagagacgtgatgaagtccagcaacctggcggcagcgcaaaagatg

SEQ ID NO: 163088 - DNA, 103 bp, Artificial Sequence
  Synthetic Polynucleotide
taatacgactcactatagggtgagcacgcggtccgaggcctggctggactaacagaggagaagtccaatgaggcctcggaacctggcggcagcgcaaaagatg

SEQ ID NO: 163089 - DNA, 103 bp, Artificial Sequence
  Synthetic Polynucleotide
taatacgactcactatagggtgtttatcttgtgtttttctttttttcgccaacagaggagaggcgaaatgaagaaaaacaacctggcggcagcgcaaaagatg

SEQ ID NO: 163090 - DNA, 103 bp, Artificial Sequence
  Synthetic Polynucleotide
taatacgactcactatagggcacattggcctgagcacgcggtccgaggccaacagaggagaggcctcatgccgcgtgctaacctggcggcagcgcaaaagatg

SEQ ID NO: 163091 - DNA, 103 bp, Artificial Sequence
  Synthetic Polynucleotide
taatacgactcactatagggcttcacaaagcacattggcctgagcacgcgaacagaggagacgcgtgatgaggccaatgaacctggcggcagcgcaaaagatg

SEQ ID NO: 163092 - DNA, 103 bp, Artificial Sequence
  Synthetic Polynucleotide
taatacgactcactatagggtctccagctgcttcacaaagcacattggccaacagaggagaggccaaatggctttgtgaaacctggcggcagcgcaaaagatg

SEQ ID NO: 163093 - DNA, 103 bp, Artificial Sequence
  Synthetic Polynucleotide
taatacgactcactatagggtactgaggaatctccagctgcttcacaaagaacagaggagactttgtatggcagctggaaacctggcggcagcgcaaaagatg

SEQ ID NO: 163094 - DNA, 103 bp, Artificial Sequence
  Synthetic Polynucleotide
taatacgactcactatagggtctgtagccatactgaggaatctccagctgaacagaggagacagctgatgattcctcagaacctggcggcagcgcaaaagatg

SEQ ID NO: 163095 - DNA, 103 bp, Artificial Sequence
  Synthetic Polynucleotide
taatacgactcactatagggggacattgtttctgtagccatactgaggaaaacagaggagattcctcatgatggctacaaacctggcggcagcgcaaaagatg

SEQ ID NO: 163096 - DNA, 103 bp, Artificial Sequence
  Synthetic Polynucleotide
taatacgactcactataggggtagttgtggggacattgtttctgtagccaaacagaggagatggctaatgaaacaatgtaacctggcggcagcgcaaaagatg

SEQ ID NO: 163097 - DNA, 103 bp, Artificial Sequence
  Synthetic Polynucleotide
taatacgactcactatagggggaacgcggcgtagttgtggggacattgttaacagaggagaaacaatatgcccacaactaacctggcggcagcgcaaaagatg

SEQ ID NO: 163098 - DNA, 103 bp, Artificial Sequence
  Synthetic Polynucleotide
taatacgactcactatagggtggccaggttggaacgcggcgtagttgtggaacagaggagaccacaaatgcgccgcgttaacctggcggcagcgcaaaagatg

SEQ ID NO: 163099 - DNA, 103 bp, Artificial Sequence
  Synthetic Polynucleotide
taatacgactcactatagggtcgagctccttggccaggttggaacgcggcaacagaggagagccgcgatgcaacctggcaacctggcggcagcgcaaaagatg

SEQ ID NO: 163100 - DNA, 103 bp, Artificial Sequence
  Synthetic Polynucleotide
taatacgactcactatagggttcctggggctgtttatcttgtgtttttctaacagaggagaagaaaaatgcaagataaaaacctggcggcagcgcaaaagatg

SEQ ID NO: 163101 - DNA, 103 bp, Artificial Sequence
  Synthetic Polynucleotide
taatacgactcactatagggggaatatttctcgagctccttggccaggttaacagaggagaaacctgatgaaggagctcaacctggcggcagcgcaaaagatg

SEQ ID NO: 163102 - DNA, 103 bp, Artificial Sequence
  Synthetic Polynucleotide
taatacgactcactatagggacgaggtcttggaatatttctcgagctcctaacagaggagaaggagcatgagaaatattaacctggcggcagcgcaaaagatg

SEQ ID NO: 163103 - DNA, 103 bp, Artificial Sequence
  Synthetic Polynucleotide
taatacgactcactatagggttgtattcaaacgaggtcttggaatatttcaacagaggagagaaataatgcaagacctcaacctggcggcagcgcaaaagatg

SEQ ID NO: 163104 - DNA, 103 bp, Artificial Sequence
  Synthetic Polynucleotide
taatacgactcactataggggtcgtaactgttgtattcaaacgaggtcttaacagaggagaaagaccatgtttgaatacaacctggcggcagcgcaaaagatg

SEQ ID NO: 163105 - DNA, 103 bp, Artificial Sequence
  Synthetic Polynucleotide
taatacgactcactatagggaagtatggttgtcgtaactgttgtattcaaaacagaggagattgaatatgacagttacgaacctggcggcagcgcaaaagatg

SEQ ID NO: 163106 - DNA, 103 bp, Artificial Sequence
  Synthetic Polynucleotide
taatacgactcactatagggcgcttgccataagtatggttgtcgtaactgaacagaggagacagttaatgcaaccatacaacctggcggcagcgcaaaagatg

SEQ ID NO: 163107 - DNA, 103 bp, Artificial Sequence
  Synthetic Polynucleotide
taatacgactcactatagggagctatggctcgcttgccataagtatggttaacagaggagaaaccatatgtatggcaagaacctggcggcagcgcaaaagatg

SEQ ID NO: 163108 - DNA, 103 bp, Artificial Sequence
  Synthetic Polynucleotide
taatacgactcactataggggcaccttgggagctatggctcgcttgccataacagaggagaatggcaatggagccatagaacctggcggcagcgcaaaagatg

SEQ ID NO: 163109 - DNA, 103 bp, Artificial Sequence
  Synthetic Polynucleotide
taatacgactcactatagggtccctggtttgcaccttgggagctatggctaacagaggagaagccatatgtcccaaggtaacctggcggcagcgcaaaagatg

SEQ ID NO: 163110 - DNA, 103 bp, Artificial Sequence
  Synthetic Polynucleotide
taatacgactcactataggggggggatatatccctggtttgcaccttgggaacagaggagacccaagatgcaaaccaggaacctggcggcagcgcaaaagatg

SEQ ID NO: 163111 - DNA, 103 bp, Artificial Sequence
  Synthetic Polynucleotide
taatacgactcactatagggaccgcgtgcgatgccgcttctcctcggtgtaacagaggagaacaccgatgagaagcggcaacctggcggcagcgcaaaagatg

SEQ ID NO: 163112 - DNA, 103 bp, Artificial Sequence
  Synthetic Polynucleotide
taatacgactcactatagggtaggagcaggttcctggggctgtttatcttaacagaggagaaagataatgagccccaggaacctggcggcagcgcaaaagatg

SEQ ID NO: 163113 - DNA, 103 bp, Artificial Sequence
  Synthetic Polynucleotide
taatacgactcactatagggcatatcctttgggggatatatccctggtttaacagaggagaaaaccaatgatatatcccaacctggcggcagcgcaaaagatg

SEQ ID NO: 163114 - DNA, 103 bp, Artificial Sequence
  Synthetic Polynucleotide
taatacgactcactatagggttcgcatcatcatatcctttgggggatataaacagaggagatatatcatgcaaaggataaacctggcggcagcgcaaaagatg

SEQ ID NO: 163115 - DNA, 103 bp, Artificial Sequence
  Synthetic Polynucleotide
taatacgactcactataggggcagtaccgcttcgcatcatcatatcctttaacagaggagaaaaggaatggatgatgcgaacctggcggcagcgcaaaagatg

SEQ ID NO: 163116 - DNA, 103 bp, Artificial Sequence
  Synthetic Polynucleotide
taatacgactcactatagggtggggtccttgcagtaccgcttcgcatcataacagaggagaatgatgatgagcggtactaacctggcggcagcgcaaaagatg

SEQ ID NO: 163117 - DNA, 103 bp, Artificial Sequence
  Synthetic Polynucleotide
taatacgactcactatagggctgctggggctggggtccttgcagtaccgcaacagaggagagcggtaatgcaaggacccaacctggcggcagcgcaaaagatg

SEQ ID NO: 163118 - DNA, 103 bp, Artificial Sequence
  Synthetic Polynucleotide
taatacgactcactatagggggtgctgctgctgctggggctggggtccttaacagaggagaaaggacatgagccccagcaacctggcggcagcgcaaaagatg

SEQ ID NO: 163119 - DNA, 103 bp, Artificial Sequence
  Synthetic Polynucleotide
taatacgactcactatagggcgtagctgctggtgctgctgctgctggggcaacagaggagagccccaatggcagcagcaaacctggcggcagcgcaaaagatg

SEQ ID NO: 163120 - DNA, 103 bp, Artificial Sequence
  Synthetic Polynucleotide
taatacgactcactatagggctgctgggcgcgtagctgctggtgctgctgaacagaggagacagcagatgcagcagctaaacctggcggcagcgcaaaagatg

SEQ ID NO: 163121 - DNA, 103 bp, Artificial Sequence
  Synthetic Polynucleotide
taatacgactcactataggggttgctgctgctgctgggcgcgtagctgctaacagaggagaagcagcatggcgcccagcaacctggcggcagcgcaaaagatg

SEQ ID NO: 163122 - DNA, 103 bp, Artificial Sequence
  Synthetic Polynucleotide
taatacgactcactatagggcgcagctcaggttgctgctgctgctgggcgaacagaggagacgcccaatggcagcagcaaacctggcggcagcgcaaaagatg

SEQ ID NO: 163123 - DNA, 103 bp, Artificial Sequence
  Synthetic Polynucleotide
taatacgactcactatagggggctttcgtttaggagcaggttcctggggcaacagaggagagccccaatgacctgctccaacctggcggcagcgcaaaagatg

SEQ ID NO: 163124 - DNA, 103 bp, Artificial Sequence
  Synthetic Polynucleotide
taatacgactcactatagggctgcccccgccgcagctcaggttgctgctgaacagaggagacagcagatgcctgagctgaacctggcggcagcgcaaaagatg

SEQ ID NO: 163125 - DNA, 103 bp, Artificial Sequence
  Synthetic Polynucleotide
taatacgactcactataggggctggcgctgctgcccccgccgcagctcagaacagaggagactgagcatgggcgggggcaacctggcggcagcgcaaaagatg

SEQ ID NO: 163126 - DNA, 103 bp, Artificial Sequence
  Synthetic Polynucleotide
taatacgactcactatagggtgcacgtgctgctggcgctgctgcccccgcaacagaggagagcggggatggcagcgccaaacctggcggcagcgcaaaagatg

SEQ ID NO: 163127 - DNA, 103 bp, Artificial Sequence
  Synthetic Polynucleotide
taatacgactcactatagggctgctcttgctgcacgtgctgctggcgctgaacagaggagacagcgcatgcagcacgtgaacctggcggcagcgcaaaagatg

SEQ ID NO: 163128 - DNA, 103 bp, Artificial Sequence
  Synthetic Polynucleotide
taatacgactcactataggggtagtcgaagctgctcttgctgcacgtgctaacagaggagaagcacgatgagcaagagcaacctggcggcagcgcaaaagatg

SEQ ID NO: 163129 - DNA, 103 bp, Artificial Sequence
  Synthetic Polynucleotide
taatacgactcactatagggtgtcgtgcgtgtagtcgaagctgctcttgcaacagaggagagcaagaatggcttcgactaacctggcggcagcgcaaaagatg

SEQ ID NO: 163130 - DNA, 103 bp, Artificial Sequence
  Synthetic Polynucleotide
taatacgactcactataggggccgcctccatgtcgtgcgtgtagtcgaagaacagaggagacttcgaatgcacgcacgaaacctggcggcagcgcaaaagatg

SEQ ID NO: 163131 - DNA, 103 bp, Artificial Sequence
  Synthetic Polynucleotide
taatacgactcactatagggcgccatgtgggccgcctccatgtcgtgcgtaacagaggagaacgcacatgatggaggcgaacctggcggcagcgcaaaagatg

SEQ ID NO: 163132 - DNA, 103 bp, Artificial Sequence
  Synthetic Polynucleotide
taatacgactcactatagggtggcggtggccgccatgtgggccgcctccaaacagaggagatggaggatgcccacatggaacctggcggcagcgcaaaagatg

SEQ ID NO: 163133 - DNA, 103 bp, Artificial Sequence
  Synthetic Polynucleotide
taatacgactcactatagggaggttgaggatggcggtggccgccatgtggaacagaggagaccacatatgggccaccgcaacctggcggcagcgcaaaagatg

SEQ ID NO: 163134 - DNA, 103 bp, Artificial Sequence
  Synthetic Polynucleotide
taatacgactcactatagggcacggcaaatggctttcgtttaggagcaggaacagaggagacctgctatgaaacgaaagaacctggcggcagcgcaaaagatg

SEQ ID NO: 163135 - DNA, 103 bp, Artificial Sequence
  Synthetic Polynucleotide
taatacgactcactataggggcgcgtggacaggttgaggatggcggtggcaacagaggagagccaccatgatcctcaacaacctggcggcagcgcaaaagatg

SEQ ID NO: 163136 - DNA, 103 bp, Artificial Sequence
  Synthetic Polynucleotide
taatacgactcactatagggtctcgcggcagcgcgtggacaggttgaggaaacagaggagatcctcaatgtgtccacgcaacctggcggcagcgcaaaagatg

SEQ ID NO: 163137 - DNA, 103 bp, Artificial Sequence
  Synthetic Polynucleotide
taatacgactcactatagggttctgcggcatctcgcggcagcgcgtggacaacagaggagagtccacatgctgccgcgaaacctggcggcagcgcaaaagatg

SEQ ID NO: 163138 - DNA, 103 bp, Artificial Sequence
  Synthetic Polynucleotide
taatacgactcactatagggggtgctcaggttctgcggcatctcgcggcaaacagaggagatgccgcatgatgccgcagaacctggcggcagcgcaaaagatg

SEQ ID NO: 163139 - DNA, 103 bp, Artificial Sequence
  Synthetic Polynucleotide
taatacgactcactatagggcctgcggcttggtgctcaggttctgcggcaaacagaggagatgccgcatgacctgagcaaacctggcggcagcgcaaaagatg

SEQ ID NO: 163140 - DNA, 103 bp, Artificial Sequence
  Synthetic Polynucleotide
taatacgactcactataggggcgcacaggtcctgcggcttggtgctcaggaacagaggagacctgagatgcaagccgcaaacctggcggcagcgcaaaagatg

SEQ ID NO: 163141 - DNA, 103 bp, Artificial Sequence
  Synthetic Polynucleotide
taatacgactcactataggggttccgcgtggcgcacaggtcctgcggcttaacagaggagaaagccgatggacctgtgcaacctggcggcagcgcaaaagatg

SEQ ID NO: 163142 - DNA, 103 bp, Artificial Sequence
  Synthetic Polynucleotide
taatacgactcactatagggccatgtcagggttccgcgtggcgcacaggtaacagaggagaacctgtatgccacgcggaaacctggcggcagcgcaaaagatg

SEQ ID NO: 163143 - DNA, 103 bp, Artificial Sequence
  Synthetic Polynucleotide
taatacgactcactatagggtcatccacctccatgtcagggttccgcgtgaacagaggagacacgcgatgccctgacataacctggcggcagcgcaaaagatg

SEQ ID NO: 163144 - DNA, 103 bp, Artificial Sequence
  Synthetic Polynucleotide
taatacgactcactatagggggtcccgttctcatccacctccatgtcaggaacagaggagacctgacatggaggtggataacctggcggcagcgcaaaagatg

SEQ ID NO: 163145 - DNA, 103 bp, Artificial Sequence
  Synthetic Polynucleotide
taatacgactcactatagggtgtctgctttcacggcaaatggctttcgttaacagaggagaaacgaaatgcatttgccgaacctggcggcagcgcaaaagatg

SEQ ID NO: 163146 - DNA, 103 bp, Artificial Sequence
  Synthetic Polynucleotide
taatacgactcactatagggtgaggtccagggtcccgttctcatccacctaacagaggagaaggtggatgagaacgggaaacctggcggcagcgcaaaagatg

SEQ ID NO: 163147 - DNA, 103 bp, Artificial Sequence
  Synthetic Polynucleotide
taatacgactcactatagggttgttcatgctgaggtccagggtcccgttcaacagaggagagaacggatgcctggacctaacctggcggcagcgcaaaagatg

SEQ ID NO: 163148 - DNA, 103 bp, Artificial Sequence
  Synthetic Polynucleotide
taatacgactcactatagggcggcctctgcttgttcatgctgaggtccagaacagaggagactggacatgagcatgaacaacctggcggcagcgcaaaagatg

SEQ ID NO: 163149 - DNA, 103 bp, Artificial Sequence
  Synthetic Polynucleotide
taatacgactcactatagggagctgtcccgcggcctctgcttgttcatgcaacagaggagagcatgaatgagcagaggcaacctggcggcagcgcaaaagatg

SEQ ID NO: 163150 - DNA, 103 bp, Artificial Sequence
  Synthetic Polynucleotide
taatacgactcactatagggatggggcagcagctgtcccgcggcctctgcaacagaggagagcagagatggcgggacagaacctggcggcagcgcaaaagatg

SEQ ID NO: 163151 - DNA, 103 bp, Artificial Sequence
  Synthetic Polynucleotide
taatacgactcactatagggaggggtcaggatggggcagcagctgtcccgaacagaggagacgggacatgtgctgccccaacctggcggcagcgcaaaagatg

SEQ ID NO: 163152 - DNA, 103 bp, Artificial Sequence
  Synthetic Polynucleotide
taatacgactcactatagggtgggctccagaggggtcaggatggggcagcaacagaggagagctgccatgtcctgacccaacctggcggcagcgcaaaagatg

SEQ ID NO: 163153 - DNA, 103 bp, Artificial Sequence
  Synthetic Polynucleotide
taatacgactcactatagggtggggggacatgggctccagaggggtcaggaacagaggagacctgacatgtctggagccaacctggcggcagcgcaaaagatg

SEQ ID NO: 163154 - DNA, 103 bp, Artificial Sequence
  Synthetic Polynucleotide
taatacgactcactatagggtgcctgctgctggggggacatgggctccagaacagaggagactggagatgatgtcccccaacctggcggcagcgcaaaagatg

SEQ ID NO: 163155 - DNA, 103 bp, Artificial Sequence
  Synthetic Polynucleotide
taatacgactcactatagggtgttcatcactgcctgctgctggggggacaaacagaggagatgtcccatgagcagcaggaacctggcggcagcgcaaaagatg

SEQ ID NO: 163156 - DNA, 103 bp, Artificial Sequence
  Synthetic Polynucleotide
taatacgactcactatagggactgaggagctgtctgctttcacggcaaataacagaggagaatttgcatggaaagcagaaacctggcggcagcgcaaaagatg

SEQ ID NO: 163157 - DNA, 103 bp, Artificial Sequence
  Synthetic Polynucleotide
taatacgactcactatagggaaacaccggttgttcatcactgcctgctgcaacagaggagagcagcaatgagtgatgaaaacctggcggcagcgcaaaagatg

SEQ ID NO: 163158 - DNA, 103 bp, Artificial Sequence
  Synthetic Polynucleotide
taatacgactcactataggggcccagctggaaacaccggttgttcatcacaacagaggagagtgatgatgaaccggtgtaacctggcggcagcgcaaaagatg

SEQ ID NO: 163159 - DNA, 103 bp, Artificial Sequence
  Synthetic Polynucleotide
taatacgactcactatagggagtcgccctcgcccagctggaaacaccggtaacagaggagaaccggtatgtccagctggaacctggcggcagcgcaaaagatg

SEQ ID NO: 163160 - DNA, 103 bp, Artificial Sequence
  Synthetic Polynucleotide
taatacgactcactatagggaagtcccagcagtcgccctcgcccagctggaacagaggagaccagctatgcgagggcgaaacctggcggcagcgcaaaagatg

SEQ ID NO: 163161 - DNA, 103 bp, Artificial Sequence
  Synthetic Polynucleotide
taatacgactcactataggggtctacgggcaagtcccagcagtcgccctcaacagaggagagagggcatgtgctgggacaacctggcggcagcgcaaaagatg

SEQ ID NO: 163162 - DNA, 103 bp, Artificial Sequence
  Synthetic Polynucleotide
taatacgactcactatagggttttggtgtagtctacgggcaagtcccagcaacagaggagagctgggatgtgcccgtagaacctggcggcagcgcaaaagatg

SEQ ID NO: 163163 - DNA, 103 bp, Artificial Sequence
  Synthetic Polynucleotide
taatacgactcactatagggcggggtttcattttggtgtagtctacgggcaacagaggagagcccgtatgctacaccaaaacctggcggcagcgcaaaagatg

SEQ ID NO: 163164 - DNA, 103 bp, Artificial Sequence
  Synthetic Polynucleotide
taatacgactcactataggggtctatcctccggggtttcattttggtgtaaacagaggagatacaccatgatgaaacccaacctggcggcagcgcaaaagatg

SEQ ID NO: 163165 - DNA, 103 bp, Artificial Sequence
  Synthetic Polynucleotide
taatacgactcactatagggactcgtcctcgtctatcctccggggtttcaaacagaggagatgaaacatgggaggatagaacctggcggcagcgcaaaagatg

SEQ ID NO: 163166 - DNA, 103 bp, Artificial Sequence
  Synthetic Polynucleotide
taatacgactcactatagggatgtctttggactcgtcctcgtctatcctcaacagaggagagaggatatgcgaggacgaaacctggcggcagcgcaaaagatg

SEQ ID NO: 163167 - DNA, 103 bp, Artificial Sequence
  Synthetic Polynucleotide
taatacgactcactatagggacactcatccactgaggagctgtctgctttaacagaggagaaaagcaatgagctcctcaaacctggcggcagcgcaaaagatg

SEQ ID NO: 163168 - DNA, 103 bp, Artificial Sequence
  Synthetic Polynucleotide
taatacgactcactatagggttctggagtaatgtctttggactcgtcctcaacagaggagagaggacatgtccaaagacaacctggcggcagcgcaaaagatg

SEQ ID NO: 163169 - DNA, 103 bp, Artificial Sequence
  Synthetic Polynucleotide
taatacgactcactatagggggtccaagtcttctggagtaatgtctttggaacagaggagaccaaagatgttactccagaacctggcggcagcgcaaaagatg

SEQ ID NO: 163170 - DNA, 103 bp, Artificial Sequence
  Synthetic Polynucleotide
taatacgactcactatagggtcctggaatgggtccaagtcttctggagtaaacagaggagatactccatgagacttggaaacctggcggcagcgcaaaagatg

SEQ ID NO: 163171 - DNA, 103 bp, Artificial Sequence
  Synthetic Polynucleotide
taatacgactcactatagggttctagagcctcctggaatgggtccaagtcaacagaggagagacttgatgccattccagaacctggcggcagcgcaaaagatg

SEQ ID NO: 163172 - DNA, 103 bp, Artificial Sequence
  Synthetic Polynucleotide
taatacgactcactatagggaccgtctttcttctagagcctcctggaatgaacagaggagacattccatgaggctctagaacctggcggcagcgcaaaagatg

SEQ ID NO: 163173 - DNA, 103 bp, Artificial Sequence
  Synthetic Polynucleotide
taatacgactcactatagggtccccgggataccgtctttcttctagagccaacagaggagaggctctatgagaaagacgaacctggcggcagcgcaaaagatg

SEQ ID NO: 163174 - DNA, 103 bp, Artificial Sequence
  Synthetic Polynucleotide
taatacgactcactataggggatggtcacctccccgggataccgtctttcaacagaggagagaaagaatgtatcccgggaacctggcggcagcgcaaaagatg

SEQ ID NO: 163175 - DNA, 103 bp, Artificial Sequence
  Synthetic Polynucleotide
taatacgactcactatagggtgggacttgggatggtcacctccccgggataacagaggagaatcccgatgaggtgaccaaacctggcggcagcgcaaaagatg

SEQ ID NO: 163176 - DNA, 103 bp, Artificial Sequence
  Synthetic Polynucleotide
taatacgactcactatagggtacttgggtttgggacttgggatggtcaccaacagaggagaggtgacatgcccaagtccaacctggcggcagcgcaaaagatg

SEQ ID NO: 163177 - DNA, 103 bp, Artificial Sequence
  Synthetic Polynucleotide
taatacgactcactataggggcactgagggtacttgggtttgggacttggaacagaggagaccaagtatgaaacccaagaacctggcggcagcgcaaaagatg

SEQ ID NO: 163178 - DNA, 103 bp, Artificial Sequence
  Synthetic Polynucleotide
taatacgactcactatagggcactgtcgtcacactcatccactgaggagcaacagaggagagctcctatgtggatgagtaacctggcggcagcgcaaaagatg

SEQ ID NO: 163179 - DNA, 103 bp, Artificial Sequence
  Synthetic Polynucleotide
taatacgactcactatagggtgctctccttgcactgagggtacttgggttaacagaggagaaacccaatgaccctcagtaacctggcggcagcgcaaaagatg

SEQ ID NO: 163180 - DNA, 103 bp, Artificial Sequence
  Synthetic Polynucleotide
taatacgactcactatagggaagtcctttttgctctccttgcactgagggaacagaggagaccctcaatgcaaggagagaacctggcggcagcgcaaaagatg

SEQ ID NO: 163181 - DNA, 103 bp, Artificial Sequence
  Synthetic Polynucleotide
taatacgactcactatagggcagagttattaagtcctttttgctctccttaacagaggagaaaggagatgaaaaaggacaacctggcggcagcgcaaaagatg

SEQ ID NO: 163182 - DNA, 103 bp, Artificial Sequence
  Synthetic Polynucleotide
taatacgactcactatagggggcagccagacagagttattaagtccttttaacagaggagaaaaaggatgtaataactcaacctggcggcagcgcaaaagatg

SEQ ID NO: 163183 - DNA, 103 bp, Artificial Sequence
  Synthetic Polynucleotide
taatacgactcactatagggtccgccagggggcagccagacagagttattaacagaggagaaataacatggtctggctgaacctggcggcagcgcaaaagatg

SEQ ID NO: 163184 - DNA, 103 bp, Artificial Sequence
  Synthetic Polynucleotide
taatacgactcactatagggaatgcttttgtccgccagggggcagccagaaacagaggagatctggcatgcccctggcgaacctggcggcagcgcaaaagatg

SEQ ID NO: 163185 - DNA, 103 bp, Artificial Sequence
  Synthetic Polynucleotide
taatacgactcactataggggcatacttcgaatgcttttgtccgccagggaacagaggagaccctggatgacaaaagcaaacctggcggcagcgcaaaagatg

SEQ ID NO: 163186 - DNA, 103 bp, Artificial Sequence
  Synthetic Polynucleotide
taatacgactcactatagggctggtggccagcatacttcgaatgcttttgaacagaggagacaaaagatgtcgaagtataacctggcggcagcgcaaaagatg

SEQ ID NO: 163187 - DNA, 103 bp, Artificial Sequence
  Synthetic Polynucleotide
taatacgactcactatagggttcttgggagctggtggccagcatacttcgaacagaggagacgaagtatgctggccaccaacctggcggcagcgcaaaagatg

SEQ ID NO: 163188 - DNA, 103 bp, Artificial Sequence
  Synthetic Polynucleotide
taatacgactcactatagggggcacttgagttcttgggagctggtggccaaacagaggagatggccaatggctcccaagaacctggcggcagcgcaaaagatg

SEQ ID NO: 163189 - DNA, 103 bp, Artificial Sequence
  Synthetic Polynucleotide
taatacgactcactatagggtcagtcccatcactgtcgtcacactcatccaacagaggagaggatgaatgtgacgacagaacctggcggcagcgcaaaagatg

SEQ ID NO: 163190 - DNA, 103 bp, Artificial Sequence
  Synthetic Polynucleotide
taatacgactcactatagggccaggcgtggggcacttgagttcttgggagaacagaggagactcccaatgactcaagtgaacctggcggcagcgcaaaagatg

SEQ ID NO: 163191 - DNA, 103 bp, Artificial Sequence
  Synthetic Polynucleotide
taatacgactcactatagggaccatcacagccaggcgtggggcacttgagaacagaggagactcaagatgcccacgcctaacctggcggcagcgcaaaagatg

SEQ ID NO: 163192 - DNA, 103 bp, Artificial Sequence
  Synthetic Polynucleotide
taatacgactcactatagggtatgtccagaaccatcacagccaggcgtggaacagaggagaccacgcatggctgtgatgaacctggcggcagcgcaaaagatg

SEQ ID NO: 163193 - DNA, 103 bp, Artificial Sequence
  Synthetic Polynucleotide
taatacgactcactatagggttgccggtgatatgtccagaaccatcacagaacagaggagactgtgaatgttctggacaaacctggcggcagcgcaaaagatg

SEQ ID NO: 163194 - DNA, 103 bp, Artificial Sequence
  Synthetic Polynucleotide
taatacgactcactatagggagaagcataattgccggtgatatgtccagaaacagaggagatctggaatgatcaccggcaacctggcggcagcgcaaaagatg

SEQ ID NO: 163195 - DNA, 103 bp, Artificial Sequence
  Synthetic Polynucleotide
taatacgactcactatagggggctccgatgagaagcataattgccggtgaaacagaggagatcaccgatgattatgcttaacctggcggcagcgcaaaagatg

SEQ ID NO: 163196 - DNA, 103 bp, Artificial Sequence
  Synthetic Polynucleotide
taatacgactcactatagggcaacctgaaaggctccgatgagaagcataaaacagaggagattatgcatgtcatcggagaacctggcggcagcgcaaaagatg

SEQ ID NO: 163197 - DNA, 103 bp, Artificial Sequence
  Synthetic Polynucleotide
taatacgactcactatagggtgctcttgggcaacctgaaaggctccgatgaacagaggagacatcggatgctttcaggtaacctggcggcagcgcaaaagatg

SEQ ID NO: 163198 - DNA, 103 bp, Artificial Sequence
  Synthetic Polynucleotide
taatacgactcactatagggcacttttctttgctcttgggcaacctgaaaaacagaggagatttcagatggcccaagagaacctggcggcagcgcaaaagatg

SEQ ID NO: 163199 - DNA, 103 bp, Artificial Sequence
  Synthetic Polynucleotide
taatacgactcactatagggatcctgataccacttttctttgctcttgggaacagaggagacccaagatgaaagaaaagaacctggcggcagcgcaaaagatg

SEQ ID NO: 163200 - DNA, 103 bp, Artificial Sequence
  Synthetic Polynucleotide
taatacgactcactatagggatccatgtcctcagtcccatcactgtcgtcaacagaggagagacgacatggatgggactaacctggcggcagcgcaaaagatg

SEQ ID NO: 163201 - DNA, 103 bp, Artificial Sequence
  Synthetic Polynucleotide
taatacgactcactataggggctctgtgctatcctgataccacttttcttaacagaggagaaagaaaatgggtatcaggaacctggcggcagcgcaaaagatg

SEQ ID NO: 163202 - DNA, 103 bp, Artificial Sequence
  Synthetic Polynucleotide
taatacgactcactatagggtatcttctttgctctgtgctatcctgatacaacagaggagagtatcaatgtagcacagaaacctggcggcagcgcaaaagatg

SEQ ID NO: 163203 - DNA, 103 bp, Artificial Sequence
  Synthetic Polynucleotide
taatacgactcactatagggtgatcttctttatcttctttgctctgtgctaacagaggagaagcacaatgcaaagaagaaacctggcggcagcgcaaaagatg

SEQ ID NO: 163204 - DNA, 103 bp, Artificial Sequence
  Synthetic Polynucleotide
taatacgactcactataggggatgggttcttgatcttctttatcttctttaacagaggagaaaagaaatgaaagaagataacctggcggcagcgcaaaagatg

SEQ ID NO: 163205 - DNA, 103 bp, Artificial Sequence
  Synthetic Polynucleotide
taatacgactcactatagggccggacacctgatgggttcttgatcttcttaacagaggagaaagaagatgaagaacccaaacctggcggcagcgcaaaagatg

SEQ ID NO: 163206 - DNA, 103 bp, Artificial Sequence
  Synthetic Polynucleotide
taatacgactcactatagggcacccggggaccggacacctgatgggttctaacagaggagaagaaccatgcaggtgtccaacctggcggcagcgcaaaagatg

SEQ ID NO: 163207 - DNA, 103 bp, Artificial Sequence
  Synthetic Polynucleotide
taatacgactcactatagggctggccgtcgcacccggggaccggacacctaacagaggagaaggtgtatggtccccgggaacctggcggcagcgcaaaagatg

SEQ ID NO: 163208 - DNA, 103 bp, Artificial Sequence
  Synthetic Polynucleotide
taatacgactcactatagggtgatgtggccctggccgtcgcacccggggaaacagaggagatccccgatggcgacggccaacctggcggcagcgcaaaagatg

SEQ ID NO: 163209 - DNA, 103 bp, Artificial Sequence
  Synthetic Polynucleotide
taatacgactcactatagggtacttcccagtgatgtggccctggccgtcgaacagaggagacgacggatggggccacataacctggcggcagcgcaaaagatg

SEQ ID NO: 163210 - DNA, 103 bp, Artificial Sequence
  Synthetic Polynucleotide
taatacgactcactatagggatgggacgcgtacttcccagtgatgtggccaacagaggagaggccacatgactgggaagaacctggcggcagcgcaaaagatg

SEQ ID NO: 163211 - DNA, 103 bp, Artificial Sequence
  Synthetic Polynucleotide
taatacgactcactatagggcctccttctcatccatgtcctcagtcccataacagaggagaatgggaatgaggacatggaacctggcggcagcgcaaaagatg

SEQ ID NO: 163212 - DNA, 103 bp, Artificial Sequence
  Synthetic Polynucleotide
taatacgactcactatagggaggcgctgcgatgggacgcgtacttcccagaacagaggagactgggaatgacgcgtcccaacctggcggcagcgcaaaagatg

SEQ ID NO: 163213 - DNA, 103 bp, Artificial Sequence
  Synthetic Polynucleotide
taatacgactcactataggggggcacccggaggcgctgcgatgggacgcgaacagaggagacgcgtcatgtcgcagcgcaacctggcggcagcgcaaaagatg

SEQ ID NO: 163214 - DNA, 103 bp, Artificial Sequence
  Synthetic Polynucleotide
taatacgactcactatagggggccgccaaggggcacccggaggcgctgcgaacagaggagacgcagcatgtccgggtgcaacctggcggcagcgcaaaagatg

SEQ ID NO: 163215 - DNA, 103 bp, Artificial Sequence
  Synthetic Polynucleotide
taatacgactcactatagggtctgcctcttggccgccaaggggcacccggaacagaggagaccgggtatgccttggcggaacctggcggcagcgcaaaagatg

SEQ ID NO: 163216 - DNA, 103 bp, Artificial Sequence
  Synthetic Polynucleotide
taatacgactcactatagggtacccgtctttctgcctcttggccgccaagaacagaggagacttggcatgcaagaggcaaacctggcggcagcgcaaaagatg

SEQ ID NO: 163217 - DNA, 103 bp, Artificial Sequence
  Synthetic Polynucleotide
taatacgactcactataggggccattcaggtacccgtctttctgcctcttaacagaggagaaagaggatgaaagacgggaacctggcggcagcgcaaaagatg

SEQ ID NO: 163218 - DNA, 103 bp, Artificial Sequence
  Synthetic Polynucleotide
taatacgactcactatagggagaactgggagccattcaggtacccgtcttaacagaggagaaagacgatgacctgaatgaacctggcggcagcgcaaaagatg

SEQ ID NO: 163219 - DNA, 103 bp, Artificial Sequence
  Synthetic Polynucleotide
taatacgactcactataggggacttccaggagaactgggagccattcaggaacagaggagacctgaaatgctcccagttaacctggcggcagcgcaaaagatg

SEQ ID NO: 163220 - DNA, 103 bp, Artificial Sequence
  Synthetic Polynucleotide
taatacgactcactatagggcgtcttgaccgacttccaggagaactgggaaacagaggagatcccagatgtcctggaagaacctggcggcagcgcaaaagatg

SEQ ID NO: 163221 - DNA, 103 bp, Artificial Sequence
  Synthetic Polynucleotide
taatacgactcactatagggacatgccttccgtcttgaccgacttccaggaacagaggagacctggaatgcggtcaagaaacctggcggcagcgcaaaagatg

SEQ ID NO: 163222 - DNA, 103 bp, Artificial Sequence
  Synthetic Polynucleotide
taatacgactcactatagggacccctttggaccgcgtgcgatgccgcttcaacagaggagagaagcgatgtcgcacgcgaacctggcggcagcgcaaaagatg

SEQ ID NO: 163223 - DNA, 103 bp, Artificial Sequence
  Synthetic Polynucleotide
taatacgactcactatagggccctcatcctcctccttctcatccatgtccaacagaggagaggacatatgtgagaaggaaacctggcggcagcgcaaaagatg

SEQ ID NO: 163224 - DNA, 103 bp, Artificial Sequence
  Synthetic Polynucleotide
taatacgactcactataggggtggggcaggacatgccttccgtcttgaccaacagaggagaggtcaaatgggaaggcataacctggcggcagcgcaaaagatg

SEQ ID NO: 163225 - DNA, 103 bp, Artificial Sequence
  Synthetic Polynucleotide
taatacgactcactataggggcatcctggcgtggggcaggacatgccttcaacagaggagagaaggcatgtcctgccccaacctggcggcagcgcaaaagatg

SEQ ID NO: 163226 - DNA, 103 bp, Artificial Sequence
  Synthetic Polynucleotide
taatacgactcactatagggctgagccgtcgcatcctggcgtggggcaggaacagaggagacctgccatgcgccaggataacctggcggcagcgcaaaagatg

SEQ ID NO: 163227 - DNA, 103 bp, Artificial Sequence
  Synthetic Polynucleotide
taatacgactcactatagggctgacgtggcctgagccgtcgcatcctggcaacagaggagagccaggatgcgacggctcaacctggcggcagcgcaaaagatg

SEQ ID NO: 163228 - DNA, 103 bp, Artificial Sequence
  Synthetic Polynucleotide
taatacgactcactataggggaagctgccgctgacgtggcctgagccgtcaacagaggagagacggcatgggccacgtcaacctggcggcagcgcaaaagatg

SEQ ID NO: 163229 - DNA, 103 bp, Artificial Sequence
  Synthetic Polynucleotide
taatacgactcactatagggggtgtgtgaggaagctgccgctgacgtggcaacagaggagagccacgatggcggcagctaacctggcggcagcgcaaaagatg

SEQ ID NO: 163230 - DNA, 103 bp, Artificial Sequence
  Synthetic Polynucleotide
taatacgactcactataggggacaagctgcggtgtgtgaggaagctgccgaacagaggagacggcagatgcctcacacaaacctggcggcagcgcaaaagatg

SEQ ID NO: 163231 - DNA, 103 bp, Artificial Sequence
  Synthetic Polynucleotide
taatacgactcactatagggcgggcatcctgacaagctgcggtgtgtgagaacagaggagactcacaatgcgcagcttgaacctggcggcagcgcaaaagatg

SEQ ID NO: 163232 - DNA, 103 bp, Artificial Sequence
  Synthetic Polynucleotide
taatacgactcactatagggacgtggctctcgggcatcctgacaagctgcaacagaggagagcagctatgcaggatgccaacctggcggcagcgcaaaagatg

SEQ ID NO: 163233 - DNA, 103 bp, Artificial Sequence
  Synthetic Polynucleotide
taatacgactcactatagggttcatcgctgacgtggctctcgggcatcctaacagaggagaaggatgatggagagccacaacctggcggcagcgcaaaagatg

SEQ ID NO: 163234 - DNA, 103 bp, Artificial Sequence
  Synthetic Polynucleotide
taatacgactcactataggggtactcctccccctcatcctcctccttctcaacagaggagagagaagatggaggatgagaacctggcggcagcgcaaaagatg

SEQ ID NO: 163235 - DNA, 103 bp, Artificial Sequence
  Synthetic Polynucleotide
taatacgactcactatagggctttgccttcttcatcgctgacgtggctctaacagaggagaagagccatgtcagcgatgaacctggcggcagcgcaaaagatg

SEQ ID NO: 163236 - DNA, 103 bp, Artificial Sequence
  Synthetic Polynucleotide
taatacgactcactatagggctccagaaagctttgccttcttcatcgctgaacagaggagacagcgaatgagaaggcaaaacctggcggcagcgcaaaagatg

SEQ ID NO: 163237 - DNA, 103 bp, Artificial Sequence
  Synthetic Polynucleotide
taatacgactcactatagggagcatctgctctccagaaagctttgccttcaacagaggagagaaggcatggctttctggaacctggcggcagcgcaaaagatg

SEQ ID NO: 163238 - DNA, 103 bp, Artificial Sequence
  Synthetic Polynucleotide
taatacgactcactatagggtttgatggtcagcatctgctctccagaaagaacagaggagactttctatggagcagatgaacctggcggcagcgcaaaagatg

SEQ ID NO: 163239 - DNA, 103 bp, Artificial Sequence
  Synthetic Polynucleotide
taatacgactcactatagggtggcccgctgtttgatggtcagcatctgctaacagaggagaagcagaatgtgaccatcaaacctggcggcagcgcaaaagatg

SEQ ID NO: 163240 - DNA, 103 bp, Artificial Sequence
  Synthetic Polynucleotide
taatacgactcactatagggataccgttgctggcccgctgtttgatggtcaacagaggagagaccatatgacagcgggcaacctggcggcagcgcaaaagatg

SEQ ID NO: 163241 - DNA, 103 bp, Artificial Sequence
  Synthetic Polynucleotide
taatacgactcactatagggatcattttctataccgttgctggcccgctgaacagaggagacagcggatgagcaacggtaacctggcggcagcgcaaaagatg

SEQ ID NO: 163242 - DNA, 103 bp, Artificial Sequence
  Synthetic Polynucleotide
taatacgactcactatagggtgatttcttcatcattttctataccgttgcaacagaggagagcaacgatgtagaaaatgaacctggcggcagcgcaaaagatg

SEQ ID NO: 163243 - DNA, 103 bp, Artificial Sequence
  Synthetic Polynucleotide
taatacgactcactatagggtctaactgtttgatttcttcatcattttctaacagaggagaagaaaaatgtgaagaaataacctggcggcagcgcaaaagatg

SEQ ID NO: 163244 - DNA, 103 bp, Artificial Sequence
  Synthetic Polynucleotide
taatacgactcactataggggatttcttcatctaactgtttgatttcttcaacagaggagagaagaaatgaaacagttaaacctggcggcagcgcaaaagatg

SEQ ID NO: 163245 - DNA, 103 bp, Artificial Sequence
  Synthetic Polynucleotide
taatacgactcactatagggtgtcctcggagtactcctccccctcatcctaacagaggagaaggatgatggggaggagtaacctggcggcagcgcaaaagatg

SEQ ID NO: 163246 - DNA, 103 bp, Artificial Sequence
  Synthetic Polynucleotide
taatacgactcactatagggttagctccttgatttcttcatctaactgttaacagaggagaaacagtatgatgaagaaaaacctggcggcagcgcaaaagatg

SEQ ID NO: 163247 - DNA, 103 bp, Artificial Sequence
  Synthetic Polynucleotide
taatacgactcactatagggttggattcatttagctccttgatttcttcaaacagaggagatgaagaatgcaaggagctaacctggcggcagcgcaaaagatg

SEQ ID NO: 163248 - DNA, 103 bp, Artificial Sequence
  Synthetic Polynucleotide
taatacgactcactatagggcatctgggaattggattcatttagctccttaacagaggagaaaggagatgaatgaatccaacctggcggcagcgcaaaagatg

SEQ ID NO: 163249 - DNA, 103 bp, Artificial Sequence
  Synthetic Polynucleotide
taatacgactcactatagggtatcggcttccatctgggaattggattcataacagaggagaatgaatatgattcccagaaacctggcggcagcgcaaaagatg

SEQ ID NO: 163250 - DNA, 103 bp, Artificial Sequence
  Synthetic Polynucleotide
taatacgactcactatagggagtttaatcatatcggcttccatctgggaaaacagaggagattcccaatgggaagccgaaacctggcggcagcgcaaaagatg

SEQ ID NO: 163251 - DNA, 103 bp, Artificial Sequence
  Synthetic Polynucleotide
taatacgactcactatagggctgagttctgagtttaatcatatcggcttcaacagaggagagaagccatgatgattaaaaacctggcggcagcgcaaaagatg

SEQ ID NO: 163252 - DNA, 103 bp, Artificial Sequence
  Synthetic Polynucleotide
taatacgactcactatagggtcgtggtaatctgagttctgagtttaatcaaacagaggagatgattaatgtcagaactcaacctggcggcagcgcaaaagatg

SEQ ID NO: 163253 - DNA, 103 bp, Artificial Sequence
  Synthetic Polynucleotide
taatacgactcactatagggttgctctccatcgtggtaatctgagttctgaacagaggagacagaacatggattaccacaacctggcggcagcgcaaaagatg

SEQ ID NO: 163254 - DNA, 103 bp, Artificial Sequence
  Synthetic Polynucleotide
taatacgactcactatagggggtcttcaggttgctctccatcgtggtaataacagaggagaattaccatgatggagagcaacctggcggcagcgcaaaagatg

SEQ ID NO: 163255 - DNA, 103 bp, Artificial Sequence
  Synthetic Polynucleotide
taatacgactcactatagggcctcttcgatggtcttcaggttgctctccaaacagaggagatggagaatgacctgaagaaacctggcggcagcgcaaaagatg

SEQ ID NO: 163256 - DNA, 103 bp, Artificial Sequence
  Synthetic Polynucleotide
taatacgactcactatagggggctcatcattgtcctcggagtactcctccaacagaggagaggaggaatgctccgaggaaacctggcggcagcgcaaaagatg

SEQ ID NO: 163257 - DNA, 103 bp, Artificial Sequence
  Synthetic Polynucleotide
taatacgactcactatagggactttgttctcctcttcgatggtcttcaggaacagaggagacctgaaatgcatcgaagaaacctggcggcagcgcaaaagatg

SEQ ID NO: 163258 - DNA, 103 bp, Artificial Sequence
  Synthetic Polynucleotide
taatacgactcactatagggctgctcaatcactttgttctcctcttcgataacagaggagaatcgaaatggagaacaaaaacctggcggcagcgcaaaagatg

SEQ ID NO: 163259 - DNA, 103 bp, Artificial Sequence
  Synthetic Polynucleotide
taatacgactcactatagggactcgttctgctgctcaatcactttgttctaacagaggagaagaacaatgtgattgagcaacctggcggcagcgcaaaagatg

SEQ ID NO: 163260 - DNA, 103 bp, Artificial Sequence
  Synthetic Polynucleotide
taatacgactcactatagggtggaggagagactcgttctgctgctcaatcaacagaggagagattgaatggcagaacgaaacctggcggcagcgcaaaagatg

SEQ ID NO: 163261 - DNA, 103 bp, Artificial Sequence
  Synthetic Polynucleotide
taatacgactcactatagggcgccagctcgtggaggagagactcgttctgaacagaggagacagaacatgtctctcctcaacctggcggcagcgcaaaagatg

SEQ ID NO: 163262 - DNA, 103 bp, Artificial Sequence
  Synthetic Polynucleotide
taatacgactcactatagggggctcaggttcgccagctcgtggaggagagaacagaggagactctccatgacgagctggaacctggcggcagcgcaaaagatg

SEQ ID NO: 163263 - DNA, 103 bp, Artificial Sequence
  Synthetic Polynucleotide
taatacgactcactatagggatcagagactggctcaggttcgccagctcgaacagaggagacgagctatggaacctgagaacctggcggcagcgcaaaagatg

SEQ ID NO: 163264 - DNA, 103 bp, Artificial Sequence
  Synthetic Polynucleotide
taatacgactcactatagggcaggctgtggatcagagactggctcaggttaacagaggagaaacctgatgcagtctctgaacctggcggcagcgcaaaagatg

SEQ ID NO: 163265 - DNA, 103 bp, Artificial Sequence
  Synthetic Polynucleotide
taatacgactcactatagggggatgttagccaggctgtggatcagagactaacagaggagaagtctcatgtccacagccaacctggcggcagcgcaaaagatg

SEQ ID NO: 163266 - DNA, 103 bp, Artificial Sequence
  Synthetic Polynucleotide
taatacgactcactatagggtgcggcagctggatgttagccaggctgtggaacagaggagaccacagatgggctaacataacctggcggcagcgcaaaagatg

SEQ ID NO: 163267 - DNA, 103 bp, Artificial Sequence
  Synthetic Polynucleotide
taatacgactcactatagggctcatcccctggctcatcattgtcctcggaaacagaggagatccgagatgaatgatgagaacctggcggcagcgcaaaagatg

SEQ ID NO: 163268 - DNA, 103 bp, Artificial Sequence
  Synthetic Polynucleotide
taatacgactcactatagggtggatccatgtgcggcagctggatgttagcaacagaggagagctaacatgcagctgccgaacctggcggcagcgcaaaagatg

SEQ ID NO: 163269 - DNA, 103 bp, Artificial Sequence
  Synthetic Polynucleotide
taatacgactcactataggggttcattgattggatccatgtgcggcagctaacagaggagaagctgcatgacatggatcaacctggcggcagcgcaaaagatg

SEQ ID NO: 163270 - DNA, 103 bp, Artificial Sequence
  Synthetic Polynucleotide
taatacgactcactatagggtcaaaattttgttcattgattggatccatgaacagaggagacatggaatgaatcaatgaaacctggcggcagcgcaaaagatg

SEQ ID NO: 163271 - DNA, 103 bp, Artificial Sequence
  Synthetic Polynucleotide
taatacgactcactatagggcacgtaagcatcaaaattttgttcattgataacagaggagaatcaatatgcaaaattttaacctggcggcagcgcaaaagatg

SEQ ID NO: 163272 - DNA, 103 bp, Artificial Sequence
  Synthetic Polynucleotide
taatacgactcactatagggtcaaagtagtcacgtaagcatcaaaattttaacagaggagaaaaattatgatgcttacgaacctggcggcagcgcaaaagatg

SEQ ID NO: 163273 - DNA, 103 bp, Artificial Sequence
  Synthetic Polynucleotide
taatacgactcactatagggtacatttccgtcaaagtagtcacgtaagcaaacagaggagatgcttaatggactactttaacctggcggcagcgcaaaagatg

SEQ ID NO: 163274 - DNA, 103 bp, Artificial Sequence
  Synthetic Polynucleotide
taatacgactcactatagggttgatttgtatacatttccgtcaaagtagtaacagaggagaactactatgacggaaatgaacctggcggcagcgcaaaagatg

SEQ ID NO: 163275 - DNA, 103 bp, Artificial Sequence
  Synthetic Polynucleotide
taatacgactcactataggggataacgatcttgatttgtatacatttccgaacagaggagacggaaaatgatacaaatcaacctggcggcagcgcaaaagatg

SEQ ID NO: 163276 - DNA, 103 bp, Artificial Sequence
  Synthetic Polynucleotide
taatacgactcactatagggtctggactctgataacgatcttgatttgtaaacagaggagatacaaaatgagatcgttaaacctggcggcagcgcaaaagatg

SEQ ID NO: 163277 - DNA, 103 bp, Artificial Sequence
  Synthetic Polynucleotide
taatacgactcactatagggggctttattttctggactctgataacgatcaacagaggagagatcgtatgcagagtccaaacctggcggcagcgcaaaagatg

SEQ ID NO: 163278 - DNA, 103 bp, Artificial Sequence
  Synthetic Polynucleotide
taatacgactcactatagggcctcctcgtcctcatcccctggctcatcataacagaggagaatgatgatgcaggggatgaacctggcggcagcgcaaaagatg

SEQ ID NO: 163279 - DNA, 103 bp, Artificial Sequence
  Synthetic Polynucleotide
taatacgactcactatagggtttccagtagggctttattttctggactctaacagaggagaagagtcatgaaaataaagaacctggcggcagcgcaaaagatg

SEQ ID NO: 163280 - DNA, 103 bp, Artificial Sequence
  Synthetic Polynucleotide
taatacgactcactatagggtgctttatattttccagtagggctttatttaacagaggagaaaataaatgcctactggaaacctggcggcagcgcaaaagatg

SEQ ID NO: 163281 - DNA, 103 bp, Artificial Sequence
  Synthetic Polynucleotide
taatacgactcactatagggtctcacagcctgctttatattttccagtagaacagaggagactactgatgaatataaagaacctggcggcagcgcaaaagatg

SEQ ID NO: 163282 - DNA, 103 bp, Artificial Sequence
  Synthetic Polynucleotide
taatacgactcactatagggcctgaattcctctcacagcctgctttatataacagaggagaatataaatgaggctgtgaaacctggcggcagcgcaaaagatg

SEQ ID NO: 163283 - DNA, 103 bp, Artificial Sequence
  Synthetic Polynucleotide
taatacgactcactatagggccctcctcgtcctcctcgtcctcatcccctaacagaggagaaggggaatgggacgaggaaacctggcggcagcgcaaaagatg

SEQ ID NO: 163284 - DNA, 103 bp, Artificial Sequence
  Synthetic Polynucleotide
taatacgactcactatagggctcccggtccccctcctcgtcctcctcgtcaacagaggagagacgagatggacgaggagaacctggcggcagcgcaaaagatg

SEQ ID NO: 163285 - DNA, 103 bp, Artificial Sequence
  Synthetic Polynucleotide
taatacgactcactatagggcctcctcctcctcccggtccccctcctcgtaacagaggagaacgaggatggggaccgggaacctggcggcagcgcaaaagatg

SEQ ID NO: 163286 - DNA, 103 bp, Artificial Sequence
  Synthetic Polynucleotide
taatacgactcactatagggtcctcgatctcctcctcctcctcccggtccaacagaggagaggaccgatgggaggaggaaacctggcggcagcgcaaaagatg

SEQ ID NO: 163287 - DNA, 103 bp, Artificial Sequence
  Synthetic Polynucleotide
taatacgactcactataggggggaactcgaacccctttggaccgcgtgcgaacagaggagacgcacgatgtccaaagggaacctggcggcagcgcaaaagatg

SEQ ID NO: 163288 - DNA, 103 bp, Artificial Sequence
  Synthetic Polynucleotide
taatacgactcactatagggctcatcctcctcctcgatctcctcctcctcaacagaggagagaggagatggagatcgagaacctggcggcagcgcaaaagatg

SEQ ID NO: 163289 - DNA, 103 bp, Artificial Sequence
  Synthetic Polynucleotide
taatacgactcactatagggcgtcatcgtcctcatcctcctcctcgatctaacagaggagaagatcgatgaggaggatgaacctggcggcagcgcaaaagatg

SEQ ID NO: 163290 - DNA, 103 bp, Artificial Sequence
  Synthetic Polynucleotide
taatacgactcactatagggtctccatcctcgtcatcgtcctcatcctccaacagaggagaggaggaatgggacgatgaaacctggcggcagcgcaaaagatg

SEQ ID NO: 163291 - DNA, 103 bp, Artificial Sequence
  Synthetic Polynucleotide
taatacgactcactatagggctccacatcttctccatcctcgtcatcgtcaacagaggagagacgatatggaggatggaaacctggcggcagcgcaaaagatg

SEQ ID NO: 163292 - DNA, 103 bp, Artificial Sequence
  Synthetic Polynucleotide
taatacgactcactatagggcttcttcatcctccacatcttctccatcctaacagaggagaaggatgatgaagatgtggaacctggcggcagcgcaaaagatg

SEQ ID NO: 163293 - DNA, 103 bp, Artificial Sequence
  Synthetic Polynucleotide
taatacgactcactatagggtcctcttcctcttcttcatcctccacatctaacagaggagaagatgtatgggatgaagaaacctggcggcagcgcaaaagatg

SEQ ID NO: 163294 - DNA, 103 bp, Artificial Sequence
  Synthetic Polynucleotide
taatacgactcactatagggctcctcctcctcctcttcctcttcttcatcaacagaggagagatgaaatggaggaagagaacctggcggcagcgcaaaagatg

SEQ ID NO: 163295 - DNA, 103 bp, Artificial Sequence
  Synthetic Polynucleotide
taatacgactcactatagggcttcctcctcctcctcctcctcctcttcctaacagaggagaaggaagatgaggaggaggaacctggcggcagcgcaaaagatg

SEQ ID NO: 163296 - DNA, 103 bp, Artificial Sequence
  Synthetic Polynucleotide
taatacgactcactatagggtcttcttcctcttcctcctcctcctcctccaacagaggagaggaggaatgggaggaggaaacctggcggcagcgcaaaagatg

SEQ ID NO: 163297 - DNA, 103 bp, Artificial Sequence
  Synthetic Polynucleotide
taatacgactcactataggggtcttcgttttcttcttcctcttcctcctcaacagaggagagaggagatggaggaagaaaacctggcggcagcgcaaaagatg

SEQ ID NO: 163298 - DNA, 103 bp, Artificial Sequence
  Synthetic Polynucleotide
taatacgactcactatagggctggttccacgggaactcgaacccctttggaacagaggagaccaaagatgttcgagttcaacctggcggcagcgcaaaagatg

SEQ ID NO: 163299 - DNA, 103 bp, Artificial Sequence
  Synthetic Polynucleotide
taatacgactcactatagggtcatttgatggtcttcgttttcttcttcctaacagaggagaaggaagatgaaaacgaagaacctggcggcagcgcaaaagatg

SEQ ID NO: 163300 - DNA, 103 bp, Artificial Sequence
  Synthetic Polynucleotide
taatacgactcactatagggttgtgacaattcatttgatggtcttcgtttaacagaggagaaaacgaatgccatcaaataacctggcggcagcgcaaaagatg

SEQ ID NO: 163301 - DNA, 103 bp, Artificial Sequence
  Synthetic Polynucleotide
taatacgactcactatagggtattcgagtattgtgacaattcatttgatgaacagaggagacatcaaatgaattgtcacaacctggcggcagcgcaaaagatg

SEQ ID NO: 163302 - DNA, 103 bp, Artificial Sequence
  Synthetic Polynucleotide
taatacgactcactatagggtgtcttgcattattcgagtattgtgacaataacagaggagaattgtcatgatactcgaaaacctggcggcagcgcaaaagatg

SEQ ID NO: 163303 - DNA, 103 bp, Artificial Sequence
  Synthetic Polynucleotide
taatacgactcactatagggtccttttctgtgtcttgcattattcgagtaaacagaggagatactcgatgaatgcaagaaacctggcggcagcgcaaaagatg

SEQ ID NO: 163304 - DNA, 103 bp, Artificial Sequence
  Synthetic Polynucleotide
taatacgactcactatagggattgttatcatccttttctgtgtcttgcataacagaggagaatgcaaatgacagaaaagaacctggcggcagcgcaaaagatg

SEQ ID NO: 163305 - DNA, 103 bp, Artificial Sequence
  Synthetic Polynucleotide
taatacgactcactatagggattcgtcattattgttatcatccttttctgaacagaggagacagaaaatgatgataacaaacctggcggcagcgcaaaagatg

SEQ ID NO: 163306 - DNA, 103 bp, Artificial Sequence
  Synthetic Polynucleotide
taatacgactcactatagggtaattgtcatattcgtcattattgttatcaaacagaggagatgataaatgtaatgacgaaacctggcggcagcgcaaaagatg

SEQ ID NO: 163307 - DNA, 103 bp, Artificial Sequence
  Synthetic Polynucleotide
taatacgactcactatagggcagttcatcgtaattgtcatattcgtcattaacagaggagaaatgacatgtatgacaataacctggcggcagcgcaaaagatg

SEQ ID NO: 163308 - DNA, 103 bp, Artificial Sequence
  Synthetic Polynucleotide
taatacgactcactatagggacttggccaccagttcatcgtaattgtcataacagaggagaatgacaatgacgatgaacaacctggcggcagcgcaaaagatg

SEQ ID NO: 163309 - DNA, 103 bp, Artificial Sequence
  Synthetic Polynucleotide
taatacgactcactatagggtcttgtatggctggttccacgggaactcgaaacagaggagatcgagtatgcgtggaaccaacctggcggcagcgcaaaagatg

SEQ ID NO: 163310 - DNA, 103 bp, Artificial Sequence
  Synthetic Polynucleotide
taatacgactcactatagggtttaacaatgacttggccaccagttcatcgaacagaggagacgatgaatgggtggccaaaacctggcggcagcgcaaaagatg

SEQ ID NO: 163311 - DNA, 103 bp, Artificial Sequence
  Synthetic Polynucleotide
taatacgactcactatagggtttgccgaggtttaacaatgacttggccacaacagaggagagtggccatgtcattgttaaacctggcggcagcgcaaaagatg

SEQ ID NO: 163312 - DNA, 103 bp, Artificial Sequence
  Synthetic Polynucleotide
taatacgactcactatagggcctcagcgattttgccgaggtttaacaatgaacagaggagacattgtatgacctcggcaaacctggcggcagcgcaaaagatg

SEQ ID NO: 163313 - DNA, 103 bp, Artificial Sequence
  Synthetic Polynucleotide
taatacgactcactatagggtaggctgcatcctcagcgattttgccgaggaacagaggagacctcggatgaatcgctgaaacctggcggcagcgcaaaagatg

SEQ ID NO: 163314 - DNA, 103 bp, Artificial Sequence
  Synthetic Polynucleotide
taatacgactcactatagggcctggcccggtaggctgcatcctcagcgataacagaggagaatcgctatggatgcagccaacctggcggcagcgcaaaagatg

SEQ ID NO: 163315 - DNA, 103 bp, Artificial Sequence
  Synthetic Polynucleotide
taatacgactcactatagggctgactcagtcctggcccggtaggctgcataacagaggagaatgcagatgaccgggccaaacctggcggcagcgcaaaagatg

SEQ ID NO: 163316 - DNA, 103 bp, Artificial Sequence
  Synthetic Polynucleotide
taatacgactcactatagggctgttcatttctgactcagtcctggcccggaacagaggagaccgggcatggactgagtcaacctggcggcagcgcaaaagatg

SEQ ID NO: 163317 - DNA, 103 bp, Artificial Sequence
  Synthetic Polynucleotide
taatacgactcactatagggggaggtattgctgttcatttctgactcagtaacagaggagaactgagatggaaatgaacaacctggcggcagcgcaaaagatg

SEQ ID NO: 163318 - DNA, 103 bp, Artificial Sequence
  Synthetic Polynucleotide
taatacgactcactatagggccagactattggaggtattgctgttcatttaacagaggagaaaatgaatggcaatacctaacctggcggcagcgcaaaagatg

SEQ ID NO: 163319 - DNA, 103 bp, Artificial Sequence
  Synthetic Polynucleotide
taatacgactcactatagggctatcgtcttccagactattggaggtattgaacagaggagacaatacatgcaatagtctaacctggcggcagcgcaaaagatg

SEQ ID NO: 163320 - DNA, 103 bp, Artificial Sequence
  Synthetic Polynucleotide
taatacgactcactataggggctgaacagctcttgtatggctggttccacaacagaggagagtggaaatggccatacaaaacctggcggcagcgcaaaagatg

SEQ ID NO: 163321 - DNA, 103 bp, Artificial Sequence
  Synthetic Polynucleotide
taatacgactcactataggggtttttgtcactatcgtcttccagactattaacagaggagaaatagtatggaagacgataacctggcggcagcgcaaaagatg

SEQ ID NO: 163322 - DNA, 103 bp, Artificial Sequence
  Synthetic Polynucleotide
taatacgactcactatagggccaggttttcgtttttgtcactatcgtcttaacagaggagaaagacgatggtgacaaaaaacctggcggcagcgcaaaagatg

SEQ ID NO: 163323 - DNA, 103 bp, Artificial Sequence
  Synthetic Polynucleotide
taatacgactcactatagggcttttccgacccaggttttcgtttttgtcaaacagaggagatgacaaatgcgaaaacctaacctggcggcagcgcaaaagatg

SEQ ID NO: 163324 - DNA, 103 bp, Artificial Sequence
  Synthetic Polynucleotide
taatacgactcactatagggactcaactcacttttccgacccaggttttcaacagaggagagaaaacatgggtcggaaaaacctggcggcagcgcaaaagatg

SEQ ID NO: 163325 - DNA, 103 bp, Artificial Sequence
  Synthetic Polynucleotide
taatacgactcactatagggctaagtctaaactcaactcacttttccgacaacagaggagagtcggaatggtgagttgaaacctggcggcagcgcaaaagatg

SEQ ID NO: 163326 - DNA, 103 bp, Artificial Sequence
  Synthetic Polynucleotide
taatacgactcactatagggacatcactgtctaagtctaaactcaactcaaacagaggagatgagttatgtttagacttaacctggcggcagcgcaaaagatg

SEQ ID NO: 163327 - DNA, 103 bp, Artificial Sequence
  Synthetic Polynucleotide
taatacgactcactatagggttctctaacaacatcactgtctaagtctaaaacagaggagattagacatggacagtgataacctggcggcagcgcaaaagatg

SEQ ID NO: 163328 - DNA, 103 bp, Artificial Sequence
  Synthetic Polynucleotide
taatacgactcactatagggagtccactgtttctctaacaacatcactgtaacagaggagaacagtgatgttgttagagaacctggcggcagcgcaaaagatg

SEQ ID NO: 163329 - DNA, 103 bp, Artificial Sequence
  Synthetic Polynucleotide
taatacgactcactatagggagtttaagggagtccactgtttctctaacaaacagaggagatgttagatgaacagtggaaacctggcggcagcgcaaaagatg

SEQ ID NO: 163330 - DNA, 103 bp, Artificial Sequence
  Synthetic Polynucleotide
taatacgactcactatagggttgggctaatagtttaagggagtccactgtaacagaggagaacagtgatgtcccttaaaaacctggcggcagcgcaaaagatg

SEQ ID NO: 163331 - DNA, 103 bp, Artificial Sequence
  Synthetic Polynucleotide
taatacgactcactataggggggtgggacagctgaacagctcttgtatggaacagaggagaccatacatgagctgttcaaacctggcggcagcgcaaaagatg

SEQ ID NO: 163332 - DNA, 103 bp, Artificial Sequence
  Synthetic Polynucleotide
taatacgactcactatagggcaccgtgtccttgggctaatagtttaagggaacagaggagacccttaatgtattagcccaacctggcggcagcgcaaaagatg

SEQ ID NO: 163333 - DNA, 103 bp, Artificial Sequence
  Synthetic Polynucleotide
taatacgactcactataggggagagcacaacaccgtgtccttgggctaataacagaggagaattagcatgaggacacggaacctggcggcagcgcaaaagatg

SEQ ID NO: 163334 - DNA, 103 bp, Artificial Sequence
  Synthetic Polynucleotide
taatacgactcactatagggcatgttttctgagagcacaacaccgtgtccaacagaggagaggacacatggttgtgctcaacctggcggcagcgcaaaagatg

SEQ ID NO: 163335 - DNA, 103 bp, Artificial Sequence
  Synthetic Polynucleotide
taatacgactcactatagggttctgtcattcatgttttctgagagcacaaaacagaggagattgtgcatgcagaaaacaaacctggcggcagcgcaaaagatg

SEQ ID NO: 163336 - DNA, 103 bp, Artificial Sequence
  Synthetic Polynucleotide
taatacgactcactatagggtctgcataatttctgtcattcatgttttctaacagaggagaagaaaaatggaatgacagaacctggcggcagcgcaaaagatg

SEQ ID NO: 163337 - DNA, 103 bp, Artificial Sequence
  Synthetic Polynucleotide
taatacgactcactatagggcgacatgctgtctgcataatttctgtcattaacagaggagaaatgacatgaattatgcaaacctggcggcagcgcaaaagatg

SEQ ID NO: 163338 - DNA, 103 bp, Artificial Sequence
  Synthetic Polynucleotide
taatacgactcactatagggtgtcttgctgcgacatgctgtctgcataataacagaggagaattatgatgacagcatgtaacctggcggcagcgcaaaagatg

SEQ ID NO: 163339 - DNA, 103 bp, Artificial Sequence
  Synthetic Polynucleotide
taatacgactcactatagggatatttctactgtcttgctgcgacatgctgaacagaggagacagcatatggcagcaagaaacctggcggcagcgcaaaagatg

SEQ ID NO: 163340 - DNA, 103 bp, Artificial Sequence
  Synthetic Polynucleotide
taatacgactcactataggggacgtaattcatatttctactgtcttgctgaacagaggagacagcaaatgagtagaaataacctggcggcagcgcaaaagatg

SEQ ID NO: 163341 - DNA, 103 bp, Artificial Sequence
  Synthetic Polynucleotide
taatacgactcactatagggtccccaacatgacgtaattcatatttctacaacagaggagagtagaaatgtgaattacgaacctggcggcagcgcaaaagatg

SEQ ID NO: 163342 - DNA, 103 bp, Artificial Sequence
  Synthetic Polynucleotide
taatacgactcactatagggtcacagccaggggtgggacagctgaacagcaacagaggagagctgttatgctgtcccacaacctggcggcagcgcaaaagatg

SEQ ID NO: 163343 - DNA, 103 bp, Artificial Sequence
  Synthetic Polynucleotide
taatacgactcactatagggttcatgggcttccccaacatgacgtaattcaacagaggagagaattaatgcatgttgggaacctggcggcagcgcaaaagatg

SEQ ID NO: 163344 - DNA, 103 bp, Artificial Sequence
  Synthetic Polynucleotide
taatacgactcactataggggagtccgttgttcatgggcttccccaacataacagaggagaatgttgatgaagcccatgaacctggcggcagcgcaaaagatg

SEQ ID NO: 163345 - DNA, 103 bp, Artificial Sequence
  Synthetic Polynucleotide
taatacgactcactatagggtcttttccatgagtccgttgttcatgggctaacagaggagaagcccaatgacaacggacaacctggcggcagcgcaaaagatg

SEQ ID NO: 163346 - DNA, 103 bp, Artificial Sequence
  Synthetic Polynucleotide
taatacgactcactatagggtcctccaccatcttttccatgagtccgttgaacagaggagacaacggatgcatggaaaaaacctggcggcagcgcaaaagatg

SEQ ID NO: 163347 - DNA, 103 bp, Artificial Sequence
  Synthetic Polynucleotide
taatacgactcactatagggctcatcgctctcctccaccatcttttccataacagaggagaatggaaatgatggtggagaacctggcggcagcgcaaaagatg

SEQ ID NO: 163348 - DNA, 103 bp, Artificial Sequence
  Synthetic Polynucleotide
taatacgactcactataggggacacacctcctcatcgctctcctccaccaaacagaggagatggtggatgagagcgatgaacctggcggcagcgcaaaagatg

SEQ ID NO: 163349 - DNA, 103 bp, Artificial Sequence
  Synthetic Polynucleotide
taatacgactcactatagggagactgctcagacacacctcctcatcgctcaacagaggagagagcgaatgggaggtgtgaacctggcggcagcgcaaaagatg

SEQ ID NO: 163350 - DNA, 103 bp, Artificial Sequence
  Synthetic Polynucleotide
taatacgactcactatagggcaaacactccagactgctcagacacacctcaacagaggagagaggtgatgctgagcagtaacctggcggcagcgcaaaagatg

SEQ ID NO: 163351 - DNA, 103 bp, Artificial Sequence
  Synthetic Polynucleotide
taatacgactcactatagggactgattcctcaaacactccagactgctcaaacagaggagatgagcaatgtggagtgttaacctggcggcagcgcaaaagatg

SEQ ID NO: 163352 - DNA, 103 bp, Artificial Sequence
  Synthetic Polynucleotide
taatacgactcactatagggaggtcgaagcactgattcctcaaacactccaacagaggagaggagtgatggaggaatcaaacctggcggcagcgcaaaagatg

SEQ ID NO: 163353 - DNA, 103 bp, Artificial Sequence
  Synthetic Polynucleotide
taatacgactcactataggggtctggggagcccagcaccgcaggcctcataacagaggagaatgaggatggcggtgctgaacctggcggcagcgcaaaagatg

SEQ ID NO: 163354 - DNA, 103 bp, Artificial Sequence
  Synthetic Polynucleotide
taatacgactcactatagggagggcctgggtcccataaggcagcctcaccaacagaggagaggtgagatggccttatggaacctggcggcagcgcaaaagatg

SEQ ID NO: 163355 - DNA, 103 bp, Artificial Sequence
  Synthetic Polynucleotide
taatacgactcactataggggcccctgggggagcgccagcgggtggtgataacagaggagaatcaccatgcgctggcgcaacctggcggcagcgcaaaagatg

SEQ ID NO: 163356 - DNA, 103 bp, Artificial Sequence
  Synthetic Polynucleotide
taatacgactcactatagggcccggctccggcccctgggggagcgccagcaacagaggagagctggcatgcccccagggaacctggcggcagcgcaaaagatg

SEQ ID NO: 163357 - DNA, 103 bp, Artificial Sequence
  Synthetic Polynucleotide
taatacgactcactatagggctggggcggccccggctccggcccctggggaacagaggagaccccagatgccggagccgaacctggcggcagcgcaaaagatg

SEQ ID NO: 163358 - DNA, 103 bp, Artificial Sequence
  Synthetic Polynucleotide
taatacgactcactataggggcccccagtgctggggcggccccggctccgaacagaggagacggagcatgggccgccccaacctggcggcagcgcaaaagatg

SEQ ID NO: 163359 - DNA, 103 bp, Artificial Sequence
  Synthetic Polynucleotide
taatacgactcactatagggtaaccaccccgcccccagtgctggggcggcaacagaggagagccgccatggcactggggaacctggcggcagcgcaaaagatg

SEQ ID NO: 163360 - DNA, 103 bp, Artificial Sequence
  Synthetic Polynucleotide
taatacgactcactatagggcggccgcccctaaccaccccgcccccagtgaacagaggagacactggatgcggggtggtaacctggcggcagcgcaaaagatg

SEQ ID NO: 163361 - DNA, 103 bp, Artificial Sequence
  Synthetic Polynucleotide
taatacgactcactatagggtacatcgcaacggccgcccctaaccaccccaacagaggagaggggtgatgaggggcggcaacctggcggcagcgcaaaagatg

SEQ ID NO: 163362 - DNA, 103 bp, Artificial Sequence
  Synthetic Polynucleotide
taatacgactcactatagggccttgccacatacatcgcaacggccgccccaacagaggagaggggcgatggttgcgatgaacctggcggcagcgcaaaagatg

SEQ ID NO: 163363 - DNA, 103 bp, Artificial Sequence
  Synthetic Polynucleotide
taatacgactcactatagggtggctgaacaccttgccacatacatcgcaaaacagaggagattgcgaatgatgtggcaaaacctggcggcagcgcaaaagatg

SEQ ID NO: 163364 - DNA, 103 bp, Artificial Sequence
  Synthetic Polynucleotide
taatacgactcactataggggttgctgcgttggctgaacaccttgccacaaacagaggagatgtggcatggtgttcagcaacctggcggcagcgcaaaagatg

SEQ ID NO: 163365 - DNA, 103 bp, Artificial Sequence
  Synthetic Polynucleotide
taatacgactcactataggggtgcagcttcagggcctgggtcccataaggaacagaggagaccttatatgacccaggccaacctggcggcagcgcaaaagatg

SEQ ID NO: 163366 - DNA, 103 bp, Artificial Sequence
  Synthetic Polynucleotide
taatacgactcactataggggcctcagcaggttgctgcgttggctgaacaaacagaggagatgttcaatgaacgcagcaaacctggcggcagcgcaaaagatg

SEQ ID NO: 163367 - DNA, 103 bp, Artificial Sequence
  Synthetic Polynucleotide
taatacgactcactatagggatcttctggtgcctcagcaggttgctgcgtaacagaggagaacgcagatgcctgctgagaacctggcggcagcgcaaaagatg

SEQ ID NO: 163368 - DNA, 103 bp, Artificial Sequence
  Synthetic Polynucleotide
taatacgactcactatagggacccgtgtggatcttctggtgcctcagcagaacagaggagactgctgatgcaccagaagaacctggcggcagcgcaaaagatg

SEQ ID NO: 163369 - DNA, 103 bp, Artificial Sequence
  Synthetic Polynucleotide
taatacgactcactatagggatggtcgctcacccgtgtggatcttctggtaacagaggagaaccagaatgtccacacggaacctggcggcagcgcaaaagatg

SEQ ID NO: 163370 - DNA, 103 bp, Artificial Sequence
  Synthetic Polynucleotide
taatacgactcactatagggctgcacacgaatggtcgctcacccgtgtggaacagaggagaccacacatgtgagcgaccaacctggcggcagcgcaaaagatg

SEQ ID NO: 163371 - DNA, 103 bp, Artificial Sequence
  Synthetic Polynucleotide
taatacgactcactataggggccgcactcgctgcacacgaatggtcgctcaacagaggagagagcgaatgttcgtgtgcaacctggcggcagcgcaaaagatg

SEQ ID NO: 163372 - DNA, 103 bp, Artificial Sequence
  Synthetic Polynucleotide
taatacgactcactatagggtgaagctgcggccgcactcgctgcacacgaaacagaggagatcgtgtatggcgagtgcgaacctggcggcagcgcaaaagatg

SEQ ID NO: 163373 - DNA, 103 bp, Artificial Sequence
  Synthetic Polynucleotide
taatacgactcactataggggagctgcggctgaagctgcggccgcactcgaacagaggagacgagtgatgccgcagcttaacctggcggcagcgcaaaagatg

SEQ ID NO: 163374 - DNA, 103 bp, Artificial Sequence
  Synthetic Polynucleotide
taatacgactcactatagggcagcaggtgcgagctgcggctgaagctgcgaacagaggagacgcagcatgagccgcagcaacctggcggcagcgcaaaagatg

SEQ ID NO: 163375 - DNA, 103 bp, Artificial Sequence
  Synthetic Polynucleotide
taatacgactcactataggggctggtggcgcagcaggtgcgagctgcggcaacagaggagagccgcaatgcgcacctgcaacctggcggcagcgcaaaagatg

SEQ ID NO: 163376 - DNA, 103 bp, Artificial Sequence
  Synthetic Polynucleotide
taatacgactcactatagggaaacgcaggcgtgcagcttcagggcctgggaacagaggagacccaggatgtgaagctgcaacctggcggcagcgcaaaagatg

SEQ ID NO: 163377 - DNA, 103 bp, Artificial Sequence
  Synthetic Polynucleotide
taatacgactcactataggggtgtgcgtaagctggtggcgcagcaggtgcaacagaggagagcacctatggcgccaccaaacctggcggcagcgcaaaagatg

SEQ ID NO: 163378 - DNA, 103 bp, Artificial Sequence
  Synthetic Polynucleotide
taatacgactcactatagggccgctcctcggtgtgcgtaagctggtggcgaacagaggagacgccacatgcttacgcacaacctggcggcagcgcaaaagatg

SEQ ID NO: 163379 - DNA, 103 bp, Artificial Sequence
  Synthetic Polynucleotide
taatacgactcactatagggacacgaacggccgctcctcggtgtgcgtaaaacagaggagattacgcatgccgaggagcaacctggcggcagcgcaaaagatg

SEQ ID NO: 163380 - DNA, 103 bp, Artificial Sequence
  Synthetic Polynucleotide
taatacgactcactatagggcagtcgccgcacacgaacggccgctcctcgaacagaggagacgaggaatggccgttcgtaacctggcggcagcgcaaaagatg

SEQ ID NO: 163381 - DNA, 103 bp, Artificial Sequence
  Synthetic Polynucleotide
taatacgactcactataggggccctggccacagtcgccgcacacgaacggaacagaggagaccgttcatgtgcggcgacaacctggcggcagcgcaaaagatg

SEQ ID NO: 163382 - DNA, 103 bp, Artificial Sequence
  Synthetic Polynucleotide
taatacgactcactatagggtgcgcacgaagccctggccacagtcgccgcaacagaggagagcggcgatggtggccaggaacctggcggcagcgcaaaagatg

SEQ ID NO: 163383 - DNA, 103 bp, Artificial Sequence
  Synthetic Polynucleotide
taatacgactcactatagggaggcgcgcgctgcgcacgaagccctggccaaacagaggagatggccaatgcttcgtgcgaacctggcggcagcgcaaaagatg

SEQ ID NO: 163384 - DNA, 103 bp, Artificial Sequence
  Synthetic Polynucleotide
taatacgactcactatagggatgctcttccaggcgcgcgctgcgcacgaaaacagaggagattcgtgatgagcgcgcgcaacctggcggcagcgcaaaagatg

SEQ ID NO: 163385 - DNA, 103 bp, Artificial Sequence
  Synthetic Polynucleotide
taatacgactcactataggggcactctccgatgctcttccaggcgcgcgcaacagaggagagcgcgcatgtggaagagcaacctggcggcagcgcaaaagatg

SEQ ID NO: 163386 - DNA, 103 bp, Artificial Sequence
  Synthetic Polynucleotide
taatacgactcactatagggtcgcccgtgtgcactctccgatgctcttccaacagaggagaggaagaatgtcggagagtaacctggcggcagcgcaaaagatg

SEQ ID NO: 163387 - DNA, 103 bp, Artificial Sequence
  Synthetic Polynucleotide
taatacgactcactataggggaagcaccggaaacgcaggcgtgcagcttcaacagaggagagaagctatgcgcctgcgtaacctggcggcagcgcaaaagatg

SEQ ID NO: 163388 - DNA, 103 bp, Artificial Sequence
  Synthetic Polynucleotide
taatacgactcactataggggaaaggctgttcgcccgtgtgcactctccgaacagaggagacggagaatgcacacgggcaacctggcggcagcgcaaaagatg

SEQ ID NO: 163389 - DNA, 103 bp, Artificial Sequence
  Synthetic Polynucleotide
taatacgactcactatagggcagcgcaacggaaaggctgttcgcccgtgtaacagaggagaacacggatgaacagccttaacctggcggcagcgcaaaagatg

SEQ ID NO: 163390 - DNA, 103 bp, Artificial Sequence
  Synthetic Polynucleotide
taatacgactcactatagggtggccgcactcagcgcaacggaaaggctgtaacagaggagaacagccatgccgttgcgcaacctggcggcagcgcaaaagatg

SEQ ID NO: 163391 - DNA, 103 bp, Artificial Sequence
  Synthetic Polynucleotide
taatacgactcactatagggccggaagctctggccgcactcagcgcaacgaacagaggagacgttgcatggagtgcggcaacctggcggcagcgcaaaagatg

SEQ ID NO: 163392 - DNA, 103 bp, Artificial Sequence
  Synthetic Polynucleotide
taatacgactcactatagggtggagcgctgccggaagctctggccgcactaacagaggagaagtgcgatgagagcttccaacctggcggcagcgcaaaagatg

SEQ ID NO: 163393 - DNA, 103 bp, Artificial Sequence
  Synthetic Polynucleotide
taatacgactcactatagggtgcagcagattggagcgctgccggaagctcaacagaggagagagcttatggcagcgctcaacctggcggcagcgcaaaagatg

SEQ ID NO: 163394 - DNA, 103 bp, Artificial Sequence
  Synthetic Polynucleotide
taatacgactcactataggggcgctggtgctgcagcagattggagcgctgaacagaggagacagcgcatgaatctgctgaacctggcggcagcgcaaaagatg

SEQ ID NO: 163395 - DNA, 103 bp, Artificial Sequence
  Synthetic Polynucleotide
taatacgactcactatagggcgccgtggatgcgctggtgctgcagcagataacagaggagaatctgcatgagcaccagcaacctggcggcagcgcaaaagatg

SEQ ID NO: 163396 - DNA, 103 bp, Artificial Sequence
  Synthetic Polynucleotide
taatacgactcactatagggcccgggggatcgccgtggatgcgctggtgcaacagaggagagcaccaatgcatccacggaacctggcggcagcgcaaaagatg

SEQ ID NO: 163397 - DNA, 103 bp, Artificial Sequence
  Synthetic Polynucleotide
taatacgactcactatagggagcgccagggcccgggggatcgccgtggataacagaggagaatccacatggatcccccgaacctggcggcagcgcaaaagatg

SEQ ID NO: 163398 - DNA, 103 bp, Artificial Sequence
  Synthetic Polynucleotide
taatacgactcactatagggcctcatagcggaagcaccggaaacgcaggcaacagaggagagcctgcatgtccggtgctaacctggcggcagcgcaaaagatg

SEQ ID NO: 163399 - DNA, 103 bp, Artificial Sequence
  Synthetic Polynucleotide
taatacgactcactatagggccgggggcttagcgccagggcccgggggataacagaggagaatccccatggccctggcgaacctggcggcagcgcaaaagatg

SEQ ID NO: 163400 - DNA, 103 bp, Artificial Sequence
  Synthetic Polynucleotide
taatacgactcactatagggccaggaggggccgggggcttagcgccagggaacagaggagaccctggatgtaagcccccaacctggcggcagcgcaaaagatg

SEQ ID NO: 163401 - DNA, 103 bp, Artificial Sequence
  Synthetic Polynucleotide
taatacgactcactatagggctcgggcgcaccaggaggggccgggggcttaacagaggagaaagcccatggcccctcctaacctggcggcagcgcaaaagatg

SEQ ID NO: 163402 - DNA, 103 bp, Artificial Sequence
  Synthetic Polynucleotide
taatacgactcactatagggggccgggaggctcgggcgcaccaggaggggaacagaggagacccctcatggtgcgcccgaacctggcggcagcgcaaaagatg

SEQ ID NO: 163403 - DNA, 103 bp, Artificial Sequence
  Synthetic Polynucleotide
taatacgactcactatagggcacggaaaggggccgggaggctcgggcgcaaacagaggagatgcgccatggcctcccggaacctggcggcagcgcaaaagatg

SEQ ID NO: 163404 - DNA, 103 bp, Artificial Sequence
  Synthetic Polynucleotide
taatacgactcactataggggcactcgctgcacggaaaggggccgggaggaacagaggagacctcccatgccctttccgaacctggcggcagcgcaaaagatg

SEQ ID NO: 163405 - DNA, 103 bp, Artificial Sequence
  Synthetic Polynucleotide
taatacgactcactatagggagctctcgcggcactcgctgcacggaaaggaacagaggagacctttcatggcagcgagtaacctggcggcagcgcaaaagatg

SEQ ID NO: 163406 - DNA, 103 bp, Artificial Sequence
  Synthetic Polynucleotide
taatacgactcactatagggcgccgcgcgaagctctcgcggcactcgctgaacagaggagacagcgaatgccgcgagagaacctggcggcagcgcaaaagatg

SEQ ID NO: 163407 - DNA, 103 bp, Artificial Sequence
  Synthetic Polynucleotide
taatacgactcactatagggcagcacggcgcgccgcgcgaagctctcgcgaacagaggagacgcgagatgttcgcgcggaacctggcggcagcgcaaaagatg

SEQ ID NO: 163408 - DNA, 103 bp, Artificial Sequence
  Synthetic Polynucleotide
taatacgactcactatagggggtgctccagcagcacggcgcgccgcgcgaaacagaggagatcgcgcatggcgccgtgcaacctggcggcagcgcaaaagatg

SEQ ID NO: 163409 - DNA, 103 bp, Artificial Sequence
  Synthetic Polynucleotide
taatacgactcactatagggcctgtggcctcctcatagcggaagcaccggaacagaggagaccggtgatgccgctatgaaacctggcggcagcgcaaaagatg

SEQ ID NO: 163410 - DNA, 103 bp, Artificial Sequence
  Synthetic Polynucleotide
taatacgactcactatagggtgtaccgcctggtgctccagcagcacggcgaacagaggagacgccgtatggctggagcaaacctggcggcagcgcaaaagatg

SEQ ID NO: 163411 - DNA, 103 bp, Artificial Sequence
  Synthetic Polynucleotide
taatacgactcactataggggtcgcccgtgtgtaccgcctggtgctccagaacagaggagactggagatgcaggcggtaaacctggcggcagcgcaaaagatg

SEQ ID NO: 163412 - DNA, 103 bp, Artificial Sequence
  Synthetic Polynucleotide
taatacgactcactatagggcaaaggacttgtcgcccgtgtgtaccgcctaacagaggagaaggcggatgacacgggcgaacctggcggcagcgcaaaagatg

SEQ ID NO: 163413 - DNA, 103 bp, Artificial Sequence
  Synthetic Polynucleotide
taatacgactcactatagggtcgacgcagccaaaggacttgtcgcccgtgaacagaggagacacgggatgcaagtccttaacctggcggcagcgcaaaagatg

SEQ ID NO: 163414 - DNA, 103 bp, Artificial Sequence
  Synthetic Polynucleotide
taatacgactcactatagggctcgccgcactcgacgcagccaaaggacttaacagaggagaaagtccatgggctgcgtcaacctggcggcagcgcaaaagatg

SEQ ID NO: 163415 - DNA, 103 bp, Artificial Sequence
  Synthetic Polynucleotide
taatacgactcactatagggggccgaagcgctcgccgcactcgacgcagcaacagaggagagctgcgatgagtgcggcgaacctggcggcagcgcaaaagatg

SEQ ID NO: 163416 - DNA, 103 bp, Artificial Sequence
  Synthetic Polynucleotide
taatacgactcactatagggactgagcggcggccgaagcgctcgccgcacaacagaggagagtgcggatggcgcttcggaacctggcggcagcgcaaaagatg

SEQ ID NO: 163417 - DNA, 103 bp, Artificial Sequence
  Synthetic Polynucleotide
taatacgactcactatagggctgcagcagcactgagcggcggccgaagcgaacagaggagacgcttcatgcgccgctcaaacctggcggcagcgcaaaagatg

SEQ ID NO: 163418 - DNA, 103 bp, Artificial Sequence
  Synthetic Polynucleotide
taatacgactcactatagggcgcgccggtgctgcagcagcactgagcggcaacagaggagagccgctatgtgctgctgcaacctggcggcagcgcaaaagatg

SEQ ID NO: 163419 - DNA, 103 bp, Artificial Sequence
  Synthetic Polynucleotide
taatacgactcactatagggccactgtgcacgcgccggtgctgcagcagcaacagaggagagctgctatggcaccggcgaacctggcggcagcgcaaaagatg

SEQ ID NO: 163420 - DNA, 103 bp, Artificial Sequence
  Synthetic Polynucleotide
taatacgactcactatagggctcttggggccctgtggcctcctcatagcgaacagaggagacgctatatggaggccacaaacctggcggcagcgcaaaagatg

SEQ ID NO: 163421 - DNA, 103 bp, Artificial Sequence
  Synthetic Polynucleotide
taatacgactcactataggggggccgctcgccactgtgcacgcgccggtgaacagaggagacaccggatggtgcacagtaacctggcggcagcgcaaaagatg

SEQ ID NO: 163422 - DNA, 103 bp, Artificial Sequence
  Synthetic Polynucleotide
taatacgactcactatagggcacaggcgaagggccgctcgccactgtgcaaacagaggagatgcacaatggcgagcggcaacctggcggcagcgcaaaagatg

SEQ ID NO: 163423 - DNA, 103 bp, Artificial Sequence
  Synthetic Polynucleotide
taatacgactcactatagggccgcactcggcacaggcgaagggccgctcgaacagaggagacgagcgatgcttcgcctgaacctggcggcagcgcaaaagatg

SEQ ID NO: 163424 - DNA, 103 bp, Artificial Sequence
  Synthetic Polynucleotide
taatacgactcactataggggaagctctggccgcactcggcacaggcgaaaacagaggagattcgccatggccgagtgcaacctggcggcagcgcaaaagatg

SEQ ID NO: 163425 - DNA, 103 bp, Artificial Sequence
  Synthetic Polynucleotide
taatacgactcactatagggagcgctgccggaagctctggccgcactcggaacagaggagaccgagtatggccagagctaacctggcggcagcgcaaaagatg

SEQ ID NO: 163426 - DNA, 103 bp, Artificial Sequence
  Synthetic Polynucleotide
taatacgactcactataggggtcaggttggagcgctgccggaagctctggaacagaggagaccagagatgccggcagcgaacctggcggcagcgcaaaagatg

SEQ ID NO: 163427 - DNA, 103 bp, Artificial Sequence
  Synthetic Polynucleotide
taatacgactcactatagggccggtgctgcgtcaggttggagcgctgccgaacagaggagacggcagatgtccaacctgaacctggcggcagcgcaaaagatg

SEQ ID NO: 163428 - DNA, 103 bp, Artificial Sequence
  Synthetic Polynucleotide
taatacgactcactatagggtgtggatgcgccggtgctgcgtcaggttggaacagaggagaccaaccatgcgcagcaccaacctggcggcagcgcaaaagatg

SEQ ID NO: 163429 - DNA, 103 bp, Artificial Sequence
  Synthetic Polynucleotide
taatacgactcactatagggcgctccccggtgtggatgcgccggtgctgcaacagaggagagcagcaatggcgcatccaaacctggcggcagcgcaaaagatg

SEQ ID NO: 163430 - DNA, 103 bp, Artificial Sequence
  Synthetic Polynucleotide
taatacgactcactatagggggcgaagggccgctccccggtgtggatgcgaacagaggagacgcatcatgaccggggagaacctggcggcagcgcaaaagatg

SEQ ID NO: 163431 - DNA, 103 bp, Artificial Sequence
  Synthetic Polynucleotide
taatacgactcactataggggggccagggcctcttggggccctgtggcctaacagaggagaaggccaatgggccccaagaacctggcggcagcgcaaaagatg

SEQ ID NO: 163432 - DNA, 103 bp, Artificial Sequence
  Synthetic Polynucleotide
taatacgactcactatagggactcggcgcaggcgaagggccgctccccggaacagaggagaccggggatgggcccttcgaacctggcggcagcgcaaaagatg

SEQ ID NO: 163433 - DNA, 103 bp, Artificial Sequence
  Synthetic Polynucleotide
taatacgactcactataggggccttgccacactcggcgcaggcgaagggcaacagaggagagcccttatgctgcgccgaaacctggcggcagcgcaaaagatg

SEQ ID NO: 163434 - DNA, 103 bp, Artificial Sequence
  Synthetic Polynucleotide
taatacgactcactatagggctggcggaaggccttgccacactcggcgcaaacagaggagatgcgccatgtgtggcaagaacctggcggcagcgcaaaagatg

SEQ ID NO: 163435 - DNA, 103 bp, Artificial Sequence
  Synthetic Polynucleotide
taatacgactcactataggggcgtaggccgctggcggaaggccttgccacaacagaggagagtggcaatgccttccgccaacctggcggcagcgcaaaagatg

SEQ ID NO: 163436 - DNA, 103 bp, Artificial Sequence
  Synthetic Polynucleotide
taatacgactcactatagggtgctgcgtgagcgtaggccgctggcggaagaacagaggagacttccgatggcggcctacaacctggcggcagcgcaaaagatg

SEQ ID NO: 163437 - DNA, 103 bp, Artificial Sequence
  Synthetic Polynucleotide
taatacgactcactatagggtacgcggagatgctgcgtgagcgtaggccgaacagaggagacggcctatgctcacgcagaacctggcggcagcgcaaaagatg

SEQ ID NO: 163438 - DNA, 103 bp, Artificial Sequence
  Synthetic Polynucleotide
taatacgactcactatagggcgcccgtgtgtacgcggagatgctgcgtgaaacagaggagatcacgcatgatctccgcgaacctggcggcagcgcaaaagatg

SEQ ID NO: 163439 - DNA, 103 bp, Artificial Sequence
  Synthetic Polynucleotide
taatacgactcactatagggaagggtttctcgcccgtgtgtacgcggagaaacagaggagatctccgatgacacacgggaacctggcggcagcgcaaaagatg

SEQ ID NO: 163440 - DNA, 103 bp, Artificial Sequence
  Synthetic Polynucleotide
taatacgactcactatagggggggcaggcaaagggtttctcgcccgtgtgaacagaggagacacacgatggagaaacccaacctggcggcagcgcaaaagatg

SEQ ID NO: 163441 - DNA, 103 bp, Artificial Sequence
  Synthetic Polynucleotide
taatacgactcactatagggggccacactcggggcaggcaaagggtttctaacagaggagaagaaacatgttgcctgccaacctggcggcagcgcaaaagatg

SEQ ID NO: 163442 - DNA, 103 bp, Artificial Sequence
  Synthetic Polynucleotide
taatacgactcactatagggtctcggagctgggccagggcctcttggggcaacagaggagagccccaatgggccctggcaacctggcggcagcgcaaaagatg

SEQ ID NO: 163443 - DNA, 103 bp, Artificial Sequence
  Synthetic Polynucleotide
taatacgactcactatagggctgaagcgctggccacactcggggcaggcaaacagaggagatgcctgatgcgagtgtggaacctggcggcagcgcaaaagatg

SEQ ID NO: 163444 - DNA, 103 bp, Artificial Sequence
  Synthetic Polynucleotide
taatacgactcactataggggaggcgctggctgaagcgctggccacactcaacagaggagagagtgtatgcagcgcttcaacctggcggcagcgcaaaagatg

SEQ ID NO: 163445 - DNA, 103 bp, Artificial Sequence
  Synthetic Polynucleotide
taatacgactcactataggggcgtgagcttgaggcgctggctgaagcgctaacagaggagaagcgctatggccagcgccaacctggcggcagcgcaaaagatg

SEQ ID NO: 163446 - DNA, 103 bp, Artificial Sequence
  Synthetic Polynucleotide
taatacgactcactatagggctctgatgacgcgtgagcttgaggcgctggaacagaggagaccagcgatgcaagctcacaacctggcggcagcgcaaaagatg

SEQ ID NO: 163447 - DNA, 103 bp, Artificial Sequence
  Synthetic Polynucleotide
taatacgactcactatagggggtgtgtgtcctctgatgacgcgtgagcttaacagaggagaaagctcatgcgtcatcagaacctggcggcagcgcaaaagatg

SEQ ID NO: 163448 - DNA, 103 bp, Artificial Sequence
  Synthetic Polynucleotide
taatacgactcactataggggcttttcgccggtgtgtgtcctctgatgacaacagaggagagtcatcatgggacacacaaacctggcggcagcgcaaaagatg

SEQ ID NO: 163449 - DNA, 103 bp, Artificial Sequence
  Synthetic Polynucleotide
taatacgactcactatagggcagtggtagggcttttcgccggtgtgtgtcaacagaggagagacacaatgcggcgaaaaaacctggcggcagcgcaaaagatg

SEQ ID NO: 163450 - DNA, 103 bp, Artificial Sequence
  Synthetic Polynucleotide
taatacgactcactataggggcactcaccgcagtggtagggcttttcgccaacagaggagaggcgaaatgccctaccacaacctggcggcagcgcaaaagatg

SEQ ID NO: 163451 - DNA, 103 bp, Artificial Sequence
  Synthetic Polynucleotide
taatacgactcactatagggagcccaggccgcactcaccgcagtggtaggaacagaggagacctaccatggcggtgagtaacctggcggcagcgcaaaagatg

SEQ ID NO: 163452 - DNA, 103 bp, Artificial Sequence
  Synthetic Polynucleotide
taatacgactcactatagggacctgcgtgaagcccaggccgcactcaccgaacagaggagacggtgaatgcggcctgggaacctggcggcagcgcaaaagatg

SEQ ID NO: 163453 - DNA, 103 bp, Artificial Sequence
  Synthetic Polynucleotide
taatacgactcactataggggcgacacagctctcggagctgggccagggcaacagaggagagccctgatgcagctccgaaacctggcggcagcgcaaaagatg

SEQ ID NO: 163454 - DNA, 103 bp, Artificial Sequence
  Synthetic Polynucleotide
taatacgactcactataggggagccgcgagacctgcgtgaagcccaggccaacagaggagaggcctgatgttcacgcagaacctggcggcagcgcaaaagatg

SEQ ID NO: 163455 - DNA, 103 bp, Artificial Sequence
  Synthetic Polynucleotide
taatacgactcactatagggggtgctcggtgagccgcgagacctgcgtgaaacagaggagatcacgcatgtctcgcggcaacctggcggcagcgcaaaagatg

SEQ ID NO: 163456 - DNA, 103 bp, Artificial Sequence
  Synthetic Polynucleotide
taatacgactcactatagggtggatgcgctggtgctcggtgagccgcgagaacagaggagactcgcgatgcaccgagcaaacctggcggcagcgcaaaagatg

SEQ ID NO: 163457 - DNA, 103 bp, Artificial Sequence
  Synthetic Polynucleotide
taatacgactcactatagggttcgcccgtgtggatgcgctggtgctcggtaacagaggagaaccgagatgcagcgcatcaacctggcggcagcgcaaaagatg

SEQ ID NO: 163458 - DNA, 103 bp, Artificial Sequence
  Synthetic Polynucleotide
taatacgactcactatagggcgaagggccgttcgcccgtgtggatgcgctaacagaggagaagcgcaatgacacgggcgaacctggcggcagcgcaaaagatg

SEQ ID NO: 163459 - DNA, 103 bp, Artificial Sequence
  Synthetic Polynucleotide
taatacgactcactatagggtcggggcaggcgaagggccgttcgcccgtgaacagaggagacacgggatgacggcccttaacctggcggcagcgcaaaagatg

SEQ ID NO: 163460 - DNA, 103 bp, Artificial Sequence
  Synthetic Polynucleotide
taatacgactcactatagggctggccgcactcggggcaggcgaagggccgaacagaggagacggcccatggcctgccccaacctggcggcagcgcaaaagatg

SEQ ID NO: 163461 - DNA, 103 bp, Artificial Sequence
  Synthetic Polynucleotide
taatacgactcactataggggccgaaagctctggccgcactcggggcaggaacagaggagacctgccatgagtgcggccaacctggcggcagcgcaaaagatg

SEQ ID NO: 163462 - DNA, 103 bp, Artificial Sequence
  Synthetic Polynucleotide
taatacgactcactatagggttggcgtgctgccgaaagctctggccgcacaacagaggagagtgcggatggagctttcgaacctggcggcagcgcaaaagatg

SEQ ID NO: 163463 - DNA, 103 bp, Artificial Sequence
  Synthetic Polynucleotide
taatacgactcactatagggctgggtgaggttggcgtgctgccgaaagctaacagaggagaagctttatgcagcacgccaacctggcggcagcgcaaaagatg

SEQ ID NO: 163464 - DNA, 103 bp, Artificial Sequence
  Synthetic Polynucleotide
taatacgactcactatagggggggtgctcggtctggggagcccagcaccgaacagaggagacggtgcatggctccccagaacctggcggcagcgcaaaagatg

SEQ ID NO: 163465 - DNA, 103 bp, Artificial Sequence
  Synthetic Polynucleotide
taatacgactcactataggggcagccactggcgacacagctctcggagctaacagaggagaagctccatgagctgtgtcaacctggcggcagcgcaaaagatg

SEQ ID NO: 163466 - DNA, 103 bp, Artificial Sequence
  Synthetic Polynucleotide
taatacgactcactatagggtgcgccggtgctgggtgaggttggcgtgctaacagaggagaagcacgatgacctcacccaacctggcggcagcgcaaaagatg

SEQ ID NO: 163467 - DNA, 103 bp, Artificial Sequence
  Synthetic Polynucleotide
taatacgactcactatagggcccgtgtggatgcgccggtgctgggtgaggaacagaggagacctcacatggcaccggcgaacctggcggcagcgcaaaagatg

SEQ ID NO: 163468 - DNA, 103 bp, Artificial Sequence
  Synthetic Polynucleotide
taatacgactcactataggggggccgttcacccgtgtggatgcgccggtgaacagaggagacaccggatgatccacacgaacctggcggcagcgcaaaagatg

SEQ ID NO: 163469 - DNA, 103 bp, Artificial Sequence
  Synthetic Polynucleotide
taatacgactcactatagggggcatgcgtagggccgttcacccgtgtggaaacagaggagatccacaatggtgaacggcaacctggcggcagcgcaaaagatg

SEQ ID NO: 163470 - DNA, 103 bp, Artificial Sequence
  Synthetic Polynucleotide
taatacgactcactatagggccacactcagggcatgcgtagggccgttcaaacagaggagatgaacgatgctacgcatgaacctggcggcagcgcaaaagatg

SEQ ID NO: 163471 - DNA, 103 bp, Artificial Sequence
  Synthetic Polynucleotide
taatacgactcactataggggaaggccttgccacactcagggcatgcgtaaacagaggagatacgcaatgcctgagtgtaacctggcggcagcgcaaaagatg

SEQ ID NO: 163472 - DNA, 103 bp, Artificial Sequence
  Synthetic Polynucleotide
taatacgactcactataggggccgctggcggaaggccttgccacactcagaacagaggagactgagtatggcaaggcctaacctggcggcagcgcaaaagatg

SEQ ID NO: 163473 - DNA, 103 bp, Artificial Sequence
  Synthetic Polynucleotide
taatacgactcactataggggtgagcgtgggccgctggcggaaggccttgaacagaggagacaaggcatgccgccagcgaacctggcggcagcgcaaaagatg

SEQ ID NO: 163474 - DNA, 103 bp, Artificial Sequence
  Synthetic Polynucleotide
taatacgactcactatagggcagatgctgcgtgagcgtgggccgctggcgaacagaggagacgccagatgcccacgctcaacctggcggcagcgcaaaagatg

SEQ ID NO: 163475 - DNA, 103 bp, Artificial Sequence
  Synthetic Polynucleotide
taatacgactcactatagggggtgggtgcgcagatgctgcgtgagcgtggaacagaggagaccacgcatgcgcagcatcaacctggcggcagcgcaaaagatg

SEQ ID NO: 163476 - DNA, 103 bp, Artificial Sequence
  Synthetic Polynucleotide
taatacgactcactatagggacctctggacgcagccactggcgacacagcaacagaggagagctgtgatgccagtggctaacctggcggcagcgcaaaagatg

SEQ ID NO: 163477 - DNA, 103 bp, Artificial Sequence
  Synthetic Polynucleotide
taatacgactcactatagggttctctcgtcggtgggtgcgcagatgctgcaacagaggagagcagcaatggcgcacccaaacctggcggcagcgcaaaagatg

SEQ ID NO: 163478 - DNA, 103 bp, Artificial Sequence
  Synthetic Polynucleotide
taatacgactcactatagggggcgaagggcttctctcgtcggtgggtgcgaacagaggagacgcaccatgcgacgagagaacctggcggcagcgcaaaagatg

SEQ ID NO: 163479 - DNA, 103 bp, Artificial Sequence
  Synthetic Polynucleotide
taatacgactcactatagggagtcctggcaggcgaagggcttctctcgtcaacagaggagagacgagatgagcccttcgaacctggcggcagcgcaaaagatg

SEQ ID NO: 163480 - DNA, 103 bp, Artificial Sequence
  Synthetic Polynucleotide
taatacgactcactatagggcggcggccacagtcctggcaggcgaagggcaacagaggagagcccttatgctgccaggaaacctggcggcagcgcaaaagatg

SEQ ID NO: 163481 - DNA, 103 bp, Artificial Sequence
  Synthetic Polynucleotide
taatacgactcactatagggctggtggaagcggcggccacagtcctggcaaacagaggagatgccagatgtgtggccgcaacctggcggcagcgcaaaagatg

SEQ ID NO: 163482 - DNA, 103 bp, Artificial Sequence
  Synthetic Polynucleotide
taatacgactcactataggggcttggtgctctggtggaagcggcggccacaacagaggagagtggccatggcttccaccaacctggcggcagcgcaaaagatg

SEQ ID NO: 163483 - DNA, 103 bp, Artificial Sequence
  Synthetic Polynucleotide
taatacgactcactatagggtgctgaatgagcttggtgctctggtggaagaacagaggagacttccaatggagcaccaaaacctggcggcagcgcaaaagatg

SEQ ID NO: 163484 - DNA, 103 bp, Artificial Sequence
  Synthetic Polynucleotide
taatacgactcactataggggacgcgctggtgctgaatgagcttggtgctaacagaggagaagcaccatgctcattcagaacctggcggcagcgcaaaagatg

SEQ ID NO: 163485 - DNA, 103 bp, Artificial Sequence
  Synthetic Polynucleotide
taatacgactcactatagggcggcgctgtggacgcgctggtgctgaatgaaacagaggagatcattcatgaccagcgcgaacctggcggcagcgcaaaagatg

SEQ ID NO: 163486 - DNA, 103 bp, Artificial Sequence
  Synthetic Polynucleotide
taatacgactcactatagggcttggagcgtacctctggacgcagccactgaacagaggagacagtggatgcgtccagagaacctggcggcagcgcaaaagatg

SEQ ID NO: 163487 - DNA, 103 bp, Artificial Sequence
  Synthetic Polynucleotide
taatacgactcactataggggcatctgctccttggagcgtacctctggacaacagaggagagtccagatgtacgctccaaacctggcggcagcgcaaaagatg

SEQ ID NO: 163488 - DNA, 103 bp, Artificial Sequence
  Synthetic Polynucleotide
taatacgactcactatagggaacagctccagcatctgctccttggagcgtaacagaggagaacgctcatgggagcagataacctggcggcagcgcaaaagatg

SEQ ID NO: 163489 - DNA, 103 bp, Artificial Sequence
  Synthetic Polynucleotide
taatacgactcactatagggctccagcaccaacagctccagcatctgctcaacagaggagagagcagatgctggagctgaacctggcggcagcgcaaaagatg

SEQ ID NO: 163490 - DNA, 103 bp, Artificial Sequence
  Synthetic Polynucleotide
taatacgactcactatagggccaggaactgctccagcaccaacagctccaaacagaggagatggagcatgtggtgctggaacctggcggcagcgcaaaagatg

SEQ ID NO: 163491 - DNA, 103 bp, Artificial Sequence
  Synthetic Polynucleotide
taatacgactcactatagggggcagtgcgcccaggaactgctccagcaccaacagaggagaggtgctatggcagttcctaacctggcggcagcgcaaaagatg

SEQ ID NO: 163492 - DNA, 103 bp, Artificial Sequence
  Synthetic Polynucleotide
taatacgactcactataggggatctcagggggcagtgcgcccaggaactgaacagaggagacagttcatgggcgcactgaacctggcggcagcgcaaaagatg

SEQ ID NO: 163493 - DNA, 103 bp, Artificial Sequence
  Synthetic Polynucleotide
taatacgactcactatagggcacgggcctggatctcagggggcagtgcgcaacagaggagagcgcacatgcccctgagaaacctggcggcagcgcaaaagatg

SEQ ID NO: 163494 - DNA, 103 bp, Artificial Sequence
  Synthetic Polynucleotide
taatacgactcactatagggtcatcttctgggggtgctcggtctggggagaacagaggagactccccatgccgagcaccaacctggcggcagcgcaaaagatg

SEQ ID NO: 163495 - DNA, 103 bp, Artificial Sequence
  Synthetic Polynucleotide
taatacgactcactatagggtgcccctgcacacgggcctggatctcagggaacagaggagaccctgaatgccaggcccgaacctggcggcagcgcaaaagatg

SEQ ID NO: 163496 - DNA, 103 bp, Artificial Sequence
  Synthetic Polynucleotide
taatacgactcactataggggcctggccgctgcccctgcacacgggcctgaacagaggagacaggccatggtgcaggggaacctggcggcagcgcaaaagatg

SEQ ID NO: 163497 - DNA, 103 bp, Artificial Sequence
  Synthetic Polynucleotide
taatacgactcactatagggcctcggggctgcctggccgctgcccctgcaaacagaggagatgcaggatgagcggccagaacctggcggcagcgcaaaagatg

SEQ ID NO: 163498 - DNA, 103 bp, Artificial Sequence
  Synthetic Polynucleotide
taatacgactcactataggggcagcagcctcctcggggctgcctggccgcaacagaggagagcggccatgcagccccgaaacctggcggcagcgcaaaagatg

SEQ ID NO: 163499 - DNA, 103 bp, Artificial Sequence
  Synthetic Polynucleotide
taatacgactcactatagggatctactagggcagcagcctcctcggggctaacagaggagaagccccatggaggctgctaacctggcggcagcgcaaaagatg

SEQ ID NO: 163500 - DNA, 103 bp, Artificial Sequence
  Synthetic Polynucleotide
taatacgactcactatagggggcgcagcccatctactagggcagcagcctaacagaggagaaggctgatgccctagtagaacctggcggcagcgcaaaagatg

SEQ ID NO: 163501 - DNA, 103 bp, Artificial Sequence
  Synthetic Polynucleotide
taatacgactcactatagggcccggctcccggcgcagcccatctactaggaacagaggagacctagtatgtgggctgcgaacctggcggcagcgcaaaagatg

SEQ ID NO: 163502 - DNA, 103 bp, Artificial Sequence
  Synthetic Polynucleotide
taatacgactcactatagggccggggtccgcccggctcccggcgcagcccaacagaggagagggctgatgcgggagccgaacctggcggcagcgcaaaagatg

SEQ ID NO: 163503 - DNA, 103 bp, Artificial Sequence
  Synthetic Polynucleotide
taatacgactcactatagggtgacccatctccggggtccgcccggctcccaacagaggagagggagcatggcggaccccaacctggcggcagcgcaaaagatg

SEQ ID NO: 163504 - DNA, 103 bp, Artificial Sequence
  Synthetic Polynucleotide
taatacgactcactatagggacctggactgtgacccatctccggggtccgaacagaggagacggaccatggagatgggtaacctggcggcagcgcaaaagatg

SEQ ID NO: 163505 - DNA, 103 bp, Artificial Sequence
  Synthetic Polynucleotide
taatacgactcactataggggacaggcccctcatcttctgggggtgctcgaacagaggagacgagcaatgccagaagataacctggcggcagcgcaaaagatg

SEQ ID NO: 163506 - DNA, 103 bp, Artificial Sequence
  Synthetic Polynucleotide
taatacgactcactatagggctggccctgcacctggactgtgacccatctaacagaggagaagatggatgacagtccagaacctggcggcagcgcaaaagatg

SEQ ID NO: 163507 - DNA, 103 bp, Artificial Sequence
  Synthetic Polynucleotide
taatacgactcactatagggataggacctcctggccctgcacctggactgaacagaggagacagtccatgtgcagggccaacctggcggcagcgcaaaagatg

SEQ ID NO: 163508 - DNA, 103 bp, Artificial Sequence
  Synthetic Polynucleotide
taatacgactcactatagggatcttctctgataggacctcctggccctgcaacagaggagagcagggatgggaggtcctaacctggcggcagcgcaaaagatg

SEQ ID NO: 163509 - DNA, 103 bp, Artificial Sequence
  Synthetic Polynucleotide
taatacgactcactatagggggagggctccatcttctctgataggacctcaacagaggagagaggtcatgtcagagaagaacctggcggcagcgcaaaagatg

SEQ ID NO: 163510 - DNA, 103 bp, Artificial Sequence
  Synthetic Polynucleotide
taatacgactcactataggggctggaaactggagggctccatcttctctgaacagaggagacagagaatgtggagccctaacctggcggcagcgcaaaagatg

SEQ ID NO: 163511 - DNA, 103 bp, Artificial Sequence
  Synthetic Polynucleotide
taatacgactcactatagggtcaggtaggggctggaaactggagggctccaacagaggagaggagccatgcagtttccaaacctggcggcagcgcaaaagatg

SEQ ID NO: 163512 - DNA, 103 bp, Artificial Sequence
  Synthetic Polynucleotide
taatacgactcactatagggaggctcagtttcaggtaggggctggaaactaacagaggagaagtttcatgcccctacctaacctggcggcagcgcaaaagatg

SEQ ID NO: 163513 - DNA, 103 bp, Artificial Sequence
  Synthetic Polynucleotide
taatacgactcactatagggctggagttggaggctcagtttcaggtagggaacagaggagaccctacatgaaactgagcaacctggcggcagcgcaaaagatg

SEQ ID NO: 163514 - DNA, 103 bp, Artificial Sequence
  Synthetic Polynucleotide
taatacgactcactatagggggcccaggctctggagttggaggctcagttaacagaggagaaactgaatgtccaactccaacctggcggcagcgcaaaagatg

SEQ ID NO: 163515 - DNA, 103 bp, Artificial Sequence
  Synthetic Polynucleotide
taatacgactcactatagggaggtgtcttgggcccaggctctggagttggaacagaggagaccaactatggagcctgggaacctggcggcagcgcaaaagatg

SEQ ID NO: 163516 - DNA, 103 bp, Artificial Sequence
  Synthetic Polynucleotide
taatacgactcactataggggcttcaccatgacaggcccctcatcttctgaacagaggagacagaagatgaggggcctgaacctggcggcagcgcaaaagatg

SEQ ID NO: 163517 - DNA, 103 bp, Artificial Sequence
  Synthetic Polynucleotide
taatacgactcactatagggtagtcctaggaggtgtcttgggcccaggctaacagaggagaagcctgatgccaagacacaacctggcggcagcgcaaaagatg

SEQ ID NO: 163518 - DNA, 103 bp, Artificial Sequence
  Synthetic Polynucleotide
taatacgactcactataggggattcctgcatagtcctaggaggtgtcttgaacagaggagacaagacatgtcctaggacaacctggcggcagcgcaaaagatg

SEQ ID NO: 163519 - DNA, 103 bp, Artificial Sequence
  Synthetic Polynucleotide
taatacgactcactataggggcccagtggtgattcctgcatagtcctaggaacagaggagacctaggatgatgcaggaaaacctggcggcagcgcaaaagatg

SEQ ID NO: 163520 - DNA, 103 bp, Artificial Sequence
  Synthetic Polynucleotide
taatacgactcactatagggtcacctgcaggcccagtggtgattcctgcaaacagaggagatgcaggatgcaccactggaacctggcggcagcgcaaaagatg

SEQ ID NO: 163521 - DNA, 103 bp, Artificial Sequence
  Synthetic Polynucleotide
taatacgactcactataggggactcctctttcacctgcaggcccagtggtaacagaggagaaccactatgcctgcaggtaacctggcggcagcgcaaaagatg

SEQ ID NO: 163522 - DNA, 103 bp, Artificial Sequence
  Synthetic Polynucleotide
taatacgactcactatagggtgtaacctctgactcctctttcacctgcagaacagaggagactgcagatgaaagaggagaacctggcggcagcgcaaaagatg

SEQ ID NO: 163523 - DNA, 103 bp, Artificial Sequence
  Synthetic Polynucleotide
taatacgactcactatagggctgagtcctctgtaacctctgactcctcttaacagaggagaaagaggatgcagaggttaaacctggcggcagcgcaaaagatg

SEQ ID NO: 163524 - DNA, 103 bp, Artificial Sequence
  Synthetic Polynucleotide
taatacgactcactatagggtccaggaaatctgagtcctctgtaacctctaacagaggagaagaggtatgagaggactcaacctggcggcagcgcaaaagatg

SEQ ID NO: 163525 - DNA, 103 bp, Artificial Sequence
  Synthetic Polynucleotide
taatacgactcactatagggaggcccagactccaggaaatctgagtcctcaacagaggagagaggacatggatttcctgaacctggcggcagcgcaaaagatg

SEQ ID NO: 163526 - DNA, 103 bp, Artificial Sequence
  Synthetic Polynucleotide
taatacgactcactatagggtggcagctagaggcccagactccaggaaataacagaggagaatttccatgagtctgggcaacctggcggcagcgcaaaagatg

SEQ ID NO: 163527 - DNA, 103 bp, Artificial Sequence
  Synthetic Polynucleotide
taatacgactcactataggggagtcctctagcttcaccatgacaggccccaacagaggagaggggccatgcatggtgaaaacctggcggcagcgcaaaagatg

SEQ ID NO: 163528 - DNA, 103 bp, Artificial Sequence
  Synthetic Polynucleotide
taatacgactcactataggggactcctgggtggcagctagaggcccagacaacagaggagagtctggatgtctagctgcaacctggcggcagcgcaaaagatg

SEQ ID NO: 163529 - DNA, 103 bp, Artificial Sequence
  Synthetic Polynucleotide
taatacgactcactatagggggtgggtacagactcctgggtggcagctagaacagaggagactagctatgacccaggagaacctggcggcagcgcaaaagatg

SEQ ID NO: 163530 - DNA, 103 bp, Artificial Sequence
  Synthetic Polynucleotide
taatacgactcactatagggcaggcaggagggtgggtacagactcctgggaacagaggagacccaggatgctgtacccaaacctggcggcagcgcaaaagatg

SEQ ID NO: 163531 - DNA, 103 bp, Artificial Sequence
  Synthetic Polynucleotide
taatacgactcactatagggtgggcctcctcaggcaggagggtgggtacaaacagaggagatgtaccatgcctcctgccaacctggcggcagcgcaaaagatg

SEQ ID NO: 163532 - DNA, 103 bp, Artificial Sequence
  Synthetic Polynucleotide
taatacgactcactatagggcccacatctctgggcctcctcaggcaggagaacagaggagactcctgatggaggaggccaacctggcggcagcgcaaaagatg

SEQ ID NO: 163533 - DNA, 103 bp, Artificial Sequence
  Synthetic Polynucleotide
taatacgactcactatagggccagcacggtcccacatctctgggcctcctaacagaggagaaggaggatgagagatgtgaacctggcggcagcgcaaaagatg

SEQ ID NO: 163534 - DNA, 103 bp, Artificial Sequence
  Synthetic Polynucleotide
taatacgactcactatagggaagatctggtccagcacggtcccacatctcaacagaggagagagatgatggaccgtgctaacctggcggcagcgcaaaagatg

SEQ ID NO: 163535 - DNA, 103 bp, Artificial Sequence
  Synthetic Polynucleotide
taatacgactcactataggggctgtggggaaagatctggtccagcacggtaacagaggagaaccgtgatggaccagatcaacctggcggcagcgcaaaagatg

SEQ ID NO: 163536 - DNA, 103 bp, Artificial Sequence
  Synthetic Polynucleotide
taatacgactcactataggggcccagtcttgctgtggggaaagatctggtaacagaggagaaccagaatgttccccacaaacctggcggcagcgcaaaagatg

SEQ ID NO: 163537 - DNA, 103 bp, Artificial Sequence
  Synthetic Polynucleotide
taatacgactcactatagggggaccctcaggcccagtcttgctgtggggaaacagaggagatccccaatgcaagactggaacctggcggcagcgcaaaagatg

SEQ ID NO: 163538 - DNA, 103 bp, Artificial Sequence
  Synthetic Polynucleotide
taatacgactcactatagggctcctcctcagagtcctctagcttcaccataacagaggagaatggtgatgctagaggacaacctggcggcagcgcaaaagatg

SEQ ID NO: 163539 - DNA, 103 bp, Artificial Sequence
  Synthetic Polynucleotide
taatacgactcactatagggcctccatgagggaccctcaggcccagtcttaacagaggagaaagactatgcctgagggtaacctggcggcagcgcaaaagatg

SEQ ID NO: 163540 - DNA, 103 bp, Artificial Sequence
  Synthetic Polynucleotide
taatacgactcactatagggtggggtgctccctccatgagggaccctcagaacagaggagactgaggatgcctcatggaaacctggcggcagcgcaaaagatg

SEQ ID NO: 163541 - DNA, 103 bp, Artificial Sequence
  Synthetic Polynucleotide
taatacgactcactatagggcacagggccctggggtgctccctccatgagaacagaggagactcatgatgggagcacccaacctggcggcagcgcaaaagatg

SEQ ID NO: 163542 - DNA, 103 bp, Artificial Sequence
  Synthetic Polynucleotide
taatacgactcactatagggttcctcatgccacagggccctggggtgctcaacagaggagagagcacatgagggccctgaacctggcggcagcgcaaaagatg

SEQ ID NO: 163543 - DNA, 103 bp, Artificial Sequence
  Synthetic Polynucleotide
taatacgactcactatagggtgcccccagcttcctcatgccacagggcccaacagaggagagggcccatgggcatgaggaacctggcggcagcgcaaaagatg

SEQ ID NO: 163544 - DNA, 103 bp, Artificial Sequence
  Synthetic Polynucleotide
taatacgactcactatagggggggagaagatgcccccagcttcctcatgcaacagaggagagcatgaatgagctgggggaacctggcggcagcgcaaaagatg

SEQ ID NO: 163545 - DNA, 103 bp, Artificial Sequence
  Synthetic Polynucleotide
taatacgactcactatagggcgcgaaccctggggagaagatgcccccagcaacagaggagagctgggatgatcttctccaacctggcggcagcgcaaaagatg

SEQ ID NO: 163546 - DNA, 103 bp, Artificial Sequence
  Synthetic Polynucleotide
taatacgactcactatagggctagctgcagcgcgaaccctggggagaagaaacagaggagatcttctatgcagggttcgaacctggcggcagcgcaaaagatg

SEQ ID NO: 163547 - DNA, 103 bp, Artificial Sequence
  Synthetic Polynucleotide
taatacgactcactataggggagatgctgcctagctgcagcgcgaaccctaacagaggagaagggttatggctgcagctaacctggcggcagcgcaaaagatg

SEQ ID NO: 163548 - DNA, 103 bp, Artificial Sequence
  Synthetic Polynucleotide
taatacgactcactatagggtggacctgcggagatgctgcctagctgcagaacagaggagactgcagatgggcagcatcaacctggcggcagcgcaaaagatg

SEQ ID NO: 163549 - DNA, 103 bp, Artificial Sequence
  Synthetic Polynucleotide
taatacgactcactatagggcagcctcaccctcctcctcagagtcctctaaacagaggagatagaggatgctgaggaggaacctggcggcagcgcaaaagatg

SEQ ID NO: 163550 - DNA, 103 bp, Artificial Sequence
  Synthetic Polynucleotide
taatacgactcactatagggttacactacctggacctgcggagatgctgcaacagaggagagcagcaatgccgcaggtcaacctggcggcagcgcaaaagatg

SEQ ID NO: 163551 - DNA, 103 bp, Artificial Sequence
  Synthetic Polynucleotide
taatacgactcactatagggaggtgagggcttacactacctggacctgcgaacagaggagacgcaggatgaggtagtgtaacctggcggcagcgcaaaagatg

SEQ ID NO: 163552 - DNA, 103 bp, Artificial Sequence
  Synthetic Polynucleotide
taatacgactcactatagggggggacgtggaggtgagggcttacactaccaacagaggagaggtagtatgagccctcacaacctggcggcagcgcaaaagatg

SEQ ID NO: 163553 - DNA, 103 bp, Artificial Sequence
  Synthetic Polynucleotide
taatacgactcactatagggcgaggtcccaggggacgtggaggtgagggcaacagaggagagccctcatgtccacgtccaacctggcggcagcgcaaaagatg

SEQ ID NO: 163554 - DNA, 103 bp, Artificial Sequence
  Synthetic Polynucleotide
taatacgactcactatagggccagccatgccgaggtcccaggggacgtggaacagaggagaccacgtatgctgggacctaacctggcggcagcgcaaaagatg

SEQ ID NO: 163555 - DNA, 103 bp, Artificial Sequence
  Synthetic Polynucleotide
taatacgactcactataggggccagaaaggccagccatgccgaggtcccaaacagaggagatgggacatgggcatggctaacctggcggcagcgcaaaagatg

SEQ ID NO: 163556 - DNA, 103 bp, Artificial Sequence
  Synthetic Polynucleotide
taatacgactcactatagggattggatctggccagaaaggccagccatgcaacagaggagagcatggatggcctttctgaacctggcggcagcgcaaaagatg

SEQ ID NO: 163557 - DNA, 103 bp, Artificial Sequence
  Synthetic Polynucleotide
taatacgactcactatagggcgggagggtgattggatctggccagaaaggaacagaggagacctttcatgccagatccaaacctggcggcagcgcaaaagatg

SEQ ID NO: 163558 - DNA, 103 bp, Artificial Sequence
  Synthetic Polynucleotide
taatacgactcactataggggccaccttcgcgggagggtgattggatctgaacagaggagacagatcatgtcaccctccaacctggcggcagcgcaaaagatg

SEQ ID NO: 163559 - DNA, 103 bp, Artificial Sequence
  Synthetic Polynucleotide
taatacgactcactatagggcatgcgcaaagccaccttcgcgggagggtgaacagaggagacaccctatggcgaaggtgaacctggcggcagcgcaaaagatg

SEQ ID NO: 163560 - DNA, 103 bp, Artificial Sequence
  Synthetic Polynucleotide
taatacgactcactatagggtcccataaggcagcctcaccctcctcctcaaacagaggagatgaggaatggggtgaggcaacctggcggcagcgcaaaagatg

SEQ ID NO: 163561 - DNA, 103 bp, Artificial Sequence
  Synthetic Polynucleotide
taatacgactcactatagggagcagaagcgcatgcgcaaagccaccttcgaacagaggagacgaaggatgctttgcgcaaacctggcggcagcgcaaaagatg

SEQ ID NO: 163562 - DNA, 103 bp, Artificial Sequence
  Synthetic Polynucleotide
taatacgactcactatagggatcgctggggagcagaagcgcatgcgcaaaaacagaggagatttgcgatggcgcttctgaacctggcggcagcgcaaaagatg

SEQ ID NO: 163563 - DNA, 103 bp, Artificial Sequence
  Synthetic Polynucleotide
taatacgactcactatagggcactcctcagatcgctggggagcagaagcgaacagaggagacgcttcatgtccccagcgaacctggcggcagcgcaaaagatg

SEQ ID NO: 163564 - DNA, 103 bp, Artificial Sequence
  Synthetic Polynucleotide
taatacgactcactataggggggtcctgttcactcctcagatcgctggggaacagaggagaccccagatgtctgaggagaacctggcggcagcgcaaaagatg

SEQ ID NO: 163565 - DNA, 103 bp, Artificial Sequence
  Synthetic Polynucleotide
taatacgactcactatagggctcgtccgtggggtcctgttcactcctcagaacagaggagactgaggatggaacaggacaacctggcggcagcgcaaaagatg

SEQ ID NO: 163566 - DNA, 103 bp, Artificial Sequence
  Synthetic Polynucleotide
taatacgactcactatagggggcagggatcctcgtccgtggggtcctgttaacagaggagaaacaggatgccacggacgaacctggcggcagcgcaaaagatg

SEQ ID NO: 163567 - DNA, 103 bp, Artificial Sequence
  Synthetic Polynucleotide
taatacgactcactatagggcccacaccccggcagggatcctcgtccgtgaacagaggagacacggaatgggatccctgaacctggcggcagcgcaaaagatg

SEQ ID NO: 163568 - DNA, 103 bp, Artificial Sequence
  Synthetic Polynucleotide
taatacgactcactatagggcagagcagggcccacaccccggcagggatcaacagaggagagatcccatgcggggtgtgaacctggcggcagcgcaaaagatg

SEQ ID NO: 163569 - DNA, 103 bp, Artificial Sequence
  Synthetic Polynucleotide
taatacgactcactataggggggtggtgatcagagcagggcccacaccccaacagaggagaggggtgatggccctgctcaacctggcggcagcgcaaaagatg

SEQ ID NO: 163570 - DNA, 103 bp, Artificial Sequence
  Synthetic Polynucleotide
taatacgactcactataggggagcgccagcgggtggtgatcagagcagggaacagaggagaccctgcatggatcaccacaacctggcggcagcgcaaaagatg

SEQ ID NO: 163571 - DNA, 103 bp, Artificial Sequence
  Synthetic Polynucleotide
taatacgactcactatagggggggatctcgatgtgcagcatctgagacataacagaggagaatgtctatgatgctgcacaacctggcggcagcgcaaaagatg

SEQ ID NO: 163572 - DNA, 103 bp, Artificial Sequence
  Synthetic Polynucleotide
taatacgactcactatagggggcctggcccttgaccacgatggacacatcaacagaggagagatgtgatgatcgtggtcaacctggcggcagcgcaaaagatg

SEQ ID NO: 163573 - DNA, 103 bp, Artificial Sequence
  Synthetic Polynucleotide
taatacgactcactatagggcccttccgagtagagcttgggatggcagcgaacagaggagacgctgcatgcccaagctcaacctggcggcagcgcaaaagatg

SEQ ID NO: 163574 - DNA, 103 bp, Artificial Sequence
  Synthetic Polynucleotide
taatacgactcactatagggccccggggtccccttccgagtagagcttggaacagaggagaccaagcatgactcggaagaacctggcggcagcgcaaaagatg

SEQ ID NO: 163575 - DNA, 103 bp, Artificial Sequence
  Synthetic Polynucleotide
taatacgactcactatagggtccagcttctccccggggtccccttccgagaacagaggagactcggaatgggaccccggaacctggcggcagcgcaaaagatg

SEQ ID NO: 163576 - DNA, 103 bp, Artificial Sequence
  Synthetic Polynucleotide
taatacgactcactatagggtgccaccagctccagcttctccccggggtcaacagaggagagaccccatggagaagctgaacctggcggcagcgcaaaagatg

SEQ ID NO: 163577 - DNA, 103 bp, Artificial Sequence
  Synthetic Polynucleotide
taatacgactcactatagggccccagagcctgccaccagctccagcttctaacagaggagaagaagcatgagctggtggaacctggcggcagcgcaaaagatg

SEQ ID NO: 163578 - DNA, 103 bp, Artificial Sequence
  Synthetic Polynucleotide
taatacgactcactataggggtgatgtagaccccagagcctgccaccagcaacagaggagagctggtatgaggctctggaacctggcggcagcgcaaaagatg

SEQ ID NO: 163579 - DNA, 103 bp, Artificial Sequence
  Synthetic Polynucleotide
taatacgactcactatagggctggccgcgtgtgatgtagaccccagagccaacagaggagaggctctatggtctacatcaacctggcggcagcgcaaaagatg

SEQ ID NO: 163580 - DNA, 103 bp, Artificial Sequence
  Synthetic Polynucleotide
taatacgactcactatagggagttcatcagctggccgcgtgtgatgtagaaacagaggagatctacaatgcacgcggccaacctggcggcagcgcaaaagatg

SEQ ID NO: 163581 - DNA, 103 bp, Artificial Sequence
  Synthetic Polynucleotide
taatacgactcactatagggcacaggtggcagttcatcagctggccgcgtaacagaggagaacgcggatggctgatgaaaacctggcggcagcgcaaaagatg

SEQ ID NO: 163582 - DNA, 103 bp, Artificial Sequence
  Synthetic Polynucleotide
taatacgactcactatagggcacccctgcacacaggtggcagttcatcagaacagaggagactgatgatgtgccacctgaacctggcggcagcgcaaaagatg

SEQ ID NO: 163583 - DNA, 103 bp, Artificial Sequence
  Synthetic Polynucleotide
taatacgactcactataggggggccttgaaggcctggcccttgaccacgaaacagaggagatcgtggatgagggccaggaacctggcggcagcgcaaaagatg

SEQ ID NO: 163584 - DNA, 103 bp, Artificial Sequence
  Synthetic Polynucleotide
taatacgactcactatagggccttatgcttcacccctgcacacaggtggcaacagaggagagccaccatggtgcaggggaacctggcggcagcgcaaaagatg

SEQ ID NO: 163585 - DNA, 103 bp, Artificial Sequence
  Synthetic Polynucleotide
taatacgactcactatagggcgcagcaagaccttatgcttcacccctgcaaacagaggagatgcaggatggaagcataaaacctggcggcagcgcaaaagatg

SEQ ID NO: 163586 - DNA, 103 bp, Artificial Sequence
  Synthetic Polynucleotide
taatacgactcactatagggcaggagcctccgcagcaagaccttatgcttaacagaggagaaagcatatggtcttgctgaacctggcggcagcgcaaaagatg

SEQ ID NO: 163587 - DNA, 103 bp, Artificial Sequence
  Synthetic Polynucleotide
taatacgactcactatagggagaaggtggccaggagcctccgcagcaagaaacagaggagatcttgcatgggaggctccaacctggcggcagcgcaaaagatg

SEQ ID NO: 163588 - DNA, 103 bp, Artificial Sequence
  Synthetic Polynucleotide
taatacgactcactatagggttcctgtcaaagaaggtggccaggagcctcaacagaggagagaggctatgggccaccttaacctggcggcagcgcaaaagatg

SEQ ID NO: 163589 - DNA, 103 bp, Artificial Sequence
  Synthetic Polynucleotide
taatacgactcactatagggggccagcgtgttcctgtcaaagaaggtggcaacagaggagagccaccatgtttgacaggaacctggcggcagcgcaaaagatg

SEQ ID NO: 163590 - DNA, 103 bp, Artificial Sequence
  Synthetic Polynucleotide
taatacgactcactatagggcgcagctgttggccagcgtgttcctgtcaaaacagaggagattgacaatgacacgctggaacctggcggcagcgcaaaagatg

SEQ ID NO: 163591 - DNA, 103 bp, Artificial Sequence
  Synthetic Polynucleotide
taatacgactcactatagggatgccagtcccgcagctgttggccagcgtgaacagaggagacacgctatgcaacagctgaacctggcggcagcgcaaaagatg

SEQ ID NO: 163592 - DNA, 103 bp, Artificial Sequence
  Synthetic Polynucleotide
taatacgactcactatagggggacgagcggatgccagtcccgcagctgttaacagaggagaaacagcatggggactggcaacctggcggcagcgcaaaagatg

SEQ ID NO: 163593 - DNA, 103 bp, Artificial Sequence
  Synthetic Polynucleotide
taatacgactcactatagggggtcgctggtggacgagcggatgccagtccaacagaggagaggactgatgtccgctcgtaacctggcggcagcgcaaaagatg

SEQ ID NO: 163594 - DNA, 103 bp, Artificial Sequence
  Synthetic Polynucleotide
taatacgactcactatagggaccgcccggtgggccttgaaggcctggcccaacagaggagagggccaatgcttcaaggcaacctggcggcagcgcaaaagatg

SEQ ID NO: 163595 - DNA, 103 bp, Artificial Sequence
  Synthetic Polynucleotide
taatacgactcactatagggttccggctggggtcgctggtggacgagcggaacagaggagaccgctcatgcaccagcgaaacctggcggcagcgcaaaagatg

SEQ ID NO: 163596 - DNA, 103 bp, Artificial Sequence
  Synthetic Polynucleotide
taatacgactcactataggggtccagcggcttccggctggggtcgctggtaacagaggagaaccagcatgcccagccggaacctggcggcagcgcaaaagatg

SEQ ID NO: 163597 - DNA, 103 bp, Artificial Sequence
  Synthetic Polynucleotide
taatacgactcactatagggggacccggctgtccagcggcttccggctggaacagaggagaccagccatgagccgctggaacctggcggcagcgcaaaagatg

SEQ ID NO: 163598 - DNA, 103 bp, Artificial Sequence
  Synthetic Polynucleotide
taatacgactcactatagggacagcgttcaggacccggctgtccagcggcaacagaggagagccgctatgcagccgggtaacctggcggcagcgcaaaagatg

SEQ ID NO: 163599 - DNA, 103 bp, Artificial Sequence
  Synthetic Polynucleotide
taatacgactcactataggggtacaatttcacagcgttcaggacccggctaacagaggagaagccggatgctgaacgctaacctggcggcagcgcaaaagatg

SEQ ID NO: 163600 - DNA, 103 bp, Artificial Sequence
  Synthetic Polynucleotide
taatacgactcactatagggagttctgacagtacaatttcacagcgttcaaacagaggagatgaacgatgtgaaattgtaacctggcggcagcgcaaaagatg

SEQ ID NO: 163601 - DNA, 103 bp, Artificial Sequence
  Synthetic Polynucleotide
taatacgactcactatagggctgggggcgaagttctgacagtacaatttcaacagaggagagaaattatgctgtcagaaaacctggcggcagcgcaaaagatg

SEQ ID NO: 163602 - DNA, 103 bp, Artificial Sequence
  Synthetic Polynucleotide
taatacgactcactatagggctccttgaagctgggggcgaagttctgacaaacagaggagatgtcagatgttcgcccccaacctggcggcagcgcaaaagatg

SEQ ID NO: 163603 - DNA, 103 bp, Artificial Sequence
  Synthetic Polynucleotide
taatacgactcactatagggtcatctcgctctccttgaagctgggggcgaaacagaggagatcgcccatggcttcaaggaacctggcggcagcgcaaaagatg

SEQ ID NO: 163604 - DNA, 103 bp, Artificial Sequence
  Synthetic Polynucleotide
taatacgactcactataggggcgatcacgttcatctcgctctccttgaagaacagaggagacttcaaatggagcgagataacctggcggcagcgcaaaagatg

SEQ ID NO: 163605 - DNA, 103 bp, Artificial Sequence
  Synthetic Polynucleotide
taatacgactcactatagggggcggccagcaccgcccggtgggccttgaaaacagaggagattcaagatgcaccgggcgaacctggcggcagcgcaaaagatg

SEQ ID NO: 163606 - DNA, 103 bp, Artificial Sequence
  Synthetic Polynucleotide
taatacgactcactatagggcatgtccgcggcgatcacgttcatctcgctaacagaggagaagcgagatgaacgtgatcaacctggcggcagcgcaaaagatg

SEQ ID NO: 163607 - DNA, 103 bp, Artificial Sequence
  Synthetic Polynucleotide
taatacgactcactatagggcgttggtgcacatgtccgcggcgatcacgtaacagaggagaacgtgaatgccgcggacaaacctggcggcagcgcaaaagatg

SEQ ID NO: 163608 - DNA, 103 bp, Artificial Sequence
  Synthetic Polynucleotide
taatacgactcactatagggacgcggcgggcgttggtgcacatgtccgcgaacagaggagacgcggaatggtgcaccaaaacctggcggcagcgcaaaagatg

SEQ ID NO: 163609 - DNA, 103 bp, Artificial Sequence
  Synthetic Polynucleotide
taatacgactcactataggggcgcttgcgaacgcggcgggcgttggtgcaaacagaggagatgcaccatggcccgccgcaacctggcggcagcgcaaaagatg

SEQ ID NO: 163610 - DNA, 103 bp, Artificial Sequence
  Synthetic Polynucleotide
taatacgactcactatagggtgggcagccagcgcttgcgaacgcggcgggaacagaggagacccgccatgttcgcaagcaacctggcggcagcgcaaaagatg

SEQ ID NO: 163611 - DNA, 103 bp, Artificial Sequence
  Synthetic Polynucleotide
taatacgactcactataggggacttgatcttgggcagccagcgcttgcgaaacagaggagatcgcaaatgctggctgccaacctggcggcagcgcaaaagatg

SEQ ID NO: 163612 - DNA, 103 bp, Artificial Sequence
  Synthetic Polynucleotide
taatacgactcactatagggcggcagcatggacttgatcttgggcagccaaacagaggagatggctgatgaagatcaagaacctggcggcagcgcaaaagatg

SEQ ID NO: 163613 - DNA, 103 bp, Artificial Sequence
  Synthetic Polynucleotide
taatacgactcactatagggccacgccctccggcagcatggacttgatctaacagaggagaagatcaatgccatgctgcaacctggcggcagcgcaaaagatg

SEQ ID NO: 163614 - DNA, 103 bp, Artificial Sequence
  Synthetic Polynucleotide
taatacgactcactatagggcggtacatctccacgccctccggcagcatgaacagaggagacatgctatgggagggcgtaacctggcggcagcgcaaaagatg

SEQ ID NO: 163615 - DNA, 103 bp, Artificial Sequence
  Synthetic Polynucleotide
taatacgactcactatagggcatgaccgtgcggtacatctccacgccctcaacagaggagagagggcatggagatgtacaacctggcggcagcgcaaaagatg

SEQ ID NO: 163616 - DNA, 103 bp, Artificial Sequence
  Synthetic Polynucleotide
taatacgactcactatagggagaggctgctggcggccagcaccgcccggtaacagaggagaaccgggatgtgctggccgaacctggcggcagcgcaaaagatg

SEQ ID NO: 163617 - DNA, 103 bp, Artificial Sequence
  Synthetic Polynucleotide
taatacgactcactatagggcggcggagcccatgaccgtgcggtacatctaacagaggagaagatgtatggcacggtcaaacctggcggcagcgcaaaagatg

SEQ ID NO: 163618 - DNA, 103 bp, Artificial Sequence
  Synthetic Polynucleotide
taatacgactcactatagggacgctggcggcggcggagcccatgaccgtgaacagaggagacacggtatggggctccgcaacctggcggcagcgcaaaagatg

SEQ ID NO: 163619 - DNA, 103 bp, Artificial Sequence
  Synthetic Polynucleotide
taatacgactcactataggggtcgaggggcacgctggcggcggcggagccaacagaggagaggctccatggccgccagcaacctggcggcagcgcaaaagatg

SEQ ID NO: 163620 - DNA, 103 bp, Artificial Sequence
  Synthetic Polynucleotide
taatacgactcactatagggggaactcggggtcgaggggcacgctggcggaacagaggagaccgccaatgtgcccctcgaacctggcggcagcgcaaaagatg

SEQ ID NO: 163621 - DNA, 103 bp, Artificial Sequence
  Synthetic Polynucleotide
taatacgactcactataggggcggcaggcgggaactcggggtcgaggggcaacagaggagagcccctatgccccgagttaacctggcggcagcgcaaaagatg

SEQ ID NO: 163622 - DNA, 103 bp, Artificial Sequence
  Synthetic Polynucleotide
taatacgactcactatagggcacctgtgccgcggcaggcgggaactcgggaacagaggagacccgagatgccgcctgccaacctggcggcagcgcaaaagatg

SEQ ID NO: 163623 - DNA, 103 bp, Artificial Sequence
  Synthetic Polynucleotide
taatacgactcactataggggttgctcgaacacctgtgccgcggcaggcgaacagaggagacgcctgatgcggcacaggaacctggcggcagcgcaaaagatg

SEQ ID NO: 163624 - DNA, 103 bp, Artificial Sequence
  Synthetic Polynucleotide
taatacgactcactataggggcgtagatgcgttgctcgaacacctgtgccaacagaggagaggcacaatggttcgagcaaacctggcggcagcgcaaaagatg

SEQ ID NO: 163625 - DNA, 103 bp, Artificial Sequence
  Synthetic Polynucleotide
taatacgactcactatagggccgccgctcggcgtagatgcgttgctcgaaaacagaggagattcgagatgcgcatctacaacctggcggcagcgcaaaagatg

SEQ ID NO: 163626 - DNA, 103 bp, Artificial Sequence
  Synthetic Polynucleotide
taatacgactcactatagggcggcgtcgccccgccgctcggcgtagatgcaacagaggagagcatctatgccgagcggcaacctggcggcagcgcaaaagatg

SEQ ID NO: 163627 - DNA, 103 bp, Artificial Sequence
  Synthetic Polynucleotide
taatacgactcactatagggtcgcggaagtagaggctgctggcggccagcaacagaggagagctggcatgcagcagcctaacctggcggcagcgcaaaagatg

SEQ ID NO: 163628 - DNA, 103 bp, Artificial Sequence
  Synthetic Polynucleotide
taatacgactcactatagggacgatggtggcggcgtcgccccgccgctcgaacagaggagacgagcgatggggcgacgcaacctggcggcagcgcaaaagatg

SEQ ID NO: 163629 - DNA, 103 bp, Artificial Sequence
  Synthetic Polynucleotide
taatacgactcactatagggtctcagagccacgatggtggcggcgtcgccaacagaggagaggcgacatggccaccatcaacctggcggcagcgcaaaagatg

SEQ ID NO: 163630 - DNA, 103 bp, Artificial Sequence
  Synthetic Polynucleotide
taatacgactcactatagggcggcgtcagttctcagagccacgatggtggaacagaggagaccaccaatgtggctctgaaacctggcggcagcgcaaaagatg

SEQ ID NO: 163631 - DNA, 103 bp, Artificial Sequence
  Synthetic Polynucleotide
taatacgactcactatagggtcaacattcacggcgtcagttctcagagccaacagaggagaggctctatgaactgacgcaacctggcggcagcgcaaaagatg

SEQ ID NO: 163632 - DNA, 103 bp, Artificial Sequence
  Synthetic Polynucleotide
taatacgactcactatagggggcactcaggtcaacattcacggcgtcagtaacagaggagaactgacatggtgaatgttaacctggcggcagcgcaaaagatg

SEQ ID NO: 163633 - DNA, 103 bp, Artificial Sequence
  Synthetic Polynucleotide
taatacgactcactatagggggttggcggcggcactcaggtcaacattcaaacagaggagatgaatgatgacctgagtgaacctggcggcagcgcaaaagatg

SEQ ID NO: 163634 - DNA, 103 bp, Artificial Sequence
  Synthetic Polynucleotide
taatacgactcactatagggtcgaaggcggggttggcggcggcactcaggaacagaggagacctgagatgcgccgccaaaacctggcggcagcgcaaaagatg

SEQ ID NO: 163635 - DNA, 103 bp, Artificial Sequence
  Synthetic Polynucleotide
taatacgactcactatagggctcgccggcgtcgaaggcggggttggcggcaacagaggagagccgccatgcccgccttcaacctggcggcagcgcaaaagatg

SEQ ID NO: 163636 - DNA, 103 bp, Artificial Sequence
  Synthetic Polynucleotide
taatacgactcactatagggcgtccacctcctcgccggcgtcgaaggcggaacagaggagaccgcctatgacgccggcgaacctggcggcagcgcaaaagatg

SEQ ID NO: 163637 - DNA, 103 bp, Artificial Sequence
  Synthetic Polynucleotide
taatacgactcactataggggagccagccccgtccacctcctcgccggcgaacagaggagacgccggatgggaggtggaaacctggcggcagcgcaaaagatg

SEQ ID NO: 163638 - DNA, 103 bp, Artificial Sequence
  Synthetic Polynucleotide
taatacgactcactataggggctgaacaggtcgcggaagtagaggctgctaacagaggagaagcagcatgtacttccgcaacctggcggcagcgcaaaagatg

SEQ ID NO: 163639 - DNA, 103 bp, Artificial Sequence
  Synthetic Polynucleotide
taatacgactcactatagggctggatgaccgagccagccccgtccacctcaacagaggagagaggtgatgggggctggcaacctggcggcagcgcaaaagatg

SEQ ID NO: 163640 - DNA, 103 bp, Artificial Sequence
  Synthetic Polynucleotide
taatacgactcactatagggcggccacctcctggatgaccgagccagcccaacagaggagagggctgatgcggtcatccaacctggcggcagcgcaaaagatg

SEQ ID NO: 163641 - DNA, 103 bp, Artificial Sequence
  Synthetic Polynucleotide
taatacgactcactatagggggctcgggggcggccacctcctggatgaccaacagaggagaggtcatatgggaggtggcaacctggcggcagcgcaaaagatg

SEQ ID NO: 163642 - DNA, 103 bp, Artificial Sequence
  Synthetic Polynucleotide
taatacgactcactatagggggcgggcagcggctcgggggcggccacctcaacagaggagagaggtgatggcccccgagaacctggcggcagcgcaaaagatg

SEQ ID NO: 163643 - DNA, 103 bp, Artificial Sequence
  Synthetic Polynucleotide
taatacgactcactatagggtctggccatcggcgggcagcggctcgggggaacagaggagacccccgatgcgctgcccgaacctggcggcagcgcaaaagatg

SEQ ID NO: 163644 - DNA, 103 bp, Artificial Sequence
  Synthetic Polynucleotide
taatacgactcactatagggtgtggggggctctggccatcggcgggcagcaacagaggagagctgccatgcgatggccaaacctggcggcagcgcaaaagatg

SEQ ID NO: 163645 - DNA, 103 bp, Artificial Sequence
  Synthetic Polynucleotide
taatacgactcactatagggctcaaagggctgtggggggctctggccatcaacagaggagagatggcatgagccccccaaacctggcggcagcgcaaaagatg

SEQ ID NO: 163646 - DNA, 103 bp, Artificial Sequence
  Synthetic Polynucleotide
taatacgactcactatagggccccgccctgctcaaagggctgtggggggcaacagaggagagcccccatgagccctttgaacctggcggcagcgcaaaagatg

SEQ ID NO: 163647 - DNA, 103 bp, Artificial Sequence
  Synthetic Polynucleotide
taatacgactcactatagggctggggccgcccccgccctgctcaaagggcaacagaggagagcccttatggcagggcggaacctggcggcagcgcaaaagatg

SEQ ID NO: 163648 - DNA, 103 bp, Artificial Sequence
  Synthetic Polynucleotide
taatacgactcactatagggctggggcctgctggggccgcccccgccctgaacagaggagacagggcatgggcggccccaacctggcggcagcgcaaaagatg

SEQ ID NO: 163649 - DNA, 103 bp, Artificial Sequence
  Synthetic Polynucleotide
taatacgactcactatagggtgctgttgccgctgaacaggtcgcggaagtaacagaggagaacttccatgacctgttcaaacctggcggcagcgcaaaagatg

SEQ ID NO: 163650 - DNA, 103 bp, Artificial Sequence
  Synthetic Polynucleotide
taatacgactcactatagggccgccggcgtctggggcctgctggggccgcaacagaggagagcggccatggcaggccccaacctggcggcagcgcaaaagatg

SEQ ID NO: 163651 - DNA, 103 bp, Artificial Sequence
  Synthetic Polynucleotide
taatacgactcactatagggcgggccgcggccgccggcgtctggggcctgaacagaggagacaggccatggacgccggcaacctggcggcagcgcaaaagatg

SEQ ID NO: 163652 - DNA, 103 bp, Artificial Sequence
  Synthetic Polynucleotide
taatacgactcactatagggctccggcctccgggccgcggccgccggcgtaacagaggagaacgccgatggccgcggccaacctggcggcagcgcaaaagatg

SEQ ID NO: 163653 - DNA, 103 bp, Artificial Sequence
  Synthetic Polynucleotide
taatacgactcactatagggcataggtgccctccggcctccgggccgcggaacagaggagaccgcggatgggaggccggaacctggcggcagcgcaaaagatg

SEQ ID NO: 163654 - DNA, 103 bp, Artificial Sequence
  Synthetic Polynucleotide
taatacgactcactatagggaaggtccctgcataggtgccctccggcctcaacagaggagagaggccatggggcacctaaacctggcggcagcgcaaaagatg

SEQ ID NO: 163655 - DNA, 103 bp, Artificial Sequence
  Synthetic Polynucleotide
taatacgactcactatagggaaggcgctcttgctgttgccgctgaacaggaacagaggagacctgttatgcggcaacagaacctggcggcagcgcaaaagatg

SEQ ID NO: 163656 - DNA, 103 bp, Artificial Sequence
  Synthetic Polynucleotide
taatacgactcactataggggggcagctcgaaggcgctcttgctgttgccaacagaggagaggcaacatgaagagcgccaacctggcggcagcgcaaaagatg

SEQ ID NO: 163657 - DNA, 103 bp, Artificial Sequence
  Synthetic Polynucleotide
taatacgactcactatagggtcccgaagttggggatctcgatgtgcagcaaacagaggagatgctgcatgtcgagatccaacctggcggcagcgcaaaagatg

SEQ ID NO: 163658 - DNA, 103 bp, Artificial Sequence
  Synthetic Polynucleotide
taatacgactcactataggggcacggagccgggcagctcgaaggcgctctaacagaggagaagagcgatgtcgagctgcaacctggcggcagcgcaaaagatg

SEQ ID NO: 163659 - DNA, 103 bp, Artificial Sequence
  Synthetic Polynucleotide
taatacgactcactatagggcaggcgggcggcacggagccgggcagctcgaacagaggagacgagctatgcggctccgtaacctggcggcagcgcaaaagatg

SEQ ID NO: 163660 - DNA, 103 bp, Artificial Sequence
  Synthetic Polynucleotide
taatacgactcactatagggctgctggaagcaggcgggcggcacggagccaacagaggagaggctccatgccgcccgccaacctggcggcagcgcaaaagatg

SEQ ID NO: 163661 - DNA, 103 bp, Artificial Sequence
  Synthetic Polynucleotide
taatacgactcactatagggaggacaggatctgctggaagcaggcgggcgaacagaggagacgcccgatggcttccagcaacctggcggcagcgcaaaagatg

SEQ ID NO: 163662 - DNA, 103 bp, Artificial Sequence
  Synthetic Polynucleotide
taatacgactcactataggggtgtagcagaaggacaggatctgctggaagaacagaggagacttccaatggatcctgtcaacctggcggcagcgcaaaagatg

SEQ ID NO: 163663 - DNA, 103 bp, Artificial Sequence
  Synthetic Polynucleotide
taatacgactcactataggggagcctgcccgtgtagcagaaggacaggataacagaggagaatcctgatgttctgctacaacctggcggcagcgcaaaagatg

SEQ ID NO: 163664 - DNA, 103 bp, Artificial Sequence
  Synthetic Polynucleotide
taatacgactcactatagggccgtcatggtgagcctgcccgtgtagcagaaacagaggagatctgctatgcgggcaggcaacctggcggcagcgcaaaagatg

SEQ ID NO: 163665 - DNA, 103 bp, Artificial Sequence
  Synthetic Polynucleotide
taatacgactcactatagggtgctcgctggccgtcatggtgagcctgcccaacagaggagagggcagatgcaccatgacaacctggcggcagcgcaaaagatg

SEQ ID NO: 163666 - DNA, 103 bp, Artificial Sequence
  Synthetic Polynucleotide
taatacgactcactataggggaccacgagctgctcgctggccgtcatggtaacagaggagaaccatgatggccagcgagaacctggcggcagcgcaaaagatg

SEQ ID NO: 163667 - DNA, 103 bp, Artificial Sequence
  Synthetic Polynucleotide
taatacgactcactatagggccgtgtacatgaccacgagctgctcgctggaacagaggagaccagcgatgagctcgtggaacctggcggcagcgcaaaagatg

SEQ ID NO: 163668 - DNA, 103 bp, Artificial Sequence
  Synthetic Polynucleotide
taatacgactcactatagggagcactgtgttcccgaagttggggatctcgaacagaggagacgagatatgcaacttcggaacctggcggcagcgcaaaagatg

SEQ ID NO: 163669 - DNA, 103 bp, Artificial Sequence
  Synthetic Polynucleotide
taatacgactcactatagggaggaagccggccgtgtacatgaccacgagcaacagaggagagctcgtatgcatgtacacaacctggcggcagcgcaaaagatg

SEQ ID NO: 163670 - DNA, 103 bp, Artificial Sequence
  Synthetic Polynucleotide
taatacgactcactatagggctggatctgcaggaagccggccgtgtacataacagaggagaatgtacatggccggcttcaacctggcggcagcgcaaaagatg

SEQ ID NO: 163671 - DNA, 103 bp, Artificial Sequence
  Synthetic Polynucleotide
taatacgactcactatagggccacgatgtgctggatctgcaggaagccggaacagaggagaccggctatgtgcagatccaacctggcggcagcgcaaaagatg

SEQ ID NO: 163672 - DNA, 103 bp, Artificial Sequence
  Synthetic Polynucleotide
taatacgactcactataggggtgccgcgctccacgatgtgctggatctgcaacagaggagagcagatatggcacatcgtaacctggcggcagcgcaaaagatg

SEQ ID NO: 163673 - DNA, 103 bp, Artificial Sequence
  Synthetic Polynucleotide
taatacgactcactatagggcatgaggtcggtgccgcgctccacgatgtgaacagaggagacacatcatggagcgcggcaacctggcggcagcgcaaaagatg

SEQ ID NO: 163674 - DNA, 103 bp, Artificial Sequence
  Synthetic Polynucleotide
taatacgactcactatagggtcaccttgaacatgaggtcggtgccgcgctaacagaggagaagcgcgatgccgacctcaaacctggcggcagcgcaaaagatg

SEQ ID NO: 163675 - DNA, 103 bp, Artificial Sequence
  Synthetic Polynucleotide
taatacgactcactatagggtggggcgagctcaccttgaacatgaggtcgaacagaggagacgacctatggttcaaggtaacctggcggcagcgcaaaagatg

SEQ ID NO: 163676 - DNA, 103 bp, Artificial Sequence
  Synthetic Polynucleotide
taatacgactcactatagggcgagtcgcagtggggcgagctcaccttgaaaacagaggagattcaagatgagctcgcccaacctggcggcagcgcaaaagatg

SEQ ID NO: 163677 - DNA, 103 bp, Artificial Sequence
  Synthetic Polynucleotide
taatacgactcactatagggcagcggtctgcgagtcgcagtggggcgagcaacagaggagagctcgcatgactgcgactaacctggcggcagcgcaaaagatg

SEQ ID NO: 163678 - DNA, 103 bp, Artificial Sequence
  Synthetic Polynucleotide
taatacgactcactatagggtcctcgatcacagcggtctgcgagtcgcagaacagaggagactgcgaatggcagaccgcaacctggcggcagcgcaaaagatg

SEQ ID NO: 163679 - DNA, 103 bp, Artificial Sequence
  Synthetic Polynucleotide
taatacgactcactatagggcaggcagcccagcactgtgttcccgaagttaacagaggagaaacttcatgaacacagtgaacctggcggcagcgcaaaagatg

SEQ ID NO: 163680 - DNA, 103 bp, Artificial Sequence
  Synthetic Polynucleotide
taatacgactcactatagggggagccggcgtcctcgatcacagcggtctgaacagaggagacagaccatggtgatcgagaacctggcggcagcgcaaaagatg

SEQ ID NO: 163681 - DNA, 103 bp, Artificial Sequence
  Synthetic Polynucleotide
taatacgactcactatagggtctggggctcggagccggcgtcctcgatcaaacagaggagatgatcgatgacgccggctaacctggcggcagcgcaaaagatg

SEQ ID NO: 163682 - DNA, 103 bp, Artificial Sequence
  Synthetic Polynucleotide
taatacgactcactatagggttgcaggggctctggggctcggagccggcgaacagaggagacgccggatgcgagccccaaacctggcggcagcgcaaaagatg

SEQ ID NO: 163683 - DNA, 103 bp, Artificial Sequence
  Synthetic Polynucleotide
taatacgactcactatagggctgcagctggttgcaggggctctggggctcaacagaggagagagcccatgagcccctgcaacctggcggcagcgcaaaagatg

SEQ ID NO: 163684 - DNA, 103 bp, Artificial Sequence
  Synthetic Polynucleotide
taatacgactcactatagggcggcggccggctgcagctggttgcaggggcaacagaggagagcccctatgaccagctgcaacctggcggcagcgcaaaagatg

SEQ ID NO: 163685 - DNA, 103 bp, Artificial Sequence
  Synthetic Polynucleotide
taatacgactcactataggggccgcggcggcggcggccggctgcagctggaacagaggagaccagctatggccggccgcaacctggcggcagcgcaaaagatg

SEQ ID NO: 163686 - DNA, 103 bp, Artificial Sequence
  Synthetic Polynucleotide
taatacgactcactataggggacgtagggggccgcggcggcggcggccggaacagaggagaccggccatggccgccgcgaacctggcggcagcgcaaaagatg

SEQ ID NO: 163687 - DNA, 103 bp, Artificial Sequence
  Synthetic Polynucleotide
taatacgactcactatagggagggggacacgacgtagggggccgcggcggaacagaggagaccgccgatgccccctacgaacctggcggcagcgcaaaagatg

SEQ ID NO: 163688 - DNA, 103 bp, Artificial Sequence
  Synthetic Polynucleotide
taatacgactcactatagggatgggcaccgagggggacacgacgtaggggaacagaggagacccctaatgcgtgtccccaacctggcggcagcgcaaaagatg

SEQ ID NO: 163689 - DNA, 103 bp, Artificial Sequence
  Synthetic Polynucleotide
taatacgactcactatagggcagcagcgggatgggcaccgagggggacacaacagaggagagtgtccatgtcggtgcccaacctggcggcagcgcaaaagatg

SEQ ID NO: 163690 - DNA, 103 bp, Artificial Sequence
  Synthetic Polynucleotide
taatacgactcactataggggctgctcgttcaggcagcccagcactgtgtaacagaggagaacacagatgtgggctgccaacctggcggcagcgcaaaagatg

SEQ ID NO: 163691 - DNA, 103 bp, Artificial Sequence
  Synthetic Polynucleotide
taatacgactcactatagggttactcgggtcagcagcgggatgggcaccgaacagaggagacggtgcatgtcccgctgcaacctggcggcagcgcaaaagatg

SEQ ID NO: 163692 - DNA, 103 bp, Artificial Sequence
  Synthetic Polynucleotide
taatacgactcactataggggcttcatgctttactcgggtcagcagcgggaacagaggagacccgctatggacccgagtaacctggcggcagcgcaaaagatg

SEQ ID NO: 163693 - DNA, 103 bp, Artificial Sequence
  Synthetic Polynucleotide
taatacgactcactatagggcagctccatggcttcatgctttactcgggtaacagaggagaacccgaatgaagcatgaaaacctggcggcagcgcaaaagatg

SEQ ID NO: 163694 - DNA, 103 bp, Artificial Sequence
  Synthetic Polynucleotide
taatacgactcactatagggcggccggcggcagctccatggcttcatgctaacagaggagaagcatgatgccatggagcaacctggcggcagcgcaaaagatg

SEQ ID NO: 163695 - DNA, 103 bp, Artificial Sequence
  Synthetic Polynucleotide
taatacgactcactatagggaggcctgggccggccggcggcagctccatgaacagaggagacatggaatggccgccggcaacctggcggcagcgcaaaagatg

SEQ ID NO: 163696 - DNA, 103 bp, Artificial Sequence
  Synthetic Polynucleotide
taatacgactcactatagggcttgggggccaggcctgggccggccggcggaacagaggagaccgccgatgggcccaggcaacctggcggcagcgcaaaagatg

SEQ ID NO: 163697 - DNA, 103 bp, Artificial Sequence
  Synthetic Polynucleotide
taatacgactcactatagggccagcgggcgcttgggggccaggcctgggcaacagaggagagcccagatgtggcccccaaacctggcggcagcgcaaaagatg

SEQ ID NO: 163698 - DNA, 103 bp, Artificial Sequence
  Synthetic Polynucleotide
taatacgactcactatagggggccccgtctccagcgggcgcttgggggccaacagaggagaggccccatggcgcccgctaacctggcggcagcgcaaaagatg

SEQ ID NO: 163699 - DNA, 103 bp, Artificial Sequence
  Synthetic Polynucleotide
taatacgactcactataggggccgtcccggggccccgtctccagcgggcgaacagaggagacgcccgatggagacggggaacctggcggcagcgcaaaagatg

SEQ ID NO: 163700 - DNA, 103 bp, Artificial Sequence
  Synthetic Polynucleotide
taatacgactcactatagggccaccgccacgccgtcccggggccccgtctaacagaggagaagacggatgcccgggacgaacctggcggcagcgcaaaagatg

SEQ ID NO: 163701 - DNA, 103 bp, Artificial Sequence
  Synthetic Polynucleotide
taatacgactcactatagggcccagcaggcgctgctcgttcaggcagcccaacagaggagagggctgatggaacgagcaaacctggcggcagcgcaaaagatg

SEQ ID NO: 163702 - DNA, 103 bp, Artificial Sequence
  Synthetic Polynucleotide
taatacgactcactataggggcccccgcggccaccgccacgccgtcccggaacagaggagaccgggaatgcgtggcggtaacctggcggcagcgcaaaagatg

SEQ ID NO: 163703 - DNA, 103 bp, Artificial Sequence
  Synthetic Polynucleotide
taatacgactcactatagggcgccaccgcagcccccgcggccaccgccacaacagaggagagtggcgatggccgcggggaacctggcggcagcgcaaaagatg

SEQ ID NO: 163704 - DNA, 103 bp, Artificial Sequence
  Synthetic Polynucleotide
taatacgactcactatagggctgtgcccgccgccaccgcagcccccgcggaacagaggagaccgcggatgctgcggtggaacctggcggcagcgcaaaagatg

SEQ ID NO: 163705 - DNA, 103 bp, Artificial Sequence
  Synthetic Polynucleotide
taatacgactcactatagggttgagaggggctgtgcccgccgccaccgcaaacagaggagatgcggtatgggcgggcacaacctggcggcagcgcaaaagatg

SEQ ID NO: 163706 - DNA, 103 bp, Artificial Sequence
  Synthetic Polynucleotide
taatacgactcactatagggacggggcagtttgagaggggctgtgcccgcaacagaggagagcgggcatggcccctctcaacctggcggcagcgcaaaagatg

SEQ ID NO: 163707 - DNA, 103 bp, Artificial Sequence
  Synthetic Polynucleotide
taatacgactcactatagggagtaggagacacggggcagtttgagaggggaacagaggagacccctcatgaactgccccaacctggcggcagcgcaaaagatg

SEQ ID NO: 163708 - DNA, 103 bp, Artificial Sequence
  Synthetic Polynucleotide
taatacgactcactatagggggcaccccgtagtaggagacacggggcagtaacagaggagaactgccatgtgtctcctaaacctggcggcagcgcaaaagatg

SEQ ID NO: 163709 - DNA, 103 bp, Artificial Sequence
  Synthetic Polynucleotide
taatacgactcactatagggggccaggctgggcaccccgtagtaggagacaacagaggagagtctccatgtacggggtgaacctggcggcagcgcaaaagatg

SEQ ID NO: 163710 - DNA, 103 bp, Artificial Sequence
  Synthetic Polynucleotide
taatacgactcactatagggggatgagggtggccaggctgggcaccccgtaacagaggagaacggggatgccagcctggaacctggcggcagcgcaaaagatg

SEQ ID NO: 163711 - DNA, 103 bp, Artificial Sequence
  Synthetic Polynucleotide
taatacgactcactatagggtggatgccggggatgagggtggccaggctgaacagaggagacagcctatgcaccctcataacctggcggcagcgcaaaagatg

SEQ ID NO: 163712 - DNA, 103 bp, Artificial Sequence
  Synthetic Polynucleotide
taatacgactcactataggggcagtagaggcccagcaggcgctgctcgttaacagaggagaaacgagatgcgcctgctgaacctggcggcagcgcaaaagatg

SEQ ID NO: 163713 - DNA, 103 bp, Artificial Sequence
  Synthetic Polynucleotide
taatacgactcactataggggggcatctgctggatgccggggatgagggtaacagaggagaaccctcatgcccggcatcaacctggcggcagcgcaaaagatg

SEQ ID NO: 163714 - DNA, 103 bp, Artificial Sequence
  Synthetic Polynucleotide
taatacgactcactatagggcctgggggtagggcatctgctggatgccggaacagaggagaccggcaatgagcagatgcaacctggcggcagcgcaaaagatg

SEQ ID NO: 163715 - DNA, 103 bp, Artificial Sequence
  Synthetic Polynucleotide
taatacgactcactataggggtccgctccccctgggggtagggcatctgcaacagaggagagcagatatgctacccccaaacctggcggcagcgcaaaagatg

SEQ ID NO: 163716 - DNA, 103 bp, Artificial Sequence
  Synthetic Polynucleotide
taatacgactcactataggggcctggactggtccgctccccctgggggtaaacagaggagataccccatgggggagcggaacctggcggcagcgcaaaagatg

SEQ ID NO: 163717 - DNA, 103 bp, Artificial Sequence
  Synthetic Polynucleotide
taatacgactcactatagggggctgctggcgcctggactggtccgctcccaacagaggagagggagcatgccagtccagaacctggcggcagcgcaaaagatg

SEQ ID NO: 163718 - DNA, 103 bp, Artificial Sequence
  Synthetic Polynucleotide
taatacgactcactataggggtggtgggcaggctgctggcgcctggactgaacagaggagacagtccatgcgccagcagaacctggcggcagcgcaaaagatg

SEQ ID NO: 163719 - DNA, 103 bp, Artificial Sequence
  Synthetic Polynucleotide
taatacgactcactatagggggggctgtcggtggtgggcaggctgctggcaacagaggagagccagcatgctgcccaccaacctggcggcagcgcaaaagatg

SEQ ID NO: 163720 - DNA, 103 bp, Artificial Sequence
  Synthetic Polynucleotide
taatacgactcactatagggggtacgaggtggggctgtcggtggtgggcaaacagaggagatgcccaatgccgacagccaacctggcggcagcgcaaaagatg

SEQ ID NO: 163721 - DNA, 103 bp, Artificial Sequence
  Synthetic Polynucleotide
taatacgactcactatagggtcctcgttgtggtacgaggtggggctgtcgaacagaggagacgacagatgcacctcgtaaacctggcggcagcgcaaaagatg

SEQ ID NO: 163722 - DNA, 103 bp, Artificial Sequence
  Synthetic Polynucleotide
taatacgactcactatagggctcctcgtcctcctcgttgtggtacgaggtaacagaggagaacctcgatgcacaacgagaacctggcggcagcgcaaaagatg

SEQ ID NO: 163723 - DNA, 103 bp, Artificial Sequence
  Synthetic Polynucleotide
taatacgactcactatagggtggacacatcgcagtagaggcccagcaggcaacagaggagagcctgcatggcctctactaacctggcggcagcgcaaaagatg

SEQ ID NO: 163724 - DNA, 103 bp, Artificial Sequence
  Synthetic Polynucleotide
taatacgactcactatagggcctcgtcgtcctcctcgtcctcctcgttgtaacagaggagaacaacgatgaggacgaggaacctggcggcagcgcaaaagatg

SEQ ID NO: 163725 - DNA, 103 bp, Artificial Sequence
  Synthetic Polynucleotide
taatacgactcactataggggtgtcgtaggcctcgtcgtcctcctcgtccaacagaggagaggacgaatgggacgacgaaacctggcggcagcgcaaaagatg

SEQ ID NO: 163726 - DNA, 103 bp, Artificial Sequence
  Synthetic Polynucleotide
taatacgactcactatagggctccaccatggtgtcgtaggcctcgtcgtcaacagaggagagacgacatggcctacgacaacctggcggcagcgcaaaagatg

SEQ ID NO: 163727 - DNA, 103 bp, Artificial Sequence
  Synthetic Polynucleotide
taatacgactcactatagggcgtactgctcctccaccatggtgtcgtaggaacagaggagacctacgatgccatggtggaacctggcggcagcgcaaaagatg

SEQ ID NO: 163728 - DNA, 103 bp, Artificial Sequence
  Synthetic Polynucleotide
taatacgactcactatagggtacatctggccgtactgctcctccaccatgaacagaggagacatggtatgggagcagtaaacctggcggcagcgcaaaagatg

SEQ ID NO: 163729 - DNA, 103 bp, Artificial Sequence
  Synthetic Polynucleotide
taatacgactcactatagggggccttgatgtacatctggccgtactgctcaacagaggagagagcagatgggccagatgaacctggcggcagcgcaaaagatg

SEQ ID NO: 163730 - DNA, 103 bp, Artificial Sequence
  Synthetic Polynucleotide
taatacgactcactatagggagctgccggaggccttgatgtacatctggcaacagaggagagccagaatgacatcaaggaacctggcggcagcgcaaaagatg

SEQ ID NO: 163731 - DNA, 103 bp, Artificial Sequence
  Synthetic Polynucleotide
taatacgactcactatagggtgcactgcatagctgccggaggccttgatgaacagaggagacatcaaatgctccggcagaacctggcggcagcgcaaaagatg

SEQ ID NO: 163732 - DNA, 103 bp, Artificial Sequence
  Synthetic Polynucleotide
taatacgactcactatagggaggcttctcttgcactgcatagctgccggaaacagaggagatccggcatgtatgcagtgaacctggcggcagcgcaaaagatg

SEQ ID NO: 163733 - DNA, 103 bp, Artificial Sequence
  Synthetic Polynucleotide
taatacgactcactataggggcactggctcaggcttctcttgcactgcataacagaggagaatgcagatgaagagaagcaacctggcggcagcgcaaaagatg

SEQ ID NO: 163734 - DNA, 103 bp, Artificial Sequence
  Synthetic Polynucleotide
taatacgactcactatagggttgaccacgatggacacatcgcagtagaggaacagaggagacctctaatgcgatgtgtcaacctggcggcagcgcaaaagatg

SEQ ID NO: 163735 - DNA, 103 bp, Artificial Sequence
  Synthetic Polynucleotide
taatacgactcactatagggctctccagcggcactggctcaggcttctctaacagaggagaagagaaatgtgagccagtaacctggcggcagcgcaaaagatg

SEQ ID NO: 163736 - DNA, 103 bp, Artificial Sequence
  Synthetic Polynucleotide
taatacgactcactataggggcaggagcggctctccagcggcactggctcaacagaggagagagccaatgccgctggagaacctggcggcagcgcaaaagatg

SEQ ID NO: 163737 - DNA, 103 bp, Artificial Sequence
  Synthetic Polynucleotide
taatacgactcactatagggggatgaggacgcaggagcggctctccagcgaacagaggagacgctggatggccgctcctaacctggcggcagcgcaaaagatg

SEQ ID NO: 163738 - DNA, 103 bp, Artificial Sequence
  Synthetic Polynucleotide
taatacgactcactatagggaggtcgcggcggatgaggacgcaggagcggaacagaggagaccgctcatgcgtcctcataacctggcggcagcgcaaaagatg

SEQ ID NO: 163739 - DNA, 103 bp, Artificial Sequence
  Synthetic Polynucleotide
taatacgactcactatagggtagggccacgaggtcgcggcggatgaggacaacagaggagagtcctcatgcgccgcgacaacctggcggcagcgcaaaagatg

SEQ ID NO: 163740 - DNA, 103 bp, Artificial Sequence
  Synthetic Polynucleotide
taatacgactcactatagggggctggcaggtagggccacgaggtcgcggcaacagaggagagccgcgatgtcgtggcccaacctggcggcagcgcaaaagatg

SEQ ID NO: 163741 - DNA, 103 bp, Artificial Sequence
  Synthetic Polynucleotide
taatacgactcactatagggtggctgatgaggctggcaggtagggccacgaacagaggagacgtggcatgacctgccagaacctggcggcagcgcaaaagatg

SEQ ID NO: 163742 - DNA, 103 bp, Artificial Sequence
  Synthetic Polynucleotide
taatacgactcactataggggtatccgatctggctgatgaggctggcaggaacagaggagacctgccatgctcatcagcaacctggcggcagcgcaaaagatg

SEQ ID NO: 163743 - DNA, 103 bp, Artificial Sequence
  Synthetic Polynucleotide
taatacgactcactataggggatggcagcggtatccgatctggctgatgaaacagaggagatcatcaatgagatcggataacctggcggcagcgcaaaagatg

SEQ ID NO: 163744 - DNA, 103 bp, Artificial Sequence
  Synthetic Polynucleotide
taatacgactcactatagggtagagcttgggatggcagcggtatccgatcaacagaggagagatcggatgccgctgccaaacctggcggcagcgcaaaagatg

SEQ ID NO: 163745 - DNA, 103 bp, Artificial Sequence
  Synthetic Polynucleotide
taatacgactcactataggggctttggggacaagctggatccacactcataacagaggagaatgagtatggatccagctaacctggcggcagcgcaaaagatg

SEQ ID NO: 163746 - DNA, 103 bp, Artificial Sequence
  Synthetic Polynucleotide
taatacgactcactatagggcatttgcaaggatggatagttttcttcaggaacagaggagacctgaaatgaactatccaaacctggcggcagcgcaaaagatg

SEQ ID NO: 163747 - DNA, 103 bp, Artificial Sequence
  Synthetic Polynucleotide
taatacgactcactatagggcagcagaagacatttgcaaggatggatagtaacagaggagaactatcatgccttgcaaaaacctggcggcagcgcaaaagatg

SEQ ID NO: 163748 - DNA, 103 bp, Artificial Sequence
  Synthetic Polynucleotide
taatacgactcactatagggtgaggcatctcagcagaagacatttgcaagaacagaggagacttgcaatggtcttctgcaacctggcggcagcgcaaaagatg

SEQ ID NO: 163749 - DNA, 103 bp, Artificial Sequence
  Synthetic Polynucleotide
taatacgactcactatagggagtctccgtgtgaggcatctcagcagaagaaacagaggagatcttctatggagatgcctaacctggcggcagcgcaaaagatg

SEQ ID NO: 163750 - DNA, 103 bp, Artificial Sequence
  Synthetic Polynucleotide
taatacgactcactataggggaggagagacagtctccgtgtgaggcatctaacagaggagaagatgcatgacacggagaaacctggcggcagcgcaaaagatg

SEQ ID NO: 163751 - DNA, 103 bp, Artificial Sequence
  Synthetic Polynucleotide
taatacgactcactataggggaggaaggaagaggagagacagtctccgtgaacagaggagacacggaatgtgtctctccaacctggcggcagcgcaaaagatg

SEQ ID NO: 163752 - DNA, 103 bp, Artificial Sequence
  Synthetic Polynucleotide
taatacgactcactatagggcagatccatggaggaaggaagaggagagacaacagaggagagtctctatgcttccttccaacctggcggcagcgcaaaagatg

SEQ ID NO: 163753 - DNA, 103 bp, Artificial Sequence
  Synthetic Polynucleotide
taatacgactcactatagggcctgaataagcagatccatggaggaaggaaaacagaggagattccttatgccatggatcaacctggcggcagcgcaaaagatg

SEQ ID NO: 163754 - DNA, 103 bp, Artificial Sequence
  Synthetic Polynucleotide
taatacgactcactatagggtcagggctgtcctgaataagcagatccatgaacagaggagacatggaatggcttattcaaacctggcggcagcgcaaaagatg

SEQ ID NO: 163755 - DNA, 103 bp, Artificial Sequence
  Synthetic Polynucleotide
taatacgactcactatagggggtggaagaatcagggctgtcctgaataagaacagaggagacttattatggacagccctaacctggcggcagcgcaaaagatg

SEQ ID NO: 163756 - DNA, 103 bp, Artificial Sequence
  Synthetic Polynucleotide
taatacgactcactatagggagcaaggcaagctttggggacaagctggataacagaggagaatccagatggtccccaaaaacctggcggcagcgcaaaagatg

SEQ ID NO: 163757 - DNA, 103 bp, Artificial Sequence
  Synthetic Polynucleotide
taatacgactcactatagggctttgggactggtggaagaatcagggctgtaacagaggagaacagccatgattcttccaaacctggcggcagcgcaaaagatg

SEQ ID NO: 163758 - DNA, 103 bp, Artificial Sequence
  Synthetic Polynucleotide
taatacgactcactatagggggttgtttgcctttgggactggtggaagaaaacagaggagattcttcatgcagtcccaaaacctggcggcagcgcaaaagatg

SEQ ID NO: 163759 - DNA, 103 bp, Artificial Sequence
  Synthetic Polynucleotide
taatacgactcactatagggtgcagaagtgggttgtttgcctttgggactaacagaggagaagtcccatgggcaaacaaaacctggcggcagcgcaaaagatg

SEQ ID NO: 163760 - DNA, 103 bp, Artificial Sequence
  Synthetic Polynucleotide
taatacgactcactatagggcactcttctctgcagaagtgggttgtttgcaacagaggagagcaaacatgccacttctgaacctggcggcagcgcaaaagatg

SEQ ID NO: 163761 - DNA, 103 bp, Artificial Sequence
  Synthetic Polynucleotide
taatacgactcactatagggttttttgcgacactcttctctgcagaagtgaacagaggagacacttcatgagagaagagaacctggcggcagcgcaaaagatg

SEQ ID NO: 163762 - DNA, 103 bp, Artificial Sequence
  Synthetic Polynucleotide
taatacgactcactatagggcttgtcttccttttttgcgacactcttctcaacagaggagagagaagatggtcgcaaaaaacctggcggcagcgcaaaagatg

SEQ ID NO: 163763 - DNA, 103 bp, Artificial Sequence
  Synthetic Polynucleotide
taatacgactcactatagggtgaccgggaccttgtcttccttttttgcgaaacagaggagatcgcaaatgaggaagacaaacctggcggcagcgcaaaagatg

SEQ ID NO: 163764 - DNA, 103 bp, Artificial Sequence
  Synthetic Polynucleotide
taatacgactcactatagggttctgtttcttgaccgggaccttgtcttccaacagaggagaggaagaatgggtcccggtaacctggcggcagcgcaaaagatg

SEQ ID NO: 163765 - DNA, 103 bp, Artificial Sequence
  Synthetic Polynucleotide
taatacgactcactatagggagttctggtcttctgtttcttgaccgggacaacagaggagagtcccgatgaagaaacagaacctggcggcagcgcaaaagatg

SEQ ID NO: 163766 - DNA, 103 bp, Artificial Sequence
  Synthetic Polynucleotide
taatacgactcactatagggaagagaacacagttctggtcttctgtttctaacagaggagaagaaacatgagaccagaaaacctggcggcagcgcaaaagatg

SEQ ID NO: 163767 - DNA, 103 bp, Artificial Sequence
  Synthetic Polynucleotide
taatacgactcactataggggatgcttcaaagcaaggcaagctttggggaaacagaggagatccccaatgcttgccttgaacctggcggcagcgcaaaagatg

SEQ ID NO: 163768 - DNA, 103 bp, Artificial Sequence
  Synthetic Polynucleotide
taatacgactcactatagggagctgggtggaagagaacacagttctggtcaacagaggagagaccagatgtgtgttctcaacctggcggcagcgcaaaagatg

SEQ ID NO: 163769 - DNA, 103 bp, Artificial Sequence
  Synthetic Polynucleotide
taatacgactcactataggggagtacacacagctgggtggaagagaacacaacagaggagagtgttcatgtccacccagaacctggcggcagcgcaaaagatg

SEQ ID NO: 163770 - DNA, 103 bp, Artificial Sequence
  Synthetic Polynucleotide
taatacgactcactatagggatctatcattgagtacacacagctgggtggaacagaggagaccacccatgtgtgtgtacaacctggcggcagcgcaaaagatg

SEQ ID NO: 163771 - DNA, 103 bp, Artificial Sequence
  Synthetic Polynucleotide
taatacgactcactatagggtgtctctgaaatctatcattgagtacacacaacagaggagagtgtgtatgcaatgatagaacctggcggcagcgcaaaagatg

SEQ ID NO: 163772 - DNA, 103 bp, Artificial Sequence
  Synthetic Polynucleotide
taatacgactcactataggggaggtatttctgtctctgaaatctatcattaacagaggagaaatgatatgtttcagagaaacctggcggcagcgcaaaagatg

SEQ ID NO: 163773 - DNA, 103 bp, Artificial Sequence
  Synthetic Polynucleotide
taatacgactcactataggggctggaggctgaggtatttctgtctctgaaaacagaggagattcagaatgagaaataccaacctggcggcagcgcaaaagatg

SEQ ID NO: 163774 - DNA, 103 bp, Artificial Sequence
  Synthetic Polynucleotide
taatacgactcactatagggtcttgcatctgctggaggctgaggtatttcaacagaggagagaaataatgcagcctccaaacctggcggcagcgcaaaagatg

SEQ ID NO: 163775 - DNA, 103 bp, Artificial Sequence
  Synthetic Polynucleotide
taatacgactcactataggggttggagagttcttgcatctgctggaggctaacagaggagaagcctcatgcagatgcaaaacctggcggcagcgcaaaagatg

SEQ ID NO: 163776 - DNA, 103 bp, Artificial Sequence
  Synthetic Polynucleotide
taatacgactcactatagggggttcaggatgttggagagttcttgcatctaacagaggagaagatgcatgaactctccaaacctggcggcagcgcaaaagatg

SEQ ID NO: 163777 - DNA, 103 bp, Artificial Sequence
  Synthetic Polynucleotide
taatacgactcactatagggttgtagctgaggttcaggatgttggagagtaacagaggagaactctcatgcatcctgaaaacctggcggcagcgcaaaagatg

SEQ ID NO: 163778 - DNA, 103 bp, Artificial Sequence
  Synthetic Polynucleotide
taatacgactcactatagggtttacagtcggatgcttcaaagcaaggcaaaacagaggagattgcctatgtttgaagcaaacctggcggcagcgcaaaagatg

SEQ ID NO: 163779 - DNA, 103 bp, Artificial Sequence
  Synthetic Polynucleotide
taatacgactcactatagggcttcacctgtttgtagctgaggttcaggataacagaggagaatcctgatgctcagctacaacctggcggcagcgcaaaagatg

SEQ ID NO: 163780 - DNA, 103 bp, Artificial Sequence
  Synthetic Polynucleotide
taatacgactcactatagggggaaccaggtcttcacctgtttgtagctgaaacagaggagatcagctatgaacaggtgaaacctggcggcagcgcaaaagatg

SEQ ID NO: 163781 - DNA, 103 bp, Artificial Sequence
  Synthetic Polynucleotide
taatacgactcactatagggctctggttctggaaccaggtcttcacctgtaacagaggagaacaggtatggacctggttaacctggcggcagcgcaaaagatg

SEQ ID NO: 163782 - DNA, 103 bp, Artificial Sequence
  Synthetic Polynucleotide
taatacgactcactatagggagatttcattctctggttctggaaccaggtaacagaggagaacctggatgcagaaccagaacctggcggcagcgcaaaagatg

SEQ ID NO: 163783 - DNA, 103 bp, Artificial Sequence
  Synthetic Polynucleotide
taatacgactcactataggggccacctcttagatttcattctctggttctaacagaggagaagaaccatggaatgaaataacctggcggcagcgcaaaagatg

SEQ ID NO: 163784 - DNA, 103 bp, Artificial Sequence
  Synthetic Polynucleotide
taatacgactcactatagggttgtttttctgccacctcttagatttcattaacagaggagaaatgaaatgtaagaggtgaacctggcggcagcgcaaaagatg

SEQ ID NO: 163785 - DNA, 103 bp, Artificial Sequence
  Synthetic Polynucleotide
taatacgactcactatagggcttcggccagttgtttttctgccacctcttaacagaggagaaagaggatgcagaaaaacaacctggcggcagcgcaaaagatg

SEQ ID NO: 163786 - DNA, 103 bp, Artificial Sequence
  Synthetic Polynucleotide
taatacgactcactatagggcattgctattcttcggccagttgtttttctaacagaggagaagaaaaatgactggccgaaacctggcggcagcgcaaaagatg

SEQ ID NO: 163787 - DNA, 103 bp, Artificial Sequence
  Synthetic Polynucleotide
taatacgactcactatagggtgcgtcacaccattgctattcttcggccagaacagaggagactggccatggaatagcaaaacctggcggcagcgcaaaagatg

SEQ ID NO: 163788 - DNA, 103 bp, Artificial Sequence
  Synthetic Polynucleotide
taatacgactcactatagggtgaggccttctgcgtcacaccattgctattaacagaggagaaatagcatgggtgtgacgaacctggcggcagcgcaaaagatg

SEQ ID NO: 163789 - DNA, 103 bp, Artificial Sequence
  Synthetic Polynucleotide
taatacgactcactataggggtgaagattctttacagtcggatgcttcaaaacagaggagattgaagatgccgactgtaaacctggcggcagcgcaaaagatg

SEQ ID NO: 163790 - DNA, 103 bp, Artificial Sequence
  Synthetic Polynucleotide
taatacgactcactatagggaggtaggtgctgaggccttctgcgtcacacaacagaggagagtgtgaatgagaaggcctaacctggcggcagcgcaaaagatg

SEQ ID NO: 163791 - DNA, 103 bp, Artificial Sequence
  Synthetic Polynucleotide
taatacgactcactatagggaggctggggtaggtaggtgctgaggccttcaacagaggagagaaggcatgagcacctacaacctggcggcagcgcaaaagatg

SEQ ID NO: 163792 - DNA, 103 bp, Artificial Sequence
  Synthetic Polynucleotide
taatacgactcactatagggggaagagtaaaggctggggtaggtaggtgcaacagaggagagcacctatgtaccccagcaacctggcggcagcgcaaaagatg

SEQ ID NO: 163793 - DNA, 103 bp, Artificial Sequence
  Synthetic Polynucleotide
taatacgactcactatagggcctggtggtaggaagagtaaaggctggggtaacagaggagaaccccaatgtttactcttaacctggcggcagcgcaaaagatg

SEQ ID NO: 163794 - DNA, 103 bp, Artificial Sequence
  Synthetic Polynucleotide
taatacgactcactatagggaccaggcatccctggtggtaggaagagtaaaacagaggagattactcatgctaccaccaaacctggcggcagcgcaaaagatg

SEQ ID NO: 163795 - DNA, 103 bp, Artificial Sequence
  Synthetic Polynucleotide
taatacgactcactatagggagtcgggttcaccaggcatccctggtggtaaacagaggagataccacatgggatgcctgaacctggcggcagcgcaaaagatg

SEQ ID NO: 163796 - DNA, 103 bp, Artificial Sequence
  Synthetic Polynucleotide
taatacgactcactataggggaaggttcccagtcgggttcaccaggcatcaacagaggagagatgccatgtgaacccgaaacctggcggcagcgcaaaagatg

SEQ ID NO: 163797 - DNA, 103 bp, Artificial Sequence
  Synthetic Polynucleotide
taatacgactcactatagggctccacattggaaggttcccagtcgggttcaacagaggagagaacccatgtgggaacctaacctggcggcagcgcaaaagatg

SEQ ID NO: 163798 - DNA, 103 bp, Artificial Sequence
  Synthetic Polynucleotide
taatacgactcactatagggggtctggttgctccacattggaaggttcccaacagaggagagggaacatgccaatgtggaacctggcggcagcgcaaaagatg

SEQ ID NO: 163799 - DNA, 103 bp, Artificial Sequence
  Synthetic Polynucleotide
taatacgactcactatagggaattgttccaggtctggttgctccacattgaacagaggagacaatgtatggcaaccagaaacctggcggcagcgcaaaagatg

SEQ ID NO: 163800 - DNA, 103 bp, Artificial Sequence
  Synthetic Polynucleotide
taatacgactcactatagggacaggcataggtgaagattctttacagtcgaacagaggagacgactgatgagaatcttcaacctggcggcagcgcaaaagatg

SEQ ID NO: 163801 - DNA, 103 bp, Artificial Sequence
  Synthetic Polynucleotide
taatacgactcactatagggctccaggttgaattgttccaggtctggttgaacagaggagacaaccaatgctggaacaaaacctggcggcagcgcaaaagatg

SEQ ID NO: 163802 - DNA, 103 bp, Artificial Sequence
  Synthetic Polynucleotide
taatacgactcactatagggggtctggttgctccaggttgaattgttccaaacagaggagatggaacatgtcaacctggaacctggcggcagcgcaaaagatg

SEQ ID NO: 163803 - DNA, 103 bp, Artificial Sequence
  Synthetic Polynucleotide
taatacgactcactatagggggatgttctgggtctggttgctccaggttgaacagaggagacaacctatggcaaccagaaacctggcggcagcgcaaaagatg

SEQ ID NO: 163804 - DNA, 103 bp, Artificial Sequence
  Synthetic Polynucleotide
taatacgactcactatagggctccaggactggatgttctgggtctggttgaacagaggagacaaccaatgccagaacataacctggcggcagcgcaaaagatg

SEQ ID NO: 163805 - DNA, 103 bp, Artificial Sequence
  Synthetic Polynucleotide
taatacgactcactatagggggagtggttgctccaggactggatgttctgaacagaggagacagaacatgcagtcctggaacctggcggcagcgcaaaagatg

SEQ ID NO: 163806 - DNA, 103 bp, Artificial Sequence
  Synthetic Polynucleotide
taatacgactcactataggggagtgttccaggagtggttgctccaggactaacagaggagaagtcctatggcaaccactaacctggcggcagcgcaaaagatg

SEQ ID NO: 163807 - DNA, 103 bp, Artificial Sequence
  Synthetic Polynucleotide
taatacgactcactatagggcaccaggtctgagtgttccaggagtggttgaacagaggagacaaccaatgctggaacacaacctggcggcagcgcaaaagatg

SEQ ID NO: 163808 - DNA, 103 bp, Artificial Sequence
  Synthetic Polynucleotide
taatacgactcactatagggggattgggtgcaccaggtctgagtgttccaaacagaggagatggaacatgcagacctggaacctggcggcagcgcaaaagatg

SEQ ID NO: 163809 - DNA, 103 bp, Artificial Sequence
  Synthetic Polynucleotide
taatacgactcactataggggattgttccaggattgggtgcaccaggtctaacagaggagaagacctatggcacccaataacctggcggcagcgcaaaagatg

SEQ ID NO: 163810 - DNA, 103 bp, Artificial Sequence
  Synthetic Polynucleotide
taatacgactcactatagggttccaggcctgattgttccaggattgggtgaacagaggagacacccaatgctggaacaaaacctggcggcagcgcaaaagatg

SEQ ID NO: 163811 - DNA, 103 bp, Artificial Sequence
  Synthetic Polynucleotide
taatacgactcactatagggcccacaaatcacaggcataggtgaagattcaacagaggagagaatctatgcctatgcctaacctggcggcagcgcaaaagatg

SEQ ID NO: 163812 - DNA, 103 bp, Artificial Sequence
  Synthetic Polynucleotide
taatacgactcactataggggaagggactgttccaggcctgattgttccaaacagaggagatggaacatgcaggcctggaacctggcggcagcgcaaaagatg

SEQ ID NO: 163813 - DNA, 103 bp, Artificial Sequence
  Synthetic Polynucleotide
taatacgactcactatagggcacagttatagaagggactgttccaggcctaacagaggagaaggcctatgacagtccctaacctggcggcagcgcaaaagatg

SEQ ID NO: 163814 - DNA, 103 bp, Artificial Sequence
  Synthetic Polynucleotide
taatacgactcactataggggattcctctccacagttatagaagggactgaacagaggagacagtccatgctataactgaacctggcggcagcgcaaaagatg

SEQ ID NO: 163815 - DNA, 103 bp, Artificial Sequence
  Synthetic Polynucleotide
taatacgactcactatagggggactgcagagattcctctccacagttataaacagaggagatataacatgggagaggaaaacctggcggcagcgcaaaagatg

SEQ ID NO: 163816 - DNA, 103 bp, Artificial Sequence
  Synthetic Polynucleotide
taatacgactcactatagggactgcatgcaggactgcagagattcctctcaacagaggagagagaggatgctctgcagtaacctggcggcagcgcaaaagatg

SEQ ID NO: 163817 - DNA, 103 bp, Artificial Sequence
  Synthetic Polynucleotide
taatacgactcactatagggtttggctggaactgcatgcaggactgcagaaacagaggagatctgcaatgctgcatgcaaacctggcggcagcgcaaaagatg

SEQ ID NO: 163818 - DNA, 103 bp, Artificial Sequence
  Synthetic Polynucleotide
taatacgactcactatagggggcaggagaatttggctggaactgcatgcaaacagaggagatgcatgatgttccagccaaacctggcggcagcgcaaaagatg

SEQ ID NO: 163819 - DNA, 103 bp, Artificial Sequence
  Synthetic Polynucleotide
taatacgactcactatagggccaagtcactggcaggagaatttggctggaaacagaggagatccagcatgattctcctgaacctggcggcagcgcaaaagatg

SEQ ID NO: 163820 - DNA, 103 bp, Artificial Sequence
  Synthetic Polynucleotide
taatacgactcactatagggaaggcagcctccaagtcactggcaggagaaaacagaggagattctccatgcagtgacttaacctggcggcagcgcaaaagatg

SEQ ID NO: 163821 - DNA, 103 bp, Artificial Sequence
  Synthetic Polynucleotide
taatacgactcactatagggagcagcttccaaggcagcctccaagtcactaacagaggagaagtgacatggaggctgccaacctggcggcagcgcaaaagatg

SEQ ID NO: 163822 - DNA, 103 bp, Artificial Sequence
  Synthetic Polynucleotide
taatacgactcactatagggtttcttcaggcccacaaatcacaggcatagaacagaggagactatgcatgtgatttgtgaacctggcggcagcgcaaaagatg

SEQ ID NO: 163823 - DNA, 103 bp, Artificial Sequence
  Synthetic Polynucleotide
taatacgactcactatagggggccttccccagcagcttccaaggcagcctaacagaggagaaggctgatgtggaagctgaacctggcggcagcgcaaaagatg

SEQ ID NO: 163824 - DNA, 103 bp, Artificial Sequence
  Synthetic Polynucleotide
taatacgactcactatagggattacattaaggccttccccagcagcttccaacagaggagaggaagcatgtggggaaggaacctggcggcagcgcaaaagatg

SEQ ID NO: 163825 - DNA, 103 bp, Artificial Sequence
  Synthetic Polynucleotide
taatacgactcactatagggggtctgctgtattacattaaggccttccccaacagaggagaggggaaatgcttaatgtaaacctggcggcagcgcaaaagatg

SEQ ID NO: 163826 - DNA, 103 bp, Artificial Sequence
  Synthetic Polynucleotide
taatacgactcactatagggaatacctagtggtctgctgtattacattaaaacagaggagattaatgatgtacagcagaaacctggcggcagcgcaaaagatg

SEQ ID NO: 163827 - DNA, 103 bp, Artificial Sequence
  Synthetic Polynucleotide
taatacgactcactatagggggagtactaaaatacctagtggtctgctgtaacagaggagaacagcaatgcactaggtaaacctggcggcagcgcaaaagatg

SEQ ID NO: 163828 - DNA, 103 bp, Artificial Sequence
  Synthetic Polynucleotide
taatacgactcactatagggcatggtttgtggagtactaaaatacctagtaacagaggagaactaggatgtttagtactaacctggcggcagcgcaaaagatg

SEQ ID NO: 163829 - DNA, 103 bp, Artificial Sequence
  Synthetic Polynucleotide
taatacgactcactatagggggaataaatccatggtttgtggagtactaaaacagaggagattagtaatgcacaaaccaaacctggcggcagcgcaaaagatg

SEQ ID NO: 163830 - DNA, 103 bp, Artificial Sequence
  Synthetic Polynucleotide
taatacgactcactataggggagtagtttaggaataaatccatggtttgtaacagaggagaacaaacatgggatttattaacctggcggcagcgcaaaagatg

SEQ ID NO: 163831 - DNA, 103 bp, Artificial Sequence
  Synthetic Polynucleotide
taatacgactcactatagggcatgttcatggagtagtttaggaataaatcaacagaggagagatttaatgctaaactacaacctggcggcagcgcaaaagatg

SEQ ID NO: 163832 - DNA, 103 bp, Artificial Sequence
  Synthetic Polynucleotide
taatacgactcactatagggcttcaggttgcatgttcatggagtagtttaaacagaggagataaactatgccatgaacaaacctggcggcagcgcaaaagatg

SEQ ID NO: 163833 - DNA, 103 bp, Artificial Sequence
  Synthetic Polynucleotide
taatacgactcactataggggatggatagttttcttcaggcccacaaatcaacagaggagagatttgatggcctgaagaaacctggcggcagcgcaaaagatg

SEQ ID NO: 163834 - DNA, 103 bp, Artificial Sequence
  Synthetic Polynucleotide
taatacgactcactataggggtcagaggtattttctcccatcccactcataacagaggagaatgagtatgatgggagaaaacctggcggcagcgcaaaagatg

SEQ ID NO: 163835 - DNA, 103 bp, Artificial Sequence
  Synthetic Polynucleotide
taatacgactcactatagggttcacgattacgtttttcagtgttccttttaacagaggagaaaaaggatgactgaaaaaaacctggcggcagcgcaaaagatg

SEQ ID NO: 163836 - DNA, 103 bp, Artificial Sequence
  Synthetic Polynucleotide
taatacgactcactatagggggaaaaacgatagatttgactgaatgccaaaacagaggagattggcaatgagtcaaatcaacctggcggcagcgcaaaagatg

SEQ ID NO: 163837 - DNA, 103 bp, Artificial Sequence
  Synthetic Polynucleotide
taatacgactcactatagggcatcagacaaggaaaaacgatagatttgacaacagaggagagtcaaaatgatcgtttttaacctggcggcagcgcaaaagatg

SEQ ID NO: 163838 - DNA, 103 bp, Artificial Sequence
  Synthetic Polynucleotide
taatacgactcactatagggacaagagtgccatcagacaaggaaaaacgaaacagaggagatcgtttatgcttgtctgaaacctggcggcagcgcaaaagatg

SEQ ID NO: 163839 - DNA, 103 bp, Artificial Sequence
  Synthetic Polynucleotide
taatacgactcactatagggttgtgcagcaacaagagtgccatcagacaaaacagaggagattgtctatgggcactcttaacctggcggcagcgcaaaagatg

SEQ ID NO: 163840 - DNA, 103 bp, Artificial Sequence
  Synthetic Polynucleotide
taatacgactcactatagggtgctcttcgtttgtgcagcaacaagagtgcaacagaggagagcactcatgttgctgcacaacctggcggcagcgcaaaagatg

SEQ ID NO: 163841 - DNA, 103 bp, Artificial Sequence
  Synthetic Polynucleotide
taatacgactcactatagggcggatgagtttgctcttcgtttgtgcagcaaacagaggagatgctgcatgaacgaagagaacctggcggcagcgcaaaagatg

SEQ ID NO: 163842 - DNA, 103 bp, Artificial Sequence
  Synthetic Polynucleotide
taatacgactcactatagggagtctgagaacggatgagtttgctcttcgtaacagaggagaacgaagatgaaactcatcaacctggcggcagcgcaaaagatg

SEQ ID NO: 163843 - DNA, 103 bp, Artificial Sequence
  Synthetic Polynucleotide
taatacgactcactataggggttcattagtagtctgagaacggatgagttaacagaggagaaactcaatggttctcagaaacctggcggcagcgcaaaagatg

SEQ ID NO: 163844 - DNA, 103 bp, Artificial Sequence
  Synthetic Polynucleotide
taatacgactcactatagggacaagttgaggttcattagtagtctgagaaaacagaggagattctcaatgtactaatgaaacctggcggcagcgcaaaagatg

SEQ ID NO: 163845 - DNA, 103 bp, Artificial Sequence
  Synthetic Polynucleotide
taatacgactcactatagggtaaagatattacaagttgaggttcattagtaacagaggagaactaatatgcctcaacttaacctggcggcagcgcaaaagatg

SEQ ID NO: 163846 - DNA, 103 bp, Artificial Sequence
  Synthetic Polynucleotide
taatacgactcactatagggtattttcctgttcacgattacgtttttcagaacagaggagactgaaaatggtaatcgtgaacctggcggcagcgcaaaagatg

SEQ ID NO: 163847 - DNA, 103 bp, Artificial Sequence
  Synthetic Polynucleotide
taatacgactcactataggggaagcatatgtaaagatattacaagttgagaacagaggagactcaacatgtaatatcttaacctggcggcagcgcaaaagatg

SEQ ID NO: 163848 - DNA, 103 bp, Artificial Sequence
  Synthetic Polynucleotide
taatacgactcactatagggtgctctctgtgaagcatatgtaaagatattaacagaggagaaatatcatgacatatgctaacctggcggcagcgcaaaagatg

SEQ ID NO: 163849 - DNA, 103 bp, Artificial Sequence
  Synthetic Polynucleotide
taatacgactcactatagggacacacattctgctctctgtgaagcatatgaacagaggagacatatgatgcacagagagaacctggcggcagcgcaaaagatg

SEQ ID NO: 163850 - DNA, 103 bp, Artificial Sequence
  Synthetic Polynucleotide
taatacgactcactataggggattcatcacacacacattctgctctctgtaacagaggagaacagagatgagaatgtgtaacctggcggcagcgcaaaagatg

SEQ ID NO: 163851 - DNA, 103 bp, Artificial Sequence
  Synthetic Polynucleotide
taatacgactcactataggggtcagatccggattcatcacacacacattcaacagaggagagaatgtatgtgtgatgaaaacctggcggcagcgcaaaagatg

SEQ ID NO: 163852 - DNA, 103 bp, Artificial Sequence
  Synthetic Polynucleotide
taatacgactcactatagggcgtttgtccagtcagatccggattcatcacaacagaggagagtgatgatgccggatctgaacctggcggcagcgcaaaagatg

SEQ ID NO: 163853 - DNA, 103 bp, Artificial Sequence
  Synthetic Polynucleotide
taatacgactcactataggggcttccccatcgtttgtccagtcagatccgaacagaggagacggatcatgctggacaaaaacctggcggcagcgcaaaagatg

SEQ ID NO: 163854 - DNA, 103 bp, Artificial Sequence
  Synthetic Polynucleotide
taatacgactcactatagggggattcagtggcttccccatcgtttgtccaaacagaggagatggacaatggatggggaaaacctggcggcagcgcaaaagatg

SEQ ID NO: 163855 - DNA, 103 bp, Artificial Sequence
  Synthetic Polynucleotide
taatacgactcactatagggagagctaattggattcagtggcttccccataacagaggagaatggggatgccactgaataacctggcggcagcgcaaaagatg

SEQ ID NO: 163856 - DNA, 103 bp, Artificial Sequence
  Synthetic Polynucleotide
taatacgactcactatagggcagggctgttagagctaattggattcagtgaacagaggagacactgaatgcaattagctaacctggcggcagcgcaaaagatg

SEQ ID NO: 163857 - DNA, 103 bp, Artificial Sequence
  Synthetic Polynucleotide
taatacgactcactatagggtctatatatttattttcctgttcacgattaaacagaggagataatcgatgacaggaaaaaacctggcggcagcgcaaaagatg

SEQ ID NO: 163858 - DNA, 103 bp, Artificial Sequence
  Synthetic Polynucleotide
taatacgactcactataggggcctgatgggcagggctgttagagctaattaacagaggagaaattagatgtaacagcccaacctggcggcagcgcaaaagatg

SEQ ID NO: 163859 - DNA, 103 bp, Artificial Sequence
  Synthetic Polynucleotide
taatacgactcactatagggactgcacagggcctgatgggcagggctgttaacagaggagaaacagcatggcccatcagaacctggcggcagcgcaaaagatg

SEQ ID NO: 163860 - DNA, 103 bp, Artificial Sequence
  Synthetic Polynucleotide
taatacgactcactatagggctgggttcccactgcacagggcctgatgggaacagaggagacccatcatgccctgtgcaaacctggcggcagcgcaaaagatg

SEQ ID NO: 163861 - DNA, 103 bp, Artificial Sequence
  Synthetic Polynucleotide
taatacgactcactatagggatgtcctgacctgggttcccactgcacaggaacagaggagacctgtgatgtgggaacccaacctggcggcagcgcaaaagatg

SEQ ID NO: 163862 - DNA, 103 bp, Artificial Sequence
  Synthetic Polynucleotide
taatacgactcactatagggactgagggtcatgtcctgacctgggttcccaacagaggagagggaacatgggtcaggacaacctggcggcagcgcaaaagatg

SEQ ID NO: 163863 - DNA, 103 bp, Artificial Sequence
  Synthetic Polynucleotide
taatacgactcactatagggttatattgctactgagggtcatgtcctgacaacagaggagagtcaggatgtgaccctcaaacctggcggcagcgcaaaagatg

SEQ ID NO: 163864 - DNA, 103 bp, Artificial Sequence
  Synthetic Polynucleotide
taatacgactcactatagggatgggaaaatttatattgctactgagggtcaacagaggagagaccctatgtagcaatataacctggcggcagcgcaaaagatg

SEQ ID NO: 163865 - DNA, 103 bp, Artificial Sequence
  Synthetic Polynucleotide
taatacgactcactatagggtgggccatttatgggaaaatttatattgctaacagaggagaagcaatatgaattttcccaacctggcggcagcgcaaaagatg

SEQ ID NO: 163866 - DNA, 103 bp, Artificial Sequence
  Synthetic Polynucleotide
taatacgactcactatagggtttgttcctttgggccatttatgggaaaataacagaggagaattttcatgtaaatggccaacctggcggcagcgcaaaagatg

SEQ ID NO: 163867 - DNA, 103 bp, Artificial Sequence
  Synthetic Polynucleotide
taatacgactcactatagggggcatgcccatttgttcctttgggccatttaacagaggagaaaatggatgaaaggaacaaacctggcggcagcgcaaaagatg

SEQ ID NO: 163868 - DNA, 103 bp, Artificial Sequence
  Synthetic Polynucleotide
taatacgactcactatagggtgcaagttcttctatatatttattttcctgaacagaggagacaggaaatgaaatatataaacctggcggcagcgcaaaagatg

SEQ ID NO: 163869 - DNA, 103 bp, Artificial Sequence
  Synthetic Polynucleotide
taatacgactcactatagggcctgcccatgggcatgcccatttgttccttaacagaggagaaaggaaatgatgggcatgaacctggcggcagcgcaaaagatg

SEQ ID NO: 163870 - DNA, 103 bp, Artificial Sequence
  Synthetic Polynucleotide
taatacgactcactatagggaaccaccaaacctgcccatgggcatgcccaaacagaggagatgggcaatgccatgggcaaacctggcggcagcgcaaaagatg

SEQ ID NO: 163871 - DNA, 103 bp, Artificial Sequence
  Synthetic Polynucleotide
taatacgactcactatagggattcccccagaaccaccaaacctgcccatgaacagaggagacatgggatggtttggtggaacctggcggcagcgcaaaagatg

SEQ ID NO: 163872 - DNA, 103 bp, Artificial Sequence
  Synthetic Polynucleotide
taatacgactcactatagggcacatggttcattcccccagaaccaccaaaaacagaggagatttggtatgtctgggggaaacctggcggcagcgcaaaagatg

SEQ ID NO: 163873 - DNA, 103 bp, Artificial Sequence
  Synthetic Polynucleotide
taatacgactcactataggggcatgcctgacacatggttcattcccccagaacagaggagactggggatgtgaaccatgaacctggcggcagcgcaaaagatg

SEQ ID NO: 163874 - DNA, 103 bp, Artificial Sequence
  Synthetic Polynucleotide
taatacgactcactataggggtggttgcttgcatgcctgacacatggttcaacagaggagagaaccaatggtcaggcataacctggcggcagcgcaaaagatg

SEQ ID NO: 163875 - DNA, 103 bp, Artificial Sequence
  Synthetic Polynucleotide
taatacgactcactatagggaccctgaggagtggttgcttgcatgcctgaaacagaggagatcaggcatgcaagcaaccaacctggcggcagcgcaaaagatg

SEQ ID NO: 163876 - DNA, 103 bp, Artificial Sequence
  Synthetic Polynucleotide
taatacgactcactatagggcatagttactaccctgaggagtggttgcttaacagaggagaaagcaaatgctcctcaggaacctggcggcagcgcaaaagatg

SEQ ID NO: 163877 - DNA, 103 bp, Artificial Sequence
  Synthetic Polynucleotide
taatacgactcactatagggattttgagtgcatagttactaccctgaggaaacagaggagatcctcaatgtagtaactaaacctggcggcagcgcaaaagatg

SEQ ID NO: 163878 - DNA, 103 bp, Artificial Sequence
  Synthetic Polynucleotide
taatacgactcactatagggggggctgttcattttgagtgcatagttactaacagaggagaagtaacatggcactcaaaaacctggcggcagcgcaaaagatg

SEQ ID NO: 163879 - DNA, 103 bp, Artificial Sequence
  Synthetic Polynucleotide
taatacgactcactatagggaaatcaactctgcaagttcttctatatattaacagaggagaaatataatgaagaacttgaacctggcggcagcgcaaaagatg

SEQ ID NO: 163880 - DNA, 103 bp, Artificial Sequence
  Synthetic Polynucleotide
taatacgactcactatagggtgctttgtgaggggctgttcattttgagtgaacagaggagacactcaatgtgaacagccaacctggcggcagcgcaaaagatg

SEQ ID NO: 163881 - DNA, 103 bp, Artificial Sequence
  Synthetic Polynucleotide
taatacgactcactatagggatgccagggctgctttgtgaggggctgttcaacagaggagagaacagatgctcacaaagaacctggcggcagcgcaaaagatg

SEQ ID NO: 163882 - DNA, 103 bp, Artificial Sequence
  Synthetic Polynucleotide
taatacgactcactatagggtcctggattcatgccagggctgctttgtgaaacagaggagatcacaaatgagccctggcaacctggcggcagcgcaaaagatg

SEQ ID NO: 163883 - DNA, 103 bp, Artificial Sequence
  Synthetic Polynucleotide
taatacgactcactatagggaggtgggctgtcctggattcatgccagggcaacagaggagagccctgatgtgaatccagaacctggcggcagcgcaaaagatg

SEQ ID NO: 163884 - DNA, 103 bp, Artificial Sequence
  Synthetic Polynucleotide
taatacgactcactataggggaaagcatggaggtgggctgtcctggattcaacagaggagagaatccatgacagcccacaacctggcggcagcgcaaaagatg

SEQ ID NO: 163885 - DNA, 103 bp, Artificial Sequence
  Synthetic Polynucleotide
taatacgactcactatagggatgccttggtgaaagcatggaggtgggctgaacagaggagacagcccatgtccatgcttaacctggcggcagcgcaaaagatg

SEQ ID NO: 163886 - DNA, 103 bp, Artificial Sequence
  Synthetic Polynucleotide
taatacgactcactatagggggctcatgcgatgccttggtgaaagcatggaacagaggagaccatgcatgcaccaaggcaacctggcggcagcgcaaaagatg

SEQ ID NO: 163887 - DNA, 103 bp, Artificial Sequence
  Synthetic Polynucleotide
taatacgactcactataggggccactccagggctcatgcgatgccttggtaacagaggagaaccaagatgtcgcatgagaacctggcggcagcgcaaaagatg

SEQ ID NO: 163888 - DNA, 103 bp, Artificial Sequence
  Synthetic Polynucleotide
taatacgactcactatagggagggctgccagccactccagggctcatgcgaacagaggagacgcatgatgcctggagtgaacctggcggcagcgcaaaagatg

SEQ ID NO: 163889 - DNA, 103 bp, Artificial Sequence
  Synthetic Polynucleotide
taatacgactcactataggggtgggattcgagggctgccagccactccagaacagaggagactggagatgctggcagccaacctggcggcagcgcaaaagatg

SEQ ID NO: 163890 - DNA, 103 bp, Artificial Sequence
  Synthetic Polynucleotide
taatacgactcactatagggaaatttgcaaaaatcaactctgcaagttctaacagaggagaagaactatgagagttgataacctggcggcagcgcaaaagatg

SEQ ID NO: 163891 - DNA, 103 bp, Artificial Sequence
  Synthetic Polynucleotide
taatacgactcactatagggaactgactgggtgggattcgagggctgccaaacagaggagatggcagatgtcgaatcccaacctggcggcagcgcaaaagatg

SEQ ID NO: 163892 - DNA, 103 bp, Artificial Sequence
  Synthetic Polynucleotide
taatacgactcactatagggtgcaggggaaaactgactgggtgggattcgaacagaggagacgaatcatgcccagtcagaacctggcggcagcgcaaaagatg

SEQ ID NO: 163893 - DNA, 103 bp, Artificial Sequence
  Synthetic Polynucleotide
taatacgactcactataggggcaagcttcctgcaggggaaaactgactggaacagaggagaccagtcatgtttcccctgaacctggcggcagcgcaaaagatg

SEQ ID NO: 163894 - DNA, 103 bp, Artificial Sequence
  Synthetic Polynucleotide
taatacgactcactatagggacaggggaatgcaagcttcctgcaggggaaaacagaggagattccccatgaggaagcttaacctggcggcagcgcaaaagatg

SEQ ID NO: 163895 - DNA, 103 bp, Artificial Sequence
  Synthetic Polynucleotide
taatacgactcactataggggcaaactcccacaggggaatgcaagcttccaacagaggagaggaagcatgcattcccctaacctggcggcagcgcaaaagatg

SEQ ID NO: 163896 - DNA, 103 bp, Artificial Sequence
  Synthetic Polynucleotide
taatacgactcactatagggctgtgctgctgcaaactcccacaggggaataacagaggagaattcccatgtgggagtttaacctggcggcagcgcaaaagatg

SEQ ID NO: 163897 - DNA, 103 bp, Artificial Sequence
  Synthetic Polynucleotide
taatacgactcactatagggtggctatttcctgtgctgctgcaaactcccaacagaggagagggagtatgcagcagcacaacctggcggcagcgcaaaagatg

SEQ ID NO: 163898 - DNA, 103 bp, Artificial Sequence
  Synthetic Polynucleotide
taatacgactcactatagggggtataactatggctatttcctgtgctgctaacagaggagaagcagcatgggaaatagcaacctggcggcagcgcaaaagatg

SEQ ID NO: 163899 - DNA, 103 bp, Artificial Sequence
  Synthetic Polynucleotide
taatacgactcactataggggggagctgttggtataactatggctatttcaacagaggagagaaataatgatagttataaacctggcggcagcgcaaaagatg

SEQ ID NO: 163900 - DNA, 103 bp, Artificial Sequence
  Synthetic Polynucleotide
taatacgactcactatagggagtgcattgagggagctgttggtataactaaacagaggagatagttaatgcaacagctcaacctggcggcagcgcaaaagatg

SEQ ID NO: 163901 - DNA, 103 bp, Artificial Sequence
  Synthetic Polynucleotide
taatacgactcactatagggtatatcattaaaatttgcaaaaatcaactcaacagaggagagagttgatgtttgcaaataacctggcggcagcgcaaaagatg

SEQ ID NO: 163902 - DNA, 103 bp, Artificial Sequence
  Synthetic Polynucleotide
taatacgactcactataggggagggcctgaagtgcattgagggagctgttaacagaggagaaacagcatgctcaatgcaaacctggcggcagcgcaaaagatg

SEQ ID NO: 163903 - DNA, 103 bp, Artificial Sequence
  Synthetic Polynucleotide
taatacgactcactataggggcccctcgctgagggcctgaagtgcattgaaacagaggagatcaatgatgttcaggcccaacctggcggcagcgcaaaagatg

SEQ ID NO: 163904 - DNA, 103 bp, Artificial Sequence
  Synthetic Polynucleotide
taatacgactcactataggggagaccccgtgcccctcgctgagggcctgaaacagaggagatcaggcatgcagcgagggaacctggcggcagcgcaaaagatg

SEQ ID NO: 163905 - DNA, 103 bp, Artificial Sequence
  Synthetic Polynucleotide
taatacgactcactatagggtgaccctaatgagaccccgtgcccctcgctaacagaggagaagcgagatgcacggggtcaacctggcggcagcgcaaaagatg

SEQ ID NO: 163906 - DNA, 103 bp, Artificial Sequence
  Synthetic Polynucleotide
taatacgactcactatagggaagccaacgatgaccctaatgagaccccgtaacagaggagaacggggatgcattagggtaacctggcggcagcgcaaaagatg

SEQ ID NO: 163907 - DNA, 103 bp, Artificial Sequence
  Synthetic Polynucleotide
taatacgactcactatagggaggtctggtgaagccaacgatgaccctaataacagaggagaattaggatgatcgttggcaacctggcggcagcgcaaaagatg

SEQ ID NO: 163908 - DNA, 103 bp, Artificial Sequence
  Synthetic Polynucleotide
taatacgactcactataggggcccatttttaggtctggtgaagccaacgaaacagaggagatcgttgatgtcaccagacaacctggcggcagcgcaaaagatg

SEQ ID NO: 163909 - DNA, 103 bp, Artificial Sequence
  Synthetic Polynucleotide
taatacgactcactatagggtttgcaaattgcccatttttaggtctggtgaacagaggagacaccagatgtaaaaatggaacctggcggcagcgcaaaagatg

SEQ ID NO: 163910 - DNA, 103 bp, Artificial Sequence
  Synthetic Polynucleotide
taatacgactcactatagggactggggagttttgcaaattgcccatttttaacagaggagaaaaaatatgcaatttgcaaacctggcggcagcgcaaaagatg

SEQ ID NO: 163911 - DNA, 103 bp, Artificial Sequence
  Synthetic Polynucleotide
taatacgactcactatagggattcatattaactggggagttttgcaaattaacagaggagaaatttgatgaactccccaaacctggcggcagcgcaaaagatg

SEQ ID NO: 163912 - DNA, 103 bp, Artificial Sequence
  Synthetic Polynucleotide
taatacgactcactatagggtaaagttgtctatatcattaaaatttgcaaaacagaggagattgcaaatgttaatgataaacctggcggcagcgcaaaagatg

SEQ ID NO: 163913 - DNA, 103 bp, Artificial Sequence
  Synthetic Polynucleotide
taatacgactcactataggggtgggggaggattcatattaactggggagtaacagaggagaactcccatgttaatatgaaacctggcggcagcgcaaaagatg

SEQ ID NO: 163914 - DNA, 103 bp, Artificial Sequence
  Synthetic Polynucleotide
taatacgactcactatagggatcttgctgagtgggggaggattcatattaaacagaggagataatatatgtcctcccccaacctggcggcagcgcaaaagatg

SEQ ID NO: 163915 - DNA, 103 bp, Artificial Sequence
  Synthetic Polynucleotide
taatacgactcactatagggcaagcttcccatcttgctgagtgggggaggaacagaggagacctcccatgctcagcaagaacctggcggcagcgcaaaagatg

SEQ ID NO: 163916 - DNA, 103 bp, Artificial Sequence
  Synthetic Polynucleotide
taatacgactcactatagggcttttgagtccaagcttcccatcttgctgaaacagaggagatcagcaatgtgggaagctaacctggcggcagcgcaaaagatg

SEQ ID NO: 163917 - DNA, 103 bp, Artificial Sequence
  Synthetic Polynucleotide
taatacgactcactatagggccaaaacagtcttttgagtccaagcttcccaacagaggagagggaagatgggactcaaaaacctggcggcagcgcaaaagatg

SEQ ID NO: 163918 - DNA, 103 bp, Artificial Sequence
  Synthetic Polynucleotide
taatacgactcactatagggcccatatagtccaaaacagtcttttgagtcaacagaggagagactcaatggactgttttaacctggcggcagcgcaaaagatg

SEQ ID NO: 163919 - DNA, 103 bp, Artificial Sequence
  Synthetic Polynucleotide
taatacgactcactatagggcagagggctccccatatagtccaaaacagtaacagaggagaactgttatggactatatgaacctggcggcagcgcaaaagatg

SEQ ID NO: 163920 - DNA, 103 bp, Artificial Sequence
  Synthetic Polynucleotide
taatacgactcactataggggttgtaccttcagagggctccccatatagtaacagaggagaactataatgggagccctcaacctggcggcagcgcaaaagatg

SEQ ID NO: 163921 - DNA, 103 bp, Artificial Sequence
  Synthetic Polynucleotide
taatacgactcactatagggtgcttgtccagttgtaccttcagagggctcaacagaggagagagcccatggaaggtacaaacctggcggcagcgcaaaagatg

SEQ ID NO: 163922 - DNA, 103 bp, Artificial Sequence
  Synthetic Polynucleotide
taatacgactcactatagggagctgctctctgcttgtccagttgtaccttaacagaggagaaaggtaatgctggacaagaacctggcggcagcgcaaaagatg

SEQ ID NO: 163923 - DNA, 103 bp, Artificial Sequence
  Synthetic Polynucleotide
taatacgactcactatagggggtttgaagttaaagttgtctatatcattaaacagaggagataatgaatgagacaacttaacctggcggcagcgcaaaagatg

SEQ ID NO: 163924 - DNA, 103 bp, Artificial Sequence
  Synthetic Polynucleotide
taatacgactcactatagggccaggatggcagctgctctctgcttgtccaaacagaggagatggacaatgagagagcagaacctggcggcagcgcaaaagatg

SEQ ID NO: 163925 - DNA, 103 bp, Artificial Sequence
  Synthetic Polynucleotide
taatacgactcactatagggcttttgctctccaggatggcagctgctctcaacagaggagagagagcatgtgccatcctaacctggcggcagcgcaaaagatg

SEQ ID NO: 163926 - DNA, 103 bp, Artificial Sequence
  Synthetic Polynucleotide
taatacgactcactatagggcatttgtttccttttgctctccaggatggcaacagaggagagccatcatggagagcaaaaacctggcggcagcgcaaaagatg

SEQ ID NO: 163927 - DNA, 103 bp, Artificial Sequence
  Synthetic Polynucleotide
taatacgactcactatagggaggttggggtcatttgtttccttttgctctaacagaggagaagagcaatgggaaacaaaaacctggcggcagcgcaaaagatg

SEQ ID NO: 163928 - DNA, 103 bp, Artificial Sequence
  Synthetic Polynucleotide
taatacgactcactatagggggccgggggcaggttggggtcatttgtttcaacagaggagagaaacaatggaccccaacaacctggcggcagcgcaaaagatg

SEQ ID NO: 163929 - DNA, 103 bp, Artificial Sequence
  Synthetic Polynucleotide
taatacgactcactatagggcactgctcacggccgggggcaggttggggtaacagaggagaaccccaatgtgcccccggaacctggcggcagcgcaaaagatg

SEQ ID NO: 163930 - DNA, 103 bp, Artificial Sequence
  Synthetic Polynucleotide
taatacgactcactatagggtcagctctctcactgctcacggccgggggcaacagaggagagcccccatgcgtgagcagaacctggcggcagcgcaaaagatg

SEQ ID NO: 163931 - DNA, 103 bp, Artificial Sequence
  Synthetic Polynucleotide
taatacgactcactataggggctctgcccgtcagctctctcactgctcacaacagaggagagtgagcatggagagagctaacctggcggcagcgcaaaagatg

SEQ ID NO: 163932 - DNA, 103 bp, Artificial Sequence
  Synthetic Polynucleotide
taatacgactcactatagggcatgcagtctgctctgcccgtcagctctctaacagaggagaagagagatgacgggcagaaacctggcggcagcgcaaaagatg

SEQ ID NO: 163933 - DNA, 103 bp, Artificial Sequence
  Synthetic Polynucleotide
taatacgactcactatagggcctttgctgtcatgcagtctgctctgcccgaacagaggagacgggcaatgcagactgcaaacctggcggcagcgcaaaagatg

SEQ ID NO: 163934 - DNA, 103 bp, Artificial Sequence
  Synthetic Polynucleotide
taatacgactcactatagggacatttgtcaggtttgaagttaaagttgtcaacagaggagagacaacatgaacttcaaaaacctggcggcagcgcaaaagatg

SEQ ID NO: 163935 - DNA, 103 bp, Artificial Sequence
  Synthetic Polynucleotide
taatacgactcactatagggtttggtctgccctttgctgtcatgcagtctaacagaggagaagactgatggacagcaaaaacctggcggcagcgcaaaagatg

SEQ ID NO: 163936 - DNA, 103 bp, Artificial Sequence
  Synthetic Polynucleotide
taatacgactcactataggggctgcaggagtttggtctgccctttgctgtaacagaggagaacagcaatgggcagaccaaacctggcggcagcgcaaaagatg

SEQ ID NO: 163937 - DNA, 103 bp, Artificial Sequence
  Synthetic Polynucleotide
taatacgactcactataggggtggtcagcagctgcaggagtttggtctgcaacagaggagagcagacatgactcctgcaaacctggcggcagcgcaaaagatg

SEQ ID NO: 163938 - DNA, 103 bp, Artificial Sequence
  Synthetic Polynucleotide
taatacgactcactatagggatcagatttggtggtcagcagctgcaggagaacagaggagactcctgatgctgctgaccaacctggcggcagcgcaaaagatg

SEQ ID NO: 163939 - DNA, 103 bp, Artificial Sequence
  Synthetic Polynucleotide
taatacgactcactataggggctccatctgatcagatttggtggtcagcaaacagaggagatgctgaatgccaaatctgaacctggcggcagcgcaaaagatg

SEQ ID NO: 163940 - DNA, 103 bp, Artificial Sequence
  Synthetic Polynucleotide
taatacgactcactatagggaagggcgagggctccatctgatcagatttgaacagaggagacaaatcatgtcagatggaaacctggcggcagcgcaaaagatg

SEQ ID NO: 163941 - DNA, 103 bp, Artificial Sequence
  Synthetic Polynucleotide
taatacgactcactatagggagagctggctaagggcgagggctccatctgaacagaggagacagatgatgccctcgcccaacctggcggcagcgcaaaagatg

SEQ ID NO: 163942 - DNA, 103 bp, Artificial Sequence
  Synthetic Polynucleotide
taatacgactcactatagggtatccgacaaagagctggctaagggcgaggaacagaggagacctcgcatgtagccagctaacctggcggcagcgcaaaagatg

SEQ ID NO: 163943 - DNA, 103 bp, Artificial Sequence
  Synthetic Polynucleotide
taatacgactcactatagggtctttgtttgtatccgacaaagagctggctaacagaggagaagccagatgtttgtcggaaacctggcggcagcgcaaaagatg

SEQ ID NO: 163944 - DNA, 103 bp, Artificial Sequence
  Synthetic Polynucleotide
taatacgactcactatagggacctgtggagtctttgtttgtatccgacaaaacagaggagattgtcgatgacaaacaaaaacctggcggcagcgcaaaagatg

SEQ ID NO: 163945 - DNA, 103 bp, Artificial Sequence
  Synthetic Polynucleotide
taatacgactcactatagggccctggaggggtcagaggtattttctcccaaacagaggagatgggagatgatacctctgaacctggcggcagcgcaaaagatg

SEQ ID NO: 163946 - DNA, 103 bp, Artificial Sequence
  Synthetic Polynucleotide
taatacgactcactatagggttaagattgcacatttgtcaggtttgaagtaacagaggagaacttcaatgctgacaaataacctggcggcagcgcaaaagatg

SEQ ID NO: 163947 - DNA, 103 bp, Artificial Sequence
  Synthetic Polynucleotide
taatacgactcactatagggcaggcaagctacctgtggagtctttgtttgaacagaggagacaaacaatgactccacagaacctggcggcagcgcaaaagatg

SEQ ID NO: 163948 - DNA, 103 bp, Artificial Sequence
  Synthetic Polynucleotide
taatacgactcactataggggacccagaaccaggcaagctacctgtggagaacagaggagactccacatgtagcttgccaacctggcggcagcgcaaaagatg

SEQ ID NO: 163949 - DNA, 103 bp, Artificial Sequence
  Synthetic Polynucleotide
taatacgactcactatagggtccatgtgtagacccagaaccaggcaagctaacagaggagaagcttgatgggttctgggaacctggcggcagcgcaaaagatg

SEQ ID NO: 163950 - DNA, 103 bp, Artificial Sequence
  Synthetic Polynucleotide
taatacgactcactatagggtgagcgaggttccatgtgtagacccagaacaacagaggagagttctgatgctacacatgaacctggcggcagcgcaaaagatg

SEQ ID NO: 163951 - DNA, 103 bp, Artificial Sequence
  Synthetic Polynucleotide
taatacgactcactatagggtgcttctccttgagcgaggttccatgtgtaaacagaggagatacacaatgaacctcgctaacctggcggcagcgcaaaagatg

SEQ ID NO: 163952 - DNA, 103 bp, Artificial Sequence
  Synthetic Polynucleotide
taatacgactcactatagggcaaaattttatgcttctccttgagcgaggtaacagaggagaacctcgatgaaggagaagaacctggcggcagcgcaaaagatg

SEQ ID NO: 163953 - DNA, 103 bp, Artificial Sequence
  Synthetic Polynucleotide
taatacgactcactatagggagagtctgtgcaaaattttatgcttctcctaacagaggagaaggagaatgataaaatttaacctggcggcagcgcaaaagatg

SEQ ID NO: 163954 - DNA, 103 bp, Artificial Sequence
  Synthetic Polynucleotide
taatacgactcactatagggctgtcctgcaagagtctgtgcaaaattttaaacagaggagataaaatatggcacagactaacctggcggcagcgcaaaagatg

SEQ ID NO: 163955 - DNA, 103 bp, Artificial Sequence
  Synthetic Polynucleotide
taatacgactcactatagggaggggaactgctgtcctgcaagagtctgtgaacagaggagacacagaatgttgcaggacaacctggcggcagcgcaaaagatg

SEQ ID NO: 163956 - DNA, 103 bp, Artificial Sequence
  Synthetic Polynucleotide
taatacgactcactatagggccaagtccacaggggaactgctgtcctgcaaacagaggagatgcaggatggcagttcccaacctggcggcagcgcaaaagatg

SEQ ID NO: 163957 - DNA, 103 bp, Artificial Sequence
  Synthetic Polynucleotide
taatacgactcactatagggacagtttcttttaagattgcacatttgtcaaacagaggagatgacaaatgtgcaatcttaacctggcggcagcgcaaaagatg

SEQ ID NO: 163958 - DNA, 103 bp, Artificial Sequence
  Synthetic Polynucleotide
taatacgactcactataggggttaacttggccaagtccacaggggaactgaacagaggagacagttcatgtgtggacttaacctggcggcagcgcaaaagatg

SEQ ID NO: 163959 - DNA, 103 bp, Artificial Sequence
  Synthetic Polynucleotide
taatacgactcactatagggggcttctgctgttaacttggccaagtccacaacagaggagagtggacatggccaagttaaacctggcggcagcgcaaaagatg

SEQ ID NO: 163960 - DNA, 103 bp, Artificial Sequence
  Synthetic Polynucleotide
taatacgactcactatagggctttgcctgtggcttctgctgttaacttggaacagaggagaccaagtatgcagcagaagaacctggcggcagcgcaaaagatg

SEQ ID NO: 163961 - DNA, 103 bp, Artificial Sequence
  Synthetic Polynucleotide
taatacgactcactatagggtggctcaggtctttgcctgtggcttctgctaacagaggagaagcagaatgcacaggcaaaacctggcggcagcgcaaaagatg

SEQ ID NO: 163962 - DNA, 103 bp, Artificial Sequence
  Synthetic Polynucleotide
taatacgactcactataggggctggactcctggctcaggtctttgcctgtaacagaggagaacaggcatggacctgagcaacctggcggcagcgcaaaagatg

SEQ ID NO: 163963 - DNA, 103 bp, Artificial Sequence
  Synthetic Polynucleotide
taatacgactcactataggggagctgtgctgctggactcctggctcaggtaacagaggagaacctgaatgaggagtccaaacctggcggcagcgcaaaagatg

SEQ ID NO: 163964 - DNA, 103 bp, Artificial Sequence
  Synthetic Polynucleotide
taatacgactcactatagggtctgatccaggagctgtgctgctggactccaacagaggagaggagtcatgcagcacagcaacctggcggcagcgcaaaagatg

SEQ ID NO: 163965 - DNA, 103 bp, Artificial Sequence
  Synthetic Polynucleotide
taatacgactcactatagggaatagtcacttctgatccaggagctgtgctaacagaggagaagcacaatgcctggatcaaacctggcggcagcgcaaaagatg

SEQ ID NO: 163966 - DNA, 103 bp, Artificial Sequence
  Synthetic Polynucleotide
taatacgactcactataggggctcttgtttaatagtcacttctgatccagaacagaggagactggatatgaagtgactaaacctggcggcagcgcaaaagatg

SEQ ID NO: 163967 - DNA, 103 bp, Artificial Sequence
  Synthetic Polynucleotide
taatacgactcactataggggggctcaccggctcttgtttaatagtcactaacagaggagaagtgacatgtaaacaagaaacctggcggcagcgcaaaagatg

SEQ ID NO: 163968 - DNA, 103 bp, Artificial Sequence
  Synthetic Polynucleotide
taatacgactcactatagggaatttgcttcacagtttcttttaagattgcaacagaggagagcaatcatgaaagaaactaacctggcggcagcgcaaaagatg

SEQ ID NO: 163969 - DNA, 103 bp, Artificial Sequence
  Synthetic Polynucleotide
taatacgactcactatagggtttcttcttggggctcaccggctcttgtttaacagaggagaaaacaaatgccggtgagcaacctggcggcagcgcaaaagatg

SEQ ID NO: 163970 - DNA, 103 bp, Artificial Sequence
  Synthetic Polynucleotide
taatacgactcactataggggtgcattctctttcttcttggggctcaccgaacagaggagacggtgaatgccaagaagaaacctggcggcagcgcaaaagatg

SEQ ID NO: 163971 - DNA, 103 bp, Artificial Sequence
  Synthetic Polynucleotide
taatacgactcactatagggtagcgaagtagtgcattctctttcttcttgaacagaggagacaagaaatgagagaatgcaacctggcggcagcgcaaaagatg

SEQ ID NO: 163972 - DNA, 103 bp, Artificial Sequence
  Synthetic Polynucleotide
taatacgactcactatagggatctagcaaatagcgaagtagtgcattctcaacagaggagagagaatatgctacttcgcaacctggcggcagcgcaaaagatg

SEQ ID NO: 163973 - DNA, 103 bp, Artificial Sequence
  Synthetic Polynucleotide
taatacgactcactatagggtatcatctttatctagcaaatagcgaagtaaacagaggagatacttcatgatttgctagaacctggcggcagcgcaaaagatg

SEQ ID NO: 163974 - DNA, 103 bp, Artificial Sequence
  Synthetic Polynucleotide
taatacgactcactatagggatatctttagtatcatctttatctagcaaaaacagaggagatttgctatgtaaagatgaaacctggcggcagcgcaaaagatg

SEQ ID NO: 163975 - DNA, 103 bp, Artificial Sequence
  Synthetic Polynucleotide
taatacgactcactatagggtggtaaaccaatatctttagtatcatctttaacagaggagaaaagatatgactaaagataacctggcggcagcgcaaaagatg

SEQ ID NO: 163976 - DNA, 103 bp, Artificial Sequence
  Synthetic Polynucleotide
taatacgactcactataggggggttatttctggtaaaccaatatctttagaacagaggagactaaagatgttggtttacaacctggcggcagcgcaaaagatg

SEQ ID NO: 163977 - DNA, 103 bp, Artificial Sequence
  Synthetic Polynucleotide
taatacgactcactatagggtcaagtttgggggttatttctggtaaaccaaacagaggagatggtttatgagaaataacaacctggcggcagcgcaaaagatg

SEQ ID NO: 163978 - DNA, 103 bp, Artificial Sequence
  Synthetic Polynucleotide
taatacgactcactataggggtccagtctctcaagtttgggggttatttcaacagaggagagaaataatgcccaaacttaacctggcggcagcgcaaaagatg

SEQ ID NO: 163979 - DNA, 103 bp, Artificial Sequence
  Synthetic Polynucleotide
taatacgactcactatagggtgatctgacgaatttgcttcacagtttcttaacagaggagaaagaaaatgtgaagcaaaaacctggcggcagcgcaaaagatg

SEQ ID NO: 163980 - DNA, 103 bp, Artificial Sequence
  Synthetic Polynucleotide
taatacgactcactatagggctgtcttactgtccagtctctcaagtttggaacagaggagaccaaacatgagagactggaacctggcggcagcgcaaaagatg

SEQ ID NO: 163981 - DNA, 103 bp, Artificial Sequence
  Synthetic Polynucleotide
taatacgactcactatagggctggcaggatctgtcttactgtccagtctcaacagaggagagagactatgcagtaagacaacctggcggcagcgcaaaagatg

SEQ ID NO: 163982 - DNA, 103 bp, Artificial Sequence
  Synthetic Polynucleotide
taatacgactcactatagggttttgtgttactggcaggatctgtcttactaacagaggagaagtaagatggatcctgccaacctggcggcagcgcaaaagatg

SEQ ID NO: 163983 - DNA, 103 bp, Artificial Sequence
  Synthetic Polynucleotide
taatacgactcactatagggttgctattaattttgtgttactggcaggataacagaggagaatcctgatggtaacacaaaacctggcggcagcgcaaaagatg

SEQ ID NO: 163984 - DNA, 103 bp, Artificial Sequence
  Synthetic Polynucleotide
taatacgactcactatagggtcagttttcattgctattaattttgtgttaaacagaggagataacacatgattaatagcaacctggcggcagcgcaaaagatg

SEQ ID NO: 163985 - DNA, 103 bp, Artificial Sequence
  Synthetic Polynucleotide
taatacgactcactatagggctcctccttctcagttttcattgctattaaaacagaggagattaataatgatgaaaactaacctggcggcagcgcaaaagatg

SEQ ID NO: 163986 - DNA, 103 bp, Artificial Sequence
  Synthetic Polynucleotide
taatacgactcactatagggcaaagctcatctcctccttctcagttttcaaacagaggagatgaaaaatgagaaggaggaacctggcggcagcgcaaaagatg

SEQ ID NO: 163987 - DNA, 103 bp, Artificial Sequence
  Synthetic Polynucleotide
taatacgactcactatagggtcaccaggctcaaagctcatctcctccttcaacagaggagagaaggaatggatgagcttaacctggcggcagcgcaaaagatg

SEQ ID NO: 163988 - DNA, 103 bp, Artificial Sequence
  Synthetic Polynucleotide
taatacgactcactataggggccaggctggtcaccaggctcaaagctcataacagaggagaatgagcatggagcctggtaacctggcggcagcgcaaaagatg

SEQ ID NO: 163989 - DNA, 103 bp, Artificial Sequence
  Synthetic Polynucleotide
taatacgactcactatagggccagctcactgccaggctggtcaccaggctaacagaggagaagcctgatgaccagcctgaacctggcggcagcgcaaaagatg

SEQ ID NO: 163990 - DNA, 103 bp, Artificial Sequence
  Synthetic Polynucleotide
taatacgactcactatagggtcttgttctttgatctgacgaatttgcttcaacagaggagagaagcaatgtcgtcagataacctggcggcagcgcaaaagatg

SEQ ID NO: 163991 - DNA, 103 bp, Artificial Sequence
  Synthetic Polynucleotide
taatacgactcactatagggtccaagttgtccagctcactgccaggctggaacagaggagaccagccatgcagtgagctaacctggcggcagcgcaaaagatg

SEQ ID NO: 163992 - DNA, 103 bp, Artificial Sequence
  Synthetic Polynucleotide
taatacgactcactatagggcaaaatctcctccaagttgtccagctcactaacagaggagaagtgagatggacaacttgaacctggcggcagcgcaaaagatg

SEQ ID NO: 163993 - DNA, 103 bp, Artificial Sequence
  Synthetic Polynucleotide
taatacgactcactataggggcaaatcatccaaaatctcctccaagttgtaacagaggagaacaactatgaggagatttaacctggcggcagcgcaaaagatg

SEQ ID NO: 163994 - DNA, 103 bp, Artificial Sequence
  Synthetic Polynucleotide
taatacgactcactatagggtgactattctgcaaatcatccaaaatctccaacagaggagaggagatatgggatgatttaacctggcggcagcgcaaaagatg

SEQ ID NO: 163995 - DNA, 103 bp, Artificial Sequence
  Synthetic Polynucleotide
taatacgactcactatagggctgtggtaattgactattctgcaaatcatcaacagaggagagatgatatgcagaatagtaacctggcggcagcgcaaaagatg

SEQ ID NO: 163996 - DNA, 103 bp, Artificial Sequence
  Synthetic Polynucleotide
taatacgactcactatagggctgggaaaagctgtggtaattgactattctaacagaggagaagaataatgaattaccacaacctggcggcagcgcaaaagatg

SEQ ID NO: 163997 - DNA, 103 bp, Artificial Sequence
  Synthetic Polynucleotide
taatacgactcactatagggggcctcgtgtctgggaaaagctgtggtaataacagaggagaattaccatggcttttcccaacctggcggcagcgcaaaagatg

SEQ ID NO: 163998 - DNA, 103 bp, Artificial Sequence
  Synthetic Polynucleotide
taatacgactcactatagggaggggcgcctggcctcgtgtctgggaaaagaacagaggagacttttcatggacacgaggaacctggcggcagcgcaaaagatg

SEQ ID NO: 163999 - DNA, 103 bp, Artificial Sequence
  Synthetic Polynucleotide
taatacgactcactatagggctgatccagcaggggcgcctggcctcgtgtaacagaggagaacacgaatgcaggcgcccaacctggcggcagcgcaaaagatg

SEQ ID NO: 164000 - DNA, 103 bp, Artificial Sequence
  Synthetic Polynucleotide
taatacgactcactatagggtgcttgtcaactgatccagcaggggcgcctaacagaggagaaggcgcatgtgctggatcaacctggcggcagcgcaaaagatg

SEQ ID NO: 164001 - DNA, 103 bp, Artificial Sequence
  Synthetic Polynucleotide
taatacgactcactatagggtgctgctttctcttgttctttgatctgacgaacagaggagacgtcagatgaaagaacaaaacctggcggcagcgcaaaagatg

SEQ ID NO: 164002 - DNA, 103 bp, Artificial Sequence
  Synthetic Polynucleotide
taatacgactcactataggggatgatggcttgcttgtcaactgatccagcaacagaggagagctggaatggttgacaagaacctggcggcagcgcaaaagatg

SEQ ID NO: 164003 - DNA, 103 bp, Artificial Sequence
  Synthetic Polynucleotide
taatacgactcactatagggtgaggtcattgatgatggcttgcttgtcaaaacagaggagattgacaatgaagccatcaaacctggcggcagcgcaaaagatg

SEQ ID NO: 164004 - DNA, 103 bp, Artificial Sequence
  Synthetic Polynucleotide
taatacgactcactataggggtgagttgcatgaggtcattgatgatggctaacagaggagaagccatatgcaatgacctaacctggcggcagcgcaaaagatg

SEQ ID NO: 164005 - DNA, 103 bp, Artificial Sequence
  Synthetic Polynucleotide
taatacgactcactataggggttttcagctgtgagttgcatgaggtcattaacagaggagaaatgacatgatgcaactcaacctggcggcagcgcaaaagatg

SEQ ID NO: 164006 - DNA, 103 bp, Artificial Sequence
  Synthetic Polynucleotide
taatacgactcactatagggtgacagggctgttttcagctgtgagttgcaaacagaggagatgcaacatgcagctgaaaaacctggcggcagcgcaaaagatg

SEQ ID NO: 164007 - DNA, 103 bp, Artificial Sequence
  Synthetic Polynucleotide
taatacgactcactatagggccaacaggtgtgacagggctgttttcagctaacagaggagaagctgaatgcagccctgtaacctggcggcagcgcaaaagatg

SEQ ID NO: 164008 - DNA, 103 bp, Artificial Sequence
  Synthetic Polynucleotide
taatacgactcactatagggtttctgggctccaacaggtgtgacagggctaacagaggagaagccctatgacacctgttaacctggcggcagcgcaaaagatg

SEQ ID NO: 164009 - DNA, 103 bp, Artificial Sequence
  Synthetic Polynucleotide
taatacgactcactataggggcagtgctgttttctgggctccaacaggtgaacagaggagacacctgatggagcccagaaacctggcggcagcgcaaaagatg

SEQ ID NO: 164010 - DNA, 103 bp, Artificial Sequence
  Synthetic Polynucleotide
taatacgactcactatagggtgtgaaattcgcagtgctgttttctgggctaacagaggagaagcccaatgaacagcactaacctggcggcagcgcaaaagatg

SEQ ID NO: 164011 - DNA, 103 bp, Artificial Sequence
  Synthetic Polynucleotide
taatacgactcactatagggaaaagtgctctgtgaaattcgcagtgctgtaacagaggagaacagcaatgcgaatttcaaacctggcggcagcgcaaaagatg

SEQ ID NO: 164012 - DNA, 103 bp, Artificial Sequence
  Synthetic Polynucleotide
taatacgactcactatagggtgttggcagctgctgctttctcttgttcttaacagaggagaaagaacatgagaaagcagaacctggcggcagcgcaaaagatg

SEQ ID NO: 164013 - DNA, 103 bp, Artificial Sequence
  Synthetic Polynucleotide
taatacgactcactataggggtgggttattaaaagtgctctgtgaaattcaacagaggagagaatttatgagagcacttaacctggcggcagcgcaaaagatg

SEQ ID NO: 164014 - DNA, 103 bp, Artificial Sequence
  Synthetic Polynucleotide
taatacgactcactatagggtgccctggtcgtgggttattaaaagtgctcaacagaggagagagcacatgtaataacccaacctggcggcagcgcaaaagatg

SEQ ID NO: 164015 - DNA, 103 bp, Artificial Sequence
  Synthetic Polynucleotide
taatacgactcactatagggcctgcccagttgccctggtcgtgggttattaacagaggagaaataacatgcgaccagggaacctggcggcagcgcaaaagatg

SEQ ID NO: 164016 - DNA, 103 bp, Artificial Sequence
  Synthetic Polynucleotide
taatacgactcactatagggttggcaataacctgcccagttgccctggtcaacagaggagagaccagatgaactgggcaaacctggcggcagcgcaaaagatg

SEQ ID NO: 164017 - DNA, 103 bp, Artificial Sequence
  Synthetic Polynucleotide
taatacgactcactatagggaaattctggtttggcaataacctgcccagtaacagaggagaactgggatggttattgccaacctggcggcagcgcaaaagatg

SEQ ID NO: 164018 - DNA, 103 bp, Artificial Sequence
  Synthetic Polynucleotide
taatacgactcactataggggtcaagtggtaaattctggtttggcaataaaacagaggagattattgatgaaccagaataacctggcggcagcgcaaaagatg

SEQ ID NO: 164019 - DNA, 103 bp, Artificial Sequence
  Synthetic Polynucleotide
taatacgactcactataggggcaatgtgatgtcaagtggtaaattctggtaacagaggagaaccagaatgtaccacttgaacctggcggcagcgcaaaagatg

SEQ ID NO: 164020 - DNA, 103 bp, Artificial Sequence
  Synthetic Polynucleotide
taatacgactcactataggggttgggctttgcaatgtgatgtcaagtggtaacagaggagaaccactatgcatcacattaacctggcggcagcgcaaaagatg

SEQ ID NO: 164021 - DNA, 103 bp, Artificial Sequence
  Synthetic Polynucleotide
taatacgactcactatagggtccagcaccagttgggctttgcaatgtgataacagaggagaatcacaatgcaaagcccaaacctggcggcagcgcaaaagatg

SEQ ID NO: 164022 - DNA, 103 bp, Artificial Sequence
  Synthetic Polynucleotide
taatacgactcactataggggtgggaaaggtccagcaccagttgggctttaacagaggagaaaagccatgctggtgctgaacctggcggcagcgcaaaagatg

SEQ ID NO: 164023 - DNA, 103 bp, Artificial Sequence
  Synthetic Polynucleotide
taatacgactcactatagggacttcatctatgttggcagctgctgctttcaacagaggagagaaagcatgagctgccaaaacctggcggcagcgcaaaagatg

SEQ ID NO: 164024 - DNA, 103 bp, Artificial Sequence
  Synthetic Polynucleotide
taatacgactcactatagggtttctgattggtgggaaaggtccagcaccaaacagaggagatggtgcatgacctttcccaacctggcggcagcgcaaaagatg

SEQ ID NO: 164025 - DNA, 103 bp, Artificial Sequence
  Synthetic Polynucleotide
taatacgactcactataggggggactactgtttctgattggtgggaaaggaacagaggagacctttcatgccaatcagaaacctggcggcagcgcaaaagatg

SEQ ID NO: 164026 - DNA, 103 bp, Artificial Sequence
  Synthetic Polynucleotide
taatacgactcactatagggtcactgagtagggactactgtttctgattgaacagaggagacaatcaatgacagtagtcaacctggcggcagcgcaaaagatg

SEQ ID NO: 164027 - DNA, 103 bp, Artificial Sequence
  Synthetic Polynucleotide
taatacgactcactatagggggctgaggtatcactgagtagggactactgaacagaggagacagtagatgctactcagtaacctggcggcagcgcaaaagatg

SEQ ID NO: 164028 - DNA, 103 bp, Artificial Sequence
  Synthetic Polynucleotide
taatacgactcactatagggcatcattcctggctgaggtatcactgagtaaacagaggagatactcaatgatacctcagaacctggcggcagcgcaaaagatg

SEQ ID NO: 164029 - DNA, 103 bp, Artificial Sequence
  Synthetic Polynucleotide
taatacgactcactatagggcttgattacccatcattcctggctgaggtaaacagaggagatacctcatgcaggaatgaaacctggcggcagcgcaaaagatg

SEQ ID NO: 164030 - DNA, 103 bp, Artificial Sequence
  Synthetic Polynucleotide
taatacgactcactatagggcctatcatcccttgattacccatcattcctaacagaggagaaggaatatggggtaatcaaacctggcggcagcgcaaaagatg

SEQ ID NO: 164031 - DNA, 103 bp, Artificial Sequence
  Synthetic Polynucleotide
taatacgactcactatagggtccttggtttcctatcatcccttgattaccaacagaggagaggtaatatggggatgataaacctggcggcagcgcaaaagatg

SEQ ID NO: 164032 - DNA, 103 bp, Artificial Sequence
  Synthetic Polynucleotide
taatacgactcactatagggtccctaaatttccttggtttcctatcatccaacagaggagaggatgaatggaaaccaagaacctggcggcagcgcaaaagatg

SEQ ID NO: 164033 - DNA, 103 bp, Artificial Sequence
  Synthetic Polynucleotide
taatacgactcactataggggtgctactgttccctaaatttccttggtttaacagaggagaaaaccaatgaaatttaggaacctggcggcagcgcaaaagatg

SEQ ID NO: 164034 - DNA, 103 bp, Artificial Sequence
  Synthetic Polynucleotide
taatacgactcactatagggtgacttctgcacttcatctatgttggcagcaacagaggagagctgccatgatagatgaaaacctggcggcagcgcaaaagatg

SEQ ID NO: 164035 - DNA, 103 bp, Artificial Sequence
  Synthetic Polynucleotide
taatacgactcactatagggaatcattcctgtgctactgttccctaaattaacagaggagaaatttaatgaacagtagcaacctggcggcagcgcaaaagatg

SEQ ID NO: 164036 - DNA, 103 bp, Artificial Sequence
  Synthetic Polynucleotide
taatacgactcactatagggcactgttaccaatcattcctgtgctactgtaacagaggagaacagtaatgcaggaatgaaacctggcggcagcgcaaaagatg

SEQ ID NO: 164037 - DNA, 103 bp, Artificial Sequence
  Synthetic Polynucleotide
taatacgactcactatagggggccgagaagcactgttaccaatcattcctaacagaggagaaggaatatgtggtaacagaacctggcggcagcgcaaaagatg

SEQ ID NO: 164038 - DNA, 103 bp, Artificial Sequence
  Synthetic Polynucleotide
taatacgactcactatagggtggcatagtaggccgagaagcactgttaccaacagaggagaggtaacatggcttctcggaacctggcggcagcgcaaaagatg

SEQ ID NO: 164039 - DNA, 103 bp, Artificial Sequence
  Synthetic Polynucleotide
taatacgactcactatagggattctccagatggcatagtaggccgagaagaacagaggagacttctcatgctactatgcaacctggcggcagcgcaaaagatg

SEQ ID NO: 164040 - DNA, 103 bp, Artificial Sequence
  Synthetic Polynucleotide
taatacgactcactatagggtgcggtgcccattctccagatggcatagtaaacagaggagatactatatgatctggagaaacctggcggcagcgcaaaagatg

SEQ ID NO: 164041 - DNA, 103 bp, Artificial Sequence
  Synthetic Polynucleotide
taatacgactcactatagggagccgaactctgcggtgcccattctccagaaacagaggagatctggaatgtgggcaccgaacctggcggcagcgcaaaagatg

SEQ ID NO: 164042 - DNA, 103 bp, Artificial Sequence
  Synthetic Polynucleotide
taatacgactcactatagggtgactctcacagccgaactctgcggtgcccaacagaggagagggcacatgagagttcggaacctggcggcagcgcaaaagatg

SEQ ID NO: 164043 - DNA, 103 bp, Artificial Sequence
  Synthetic Polynucleotide
taatacgactcactataggggcagcacaggtgactctcacagccgaactcaacagaggagagagttcatgtgtgagagtaacctggcggcagcgcaaaagatg

SEQ ID NO: 164044 - DNA, 103 bp, Artificial Sequence
  Synthetic Polynucleotide
taatacgactcactatagggactggtggtagcagcacaggtgactctcacaacagaggagagtgagaatgacctgtgctaacctggcggcagcgcaaaagatg

SEQ ID NO: 164045 - DNA, 103 bp, Artificial Sequence
  Synthetic Polynucleotide
taatacgactcactatagggaggatacatctgacttctgcacttcatctaaacagaggagatagatgatgtgcagaagtaacctggcggcagcgcaaaagatg

SEQ ID NO: 164046 - DNA, 103 bp, Artificial Sequence
  Synthetic Polynucleotide
taatacgactcactatagggggttcatggcactggtggtagcagcacaggaacagaggagacctgtgatgctaccaccaaacctggcggcagcgcaaaagatg

SEQ ID NO: 164047 - DNA, 103 bp, Artificial Sequence
  Synthetic Polynucleotide
taatacgactcactatagggtggactggccggttcatggcactggtggtaaacagaggagataccacatgtgccatgaaaacctggcggcagcgcaaaagatg

SEQ ID NO: 164048 - DNA, 103 bp, Artificial Sequence
  Synthetic Polynucleotide
taatacgactcactatagggcatacctccttggactggccggttcatggcaacagaggagagccatgatgcggccagtcaacctggcggcagcgcaaaagatg

SEQ ID NO: 164049 - DNA, 103 bp, Artificial Sequence
  Synthetic Polynucleotide
taatacgactcactatagggggttccgaatcatacctccttggactggccaacagaggagaggccagatgaaggaggtaaacctggcggcagcgcaaaagatg

SEQ ID NO: 164050 - DNA, 103 bp, Artificial Sequence
  Synthetic Polynucleotide
taatacgactcactatagggctggctgctgggttccgaatcatacctcctaacagaggagaaggaggatggattcggaaaacctggcggcagcgcaaaagatg

SEQ ID NO: 164051 - DNA, 103 bp, Artificial Sequence
  Synthetic Polynucleotide
taatacgactcactatagggcatggggatgctggctgctgggttccgaataacagaggagaattcggatgccagcagccaacctggcggcagcgcaaaagatg

SEQ ID NO: 164052 - DNA, 103 bp, Artificial Sequence
  Synthetic Polynucleotide
taatacgactcactatagggtgctgggcctcatggggatgctggctgctgaacagaggagacagcagatggcatccccaaacctggcggcagcgcaaaagatg

SEQ ID NO: 164053 - DNA, 103 bp, Artificial Sequence
  Synthetic Polynucleotide
taatacgactcactatagggccaggctggctgctgggcctcatggggatgaacagaggagacatcccatggaggcccagaacctggcggcagcgcaaaagatg

SEQ ID NO: 164054 - DNA, 103 bp, Artificial Sequence
  Synthetic Polynucleotide
taatacgactcactatagggctgtctttggccaggctggctgctgggcctaacagaggagaaggcccatgagccagcctaacctggcggcagcgcaaaagatg

SEQ ID NO: 164055 - DNA, 103 bp, Artificial Sequence
  Synthetic Polynucleotide
taatacgactcactatagggactgaagcgtctgtctttggccaggctggcaacagaggagagccagcatggccaaagacaacctggcggcagcgcaaaagatg

SEQ ID NO: 164056 - DNA, 103 bp, Artificial Sequence
  Synthetic Polynucleotide
taatacgactcactatagggcttgtctctgccctggaggggtcagaggtaaacagaggagatacctcatgcccctccagaacctggcggcagcgcaaaagatg

SEQ ID NO: 164057 - DNA, 103 bp, Artificial Sequence
  Synthetic Polynucleotide
taatacgactcactatagggtgccctgtagaggatacatctgacttctgcaacagaggagagcagaaatgagatgtatcaacctggcggcagcgcaaaagatg

SEQ ID NO: 164058 - DNA, 103 bp, Artificial Sequence
  Synthetic Polynucleotide
taatacgactcactatagggatgacctgagactgaagcgtctgtctttggaacagaggagaccaaagatggacgcttcaaacctggcggcagcgcaaaagatg

SEQ ID NO: 164059 - DNA, 103 bp, Artificial Sequence
  Synthetic Polynucleotide
taatacgactcactatagggccctatattcatgacctgagactgaagcgtaacagaggagaacgcttatgtctcaggtcaacctggcggcagcgcaaaagatg

SEQ ID NO: 164060 - DNA, 103 bp, Artificial Sequence
  Synthetic Polynucleotide
taatacgactcactatagggattcagatggccctatattcatgacctgagaacagaggagactcaggatgtgaatatagaacctggcggcagcgcaaaagatg

SEQ ID NO: 164061 - DNA, 103 bp, Artificial Sequence
  Synthetic Polynucleotide
taatacgactcactatagggttcatctctaattcagatggccctatattcaacagaggagagaatatatggccatctgaaacctggcggcagcgcaaaagatg

SEQ ID NO: 164062 - DNA, 103 bp, Artificial Sequence
  Synthetic Polynucleotide
taatacgactcactatagggtccccccatgttcatctctaattcagatggaacagaggagaccatctatgttagagatgaacctggcggcagcgcaaaagatg

SEQ ID NO: 164063 - DNA, 103 bp, Artificial Sequence
  Synthetic Polynucleotide
taatacgactcactatagggtatactgaggtccccccatgttcatctctaaacagaggagatagagaatgacatgggggaacctggcggcagcgcaaaagatg

SEQ ID NO: 164064 - DNA, 103 bp, Artificial Sequence
  Synthetic Polynucleotide
taatacgactcactatagggtgttgttggctatactgaggtccccccatgaacagaggagacatgggatgacctcagtaaacctggcggcagcgcaaaagatg

SEQ ID NO: 164065 - DNA, 103 bp, Artificial Sequence
  Synthetic Polynucleotide
taatacgactcactatagggtggaggagcttgttgttggctatactgaggaacagaggagacctcagatgagccaacaaaacctggcggcagcgcaaaagatg

SEQ ID NO: 164066 - DNA, 103 bp, Artificial Sequence
  Synthetic Polynucleotide
taatacgactcactatagggcagtctgatttggaggagcttgttgttggcaacagaggagagccaacatgaagctcctcaacctggcggcagcgcaaaagatg

SEQ ID NO: 164067 - DNA, 103 bp, Artificial Sequence
  Synthetic Polynucleotide
taatacgactcactatagggggccatggggcagtctgatttggaggagctaacagaggagaagctccatgaaatcagacaacctggcggcagcgcaaaagatg

SEQ ID NO: 164068 - DNA, 103 bp, Artificial Sequence
  Synthetic Polynucleotide
taatacgactcactataggggatgacaccctgccctgtagaggatacatcaacagaggagagatgtaatgtctacagggaacctggcggcagcgcaaaagatg

SEQ ID NO: 164069 - DNA, 103 bp, Artificial Sequence
  Synthetic Polynucleotide
taatacgactcactataggggatgctttcaggccatggggcagtctgattaacagaggagaaatcagatggccccatggaacctggcggcagcgcaaaagatg

SEQ ID NO: 164070 - DNA, 103 bp, Artificial Sequence
  Synthetic Polynucleotide
taatacgactcactatagggctataggcaggatgctttcaggccatggggaacagaggagaccccatatgctgaaagcaaacctggcggcagcgcaaaagatg

SEQ ID NO: 164071 - DNA, 103 bp, Artificial Sequence
  Synthetic Polynucleotide
taatacgactcactataggggacgcctggtctataggcaggatgctttcaaacagaggagatgaaagatgcctgcctataacctggcggcagcgcaaaagatg

SEQ ID NO: 164072 - DNA, 103 bp, Artificial Sequence
  Synthetic Polynucleotide
taatacgactcactataggggctggcaaaagacgcctggtctataggcagaacagaggagactgcctatggaccaggcgaacctggcggcagcgcaaaagatg

SEQ ID NO: 164073 - DNA, 103 bp, Artificial Sequence
  Synthetic Polynucleotide
taatacgactcactataggggcctgttttggctggcaaaagacgcctggtaacagaggagaaccaggatgcttttgccaaacctggcggcagcgcaaaagatg

SEQ ID NO: 164074 - DNA, 103 bp, Artificial Sequence
  Synthetic Polynucleotide
taatacgactcactatagggccaaatggctgcctgttttggctggcaaaaaacagaggagattttgcatgccaaaacagaacctggcggcagcgcaaaagatg

SEQ ID NO: 164075 - DNA, 103 bp, Artificial Sequence
  Synthetic Polynucleotide
taatacgactcactatagggtggagaactgccaaatggctgcctgttttgaacagaggagacaaaacatgcagccatttaacctggcggcagcgcaaaagatg

SEQ ID NO: 164076 - DNA, 103 bp, Artificial Sequence
  Synthetic Polynucleotide
taatacgactcactataggggcaagtcatctggagaactgccaaatggctaacagaggagaagccatatggcagttctcaacctggcggcagcgcaaaagatg

SEQ ID NO: 164077 - DNA, 103 bp, Artificial Sequence
  Synthetic Polynucleotide
taatacgactcactatagggtgtggacatagcaagtcatctggagaactgaacagaggagacagttcatgagatgacttaacctggcggcagcgcaaaagatg

SEQ ID NO: 164078 - DNA, 103 bp, Artificial Sequence
  Synthetic Polynucleotide
taatacgactcactatagggagctgcaggatgtggacatagcaagtcatcaacagaggagagatgacatgctatgtccaaacctggcggcagcgcaaaagatg

SEQ ID NO: 164079 - DNA, 103 bp, Artificial Sequence
  Synthetic Polynucleotide
taatacgactcactatagggcatccttgtcgatgacaccctgccctgtagaacagaggagactacagatgagggtgtcaaacctggcggcagcgcaaaagatg

SEQ ID NO: 164080 - DNA, 103 bp, Artificial Sequence
  Synthetic Polynucleotide
taatacgactcactatagggtcggagactcagctgcaggatgtggacataaacagaggagatatgtcatgatcctgcagaacctggcggcagcgcaaaagatg

SEQ ID NO: 164081 - DNA, 103 bp, Artificial Sequence
  Synthetic Polynucleotide
taatacgactcactatagggccctcatcactcggagactcagctgcaggaaacagaggagatcctgcatgtgagtctccaacctggcggcagcgcaaaagatg

SEQ ID NO: 164082 - DNA, 103 bp, Artificial Sequence
  Synthetic Polynucleotide
taatacgactcactatagggcaggagagctccctcatcactcggagactcaacagaggagagagtctatgagtgatgagaacctggcggcagcgcaaaagatg

SEQ ID NO: 164083 - DNA, 103 bp, Artificial Sequence
  Synthetic Polynucleotide
taatacgactcactatagggacagctggtccaggagagctccctcatcacaacagaggagagtgatgatggagctctccaacctggcggcagcgcaaaagatg

SEQ ID NO: 164084 - DNA, 103 bp, Artificial Sequence
  Synthetic Polynucleotide
taatacgactcactatagggaaggccagatacagctggtccaggagagctaacagaggagaagctctatgggaccagctaacctggcggcagcgcaaaagatg

SEQ ID NO: 164085 - DNA, 103 bp, Artificial Sequence
  Synthetic Polynucleotide
taatacgactcactatagggaaaattccgcaaggccagatacagctggtcaacagaggagagaccagatgtatctggccaacctggcggcagcgcaaaagatg

SEQ ID NO: 164086 - DNA, 103 bp, Artificial Sequence
  Synthetic Polynucleotide
taatacgactcactatagggccaggccatcaaaattccgcaaggccagataacagaggagaatctggatgtgcggaattaacctggcggcagcgcaaaagatg

SEQ ID NO: 164087 - DNA, 103 bp, Artificial Sequence
  Synthetic Polynucleotide
taatacgactcactatagggtcaatctcctccaggccatcaaaattccgcaacagaggagagcggaaatgtgatggcctaacctggcggcagcgcaaaagatg

SEQ ID NO: 164088 - DNA, 103 bp, Artificial Sequence
  Synthetic Polynucleotide
taatacgactcactatagggtaaggctctatcaatctcctccaggccatcaacagaggagagatggcatggaggagattaacctggcggcagcgcaaaagatg

SEQ ID NO: 164089 - DNA, 103 bp, Artificial Sequence
  Synthetic Polynucleotide
taatacgactcactatagggcgggtattcctaaggctctatcaatctcctaacagaggagaaggagaatgatagagcctaacctggcggcagcgcaaaagatg

SEQ ID NO: 164090 - DNA, 103 bp, Artificial Sequence
  Synthetic Polynucleotide
taatacgactcactatagggggccccagcgcatccttgtcgatgacacccaacagaggagagggtgtatgcgacaaggaaacctggcggcagcgcaaaagatg

SEQ ID NO: 164091 - DNA, 103 bp, Artificial Sequence
  Synthetic Polynucleotide
taatacgactcactatagggctgaccagttcgggtattcctaaggctctaaacagaggagatagagcatgaggaataccaacctggcggcagcgcaaaagatg

SEQ ID NO: 164092 - DNA, 103 bp, Artificial Sequence
  Synthetic Polynucleotide
taatacgactcactatagggttggctctggctgaccagttcgggtattccaacagaggagaggaataatggaactggtcaacctggcggcagcgcaaaagatg

SEQ ID NO: 164093 - DNA, 103 bp, Artificial Sequence
  Synthetic Polynucleotide
taatacgactcactataggggatctactgcttggctctggctgaccagttaacagaggagaaactggatggccagagccaacctggcggcagcgcaaaagatg

SEQ ID NO: 164094 - DNA, 103 bp, Artificial Sequence
  Synthetic Polynucleotide
taatacgactcactatagggaactgttctggatctactgcttggctctggaacagaggagaccagagatgagcagtagaaacctggcggcagcgcaaaagatg

SEQ ID NO: 164095 - DNA, 103 bp, Artificial Sequence
  Synthetic Polynucleotide
taatacgactcactatagggctgacttgagaactgttctggatctactgcaacagaggagagcagtaatgccagaacagaacctggcggcagcgcaaaagatg

SEQ ID NO: 164096 - DNA, 103 bp, Artificial Sequence
  Synthetic Polynucleotide
taatacgactcactatagggtgttggaatcctgacttgagaactgttctgaacagaggagacagaacatgtctcaagtcaacctggcggcagcgcaaaagatg

SEQ ID NO: 164097 - DNA, 103 bp, Artificial Sequence
  Synthetic Polynucleotide
taatacgactcactatagggtccagcatgatgttggaatcctgacttgagaacagaggagactcaagatgggattccaaaacctggcggcagcgcaaaagatg

SEQ ID NO: 164098 - DNA, 103 bp, Artificial Sequence
  Synthetic Polynucleotide
taatacgactcactatagggcgccttctgctccagcatgatgttggaatcaacagaggagagattccatgatcatgctgaacctggcggcagcgcaaaagatg

SEQ ID NO: 164099 - DNA, 103 bp, Artificial Sequence
  Synthetic Polynucleotide
taatacgactcactatagggggaaaacgggcgccttctgctccagcatgaaacagaggagatcatgcatgagcagaaggaacctggcggcagcgcaaaagatg

SEQ ID NO: 164100 - DNA, 103 bp, Artificial Sequence
  Synthetic Polynucleotide
taatacgactcactatagggtactgctgtgggaaaacgggcgccttctgcaacagaggagagcagaaatggcccgttttaacctggcggcagcgcaaaagatg

SEQ ID NO: 164101 - DNA, 103 bp, Artificial Sequence
  Synthetic Polynucleotide
taatacgactcactatagggaagcatcataggccccagcgcatccttgtcaacagaggagagacaagatggcgctggggaacctggcggcagcgcaaaagatg

SEQ ID NO: 164102 - DNA, 103 bp, Artificial Sequence
  Synthetic Polynucleotide
taatacgactcactatagggctgagatgcatactgctgtgggaaaacgggaacagaggagacccgttatgccacagcagaacctggcggcagcgcaaaagatg

SEQ ID NO: 164103 - DNA, 103 bp, Artificial Sequence
  Synthetic Polynucleotide
taatacgactcactatagggccatttgtgcctgagatgcatactgctgtgaacagaggagacacagcatgatgcatctcaacctggcggcagcgcaaaagatg

SEQ ID NO: 164104 - DNA, 103 bp, Artificial Sequence
  Synthetic Polynucleotide
taatacgactcactatagggctaccctgggccatttgtgcctgagatgcaaacagaggagatgcatcatgggcacaaataacctggcggcagcgcaaaagatg

SEQ ID NO: 164105 - DNA, 103 bp, Artificial Sequence
  Synthetic Polynucleotide
taatacgactcactataggggggagaatagctaccctgggccatttgtgcaacagaggagagcacaaatggcccagggtaacctggcggcagcgcaaaagatg

SEQ ID NO: 164106 - DNA, 103 bp, Artificial Sequence
  Synthetic Polynucleotide
taatacgactcactataggggatcttgcatgggagaatagctaccctgggaacagaggagacccaggatggctattctcaacctggcggcagcgcaaaagatg

SEQ ID NO: 164107 - DNA, 103 bp, Artificial Sequence
  Synthetic Polynucleotide
taatacgactcactatagggtgaaagtttggatcttgcatgggagaatagaacagaggagactattcatgcatgcaagaaacctggcggcagcgcaaaagatg

SEQ ID NO: 164108 - DNA, 103 bp, Artificial Sequence
  Synthetic Polynucleotide
taatacgactcactatagggtcccatggtgtgaaagtttggatcttgcataacagaggagaatgcaaatgccaaactttaacctggcggcagcgcaaaagatg

SEQ ID NO: 164109 - DNA, 103 bp, Artificial Sequence
  Synthetic Polynucleotide
taatacgactcactatagggtaggccgctgtcccatggtgtgaaagtttgaacagaggagacaaactatgacaccatggaacctggcggcagcgcaaaagatg

SEQ ID NO: 164110 - DNA, 103 bp, Artificial Sequence
  Synthetic Polynucleotide
taatacgactcactataggggtggcataactaggccgctgtcccatggtgaacagaggagacaccatatgacagcggccaacctggcggcagcgcaaaagatg

SEQ ID NO: 164111 - DNA, 103 bp, Artificial Sequence
  Synthetic Polynucleotide
taatacgactcactatagggcatacggagtgtggcataactaggccgctgaacagaggagacagcggatgagttatgccaacctggcggcagcgcaaaagatg

SEQ ID NO: 164112 - DNA, 103 bp, Artificial Sequence
  Synthetic Polynucleotide
taatacgactcactatagggcaagggcctcaagcatcataggccccagcgaacagaggagacgctggatgctatgatgcaacctggcggcagcgcaaaagatg

SEQ ID NO: 164113 - DNA, 103 bp, Artificial Sequence
  Synthetic Polynucleotide
taatacgactcactataggggtctgggctgcatacggagtgtggcataacaacagaggagagttatgatgcactccgtaaacctggcggcagcgcaaaagatg

SEQ ID NO: 164114 - DNA, 103 bp, Artificial Sequence
  Synthetic Polynucleotide
taatacgactcactatagggctgaggcccggtctgggctgcatacggagtaacagaggagaactccgatggcagcccagaacctggcggcagcgcaaaagatg

SEQ ID NO: 164115 - DNA, 103 bp, Artificial Sequence
  Synthetic Polynucleotide
taatacgactcactataggggcccgtgggcctgaggcccggtctgggctgaacagaggagacagcccatgccgggcctcaacctggcggcagcgcaaaagatg

SEQ ID NO: 164116 - DNA, 103 bp, Artificial Sequence
  Synthetic Polynucleotide
taatacgactcactatagggtctgcactaggcccgtgggcctgaggcccgaacagaggagacgggccatgggcccacggaacctggcggcagcgcaaaagatg

SEQ ID NO: 164117 - DNA, 103 bp, Artificial Sequence
  Synthetic Polynucleotide
taatacgactcactatagggtttggctggttctgcactaggcccgtgggcaacagaggagagcccacatgcctagtgcaaacctggcggcagcgcaaaagatg

SEQ ID NO: 164118 - DNA, 103 bp, Artificial Sequence
  Synthetic Polynucleotide
taatacgactcactatagggtcttagttgatttggctggttctgcactagaacagaggagactagtgatgaaccagccaaacctggcggcagcgcaaaagatg

SEQ ID NO: 164119 - DNA, 103 bp, Artificial Sequence
  Synthetic Polynucleotide
taatacgactcactataggggaagttgaagtcttagttgatttggctggtaacagaggagaaccagcatgatcaactaaaacctggcggcagcgcaaaagatg

SEQ ID NO: 164120 - DNA, 103 bp, Artificial Sequence
  Synthetic Polynucleotide
taatacgactcactatagggaggcgatgctgaagttgaagtcttagttgaaacagaggagatcaactatgacttcaactaacctggcggcagcgcaaaagatg

SEQ ID NO: 164121 - DNA, 103 bp, Artificial Sequence
  Synthetic Polynucleotide
taatacgactcactatagggctgtgcttggaggcgatgctgaagttgaagaacagaggagacttcaaatgcagcatcgcaacctggcggcagcgcaaaagatg

SEQ ID NO: 164122 - DNA, 103 bp, Artificial Sequence
  Synthetic Polynucleotide
taatacgactcactatagggggcgattctgctgtgcttggaggcgatgctaacagaggagaagcatcatgtccaagcacaacctggcggcagcgcaaaagatg

SEQ ID NO: 164123 - DNA, 103 bp, Artificial Sequence
  Synthetic Polynucleotide
taatacgactcactatagggaagaacccatcaagggcctcaagcatcataaacagaggagatatgatatgtgaggccctaacctggcggcagcgcaaaagatg

SEQ ID NO: 164124 - DNA, 103 bp, Artificial Sequence
  Synthetic Polynucleotide
taatacgactcactatagggataagtggctggcgattctgctgtgcttggaacagaggagaccaagcatggcagaatcgaacctggcggcagcgcaaaagatg

SEQ ID NO: 164125 - DNA, 103 bp, Artificial Sequence
  Synthetic Polynucleotide
taatacgactcactataggggatttgattcataagtggctggcgattctgaacagaggagacagaatatgcagccacttaacctggcggcagcgcaaaagatg

SEQ ID NO: 164126 - DNA, 103 bp, Artificial Sequence
  Synthetic Polynucleotide
taatacgactcactatagggaaacattgctgatttgattcataagtggctaacagaggagaagccacatgtgaatcaaaaacctggcggcagcgcaaaagatg

SEQ ID NO: 164127 - DNA, 103 bp, Artificial Sequence
  Synthetic Polynucleotide
taatacgactcactatagggttcacattggaaacattgctgatttgattcaacagaggagagaatcaatgcagcaatgtaacctggcggcagcgcaaaagatg

SEQ ID NO: 164128 - DNA, 103 bp, Artificial Sequence
  Synthetic Polynucleotide
taatacgactcactatagggcagagtcaagttcacattggaaacattgctaacagaggagaagcaatatgtccaatgtgaacctggcggcagcgcaaaagatg

SEQ ID NO: 164129 - DNA, 103 bp, Artificial Sequence
  Synthetic Polynucleotide
taatacgactcactatagggctccaggcctcagagtcaagttcacattggaacagaggagaccaatgatgacttgactcaacctggcggcagcgcaaaagatg

SEQ ID NO: 164130 - DNA, 103 bp, Artificial Sequence
  Synthetic Polynucleotide
taatacgactcactatagggtgtgttggtactccaggcctcagagtcaagaacagaggagacttgacatggaggcctggaacctggcggcagcgcaaaagatg

SEQ ID NO: 164131 - DNA, 103 bp, Artificial Sequence
  Synthetic Polynucleotide
taatacgactcactatagggaataggtgcctgtgttggtactccaggcctaacagaggagaaggcctatggtaccaacaaacctggcggcagcgcaaaagatg

SEQ ID NO: 164132 - DNA, 103 bp, Artificial Sequence
  Synthetic Polynucleotide
taatacgactcactatagggtctgtgcattaataggtgcctgtgttggtaaacagaggagataccaaatgaggcacctaaacctggcggcagcgcaaaagatg

SEQ ID NO: 164133 - DNA, 103 bp, Artificial Sequence
  Synthetic Polynucleotide
taatacgactcactatagggtgggccagcatctgtgcattaataggtgccaacagaggagaggcaccatgtaatgcacaaacctggcggcagcgcaaaagatg

SEQ ID NO: 164134 - DNA, 103 bp, Artificial Sequence
  Synthetic Polynucleotide
taatacgactcactatagggcactacaaagaagaacccatcaagggcctcaacagaggagagaggccatggatgggttcaacctggcggcagcgcaaaagatg

SEQ ID NO: 164135 - DNA, 103 bp, Artificial Sequence
  Synthetic Polynucleotide
taatacgactcactatagggcctctgtctctgggccagcatctgtgcattaacagaggagaaatgcaatgatgctggccaacctggcggcagcgcaaaagatg

SEQ ID NO: 164136 - DNA, 103 bp, Artificial Sequence
  Synthetic Polynucleotide
taatacgactcactatagggtcaggatttccctctgtctctgggccagcaaacagaggagatgctggatgagagacagaaacctggcggcagcgcaaaagatg

SEQ ID NO: 164137 - DNA, 103 bp, Artificial Sequence
  Synthetic Polynucleotide
taatacgactcactatagggagatgctggttcaggatttccctctgtctcaacagaggagagagacaatgggaaatcctaacctggcggcagcgcaaaagatg

SEQ ID NO: 164138 - DNA, 103 bp, Artificial Sequence
  Synthetic Polynucleotide
taatacgactcactatagggtctctgtcgaagatgctggttcaggatttcaacagaggagagaaatcatgaaccagcataacctggcggcagcgcaaaagatg

SEQ ID NO: 164139 - DNA, 103 bp, Artificial Sequence
  Synthetic Polynucleotide
taatacgactcactataggggatgcatttgtctctgtcgaagatgctggtaacagaggagaaccagcatgttcgacagaaacctggcggcagcgcaaaagatg

SEQ ID NO: 164140 - DNA, 103 bp, Artificial Sequence
  Synthetic Polynucleotide
taatacgactcactatagggtgctgttgctgatgcatttgtctctgtcgaaacagaggagatcgacaatgacaaatgcaaacctggcggcagcgcaaaagatg

SEQ ID NO: 164141 - DNA, 103 bp, Artificial Sequence
  Synthetic Polynucleotide
taatacgactcactatagggttgctgaacttgctgttgctgatgcatttgaacagaggagacaaatgatgcagcaacagaacctggcggcagcgcaaaagatg

SEQ ID NO: 164142 - DNA, 103 bp, Artificial Sequence
  Synthetic Polynucleotide
taatacgactcactatagggtcaaagttcgttgctgaacttgctgttgctaacagaggagaagcaacatgaagttcagcaacctggcggcagcgcaaaagatg

SEQ ID NO: 164143 - DNA, 103 bp, Artificial Sequence
  Synthetic Polynucleotide
taatacgactcactatagggcctctcatcatcaaagttcgttgctgaactaacagaggagaagttcaatgacgaactttaacctggcggcagcgcaaaagatg

SEQ ID NO: 164144 - DNA, 103 bp, Artificial Sequence
  Synthetic Polynucleotide
taatacgactcactatagggcaacccttgtcctctcatcatcaaagttcgaacagaggagacgaactatgatgatgagaaacctggcggcagcgcaaaagatg

SEQ ID NO: 164145 - DNA, 103 bp, Artificial Sequence
  Synthetic Polynucleotide
taatacgactcactatagggcttccaggttcactacaaagaagaacccataacagaggagaatgggtatgtctttgtagaacctggcggcagcgcaaaagatg

SEQ ID NO: 164146 - DNA, 103 bp, Artificial Sequence
  Synthetic Polynucleotide
taatacgactcactataggggtgtcatattcaacccttgtcctctcatcaaacagaggagatgatgaatggacaagggtaacctggcggcagcgcaaaagatg

SEQ ID NO: 164147 - DNA, 103 bp, Artificial Sequence
  Synthetic Polynucleotide
taatacgactcactatagggaccatgcttggtgtcatattcaacccttgtaacagaggagaacaaggatggaatatgacaacctggcggcagcgcaaaagatg

SEQ ID NO: 164148 - DNA, 103 bp, Artificial Sequence
  Synthetic Polynucleotide
taatacgactcactatagggactaggagccaccatgcttggtgtcatattaacagaggagaaatatgatgccaagcatgaacctggcggcagcgcaaaagatg

SEQ ID NO: 164149 - DNA, 103 bp, Artificial Sequence
  Synthetic Polynucleotide
taatacgactcactatagggctggcataccactaggagccaccatgcttgaacagaggagacaagcaatgtggctcctaaacctggcggcagcgcaaaagatg

SEQ ID NO: 164150 - DNA, 103 bp, Artificial Sequence
  Synthetic Polynucleotide
taatacgactcactatagggctcatagttgctggcataccactaggagccaacagaggagaggctccatgtggtatgccaacctggcggcagcgcaaaagatg

SEQ ID NO: 164151 - DNA, 103 bp, Artificial Sequence
  Synthetic Polynucleotide
taatacgactcactatagggccgagggttgctcatagttgctggcataccaacagaggagaggtatgatggcaactatgaacctggcggcagcgcaaaagatg

SEQ ID NO: 164152 - DNA, 103 bp, Artificial Sequence
  Synthetic Polynucleotide
taatacgactcactatagggcctggggaatccgagggttgctcatagttgaacagaggagacaactaatggcaaccctcaacctggcggcagcgcaaaagatg

SEQ ID NO: 164153 - DNA, 103 bp, Artificial Sequence
  Synthetic Polynucleotide
taatacgactcactatagggtgtgcatttgcctggggaatccgagggttgaacagaggagacaacccatggattccccaaacctggcggcagcgcaaaagatg

SEQ ID NO: 164154 - DNA, 103 bp, Artificial Sequence
  Synthetic Polynucleotide
taatacgactcactatagggtggaaactgctgtgcatttgcctggggaataacagaggagaattcccatggcaaatgcaaacctggcggcagcgcaaaagatg

SEQ ID NO: 164155 - DNA, 103 bp, Artificial Sequence
  Synthetic Polynucleotide
taatacgactcactatagggttggaggaaatggaaactgctgtgcatttgaacagaggagacaaatgatgagcagtttcaacctggcggcagcgcaaaagatg

SEQ ID NO: 164156 - DNA, 103 bp, Artificial Sequence
  Synthetic Polynucleotide
taatacgactcactatagggacaacgttgccttccaggttcactacaaagaacagaggagactttgtatggaacctggaaacctggcggcagcgcaaaagatg

SEQ ID NO: 164157 - DNA, 103 bp, Artificial Sequence
  Synthetic Polynucleotide
taatacgactcactatagggattccgtagtttggaggaaatggaaactgcaacagaggagagcagttatgatttcctccaacctggcggcagcgcaaaagatg

SEQ ID NO: 164158 - DNA, 103 bp, Artificial Sequence
  Synthetic Polynucleotide
taatacgactcactatagggttgctgacttattccgtagtttggaggaaaaacagaggagatttcctatgaactacggaaacctggcggcagcgcaaaagatg

SEQ ID NO: 164159 - DNA, 103 bp, Artificial Sequence
  Synthetic Polynucleotide
taatacgactcactatagggctggatcaggttgctgacttattccgtagtaacagaggagaactacgatgtaagtcagcaacctggcggcagcgcaaaagatg

SEQ ID NO: 164160 - DNA, 103 bp, Artificial Sequence
  Synthetic Polynucleotide
taatacgactcactatagggccagtaaagcctggatcaggttgctgacttaacagaggagaaagtcaatgacctgatccaacctggcggcagcgcaaaagatg

SEQ ID NO: 164161 - DNA, 103 bp, Artificial Sequence
  Synthetic Polynucleotide
taatacgactcactatagggagtcgtagccccagtaaagcctggatcaggaacagaggagacctgatatgggctttactaacctggcggcagcgcaaaagatg

SEQ ID NO: 164162 - DNA, 103 bp, Artificial Sequence
  Synthetic Polynucleotide
taatacgactcactatagggggctctggggagtcgtagccccagtaaagcaacagaggagagctttaatggggctacgaaacctggcggcagcgcaaaagatg

SEQ ID NO: 164163 - DNA, 103 bp, Artificial Sequence
  Synthetic Polynucleotide
taatacgactcactataggggacataagtgggctctggggagtcgtagccaacagaggagaggctacatgtccccagagaacctggcggcagcgcaaaagatg

SEQ ID NO: 164164 - DNA, 103 bp, Artificial Sequence
  Synthetic Polynucleotide
taatacgactcactatagggcattcggggtgacataagtgggctctggggaacagaggagaccccagatgccacttatgaacctggcggcagcgcaaaagatg

SEQ ID NO: 164165 - DNA, 103 bp, Artificial Sequence
  Synthetic Polynucleotide
taatacgactcactataggggtgtatgtgccattcggggtgacataagtgaacagaggagacacttaatgcaccccgaaaacctggcggcagcgcaaaagatg

SEQ ID NO: 164166 - DNA, 103 bp, Artificial Sequence
  Synthetic Polynucleotide
taatacgactcactatagggatgggactctgtgtatgtgccattcggggtaacagaggagaaccccgatgggcacatacaacctggcggcagcgcaaaagatg

SEQ ID NO: 164167 - DNA, 103 bp, Artificial Sequence
  Synthetic Polynucleotide
taatacgactcactatagggcttgcgctttcttgtctctgccctggagggaacagaggagaccctccatggcagagacaaacctggcggcagcgcaaaagatg

SEQ ID NO: 164168 - DNA, 103 bp, Artificial Sequence
  Synthetic Polynucleotide
taatacgactcactatagggtgacacaaacacaacgttgccttccaggttaacagaggagaaacctgatgggcaacgttaacctggcggcagcgcaaaagatg

SEQ ID NO: 164169 - DNA, 103 bp, Artificial Sequence
  Synthetic Polynucleotide
taatacgactcactatagggctgttgcatcatgggactctgtgtatgtgcaacagaggagagcacatatgcagagtcccaacctggcggcagcgcaaaagatg

SEQ ID NO: 164170 - DNA, 103 bp, Artificial Sequence
  Synthetic Polynucleotide
taatacgactcactatagggtggcctgagactgttgcatcatgggactctaacagaggagaagagtcatgtgatgcaacaacctggcggcagcgcaaaagatg

SEQ ID NO: 164171 - DNA, 103 bp, Artificial Sequence
  Synthetic Polynucleotide
taatacgactcactatagggtaggctgggttggcctgagactgttgcatcaacagaggagagatgcaatggtctcaggcaacctggcggcagcgcaaaagatg

SEQ ID NO: 164172 - DNA, 103 bp, Artificial Sequence
  Synthetic Polynucleotide
taatacgactcactataggggggggcctgataggctgggttggcctgagaaacagaggagatctcagatgaacccagccaacctggcggcagcgcaaaagatg

SEQ ID NO: 164173 - DNA, 103 bp, Artificial Sequence
  Synthetic Polynucleotide
taatacgactcactatagggttatgtcggagggggcctgataggctgggtaacagaggagaacccagatgatcaggcccaacctggcggcagcgcaaaagatg

SEQ ID NO: 164174 - DNA, 103 bp, Artificial Sequence
  Synthetic Polynucleotide
taatacgactcactataggggcccatccatttatgtcggagggggcctgaaacagaggagatcaggcatgctccgacataacctggcggcagcgcaaaagatg

SEQ ID NO: 164175 - DNA, 103 bp, Artificial Sequence
  Synthetic Polynucleotide
taatacgactcactataggggttcccctgcgcccatccatttatgtcggaaacagaggagatccgacatgaatggatggaacctggcggcagcgcaaaagatg

SEQ ID NO: 164176 - DNA, 103 bp, Artificial Sequence
  Synthetic Polynucleotide
taatacgactcactatagggttccgcccatgttcccctgcgcccatccataacagaggagaatggatatgcgcaggggaaacctggcggcagcgcaaaagatg

SEQ ID NO: 164177 - DNA, 103 bp, Artificial Sequence
  Synthetic Polynucleotide
taatacgactcactatagggaacatgctgtttccgcccatgttcccctgcaacagaggagagcagggatgcatgggcggaacctggcggcagcgcaaaagatg

SEQ ID NO: 164178 - DNA, 103 bp, Artificial Sequence
  Synthetic Polynucleotide
taatacgactcactatagggctgctgggaaaacatgctgtttccgcccataacagaggagaatgggcatgaacagcatgaacctggcggcagcgcaaaagatg

SEQ ID NO: 164179 - DNA, 103 bp, Artificial Sequence
  Synthetic Polynucleotide
taatacgactcactatagggtcacattctctgacacaaacacaacgttgcaacagaggagagcaacgatgtgtttgtgtaacctggcggcagcgcaaaagatg

SEQ ID NO: 164180 - DNA, 103 bp, Artificial Sequence
  Synthetic Polynucleotide
taatacgactcactataggggtggtggggactgctgggaaaacatgctgtaacagaggagaacagcaatgtttcccagcaacctggcggcagcgcaaaagatg

SEQ ID NO: 164181 - DNA, 103 bp, Artificial Sequence
  Synthetic Polynucleotide
taatacgactcactatagggtgcccaaagtgtggtggggactgctgggaaaacagaggagattcccaatggtccccaccaacctggcggcagcgcaaaagatg

SEQ ID NO: 164182 - DNA, 103 bp, Artificial Sequence
  Synthetic Polynucleotide
taatacgactcactataggggtttgcttgctgcccaaagtgtggtggggaaacagaggagatccccaatgcactttgggaacctggcggcagcgcaaaagatg

SEQ ID NO: 164183 - DNA, 103 bp, Artificial Sequence
  Synthetic Polynucleotide
taatacgactcactatagggacatgctggtgtttgcttgctgcccaaagtaacagaggagaactttgatgagcaagcaaaacctggcggcagcgcaaaagatg

SEQ ID NO: 164184 - DNA, 103 bp, Artificial Sequence
  Synthetic Polynucleotide
taatacgactcactatagggttgttactgtacatgctggtgtttgcttgcaacagaggagagcaagcatgcaccagcataacctggcggcagcgcaaaagatg

SEQ ID NO: 164185 - DNA, 103 bp, Artificial Sequence
  Synthetic Polynucleotide
taatacgactcactataggggatgttcatgttgttactgtacatgctggtaacagaggagaaccagcatgtacagtaacaacctggcggcagcgcaaaagatg

SEQ ID NO: 164186 - DNA, 103 bp, Artificial Sequence
  Synthetic Polynucleotide
taatacgactcactatagggtggacacattgatgttcatgttgttactgtaacagaggagaacagtaatgacatgaacaaacctggcggcagcgcaaaagatg

SEQ ID NO: 164187 - DNA, 103 bp, Artificial Sequence
  Synthetic Polynucleotide
taatacgactcactatagggttggtcgccatggacacattgatgttcatgaacagaggagacatgaaatgcaatgtgtcaacctggcggcagcgcaaaagatg

SEQ ID NO: 164188 - DNA, 103 bp, Artificial Sequence
  Synthetic Polynucleotide
taatacgactcactataggggccacctgtgttggtcgccatggacacattaacagaggagaaatgtgatgatggcgaccaacctggcggcagcgcaaaagatg

SEQ ID NO: 164189 - DNA, 103 bp, Artificial Sequence
  Synthetic Polynucleotide
taatacgactcactatagggtgctgctcatgccacctgtgttggtcgccaaacagaggagatggcgaatgacacaggtgaacctggcggcagcgcaaaagatg

SEQ ID NO: 164190 - DNA, 103 bp, Artificial Sequence
  Synthetic Polynucleotide
taatacgactcactatagggagatactgtgtcacattctctgacacaaacaacagaggagagtttgtatgagagaatgtaacctggcggcagcgcaaaagatg

SEQ ID NO: 164191 - DNA, 103 bp, Artificial Sequence
  Synthetic Polynucleotide
taatacgactcactatagggatctggttcatgctgctcatgccacctgtgaacagaggagacacaggatgcatgagcagaacctggcggcagcgcaaaagatg

SEQ ID NO: 164192 - DNA, 103 bp, Artificial Sequence
  Synthetic Polynucleotide
taatacgactcactatagggctgtcctgtcatctggttcatgctgctcataacagaggagaatgagcatgatgaaccagaacctggcggcagcgcaaaagatg

SEQ ID NO: 164193 - DNA, 103 bp, Artificial Sequence
  Synthetic Polynucleotide
taatacgactcactatagggtcatgctgatctgtcctgtcatctggttcaaacagaggagatgaaccatgtgacaggacaacctggcggcagcgcaaaagatg

SEQ ID NO: 164194 - DNA, 103 bp, Artificial Sequence
  Synthetic Polynucleotide
taatacgactcactataggggtcactgaggtcatgctgatctgtcctgtcaacagaggagagacaggatggatcagcataacctggcggcagcgcaaaagatg

SEQ ID NO: 164195 - DNA, 103 bp, Artificial Sequence
  Synthetic Polynucleotide
taatacgactcactatagggaggcacggaggtcactgaggtcatgctgataacagaggagaatcagcatgacctcagtgaacctggcggcagcgcaaaagatg

SEQ ID NO: 164196 - DNA, 103 bp, Artificial Sequence
  Synthetic Polynucleotide
taatacgactcactataggggccctgacgtaggcacggaggtcactgaggaacagaggagacctcagatgcctccgtgcaacctggcggcagcgcaaaagatg

SEQ ID NO: 164197 - DNA, 103 bp, Artificial Sequence
  Synthetic Polynucleotide
taatacgactcactatagggatggaggacagccctgacgtaggcacggagaacagaggagactccgtatgtacgtcaggaacctggcggcagcgcaaaagatg

SEQ ID NO: 164198 - DNA, 103 bp, Artificial Sequence
  Synthetic Polynucleotide
taatacgactcactatagggctcgggacccatggaggacagccctgacgtaacagaggagaacgtcaatgctgtcctccaacctggcggcagcgcaaaagatg

SEQ ID NO: 164199 - DNA, 103 bp, Artificial Sequence
  Synthetic Polynucleotide
taatacgactcactatagggcattaacctgctcgggacccatggaggacaaacagaggagatgtcctatgtgggtcccgaacctggcggcagcgcaaaagatg

SEQ ID NO: 164200 - DNA, 103 bp, Artificial Sequence
  Synthetic Polynucleotide
taatacgactcactatagggagagcaggatcattaacctgctcgggacccaacagaggagagggtccatggcaggttaaaacctggcggcagcgcaaaagatg

SEQ ID NO: 164201 - DNA, 103 bp, Artificial Sequence
  Synthetic Polynucleotide
taatacgactcactataggggttataccttagatactgtgtcacattctcaacagaggagagagaatatgacacagtataacctggcggcagcgcaaaagatg

SEQ ID NO: 164202 - DNA, 103 bp, Artificial Sequence
  Synthetic Polynucleotide
taatacgactcactataggggcctcccctcagagcaggatcattaacctgaacagaggagacaggttatggatcctgctaacctggcggcagcgcaaaagatg

SEQ ID NO: 164203 - DNA, 103 bp, Artificial Sequence
  Synthetic Polynucleotide
taatacgactcactatagggggaacaggttgcctcccctcagagcaggataacagaggagaatcctgatgtgaggggagaacctggcggcagcgcaaaagatg

SEQ ID NO: 164204 - DNA, 103 bp, Artificial Sequence
  Synthetic Polynucleotide
taatacgactcactatagggagctggtttgggaacaggttgcctcccctcaacagaggagagaggggatgcaacctgttaacctggcggcagcgcaaaagatg

SEQ ID NO: 164205 - DNA, 103 bp, Artificial Sequence
  Synthetic Polynucleotide
taatacgactcactatagggcattccaggcagctggtttgggaacaggttaacagaggagaaacctgatgccaaaccagaacctggcggcagcgcaaaagatg

SEQ ID NO: 164206 - DNA, 103 bp, Artificial Sequence
  Synthetic Polynucleotide
taatacgactcactatagggtaatcatatccattccaggcagctggtttgaacagaggagacaaaccatgtgcctggaaaacctggcggcagcgcaaaagatg

SEQ ID NO: 164207 - DNA, 103 bp, Artificial Sequence
  Synthetic Polynucleotide
taatacgactcactatagggccctcctgcttaatcatatccattccaggcaacagaggagagcctggatgggatatgataacctggcggcagcgcaaaagatg

SEQ ID NO: 164208 - DNA, 103 bp, Artificial Sequence
  Synthetic Polynucleotide
taatacgactcactatagggtgttgtgtctccctcctgcttaatcatatcaacagaggagagatatgatgaagcaggagaacctggcggcagcgcaaaagatg

SEQ ID NO: 164209 - DNA, 103 bp, Artificial Sequence
  Synthetic Polynucleotide
taatacgactcactatagggaatatttccgtgttgtgtctccctcctgctaacagaggagaagcaggatggagacacaaaacctggcggcagcgcaaaagatg

SEQ ID NO: 164210 - DNA, 103 bp, Artificial Sequence
  Synthetic Polynucleotide
taatacgactcactataggggctcttcttggttataccttagatactgtgaacagaggagacacagtatgtaaggtataaacctggcggcagcgcaaaagatg

SEQ ID NO: 164211 - DNA, 103 bp, Artificial Sequence
  Synthetic Polynucleotide
taatacgactcactatagggttgttcatcagctcttcttggttataccttaacagaggagaaaggtaatgccaagaagaaacctggcggcagcgcaaaagatg

SEQ ID NO: 164212 - DNA, 103 bp, Artificial Sequence
  Synthetic Polynucleotide
taatacgactcactatagggatatacacttttgttcatcagctcttcttgaacagaggagacaagaaatgctgatgaacaacctggcggcagcgcaaaagatg

SEQ ID NO: 164213 - DNA, 103 bp, Artificial Sequence
  Synthetic Polynucleotide
taatacgactcactataggggcaagatgctatatacacttttgttcatcaaacagaggagatgatgaatgaaagtgtataacctggcggcagcgcaaaagatg

SEQ ID NO: 164214 - DNA, 103 bp, Artificial Sequence
  Synthetic Polynucleotide
taatacgactcactatagggtccccaacatgcaagatgctatatacacttaacagaggagaaagtgtatgtagcatcttaacctggcggcagcgcaaaagatg

SEQ ID NO: 164215 - DNA, 103 bp, Artificial Sequence
  Synthetic Polynucleotide
taatacgactcactatagggttccgtgtggtccccaacatgcaagatgctaacagaggagaagcatcatgcatgttgggaacctggcggcagcgcaaaagatg

SEQ ID NO: 164216 - DNA, 103 bp, Artificial Sequence
  Synthetic Polynucleotide
taatacgactcactatagggcaggacattccttgcgctttcttgtctctgaacagaggagacagagaatggaaagcgcaaacctggcggcagcgcaaaagatg

SEQ ID NO: 164217 - DNA, 103 bp, Artificial Sequence
  Synthetic Polynucleotide
taatacgactcactatagggttttgacaaattccgtgtggtccccaacataacagaggagaatgttgatgaccacacggaacctggcggcagcgcaaaagatg

SEQ ID NO: 164218 - DNA, 103 bp, Artificial Sequence
  Synthetic Polynucleotide
taatacgactcactatagggggcagcaggtttttgacaaattccgtgtggaacagaggagaccacacatgatttgtcaaaacctggcggcagcgcaaaagatg

SEQ ID NO: 164219 - DNA, 103 bp, Artificial Sequence
  Synthetic Polynucleotide
taatacgactcactatagggtatagactttggcagcaggtttttgacaaaaacagaggagatttgtcatgaacctgctgaacctggcggcagcgcaaaagatg

SEQ ID NO: 164220 - DNA, 103 bp, Artificial Sequence
  Synthetic Polynucleotide
taatacgactcactatagggccccatttactatagactttggcagcaggtaacagaggagaacctgcatgcaaagtctaaacctggcggcagcgcaaaagatg

SEQ ID NO: 164221 - DNA, 103 bp, Artificial Sequence
  Synthetic Polynucleotide
taatacgactcactataggggaccaagatcccccatttactatagactttaacagaggagaaaagtcatgagtaaatggaacctggcggcagcgcaaaagatg

SEQ ID NO: 164222 - DNA, 103 bp, Artificial Sequence
  Synthetic Polynucleotide
taatacgactcactatagggaggttcgccagaccaagatcccccatttacaacagaggagagtaaatatgggatcttggaacctggcggcagcgcaaaagatg

SEQ ID NO: 164223 - DNA, 103 bp, Artificial Sequence
  Synthetic Polynucleotide
taatacgactcactatagggtccgcctcggaggttcgccagaccaagatcaacagaggagagatcttatgctggcgaacaacctggcggcagcgcaaaagatg

SEQ ID NO: 164224 - DNA, 103 bp, Artificial Sequence
  Synthetic Polynucleotide
taatacgactcactataggggtatggctgttccgcctcggaggttcgccaaacagaggagatggcgaatgtccgaggcgaacctggcggcagcgcaaaagatg

SEQ ID NO: 164225 - DNA, 103 bp, Artificial Sequence
  Synthetic Polynucleotide
taatacgactcactatagggacaattgaaggtatggctgttccgcctcggaacagaggagaccgaggatgaacagccataacctggcggcagcgcaaaagatg

SEQ ID NO: 164226 - DNA, 103 bp, Artificial Sequence
  Synthetic Polynucleotide
taatacgactcactatagggccagcatccgacaattgaaggtatggctgtaacagaggagaacagccatgccttcaattaacctggcggcagcgcaaaagatg

SEQ ID NO: 164227 - DNA, 103 bp, Artificial Sequence
  Synthetic Polynucleotide
taatacgactcactatagggccaagttggtcaggacattccttgcgctttaacagaggagaaaagcgatgggaatgtccaacctggcggcagcgcaaaagatg

SEQ ID NO: 164228 - DNA, 103 bp, Artificial Sequence
  Synthetic Polynucleotide
taatacgactcactatagggaaaggttttaccagcatccgacaattgaagaacagaggagacttcaaatgtcggatgctaacctggcggcagcgcaaaagatg

SEQ ID NO: 164229 - DNA, 103 bp, Artificial Sequence
  Synthetic Polynucleotide
taatacgactcactatagggtgaatcaggtaaaggttttaccagcatccgaacagaggagacggatgatggtaaaacctaacctggcggcagcgcaaaagatg

SEQ ID NO: 164230 - DNA, 103 bp, Artificial Sequence
  Synthetic Polynucleotide
taatacgactcactatagggcctcctcttctgaatcaggtaaaggttttaaacagaggagataaaacatgtacctgattaacctggcggcagcgcaaaagatg

SEQ ID NO: 164231 - DNA, 103 bp, Artificial Sequence
  Synthetic Polynucleotide
taatacgactcactatagggttatcatgaccctcctcttctgaatcaggtaacagaggagaacctgaatgagaagaggaaacctggcggcagcgcaaaagatg

SEQ ID NO: 164232 - DNA, 103 bp, Artificial Sequence
  Synthetic Polynucleotide
taatacgactcactatagggagcttcctggttatcatgaccctcctcttcaacagaggagagaagagatgggtcatgataacctggcggcagcgcaaaagatg

SEQ ID NO: 164233 - DNA, 103 bp, Artificial Sequence
  Synthetic Polynucleotide
taatacgactcactatagggatttctgatgagcttcctggttatcatgacaacagaggagagtcatgatgaccaggaagaacctggcggcagcgcaaaagatg

SEQ ID NO: 164234 - DNA, 103 bp, Artificial Sequence
  Synthetic Polynucleotide
taatacgactcactatagggatagtttcatatttctgatgagcttcctggaacagaggagaccaggaatgtcatcagaaaacctggcggcagcgcaaaagatg

SEQ ID NO: 164235 - DNA, 103 bp, Artificial Sequence
  Synthetic Polynucleotide
taatacgactcactataggggaagcactgcatagtttcatatttctgatgaacagaggagacatcagatgtatgaaactaacctggcggcagcgcaaaagatg

SEQ ID NO: 164236 - DNA, 103 bp, Artificial Sequence
  Synthetic Polynucleotide
taatacgactcactataggggagagacagcgaagcactgcatagtttcataacagaggagaatgaaaatgtgcagtgctaacctggcggcagcgcaaaagatg

SEQ ID NO: 164237 - DNA, 103 bp, Artificial Sequence
  Synthetic Polynucleotide
taatacgactcactataggggactttggttgagagacagcgaagcactgcaacagaggagagcagtgatgcgctgtctcaacctggcggcagcgcaaaagatg

SEQ ID NO: 164238 - DNA, 103 bp, Artificial Sequence
  Synthetic Polynucleotide
taatacgactcactatagggggggctgggtccaagttggtcaggacattcaacagaggagagaatgtatggaccaacttaacctggcggcagcgcaaaagatg

SEQ ID NO: 164239 - DNA, 103 bp, Artificial Sequence
  Synthetic Polynucleotide
taatacgactcactatagggttctttgatggactttggttgagagacagcaacagaggagagctgtcatgcaaccaaagaacctggcggcagcgcaaaagatg

SEQ ID NO: 164240 - DNA, 103 bp, Artificial Sequence
  Synthetic Polynucleotide
taatacgactcactatagggcttctccttcttctttgatggactttggttaacagaggagaaaccaaatgccatcaaagaacctggcggcagcgcaaaagatg

SEQ ID NO: 164241 - DNA, 103 bp, Artificial Sequence
  Synthetic Polynucleotide
taatacgactcactataggggactgcaaatcttctccttcttctttgatgaacagaggagacatcaaatgagaaggagaaacctggcggcagcgcaaaagatg

SEQ ID NO: 164242 - DNA, 103 bp, Artificial Sequence
  Synthetic Polynucleotide
taatacgactcactatagggaatcaagcaggactgcaaatcttctccttcaacagaggagagaaggaatggatttgcagaacctggcggcagcgcaaaagatg

SEQ ID NO: 164243 - DNA, 103 bp, Artificial Sequence
  Synthetic Polynucleotide
taatacgactcactatagggttgccacgcaaatcaagcaggactgcaaataacagaggagaatttgcatgcctgcttgaaacctggcggcagcgcaaaagatg

SEQ ID NO: 164244 - DNA, 103 bp, Artificial Sequence
  Synthetic Polynucleotide
taatacgactcactatagggggaactcttcttgccacgcaaatcaagcagaacagaggagactgcttatgttgcgtggcaacctggcggcagcgcaaaagatg

SEQ ID NO: 164245 - DNA, 103 bp, Artificial Sequence
  Synthetic Polynucleotide
taatacgactcactatagggttccttcatgggaactcttcttgccacgcaaacagaggagatgcgtgatgagaagagttaacctggcggcagcgcaaaagatg

SEQ ID NO: 164246 - DNA, 103 bp, Artificial Sequence
  Synthetic Polynucleotide
taatacgactcactataggggaactggtctttccttcatgggaactcttcaacagaggagagaagagatgccatgaaggaacctggcggcagcgcaaaagatg

SEQ ID NO: 164247 - DNA, 103 bp, Artificial Sequence
  Synthetic Polynucleotide
taatacgactcactataggggatgagggaagaactggtctttccttcatgaacagaggagacatgaaatgaagaccagtaacctggcggcagcgcaaaagatg

SEQ ID NO: 164248 - DNA, 103 bp, Artificial Sequence
  Synthetic Polynucleotide
taatacgactcactatagggaaaactttctgatgagggaagaactggtctaacagaggagaagaccaatgcttccctcaaacctggcggcagcgcaaaagatg

SEQ ID NO: 164249 - DNA, 103 bp, Artificial Sequence
  Synthetic Polynucleotide
taatacgactcactatagggtgttccttttggggctgggtccaagttggtaacagaggagaaccaacatggacccagccaacctggcggcagcgcaaaagatg

SEQ ID NO: 164250 - DNA, 103 bp, Artificial Sequence
  Synthetic Polynucleotide
taatacgactcactatagggggcgagtagtaaaactttctgatgagggaaaacagaggagattccctatgcagaaagttaacctggcggcagcgcaaaagatg

SEQ ID NO: 164251 - DNA, 103 bp, Artificial Sequence
  Synthetic Polynucleotide
taatacgactcactatagggtggagatcctggcgagtagtaaaactttctaacagaggagaagaaagatgtactactcgaacctggcggcagcgcaaaagatg

SEQ ID NO: 164252 - DNA, 103 bp, Artificial Sequence
  Synthetic Polynucleotide
taatacgactcactataggggatcttgccttggagatcctggcgagtagtaacagaggagaactactatgcaggatctcaacctggcggcagcgcaaaagatg

SEQ ID NO: 164253 - DNA, 103 bp, Artificial Sequence
  Synthetic Polynucleotide
taatacgactcactatagggccagagacgtgatcttgccttggagatcctaacagaggagaaggatcatgaaggcaagaaacctggcggcagcgcaaaagatg

SEQ ID NO: 164254 - DNA, 103 bp, Artificial Sequence
  Synthetic Polynucleotide
taatacgactcactataggggtgctggtatccagagacgtgatcttgcctaacagaggagaaggcaaatgcacgtctctaacctggcggcagcgcaaaagatg

SEQ ID NO: 164255 - DNA, 103 bp, Artificial Sequence
  Synthetic Polynucleotide
taatacgactcactatagggtgctctcatggtgctggtatccagagacgtaacagaggagaacgtctatggataccagcaacctggcggcagcgcaaaagatg

SEQ ID NO: 164256 - DNA, 103 bp, Artificial Sequence
  Synthetic Polynucleotide
taatacgactcactataggggtttcatggctgctctcatggtgctggtataacagaggagaataccaatgccatgagagaacctggcggcagcgcaaaagatg

SEQ ID NO: 164257 - DNA, 103 bp, Artificial Sequence
  Synthetic Polynucleotide
taatacgactcactatagggtcccagcctggtttcatggctgctctcatgaacagaggagacatgagatgagccatgaaaacctggcggcagcgcaaaagatg

SEQ ID NO: 164258 - DNA, 103 bp, Artificial Sequence
  Synthetic Polynucleotide
taatacgactcactatagggtaccaggtcctcccagcctggtttcatggcaacagaggagagccatgatgccaggctggaacctggcggcagcgcaaaagatg

SEQ ID NO: 164259 - DNA, 103 bp, Artificial Sequence
  Synthetic Polynucleotide
taatacgactcactatagggtacaccttcttaccaggtcctcccagcctgaacagaggagacaggctatgaggacctggaacctggcggcagcgcaaaagatg

SEQ ID NO: 164260 - DNA, 103 bp, Artificial Sequence
  Synthetic Polynucleotide
taatacgactcactatagggcgtttttcagtgttccttttggggctgggtaacagaggagaacccagatgcaaaaggaaaacctggcggcagcgcaaaagatg

SEQ ID NO: 164261 - DNA, 103 bp, Artificial Sequence
  Synthetic Polynucleotide
taatacgactcactatagggaacttctgaatacaccttcttaccaggtccaacagaggagaggacctatgaagaaggtgaacctggcggcagcgcaaaagatg

SEQ ID NO: 164262 - DNA, 103 bp, Artificial Sequence
  Synthetic Polynucleotide
taatacgactcactatagggctgcgcatggaacttctgaatacaccttctaacagaggagaagaaggatgattcagaagaacctggcggcagcgcaaaagatg

SEQ ID NO: 164263 - DNA, 103 bp, Artificial Sequence
  Synthetic Polynucleotide
taatacgactcactatagggctccttcatgctgcgcatggaacttctgaaaacagaggagattcagaatgtccatgcgcaacctggcggcagcgcaaaagatg

SEQ ID NO: 164264 - DNA, 103 bp, Artificial Sequence
  Synthetic Polynucleotide
taatacgactcactataggggacacagattctccttcatgctgcgcatggaacagaggagaccatgcatggcatgaaggaacctggcggcagcgcaaaagatg

SEQ ID NO: 164265 - DNA, 103 bp, Artificial Sequence
  Synthetic Polynucleotide
taatacgactcactatagggcttagcataggacacagattctccttcatgaacagaggagacatgaaatggaatctgtgaacctggcggcagcgcaaaagatg

SEQ ID NO: 164266 - DNA, 103 bp, Artificial Sequence
  Synthetic Polynucleotide
taatacgactcactataggggatgatgcctcttagcataggacacagattaacagaggagaaatctgatgcctatgctaaacctggcggcagcgcaaaagatg

SEQ ID NO: 164267 - DNA, 103 bp, Artificial Sequence
  Synthetic Polynucleotide
taatacgactcactatagggagtacttcatgatgatgcctcttagcatagaacagaggagactatgcatggaggcatcaaacctggcggcagcgcaaaagatg

SEQ ID NO: 164268 - DNA, 103 bp, Artificial Sequence
  Synthetic Polynucleotide
taatacgactcactatagggtccttgtctcagtacttcatgatgatgcctaacagaggagaaggcatatgcatgaagtaaacctggcggcagcgcaaaagatg

SEQ ID NO: 164269 - DNA, 103 bp, Artificial Sequence
  Synthetic Polynucleotide
taatacgactcactatagggtgaatgccaatccttgtctcagtacttcataacagaggagaatgaagatgtgagacaagaacctggcggcagcgcaaaagatg

SEQ ID NO: 164270 - DNA, 103 bp, Artificial Sequence
  Synthetic Polynucleotide
taatacgactcactatagggtagatttgactgaatgccaatccttgtctcaacagaggagagagacaatgattggcattaacctggcggcagcgcaaaagatg

SEQ ID NO: 164271 - DNA, 103 bp, Artificial Sequence
  Synthetic Polynucleotide
taatacgactcactatagggttggttgggaggataacctgaacttgacataacagaggagaatgtcaatgtcaggttataacctggcggcagcgcaaaagatg

SEQ ID NO: 164272 - DNA, 103 bp, Artificial Sequence
  Synthetic Polynucleotide
taatacgactcactataggggactgcgaactcctgctggtggcgggtgttaacagaggagaaacaccatgcaccagcagaacctggcggcagcgcaaaagatg

SEQ ID NO: 164273 - DNA, 103 bp, Artificial Sequence
  Synthetic Polynucleotide
taatacgactcactatagggttcccttgttttgctttctttagctttcctaacagaggagaaggaaaatgaaagaaagcaacctggcggcagcgcaaaagatg

SEQ ID NO: 164274 - DNA, 103 bp, Artificial Sequence
  Synthetic Polynucleotide
taatacgactcactatagggtttcatagtattcccttgttttgctttcttaacagaggagaaagaaaatgaaacaagggaacctggcggcagcgcaaaagatg

SEQ ID NO: 164275 - DNA, 103 bp, Artificial Sequence
  Synthetic Polynucleotide
taatacgactcactatagggggaaactgcttttcatagtattcccttgttaacagaggagaaacaagatgatactatgaaacctggcggcagcgcaaaagatg

SEQ ID NO: 164276 - DNA, 103 bp, Artificial Sequence
  Synthetic Polynucleotide
taatacgactcactatagggtcgaatttctggaaactgcttttcatagtaaacagaggagatactatatgaagcagtttaacctggcggcagcgcaaaagatg

SEQ ID NO: 164277 - DNA, 103 bp, Artificial Sequence
  Synthetic Polynucleotide
taatacgactcactatagggctctttgttttcgaatttctggaaactgctaacagaggagaagcagtatgcagaaattcaacctggcggcagcgcaaaagatg

SEQ ID NO: 164278 - DNA, 103 bp, Artificial Sequence
  Synthetic Polynucleotide
taatacgactcactatagggtcttgctgttctctttgttttcgaatttctaacagaggagaagaaatatgaaaacaaagaacctggcggcagcgcaaaagatg

SEQ ID NO: 164279 - DNA, 103 bp, Artificial Sequence
  Synthetic Polynucleotide
taatacgactcactatagggctgaaatctttcttgctgttctctttgtttaacagaggagaaaacaaatggaacagcaaaacctggcggcagcgcaaaagatg

SEQ ID NO: 164280 - DNA, 103 bp, Artificial Sequence
  Synthetic Polynucleotide
taatacgactcactataggggcccaactcgctgaaatctttcttgctgttaacagaggagaaacagcatgaaagatttcaacctggcggcagcgcaaaagatg

SEQ ID NO: 164281 - DNA, 103 bp, Artificial Sequence
  Synthetic Polynucleotide
taatacgactcactataggggctcccctctgcccaactcgctgaaatcttaacagaggagaaagattatggcgagttggaacctggcggcagcgcaaaagatg

SEQ ID NO: 164282 - DNA, 103 bp, Artificial Sequence
  Synthetic Polynucleotide
taatacgactcactatagggtgaaagaccagctcccctctgcccaactcgaacagaggagacgagttatgcagaggggaaacctggcggcagcgcaaaagatg

SEQ ID NO: 164283 - DNA, 103 bp, Artificial Sequence
  Synthetic Polynucleotide
taatacgactcactataggggataatcagggactgcgaactcctgctggtaacagaggagaaccagcatgagttcgcagaacctggcggcagcgcaaaagatg

SEQ ID NO: 164284 - DNA, 103 bp, Artificial Sequence
  Synthetic Polynucleotide
taatacgactcactatagggcaatggtggctgaaagaccagctcccctctaacagaggagaagagggatgctggtctttaacctggcggcagcgcaaaagatg

SEQ ID NO: 164285 - DNA, 103 bp, Artificial Sequence
  Synthetic Polynucleotide
taatacgactcactatagggtcactcctagcaatggtggctgaaagaccaaacagaggagatggtctatgagccaccataacctggcggcagcgcaaaagatg

SEQ ID NO: 164286 - DNA, 103 bp, Artificial Sequence
  Synthetic Polynucleotide
taatacgactcactatagggaatctcatgctcactcctagcaatggtggcaacagaggagagccaccatggctaggagtaacctggcggcagcgcaaaagatg

SEQ ID NO: 164287 - DNA, 103 bp, Artificial Sequence
  Synthetic Polynucleotide
taatacgactcactatagggtaatttcagaaatctcatgctcactcctagaacagaggagactaggaatgagcatgagaaacctggcggcagcgcaaaagatg

SEQ ID NO: 164288 - DNA, 103 bp, Artificial Sequence
  Synthetic Polynucleotide
taatacgactcactatagggagcccatcaataatttcagaaatctcatgcaacagaggagagcatgaatgttctgaaataacctggcggcagcgcaaaagatg

SEQ ID NO: 164289 - DNA, 103 bp, Artificial Sequence
  Synthetic Polynucleotide
taatacgactcactatagggctgctcagagagcccatcaataatttcagaaacagaggagatctgaaatgattgatgggaacctggcggcagcgcaaaagatg

SEQ ID NO: 164290 - DNA, 103 bp, Artificial Sequence
  Synthetic Polynucleotide
taatacgactcactatagggcattattctcctgctcagagagcccatcaaaacagaggagattgatgatgtctctgagcaacctggcggcagcgcaaaagatg

SEQ ID NO: 164291 - DNA, 103 bp, Artificial Sequence
  Synthetic Polynucleotide
taatacgactcactatagggatttgtttctcattattctcctgctcagagaacagaggagactctgaatgggagaataaaacctggcggcagcgcaaaagatg

SEQ ID NO: 164292 - DNA, 103 bp, Artificial Sequence
  Synthetic Polynucleotide
taatacgactcactataggggagctgccgcatttgtttctcattattctcaacagaggagagagaatatggagaaacaaaacctggcggcagcgcaaaagatg

SEQ ID NO: 164293 - DNA, 103 bp, Artificial Sequence
  Synthetic Polynucleotide
taatacgactcactataggggaatcacagagagctgccgcatttgtttctaacagaggagaagaaacatgtgcggcagcaacctggcggcagcgcaaaagatg

SEQ ID NO: 164294 - DNA, 103 bp, Artificial Sequence
  Synthetic Polynucleotide
taatacgactcactatagggtgagaggaacgataatcagggactgcgaacaacagaggagagttcgcatgccctgattaaacctggcggcagcgcaaaagatg

SEQ ID NO: 164295 - DNA, 103 bp, Artificial Sequence
  Synthetic Polynucleotide
taatacgactcactatagggatcataggtggaatcacagagagctgccgcaacagaggagagcggcaatgctctgtgataacctggcggcagcgcaaaagatg

SEQ ID NO: 164296 - DNA, 103 bp, Artificial Sequence
  Synthetic Polynucleotide
taatacgactcactatagggtgcatcaaacatcataggtggaatcacagaaacagaggagatctgtgatgccacctatgaacctggcggcagcgcaaaagatg

SEQ ID NO: 164297 - DNA, 103 bp, Artificial Sequence
  Synthetic Polynucleotide
taatacgactcactataggggtctttgttctgcatcaaacatcataggtgaacagaggagacacctaatgtgtttgatgaacctggcggcagcgcaaaagatg

SEQ ID NO: 164298 - DNA, 103 bp, Artificial Sequence
  Synthetic Polynucleotide
taatacgactcactatagggaacttgactcgtctttgttctgcatcaaacaacagaggagagtttgaatgagaacaaagaacctggcggcagcgcaaaagatg

SEQ ID NO: 164299 - DNA, 103 bp, Artificial Sequence
  Synthetic Polynucleotide
taatacgactcactatagggcatgttaatgaacttgactcgtctttgttcaacagaggagagaacaaatgcgagtcaagaacctggcggcagcgcaaaagatg

SEQ ID NO: 164300 - DNA, 103 bp, Artificial Sequence
  Synthetic Polynucleotide
taatacgactcactatagggtaagcccattcatgttaatgaacttgactcaacagaggagagagtcaatgtcattaacaaacctggcggcagcgcaaaagatg

SEQ ID NO: 164301 - DNA, 103 bp, Artificial Sequence
  Synthetic Polynucleotide
taatacgactcactataggggggtcctccataagcccattcatgttaatgaacagaggagacattaaatggaatgggctaacctggcggcagcgcaaaagatg

SEQ ID NO: 164302 - DNA, 103 bp, Artificial Sequence
  Synthetic Polynucleotide
taatacgactcactatagggcactttcatagggtcctccataagcccattaacagaggagaaatgggatgatggaggacaacctggcggcagcgcaaaagatg

SEQ ID NO: 164303 - DNA, 103 bp, Artificial Sequence
  Synthetic Polynucleotide
taatacgactcactatagggtatctttatacactttcatagggtcctccaaacagaggagatggaggatgctatgaaagaacctggcggcagcgcaaaagatg

SEQ ID NO: 164304 - DNA, 103 bp, Artificial Sequence
  Synthetic Polynucleotide
taatacgactcactatagggataaactgcctatctttatacactttcataaacagaggagatatgaaatggtataaagaaacctggcggcagcgcaaaagatg

SEQ ID NO: 164305 - DNA, 103 bp, Artificial Sequence
  Synthetic Polynucleotide
taatacgactcactatagggcacttcaagatgagaggaacgataatcaggaacagaggagacctgatatgcgttcctctaacctggcggcagcgcaaaagatg

SEQ ID NO: 164306 - DNA, 103 bp, Artificial Sequence
  Synthetic Polynucleotide
taatacgactcactatagggccaaacattcataaactgcctatctttataaacagaggagatataaaatgaggcagtttaacctggcggcagcgcaaaagatg

SEQ ID NO: 164307 - DNA, 103 bp, Artificial Sequence
  Synthetic Polynucleotide
taatacgactcactatagggcatggtcagtccaaacattcataaactgccaacagaggagaggcagtatgtgaatgtttaacctggcggcagcgcaaaagatg

SEQ ID NO: 164308 - DNA, 103 bp, Artificial Sequence
  Synthetic Polynucleotide
taatacgactcactatagggatctccttttcatggtcagtccaaacattcaacagaggagagaatgtatggactgaccaaacctggcggcagcgcaaaagatg

SEQ ID NO: 164309 - DNA, 103 bp, Artificial Sequence
  Synthetic Polynucleotide
taatacgactcactataggggtccttaaagatctccttttcatggtcagtaacagaggagaactgacatggaaaaggagaacctggcggcagcgcaaaagatg

SEQ ID NO: 164310 - DNA, 103 bp, Artificial Sequence
  Synthetic Polynucleotide
taatacgactcactatagggggataaacttgtccttaaagatctccttttaacagaggagaaaaaggatgtctttaaggaacctggcggcagcgcaaaagatg

SEQ ID NO: 164311 - DNA, 103 bp, Artificial Sequence
  Synthetic Polynucleotide
taatacgactcactatagggtttggatgctggataaacttgtccttaaagaacagaggagactttaaatgcaagtttataacctggcggcagcgcaaaagatg

SEQ ID NO: 164312 - DNA, 103 bp, Artificial Sequence
  Synthetic Polynucleotide
taatacgactcactatagggtccaaagttttttggatgctggataaacttaacagaggagaaagtttatgcagcatccaaacctggcggcagcgcaaaagatg

SEQ ID NO: 164313 - DNA, 103 bp, Artificial Sequence
  Synthetic Polynucleotide
taatacgactcactatagggatgcaattagtccaaagttttttggatgctaacagaggagaagcatcatgaaaactttgaacctggcggcagcgcaaaagatg

SEQ ID NO: 164314 - DNA, 103 bp, Artificial Sequence
  Synthetic Polynucleotide
taatacgactcactatagggtccaagtatgatgcaattagtccaaagtttaacagaggagaaaacttatgactaattgcaacctggcggcagcgcaaaagatg

SEQ ID NO: 164315 - DNA, 103 bp, Artificial Sequence
  Synthetic Polynucleotide
taatacgactcactatagggactcttcctctccaagtatgatgcaattagaacagaggagactaattatgtcatacttgaacctggcggcagcgcaaaagatg

SEQ ID NO: 164316 - DNA, 103 bp, Artificial Sequence
  Synthetic Polynucleotide
taatacgactcactatagggatgcctgactcacttcaagatgagaggaacaacagaggagagttcctatgatcttgaagaacctggcggcagcgcaaaagatg

SEQ ID NO: 164317 - DNA, 103 bp, Artificial Sequence
  Synthetic Polynucleotide
taatacgactcactatagggaatcaggaacactcttcctctccaagtatgaacagaggagacatactatgagaggaagaaacctggcggcagcgcaaaagatg

SEQ ID NO: 164318 - DNA, 103 bp, Artificial Sequence
  Synthetic Polynucleotide
taatacgactcactatagggtacaaaacacaatcaggaacactcttcctcaacagaggagagaggaaatgtgttcctgaaacctggcggcagcgcaaaagatg

SEQ ID NO: 164319 - DNA, 103 bp, Artificial Sequence
  Synthetic Polynucleotide
taatacgactcactatagggtaaatagtaatacaaaacacaatcaggaacaacagaggagagttcctatgtgtgttttgaacctggcggcagcgcaaaagatg

SEQ ID NO: 164320 - DNA, 103 bp, Artificial Sequence
  Synthetic Polynucleotide
taatacgactcactatagggttttcttggttaaatagtaatacaaaacacaacagaggagagtgtttatgattactattaacctggcggcagcgcaaaagatg

SEQ ID NO: 164321 - DNA, 103 bp, Artificial Sequence
  Synthetic Polynucleotide
taatacgactcactatagggtaattctcatttttcttggttaaatagtaaaacagaggagattactaatgaaccaagaaaacctggcggcagcgcaaaagatg

SEQ ID NO: 164322 - DNA, 103 bp, Artificial Sequence
  Synthetic Polynucleotide
taatacgactcactataggggagggctttataattctcatttttcttggtaacagaggagaaccaagatgaatgagaataacctggcggcagcgcaaaagatg

SEQ ID NO: 164323 - DNA, 103 bp, Artificial Sequence
  Synthetic Polynucleotide
taatacgactcactatagggtccttctgacgagggctttataattctcataacagaggagaatgagaatgataaagcccaacctggcggcagcgcaaaagatg

SEQ ID NO: 164324 - DNA, 103 bp, Artificial Sequence
  Synthetic Polynucleotide
taatacgactcactatagggttcccataattccttctgacgagggctttaaacagaggagataaagcatgcgtcagaagaacctggcggcagcgcaaaagatg

SEQ ID NO: 164325 - DNA, 103 bp, Artificial Sequence
  Synthetic Polynucleotide
taatacgactcactataggggcctctgcgtttcccataattccttctgacaacagaggagagtcagaatgaattatgggaacctggcggcagcgcaaaagatg

SEQ ID NO: 164326 - DNA, 103 bp, Artificial Sequence
  Synthetic Polynucleotide
taatacgactcactataggggctggtttctgcctctgcgtttcccataataacagaggagaattatgatgaacgcagagaacctggcggcagcgcaaaagatg

SEQ ID NO: 164327 - DNA, 103 bp, Artificial Sequence
  Synthetic Polynucleotide
taatacgactcactatagggaaaagctgtgatgcctgactcacttcaagaaacagaggagatcttgaatggagtcaggcaacctggcggcagcgcaaaagatg

SEQ ID NO: 164328 - DNA, 103 bp, Artificial Sequence
  Synthetic Polynucleotide
taatacgactcactatagggcgagcaatttgctggtttctgcctctgcgtaacagaggagaacgcagatgcagaaaccaaacctggcggcagcgcaaaagatg

SEQ ID NO: 164329 - DNA, 103 bp, Artificial Sequence
  Synthetic Polynucleotide
taatacgactcactatagggttgcgagggtcgagcaatttgctggtttctaacagaggagaagaaacatgcaaattgctaacctggcggcagcgcaaaagatg

SEQ ID NO: 164330 - DNA, 103 bp, Artificial Sequence
  Synthetic Polynucleotide
taatacgactcactatagggctttttcttcttgcgagggtcgagcaatttaacagaggagaaaattgatggaccctcgcaacctggcggcagcgcaaaagatg

SEQ ID NO: 164331 - DNA, 103 bp, Artificial Sequence
  Synthetic Polynucleotide
taatacgactcactatagggttttcttctactttttcttcttgcgagggtaacagaggagaaccctcatgagaagaaaaaacctggcggcagcgcaaaagatg

SEQ ID NO: 164332 - DNA, 103 bp, Artificial Sequence
  Synthetic Polynucleotide
taatacgactcactatagggatcctcttctttttcttctactttttcttcaacagaggagagaagaaatggtagaagaaaacctggcggcagcgcaaaagatg

SEQ ID NO: 164333 - DNA, 103 bp, Artificial Sequence
  Synthetic Polynucleotide
taatacgactcactatagggtttctgctttatcctcttctttttcttctaaacagaggagatagaagatgaagaagaggaacctggcggcagcgcaaaagatg

SEQ ID NO: 164334 - DNA, 103 bp, Artificial Sequence
  Synthetic Polynucleotide
taatacgactcactatagggttttctgttttttctgctttatcctcttctaacagaggagaagaagaatgtaaagcagaaacctggcggcagcgcaaaagatg

SEQ ID NO: 164335 - DNA, 103 bp, Artificial Sequence
  Synthetic Polynucleotide
taatacgactcactatagggttcttcttttttttctgttttttctgctttaacagaggagaaaagcaatgaaaacagaaaacctggcggcagcgcaaaagatg

SEQ ID NO: 164336 - DNA, 103 bp, Artificial Sequence
  Synthetic Polynucleotide
taatacgactcactatagggctttcttttcttcttcttttttttctgtttaacagaggagaaaacagatgaaaaagaagaacctggcggcagcgcaaaagatg

SEQ ID NO: 164337 - DNA, 103 bp, Artificial Sequence
  Synthetic Polynucleotide
taatacgactcactatagggtcctcttcatctttcttttcttcttcttttaacagaggagaaaaagaatgagaaaagaaaacctggcggcagcgcaaaagatg

SEQ ID NO: 164338 - DNA, 103 bp, Artificial Sequence
  Synthetic Polynucleotide
taatacgactcactatagggctgttgctgcaaaagctgtgatgcctgactaacagaggagaagtcagatgtcacagcttaacctggcggcagcgcaaaagatg

SEQ ID NO: 164339 - DNA, 103 bp, Artificial Sequence
  Synthetic Polynucleotide
taatacgactcactatagggttcatctttttcctcttcatctttcttttcaacagaggagagaaaagatggatgaagagaacctggcggcagcgcaaaagatg

SEQ ID NO: 164340 - DNA, 103 bp, Artificial Sequence
  Synthetic Polynucleotide
taatacgactcactatagggagtcttctttttcatctttttcctcttcataacagaggagaatgaagatgaaaaagatgaacctggcggcagcgcaaaagatg

SEQ ID NO: 164341 - DNA, 103 bp, Artificial Sequence
  Synthetic Polynucleotide
taatacgactcactatagggttttctttggagtcttctttttcatcttttaacagaggagaaaaagaatgaaaagaagaaacctggcggcagcgcaaaagatg

SEQ ID NO: 164342 - DNA, 103 bp, Artificial Sequence
  Synthetic Polynucleotide
taatacgactcactatagggttccttggtattttctttggagtcttctttaacagaggagaaaagaaatgtccaaagaaaacctggcggcagcgcaaaagatg

SEQ ID NO: 164343 - DNA, 103 bp, Artificial Sequence
  Synthetic Polynucleotide
taatacgactcactatagggtcttgtccttttccttggtattttctttggaacagaggagaccaaagatgataccaaggaacctggcggcagcgcaaaagatg

SEQ ID NO: 164344 - DNA, 103 bp, Artificial Sequence
  Synthetic Polynucleotide
taatacgactcactataggggtaccatctatcttgtccttttccttggtaaacagaggagataccaaatgaaaggacaaaacctggcggcagcgcaaaagatg

SEQ ID NO: 164345 - DNA, 103 bp, Artificial Sequence
  Synthetic Polynucleotide
taatacgactcactatagggttcttctgctgtaccatctatcttgtccttaacagaggagaaaggacatgatagatggtaacctggcggcagcgcaaaagatg

SEQ ID NO: 164346 - DNA, 103 bp, Artificial Sequence
  Synthetic Polynucleotide
taatacgactcactatagggtttcctcagtttcttctgctgtaccatctaaacagaggagatagatgatgcagcagaagaacctggcggcagcgcaaaagatg

SEQ ID NO: 164347 - DNA, 103 bp, Artificial Sequence
  Synthetic Polynucleotide
taatacgactcactataggggcttgctctctttcctcagtttcttctgctaacagaggagaagcagaatgaactgaggaaacctggcggcagcgcaaaagatg

SEQ ID NO: 164348 - DNA, 103 bp, Artificial Sequence
  Synthetic Polynucleotide
taatacgactcactatagggccggggtgtggcttgctctctttcctcagtaacagaggagaactgagatgagagagcaaaacctggcggcagcgcaaaagatg

SEQ ID NO: 164349 - DNA, 103 bp, Artificial Sequence
  Synthetic Polynucleotide
taatacgactcactataggggttgctgctgctgttgctgcaaaagctgtgaacagaggagacacagcatgtgcagcaacaacctggcggcagcgcaaaagatg

SEQ ID NO: 164350 - DNA, 103 bp, Artificial Sequence
  Synthetic Polynucleotide
taatacgactcactatagggtctttcgcccccggggtgtggcttgctctcaacagaggagagagagcatgccacaccccaacctggcggcagcgcaaaagatg

SEQ ID NO: 164351 - DNA, 103 bp, Artificial Sequence
  Synthetic Polynucleotide
taatacgactcactatagggctgttggcagtctttcgcccccggggtgtgaacagaggagacacaccatgggggcgaaaaacctggcggcagcgcaaaagatg

SEQ ID NO: 164352 - DNA, 103 bp, Artificial Sequence
  Synthetic Polynucleotide
taatacgactcactataggggcggccctgactgttggcagtctttcgcccaacagaggagagggcgaatgactgccaacaacctggcggcagcgcaaaagatg

SEQ ID NO: 164353 - DNA, 103 bp, Artificial Sequence
  Synthetic Polynucleotide
taatacgactcactatagggggcccttacggcggccctgactgttggcagaacagaggagactgccaatggtcagggccaacctggcggcagcgcaaaagatg

SEQ ID NO: 164354 - DNA, 103 bp, Artificial Sequence
  Synthetic Polynucleotide
taatacgactcactatagggctggtgatccggcccttacggcggccctgaaacagaggagatcagggatgccgtaagggaacctggcggcagcgcaaaagatg

SEQ ID NO: 164355 - DNA, 103 bp, Artificial Sequence
  Synthetic Polynucleotide
taatacgactcactatagggtgtcatggacctggtgatccggcccttacgaacagaggagacgtaagatgcggatcaccaacctggcggcagcgcaaaagatg

SEQ ID NO: 164356 - DNA, 103 bp, Artificial Sequence
  Synthetic Polynucleotide
taatacgactcactatagggcagcttcgtttgtcatggacctggtgatccaacagaggagaggatcaatgggtccatgaaacctggcggcagcgcaaaagatg

SEQ ID NO: 164357 - DNA, 103 bp, Artificial Sequence
  Synthetic Polynucleotide
taatacgactcactatagggctggcagctgcagcttcgtttgtcatggacaacagaggagagtccatatgaaacgaagcaacctggcggcagcgcaaaagatg

SEQ ID NO: 164358 - DNA, 103 bp, Artificial Sequence
  Synthetic Polynucleotide
taatacgactcactatagggggctgcagcactggcagctgcagcttcgttaacagaggagaaacgaaatggcagctgccaacctggcggcagcgcaaaagatg

SEQ ID NO: 164359 - DNA, 103 bp, Artificial Sequence
  Synthetic Polynucleotide
taatacgactcactatagggtagccgctgcggctgcagcactggcagctgaacagaggagacagctgatggtgctgcagaacctggcggcagcgcaaaagatg

SEQ ID NO: 164360 - DNA, 103 bp, Artificial Sequence
  Synthetic Polynucleotide
taatacgactcactatagggcttcgaagctgttgctgctgctgttgctgcaacagaggagagcagcaatggcagcagcaaacctggcggcagcgcaaaagatg

SEQ ID NO: 164361 - DNA, 103 bp, Artificial Sequence
  Synthetic Polynucleotide
taatacgactcactatagggggctcttcagtagccgctgcggctgcagcaaacagaggagatgctgcatgcgcagcggcaacctggcggcagcgcaaaagatg

SEQ ID NO: 164362 - DNA, 103 bp, Artificial Sequence
  Synthetic Polynucleotide
taatacgactcactatagggaggtggtgggggctcttcagtagccgctgcaacagaggagagcagcgatgactgaagagaacctggcggcagcgcaaaagatg

SEQ ID NO: 164363 - DNA, 103 bp, Artificial Sequence
  Synthetic Polynucleotide
taatacgactcactataggggcggtggcagaggtggtgggggctcttcagaacagaggagactgaagatgccccaccacaacctggcggcagcgcaaaagatg

SEQ ID NO: 164364 - DNA, 103 bp, Artificial Sequence
  Synthetic Polynucleotide
taatacgactcactatagggggttctggtggcggtggcagaggtggtgggaacagaggagacccaccatgtctgccaccaacctggcggcagcgcaaaagatg

SEQ ID NO: 164365 - DNA, 103 bp, Artificial Sequence
  Synthetic Polynucleotide
taatacgactcactatagggtgtagaaatgggttctggtggcggtggcagaacagaggagactgccaatgccaccagaaaacctggcggcagcgcaaaagatg

SEQ ID NO: 164366 - DNA, 103 bp, Artificial Sequence
  Synthetic Polynucleotide
taatacgactcactatagggccacaggctctgtagaaatgggttctggtgaacagaggagacaccagatgccatttctaaacctggcggcagcgcaaaagatg

SEQ ID NO: 164367 - DNA, 103 bp, Artificial Sequence
  Synthetic Polynucleotide
taatacgactcactatagggcgagaggtctccacaggctctgtagaaatgaacagaggagacatttcatgagagcctgtaacctggcggcagcgcaaaagatg

SEQ ID NO: 164368 - DNA, 103 bp, Artificial Sequence
  Synthetic Polynucleotide
taatacgactcactatagggttctgtccatcgagaggtctccacaggctcaacagaggagagagcctatggagacctctaacctggcggcagcgcaaaagatg

SEQ ID NO: 164369 - DNA, 103 bp, Artificial Sequence
  Synthetic Polynucleotide
taatacgactcactatagggccatttcttcttctgtccatcgagaggtctaacagaggagaagacctatggatggacagaacctggcggcagcgcaaaagatg

SEQ ID NO: 164370 - DNA, 103 bp, Artificial Sequence
  Synthetic Polynucleotide
taatacgactcactatagggttagcaacttccatttcttcttctgtccataacagaggagaatggacatgagaagaaataacctggcggcagcgcaaaagatg

SEQ ID NO: 164371 - DNA, 103 bp, Artificial Sequence
  Synthetic Polynucleotide
taatacgactcactatagggggaaggtcgccttcgaagctgttgctgctgaacagaggagacagcagatgcagcttcgaaacctggcggcagcgcaaaagatg

SEQ ID NO: 164372 - DNA, 103 bp, Artificial Sequence
  Synthetic Polynucleotide
taatacgactcactatagggtagaccttttttagcaacttccatttcttcaacagaggagagaagaaatggaagttgctaacctggcggcagcgcaaaagatg

SEQ ID NO: 164373 - DNA, 103 bp, Artificial Sequence
  Synthetic Polynucleotide
taatacgactcactatagggcatgttctactagaccttttttagcaacttaacagaggagaaagttgatgaaaaaggtcaacctggcggcagcgcaaaagatg

SEQ ID NO: 164374 - DNA, 103 bp, Artificial Sequence
  Synthetic Polynucleotide
taatacgactcactatagggcagttacgaccatgttctactagaccttttaacagaggagaaaaaggatgagtagaacaaacctggcggcagcgcaaaagatg

SEQ ID NO: 164375 - DNA, 103 bp, Artificial Sequence
  Synthetic Polynucleotide
taatacgactcactatagggaattgctgcccagttacgaccatgttctacaacagaggagagtagaaatgggtcgtaacaacctggcggcagcgcaaaagatg

SEQ ID NO: 164376 - DNA, 103 bp, Artificial Sequence
  Synthetic Polynucleotide
taatacgactcactatagggccattttagcaattgctgcccagttacgacaacagaggagagtcgtaatggggcagcaaaacctggcggcagcgcaaaagatg

SEQ ID NO: 164377 - DNA, 103 bp, Artificial Sequence
  Synthetic Polynucleotide
taatacgactcactatagggttcgttcccaccattttagcaattgctgccaacagaggagaggcagcatgtgctaaaataacctggcggcagcgcaaaagatg

SEQ ID NO: 164378 - DNA, 103 bp, Artificial Sequence
  Synthetic Polynucleotide
taatacgactcactatagggagcttcacttttcgttcccaccattttagcaacagaggagagctaaaatggtgggaacgaacctggcggcagcgcaaaagatg

SEQ ID NO: 164379 - DNA, 103 bp, Artificial Sequence
  Synthetic Polynucleotide
taatacgactcactatagggttttacattgagcttcacttttcgttcccaaacagaggagatgggaaatgaaagtgaagaacctggcggcagcgcaaaagatg

SEQ ID NO: 164380 - DNA, 103 bp, Artificial Sequence
  Synthetic Polynucleotide
taatacgactcactatagggaaatagaagtttttacattgagcttcacttaacagaggagaaagtgaatgtcaatgtaaaacctggcggcagcgcaaaagatg

SEQ ID NO: 164381 - DNA, 103 bp, Artificial Sequence
  Synthetic Polynucleotide
taatacgactcactatagggtttatagttaaaatagaagtttttacattgaacagaggagacaatgtatgaacttctataacctggcggcagcgcaaaagatg

SEQ ID NO: 164382 - DNA, 103 bp, Artificial Sequence
  Synthetic Polynucleotide
taatacgactcactatagggtgaatgctccttggttgggaggataacctgaacagaggagacaggttatgctcccaaccaacctggcggcagcgcaaaagatg

SEQ ID NO: 164383 - DNA, 103 bp, Artificial Sequence
  Synthetic Polynucleotide
taatacgactcactatagggctgaaagcaaggaaggtcgccttcgaagctaacagaggagaagcttcatgggcgaccttaacctggcggcagcgcaaaagatg

SEQ ID NO: 164384 - DNA, 103 bp, Artificial Sequence
  Synthetic Polynucleotide
taatacgactcactatagggtgtgtcgccttttatagttaaaatagaagtaacagaggagaacttctatgttaactataaacctggcggcagcgcaaaagatg

SEQ ID NO: 164385 - DNA, 103 bp, Artificial Sequence
  Synthetic Polynucleotide
taatacgactcactatagggttgtcaagattgtgtcgccttttatagttaaacagaggagataactaatgaaggcgacaaacctggcggcagcgcaaaagatg

SEQ ID NO: 164386 - DNA, 103 bp, Artificial Sequence
  Synthetic Polynucleotide
taatacgactcactatagggctgtaagaggttgtcaagattgtgtcgcctaacagaggagaaggcgaatgaatcttgacaacctggcggcagcgcaaaagatg

SEQ ID NO: 164387 - DNA, 103 bp, Artificial Sequence
  Synthetic Polynucleotide
taatacgactcactataggggtttatgctgctgtaagaggttgtcaagataacagaggagaatcttgatgacctcttacaacctggcggcagcgcaaaagatg

SEQ ID NO: 164388 - DNA, 103 bp, Artificial Sequence
  Synthetic Polynucleotide
taatacgactcactataggggaagttttctgtttatgctgctgtaagaggaacagaggagacctcttatggcagcataaaacctggcggcagcgcaaaagatg

SEQ ID NO: 164389 - DNA, 103 bp, Artificial Sequence
  Synthetic Polynucleotide
taatacgactcactatagggaggttttcgtgaagttttctgtttatgctgaacagaggagacagcatatgcagaaaactaacctggcggcagcgcaaaagatg

SEQ ID NO: 164390 - DNA, 103 bp, Artificial Sequence
  Synthetic Polynucleotide
taatacgactcactataggggctcttcacgaggttttcgtgaagttttctaacagaggagaagaaaaatgcacgaaaacaacctggcggcagcgcaaaagatg

SEQ ID NO: 164391 - DNA, 103 bp, Artificial Sequence
  Synthetic Polynucleotide
taatacgactcactataggggacacatctcgctcttcacgaggttttcgtaacagaggagaacgaaaatgtcgtgaagaaacctggcggcagcgcaaaagatg

SEQ ID NO: 164392 - DNA, 103 bp, Artificial Sequence
  Synthetic Polynucleotide
taatacgactcactatagggttcacattgagacacatctcgctcttcacgaacagaggagacgtgaaatgcgagatgtgaacctggcggcagcgcaaaagatg

SEQ ID NO: 164393 - DNA, 103 bp, Artificial Sequence
  Synthetic Polynucleotide
taatacgactcactatagggaagcgacactttcacattgagacacatctcaacagaggagagagatgatgctcaatgtgaacctggcggcagcgcaaaagatg

SEQ ID NO: 164394 - DNA, 103 bp, Artificial Sequence
  Synthetic Polynucleotide
taatacgactcactataggggggtgaaattctgaaagcaaggaaggtcgcaacagaggagagcgaccatgcttgctttcaacctggcggcagcgcaaaagatg

SEQ ID NO: 164395 - DNA, 103 bp, Artificial Sequence
  Synthetic Polynucleotide
taatacgactcactataggggaaacagtggaagcgacactttcacattgaaacagaggagatcaatgatgaagtgtcgcaacctggcggcagcgcaaaagatg

SEQ ID NO: 164396 - DNA, 103 bp, Artificial Sequence
  Synthetic Polynucleotide
taatacgactcactatagggctcctgagcagaaacagtggaagcgacactaacagaggagaagtgtcatgtccactgttaacctggcggcagcgcaaaagatg

SEQ ID NO: 164397 - DNA, 103 bp, Artificial Sequence
  Synthetic Polynucleotide
taatacgactcactatagggtatcttcatcctcctgagcagaaacagtggaacagaggagaccactgatgctgctcaggaacctggcggcagcgcaaaagatg

SEQ ID NO: 164398 - DNA, 103 bp, Artificial Sequence
  Synthetic Polynucleotide
taatacgactcactataggggaggcttcaatatcttcatcctcctgagcaaacagaggagatgctcaatgggatgaagaaacctggcggcagcgcaaaagatg

SEQ ID NO: 164399 - DNA, 103 bp, Artificial Sequence
  Synthetic Polynucleotide
taatacgactcactatagggttcttcattggaggcttcaatatcttcatcaacagaggagagatgaaatgattgaagccaacctggcggcagcgcaaaagatg

SEQ ID NO: 164400 - DNA, 103 bp, Artificial Sequence
  Synthetic Polynucleotide
taatacgactcactatagggctggattttcttcttcattggaggcttcaaaacagaggagattgaagatgccaatgaagaacctggcggcagcgcaaaagatg

SEQ ID NO: 164401 - DNA, 103 bp, Artificial Sequence
  Synthetic Polynucleotide
taatacgactcactatagggtcgctgtcttctggattttcttcttcattgaacagaggagacaatgaatgagaaaatccaacctggcggcagcgcaaaagatg

SEQ ID NO: 164402 - DNA, 103 bp, Artificial Sequence
  Synthetic Polynucleotide
taatacgactcactatagggagcttcaacttcgctgtcttctggattttcaacagaggagagaaaatatggaagacagcaacctggcggcagcgcaaaagatg

SEQ ID NO: 164403 - DNA, 103 bp, Artificial Sequence
  Synthetic Polynucleotide
taatacgactcactatagggtgggcttgacagcttcaacttcgctgtcttaacagaggagaaagacaatgaagttgaagaacctggcggcagcgcaaaagatg

SEQ ID NO: 164404 - DNA, 103 bp, Artificial Sequence
  Synthetic Polynucleotide
taatacgactcactatagggctgtcctcgctgggcttgacagcttcaactaacagaggagaagttgaatgtgtcaagccaacctggcggcagcgcaaaagatg

SEQ ID NO: 164405 - DNA, 103 bp, Artificial Sequence
  Synthetic Polynucleotide
taatacgactcactataggggtcagaacctgggtgaaattctgaaagcaaaacagaggagattgcttatggaatttcacaacctggcggcagcgcaaaagatg

SEQ ID NO: 164406 - DNA, 103 bp, Artificial Sequence
  Synthetic Polynucleotide
taatacgactcactatagggattttcaggactgtcctcgctgggcttgacaacagaggagagtcaagatgagcgaggacaacctggcggcagcgcaaaagatg

SEQ ID NO: 164407 - DNA, 103 bp, Artificial Sequence
  Synthetic Polynucleotide
taatacgactcactataggggagaagtagcattttcaggactgtcctcgcaacagaggagagcgaggatggtcctgaaaaacctggcggcagcgcaaaagatg

SEQ ID NO: 164408 - DNA, 103 bp, Artificial Sequence
  Synthetic Polynucleotide
taatacgactcactataggggtgtttcctcgagaagtagcattttcaggaaacagaggagatcctgaatgtgctacttcaacctggcggcagcgcaaaagatg

SEQ ID NO: 164409 - DNA, 103 bp, Artificial Sequence
  Synthetic Polynucleotide
taatacgactcactatagggcgcaggttctgtgtttcctcgagaagtagcaacagaggagagctactatgcgaggaaacaacctggcggcagcgcaaaagatg

SEQ ID NO: 164410 - DNA, 103 bp, Artificial Sequence
  Synthetic Polynucleotide
taatacgactcactatagggcaagctcaaccgcaggttctgtgtttcctcaacagaggagagaggaaatgcagaacctgaacctggcggcagcgcaaaagatg

SEQ ID NO: 164411 - DNA, 103 bp, Artificial Sequence
  Synthetic Polynucleotide
taatacgactcactataggggtggtgggctcaagctcaaccgcaggttctaacagaggagaagaaccatgggttgagctaacctggcggcagcgcaaaagatg

SEQ ID NO: 164412 - DNA, 103 bp, Artificial Sequence
  Synthetic Polynucleotide
taatacgactcactatagggtgcagtttccgtggtgggctcaagctcaacaacagaggagagttgagatggagcccaccaacctggcggcagcgcaaaagatg

SEQ ID NO: 164413 - DNA, 103 bp, Artificial Sequence
  Synthetic Polynucleotide
taatacgactcactatagggatgtactgggtgcagtttccgtggtgggctaacagaggagaagcccaatgcggaaactgaacctggcggcagcgcaaaagatg

SEQ ID NO: 164414 - DNA, 103 bp, Artificial Sequence
  Synthetic Polynucleotide
taatacgactcactatagggaaggagggagatgtactgggtgcagtttccaacagaggagaggaaacatgacccagtacaacctggcggcagcgcaaaagatg

SEQ ID NO: 164415 - DNA, 103 bp, Artificial Sequence
  Synthetic Polynucleotide
taatacgactcactatagggtggaactgctaaggagggagatgtactgggaacagaggagacccagtatgtctccctccaacctggcggcagcgcaaaagatg

SEQ ID NO: 164416 - DNA, 103 bp, Artificial Sequence
  Synthetic Polynucleotide
taatacgactcactatagggcttgaggcctgtcagaacctgggtgaaattaacagaggagaaatttcatgcaggttctgaacctggcggcagcgcaaaagatg

SEQ ID NO: 164417 - DNA, 103 bp, Artificial Sequence
  Synthetic Polynucleotide
taatacgactcactataggggttttgtacttggaactgctaaggagggagaacagaggagactccctatgtagcagttcaacctggcggcagcgcaaaagatg

SEQ ID NO: 164418 - DNA, 103 bp, Artificial Sequence
  Synthetic Polynucleotide
taatacgactcactatagggtcttcagctggttttgtacttggaactgctaacagaggagaagcagtatgaagtacaaaaacctggcggcagcgcaaaagatg

SEQ ID NO: 164419 - DNA, 103 bp, Artificial Sequence
  Synthetic Polynucleotide
taatacgactcactatagggcacactttcatcttcagctggttttgtactaacagaggagaagtacaatgccagctgaaaacctggcggcagcgcaaaagatg

SEQ ID NO: 164420 - DNA, 103 bp, Artificial Sequence
  Synthetic Polynucleotide
taatacgactcactatagggcctgggtctccacactttcatcttcagctgaacagaggagacagctgatgatgaaagtgaacctggcggcagcgcaaaagatg

SEQ ID NO: 164421 - DNA, 103 bp, Artificial Sequence
  Synthetic Polynucleotide
taatacgactcactatagggctgtcattcacctgggtctccacactttcaaacagaggagatgaaagatgggagacccaaacctggcggcagcgcaaaagatg

SEQ ID NO: 164422 - DNA, 103 bp, Artificial Sequence
  Synthetic Polynucleotide
taatacgactcactatagggagcactgatgctgtcattcacctgggtctcaacagaggagagagaccatggtgaatgacaacctggcggcagcgcaaaagatg

SEQ ID NO: 164423 - DNA, 103 bp, Artificial Sequence
  Synthetic Polynucleotide
taatacgactcactatagggctgctgtctcagcactgatgctgtcattcaaacagaggagatgaatgatggcatcagtgaacctggcggcagcgcaaaagatg

SEQ ID NO: 164424 - DNA, 103 bp, Artificial Sequence
  Synthetic Polynucleotide
taatacgactcactatagggtccatctgctctgctgtctcagcactgatgaacagaggagacatcagatgtgagacagcaacctggcggcagcgcaaaagatg

SEQ ID NO: 164425 - DNA, 103 bp, Artificial Sequence
  Synthetic Polynucleotide
taatacgactcactatagggctgatctacatccatctgctctgctgtctcaacagaggagagagacaatggagcagatgaacctggcggcagcgcaaaagatg

SEQ ID NO: 164426 - DNA, 103 bp, Artificial Sequence
  Synthetic Polynucleotide
taatacgactcactatagggtgtgctcctgctgatctacatccatctgctaacagaggagaagcagaatgatgtagatcaacctggcggcagcgcaaaagatg

SEQ ID NO: 164427 - DNA, 103 bp, Artificial Sequence
  Synthetic Polynucleotide
taatacgactcactataggggttctcctttcttgaggcctgtcagaacctaacagaggagaaggttcatgcaggcctcaaacctggcggcagcgcaaaagatg

SEQ ID NO: 164428 - DNA, 103 bp, Artificial Sequence
  Synthetic Polynucleotide
taatacgactcactatagggtcttcagcactgtgctcctgctgatctacaaacagaggagatgtagaatggcaggagcaaacctggcggcagcgcaaaagatg

SEQ ID NO: 164429 - DNA, 103 bp, Artificial Sequence
  Synthetic Polynucleotide
taatacgactcactatagggaacagaaccctcttcagcactgtgctcctgaacagaggagacaggagatgagtgctgaaaacctggcggcagcgcaaaagatg

SEQ ID NO: 164430 - DNA, 103 bp, Artificial Sequence
  Synthetic Polynucleotide
taatacgactcactatagggggggatcacaaacagaaccctcttcagcacaacagaggagagtgctgatgagggttctgaacctggcggcagcgcaaaagatg

SEQ ID NO: 164431 - DNA, 103 bp, Artificial Sequence
  Synthetic Polynucleotide
taatacgactcactataggggtagcgggtgggggatcacaaacagaacccaacagaggagagggttcatgttgtgatccaacctggcggcagcgcaaaagatg

SEQ ID NO: 164432 - DNA, 103 bp, Artificial Sequence
  Synthetic Polynucleotide
taatacgactcactataggggtcagctttggtagcgggtgggggatcacaaacagaggagatgtgatatgccacccgctaacctggcggcagcgcaaaagatg

SEQ ID NO: 164433 - DNA, 103 bp, Artificial Sequence
  Synthetic Polynucleotide
taatacgactcactatagggcgtccacagagtcagctttggtagcgggtgaacagaggagacacccgatgccaaagctgaacctggcggcagcgcaaaagatg

SEQ ID NO: 164434 - DNA, 103 bp, Artificial Sequence
  Synthetic Polynucleotide
taatacgactcactatagggctcacttcaacgtccacagagtcagctttgaacagaggagacaaagcatgctctgtggaaacctggcggcagcgcaaaagatg

SEQ ID NO: 164435 - DNA, 103 bp, Artificial Sequence
  Synthetic Polynucleotide
taatacgactcactatagggttctggcaccctcacttcaacgtccacagaaacagaggagatctgtgatggttgaagtgaacctggcggcagcgcaaaagatg

SEQ ID NO: 164436 - DNA, 103 bp, Artificial Sequence
  Synthetic Polynucleotide
taatacgactcactatagggatgcatggttttctggcaccctcacttcaaaacagaggagattgaagatggggtgccagaacctggcggcagcgcaaaagatg

SEQ ID NO: 164437 - DNA, 103 bp, Artificial Sequence
  Synthetic Polynucleotide
taatacgactcactatagggtcaactttagatgcatggttttctggcaccaacagaggagaggtgccatgaaaccatgcaacctggcggcagcgcaaaagatg

SEQ ID NO: 164438 - DNA, 103 bp, Artificial Sequence
  Synthetic Polynucleotide
taatacgactcactatagggttcataactagttctcctttcttgaggcctaacagaggagaaggcctatggaaaggagaaacctggcggcagcgcaaaagatg

SEQ ID NO: 164439 - DNA, 103 bp, Artificial Sequence
  Synthetic Polynucleotide
taatacgactcactatagggattatcaccttcaactttagatgcatggttaacagaggagaaaccatatgtctaaagttaacctggcggcagcgcaaaagatg

SEQ ID NO: 164440 - DNA, 103 bp, Artificial Sequence
  Synthetic Polynucleotide
taatacgactcactatagggtttctttggtattatcaccttcaactttagaacagaggagactaaagatgaaggtgataaacctggcggcagcgcaaaagatg

SEQ ID NO: 164441 - DNA, 103 bp, Artificial Sequence
  Synthetic Polynucleotide
taatacgactcactatagggtccaagtctctttctttggtattatcacctaacagaggagaaggtgaatgtaccaaagaaacctggcggcagcgcaaaagatg

SEQ ID NO: 164442 - DNA, 103 bp, Artificial Sequence
  Synthetic Polynucleotide
taatacgactcactatagggactggctctatccaagtctctttctttggtaacagaggagaaccaaaatgagagacttgaacctggcggcagcgcaaaagatg

SEQ ID NO: 164443 - DNA, 103 bp, Artificial Sequence
  Synthetic Polynucleotide
taatacgactcactatagggccaccttctcactggctctatccaagtctcaacagaggagagagactatgatagagccaaacctggcggcagcgcaaaagatg

SEQ ID NO: 164444 - DNA, 103 bp, Artificial Sequence
  Synthetic Polynucleotide
taatacgactcactatagggtctctaggttccaccttctcactggctctaaacagaggagatagagcatgtgagaaggtaacctggcggcagcgcaaaagatg

SEQ ID NO: 164445 - DNA, 103 bp, Artificial Sequence
  Synthetic Polynucleotide
taatacgactcactatagggcaaatcttcatctctaggttccaccttctcaacagaggagagagaagatggaacctagaaacctggcggcagcgcaaaagatg

SEQ ID NO: 164446 - DNA, 103 bp, Artificial Sequence
  Synthetic Polynucleotide
taatacgactcactataggggagctaccaccaaatcttcatctctaggttaacagaggagaaacctaatgatgaagattaacctggcggcagcgcaaaagatg

SEQ ID NO: 164447 - DNA, 103 bp, Artificial Sequence
  Synthetic Polynucleotide
taatacgactcactatagggtttatttgctgagctaccaccaaatcttcaaacagaggagatgaagaatgggtggtagcaacctggcggcagcgcaaaagatg

SEQ ID NO: 164448 - DNA, 103 bp, Artificial Sequence
  Synthetic Polynucleotide
taatacgactcactatagggcctttgggcatttatttgctgagctaccacaacagaggagagtggtaatgcagcaaataaacctggcggcagcgcaaaagatg

SEQ ID NO: 164449 - DNA, 103 bp, Artificial Sequence
  Synthetic Polynucleotide
taatacgactcactataggggatgaaacggttcataactagttctcctttaacagaggagaaaaggaatgctagttatgaacctggcggcagcgcaaaagatg

SEQ ID NO: 164450 - DNA, 103 bp, Artificial Sequence
  Synthetic Polynucleotide
taatacgactcactatagggggggctcgggcctttgggcatttatttgctaacagaggagaagcaaaatgatgcccaaaaacctggcggcagcgcaaaagatg

SEQ ID NO: 164451 - DNA, 103 bp, Artificial Sequence
  Synthetic Polynucleotide
taatacgactcactatagggttgtctgactggggctcgggcctttgggcaaacagaggagatgcccaatggcccgagccaacctggcggcagcgcaaaagatg

SEQ ID NO: 164452 - DNA, 103 bp, Artificial Sequence
  Synthetic Polynucleotide
taatacgactcactatagggactggaatcattgtctgactggggctcgggaacagaggagacccgagatgcagtcagacaacctggcggcagcgcaaaagatg

SEQ ID NO: 164453 - DNA, 103 bp, Artificial Sequence
  Synthetic Polynucleotide
taatacgactcactatagggtgcacgtggcactggaatcattgtctgactaacagaggagaagtcagatgatgattccaaacctggcggcagcgcaaaagatg

SEQ ID NO: 164454 - DNA, 103 bp, Artificial Sequence
  Synthetic Polynucleotide
taatacgactcactatagggtcatcagcgctgcacgtggcactggaatcaaacagaggagatgattcatgtgccacgtgaacctggcggcagcgcaaaagatg

SEQ ID NO: 164455 - DNA, 103 bp, Artificial Sequence
  Synthetic Polynucleotide
taatacgactcactatagggatccacatcctcatcagcgctgcacgtggcaacagaggagagccacgatgagcgctgataacctggcggcagcgcaaaagatg

SEQ ID NO: 164456 - DNA, 103 bp, Artificial Sequence
  Synthetic Polynucleotide
taatacgactcactatagggctggctctccatccacatcctcatcagcgcaacagaggagagcgctgatgaggatgtggaacctggcggcagcgcaaaagatg

SEQ ID NO: 164457 - DNA, 103 bp, Artificial Sequence
  Synthetic Polynucleotide
taatacgactcactatagggctctgcctctctggctctccatccacatccaacagaggagaggatgtatgtggagagccaacctggcggcagcgcaaaagatg

SEQ ID NO: 164458 - DNA, 103 bp, Artificial Sequence
  Synthetic Polynucleotide
taatacgactcactatagggaggaaacattctctgcctctctggctctccaacagaggagaggagagatggagaggcagaacctggcggcagcgcaaaagatg

SEQ ID NO: 164459 - DNA, 103 bp, Artificial Sequence
  Synthetic Polynucleotide
taatacgactcactatagggttgagtccataggaaacattctctgcctctaacagaggagaagaggcatggaatgtttcaacctggcggcagcgcaaaagatg

SEQ ID NO: 164460 - DNA, 103 bp, Artificial Sequence
  Synthetic Polynucleotide
taatacgactcactataggggatgggcctggatgaaacggttcataactaaacagaggagatagttaatgaccgtttcaaacctggcggcagcgcaaaagatg

SEQ ID NO: 164461 - DNA, 103 bp, Artificial Sequence
  Synthetic Polynucleotide
taatacgactcactatagggagtgaaggctttgagtccataggaaacattaacagaggagaaatgttatgtatggactcaacctggcggcagcgcaaaagatg

SEQ ID NO: 164462 - DNA, 103 bp, Artificial Sequence
  Synthetic Polynucleotide
taatacgactcactatagggggggtttaacagtgaaggctttgagtccataacagaggagaatggacatgaagccttcaaacctggcggcagcgcaaaagatg

SEQ ID NO: 164463 - DNA, 103 bp, Artificial Sequence
  Synthetic Polynucleotide
taatacgactcactatagggtagatccagtggggtttaacagtgaaggctaacagaggagaagccttatgtgttaaaccaacctggcggcagcgcaaaagatg

SEQ ID NO: 164464 - DNA, 103 bp, Artificial Sequence
  Synthetic Polynucleotide
taatacgactcactataggggagacgagtatagatccagtggggtttaacaacagaggagagttaaaatgcactggatcaacctggcggcagcgcaaaagatg

SEQ ID NO: 164465 - DNA, 103 bp, Artificial Sequence
  Synthetic Polynucleotide
taatacgactcactatagggtaacggagatgagacgagtatagatccagtaacagaggagaactggaatgatactcgtcaacctggcggcagcgcaaaagatg

SEQ ID NO: 164466 - DNA, 103 bp, Artificial Sequence
  Synthetic Polynucleotide
taatacgactcactataggggatttggttttaacggagatgagacgagtaaacagaggagatactcgatgcatctccgtaacctggcggcagcgcaaaagatg

SEQ ID NO: 164467 - DNA, 103 bp, Artificial Sequence
  Synthetic Polynucleotide
taatacgactcactatagggagatccagtggatttggttttaacggagataacagaggagaatctccatgaaaaccaaaaacctggcggcagcgcaaaagatg

SEQ ID NO: 164468 - DNA, 103 bp, Artificial Sequence
  Synthetic Polynucleotide
taatacgactcactatagggaagctgtggcagatccagtggatttggtttaacagaggagaaaaccaatgccactggataacctggcggcagcgcaaaagatg

SEQ ID NO: 164469 - DNA, 103 bp, Artificial Sequence
  Synthetic Polynucleotide
taatacgactcactatagggctcgatgctgaagctgtggcagatccagtgaacagaggagacactggatgtgccacagcaacctggcggcagcgcaaaagatg

SEQ ID NO: 164470 - DNA, 103 bp, Artificial Sequence
  Synthetic Polynucleotide
taatacgactcactatagggataacagcagctcgatgctgaagctgtggcaacagaggagagccacaatgtcagcatcgaacctggcggcagcgcaaaagatg

SEQ ID NO: 164471 - DNA, 103 bp, Artificial Sequence
  Synthetic Polynucleotide
taatacgactcactatagggatccactggggatgggcctggatgaaacggaacagaggagaccgtttatgccaggcccaaacctggcggcagcgcaaaagatg

SEQ ID NO: 164472 - DNA, 103 bp, Artificial Sequence
  Synthetic Polynucleotide
taatacgactcactatagggcattggtgggataacagcagctcgatgctgaacagaggagacagcatatggctgctgttaacctggcggcagcgcaaaagatg

SEQ ID NO: 164473 - DNA, 103 bp, Artificial Sequence
  Synthetic Polynucleotide
taatacgactcactatagggtgcaggataccattggtgggataacagcagaacagaggagactgctgatgtcccaccaaaacctggcggcagcgcaaaagatg

SEQ ID NO: 164474 - DNA, 103 bp, Artificial Sequence
  Synthetic Polynucleotide
taatacgactcactatagggttacatggggtgcaggataccattggtgggaacagaggagacccaccatgggtatcctgaacctggcggcagcgcaaaagatg

SEQ ID NO: 164475 - DNA, 103 bp, Artificial Sequence
  Synthetic Polynucleotide
taatacgactcactatagggaattggtatgttacatggggtgcaggatacaacagaggagagtatccatgaccccatgtaacctggcggcagcgcaaaagatg

SEQ ID NO: 164476 - DNA, 103 bp, Artificial Sequence
  Synthetic Polynucleotide
taatacgactcactatagggctggggttccaattggtatgttacatggggaacagaggagaccccatatgacataccaaaacctggcggcagcgcaaaagatg

SEQ ID NO: 164477 - DNA, 103 bp, Artificial Sequence
  Synthetic Polynucleotide
taatacgactcactatagggtagccgctcactggggttccaattggtatgaacagaggagacataccatgtggaaccccaacctggcggcagcgcaaaagatg

SEQ ID NO: 164478 - DNA, 103 bp, Artificial Sequence
  Synthetic Polynucleotide
taatacgactcactataggggtagagagcatagccgctcactggggttccaacagaggagaggaaccatggtgagcggcaacctggcggcagcgcaaaagatg

SEQ ID NO: 164479 - DNA, 103 bp, Artificial Sequence
  Synthetic Polynucleotide
taatacgactcactatagggtgtgtcgctggtagagagcatagccgctcaaacagaggagatgagcgatgatgctctctaacctggcggcagcgcaaaagatg

SEQ ID NO: 164480 - DNA, 103 bp, Artificial Sequence
  Synthetic Polynucleotide
taatacgactcactatagggattgctttaatgtgtcgctggtagagagcaaacagaggagatgctctatgccagcgacaaacctggcggcagcgcaaaagatg

SEQ ID NO: 164481 - DNA, 103 bp, Artificial Sequence
  Synthetic Polynucleotide
taatacgactcactatagggtgactcatgcattgctttaatgtgtcgctgaacagaggagacagcgaatgattaaagcaaacctggcggcagcgcaaaagatg

SEQ ID NO: 164482 - DNA, 103 bp, Artificial Sequence
  Synthetic Polynucleotide
taatacgactcactataggggtgaatcatgatccactggggatgggcctgaacagaggagacaggccatgccccagtggaacctggcggcagcgcaaaagatg

SEQ ID NO: 164483 - DNA, 103 bp, Artificial Sequence
  Synthetic Polynucleotide
taatacgactcactatagggccaggagtgctgactcatgcattgctttaaaacagaggagattaaagatgtgcatgagtaacctggcggcagcgcaaaagatg

SEQ ID NO: 164484 - DNA, 103 bp, Artificial Sequence
  Synthetic Polynucleotide
taatacgactcactatagggcgctgctcctccaggagtgctgactcatgcaacagaggagagcatgaatgagcactcctaacctggcggcagcgcaaaagatg

SEQ ID NO: 164485 - DNA, 103 bp, Artificial Sequence
  Synthetic Polynucleotide
taatacgactcactatagggttgtctctgccgctgctcctccaggagtgcaacagaggagagcactcatggaggagcagaacctggcggcagcgcaaaagatg

SEQ ID NO: 164486 - DNA, 103 bp, Artificial Sequence
  Synthetic Polynucleotide
taatacgactcactatagggctatctgttcttgtctctgccgctgctcctaacagaggagaaggagcatgggcagagacaacctggcggcagcgcaaaagatg

SEQ ID NO: 164487 - DNA, 103 bp, Artificial Sequence
  Synthetic Polynucleotide
taatacgactcactatagggcattccaaatctatctgttcttgtctctgcaacagaggagagcagagatgagaacagataacctggcggcagcgcaaaagatg

SEQ ID NO: 164488 - DNA, 103 bp, Artificial Sequence
  Synthetic Polynucleotide
taatacgactcactatagggagaacttctacattccaaatctatctgttcaacagaggagagaacagatggatttggaaaacctggcggcagcgcaaaagatg

SEQ ID NO: 164489 - DNA, 103 bp, Artificial Sequence
  Synthetic Polynucleotide
taatacgactcactatagggatggacttgtagaacttctacattccaaataacagaggagaatttggatggtagaagttaacctggcggcagcgcaaaagatg

SEQ ID NO: 164490 - DNA, 103 bp, Artificial Sequence
  Synthetic Polynucleotide
taatacgactcactataggggatgtgccacatggacttgtagaacttctaaacagaggagatagaagatgtacaagtccaacctggcggcagcgcaaaagatg

SEQ ID NO: 164491 - DNA, 103 bp, Artificial Sequence
  Synthetic Polynucleotide
taatacgactcactatagggtggactcttggatgtgccacatggacttgtaacagaggagaacaagtatgtgtggcacaaacctggcggcagcgcaaaagatg

SEQ ID NO: 164492 - DNA, 103 bp, Artificial Sequence
  Synthetic Polynucleotide
taatacgactcactatagggactctctgtttggactcttggatgtgccacaacagaggagagtggcaatgccaagagtcaacctggcggcagcgcaaaagatg

SEQ ID NO: 164493 - DNA, 103 bp, Artificial Sequence
  Synthetic Polynucleotide
taatacgactcactatagggtgttctgtgctgaatgctccttggttgggaaacagaggagatcccaaatgaggagcattaacctggcggcagcgcaaaagatg

SEQ ID NO: 164494 - DNA, 103 bp, Artificial Sequence
  Synthetic Polynucleotide
taatacgactcactatagggttcgattccagtgaatcatgatccactgggaacagaggagacccagtatgtcatgattcaacctggcggcagcgcaaaagatg

SEQ ID NO: 164495 - DNA, 103 bp, Artificial Sequence
  Synthetic Polynucleotide
taatacgactcactatagggaggacttcccactctctgtttggactcttgaacagaggagacaagagatgaaacagagaaacctggcggcagcgcaaaagatg

SEQ ID NO: 164496 - DNA, 103 bp, Artificial Sequence
  Synthetic Polynucleotide
taatacgactcactatagggagcaggctgaaggacttcccactctctgttaacagaggagaaacagaatgtgggaagtcaacctggcggcagcgcaaaagatg

SEQ ID NO: 164497 - DNA, 103 bp, Artificial Sequence
  Synthetic Polynucleotide
taatacgactcactatagggcttgatgtggagcaggctgaaggacttcccaacagaggagagggaagatgttcagcctgaacctggcggcagcgcaaaagatg

SEQ ID NO: 164498 - DNA, 103 bp, Artificial Sequence
  Synthetic Polynucleotide
taatacgactcactatagggttagttatcacttgatgtggagcaggctgaaacagaggagatcagccatgtccacatcaaacctggcggcagcgcaaaagatg

SEQ ID NO: 164499 - DNA, 103 bp, Artificial Sequence
  Synthetic Polynucleotide
taatacgactcactatagggttcagggagattagttatcacttgatgtggaacagaggagaccacatatggtgataactaacctggcggcagcgcaaaagatg

SEQ ID NO: 164500 - DNA, 103 bp, Artificial Sequence
  Synthetic Polynucleotide
taatacgactcactataggggccgaacgccttcagggagattagttatcaaacagaggagatgataaatgatctccctgaacctggcggcagcgcaaaagatg

SEQ ID NO: 164501 - DNA, 103 bp, Artificial Sequence
  Synthetic Polynucleotide
taatacgactcactataggggttgtcggaagccgaacgccttcagggagaaacagaggagatctcccatgaggcgttcgaacctggcggcagcgcaaaagatg

SEQ ID NO: 164502 - DNA, 103 bp, Artificial Sequence
  Synthetic Polynucleotide
taatacgactcactatagggggttggtcgagttgtcggaagccgaacgccaacagaggagaggcgttatgcttccgacaaacctggcggcagcgcaaaagatg

SEQ ID NO: 164503 - DNA, 103 bp, Artificial Sequence
  Synthetic Polynucleotide
taatacgactcactataggggcggtggcctggttggtcgagttgtcggaaaacagaggagattccgaatgctcgaccaaaacctggcggcagcgcaaaagatg

SEQ ID NO: 164504 - DNA, 103 bp, Artificial Sequence
  Synthetic Polynucleotide
taatacgactcactatagggatgagagggggcggtggcctggttggtcgaaacagaggagatcgaccatgcaggccaccaacctggcggcagcgcaaaagatg

SEQ ID NO: 164505 - DNA, 103 bp, Artificial Sequence
  Synthetic Polynucleotide
taatacgactcactatagggacgtggtcgcttcgattccagtgaatcatgaacagaggagacatgatatgctggaatcgaacctggcggcagcgcaaaagatg

SEQ ID NO: 164506 - DNA, 103 bp, Artificial Sequence
  Synthetic Polynucleotide
taatacgactcactatagggggatgacgggatgagagggggcggtggcctaacagaggagaaggccaatgccccctctcaacctggcggcagcgcaaaagatg

SEQ ID NO: 164507 - DNA, 103 bp, Artificial Sequence
  Synthetic Polynucleotide
taatacgactcactatagggctgtggttttggatgacgggatgagaggggaacagaggagacccctcatgtcccgtcataacctggcggcagcgcaaaagatg

SEQ ID NO: 164508 - DNA, 103 bp, Artificial Sequence
  Synthetic Polynucleotide
taatacgactcactatagggtctgaagccactgtggttttggatgacgggaacagaggagacccgtcatgcaaaaccacaacctggcggcagcgcaaaagatg

SEQ ID NO: 164509 - DNA, 103 bp, Artificial Sequence
  Synthetic Polynucleotide
taatacgactcactatagggagatggtttttctgaagccactgtggttttaacagaggagaaaaaccatggtggcttcaaacctggcggcagcgcaaaagatg

SEQ ID NO: 164510 - DNA, 103 bp, Artificial Sequence
  Synthetic Polynucleotide
taatacgactcactatagggccattataaaagatggtttttctgaagccaaacagaggagatggcttatgaaaaaccataacctggcggcagcgcaaaagatg

SEQ ID NO: 164511 - DNA, 103 bp, Artificial Sequence
  Synthetic Polynucleotide
taatacgactcactatagggatggagcctcccattataaaagatggttttaacagaggagaaaaaccatgttttataataacctggcggcagcgcaaaagatg

SEQ ID NO: 164512 - DNA, 103 bp, Artificial Sequence
  Synthetic Polynucleotide
taatacgactcactatagggtccctgtgagatggagcctcccattataaaaacagaggagatttataatgggaggctccaacctggcggcagcgcaaaagatg

SEQ ID NO: 164513 - DNA, 103 bp, Artificial Sequence
  Synthetic Polynucleotide
taatacgactcactatagggtgcctggtgttccctgtgagatggagcctcaacagaggagagaggctatgtctcacaggaacctggcggcagcgcaaaagatg

SEQ ID NO: 164514 - DNA, 103 bp, Artificial Sequence
  Synthetic Polynucleotide
taatacgactcactataggggtcaaataagtgcctggtgttccctgtgagaacagaggagactcacaatgaacaccaggaacctggcggcagcgcaaaagatg

SEQ ID NO: 164515 - DNA, 103 bp, Artificial Sequence
  Synthetic Polynucleotide
taatacgactcactatagggattatgagaagtcaaataagtgcctggtgtaacagaggagaacaccaatgacttatttgaacctggcggcagcgcaaaagatg

SEQ ID NO: 164516 - DNA, 103 bp, Artificial Sequence
  Synthetic Polynucleotide
taatacgactcactatagggcctgttccagacgtggtcgcttcgattccaaacagaggagatggaatatgagcgaccacaacctggcggcagcgcaaaagatg

SEQ ID NO: 164517 - DNA, 103 bp, Artificial Sequence
  Synthetic Polynucleotide
taatacgactcactatagggaggaagcctgattatgagaagtcaaataagaacagaggagacttattatgcttctcataaacctggcggcagcgcaaaagatg

SEQ ID NO: 164518 - DNA, 103 bp, Artificial Sequence
  Synthetic Polynucleotide
taatacgactcactatagggtcttgagtgtaggaagcctgattatgagaaaacagaggagattctcaatgtcaggcttcaacctggcggcagcgcaaaagatg

SEQ ID NO: 164519 - DNA, 103 bp, Artificial Sequence
  Synthetic Polynucleotide
taatacgactcactatagggcttgggtgtttcttgagtgtaggaagcctgaacagaggagacaggctatgtacactcaaaacctggcggcagcgcaaaagatg

SEQ ID NO: 164520 - DNA, 103 bp, Artificial Sequence
  Synthetic Polynucleotide
taatacgactcactatagggccactgacggcttgggtgtttcttgagtgtaacagaggagaacactcatgaaacacccaaacctggcggcagcgcaaaagatg

SEQ ID NO: 164521 - DNA, 103 bp, Artificial Sequence
  Synthetic Polynucleotide
taatacgactcactataggggagatagatcccactgacggcttgggtgttaacagaggagaaacaccatggccgtcagtaacctggcggcagcgcaaaagatg

SEQ ID NO: 164522 - DNA, 103 bp, Artificial Sequence
  Synthetic Polynucleotide
taatacgactcactatagggcagtccaagagagatagatcccactgacggaacagaggagaccgtcaatgggatctatcaacctggcggcagcgcaaaagatg

SEQ ID NO: 164523 - DNA, 103 bp, Artificial Sequence
  Synthetic Polynucleotide
taatacgactcactataggggttgccgtggcagtccaagagagatagatcaacagaggagagatctaatgctcttggacaacctggcggcagcgcaaaagatg

SEQ ID NO: 164524 - DNA, 103 bp, Artificial Sequence
  Synthetic Polynucleotide
taatacgactcactataggggcagattcctgttgccgtggcagtccaagaaacagaggagatcttggatggccacggcaaacctggcggcagcgcaaaagatg

SEQ ID NO: 164525 - DNA, 103 bp, Artificial Sequence
  Synthetic Polynucleotide
taatacgactcactatagggagctgatttggcagattcctgttgccgtggaacagaggagaccacggatgcaggaatctaacctggcggcagcgcaaaagatg

SEQ ID NO: 164526 - DNA, 103 bp, Artificial Sequence
  Synthetic Polynucleotide
taatacgactcactatagggagggcaaagtagctgatttggcagattcctaacagaggagaaggaatatgccaaatcagaacctggcggcagcgcaaaagatg

SEQ ID NO: 164527 - DNA, 103 bp, Artificial Sequence
  Synthetic Polynucleotide
taatacgactcactataggggaatcagaaacctgttccagacgtggtcgcaacagaggagagcgaccatgtctggaacaaacctggcggcagcgcaaaagatg

SEQ ID NO: 164528 - DNA, 103 bp, Artificial Sequence
  Synthetic Polynucleotide
taatacgactcactatagggtgcttgatgtagggcaaagtagctgatttgaacagaggagacaaatcatgtactttgccaacctggcggcagcgcaaaagatg

SEQ ID NO: 164529 - DNA, 103 bp, Artificial Sequence
  Synthetic Polynucleotide
taatacgactcactatagggaaattcttcctgcttgatgtagggcaaagtaacagaggagaactttgatgtacatcaagaacctggcggcagcgcaaaagatg

SEQ ID NO: 164530 - DNA, 103 bp, Artificial Sequence
  Synthetic Polynucleotide
taatacgactcactatagggttcggggagaaaattcttcctgcttgatgtaacagaggagaacatcaatgaggaagaataacctggcggcagcgcaaaagatg

SEQ ID NO: 164531 - DNA, 103 bp, Artificial Sequence
  Synthetic Polynucleotide
taatacgactcactataggggagttttggcttcggggagaaaattcttccaacagaggagaggaagaatgttctccccgaacctggcggcagcgcaaaagatg

SEQ ID NO: 164532 - DNA, 103 bp, Artificial Sequence
  Synthetic Polynucleotide
taatacgactcactatagggctcaggttgtgagttttggcttcggggagaaacagaggagatctcccatgagccaaaacaacctggcggcagcgcaaaagatg

SEQ ID NO: 164533 - DNA, 103 bp, Artificial Sequence
  Synthetic Polynucleotide
taatacgactcactatagggccaacagaccctcaggttgtgagttttggcaacagaggagagccaaaatgcacaacctgaacctggcggcagcgcaaaagatg

SEQ ID NO: 164534 - DNA, 103 bp, Artificial Sequence
  Synthetic Polynucleotide
taatacgactcactatagggtgggccctgaccaacagaccctcaggttgtaacagaggagaacaaccatggggtctgttaacctggcggcagcgcaaaagatg

SEQ ID NO: 164535 - DNA, 103 bp, Artificial Sequence
  Synthetic Polynucleotide
taatacgactcactatagggaccttcatgttgggccctgaccaacagaccaacagaggagaggtctgatggtcagggccaacctggcggcagcgcaaaagatg

SEQ ID NO: 164536 - DNA, 103 bp, Artificial Sequence
  Synthetic Polynucleotide
taatacgactcactatagggctctgactacaccttcatgttgggccctgaaacagaggagatcagggatgaacatgaagaacctggcggcagcgcaaaagatg

SEQ ID NO: 164537 - DNA, 103 bp, Artificial Sequence
  Synthetic Polynucleotide
taatacgactcactatagggcctgcggtacctctgactacaccttcatgtaacagaggagaacatgaatgtgtagtcagaacctggcggcagcgcaaaagatg

SEQ ID NO: 164538 - DNA, 103 bp, Artificial Sequence
  Synthetic Polynucleotide
taatacgactcactatagggctgaaaatgagaatcagaaacctgttccagaacagaggagactggaaatggtttctgataacctggcggcagcgcaaaagatg

SEQ ID NO: 164539 - DNA, 103 bp, Artificial Sequence
  Synthetic Polynucleotide
taatacgactcactatagggttgtatggctcctgcggtacctctgactacaacagaggagagtagtcatgggtaccgcaaacctggcggcagcgcaaaagatg

SEQ ID NO: 164540 - DNA, 103 bp, Artificial Sequence
  Synthetic Polynucleotide
taatacgactcactatagggtacttccttcttgtatggctcctgcggtacaacagaggagagtaccgatggagccatacaacctggcggcagcgcaaaagatg

SEQ ID NO: 164541 - DNA, 103 bp, Artificial Sequence
  Synthetic Polynucleotide
taatacgactcactatagggccccgagttatacttccttcttgtatggctaacagaggagaagccatatgagaaggaagaacctggcggcagcgcaaaagatg

SEQ ID NO: 164542 - DNA, 103 bp, Artificial Sequence
  Synthetic Polynucleotide
taatacgactcactatagggggttggagttccccgagttatacttccttcaacagaggagagaaggaatgataactcggaacctggcggcagcgcaaaagatg

SEQ ID NO: 164543 - DNA, 103 bp, Artificial Sequence
  Synthetic Polynucleotide
taatacgactcactatagggaaattttgctggttggagttccccgagttaaacagaggagataactcatggaactccaaaacctggcggcagcgcaaaagatg

SEQ ID NO: 164544 - DNA, 103 bp, Artificial Sequence
  Synthetic Polynucleotide
taatacgactcactatagggctctccactgaaattttgctggttggagttaacagaggagaaactccatgcagcaaaataacctggcggcagcgcaaaagatg

SEQ ID NO: 164545 - DNA, 103 bp, Artificial Sequence
  Synthetic Polynucleotide
taatacgactcactatagggggatggaatgctctccactgaaattttgctaacagaggagaagcaaaatgtcagtggagaacctggcggcagcgcaaaagatg

SEQ ID NO: 164546 - DNA, 103 bp, Artificial Sequence
  Synthetic Polynucleotide
taatacgactcactatagggagccccgtagggatggaatgctctccactgaacagaggagacagtggatggcattccataacctggcggcagcgcaaaagatg

SEQ ID NO: 164547 - DNA, 103 bp, Artificial Sequence
  Synthetic Polynucleotide
taatacgactcactatagggtgagtgatagagccccgtagggatggaatgaacagaggagacattccatgcctacggggaacctggcggcagcgcaaaagatg

SEQ ID NO: 164548 - DNA, 103 bp, Artificial Sequence
  Synthetic Polynucleotide
taatacgactcactatagggcggggtgccctgagtgatagagccccgtagaacagaggagactacggatgtctatcactaacctggcggcagcgcaaaagatg

SEQ ID NO: 164549 - DNA, 103 bp, Artificial Sequence
  Synthetic Polynucleotide
taatacgactcactatagggcactgacacgctgaaaatgagaatcagaaaaacagaggagatttctgatgctcattttcaacctggcggcagcgcaaaagatg

SEQ ID NO: 164550 - DNA, 103 bp, Artificial Sequence
  Synthetic Polynucleotide
taatacgactcactatagggggggcagagccggggtgccctgagtgatagaacagaggagactatcaatgagggcacccaacctggcggcagcgcaaaagatg

SEQ ID NO: 164551 - DNA, 103 bp, Artificial Sequence
  Synthetic Polynucleotide
taatacgactcactatagggatgccagtctggggcagagccggggtgcccaacagaggagagggcacatgggctctgccaacctggcggcagcgcaaaagatg

SEQ ID NO: 164552 - DNA, 103 bp, Artificial Sequence
  Synthetic Polynucleotide
taatacgactcactatagggctctgttggtatgccagtctggggcagagcaacagaggagagctctgatgcagactggcaacctggcggcagcgcaaaagatg

SEQ ID NO: 164553 - DNA, 103 bp, Artificial Sequence
  Synthetic Polynucleotide
taatacgactcactatagggtcaccaaagcctctgttggtatgccagtctaacagaggagaagactgatgtaccaacagaacctggcggcagcgcaaaagatg

SEQ ID NO: 164554 - DNA, 103 bp, Artificial Sequence
  Synthetic Polynucleotide
taatacgactcactatagggatggaccccttcaccaaagcctctgttggtaacagaggagaaccaacatgggctttggtaacctggcggcagcgcaaaagatg

SEQ ID NO: 164555 - DNA, 103 bp, Artificial Sequence
  Synthetic Polynucleotide
taatacgactcactatagggcattctcgaaatggaccccttcaccaaagcaacagaggagagctttgatgaaggggtccaacctggcggcagcgcaaaagatg

SEQ ID NO: 164556 - DNA, 103 bp, Artificial Sequence
  Synthetic Polynucleotide
taatacgactcactatagggcttcaatgggcattctcgaaatggacccctaacagaggagaaggggtatgtttcgagaaaacctggcggcagcgcaaaagatg

SEQ ID NO: 164557 - DNA, 103 bp, Artificial Sequence
  Synthetic Polynucleotide
taatacgactcactatagggggactgctgtcttcaatgggcattctcgaaaacagaggagattcgagatggcccattgaaacctggcggcagcgcaaaagatg

SEQ ID NO: 164558 - DNA, 103 bp, Artificial Sequence
  Synthetic Polynucleotide
taatacgactcactataggggcctttctcaggactgctgtcttcaatgggaacagaggagacccattatggacagcagtaacctggcggcagcgcaaaagatg

SEQ ID NO: 164559 - DNA, 103 bp, Artificial Sequence
  Synthetic Polynucleotide
taatacgactcactatagggcttcctctctgcctttctcaggactgctgtaacagaggagaacagcaatgctgagaaagaacctggcggcagcgcaaaagatg

SEQ ID NO: 164560 - DNA, 103 bp, Artificial Sequence
  Synthetic Polynucleotide
taatacgactcactatagggaaaaccgcagcactgacacgctgaaaatgaaacagaggagatcatttatggcgtgtcagaacctggcggcagcgcaaaagatg

SEQ ID NO: 164561 - DNA, 103 bp, Artificial Sequence
  Synthetic Polynucleotide
taatacgactcactatagggttggatgcagcttcctctctgcctttctcaaacagaggagatgagaaatgcagagaggaaacctggcggcagcgcaaaagatg

SEQ ID NO: 164562 - DNA, 103 bp, Artificial Sequence
  Synthetic Polynucleotide
taatacgactcactatagggaacatggcctttggatgcagcttcctctctaacagaggagaagagagatggctgcatccaacctggcggcagcgcaaaagatg

SEQ ID NO: 164563 - DNA, 103 bp, Artificial Sequence
  Synthetic Polynucleotide
taatacgactcactatagggcttcataaataacatggcctttggatgcagaacagaggagactgcatatgaaggccatgaacctggcggcagcgcaaaagatg

SEQ ID NO: 164564 - DNA, 103 bp, Artificial Sequence
  Synthetic Polynucleotide
taatacgactcactatagggccacttttgccttcataaataacatggcctaacagaggagaaggccaatgtatttatgaaacctggcggcagcgcaaaagatg

SEQ ID NO: 164565 - DNA, 103 bp, Artificial Sequence
  Synthetic Polynucleotide
taatacgactcactatagggcaagatatgtccacttttgccttcataaataacagaggagaatttatatgggcaaaagtaacctggcggcagcgcaaaagatg

SEQ ID NO: 164566 - DNA, 103 bp, Artificial Sequence
  Synthetic Polynucleotide
taatacgactcactatagggtatcatatgacaagatatgtccacttttgcaacagaggagagcaaaaatggacatatctaacctggcggcagcgcaaaagatg

SEQ ID NO: 164567 - DNA, 103 bp, Artificial Sequence
  Synthetic Polynucleotide
taatacgactcactatagggttcttaatattatcatatgacaagatatgtaacagaggagaacatatatggtcatatgaaacctggcggcagcgcaaaagatg

SEQ ID NO: 164568 - DNA, 103 bp, Artificial Sequence
  Synthetic Polynucleotide
taatacgactcactatagggttctcgggcattcttaatattatcatatgaaacagaggagatcatatatgaatattaagaacctggcggcagcgcaaaagatg

SEQ ID NO: 164569 - DNA, 103 bp, Artificial Sequence
  Synthetic Polynucleotide
taatacgactcactatagggtcctagtcccttctcgggcattcttaatataacagaggagaatattaatgatgcccgagaacctggcggcagcgcaaaagatg

SEQ ID NO: 164570 - DNA, 103 bp, Artificial Sequence
  Synthetic Polynucleotide
taatacgactcactataggggttcttggactcctagtcccttctcgggcaaacagaggagatgcccgatgagggactagaacctggcggcagcgcaaaagatg

SEQ ID NO: 164571 - DNA, 103 bp, Artificial Sequence
  Synthetic Polynucleotide
taatacgactcactatagggcactaaaggcaaaaccgcagcactgacacgaacagaggagacgtgtcatggctgcggttaacctggcggcagcgcaaaagatg

SEQ ID NO: 164572 - DNA, 103 bp, Artificial Sequence
  Synthetic Polynucleotide
taatacgactcactatagggttcatgagctgttcttggactcctagtcccaacagaggagagggactatgagtccaagaaacctggcggcagcgcaaaagatg

SEQ ID NO: 164573 - DNA, 103 bp, Artificial Sequence
  Synthetic Polynucleotide
taatacgactcactatagggttaaactgatttcatgagctgttcttggacaacagaggagagtccaaatgcagctcatgaacctggcggcagcgcaaaagatg

SEQ ID NO: 164574 - DNA, 103 bp, Artificial Sequence
  Synthetic Polynucleotide
taatacgactcactatagggtagcttctctttaaactgatttcatgagctaacagaggagaagctcaatgaatcagtttaacctggcggcagcgcaaaagatg

SEQ ID NO: 164575 - DNA, 103 bp, Artificial Sequence
  Synthetic Polynucleotide
taatacgactcactatagggcactgattcatagcttctctttaaactgataacagaggagaatcagtatgaagagaagcaacctggcggcagcgcaaaagatg

SEQ ID NO: 164576 - DNA, 103 bp, Artificial Sequence
  Synthetic Polynucleotide
taatacgactcactatagggtatttccttccactgattcatagcttctctaacagaggagaagagaaatgatgaatcagaacctggcggcagcgcaaaagatg

SEQ ID NO: 164577 - DNA, 103 bp, Artificial Sequence
  Synthetic Polynucleotide
taatacgactcactatagggccttgctttatatttccttccactgattcaaacagaggagatgaatcatgggaaggaaaaacctggcggcagcgcaaaagatg

SEQ ID NO: 164578 - DNA, 103 bp, Artificial Sequence
  Synthetic Polynucleotide
taatacgactcactatagggcattgacatcccttgctttatatttccttcaacagaggagagaaggaatgataaagcaaaacctggcggcagcgcaaaagatg

SEQ ID NO: 164579 - DNA, 103 bp, Artificial Sequence
  Synthetic Polynucleotide
taatacgactcactataggggagactccctcattgacatcccttgctttaaacagaggagataaagcatgggatgtcaaaacctggcggcagcgcaaaagatg

SEQ ID NO: 164580 - DNA, 103 bp, Artificial Sequence
  Synthetic Polynucleotide
taatacgactcactataggggctgatacaggagactccctcattgacatcaacagaggagagatgtcatggagggagtcaacctggcggcagcgcaaaagatg

SEQ ID NO: 164581 - DNA, 103 bp, Artificial Sequence
  Synthetic Polynucleotide
taatacgactcactatagggctctaacggtgctgatacaggagactccctaacagaggagaagggagatgcctgtatcaaacctggcggcagcgcaaaagatg

SEQ ID NO: 164582 - DNA, 103 bp, Artificial Sequence
  Synthetic Polynucleotide
taatacgactcactataggggcagcgggtgcactaaaggcaaaaccgcagaacagaggagactgcggatgtgcctttagaacctggcggcagcgcaaaagatg

SEQ ID NO: 164583 - DNA, 103 bp, Artificial Sequence
  Synthetic Polynucleotide
taatacgactcactatagggatatcagcccctctaacggtgctgatacagaacagaggagactgtatatgcaccgttagaacctggcggcagcgcaaaagatg

SEQ ID NO: 164584 - DNA, 103 bp, Artificial Sequence
  Synthetic Polynucleotide
taatacgactcactatagggaatgctcggcatatcagcccctctaacggtaacagaggagaaccgttatgggggctgataacctggcggcagcgcaaaagatg

SEQ ID NO: 164585 - DNA, 103 bp, Artificial Sequence
  Synthetic Polynucleotide
taatacgactcactatagggccccctgggtaatgctcggcatatcagcccaacagaggagagggctgatgtgccgagcaaacctggcggcagcgcaaaagatg

SEQ ID NO: 164586 - DNA, 103 bp, Artificial Sequence
  Synthetic Polynucleotide
taatacgactcactatagggaatgaggactccccctgggtaatgctcggcaacagaggagagccgagatgtacccagggaacctggcggcagcgcaaaagatg

SEQ ID NO: 164587 - DNA, 103 bp, Artificial Sequence
  Synthetic Polynucleotide
taatacgactcactatagggttgaggtcagaatgaggactccccctgggtaacagaggagaacccagatggagtcctcaaacctggcggcagcgcaaaagatg

SEQ ID NO: 164588 - DNA, 103 bp, Artificial Sequence
  Synthetic Polynucleotide
taatacgactcactatagggagtcctttctttgaggtcagaatgaggactaacagaggagaagtcctatgtctgacctcaacctggcggcagcgcaaaagatg

SEQ ID NO: 164589 - DNA, 103 bp, Artificial Sequence
  Synthetic Polynucleotide
taatacgactcactatagggcagacaatacagtcctttctttgaggtcagaacagaggagactgaccatgaagaaaggaaacctggcggcagcgcaaaagatg

SEQ ID NO: 164590 - DNA, 103 bp, Artificial Sequence
  Synthetic Polynucleotide
taatacgactcactatagggattatggagccagacaatacagtcctttctaacagaggagaagaaagatgtgtattgtcaacctggcggcagcgcaaaagatg

SEQ ID NO: 164591 - DNA, 103 bp, Artificial Sequence
  Synthetic Polynucleotide
taatacgactcactatagggtgtcccctgcattatggagccagacaatacaacagaggagagtattgatgggctccataaacctggcggcagcgcaaaagatg

SEQ ID NO: 164592 - DNA, 103 bp, Artificial Sequence
  Synthetic Polynucleotide
taatacgactcactatagggttgctcttggtgtcccctgcattatggagcaacagaggagagctccaatgtgcaggggaaacctggcggcagcgcaaaagatg

SEQ ID NO: 164593 - DNA, 103 bp, Artificial Sequence
  Synthetic Polynucleotide
taatacgactcactatagggagcccttctggcagcgggtgcactaaaggcaacagaggagagcctttatggcacccgctaacctggcggcagcgcaaaagatg

SEQ ID NO: 164594 - DNA, 103 bp, Artificial Sequence
  Synthetic Polynucleotide
taatacgactcactatagggctttcagttgttgctcttggtgtcccctgcaacagaggagagcagggatgaccaagagcaacctggcggcagcgcaaaagatg

SEQ ID NO: 164595 - DNA, 103 bp, Artificial Sequence
  Synthetic Polynucleotide
taatacgactcactatagggatcttcaaagctttcagttgttgctcttggaacagaggagaccaagaatgacaactgaaaacctggcggcagcgcaaaagatg

SEQ ID NO: 164596 - DNA, 103 bp, Artificial Sequence
  Synthetic Polynucleotide
taatacgactcactatagggatttaaggccatcttcaaagctttcagttgaacagaggagacaactgatggctttgaagaacctggcggcagcgcaaaagatg

SEQ ID NO: 164597 - DNA, 103 bp, Artificial Sequence
  Synthetic Polynucleotide
taatacgactcactatagggtgtttgggatatttaaggccatcttcaaagaacagaggagactttgaatgtggccttaaaacctggcggcagcgcaaaagatg

SEQ ID NO: 164598 - DNA, 103 bp, Artificial Sequence
  Synthetic Polynucleotide
taatacgactcactatagggccttttaatttgtttgggatatttaaggccaacagaggagaggccttatgtatcccaaaaacctggcggcagcgcaaaagatg

SEQ ID NO: 164599 - DNA, 103 bp, Artificial Sequence
  Synthetic Polynucleotide
taatacgactcactataggggaggactttcccttttaatttgtttgggataacagaggagaatcccaatgaaattaaaaaacctggcggcagcgcaaaagatg

SEQ ID NO: 164600 - DNA, 103 bp, Artificial Sequence
  Synthetic Polynucleotide
taatacgactcactataggggctcgtatgggaggactttcccttttaattaacagaggagaaattaaatgggaaagtccaacctggcggcagcgcaaaagatg

SEQ ID NO: 164601 - DNA, 103 bp, Artificial Sequence
  Synthetic Polynucleotide
taatacgactcactatagggaccttcaaatgctcgtatgggaggactttcaacagaggagagaaagtatgcccatacgaaacctggcggcagcgcaaaagatg

SEQ ID NO: 164602 - DNA, 103 bp, Artificial Sequence
  Synthetic Polynucleotide
taatacgactcactatagggtggtaatggcaccttcaaatgctcgtatggaacagaggagaccatacatgcatttgaagaacctggcggcagcgcaaaagatg

SEQ ID NO: 164603 - DNA, 103 bp, Artificial Sequence
  Synthetic Polynucleotide
taatacgactcactatagggggttttcctttggtaatggcaccttcaaataacagaggagaatttgaatgtgccattacaacctggcggcagcgcaaaagatg

SEQ ID NO: 164604 - DNA, 103 bp, Artificial Sequence
  Synthetic Polynucleotide
taatacgactcactatagggataacgactttgttctgtgctgaatgctccaacagaggagaggagcaatgagcacagaaaacctggcggcagcgcaaaagatg

SEQ ID NO: 164605 - DNA, 103 bp, Artificial Sequence
  Synthetic Polynucleotide
taatacgactcactatagggagaagccctcagcccttctggcagcgggtgaacagaggagacacccgatgccagaagggaacctggcggcagcgcaaaagatg

SEQ ID NO: 164606 - DNA, 103 bp, Artificial Sequence
  Synthetic Polynucleotide
taatacgactcactataggggccatcatatggttttcctttggtaatggcaacagaggagagccattatgaaaggaaaaaacctggcggcagcgcaaaagatg

SEQ ID NO: 164607 - DNA, 103 bp, Artificial Sequence
  Synthetic Polynucleotide
taatacgactcactatagggtggtggtgatgccatcatatggttttccttaacagaggagaaaggaaatgcatatgatgaacctggcggcagcgcaaaagatg

SEQ ID NO: 164608 - DNA, 103 bp, Artificial Sequence
  Synthetic Polynucleotide
taatacgactcactatagggatttctttgatggtggtgatgccatcatataacagaggagaatatgaatgcatcaccacaacctggcggcagcgcaaaagatg

SEQ ID NO: 164609 - DNA, 103 bp, Artificial Sequence
  Synthetic Polynucleotide
taatacgactcactatagggggaacgccccatttctttgatggtggtgataacagaggagaatcaccatgatcaaagaaaacctggcggcagcgcaaaagatg

SEQ ID NO: 164610 - DNA, 103 bp, Artificial Sequence
  Synthetic Polynucleotide
taatacgactcactatagggtctcatgaatggaacgccccatttctttgaaacagaggagatcaaagatgtggggcgttaacctggcggcagcgcaaaagatg

SEQ ID NO: 164611 - DNA, 103 bp, Artificial Sequence
  Synthetic Polynucleotide
taatacgactcactatagggtgccttggaatctcatgaatggaacgccccaacagaggagaggggcgatgcattcatgaaacctggcggcagcgcaaaagatg

SEQ ID NO: 164612 - DNA, 103 bp, Artificial Sequence
  Synthetic Polynucleotide
taatacgactcactatagggtaaaatatcttgccttggaatctcatgaataacagaggagaattcatatgattccaaggaacctggcggcagcgcaaaagatg

SEQ ID NO: 164613 - DNA, 103 bp, Artificial Sequence
  Synthetic Polynucleotide
taatacgactcactatagggtttcctgagttaaaatatcttgccttggaaaacagaggagattccaaatgaagatatttaacctggcggcagcgcaaaagatg

SEQ ID NO: 164614 - DNA, 103 bp, Artificial Sequence
  Synthetic Polynucleotide
taatacgactcactataggggttttccgactttcctgagttaaaatatctaacagaggagaagatatatgaactcaggaaacctggcggcagcgcaaaagatg

SEQ ID NO: 164615 - DNA, 103 bp, Artificial Sequence
  Synthetic Polynucleotide
taatacgactcactatagggcacttctggagttttccgactttcctgagtaacagaggagaactcagatgagtcggaaaaacctggcggcagcgcaaaagatg

SEQ ID NO: 164616 - DNA, 103 bp, Artificial Sequence
  Synthetic Polynucleotide
taatacgactcactatagggtagcatctgcagaagccctcagcccttctgaacagaggagacagaagatgtgagggcttaacctggcggcagcgcaaaagatg

SEQ ID NO: 164617 - DNA, 103 bp, Artificial Sequence
  Synthetic Polynucleotide
taatacgactcactatagggtgctctggaccacttctggagttttccgacaacagaggagagtcggaatgctccagaagaacctggcggcagcgcaaaagatg

SEQ ID NO: 164618 - DNA, 103 bp, Artificial Sequence
  Synthetic Polynucleotide
taatacgactcactatagggatcggccgtgtgctctggaccacttctggaaacagaggagatccagaatgggtccagagaacctggcggcagcgcaaaagatg

SEQ ID NO: 164619 - DNA, 103 bp, Artificial Sequence
  Synthetic Polynucleotide
taatacgactcactatagggaccctcaattatcggccgtgtgctctggacaacagaggagagtccagatgacacggccgaacctggcggcagcgcaaaagatg

SEQ ID NO: 164620 - DNA, 103 bp, Artificial Sequence
  Synthetic Polynucleotide
taatacgactcactataggggggaaatggaaccctcaattatcggccgtgaacagaggagacacggcatgtaattgaggaacctggcggcagcgcaaaagatg

SEQ ID NO: 164621 - DNA, 103 bp, Artificial Sequence
  Synthetic Polynucleotide
taatacgactcactatagggggtgtgccctgggaaatggaaccctcaattaacagaggagaaattgaatgttccatttcaacctggcggcagcgcaaaagatg

SEQ ID NO: 164622 - DNA, 103 bp, Artificial Sequence
  Synthetic Polynucleotide
taatacgactcactatagggaaactttattggtgtgccctgggaaatggaaacagaggagatccattatgcagggcacaaacctggcggcagcgcaaaagatg

SEQ ID NO: 164623 - DNA, 103 bp, Artificial Sequence
  Synthetic Polynucleotide
taatacgactcactatagggagttgttgtcaaactttattggtgtgccctaacagaggagaagggcaatgcaataaagtaacctggcggcagcgcaaaagatg

SEQ ID NO: 164624 - DNA, 103 bp, Artificial Sequence
  Synthetic Polynucleotide
taatacgactcactataggggattgacctgagttgttgtcaaactttattaacagaggagaaataaaatgtgacaacaaaacctggcggcagcgcaaaagatg

SEQ ID NO: 164625 - DNA, 103 bp, Artificial Sequence
  Synthetic Polynucleotide
taatacgactcactatagggtttgatggcagattgacctgagttgttgtcaacagaggagagacaacatgtcaggtcaaaacctggcggcagcgcaaaagatg

SEQ ID NO: 164626 - DNA, 103 bp, Artificial Sequence
  Synthetic Polynucleotide
taatacgactcactatagggtgacattgtgtttgatggcagattgacctgaacagaggagacaggtcatgctgccatcaaacctggcggcagcgcaaaagatg

SEQ ID NO: 164627 - DNA, 103 bp, Artificial Sequence
  Synthetic Polynucleotide
taatacgactcactatagggggatccttcttagcatctgcagaagccctcaacagaggagagagggcatgtgcagatgcaacctggcggcagcgcaaaagatg

SEQ ID NO: 164628 - DNA, 103 bp, Artificial Sequence
  Synthetic Polynucleotide
taatacgactcactatagggattaaggatttgacattgtgtttgatggcaaacagaggagatgccatatgacacaatgtaacctggcggcagcgcaaaagatg

SEQ ID NO: 164629 - DNA, 103 bp, Artificial Sequence
  Synthetic Polynucleotide
taatacgactcactatagggaggccccgtgattaaggatttgacattgtgaacagaggagacacaatatgaaatccttaaacctggcggcagcgcaaaagatg

SEQ ID NO: 164630 - DNA, 103 bp, Artificial Sequence
  Synthetic Polynucleotide
taatacgactcactatagggatagtttgctaggccccgtgattaaggattaacagaggagaaatcctatgtcacggggcaacctggcggcagcgcaaaagatg

SEQ ID NO: 164631 - DNA, 103 bp, Artificial Sequence
  Synthetic Polynucleotide
taatacgactcactatagggattccacgggatagtttgctaggccccgtgaacagaggagacacgggatgtagcaaactaacctggcggcagcgcaaaagatg

SEQ ID NO: 164632 - DNA, 103 bp, Artificial Sequence
  Synthetic Polynucleotide
taatacgactcactatagggcagcggaggcattccacgggatagtttgctaacagaggagaagcaaaatgtcccgtggaaacctggcggcagcgcaaaagatg

SEQ ID NO: 164633 - DNA, 103 bp, Artificial Sequence
  Synthetic Polynucleotide
taatacgactcactataggggcacaatttccagcggaggcattccacgggaacagaggagacccgtgatgtgcctccgcaacctggcggcagcgcaaaagatg

SEQ ID NO: 164634 - DNA, 103 bp, Artificial Sequence
  Synthetic Polynucleotide
taatacgactcactatagggatgttctctggcacaatttccagcggaggcaacagaggagagcctccatgggaaattgtaacctggcggcagcgcaaaagatg

SEQ ID NO: 164635 - DNA, 103 bp, Artificial Sequence
  Synthetic Polynucleotide
taatacgactcactatagggtaccacttttatgttctctggcacaatttcaacagaggagagaaattatgccagagaacaacctggcggcagcgcaaaagatg

SEQ ID NO: 164636 - DNA, 103 bp, Artificial Sequence
  Synthetic Polynucleotide
taatacgactcactatagggttccccgttctaccacttttatgttctctgaacagaggagacagagaatgtaaaagtggaacctggcggcagcgcaaaagatg

SEQ ID NO: 164637 - DNA, 103 bp, Artificial Sequence
  Synthetic Polynucleotide
taatacgactcactatagggtcctcatattttccccgttctaccacttttaacagaggagaaaaagtatgagaacggggaacctggcggcagcgcaaaagatg

SEQ ID NO: 164638 - DNA, 103 bp, Artificial Sequence
  Synthetic Polynucleotide
taatacgactcactatagggtccgaatgctggatccttcttagcatctgcaacagaggagagcagatatgaagaaggataacctggcggcagcgcaaaagatg

SEQ ID NO: 164639 - DNA, 103 bp, Artificial Sequence
  Synthetic Polynucleotide
taatacgactcactatagggtgctttcacatcctcatattttccccgttcaacagaggagagaacggatgaaatatgagaacctggcggcagcgcaaaagatg

SEQ ID NO: 164640 - DNA, 103 bp, Artificial Sequence
  Synthetic Polynucleotide
taatacgactcactatagggcggtctcgcctgctttcacatcctcatattaacagaggagaaatatgatgatgtgaaagaacctggcggcagcgcaaaagatg

SEQ ID NO: 164641 - DNA, 103 bp, Artificial Sequence
  Synthetic Polynucleotide
taatacgactcactatagggcgggaacgcacggtctcgcctgctttcacaaacagaggagatgtgaaatgaggcgagacaacctggcggcagcgcaaaagatg

SEQ ID NO: 164642 - DNA, 103 bp, Artificial Sequence
  Synthetic Polynucleotide
taatacgactcactatagggtgacgtgtgccgggaacgcacggtctcgccaacagaggagaggcgagatggtgcgttccaacctggcggcagcgcaaaagatg

SEQ ID NO: 164643 - DNA, 103 bp, Artificial Sequence
  Synthetic Polynucleotide
taatacgactcactatagggagcttaccactgacgtgtgccgggaacgcaaacagaggagatgcgttatgggcacacgtaacctggcggcagcgcaaaagatg

SEQ ID NO: 164644 - DNA, 103 bp, Artificial Sequence
  Synthetic Polynucleotide
taatacgactcactataggggaggggccagagcttaccactgacgtgtgcaacagaggagagcacacatgagtggtaagaacctggcggcagcgcaaaagatg

SEQ ID NO: 164645 - DNA, 103 bp, Artificial Sequence
  Synthetic Polynucleotide
taatacgactcactatagggcctaagaacggaggggccagagcttaccacaacagaggagagtggtaatgtctggccccaacctggcggcagcgcaaaagatg

SEQ ID NO: 164646 - DNA, 103 bp, Artificial Sequence
  Synthetic Polynucleotide
taatacgactcactataggggcagtgtggacctaagaacggaggggccagaacagaggagactggccatgccgttcttaaacctggcggcagcgcaaaagatg

SEQ ID NO: 164647 - DNA, 103 bp, Artificial Sequence
  Synthetic Polynucleotide
taatacgactcactatagggggagcttcatgcagtgtggacctaagaacgaacagaggagacgttctatggtccacactaacctggcggcagcgcaaaagatg

SEQ ID NO: 164648 - DNA, 103 bp, Artificial Sequence
  Synthetic Polynucleotide
taatacgactcactatagggttgtgctttgggagcttcatgcagtgtggaaacagaggagatccacaatgcatgaagctaacctggcggcagcgcaaaagatg

SEQ ID NO: 164649 - DNA, 103 bp, Artificial Sequence
  Synthetic Polynucleotide
taatacgactcactatagggcatgtttgcctccgaatgctggatccttctaacagaggagaagaaggatgcagcattcgaacctggcggcagcgcaaaagatg

SEQ ID NO: 164650 - DNA, 103 bp, Artificial Sequence
  Synthetic Polynucleotide
taatacgactcactatagggcagggctcagttgtgctttgggagcttcataacagaggagaatgaagatgccaaagcacaacctggcggcagcgcaaaagatg

SEQ ID NO: 164651 - DNA, 103 bp, Artificial Sequence
  Synthetic Polynucleotide
taatacgactcactatagggtcataaatcccagggctcagttgtgctttgaacagaggagacaaagcatgactgagcccaacctggcggcagcgcaaaagatg

SEQ ID NO: 164652 - DNA, 103 bp, Artificial Sequence
  Synthetic Polynucleotide
taatacgactcactatagggactggtgtcatcataaatcccagggctcagaacagaggagactgagcatggggatttataacctggcggcagcgcaaaagatg

SEQ ID NO: 164653 - DNA, 103 bp, Artificial Sequence
  Synthetic Polynucleotide
taatacgactcactatagggtcctccgtgcactggtgtcatcataaatccaacagaggagaggatttatgatgacaccaaacctggcggcagcgcaaaagatg

SEQ ID NO: 164654 - DNA, 103 bp, Artificial Sequence
  Synthetic Polynucleotide
taatacgactcactatagggctcacaggggtcctccgtgcactggtgtcaaacagaggagatgacacatgtgcacggagaacctggcggcagcgcaaaagatg

SEQ ID NO: 164655 - DNA, 103 bp, Artificial Sequence
  Synthetic Polynucleotide
taatacgactcactataggggttttgataactcacaggggtcctccgtgcaacagaggagagcacggatgacccctgtgaacctggcggcagcgcaaaagatg

SEQ ID NO: 164656 - DNA, 103 bp, Artificial Sequence
  Synthetic Polynucleotide
taatacgactcactatagggtggacatggtgttttgataactcacaggggaacagaggagacccctgatggttatcaaaaacctggcggcagcgcaaaagatg

SEQ ID NO: 164657 - DNA, 103 bp, Artificial Sequence
  Synthetic Polynucleotide
taatacgactcactatagggggtgagcctctggacatggtgttttgataaaacagaggagattatcaatgcaccatgtcaacctggcggcagcgcaaaagatg

SEQ ID NO: 164658 - DNA, 103 bp, Artificial Sequence
  Synthetic Polynucleotide
taatacgactcactataggggttcatcatgggtgagcctctggacatggtaacagaggagaaccatgatgagaggctcaaacctggcggcagcgcaaaagatg

SEQ ID NO: 164659 - DNA, 103 bp, Artificial Sequence
  Synthetic Polynucleotide
taatacgactcactatagggcagaagttctgttcatcatgggtgagcctcaacagaggagagaggctatgccatgatgaaacctggcggcagcgcaaaagatg

SEQ ID NO: 164660 - DNA, 103 bp, Artificial Sequence
  Synthetic Polynucleotide
taatacgactcactataggggatggagcttcatgtttgcctccgaatgctaacagaggagaagcattatgaggcaaacaaacctggcggcagcgcaaaagatg

SEQ ID NO: 164661 - DNA, 103 bp, Artificial Sequence
  Synthetic Polynucleotide
taatacgactcactatagggattgtaacatcagaagttctgttcatcatgaacagaggagacatgatatgcagaacttcaacctggcggcagcgcaaaagatg

SEQ ID NO: 164662 - DNA, 103 bp, Artificial Sequence
  Synthetic Polynucleotide
taatacgactcactataggggttagaagaaattgtaacatcagaagttctaacagaggagaagaactatggatgttacaaacctggcggcagcgcaaaagatg

SEQ ID NO: 164663 - DNA, 103 bp, Artificial Sequence
  Synthetic Polynucleotide
taatacgactcactatagggtggtagacttgttagaagaaattgtaacataacagaggagaatgttaatgtttcttctaaacctggcggcagcgcaaaagatg

SEQ ID NO: 164664 - DNA, 103 bp, Artificial Sequence
  Synthetic Polynucleotide
taatacgactcactatagggctttcatgattggtagacttgttagaagaaaacagaggagattcttcatgcaagtctacaacctggcggcagcgcaaaagatg

SEQ ID NO: 164665 - DNA, 103 bp, Artificial Sequence
  Synthetic Polynucleotide
taatacgactcactatagggtgtcgatttcctttcatgattggtagacttaacagaggagaaagtctatgaatcatgaaaacctggcggcagcgcaaaagatg

SEQ ID NO: 164666 - DNA, 103 bp, Artificial Sequence
  Synthetic Polynucleotide
taatacgactcactatagggtaggggtcagtgtcgatttcctttcatgataacagaggagaatcatgatgggaaatcgaaacctggcggcagcgcaaaagatg

SEQ ID NO: 164667 - DNA, 103 bp, Artificial Sequence
  Synthetic Polynucleotide
taatacgactcactatagggtccctctgggtaggggtcagtgtcgatttcaacagaggagagaaatcatgactgaccccaacctggcggcagcgcaaaagatg

SEQ ID NO: 164668 - DNA, 103 bp, Artificial Sequence
  Synthetic Polynucleotide
taatacgactcactatagggtgggatactttccctctgggtaggggtcagaacagaggagactgaccatgacccagaggaacctggcggcagcgcaaaagatg

SEQ ID NO: 164669 - DNA, 103 bp, Artificial Sequence
  Synthetic Polynucleotide
taatacgactcactataggggagacttcgctgggatactttccctctgggaacagaggagacccagaatgaaagtatccaacctggcggcagcgcaaaagatg

SEQ ID NO: 164670 - DNA, 103 bp, Artificial Sequence
  Synthetic Polynucleotide
taatacgactcactatagggccaggcactggagacttcgctgggatacttaacagaggagaaagtatatgagcgaagtcaacctggcggcagcgcaaaagatg

SEQ ID NO: 164671 - DNA, 103 bp, Artificial Sequence
  Synthetic Polynucleotide
taatacgactcactatagggaattggagaggatggagcttcatgtttgccaacagaggagaggcaaaatggaagctccaaacctggcggcagcgcaaaagatg

SEQ ID NO: 164672 - DNA, 103 bp, Artificial Sequence
  Synthetic Polynucleotide
taatacgactcactatagggagggtccaccccaggcactggagacttcgcaacagaggagagcgaagatgccagtgcctaacctggcggcagcgcaaaagatg

SEQ ID NO: 164673 - DNA, 103 bp, Artificial Sequence
  Synthetic Polynucleotide
taatacgactcactatagggggctcacgacagggtccaccccaggcactgaacagaggagacagtgcatggggtggaccaacctggcggcagcgcaaaagatg

SEQ ID NO: 164674 - DNA, 103 bp, Artificial Sequence
  Synthetic Polynucleotide
taatacgactcactatagggaacggactgtggctcacgacagggtccaccaacagaggagaggtggaatgtgtcgtgagaacctggcggcagcgcaaaagatg

SEQ ID NO: 164675 - DNA, 103 bp, Artificial Sequence
  Synthetic Polynucleotide
taatacgactcactatagggatggggatcaaacggactgtggctcacgacaacagaggagagtcgtgatgcacagtccgaacctggcggcagcgcaaaagatg

SEQ ID NO: 164676 - DNA, 103 bp, Artificial Sequence
  Synthetic Polynucleotide
taatacgactcactatagggtgcctctgtgatggggatcaaacggactgtaacagaggagaacagtcatgttgatccccaacctggcggcagcgcaaaagatg

SEQ ID NO: 164677 - DNA, 103 bp, Artificial Sequence
  Synthetic Polynucleotide
taatacgactcactatagggcctgcagtgctgcctctgtgatggggatcaaacagaggagatgatccatgtcacagaggaacctggcggcagcgcaaaagatg

SEQ ID NO: 164678 - DNA, 103 bp, Artificial Sequence
  Synthetic Polynucleotide
taatacgactcactatagggataaacctcgcctgcagtgctgcctctgtgaacagaggagacacagaatgagcactgcaaacctggcggcagcgcaaaagatg

SEQ ID NO: 164679 - DNA, 103 bp, Artificial Sequence
  Synthetic Polynucleotide
taatacgactcactatagggggtggctccgataaacctcgcctgcagtgcaacagaggagagcactgatggcgaggtttaacctggcggcagcgcaaaagatg

SEQ ID NO: 164680 - DNA, 103 bp, Artificial Sequence
  Synthetic Polynucleotide
taatacgactcactatagggtgcgtgggcaggtggctccgataaacctcgaacagaggagacgaggtatgtcggagccaaacctggcggcagcgcaaaagatg

SEQ ID NO: 164681 - DNA, 103 bp, Artificial Sequence
  Synthetic Polynucleotide
taatacgactcactatagggtggatccaagtgcgtgggcaggtggctccgaacagaggagacggagcatgctgcccacgaacctggcggcagcgcaaaagatg

SEQ ID NO: 164682 - DNA, 103 bp, Artificial Sequence
  Synthetic Polynucleotide
taatacgactcactataggggttgccccgaaattggagaggatggagcttaacagaggagaaagctcatgcctctccaaaacctggcggcagcgcaaaagatg

SEQ ID NO: 164683 - DNA, 103 bp, Artificial Sequence
  Synthetic Polynucleotide
taatacgactcactatagggaaggcatggctggatccaagtgcgtgggcaaacagaggagatgcccaatgacttggatcaacctggcggcagcgcaaaagatg

SEQ ID NO: 164684 - DNA, 103 bp, Artificial Sequence
  Synthetic Polynucleotide
taatacgactcactataggggccctgtgaaaaggcatggctggatccaagaacagaggagacttggaatgagccatgccaacctggcggcagcgcaaaagatg

SEQ ID NO: 164685 - DNA, 103 bp, Artificial Sequence
  Synthetic Polynucleotide
taatacgactcactatagggaggatccaaagccctgtgaaaaggcatggcaacagaggagagccatgatgtttcacaggaacctggcggcagcgcaaaagatg

SEQ ID NO: 164686 - DNA, 103 bp, Artificial Sequence
  Synthetic Polynucleotide
taatacgactcactatagggcagccgctgcaggatccaaagccctgtgaaaacagaggagattcacaatgctttggatcaacctggcggcagcgcaaaagatg

SEQ ID NO: 164687 - DNA, 103 bp, Artificial Sequence
  Synthetic Polynucleotide
taatacgactcactatagggaacaggtaagcagccgctgcaggatccaaaaacagaggagatttggaatgtgcagcggcaacctggcggcagcgcaaaagatg

SEQ ID NO: 164688 - DNA, 103 bp, Artificial Sequence
  Synthetic Polynucleotide
taatacgactcactatagggctgtctctgaaacaggtaagcagccgctgcaacagaggagagcagcgatggcttacctgaacctggcggcagcgcaaaagatg

SEQ ID NO: 164689 - DNA, 103 bp, Artificial Sequence
  Synthetic Polynucleotide
taatacgactcactatagggttggtgaaagctgtctctgaaacaggtaagaacagaggagacttaccatgttcagagacaacctggcggcagcgcaaaagatg

SEQ ID NO: 164690 - DNA, 103 bp, Artificial Sequence
  Synthetic Polynucleotide
taatacgactcactatagggtaacctggagttggtgaaagctgtctctgaaacagaggagatcagagatggctttcaccaacctggcggcagcgcaaaagatg

SEQ ID NO: 164691 - DNA, 103 bp, Artificial Sequence
  Synthetic Polynucleotide
taatacgactcactatagggctgacttgggtaacctggagttggtgaaagaacagaggagactttcaatgactccaggtaacctggcggcagcgcaaaagatg

SEQ ID NO: 164692 - DNA, 103 bp, Artificial Sequence
  Synthetic Polynucleotide
taatacgactcactatagggaaagctgatactgacttgggtaacctggagaacagaggagactccagatgacccaagtcaacctggcggcagcgcaaaagatg

SEQ ID NO: 164693 - DNA, 103 bp, Artificial Sequence
  Synthetic Polynucleotide
taatacgactcactatagggtctccacatggttgccccgaaattggagagaacagaggagactctccatgttcggggcaaacctggcggcagcgcaaaagatg

SEQ ID NO: 164694 - DNA, 103 bp, Artificial Sequence
  Synthetic Polynucleotide
taatacgactcactatagggtccattgcgtaaagctgatactgacttgggaacagaggagacccaagatggtatcagctaacctggcggcagcgcaaaagatg

SEQ ID NO: 164695 - DNA, 103 bp, Artificial Sequence
  Synthetic Polynucleotide
taatacgactcactatagggtcttgtgttctccattgcgtaaagctgataaacagaggagatatcagatgtacgcaatgaacctggcggcagcgcaaaagatg

SEQ ID NO: 164696 - DNA, 103 bp, Artificial Sequence
  Synthetic Polynucleotide
taatacgactcactatagggagattgtctgtcttgtgttctccattgcgtaacagaggagaacgcaaatgagaacacaaaacctggcggcagcgcaaaagatg

SEQ ID NO: 164697 - DNA, 103 bp, Artificial Sequence
  Synthetic Polynucleotide
taatacgactcactatagggtaatcatttaagattgtctgtcttgtgttcaacagaggagagaacacatgacagacaataacctggcggcagcgcaaaagatg

SEQ ID NO: 164698 - DNA, 103 bp, Artificial Sequence
  Synthetic Polynucleotide
taatacgactcactatagggtgaggtaatgtaatcatttaagattgtctgaacagaggagacagacaatgttaaatgataacctggcggcagcgcaaaagatg

SEQ ID NO: 164699 - DNA, 103 bp, Artificial Sequence
  Synthetic Polynucleotide
taatacgactcactataggggcatctgttgtgaggtaatgtaatcatttaaacagaggagataaatgatgacattacctaacctggcggcagcgcaaaagatg

SEQ ID NO: 164700 - DNA, 103 bp, Artificial Sequence
  Synthetic Polynucleotide
taatacgactcactatagggaagttcacttgcatctgttgtgaggtaatgaacagaggagacattacatgacaacagataacctggcggcagcgcaaaagatg

SEQ ID NO: 164701 - DNA, 103 bp, Artificial Sequence
  Synthetic Polynucleotide
taatacgactcactatagggatctggacgcaagttcacttgcatctgttgaacagaggagacaacagatgcaagtgaacaacctggcggcagcgcaaaagatg

SEQ ID NO: 164702 - DNA, 103 bp, Artificial Sequence
  Synthetic Polynucleotide
taatacgactcactatagggctctggccacatctggacgcaagttcacttaacagaggagaaagtgaatgtgcgtccagaacctggcggcagcgcaaaagatg

SEQ ID NO: 164703 - DNA, 103 bp, Artificial Sequence
  Synthetic Polynucleotide
taatacgactcactatagggggggagagtcctctggccacatctggacgcaacagaggagagcgtccatgtgtggccagaacctggcggcagcgcaaaagatg

SEQ ID NO: 164704 - DNA, 103 bp, Artificial Sequence
  Synthetic Polynucleotide
taatacgactcactatagggattttgatcatctccacatggttgccccgaaacagaggagatcggggatgccatgtggaaacctggcggcagcgcaaaagatg

SEQ ID NO: 164705 - DNA, 103 bp, Artificial Sequence
  Synthetic Polynucleotide
taatacgactcactatagggctgctctcttggggagagtcctctggccacaacagaggagagtggccatgggactctccaacctggcggcagcgcaaaagatg

SEQ ID NO: 164706 - DNA, 103 bp, Artificial Sequence
  Synthetic Polynucleotide
taatacgactcactataggggacccagtggctgctctcttggggagagtcaacagaggagagactctatgcaagagagcaacctggcggcagcgcaaaagatg

SEQ ID NO: 164707 - DNA, 103 bp, Artificial Sequence
  Synthetic Polynucleotide
taatacgactcactataggggggtatgggagacccagtggctgctctcttaacagaggagaaagagaatggccactgggaacctggcggcagcgcaaaagatg

SEQ ID NO: 164708 - DNA, 103 bp, Artificial Sequence
  Synthetic Polynucleotide
taatacgactcactatagggtctcgttgctgggtatgggagacccagtggaacagaggagaccactgatgctcccatacaacctggcggcagcgcaaaagatg

SEQ ID NO: 164709 - DNA, 103 bp, Artificial Sequence
  Synthetic Polynucleotide
taatacgactcactatagggcaatgattcctctcgttgctgggtatgggaaacagaggagatcccatatgcagcaacgaaacctggcggcagcgcaaaagatg

SEQ ID NO: 164710 - DNA, 103 bp, Artificial Sequence
  Synthetic Polynucleotide
taatacgactcactatagggttggtcaggtcaatgattcctctcgttgctaacagaggagaagcaacatgaggaatcataacctggcggcagcgcaaaagatg

SEQ ID NO: 164711 - DNA, 103 bp, Artificial Sequence
  Synthetic Polynucleotide
taatacgactcactatagggtggaggcatattggtcaggtcaatgattccaacagaggagaggaatcatggacctgaccaacctggcggcagcgcaaaagatg

SEQ ID NO: 164712 - DNA, 103 bp, Artificial Sequence
  Synthetic Polynucleotide
taatacgactcactatagggctaaaattgttggaggcatattggtcaggtaacagaggagaacctgaatgatatgcctcaacctggcggcagcgcaaaagatg

SEQ ID NO: 164713 - DNA, 103 bp, Artificial Sequence
  Synthetic Polynucleotide
taatacgactcactatagggggatgaggcactaaaattgttggaggcataaacagaggagatatgccatgaacaattttaacctggcggcagcgcaaaagatg

SEQ ID NO: 164714 - DNA, 103 bp, Artificial Sequence
  Synthetic Polynucleotide
taatacgactcactatagggtgttccccctggatgaggcactaaaattgtaacagaggagaacaattatggtgcctcataacctggcggcagcgcaaaagatg

SEQ ID NO: 164715 - DNA, 103 bp, Artificial Sequence
  Synthetic Polynucleotide
taatacgactcactatagggagtgaggaggataacgactttgttctgtgcaacagaggagagcacagatgaaagtcgttaacctggcggcagcgcaaaagatg

SEQ ID NO: 164716 - DNA, 103 bp, Artificial Sequence
  Synthetic Polynucleotide
taatacgactcactatagggaaggtgaagcattttgatcatctccacatgaacagaggagacatgtgatgatgatcaaaaacctggcggcagcgcaaaagatg

SEQ ID NO: 164717 - DNA, 103 bp, Artificial Sequence
  Synthetic Polynucleotide
taatacgactcactataggggaggagtgcttgttccccctggatgaggcaaacagaggagatgcctcatgcagggggaaaacctggcggcagcgcaaaagatg

SEQ ID NO: 164718 - DNA, 103 bp, Artificial Sequence
  Synthetic Polynucleotide
taatacgactcactatagggctgtccatgggaggagtgcttgttccccctaacagaggagaagggggatgaagcactccaacctggcggcagcgcaaaagatg

SEQ ID NO: 164719 - DNA, 103 bp, Artificial Sequence
  Synthetic Polynucleotide
taatacgactcactatagggataagtgattctgtccatgggaggagtgctaacagaggagaagcactatgcccatggacaacctggcggcagcgcaaaagatg

SEQ ID NO: 164720 - DNA, 103 bp, Artificial Sequence
  Synthetic Polynucleotide
taatacgactcactatagggtaccaggaatataagtgattctgtccatggaacagaggagaccatggatggaatcacttaacctggcggcagcgcaaaagatg

SEQ ID NO: 164721 - DNA, 103 bp, Artificial Sequence
  Synthetic Polynucleotide
taatacgactcactataggggtaatctgtgtaccaggaatataagtgattaacagaggagaaatcacatgtattcctggaacctggcggcagcgcaaaagatg

SEQ ID NO: 164722 - DNA, 103 bp, Artificial Sequence
  Synthetic Polynucleotide
taatacgactcactataggggggagggaaagtaatctgtgtaccaggaataacagaggagaattcctatgacacagattaacctggcggcagcgcaaaagatg

SEQ ID NO: 164723 - DNA, 103 bp, Artificial Sequence
  Synthetic Polynucleotide
taatacgactcactatagggtgtacggcctgggagggaaagtaatctgtgaacagaggagacacagaatgctttccctcaacctggcggcagcgcaaaagatg

SEQ ID NO: 164724 - DNA, 103 bp, Artificial Sequence
  Synthetic Polynucleotide
taatacgactcactataggggaagcagagttgtacggcctgggagggaaaaacagaggagatttcccatgcaggccgtaaacctggcggcagcgcaaaagatg

SEQ ID NO: 164725 - DNA, 103 bp, Artificial Sequence
  Synthetic Polynucleotide
taatacgactcactatagggtggagacatggaagcagagttgtacggcctaacagaggagaaggccgatgaactctgctaacctggcggcagcgcaaaagatg

SEQ ID NO: 164726 - DNA, 103 bp, Artificial Sequence
  Synthetic Polynucleotide
taatacgactcactatagggttgggtgtcctggagacatggaagcagagtaacagaggagaactctgatgccatgtctcaacctggcggcagcgcaaaagatg

SEQ ID NO: 164727 - DNA, 103 bp, Artificial Sequence
  Synthetic Polynucleotide
taatacgactcactataggggagagttttgaaggtgaagcattttgatcaaacagaggagatgatcaatgtgcttcaccaacctggcggcagcgcaaaagatg

SEQ ID NO: 164728 - DNA, 103 bp, Artificial Sequence
  Synthetic Polynucleotide
taatacgactcactataggggcaaggtgtgttgggtgtcctggagacatgaacagaggagacatgtcatgaggacacccaacctggcggcagcgcaaaagatg

SEQ ID NO: 164729 - DNA, 103 bp, Artificial Sequence
  Synthetic Polynucleotide
taatacgactcactatagggtgcagcagctgcaaggtgtgttgggtgtccaacagaggagaggacacatgacacaccttaacctggcggcagcgcaaaagatg

SEQ ID NO: 164730 - DNA, 103 bp, Artificial Sequence
  Synthetic Polynucleotide
taatacgactcactatagggtctcagcacttgcagcagctgcaaggtgtgaacagaggagacacaccatgcagctgctgaacctggcggcagcgcaaaagatg

SEQ ID NO: 164731 - DNA, 103 bp, Artificial Sequence
  Synthetic Polynucleotide
taatacgactcactatagggtcccgttccctctcagcacttgcagcagctaacagaggagaagctgcatgaagtgctgaaacctggcggcagcgcaaaagatg

SEQ ID NO: 164732 - DNA, 103 bp, Artificial Sequence
  Synthetic Polynucleotide
taatacgactcactatagggccgctcccgttcccgttccctctcagcactaacagaggagaagtgctatgagggaacggaacctggcggcagcgcaaaagatg

SEQ ID NO: 164733 - DNA, 103 bp, Artificial Sequence
  Synthetic Polynucleotide
taatacgactcactataggggctccttctcccgctcccgttcccgttcccaacagaggagagggaacatgaacgggagcaacctggcggcagcgcaaaagatg

SEQ ID NO: 164734 - DNA, 103 bp, Artificial Sequence
  Synthetic Polynucleotide
taatacgactcactatagggtcccgctcccgctccttctcccgctcccgtaacagaggagaacgggaatgggagaaggaaacctggcggcagcgcaaaagatg

SEQ ID NO: 164735 - DNA, 103 bp, Artificial Sequence
  Synthetic Polynucleotide
taatacgactcactatagggagcaatccgttcccgctcccgctccttctcaacagaggagagagaagatgcgggagcggaacctggcggcagcgcaaaagatg

SEQ ID NO: 164736 - DNA, 103 bp, Artificial Sequence
  Synthetic Polynucleotide
taatacgactcactatagggaggaagctgcagcaatccgttcccgctcccaacagaggagagggagcatgaacggattgaacctggcggcagcgcaaaagatg

SEQ ID NO: 164737 - DNA, 103 bp, Artificial Sequence
  Synthetic Polynucleotide
taatacgactcactatagggtagaggtcggaggaagctgcagcaatccgtaacagaggagaacggatatgtgcagcttcaacctggcggcagcgcaaaagatg

SEQ ID NO: 164738 - DNA, 103 bp, Artificial Sequence
  Synthetic Polynucleotide
taatacgactcactatagggctcttcctttgagagttttgaaggtgaagcaacagaggagagcttcaatgtcaaaactcaacctggcggcagcgcaaaagatg

SEQ ID NO: 164739 - DNA, 103 bp, Artificial Sequence
  Synthetic Polynucleotide
taatacgactcactatagggtggccgcaggtagaggtcggaggaagctgcaacagaggagagcagctatgtccgacctcaacctggcggcagcgcaaaagatg

SEQ ID NO: 164740 - DNA, 103 bp, Artificial Sequence
  Synthetic Polynucleotide
taatacgactcactataggggttctgagcctggccgcaggtagaggtcggaacagaggagaccgaccatgacctgcggcaacctggcggcagcgcaaaagatg

SEQ ID NO: 164741 - DNA, 103 bp, Artificial Sequence
  Synthetic Polynucleotide
taatacgactcactatagggcggccaggctgttctgagcctggccgcaggaacagaggagacctgcgatgaggctcagaaacctggcggcagcgcaaaagatg

SEQ ID NO: 164742 - DNA, 103 bp, Artificial Sequence
  Synthetic Polynucleotide
taatacgactcactatagggactgccaggtcggccaggctgttctgagccaacagaggagaggctcaatgcagcctggcaacctggcggcagcgcaaaagatg

SEQ ID NO: 164743 - DNA, 103 bp, Artificial Sequence
  Synthetic Polynucleotide
taatacgactcactatagggcatatccatgactgccaggtcggccaggctaacagaggagaagcctgatggacctggcaaacctggcggcagcgcaaaagatg

SEQ ID NO: 164744 - DNA, 103 bp, Artificial Sequence
  Synthetic Polynucleotide
taatacgactcactatagggggggagcgaacatatccatgactgccaggtaacagaggagaacctggatgtcatggataaacctggcggcagcgcaaaagatg

SEQ ID NO: 164745 - DNA, 103 bp, Artificial Sequence
  Synthetic Polynucleotide
taatacgactcactatagggtgaaggggaaggggagcgaacatatccatgaacagaggagacatggaatggttcgctccaacctggcggcagcgcaaaagatg

SEQ ID NO: 164746 - DNA, 103 bp, Artificial Sequence
  Synthetic Polynucleotide
taatacgactcactataggggagttcttactgaaggggaaggggagcgaaaacagaggagattcgctatgcttccccttaacctggcggcagcgcaaaagatg

SEQ ID NO: 164747 - DNA, 103 bp, Artificial Sequence
  Synthetic Polynucleotide
taatacgactcactatagggatggtctcctgagttcttactgaaggggaaaacagaggagattccccatgagtaagaacaacctggcggcagcgcaaaagatg

SEQ ID NO: 164748 - DNA, 103 bp, Artificial Sequence
  Synthetic Polynucleotide
taatacgactcactatagggctgttgcaacatggtctcctgagttcttacaacagaggagagtaagaatgcaggagaccaacctggcggcagcgcaaaagatg

SEQ ID NO: 164749 - DNA, 103 bp, Artificial Sequence
  Synthetic Polynucleotide
taatacgactcactatagggtctgtattaactcttcctttgagagttttgaacagaggagacaaaacatgcaaaggaagaacctggcggcagcgcaaaagatg

SEQ ID NO: 164750 - DNA, 103 bp, Artificial Sequence
  Synthetic Polynucleotide
taatacgactcactatagggcactgggtctctgttgcaacatggtctcctaacagaggagaaggagaatgtgttgcaacaacctggcggcagcgcaaaagatg

SEQ ID NO: 164751 - DNA, 103 bp, Artificial Sequence
  Synthetic Polynucleotide
taatacgactcactatagggccttggaaaacactgggtctctgttgcaacaacagaggagagttgcaatggagacccagaacctggcggcagcgcaaaagatg

SEQ ID NO: 164752 - DNA, 103 bp, Artificial Sequence
  Synthetic Polynucleotide
taatacgactcactatagggtccattggttccttggaaaacactgggtctaacagaggagaagacccatggttttccaaaacctggcggcagcgcaaaagatg

SEQ ID NO: 164753 - DNA, 103 bp, Artificial Sequence
  Synthetic Polynucleotide
taatacgactcactatagggttacactggttccattggttccttggaaaaaacagaggagattttccatggaaccaatgaacctggcggcagcgcaaaagatg

SEQ ID NO: 164754 - DNA, 103 bp, Artificial Sequence
  Synthetic Polynucleotide
taatacgactcactatagggaaaggtgtgattacactggttccattggttaacagaggagaaaccaaatgaaccagtgtaacctggcggcagcgcaaaagatg

SEQ ID NO: 164755 - DNA, 103 bp, Artificial Sequence
  Synthetic Polynucleotide
taatacgactcactatagggagttggatccaaaggtgtgattacactggtaacagaggagaaccagtatgatcacacctaacctggcggcagcgcaaaagatg

SEQ ID NO: 164756 - DNA, 103 bp, Artificial Sequence
  Synthetic Polynucleotide
taatacgactcactataggggtagctgagcagttggatccaaaggtgtgaaacagaggagatcacacatgtggatccaaaacctggcggcagcgcaaaagatg

SEQ ID NO: 164757 - DNA, 103 bp, Artificial Sequence
  Synthetic Polynucleotide
taatacgactcactatagggggcatgattcgtagctgagcagttggatccaacagaggagaggatccatgtgctcagctaacctggcggcagcgcaaaagatg

SEQ ID NO: 164758 - DNA, 103 bp, Artificial Sequence
  Synthetic Polynucleotide
taatacgactcactatagggagcaggcagtggcatgattcgtagctgagcaacagaggagagctcagatgcgaatcatgaacctggcggcagcgcaaaagatg

SEQ ID NO: 164759 - DNA, 103 bp, Artificial Sequence
  Synthetic Polynucleotide
taatacgactcactatagggaagggcccccagcaggcagtggcatgattcaacagaggagagaatcaatgcactgcctgaacctggcggcagcgcaaaagatg

SEQ ID NO: 164760 - DNA, 103 bp, Artificial Sequence
  Synthetic Polynucleotide
taatacgactcactatagggcgatccatactctgtattaactcttcctttaacagaggagaaaaggaatggttaatacaaacctggcggcagcgcaaaagatg

SEQ ID NO: 164761 - DNA, 103 bp, Artificial Sequence
  Synthetic Polynucleotide
taatacgactcactatagggtggcttattgaagggcccccagcaggcagtaacagaggagaactgccatgtgggggcccaacctggcggcagcgcaaaagatg

SEQ ID NO: 164762 - DNA, 103 bp, Artificial Sequence
  Synthetic Polynucleotide
taatacgactcactatagggtggcaggccttggcttattgaagggcccccaacagaggagagggggcatgtcaataagcaacctggcggcagcgcaaaagatg

SEQ ID NO: 164763 - DNA, 103 bp, Artificial Sequence
  Synthetic Polynucleotide
taatacgactcactatagggaacgggaggctggcaggccttggcttattgaacagaggagacaataaatgaaggcctgcaacctggcggcagcgcaaaagatg

SEQ ID NO: 164764 - DNA, 103 bp, Artificial Sequence
  Synthetic Polynucleotide
taatacgactcactataggggcagtgttgtaacgggaggctggcaggcctaacagaggagaaggcctatgagcctcccgaacctggcggcagcgcaaaagatg

SEQ ID NO: 164765 - DNA, 103 bp, Artificial Sequence
  Synthetic Polynucleotide
taatacgactcactatagggggcatccgcagcagtgttgtaacgggaggcaacagaggagagcctccatgtacaacactaacctggcggcagcgcaaaagatg

SEQ ID NO: 164766 - DNA, 103 bp, Artificial Sequence
  Synthetic Polynucleotide
taatacgactcactataggggagcagccagggcatccgcagcagtgttgtaacagaggagaacaacaatgctgcggatgaacctggcggcagcgcaaaagatg

SEQ ID NO: 164767 - DNA, 103 bp, Artificial Sequence
  Synthetic Polynucleotide
taatacgactcactataggggcatccacaagagcagccagggcatccgcaaacagaggagatgcggaatgcctggctgcaacctggcggcagcgcaaaagatg

SEQ ID NO: 164768 - DNA, 103 bp, Artificial Sequence
  Synthetic Polynucleotide
taatacgactcactatagggagaagctgcagcatccacaagagcagccagaacagaggagactggctatgcttgtggataacctggcggcagcgcaaaagatg

SEQ ID NO: 164769 - DNA, 103 bp, Artificial Sequence
  Synthetic Polynucleotide
taatacgactcactatagggtctggggtgcagaagctgcagcatccacaaaacagaggagattgtggatgctgcagcttaacctggcggcagcgcaaaagatg

SEQ ID NO: 164770 - DNA, 103 bp, Artificial Sequence
  Synthetic Polynucleotide
taatacgactcactataggggacacatccatctggggtgcagaagctgcaaacagaggagatgcagcatgtgcaccccaaacctggcggcagcgcaaaagatg

SEQ ID NO: 164771 - DNA, 103 bp, Artificial Sequence
  Synthetic Polynucleotide
taatacgactcactatagggtcgatctacacgatccatactctgtattaaaacagaggagattaataatgagtatggataacctggcggcagcgcaaaagatg

SEQ ID NO: 164772 - DNA, 103 bp, Artificial Sequence
  Synthetic Polynucleotide
taatacgactcactatagggttttgttttggacacatccatctggggtgcaacagaggagagcacccatgatggatgtgaacctggcggcagcgcaaaagatg

SEQ ID NO: 164773 - DNA, 103 bp, Artificial Sequence
  Synthetic Polynucleotide
taatacgactcactataggggcttactctcttttgttttggacacatccaaacagaggagatggatgatgccaaaacaaaacctggcggcagcgcaaaagatg

SEQ ID NO: 164774 - DNA, 103 bp, Artificial Sequence
  Synthetic Polynucleotide
taatacgactcactataggggcagcttcatgcttactctcttttgttttgaacagaggagacaaaacatgagagagtaaaacctggcggcagcgcaaaagatg

SEQ ID NO: 164775 - DNA, 103 bp, Artificial Sequence
  Synthetic Polynucleotide
taatacgactcactatagggttctaacctggcagcttcatgcttactctcaacagaggagagagagtatgcatgaagctaacctggcggcagcgcaaaagatg

SEQ ID NO: 164776 - DNA, 103 bp, Artificial Sequence
  Synthetic Polynucleotide
taatacgactcactatagggtcaaattttcttctaacctggcagcttcataacagaggagaatgaagatgccaggttagaacctggcggcagcgcaaaagatg

SEQ ID NO: 164777 - DNA, 103 bp, Artificial Sequence
  Synthetic Polynucleotide
taatacgactcactataggggacctgcttctcaaattttcttctaacctgaacagaggagacaggttatgagaaaatttaacctggcggcagcgcaaaagatg

SEQ ID NO: 164778 - DNA, 103 bp, Artificial Sequence
  Synthetic Polynucleotide
taatacgactcactatagggaactgctgctgacctgcttctcaaattttcaacagaggagagaaaatatgagaagcaggaacctggcggcagcgcaaaagatg

SEQ ID NO: 164779 - DNA, 103 bp, Artificial Sequence
  Synthetic Polynucleotide
taatacgactcactataggggctgttcactaactgctgctgacctgcttcaacagaggagagaagcaatgcagcagcagaacctggcggcagcgcaaaagatg

SEQ ID NO: 164780 - DNA, 103 bp, Artificial Sequence
  Synthetic Polynucleotide
taatacgactcactatagggtctagctgctgctgttcactaactgctgctaacagaggagaagcagcatgtagtgaacaaacctggcggcagcgcaaaagatg

SEQ ID NO: 164781 - DNA, 103 bp, Artificial Sequence
  Synthetic Polynucleotide
taatacgactcactatagggggttttctgctctagctgctgctgttcactaacagaggagaagtgaaatgcagcagctaaacctggcggcagcgcaaaagatg

SEQ ID NO: 164782 - DNA, 103 bp, Artificial Sequence
  Synthetic Polynucleotide
taatacgactcactatagggttgcaatttctcgatctacacgatccatacaacagaggagagtatggatggtgtagatcaacctggcggcagcgcaaaagatg

SEQ ID NO: 164783 - DNA, 103 bp, Artificial Sequence
  Synthetic Polynucleotide
taatacgactcactatagggccacctccagggttttctgctctagctgctaacagaggagaagcagcatgagcagaaaaaacctggcggcagcgcaaaagatg

SEQ ID NO: 164784 - DNA, 103 bp, Artificial Sequence
  Synthetic Polynucleotide
taatacgactcactataggggatctcttctccacctccagggttttctgcaacagaggagagcagaaatgcctggaggtaacctggcggcagcgcaaaagatg

SEQ ID NO: 164785 - DNA, 103 bp, Artificial Sequence
  Synthetic Polynucleotide
taatacgactcactatagggacactgaacagatctcttctccacctccagaacagaggagactggagatggagaagagaaacctggcggcagcgcaaaagatg

SEQ ID NO: 164786 - DNA, 103 bp, Artificial Sequence
  Synthetic Polynucleotide
taatacgactcactatagggaagtgtataaacactgaacagatctcttctaacagaggagaagaagaatgctgttcagtaacctggcggcagcgcaaaagatg

SEQ ID NO: 164787 - DNA, 103 bp, Artificial Sequence
  Synthetic Polynucleotide
taatacgactcactatagggaaggctgaagaagtgtataaacactgaacaaacagaggagatgttcaatgtttatacacaacctggcggcagcgcaaaagatg

SEQ ID NO: 164788 - DNA, 103 bp, Artificial Sequence
  Synthetic Polynucleotide
taatacgactcactataggggccacttggaaaggctgaagaagtgtataaaacagaggagattatacatgtcttcagccaacctggcggcagcgcaaaagatg

SEQ ID NO: 164789 - DNA, 103 bp, Artificial Sequence
  Synthetic Polynucleotide
taatacgactcactataggggctggggcttgccacttggaaaggctgaagaacagaggagacttcagatgttccaagtgaacctggcggcagcgcaaaagatg

SEQ ID NO: 164790 - DNA, 103 bp, Artificial Sequence
  Synthetic Polynucleotide
taatacgactcactataggggaagaatgaggctggggcttgccacttggaaacagaggagatccaagatgcaagccccaaacctggcggcagcgcaaaagatg

SEQ ID NO: 164791 - DNA, 103 bp, Artificial Sequence
  Synthetic Polynucleotide
taatacgactcactatagggataaactactgaagaatgaggctggggcttaacagaggagaaagcccatgcctcattctaacctggcggcagcgcaaaagatg

SEQ ID NO: 164792 - DNA, 103 bp, Artificial Sequence
  Synthetic Polynucleotide
taatacgactcactatagggcagcctcagaataaactactgaagaatgagaacagaggagactcattatgcagtagtttaacctggcggcagcgcaaaagatg

SEQ ID NO: 164793 - DNA, 103 bp, Artificial Sequence
  Synthetic Polynucleotide
taatacgactcactatagggtgttctacttttgcaatttctcgatctacaaacagaggagatgtagaatgagaaattgcaacctggcggcagcgcaaaagatg

SEQ ID NO: 164794 - DNA, 103 bp, Artificial Sequence
  Synthetic Polynucleotide
taatacgactcactatagggttatctttcccagcctcagaataaactactaacagaggagaagtagtatgttctgaggcaacctggcggcagcgcaaaagatg

SEQ ID NO: 164795 - DNA, 103 bp, Artificial Sequence
  Synthetic Polynucleotide
taatacgactcactatagggaggaggccctttatctttcccagcctcagaaacagaggagatctgagatggggaaagataacctggcggcagcgcaaaagatg

SEQ ID NO: 164796 - DNA, 103 bp, Artificial Sequence
  Synthetic Polynucleotide
taatacgactcactatagggtggattttggaggaggccctttatctttccaacagaggagaggaaagatgaagggcctcaacctggcggcagcgcaaaagatg

SEQ ID NO: 164797 - DNA, 103 bp, Artificial Sequence
  Synthetic Polynucleotide
taatacgactcactatagggtcctcatatctggattttggaggaggccctaacagaggagaagggccatgtccaaaatcaacctggcggcagcgcaaaagatg

SEQ ID NO: 164798 - DNA, 103 bp, Artificial Sequence
  Synthetic Polynucleotide
taatacgactcactatagggccttagctcttcctcatatctggattttggaacagaggagaccaaaaatgagatatgagaacctggcggcagcgcaaaagatg

SEQ ID NO: 164799 - DNA, 103 bp, Artificial Sequence
  Synthetic Polynucleotide
taatacgactcactatagggtccctctggtccttagctcttcctcatatcaacagaggagagatatgatgaagagctaaaacctggcggcagcgcaaaagatg

SEQ ID NO: 164800 - DNA, 103 bp, Artificial Sequence
  Synthetic Polynucleotide
taatacgactcactatagggatggtagtcttccctctggtccttagctctaacagaggagaagagctatggaccagaggaacctggcggcagcgcaaaagatg

SEQ ID NO: 164801 - DNA, 103 bp, Artificial Sequence
  Synthetic Polynucleotide
taatacgactcactatagggagctgcagtaatggtagtcttccctctggtaacagaggagaaccagaatgaagactaccaacctggcggcagcgcaaaagatg

SEQ ID NO: 164802 - DNA, 103 bp, Artificial Sequence
  Synthetic Polynucleotide
taatacgactcactatagggctatgaagttagctgcagtaatggtagtctaacagaggagaagactaatgttactgcagaacctggcggcagcgcaaaagatg

SEQ ID NO: 164803 - DNA, 103 bp, Artificial Sequence
  Synthetic Polynucleotide
taatacgactcactatagggatgatcacgtctatgaagttagctgcagtaaacagaggagatactgcatgtaacttcataacctggcggcagcgcaaaagatg

SEQ ID NO: 164804 - DNA, 103 bp, Artificial Sequence
  Synthetic Polynucleotide
taatacgactcactatagggaaggatctgctgttctacttttgcaatttcaacagaggagagaaattatgaaagtagaaaacctggcggcagcgcaaaagatg

SEQ ID NO: 164805 - DNA, 103 bp, Artificial Sequence
  Synthetic Polynucleotide
taatacgactcactatagggttgccgggtgatgatcacgtctatgaagttaacagaggagaaacttcatggacgtgatcaacctggcggcagcgcaaaagatg

SEQ ID NO: 164806 - DNA, 103 bp, Artificial Sequence
  Synthetic Polynucleotide
taatacgactcactatagggccgaggcaatttgccgggtgatgatcacgtaacagaggagaacgtgaatgtcacccggcaacctggcggcagcgcaaaagatg

SEQ ID NO: 164807 - DNA, 103 bp, Artificial Sequence
  Synthetic Polynucleotide
taatacgactcactataggggcatccttgtccgaggcaatttgccgggtgaacagaggagacacccgatgaattgcctcaacctggcggcagcgcaaaagatg

SEQ ID NO: 164808 - DNA, 103 bp, Artificial Sequence
  Synthetic Polynucleotide
taatacgactcactatagggacgttccctcgcatccttgtccgaggcaataacagaggagaattgccatggacaaggataacctggcggcagcgcaaaagatg

SEQ ID NO: 164809 - DNA, 103 bp, Artificial Sequence
  Synthetic Polynucleotide
taatacgactcactatagggtttgagagccacgttccctcgcatccttgtaacagaggagaacaaggatgcgagggaacaacctggcggcagcgcaaaagatg

SEQ ID NO: 164810 - DNA, 103 bp, Artificial Sequence
  Synthetic Polynucleotide
taatacgactcactataggggagtctgaactttgagagccacgttccctcaacagaggagagagggaatgtggctctcaaacctggcggcagcgcaaaagatg

SEQ ID NO: 164811 - DNA, 103 bp, Artificial Sequence
  Synthetic Polynucleotide
taatacgactcactataggggctactagaagagtctgaactttgagagccaacagaggagaggctctatgagttcagacaacctggcggcagcgcaaaagatg

SEQ ID NO: 164812 - DNA, 103 bp, Artificial Sequence
  Synthetic Polynucleotide
taatacgactcactataggggagaagataagctactagaagagtctgaacaacagaggagagttcagatgcttctagtaaacctggcggcagcgcaaaagatg

SEQ ID NO: 164813 - DNA, 103 bp, Artificial Sequence
  Synthetic Polynucleotide
taatacgactcactatagggtcatacctgtgagaagataagctactagaaaacagaggagattctagatgcttatcttcaacctggcggcagcgcaaaagatg

SEQ ID NO: 164814 - DNA, 103 bp, Artificial Sequence
  Synthetic Polynucleotide
taatacgactcactataggggctaggtgtttcatacctgtgagaagataaaacagaggagattatctatgcacaggtataacctggcggcagcgcaaaagatg

SEQ ID NO: 164815 - DNA, 103 bp, Artificial Sequence
  Synthetic Polynucleotide
taatacgactcactatagggttttcagtttaaggatctgctgttctacttaacagaggagaaagtagatgagcagatccaacctggcggcagcgcaaaagatg

SEQ ID NO: 164816 - DNA, 103 bp, Artificial Sequence
  Synthetic Polynucleotide
taatacgactcactatagggcaatagcatcgctaggtgtttcatacctgtaacagaggagaacaggtatgaaacacctaaacctggcggcagcgcaaaagatg

SEQ ID NO: 164817 - DNA, 103 bp, Artificial Sequence
  Synthetic Polynucleotide
taatacgactcactatagggcttatcacctcaatagcatcgctaggtgttaacagaggagaaacaccatgcgatgctataacctggcggcagcgcaaaagatg

SEQ ID NO: 164818 - DNA, 103 bp, Artificial Sequence
  Synthetic Polynucleotide
taatacgactcactataggggctggcaggacttatcacctcaatagcatcaacagaggagagatgctatggaggtgataaacctggcggcagcgcaaaagatg

SEQ ID NO: 164819 - DNA, 103 bp, Artificial Sequence
  Synthetic Polynucleotide
taatacgactcactataggggcgcaggtgagctggcaggacttatcacctaacagaggagaaggtgaatggtcctgccaaacctggcggcagcgcaaaagatg

SEQ ID NO: 164820 - DNA, 103 bp, Artificial Sequence
  Synthetic Polynucleotide
taatacgactcactatagggtcctggggtggcgcaggtgagctggcaggaaacagaggagatcctgcatgctcacctgcaacctggcggcagcgcaaaagatg

SEQ ID NO: 164821 - DNA, 103 bp, Artificial Sequence
  Synthetic Polynucleotide
taatacgactcactatagggctgcagtttctcctggggtggcgcaggtgaaacagaggagatcacctatgccaccccagaacctggcggcagcgcaaaagatg

SEQ ID NO: 164822 - DNA, 103 bp, Artificial Sequence
  Synthetic Polynucleotide
taatacgactcactataggggctgataggtctgcagtttctcctggggtgaacagaggagacaccccatgagaaactgcaacctggcggcagcgcaaaagatg

SEQ ID NO: 164823 - DNA, 103 bp, Artificial Sequence
  Synthetic Polynucleotide
taatacgactcactatagggacaacctctggctgataggtctgcagtttcaacagaggagagaaactatggacctatcaaacctggcggcagcgcaaaagatg

SEQ ID NO: 164824 - DNA, 103 bp, Artificial Sequence
  Synthetic Polynucleotide
taatacgactcactatagggatttgccttaacaacctctggctgataggtaacagaggagaacctatatgccagaggttaacctggcggcagcgcaaaagatg

SEQ ID NO: 164825 - DNA, 103 bp, Artificial Sequence
  Synthetic Polynucleotide
taatacgactcactatagggtttccgcttgatttgccttaacaacctctgaacagaggagacagaggatgttaaggcaaaacctggcggcagcgcaaaagatg

SEQ ID NO: 164826 - DNA, 103 bp, Artificial Sequence
  Synthetic Polynucleotide
taatacgactcactatagggtactggacagagtgaggaggataacgacttaacagaggagaaagtcgatgtcctcctcaaacctggcggcagcgcaaaagatg

SEQ ID NO: 164827 - DNA, 103 bp, Artificial Sequence
  Synthetic Polynucleotide
taatacgactcactatagggtgttgtttctttttcagtttaaggatctgcaacagaggagagcagatatgtaaactgaaaacctggcggcagcgcaaaagatg

SEQ ID NO: 164828 - DNA, 103 bp, Artificial Sequence
  Synthetic Polynucleotide
taatacgactcactataggggtaggatcattttccgcttgatttgccttaaacagaggagataaggcatgtcaagcggaaacctggcggcagcgcaaaagatg

SEQ ID NO: 164829 - DNA, 103 bp, Artificial Sequence
  Synthetic Polynucleotide
taatacgactcactatagggatattgtctggtaggatcattttccgcttgaacagaggagacaagcgatgaatgatcctaacctggcggcagcgcaaaagatg

SEQ ID NO: 164830 - DNA, 103 bp, Artificial Sequence
  Synthetic Polynucleotide
taatacgactcactatagggatggtccttcatattgtctggtaggatcataacagaggagaatgatcatgccagacaataacctggcggcagcgcaaaagatg

SEQ ID NO: 164831 - DNA, 103 bp, Artificial Sequence
  Synthetic Polynucleotide
taatacgactcactatagggtagtgatgtaatggtccttcatattgtctgaacagaggagacagacaatgtgaaggaccaacctggcggcagcgcaaaagatg

SEQ ID NO: 164832 - DNA, 103 bp, Artificial Sequence
  Synthetic Polynucleotide
taatacgactcactatagggctgtggtcgatagtgatgtaatggtccttcaacagaggagagaaggaatgttacatcacaacctggcggcagcgcaaaagatg

SEQ ID NO: 164833 - DNA, 103 bp, Artificial Sequence
  Synthetic Polynucleotide
taatacgactcactataggggtgattcctgctgtggtcgatagtgatgtaaacagaggagatacatcatgatcgaccacaacctggcggcagcgcaaaagatg

SEQ ID NO: 164834 - DNA, 103 bp, Artificial Sequence
  Synthetic Polynucleotide
taatacgactcactatagggtggggagatggtgattcctgctgtggtcgaaacagaggagatcgaccatggcaggaatcaacctggcggcagcgcaaaagatg

SEQ ID NO: 164835 - DNA, 103 bp, Artificial Sequence
  Synthetic Polynucleotide
taatacgactcactatagggcagctgttgttggggagatggtgattcctgaacagaggagacaggaaatgccatctcccaacctggcggcagcgcaaaagatg

SEQ ID NO: 164836 - DNA, 103 bp, Artificial Sequence
  Synthetic Polynucleotide
taatacgactcactatagggaagaagggggcagctgttgttggggagatgaacagaggagacatctcatgaacaacagcaacctggcggcagcgcaaaagatg

SEQ ID NO: 164837 - DNA, 103 bp, Artificial Sequence
  Synthetic Polynucleotide
taatacgactcactatagggtctgcctgtgaagaagggggcagctgttgtaacagaggagaacaacaatggcccccttcaacctggcggcagcgcaaaagatg

SEQ ID NO: 164838 - DNA, 103 bp, Artificial Sequence
  Synthetic Polynucleotide
taatacgactcactatagggttcaagctgttgttgtttctttttcagtttaacagaggagaaaactgatgaagaaacaaaacctggcggcagcgcaaaagatg

SEQ ID NO: 164839 - DNA, 103 bp, Artificial Sequence
  Synthetic Polynucleotide
taatacgactcactatagggccccattccctctgcctgtgaagaagggggaacagaggagaccccctatgtcacaggcaaacctggcggcagcgcaaaagatg

SEQ ID NO: 164840 - DNA, 103 bp, Artificial Sequence
  Synthetic Polynucleotide
taatacgactcactatagggtgggcacttgccccattccctctgcctgtgaacagaggagacacaggatgagggaatggaacctggcggcagcgcaaaagatg

SEQ ID NO: 164841 - DNA, 103 bp, Artificial Sequence
  Synthetic Polynucleotide
taatacgactcactatagggcgatgggtcctgggcacttgccccattcccaacagaggagagggaatatggcaagtgccaacctggcggcagcgcaaaagatg

SEQ ID NO: 164842 - DNA, 103 bp, Artificial Sequence
  Synthetic Polynucleotide
taatacgactcactatagggtgtgatcagccgatgggtcctgggcacttgaacagaggagacaagtgatgaggacccataacctggcggcagcgcaaaagatg

SEQ ID NO: 164843 - DNA, 103 bp, Artificial Sequence
  Synthetic Polynucleotide
taatacgactcactataggggatcagcaagtgtgatcagccgatgggtccaacagaggagaggacccatgggctgatcaaacctggcggcagcgcaaaagatg

SEQ ID NO: 164844 - DNA, 103 bp, Artificial Sequence
  Synthetic Polynucleotide
taatacgactcactatagggtgacagatgtgatcagcaagtgtgatcagcaacagaggagagctgatatgacttgctgaaacctggcggcagcgcaaaagatg

SEQ ID NO: 164845 - DNA, 103 bp, Artificial Sequence
  Synthetic Polynucleotide
taatacgactcactatagggtgtgataatttgacagatgtgatcagcaagaacagaggagacttgctatgcacatctgtaacctggcggcagcgcaaaagatg

SEQ ID NO: 164846 - DNA, 103 bp, Artificial Sequence
  Synthetic Polynucleotide
taatacgactcactatagggcaaaatcttgtgtgataatttgacagatgtaacagaggagaacatctatgaaattatcaaacctggcggcagcgcaaaagatg

SEQ ID NO: 164847 - DNA, 103 bp, Artificial Sequence
  Synthetic Polynucleotide
taatacgactcactatagggtgatttctagcaaaatcttgtgtgataattaacagaggagaaattatatgacaagatttaacctggcggcagcgcaaaagatg

SEQ ID NO: 164848 - DNA, 103 bp, Artificial Sequence
  Synthetic Polynucleotide
taatacgactcactatagggcgaggaaacttgatttctagcaaaatcttgaacagaggagacaagatatggctagaaataacctggcggcagcgcaaaagatg

SEQ ID NO: 164849 - DNA, 103 bp, Artificial Sequence
  Synthetic Polynucleotide
taatacgactcactatagggctgcctcttcttcaagctgttgttgtttctaacagaggagaagaaacatgaacagcttgaacctggcggcagcgcaaaagatg

SEQ ID NO: 164850 - DNA, 103 bp, Artificial Sequence
  Synthetic Polynucleotide
taatacgactcactatagggggggagtctgcgaggaaacttgatttctagaacagaggagactagaaatgaagtttcctaacctggcggcagcgcaaaagatg

SEQ ID NO: 164851 - DNA, 103 bp, Artificial Sequence
  Synthetic Polynucleotide
taatacgactcactatagggggaggctgctggggagtctgcgaggaaactaacagaggagaagtttcatggcagactccaacctggcggcagcgcaaaagatg

SEQ ID NO: 164852 - DNA, 103 bp, Artificial Sequence
  Synthetic Polynucleotide
taatacgactcactatagggtgtagaagtaggaggctgctggggagtctgaacagaggagacagactatgcagcagcctaacctggcggcagcgcaaaagatg

SEQ ID NO: 164853 - DNA, 103 bp, Artificial Sequence
  Synthetic Polynucleotide
taatacgactcactatagggagttctggaatgtagaagtaggaggctgctaacagaggagaagcagcatgctacttctaaacctggcggcagcgcaaaagatg

SEQ ID NO: 164854 - DNA, 103 bp, Artificial Sequence
  Synthetic Polynucleotide
taatacgactcactataggggcagaaggtgagttctggaatgtagaagtaaacagaggagatacttcatgattccagaaaacctggcggcagcgcaaaagatg

SEQ ID NO: 164855 - DNA, 103 bp, Artificial Sequence
  Synthetic Polynucleotide
taatacgactcactatagggagataccaaagcagaaggtgagttctggaaaacagaggagattccagatgtcaccttctaacctggcggcagcgcaaaagatg

SEQ ID NO: 164856 - DNA, 103 bp, Artificial Sequence
  Synthetic Polynucleotide
taatacgactcactatagggtcacaggtgtagataccaaagcagaaggtgaacagaggagacaccttatgctttggtataacctggcggcagcgcaaaagatg

SEQ ID NO: 164857 - DNA, 103 bp, Artificial Sequence
  Synthetic Polynucleotide
taatacgactcactataggggttttagtcctcacaggtgtagataccaaaaacagaggagatttggtatgtacacctgtaacctggcggcagcgcaaaagatg

SEQ ID NO: 164858 - DNA, 103 bp, Artificial Sequence
  Synthetic Polynucleotide
taatacgactcactatagggacggtttgatgttttagtcctcacaggtgtaacagaggagaacacctatgaggactaaaaacctggcggcagcgcaaaagatg

SEQ ID NO: 164859 - DNA, 103 bp, Artificial Sequence
  Synthetic Polynucleotide
taatacgactcactatagggctgggctgtaacggtttgatgttttagtccaacagaggagaggactaatgcatcaaaccaacctggcggcagcgcaaaagatg

SEQ ID NO: 164860 - DNA, 103 bp, Artificial Sequence
  Synthetic Polynucleotide
taatacgactcactatagggggaggtttagctgcctcttcttcaagctgtaacagaggagaacagctatgagaagaggcaacctggcggcagcgcaaaagatg

SEQ ID NO: 164861 - DNA, 103 bp, Artificial Sequence
  Synthetic Polynucleotide
taatacgactcactataggggcctgggattctgggctgtaacggtttgataacagaggagaatcaaaatgttacagcccaacctggcggcagcgcaaaagatg

SEQ ID NO: 164862 - DNA, 103 bp, Artificial Sequence
  Synthetic Polynucleotide
taatacgactcactataggggacagactgagcctgggattctgggctgtaaacagaggagatacagcatggaatcccagaacctggcggcagcgcaaaagatg

SEQ ID NO: 164863 - DNA, 103 bp, Artificial Sequence
  Synthetic Polynucleotide
taatacgactcactatagggtttgatgatggacagactgagcctgggattaacagaggagaaatcccatgctcagtctgaacctggcggcagcgcaaaagatg

SEQ ID NO: 164864 - DNA, 103 bp, Artificial Sequence
  Synthetic Polynucleotide
taatacgactcactataggggaacctggtctttgatgatggacagactgaaacagaggagatcagtcatgccatcatcaaacctggcggcagcgcaaaagatg

SEQ ID NO: 164865 - DNA, 103 bp, Artificial Sequence
  Synthetic Polynucleotide
taatacgactcactatagggagagacccttgaacctggtctttgatgatgaacagaggagacatcatatgagaccaggtaacctggcggcagcgcaaaagatg

SEQ ID NO: 164866 - DNA, 103 bp, Artificial Sequence
  Synthetic Polynucleotide
taatacgactcactataggggattttctggagagacccttgaacctggtcaacagaggagagaccagatgcaagggtctaacctggcggcagcgcaaaagatg

SEQ ID NO: 164867 - DNA, 103 bp, Artificial Sequence
  Synthetic Polynucleotide
taatacgactcactatagggttgtccacaagattttctggagagacccttaacagaggagaaagggtatgtccagaaaaaacctggcggcagcgcaaaagatg

SEQ ID NO: 164868 - DNA, 103 bp, Artificial Sequence
  Synthetic Polynucleotide
taatacgactcactatagggtcccctggatttgtccacaagattttctggaacagaggagaccagaaatgcttgtggacaacctggcggcagcgcaaaagatg

SEQ ID NO: 164869 - DNA, 103 bp, Artificial Sequence
  Synthetic Polynucleotide
taatacgactcactatagggcaggcctacttcccctggatttgtccacaaaacagaggagattgtggatgaatccagggaacctggcggcagcgcaaaagatg

SEQ ID NO: 164870 - DNA, 103 bp, Artificial Sequence
  Synthetic Polynucleotide
taatacgactcactatagggggggattttccaggcctacttcccctggataacagaggagaatccagatgaagtaggccaacctggcggcagcgcaaaagatg

SEQ ID NO: 164871 - DNA, 103 bp, Artificial Sequence
  Synthetic Polynucleotide
taatacgactcactatagggctcaggctcaggaggtttagctgcctcttcaacagaggagagaagagatggctaaacctaacctggcggcagcgcaaaagatg

SEQ ID NO: 164872 - DNA, 103 bp, Artificial Sequence
  Synthetic Polynucleotide
taatacgactcactatagggactcctctctggggattttccaggcctactaacagaggagaagtaggatgggaaaatccaacctggcggcagcgcaaaagatg

SEQ ID NO: 164873 - DNA, 103 bp, Artificial Sequence
  Synthetic Polynucleotide
taatacgactcactatagggaagagacgtgactcctctctggggattttcaacagaggagagaaaatatgcagagaggaaacctggcggcagcgcaaaagatg

SEQ ID NO: 164874 - DNA, 103 bp, Artificial Sequence
  Synthetic Polynucleotide
taatacgactcactatagggtagggctccgaagagacgtgactcctctctaacagaggagaagagagatgtcacgtctcaacctggcggcagcgcaaaagatg

SEQ ID NO: 164875 - DNA, 103 bp, Artificial Sequence
  Synthetic Polynucleotide
taatacgactcactataggggatgggctcgtagggctccgaagagacgtgaacagaggagacacgtcatgtcggagcccaacctggcggcagcgcaaaagatg

SEQ ID NO: 164876 - DNA, 103 bp, Artificial Sequence
  Synthetic Polynucleotide
taatacgactcactatagggggggtggggagatgggctcgtagggctccgaacagaggagacggagcatgacgagcccaaacctggcggcagcgcaaaagatg

SEQ ID NO: 164877 - DNA, 103 bp, Artificial Sequence
  Synthetic Polynucleotide
taatacgactcactatagggaccggaacctggggtggggagatgggctcgaacagaggagacgagccatgctccccaccaacctggcggcagcgcaaaagatg

SEQ ID NO: 164878 - DNA, 103 bp, Artificial Sequence
  Synthetic Polynucleotide
taatacgactcactatagggctcatgcacaaccggaacctggggtggggaaacagaggagatccccaatgcaggttccgaacctggcggcagcgcaaaagatg

SEQ ID NO: 164879 - DNA, 103 bp, Artificial Sequence
  Synthetic Polynucleotide
taatacgactcactatagggtgtcctgtttctcatgcacaaccggaacctaacagaggagaaggttcatgttgtgcatgaacctggcggcagcgcaaaagatg

SEQ ID NO: 164880 - DNA, 103 bp, Artificial Sequence
  Synthetic Polynucleotide
taatacgactcactatagggagcagcaagctgtcctgtttctcatgcacaaacagaggagatgtgcaatggaaacaggaaacctggcggcagcgcaaaagatg

SEQ ID NO: 164881 - DNA, 103 bp, Artificial Sequence
  Synthetic Polynucleotide
taatacgactcactatagggctgagacaagagcagcaagctgtcctgtttaacagaggagaaaacagatgagcttgctgaacctggcggcagcgcaaaagatg

SEQ ID NO: 164882 - DNA, 103 bp, Artificial Sequence
  Synthetic Polynucleotide
taatacgactcactatagggacacgggcttctcaggctcaggaggtttagaacagaggagactaaacatgctgagcctgaacctggcggcagcgcaaaagatg

SEQ ID NO: 164883 - DNA, 103 bp, Artificial Sequence
  Synthetic Polynucleotide
taatacgactcactatagggctgcgcccctctgagacaagagcagcaagcaacagaggagagcttgcatgtcttgtctcaacctggcggcagcgcaaaagatg

SEQ ID NO: 164884 - DNA, 103 bp, Artificial Sequence
  Synthetic Polynucleotide
taatacgactcactatagggtctgcaggctctgcgcccctctgagacaagaacagaggagacttgtcatggaggggcgcaacctggcggcagcgcaaaagatg

SEQ ID NO: 164885 - DNA, 103 bp, Artificial Sequence
  Synthetic Polynucleotide
taatacgactcactatagggattcctctgctctgcaggctctgcgcccctaacagaggagaaggggcatggagcctgcaaacctggcggcagcgcaaaagatg

SEQ ID NO: 164886 - DNA, 103 bp, Artificial Sequence
  Synthetic Polynucleotide
taatacgactcactatagggagcgggcatcattcctctgctctgcaggctaacagaggagaagcctgatgagcagaggaaacctggcggcagcgcaaaagatg

SEQ ID NO: 164887 - DNA, 103 bp, Artificial Sequence
  Synthetic Polynucleotide
taatacgactcactatagggctccctggtgagcgggcatcattcctctgcaacagaggagagcagagatgtgatgcccgaacctggcggcagcgcaaaagatg

SEQ ID NO: 164888 - DNA, 103 bp, Artificial Sequence
  Synthetic Polynucleotide
taatacgactcactataggggtagcttatactccctggtgagcgggcatcaacagaggagagatgccatgtcaccagggaacctggcggcagcgcaaaagatg

SEQ ID NO: 164889 - DNA, 103 bp, Artificial Sequence
  Synthetic Polynucleotide
taatacgactcactatagggatgaaggcaagtagcttatactccctggtgaacagaggagacaccagatggtataagctaacctggcggcagcgcaaaagatg

SEQ ID NO: 164890 - DNA, 103 bp, Artificial Sequence
  Synthetic Polynucleotide
taatacgactcactatagggttggtgaagaatgaaggcaagtagcttataaacagaggagatataagatgcttgccttcaacctggcggcagcgcaaaagatg

SEQ ID NO: 164891 - DNA, 103 bp, Artificial Sequence
  Synthetic Polynucleotide
taatacgactcactatagggattttcaagcttggtgaagaatgaaggcaaaacagaggagattgcctatgttcttcaccaacctggcggcagcgcaaaagatg

SEQ ID NO: 164892 - DNA, 103 bp, Artificial Sequence
  Synthetic Polynucleotide
taatacgactcactatagggtgggtgatgtattttcaagcttggtgaagaaacagaggagatcttcaatgagcttgaaaaacctggcggcagcgcaaaagatg

SEQ ID NO: 164893 - DNA, 103 bp, Artificial Sequence
  Synthetic Polynucleotide
taatacgactcactatagggggaggaggggacacgggcttctcaggctcaaacagaggagatgagccatggaagcccgtaacctggcggcagcgcaaaagatg

SEQ ID NO: 164894 - DNA, 103 bp, Artificial Sequence
  Synthetic Polynucleotide
taatacgactcactataggggatttaaccatgggtgatgtattttcaagcaacagaggagagcttgaatgtacatcaccaacctggcggcagcgcaaaagatg

SEQ ID NO: 164895 - DNA, 103 bp, Artificial Sequence
  Synthetic Polynucleotide
taatacgactcactatagggctgcttctttgatttaaccatgggtgatgtaacagaggagaacatcaatgatggttaaaaacctggcggcagcgcaaaagatg

SEQ ID NO: 164896 - DNA, 103 bp, Artificial Sequence
  Synthetic Polynucleotide
taatacgactcactataggggaaaaatctcctgcttctttgatttaaccaaacagaggagatggttaatgcaaagaagcaacctggcggcagcgcaaaagatg

SEQ ID NO: 164897 - DNA, 103 bp, Artificial Sequence
  Synthetic Polynucleotide
taatacgactcactatagggttcaacttacgaaaaatctcctgcttctttaacagaggagaaaagaaatgggagattttaacctggcggcagcgcaaaagatg

SEQ ID NO: 164898 - DNA, 103 bp, Artificial Sequence
  Synthetic Polynucleotide
taatacgactcactatagggaccagaggagttcaacttacgaaaaatctcaacagaggagagagattatgcgtaagttgaacctggcggcagcgcaaaagatg

SEQ ID NO: 164899 - DNA, 103 bp, Artificial Sequence
  Synthetic Polynucleotide
taatacgactcactatagggagtcacctccaccagaggagttcaacttacaacagaggagagtaagtatgactcctctgaacctggcggcagcgcaaaagatg

SEQ ID NO: 164900 - DNA, 103 bp, Artificial Sequence
  Synthetic Polynucleotide
taatacgactcactataggggccatatcagagtcacctccaccagaggagaacagaggagactcctcatgtggaggtgaaacctggcggcagcgcaaaagatg

SEQ ID NO: 164901 - DNA, 103 bp, Artificial Sequence
  Synthetic Polynucleotide
taatacgactcactatagggctgagcagctgccatatcagagtcacctccaacagaggagaggaggtatgtctgatatgaacctggcggcagcgcaaaagatg

SEQ ID NO: 164902 - DNA, 103 bp, Artificial Sequence
  Synthetic Polynucleotide
taatacgactcactatagggcagttcctggctgagcagctgccatatcagaacagaggagactgataatgcagctgctcaacctggcggcagcgcaaaagatg

SEQ ID NO: 164903 - DNA, 103 bp, Artificial Sequence
  Synthetic Polynucleotide
taatacgactcactatagggttaaagatctcagttcctggctgagcagctaacagaggagaagctgcatggccaggaacaacctggcggcagcgcaaaagatg

SEQ ID NO: 164904 - DNA, 103 bp, Artificial Sequence
  Synthetic Polynucleotide
taatacgactcactatagggctgctccacaggaggaggggacacgggcttaacagaggagaaagcccatgtcccctcctaacctggcggcagcgcaaaagatg

SEQ ID NO: 164905 - DNA, 103 bp, Artificial Sequence
  Synthetic Polynucleotide
taatacgactcactatagggtgctggcagattaaagatctcagttcctggaacagaggagaccaggaatggagatctttaacctggcggcagcgcaaaagatg

SEQ ID NO: 164906 - DNA, 103 bp, Artificial Sequence
  Synthetic Polynucleotide
taatacgactcactatagggacgtagtaactgctggcagattaaagatctaacagaggagaagatctatgatctgccagaacctggcggcagcgcaaaagatg

SEQ ID NO: 164907 - DNA, 103 bp, Artificial Sequence
  Synthetic Polynucleotide
taatacgactcactatagggactgagcctgacgtagtaactgctggcagaaacagaggagatctgccatgagttactacaacctggcggcagcgcaaaagatg

SEQ ID NO: 164908 - DNA, 103 bp, Artificial Sequence
  Synthetic Polynucleotide
taatacgactcactatagggtctagagctaactgagcctgacgtagtaacaacagaggagagttactatgtcaggctcaaacctggcggcagcgcaaaagatg

SEQ ID NO: 164909 - DNA, 103 bp, Artificial Sequence
  Synthetic Polynucleotide
taatacgactcactatagggaagaatggcctctagagctaactgagcctgaacagaggagacaggctatgttagctctaaacctggcggcagcgcaaaagatg

SEQ ID NO: 164910 - DNA, 103 bp, Artificial Sequence
  Synthetic Polynucleotide
taatacgactcactatagggggatcagcaaaagaatggcctctagagctaaacagaggagatagctcatgaggccattcaacctggcggcagcgcaaaagatg

SEQ ID NO: 164911 - DNA, 103 bp, Artificial Sequence
  Synthetic Polynucleotide
taatacgactcactatagggattactggcaggatcagcaaaagaatggccaacagaggagaggccatatgtttgctgataacctggcggcagcgcaaaagatg

SEQ ID NO: 164912 - DNA, 103 bp, Artificial Sequence
  Synthetic Polynucleotide
taatacgactcactatagggccagcccaagattactggcaggatcagcaaaacagaggagattgctgatgctgccagtaaacctggcggcagcgcaaaagatg

SEQ ID NO: 164913 - DNA, 103 bp, Artificial Sequence
  Synthetic Polynucleotide
taatacgactcactatagggataatgtcttccagcccaagattactggcaaacagaggagatgccagatgtcttgggctaacctggcggcagcgcaaaagatg

SEQ ID NO: 164914 - DNA, 103 bp, Artificial Sequence
  Synthetic Polynucleotide
taatacgactcactatagggagccttcctgataatgtcttccagcccaagaacagaggagacttgggatggaagacattaacctggcggcagcgcaaaagatg

SEQ ID NO: 164915 - DNA, 103 bp, Artificial Sequence
  Synthetic Polynucleotide
taatacgactcactatagggtgcggtgtttctgctccacaggaggaggggaacagaggagacccctcatgctgtggagcaacctggcggcagcgcaaaagatg

SEQ ID NO: 164916 - DNA, 103 bp, Artificial Sequence
  Synthetic Polynucleotide
taatacgactcactatagggttcccatgagagccttcctgataatgtcttaacagaggagaaagacaatgtcaggaaggaacctggcggcagcgcaaaagatg

SEQ ID NO: 164917 - DNA, 103 bp, Artificial Sequence
  Synthetic Polynucleotide
taatacgactcactatagggtcatcaaagcttcccatgagagccttcctgaacagaggagacaggaaatgtctcatgggaacctggcggcagcgcaaaagatg

SEQ ID NO: 164918 - DNA, 103 bp, Artificial Sequence
  Synthetic Polynucleotide
taatacgactcactatagggctcaactttgtcatcaaagcttcccatgagaacagaggagactcatgatgagctttgataacctggcggcagcgcaaaagatg

SEQ ID NO: 164919 - DNA, 103 bp, Artificial Sequence
  Synthetic Polynucleotide
taatacgactcactatagggctccatgatcctcaactttgtcatcaaagcaacagaggagagctttgatgacaaagttgaacctggcggcagcgcaaaagatg

SEQ ID NO: 164920 - DNA, 103 bp, Artificial Sequence
  Synthetic Polynucleotide
taatacgactcactataggggacatgacaactccatgatcctcaactttgaacagaggagacaaagtatgggatcatggaacctggcggcagcgcaaaagatg

SEQ ID NO: 164921 - DNA, 103 bp, Artificial Sequence
  Synthetic Polynucleotide
taatacgactcactatagggcataggctgggacatgacaactccatgatcaacagaggagagatcatatggttgtcatgaacctggcggcagcgcaaaagatg

SEQ ID NO: 164922 - DNA, 103 bp, Artificial Sequence
  Synthetic Polynucleotide
taatacgactcactataggggcactactcccataggctgggacatgacaaaacagaggagattgtcaatgcccagcctaaacctggcggcagcgcaaaagatg

SEQ ID NO: 164923 - DNA, 103 bp, Artificial Sequence
  Synthetic Polynucleotide
taatacgactcactataggggcagtaccaggcactactcccataggctggaacagaggagaccagccatggggagtagtaacctggcggcagcgcaaaagatg

SEQ ID NO: 164924 - DNA, 103 bp, Artificial Sequence
  Synthetic Polynucleotide
taatacgactcactatagggtgaggtgttggcagtaccaggcactactccaacagaggagaggagtaatgcctggtactaacctggcggcagcgcaaaagatg

SEQ ID NO: 164925 - DNA, 103 bp, Artificial Sequence
  Synthetic Polynucleotide
taatacgactcactatagggtggtcacaactgaggtgttggcagtaccagaacagaggagactggtaatgccaacacctaacctggcggcagcgcaaaagatg

SEQ ID NO: 164926 - DNA, 103 bp, Artificial Sequence
  Synthetic Polynucleotide
taatacgactcactatagggtggacaatactgcggtgtttctgctccacaaacagaggagatgtggaatggaaacaccgaacctggcggcagcgcaaaagatg

SEQ ID NO: 164927 - DNA, 103 bp, Artificial Sequence
  Synthetic Polynucleotide
taatacgactcactataggggtctcaccactggtcacaactgaggtgttgaacagaggagacaacacatgagttgtgacaacctggcggcagcgcaaaagatg

SEQ ID NO: 164928 - DNA, 103 bp, Artificial Sequence
  Synthetic Polynucleotide
taatacgactcactatagggctctcttcgtgtctcaccactggtcacaacaacagaggagagttgtgatgagtggtgagaacctggcggcagcgcaaaagatg

SEQ ID NO: 164929 - DNA, 103 bp, Artificial Sequence
  Synthetic Polynucleotide
taatacgactcactatagggggtccccttcctctcttcgtgtctcaccacaacagaggagagtggtgatgcacgaagagaacctggcggcagcgcaaaagatg

SEQ ID NO: 164930 - DNA, 103 bp, Artificial Sequence
  Synthetic Polynucleotide
taatacgactcactatagggtgaggtgatgggtccccttcctctcttcgtaacagaggagaacgaagatgggaaggggaaacctggcggcagcgcaaaagatg

SEQ ID NO: 164931 - DNA, 103 bp, Artificial Sequence
  Synthetic Polynucleotide
taatacgactcactatagggtcctcctgaatgaggtgatgggtccccttcaacagaggagagaagggatgccatcacctaacctggcggcagcgcaaaagatg

SEQ ID NO: 164932 - DNA, 103 bp, Artificial Sequence
  Synthetic Polynucleotide
taatacgactcactataggggtttgcaaactcctcctgaatgaggtgatgaacagaggagacatcacatgattcaggagaacctggcggcagcgcaaaagatg

SEQ ID NO: 164933 - DNA, 103 bp, Artificial Sequence
  Synthetic Polynucleotide
taatacgactcactatagggatcagctttggtttgcaaactcctcctgaaaacagaggagattcaggatgagtttgcaaaacctggcggcagcgcaaaagatg

SEQ ID NO: 164934 - DNA, 103 bp, Artificial Sequence
  Synthetic Polynucleotide
taatacgactcactatagggtgacttgctgatcagctttggtttgcaaacaacagaggagagtttgcatgccaaagctgaacctggcggcagcgcaaaagatg

SEQ ID NO: 164935 - DNA, 103 bp, Artificial Sequence
  Synthetic Polynucleotide
taatacgactcactatagggtcctgctgtttgacttgctgatcagctttgaacagaggagacaaagcatgtcagcaagtaacctggcggcagcgcaaaagatg

SEQ ID NO: 164936 - DNA, 103 bp, Artificial Sequence
  Synthetic Polynucleotide
taatacgactcactataggggacttagatttcctgctgtttgacttgctgaacagaggagacagcaaatgaaacagcagaacctggcggcagcgcaaaagatg

SEQ ID NO: 164937 - DNA, 103 bp, Artificial Sequence
  Synthetic Polynucleotide
taatacgactcactataggggggaaatgtatactggacagagtgaggaggaacagaggagacctcctatgtctgtccagaacctggcggcagcgcaaaagatg

SEQ ID NO: 164938 - DNA, 103 bp, Artificial Sequence
  Synthetic Polynucleotide
taatacgactcactatagggataaataatttggacaatactgcggtgtttaacagaggagaaaacacatgagtattgtcaacctggcggcagcgcaaaagatg

SEQ ID NO: 164939 - DNA, 103 bp, Artificial Sequence
  Synthetic Polynucleotide
taatacgactcactatagggaggtataggagacttagatttcctgctgttaacagaggagaaacagcatgaaatctaagaacctggcggcagcgcaaaagatg

SEQ ID NO: 164940 - DNA, 103 bp, Artificial Sequence
  Synthetic Polynucleotide
taatacgactcactatagggagccttgcccaggtataggagacttagattaacagaggagaaatctaatgctcctatacaacctggcggcagcgcaaaagatg

SEQ ID NO: 164941 - DNA, 103 bp, Artificial Sequence
  Synthetic Polynucleotide
taatacgactcactataggggttcctaagtagccttgcccaggtataggaaacagaggagatcctatatgtgggcaaggaacctggcggcagcgcaaaagatg

SEQ ID NO: 164942 - DNA, 103 bp, Artificial Sequence
  Synthetic Polynucleotide
taatacgactcactataggggggccgttccgttcctaagtagccttgcccaacagaggagagggcaaatgtacttaggaaacctggcggcagcgcaaaagatg

SEQ ID NO: 164943 - DNA, 103 bp, Artificial Sequence
  Synthetic Polynucleotide
taatacgactcactatagggagactgaagagggccgttccgttcctaagtaacagaggagaacttagatgcggaacggcaacctggcggcagcgcaaaagatg

SEQ ID NO: 164944 - DNA, 103 bp, Artificial Sequence
  Synthetic Polynucleotide
taatacgactcactatagggtgtacagaggagactgaagagggccgttccaacagaggagaggaacgatgctcttcagtaacctggcggcagcgcaaaagatg

SEQ ID NO: 164945 - DNA, 103 bp, Artificial Sequence
  Synthetic Polynucleotide
taatacgactcactatagggcccttctgaatgtacagaggagactgaagaaacagaggagatcttcaatgtcctctgtaaacctggcggcagcgcaaaagatg

SEQ ID NO: 164946 - DNA, 103 bp, Artificial Sequence
  Synthetic Polynucleotide
taatacgactcactatagggtatggtaatccccttctgaatgtacagaggaacagaggagacctctgatgattcagaagaacctggcggcagcgcaaaagatg

SEQ ID NO: 164947 - DNA, 103 bp, Artificial Sequence
  Synthetic Polynucleotide
taatacgactcactatagggggcgtctgcctatggtaatccccttctgaaaacagaggagattcagaatgggattaccaaacctggcggcagcgcaaaagatg

SEQ ID NO: 164948 - DNA, 103 bp, Artificial Sequence
  Synthetic Polynucleotide
taatacgactcactatagggggcccaccctggcgtctgcctatggtaatcaacagaggagagattacatgaggcagacgaacctggcggcagcgcaaaagatg

SEQ ID NO: 164949 - DNA, 103 bp, Artificial Sequence
  Synthetic Polynucleotide
taatacgactcactataggggattctcatcataaataatttggacaatacaacagaggagagtattgatgaaattatttaacctggcggcagcgcaaaagatg

SEQ ID NO: 164950 - DNA, 103 bp, Artificial Sequence
  Synthetic Polynucleotide
taatacgactcactatagggtgtcttcccaggcccaccctggcgtctgccaacagaggagaggcagaatgcagggtgggaacctggcggcagcgcaaaagatg

SEQ ID NO: 164951 - DNA, 103 bp, Artificial Sequence
  Synthetic Polynucleotide
taatacgactcactataggggaagagggcctgtcttcccaggcccaccctaacagaggagaagggtgatgctgggaagaaacctggcggcagcgcaaaagatg

SEQ ID NO: 164952 - DNA, 103 bp, Artificial Sequence
  Synthetic Polynucleotide
taatacgactcactatagggtgagcctgttgaagagggcctgtcttcccaaacagaggagatgggaaatgaggccctctaacctggcggcagcgcaaaagatg

SEQ ID NO: 164953 - DNA, 103 bp, Artificial Sequence
  Synthetic Polynucleotide
taatacgactcactataggggaaactgagttgagcctgttgaagagggccaacagaggagaggccctatgcaacaggctaacctggcggcagcgcaaaagatg

SEQ ID NO: 164954 - DNA, 103 bp, Artificial Sequence
  Synthetic Polynucleotide
taatacgactcactataggggggttataaggaaactgagttgagcctgttaacagaggagaaacaggatgaactcagttaacctggcggcagcgcaaaagatg

SEQ ID NO: 164955 - DNA, 103 bp, Artificial Sequence
  Synthetic Polynucleotide
taatacgactcactatagggcatagtcagagggttataaggaaactgagtaacagaggagaactcagatgccttataacaacctggcggcagcgcaaaagatg

SEQ ID NO: 164956 - DNA, 103 bp, Artificial Sequence
  Synthetic Polynucleotide
taatacgactcactatagggtgagcatccgcatagtcagagggttataagaacagaggagacttataatgctctgactaaacctggcggcagcgcaaaagatg

SEQ ID NO: 164957 - DNA, 103 bp, Artificial Sequence
  Synthetic Polynucleotide
taatacgactcactatagggggagtactgctgagcatccgcatagtcagaaacagaggagatctgacatggcggatgctaacctggcggcagcgcaaaagatg

SEQ ID NO: 164958 - DNA, 103 bp, Artificial Sequence
  Synthetic Polynucleotide
taatacgactcactatagggcggtgttggtggagtactgctgagcatccgaacagaggagacggatgatgagcagtactaacctggcggcagcgcaaaagatg

SEQ ID NO: 164959 - DNA, 103 bp, Artificial Sequence
  Synthetic Polynucleotide
taatacgactcactatagggcacatgcaatcggtgttggtggagtactgcaacagaggagagcagtaatgcaccaacacaacctggcggcagcgcaaaagatg

SEQ ID NO: 164960 - DNA, 103 bp, Artificial Sequence
  Synthetic Polynucleotide
taatacgactcactataggggcttttttccgattctcatcataaataattaacagaggagaaattatatgtgatgagaaaacctggcggcagcgcaaaagatg

SEQ ID NO: 164961 - DNA, 103 bp, Artificial Sequence
  Synthetic Polynucleotide
taatacgactcactataggggcagagggagcacatgcaatcggtgttggtaacagaggagaaccaacatggattgcatgaacctggcggcagcgcaaaagatg

SEQ ID NO: 164962 - DNA, 103 bp, Artificial Sequence
  Synthetic Polynucleotide
taatacgactcactatagggttggttcaccgcagagggagcacatgcaataacagaggagaattgcaatggctccctctaacctggcggcagcgcaaaagatg

SEQ ID NO: 164963 - DNA, 103 bp, Artificial Sequence
  Synthetic Polynucleotide
taatacgactcactataggggaggagctgcttggttcaccgcagagggagaacagaggagactccctatgcggtgaaccaacctggcggcagcgcaaaagatg

SEQ ID NO: 164964 - DNA, 103 bp, Artificial Sequence
  Synthetic Polynucleotide
taatacgactcactatagggttctgttggtgaggagctgcttggttcaccaacagaggagaggtgaaatgagcagctccaacctggcggcagcgcaaaagatg

SEQ ID NO: 164965 - DNA, 103 bp, Artificial Sequence
  Synthetic Polynucleotide
taatacgactcactatagggccagatcctgttctgttggtgaggagctgcaacagaggagagcagctatgcaccaacagaacctggcggcagcgcaaaagatg

SEQ ID NO: 164966 - DNA, 103 bp, Artificial Sequence
  Synthetic Polynucleotide
taatacgactcactataggggctctcgctcccagatcctgttctgttggtaacagaggagaaccaacatgacaggatctaacctggcggcagcgcaaaagatg

SEQ ID NO: 164967 - DNA, 103 bp, Artificial Sequence
  Synthetic Polynucleotide
taatacgactcactatagggagtggggcaggctctcgctcccagatcctgaacagaggagacaggatatgggagcgagaaacctggcggcagcgcaaaagatg

SEQ ID NO: 164968 - DNA, 103 bp, Artificial Sequence
  Synthetic Polynucleotide
taatacgactcactatagggtgctgagagcagtggggcaggctctcgctcaacagaggagagagcgaatgcctgccccaaacctggcggcagcgcaaaagatg

SEQ ID NO: 164969 - DNA, 103 bp, Artificial Sequence
  Synthetic Polynucleotide
taatacgactcactatagggtctcgtactgtgctgagagcagtggggcagaacagaggagactgcccatgtgctctcagaacctggcggcagcgcaaaagatg

SEQ ID NO: 164970 - DNA, 103 bp, Artificial Sequence
  Synthetic Polynucleotide
taatacgactcactatagggtccgacagggtctcgtactgtgctgagagcaacagaggagagctctcatgacagtacgaaacctggcggcagcgcaaaagatg

SEQ ID NO: 164971 - DNA, 103 bp, Artificial Sequence
  Synthetic Polynucleotide
taatacgactcactatagggagcttcttctgcttttttccgattctcatcaacagaggagagatgagatgcggaaaaaaaacctggcggcagcgcaaaagatg

SEQ ID NO: 164972 - DNA, 103 bp, Artificial Sequence
  Synthetic Polynucleotide
taatacgactcactataggggtcatcactatccgacagggtctcgtactgaacagaggagacagtacatgaccctgtcgaacctggcggcagcgcaaaagatg

SEQ ID NO: 164973 - DNA, 103 bp, Artificial Sequence
  Synthetic Polynucleotide
taatacgactcactatagggaaattttatgagcttcttctgcttttttccaacagaggagaggaaaaatgcagaagaagaacctggcggcagcgcaaaagatg

SEQ ID NO: 164974 - DNA, 103 bp, Artificial Sequence
  Synthetic Polynucleotide
taatacgactcactatagggagaccttcaaaaattttatgagcttcttctaacagaggagaagaagaatgtcataaaataacctggcggcagcgcaaaagatg

SEQ ID NO: 164975 - DNA, 103 bp, Artificial Sequence
  Synthetic Polynucleotide
taatacgactcactatagggttttgggccaagaccttcaaaaattttatgaacagaggagacataaaatgtttgaaggtaacctggcggcagcgcaaaagatg

SEQ ID NO: 164976 - DNA, 103 bp, Artificial Sequence
  Synthetic Polynucleotide
taatacgactcactataggggcagttcaacttttgggccaagaccttcaaaacagaggagattgaagatgttggcccaaaacctggcggcagcgcaaaagatg

SEQ ID NO: 164977 - DNA, 103 bp, Artificial Sequence
  Synthetic Polynucleotide
taatacgactcactatagggttatacagtggcagttcaacttttgggccaaacagaggagatggcccatgagttgaactaacctggcggcagcgcaaaagatg

SEQ ID NO: 164978 - DNA, 103 bp, Artificial Sequence
  Synthetic Polynucleotide
taatacgactcactatagggtgatggctggttatacagtggcagttcaacaacagaggagagttgaaatgccactgtataacctggcggcagcgcaaaagatg

SEQ ID NO: 164979 - DNA, 103 bp, Artificial Sequence
  Synthetic Polynucleotide
taatacgactcactatagggggcgggtgttgggaaatgtatactggacagaacagaggagactgtccatgatacatttcaacctggcggcagcgcaaaagatg

SEQ ID NO: 164980 - DNA, 103 bp, Artificial Sequence
  Synthetic Polynucleotide
taatacgactcactatagggccttggtatctgatggctggttatacagtgaacagaggagacactgtatgaccagccataacctggcggcagcgcaaaagatg

SEQ ID NO: 164981 - DNA, 103 bp, Artificial Sequence
  Synthetic Polynucleotide
taatacgactcactatagggtcatggtacaccttggtatctgatggctggaacagaggagaccagccatgagataccaaaacctggcggcagcgcaaaagatg

SEQ ID NO: 164982 - DNA, 103 bp, Artificial Sequence
  Synthetic Polynucleotide
taatacgactcactatagggcttgatgttctcatggtacaccttggtatcaacagaggagagataccatggtgtaccataacctggcggcagcgcaaaagatg

SEQ ID NO: 164983 - DNA, 103 bp, Artificial Sequence
  Synthetic Polynucleotide
taatacgactcactatagggcctggtttgtcttgatgttctcatggtacaaacagaggagatgtaccatgagaacatcaaacctggcggcagcgcaaaagatg

SEQ ID NO: 164984 - DNA, 103 bp, Artificial Sequence
  Synthetic Polynucleotide
taatacgactcactatagggttcctcatcacctggtttgtcttgatgttcaacagaggagagaacatatggacaaaccaaacctggcggcagcgcaaaagatg

SEQ ID NO: 164985 - DNA, 103 bp, Artificial Sequence
  Synthetic Polynucleotide
taatacgactcactatagggaatgagttttttcctcatcacctggtttgtaacagaggagaacaaacatggtgatgaggaacctggcggcagcgcaaaagatg

SEQ ID NO: 164986 - DNA, 103 bp, Artificial Sequence
  Synthetic Polynucleotide
taatacgactcactatagggtaaaaaataaaatgagttttttcctcatcaaacagaggagatgatgaatgaaaaactcaaacctggcggcagcgcaaaagatg

SEQ ID NO: 164987 - DNA, 103 bp, Artificial Sequence
  Synthetic Polynucleotide
taatacgactcactatagggtttcttcttttaaaaaataaaatgagttttaacagaggagaaaaactatgtttatttttaacctggcggcagcgcaaaagatg

SEQ ID NO: 164988 - DNA, 103 bp, Artificial Sequence
  Synthetic Polynucleotide
taatacgactcactatagggtcttgcatgatttcttcttttaaaaaataaaacagaggagattatttatgaaaagaagaaacctggcggcagcgcaaaagatg

SEQ ID NO: 164989 - DNA, 103 bp, Artificial Sequence
  Synthetic Polynucleotide
taatacgactcactatagggccctttgttttcttgcatgatttcttctttaacagaggagaaaagaaatgatcatgcaaaacctggcggcagcgcaaaagatg

SEQ ID NO: 164990 - DNA, 103 bp, Artificial Sequence
  Synthetic Polynucleotide
taatacgactcactatagggtcctgctggtggcgggtgttgggaaatgtaaacagaggagatacattatgcaacacccgaacctggcggcagcgcaaaagatg

SEQ ID NO: 164991 - DNA, 103 bp, Artificial Sequence
  Synthetic Polynucleotide
taatacgactcactatagggattttttgttccctttgttttcttgcatgaaacagaggagatcatgcatgaaaacaaagaacctggcggcagcgcaaaagatg

SEQ ID NO: 164992 - DNA, 103 bp, Artificial Sequence
  Synthetic Polynucleotide
taatacgactcactatagggacgctggcagattttttgttccctttgtttaacagaggagaaaacaaatggaacaaaaaaacctggcggcagcgcaaaagatg

SEQ ID NO: 164993 - DNA, 103 bp, Artificial Sequence
  Synthetic Polynucleotide
taatacgactcactataggggctgatcataacgctggcagattttttgttaacagaggagaaacaaaatgtctgccagcaacctggcggcagcgcaaaagatg

SEQ ID NO: 164994 - DNA, 103 bp, Artificial Sequence
  Synthetic Polynucleotide
taatacgactcactataggggcctccatgagctgatcataacgctggcagaacagaggagactgccaatgttatgatcaaacctggcggcagcgcaaaagatg

SEQ ID NO: 164995 - DNA, 103 bp, Artificial Sequence
  Synthetic Polynucleotide
taatacgactcactatagggtttctcccatgcctccatgagctgatcataaacagaggagatatgatatgctcatggagaacctggcggcagcgcaaaagatg

SEQ ID NO: 164996 - DNA, 103 bp, Artificial Sequence
  Synthetic Polynucleotide
taatacgactcactatagggtgtccacttttttctcccatgcctccatgaaacagaggagatcatggatgcatgggagaaacctggcggcagcgcaaaagatg

SEQ ID NO: 164997 - DNA, 103 bp, Artificial Sequence
  Synthetic Polynucleotide
taatacgactcactatagggttttctattctgtccacttttttctcccataacagaggagaatgggaatgaaaagtggaaacctggcggcagcgcaaaagatg

SEQ ID NO: 164998 - DNA, 103 bp, Artificial Sequence
  Synthetic Polynucleotide
taatacgactcactatagggccgaggattattttctattctgtccactttaacagaggagaaaagtgatgagaatagaaaacctggcggcagcgcaaaagatg

SEQ ID NO: 164999 - DNA, 103 bp, Artificial Sequence
  Synthetic Polynucleotide
taatacgactcactatagggtagctttcctccgaggattattttctattcaacagaggagagaatagatgataatcctcaacctggcggcagcgcaaaagatg

SEQ ID NO: 165000 - DNA, 103 bp, Artificial Sequence
  Synthetic Polynucleotide
taatacgactcactatagggttgctttctttagctttcctccgaggattaaacagaggagataatccatggaggaaagcaacctggcggcagcgcaaaagatg

SEQ ID NO: 165001 - DNA, 103 bp, Artificial Sequence
  Synthetic Polynucleotide
taatacgactcactatagggctgtgccacaggctgtgtggatcccgacataacagaggagaatgtcgatgtccacacagaacctggcggcagcgcaaaagatg

SEQ ID NO: 165002 - DNA, 103 bp, Artificial Sequence
  Synthetic Polynucleotide
taatacgactcactatagggcaggagcccgacgtccgtgtgcgtccgggcaacagaggagagcccggatgcacacggacaacctggcggcagcgcaaaagatg

SEQ ID NO: 165003 - DNA, 103 bp, Artificial Sequence
  Synthetic Polynucleotide
taatacgactcactataggggatctcagggaactgcttctcgtagtactcaacagaggagagagtacatggagaagcagaacctggcggcagcgcaaaagatg

SEQ ID NO: 165004 - DNA, 103 bp, Artificial Sequence
  Synthetic Polynucleotide
taatacgactcactataggggctgcttgcggatctcagggaactgcttctaacagaggagaagaagcatgtccctgagaaacctggcggcagcgcaaaagatg

SEQ ID NO: 165005 - DNA, 103 bp, Artificial Sequence
  Synthetic Polynucleotide
taatacgactcactatagggtgcagctcgcgctgcttgcggatctcagggaacagaggagaccctgaatgccgcaagcaaacctggcggcagcgcaaaagatg

SEQ ID NO: 165006 - DNA, 103 bp, Artificial Sequence
  Synthetic Polynucleotide
taatacgactcactatagggcatgcgctcctgcagctcgcgctgcttgcgaacagaggagacgcaagatgcgcgagctgaacctggcggcagcgcaaaagatg

SEQ ID NO: 165007 - DNA, 103 bp, Artificial Sequence
  Synthetic Polynucleotide
taatacgactcactatagggccctgctctgcatgcgctcctgcagctcgcaacagaggagagcgagcatgaggagcgcaaacctggcggcagcgcaaaagatg

SEQ ID NO: 165008 - DNA, 103 bp, Artificial Sequence
  Synthetic Polynucleotide
taatacgactcactatagggcgctggcccaccctgctctgcatgcgctccaacagaggagaggagcgatggcagagcagaacctggcggcagcgcaaaagatg

SEQ ID NO: 165009 - DNA, 103 bp, Artificial Sequence
  Synthetic Polynucleotide
taatacgactcactatagggcccactgccccgctggcccaccctgctctgaacagaggagacagagcatggtgggccagaacctggcggcagcgcaaaagatg

SEQ ID NO: 165010 - DNA, 103 bp, Artificial Sequence
  Synthetic Polynucleotide
taatacgactcactatagggacatggacagcccactgccccgctggcccaaacagaggagatgggccatgggggcagtgaacctggcggcagcgcaaaagatg

SEQ ID NO: 165011 - DNA, 103 bp, Artificial Sequence
  Synthetic Polynucleotide
taatacgactcactatagggcgggcggccgacatggacagcccactgcccaacagaggagagggcagatggctgtccataacctggcggcagcgcaaaagatg

SEQ ID NO: 165012 - DNA, 103 bp, Artificial Sequence
  Synthetic Polynucleotide
taatacgactcactataggggtgctcgctgcgggcggccgacatggacagaacagaggagactgtccatgtcggccgccaacctggcggcagcgcaaaagatg

SEQ ID NO: 165013 - DNA, 103 bp, Artificial Sequence
  Synthetic Polynucleotide
taatacgactcactataggggctggtactccaggagcccgacgtccgtgtaacagaggagaacacggatgtcgggctccaacctggcggcagcgcaaaagatg

SEQ ID NO: 165014 - DNA, 103 bp, Artificial Sequence
  Synthetic Polynucleotide
taatacgactcactatagggctgacacctcgtgctcgctgcgggcggccgaacagaggagacggccgatggcagcgagcaacctggcggcagcgcaaaagatg

SEQ ID NO: 165015 - DNA, 103 bp, Artificial Sequence
  Synthetic Polynucleotide
taatacgactcactatagggtcgatgatctctgacacctcgtgctcgctgaacagaggagacagcgaatgcgaggtgtcaacctggcggcagcgcaaaagatg

SEQ ID NO: 165016 - DNA, 103 bp, Artificial Sequence
  Synthetic Polynucleotide
taatacgactcactatagggtgagaggccatcgatgatctctgacacctcaacagaggagagaggtgatggagatcatcaacctggcggcagcgcaaaagatg

SEQ ID NO: 165017 - DNA, 103 bp, Artificial Sequence
  Synthetic Polynucleotide
taatacgactcactatagggtctcctgctctgagaggccatcgatgatctaacagaggagaagatcaatgatggcctctaacctggcggcagcgcaaaagatg

SEQ ID NO: 165018 - DNA, 103 bp, Artificial Sequence
  Synthetic Polynucleotide
taatacgactcactatagggttctccaggttctcctgctctgagaggccaaacagaggagatggcctatgagagcaggaaacctggcggcagcgcaaaagatg

SEQ ID NO: 165019 - DNA, 103 bp, Artificial Sequence
  Synthetic Polynucleotide
taatacgactcactataggggcgcatctgcttctccaggttctcctgctcaacagaggagagagcagatgaacctggagaacctggcggcagcgcaaaagatg

SEQ ID NO: 165020 - DNA, 103 bp, Artificial Sequence
  Synthetic Polynucleotide
taatacgactcactatagggcggccagctggcgcatctgcttctccaggtaacagaggagaacctggatgagcagatgcaacctggcggcagcgcaaaagatg

SEQ ID NO: 165021 - DNA, 103 bp, Artificial Sequence
  Synthetic Polynucleotide
taatacgactcactatagggggcgggatcacggccagctggcgcatctgcaacagaggagagcagatatgccagctggcaacctggcggcagcgcaaaagatg

SEQ ID NO: 165022 - DNA, 103 bp, Artificial Sequence
  Synthetic Polynucleotide
taatacgactcactataggggtacagcatgggcgggatcacggccagctgaacagaggagacagctgatggtgatcccgaacctggcggcagcgcaaaagatg

SEQ ID NO: 165023 - DNA, 103 bp, Artificial Sequence
  Synthetic Polynucleotide
taatacgactcactatagggggtcagcgtcgtacagcatgggcgggatcaaacagaggagatgatccatgccatgctgtaacctggcggcagcgcaaaagatg

SEQ ID NO: 165024 - DNA, 103 bp, Artificial Sequence
  Synthetic Polynucleotide
taatacgactcactatagggcgggagtggtgctggtactccaggagcccgaacagaggagacgggctatgggagtaccaaacctggcggcagcgcaaaagatg

SEQ ID NO: 165025 - DNA, 103 bp, Artificial Sequence
  Synthetic Polynucleotide
taatacgactcactatagggatgcgctgctggtcagcgtcgtacagcatgaacagaggagacatgctatgcgacgctgaaacctggcggcagcgcaaaagatg

SEQ ID NO: 165026 - DNA, 103 bp, Artificial Sequence
  Synthetic Polynucleotide
taatacgactcactataggggatgaacttgatgcgctgctggtcagcgtcaacagaggagagacgctatgcagcagcgcaacctggcggcagcgcaaaagatg

SEQ ID NO: 165027 - DNA, 103 bp, Artificial Sequence
  Synthetic Polynucleotide
taatacgactcactatagggcgttcatgttgatgaacttgatgcgctgctaacagaggagaagcagcatgtcaagttcaaacctggcggcagcgcaaaagatg

SEQ ID NO: 165028 - DNA, 103 bp, Artificial Sequence
  Synthetic Polynucleotide
taatacgactcactataggggccataagcccgttcatgttgatgaacttgaacagaggagacaagttatgcaacatgaaaacctggcggcagcgcaaaagatg

SEQ ID NO: 165029 - DNA, 103 bp, Artificial Sequence
  Synthetic Polynucleotide
taatacgactcactatagggcatggggtcggccataagcccgttcatgttaacagaggagaaacatgatggggcttatgaacctggcggcagcgcaaaagatg

SEQ ID NO: 165030 - DNA, 103 bp, Artificial Sequence
  Synthetic Polynucleotide
taatacgactcactatagggtgtacaccttcatggggtcggccataagccaacagaggagaggcttaatgccgaccccaaacctggcggcagcgcaaaagatg

SEQ ID NO: 165031 - DNA, 103 bp, Artificial Sequence
  Synthetic Polynucleotide
taatacgactcactatagggtggcggtctttgtacaccttcatggggtcgaacagaggagacgacccatggaaggtgtaaacctggcggcagcgcaaaagatg

SEQ ID NO: 165032 - DNA, 103 bp, Artificial Sequence
  Synthetic Polynucleotide
taatacgactcactataggggttcatgacctggcggtctttgtacaccttaacagaggagaaaggtgatgaaagaccgcaacctggcggcagcgcaaaagatg

SEQ ID NO: 165033 - DNA, 103 bp, Artificial Sequence
  Synthetic Polynucleotide
taatacgactcactatagggcactccacatgttcatgacctggcggtcttaacagaggagaaagaccatgaggtcatgaaacctggcggcagcgcaaaagatg

SEQ ID NO: 165034 - DNA, 103 bp, Artificial Sequence
  Synthetic Polynucleotide
taatacgactcactatagggttctcctgctcactccacatgttcatgaccaacagaggagaggtcatatgcatgtggagaacctggcggcagcgcaaaagatg

SEQ ID NO: 165035 - DNA, 103 bp, Artificial Sequence
  Synthetic Polynucleotide
taatacgactcactatagggggcatagtcgcgggagtggtgctggtactcaacagaggagagagtacatgcaccactccaacctggcggcagcgcaaaagatg

SEQ ID NO: 165036 - DNA, 103 bp, Artificial Sequence
  Synthetic Polynucleotide
taatacgactcactataggggaaggtctccttctcctgctcactccacataacagaggagaatgtggatggagcaggagaacctggcggcagcgcaaaagatg

SEQ ID NO: 165037 - DNA, 103 bp, Artificial Sequence
  Synthetic Polynucleotide
taatacgactcactatagggacttctcccggaaggtctccttctcctgctaacagaggagaagcaggatgaggagacctaacctggcggcagcgcaaaagatg

SEQ ID NO: 165038 - DNA, 103 bp, Artificial Sequence
  Synthetic Polynucleotide
taatacgactcactatagggtgctgcatgaacttctcccggaaggtctccaacagaggagaggagacatgccgggagaaaacctggcggcagcgcaaaagatg

SEQ ID NO: 165039 - DNA, 103 bp, Artificial Sequence
  Synthetic Polynucleotide
taatacgactcactataggggttcttgggatgctgcatgaacttctcccgaacagaggagacgggagatgttcatgcagaacctggcggcagcgcaaaagatg

SEQ ID NO: 165040 - DNA, 103 bp, Artificial Sequence
  Synthetic Polynucleotide
taatacgactcactatagggtcaggccaaagttcttgggatgctgcatgaaacagaggagatcatgcatgatcccaagaaacctggcggcagcgcaaaagatg

SEQ ID NO: 165041 - DNA, 103 bp, Artificial Sequence
  Synthetic Polynucleotide
taatacgactcactatagggaatgatgcgatcaggccaaagttcttgggaaacagaggagatcccaaatgctttggcctaacctggcggcagcgcaaaagatg

SEQ ID NO: 165042 - DNA, 103 bp, Artificial Sequence
  Synthetic Polynucleotide
taatacgactcactatagggcctctccaggaatgatgcgatcaggccaaaaacagaggagatttggcatgatcgcatcaaacctggcggcagcgcaaaagatg

SEQ ID NO: 165043 - DNA, 103 bp, Artificial Sequence
  Synthetic Polynucleotide
taatacgactcactatagggccactgtcttcctctccaggaatgatgcgaaacagaggagatcgcatatgtcctggagaaacctggcggcagcgcaaaagatg

SEQ ID NO: 165044 - DNA, 103 bp, Artificial Sequence
  Synthetic Polynucleotide
taatacgactcactatagggacgcactcagccactgtcttcctctccaggaacagaggagacctggaatggaagacagtaacctggcggcagcgcaaaagatg

SEQ ID NO: 165045 - DNA, 103 bp, Artificial Sequence
  Synthetic Polynucleotide
taatacgactcactataggggtaatagaggacgcactcagccactgtcttaacagaggagaaagacaatggctgagtgcaacctggcggcagcgcaaaagatg

SEQ ID NO: 165046 - DNA, 103 bp, Artificial Sequence
  Synthetic Polynucleotide
taatacgactcactatagggacaggtgggaggcatagtcgcgggagtggtaacagaggagaaccactatggcgactatgaacctggcggcagcgcaaaagatg

SEQ ID NO: 165047 - DNA, 103 bp, Artificial Sequence
  Synthetic Polynucleotide
taatacgactcactatagggtagtcaggtagtaatagaggacgcactcagaacagaggagactgagtatgtcctctattaacctggcggcagcgcaaaagatg

SEQ ID NO: 165048 - DNA, 103 bp, Artificial Sequence
  Synthetic Polynucleotide
taatacgactcactatagggtcattcttcttagtcaggtagtaatagaggaacagaggagacctctaatgctacctgacaacctggcggcagcgcaaaagatg

SEQ ID NO: 165049 - DNA, 103 bp, Artificial Sequence
  Synthetic Polynucleotide
taatacgactcactatagggcttatagttctcattcttcttagtcaggtaaacagaggagatacctgatgaagaagaataacctggcggcagcgcaaaagatg

SEQ ID NO: 165050 - DNA, 103 bp, Artificial Sequence
  Synthetic Polynucleotide
taatacgactcactatagggtcaccaggctcttatagttctcattcttctaacagaggagaagaagaatgagaactataaacctggcggcagcgcaaaagatg

SEQ ID NO: 165051 - DNA, 103 bp, Artificial Sequence
  Synthetic Polynucleotide
taatacgactcactatagggtagctccgtctcaccaggctcttatagttcaacagaggagagaactaatggagcctggtaacctggcggcagcgcaaaagatg

SEQ ID NO: 165052 - DNA, 103 bp, Artificial Sequence
  Synthetic Polynucleotide
taatacgactcactataggggcggcgccgatagctccgtctcaccaggctaacagaggagaagcctgatgagacggagcaacctggcggcagcgcaaaagatg

SEQ ID NO: 165053 - DNA, 103 bp, Artificial Sequence
  Synthetic Polynucleotide
taatacgactcactatagggggctcttgccgcggcgccgatagctccgtcaacagaggagagacggaatgatcggcgccaacctggcggcagcgcaaaagatg

SEQ ID NO: 165054 - DNA, 103 bp, Artificial Sequence
  Synthetic Polynucleotide
taatacgactcactatagggtgctgctgctggctcttgccgcggcgccgaaacagaggagatcggcgatgcggcaagagaacctggcggcagcgcaaaagatg

SEQ ID NO: 165055 - DNA, 103 bp, Artificial Sequence
  Synthetic Polynucleotide
taatacgactcactatagggctgctgttgttgctgctgctggctcttgccaacagaggagaggcaagatgcagcagcagaacctggcggcagcgcaaaagatg

SEQ ID NO: 165056 - DNA, 103 bp, Artificial Sequence
  Synthetic Polynucleotide
taatacgactcactataggggctgctgctgctgctgttgttgctgctgctaacagaggagaagcagcatgaacaacagcaacctggcggcagcgcaaaagatg

SEQ ID NO: 165057 - DNA, 103 bp, Artificial Sequence
  Synthetic Polynucleotide
taatacgactcactataggggagccgggcgacaggtgggaggcatagtcgaacagaggagacgactaatgctcccacctaacctggcggcagcgcaaaagatg

SEQ ID NO: 165058 - DNA, 103 bp, Artificial Sequence
  Synthetic Polynucleotide
taatacgactcactatagggtgctgctgctgctgctgctgctgctgttgtaacagaggagaacaacaatggcagcagcaaacctggcggcagcgcaaaagatg

SEQ ID NO: 165059 - DNA, 103 bp, Artificial Sequence; identical to SEQ ID NO: 88564
  Synthetic Polynucleotide

SEQ ID NO: 165060 - DNA, 103 bp, Artificial Sequence
  Synthetic Polynucleotide
taatacgactcactatagggggggcatgggctgctgctgctgctgctgctaacagaggagaagcagcatgagcagcagcaacctggcggcagcgcaaaagatg

SEQ ID NO: 165061 - DNA, 103 bp, Artificial Sequence
  Synthetic Polynucleotide
taatacgactcactatagggtggctgctgcggggcatgggctgctgctgcaacagaggagagcagcaatggcccatgccaacctggcggcagcgcaaaagatg

SEQ ID NO: 165062 - DNA, 103 bp, Artificial Sequence
  Synthetic Polynucleotide
taatacgactcactatagggtttctcctcctggctgctgcggggcatgggaacagaggagacccatgatgcgcagcagcaacctggcggcagcgcaaaagatg

SEQ ID NO: 165063 - DNA, 103 bp, Artificial Sequence
  Synthetic Polynucleotide
taatacgactcactatagggccttctcatctttctcctcctggctgctgcaacagaggagagcagcaatgaggaggagaaacctggcggcagcgcaaaagatg

SEQ ID NO: 165064 - DNA, 103 bp, Artificial Sequence
  Synthetic Polynucleotide
taatacgactcactatagggttttccttctccttctcatctttctcctccaacagaggagaggaggaatgagatgagaaaacctggcggcagcgcaaaagatg

SEQ ID NO: 165065 - DNA, 103 bp, Artificial Sequence
  Synthetic Polynucleotide
taatacgactcactatagggctccgcctccttttccttctccttctcatcaacagaggagagatgagatggagaaggaaaacctggcggcagcgcaaaagatg

SEQ ID NO: 165066 - DNA, 103 bp, Artificial Sequence
  Synthetic Polynucleotide
taatacgactcactatagggcctcctccttctccgcctccttttccttctaacagaggagaagaaggatgaggaggcggaacctggcggcagcgcaaaagatg

SEQ ID NO: 165067 - DNA, 103 bp, Artificial Sequence
  Synthetic Polynucleotide
taatacgactcactatagggtccggcttctcctcctccttctccgcctccaacagaggagaggaggcatggaaggaggaaacctggcggcagcgcaaaagatg

SEQ ID NO: 165068 - DNA, 103 bp, Artificial Sequence
  Synthetic Polynucleotide
taatacgactcactatagggctggatgatggagccgggcgacaggtgggaaacagaggagatcccacatgtcgcccggcaacctggcggcagcgcaaaagatg

SEQ ID NO: 165069 - DNA, 103 bp, Artificial Sequence
  Synthetic Polynucleotide
taatacgactcactataggggttctccacctccggcttctcctcctccttaacagaggagaaaggagatggagaagccgaacctggcggcagcgcaaaagatg

SEQ ID NO: 165070 - DNA, 103 bp, Artificial Sequence
  Synthetic Polynucleotide
taatacgactcactatagggcttccttgtcgttctccacctccggcttctaacagaggagaagaagcatgaggtggagaaacctggcggcagcgcaaaagatg

SEQ ID NO: 165071 - DNA, 103 bp, Artificial Sequence
  Synthetic Polynucleotide
taatacgactcactatagggttgaggaggtcttccttgtcgttctccaccaacagaggagaggtggaatgcgacaaggaaacctggcggcagcgcaaaagatg

SEQ ID NO: 165072 - DNA, 103 bp, Artificial Sequence
  Synthetic Polynucleotide
taatacgactcactatagggtgtcttctccttgaggaggtcttccttgtcaacagaggagagacaagatggacctcctcaacctggcggcagcgcaaaagatg

SEQ ID NO: 165073 - DNA, 103 bp, Artificial Sequence
  Synthetic Polynucleotide
taatacgactcactatagggaggtgtcgtctgtcttctccttgaggaggtaacagaggagaacctccatgaggagaagaaacctggcggcagcgcaaaagatg

SEQ ID NO: 165074 - DNA, 103 bp, Artificial Sequence
  Synthetic Polynucleotide
taatacgactcactatagggtcctcccctgaggtgtcgtctgtcttctccaacagaggagaggagaaatgagacgacacaacctggcggcagcgcaaaagatg

SEQ ID NO: 165075 - DNA, 103 bp, Artificial Sequence
  Synthetic Polynucleotide
taatacgactcactatagggctcgtcgttgtcctcccctgaggtgtcgtcaacagaggagagacgacatgtcaggggagaacctggcggcagcgcaaaagatg

SEQ ID NO: 165076 - DNA, 103 bp, Artificial Sequence
  Synthetic Polynucleotide
taatacgactcactatagggcagcctccttctcgtcgttgtcctcccctgaacagaggagacaggggatgacaacgacgaacctggcggcagcgcaaaagatg

SEQ ID NO: 165077 - DNA, 103 bp, Artificial Sequence
  Synthetic Polynucleotide
taatacgactcactatagggttggaggccacagcctccttctcgtcgttgaacagaggagacaacgaatggaaggaggcaacctggcggcagcgcaaaagatg

SEQ ID NO: 165078 - DNA, 103 bp, Artificial Sequence
  Synthetic Polynucleotide
taatacgactcactatagggtttgcggcctttggaggccacagcctccttaacagaggagaaaggagatggtggcctccaacctggcggcagcgcaaaagatg

SEQ ID NO: 165079 - DNA, 103 bp, Artificial Sequence
  Synthetic Polynucleotide
taatacgactcactataggggccgctggggctggatgatggagccgggcgaacagaggagacgcccgatgccatcatccaacctggcggcagcgcaaaagatg

SEQ ID NO: 165080 - DNA, 103 bp, Artificial Sequence
  Synthetic Polynucleotide
taatacgactcactatagggtgttggcagttttgcggcctttggaggccaaacagaggagatggcctatgaaggccgcaaacctggcggcagcgcaaaagatg

SEQ ID NO: 165081 - DNA, 103 bp, Artificial Sequence
  Synthetic Polynucleotide
taatacgactcactatagggcttccctggctgttggcagttttgcggcctaacagaggagaaggccgatgaactgccaaaacctggcggcagcgcaaaagatg

SEQ ID NO: 165082 - DNA, 103 bp, Artificial Sequence
  Synthetic Polynucleotide
taatacgactcactataggggcctttgcgtcttccctggctgttggcagtaacagaggagaactgccatgagccagggaaacctggcggcagcgcaaaagatg

SEQ ID NO: 165083 - DNA, 103 bp, Artificial Sequence
  Synthetic Polynucleotide
taatacgactcactataggggggtgatgcggcctttgcgtcttccctggcaacagaggagagccaggatggacgcaaagaacctggcggcagcgcaaaagatg

SEQ ID NO: 165084 - DNA, 103 bp, Artificial Sequence
  Synthetic Polynucleotide
taatacgactcactataggggccattgagcgggtgatgcggcctttgcgtaacagaggagaacgcaaatgccgcatcacaacctggcggcagcgcaaaagatg

SEQ ID NO: 165085 - DNA, 103 bp, Artificial Sequence
  Synthetic Polynucleotide
taatacgactcactatagggggcctcattagccattgagcgggtgatgcgaacagaggagacgcatcatgcgctcaatgaacctggcggcagcgcaaaagatg

SEQ ID NO: 165086 - DNA, 103 bp, Artificial Sequence
  Synthetic Polynucleotide
taatacgactcactatagggcctcgctgttggcctcattagccattgagcaacagaggagagctcaaatgctaatgaggaacctggcggcagcgcaaaagatg

SEQ ID NO: 165087 - DNA, 103 bp, Artificial Sequence
  Synthetic Polynucleotide
taatacgactcactataggggtgatggcctcctcgctgttggcctcattaaacagaggagataatgaatgcaacagcgaaacctggcggcagcgcaaaagatg

SEQ ID NO: 165088 - DNA, 103 bp, Artificial Sequence
  Synthetic Polynucleotide
taatacgactcactatagggctgctggggggtgatggcctcctcgctgttaacagaggagaaacagcatggaggccatcaacctggcggcagcgcaaaagatg

SEQ ID NO: 165089 - DNA, 103 bp, Artificial Sequence
  Synthetic Polynucleotide
taatacgactcactataggggctcggcgctctgctggggggtgatggcctaacagaggagaaggccaatgccccccagcaacctggcggcagcgcaaaagatg

SEQ ID NO: 165090 - DNA, 103 bp, Artificial Sequence
  Synthetic Polynucleotide
taatacgactcactataggggagggcctccgccgctggggctggatgatgaacagaggagacatcatatggccccagcgaacctggcggcagcgcaaaagatg

SEQ ID NO: 165091 - DNA, 103 bp, Artificial Sequence
  Synthetic Polynucleotide
taatacgactcactatagggatggaggccagctcggcgctctgctgggggaacagaggagacccccaatggagcgccgaaacctggcggcagcgcaaaagatg

SEQ ID NO: 165092 - DNA, 103 bp, Artificial Sequence
  Synthetic Polynucleotide
taatacgactcactatagggattcagctccatggaggccagctcggcgctaacagaggagaagcgccatgctggcctccaacctggcggcagcgcaaaagatg

SEQ ID NO: 165093 - DNA, 103 bp, Artificial Sequence
  Synthetic Polynucleotide
taatacgactcactataggggagaactctcattcagctccatggaggccaaacagaggagatggcctatgtggagctgaaacctggcggcagcgcaaaagatg

SEQ ID NO: 165094 - DNA, 103 bp, Artificial Sequence
  Synthetic Polynucleotide
taatacgactcactatagggtctgtccagcgagaactctcattcagctccaacagaggagaggagctatgtgagagttcaacctggcggcagcgcaaaagatg

SEQ ID NO: 165095 - DNA, 103 bp, Artificial Sequence
  Synthetic Polynucleotide
taatacgactcactatagggcatttcttcttctgtccagcgagaactctcaacagaggagagagagtatgcgctggacaaacctggcggcagcgcaaaagatg

SEQ ID NO: 165096 - DNA, 103 bp, Artificial Sequence
  Synthetic Polynucleotide
taatacgactcactatagggtggctgtttccatttcttcttctgtccagcaacagaggagagctggaatgaagaagaaaaacctggcggcagcgcaaaagatg

SEQ ID NO: 165097 - DNA, 103 bp, Artificial Sequence
  Synthetic Polynucleotide
taatacgactcactatagggagacctttcttggctgtttccatttcttctaacagaggagaagaagaatgggaaacagcaacctggcggcagcgcaaaagatg

SEQ ID NO: 165098 - DNA, 103 bp, Artificial Sequence
  Synthetic Polynucleotide
taatacgactcactataggggtgttccaggagacctttcttggctgtttcaacagaggagagaaacaatgaagaaaggtaacctggcggcagcgcaaaagatg

SEQ ID NO: 165099 - DNA, 103 bp, Artificial Sequence
  Synthetic Polynucleotide
taatacgactcactatagggagttgcggccgtgttccaggagacctttctaacagaggagaagaaagatgtcctggaacaacctggcggcagcgcaaaagatg

SEQ ID NO: 165100 - DNA, 103 bp, Artificial Sequence
  Synthetic Polynucleotide
taatacgactcactatagggatggccgaccagttgcggccgtgttccaggaacagaggagacctggaatgcggccgcaaaacctggcggcagcgcaaaagatg

SEQ ID NO: 165101 - DNA, 103 bp, Artificial Sequence
  Synthetic Polynucleotide
taatacgactcactatagggagacagcagggagggcctccgccgctggggaacagaggagaccccagatgcggaggcccaacctggcggcagcgcaaaagatg

SEQ ID NO: 165102 - DNA, 103 bp, Artificial Sequence
  Synthetic Polynucleotide
taatacgactcactatagggcatccgggcgatggccgaccagttgcggccaacagaggagaggccgcatgtggtcggccaacctggcggcagcgcaaaagatg

SEQ ID NO: 165103 - DNA, 103 bp, Artificial Sequence
  Synthetic Polynucleotide
taatacgactcactatagggtggagcccaccatccgggcgatggccgaccaacagaggagaggtcggatgtcgcccggaaacctggcggcagcgcaaaagatg

SEQ ID NO: 165104 - DNA, 103 bp, Artificial Sequence
  Synthetic Polynucleotide
taatacgactcactataggggacacagtcttggagcccaccatccgggcgaacagaggagacgcccgatgggtgggctcaacctggcggcagcgcaaaagatg

SEQ ID NO: 165105 - DNA, 103 bp, Artificial Sequence
  Synthetic Polynucleotide
taatacgactcactatagggcttacactgcgacacagtcttggagcccacaacagaggagagtgggcatgaagactgtgaacctggcggcagcgcaaaagatg

SEQ ID NO: 165106 - DNA, 103 bp, Artificial Sequence
  Synthetic Polynucleotide
taatacgactcactatagggagtagaagttcttacactgcgacacagtctaacagaggagaagactgatgcgcagtgtaaacctggcggcagcgcaaaagatg

SEQ ID NO: 165107 - DNA, 103 bp, Artificial Sequence
  Synthetic Polynucleotide
taatacgactcactatagggttgtagttgaagtagaagttcttacactgcaacagaggagagcagtgatggaacttctaaacctggcggcagcgcaaaagatg

SEQ ID NO: 165108 - DNA, 103 bp, Artificial Sequence
  Synthetic Polynucleotide
taatacgactcactatagggctgcctcttcttgtagttgaagtagaagttaacagaggagaaacttcatgttcaactacaacctggcggcagcgcaaaagatg

SEQ ID NO: 165109 - DNA, 103 bp, Artificial Sequence
  Synthetic Polynucleotide
taatacgactcactatagggcatcgaggttctgcctcttcttgtagttgaaacagaggagatcaactatgagaagaggcaacctggcggcagcgcaaaagatg

SEQ ID NO: 165110 - DNA, 103 bp, Artificial Sequence
  Synthetic Polynucleotide
taatacgactcactatagggtgcaagatctcatcgaggttctgcctcttcaacagaggagagaagagatggaacctcgaaacctggcggcagcgcaaaagatg

SEQ ID NO: 165111 - DNA, 103 bp, Artificial Sequence
  Synthetic Polynucleotide
taatacgactcactatagggcttgtgctgctgcaagatctcatcgaggttaacagaggagaaacctcatggagatcttgaacctggcggcagcgcaaaagatg

SEQ ID NO: 165112 - DNA, 103 bp, Artificial Sequence
  Synthetic Polynucleotide
taatacgactcactatagggccctccacgtctgtgccacaggctgtgtggaacagaggagaccacacatgctgtggcacaacctggcggcagcgcaaaagatg

SEQ ID NO: 165113 - DNA, 103 bp, Artificial Sequence
  Synthetic Polynucleotide
taatacgactcactataggggctggaactcagacagcagggagggcctccaacagaggagaggaggcatgccctgctgtaacctggcggcagcgcaaaagatg

SEQ ID NO: 165114 - DNA, 103 bp, Artificial Sequence
  Synthetic Polynucleotide
taatacgactcactatagggccatcttcagcttgtgctgctgcaagatctaacagaggagaagatctatgagcagcacaaacctggcggcagcgcaaaagatg

SEQ ID NO: 165115 - DNA, 103 bp, Artificial Sequence
  Synthetic Polynucleotide
taatacgactcactatagggctctccttctccatcttcagcttgtgctgcaacagaggagagcagcaatggctgaagataacctggcggcagcgcaaaagatg

SEQ ID NO: 165116 - DNA, 103 bp, Artificial Sequence
  Synthetic Polynucleotide
taatacgactcactatagggccgcgcgttcctctccttctccatcttcagaacagaggagactgaagatggagaaggagaacctggcggcagcgcaaaagatg

SEQ ID NO: 165117 - DNA, 103 bp, Artificial Sequence
  Synthetic Polynucleotide
taatacgactcactatagggtcttcttcctccgcgcgttcctctccttctaacagaggagaagaaggatgggaacgcgcaacctggcggcagcgcaaaagatg

SEQ ID NO: 165118 - DNA, 103 bp, Artificial Sequence
  Synthetic Polynucleotide
taatacgactcactatagggggcgctttcttcttcttcctccgcgcgttcaacagaggagagaacgcatggaggaagaaaacctggcggcagcgcaaaagatg

SEQ ID NO: 165119 - DNA, 103 bp, Artificial Sequence
  Synthetic Polynucleotide
taatacgactcactatagggggccgccgccggcgctttcttcttcttcctaacagaggagaaggaagatgaagaaagcgaacctggcggcagcgcaaaagatg

SEQ ID NO: 165120 - DNA, 103 bp, Artificial Sequence
  Synthetic Polynucleotide
taatacgactcactatagggcctcctcgctggccgccgccggcgctttctaacagaggagaagaaagatgcggcggcggaacctggcggcagcgcaaaagatg

SEQ ID NO: 165121 - DNA, 103 bp, Artificial Sequence
  Synthetic Polynucleotide
taatacgactcactataggggggaatgcagcctcctcgctggccgccgccaacagaggagaggcggcatgcagcgaggaaacctggcggcagcgcaaaagatg

SEQ ID NO: 165122 - DNA, 103 bp, Artificial Sequence
  Synthetic Polynucleotide
taatacgactcactatagggcaccacgggcgggaatgcagcctcctcgctaacagaggagaagcgagatggctgcattcaacctggcggcagcgcaaaagatg

SEQ ID NO: 165123 - DNA, 103 bp, Artificial Sequence
  Synthetic Polynucleotide
taatacgactcactatagggcctcatcctccaccacgggcgggaatgcagaacagaggagactgcatatgcgcccgtggaacctggcggcagcgcaaaagatg

SEQ ID NO: 165124 - DNA, 103 bp, Artificial Sequence
  Synthetic Polynucleotide
taatacgactcactatagggtcattcccgggctggaactcagacagcaggaacagaggagacctgctatgtgagttccaaacctggcggcagcgcaaaagatg

SEQ ID NO: 165125 - DNA, 103 bp, Artificial Sequence
  Synthetic Polynucleotide
taatacgactcactataggggcctccatctcctcatcctccaccacgggcaacagaggagagcccgtatgggaggatgaaacctggcggcagcgcaaaagatg

SEQ ID NO: 165126 - DNA, 103 bp, Artificial Sequence
  Synthetic Polynucleotide
taatacgactcactatagggcacgcccgacgcctccatctcctcatcctcaacagaggagagaggatatggagatggagaacctggcggcagcgcaaaagatg

SEQ ID NO: 165127 - DNA, 103 bp, Artificial Sequence
  Synthetic Polynucleotide
taatacgactcactatagggcatttccgctcacgcccgacgcctccatctaacagaggagaagatggatgcgtcgggcgaacctggcggcagcgcaaaagatg

SEQ ID NO: 165128 - DNA, 103 bp, Artificial Sequence
  Synthetic Polynucleotide
taatacgactcactatagggatctcctcctcatttccgctcacgcccgacaacagaggagagtcgggatggagcggaaaaacctggcggcagcgcaaaagatg

SEQ ID NO: 165129 - DNA, 103 bp, Artificial Sequence
  Synthetic Polynucleotide
taatacgactcactatagggctcctccaccatctcctcctcatttccgctaacagaggagaagcggaatggaggaggagaacctggcggcagcgcaaaagatg

SEQ ID NO: 165130 - DNA, 103 bp, Artificial Sequence
  Synthetic Polynucleotide
taatacgactcactatagggaggcttcagcctcctccaccatctcctcctaacagaggagaaggaggatgtggtggaggaacctggcggcagcgcaaaagatg

SEQ ID NO: 165131 - DNA, 103 bp, Artificial Sequence
  Synthetic Polynucleotide
taatacgactcactataggggaggcatgtaaggcttcagcctcctccaccaacagaggagaggtggaatgggctgaagcaacctggcggcagcgcaaaagatg

SEQ ID NO: 165132 - DNA, 103 bp, Artificial Sequence
  Synthetic Polynucleotide
taatacgactcactatagggctcattcccagaggcatgtaaggcttcagcaacagaggagagctgaaatgttacatgccaacctggcggcagcgcaaaagatg

SEQ ID NO: 165133 - DNA, 103 bp, Artificial Sequence
  Synthetic Polynucleotide
taatacgactcactatagggctctgggcacctcattcccagaggcatgtaaacagaggagatacatgatgctgggaatgaacctggcggcagcgcaaaagatg

SEQ ID NO: 165134 - DNA, 103 bp, Artificial Sequence
  Synthetic Polynucleotide
taatacgactcactatagggctgcattcccctctgggcacctcattcccaaacagaggagatgggaaatgggtgcccagaacctggcggcagcgcaaaagatg

SEQ ID NO: 165135 - DNA, 103 bp, Artificial Sequence
  Synthetic Polynucleotide
taatacgactcactatagggctgggaccgttcattcccgggctggaactcaacagaggagagagttcatgcccgggaataacctggcggcagcgcaaaagatg

SEQ ID NO: 165136 - DNA, 103 bp, Artificial Sequence
  Synthetic Polynucleotide
taatacgactcactatagggggctgggccactgcattcccctctgggcacaacagaggagagtgcccatgggggaatgcaacctggcggcagcgcaaaagatg

SEQ ID NO: 165137 - DNA, 103 bp, Artificial Sequence
  Synthetic Polynucleotide
taatacgactcactatagggtgttgacagtggctgggccactgcattcccaacagaggagagggaatatggtggcccagaacctggcggcagcgcaaaagatg

SEQ ID NO: 165138 - DNA, 103 bp, Artificial Sequence
  Synthetic Polynucleotide
taatacgactcactatagggtctgagctgttgttgacagtggctgggccaaacagaggagatggcccatgcactgtcaaaacctggcggcagcgcaaaagatg

SEQ ID NO: 165139 - DNA, 103 bp, Artificial Sequence
  Synthetic Polynucleotide
taatacgactcactataggggctctcggtgtctgagctgttgttgacagtaacagaggagaactgtcatgaacagctcaaacctggcggcagcgcaaaagatg

SEQ ID NO: 165140 - DNA, 103 bp, Artificial Sequence
  Synthetic Polynucleotide
taatacgactcactataggggagaggggatgctctcggtgtctgagctgtaacagaggagaacagctatgacaccgagaaacctggcggcagcgcaaaagatg

SEQ ID NO: 165141 - DNA, 103 bp, Artificial Sequence
  Synthetic Polynucleotide
taatacgactcactatagggtcagtgtgaggagaggggatgctctcggtgaacagaggagacaccgaatgcatcccctcaacctggcggcagcgcaaaagatg

SEQ ID NO: 165142 - DNA, 103 bp, Artificial Sequence
  Synthetic Polynucleotide
taatacgactcactatagggcttggcggcctcagtgtgaggagaggggataacagaggagaatccccatgcctcacactaacctggcggcagcgcaaaagatg

SEQ ID NO: 165143 - DNA, 103 bp, Artificial Sequence
  Synthetic Polynucleotide
taatacgactcactataggggccctgtgtccttggcggcctcagtgtgagaacagaggagactcacaatgaggccgccaaacctggcggcagcgcaaaagatg

SEQ ID NO: 165144 - DNA, 103 bp, Artificial Sequence
  Synthetic Polynucleotide
taatacgactcactatagggggcccattctgccctgtgtccttggcggccaacagaggagaggccgcatgggacacaggaacctggcggcagcgcaaaagatg

SEQ ID NO: 165145 - DNA, 103 bp, Artificial Sequence
  Synthetic Polynucleotide
taatacgactcactatagggtgggggcttgggcccattctgccctgtgtcaacagaggagagacacaatgcagaatgggaacctggcggcagcgcaaaagatg

SEQ ID NO: 165146 - DNA, 103 bp, Artificial Sequence
  Synthetic Polynucleotide
taatacgactcactatagggggtggagctcctgggaccgttcattcccggaacagaggagaccgggaatgaacggtcccaacctggcggcagcgcaaaagatg

SEQ ID NO: 165147 - DNA, 103 bp, Artificial Sequence
  Synthetic Polynucleotide
taatacgactcactatagggccagggtggctgggggcttgggcccattctaacagaggagaagaatgatgccaagccccaacctggcggcagcgcaaaagatg

SEQ ID NO: 165148 - DNA, 103 bp, Artificial Sequence
  Synthetic Polynucleotide
taatacgactcactatagggccgtcggcgcccagggtggctgggggcttgaacagaggagacaagccatgagccaccctaacctggcggcagcgcaaaagatg

SEQ ID NO: 165149 - DNA, 103 bp, Artificial Sequence
  Synthetic Polynucleotide
taatacgactcactatagggtgggggtggcccgtcggcgcccagggtggcaacagaggagagccaccatgggcgccgacaacctggcggcagcgcaaaagatg

SEQ ID NO: 165150 - DNA, 103 bp, Artificial Sequence
  Synthetic Polynucleotide
taatacgactcactatagggtgggtggccctgggggtggcccgtcggcgcaacagaggagagcgccgatgggccaccccaacctggcggcagcgcaaaagatg

SEQ ID NO: 165151 - DNA, 103 bp, Artificial Sequence
  Synthetic Polynucleotide
taatacgactcactatagggggtggtggggtgggtggccctgggggtggcaacagaggagagccaccatgagggccaccaacctggcggcagcgcaaaagatg

SEQ ID NO: 165152 - DNA, 103 bp, Artificial Sequence
  Synthetic Polynucleotide
taatacgactcactataggggatgtcctccggtggtggggtgggtggcccaacagaggagagggccaatgaccccaccaaacctggcggcagcgcaaaagatg

SEQ ID NO: 165153 - DNA, 103 bp, Artificial Sequence
  Synthetic Polynucleotide
taatacgactcactatagggtgggggccgggatgtcctccggtggtggggaacagaggagaccccacatgcggaggacaaacctggcggcagcgcaaaagatg

SEQ ID NO: 165154 - DNA, 103 bp, Artificial Sequence
  Synthetic Polynucleotide
taatacgactcactataggggtgggctcagtgggggccgggatgtcctccaacagaggagaggaggaatgcccggccccaacctggcggcagcgcaaaagatg

SEQ ID NO: 165155 - DNA, 103 bp, Artificial Sequence
  Synthetic Polynucleotide
taatacgactcactatagggagaggccggggtgggctcagtgggggccggaacagaggagaccggccatgactgagcccaacctggcggcagcgcaaaagatg

SEQ ID NO: 165156 - DNA, 103 bp, Artificial Sequence
  Synthetic Polynucleotide
taatacgactcactatagggcggtggcttcagaggccggggtgggctcagaacagaggagactgagcatgccccggcctaacctggcggcagcgcaaaagatg

SEQ ID NO: 165157 - DNA, 103 bp, Artificial Sequence
  Synthetic Polynucleotide
taatacgactcactatagggtctggccgcaggtggagctcctgggaccgtaacagaggagaacggtcatgggagctccaaacctggcggcagcgcaaaagatg

SEQ ID NO: 165158 - DNA, 103 bp, Artificial Sequence
  Synthetic Polynucleotide
taatacgactcactataggggtaggggctccggtggcttcagaggccgggaacagaggagacccggcatgtgaagccacaacctggcggcagcgcaaaagatg

SEQ ID NO: 165159 - DNA, 103 bp, Artificial Sequence
  Synthetic Polynucleotide
taatacgactcactatagggtggtgggggcgtaggggctccggtggcttcaacagaggagagaagccatgggagcccctaacctggcggcagcgcaaaagatg

SEQ ID NO: 165160 - DNA, 103 bp, Artificial Sequence
  Synthetic Polynucleotide
taatacgactcactatagggatgggggtgctggtgggggcgtaggggctcaacagaggagagagcccatgcgcccccacaacctggcggcagcgcaaaagatg

SEQ ID NO: 165161 - DNA, 103 bp, Artificial Sequence
  Synthetic Polynucleotide
taatacgactcactataggggcagagggcgatgggggtgctggtgggggcaacagaggagagcccccatgagcacccccaacctggcggcagcgcaaaagatg

SEQ ID NO: 165162 - DNA, 103 bp, Artificial Sequence
  Synthetic Polynucleotide
taatacgactcactatagggaggaggaggtgcagagggcgatgggggtgcaacagaggagagcacccatgtcgccctctaacctggcggcagcgcaaaagatg

SEQ ID NO: 165163 - DNA, 103 bp, Artificial Sequence
  Synthetic Polynucleotide
taatacgactcactatagggtggggaccacaggaggaggtgcagagggcgaacagaggagacgccctatgcacctcctcaacctggcggcagcgcaaaagatg

SEQ ID NO: 165164 - DNA, 103 bp, Artificial Sequence
  Synthetic Polynucleotide
taatacgactcactatagggttctcctccttggggaccacaggaggaggtaacagaggagaacctccatgtgtggtcccaacctggcggcagcgcaaaagatg

SEQ ID NO: 165165 - DNA, 103 bp, Artificial Sequence
  Synthetic Polynucleotide
taatacgactcactatagggctcctcctccttctcctccttggggaccacaacagaggagagtggtcatgaaggaggagaacctggcggcagcgcaaaagatg

SEQ ID NO: 165166 - DNA, 103 bp, Artificial Sequence
  Synthetic Polynucleotide
taatacgactcactatagggctgctgcggtctcctcctccttctcctcctaacagaggagaaggaggatgaggaggaggaacctggcggcagcgcaaaagatg

SEQ ID NO: 165167 - DNA, 103 bp, Artificial Sequence
  Synthetic Polynucleotide
taatacgactcactatagggactgggggcgctgctgcggtctcctcctccaacagaggagaggaggaatggaccgcagcaacctggcggcagcgcaaaagatg

SEQ ID NO: 165168 - DNA, 103 bp, Artificial Sequence
  Synthetic Polynucleotide
taatacgactcactatagggtgagtgggactctggccgcaggtggagctcaacagaggagagagctcatgctgcggccaaacctggcggcagcgcaaaagatg

SEQ ID NO: 165169 - DNA, 103 bp, Artificial Sequence
  Synthetic Polynucleotide
taatacgactcactatagggcccctcctccactgggggcgctgctgcggtaacagaggagaaccgcaatggcgcccccaaacctggcggcagcgcaaaagatg

SEQ ID NO: 165170 - DNA, 103 bp, Artificial Sequence
  Synthetic Polynucleotide
taatacgactcactatagggtctgctcctccccctcctccactgggggcgaacagaggagacgccccatgtggaggaggaacctggcggcagcgcaaaagatg

SEQ ID NO: 165171 - DNA, 103 bp, Artificial Sequence
  Synthetic Polynucleotide
taatacgactcactataggggcggggggcttctgctcctccccctcctccaacagaggagaggaggaatgggaggagcaaacctggcggcagcgcaaaagatg

SEQ ID NO: 165172 - DNA, 103 bp, Artificial Sequence
  Synthetic Polynucleotide
taatacgactcactatagggctcctcagccgcggggggcttctgctcctcaacagaggagagaggagatgaagccccccaacctggcggcagcgcaaaagatg

SEQ ID NO: 165173 - DNA, 103 bp, Artificial Sequence
  Synthetic Polynucleotide
taatacgactcactatagggccactgccagctcctcagccgcggggggctaacagaggagaagccccatgcggctgaggaacctggcggcagcgcaaaagatg

SEQ ID NO: 165174 - DNA, 103 bp, Artificial Sequence
  Synthetic Polynucleotide
taatacgactcactatagggttccctgtgtccactgccagctcctcagccaacagaggagaggctgaatggctggcagtaacctggcggcagcgcaaaagatg

SEQ ID NO: 165175 - DNA, 103 bp, Artificial Sequence
  Synthetic Polynucleotide
taatacgactcactatagggctcctcggccttccctgtgtccactgccagaacagaggagactggcaatggacacagggaacctggcggcagcgcaaaagatg

SEQ ID NO: 165176 - DNA, 103 bp, Artificial Sequence
  Synthetic Polynucleotide
taatacgactcactatagggtcttgacgggctcctcggccttccctgtgtaacagaggagaacacagatgaggccgaggaacctggcggcagcgcaaaagatg

SEQ ID NO: 165177 - DNA, 103 bp, Artificial Sequence
  Synthetic Polynucleotide
taatacgactcactataggggtgcactcgctcttgacgggctcctcggccaacagaggagaggccgaatggcccgtcaaaacctggcggcagcgcaaaagatg

SEQ ID NO: 165178 - DNA, 103 bp, Artificial Sequence
  Synthetic Polynucleotide
taatacgactcactatagggggcttcctccgtgcactcgctcttgacgggaacagaggagacccgtcatgagcgagtgcaacctggcggcagcgcaaaagatg

SEQ ID NO: 165179 - DNA, 103 bp, Artificial Sequence
  Synthetic Polynucleotide
taatacgactcactatagggcgggcaggtatgagtgggactctggccgcaaacagaggagatgcggcatgagtcccactaacctggcggcagcgcaaaagatg

SEQ ID NO: 165180 - DNA, 103 bp, Artificial Sequence
  Synthetic Polynucleotide
taatacgactcactataggggcccctcctcggcttcctccgtgcactcgcaacagaggagagcgagtatgcggaggaagaacctggcggcagcgcaaaagatg

SEQ ID NO: 165181 - DNA, 103 bp, Artificial Sequence
  Synthetic Polynucleotide
taatacgactcactatagggcccttggccggcccctcctcggcttcctccaacagaggagaggaggaatgcgaggagggaacctggcggcagcgcaaaagatg

SEQ ID NO: 165182 - DNA, 103 bp, Artificial Sequence
  Synthetic Polynucleotide
taatacgactcactatagggcgcgtccttgcccttggccggcccctcctcaacagaggagagaggagatgccggccaagaacctggcggcagcgcaaaagatg

SEQ ID NO: 165183 - DNA, 103 bp, Artificial Sequence
  Synthetic Polynucleotide
taatacgactcactatagggcagcggcctccgcgtccttgcccttggccgaacagaggagacggccaatggcaaggacgaacctggcggcagcgcaaaagatg

SEQ ID NO: 165184 - DNA, 103 bp, Artificial Sequence
  Synthetic Polynucleotide
taatacgactcactataggggccgtggcctcagcggcctccgcgtccttgaacagaggagacaaggaatgggaggccgcaacctggcggcagcgcaaaagatg

SEQ ID NO: 165185 - DNA, 103 bp, Artificial Sequence
  Synthetic Polynucleotide
taatacgactcactatagggcgccccctcggccgtggcctcagcggcctcaacagaggagagaggccatggaggccacgaacctggcggcagcgcaaaagatg

SEQ ID NO: 165186 - DNA, 103 bp, Artificial Sequence
  Synthetic Polynucleotide
taatacgactcactatagggctgccttgagcgccccctcggccgtggcctaacagaggagaaggccaatgccgagggggaacctggcggcagcgcaaaagatg

SEQ ID NO: 165187 - DNA, 103 bp, Artificial Sequence
  Synthetic Polynucleotide
taatacgactcactatagggtccttcttctctgccttgagcgccccctcgaacagaggagacgagggatggctcaaggcaacctggcggcagcgcaaaagatg

SEQ ID NO: 165188 - DNA, 103 bp, Artificial Sequence
  Synthetic Polynucleotide
taatacgactcactataggggctcccgccctccttcttctctgccttgagaacagaggagactcaagatggagaagaagaacctggcggcagcgcaaaagatg

SEQ ID NO: 165189 - DNA, 103 bp, Artificial Sequence
  Synthetic Polynucleotide
taatacgactcactatagggtggccctgccgctcccgccctccttcttctaacagaggagaagaagaatgagggcgggaaacctggcggcagcgcaaaagatg

SEQ ID NO: 165190 - DNA, 103 bp, Artificial Sequence
  Synthetic Polynucleotide
taatacgactcactatagggttccccagctcgggcaggtatgagtgggacaacagaggagagtcccaatgatacctgccaacctggcggcagcgcaaaagatg

SEQ ID NO: 165191 - DNA, 103 bp, Artificial Sequence
  Synthetic Polynucleotide
taatacgactcactatagggttggctgtggtggccctgccgctcccgcccaacagaggagagggcggatgcggcagggcaacctggcggcagcgcaaaagatg

SEQ ID NO: 165192 - DNA, 103 bp, Artificial Sequence
  Synthetic Polynucleotide
taatacgactcactataggggcccgagctcttggctgtggtggccctgccaacagaggagaggcaggatgaccacagccaacctggcggcagcgcaaaagatg

SEQ ID NO: 165193 - DNA, 103 bp, Artificial Sequence
  Synthetic Polynucleotide
taatacgactcactatagggcctggggggcgcccgagctcttggctgtggaacagaggagaccacagatgagagctcggaacctggcggcagcgcaaaagatg

SEQ ID NO: 165194 - DNA, 103 bp, Artificial Sequence
  Synthetic Polynucleotide
taatacgactcactataggggagtcgctgtcctggggggcgcccgagctcaacagaggagagagctcatgcgccccccaaacctggcggcagcgcaaaagatg

SEQ ID NO: 165195 - DNA, 103 bp, Artificial Sequence
  Synthetic Polynucleotide
taatacgactcactatagggggtagcactggagtcgctgtcctggggggcaacagaggagagcccccatggacagcgacaacctggcggcagcgcaaaagatg

SEQ ID NO: 165196 - DNA, 103 bp, Artificial Sequence
  Synthetic Polynucleotide
taatacgactcactatagggctgcactgcaggtagcactggagtcgctgtaacagaggagaacagcgatgccagtgctaaacctggcggcagcgcaaaagatg

SEQ ID NO: 165197 - DNA, 103 bp, Artificial Sequence
  Synthetic Polynucleotide
taatacgactcactatagggtccacctcgtctgcactgcaggtagcactgaacagaggagacagtgcatgctgcagtgcaacctggcggcagcgcaaaagatg

SEQ ID NO: 165198 - DNA, 103 bp, Artificial Sequence
  Synthetic Polynucleotide
taatacgactcactatagggctcggcctcatccacctcgtctgcactgcaaacagaggagatgcagtatggacgaggtgaacctggcggcagcgcaaaagatg

SEQ ID NO: 165199 - DNA, 103 bp, Artificial Sequence
  Synthetic Polynucleotide
taatacgactcactatagggtgtcgccgccctcggcctcatccacctcgtaacagaggagaacgaggatgatgaggccgaacctggcggcagcgcaaaagatg

SEQ ID NO: 165200 - DNA, 103 bp, Artificial Sequence
  Synthetic Polynucleotide
taatacgactcactatagggagccggttcttgtcgccgccctcggcctcaaacagaggagatgaggcatggggcggcgaaacctggcggcagcgcaaaagatg

SEQ ID NO: 165201 - DNA, 103 bp, Artificial Sequence
  Synthetic Polynucleotide
taatacgactcactatagggcatctctgacttccccagctcgggcaggtaaacagaggagatacctgatggagctggggaacctggcggcagcgcaaaagatg

SEQ ID NO: 165202 - DNA, 103 bp, Artificial Sequence
  Synthetic Polynucleotide
taatacgactcactatagggtggggacagcagccggttcttgtcgccgccaacagaggagaggcggcatgaagaaccggaacctggcggcagcgcaaaagatg

SEQ ID NO: 165203 - DNA, 103 bp, Artificial Sequence
  Synthetic Polynucleotide
taatacgactcactatagggggctgggccttggggacagcagccggttctaacagaggagaagaaccatgtgctgtcccaacctggcggcagcgcaaaagatg

SEQ ID NO: 165204 - DNA, 103 bp, Artificial Sequence
  Synthetic Polynucleotide
taatacgactcactatagggggggtgaggaggctgggccttggggacagcaacagaggagagctgtcatgaaggcccagaacctggcggcagcgcaaaagatg

SEQ ID NO: 165205 - DNA, 103 bp, Artificial Sequence
  Synthetic Polynucleotide
taatacgactcactataggggtcgccagtcggggtgaggaggctgggcctaacagaggagaaggcccatgctcctcaccaacctggcggcagcgcaaaagatg

SEQ ID NO: 165206 - DNA, 103 bp, Artificial Sequence
  Synthetic Polynucleotide
taatacgactcactatagggtggcccgggggtcgccagtcggggtgaggaaacagaggagatcctcaatgcgactggcgaacctggcggcagcgcaaaagatg

SEQ ID NO: 165207 - DNA, 103 bp, Artificial Sequence
  Synthetic Polynucleotide
taatacgactcactatagggggtgaggcattggcccgggggtcgccagtcaacagaggagagactggatgcccccgggcaacctggcggcagcgcaaaagatg

SEQ ID NO: 165208 - DNA, 103 bp, Artificial Sequence
  Synthetic Polynucleotide
taatacgactcactatagggtggcttctggggtgaggcattggcccggggaacagaggagaccccggatgaatgcctcaaacctggcggcagcgcaaaagatg

SEQ ID NO: 165209 - DNA, 103 bp, Artificial Sequence
  Synthetic Polynucleotide
taatacgactcactatagggtcaggtccagtggcttctggggtgaggcataacagaggagaatgcctatgcccagaagcaacctggcggcagcgcaaaagatg

SEQ ID NO: 165210 - DNA, 103 bp, Artificial Sequence
  Synthetic Polynucleotide
taatacgactcactatagggttcagctgcttcaggtccagtggcttctggaacagaggagaccagaaatgactggacctaacctggcggcagcgcaaaagatg

SEQ ID NO: 165211 - DNA, 103 bp, Artificial Sequence
  Synthetic Polynucleotide
taatacgactcactatagggcgctcgctgcttcagctgcttcaggtccagaacagaggagactggacatgaagcagctgaacctggcggcagcgcaaaagatg

SEQ ID NO: 165212 - DNA, 103 bp, Artificial Sequence
  Synthetic Polynucleotide
taatacgactcactatagggcaatgaactccatctctgacttccccagctaacagaggagaagctggatgagtcagagaaacctggcggcagcgcaaaagatg

SEQ ID NO: 165213 - DNA, 103 bp, Artificial Sequence
  Synthetic Polynucleotide
taatacgactcactatagggggatggcagccgctcgctgcttcagctgctaacagaggagaagcagcatgagcagcgagaacctggcggcagcgcaaaagatg

SEQ ID NO: 165214 - DNA, 103 bp, Artificial Sequence
  Synthetic Polynucleotide
taatacgactcactatagggtggatgggggggatggcagccgctcgctgcaacagaggagagcagcgatgggctgccataacctggcggcagcgcaaaagatg

SEQ ID NO: 165215 - DNA, 103 bp, Artificial Sequence
  Synthetic Polynucleotide
taatacgactcactatagggtttggtgacctggatgggggggatggcagcaacagaggagagctgccatgccccccatcaacctggcggcagcgcaaaagatg

SEQ ID NO: 165216 - DNA, 103 bp, Artificial Sequence
  Synthetic Polynucleotide
taatacgactcactataggggctcatggactttggtgacctggatgggggaacagaggagacccccaatgaggtcaccaaacctggcggcagcgcaaaagatg

SEQ ID NO: 165217 - DNA, 103 bp, Artificial Sequence
  Synthetic Polynucleotide
taatacgactcactatagggtcccgggggggctcatggactttggtgaccaacagaggagaggtcacatgagtccatgaaacctggcggcagcgcaaaagatg

SEQ ID NO: 165218 - DNA, 103 bp, Artificial Sequence
  Synthetic Polynucleotide
taatacgactcactatagggagctgcgtcctcccgggggggctcatggacaacagaggagagtccatatgcccccccggaacctggcggcagcgcaaaagatg

SEQ ID NO: 165219 - DNA, 103 bp, Artificial Sequence
  Synthetic Polynucleotide
taatacgactcactataggggcttggtgggagctgcgtcctcccggggggaacagaggagaccccccatgaggacgcagaacctggcggcagcgcaaaagatg

SEQ ID NO: 165220 - DNA, 103 bp, Artificial Sequence
  Synthetic Polynucleotide
taatacgactcactataggggggggagctggcttggtgggagctgcgtccaacagaggagaggacgcatgtcccaccaaaacctggcggcagcgcaaaagatg

SEQ ID NO: 165221 - DNA, 103 bp, Artificial Sequence
  Synthetic Polynucleotide
taatacgactcactatagggcggtggggctgggggagctggcttggtgggaacagaggagacccaccatgccagctcccaacctggcggcagcgcaaaagatg

SEQ ID NO: 165222 - DNA, 103 bp, Artificial Sequence
  Synthetic Polynucleotide
taatacgactcactatagggtttgcggtggcggtggggctgggggagctgaacagaggagacagctcatgcagccccacaacctggcggcagcgcaaaagatg

SEQ ID NO: 165223 - DNA, 103 bp, Artificial Sequence
  Synthetic Polynucleotide
taatacgactcactatagggggctcagtggccctccacgtctgtgccacaaacagaggagatgtggcatggacgtggagaacctggcggcagcgcaaaagatg

SEQ ID NO: 165224 - DNA, 103 bp, Artificial Sequence
  Synthetic Polynucleotide
taatacgactcactatagggcgcttgctttcaatgaactccatctctgacaacagaggagagtcagaatgggagttcataacctggcggcagcgcaaaagatg

SEQ ID NO: 165225 - DNA, 103 bp, Artificial Sequence
  Synthetic Polynucleotide
taatacgactcactatagggggctgcaggttttgcggtggcggtggggctaacagaggagaagccccatggccaccgcaaacctggcggcagcgcaaaagatg

SEQ ID NO: 165226 - DNA, 103 bp, Artificial Sequence
  Synthetic Polynucleotide
taatacgactcactataggggtcgctctccggctgcaggttttgcggtggaacagaggagaccaccgatgaacctgcagaacctggcggcagcgcaaaagatg

SEQ ID NO: 165227 - DNA, 103 bp, Artificial Sequence
  Synthetic Polynucleotide
taatacgactcactataggggctgaggggcgtcgctctccggctgcaggtaacagaggagaacctgcatgcggagagcgaacctggcggcagcgcaaaagatg

SEQ ID NO: 165228 - DNA, 103 bp, Artificial Sequence
  Synthetic Polynucleotide
taatacgactcactatagggctgccaggctgctgaggggcgtcgctctccaacagaggagaggagagatgcgcccctcaaacctggcggcagcgcaaaagatg

SEQ ID NO: 165229 - DNA, 103 bp, Artificial Sequence
  Synthetic Polynucleotide
taatacgactcactatagggccgggggctgctgccaggctgctgaggggcaacagaggagagcccctatgcagcctggcaacctggcggcagcgcaaaagatg

SEQ ID NO: 165230 - DNA, 103 bp, Artificial Sequence
  Synthetic Polynucleotide
taatacgactcactatagggtgctcttgccccgggggctgctgccaggctaacagaggagaagcctgatggcagcccccaacctggcggcagcgcaaaagatg

SEQ ID NO: 165231 - DNA, 103 bp, Artificial Sequence
  Synthetic Polynucleotide
taatacgactcactataggggccgggctcctgctcttgccccgggggctgaacagaggagacagcccatggggcaagagaacctggcggcagcgcaaaagatg

SEQ ID NO: 165232 - DNA, 103 bp, Artificial Sequence
  Synthetic Polynucleotide
taatacgactcactatagggggcggggggtgccgggctcctgctcttgccaacagaggagaggcaagatgaggagcccgaacctggcggcagcgcaaaagatg

SEQ ID NO: 165233 - DNA, 103 bp, Artificial Sequence
  Synthetic Polynucleotide
taatacgactcactatagggcctccttgtcggcggggggtgccgggctccaacagaggagaggagccatgcaccccccgaacctggcggcagcgcaaaagatg

SEQ ID NO: 165234 - DNA, 103 bp, Artificial Sequence
  Synthetic Polynucleotide
taatacgactcactataggggctgcgaaggcctccttgtcggcggggggtaacagaggagaacccccatgcgacaaggaaacctggcggcagcgcaaaagatg

SEQ ID NO: 165235 - DNA, 103 bp, Artificial Sequence
  Synthetic Polynucleotide
taatacgactcactatagggtagccgagggcgcttgctttcaatgaactcaacagaggagagagttcatggaaagcaagaacctggcggcagcgcaaaagatg

SEQ ID NO: 165236 - DNA, 103 bp, Artificial Sequence
  Synthetic Polynucleotide
taatacgactcactatagggctgggcctcggctgcgaaggcctccttgtcaacagaggagagacaagatggccttcgcaaacctggcggcagcgcaaaagatg

SEQ ID NO: 165237 - DNA, 103 bp, Artificial Sequence
  Synthetic Polynucleotide
taatacgactcactatagggcaggcagcttctgggcctcggctgcgaaggaacagaggagaccttcgatgccgaggcccaacctggcggcagcgcaaaagatg

SEQ ID NO: 165238 - DNA, 103 bp, Artificial Sequence
  Synthetic Polynucleotide
taatacgactcactatagggggggggtccccaggcagcttctgggcctcgaacagaggagacgaggcatggaagctgccaacctggcggcagcgcaaaagatg

SEQ ID NO: 165239 - DNA, 103 bp, Artificial Sequence
  Synthetic Polynucleotide
taatacgactcactatagggagtccagcaaggggggtccccaggcagcttaacagaggagaaagctgatgggggaccccaacctggcggcagcgcaaaagatg

SEQ ID NO: 165240 - DNA, 103 bp, Artificial Sequence
  Synthetic Polynucleotide
taatacgactcactataggggcaggccggaagtccagcaaggggggtcccaacagaggagagggaccatgcttgctggaaacctggcggcagcgcaaaagatg

SEQ ID NO: 165241 - DNA, 103 bp, Artificial Sequence
  Synthetic Polynucleotide
taatacgactcactatagggacggggaagggcaggccggaagtccagcaaaacagaggagattgctgatgttccggcctaacctggcggcagcgcaaaagatg

SEQ ID NO: 165242 - DNA, 103 bp, Artificial Sequence
  Synthetic Polynucleotide
taatacgactcactatagggacgggggggcacggggaagggcaggccggaaacagaggagatccggcatgcccttccccaacctggcggcagcgcaaaagatg

SEQ ID NO: 165243 - DNA, 103 bp, Artificial Sequence
  Synthetic Polynucleotide
taatacgactcactatagggtgatcacctcacgggggggcacggggaaggaacagaggagaccttccatgtgcccccccaacctggcggcagcgcaaaagatg

SEQ ID NO: 165244 - DNA, 103 bp, Artificial Sequence
  Synthetic Polynucleotide
taatacgactcactatagggggggaggccttgatcacctcacgggggggcaacagaggagagcccccatgtgaggtgataacctggcggcagcgcaaaagatg

SEQ ID NO: 165245 - DNA, 103 bp, Artificial Sequence
  Synthetic Polynucleotide
taatacgactcactatagggcggggcatgcggggaggccttgatcacctcaacagaggagagaggtgatgaaggcctccaacctggcggcagcgcaaaagatg

SEQ ID NO: 165246 - DNA, 103 bp, Artificial Sequence
  Synthetic Polynucleotide
taatacgactcactataggggcagcagctctagccgagggcgcttgctttaacagaggagaaaagcaatggccctcggcaacctggcggcagcgcaaaagatg

SEQ ID NO: 165247 - DNA, 103 bp, Artificial Sequence
  Synthetic Polynucleotide
taatacgactcactatagggctgaggggtccggggcatgcggggaggcctaacagaggagaaggcctatgcgcatgcccaacctggcggcagcgcaaaagatg

SEQ ID NO: 165248 - DNA, 103 bp, Artificial Sequence
  Synthetic Polynucleotide
taatacgactcactatagggtaggagaaggctgaggggtccggggcatgcaacagaggagagcatgcatgggacccctcaacctggcggcagcgcaaaagatg

SEQ ID NO: 165249 - DNA, 103 bp, Artificial Sequence
  Synthetic Polynucleotide
taatacgactcactatagggaggtggagcgtaggagaaggctgaggggtcaacagaggagagaccccatggccttctccaacctggcggcagcgcaaaagatg

SEQ ID NO: 165250 - DNA, 103 bp, Artificial Sequence
  Synthetic Polynucleotide
taatacgactcactataggggtgggtgaccaggtggagcgtaggagaaggaacagaggagaccttctatgacgctccacaacctggcggcagcgcaaaagatg

SEQ ID NO: 165251 - DNA, 103 bp, Artificial Sequence
  Synthetic Polynucleotide
taatacgactcactatagggcccaggggcagtgggtgaccaggtggagcgaacagaggagacgctccatgtggtcacccaacctggcggcagcgcaaaagatg

SEQ ID NO: 165252 - DNA, 103 bp, Artificial Sequence
  Synthetic Polynucleotide
taatacgactcactataggggtcatggaggcccaggggcagtgggtgaccaacagaggagaggtcacatgctgcccctgaacctggcggcagcgcaaaagatg

SEQ ID NO: 165253 - DNA, 103 bp, Artificial Sequence
  Synthetic Polynucleotide
taatacgactcactataggggccgggcagtgtcatggaggcccaggggcaaacagaggagatgccccatggcctccatgaacctggcggcagcgcaaaagatg

SEQ ID NO: 165254 - DNA, 103 bp, Artificial Sequence
  Synthetic Polynucleotide
taatacgactcactatagggggcaggacgggccgggcagtgtcatggaggaacagaggagacctccaatgcactgcccgaacctggcggcagcgcaaaagatg

SEQ ID NO: 165255 - DNA, 103 bp, Artificial Sequence
  Synthetic Polynucleotide
taatacgactcactataggggggtgggcgcggcaggacgggccgggcagtaacagaggagaactgccatgcccgtcctgaacctggcggcagcgcaaaagatg

SEQ ID NO: 165256 - DNA, 103 bp, Artificial Sequence
  Synthetic Polynucleotide
taatacgactcactatagggtggagatggtgggtgggcgcggcaggacggaacagaggagaccgtccatgcgcgcccacaacctggcggcagcgcaaaagatg

SEQ ID NO: 165257 - DNA, 103 bp, Artificial Sequence
  Synthetic Polynucleotide
taatacgactcactatagggagggggtcaggcagcagctctagccgagggaacagaggagaccctcgatgagagctgctaacctggcggcagcgcaaaagatg

SEQ ID NO: 165258 - DNA, 103 bp, Artificial Sequence
  Synthetic Polynucleotide
taatacgactcactatagggggaggcgggttggagatggtgggtgggcgcaacagaggagagcgcccatgcaccatctcaacctggcggcagcgcaaaagatg

SEQ ID NO: 165259 - DNA, 103 bp, Artificial Sequence
  Synthetic Polynucleotide
taatacgactcactatagggggagatgaggggaggcgggttggagatggtaacagaggagaaccatcatgaacccgcctaacctggcggcagcgcaaaagatg

SEQ ID NO: 165260 - DNA, 103 bp, Artificial Sequence
  Synthetic Polynucleotide
taatacgactcactataggggcttggcagaggagatgaggggaggcgggtaacagaggagaacccgcatgccctcatctaacctggcggcagcgcaaaagatg

SEQ ID NO: 165261 - DNA, 103 bp, Artificial Sequence
  Synthetic Polynucleotide
taatacgactcactatagggacgctggggtgcttggcagaggagatgaggaacagaggagacctcatatgctctgccaaaacctggcggcagcgcaaaagatg

SEQ ID NO: 165262 - DNA, 103 bp, Artificial Sequence
  Synthetic Polynucleotide
taatacgactcactatagggcctctcgaggacgctggggtgcttggcagaaacagaggagatctgccatgcaccccagcaacctggcggcagcgcaaaagatg

SEQ ID NO: 165263 - DNA, 103 bp, Artificial Sequence
  Synthetic Polynucleotide
taatacgactcactatagggcacctatttgcctctcgaggacgctggggtaacagaggagaaccccaatgtcctcgagaaacctggcggcagcgcaaaagatg

SEQ ID NO: 165264 - DNA, 103 bp, Artificial Sequence
  Synthetic Polynucleotide
taatacgactcactatagggtgggagatggcacctatttgcctctcgaggaacagaggagacctcgaatggcaaataggaacctggcggcagcgcaaaagatg

SEQ ID NO: 165265 - DNA, 103 bp, Artificial Sequence
  Synthetic Polynucleotide
taatacgactcactatagggcgacattccttgggagatggcacctatttgaacagaggagacaaataatggccatctccaacctggcggcagcgcaaaagatg

SEQ ID NO: 165266 - DNA, 103 bp, Artificial Sequence
  Synthetic Polynucleotide
taatacgactcactatagggggagctggaccgacattccttgggagatggaacagaggagaccatctatgaaggaatgtaacctggcggcagcgcaaaagatg

SEQ ID NO: 165267 - DNA, 103 bp, Artificial Sequence
  Synthetic Polynucleotide
taatacgactcactatagggtacgggacgtggagctggaccgacattcctaacagaggagaaggaatatgggtccagctaacctggcggcagcgcaaaagatg

SEQ ID NO: 165268 - DNA, 103 bp, Artificial Sequence
  Synthetic Polynucleotide
taatacgactcactatagggcggtcgcagcagggggtcaggcagcagctcaacagaggagagagctgatgcctgaccccaacctggcggcagcgcaaaagatg

SEQ ID NO: 165269 - DNA, 103 bp, Artificial Sequence
  Synthetic Polynucleotide
taatacgactcactatagggatgctctgagtacgggacgtggagctggacaacagaggagagtccagatgcacgtcccgaacctggcggcagcgcaaaagatg

SEQ ID NO: 165270 - DNA, 103 bp, Artificial Sequence
  Synthetic Polynucleotide
taatacgactcactataggggggccttggcatgctctgagtacgggacgtaacagaggagaacgtccatgactcagagcaacctggcggcagcgcaaaagatg

SEQ ID NO: 165271 - DNA, 103 bp, Artificial Sequence
  Synthetic Polynucleotide
taatacgactcactataggggggcccaccggggccttggcatgctctgagaacagaggagactcagaatgtgccaaggcaacctggcggcagcgcaaaagatg

SEQ ID NO: 165272 - DNA, 103 bp, Artificial Sequence
  Synthetic Polynucleotide
taatacgactcactatagggcatggtgacagggcccaccggggccttggcaacagaggagagccaagatgccggtgggcaacctggcggcagcgcaaaagatg

SEQ ID NO: 165273 - DNA, 103 bp, Artificial Sequence
  Synthetic Polynucleotide
taatacgactcactatagggggggcagccccatggtgacagggcccaccgaacagaggagacggtggatgctgtcaccaaacctggcggcagcgcaaaagatg

SEQ ID NO: 165274 - DNA, 103 bp, Artificial Sequence
  Synthetic Polynucleotide
taatacgactcactatagggtccatgggcaggggcagccccatggtgacaaacagaggagatgtcacatgggggctgccaacctggcggcagcgcaaaagatg

SEQ ID NO: 165275 - DNA, 103 bp, Artificial Sequence
  Synthetic Polynucleotide
taatacgactcactatagggctttttggggtccatgggcaggggcagcccaacagaggagagggctgatgctgcccatgaacctggcggcagcgcaaaagatg

SEQ ID NO: 165276 - DNA, 103 bp, Artificial Sequence
  Synthetic Polynucleotide
taatacgactcactatagggagggtgccagctttttggggtccatgggcaaacagaggagatgcccaatgaccccaaaaaacctggcggcagcgcaaaagatg

SEQ ID NO: 165277 - DNA, 103 bp, Artificial Sequence
  Synthetic Polynucleotide
taatacgactcactatagggactccgctgaagggtgccagctttttggggaacagaggagaccccaaatggctggcaccaacctggcggcagcgcaaaagatg

SEQ ID NO: 165278 - DNA, 103 bp, Artificial Sequence
  Synthetic Polynucleotide
taatacgactcactatagggctcctgcttcactccgctgaagggtgccagaacagaggagactggcaatgttcagcggaaacctggcggcagcgcaaaagatg

SEQ ID NO: 165279 - DNA, 103 bp, Artificial Sequence
  Synthetic Polynucleotide
taatacgactcactataggggcaggggtgacggtcgcagcagggggtcagaacagaggagactgaccatgtgctgcgacaacctggcggcagcgcaaaagatg

SEQ ID NO: 165280 - DNA, 103 bp, Artificial Sequence
  Synthetic Polynucleotide
taatacgactcactataggggggacagctgctcctgcttcactccgctgaaacagaggagatcagcgatgtgaagcaggaacctggcggcagcgcaaaagatg

SEQ ID NO: 165281 - DNA, 103 bp, Artificial Sequence
  Synthetic Polynucleotide
taatacgactcactatagggtggccccgtggggacagctgctcctgcttcaacagaggagagaagcaatggcagctgtcaacctggcggcagcgcaaaagatg

SEQ ID NO: 165282 - DNA, 103 bp, Artificial Sequence
  Synthetic Polynucleotide
taatacgactcactatagggtggcccagcctggccccgtggggacagctgaacagaggagacagctgatgccacggggcaacctggcggcagcgcaaaagatg

SEQ ID NO: 165283 - DNA, 103 bp, Artificial Sequence
  Synthetic Polynucleotide
taatacgactcactatagggggctctccggtggcccagcctggccccgtgaacagaggagacacgggatgaggctgggcaacctggcggcagcgcaaaagatg

SEQ ID NO: 165284 - DNA, 103 bp, Artificial Sequence
  Synthetic Polynucleotide
taatacgactcactatagggggcacccccaggctctccggtggcccagccaacagaggagaggctggatgaccggagagaacctggcggcagcgcaaaagatg

SEQ ID NO: 165285 - DNA, 103 bp, Artificial Sequence
  Synthetic Polynucleotide
taatacgactcactatagggctgggctgtgggcacccccaggctctccggaacagaggagaccggagatgctgggggtgaacctggcggcagcgcaaaagatg

SEQ ID NO: 165286 - DNA, 103 bp, Artificial Sequence
  Synthetic Polynucleotide
taatacgactcactatagggcggacgcctcctgggctgtgggcacccccaaacagaggagatgggggatgccacagcccaacctggcggcagcgcaaaagatg

SEQ ID NO: 165287 - DNA, 103 bp, Artificial Sequence
  Synthetic Polynucleotide
taatacgactcactatagggcctctcagcacggacgcctcctgggctgtgaacagaggagacacagcatgggaggcgtcaacctggcggcagcgcaaaagatg

SEQ ID NO: 165288 - DNA, 103 bp, Artificial Sequence
  Synthetic Polynucleotide
taatacgactcactatagggcagagctgtccctctcagcacggacgcctcaacagaggagagaggcgatggtgctgagaaacctggcggcagcgcaaaagatg

SEQ ID NO: 165289 - DNA, 103 bp, Artificial Sequence
  Synthetic Polynucleotide
taatacgactcactataggggaactgagcccagagctgtccctctcagcaaacagaggagatgctgaatgggacagctcaacctggcggcagcgcaaaagatg

SEQ ID NO: 165290 - DNA, 103 bp, Artificial Sequence
  Synthetic Polynucleotide
taatacgactcactatagggcccgtggccagcaggggtgacggtcgcagcaacagaggagagctgcgatggtcacccctaacctggcggcagcgcaaaagatg

SEQ ID NO: 165291 - DNA, 103 bp, Artificial Sequence
  Synthetic Polynucleotide
taatacgactcactatagggcttccgcccggaactgagcccagagctgtcaacagaggagagacagcatggggctcagtaacctggcggcagcgcaaaagatg

SEQ ID NO: 165292 - DNA, 103 bp, Artificial Sequence
  Synthetic Polynucleotide
taatacgactcactatagggtttggtgatgcttccgcccggaactgagccaacagaggagaggctcaatgccgggcggaaacctggcggcagcgcaaaagatg

SEQ ID NO: 165293 - DNA, 103 bp, Artificial Sequence
  Synthetic Polynucleotide
taatacgactcactatagggtgggaatgcctttggtgatgcttccgcccgaacagaggagacgggcgatggcatcaccaaacctggcggcagcgcaaaagatg

SEQ ID NO: 165294 - DNA, 103 bp, Artificial Sequence
  Synthetic Polynucleotide
taatacgactcactatagggacccgtgtgctgggaatgcctttggtgatgaacagaggagacatcacatgaggcattccaacctggcggcagcgcaaaagatg

SEQ ID NO: 165295 - DNA, 103 bp, Artificial Sequence
  Synthetic Polynucleotide
taatacgactcactataggggtccgagggcacccgtgtgctgggaatgccaacagaggagaggcattatgagcacacggaacctggcggcagcgcaaaagatg

SEQ ID NO: 165296 - DNA, 103 bp, Artificial Sequence
  Synthetic Polynucleotide
taatacgactcactatagggtgatggcgctgtccgagggcacccgtgtgcaacagaggagagcacacatgtgccctcggaacctggcggcagcgcaaaagatg

SEQ ID NO: 165297 - DNA, 103 bp, Artificial Sequence
  Synthetic Polynucleotide
taatacgactcactatagggccgcggtatgtgatggcgctgtccgagggcaacagaggagagccctcatgcagcgccataacctggcggcagcgcaaaagatg

SEQ ID NO: 165298 - DNA, 103 bp, Artificial Sequence
  Synthetic Polynucleotide
taatacgactcactatagggggtgatggagccgcggtatgtgatggcgctaacagaggagaagcgccatgacataccgcaacctggcggcagcgcaaaagatg

SEQ ID NO: 165299 - DNA, 103 bp, Artificial Sequence
  Synthetic Polynucleotide
taatacgactcactataggggcgtgccgtgggtgatggagccgcggtatgaacagaggagacataccatggctccatcaaacctggcggcagcgcaaaagatg

SEQ ID NO: 165300 - DNA, 103 bp, Artificial Sequence
  Synthetic Polynucleotide
taatacgactcactatagggacgtcagctggcgtgccgtgggtgatggagaacagaggagactccatatgccacggcacaacctggcggcagcgcaaaagatg

SEQ ID NO: 165301 - DNA, 103 bp, Artificial Sequence
  Synthetic Polynucleotide
taatacgactcactatagggcgcaggctggcccgtggccagcaggggtgaaacagaggagatcacccatgctggccacgaacctggcggcagcgcaaaagatg

SEQ ID NO: 165302 - DNA, 103 bp, Artificial Sequence
  Synthetic Polynucleotide
taatacgactcactatagggcttgtacaggacgtcagctggcgtgccgtgaacagaggagacacggcatgccagctgacaacctggcggcagcgcaaaagatg

SEQ ID NO: 165303 - DNA, 103 bp, Artificial Sequence
  Synthetic Polynucleotide
taatacgactcactatagggtgatggtgcccttgtacaggacgtcagctgaacagaggagacagctgatgtcctgtacaaacctggcggcagcgcaaaagatg

SEQ ID NO: 165304 - DNA, 103 bp, Artificial Sequence
  Synthetic Polynucleotide
taatacgactcactatagggatgatcctggtgatggtgcccttgtacaggaacagaggagacctgtaatggggcaccataacctggcggcagcgcaaaagatg

SEQ ID NO: 165305 - DNA, 103 bp, Artificial Sequence
  Synthetic Polynucleotide
taatacgactcactataggggtcctcgccgatgatcctggtgatggtgccaacagaggagaggcaccatgaccaggatcaacctggcggcagcgcaaaagatg

SEQ ID NO: 165306 - DNA, 103 bp, Artificial Sequence
  Synthetic Polynucleotide
taatacgactcactataggggactcgggctgtcctcgccgatgatcctggaacagaggagaccaggaatgtcggcgaggaacctggcggcagcgcaaaagatg

SEQ ID NO: 165307 - DNA, 103 bp, Artificial Sequence
  Synthetic Polynucleotide
taatacgactcactatagggcggtccaagcgactcgggctgtcctcgccgaacagaggagacggcgaatgcagcccgagaacctggcggcagcgcaaaagatg

SEQ ID NO: 165308 - DNA, 103 bp, Artificial Sequence
  Synthetic Polynucleotide
taatacgactcactatagggctcccggccgcggtccaagcgactcgggctaacagaggagaagcccgatgcgcttggacaacctggcggcagcgcaaaagatg

SEQ ID NO: 165309 - DNA, 103 bp, Artificial Sequence
  Synthetic Polynucleotide
taatacgactcactataggggcaggctgtcctcccggccgcggtccaagcaacagaggagagcttggatggcggccgggaacctggcggcagcgcaaaagatg

SEQ ID NO: 165310 - DNA, 103 bp, Artificial Sequence
  Synthetic Polynucleotide
taatacgactcactatagggtggcccttgggcaggctgtcctcccggccgaacagaggagacggccgatgggacagcctaacctggcggcagcgcaaaagatg

SEQ ID NO: 165311 - DNA, 103 bp, Artificial Sequence
  Synthetic Polynucleotide
taatacgactcactataggggtagatgacgtggcccttgggcaggctgtcaacagaggagagacagcatgcccaagggcaacctggcggcagcgcaaaagatg

SEQ ID NO: 165312 - DNA, 103 bp, Artificial Sequence
  Synthetic Polynucleotide
taatacgactcactatagggcttcagatcccgcaggctggcccgtggccaaacagaggagatggccaatggccagcctgaacctggcggcagcgcaaaagatg

SEQ ID NO: 165313 - DNA, 103 bp, Artificial Sequence
  Synthetic Polynucleotide
taatacgactcactatagggtcttgccttcgtagatgacgtggcccttggaacagaggagaccaaggatgacgtcatctaacctggcggcagcgcaaaagatg

SEQ ID NO: 165314 - DNA, 103 bp, Artificial Sequence
  Synthetic Polynucleotide
taatacgactcactatagggacgtggcccttcttgccttcgtagatgacgaacagaggagacgtcatatgcgaaggcaaaacctggcggcagcgcaaaagatg

SEQ ID NO: 165315 - DNA, 103 bp, Artificial Sequence
  Synthetic Polynucleotide
taatacgactcactatagggataggacaagacgtggcccttcttgccttcaacagaggagagaaggcatgaagggccacaacctggcggcagcgcaaaagatg

SEQ ID NO: 165316 - DNA, 103 bp, Artificial Sequence
  Synthetic Polynucleotide
taatacgactcactatagggtgccaccctcataggacaagacgtggccctaacagaggagaagggccatgtcttgtcctaacctggcggcagcgcaaaagatg

SEQ ID NO: 165317 - DNA, 103 bp, Artificial Sequence
  Synthetic Polynucleotide
taatacgactcactataggggtcacagacatgccaccctcataggacaagaacagaggagacttgtcatgtgagggtggaacctggcggcagcgcaaaagatg

SEQ ID NO: 165318 - DNA, 103 bp, Artificial Sequence
  Synthetic Polynucleotide
taatacgactcactatagggggagcactgggtcacagacatgccaccctcaacagaggagagagggtatgatgtctgtgaacctggcggcagcgcaaaagatg

SEQ ID NO: 165319 - DNA, 103 bp, Artificial Sequence
  Synthetic Polynucleotide
taatacgactcactatagggcgtcctccttggagcactgggtcacagacaaacagaggagatgtctgatgcccagtgctaacctggcggcagcgcaaaagatg

SEQ ID NO: 165320 - DNA, 103 bp, Artificial Sequence
  Synthetic Polynucleotide
taatacgactcactatagggctgcttctgccgtcctccttggagcactggaacagaggagaccagtgatgcaaggaggaaacctggcggcagcgcaaaagatg

SEQ ID NO: 165321 - DNA, 103 bp, Artificial Sequence
  Synthetic Polynucleotide
taatacgactcactataggggggtcctgagctgcttctgccgtcctccttaacagaggagaaaggagatgggcagaagcaacctggcggcagcgcaaaagatg

SEQ ID NO: 165322 - DNA, 103 bp, Artificial Sequence
  Synthetic Polynucleotide
taatacgactcactatagggtctcatgggggggtcctgagctgcttctgcaacagaggagagcagaaatggctcaggacaacctggcggcagcgcaaaagatg

SEQ ID NO: 165323 - DNA, 103 bp, Artificial Sequence
  Synthetic Polynucleotide
taatacgactcactatagggttggtgaggtcttcagatcccgcaggctggaacagaggagaccagccatggggatctgaaacctggcggcagcgcaaaagatg

SEQ ID NO: 165324 - DNA, 103 bp, Artificial Sequence
  Synthetic Polynucleotide
taatacgactcactatagggggggcggccgtctcatgggggggtcctgagaacagaggagactcaggatgcccccatgaaacctggcggcagcgcaaaagatg

SEQ ID NO: 165325 - DNA, 103 bp, Artificial Sequence
  Synthetic Polynucleotide
taatacgactcactatagggggtgcgcttgggggcggccgtctcatggggaacagaggagaccccatatgacggccgccaacctggcggcagcgcaaaagatg

SEQ ID NO: 165326 - DNA, 103 bp, Artificial Sequence
  Synthetic Polynucleotide
taatacgactcactatagggtcatgtcataggtgcgcttgggggcggccgaacagaggagacggccgatgccaagcgcaaacctggcggcagcgcaaaagatg

SEQ ID NO: 165327 - DNA, 103 bp, Artificial Sequence
  Synthetic Polynucleotide
taatacgactcactatagggcggccctccatcatgtcataggtgcgcttgaacagaggagacaagcgatgctatgacataacctggcggcagcgcaaaagatg

SEQ ID NO: 165328 - DNA, 103 bp, Artificial Sequence
  Synthetic Polynucleotide
taatacgactcactatagggtctgcccacgcggccctccatcatgtcataaacagaggagatatgacatgatggagggcaacctggcggcagcgcaaaagatg

SEQ ID NO: 165329 - DNA, 103 bp, Artificial Sequence
  Synthetic Polynucleotide
taatacgactcactatagggaggagatggctctgcccacgcggccctccaaacagaggagatggaggatggcgtgggcaaacctggcggcagcgcaaaagatg

SEQ ID NO: 165330 - DNA, 103 bp, Artificial Sequence
  Synthetic Polynucleotide
taatacgactcactatagggatgctggctgaggagatggctctgcccacgaacagaggagacgtgggatgagccatctcaacctggcggcagcgcaaaagatg

SEQ ID NO: 165331 - DNA, 103 bp, Artificial Sequence
  Synthetic Polynucleotide
taatacgactcactataggggagaccttcgatgctggctgaggagatggcaacagaggagagccatcatgtcagccagcaacctggcggcagcgcaaaagatg

SEQ ID NO: 165332 - DNA, 103 bp, Artificial Sequence
  Synthetic Polynucleotide
taatacgactcactatagggcacggcccatgagaccttcgatgctggctgaacagaggagacagccaatgtcgaaggtcaacctggcggcagcgcaaaagatg

SEQ ID NO: 165333 - DNA, 103 bp, Artificial Sequence
  Synthetic Polynucleotide
taatacgactcactatagggggcgggatggcacggcccatgagaccttcgaacagaggagacgaaggatgcatgggccgaacctggcggcagcgcaaaagatg

SEQ ID NO: 165334 - DNA, 103 bp, Artificial Sequence
  Synthetic Polynucleotide
taatacgactcactatagggcgggtagcggggctcagtggccctccacgtaacagaggagaacgtggatggccactgagaacctggcggcagcgcaaaagatg

SEQ ID NO: 165335 - DNA, 103 bp, Artificial Sequence
  Synthetic Polynucleotide
taatacgactcactataggggctacggtccttggtgaggtcttcagatccaacagaggagaggatctatggacctcaccaacctggcggcagcgcaaaagatg

SEQ ID NO: 165336 - DNA, 103 bp, Artificial Sequence
  Synthetic Polynucleotide
taatacgactcactataggggtgtcgctccggcgggatggcacggcccataacagaggagaatgggcatggccatcccgaacctggcggcagcgcaaaagatg

SEQ ID NO: 165337 - DNA, 103 bp, Artificial Sequence
  Synthetic Polynucleotide
taatacgactcactatagggggtgggggctgtgtcgctccggcgggatggaacagaggagaccatccatgcggagcgacaacctggcggcagcgcaaaagatg

SEQ ID NO: 165338 - DNA, 103 bp, Artificial Sequence
  Synthetic Polynucleotide
taatacgactcactatagggtctttgaggtggtgggggctgtgtcgctccaacagaggagaggagcgatgcagcccccaaacctggcggcagcgcaaaagatg

SEQ ID NO: 165339 - DNA, 103 bp, Artificial Sequence
  Synthetic Polynucleotide
taatacgactcactataggggtggtgctgctctttgaggtggtgggggctaacagaggagaagccccatgcacctcaaaaacctggcggcagcgcaaaagatg

SEQ ID NO: 165340 - DNA, 103 bp, Artificial Sequence
  Synthetic Polynucleotide
taatacgactcactatagggacccgcggatgtggtgctgctctttgaggtaacagaggagaacctcaatgagcagcaccaacctggcggcagcgcaaaagatg

SEQ ID NO: 165341 - DNA, 103 bp, Artificial Sequence
  Synthetic Polynucleotide
taatacgactcactatagggtgtgtgatggacccgcggatgtggtgctgcaacagaggagagcagcaatgcatccgcggaacctggcggcagcgcaaaagatg

SEQ ID NO: 165342 - DNA, 103 bp, Artificial Sequence
  Synthetic Polynucleotide
taatacgactcactatagggagggatcccttgtgtgatggacccgcggataacagaggagaatccgcatgtccatcacaaacctggcggcagcgcaaaagatg

SEQ ID NO: 165343 - DNA, 103 bp, Artificial Sequence
  Synthetic Polynucleotide
taatacgactcactatagggcgtaggaccgagggatcccttgtgtgatggaacagaggagaccatcaatgaagggatccaacctggcggcagcgcaaaagatg

SEQ ID NO: 165344 - DNA, 103 bp, Artificial Sequence
  Synthetic Polynucleotide
taatacgactcactatagggtgtgcctccacgtaggaccgagggatccctaacagaggagaagggatatgtcggtcctaaacctggcggcagcgcaaaagatg

SEQ ID NO: 165345 - DNA, 103 bp, Artificial Sequence
  Synthetic Polynucleotide
taatacgactcactataggggtagtcctcctgtgcctccacgtaggaccgaacagaggagacggtccatggtggaggcaaacctggcggcagcgcaaaagatg

SEQ ID NO: 165346 - DNA, 103 bp, Artificial Sequence
  Synthetic Polynucleotide
taatacgactcactatagggtgcccgtcaggctacggtccttggtgaggtaacagaggagaacctcaatgaggaccgtaaacctggcggcagcgcaaaagatg

SEQ ID NO: 165347 - DNA, 103 bp, Artificial Sequence
  Synthetic Polynucleotide
taatacgactcactatagggcccgacgcaggtagtcctcctgtgcctccaaacagaggagatggaggatgaggaggactaacctggcggcagcgcaaaagatg

SEQ ID NO: 165348 - DNA, 103 bp, Artificial Sequence
  Synthetic Polynucleotide
taatacgactcactatagggagcttggcctcccgacgcaggtagtcctccaacagaggagaggaggaatgcctgcgtcgaacctggcggcagcgcaaaagatg

SEQ ID NO: 165349 - DNA, 103 bp, Artificial Sequence
  Synthetic Polynucleotide
taatacgactcactatagggccgctttaggagcttggcctcccgacgcagaacagaggagactgcgtatggaggccaagaacctggcggcagcgcaaaagatg

SEQ ID NO: 165350 - DNA, 103 bp, Artificial Sequence
  Synthetic Polynucleotide
taatacgactcactataggggcgtgccctcccgctttaggagcttggcctaacagaggagaaggccaatgtcctaaagcaacctggcggcagcgcaaaagatg

SEQ ID NO: 165351 - DNA, 103 bp, Artificial Sequence
  Synthetic Polynucleotide
taatacgactcactataggggggggcggaggcgtgccctcccgctttaggaacagaggagacctaaaatgggagggcacaacctggcggcagcgcaaaagatg

SEQ ID NO: 165352 - DNA, 103 bp, Artificial Sequence
  Synthetic Polynucleotide
taatacgactcactatagggtgagggcggtgggggcggaggcgtgccctcaacagaggagagagggcatgcctccgcccaacctggcggcagcgcaaaagatg

SEQ ID NO: 165353 - DNA, 103 bp, Artificial Sequence
  Synthetic Polynucleotide
taatacgactcactatagggtcaggtcccgtgagggcggtgggggcggagaacagaggagactccgcatgcaccgccctaacctggcggcagcgcaaaagatg

SEQ ID NO: 165354 - DNA, 103 bp, Artificial Sequence
  Synthetic Polynucleotide
taatacgactcactatagggtaggcctcggtcaggtcccgtgagggcggtaacagaggagaaccgccatgacgggacctaacctggcggcagcgcaaaagatg

SEQ ID NO: 165355 - DNA, 103 bp, Artificial Sequence
  Synthetic Polynucleotide
taatacgactcactatagggctgcgtcttgtaggcctcggtcaggtcccgaacagaggagacgggacatgaccgaggccaacctggcggcagcgcaaaagatg

SEQ ID NO: 165356 - DNA, 103 bp, Artificial Sequence
  Synthetic Polynucleotide
taatacgactcactatagggggcccagggcctgcgtcttgtaggcctcggaacagaggagaccgaggatgacaagacgcaacctggcggcagcgcaaaagatg

SEQ ID NO: 165357 - DNA, 103 bp, Artificial Sequence
  Synthetic Polynucleotide
taatacgactcactatagggggttccagcttgcccgtcaggctacggtccaacagaggagaggaccgatgcctgacgggaacctggcggcagcgcaaaagatg

SEQ ID NO: 165358 - DNA, 103 bp, Artificial Sequence
  Synthetic Polynucleotide
taatacgactcactatagggagcttcagggggcccagggcctgcgtcttgaacagaggagacaagacatgggccctgggaacctggcggcagcgcaaaagatg

SEQ ID NO: 165359 - DNA, 103 bp, Artificial Sequence
  Synthetic Polynucleotide
taatacgactcactatagggggccggcttcagcttcagggggcccagggcaacagaggagagccctgatgcccctgaagaacctggcggcagcgcaaaagatg

SEQ ID NO: 165360 - DNA, 103 bp, Artificial Sequence
  Synthetic Polynucleotide
taatacgactcactatagggggccctcatgggccggcttcagcttcagggaacagaggagaccctgaatgtgaagccggaacctggcggcagcgcaaaagatg

SEQ ID NO: 165361 - DNA, 103 bp, Artificial Sequence
  Synthetic Polynucleotide
taatacgactcactataggggtggccaccaggccctcatgggccggcttcaacagaggagagaagccatgccatgagggaacctggcggcagcgcaaaagatg

SEQ ID NO: 165362 - DNA, 103 bp, Artificial Sequence
  Synthetic Polynucleotide
taatacgactcactatagggctccttcaccgtggccaccaggccctcatgaacagaggagacatgagatgctggtggccaacctggcggcagcgcaaaagatg

SEQ ID NO: 165363 - DNA, 103 bp, Artificial Sequence
  Synthetic Polynucleotide
taatacgactcactatagggagcggcccgcctccttcaccgtggccaccaaacagaggagatggtggatgcggtgaaggaacctggcggcagcgcaaaagatg

SEQ ID NO: 165364 - DNA, 103 bp, Artificial Sequence
  Synthetic Polynucleotide
taatacgactcactatagggtcatggatggagcggcccgcctccttcaccaacagaggagaggtgaaatgggcgggccgaacctggcggcagcgcaaaagatg

SEQ ID NO: 165365 - DNA, 103 bp, Artificial Sequence
  Synthetic Polynucleotide
taatacgactcactataggggcgcgggatctcatggatggagcggcccgcaacagaggagagcgggcatgtccatccataacctggcggcagcgcaaaagatg

SEQ ID NO: 165366 - DNA, 103 bp, Artificial Sequence
  Synthetic Polynucleotide
taatacgactcactataggggcagctcctcgcgcgggatctcatggatggaacagaggagaccatccatgagatcccgcaacctggcggcagcgcaaaagatg

SEQ ID NO: 165367 - DNA, 103 bp, Artificial Sequence
  Synthetic Polynucleotide
taatacgactcactatagggggcgtgtgccgcagctcctcgcgcgggatcaacagaggagagatcccatgcgaggagctaacctggcggcagcgcaaaagatg

SEQ ID NO: 165368 - DNA, 103 bp, Artificial Sequence
  Synthetic Polynucleotide
taatacgactcactataggggggagacaccggttccagcttgcccgtcagaacagaggagactgacgatgaagctggaaaacctggcggcagcgcaaaagatg

SEQ ID NO: 165369 - DNA, 103 bp, Artificial Sequence
  Synthetic Polynucleotide
taatacgactcactataggggggcagctcgggcgtgtgccgcagctcctcaacagaggagagaggagatgcggcacacgaacctggcggcagcgcaaaagatg

SEQ ID NO: 165370 - DNA, 103 bp, Artificial Sequence
  Synthetic Polynucleotide
taatacgactcactataggggcggggccaggggcagctcgggcgtgtgccaacagaggagaggcacaatgccgagctgcaacctggcggcagcgcaaaagatg

SEQ ID NO: 165371 - DNA, 103 bp, Artificial Sequence
  Synthetic Polynucleotide
taatacgactcactatagggttgagcggccgcggggccaggggcagctcgaacagaggagacgagctatgcctggccccaacctggcggcagcgcaaaagatg

SEQ ID NO: 165372 - DNA, 103 bp, Artificial Sequence
  Synthetic Polynucleotide
taatacgactcactatagggggagccctccttgagcggccgcggggccagaacagaggagactggccatgcggccgctcaacctggcggcagcgcaaaagatg

SEQ ID NO: 165373 - DNA, 103 bp, Artificial Sequence
  Synthetic Polynucleotide
taatacgactcactatagggcctgcgtgatggagccctccttgagcggccaacagaggagaggccgcatgaggagggctaacctggcggcagcgcaaaagatg

SEQ ID NO: 165374 - DNA, 103 bp, Artificial Sequence
  Synthetic Polynucleotide
taatacgactcactatagggagcggggtgccctgcgtgatggagccctccaacagaggagaggagggatgcatcacgcaaacctggcggcagcgcaaaagatg

SEQ ID NO: 165375 - DNA, 103 bp, Artificial Sequence
  Synthetic Polynucleotide
taatacgactcactataggggtcgtacttgagcggggtgccctgcgtgataacagaggagaatcacgatgggcaccccgaacctggcggcagcgcaaaagatg

SEQ ID NO: 165376 - DNA, 103 bp, Artificial Sequence
  Synthetic Polynucleotide
taatacgactcactatagggacgcgccggtgtcgtacttgagcggggtgcaacagaggagagcacccatgtcaagtacgaacctggcggcagcgcaaaagatg

SEQ ID NO: 165377 - DNA, 103 bp, Artificial Sequence
  Synthetic Polynucleotide
taatacgactcactatagggccagtggtggacgcgccggtgtcgtacttgaacagaggagacaagtaatgcaccggcgcaacctggcggcagcgcaaaagatg

SEQ ID NO: 165378 - DNA, 103 bp, Artificial Sequence
  Synthetic Polynucleotide
taatacgactcactatagggctttttggagccagtggtggacgcgccggtaacagaggagaaccggcatgtccaccactaacctggcggcagcgcaaaagatg

SEQ ID NO: 165379 - DNA, 103 bp, Artificial Sequence
  Synthetic Polynucleotide
taatacgactcactataggggggggctggggggagacaccggttccagctaacagaggagaagctggatgcggtgtctcaacctggcggcagcgcaaaagatg

SEQ ID NO: 165380 - DNA, 103 bp, Artificial Sequence
  Synthetic Polynucleotide
taatacgactcactataggggtacgtcgtgctttttggagccagtggtggaacagaggagaccaccaatggctccaaaaaacctggcggcagcgcaaaagatg

SEQ ID NO: 165381 - DNA, 103 bp, Artificial Sequence
  Synthetic Polynucleotide
taatacgactcactatagggatgagggagcgtacgtcgtgctttttggagaacagaggagactccaaatggcacgacgtaacctggcggcagcgcaaaagatg

SEQ ID NO: 165382 - DNA, 103 bp, Artificial Sequence
  Synthetic Polynucleotide
taatacgactcactatagggggggctgccgatgagggagcgtacgtcgtgaacagaggagacacgacatgcgctccctcaacctggcggcagcgcaaaagatg

SEQ ID NO: 165383 - DNA, 103 bp, Artificial Sequence
  Synthetic Polynucleotide
taatacgactcactatagggacgtccggccggggctgccgatgagggagcaacagaggagagctcccatgtcggcagccaacctggcggcagcgcaaaagatg

SEQ ID NO: 165384 - DNA, 103 bp, Artificial Sequence
  Synthetic Polynucleotide
taatacgactcactatagggacgggtgggaacgtccggccggggctgccgaacagaggagacggcagatgcggccggacaacctggcggcagcgcaaaagatg

SEQ ID NO: 165385 - DNA, 103 bp, Artificial Sequence
  Synthetic Polynucleotide
taatacgactcactatagggcagcgggtgcacgggtgggaacgtccggccaacagaggagaggccggatgttcccacccaacctggcggcagcgcaaaagatg

SEQ ID NO: 165386 - DNA, 103 bp, Artificial Sequence
  Synthetic Polynucleotide
taatacgactcactatagggccatcacatccagcgggtgcacgggtgggaaacagaggagatcccacatgtgcacccgcaacctggcggcagcgcaaaagatg

SEQ ID NO: 165387 - DNA, 103 bp, Artificial Sequence
  Synthetic Polynucleotide
taatacgactcactatagggcgggcgtcggccatcacatccagcgggtgcaacagaggagagcacccatgggatgtgataacctggcggcagcgcaaaagatg

SEQ ID NO: 165388 - DNA, 103 bp, Artificial Sequence
  Synthetic Polynucleotide
taatacgactcactatagggttccagtgcccgggcgtcggccatcacatcaacagaggagagatgtgatggccgacgccaacctggcggcagcgcaaaagatg

SEQ ID NO: 165389 - DNA, 103 bp, Artificial Sequence
  Synthetic Polynucleotide
taatacgactcactatagggagcaggcacgttccagtgcccgggcgtcggaacagaggagaccgacgatggggcactggaacctggcggcagcgcaaaagatg

SEQ ID NO: 165390 - DNA, 103 bp, Artificial Sequence
  Synthetic Polynucleotide
taatacgactcactatagggtcagtgtgcggggggctggggggagacaccaacagaggagaggtgtcatgccccagcccaacctggcggcagcgcaaaagatg

SEQ ID NO: 165391 - DNA, 103 bp, Artificial Sequence
  Synthetic Polynucleotide
taatacgactcactatagggctctcctcgtagcaggcacgttccagtgccaacagaggagaggcactatgacgtgcctgaacctggcggcagcgcaaaagatg

SEQ ID NO: 165392 - DNA, 103 bp, Artificial Sequence
  Synthetic Polynucleotide
taatacgactcactataggggctcttcaggctctcctcgtagcaggcacgaacagaggagacgtgccatgtacgaggagaacctggcggcagcgcaaaagatg

SEQ ID NO: 165393 - DNA, 103 bp, Artificial Sequence
  Synthetic Polynucleotide
taatacgactcactatagggtccctggccggctcttcaggctctcctcgtaacagaggagaacgaggatggcctgaagaaacctggcggcagcgcaaaagatg

SEQ ID NO: 165394 - DNA, 103 bp, Artificial Sequence
  Synthetic Polynucleotide
taatacgactcactatagggctgctggcggtccctggccggctcttcaggaacagaggagacctgaaatgccggccaggaacctggcggcagcgcaaaagatg

SEQ ID NO: 165395 - DNA, 103 bp, Artificial Sequence
  Synthetic Polynucleotide
taatacgactcactataggggccccccgagctgctggcggtccctggccgaacagaggagacggccaatgaccgccagcaacctggcggcagcgcaaaagatg

SEQ ID NO: 165396 - DNA, 103 bp, Artificial Sequence
  Synthetic Polynucleotide
taatacgactcactataggggcgcaatggagccccccgagctgctggcggaacagaggagaccgccaatggctcgggggaacctggcggcagcgcaaaagatg

SEQ ID NO: 165397 - DNA, 103 bp, Artificial Sequence
  Synthetic Polynucleotide
taatacgactcactatagggggggcgccgcgcgcaatggagccccccgagaacagaggagactcgggatgctccattgcaacctggcggcagcgcaaaagatg

SEQ ID NO: 165398 - DNA, 103 bp, Artificial Sequence
  Synthetic Polynucleotide
taatacgactcactatagggcacaatgaccggggcgccgcgcgcaatggaaacagaggagatccattatgcgcggcgccaacctggcggcagcgcaaaagatg

SEQ ID NO: 165399 - DNA, 103 bp, Artificial Sequence
  Synthetic Polynucleotide
taatacgactcactatagggccagctcaggcacaatgaccggggcgccgcaacagaggagagcggcgatgcggtcattgaacctggcggcagcgcaaaagatg

SEQ ID NO: 165400 - DNA, 103 bp, Artificial Sequence
  Synthetic Polynucleotide
taatacgactcactatagggcgcggcttacccagctcaggcacaatgaccaacagaggagaggtcatatggcctgagctaacctggcggcagcgcaaaagatg

SEQ ID NO: 165401 - DNA, 103 bp, Artificial Sequence
  Synthetic Polynucleotide
taatacgactcactatagggcagctcagggtcagtgtgcggggggctgggaacagaggagacccagcatgccgcacactaacctggcggcagcgcaaaagatg

SEQ ID NO: 165402 - DNA, 103 bp, Artificial Sequence
  Synthetic Polynucleotide
taatacgactcactatagggggggctctgccgcggcttacccagctcaggaacagaggagacctgagatgggtaagccgaacctggcggcagcgcaaaagatg

SEQ ID NO: 165403 - DNA, 103 bp, Artificial Sequence
  Synthetic Polynucleotide
taatacgactcactatagggcataggtcagggggctctgccgcggcttacaacagaggagagtaagcatgggcagagccaacctggcggcagcgcaaaagatg

SEQ ID NO: 165404 - DNA, 103 bp, Artificial Sequence
  Synthetic Polynucleotide
taatacgactcactatagggccgtggtcctcataggtcagggggctctgcaacagaggagagcagagatgcctgacctaaacctggcggcagcgcaaaagatg

SEQ ID NO: 165405 - DNA, 103 bp, Artificial Sequence
  Synthetic Polynucleotide
taatacgactcactatagggaaagggtgccccgtggtcctcataggtcagaacagaggagactgaccatggaggaccacaacctggcggcagcgcaaaagatg

SEQ ID NO: 165406 - DNA, 103 bp, Artificial Sequence
  Synthetic Polynucleotide
taatacgactcactatagggggtggccggcaaagggtgccccgtggtcctaacagaggagaaggaccatggggcaccctaacctggcggcagcgcaaaagatg

SEQ ID NO: 165407 - DNA, 103 bp, Artificial Sequence
  Synthetic Polynucleotide
taatacgactcactatagggcctcgtgggaggtggccggcaaagggtgccaacagaggagaggcaccatgtgccggccaaacctggcggcagcgcaaaagatg

SEQ ID NO: 165408 - DNA, 103 bp, Artificial Sequence
  Synthetic Polynucleotide
taatacgactcactatagggcacgggcgaacctcgtgggaggtggccggcaacagaggagagccggcatgctcccacgaaacctggcggcagcgcaaaagatg

SEQ ID NO: 165409 - DNA, 103 bp, Artificial Sequence
  Synthetic Polynucleotide
taatacgactcactatagggcccgcgtggtcacgggcgaacctcgtgggaaacagaggagatcccacatggttcgcccgaacctggcggcagcgcaaaagatg

SEQ ID NO: 165410 - DNA, 103 bp, Artificial Sequence
  Synthetic Polynucleotide
taatacgactcactatagggggcgtgggctcccgcgtggtcacgggcgaaaacagaggagattcgccatggaccacgcgaacctggcggcagcgcaaaagatg

SEQ ID NO: 165411 - DNA, 103 bp, Artificial Sequence
  Synthetic Polynucleotide
taatacgactcactatagggctgcaggcgcggcgtgggctcccgcgtggtaacagaggagaaccacgatggagcccacgaacctggcggcagcgcaaaagatg

SEQ ID NO: 165412 - DNA, 103 bp, Artificial Sequence
  Synthetic Polynucleotide
taatacgactcactataggggcaccagctccagctcagggtcagtgtgcgaacagaggagacgcacaatgaccctgagcaacctggcggcagcgcaaaagatg

SEQ ID NO: 165413 - DNA, 103 bp, Artificial Sequence
  Synthetic Polynucleotide
taatacgactcactatagggggctgccctcctgcaggcgcggcgtgggctaacagaggagaagcccaatgcgcgcctgcaacctggcggcagcgcaaaagatg

SEQ ID NO: 165414 - DNA, 103 bp, Artificial Sequence
  Synthetic Polynucleotide
taatacgactcactatagggctggacgaaaggctgccctcctgcaggcgcaacagaggagagcgcctatgggagggcagaacctggcggcagcgcaaaagatg

SEQ ID NO: 165415 - DNA, 103 bp, Artificial Sequence
  Synthetic Polynucleotide
taatacgactcactatagggggatgccttgctggacgaaaggctgccctcaacagaggagagagggcatgctttcgtccaacctggcggcagcgcaaaagatg

SEQ ID NO: 165416 - DNA, 103 bp, Artificial Sequence
  Synthetic Polynucleotide
taatacgactcactatagggttcggtcctgggatgccttgctggacgaaaaacagaggagatttcgtatggcaaggcataacctggcggcagcgcaaaagatg

SEQ ID NO: 165417 - DNA, 103 bp, Artificial Sequence
  Synthetic Polynucleotide
taatacgactcactataggggacgtcagctttcggtcctgggatgccttgaacagaggagacaaggcatgccaggaccgaacctggcggcagcgcaaaagatg

SEQ ID NO: 165418 - DNA, 103 bp, Artificial Sequence
  Synthetic Polynucleotide
taatacgactcactatagggacgaggcgtcgacgtcagctttcggtcctgaacagaggagacaggacatgaagctgacgaacctggcggcagcgcaaaagatg

SEQ ID NO: 165419 - DNA, 103 bp, Artificial Sequence
  Synthetic Polynucleotide
taatacgactcactatagggtggcgatctcacgaggcgtcgacgtcagctaacagaggagaagctgaatgcgacgcctcaacctggcggcagcgcaaaagatg

SEQ ID NO: 165420 - DNA, 103 bp, Artificial Sequence
  Synthetic Polynucleotide
taatacgactcactatagggtgcggggacttggcgatctcacgaggcgtcaacagaggagagacgccatgtgagatcgcaacctggcggcagcgcaaaagatg

SEQ ID NO: 165421 - DNA, 103 bp, Artificial Sequence
  Synthetic Polynucleotide
taatacgactcactatagggcacggtgctgtgcggggacttggcgatctcaacagaggagagagatcatgaagtccccgaacctggcggcagcgcaaaagatg

SEQ ID NO: 165422 - DNA, 103 bp, Artificial Sequence
  Synthetic Polynucleotide
taatacgactcactatagggggtgctcgggcacggtgctgtgcggggactaacagaggagaagtcccatgacagcaccgaacctggcggcagcgcaaaagatg

SEQ ID NO: 165423 - DNA, 103 bp, Artificial Sequence
  Synthetic Polynucleotide
taatacgactcactatagggagccgtggcggcaccagctccagctcagggaacagaggagaccctgaatgggagctggtaacctggcggcagcgcaaaagatg

SEQ ID NO: 165424 - DNA, 103 bp, Artificial Sequence
  Synthetic Polynucleotide
taatacgactcactataggggggtgtgggtggtgctcgggcacggtgctgaacagaggagacagcacatggcccgagcaaacctggcggcagcgcaaaagatg

SEQ ID NO: 165425 - DNA, 103 bp, Artificial Sequence
  Synthetic Polynucleotide
taatacgactcactataggggggcgagatggggtgtgggtggtgctcgggaacagaggagacccgagatgcacccacacaacctggcggcagcgcaaaagatg

SEQ ID NO: 165426 - DNA, 103 bp, Artificial Sequence
  Synthetic Polynucleotide
taatacgactcactatagggggtgctcatagggcgagatggggtgtgggtaacagaggagaacccacatgccatctcgcaacctggcggcagcgcaaaagatg

SEQ ID NO: 165427 - DNA, 103 bp, Artificial Sequence
  Synthetic Polynucleotide
taatacgactcactatagggccccgaagcaggtgctcatagggcgagatgaacagaggagacatctcatgctatgagcaaacctggcggcagcgcaaaagatg

SEQ ID NO: 165428 - DNA, 103 bp, Artificial Sequence
  Synthetic Polynucleotide
taatacgactcactataggggccactcacgccccgaagcaggtgctcataaacagaggagatatgagatgctgcttcggaacctggcggcagcgcaaaagatg

SEQ ID NO: 165429 - DNA, 103 bp, Artificial Sequence
  Synthetic Polynucleotide
taatacgactcactatagggacaggtccacgccactcacgccccgaagcaaacagaggagatgcttcatggcgtgagtgaacctggcggcagcgcaaaagatg

SEQ ID NO: 165430 - DNA, 103 bp, Artificial Sequence
  Synthetic Polynucleotide
taatacgactcactatagggtggctgcgatacaggtccacgccactcacgaacagaggagacgtgagatgcgtggacctaacctggcggcagcgcaaaagatg

SEQ ID NO: 165431 - DNA, 103 bp, Artificial Sequence
  Synthetic Polynucleotide
taatacgactcactatagggcagggggatgtggctgcgatacaggtccacaacagaggagagtggacatgtatcgcagcaacctggcggcagcgcaaaagatg

SEQ ID NO: 165432 - DNA, 103 bp, Artificial Sequence
  Synthetic Polynucleotide
taatacgactcactatagggggtcgaaggccagggggatgtggctgcgataacagaggagaatcgcaatgacatcccccaacctggcggcagcgcaaaagatg

SEQ ID NO: 165433 - DNA, 103 bp, Artificial Sequence
  Synthetic Polynucleotide
taatacgactcactatagggatggaggtggggtcgaaggccagggggatgaacagaggagacatcccatgggccttcgaaacctggcggcagcgcaaaagatg

SEQ ID NO: 165434 - DNA, 103 bp, Artificial Sequence
  Synthetic Polynucleotide
taatacgactcactatagggctccttggacagccgtggcggcaccagctcaacagaggagagagctgatgccgccacggaacctggcggcagcgcaaaagatg

SEQ ID NO: 165435 - DNA, 103 bp, Artificial Sequence
  Synthetic Polynucleotide
taatacgactcactataggggccgcggggtatggaggtggggtcgaaggcaacagaggagagccttcatgcccacctccaacctggcggcagcgcaaaagatg

SEQ ID NO: 165436 - DNA, 103 bp, Artificial Sequence
  Synthetic Polynucleotide
taatacgactcactatagggccagagggatgccgcggggtatggaggtggaacagaggagaccacctatgtaccccgcgaacctggcggcagcgcaaaagatg

SEQ ID NO: 165437 - DNA, 103 bp, Artificial Sequence
  Synthetic Polynucleotide
taatacgactcactataggggcggctgcgtccagagggatgccgcggggtaacagaggagaaccccgatgcatccctctaacctggcggcagcgcaaaagatg

SEQ ID NO: 165438 - DNA, 103 bp, Artificial Sequence
  Synthetic Polynucleotide
taatacgactcactataggggtagtaggcagcggctgcgtccagagggataacagaggagaatccctatggacgcagccaacctggcggcagcgcaaaagatg

SEQ ID NO: 165439 - DNA, 103 bp, Artificial Sequence
  Synthetic Polynucleotide
taatacgactcactataggggtcggggcaggtagtaggcagcggctgcgtaacagaggagaacgcagatgctgcctactaacctggcggcagcgcaaaagatg

SEQ ID NO: 165440 - DNA, 103 bp, Artificial Sequence
  Synthetic Polynucleotide
taatacgactcactatagggggggccaggtgtcggggcaggtagtaggcaaacagaggagatgcctaatgcctgccccgaacctggcggcagcgcaaaagatg

SEQ ID NO: 165441 - DNA, 103 bp, Artificial Sequence
  Synthetic Polynucleotide
taatacgactcactatagggggtggggttgggggccaggtgtcggggcagaacagaggagactgcccatgcacctggccaacctggcggcagcgcaaaagatg

SEQ ID NO: 165442 - DNA, 103 bp, Artificial Sequence
  Synthetic Polynucleotide
taatacgactcactatagggggtgcgggtaggtggggttgggggccaggtaacagaggagaacctggatgccaaccccaaacctggcggcagcgcaaaagatg

SEQ ID NO: 165443 - DNA, 103 bp, Artificial Sequence
  Synthetic Polynucleotide
taatacgactcactatagggggtgggtacaggtgcgggtaggtggggttgaacagaggagacaacccatgctacccgcaaacctggcggcagcgcaaaagatg

SEQ ID NO: 165444 - DNA, 103 bp, Artificial Sequence
  Synthetic Polynucleotide
taatacgactcactataggggatgaggtagggtgggtacaggtgcgggtaaacagaggagatacccgatgctgtacccaaacctggcggcagcgcaaaagatg

SEQ ID NO: 165445 - DNA, 103 bp, Artificial Sequence
  Synthetic Polynucleotide
taatacgactcactatagggggctgtggggcgggtagcggggctcagtggaacagaggagaccactgatgcccgctaccaacctggcggcagcgcaaaagatg

SEQ ID NO: 165446 - DNA, 103 bp, Artificial Sequence
  Synthetic Polynucleotide
taatacgactcactatagggggatcagctcctccttggacagccgtggcgaacagaggagacgccacatgtgtccaaggaacctggcggcagcgcaaaagatg

SEQ ID NO: 165447 - DNA, 103 bp, Artificial Sequence
  Synthetic Polynucleotide
taatacgactcactatagggggtagccgcggatgaggtagggtgggtacaaacagaggagatgtaccatgcctacctcaaacctggcggcagcgcaaaagatg

SEQ ID NO: 165448 - DNA, 103 bp, Artificial Sequence
  Synthetic Polynucleotide
taatacgactcactataggggccgtgtcggggtagccgcggatgaggtagaacagaggagactacctatgccgcggctaaacctggcggcagcgcaaaagatg

SEQ ID NO: 165449 - DNA, 103 bp, Artificial Sequence
  Synthetic Polynucleotide
taatacgactcactatagggctccagcgccgccgtgtcggggtagccgcgaacagaggagacgcggcatgcccgacacgaacctggcggcagcgcaaaagatg

SEQ ID NO: 165450 - DNA, 103 bp, Artificial Sequence
  Synthetic Polynucleotide
taatacgactcactatagggtctgccggttctccagcgccgccgtgtcggaacagaggagaccgacaatgcggcgctggaacctggcggcagcgcaaaagatg

SEQ ID NO: 165451 - DNA, 103 bp, Artificial Sequence
  Synthetic Polynucleotide
taatacgactcactatagggttgatgatggtctgccggttctccagcgccaacagaggagaggcgctatggaaccggcaaacctggcggcagcgcaaaagatg

SEQ ID NO: 165452 - DNA, 103 bp, Artificial Sequence
  Synthetic Polynucleotide
taatacgactcactataggggatgtagtcattgatgatggtctgccggttaacagaggagaaaccggatgaccatcatcaacctggcggcagcgcaaaagatg

SEQ ID NO: 165453 - DNA, 103 bp, Artificial Sequence
  Synthetic Polynucleotide
taatacgactcactataggggctgcgaggtgatgtagtcattgatgatggaacagaggagaccatcaatgatgactacaaacctggcggcagcgcaaaagatg

SEQ ID NO: 165454 - DNA, 103 bp, Artificial Sequence
  Synthetic Polynucleotide
taatacgactcactatagggtggtgcatctgctgcgaggtgatgtagtcaaacagaggagatgactaatgcacctcgcaaacctggcggcagcgcaaaagatg

SEQ ID NO: 165455 - DNA, 103 bp, Artificial Sequence
  Synthetic Polynucleotide
taatacgactcactatagggggccgcgttgtggtgcatctgctgcgaggtaacagaggagaacctcgatgcagatgcacaacctggcggcagcgcaaaagatg

SEQ ID NO: 165456 - DNA, 103 bp, Artificial Sequence
  Synthetic Polynucleotide
taatacgactcactatagggccatggcggtggccgcgttgtggtgcatctaacagaggagaagatgcatgacaacgcggaacctggcggcagcgcaaaagatg

SEQ ID NO: 165457 - DNA, 103 bp, Artificial Sequence
  Synthetic Polynucleotide
taatacgactcactatagggtccatgttctggatcagctcctccttggacaacagaggagagtccaaatgggagctgataacctggcggcagcgcaaaagatg

SEQ ID NO: 165458 - DNA, 103 bp, Artificial Sequence
  Synthetic Polynucleotide
taatacgactcactataggggctcgctgggccatggcggtggccgcgttgaacagaggagacaacgcatgcaccgccataacctggcggcagcgcaaaagatg

SEQ ID NO: 165459 - DNA, 103 bp, Artificial Sequence
  Synthetic Polynucleotide
taatacgactcactatagggcagcatatcagctcgctgggccatggcggtaacagaggagaaccgccatggcccagcgaaacctggcggcagcgcaaaagatg

SEQ ID NO: 165460 - DNA, 103 bp, Artificial Sequence
  Synthetic Polynucleotide
taatacgactcactatagggagaggcccctcagcatatcagctcgctgggaacagaggagacccagcatgctgatatgcaacctggcggcagcgcaaaagatg

SEQ ID NO: 165461 - DNA, 103 bp, Artificial Sequence
  Synthetic Polynucleotide
taatacgactcactatagggtcgcggggcgagaggcccctcagcatatcaaacagaggagatgatatatggaggggcctaacctggcggcagcgcaaaagatg

SEQ ID NO: 165462 - DNA, 103 bp, Artificial Sequence
  Synthetic Polynucleotide
taatacgactcactatagggcagcgaggactcgcggggcgagaggcccctaacagaggagaaggggcatgtcgccccgcaacctggcggcagcgcaaaagatg

SEQ ID NO: 165463 - DNA, 103 bp, Artificial Sequence
  Synthetic Polynucleotide
taatacgactcactatagggagttgagtgccagcgaggactcgcggggcgaacagaggagacgccccatgagtcctcgcaacctggcggcagcgcaaaagatg

SEQ ID NO: 165464 - DNA, 103 bp, Artificial Sequence
  Synthetic Polynucleotide
taatacgactcactatagggcccgcagcgtagttgagtgccagcgaggacaacagaggagagtcctcatgggcactcaaaacctggcggcagcgcaaaagatg

SEQ ID NO: 165465 - DNA, 103 bp, Artificial Sequence
  Synthetic Polynucleotide
taatacgactcactataggggcctcggggacccgcagcgtagttgagtgcaacagaggagagcactcatgtacgctgcgaacctggcggcagcgcaaaagatg

SEQ ID NO: 165466 - DNA, 103 bp, Artificial Sequence
  Synthetic Polynucleotide
taatacgactcactatagggggtcgatgatgcctcggggacccgcagcgtaacagaggagaacgctgatggtccccgagaacctggcggcagcgcaaaagatg

SEQ ID NO: 165467 - DNA, 103 bp, Artificial Sequence
  Synthetic Polynucleotide
taatacgactcactatagggacttgggacaggtcgatgatgcctcggggaaacagaggagatccccgatgcatcatcgaaacctggcggcagcgcaaaagatg

SEQ ID NO: 165468 - DNA, 103 bp, Artificial Sequence
  Synthetic Polynucleotide
taatacgactcactataggggtccacgcggtccatgttctggatcagctcaacagaggagagagctgatgcagaacatgaacctggcggcagcgcaaaagatg

SEQ ID NO: 165469 - DNA, 103 bp, Artificial Sequence
  Synthetic Polynucleotide
taatacgactcactatagggcaggtgtggcacttgggacaggtcgatgataacagaggagaatcatcatgctgtcccaaaacctggcggcagcgcaaaagatg

SEQ ID NO: 165470 - DNA, 103 bp, Artificial Sequence
  Synthetic Polynucleotide
taatacgactcactatagggcgagcacaggcaggtgtggcacttgggacaaacagaggagatgtcccatgtgccacaccaacctggcggcagcgcaaaagatg

SEQ ID NO: 165471 - DNA, 103 bp, Artificial Sequence
  Synthetic Polynucleotide
taatacgactcactataggggtcgggggcacgagcacaggcaggtgtggcaacagaggagagccacaatggcctgtgctaacctggcggcagcgcaaaagatg

SEQ ID NO: 165472 - DNA, 103 bp, Artificial Sequence
  Synthetic Polynucleotide
taatacgactcactatagggggtgcctggtgtcgggggcacgagcacaggaacagaggagacctgtgatggtgcccccgaacctggcggcagcgcaaaagatg

SEQ ID NO: 165473 - DNA, 103 bp, Artificial Sequence
  Synthetic Polynucleotide
taatacgactcactatagggcggtggctggggtgcctggtgtcgggggcaaacagaggagatgccccatgcaccaggcaaacctggcggcagcgcaaaagatg

SEQ ID NO: 165474 - DNA, 103 bp, Artificial Sequence
  Synthetic Polynucleotide
taatacgactcactatagggcggtccatggcggtggctggggtgcctggtaacagaggagaaccaggatgcccagccacaacctggcggcagcgcaaaagatg

SEQ ID NO: 165475 - DNA, 103 bp, Artificial Sequence
  Synthetic Polynucleotide
taatacgactcactataggggtaggcaaggcggtccatggcggtggctggaacagaggagaccagccatggccatggacaacctggcggcagcgcaaaagatg

SEQ ID NO: 165476 - DNA, 103 bp, Artificial Sequence
  Synthetic Polynucleotide
taatacgactcactatagggcggtggggaggtaggcaaggcggtccatggaacagaggagaccatggatggccttgcctaacctggcggcagcgcaaaagatg

SEQ ID NO: 165477 - DNA, 103 bp, Artificial Sequence
  Synthetic Polynucleotide
taatacgactcactatagggggctggggcgcggtggggaggtaggcaaggaacagaggagaccttgcatgcctccccacaacctggcggcagcgcaaaagatg

SEQ ID NO: 165478 - DNA, 103 bp, Artificial Sequence
  Synthetic Polynucleotide
taatacgactcactataggggctgctgaagggctggggcgcggtggggagaacagaggagactccccatggcgccccagaacctggcggcagcgcaaaagatg

SEQ ID NO: 165479 - DNA, 103 bp, Artificial Sequence
  Synthetic Polynucleotide
taatacgactcactatagggtgatctctcggtccacgcggtccatgttctaacagaggagaagaacaatgaccgcgtggaacctggcggcagcgcaaaagatg

SEQ ID NO: 165480 - DNA, 103 bp, Artificial Sequence
  Synthetic Polynucleotide
taatacgactcactatagggtgctgtggcggctgctgaagggctggggcgaacagaggagacgccccatgccttcagcaaacctggcggcagcgcaaaagatg

SEQ ID NO: 165481 - DNA, 103 bp, Artificial Sequence
  Synthetic Polynucleotide
taatacgactcactatagggagtggggagctgctgtggcggctgctgaagaacagaggagacttcagatgccgccacagaacctggcggcagcgcaaaagatg

SEQ ID NO: 165482 - DNA, 103 bp, Artificial Sequence
  Synthetic Polynucleotide
taatacgactcactatagggtcctggggagagtggggagctgctgtggcgaacagaggagacgccacatgagctccccaaacctggcggcagcgcaaaagatg

SEQ ID NO: 165483 - DNA, 103 bp, Artificial Sequence
  Synthetic Polynucleotide
taatacgactcactataggggtgttggacctcctggggagagtggggagcaacagaggagagctcccatgtctccccagaacctggcggcagcgcaaaagatg

SEQ ID NO: 165484 - DNA, 103 bp, Artificial Sequence
  Synthetic Polynucleotide
taatacgactcactatagggtttgtcaagtgtgttggacctcctggggagaacagaggagactccccatgaggtccaacaacctggcggcagcgcaaaagatg

SEQ ID NO: 165485 - DNA, 103 bp, Artificial Sequence
  Synthetic Polynucleotide
taatacgactcactatagggggtggttggttttgtcaagtgtgttggaccaacagaggagaggtccaatgcacttgacaaacctggcggcagcgcaaaagatg

SEQ ID NO: 165486 - DNA, 103 bp, Artificial Sequence
  Synthetic Polynucleotide
taatacgactcactatagggacgaggacgtggtggttggttttgtcaagtaacagaggagaacttgaatgaaccaaccaaacctggcggcagcgcaaaagatg

SEQ ID NO: 165487 - DNA, 103 bp, Artificial Sequence
  Synthetic Polynucleotide
taatacgactcactatagggtcccgctcggacgaggacgtggtggttggtaacagaggagaaccaacatgcacgtcctcaacctggcggcagcgcaaaagatg

SEQ ID NO: 165488 - DNA, 103 bp, Artificial Sequence
  Synthetic Polynucleotide
taatacgactcactatagggccggtctcgctcccgctcggacgaggacgtaacagaggagaacgtccatgtccgagcggaacctggcggcagcgcaaaagatg

SEQ ID NO: 165489 - DNA, 103 bp, Artificial Sequence
  Synthetic Polynucleotide
taatacgactcactataggggctctcgatcccggtctcgctcccgctcggaacagaggagaccgagcatgagcgagaccaacctggcggcagcgcaaaagatg

SEQ ID NO: 165490 - DNA, 103 bp, Artificial Sequence
  Synthetic Polynucleotide
taatacgactcactatagggtctaccatggtgatctctcggtccacgcggaacagaggagaccgcgtatgccgagagataacctggcggcagcgcaaaagatg

SEQ ID NO: 165491 - DNA, 103 bp, Artificial Sequence
  Synthetic Polynucleotide
taatacgactcactatagggtcccggtcccgctctcgatcccggtctcgcaacagaggagagcgagaatgggatcgagaaacctggcggcagcgcaaaagatg

SEQ ID NO: 165492 - DNA, 103 bp, Artificial Sequence
  Synthetic Polynucleotide
taatacgactcactatagggccgctcccgatcccggtcccgctctcgatcaacagaggagagatcgaatgcgggaccggaacctggcggcagcgcaaaagatg

SEQ ID NO: 165493 - DNA, 103 bp, Artificial Sequence
  Synthetic Polynucleotide
taatacgactcactatagggtggacttttcccgctcccgatcccggtcccaacagaggagagggaccatgatcgggagcaacctggcggcagcgcaaaagatg

SEQ ID NO: 165494 - DNA, 103 bp, Artificial Sequence
  Synthetic Polynucleotide
taatacgactcactataggggacgtgaggatggacttttcccgctcccgaaacagaggagatcgggaatgggaaaagtcaacctggcggcagcgcaaaagatg

SEQ ID NO: 165495 - DNA, 103 bp, Artificial Sequence
  Synthetic Polynucleotide
taatacgactcactatagggcgtcgtggtggacgtgaggatggacttttcaacagaggagagaaaagatgatcctcacgaacctggcggcagcgcaaaagatg

SEQ ID NO: 165496 - DNA, 103 bp, Artificial Sequence
  Synthetic Polynucleotide
taatacgactcactatagggcgtgctccaccgtcgtggtggacgtgaggaaacagaggagatcctcaatgccaccacgaaacctggcggcagcgcaaaagatg

SEQ ID NO: 165497 - DNA, 103 bp, Artificial Sequence
  Synthetic Polynucleotide
taatacgactcactatagggcagatgggtgcgtgctccaccgtcgtggtgaacagaggagacaccacatgggtggagcaaacctggcggcagcgcaaaagatg

SEQ ID NO: 165498 - DNA, 103 bp, Artificial Sequence
  Synthetic Polynucleotide
taatacgactcactatagggaccaggtctccagatgggtgcgtgctccacaacagaggagagtggagatggcacccatcaacctggcggcagcgcaaaagatg

SEQ ID NO: 165499 - DNA, 103 bp, Artificial Sequence
  Synthetic Polynucleotide
taatacgactcactatagggtctgctctgtaccaggtctccagatgggtgaacagaggagacacccaatgggagacctgaacctggcggcagcgcaaaagatg

SEQ ID NO: 165500 - DNA, 103 bp, Artificial Sequence
  Synthetic Polynucleotide
taatacgactcactatagggctgccgctgctctgctctgtaccaggtctcaacagaggagagagaccatgtacagagcaaacctggcggcagcgcaaaagatg

SEQ ID NO: 165501 - DNA, 103 bp, Artificial Sequence
  Synthetic Polynucleotide
taatacgactcactataggggatctgctgctctaccatggtgatctctcgaacagaggagacgagagatgaccatggtaaacctggcggcagcgcaaaagatg

SEQ ID NO: 165502 - DNA, 103 bp, Artificial Sequence
  Synthetic Polynucleotide
taatacgactcactatagggcccgccgctgctgccgctgctctgctctgtaacagaggagaacagagatgagcagcggcaacctggcggcagcgcaaaagatg

SEQ ID NO: 165503 - DNA, 103 bp, Artificial Sequence
  Synthetic Polynucleotide
taatacgactcactatagggtgcccccacccccgccgctgctgccgctgcaacagaggagagcagcgatggcagcggcgaacctggcggcagcgcaaaagatg

SEQ ID NO: 165504 - DNA, 103 bp, Artificial Sequence
  Synthetic Polynucleotide
taatacgactcactatagggcggctgctgctgcccccacccccgccgctgaacagaggagacagcggatggggtgggggaacctggcggcagcgcaaaagatg

SEQ ID NO: 165505 - DNA, 103 bp, Artificial Sequence
  Synthetic Polynucleotide
taatacgactcactatagggggaggcggggcggctgctgctgcccccaccaacagaggagaggtgggatgagcagcagcaacctggcggcagcgcaaaagatg

SEQ ID NO: 165506 - DNA, 103 bp, Artificial Sequence
  Synthetic Polynucleotide
taatacgactcactatagggcatgggagtgggaggcggggcggctgctgcaacagaggagagcagcaatggccccgcctaacctggcggcagcgcaaaagatg

SEQ ID NO: 165507 - DNA, 103 bp, Artificial Sequence
  Synthetic Polynucleotide
taatacgactcactatagggtgctggtgggcatgggagtgggaggcggggaacagaggagaccccgcatgccactcccaaacctggcggcagcgcaaaagatg

SEQ ID NO: 165508 - DNA, 103 bp, Artificial Sequence
  Synthetic Polynucleotide
taatacgactcactataggggatgggcgagtgctggtgggcatgggagtgaacagaggagacactccatggcccaccagaacctggcggcagcgcaaaagatg

SEQ ID NO: 165509 - DNA, 103 bp, Artificial Sequence
  Synthetic Polynucleotide
taatacgactcactatagggtccgaggggagatgggcgagtgctggtgggaacagaggagacccaccatgactcgcccaaacctggcggcagcgcaaaagatg

SEQ ID NO: 165510 - DNA, 103 bp, Artificial Sequence
  Synthetic Polynucleotide
taatacgactcactataggggcatcctgggtccgaggggagatgggcgagaacagaggagactcgccatgctcccctcgaacctggcggcagcgcaaaagatg

SEQ ID NO: 165511 - DNA, 103 bp, Artificial Sequence
  Synthetic Polynucleotide
taatacgactcactatagggctgctggagggcatcctgggtccgaggggaaacagaggagatcccctatgacccaggataacctggcggcagcgcaaaagatg

SEQ ID NO: 165512 - DNA, 103 bp, Artificial Sequence
  Synthetic Polynucleotide
taatacgactcactatagggtcagcttagagatctgctgctctaccatggaacagaggagaccatggatgagcagcagaaacctggcggcagcgcaaaagatg

SEQ ID NO: 165513 - DNA, 103 bp, Artificial Sequence
  Synthetic Polynucleotide
taatacgactcactatagggcactgggtctctgctggagggcatcctgggaacagaggagacccaggatgccctccagcaacctggcggcagcgcaaaagatg

SEQ ID NO: 165514 - DNA, 103 bp, Artificial Sequence
  Synthetic Polynucleotide
taatacgactcactatagggttgtgaagcacactgggtctctgctggaggaacagaggagacctccaatggagacccagaacctggcggcagcgcaaaagatg

SEQ ID NO: 165515 - DNA, 103 bp, Artificial Sequence
  Synthetic Polynucleotide
taatacgactcactatagggcatgcctgtgttgtgaagcacactgggtctaacagaggagaagacccatggtgcttcacaacctggcggcagcgcaaaagatg

SEQ ID NO: 165516 - DNA, 103 bp, Artificial Sequence
  Synthetic Polynucleotide
taatacgactcactatagggtgatacccttcatgcctgtgttgtgaagcaaacagaggagatgcttcatgacacaggcaaacctggcggcagcgcaaaagatg

SEQ ID NO: 165517 - DNA, 103 bp, Artificial Sequence
  Synthetic Polynucleotide
taatacgactcactatagggacagcggtgatgatacccttcatgcctgtgaacagaggagacacaggatggaagggtataacctggcggcagcgcaaaagatg

SEQ ID NO: 165518 - DNA, 103 bp, Artificial Sequence
  Synthetic Polynucleotide
taatacgactcactataggggctgggctccacagcggtgatgatacccttaacagaggagaaagggtatgatcaccgctaacctggcggcagcgcaaaagatg

SEQ ID NO: 165519 - DNA, 103 bp, Artificial Sequence
  Synthetic Polynucleotide
taatacgactcactatagggccgtgggcgtgctgggctccacagcggtgaaacagaggagatcaccgatgtggagcccaaacctggcggcagcgcaaaagatg

SEQ ID NO: 165520 - DNA, 103 bp, Artificial Sequence
  Synthetic Polynucleotide
taatacgactcactataggggacctcaggaccgtgggcgtgctgggctccaacagaggagaggagccatgcacgcccacaacctggcggcagcgcaaaagatg

SEQ ID NO: 165521 - DNA, 103 bp, Artificial Sequence
  Synthetic Polynucleotide
taatacgactcactatagggggtggaggtggacctcaggaccgtgggcgtaacagaggagaacgcccatggtcctgaggaacctggcggcagcgcaaaagatg

SEQ ID NO: 165522 - DNA, 103 bp, Artificial Sequence
  Synthetic Polynucleotide
taatacgactcactatagggcgggtgaggaggtggaggtggacctcaggaaacagaggagatcctgaatgccacctccaaacctggcggcagcgcaaaagatg

SEQ ID NO: 165523 - DNA, 103 bp, Artificial Sequence
  Synthetic Polynucleotide
taatacgactcactatagggtgcttcttcttcagcttagagatctgctgcaacagaggagagcagcaatgctctaagctaacctggcggcagcgcaaaagatg

SEQ ID NO: 165524 - DNA, 103 bp, Artificial Sequence
  Synthetic Polynucleotide
taatacgactcactataggggccgggcgaacgggtgaggaggtggaggtgaacagaggagacacctcatgctcctcaccaacctggcggcagcgcaaaagatg

SEQ ID NO: 165525 - DNA, 103 bp, Artificial Sequence
  Synthetic Polynucleotide
taatacgactcactataggggaatgtggcagccgggcgaacgggtgaggaaacagaggagatcctcaatggttcgcccgaacctggcggcagcgcaaaagatg

SEQ ID NO: 165526 - DNA, 103 bp, Artificial Sequence
  Synthetic Polynucleotide
taatacgactcactatagggtggcaggtgggaatgtggcagccgggcgaaaacagaggagattcgccatgctgccacataacctggcggcagcgcaaaagatg

SEQ ID NO: 165527 - DNA, 103 bp, Artificial Sequence
  Synthetic Polynucleotide
taatacgactcactataggggggcagtgggtggcaggtgggaatgtggcaaacagaggagatgccacatgcccacctgcaacctggcggcagcgcaaaagatg

SEQ ID NO: 165528 - DNA, 103 bp, Artificial Sequence
  Synthetic Polynucleotide
taatacgactcactataggggccgcccagtgggcagtgggtggcaggtggaacagaggagaccacctatgacccactgcaacctggcggcagcgcaaaagatg

SEQ ID NO: 165529 - DNA, 103 bp, Artificial Sequence
  Synthetic Polynucleotide
taatacgactcactatagggcatcgagggtgccgcccagtgggcagtgggaacagaggagacccactatgcactgggcgaacctggcggcagcgcaaaagatg

SEQ ID NO: 165530 - DNA, 103 bp, Artificial Sequence
  Synthetic Polynucleotide
taatacgactcactataggggggtagaccccatcgagggtgccgcccagtaacagaggagaactgggatgcaccctcgaaacctggcggcagcgcaaaagatg

SEQ ID NO: 165531 - DNA, 103 bp, Artificial Sequence
  Synthetic Polynucleotide
taatacgactcactatagggcatgagggtagggtagaccccatcgagggtaacagaggagaaccctcatgggggtctacaacctggcggcagcgcaaaagatg

SEQ ID NO: 165532 - DNA, 103 bp, Artificial Sequence
  Synthetic Polynucleotide
taatacgactcactatagggagacgggctccatgagggtagggtagacccaacagaggagagggtctatgctaccctcaaacctggcggcagcgcaaaagatg

SEQ ID NO: 165533 - DNA, 103 bp, Artificial Sequence
  Synthetic Polynucleotide
taatacgactcactatagggttgggcagcaagacgggctccatgagggtaaacagaggagataccctatgggagcccgtaacctggcggcagcgcaaaagatg

SEQ ID NO: 165534 - DNA, 103 bp, Artificial Sequence
  Synthetic Polynucleotide
taatacgactcactatagggcagctgttgctgcttcttcttcagcttagaaacagaggagatctaagatgaagaagaagaacctggcggcagcgcaaaagatg

SEQ ID NO: 165535 - DNA, 103 bp, Artificial Sequence
  Synthetic Polynucleotide
taatacgactcactataggggggggcctccttgggcagcaagacgggctcaacagaggagagagcccatgttgctgcccaacctggcggcagcgcaaaagatg

SEQ ID NO: 165536 - DNA, 103 bp, Artificial Sequence
  Synthetic Polynucleotide
taatacgactcactataggggggcgacccggggggcctccttgggcagcaaacagaggagatgctgcatgaggaggcccaacctggcggcagcgcaaaagatg

SEQ ID NO: 165537 - DNA, 103 bp, Artificial Sequence
  Synthetic Polynucleotide
taatacgactcactatagggcgctctggccgggcgacccggggggcctccaacagaggagaggaggcatgccgggtcgcaacctggcggcagcgcaaaagatg

SEQ ID NO: 165538 - DNA, 103 bp, Artificial Sequence
  Synthetic Polynucleotide
taatacgactcactatagggtgctcggggccgctctggccgggcgacccgaacagaggagacgggtcatgcggccagagaacctggcggcagcgcaaaagatg

SEQ ID NO: 165539 - DNA, 103 bp, Artificial Sequence
  Synthetic Polynucleotide
taatacgactcactatagggggccggtgtctgctcggggccgctctggccaacagaggagaggccagatgggccccgagaacctggcggcagcgcaaaagatg

SEQ ID NO: 165540 - DNA, 103 bp, Artificial Sequence
  Synthetic Polynucleotide
taatacgactcactatagggaggaaggcatggccggtgtctgctcggggcaacagaggagagccccgatgagacaccggaacctggcggcagcgcaaaagatg

SEQ ID NO: 165541 - DNA, 103 bp, Artificial Sequence
  Synthetic Polynucleotide
taatacgactcactataggggggcttggcgaggaaggcatggccggtgtcaacagaggagagacaccatgcatgccttcaacctggcggcagcgcaaaagatg

SEQ ID NO: 165542 - DNA, 103 bp, Artificial Sequence
  Synthetic Polynucleotide
taatacgactcactatagggagcgggctgggggcttggcgaggaaggcataacagaggagaatgcctatgtcgccaagcaacctggcggcagcgcaaaagatg

SEQ ID NO: 165543 - DNA, 103 bp, Artificial Sequence
  Synthetic Polynucleotide
taatacgactcactatagggtccagcccggagcgggctgggggcttggcgaacagaggagacgccaaatgcccagcccgaacctggcggcagcgcaaaagatg

SEQ ID NO: 165544 - DNA, 103 bp, Artificial Sequence
  Synthetic Polynucleotide
taatacgactcactatagggggaggcgggctccagcccggagcgggctggaacagaggagaccagccatgtccgggctgaacctggcggcagcgcaaaagatg

SEQ ID NO: 165545 - DNA, 103 bp, Artificial Sequence
  Synthetic Polynucleotide
taatacgactcactatagggcctcctcctccagctgttgctgcttcttctaacagaggagaagaagaatgagcaacagcaacctggcggcagcgcaaaagatg

SEQ ID NO: 165546 - DNA, 103 bp, Artificial Sequence
  Synthetic Polynucleotide
taatacgactcactatagggtgctgggggaggaggcgggctccagcccggaacagaggagaccgggcatgagcccgcctaacctggcggcagcgcaaaagatg

SEQ ID NO: 165547 - DNA, 103 bp, Artificial Sequence
  Synthetic Polynucleotide
taatacgactcactatagggtccgagcccttgctgggggaggaggcgggcaacagaggagagcccgcatgctcccccagaacctggcggcagcgcaaaagatg

SEQ ID NO: 165548 - DNA, 103 bp, Artificial Sequence
  Synthetic Polynucleotide
taatacgactcactataggggggccggggctccgagcccttgctgggggaaacagaggagatcccccatgaagggctcgaacctggcggcagcgcaaaagatg

SEQ ID NO: 165549 - DNA, 103 bp, Artificial Sequence
  Synthetic Polynucleotide
taatacgactcactataggggaggcactaggggccggggctccgagccctaacagaggagaagggctatgagccccggcaacctggcggcagcgcaaaagatg

SEQ ID NO: 165550 - DNA, 103 bp, Artificial Sequence
  Synthetic Polynucleotide
taatacgactcactatagggccagagacaggaggcactaggggccggggcaacagaggagagccccgatgcctagtgccaacctggcggcagcgcaaaagatg

SEQ ID NO: 165551 - DNA, 103 bp, Artificial Sequence
  Synthetic Polynucleotide
taatacgactcactatagggggtggcgtggccagagacaggaggcactagaacagaggagactagtgatgcctgtctctaacctggcggcagcgcaaaagatg

SEQ ID NO: 165552 - DNA, 103 bp, Artificial Sequence
  Synthetic Polynucleotide
taatacgactcactatagggtgcgggcgatggtggcgtggccagagacagaacagaggagactgtctatggccacgccaaacctggcggcagcgcaaaagatg

SEQ ID NO: 165553 - DNA, 103 bp, Artificial Sequence
  Synthetic Polynucleotide
taatacgactcactatagggttcgcaggggtgcgggcgatggtggcgtggaacagaggagaccacgcatgcatcgcccgaacctggcggcagcgcaaaagatg

SEQ ID NO: 165554 - DNA, 103 bp, Artificial Sequence
  Synthetic Polynucleotide
taatacgactcactatagggtgcgaggttcttcgcaggggtgcgggcgataacagaggagaatcgccatgacccctgcgaacctggcggcagcgcaaaagatg

SEQ ID NO: 165555 - DNA, 103 bp, Artificial Sequence
  Synthetic Polynucleotide
taatacgactcactatagggcgtggtgaggtgcgaggttcttcgcaggggaacagaggagacccctgatgagaacctcgaacctggcggcagcgcaaaagatg

SEQ ID NO: 165556 - DNA, 103 bp, Artificial Sequence
  Synthetic Polynucleotide
taatacgactcactataggggggtaggaaaggctgtggggcgggtagcggaacagaggagaccgctaatggccccacagaacctggcggcagcgcaaaagatg

SEQ ID NO: 165557 - DNA, 103 bp, Artificial Sequence
  Synthetic Polynucleotide
taatacgactcactatagggggcttggcagcctcctcctccagctgttgcaacagaggagagcaacaatgggaggaggaaacctggcggcagcgcaaaagatg

SEQ ID NO: 165558 - DNA, 103 bp, Artificial Sequence
  Synthetic Polynucleotide
taatacgactcactatagggtccgggctggcgtggtgaggtgcgaggttcaacagaggagagaacctatgacctcaccaaacctggcggcagcgcaaaagatg

SEQ ID NO: 165559 - DNA, 103 bp, Artificial Sequence
  Synthetic Polynucleotide
taatacgactcactatagggcgccggcgggtccgggctggcgtggtgaggaacagaggagacctcacatggccagcccgaacctggcggcagcgcaaaagatg

SEQ ID NO: 165560 - DNA, 103 bp, Artificial Sequence
  Synthetic Polynucleotide
taatacgactcactatagggaggcaggtggcgccggcgggtccgggctggaacagaggagaccagccatgacccgccggaacctggcggcagcgcaaaagatg

SEQ ID NO: 165561 - DNA, 103 bp, Artificial Sequence
  Synthetic Polynucleotide
taatacgactcactatagggtccgaggccgaggcaggtggcgccggcgggaacagaggagacccgccatggccacctgcaacctggcggcagcgcaaaagatg

SEQ ID NO: 165562 - DNA, 103 bp, Artificial Sequence
  Synthetic Polynucleotide
taatacgactcactatagggccggtgcgggtccgaggccgaggcaggtggaacagaggagaccacctatgtcggcctcgaacctggcggcagcgcaaaagatg

SEQ ID NO: 165563 - DNA, 103 bp, Artificial Sequence
  Synthetic Polynucleotide
taatacgactcactataggggagtcttttcccggtgcgggtccgaggccgaacagaggagacggcctatgacccgcaccaacctggcggcagcgcaaaagatg

SEQ ID NO: 165564 - DNA, 103 bp, Artificial Sequence
  Synthetic Polynucleotide
taatacgactcactatagggggtttactttgagtcttttcccggtgcgggaacagaggagacccgcaatgggaaaagacaacctggcggcagcgcaaaagatg

SEQ ID NO: 165565 - DNA, 103 bp, Artificial Sequence
  Synthetic Polynucleotide
taatacgactcactataggggatggaaaagggtttactttgagtcttttcaacagaggagagaaaagatgcaaagtaaaaacctggcggcagcgcaaaagatg

SEQ ID NO: 165566 - DNA, 103 bp, Artificial Sequence
  Synthetic Polynucleotide
taatacgactcactatagggccagttcctggatggaaaagggtttactttaacagaggagaaaagtaatgccttttccaaacctggcggcagcgcaaaagatg

SEQ ID NO: 165567 - DNA, 103 bp, Artificial Sequence
  Synthetic Polynucleotide
taatacgactcactataggggaacggagttccagttcctggatggaaaagaacagaggagacttttcatgccaggaactaacctggcggcagcgcaaaagatg

SEQ ID NO: 165568 - DNA, 103 bp, Artificial Sequence
  Synthetic Polynucleotide
taatacgactcactatagggaggctcgggcggcttggcagcctcctcctcaacagaggagagaggagatggctgccaagaacctggcggcagcgcaaaagatg

SEQ ID NO: 165569 - DNA, 103 bp, Artificial Sequence
  Synthetic Polynucleotide
taatacgactcactataggggtaacccagagaacggagttccagttcctgaacagaggagacaggaaatggaactccgtaacctggcggcagcgcaaaagatg

SEQ ID NO: 165570 - DNA, 103 bp, Artificial Sequence
  Synthetic Polynucleotide
taatacgactcactatagggtgctgccgtggtaacccagagaacggagttaacagaggagaaactccatgctctgggttaacctggcggcagcgcaaaagatg

SEQ ID NO: 165571 - DNA, 103 bp, Artificial Sequence
  Synthetic Polynucleotide
taatacgactcactataggggggctgtagctgctgccgtggtaacccagaaacagaggagatctgggatgccacggcagaacctggcggcagcgcaaaagatg

SEQ ID NO: 165572 - DNA, 103 bp, Artificial Sequence
  Synthetic Polynucleotide
taatacgactcactatagggcaccccttcggggctgtagctgctgccgtgaacagaggagacacggcatgagctacagcaacctggcggcagcgcaaaagatg

SEQ ID NO: 165573 - DNA, 103 bp, Artificial Sequence
  Synthetic Polynucleotide
taatacgactcactatagggtgacgggctccaccccttcggggctgtagcaacagaggagagctacaatgccgaaggggaacctggcggcagcgcaaaagatg

SEQ ID NO: 165574 - DNA, 103 bp, Artificial Sequence
  Synthetic Polynucleotide
taatacgactcactatagggctcacagggctgacgggctccaccccttcgaacagaggagacgaaggatgggagcccgtaacctggcggcagcgcaaaagatg

SEQ ID NO: 165575 - DNA, 103 bp, Artificial Sequence
  Synthetic Polynucleotide
taatacgactcactatagggactgggtgagctcacagggctgacgggctcaacagaggagagagcccatgagccctgtgaacctggcggcagcgcaaaagatg

SEQ ID NO: 165576 - DNA, 103 bp, Artificial Sequence
  Synthetic Polynucleotide
taatacgactcactatagggcgtgggtcagactgggtgagctcacagggcaacagaggagagccctgatggctcacccaaacctggcggcagcgcaaaagatg

SEQ ID NO: 165577 - DNA, 103 bp, Artificial Sequence
  Synthetic Polynucleotide
taatacgactcactatagggagccccttgtcgtgggtcagactgggtgagaacagaggagactcaccatgtctgacccaaacctggcggcagcgcaaaagatg

SEQ ID NO: 165578 - DNA, 103 bp, Artificial Sequence
  Synthetic Polynucleotide
taatacgactcactataggggtgcttggggagccccttgtcgtgggtcagaacagaggagactgaccatggacaaggggaacctggcggcagcgcaaaagatg

SEQ ID NO: 165579 - DNA, 103 bp, Artificial Sequence
  Synthetic Polynucleotide
taatacgactcactatagggcgggcttctcaggctcgggcggcttggcagaacagaggagactgccaatgcgcccgagcaacctggcggcagcgcaaaagatg

SEQ ID NO: 165580 - DNA, 103 bp, Artificial Sequence
  Synthetic Polynucleotide
taatacgactcactataggggctcttccaggtgcttggggagccccttgtaacagaggagaacaaggatgtccccaagcaacctggcggcagcgcaaaagatg

SEQ ID NO: 165581 - DNA, 103 bp, Artificial Sequence
  Synthetic Polynucleotide
taatacgactcactatagggctcttgtcgagctcttccaggtgcttggggaacagaggagaccccaaatgcctggaagaaacctggcggcagcgcaaaagatg

SEQ ID NO: 165582 - DNA, 103 bp, Artificial Sequence
  Synthetic Polynucleotide
taatacgactcactatagggctccaggtggctcttgtcgagctcttccagaacagaggagactggaaatgctcgacaagaacctggcggcagcgcaaaagatg

SEQ ID NO: 165583 - DNA, 103 bp, Artificial Sequence
  Synthetic Polynucleotide
taatacgactcactataggggcagctccccctccaggtggctcttgtcgaaacagaggagatcgacaatggccacctggaacctggcggcagcgcaaaagatg

SEQ ID NO: 165584 - DNA, 103 bp, Artificial Sequence
  Synthetic Polynucleotide
taatacgactcactatagggtgcttgggccgcagctccccctccaggtggaacagaggagaccacctatggggggagctaacctggcggcagcgcaaaagatg

SEQ ID NO: 165585 - DNA, 103 bp, Artificial Sequence
  Synthetic Polynucleotide
taatacgactcactatagggggggcctggctgcttgggccgcagctccccaacagaggagaggggagatgcggcccaagaacctggcggcagcgcaaaagatg

SEQ ID NO: 165586 - DNA, 103 bp, Artificial Sequence
  Synthetic Polynucleotide
taatacgactcactatagggcaagcttcacggggcctggctgcttgggccaacagaggagaggcccaatgagccaggccaacctggcggcagcgcaaaagatg

SEQ ID NO: 165587 - DNA, 103 bp, Artificial Sequence
  Synthetic Polynucleotide
taatacgactcactataggggcctccccgccaagcttcacggggcctggcaacagaggagagccaggatgcgtgaagctaacctggcggcagcgcaaaagatg

SEQ ID NO: 165588 - DNA, 103 bp, Artificial Sequence
  Synthetic Polynucleotide
taatacgactcactataggggaggtgggcggcctccccgccaagcttcacaacagaggagagtgaagatgggcggggagaacctggcggcagcgcaaaagatg

SEQ ID NO: 165589 - DNA, 103 bp, Artificial Sequence
  Synthetic Polynucleotide
taatacgactcactataggggcaggtgtgggaggtgggcggcctccccgcaacagaggagagcggggatgccgcccaccaacctggcggcagcgcaaaagatg

SEQ ID NO: 165590 - DNA, 103 bp, Artificial Sequence
  Synthetic Polynucleotide
taatacgactcactatagggggcggtgacacgggcttctcaggctcgggcaacagaggagagcccgaatgtgagaagccaacctggcggcagcgcaaaagatg

SEQ ID NO: 165591 - DNA, 103 bp, Artificial Sequence
  Synthetic Polynucleotide
taatacgactcactatagggggcagcggccgcaggtgtgggaggtgggcgaacagaggagacgcccaatgcccacacctaacctggcggcagcgcaaaagatg

SEQ ID NO: 165592 - DNA, 103 bp, Artificial Sequence
  Synthetic Polynucleotide
taatacgactcactatagggctggctctcaggcagcggccgcaggtgtggaacagaggagaccacacatgcggccgctgaacctggcggcagcgcaaaagatg

SEQ ID NO: 165593 - DNA, 103 bp, Artificial Sequence
  Synthetic Polynucleotide
taatacgactcactatagggtggacgagggctggctctcaggcagcggccaacagaggagaggccgcatgctgagagccaacctggcggcagcgcaaaagatg

SEQ ID NO: 165594 - DNA, 103 bp, Artificial Sequence
  Synthetic Polynucleotide
taatacgactcactatagggagcagcgggctggacgagggctggctctcaaacagaggagatgagagatggccctcgtcaacctggcggcagcgcaaaagatg

SEQ ID NO: 165595 - DNA, 103 bp, Artificial Sequence
  Synthetic Polynucleotide
taatacgactcactatagggggcggtctggagcagcgggctggacgagggaacagaggagaccctcgatgagcccgctgaacctggcggcagcgcaaaagatg

SEQ ID NO: 165596 - DNA, 103 bp, Artificial Sequence
  Synthetic Polynucleotide
taatacgactcactatagggtgacccctggggcggtctggagcagcgggcaacagaggagagcccgcatgtccagaccgaacctggcggcagcgcaaaagatg

SEQ ID NO: 165597 - DNA, 103 bp, Artificial Sequence
  Synthetic Polynucleotide
taatacgactcactatagggtggtgacctttgacccctggggcggtctggaacagaggagaccagacatgcccaggggtaacctggcggcagcgcaaaagatg

SEQ ID NO: 165598 - DNA, 103 bp, Artificial Sequence
  Synthetic Polynucleotide
taatacgactcactataggggaccacccgctggtgacctttgacccctggaacagaggagaccagggatgaaaggtcacaacctggcggcagcgcaaaagatg

SEQ ID NO: 165599 - DNA, 103 bp, Artificial Sequence
  Synthetic Polynucleotide
taatacgactcactataggggggccagggtgaccacccgctggtgaccttaacagaggagaaaggtcatgagcgggtggaacctggcggcagcgcaaaagatg

SEQ ID NO: 165600 - DNA, 103 bp, Artificial Sequence
  Synthetic Polynucleotide
taatacgactcactatagggctgatgtgctgggccagggtgaccacccgcaacagaggagagcgggtatgcaccctggcaacctggcggcagcgcaaaagatg

SEQ ID NO: 165601 - DNA, 103 bp, Artificial Sequence
  Synthetic Polynucleotide
taatacgactcactatagggctcgatgggcggcggtgacacgggcttctcaacagaggagagagaagatggtgtcaccgaacctggcggcagcgcaaaagatg

SEQ ID NO: 165602 - DNA, 103 bp, Artificial Sequence
  Synthetic Polynucleotide
taatacgactcactataggggatgacctcactgatgtgctgggccagggtaacagaggagaaccctgatgcagcacatcaacctggcggcagcgcaaaagatg

SEQ ID NO: 165603 - DNA, 103 bp, Artificial Sequence
  Synthetic Polynucleotide
taatacgactcactatagggagtcctgtgtgatgacctcactgatgtgctaacagaggagaagcacaatggtgaggtcaaacctggcggcagcgcaaaagatg

SEQ ID NO: 165604 - DNA, 103 bp, Artificial Sequence
  Synthetic Polynucleotide
taatacgactcactatagggtgccgggtgtagtcctgtgtgatgacctcaaacagaggagatgaggtatgcacacaggaaacctggcggcagcgcaaaagatg

SEQ ID NO: 165605 - DNA, 103 bp, Artificial Sequence
  Synthetic Polynucleotide
taatacgactcactatagggctgtgggtggtgccgggtgtagtcctgtgtaacagaggagaacacagatgtacacccggaacctggcggcagcgcaaaagatg

SEQ ID NO: 165606 - DNA, 103 bp, Artificial Sequence
  Synthetic Polynucleotide
taatacgactcactatagggcgctgagctgctgtgggtggtgccgggtgtaacagaggagaacacccatgaccacccacaacctggcggcagcgcaaaagatg

SEQ ID NO: 165607 - DNA, 103 bp, Artificial Sequence
  Synthetic Polynucleotide
taatacgactcactatagggggcaggggtgcgctgagctgctgtgggtggaacagaggagaccacccatggcagctcagaacctggcggcagcgcaaaagatg

SEQ ID NO: 165608 - DNA, 103 bp, Artificial Sequence
  Synthetic Polynucleotide
taatacgactcactataggggaggggggcgggcaggggtgcgctgagctgaacagaggagacagctcatggcacccctgaacctggcggcagcgcaaaagatg

SEQ ID NO: 165609 - DNA, 103 bp, Artificial Sequence
  Synthetic Polynucleotide
taatacgactcactatagggggaaggagtagaggggggcgggcaggggtgaacagaggagacaccccatgccgccccccaacctggcggcagcgcaaaagatg

SEQ ID NO: 165610 - DNA, 103 bp, Artificial Sequence
  Synthetic Polynucleotide
taatacgactcactatagggctggccccagggaaggagtagaggggggcgaacagaggagacgccccatgctactccttaacctggcggcagcgcaaaagatg

SEQ ID NO: 165611 - DNA, 103 bp, Artificial Sequence
  Synthetic Polynucleotide
taatacgactcactataggggacggggcagctggccccagggaaggagtaaacagaggagatactccatgcctggggccaacctggcggcagcgcaaaagatg

SEQ ID NO: 165612 - DNA, 103 bp, Artificial Sequence
  Synthetic Polynucleotide
taatacgactcactatagggggtgcttcgactcgatgggcggcggtgacaaacagaggagatgtcacatgcgcccatcgaacctggcggcagcgcaaaagatg

SEQ ID NO: 165613 - DNA, 103 bp, Artificial Sequence
  Synthetic Polynucleotide
taatacgactcactatagggggaggtccaggacggggcagctggccccagaacagaggagactggggatggctgccccgaacctggcggcagcgcaaaagatg

SEQ ID NO: 165614 - DNA, 103 bp, Artificial Sequence
  Synthetic Polynucleotide
taatacgactcactatagggggtgggcggcggaggtccaggacggggcagaacagaggagactgcccatgcctggacctaacctggcggcagcgcaaaagatg

SEQ ID NO: 165615 - DNA, 103 bp, Artificial Sequence
  Synthetic Polynucleotide
taatacgactcactataggggaggtcactgggtgggcggcggaggtccagaacagaggagactggacatgcgccgcccaaacctggcggcagcgcaaaagatg

SEQ ID NO: 165616 - DNA, 103 bp, Artificial Sequence
  Synthetic Polynucleotide
taatacgactcactataggggcgggaggtagaggtcactgggtgggcggcaacagaggagagccgccatgccagtgaccaacctggcggcagcgcaaaagatg

SEQ ID NO: 165617 - DNA, 103 bp, Artificial Sequence
  Synthetic Polynucleotide
taatacgactcactatagggtggtccgggggcgggaggtagaggtcactgaacagaggagacagtgaatgctacctcccaacctggcggcagcgcaaaagatg

SEQ ID NO: 165618 - DNA, 103 bp, Artificial Sequence
  Synthetic Polynucleotide
taatacgactcactatagggcggggcaccatggtccgggggcgggaggtaaacagaggagatacctcatgcccccggacaacctggcggcagcgcaaaagatg

SEQ ID NO: 165619 - DNA, 103 bp, Artificial Sequence
  Synthetic Polynucleotide
taatacgactcactatagggagccacgggccggggcaccatggtccggggaacagaggagaccccggatgatggtgcccaacctggcggcagcgcaaaagatg

SEQ ID NO: 165620 - DNA, 103 bp, Artificial Sequence
  Synthetic Polynucleotide
taatacgactcactatagggctgtggggggagccacgggccggggcaccaaacagaggagatggtgcatgggcccgtggaacctggcggcagcgcaaaagatg

SEQ ID NO: 165621 - DNA, 103 bp, Artificial Sequence
  Synthetic Polynucleotide
taatacgactcactataggggcccccttcgctgtggggggagccacgggcaacagaggagagcccgtatgtccccccacaacctggcggcagcgcaaaagatg

SEQ ID NO: 165622 - DNA, 103 bp, Artificial Sequence
  Synthetic Polynucleotide
taatacgactcactataggggagacctcttgcccccttcgctgtggggggaacagaggagaccccccatggcgaaggggaacctggcggcagcgcaaaagatg

SEQ ID NO: 165623 - DNA, 103 bp, Artificial Sequence
  Synthetic Polynucleotide
taatacgactcactatagggaccaggctgcggtgcttcgactcgatgggcaacagaggagagcccatatggtcgaagcaaacctggcggcagcgcaaaagatg

SEQ ID NO: 165624 - DNA, 103 bp, Artificial Sequence
  Synthetic Polynucleotide
taatacgactcactatagggtttggctctggagacctcttgcccccttcgaacagaggagacgaaggatgcaagaggtcaacctggcggcagcgcaaaagatg

SEQ ID NO: 165625 - DNA, 103 bp, Artificial Sequence
  Synthetic Polynucleotide
taatacgactcactatagggcgacgtcttgtttggctctggagacctcttaacagaggagaaagaggatgccagagccaaacctggcggcagcgcaaaagatg

SEQ ID NO: 165626 - DNA, 103 bp, Artificial Sequence
  Synthetic Polynucleotide
taatacgactcactatagggcacccaagaccgacgtcttgtttggctctgaacagaggagacagagcatgacaagacgtaacctggcggcagcgcaaaagatg

SEQ ID NO: 165627 - DNA, 103 bp, Artificial Sequence
  Synthetic Polynucleotide
taatacgactcactatagggtcctcaccaccacccaagaccgacgtcttgaacagaggagacaagacatgggtcttgggaacctggcggcagcgcaaaagatg

SEQ ID NO: 165628 - DNA, 103 bp, Artificial Sequence
  Synthetic Polynucleotide
taatacgactcactatagggttcaataccgtcctcaccaccacccaagacaacagaggagagtcttgatgggtggtgagaacctggcggcagcgcaaaagatg

SEQ ID NO: 165629 - DNA, 103 bp, Artificial Sequence
  Synthetic Polynucleotide
taatacgactcactataggggggacacaggttcaataccgtcctcaccacaacagaggagagtggtgatgacggtattgaacctggcggcagcgcaaaagatg

SEQ ID NO: 165630 - DNA, 103 bp, Artificial Sequence
  Synthetic Polynucleotide
taatacgactcactatagggccctccggtggggacacaggttcaataccgaacagaggagacggtatatgacctgtgtcaacctggcggcagcgcaaaagatg

SEQ ID NO: 165631 - DNA, 103 bp, Artificial Sequence
  Synthetic Polynucleotide
taatacgactcactatagggctccgtcatgccctccggtggggacacaggaacagaggagacctgtgatgccaccggagaacctggcggcagcgcaaaagatg

SEQ ID NO: 165632 - DNA, 103 bp, Artificial Sequence
  Synthetic Polynucleotide
taatacgactcactatagggagtgccctggctccgtcatgccctccggtgaacagaggagacaccggatggcatgacggaacctggcggcagcgcaaaagatg

SEQ ID NO: 165633 - DNA, 103 bp, Artificial Sequence
  Synthetic Polynucleotide
taatacgactcactataggggcactccgggagtgccctggctccgtcatgaacagaggagacatgacatggccagggcaaacctggcggcagcgcaaaagatg

SEQ ID NO: 165634 - DNA, 103 bp, Artificial Sequence
  Synthetic Polynucleotide
taatacgactcactataggggatgatctgcaccaggctgcggtgcttcgaaacagaggagatcgaagatgcgcagcctgaacctggcggcagcgcaaaagatg

SEQ ID NO: 165635 - DNA, 103 bp, Artificial Sequence
  Synthetic Polynucleotide
taatacgactcactatagggcgggtacacagcactccgggagtgccctggaacagaggagaccagggatgtcccggagtaacctggcggcagcgcaaaagatg

SEQ ID NO: 165636 - DNA, 103 bp, Artificial Sequence
  Synthetic Polynucleotide
taatacgactcactatagggggtacagcagcgggtacacagcactccgggaacagaggagacccggaatgctgtgtaccaacctggcggcagcgcaaaagatg

SEQ ID NO: 165637 - DNA, 103 bp, Artificial Sequence
  Synthetic Polynucleotide
taatacgactcactatagggtccccatcccggtacagcagcgggtacacaaacagaggagatgtgtaatggctgctgtaaacctggcggcagcgcaaaagatg

SEQ ID NO: 165638 - DNA, 103 bp, Artificial Sequence
  Synthetic Polynucleotide
taatacgactcactatagggctccgtctgttccccatcccggtacagcagaacagaggagactgctgatgcgggatgggaacctggcggcagcgcaaaagatg

SEQ ID NO: 165639 - DNA, 103 bp, Artificial Sequence
  Synthetic Polynucleotide
taatacgactcactatagggtcctgctgggctccgtctgttccccatcccaacagaggagagggatgatgaacagacggaacctggcggcagcgcaaaagatg

SEQ ID NO: 165640 - DNA, 103 bp, Artificial Sequence
  Synthetic Polynucleotide
taatacgactcactatagggttggagcccatcctgctgggctccgtctgtaacagaggagaacagacatggcccagcagaacctggcggcagcgcaaaagatg

SEQ ID NO: 165641 - DNA, 103 bp, Artificial Sequence
  Synthetic Polynucleotide
taatacgactcactataggggcctggagacttggagcccatcctgctgggaacagaggagacccagcatgatgggctccaacctggcggcagcgcaaaagatg

SEQ ID NO: 165642 - DNA, 103 bp, Artificial Sequence
  Synthetic Polynucleotide
taatacgactcactatagggggctggtgttgcctggagacttggagcccaaacagaggagatgggctatgagtctccagaacctggcggcagcgcaaaagatg

SEQ ID NO: 165643 - DNA, 103 bp, Artificial Sequence
  Synthetic Polynucleotide
taatacgactcactataggggctggcggctggctggtgttgcctggagacaacagaggagagtctccatgcaacaccagaacctggcggcagcgcaaaagatg

SEQ ID NO: 165644 - DNA, 103 bp, Artificial Sequence
  Synthetic Polynucleotide
taatacgactcactataggggctgaagaaggctggcggctggctggtgttaacagaggagaaacaccatgcagccgccaaacctggcggcagcgcaaaagatg

SEQ ID NO: 165645 - DNA, 103 bp, Artificial Sequence
  Synthetic Polynucleotide
taatacgactcactatagggtctcgtcgtagatgatctgcaccaggctgcaacagaggagagcagccatgtgcagatcaaacctggcggcagcgcaaaagatg

SEQ ID NO: 165646 - DNA, 103 bp, Artificial Sequence
  Synthetic Polynucleotide
taatacgactcactatagggcggtcagcttgctgaagaaggctggcggctaacagaggagaagccgcatgccttcttcaaacctggcggcagcgcaaaagatg

SEQ ID NO: 165647 - DNA, 103 bp, Artificial Sequence
  Synthetic Polynucleotide
taatacgactcactataggggagttgctctcggtcagcttgctgaagaagaacagaggagacttcttatgcaagctgacaacctggcggcagcgcaaaagatg

SEQ ID NO: 165648 - DNA, 103 bp, Artificial Sequence
  Synthetic Polynucleotide
taatacgactcactataggggaccatggcggagttgctctcggtcagcttaacagaggagaaagctgatggagagcaacaacctggcggcagcgcaaaagatg

SEQ ID NO: 165649 - DNA, 103 bp, Artificial Sequence
  Synthetic Polynucleotide
taatacgactcactatagggtcttggacttgaccatggcggagttgctctaacagaggagaagagcaatgccgccatggaacctggcggcagcgcaaaagatg

SEQ ID NO: 165650 - DNA, 103 bp, Artificial Sequence
  Synthetic Polynucleotide
taatacgactcactatagggatctcttgcttcttggacttgaccatggcgaacagaggagacgccatatgcaagtccaaaacctggcggcagcgcaaaagatg

SEQ ID NO: 165651 - DNA, 103 bp, Artificial Sequence
  Synthetic Polynucleotide
taatacgactcactatagggcttcttgttgatctcttgcttcttggacttaacagaggagaaagtccatgaagcaagagaacctggcggcagcgcaaaagatg

SEQ ID NO: 165652 - DNA, 103 bp, Artificial Sequence
  Synthetic Polynucleotide
taatacgactcactataggggggtgttcagcttcttgttgatctcttgctaacagaggagaagcaagatgtcaacaagaaacctggcggcagcgcaaaagatg

SEQ ID NO: 165653 - DNA, 103 bp, Artificial Sequence
  Synthetic Polynucleotide
taatacgactcactatagggttccggttgtgggtgttcagcttcttgttgaacagaggagacaacaaatggctgaacacaacctggcggcagcgcaaaagatg

SEQ ID NO: 165654 - DNA, 103 bp, Artificial Sequence
  Synthetic Polynucleotide
taatacgactcactatagggttcaggctcattccggttgtgggtgttcagaacagaggagactgaacatgcacaaccggaacctggcggcagcgcaaaagatg

SEQ ID NO: 165655 - DNA, 103 bp, Artificial Sequence
  Synthetic Polynucleotide
taatacgactcactatagggtgatattgtattcaggctcattccggttgtaacagaggagaacaaccatgatgagcctgaacctggcggcagcgcaaaagatg

SEQ ID NO: 165656 - DNA, 103 bp, Artificial Sequence
  Synthetic Polynucleotide
taatacgactcactatagggttcttccggttctcgtcgtagatgatctgcaacagaggagagcagatatgctacgacgaaacctggcggcagcgcaaaagatg

SEQ ID NO: 165657 - DNA, 103 bp, Artificial Sequence
  Synthetic Polynucleotide
taatacgactcactatagggccaggctggctgatattgtattcaggctcaaacagaggagatgagccatgatacaatataacctggcggcagcgcaaaagatg

SEQ ID NO: 165658 - DNA, 103 bp, Artificial Sequence
  Synthetic Polynucleotide
taatacgactcactataggggatctccgtcccaggctggctgatattgtaaacagaggagatacaatatgagccagcctaacctggcggcagcgcaaaagatg

SEQ ID NO: 165659 - DNA, 103 bp, Artificial Sequence
  Synthetic Polynucleotide
taatacgactcactataggggcatattgaagatctccgtcccaggctggcaacagaggagagccagcatgggacggagaaacctggcggcagcgcaaaagatg

SEQ ID NO: 165660 - DNA, 103 bp, Artificial Sequence
  Synthetic Polynucleotide
taatacgactcactataggggtgatggcgggcatattgaagatctccgtcaacagaggagagacggaatgcttcaatataacctggcggcagcgcaaaagatg

SEQ ID NO: 165661 - DNA, 103 bp, Artificial Sequence
  Synthetic Polynucleotide
taatacgactcactataggggcctgttccggtgatggcgggcatattgaaaacagaggagattcaatatgcccgccatcaacctggcggcagcgcaaaagatg

SEQ ID NO: 165662 - DNA, 103 bp, Artificial Sequence
  Synthetic Polynucleotide
taatacgactcactatagggaggtcataaggcctgttccggtgatggcggaacagaggagaccgccaatgccggaacagaacctggcggcagcgcaaaagatg

SEQ ID NO: 165663 - DNA, 103 bp, Artificial Sequence
  Synthetic Polynucleotide
taatacgactcactatagggtggcttctataggtcataaggcctgttccgaacagaggagacggaacatgccttatgacaacctggcggcagcgcaaaagatg

SEQ ID NO: 165664 - DNA, 103 bp, Artificial Sequence
  Synthetic Polynucleotide
taatacgactcactatagggctgcaccgcctggcttctataggtcataagaacagaggagacttatgatgtatagaagcaacctggcggcagcgcaaaagatg

SEQ ID NO: 165665 - DNA, 103 bp, Artificial Sequence
  Synthetic Polynucleotide
taatacgactcactatagggtggcatgttcctgcaccgcctggcttctataacagaggagaatagaaatgaggcggtgcaacctggcggcagcgcaaaagatg

SEQ ID NO: 165666 - DNA, 103 bp, Artificial Sequence
  Synthetic Polynucleotide
taatacgactcactatagggatgttggtgctggcatgttcctgcaccgccaacagaggagaggcggtatgggaacatgcaacctggcggcagcgcaaaagatg

SEQ ID NO: 165667 - DNA, 103 bp, Artificial Sequence
  Synthetic Polynucleotide
taatacgactcactataggggatctgcactgggtaggaaaggctgtggggaacagaggagaccccacatgctttcctacaacctggcggcagcgcaaaagatg

SEQ ID NO: 165668 - DNA, 103 bp, Artificial Sequence
  Synthetic Polynucleotide
taatacgactcactatagggagcttcagccttcttccggttctcgtcgtaaacagaggagatacgacatgaaccggaagaacctggcggcagcgcaaaagatg

SEQ ID NO: 165669 - DNA, 103 bp, Artificial Sequence
  Synthetic Polynucleotide
taatacgactcactatagggctccagccccatgttggtgctggcatgttcaacagaggagagaacatatgagcaccaacaacctggcggcagcgcaaaagatg

SEQ ID NO: 165670 - DNA, 103 bp, Artificial Sequence
  Synthetic Polynucleotide
taatacgactcactatagggtaattatggcctccagccccatgttggtgcaacagaggagagcaccaatgtggggctggaacctggcggcagcgcaaaagatg

SEQ ID NO: 165671 - DNA, 103 bp, Artificial Sequence
  Synthetic Polynucleotide
taatacgactcactatagggagtgcctttctaattatggcctccagccccaacagaggagaggggctatgggccataataacctggcggcagcgcaaaagatg

SEQ ID NO: 165672 - DNA, 103 bp, Artificial Sequence
  Synthetic Polynucleotide
taatacgactcactatagggtttacccatgagtgcctttctaattatggcaacagaggagagccataatgagaaaggcaaacctggcggcagcgcaaaagatg

SEQ ID NO: 165673 - DNA, 103 bp, Artificial Sequence
  Synthetic Polynucleotide
taatacgactcactatagggactggtcatatttacccatgagtgcctttcaacagaggagagaaaggatgtcatgggtaaacctggcggcagcgcaaaagatg

SEQ ID NO: 165674 - DNA, 103 bp, Artificial Sequence
  Synthetic Polynucleotide
taatacgactcactataggggactcttcccactggtcatatttacccatgaacagaggagacatgggatgatatgaccaaacctggcggcagcgcaaaagatg

SEQ ID NO: 165675 - DNA, 103 bp, Artificial Sequence
  Synthetic Polynucleotide
taatacgactcactataggggagcggcggggactcttcccactggtcataaacagaggagatatgacatgtgggaagagaacctggcggcagcgcaaaagatg

SEQ ID NO: 165676 - DNA, 103 bp, Artificial Sequence
  Synthetic Polynucleotide
taatacgactcactatagggcattggcgctgagcggcggggactcttcccaacagaggagagggaagatgccccgccgcaacctggcggcagcgcaaaagatg

SEQ ID NO: 165677 - DNA, 103 bp, Artificial Sequence
  Synthetic Polynucleotide
taatacgactcactataggggggttaaaagcattggcgctgagcggcgggaacagaggagacccgccatgcagcgccaaaacctggcggcagcgcaaaagatg

SEQ ID NO: 165678 - DNA, 103 bp, Artificial Sequence
  Synthetic Polynucleotide
taatacgactcactatagggggcattcagagggttaaaagcattggcgctaacagaggagaagcgccatggcttttaacaacctggcggcagcgcaaaagatg

SEQ ID NO: 165679 - DNA, 103 bp, Artificial Sequence
  Synthetic Polynucleotide
taatacgactcactatagggtccgatgtgcagcttcagccttcttccggtaacagaggagaaccggaatgaggctgaagaacctggcggcagcgcaaaagatg

SEQ ID NO: 165680 - DNA, 103 bp, Artificial Sequence
  Synthetic Polynucleotide
taatacgactcactatagggggctggcactggcattcagagggttaaaagaacagaggagacttttaatgctctgaatgaacctggcggcagcgcaaaagatg

SEQ ID NO: 165681 - DNA, 103 bp, Artificial Sequence
  Synthetic Polynucleotide
taatacgactcactataggggcagcgggcaggctggcactggcattcagaaacagaggagatctgaaatgcagtgccagaacctggcggcagcgcaaaagatg

SEQ ID NO: 165682 - DNA, 103 bp, Artificial Sequence
  Synthetic Polynucleotide
taatacgactcactatagggtatgggcatagcagcgggcaggctggcactaacagaggagaagtgccatgctgcccgctaacctggcggcagcgcaaaagatg

SEQ ID NO: 165683 - DNA, 103 bp, Artificial Sequence
  Synthetic Polynucleotide
taatacgactcactatagggcagcagcggttatgggcatagcagcgggcaaacagaggagatgcccgatgctatgcccaaacctggcggcagcgcaaaagatg

SEQ ID NO: 165684 - DNA, 103 bp, Artificial Sequence
  Synthetic Polynucleotide
taatacgactcactatagggctccgtccgtcagcagcggttatgggcataaacagaggagatatgccatgaaccgctgcaacctggcggcagcgcaaaagatg

SEQ ID NO: 165685 - DNA, 103 bp, Artificial Sequence
  Synthetic Polynucleotide
taatacgactcactatagggtgtgtggtcactccgtccgtcagcagcggtaacagaggagaaccgctatggacggacggaacctggcggcagcgcaaaagatg

SEQ ID NO: 165686 - DNA, 103 bp, Artificial Sequence
  Synthetic Polynucleotide
taatacgactcactataggggcgaggtgagtgtgtggtcactccgtccgtaacagaggagaacggacatggtgaccacaaacctggcggcagcgcaaaagatg

SEQ ID NO: 165687 - DNA, 103 bp, Artificial Sequence
  Synthetic Polynucleotide
taatacgactcactatagggccgccacctggcgaggtgagtgtgtggtcaaacagaggagatgaccaatgactcacctcaacctggcggcagcgcaaaagatg

SEQ ID NO: 165688 - DNA, 103 bp, Artificial Sequence
  Synthetic Polynucleotide
taatacgactcactatagggggccttcccgccgccacctggcgaggtgagaacagaggagactcaccatgccaggtggcaacctggcggcagcgcaaaagatg

SEQ ID NO: 165689 - DNA, 103 bp, Artificial Sequence
  Synthetic Polynucleotide
taatacgactcactatagggcagagaccttggccttcccgccgccacctgaacagaggagacaggtgatggcgggaaggaacctggcggcagcgcaaaagatg

SEQ ID NO: 165690 - DNA, 103 bp, Artificial Sequence
  Synthetic Polynucleotide
taatacgactcactatagggccttccagaatccgatgtgcagcttcagccaacagaggagaggctgaatgtgcacatcgaacctggcggcagcgcaaaagatg

SEQ ID NO: 165691 - DNA, 103 bp, Artificial Sequence
  Synthetic Polynucleotide
taatacgactcactatagggctgggtctgccagagaccttggccttcccgaacagaggagacgggaaatgcaaggtctcaacctggcggcagcgcaaaagatg

SEQ ID NO: 165692 - DNA, 103 bp, Artificial Sequence
  Synthetic Polynucleotide
taatacgactcactatagggttttcggctgctgggtctgccagagaccttaacagaggagaaaggtcatgggcagacccaacctggcggcagcgcaaaagatg

SEQ ID NO: 165693 - DNA, 103 bp, Artificial Sequence
  Synthetic Polynucleotide
taatacgactcactataggggggacttggcttttcggctgctgggtctgcaacagaggagagcagacatggcagccgaaaacctggcggcagcgcaaaagatg

SEQ ID NO: 165694 - DNA, 103 bp, Artificial Sequence
  Synthetic Polynucleotide
taatacgactcactatagggcccggggccggggacttggcttttcggctgaacagaggagacagccgatgagccaagtcaacctggcggcagcgcaaaagatg

SEQ ID NO: 165695 - DNA, 103 bp, Artificial Sequence
  Synthetic Polynucleotide
taatacgactcactatagggagatgccaggcccggggccggggacttggcaacagaggagagccaagatgccggccccgaacctggcggcagcgcaaaagatg

SEQ ID NO: 165696 - DNA, 103 bp, Artificial Sequence
  Synthetic Polynucleotide
taatacgactcactataggggccggtccccagatgccaggcccggggccgaacagaggagacggcccatggcctggcataacctggcggcagcgcaaaagatg

SEQ ID NO: 165697 - DNA, 103 bp, Artificial Sequence
  Synthetic Polynucleotide
taatacgactcactatagggacagagggtggccggtccccagatgccaggaacagaggagacctggcatgtggggaccgaacctggcggcagcgcaaaagatg

SEQ ID NO: 165698 - DNA, 103 bp, Artificial Sequence
  Synthetic Polynucleotide
taatacgactcactatagggcactgaggagacagagggtggccggtccccaacagaggagaggggacatgccaccctctaacctggcggcagcgcaaaagatg

SEQ ID NO: 165699 - DNA, 103 bp, Artificial Sequence
  Synthetic Polynucleotide
taatacgactcactatagggcctccgagtgcactgaggagacagagggtgaacagaggagacaccctatgtctcctcagaacctggcggcagcgcaaaagatg

SEQ ID NO: 165700 - DNA, 103 bp, Artificial Sequence
  Synthetic Polynucleotide
taatacgactcactatagggttgcagtctccctccgagtgcactgaggagaacagaggagactcctcatggcactcggaaacctggcggcagcgcaaaagatg

SEQ ID NO: 165701 - DNA, 103 bp, Artificial Sequence
  Synthetic Polynucleotide
taatacgactcactataggggggccccaggccttccagaatccgatgtgcaacagaggagagcacatatgattctggaaaacctggcggcagcgcaaaagatg

SEQ ID NO: 165702 - DNA, 103 bp, Artificial Sequence
  Synthetic Polynucleotide
taatacgactcactatagggcgtccggcggttgcagtctccctccgagtgaacagaggagacactcgatgggagactgcaacctggcggcagcgcaaaagatg

SEQ ID NO: 165703 - DNA, 103 bp, Artificial Sequence
  Synthetic Polynucleotide
taatacgactcactatagggtggtgagcggcgtccggcggttgcagtctcaacagaggagagagactatgaccgccggaaacctggcggcagcgcaaaagatg

SEQ ID NO: 165704 - DNA, 103 bp, Artificial Sequence
  Synthetic Polynucleotide
taatacgactcactatagggcacacgcggttggtgagcggcgtccggcggaacagaggagaccgccgatggccgctcacaacctggcggcagcgcaaaagatg

SEQ ID NO: 165705 - DNA, 103 bp, Artificial Sequence
  Synthetic Polynucleotide
taatacgactcactatagggcctgtcctcccacacgcggttggtgagcggaacagaggagaccgctcatgaaccgcgtgaacctggcggcagcgcaaaagatg

SEQ ID NO: 165706 - DNA, 103 bp, Artificial Sequence
  Synthetic Polynucleotide
taatacgactcactatagggcggacgagggcctgtcctcccacacgcggtaacagaggagaaccgcgatggggaggacaaacctggcggcagcgcaaaagatg

SEQ ID NO: 165707 - DNA, 103 bp, Artificial Sequence
  Synthetic Polynucleotide
taatacgactcactataggggtggaacctgcggacgagggcctgtcctccaacagaggagaggaggaatggccctcgtcaacctggcggcagcgcaaaagatg

SEQ ID NO: 165708 - DNA, 103 bp, Artificial Sequence
  Synthetic Polynucleotide
taatacgactcactatagggggggaatggcgtggaacctgcggacgagggaacagaggagaccctcgatggcaggttccaacctggcggcagcgcaaaagatg

SEQ ID NO: 165709 - DNA, 103 bp, Artificial Sequence
  Synthetic Polynucleotide
taatacgactcactataggggggggttgtaggggaatggcgtggaacctgaacagaggagacaggttatgcgccattccaacctggcggcagcgcaaaagatg

SEQ ID NO: 165710 - DNA, 103 bp, Artificial Sequence
  Synthetic Polynucleotide
taatacgactcactatagggcgcatgatcagggggttgtaggggaatggcaacagaggagagccattatgctacaacccaacctggcggcagcgcaaaagatg

SEQ ID NO: 165711 - DNA, 103 bp, Artificial Sequence
  Synthetic Polynucleotide
taatacgactcactatagggcgcctgcagccgcatgatcagggggttgtaaacagaggagatacaacatgctgatcatgaacctggcggcagcgcaaaagatg

SEQ ID NO: 165712 - DNA, 103 bp, Artificial Sequence
  Synthetic Polynucleotide
taatacgactcactataggggctccacctggggccccaggccttccagaaaacagaggagattctggatggcctggggcaacctggcggcagcgcaaaagatg

SEQ ID NO: 165713 - DNA, 103 bp, Artificial Sequence
  Synthetic Polynucleotide
taatacgactcactatagggccatgacacccgcctgcagccgcatgatcaaacagaggagatgatcaatgggctgcaggaacctggcggcagcgcaaaagatg

SEQ ID NO: 165714 - DNA, 103 bp, Artificial Sequence
  Synthetic Polynucleotide
taatacgactcactatagggggtggggaagccatgacacccgcctgcagcaacagaggagagctgcaatggggtgtcataacctggcggcagcgcaaaagatg

SEQ ID NO: 165715 - DNA, 103 bp, Artificial Sequence
  Synthetic Polynucleotide
taatacgactcactataggggcccggtgggggtggggaagccatgacaccaacagaggagaggtgtcatggcttccccaaacctggcggcagcgcaaaagatg

SEQ ID NO: 165716 - DNA, 103 bp, Artificial Sequence
  Synthetic Polynucleotide
taatacgactcactatagggccgcggggaggcccggtgggggtggggaagaacagaggagacttcccatgccccaccggaacctggcggcagcgcaaaagatg

SEQ ID NO: 165717 - DNA, 103 bp, Artificial Sequence
  Synthetic Polynucleotide
taatacgactcactatagggggcccgctgcccgcggggaggcccggtgggaacagaggagacccaccatgcctccccgcaacctggcggcagcgcaaaagatg

SEQ ID NO: 165718 - DNA, 103 bp, Artificial Sequence
  Synthetic Polynucleotide
taatacgactcactataggggccagcgaggggcccgctgcccgcggggagaacagaggagactccccatgggcagcgggaacctggcggcagcgcaaaagatg

SEQ ID NO: 165719 - DNA, 103 bp, Artificial Sequence
  Synthetic Polynucleotide
taatacgactcactatagggcgtggtgggggccagcgaggggcccgctgcaacagaggagagcagcgatgccctcgctgaacctggcggcagcgcaaaagatg

SEQ ID NO: 165720 - DNA, 103 bp, Artificial Sequence
  Synthetic Polynucleotide
taatacgactcactatagggtcgtcccaggcgtggtgggggccagcgaggaacagaggagacctcgcatgcccccaccaaacctggcggcagcgcaaaagatg

SEQ ID NO: 165721 - DNA, 103 bp, Artificial Sequence
  Synthetic Polynucleotide
taatacgactcactatagggcttgggctcctcgtcccaggcgtggtggggaacagaggagaccccacatggcctgggacaacctggcggcagcgcaaaagatg

SEQ ID NO: 165722 - DNA, 103 bp, Artificial Sequence
  Synthetic Polynucleotide
taatacgactcactatagggagagcagtggcttgggctcctcgtcccaggaacagaggagacctgggatgaggagcccaaacctggcggcagcgcaaaagatg

SEQ ID NO: 165723 - DNA, 103 bp, Artificial Sequence
  Synthetic Polynucleotide
taatacgactcactatagggtacagcggcagctccacctggggccccaggaacagaggagacctgggatgccaggtggaaacctggcggcagcgcaaaagatg

SEQ ID NO: 165724 - DNA, 103 bp, Artificial Sequence
  Synthetic Polynucleotide
taatacgactcactatagggtactgcgagcagagcagtggcttgggctccaacagaggagaggagccatggccactgctaacctggcggcagcgcaaaagatg

SEQ ID NO: 165725 - DNA, 103 bp, Artificial Sequence
  Synthetic Polynucleotide
taatacgactcactataggggagtgtctcgtactgcgagcagagcagtggaacagaggagaccactgatgtgctcgcagaacctggcggcagcgcaaaagatg

SEQ ID NO: 165726 - DNA, 103 bp, Artificial Sequence
  Synthetic Polynucleotide
taatacgactcactatagggcgctgtcggagagtgtctcgtactgcgagcaacagaggagagctcgcatgacgagacacaacctggcggcagcgcaaaagatg

SEQ ID NO: 165727 - DNA, 103 bp, Artificial Sequence
  Synthetic Polynucleotide
taatacgactcactataggggggctggttgtacagcggcagctccacctgaacagaggagacaggtgatgctgccgctgaacctggcggcagcgcaaaagatg

SEQ ID NO: 165728 - DNA, 103 bp, Artificial Sequence
  Synthetic Polynucleotide
taatacgactcactataggggggtgtcggagggctggttgtacagcggcaaacagaggagatgccgcatgacaaccagcaacctggcggcagcgcaaaagatg

SEQ ID NO: 165729 - DNA, 103 bp, Artificial Sequence
  Synthetic Polynucleotide
taatacgactcactatagggtgatactgccgggtgtcggagggctggttgaacagaggagacaaccaatgctccgacacaacctggcggcagcgcaaaagatg

SEQ ID NO: 165730 - DNA, 103 bp, Artificial Sequence
  Synthetic Polynucleotide
taatacgactcactataggggatgttctcatgatactgccgggtgtcggaaacagaggagatccgacatgcggcagtataacctggcggcagcgcaaaagatg

SEQ ID NO: 165731 - DNA, 103 bp, Artificial Sequence
  Synthetic Polynucleotide
taatacgactcactataggggcgtccgggcgatctgcactgggtaggaaaaacagaggagatttcctatgcagtgcagaaacctggcggcagcgcaaaagatg

SEQ ID NO: 165732 - DNA, 103 bp, Artificial Sequence
  Synthetic Polynucleotide
taatacgactcactatagggggtttattttgatgttctcatgatactgccaacagaggagaggcagtatgatgagaacaaacctggcggcagcgcaaaagatg

SEQ ID NO: 165733 - DNA, 103 bp, Artificial Sequence
  Synthetic Polynucleotide
taatacgactcactatagggcgcatcgcctggtttattttgatgttctcaaacagaggagatgagaaatgcaaaataaaaacctggcggcagcgcaaaagatg

SEQ ID NO: 165734 - DNA, 103 bp, Artificial Sequence
  Synthetic Polynucleotide
taatacgactcactatagggtagcttcttccgcatcgcctggtttattttaacagaggagaaaaataatgcaggcgatgaacctggcggcagcgcaaaagatg

SEQ ID NO: 165735 - DNA, 103 bp, Artificial Sequence
  Synthetic Polynucleotide
taatacgactcactatagggagtacaagattagcttcttccgcatcgcctaacagaggagaaggcgaatgggaagaagcaacctggcggcagcgcaaaagatg

SEQ ID NO: 165736 - DNA, 103 bp, Artificial Sequence
  Synthetic Polynucleotide
taatacgactcactatagggctcctcttgaagtacaagattagcttcttcaacagaggagagaagaaatgaatcttgtaaacctggcggcagcgcaaaagatg

SEQ ID NO: 165737 - DNA, 103 bp, Artificial Sequence
  Synthetic Polynucleotide
taatacgactcactatagggagcgtgattcctcctcttgaagtacaagataacagaggagaatcttgatgttcaagaggaacctggcggcagcgcaaaagatg

SEQ ID NO: 165738 - DNA, 103 bp, Artificial Sequence
  Synthetic Polynucleotide
taatacgactcactatagggattgtttccgagcgtgattcctcctcttgaaacagaggagatcaagaatgggaatcacgaacctggcggcagcgcaaaagatg

SEQ ID NO: 165739 - DNA, 103 bp, Artificial Sequence
  Synthetic Polynucleotide
taatacgactcactatagggttctgctcccattgtttccgagcgtgattcaacagaggagagaatcaatgtcggaaacaaacctggcggcagcgcaaaagatg

SEQ ID NO: 165740 - DNA, 103 bp, Artificial Sequence
  Synthetic Polynucleotide
taatacgactcactatagggctggcagaacttctgctcccattgtttccgaacagaggagacggaaaatgtgggagcagaacctggcggcagcgcaaaagatg

SEQ ID NO: 165741 - DNA, 103 bp, Artificial Sequence
  Synthetic Polynucleotide
taatacgactcactatagggggtcatagcgctggcagaacttctgctcccaacagaggagagggagcatgagttctgccaacctggcggcagcgcaaaagatg

SEQ ID NO: 165742 - DNA, 103 bp, Artificial Sequence
  Synthetic Polynucleotide
taatacgactcactatagggacgtccgtgtgcgtccgggcgatctgcactaacagaggagaagtgcaatgcgcccggacaacctggcggcagcgcaaaagatg

SEQ ID NO: 165743 - DNA, 103 bp, Artificial Sequence
  Synthetic Polynucleotide
taatacgactcactatagggtccatgagctggtcatagcgctggcagaacaacagaggagagttctgatggcgctatgaaacctggcggcagcgcaaaagatg

SEQ ID NO: 165744 - DNA, 103 bp, Artificial Sequence
  Synthetic Polynucleotide
taatacgactcactatagggctcccaggcctccatgagctggtcatagcgaacagaggagacgctatatgcagctcatgaacctggcggcagcgcaaaagatg

SEQ ID NO: 165745 - DNA, 103 bp, Artificial Sequence
  Synthetic Polynucleotide
taatacgactcactatagggccaccttcttctcccaggcctccatgagctaacagaggagaagctcaatgaggcctgggaacctggcggcagcgcaaaagatg

SEQ ID NO: 165746 - DNA, 103 bp, Artificial Sequence
  Synthetic Polynucleotide
taatacgactcactatagggtcgatgcgctccaccttcttctcccaggccaacagaggagaggcctgatggaagaaggtaacctggcggcagcgcaaaagatg

SEQ ID NO: 165747 - DNA, 103 bp, Artificial Sequence
  Synthetic Polynucleotide
taatacgactcactatagggggggttgttctcgatgcgctccaccttcttaacagaggagaaagaagatggagcgcatcaacctggcggcagcgcaaaagatg

SEQ ID NO: 165748 - DNA, 103 bp, Artificial Sequence
  Synthetic Polynucleotide
taatacgactcactatagggcccgccgccgggggttgttctcgatgcgctaacagaggagaagcgcaatgagaacaaccaacctggcggcagcgcaaaagatg

SEQ ID NO: 165749 - DNA, 103 bp, Artificial Sequence
  Synthetic Polynucleotide
taatacgactcactatagggctctccttggcccgccgccgggggttgttcaacagaggagagaacaaatgccggcggcgaacctggcggcagcgcaaaagatg

SEQ ID NO: 165750 - DNA, 103 bp, Artificial Sequence
  Synthetic Polynucleotide
taatacgactcactataggggcgcaccttgctctccttggcccgccgccgaacagaggagacggcggatggccaaggagaacctggcggcagcgcaaaagatg

SEQ ID NO: 165751 - DNA, 103 bp, Artificial Sequence
  Synthetic Polynucleotide
taatacgactcactatagggcgtagtactcgcgcaccttgctctccttggaacagaggagaccaaggatggcaaggtgcaacctggcggcagcgcaaaagatg

SEQ ID NO: 165752 - DNA, 103 bp, Artificial Sequence
  Synthetic Polynucleotide
taatacgactcactatagggaactgcttctcgtagtactcgcgcaccttgaacagaggagacaaggtatgcgagtactaaacctggcggcagcgcaaaagatg

SEQ ID NO: 165753 - DNA, 103 bp, Artificial Sequence
  Synthetic Polynucleotide
taatacgactcactataggggtcgctcagatccttactttgttctgacataacagaggagaatgtcaatgcaaagtaagaacctggcggcagcgcaaaagatg

SEQ ID NO: 165754 - DNA, 103 bp, Artificial Sequence
  Synthetic Polynucleotide
taatacgactcactatagggctctgccagggtcgcggacggaggaaccccaacagaggagaggggttatgccgtccgcgaacctggcggcagcgcaaaagatg

SEQ ID NO: 165755 - DNA, 103 bp, Artificial Sequence
  Synthetic Polynucleotide
taatacgactcactatagggggctctgcggctctgccagggtcgcggacgaacagaggagacgtccgatgccctggcagaacctggcggcagcgcaaaagatg

SEQ ID NO: 165756 - DNA, 103 bp, Artificial Sequence
  Synthetic Polynucleotide
taatacgactcactatagggcctagaggagggctctgcggctctgccaggaacagaggagacctggcatggccgcagagaacctggcggcagcgcaaaagatg

SEQ ID NO: 165757 - DNA, 103 bp, Artificial Sequence
  Synthetic Polynucleotide
taatacgactcactatagggggccgtcgggcctagaggagggctctgcggaacagaggagaccgcagatgcctcctctaaacctggcggcagcgcaaaagatg

SEQ ID NO: 165758 - DNA, 103 bp, Artificial Sequence
  Synthetic Polynucleotide
taatacgactcactatagggcctgcggagcggccgtcgggcctagaggagaacagaggagactcctcatggcccgacggaacctggcggcagcgcaaaagatg

SEQ ID NO: 165759 - DNA, 103 bp, Artificial Sequence
  Synthetic Polynucleotide
taatacgactcactatagggggcggcgcggcctgcggagcggccgtcgggaacagaggagacccgacatgcgctccgcaaacctggcggcagcgcaaaagatg

SEQ ID NO: 165760 - DNA, 103 bp, Artificial Sequence
  Synthetic Polynucleotide
taatacgactcactatagggggcctggggaggcggcgcggcctgcggagcaacagaggagagctccgatggccgcgccgaacctggcggcagcgcaaaagatg

SEQ ID NO: 165761 - DNA, 103 bp, Artificial Sequence
  Synthetic Polynucleotide
taatacgactcactatagggcgtcgttcggggcctggggaggcggcgcggaacagaggagaccgcgcatgctccccaggaacctggcggcagcgcaaaagatg

SEQ ID NO: 165762 - DNA, 103 bp, Artificial Sequence
  Synthetic Polynucleotide
taatacgactcactataggggggtcgccctcgtcgttcggggcctggggaaacagaggagatccccaatgcccgaacgaaacctggcggcagcgcaaaagatg

SEQ ID NO: 165763 - DNA, 103 bp, Artificial Sequence
  Synthetic Polynucleotide
taatacgactcactatagggcagggccttcgggtcgccctcgtcgttcggaacagaggagaccgaacatggagggcgacaacctggcggcagcgcaaaagatg

SEQ ID NO: 165764 - DNA, 103 bp, Artificial Sequence
  Synthetic Polynucleotide
taatacgactcactatagggcaaagttagggtcgctcagatccttactttaacagaggagaaaagtaatgatctgagcgaacctggcggcagcgcaaaagatg

SEQ ID NO: 165765 - DNA, 103 bp, Artificial Sequence
  Synthetic Polynucleotide
taatacgactcactatagggcagcctgctgcagggccttcgggtcgccctaacagaggagaagggcgatgcgaaggcccaacctggcggcagcgcaaaagatg

SEQ ID NO: 165766 - DNA, 103 bp, Artificial Sequence
  Synthetic Polynucleotide
taatacgactcactatagggccctcctccgcagcctgctgcagggccttcaacagaggagagaaggcatggcagcaggcaacctggcggcagcgcaaaagatg

SEQ ID NO: 165767 - DNA, 103 bp, Artificial Sequence
  Synthetic Polynucleotide
taatacgactcactataggggtgggcgcggccctcctccgcagcctgctgaacagaggagacagcagatggcggaggagaacctggcggcagcgcaaaagatg

SEQ ID NO: 165768 - DNA, 103 bp, Artificial Sequence
  Synthetic Polynucleotide
taatacgactcactatagggtcggggcctggtgggcgcggccctcctccgaacagaggagacggaggatggccgcgcccaacctggcggcagcgcaaaagatg

SEQ ID NO: 165769 - DNA, 103 bp, Artificial Sequence
  Synthetic Polynucleotide
taatacgactcactatagggtgggccgcgctcggggcctggtgggcgcggaacagaggagaccgcgcatgccaggccccaacctggcggcagcgcaaaagatg

SEQ ID NO: 165770 - DNA, 103 bp, Artificial Sequence
  Synthetic Polynucleotide
taatacgactcactatagggcgggcccggctgggccgcgctcggggcctgaacagaggagacaggccatgagcgcggccaacctggcggcagcgcaaaagatg

SEQ ID NO: 165771 - DNA, 103 bp, Artificial Sequence
  Synthetic Polynucleotide
taatacgactcactatagggctggcggtgccgggcccggctgggccgcgcaacagaggagagcgcggatgagccgggccaacctggcggcagcgcaaaagatg

SEQ ID NO: 165772 - DNA, 103 bp, Artificial Sequence
  Synthetic Polynucleotide
taatacgactcactatagggtgcgccggggctggcggtgccgggcccggcaacagaggagagccgggatgggcaccgccaacctggcggcagcgcaaaagatg

SEQ ID NO: 165773 - DNA, 103 bp, Artificial Sequence
  Synthetic Polynucleotide
taatacgactcactatagggctgcaccagctgcgccggggctggcggtgcaacagaggagagcaccgatggccccggcgaacctggcggcagcgcaaaagatg

SEQ ID NO: 165774 - DNA, 103 bp, Artificial Sequence
  Synthetic Polynucleotide
taatacgactcactatagggcgtgcgccttctgcaccagctgcgccggggaacagaggagaccccggatgagctggtgcaacctggcggcagcgcaaaagatg

SEQ ID NO: 165775 - DNA, 103 bp, Artificial Sequence
  Synthetic Polynucleotide
taatacgactcactataggggcctcggctgcaaagttagggtcgctcagaaacagaggagatctgagatgccctaacttaacctggcggcagcgcaaaagatg

SEQ ID NO: 165776 - DNA, 103 bp, Artificial Sequence
  Synthetic Polynucleotide
taatacgactcactatagggcacatgagctcgtgcgccttctgcaccagcaacagaggagagctggtatggaaggcgcaaacctggcggcagcgcaaaagatg

SEQ ID NO: 165777 - DNA, 103 bp, Artificial Sequence
  Synthetic Polynucleotide
taatacgactcactatagggcagcacgtaccacatgagctcgtgcgccttaacagaggagaaaggcgatggagctcatgaacctggcggcagcgcaaaagatg

SEQ ID NO: 165778 - DNA, 103 bp, Artificial Sequence
  Synthetic Polynucleotide
taatacgactcactatagggggtccttgaccagcacgtaccacatgagctaacagaggagaagctcaatgggtacgtgcaacctggcggcagcgcaaaagatg

SEQ ID NO: 165779 - DNA, 103 bp, Artificial Sequence
  Synthetic Polynucleotide
taatacgactcactatagggatcttcttctggtccttgaccagcacgtacaacagaggagagtacgtatgggtcaaggaaacctggcggcagcgcaaaagatg

SEQ ID NO: 165780 - DNA, 103 bp, Artificial Sequence
  Synthetic Polynucleotide
taatacgactcactatagggccagatgatcatcttcttctggtccttgacaacagaggagagtcaagatgcagaagaagaacctggcggcagcgcaaaagatg

SEQ ID NO: 165781 - DNA, 103 bp, Artificial Sequence
  Synthetic Polynucleotide
taatacgactcactatagggtgtctggaaaccagatgatcatcttcttctaacagaggagaagaagaatgtgatcatctaacctggcggcagcgcaaaagatg

SEQ ID NO: 165782 - DNA, 103 bp, Artificial Sequence
  Synthetic Polynucleotide
taatacgactcactatagggtctttcaccatgtctggaaaccagatgatcaacagaggagagatcatatggtttccagaaacctggcggcagcgcaaaagatg

SEQ ID NO: 165783 - DNA, 103 bp, Artificial Sequence
  Synthetic Polynucleotide
taatacgactcactataggggccgatgacatctttcaccatgtctggaaaaacagaggagatttccaatgatggtgaaaaacctggcggcagcgcaaaagatg

SEQ ID NO: 165784 - DNA, 103 bp, Artificial Sequence
  Synthetic Polynucleotide
taatacgactcactatagggtcttgtagctgccgatgacatctttcaccaaacagaggagatggtgaatgatgtcatcgaacctggcggcagcgcaaaagatg

SEQ ID NO: 165785 - DNA, 103 bp, Artificial Sequence
  Synthetic Polynucleotide
taatacgactcactatagggctgcaccacttcttgtagctgccgatgacaaacagaggagatgtcatatgcagctacaaaacctggcggcagcgcaaaagatg

SEQ ID NO: 165786 - DNA, 103 bp, Artificial Sequence
  Synthetic Polynucleotide
taatacgactcactatagggggagttgggggcctcggctgcaaagttaggaacagaggagacctaacatggcagccgagaacctggcggcagcgcaaaagatg

SEQ ID NO: 165787 - DNA, 103 bp, Artificial Sequence
  Synthetic Polynucleotide
taatacgactcactataggggaggatgctcctgcaccacttcttgtagctaacagaggagaagctacatgaagtggtgcaacctggcggcagcgcaaaagatg

SEQ ID NO: 165788 - DNA, 103 bp, Artificial Sequence
  Synthetic Polynucleotide
taatacgactcactatagggtggtgcgccggaggatgctcctgcaccactaacagaggagaagtggtatgggagcatccaacctggcggcagcgcaaaagatg

SEQ ID NO: 165789 - DNA, 103 bp, Artificial Sequence
  Synthetic Polynucleotide
taatacgactcactatagggaggatgaggctggtgcgccggaggatgctcaacagaggagagagcatatgccggcgcacaacctggcggcagcgcaaaagatg

SEQ ID NO: 165790 - DNA, 103 bp, Artificial Sequence
  Synthetic Polynucleotide
taatacgactcactatagggcacccgggcgaggatgaggctggtgcgccgaacagaggagacggcgcatgagcctcatcaacctggcggcagcgcaaaagatg

SEQ ID NO: 165791 - DNA, 103 bp, Artificial Sequence
  Synthetic Polynucleotide
taatacgactcactataggggcagcccgaacacccgggcgaggatgaggcaacagaggagagcctcaatgtcgcccgggaacctggcggcagcgcaaaagatg

SEQ ID NO: 165792 - DNA, 103 bp, Artificial Sequence
  Synthetic Polynucleotide
taatacgactcactatagggagcctcaggtgcagcccgaacacccgggcgaacagaggagacgcccgatggttcgggctaacctggcggcagcgcaaaagatg

SEQ ID NO: 165793 - DNA, 103 bp, Artificial Sequence
  Synthetic Polynucleotide
taatacgactcactatagggcaggctggttagcctcaggtgcagcccgaaaacagaggagattcgggatgcacctgaggaacctggcggcagcgcaaaagatg

SEQ ID NO: 165794 - DNA, 103 bp, Artificial Sequence
  Synthetic Polynucleotide
taatacgactcactatagggccatggtgtgcaggctggttagcctcaggtaacagaggagaacctgaatgtaaccagccaacctggcggcagcgcaaaagatg

SEQ ID NO: 165795 - DNA, 103 bp, Artificial Sequence
  Synthetic Polynucleotide
taatacgactcactatagggagcgcaaactccatggtgtgcaggctggttaacagaggagaaaccagatggcacaccataacctggcggcagcgcaaaagatg

SEQ ID NO: 165796 - DNA, 103 bp, Artificial Sequence
  Synthetic Polynucleotide
taatacgactcactatagggcgctttgaccagcgcaaactccatggtgtgaacagaggagacacaccatggagtttgcgaacctggcggcagcgcaaaagatg

SEQ ID NO: 165797 - DNA, 103 bp, Artificial Sequence
  Synthetic Polynucleotide
taatacgactcactatagggtgtgcacctcggagttgggggcctcggctgaacagaggagacagccgatgcccccaactaacctggcggcagcgcaaaagatg

SEQ ID NO: 165798 - DNA, 103 bp, Artificial Sequence
  Synthetic Polynucleotide
taatacgactcactatagggcgggctccagcgctttgaccagcgcaaactaacagaggagaagtttgatgtggtcaaagaacctggcggcagcgcaaaagatg

SEQ ID NO: 165799 - DNA, 103 bp, Artificial Sequence
  Synthetic Polynucleotide
taatacgactcactatagggtccagctcctcgggctccagcgctttgaccaacagaggagaggtcaaatggctggagccaacctggcggcagcgcaaaagatg

SEQ ID NO: 165800 - DNA, 103 bp, Artificial Sequence
  Synthetic Polynucleotide
taatacgactcactatagggcgccaccctgtccagctcctcgggctccagaacagaggagactggagatggaggagctgaacctggcggcagcgcaaaagatg

SEQ ID NO: 165801 - DNA, 103 bp, Artificial Sequence
  Synthetic Polynucleotide
taatacgactcactatagggggttgctcagcgccaccctgtccagctcctaacagaggagaaggagcatgacagggtggaacctggcggcagcgcaaaagatg

SEQ ID NO: 165802 - DNA, 103 bp, Artificial Sequence
  Synthetic Polynucleotide
taatacgactcactatagggatgggcatgcggttgctcagcgccaccctgaacagaggagacagggtatggctgagcaaaacctggcggcagcgcaaaagatg

SEQ ID NO: 165803 - DNA, 103 bp, Artificial Sequence
  Synthetic Polynucleotide
taatacgactcactataggggaggcctgtcatgggcatgcggttgctcagaacagaggagactgagcatgcgcatgcccaacctggcggcagcgcaaaagatg

SEQ ID NO: 165804 - DNA, 103 bp, Artificial Sequence
  Synthetic Polynucleotide
taatacgactcactatagggtcatgagcaggaggcctgtcatgggcatgcaacagaggagagcatgcatgtgacaggccaacctggcggcagcgcaaaagatg

SEQ ID NO: 165805 - DNA, 103 bp, Artificial Sequence
  Synthetic Polynucleotide
taatacgactcactatagggaggctcaggatcatgagcaggaggcctgtcaacagaggagagacaggatgcctgctcataacctggcggcagcgcaaaagatg

SEQ ID NO: 165806 - DNA, 103 bp, Artificial Sequence
  Synthetic Polynucleotide
taatacgactcactatagggcacgtagatgaggctcaggatcatgagcagaacagaggagactgctcatgatcctgagcaacctggcggcagcgcaaaagatg

SEQ ID NO: 165807 - DNA, 103 bp, Artificial Sequence
  Synthetic Polynucleotide
taatacgactcactatagggcgcggcccttcacgtagatgaggctcaggaaacagaggagatcctgaatgtcatctacgaacctggcggcagcgcaaaagatg

SEQ ID NO: 165808 - DNA, 103 bp, Artificial Sequence
  Synthetic Polynucleotide
taatacgactcactatagggccagggctgctgtgcacctcggagttggggaacagaggagaccccaaatgcgaggtgcaaacctggcggcagcgcaaaagatg

SEQ ID NO: 165809 - DNA, 103 bp, Artificial Sequence
  Synthetic Polynucleotide
taatacgactcactatagggtctctggcgccgcggcccttcacgtagatgaacagaggagacatctaatggaagggccgaacctggcggcagcgcaaaagatg

SEQ ID NO: 165810 - DNA, 103 bp, Artificial Sequence
  Synthetic Polynucleotide
taatacgactcactataggggacggcgctctctctggcgccgcggcccttaacagaggagaaagggcatgggcgccagaaacctggcggcagcgcaaaagatg

SEQ ID NO: 165811 - DNA, 103 bp, Artificial Sequence
  Synthetic Polynucleotide
taatacgactcactataggggcacgttccagacggcgctctctctggcgcaacagaggagagcgccaatgagagcgccgaacctggcggcagcgcaaaagatg

SEQ ID NO: 165812 - DNA, 103 bp, Artificial Sequence
  Synthetic Polynucleotide
taatacgactcactatagggaggatgcgcagcacgttccagacggcgctcaacagaggagagagcgcatgctggaacgtaacctggcggcagcgcaaaagatg

SEQ ID NO: 165813 - DNA, 103 bp, Artificial Sequence
  Synthetic Polynucleotide
taatacgactcactatagggccgcagccccaggatgcgcagcacgttccaaacagaggagatggaacatgctgcgcatcaacctggcggcagcgcaaaagatg

SEQ ID NO: 165814 - DNA, 103 bp, Artificial Sequence
  Synthetic Polynucleotide
taatacgactcactatagggtcttccagggccgcagccccaggatgcgcaaacagaggagatgcgcaatgtggggctgcaacctggcggcagcgcaaaagatg

SEQ ID NO: 165815 - DNA, 103 bp, Artificial Sequence
  Synthetic Polynucleotide
taatacgactcactataggggtggagtgcttcttccagggccgcagccccaacagaggagaggggctatggccctggaaaacctggcggcagcgcaaaagatg

SEQ ID NO: 165816 - DNA, 103 bp, Artificial Sequence
  Synthetic Polynucleotide
taatacgactcactataggggtccccgaaggtggagtgcttcttccagggaacagaggagaccctggatgaagcactccaacctggcggcagcgcaaaagatg

SEQ ID NO: 165817 - DNA, 103 bp, Artificial Sequence
  Synthetic Polynucleotide
taatacgactcactataggggcttccgcacgtccccgaaggtggagtgctaacagaggagaagcactatgccttcggggaacctggcggcagcgcaaaagatg

SEQ ID NO: 165818 - DNA, 103 bp, Artificial Sequence
  Synthetic Polynucleotide
taatacgactcactatagggtcagtgatgagcttccgcacgtccccgaagaacagaggagacttcggatgcgtgcggaaaacctggcggcagcgcaaaagatg

SEQ ID NO: 165819 - DNA, 103 bp, Artificial Sequence
  Synthetic Polynucleotide
taatacgactcactatagggctccgaaaccccagggctgctgtgcacctcaacagaggagagaggtgatgagcagccctaacctggcggcagcgcaaaagatg

SEQ ID NO: 165820 - DNA, 103 bp, Artificial Sequence
  Synthetic Polynucleotide
taatacgactcactataggggacgaactcctcagtgatgagcttccgcacaacagaggagagtgcggatgctcatcactaacctggcggcagcgcaaaagatg

SEQ ID NO: 165821 - DNA, 103 bp, Artificial Sequence
  Synthetic Polynucleotide
taatacgactcactatagggaattcatttggacgaactcctcagtgatgaaacagaggagatcatcaatgaggagttcgaacctggcggcagcgcaaaagatg

SEQ ID NO: 165822 - DNA, 103 bp, Artificial Sequence
  Synthetic Polynucleotide
taatacgactcactatagggtacttcaggtaattcatttggacgaactccaacagaggagaggagttatgccaaatgaaaacctggcggcagcgcaaaagatg

SEQ ID NO: 165823 - DNA, 103 bp, Artificial Sequence
  Synthetic Polynucleotide
taatacgactcactataggggacgcgctggtacttcaggtaattcatttgaacagaggagacaaatgatgtacctgaagaacctggcggcagcgcaaaagatg

SEQ ID NO: 165824 - DNA, 103 bp, Artificial Sequence
  Synthetic Polynucleotide
taatacgactcactatagggccacgtatgggacgcgctggtacttcaggtaacagaggagaacctgaatgaccagcgcgaacctggcggcagcgcaaaagatg

SEQ ID NO: 165825 - DNA, 103 bp, Artificial Sequence
  Synthetic Polynucleotide
taatacgactcactatagggtcgggcggctccacgtatgggacgcgctggaacagaggagaccagcgatgcccatacgtaacctggcggcagcgcaaaagatg

SEQ ID NO: 165826 - DNA, 103 bp, Artificial Sequence
  Synthetic Polynucleotide
taatacgactcactataggggaactcgtattcgggcggctccacgtatggaacagaggagaccatacatggagccgcccaacctggcggcagcgcaaaagatg

SEQ ID NO: 165827 - DNA, 103 bp, Artificial Sequence
  Synthetic Polynucleotide
taatacgactcactatagggagccccaaaagaactcgtattcgggcggctaacagaggagaagccgcatgaatacgagtaacctggcggcagcgcaaaagatg

SEQ ID NO: 165828 - DNA, 103 bp, Artificial Sequence
  Synthetic Polynucleotide
taatacgactcactatagggctggcccgggagccccaaaagaactcgtataacagaggagaatacgaatgcttttggggaacctggcggcagcgcaaaagatg

SEQ ID NO: 165829 - DNA, 103 bp, Artificial Sequence
  Synthetic Polynucleotide
taatacgactcactataggggatttcgcggctggcccgggagccccaaaaaacagaggagattttggatgtcccgggccaacctggcggcagcgcaaaagatg

SEQ ID NO: 165830 - DNA, 103 bp, Artificial Sequence
  Synthetic Polynucleotide
taatacgactcactataggggaggaaccccctccgaaaccccagggctgcaacagaggagagcagccatggggtttcggaacctggcggcagcgcaaaagatg

SEQ ID NO: 165831 - DNA, 103 bp, Artificial Sequence
  Synthetic Polynucleotide
taatacgactcactataggggcatcttggtgatttcgcggctggcccgggaacagaggagacccgggatggccgcgaaaaacctggcggcagcgcaaaagatg

SEQ ID NO: 165832 - DNA, 103 bp, Artificial Sequence
  Synthetic Polynucleotide
taatacgactcactatagggtccatgatttgcatcttggtgatttcgcggaacagaggagaccgcgaatgcaccaagataacctggcggcagcgcaaaagatg

SEQ ID NO: 165833 - DNA, 103 bp, Artificial Sequence
  Synthetic Polynucleotide
taatacgactcactatagggggccaggaactccatgatttgcatcttggtaacagaggagaaccaagatgcaaatcatgaacctggcggcagcgcaaaagatg

SEQ ID NO: 165834 - DNA, 103 bp, Artificial Sequence
  Synthetic Polynucleotide
taatacgactcactatagggtaaagaccctggccaggaactccatgatttaacagaggagaaaatcaatgagttcctggaacctggcggcagcgcaaaagatg

SEQ ID NO: 165835 - DNA, 103 bp, Artificial Sequence
  Synthetic Polynucleotide
taatacgactcactataggggggtctttcttaaagaccctggccaggaacaacagaggagagttcctatgcagggtcttaacctggcggcagcgcaaaagatg

SEQ ID NO: 165836 - DNA, 103 bp, Artificial Sequence
  Synthetic Polynucleotide
taatacgactcactatagggccaggcctgggggtctttcttaaagaccctaacagaggagaagggtcatgaagaaagacaacctggcggcagcgcaaaagatg

SEQ ID NO: 165837 - DNA, 103 bp, Artificial Sequence
  Synthetic Polynucleotide
taatacgactcactatagggatcgggagggccaggcctgggggtctttctaacagaggagaagaaagatgcccaggcctaacctggcggcagcgcaaaagatg

SEQ ID NO: 165838 - DNA, 103 bp, Artificial Sequence
  Synthetic Polynucleotide
taatacgactcactataggggcttctctgtatcgggagggccaggcctggaacagaggagaccaggcatggccctcccgaacctggcggcagcgcaaaagatg

SEQ ID NO: 165839 - DNA, 103 bp, Artificial Sequence
  Synthetic Polynucleotide
taatacgactcactatagggctcctccagagcttctctgtatcgggagggaacagaggagaccctccatgtacagagaaaacctggcggcagcgcaaaagatg

SEQ ID NO: 165840 - DNA, 103 bp, Artificial Sequence
  Synthetic Polynucleotide
taatacgactcactataggggagctctggcctcctccagagcttctctgtaacagaggagaacagagatgctctggaggaacctggcggcagcgcaaaagatg

SEQ ID NO: 165841 - DNA, 103 bp, Artificial Sequence
  Synthetic Polynucleotide
taatacgactcactataggggtcgcggacggaggaaccccctccgaaaccaacagaggagaggtttcatggggggttccaacctggcggcagcgcaaaagatg

SEQ ID NO: 165842 - DNA, 103 bp, Artificial Sequence
  Synthetic Polynucleotide
taatacgactcactataggggcctcccgcagagctctggcctcctccagaaacagaggagatctggaatgggccagagcaacctggcggcagcgcaaaagatg

SEQ ID NO: 165843 - DNA, 103 bp, Artificial Sequence
  Synthetic Polynucleotide
taatacgactcactatagggagtgggattagcctcccgcagagctctggcaacagaggagagccagaatgctgcgggagaacctggcggcagcgcaaaagatg

SEQ ID NO: 165844 - DNA, 103 bp, Artificial Sequence
  Synthetic Polynucleotide
taatacgactcactatagggggtagtgggcagtgggattagcctcccgcaaacagaggagatgcgggatgctaatcccaaacctggcggcagcgcaaaagatg

SEQ ID NO: 165845 - DNA, 103 bp, Artificial Sequence
  Synthetic Polynucleotide
taatacgactcactatagggctgctgcgagggtagtgggcagtgggattaaacagaggagataatccatgtgcccactaaacctggcggcagcgcaaaagatg

SEQ ID NO: 165846 - DNA, 103 bp, Artificial Sequence
  Synthetic Polynucleotide
taatacgactcactatagggctcagagacactgctgcgagggtagtgggcaacagaggagagcccacatgcctcgcagcaacctggcggcagcgcaaaagatg

SEQ ID NO: 165847 - DNA, 103 bp, Artificial Sequence
  Synthetic Polynucleotide
taatacgactcactatagggcagcccactctcgctgtacgatttggtcataacagaggagaatgaccatgtcgtacagcaacctggcggcagcgcaaaagatg

SEQ ID NO: 165848 - DNA, 103 bp, Artificial Sequence
  Synthetic Polynucleotide
taatacgactcactatagggctccttcttgtctgcctcgtgctcctcgtcaacagaggagagacgagatgcacgaggcaaacctggcggcagcgcaaaagatg

SEQ ID NO: 165849 - DNA, 103 bp, Artificial Sequence
  Synthetic Polynucleotide
taatacgactcactatagggtgaatggctatcgaaggacataatattgtcaacagaggagagacaatatgatgtccttcaacctggcggcagcgcaaaagatg

SEQ ID NO: 165850 - DNA, 103 bp, Artificial Sequence
  Synthetic Polynucleotide
taatacgactcactataggggctcatgatgtgaatggctatcgaaggacaaacagaggagatgtcctatgatagccattaacctggcggcagcgcaaaagatg

SEQ ID NO: 165851 - DNA, 103 bp, Artificial Sequence
  Synthetic Polynucleotide
taatacgactcactatagggctcatgactcgctcatgatgtgaatggctaaacagaggagatagccaatgacatcatgaaacctggcggcagcgcaaaagatg

SEQ ID NO: 165852 - DNA, 103 bp, Artificial Sequence
  Synthetic Polynucleotide
taatacgactcactataggggagctgggcactcatgactcgctcatgatgaacagaggagacatcatatgcgagtcatgaacctggcggcagcgcaaaagatg

SEQ ID NO: 165853 - DNA, 103 bp, Artificial Sequence
  Synthetic Polynucleotide
taatacgactcactatagggatatggcattgagctgggcactcatgactcaacagaggagagagtcaatggtgcccagcaacctggcggcagcgcaaaagatg

SEQ ID NO: 165854 - DNA, 103 bp, Artificial Sequence
  Synthetic Polynucleotide
taatacgactcactatagggtaatcatgaaatatggcattgagctgggcaaacagaggagatgcccaatgcaatgccataacctggcggcagcgcaaaagatg

SEQ ID NO: 165855 - DNA, 103 bp, Artificial Sequence
  Synthetic Polynucleotide
taatacgactcactatagggcgaggtcgtcctccttcttgtctgcctcgtaacagaggagaacgaggatgacaagaaggaacctggcggcagcgcaaaagatg

SEQ ID NO: 165856 - DNA, 103 bp, Artificial Sequence
  Synthetic Polynucleotide
taatacgactcactatagggttcatggtttcgaggtcgtcctccttcttgaacagaggagacaagaaatgggacgacctaacctggcggcagcgcaaaagatg

SEQ ID NO: 165857 - DNA, 103 bp, Artificial Sequence
  Synthetic Polynucleotide
taatacgactcactatagggctcctctgcgttcatggtttcgaggtcgtcaacagaggagagacgacatggaaaccatgaacctggcggcagcgcaaaagatg

SEQ ID NO: 165858 - DNA, 103 bp, Artificial Sequence
  Synthetic Polynucleotide
taatacgactcactatagggtcagtgagtcctcctctgcgttcatggtttaacagaggagaaaaccaatgacgcagaggaacctggcggcagcgcaaaagatg

SEQ ID NO: 165859 - DNA, 103 bp, Artificial Sequence
  Synthetic Polynucleotide
taatacgactcactatagggcccccgttcctcagtgagtcctcctctgcgaacagaggagacgcagaatgggactcactaacctggcggcagcgcaaaagatg

SEQ ID NO: 165860 - DNA, 103 bp, Artificial Sequence
  Synthetic Polynucleotide
taatacgactcactatagggctcctcctctcccccgttcctcagtgagtcaacagaggagagactcaatgaggaacgggaacctggcggcagcgcaaaagatg

SEQ ID NO: 165861 - DNA, 103 bp, Artificial Sequence
  Synthetic Polynucleotide
taatacgactcactatagggcatcttcgtcctcctcctctcccccgttccaacagaggagaggaacgatggagaggaggaacctggcggcagcgcaaaagatg

SEQ ID NO: 165862 - DNA, 103 bp, Artificial Sequence
  Synthetic Polynucleotide
taatacgactcactatagggtccaggtcctcatcttcgtcctcctcctctaacagaggagaagaggaatgggacgaagaaacctggcggcagcgcaaaagatg

SEQ ID NO: 165863 - DNA, 103 bp, Artificial Sequence
  Synthetic Polynucleotide
taatacgactcactatagggttcctcctcttccaggtcctcatcttcgtcaacagaggagagacgaaatggaggacctgaacctggcggcagcgcaaaagatg

SEQ ID NO: 165864 - DNA, 103 bp, Artificial Sequence
  Synthetic Polynucleotide
taatacgactcactataggggctcgcccatcagcccactctcgctgtacgaacagaggagacgtacaatgagagtgggcaacctggcggcagcgcaaaagatg

SEQ ID NO: 165865 - DNA, 103 bp, Artificial Sequence
  Synthetic Polynucleotide
taatacgactcactatagggcttcctcttcttcctcctcttccaggtcctaacagaggagaaggaccatgaagaggaggaacctggcggcagcgcaaaagatg

SEQ ID NO: 165866 - DNA, 103 bp, Artificial Sequence
  Synthetic Polynucleotide
taatacgactcactatagggtcatcctcctcttcctcttcttcctcctctaacagaggagaagaggaatgagaagaggaaacctggcggcagcgcaaaagatg

SEQ ID NO: 165867 - DNA, 103 bp, Artificial Sequence
  Synthetic Polynucleotide
taatacgactcactatagggcttttgatcgtcatcctcctcttcctcttcaacagaggagagaagagatggaggaggataacctggcggcagcgcaaaagatg

SEQ ID NO: 165868 - DNA, 103 bp, Artificial Sequence
  Synthetic Polynucleotide
taatacgactcactataggggtctcttgggcttttgatcgtcatcctcctaacagaggagaaggaggatgacgatcaaaaacctggcggcagcgcaaaagatg

SEQ ID NO: 165869 - DNA, 103 bp, Artificial Sequence
  Synthetic Polynucleotide
taatacgactcactatagggttggggccgcgtctcttgggcttttgatcgaacagaggagacgatcaatggcccaagagaacctggcggcagcgcaaaagatg

SEQ ID NO: 165870 - DNA, 103 bp, Artificial Sequence
  Synthetic Polynucleotide
taatacgactcactatagggcttcttctttttggggccgcgtctcttgggaacagaggagacccaagatgcgcggccccaacctggcggcagcgcaaaagatg

SEQ ID NO: 165871 - DNA, 103 bp, Artificial Sequence
  Synthetic Polynucleotide
taatacgactcactatagggccttagtcatcttcttctttttggggccgcaacagaggagagcggccatgaaaagaagaaacctggcggcagcgcaaaagatg

SEQ ID NO: 165872 - DNA, 103 bp, Artificial Sequence
  Synthetic Polynucleotide
taatacgactcactatagggtccaggcgagccttagtcatcttcttctttaacagaggagaaaagaaatggatgactaaaacctggcggcagcgcaaaagatg

SEQ ID NO: 165873 - DNA, 103 bp, Artificial Sequence
  Synthetic Polynucleotide
taatacgactcactatagggtttaaaacgctccaggcgagccttagtcataacagaggagaatgactatggctcgcctgaacctggcggcagcgcaaaagatg

SEQ ID NO: 165874 - DNA, 103 bp, Artificial Sequence
  Synthetic Polynucleotide
taatacgactcactatagggtgcgtctcaatttaaaacgctccaggcgagaacagaggagactcgccatgagcgttttaaacctggcggcagcgcaaaagatg

SEQ ID NO: 165875 - DNA, 103 bp, Artificial Sequence
  Synthetic Polynucleotide
taatacgactcactatagggtggggctgaggctcgcccatcagcccactcaacagaggagagagtggatggatgggcgaaacctggcggcagcgcaaaagatg

SEQ ID NO: 165876 - DNA, 103 bp, Artificial Sequence
  Synthetic Polynucleotide
taatacgactcactatagggttagccttcatgcgtctcaatttaaaacgcaacagaggagagcgtttatgattgagacgaacctggcggcagcgcaaaagatg

SEQ ID NO: 165877 - DNA, 103 bp, Artificial Sequence
  Synthetic Polynucleotide
taatacgactcactatagggctcccgggcgttagccttcatgcgtctcaaaacagaggagattgagaatgatgaaggctaacctggcggcagcgcaaaagatg

SEQ ID NO: 165878 - DNA, 103 bp, Artificial Sequence
  Synthetic Polynucleotide
taatacgactcactatagggtgcggttccgctcccgggcgttagccttcaaacagaggagatgaaggatgacgcccgggaacctggcggcagcgcaaaagatg

SEQ ID NO: 165879 - DNA, 103 bp, Artificial Sequence
  Synthetic Polynucleotide
taatacgactcactatagggagtccgtgcatgcggttccgctcccgggcgaacagaggagacgcccgatggcggaaccgaacctggcggcagcgcaaaagatg

SEQ ID NO: 165880 - DNA, 103 bp, Artificial Sequence
  Synthetic Polynucleotide
taatacgactcactatagggcgccgcgttcagtccgtgcatgcggttccgaacagaggagacggaacatgatgcacggaaacctggcggcagcgcaaaagatg

SEQ ID NO: 165881 - DNA, 103 bp, Artificial Sequence
  Synthetic Polynucleotide
taatacgactcactatagggggttgtctagcgccgcgttcagtccgtgcaaacagaggagatgcacgatgtgaacgcggaacctggcggcagcgcaaaagatg

SEQ ID NO: 165882 - DNA, 103 bp, Artificial Sequence
  Synthetic Polynucleotide
taatacgactcactatagggaccttgcgcaggttgtctagcgccgcgttcaacagaggagagaacgcatggctagacaaaacctggcggcagcgcaaaagatg

SEQ ID NO: 165883 - DNA, 103 bp, Artificial Sequence
  Synthetic Polynucleotide
taatacgactcactataggggcaaggcaccaccttgcgcaggttgtctagaacagaggagactagacatgctgcgcaagaacctggcggcagcgcaaaagatg

SEQ ID NO: 165884 - DNA, 103 bp, Artificial Sequence
  Synthetic Polynucleotide
taatacgactcactatagggtcttagaatagcaaggcaccaccttgcgcaaacagaggagatgcgcaatgtggtgccttaacctggcggcagcgcaaaagatg

SEQ ID NO: 165885 - DNA, 103 bp, Artificial Sequence
  Synthetic Polynucleotide
taatacgactcactatagggagcttctgcgtcttagaatagcaaggcaccaacagaggagaggtgccatgctattctaaaacctggcggcagcgcaaaagatg

SEQ ID NO: 165886 - DNA, 103 bp, Artificial Sequence
  Synthetic Polynucleotide
taatacgactcactatagggtggaggaccttggggctgaggctcgcccataacagaggagaatgggcatgcctcagcccaacctggcggcagcgcaaaagatg

SEQ ID NO: 165887 - DNA, 103 bp, Artificial Sequence
  Synthetic Polynucleotide
taatacgactcactataggggattttggacagcttctgcgtcttagaataaacagaggagatattctatgacgcagaagaacctggcggcagcgcaaaagatg

SEQ ID NO: 165888 - DNA, 103 bp, Artificial Sequence
  Synthetic Polynucleotide
taatacgactcactataggggcagagtctcgattttggacagcttctgcgaacagaggagacgcagaatgtgtccaaaaaacctggcggcagcgcaaaagatg

SEQ ID NO: 165889 - DNA, 103 bp, Artificial Sequence
  Synthetic Polynucleotide
taatacgactcactatagggttggccaagcgcagagtctcgattttggacaacagaggagagtccaaatgcgagactctaacctggcggcagcgcaaaagatg

SEQ ID NO: 165890 - DNA, 103 bp, Artificial Sequence
  Synthetic Polynucleotide
taatacgactcactataggggatgtagttcttggccaagcgcagagtctcaacagaggagagagactatgcgcttggccaacctggcggcagcgcaaaagatg

SEQ ID NO: 165891 - DNA, 103 bp, Artificial Sequence
  Synthetic Polynucleotide
taatacgactcactatagggacagagcccagatgtagttcttggccaagcaacagaggagagcttggatgagaactacaaacctggcggcagcgcaaaagatg

SEQ ID NO: 165892 - DNA, 103 bp, Artificial Sequence
  Synthetic Polynucleotide
taatacgactcactatagggaggatctccgacagagcccagatgtagttcaacagaggagagaactaatgctgggctctaacctggcggcagcgcaaaagatg

SEQ ID NO: 165893 - DNA, 103 bp, Artificial Sequence
  Synthetic Polynucleotide
taatacgactcactataggggcctgagcgcaggatctccgacagagcccaaacagaggagatgggctatgtcggagatcaacctggcggcagcgcaaaagatg

SEQ ID NO: 165894 - DNA, 103 bp, Artificial Sequence
  Synthetic Polynucleotide
taatacgactcactatagggctgggcttttgcctgagcgcaggatctccgaacagaggagacggagaatgtgcgctcagaacctggcggcagcgcaaaagatg

SEQ ID NO: 165895 - DNA, 103 bp, Artificial Sequence
  Synthetic Polynucleotide
taatacgactcactataggggagaccaggtctgggcttttgcctgagcgcaacagaggagagcgctcatgcaaaagcccaacctggcggcagcgcaaaagatg

SEQ ID NO: 165896 - DNA, 103 bp, Artificial Sequence
  Synthetic Polynucleotide
taatacgactcactatagggctgaacgaaggagaccaggtctgggcttttaacagaggagaaaaagcatggacctggtcaacctggcggcagcgcaaaagatg

SEQ ID NO: 165897 - DNA, 103 bp, Artificial Sequence
  Synthetic Polynucleotide
taatacgactcactatagggctgtccagcttggaggaccttggggctgagaacagaggagactcagcatgaaggtcctcaacctggcggcagcgcaaaagatg

SEQ ID NO: 165898 - DNA, 103 bp, Artificial Sequence
  Synthetic Polynucleotide
taatacgactcactatagggtgcaaagcgtctgaacgaaggagaccaggtaacagaggagaacctggatgccttcgttcaacctggcggcagcgcaaaagatg

SEQ ID NO: 165899 - DNA, 103 bp, Artificial Sequence
  Synthetic Polynucleotide
taatacgactcactataggggataagcccttgcaaagcgtctgaacgaagaacagaggagacttcgtatggacgctttgaacctggcggcagcgcaaaagatg

SEQ ID NO: 165900 - DNA, 103 bp, Artificial Sequence
  Synthetic Polynucleotide
taatacgactcactatagggggtgggttgggataagcccttgcaaagcgtaacagaggagaacgcttatgaagggcttaaacctggcggcagcgcaaaagatg

SEQ ID NO: 165901 - DNA, 103 bp, Artificial Sequence
  Synthetic Polynucleotide
taatacgactcactatagggccaggttggtggtgggttgggataagccctaacagaggagaagggctatgcccaacccaaacctggcggcagcgcaaaagatg

SEQ ID NO: 165902 - DNA, 103 bp, Artificial Sequence
  Synthetic Polynucleotide
taatacgactcactatagggcagcccgcaaccaggttggtggtgggttggaacagaggagaccaaccatgcaccaacctaacctggcggcagcgcaaaagatg

SEQ ID NO: 165903 - DNA, 103 bp, Artificial Sequence
  Synthetic Polynucleotide
taatacgactcactataggggagttgcaggcagcccgcaaccaggttggtaacagaggagaaccaacatggttgcgggcaacctggcggcagcgcaaaagatg

SEQ ID NO: 165904 - DNA, 103 bp, Artificial Sequence
  Synthetic Polynucleotide
taatacgactcactatagggtccgaggattgagttgcaggcagcccgcaaaacagaggagattgcggatggcctgcaacaacctggcggcagcgcaaaagatg

SEQ ID NO: 165905 - DNA, 103 bp, Artificial Sequence
  Synthetic Polynucleotide
taatacgactcactatagggggcagaaaagtccgaggattgagttgcaggaacagaggagacctgcaatgcaatcctcgaacctggcggcagcgcaaaagatg

SEQ ID NO: 165906 - DNA, 103 bp, Artificial Sequence
  Synthetic Polynucleotide
taatacgactcactataggggttctgctcaggcagaaaagtccgaggattaacagaggagaaatcctatgacttttctgaacctggcggcagcgcaaaagatg

SEQ ID NO: 165907 - DNA, 103 bp, Artificial Sequence
  Synthetic Polynucleotide
taatacgactcactataggggcatgtcctggttctgctcaggcagaaaagaacagaggagacttttcatgctgagcagaaacctggcggcagcgcaaaagatg

SEQ ID NO: 165908 - DNA, 103 bp, Artificial Sequence
  Synthetic Polynucleotide
taatacgactcactatagggagacactcgtctgtccagcttggaggacctaacagaggagaaggtccatgaagctggacaacctggcggcagcgcaaaagatg

SEQ ID NO: 165909 - DNA, 103 bp, Artificial Sequence
  Synthetic Polynucleotide
taatacgactcactatagggaggtgggggggcatgtcctggttctgctcaaacagaggagatgagcaatgccaggacataacctggcggcagcgcaaaagatg

SEQ ID NO: 165910 - DNA, 103 bp, Artificial Sequence
  Synthetic Polynucleotide
taatacgactcactatagggggccgtcggcaggtgggggggcatgtcctgaacagaggagacaggacatgcccccccacaacctggcggcagcgcaaaagatg

SEQ ID NO: 165911 - DNA, 103 bp, Artificial Sequence
  Synthetic Polynucleotide
taatacgactcactatagggaggaagcgctggccgtcggcaggtggggggaacagaggagaccccccatgtgccgacggaacctggcggcagcgcaaaagatg

SEQ ID NO: 165912 - DNA, 103 bp, Artificial Sequence
  Synthetic Polynucleotide
taatacgactcactatagggtgtacagggaaggaagcgctggccgtcggcaacagaggagagccgacatgcagcgcttcaacctggcggcagcgcaaaagatg

SEQ ID NO: 165913 - DNA, 103 bp, Artificial Sequence
  Synthetic Polynucleotide
taatacgactcactatagggggagtaggggtgtacagggaaggaagcgctaacagaggagaagcgctatgttccctgtaaacctggcggcagcgcaaaagatg

SEQ ID NO: 165914 - DNA, 103 bp, Artificial Sequence
  Synthetic Polynucleotide
taatacgactcactataggggcgactggtaggagtaggggtgtacagggaaacagaggagatccctgatgacccctactaacctggcggcagcgcaaaagatg

SEQ ID NO: 165915 - DNA, 103 bp, Artificial Sequence
  Synthetic Polynucleotide
taatacgactcactatagggggcagcccaggcgactggtaggagtaggggaacagaggagacccctaatgctaccagtcaacctggcggcagcgcaaaagatg

SEQ ID NO: 165916 - DNA, 103 bp, Artificial Sequence
  Synthetic Polynucleotide
taatacgactcactatagggaggcggactgggcagcccaggcgactggtaaacagaggagataccagatgcctgggctgaacctggcggcagcgcaaaagatg

SEQ ID NO: 165917 - DNA, 103 bp, Artificial Sequence
  Synthetic Polynucleotide
taatacgactcactatagggtggtaccgtaaggcggactgggcagcccagaacagaggagactgggcatgccagtccgcaacctggcggcagcgcaaaagatg

SEQ ID NO: 165918 - DNA, 103 bp, Artificial Sequence
  Synthetic Polynucleotide
taatacgactcactataggggagctgtccatggtaccgtaaggcggactgaacagaggagacagtccatgttacggtacaacctggcggcagcgcaaaagatg

SEQ ID NO: 165919 - DNA, 103 bp, Artificial Sequence
  Synthetic Polynucleotide
taatacgactcactatagggctgagaactgagacactcgtctgtccagctaacagaggagaagctggatggacgagtgtaacctggcggcagcgcaaaagatg

SEQ ID NO: 165920 - DNA, 103 bp, Artificial Sequence
  Synthetic Polynucleotide
taatacgactcactataggggaagacatgggagctgtccatggtaccgtaaacagaggagatacggtatgatggacagcaacctggcggcagcgcaaaagatg

SEQ ID NO: 165921 - DNA, 103 bp, Artificial Sequence
  Synthetic Polynucleotide
taatacgactcactataggggcttaacgtggaagacatgggagctgtccaaacagaggagatggacaatgcccatgtctaacctggcggcagcgcaaaagatg

SEQ ID NO: 165922 - DNA, 103 bp, Artificial Sequence
  Synthetic Polynucleotide
taatacgactcactatagggtgcggcggaggcttaacgtggaagacatggaacagaggagaccatgtatgccacgttaaaacctggcggcagcgcaaaagatg

SEQ ID NO: 165923 - DNA, 103 bp, Artificial Sequence
  Synthetic Polynucleotide
taatacgactcactataggggctgtaggcgtgcggcggaggcttaacgtgaacagaggagacacgttatgcctccgccgaacctggcggcagcgcaaaagatg

SEQ ID NO: 165924 - DNA, 103 bp, Artificial Sequence
  Synthetic Polynucleotide
taatacgactcactatagggccagcgctgcgctgtaggcgtgcggcggagaacagaggagactccgcatgacgcctacaaacctggcggcagcgcaaaagatg

SEQ ID NO: 165925 - DNA, 103 bp, Artificial Sequence
  Synthetic Polynucleotide
taatacgactcactatagggaagaagggctccagcgctgcgctgtaggcgaacagaggagacgcctaatgcgcagcgctaacctggcggcagcgcaaaagatg

SEQ ID NO: 165926 - DNA, 103 bp, Artificial Sequence
  Synthetic Polynucleotide
taatacgactcactatagggagggctttcaaagaagggctccagcgctgcaacagaggagagcagcgatggagcccttcaacctggcggcagcgcaaaagatg

SEQ ID NO: 165927 - DNA, 103 bp, Artificial Sequence
  Synthetic Polynucleotide
taatacgactcactatagggaatcagtcagagggctttcaaagaagggctaacagaggagaagccctatgttgaaagccaacctggcggcagcgcaaaagatg

SEQ ID NO: 165928 - DNA, 103 bp, Artificial Sequence
  Synthetic Polynucleotide
taatacgactcactataggggggctggtgcaatcagtcagagggctttcaaacagaggagatgaaagatgtctgactgaaacctggcggcagcgcaaaagatg

SEQ ID NO: 165929 - DNA, 103 bp, Artificial Sequence
  Synthetic Polynucleotide
taatacgactcactatagggatcaaaggaagggctggtgcaatcagtcagaacagaggagactgactatgtgcaccagcaacctggcggcagcgcaaaagatg

SEQ ID NO: 165930 - DNA, 103 bp, Artificial Sequence
  Synthetic Polynucleotide
taatacgactcactataggggctcctcgtcctgagaactgagacactcgtaacagaggagaacgagtatgtcagttctcaacctggcggcagcgcaaaagatg

SEQ ID NO: 165931 - DNA, 103 bp, Artificial Sequence
  Synthetic Polynucleotide
taatacgactcactatagggtgaggggtccatcaaaggaagggctggtgcaacagaggagagcaccaatgcttcctttgaacctggcggcagcgcaaaagatg

SEQ ID NO: 165932 - DNA, 103 bp, Artificial Sequence
  Synthetic Polynucleotide
taatacgactcactatagggagcggcgggctgaggggtccatcaaaggaaaacagaggagattccttatgtggacccctaacctggcggcagcgcaaaagatg

SEQ ID NO: 165933 - DNA, 103 bp, Artificial Sequence
  Synthetic Polynucleotide
taatacgactcactatagggattgatgctgagcggcgggctgaggggtccaacagaggagaggacccatgagcccgccgaacctggcggcagcgcaaaagatg

SEQ ID NO: 165934 - DNA, 103 bp, Artificial Sequence
  Synthetic Polynucleotide
taatacgactcactatagggagaagttgccattgatgctgagcggcgggcaacagaggagagcccgcatgtcagcatcaaacctggcggcagcgcaaaagatg

SEQ ID NO: 165935 - DNA, 103 bp, Artificial Sequence
  Synthetic Polynucleotide
taatacgactcactatagggtgtttgaaagagaagttgccattgatgctgaacagaggagacagcatatgtggcaacttaacctggcggcagcgcaaaagatg

SEQ ID NO: 165936 - DNA, 103 bp, Artificial Sequence
  Synthetic Polynucleotide
taatacgactcactatagggggacggttcgtgtttgaaagagaagttgccaacagaggagaggcaacatgtctttcaaaaacctggcggcagcgcaaaagatg

SEQ ID NO: 165937 - DNA, 103 bp, Artificial Sequence
  Synthetic Polynucleotide
taatacgactcactatagggcaaactcggcggacggttcgtgtttgaaagaacagaggagactttcaatgacgaaccgtaacctggcggcagcgcaaaagatg

SEQ ID NO: 165938 - DNA, 103 bp, Artificial Sequence
  Synthetic Polynucleotide
taatacgactcactatagggtaatttttctcaaactcggcggacggttcgaacagaggagacgaaccatgcgccgagttaacctggcggcagcgcaaaagatg

SEQ ID NO: 165939 - DNA, 103 bp, Artificial Sequence
  Synthetic Polynucleotide
taatacgactcactatagggggtaaaggcataatttttctcaaactcggcaacagaggagagccgagatggagaaaaataacctggcggcagcgcaaaagatg

SEQ ID NO: 165940 - DNA, 103 bp, Artificial Sequence
  Synthetic Polynucleotide
taatacgactcactataggggatagtgcatggtaaaggcataatttttctaacagaggagaagaaaaatgatgcctttaaacctggcggcagcgcaaaagatg

SEQ ID NO: 165941 - DNA, 103 bp, Artificial Sequence
  Synthetic Polynucleotide
taatacgactcactatagggtctgcctcgtgctcctcgtcctgagaactgaacagaggagacagttcatgggacgaggaaacctggcggcagcgcaaaagatg

SEQ ID NO: 165942 - DNA, 103 bp, Artificial Sequence
  Synthetic Polynucleotide
taatacgactcactataggggtcgctgcaggatagtgcatggtaaaggcaaacagaggagatgccttatgcatgcactaaacctggcggcagcgcaaaagatg

SEQ ID NO: 165943 - DNA, 103 bp, Artificial Sequence
  Synthetic Polynucleotide
taatacgactcactatagggccctgccagtgtcgctgcaggatagtgcataacagaggagaatgcacatgcctgcagcgaacctggcggcagcgcaaaagatg

SEQ ID NO: 165944 - DNA, 103 bp, Artificial Sequence
  Synthetic Polynucleotide
taatacgactcactatagggggctttgggcccctgccagtgtcgctgcagaacagaggagactgcagatgcactggcagaacctggcggcagcgcaaaagatg

SEQ ID NO: 165945 - DNA, 103 bp, Artificial Sequence
  Synthetic Polynucleotide
taatacgactcactatagggattgatccgtggctttgggcccctgccagtaacagaggagaactggcatgggcccaaagaacctggcggcagcgcaaaagatg

SEQ ID NO: 165946 - DNA, 103 bp, Artificial Sequence
  Synthetic Polynucleotide
taatacgactcactataggggcctgagaagattgatccgtggctttgggcaacagaggagagcccaaatgcacggatcaaacctggcggcagcgcaaaagatg

SEQ ID NO: 165947 - DNA, 103 bp, Artificial Sequence
  Synthetic Polynucleotide
taatacgactcactataggggggcagcggtgcctgagaagattgatccgtaacagaggagaacggatatgtcttctcagaacctggcggcagcgcaaaagatg

SEQ ID NO: 165948 - DNA, 103 bp, Artificial Sequence
  Synthetic Polynucleotide
taatacgactcactatagggtcgcagcgaggggcagcggtgcctgagaagaacagaggagacttctcatgcaccgctgcaacctggcggcagcgcaaaagatg

SEQ ID NO: 165949 - DNA, 103 bp, Artificial Sequence
  Synthetic Polynucleotide
taatacgactcactatagggtatggggatctcgcagcgaggggcagcggtaacagaggagaaccgctatgcctcgctgcaacctggcggcagcgcaaaagatg

SEQ ID NO: 165950 - DNA, 103 bp, Artificial Sequence
  Synthetic Polynucleotide
taatacgactcactatagggtaatattgtctatggggatctcgcagcgagaacagaggagactcgctatgagatccccaaacctggcggcagcgcaaaagatg

SEQ ID NO: 165951 - DNA, 103 bp, Artificial Sequence
  Synthetic Polynucleotide
taatacgactcactatagggtcgaaggacataatattgtctatggggatcaacagaggagagatcccatgagacaatataacctggcggcagcgcaaaagatg

SEQ ID NO: 165952 - DNA, 103 bp, Artificial Sequence
  Synthetic Polynucleotide
taatacgactcactataggggccgggctcgctgaacaggcgggtcagcataacagaggagaatgctgatgcgcctgttcaacctggcggcagcgcaaaagatg

SEQ ID NO: 165953 - DNA, 103 bp, Artificial Sequence
  Synthetic Polynucleotide
taatacgactcactatagggtggcggtggcggcgcgtcgcccttgtcgctaacagaggagaagcgacatgggcgacgcgaacctggcggcagcgcaaaagatg

SEQ ID NO: 165954 - DNA, 103 bp, Artificial Sequence
  Synthetic Polynucleotide
taatacgactcactataggggtggcccgtgggccgcgaaccgggcagcgcaacagaggagagcgctgatgggttcgcggaacctggcggcagcgcaaaagatg

SEQ ID NO: 165955 - DNA, 103 bp, Artificial Sequence
  Synthetic Polynucleotide
taatacgactcactatagggagactagcccgtggcccgtgggccgcgaacaacagaggagagttcgcatgccacgggccaacctggcggcagcgcaaaagatg

SEQ ID NO: 165956 - DNA, 103 bp, Artificial Sequence
  Synthetic Polynucleotide
taatacgactcactataggggacgagccgaagactagcccgtggcccgtgaacagaggagacacgggatgcgggctagtaacctggcggcagcgcaaaagatg

SEQ ID NO: 165957 - DNA, 103 bp, Artificial Sequence
  Synthetic Polynucleotide
taatacgactcactataggggcgcacagccgacgagccgaagactagcccaacagaggagagggctaatgttcggctcgaacctggcggcagcgcaaaagatg

SEQ ID NO: 165958 - DNA, 103 bp, Artificial Sequence
  Synthetic Polynucleotide
taatacgactcactatagggggacgcccccgcgcacagccgacgagccgaaacagaggagatcggctatgcggctgtgcaacctggcggcagcgcaaaagatg

SEQ ID NO: 165959 - DNA, 103 bp, Artificial Sequence
  Synthetic Polynucleotide
taatacgactcactatagggttctccgagtggacgcccccgcgcacagccaacagaggagaggctgtatgcgggggcgtaacctggcggcagcgcaaaagatg

SEQ ID NO: 165960 - DNA, 103 bp, Artificial Sequence
  Synthetic Polynucleotide
taatacgactcactatagggagacaagagattctccgagtggacgcccccaacagaggagagggggcatgcactcggagaacctggcggcagcgcaaaagatg

SEQ ID NO: 165961 - DNA, 103 bp, Artificial Sequence
  Synthetic Polynucleotide
taatacgactcactataggggcatatcgtaagacaagagattctccgagtaacagaggagaactcggatgatctcttgtaacctggcggcagcgcaaaagatg

SEQ ID NO: 165962 - DNA, 103 bp, Artificial Sequence
  Synthetic Polynucleotide
taatacgactcactatagggtggtgaaggtgcatatcgtaagacaagagaaacagaggagatctcttatgttacgatataacctggcggcagcgcaaaagatg

SEQ ID NO: 165963 - DNA, 103 bp, Artificial Sequence
  Synthetic Polynucleotide
taatacgactcactataggggccccggtcgtggtgaaggtgcatatcgtaaacagaggagatacgatatgcaccttcacaacctggcggcagcgcaaaagatg

SEQ ID NO: 165964 - DNA, 103 bp, Artificial Sequence
  Synthetic Polynucleotide
taatacgactcactataggggcgcaggcggtggcggtggcggcgcgtcgcaacagaggagagcgacgatgcgccaccgcaacctggcggcagcgcaaaagatg

SEQ ID NO: 165965 - DNA, 103 bp, Artificial Sequence
  Synthetic Polynucleotide
taatacgactcactatagggcgtacatggggccccggtcgtggtgaaggtaacagaggagaaccttcatgacgaccgggaacctggcggcagcgcaaaagatg

SEQ ID NO: 165966 - DNA, 103 bp, Artificial Sequence
  Synthetic Polynucleotide
taatacgactcactatagggttgagctcctcgtacatggggccccggtcgaacagaggagacgaccgatgccccatgtaaacctggcggcagcgcaaaagatg

SEQ ID NO: 165967 - DNA, 103 bp, Artificial Sequence
  Synthetic Polynucleotide
taatacgactcactatagggaaaaaacgcattgagctcctcgtacatgggaacagaggagacccatgatggaggagctcaacctggcggcagcgcaaaagatg

SEQ ID NO: 165968 - DNA, 103 bp, Artificial Sequence
  Synthetic Polynucleotide
taatacgactcactatagggcctggcccgggcgcaggcggtggcggtggcaacagaggagagccaccatgaccgcctgcaacctggcggcagcgcaaaagatg

SEQ ID NO: 165969 - DNA, 103 bp, Artificial Sequence
  Synthetic Polynucleotide
taatacgactcactatagggccccggagcccctggcccgggcgcaggcggaacagaggagaccgcctatgcccgggccaaacctggcggcagcgcaaaagatg

SEQ ID NO: 165970 - DNA, 103 bp, Artificial Sequence
  Synthetic Polynucleotide
taatacgactcactatagggcccgggctggccccggagcccctggcccggaacagaggagaccgggcatggggctccggaacctggcggcagcgcaaaagatg

SEQ ID NO: 165971 - DNA, 103 bp, Artificial Sequence
  Synthetic Polynucleotide
taatacgactcactatagggggcttggccgcccgggctggccccggagccaacagaggagaggctccatggccagcccgaacctggcggcagcgcaaaagatg

SEQ ID NO: 165972 - DNA, 103 bp, Artificial Sequence
  Synthetic Polynucleotide
taatacgactcactataggggagagggactggcttggccgcccgggctggaacagaggagaccagccatggcggccaagaacctggcggcagcgcaaaagatg

SEQ ID NO: 165973 - DNA, 103 bp, Artificial Sequence
  Synthetic Polynucleotide
taatacgactcactatagggcttctccacggagagggactggcttggccgaacagaggagacggccaatgcagtccctcaacctggcggcagcgcaaaagatg

SEQ ID NO: 165974 - DNA, 103 bp, Artificial Sequence
  Synthetic Polynucleotide
taatacgactcactatagggtccgtcccctcttctccacggagagggactaacagaggagaagtcccatgccgtggagaaacctggcggcagcgcaaaagatg

SEQ ID NO: 165975 - DNA, 103 bp, Artificial Sequence
  Synthetic Polynucleotide
taatacgactcactatagggcaacgtggcctccgtcccctcttctccacgaacagaggagacgtggaatggaggggacgaacctggcggcagcgcaaaagatg

SEQ ID NO: 165976 - DNA, 103 bp, Artificial Sequence
  Synthetic Polynucleotide
taatacgactcactatagggccgagagaaggccgggctcgctgaacaggcaacagaggagagcctgtatggcgagcccgaacctggcggcagcgcaaaagatg

SEQ ID NO: 165977 - DNA, 103 bp, Artificial Sequence
  Synthetic Polynucleotide
taatacgactcactatagggtgacctcggccaacgtggcctccgtcccctaacagaggagaaggggaatgaggccacgtaacctggcggcagcgcaaaagatg

SEQ ID NO: 165978 - DNA, 103 bp, Artificial Sequence
  Synthetic Polynucleotide
taatacgactcactatagggccttcctccttgacctcggccaacgtggccaacagaggagaggccacatgggccgaggtaacctggcggcagcgcaaaagatg

SEQ ID NO: 165979 - DNA, 103 bp, Artificial Sequence
  Synthetic Polynucleotide
taatacgactcactatagggccccagctcgccttcctccttgacctcggcaacagaggagagccgagatgaaggaggaaaacctggcggcagcgcaaaagatg

SEQ ID NO: 165980 - DNA, 103 bp, Artificial Sequence
  Synthetic Polynucleotide
taatacgactcactatagggcctcctctccccccagctcgccttcctcctaacagaggagaaggaggatggcgagctggaacctggcggcagcgcaaaagatg

SEQ ID NO: 165981 - DNA, 103 bp, Artificial Sequence
  Synthetic Polynucleotide
taatacgactcactatagggtcttcctcctcctcctctccccccagctcgaacagaggagacgagctatggggagaggaaacctggcggcagcgcaaaagatg

SEQ ID NO: 165982 - DNA, 103 bp, Artificial Sequence
  Synthetic Polynucleotide
taatacgactcactatagggttcctcctcctcttcctcctcctcctctccaacagaggagaggagagatggaggaggaaaacctggcggcagcgcaaaagatg

SEQ ID NO: 165983 - DNA, 103 bp, Artificial Sequence
  Synthetic Polynucleotide
taatacgactcactatagggccagtccttcttcctcctcctcttcctcctaacagaggagaaggaggatgaggaggaggaacctggcggcagcgcaaaagatg

SEQ ID NO: 165984 - DNA, 103 bp, Artificial Sequence
  Synthetic Polynucleotide
taatacgactcactatagggtccgcctcgtccagtccttcttcctcctccaacagaggagaggaggaatgagaaggactaacctggcggcagcgcaaaagatg

SEQ ID NO: 165985 - DNA, 103 bp, Artificial Sequence
  Synthetic Polynucleotide
taatacgactcactatagggccgctcgccctccgcctcgtccagtccttcaacagaggagagaaggaatggacgaggcgaacctggcggcagcgcaaaagatg

SEQ ID NO: 165986 - DNA, 103 bp, Artificial Sequence
  Synthetic Polynucleotide
taatacgactcactataggggcttcttgggccgctcgccctccgcctcgtaacagaggagaacgaggatgagggcgagcaacctggcggcagcgcaaaagatg

SEQ ID NO: 165987 - DNA, 103 bp, Artificial Sequence
  Synthetic Polynucleotide
taatacgactcactatagggttgggcacgtccgagagaaggccgggctcgaacagaggagacgagccatgccttctctcaacctggcggcagcgcaaaagatg

SEQ ID NO: 165988 - DNA, 103 bp, Artificial Sequence
  Synthetic Polynucleotide
taatacgactcactatagggttgggcccgcgcttcttgggccgctcgcccaacagaggagagggcgaatggcccaagaaaacctggcggcagcgcaaaagatg

SEQ ID NO: 165989 - DNA, 103 bp, Artificial Sequence
  Synthetic Polynucleotide
taatacgactcactatagggcttgcgcttcttgggcccgcgcttcttgggaacagaggagacccaagatgcgcgggcccaacctggcggcagcgcaaaagatg

SEQ ID NO: 165990 - DNA, 103 bp, Artificial Sequence
  Synthetic Polynucleotide
taatacgactcactatagggccttggtcatcttgcgcttcttgggcccgcaacagaggagagcgggcatgagaagcgcaaacctggcggcagcgcaaaagatg

SEQ ID NO: 165991 - DNA, 103 bp, Artificial Sequence
  Synthetic Polynucleotide
taatacgactcactatagggtccaagcgcgccttggtcatcttgcgcttcaacagaggagagaagcgatggatgaccaaaacctggcggcagcgcaaaagatg

SEQ ID NO: 165992 - DNA, 103 bp, Artificial Sequence
  Synthetic Polynucleotide
taatacgactcactatagggcttggagcgctccaagcgcgccttggtcataacagaggagaatgaccatggcgcgcttgaacctggcggcagcgcaaaagatg

SEQ ID NO: 165993 - DNA, 103 bp, Artificial Sequence
  Synthetic Polynucleotide
taatacgactcactataggggccgccgaagcttggagcgctccaagcgcgaacagaggagacgcgctatgagcgctccaaacctggcggcagcgcaaaagatg

SEQ ID NO: 165994 - DNA, 103 bp, Artificial Sequence
  Synthetic Polynucleotide
taatacgactcactatagggttcgccttctgccgccgaagcttggagcgcaacagaggagagcgctcatggcttcggcgaacctggcggcagcgcaaaagatg

SEQ ID NO: 165995 - DNA, 103 bp, Artificial Sequence
  Synthetic Polynucleotide
taatacgactcactatagggctcccgcgcgttcgccttctgccgccgaagaacagaggagacttcggatgcagaaggcgaacctggcggcagcgcaaaagatg

SEQ ID NO: 165996 - DNA, 103 bp, Artificial Sequence
  Synthetic Polynucleotide
taatacgactcactatagggtgcggttgcgctcccgcgcgttcgccttctaacagaggagaagaaggatgacgcgcgggaacctggcggcagcgcaaaagatg

SEQ ID NO: 165997 - DNA, 103 bp, Artificial Sequence
  Synthetic Polynucleotide
taatacgactcactatagggaggtcgtgcatgcggttgcgctcccgcgcgaacagaggagacgcgcgatggcgcaaccgaacctggcggcagcgcaaaagatg

SEQ ID NO: 165998 - DNA, 103 bp, Artificial Sequence
  Synthetic Polynucleotide
taatacgactcactataggggctggcgaacttgggcacgtccgagagaagaacagaggagacttctcatggacgtgcccaacctggcggcagcgcaaaagatg

SEQ ID NO: 165999 - DNA, 103 bp, Artificial Sequence
  Synthetic Polynucleotide
taatacgactcactatagggggctgcgttcaggtcgtgcatgcggttgcgaacagaggagacgcaacatgatgcacgacaacctggcggcagcgcaaaagatg

SEQ ID NO: 166000 - DNA, 103 bp, Artificial Sequence
  Synthetic Polynucleotide
taatacgactcactatagggggttgtccagggctgcgttcaggtcgtgcaaacagaggagatgcacgatgtgaacgcagaacctggcggcagcgcaaaagatg

SEQ ID NO: 166001 - DNA, 103 bp, Artificial Sequence
  Synthetic Polynucleotide
taatacgactcactatagggaccttgcgcaggttgtccagggctgcgttcaacagaggagagaacgcatgcctggacaaaacctggcggcagcgcaaaagatg

SEQ ID NO: 166002 - DNA, 103 bp, Artificial Sequence
  Synthetic Polynucleotide
taatacgactcactataggggcagggcaccaccttgcgcaggttgtccagaacagaggagactggacatgctgcgcaagaacctggcggcagcgcaaaagatg

SEQ ID NO: 166003 - DNA, 103 bp, Artificial Sequence
  Synthetic Polynucleotide
taatacgactcactatagggtcttggagtagcagggcaccaccttgcgcaaacagaggagatgcgcaatgtggtgccctaacctggcggcagcgcaaaagatg

SEQ ID NO: 166004 - DNA, 103 bp, Artificial Sequence
  Synthetic Polynucleotide
taatacgactcactatagggagcttctgcgtcttggagtagcagggcaccaacagaggagaggtgccatgctactccaaaacctggcggcagcgcaaaagatg

SEQ ID NO: 166005 - DNA, 103 bp, Artificial Sequence
  Synthetic Polynucleotide
taatacgactcactataggggatcttggacagcttctgcgtcttggagtaaacagaggagatactccatgacgcagaagaacctggcggcagcgcaaaagatg

SEQ ID NO: 166006 - DNA, 103 bp, Artificial Sequence
  Synthetic Polynucleotide
taatacgactcactataggggcagcgtctcgatcttggacagcttctgcgaacagaggagacgcagaatgtgtccaagaaacctggcggcagcgcaaaagatg

SEQ ID NO: 166007 - DNA, 103 bp, Artificial Sequence
  Synthetic Polynucleotide
taatacgactcactatagggttggctaggcgcagcgtctcgatcttggacaacagaggagagtccaaatgcgagacgctaacctggcggcagcgcaaaagatg

SEQ ID NO: 166008 - DNA, 103 bp, Artificial Sequence
  Synthetic Polynucleotide
taatacgactcactataggggatatagttcttggctaggcgcagcgtctcaacagaggagagagacgatgcgcctagccaacctggcggcagcgcaaaagatg

SEQ ID NO: 166009 - DNA, 103 bp, Artificial Sequence
  Synthetic Polynucleotide
taatacgactcactatagggcgtcgccccagctggcgaacttgggcacgtaacagaggagaacgtgcatgagttcgccaaacctggcggcagcgcaaaagatg

SEQ ID NO: 166010 - DNA, 103 bp, Artificial Sequence
  Synthetic Polynucleotide
taatacgactcactatagggagagcgcccagatatagttcttggctaggcaacagaggagagcctagatgagaactataaacctggcggcagcgcaaaagatg

SEQ ID NO: 166011 - DNA, 103 bp, Artificial Sequence
  Synthetic Polynucleotide
taatacgactcactatagggaggatctccgagagcgcccagatatagttcaacagaggagagaactaatgctgggcgctaacctggcggcagcgcaaaagatg

SEQ ID NO: 166012 - DNA, 103 bp, Artificial Sequence
  Synthetic Polynucleotide
taatacgactcactataggggccggagcgcaggatctccgagagcgcccaaacagaggagatgggcgatgtcggagatcaacctggcggcagcgcaaaagatg

SEQ ID NO: 166013 - DNA, 103 bp, Artificial Sequence
  Synthetic Polynucleotide
taatacgactcactatagggctggccgcttgccggagcgcaggatctccgaacagaggagacggagaatgtgcgctccgaacctggcggcagcgcaaaagatg

SEQ ID NO: 166014 - DNA, 103 bp, Artificial Sequence
  Synthetic Polynucleotide
taatacgactcactataggggacactaggtctggccgcttgccggagcgcaacagaggagagcgctcatgcaagcggccaacctggcggcagcgcaaaagatg

SEQ ID NO: 166015 - DNA, 103 bp, Artificial Sequence
  Synthetic Polynucleotide
taatacgactcactatagggctgcacgtaggacactaggtctggccgcttaacagaggagaaagcggatggacctagtgaacctggcggcagcgcaaaagatg

SEQ ID NO: 166016 - DNA, 103 bp, Artificial Sequence
  Synthetic Polynucleotide
taatacgactcactatagggtgcacagagtctgcacgtaggacactaggtaacagaggagaacctagatgcctacgtgcaacctggcggcagcgcaaaagatg

SEQ ID NO: 166017 - DNA, 103 bp, Artificial Sequence
  Synthetic Polynucleotide
taatacgactcactataggggacagacccttgcacagagtctgcacgtagaacagaggagactacgtatggactctgtgaacctggcggcagcgcaaaagatg

SEQ ID NO: 166018 - DNA, 103 bp, Artificial Sequence
  Synthetic Polynucleotide
taatacgactcactatagggggtgggctgcgacagacccttgcacagagtaacagaggagaactctgatgaagggtctgaacctggcggcagcgcaaaagatg

SEQ ID NO: 166019 - DNA, 103 bp, Artificial Sequence
  Synthetic Polynucleotide
taatacgactcactatagggccagattggtggtgggctgcgacagaccctaacagaggagaagggtcatgcgcagcccaaacctggcggcagcgcaaaagatg

SEQ ID NO: 166020 - DNA, 103 bp, Artificial Sequence
  Synthetic Polynucleotide
taatacgactcactatagggtcgtcttcgccgtcgccccagctggcgaacaacagaggagagttcgcatgctggggcgaaacctggcggcagcgcaaaagatg

SEQ ID NO: 166021 - DNA, 103 bp, Artificial Sequence
  Synthetic Polynucleotide
taatacgactcactatagggcagccggccaccagattggtggtgggctgcaacagaggagagcagccatgcaccaatctaacctggcggcagcgcaaaagatg

SEQ ID NO: 166022 - DNA, 103 bp, Artificial Sequence
  Synthetic Polynucleotide
taatacgactcactataggggagctgcagacagccggccaccagattggtaacagaggagaaccaatatggtggccggcaacctggcggcagcgcaaaagatg

SEQ ID NO: 166023 - DNA, 103 bp, Artificial Sequence
  Synthetic Polynucleotide
taatacgactcactatagggtgcgagagttgagctgcagacagccggccaaacagaggagatggccgatggtctgcagcaacctggcggcagcgcaaaagatg

SEQ ID NO: 166024 - DNA, 103 bp, Artificial Sequence
  Synthetic Polynucleotide
taatacgactcactataggggtgaggaagttgcgagagttgagctgcagaaacagaggagatctgcaatgcaactctcgaacctggcggcagcgcaaaagatg

SEQ ID NO: 166025 - DNA, 103 bp, Artificial Sequence
  Synthetic Polynucleotide
taatacgactcactataggggccttgctccgtgaggaagttgcgagagttaacagaggagaaactctatgaacttcctcaacctggcggcagcgcaaaagatg

SEQ ID NO: 166026 - DNA, 103 bp, Artificial Sequence
  Synthetic Polynucleotide
taatacgactcactatagggcaccgtcggcgccttgctccgtgaggaagtaacagaggagaacttccatgcggagcaagaacctggcggcagcgcaaaagatg

SEQ ID NO: 166027 - DNA, 103 bp, Artificial Sequence
  Synthetic Polynucleotide
taatacgactcactatagggaagcggccggcaccgtcggcgccttgctccaacagaggagaggagcaatgcgccgacggaacctggcggcagcgcaaaagatg

SEQ ID NO: 166028 - DNA, 103 bp, Artificial Sequence
  Synthetic Polynucleotide
taatacgactcactatagggcgagccgtggaagcggccggcaccgtcggcaacagaggagagccgacatggccggccgcaacctggcggcagcgcaaaagatg

SEQ ID NO: 166029 - DNA, 103 bp, Artificial Sequence
  Synthetic Polynucleotide
taatacgactcactatagggacgggccgcccgagccgtggaagcggccggaacagaggagaccggccatgtccacggctaacctggcggcagcgcaaaagatg

SEQ ID NO: 166030 - DNA, 103 bp, Artificial Sequence
  Synthetic Polynucleotide
taatacgactcactatagggtgcatggcgaacgggccgcccgagccgtggaacagaggagaccacggatggggcggcccaacctggcggcagcgcaaaagatg

SEQ ID NO: 166031 - DNA, 103 bp, Artificial Sequence
  Synthetic Polynucleotide
taatacgactcactatagggcctcggctcgtcgtcttcgccgtcgccccaaacagaggagatggggcatgggcgaagacaacctggcggcagcgcaaaagatg

SEQ ID NO: 166032 - DNA, 103 bp, Artificial Sequence
  Synthetic Polynucleotide
taatacgactcactatagggcgggtaggggtgcatggcgaacgggccgccaacagaggagaggcggcatgttcgccatgaacctggcggcagcgcaaaagatg

SEQ ID NO: 166033 - DNA, 103 bp, Artificial Sequence
  Synthetic Polynucleotide
taatacgactcactatagggagcacgggtacgggtaggggtgcatggcgaaacagaggagatcgccaatgacccctaccaacctggcggcagcgcaaaagatg

SEQ ID NO: 166034 - DNA, 103 bp, Artificial Sequence
  Synthetic Polynucleotide
taatacgactcactataggggccaggcgcgagcacgggtacgggtaggggaacagaggagacccctaatggtacccgtgaacctggcggcagcgcaaaagatg

SEQ ID NO: 166035 - DNA, 103 bp, Artificial Sequence
  Synthetic Polynucleotide
taatacgactcactatagggctgtgcgcccgccaggcgcgagcacgggtaaacagaggagatacccgatgtcgcgcctgaacctggcggcagcgcaaaagatg

SEQ ID NO: 166036 - DNA, 103 bp, Artificial Sequence
  Synthetic Polynucleotide
taatacgactcactatagggccgcctggcactgtgcgcccgccaggcgcgaacagaggagacgcgccatgcgggcgcacaacctggcggcagcgcaaaagatg

SEQ ID NO: 166037 - DNA, 103 bp, Artificial Sequence
  Synthetic Polynucleotide
taatacgactcactatagggaggccgccggccgcctggcactgtgcgcccaacagaggagagggcgcatggtgccaggcaacctggcggcagcgcaaaagatg

SEQ ID NO: 166038 - DNA, 103 bp, Artificial Sequence
  Synthetic Polynucleotide
taatacgactcactataggggccgccgcccaggccgccggccgcctggcaaacagaggagatgccagatggccggcggcaacctggcggcagcgcaaaagatg

SEQ ID NO: 166039 - DNA, 103 bp, Artificial Sequence
  Synthetic Polynucleotide
taatacgactcactatagggcgtgcgccgcgccgccgcccaggccgccggaacagaggagaccggcgatgtgggcggcgaacctggcggcagcgcaaaagatg

SEQ ID NO: 166040 - DNA, 103 bp, Artificial Sequence
  Synthetic Polynucleotide
taatacgactcactataggggtccgcagggcgtgcgccgcgccgccgcccaacagaggagagggcggatgcgcggcgcaaacctggcggcagcgcaaaagatg

SEQ ID NO: 166041 - DNA, 103 bp, Artificial Sequence
  Synthetic Polynucleotide
taatacgactcactataggggtagccgtgggtccgcagggcgtgcgccgcaacagaggagagcggcgatggccctgcggaacctggcggcagcgcaaaagatg

SEQ ID NO: 166042 - DNA, 103 bp, Artificial Sequence
  Synthetic Polynucleotide
taatacgactcactatagggccttgtcgctcctcggctcgtcgtcttcgcaacagaggagagcgaagatgacgagccgaaacctggcggcagcgcaaaagatg

SEQ ID NO: 166043 - DNA, 103 bp, Artificial Sequence
  Synthetic Polynucleotide
taatacgactcactatagggaggcggcgcagtagccgtgggtccgcagggaacagaggagaccctgcatgcccacggctaacctggcggcagcgcaaaagatg

SEQ ID NO: 166044 - DNA, 103 bp, Artificial Sequence
  Synthetic Polynucleotide
taatacgactcactatagggagcgtctcgtaggcggcgcagtagccgtggaacagaggagaccacggatgctgcgccgcaacctggcggcagcgcaaaagatg

SEQ ID NO: 166045 - DNA, 103 bp, Artificial Sequence
  Synthetic Polynucleotide
taatacgactcactatagggcgccgcatacagcgtctcgtaggcggcgcaaacagaggagatgcgccatgtacgagacgaacctggcggcagcgcaaaagatg

SEQ ID NO: 166046 - DNA, 103 bp, Artificial Sequence
  Synthetic Polynucleotide
taatacgactcactatagggcaccgcctgccgccgcatacagcgtctcgtaacagaggagaacgagaatgtgtatgcggaacctggcggcagcgcaaaagatg

SEQ ID NO: 166047 - DNA, 103 bp, Artificial Sequence
  Synthetic Polynucleotide
taatacgactcactatagggctcgcgccgccaccgcctgccgccgcatacaacagaggagagtatgcatgggcaggcggaacctggcggcagcgcaaaagatg

SEQ ID NO: 166048 - DNA, 103 bp, Artificial Sequence
  Synthetic Polynucleotide
taatacgactcactataggggtagtccgggctcgcgccgccaccgcctgcaacagaggagagcaggcatgggcggcgcgaacctggcggcagcgcaaaagatg

SEQ ID NO: 166049 - DNA, 103 bp, Artificial Sequence
  Synthetic Polynucleotide
taatacgactcactatagggcggagctgttgtagtccgggctcgcgccgcaacagaggagagcggcgatggcccggactaacctggcggcagcgcaaaagatg

SEQ ID NO: 166050 - DNA, 103 bp, Artificial Sequence
  Synthetic Polynucleotide
taatacgactcactatagggccctcgtactcggagctgttgtagtccgggaacagaggagacccggaatgcaacagctcaacctggcggcagcgcaaaagatg

SEQ ID NO: 166051 - DNA, 103 bp, Artificial Sequence
  Synthetic Polynucleotide
taatacgactcactataggggctgagcgggccctcgtactcggagctgttaacagaggagaaacagcatggagtacgagaacctggcggcagcgcaaaagatg

SEQ ID NO: 166052 - DNA, 103 bp, Artificial Sequence
  Synthetic Polynucleotide
taatacgactcactatagggagagcggggggctgagcgggccctcgtactaacagaggagaagtacgatggcccgctcaaacctggcggcagcgcaaaagatg

SEQ ID NO: 166053 - DNA, 103 bp, Artificial Sequence
  Synthetic Polynucleotide
taatacgactcactatagggggcgcgtcgcccttgtcgctcctcggctcgaacagaggagacgagccatggagcgacaaaacctggcggcagcgcaaaagatg

SEQ ID NO: 166054 - DNA, 103 bp, Artificial Sequence
  Synthetic Polynucleotide
taatacgactcactatagggccattgagacagagcggggggctgagcgggaacagaggagacccgctatgccccccgctaacctggcggcagcgcaaaagatg

SEQ ID NO: 166055 - DNA, 103 bp, Artificial Sequence
  Synthetic Polynucleotide
taatacgactcactatagggtgagaagttgccattgagacagagcgggggaacagaggagacccccgatgtgtctcaataacctggcggcagcgcaaaagatg

SEQ ID NO: 166056 - DNA, 103 bp, Artificial Sequence
  Synthetic Polynucleotide
taatacgactcactatagggcctgcttgagtgagaagttgccattgagacaacagaggagagtctcaatggcaacttctaacctggcggcagcgcaaaagatg

SEQ ID NO: 166057 - DNA, 103 bp, Artificial Sequence
  Synthetic Polynucleotide
taatacgactcactatagggggcgaggagtcctgcttgagtgagaagttgaacagaggagacaacttatgactcaagcaaacctggcggcagcgcaaaagatg

SEQ ID NO: 166058 - DNA, 103 bp, Artificial Sequence
  Synthetic Polynucleotide
taatacgactcactatagggctcgtggtcgggcgaggagtcctgcttgagaacagaggagactcaagatggactcctcgaacctggcggcagcgcaaaagatg

SEQ ID NO: 166059 - DNA, 103 bp, Artificial Sequence
  Synthetic Polynucleotide
taatacgactcactatagggggtagcttttctcgtggtcgggcgaggagtaacagaggagaactcctatgccgaccacgaacctggcggcagcgcaaaagatg

SEQ ID NO: 166060 - DNA, 103 bp, Artificial Sequence
  Synthetic Polynucleotide
taatacgactcactatagggatagagtagtggtagcttttctcgtggtcgaacagaggagacgaccaatggaaaagctaaacctggcggcagcgcaaaagatg

SEQ ID NO: 166061 - DNA, 103 bp, Artificial Sequence
  Synthetic Polynucleotide
taatacgactcactatagggcgagtagtgcatagagtagtggtagcttttaacagaggagaaaaagcatgcactactctaacctggcggcagcgcaaaagatg

SEQ ID NO: 166062 - DNA, 103 bp, Artificial Sequence
  Synthetic Polynucleotide
taatacgactcactatagggcgggcagcgccgagtagtgcatagagtagtaacagaggagaactactatgtgcactactaacctggcggcagcgcaaaagatg

SEQ ID NO: 166063 - DNA, 103 bp, Artificial Sequence
  Synthetic Polynucleotide
taatacgactcactatagggggccgcgaaccgggcagcgccgagtagtgcaacagaggagagcactaatgggcgctgccaacctggcggcagcgcaaaagatg

SEQ ID NO: 166064 - DNA, 103 bp, Artificial Sequence
  Synthetic Polynucleotide
taatacgactcactatagggaacagactcatcaaacggtagtgttaacataacagaggagaatgttaatgctaccgtttaacctggcggcagcgcaaaagatg

SEQ ID NO: 166065 - DNA, 103 bp, Artificial Sequence
  Synthetic Polynucleotide
taatacgactcactatagggctgtttggaaaagctttctggcttcttaataacagaggagaattaagatgccagaaagcaacctggcggcagcgcaaaagatg

SEQ ID NO: 166066 - DNA, 103 bp, Artificial Sequence
  Synthetic Polynucleotide
taatacgactcactataggggaaggacaatctgtttggaaaagctttctgaacagaggagacagaaaatgtttccaaacaacctggcggcagcgcaaaagatg

SEQ ID NO: 166067 - DNA, 103 bp, Artificial Sequence
  Synthetic Polynucleotide
taatacgactcactatagggctctttcctcgaaggacaatctgtttggaaaacagaggagattccaaatggattgtcctaacctggcggcagcgcaaaagatg

SEQ ID NO: 166068 - DNA, 103 bp, Artificial Sequence
  Synthetic Polynucleotide
taatacgactcactatagggccttttgatgctctttcctcgaaggacaataacagaggagaattgtcatgcgaggaaagaacctggcggcagcgcaaaagatg

SEQ ID NO: 166069 - DNA, 103 bp, Artificial Sequence
  Synthetic Polynucleotide
taatacgactcactatagggctccaggggcccttttgatgctctttcctcaacagaggagagaggaaatggcatcaaaaaacctggcggcagcgcaaaagatg

SEQ ID NO: 166070 - DNA, 103 bp, Artificial Sequence
  Synthetic Polynucleotide
taatacgactcactatagggtcggtttcttctccaggggcccttttgatgaacagaggagacatcaaatgggcccctggaacctggcggcagcgcaaaagatg

SEQ ID NO: 166071 - DNA, 103 bp, Artificial Sequence
  Synthetic Polynucleotide
taatacgactcactatagggttcttctttctcggtttcttctccaggggcaacagaggagagcccctatggaagaaaccaacctggcggcagcgcaaaagatg

SEQ ID NO: 166072 - DNA, 103 bp, Artificial Sequence
  Synthetic Polynucleotide
taatacgactcactatagggcttcctcctcttcttctttctcggtttcttaacagaggagaaagaaaatgagaaagaagaacctggcggcagcgcaaaagatg

SEQ ID NO: 166073 - DNA, 103 bp, Artificial Sequence
  Synthetic Polynucleotide
taatacgactcactatagggtcttccctgtcttcctcctcttcttctttcaacagaggagagaaagaatgagaggaggaaacctggcggcagcgcaaaagatg

SEQ ID NO: 166074 - DNA, 103 bp, Artificial Sequence
  Synthetic Polynucleotide
taatacgactcactatagggttcatcttcctcttccctgtcttcctcctcaacagaggagagaggagatggacagggaaaacctggcggcagcgcaaaagatg

SEQ ID NO: 166075 - DNA, 103 bp, Artificial Sequence
  Synthetic Polynucleotide
taatacgactcactatagggctggcattacaacagactcatcaaacggtaaacagaggagataccgtatgatgagtctgaacctggcggcagcgcaaaagatg

SEQ ID NO: 166076 - DNA, 103 bp, Artificial Sequence
  Synthetic Polynucleotide
taatacgactcactataggggcaacccattttcatcttcctcttccctgtaacagaggagaacagggatgaggaagatgaacctggcggcagcgcaaaagatg

SEQ ID NO: 166077 - DNA, 103 bp, Artificial Sequence
  Synthetic Polynucleotide
taatacgactcactatagggctccttctaggcaacccattttcatcttccaacagaggagaggaagaatgaaatgggttaacctggcggcagcgcaaaagatg

SEQ ID NO: 166078 - DNA, 103 bp, Artificial Sequence
  Synthetic Polynucleotide
taatacgactcactatagggcctaagacccctccttctaggcaacccattaacagaggagaaatgggatgcctagaaggaacctggcggcagcgcaaaagatg

SEQ ID NO: 166079 - DNA, 103 bp, Artificial Sequence
  Synthetic Polynucleotide
taatacgactcactatagggtcttttttttcctaagacccctccttctagaacagaggagactagaaatgggggtcttaaacctggcggcagcgcaaaagatg

SEQ ID NO: 166080 - DNA, 103 bp, Artificial Sequence
  Synthetic Polynucleotide
taatacgactcactatagggagctttgttgtcttttttttcctaagacccaacagaggagagggtctatggaaaaaaaaaacctggcggcagcgcaaaagatg

SEQ ID NO: 166081 - DNA, 103 bp, Artificial Sequence
  Synthetic Polynucleotide
taatacgactcactatagggttccaatcgcagctttgttgtcttttttttaacagaggagaaaaaaaatgacaacaaagaacctggcggcagcgcaaaagatg

SEQ ID NO: 166082 - DNA, 103 bp, Artificial Sequence
  Synthetic Polynucleotide
taatacgactcactatagggacttgaccctttccaatcgcagctttgttgaacagaggagacaacaaatgtgcgattggaacctggcggcagcgcaaaagatg

SEQ ID NO: 166083 - DNA, 103 bp, Artificial Sequence
  Synthetic Polynucleotide
taatacgactcactatagggtgtctcctgaacttgaccctttccaatcgcaacagaggagagcgattatgaagggtcaaaacctggcggcagcgcaaaagatg

SEQ ID NO: 166084 - DNA, 103 bp, Artificial Sequence
  Synthetic Polynucleotide
taatacgactcactataggggttcgcttcctgtctcctgaacttgaccctaacagaggagaagggtcatgttcaggagaaacctggcggcagcgcaaaagatg

SEQ ID NO: 166085 - DNA, 103 bp, Artificial Sequence
  Synthetic Polynucleotide
taatacgactcactatagggtctcgcgcgcgttcgcttcctgtctcctgaaacagaggagatcaggaatgaggaagcgaaacctggcggcagcgcaaaagatg

SEQ ID NO: 166086 - DNA, 103 bp, Artificial Sequence
  Synthetic Polynucleotide
taatacgactcactatagggatctgggattctggcattacaacagactcaaacagaggagatgagtcatgtgtaatgccaacctggcggcagcgcaaaagatg

SEQ ID NO: 166087 - DNA, 103 bp, Artificial Sequence
  Synthetic Polynucleotide
taatacgactcactatagggatcctgttcctctcgcgcgcgttcgcttccaacagaggagaggaagcatgcgcgcgcgaaacctggcggcagcgcaaaagatg

SEQ ID NO: 166088 - DNA, 103 bp, Artificial Sequence
  Synthetic Polynucleotide
taatacgactcactataggggaggccgtgcatcctgttcctctcgcgcgcaacagaggagagcgcgcatgaggaacaggaacctggcggcagcgcaaaagatg

SEQ ID NO: 166089 - DNA, 103 bp, Artificial Sequence
  Synthetic Polynucleotide
taatacgactcactataggggagcgtcgttgaggccgtgcatcctgttccaacagaggagaggaacaatgtgcacggccaacctggcggcagcgcaaaagatg

SEQ ID NO: 166090 - DNA, 103 bp, Artificial Sequence
  Synthetic Polynucleotide
taatacgactcactatagggaagttgtccagagcgtcgttgaggccgtgcaacagaggagagcacggatgcaacgacgcaacctggcggcagcgcaaaagatg

SEQ ID NO: 166091 - DNA, 103 bp, Artificial Sequence
  Synthetic Polynucleotide
taatacgactcactatagggcacttttcttaagttgtccagagcgtcgttaacagaggagaaacgacatgctggacaacaacctggcggcagcgcaaaagatg

SEQ ID NO: 166092 - DNA, 103 bp, Artificial Sequence
  Synthetic Polynucleotide
taatacgactcactatagggaacaggggaccacttttcttaagttgtccaaacagaggagatggacaatgtaagaaaagaacctggcggcagcgcaaaagatg

SEQ ID NO: 166093 - DNA, 103 bp, Artificial Sequence
  Synthetic Polynucleotide
taatacgactcactataggggttttagaataacaggggaccacttttcttaacagaggagaaagaaaatgggtcccctgaacctggcggcagcgcaaaagatg

SEQ ID NO: 166094 - DNA, 103 bp, Artificial Sequence
  Synthetic Polynucleotide
taatacgactcactatagggcagtttctgggttttagaataacaggggacaacagaggagagtccccatgtattctaaaaacctggcggcagcgcaaaagatg

SEQ ID NO: 166095 - DNA, 103 bp, Artificial Sequence
  Synthetic Polynucleotide
taatacgactcactatagggctattttggacagtttctgggttttagaataacagaggagaattctaatgcccagaaacaacctggcggcagcgcaaaagatg

SEQ ID NO: 166096 - DNA, 103 bp, Artificial Sequence
  Synthetic Polynucleotide
taatacgactcactatagggcgtaaagtctctattttggacagtttctggaacagaggagaccagaaatggtccaaaataacctggcggcagcgcaaaagatg

SEQ ID NO: 166097 - DNA, 103 bp, Artificial Sequence
  Synthetic Polynucleotide
taatacgactcactatagggctttctgcacatctgggattctggcattacaacagaggagagtaatgatggaatcccagaacctggcggcagcgcaaaagatg

SEQ ID NO: 166098 - DNA, 103 bp, Artificial Sequence
  Synthetic Polynucleotide
taatacgactcactatagggtttggccagtcgtaaagtctctattttggaaacagaggagatccaaaatggagactttaaacctggcggcagcgcaaaagatg

SEQ ID NO: 166099 - DNA, 103 bp, Artificial Sequence
  Synthetic Polynucleotide
taatacgactcactatagggagatgtagtttttggccagtcgtaaagtctaacagaggagaagacttatggactggccaaacctggcggcagcgcaaaagatg

SEQ ID NO: 166100 - DNA, 103 bp, Artificial Sequence
  Synthetic Polynucleotide
taatacgactcactataggggaaagtgcccagatgtagtttttggccagtaacagaggagaactggcatgaaactacataacctggcggcagcgcaaaagatg

SEQ ID NO: 166101 - DNA, 103 bp, Artificial Sequence
  Synthetic Polynucleotide
taatacgactcactatagggcagaatttcagaaagtgcccagatgtagttaacagaggagaaactacatgtgggcacttaacctggcggcagcgcaaaagatg

SEQ ID NO: 166102 - DNA, 103 bp, Artificial Sequence
  Synthetic Polynucleotide
taatacgactcactatagggtgccgattctcagaatttcagaaagtgcccaacagaggagagggcacatgctgaaattcaacctggcggcagcgcaaaagatg

SEQ ID NO: 166103 - DNA, 103 bp, Artificial Sequence
  Synthetic Polynucleotide
taatacgactcactatagggtctggtctcttgccgattctcagaatttcaaacagaggagatgaaatatggagaatcggaacctggcggcagcgcaaaagatg

SEQ ID NO: 166104 - DNA, 103 bp, Artificial Sequence
  Synthetic Polynucleotide
taatacgactcactatagggtgtgagcagatctggtctcttgccgattctaacagaggagaagaatcatgaagagaccaaacctggcggcagcgcaaaagatg

SEQ ID NO: 166105 - DNA, 103 bp, Artificial Sequence
  Synthetic Polynucleotide
taatacgactcactatagggtttggacgaatgtgagcagatctggtctctaacagaggagaagagacatgatctgctcaaacctggcggcagcgcaaaagatg

SEQ ID NO: 166106 - DNA, 103 bp, Artificial Sequence
  Synthetic Polynucleotide
taatacgactcactatagggttgcataagttttggacgaatgtgagcagaaacagaggagatctgctatgattcgtccaaacctggcggcagcgcaaaagatg

SEQ ID NO: 166107 - DNA, 103 bp, Artificial Sequence
  Synthetic Polynucleotide
taatacgactcactatagggggaaagacctttgcataagttttggacgaaaacagaggagattcgtcatgaacttatgcaacctggcggcagcgcaaaagatg

SEQ ID NO: 166108 - DNA, 103 bp, Artificial Sequence
  Synthetic Polynucleotide
taatacgactcactatagggctctagaaaactttctgcacatctgggattaacagaggagaaatcccatgtgtgcagaaaacctggcggcagcgcaaaagatg

SEQ ID NO: 166109 - DNA, 103 bp, Artificial Sequence
  Synthetic Polynucleotide
taatacgactcactatagggtagttggctgggaaagacctttgcataagtaacagaggagaacttatatgaaggtctttaacctggcggcagcgcaaaagatg

SEQ ID NO: 166110 - DNA, 103 bp, Artificial Sequence
  Synthetic Polynucleotide
taatacgactcactatagggaccaagtttgtagttggctgggaaagacctaacagaggagaaggtctatgccagccaacaacctggcggcagcgcaaaagatg

SEQ ID NO: 166111 - DNA, 103 bp, Artificial Sequence
  Synthetic Polynucleotide
taatacgactcactataggggcagcctgccaccaagtttgtagttggctgaacagaggagacagccaatgacaaacttgaacctggcggcagcgcaaaagatg

SEQ ID NO: 166112 - DNA, 103 bp, Artificial Sequence
  Synthetic Polynucleotide
taatacgactcactatagggtgagctgcaagcagcctgccaccaagtttgaacagaggagacaaactatgtggcaggctaacctggcggcagcgcaaaagatg

SEQ ID NO: 166113 - DNA, 103 bp, Artificial Sequence
  Synthetic Polynucleotide
taatacgactcactatagggctcctggcgttgagctgcaagcagcctgccaacagaggagaggcaggatgcttgcagctaacctggcggcagcgcaaaagatg

SEQ ID NO: 166114 - DNA, 103 bp, Artificial Sequence
  Synthetic Polynucleotide
taatacgactcactatagggcatcaggaaactcctggcgttgagctgcaaaacagaggagattgcagatgaacgccaggaacctggcggcagcgcaaaagatg

SEQ ID NO: 166115 - DNA, 103 bp, Artificial Sequence
  Synthetic Polynucleotide
taatacgactcactatagggcaccctgacccatcaggaaactcctggcgtaacagaggagaacgccaatggtttcctgaaacctggcggcagcgcaaaagatg

SEQ ID NO: 166116 - DNA, 103 bp, Artificial Sequence
  Synthetic Polynucleotide
taatacgactcactataggggcagcctccccaccctgacccatcaggaaaaacagaggagatttcctatggggtcagggaacctggcggcagcgcaaaagatg

SEQ ID NO: 166117 - DNA, 103 bp, Artificial Sequence
  Synthetic Polynucleotide
taatacgactcactatagggtgtgtggtgtgcagcctccccaccctgaccaacagaggagaggtcagatgggggaggctaacctggcggcagcgcaaaagatg

SEQ ID NO: 166118 - DNA, 103 bp, Artificial Sequence
  Synthetic Polynucleotide
taatacgactcactatagggagggtgaccttgtgtggtgtgcagcctcccaacagaggagagggaggatgcacaccacaaacctggcggcagcgcaaaagatg

SEQ ID NO: 166119 - DNA, 103 bp, Artificial Sequence
  Synthetic Polynucleotide
taatacgactcactatagggtcctcgcattctctagaaaactttctgcacaacagaggagagtgcagatggttttctagaacctggcggcagcgcaaaagatg

SEQ ID NO: 166120 - DNA, 103 bp, Artificial Sequence
  Synthetic Polynucleotide
taatacgactcactatagggaaggtagagtagggtgaccttgtgtggtgtaacagaggagaacaccaatgaaggtcaccaacctggcggcagcgcaaaagatg

SEQ ID NO: 166121 - DNA, 103 bp, Artificial Sequence
  Synthetic Polynucleotide
taatacgactcactataggggggtgggtagaaggtagagtagggtgacctaacagaggagaaggtcaatgtactctaccaacctggcggcagcgcaaaagatg

SEQ ID NO: 166122 - DNA, 103 bp, Artificial Sequence
  Synthetic Polynucleotide
taatacgactcactatagggggctgtggtagggtgggtagaaggtagagtaacagaggagaactctaatgtctacccacaacctggcggcagcgcaaaagatg

SEQ ID NO: 166123 - DNA, 103 bp, Artificial Sequence
  Synthetic Polynucleotide
taatacgactcactataggggtgagctcagggctgtggtagggtgggtagaacagaggagactacccatgctaccacagaacctggcggcagcgcaaaagatg

SEQ ID NO: 166124 - DNA, 103 bp, Artificial Sequence
  Synthetic Polynucleotide
taatacgactcactatagggtgggggagtggtgagctcagggctgtggtaaacagaggagataccacatgcctgagctcaacctggcggcagcgcaaaagatg

SEQ ID NO: 166125 - DNA, 103 bp, Artificial Sequence
  Synthetic Polynucleotide
taatacgactcactatagggtcccatgccctgggggagtggtgagctcagaacagaggagactgagcatgccactccccaacctggcggcagcgcaaaagatg

SEQ ID NO: 166126 - DNA, 103 bp, Artificial Sequence
  Synthetic Polynucleotide
taatacgactcactatagggttatcaagagtcccatgccctgggggagtgaacagaggagacactccatgagggcatggaacctggcggcagcgcaaaagatg

SEQ ID NO: 166127 - DNA, 103 bp, Artificial Sequence
  Synthetic Polynucleotide
taatacgactcactatagggggacttggaattatcaagagtcccatgcccaacagaggagagggcatatgactcttgataacctggcggcagcgcaaaagatg

SEQ ID NO: 166128 - DNA, 103 bp, Artificial Sequence
  Synthetic Polynucleotide
taatacgactcactatagggagggtttcatggacttggaattatcaagagaacagaggagactcttgatgattccaagtaacctggcggcagcgcaaaagatg

SEQ ID NO: 166129 - DNA, 103 bp, Artificial Sequence
  Synthetic Polynucleotide
taatacgactcactatagggcaataattgtagggtttcatggacttggaaaacagaggagattccaaatgcatgaaaccaacctggcggcagcgcaaaagatg

SEQ ID NO: 166130 - DNA, 103 bp, Artificial Sequence
  Synthetic Polynucleotide
taatacgactcactatagggttgcttctggtcctcgcattctctagaaaaaacagaggagattttctatggaatgcgagaacctggcggcagcgcaaaagatg

SEQ ID NO: 166131 - DNA, 103 bp, Artificial Sequence
  Synthetic Polynucleotide
taatacgactcactatagggatacgcactgcaataattgtagggtttcataacagaggagaatgaaaatgtacaattataacctggcggcagcgcaaaagatg

SEQ ID NO: 166132 - DNA, 103 bp, Artificial Sequence
  Synthetic Polynucleotide
taatacgactcactatagggagaaggattcatacgcactgcaataattgtaacagaggagaacaattatggcagtgcgtaacctggcggcagcgcaaaagatg

SEQ ID NO: 166133 - DNA, 103 bp, Artificial Sequence
  Synthetic Polynucleotide
taatacgactcactataggggtactttcatagaaggattcatacgcactgaacagaggagacagtgcatgtgaatccttaacctggcggcagcgcaaaagatg

SEQ ID NO: 166134 - DNA, 103 bp, Artificial Sequence
  Synthetic Polynucleotide
taatacgactcactatagggctcaggggaagtactttcatagaaggattcaacagaggagagaatccatgtatgaaagtaacctggcggcagcgcaaaagatg

SEQ ID NO: 166135 - DNA, 103 bp, Artificial Sequence
  Synthetic Polynucleotide
taatacgactcactatagggggctggcacactcaggggaagtactttcataacagaggagaatgaaaatgcttcccctgaacctggcggcagcgcaaaagatg

SEQ ID NO: 166136 - DNA, 103 bp, Artificial Sequence
  Synthetic Polynucleotide
taatacgactcactatagggtcaaactgagggctggcacactcaggggaaaacagaggagattccccatggtgtgccagaacctggcggcagcgcaaaagatg

SEQ ID NO: 166137 - DNA, 103 bp, Artificial Sequence
  Synthetic Polynucleotide
taatacgactcactatagggtaagggaccttcaaactgagggctggcacaaacagaggagatgtgccatgcctcagtttaacctggcggcagcgcaaaagatg

SEQ ID NO: 166138 - DNA, 103 bp, Artificial Sequence
  Synthetic Polynucleotide
taatacgactcactatagggggggaggacttaagggaccttcaaactgagaacagaggagactcagtatgaaggtccctaacctggcggcagcgcaaaagatg

SEQ ID NO: 166139 - DNA, 103 bp, Artificial Sequence
  Synthetic Polynucleotide
taatacgactcactatagggtagttaattgggggaggacttaagggacctaacagaggagaaggtccatgaagtcctccaacctggcggcagcgcaaaagatg

SEQ ID NO: 166140 - DNA, 103 bp, Artificial Sequence
  Synthetic Polynucleotide
taatacgactcactatagggtatcccattatagttaattgggggaggactaacagaggagaagtcctatgccaattaacaacctggcggcagcgcaaaagatg

SEQ ID NO: 166141 - DNA, 103 bp, Artificial Sequence
  Synthetic Polynucleotide
taatacgactcactataggggcttcttaatttgcttctggtcctcgcattaacagaggagaaatgcgatgaccagaagcaacctggcggcagcgcaaaagatg

SEQ ID NO: 166142 - DNA, 103 bp, Artificial Sequence
  Synthetic Polynucleotide
taatacgactcactatagggtcagggaaaatatcccattatagttaattgaacagaggagacaattaatgataatgggaaacctggcggcagcgcaaaagatg

SEQ ID NO: 166143 - DNA, 103 bp, Artificial Sequence
  Synthetic Polynucleotide
taatacgactcactatagggtcttcttgcttcagggaaaatatcccattaaacagaggagataatggatgattttccctaacctggcggcagcgcaaaagatg

SEQ ID NO: 166144 - DNA, 103 bp, Artificial Sequence
  Synthetic Polynucleotide
taatacgactcactataggggtccaaggtttcttcttgcttcagggaaaaaacagaggagattttccatgaagcaagaaaacctggcggcagcgcaaaagatg

SEQ ID NO: 166145 - DNA, 103 bp, Artificial Sequence
  Synthetic Polynucleotide
taatacgactcactatagggttttaccatagtccaaggtttcttcttgctaacagaggagaagcaagatgaaaccttggaacctggcggcagcgcaaaagatg

SEQ ID NO: 166146 - DNA, 103 bp, Artificial Sequence
  Synthetic Polynucleotide
taatacgactcactatagggtaattgtaatttttaccatagtccaaggttaacagaggagaaaccttatgctatggtaaaacctggcggcagcgcaaaagatg

SEQ ID NO: 166147 - DNA, 103 bp, Artificial Sequence
  Synthetic Polynucleotide
taatacgactcactatagggatgcatgccgtaattgtaatttttaccataaacagaggagatatggtatgaattacaataacctggcggcagcgcaaaagatg

SEQ ID NO: 166148 - DNA, 103 bp, Artificial Sequence
  Synthetic Polynucleotide
taatacgactcactatagggctgcacagtaatgcatgccgtaattgtaataacagaggagaattacaatgacggcatgcaacctggcggcagcgcaaaagatg

SEQ ID NO: 166149 - DNA, 103 bp, Artificial Sequence
  Synthetic Polynucleotide
taatacgactcactatagggctgggtggcactgcacagtaatgcatgccgaacagaggagacggcatatgttactgtgcaacctggcggcagcgcaaaagatg

SEQ ID NO: 166150 - DNA, 103 bp, Artificial Sequence
  Synthetic Polynucleotide
taatacgactcactatagggaaggggacccctgggtggcactgcacagtaaacagaggagatactgtatggtgccacccaacctggcggcagcgcaaaagatg

SEQ ID NO: 166151 - DNA, 103 bp, Artificial Sequence
  Synthetic Polynucleotide
taatacgactcactatagggcaccctgcccaaggggacccctgggtggcaaacagaggagatgccacatgggggtccccaacctggcggcagcgcaaaagatg

SEQ ID NO: 166152 - DNA, 103 bp, Artificial Sequence
  Synthetic Polynucleotide
taatacgactcactatagggaagctttctggcttcttaatttgcttctggaacagaggagaccagaaatgaattaagaaaacctggcggcagcgcaaaagatg

SEQ ID NO: 166153 - DNA, 103 bp, Artificial Sequence
  Synthetic Polynucleotide
taatacgactcactatagggctgaacatggcaccctgcccaaggggacccaacagaggagagggtccatgtgggcagggaacctggcggcagcgcaaaagatg

SEQ ID NO: 166154 - DNA, 103 bp, Artificial Sequence
  Synthetic Polynucleotide
taatacgactcactatagggggtgggcaacctgaacatggcaccctgcccaacagaggagagggcagatggccatgttcaacctggcggcagcgcaaaagatg

SEQ ID NO: 166155 - DNA, 103 bp, Artificial Sequence
  Synthetic Polynucleotide
taatacgactcactatagggagtggctgtcggtgggcaacctgaacatggaacagaggagaccatgtatgggttgcccaaacctggcggcagcgcaaaagatg

SEQ ID NO: 166156 - DNA, 103 bp, Artificial Sequence
  Synthetic Polynucleotide
taatacgactcactatagggtcgtaagggaagtggctgtcggtgggcaacaacagaggagagttgccatgcgacagccaaacctggcggcagcgcaaaagatg

SEQ ID NO: 166157 - DNA, 103 bp, Artificial Sequence
  Synthetic Polynucleotide
taatacgactcactatagggcagatgtaagtcgtaagggaagtggctgtcaacagaggagagacagcatgttcccttacaacctggcggcagcgcaaaagatg

SEQ ID NO: 166158 - DNA, 103 bp, Artificial Sequence
  Synthetic Polynucleotide
taatacgactcactatagggattggctgcgcagatgtaagtcgtaagggaaacagaggagatcccttatgacttacatcaacctggcggcagcgcaaaagatg

SEQ ID NO: 166159 - DNA, 103 bp, Artificial Sequence
  Synthetic Polynucleotide
taatacgactcactatagggattgtgagagattggctgcgcagatgtaagaacagaggagacttacaatggcgcagccaaacctggcggcagcgcaaaagatg

SEQ ID NO: 166160 - DNA, 103 bp, Artificial Sequence
  Synthetic Polynucleotide
taatacgactcactatagggttcatcttgcattgtgagagattggctgcgaacagaggagacgcagcatgtctctcacaaacctggcggcagcgcaaaagatg

SEQ ID NO: 166161 - DNA, 103 bp, Artificial Sequence
  Synthetic Polynucleotide
taatacgactcactatagggctgcatttaattcatcttgcattgtgagagaacagaggagactctcaatgtgcaagatgaacctggcggcagcgcaaaagatg

SEQ ID NO: 166162 - DNA, 103 bp, Artificial Sequence
  Synthetic Polynucleotide
taatacgactcactatagggttatgaaaaactgcatttaattcatcttgcaacagaggagagcaagaatgattaaatgcaacctggcggcagcgcaaaagatg

SEQ ID NO: 166163 - DNA, 103 bp, Artificial Sequence
  Synthetic Polynucleotide
taatacgactcactatagggggagatgcaggtctcaaggcgggctggcataacagaggagaatgccaatgcgccttgagaacctggcggcagcgcaaaagatg

SEQ ID NO: 166164 - DNA, 103 bp, Artificial Sequence
  Synthetic Polynucleotide
taatacgactcactatagggggaggctgcctgttggagtctggcacagtcaacagaggagagactgtatgagactccaaaacctggcggcagcgcaaaagatg

SEQ ID NO: 166165 - DNA, 103 bp, Artificial Sequence
  Synthetic Polynucleotide
taatacgactcactataggggccccgaagcggaggctgcctgttggagtcaacagaggagagactccatgaggcagcctaacctggcggcagcgcaaaagatg

SEQ ID NO: 166166 - DNA, 103 bp, Artificial Sequence
  Synthetic Polynucleotide
taatacgactcactatagggggcgcgggcggccccgaagcggaggctgccaacagaggagaggcagcatgcgcttcgggaacctggcggcagcgcaaaagatg

SEQ ID NO: 166167 - DNA, 103 bp, Artificial Sequence
  Synthetic Polynucleotide
taatacgactcactatagggcctgcgggccggcgcgggcggccccgaagcaacagaggagagcttcgatgccgcccgcgaacctggcggcagcgcaaaagatg

SEQ ID NO: 166168 - DNA, 103 bp, Artificial Sequence
  Synthetic Polynucleotide
taatacgactcactatagggtgggcgcgcccctgcgggccggcgcgggcgaacagaggagacgcccgatgcggcccgcaaacctggcggcagcgcaaaagatg

SEQ ID NO: 166169 - DNA, 103 bp, Artificial Sequence
  Synthetic Polynucleotide
taatacgactcactatagggcgggagatattgggcgcgcccctgcgggccaacagaggagaggcccgatggggcgcgccaacctggcggcagcgcaaaagatg

SEQ ID NO: 166170 - DNA, 103 bp, Artificial Sequence
  Synthetic Polynucleotide
taatacgactcactatagggctcagacgcccgggagatattgggcgcgccaacagaggagaggcgcgatgaatatctccaacctggcggcagcgcaaaagatg

SEQ ID NO: 166171 - DNA, 103 bp, Artificial Sequence
  Synthetic Polynucleotide
taatacgactcactatagggcccctggaacctcagacgcccgggagatataacagaggagaatatctatggggcgtctgaacctggcggcagcgcaaaagatg

SEQ ID NO: 166172 - DNA, 103 bp, Artificial Sequence
  Synthetic Polynucleotide
taatacgactcactatagggtcgtcctgtgcccctggaacctcagacgccaacagaggagaggcgtcatgggttccaggaacctggcggcagcgcaaaagatg

SEQ ID NO: 166173 - DNA, 103 bp, Artificial Sequence
  Synthetic Polynucleotide
taatacgactcactatagggctcctgctcgtcgtcctgtgcccctggaacaacagaggagagttccaatggcacaggacaacctggcggcagcgcaaaagatg

SEQ ID NO: 166174 - DNA, 103 bp, Artificial Sequence
  Synthetic Polynucleotide
taatacgactcactatagggagtcgaggtcggagatgcaggtctcaaggcaacagaggagagccttgatgcctgcatctaacctggcggcagcgcaaaagatg

SEQ ID NO: 166175 - DNA, 103 bp, Artificial Sequence
  Synthetic Polynucleotide
taatacgactcactataggggccgccgcctctcctgctcgtcgtcctgtgaacagaggagacacaggatgacgagcaggaacctggcggcagcgcaaaagatg

SEQ ID NO: 166176 - DNA, 103 bp, Artificial Sequence
  Synthetic Polynucleotide
taatacgactcactatagggcggccgcggcgccgccgcctctcctgctcgaacagaggagacgagcaatggaggcggcgaacctggcggcagcgcaaaagatg

SEQ ID NO: 166177 - DNA, 103 bp, Artificial Sequence
  Synthetic Polynucleotide
taatacgactcactataggggacccgcgtccggccgcggcgccgccgcctaacagaggagaaggcggatgcgccgcggcaacctggcggcagcgcaaaagatg

SEQ ID NO: 166178 - DNA, 103 bp, Artificial Sequence
  Synthetic Polynucleotide
taatacgactcactatagggcctcggagcggacccgcgtccggccgcggcaacagaggagagccgcgatgggacgcgggaacctggcggcagcgcaaaagatg

SEQ ID NO: 166179 - DNA, 103 bp, Artificial Sequence
  Synthetic Polynucleotide
taatacgactcactatagggtgcagcagcgcctcggagcggacccgcgtcaacagaggagagacgcgatgccgctccgaaacctggcggcagcgcaaaagatg

SEQ ID NO: 166180 - DNA, 103 bp, Artificial Sequence
  Synthetic Polynucleotide
taatacgactcactataggggcgcagcgagtgcagcagcgcctcggagcgaacagaggagacgctccatggcgctgctgaacctggcggcagcgcaaaagatg

SEQ ID NO: 166181 - DNA, 103 bp, Artificial Sequence
  Synthetic Polynucleotide
taatacgactcactataggggccggctcctgcgcagcgagtgcagcagcgaacagaggagacgctgcatgactcgctgcaacctggcggcagcgcaaaagatg

SEQ ID NO: 166182 - DNA, 103 bp, Artificial Sequence
  Synthetic Polynucleotide
taatacgactcactataggggccttgacgcgccggctcctgcgcagcgagaacagaggagactcgctatgcaggagccgaacctggcggcagcgcaaaagatg

SEQ ID NO: 166183 - DNA, 103 bp, Artificial Sequence
  Synthetic Polynucleotide
taatacgactcactataggggcgatcgttggccttgacgcgccggctcctaacagaggagaaggagcatgcgcgtcaagaacctggcggcagcgcaaaagatg

SEQ ID NO: 166184 - DNA, 103 bp, Artificial Sequence
  Synthetic Polynucleotide
taatacgactcactatagggggttgcgctcgcgatcgttggccttgacgcaacagaggagagcgtcaatgccaacgatcaacctggcggcagcgcaaaagatg

SEQ ID NO: 166185 - DNA, 103 bp, Artificial Sequence
  Synthetic Polynucleotide
taatacgactcactatagggctgctggcgcagtcgaggtcggagatgcagaacagaggagactgcatatgcgacctcgaaacctggcggcagcgcaaaagatg

SEQ ID NO: 166186 - DNA, 103 bp, Artificial Sequence
  Synthetic Polynucleotide
taatacgactcactatagggttgtgcatgcggttgcgctcgcgatcgttgaacagaggagacaacgaatgcgagcgcaaaacctggcggcagcgcaaaagatg

SEQ ID NO: 166187 - DNA, 103 bp, Artificial Sequence
  Synthetic Polynucleotide
taatacgactcactatagggcgcgttcaagttgtgcatgcggttgcgctcaacagaggagagagcgcatgcgcatgcacaacctggcggcagcgcaaaagatg

SEQ ID NO: 166188 - DNA, 103 bp, Artificial Sequence
  Synthetic Polynucleotide
taatacgactcactatagggcgtccagggccgcgttcaagttgtgcatgcaacagaggagagcatgcatgacttgaacgaacctggcggcagcgcaaaagatg

SEQ ID NO: 166189 - DNA, 103 bp, Artificial Sequence
  Synthetic Polynucleotide
taatacgactcactatagggctgcgcagtgcgtccagggccgcgttcaagaacagaggagacttgaaatgggccctggaaacctggcggcagcgcaaaagatg

SEQ ID NO: 166190 - DNA, 103 bp, Artificial Sequence
  Synthetic Polynucleotide
taatacgactcactataggggggcagcacgctgcgcagtgcgtccagggcaacagaggagagccctgatggcactgcgcaacctggcggcagcgcaaaagatg

SEQ ID NO: 166191 - DNA, 103 bp, Artificial Sequence
  Synthetic Polynucleotide
taatacgactcactatagggcggggaacgagggcagcacgctgcgcagtgaacagaggagacactgcatggcgtgctgcaacctggcggcagcgcaaaagatg

SEQ ID NO: 166192 - DNA, 103 bp, Artificial Sequence
  Synthetic Polynucleotide
taatacgactcactatagggttggtgtcgtcggggaacgagggcagcacgaacagaggagacgtgctatgctcgttcccaacctggcggcagcgcaaaagatg

SEQ ID NO: 166193 - DNA, 103 bp, Artificial Sequence
  Synthetic Polynucleotide
taatacgactcactatagggtttggtgagcttggtgtcgtcggggaacgaaacagaggagatcgttcatggacgacaccaacctggcggcagcgcaaaagatg

SEQ ID NO: 166194 - DNA, 103 bp, Artificial Sequence
  Synthetic Polynucleotide
taatacgactcactataggggcgtctcgattttggtgagcttggtgtcgtaacagaggagaacgacaatgagctcaccaaacctggcggcagcgcaaaagatg

SEQ ID NO: 166195 - DNA, 103 bp, Artificial Sequence
  Synthetic Polynucleotide
taatacgactcactataggggcgaagcgcagcgtctcgattttggtgagcaacagaggagagctcacatgaatcgagacaacctggcggcagcgcaaaagatg

SEQ ID NO: 166196 - DNA, 103 bp, Artificial Sequence
  Synthetic Polynucleotide
taatacgactcactatagggactgccgctgctgctggcgcagtcgaggtcaacagaggagagacctcatgtgcgccagcaacctggcggcagcgcaaaagatg

SEQ ID NO: 166197 - DNA, 103 bp, Artificial Sequence
  Synthetic Polynucleotide
taatacgactcactataggggtagttgtaggcgaagcgcagcgtctcgataacagaggagaatcgagatgctgcgcttcaacctggcggcagcgcaaaagatg

SEQ ID NO: 166198 - DNA, 103 bp, Artificial Sequence
  Synthetic Polynucleotide
taatacgactcactataggggagcccagatgtagttgtaggcgaagcgcaaacagaggagatgcgctatgcctacaactaacctggcggcagcgcaaaagatg

SEQ ID NO: 166199 - DNA, 103 bp, Artificial Sequence
  Synthetic Polynucleotide
taatacgactcactataggggtctcggccagagcccagatgtagttgtagaacagaggagactacaaatgcatctgggcaacctggcggcagcgcaaaagatg

SEQ ID NO: 166200 - DNA, 103 bp, Artificial Sequence
  Synthetic Polynucleotide
taatacgactcactatagggcaggcgcagtgtctcggccagagcccagataacagaggagaatctggatgctggccgagaacctggcggcagcgcaaaagatg

SEQ ID NO: 166201 - DNA, 103 bp, Artificial Sequence
  Synthetic Polynucleotide
taatacgactcactatagggcttgatccgccaggcgcagtgtctcggccaaacagaggagatggccgatgcactgcgccaacctggcggcagcgcaaaagatg

SEQ ID NO: 166202 - DNA, 103 bp, Artificial Sequence
  Synthetic Polynucleotide
taatacgactcactatagggccgggcagcccttgatccgccaggcgcagtaacagaggagaactgcgatgggcggatcaaacctggcggcagcgcaaaagatg

SEQ ID NO: 166203 - DNA, 103 bp, Artificial Sequence
  Synthetic Polynucleotide
taatacgactcactatagggggcaccgcctccgggcagcccttgatccgcaacagaggagagcggatatggggctgcccaacctggcggcagcgcaaaagatg

SEQ ID NO: 166204 - DNA, 103 bp, Artificial Sequence
  Synthetic Polynucleotide
taatacgactcactatagggggcgctcccgggcaccgcctccgggcagccaacagaggagaggctgcatggaggcggtgaacctggcggcagcgcaaaagatg

SEQ ID NO: 166205 - DNA, 103 bp, Artificial Sequence
  Synthetic Polynucleotide
taatacgactcactatagggggcggcaggaggcgctcccgggcaccgcctaacagaggagaaggcggatgccgggagcgaacctggcggcagcgcaaaagatg

SEQ ID NO: 166206 - DNA, 103 bp, Artificial Sequence
  Synthetic Polynucleotide
taatacgactcactataggggacgcactgcggcggcaggaggcgctcccgaacagaggagacgggagatgctcctgccgaacctggcggcagcgcaaaagatg

SEQ ID NO: 166207 - DNA, 103 bp, Artificial Sequence
  Synthetic Polynucleotide
taatacgactcactatagggcggataggtcactgccgctgctgctggcgcaacagaggagagcgccaatggcagcggcaaacctggcggcagcgcaaaagatg

SEQ ID NO: 166208 - DNA, 103 bp, Artificial Sequence
  Synthetic Polynucleotide
taatacgactcactataggggcaggcaggggacgcactgcggcggcaggaaacagaggagatcctgcatgcgcagtgcgaacctggcggcagcgcaaaagatg

SEQ ID NO: 166209 - DNA, 103 bp, Artificial Sequence
  Synthetic Polynucleotide
taatacgactcactataggggggggaccgggcaggcaggggacgcactgcaacagaggagagcagtgatgcccctgcctaacctggcggcagcgcaaaagatg

SEQ ID NO: 166210 - DNA, 103 bp, Artificial Sequence
  Synthetic Polynucleotide
taatacgactcactatagggggcggggcttgggggaccgggcaggcagggaacagaggagaccctgcatgcccggtcccaacctggcggcagcgcaaaagatg

SEQ ID NO: 166211 - DNA, 103 bp, Artificial Sequence
  Synthetic Polynucleotide
taatacgactcactatagggccgcgtcgctggcggggcttgggggaccggaacagaggagaccggtcatgcaagccccgaacctggcggcagcgcaaaagatg

SEQ ID NO: 166212 - DNA, 103 bp, Artificial Sequence
  Synthetic Polynucleotide
taatacgactcactatagggccccaggactccgcgtcgctggcggggcttaacagaggagaaagcccatgcagcgacgcaacctggcggcagcgcaaaagatg

SEQ ID NO: 166213 - DNA, 103 bp, Artificial Sequence
  Synthetic Polynucleotide
taatacgactcactatagggggcacctgagccccaggactccgcgtcgctaacagaggagaagcgacatggagtcctggaacctggcggcagcgcaaaagatg

SEQ ID NO: 166214 - DNA, 103 bp, Artificial Sequence
  Synthetic Polynucleotide
taatacgactcactatagggaggcggcggcggcacctgagccccaggactaacagaggagaagtcctatggctcaggtgaacctggcggcagcgcaaaagatg

SEQ ID NO: 166215 - DNA, 103 bp, Artificial Sequence
  Synthetic Polynucleotide
taatacgactcactataggggagagcggggaggcggcggcggcacctgagaacagaggagactcaggatgcgccgccgcaacctggcggcagcgcaaaagatg

SEQ ID NO: 166216 - DNA, 103 bp, Artificial Sequence
  Synthetic Polynucleotide
taatacgactcactatagggactggggtcagagagcggggaggcggcggcaacagaggagagccgccatgtccccgctcaacctggcggcagcgcaaaagatg

SEQ ID NO: 166217 - DNA, 103 bp, Artificial Sequence
  Synthetic Polynucleotide
taatacgactcactatagggcggctgggctactggggtcagagagcggggaacagaggagaccccgcatgctgaccccaaacctggcggcagcgcaaaagatg

SEQ ID NO: 166218 - DNA, 103 bp, Artificial Sequence
  Synthetic Polynucleotide
taatacgactcactataggggtgaggaagccggataggtcactgccgctgaacagaggagacagcggatgtgacctatcaacctggcggcagcgcaaaagatg

SEQ ID NO: 166219 - DNA, 103 bp, Artificial Sequence
  Synthetic Polynucleotide
taatacgactcactatagggtcttcggaggcggctgggctactggggtcaaacagaggagatgacccatgtagcccagcaacctggcggcagcgcaaaagatg

SEQ ID NO: 166220 - DNA, 103 bp, Artificial Sequence
  Synthetic Polynucleotide
taatacgactcactataggggtaggtgaagtcttcggaggcggctgggctaacagaggagaagcccaatggcctccgaaaacctggcggcagcgcaaaagatg

SEQ ID NO: 166221 - DNA, 103 bp, Artificial Sequence
  Synthetic Polynucleotide
taatacgactcactatagggcgccggggcggtaggtgaagtcttcggaggaacagaggagacctccgatgacttcacctaacctggcggcagcgcaaaagatg

SEQ ID NO: 166222 - DNA, 103 bp, Artificial Sequence
  Synthetic Polynucleotide
taatacgactcactatagggaaaacagggtcgccggggcggtaggtgaagaacagaggagacttcacatgccgccccggaacctggcggcagcgcaaaagatg

SEQ ID NO: 166223 - DNA, 103 bp, Artificial Sequence
  Synthetic Polynucleotide
taatacgactcactatagggtgggaaggagaaaacagggtcgccggggcgaacagaggagacgccccatggaccctgttaacctggcggcagcgcaaaagatg

SEQ ID NO: 166224 - DNA, 103 bp, Artificial Sequence
  Synthetic Polynucleotide
taatacgactcactatagggtgggcaggcttgggaaggagaaaacagggtaacagaggagaaccctgatgtctccttccaacctggcggcagcgcaaaagatg

SEQ ID NO: 166225 - DNA, 103 bp, Artificial Sequence
  Synthetic Polynucleotide
taatacgactcactatagggagcaagtctttgggcaggcttgggaaggagaacagaggagactccttatgaagcctgccaacctggcggcagcgcaaaagatg

SEQ ID NO: 166226 - DNA, 103 bp, Artificial Sequence
  Synthetic Polynucleotide
taatacgactcactatagggcgttgtgtggagcaagtctttgggcaggctaacagaggagaagcctgatgaaagacttgaacctggcggcagcgcaaaagatg

SEQ ID NO: 166227 - DNA, 103 bp, Artificial Sequence
  Synthetic Polynucleotide
taatacgactcactatagggtgaaacagggcgttgtgtggagcaagtcttaacagaggagaaagactatgtccacacaaaacctggcggcagcgcaaaagatg

SEQ ID NO: 166228 - DNA, 103 bp, Artificial Sequence
  Synthetic Polynucleotide
taatacgactcactatagggtggtaaggaatgaaacagggcgttgtgtggaacagaggagaccacacatggccctgtttaacctggcggcagcgcaaaagatg

SEQ ID NO: 166229 - DNA, 103 bp, Artificial Sequence
  Synthetic Polynucleotide
taatacgactcactatagggttcctcgtcggtgaggaagccggataggtcaacagaggagagacctaatgggcttcctcaacctggcggcagcgcaaaagatg

SEQ ID NO: 166230 - DNA, 103 bp, Artificial Sequence
  Synthetic Polynucleotide
taatacgactcactatagggtggcacagtcttcctcgtcggtgaggaagcaacagaggagagcttccatgccgacgaggaacctggcggcagcgcaaaagatg

SEQ ID NO: 166231 - DNA, 103 bp, Artificial Sequence
  Synthetic Polynucleotide
taatacgactcactatagggtgttggagtctggcacagtcttcctcgtcgaacagaggagacgacgaatgagactgtgcaacctggcggcagcgcaaaagatg

SEQ ID NO: 166232 - DNA, 103 bp, Artificial Sequence
  Synthetic Polynucleotide
taatacgactcactatagggcaactccaaggtctcggatttgacgaacataacagaggagaatgttcatgaaatccgagaacctggcggcagcgcaaaagatg

SEQ ID NO: 166233 - DNA, 103 bp, Artificial Sequence
  Synthetic Polynucleotide
taatacgactcactatagggttcttcgtcggcgctggatgacagcggggtaacagaggagaaccccgatgtcatccagcaacctggcggcagcgcaaaagatg

SEQ ID NO: 166234 - DNA, 103 bp, Artificial Sequence
  Synthetic Polynucleotide
taatacgactcactatagggcctcctcctcttcttcgtcggcgctggatgaacagaggagacatccaatgccgacgaagaacctggcggcagcgcaaaagatg

SEQ ID NO: 166235 - DNA, 103 bp, Artificial Sequence
  Synthetic Polynucleotide
taatacgactcactataggggcgcccggctcctcctcctcttcttcgtcgaacagaggagacgacgaatgagaggaggaaacctggcggcagcgcaaaagatg

SEQ ID NO: 166236 - DNA, 103 bp, Artificial Sequence
  Synthetic Polynucleotide
taatacgactcactatagggcccgcctgacgcgcccggctcctcctcctcaacagaggagagaggagatggagccgggcaacctggcggcagcgcaaaagatg

SEQ ID NO: 166237 - DNA, 103 bp, Artificial Sequence
  Synthetic Polynucleotide
taatacgactcactataggggccgacgcgccccgcctgacgcgcccggctaacagaggagaagccggatgcgtcaggcgaacctggcggcagcgcaaaagatg

SEQ ID NO: 166238 - DNA, 103 bp, Artificial Sequence
  Synthetic Polynucleotide
taatacgactcactataggggccccgcgctgccgacgcgccccgcctgacaacagaggagagtcaggatgggcgcgtcgaacctggcggcagcgcaaaagatg

SEQ ID NO: 166239 - DNA, 103 bp, Artificial Sequence
  Synthetic Polynucleotide
taatacgactcactatagggcccggcctcagccccgcgctgccgacgcgcaacagaggagagcgcgtatgcagcgcgggaacctggcggcagcgcaaaagatg

SEQ ID NO: 166240 - DNA, 103 bp, Artificial Sequence
  Synthetic Polynucleotide
taatacgactcactataggggcgccccctgcccggcctcagccccgcgctaacagaggagaagcgcgatgctgaggccgaacctggcggcagcgcaaaagatg

SEQ ID NO: 166241 - DNA, 103 bp, Artificial Sequence
  Synthetic Polynucleotide
taatacgactcactatagggacgccgccccgcgccccctgcccggcctcaaacagaggagatgaggcatggcagggggcaacctggcggcagcgcaaaagatg

SEQ ID NO: 166242 - DNA, 103 bp, Artificial Sequence
  Synthetic Polynucleotide
taatacgactcactatagggacccgcagccacgccgccccgcgccccctgaacagaggagacaggggatgcggggcggcaacctggcggcagcgcaaaagatg

SEQ ID NO: 166243 - DNA, 103 bp, Artificial Sequence
  Synthetic Polynucleotide
taatacgactcactatagggcttcctccttcaactccaaggtctcggattaacagaggagaaatccgatgccttggagtaacctggcggcagcgcaaaagatg

SEQ ID NO: 166244 - DNA, 103 bp, Artificial Sequence
  Synthetic Polynucleotide
taatacgactcactatagggagccctccgcacccgcagccacgccgccccaacagaggagaggggcgatgtggctgcggaacctggcggcagcgcaaaagatg

SEQ ID NO: 166245 - DNA, 103 bp, Artificial Sequence
  Synthetic Polynucleotide
taatacgactcactataggggcgggccggcagccctccgcacccgcagccaacagaggagaggctgcatgtgcggagggaacctggcggcagcgcaaaagatg

SEQ ID NO: 166246 - DNA, 103 bp, Artificial Sequence
  Synthetic Polynucleotide
taatacgactcactatagggcagcagccgtgcgggccggcagccctccgcaacagaggagagcggagatgtgccggcccaacctggcggcagcgcaaaagatg

SEQ ID NO: 166247 - DNA, 103 bp, Artificial Sequence
  Synthetic Polynucleotide
taatacgactcactataggggtaccagacccagcagccgtgcgggccggcaacagaggagagccggcatgcacggctgcaacctggcggcagcgcaaaagatg

SEQ ID NO: 166248 - DNA, 103 bp, Artificial Sequence
  Synthetic Polynucleotide
taatacgactcactatagggttgcaatcgtgtaccagacccagcagccgtaacagaggagaacggctatggggtctggtaacctggcggcagcgcaaaagatg

SEQ ID NO: 166249 - DNA, 103 bp, Artificial Sequence
  Synthetic Polynucleotide
taatacgactcactatagggagggcgccgtttgcaatcgtgtaccagaccaacagaggagaggtctgatgcacgattgcaacctggcggcagcgcaaaagatg

SEQ ID NO: 166250 - DNA, 103 bp, Artificial Sequence
  Synthetic Polynucleotide
taatacgactcactataggggcgcccgggaagggcgccgtttgcaatcgtaacagaggagaacgattatgaacggcgccaacctggcggcagcgcaaaagatg

SEQ ID NO: 166251 - DNA, 103 bp, Artificial Sequence
  Synthetic Polynucleotide
taatacgactcactataggggagacggcccgcgcccgggaagggcgccgtaacagaggagaacggcgatgttcccgggcaacctggcggcagcgcaaaagatg

SEQ ID NO: 166252 - DNA, 103 bp, Artificial Sequence
  Synthetic Polynucleotide
taatacgactcactatagggggcgcctcgggagacggcccgcgcccgggaaacagaggagatcccggatgcgggccgtcaacctggcggcagcgcaaaagatg

SEQ ID NO: 166253 - DNA, 103 bp, Artificial Sequence
  Synthetic Polynucleotide
taatacgactcactatagggcggccgtcttggcgcctcgggagacggcccaacagaggagagggccgatgcccgaggcgaacctggcggcagcgcaaaagatg

SEQ ID NO: 166254 - DNA, 103 bp, Artificial Sequence
  Synthetic Polynucleotide
taatacgactcactatagggaacacgtcctcttcctccttcaactccaagaacagaggagacttggaatggaaggaggaaacctggcggcagcgcaaaagatg

SEQ ID NO: 166255 - DNA, 103 bp, Artificial Sequence
  Synthetic Polynucleotide
taatacgactcactatagggtgcaccgtctcggccgtcttggcgcctcggaacagaggagaccgaggatgcaagacggcaacctggcggcagcgcaaaagatg

SEQ ID NO: 166256 - DNA, 103 bp, Artificial Sequence
  Synthetic Polynucleotide
taatacgactcactatagggcttgatgcgctgcaccgtctcggccgtcttaacagaggagaaagacgatggagacggtgaacctggcggcagcgcaaaagatg

SEQ ID NO: 166257 - DNA, 103 bp, Artificial Sequence
  Synthetic Polynucleotide
taatacgactcactatagggtacgggtcttcttgatgcgctgcaccgtctaacagaggagaagacggatgagcgcatcaaacctggcggcagcgcaaaagatg

SEQ ID NO: 166258 - DNA, 103 bp, Artificial Sequence
  Synthetic Polynucleotide
taatacgactcactataggggccttcagtctacgggtcttcttgatgcgcaacagaggagagcgcatatggaagacccgaacctggcggcagcgcaaaagatg

SEQ ID NO: 166259 - DNA, 103 bp, Artificial Sequence
  Synthetic Polynucleotide
taatacgactcactataggggcggttgttggccttcagtctacgggtcttaacagaggagaaagaccatgagactgaagaacctggcggcagcgcaaaagatg

SEQ ID NO: 166260 - DNA, 103 bp, Artificial Sequence
  Synthetic Polynucleotide
taatacgactcactatagggggtttcgctcgcggttgttggccttcagtcaacagaggagagactgaatgccaacaaccaacctggcggcagcgcaaaagatg

SEQ ID NO: 166261 - DNA, 103 bp, Artificial Sequence
  Synthetic Polynucleotide
taatacgactcactatagggttgtgcatgcggtttcgctcgcggttgttgaacagaggagacaacaaatgcgagcgaaaaacctggcggcagcgcaaaagatg

SEQ ID NO: 166262 - DNA, 103 bp, Artificial Sequence
  Synthetic Polynucleotide
taatacgactcactatagggcgcgttgaggttgtgcatgcggtttcgctcaacagaggagagagcgaatgcgcatgcacaacctggcggcagcgcaaaagatg

SEQ ID NO: 166263 - DNA, 103 bp, Artificial Sequence
  Synthetic Polynucleotide
taatacgactcactatagggcgtccagtgccgcgttgaggttgtgcatgcaacagaggagagcatgcatgacctcaacgaacctggcggcagcgcaaaagatg

SEQ ID NO: 166264 - DNA, 103 bp, Artificial Sequence
  Synthetic Polynucleotide
taatacgactcactatagggtcgcgcagcgcgtccagtgccgcgttgaggaacagaggagacctcaaatgggcactggaaacctggcggcagcgcaaaagatg

SEQ ID NO: 166265 - DNA, 103 bp, Artificial Sequence
  Synthetic Polynucleotide
taatacgactcactataggggagcagcactaacacgtcctcttcctccttaacagaggagaaaggagatggaggacgtgaacctggcggcagcgcaaaagatg

SEQ ID NO: 166266 - DNA, 103 bp, Artificial Sequence
  Synthetic Polynucleotide
taatacgactcactatagggggggagcacctcgcgcagcgcgtccagtgcaacagaggagagcactgatggcgctgcgcaacctggcggcagcgcaaaagatg

SEQ ID NO: 166267 - DNA, 103 bp, Artificial Sequence
  Synthetic Polynucleotide
taatacgactcactatagggcggggaacgtggggagcacctcgcgcagcgaacagaggagacgctgcatgaggtgctccaacctggcggcagcgcaaaagatg

SEQ ID NO: 166268 - DNA, 103 bp, Artificial Sequence
  Synthetic Polynucleotide
taatacgactcactatagggttggcgtcctcggggaacgtggggagcaccaacagaggagaggtgctatgcacgttcccaacctggcggcagcgcaaaagatg

SEQ ID NO: 166269 - DNA, 103 bp, Artificial Sequence
  Synthetic Polynucleotide
taatacgactcactatagggcttggtgagcttggcgtcctcggggaacgtaacagaggagaacgttcatggaggacgccaacctggcggcagcgcaaaagatg

SEQ ID NO: 166270 - DNA, 103 bp, Artificial Sequence
  Synthetic Polynucleotide
taatacgactcactataggggggtctcgatcttggtgagcttggcgtcctaacagaggagaaggacgatgagctcaccaaacctggcggcagcgcaaaagatg

SEQ ID NO: 166271 - DNA, 103 bp, Artificial Sequence
  Synthetic Polynucleotide
taatacgactcactataggggcgaagcgcagggtctcgatcttggtgagcaacagaggagagctcacatggatcgagacaacctggcggcagcgcaaaagatg

SEQ ID NO: 166272 - DNA, 103 bp, Artificial Sequence
  Synthetic Polynucleotide
taatacgactcactataggggtagttgtgggcgaagcgcagggtctcgataacagaggagaatcgagatgctgcgcttcaacctggcggcagcgcaaaagatg

SEQ ID NO: 166273 - DNA, 103 bp, Artificial Sequence
  Synthetic Polynucleotide
taatacgactcactataggggtgcccagatgtagttgtgggcgaagcgcaaacagaggagatgcgctatgcccacaactaacctggcggcagcgcaaaagatg

SEQ ID NO: 166274 - DNA, 103 bp, Artificial Sequence
  Synthetic Polynucleotide
taatacgactcactataggggtctcggtgagtgcccagatgtagttgtggaacagaggagaccacaaatgcatctgggcaacctggcggcagcgcaaaagatg

SEQ ID NO: 166275 - DNA, 103 bp, Artificial Sequence
  Synthetic Polynucleotide
taatacgactcactatagggcaggcgcagggtctcggtgagtgcccagataacagaggagaatctggatgctcaccgagaacctggcggcagcgcaaaagatg

SEQ ID NO: 166276 - DNA, 103 bp, Artificial Sequence
  Synthetic Polynucleotide
taatacgactcactatagggaggccgatccgagcagcactaacacgtcctaacagaggagaaggacgatgtagtgctgcaacctggcggcagcgcaaaagatg

SEQ ID NO: 166277 - DNA, 103 bp, Artificial Sequence
  Synthetic Polynucleotide
taatacgactcactatagggagtgatccgccaggcgcagggtctcggtgaaacagaggagatcaccgatgccctgcgccaacctggcggcagcgcaaaagatg

SEQ ID NO: 166278 - DNA, 103 bp, Artificial Sequence
  Synthetic Polynucleotide
taatacgactcactatagggccgcccccgcagtgatccgccaggcgcaggaacagaggagacctgcgatgggcggatcaaacctggcggcagcgcaaaagatg

SEQ ID NO: 166279 - DNA, 103 bp, Artificial Sequence
  Synthetic Polynucleotide
taatacgactcactataggggcccccgccgccgcccccgcagtgatccgcaacagaggagagcggatatgtgcgggggcaacctggcggcagcgcaaaagatg

SEQ ID NO: 166280 - DNA, 103 bp, Artificial Sequence
  Synthetic Polynucleotide
taatacgactcactatagggcccccggcaggcccccgccgccgcccccgcaacagaggagagcggggatggcggcggggaacctggcggcagcgcaaaagatg

SEQ ID NO: 166281 - DNA, 103 bp, Artificial Sequence
  Synthetic Polynucleotide
taatacgactcactataggggagaagagcgcccccggcaggcccccgccgaacagaggagacggcggatgcctgccgggaacctggcggcagcgcaaaagatg

SEQ ID NO: 166282 - DNA, 103 bp, Artificial Sequence
  Synthetic Polynucleotide
taatacgactcactatagggcactgcctcggagaagagcgcccccggcagaacagaggagactgccgatggcgctcttcaacctggcggcagcgcaaaagatg

SEQ ID NO: 166283 - DNA, 103 bp, Artificial Sequence
  Synthetic Polynucleotide
taatacgactcactatagggggctcagcaacactgcctcggagaagagcgaacagaggagacgctctatgccgaggcagaacctggcggcagcgcaaaagatg

SEQ ID NO: 166284 - DNA, 103 bp, Artificial Sequence
  Synthetic Polynucleotide
taatacgactcactataggggctcctcccgggctcagcaacactgcctcgaacagaggagacgaggcatggttgctgagaacctggcggcagcgcaaaagatg

SEQ ID NO: 166285 - DNA, 103 bp, Artificial Sequence
  Synthetic Polynucleotide
taatacgactcactatagggggcggcgctggctcctcccgggctcagcaaaacagaggagattgctgatgccgggaggaaacctggcggcagcgcaaaagatg

SEQ ID NO: 166286 - DNA, 103 bp, Artificial Sequence
  Synthetic Polynucleotide
taatacgactcactatagggtgctgctcagggcggcgctggctcctcccgaacagaggagacgggagatgccagcgccgaacctggcggcagcgcaaaagatg

SEQ ID NO: 166287 - DNA, 103 bp, Artificial Sequence
  Synthetic Polynucleotide
taatacgactcactatagggaaggcgggggaggccgatccgagcagcactaacagaggagaagtgctatgcggatcggcaacctggcggcagcgcaaaagatg

SEQ ID NO: 166288 - DNA, 103 bp, Artificial Sequence
  Synthetic Polynucleotide
taatacgactcactatagggctgtctccgctgctgctcagggcggcgctgaacagaggagacagcgcatgcctgagcagaacctggcggcagcgcaaaagatg

SEQ ID NO: 166289 - DNA, 103 bp, Artificial Sequence
  Synthetic Polynucleotide
taatacgactcactataggggggcgaggggctgtctccgctgctgctcagaacagaggagactgagcatgagcggagacaacctggcggcagcgcaaaagatg

SEQ ID NO: 166290 - DNA, 103 bp, Artificial Sequence
  Synthetic Polynucleotide
taatacgactcactatagggacgtggaggcgggcgaggggctgtctccgcaacagaggagagcggagatggcccctcgcaacctggcggcagcgcaaaagatg

SEQ ID NO: 166291 - DNA, 103 bp, Artificial Sequence
  Synthetic Polynucleotide
taatacgactcactataggggtgcaactccacgtggaggcgggcgaggggaacagaggagacccctcatgcgcctccacaacctggcggcagcgcaaaagatg

SEQ ID NO: 166292 - DNA, 103 bp, Artificial Sequence
  Synthetic Polynucleotide
taatacgactcactatagggggggctgttggtgcaactccacgtggaggcaacagaggagagcctccatgtggagttgcaacctggcggcagcgcaaaagatg

SEQ ID NO: 166293 - DNA, 103 bp, Artificial Sequence
  Synthetic Polynucleotide
taatacgactcactatagggaggacggcgcggggctgttggtgcaactccaacagaggagaggagttatgccaacagccaacctggcggcagcgcaaaagatg

SEQ ID NO: 166294 - DNA, 103 bp, Artificial Sequence
  Synthetic Polynucleotide
taatacgactcactataggggacacggaggaggacggcgcggggctgttgaacagaggagacaacagatgcgcgccgtcaacctggcggcagcgcaaaagatg

SEQ ID NO: 166295 - DNA, 103 bp, Artificial Sequence
  Synthetic Polynucleotide
taatacgactcactatagggggaattggaggacacggaggaggacggcgcaacagaggagagcgccgatgtcctccgtgaacctggcggcagcgcaaaagatg

SEQ ID NO: 166296 - DNA, 103 bp, Artificial Sequence
  Synthetic Polynucleotide
taatacgactcactatagggagggggaggtggaattggaggacacggaggaacagaggagacctccgatgcctccaattaacctggcggcagcgcaaaagatg

SEQ ID NO: 166297 - DNA, 103 bp, Artificial Sequence
  Synthetic Polynucleotide
taatacgactcactataggggtgcagctgtagggggaggtggaattggagaacagaggagactccaaatgcacctccccaacctggcggcagcgcaaaagatg

SEQ ID NO: 166298 - DNA, 103 bp, Artificial Sequence
  Synthetic Polynucleotide
taatacgactcactatagggcagggccgccaaggcgggggaggccgatccaacagaggagaggatcgatgtcccccgccaacctggcggcagcgcaaaagatg

SEQ ID NO: 166299 - DNA, 103 bp, Artificial Sequence
  Synthetic Polynucleotide
taatacgactcactataggggggcgataaagtgcagctgtagggggaggtaacagaggagaacctccatgtacagctgcaacctggcggcagcgcaaaagatg

SEQ ID NO: 166300 - DNA, 103 bp, Artificial Sequence
  Synthetic Polynucleotide
taatacgactcactatagggccgggctggcgggcgataaagtgcagctgtaacagaggagaacagctatgctttatcgcaacctggcggcagcgcaaaagatg

SEQ ID NO: 166301 - DNA, 103 bp, Artificial Sequence
  Synthetic Polynucleotide
taatacgactcactatagggtctgacccggccgggctggcgggcgataaaaacagaggagatttatcatgcgccagcccaacctggcggcagcgcaaaagatg

SEQ ID NO: 166302 - DNA, 103 bp, Artificial Sequence
  Synthetic Polynucleotide
taatacgactcactatagggatagtccatgtctgacccggccgggctggcaacagaggagagccagcatggccgggtcaaacctggcggcagcgcaaaagatg

SEQ ID NO: 166303 - DNA, 103 bp, Artificial Sequence
  Synthetic Polynucleotide
taatacgactcactatagggggggctgccaatagtccatgtctgacccggaacagaggagaccgggtatgacatggactaacctggcggcagcgcaaaagatg

SEQ ID NO: 166304 - DNA, 103 bp, Artificial Sequence
  Synthetic Polynucleotide
taatacgactcactatagggtcgggaggtgggggctgccaatagtccatgaacagaggagacatggaatgttggcagccaacctggcggcagcgcaaaagatg

SEQ ID NO: 166305 - DNA, 103 bp, Artificial Sequence
  Synthetic Polynucleotide
taatacgactcactataggggcggtgcttgtcgggaggtgggggctgccaaacagaggagatggcagatgccacctcccaacctggcggcagcgcaaaagatg

SEQ ID NO: 166306 - DNA, 103 bp, Artificial Sequence
  Synthetic Polynucleotide
taatacgactcactataggggaggtgcatagcggtgcttgtcgggaggtgaacagaggagacacctcatgacaagcaccaacctggcggcagcgcaaaagatg

SEQ ID NO: 166307 - DNA, 103 bp, Artificial Sequence
  Synthetic Polynucleotide
taatacgactcactatagggatggggaggtgaggtgcatagcggtgcttgaacagaggagacaagcaatgctatgcaccaacctggcggcagcgcaaaagatg

SEQ ID NO: 166308 - DNA, 103 bp, Artificial Sequence
  Synthetic Polynucleotide
taatacgactcactatagggatccctggctatggggaggtgaggtgcataaacagaggagatatgcaatgcacctccccaacctggcggcagcgcaaaagatg

SEQ ID NO: 166309 - DNA, 103 bp, Artificial Sequence
  Synthetic Polynucleotide
taatacgactcactatagggacagcggggtcagggccgccaaggcgggggaacagaggagacccccgatgtggcggcccaacctggcggcagcgcaaaagatg

SEQ ID NO: 166310 - DNA, 103 bp, Artificial Sequence
  Synthetic Polynucleotide
taatacgactcactataggggcgctggatgacagcggggtcagggccgccaacagaggagaggcggcatggaccccgctaacctggcggcagcgcaaaagatg

SEQ ID NO: 166311 - DNA, 103 bp, Artificial Sequence
  Synthetic Polynucleotide
taatacgactcactatagggagtgggcgcacccgagggttgaggcgtcataacagaggagaatgacgatgcaaccctcgaacctggcggcagcgcaaaagatg

SEQ ID NO: 166312 - DNA, 103 bp, Artificial Sequence
  Synthetic Polynucleotide
taatacgactcactatagggagtggggctgggcggggcggacgtggggcaaacagaggagatgccccatgtccgccccgaacctggcggcagcgcaaaagatg

SEQ ID NO: 166313 - DNA, 103 bp, Artificial Sequence
  Synthetic Polynucleotide
taatacgactcactatagggcccgtgtgcgagtggggctgggcggggcggaacagaggagaccgcccatgccagccccaaacctggcggcagcgcaaaagatg

SEQ ID NO: 166314 - DNA, 103 bp, Artificial Sequence
  Synthetic Polynucleotide
taatacgactcactataggggcgcagttcccccgtgtgcgagtggggctgaacagaggagacagcccatgtcgcacacgaacctggcggcagcgcaaaagatg

SEQ ID NO: 166315 - DNA, 103 bp, Artificial Sequence
  Synthetic Polynucleotide
taatacgactcactatagggttccgcctctgcgcagttcccccgtgtgcgaacagaggagacgcacaatggggaactgcaacctggcggcagcgcaaaagatg

SEQ ID NO: 166316 - DNA, 103 bp, Artificial Sequence
  Synthetic Polynucleotide
taatacgactcactatagggagcctccctcttccgcctctgcgcagttccaacagaggagaggaactatgcagaggcggaacctggcggcagcgcaaaagatg

SEQ ID NO: 166317 - DNA, 103 bp, Artificial Sequence
  Synthetic Polynucleotide
taatacgactcactataggggcccctcggcagcctccctcttccgcctctaacagaggagaagaggcatgagagggaggaacctggcggcagcgcaaaagatg

SEQ ID NO: 166318 - DNA, 103 bp, Artificial Sequence
  Synthetic Polynucleotide
taatacgactcactatagggcttcctcggggcccctcggcagcctccctcaacagaggagagagggaatgtgccgagggaacctggcggcagcgcaaaagatg

SEQ ID NO: 166319 - DNA, 103 bp, Artificial Sequence
  Synthetic Polynucleotide
taatacgactcactataggggtgcccggagcttcctcggggcccctcggcaacagaggagagccgagatgccccgaggaaacctggcggcagcgcaaaagatg

SEQ ID NO: 166320 - DNA, 103 bp, Artificial Sequence
  Synthetic Polynucleotide
taatacgactcactatagggcccccgcgccgtgcccggagcttcctcgggaacagaggagacccgagatggctccgggcaacctggcggcagcgcaaaagatg

SEQ ID NO: 166321 - DNA, 103 bp, Artificial Sequence
  Synthetic Polynucleotide
taatacgactcactatagggccggctgcgtcccccgcgccgtgcccggagaacagaggagactccggatgcggcgcgggaacctggcggcagcgcaaaagatg

SEQ ID NO: 166322 - DNA, 103 bp, Artificial Sequence
  Synthetic Polynucleotide
taatacgactcactatagggtcacttggacagtgggcgcacccgagggttaacagaggagaaaccctatggtgcgcccaaacctggcggcagcgcaaaagatg

SEQ ID NO: 166323 - DNA, 103 bp, Artificial Sequence
  Synthetic Polynucleotide
taatacgactcactatagggcgctcttaggccggctgcgtcccccgcgccaacagaggagaggcgcgatggacgcagccaacctggcggcagcgcaaaagatg

SEQ ID NO: 166324 - DNA, 103 bp, Artificial Sequence
  Synthetic Polynucleotide
taatacgactcactatagggagtgccaactcgctcttaggccggctgcgtaacagaggagaacgcagatggcctaagagaacctggcggcagcgcaaaagatg

SEQ ID NO: 166325 - DNA, 103 bp, Artificial Sequence
  Synthetic Polynucleotide
taatacgactcactatagggctgcttgctcagtgccaactcgctcttaggaacagaggagacctaagatggagttggcaaacctggcggcagcgcaaaagatg

SEQ ID NO: 166326 - DNA, 103 bp, Artificial Sequence
  Synthetic Polynucleotide
taatacgactcactataggggactccgtcgctgcttgctcagtgccaactaacagaggagaagttggatgtgagcaagcaacctggcggcagcgcaaaagatg

SEQ ID NO: 166327 - DNA, 103 bp, Artificial Sequence
  Synthetic Polynucleotide
taatacgactcactatagggttctttcgccgactccgtcgctgcttgctcaacagaggagagagcaaatggcgacggagaacctggcggcagcgcaaaagatg

SEQ ID NO: 166328 - DNA, 103 bp, Artificial Sequence
  Synthetic Polynucleotide
taatacgactcactataggggtcgttggccttctttcgccgactccgtcgaacagaggagacgacggatgcggcgaaagaacctggcggcagcgcaaaagatg

SEQ ID NO: 166329 - DNA, 103 bp, Artificial Sequence
  Synthetic Polynucleotide
taatacgactcactatagggtgcgctcgcggtcgttggccttctttcgccaacagaggagaggcgaaatgaggccaacgaacctggcggcagcgcaaaagatg

SEQ ID NO: 166330 - DNA, 103 bp, Artificial Sequence
  Synthetic Polynucleotide
taatacgactcactatagggtgcattcgattgcgctcgcggtcgttggccaacagaggagaggccaaatgccgcgagcgaacctggcggcagcgcaaaagatg

SEQ ID NO: 166331 - DNA, 103 bp, Artificial Sequence
  Synthetic Polynucleotide
taatacgactcactataggggttgaggttgtgcattcgattgcgctcgcgaacagaggagacgcgagatgaatcgaatgaacctggcggcagcgcaaaagatg

SEQ ID NO: 166332 - DNA, 103 bp, Artificial Sequence
  Synthetic Polynucleotide
taatacgactcactatagggccagtgccgagttgaggttgtgcattcgataacagaggagaatcgaaatgacaacctcaaacctggcggcagcgcaaaagatg

SEQ ID NO: 166333 - DNA, 103 bp, Artificial Sequence
  Synthetic Polynucleotide
taatacgactcactataggggtctcacgggtcacttggacagtgggcgcaaacagaggagatgcgccatgtgtccaagtaacctggcggcagcgcaaaagatg

SEQ ID NO: 166334 - DNA, 103 bp, Artificial Sequence
  Synthetic Polynucleotide
taatacgactcactatagggcgcagggcgtccagtgccgagttgaggttgaacagaggagacaacctatgctcggcactaacctggcggcagcgcaaaagatg

SEQ ID NO: 166335 - DNA, 103 bp, Artificial Sequence
  Synthetic Polynucleotide
taatacgactcactatagggcaggacaccgcgcagggcgtccagtgccgaaacagaggagatcggcaatggacgccctgaacctggcggcagcgcaaaagatg

SEQ ID NO: 166336 - DNA, 103 bp, Artificial Sequence
  Synthetic Polynucleotide
taatacgactcactatagggggaaggtgggcaggacaccgcgcagggcgtaacagaggagaacgcccatggcggtgtccaacctggcggcagcgcaaaagatg

SEQ ID NO: 166337 - DNA, 103 bp, Artificial Sequence
  Synthetic Polynucleotide
taatacgactcactataggggcgtcgtctgggaaggtgggcaggacaccgaacagaggagacggtgtatggcccaccttaacctggcggcagcgcaaaagatg

SEQ ID NO: 166338 - DNA, 103 bp, Artificial Sequence
  Synthetic Polynucleotide
taatacgactcactatagggggtgagcttcgcgtcgtctgggaaggtgggaacagaggagacccaccatgccagacgacaacctggcggcagcgcaaaagatg

SEQ ID NO: 166339 - DNA, 103 bp, Artificial Sequence
  Synthetic Polynucleotide
taatacgactcactatagggtctcgatcttggtgagcttcgcgtcgtctgaacagaggagacagacgatgcgaagctcaaacctggcggcagcgcaaaagatg

SEQ ID NO: 166340 - DNA, 103 bp, Artificial Sequence
  Synthetic Polynucleotide
taatacgactcactatagggaagcgcagcgtctcgatcttggtgagcttcaacagaggagagaagctatgcaagatcgaaacctggcggcagcgcaaaagatg

SEQ ID NO: 166341 - DNA, 103 bp, Artificial Sequence
  Synthetic Polynucleotide
taatacgactcactataggggttgtgggcgaagcgcagcgtctcgatcttaacagaggagaaagatcatgacgctgcgcaacctggcggcagcgcaaaagatg

SEQ ID NO: 166342 - DNA, 103 bp, Artificial Sequence
  Synthetic Polynucleotide
taatacgactcactatagggcccagatgtagttgtgggcgaagcgcagcgaacagaggagacgctgcatgtcgcccacaaacctggcggcagcgcaaaagatg

SEQ ID NO: 166343 - DNA, 103 bp, Artificial Sequence
  Synthetic Polynucleotide
taatacgactcactatagggtgagtcagcgcccagatgtagttgtgggcgaacagaggagacgcccaatgctacatctgaacctggcggcagcgcaaaagatg

SEQ ID NO: 166344 - DNA, 103 bp, Artificial Sequence
  Synthetic Polynucleotide
taatacgactcactatagggggaccgctccgtctcacgggtcacttggacaacagaggagagtccaaatgacccgtgagaacctggcggcagcgcaaaagatg

SEQ ID NO: 166345 - DNA, 103 bp, Artificial Sequence
  Synthetic Polynucleotide
taatacgactcactataggggcgcagcgtttgagtcagcgcccagatgtaaacagaggagatacatcatggcgctgactaacctggcggcagcgcaaaagatg

SEQ ID NO: 166346 - DNA, 103 bp, Artificial Sequence
  Synthetic Polynucleotide
taatacgactcactatagggggtccgctatgcgcagcgtttgagtcagcgaacagaggagacgctgaatgaaacgctgcaacctggcggcagcgcaaaagatg

SEQ ID NO: 166347 - DNA, 103 bp, Artificial Sequence
  Synthetic Polynucleotide
taatacgactcactatagggtacaagctgtggtccgctatgcgcagcgttaacagaggagaaacgctatgcatagcggaaacctggcggcagcgcaaaagatg

SEQ ID NO: 166348 - DNA, 103 bp, Artificial Sequence
  Synthetic Polynucleotide
taatacgactcactatagggctccagcgcgtacaagctgtggtccgctataacagaggagaatagcgatgcacagcttgaacctggcggcagcgcaaaagatg

SEQ ID NO: 166349 - DNA, 103 bp, Artificial Sequence
  Synthetic Polynucleotide
taatacgactcactataggggcgccggcggctccagcgcgtacaagctgtaacagaggagaacagctatgacgcgctggaacctggcggcagcgcaaaagatg

SEQ ID NO: 166350 - DNA, 103 bp, Artificial Sequence
  Synthetic Polynucleotide
taatacgactcactatagggccgcagtgcggcgccggcggctccagcgcgaacagaggagacgcgctatggccgccggcaacctggcggcagcgcaaaagatg

SEQ ID NO: 166351 - DNA, 103 bp, Artificial Sequence
  Synthetic Polynucleotide
taatacgactcactataggggcccagctccccgcagtgcggcgccggcggaacagaggagaccgccgatgccgcactgcaacctggcggcagcgcaaaagatg

SEQ ID NO: 166352 - DNA, 103 bp, Artificial Sequence
  Synthetic Polynucleotide
taatacgactcactatagggcgcctgggctgcccagctccccgcagtgcgaacagaggagacgcactatggggagctggaacctggcggcagcgcaaaagatg

SEQ ID NO: 166353 - DNA, 103 bp, Artificial Sequence
  Synthetic Polynucleotide
taatacgactcactatagggccgggggaaccgcctgggctgcccagctccaacagaggagaggagctatgcagcccaggaacctggcggcagcgcaaaagatg

SEQ ID NO: 166354 - DNA, 103 bp, Artificial Sequence
  Synthetic Polynucleotide
taatacgactcactatagggcccccagtccccgggggaaccgcctgggctaacagaggagaagcccaatgggttcccccaacctggcggcagcgcaaaagatg

SEQ ID NO: 166355 - DNA, 103 bp, Artificial Sequence
  Synthetic Polynucleotide
taatacgactcactatagggctctggggaaggaccgctccgtctcacgggaacagaggagacccgtgatgcggagcggtaacctggcggcagcgcaaaagatg

SEQ ID NO: 166356 - DNA, 103 bp, Artificial Sequence
  Synthetic Polynucleotide
taatacgactcactatagggagtagagggacccccagtccccgggggaacaacagaggagagttcccatggggactgggaacctggcggcagcgcaaaagatg

SEQ ID NO: 166357 - DNA, 103 bp, Artificial Sequence
  Synthetic Polynucleotide
taatacgactcactataggggagactggggagtagagggacccccagtccaacagaggagaggactgatggtccctctaaacctggcggcagcgcaaaagatg

SEQ ID NO: 166358 - DNA, 103 bp, Artificial Sequence
  Synthetic Polynucleotide
taatacgactcactataggggccagcctgggagactggggagtagagggaaacagaggagatccctcatgtccccagtcaacctggcggcagcgcaaaagatg

SEQ ID NO: 166359 - DNA, 103 bp, Artificial Sequence
  Synthetic Polynucleotide
taatacgactcactataggggactcaggctgccagcctgggagactggggaacagaggagaccccagatgcccaggctgaacctggcggcagcgcaaaagatg

SEQ ID NO: 166360 - DNA, 103 bp, Artificial Sequence
  Synthetic Polynucleotide
taatacgactcactataggggacgcggcgggactcaggctgccagcctggaacagaggagaccaggcatgcagcctgagaacctggcggcagcgcaaaagatg

SEQ ID NO: 166361 - DNA, 103 bp, Artificial Sequence
  Synthetic Polynucleotide
taatacgactcactatagggctcctccagcgacgcggcgggactcaggctaacagaggagaagcctgatgcccgccgcgaacctggcggcagcgcaaaagatg

SEQ ID NO: 166362 - DNA, 103 bp, Artificial Sequence
  Synthetic Polynucleotide
taatacgactcactataggggcccgggtcgctcctccagcgacgcggcggaacagaggagaccgccgatgcgctggaggaacctggcggcagcgcaaaagatg

SEQ ID NO: 166363 - DNA, 103 bp, Artificial Sequence
  Synthetic Polynucleotide
taatacgactcactataggggcccccagcagcccgggtcgctcctccagcaacagaggagagctggaatggcgacccggaacctggcggcagcgcaaaagatg

SEQ ID NO: 166364 - DNA, 103 bp, Artificial Sequence
  Synthetic Polynucleotide
taatacgactcactatagggggaaaaggtggcccccagcagcccgggtcgaacagaggagacgacccatgctgctggggaacctggcggcagcgcaaaagatg

SEQ ID NO: 166365 - DNA, 103 bp, Artificial Sequence
  Synthetic Polynucleotide
taatacgactcactatagggtcaagcaggcggaaaaggtggcccccagcaaacagaggagatgctggatgccaccttttaacctggcggcagcgcaaaagatg

SEQ ID NO: 166366 - DNA, 103 bp, Artificial Sequence
  Synthetic Polynucleotide
taatacgactcactatagggtcttccgaggctctggggaaggaccgctccaacagaggagaggagcgatgcttccccagaacctggcggcagcgcaaaagatg

SEQ ID NO: 166367 - DNA, 103 bp, Artificial Sequence
  Synthetic Polynucleotide
taatacgactcactatagggctgcctgggctcaagcaggcggaaaaggtgaacagaggagacaccttatgcgcctgcttaacctggcggcagcgcaaaagatg

SEQ ID NO: 166368 - DNA, 103 bp, Artificial Sequence
  Synthetic Polynucleotide
taatacgactcactataggggaaagccagactgcctgggctcaagcaggcaacagaggagagcctgcatgagcccaggcaacctggcggcagcgcaaaagatg

SEQ ID NO: 166369 - DNA, 103 bp, Artificial Sequence
  Synthetic Polynucleotide
taatacgactcactataggggaaaatctgagaaagccagactgcctgggcaacagaggagagcccagatggtctggcttaacctggcggcagcgcaaaagatg

SEQ ID NO: 166370 - DNA, 103 bp, Artificial Sequence
  Synthetic Polynucleotide
taatacgactcactatagggggtcacttcgtcttccgaggctctggggaaaacagaggagattccccatggcctcggaaaacctggcggcagcgcaaaagatg

SEQ ID NO: 166371 - DNA, 103 bp, Artificial Sequence
  Synthetic Polynucleotide
taatacgactcactatagggacgtggggcaggtcacttcgtcttccgaggaacagaggagacctcggatgacgaagtgaaacctggcggcagcgcaaaagatg

SEQ ID NO: 166372 - DNA, 103 bp, Artificial Sequence
  Synthetic Polynucleotide
taatacgactcactatagggggcggggcggacgtggggcaggtcacttcgaacagaggagacgaagtatgctgccccacaacctggcggcagcgcaaaagatg

SEQ ID NO: 166373 - DNA, 103 bp, Artificial Sequence
  Synthetic Polynucleotide
taatacgactcactataggggctgagcaatgagatgaagtccgagggcataacagaggagaatgcccatggacttcatcaacctggcggcagcgcaaaagatg

SEQ ID NO: 166374 - DNA, 103 bp, Artificial Sequence
  Synthetic Polynucleotide
taatacgactcactatagggagatggaggtaactgtaactcctttgggagaacagaggagactcccaatggagttacagaacctggcggcagcgcaaaagatg

SEQ ID NO: 166375 - DNA, 103 bp, Artificial Sequence
  Synthetic Polynucleotide
taatacgactcactatagggtggtttcactcgtccagagtcgttgcccacaacagaggagagtgggcatggactctggaaacctggcggcagcgcaaaagatg

SEQ ID NO: 166376 - DNA, 103 bp, Artificial Sequence
  Synthetic Polynucleotide
taatacgactcactatagggaaaatccatgtggtttcactcgtccagagtaacagaggagaactctgatggagtgaaacaacctggcggcagcgcaaaagatg

SEQ ID NO: 166377 - DNA, 103 bp, Artificial Sequence
  Synthetic Polynucleotide
taatacgactcactatagggcaggcctgataaaatccatgtggtttcactaacagaggagaagtgaaatgacatggattaacctggcggcagcgcaaaagatg

SEQ ID NO: 166378 - DNA, 103 bp, Artificial Sequence
  Synthetic Polynucleotide
taatacgactcactatagggagttactctgcaggcctgataaaatccatgaacagaggagacatggaatgtatcaggccaacctggcggcagcgcaaaagatg

SEQ ID NO: 166379 - DNA, 103 bp, Artificial Sequence
  Synthetic Polynucleotide
taatacgactcactatagggtatttcgtccagttactctgcaggcctgataacagaggagaatcaggatggcagagtaaaacctggcggcagcgcaaaagatg

SEQ ID NO: 166380 - DNA, 103 bp, Artificial Sequence
  Synthetic Polynucleotide
taatacgactcactatagggcaaggagttgtatttcgtccagttactctgaacagaggagacagagtatgtggacgaaaaacctggcggcagcgcaaaagatg

SEQ ID NO: 166381 - DNA, 103 bp, Artificial Sequence
  Synthetic Polynucleotide
taatacgactcactatagggcacttctttgcaaggagttgtatttcgtccaacagaggagaggacgaatgacaactcctaacctggcggcagcgcaaaagatg

SEQ ID NO: 166382 - DNA, 103 bp, Artificial Sequence
  Synthetic Polynucleotide
taatacgactcactatagggcttcaatgtccacttctttgcaaggagttgaacagaggagacaactcatggcaaagaagaacctggcggcagcgcaaaagatg

SEQ ID NO: 166383 - DNA, 103 bp, Artificial Sequence
  Synthetic Polynucleotide
taatacgactcactatagggacagtagtgccttcaatgtccacttctttgaacagaggagacaaagaatgggacattgaaacctggcggcagcgcaaaagatg

SEQ ID NO: 166384 - DNA, 103 bp, Artificial Sequence
  Synthetic Polynucleotide
taatacgactcactataggggacttctataacagtagtgccttcaatgtcaacagaggagagacattatgggcactactaacctggcggcagcgcaaaagatg

SEQ ID NO: 166385 - DNA, 103 bp, Artificial Sequence
  Synthetic Polynucleotide
taatacgactcactatagggatgtttctctagatggaggtaactgtaactaacagaggagaagttacatgtacctccataacctggcggcagcgcaaaagatg

SEQ ID NO: 166386 - DNA, 103 bp, Artificial Sequence
  Synthetic Polynucleotide
taatacgactcactataggggatcaaggccgacttctataacagtagtgcaacagaggagagcactaatgttatagaagaacctggcggcagcgcaaaagatg

SEQ ID NO: 166387 - DNA, 103 bp, Artificial Sequence
  Synthetic Polynucleotide
taatacgactcactatagggttgttgctaggatcaaggccgacttctataaacagaggagatatagaatgcggccttgaaacctggcggcagcgcaaaagatg

SEQ ID NO: 166388 - DNA, 103 bp, Artificial Sequence
  Synthetic Polynucleotide
taatacgactcactatagggcagtgtcatgttgttgctaggatcaaggccaacagaggagaggccttatgcctagcaacaacctggcggcagcgcaaaagatg

SEQ ID NO: 166389 - DNA, 103 bp, Artificial Sequence
  Synthetic Polynucleotide
taatacgactcactatagggagtccaccgccagtgtcatgttgttgctagaacagaggagactagcaatgacatgacacaacctggcggcagcgcaaaagatg

SEQ ID NO: 166390 - DNA, 103 bp, Artificial Sequence
  Synthetic Polynucleotide
taatacgactcactatagggatccctacgcagtccaccgccagtgtcatgaacagaggagacatgacatgggcggtggaaacctggcggcagcgcaaaagatg

SEQ ID NO: 166391 - DNA, 103 bp, Artificial Sequence
  Synthetic Polynucleotide
taatacgactcactatagggcaatttcaatatccctacgcagtccaccgcaacagaggagagcggtgatgtgcgtagggaacctggcggcagcgcaaaagatg

SEQ ID NO: 166392 - DNA, 103 bp, Artificial Sequence
  Synthetic Polynucleotide
taatacgactcactatagggcagcattcctcaatttcaatatccctacgcaacagaggagagcgtagatgtattgaaataacctggcggcagcgcaaaagatg

SEQ ID NO: 166393 - DNA, 103 bp, Artificial Sequence
  Synthetic Polynucleotide
taatacgactcactataggggcttcgacatcagcattcctcaatttcaataacagaggagaattgaaatggaggaatgcaacctggcggcagcgcaaaagatg

SEQ ID NO: 166394 - DNA, 103 bp, Artificial Sequence
  Synthetic Polynucleotide
taatacgactcactatagggtcctattctggcttcgacatcagcattcctaacagaggagaaggaatatggatgtcgaaaacctggcggcagcgcaaaagatg

SEQ ID NO: 166395 - DNA, 103 bp, Artificial Sequence
  Synthetic Polynucleotide
taatacgactcactatagggaaccagcaattcctattctggcttcgacataacagaggagaatgtcgatgccagaatagaacctggcggcagcgcaaaagatg

SEQ ID NO: 166396 - DNA, 103 bp, Artificial Sequence
  Synthetic Polynucleotide
taatacgactcactataggggatgctacagatgtttctctagatggaggtaacagaggagaacctccatgtagagaaacaacctggcggcagcgcaaaagatg

SEQ ID NO: 166397 - DNA, 103 bp, Artificial Sequence
  Synthetic Polynucleotide
taatacgactcactatagggttcttcttggaaccagcaattcctattctgaacagaggagacagaatatgaattgctggaacctggcggcagcgcaaaagatg

SEQ ID NO: 166398 - DNA, 103 bp, Artificial Sequence
  Synthetic Polynucleotide
taatacgactcactatagggacgagtgcttttcttcttggaaccagcaataacagaggagaattgctatgtccaagaagaacctggcggcagcgcaaaagatg

SEQ ID NO: 166399 - DNA, 103 bp, Artificial Sequence
  Synthetic Polynucleotide
taatacgactcactatagggccaatctggcacgagtgcttttcttcttggaacagaggagaccaagaatgaaagcactcaacctggcggcagcgcaaaagatg

SEQ ID NO: 166400 - DNA, 103 bp, Artificial Sequence
  Synthetic Polynucleotide
taatacgactcactatagggactcgaaaaaccaatctggcacgagtgcttaacagaggagaaagcacatgtgccagattaacctggcggcagcgcaaaagatg

SEQ ID NO: 166401 - DNA, 103 bp, Artificial Sequence
  Synthetic Polynucleotide
taatacgactcactatagggcatgatattaactcgaaaaaccaatctggcaacagaggagagccagaatggtttttcgaaacctggcggcagcgcaaaagatg

SEQ ID NO: 166402 - DNA, 103 bp, Artificial Sequence
  Synthetic Polynucleotide
taatacgactcactatagggcatctttcctcatgatattaactcgaaaaaaacagaggagatttttcatgttaatatcaaacctggcggcagcgcaaaagatg

SEQ ID NO: 166403 - DNA, 103 bp, Artificial Sequence
  Synthetic Polynucleotide
taatacgactcactatagggaaagtggagccatctttcctcatgatattaaacagaggagataatatatggaggaaagaaacctggcggcagcgcaaaagatg

SEQ ID NO: 166404 - DNA, 103 bp, Artificial Sequence
  Synthetic Polynucleotide
taatacgactcactatagggttgcagtgtcaaagtggagccatctttcctaacagaggagaaggaaaatgggctccactaacctggcggcagcgcaaaagatg

SEQ ID NO: 166405 - DNA, 103 bp, Artificial Sequence
  Synthetic Polynucleotide
taatacgactcactatagggaagagggtgtttgcagtgtcaaagtggagcaacagaggagagctccaatgtgacactgcaacctggcggcagcgcaaaagatg

SEQ ID NO: 166406 - DNA, 103 bp, Artificial Sequence
  Synthetic Polynucleotide
taatacgactcactatagggaaaattggagaagagggtgtttgcagtgtcaacagaggagagacactatgaacaccctcaacctggcggcagcgcaaaagatg

SEQ ID NO: 166407 - DNA, 103 bp, Artificial Sequence
  Synthetic Polynucleotide
taatacgactcactatagggctgactcattgatgctacagatgtttctctaacagaggagaagagaaatgtctgtagcaaacctggcggcagcgcaaaagatg

SEQ ID NO: 166408 - DNA, 103 bp, Artificial Sequence
  Synthetic Polynucleotide
taatacgactcactatagggctgagtacacaaaattggagaagagggtgtaacagaggagaacacccatgtctccaattaacctggcggcagcgcaaaagatg

SEQ ID NO: 166409 - DNA, 103 bp, Artificial Sequence
  Synthetic Polynucleotide
taatacgactcactatagggctcctgctggctgagtacacaaaattggagaacagaggagactccaaatgtgtgtactcaacctggcggcagcgcaaaagatg

SEQ ID NO: 166410 - DNA, 103 bp, Artificial Sequence
  Synthetic Polynucleotide
taatacgactcactatagggatttctggcactcctgctggctgagtacacaacagaggagagtgtacatggccagcaggaacctggcggcagcgcaaaagatg

SEQ ID NO: 166411 - DNA, 103 bp, Artificial Sequence
  Synthetic Polynucleotide
taatacgactcactatagggtttctttaagatttctggcactcctgctggaacagaggagaccagcaatggtgccagaaaacctggcggcagcgcaaaagatg

SEQ ID NO: 166412 - DNA, 103 bp, Artificial Sequence
  Synthetic Polynucleotide
taatacgactcactatagggtatgcaagcttttctttaagatttctggcaaacagaggagatgccagatgtcttaaagaaacctggcggcagcgcaaaagatg

SEQ ID NO: 166413 - DNA, 103 bp, Artificial Sequence
  Synthetic Polynucleotide
taatacgactcactatagggactgaacagctatgcaagcttttctttaagaacagaggagacttaaaatgaagcttgcaaacctggcggcagcgcaaaagatg

SEQ ID NO: 166414 - DNA, 103 bp, Artificial Sequence
  Synthetic Polynucleotide
taatacgactcactatagggttctcctttcactgaacagctatgcaagctaacagaggagaagcttgatgagctgttcaaacctggcggcagcgcaaaagatg

SEQ ID NO: 166415 - DNA, 103 bp, Artificial Sequence
  Synthetic Polynucleotide
taatacgactcactatagggacacttcttcttctcctttcactgaacagcaacagaggagagctgttatgtgaaaggagaacctggcggcagcgcaaaagatg

SEQ ID NO: 166416 - DNA, 103 bp, Artificial Sequence
  Synthetic Polynucleotide
taatacgactcactatagggccgattaaaaacacttcttcttctcctttcaacagaggagagaaaggatgagaagaagtaacctggcggcagcgcaaaagatg

SEQ ID NO: 166417 - DNA, 103 bp, Artificial Sequence
  Synthetic Polynucleotide
taatacgactcactatagggaaagttcttgccgattaaaaacacttcttcaacagaggagagaagaaatgtttttaatcaacctggcggcagcgcaaaagatg

SEQ ID NO: 166418 - DNA, 103 bp, Artificial Sequence
  Synthetic Polynucleotide
taatacgactcactatagggcaccgcttgtctgactcattgatgctacagaacagaggagactgtagatgcaatgagtcaacctggcggcagcgcaaaagatg

SEQ ID NO: 166419 - DNA, 103 bp, Artificial Sequence
  Synthetic Polynucleotide
taatacgactcactatagggttcctttcagaaagttcttgccgattaaaaaacagaggagattttaaatggcaagaactaacctggcggcagcgcaaaagatg

SEQ ID NO: 166420 - DNA, 103 bp, Artificial Sequence
  Synthetic Polynucleotide
taatacgactcactatagggataactttagttcctttcagaaagttcttgaacagaggagacaagaaatgtctgaaaggaacctggcggcagcgcaaaagatg

SEQ ID NO: 166421 - DNA, 103 bp, Artificial Sequence
  Synthetic Polynucleotide
taatacgactcactatagggttcttggaaaataactttagttcctttcagaacagaggagactgaaaatgactaaagttaacctggcggcagcgcaaaagatg

SEQ ID NO: 166422 - DNA, 103 bp, Artificial Sequence
  Synthetic Polynucleotide
taatacgactcactatagggcagaaacattttcttggaaaataactttagaacagaggagactaaagatgttttccaagaacctggcggcagcgcaaaagatg

SEQ ID NO: 166423 - DNA, 103 bp, Artificial Sequence
  Synthetic Polynucleotide
taatacgactcactataggggagttttcatcagaaacattttcttggaaaaacagaggagatttccaatgaaatgtttcaacctggcggcagcgcaaaagatg

SEQ ID NO: 166424 - DNA, 103 bp, Artificial Sequence
  Synthetic Polynucleotide
taatacgactcactatagggtgacttccaagagttttcatcagaaacattaacagaggagaaatgttatggatgaaaacaacctggcggcagcgcaaaagatg

SEQ ID NO: 166425 - DNA, 103 bp, Artificial Sequence
  Synthetic Polynucleotide
taatacgactcactatagggtttcagcttctgacttccaagagttttcataacagaggagaatgaaaatgcttggaagtaacctggcggcagcgcaaaagatg

SEQ ID NO: 166426 - DNA, 103 bp, Artificial Sequence
  Synthetic Polynucleotide
taatacgactcactatagggtccatatcaatttcagcttctgacttccaaaacagaggagattggaaatgagaagctgaaacctggcggcagcgcaaaagatg

SEQ ID NO: 166427 - DNA, 103 bp, Artificial Sequence
  Synthetic Polynucleotide
taatacgactcactatagggatgaaatagttccatatcaatttcagcttcaacagaggagagaagctatgattgatatgaacctggcggcagcgcaaaagatg

SEQ ID NO: 166428 - DNA, 103 bp, Artificial Sequence
  Synthetic Polynucleotide
taatacgactcactataggggatgattctgatgaaatagttccatatcaaaacagaggagattgataatgaactatttcaacctggcggcagcgcaaaagatg

SEQ ID NO: 166429 - DNA, 103 bp, Artificial Sequence
  Synthetic Polynucleotide
taatacgactcactatagggcctgcctcaccaccgcttgtctgactcattaacagaggagaaatgagatggacaagcggaacctggcggcagcgcaaaagatg

SEQ ID NO: 166430 - DNA, 103 bp, Artificial Sequence
  Synthetic Polynucleotide
taatacgactcactatagggttcacaataagatgattctgatgaaatagtaacagaggagaactattatgtcagaatcaaacctggcggcagcgcaaaagatg

SEQ ID NO: 166431 - DNA, 103 bp, Artificial Sequence
  Synthetic Polynucleotide
taatacgactcactataggggggaggaaccttcacaataagatgattctgaacagaggagacagaatatgcttattgtgaacctggcggcagcgcaaaagatg

SEQ ID NO: 166432 - DNA, 103 bp, Artificial Sequence
  Synthetic Polynucleotide
taatacgactcactatagggggtcatgatagggaggaaccttcacaataaaacagaggagattattgatgaggttcctcaacctggcggcagcgcaaaagatg

SEQ ID NO: 166433 - DNA, 103 bp, Artificial Sequence
  Synthetic Polynucleotide
taatacgactcactataggggttatatgttggtcatgatagggaggaaccaacagaggagaggttccatgctatcatgaaacctggcggcagcgcaaaagatg

SEQ ID NO: 166434 - DNA, 103 bp, Artificial Sequence
  Synthetic Polynucleotide
taatacgactcactatagggcacaggcaaagttatatgttggtcatgataaacagaggagatatcatatgcaacatataaacctggcggcagcgcaaaagatg

SEQ ID NO: 166435 - DNA, 103 bp, Artificial Sequence
  Synthetic Polynucleotide
taatacgactcactatagggttcccactgacacaggcaaagttatatgttaacagaggagaaacataatgctttgcctgaacctggcggcagcgcaaaagatg

SEQ ID NO: 166436 - DNA, 103 bp, Artificial Sequence
  Synthetic Polynucleotide
taatacgactcactatagggactacatatattcccactgacacaggcaaaaacagaggagatttgccatggtcagtgggaacctggcggcagcgcaaaagatg

SEQ ID NO: 166437 - DNA, 103 bp, Artificial Sequence
  Synthetic Polynucleotide
taatacgactcactatagggagcatttgtcactacatatattcccactgaaacagaggagatcagtgatgatatatgtaaacctggcggcagcgcaaaagatg

SEQ ID NO: 166438 - DNA, 103 bp, Artificial Sequence
  Synthetic Polynucleotide
taatacgactcactataggggagatcttccagcatttgtcactacatataaacagaggagatatatgatgtgacaaatgaacctggcggcagcgcaaaagatg

SEQ ID NO: 166439 - DNA, 103 bp, Artificial Sequence
  Synthetic Polynucleotide
taatacgactcactatagggtgaacatcatgagatcttccagcatttgtcaacagaggagagacaaaatgtggaagatcaacctggcggcagcgcaaaagatg

SEQ ID NO: 166440 - DNA, 103 bp, Artificial Sequence
  Synthetic Polynucleotide
taatacgactcactatagggaggaggcgagcctgcctcaccaccgcttgtaacagaggagaacaagcatgggtgaggcaaacctggcggcagcgcaaaagatg

SEQ ID NO: 166441 - DNA, 103 bp, Artificial Sequence
  Synthetic Polynucleotide
taatacgactcactatagggagtgaatggttgaacatcatgagatcttccaacagaggagaggaagaatgcatgatgttaacctggcggcagcgcaaaagatg

SEQ ID NO: 166442 - DNA, 103 bp, Artificial Sequence
  Synthetic Polynucleotide
taatacgactcactatagggctggagtgtaagtgaatggttgaacatcataacagaggagaatgatgatgaaccattcaaacctggcggcagcgcaaaagatg

SEQ ID NO: 166443 - DNA, 103 bp, Artificial Sequence
  Synthetic Polynucleotide
taatacgactcactataggggctgctgggtctggagtgtaagtgaatggtaacagaggagaaccattatgttacactccaacctggcggcagcgcaaaagatg

SEQ ID NO: 166444 - DNA, 103 bp, Artificial Sequence
  Synthetic Polynucleotide
taatacgactcactatagggagcaccagctgctgctgggtctggagtgtaaacagaggagatacactatggacccagcaaacctggcggcagcgcaaaagatg

SEQ ID NO: 166445 - DNA, 103 bp, Artificial Sequence
  Synthetic Polynucleotide
taatacgactcactatagggttacattcaaagcaccagctgctgctgggtaacagaggagaacccagatgcagctggtgaacctggcggcagcgcaaaagatg

SEQ ID NO: 166446 - DNA, 103 bp, Artificial Sequence
  Synthetic Polynucleotide
taatacgactcactatagggttcttcacatttacattcaaagcaccagctaacagaggagaagctggatgtttgaatgtaacctggcggcagcgcaaaagatg

SEQ ID NO: 166447 - DNA, 103 bp, Artificial Sequence
  Synthetic Polynucleotide
taatacgactcactatagggagatatttccttcttcacatttacattcaaaacagaggagattgaatatgaatgtgaagaacctggcggcagcgcaaaagatg

SEQ ID NO: 166448 - DNA, 103 bp, Artificial Sequence
  Synthetic Polynucleotide
taatacgactcactatagggttgctggactagatatttccttcttcacataacagaggagaatgtgaatgaggaaatataacctggcggcagcgcaaaagatg

SEQ ID NO: 166449 - DNA, 103 bp, Artificial Sequence
  Synthetic Polynucleotide
taatacgactcactataggggagcaaggtcttgctggactagatatttccaacagaggagaggaaatatgtagtccagcaacctggcggcagcgcaaaagatg

SEQ ID NO: 166450 - DNA, 103 bp, Artificial Sequence
  Synthetic Polynucleotide
taatacgactcactatagggctcttcaaaagagcaaggtcttgctggactaacagaggagaagtccaatgagaccttgcaacctggcggcagcgcaaaagatg

SEQ ID NO: 166451 - DNA, 103 bp, Artificial Sequence
  Synthetic Polynucleotide
taatacgactcactatagggcaacagctggaggaggcgagcctgcctcacaacagaggagagtgaggatggctcgcctcaacctggcggcagcgcaaaagatg

SEQ ID NO: 166452 - DNA, 103 bp, Artificial Sequence
  Synthetic Polynucleotide
taatacgactcactatagggctttcatggcctcttcaaaagagcaaggtcaacagaggagagaccttatgcttttgaagaacctggcggcagcgcaaaagatg

SEQ ID NO: 166453 - DNA, 103 bp, Artificial Sequence
  Synthetic Polynucleotide
taatacgactcactataggggttttcattgctttcatggcctcttcaaaaaacagaggagattttgaatgggccatgaaaacctggcggcagcgcaaaagatg

SEQ ID NO: 166454 - DNA, 103 bp, Artificial Sequence
  Synthetic Polynucleotide
taatacgactcactatagggacatccagtagttttcattgctttcatggcaacagaggagagccatgatggcaatgaaaaacctggcggcagcgcaaaagatg

SEQ ID NO: 166455 - DNA, 103 bp, Artificial Sequence
  Synthetic Polynucleotide
taatacgactcactatagggtatctaaattacatccagtagttttcattgaacagaggagacaatgaatgctactggataacctggcggcagcgcaaaagatg

SEQ ID NO: 166456 - DNA, 103 bp, Artificial Sequence
  Synthetic Polynucleotide
taatacgactcactatagggatatttaccttatctaaattacatccagtaaacagaggagatactggatgtaatttagaaacctggcggcagcgcaaaagatg

SEQ ID NO: 166457 - DNA, 103 bp, Artificial Sequence
  Synthetic Polynucleotide
taatacgactcactatagggattagggataatatttaccttatctaaattaacagaggagaaatttaatgaaggtaaataacctggcggcagcgcaaaagatg

SEQ ID NO: 166458 - DNA, 103 bp, Artificial Sequence
  Synthetic Polynucleotide
taatacgactcactatagggtcatcagggcattagggataatatttacctaacagaggagaaggtaaatgttatccctaaacctggcggcagcgcaaaagatg

SEQ ID NO: 166459 - DNA, 103 bp, Artificial Sequence
  Synthetic Polynucleotide
taatacgactcactatagggatgagtggagtcatcagggcattagggataaacagaggagatatcccatgtgccctgataacctggcggcagcgcaaaagatg

SEQ ID NO: 166460 - DNA, 103 bp, Artificial Sequence
  Synthetic Polynucleotide
taatacgactcactatagggactgcttggtatgagtggagtcatcagggcaacagaggagagccctgatgactccactcaacctggcggcagcgcaaaagatg

SEQ ID NO: 166461 - DNA, 103 bp, Artificial Sequence
  Synthetic Polynucleotide
taatacgactcactatagggtcttaatcatactgcttggtatgagtggagaacagaggagactccacatgtaccaagcaaacctggcggcagcgcaaaagatg

SEQ ID NO: 166462 - DNA, 103 bp, Artificial Sequence
  Synthetic Polynucleotide
taatacgactcactatagggtcagcagcaacaacagctggaggaggcgagaacagaggagactcgccatgtccagctgtaacctggcggcagcgcaaaagatg

SEQ ID NO: 166463 - DNA, 103 bp, Artificial Sequence
  Synthetic Polynucleotide
taatacgactcactatagggacatcttcactcttaatcatactgcttggtaacagaggagaaccaagatgtatgattaaaacctggcggcagcgcaaaagatg

SEQ ID NO: 166464 - DNA, 103 bp, Artificial Sequence
  Synthetic Polynucleotide
taatacgactcactatagggcattggagtaacatcttcactcttaatcataacagaggagaatgattatgagtgaagataacctggcggcagcgcaaaagatg

SEQ ID NO: 166465 - DNA, 103 bp, Artificial Sequence
  Synthetic Polynucleotide
taatacgactcactatagggctgttacttccattggagtaacatcttcacaacagaggagagtgaagatgttactccaaaacctggcggcagcgcaaaagatg

SEQ ID NO: 166466 - DNA, 103 bp, Artificial Sequence
  Synthetic Polynucleotide
taatacgactcactatagggcttttttctgctgttacttccattggagtaaacagaggagatactccatgggaagtaacaacctggcggcagcgcaaaagatg

SEQ ID NO: 166467 - DNA, 103 bp, Artificial Sequence
  Synthetic Polynucleotide
taatacgactcactatagggagtggaagatcttttttctgctgttacttcaacagaggagagaagtaatggcagaaaaaaacctggcggcagcgcaaaagatg

SEQ ID NO: 166468 - DNA, 103 bp, Artificial Sequence
  Synthetic Polynucleotide
taatacgactcactatagggtcttaaaaatagtggaagatcttttttctgaacagaggagacagaaaatggatcttccaaacctggcggcagcgcaaaagatg

SEQ ID NO: 166469 - DNA, 103 bp, Artificial Sequence
  Synthetic Polynucleotide
taatacgactcactataggggactttgtagtcttaaaaatagtggaagataacagaggagaatcttcatgtatttttaaaacctggcggcagcgcaaaagatg

SEQ ID NO: 166470 - DNA, 103 bp, Artificial Sequence
  Synthetic Polynucleotide
taatacgactcactatagggtgatccaacagactttgtagtcttaaaaataacagaggagaatttttatgactacaaagaacctggcggcagcgcaaaagatg

SEQ ID NO: 166471 - DNA, 103 bp, Artificial Sequence
  Synthetic Polynucleotide
taatacgactcactatagggtttgctgagttgatccaacagactttgtagaacagaggagactacaaatgctgttggataacctggcggcagcgcaaaagatg

SEQ ID NO: 166472 - DNA, 103 bp, Artificial Sequence
  Synthetic Polynucleotide
taatacgactcactatagggttttctaatgtttgctgagttgatccaacaaacagaggagatgttggatgaactcagcaaacctggcggcagcgcaaaagatg

SEQ ID NO: 166473 - DNA, 103 bp, Artificial Sequence
  Synthetic Polynucleotide
taatacgactcactatagggtgaagaagcatcagcagcaacaacagctggaacagaggagaccagctatggttgctgctaacctggcggcagcgcaaaagatg

SEQ ID NO: 166474 - DNA, 103 bp, Artificial Sequence
  Synthetic Polynucleotide
taatacgactcactataggggtttgagatgttttctaatgtttgctgagtaacagaggagaactcagatgacattagaaaacctggcggcagcgcaaaagatg

SEQ ID NO: 166475 - DNA, 103 bp, Artificial Sequence
  Synthetic Polynucleotide
taatacgactcactatagggttcctgctatgtttgagatgttttctaatgaacagaggagacattagatgacatctcaaaacctggcggcagcgcaaaagatg

SEQ ID NO: 166476 - DNA, 103 bp, Artificial Sequence
  Synthetic Polynucleotide
taatacgactcactatagggaaagagccatttcctgctatgtttgagatgaacagaggagacatctcatgcatagcaggaacctggcggcagcgcaaaagatg

SEQ ID NO: 166477 - DNA, 103 bp, Artificial Sequence
  Synthetic Polynucleotide
taatacgactcactatagggtggtgatgaaaaagagccatttcctgctataacagaggagaatagcaatgaatggctctaacctggcggcagcgcaaaagatg

SEQ ID NO: 166478 - DNA, 103 bp, Artificial Sequence
  Synthetic Polynucleotide
taatacgactcactataggggggaagatgatggtgatgaaaaagagccataacagaggagaatggctatgtttcatcacaacctggcggcagcgcaaaagatg

SEQ ID NO: 166479 - DNA, 103 bp, Artificial Sequence
  Synthetic Polynucleotide
taatacgactcactataggggaaggtaggtgggaagatgatggtgatgaaaacagaggagattcatcatgatcatcttcaacctggcggcagcgcaaaagatg

SEQ ID NO: 166480 - DNA, 103 bp, Artificial Sequence
  Synthetic Polynucleotide
taatacgactcactatagggttcattttcagaaggtaggtgggaagatgaaacagaggagatcatctatgcacctacctaacctggcggcagcgcaaaagatg

SEQ ID NO: 166481 - DNA, 103 bp, Artificial Sequence
  Synthetic Polynucleotide
taatacgactcactataggggctgctgtttttcattttcagaaggtaggtaacagaggagaacctacatgctgaaaatgaacctggcggcagcgcaaaagatg

SEQ ID NO: 166482 - DNA, 103 bp, Artificial Sequence
  Synthetic Polynucleotide
taatacgactcactatagggggctgaatctgctgctgtttttcattttcaaacagaggagatgaaaaatgaaaacagcaaacctggcggcagcgcaaaagatg

SEQ ID NO: 166483 - DNA, 103 bp, Artificial Sequence
  Synthetic Polynucleotide
taatacgactcactataggggtatgccttgggctgaatctgctgctgtttaacagaggagaaaacagatgcagattcagaacctggcggcagcgcaaaagatg

SEQ ID NO: 166484 - DNA, 103 bp, Artificial Sequence
  Synthetic Polynucleotide
taatacgactcactatagggctaggtccgcgctgagcaatgagatgaagtaacagaggagaacttcaatgcattgctcaaacctggcggcagcgcaaaagatg

SEQ ID NO: 166485 - DNA, 103 bp, Artificial Sequence
  Synthetic Polynucleotide
taatacgactcactatagggaggagggagctgaagaagcatcagcagcaaaacagaggagattgctgatgatgcttcttaacctggcggcagcgcaaaagatg

SEQ ID NO: 166486 - DNA, 103 bp, Artificial Sequence
  Synthetic Polynucleotide
taatacgactcactatagggtctctgggttgtatgccttgggctgaatctaacagaggagaagattcatgccaaggcataacctggcggcagcgcaaaagatg

SEQ ID NO: 166487 - DNA, 103 bp, Artificial Sequence
  Synthetic Polynucleotide
taatacgactcactataggggttgtcagggtctctgggttgtatgccttgaacagaggagacaaggcatgcaacccagaaacctggcggcagcgcaaaagatg

SEQ ID NO: 166488 - DNA, 103 bp, Artificial Sequence
  Synthetic Polynucleotide
taatacgactcactatagggggtttgaatagttgtcagggtctctgggttaacagaggagaaacccaatgaccctgacaaacctggcggcagcgcaaaagatg

SEQ ID NO: 166489 - DNA, 103 bp, Artificial Sequence
  Synthetic Polynucleotide
taatacgactcactatagggagatgtcctgggtttgaatagttgtcagggaacagaggagaccctgaatgctattcaaaaacctggcggcagcgcaaaagatg

SEQ ID NO: 166490 - DNA, 103 bp, Artificial Sequence
  Synthetic Polynucleotide
taatacgactcactatagggccaggctgtgagatgtcctgggtttgaataaacagaggagatattcaatgccaggacataacctggcggcagcgcaaaagatg

SEQ ID NO: 166491 - DNA, 103 bp, Artificial Sequence
  Synthetic Polynucleotide
taatacgactcactatagggtggaaaagtaccaggctgtgagatgtcctgaacagaggagacaggacatgtcacagcctaacctggcggcagcgcaaaagatg

SEQ ID NO: 166492 - DNA, 103 bp, Artificial Sequence
  Synthetic Polynucleotide
taatacgactcactatagggcagaaactgctggaaaagtaccaggctgtgaacagaggagacacagcatggtacttttcaacctggcggcagcgcaaaagatg

SEQ ID NO: 166493 - DNA, 103 bp, Artificial Sequence
  Synthetic Polynucleotide
taatacgactcactatagggtgactagaagcagaaactgctggaaaagtaaacagaggagatactttatgagcagtttcaacctggcggcagcgcaaaagatg

SEQ ID NO: 166494 - DNA, 103 bp, Artificial Sequence
  Synthetic Polynucleotide
taatacgactcactataggggttgggcagctgactagaagcagaaactgcaacagaggagagcagttatggcttctagtaacctggcggcagcgcaaaagatg

SEQ ID NO: 166495 - DNA, 103 bp, Artificial Sequence
  Synthetic Polynucleotide
taatacgactcactataggggtgcatcgctgttgggcagctgactagaagaacagaggagacttctaatgagctgcccaaacctggcggcagcgcaaaagatg

SEQ ID NO: 166496 - DNA, 103 bp, Artificial Sequence
  Synthetic Polynucleotide
taatacgactcactatagggatggaggaagaggagggagctgaagaagcaaacagaggagatgcttcatgagctccctcaacctggcggcagcgcaaaagatg

SEQ ID NO: 166497 - DNA, 103 bp, Artificial Sequence
  Synthetic Polynucleotide
taatacgactcactatagggtgctgcaatagtgcatcgctgttgggcagcaacagaggagagctgccatgcagcgatgcaacctggcggcagcgcaaaagatg

SEQ ID NO: 166498 - DNA, 103 bp, Artificial Sequence
  Synthetic Polynucleotide
taatacgactcactatagggctgtgtagcctgctgcaatagtgcatcgctaacagaggagaagcgatatgctattgcagaacctggcggcagcgcaaaagatg

SEQ ID NO: 166499 - DNA, 103 bp, Artificial Sequence
  Synthetic Polynucleotide
taatacgactcactatagggttgtctgaaactgtgtagcctgctgcaataaacagaggagatattgcatgaggctacacaacctggcggcagcgcaaaagatg

SEQ ID NO: 166500 - DNA, 103 bp, Artificial Sequence
  Synthetic Polynucleotide
taatacgactcactatagggtgagtttctcttgtctgaaactgtgtagccaacagaggagaggctacatggtttcagacaacctggcggcagcgcaaaagatg

SEQ ID NO: 166501 - DNA, 103 bp, Artificial Sequence
  Synthetic Polynucleotide
taatacgactcactatagggctctctagactgagtttctcttgtctgaaaaacagaggagatttcagatgagagaaactaacctggcggcagcgcaaaagatg

SEQ ID NO: 166502 - DNA, 103 bp, Artificial Sequence
  Synthetic Polynucleotide
taatacgactcactatagggactgtaatatctctctagactgagtttctcaacagaggagagagaaaatgagtctagagaacctggcggcagcgcaaaagatg

SEQ ID NO: 166503 - DNA, 103 bp, Artificial Sequence
  Synthetic Polynucleotide
taatacgactcactataggggtaccatctgactgtaatatctctctagacaacagaggagagtctagatggatattacaaacctggcggcagcgcaaaagatg

SEQ ID NO: 166504 - DNA, 103 bp, Artificial Sequence
  Synthetic Polynucleotide
taatacgactcactatagggattaaccactgtaccatctgactgtaatataacagaggagaatattaatgtcagatggtaacctggcggcagcgcaaaagatg

SEQ ID NO: 166505 - DNA, 103 bp, Artificial Sequence
  Synthetic Polynucleotide
taatacgactcactataggggttgtgacaaattaaccactgtaccatctgaacagaggagacagatgatgcagtggttaaacctggcggcagcgcaaaagatg

SEQ ID NO: 166506 - DNA, 103 bp, Artificial Sequence
  Synthetic Polynucleotide
taatacgactcactataggggcctcagtcagttgtgacaaattaaccactaacagaggagaagtggtatgtttgtcacaaacctggcggcagcgcaaaagatg

SEQ ID NO: 166507 - DNA, 103 bp, Artificial Sequence
  Synthetic Polynucleotide
taatacgactcactatagggagcaccgcccatggaggaagaggagggagcaacagaggagagctcccatgtcttcctccaacctggcggcagcgcaaaagatg

SEQ ID NO: 166508 - DNA, 103 bp, Artificial Sequence
  Synthetic Polynucleotide
taatacgactcactatagggttgttgtgatgcctcagtcagttgtgacaaaacagaggagattgtcaatgctgactgagaacctggcggcagcgcaaaagatg

SEQ ID NO: 166509 - DNA, 103 bp, Artificial Sequence
  Synthetic Polynucleotide
taatacgactcactatagggactgctgctgttgttgtgatgcctcagtcaaacagaggagatgactgatgcatcacaacaacctggcggcagcgcaaaagatg

SEQ ID NO: 166510 - DNA, 103 bp, Artificial Sequence
  Synthetic Polynucleotide
taatacgactcactatagggtgtagtggtgactgctgctgttgttgtgataacagaggagaatcacaatgacagcagcaaacctggcggcagcgcaaaagatg

SEQ ID NO: 166511 - DNA, 103 bp, Artificial Sequence
  Synthetic Polynucleotide
taatacgactcactatagggtgcttgttcttgtagtggtgactgctgctgaacagaggagacagcagatgtcaccactaaacctggcggcagcgcaaaagatg

SEQ ID NO: 166512 - DNA, 103 bp, Artificial Sequence
  Synthetic Polynucleotide
taatacgactcactataggggtaaagtctgtgcttgttcttgtagtggtgaacagaggagacaccacatgaagaacaagaacctggcggcagcgcaaaagatg

SEQ ID NO: 166513 - DNA, 103 bp, Artificial Sequence
  Synthetic Polynucleotide
taatacgactcactatagggatctgctgctgtaaagtctgtgcttgttctaacagaggagaagaacaatgacagactttaacctggcggcagcgcaaaagatg

SEQ ID NO: 166514 - DNA, 103 bp, Artificial Sequence
  Synthetic Polynucleotide
taatacgactcactatagggatttgatgaaatctgctgctgtaaagtctgaacagaggagacagactatgcagcagcagaacctggcggcagcgcaaaagatg

SEQ ID NO: 166515 - DNA, 103 bp, Artificial Sequence
  Synthetic Polynucleotide
taatacgactcactatagggatggaaaaatatttgatgaaatctgctgctaacagaggagaagcagcatgtttcatcaaaacctggcggcagcgcaaaagatg

SEQ ID NO: 166516 - DNA, 103 bp, Artificial Sequence
  Synthetic Polynucleotide
taatacgactcactatagggctatttggtgatggaaaaatatttgatgaaaacagaggagattcatcatgtatttttccaacctggcggcagcgcaaaagatg

SEQ ID NO: 166517 - DNA, 103 bp, Artificial Sequence
  Synthetic Polynucleotide
taatacgactcactatagggctgactcacactatttggtgatggaaaaataacagaggagaatttttatgtcaccaaataacctggcggcagcgcaaaagatg

SEQ ID NO: 166518 - DNA, 103 bp, Artificial Sequence
  Synthetic Polynucleotide
taatacgactcactatagggaggagctgcaagcaccgcccatggaggaagaacagaggagacttcctatgtgggcggtgaacctggcggcagcgcaaaagatg

SEQ ID NO: 166519 - DNA, 103 bp, Artificial Sequence
  Synthetic Polynucleotide
taatacgactcactatagggtattctgaagctgactcacactatttggtgaacagaggagacaccaaatggtgtgagtcaacctggcggcagcgcaaaagatg

SEQ ID NO: 166520 - DNA, 103 bp, Artificial Sequence
  Synthetic Polynucleotide
taatacgactcactatagggtgctgaatagtattctgaagctgactcacaaacagaggagatgtgagatggcttcagaaaacctggcggcagcgcaaaagatg

SEQ ID NO: 166521 - DNA, 103 bp, Artificial Sequence
  Synthetic Polynucleotide
taatacgactcactatagggtgcttgcagctgctgaatagtattctgaagaacagaggagacttcagatgactattcagaacctggcggcagcgcaaaagatg

SEQ ID NO: 166522 - DNA, 103 bp, Artificial Sequence
  Synthetic Polynucleotide
taatacgactcactatagggtgaaactccctgcttgcagctgctgaatagaacagaggagactattcatgagctgcaagaacctggcggcagcgcaaaagatg

SEQ ID NO: 166523 - DNA, 103 bp, Artificial Sequence
  Synthetic Polynucleotide
taatacgactcactataggggtactgcctgtgaaactccctgcttgcagcaacagaggagagctgcaatgagggagtttaacctggcggcagcgcaaaagatg

SEQ ID NO: 166524 - DNA, 103 bp, Artificial Sequence
  Synthetic Polynucleotide
taatacgactcactataggggccactagcagtactgcctgtgaaactcccaacagaggagagggagtatgacaggcagtaacctggcggcagcgcaaaagatg

SEQ ID NO: 166525 - DNA, 103 bp, Artificial Sequence
  Synthetic Polynucleotide
taatacgactcactatagggttccactgctgccactagcagtactgcctgaacagaggagacaggcaatgctgctagtgaacctggcggcagcgcaaaagatg

SEQ ID NO: 166526 - DNA, 103 bp, Artificial Sequence
  Synthetic Polynucleotide
taatacgactcactatagggaagtcaacacttccactgctgccactagcaaacagaggagatgctagatgcagcagtggaacctggcggcagcgcaaaagatg

SEQ ID NO: 166527 - DNA, 103 bp, Artificial Sequence
  Synthetic Polynucleotide
taatacgactcactatagggttgttggaccaagtcaacacttccactgctaacagaggagaagcagtatgagtgttgacaacctggcggcagcgcaaaagatg

SEQ ID NO: 166528 - DNA, 103 bp, Artificial Sequence
  Synthetic Polynucleotide
taatacgactcactatagggcctctaaaacttgttggaccaagtcaacacaacagaggagagtgttgatgtggtccaacaacctggcggcagcgcaaaagatg

SEQ ID NO: 166529 - DNA, 103 bp, Artificial Sequence
  Synthetic Polynucleotide
taatacgactcactataggggaggtggtaaaggagctgcaagcaccgcccaacagaggagagggcggatgttgcagctcaacctggcggcagcgcaaaagatg

SEQ ID NO: 166530 - DNA, 103 bp, Artificial Sequence
  Synthetic Polynucleotide
taatacgactcactatagggtgctgctgtgcctctaaaacttgttggaccaacagaggagaggtccaatgagttttagaaacctggcggcagcgcaaaagatg

SEQ ID NO: 166531 - DNA, 103 bp, Artificial Sequence
  Synthetic Polynucleotide
taatacgactcactatagggtgaagataactgctgctgtgcctctaaaacaacagaggagagttttaatggcacagcagaacctggcggcagcgcaaaagatg

SEQ ID NO: 166532 - DNA, 103 bp, Artificial Sequence
  Synthetic Polynucleotide
taatacgactcactatagggaaaataaaactgaagataactgctgctgtgaacagaggagacacagcatgagttatcttaacctggcggcagcgcaaaagatg

SEQ ID NO: 166533 - DNA, 103 bp, Artificial Sequence
  Synthetic Polynucleotide
taatacgactcactatagggtctggagcagaaaataaaactgaagataacaacagaggagagttatcatgagttttattaacctggcggcagcgcaaaagatg

SEQ ID NO: 166534 - DNA, 103 bp, Artificial Sequence
  Synthetic Polynucleotide
taatacgactcactatagggctcattaccatctggagcagaaaataaaacaacagaggagagttttaatgtctgctccaaacctggcggcagcgcaaaagatg

SEQ ID NO: 166535 - DNA, 103 bp, Artificial Sequence
  Synthetic Polynucleotide
taatacgactcactatagggcttgaacattctcattaccatctggagcagaacagaggagactgctcatgatggtaatgaacctggcggcagcgcaaaagatg

SEQ ID NO: 166536 - DNA, 103 bp, Artificial Sequence
  Synthetic Polynucleotide
taatacgactcactatagggctaagctgctcttgaacattctcattaccaaacagaggagatggtaaatggaatgttcaaacctggcggcagcgcaaaagatg

SEQ ID NO: 166537 - DNA, 103 bp, Artificial Sequence
  Synthetic Polynucleotide
taatacgactcactatagggaatatctgcactaagctgctcttgaacattaacagaggagaaatgttatggagcagcttaacctggcggcagcgcaaaagatg

SEQ ID NO: 166538 - DNA, 103 bp, Artificial Sequence
  Synthetic Polynucleotide
taatacgactcactatagggcttgttgaaaaatatctgcactaagctgctaacagaggagaagcagcatggtgcagataaacctggcggcagcgcaaaagatg

SEQ ID NO: 166539 - DNA, 103 bp, Artificial Sequence
  Synthetic Polynucleotide
taatacgactcactatagggatttgactgacttgttgaaaaatatctgcaaacagaggagatgcagaatgttttcaacaaacctggcggcagcgcaaaagatg

SEQ ID NO: 166540 - DNA, 103 bp, Artificial Sequence
  Synthetic Polynucleotide
taatacgactcactatagggagggctggaagaggtggtaaaggagctgcaaacagaggagatgcagcatgtttaccaccaacctggcggcagcgcaaaagatg

SEQ ID NO: 166541 - DNA, 103 bp, Artificial Sequence
  Synthetic Polynucleotide
taatacgactcactatagggaccactctgaatttgactgacttgttgaaaaacagaggagatttcaaatggtcagtcaaaacctggcggcagcgcaaaagatg

SEQ ID NO: 166542 - DNA, 103 bp, Artificial Sequence
  Synthetic Polynucleotide
taatacgactcactatagggcagggcttacaccactctgaatttgactgaaacagaggagatcagtcatgttcagagtgaacctggcggcagcgcaaaagatg

SEQ ID NO: 166543 - DNA, 103 bp, Artificial Sequence
  Synthetic Polynucleotide
taatacgactcactataggggaaaacattccagggcttacaccactctgaaacagaggagatcagagatgtgtaagcccaacctggcggcagcgcaaaagatg

SEQ ID NO: 166544 - DNA, 103 bp, Artificial Sequence
  Synthetic Polynucleotide
taatacgactcactatagggctctgttgaggaaaacattccagggcttacaacagaggagagtaagcatgggaatgtttaacctggcggcagcgcaaaagatg

SEQ ID NO: 166545 - DNA, 103 bp, Artificial Sequence
  Synthetic Polynucleotide
taatacgactcactatagggggactgttggctctgttgaggaaaacattcaacagaggagagaatgtatgcctcaacagaacctggcggcagcgcaaaagatg

SEQ ID NO: 166546 - DNA, 103 bp, Artificial Sequence
  Synthetic Polynucleotide
taatacgactcactatagggggtctggtatggactgttggctctgttgagaacagaggagactcaacatggccaacagtaacctggcggcagcgcaaaagatg

SEQ ID NO: 166547 - DNA, 103 bp, Artificial Sequence
  Synthetic Polynucleotide
taatacgactcactatagggtaaattatctggtctggtatggactgttggaacagaggagaccaacaatgcataccagaaacctggcggcagcgcaaaagatg

SEQ ID NO: 166548 - DNA, 103 bp, Artificial Sequence
  Synthetic Polynucleotide
taatacgactcactatagggttccaggtaataaattatctggtctggtataacagaggagaataccaatgcagataattaacctggcggcagcgcaaaagatg

SEQ ID NO: 166549 - DNA, 103 bp, Artificial Sequence
  Synthetic Polynucleotide
taatacgactcactatagggctttcagctcttccaggtaataaattatctaacagaggagaagataaatgattacctggaacctggcggcagcgcaaaagatg

SEQ ID NO: 166550 - DNA, 103 bp, Artificial Sequence
  Synthetic Polynucleotide
taatacgactcactatagggtggatgaacactttcagctcttccaggtaaaacagaggagattacctatgagagctgaaaacctggcggcagcgcaaaagatg

SEQ ID NO: 166551 - DNA, 103 bp, Artificial Sequence
  Synthetic Polynucleotide
taatacgactcactatagggaataaatggtagggctggaagaggtggtaaaacagaggagattaccaatgcttccagccaacctggcggcagcgcaaaagatg

SEQ ID NO: 166552 - DNA, 103 bp, Artificial Sequence
  Synthetic Polynucleotide
taatacgactcactatagggtttcagactgtggatgaacactttcagctcaacagaggagagagctgatggtgttcatcaacctggcggcagcgcaaaagatg

SEQ ID NO: 166553 - DNA, 103 bp, Artificial Sequence
  Synthetic Polynucleotide
taatacgactcactataggggataacgtgttttcagactgtggatgaacaaacagaggagatgttcaatgacagtctgaaacctggcggcagcgcaaaagatg

SEQ ID NO: 166554 - DNA, 103 bp, Artificial Sequence
  Synthetic Polynucleotide
taatacgactcactatagggctgttgattagataacgtgttttcagactgaacagaggagacagtctatgaacacgttaaacctggcggcagcgcaaaagatg

SEQ ID NO: 166555 - DNA, 103 bp, Artificial Sequence
  Synthetic Polynucleotide
taatacgactcactataggggctgctgctgctgttgattagataacgtgtaacagaggagaacacgtatgctaatcaacaacctggcggcagcgcaaaagatg

SEQ ID NO: 166556 - DNA, 103 bp, Artificial Sequence
  Synthetic Polynucleotide
taatacgactcactatagggtgttgctgctgctgctgctgctgttgattaaacagaggagataatcaatggcagcagcaaacctggcggcagcgcaaaagatg

SEQ ID NO: 166557 - DNA, 103 bp, Artificial Sequence
  Synthetic Polynucleotide
taatacgactcactatagggcatcacttgctgttgctgctgctgctgctgaacagaggagacagcagatgcagcagcaaaacctggcggcagcgcaaaagatg

SEQ ID NO: 166558 - DNA, 103 bp, Artificial Sequence
  Synthetic Polynucleotide
taatacgactcactatagggctgaagattccatcacttgctgttgctgctaacagaggagaagcagcatgagcaagtgaaacctggcggcagcgcaaaagatg

SEQ ID NO: 166559 - DNA, 103 bp, Artificial Sequence
  Synthetic Polynucleotide
taatacgactcactatagggaccattgcggctgaagattccatcacttgcaacagaggagagcaagtatgggaatcttcaacctggcggcagcgcaaaagatg

SEQ ID NO: 166560 - DNA, 103 bp, Artificial Sequence
  Synthetic Polynucleotide
taatacgactcactatagggcatctccatcaccattgcggctgaagattcaacagaggagagaatctatggccgcaatgaacctggcggcagcgcaaaagatg

SEQ ID NO: 166561 - DNA, 103 bp, Artificial Sequence
  Synthetic Polynucleotide
taatacgactcactatagggtactctgttgcatctccatcaccattgcggaacagaggagaccgcaaatgtgatggagaaacctggcggcagcgcaaaagatg

SEQ ID NO: 166562 - DNA, 103 bp, Artificial Sequence
  Synthetic Polynucleotide
taatacgactcactatagggactgaggtagaataaatggtagggctggaaaacagaggagattccagatgtaccatttaaacctggcggcagcgcaaaagatg

SEQ ID NO: 166563 - DNA, 103 bp, Artificial Sequence
  Synthetic Polynucleotide
taatacgactcactataggggcctggcagatactctgttgcatctccatcaacagaggagagatggaatggcaacagagaacctggcggcagcgcaaaagatg

SEQ ID NO: 166564 - DNA, 103 bp, Artificial Sequence
  Synthetic Polynucleotide
taatacgactcactatagggctgggcagctgcctggcagatactctgttgaacagaggagacaacagatgatctgccagaacctggcggcagcgcaaaagatg

SEQ ID NO: 166565 - DNA, 103 bp, Artificial Sequence
  Synthetic Polynucleotide
taatacgactcactatagggctgactgaatctgggcagctgcctggcagaaacagaggagatctgccatgcagctgcccaacctggcggcagcgcaaaagatg

SEQ ID NO: 166566 - DNA, 103 bp, Artificial Sequence
  Synthetic Polynucleotide
taatacgactcactataggggggaataactctgactgaatctgggcagctaacagaggagaagctgcatggattcagtcaacctggcggcagcgcaaaagatg

SEQ ID NO: 166567 - DNA, 103 bp, Artificial Sequence
  Synthetic Polynucleotide
taatacgactcactatagggagcagttgaagggaataactctgactgaataacagaggagaattcagatggagttattcaacctggcggcagcgcaaaagatg

SEQ ID NO: 166568 - DNA, 103 bp, Artificial Sequence
  Synthetic Polynucleotide
taatacgactcactatagggcatttgctgaagcagttgaagggaataactaacagaggagaagttatatgcttcaactgaacctggcggcagcgcaaaagatg

SEQ ID NO: 166569 - DNA, 103 bp, Artificial Sequence
  Synthetic Polynucleotide
taatacgactcactatagggtgaaggtttccatttgctgaagcagttgaaaacagaggagattcaacatgttcagcaaaaacctggcggcagcgcaaaagatg

SEQ ID NO: 166570 - DNA, 103 bp, Artificial Sequence
  Synthetic Polynucleotide
taatacgactcactatagggtggcgattgctgaaggtttccatttgctgaaacagaggagatcagcaatgggaaaccttaacctggcggcagcgcaaaagatg

SEQ ID NO: 166571 - DNA, 103 bp, Artificial Sequence
  Synthetic Polynucleotide
taatacgactcactataggggctggtaaactggcgattgctgaaggtttcaacagaggagagaaaccatgagcaatcgcaacctggcggcagcgcaaaagatg

SEQ ID NO: 166572 - DNA, 103 bp, Artificial Sequence
  Synthetic Polynucleotide
taatacgactcactatagggtgagaagtctgctggtaaactggcgattgcaacagaggagagcaatcatgagtttaccaaacctggcggcagcgcaaaagatg

SEQ ID NO: 166573 - DNA, 103 bp, Artificial Sequence
  Synthetic Polynucleotide
taatacgactcactataggggctgtcggtgactgaggtagaataaatggtaacagaggagaaccattatgtctacctcaaacctggcggcagcgcaaaagatg

SEQ ID NO: 166574 - DNA, 103 bp, Artificial Sequence
  Synthetic Polynucleotide
taatacgactcactatagggactcatcatgtgagaagtctgctggtaaacaacagaggagagtttacatgcagacttctaacctggcggcagcgcaaaagatg

SEQ ID NO: 166575 - DNA, 103 bp, Artificial Sequence
  Synthetic Polynucleotide
taatacgactcactatagggtagacaatgcactcatcatgtgagaagtctaacagaggagaagacttatgacatgatgaaacctggcggcagcgcaaaagatg

SEQ ID NO: 166576 - DNA, 103 bp, Artificial Sequence
  Synthetic Polynucleotide
taatacgactcactatagggtcctcattggtagacaatgcactcatcatgaacagaggagacatgatatgtgcattgtcaacctggcggcagcgcaaaagatg

SEQ ID NO: 166577 - DNA, 103 bp, Artificial Sequence
  Synthetic Polynucleotide
taatacgactcactatagggcatttgcatatcctcattggtagacaatgcaacagaggagagcattgatgaccaatgagaacctggcggcagcgcaaaagatg

SEQ ID NO: 166578 - DNA, 103 bp, Artificial Sequence
  Synthetic Polynucleotide
taatacgactcactatagggattcacactgcatttgcatatcctcattggaacagaggagaccaatgatgatatgcaaaaacctggcggcagcgcaaaagatg

SEQ ID NO: 166579 - DNA, 103 bp, Artificial Sequence
  Synthetic Polynucleotide
taatacgactcactataggggaagaaaacaattcacactgcatttgcataaacagaggagatatgcaatggcagtgtgaaacctggcggcagcgcaaaagatg

SEQ ID NO: 166580 - DNA, 103 bp, Artificial Sequence
  Synthetic Polynucleotide
taatacgactcactatagggtgcaggaggagaagaaaacaattcacactgaacagaggagacagtgtatgttgttttctaacctggcggcagcgcaaaagatg

SEQ ID NO: 166581 - DNA, 103 bp, Artificial Sequence
  Synthetic Polynucleotide
taatacgactcactatagggttccagaaactgcaggaggagaagaaaacaaacagaggagatgttttatgctcctcctgaacctggcggcagcgcaaaagatg

SEQ ID NO: 166582 - DNA, 103 bp, Artificial Sequence
  Synthetic Polynucleotide
taatacgactcactataggggaagtttcatttccagaaactgcaggaggaaacagaggagatcctccatgagtttctggaacctggcggcagcgcaaaagatg

SEQ ID NO: 166583 - DNA, 103 bp, Artificial Sequence
  Synthetic Polynucleotide
taatacgactcactatagggggtagttgtagaagtttcatttccagaaacaacagaggagagtttctatgaatgaaactaacctggcggcagcgcaaaagatg

SEQ ID NO: 166584 - DNA, 103 bp, Artificial Sequence
  Synthetic Polynucleotide
taatacgactcactataggggcatagccttgctgtcggtgactgaggtagaacagaggagactacctatgtcaccgacaaacctggcggcagcgcaaaagatg

SEQ ID NO: 166585 - DNA, 103 bp, Artificial Sequence
  Synthetic Polynucleotide
taatacgactcactatagggcctgctgtgtggtagttgtagaagtttcataacagaggagaatgaaaatgctacaactaaacctggcggcagcgcaaaagatg

SEQ ID NO: 166586 - DNA, 103 bp, Artificial Sequence
  Synthetic Polynucleotide
taatacgactcactatagggggggttgcaacctgctgtgtggtagttgtaaacagaggagatacaacatgcacacagcaaacctggcggcagcgcaaaagatg

SEQ ID NO: 166587 - DNA, 103 bp, Artificial Sequence
  Synthetic Polynucleotide
taatacgactcactatagggggtagtgccaggggttgcaacctgctgtgtaacagaggagaacacagatggttgcaaccaacctggcggcagcgcaaaagatg

SEQ ID NO: 166588 - DNA, 103 bp, Artificial Sequence
  Synthetic Polynucleotide
taatacgactcactatagggtctgaaacatggtagtgccaggggttgcaaaacagaggagattgcaaatgctggcactaaacctggcggcagcgcaaaagatg

SEQ ID NO: 166589 - DNA, 103 bp, Artificial Sequence
  Synthetic Polynucleotide
taatacgactcactataggggaacttgatgtctgaaacatggtagtgccaaacagaggagatggcacatgcatgtttcaaacctggcggcagcgcaaaagatg

SEQ ID NO: 166590 - DNA, 103 bp, Artificial Sequence
  Synthetic Polynucleotide
taatacgactcactatagggtccatctcctgaacttgatgtctgaaacataacagaggagaatgtttatgacatcaagtaacctggcggcagcgcaaaagatg

SEQ ID NO: 166591 - DNA, 103 bp, Artificial Sequence
  Synthetic Polynucleotide
taatacgactcactatagggcagtttcttctccatctcctgaacttgatgaacagaggagacatcaaatgcaggagatgaacctggcggcagcgcaaaagatg

SEQ ID NO: 166592 - DNA, 103 bp, Artificial Sequence
  Synthetic Polynucleotide
taatacgactcactataggggcttgtgttccagtttcttctccatctcctaacagaggagaaggagaatgagaagaaacaacctggcggcagcgcaaaagatg

SEQ ID NO: 166593 - DNA, 103 bp, Artificial Sequence
  Synthetic Polynucleotide
taatacgactcactatagggaatctgttttgcttgtgttccagtttcttcaacagaggagagaagaaatgggaacacaaaacctggcggcagcgcaaaagatg

SEQ ID NO: 166594 - DNA, 103 bp, Artificial Sequence
  Synthetic Polynucleotide
taatacgactcactatagggcactgttctgaatctgttttgcttgtgttcaacagaggagagaacacatgcaaaacagaaacctggcggcagcgcaaaagatg

SEQ ID NO: 166595 - DNA, 103 bp, Artificial Sequence
  Synthetic Polynucleotide
taatacgactcactataggggattccaggtctaggtccgcgctgagcaataacagaggagaattgctatgcgcggacctaacctggcggcagcgcaaaagatg

SEQ ID NO: 166596 - DNA, 103 bp, Artificial Sequence
  Synthetic Polynucleotide
taatacgactcactatagggctctccacttgcatagccttgctgtcggtgaacagaggagacaccgaatgcaaggctataacctggcggcagcgcaaaagatg

SEQ ID NO: 166597 - DNA, 103 bp, Artificial Sequence
  Synthetic Polynucleotide
taatacgactcactataggggtctgaaagacactgttctgaatctgttttaacagaggagaaaaacaatgtcagaacagaacctggcggcagcgcaaaagatg

SEQ ID NO: 166598 - DNA, 103 bp, Artificial Sequence
  Synthetic Polynucleotide
taatacgactcactatagggttggaccatggtctgaaagacactgttctgaacagaggagacagaacatggtctttcagaacctggcggcagcgcaaaagatg

SEQ ID NO: 166599 - DNA, 103 bp, Artificial Sequence
  Synthetic Polynucleotide
taatacgactcactatagggtatgttgcatttggaccatggtctgaaagaaacagaggagatctttcatgccatggtccaacctggcggcagcgcaaaagatg

SEQ ID NO: 166600 - DNA, 103 bp, Artificial Sequence
  Synthetic Polynucleotide
taatacgactcactatagggttgtccccactatgttgcatttggaccatgaacagaggagacatggtatgaatgcaacaaacctggcggcagcgcaaaagatg

SEQ ID NO: 166601 - DNA, 103 bp, Artificial Sequence
  Synthetic Polynucleotide
taatacgactcactatagggttgaggttgattgtccccactatgttgcataacagaggagaatgcaaatgagtggggacaacctggcggcagcgcaaaagatg

SEQ ID NO: 166602 - DNA, 103 bp, Artificial Sequence
  Synthetic Polynucleotide
taatacgactcactatagggaaaggttaacttgaggttgattgtccccacaacagaggagagtggggatgatcaacctcaacctggcggcagcgcaaaagatg

SEQ ID NO: 166603 - DNA, 103 bp, Artificial Sequence
  Synthetic Polynucleotide
taatacgactcactataggggtggatgaaaaaaggttaacttgaggttgaaacagaggagatcaaccatgagttaacctaacctggcggcagcgcaaaagatg

SEQ ID NO: 166604 - DNA, 103 bp, Artificial Sequence
  Synthetic Polynucleotide
taatacgactcactatagggcatactttttgtggatgaaaaaaggttaacaacagaggagagttaacatgttttcatccaacctggcggcagcgcaaaagatg

SEQ ID NO: 166605 - DNA, 103 bp, Artificial Sequence
  Synthetic Polynucleotide
taatacgactcactataggggaacactcatcatactttttgtggatgaaaaacagaggagatttcatatgcaaaaagtaaacctggcggcagcgcaaaagatg

SEQ ID NO: 166606 - DNA, 103 bp, Artificial Sequence
  Synthetic Polynucleotide
taatacgactcactatagggccactattctgaacactcatcatactttttaacagaggagaaaaaagatggatgagtgtaacctggcggcagcgcaaaagatg

SEQ ID NO: 166607 - DNA, 103 bp, Artificial Sequence
  Synthetic Polynucleotide
taatacgactcactatagggtgaggagcagctctccacttgcatagccttaacagaggagaaaggctatgcaagtggagaacctggcggcagcgcaaaagatg

SEQ ID NO: 166608 - DNA, 103 bp, Artificial Sequence
  Synthetic Polynucleotide
taatacgactcactatagggttgttgggtaccactattctgaacactcataacagaggagaatgagtatgcagaatagtaacctggcggcagcgcaaaagatg

SEQ ID NO: 166609 - DNA, 103 bp, Artificial Sequence
  Synthetic Polynucleotide
taatacgactcactatagggcattaccttgttgttgggtaccactattctaacagaggagaagaataatggtacccaacaacctggcggcagcgcaaaagatg

SEQ ID NO: 166610 - DNA, 103 bp, Artificial Sequence
  Synthetic Polynucleotide
taatacgactcactatagggtggaataaaccattaccttgttgttgggtaaacagaggagatacccaatgacaaggtaaaacctggcggcagcgcaaaagatg

SEQ ID NO: 166611 - DNA, 103 bp, Artificial Sequence
  Synthetic Polynucleotide
taatacgactcactatagggattcccttgctggaataaaccattaccttgaacagaggagacaaggtatgggtttattcaacctggcggcagcgcaaaagatg

SEQ ID NO: 166612 - DNA, 103 bp, Artificial Sequence
  Synthetic Polynucleotide
taatacgactcactatagggacatcatctcattcccttgctggaataaacaacagaggagagtttatatgagcaagggaaacctggcggcagcgcaaaagatg

SEQ ID NO: 166613 - DNA, 103 bp, Artificial Sequence
  Synthetic Polynucleotide
taatacgactcactataggggattgaagtgacatcatctcattcccttgcaacagaggagagcaaggatgtgagatgataacctggcggcagcgcaaaagatg

SEQ ID NO: 166614 - DNA, 103 bp, Artificial Sequence
  Synthetic Polynucleotide
taatacgactcactatagggaaaatttccagattgaagtgacatcatctcaacagaggagagagatgatgtcacttcaaaacctggcggcagcgcaaaagatg

SEQ ID NO: 166615 - DNA, 103 bp, Artificial Sequence
  Synthetic Polynucleotide
taatacgactcactatagggactgctgcaaaaaatttccagattgaagtgaacagaggagacacttcatgctggaaattaacctggcggcagcgcaaaagatg

SEQ ID NO: 166616 - DNA, 103 bp, Artificial Sequence
  Synthetic Polynucleotide
taatacgactcactataggggaatgagaagactgctgcaaaaaatttccaaacagaggagatggaaaatgtttgcagcaaacctggcggcagcgcaaaagatg

SEQ ID NO: 166617 - DNA, 103 bp, Artificial Sequence
  Synthetic Polynucleotide
taatacgactcactatagggttgggcctgtgaatgagaagactgctgcaaaacagaggagattgcagatgtcttctcataacctggcggcagcgcaaaagatg

SEQ ID NO: 166618 - DNA, 103 bp, Artificial Sequence
  Synthetic Polynucleotide
taatacgactcactatagggcccccacggctgaggagcagctctccacttaacagaggagaaagtggatggctgctcctaacctggcggcagcgcaaaagatg

SEQ ID NO: 166619 - DNA, 103 bp, Artificial Sequence
  Synthetic Polynucleotide
taatacgactcactataggggatgaaaaagttgggcctgtgaatgagaagaacagaggagacttctcatgcacaggcccaacctggcggcagcgcaaaagatg

SEQ ID NO: 166620 - DNA, 103 bp, Artificial Sequence
  Synthetic Polynucleotide
taatacgactcactatagggggattttgaggatgaaaaagttgggcctgtaacagaggagaacaggcatgactttttcaaacctggcggcagcgcaaaagatg

SEQ ID NO: 166621 - DNA, 103 bp, Artificial Sequence
  Synthetic Polynucleotide
taatacgactcactatagggatcggcaataggattttgaggatgaaaaagaacagaggagactttttatgcctcaaaataacctggcggcagcgcaaaagatg

SEQ ID NO: 166622 - DNA, 103 bp, Artificial Sequence
  Synthetic Polynucleotide
taatacgactcactatagggggttctgagcatcggcaataggattttgagaacagaggagactcaaaatgctattgccgaacctggcggcagcgcaaaagatg

SEQ ID NO: 166623 - DNA, 103 bp, Artificial Sequence
  Synthetic Polynucleotide
taatacgactcactatagggtcctgggaaaggttctgagcatcggcaataaacagaggagatattgcatgtgctcagaaaacctggcggcagcgcaaaagatg

SEQ ID NO: 166624 - DNA, 103 bp, Artificial Sequence
  Synthetic Polynucleotide
taatacgactcactatagggaccttgagtttcctgggaaaggttctgagcaacagaggagagctcagatgctttcccagaacctggcggcagcgcaaaagatg

SEQ ID NO: 166625 - DNA, 103 bp, Artificial Sequence
  Synthetic Polynucleotide
taatacgactcactataggggaaagagagaaccttgagtttcctgggaaaaacagaggagatttcccatgaaactcaagaacctggcggcagcgcaaaagatg

SEQ ID NO: 166626 - DNA, 103 bp, Artificial Sequence
  Synthetic Polynucleotide
taatacgactcactatagggtttggactatgaaagagagaaccttgagttaacagaggagaaactcaatgttctctcttaacctggcggcagcgcaaaagatg

SEQ ID NO: 166627 - DNA, 103 bp, Artificial Sequence
  Synthetic Polynucleotide
taatacgactcactataggggacaataggatttggactatgaaagagagaaacagaggagatctctcatgcatagtccaaacctggcggcagcgcaaaagatg

SEQ ID NO: 166628 - DNA, 103 bp, Artificial Sequence
  Synthetic Polynucleotide
taatacgactcactatagggtctgactgtggacaataggatttggactataacagaggagaatagtcatgatcctattgaacctggcggcagcgcaaaagatg

SEQ ID NO: 166629 - DNA, 103 bp, Artificial Sequence
  Synthetic Polynucleotide
taatacgactcactatagggctgttacttacccccacggctgaggagcagaacagaggagactgctcatgagccgtgggaacctggcggcagcgcaaaagatg

SEQ ID NO: 166630 - DNA, 103 bp, Artificial Sequence
  Synthetic Polynucleotide
taatacgactcactataggggttgtagaagtctgactgtggacaataggaaacagaggagatcctatatgccacagtcaaacctggcggcagcgcaaaagatg

SEQ ID NO: 166631 - DNA, 103 bp, Artificial Sequence
  Synthetic Polynucleotide
taatacgactcactatagggttcagaggaggttgtagaagtctgactgtgaacagaggagacacagtatgacttctacaaacctggcggcagcgcaaaagatg

SEQ ID NO: 166632 - DNA, 103 bp, Artificial Sequence
  Synthetic Polynucleotide
taatacgactcactataggggctgcatttgttcagaggaggttgtagaagaacagaggagacttctaatgcctcctctgaacctggcggcagcgcaaaagatg

SEQ ID NO: 166633 - DNA, 103 bp, Artificial Sequence
  Synthetic Polynucleotide
taatacgactcactatagggaacattggaggctgcatttgttcagaggagaacagaggagactcctcatgacaaatgcaaacctggcggcagcgcaaaagatg

SEQ ID NO: 166634 - DNA, 103 bp, Artificial Sequence
  Synthetic Polynucleotide
taatacgactcactatagggttgagagtgaaacattggaggctgcatttgaacagaggagacaaatgatgcctccaatgaacctggcggcagcgcaaaagatg

SEQ ID NO: 166635 - DNA, 103 bp, Artificial Sequence
  Synthetic Polynucleotide
taatacgactcactatagggcaatggtactttgagagtgaaacattggagaacagaggagactccaaatgttcactctcaacctggcggcagcgcaaaagatg

SEQ ID NO: 166636 - DNA, 103 bp, Artificial Sequence
  Synthetic Polynucleotide
taatacgactcactatagggtgtaacacagcaatggtactttgagagtgaaacagaggagatcactcatgaagtaccataacctggcggcagcgcaaaagatg

SEQ ID NO: 166637 - DNA, 103 bp, Artificial Sequence
  Synthetic Polynucleotide
taatacgactcactatagggtgaagagccctgtaacacagcaatggtactaacagaggagaagtaccatggctgtgttaaacctggcggcagcgcaaaagatg

SEQ ID NO: 166638 - DNA, 103 bp, Artificial Sequence
  Synthetic Polynucleotide
taatacgactcactatagggcttgaggaactgaagagccctgtaacacagaacagaggagactgtgtatgagggctcttaacctggcggcagcgcaaaagatg

SEQ ID NO: 166639 - DNA, 103 bp, Artificial Sequence
  Synthetic Polynucleotide
taatacgactcactataggggactgctggtcttgaggaactgaagagcccaacagaggagagggctcatgagttcctcaaacctggcggcagcgcaaaagatg

SEQ ID NO: 166640 - DNA, 103 bp, Artificial Sequence
  Synthetic Polynucleotide
taatacgactcactatagggacttacccctctgttacttacccccacggcaacagaggagagccgtgatggtaagtaacaacctggcggcagcgcaaaagatg

SEQ ID NO: 166641 - DNA, 103 bp, Artificial Sequence
  Synthetic Polynucleotide
taatacgactcactatagggtatgttggttgactgctggtcttgaggaacaacagaggagagttcctatggaccagcagaacctggcggcagcgcaaaagatg

SEQ ID NO: 166642 - DNA, 103 bp, Artificial Sequence
  Synthetic Polynucleotide
taatacgactcactataggggggaaagaaatatgttggttgactgctggtaacagaggagaaccagcatgcaaccaacaaacctggcggcagcgcaaaagatg

SEQ ID NO: 166643 - DNA, 103 bp, Artificial Sequence
  Synthetic Polynucleotide
taatacgactcactatagggatgggactctgggaaagaaatatgttggttaacagaggagaaaccaaatgatttctttcaacctggcggcagcgcaaaagatg

SEQ ID NO: 166644 - DNA, 103 bp, Artificial Sequence
  Synthetic Polynucleotide
taatacgactcactatagggaagattattcatgggactctgggaaagaaaaacagaggagatttcttatgcagagtcccaacctggcggcagcgcaaaagatg

SEQ ID NO: 166645 - DNA, 103 bp, Artificial Sequence
  Synthetic Polynucleotide
taatacgactcactatagggtgttagtctgaagattattcatgggactctaacagaggagaagagtcatgtgaataatcaacctggcggcagcgcaaaagatg

SEQ ID NO: 166646 - DNA, 103 bp, Artificial Sequence
  Synthetic Polynucleotide
taatacgactcactatagggtgggctactgtgttagtctgaagattattcaacagaggagagaataaatgtcagactaaaacctggcggcagcgcaaaagatg

SEQ ID NO: 166647 - DNA, 103 bp, Artificial Sequence
  Synthetic Polynucleotide
taatacgactcactatagggaaatgcttcttgggctactgtgttagtctgaacagaggagacagactatgacagtagccaacctggcggcagcgcaaaagatg

SEQ ID NO: 166648 - DNA, 103 bp, Artificial Sequence
  Synthetic Polynucleotide
taatacgactcactataggggtgctgcaaaaaatgcttcttgggctactgaacagaggagacagtagatgaagaagcataacctggcggcagcgcaaaagatg

SEQ ID NO: 166649 - DNA, 103 bp, Artificial Sequence
  Synthetic Polynucleotide
taatacgactcactatagggattgagttcggtgctgcaaaaaatgcttctaacagaggagaagaagcatgttttgcagcaacctggcggcagcgcaaaagatg

SEQ ID NO: 166650 - DNA, 103 bp, Artificial Sequence
  Synthetic Polynucleotide
taatacgactcactatagggaagtggagaaattgagttcggtgctgcaaaaacagaggagatttgcaatgccgaactcaaacctggcggcagcgcaaaagatg

SEQ ID NO: 166651 - DNA, 103 bp, Artificial Sequence
  Synthetic Polynucleotide
taatacgactcactatagggactgcttttcacttacccctctgttacttaaacagaggagataagtaatggaggggtaaaacctggcggcagcgcaaaagatg

SEQ ID NO: 166652 - DNA, 103 bp, Artificial Sequence
  Synthetic Polynucleotide
taatacgactcactatagggatgttgactgaagtggagaaattgagttcgaacagaggagacgaactatgtttctccacaacctggcggcagcgcaaaagatg

SEQ ID NO: 166653 - DNA, 103 bp, Artificial Sequence
  Synthetic Polynucleotide
taatacgactcactatagggtcactgtttgatgttgactgaagtggagaaaacagaggagattctccatgtcagtcaacaacctggcggcagcgcaaaagatg

SEQ ID NO: 166654 - DNA, 103 bp, Artificial Sequence
  Synthetic Polynucleotide
taatacgactcactatagggagcttgttgttcactgtttgatgttgactgaacagaggagacagtcaatgtcaaacagtaacctggcggcagcgcaaaagatg

SEQ ID NO: 166655 - DNA, 103 bp, Artificial Sequence
  Synthetic Polynucleotide
taatacgactcactataggggttggaaagcagcttgttgttcactgtttgaacagaggagacaaacaatgaacaacaagaacctggcggcagcgcaaaagatg

SEQ ID NO: 166656 - DNA, 103 bp, Artificial Sequence
  Synthetic Polynucleotide
taatacgactcactatagggggagcttgctgttggaaagcagcttgttgtaacagaggagaacaacaatgtgctttccaaacctggcggcagcgcaaaagatg

SEQ ID NO: 166657 - DNA, 103 bp, Artificial Sequence
  Synthetic Polynucleotide
taatacgactcactataggggtgtgatattggagcttgctgttggaaagcaacagaggagagctttcatgcagcaagctaacctggcggcagcgcaaaagatg

SEQ ID NO: 166658 - DNA, 103 bp, Artificial Sequence
  Synthetic Polynucleotide
taatacgactcactataggggagtctggatgtgtgatattggagcttgctaacagaggagaagcaagatgcaatatcacaacctggcggcagcgcaaaagatg

SEQ ID NO: 166659 - DNA, 103 bp, Artificial Sequence
  Synthetic Polynucleotide
taatacgactcactataggggaaagcataggagtctggatgtgtgatattaacagaggagaaatatcatgcatccagacaacctggcggcagcgcaaaagatg

SEQ ID NO: 166660 - DNA, 103 bp, Artificial Sequence
  Synthetic Polynucleotide
taatacgactcactatagggctgttcttgggaaagcataggagtctggataacagaggagaatccagatgcctatgcttaacctggcggcagcgcaaaagatg

SEQ ID NO: 166661 - DNA, 103 bp, Artificial Sequence
  Synthetic Polynucleotide
taatacgactcactatagggggggttgtgcctgttcttgggaaagcatagaacagaggagactatgcatgcccaagaacaacctggcggcagcgcaaaagatg

SEQ ID NO: 166662 - DNA, 103 bp, Artificial Sequence
  Synthetic Polynucleotide
taatacgactcactatagggttactggttaactgcttttcacttacccctaacagaggagaaggggtatgtgaaaagcaaacctggcggcagcgcaaaagatg

SEQ ID NO: 166663 - DNA, 103 bp, Artificial Sequence
  Synthetic Polynucleotide
taatacgactcactatagggccctgctgcgggggttgtgcctgttcttggaacagaggagaccaagaatgggcacaaccaacctggcggcagcgcaaaagatg

SEQ ID NO: 166664 - DNA, 103 bp, Artificial Sequence
  Synthetic Polynucleotide
taatacgactcactatagggctgaaataaaccctgctgcgggggttgtgcaacagaggagagcacaaatgccgcagcagaacctggcggcagcgcaaaagatg

SEQ ID NO: 166665 - DNA, 103 bp, Artificial Sequence
  Synthetic Polynucleotide
taatacgactcactatagggccacctgaggctgaaataaaccctgctgcgaacagaggagacgcagcatggtttatttcaacctggcggcagcgcaaaagatg

SEQ ID NO: 166666 - DNA, 103 bp, Artificial Sequence
  Synthetic Polynucleotide
taatacgactcactataggggagcccagggccacctgaggctgaaataaaaacagaggagatttattatggcctcaggtaacctggcggcagcgcaaaagatg

SEQ ID NO: 166667 - DNA, 103 bp, Artificial Sequence
  Synthetic Polynucleotide
taatacgactcactatagggaggtggaagggagcccagggccacctgaggaacagaggagacctcagatggccctgggcaacctggcggcagcgcaaaagatg

SEQ ID NO: 166668 - DNA, 103 bp, Artificial Sequence
  Synthetic Polynucleotide
taatacgactcactataggggcattggattaggtggaagggagcccagggaacagaggagaccctggatgcccttccacaacctggcggcagcgcaaaagatg

SEQ ID NO: 166669 - DNA, 103 bp, Artificial Sequence
  Synthetic Polynucleotide
taatacgactcactatagggtggctttgaggcattggattaggtggaaggaacagaggagaccttccatgtaatccaataacctggcggcagcgcaaaagatg

SEQ ID NO: 166670 - DNA, 103 bp, Artificial Sequence
  Synthetic Polynucleotide
taatacgactcactatagggggttccttgttggctttgaggcattggattaacagaggagaaatccaatgcctcaaagcaacctggcggcagcgcaaaagatg

SEQ ID NO: 166671 - DNA, 103 bp, Artificial Sequence
  Synthetic Polynucleotide
taatacgactcactatagggactggaacatggttccttgttggctttgagaacagaggagactcaaaatgaacaaggaaaacctggcggcagcgcaaaagatg

SEQ ID NO: 166672 - DNA, 103 bp, Artificial Sequence
  Synthetic Polynucleotide
taatacgactcactataggggagtgctgtgactggaacatggttccttgtaacagaggagaacaaggatgcatgttccaaacctggcggcagcgcaaaagatg

SEQ ID NO: 166673 - DNA, 103 bp, Artificial Sequence
  Synthetic Polynucleotide
taatacgactcactatagggctgaactgtgttactggttaactgcttttcaacagaggagagaaaagatgttaaccagtaacctggcggcagcgcaaaagatg

SEQ ID NO: 166674 - DNA, 103 bp, Artificial Sequence
  Synthetic Polynucleotide
taatacgactcactatagggggcaactattgagtgctgtgactggaacataacagaggagaatgttcatgtcacagcacaacctggcggcagcgcaaaagatg

SEQ ID NO: 166675 - DNA, 103 bp, Artificial Sequence
  Synthetic Polynucleotide
taatacgactcactatagggtactctgcatggcaactattgagtgctgtgaacagaggagacacagcatgcaatagttgaacctggcggcagcgcaaaagatg

SEQ ID NO: 166676 - DNA, 103 bp, Artificial Sequence
  Synthetic Polynucleotide
taatacgactcactataggggatggagagttactctgcatggcaactattaacagaggagaaatagtatgcatgcagagaacctggcggcagcgcaaaagatg

SEQ ID NO: 166677 - DNA, 103 bp, Artificial Sequence
  Synthetic Polynucleotide
taatacgactcactatagggctgttcctgggatggagagttactctgcataacagaggagaatgcagatgaactctccaaacctggcggcagcgcaaaagatg

SEQ ID NO: 166678 - DNA, 103 bp, Artificial Sequence
  Synthetic Polynucleotide
taatacgactcactataggggctgctgctgctgttcctgggatggagagtaacagaggagaactctcatgcccaggaacaacctggcggcagcgcaaaagatg

SEQ ID NO: 166679 - DNA, 103 bp, Artificial Sequence
  Synthetic Polynucleotide
taatacgactcactatagggtgctgttgctgctgctgctgctgttcctggaacagaggagaccaggaatggcagcagcaaacctggcggcagcgcaaaagatg

SEQ ID NO: 166680 - DNA, 103 bp, Artificial Sequence
  Synthetic Polynucleotide
taatacgactcactatagggctgttgctgctgctgttgctgctgctgctgaacagaggagacagcagatgcagcaacagaacctggcggcagcgcaaaagatg

SEQ ID NO: 166681 - DNA, 103 bp, Artificial Sequence
  Synthetic Polynucleotide
taatacgactcactataggggttgctgctgctgttgctgctgctgttgctaacagaggagaagcaacatgagcagcaacaacctggcggcagcgcaaaagatg

SEQ ID NO: 166682 - DNA, 103 bp, Artificial Sequence
  Synthetic Polynucleotide
taatacgactcactatagggctctgttgttgttgctgctgctgttgctgcaacagaggagagcagcaatggcagcagcaaacctggcggcagcgcaaaagatg

SEQ ID NO: 166683 - DNA, 103 bp, Artificial Sequence
  Synthetic Polynucleotide
taatacgactcactataggggaataaaatgctctgttgttgttgctgctgaacagaggagacagcagatgcaacaacagaacctggcggcagcgcaaaagatg

SEQ ID NO: 166684 - DNA, 103 bp, Artificial Sequence
  Synthetic Polynucleotide
taatacgactcactatagggatggatgctgctgaactgtgttactggttaaacagaggagataaccaatgacacagttcaacctggcggcagcgcaaaagatg

SEQ ID NO: 166685 - DNA, 103 bp, Artificial Sequence
  Synthetic Polynucleotide
taatacgactcactatagggtctgattactgaataaaatgctctgttgttaacagaggagaaacaacatggcattttataacctggcggcagcgcaaaagatg

SEQ ID NO: 166686 - DNA, 103 bp, Artificial Sequence
  Synthetic Polynucleotide
taatacgactcactataggggccatggtattctgattactgaataaaatgaacagaggagacattttatgcagtaatcaaacctggcggcagcgcaaaagatg

SEQ ID NO: 166687 - DNA, 103 bp, Artificial Sequence
  Synthetic Polynucleotide
taatacgactcactatagggcgccattgtagccatggtattctgattactaacagaggagaagtaatatgaataccatgaacctggcggcagcgcaaaagatg

SEQ ID NO: 166688 - DNA, 103 bp, Artificial Sequence
  Synthetic Polynucleotide
taatacgactcactataggggctttggagacgccattgtagccatggtataacagaggagaataccaatgctacaatggaacctggcggcagcgcaaaagatg

SEQ ID NO: 166689 - DNA, 103 bp, Artificial Sequence
  Synthetic Polynucleotide
taatacgactcactatagggggtggtggttgctttggagacgccattgtaaacagaggagatacaatatggtctccaaaaacctggcggcagcgcaaaagatg

SEQ ID NO: 166690 - DNA, 103 bp, Artificial Sequence
  Synthetic Polynucleotide
taatacgactcactatagggtatcatgtttggtggtggttgctttggagaaacagaggagatctccaatgcaaccaccaaacctggcggcagcgcaaaagatg

SEQ ID NO: 166691 - DNA, 103 bp, Artificial Sequence
  Synthetic Polynucleotide
taatacgactcactatagggttgggttgaatatcatgtttggtggtggttaacagaggagaaaccacatgcaaacatgaaacctggcggcagcgcaaaagatg

SEQ ID NO: 166692 - DNA, 103 bp, Artificial Sequence
  Synthetic Polynucleotide
taatacgactcactatagggggattttgatttgggttgaatatcatgtttaacagaggagaaaacatatgattcaacccaacctggcggcagcgcaaaagatg

SEQ ID NO: 166693 - DNA, 103 bp, Artificial Sequence
  Synthetic Polynucleotide
taatacgactcactatagggattagccattggattttgatttgggttgaaaacagaggagattcaacatgaatcaaaataacctggcggcagcgcaaaagatg

SEQ ID NO: 166694 - DNA, 103 bp, Artificial Sequence
  Synthetic Polynucleotide
taatacgactcactataggggttgctcctgattagccattggattttgataacagaggagaatcaaaatgcaatggctaaacctggcggcagcgcaaaagatg

SEQ ID NO: 166695 - DNA, 103 bp, Artificial Sequence
  Synthetic Polynucleotide
taatacgactcactatagggttcggtgttgatggatgctgctgaactgtgaacagaggagacacagtatggcagcatccaacctggcggcagcgcaaaagatg

SEQ ID NO: 166696 - DNA, 103 bp, Artificial Sequence
  Synthetic Polynucleotide
taatacgactcactataggggactggttctgttgctcctgattagccattaacagaggagaaatggcatgtcaggagcaaacctggcggcagcgcaaaagatg

SEQ ID NO: 166697 - DNA, 103 bp, Artificial Sequence
  Synthetic Polynucleotide
taatacgactcactataggggtgaaaaattgactggttctgttgctcctgaacagaggagacaggagatgcagaaccagaacctggcggcagcgcaaaagatg

SEQ ID NO: 166698 - DNA, 103 bp, Artificial Sequence
  Synthetic Polynucleotide
taatacgactcactatagggtactttgttggtgaaaaattgactggttctaacagaggagaagaaccatgcaatttttcaacctggcggcagcgcaaaagatg

SEQ ID NO: 166699 - DNA, 103 bp, Artificial Sequence
  Synthetic Polynucleotide
taatacgactcactatagggggggccatgttactttgttggtgaaaaattaacagaggagaaattttatgccaacaaagaacctggcggcagcgcaaaagatg

SEQ ID NO: 166700 - DNA, 103 bp, Artificial Sequence
  Synthetic Polynucleotide
taatacgactcactatagggttgattcattggggccatgttactttgttgaacagaggagacaacaaatgaacatggccaacctggcggcagcgcaaaagatg

SEQ ID NO: 166701 - DNA, 103 bp, Artificial Sequence
  Synthetic Polynucleotide
taatacgactcactataggggctgttgctcttgattcattggggccatgtaacagaggagaacatggatgcaatgaatcaacctggcggcagcgcaaaagatg

SEQ ID NO: 166702 - DNA, 103 bp, Artificial Sequence
  Synthetic Polynucleotide
taatacgactcactatagggaattgcatgggctgttgctcttgattcattaacagaggagaaatgaaatgagagcaacaaacctggcggcagcgcaaaagatg

SEQ ID NO: 166703 - DNA, 103 bp, Artificial Sequence
  Synthetic Polynucleotide
taatacgactcactatagggctgactctgaaattgcatgggctgttgctcaacagaggagagagcaaatgcccatgcaaaacctggcggcagcgcaaaagatg

SEQ ID NO: 166704 - DNA, 103 bp, Artificial Sequence
  Synthetic Polynucleotide
taatacgactcactatagggaaactgtggactgactctgaaattgcatggaacagaggagaccatgcatgttcagagtcaacctggcggcagcgcaaaagatg

SEQ ID NO: 166705 - DNA, 103 bp, Artificial Sequence
  Synthetic Polynucleotide
taatacgactcactatagggtgaagtgaggaaactgtggactgactctgaaacagaggagatcagagatggtccacagtaacctggcggcagcgcaaaagatg

SEQ ID NO: 166706 - DNA, 103 bp, Artificial Sequence
  Synthetic Polynucleotide
taatacgactcactatagggggacttgggcgattccaggtctaggtccgcaacagaggagagcggacatggacctggaaaacctggcggcagcgcaaaagatg

SEQ ID NO: 166707 - DNA, 103 bp, Artificial Sequence
  Synthetic Polynucleotide
taatacgactcactatagggtgtgtgcctcttcggtgttgatggatgctgaacagaggagacagcatatgtcaacaccgaacctggcggcagcgcaaaagatg

SEQ ID NO: 166708 - DNA, 103 bp, Artificial Sequence
  Synthetic Polynucleotide
taatacgactcactatagggacctgggttctgaagtgaggaaactgtggaaacagaggagatccacaatgtcctcacttaacctggcggcagcgcaaaagatg

SEQ ID NO: 166709 - DNA, 103 bp, Artificial Sequence
  Synthetic Polynucleotide
taatacgactcactatagggactgggtaggacctgggttctgaagtgaggaacagaggagacctcacatgagaacccagaacctggcggcagcgcaaaagatg

SEQ ID NO: 166710 - DNA, 103 bp, Artificial Sequence
  Synthetic Polynucleotide
taatacgactcactataggggatgattccgactgggtaggacctgggttcaacagaggagagaacccatgtcctacccaaacctggcggcagcgcaaaagatg

SEQ ID NO: 166711 - DNA, 103 bp, Artificial Sequence
  Synthetic Polynucleotide
taatacgactcactataggggggggtctgtgatgattccgactgggtaggaacagaggagacctaccatgtcggaatcaaacctggcggcagcgcaaaagatg

SEQ ID NO: 166712 - DNA, 103 bp, Artificial Sequence
  Synthetic Polynucleotide
taatacgactcactatagggtatggaacaagggggtctgtgatgattccgaacagaggagacggaatatgcacagacccaacctggcggcagcgcaaaagatg

SEQ ID NO: 166713 - DNA, 103 bp, Artificial Sequence
  Synthetic Polynucleotide
taatacgactcactatagggtgaggagagctatggaacaagggggtctgtaacagaggagaacagacatgcttgttccaaacctggcggcagcgcaaaagatg

SEQ ID NO: 166714 - DNA, 103 bp, Artificial Sequence
  Synthetic Polynucleotide
taatacgactcactatagggcaactgaatctgaggagagctatggaacaaaacagaggagattgttcatgagctctcctaacctggcggcagcgcaaaagatg

SEQ ID NO: 166715 - DNA, 103 bp, Artificial Sequence
  Synthetic Polynucleotide
taatacgactcactatagggacccttgtaccaactgaatctgaggagagcaacagaggagagctctcatgagattcagtaacctggcggcagcgcaaaagatg

SEQ ID NO: 166716 - DNA, 103 bp, Artificial Sequence
  Synthetic Polynucleotide
taatacgactcactataggggaactaggtgacccttgtaccaactgaatcaacagaggagagattcaatgggtacaaggaacctggcggcagcgcaaaagatg

SEQ ID NO: 166717 - DNA, 103 bp, Artificial Sequence
  Synthetic Polynucleotide
taatacgactcactatagggctgctcttgagaactaggtgacccttgtacaacagaggagagtacaaatgtcacctagtaacctggcggcagcgcaaaagatg

SEQ ID NO: 166718 - DNA, 103 bp, Artificial Sequence
  Synthetic Polynucleotide
taatacgactcactatagggtgtacaagactgtgtgcctcttcggtgttgaacagaggagacaacacatgagaggcacaaacctggcggcagcgcaaaagatg

SEQ ID NO: 166719 - DNA, 103 bp, Artificial Sequence
  Synthetic Polynucleotide
taatacgactcactataggggagttacttgctgctcttgagaactaggtgaacagaggagacacctaatgctcaagagcaacctggcggcagcgcaaaagatg

SEQ ID NO: 166720 - DNA, 103 bp, Artificial Sequence
  Synthetic Polynucleotide
taatacgactcactataggggataagaagagagttacttgctgctcttgaaacagaggagatcaagaatggcaagtaacaacctggcggcagcgcaaaagatg

SEQ ID NO: 166721 - DNA, 103 bp, Artificial Sequence
  Synthetic Polynucleotide
taatacgactcactatagggggatgctggagataagaagagagttacttgaacagaggagacaagtaatgctcttcttaaacctggcggcagcgcaaaagatg

SEQ ID NO: 166722 - DNA, 103 bp, Artificial Sequence
  Synthetic Polynucleotide
taatacgactcactatagggaggcagacatggatgctggagataagaagaaacagaggagatcttctatgctccagcataacctggcggcagcgcaaaagatg

SEQ ID NO: 166723 - DNA, 103 bp, Artificial Sequence
  Synthetic Polynucleotide
taatacgactcactatagggctggtctgcaaggcagacatggatgctggaaacagaggagatccagcatgcatgtctgcaacctggcggcagcgcaaaagatg

SEQ ID NO: 166724 - DNA, 103 bp, Artificial Sequence
  Synthetic Polynucleotide
taatacgactcactatagggttgatttatactggtctgcaaggcagacataacagaggagaatgtctatgttgcagaccaacctggcggcagcgcaaaagatg

SEQ ID NO: 166725 - DNA, 103 bp, Artificial Sequence
  Synthetic Polynucleotide
taatacgactcactataggggcatatcttgttgatttatactggtctgcaaacagaggagatgcagaatggtataaatcaacctggcggcagcgcaaaagatg

SEQ ID NO: 166726 - DNA, 103 bp, Artificial Sequence
  Synthetic Polynucleotide
taatacgactcactatagggggagactgttgcatatcttgttgatttataaacagaggagatataaaatgacaagatataacctggcggcagcgcaaaagatg

SEQ ID NO: 166727 - DNA, 103 bp, Artificial Sequence
  Synthetic Polynucleotide
taatacgactcactatagggggaataaagaggagactgttgcatatcttgaacagaggagacaagatatgcaacagtctaacctggcggcagcgcaaaagatg

SEQ ID NO: 166728 - DNA, 103 bp, Artificial Sequence
  Synthetic Polynucleotide
taatacgactcactatagggtgttctgaggggaataaagaggagactgttaacagaggagaaacagtatgctctttattaacctggcggcagcgcaaaagatg

SEQ ID NO: 166729 - DNA, 103 bp, Artificial Sequence
  Synthetic Polynucleotide
taatacgactcactatagggggtggtgagatgtacaagactgtgtgcctcaacagaggagagaggcaatgagtcttgtaaacctggcggcagcgcaaaagatg

SEQ ID NO: 166730 - DNA, 103 bp, Artificial Sequence
  Synthetic Polynucleotide
taatacgactcactatagggccaggcatgttgttctgaggggaataaagaaacagaggagatctttaatgccctcagaaaacctggcggcagcgcaaaagatg

SEQ ID NO: 166731 - DNA, 103 bp, Artificial Sequence
  Synthetic Polynucleotide
taatacgactcactatagggtccttgaattccaggcatgttgttctgaggaacagaggagacctcagatgaacatgcctaacctggcggcagcgcaaaagatg

SEQ ID NO: 166732 - DNA, 103 bp, Artificial Sequence
  Synthetic Polynucleotide
taatacgactcactatagggaagatgtggctccttgaattccaggcatgtaacagaggagaacatgcatggaattcaagaacctggcggcagcgcaaaagatg

SEQ ID NO: 166733 - DNA, 103 bp, Artificial Sequence
  Synthetic Polynucleotide
taatacgactcactatagggggttgaggcgaagatgtggctccttgaattaacagaggagaaattcaatgagccacatcaacctggcggcagcgcaaaagatg

SEQ ID NO: 166734 - DNA, 103 bp, Artificial Sequence
  Synthetic Polynucleotide
taatacgactcactatagggagtagcctgtggttgaggcgaagatgtggcaacagaggagagccacaatgtcgcctcaaaacctggcggcagcgcaaaagatg

SEQ ID NO: 166735 - DNA, 103 bp, Artificial Sequence
  Synthetic Polynucleotide
taatacgactcactatagggtgtgaaataaagtagcctgtggttgaggcgaacagaggagacgcctcatgcacaggctaaacctggcggcagcgcaaaagatg

SEQ ID NO: 166736 - DNA, 103 bp, Artificial Sequence
  Synthetic Polynucleotide
taatacgactcactatagggcctgctgtgttgtgaaataaagtagcctgtaacagaggagaacaggcatgtttatttcaaacctggcggcagcgcaaaagatg

SEQ ID NO: 166737 - DNA, 103 bp, Artificial Sequence
  Synthetic Polynucleotide
taatacgactcactatagggcattgtgcctcctgctgtgttgtgaaataaaacagaggagattatttatgaacacagcaaacctggcggcagcgcaaaagatg

SEQ ID NO: 166738 - DNA, 103 bp, Artificial Sequence
  Synthetic Polynucleotide
taatacgactcactataggggcagttggttcattgtgcctcctgctgtgtaacagaggagaacacagatggaggcacaaaacctggcggcagcgcaaaagatg

SEQ ID NO: 166739 - DNA, 103 bp, Artificial Sequence
  Synthetic Polynucleotide
taatacgactcactatagggggagaattctgcagttggttcattgtgcctaacagaggagaaggcacatggaaccaactaacctggcggcagcgcaaaagatg

SEQ ID NO: 166740 - DNA, 103 bp, Artificial Sequence
  Synthetic Polynucleotide
taatacgactcactataggggtcctcaggtggtggtgagatgtacaagacaacagaggagagtcttgatgatctcaccaaacctggcggcagcgcaaaagatg

SEQ ID NO: 166741 - DNA, 103 bp, Artificial Sequence
  Synthetic Polynucleotide
taatacgactcactatagggagatgagccaggagaattctgcagttggttaacagaggagaaaccaaatgcagaattctaacctggcggcagcgcaaaagatg

SEQ ID NO: 166742 - DNA, 103 bp, Artificial Sequence
  Synthetic Polynucleotide
taatacgactcactatagggatgtctgctgagatgagccaggagaattctaacagaggagaagaattatgctggctcataacctggcggcagcgcaaaagatg

SEQ ID NO: 166743 - DNA, 103 bp, Artificial Sequence
  Synthetic Polynucleotide
taatacgactcactatagggaacattcctgatgtctgctgagatgagccaaacagaggagatggctcatgtcagcagacaacctggcggcagcgcaaaagatg

SEQ ID NO: 166744 - DNA, 103 bp, Artificial Sequence
  Synthetic Polynucleotide
taatacgactcactataggggccaaataagaacattcctgatgtctgctgaacagaggagacagcagatgtcaggaatgaacctggcggcagcgcaaaagatg

SEQ ID NO: 166745 - DNA, 103 bp, Artificial Sequence
  Synthetic Polynucleotide
taatacgactcactatagggtattttgaatgccaaataagaacattcctgaacagaggagacaggaaatgtcttatttgaacctggcggcagcgcaaaagatg

SEQ ID NO: 166746 - DNA, 103 bp, Artificial Sequence
  Synthetic Polynucleotide
taatacgactcactatagggtgactacagttattttgaatgccaaataagaacagaggagacttattatgcattcaaaaaacctggcggcagcgcaaaagatg

SEQ ID NO: 166747 - DNA, 103 bp, Artificial Sequence
  Synthetic Polynucleotide
taatacgactcactatagggggttaaaagctgactacagttattttgaataacagaggagaattcaaatgaactgtagtaacctggcggcagcgcaaaagatg

SEQ ID NO: 166748 - DNA, 103 bp, Artificial Sequence
  Synthetic Polynucleotide
taatacgactcactatagggctggtccagaggttaaaagctgactacagtaacagaggagaactgtaatgagcttttaaaacctggcggcagcgcaaaagatg

SEQ ID NO: 166749 - DNA, 103 bp, Artificial Sequence
  Synthetic Polynucleotide
taatacgactcactatagggggcaatgtagctggtccagaggttaaaagcaacagaggagagcttttatgctctggaccaacctggcggcagcgcaaaagatg

SEQ ID NO: 166750 - DNA, 103 bp, Artificial Sequence
  Synthetic Polynucleotide
taatacgactcactatagggcaactgatcaggcaatgtagctggtccagaaacagaggagatctggaatggctacattgaacctggcggcagcgcaaaagatg

SEQ ID NO: 166751 - DNA, 103 bp, Artificial Sequence
  Synthetic Polynucleotide
taatacgactcactatagggtatccagcaagtcctcaggtggtggtgagaaacagaggagatctcacatgcacctgaggaacctggcggcagcgcaaaagatg

SEQ ID NO: 166752 - DNA, 103 bp, Artificial Sequence
  Synthetic Polynucleotide
taatacgactcactatagggttatggccatcaactgatcaggcaatgtagaacagaggagactacatatgctgatcagtaacctggcggcagcgcaaaagatg

SEQ ID NO: 166753 - DNA, 103 bp, Artificial Sequence
  Synthetic Polynucleotide
taatacgactcactatagggcctggctgacttatggccatcaactgatcaaacagaggagatgatcaatggatggccataacctggcggcagcgcaaaagatg

SEQ ID NO: 166754 - DNA, 103 bp, Artificial Sequence
  Synthetic Polynucleotide
taatacgactcactatagggttgtggttggcctggctgacttatggccataacagaggagaatggccatgagtcagccaaacctggcggcagcgcaaaagatg

SEQ ID NO: 166755 - DNA, 103 bp, Artificial Sequence
  Synthetic Polynucleotide
taatacgactcactatagggggccctcgttttgtggttggcctggctgacaacagaggagagtcagcatggccaaccacaacctggcggcagcgcaaaagatg

SEQ ID NO: 166756 - DNA, 103 bp, Artificial Sequence
  Synthetic Polynucleotide
taatacgactcactatagggacaggtggctggccctcgttttgtggttggaacagaggagaccaaccatgaaacgagggaacctggcggcagcgcaaaagatg

SEQ ID NO: 166757 - DNA, 103 bp, Artificial Sequence
  Synthetic Polynucleotide
taatacgactcactatagggaagtgttgtcacaggtggctggccctcgttaacagaggagaaacgagatgcagccacctaacctggcggcagcgcaaaagatg

SEQ ID NO: 166758 - DNA, 103 bp, Artificial Sequence
  Synthetic Polynucleotide
taatacgactcactataggggctgagaaagaagtgttgtcacaggtggctaacagaggagaagccacatgtgacaacacaacctggcggcagcgcaaaagatg

SEQ ID NO: 166759 - DNA, 103 bp, Artificial Sequence
  Synthetic Polynucleotide
taatacgactcactatagggtctggcatttgctgagaaagaagtgttgtcaacagaggagagacaacatgtctttctcaaacctggcggcagcgcaaaagatg

SEQ ID NO: 166760 - DNA, 103 bp, Artificial Sequence
  Synthetic Polynucleotide
taatacgactcactatagggtggagaattctctggcatttgctgagaaagaacagaggagactttctatgcaaatgccaaacctggcggcagcgcaaaagatg

SEQ ID NO: 166761 - DNA, 103 bp, Artificial Sequence
  Synthetic Polynucleotide
taatacgactcactatagggaggatgccagtggagaattctctggcatttaacagaggagaaaatgcatgagaattctcaacctggcggcagcgcaaaagatg

SEQ ID NO: 166762 - DNA, 103 bp, Artificial Sequence
  Synthetic Polynucleotide
taatacgactcactatagggatccgactgttatccagcaagtcctcaggtaacagaggagaacctgaatgcttgctggaaacctggcggcagcgcaaaagatg

SEQ ID NO: 166763 - DNA, 103 bp, Artificial Sequence
  Synthetic Polynucleotide
taatacgactcactataggggtgtttatagaggatgccagtggagaattcaacagaggagagaattcatgactggcatcaacctggcggcagcgcaaaagatg

SEQ ID NO: 166764 - DNA, 103 bp, Artificial Sequence
  Synthetic Polynucleotide
taatacgactcactataggggttctggttggtgtttatagaggatgccagaacagaggagactggcaatgtctataaacaacctggcggcagcgcaaaagatg

SEQ ID NO: 166765 - DNA, 103 bp, Artificial Sequence
  Synthetic Polynucleotide
taatacgactcactatagggtcttttcgatgttctggttggtgtttatagaacagaggagactataaatgccaaccagaaacctggcggcagcgcaaaagatg

SEQ ID NO: 166766 - DNA, 103 bp, Artificial Sequence
  Synthetic Polynucleotide
taatacgactcactatagggagcaaatcaatcttttcgatgttctggttgaacagaggagacaaccaatgcatcgaaaaaacctggcggcagcgcaaaagatg

SEQ ID NO: 166767 - DNA, 103 bp, Artificial Sequence
  Synthetic Polynucleotide
taatacgactcactatagggcaatgaaacaagcaaatcaatcttttcgataacagaggagaatcgaaatgattgatttgaacctggcggcagcgcaaaagatg

SEQ ID NO: 166768 - DNA, 103 bp, Artificial Sequence
  Synthetic Polynucleotide
taatacgactcactatagggcttggttttgcaatgaaacaagcaaatcaaaacagaggagattgattatgttgtttcataacctggcggcagcgcaaaagatg

SEQ ID NO: 166769 - DNA, 103 bp, Artificial Sequence
  Synthetic Polynucleotide
taatacgactcactatagggaagttgttcccttggttttgcaatgaaacaaacagaggagatgtttcatggcaaaaccaaacctggcggcagcgcaaaagatg

SEQ ID NO: 166770 - DNA, 103 bp, Artificial Sequence
  Synthetic Polynucleotide
taatacgactcactatagggggagccagtcaagttgttcccttggttttgaacagaggagacaaaacatggggaacaacaacctggcggcagcgcaaaagatg

SEQ ID NO: 166771 - DNA, 103 bp, Artificial Sequence
  Synthetic Polynucleotide
taatacgactcactatagggctggcaggacatccgactgttatccagcaaaacagaggagattgctgatgaacagtcggaacctggcggcagcgcaaaagatg

SEQ ID NO: 166772 - DNA, 103 bp, Artificial Sequence
  Synthetic Polynucleotide
taatacgactcactatagggacccctcatcctggcaggacatccgactgtaacagaggagaacagtcatgtgtcctgccaacctggcggcagcgcaaaagatg

SEQ ID NO: 166773 - DNA, 103 bp, Artificial Sequence
  Synthetic Polynucleotide
taatacgactcactatagggtccaatccacacccctcatcctggcaggacaacagaggagagtcctgatgggatgagggaacctggcggcagcgcaaaagatg

SEQ ID NO: 166774 - DNA, 103 bp, Artificial Sequence
  Synthetic Polynucleotide
taatacgactcactatagggctgctcagattccaatccacacccctcatcaacagaggagagatgagatgtgtggattgaacctggcggcagcgcaaaagatg

SEQ ID NO: 166775 - DNA, 103 bp, Artificial Sequence
  Synthetic Polynucleotide
taatacgactcactataggggcgagtagagggacttgggcgattccaggtaacagaggagaacctggatgcgcccaagtaacctggcggcagcgcaaaagatg

SEQ ID NO: 166776 - DNA, 103 bp, Artificial Sequence
  Synthetic Polynucleotide
taatacgactcactatagggtactgcagctctgctcagattccaatccacaacagaggagagtggatatgaatctgagcaacctggcggcagcgcaaaagatg

SEQ ID NO: 166777 - DNA, 103 bp, Artificial Sequence
  Synthetic Polynucleotide
taatacgactcactatagggtccatccacatactgcagctctgctcagataacagaggagaatctgaatggagctgcagaacctggcggcagcgcaaaagatg

SEQ ID NO: 166778 - DNA, 103 bp, Artificial Sequence
  Synthetic Polynucleotide
taatacgactcactataggggggggaatcctccatccacatactgcagctaacagaggagaagctgcatgatgtggatgaacctggcggcagcgcaaaagatg

SEQ ID NO: 166779 - DNA, 103 bp, Artificial Sequence
  Synthetic Polynucleotide
taatacgactcactatagggtgaagttggagggggaatcctccatccacaaacagaggagatgtggaatgaggattcccaacctggcggcagcgcaaaagatg

SEQ ID NO: 166780 - DNA, 103 bp, Artificial Sequence
  Synthetic Polynucleotide
taatacgactcactatagggctcatgttactgaagttggagggggaatccaacagaggagaggattcatgctccaacttaacctggcggcagcgcaaaagatg

SEQ ID NO: 166781 - DNA, 103 bp, Artificial Sequence
  Synthetic Polynucleotide
taatacgactcactatagggggaactggtgctcatgttactgaagttggaaacagaggagatccaacatgagtaacatgaacctggcggcagcgcaaaagatg

SEQ ID NO: 166782 - DNA, 103 bp, Artificial Sequence
  Synthetic Polynucleotide
taatacgactcactatagggtatcattgtaggaactggtgctcatgttacaacagaggagagtaacaatggcaccagttaacctggcggcagcgcaaaagatg

SEQ ID NO: 166783 - DNA, 103 bp, Artificial Sequence
  Synthetic Polynucleotide
taatacgactcactatagggacctcagtgttatcattgtaggaactggtgaacagaggagacaccagatgctacaatgaaacctggcggcagcgcaaaagatg

SEQ ID NO: 166784 - DNA, 103 bp, Artificial Sequence
  Synthetic Polynucleotide
taatacgactcactatagggtttacgaggtacctcagtgttatcattgtaaacagaggagatacaatatgaacactgagaacctggcggcagcgcaaaagatg

SEQ ID NO: 166785 - DNA, 103 bp, Artificial Sequence
  Synthetic Polynucleotide
taatacgactcactataggggttttcgtgatttacgaggtacctcagtgtaacagaggagaacactgatgtacctcgtaaacctggcggcagcgcaaaagatg

SEQ ID NO: 166786 - DNA, 103 bp, Artificial Sequence
  Synthetic Polynucleotide
taatacgactcactatagggacagattctcgcgagtagagggacttgggcaacagaggagagcccaaatgcctctactcaacctggcggcagcgcaaaagatg

SEQ ID NO: 166787 - DNA, 103 bp, Artificial Sequence
  Synthetic Polynucleotide
taatacgactcactatagggtttggatttcgttttcgtgatttacgaggtaacagaggagaacctcgatgatcacgaaaaacctggcggcagcgcaaaagatg

SEQ ID NO: 166788 - DNA, 103 bp, Artificial Sequence
  Synthetic Polynucleotide
taatacgactcactatagggcggcctctgctttggatttcgttttcgtgaaacagaggagatcacgaatgcgaaatccaaacctggcggcagcgcaaaagatg

SEQ ID NO: 166789 - DNA, 103 bp, Artificial Sequence
  Synthetic Polynucleotide
taatacgactcactataggggtttgacccccggcctctgctttggatttcaacagaggagagaaatcatgagcagaggcaacctggcggcagcgcaaaagatg

SEQ ID NO: 166790 - DNA, 103 bp, Artificial Sequence
  Synthetic Polynucleotide
taatacgactcactatagggcaatctcgtcgtttgacccccggcctctgcaacagaggagagcagagatggggggtcaaaacctggcggcagcgcaaaagatg

SEQ ID NO: 166791 - DNA, 103 bp, Artificial Sequence
  Synthetic Polynucleotide
taatacgactcactatagggagattcttcacaatctcgtcgtttgaccccaacagaggagaggggtcatgcgacgagataacctggcggcagcgcaaaagatg

SEQ ID NO: 166792 - DNA, 103 bp, Artificial Sequence
  Synthetic Polynucleotide
taatacgactcactatagggtatccatattagattcttcacaatctcgtcaacagaggagagacgagatggtgaagaataacctggcggcagcgcaaaagatg

SEQ ID NO: 166793 - DNA, 103 bp, Artificial Sequence
  Synthetic Polynucleotide
taatacgactcactataggggcatcaaatatatccatattagattcttcaaacagaggagatgaagaatgtaatatggaaacctggcggcagcgcaaaagatg

SEQ ID NO: 166794 - DNA, 103 bp, Artificial Sequence
  Synthetic Polynucleotide
taatacgactcactatagggggcactgtcggcatcaaatatatccatattaacagaggagaaatatgatgatatttgataacctggcggcagcgcaaaagatg

SEQ ID NO: 166795 - DNA, 103 bp, Artificial Sequence
  Synthetic Polynucleotide
taatacgactcactataggggaggtgctttggcactgtcggcatcaaataaacagaggagatatttgatgccgacagtgaacctggcggcagcgcaaaagatg

SEQ ID NO: 166796 - DNA, 103 bp, Artificial Sequence
  Synthetic Polynucleotide
taatacgactcactatagggagcacatagtgaggtgctttggcactgtcgaacagaggagacgacagatgcaaagcaccaacctggcggcagcgcaaaagatg

SEQ ID NO: 166797 - DNA, 103 bp, Artificial Sequence
  Synthetic Polynucleotide
taatacgactcactatagggaagatcatagacagattctcgcgagtagagaacagaggagactctacatgcgagaatctaacctggcggcagcgcaaaagatg

SEQ ID NO: 166798 - DNA, 103 bp, Artificial Sequence
  Synthetic Polynucleotide
taatacgactcactatagggaagctgagaaagcacatagtgaggtgctttaacagaggagaaaagcaatgcactatgtgaacctggcggcagcgcaaaagatg

SEQ ID NO: 166799 - DNA, 103 bp, Artificial Sequence
  Synthetic Polynucleotide
taatacgactcactatagggtgtccgtggtaagctgagaaagcacatagtaacagaggagaactatgatgtttctcagcaacctggcggcagcgcaaaagatg

SEQ ID NO: 166800 - DNA, 103 bp, Artificial Sequence
  Synthetic Polynucleotide
taatacgactcactatagggttgcctttgttgtccgtggtaagctgagaaaacagaggagattctcaatgtaccacggaaacctggcggcagcgcaaaagatg

SEQ ID NO: 166801 - DNA, 103 bp, Artificial Sequence
  Synthetic Polynucleotide
taatacgactcactatagggcgcttttgagttgcctttgttgtccgtggtaacagaggagaaccacgatgaacaaaggcaacctggcggcagcgcaaaagatg

SEQ ID NO: 166802 - DNA, 103 bp, Artificial Sequence
  Synthetic Polynucleotide
taatacgactcactatagggttccatttcccgcttttgagttgcctttgtaacagaggagaacaaagatgactcaaaagaacctggcggcagcgcaaaagatg

SEQ ID NO: 166803 - DNA, 103 bp, Artificial Sequence
  Synthetic Polynucleotide
taatacgactcactatagggttttccaatgttccatttcccgcttttgagaacagaggagactcaaaatggggaaatggaacctggcggcagcgcaaaagatg

SEQ ID NO: 166804 - DNA, 103 bp, Artificial Sequence
  Synthetic Polynucleotide
taatacgactcactatagggtcctttttggttttccaatgttccatttccaacagaggagaggaaatatgacattggaaaacctggcggcagcgcaaaagatg

SEQ ID NO: 166805 - DNA, 103 bp, Artificial Sequence
  Synthetic Polynucleotide
taatacgactcactatagggttactccagttcctttttggttttccaatgaacagaggagacattggatgaccaaaaagaacctggcggcagcgcaaaagatg

SEQ ID NO: 166806 - DNA, 103 bp, Artificial Sequence
  Synthetic Polynucleotide
taatacgactcactataggggggctcttctttactccagttcctttttggaacagaggagaccaaaaatgaactggagtaacctggcggcagcgcaaaagatg

SEQ ID NO: 166807 - DNA, 103 bp, Artificial Sequence
  Synthetic Polynucleotide
taatacgactcactatagggacacaacatagggctcttctttactccagtaacagaggagaactggaatgaagaagagcaacctggcggcagcgcaaaagatg

SEQ ID NO: 166808 - DNA, 103 bp, Artificial Sequence
  Synthetic Polynucleotide
taatacgactcactatagggcctttgggagaagatcatagacagattctcaacagaggagagagaatatgtctatgatcaacctggcggcagcgcaaaagatg

SEQ ID NO: 166809 - DNA, 103 bp, Artificial Sequence
  Synthetic Polynucleotide
taatacgactcactataggggatattgtccacacaacatagggctcttctaacagaggagaagaagaatgctatgttgtaacctggcggcagcgcaaaagatg

SEQ ID NO: 166810 - DNA, 103 bp, Artificial Sequence
  Synthetic Polynucleotide
taatacgactcactatagggcttttaacaggatattgtccacacaacataaacagaggagatatgttatgtggacaataaacctggcggcagcgcaaaagatg

SEQ ID NO: 166811 - DNA, 103 bp, Artificial Sequence
  Synthetic Polynucleotide
taatacgactcactatagggctttccctcacttttaacaggatattgtccaacagaggagaggacaaatgcctgttaaaaacctggcggcagcgcaaaagatg

SEQ ID NO: 166812 - DNA, 103 bp, Artificial Sequence
  Synthetic Polynucleotide
taatacgactcactatagggtcttcagctcctttccctcacttttaacagaacagaggagactgttaatggtgagggaaaacctggcggcagcgcaaaagatg

SEQ ID NO: 166813 - DNA, 103 bp, Artificial Sequence
  Synthetic Polynucleotide
taatacgactcactatagggtgtacaactatcttcagctcctttccctcaaacagaggagatgagggatgggagctgaaaacctggcggcagcgcaaaagatg

SEQ ID NO: 166814 - DNA, 103 bp, Artificial Sequence
  Synthetic Polynucleotide
taatacgactcactatagggtgtctcaggttgtacaactatcttcagctcaacagaggagagagctgatgatagttgtaaacctggcggcagcgcaaaagatg

SEQ ID NO: 166815 - DNA, 103 bp, Artificial Sequence
  Synthetic Polynucleotide
taatacgactcactatagggctcggtgctgtgtctcaggttgtacaactaaacagaggagatagttgatgaacctgagaaacctggcggcagcgcaaaagatg

SEQ ID NO: 166816 - DNA, 103 bp, Artificial Sequence
  Synthetic Polynucleotide
taatacgactcactatagggaggtaccgagctcggtgctgtgtctcaggtaacagaggagaacctgaatgacagcaccgaacctggcggcagcgcaaaagatg

SEQ ID NO: 166817 - DNA, 103 bp, Artificial Sequence
  Synthetic Polynucleotide
taatacgactcactataggggccctcagtcaggtaccgagctcggtgctgaacagaggagacagcacatggctcggtacaacctggcggcagcgcaaaagatg

SEQ ID NO: 166818 - DNA, 103 bp, Artificial Sequence
  Synthetic Polynucleotide
taatacgactcactatagggagccacggctgccctcagtcaggtaccgagaacagaggagactcggtatgtgactgaggaacctggcggcagcgcaaaagatg

SEQ ID NO: 166819 - DNA, 103 bp, Artificial Sequence
  Synthetic Polynucleotide
taatacgactcactatagggaactgtaactcctttgggagaagatcatagaacagaggagactatgaatgtctcccaaaaacctggcggcagcgcaaaagatg

SEQ ID NO: 166820 - DNA, 103 bp, Artificial Sequence
  Synthetic Polynucleotide
taatacgactcactatagggtctttcactgagccacggctgccctcagtcaacagaggagagactgaatgcagccgtggaacctggcggcagcgcaaaagatg

SEQ ID NO: 166821 - DNA, 103 bp, Artificial Sequence
  Synthetic Polynucleotide
taatacgactcactatagggctgtgttctatctttcactgagccacggctaacagaggagaagccgtatgtcagtgaaaaacctggcggcagcgcaaaagatg

SEQ ID NO: 166822 - DNA, 103 bp, Artificial Sequence
  Synthetic Polynucleotide
taatacgactcactataggggaaagccttgctgtgttctatctttcactgaacagaggagacagtgaatgatagaacacaacctggcggcagcgcaaaagatg

SEQ ID NO: 166823 - DNA, 103 bp, Artificial Sequence
  Synthetic Polynucleotide
taatacgactcactatagggtttactgtaggaaagccttgctgtgttctaaacagaggagatagaacatggcaaggcttaacctggcggcagcgcaaaagatg

SEQ ID NO: 166824 - DNA, 103 bp, Artificial Sequence
  Synthetic Polynucleotide
taatacgactcactataggggccttccagctttactgtaggaaagccttgaacagaggagacaaggcatgcctacagtaaacctggcggcagcgcaaaagatg

SEQ ID NO: 166825 - DNA, 103 bp, Artificial Sequence
  Synthetic Polynucleotide
taatacgactcactataggggttcattatggccttccagctttactgtagaacagaggagactacagatgagctggaagaacctggcggcagcgcaaaagatg

SEQ ID NO: 166826 - DNA, 103 bp, Artificial Sequence
  Synthetic Polynucleotide
taatacgactcactatagggaacactacaggttcattatggccttccagcaacagaggagagctggaatgccataatgaaacctggcggcagcgcaaaagatg

SEQ ID NO: 166827 - DNA, 103 bp, Artificial Sequence
  Synthetic Polynucleotide
taatacgactcactatagggaaacacttgcaacactacaggttcattatgaacagaggagacataatatgcctgtagtgaacctggcggcagcgcaaaagatg

SEQ ID NO: 166828 - DNA, 103 bp, Artificial Sequence
  Synthetic Polynucleotide
taatacgactcactatagggcgttgcccacaaacacttgcaacactacagaacagaggagactgtagatgtgcaagtgtaacctggcggcagcgcaaaagatg

SEQ ID NO: 166829 - DNA, 103 bp, Artificial Sequence
  Synthetic Polynucleotide
taatacgactcactatagggcgtccagagtcgttgcccacaaacacttgcaacagaggagagcaagtatgtgtgggcaaaacctggcggcagcgcaaaagatg

SEQ ID NO: 166830 - DNA, 103 bp, Artificial Sequence
  Synthetic Polynucleotide
taatacgactcactatagggggaagggactggaaagctggtgcttggcataacagaggagaatgccaatgaccagctttaacctggcggcagcgcaaaagatg

SEQ ID NO: 166831 - DNA, 103 bp, Artificial Sequence
  Synthetic Polynucleotide
taatacgactcactatagggcgctgacttcatggtgccgccggcgcgcggaacagaggagaccgcgcatgggcggcaccaacctggcggcagcgcaaaagatg

SEQ ID NO: 166832 - DNA, 103 bp, Artificial Sequence
  Synthetic Polynucleotide
taatacgactcactatagggcagggtggtcttgcgggacttgacagggacaacagaggagagtccctatgaagtcccgcaacctggcggcagcgcaaaagatg

SEQ ID NO: 166833 - DNA, 103 bp, Artificial Sequence
  Synthetic Polynucleotide
taatacgactcactataggggcggctgctccagggtggtcttgcgggactaacagaggagaagtcccatgagaccacccaacctggcggcagcgcaaaagatg

SEQ ID NO: 166834 - DNA, 103 bp, Artificial Sequence
  Synthetic Polynucleotide
taatacgactcactataggggccactgagggcggctgctccagggtggtcaacagaggagagaccacatgggagcagccaacctggcggcagcgcaaaagatg

SEQ ID NO: 166835 - DNA, 103 bp, Artificial Sequence
  Synthetic Polynucleotide
taatacgactcactatagggcaccttgagcgccactgagggcggctgctcaacagaggagagagcagatgccctcagtgaacctggcggcagcgcaaaagatg

SEQ ID NO: 166836 - DNA, 103 bp, Artificial Sequence
  Synthetic Polynucleotide
taatacgactcactatagggcgacgggctccaccttgagcgccactgaggaacagaggagacctcagatgcgctcaaggaacctggcggcagcgcaaaagatg

SEQ ID NO: 166837 - DNA, 103 bp, Artificial Sequence
  Synthetic Polynucleotide
taatacgactcactatagggaggtcctccccgacgggctccaccttgagcaacagaggagagctcaaatgggagcccgtaacctggcggcagcgcaaaagatg

SEQ ID NO: 166838 - DNA, 103 bp, Artificial Sequence
  Synthetic Polynucleotide
taatacgactcactatagggggggctgcccaggtcctccccgacgggctcaacagaggagagagcccatgggggaggacaacctggcggcagcgcaaaagatg

SEQ ID NO: 166839 - DNA, 103 bp, Artificial Sequence
  Synthetic Polynucleotide
taatacgactcactatagggccgggggcggggggctgcccaggtcctcccaacagaggagagggaggatgtgggcagccaacctggcggcagcgcaaaagatg

SEQ ID NO: 166840 - DNA, 103 bp, Artificial Sequence
  Synthetic Polynucleotide
taatacgactcactataggggcgaagtcggccgggggcggggggctgcccaacagaggagagggcagatgcccgcccccaacctggcggcagcgcaaaagatg

SEQ ID NO: 166841 - DNA, 103 bp, Artificial Sequence
  Synthetic Polynucleotide
taatacgactcactataggggtcttcgggcgcgaagtcggccgggggcggaacagaggagaccgcccatggccgacttcaacctggcggcagcgcaaaagatg

SEQ ID NO: 166842 - DNA, 103 bp, Artificial Sequence
  Synthetic Polynucleotide
taatacgactcactataggggttcttcctccgctgacttcatggtgccgcaacagaggagagcggcaatgtgaagtcagaacctggcggcagcgcaaaagatg

SEQ ID NO: 166843 - DNA, 103 bp, Artificial Sequence
  Synthetic Polynucleotide
taatacgactcactatagggaagaggagtagtcttcgggcgcgaagtcggaacagaggagaccgactatgcgcccgaagaacctggcggcagcgcaaaagatg

SEQ ID NO: 166844 - DNA, 103 bp, Artificial Sequence
  Synthetic Polynucleotide
taatacgactcactatagggatgtgctggaaagaggagtagtcttcgggcaacagaggagagcccgaatgctactcctcaacctggcggcagcgcaaaagatg

SEQ ID NO: 166845 - DNA, 103 bp, Artificial Sequence
  Synthetic Polynucleotide
taatacgactcactataggggcccttcctgatgtgctggaaagaggagtaaacagaggagatactccatgttccagcacaacctggcggcagcgcaaaagatg

SEQ ID NO: 166846 - DNA, 103 bp, Artificial Sequence
  Synthetic Polynucleotide
taatacgactcactatagggcgcagaagccgcccttcctgatgtgctggaaacagaggagatccagcatgtcaggaaggaacctggcggcagcgcaaaagatg

SEQ ID NO: 166847 - DNA, 103 bp, Artificial Sequence
  Synthetic Polynucleotide
taatacgactcactatagggaggtactggtcgcagaagccgcccttcctgaacagaggagacaggaaatgcggcttctgaacctggcggcagcgcaaaagatg

SEQ ID NO: 166848 - DNA, 103 bp, Artificial Sequence
  Synthetic Polynucleotide
taatacgactcactatagggcggcaccgccaggtactggtcgcagaagccaacagaggagaggcttcatggaccagtacaacctggcggcagcgcaaaagatg

SEQ ID NO: 166849 - DNA, 103 bp, Artificial Sequence
  Synthetic Polynucleotide
taatacgactcactatagggaggggtgctgcggcaccgccaggtactggtaacagaggagaaccagtatgtggcggtgcaacctggcggcagcgcaaaagatg

SEQ ID NO: 166850 - DNA, 103 bp, Artificial Sequence
  Synthetic Polynucleotide
taatacgactcactataggggcccactggtaggggtgctgcggcaccgccaacagaggagaggcggtatggcagcacccaacctggcggcagcgcaaaagatg

SEQ ID NO: 166851 - DNA, 103 bp, Artificial Sequence
  Synthetic Polynucleotide
taatacgactcactatagggcttgggcttcgcccactggtaggggtgctgaacagaggagacagcacatgtaccagtggaacctggcggcagcgcaaaagatg

SEQ ID NO: 166852 - DNA, 103 bp, Artificial Sequence
  Synthetic Polynucleotide
taatacgactcactataggggggacaggggcttgggcttcgcccactggtaacagaggagaaccagtatgcgaagcccaaacctggcggcagcgcaaaagatg

SEQ ID NO: 166853 - DNA, 103 bp, Artificial Sequence
  Synthetic Polynucleotide
taatacgactcactatagggtagccatagtgttcttcctccgctgacttcaacagaggagagaagtcatgggaggaagaaacctggcggcagcgcaaaagatg

SEQ ID NO: 166854 - DNA, 103 bp, Artificial Sequence
  Synthetic Polynucleotide
taatacgactcactatagggtaggacgtaggggacaggggcttgggcttcaacagaggagagaagccatggcccctgtcaacctggcggcagcgcaaaagatg

SEQ ID NO: 166855 - DNA, 103 bp, Artificial Sequence
  Synthetic Polynucleotide
taatacgactcactatagggcgggctcatgtaggacgtaggggacaggggaacagaggagacccctgatgcctacgtccaacctggcggcagcgcaaaagatg

SEQ ID NO: 166856 - DNA, 103 bp, Artificial Sequence
  Synthetic Polynucleotide
taatacgactcactatagggcgggcagggtcgggctcatgtaggacgtagaacagaggagactacgtatgacatgagccaacctggcggcagcgcaaaagatg

SEQ ID NO: 166857 - DNA, 103 bp, Artificial Sequence
  Synthetic Polynucleotide
taatacgactcactatagggcagtccagggcgggcagggtcgggctcatgaacagaggagacatgagatggaccctgccaacctggcggcagcgcaaaagatg

SEQ ID NO: 166858 - DNA, 103 bp, Artificial Sequence
  Synthetic Polynucleotide
taatacgactcactatagggcggcagctgccagtccagggcgggcagggtaacagaggagaaccctgatggccctggacaacctggcggcagcgcaaaagatg

SEQ ID NO: 166859 - DNA, 103 bp, Artificial Sequence
  Synthetic Polynucleotide
taatacgactcactatagggctgagtgggacggcagctgccagtccagggaacagaggagaccctggatgggcagctgcaacctggcggcagcgcaaaagatg

SEQ ID NO: 166860 - DNA, 103 bp, Artificial Sequence
  Synthetic Polynucleotide
taatacgactcactatagggtcatacgggcctgagtgggacggcagctgcaacagaggagagcagctatggtcccactcaacctggcggcagcgcaaaagatg

SEQ ID NO: 166861 - DNA, 103 bp, Artificial Sequence
  Synthetic Polynucleotide
taatacgactcactatagggaatccgaagctcatacgggcctgagtgggaaacagaggagatcccacatgggcccgtataacctggcggcagcgcaaaagatg

SEQ ID NO: 166862 - DNA, 103 bp, Artificial Sequence
  Synthetic Polynucleotide
taatacgactcactataggggctgcacctcaatccgaagctcatacgggcaacagaggagagcccgtatgagcttcggaaacctggcggcagcgcaaaagatg

SEQ ID NO: 166863 - DNA, 103 bp, Artificial Sequence
  Synthetic Polynucleotide
taatacgactcactatagggtgggacttgggctgcacctcaatccgaagcaacagaggagagcttcgatgtgaggtgcaaacctggcggcagcgcaaaagatg

SEQ ID NO: 166864 - DNA, 103 bp, Artificial Sequence
  Synthetic Polynucleotide
taatacgactcactatagggggaggatgcatagccatagtgttcttcctcaacagaggagagaggaaatgcactatggcaacctggcggcagcgcaaaagatg

SEQ ID NO: 166865 - DNA, 103 bp, Artificial Sequence
  Synthetic Polynucleotide
taatacgactcactatagggggctcggtggtgggacttgggctgcacctcaacagaggagagaggtgatgcccaagtccaacctggcggcagcgcaaaagatg

SEQ ID NO: 166866 - DNA, 103 bp, Artificial Sequence
  Synthetic Polynucleotide
taatacgactcactatagggtctcgtagtgggctcggtggtgggacttggaacagaggagaccaagtatgaccaccgagaacctggcggcagcgcaaaagatg

SEQ ID NO: 166867 - DNA, 103 bp, Artificial Sequence
  Synthetic Polynucleotide
taatacgactcactatagggctgccctccgtctcgtagtgggctcggtggaacagaggagaccaccgatgccactacgaaacctggcggcagcgcaaaagatg

SEQ ID NO: 166868 - DNA, 103 bp, Artificial Sequence
  Synthetic Polynucleotide
taatacgactcactatagggggccccccggctgccctccgtctcgtagtgaacagaggagacactacatgacggagggcaacctggcggcagcgcaaaagatg

SEQ ID NO: 166869 - DNA, 103 bp, Artificial Sequence
  Synthetic Polynucleotide
taatacgactcactatagggacgccttcacggccccccggctgccctccgaacagaggagacggaggatggccggggggaacctggcggcagcgcaaaagatg

SEQ ID NO: 166870 - DNA, 103 bp, Artificial Sequence
  Synthetic Polynucleotide
taatacgactcactatagggcctccggccgacgccttcacggccccccggaacagaggagaccggggatgcgtgaaggcaacctggcggcagcgcaaaagatg

SEQ ID NO: 166871 - DNA, 103 bp, Artificial Sequence
  Synthetic Polynucleotide
taatacgactcactataggggatggggtgtcctccggccgacgccttcacaacagaggagagtgaagatgtcggccggaaacctggcggcagcgcaaaagatg

SEQ ID NO: 166872 - DNA, 103 bp, Artificial Sequence
  Synthetic Polynucleotide
taatacgactcactataggggcagctgcacgatggggtgtcctccggccgaacagaggagacggccgatggacaccccaaacctggcggcagcgcaaaagatg

SEQ ID NO: 166873 - DNA, 103 bp, Artificial Sequence
  Synthetic Polynucleotide
taatacgactcactatagggaagtagccatgcagctgcacgatggggtgtaacagaggagaacacccatgcgtgcagctaacctggcggcagcgcaaaagatg

SEQ ID NO: 166874 - DNA, 103 bp, Artificial Sequence
  Synthetic Polynucleotide
taatacgactcactatagggctcattctccaagtagccatgcagctgcacaacagaggagagtgcagatgcatggctacaacctggcggcagcgcaaaagatg

SEQ ID NO: 166875 - DNA, 103 bp, Artificial Sequence
  Synthetic Polynucleotide
taatacgactcactatagggggctgacgttggaggatgcatagccatagtaacagaggagaactatgatgatgcatcctaacctggcggcagcgcaaaagatg

SEQ ID NO: 166876 - DNA, 103 bp, Artificial Sequence
  Synthetic Polynucleotide
taatacgactcactataggggcatcagcggctcattctccaagtagccataacagaggagaatggctatgtggagaatgaacctggcggcagcgcaaaagatg

SEQ ID NO: 166877 - DNA, 103 bp, Artificial Sequence
  Synthetic Polynucleotide
taatacgactcactatagggaaaagctgcagcatcagcggctcattctccaacagaggagaggagaaatggccgctgataacctggcggcagcgcaaaagatg

SEQ ID NO: 166878 - DNA, 103 bp, Artificial Sequence
  Synthetic Polynucleotide
taatacgactcactatagggcgtcccaatgaaaagctgcagcatcagcggaacagaggagaccgctgatgctgcagcttaacctggcggcagcgcaaaagatg

SEQ ID NO: 166879 - DNA, 103 bp, Artificial Sequence
  Synthetic Polynucleotide
taatacgactcactatagggggtcgtccgccgtcccaatgaaaagctgcaaacagaggagatgcagcatgtcattgggaaacctggcggcagcgcaaaagatg

SEQ ID NO: 166880 - DNA, 103 bp, Artificial Sequence
  Synthetic Polynucleotide
taatacgactcactatagggcgcagcaggcggtcgtccgccgtcccaatgaacagaggagacattggatgggcggacgaaacctggcggcagcgcaaaagatg

SEQ ID NO: 166881 - DNA, 103 bp, Artificial Sequence
  Synthetic Polynucleotide
taatacgactcactatagggggcgtgcgggcgcagcaggcggtcgtccgcaacagaggagagcggacatgcgcctgctgaacctggcggcagcgcaaaagatg

SEQ ID NO: 166882 - DNA, 103 bp, Artificial Sequence
  Synthetic Polynucleotide
taatacgactcactatagggcctggtagaaggcgtgcgggcgcagcaggcaacagaggagagcctgcatggcccgcacgaacctggcggcagcgcaaaagatg

SEQ ID NO: 166883 - DNA, 103 bp, Artificial Sequence
  Synthetic Polynucleotide
taatacgactcactatagggatgcggtgcacctggtagaaggcgtgcgggaacagaggagacccgcaatgcttctaccaaacctggcggcagcgcaaaagatg

SEQ ID NO: 166884 - DNA, 103 bp, Artificial Sequence
  Synthetic Polynucleotide
taatacgactcactatagggcttccctgtgatgcggtgcacctggtagaaaacagaggagattctacatggtgcaccgcaacctggcggcagcgcaaaagatg

SEQ ID NO: 166885 - DNA, 103 bp, Artificial Sequence
  Synthetic Polynucleotide
taatacgactcactatagggtggacacggtcttccctgtgatgcggtgcaaacagaggagatgcaccatgtcacagggaaacctggcggcagcgcaaaagatg

SEQ ID NO: 166886 - DNA, 103 bp, Artificial Sequence
  Synthetic Polynucleotide
taatacgactcactatagggggcagggcggggctgacgttggaggatgcaaacagaggagatgcatcatgcaacgtcagaacctggcggcagcgcaaaagatg

SEQ ID NO: 166887 - DNA, 103 bp, Artificial Sequence
  Synthetic Polynucleotide
taatacgactcactatagggtggctggtggtggacacggtcttccctgtgaacagaggagacacaggatggaccgtgtcaacctggcggcagcgcaaaagatg

SEQ ID NO: 166888 - DNA, 103 bp, Artificial Sequence
  Synthetic Polynucleotide
taatacgactcactataggggatggcctcgtggctggtggtggacacggtaacagaggagaaccgtgatgaccaccagcaacctggcggcagcgcaaaagatg

SEQ ID NO: 166889 - DNA, 103 bp, Artificial Sequence
  Synthetic Polynucleotide
taatacgactcactatagggtgttggagaggatggcctcgtggctggtggaacagaggagaccaccaatgacgaggccaaacctggcggcagcgcaaaagatg

SEQ ID NO: 166890 - DNA, 103 bp, Artificial Sequence
  Synthetic Polynucleotide
taatacgactcactatagggaggactttggtgttggagaggatggcctcgaacagaggagacgaggcatgcctctccaaaacctggcggcagcgcaaaagatg

SEQ ID NO: 166891 - DNA, 103 bp, Artificial Sequence
  Synthetic Polynucleotide
taatacgactcactatagggtgggatctccaggactttggtgttggagagaacagaggagactctccatgaccaaagtcaacctggcggcagcgcaaaagatg

SEQ ID NO: 166892 - DNA, 103 bp, Artificial Sequence
  Synthetic Polynucleotide
taatacgactcactatagggccggcaggagtgggatctccaggactttggaacagaggagaccaaagatgtggagatccaacctggcggcagcgcaaaagatg

SEQ ID NO: 166893 - DNA, 103 bp, Artificial Sequence
  Synthetic Polynucleotide
taatacgactcactatagggatgctgttctccggcaggagtgggatctccaacagaggagaggagatatgactcctgccaacctggcggcagcgcaaaagatg

SEQ ID NO: 166894 - DNA, 103 bp, Artificial Sequence
  Synthetic Polynucleotide
taatacgactcactataggggacggctcgcatgctgttctccggcaggagaacagaggagactcctgatggagaacagcaacctggcggcagcgcaaaagatg

SEQ ID NO: 166895 - DNA, 103 bp, Artificial Sequence
  Synthetic Polynucleotide
taatacgactcactatagggcacagtcaatgacggctcgcatgctgttctaacagaggagaagaacaatgtgcgagccgaacctggcggcagcgcaaaagatg

SEQ ID NO: 166896 - DNA, 103 bp, Artificial Sequence
  Synthetic Polynucleotide
taatacgactcactatagggaggattccggcacagtcaatgacggctcgcaacagaggagagcgagcatgcattgactgaacctggcggcagcgcaaaagatg

SEQ ID NO: 166897 - DNA, 103 bp, Artificial Sequence
  Synthetic Polynucleotide
taatacgactcactatagggcgtggggagcggcagggcggggctgacgttaacagaggagaaacgtcatgcccgccctgaacctggcggcagcgcaaaagatg

SEQ ID NO: 166898 - DNA, 103 bp, Artificial Sequence
  Synthetic Polynucleotide
taatacgactcactatagggtctgagtttcaggattccggcacagtcaataacagaggagaattgacatggccggaatcaacctggcggcagcgcaaaagatg

SEQ ID NO: 166899 - DNA, 103 bp, Artificial Sequence
  Synthetic Polynucleotide
taatacgactcactatagggtgtcggagtttctgagtttcaggattccggaacagaggagaccggaaatgtgaaactcaaacctggcggcagcgcaaaagatg

SEQ ID NO: 166900 - DNA, 103 bp, Artificial Sequence
  Synthetic Polynucleotide
taatacgactcactatagggcgaagttcaatgtcggagtttctgagtttcaacagaggagagaaactatgaaactccgaaacctggcggcagcgcaaaagatg

SEQ ID NO: 166901 - DNA, 103 bp, Artificial Sequence
  Synthetic Polynucleotide
taatacgactcactatagggctctcctttccgaagttcaatgtcggagttaacagaggagaaactccatgattgaacttaacctggcggcagcgcaaaagatg

SEQ ID NO: 166902 - DNA, 103 bp, Artificial Sequence
  Synthetic Polynucleotide
taatacgactcactatagggcgatgtccgtctctcctttccgaagttcaaaacagaggagattgaacatgggaaaggagaacctggcggcagcgcaaaagatg

SEQ ID NO: 166903 - DNA, 103 bp, Artificial Sequence
  Synthetic Polynucleotide
taatacgactcactatagggttcttcctcccgatgtccgtctctcctttcaacagaggagagaaaggatggacggacataacctggcggcagcgcaaaagatg

SEQ ID NO: 166904 - DNA, 103 bp, Artificial Sequence
  Synthetic Polynucleotide
taatacgactcactatagggtacccgtgtgttcttcctcccgatgtccgtaacagaggagaacggacatggggaggaagaacctggcggcagcgcaaaagatg

SEQ ID NO: 166905 - DNA, 103 bp, Artificial Sequence
  Synthetic Polynucleotide
taatacgactcactatagggacaccagccgtacccgtgtgttcttcctccaacagaggagaggaggaatgacacacgggaacctggcggcagcgcaaaagatg

SEQ ID NO: 166906 - DNA, 103 bp, Artificial Sequence
  Synthetic Polynucleotide
taatacgactcactatagggtgaacgcggaacaccagccgtacccgtgtgaacagaggagacacacgatgacggctggtaacctggcggcagcgcaaaagatg

SEQ ID NO: 166907 - DNA, 103 bp, Artificial Sequence
  Synthetic Polynucleotide
taatacgactcactatagggttgcgggacgtgaacgcggaacaccagccgaacagaggagacggctgatgttccgcgttaacctggcggcagcgcaaaagatg

SEQ ID NO: 166908 - DNA, 103 bp, Artificial Sequence
  Synthetic Polynucleotide
taatacgactcactatagggtggagtgcgccgtggggagcggcagggcggaacagaggagaccgcccatgcgctccccaaacctggcggcagcgcaaaagatg

SEQ ID NO: 166909 - DNA, 103 bp, Artificial Sequence
  Synthetic Polynucleotide
taatacgactcactatagggggccgctgggttgcgggacgtgaacgcggaaacagaggagatccgcgatgacgtcccgcaacctggcggcagcgcaaaagatg

SEQ ID NO: 166910 - DNA, 103 bp, Artificial Sequence
  Synthetic Polynucleotide
taatacgactcactataggggacagcgtgcggccgctgggttgcgggacgaacagaggagacgtcccatgacccagcggaacctggcggcagcgcaaaagatg

SEQ ID NO: 166911 - DNA, 103 bp, Artificial Sequence
  Synthetic Polynucleotide
taatacgactcactatagggcacctgcagggacagcgtgcggccgctgggaacagaggagacccagcatgcgcacgctgaacctggcggcagcgcaaaagatg

SEQ ID NO: 166912 - DNA, 103 bp, Artificial Sequence
  Synthetic Polynucleotide
taatacgactcactatagggggttggaggccacctgcagggacagcgtgcaacagaggagagcacgcatgccctgcaggaacctggcggcagcgcaaaagatg

SEQ ID NO: 166913 - DNA, 103 bp, Artificial Sequence
  Synthetic Polynucleotide
taatacgactcactatagggcattcgatggggttggaggccacctgcaggaacagaggagacctgcaatgggcctccaaaacctggcggcagcgcaaaagatg

SEQ ID NO: 166914 - DNA, 103 bp, Artificial Sequence
  Synthetic Polynucleotide
taatacgactcactataggggcgctgggagcattcgatggggttggaggcaacagaggagagcctccatgcccatcgaaaacctggcggcagcgcaaaagatg

SEQ ID NO: 166915 - DNA, 103 bp, Artificial Sequence
  Synthetic Polynucleotide
taatacgactcactatagggcctgagctgagcgctgggagcattcgatggaacagaggagaccatcgatggctcccagcaacctggcggcagcgcaaaagatg

SEQ ID NO: 166916 - DNA, 103 bp, Artificial Sequence
  Synthetic Polynucleotide
taatacgactcactatagggagaggcagctcctgagctgagcgctgggagaacagaggagactcccaatgctcagctcaaacctggcggcagcgcaaaagatg

SEQ ID NO: 166917 - DNA, 103 bp, Artificial Sequence
  Synthetic Polynucleotide
taatacgactcactatagggcttctccaccagaggcagctcctgagctgaaacagaggagatcagctatggagctgcctaacctggcggcagcgcaaaagatg

SEQ ID NO: 166918 - DNA, 103 bp, Artificial Sequence
  Synthetic Polynucleotide
taatacgactcactatagggccgtgctctgcttctccaccagaggcagctaacagaggagaagctgcatgtggtggagaaacctggcggcagcgcaaaagatg

SEQ ID NO: 166919 - DNA, 103 bp, Artificial Sequence
  Synthetic Polynucleotide
taatacgactcactataggggccggcagggtggagtgcgccgtggggagcaacagaggagagctcccatgggcgcactcaacctggcggcagcgcaaaagatg

SEQ ID NO: 166920 - DNA, 103 bp, Artificial Sequence
  Synthetic Polynucleotide
taatacgactcactatagggggatagctgtccgtgctctgcttctccaccaacagaggagaggtggaatggcagagcacaacctggcggcagcgcaaaagatg

SEQ ID NO: 166921 - DNA, 103 bp, Artificial Sequence
  Synthetic Polynucleotide
taatacgactcactataggggcccacgaccggatagctgtccgtgctctgaacagaggagacagagcatggacagctataacctggcggcagcgcaaaagatg

SEQ ID NO: 166922 - DNA, 103 bp, Artificial Sequence
  Synthetic Polynucleotide
taatacgactcactatagggtcttcttcccgcccacgaccggatagctgtaacagaggagaacagctatgcggtcgtggaacctggcggcagcgcaaaagatg

SEQ ID NO: 166923 - DNA, 103 bp, Artificial Sequence
  Synthetic Polynucleotide
taatacgactcactataggggacaggaccatcttcttcccgcccacgaccaacagaggagaggtcgtatgcgggaagaaaacctggcggcagcgcaaaagatg

SEQ ID NO: 166924 - DNA, 103 bp, Artificial Sequence
  Synthetic Polynucleotide
taatacgactcactataggggttgtggccagacaggaccatcttcttcccaacagaggagagggaagatgatggtcctgaacctggcggcagcgcaaaagatg

SEQ ID NO: 166925 - DNA, 103 bp, Artificial Sequence
  Synthetic Polynucleotide
taatacgactcactatagggcctgcaggaagttgtggccagacaggaccaaacagaggagatggtccatgctggccacaaacctggcggcagcgcaaaagatg

SEQ ID NO: 166926 - DNA, 103 bp, Artificial Sequence
  Synthetic Polynucleotide
taatacgactcactatagggaccttggagtcctgcaggaagttgtggccaaacagaggagatggccaatgcttcctgcaaacctggcggcagcgcaaaagatg

SEQ ID NO: 166927 - DNA, 103 bp, Artificial Sequence
  Synthetic Polynucleotide
taatacgactcactatagggcacgaaaatgaccttggagtcctgcaggaaaacagaggagattcctgatggactccaagaacctggcggcagcgcaaaagatg

SEQ ID NO: 166928 - DNA, 103 bp, Artificial Sequence
  Synthetic Polynucleotide
taatacgactcactataggggggctttctccacgaaaatgaccttggagtaacagaggagaactccaatgtcattttcgaacctggcggcagcgcaaaagatg

SEQ ID NO: 166929 - DNA, 103 bp, Artificial Sequence
  Synthetic Polynucleotide
taatacgactcactatagggtggccatctggggctttctccacgaaaatgaacagaggagacattttatgggagaaagcaacctggcggcagcgcaaaagatg

SEQ ID NO: 166930 - DNA, 103 bp, Artificial Sequence
  Synthetic Polynucleotide
taatacgactcactataggggtggcacggggccggcagggtggagtgcgcaacagaggagagcgcacatgaccctgccgaacctggcggcagcgcaaaagatg

SEQ ID NO: 166931 - DNA, 103 bp, Artificial Sequence
  Synthetic Polynucleotide
taatacgactcactatagggccagacatggtggccatctggggctttctcaacagaggagagagaaaatgccagatggcaacctggcggcagcgcaaaagatg

SEQ ID NO: 166932 - DNA, 103 bp, Artificial Sequence
  Synthetic Polynucleotide
taatacgactcactatagggcttccatctcccagacatggtggccatctgaacagaggagacagatgatgaccatgtctaacctggcggcagcgcaaaagatg

SEQ ID NO: 166933 - DNA, 103 bp, Artificial Sequence
  Synthetic Polynucleotide
taatacgactcactatagggtcagttttcgcttccatctcccagacatggaacagaggagaccatgtatgggagatggaaacctggcggcagcgcaaaagatg

SEQ ID NO: 166934 - DNA, 103 bp, Artificial Sequence
  Synthetic Polynucleotide
taatacgactcactatagggcaggtcccggtcagttttcgcttccatctcaacagaggagagagatgatggcgaaaactaacctggcggcagcgcaaaagatg

SEQ ID NO: 166935 - DNA, 103 bp, Artificial Sequence
  Synthetic Polynucleotide
taatacgactcactatagggtcggcttgcacaggtcccggtcagttttcgaacagaggagacgaaaaatgaccgggaccaacctggcggcagcgcaaaagatg

SEQ ID NO: 166936 - DNA, 103 bp, Artificial Sequence
  Synthetic Polynucleotide
taatacgactcactatagggaccagagaattcggcttgcacaggtcccggaacagaggagaccgggaatggtgcaagccaacctggcggcagcgcaaaagatg

SEQ ID NO: 166937 - DNA, 103 bp, Artificial Sequence
  Synthetic Polynucleotide
taatacgactcactataggggatctcaaccaccagagaattcggcttgcaaacagaggagatgcaagatgaattctctgaacctggcggcagcgcaaaagatg

SEQ ID NO: 166938 - DNA, 103 bp, Artificial Sequence
  Synthetic Polynucleotide
taatacgactcactataggggaaatggcgggatctcaaccaccagagaataacagaggagaattctcatgtggttgagaaacctggcggcagcgcaaaagatg

SEQ ID NO: 166939 - DNA, 103 bp, Artificial Sequence
  Synthetic Polynucleotide
taatacgactcactatagggctctgattccgaaatggcgggatctcaaccaacagaggagaggttgaatgcccgccattaacctggcggcagcgcaaaagatg

SEQ ID NO: 166940 - DNA, 103 bp, Artificial Sequence
  Synthetic Polynucleotide
taatacgactcactataggggctggttatcctctgattccgaaatggcggaacagaggagaccgccaatgcggaatcagaacctggcggcagcgcaaaagatg

SEQ ID NO: 166941 - DNA, 103 bp, Artificial Sequence
  Synthetic Polynucleotide
taatacgactcactataggggtggaaacttggaagggactggaaagctggaacagaggagaccagctatgcagtcccttaacctggcggcagcgcaaaagatg

SEQ ID NO: 166942 - DNA, 103 bp, Artificial Sequence
  Synthetic Polynucleotide
taatacgactcactatagggtctgaaggttgtggcacggggccggcagggaacagaggagaccctgcatgccccgtgccaacctggcggcagcgcaaaagatg

SEQ ID NO: 166943 - DNA, 103 bp, Artificial Sequence
  Synthetic Polynucleotide
taatacgactcactatagggcgtgaacggggctggttatcctctgattccaacagaggagaggaatcatgggataaccaaacctggcggcagcgcaaaagatg

SEQ ID NO: 166944 - DNA, 103 bp, Artificial Sequence
  Synthetic Polynucleotide
taatacgactcactatagggtagaaactgacgtgaacggggctggttatcaacagaggagagataacatgccccgttcaaacctggcggcagcgcaaaagatg

SEQ ID NO: 166945 - DNA, 103 bp, Artificial Sequence
  Synthetic Polynucleotide
taatacgactcactataggggttgcagacgtagaaactgacgtgaacgggaacagaggagacccgttatggtcagtttcaacctggcggcagcgcaaaagatg

SEQ ID NO: 166946 - DNA, 103 bp, Artificial Sequence
  Synthetic Polynucleotide
taatacgactcactatagggttctcttcccgttgcagacgtagaaactgaaacagaggagatcagttatgacgtctgcaaacctggcggcagcgcaaaagatg

SEQ ID NO: 166947 - DNA, 103 bp, Artificial Sequence
  Synthetic Polynucleotide
taatacgactcactatagggtggcttcgctttctcttcccgttgcagacgaacagaggagacgtctgatgcgggaagagaacctggcggcagcgcaaaagatg

SEQ ID NO: 166948 - DNA, 103 bp, Artificial Sequence
  Synthetic Polynucleotide
taatacgactcactatagggacgctggtactggcttcgctttctcttcccaacagaggagagggaagatgaagcgaagcaacctggcggcagcgcaaaagatg

SEQ ID NO: 166949 - DNA, 103 bp, Artificial Sequence
  Synthetic Polynucleotide
taatacgactcactatagggggtaggtgaaacgctggtactggcttcgctaacagaggagaagcgaaatgagtaccagcaacctggcggcagcgcaaaagatg

SEQ ID NO: 166950 - DNA, 103 bp, Artificial Sequence
  Synthetic Polynucleotide
taatacgactcactatagggttggcgggaaggtaggtgaaacgctggtacaacagaggagagtaccaatgtttcacctaaacctggcggcagcgcaaaagatg

SEQ ID NO: 166951 - DNA, 103 bp, Artificial Sequence
  Synthetic Polynucleotide
taatacgactcactatagggaattggaacgttggcgggaaggtaggtgaaaacagaggagattcaccatgcttcccgccaacctggcggcagcgcaaaagatg

SEQ ID NO: 166952 - DNA, 103 bp, Artificial Sequence
  Synthetic Polynucleotide
taatacgactcactatagggctgtttttataattggaacgttggcgggaaaacagaggagattcccgatgacgttccaaaacctggcggcagcgcaaaagatg

SEQ ID NO: 166953 - DNA, 103 bp, Artificial Sequence
  Synthetic Polynucleotide
taatacgactcactatagggggtgtggaggtctgaaggttgtggcacgggaacagaggagacccgtgatgcaaccttcaaacctggcggcagcgcaaaagatg

SEQ ID NO: 166954 - DNA, 103 bp, Artificial Sequence
  Synthetic Polynucleotide
taatacgactcactatagggtcagtgggttctgtttttataattggaacgaacagaggagacgttccatgtataaaaacaacctggcggcagcgcaaaagatg

SEQ ID NO: 166955 - DNA, 103 bp, Artificial Sequence
  Synthetic Polynucleotide
taatacgactcactatagggctcataatcatcagtgggttctgtttttataacagaggagaataaaaatggaacccactaacctggcggcagcgcaaaagatg

SEQ ID NO: 166956 - DNA, 103 bp, Artificial Sequence
  Synthetic Polynucleotide
taatacgactcactatagggttggagcaggctcataatcatcagtgggttaacagaggagaaacccaatgatgattatgaacctggcggcagcgcaaaagatg

SEQ ID NO: 166957 - DNA, 103 bp, Artificial Sequence
  Synthetic Polynucleotide
taatacgactcactatagggggtccacaggttggagcaggctcataatcaaacagaggagatgattaatggcctgctccaacctggcggcagcgcaaaagatg

SEQ ID NO: 166958 - DNA, 103 bp, Artificial Sequence
  Synthetic Polynucleotide
taatacgactcactatagggctggctcaccggtccacaggttggagcaggaacagaggagacctgctatgacctgtggaaacctggcggcagcgcaaaagatg

SEQ ID NO: 166959 - DNA, 103 bp, Artificial Sequence
  Synthetic Polynucleotide
taatacgactcactataggggacttaacccctggctcaccggtccacaggaacagaggagacctgtgatgcggtgagccaacctggcggcagcgcaaaagatg

SEQ ID NO: 166960 - DNA, 103 bp, Artificial Sequence
  Synthetic Polynucleotide
taatacgactcactatagggcttgggagaggacttaacccctggctcaccaacagaggagaggtgagatgggggttaagaacctggcggcagcgcaaaagatg

SEQ ID NO: 166961 - DNA, 103 bp, Artificial Sequence
  Synthetic Polynucleotide
taatacgactcactataggggtagtatggtcttgggagaggacttaacccaacagaggagagggttaatgcctctcccaaacctggcggcagcgcaaaagatg

SEQ ID NO: 166962 - DNA, 103 bp, Artificial Sequence
  Synthetic Polynucleotide
taatacgactcactataggggctgctggctgtagtatggtcttgggagagaacagaggagactctccatggaccatactaacctggcggcagcgcaaaagatg

SEQ ID NO: 166963 - DNA, 103 bp, Artificial Sequence
  Synthetic Polynucleotide
taatacgactcactatagggggcatcgcgagctgctggctgtagtatggtaacagaggagaaccataatgcagccagcaaacctggcggcagcgcaaaagatg

SEQ ID NO: 166964 - DNA, 103 bp, Artificial Sequence
  Synthetic Polynucleotide
taatacgactcactataggggatgatgcccggtgtggaggtctgaaggttaacagaggagaaaccttatgacctccacaaacctggcggcagcgcaaaagatg

SEQ ID NO: 166965 - DNA, 103 bp, Artificial Sequence
  Synthetic Polynucleotide
taatacgactcactatagggggggtcgggtggcatcgcgagctgctggctaacagaggagaagccagatgctcgcgatgaacctggcggcagcgcaaaagatg

SEQ ID NO: 166966 - DNA, 103 bp, Artificial Sequence
  Synthetic Polynucleotide
taatacgactcactatagggggcaggagctggggtcgggtggcatcgcgaaacagaggagatcgcgaatgcacccgaccaacctggcggcagcgcaaaagatg

SEQ ID NO: 166967 - DNA, 103 bp, Artificial Sequence
  Synthetic Polynucleotide
taatacgactcactatagggccggccacgaggcaggagctggggtcgggtaacagaggagaacccgaatgcagctcctgaacctggcggcagcgcaaaagatg

SEQ ID NO: 166968 - DNA, 103 bp, Artificial Sequence
  Synthetic Polynucleotide
taatacgactcactataggggggcgggaagccggccacgaggcaggagctaacagaggagaagctccatgctcgtggccaacctggcggcagcgcaaaagatg

SEQ ID NO: 166969 - DNA, 103 bp, Artificial Sequence
  Synthetic Polynucleotide
taatacgactcactatagggtctgcggacagggcgggaagccggccacgaaacagaggagatcgtggatggcttcccgcaacctggcggcagcgcaaaagatg

SEQ ID NO: 166970 - DNA, 103 bp, Artificial Sequence
  Synthetic Polynucleotide
taatacgactcactatagggagggtgcttctctgcggacagggcgggaagaacagaggagacttcccatgctgtccgcaaacctggcggcagcgcaaaagatg

SEQ ID NO: 166971 - DNA, 103 bp, Artificial Sequence
  Synthetic Polynucleotide
taatacgactcactatagggcgctggcatcagggtgcttctctgcggacaaacagaggagatgtccgatgagaagcaccaacctggcggcagcgcaaaagatg

SEQ ID NO: 166972 - DNA, 103 bp, Artificial Sequence
  Synthetic Polynucleotide
taatacgactcactatagggcgccaggggccgctggcatcagggtgcttcaacagaggagagaagcaatgtgatgccagaacctggcggcagcgcaaaagatg

SEQ ID NO: 166973 - DNA, 103 bp, Artificial Sequence
  Synthetic Polynucleotide
taatacgactcactatagggttggggctcacgccaggggccgctggcatcaacagaggagagatgccatgggcccctggaacctggcggcagcgcaaaagatg

SEQ ID NO: 166974 - DNA, 103 bp, Artificial Sequence
  Synthetic Polynucleotide
taatacgactcactataggggtcgtggagcttggggctcacgccaggggcaacagaggagagcccctatggtgagccccaacctggcggcagcgcaaaagatg

SEQ ID NO: 166975 - DNA, 103 bp, Artificial Sequence
  Synthetic Polynucleotide
taatacgactcactatagggccgccggcgggatgatgcccggtgtggaggaacagaggagacctccaatgcgggcatcaaacctggcggcagcgcaaaagatg

SEQ ID NO: 166976 - DNA, 103 bp, Artificial Sequence
  Synthetic Polynucleotide
taatacgactcactatagggcgggagaaaggtcgtggagcttggggctcaaacagaggagatgagccatgagctccacgaacctggcggcagcgcaaaagatg

SEQ ID NO: 166977 - DNA, 103 bp, Artificial Sequence
  Synthetic Polynucleotide
taatacgactcactataggggtgtaggcagcgggagaaaggtcgtggagcaacagaggagagctccaatgcctttctccaacctggcggcagcgcaaaagatg

SEQ ID NO: 166978 - DNA, 103 bp, Artificial Sequence
  Synthetic Polynucleotide
taatacgactcactatagggaacgcccttggtgtaggcagcgggagaaagaacagaggagactttctatggctgcctacaacctggcggcagcgcaaaagatg

SEQ ID NO: 166979 - DNA, 103 bp, Artificial Sequence
  Synthetic Polynucleotide
taatacgactcactatagggccgggctggcaacgcccttggtgtaggcagaacagaggagactgcctatgccaagggcgaacctggcggcagcgcaaaagatg

SEQ ID NO: 166980 - DNA, 103 bp, Artificial Sequence
  Synthetic Polynucleotide
taatacgactcactatagggtgacagtggcccgggctggcaacgcccttgaacagaggagacaagggatgtgccagcccaacctggcggcagcgcaaaagatg

SEQ ID NO: 166981 - DNA, 103 bp, Artificial Sequence
  Synthetic Polynucleotide
taatacgactcactataggggagtccgaggtgacagtggcccgggctggcaacagaggagagccagcatgggccactgtaacctggcggcagcgcaaaagatg

SEQ ID NO: 166982 - DNA, 103 bp, Artificial Sequence
  Synthetic Polynucleotide
taatacgactcactatagggccggctgcgggagtccgaggtgacagtggcaacagaggagagccactatgacctcggacaacctggcggcagcgcaaaagatg

SEQ ID NO: 166983 - DNA, 103 bp, Artificial Sequence
  Synthetic Polynucleotide
taatacgactcactataggggcctctccggccggctgcgggagtccgaggaacagaggagacctcggatgcccgcagccaacctggcggcagcgcaaaagatg

SEQ ID NO: 166984 - DNA, 103 bp, Artificial Sequence
  Synthetic Polynucleotide
taatacgactcactataggggacggcgggggcctctccggccggctgcggaacagaggagaccgcagatggccggagagaacctggcggcagcgcaaaagatg

SEQ ID NO: 166985 - DNA, 103 bp, Artificial Sequence
  Synthetic Polynucleotide
taatacgactcactataggggcacgtcctggacggcgggggcctctccggaacagaggagaccggagatgcccccgccgaacctggcggcagcgcaaaagatg

SEQ ID NO: 166986 - DNA, 103 bp, Artificial Sequence
  Synthetic Polynucleotide
taatacgactcactataggggaggggtgatccgccggcgggatgatgcccaacagaggagagggcatatgcccgccggcaacctggcggcagcgcaaaagatg

SEQ ID NO: 166987 - DNA, 103 bp, Artificial Sequence
  Synthetic Polynucleotide
taatacgactcactatagggactggcctgggcacgtcctggacggcggggaacagaggagaccccgcatgccaggacgtaacctggcggcagcgcaaaagatg

SEQ ID NO: 166988 - DNA, 103 bp, Artificial Sequence
  Synthetic Polynucleotide
taatacgactcactataggggtgcgtggccactggcctgggcacgtcctgaacagaggagacaggacatgcccaggccaaacctggcggcagcgcaaaagatg

SEQ ID NO: 166989 - DNA, 103 bp, Artificial Sequence
  Synthetic Polynucleotide
taatacgactcactataggggcgagccggggtgcgtggccactggcctggaacagaggagaccaggcatgtggccacgcaacctggcggcagcgcaaaagatg

SEQ ID NO: 166990 - DNA, 103 bp, Artificial Sequence
  Synthetic Polynucleotide
taatacgactcactatagggggctgcccgggcgagccggggtgcgtggccaacagaggagaggccacatgccccggctcaacctggcggcagcgcaaaagatg

SEQ ID NO: 166991 - DNA, 103 bp, Artificial Sequence
  Synthetic Polynucleotide
taatacgactcactatagggggccgggggtggctgcccgggcgagccgggaacagaggagacccggcatgcccgggcagaacctggcggcagcgcaaaagatg

SEQ ID NO: 166992 - DNA, 103 bp, Artificial Sequence
  Synthetic Polynucleotide
taatacgactcactataggggtggcagcagggccgggggtggctgcccggaacagaggagaccgggcatgcacccccggaacctggcggcagcgcaaaagatg

SEQ ID NO: 166993 - DNA, 103 bp, Artificial Sequence
  Synthetic Polynucleotide
taatacgactcactatagggtccgtaccccgaggggtgatccgccggcggaacagaggagaccgccgatggatcaccccaacctggcggcagcgcaaaagatg

SEQ ID NO: 166994 - DNA, 103 bp, Artificial Sequence
  Synthetic Polynucleotide
taatacgactcactatagggccaaagctgctccgtaccccgaggggtgataacagaggagaatcaccatgcggggtacgaacctggcggcagcgcaaaagatg

SEQ ID NO: 166995 - DNA, 103 bp, Artificial Sequence
  Synthetic Polynucleotide
taatacgactcactatagggggcccaccgtccaaagctgctccgtaccccaacagaggagaggggtaatgagcagctttaacctggcggcagcgcaaaagatg

SEQ ID NO: 166996 - DNA, 103 bp, Artificial Sequence
  Synthetic Polynucleotide
taatacgactcactataggggtagcccgcgggcccaccgtccaaagctgcaacagaggagagcagctatggacggtgggaacctggcggcagcgcaaaagatg

SEQ ID NO: 166997 - DNA, 103 bp, Artificial Sequence
  Synthetic Polynucleotide
taatacgactcactatagggaggagaggaagtagcccgcgggcccaccgtaacagaggagaacggtgatgccgcgggctaacctggcggcagcgcaaaagatg

SEQ ID NO: 166998 - DNA, 103 bp, Artificial Sequence
  Synthetic Polynucleotide
taatacgactcactataggggcagggccaagtggaaacttggaagggactaacagaggagaagtcccatgcaagtttccaacctggcggcagcgcaaaagatg

SEQ ID NO: 166999 - DNA, 103 bp, Artificial Sequence
  Synthetic Polynucleotide
taatacgactcactataggggtgtggccggaggagaggaagtagcccgcgaacagaggagacgcgggatgcttcctctcaacctggcggcagcgcaaaagatg

SEQ ID NO: 167000 - DNA, 103 bp, Artificial Sequence
  Synthetic Polynucleotide
taatacgactcactatagggatcaggcctggtgtggccggaggagaggaaaacagaggagattcctcatgtccggccacaacctggcggcagcgcaaaagatg

SEQ ID NO: 167001 - DNA, 103 bp, Artificial Sequence
  Synthetic Polynucleotide
taatacgactcactatagggcaggggccccatcaggcctggtgtggccggaacagaggagaccggccatgccaggcctgaacctggcggcagcgcaaaagatg

SEQ ID NO: 167002 - DNA, 103 bp, Artificial Sequence
  Synthetic Polynucleotide
taatacgactcactatagggctctccagggcaggggccccatcaggcctgaacagaggagacaggccatgtggggccccaacctggcggcagcgcaaaagatg

SEQ ID NO: 167003 - DNA, 103 bp, Artificial Sequence
  Synthetic Polynucleotide
taatacgactcactataggggatgcgaggactctccagggcaggggccccaacagaggagaggggccatggccctggagaacctggcggcagcgcaaaagatg

SEQ ID NO: 167004 - DNA, 103 bp, Artificial Sequence
  Synthetic Polynucleotide
taatacgactcactatagggaggttatctcgatgcgaggactctccagggaacagaggagaccctggatggtcctcgcaaacctggcggcagcgcaaaagatg

SEQ ID NO: 167005 - DNA, 103 bp, Artificial Sequence
  Synthetic Polynucleotide
taatacgactcactatagggcccaagcacgaggttatctcgatgcgaggaaacagaggagatcctcgatgcgagataacaacctggcggcagcgcaaaagatg

SEQ ID NO: 167006 - DNA, 103 bp, Artificial Sequence
  Synthetic Polynucleotide
taatacgactcactataggggtggtacaggcccaagcacgaggttatctcaacagaggagagagataatgtcgtgcttgaacctggcggcagcgcaaaagatg

SEQ ID NO: 167007 - DNA, 103 bp, Artificial Sequence
  Synthetic Polynucleotide
taatacgactcactatagggggttattgttgtggtacaggcccaagcacgaacagaggagacgtgctatggcctgtaccaacctggcggcagcgcaaaagatg

SEQ ID NO: 167008 - DNA, 103 bp, Artificial Sequence
  Synthetic Polynucleotide
taatacgactcactatagggtggaaaaactggttattgttgtggtacaggaacagaggagacctgtaatgcaacaataaaacctggcggcagcgcaaaagatg

SEQ ID NO: 167009 - DNA, 103 bp, Artificial Sequence
  Synthetic Polynucleotide
taatacgactcactataggggaccgcagccgcagggccaagtggaaacttaacagaggagaaagtttatgcttggccctaacctggcggcagcgcaaaagatg

SEQ ID NO: 167010 - DNA, 103 bp, Artificial Sequence
  Synthetic Polynucleotide
taatacgactcactatagggctccacatcgtggaaaaactggttattgttaacagaggagaaacaatatgcagtttttcaacctggcggcagcgcaaaagatg

SEQ ID NO: 167011 - DNA, 103 bp, Artificial Sequence
  Synthetic Polynucleotide
taatacgactcactatagggcgtcttccacctccacatcgtggaaaaactaacagaggagaagttttatgacgatgtggaacctggcggcagcgcaaaagatg

SEQ ID NO: 167012 - DNA, 103 bp, Artificial Sequence
  Synthetic Polynucleotide
taatacgactcactatagggctagggaggacgtcttccacctccacatcgaacagaggagacgatgtatgggtggaagaaacctggcggcagcgcaaaagatg

SEQ ID NO: 167013 - DNA, 103 bp, Artificial Sequence
  Synthetic Polynucleotide
taatacgactcactatagggccgtttggagctagggaggacgtcttccacaacagaggagagtggaaatggtcctccctaacctggcggcagcgcaaaagatg

SEQ ID NO: 167014 - DNA, 103 bp, Artificial Sequence
  Synthetic Polynucleotide
taatacgactcactatagggtggagggggaccgtttggagctagggaggaaacagaggagatcctccatggctccaaacaacctggcggcagcgcaaaagatg

SEQ ID NO: 167015 - DNA, 103 bp, Artificial Sequence
  Synthetic Polynucleotide
taatacgactcactatagggagcgtggccgtggagggggaccgtttggagaacagaggagactccaaatggtccccctcaacctggcggcagcgcaaaagatg

SEQ ID NO: 167016 - DNA, 103 bp, Artificial Sequence
  Synthetic Polynucleotide
taatacgactcactataggggggcagactcagcgtggccgtggagggggaaacagaggagatcccccatgacggccacgaacctggcggcagcgcaaaagatg

SEQ ID NO: 167017 - DNA, 103 bp, Artificial Sequence
  Synthetic Polynucleotide
taatacgactcactatagggcctccaggctgggcagactcagcgtggccgaacagaggagacggccaatgtgagtctgcaacctggcggcagcgcaaaagatg

SEQ ID NO: 167018 - DNA, 103 bp, Artificial Sequence
  Synthetic Polynucleotide
taatacgactcactatagggtctctgtaggcctccaggctgggcagactcaacagaggagagagtctatgcagcctggaaacctggcggcagcgcaaaagatg

SEQ ID NO: 167019 - DNA, 103 bp, Artificial Sequence
  Synthetic Polynucleotide
taatacgactcactataggggcacgaggggtctctgtaggcctccaggctaacagaggagaagcctgatggcctacagaaacctggcggcagcgcaaaagatg

SEQ ID NO: 167020 - DNA, 103 bp, Artificial Sequence
  Synthetic Polynucleotide
taatacgactcactatagggctctcccgaagaccgcagccgcagggccaaaacagaggagattggccatgcggctgcggaacctggcggcagcgcaaaagatg

SEQ ID NO: 167021 - DNA, 103 bp, Artificial Sequence
  Synthetic Polynucleotide
taatacgactcactatagggccgggctcaggcacgaggggtctctgtaggaacagaggagacctacaatgacccctcgtaacctggcggcagcgcaaaagatg

SEQ ID NO: 167022 - DNA, 103 bp, Artificial Sequence
  Synthetic Polynucleotide
taatacgactcactatagggaggctgctggccgggctcaggcacgaggggaacagaggagacccctcatgcctgagcccaacctggcggcagcgcaaaagatg

SEQ ID NO: 167023 - DNA, 103 bp, Artificial Sequence
  Synthetic Polynucleotide
taatacgactcactatagggccgggaggacaggctgctggccgggctcagaacagaggagactgagcatggccagcagcaacctggcggcagcgcaaaagatg

SEQ ID NO: 167024 - DNA, 103 bp, Artificial Sequence
  Synthetic Polynucleotide
taatacgactcactatagggagttgcagctccgggaggacaggctgctggaacagaggagaccagcaatgtgtcctcccaacctggcggcagcgcaaaagatg

SEQ ID NO: 167025 - DNA, 103 bp, Artificial Sequence
  Synthetic Polynucleotide
taatacgactcactataggggaggcctctgagttgcagctccgggaggacaacagaggagagtcctcatggagctgcaaaacctggcggcagcgcaaaagatg

SEQ ID NO: 167026 - DNA, 103 bp, Artificial Sequence
  Synthetic Polynucleotide
taatacgactcactatagggctcgtaggaggaggcctctgagttgcagctaacagaggagaagctgcatgtcagaggccaacctggcggcagcgcaaaagatg

SEQ ID NO: 167027 - DNA, 103 bp, Artificial Sequence
  Synthetic Polynucleotide
taatacgactcactatagggagtagttggactcgtaggaggaggcctctgaacagaggagacagaggatgcctcctacgaacctggcggcagcgcaaaagatg

SEQ ID NO: 167028 - DNA, 103 bp, Artificial Sequence
  Synthetic Polynucleotide
taatacgactcactatagggtacgggtacgagtagttggactcgtaggagaacagaggagactcctaatggtccaactaaacctggcggcagcgcaaaagatg

SEQ ID NO: 167029 - DNA, 103 bp, Artificial Sequence
  Synthetic Polynucleotide
taatacgactcactataggggggggacgcgtacgggtacgagtagttggaaacagaggagatccaacatgtcgtacccgaacctggcggcagcgcaaaagatg

SEQ ID NO: 167030 - DNA, 103 bp, Artificial Sequence
  Synthetic Polynucleotide
taatacgactcactataggggcgacgtctggggggacgcgtacgggtacgaacagaggagacgtaccatgacgcgtcccaacctggcggcagcgcaaaagatg

SEQ ID NO: 167031 - DNA, 103 bp, Artificial Sequence
  Synthetic Polynucleotide
taatacgactcactatagggaaagtttctcctctcccgaagaccgcagccaacagaggagaggctgcatgcttcgggagaacctggcggcagcgcaaaagatg

SEQ ID NO: 167032 - DNA, 103 bp, Artificial Sequence
  Synthetic Polynucleotide
taatacgactcactataggggactgccatggcgacgtctggggggacgcgaacagaggagacgcgtcatgccagacgtcaacctggcggcagcgcaaaagatg

SEQ ID NO: 167033 - DNA, 103 bp, Artificial Sequence
  Synthetic Polynucleotide
taatacgactcactatagggcacgcagggagactgccatggcgacgtctgaacagaggagacagacgatgccatggcagaacctggcggcagcgcaaaagatg

SEQ ID NO: 167034 - DNA, 103 bp, Artificial Sequence
  Synthetic Polynucleotide
taatacgactcactatagggtcttgggagacacgcagggagactgccatgaacagaggagacatggcatgctccctgcgaacctggcggcagcgcaaaagatg

SEQ ID NO: 167035 - DNA, 103 bp, Artificial Sequence
  Synthetic Polynucleotide
taatacgactcactataggggggtccgtggtcttgggagacacgcagggaaacagaggagatccctgatggtctcccaaaacctggcggcagcgcaaaagatg

SEQ ID NO: 167036 - DNA, 103 bp, Artificial Sequence
  Synthetic Polynucleotide
taatacgactcactataggggccctcctcggggtccgtggtcttgggagaaacagaggagatctcccatgaccacggacaacctggcggcagcgcaaaagatg

SEQ ID NO: 167037 - DNA, 103 bp, Artificial Sequence
  Synthetic Polynucleotide
taatacgactcactatagggcgcggggaaagccctcctcggggtccgtggaacagaggagaccacggatgccgaggaggaacctggcggcagcgcaaaagatg

SEQ ID NO: 167038 - DNA, 103 bp, Artificial Sequence
  Synthetic Polynucleotide
taatacgactcactataggggcccccagcccgcggggaaagccctcctcgaacagaggagacgaggaatgctttccccgaacctggcggcagcgcaaaagatg

SEQ ID NO: 167039 - DNA, 103 bp, Artificial Sequence
  Synthetic Polynucleotide
taatacgactcactatagggcagtgtgcaggcccccagcccgcggggaaaaacagaggagatttcccatggggctggggaacctggcggcagcgcaaaagatg

SEQ ID NO: 167040 - DNA, 103 bp, Artificial Sequence
  Synthetic Polynucleotide
taatacgactcactataggggggaacccagcagtgtgcaggcccccagccaacagaggagaggctggatgcctgcacacaacctggcggcagcgcaaaagatg

SEQ ID NO: 167041 - DNA, 103 bp, Artificial Sequence
  Synthetic Polynucleotide
taatacgactcactataggggagtgccgcggggaacccagcagtgtgcagaacagaggagactgcacatggctgggttcaacctggcggcagcgcaaaagatg

SEQ ID NO: 167042 - DNA, 103 bp, Artificial Sequence
  Synthetic Polynucleotide
taatacgactcactatagggcgcgggccccaaagtttctcctctcccgaaaacagaggagattcgggatgggagaaactaacctggcggcagcgcaaaagatg

SEQ ID NO: 167043 - DNA, 103 bp, Artificial Sequence
  Synthetic Polynucleotide
taatacgactcactatagggggtggagggggagtgccgcggggaacccagaacagaggagactgggtatgccgcggcacaacctggcggcagcgcaaaagatg

SEQ ID NO: 167044 - DNA, 103 bp, Artificial Sequence
  Synthetic Polynucleotide
taatacgactcactatagggcgcggggcgaggtggagggggagtgccgcgaacagaggagacgcggcatgccccctccaaacctggcggcagcgcaaaagatg

SEQ ID NO: 167045 - DNA, 103 bp, Artificial Sequence
  Synthetic Polynucleotide
taatacgactcactataggggtgacgctggcgcggggcgaggtggaggggaacagaggagacccctcatgctcgccccgaacctggcggcagcgcaaaagatg

SEQ ID NO: 167046 - DNA, 103 bp, Artificial Sequence
  Synthetic Polynucleotide
taatacgactcactataggggctctcctcagtgacgctggcgcggggcgaaacagaggagatcgcccatggccagcgtcaacctggcggcagcgcaaaagatg

SEQ ID NO: 167047 - DNA, 103 bp, Artificial Sequence
  Synthetic Polynucleotide
taatacgactcactatagggcacccagccagctctcctcagtgacgctggaacagaggagaccagcgatgctgaggagaaacctggcggcagcgcaaaagatg

SEQ ID NO: 167048 - DNA, 103 bp, Artificial Sequence
  Synthetic Polynucleotide
taatacgactcactataggggaggagcgggcacccagccagctctcctcaaacagaggagatgaggaatgctggctgggaacctggcggcagcgcaaaagatg

SEQ ID NO: 167049 - DNA, 103 bp, Artificial Sequence
  Synthetic Polynucleotide
taatacgactcactatagggcgcgggtctggaggagcgggcacccagccaaacagaggagatggctgatggcccgctccaacctggcggcagcgcaaaagatg

SEQ ID NO: 167050 - DNA, 103 bp, Artificial Sequence
  Synthetic Polynucleotide
taatacgactcactatagggtgcaaggggacgcgggtctggaggagcgggaacagaggagacccgctatgccagacccgaacctggcggcagcgcaaaagatg

SEQ ID NO: 167051 - DNA, 103 bp, Artificial Sequence
  Synthetic Polynucleotide
taatacgactcactatagggttcctcttgttgcaaggggacgcgggtctgaacagaggagacagaccatggtccccttgaacctggcggcagcgcaaaagatg

SEQ ID NO: 167052 - DNA, 103 bp, Artificial Sequence
  Synthetic Polynucleotide
taatacgactcactataggggaggctgtacttcctcttgttgcaaggggaaacagaggagatcccctatgaacaagaggaacctggcggcagcgcaaaagatg

SEQ ID NO: 167053 - DNA, 103 bp, Artificial Sequence
  Synthetic Polynucleotide
taatacgactcactatagggcggcgcgcggcgcgggccccaaagtttctcaacagaggagagagaaaatgtggggcccgaacctggcggcagcgcaaaagatg

SEQ ID NO: 167054 - DNA, 103 bp, Artificial Sequence
  Synthetic Polynucleotide
taatacgactcactataggggccggccgttgaggctgtacttcctcttgtaacagaggagaacaagaatgagtacagccaacctggcggcagcgcaaaagatg

SEQ ID NO: 167055 - DNA, 103 bp, Artificial Sequence
  Synthetic Polynucleotide
taatacgactcactatagggtagggcggctgccggccgttgaggctgtacaacagaggagagtacagatgcaacggccgaacctggcggcagcgcaaaagatg

SEQ ID NO: 167056 - DNA, 103 bp, Artificial Sequence
  Synthetic Polynucleotide
taatacgactcactataggggtggggtgagtagggcggctgccggccgttaacagaggagaaacggcatgcagccgcccaacctggcggcagcgcaaaagatg

SEQ ID NO: 167057 - DNA, 103 bp, Artificial Sequence
  Synthetic Polynucleotide
taatacgactcactatagggtgggcgagtggtggggtgagtagggcggctaacagaggagaagccgcatgactcaccccaacctggcggcagcgcaaaagatg

SEQ ID NO: 167058 - DNA, 103 bp, Artificial Sequence
  Synthetic Polynucleotide
taatacgactcactatagggggggacggcgtgggcgagtggtggggtgagaacagaggagactcaccatgccactcgccaacctggcggcagcgcaaaagatg

SEQ ID NO: 167059 - DNA, 103 bp, Artificial Sequence
  Synthetic Polynucleotide
taatacgactcactatagggggagccgtgcggggacggcgtgggcgagtgaacagaggagacactcgatgacgccgtccaacctggcggcagcgcaaaagatg

SEQ ID NO: 167060 - DNA, 103 bp, Artificial Sequence
  Synthetic Polynucleotide
taatacgactcactatagggtgacccgcggggagccgtgcggggacggcgaacagaggagacgccgtatgcgcacggctaacctggcggcagcgcaaaagatg

SEQ ID NO: 167061 - DNA, 103 bp, Artificial Sequence
  Synthetic Polynucleotide
taatacgactcactatagggtcggtcacgctgacccgcggggagccgtgcaacagaggagagcacggatgcccgcgggtaacctggcggcagcgcaaaagatg

SEQ ID NO: 167062 - DNA, 103 bp, Artificial Sequence
  Synthetic Polynucleotide
taatacgactcactatagggccacgagtcgtcggtcacgctgacccgcggaacagaggagaccgcggatgagcgtgaccaacctggcggcagcgcaaaagatg

SEQ ID NO: 167063 - DNA, 103 bp, Artificial Sequence
  Synthetic Polynucleotide
taatacgactcactatagggtgttgcccaaccacgagtcgtcggtcacgcaacagaggagagcgtgaatgacgactcgtaacctggcggcagcgcaaaagatg

SEQ ID NO: 167064 - DNA, 103 bp, Artificial Sequence
  Synthetic Polynucleotide
taatacgactcactatagggatggtgccgccggcgcgcggcgcgggccccaacagaggagaggggccatggccgcgcgcaacctggcggcagcgcaaaagatg

SEQ ID NO: 167065 - DNA, 103 bp, Artificial Sequence
  Synthetic Polynucleotide
taatacgactcactatagggtactgggtggtgttgcccaaccacgagtcgaacagaggagacgactcatggttgggcaaaacctggcggcagcgcaaaagatg

SEQ ID NO: 167066 - DNA, 103 bp, Artificial Sequence
  Synthetic Polynucleotide
taatacgactcactatagggcgagctggtgtactgggtggtgttgcccaaaacagaggagattgggcatgaccacccagaacctggcggcagcgcaaaagatg

SEQ ID NO: 167067 - DNA, 103 bp, Artificial Sequence
  Synthetic Polynucleotide
taatacgactcactatagggccacgatggccgagctggtgtactgggtggaacagaggagaccacccatgacaccagctaacctggcggcagcgcaaaagatg

SEQ ID NO: 167068 - DNA, 103 bp, Artificial Sequence
  Synthetic Polynucleotide
taatacgactcactatagggttgatggcggccacgatggccgagctggtgaacagaggagacaccagatgggccatcgtaacctggcggcagcgcaaaagatg

SEQ ID NO: 167069 - DNA, 103 bp, Artificial Sequence
  Synthetic Polynucleotide
taatacgactcactatagggggtcagcgcgttgatggcggccacgatggcaacagaggagagccatcatggccgccatcaacctggcggcagcgcaaaagatg

SEQ ID NO: 167070 - DNA, 103 bp, Artificial Sequence
  Synthetic Polynucleotide
taatacgactcactatagggtgctgtcggtggtcagcgcgttgatggcggaacagaggagaccgccaatgacgcgctgaaacctggcggcagcgcaaaagatg

SEQ ID NO: 167071 - DNA, 103 bp, Artificial Sequence
  Synthetic Polynucleotide
taatacgactcactatagggaggtccaggctgctgtcggtggtcagcgcgaacagaggagacgcgctatgcaccgacagaacctggcggcagcgcaaaagatg

SEQ ID NO: 167072 - DNA, 103 bp, Artificial Sequence
  Synthetic Polynucleotide
taatacgactcactataggggccatctcccaggtccaggctgctgtcggtaacagaggagaaccgacatgagcctggacaacctggcggcagcgcaaaagatg

SEQ ID NO: 167073 - DNA, 103 bp, Artificial Sequence
  Synthetic Polynucleotide
taatacgactcactatagggtgacagggacgccatctcccaggtccaggcaacagaggagagcctggatgtgggagatgaacctggcggcagcgcaaaagatg

SEQ ID NO: 167074 - DNA, 103 bp, Artificial Sequence
  Synthetic Polynucleotide
taatacgactcactatagggttgcgggacttgacagggacgccatctcccaacagaggagagggagaatgcgtccctgtaacctggcggcagcgcaaaagatg

SEQ ID NO: 167075 - DNA, 103 bp, Artificial Sequence
  Synthetic Polynucleotide
taatacgactcactataggggggttggggctgccgctcgggggcgttcataacagaggagaatgaacatgcccgagcggaacctggcggcagcgcaaaagatg

SEQ ID NO: 167076 - DNA, 103 bp, Artificial Sequence
  Synthetic Polynucleotide
taatacgactcactatagggattcaaatactcatagtcgaagaggatggaaacagaggagatccatcatgttcgactataacctggcggcagcgcaaaagatg

SEQ ID NO: 167077 - DNA, 103 bp, Artificial Sequence
  Synthetic Polynucleotide
taatacgactcactataggggccggccttggatggggcggcagacaccggaacagaggagaccggtgatggccgccccaaacctggcggcagcgcaaaagatg

SEQ ID NO: 167078 - DNA, 103 bp, Artificial Sequence
  Synthetic Polynucleotide
taatacgactcactatagggggcgaggcaggccggccttggatggggcggaacagaggagaccgcccatgccaaggccgaacctggcggcagcgcaaaagatg

SEQ ID NO: 167079 - DNA, 103 bp, Artificial Sequence
  Synthetic Polynucleotide
taatacgactcactataggggggtagatgtggcgaggcaggccggccttgaacagaggagacaaggcatgcctgcctcgaacctggcggcagcgcaaaagatg

SEQ ID NO: 167080 - DNA, 103 bp, Artificial Sequence
  Synthetic Polynucleotide
taatacgactcactatagggctccacggccgggtagatgtggcgaggcagaacagaggagactgcctatgcacatctacaacctggcggcagcgcaaaagatg

SEQ ID NO: 167081 - DNA, 103 bp, Artificial Sequence
  Synthetic Polynucleotide
taatacgactcactataggggccccaggaactccacggccgggtagatgtaacagaggagaacatctatgcggccgtggaacctggcggcagcgcaaaagatg

SEQ ID NO: 167082 - DNA, 103 bp, Artificial Sequence
  Synthetic Polynucleotide
taatacgactcactatagggtgctcgcagggccccaggaactccacggccaacagaggagaggccgtatggttcctgggaacctggcggcagcgcaaaagatg

SEQ ID NO: 167083 - DNA, 103 bp, Artificial Sequence
  Synthetic Polynucleotide
taatacgactcactatagggcctctcgccctgctcgcagggccccaggaaaacagaggagattcctgatgccctgcgagaacctggcggcagcgcaaaagatg

SEQ ID NO: 167084 - DNA, 103 bp, Artificial Sequence
  Synthetic Polynucleotide
taatacgactcactatagggccgagtttctcctctcgccctgctcgcaggaacagaggagacctgcgatgagggcgagaaacctggcggcagcgcaaaagatg

SEQ ID NO: 167085 - DNA, 103 bp, Artificial Sequence
  Synthetic Polynucleotide
taatacgactcactataggggattctggagccgagtttctcctctcgcccaacagaggagagggcgaatggagaaactcaacctggcggcagcgcaaaagatg

SEQ ID NO: 167086 - DNA, 103 bp, Artificial Sequence
  Synthetic Polynucleotide
taatacgactcactatagggcagcaggatggattctggagccgagtttctaacagaggagaagaaacatggctccagaaaacctggcggcagcgcaaaagatg

SEQ ID NO: 167087 - DNA, 103 bp, Artificial Sequence
  Synthetic Polynucleotide
taatacgactcactatagggcttcgttcggattcaaatactcatagtcgaaacagaggagatcgactatgagtatttgaaacctggcggcagcgcaaaagatg

SEQ ID NO: 167088 - DNA, 103 bp, Artificial Sequence
  Synthetic Polynucleotide
taatacgactcactatagggtgggcggaaccagcaggatggattctggagaacagaggagactccagatgccatcctgcaacctggcggcagcgcaaaagatg

SEQ ID NO: 167089 - DNA, 103 bp, Artificial Sequence
  Synthetic Polynucleotide
taatacgactcactatagggttgggccaagtgggcggaaccagcaggatgaacagaggagacatcctatgggttccgccaacctggcggcagcgcaaaagatg

SEQ ID NO: 167090 - DNA, 103 bp, Artificial Sequence
  Synthetic Polynucleotide
taatacgactcactatagggcaccagcggcttgggccaagtgggcggaacaacagaggagagttccgatgacttggcccaacctggcggcagcgcaaaagatg

SEQ ID NO: 167091 - DNA, 103 bp, Artificial Sequence
  Synthetic Polynucleotide
taatacgactcactataggggaatggcaggcaccagcggcttgggccaagaacagaggagacttggcatgagccgctggaacctggcggcagcgcaaaagatg

SEQ ID NO: 167092 - DNA, 103 bp, Artificial Sequence
  Synthetic Polynucleotide
taatacgactcactatagggctgcagatgggaatggcaggcaccagcggcaacagaggagagccgctatggcctgccataacctggcggcagcgcaaaagatg

SEQ ID NO: 167093 - DNA, 103 bp, Artificial Sequence
  Synthetic Polynucleotide
taatacgactcactatagggcactgggatgctgcagatgggaatggcaggaacagaggagacctgccatgcccatctgcaacctggcggcagcgcaaaagatg

SEQ ID NO: 167094 - DNA, 103 bp, Artificial Sequence
  Synthetic Polynucleotide
taatacgactcactataggggggatgcagtcactgggatgctgcagatggaacagaggagaccatctatggcatcccagaacctggcggcagcgcaaaagatg

SEQ ID NO: 167095 - DNA, 103 bp, Artificial Sequence
  Synthetic Polynucleotide
taatacgactcactatagggagtggagggagggatgcagtcactgggatgaacagaggagacatcccatggactgcatcaacctggcggcagcgcaaaagatg

SEQ ID NO: 167096 - DNA, 103 bp, Artificial Sequence
  Synthetic Polynucleotide
taatacgactcactatagggcggccactcaagtggagggagggatgcagtaacagaggagaactgcaatgctccctccaaacctggcggcagcgcaaaagatg

SEQ ID NO: 167097 - DNA, 103 bp, Artificial Sequence
  Synthetic Polynucleotide
taatacgactcactataggggactggacagcggccactcaagtggagggaaacagaggagatccctcatgttgagtggcaacctggcggcagcgcaaaagatg

SEQ ID NO: 167098 - DNA, 103 bp, Artificial Sequence
  Synthetic Polynucleotide
taatacgactcactatagggttcggctcttcttcgttcggattcaaatacaacagaggagagtatttatgtccgaacgaaacctggcggcagcgcaaaagatg

SEQ ID NO: 167099 - DNA, 103 bp, Artificial Sequence
  Synthetic Polynucleotide
taatacgactcactataggggagcctgactgactggacagcggccactcaaacagaggagatgagtgatggctgtccagaacctggcggcagcgcaaaagatg

SEQ ID NO: 167100 - DNA, 103 bp, Artificial Sequence
  Synthetic Polynucleotide
taatacgactcactatagggcagctcgtaagagcctgactgactggacagaacagaggagactgtccatgcagtcaggcaacctggcggcagcgcaaaagatg

SEQ ID NO: 167101 - DNA, 103 bp, Artificial Sequence
  Synthetic Polynucleotide
taatacgactcactatagggcctcgatccgcagctcgtaagagcctgactaacagaggagaagtcagatgcttacgagcaacctggcggcagcgcaaaagatg

SEQ ID NO: 167102 - DNA, 103 bp, Artificial Sequence
  Synthetic Polynucleotide
taatacgactcactatagggttgggctgcacctcgatccgcagctcgtaaaacagaggagattacgaatggcggatcgaaacctggcggcagcgcaaaagatg

SEQ ID NO: 167103 - DNA, 103 bp, Artificial Sequence
  Synthetic Polynucleotide
taatacgactcactataggggtgatgtggcttgggctgcacctcgatccgaacagaggagacggatcatggtgcagcccaacctggcggcagcgcaaaagatg

SEQ ID NO: 167104 - DNA, 103 bp, Artificial Sequence
  Synthetic Polynucleotide
taatacgactcactatagggagtgggcccggtgatgtggcttgggctgcaaacagaggagatgcagcatgagccacatcaacctggcggcagcgcaaaagatg

SEQ ID NO: 167105 - DNA, 103 bp, Artificial Sequence
  Synthetic Polynucleotide
taatacgactcactatagggtctgtctcatagtgggcccggtgatgtggcaacagaggagagccacaatgccgggcccaaacctggcggcagcgcaaaagatg

SEQ ID NO: 167106 - DNA, 103 bp, Artificial Sequence
  Synthetic Polynucleotide
taatacgactcactatagggtcggctgccttctgtctcatagtgggcccgaacagaggagacgggccatgtatgagacaaacctggcggcagcgcaaaagatg

SEQ ID NO: 167107 - DNA, 103 bp, Artificial Sequence
  Synthetic Polynucleotide
taatacgactcactatagggtgacagcccctcggctgccttctgtctcataacagaggagaatgagaatgaaggcagccaacctggcggcagcgcaaaagatg

SEQ ID NO: 167108 - DNA, 103 bp, Artificial Sequence
  Synthetic Polynucleotide
taatacgactcactataggggttggagctttgacagcccctcggctgcctaacagaggagaaggcagatgaggggctgtaacctggcggcagcgcaaaagatg

SEQ ID NO: 167109 - DNA, 103 bp, Artificial Sequence
  Synthetic Polynucleotide
taatacgactcactatagggcttatgtgcattcggctcttcttcgttcggaacagaggagaccgaacatggaagagccgaacctggcggcagcgcaaaagatg

SEQ ID NO: 167110 - DNA, 103 bp, Artificial Sequence
  Synthetic Polynucleotide
taatacgactcactataggggtggcctccagttggagctttgacagccccaacagaggagaggggctatgaaagctccaaacctggcggcagcgcaaaagatg

SEQ ID NO: 167111 - DNA, 103 bp, Artificial Sequence
  Synthetic Polynucleotide
taatacgactcactataggggaaccacagggtggcctccagttggagcttaacagaggagaaagctcatgctggaggccaacctggcggcagcgcaaaagatg

SEQ ID NO: 167112 - DNA, 103 bp, Artificial Sequence
  Synthetic Polynucleotide
taatacgactcactatagggccatggagctgaaccacagggtggcctccaaacagaggagatggaggatgccctgtggtaacctggcggcagcgcaaaagatg

SEQ ID NO: 167113 - DNA, 103 bp, Artificial Sequence
  Synthetic Polynucleotide
taatacgactcactatagggttccatgtagccatggagctgaaccacaggaacagaggagacctgtgatgcagctccataacctggcggcagcgcaaaagatg

SEQ ID NO: 167114 - DNA, 103 bp, Artificial Sequence
  Synthetic Polynucleotide
taatacgactcactataggggaggcttgttttccatgtagccatggagctaacagaggagaagctccatggctacatggaacctggcggcagcgcaaaagatg

SEQ ID NO: 167115 - DNA, 103 bp, Artificial Sequence
  Synthetic Polynucleotide
taatacgactcactatagggtgaagtcccagaggcttgttttccatgtagaacagaggagactacatatgaaacaagccaacctggcggcagcgcaaaagatg

SEQ ID NO: 167116 - DNA, 103 bp, Artificial Sequence
  Synthetic Polynucleotide
taatacgactcactatagggaatgaagatctgaagtcccagaggcttgttaacagaggagaaacaagatgctgggacttaacctggcggcagcgcaaaagatg

SEQ ID NO: 167117 - DNA, 103 bp, Artificial Sequence
  Synthetic Polynucleotide
taatacgactcactatagggcagctgtcccaatgaagatctgaagtcccaaacagaggagatgggacatgagatcttcaaacctggcggcagcgcaaaagatg

SEQ ID NO: 167118 - DNA, 103 bp, Artificial Sequence
  Synthetic Polynucleotide
taatacgactcactatagggatccgctcatcagctgtcccaatgaagatcaacagaggagagatcttatgtgggacagcaacctggcggcagcgcaaaagatg

SEQ ID NO: 167119 - DNA, 103 bp, Artificial Sequence
  Synthetic Polynucleotide
taatacgactcactatagggcggcttaaggatccgctcatcagctgtcccaacagaggagagggacaatggatgagcggaacctggcggcagcgcaaaagatg

SEQ ID NO: 167120 - DNA, 103 bp, Artificial Sequence
  Synthetic Polynucleotide
taatacgactcactatagggggctggcgaccttatgtgcattcggctcttaacagaggagaaagagcatgatgcacataaacctggcggcagcgcaaaagatg

SEQ ID NO: 167121 - DNA, 103 bp, Artificial Sequence
  Synthetic Polynucleotide
taatacgactcactatagggagaaggcgtgcggcttaaggatccgctcataacagaggagaatgagcatgtccttaagcaacctggcggcagcgcaaaagatg

SEQ ID NO: 167122 - DNA, 103 bp, Artificial Sequence
  Synthetic Polynucleotide
taatacgactcactatagggtgcacctggtagaaggcgtgcggcttaaggaacagaggagaccttaaatggcacgccttaacctggcggcagcgcaaaagatg

SEQ ID NO: 167123 - DNA, 103 bp, Artificial Sequence
  Synthetic Polynucleotide
taatacgactcactatagggcgtgattcggtgcacctggtagaaggcgtgaacagaggagacacgccatgtaccaggtgaacctggcggcagcgcaaaagatg

SEQ ID NO: 167124 - DNA, 103 bp, Artificial Sequence
  Synthetic Polynucleotide
taatacgactcactatagggcagttttccccgtgattcggtgcacctggtaacagaggagaaccaggatgaccgaatcaaacctggcggcagcgcaaaagatg

SEQ ID NO: 167125 - DNA, 103 bp, Artificial Sequence
  Synthetic Polynucleotide
taatacgactcactataggggtggtggtgacagttttccccgtgattcggaacagaggagaccgaatatgggggaaaacaacctggcggcagcgcaaaagatg

SEQ ID NO: 167126 - DNA, 103 bp, Artificial Sequence
  Synthetic Polynucleotide
taatacgactcactatagggctcatagctggtggtggtgacagttttcccaacagaggagagggaaaatggtcaccaccaacctggcggcagcgcaaaagatg

SEQ ID NO: 167127 - DNA, 103 bp, Artificial Sequence
  Synthetic Polynucleotide
taatacgactcactatagggccactatcttctcatagctggtggtggtgaaacagaggagatcaccaatgccagctatgaacctggcggcagcgcaaaagatg

SEQ ID NO: 167128 - DNA, 103 bp, Artificial Sequence
  Synthetic Polynucleotide
taatacgactcactatagggttggtgttgcccactatcttctcatagctgaacagaggagacagctaatggaagatagtaacctggcggcagcgcaaaagatg

SEQ ID NO: 167129 - DNA, 103 bp, Artificial Sequence
  Synthetic Polynucleotide
taatacgactcactatagggctccaggactttggtgttgcccactatcttaacagaggagaaagataatgggcaacaccaacctggcggcagcgcaaaagatg

SEQ ID NO: 167130 - DNA, 103 bp, Artificial Sequence
  Synthetic Polynucleotide
taatacgactcactatagggccaagggtatctccaggactttggtgttgcaacagaggagagcaacaatgaagtcctggaacctggcggcagcgcaaaagatg

SEQ ID NO: 167131 - DNA, 103 bp, Artificial Sequence
  Synthetic Polynucleotide
taatacgactcactatagggccggagggtgggctggcgaccttatgtgcaaacagaggagatgcacaatgggtcgccagaacctggcggcagcgcaaaagatg

SEQ ID NO: 167132 - DNA, 103 bp, Artificial Sequence
  Synthetic Polynucleotide
taatacgactcactatagggtttttgggctccaagggtatctccaggactaacagaggagaagtcctatggatacccttaacctggcggcagcgcaaaagatg

SEQ ID NO: 167133 - DNA, 103 bp, Artificial Sequence
  Synthetic Polynucleotide
taatacgactcactatagggcctcatgttgtttttgggctccaagggtataacagaggagaatacccatggagcccaaaaacctggcggcagcgcaaaagatg

SEQ ID NO: 167134 - DNA, 103 bp, Artificial Sequence
  Synthetic Polynucleotide
taatacgactcactatagggcgatggttgccctcatgttgtttttgggctaacagaggagaagcccaatgacaacatgaaacctggcggcagcgcaaaagatg

SEQ ID NO: 167135 - DNA, 103 bp, Artificial Sequence
  Synthetic Polynucleotide
taatacgactcactatagggcccgcacagtcgatggttgccctcatgttgaacagaggagacaacatatgggcaaccataacctggcggcagcgcaaaagatg

SEQ ID NO: 167136 - DNA, 103 bp, Artificial Sequence
  Synthetic Polynucleotide
taatacgactcactatagggcttcaagatccccgcacagtcgatggttgcaacagaggagagcaaccatggactgtgcgaacctggcggcagcgcaaaagatg

SEQ ID NO: 167137 - DNA, 103 bp, Artificial Sequence
  Synthetic Polynucleotide
taatacgactcactatagggcgtttctaagcttcaagatccccgcacagtaacagaggagaactgtgatgggatcttgaaacctggcggcagcgcaaaagatg

SEQ ID NO: 167138 - DNA, 103 bp, Artificial Sequence
  Synthetic Polynucleotide
taatacgactcactatagggtcaatgtcggcgtttctaagcttcaagatcaacagaggagagatcttatggcttagaaaaacctggcggcagcgcaaaagatg

SEQ ID NO: 167139 - DNA, 103 bp, Artificial Sequence
  Synthetic Polynucleotide
taatacgactcactatagggtttccgcagctcaatgtcggcgtttctaagaacagaggagacttagaatggccgacattaacctggcggcagcgcaaaagatg

SEQ ID NO: 167140 - DNA, 103 bp, Artificial Sequence
  Synthetic Polynucleotide
taatacgactcactatagggccgtctcgcctttccgcagctcaatgtcggaacagaggagaccgacaatgagctgcggaaacctggcggcagcgcaaaagatg

SEQ ID NO: 167141 - DNA, 103 bp, Artificial Sequence
  Synthetic Polynucleotide
taatacgactcactatagggcttccaatgtccgtctcgcctttccgcagcaacagaggagagctgcgatgaggcgagacaacctggcggcagcgcaaaagatg

SEQ ID NO: 167142 - DNA, 103 bp, Artificial Sequence
  Synthetic Polynucleotide
taatacgactcactataggggtatgcgggtccggagggtgggctggcgacaacagaggagagtcgccatgccaccctccaacctggcggcagcgcaaaagatg

SEQ ID NO: 167143 - DNA, 103 bp, Artificial Sequence
  Synthetic Polynucleotide
taatacgactcactatagggcgtgttctttcttccaatgtccgtctcgccaacagaggagaggcgagatggacattggaaacctggcggcagcgcaaaagatg

SEQ ID NO: 167144 - DNA, 103 bp, Artificial Sequence
  Synthetic Polynucleotide
taatacgactcactataggggtctcacccgcgtgttctttcttccaatgtaacagaggagaacattgatggaaagaacaaacctggcggcagcgcaaaagatg

SEQ ID NO: 167145 - DNA, 103 bp, Artificial Sequence
  Synthetic Polynucleotide
taatacgactcactatagggcggaaaaccagtctcacccgcgtgttctttaacagaggagaaaagaaatggcgggtgagaacctggcggcagcgcaaaagatg

SEQ ID NO: 167146 - DNA, 103 bp, Artificial Sequence
  Synthetic Polynucleotide
taatacgactcactataggggatgtgaactcggaaaaccagtctcacccgaacagaggagacgggtgatgctggttttcaacctggcggcagcgcaaaagatg

SEQ ID NO: 167147 - DNA, 103 bp, Artificial Sequence
  Synthetic Polynucleotide
taatacgactcactatagggtggactctgggatgtgaactcggaaaaccaaacagaggagatggtttatggagttcacaaacctggcggcagcgcaaaagatg

SEQ ID NO: 167148 - DNA, 103 bp, Artificial Sequence
  Synthetic Polynucleotide
taatacgactcactatagggattctgccactggactctgggatgtgaactaacagaggagaagttcaatgcccagagtcaacctggcggcagcgcaaaagatg

SEQ ID NO: 167149 - DNA, 103 bp, Artificial Sequence
  Synthetic Polynucleotide
taatacgactcactatagggtaaagagacgattctgccactggactctggaacagaggagaccagagatgagtggcagaaacctggcggcagcgcaaaagatg

SEQ ID NO: 167150 - DNA, 103 bp, Artificial Sequence
  Synthetic Polynucleotide
taatacgactcactatagggatgcagtctgtaaagagacgattctgccacaacagaggagagtggcaatgtcgtctcttaacctggcggcagcgcaaaagatg

SEQ ID NO: 167151 - DNA, 103 bp, Artificial Sequence
  Synthetic Polynucleotide
taatacgactcactatagggatggggttagatgcagtctgtaaagagacgaacagaggagacgtctcatgacagactgcaacctggcggcagcgcaaaagatg

SEQ ID NO: 167152 - DNA, 103 bp, Artificial Sequence
  Synthetic Polynucleotide
taatacgactcactatagggggagcactcgatggggttagatgcagtctgaacagaggagacagactatgtctaaccccaacctggcggcagcgcaaaagatg

SEQ ID NO: 167153 - DNA, 103 bp, Artificial Sequence
  Synthetic Polynucleotide
taatacgactcactatagggcatcatcggggtatgcgggtccggagggtgaacagaggagacaccctatggacccgcataacctggcggcagcgcaaaagatg

SEQ ID NO: 167154 - DNA, 103 bp, Artificial Sequence
  Synthetic Polynucleotide
taatacgactcactatagggcagatcgctgggagcactcgatggggttagaacagaggagactaaccatgtcgagtgctaacctggcggcagcgcaaaagatg

SEQ ID NO: 167155 - DNA, 103 bp, Artificial Sequence
  Synthetic Polynucleotide
taatacgactcactatagggagctcgtgagcagatcgctgggagcactcgaacagaggagacgagtgatgccagcgatcaacctggcggcagcgcaaaagatg

SEQ ID NO: 167156 - DNA, 103 bp, Artificial Sequence
  Synthetic Polynucleotide
taatacgactcactatagggaaccatgggcagctcgtgagcagatcgctgaacagaggagacagcgaatggctcacgagaacctggcggcagcgcaaaagatg

SEQ ID NO: 167157 - DNA, 103 bp, Artificial Sequence
  Synthetic Polynucleotide
taatacgactcactatagggcttgtctttcaaccatgggcagctcgtgagaacagaggagactcacgatgtgcccatggaacctggcggcagcgcaaaagatg

SEQ ID NO: 167158 - DNA, 103 bp, Artificial Sequence
  Synthetic Polynucleotide
taatacgactcactatagggctgtctgtgtcttgtctttcaaccatgggcaacagaggagagcccatatgtgaaagacaaacctggcggcagcgcaaaagatg

SEQ ID NO: 167159 - DNA, 103 bp, Artificial Sequence
  Synthetic Polynucleotide
taatacgactcactataggggaccaggcagctgtctgtgtcttgtctttcaacagaggagagaaagaatggacacagacaacctggcggcagcgcaaaagatg

SEQ ID NO: 167160 - DNA, 103 bp, Artificial Sequence
  Synthetic Polynucleotide
taatacgactcactatagggggccgccatagaccaggcagctgtctgtgtaacagaggagaacacagatggctgcctggaacctggcggcagcgcaaaagatg

SEQ ID NO: 167161 - DNA, 103 bp, Artificial Sequence
  Synthetic Polynucleotide
taatacgactcactatagggatcatttgctggccgccatagaccaggcagaacagaggagactgcctatgctatggcggaacctggcggcagcgcaaaagatg

SEQ ID NO: 167162 - DNA, 103 bp, Artificial Sequence
  Synthetic Polynucleotide
taatacgactcactatagggccccgtgaggatcatttgctggccgccataaacagaggagatatggcatgcagcaaatgaacctggcggcagcgcaaaagatg

SEQ ID NO: 167163 - DNA, 103 bp, Artificial Sequence
  Synthetic Polynucleotide
taatacgactcactatagggtaaagttctgccccgtgaggatcatttgctaacagaggagaagcaaaatgtcctcacggaacctggcggcagcgcaaaagatg

SEQ ID NO: 167164 - DNA, 103 bp, Artificial Sequence
  Synthetic Polynucleotide
taatacgactcactatagggtagtccaggacatcatcggggtatgcgggtaacagaggagaacccgcatgccccgatgaaacctggcggcagcgcaaaagatg

SEQ ID NO: 167165 - DNA, 103 bp, Artificial Sequence
  Synthetic Polynucleotide
taatacgactcactataggggactcggatgtaaagttctgccccgtgaggaacagaggagacctcacatggcagaacttaacctggcggcagcgcaaaagatg

SEQ ID NO: 167166 - DNA, 103 bp, Artificial Sequence
  Synthetic Polynucleotide
taatacgactcactatagggcacaactttggactcggatgtaaagttctgaacagaggagacagaacatgacatccgagaacctggcggcagcgcaaaagatg

SEQ ID NO: 167167 - DNA, 103 bp, Artificial Sequence
  Synthetic Polynucleotide
taatacgactcactatagggtctcagtaaacacaactttggactcggatgaacagaggagacatccgatgccaaagttgaacctggcggcagcgcaaaagatg

SEQ ID NO: 167168 - DNA, 103 bp, Artificial Sequence
  Synthetic Polynucleotide
taatacgactcactatagggtctgtggtcttctcagtaaacacaactttgaacagaggagacaaagtatggtttactgaaacctggcggcagcgcaaaagatg

SEQ ID NO: 167169 - DNA, 103 bp, Artificial Sequence
  Synthetic Polynucleotide
taatacgactcactatagggttgctgtccatctgtggtcttctcagtaaaaacagaggagatttactatgaagaccacaaacctggcggcagcgcaaaagatg

SEQ ID NO: 167170 - DNA, 103 bp, Artificial Sequence
  Synthetic Polynucleotide
taatacgactcactatagggtctcccaaatttgctgtccatctgtggtctaacagaggagaagaccaatgatggacagcaacctggcggcagcgcaaaagatg

SEQ ID NO: 167171 - DNA, 103 bp, Artificial Sequence
  Synthetic Polynucleotide
taatacgactcactataggggtggcttccatctcccaaatttgctgtccaaacagaggagatggacaatgaatttgggaaacctggcggcagcgcaaaagatg

SEQ ID NO: 167172 - DNA, 103 bp, Artificial Sequence
  Synthetic Polynucleotide
taatacgactcactatagggcttatccaccgtggcttccatctcccaaataacagaggagaatttggatgatggaagccaacctggcggcagcgcaaaagatg

SEQ ID NO: 167173 - DNA, 103 bp, Artificial Sequence
  Synthetic Polynucleotide
taatacgactcactatagggggctcttgtccttatccaccgtggcttccaaacagaggagatggaagatgcggtggataaacctggcggcagcgcaaaagatg

SEQ ID NO: 167174 - DNA, 103 bp, Artificial Sequence
  Synthetic Polynucleotide
taatacgactcactatagggatgttgggctggctcttgtccttatccaccaacagaggagaggtggaatgggacaagagaacctggcggcagcgcaaaagatg

SEQ ID NO: 167175 - DNA, 103 bp, Artificial Sequence
  Synthetic Polynucleotide
taatacgactcactatagggcttgaggccatagtccaggacatcatcgggaacagaggagacccgatatggtcctggacaacctggcggcagcgcaaaagatg

SEQ ID NO: 167176 - DNA, 103 bp, Artificial Sequence
  Synthetic Polynucleotide
taatacgactcactatagggaacaaaaagcatgttgggctggctcttgtcaacagaggagagacaagatgcagcccaacaacctggcggcagcgcaaaagatg

SEQ ID NO: 167177 - DNA, 103 bp, Artificial Sequence
  Synthetic Polynucleotide
taatacgactcactatagggcagggatctcaacaaaaagcatgttgggctaacagaggagaagcccaatgtgctttttgaacctggcggcagcgcaaaagatg

SEQ ID NO: 167178 - DNA, 103 bp, Artificial Sequence
  Synthetic Polynucleotide
taatacgactcactatagggttccgatattcagggatctcaacaaaaagcaacagaggagagcttttatgtgagatcccaacctggcggcagcgcaaaagatg

SEQ ID NO: 167179 - DNA, 103 bp, Artificial Sequence
  Synthetic Polynucleotide
taatacgactcactataggggatatgcttgttccgatattcagggatctcaacagaggagagagatcatggaatatcggaacctggcggcagcgcaaaagatg

SEQ ID NO: 167180 - DNA, 103 bp, Artificial Sequence
  Synthetic Polynucleotide
taatacgactcactatagggcaggtgtgcggatatgcttgttccgatattaacagaggagaaatatcatgacaagcataaacctggcggcagcgcaaaagatg

SEQ ID NO: 167181 - DNA, 103 bp, Artificial Sequence
  Synthetic Polynucleotide
taatacgactcactatagggttcacttttacaggtgtgcggatatgcttgaacagaggagacaagcaatgccgcacaccaacctggcggcagcgcaaaagatg

SEQ ID NO: 167182 - DNA, 103 bp, Artificial Sequence
  Synthetic Polynucleotide
taatacgactcactataggggacgtagaagttcacttttacaggtgtgcgaacagaggagacgcacaatggtaaaagtgaacctggcggcagcgcaaaagatg

SEQ ID NO: 167183 - DNA, 103 bp, Artificial Sequence
  Synthetic Polynucleotide
taatacgactcactatagggtcccattgatgacgtagaagttcacttttaaacagaggagataaaagatgacttctacgaacctggcggcagcgcaaaagatg

SEQ ID NO: 167184 - DNA, 103 bp, Artificial Sequence
  Synthetic Polynucleotide
taatacgactcactatagggcgttttctcttcccattgatgacgtagaagaacagaggagacttctaatgcatcaatggaacctggcggcagcgcaaaagatg

SEQ ID NO: 167185 - DNA, 103 bp, Artificial Sequence
  Synthetic Polynucleotide
taatacgactcactatagggaggctgacttcgttttctcttcccattgataacagaggagaatcaatatgaagagaaaaaacctggcggcagcgcaaaagatg

SEQ ID NO: 167186 - DNA, 103 bp, Artificial Sequence
  Synthetic Polynucleotide
taatacgactcactatagggccccgccgtcgggttggggctgccgctcggaacagaggagaccgagcatgagccccaacaacctggcggcagcgcaaaagatg

SEQ ID NO: 167187 - DNA, 103 bp, Artificial Sequence
  Synthetic Polynucleotide
taatacgactcactatagggggctgtatggcttgaggccatagtccaggaaacagaggagatcctggatgatggcctcaaacctggcggcagcgcaaaagatg

SEQ ID NO: 167188 - DNA, 103 bp, Artificial Sequence
  Synthetic Polynucleotide
taatacgactcactatagggtaaagtgctgaggctgacttcgttttctctaacagaggagaagagaaatggaagtcagcaacctggcggcagcgcaaaagatg

SEQ ID NO: 167189 - DNA, 103 bp, Artificial Sequence
  Synthetic Polynucleotide
taatacgactcactataggggggtggtaggtaaagtgctgaggctgacttaacagaggagaaagtcaatgtcagcacttaacctggcggcagcgcaaaagatg

SEQ ID NO: 167190 - DNA, 103 bp, Artificial Sequence
  Synthetic Polynucleotide
taatacgactcactatagggggctgggactgggtggtaggtaaagtgctgaacagaggagacagcacatgacctaccacaacctggcggcagcgcaaaagatg

SEQ ID NO: 167191 - DNA, 103 bp, Artificial Sequence
  Synthetic Polynucleotide
taatacgactcactatagggccgtcttgatggctgggactgggtggtaggaacagaggagacctaccatgcagtcccagaacctggcggcagcgcaaaagatg

SEQ ID NO: 167192 - DNA, 103 bp, Artificial Sequence
  Synthetic Polynucleotide
taatacgactcactatagggtccgtgggctccgtcttgatggctgggactaacagaggagaagtcccatgcatcaagacaacctggcggcagcgcaaaagatg

SEQ ID NO: 167193 - DNA, 103 bp, Artificial Sequence
  Synthetic Polynucleotide
taatacgactcactataggggtcatattcatccgtgggctccgtcttgataacagaggagaatcaagatggagcccacgaacctggcggcagcgcaaaagatg

SEQ ID NO: 167194 - DNA, 103 bp, Artificial Sequence
  Synthetic Polynucleotide
taatacgactcactatagggtcagagtggggtcatattcatccgtgggctaacagaggagaagcccaatgatgaatatgaacctggcggcagcgcaaaagatg

SEQ ID NO: 167195 - DNA, 103 bp, Artificial Sequence
  Synthetic Polynucleotide
taatacgactcactataggggggctgcagatcagagtggggtcatattcaaacagaggagatgaataatgccccactctaacctggcggcagcgcaaaagatg

SEQ ID NO: 167196 - DNA, 103 bp, Artificial Sequence
  Synthetic Polynucleotide
taatacgactcactatagggtccatgggtggggctgcagatcagagtgggaacagaggagacccactatgatctgcagcaacctggcggcagcgcaaaagatg

SEQ ID NO: 167197 - DNA, 103 bp, Artificial Sequence
  Synthetic Polynucleotide
taatacgactcactatagggtccccaggcctccatgggtggggctgcagaaacagaggagatctgcaatgccacccatgaacctggcggcagcgcaaaagatg

SEQ ID NO: 167198 - DNA, 103 bp, Artificial Sequence
  Synthetic Polynucleotide
taatacgactcactatagggctagcaagggggctgtatggcttgaggccaaacagaggagatggcctatggccatacagaacctggcggcagcgcaaaagatg

SEQ ID NO: 167199 - DNA, 103 bp, Artificial Sequence
  Synthetic Polynucleotide
taatacgactcactatagggtaaggctggctccccaggcctccatgggtgaacagaggagacacccaatgaggcctgggaacctggcggcagcgcaaaagatg

SEQ ID NO: 167200 - DNA, 103 bp, Artificial Sequence
  Synthetic Polynucleotide
taatacgactcactatagggctgggggtagtaaggctggctccccaggccaacagaggagaggcctgatgagccagcctaacctggcggcagcgcaaaagatg

SEQ ID NO: 167201 - DNA, 103 bp, Artificial Sequence
  Synthetic Polynucleotide
taatacgactcactatagggccatcgggtgctgggggtagtaaggctggcaacagaggagagccagcatgactacccccaacctggcggcagcgcaaaagatg

SEQ ID NO: 167202 - DNA, 103 bp, Artificial Sequence
  Synthetic Polynucleotide
taatacgactcactataggggactcggccaccatcgggtgctgggggtagaacagaggagactacccatggcacccgataacctggcggcagcgcaaaagatg

SEQ ID NO: 167203 - DNA, 103 bp, Artificial Sequence
  Synthetic Polynucleotide
taatacgactcactataggggcaggagggggactcggccaccatcgggtgaacagaggagacacccgatggtggccgagaacctggcggcagcgcaaaagatg

SEQ ID NO: 167204 - DNA, 103 bp, Artificial Sequence
  Synthetic Polynucleotide
taatacgactcactatagggtggccacgaggcaggagggggactcggccaaacagaggagatggccgatgccccctcctaacctggcggcagcgcaaaagatg

SEQ ID NO: 167205 - DNA, 103 bp, Artificial Sequence
  Synthetic Polynucleotide
taatacgactcactatagggggagccatggtggccacgaggcaggaggggaacagaggagacccctcatgcctcgtggcaacctggcggcagcgcaaaagatg

SEQ ID NO: 167206 - DNA, 103 bp, Artificial Sequence
  Synthetic Polynucleotide
taatacgactcactatagggctgctggcagggagccatggtggccacgagaacagaggagactcgtgatgaccatggctaacctggcggcagcgcaaaagatg

SEQ ID NO: 167207 - DNA, 103 bp, Artificial Sequence
  Synthetic Polynucleotide
taatacgactcactatagggccgtgcggaactgctggcagggagccatggaacagaggagaccatggatgcctgccagcaacctggcggcagcgcaaaagatg

SEQ ID NO: 167208 - DNA, 103 bp, Artificial Sequence
  Synthetic Polynucleotide
taatacgactcactataggggatgagagccccgtgcggaactgctggcagaacagaggagactgccaatggttccgcacaacctggcggcagcgcaaaagatg

SEQ ID NO: 167209 - DNA, 103 bp, Artificial Sequence
  Synthetic Polynucleotide
taatacgactcactataggggccagagagactagcaagggggctgtatggaacagaggagaccatacatgccccttgctaacctggcggcagcgcaaaagatg

SEQ ID NO: 167210 - DNA, 103 bp, Artificial Sequence
  Synthetic Polynucleotide
taatacgactcactatagggggcgtcaggggatgagagccccgtgcggaaaacagaggagattccgcatggggctctcaaacctggcggcagcgcaaaagatg

SEQ ID NO: 167211 - DNA, 103 bp, Artificial Sequence
  Synthetic Polynucleotide
taatacgactcactataggggctggtagcgggcgtcaggggatgagagccaacagaggagaggctctatgcccctgacgaacctggcggcagcgcaaaagatg

SEQ ID NO: 167212 - DNA, 103 bp, Artificial Sequence
  Synthetic Polynucleotide
taatacgactcactataggggggttctgttgctggtagcgggcgtcagggaacagaggagaccctgaatgccgctaccaaacctggcggcagcgcaaaagatg

SEQ ID NO: 167213 - DNA, 103 bp, Artificial Sequence
  Synthetic Polynucleotide
taatacgactcactatagggtacggccgctgggttctgttgctggtagcgaacagaggagacgctacatgcaacagaacaacctggcggcagcgcaaaagatg

SEQ ID NO: 167214 - DNA, 103 bp, Artificial Sequence
  Synthetic Polynucleotide
taatacgactcactataggggctggtagagtacggccgctgggttctgttaacagaggagaaacagaatgcagcggccgaacctggcggcagcgcaaaagatg

SEQ ID NO: 167215 - DNA, 103 bp, Artificial Sequence
  Synthetic Polynucleotide
taatacgactcactatagggctcttgctccgctggtagagtacggccgctaacagaggagaagcggcatgactctaccaaacctggcggcagcgcaaaagatg

SEQ ID NO: 167216 - DNA, 103 bp, Artificial Sequence
  Synthetic Polynucleotide
taatacgactcactatagggggggctcaggctcttgctccgctggtagagaacagaggagactctacatgcggagcaagaacctggcggcagcgcaaaagatg

SEQ ID NO: 167217 - DNA, 103 bp, Artificial Sequence
  Synthetic Polynucleotide
taatacgactcactatagggccagcaggctggggctcaggctcttgctccaacagaggagaggagcaatggcctgagccaacctggcggcagcgcaaaagatg

SEQ ID NO: 167218 - DNA, 103 bp, Artificial Sequence
  Synthetic Polynucleotide
taatacgactcactatagggtgctgatagcccagcaggctggggctcaggaacagaggagacctgagatgcagcctgctaacctggcggcagcgcaaaagatg

SEQ ID NO: 167219 - DNA, 103 bp, Artificial Sequence
  Synthetic Polynucleotide
taatacgactcactataggggagggccggctgctgatagcccagcaggctaacagaggagaagcctgatgggctatcagaacctggcggcagcgcaaaagatg

SEQ ID NO: 167220 - DNA, 103 bp, Artificial Sequence
  Synthetic Polynucleotide
taatacgactcactatagggcggggggctcgccagagagactagcaagggaacagaggagacccttgatggtctctctgaacctggcggcagcgcaaaagatg

SEQ ID NO: 167221 - DNA, 103 bp, Artificial Sequence
  Synthetic Polynucleotide
taatacgactcactataggggggcggccatgagggccggctgctgatagcaacagaggagagctatcatgagccggcccaacctggcggcagcgcaaaagatg

SEQ ID NO: 167222 - DNA, 103 bp, Artificial Sequence
  Synthetic Polynucleotide
taatacgactcactatagggagggacagcggggcggccatgagggccggcaacagaggagagccggcatgcatggccgcaacctggcggcagcgcaaaagatg

SEQ ID NO: 167223 - DNA, 103 bp, Artificial Sequence
  Synthetic Polynucleotide
taatacgactcactatagggagcgtccgcaagggacagcggggcggccataacagaggagaatggccatgccgctgtccaacctggcggcagcgcaaaagatg

SEQ ID NO: 167224 - DNA, 103 bp, Artificial Sequence
  Synthetic Polynucleotide
taatacgactcactatagggcagagcggtgagcgtccgcaagggacagcgaacagaggagacgctgtatgttgcggacgaacctggcggcagcgcaaaagatg

SEQ ID NO: 167225 - DNA, 103 bp, Artificial Sequence
  Synthetic Polynucleotide
taatacgactcactatagggtgcaccagcacagagcggtgagcgtccgcaaacagaggagatgcggaatgtcaccgctcaacctggcggcagcgcaaaagatg

SEQ ID NO: 167226 - DNA, 103 bp, Artificial Sequence
  Synthetic Polynucleotide
taatacgactcactatagggggagccggcgtgcaccagcacagagcggtgaacagaggagacaccgcatggtgctggtgaacctggcggcagcgcaaaagatg

SEQ ID NO: 167227 - DNA, 103 bp, Artificial Sequence
  Synthetic Polynucleotide
taatacgactcactatagggtctggccctgggagccggcgtgcaccagcaaacagaggagatgctggatgacgccggctaacctggcggcagcgcaaaagatg

SEQ ID NO: 167228 - DNA, 103 bp, Artificial Sequence
  Synthetic Polynucleotide
taatacgactcactatagggagggctgagctctggccctgggagccggcgaacagaggagacgccggatgccagggccaaacctggcggcagcgcaaaagatg

SEQ ID NO: 167229 - DNA, 103 bp, Artificial Sequence
  Synthetic Polynucleotide
taatacgactcactatagggggggtggagcagggctgagctctggccctgaacagaggagacagggcatgagctcagccaacctggcggcagcgcaaaagatg

SEQ ID NO: 167230 - DNA, 103 bp, Artificial Sequence
  Synthetic Polynucleotide
taatacgactcactatagggtggtcggagaggggtggagcagggctgagcaacagaggagagctcagatgtgctccaccaacctggcggcagcgcaaaagatg

SEQ ID NO: 167231 - DNA, 103 bp, Artificial Sequence
  Synthetic Polynucleotide
taatacgactcactatagggccgaatcggccggggggctcgccagagagaaacagaggagatctctcatgcgagcccccaacctggcggcagcgcaaaagatg

SEQ ID NO: 167232 - DNA, 103 bp, Artificial Sequence
  Synthetic Polynucleotide
taatacgactcactataggggcctgctggttggtcggagaggggtggagcaacagaggagagctccaatgctctccgacaacctggcggcagcgcaaaagatg

SEQ ID NO: 167233 - DNA, 103 bp, Artificial Sequence
  Synthetic Polynucleotide
taatacgactcactatagggcacaggcgaggcctgctggttggtcggagaaacagaggagatctccgatgaaccagcagaacctggcggcagcgcaaaagatg

SEQ ID NO: 167234 - DNA, 103 bp, Artificial Sequence
  Synthetic Polynucleotide
taatacgactcactatagggagtagtggatcacaggcgaggcctgctggtaacagaggagaaccagcatgcctcgcctgaacctggcggcagcgcaaaagatg

SEQ ID NO: 167235 - DNA, 103 bp, Artificial Sequence
  Synthetic Polynucleotide
taatacgactcactatagggttggtgggtgagtagtggatcacaggcgagaacagaggagactcgccatggatccactaaacctggcggcagcgcaaaagatg

SEQ ID NO: 167236 - DNA, 103 bp, Artificial Sequence
  Synthetic Polynucleotide
taatacgactcactatagggcagctgctggttggtgggtgagtagtggataacagaggagaatccacatgtcacccaccaacctggcggcagcgcaaaagatg

SEQ ID NO: 167237 - DNA, 103 bp, Artificial Sequence
  Synthetic Polynucleotide
taatacgactcactatagggttccgcagcgcagctgctggttggtgggtgaacagaggagacacccaatgaccagcagcaacctggcggcagcgcaaaagatg

SEQ ID NO: 167238 - DNA, 103 bp, Artificial Sequence
  Synthetic Polynucleotide
taatacgactcactatagggtcctggtggcttccgcagcgcagctgctggaacagaggagaccagcaatggcgctgcggaacctggcggcagcgcaaaagatg

SEQ ID NO: 167239 - DNA, 103 bp, Artificial Sequence
  Synthetic Polynucleotide
taatacgactcactataggggtgctggaactcctggtggcttccgcagcgaacagaggagacgctgcatgagccaccagaacctggcggcagcgcaaaagatg

SEQ ID NO: 167240 - DNA, 103 bp, Artificial Sequence
  Synthetic Polynucleotide
taatacgactcactatagggagtacatgatgtgctggaactcctggtggcaacagaggagagccaccatgagttccagcaacctggcggcagcgcaaaagatg

SEQ ID NO: 167241 - DNA, 103 bp, Artificial Sequence
  Synthetic Polynucleotide
taatacgactcactatagggaaattctcgcagtacatgatgtgctggaacaacagaggagagttccaatgcatcatgtaaacctggcggcagcgcaaaagatg

SEQ ID NO: 167242 - DNA, 103 bp, Artificial Sequence
  Synthetic Polynucleotide
taatacgactcactatagggatccggctctccgaatcggccggggggctcaacagaggagagagcccatgggccgattcaacctggcggcagcgcaaaagatg

SEQ ID NO: 167243 - DNA, 103 bp, Artificial Sequence
  Synthetic Polynucleotide
taatacgactcactataggggcctggtgcgaaattctcgcagtacatgataacagaggagaatcatgatgtgcgagaataacctggcggcagcgcaaaagatg

SEQ ID NO: 167244 - DNA, 103 bp, Artificial Sequence
  Synthetic Polynucleotide
taatacgactcactataggggtctggtggtgcctggtgcgaaattctcgcaacagaggagagcgagaatgtcgcaccagaacctggcggcagcgcaaaagatg

SEQ ID NO: 167245 - DNA, 103 bp, Artificial Sequence
  Synthetic Polynucleotide
taatacgactcactatagggggcgggccaggtctggtggtgcctggtgcgaacagaggagacgcaccatgcaccaccagaacctggcggcagcgcaaaagatg

SEQ ID NO: 167246 - DNA, 103 bp, Artificial Sequence
  Synthetic Polynucleotide
taatacgactcactatagggactgaccgggggcgggccaggtctggtggtaacagaggagaaccaccatgcctggcccgaacctggcggcagcgcaaaagatg

SEQ ID NO: 167247 - DNA, 103 bp, Artificial Sequence
  Synthetic Polynucleotide
taatacgactcactatagggtctgaccttgactgaccgggggcgggccagaacagaggagactggccatgccccggtcaaacctggcggcagcgcaaaagatg

SEQ ID NO: 167248 - DNA, 103 bp, Artificial Sequence
  Synthetic Polynucleotide
taatacgactcactataggggggctcagcctctgaccttgactgaccgggaacagaggagacccggtatgtcaaggtcaaacctggcggcagcgcaaaagatg

SEQ ID NO: 167249 - DNA, 103 bp, Artificial Sequence
  Synthetic Polynucleotide
taatacgactcactataggggtaggaacccgggctcagcctctgaccttgaacagaggagacaaggtatgaggctgagcaacctggcggcagcgcaaaagatg

SEQ ID NO: 167250 - DNA, 103 bp, Artificial Sequence
  Synthetic Polynucleotide
taatacgactcactatagggtgactgtggggtaggaacccgggctcagccaacagaggagaggctgaatgcgggttcctaacctggcggcagcgcaaaagatg

SEQ ID NO: 167251 - DNA, 103 bp, Artificial Sequence
  Synthetic Polynucleotide
taatacgactcactatagggtgctgctgaatgactgtggggtaggaacccaacagaggagagggttcatgccccacagtaacctggcggcagcgcaaaagatg

SEQ ID NO: 167252 - DNA, 103 bp, Artificial Sequence
  Synthetic Polynucleotide
taatacgactcactatagggcgtggcattctgctgctgaatgactgtgggaacagaggagacccacaatgattcagcagaacctggcggcagcgcaaaagatg

SEQ ID NO: 167253 - DNA, 103 bp, Artificial Sequence
  Synthetic Polynucleotide
taatacgactcactataggggccctaccctatccggctctccgaatcggcaacagaggagagccgatatggagagccggaacctggcggcagcgcaaaagatg

SEQ ID NO: 167254 - DNA, 103 bp, Artificial Sequence
  Synthetic Polynucleotide
taatacgactcactatagggctctttggctcgtggcattctgctgctgaaaacagaggagattcagcatgagaatgccaaacctggcggcagcgcaaaagatg

SEQ ID NO: 167255 - DNA, 103 bp, Artificial Sequence
  Synthetic Polynucleotide
taatacgactcactatagggtttttggcggctctttggctcgtggcattcaacagaggagagaatgcatggagccaaagaacctggcggcagcgcaaaagatg

SEQ ID NO: 167256 - DNA, 103 bp, Artificial Sequence
  Synthetic Polynucleotide
taatacgactcactatagggcgggggtccgtttttggcggctctttggctaacagaggagaagccaaatggccgccaaaaacctggcggcagcgcaaaagatg

SEQ ID NO: 167257 - DNA, 103 bp, Artificial Sequence
  Synthetic Polynucleotide
taatacgactcactatagggggtcactgaccgggggtccgtttttggcggaacagaggagaccgccaatgacggaccccaacctggcggcagcgcaaaagatg

SEQ ID NO: 167258 - DNA, 103 bp, Artificial Sequence
  Synthetic Polynucleotide
taatacgactcactatagggacttccttttggtcactgaccgggggtccgaacagaggagacggaccatgggtcagtgaaacctggcggcagcgcaaaagatg

SEQ ID NO: 167259 - DNA, 103 bp, Artificial Sequence
  Synthetic Polynucleotide
taatacgactcactatagggcgcaggtaatacttccttttggtcactgacaacagaggagagtcagtatgcaaaaggaaaacctggcggcagcgcaaaagatg

SEQ ID NO: 167260 - DNA, 103 bp, Artificial Sequence
  Synthetic Polynucleotide
taatacgactcactatagggtggtcacccccgcaggtaatacttccttttaacagaggagaaaaaggatgtattacctgaacctggcggcagcgcaaaagatg

SEQ ID NO: 167261 - DNA, 103 bp, Artificial Sequence
  Synthetic Polynucleotide
taatacgactcactatagggtcctgtttaatggtcacccccgcaggtaataacagaggagaattaccatggggggtgacaacctggcggcagcgcaaaagatg

SEQ ID NO: 167262 - DNA, 103 bp, Artificial Sequence
  Synthetic Polynucleotide
taatacgactcactatagggcaagttctgctcctgtttaatggtcaccccaacagaggagaggggtgatgattaaacagaacctggcggcagcgcaaaagatg

SEQ ID NO: 167263 - DNA, 103 bp, Artificial Sequence
  Synthetic Polynucleotide
taatacgactcactatagggaggtctggtccaagttctgctcctgtttaaaacagaggagattaaacatgagcagaactaacctggcggcagcgcaaaagatg

SEQ ID NO: 167264 - DNA, 103 bp, Artificial Sequence
  Synthetic Polynucleotide
taatacgactcactatagggaacttctgcggccctaccctatccggctctaacagaggagaagagccatgtagggtaggaacctggcggcagcgcaaaagatg

SEQ ID NO: 167265 - DNA, 103 bp, Artificial Sequence
  Synthetic Polynucleotide
taatacgactcactatagggtcatccaagtaggtctggtccaagttctgcaacagaggagagcagaaatgggaccagacaacctggcggcagcgcaaaagatg

SEQ ID NO: 167266 - DNA, 103 bp, Artificial Sequence
  Synthetic Polynucleotide
taatacgactcactatagggtatcagctcatcatccaagtaggtctggtcaacagaggagagaccagatgtacttggataacctggcggcagcgcaaaagatg

SEQ ID NO: 167267 - DNA, 103 bp, Artificial Sequence
  Synthetic Polynucleotide
taatacgactcactatagggggtgtgtgtctatcagctcatcatccaagtaacagaggagaacttggatgatgagctgaaacctggcggcagcgcaaaagatg

SEQ ID NO: 167268 - DNA, 103 bp, Artificial Sequence
  Synthetic Polynucleotide
taatacgactcactatagggatccagctaaggtgtgtgtctatcagctcaaacagaggagatgagctatgagacacacaaacctggcggcagcgcaaaagatg

SEQ ID NO: 167269 - DNA, 103 bp, Artificial Sequence
  Synthetic Polynucleotide
taatacgactcactatagggtatgttttgtatccagctaaggtgtgtgtcaacagaggagagacacaatgcttagctggaacctggcggcagcgcaaaagatg

SEQ ID NO: 167270 - DNA, 103 bp, Artificial Sequence
  Synthetic Polynucleotide
taatacgactcactatagggcgcgctcagaaacttctgcggccctaccctaacagaggagaagggtaatgccgcagaagaacctggcggcagcgcaaaagatg

SEQ ID NO: 167271 - DNA, 103 bp, Artificial Sequence
  Synthetic Polynucleotide
taatacgactcactatagggctggcttggccgcgctcagaaacttctgcgaacagaggagacgcagaatgttctgagcgaacctggcggcagcgcaaaagatg

SEQ ID NO: 167272 - DNA, 103 bp, Artificial Sequence
  Synthetic Polynucleotide
taatacgactcactatagggcctggggcgtccccgccgtcgggttggggcaacagaggagagccccaatgcgacggcggaacctggcggcagcgcaaaagatg

SEQ ID NO: 167273 - DNA, 103 bp, Artificial Sequence
  Synthetic Polynucleotide
taatacgactcactataggggaggcccctgctggcttggccgcgctcagaaacagaggagatctgagatgggccaagccaacctggcggcagcgcaaaagatg

SEQ ID NO: 167274 - DNA, 103 bp, Artificial Sequence
  Synthetic Polynucleotide
taatacgactcactataggggctcaggcccgaggcccctgctggcttggcaacagaggagagccaagatggcaggggccaacctggcggcagcgcaaaagatg

SEQ ID NO: 167275 - DNA, 103 bp, Artificial Sequence
  Synthetic Polynucleotide
taatacgactcactatagggcgatccgagggctcaggcccgaggcccctgaacagaggagacaggggatgcgggcctgaaacctggcggcagcgcaaaagatg

SEQ ID NO: 167276 - DNA, 103 bp, Artificial Sequence
  Synthetic Polynucleotide
taatacgactcactatagggggagtgatctcgatccgagggctcaggcccaacagaggagagggcctatgccctcggataacctggcggcagcgcaaaagatg

SEQ ID NO: 167277 - DNA, 103 bp, Artificial Sequence
  Synthetic Polynucleotide
taatacgactcactatagggttcgtgggacggagtgatctcgatccgaggaacagaggagacctcggatggagatcactaacctggcggcagcgcaaaagatg

SEQ ID NO: 167278 - DNA, 103 bp, Artificial Sequence
  Synthetic Polynucleotide
taatacgactcactatagggcctggatcagttcgtgggacggagtgatctaacagaggagaagatcaatgcgtcccacgaacctggcggcagcgcaaaagatg

SEQ ID NO: 167279 - DNA, 103 bp, Artificial Sequence
  Synthetic Polynucleotide
taatacgactcactatagggggccccactgcctggatcagttcgtgggacaacagaggagagtcccaatgactgatccaaacctggcggcagcgcaaaagatg

SEQ ID NO: 167280 - DNA, 103 bp, Artificial Sequence
  Synthetic Polynucleotide
taatacgactcactatagggcatgcggaggggccccactgcctggatcagaacagaggagactgatcatggcagtggggaacctggcggcagcgcaaaagatg

SEQ ID NO: 167281 - DNA, 103 bp, Artificial Sequence
  Synthetic Polynucleotide
taatacgactcactatagggccgcgtctctcatgcggaggggccccactgaacagaggagacagtggatgccctccgcaaacctggcggcagcgcaaaagatg

SEQ ID NO: 167282 - DNA, 103 bp, Artificial Sequence
  Synthetic Polynucleotide
taatacgactcactatagggaccaggaggcccgcgtctctcatgcggaggaacagaggagacctccgatggagagacgcaacctggcggcagcgcaaaagatg

SEQ ID NO: 167283 - DNA, 103 bp, Artificial Sequence
  Synthetic Polynucleotide
taatacgactcactatagggaggctcgtggcctggggcgtccccgccgtcaacagaggagagacggcatggacgccccaaacctggcggcagcgcaaaagatg

SEQ ID NO: 167284 - DNA, 103 bp, Artificial Sequence
  Synthetic Polynucleotide
taatacgactcactatagggcggctgctccaccaggaggcccgcgtctctaacagaggagaagagacatgggcctcctgaacctggcggcagcgcaaaagatg

SEQ ID NO: 167285 - DNA, 103 bp, Artificial Sequence
  Synthetic Polynucleotide
taatacgactcactatagggcggccaggggcggctgctccaccaggaggcaacagaggagagcctccatgtggagcagcaacctggcggcagcgcaaaagatg

SEQ ID NO: 167286 - DNA, 103 bp, Artificial Sequence
  Synthetic Polynucleotide
taatacgactcactataggggcggccaccccggccaggggcggctgctccaacagaggagaggagcaatggcccctggcaacctggcggcagcgcaaaagatg

SEQ ID NO: 167287 - DNA, 103 bp, Artificial Sequence
  Synthetic Polynucleotide
taatacgactcactatagggcctcgggctggcggccaccccggccaggggaacagaggagacccctgatgggggtggccaacctggcggcagcgcaaaagatg

SEQ ID NO: 167288 - DNA, 103 bp, Artificial Sequence
  Synthetic Polynucleotide
taatacgactcactataggggcagggtgaacctcgggctggcggccacccaacagaggagagggtggatgccagcccgaaacctggcggcagcgcaaaagatg

SEQ ID NO: 167289 - DNA, 103 bp, Artificial Sequence
  Synthetic Polynucleotide
taatacgactcactatagggccgggcacgggcagggtgaacctcgggctgaacagaggagacagcccatggttcaccctaacctggcggcagcgcaaaagatg

SEQ ID NO: 167290 - DNA, 103 bp, Artificial Sequence
  Synthetic Polynucleotide
taatacgactcactataggggccctcgaagccgggcacgggcagggtgaaaacagaggagattcaccatgcccgtgcccaacctggcggcagcgcaaaagatg

SEQ ID NO: 167291 - DNA, 103 bp, Artificial Sequence
  Synthetic Polynucleotide
taatacgactcactataggggctcgcggtagccctcgaagccgggcacggaacagaggagaccgtgcatggcttcgaggaacctggcggcagcgcaaaagatg

SEQ ID NO: 167292 - DNA, 103 bp, Artificial Sequence
  Synthetic Polynucleotide
taatacgactcactatagggaagcaaagcggctcgcggtagccctcgaagaacagaggagacttcgaatgctaccgcgaaacctggcggcagcgcaaaagatg

SEQ ID NO: 167293 - DNA, 103 bp, Artificial Sequence
  Synthetic Polynucleotide
taatacgactcactatagggagcggggctcaagcaaagcggctcgcggtaaacagaggagataccgcatgccgctttgcaacctggcggcagcgcaaaagatg

SEQ ID NO: 167294 - DNA, 103 bp, Artificial Sequence
  Synthetic Polynucleotide
taatacgactcactatagggggctgcccccaggctcgtggcctggggcgtaacagaggagaacgcccatggccacgagcaacctggcggcagcgcaaaagatg

SEQ ID NO: 167295 - DNA, 103 bp, Artificial Sequence
  Synthetic Polynucleotide
taatacgactcactatagggagccgctgctagcggggctcaagcaaagcgaacagaggagacgctttatgtgagccccgaacctggcggcagcgcaaaagatg

SEQ ID NO: 167296 - DNA, 103 bp, Artificial Sequence
  Synthetic Polynucleotide
taatacgactcactatagggctggcagaggagccgctgctagcggggctcaacagaggagagagcccatgtagcagcggaacctggcggcagcgcaaaagatg

SEQ ID NO: 167297 - DNA, 103 bp, Artificial Sequence
  Synthetic Polynucleotide
taatacgactcactatagggagaaatgaagctggcagaggagccgctgctaacagaggagaagcagcatgtcctctgccaacctggcggcagcgcaaaagatg

SEQ ID NO: 167298 - DNA, 103 bp, Artificial Sequence
  Synthetic Polynucleotide
taatacgactcactatagggagaaggtgtcagaaatgaagctggcagaggaacagaggagacctctgatggcttcatttaacctggcggcagcgcaaaagatg

SEQ ID NO: 167299 - DNA, 103 bp, Artificial Sequence
  Synthetic Polynucleotide
taatacgactcactataggggtgtagggggagaaggtgtcagaaatgaagaacagaggagacttcatatgtgacaccttaacctggcggcagcgcaaaagatg

SEQ ID NO: 167300 - DNA, 103 bp, Artificial Sequence
  Synthetic Polynucleotide
taatacgactcactataggggcagggcgaggtgtagggggagaaggtgtcaacagaggagagacaccatgtccccctacaacctggcggcagcgcaaaagatg

SEQ ID NO: 167301 - DNA, 103 bp, Artificial Sequence
  Synthetic Polynucleotide
taatacgactcactatagggtgggcgagacgcagggcgaggtgtagggggaacagaggagaccccctatgcctcgccctaacctggcggcagcgcaaaagatg

SEQ ID NO: 167302 - DNA, 103 bp, Artificial Sequence
  Synthetic Polynucleotide
taatacgactcactatagggccgccgttattgggcgagacgcagggcgagaacagaggagactcgccatgcgtctcgccaacctggcggcagcgcaaaagatg

SEQ ID NO: 167303 - DNA, 103 bp, Artificial Sequence
  Synthetic Polynucleotide
taatacgactcactataggggtcgtcgggcccgccgttattgggcgagacaacagaggagagtctcgatgaataacggcaacctggcggcagcgcaaaagatg

SEQ ID NO: 167304 - DNA, 103 bp, Artificial Sequence
  Synthetic Polynucleotide
taatacgactcactataggggcggacacaggtcgtcgggcccgccgttataacagaggagaataacgatgggcccgacgaacctggcggcagcgcaaaagatg

SEQ ID NO: 167305 - DNA, 103 bp, Artificial Sequence
  Synthetic Polynucleotide
taatacgactcactatagggtcgtcttgggggctgcccccaggctcgtggaacagaggagaccacgaatgtgggggcagaacctggcggcagcgcaaaagatg

SEQ ID NO: 167306 - DNA, 103 bp, Artificial Sequence
  Synthetic Polynucleotide
taatacgactcactatagggttttgaaactgcggacacaggtcgtcgggcaacagaggagagcccgaatgcctgtgtccaacctggcggcagcgcaaaagatg

SEQ ID NO: 167307 - DNA, 103 bp, Artificial Sequence
  Synthetic Polynucleotide
taatacgactcactatagggagcagggatgttttgaaactgcggacacagaacagaggagactgtgtatgcagtttcaaaacctggcggcagcgcaaaagatg

SEQ ID NO: 167308 - DNA, 103 bp, Artificial Sequence
  Synthetic Polynucleotide
taatacgactcactataggggggaataatgagcagggatgttttgaaactaacagaggagaagtttcatgacatccctgaacctggcggcagcgcaaaagatg

SEQ ID NO: 167309 - DNA, 103 bp, Artificial Sequence
  Synthetic Polynucleotide
taatacgactcactataggggaggttctgggggaataatgagcagggatgaacagaggagacatcccatgtcattattcaacctggcggcagcgcaaaagatg

SEQ ID NO: 167310 - DNA, 103 bp, Artificial Sequence
  Synthetic Polynucleotide
taatacgactcactatagggcattattggcgaggttctgggggaataatgaacagaggagacattatatgcccagaaccaacctggcggcagcgcaaaagatg

SEQ ID NO: 167311 - DNA, 103 bp, Artificial Sequence
  Synthetic Polynucleotide
taatacgactcactatagggttcgaggtgacattattggcgaggttctggaacagaggagaccagaaatgcgccaataaaacctggcggcagcgcaaaagatg

SEQ ID NO: 167312 - DNA, 103 bp, Artificial Sequence
  Synthetic Polynucleotide
taatacgactcactataggggcgaggctggttcgaggtgacattattggcaacagaggagagccaatatggtcacctcgaacctggcggcagcgcaaaagatg

SEQ ID NO: 167313 - DNA, 103 bp, Artificial Sequence
  Synthetic Polynucleotide
taatacgactcactataggggctgtcctcggcgaggctggttcgaggtgaaacagaggagatcacctatgaccagcctcaacctggcggcagcgcaaaagatg

SEQ ID NO: 167314 - DNA, 103 bp, Artificial Sequence
  Synthetic Polynucleotide
taatacgactcactatagggggcccaggcagctgtcctcggcgaggctggaacagaggagaccagccatgccgaggacaaacctggcggcagcgcaaaagatg

SEQ ID NO: 167315 - DNA, 103 bp, Artificial Sequence
  Synthetic Polynucleotide
taatacgactcactatagggggcgagtggcggcccaggcagctgtcctcgaacagaggagacgaggaatgctgcctgggaacctggcggcagcgcaaaagatg

SEQ ID NO: 167316 - DNA, 103 bp, Artificial Sequence
  Synthetic Polynucleotide
taatacgactcactataggggaagtcaagctcgtcttgggggctgcccccaacagaggagagggggcatgccccaagacaacctggcggcagcgcaaaagatg

SEQ ID NO: 167317 - DNA, 103 bp, Artificial Sequence
  Synthetic Polynucleotide
taatacgactcactatagggacggggcacgggcgagtggcggcccaggcaaacagaggagatgcctgatgcgccactcgaacctggcggcagcgcaaaagatg

SEQ ID NO: 167318 - DNA, 103 bp, Artificial Sequence
  Synthetic Polynucleotide
taatacgactcactataggggggaggccggacggggcacgggcgagtggcaacagaggagagccactatgccgtgccccaacctggcggcagcgcaaaagatg

SEQ ID NO: 167319 - DNA, 103 bp, Artificial Sequence
  Synthetic Polynucleotide
taatacgactcactataggggatgaggagcgggaggccggacggggcacgaacagaggagacgtgccatgtccggcctcaacctggcggcagcgcaaaagatg

SEQ ID NO: 167320 - DNA, 103 bp, Artificial Sequence
  Synthetic Polynucleotide
taatacgactcactatagggggcaccaggcgatgaggagcgggaggccggaacagaggagaccggccatgcgctcctcaaacctggcggcagcgcaaaagatg

SEQ ID NO: 167321 - DNA, 103 bp, Artificial Sequence
  Synthetic Polynucleotide
taatacgactcactataggggcctccgcttggcaccaggcgatgaggagcaacagaggagagctcctatgcgcctggtgaacctggcggcagcgcaaaagatg

SEQ ID NO: 167322 - DNA, 103 bp, Artificial Sequence
  Synthetic Polynucleotide
taatacgactcactataggggcgcacgaatgcctccgcttggcaccaggcaacagaggagagcctggatgcaagcggagaacctggcggcagcgcaaaagatg

SEQ ID NO: 167323 - DNA, 103 bp, Artificial Sequence
  Synthetic Polynucleotide
taatacgactcactatagggcaaggcctcggcgcacgaatgcctccgcttaacagaggagaaagcggatgcattcgtgcaacctggcggcagcgcaaaagatg

SEQ ID NO: 167324 - DNA, 103 bp, Artificial Sequence
  Synthetic Polynucleotide
taatacgactcactataggggcagggcaaccaaggcctcggcgcacgaataacagaggagaattcgtatgccgaggcctaacctggcggcagcgcaaaagatg

SEQ ID NO: 167325 - DNA, 103 bp, Artificial Sequence
  Synthetic Polynucleotide
taatacgactcactataggggctccgggcggcagggcaaccaaggcctcgaacagaggagacgaggcatgggttgccctaacctggcggcagcgcaaaagatg

SEQ ID NO: 167326 - DNA, 103 bp, Artificial Sequence
  Synthetic Polynucleotide
taatacgactcactatagggctggggtgaggctccgggcggcagggcaacaacagaggagagttgccatgccgcccggaaacctggcggcagcgcaaaagatg

SEQ ID NO: 167327 - DNA, 103 bp, Artificial Sequence
  Synthetic Polynucleotide
taatacgactcactatagggagaggatggagaagtcaagctcgtcttgggaacagaggagacccaagatgagcttgactaacctggcggcagcgcaaaagatg

SEQ ID NO: 167328 - DNA, 103 bp, Artificial Sequence
  Synthetic Polynucleotide
taatacgactcactatagggtccgggagcgctggggtgaggctccgggcgaacagaggagacgcccgatgcctcaccccaacctggcggcagcgcaaaagatg

SEQ ID NO: 167329 - DNA, 103 bp, Artificial Sequence
  Synthetic Polynucleotide
taatacgactcactatagggggcgaggggctccgggagcgctggggtgagaacagaggagactcaccatggcgctcccgaacctggcggcagcgcaaaagatg

SEQ ID NO: 167330 - DNA, 103 bp, Artificial Sequence
  Synthetic Polynucleotide
taatacgactcactatagggtgagggctgcggcgaggggctccgggagcgaacagaggagacgctccatgagcccctcgaacctggcggcagcgcaaaagatg

SEQ ID NO: 167331 - DNA, 103 bp, Artificial Sequence
  Synthetic Polynucleotide
taatacgactcactatagggccacgtgagatgagggctgcggcgaggggcaacagaggagagcccctatgcgcagccctaacctggcggcagcgcaaaagatg

SEQ ID NO: 167332 - DNA, 103 bp, Artificial Sequence
  Synthetic Polynucleotide
taatacgactcactatagggtcctggggtgccacgtgagatgagggctgcaacagaggagagcagccatgatctcacgtaacctggcggcagcgcaaaagatg

SEQ ID NO: 167333 - DNA, 103 bp, Artificial Sequence
  Synthetic Polynucleotide
taatacgactcactatagggggagccgtggtcctggggtgccacgtgagaaacagaggagatctcacatggcaccccagaacctggcggcagcgcaaaagatg

SEQ ID NO: 167334 - DNA, 103 bp, Artificial Sequence
  Synthetic Polynucleotide
taatacgactcactatagggacccagccggggagccgtggtcctggggtgaacagaggagacaccccatgaccacggctaacctggcggcagcgcaaaagatg

SEQ ID NO: 167335 - DNA, 103 bp, Artificial Sequence
  Synthetic Polynucleotide
taatacgactcactatagggacaggggggtacccagccggggagccgtggaacagaggagaccacggatgcccggctggaacctggcggcagcgcaaaagatg

SEQ ID NO: 167336 - DNA, 103 bp, Artificial Sequence
  Synthetic Polynucleotide
taatacgactcactatagggagagccagccacaggggggtacccagccggaacagaggagaccggctatgtacccccctaacctggcggcagcgcaaaagatg

SEQ ID NO: 167337 - DNA, 103 bp, Artificial Sequence
  Synthetic Polynucleotide
taatacgactcactatagggtgatcacggcagagccagccacaggggggtaacagaggagaacccccatgtggctggctaacctggcggcagcgcaaaagatg

SEQ ID NO: 167338 - DNA, 103 bp, Artificial Sequence
  Synthetic Polynucleotide
taatacgactcactatagggtcatagtcgaagaggatggagaagtcaagcaacagaggagagcttgaatgctccatcctaacctggcggcagcgcaaaagatg

SEQ ID NO: 167339 - DNA, 103 bp, Artificial Sequence
  Synthetic Polynucleotide
taatacgactcactatagggagggcatccatgatcacggcagagccagccaacagaggagaggctggatgtgccgtgataacctggcggcagcgcaaaagatg

SEQ ID NO: 167340 - DNA, 103 bp, Artificial Sequence
  Synthetic Polynucleotide
taatacgactcactataggggaggctgttcagggcatccatgatcacggcaacagaggagagccgtgatgatggatgccaacctggcggcagcgcaaaagatg

SEQ ID NO: 167341 - DNA, 103 bp, Artificial Sequence
  Synthetic Polynucleotide
taatacgactcactatagggagtccgtggcgaggctgttcagggcatccaaacagaggagatggatgatgtgaacagccaacctggcggcagcgcaaaagatg

SEQ ID NO: 167342 - DNA, 103 bp, Artificial Sequence
  Synthetic Polynucleotide
taatacgactcactatagggccacaaggcgagtccgtggcgaggctgttcaacagaggagagaacagatgcgccacggaaacctggcggcagcgcaaaagatg

SEQ ID NO: 167343 - DNA, 103 bp, Artificial Sequence
  Synthetic Polynucleotide
taatacgactcactataggggggggggatcccacaaggcgagtccgtggcaacagaggagagccacgatgtcgccttgtaacctggcggcagcgcaaaagatg

SEQ ID NO: 167344 - DNA, 103 bp, Artificial Sequence
  Synthetic Polynucleotide
taatacgactcactatagggtccacatcttgggggggatcccacaaggcgaacagaggagacgccttatgggatcccccaacctggcggcagcgcaaaagatg

SEQ ID NO: 167345 - DNA, 103 bp, Artificial Sequence
  Synthetic Polynucleotide
taatacgactcactataggggggctggtcttccacatcttgggggggatcaacagaggagagatcccatgcaagatgtgaacctggcggcagcgcaaaagatg

SEQ ID NO: 167346 - DNA, 103 bp, Artificial Sequence
  Synthetic Polynucleotide
taatacgactcactatagggcgaggggtcagggctggtcttccacatcttaacagaggagaaagatgatgaagaccagcaacctggcggcagcgcaaaagatg

SEQ ID NO: 167347 - DNA, 103 bp, Artificial Sequence
  Synthetic Polynucleotide
taatacgactcactatagggcagacaccggcgaggggtcagggctggtctaacagaggagaagaccaatgctgacccctaacctggcggcagcgcaaaagatg

SEQ ID NO: 167348 - DNA, 103 bp, Artificial Sequence
  Synthetic Polynucleotide
taatacgactcactataggggatggggcggcagacaccggcgaggggtcaaacagaggagatgacccatggccggtgtcaacctggcggcagcgcaaaagatg

SEQ ID NO: 167349 - DNA, 103 bp, Artificial Sequence
  Synthetic Polynucleotide
taatacgactcactataggggtcgtgggcgccacagtttgcagtagtcataacagaggagaatgactatggcaaactgtaacctggcggcagcgcaaaagatg

SEQ ID NO: 167350 - DNA, 103 bp, Artificial Sequence
  Synthetic Polynucleotide
taatacgactcactatagggatcatctggctcaagatctgcaggccgcgaaacagaggagatcgcggatggcagatcttaacctggcggcagcgcaaaagatg

SEQ ID NO: 167351 - DNA, 103 bp, Artificial Sequence
  Synthetic Polynucleotide
taatacgactcactatagggtgttttgagagggatgtcagtctctacacaaacagaggagatgtgtaatgactgacatcaacctggcggcagcgcaaaagatg

SEQ ID NO: 167352 - DNA, 103 bp, Artificial Sequence
  Synthetic Polynucleotide
taatacgactcactatagggaagttttccttgttttgagagggatgtcagaacagaggagactgacaatgctctcaaaaaacctggcggcagcgcaaaagatg

SEQ ID NO: 167353 - DNA, 103 bp, Artificial Sequence
  Synthetic Polynucleotide
taatacgactcactatagggtgatcttcagaagttttccttgttttgagaaacagaggagatctcaaatgaaggaaaacaacctggcggcagcgcaaaagatg

SEQ ID NO: 167354 - DNA, 103 bp, Artificial Sequence
  Synthetic Polynucleotide
taatacgactcactatagggtatggcagcttgatcttcagaagttttcctaacagaggagaaggaaaatgtctgaagataacctggcggcagcgcaaaagatg

SEQ ID NO: 167355 - DNA, 103 bp, Artificial Sequence
  Synthetic Polynucleotide
taatacgactcactatagggttcctggtagtatggcagcttgatcttcagaacagaggagactgaagatgaagctgccaaacctggcggcagcgcaaaagatg

SEQ ID NO: 167356 - DNA, 103 bp, Artificial Sequence
  Synthetic Polynucleotide
taatacgactcactatagggagctctaattttcctggtagtatggcagctaacagaggagaagctgcatgactaccaggaacctggcggcagcgcaaaagatg

SEQ ID NO: 167357 - DNA, 103 bp, Artificial Sequence
  Synthetic Polynucleotide
taatacgactcactatagggatctgaacacagctctaattttcctggtagaacagaggagactaccaatgaaattagagaacctggcggcagcgcaaaagatg

SEQ ID NO: 167358 - DNA, 103 bp, Artificial Sequence
  Synthetic Polynucleotide
taatacgactcactatagggtcccttggtcatctgaacacagctctaattaacagaggagaaattagatgtgtgttcagaacctggcggcagcgcaaaagatg

SEQ ID NO: 167359 - DNA, 103 bp, Artificial Sequence
  Synthetic Polynucleotide
taatacgactcactatagggggtgataaactcccttggtcatctgaacacaacagaggagagtgttcatgtgaccaaggaacctggcggcagcgcaaaagatg

SEQ ID NO: 167360 - DNA, 103 bp, Artificial Sequence
  Synthetic Polynucleotide
taatacgactcactatagggctcccgggctggtgataaactcccttggtcaacagaggagagaccaaatgagtttatcaaacctggcggcagcgcaaaagatg

SEQ ID NO: 167361 - DNA, 103 bp, Artificial Sequence
  Synthetic Polynucleotide
taatacgactcactatagggtggatgcacaatcatctggctcaagatctgaacagaggagacagatcatgagccagatgaacctggcggcagcgcaaaagatg

SEQ ID NO: 167362 - DNA, 103 bp, Artificial Sequence
  Synthetic Polynucleotide
taatacgactcactatagggctattgaagtctcccgggctggtgataaacaacagaggagagtttatatgcagcccgggaacctggcggcagcgcaaaagatg

SEQ ID NO: 167363 - DNA, 103 bp, Artificial Sequence
  Synthetic Polynucleotide
taatacgactcactatagggaggccatcatctattgaagtctcccgggctaacagaggagaagcccgatggacttcaataacctggcggcagcgcaaaagatg

SEQ ID NO: 167364 - DNA, 103 bp, Artificial Sequence
  Synthetic Polynucleotide
taatacgactcactatagggctgagatccaaggccatcatctattgaagtaacagaggagaacttcaatggatgatggcaacctggcggcagcgcaaaagatg

SEQ ID NO: 167365 - DNA, 103 bp, Artificial Sequence
  Synthetic Polynucleotide
taatacgactcactatagggttaaaggatactgagatccaaggccatcataacagaggagaatgatgatgttggatctcaacctggcggcagcgcaaaagatg

SEQ ID NO: 167366 - DNA, 103 bp, Artificial Sequence
  Synthetic Polynucleotide
taatacgactcactataggggaatctttctttaaaggatactgagatccaaacagaggagatggatcatggtatcctttaacctggcggcagcgcaaaagatg

SEQ ID NO: 167367 - DNA, 103 bp, Artificial Sequence
  Synthetic Polynucleotide
taatacgactcactatagggatcaccacatgaatctttctttaaaggataaacagaggagatatcctatgaagaaagataacctggcggcagcgcaaaagatg

SEQ ID NO: 167368 - DNA, 103 bp, Artificial Sequence
  Synthetic Polynucleotide
taatacgactcactatagggaaagaaactgatcaccacatgaatctttctaacagaggagaagaaagatgcatgtggtgaacctggcggcagcgcaaaagatg

SEQ ID NO: 167369 - DNA, 103 bp, Artificial Sequence
  Synthetic Polynucleotide
taatacgactcactataggggaaggaactgaaagaaactgatcaccacataacagaggagaatgtggatgtcagtttctaacctggcggcagcgcaaaagatg

SEQ ID NO: 167370 - DNA, 103 bp, Artificial Sequence
  Synthetic Polynucleotide
taatacgactcactatagggggtaaagggtgaaggaactgaaagaaactgaacagaggagacagtttatgtcagttcctaacctggcggcagcgcaaaagatg

SEQ ID NO: 167371 - DNA, 103 bp, Artificial Sequence
  Synthetic Polynucleotide
taatacgactcactataggggtttgctccaggtaaagggtgaaggaactgaacagaggagacagttcatgcaccctttaaacctggcggcagcgcaaaagatg

SEQ ID NO: 167372 - DNA, 103 bp, Artificial Sequence
  Synthetic Polynucleotide
taatacgactcactatagggaagatgtaaatggatgcacaatcatctggcaacagaggagagccagaatgttgtgcatcaacctggcggcagcgcaaaagatg

SEQ ID NO: 167373 - DNA, 103 bp, Artificial Sequence
  Synthetic Polynucleotide
taatacgactcactatagggccaggctttggtttgctccaggtaaagggtaacagaggagaacccttatgctggagcaaaacctggcggcagcgcaaaagatg

SEQ ID NO: 167374 - DNA, 103 bp, Artificial Sequence
  Synthetic Polynucleotide
taatacgactcactatagggaggggtgtggccaggctttggtttgctccaaacagaggagatggagcatgccaaagcctaacctggcggcagcgcaaaagatg

SEQ ID NO: 167375 - DNA, 103 bp, Artificial Sequence
  Synthetic Polynucleotide
taatacgactcactatagggtgcgaaatataggggtgtggccaggctttgaacagaggagacaaagcatggccacacccaacctggcggcagcgcaaaagatg

SEQ ID NO: 167376 - DNA, 103 bp, Artificial Sequence
  Synthetic Polynucleotide
taatacgactcactatagggaatgaagatgtgcgaaatataggggtgtggaacagaggagaccacacatgtatatttcgaacctggcggcagcgcaaaagatg

SEQ ID NO: 167377 - DNA, 103 bp, Artificial Sequence
  Synthetic Polynucleotide
taatacgactcactatagggtagtggaggtaatgaagatgtgcgaaatataacagaggagaatatttatgacatcttcaaacctggcggcagcgcaaaagatg

SEQ ID NO: 167378 - DNA, 103 bp, Artificial Sequence
  Synthetic Polynucleotide
taatacgactcactatagggaaggccagtctagtggaggtaatgaagatgaacagaggagacatcttatgtacctccacaacctggcggcagcgcaaaagatg

SEQ ID NO: 167379 - DNA, 103 bp, Artificial Sequence
  Synthetic Polynucleotide
taatacgactcactatagggtgagctggtaaaggccagtctagtggaggtaacagaggagaacctccatgagactggccaacctggcggcagcgcaaaagatg

SEQ ID NO: 167380 - DNA, 103 bp, Artificial Sequence
  Synthetic Polynucleotide
taatacgactcactatagggttgtccaaaatgagctggtaaaggccagtcaacagaggagagactggatgttaccagctaacctggcggcagcgcaaaagatg

SEQ ID NO: 167381 - DNA, 103 bp, Artificial Sequence
  Synthetic Polynucleotide
taatacgactcactatagggtcagttcacattgtccaaaatgagctggtaaacagaggagataccagatgattttggacaacctggcggcagcgcaaaagatg

SEQ ID NO: 167382 - DNA, 103 bp, Artificial Sequence
  Synthetic Polynucleotide
taatacgactcactatagggacttctattttcagttcacattgtccaaaaaacagaggagattttggatgatgtgaactaacctggcggcagcgcaaaagatg

SEQ ID NO: 167383 - DNA, 103 bp, Artificial Sequence
  Synthetic Polynucleotide
taatacgactcactatagggatctacattaaagatgtaaatggatgcacaaacagaggagatgtgcaatgatttacatcaacctggcggcagcgcaaaagatg

SEQ ID NO: 167384 - DNA, 103 bp, Artificial Sequence
  Synthetic Polynucleotide
taatacgactcactatagggtttaggttgcacttctattttcagttcacaaacagaggagatgtgaaatgaaaatagaaaacctggcggcagcgcaaaagatg

SEQ ID NO: 167385 - DNA, 103 bp, Artificial Sequence
  Synthetic Polynucleotide
taatacgactcactataggggatgatgagttttaggttgcacttctatttaacagaggagaaaatagatgtgcaacctaaacctggcggcagcgcaaaagatg

SEQ ID NO: 167386 - DNA, 103 bp, Artificial Sequence
  Synthetic Polynucleotide
taatacgactcactatagggtaatgggctcgatgatgagttttaggttgcaacagaggagagcaaccatgaactcatcaaacctggcggcagcgcaaaagatg

SEQ ID NO: 167387 - DNA, 103 bp, Artificial Sequence
  Synthetic Polynucleotide
taatacgactcactatagggttcagtttcataatgggctcgatgatgagtaacagaggagaactcatatgcgagcccataacctggcggcagcgcaaaagatg

SEQ ID NO: 167388 - DNA, 103 bp, Artificial Sequence
  Synthetic Polynucleotide
taatacgactcactatagggctcggctaccttcagtttcataatgggctcaacagaggagagagcccatgatgaaactgaacctggcggcagcgcaaaagatg

SEQ ID NO: 167389 - DNA, 103 bp, Artificial Sequence
  Synthetic Polynucleotide
taatacgactcactatagggtttactgcccctcggctaccttcagtttcaaacagaggagatgaaacatgaggtagccgaacctggcggcagcgcaaaagatg

SEQ ID NO: 167390 - DNA, 103 bp, Artificial Sequence
  Synthetic Polynucleotide
taatacgactcactatagggagtagatgcttttactgcccctcggctaccaacagaggagaggtagcatgggggcagtaaacctggcggcagcgcaaaagatg

SEQ ID NO: 167391 - DNA, 103 bp, Artificial Sequence
  Synthetic Polynucleotide
taatacgactcactataggggatgtcccccagtagatgcttttactgcccaacagaggagagggcagatgaagcatctaaacctggcggcagcgcaaaagatg

SEQ ID NO: 167392 - DNA, 103 bp, Artificial Sequence
  Synthetic Polynucleotide
taatacgactcactatagggttcacaacaggatgtcccccagtagatgctaacagaggagaagcatcatgtgggggacaaacctggcggcagcgcaaaagatg

SEQ ID NO: 167393 - DNA, 103 bp, Artificial Sequence
  Synthetic Polynucleotide
taatacgactcactataggggcccaggagcttcacaacaggatgtcccccaacagaggagagggggaatgcctgttgtgaacctggcggcagcgcaaaagatg

SEQ ID NO: 167394 - DNA, 103 bp, Artificial Sequence
  Synthetic Polynucleotide
taatacgactcactatagggatggaggtggatctacattaaagatgtaaaaacagaggagatttacaatgttaatgtagaacctggcggcagcgcaaaagatg

SEQ ID NO: 167395 - DNA, 103 bp, Artificial Sequence
  Synthetic Polynucleotide
taatacgactcactatagggtttcgttatagcccaggagcttcacaacagaacagaggagactgttgatgagctcctggaacctggcggcagcgcaaaagatg

SEQ ID NO: 167396 - DNA, 103 bp, Artificial Sequence
  Synthetic Polynucleotide
taatacgactcactatagggtttattggcttttcgttatagcccaggagcaacagaggagagctcctatgctataacgaaacctggcggcagcgcaaaagatg

SEQ ID NO: 167397 - DNA, 103 bp, Artificial Sequence
  Synthetic Polynucleotide
taatacgactcactatagggcatttgtagatttattggcttttcgttataaacagaggagatataacatgaagccaataaacctggcggcagcgcaaaagatg

SEQ ID NO: 167398 - DNA, 103 bp, Artificial Sequence
  Synthetic Polynucleotide
taatacgactcactatagggtcccaataaacatttgtagatttattggctaacagaggagaagccaaatgatctacaaaaacctggcggcagcgcaaaagatg

SEQ ID NO: 167399 - DNA, 103 bp, Artificial Sequence
  Synthetic Polynucleotide
taatacgactcactatagggtcatctgctgtcccaataaacatttgtagaaacagaggagatctacaatggtttattggaacctggcggcagcgcaaaagatg

SEQ ID NO: 167400 - DNA, 103 bp, Artificial Sequence
  Synthetic Polynucleotide
taatacgactcactatagggtaaatatcgatcatctgctgtcccaataaaaacagaggagatttattatgacagcagataacctggcggcagcgcaaaagatg

SEQ ID NO: 167401 - DNA, 103 bp, Artificial Sequence
  Synthetic Polynucleotide
taatacgactcactatagggcatgaggtcgtaaatatcgatcatctgctgaacagaggagacagcagatgatcgatattaacctggcggcagcgcaaaagatg

SEQ ID NO: 167402 - DNA, 103 bp, Artificial Sequence
  Synthetic Polynucleotide
taatacgactcactatagggtggtaaaatgcatgaggtcgtaaatatcgaaacagaggagatcgataatgacgacctcaaacctggcggcagcgcaaaagatg

SEQ ID NO: 167403 - DNA, 103 bp, Artificial Sequence
  Synthetic Polynucleotide
taatacgactcactatagggtcgatgcacctggtaaaatgcatgaggtcgaacagaggagacgacctatggcattttacaacctggcggcagcgcaaaagatg

SEQ ID NO: 167404 - DNA, 103 bp, Artificial Sequence
  Synthetic Polynucleotide
taatacgactcactatagggtcccagtgattcgatgcacctggtaaaatgaacagaggagacattttatgaggtgcatcaacctggcggcagcgcaaaagatg

SEQ ID NO: 167405 - DNA, 103 bp, Artificial Sequence
  Synthetic Polynucleotide
taatacgactcactataggggttaaagtagatggaggtggatctacattaaacagaggagataatgtatgtccacctccaacctggcggcagcgcaaaagatg

SEQ ID NO: 167406 - DNA, 103 bp, Artificial Sequence
  Synthetic Polynucleotide
taatacgactcactataggggcgactgtcttcccagtgattcgatgcaccaacagaggagaggtgcaatgaatcactggaacctggcggcagcgcaaaagatg

SEQ ID NO: 167407 - DNA, 103 bp, Artificial Sequence
  Synthetic Polynucleotide
taatacgactcactataggggcttgcagtagcgactgtcttcccagtgataacagaggagaatcactatgaagacagtcaacctggcggcagcgcaaaagatg

SEQ ID NO: 167408 - DNA, 103 bp, Artificial Sequence
  Synthetic Polynucleotide
taatacgactcactatagggttatctcttggcttgcagtagcgactgtctaacagaggagaagacagatgctactgcaaaacctggcggcagcgcaaaagatg

SEQ ID NO: 167409 - DNA, 103 bp, Artificial Sequence
  Synthetic Polynucleotide
taatacgactcactatagggctggcaattattatctcttggcttgcagtaaacagaggagatactgcatgccaagagataacctggcggcagcgcaaaagatg

SEQ ID NO: 167410 - DNA, 103 bp, Artificial Sequence
  Synthetic Polynucleotide
taatacgactcactatagggaacttttgtactggcaattattatctcttgaacagaggagacaagagatgataattgccaacctggcggcagcgcaaaagatg

SEQ ID NO: 167411 - DNA, 103 bp, Artificial Sequence
  Synthetic Polynucleotide
taatacgactcactataggggaatttccagaacttttgtactggcaattaaacagaggagataattgatggtacaaaagaacctggcggcagcgcaaaagatg

SEQ ID NO: 167412 - DNA, 103 bp, Artificial Sequence
  Synthetic Polynucleotide
taatacgactcactatagggggaagaagtggaatttccagaacttttgtaaacagaggagatacaaaatgtctggaaataacctggcggcagcgcaaaagatg

SEQ ID NO: 167413 - DNA, 103 bp, Artificial Sequence
  Synthetic Polynucleotide
taatacgactcactatagggattattttcaggaagaagtggaatttccagaacagaggagactggaaatgccacttcttaacctggcggcagcgcaaaagatg

SEQ ID NO: 167414 - DNA, 103 bp, Artificial Sequence
  Synthetic Polynucleotide
taatacgactcactatagggtggctgacatattattttcaggaagaagtgaacagaggagacacttcatgctgaaaataaacctggcggcagcgcaaaagatg

SEQ ID NO: 167415 - DNA, 103 bp, Artificial Sequence
  Synthetic Polynucleotide
taatacgactcactatagggcaatcaatactggctgacatattattttcaaacagaggagatgaaaaatgtatgtcagcaacctggcggcagcgcaaaagatg

SEQ ID NO: 167416 - DNA, 103 bp, Artificial Sequence
  Synthetic Polynucleotide
taatacgactcactatagggaagtggtgtggttaaagtagatggaggtggaacagaggagaccacctatgtctactttaaacctggcggcagcgcaaaagatg

SEQ ID NO: 167417 - DNA, 103 bp, Artificial Sequence
  Synthetic Polynucleotide
taatacgactcactatagggaatacctgcacaatcaatactggctgacataacagaggagaatgtcaatgagtattgataacctggcggcagcgcaaaagatg

SEQ ID NO: 167418 - DNA, 103 bp, Artificial Sequence
  Synthetic Polynucleotide
taatacgactcactatagggggagtttcaaaatacctgcacaatcaatacaacagaggagagtattgatggtgcaggtaaacctggcggcagcgcaaaagatg

SEQ ID NO: 167419 - DNA, 103 bp, Artificial Sequence
  Synthetic Polynucleotide
taatacgactcactatagggtctgaattgcggagtttcaaaatacctgcaaacagaggagatgcaggatgtttgaaactaacctggcggcagcgcaaaagatg

SEQ ID NO: 167420 - DNA, 103 bp, Artificial Sequence
  Synthetic Polynucleotide
taatacgactcactatagggaagttctatatctgaattgcggagtttcaaaacagaggagattgaaaatgcgcaattcaaacctggcggcagcgcaaaagatg

SEQ ID NO: 167421 - DNA, 103 bp, Artificial Sequence
  Synthetic Polynucleotide
taatacgactcactatagggctccttttcgaagttctatatctgaattgcaacagaggagagcaattatgatatagaacaacctggcggcagcgcaaaagatg

SEQ ID NO: 167422 - DNA, 103 bp, Artificial Sequence
  Synthetic Polynucleotide
taatacgactcactatagggatatcagtttctccttttcgaagttctataaacagaggagatatagaatgtcgaaaaggaacctggcggcagcgcaaaagatg

SEQ ID NO: 167423 - DNA, 103 bp, Artificial Sequence
  Synthetic Polynucleotide
taatacgactcactatagggctttctgccaatatcagtttctccttttcgaacagaggagacgaaaaatggaaactgataacctggcggcagcgcaaaagatg

SEQ ID NO: 167424 - DNA, 103 bp, Artificial Sequence
  Synthetic Polynucleotide
taatacgactcactatagggctctagtattctttctgccaatatcagtttaacagaggagaaaactgatgttggcagaaaacctggcggcagcgcaaaagatg

SEQ ID NO: 167425 - DNA, 103 bp, Artificial Sequence
  Synthetic Polynucleotide
taatacgactcactatagggacaagtcgtactctagtattctttctgccaaacagaggagatggcagatggaatactagaacctggcggcagcgcaaaagatg

SEQ ID NO: 167426 - DNA, 103 bp, Artificial Sequence
  Synthetic Polynucleotide
taatacgactcactatagggtacacgaaacacaagtcgtactctagtattaacagaggagaaatactatggtacgacttaacctggcggcagcgcaaaagatg

SEQ ID NO: 167427 - DNA, 103 bp, Artificial Sequence
  Synthetic Polynucleotide
taatacgactcactataggggtggtaagcaaagtggtgtggttaaagtagaacagaggagactacttatgccacaccacaacctggcggcagcgcaaaagatg

SEQ ID NO: 167428 - DNA, 103 bp, Artificial Sequence
  Synthetic Polynucleotide
taatacgactcactataggggtgggatgtgtacacgaaacacaagtcgtaaacagaggagatacgacatgtgtttcgtgaacctggcggcagcgcaaaagatg

SEQ ID NO: 167429 - DNA, 103 bp, Artificial Sequence
  Synthetic Polynucleotide
taatacgactcactatagggccactgggctgtgggatgtgtacacgaaacaacagaggagagtttcgatgacacatcccaacctggcggcagcgcaaaagatg

SEQ ID NO: 167430 - DNA, 103 bp, Artificial Sequence
  Synthetic Polynucleotide
taatacgactcactatagggaaggacttttccactgggctgtgggatgtgaacagaggagacacatcatgcagcccagtaacctggcggcagcgcaaaagatg

SEQ ID NO: 167431 - DNA, 103 bp, Artificial Sequence
  Synthetic Polynucleotide
taatacgactcactatagggtctgcagagaaaggacttttccactgggctaacagaggagaagcccaatggaaaagtccaacctggcggcagcgcaaaagatg

SEQ ID NO: 167432 - DNA, 103 bp, Artificial Sequence
  Synthetic Polynucleotide
taatacgactcactatagggatagaggctatctgcagagaaaggacttttaacagaggagaaaaagtatgttctctgcaaacctggcggcagcgcaaaagatg

SEQ ID NO: 167433 - DNA, 103 bp, Artificial Sequence
  Synthetic Polynucleotide
taatacgactcactatagggctcaacgggtatagaggctatctgcagagaaacagaggagatctctgatgatagcctctaacctggcggcagcgcaaaagatg

SEQ ID NO: 167434 - DNA, 103 bp, Artificial Sequence
  Synthetic Polynucleotide
taatacgactcactataggggctgggagcactcaacgggtatagaggctaaacagaggagatagcctatgtacccgttgaacctggcggcagcgcaaaagatg

SEQ ID NO: 167435 - DNA, 103 bp, Artificial Sequence
  Synthetic Polynucleotide
taatacgactcactatagggtgagcagaccgctgggagcactcaacgggtaacagaggagaacccgtatggtgctcccaaacctggcggcagcgcaaaagatg

SEQ ID NO: 167436 - DNA, 103 bp, Artificial Sequence
  Synthetic Polynucleotide
taatacgactcactatagggaggaagttcttgagcagaccgctgggagcaaacagaggagatgctccatgcggtctgctaacctggcggcagcgcaaaagatg

SEQ ID NO: 167437 - DNA, 103 bp, Artificial Sequence
  Synthetic Polynucleotide
taatacgactcactatagggtctcaatatgaggaagttcttgagcagaccaacagaggagaggtctgatgaagaacttcaacctggcggcagcgcaaaagatg

SEQ ID NO: 167438 - DNA, 103 bp, Artificial Sequence
  Synthetic Polynucleotide
taatacgactcactatagggaatccatgatgtggtaagcaaagtggtgtgaacagaggagacacaccatgttgcttaccaacctggcggcagcgcaaaagatg

SEQ ID NO: 167439 - DNA, 103 bp, Artificial Sequence
  Synthetic Polynucleotide
taatacgactcactatagggatactgtacttctcaatatgaggaagttctaacagaggagaagaactatgtcatattgaaacctggcggcagcgcaaaagatg

SEQ ID NO: 167440 - DNA, 103 bp, Artificial Sequence
  Synthetic Polynucleotide
taatacgactcactatagggacaactgttgatactgtacttctcaatatgaacagaggagacatattatgaagtacagtaacctggcggcagcgcaaaagatg

SEQ ID NO: 167441 - DNA, 103 bp, Artificial Sequence
  Synthetic Polynucleotide
taatacgactcactatagggcatttacagaacaactgttgatactgtactaacagaggagaagtacaatgtcaacagttaacctggcggcagcgcaaaagatg

SEQ ID NO: 167442 - DNA, 103 bp, Artificial Sequence
  Synthetic Polynucleotide
taatacgactcactatagggtcatgacctccatttacagaacaactgttgaacagaggagacaacagatgttctgtaaaaacctggcggcagcgcaaaagatg

SEQ ID NO: 167443 - DNA, 103 bp, Artificial Sequence
  Synthetic Polynucleotide
taatacgactcactatagggcacaaccatttcatgacctccatttacagaaacagaggagatctgtaatgggaggtcataacctggcggcagcgcaaaagatg

SEQ ID NO: 167444 - DNA, 103 bp, Artificial Sequence
  Synthetic Polynucleotide
taatacgactcactatagggtagatccagtcacaaccatttcatgacctcaacagaggagagaggtcatgaaatggttgaacctggcggcagcgcaaaagatg

SEQ ID NO: 167445 - DNA, 103 bp, Artificial Sequence
  Synthetic Polynucleotide
taatacgactcactatagggggaagaaaattagatccagtcacaaccattaacagaggagaaatggtatggactggatcaacctggcggcagcgcaaaagatg

SEQ ID NO: 167446 - DNA, 103 bp, Artificial Sequence
  Synthetic Polynucleotide
taatacgactcactatagggtttggattctggaagaaaattagatccagtaacagaggagaactggaatgaattttcttaacctggcggcagcgcaaaagatg

SEQ ID NO: 167447 - DNA, 103 bp, Artificial Sequence
  Synthetic Polynucleotide
taatacgactcactataggggaaaaatgattttggattctggaagaaaataacagaggagaattttcatgcagaatccaaacctggcggcagcgcaaaagatg

SEQ ID NO: 167448 - DNA, 103 bp, Artificial Sequence
  Synthetic Polynucleotide
taatacgactcactatagggcctttttcaagaaaaatgattttggattctaacagaggagaagaatcatgaatcattttaacctggcggcagcgcaaaagatg

SEQ ID NO: 167449 - DNA, 103 bp, Artificial Sequence
  Synthetic Polynucleotide
taatacgactcactataggggtgagacggtaatccatgatgtggtaagcaaacagaggagatgcttaatgcatcatggaaacctggcggcagcgcaaaagatg

SEQ ID NO: 167450 - DNA, 103 bp, Artificial Sequence
  Synthetic Polynucleotide
taatacgactcactatagggtccatcttgtcctttttcaagaaaaatgataacagaggagaatcattatgcttgaaaaaaacctggcggcagcgcaaaagatg

SEQ ID NO: 167451 - DNA, 103 bp, Artificial Sequence
  Synthetic Polynucleotide
taatacgactcactatagggactgaggtcgtccatcttgtcctttttcaaaacagaggagattgaaaatggacaagatgaacctggcggcagcgcaaaagatg

SEQ ID NO: 167452 - DNA, 103 bp, Artificial Sequence
  Synthetic Polynucleotide
taatacgactcactatagggtctacctcccactgaggtcgtccatcttgtaacagaggagaacaagaatgacgacctcaaacctggcggcagcgcaaaagatg

SEQ ID NO: 167453 - DNA, 103 bp, Artificial Sequence
  Synthetic Polynucleotide
taatacgactcactatagggtatcttcccttctacctcccactgaggtcgaacagaggagacgacctatgtgggaggtaaacctggcggcagcgcaaaagatg

SEQ ID NO: 167454 - DNA, 103 bp, Artificial Sequence
  Synthetic Polynucleotide
taatacgactcactatagggtttccctgattatcttcccttctacctcccaacagaggagagggaggatgaagggaagaaacctggcggcagcgcaaaagatg

SEQ ID NO: 167455 - DNA, 103 bp, Artificial Sequence
  Synthetic Polynucleotide
taatacgactcactatagggccttgacatttttccctgattatcttccctaacagaggagaagggaaatgaatcagggaaacctggcggcagcgcaaaagatg

SEQ ID NO: 167456 - DNA, 103 bp, Artificial Sequence
  Synthetic Polynucleotide
taatacgactcactatagggaatgtgagccccttgacatttttccctgataacagaggagaatcaggatgaaatgtcaaaacctggcggcagcgcaaaagatg

SEQ ID NO: 167457 - DNA, 103 bp, Artificial Sequence
  Synthetic Polynucleotide
taatacgactcactatagggcttcaaggacaatgtgagccccttgacattaacagaggagaaatgtcatggggctcacaaacctggcggcagcgcaaaagatg

SEQ ID NO: 167458 - DNA, 103 bp, Artificial Sequence
  Synthetic Polynucleotide
taatacgactcactatagggtatggaggaacttcaaggacaatgtgagccaacagaggagaggctcaatgtgtccttgaaacctggcggcagcgcaaaagatg

SEQ ID NO: 167459 - DNA, 103 bp, Artificial Sequence
  Synthetic Polynucleotide
taatacgactcactatagggtgggttatgatatggaggaacttcaaggacaacagaggagagtccttatggttcctccaaacctggcggcagcgcaaaagatg

SEQ ID NO: 167460 - DNA, 103 bp, Artificial Sequence
  Synthetic Polynucleotide
taatacgactcactatagggagtcgagctcgtcgtgggcgccacagtttgaacagaggagacaaactatggcgcccacgaacctggcggcagcgcaaaagatg

SEQ ID NO: 167461 - DNA, 103 bp, Artificial Sequence
  Synthetic Polynucleotide
taatacgactcactatagggaaacagaagagtgagacggtaatccatgataacagaggagaatcatgatgtaccgtctcaacctggcggcagcgcaaaagatg

SEQ ID NO: 167462 - DNA, 103 bp, Artificial Sequence
  Synthetic Polynucleotide
taatacgactcactatagggctgtaactgctgggttatgatatggaggaaaacagaggagattcctcatgatcataaccaacctggcggcagcgcaaaagatg

SEQ ID NO: 167463 - DNA, 103 bp, Artificial Sequence
  Synthetic Polynucleotide
taatacgactcactatagggtgcactgcagctgtaactgctgggttatgaaacagaggagatcataaatgagcagttacaacctggcggcagcgcaaaagatg

SEQ ID NO: 167464 - DNA, 103 bp, Artificial Sequence
  Synthetic Polynucleotide
taatacgactcactatagggaaagtgcacctgcactgcagctgtaactgcaacagaggagagcagttatggctgcagtgaacctggcggcagcgcaaaagatg

SEQ ID NO: 167465 - DNA, 103 bp, Artificial Sequence
  Synthetic Polynucleotide
taatacgactcactatagggtgcaaagataaaagtgcacctgcactgcagaacagaggagactgcagatgaggtgcactaacctggcggcagcgcaaaagatg

SEQ ID NO: 167466 - DNA, 103 bp, Artificial Sequence
  Synthetic Polynucleotide
taatacgactcactatagggctcttgccattgcaaagataaaagtgcaccaacagaggagaggtgcaatgttatctttgaacctggcggcagcgcaaaagatg

SEQ ID NO: 167467 - DNA, 103 bp, Artificial Sequence
  Synthetic Polynucleotide
taatacgactcactataggggctttttttcctcttgccattgcaaagataaacagaggagatatcttatgaatggcaagaacctggcggcagcgcaaaagatg

SEQ ID NO: 167468 - DNA, 103 bp, Artificial Sequence
  Synthetic Polynucleotide
taatacgactcactataggggttgagactggctttttttcctcttgccataacagaggagaatggcaatgggaaaaaaaaacctggcggcagcgcaaaagatg

SEQ ID NO: 167469 - DNA, 103 bp, Artificial Sequence
  Synthetic Polynucleotide
taatacgactcactatagggtaagtaaaacgttgagactggctttttttcaacagaggagagaaaaaatgccagtctcaaacctggcggcagcgcaaaagatg

SEQ ID NO: 167470 - DNA, 103 bp, Artificial Sequence
  Synthetic Polynucleotide
taatacgactcactatagggaactggtgtataagtaaaacgttgagactgaacagaggagacagtctatgcgttttactaacctggcggcagcgcaaaagatg

SEQ ID NO: 167471 - DNA, 103 bp, Artificial Sequence
  Synthetic Polynucleotide
taatacgactcactataggggcttcatcaaaactggtgtataagtaaaacaacagaggagagttttaatgatacaccagaacctggcggcagcgcaaaagatg

SEQ ID NO: 167472 - DNA, 103 bp, Artificial Sequence
  Synthetic Polynucleotide
taatacgactcactataggggatggtgacaaaacagaagagtgagacggtaacagaggagaaccgtcatgctcttctgtaacctggcggcagcgcaaaagatg

SEQ ID NO: 167473 - DNA, 103 bp, Artificial Sequence
  Synthetic Polynucleotide
taatacgactcactatagggctgtgttcttgcttcatcaaaactggtgtaaacagaggagatacaccatgtttgatgaaaacctggcggcagcgcaaaagatg

SEQ ID NO: 167474 - DNA, 103 bp, Artificial Sequence
  Synthetic Polynucleotide
taatacgactcactatagggaatctcttctctgtgttcttgcttcatcaaaacagaggagattgatgatgcaagaacacaacctggcggcagcgcaaaagatg

SEQ ID NO: 167475 - DNA, 103 bp, Artificial Sequence
  Synthetic Polynucleotide
taatacgactcactatagggaagacaaatcaatctcttctctgtgttcttaacagaggagaaagaacatggagaagagaaacctggcggcagcgcaaaagatg

SEQ ID NO: 167476 - DNA, 103 bp, Artificial Sequence
  Synthetic Polynucleotide
taatacgactcactataggggatggaactgaagacaaatcaatctcttctaacagaggagaagaagaatgtgatttgtcaacctggcggcagcgcaaaagatg

SEQ ID NO: 167477 - DNA, 103 bp, Artificial Sequence
  Synthetic Polynucleotide
taatacgactcactatagggcacaggcaaagatggaactgaagacaaatcaacagaggagagatttgatgtcagttccaaacctggcggcagcgcaaaagatg

SEQ ID NO: 167478 - DNA, 103 bp, Artificial Sequence
  Synthetic Polynucleotide
taatacgactcactatagggcaggatgaggcacaggcaaagatggaactgaacagaggagacagttcatgctttgcctgaacctggcggcagcgcaaaagatg

SEQ ID NO: 167479 - DNA, 103 bp, Artificial Sequence
  Synthetic Polynucleotide
taatacgactcactatagggtgggtctgagcaggatgaggcacaggcaaaaacagaggagatttgccatggcctcatccaacctggcggcagcgcaaaagatg

SEQ ID NO: 167480 - DNA, 103 bp, Artificial Sequence
  Synthetic Polynucleotide
taatacgactcactatagggggaaggcctctgggtctgagcaggatgaggaacagaggagacctcatatggctcagaccaacctggcggcagcgcaaaagatg

SEQ ID NO: 167481 - DNA, 103 bp, Artificial Sequence
  Synthetic Polynucleotide
taatacgactcactatagggctgaatcagaggaaggcctctgggtctgagaacagaggagactcagaatgagaggccttaacctggcggcagcgcaaaagatg

SEQ ID NO: 167482 - DNA, 103 bp, Artificial Sequence
  Synthetic Polynucleotide
taatacgactcactatagggtgtgaacaccctgaatcagaggaaggcctcaacagaggagagaggccatgctctgattcaacctggcggcagcgcaaaagatg

SEQ ID NO: 167483 - DNA, 103 bp, Artificial Sequence
  Synthetic Polynucleotide
taatacgactcactataggggagctgaaacgatggtgacaaaacagaagaaacagaggagatcttctatgttgtcaccaaacctggcggcagcgcaaaagatg

SEQ ID NO: 167484 - DNA, 103 bp, Artificial Sequence
  Synthetic Polynucleotide
taatacgactcactatagggtacactgtcatgtgaacaccctgaatcagaaacagaggagatctgatatggggtgttcaaacctggcggcagcgcaaaagatg

SEQ ID NO: 167485 - DNA, 103 bp, Artificial Sequence
  Synthetic Polynucleotide
taatacgactcactataggggtcctgacagtacactgtcatgtgaacaccaacagaggagaggtgttatgatgacagtgaacctggcggcagcgcaaaagatg

SEQ ID NO: 167486 - DNA, 103 bp, Artificial Sequence
  Synthetic Polynucleotide
taatacgactcactatagggaaacttctctgtcctgacagtacactgtcaaacagaggagatgacagatgactgtcaggaacctggcggcagcgcaaaagatg

SEQ ID NO: 167487 - DNA, 103 bp, Artificial Sequence
  Synthetic Polynucleotide
taatacgactcactatagggggagcaaatcaaacttctctgtcctgacagaacagaggagactgtcaatgcagagaagtaacctggcggcagcgcaaaagatg

SEQ ID NO: 167488 - DNA, 103 bp, Artificial Sequence
  Synthetic Polynucleotide
taatacgactcactatagggtttgtgggatggagcaaatcaaacttctctaacagaggagaagagaaatgtgatttgctaacctggcggcagcgcaaaagatg

SEQ ID NO: 167489 - DNA, 103 bp, Artificial Sequence
  Synthetic Polynucleotide
taatacgactcactataggggatgcatatgtttgtgggatggagcaaatcaacagaggagagatttgatgcatcccacaaacctggcggcagcgcaaaagatg

SEQ ID NO: 167490 - DNA, 103 bp, Artificial Sequence
  Synthetic Polynucleotide
taatacgactcactatagggggtcaccatggatgcatatgtttgtgggataacagaggagaatcccaatgacatatgcaaacctggcggcagcgcaaaagatg

SEQ ID NO: 167491 - DNA, 103 bp, Artificial Sequence
  Synthetic Polynucleotide
taatacgactcactataggggatgggatgaggtcaccatggatgcatatgaacagaggagacatatgatgccatggtgaaacctggcggcagcgcaaaagatg

SEQ ID NO: 167492 - DNA, 103 bp, Artificial Sequence
  Synthetic Polynucleotide
taatacgactcactatagggaactgtggcagatgggatgaggtcaccatgaacagaggagacatggtatgctcatcccaaacctggcggcagcgcaaaagatg

SEQ ID NO: 167493 - DNA, 103 bp, Artificial Sequence
  Synthetic Polynucleotide
taatacgactcactatagggtctacactgcaactgtggcagatgggatgaaacagaggagatcatccatgctgccacagaacctggcggcagcgcaaaagatg

SEQ ID NO: 167494 - DNA, 103 bp, Artificial Sequence
  Synthetic Polynucleotide
taatacgactcactatagggtgtgactttggagctgaaacgatggtgacaaacagaggagatgtcacatgcgtttcagcaacctggcggcagcgcaaaagatg

SEQ ID NO: 167495 - DNA, 103 bp, Artificial Sequence
  Synthetic Polynucleotide
taatacgactcactatagggcactctcatctctacactgcaactgtggcaaacagaggagatgccacatgtgcagtgtaaacctggcggcagcgcaaaagatg

SEQ ID NO: 167496 - DNA, 103 bp, Artificial Sequence
  Synthetic Polynucleotide
taatacgactcactatagggtctttactaacactctcatctctacactgcaacagaggagagcagtgatgagatgagagaacctggcggcagcgcaaaagatg

SEQ ID NO: 167497 - DNA, 103 bp, Artificial Sequence
  Synthetic Polynucleotide
taatacgactcactatagggcatatgctgttctttactaacactctcatcaacagaggagagatgagatggttagtaaaaacctggcggcagcgcaaaagatg

SEQ ID NO: 167498 - DNA, 103 bp, Artificial Sequence
  Synthetic Polynucleotide
taatacgactcactataggggagaaggaatcatatgctgttctttactaaaacagaggagattagtaatgaacagcataaacctggcggcagcgcaaaagatg

SEQ ID NO: 167499 - DNA, 103 bp, Artificial Sequence
  Synthetic Polynucleotide
taatacgactcactatagggtgtacaattggagaaggaatcatatgctgtaacagaggagaacagcaatggattccttcaacctggcggcagcgcaaaagatg

SEQ ID NO: 167500 - DNA, 103 bp, Artificial Sequence
  Synthetic Polynucleotide
taatacgactcactatagggaaaaggctggtgtacaattggagaaggaataacagaggagaattcctatgccaattgtaaacctggcggcagcgcaaaagatg

SEQ ID NO: 167501 - DNA, 103 bp, Artificial Sequence
  Synthetic Polynucleotide
taatacgactcactataggggtgtgacttgaaaaggctggtgtacaattgaacagaggagacaattgatgaccagccttaacctggcggcagcgcaaaagatg

SEQ ID NO: 167502 - DNA, 103 bp, Artificial Sequence
  Synthetic Polynucleotide
taatacgactcactatagggggaggtgttggtgtgacttgaaaaggctggaacagaggagaccagccatgtcaagtcacaacctggcggcagcgcaaaagatg

SEQ ID NO: 167503 - DNA, 103 bp, Artificial Sequence
  Synthetic Polynucleotide
taatacgactcactatagggagaccccacaggaggtgttggtgtgacttgaacagaggagacaagtcatgccaacacctaacctggcggcagcgcaaaagatg

SEQ ID NO: 167504 - DNA, 103 bp, Artificial Sequence
  Synthetic Polynucleotide
taatacgactcactataggggctgataggaagaccccacaggaggtgttgaacagaggagacaacacatgctgtggggtaacctggcggcagcgcaaaagatg

SEQ ID NO: 167505 - DNA, 103 bp, Artificial Sequence
  Synthetic Polynucleotide
taatacgactcactatagggtcatagtttttgtgactttggagctgaaacaacagaggagagtttcaatgccaaagtcaaacctggcggcagcgcaaaagatg

SEQ ID NO: 167506 - DNA, 103 bp, Artificial Sequence
  Synthetic Polynucleotide
taatacgactcactataggggtttgcataggctgataggaagaccccacaaacagaggagatgtgggatgttcctatcaaacctggcggcagcgcaaaagatg

SEQ ID NO: 167507 - DNA, 103 bp, Artificial Sequence
  Synthetic Polynucleotide
taatacgactcactatagggcacaacattagtttgcataggctgataggaaacagaggagatcctatatgcctatgcaaaacctggcggcagcgcaaaagatg

SEQ ID NO: 167508 - DNA, 103 bp, Artificial Sequence
  Synthetic Polynucleotide
taatacgactcactataggggtccattgtacacaacattagtttgcatagaacagaggagactatgcatgctaatgttgaacctggcggcagcgcaaaagatg

SEQ ID NO: 167509 - DNA, 103 bp, Artificial Sequence
  Synthetic Polynucleotide
taatacgactcactatagggagacaagttggtccattgtacacaacattaaacagaggagataatgtatggtacaatggaacctggcggcagcgcaaaagatg

SEQ ID NO: 167510 - DNA, 103 bp, Artificial Sequence
  Synthetic Polynucleotide
taatacgactcactatagggattaataggaagacaagttggtccattgtaaacagaggagatacaatatgccaacttgtaacctggcggcagcgcaaaagatg

SEQ ID NO: 167511 - DNA, 103 bp, Artificial Sequence
  Synthetic Polynucleotide
taatacgactcactatagggtagaggcagcattaataggaagacaagttgaacagaggagacaacttatgttcctattaaacctggcggcagcgcaaaagatg

SEQ ID NO: 167512 - DNA, 103 bp, Artificial Sequence
  Synthetic Polynucleotide
taatacgactcactatagggaattcttgactagaggcagcattaataggaaacagaggagatcctatatgtgctgcctcaacctggcggcagcgcaaaagatg

SEQ ID NO: 167513 - DNA, 103 bp, Artificial Sequence
  Synthetic Polynucleotide
taatacgactcactatagggaactgaatcaaattcttgactagaggcagcaacagaggagagctgccatgagtcaagaaaacctggcggcagcgcaaaagatg

SEQ ID NO: 167514 - DNA, 103 bp, Artificial Sequence
  Synthetic Polynucleotide
taatacgactcactataggggctgaaacaaaactgaatcaaattcttgacaacagaggagagtcaagatgttgattcagaacctggcggcagcgcaaaagatg

SEQ ID NO: 167515 - DNA, 103 bp, Artificial Sequence
  Synthetic Polynucleotide
taatacgactcactataggggttgcatcctgctgaaacaaaactgaatcaaacagaggagatgattcatgtttgtttcaaacctggcggcagcgcaaaagatg

SEQ ID NO: 167516 - DNA, 103 bp, Artificial Sequence
  Synthetic Polynucleotide
taatacgactcactatagggacaagttccttcatagtttttgtgactttgaacagaggagacaaagtatgaaaaactataacctggcggcagcgcaaaagatg

SEQ ID NO: 167517 - DNA, 103 bp, Artificial Sequence
  Synthetic Polynucleotide
taatacgactcactatagggaccagaaagagttgcatcctgctgaaacaaaacagaggagattgtttatgcaggatgcaaacctggcggcagcgcaaaagatg

SEQ ID NO: 167518 - DNA, 103 bp, Artificial Sequence
  Synthetic Polynucleotide
taatacgactcactataggggattcactaaaccagaaagagttgcatcctaacagaggagaaggatgatgctctttctgaacctggcggcagcgcaaaagatg

SEQ ID NO: 167519 - DNA, 103 bp, Artificial Sequence
  Synthetic Polynucleotide
taatacgactcactatagggtgacagccaagattcactaaaccagaaagaaacagaggagatctttcatgtttagtgaaaacctggcggcagcgcaaaagatg

SEQ ID NO: 167520 - DNA, 103 bp, Artificial Sequence
  Synthetic Polynucleotide
taatacgactcactatagggtgacagtggttgacagccaagattcactaaaacagaggagattagtgatgcttggctgtaacctggcggcagcgcaaaagatg

SEQ ID NO: 167521 - DNA, 103 bp, Artificial Sequence
  Synthetic Polynucleotide
taatacgactcactatagggatggtatggatgacagtggttgacagccaaaacagaggagattggctatgaaccactgtaacctggcggcagcgcaaaagatg

SEQ ID NO: 167522 - DNA, 103 bp, Artificial Sequence
  Synthetic Polynucleotide
taatacgactcactataggggaagaatgaaatggtatggatgacagtggtaacagaggagaaccactatgatccataccaacctggcggcagcgcaaaagatg

SEQ ID NO: 167523 - DNA, 103 bp, Artificial Sequence
  Synthetic Polynucleotide
taatacgactcactataggggcctgaatttgaagaatgaaatggtatggaaacagaggagatccataatgtttcattctaacctggcggcagcgcaaaagatg

SEQ ID NO: 167524 - DNA, 103 bp, Artificial Sequence
  Synthetic Polynucleotide
taatacgactcactataggggtcctgttgagcctgaatttgaagaatgaaaacagaggagattcattatgcaaattcagaacctggcggcagcgcaaaagatg

SEQ ID NO: 167525 - DNA, 103 bp, Artificial Sequence
  Synthetic Polynucleotide
taatacgactcactataggggctaagagatgtcctgttgagcctgaatttaacagaggagaaaattcatgctcaacaggaacctggcggcagcgcaaaagatg

SEQ ID NO: 167526 - DNA, 103 bp, Artificial Sequence
  Synthetic Polynucleotide
taatacgactcactatagggaggtgtatgggctaagagatgtcctgttgaaacagaggagatcaacaatgcatctcttaaacctggcggcagcgcaaaagatg

SEQ ID NO: 167527 - DNA, 103 bp, Artificial Sequence
  Synthetic Polynucleotide
taatacgactcactatagggcaggaatctcacaagttccttcatagttttaacagaggagaaaaactatgaaggaacttaacctggcggcagcgcaaaagatg

SEQ ID NO: 167528 - DNA, 103 bp, Artificial Sequence
  Synthetic Polynucleotide
taatacgactcactataggggcacagaatgaggtgtatgggctaagagataacagaggagaatctctatgcccatacacaacctggcggcagcgcaaaagatg

SEQ ID NO: 167529 - DNA, 103 bp, Artificial Sequence
  Synthetic Polynucleotide
taatacgactcactatagggggcagggtatgcacagaatgaggtgtatggaacagaggagaccatacatgtcattctgtaacctggcggcagcgcaaaagatg

SEQ ID NO: 167530 - DNA, 103 bp, Artificial Sequence
  Synthetic Polynucleotide
taatacgactcactatagggttgcagatgaggcagggtatgcacagaatgaacagaggagacattctatgcataccctgaacctggcggcagcgcaaaagatg

SEQ ID NO: 167531 - DNA, 103 bp, Artificial Sequence
  Synthetic Polynucleotide
taatacgactcactatagggatcccattgattgcagatgaggcagggtataacagaggagaatacccatgctcatctgcaacctggcggcagcgcaaaagatg

SEQ ID NO: 167532 - DNA, 103 bp, Artificial Sequence
  Synthetic Polynucleotide
taatacgactcactataggggaacaatgatatcccattgattgcagatgaaacagaggagatcatctatgatcaatgggaacctggcggcagcgcaaaagatg

SEQ ID NO: 167533 - DNA, 103 bp, Artificial Sequence
  Synthetic Polynucleotide
taatacgactcactatagggtcctgtatttgaacaatgatatcccattgaaacagaggagatcaatgatgtatcattgtaacctggcggcagcgcaaaagatg

SEQ ID NO: 167534 - DNA, 103 bp, Artificial Sequence
  Synthetic Polynucleotide
taatacgactcactataggggagatctttgtcctgtatttgaacaatgataacagaggagaatcattatgcaaatacagaacctggcggcagcgcaaaagatg

SEQ ID NO: 167535 - DNA, 103 bp, Artificial Sequence
  Synthetic Polynucleotide
taatacgactcactatagggggagaagaaagagatctttgtcctgtatttaacagaggagaaaatacatgacaaagatcaacctggcggcagcgcaaaagatg

SEQ ID NO: 167536 - DNA, 103 bp, Artificial Sequence
  Synthetic Polynucleotide
taatacgactcactataggggtcagccactggagaagaaagagatctttgaacagaggagacaaagaatgctttcttctaacctggcggcagcgcaaaagatg

SEQ ID NO: 167537 - DNA, 103 bp, Artificial Sequence
  Synthetic Polynucleotide
taatacgactcactatagggctgtaatctggtcagccactggagaagaaaaacagaggagatttcttatgcagtggctgaacctggcggcagcgcaaaagatg

SEQ ID NO: 167538 - DNA, 103 bp, Artificial Sequence
  Synthetic Polynucleotide
taatacgactcactatagggtatttagattcaggaatctcacaagttcctaacagaggagaaggaacatgtgagattccaacctggcggcagcgcaaaagatg

SEQ ID NO: 167539 - DNA, 103 bp, Artificial Sequence
  Synthetic Polynucleotide
taatacgactcactataggggaaggctgacctgtaatctggtcagccactaacagaggagaagtggcatgccagattacaacctggcggcagcgcaaaagatg

SEQ ID NO: 167540 - DNA, 103 bp, Artificial Sequence
  Synthetic Polynucleotide
taatacgactcactatagggtaactgagacgaaggctgacctgtaatctgaacagaggagacagattatgggtcagcctaacctggcggcagcgcaaaagatg

SEQ ID NO: 167541 - DNA, 103 bp, Artificial Sequence
  Synthetic Polynucleotide
taatacgactcactatagggtaataggttgtaactgagacgaaggctgacaacagaggagagtcagcatgcgtctcagtaacctggcggcagcgcaaaagatg

SEQ ID NO: 167542 - DNA, 103 bp, Artificial Sequence
  Synthetic Polynucleotide
taatacgactcactatagggggaccatatgtaataggttgtaactgagacaacagaggagagtctcaatgacaacctataacctggcggcagcgcaaaagatg

SEQ ID NO: 167543 - DNA, 103 bp, Artificial Sequence
  Synthetic Polynucleotide
taatacgactcactatagggtgaatgtgaaggaccatatgtaataggttgaacagaggagacaacctatgacatatggtaacctggcggcagcgcaaaagatg

SEQ ID NO: 167544 - DNA, 103 bp, Artificial Sequence
  Synthetic Polynucleotide
taatacgactcactatagggtagcagaccctgaatgtgaaggaccatatgaacagaggagacatatgatgcttcacattaacctggcggcagcgcaaaagatg

SEQ ID NO: 167545 - DNA, 103 bp, Artificial Sequence
  Synthetic Polynucleotide
taatacgactcactataggggaagctgttgtagcagaccctgaatgtgaaaacagaggagattcacaatgagggtctgcaacctggcggcagcgcaaaagatg

SEQ ID NO: 167546 - DNA, 103 bp, Artificial Sequence
  Synthetic Polynucleotide
taatacgactcactatagggagctgctggggaagctgttgtagcagacccaacagaggagagggtctatgacaacagctaacctggcggcagcgcaaaagatg

SEQ ID NO: 167547 - DNA, 103 bp, Artificial Sequence
  Synthetic Polynucleotide
taatacgactcactatagggagggatgagaagctgctggggaagctgttgaacagaggagacaacagatgccccagcagaacctggcggcagcgcaaaagatg

SEQ ID NO: 167548 - DNA, 103 bp, Artificial Sequence
  Synthetic Polynucleotide
taatacgactcactataggggaactagccaagggatgagaagctgctgggaacagaggagacccagcatgttctcatccaacctggcggcagcgcaaaagatg

SEQ ID NO: 167549 - DNA, 103 bp, Artificial Sequence
  Synthetic Polynucleotide
taatacgactcactatagggtaatgggctatatttagattcaggaatctcaacagaggagagagattatggaatctaaaaacctggcggcagcgcaaaagatg

SEQ ID NO: 167550 - DNA, 103 bp, Artificial Sequence
  Synthetic Polynucleotide
taatacgactcactatagggagaaagcggtgaactagccaagggatgagaaacagaggagatctcatatgttggctagtaacctggcggcagcgcaaaagatg

SEQ ID NO: 167551 - DNA, 103 bp, Artificial Sequence
  Synthetic Polynucleotide
taatacgactcactatagggatggtggcccagaaagcggtgaactagccaaacagaggagatggctaatgcaccgctttaacctggcggcagcgcaaaagatg

SEQ ID NO: 167552 - DNA, 103 bp, Artificial Sequence
  Synthetic Polynucleotide
taatacgactcactatagggagctgaggagatggtggcccagaaagcggtaacagaggagaaccgctatgtgggccaccaacctggcggcagcgcaaaagatg

SEQ ID NO: 167553 - DNA, 103 bp, Artificial Sequence
  Synthetic Polynucleotide
taatacgactcactatagggcataggctgaagctgaggagatggtggcccaacagaggagagggccaatgtctcctcagaacctggcggcagcgcaaaagatg

SEQ ID NO: 167554 - DNA, 103 bp, Artificial Sequence
  Synthetic Polynucleotide
taatacgactcactatagggattggtaaggcataggctgaagctgaggagaacagaggagactcctcatgttcagcctaaacctggcggcagcgcaaaagatg

SEQ ID NO: 167555 - DNA, 103 bp, Artificial Sequence
  Synthetic Polynucleotide
taatacgactcactataggggagctaggagattggtaaggcataggctgaaacagaggagatcagccatggccttaccaaacctggcggcagcgcaaaagatg

SEQ ID NO: 167556 - DNA, 103 bp, Artificial Sequence
  Synthetic Polynucleotide
taatacgactcactatagggggcagttcctgagctaggagattggtaaggaacagaggagaccttacatgtctcctagcaacctggcggcagcgcaaaagatg

SEQ ID NO: 167557 - DNA, 103 bp, Artificial Sequence
  Synthetic Polynucleotide
taatacgactcactatagggacggtgatgaggcagttcctgagctaggagaacagaggagactcctaatgcaggaactgaacctggcggcagcgcaaaagatg

SEQ ID NO: 167558 - DNA, 103 bp, Artificial Sequence
  Synthetic Polynucleotide
taatacgactcactataggggtggctggagacggtgatgaggcagttcctaacagaggagaaggaacatgctcatcaccaacctggcggcagcgcaaaagatg

SEQ ID NO: 167559 - DNA, 103 bp, Artificial Sequence
  Synthetic Polynucleotide
taatacgactcactatagggatgcattctggtggctggagacggtgatgaaacagaggagatcatcaatgtctccagccaacctggcggcagcgcaaaagatg

SEQ ID NO: 167560 - DNA, 103 bp, Artificial Sequence
  Synthetic Polynucleotide
taatacgactcactatagggtgggaccacctaatgggctatatttagattaacagaggagaaatctaatgatagcccataacctggcggcagcgcaaaagatg

SEQ ID NO: 167561 - DNA, 103 bp, Artificial Sequence
  Synthetic Polynucleotide
taatacgactcactataggggctgtccagaatgcattctggtggctggagaacagaggagactccagatgccagaatgcaacctggcggcagcgcaaaagatg

SEQ ID NO: 167562 - DNA, 103 bp, Artificial Sequence
  Synthetic Polynucleotide
taatacgactcactatagggtgagttgagtgctgtccagaatgcattctgaacagaggagacagaatatgttctggacaaacctggcggcagcgcaaaagatg

SEQ ID NO: 167563 - DNA, 103 bp, Artificial Sequence
  Synthetic Polynucleotide
taatacgactcactatagggactttgtgcttgagttgagtgctgtccagaaacagaggagatctggaatgcactcaactaacctggcggcagcgcaaaagatg

SEQ ID NO: 167564 - DNA, 103 bp, Artificial Sequence
  Synthetic Polynucleotide
taatacgactcactatagggcctggcccgtactttgtgcttgagttgagtaacagaggagaactcaaatgaagcacaaaaacctggcggcagcgcaaaagatg

SEQ ID NO: 167565 - DNA, 103 bp, Artificial Sequence
  Synthetic Polynucleotide
taatacgactcactataggggaaagacccccctggcccgtactttgtgctaacagaggagaagcacaatgtacgggccaaacctggcggcagcgcaaaagatg

SEQ ID NO: 167566 - DNA, 103 bp, Artificial Sequence
  Synthetic Polynucleotide
taatacgactcactatagggtgaaggtgcagaaagacccccctggcccgtaacagaggagaacgggcatggggggtcttaacctggcggcagcgcaaaagatg

SEQ ID NO: 167567 - DNA, 103 bp, Artificial Sequence
  Synthetic Polynucleotide
taatacgactcactatagggatattaaggatgaaggtgcagaaagaccccaacagaggagaggggtcatgctgcaccttaacctggcggcagcgcaaaagatg

SEQ ID NO: 167568 - DNA, 103 bp, Artificial Sequence
  Synthetic Polynucleotide
taatacgactcactatagggaaactgtgacatattaaggatgaaggtgcaaacagaggagatgcaccatgatccttaataacctggcggcagcgcaaaagatg

SEQ ID NO: 167569 - DNA, 103 bp, Artificial Sequence
  Synthetic Polynucleotide
taatacgactcactatagggtggatcacacaaactgtgacatattaaggaaacagaggagatccttaatgtgtcacagtaacctggcggcagcgcaaaagatg

SEQ ID NO: 167570 - DNA, 103 bp, Artificial Sequence
  Synthetic Polynucleotide
taatacgactcactataggggaaatgacgctggatcacacaaactgtgacaacagaggagagtcacaatgtgtgtgatcaacctggcggcagcgcaaaagatg

SEQ ID NO: 167571 - DNA, 103 bp, Artificial Sequence
  Synthetic Polynucleotide
taatacgactcactatagggacgagtttgaagtcgagctcgtcgtgggcgaacagaggagacgcccaatgcgagctcgaaacctggcggcagcgcaaaagatg

SEQ ID NO: 167572 - DNA, 103 bp, Artificial Sequence
  Synthetic Polynucleotide
taatacgactcactatagggtcaaagggtttgggaccacctaatgggctaaacagaggagatagcccatgaggtggtccaacctggcggcagcgcaaaagatg

SEQ ID NO: 167573 - DNA, 103 bp, Artificial Sequence
  Synthetic Polynucleotide
taatacgactcactatagggccatcaggtggaaatgacgctggatcacacaacagaggagagtgtgaatgagcgtcattaacctggcggcagcgcaaaagatg

SEQ ID NO: 167574 - DNA, 103 bp, Artificial Sequence
  Synthetic Polynucleotide
taatacgactcactatagggcacagttgccccatcaggtggaaatgacgcaacagaggagagcgtcaatgccacctgataacctggcggcagcgcaaaagatg

SEQ ID NO: 167575 - DNA, 103 bp, Artificial Sequence
  Synthetic Polynucleotide
taatacgactcactataggggtttaatgctcacagttgccccatcaggtgaacagaggagacacctgatggggcaactgaacctggcggcagcgcaaaagatg

SEQ ID NO: 167576 - DNA, 103 bp, Artificial Sequence
  Synthetic Polynucleotide
taatacgactcactatagggtctggttcaggtttaatgctcacagttgccaacagaggagaggcaacatggagcattaaaacctggcggcagcgcaaaagatg

SEQ ID NO: 167577 - DNA, 103 bp, Artificial Sequence
  Synthetic Polynucleotide
taatacgactcactatagggctctcgatcttctggttcaggtttaatgctaacagaggagaagcattatgcctgaaccaaacctggcggcagcgcaaaagatg

SEQ ID NO: 167578 - DNA, 103 bp, Artificial Sequence
  Synthetic Polynucleotide
taatacgactcactatagggcaaagttaggctctcgatcttctggttcagaacagaggagactgaacatgaagatcgagaacctggcggcagcgcaaaagatg

SEQ ID NO: 167579 - DNA, 103 bp, Artificial Sequence
  Synthetic Polynucleotide
taatacgactcactatagggccaatggttgcaaagttaggctctcgatctaacagaggagaagatcgatggcctaacttaacctggcggcagcgcaaaagatg

SEQ ID NO: 167580 - DNA, 103 bp, Artificial Sequence
  Synthetic Polynucleotide
taatacgactcactataggggtcctgcagaccaatggttgcaaagttaggaacagaggagacctaacatggcaaccattaacctggcggcagcgcaaaagatg

SEQ ID NO: 167581 - DNA, 103 bp, Artificial Sequence
  Synthetic Polynucleotide
taatacgactcactatagggctaaagtgatgtcctgcagaccaatggttgaacagaggagacaaccaatggtctgcaggaacctggcggcagcgcaaaagatg

SEQ ID NO: 167582 - DNA, 103 bp, Artificial Sequence
  Synthetic Polynucleotide
taatacgactcactatagggttcacatcatctaaagtgatgtcctgcagaaacagaggagatctgcaatgcatcactttaacctggcggcagcgcaaaagatg

SEQ ID NO: 167583 - DNA, 103 bp, Artificial Sequence
  Synthetic Polynucleotide
taatacgactcactatagggacttgggcactcaaagggtttgggaccaccaacagaggagaggtggtatgaaaccctttaacctggcggcagcgcaaaagatg

SEQ ID NO: 167584 - DNA, 103 bp, Artificial Sequence
  Synthetic Polynucleotide
taatacgactcactatagggaattatctcgttcacatcatctaaagtgataacagaggagaatcactatggatgatgtgaacctggcggcagcgcaaaagatg

SEQ ID NO: 167585 - DNA, 103 bp, Artificial Sequence
  Synthetic Polynucleotide
taatacgactcactatagggtgtctctcccaattatctcgttcacatcataacagaggagaatgatgatgacgagataaaacctggcggcagcgcaaaagatg

SEQ ID NO: 167586 - DNA, 103 bp, Artificial Sequence
  Synthetic Polynucleotide
taatacgactcactatagggatctgggacatgtctctcccaattatctcgaacagaggagacgagatatgtgggagagaaacctggcggcagcgcaaaagatg

SEQ ID NO: 167587 - DNA, 103 bp, Artificial Sequence
  Synthetic Polynucleotide
taatacgactcactatagggggaaacagaaatctgggacatgtctctcccaacagaggagagggagaatgatgtcccagaacctggcggcagcgcaaaagatg

SEQ ID NO: 167588 - DNA, 103 bp, Artificial Sequence
  Synthetic Polynucleotide
taatacgactcactatagggctgctccttgggaaacagaaatctgggacaaacagaggagatgtcccatgtttctgtttaacctggcggcagcgcaaaagatg

SEQ ID NO: 167589 - DNA, 103 bp, Artificial Sequence
  Synthetic Polynucleotide
taatacgactcactatagggctgctcacccctgctccttgggaaacagaaaacagaggagattctgtatgccaaggagcaacctggcggcagcgcaaaagatg

SEQ ID NO: 167590 - DNA, 103 bp, Artificial Sequence
  Synthetic Polynucleotide
taatacgactcactataggggggagcctgcctgctcacccctgctccttgaacagaggagacaaggaatgggggtgagcaacctggcggcagcgcaaaagatg

SEQ ID NO: 167591 - DNA, 103 bp, Artificial Sequence
  Synthetic Polynucleotide
taatacgactcactataggggactcgggaggggagcctgcctgctcacccaacagaggagagggtgaatgggcaggctcaacctggcggcagcgcaaaagatg

SEQ ID NO: 167592 - DNA, 103 bp, Artificial Sequence
  Synthetic Polynucleotide
taatacgactcactatagggagggactcaggactcgggaggggagcctgcaacagaggagagcaggcatgcctcccgagaacctggcggcagcgcaaaagatg

SEQ ID NO: 167593 - DNA, 103 bp, Artificial Sequence
  Synthetic Polynucleotide
taatacgactcactatagggtcctaaatccagggactcaggactcgggagaacagaggagactcccgatgcctgagtccaacctggcggcagcgcaaaagatg

SEQ ID NO: 167594 - DNA, 103 bp, Artificial Sequence
  Synthetic Polynucleotide
taatacgactcactatagggtaatttgaatacttgggcactcaaagggttaacagaggagaaaccctatgagtgcccaaaacctggcggcagcgcaaaagatg

SEQ ID NO: 167595 - DNA, 103 bp, Artificial Sequence
  Synthetic Polynucleotide
taatacgactcactatagggcatcagatcttcctaaatccagggactcagaacagaggagactgagtatgtggatttagaacctggcggcagcgcaaaagatg

SEQ ID NO: 167596 - DNA, 103 bp, Artificial Sequence
  Synthetic Polynucleotide
taatacgactcactataggggagatagatgtaatttgaatacttgggcacaacagaggagagtgcccatgtattcaaataacctggcggcagcgcaaaagatg

SEQ ID NO: 167597 - DNA, 103 bp, Artificial Sequence
  Synthetic Polynucleotide
taatacgactcactatagggacagttaggagagatagatgtaatttgaataacagaggagaattcaaatgacatctatcaacctggcggcagcgcaaaagatg

SEQ ID NO: 167598 - DNA, 103 bp, Artificial Sequence
  Synthetic Polynucleotide
taatacgactcactatagggattcttgatgacagttaggagagatagatgaacagaggagacatctaatgctcctaactaacctggcggcagcgcaaaagatg

SEQ ID NO: 167599 - DNA, 103 bp, Artificial Sequence
  Synthetic Polynucleotide
taatacgactcactatagggtgtgcatctaattcttgatgacagttaggaaacagaggagatcctaaatgtcatcaagaaacctggcggcagcgcaaaagatg

SEQ ID NO: 167600 - DNA, 103 bp, Artificial Sequence
  Synthetic Polynucleotide
taatacgactcactataggggtcatcttcatgtgcatctaattcttgatgaacagaggagacatcaaatgttagatgcaaacctggcggcagcgcaaaagatg

SEQ ID NO: 167601 - DNA, 103 bp, Artificial Sequence
  Synthetic Polynucleotide
taatacgactcactatagggttatctgtaggtcatcttcatgtgcatctaaacagaggagatagatgatgatgaagatgaacctggcggcagcgcaaaagatg

SEQ ID NO: 167602 - DNA, 103 bp, Artificial Sequence
  Synthetic Polynucleotide
taatacgactcactatagggtctgggtcatttatctgtaggtcatcttcaaacagaggagatgaagaatgcctacagataacctggcggcagcgcaaaagatg

SEQ ID NO: 167603 - DNA, 103 bp, Artificial Sequence
  Synthetic Polynucleotide
taatacgactcactatagggctcgccaaagacgagtttgaagtcgagctcaacagaggagagagctcatgttcaaactcaacctggcggcagcgcaaaagatg

SEQ ID NO: 167604 - DNA, 103 bp, Artificial Sequence
  Synthetic Polynucleotide
taatacgactcactatagggaaattcccgttctgggtcatttatctgtagaacagaggagactacagatgaatgacccaaacctggcggcagcgcaaaagatg

SEQ ID NO: 167605 - DNA, 103 bp, Artificial Sequence
  Synthetic Polynucleotide
taatacgactcactataggggcctttccaaaaattcccgttctgggtcataacagaggagaatgaccatgaacgggaataacctggcggcagcgcaaaagatg

SEQ ID NO: 167606 - DNA, 103 bp, Artificial Sequence
  Synthetic Polynucleotide
taatacgactcactatagggtctctagaaggcctttccaaaaattcccgtaacagaggagaacgggaatgtttggaaagaacctggcggcagcgcaaaagatg

SEQ ID NO: 167607 - DNA, 103 bp, Artificial Sequence
  Synthetic Polynucleotide
taatacgactcactatagggatagagatgatctctagaaggcctttccaaaacagaggagattggaaatgccttctagaaacctggcggcagcgcaaaagatg

SEQ ID NO: 167608 - DNA, 103 bp, Artificial Sequence
  Synthetic Polynucleotide
taatacgactcactatagggcaagaggaagatagagatgatctctagaagaacagaggagacttctaatgatcatctctaacctggcggcagcgcaaaagatg

SEQ ID NO: 167609 - DNA, 103 bp, Artificial Sequence
  Synthetic Polynucleotide
taatacgactcactatagggtaggatggctcaagaggaagatagagatgaaacagaggagatcatctatgtcttcctctaacctggcggcagcgcaaaagatg

SEQ ID NO: 167610 - DNA, 103 bp, Artificial Sequence
  Synthetic Polynucleotide
taatacgactcactatagggagactcccggtaggatggctcaagaggaagaacagaggagacttcctatggagccatccaacctggcggcagcgcaaaagatg

SEQ ID NO: 167611 - DNA, 103 bp, Artificial Sequence
  Synthetic Polynucleotide
taatacgactcactataggggactaagagaagactcccggtaggatggctaacagaggagaagccatatgaccgggagtaacctggcggcagcgcaaaagatg

SEQ ID NO: 167612 - DNA, 103 bp, Artificial Sequence
  Synthetic Polynucleotide
taatacgactcactataggggcaggactaggactaagagaagactcccggaacagaggagaccgggaatgttctcttagaacctggcggcagcgcaaaagatg

SEQ ID NO: 167613 - DNA, 103 bp, Artificial Sequence
  Synthetic Polynucleotide
taatacgactcactataggggatgctgctggcaggactaggactaagagaaacagaggagatctcttatgcctagtcctaacctggcggcagcgcaaaagatg

SEQ ID NO: 167614 - DNA, 103 bp, Artificial Sequence
  Synthetic Polynucleotide
taatacgactcactataggggcgccccgtcctcgccaaagacgagtttgaaacagaggagatcaaacatgtctttggcgaacctggcggcagcgcaaaagatg

SEQ ID NO: 167615 - DNA, 103 bp, Artificial Sequence
  Synthetic Polynucleotide
taatacgactcactatagggtcctagaagagatgctgctggcaggactagaacagaggagactagtcatgccagcagcaaacctggcggcagcgcaaaagatg

SEQ ID NO: 167616 - DNA, 103 bp, Artificial Sequence
  Synthetic Polynucleotide
taatacgactcactataggggagaaccaactcctagaagagatgctgctgaacagaggagacagcagatgctcttctagaacctggcggcagcgcaaaagatg

SEQ ID NO: 167617 - DNA, 103 bp, Artificial Sequence
  Synthetic Polynucleotide
taatacgactcactatagggagatgcatcagagaaccaactcctagaagaaacagaggagatcttctatgagttggttcaacctggcggcagcgcaaaagatg

SEQ ID NO: 167618 - DNA, 103 bp, Artificial Sequence
  Synthetic Polynucleotide
taatacgactcactatagggattcacaagaagatgcatcagagaaccaacaacagaggagagttggtatgctgatgcataacctggcggcagcgcaaaagatg

SEQ ID NO: 167619 - DNA, 103 bp, Artificial Sequence
  Synthetic Polynucleotide
taatacgactcactatagggtgtgaaagcgattcacaagaagatgcatcaaacagaggagatgatgcatgttcttgtgaaacctggcggcagcgcaaaagatg

SEQ ID NO: 167620 - DNA, 103 bp, Artificial Sequence
  Synthetic Polynucleotide
taatacgactcactatagggatcataaatatgtgaaagcgattcacaagaaacagaggagatcttgtatgtcgctttcaaacctggcggcagcgcaaaagatg

SEQ ID NO: 167621 - DNA, 103 bp, Artificial Sequence
  Synthetic Polynucleotide
taatacgactcactatagggagtccacatcatcataaatatgtgaaagcgaacagaggagacgctttatgatatttatgaacctggcggcagcgcaaaagatg

SEQ ID NO: 167622 - DNA, 103 bp, Artificial Sequence
  Synthetic Polynucleotide
taatacgactcactatagggttcaactctgagtccacatcatcataaataaacagaggagatatttaatgtgatgtggaaacctggcggcagcgcaaaagatg

SEQ ID NO: 167623 - DNA, 103 bp, Artificial Sequence
  Synthetic Polynucleotide
taatacgactcactatagggtgcagcttcattcaactctgagtccacatcaacagaggagagatgtgatgtcagagttgaacctggcggcagcgcaaaagatg

SEQ ID NO: 167624 - DNA, 103 bp, Artificial Sequence
  Synthetic Polynucleotide
taatacgactcactatagggtaaatcgggctgcagcttcattcaactctgaacagaggagacagagtatgatgaagctgaacctggcggcagcgcaaaagatg

SEQ ID NO: 167625 - DNA, 103 bp, Artificial Sequence
  Synthetic Polynucleotide
taatacgactcactatagggggcggcgccggcgccccgtcctcgccaaagaacagaggagactttggatgggacggggcaacctggcggcagcgcaaaagatg

SEQ ID NO: 167626 - DNA, 103 bp, Artificial Sequence
  Synthetic Polynucleotide
taatacgactcactataggggatccaagggtaaatcgggctgcagcttcaaacagaggagatgaagcatgagcccgattaacctggcggcagcgcaaaagatg

SEQ ID NO: 167627 - DNA, 103 bp, Artificial Sequence
  Synthetic Polynucleotide
taatacgactcactatagggagtcagaggggatccaagggtaaatcgggcaacagaggagagcccgaatgacccttggaaacctggcggcagcgcaaaagatg

SEQ ID NO: 167628 - DNA, 103 bp, Artificial Sequence
  Synthetic Polynucleotide
taatacgactcactatagggcaccaggagaagtcagaggggatccaagggaacagaggagacccttgatgcccctctgaaacctggcggcagcgcaaaagatg

SEQ ID NO: 167629 - DNA, 103 bp, Artificial Sequence
  Synthetic Polynucleotide
taatacgactcactatagggcctggagagccaccaggagaagtcagagggaacagaggagaccctctatgttctcctggaacctggcggcagcgcaaaagatg

SEQ ID NO: 167630 - DNA, 103 bp, Artificial Sequence
  Synthetic Polynucleotide
taatacgactcactatagggagggcagccccctggagagccaccaggagaaacagaggagatctcctatgggctctccaaacctggcggcagcgcaaaagatg

SEQ ID NO: 167631 - DNA, 103 bp, Artificial Sequence
  Synthetic Polynucleotide
taatacgactcactatagggtttcttctccagggcagccccctggagagcaacagaggagagctctcatgggggctgccaacctggcggcagcgcaaaagatg

SEQ ID NO: 167632 - DNA, 103 bp, Artificial Sequence
  Synthetic Polynucleotide
taatacgactcactatagggtgatgccaagtttcttctccagggcagcccaacagaggagagggctgatgtggagaagaaacctggcggcagcgcaaaagatg

SEQ ID NO: 167633 - DNA, 103 bp, Artificial Sequence
  Synthetic Polynucleotide
taatacgactcactatagggtccatactgttgatgccaagtttcttctccaacagaggagaggagaaatgacttggcataacctggcggcagcgcaaaagatg

SEQ ID NO: 167634 - DNA, 103 bp, Artificial Sequence
  Synthetic Polynucleotide
taatacgactcactatagggagtgtccaagtccatactgttgatgccaagaacagaggagacttggcatgaacagtatgaacctggcggcagcgcaaaagatg

SEQ ID NO: 167635 - DNA, 103 bp, Artificial Sequence
  Synthetic Polynucleotide
taatacgactcactatagggggtgataatgagtgtccaagtccatactgtaacagaggagaacagtaatgacttggacaaacctggcggcagcgcaaaagatg

SEQ ID NO: 167636 - DNA, 103 bp, Artificial Sequence
  Synthetic Polynucleotide
taatacgactcactataggggcccgggggcggcggcgccggcgccccgtcaacagaggagagacgggatgccggcgccgaacctggcggcagcgcaaaagatg

SEQ ID NO: 167637 - DNA, 103 bp, Artificial Sequence
  Synthetic Polynucleotide
taatacgactcactatagggagattgcctgggtgataatgagtgtccaagaacagaggagacttggaatgtcattatcaaacctggcggcagcgcaaaagatg

SEQ ID NO: 167638 - DNA, 103 bp, Artificial Sequence
  Synthetic Polynucleotide
taatacgactcactatagggagtggcaaggagattgcctgggtgataatgaacagaggagacattatatgccaggcaataacctggcggcagcgcaaaagatg

SEQ ID NO: 167639 - DNA, 103 bp, Artificial Sequence
  Synthetic Polynucleotide
taatacgactcactataggggatctaggagagtggcaaggagattgcctgaacagaggagacaggcaatgtccttgccaaacctggcggcagcgcaaaagatg

SEQ ID NO: 167640 - DNA, 103 bp, Artificial Sequence
  Synthetic Polynucleotide
taatacgactcactatagggagtgacactggatctaggagagtggcaaggaacagaggagaccttgcatgtctcctagaaacctggcggcagcgcaaaagatg

SEQ ID NO: 167641 - DNA, 103 bp, Artificial Sequence
  Synthetic Polynucleotide
taatacgactcactatagggaattctcatcagtgacactggatctaggagaacagaggagactcctaatgccagtgtcaaacctggcggcagcgcaaaagatg

SEQ ID NO: 167642 - DNA, 103 bp, Artificial Sequence
  Synthetic Polynucleotide
taatacgactcactataggggggctcagccaattctcatcagtgacactgaacagaggagacagtgtatgtgatgagaaaacctggcggcagcgcaaaagatg

SEQ ID NO: 167643 - DNA, 103 bp, Artificial Sequence
  Synthetic Polynucleotide
taatacgactcactatagggggctggcctggggctcagccaattctcatcaacagaggagagatgagatgtggctgagcaacctggcggcagcgcaaaagatg

SEQ ID NO: 167644 - DNA, 103 bp, Artificial Sequence
  Synthetic Polynucleotide
taatacgactcactatagggagggtcctgaggctggcctggggctcagccaacagaggagaggctgaatgccaggccagaacctggcggcagcgcaaaagatg

SEQ ID NO: 167645 - DNA, 103 bp, Artificial Sequence
  Synthetic Polynucleotide
taatacgactcactatagggggccttgatgagggtcctgaggctggcctgaacagaggagacaggccatgctcaggaccaacctggcggcagcgcaaaagatg

SEQ ID NO: 167646 - DNA, 103 bp, Artificial Sequence
  Synthetic Polynucleotide
taatacgactcactataggggggggatgtgggccttgatgagggtcctgaaacagaggagatcaggaatgtcatcaaggaacctggcggcagcgcaaaagatg

SEQ ID NO: 167647 - DNA, 103 bp, Artificial Sequence
  Synthetic Polynucleotide
taatacgactcactatagggcaggccgcgagcccgggggcggcggcgccgaacagaggagacggcgcatgcgcccccggaacctggcggcagcgcaaaagatg

SEQ ID NO: 167648 - DNA, 103 bp, Artificial Sequence
  Synthetic Polynucleotide
taatacgactcactataggggtttcccacagggggatgtgggccttgatgaacagaggagacatcaaatgccacatcccaacctggcggcagcgcaaaagatg

SEQ ID NO: 167649 - DNA, 103 bp, Artificial Sequence
  Synthetic Polynucleotide
taatacgactcactataggggagtgcctccgtttcccacagggggatgtgaacagaggagacacatcatgctgtgggaaaacctggcggcagcgcaaaagatg

SEQ ID NO: 167650 - DNA, 103 bp, Artificial Sequence
  Synthetic Polynucleotide
taatacgactcactatagggttcagcactggagtgcctccgtttcccacaaacagaggagatgtgggatgcggaggcacaacctggcggcagcgcaaaagatg

SEQ ID NO: 167651 - DNA, 103 bp, Artificial Sequence
  Synthetic Polynucleotide
taatacgactcactatagggcataacaaacttcagcactggagtgcctccaacagaggagaggaggcatgccagtgctgaacctggcggcagcgcaaaagatg

SEQ ID NO: 167652 - DNA, 103 bp, Artificial Sequence
  Synthetic Polynucleotide
taatacgactcactatagggagggacccagcataacaaacttcagcactgaacagaggagacagtgcatgagtttgttaaacctggcggcagcgcaaaagatg

SEQ ID NO: 167653 - DNA, 103 bp, Artificial Sequence
  Synthetic Polynucleotide
taatacgactcactatagggatggggtgaaagggacccagcataacaaacaacagaggagagtttgtatggctgggtccaacctggcggcagcgcaaaagatg

SEQ ID NO: 167654 - DNA, 103 bp, Artificial Sequence
  Synthetic Polynucleotide
taatacgactcactatagggcaggtgagtgatggggtgaaagggacccagaacagaggagactgggtatgtttcaccccaacctggcggcagcgcaaaagatg

SEQ ID NO: 167655 - DNA, 103 bp, Artificial Sequence
  Synthetic Polynucleotide
taatacgactcactatagggggtgaaggaacaggtgagtgatggggtgaaaacagaggagattcaccatgtcactcaccaacctggcggcagcgcaaaagatg

SEQ ID NO: 167656 - DNA, 103 bp, Artificial Sequence
  Synthetic Polynucleotide
taatacgactcactatagggggagtgaccaggtgaaggaacaggtgagtgaacagaggagacactcaatggttccttcaaacctggcggcagcgcaaaagatg

SEQ ID NO: 167657 - DNA, 103 bp, Artificial Sequence
  Synthetic Polynucleotide
taatacgactcactatagggttcccctgggggagtgaccaggtgaaggaaaacagaggagattccttatgctggtcactaacctggcggcagcgcaaaagatg

SEQ ID NO: 167658 - DNA, 103 bp, Artificial Sequence
  Synthetic Polynucleotide
taatacgactcactatagggtcaagatctgcaggccgcgagcccgggggcaacagaggagagcccccatgctcgcggccaacctggcggcagcgcaaaagatg

SEQ ID NO: 167659 - DNA, 103 bp, Artificial Sequence
  Synthetic Polynucleotide
taatacgactcactatagggtctgtcacacttcccctgggggagtgaccaaacagaggagatggtcaatgccccaggggaacctggcggcagcgcaaaagatg

SEQ ID NO: 167660 - DNA, 103 bp, Artificial Sequence
  Synthetic Polynucleotide
taatacgactcactatagggccacgtatcttctgtcacacttcccctgggaacagaggagacccaggatgagtgtgacaaacctggcggcagcgcaaaagatg

SEQ ID NO: 167661 - DNA, 103 bp, Artificial Sequence
  Synthetic Polynucleotide
taatacgactcactatagggaagcattgagccacgtatcttctgtcacacaacagaggagagtgtgaatgaagatacgtaacctggcggcagcgcaaaagatg

SEQ ID NO: 167662 - DNA, 103 bp, Artificial Sequence
  Synthetic Polynucleotide
taatacgactcactatagggccatggacagaagcattgagccacgtatctaacagaggagaagatacatggctcaatgcaacctggcggcagcgcaaaagatg

SEQ ID NO: 167663 - DNA, 103 bp, Artificial Sequence
  Synthetic Polynucleotide
taatacgactcactataggggcctgacccaccatggacagaagcattgagaacagaggagactcaatatgtctgtccataacctggcggcagcgcaaaagatg

SEQ ID NO: 167664 - DNA, 103 bp, Artificial Sequence
  Synthetic Polynucleotide
taatacgactcactatagggcagggccaaggcctgacccaccatggacagaacagaggagactgtccatggtgggtcagaacctggcggcagcgcaaaagatg

SEQ ID NO: 167665 - DNA, 103 bp, Artificial Sequence
  Synthetic Polynucleotide
taatacgactcactatagggggaaaaactgcagggccaaggcctgacccaaacagaggagatgggtcatgccttggcccaacctggcggcagcgcaaaagatg

SEQ ID NO: 167666 - DNA, 103 bp, Artificial Sequence
  Synthetic Polynucleotide
taatacgactcactataggggtactgaaatggaaaaactgcagggccaagaacagaggagacttggcatggcagtttttaacctggcggcagcgcaaaagatg

SEQ ID NO: 167667 - DNA, 103 bp, Artificial Sequence
  Synthetic Polynucleotide
taatacgactcactatagggtctctacacagtactgaaatggaaaaactgaacagaggagacagtttatgcatttcagtaacctggcggcagcgcaaaagatg

SEQ ID NO: 167668 - DNA, 103 bp, Artificial Sequence
  Synthetic Polynucleotide
taatacgactcactataggggggatgtcagtctctacacagtactgaaataacagaggagaatttcaatgctgtgtagaaacctggcggcagcgcaaaagatg

SEQ ID NO: 167669 - DNA, 103 bp, Artificial Sequence
  Synthetic Polynucleotide
taatacgactcactatagggctcctcatcctcgcagctggccgcccccataacagaggagaatggggatggccagctgcaacctggcggcagcgcaaaagatg

SEQ ID NO: 167670 - DNA, 103 bp, Artificial Sequence
  Synthetic Polynucleotide
taatacgactcactatagggggcatcctctgagtccagttcttcccccaaaacagaggagattggggatggaactggacaacctggcggcagcgcaaaagatg

SEQ ID NO: 167671 - DNA, 103 bp, Artificial Sequence
  Synthetic Polynucleotide
taatacgactcactatagggagccactgcctgctcgctggaagtccgccgaacagaggagacggcggatgtccagcgagaacctggcggcagcgcaaaagatg

SEQ ID NO: 167672 - DNA, 103 bp, Artificial Sequence
  Synthetic Polynucleotide
taatacgactcactatagggaccgaggcagagccactgcctgctcgctggaacagaggagaccagcgatgaggcagtggaacctggcggcagcgcaaaagatg

SEQ ID NO: 167673 - DNA, 103 bp, Artificial Sequence
  Synthetic Polynucleotide
taatacgactcactatagggggctcctcagaccgaggcagagccactgccaacagaggagaggcagtatgtctgcctcgaacctggcggcagcgcaaaagatg

SEQ ID NO: 167674 - DNA, 103 bp, Artificial Sequence
  Synthetic Polynucleotide
taatacgactcactataggggcatgaggcaggctcctcagaccgaggcagaacagaggagactgcctatgtctgaggagaacctggcggcagcgcaaaagatg

SEQ ID NO: 167675 - DNA, 103 bp, Artificial Sequence
  Synthetic Polynucleotide
taatacgactcactataggggcttcccattgcatgaggcaggctcctcagaacagaggagactgaggatgctgcctcataacctggcggcagcgcaaaagatg

SEQ ID NO: 167676 - DNA, 103 bp, Artificial Sequence
  Synthetic Polynucleotide
taatacgactcactatagggcccaagggcagcttcccattgcatgaggcaaacagaggagatgcctcatgcaatgggaaaacctggcggcagcgcaaaagatg

SEQ ID NO: 167677 - DNA, 103 bp, Artificial Sequence
  Synthetic Polynucleotide
taatacgactcactatagggctcctctgctcccaagggcagcttcccattaacagaggagaaatgggatgctgcccttgaacctggcggcagcgcaaaagatg

SEQ ID NO: 167678 - DNA, 103 bp, Artificial Sequence
  Synthetic Polynucleotide
taatacgactcactataggggagccacagactcctctgctcccaagggcaaacagaggagatgccctatggagcagaggaacctggcggcagcgcaaaagatg

SEQ ID NO: 167679 - DNA, 103 bp, Artificial Sequence
  Synthetic Polynucleotide
taatacgactcactatagggcctcctggaggagccacagactcctctgctaacagaggagaagcagaatggtctgtggcaacctggcggcagcgcaaaagatg

SEQ ID NO: 167680 - DNA, 103 bp, Artificial Sequence
  Synthetic Polynucleotide
taatacgactcactatagggcttccgggaacctcctggaggagccacagaaacagaggagatctgtgatgcctccaggaaacctggcggcagcgcaaaagatg

SEQ ID NO: 167681 - DNA, 103 bp, Artificial Sequence
  Synthetic Polynucleotide
taatacgactcactatagggagcatggcggggcatcctctgagtccagttaacagaggagaaactggatgcagaggatgaacctggcggcagcgcaaaagatg

SEQ ID NO: 167682 - DNA, 103 bp, Artificial Sequence
  Synthetic Polynucleotide
taatacgactcactatagggcagccacctccttccgggaacctcctggagaacagaggagactccagatggttcccggaaacctggcggcagcgcaaaagatg

SEQ ID NO: 167683 - DNA, 103 bp, Artificial Sequence
  Synthetic Polynucleotide
taatacgactcactatagggtagtccatgccagccacctccttccgggaaaacagaggagattcccgatgggaggtggcaacctggcggcagcgcaaaagatg

SEQ ID NO: 167684 - DNA, 103 bp, Artificial Sequence
  Synthetic Polynucleotide
taatacgactcactatagggcactgccaggtagtccatgccagccacctcaacagaggagagaggtgatgggcatggacaacctggcggcagcgcaaaagatg

SEQ ID NO: 167685 - DNA, 103 bp, Artificial Sequence
  Synthetic Polynucleotide
taatacgactcactataggggtggggagggcactgccaggtagtccatgcaacagaggagagcatggatgacctggcagaacctggcggcagcgcaaaagatg

SEQ ID NO: 167686 - DNA, 103 bp, Artificial Sequence
  Synthetic Polynucleotide
taatacgactcactataggggaccaagcgagtggggagggcactgccaggaacagaggagacctggcatggccctccccaacctggcggcagcgcaaaagatg

SEQ ID NO: 167687 - DNA, 103 bp, Artificial Sequence
  Synthetic Polynucleotide
taatacgactcactatagggccgggccttggaccaagcgagtggggagggaacagaggagaccctccatgctcgcttggaacctggcggcagcgcaaaagatg

SEQ ID NO: 167688 - DNA, 103 bp, Artificial Sequence
  Synthetic Polynucleotide
taatacgactcactataggggtcccccaatccgggccttggaccaagcgaaacagaggagatcgcttatgccaaggcccaacctggcggcagcgcaaaagatg

SEQ ID NO: 167689 - DNA, 103 bp, Artificial Sequence
  Synthetic Polynucleotide
taatacgactcactatagggatagggctgtgtcccccaatccgggccttgaacagaggagacaaggcatggattgggggaacctggcggcagcgcaaaagatg

SEQ ID NO: 167690 - DNA, 103 bp, Artificial Sequence
  Synthetic Polynucleotide
taatacgactcactatagggggtcctgaagatagggctgtgtcccccaataacagaggagaattgggatgcacagccctaacctggcggcagcgcaaaagatg

SEQ ID NO: 167691 - DNA, 103 bp, Artificial Sequence
  Synthetic Polynucleotide
taatacgactcactataggggtagggcagaggtcctgaagatagggctgtaacagaggagaacagccatgtcttcaggaaacctggcggcagcgcaaaagatg

SEQ ID NO: 167692 - DNA, 103 bp, Artificial Sequence
  Synthetic Polynucleotide
taatacgactcactataggggccagacggcagcatggcggggcatcctctaacagaggagaagaggaatgcccgccatgaacctggcggcagcgcaaaagatg

SEQ ID NO: 167693 - DNA, 103 bp, Artificial Sequence
  Synthetic Polynucleotide
taatacgactcactatagggtccagtgggggtagggcagaggtcctgaagaacagaggagacttcagatgctctgccctaacctggcggcagcgcaaaagatg

SEQ ID NO: 167694 - DNA, 103 bp, Artificial Sequence
  Synthetic Polynucleotide
taatacgactcactatagggcagaggccagtccagtgggggtagggcagaaacagaggagatctgccatgcccccactgaacctggcggcagcgcaaaagatg

SEQ ID NO: 167695 - DNA, 103 bp, Artificial Sequence
  Synthetic Polynucleotide
taatacgactcactatagggattggctgggcagaggccagtccagtggggaacagaggagaccccacatgactggcctcaacctggcggcagcgcaaaagatg

SEQ ID NO: 167696 - DNA, 103 bp, Artificial Sequence
  Synthetic Polynucleotide
taatacgactcactatagggagctgctcatattggctgggcagaggccagaacagaggagactggccatggcccagccaaacctggcggcagcgcaaaagatg

SEQ ID NO: 167697 - DNA, 103 bp, Artificial Sequence
  Synthetic Polynucleotide
taatacgactcactatagggcctcagctccagctgctcatattggctgggaacagaggagacccagcatgtatgagcagaacctggcggcagcgcaaaagatg

SEQ ID NO: 167698 - DNA, 103 bp, Artificial Sequence
  Synthetic Polynucleotide
taatacgactcactataggggtacctcgatcctcagctccagctgctcataacagaggagaatgagcatgtggagctgaaacctggcggcagcgcaaaagatg

SEQ ID NO: 167699 - DNA, 103 bp, Artificial Sequence
  Synthetic Polynucleotide
taatacgactcactataggggctctaggctgtacctcgatcctcagctccaacagaggagaggagctatggatcgaggtaacctggcggcagcgcaaaagatg

SEQ ID NO: 167700 - DNA, 103 bp, Artificial Sequence
  Synthetic Polynucleotide
taatacgactcactatagggccggtggtgggctctaggctgtacctcgataacagaggagaatcgagatgcagcctagaaacctggcggcagcgcaaaagatg

SEQ ID NO: 167701 - DNA, 103 bp, Artificial Sequence
  Synthetic Polynucleotide
taatacgactcactatagggcatagtgggcccggtggtgggctctaggctaacagaggagaagcctaatgcccaccaccaacctggcggcagcgcaaaagatg

SEQ ID NO: 167702 - DNA, 103 bp, Artificial Sequence
  Synthetic Polynucleotide
taatacgactcactatagggccttctgtctcatagtgggcccggtggtggaacagaggagaccaccaatgggcccactaaacctggcggcagcgcaaaagatg

SEQ ID NO: 167703 - DNA, 103 bp, Artificial Sequence
  Synthetic Polynucleotide
taatacgactcactatagggctctcccaaggccagacggcagcatggcggaacagaggagaccgccaatgtgccgtctgaacctggcggcagcgcaaaagatg

SEQ ID NO: 167704 - DNA, 103 bp, Artificial Sequence
  Synthetic Polynucleotide
taatacgactcactatagggtccacggctgccttctgtctcatagtgggcaacagaggagagcccacatggagacagaaaacctggcggcagcgcaaaagatg

SEQ ID NO: 167705 - DNA, 103 bp, Artificial Sequence
  Synthetic Polynucleotide
taatacgactcactatagggctttgacagctccacggctgccttctgtctaacagaggagaagacagatggcagccgtgaacctggcggcagcgcaaaagatg

SEQ ID NO: 167706 - DNA, 103 bp, Artificial Sequence
  Synthetic Polynucleotide
taatacgactcactatagggccaggggcagctttgacagctccacggctgaacagaggagacagccgatgagctgtcaaaacctggcggcagcgcaaaagatg

SEQ ID NO: 167707 - DNA, 103 bp, Artificial Sequence
  Synthetic Polynucleotide
taatacgactcactatagggggggtgaccgccaggggcagctttgacagcaacagaggagagctgtcatggctgcccctaacctggcggcagcgcaaaagatg

SEQ ID NO: 167708 - DNA, 103 bp, Artificial Sequence
  Synthetic Polynucleotide
taatacgactcactataggggcttgactacggggtgaccgccaggggcagaacagaggagactgcccatggcggtcaccaacctggcggcagcgcaaaagatg

SEQ ID NO: 167709 - DNA, 103 bp, Artificial Sequence
  Synthetic Polynucleotide
taatacgactcactatagggtagcctaggagcttgactacggggtgaccgaacagaggagacggtcaatgcgtagtcaaaacctggcggcagcgcaaaagatg

SEQ ID NO: 167710 - DNA, 103 bp, Artificial Sequence
  Synthetic Polynucleotide
taatacgactcactatagggcttctcactgtagcctaggagcttgactacaacagaggagagtagtcatgctcctaggcaacctggcggcagcgcaaaagatg

SEQ ID NO: 167711 - DNA, 103 bp, Artificial Sequence
  Synthetic Polynucleotide
taatacgactcactataggggggtcagtggcttctcactgtagcctaggaaacagaggagatcctagatgacagtgagaaacctggcggcagcgcaaaagatg

SEQ ID NO: 167712 - DNA, 103 bp, Artificial Sequence
  Synthetic Polynucleotide
taatacgactcactatagggaacatctgtagggtcagtggcttctcactgaacagaggagacagtgaatggccactgacaacctggcggcagcgcaaaagatg

SEQ ID NO: 167713 - DNA, 103 bp, Artificial Sequence
  Synthetic Polynucleotide
taatacgactcactatagggagtgccgatgaacatctgtagggtcagtggaacagaggagaccactgatgctacagatgaacctggcggcagcgcaaaagatg

SEQ ID NO: 167714 - DNA, 103 bp, Artificial Sequence
  Synthetic Polynucleotide
taatacgactcactatagggagggagggggctctcccaaggccagacggcaacagaggagagccgtcatgccttgggagaacctggcggcagcgcaaaagatg

SEQ ID NO: 167715 - DNA, 103 bp, Artificial Sequence
  Synthetic Polynucleotide
taatacgactcactatagggtttcatctgcagtgccgatgaacatctgtaaacagaggagatacagaatgtcatcggcaaacctggcggcagcgcaaaagatg

SEQ ID NO: 167716 - DNA, 103 bp, Artificial Sequence
  Synthetic Polynucleotide
taatacgactcactatagggcgcaggttcctttcatctgcagtgccgatgaacagaggagacatcggatgtgcagatgaaacctggcggcagcgcaaaagatg

SEQ ID NO: 167717 - DNA, 103 bp, Artificial Sequence
  Synthetic Polynucleotide
taatacgactcactatagggggcatgaggccgcaggttcctttcatctgcaacagaggagagcagatatgaggaacctgaacctggcggcagcgcaaaagatg

SEQ ID NO: 167718 - DNA, 103 bp, Artificial Sequence
  Synthetic Polynucleotide
taatacgactcactatagggcctgatagaaggcatgaggccgcaggttccaacagaggagaggaaccatgggcctcatgaacctggcggcagcgcaaaagatg

SEQ ID NO: 167719 - DNA, 103 bp, Artificial Sequence
  Synthetic Polynucleotide
taatacgactcactatagggatacggtgcacctgatagaaggcatgaggcaacagaggagagcctcaatgcttctatcaaacctggcggcagcgcaaaagatg

SEQ ID NO: 167720 - DNA, 103 bp, Artificial Sequence
  Synthetic Polynucleotide
taatacgactcactatagggcttgcctgtgatacggtgcacctgatagaaaacagaggagattctatatggtgcaccgtaacctggcggcagcgcaaaagatg

SEQ ID NO: 167721 - DNA, 103 bp, Artificial Sequence
  Synthetic Polynucleotide
taatacgactcactatagggtggccaccatcttgcctgtgatacggtgcaaacagaggagatgcaccatgtcacaggcaaacctggcggcagcgcaaaagatg

SEQ ID NO: 167722 - DNA, 103 bp, Artificial Sequence
  Synthetic Polynucleotide
taatacgactcactatagggtagctggccgtggccaccatcttgcctgtgaacagaggagacacaggatggatggtggcaacctggcggcagcgcaaaagatg

SEQ ID NO: 167723 - DNA, 103 bp, Artificial Sequence
  Synthetic Polynucleotide
taatacgactcactatagggtacggcttcatagctggccgtggccaccataacagaggagaatggtgatgacggccagcaacctggcggcagcgcaaaagatg

SEQ ID NO: 167724 - DNA, 103 bp, Artificial Sequence
  Synthetic Polynucleotide
taatacgactcactatagggtgccactgactacggcttcatagctggccgaacagaggagacggccaatgatgaagccgaacctggcggcagcgcaaaagatg

SEQ ID NO: 167725 - DNA, 103 bp, Artificial Sequence
  Synthetic Polynucleotide
taatacgactcactataggggcagcgccatagggagggggctctcccaagaacagaggagacttgggatggccccctccaacctggcggcagcgcaaaagatg

SEQ ID NO: 167726 - DNA, 103 bp, Artificial Sequence
  Synthetic Polynucleotide
taatacgactcactatagggaacaccttggtgccactgactacggcttcaaacagaggagatgaagcatgagtcagtggaacctggcggcagcgcaaaagatg

SEQ ID NO: 167727 - DNA, 103 bp, Artificial Sequence
  Synthetic Polynucleotide
taatacgactcactatagggagtcatctccaacaccttggtgccactgacaacagaggagagtcagtatgaccaaggtgaacctggcggcagcgcaaaagatg

SEQ ID NO: 167728 - DNA, 103 bp, Artificial Sequence
  Synthetic Polynucleotide
taatacgactcactatagggcaggcagcagagtcatctccaacaccttggaacagaggagaccaaggatgtggagatgaaacctggcggcagcgcaaaagatg

SEQ ID NO: 167729 - DNA, 103 bp, Artificial Sequence
  Synthetic Polynucleotide
taatacgactcactatagggatgttgttctcaggcagcagagtcatctccaacagaggagaggagatatgtctgctgccaacctggcggcagcgcaaaagatg

SEQ ID NO: 167730 - DNA, 103 bp, Artificial Sequence
  Synthetic Polynucleotide
taatacgactcactataggggttggccgccatgttgttctcaggcagcagaacagaggagactgctgatggagaacaacaacctggcggcagcgcaaaagatg

SEQ ID NO: 167731 - DNA, 103 bp, Artificial Sequence
  Synthetic Polynucleotide
taatacgactcactatagggcgcagtcaatgttggccgccatgttgttctaacagaggagaagaacaatgtggcggccaaacctggcggcagcgcaaaagatg

SEQ ID NO: 167732 - DNA, 103 bp, Artificial Sequence
  Synthetic Polynucleotide
taatacgactcactatagggaggattcccgcgcagtcaatgttggccgccaacagaggagaggcggcatgcattgactgaacctggcggcagcgcaaaagatg

SEQ ID NO: 167733 - DNA, 103 bp, Artificial Sequence
  Synthetic Polynucleotide
taatacgactcactatagggccgaagcttcaggattcccgcgcagtcaataacagaggagaattgacatggcgggaatcaacctggcggcagcgcaaaagatg

SEQ ID NO: 167734 - DNA, 103 bp, Artificial Sequence
  Synthetic Polynucleotide
taatacgactcactatagggtgtctgaattccgaagcttcaggattcccgaacagaggagacgggaaatgtgaagcttcaacctggcggcagcgcaaaagatg

SEQ ID NO: 167735 - DNA, 103 bp, Artificial Sequence
  Synthetic Polynucleotide
taatacgactcactatagggcgaagctcaatgtctgaattccgaagcttcaacagaggagagaagctatggaattcagaaacctggcggcagcgcaaaagatg

SEQ ID NO: 167736 - DNA, 103 bp, Artificial Sequence
  Synthetic Polynucleotide
taatacgactcactatagggaccgataggtgcagcgccatagggagggggaacagaggagaccccctatgtatggcgctaacctggcggcagcgcaaaagatg

SEQ ID NO: 167737 - DNA, 103 bp, Artificial Sequence
  Synthetic Polynucleotide
taatacgactcactatagggctcacccttccgaagctcaatgtctgaattaacagaggagaaattcaatgattgagcttaacctggcggcagcgcaaaagatg

SEQ ID NO: 167738 - DNA, 103 bp, Artificial Sequence
  Synthetic Polynucleotide
taatacgactcactatagggcgatgtccgtctcacccttccgaagctcaaaacagaggagattgagcatgggaagggtgaacctggcggcagcgcaaaagatg

SEQ ID NO: 167739 - DNA, 103 bp, Artificial Sequence
  Synthetic Polynucleotide
taatacgactcactatagggtttttgcgcccgatgtccgtctcacccttcaacagaggagagaagggatggacggacataacctggcggcagcgcaaaagatg

SEQ ID NO: 167740 - DNA, 103 bp, Artificial Sequence
  Synthetic Polynucleotide
taatacgactcactatagggtacacgtgtgtttttgcgcccgatgtccgtaacagaggagaacggacatggggcgcaaaaacctggcggcagcgcaaaagatg

SEQ ID NO: 167741 - DNA, 103 bp, Artificial Sequence
  Synthetic Polynucleotide
taatacgactcactatagggacaccagccgtacacgtgtgtttttgcgccaacagaggagaggcgcaatgacacacgtgaacctggcggcagcgcaaaagatg

SEQ ID NO: 167742 - DNA, 103 bp, Artificial Sequence
  Synthetic Polynucleotide
taatacgactcactatagggtgtacccggaacaccagccgtacacgtgtgaacagaggagacacacgatgacggctggtaacctggcggcagcgcaaaagatg

SEQ ID NO: 167743 - DNA, 103 bp, Artificial Sequence
  Synthetic Polynucleotide
taatacgactcactatagggctggggcacgtgtacccggaacaccagccgaacagaggagacggctgatgttccgggtaaacctggcggcagcgcaaaagatg

SEQ ID NO: 167744 - DNA, 103 bp, Artificial Sequence
  Synthetic Polynucleotide
taatacgactcactatagggtcccgccgccctggggcacgtgtacccggaaacagaggagatccgggatgacgtgccccaacctggcggcagcgcaaaagatg

SEQ ID NO: 167745 - DNA, 103 bp, Artificial Sequence
  Synthetic Polynucleotide
taatacgactcactataggggagacgaccttcccgccgccctggggcacgaacagaggagacgtgccatggggcggcggaacctggcggcagcgcaaaagatg

SEQ ID NO: 167746 - DNA, 103 bp, Artificial Sequence
  Synthetic Polynucleotide
taatacgactcactatagggtgcctgtactgagacgaccttcccgccgccaacagaggagaggcggcatgaaggtcgtcaacctggcggcagcgcaaaagatg

SEQ ID NO: 167747 - DNA, 103 bp, Artificial Sequence
  Synthetic Polynucleotide
taatacgactcactataggggtcggggaataccgataggtgcagcgccataacagaggagaatggcgatgcacctatcgaacctggcggcagcgcaaaagatg

SEQ ID NO: 167748 - DNA, 103 bp, Artificial Sequence
  Synthetic Polynucleotide
taatacgactcactataggggcaccgatgctgcctgtactgagacgacctaacagaggagaaggtcgatgcagtacaggaacctggcggcagcgcaaaagatg

SEQ ID NO: 167749 - DNA, 103 bp, Artificial Sequence
  Synthetic Polynucleotide
taatacgactcactatagggcactcgatgggcaccgatgctgcctgtactaacagaggagaagtacaatgagcatcggtaacctggcggcagcgcaaaagatg

SEQ ID NO: 167750 - DNA, 103 bp, Artificial Sequence
  Synthetic Polynucleotide
taatacgactcactataggggcgctgggagcactcgatgggcaccgatgcaacagaggagagcatcgatgcccatcgagaacctggcggcagcgcaaaagatg

SEQ ID NO: 167751 - DNA, 103 bp, Artificial Sequence
  Synthetic Polynucleotide
taatacgactcactatagggcctgggctgagcgctgggagcactcgatggaacagaggagaccatcgatggctcccagcaacctggcggcagcgcaaaagatg

SEQ ID NO: 167752 - DNA, 103 bp, Artificial Sequence
  Synthetic Polynucleotide
taatacgactcactatagggtggggcagctcctgggctgagcgctgggagaacagaggagactcccaatgctcagcccaaacctggcggcagcgcaaaagatg

SEQ ID NO: 167753 - DNA, 103 bp, Artificial Sequence
  Synthetic Polynucleotide
taatacgactcactatagggggcctccacctggggcagctcctgggctgaaacagaggagatcagccatggagctgcccaacctggcggcagcgcaaaagatg

SEQ ID NO: 167754 - DNA, 103 bp, Artificial Sequence
  Synthetic Polynucleotide
taatacgactcactatagggtggggctgtaggcctccacctggggcagctaacagaggagaagctgcatgaggtggaggaacctggcggcagcgcaaaagatg

SEQ ID NO: 167755 - DNA, 103 bp, Artificial Sequence
  Synthetic Polynucleotide
taatacgactcactataggggagcaggcactggggctgtaggcctccaccaacagaggagaggtggaatgctacagcccaacctggcggcagcgcaaaagatg

SEQ ID NO: 167756 - DNA, 103 bp, Artificial Sequence
  Synthetic Polynucleotide
taatacgactcactatagggtcctctcacagagcaggcactggggctgtaaacagaggagatacagcatgagtgcctgcaacctggcggcagcgcaaaagatg

SEQ ID NO: 167757 - DNA, 103 bp, Artificial Sequence
  Synthetic Polynucleotide
taatacgactcactataggggttcctcgcctcctctcacagagcaggcacaacagaggagagtgcctatgctgtgagagaacctggcggcagcgcaaaagatg

SEQ ID NO: 167758 - DNA, 103 bp, Artificial Sequence
  Synthetic Polynucleotide
taatacgactcactataggggggggtggaggtcggggaataccgataggtaacagaggagaacctatatgtattccccgaacctggcggcagcgcaaaagatg

SEQ ID NO: 167759 - DNA, 103 bp, Artificial Sequence
  Synthetic Polynucleotide
taatacgactcactataggggtcagtaccagttcctcgcctcctctcacaaacagaggagatgtgagatgaggcgaggaaacctggcggcagcgcaaaagatg

SEQ ID NO: 167760 - DNA, 103 bp, Artificial Sequence
  Synthetic Polynucleotide
taatacgactcactataggggttggagccagtcagtaccagttcctcgccaacagaggagaggcgagatgctggtactgaacctggcggcagcgcaaaagatg

SEQ ID NO: 167761 - DNA, 103 bp, Artificial Sequence
  Synthetic Polynucleotide
taatacgactcactatagggctggcaggaagttggagccagtcagtaccaaacagaggagatggtacatgctggctccaaacctggcggcagcgcaaaagatg

SEQ ID NO: 167762 - DNA, 103 bp, Artificial Sequence
  Synthetic Polynucleotide
taatacgactcactatagggaccttggagtctggcaggaagttggagccaaacagaggagatggctcatgcttcctgccaacctggcggcagcgcaaaagatg

SEQ ID NO: 167763 - DNA, 103 bp, Artificial Sequence
  Synthetic Polynucleotide
taatacgactcactatagggaatgaacaccaccttggagtctggcaggaaaacagaggagattcctgatggactccaagaacctggcggcagcgcaaaagatg

SEQ ID NO: 167764 - DNA, 103 bp, Artificial Sequence
  Synthetic Polynucleotide
taatacgactcactataggggacccctctcaatgaacaccaccttggagtaacagaggagaactccaatgtggtgttcaaacctggcggcagcgcaaaagatg

SEQ ID NO: 167765 - DNA, 103 bp, Artificial Sequence
  Synthetic Polynucleotide
taatacgactcactatagggttcccatcaggacccctctcaatgaacaccaacagaggagaggtgttatgtgagaggggaacctggcggcagcgcaaaagatg

SEQ ID NO: 167766 - DNA, 103 bp, Artificial Sequence
  Synthetic Polynucleotide
taatacgactcactatagggccattgcagcttcccatcaggacccctctcaacagaggagagagaggatgcctgatgggaacctggcggcagcgcaaaagatg

SEQ ID NO: 167767 - DNA, 103 bp, Artificial Sequence
  Synthetic Polynucleotide
taatacgactcactatagggcctcctcctcccattgcagcttcccatcagaacagaggagactgatgatgagctgcaataacctggcggcagcgcaaaagatg

SEQ ID NO: 167768 - DNA, 103 bp, Artificial Sequence
  Synthetic Polynucleotide
taatacgactcactatagggttcactgtggcctcctcctcccattgcagcaacagaggagagctgcaatgggaggaggaaacctggcggcagcgcaaaagatg

SEQ ID NO: 167769 - DNA, 103 bp, Artificial Sequence
  Synthetic Polynucleotide
taatacgactcactataggggccaggccgagggggtggaggtcggggaataacagaggagaattcccatgcctccacccaacctggcggcagcgcaaaagatg

SEQ ID NO: 167770 - DNA, 103 bp, Artificial Sequence
  Synthetic Polynucleotide
taatacgactcactatagggctgcagtcggttcactgtggcctcctcctcaacagaggagagaggagatggccacagtgaacctggcggcagcgcaaaagatg

SEQ ID NO: 167771 - DNA, 103 bp, Artificial Sequence
  Synthetic Polynucleotide
taatacgactcactatagggcctcgttgctctgcagtcggttcactgtggaacagaggagaccacagatgaccgactgcaacctggcggcagcgcaaaagatg

SEQ ID NO: 167772 - DNA, 103 bp, Artificial Sequence
  Synthetic Polynucleotide
taatacgactcactataggggtcagcgtcacctcgttgctctgcagtcggaacagaggagaccgactatggagcaacgaaacctggcggcagcgcaaaagatg

SEQ ID NO: 167773 - DNA, 103 bp, Artificial Sequence
  Synthetic Polynucleotide
taatacgactcactataggggacagtcagggtcagcgtcacctcgttgctaacagaggagaagcaacatggtgacgctgaacctggcggcagcgcaaaagatg

SEQ ID NO: 167774 - DNA, 103 bp, Artificial Sequence
  Synthetic Polynucleotide
taatacgactcactatagggtgtactcggggacagtcagggtcagcgtcaaacagaggagatgacgcatgccctgactgaacctggcggcagcgcaaaagatg

SEQ ID NO: 167775 - DNA, 103 bp, Artificial Sequence
  Synthetic Polynucleotide
taatacgactcactatagggctcttgttgctgtactcggggacagtcaggaacagaggagacctgacatgccccgagtaaacctggcggcagcgcaaaagatg

SEQ ID NO: 167776 - DNA, 103 bp, Artificial Sequence
  Synthetic Polynucleotide
taatacgactcactatagggccgggaaaccctcttgttgctgtactcgggaacagaggagacccgagatgagcaacaagaacctggcggcagcgcaaaagatg

SEQ ID NO: 167777 - DNA, 103 bp, Artificial Sequence
  Synthetic Polynucleotide
taatacgactcactatagggcctggactggccgggaaaccctcttgttgcaacagaggagagcaacaatggggtttcccaacctggcggcagcgcaaaagatg

SEQ ID NO: 167778 - DNA, 103 bp, Artificial Sequence
  Synthetic Polynucleotide
taatacgactcactatagggtaaaagtagacctggactggccgggaaaccaacagaggagaggtttcatggccagtccaaacctggcggcagcgcaaaagatg

SEQ ID NO: 167779 - DNA, 103 bp, Artificial Sequence
  Synthetic Polynucleotide
taatacgactcactatagggattggagacataaaagtagacctggactggaacagaggagaccagtcatggtctactttaacctggcggcagcgcaaaagatg

SEQ ID NO: 167780 - DNA, 103 bp, Artificial Sequence
  Synthetic Polynucleotide
taatacgactcactatagggtaaattccagctcctcatcctcgcagctggaacagaggagaccagctatgaggatgaggaacctggcggcagcgcaaaagatg

SEQ ID NO: 167781 - DNA, 103 bp, Artificial Sequence
  Synthetic Polynucleotide
taatacgactcactataggggcgaatgcatgccaggccgagggggtggagaacagaggagactccacatgctcggcctgaacctggcggcagcgcaaaagatg

SEQ ID NO: 167782 - DNA, 103 bp, Artificial Sequence
  Synthetic Polynucleotide
taatacgactcactatagggtcctccgcccattggagacataaaagtagaaacagaggagatctactatgatgtctccaaacctggcggcagcgcaaaagatg

SEQ ID NO: 167783 - DNA, 103 bp, Artificial Sequence
  Synthetic Polynucleotide
taatacgactcactatagggggactgcgtttcctccgcccattggagacaaacagaggagatgtctcatgtgggcggagaacctggcggcagcgcaaaagatg

SEQ ID NO: 167784 - DNA, 103 bp, Artificial Sequence
  Synthetic Polynucleotide
taatacgactcactatagggactctgggtaggactgcgtttcctccgcccaacagaggagagggcggatgaaacgcagtaacctggcggcagcgcaaaagatg

SEQ ID NO: 167785 - DNA, 103 bp, Artificial Sequence
  Synthetic Polynucleotide
taatacgactcactataggggaaacctgaaactctgggtaggactgcgttaacagaggagaaacgcaatgctacccagaaacctggcggcagcgcaaaagatg

SEQ ID NO: 167786 - DNA, 103 bp, Artificial Sequence
  Synthetic Polynucleotide
taatacgactcactatagggatcacaggcagaaacctgaaactctgggtaaacagaggagatacccaatgtttcaggttaacctggcggcagcgcaaaagatg

SEQ ID NO: 167787 - DNA, 103 bp, Artificial Sequence
  Synthetic Polynucleotide
taatacgactcactatagggctctttgcagatcacaggcagaaacctgaaaacagaggagattcaggatgctgcctgtgaacctggcggcagcgcaaaagatg

SEQ ID NO: 167788 - DNA, 103 bp, Artificial Sequence
  Synthetic Polynucleotide
taatacgactcactataggggtaggggctcctctttgcagatcacaggcaaacagaggagatgcctgatgtctgcaaagaacctggcggcagcgcaaaagatg

SEQ ID NO: 167789 - DNA, 103 bp, Artificial Sequence
  Synthetic Polynucleotide
taatacgactcactataggggatgagtccggtaggggctcctctttgcagaacagaggagactgcaaatgggagcccctaacctggcggcagcgcaaaagatg

SEQ ID NO: 167790 - DNA, 103 bp, Artificial Sequence
  Synthetic Polynucleotide
taatacgactcactatagggaccccgcagagatgagtccggtaggggctcaacagaggagagagcccatgccggactcaaacctggcggcagcgcaaaagatg

SEQ ID NO: 167791 - DNA, 103 bp, Artificial Sequence
  Synthetic Polynucleotide
taatacgactcactatagggctgaagggaaaccccgcagagatgagtccgaacagaggagacggactatgctctgcgggaacctggcggcagcgcaaaagatg

SEQ ID NO: 167792 - DNA, 103 bp, Artificial Sequence
  Synthetic Polynucleotide
taatacgactcactatagggcgcggcggtggcgaatgcatgccaggccgaaacagaggagatcggccatgcatgcattcaacctggcggcagcgcaaaagatg

SEQ ID NO: 167793 - DNA, 103 bp, Artificial Sequence
  Synthetic Polynucleotide
taatacgactcactataggggttgccgatgctgaagggaaaccccgcagaaacagaggagatctgcgatgtttcccttcaacctggcggcagcgcaaaagatg

SEQ ID NO: 167794 - DNA, 103 bp, Artificial Sequence
  Synthetic Polynucleotide
taatacgactcactataggggccaaagggggttgccgatgctgaagggaaaacagaggagattccctatggcatcggcaaacctggcggcagcgcaaaagatg

SEQ ID NO: 167795 - DNA, 103 bp, Artificial Sequence
  Synthetic Polynucleotide
taatacgactcactatagggccatgtcagtgccaaagggggttgccgatgaacagaggagacatcggatgccccctttgaacctggcggcagcgcaaaagatg

SEQ ID NO: 167796 - DNA, 103 bp, Artificial Sequence
  Synthetic Polynucleotide
taatacgactcactatagggggtgagaagtccatgtcagtgccaaaggggaacagaggagaccccttatgcactgacataacctggcggcagcgcaaaagatg

SEQ ID NO: 167797 - DNA, 103 bp, Artificial Sequence
  Synthetic Polynucleotide
taatacgactcactataggggggcctgggtggtgagaagtccatgtcagtaacagaggagaactgacatggacttctcaaacctggcggcagcgcaaaagatg

SEQ ID NO: 167798 - DNA, 103 bp, Artificial Sequence
  Synthetic Polynucleotide
taatacgactcactatagggaggggtaggggggcctgggtggtgagaagtaacagaggagaacttctatgcacccaggcaacctggcggcagcgcaaaagatg

SEQ ID NO: 167799 - DNA, 103 bp, Artificial Sequence
  Synthetic Polynucleotide
taatacgactcactatagggtggggataggaggggtaggggggcctgggtaacagaggagaacccagatgcccctacccaacctggcggcagcgcaaaagatg

SEQ ID NO: 167800 - DNA, 103 bp, Artificial Sequence
  Synthetic Polynucleotide
taatacgactcactatagggagggtcttcatggggataggaggggtagggaacagaggagaccctacatgtcctatcccaacctggcggcagcgcaaaagatg

SEQ ID NO: 167801 - DNA, 103 bp, Artificial Sequence
  Synthetic Polynucleotide
taatacgactcactatagggtttcgcaagcagggtcttcatggggataggaacagaggagacctatcatgatgaagaccaacctggcggcagcgcaaaagatg

SEQ ID NO: 167802 - DNA, 103 bp, Artificial Sequence
  Synthetic Polynucleotide
taatacgactcactatagggaggtaaggagtttcgcaagcagggtcttcaaacagaggagatgaagaatgtgcttgcgaaacctggcggcagcgcaaaagatg

SEQ ID NO: 167803 - DNA, 103 bp, Artificial Sequence
  Synthetic Polynucleotide
taatacgactcactataggggggggctggtcgcggcggtggcgaatgcataacagaggagaatgcatatgccaccgccgaacctggcggcagcgcaaaagatg

SEQ ID NO: 167804 - DNA, 103 bp, Artificial Sequence
  Synthetic Polynucleotide
taatacgactcactataggggccttctgataggtaaggagtttcgcaagcaacagaggagagcttgcatgactccttacaacctggcggcagcgcaaaagatg

SEQ ID NO: 167805 - DNA, 103 bp, Artificial Sequence
  Synthetic Polynucleotide
taatacgactcactatagggcatagccgaagccttctgataggtaaggagaacagaggagactccttatgtatcagaagaacctggcggcagcgcaaaagatg

SEQ ID NO: 167806 - DNA, 103 bp, Artificial Sequence
  Synthetic Polynucleotide
taatacgactcactataggggggggcatgccatagccgaagccttctgataacagaggagaatcagaatgcttcggctaaacctggcggcagcgcaaaagatg

SEQ ID NO: 167807 - DNA, 103 bp, Artificial Sequence
  Synthetic Polynucleotide
taatacgactcactatagggggggtacagagggggcatgccatagccgaaaacagaggagattcggcatgggcatgcccaacctggcggcagcgcaaaagatg

SEQ ID NO: 167808 - DNA, 103 bp, Artificial Sequence
  Synthetic Polynucleotide
taatacgactcactataggggccccgtctgggggtacagagggggcatgcaacagaggagagcatgcatgctctgtaccaacctggcggcagcgcaaaagatg

SEQ ID NO: 167809 - DNA, 103 bp, Artificial Sequence
  Synthetic Polynucleotide
taatacgactcactataggggatggtgggggccccgtctgggggtacagaaacagaggagatctgtaatgccagacgggaacctggcggcagcgcaaaagatg

SEQ ID NO: 167810 - DNA, 103 bp, Artificial Sequence
  Synthetic Polynucleotide
taatacgactcactatagggcggtctgtaggatggtgggggccccgtctgaacagaggagacagacgatgcccccaccaaacctggcggcagcgcaaaagatg

SEQ ID NO: 167811 - DNA, 103 bp, Artificial Sequence
  Synthetic Polynucleotide
taatacgactcactatagggtccgcaggcccggtctgtaggatggtggggaacagaggagaccccacatgcctacagacaacctggcggcagcgcaaaagatg

SEQ ID NO: 167812 - DNA, 103 bp, Artificial Sequence
  Synthetic Polynucleotide
taatacgactcactatagggtcagggaacatccgcaggcccggtctgtagaacagaggagactacagatggggcctgcgaacctggcggcagcgcaaaagatg

SEQ ID NO: 167813 - DNA, 103 bp, Artificial Sequence
  Synthetic Polynucleotide
taatacgactcactatagggacccctagtctcagggaacatccgcaggccaacagaggagaggcctgatgatgttccctaacctggcggcagcgcaaaagatg

SEQ ID NO: 167814 - DNA, 103 bp, Artificial Sequence
  Synthetic Polynucleotide
taatacgactcactatagggtgccaggtgagggggctggtcgcggcggtgaacagaggagacaccgcatggaccagcccaacctggcggcagcgcaaaagatg

SEQ ID NO: 167815 - DNA, 103 bp, Artificial Sequence
  Synthetic Polynucleotide
taatacgactcactatagggaacctgtggtacccctagtctcagggaacaaacagaggagatgttccatgagactagggaacctggcggcagcgcaaaagatg

SEQ ID NO: 167816 - DNA, 103 bp, Artificial Sequence
  Synthetic Polynucleotide
taatacgactcactatagggggttgggcacaacctgtggtacccctagtcaacagaggagagactagatgtaccacaggaacctggcggcagcgcaaaagatg

SEQ ID NO: 167817 - DNA, 103 bp, Artificial Sequence
  Synthetic Polynucleotide
taatacgactcactatagggaactgcaggtggttgggcacaacctgtggtaacagaggagaaccacaatgtgtgcccaaaacctggcggcagcgcaaaagatg

SEQ ID NO: 167818 - DNA, 103 bp, Artificial Sequence
  Synthetic Polynucleotide
taatacgactcactataggggaaggaaggaaactgcaggtggttgggcacaacagaggagagtgcccatgcacctgcagaacctggcggcagcgcaaaagatg

SEQ ID NO: 167819 - DNA, 103 bp, Artificial Sequence
  Synthetic Polynucleotide
taatacgactcactatagggaaggggcggggaaggaaggaaactgcaggtaacagaggagaacctgcatgttccttcctaacctggcggcagcgcaaaagatg

SEQ ID NO: 167820 - DNA, 103 bp, Artificial Sequence
  Synthetic Polynucleotide
taatacgactcactataggggtcactagggaaggggcggggaaggaaggaaacagaggagatccttcatgccccgccccaacctggcggcagcgcaaaagatg

SEQ ID NO: 167821 - DNA, 103 bp, Artificial Sequence
  Synthetic Polynucleotide
taatacgactcactatagggctccatacgggtcactagggaaggggcgggaacagaggagacccgccatgtccctagtgaacctggcggcagcgcaaaagatg

SEQ ID NO: 167822 - DNA, 103 bp, Artificial Sequence
  Synthetic Polynucleotide
taatacgactcactataggggagccccgccctccatacgggtcactagggaacagaggagaccctagatgcccgtatggaacctggcggcagcgcaaaagatg

SEQ ID NO: 167823 - DNA, 103 bp, Artificial Sequence
  Synthetic Polynucleotide
taatacgactcactatagggggagaaagaggagccccgccctccatacggaacagaggagaccgtatatggggcggggcaacctggcggcagcgcaaaagatg

SEQ ID NO: 167824 - DNA, 103 bp, Artificial Sequence
  Synthetic Polynucleotide
taatacgactcactataggggcagccccagggagaaagaggagccccgccaacagaggagaggcgggatgcctctttctaacctggcggcagcgcaaaagatg

SEQ ID NO: 167825 - DNA, 103 bp, Artificial Sequence
  Synthetic Polynucleotide
taatacgactcactatagggctctcccaggtgccaggtgagggggctggtaacagaggagaaccagcatgctcacctggaacctggcggcagcgcaaaagatg

SEQ ID NO: 167826 - DNA, 103 bp, Artificial Sequence
  Synthetic Polynucleotide
taatacgactcactatagggggagagaatggcagccccagggagaaagagaacagaggagactctttatgcctggggctaacctggcggcagcgcaaaagatg

SEQ ID NO: 167827 - DNA, 103 bp, Artificial Sequence
  Synthetic Polynucleotide
taatacgactcactataggggggggctggcggagagaatggcagccccagaacagaggagactggggatgccattctctaacctggcggcagcgcaaaagatg

SEQ ID NO: 167828 - DNA, 103 bp, Artificial Sequence
  Synthetic Polynucleotide
taatacgactcactataggggcggccgaaagggggctggcggagagaatgaacagaggagacattctatgcgccagcccaacctggcggcagcgcaaaagatg

SEQ ID NO: 167829 - DNA, 103 bp, Artificial Sequence
  Synthetic Polynucleotide
taatacgactcactatagggggaagaggaggcggccgaaagggggctggcaacagaggagagccagcatgctttcggccaacctggcggcagcgcaaaagatg

SEQ ID NO: 167830 - DNA, 103 bp, Artificial Sequence
  Synthetic Polynucleotide
taatacgactcactatagggtggggatgcaggaagaggaggcggccgaaaaacagaggagatttcggatgcctcctcttaacctggcggcagcgcaaaagatg

SEQ ID NO: 167831 - DNA, 103 bp, Artificial Sequence
  Synthetic Polynucleotide
taatacgactcactatagggcttcaagcggtggggatgcaggaagaggagaacagaggagactcctcatgctgcatcccaacctggcggcagcgcaaaagatg

SEQ ID NO: 167832 - DNA, 103 bp, Artificial Sequence
  Synthetic Polynucleotide
taatacgactcactataggggggaaggggccttcaagcggtggggatgcaaacagaggagatgcatcatgaccgcttgaaacctggcggcagcgcaaaagatg

SEQ ID NO: 167833 - DNA, 103 bp, Artificial Sequence
  Synthetic Polynucleotide
taatacgactcactatagggactctgggaagggaaggggccttcaagcggaacagaggagaccgcttatgggccccttcaacctggcggcagcgcaaaagatg

SEQ ID NO: 167834 - DNA, 103 bp, Artificial Sequence
  Synthetic Polynucleotide
taatacgactcactataggggatgcacatcactctgggaagggaaggggcaacagaggagagcccctatgcttcccagaaacctggcggcagcgcaaaagatg

SEQ ID NO: 167835 - DNA, 103 bp, Artificial Sequence
  Synthetic Polynucleotide
taatacgactcactataggggcaggtaggggatgcacatcactctgggaaaacagaggagattcccaatgtgatgtgcaaacctggcggcagcgcaaaagatg

SEQ ID NO: 167836 - DNA, 103 bp, Artificial Sequence
  Synthetic Polynucleotide
taatacgactcactatagggggcgggctggctctcccaggtgccaggtgaaacagaggagatcacctatgacctgggagaacctggcggcagcgcaaaagatg

SEQ ID NO: 167837 - DNA, 103 bp, Artificial Sequence
  Synthetic Polynucleotide
taatacgactcactataggggtatccctcagcaggtaggggatgcacatcaacagaggagagatgtgatgcccctacctaacctggcggcagcgcaaaagatg

SEQ ID NO: 167838 - DNA, 103 bp, Artificial Sequence
  Synthetic Polynucleotide
taatacgactcactatagggctaccttattgtatccctcagcaggtagggaacagaggagaccctacatgctgagggataacctggcggcagcgcaaaagatg

SEQ ID NO: 167839 - DNA, 103 bp, Artificial Sequence
  Synthetic Polynucleotide
taatacgactcactatagggtagcctggccctaccttattgtatccctcaaacagaggagatgagggatgcaataaggtaacctggcggcagcgcaaaagatg

SEQ ID NO: 167840 - DNA, 103 bp, Artificial Sequence
  Synthetic Polynucleotide
taatacgactcactatagggcccagggccatagcctggccctaccttattaacagaggagaaataagatggggccaggcaacctggcggcagcgcaaaagatg

SEQ ID NO: 167841 - DNA, 103 bp, Artificial Sequence
  Synthetic Polynucleotide
taatacgactcactataggggagccccctccccagggccatagcctggccaacagaggagaggccagatgatggccctgaacctggcggcagcgcaaaagatg

SEQ ID NO: 167842 - DNA, 103 bp, Artificial Sequence
  Synthetic Polynucleotide
taatacgactcactatagggtcctgctccggagccccctccccagggccaaacagaggagatggcccatgggagggggcaacctggcggcagcgcaaaagatg

SEQ ID NO: 167843 - DNA, 103 bp, Artificial Sequence
  Synthetic Polynucleotide
taatacgactcactatagggcctggatttctcctgctccggagccccctcaacagaggagagaggggatgccggagcagaacctggcggcagcgcaaaagatg

SEQ ID NO: 167844 - DNA, 103 bp, Artificial Sequence
  Synthetic Polynucleotide
taatacgactcactatagggtgtagccacccctggatttctcctgctccgaacagaggagacggagcatgagaaatccaaacctggcggcagcgcaaaagatg

SEQ ID NO: 167845 - DNA, 103 bp, Artificial Sequence
  Synthetic Polynucleotide
taatacgactcactatagggaagccgctgctgtagccacccctggatttcaacagaggagagaaatcatggggtggctaaacctggcggcagcgcaaaagatg

SEQ ID NO: 167846 - DNA, 103 bp, Artificial Sequence
  Synthetic Polynucleotide
taatacgactcactatagggactgtctcggaagccgctgctgtagccaccaacagaggagaggtggcatgagcagcggcaacctggcggcagcgcaaaagatg

SEQ ID NO: 167847 - DNA, 103 bp, Artificial Sequence
  Synthetic Polynucleotide
taatacgactcactatagggtcaccgacctggcgggctggctctcccaggaacagaggagacctgggatggccagcccgaacctggcggcagcgcaaaagatg

SEQ ID NO: 167848 - DNA, 103 bp, Artificial Sequence
  Synthetic Polynucleotide
taatacgactcactatagggggatagggacactgtctcggaagccgctgcaacagaggagagcagcgatgtccgagacaaacctggcggcagcgcaaaagatg

SEQ ID NO: 167849 - DNA, 103 bp, Artificial Sequence
  Synthetic Polynucleotide
taatacgactcactataggggtgataccctggatagggacactgtctcggaacagaggagaccgagaatgtgtccctataacctggcggcagcgcaaaagatg

SEQ ID NO: 167850 - DNA, 103 bp, Artificial Sequence
  Synthetic Polynucleotide
taatacgactcactatagggttcctccagcgtgataccctggatagggacaacagaggagagtccctatgcagggtatcaacctggcggcagcgcaaaagatg

SEQ ID NO: 167851 - DNA, 103 bp, Artificial Sequence
  Synthetic Polynucleotide
taatacgactcactatagggtctcactcacttcctccagcgtgataccctaacagaggagaagggtaatgcgctggaggaacctggcggcagcgcaaaagatg

SEQ ID NO: 167852 - DNA, 103 bp, Artificial Sequence
  Synthetic Polynucleotide
taatacgactcactatagggcggccaatgatctcactcacttcctccagcaacagaggagagctggaatgagtgagtgaaacctggcggcagcgcaaaagatg

SEQ ID NO: 167853 - DNA, 103 bp, Artificial Sequence
  Synthetic Polynucleotide
taatacgactcactatagggactcaggtctcggccaatgatctcactcacaacagaggagagtgagtatgatcattggcaacctggcggcagcgcaaaagatg

SEQ ID NO: 167854 - DNA, 103 bp, Artificial Sequence
  Synthetic Polynucleotide
taatacgactcactatagggcagggaagccactcaggtctcggccaatgaaacagaggagatcattgatggagacctgaaacctggcggcagcgcaaaagatg

SEQ ID NO: 167855 - DNA, 103 bp, Artificial Sequence
  Synthetic Polynucleotide
taatacgactcactatagggccaggaggtgcagggaagccactcaggtctaacagaggagaagacctatgtggcttcccaacctggcggcagcgcaaaagatg

SEQ ID NO: 167856 - DNA, 103 bp, Artificial Sequence
  Synthetic Polynucleotide
taatacgactcactatagggaggctcttctccaggaggtgcagggaagccaacagaggagaggcttcatggcacctcctaacctggcggcagcgcaaaagatg

SEQ ID NO: 167857 - DNA, 103 bp, Artificial Sequence
  Synthetic Polynucleotide
taatacgactcactatagggcctcccagcctcaccgacctggcgggctggaacagaggagaccagccatgcaggtcggtaacctggcggcagcgcaaaagatg

SEQ ID NO: 167858 - DNA, 103 bp, Artificial Sequence
  Synthetic Polynucleotide
taatacgactcactatagggccctcctggtcctcccagcctcaccgacctaacagaggagaaggtcgatgaggctgggaaacctggcggcagcgcaaaagatg

SEQ ID NO: 167859 - DNA, 103 bp, Artificial Sequence
  Synthetic Polynucleotide
taatacgactcactatagggccccagcaccccctcctggtcctcccagccaacagaggagaggctggatggaccaggagaacctggcggcagcgcaaaagatg

SEQ ID NO: 167860 - DNA, 103 bp, Artificial Sequence
  Synthetic Polynucleotide
taatacgactcactatagggaacaccagcttaaattccagctcctcatccaacagaggagaggatgaatggctggaattaacctggcggcagcgcaaaagatg

SEQ ID NO: 167861 - DNA, 103 bp, Artificial Sequence
  Synthetic Polynucleotide
taatacgactcactatagggcccccagcacccccagcaccccctcctggtaacagaggagaaccaggatggggtgctggaacctggcggcagcgcaaaagatg

SEQ ID NO: 167862 - DNA, 103 bp, Artificial Sequence
  Synthetic Polynucleotide
taatacgactcactatagggaacacggccacccccagcacccccagcaccaacagaggagaggtgctatgggtgctgggaacctggcggcagcgcaaaagatg

SEQ ID NO: 167863 - DNA, 103 bp, Artificial Sequence
  Synthetic Polynucleotide
taatacgactcactataggggacactcgagaacacggccacccccagcacaacagaggagagtgctgatggtggccgtgaacctggcggcagcgcaaaagatg

SEQ ID NO: 167864 - DNA, 103 bp, Artificial Sequence
  Synthetic Polynucleotide
taatacgactcactatagggcggatgctgggacactcgagaacacggccaaacagaggagatggccgatgtctcgagtgaacctggcggcagcgcaaaagatg

SEQ ID NO: 167865 - DNA, 103 bp, Artificial Sequence
  Synthetic Polynucleotide
taatacgactcactatagggggaggtgatgcggatgctgggacactcgagaacagaggagactcgagatgcccagcatcaacctggcggcagcgcaaaagatg

SEQ ID NO: 167866 - DNA, 103 bp, Artificial Sequence
  Synthetic Polynucleotide
taatacgactcactatagggtgggagagatggaggtgatgcggatgctggaacagaggagaccagcaatggcatcacctaacctggcggcagcgcaaaagatg

SEQ ID NO: 167867 - DNA, 103 bp, Artificial Sequence
  Synthetic Polynucleotide
taatacgactcactatagggggctccggcgtgggagagatggaggtgatgaacagaggagacatcacatgcatctctccaacctggcggcagcgcaaaagatg

SEQ ID NO: 167868 - DNA, 103 bp, Artificial Sequence
  Synthetic Polynucleotide
taatacgactcactatagggcgctgctggcggctccggcgtgggagagataacagaggagaatctctatgacgccggagaacctggcggcagcgcaaaagatg

SEQ ID NO: 167869 - DNA, 103 bp, Artificial Sequence
  Synthetic Polynucleotide
taatacgactcactatagggtgtcctccagcgctgctggcggctccggcgaacagaggagacgccggatgcgccagcagaacctggcggcagcgcaaaagatg

SEQ ID NO: 167870 - DNA, 103 bp, Artificial Sequence
  Synthetic Polynucleotide
taatacgactcactataggggcatcagggttgtcctccagcgctgctggcaacagaggagagccagcatggctggaggaaacctggcggcagcgcaaaagatg

SEQ ID NO: 167871 - DNA, 103 bp, Artificial Sequence
  Synthetic Polynucleotide
taatacgactcactatagggttcctccccgaacaccagcttaaattccagaacagaggagactggaaatgaagctggtgaacctggcggcagcgcaaaagatg

SEQ ID NO: 167872 - DNA, 103 bp, Artificial Sequence
  Synthetic Polynucleotide
taatacgactcactataggggtccccccaggcatcagggttgtcctccagaacagaggagactggagatgaaccctgataacctggcggcagcgcaaaagatg

SEQ ID NO: 167873 - DNA, 103 bp, Artificial Sequence
  Synthetic Polynucleotide
taatacgactcactatagggtaggagagccgtccccccaggcatcagggtaacagaggagaaccctgatgcctggggggaacctggcggcagcgcaaaagatg

SEQ ID NO: 167874 - DNA, 103 bp, Artificial Sequence
  Synthetic Polynucleotide
taatacgactcactataggggggtaatctctaggagagccgtccccccagaacagaggagactggggatgcggctctccaacctggcggcagcgcaaaagatg

SEQ ID NO: 167875 - DNA, 103 bp, Artificial Sequence
  Synthetic Polynucleotide
taatacgactcactatagggttctggtggggggtaatctctaggagagccaacagaggagaggctctatgagagattacaacctggcggcagcgcaaaagatg

SEQ ID NO: 167876 - DNA, 103 bp, Artificial Sequence
  Synthetic Polynucleotide
taatacgactcactatagggccccaaagccttctggtggggggtaatctcaacagaggagagagattatgccccaccagaacctggcggcagcgcaaaagatg

SEQ ID NO: 167877 - DNA, 103 bp, Artificial Sequence
  Synthetic Polynucleotide
taatacgactcactatagggtctctgtagcccccaaagccttctggtgggaacagaggagacccaccatgaggctttggaacctggcggcagcgcaaaagatg

SEQ ID NO: 167878 - DNA, 103 bp, Artificial Sequence
  Synthetic Polynucleotide
taatacgactcactataggggccccctgcttctctgtagcccccaaagccaacagaggagaggctttatgggctacagaaacctggcggcagcgcaaaagatg

SEQ ID NO: 167879 - DNA, 103 bp, Artificial Sequence
  Synthetic Polynucleotide
taatacgactcactatagggccccaccctggccccctgcttctctgtagcaacagaggagagctacaatgaagcaggggaacctggcggcagcgcaaaagatg

SEQ ID NO: 167880 - DNA, 103 bp, Artificial Sequence
  Synthetic Polynucleotide
taatacgactcactatagggaagaaggcccccccaccctggccccctgctaacagaggagaagcaggatgccagggtggaacctggcggcagcgcaaaagatg

SEQ ID NO: 167881 - DNA, 103 bp, Artificial Sequence
  Synthetic Polynucleotide
taatacgactcactataggggcttgggctgaagaaggcccccccaccctgaacagaggagacagggtatgggggccttcaacctggcggcagcgcaaaagatg

SEQ ID NO: 167882 - DNA, 103 bp, Artificial Sequence
  Synthetic Polynucleotide
taatacgactcactataggggggcctccttttcctccccgaacaccagctaacagaggagaagctggatgtcggggaggaacctggcggcagcgcaaaagatg

SEQ ID NO: 167883 - DNA, 103 bp, Artificial Sequence
  Synthetic Polynucleotide
taatacgactcactatagggtgctgccagggcttgggctgaagaaggcccaacagaggagagggcctatgtcagcccaaaacctggcggcagcgcaaaagatg

SEQ ID NO: 167884 - DNA, 103 bp, Artificial Sequence
  Synthetic Polynucleotide
taatacgactcactataggggacaggctgctgctgccagggcttgggctgaacagaggagacagcccatgccctggcagaacctggcggcagcgcaaaagatg

SEQ ID NO: 167885 - DNA, 103 bp, Artificial Sequence
  Synthetic Polynucleotide
taatacgactcactataggggctccacgaggacaggctgctgctgccaggaacagaggagacctggcatgagcagcctgaacctggcggcagcgcaaaagatg

SEQ ID NO: 167886 - DNA, 103 bp, Artificial Sequence
  Synthetic Polynucleotide
taatacgactcactatagggcggagaagaagctccacgaggacaggctgcaacagaggagagcagccatgcctcgtggaaacctggcggcagcgcaaaagatg

SEQ ID NO: 167887 - DNA, 103 bp, Artificial Sequence
  Synthetic Polynucleotide
taatacgactcactatagggtcagaggcatcggagaagaagctccacgagaacagaggagactcgtgatgcttcttctcaacctggcggcagcgcaaaagatg

SEQ ID NO: 167888 - DNA, 103 bp, Artificial Sequence
  Synthetic Polynucleotide
taatacgactcactatagggggctgcctcgtcagaggcatcggagaagaaaacagaggagattcttcatggatgcctctaacctggcggcagcgcaaaagatg

SEQ ID NO: 167889 - DNA, 103 bp, Artificial Sequence
  Synthetic Polynucleotide
taatacgactcactatagggctgcatacagggctgcctcgtcagaggcataacagaggagaatgcctatgacgaggcagaacctggcggcagcgcaaaagatg

SEQ ID NO: 167890 - DNA, 103 bp, Artificial Sequence
  Synthetic Polynucleotide
taatacgactcactatagggtcgtcgcaggctgcatacagggctgcctcgaacagaggagacgaggcatgcctgtatgcaacctggcggcagcgcaaaagatg

SEQ ID NO: 167891 - DNA, 103 bp, Artificial Sequence
  Synthetic Polynucleotide
taatacgactcactatagggagactccacctcgtcgcaggctgcatacagaacagaggagactgtatatggcctgcgacaacctggcggcagcgcaaaagatg

SEQ ID NO: 167892 - DNA, 103 bp, Artificial Sequence
  Synthetic Polynucleotide
taatacgactcactatagggcatttagctcagactccacctcgtcgcaggaacagaggagacctgcgatgaggtggagtaacctggcggcagcgcaaaagatg

SEQ ID NO: 167893 - DNA, 103 bp, Artificial Sequence
  Synthetic Polynucleotide
taatacgactcactatagggcccagcgggggggcctccttttcctccccgaacagaggagacggggaatgaaaggaggcaacctggcggcagcgcaaaagatg

SEQ ID NO: 167894 - DNA, 103 bp, Artificial Sequence
  Synthetic Polynucleotide
taatacgactcactataggggaggccgcctcatttagctcagactccaccaacagaggagaggtggaatgtgagctaaaaacctggcggcagcgcaaaagatg

SEQ ID NO: 167895 - DNA, 103 bp, Artificial Sequence
  Synthetic Polynucleotide
taatacgactcactataggggccaaagcgggaggccgcctcatttagctcaacagaggagagagctaatggaggcggccaacctggcggcagcgcaaaagatg

SEQ ID NO: 167896 - DNA, 103 bp, Artificial Sequence
  Synthetic Polynucleotide
taatacgactcactataggggggagcccaggccaaagcgggaggccgcctaacagaggagaaggcggatgcccgctttgaacctggcggcagcgcaaaagatg

SEQ ID NO: 167897 - DNA, 103 bp, Artificial Sequence
  Synthetic Polynucleotide
taatacgactcactataggggagggcagcggggagcccaggccaaagcggaacagaggagaccgcttatgcctgggctcaacctggcggcagcgcaaaagatg

SEQ ID NO: 167898 - DNA, 103 bp, Artificial Sequence
  Synthetic Polynucleotide
taatacgactcactatagggggcccggggcgagggcagcggggagcccagaacagaggagactgggcatgccgctgcccaacctggcggcagcgcaaaagatg

SEQ ID NO: 167899 - DNA, 103 bp, Artificial Sequence
  Synthetic Polynucleotide
taatacgactcactataggggccgaggggaggcccggggcgagggcagcgaacagaggagacgctgcatgcgccccgggaacctggcggcagcgcaaaagatg

SEQ ID NO: 167900 - DNA, 103 bp, Artificial Sequence
  Synthetic Polynucleotide
taatacgactcactatagggggggtccatggccgaggggaggcccggggcaacagaggagagccccgatgctcccctcgaacctggcggcagcgcaaaagatg

SEQ ID NO: 167901 - DNA, 103 bp, Artificial Sequence
  Synthetic Polynucleotide
taatacgactcactataggggggatcttcgggggtccatggccgaggggaaacagaggagatcccctatgccatggaccaacctggcggcagcgcaaaagatg

SEQ ID NO: 167902 - DNA, 103 bp, Artificial Sequence
  Synthetic Polynucleotide
taatacgactcactatagggacaggctccagggatcttcgggggtccatgaacagaggagacatggaatgccgaagatcaacctggcggcagcgcaaaagatg

SEQ ID NO: 167903 - DNA, 103 bp, Artificial Sequence
  Synthetic Polynucleotide
taatacgactcactatagggcttggaccatacaggctccagggatcttcgaacagaggagacgaagaatgctggagcctaacctggcggcagcgcaaaagatg

SEQ ID NO: 167904 - DNA, 103 bp, Artificial Sequence
  Synthetic Polynucleotide
taatacgactcactatagggtccccccgcgcccagcgggggggcctccttaacagaggagaaaggagatgcccccgctgaacctggcggcagcgcaaaagatg

SEQ ID NO: 167905 - DNA, 103 bp, Artificial Sequence
  Synthetic Polynucleotide
taatacgactcactataggggcctccggggcttggaccatacaggctccaaacagaggagatggagcatgtatggtccaaacctggcggcagcgcaaaagatg

SEQ ID NO: 167906 - DNA, 103 bp, Artificial Sequence
  Synthetic Polynucleotide
taatacgactcactatagggctggccctcggcctccggggcttggaccataacagaggagaatggtcatggccccggagaacctggcggcagcgcaaaagatg

SEQ ID NO: 167907 - DNA, 103 bp, Artificial Sequence
  Synthetic Polynucleotide
taatacgactcactatagggcagctatcctctggccctcggcctccggggaacagaggagaccccggatgccgagggccaacctggcggcagcgcaaaagatg

SEQ ID NO: 167908 - DNA, 103 bp, Artificial Sequence
  Synthetic Polynucleotide
taatacgactcactataggggaggagtagccagctatcctctggccctcgaacagaggagacgagggatggaggatagcaacctggcggcagcgcaaaagatg

SEQ ID NO: 167909 - DNA, 103 bp, Artificial Sequence
  Synthetic Polynucleotide
taatacgactcactatagggcaggagcactgaggagtagccagctatcctaacagaggagaaggataatgggctactccaacctggcggcagcgcaaaagatg

SEQ ID NO: 167910 - DNA, 103 bp, Artificial Sequence
  Synthetic Polynucleotide
taatacgactcactatagggggggtgggcccaggagcactgaggagtagcaacagaggagagctactatgcagtgctccaacctggcggcagcgcaaaagatg

SEQ ID NO: 167911 - DNA, 103 bp, Artificial Sequence
  Synthetic Polynucleotide
taatacgactcactatagggcggggaggctggggtgggcccaggagcactaacagaggagaagtgctatggggcccaccaacctggcggcagcgcaaaagatg

SEQ ID NO: 167912 - DNA, 103 bp, Artificial Sequence
  Synthetic Polynucleotide
taatacgactcactatagggaggcaggccgcggggaggctggggtgggccaacagaggagaggcccaatgcagcctcccaacctggcggcagcgcaaaagatg

SEQ ID NO: 167913 - DNA, 103 bp, Artificial Sequence
  Synthetic Polynucleotide
taatacgactcactatagggccacatggagaggcaggccgcggggaggctaacagaggagaagcctcatggcggcctgcaacctggcggcagcgcaaaagatg

SEQ ID NO: 167914 - DNA, 103 bp, Artificial Sequence
  Synthetic Polynucleotide
taatacgactcactataggggcgccgcttgccacatggagaggcaggccgaacagaggagacggcctatgtctccatgtaacctggcggcagcgcaaaagatg

SEQ ID NO: 167915 - DNA, 103 bp, Artificial Sequence
  Synthetic Polynucleotide
taatacgactcactatagggcttcccccaatccccccgcgcccagcggggaacagaggagaccccgcatggcgcgggggaacctggcggcagcgcaaaagatg

SEQ ID NO: 167916 - DNA, 103 bp, Artificial Sequence
  Synthetic Polynucleotide
taatacgactcactatagggagctggaatagcgccgcttgccacatggagaacagaggagactccatatggcaagcggcaacctggcggcagcgcaaaagatg

SEQ ID NO: 167917 - DNA, 103 bp, Artificial Sequence
  Synthetic Polynucleotide
taatacgactcactatagggggggttcccgagctggaatagcgccgcttgaacagaggagacaagcgatgctattccagaacctggcggcagcgcaaaagatg

SEQ ID NO: 167918 - DNA, 103 bp, Artificial Sequence
  Synthetic Polynucleotide
taatacgactcactatagggggctgaagatggggttcccgagctggaataaacagaggagatattccatgtcgggaaccaacctggcggcagcgcaaaagatg

SEQ ID NO: 167919 - DNA, 103 bp, Artificial Sequence
  Synthetic Polynucleotide
taatacgactcactataggggagctggggaggctgaagatggggttcccgaacagaggagacgggaaatgcatcttcagaacctggcggcagcgcaaaagatg

SEQ ID NO: 167920 - DNA, 103 bp, Artificial Sequence
  Synthetic Polynucleotide
taatacgactcactatagggcggcgggacagagctggggaggctgaagataacagaggagaatcttcatgctccccagcaacctggcggcagcgcaaaagatg

SEQ ID NO: 167921 - DNA, 103 bp, Artificial Sequence
  Synthetic Polynucleotide
taatacgactcactatagggcaggctgccacggcgggacagagctggggaaacagaggagatccccaatgctgtcccgcaacctggcggcagcgcaaaagatg

SEQ ID NO: 167922 - DNA, 103 bp, Artificial Sequence
  Synthetic Polynucleotide
taatacgactcactatagggcctcttcccccaggctgccacggcgggacaaacagaggagatgtcccatggtggcagccaacctggcggcagcgcaaaagatg

SEQ ID NO: 167923 - DNA, 103 bp, Artificial Sequence
  Synthetic Polynucleotide
taatacgactcactatagggggctcagacccctcttcccccaggctgccaaacagaggagatggcagatggggggaagaaacctggcggcagcgcaaaagatg

SEQ ID NO: 167924 - DNA, 103 bp, Artificial Sequence
  Synthetic Polynucleotide
taatacgactcactatagggtggtggaggtggctcagacccctcttccccaacagaggagaggggaaatggggtctgagaacctggcggcagcgcaaaagatg

SEQ ID NO: 167925 - DNA, 103 bp, Artificial Sequence
  Synthetic Polynucleotide
taatacgactcactataggggcaatgggggtggtggaggtggctcagaccaacagaggagaggtctgatgcacctccacaacctggcggcagcgcaaaagatg

SEQ ID NO: 167926 - DNA, 103 bp, Artificial Sequence
  Synthetic Polynucleotide
taatacgactcactataggggagtccagttcttcccccaatccccccgcgaacagaggagacgcgggatgattgggggaaacctggcggcagcgcaaaagatg

SEQ ID NO: 167927 - DNA, 103 bp, Artificial Sequence
  Synthetic Polynucleotide
taatacgactcactatagggcgggccagaggcaatgggggtggtggaggtaacagaggagaacctccatgacccccattaacctggcggcagcgcaaaagatg

SEQ ID NO: 167928 - DNA, 103 bp, Artificial Sequence
  Synthetic Polynucleotide
taatacgactcactataggggcccgggtcccgggccagaggcaatgggggaacagaggagacccccaatgcctctggccaacctggcggcagcgcaaaagatg

SEQ ID NO: 167929 - DNA, 103 bp, Artificial Sequence
  Synthetic Polynucleotide
taatacgactcactataggggaccaggggagcccgggtcccgggccagagaacagaggagactctggatggggacccggaacctggcggcagcgcaaaagatg

SEQ ID NO: 167930 - DNA, 103 bp, Artificial Sequence
  Synthetic Polynucleotide
taatacgactcactatagggtagtcaaagggaccaggggagcccgggtccaacagaggagaggacccatgctcccctggaacctggcggcagcgcaaaagatg

SEQ ID NO: 167931 - DNA, 103 bp, Artificial Sequence
  Synthetic Polynucleotide
taatacgactcactatagggggcccccacatagtcaaagggaccaggggaaacagaggagatcccctatgccctttgacaacctggcggcagcgcaaaagatg

SEQ ID NO: 167932 - DNA, 103 bp, Artificial Sequence
  Synthetic Polynucleotide
taatacgactcactatagggcagctggtggggcccccacatagtcaaaggaacagaggagacctttgatgatgtgggggaacctggcggcagcgcaaaagatg

SEQ ID NO: 167933 - DNA, 103 bp, Artificial Sequence
  Synthetic Polynucleotide
taatacgactcactataggggggatgctctcagctggtggggcccccacaaacagaggagatgtgggatgcccaccagcaacctggcggcagcgcaaaagatg

SEQ ID NO: 167934 - DNA, 103 bp, Artificial Sequence
  Synthetic Polynucleotide
taatacgactcactatagggtgtcttctgagggatgctctcagctggtggaacagaggagaccaccaatggagagcatcaacctggcggcagcgcaaaagatg

SEQ ID NO: 167935 - DNA, 103 bp, Artificial Sequence
  Synthetic Polynucleotide
taatacgactcactatagggaagtccgccgtgtcttctgagggatgctctaacagaggagaagagcaatgctcagaagaaacctggcggcagcgcaaaagatg

SEQ ID NO: 167936 - DNA, 103 bp, Artificial Sequence
  Synthetic Polynucleotide
taatacgactcactatagggtgctcgctggaagtccgccgtgtcttctgaaacagaggagatcagaaatgacggcggacaacctggcggcagcgcaaaagatg

SEQ ID NO: 167937 - DNA, 103 bp, Artificial Sequence
  Synthetic Polynucleotide
taatacgactcactatagggcctgctctgctggggaggacacggggacataacagaggagaatgtccatgtgtcctcccaacctggcggcagcgcaaaagatg

SEQ ID NO: 167938 - DNA, 103 bp, Artificial Sequence
  Synthetic Polynucleotide
taatacgactcactatagggcagaccctgcagctcggtgatggacatgataacagaggagaatcatgatgatcaccgagaacctggcggcagcgcaaaagatg

SEQ ID NO: 167939 - DNA, 103 bp, Artificial Sequence
  Synthetic Polynucleotide
taatacgactcactatagggttcatcccgaaggtgctggaaaatgtcacgaacagaggagacgtgacatgttccagcacaacctggcggcagcgcaaaagatg

SEQ ID NO: 167940 - DNA, 103 bp, Artificial Sequence
  Synthetic Polynucleotide
taatacgactcactatagggtgttgcctgattcatcccgaaggtgctggaaacagaggagatccagcatgttcgggatgaacctggcggcagcgcaaaagatg

SEQ ID NO: 167941 - DNA, 103 bp, Artificial Sequence
  Synthetic Polynucleotide
taatacgactcactatagggggagagtagctgttgcctgattcatcccgaaacagaggagatcgggaatgatcaggcaaaacctggcggcagcgcaaaagatg

SEQ ID NO: 167942 - DNA, 103 bp, Artificial Sequence
  Synthetic Polynucleotide
taatacgactcactataggggtactcttcaggagagtagctgttgcctgaaacagaggagatcaggcatgagctactctaacctggcggcagcgcaaaagatg

SEQ ID NO: 167943 - DNA, 103 bp, Artificial Sequence
  Synthetic Polynucleotide
taatacgactcactataggggttgcagcgcgtactcttcaggagagtagcaacagaggagagctactatgctgaagagtaacctggcggcagcgcaaaagatg

SEQ ID NO: 167944 - DNA, 103 bp, Artificial Sequence
  Synthetic Polynucleotide
taatacgactcactatagggtcggcagcctgttgcagcgcgtactcttcaaacagaggagatgaagaatgcgcgctgcaaacctggcggcagcgcaaaagatg

SEQ ID NO: 167945 - DNA, 103 bp, Artificial Sequence
  Synthetic Polynucleotide
taatacgactcactataggggatggtcccatcggcagcctgttgcagcgcaacagaggagagcgctgatgcaggctgccaacctggcggcagcgcaaaagatg

SEQ ID NO: 167946 - DNA, 103 bp, Artificial Sequence
  Synthetic Polynucleotide
taatacgactcactataggggcacaaggaagatggtcccatcggcagcctaacagaggagaaggctgatgatgggaccaaacctggcggcagcgcaaaagatg

SEQ ID NO: 167947 - DNA, 103 bp, Artificial Sequence
  Synthetic Polynucleotide
taatacgactcactataggggtcccccggggcacaaggaagatggtcccaaacagaggagatgggacatgcttccttgtaacctggcggcagcgcaaaagatg

SEQ ID NO: 167948 - DNA, 103 bp, Artificial Sequence
  Synthetic Polynucleotide
taatacgactcactatagggctccatcttggtcccccggggcacaaggaaaacagaggagattccttatgccccgggggaacctggcggcagcgcaaaagatg

SEQ ID NO: 167949 - DNA, 103 bp, Artificial Sequence
  Synthetic Polynucleotide
taatacgactcactatagggttggagcattcagaccctgcagctcggtgaaacagaggagatcaccgatgtgcagggtcaacctggcggcagcgcaaaagatg

SEQ ID NO: 167950 - DNA, 103 bp, Artificial Sequence
  Synthetic Polynucleotide
taatacgactcactatagggagtctgtggcctccatcttggtcccccgggaacagaggagacccgggatgccaagatggaacctggcggcagcgcaaaagatg

SEQ ID NO: 167951 - DNA, 103 bp, Artificial Sequence
  Synthetic Polynucleotide
taatacgactcactataggggatggctcacttggagcattcagaccctgcaacagaggagagcagggatggaatgctccaacctggcggcagcgcaaaagatg

SEQ ID NO: 167952 - DNA, 103 bp, Artificial Sequence
  Synthetic Polynucleotide
taatacgactcactataggggggctcaaatgatggctcacttggagcattaacagaggagaaatgctatgagtgagccaaacctggcggcagcgcaaaagatg

SEQ ID NO: 167953 - DNA, 103 bp, Artificial Sequence
  Synthetic Polynucleotide
taatacgactcactatagggctggggcttggggctcaaatgatggctcacaacagaggagagtgagcatgcatttgagcaacctggcggcagcgcaaaagatg

SEQ ID NO: 167954 - DNA, 103 bp, Artificial Sequence
  Synthetic Polynucleotide
taatacgactcactatagggaggtatggagctggggcttggggctcaaataacagaggagaatttgaatgccaagccccaacctggcggcagcgcaaaagatg

SEQ ID NO: 167955 - DNA, 103 bp, Artificial Sequence
  Synthetic Polynucleotide
taatacgactcactatagggtggaggtccaaggtatggagctggggcttgaacagaggagacaagccatggctccatacaacctggcggcagcgcaaaagatg

SEQ ID NO: 167956 - DNA, 103 bp, Artificial Sequence
  Synthetic Polynucleotide
taatacgactcactatagggttgtgggtggtggaggtccaaggtatggagaacagaggagactccatatgttggacctcaacctggcggcagcgcaaaagatg

SEQ ID NO: 167957 - DNA, 103 bp, Artificial Sequence
  Synthetic Polynucleotide
taatacgactcactataggggggcagtaagttgtgggtggtggaggtccaaacagaggagatggaccatgaccacccacaacctggcggcagcgcaaaagatg

SEQ ID NO: 167958 - DNA, 103 bp, Artificial Sequence
  Synthetic Polynucleotide
taatacgactcactataggggattgagcaggggcagtaagttgtgggtggaacagaggagaccacccatgacttactgcaacctggcggcagcgcaaaagatg

SEQ ID NO: 167959 - DNA, 103 bp, Artificial Sequence
  Synthetic Polynucleotide
taatacgactcactatagggtcaccctgttcctgctctgctggggaggacaacagaggagagtcctcatgagcagagcaaacctggcggcagcgcaaaagatg

SEQ ID NO: 167960 - DNA, 103 bp, Artificial Sequence
  Synthetic Polynucleotide
taatacgactcactatagggaatctgggtggattgagcaggggcagtaagaacagaggagacttactatgcctgctcaaaacctggcggcagcgcaaaagatg

SEQ ID NO: 167961 - DNA, 103 bp, Artificial Sequence
  Synthetic Polynucleotide
taatacgactcactataggggggaagccagaatctgggtggattgagcagaacagaggagactgctcatgccacccagaaacctggcggcagcgcaaaagatg

SEQ ID NO: 167962 - DNA, 103 bp, Artificial Sequence
  Synthetic Polynucleotide
taatacgactcactatagggtggaggaagtgggaagccagaatctgggtgaacagaggagacacccaatgtctggcttcaacctggcggcagcgcaaaagatg

SEQ ID NO: 167963 - DNA, 103 bp, Artificial Sequence
  Synthetic Polynucleotide
taatacgactcactatagggcataaggtggtggaggaagtgggaagccagaacagaggagactggctatgcacttcctcaacctggcggcagcgcaaaagatg

SEQ ID NO: 167964 - DNA, 103 bp, Artificial Sequence
  Synthetic Polynucleotide
taatacgactcactataggggctgggagctcataaggtggtggaggaagtaacagaggagaacttccatgaccaccttaaacctggcggcagcgcaaaagatg

SEQ ID NO: 167965 - DNA, 103 bp, Artificial Sequence
  Synthetic Polynucleotide
taatacgactcactatagggggatgtggatgctgggagctcataaggtggaacagaggagaccacctatggagctcccaaacctggcggcagcgcaaaagatg

SEQ ID NO: 167966 - DNA, 103 bp, Artificial Sequence
  Synthetic Polynucleotide
taatacgactcactatagggctgggacatgggatgtggatgctgggagctaacagaggagaagctccatgcatccacataacctggcggcagcgcaaaagatg

SEQ ID NO: 167967 - DNA, 103 bp, Artificial Sequence
  Synthetic Polynucleotide
taatacgactcactatagggtatgggggatctgggacatgggatgtggataacagaggagaatccacatgccatgtcccaacctggcggcagcgcaaaagatg

SEQ ID NO: 167968 - DNA, 103 bp, Artificial Sequence
  Synthetic Polynucleotide
taatacgactcactataggggccataggagtatgggggatctgggacatgaacagaggagacatgtcatggatcccccaaacctggcggcagcgcaaaagatg

SEQ ID NO: 167969 - DNA, 103 bp, Artificial Sequence
  Synthetic Polynucleotide
taatacgactcactatagggtggccatgttgccataggagtatgggggataacagaggagaatccccatgactcctatgaacctggcggcagcgcaaaagatg

SEQ ID NO: 167970 - DNA, 103 bp, Artificial Sequence
  Synthetic Polynucleotide
taatacgactcactataggggacagctgtatcaccctgttcctgctctgcaacagaggagagcagagatggaacagggtaacctggcggcagcgcaaaagatg

SEQ ID NO: 167971 - DNA, 103 bp, Artificial Sequence
  Synthetic Polynucleotide
taatacgactcactataggggagactggtatggccatgttgccataggagaacagaggagactcctaatgcaacatggcaacctggcggcagcgcaaaagatg

SEQ ID NO: 167972 - DNA, 103 bp, Artificial Sequence
  Synthetic Polynucleotide
taatacgactcactatagggcagtggcttggagactggtatggccatgttaacagaggagaaacatgatgataccagtcaacctggcggcagcgcaaaagatg

SEQ ID NO: 167973 - DNA, 103 bp, Artificial Sequence
  Synthetic Polynucleotide
taatacgactcactatagggctgagaggctcagtggcttggagactggtaaacagaggagataccagatgccaagccacaacctggcggcagcgcaaaagatg

SEQ ID NO: 167974 - DNA, 103 bp, Artificial Sequence
  Synthetic Polynucleotide
taatacgactcactatagggctgagcaggcctgagaggctcagtggcttgaacagaggagacaagccatggagcctctcaacctggcggcagcgcaaaagatg

SEQ ID NO: 167975 - DNA, 103 bp, Artificial Sequence
  Synthetic Polynucleotide
taatacgactcactataggggagcggctcactgagcaggcctgagaggctaacagaggagaagcctcatgggcctgctcaacctggcggcagcgcaaaagatg

SEQ ID NO: 167976 - DNA, 103 bp, Artificial Sequence
  Synthetic Polynucleotide
taatacgactcactatagggaggggtcttggagcggctcactgagcaggcaacagaggagagcctgcatggtgagccgcaacctggcggcagcgcaaaagatg

SEQ ID NO: 167977 - DNA, 103 bp, Artificial Sequence
  Synthetic Polynucleotide
taatacgactcactatagggaggagggctaaggggtcttggagcggctcaaacagaggagatgagccatgccaagacccaacctggcggcagcgcaaaagatg

SEQ ID NO: 167978 - DNA, 103 bp, Artificial Sequence
  Synthetic Polynucleotide
taatacgactcactatagggcccaatgtccaggagggctaaggggtcttgaacagaggagacaagacatgttagccctcaacctggcggcagcgcaaaagatg

SEQ ID NO: 167979 - DNA, 103 bp, Artificial Sequence
  Synthetic Polynucleotide
taatacgactcactatagggctgctggcagcccaatgtccaggagggctaaacagaggagatagcccatgtggacattgaacctggcggcagcgcaaaagatg

SEQ ID NO: 167980 - DNA, 103 bp, Artificial Sequence
  Synthetic Polynucleotide
taatacgactcactatagggttaggtggccctgctggcagcccaatgtccaacagaggagaggacatatggctgccagcaacctggcggcagcgcaaaagatg

SEQ ID NO: 167981 - DNA, 103 bp, Artificial Sequence
  Synthetic Polynucleotide
taatacgactcactatagggctctgaagtggacagctgtatcaccctgttaacagaggagaaacaggatgatacagctgaacctggcggcagcgcaaaagatg

SEQ ID NO: 167982 - DNA, 103 bp, Artificial Sequence
  Synthetic Polynucleotide
taatacgactcactatagggttcttggggcttaggtggccctgctggcagaacagaggagactgccaatggggccacctaacctggcggcagcgcaaaagatg

SEQ ID NO: 167983 - DNA, 103 bp, Artificial Sequence
  Synthetic Polynucleotide
taatacgactcactatagggattctgggtcttcttggggcttaggtggccaacagaggagaggccacatgagccccaagaacctggcggcagcgcaaaagatg

SEQ ID NO: 167984 - DNA, 103 bp, Artificial Sequence
  Synthetic Polynucleotide
taatacgactcactatagggcctgagtcggattctgggtcttcttggggcaacagaggagagccccaatgagacccagaaacctggcggcagcgcaaaagatg

SEQ ID NO: 167985 - DNA, 103 bp, Artificial Sequence
  Synthetic Polynucleotide
taatacgactcactataggggagggataatcctgagtcggattctgggtcaacagaggagagacccaatgtccgactcaaacctggcggcagcgcaaaagatg

SEQ ID NO: 167986 - DNA, 103 bp, Artificial Sequence
  Synthetic Polynucleotide
taatacgactcactatagggcgctatagttgagggataatcctgagtcggaacagaggagaccgactatggattatcccaacctggcggcagcgcaaaagatg

SEQ ID NO: 167987 - DNA, 103 bp, Artificial Sequence
  Synthetic Polynucleotide
taatacgactcactataggggattcagcatcgctatagttgagggataataacagaggagaattatcatgcaactatagaacctggcggcagcgcaaaagatg

SEQ ID NO: 167988 - DNA, 103 bp, Artificial Sequence
  Synthetic Polynucleotide
taatacgactcactatagggcagctcaagagattcagcatcgctatagttaacagaggagaaactatatggatgctgaaaacctggcggcagcgcaaaagatg

SEQ ID NO: 167989 - DNA, 103 bp, Artificial Sequence
  Synthetic Polynucleotide
taatacgactcactatagggctgtcccctccagctcaagagattcagcataacagaggagaatgctgatgctcttgagcaacctggcggcagcgcaaaagatg

SEQ ID NO: 167990 - DNA, 103 bp, Artificial Sequence
  Synthetic Polynucleotide
taatacgactcactatagggcgaccagcctctgtcccctccagctcaagaaacagaggagatcttgaatgggaggggacaacctggcggcagcgcaaaagatg

SEQ ID NO: 167991 - DNA, 103 bp, Artificial Sequence
  Synthetic Polynucleotide
taatacgactcactataggggctgcgccgccgaccagcctctgtcccctcaacagaggagagaggggatggaggctggtaacctggcggcagcgcaaaagatg

SEQ ID NO: 167992 - DNA, 103 bp, Artificial Sequence
  Synthetic Polynucleotide
taatacgactcactatagggtctctcctagctctgaagtggacagctgtaaacagaggagatacagcatgccacttcagaacctggcggcagcgcaaaagatg

SEQ ID NO: 167993 - DNA, 103 bp, Artificial Sequence
  Synthetic Polynucleotide
taatacgactcactatagggctacatattcgctgcgccgccgaccagcctaacagaggagaaggctgatgggcggcgcaaacctggcggcagcgcaaaagatg

SEQ ID NO: 167994 - DNA, 103 bp, Artificial Sequence
  Synthetic Polynucleotide
taatacgactcactataggggggtacatctctacatattcgctgcgccgcaacagaggagagcggcgatgcgaatatgtaacctggcggcagcgcaaaagatg

SEQ ID NO: 167995 - DNA, 103 bp, Artificial Sequence
  Synthetic Polynucleotide
taatacgactcactataggggtactccactgggtacatctctacatattcaacagaggagagaatatatggagatgtacaacctggcggcagcgcaaaagatg

SEQ ID NO: 167996 - DNA, 103 bp, Artificial Sequence
  Synthetic Polynucleotide
taatacgactcactataggggtgagtaggggtactccactgggtacatctaacagaggagaagatgtatgcagtggagtaacctggcggcagcgcaaaagatg

SEQ ID NO: 167997 - DNA, 103 bp, Artificial Sequence
  Synthetic Polynucleotide
taatacgactcactatagggttgggcatgagtgagtaggggtactccactaacagaggagaagtggaatgcccctactcaacctggcggcagcgcaaaagatg

SEQ ID NO: 167998 - DNA, 103 bp, Artificial Sequence
  Synthetic Polynucleotide
taatacgactcactatagggggccaaggagttgggcatgagtgagtagggaacagaggagaccctacatgctcatgcccaacctggcggcagcgcaaaagatg

SEQ ID NO: 167999 - DNA, 103 bp, Artificial Sequence
  Synthetic Polynucleotide
taatacgactcactatagggagttggagtgggccaaggagttgggcatgaaacagaggagatcatgcatgactccttggaacctggcggcagcgcaaaagatg

SEQ ID NO: 168000 - DNA, 103 bp, Artificial Sequence
  Synthetic Polynucleotide
taatacgactcactatagggggcaaggtatagttggagtgggccaaggagaacagaggagactccttatgccactccaaaacctggcggcagcgcaaaagatg

SEQ ID NO: 168001 - DNA, 103 bp, Artificial Sequence
  Synthetic Polynucleotide
taatacgactcactatagggctcagcagctggcaaggtatagttggagtgaacagaggagacactccatgtataccttgaacctggcggcagcgcaaaagatg

SEQ ID NO: 168002 - DNA, 103 bp, Artificial Sequence
  Synthetic Polynucleotide
taatacgactcactatagggccaagggggtctcagcagctggcaaggtataacagaggagaatacctatgcagctgctgaacctggcggcagcgcaaaagatg

SEQ ID NO: 168003 - DNA, 103 bp, Artificial Sequence
  Synthetic Polynucleotide
taatacgactcactataggggtcagttccatctctcctagctctgaagtgaacagaggagacacttcatggctaggagaaacctggcggcagcgcaaaagatg

SEQ ID NO: 168004 - DNA, 103 bp, Artificial Sequence
  Synthetic Polynucleotide
taatacgactcactatagggggctctaaggccaagggggtctcagcagctaacagaggagaagctgcatggacccccttaacctggcggcagcgcaaaagatg

SEQ ID NO: 168005 - DNA, 103 bp, Artificial Sequence
  Synthetic Polynucleotide
taatacgactcactataggggcctgaggagggctctaaggccaagggggtaacagaggagaacccccatggccttagagaacctggcggcagcgcaaaagatg

SEQ ID NO: 168006 - DNA, 103 bp, Artificial Sequence
  Synthetic Polynucleotide
taatacgactcactatagggcccgcacagggcctgaggagggctctaaggaacagaggagaccttagatgcctcctcagaacctggcggcagcgcaaaagatg

SEQ ID NO: 168007 - DNA, 103 bp, Artificial Sequence
  Synthetic Polynucleotide
taatacgactcactataggggtgggcttagcccgcacagggcctgaggagaacagaggagactcctcatgccctgtgcgaacctggcggcagcgcaaaagatg

SEQ ID NO: 168008 - DNA, 103 bp, Artificial Sequence
  Synthetic Polynucleotide
taatacgactcactatagggcccccgtgcagtgggcttagcccgcacaggaacagaggagacctgtgatggctaagcccaacctggcggcagcgcaaaagatg

SEQ ID NO: 168009 - DNA, 103 bp, Artificial Sequence
  Synthetic Polynucleotide
taatacgactcactatagggtccctgcctccccccgtgcagtgggcttagaacagaggagactaagcatgctgcacgggaacctggcggcagcgcaaaagatg

SEQ ID NO: 168010 - DNA, 103 bp, Artificial Sequence
  Synthetic Polynucleotide
taatacgactcactatagggtcatcccgactccctgcctccccccgtgcaaacagaggagatgcacgatgggaggcaggaacctggcggcagcgcaaaagatg

SEQ ID NO: 168011 - DNA, 103 bp, Artificial Sequence
  Synthetic Polynucleotide
taatacgactcactatagggggcccgacgttcatcccgactccctgcctcaacagaggagagaggcaatgagtcgggataacctggcggcagcgcaaaagatg

SEQ ID NO: 168012 - DNA, 103 bp, Artificial Sequence
  Synthetic Polynucleotide
taatacgactcactatagggtcatggccaaggcccgacgttcatcccgacaacagaggagagtcgggatgaacgtcgggaacctggcggcagcgcaaaagatg

SEQ ID NO: 168013 - DNA, 103 bp, Artificial Sequence
  Synthetic Polynucleotide
taatacgactcactatagggaaaggaatcttcatggccaaggcccgacgtaacagaggagaacgtcgatgcttggccataacctggcggcagcgcaaaagatg

SEQ ID NO: 168014 - DNA, 103 bp, Artificial Sequence
  Synthetic Polynucleotide
taatacgactcactatagggctcctgccaagtcagttccatctctcctagaacagaggagactaggaatgatggaactgaacctggcggcagcgcaaaagatg

SEQ ID NO: 168015 - DNA, 103 bp, Artificial Sequence
  Synthetic Polynucleotide
taatacgactcactataggggtccgtaggaaaaggaatcttcatggccaaaacagaggagattggccatgaagattcctaacctggcggcagcgcaaaagatg

SEQ ID NO: 168016 - DNA, 103 bp, Artificial Sequence
  Synthetic Polynucleotide
taatacgactcactatagggtgacaatcttgtccgtaggaaaaggaatctaacagaggagaagattcatgttcctacggaacctggcggcagcgcaaaagatg

SEQ ID NO: 168017 - DNA, 103 bp, Artificial Sequence
  Synthetic Polynucleotide
taatacgactcactatagggaccggcaagttgacaatcttgtccgtaggaaacagaggagatcctacatgcaagattgtaacctggcggcagcgcaaaagatg

SEQ ID NO: 168018 - DNA, 103 bp, Artificial Sequence
  Synthetic Polynucleotide
taatacgactcactatagggaaagtcatctaccggcaagttgacaatcttaacagaggagaaagattatgaacttgccgaacctggcggcagcgcaaaagatg

SEQ ID NO: 168019 - DNA, 103 bp, Artificial Sequence
  Synthetic Polynucleotide
taatacgactcactatagggatagctcattaaagtcatctaccggcaagtaacagaggagaacttgcatgtagatgactaacctggcggcagcgcaaaagatg

SEQ ID NO: 168020 - DNA, 103 bp, Artificial Sequence
  Synthetic Polynucleotide
taatacgactcactatagggtaccttgccaatagctcattaaagtcatctaacagaggagaagatgaatgtaatgagctaacctggcggcagcgcaaaagatg

SEQ ID NO: 168021 - DNA, 103 bp, Artificial Sequence
  Synthetic Polynucleotide
taatacgactcactatagggtgtcagcgggtaccttgccaatagctcattaacagaggagaaatgagatgttggcaaggaacctggcggcagcgcaaaagatg

SEQ ID NO: 168022 - DNA, 103 bp, Artificial Sequence
  Synthetic Polynucleotide
taatacgactcactataggggctggctctctgtcagcgggtaccttgccaaacagaggagatggcaaatgacccgctgaaacctggcggcagcgcaaaagatg

SEQ ID NO: 168023 - DNA, 103 bp, Artificial Sequence
  Synthetic Polynucleotide
taatacgactcactatagggactagcgctagctggctctctgtcagcgggaacagaggagacccgctatgagagagccaaacctggcggcagcgcaaaagatg

SEQ ID NO: 168024 - DNA, 103 bp, Artificial Sequence
  Synthetic Polynucleotide
taatacgactcactataggggatgtcccggactagcgctagctggctctcaacagaggagagagagcatgctagcgctaaacctggcggcagcgcaaaagatg

SEQ ID NO: 168025 - DNA, 103 bp, Artificial Sequence
  Synthetic Polynucleotide
taatacgactcactatagggtggacatgatctcctgccaagtcagttccaaacagaggagatggaacatgcttggcaggaacctggcggcagcgcaaaagatg

SEQ ID NO: 168026 - DNA, 103 bp, Artificial Sequence
  Synthetic Polynucleotide
taatacgactcactatagggcccgtcgtcggatgtcccggactagcgctaaacagaggagatagcgcatgtccgggacaaacctggcggcagcgcaaaagatg

SEQ ID NO: 168027 - DNA, 103 bp, Artificial Sequence
  Synthetic Polynucleotide
taatacgactcactatagggttgtttttgccccgtcgtcggatgtcccggaacagaggagaccgggaatgccgacgacgaacctggcggcagcgcaaaagatg

SEQ ID NO: 168028 - DNA, 103 bp, Artificial Sequence
  Synthetic Polynucleotide
taatacgactcactatagggggctgccaccttgtttttgccccgtcgtcgaacagaggagacgacgaatgggcaaaaacaacctggcggcagcgcaaaagatg

SEQ ID NO: 168029 - DNA, 103 bp, Artificial Sequence
  Synthetic Polynucleotide
taatacgactcactatagggggcagttctgggctgccaccttgtttttgcaacagaggagagcaaaaatgaggtggcagaacctggcggcagcgcaaaagatg

SEQ ID NO: 168030 - DNA, 103 bp, Artificial Sequence
  Synthetic Polynucleotide
taatacgactcactatagggttcctcttgcggcagttctgggctgccaccaacagaggagaggtggcatgccagaactgaacctggcggcagcgcaaaagatg

SEQ ID NO: 168031 - DNA, 103 bp, Artificial Sequence
  Synthetic Polynucleotide
taatacgactcactatagggggtttccagcttcctcttgcggcagttctgaacagaggagacagaacatgcgcaagaggaacctggcggcagcgcaaaagatg

SEQ ID NO: 168032 - DNA, 103 bp, Artificial Sequence
  Synthetic Polynucleotide
taatacgactcactataggggctgcacaatggtttccagcttcctcttgcaacagaggagagcaagaatgagctggaaaaacctggcggcagcgcaaaagatg

SEQ ID NO: 168033 - DNA, 103 bp, Artificial Sequence
  Synthetic Polynucleotide
taatacgactcactatagggtcccgctccagctgcacaatggtttccagcaacagaggagagctggaatgcattgtgcaaacctggcggcagcgcaaaagatg

SEQ ID NO: 168034 - DNA, 103 bp, Artificial Sequence
  Synthetic Polynucleotide
taatacgactcactatagggccgctccagctcccgctccagctgcacaataacagaggagaattgtgatgctggagcggaacctggcggcagcgcaaaagatg

SEQ ID NO: 168035 - DNA, 103 bp, Artificial Sequence
  Synthetic Polynucleotide
taatacgactcactatagggcattggtcagccgctccagctcccgctccaaacagaggagatggagcatgagctggagcaacctggcggcagcgcaaaagatg

SEQ ID NO: 168036 - DNA, 103 bp, Artificial Sequence
  Synthetic Polynucleotide
taatacgactcactatagggagctcggtgatggacatgatctcctgccaaaacagaggagattggcaatggatcatgtcaacctggcggcagcgcaaaagatg

SEQ ID NO: 168037 - DNA, 103 bp, Artificial Sequence
  Synthetic Polynucleotide
taatacgactcactatagggcgctcccgttcattggtcagccgctccagcaacagaggagagctggaatggctgaccaaaacctggcggcagcgcaaaagatg

SEQ ID NO: 168038 - DNA, 103 bp, Artificial Sequence
  Synthetic Polynucleotide
taatacgactcactatagggcctgagaagccgctcccgttcattggtcagaacagaggagactgaccatggaacgggagaacctggcggcagcgcaaaagatg

SEQ ID NO: 168039 - DNA, 103 bp, Artificial Sequence
  Synthetic Polynucleotide
taatacgactcactatagggccccgcgggccctgagaagccgctcccgttaacagaggagaaacgggatgggcttctcaaacctggcggcagcgcaaaagatg

SEQ ID NO: 168040 - DNA, 103 bp, Artificial Sequence
  Synthetic Polynucleotide
taatacgactcactatagggcggtctgcctccccgcgggccctgagaagcaacagaggagagcttctatgggcccgcggaacctggcggcagcgcaaaagatg

SEQ ID NO: 168041 - DNA, 103 bp, Artificial Sequence
  Synthetic Polynucleotide
taatacgactcactatagggctccagggtccggtctgcctccccgcgggcaacagaggagagcccgcatggaggcagacaacctggcggcagcgcaaaagatg

SEQ ID NO: 168042 - DNA, 103 bp, Artificial Sequence
  Synthetic Polynucleotide
taatacgactcactatagggggcgcatgacctccagggtccggtctgcctaacagaggagaaggcagatgggaccctggaacctggcggcagcgcaaaagatg

SEQ ID NO: 168043 - DNA, 103 bp, Artificial Sequence
  Synthetic Polynucleotide
taatacgactcactataggggtcagctgttggcgcatgacctccagggtcaacagaggagagaccctatgggtcatgcgaacctggcggcagcgcaaaagatg

SEQ ID NO: 168044 - DNA, 103 bp, Artificial Sequence
  Synthetic Polynucleotide
taatacgactcactataggggtacagctctgtcagctgttggcgcatgacaacagaggagagtcatgatgcaacagctgaacctggcggcagcgcaaaagatg

SEQ ID NO: 168045 - DNA, 103 bp, Artificial Sequence
  Synthetic Polynucleotide
taatacgactcactatagggaaatgtcacggtacagctctgtcagctgttaacagaggagaaacagcatgcagagctgtaacctggcggcagcgcaaaagatg

SEQ ID NO: 168046 - DNA, 103 bp, Artificial Sequence
  Synthetic Polynucleotide
taatacgactcactatagggaggtgctggaaaatgtcacggtacagctctaacagaggagaagagctatgccgtgacataacctggcggcagcgcaaaagatg

SEQ ID NO: 168047 - DNA, 103 bp, Artificial Sequence
  Synthetic Polynucleotide
taatacgactcactatagggttccgttaagtatttcttcagagaaagcataacagaggagaatgcttatgctgaagaaaaacctggcggcagcgcaaaagatg

SEQ ID NO: 168048 - DNA, 103 bp, Artificial Sequence
  Synthetic Polynucleotide
taatacgactcactatagggccggagtgggggaagctgtgaggtcaggtaaacagaggagatacctgatgtcacagcttaacctggcggcagcgcaaaagatg

SEQ ID NO: 168049 - DNA, 103 bp, Artificial Sequence
  Synthetic Polynucleotide
taatacgactcactataggggccccccagggacgcctgatgcaggctgacaacagaggagagtcagcatgcatcaggcgaacctggcggcagcgcaaaagatg

SEQ ID NO: 168050 - DNA, 103 bp, Artificial Sequence
  Synthetic Polynucleotide
taatacgactcactatagggcctggctgcagccccccagggacgcctgataacagaggagaatcaggatgccctgggggaacctggcggcagcgcaaaagatg

SEQ ID NO: 168051 - DNA, 103 bp, Artificial Sequence
  Synthetic Polynucleotide
taatacgactcactatagggagtaagaagtcctggctgcagccccccaggaacagaggagacctgggatgctgcagccaaacctggcggcagcgcaaaagatg

SEQ ID NO: 168052 - DNA, 103 bp, Artificial Sequence
  Synthetic Polynucleotide
taatacgactcactatagggggggctgaagagtaagaagtcctggctgcaaacagaggagatgcagcatggacttcttaaacctggcggcagcgcaaaagatg

SEQ ID NO: 168053 - DNA, 103 bp, Artificial Sequence
  Synthetic Polynucleotide
taatacgactcactatagggtttccacctcggggctgaagagtaagaagtaacagaggagaacttctatgtcttcagccaacctggcggcagcgcaaaagatg

SEQ ID NO: 168054 - DNA, 103 bp, Artificial Sequence
  Synthetic Polynucleotide
taatacgactcactatagggacaggcaggctttccacctcggggctgaagaacagaggagacttcagatgcgaggtggaaacctggcggcagcgcaaaagatg

SEQ ID NO: 168055 - DNA, 103 bp, Artificial Sequence
  Synthetic Polynucleotide
taatacgactcactataggggctactggccacaggcaggctttccacctcaacagaggagagaggtgatgagcctgcctaacctggcggcagcgcaaaagatg

SEQ ID NO: 168056 - DNA, 103 bp, Artificial Sequence
  Synthetic Polynucleotide
taatacgactcactataggggcagcgtggagctactggccacaggcaggcaacagaggagagcctgcatgtggccagtaaacctggcggcagcgcaaaagatg

SEQ ID NO: 168057 - DNA, 103 bp, Artificial Sequence
  Synthetic Polynucleotide
taatacgactcactataggggccaacgggagcagcgtggagctactggccaacagaggagaggccagatgctccacgctaacctggcggcagcgcaaaagatg

SEQ ID NO: 168058 - DNA, 103 bp, Artificial Sequence
  Synthetic Polynucleotide
taatacgactcactatagggattgctgggggccaacgggagcagcgtggaaacagaggagatccacgatgctcccgttgaacctggcggcagcgcaaaagatg

SEQ ID NO: 168059 - DNA, 103 bp, Artificial Sequence
  Synthetic Polynucleotide
taatacgactcactatagggggatgatctcccggagtgggggaagctgtgaacagaggagacacagcatgccccactccaacctggcggcagcgcaaaagatg

SEQ ID NO: 168060 - DNA, 103 bp, Artificial Sequence
  Synthetic Polynucleotide
taatacgactcactatagggggctggtagaattgctgggggccaacgggaaacagaggagatcccgtatgcccccagcaaacctggcggcagcgcaaaagatg

SEQ ID NO: 168061 - DNA, 103 bp, Artificial Sequence
  Synthetic Polynucleotide
taatacgactcactataggggtggagttgaggctggtagaattgctggggaacagaggagaccccagatgttctaccagaacctggcggcagcgcaaaagatg

SEQ ID NO: 168062 - DNA, 103 bp, Artificial Sequence
  Synthetic Polynucleotide
taatacgactcactatagggggagccgaaggtggagttgaggctggtagaaacagaggagatctaccatgctcaactccaacctggcggcagcgcaaaagatg

SEQ ID NO: 168063 - DNA, 103 bp, Artificial Sequence
  Synthetic Polynucleotide
taatacgactcactatagggtcaggttggtggagccgaaggtggagttgaaacagaggagatcaactatgccttcggctaacctggcggcagcgcaaaagatg

SEQ ID NO: 168064 - DNA, 103 bp, Artificial Sequence
  Synthetic Polynucleotide
taatacgactcactatagggaagagccctgtcaggttggtggagccgaagaacagaggagacttcggatgcaccaacctaacctggcggcagcgcaaaagatg

SEQ ID NO: 168065 - DNA, 103 bp, Artificial Sequence
  Synthetic Polynucleotide
taatacgactcactataggggggtggaaagaagagccctgtcaggttggtaacagaggagaaccaacatgacagggctcaacctggcggcagcgcaaaagatg

SEQ ID NO: 168066 - DNA, 103 bp, Artificial Sequence
  Synthetic Polynucleotide
taatacgactcactatagggcattgagctggggtggaaagaagagccctgaacagaggagacagggcatgtctttccacaacctggcggcagcgcaaaagatg

SEQ ID NO: 168067 - DNA, 103 bp, Artificial Sequence
  Synthetic Polynucleotide
taatacgactcactatagggttggctgtgccattgagctggggtggaaagaacagaggagactttccatgccagctcaaaacctggcggcagcgcaaaagatg

SEQ ID NO: 168068 - DNA, 103 bp, Artificial Sequence
  Synthetic Polynucleotide
taatacgactcactatagggtgctgtgtcattggctgtgccattgagctgaacagaggagacagctcatgggcacagccaacctggcggcagcgcaaaagatg

SEQ ID NO: 168069 - DNA, 103 bp, Artificial Sequence
  Synthetic Polynucleotide
taatacgactcactataggggctctgggcctgctgtgtcattggctgtgcaacagaggagagcacagatgatgacacagaacctggcggcagcgcaaaagatg

SEQ ID NO: 168070 - DNA, 103 bp, Artificial Sequence
  Synthetic Polynucleotide
taatacgactcactatagggctgggccccaggatgatctcccggagtgggaacagaggagacccactatgggagatcataacctggcggcagcgcaaaagatg

SEQ ID NO: 168071 - DNA, 103 bp, Artificial Sequence
  Synthetic Polynucleotide
taatacgactcactataggggggtcaggcagctctgggcctgctgtgtcaaacagaggagatgacacatgaggcccagaaacctggcggcagcgcaaaagatg

SEQ ID NO: 168072 - DNA, 103 bp, Artificial Sequence
  Synthetic Polynucleotide
taatacgactcactatagggaccccccaaagggtcaggcagctctgggccaacagaggagaggcccaatgctgcctgacaacctggcggcagcgcaaaagatg

SEQ ID NO: 168073 - DNA, 103 bp, Artificial Sequence
  Synthetic Polynucleotide
taatacgactcactatagggcatctaacagaccccccaaagggtcaggcaaacagaggagatgcctgatgctttgggggaacctggcggcagcgcaaaagatg

SEQ ID NO: 168074 - DNA, 103 bp, Artificial Sequence
  Synthetic Polynucleotide
taatacgactcactatagggaacatagcttcatctaacagaccccccaaaaacagaggagatttgggatgtctgttagaaacctggcggcagcgcaaaagatg

SEQ ID NO: 168075 - DNA, 103 bp, Artificial Sequence
  Synthetic Polynucleotide
taatacgactcactataggggatctcatccaacatagcttcatctaacagaacagaggagactgttaatggaagctatgaacctggcggcagcgcaaaagatg

SEQ ID NO: 168076 - DNA, 103 bp, Artificial Sequence
  Synthetic Polynucleotide
taatacgactcactatagggccataaggctgatctcatccaacatagcttaacagaggagaaagctaatgtggatgagaaacctggcggcagcgcaaaagatg

SEQ ID NO: 168077 - DNA, 103 bp, Artificial Sequence
  Synthetic Polynucleotide
taatacgactcactatagggatggccaggtccataaggctgatctcatccaacagaggagaggatgaatgcagccttataacctggcggcagcgcaaaagatg

SEQ ID NO: 168078 - DNA, 103 bp, Artificial Sequence
  Synthetic Polynucleotide
taatacgactcactataggggccttcttcaatggccaggtccataaggctaacagaggagaagccttatggacctggccaacctggcggcagcgcaaaagatg

SEQ ID NO: 168079 - DNA, 103 bp, Artificial Sequence
  Synthetic Polynucleotide
taatacgactcactatagggcagggttaaagccttcttcaatggccaggtaacagaggagaacctggatgttgaagaagaacctggcggcagcgcaaaagatg

SEQ ID NO: 168080 - DNA, 103 bp, Artificial Sequence
  Synthetic Polynucleotide
taatacgactcactataggggaggcctgcacagggttaaagccttcttcaaacagaggagatgaagaatgctttaacccaacctggcggcagcgcaaaagatg

SEQ ID NO: 168081 - DNA, 103 bp, Artificial Sequence
  Synthetic Polynucleotide
taatacgactcactatagggataggcagaactgggccccaggatgatctcaacagaggagagagatcatgctggggcccaacctggcggcagcgcaaaagatg

SEQ ID NO: 168082 - DNA, 103 bp, Artificial Sequence
  Synthetic Polynucleotide
taatacgactcactatagggctccagctgggaggcctgcacagggttaaaaacagaggagatttaacatggtgcaggccaacctggcggcagcgcaaaagatg

SEQ ID NO: 168083 - DNA, 103 bp, Artificial Sequence
  Synthetic Polynucleotide
taatacgactcactatagggcaaattcctcctccagctgggaggcctgcaaacagaggagatgcaggatgcccagctggaacctggcggcagcgcaaaagatg

SEQ ID NO: 168084 - DNA, 103 bp, Artificial Sequence
  Synthetic Polynucleotide
taatacgactcactataggggagtcagagtcaaattcctcctccagctggaacagaggagaccagctatgggaggaattaacctggcggcagcgcaaaagatg

SEQ ID NO: 168085 - DNA, 103 bp, Artificial Sequence
  Synthetic Polynucleotide
taatacgactcactatagggggaaaggcctgagtcagagtcaaattcctcaacagaggagagaggaaatggactctgacaacctggcggcagcgcaaaagatg

SEQ ID NO: 168086 - DNA, 103 bp, Artificial Sequence
  Synthetic Polynucleotide
taatacgactcactatagggtcgagtctaaggaaaggcctgagtcagagtaacagaggagaactctgatgcaggcctttaacctggcggcagcgcaaaagatg

SEQ ID NO: 168087 - DNA, 103 bp, Artificial Sequence
  Synthetic Polynucleotide
taatacgactcactataggggggctatggctcgagtctaaggaaaggcctaacagaggagaaggcctatgcttagactcaacctggcggcagcgcaaaagatg

SEQ ID NO: 168088 - DNA, 103 bp, Artificial Sequence
  Synthetic Polynucleotide
taatacgactcactatagggtagggaagaagggctatggctcgagtctaaaacagaggagattagacatgagccatagcaacctggcggcagcgcaaaagatg

SEQ ID NO: 168089 - DNA, 103 bp, Artificial Sequence
  Synthetic Polynucleotide
taatacgactcactatagggcagagctgcttagggaagaagggctatggcaacagaggagagccataatgcttcttcccaacctggcggcagcgcaaaagatg

SEQ ID NO: 168090 - DNA, 103 bp, Artificial Sequence
  Synthetic Polynucleotide
taatacgactcactataggggaactgccttcagagctgcttagggaagaaaacagaggagattcttcatgaagcagctcaacctggcggcagcgcaaaagatg

SEQ ID NO: 168091 - DNA, 103 bp, Artificial Sequence
  Synthetic Polynucleotide
taatacgactcactatagggagaagaggaagaactgccttcagagctgctaacagaggagaagcagcatggaaggcagtaacctggcggcagcgcaaaagatg

SEQ ID NO: 168092 - DNA, 103 bp, Artificial Sequence
  Synthetic Polynucleotide
taatacgactcactataggggggtctgagtataggcagaactgggccccaaacagaggagatggggcatggttctgcctaacctggcggcagcgcaaaagatg

SEQ ID NO: 168093 - DNA, 103 bp, Artificial Sequence
  Synthetic Polynucleotide
taatacgactcactatagggaggaggaggaagaagaggaagaactgccttaacagaggagaaaggcaatgcttcctcttaacctggcggcagcgcaaaagatg

SEQ ID NO: 168094 - DNA, 103 bp, Artificial Sequence
  Synthetic Polynucleotide
taatacgactcactataggggaagaggaagaggaggaggaagaagaggaaaacagaggagattcctcatgttcctcctcaacctggcggcagcgcaaaagatg

SEQ ID NO: 168095 - DNA, 103 bp, Artificial Sequence
  Synthetic Polynucleotide
taatacgactcactatagggagcagaggaagaagaggaagaggaggaggaaacagaggagatcctccatgtcttcctctaacctggcggcagcgcaaaagatg

SEQ ID NO: 168096 - DNA, 103 bp, Artificial Sequence
  Synthetic Polynucleotide
taatacgactcactatagggcagaggaagaagcagaggaagaagaggaagaacagaggagacttcctatgcttcctctgaacctggcggcagcgcaaaagatg

SEQ ID NO: 168097 - DNA, 103 bp, Artificial Sequence
  Synthetic Polynucleotide
taatacgactcactataggggaggaagaggcagaggaagaagcagaggaaaacagaggagattcctcatgttcttcctcaacctggcggcagcgcaaaagatg

SEQ ID NO: 168098 - DNA, 103 bp, Artificial Sequence
  Synthetic Polynucleotide
taatacgactcactatagggctcagaaaaggaggaagaggcagaggaagaaacagaggagatcttccatggcctcttccaacctggcggcagcgcaaaagatg

SEQ ID NO: 168099 - DNA, 103 bp, Artificial Sequence
  Synthetic Polynucleotide
taatacgactcactatagggccgcaccttcctcagaaaaggaggaagaggaacagaggagacctcttatgccttttctgaacctggcggcagcgcaaaagatg

SEQ ID NO: 168100 - DNA, 103 bp, Artificial Sequence
  Synthetic Polynucleotide
taatacgactcactatagggctgtagccaaccgcaccttcctcagaaaagaacagaggagacttttcatgggaaggtgcaacctggcggcagcgcaaaagatg

SEQ ID NO: 168101 - DNA, 103 bp, Artificial Sequence
  Synthetic Polynucleotide
taatacgactcactatagggagagtcagagctgtagccaaccgcaccttcaacagaggagagaaggtatggttggctacaacctggcggcagcgcaaaagatg

SEQ ID NO: 168102 - DNA, 103 bp, Artificial Sequence
  Synthetic Polynucleotide
taatacgactcactatagggccagggtctcagagtcagagctgtagccaaaacagaggagattggctatggctctgactaacctggcggcagcgcaaaagatg

SEQ ID NO: 168103 - DNA, 103 bp, Artificial Sequence
  Synthetic Polynucleotide
taatacgactcactatagggttgtggaactgggtctgagtataggcagaaaacagaggagattctgcatgtactcagacaacctggcggcagcgcaaaagatg

SEQ ID NO: 168104 - DNA, 103 bp, Artificial Sequence
  Synthetic Polynucleotide
taatacgactcactatagggtcttccagatccagggtctcagagtcagagaacagaggagactctgaatgtgagaccctaacctggcggcagcgcaaaagatg

SEQ ID NO: 168105 - DNA, 103 bp, Artificial Sequence
  Synthetic Polynucleotide
taatacgactcactatagggaccctcggcctcttccagatccagggtctcaacagaggagagagaccatggatctggaaaacctggcggcagcgcaaaagatg

SEQ ID NO: 168106 - DNA, 103 bp, Artificial Sequence
  Synthetic Polynucleotide
taatacgactcactatagggagcccacagcaccctcggcctcttccagataacagaggagaatctggatgaggccgaggaacctggcggcagcgcaaaagatg

SEQ ID NO: 168107 - DNA, 103 bp, Artificial Sequence
  Synthetic Polynucleotide
taatacgactcactatagggtcaggctggtagcccacagcaccctcggccaacagaggagaggccgaatgtgctgtgggaacctggcggcagcgcaaaagatg

SEQ ID NO: 168108 - DNA, 103 bp, Artificial Sequence
  Synthetic Polynucleotide
taatacgactcactatagggcttggaatactcaggctggtagcccacagcaacagaggagagctgtgatgtaccagcctaacctggcggcagcgcaaaagatg

SEQ ID NO: 168109 - DNA, 103 bp, Artificial Sequence
  Synthetic Polynucleotide
taatacgactcactatagggtgcggcagaacttggaatactcaggctggtaacagaggagaaccagcatgagtattccaaacctggcggcagcgcaaaagatg

SEQ ID NO: 168110 - DNA, 103 bp, Artificial Sequence
  Synthetic Polynucleotide
taatacgactcactatagggtggtagctcatgcggcagaacttggaatacaacagaggagagtattcatggttctgccgaacctggcggcagcgcaaaagatg

SEQ ID NO: 168111 - DNA, 103 bp, Artificial Sequence
  Synthetic Polynucleotide
taatacgactcactatagggagctggatcctggtagctcatgcggcagaaaacagaggagattctgcatgatgagctacaacctggcggcagcgcaaaagatg

SEQ ID NO: 168112 - DNA, 103 bp, Artificial Sequence
  Synthetic Polynucleotide
taatacgactcactatagggatgagagctgagctggatcctggtagctcaaacagaggagatgagctatgaggatccagaacctggcggcagcgcaaaagatg

SEQ ID NO: 168113 - DNA, 103 bp, Artificial Sequence
  Synthetic Polynucleotide
taatacgactcactatagggtagggcaggcatgagagctgagctggatccaacagaggagaggatccatgtcagctctcaacctggcggcagcgcaaaagatg

SEQ ID NO: 168114 - DNA, 103 bp, Artificial Sequence
  Synthetic Polynucleotide
taatacgactcactatagggattcctcaggttgtggaactgggtctgagtaacagaggagaactcagatgcagttccacaacctggcggcagcgcaaaagatg

SEQ ID NO: 168115 - DNA, 103 bp, Artificial Sequence
  Synthetic Polynucleotide
taatacgactcactataggggtgctccaggtagggcaggcatgagagctgaacagaggagacagctcatgtgcctgcccaacctggcggcagcgcaaaagatg

SEQ ID NO: 168116 - DNA, 103 bp, Artificial Sequence
  Synthetic Polynucleotide
taatacgactcactatagggtgtggcccacgtgctccaggtagggcaggcaacagaggagagcctgcatgacctggagcaacctggcggcagcgcaaaagatg

SEQ ID NO: 168117 - DNA, 103 bp, Artificial Sequence
  Synthetic Polynucleotide
taatacgactcactatagggtatgtgtggttgtggcccacgtgctccaggaacagaggagacctggaatgcgtgggccaaacctggcggcagcgcaaaagatg

SEQ ID NO: 168118 - DNA, 103 bp, Artificial Sequence
  Synthetic Polynucleotide
taatacgactcactatagggtgccatgttgtatgtgtggttgtggcccacaacagaggagagtgggcatgaaccacacaaacctggcggcagcgcaaaagatg

SEQ ID NO: 168119 - DNA, 103 bp, Artificial Sequence
  Synthetic Polynucleotide
taatacgactcactataggggggcactgggtgccatgttgtatgtgtggtaacagaggagaaccacaatgacaacatggaacctggcggcagcgcaaaagatg

SEQ ID NO: 168120 - DNA, 103 bp, Artificial Sequence
  Synthetic Polynucleotide
taatacgactcactataggggctgagtccagggcactgggtgccatgttgaacagaggagacaacatatgacccagtgcaacctggcggcagcgcaaaagatg

SEQ ID NO: 168121 - DNA, 103 bp, Artificial Sequence
  Synthetic Polynucleotide
taatacgactcactatagggtggcaggtcggctgagtccagggcactgggaacagaggagacccagtatgctggactcaaacctggcggcagcgcaaaagatg

SEQ ID NO: 168122 - DNA, 103 bp, Artificial Sequence
  Synthetic Polynucleotide
taatacgactcactatagggcactgggtggtggcaggtcggctgagtccaaacagaggagatggactatgccgacctgcaacctggcggcagcgcaaaagatg

SEQ ID NO: 168123 - DNA, 103 bp, Artificial Sequence
  Synthetic Polynucleotide
taatacgactcactatagggttcttgagggcactgggtggtggcaggtcgaacagaggagacgacctatgaccacccagaacctggcggcagcgcaaaagatg

SEQ ID NO: 168124 - DNA, 103 bp, Artificial Sequence
  Synthetic Polynucleotide
taatacgactcactatagggcttgctgcctttcttgagggcactgggtggaacagaggagaccacccatggccctcaagaacctggcggcagcgcaaaagatg

SEQ ID NO: 168125 - DNA, 103 bp, Artificial Sequence
  Synthetic Polynucleotide
taatacgactcactatagggcatccaaggtattcctcaggttgtggaactaacagaggagaagttccatgacctgaggaaacctggcggcagcgcaaaagatg

SEQ ID NO: 168126 - DNA, 103 bp, Artificial Sequence
  Synthetic Polynucleotide
taatacgactcactatagggcctgcttctccttgctgcctttcttgagggaacagaggagaccctcaatgaaggcagcaaacctggcggcagcgcaaaagatg

SEQ ID NO: 168127 - DNA, 103 bp, Artificial Sequence
  Synthetic Polynucleotide
taatacgactcactatagggaggaagtcagcctgcttctccttgctgcctaacagaggagaaggcagatgggagaagcaaacctggcggcagcgcaaaagatg

SEQ ID NO: 168128 - DNA, 103 bp, Artificial Sequence
  Synthetic Polynucleotide
taatacgactcactatagggctgcttgtccaggaagtcagcctgcttctcaacagaggagagagaagatggctgacttcaacctggcggcagcgcaaaagatg

SEQ ID NO: 168129 - DNA, 103 bp, Artificial Sequence
  Synthetic Polynucleotide
taatacgactcactatagggcccggctcatctgcttgtccaggaagtcagaacagaggagactgactatgtggacaagcaacctggcggcagcgcaaaagatg

SEQ ID NO: 168130 - DNA, 103 bp, Artificial Sequence
  Synthetic Polynucleotide
taatacgactcactatagggcggtgctcatcccggctcatctgcttgtccaacagaggagaggacaaatggatgagccgaacctggcggcagcgcaaaagatg

SEQ ID NO: 168131 - DNA, 103 bp, Artificial Sequence
  Synthetic Polynucleotide
taatacgactcactatagggggctcgggctcggtgctcatcccggctcataacagaggagaatgagcatggatgagcacaacctggcggcagcgcaaaagatg

SEQ ID NO: 168132 - DNA, 103 bp, Artificial Sequence
  Synthetic Polynucleotide
taatacgactcactatagggggatcttcatggctcgggctcggtgctcataacagaggagaatgagcatggagcccgagaacctggcggcagcgcaaaagatg

SEQ ID NO: 168133 - DNA, 103 bp, Artificial Sequence
  Synthetic Polynucleotide
taatacgactcactatagggttggtgaaagggatcttcatggctcgggctaacagaggagaagcccgatgcatgaagataacctggcggcagcgcaaaagatg

SEQ ID NO: 168134 - DNA, 103 bp, Artificial Sequence
  Synthetic Polynucleotide
taatacgactcactataggggattttgtcattggtgaaagggatcttcataacagaggagaatgaagatgcctttcaccaacctggcggcagcgcaaaagatg

SEQ ID NO: 168135 - DNA, 103 bp, Artificial Sequence
  Synthetic Polynucleotide
taatacgactcactataggggcaggttgatgattttgtcattggtgaaagaacagaggagactttcaatgatgacaaaaaacctggcggcagcgcaaaagatg

SEQ ID NO: 168136 - DNA, 103 bp, Artificial Sequence
  Synthetic Polynucleotide
taatacgactcactatagggataccatagccatccaaggtattcctcaggaacagaggagacctgagatgtaccttggaaacctggcggcagcgcaaaagatg

SEQ ID NO: 168137 - DNA, 103 bp, Artificial Sequence
  Synthetic Polynucleotide
taatacgactcactatagggtcctccacaggcaggttgatgattttgtcaaacagaggagatgacaaatgcatcaacctaacctggcggcagcgcaaaagatg

SEQ ID NO: 168138 - DNA, 103 bp, Artificial Sequence
  Synthetic Polynucleotide
taatacgactcactatagggttcattgaactcctccacaggcaggttgataacagaggagaatcaacatgcctgtggagaacctggcggcagcgcaaaagatg

SEQ ID NO: 168139 - DNA, 103 bp, Artificial Sequence
  Synthetic Polynucleotide
taatacgactcactatagggtggacagcagttcattgaactcctccacagaacagaggagactgtggatgagttcaatgaacctggcggcagcgcaaaagatg

SEQ ID NO: 168140 - DNA, 103 bp, Artificial Sequence
  Synthetic Polynucleotide
taatacgactcactatagggaactggtatttggacagcagttcattgaacaacagaggagagttcaaatgactgctgtcaacctggcggcagcgcaaaagatg

SEQ ID NO: 168141 - DNA, 103 bp, Artificial Sequence
  Synthetic Polynucleotide
taatacgactcactatagggggcttcactcaactggtatttggacagcagaacagaggagactgctgatgaaataccagaacctggcggcagcgcaaaagatg

SEQ ID NO: 168142 - DNA, 103 bp, Artificial Sequence
  Synthetic Polynucleotide
taatacgactcactatagggggctcagctgggcttcactcaactggtattaacagaggagaaataccatgtgagtgaagaacctggcggcagcgcaaaagatg

SEQ ID NO: 168143 - DNA, 103 bp, Artificial Sequence
  Synthetic Polynucleotide
taatacgactcactatagggtctcggatgaggctcagctgggcttcactcaacagaggagagagtgaatgccagctgagaacctggcggcagcgcaaaagatg

SEQ ID NO: 168144 - DNA, 103 bp, Artificial Sequence
  Synthetic Polynucleotide
taatacgactcactataggggcgccggatgtctcggatgaggctcagctgaacagaggagacagctgatgctcatccgaaacctggcggcagcgcaaaagatg

SEQ ID NO: 168145 - DNA, 103 bp, Artificial Sequence
  Synthetic Polynucleotide
taatacgactcactatagggtcttgccccggcgccggatgtctcggatgaaacagaggagatcatccatgacatccggcaacctggcggcagcgcaaaagatg

SEQ ID NO: 168146 - DNA, 103 bp, Artificial Sequence
  Synthetic Polynucleotide
taatacgactcactataggggccatcttgttcttgccccggcgccggatgaacagaggagacatccgatgccggggcaaaacctggcggcagcgcaaaagatg

SEQ ID NO: 168147 - DNA, 103 bp, Artificial Sequence
  Synthetic Polynucleotide
taatacgactcactatagggcttggggtggataccatagccatccaaggtaacagaggagaaccttgatgggctatggtaacctggcggcagcgcaaaagatg

SEQ ID NO: 168148 - DNA, 103 bp, Artificial Sequence
  Synthetic Polynucleotide
taatacgactcactataggggttctgcgccgccatcttgttcttgccccgaacagaggagacggggcatgaacaagatgaacctggcggcagcgcaaaagatg

SEQ ID NO: 168149 - DNA, 103 bp, Artificial Sequence
  Synthetic Polynucleotide
taatacgactcactataggggcttgcggcagttctgcgccgccatcttgtaacagaggagaacaagaatgcggcgcagaaacctggcggcagcgcaaaagatg

SEQ ID NO: 168150 - DNA, 103 bp, Artificial Sequence
  Synthetic Polynucleotide
taatacgactcactatagggtccagcttgcgcttgcggcagttctgcgccaacagaggagaggcgcaatgctgccgcaaaacctggcggcagcgcaaaagatg

SEQ ID NO: 168151 - DNA, 103 bp, Artificial Sequence
  Synthetic Polynucleotide
taatacgactcactatagggcaggatggtgtccagcttgcgcttgcggcaaacagaggagatgccgcatgcgcaagctgaacctggcggcagcgcaaaagatg

SEQ ID NO: 168152 - DNA, 103 bp, Artificial Sequence
  Synthetic Polynucleotide
taatacgactcactataggggctccagattcaggatggtgtccagcttgcaacagaggagagcaagcatgacaccatccaacctggcggcagcgcaaaagatg

SEQ ID NO: 168153 - DNA, 103 bp, Artificial Sequence
  Synthetic Polynucleotide
taatacgactcactatagggtccacatcacgctccagattcaggatggtgaacagaggagacaccatatggaatctggaaacctggcggcagcgcaaaagatg

SEQ ID NO: 168154 - DNA, 103 bp, Artificial Sequence
  Synthetic Polynucleotide
taatacgactcactatagggctgcaggtcctccacatcacgctccagattaacagaggagaaatctgatgcgtgatgtgaacctggcggcagcgcaaaagatg

SEQ ID NO: 168155 - DNA, 103 bp, Artificial Sequence
  Synthetic Polynucleotide
taatacgactcactatagggctttgtcacgctgcaggtcctccacatcacaacagaggagagtgatgatgaggacctgcaacctggcggcagcgcaaaagatg

SEQ ID NO: 168156 - DNA, 103 bp, Artificial Sequence
  Synthetic Polynucleotide
taatacgactcactatagggagcagccgggctttgtcacgctgcaggtccaacagaggagaggacctatggcgtgacaaaacctggcggcagcgcaaaagatg

SEQ ID NO: 168157 - DNA, 103 bp, Artificial Sequence
  Synthetic Polynucleotide
taatacgactcactatagggtttctcccgcagcagccgggctttgtcacgaacagaggagacgtgacatggcccggctgaacctggcggcagcgcaaaagatg

SEQ ID NO: 168158 - DNA, 103 bp, Artificial Sequence
  Synthetic Polynucleotide
taatacgactcactatagggggagaagtccttccgttaagtatttcttcaaacagaggagatgaagaatgacttaacggaacctggcggcagcgcaaaagatg

SEQ ID NO: 168159 - DNA, 103 bp, Artificial Sequence
  Synthetic Polynucleotide
taatacgactcactatagggggtctatgctcttggggtggataccatagcaacagaggagagctatgatgtccaccccaaacctggcggcagcgcaaaagatg

SEQ ID NO: 168160 - DNA, 103 bp, Artificial Sequence
  Synthetic Polynucleotide
taatacgactcactatagggggaactccactttctcccgcagcagccgggaacagaggagacccggcatgtgcgggagaaacctggcggcagcgcaaaagatg

SEQ ID NO: 168161 - DNA, 103 bp, Artificial Sequence
  Synthetic Polynucleotide
taatacgactcactatagggagggagcgcaggaactccactttctcccgcaacagaggagagcgggaatgagtggagttaacctggcggcagcgcaaaagatg

SEQ ID NO: 168162 - DNA, 103 bp, Artificial Sequence
  Synthetic Polynucleotide
taatacgactcactatagggcatctgtcgcagggagcgcaggaactccacaacagaggagagtggagatgctgcgctccaacctggcggcagcgcaaaagatg

SEQ ID NO: 168163 - DNA, 103 bp, Artificial Sequence
  Synthetic Polynucleotide
taatacgactcactatagggccttctgcttcatctgtcgcagggagcgcaaacagaggagatgcgctatgtgcgacagaaacctggcggcagcgcaaaagatg

SEQ ID NO: 168164 - DNA, 103 bp, Artificial Sequence
  Synthetic Polynucleotide
taatacgactcactatagggaggctctggaccttctgcttcatctgtcgcaacagaggagagcgacaatggaagcagaaaacctggcggcagcgcaaaagatg

SEQ ID NO: 168165 - DNA, 103 bp, Artificial Sequence
  Synthetic Polynucleotide
taatacgactcactatagggctcctggtacaggctctggaccttctgcttaacagaggagaaagcagatggtccagagcaacctggcggcagcgcaaaagatg

SEQ ID NO: 168166 - DNA, 103 bp, Artificial Sequence
  Synthetic Polynucleotide
taatacgactcactataggggcccaaacacctcctggtacaggctctggaaacagaggagatccagaatgtgtaccaggaacctggcggcagcgcaaaagatg

SEQ ID NO: 168167 - DNA, 103 bp, Artificial Sequence
  Synthetic Polynucleotide
taatacgactcactatagggtctcgcagccgcccaaacacctcctggtacaacagaggagagtaccaatgggtgtttggaacctggcggcagcgcaaaagatg

SEQ ID NO: 168168 - DNA, 103 bp, Artificial Sequence
  Synthetic Polynucleotide
taatacgactcactatagggtccgttctcatctcgcagccgcccaaacacaacagaggagagtgtttatgcggctgcgaaacctggcggcagcgcaaaagatg

SEQ ID NO: 168169 - DNA, 103 bp, Artificial Sequence
  Synthetic Polynucleotide
taatacgactcactatagggagtagggtcgtccgttctcatctcgcagccaacagaggagaggctgcatgatgagaacgaacctggcggcagcgcaaaagatg

SEQ ID NO: 168170 - DNA, 103 bp, Artificial Sequence
  Synthetic Polynucleotide
taatacgactcactatagggtaattgtccaggtctatgctcttggggtggaacagaggagaccacccatggagcatagaaacctggcggcagcgcaaaagatg

SEQ ID NO: 168171 - DNA, 103 bp, Artificial Sequence
  Synthetic Polynucleotide
taatacgactcactatagggtgactgggcgagtagggtcgtccgttctcaaacagaggagatgagaaatgacgaccctaaacctggcggcagcgcaaaagatg

SEQ ID NO: 168172 - DNA, 103 bp, Artificial Sequence
  Synthetic Polynucleotide
taatacgactcactataggggagcgcatactgactgggcgagtagggtcgaacagaggagacgacccatgtcgcccagtaacctggcggcagcgcaaaagatg

SEQ ID NO: 168173 - DNA, 103 bp, Artificial Sequence
  Synthetic Polynucleotide
taatacgactcactatagggcggcgtactggagcgcatactgactgggcgaacagaggagacgcccaatgagtatgcgcaacctggcggcagcgcaaaagatg

SEQ ID NO: 168174 - DNA, 103 bp, Artificial Sequence
  Synthetic Polynucleotide
taatacgactcactatagggctgccgtccccggcgtactggagcgcatacaacagaggagagtatgcatgccagtacgcaacctggcggcagcgcaaaagatg

SEQ ID NO: 168175 - DNA, 103 bp, Artificial Sequence
  Synthetic Polynucleotide
taatacgactcactataggggaggaggacactgccgtccccggcgtactgaacagaggagacagtacatgggggacggcaacctggcggcagcgcaaaagatg

SEQ ID NO: 168176 - DNA, 103 bp, Artificial Sequence
  Synthetic Polynucleotide
taatacgactcactatagggtgcgggggatgaggaggacactgccgtcccaacagaggagagggacgatggtgtcctccaacctggcggcagcgcaaaagatg

SEQ ID NO: 168177 - DNA, 103 bp, Artificial Sequence
  Synthetic Polynucleotide
taatacgactcactatagggtcggccatcgtgcgggggatgaggaggacaaacagaggagatgtcctatgcatcccccgaacctggcggcagcgcaaaagatg

SEQ ID NO: 168178 - DNA, 103 bp, Artificial Sequence
  Synthetic Polynucleotide
taatacgactcactatagggggcctgctggtcggccatcgtgcgggggataacagaggagaatccccatgacgatggccaacctggcggcagcgcaaaagatg

SEQ ID NO: 168179 - DNA, 103 bp, Artificial Sequence
  Synthetic Polynucleotide
taatacgactcactatagggcctgccgccgggcctgctggtcggccatcgaacagaggagacgatggatgaccagcaggaacctggcggcagcgcaaaagatg

SEQ ID NO: 168180 - DNA, 103 bp, Artificial Sequence
  Synthetic Polynucleotide
taatacgactcactatagggggcttcctctcctgccgccgggcctgctggaacagaggagaccagcaatgccggcggcaaacctggcggcagcgcaaaagatg

SEQ ID NO: 168181 - DNA, 103 bp, Artificial Sequence
  Synthetic Polynucleotide
taatacgactcactatagggggcagtgaagtaattgtccaggtctatgctaacagaggagaagcataatgctggacaataacctggcggcagcgcaaaagatg

SEQ ID NO: 168182 - DNA, 103 bp, Artificial Sequence
  Synthetic Polynucleotide
taatacgactcactatagggccggtcctttggcttcctctcctgccgccgaacagaggagacggcggatggagaggaagaacctggcggcagcgcaaaagatg

SEQ ID NO: 168183 - DNA, 103 bp, Artificial Sequence
  Synthetic Polynucleotide
taatacgactcactatagggggagccgccgggcagtgaagtaattgtccaaacagaggagatggacaatgacttcactgaacctggcggcagcgcaaaagatg

SEQ ID NO: 168184 - DNA, 103 bp, Artificial Sequence
  Synthetic Polynucleotide
taatacgactcactatagggacctgactgaggagccgccgggcagtgaagaacagaggagacttcacatgccggcggctaacctggcggcagcgcaaaagatg

SEQ ID NO: 168185 - DNA, 103 bp, Artificial Sequence
  Synthetic Polynucleotide
taatacgactcactatagggcagggccctcacctgactgaggagccgccgaacagaggagacggcggatgctcagtcagaacctggcggcagcgcaaaagatg

SEQ ID NO: 168186 - DNA, 103 bp, Artificial Sequence
  Synthetic Polynucleotide
taatacgactcactatagggggaacctgtccagggccctcacctgactgaaacagaggagatcagtcatgtgagggcccaacctggcggcagcgcaaaagatg

SEQ ID NO: 168187 - DNA, 103 bp, Artificial Sequence
  Synthetic Polynucleotide
taatacgactcactataggggttggcacctggaacctgtccagggccctcaacagaggagagagggcatgggacaggttaacctggcggcagcgcaaaagatg

SEQ ID NO: 168188 - DNA, 103 bp, Artificial Sequence
  Synthetic Polynucleotide
taatacgactcactatagggtacctcagtggttggcacctggaacctgtcaacagaggagagacaggatgcaggtgccaaacctggcggcagcgcaaaagatg

SEQ ID NO: 168189 - DNA, 103 bp, Artificial Sequence
  Synthetic Polynucleotide
taatacgactcactataggggccaggcatttacctcagtggttggcacctaacagaggagaaggtgcatgccactgaggaacctggcggcagcgcaaaagatg

SEQ ID NO: 168190 - DNA, 103 bp, Artificial Sequence
  Synthetic Polynucleotide
taatacgactcactatagggatggtgaactggagaagtccttccgttaagaacagaggagacttaacatgaggacttctaacctggcggcagcgcaaaagatg

SEQ ID NO: 168191 - DNA, 103 bp, Artificial Sequence
  Synthetic Polynucleotide
taatacgactcactatagggcggtgaaccagccaggcatttacctcagtgaacagaggagacactgaatgaaatgcctgaacctggcggcagcgcaaaagatg

SEQ ID NO: 168192 - DNA, 103 bp, Artificial Sequence
  Synthetic Polynucleotide
taatacgactcactatagggctctgggtctcggtgaaccagccaggcattaacagaggagaaatgccatgctggttcacaacctggcggcagcgcaaaagatg

SEQ ID NO: 168193 - DNA, 103 bp, Artificial Sequence
  Synthetic Polynucleotide
taatacgactcactatagggagacagacccctctgggtctcggtgaaccaaacagaggagatggttcatggagacccagaacctggcggcagcgcaaaagatg

SEQ ID NO: 168194 - DNA, 103 bp, Artificial Sequence
  Synthetic Polynucleotide
taatacgactcactatagggtgactgccagagacagacccctctgggtctaacagaggagaagacccatgggggtctgtaacctggcggcagcgcaaaagatg

SEQ ID NO: 168195 - DNA, 103 bp, Artificial Sequence
  Synthetic Polynucleotide
taatacgactcactatagggtgagttgggctgactgccagagacagacccaacagaggagagggtctatgtctggcagtaacctggcggcagcgcaaaagatg

SEQ ID NO: 168196 - DNA, 103 bp, Artificial Sequence
  Synthetic Polynucleotide
taatacgactcactataggggggcgaggcctgagttgggctgactgccagaacagaggagactggcaatgagcccaactaacctggcggcagcgcaaaagatg

SEQ ID NO: 168197 - DNA, 103 bp, Artificial Sequence
  Synthetic Polynucleotide
taatacgactcactataggggaactctcgagggcgaggcctgagttgggcaacagaggagagcccaaatgaggcctcgcaacctggcggcagcgcaaaagatg

SEQ ID NO: 168198 - DNA, 103 bp, Artificial Sequence
  Synthetic Polynucleotide
taatacgactcactataggggaggccactggaactctcgagggcgaggccaacagaggagaggcctcatgctcgagagtaacctggcggcagcgcaaaagatg

SEQ ID NO: 168199 - DNA, 103 bp, Artificial Sequence
  Synthetic Polynucleotide
taatacgactcactatagggtcacatcttggaggccactggaactctcgaaacagaggagatcgagaatgccagtggccaacctggcggcagcgcaaaagatg

SEQ ID NO: 168200 - DNA, 103 bp, Artificial Sequence
  Synthetic Polynucleotide
taatacgactcactatagggtctgggcctgtcacatcttggaggccactgaacagaggagacagtggatgccaagatgtaacctggcggcagcgcaaaagatg

SEQ ID NO: 168201 - DNA, 103 bp, Artificial Sequence
  Synthetic Polynucleotide
taatacgactcactatagggactcagcagaatggtgaactggagaagtccaacagaggagaggacttatgcagttcaccaacctggcggcagcgcaaaagatg

SEQ ID NO: 168202 - DNA, 103 bp, Artificial Sequence
  Synthetic Polynucleotide
taatacgactcactatagggcaccccgttgtctgggcctgtcacatcttgaacagaggagacaagatatgacaggcccaaacctggcggcagcgcaaaagatg

SEQ ID NO: 168203 - DNA, 103 bp, Artificial Sequence
  Synthetic Polynucleotide
taatacgactcactatagggcgctttctcgcaccccgttgtctgggcctgaacagaggagacaggccatgacaacggggaacctggcggcagcgcaaaagatg

SEQ ID NO: 168204 - DNA, 103 bp, Artificial Sequence
  Synthetic Polynucleotide
taatacgactcactatagggtgctccgtttcgctttctcgcaccccgttgaacagaggagacaacggatggcgagaaagaacctggcggcagcgcaaaagatg

SEQ ID NO: 168205 - DNA, 103 bp, Artificial Sequence
  Synthetic Polynucleotide
taatacgactcactatagggaccgaatccctgctccgtttcgctttctcgaacagaggagacgagaaatggaaacggagaacctggcggcagcgcaaaagatg

SEQ ID NO: 168206 - DNA, 103 bp, Artificial Sequence
  Synthetic Polynucleotide
taatacgactcactatagggccaaatcttcaccgaatccctgctccgtttaacagaggagaaaacggatgagggattcgaacctggcggcagcgcaaaagatg

SEQ ID NO: 168207 - DNA, 103 bp, Artificial Sequence
  Synthetic Polynucleotide
taatacgactcactatagggcccaaatcctccaaatcttcaccgaatcccaacagaggagagggattatgtgaagatttaacctggcggcagcgcaaaagatg

SEQ ID NO: 168208 - DNA, 103 bp, Artificial Sequence
  Synthetic Polynucleotide
taatacgactcactatagggggctacagcccccaaatcctccaaatcttcaacagaggagagaagatatggaggatttgaacctggcggcagcgcaaaagatg

SEQ ID NO: 168209 - DNA, 103 bp, Artificial Sequence
  Synthetic Polynucleotide
taatacgactcactatagggtgactgggggggctacagcccccaaatcctaacagaggagaaggattatggggctgtagaacctggcggcagcgcaaaagatg

SEQ ID NO: 168210 - DNA, 103 bp, Artificial Sequence
  Synthetic Polynucleotide
taatacgactcactatagggaagtctccactgactgggggggctacagccaacagaggagaggctgtatgccccccagtaacctggcggcagcgcaaaagatg

SEQ ID NO: 168211 - DNA, 103 bp, Artificial Sequence
  Synthetic Polynucleotide
taatacgactcactatagggctctttggttaagtctccactgactgggggaacagaggagacccccaatgagtggagacaacctggcggcagcgcaaaagatg

SEQ ID NO: 168212 - DNA, 103 bp, Artificial Sequence
  Synthetic Polynucleotide
taatacgactcactatagggccccaatcaaactcagcagaatggtgaactaacagaggagaagttcaatgttctgctgaaacctggcggcagcgcaaaagatg

SEQ ID NO: 168213 - DNA, 103 bp, Artificial Sequence
  Synthetic Polynucleotide
taatacgactcactataggggatctatgtcctctttggttaagtctccacaacagaggagagtggagatgtaaccaaagaacctggcggcagcgcaaaagatg

SEQ ID NO: 168214 - DNA, 103 bp, Artificial Sequence
  Synthetic Polynucleotide
taatacgactcactatagggatgtcaatcagatctatgtcctctttggttaacagaggagaaaccaaatgggacatagaaacctggcggcagcgcaaaagatg

SEQ ID NO: 168215 - DNA, 103 bp, Artificial Sequence
  Synthetic Polynucleotide
taatacgactcactatagggtcgccaaaggatgtcaatcagatctatgtcaacagaggagagacataatgctgattgacaacctggcggcagcgcaaaagatg

SEQ ID NO: 168216 - DNA, 103 bp, Artificial Sequence
  Synthetic Polynucleotide
taatacgactcactatagggcaatatcctgtcgccaaaggatgtcaatcaaacagaggagatgattgatgtcctttggcaacctggcggcagcgcaaaagatg

SEQ ID NO: 168217 - DNA, 103 bp, Artificial Sequence
  Synthetic Polynucleotide
taatacgactcactataggggcccccagatcaatatcctgtcgccaaaggaacagaggagacctttgatgacaggatataacctggcggcagcgcaaaagatg

SEQ ID NO: 168218 - DNA, 103 bp, Artificial Sequence
  Synthetic Polynucleotide
taatacgactcactatagggctcacgcccagcccccagatcaatatcctgaacagaggagacaggatatggatctggggaacctggcggcagcgcaaaagatg

SEQ ID NO: 168219 - DNA, 103 bp, Artificial Sequence
  Synthetic Polynucleotide
taatacgactcactatagggagtcaaaaacctcacgcccagcccccagataacagaggagaatctggatgctgggcgtgaacctggcggcagcgcaaaagatg

SEQ ID NO: 168220 - DNA, 103 bp, Artificial Sequence
  Synthetic Polynucleotide
taatacgactcactatagggcggtgactatagtcaaaaacctcacgcccaaacagaggagatgggcgatgggtttttgaaacctggcggcagcgcaaaagatg

SEQ ID NO: 168221 - DNA, 103 bp, Artificial Sequence
  Synthetic Polynucleotide
taatacgactcactatagggctccttctggcggtgactatagtcaaaaacaacagaggagagtttttatgtatagtcacaacctggcggcagcgcaaaagatg

SEQ ID NO: 168222 - DNA, 103 bp, Artificial Sequence
  Synthetic Polynucleotide
taatacgactcactatagggccacatcctgctccttctggcggtgactataacagaggagaatagtcatggccagaaggaacctggcggcagcgcaaaagatg

SEQ ID NO: 168223 - DNA, 103 bp, Artificial Sequence
  Synthetic Polynucleotide
taatacgactcactatagggtccacccgtaccccaatcaaactcagcagaaacagaggagatctgctatgtttgattggaacctggcggcagcgcaaaagatg

SEQ ID NO: 168224 - DNA, 103 bp, Artificial Sequence
  Synthetic Polynucleotide
taatacgactcactatagggagctccttctccacatcctgctccttctggaacagaggagaccagaaatggcaggatgtaacctggcggcagcgcaaaagatg

SEQ ID NO: 168225 - DNA, 103 bp, Artificial Sequence
  Synthetic Polynucleotide
taatacgactcactatagggtccatctcgcagctccttctccacatcctgaacagaggagacaggatatggagaaggagaacctggcggcagcgcaaaagatg

SEQ ID NO: 168226 - DNA, 103 bp, Artificial Sequence
  Synthetic Polynucleotide
taatacgactcactatagggcctgctcgcctccatctcgcagctccttctaacagaggagaagaaggatgtgcgagatgaacctggcggcagcgcaaaagatg

SEQ ID NO: 168227 - DNA, 103 bp, Artificial Sequence
  Synthetic Polynucleotide
taatacgactcactataggggcccaggtgtcctgctcgcctccatctcgcaacagaggagagcgagaatgaggcgagcaaacctggcggcagcgcaaaagatg

SEQ ID NO: 168228 - DNA, 103 bp, Artificial Sequence
  Synthetic Polynucleotide
taatacgactcactataggggccctcgcctgcccaggtgtcctgctcgccaacagaggagaggcgagatggacacctggaacctggcggcagcgcaaaagatg

SEQ ID NO: 168229 - DNA, 103 bp, Artificial Sequence
  Synthetic Polynucleotide
taatacgactcactataggggagcttccgcgccctcgcctgcccaggtgtaacagaggagaacacctatgcaggcgaggaacctggcggcagcgcaaaagatg

SEQ ID NO: 168230 - DNA, 103 bp, Artificial Sequence
  Synthetic Polynucleotide
taatacgactcactatagggttccgtgccagagcttccgcgccctcgcctaacagaggagaaggcgaatgcgcggaagcaacctggcggcagcgcaaaagatg

SEQ ID NO: 168231 - DNA, 103 bp, Artificial Sequence
  Synthetic Polynucleotide
taatacgactcactatagggcactagcaggttccgtgccagagcttccgcaacagaggagagcggaaatgctggcacggaacctggcggcagcgcaaaagatg

SEQ ID NO: 168232 - DNA, 103 bp, Artificial Sequence
  Synthetic Polynucleotide
taatacgactcactatagggtctctccatccactagcaggttccgtgccaaacagaggagatggcacatgacctgctagaacctggcggcagcgcaaaagatg

SEQ ID NO: 168233 - DNA, 103 bp, Artificial Sequence
  Synthetic Polynucleotide
taatacgactcactatagggctctccccagtctctccatccactagcaggaacagaggagacctgctatgggatggagaaacctggcggcagcgcaaaagatg

SEQ ID NO: 168234 - DNA, 103 bp, Artificial Sequence
  Synthetic Polynucleotide
taatacgactcactatagggagtatccacgtccacccgtaccccaatcaaaacagaggagattgattatggtacgggtgaacctggcggcagcgcaaaagatg

SEQ ID NO: 168235 - DNA, 103 bp, Artificial Sequence
  Synthetic Polynucleotide
taatacgactcactatagggtgcagggaagctctccccagtctctccatcaacagaggagagatggaatgactggggagaacctggcggcagcgcaaaagatg

SEQ ID NO: 168236 - DNA, 103 bp, Artificial Sequence
  Synthetic Polynucleotide
taatacgactcactatagggctggaaactgtgcagggaagctctccccagaacagaggagactggggatggcttccctgaacctggcggcagcgcaaaagatg

SEQ ID NO: 168237 - DNA, 103 bp, Artificial Sequence
  Synthetic Polynucleotide
taatacgactcactataggggaaatgtctgctggaaactgtgcagggaagaacagaggagacttcccatgacagtttccaacctggcggcagcgcaaaagatg

SEQ ID NO: 168238 - DNA, 103 bp, Artificial Sequence
  Synthetic Polynucleotide
taatacgactcactatagggtgttatgctggaaatgtctgctggaaactgaacagaggagacagtttatggcagacattaacctggcggcagcgcaaaagatg

SEQ ID NO: 168239 - DNA, 103 bp, Artificial Sequence
  Synthetic Polynucleotide
taatacgactcactataggggcactgcttctgttatgctggaaatgtctgaacagaggagacagacaatgccagcataaaacctggcggcagcgcaaaagatg

SEQ ID NO: 168240 - DNA, 103 bp, Artificial Sequence
  Synthetic Polynucleotide
taatacgactcactatagggctctcactaggcactgcttctgttatgctgaacagaggagacagcatatgagaagcagtaacctggcggcagcgcaaaagatg

SEQ ID NO: 168241 - DNA, 103 bp, Artificial Sequence
  Synthetic Polynucleotide
taatacgactcactatagggagggggctcactctcactaggcactgcttcaacagaggagagaagcaatgcctagtgagaacctggcggcagcgcaaaagatg

SEQ ID NO: 168242 - DNA, 103 bp, Artificial Sequence
  Synthetic Polynucleotide
taatacgactcactatagggtttgaagagcagggggctcactctcactagaacagaggagactagtgatggtgagccccaacctggcggcagcgcaaaagatg

SEQ ID NO: 168243 - DNA, 103 bp, Artificial Sequence
  Synthetic Polynucleotide
taatacgactcactatagggaagaggttgttttgaagagcagggggctcaaacagaggagatgagccatgtgctcttcaaacctggcggcagcgcaaaagatg

SEQ ID NO: 168244 - DNA, 103 bp, Artificial Sequence
  Synthetic Polynucleotide
taatacgactcactatagggaagaggagacaagaggttgttttgaagagcaacagaggagagctcttatgaacaacctcaacctggcggcagcgcaaaagatg

SEQ ID NO: 168245 - DNA, 103 bp, Artificial Sequence
  Synthetic Polynucleotide
taatacgactcactatagggaggtcaggtaagtatccacgtccacccgtaaacagaggagatacgggatgacgtggataaacctggcggcagcgcaaaagatg

SEQ ID NO: 168246 - DNA, 103 bp, Artificial Sequence
  Synthetic Polynucleotide
taatacgactcactatagggtcccggtcagaagaggagacaagaggttgtaacagaggagaacaaccatgtgtctcctcaacctggcggcagcgcaaaagatg

SEQ ID NO: 168247 - DNA, 103 bp, Artificial Sequence
  Synthetic Polynucleotide
taatacgactcactatagggggtgactctgtcccggtcagaagaggagacaacagaggagagtctccatgtctgaccggaacctggcggcagcgcaaaagatg

SEQ ID NO: 168248 - DNA, 103 bp, Artificial Sequence
  Synthetic Polynucleotide
taatacgactcactatagggcaaatcaaatggtgactctgtcccggtcagaacagaggagactgaccatgacagagtcaaacctggcggcagcgcaaaagatg

SEQ ID NO: 168249 - DNA, 103 bp, Artificial Sequence
  Synthetic Polynucleotide
taatacgactcactatagggactgctgttccaaatcaaatggtgactctgaacagaggagacagagtatgcatttgattaacctggcggcagcgcaaaagatg

SEQ ID NO: 168250 - DNA, 103 bp, Artificial Sequence
  Synthetic Polynucleotide
taatacgactcactatagggagatcttgccactgctgttccaaatcaaataacagaggagaatttgaatgggaacagcaaacctggcggcagcgcaaaagatg

SEQ ID NO: 168251 - DNA, 103 bp, Artificial Sequence
  Synthetic Polynucleotide
taatacgactcactataggggatggacatgagatcttgccactgctgttcaacagaggagagaacagatgtggcaagataacctggcggcagcgcaaaagatg

SEQ ID NO: 168252 - DNA, 103 bp, Artificial Sequence
  Synthetic Polynucleotide
taatacgactcactataggggcatttccatgatggacatgagatcttgccaacagaggagaggcaagatgtcatgtccaaacctggcggcagcgcaaaagatg

SEQ ID NO: 168253 - DNA, 103 bp, Artificial Sequence
  Synthetic Polynucleotide
taatacgactcactatagggtccatggcctgcatttccatgatggacatgaacagaggagacatgtcatgcatggaaataacctggcggcagcgcaaaagatg

SEQ ID NO: 168254 - DNA, 103 bp, Artificial Sequence
  Synthetic Polynucleotide
taatacgactcactatagggtgtgttcacttccatggcctgcatttccataacagaggagaatggaaatgcaggccatgaacctggcggcagcgcaaaagatg

SEQ ID NO: 168255 - DNA, 103 bp, Artificial Sequence
  Synthetic Polynucleotide
taatacgactcactatagggcacttgctgatgtgttcacttccatggcctaacagaggagaaggccaatgaagtgaacaaacctggcggcagcgcaaaagatg

SEQ ID NO: 168256 - DNA, 103 bp, Artificial Sequence
  Synthetic Polynucleotide
taatacgactcactatagggggaagctgtgaggtcaggtaagtatccacgaacagaggagacgtggaatgttacctgacaacctggcggcagcgcaaaagatg

SEQ ID NO: 168257 - DNA, 103 bp, Artificial Sequence
  Synthetic Polynucleotide
taatacgactcactatagggtacaggatttcacttgctgatgtgttcactaacagaggagaagtgaaatgatcagcaagaacctggcggcagcgcaaaagatg

SEQ ID NO: 168258 - DNA, 103 bp, Artificial Sequence
  Synthetic Polynucleotide
taatacgactcactatagggaggggcactgtacaggatttcacttgctgaaacagaggagatcagcaatggaaatcctgaacctggcggcagcgcaaaagatg

SEQ ID NO: 168259 - DNA, 103 bp, Artificial Sequence
  Synthetic Polynucleotide
taatacgactcactatagggggtctccaggaggggcactgtacaggatttaacagaggagaaaatccatgacagtgcccaacctggcggcagcgcaaaagatg

SEQ ID NO: 168260 - DNA, 103 bp, Artificial Sequence
  Synthetic Polynucleotide
taatacgactcactataggggtgctcagtgggtctccaggaggggcactgaacagaggagacagtgcatgtcctggagaaacctggcggcagcgcaaaagatg

SEQ ID NO: 168261 - DNA, 103 bp, Artificial Sequence
  Synthetic Polynucleotide
taatacgactcactataggggctgtagttggtgctcagtgggtctccaggaacagaggagacctggaatgccactgagcaacctggcggcagcgcaaaagatg

SEQ ID NO: 168262 - DNA, 103 bp, Artificial Sequence
  Synthetic Polynucleotide
taatacgactcactatagggtgggggcaaggctgtagttggtgctcagtgaacagaggagacactgaatgccaactacaaacctggcggcagcgcaaaagatg

SEQ ID NO: 168263 - DNA, 103 bp, Artificial Sequence
  Synthetic Polynucleotide
taatacgactcactatagggatgggagtgttgggggcaaggctgtagttgaacagaggagacaactaatgccttgccccaacctggcggcagcgcaaaagatg

SEQ ID NO: 168264 - DNA, 103 bp, Artificial Sequence
  Synthetic Polynucleotide
taatacgactcactatagggattctgattgatgggagtgttgggggcaagaacagaggagacttgccatgaacactcccaacctggcggcagcgcaaaagatg

SEQ ID NO: 168265 - DNA, 103 bp, Artificial Sequence
  Synthetic Polynucleotide
taatacgactcactataggggcaggctgacattctgattgatgggagtgtaacagaggagaacactcatgtcaatcagaaacctggcggcagcgcaaaagatg

SEQ ID NO: 168266 - DNA, 103 bp, Artificial Sequence
  Synthetic Polynucleotide
taatacgactcactataggggacgcctgatgcaggctgacattctgattgaacagaggagacaatcaatgtgtcagcctaacctggcggcagcgcaaaagatg

SEQ ID NO: 168267 - DNA, 103 bp, Artificial Sequence
  Synthetic Polynucleotide
taatacgactcactatagggtcccggcggcggcagctccaagtccatcataacagaggagaatgatgatgttggagctgaacctggcggcagcgcaaaagatg

SEQ ID NO: 168268 - DNA, 103 bp, Artificial Sequence
  Synthetic Polynucleotide
taatacgactcactatagggactgaagtcaaatacttctcgacttactccaacagaggagaggagtaatgcgagaagtaaacctggcggcagcgcaaaagatg

SEQ ID NO: 168269 - DNA, 103 bp, Artificial Sequence
  Synthetic Polynucleotide
taatacgactcactatagggattgaattctgctgtgctttcagggtggttaacagaggagaaaccacatggaaagcacaaacctggcggcagcgcaaaagatg

SEQ ID NO: 168270 - DNA, 103 bp, Artificial Sequence
  Synthetic Polynucleotide
taatacgactcactatagggagtcagaatcattgaattctgctgtgctttaacagaggagaaaagcaatgcagaattcaaacctggcggcagcgcaaaagatg

SEQ ID NO: 168271 - DNA, 103 bp, Artificial Sequence
  Synthetic Polynucleotide
taatacgactcactataggggaaatgccggagtcagaatcattgaattctaacagaggagaagaattatgtgattctgaaacctggcggcagcgcaaaagatg

SEQ ID NO: 168272 - DNA, 103 bp, Artificial Sequence
  Synthetic Polynucleotide
taatacgactcactatagggtgtgtttagtgaaatgccggagtcagaatcaacagaggagagattctatgtccggcattaacctggcggcagcgcaaaagatg

SEQ ID NO: 168273 - DNA, 103 bp, Artificial Sequence
  Synthetic Polynucleotide
taatacgactcactatagggcactgggacttgtgtttagtgaaatgccggaacagaggagaccggcaatgcactaaacaaacctggcggcagcgcaaaagatg

SEQ ID NO: 168274 - DNA, 103 bp, Artificial Sequence
  Synthetic Polynucleotide
taatacgactcactatagggggtgatgccacactgggacttgtgtttagtaacagaggagaactaaaatgaagtcccagaacctggcggcagcgcaaaagatg

SEQ ID NO: 168275 - DNA, 103 bp, Artificial Sequence
  Synthetic Polynucleotide
taatacgactcactatagggtgagtgttctggtgatgccacactgggactaacagaggagaagtcccatggtggcatcaaacctggcggcagcgcaaaagatg

SEQ ID NO: 168276 - DNA, 103 bp, Artificial Sequence
  Synthetic Polynucleotide
taatacgactcactatagggaagattccactgagtgttctggtgatgccaaacagaggagatggcatatgcagaacactaacctggcggcagcgcaaaagatg

SEQ ID NO: 168277 - DNA, 103 bp, Artificial Sequence
  Synthetic Polynucleotide
taatacgactcactatagggccatagctggaagattccactgagtgttctaacagaggagaagaacaatgagtggaatcaacctggcggcagcgcaaaagatg

SEQ ID NO: 168278 - DNA, 103 bp, Artificial Sequence
  Synthetic Polynucleotide
taatacgactcactatagggtagtgtgtctccatagctggaagattccacaacagaggagagtggaaatgtccagctataacctggcggcagcgcaaaagatg

SEQ ID NO: 168279 - DNA, 103 bp, Artificial Sequence
  Synthetic Polynucleotide
taatacgactcactatagggtccgtcgctgactgaagtcaaatacttctcaacagaggagagagaagatgttgacttcaaacctggcggcagcgcaaaagatg

SEQ ID NO: 168280 - DNA, 103 bp, Artificial Sequence
  Synthetic Polynucleotide
taatacgactcactatagggtgaggccaagtagtgtgtctccatagctggaacagaggagaccagctatggagacacacaacctggcggcagcgcaaaagatg

SEQ ID NO: 168281 - DNA, 103 bp, Artificial Sequence
  Synthetic Polynucleotide
taatacgactcactatagggtcagaatcactgaggccaagtagtgtgtctaacagaggagaagacacatgacttggcctaacctggcggcagcgcaaaagatg

SEQ ID NO: 168282 - DNA, 103 bp, Artificial Sequence
  Synthetic Polynucleotide
taatacgactcactatagggctcttccacttcagaatcactgaggccaagaacagaggagacttggcatgagtgattctaacctggcggcagcgcaaaagatg

SEQ ID NO: 168283 - DNA, 103 bp, Artificial Sequence
  Synthetic Polynucleotide
taatacgactcactatagggcactatctagctcttccacttcagaatcacaacagaggagagtgattatgaagtggaagaacctggcggcagcgcaaaagatg

SEQ ID NO: 168284 - DNA, 103 bp, Artificial Sequence
  Synthetic Polynucleotide
taatacgactcactatagggcttccaggggcactatctagctcttccactaacagaggagaagtggaatggctagatagaacctggcggcagcgcaaaagatg

SEQ ID NO: 168285 - DNA, 103 bp, Artificial Sequence
  Synthetic Polynucleotide
taatacgactcactatagggctgtttgacacttccaggggcactatctagaacagaggagactagatatggcccctggaaacctggcggcagcgcaaaagatg

SEQ ID NO: 168286 - DNA, 103 bp, Artificial Sequence
  Synthetic Polynucleotide
taatacgactcactatagggtaggaccattctgtttgacacttccaggggaacagaggagacccctgatggtgtcaaacaacctggcggcagcgcaaaagatg

SEQ ID NO: 168287 - DNA, 103 bp, Artificial Sequence
  Synthetic Polynucleotide
taatacgactcactatagggactggtgttttaggaccattctgtttgacaaacagaggagatgtcaaatggaatggtccaacctggcggcagcgcaaaagatg

SEQ ID NO: 168288 - DNA, 103 bp, Artificial Sequence
  Synthetic Polynucleotide
taatacgactcactatagggagaagaatgtactggtgttttaggaccattaacagaggagaaatggtatgaaaacaccaaacctggcggcagcgcaaaagatg

SEQ ID NO: 168289 - DNA, 103 bp, Artificial Sequence
  Synthetic Polynucleotide
taatacgactcactatagggccatatccccagaagaatgtactggtgtttaacagaggagaaaacacatgtacattcttaacctggcggcagcgcaaaagatg

SEQ ID NO: 168290 - DNA, 103 bp, Artificial Sequence
  Synthetic Polynucleotide
taatacgactcactatagggtcatactctttccgtcgctgactgaagtcaaacagaggagatgacttatgtcagcgacgaacctggcggcagcgcaaaagatg

SEQ ID NO: 168291 - DNA, 103 bp, Artificial Sequence
  Synthetic Polynucleotide
taatacgactcactatagggaagggttgtaccatatccccagaagaatgtaacagaggagaacattcatgtggggatataacctggcggcagcgcaaaagatg

SEQ ID NO: 168292 - DNA, 103 bp, Artificial Sequence
  Synthetic Polynucleotide
taatacgactcactatagggagatggtgacaagggttgtaccatatccccaacagaggagaggggatatggtacaacccaacctggcggcagcgcaaaagatg

SEQ ID NO: 168293 - DNA, 103 bp, Artificial Sequence
  Synthetic Polynucleotide
taatacgactcactatagggtctgcccctgagatggtgacaagggttgtaaacagaggagatacaacatgtgtcaccataacctggcggcagcgcaaaagatg

SEQ ID NO: 168294 - DNA, 103 bp, Artificial Sequence
  Synthetic Polynucleotide
taatacgactcactatagggacgtgagtgctctgcccctgagatggtgacaacagaggagagtcaccatgtcaggggcaaacctggcggcagcgcaaaagatg

SEQ ID NO: 168295 - DNA, 103 bp, Artificial Sequence
  Synthetic Polynucleotide
taatacgactcactatagggggcatcatgcacgtgagtgctctgcccctgaacagaggagacaggggatgagcactcacaacctggcggcagcgcaaaagatg

SEQ ID NO: 168296 - DNA, 103 bp, Artificial Sequence
  Synthetic Polynucleotide
taatacgactcactatagggtctcacattgggcatcatgcacgtgagtgcaacagaggagagcactcatgtgcatgatgaacctggcggcagcgcaaaagatg

SEQ ID NO: 168297 - DNA, 103 bp, Artificial Sequence
  Synthetic Polynucleotide
taatacgactcactatagggtctggtgtgttctcacattgggcatcatgcaacagaggagagcatgaatgccaatgtgaaacctggcggcagcgcaaaagatg

SEQ ID NO: 168298 - DNA, 103 bp, Artificial Sequence
  Synthetic Polynucleotide
taatacgactcactatagggcaattctttctctggtgtgttctcacattgaacagaggagacaatgtatgaacacaccaaacctggcggcagcgcaaaagatg

SEQ ID NO: 168299 - DNA, 103 bp, Artificial Sequence
  Synthetic Polynucleotide
taatacgactcactataggggacttacaggcaattctttctctggtgtgtaacagaggagaacacacatgagaaagaataacctggcggcagcgcaaaagatg

SEQ ID NO: 168300 - DNA, 103 bp, Artificial Sequence
  Synthetic Polynucleotide
taatacgactcactatagggcgatgaccaggacttacaggcaattctttcaacagaggagagaaagaatggcctgtaagaacctggcggcagcgcaaaagatg

SEQ ID NO: 168301 - DNA, 103 bp, Artificial Sequence
  Synthetic Polynucleotide
taatacgactcactatagggtttttccagctcatactctttccgtcgctgaacagaggagacagcgaatgaaagagtataacctggcggcagcgcaaaagatg

SEQ ID NO: 168302 - DNA, 103 bp, Artificial Sequence
  Synthetic Polynucleotide
taatacgactcactatagggtggggttttccgatgaccaggacttacaggaacagaggagacctgtaatgcctggtcataacctggcggcagcgcaaaagatg

SEQ ID NO: 168303 - DNA, 103 bp, Artificial Sequence
  Synthetic Polynucleotide
taatacgactcactatagggcttttgtgaatggggttttccgatgaccagaacagaggagactggtcatgggaaaacccaacctggcggcagcgcaaaagatg

SEQ ID NO: 168304 - DNA, 103 bp, Artificial Sequence
  Synthetic Polynucleotide
taatacgactcactataggggaatgtttgtcttttgtgaatggggttttcaacagaggagagaaaacatgattcacaaaaacctggcggcagcgcaaaagatg

SEQ ID NO: 168305 - DNA, 103 bp, Artificial Sequence
  Synthetic Polynucleotide
taatacgactcactatagggcaagcggcttgaatgtttgtcttttgtgaaaacagaggagattcacaatggacaaacataacctggcggcagcgcaaaagatg

SEQ ID NO: 168306 - DNA, 103 bp, Artificial Sequence
  Synthetic Polynucleotide
taatacgactcactataggggatgagcctccaagcggcttgaatgtttgtaacagaggagaacaaacatgcaagccgctaacctggcggcagcgcaaaagatg

SEQ ID NO: 168307 - DNA, 103 bp, Artificial Sequence
  Synthetic Polynucleotide
taatacgactcactatagggtctcttgtgagatgagcctccaagcggcttaacagaggagaaagccgatgggaggctcaaacctggcggcagcgcaaaagatg

SEQ ID NO: 168308 - DNA, 103 bp, Artificial Sequence
  Synthetic Polynucleotide
taatacgactcactatagggcctaagttcatctcttgtgagatgagcctcaacagaggagagaggctatgctcacaagaaacctggcggcagcgcaaaagatg

SEQ ID NO: 168309 - DNA, 103 bp, Artificial Sequence
  Synthetic Polynucleotide
taatacgactcactataggggagcttttgccctaagttcatctcttgtgaaacagaggagatcacaaatgatgaacttaaacctggcggcagcgcaaaagatg

SEQ ID NO: 168310 - DNA, 103 bp, Artificial Sequence
  Synthetic Polynucleotide
taatacgactcactataggggggatatggagagcttttgccctaagttcaaacagaggagatgaactatgggcaaaagcaacctggcggcagcgcaaaagatg

SEQ ID NO: 168311 - DNA, 103 bp, Artificial Sequence
  Synthetic Polynucleotide
taatacgactcactatagggtacagggaatgggatatggagagcttttgcaacagaggagagcaaaaatgctccatatcaacctggcggcagcgcaaaagatg

SEQ ID NO: 168312 - DNA, 103 bp, Artificial Sequence
  Synthetic Polynucleotide
taatacgactcactataggggttttttctgtttttccagctcatactcttaacagaggagaaagagtatgagctggaaaaacctggcggcagcgcaaaagatg

SEQ ID NO: 168313 - DNA, 103 bp, Artificial Sequence
  Synthetic Polynucleotide
taatacgactcactatagggtgattttttctacagggaatgggatatggaaacagaggagatccataatgcattccctgaacctggcggcagcgcaaaagatg

SEQ ID NO: 168314 - DNA, 103 bp, Artificial Sequence
  Synthetic Polynucleotide
taatacgactcactataggggggaggttaatgattttttctacagggaataacagaggagaattcccatgagaaaaaataacctggcggcagcgcaaaagatg

SEQ ID NO: 168315 - DNA, 103 bp, Artificial Sequence
  Synthetic Polynucleotide
taatacgactcactataggggtcaacaacagggaggttaatgattttttcaacagaggagagaaaaaatgattaacctcaacctggcggcagcgcaaaagatg

SEQ ID NO: 168316 - DNA, 103 bp, Artificial Sequence
  Synthetic Polynucleotide
taatacgactcactatagggtttcgttgaagtcaacaacagggaggttaaaacagaggagattaaccatgctgttgttgaacctggcggcagcgcaaaagatg

SEQ ID NO: 168317 - DNA, 103 bp, Artificial Sequence
  Synthetic Polynucleotide
taatacgactcactatagggttggacatcatttcgttgaagtcaacaacaaacagaggagatgttgtatgcttcaacgaaacctggcggcagcgcaaaagatg

SEQ ID NO: 168318 - DNA, 103 bp, Artificial Sequence
  Synthetic Polynucleotide
taatacgactcactataggggaactgctctttggacatcatttcgttgaaaacagaggagattcaacatgatgatgtccaacctggcggcagcgcaaaagatg

SEQ ID NO: 168319 - DNA, 103 bp, Artificial Sequence
  Synthetic Polynucleotide
taatacgactcactataggggagcttcattgaactgctctttggacatcaaacagaggagatgatgtatgaagagcagtaacctggcggcagcgcaaaagatg

SEQ ID NO: 168320 - DNA, 103 bp, Artificial Sequence
  Synthetic Polynucleotide
taatacgactcactatagggaatgcaagttgagcttcattgaactgctctaacagaggagaagagcaatgcaatgaagcaacctggcggcagcgcaaaagatg

SEQ ID NO: 168321 - DNA, 103 bp, Artificial Sequence
  Synthetic Polynucleotide
taatacgactcactatagggatcccgaattaatgcaagttgagcttcattaacagaggagaaatgaaatgcaacttgcaaacctggcggcagcgcaaaagatg

SEQ ID NO: 168322 - DNA, 103 bp, Artificial Sequence
  Synthetic Polynucleotide
taatacgactcactatagggtcctacgtatatcccgaattaatgcaagttaacagaggagaaacttgatgtaattcgggaacctggcggcagcgcaaaagatg

SEQ ID NO: 168323 - DNA, 103 bp, Artificial Sequence
  Synthetic Polynucleotide
taatacgactcactatagggtccttttcaagttttttctgtttttccagcaacagaggagagctggaatgacagaaaaaaacctggcggcagcgcaaaagatg

SEQ ID NO: 168324 - DNA, 103 bp, Artificial Sequence
  Synthetic Polynucleotide
taatacgactcactatagggttcttacccctcctacgtatatcccgaattaacagaggagaaattcgatgtatacgtagaacctggcggcagcgcaaaagatg

SEQ ID NO: 168325 - DNA, 103 bp, Artificial Sequence
  Synthetic Polynucleotide
taatacgactcactatagggagccactttattcttacccctcctacgtataacagaggagaatacgtatgaggggtaagaacctggcggcagcgcaaaagatg

SEQ ID NO: 168326 - DNA, 103 bp, Artificial Sequence
  Synthetic Polynucleotide
taatacgactcactatagggaattctgagcagccactttattcttaccccaacagaggagaggggtaatgataaagtggaacctggcggcagcgcaaaagatg

SEQ ID NO: 168327 - DNA, 103 bp, Artificial Sequence
  Synthetic Polynucleotide
taatacgactcactatagggctttttctgcaattctgagcagccactttaaacagaggagataaagtatgtgctcagaaaacctggcggcagcgcaaaagatg

SEQ ID NO: 168328 - DNA, 103 bp, Artificial Sequence
  Synthetic Polynucleotide
taatacgactcactatagggttccagttttctttttctgcaattctgagcaacagaggagagctcagatgtgcagaaaaaacctggcggcagcgcaaaagatg

SEQ ID NO: 168329 - DNA, 103 bp, Artificial Sequence
  Synthetic Polynucleotide
taatacgactcactatagggctactatattttccagttttctttttctgcaacagaggagagcagaaatggaaaactggaacctggcggcagcgcaaaagatg

SEQ ID NO: 168330 - DNA, 103 bp, Artificial Sequence
  Synthetic Polynucleotide
taatacgactcactatagggtgctctagttctactatattttccagttttaacagaggagaaaaactatgaaatatagtaacctggcggcagcgcaaaagatg

SEQ ID NO: 168331 - DNA, 103 bp, Artificial Sequence
  Synthetic Polynucleotide
taatacgactcactatagggatctaaatcttgctctagttctactatattaacagaggagaaatataatggaactagagaacctggcggcagcgcaaaagatg

SEQ ID NO: 168332 - DNA, 103 bp, Artificial Sequence
  Synthetic Polynucleotide
taatacgactcactatagggctttcaaatgatctaaatcttgctctagttaacagaggagaaactagatgaagatttagaacctggcggcagcgcaaaagatg

SEQ ID NO: 168333 - DNA, 103 bp, Artificial Sequence
  Synthetic Polynucleotide
taatacgactcactatagggtctttttcatctttcaaatgatctaaatctaacagaggagaagatttatgtcatttgaaaacctggcggcagcgcaaaagatg

SEQ ID NO: 168334 - DNA, 103 bp, Artificial Sequence
  Synthetic Polynucleotide
taatacgactcactatagggttcttgtctttccttttcaagttttttctgaacagaggagacagaaaatgcttgaaaagaacctggcggcagcgcaaaagatg

SEQ ID NO: 168335 - DNA, 103 bp, Artificial Sequence
  Synthetic Polynucleotide
taatacgactcactataggggagcaatttttctttttcatctttcaaatgaacagaggagacatttgatggatgaaaaaaacctggcggcagcgcaaaagatg

SEQ ID NO: 168336 - DNA, 103 bp, Artificial Sequence
  Synthetic Polynucleotide
taatacgactcactatagggctttttctttgagcaatttttctttttcataacagaggagaatgaaaatgaaaaattgcaacctggcggcagcgcaaaagatg

SEQ ID NO: 168337 - DNA, 103 bp, Artificial Sequence
  Synthetic Polynucleotide
taatacgactcactatagggtcattttctcctttttctttgagcaattttaacagaggagaaaaattatgcaaagaaaaaacctggcggcagcgcaaaagatg

SEQ ID NO: 168338 - DNA, 103 bp, Artificial Sequence
  Synthetic Polynucleotide
taatacgactcactatagggaaggcttttgtcattttctcctttttctttaacagaggagaaaagaaatgggagaaaataacctggcggcagcgcaaaagatg

SEQ ID NO: 168339 - DNA, 103 bp, Artificial Sequence
  Synthetic Polynucleotide
taatacgactcactatagggtcagtaggtgaaggcttttgtcattttctcaacagaggagagagaaaatgacaaaagccaacctggcggcagcgcaaaagatg

SEQ ID NO: 168340 - DNA, 103 bp, Artificial Sequence
  Synthetic Polynucleotide
taatacgactcactatagggagttgttttttcagtaggtgaaggcttttgaacagaggagacaaaagatgtcacctactaacctggcggcagcgcaaaagatg

SEQ ID NO: 168341 - DNA, 103 bp, Artificial Sequence
  Synthetic Polynucleotide
taatacgactcactatagggtaaggtgctgagttgttttttcagtaggtgaacagaggagacacctaatgaaaaaacaaaacctggcggcagcgcaaaagatg

SEQ ID NO: 168342 - DNA, 103 bp, Artificial Sequence
  Synthetic Polynucleotide
taatacgactcactatagggcttcgagatataaggtgctgagttgtttttaacagaggagaaaaaacatgtcagcacctaacctggcggcagcgcaaaagatg

SEQ ID NO: 168343 - DNA, 103 bp, Artificial Sequence
  Synthetic Polynucleotide
taatacgactcactatagggatgctgaaaacttcgagatataaggtgctgaacagaggagacagcacatgatatctcgaaacctggcggcagcgcaaaagatg

SEQ ID NO: 168344 - DNA, 103 bp, Artificial Sequence
  Synthetic Polynucleotide
taatacgactcactatagggatcacgtagcatgctgaaaacttcgagataaacagaggagatatctcatggttttcagcaacctggcggcagcgcaaaagatg

SEQ ID NO: 168345 - DNA, 103 bp, Artificial Sequence
  Synthetic Polynucleotide
taatacgactcactatagggtttggagttgttcttgtctttccttttcaaaacagaggagattgaaaatgaaagacaagaacctggcggcagcgcaaaagatg

SEQ ID NO: 168346 - DNA, 103 bp, Artificial Sequence
  Synthetic Polynucleotide
taatacgactcactatagggttccatcttcatcacgtagcatgctgaaaaaacagaggagattttcaatgtgctacgtgaacctggcggcagcgcaaaagatg

SEQ ID NO: 168347 - DNA, 103 bp, Artificial Sequence
  Synthetic Polynucleotide
taatacgactcactataggggaataaggttttccatcttcatcacgtagcaacagaggagagctacgatgtgaagatggaacctggcggcagcgcaaaagatg

SEQ ID NO: 168348 - DNA, 103 bp, Artificial Sequence
  Synthetic Polynucleotide
taatacgactcactatagggttcactaggagaataaggttttccatcttcaacagaggagagaagatatgaaaccttataacctggcggcagcgcaaaagatg

SEQ ID NO: 168349 - DNA, 103 bp, Artificial Sequence
  Synthetic Polynucleotide
taatacgactcactataggggcagggagtattcactaggagaataaggttaacagaggagaaaccttatgctcctagtgaacctggcggcagcgcaaaagatg

SEQ ID NO: 168350 - DNA, 103 bp, Artificial Sequence
  Synthetic Polynucleotide
taatacgactcactatagggcttgtttgctgcagggagtattcactaggaaacagaggagatcctagatgatactccctaacctggcggcagcgcaaaagatg

SEQ ID NO: 168351 - DNA, 103 bp, Artificial Sequence
  Synthetic Polynucleotide
taatacgactcactatagggattgccatctcttgtttgctgcagggagtaaacagaggagatactccatgcagcaaacaaacctggcggcagcgcaaaagatg

SEQ ID NO: 168352 - DNA, 103 bp, Artificial Sequence
  Synthetic Polynucleotide
taatacgactcactatagggcaaggaaaacattgccatctcttgtttgctaacagaggagaagcaaaatggagatggcaaacctggcggcagcgcaaaagatg

SEQ ID NO: 168353 - DNA, 103 bp, Artificial Sequence
  Synthetic Polynucleotide
taatacgactcactatagggcttttgggaacaaggaaaacattgccatctaacagaggagaagatggatgtgttttcctaacctggcggcagcgcaaaagatg

SEQ ID NO: 168354 - DNA, 103 bp, Artificial Sequence
  Synthetic Polynucleotide
taatacgactcactatagggtggcttcttacttttgggaacaaggaaaacaacagaggagagttttcatggttcccaaaaacctggcggcagcgcaaaagatg

SEQ ID NO: 168355 - DNA, 103 bp, Artificial Sequence
  Synthetic Polynucleotide
taatacgactcactatagggtcttaacatctggcttcttacttttgggaaaacagaggagattcccaatggtaagaagcaacctggcggcagcgcaaaagatg

SEQ ID NO: 168356 - DNA, 103 bp, Artificial Sequence
  Synthetic Polynucleotide
taatacgactcactatagggtcttgctccttttggagttgttcttgtcttaacagaggagaaagacaatgacaactccaaacctggcggcagcgcaaaagatg

SEQ ID NO: 168357 - DNA, 103 bp, Artificial Sequence
  Synthetic Polynucleotide
taatacgactcactatagggaaaggctttctcttgctccttttggagttgaacagaggagacaactcatgaaggagcaaaacctggcggcagcgcaaaagatg

SEQ ID NO: 168358 - DNA, 103 bp, Artificial Sequence
  Synthetic Polynucleotide
taatacgactcactataggggggacgggagtcccggcggcggcagctccaaacagaggagatggagcatgcgccgccggaacctggcggcagcgcaaaagatg

SEQ ID NO: 168359 - DNA, 103 bp, Artificial Sequence
  Synthetic Polynucleotide
taatacgactcactatagggactgagcgaaaaaggctttctcttgctcctaacagaggagaaggagcatgagaaagcctaacctggcggcagcgcaaaagatg

SEQ ID NO: 168360 - DNA, 103 bp, Artificial Sequence
  Synthetic Polynucleotide
taatacgactcactatagggtctagttgtaactgagcgaaaaaggctttcaacagaggagagaaagcatgtttcgctcaaacctggcggcagcgcaaaagatg

SEQ ID NO: 168361 - DNA, 103 bp, Artificial Sequence
  Synthetic Polynucleotide
taatacgactcactatagggtgtctcttcatctagttgtaactgagcgaaaacagaggagattcgctatgttacaactaaacctggcggcagcgcaaaagatg

SEQ ID NO: 168362 - DNA, 103 bp, Artificial Sequence
  Synthetic Polynucleotide
taatacgactcactataggggaaattcacctgtctcttcatctagttgtaaacagaggagatacaacatgatgaagagaaacctggcggcagcgcaaaagatg

SEQ ID NO: 168363 - DNA, 103 bp, Artificial Sequence
  Synthetic Polynucleotide
taatacgactcactatagggtgaattgggagaaattcacctgtctcttcaaacagaggagatgaagaatgaggtgaattaacctggcggcagcgcaaaagatg

SEQ ID NO: 168364 - DNA, 103 bp, Artificial Sequence
  Synthetic Polynucleotide
taatacgactcactatagggctgggctggctgaattgggagaaattcaccaacagaggagaggtgaaatgctcccaattaacctggcggcagcgcaaaagatg

SEQ ID NO: 168365 - DNA, 103 bp, Artificial Sequence
  Synthetic Polynucleotide
taatacgactcactatagggactggatgtgctgggctggctgaattgggaaacagaggagatcccaaatgagccagcccaacctggcggcagcgcaaaagatg

SEQ ID NO: 168366 - DNA, 103 bp, Artificial Sequence
  Synthetic Polynucleotide
taatacgactcactatagggctggtttctgactggatgtgctgggctggcaacagaggagagccagcatggcacatccaaacctggcggcagcgcaaaagatg

SEQ ID NO: 168367 - DNA, 103 bp, Artificial Sequence
  Synthetic Polynucleotide
taatacgactcactatagggggcagatccactggtttctgactggatgtgaacagaggagacacatcatgtcagaaaccaacctggcggcagcgcaaaagatg

SEQ ID NO: 168368 - DNA, 103 bp, Artificial Sequence
  Synthetic Polynucleotide
taatacgactcactataggggggagtagttggcagatccactggtttctgaacagaggagacagaaaatggtggatctgaacctggcggcagcgcaaaagatg

SEQ ID NO: 168369 - DNA, 103 bp, Artificial Sequence
  Synthetic Polynucleotide
taatacgactcactatagggatgtcctgctgggacgggagtcccggcggcaacagaggagagccgccatgactcccgtcaacctggcggcagcgcaaaagatg

SEQ ID NO: 168370 - DNA, 103 bp, Artificial Sequence
  Synthetic Polynucleotide
taatacgactcactatagggtgggcaacctgggagtagttggcagatccaaacagaggagatggatcatgcaactactcaacctggcggcagcgcaaaagatg

SEQ ID NO: 168371 - DNA, 103 bp, Artificial Sequence
  Synthetic Polynucleotide
taatacgactcactatagggtttgggaatgtgggcaacctgggagtagttaacagaggagaaactacatgcaggttgccaacctggcggcagcgcaaaagatg

SEQ ID NO: 168372 - DNA, 103 bp, Artificial Sequence
  Synthetic Polynucleotide
taatacgactcactatagggaagcatctgatttgggaatgtgggcaacctaacagaggagaaggttgatgacattcccaaacctggcggcagcgcaaaagatg

SEQ ID NO: 168373 - DNA, 103 bp, Artificial Sequence
  Synthetic Polynucleotide
taatacgactcactatagggtcaaagtacaaagcatctgatttgggaatgaacagaggagacattccatgatcagatgcaacctggcggcagcgcaaaagatg

SEQ ID NO: 168374 - DNA, 103 bp, Artificial Sequence
  Synthetic Polynucleotide
taatacgactcactatagggcatgcagtcatcaaagtacaaagcatctgaaacagaggagatcagatatgttgtactttaacctggcggcagcgcaaaagatg

SEQ ID NO: 168375 - DNA, 103 bp, Artificial Sequence
  Synthetic Polynucleotide
taatacgactcactatagggccaaaagctgcatgcagtcatcaaagtacaaacagaggagatgtactatgatgactgcaaacctggcggcagcgcaaaagatg

SEQ ID NO: 168376 - DNA, 103 bp, Artificial Sequence
  Synthetic Polynucleotide
taatacgactcactatagggaatgtctgcgccaaaagctgcatgcagtcaaacagaggagatgactgatggcagcttttaacctggcggcagcgcaaaagatg

SEQ ID NO: 168377 - DNA, 103 bp, Artificial Sequence
  Synthetic Polynucleotide
taatacgactcactatagggtacaaacgggaatgtctgcgccaaaagctgaacagaggagacagcttatggcgcagacaaacctggcggcagcgcaaaagatg

SEQ ID NO: 168378 - DNA, 103 bp, Artificial Sequence
  Synthetic Polynucleotide
taatacgactcactatagggcattgtcatctacaaacgggaatgtctgcgaacagaggagacgcagaatgtcccgtttgaacctggcggcagcgcaaaagatg

SEQ ID NO: 168379 - DNA, 103 bp, Artificial Sequence
  Synthetic Polynucleotide
taatacgactcactataggggaagaaacctcattgtcatctacaaacgggaacagaggagacccgttatgagatgacaaaacctggcggcagcgcaaaagatg

SEQ ID NO: 168380 - DNA, 103 bp, Artificial Sequence
  Synthetic Polynucleotide
taatacgactcactatagggaatcaaatccatgtcctgctgggacgggagaacagaggagactcccgatgcagcaggacaacctggcggcagcgcaaaagatg

SEQ ID NO: 168381 - DNA, 103 bp, Artificial Sequence
  Synthetic Polynucleotide
taatacgactcactatagggaaacgtagccgaagaaacctcattgtcatcaacagaggagagatgacatggaggtttctaacctggcggcagcgcaaaagatg

SEQ ID NO: 168382 - DNA, 103 bp, Artificial Sequence
  Synthetic Polynucleotide
taatacgactcactatagggcaagtgactgaaacgtagccgaagaaacctaacagaggagaaggtttatgcggctacgtaacctggcggcagcgcaaaagatg

SEQ ID NO: 168383 - DNA, 103 bp, Artificial Sequence
  Synthetic Polynucleotide
taatacgactcactatagggatatcaggaacaagtgactgaaacgtagccaacagaggagaggctacatgtcagtcactaacctggcggcagcgcaaaagatg

SEQ ID NO: 168384 - DNA, 103 bp, Artificial Sequence
  Synthetic Polynucleotide
taatacgactcactataggggtgaccgggaatatcaggaacaagtgactgaacagaggagacagtcaatggttcctgataacctggcggcagcgcaaaagatg

SEQ ID NO: 168385 - DNA, 103 bp, Artificial Sequence
  Synthetic Polynucleotide
taatacgactcactatagggggctctcgatgtgaccgggaatatcaggaaaacagaggagattcctgatgttcccggtcaacctggcggcagcgcaaaagatg

SEQ ID NO: 168386 - DNA, 103 bp, Artificial Sequence
  Synthetic Polynucleotide
taatacgactcactatagggatgaagactgggctctcgatgtgaccgggaaacagaggagatcccggatgcatcgagagaacctggcggcagcgcaaaagatg

SEQ ID NO: 168387 - DNA, 103 bp, Artificial Sequence
  Synthetic Polynucleotide
taatacgactcactatagggattagtagcaatgaagactgggctctcgataacagaggagaatcgagatgccagtcttcaacctggcggcagcgcaaaagatg

SEQ ID NO: 168388 - DNA, 103 bp, Artificial Sequence
  Synthetic Polynucleotide
taatacgactcactatagggactgagcctgattagtagcaatgaagactgaacagaggagacagtctatgttgctactaaacctggcggcagcgcaaaagatg

SEQ ID NO: 168389 - DNA, 103 bp, Artificial Sequence
  Synthetic Polynucleotide
taatacgactcactataggggtttcaggtgactgagcctgattagtagcaaacagaggagatgctacatgtcaggctcaaacctggcggcagcgcaaaagatg

SEQ ID NO: 168390 - DNA, 103 bp, Artificial Sequence
  Synthetic Polynucleotide
taatacgactcactatagggagcaacagaagtttcaggtgactgagcctgaacagaggagacaggctatgtcacctgaaaacctggcggcagcgcaaaagatg

SEQ ID NO: 168391 - DNA, 103 bp, Artificial Sequence
  Synthetic Polynucleotide
taatacgactcactatagggaaagtatgtcaatcaaatccatgtcctgctaacagaggagaagcaggatgtggatttgaaacctggcggcagcgcaaaagatg

SEQ ID NO: 168392 - DNA, 103 bp, Artificial Sequence
  Synthetic Polynucleotide
taatacgactcactataggggggctacctgagcaacagaagtttcaggtgaacagaggagacacctgatgcttctgttgaacctggcggcagcgcaaaagatg

SEQ ID NO: 168393 - DNA, 103 bp, Artificial Sequence
  Synthetic Polynucleotide
taatacgactcactatagggaaatcaacaggggctacctgagcaacagaaaacagaggagattctgtatgtcaggtagcaacctggcggcagcgcaaaagatg

SEQ ID NO: 168394 - DNA, 103 bp, Artificial Sequence
  Synthetic Polynucleotide
taatacgactcactatagggcataccgtctaaatcaacaggggctacctgaacagaggagacaggtaatgcctgttgataacctggcggcagcgcaaaagatg

SEQ ID NO: 168395 - DNA, 103 bp, Artificial Sequence
  Synthetic Polynucleotide
taatacgactcactatagggtgtcctgttgcataccgtctaaatcaacagaacagaggagactgttgatgtagacggtaaacctggcggcagcgcaaaagatg

SEQ ID NO: 168396 - DNA, 103 bp, Artificial Sequence
  Synthetic Polynucleotide
taatacgactcactatagggacttgctcaatgtcctgttgcataccgtctaacagaggagaagacggatggcaacaggaaacctggcggcagcgcaaaagatg

SEQ ID NO: 168397 - DNA, 103 bp, Artificial Sequence
  Synthetic Polynucleotide
taatacgactcactatagggctcctcccaaacttgctcaatgtcctgttgaacagaggagacaacagatgattgagcaaaacctggcggcagcgcaaaagatg

SEQ ID NO: 168398 - DNA, 103 bp, Artificial Sequence
  Synthetic Polynucleotide
taatacgactcactatagggtggataatagctcctcccaaacttgctcaaaacagaggagattgagcatgtttgggaggaacctggcggcagcgcaaaagatg

SEQ ID NO: 168399 - DNA, 103 bp, Artificial Sequence
  Synthetic Polynucleotide
taatacgactcactatagggaactcaggaatggataatagctcctcccaaaacagaggagattgggaatggctattatcaacctggcggcagcgcaaaagatg

SEQ ID NO: 168400 - DNA, 103 bp, Artificial Sequence
  Synthetic Polynucleotide
taatacgactcactatagggaagacactgtaactcaggaatggataatagaacagaggagactattaatgattcctgagaacctggcggcagcgcaaaagatg

SEQ ID NO: 168401 - DNA, 103 bp, Artificial Sequence
  Synthetic Polynucleotide
taatacgactcactatagggtttcaatattaagacactgtaactcaggaaaacagaggagattcctgatgtacagtgtcaacctggcggcagcgcaaaagatg

SEQ ID NO: 168402 - DNA, 103 bp, Artificial Sequence
  Synthetic Polynucleotide
taatacgactcactatagggtcttgcctccaaagtatgtcaatcaaatccaacagaggagaggatttatgtgacatactaacctggcggcagcgcaaaagatg

SEQ ID NO: 168403 - DNA, 103 bp, Artificial Sequence
  Synthetic Polynucleotide
taatacgactcactatagggagcttgtcattttcaatattaagacactgtaacagaggagaacagtgatgtaatattgaaacctggcggcagcgcaaaagatg

SEQ ID NO: 168404 - DNA, 103 bp, Artificial Sequence
  Synthetic Polynucleotide
taatacgactcactatagggagtctcaaccagcttgtcattttcaatattaacagaggagaaatattatgaatgacaagaacctggcggcagcgcaaaagatg

SEQ ID NO: 168405 - DNA, 103 bp, Artificial Sequence
  Synthetic Polynucleotide
taatacgactcactataggggaaccatggtagtctcaaccagcttgtcataacagaggagaatgacaatgtggttgagaaacctggcggcagcgcaaaagatg

SEQ ID NO: 168406 - DNA, 103 bp, Artificial Sequence
  Synthetic Polynucleotide
taatacgactcactatagggtctggacttggaaccatggtagtctcaaccaacagaggagaggttgaatgtaccatggtaacctggcggcagcgcaaaagatg

SEQ ID NO: 168407 - DNA, 103 bp, Artificial Sequence
  Synthetic Polynucleotide
taatacgactcactatagggcagtttggcttctggacttggaaccatggtaacagaggagaaccatgatgccaagtccaaacctggcggcagcgcaaaagatg

SEQ ID NO: 168408 - DNA, 103 bp, Artificial Sequence
  Synthetic Polynucleotide
taatacgactcactatagggcaacttctgtcagtttggcttctggacttgaacagaggagacaagtcatgaagccaaacaacctggcggcagcgcaaaagatg

SEQ ID NO: 168409 - DNA, 103 bp, Artificial Sequence
  Synthetic Polynucleotide
taatacgactcactatagggtgataattgtcaacttctgtcagtttggctaacagaggagaagccaaatggacagaagtaacctggcggcagcgcaaaagatg

SEQ ID NO: 168410 - DNA, 103 bp, Artificial Sequence
  Synthetic Polynucleotide
taatacgactcactatagggtgagtaaaaatgataattgtcaacttctgtaacagaggagaacagaaatggacaattataacctggcggcagcgcaaaagatg

SEQ ID NO: 168411 - DNA, 103 bp, Artificial Sequence
  Synthetic Polynucleotide
taatacgactcactatagggagggtatagatgagtaaaaatgataattgtaacagaggagaacaattatgatttttactaacctggcggcagcgcaaaagatg

SEQ ID NO: 168412 - DNA, 103 bp, Artificial Sequence
  Synthetic Polynucleotide
taatacgactcactatagggttttccattgagggtatagatgagtaaaaaaacagaggagatttttaatgatctataccaacctggcggcagcgcaaaagatg

SEQ ID NO: 168413 - DNA, 103 bp, Artificial Sequence
  Synthetic Polynucleotide
taatacgactcactatagggaagatctatatcttgcctccaaagtatgtcaacagaggagagacataatgtggaggcaaaacctggcggcagcgcaaaagatg

SEQ ID NO: 168414 - DNA, 103 bp, Artificial Sequence
  Synthetic Polynucleotide
taatacgactcactatagggacctacttctttttccattgagggtatagaaacagaggagatctataatgtcaatggaaaacctggcggcagcgcaaaagatg

SEQ ID NO: 168415 - DNA, 103 bp, Artificial Sequence
  Synthetic Polynucleotide
taatacgactcactataggggactacagttacctacttctttttccattgaacagaggagacaatggatgaagaagtagaacctggcggcagcgcaaaagatg

SEQ ID NO: 168416 - DNA, 103 bp, Artificial Sequence
  Synthetic Polynucleotide
taatacgactcactatagggagaaaatgtggactacagttacctacttctaacagaggagaagaagtatgtaactgtagaacctggcggcagcgcaaaagatg

SEQ ID NO: 168417 - DNA, 103 bp, Artificial Sequence
  Synthetic Polynucleotide
taatacgactcactatagggaaaagcattaagaaaatgtggactacagttaacagaggagaaactgtatgccacattttaacctggcggcagcgcaaaagatg

SEQ ID NO: 168418 - DNA, 103 bp, Artificial Sequence
  Synthetic Polynucleotide
taatacgactcactatagggaggaatcctcaaaagcattaagaaaatgtgaacagaggagacacattatgttaatgcttaacctggcggcagcgcaaaagatg

SEQ ID NO: 168419 - DNA, 103 bp, Artificial Sequence
  Synthetic Polynucleotide
taatacgactcactatagggatgctgctgaaggaatcctcaaaagcattaaacagaggagataatgcatgtgaggattcaacctggcggcagcgcaaaagatg

SEQ ID NO: 168420 - DNA, 103 bp, Artificial Sequence
  Synthetic Polynucleotide
taatacgactcactatagggtgtggagaggatgctgctgaaggaatcctcaacagaggagagaggatatgttcagcagcaacctggcggcagcgcaaaagatg

SEQ ID NO: 168421 - DNA, 103 bp, Artificial Sequence
  Synthetic Polynucleotide
taatacgactcactatagggtggggtcttctgtggagaggatgctgctgaaacagaggagatcagcaatgtcctctccaaacctggcggcagcgcaaaagatg

SEQ ID NO: 168422 - DNA, 103 bp, Artificial Sequence
  Synthetic Polynucleotide
taatacgactcactataggggtcaactggttggggtcttctgtggagaggaacagaggagacctctcatgagaagacccaacctggcggcagcgcaaaagatg

SEQ ID NO: 168423 - DNA, 103 bp, Artificial Sequence
  Synthetic Polynucleotide
taatacgactcactatagggtgagttcactgtcaactggttggggtcttcaacagaggagagaagacatgaaccagttgaacctggcggcagcgcaaaagatg

SEQ ID NO: 168424 - DNA, 103 bp, Artificial Sequence
  Synthetic Polynucleotide
taatacgactcactataggggacttactccaagatctatatcttgcctccaacagaggagaggaggcatgatatagatcaacctggcggcagcgcaaaagatg

SEQ ID NO: 168425 - DNA, 103 bp, Artificial Sequence
  Synthetic Polynucleotide
taatacgactcactatagggctgaatttaatgagttcactgtcaactggtaacagaggagaaccagtatgcagtgaactaacctggcggcagcgcaaaagatg

SEQ ID NO: 168426 - DNA, 103 bp, Artificial Sequence
  Synthetic Polynucleotide
taatacgactcactatagggactgtggcatctgaatttaatgagttcactaacagaggagaagtgaaatgattaaattcaacctggcggcagcgcaaaagatg

SEQ ID NO: 168427 - DNA, 103 bp, Artificial Sequence
  Synthetic Polynucleotide
taatacgactcactatagggatctgtgttgactgtggcatctgaatttaaaacagaggagattaaatatggatgccacaaacctggcggcagcgcaaaagatg

SEQ ID NO: 168428 - DNA, 103 bp, Artificial Sequence
  Synthetic Polynucleotide
taatacgactcactatagggcatcaccaaaatctgtgttgactgtggcataacagaggagaatgccaatgtcaacacagaacctggcggcagcgcaaaagatg

SEQ ID NO: 168429 - DNA, 103 bp, Artificial Sequence
  Synthetic Polynucleotide
taatacgactcactataggggaataaaattcatcaccaaaatctgtgttgaacagaggagacaacacatgttttggtgaaacctggcggcagcgcaaaagatg

SEQ ID NO: 168430 - DNA, 103 bp, Artificial Sequence
  Synthetic Polynucleotide
taatacgactcactatagggtatgaaagcagaataaaattcatcaccaaaaacagaggagatttggtatggaattttataacctggcggcagcgcaaaagatg

SEQ ID NO: 168431 - DNA, 103 bp, Artificial Sequence
  Synthetic Polynucleotide
taatacgactcactatagggtgggctcagctatgaaagcagaataaaattaacagaggagaaattttatgctgctttcaaacctggcggcagcgcaaaagatg

SEQ ID NO: 168432 - DNA, 103 bp, Artificial Sequence
  Synthetic Polynucleotide
taatacgactcactatagggttgctgatactgggctcagctatgaaagcaaacagaggagatgctttatgagctgagccaacctggcggcagcgcaaaagatg

SEQ ID NO: 168433 - DNA, 103 bp, Artificial Sequence
  Synthetic Polynucleotide
taatacgactcactataggggggcatgctgttgctgatactgggctcagcaacagaggagagctgagatgagtatcagcaacctggcggcagcgcaaaagatg

SEQ ID NO: 168434 - DNA, 103 bp, Artificial Sequence
  Synthetic Polynucleotide
taatacgactcactatagggtagcaggtgagggcatgctgttgctgatacaacagaggagagtatcaatgacagcatgcaacctggcggcagcgcaaaagatg

SEQ ID NO: 168435 - DNA, 103 bp, Artificial Sequence
  Synthetic Polynucleotide
taatacgactcactatagggaatacttctcgacttactccaagatctataaacagaggagatatagaatgtggagtaagaacctggcggcagcgcaaaagatg

SEQ ID NO: 168436 - DNA, 103 bp, Artificial Sequence
  Synthetic Polynucleotide
taatacgactcactatagggtggcttaaagtagcaggtgagggcatgctgaacagaggagacagcatatgctcacctgcaacctggcggcagcgcaaaagatg

SEQ ID NO: 168437 - DNA, 103 bp, Artificial Sequence
  Synthetic Polynucleotide
taatacgactcactatagggagagagtgaatggcttaaagtagcaggtgaaacagaggagatcacctatgactttaagcaacctggcggcagcgcaaaagatg

SEQ ID NO: 168438 - DNA, 103 bp, Artificial Sequence
  Synthetic Polynucleotide
taatacgactcactatagggttagaagttcagagagtgaatggcttaaagaacagaggagactttaaatgattcactctaacctggcggcagcgcaaaagatg

SEQ ID NO: 168439 - DNA, 103 bp, Artificial Sequence
  Synthetic Polynucleotide
taatacgactcactatagggatgggcccatttagaagttcagagagtgaaaacagaggagattcactatgtgaacttctaacctggcggcagcgcaaaagatg

SEQ ID NO: 168440 - DNA, 103 bp, Artificial Sequence
  Synthetic Polynucleotide
taatacgactcactatagggagaaacatcaatgggcccatttagaagttcaacagaggagagaacttatgaatgggcccaacctggcggcagcgcaaaagatg

SEQ ID NO: 168441 - DNA, 103 bp, Artificial Sequence
  Synthetic Polynucleotide
taatacgactcactataggggtgatagatcagaaacatcaatgggcccataacagaggagaatgggcatgttgatgtttaacctggcggcagcgcaaaagatg

SEQ ID NO: 168442 - DNA, 103 bp, Artificial Sequence
  Synthetic Polynucleotide
taatacgactcactataggggctttgcaaagtgatagatcagaaacatcaaacagaggagatgatgtatgtgatctatcaacctggcggcagcgcaaaagatg

SEQ ID NO: 168443 - DNA, 103 bp, Artificial Sequence
  Synthetic Polynucleotide
taatacgactcactatagggttggttgaaagctttgcaaagtgatagatcaacagaggagagatctaatgctttgcaaaaacctggcggcagcgcaaaagatg

SEQ ID NO: 168444 - DNA, 103 bp, Artificial Sequence
  Synthetic Polynucleotide
taatacgactcactatagggcagggtggttttggttgaaagctttgcaaaaacagaggagatttgcaatgctttcaaccaacctggcggcagcgcaaaagatg

SEQ ID NO: 168445 - DNA, 103 bp, Artificial Sequence
  Synthetic Polynucleotide
taatacgactcactataggggctgtgctttcagggtggttttggttgaaaaacagaggagatttcaaatgaaaccacccaacctggcggcagcgcaaaagatg

SEQ ID NO: 168446 - DNA, 103 bp, Artificial Sequence
  Synthetic Polynucleotide
taatacgactcactatagggggccgaccaccaccgcttcaggtgcttcataacagaggagaatgaagatgctgaagcggaacctggcggcagcgcaaaagatg

SEQ ID NO: 168447 - DNA, 103 bp, Artificial Sequence
  Synthetic Polynucleotide
taatacgactcactatagggggtgggcggcggcagcagcaggtaaagatcaacagaggagagatcttatgctgctgctgaacctggcggcagcgcaaaagatg

SEQ ID NO: 168448 - DNA, 103 bp, Artificial Sequence
  Synthetic Polynucleotide
taatacgactcactatagggttcttgtgactgtgaagtccttgctgttggaacagaggagaccaacaatgaggacttcaaacctggcggcagcgcaaaagatg

SEQ ID NO: 168449 - DNA, 103 bp, Artificial Sequence
  Synthetic Polynucleotide
taatacgactcactataggggcagaaatggttcttgtgactgtgaagtccaacagaggagaggacttatgagtcacaagaacctggcggcagcgcaaaagatg

SEQ ID NO: 168450 - DNA, 103 bp, Artificial Sequence
  Synthetic Polynucleotide
taatacgactcactataggggaatttaactgcagaaatggttcttgtgacaacagaggagagtcacaatgaccatttctaacctggcggcagcgcaaaagatg

SEQ ID NO: 168451 - DNA, 103 bp, Artificial Sequence
  Synthetic Polynucleotide
taatacgactcactatagggggtggtatgagaatttaactgcagaaatggaacagaggagaccatttatgcagttaaataacctggcggcagcgcaaaagatg

SEQ ID NO: 168452 - DNA, 103 bp, Artificial Sequence
  Synthetic Polynucleotide
taatacgactcactataggggctcaggattggtggtatgagaatttaactaacagaggagaagttaaatgctcataccaaacctggcggcagcgcaaaagatg

SEQ ID NO: 168453 - DNA, 103 bp, Artificial Sequence
  Synthetic Polynucleotide
taatacgactcactatagggggaagggtttgctcaggattggtggtatgaaacagaggagatcatacatgcaatcctgaaacctggcggcagcgcaaaagatg

SEQ ID NO: 168454 - DNA, 103 bp, Artificial Sequence
  Synthetic Polynucleotide
taatacgactcactatagggattagttccaggaagggtttgctcaggattaacagaggagaaatcctatgcaaacccttaacctggcggcagcgcaaaagatg

SEQ ID NO: 168455 - DNA, 103 bp, Artificial Sequence
  Synthetic Polynucleotide
taatacgactcactatagggatcctgtcaaattagttccaggaagggtttaacagaggagaaaacccatgctggaactaaacctggcggcagcgcaaaagatg

SEQ ID NO: 168456 - DNA, 103 bp, Artificial Sequence
  Synthetic Polynucleotide
taatacgactcactatagggggtgaaagaaatcctgtcaaattagttccaaacagaggagatggaacatgtttgacaggaacctggcggcagcgcaaaagatg

SEQ ID NO: 168457 - DNA, 103 bp, Artificial Sequence
  Synthetic Polynucleotide
taatacgactcactatagggattgtcaaccggtgaaagaaatcctgtcaaaacagaggagattgacaatgtttctttcaaacctggcggcagcgcaaaagatg

SEQ ID NO: 168458 - DNA, 103 bp, Artificial Sequence
  Synthetic Polynucleotide
taatacgactcactatagggcctgcagcagggtgggcggcggcagcagcaaacagaggagatgctgcatgcgccgcccaaacctggcggcagcgcaaaagatg

SEQ ID NO: 168459 - DNA, 103 bp, Artificial Sequence
  Synthetic Polynucleotide
taatacgactcactatagggtcctcatatgattgtcaaccggtgaaagaaaacagaggagattctttatgcggttgacaaacctggcggcagcgcaaaagatg

SEQ ID NO: 168460 - DNA, 103 bp, Artificial Sequence
  Synthetic Polynucleotide
taatacgactcactatagggcttgttagattcctcatatgattgtcaaccaacagaggagaggttgaatgtcatatgagaacctggcggcagcgcaaaagatg

SEQ ID NO: 168461 - DNA, 103 bp, Artificial Sequence
  Synthetic Polynucleotide
taatacgactcactatagggtaggtcttggcttgttagattcctcatatgaacagaggagacatatgatgaatctaacaaacctggcggcagcgcaaaagatg

SEQ ID NO: 168462 - DNA, 103 bp, Artificial Sequence
  Synthetic Polynucleotide
taatacgactcactatagggggtcatacagtaggtcttggcttgttagataacagaggagaatctaaatggccaagaccaacctggcggcagcgcaaaagatg

SEQ ID NO: 168463 - DNA, 103 bp, Artificial Sequence
  Synthetic Polynucleotide
taatacgactcactatagggtttatgtcaaggtcatacagtaggtcttggaacagaggagaccaagaatgactgtatgaaacctggcggcagcgcaaaagatg

SEQ ID NO: 168464 - DNA, 103 bp, Artificial Sequence
  Synthetic Polynucleotide
taatacgactcactatagggatcaaatatatttatgtcaaggtcatacagaacagaggagactgtatatgcttgacataaacctggcggcagcgcaaaagatg

SEQ ID NO: 168465 - DNA, 103 bp, Artificial Sequence
  Synthetic Polynucleotide
taatacgactcactatagggagtttatctcatcaaatatatttatgtcaaaacagaggagattgacaatgatatatttgaacctggcggcagcgcaaaagatg

SEQ ID NO: 168466 - DNA, 103 bp, Artificial Sequence
  Synthetic Polynucleotide
taatacgactcactatagggaatgacattaagtttatctcatcaaatataaacagaggagatatattatgtgagataaaaacctggcggcagcgcaaaagatg

SEQ ID NO: 168467 - DNA, 103 bp, Artificial Sequence
  Synthetic Polynucleotide
taatacgactcactatagggttctgtggccaatgacattaagtttatctcaacagaggagagagataatgttaatgtcaaacctggcggcagcgcaaaagatg

SEQ ID NO: 168468 - DNA, 103 bp, Artificial Sequence
  Synthetic Polynucleotide
taatacgactcactatagggcaaagttgtcttctgtggccaatgacattaaacagaggagataatgtatgtggccacagaacctggcggcagcgcaaaagatg

SEQ ID NO: 168469 - DNA, 103 bp, Artificial Sequence
  Synthetic Polynucleotide
taatacgactcactatagggagcagctcgtcctgcagcagggtgggcggcaacagaggagagccgccatgcctgctgcaaacctggcggcagcgcaaaagatg

SEQ ID NO: 168470 - DNA, 103 bp, Artificial Sequence
  Synthetic Polynucleotide
taatacgactcactatagggtcgattggatcaaagttgtcttctgtggccaacagaggagaggccacatgagacaacttaacctggcggcagcgcaaaagatg

SEQ ID NO: 168471 - DNA, 103 bp, Artificial Sequence
  Synthetic Polynucleotide
taatacgactcactatagggctgagaaacatcgattggatcaaagttgtcaacagaggagagacaacatggatccaatcaacctggcggcagcgcaaaagatg

SEQ ID NO: 168472 - DNA, 103 bp, Artificial Sequence
  Synthetic Polynucleotide
taatacgactcactatagggcatcaaaaagctgagaaacatcgattggataacagaggagaatccaaatgatgtttctcaacctggcggcagcgcaaaagatg

SEQ ID NO: 168473 - DNA, 103 bp, Artificial Sequence
  Synthetic Polynucleotide
taatacgactcactataggggaatctggttcatcaaaaagctgagaaacaaacagaggagatgtttcatggctttttgaaacctggcggcagcgcaaaagatg

SEQ ID NO: 168474 - DNA, 103 bp, Artificial Sequence
  Synthetic Polynucleotide
taatacgactcactataggggccagaatcagaatctggttcatcaaaaagaacagaggagactttttatggaaccagataacctggcggcagcgcaaaagatg

SEQ ID NO: 168475 - DNA, 103 bp, Artificial Sequence
  Synthetic Polynucleotide
taatacgactcactatagggctaaagaaaggccagaatcagaatctggttaacagaggagaaaccagatgctgattctgaacctggcggcagcgcaaaagatg

SEQ ID NO: 168476 - DNA, 103 bp, Artificial Sequence
  Synthetic Polynucleotide
taatacgactcactatagggtgacttgaatctaaagaaaggccagaatcaaacagaggagatgattcatgcctttctttaacctggcggcagcgcaaaagatg

SEQ ID NO: 168477 - DNA, 103 bp, Artificial Sequence
  Synthetic Polynucleotide
taatacgactcactatagggggtattattgtgacttgaatctaaagaaagaacagaggagactttctatggattcaagtaacctggcggcagcgcaaaagatg

SEQ ID NO: 168478 - DNA, 103 bp, Artificial Sequence
  Synthetic Polynucleotide
taatacgactcactatagggtgatgacagaggtattattgtgacttgaataacagaggagaattcaaatgacaataataaacctggcggcagcgcaaaagatg

SEQ ID NO: 168479 - DNA, 103 bp, Artificial Sequence
  Synthetic Polynucleotide
taatacgactcactataggggaattagacttgatgacagaggtattattgaacagaggagacaataaatgctctgtcataacctggcggcagcgcaaaagatg

SEQ ID NO: 168480 - DNA, 103 bp, Artificial Sequence
  Synthetic Polynucleotide
taatacgactcactataggggcccaggaacagcagctcgtcctgcagcagaacagaggagactgctgatggacgagctgaacctggcggcagcgcaaaagatg

SEQ ID NO: 168481 - DNA, 103 bp, Artificial Sequence
  Synthetic Polynucleotide
taatacgactcactatagggagagtgagaggaattagacttgatgacagaaacagaggagatctgtcatgaagtctaataacctggcggcagcgcaaaagatg

SEQ ID NO: 168482 - DNA, 103 bp, Artificial Sequence
  Synthetic Polynucleotide
taatacgactcactatagggcatcacacacagagtgagaggaattagactaacagaggagaagtctaatgcctctcactaacctggcggcagcgcaaaagatg

SEQ ID NO: 168483 - DNA, 103 bp, Artificial Sequence
  Synthetic Polynucleotide
taatacgactcactatagggatagcaccttcatcacacacagagtgagagaacagaggagactctcaatgtgtgtgtgaaacctggcggcagcgcaaaagatg

SEQ ID NO: 168484 - DNA, 103 bp, Artificial Sequence
  Synthetic Polynucleotide
taatacgactcactataggggcaataacctatagcaccttcatcacacacaacagaggagagtgtgtatggaaggtgctaacctggcggcagcgcaaaagatg

SEQ ID NO: 168485 - DNA, 103 bp, Artificial Sequence
  Synthetic Polynucleotide
taatacgactcactatagggcatggtcagtgcaataacctatagcaccttaacagaggagaaaggtgatgtaggttattaacctggcggcagcgcaaaagatg

SEQ ID NO: 168486 - DNA, 103 bp, Artificial Sequence
  Synthetic Polynucleotide
taatacgactcactataggggaactagattcatggtcagtgcaataacctaacagaggagaaggttaatgcactgaccaaacctggcggcagcgcaaaagatg

SEQ ID NO: 168487 - DNA, 103 bp, Artificial Sequence
  Synthetic Polynucleotide
taatacgactcactataggggtcatgatgggaactagattcatggtcagtaacagaggagaactgacatggaatctagtaacctggcggcagcgcaaaagatg

SEQ ID NO: 168488 - DNA, 103 bp, Artificial Sequence
  Synthetic Polynucleotide
taatacgactcactatagggcaccttctaagtcatgatgggaactagattaacagaggagaaatctaatgcccatcatgaacctggcggcagcgcaaaagatg

SEQ ID NO: 168489 - DNA, 103 bp, Artificial Sequence
  Synthetic Polynucleotide
taatacgactcactatagggccacctacagcaccttctaagtcatgatggaacagaggagaccatcaatgcttagaaggaacctggcggcagcgcaaaagatg

SEQ ID NO: 168490 - DNA, 103 bp, Artificial Sequence
  Synthetic Polynucleotide
taatacgactcactatagggtgggtagtagccacctacagcaccttctaaaacagaggagattagaaatggctgtaggtaacctggcggcagcgcaaaagatg

SEQ ID NO: 168491 - DNA, 103 bp, Artificial Sequence
  Synthetic Polynucleotide
taatacgactcactatagggtggccgggccgcccaggaacagcagctcgtaacagaggagaacgagcatgtgttcctggaacctggcggcagcgcaaaagatg

SEQ ID NO: 168492 - DNA, 103 bp, Artificial Sequence
  Synthetic Polynucleotide
taatacgactcactatagggtactgggttctgggtagtagccacctacagaacagaggagactgtagatggctactaccaacctggcggcagcgcaaaagatg

SEQ ID NO: 168493 - DNA, 103 bp, Artificial Sequence
  Synthetic Polynucleotide
taatacgactcactatagggtgacaaagcttactgggttctgggtagtagaacagaggagactactaatgagaacccagaacctggcggcagcgcaaaagatg

SEQ ID NO: 168494 - DNA, 103 bp, Artificial Sequence
  Synthetic Polynucleotide
taatacgactcactatagggttgatccaagtgacaaagcttactgggttcaacagaggagagaacccatgaagctttgtaacctggcggcagcgcaaaagatg

SEQ ID NO: 168495 - DNA, 103 bp, Artificial Sequence
  Synthetic Polynucleotide
taatacgactcactatagggcagaatcactttgatccaagtgacaaagctaacagaggagaagctttatgacttggatcaacctggcggcagcgcaaaagatg

SEQ ID NO: 168496 - DNA, 103 bp, Artificial Sequence
  Synthetic Polynucleotide
taatacgactcactatagggccatggaaatcagaatcactttgatccaagaacagaggagacttggaatgaagtgattcaacctggcggcagcgcaaaagatg

SEQ ID NO: 168497 - DNA, 103 bp, Artificial Sequence
  Synthetic Polynucleotide
taatacgactcactatagggtgtaagatctccatggaaatcagaatcactaacagaggagaagtgatatggatttccataacctggcggcagcgcaaaagatg

SEQ ID NO: 168498 - DNA, 103 bp, Artificial Sequence
  Synthetic Polynucleotide
taatacgactcactatagggcgtgttgaaatgtaagatctccatggaaataacagaggagaatttccatggagatcttaaacctggcggcagcgcaaaagatg

SEQ ID NO: 168499 - DNA, 103 bp, Artificial Sequence
  Synthetic Polynucleotide
taatacgactcactatagggttatgaaatacgtgttgaaatgtaagatctaacagaggagaagatctatgatttcaacaaacctggcggcagcgcaaaagatg

SEQ ID NO: 168500 - DNA, 103 bp, Artificial Sequence
  Synthetic Polynucleotide
taatacgactcactataggggtaagtgtggttatgaaatacgtgttgaaaaacagaggagatttcaaatggtatttcataacctggcggcagcgcaaaagatg

SEQ ID NO: 168501 - DNA, 103 bp, Artificial Sequence
  Synthetic Polynucleotide
taatacgactcactataggggctgtaagtggtaagtgtggttatgaaataaacagaggagatatttcatgaccacacttaacctggcggcagcgcaaaagatg

SEQ ID NO: 168502 - DNA, 103 bp, Artificial Sequence
  Synthetic Polynucleotide
taatacgactcactatagggtaggcggagctggccgggccgcccaggaacaacagaggagagttcctatgcggcccggcaacctggcggcagcgcaaaagatg

SEQ ID NO: 168503 - DNA, 103 bp, Artificial Sequence
  Synthetic Polynucleotide
taatacgactcactatagggggtgcagttggctgtaagtggtaagtgtggaacagaggagaccacacatgccacttacaaacctggcggcagcgcaaaagatg

SEQ ID NO: 168504 - DNA, 103 bp, Artificial Sequence
  Synthetic Polynucleotide
taatacgactcactatagggagtagattctggtgcagttggctgtaagtgaacagaggagacacttaatgccaactgcaaacctggcggcagcgcaaaagatg

SEQ ID NO: 168505 - DNA, 103 bp, Artificial Sequence
  Synthetic Polynucleotide
taatacgactcactatagggaaggttcagaagtagattctggtgcagttgaacagaggagacaactgatgcagaatctaaacctggcggcagcgcaaaagatg

SEQ ID NO: 168506 - DNA, 103 bp, Artificial Sequence
  Synthetic Polynucleotide
taatacgactcactatagggggccacggaaaaggttcagaagtagattctaacagaggagaagaatcatgttctgaaccaacctggcggcagcgcaaaagatg

SEQ ID NO: 168507 - DNA, 103 bp, Artificial Sequence
  Synthetic Polynucleotide
taatacgactcactatagggtgacttcccaggccacggaaaaggttcagaaacagaggagatctgaaatgtttccgtggaacctggcggcagcgcaaaagatg

SEQ ID NO: 168508 - DNA, 103 bp, Artificial Sequence
  Synthetic Polynucleotide
taatacgactcactatagggttatcttctgtgacttcccaggccacggaaaacagaggagattccgtatgctgggaagtaacctggcggcagcgcaaaagatg

SEQ ID NO: 168509 - DNA, 103 bp, Artificial Sequence
  Synthetic Polynucleotide
taatacgactcactatagggtatctactccttatcttctgtgacttcccaaacagaggagatgggaaatgacagaagataacctggcggcagcgcaaaagatg

SEQ ID NO: 168510 - DNA, 103 bp, Artificial Sequence
  Synthetic Polynucleotide
taatacgactcactataggggtcttcaaggtatctactccttatcttctgaacagaggagacagaagatgaggagtagaaacctggcggcagcgcaaaagatg

SEQ ID NO: 168511 - DNA, 103 bp, Artificial Sequence
  Synthetic Polynucleotide
taatacgactcactatagggttctatctgtgtcttcaaggtatctactccaacagaggagaggagtaatgaccttgaagaacctggcggcagcgcaaaagatg

SEQ ID NO: 168512 - DNA, 103 bp, Artificial Sequence
  Synthetic Polynucleotide
taatacgactcactatagggcggctcaagtttctatctgtgtcttcaaggaacagaggagaccttgaatgcacagatagaacctggcggcagcgcaaaagatg

SEQ ID NO: 168513 - DNA, 103 bp, Artificial Sequence
  Synthetic Polynucleotide
taatacgactcactataggggctgagcgcgtaggcggagctggccgggccaacagaggagaggcccgatgagctccgccaacctggcggcagcgcaaaagatg

SEQ ID NO: 168514 - DNA, 103 bp, Artificial Sequence
  Synthetic Polynucleotide
taatacgactcactatagggctgttcatcacggctcaagtttctatctgtaacagaggagaacagatatgaacttgagcaacctggcggcagcgcaaaagatg

SEQ ID NO: 168515 - DNA, 103 bp, Artificial Sequence
  Synthetic Polynucleotide
taatacgactcactatagggctttagcacgctgttcatcacggctcaagtaacagaggagaacttgaatggtgatgaacaacctggcggcagcgcaaaagatg

SEQ ID NO: 168516 - DNA, 103 bp, Artificial Sequence
  Synthetic Polynucleotide
taatacgactcactatagggatatgcaaagctttagcacgctgttcatcaaacagaggagatgatgaatggcgtgctaaaacctggcggcagcgcaaaagatg

SEQ ID NO: 168517 - DNA, 103 bp, Artificial Sequence
  Synthetic Polynucleotide
taatacgactcactatagggagaaaaagggatatgcaaagctttagcacgaacagaggagacgtgctatggctttgcataacctggcggcagcgcaaaagatg

SEQ ID NO: 168518 - DNA, 103 bp, Artificial Sequence
  Synthetic Polynucleotide
taatacgactcactatagggtttcatctacagaaaaagggatatgcaaagaacagaggagactttgcatgtccctttttaacctggcggcagcgcaaaagatg

SEQ ID NO: 168519 - DNA, 103 bp, Artificial Sequence
  Synthetic Polynucleotide
taatacgactcactatagggatgccgacaatttcatctacagaaaaagggaacagaggagaccctttatgtgtagatgaaacctggcggcagcgcaaaagatg

SEQ ID NO: 168520 - DNA, 103 bp, Artificial Sequence
  Synthetic Polynucleotide
taatacgactcactatagggatcaacaggcatgccgacaatttcatctacaacagaggagagtagatatgattgtcggcaacctggcggcagcgcaaaagatg

SEQ ID NO: 168521 - DNA, 103 bp, Artificial Sequence
  Synthetic Polynucleotide
taatacgactcactatagggtattgaaagaatcaacaggcatgccgacaaaacagaggagattgtcgatgtgcctgttgaacctggcggcagcgcaaaagatg

SEQ ID NO: 168522 - DNA, 103 bp, Artificial Sequence
  Synthetic Polynucleotide
taatacgactcactatagggcttaacatgctattgaaagaatcaacaggcaacagaggagagcctgtatgttctttcaaaacctggcggcagcgcaaaagatg

SEQ ID NO: 168523 - DNA, 103 bp, Artificial Sequence
  Synthetic Polynucleotide
taatacgactcactatagggataatatctacttaacatgctattgaaagaaacagaggagatctttcatgagcatgttaaacctggcggcagcgcaaaagatg

SEQ ID NO: 168524 - DNA, 103 bp, Artificial Sequence
  Synthetic Polynucleotide
taatacgactcactatagggccgagaaggggctgagcgcgtaggcggagcaacagaggagagctccgatgacgcgctcaaacctggcggcagcgcaaaagatg

SEQ ID NO: 168525 - DNA, 103 bp, Artificial Sequence
  Synthetic Polynucleotide
taatacgactcactatagggggtctgtcagataatatctacttaacatgcaacagaggagagcatgtatggtagatattaacctggcggcagcgcaaaagatg

SEQ ID NO: 168526 - DNA, 103 bp, Artificial Sequence
  Synthetic Polynucleotide
taatacgactcactataggggagacttgtaggtctgtcagataatatctaaacagaggagatagataatgtctgacagaaacctggcggcagcgcaaaagatg

SEQ ID NO: 168527 - DNA, 103 bp, Artificial Sequence
  Synthetic Polynucleotide
taatacgactcactatagggacggataagtgagacttgtaggtctgtcagaacagaggagactgacaatgctacaagtcaacctggcggcagcgcaaaagatg

SEQ ID NO: 168528 - DNA, 103 bp, Artificial Sequence
  Synthetic Polynucleotide
taatacgactcactataggggtctgatgtcacggataagtgagacttgtaaacagaggagatacaagatgcacttatccaacctggcggcagcgcaaaagatg

SEQ ID NO: 168529 - DNA, 103 bp, Artificial Sequence
  Synthetic Polynucleotide
taatacgactcactatagggttccctcttcgtctgatgtcacggataagtaacagaggagaacttatatgtgacatcagaacctggcggcagcgcaaaagatg

SEQ ID NO: 168530 - DNA, 103 bp, Artificial Sequence
  Synthetic Polynucleotide
taatacgactcactatagggaactttatttttccctcttcgtctgatgtcaacagaggagagacatcatgcgaagagggaacctggcggcagcgcaaaagatg

SEQ ID NO: 168531 - DNA, 103 bp, Artificial Sequence
  Synthetic Polynucleotide
taatacgactcactatagggtctgcgcagcaactttatttttccctcttcaacagaggagagaagagatgaaaataaagaacctggcggcagcgcaaaagatg

SEQ ID NO: 168532 - DNA, 103 bp, Artificial Sequence
  Synthetic Polynucleotide
taatacgactcactatagggttacgacagttctgcgcagcaactttatttaacagaggagaaaataaatgtgctgcgcaaacctggcggcagcgcaaaagatg

SEQ ID NO: 168533 - DNA, 103 bp, Artificial Sequence
  Synthetic Polynucleotide
taatacgactcactatagggcaatttgcgtttacgacagttctgcgcagcaacagaggagagctgcgatgaactgtcgtaacctggcggcagcgcaaaagatg

SEQ ID NO: 168534 - DNA, 103 bp, Artificial Sequence
  Synthetic Polynucleotide
taatacgactcactatagggaaattatgtccaatttgcgtttacgacagtaacagaggagaactgtcatgaacgcaaataacctggcggcagcgcaaaagatg

SEQ ID NO: 168535 - DNA, 103 bp, Artificial Sequence
  Synthetic Polynucleotide
taatacgactcactatagggcctcccgaggccgagaaggggctgagcgcgaacagaggagacgcgctatgccccttctcaacctggcggcagcgcaaaagatg

SEQ ID NO: 168536 - DNA, 103 bp, Artificial Sequence
  Synthetic Polynucleotide
taatacgactcactatagggtctaaattcaaaattatgtccaatttgcgtaacagaggagaacgcaaatgggacataataacctggcggcagcgcaaaagatg

SEQ ID NO: 168537 - DNA, 103 bp, Artificial Sequence
  Synthetic Polynucleotide
taatacgactcactatagggtacatcatcttctaaattcaaaattatgtcaacagaggagagacataatgttgaatttaaacctggcggcagcgcaaaagatg

SEQ ID NO: 168538 - DNA, 103 bp, Artificial Sequence
  Synthetic Polynucleotide
taatacgactcactataggggcaagttacatacatcatcttctaaattcaaacagaggagatgaattatgaagatgatgaacctggcggcagcgcaaaagatg

SEQ ID NO: 168539 - DNA, 103 bp, Artificial Sequence
  Synthetic Polynucleotide
taatacgactcactatagggttctttgcttgcaagttacatacatcatctaacagaggagaagatgaatgatgtaacttaacctggcggcagcgcaaaagatg

SEQ ID NO: 168540 - DNA, 103 bp, Artificial Sequence
  Synthetic Polynucleotide
taatacgactcactatagggaagagtttccttctttgcttgcaagttacaaacagaggagatgtaacatgcaagcaaagaacctggcggcagcgcaaaagatg

SEQ ID NO: 168541 - DNA, 103 bp, Artificial Sequence
  Synthetic Polynucleotide
taatacgactcactataggggctctctcttaagagtttccttctttgcttaacagaggagaaagcaaatgaggaaactcaacctggcggcagcgcaaaagatg

SEQ ID NO: 168542 - DNA, 103 bp, Artificial Sequence
  Synthetic Polynucleotide
taatacgactcactatagggcattgtgcttgctctctcttaagagtttccaacagaggagaggaaacatgtaagagagaaacctggcggcagcgcaaaagatg

SEQ ID NO: 168543 - DNA, 103 bp, Artificial Sequence
  Synthetic Polynucleotide
taatacgactcactatagggagctttgttacattgtgcttgctctctcttaacagaggagaaagagaatgcaagcacaaaacctggcggcagcgcaaaagatg

SEQ ID NO: 168544 - DNA, 103 bp, Artificial Sequence
  Synthetic Polynucleotide
taatacgactcactatagggttatgttaatagctttgttacattgtgcttaacagaggagaaagcacatggtaacaaagaacctggcggcagcgcaaaagatg

SEQ ID NO: 168545 - DNA, 103 bp, Artificial Sequence
  Synthetic Polynucleotide
taatacgactcactatagggttctgtttcattatgttaatagctttgttaaacagaggagataacaaatgtattaacataacctggcggcagcgcaaaagatg

SEQ ID NO: 168546 - DNA, 103 bp, Artificial Sequence
  Synthetic Polynucleotide
taatacgactcactataggggcgcccccaccctcccgaggccgagaagggaacagaggagacccttcatggcctcgggaaacctggcggcagcgcaaaagatg

SEQ ID NO: 168547 - DNA, 103 bp, Artificial Sequence
  Synthetic Polynucleotide
taatacgactcactataggggtcatgcagtttctgtttcattatgttaataacagaggagaattaacatgatgaaacagaacctggcggcagcgcaaaagatg

SEQ ID NO: 168548 - DNA, 103 bp, Artificial Sequence
  Synthetic Polynucleotide
taatacgactcactatagggcatgataaaggtcatgcagtttctgtttcaaacagaggagatgaaacatgaactgcatgaacctggcggcagcgcaaaagatg

SEQ ID NO: 168549 - DNA, 103 bp, Artificial Sequence
  Synthetic Polynucleotide
taatacgactcactatagggctaaaaatatcatgataaaggtcatgcagtaacagaggagaactgcaatgcctttatcaaacctggcggcagcgcaaaagatg

SEQ ID NO: 168550 - DNA, 103 bp, Artificial Sequence
  Synthetic Polynucleotide
taatacgactcactatagggtcttaatctactaaaaatatcatgataaagaacagaggagactttatatggatatttttaacctggcggcagcgcaaaagatg

SEQ ID NO: 168551 - DNA, 103 bp, Artificial Sequence
  Synthetic Polynucleotide
taatacgactcactatagggcttggtcatctcttaatctactaaaaatataacagaggagaatatttatggtagattaaaacctggcggcagcgcaaaagatg

SEQ ID NO: 168552 - DNA, 103 bp, Artificial Sequence
  Synthetic Polynucleotide
taatacgactcactatagggactggcctaccttggtcatctcttaatctaaacagaggagatagattatgagatgaccaaacctggcggcagcgcaaaagatg

SEQ ID NO: 168553 - DNA, 103 bp, Artificial Sequence
  Synthetic Polynucleotide
taatacgactcactataggggttgggattgactggcctaccttggtcatcaacagaggagagatgacatgggtaggccaaacctggcggcagcgcaaaagatg

SEQ ID NO: 168554 - DNA, 103 bp, Artificial Sequence
  Synthetic Polynucleotide
taatacgactcactataggggagcatagtggttgggattgactggcctacaacagaggagagtaggcatgtcaatcccaaacctggcggcagcgcaaaagatg

SEQ ID NO: 168555 - DNA, 103 bp, Artificial Sequence
  Synthetic Polynucleotide
taatacgactcactataggggtacactggagagcatagtggttgggattgaacagaggagacaatccatgccactatgcaacctggcggcagcgcaaaagatg

SEQ ID NO: 168556 - DNA, 103 bp, Artificial Sequence
  Synthetic Polynucleotide
taatacgactcactatagggtccatcatgggtacactggagagcatagtgaacagaggagacactatatgctccagtgtaacctggcggcagcgcaaaagatg

SEQ ID NO: 168557 - DNA, 103 bp, Artificial Sequence
  Synthetic Polynucleotide
taatacgactcactatagggggccgccgccggccgaccaccaccgcttcaaacagaggagatgaagcatgggtggtcggaacctggcggcagcgcaaaagatg

SEQ ID NO: 168558 - DNA, 103 bp, Artificial Sequence
  Synthetic Polynucleotide
taatacgactcactatagggagtggcccgcgcgcccccaccctcccgaggaacagaggagacctcggatgggtgggggcaacctggcggcagcgcaaaagatg

SEQ ID NO: 168559 - DNA, 103 bp, Artificial Sequence
  Synthetic Polynucleotide
taatacgactcactatagggtcaagatacttccatcatgggtacactggaaacagaggagatccagtatgcccatgatgaacctggcggcagcgcaaaagatg

SEQ ID NO: 168560 - DNA, 103 bp, Artificial Sequence
  Synthetic Polynucleotide
taatacgactcactatagggttgggtactatcaagatacttccatcatggaacagaggagaccatgaatgaagtatcttaacctggcggcagcgcaaaagatg

SEQ ID NO: 168561 - DNA, 103 bp, Artificial Sequence
  Synthetic Polynucleotide
taatacgactcactatagggcaccagttctttgggtactatcaagatactaacagaggagaagtatcatgatagtacccaacctggcggcagcgcaaaagatg

SEQ ID NO: 168562 - DNA, 103 bp, Artificial Sequence
  Synthetic Polynucleotide
taatacgactcactatagggggcctgaggccaccagttctttgggtactaaacagaggagatagtacatgaagaactggaacctggcggcagcgcaaaagatg

SEQ ID NO: 168563 - DNA, 103 bp, Artificial Sequence
  Synthetic Polynucleotide
taatacgactcactatagggtcctttttgtggcctgaggccaccagttctaacagaggagaagaactatgggcctcaggaacctggcggcagcgcaaaagatg

SEQ ID NO: 168564 - DNA, 103 bp, Artificial Sequence
  Synthetic Polynucleotide
taatacgactcactatagggcttttgggtttcctttttgtggcctgaggcaacagaggagagcctcaatgcacaaaaagaacctggcggcagcgcaaaagatg

SEQ ID NO: 168565 - DNA, 103 bp, Artificial Sequence
  Synthetic Polynucleotide
taatacgactcactatagggttctctttcccttttgggtttcctttttgtaacagaggagaacaaaaatgaaacccaaaaacctggcggcagcgcaaaagatg

SEQ ID NO: 168566 - DNA, 103 bp, Artificial Sequence
  Synthetic Polynucleotide
taatacgactcactatagggttggggtgcaagtggcccgcgcgcccccacaacagaggagagtggggatgcgcgggccaaacctggcggcagcgcaaaagatg

SEQ ID NO: 168567 - DNA, 103 bp, Artificial Sequence
  Synthetic Polynucleotide
taatacgactcactatagggctcccggcccttggggtgcaagtggcccgcaacagaggagagcgggcatgttgcaccccaacctggcggcagcgcaaaagatg

SEQ ID NO: 168568 - DNA, 103 bp, Artificial Sequence
  Synthetic Polynucleotide
taatacgactcactatagggcagggtccagctcccggcccttggggtgcaaacagaggagatgcaccatgagggccgggaacctggcggcagcgcaaaagatg

SEQ ID NO: 168569 - DNA, 103 bp, Artificial Sequence
  Synthetic Polynucleotide
taatacgactcactatagggggcggcgcggcagggtccagctcccggcccaacagaggagagggccgatggctggacccaacctggcggcagcgcaaaagatg

SEQ ID NO: 168570 - DNA, 103 bp, Artificial Sequence
  Synthetic Polynucleotide
taatacgactcactatagggctggccctcgggcggcgcggcagggtccagaacagaggagactggacatggccgcgccgaacctggcggcagcgcaaaagatg

SEQ ID NO: 168571 - DNA, 103 bp, Artificial Sequence
  Synthetic Polynucleotide
taatacgactcactatagggcccggagcagctggccctcgggcggcgcggaacagaggagaccgcgcatgccgagggccaacctggcggcagcgcaaaagatg

SEQ ID NO: 168572 - DNA, 103 bp, Artificial Sequence
  Synthetic Polynucleotide
taatacgactcactataggggcgcgcacctcccggagcagctggccctcgaacagaggagacgagggatggctgctccgaacctggcggcagcgcaaaagatg

SEQ ID NO: 168573 - DNA, 103 bp, Artificial Sequence
  Synthetic Polynucleotide
taatacgactcactataggggaccccgagcgcgcgcacctcccggagcagaacagaggagactgctcatggaggtgcgcaacctggcggcagcgcaaaagatg

SEQ ID NO: 168574 - DNA, 103 bp, Artificial Sequence
  Synthetic Polynucleotide
taatacgactcactatagggggacgaaggggaccccgagcgcgcgcacctaacagaggagaaggtgcatgcgctcggggaacctggcggcagcgcaaaagatg

SEQ ID NO: 168575 - DNA, 103 bp, Artificial Sequence
  Synthetic Polynucleotide
taatacgactcactatagggaggtgcaggaggccgccgccggccgaccacaacagaggagagtggtcatgcggcggcggaacctggcggcagcgcaaaagatg

SEQ ID NO: 168576 - DNA, 103 bp, Artificial Sequence
  Synthetic Polynucleotide
taatacgactcactatagggctggtgcgagggacgaaggggaccccgagcaacagaggagagctcggatgccccttcgtaacctggcggcagcgcaaaagatg

SEQ ID NO: 168577 - DNA, 103 bp, Artificial Sequence
  Synthetic Polynucleotide
taatacgactcactatagggtgcatccacgctggtgcgagggacgaagggaacagaggagacccttcatgcctcgcaccaacctggcggcagcgcaaaagatg

SEQ ID NO: 168578 - DNA, 103 bp, Artificial Sequence
  Synthetic Polynucleotide
taatacgactcactataggggcaccagccatgcatccacgctggtgcgagaacagaggagactcgcaatggcgtggatgaacctggcggcagcgcaaaagatg

SEQ ID NO: 168579 - DNA, 103 bp, Artificial Sequence
  Synthetic Polynucleotide
taatacgactcactataggggccacgctgtgcaccagccatgcatccacgaacagaggagacgtggaatgatggctggtaacctggcggcagcgcaaaagatg

SEQ ID NO: 168580 - DNA, 103 bp, Artificial Sequence
  Synthetic Polynucleotide
taatacgactcactataggggctcccggcagccacgctgtgcaccagccaaacagaggagatggctgatgcacagcgtgaacctggcggcagcgcaaaagatg

SEQ ID NO: 168581 - DNA, 103 bp, Artificial Sequence
  Synthetic Polynucleotide
taatacgactcactatagggcctcgtccgcgctcccggcagccacgctgtaacagaggagaacagcgatgctgccgggaaacctggcggcagcgcaaaagatg

SEQ ID NO: 168582 - DNA, 103 bp, Artificial Sequence
  Synthetic Polynucleotide
taatacgactcactatagggagcccgtgggcctcgtccgcgctcccggcaaacagaggagatgccggatgcgcggacgaaacctggcggcagcgcaaaagatg

SEQ ID NO: 168583 - DNA, 103 bp, Artificial Sequence
  Synthetic Polynucleotide
taatacgactcactatagggggcgccgagcagcccgtgggcctcgtccgcaacagaggagagcggacatggcccacgggaacctggcggcagcgcaaaagatg

SEQ ID NO: 168584 - DNA, 103 bp, Artificial Sequence
  Synthetic Polynucleotide
taatacgactcactatagggaggcggcggcggcgccgagcagcccgtgggaacagaggagacccacgatgtgctcggcgaacctggcggcagcgcaaaagatg

SEQ ID NO: 168585 - DNA, 103 bp, Artificial Sequence
  Synthetic Polynucleotide
taatacgactcactatagggccggtggacgaggcggcggcggcgccgagcaacagaggagagctcggatgcgccgccgcaacctggcggcagcgcaaaagatg

SEQ ID NO: 168586 - DNA, 103 bp, Artificial Sequence
  Synthetic Polynucleotide
taatacgactcactatagggcaggagggtgaggtgcaggaggccgccgccaacagaggagaggcggcatgctcctgcacaacctggcggcagcgcaaaagatg

SEQ ID NO: 168587 - DNA, 103 bp, Artificial Sequence
  Synthetic Polynucleotide
taatacgactcactataggggccggctcctccggtggacgaggcggcggcaacagaggagagccgccatgtcgtccaccaacctggcggcagcgcaaaagatg

SEQ ID NO: 168588 - DNA, 103 bp, Artificial Sequence
  Synthetic Polynucleotide
taatacgactcactatagggccacgctggcgccggctcctccggtggacgaacagaggagacgtccaatggaggagccgaacctggcggcagcgcaaaagatg

SEQ ID NO: 168589 - DNA, 103 bp, Artificial Sequence
  Synthetic Polynucleotide
taatacgactcactatagggctgccgccgtccacgctggcgccggctcctaacagaggagaaggagcatgcgccagcgtaacctggcggcagcgcaaaagatg

SEQ ID NO: 168590 - DNA, 103 bp, Artificial Sequence
  Synthetic Polynucleotide
taatacgactcactatagggcacagcctggctgccgccgtccacgctggcaacagaggagagccagcatggacggcggcaacctggcggcagcgcaaaagatg

SEQ ID NO: 168591 - DNA, 103 bp, Artificial Sequence
  Synthetic Polynucleotide
taatacgactcactatagggcgcccccctgcacagcctggctgccgccgtaacagaggagaacggcgatggccaggctgaacctggcggcagcgcaaaagatg

SEQ ID NO: 168592 - DNA, 103 bp, Artificial Sequence
  Synthetic Polynucleotide
taatacgactcactataggggggtccccgccgcccccctgcacagcctggaacagaggagaccaggcatggcaggggggaacctggcggcagcgcaaaagatg

SEQ ID NO: 168593 - DNA, 103 bp, Artificial Sequence
  Synthetic Polynucleotide
taatacgactcactatagggagccgctcgggggtccccgccgcccccctgaacagaggagacaggggatgggcggggacaacctggcggcagcgcaaaagatg

SEQ ID NO: 168594 - DNA, 103 bp, Artificial Sequence
  Synthetic Polynucleotide
taatacgactcactatagggggccactccgagccgctcgggggtccccgcaacagaggagagcggggatgcccgagcggaacctggcggcagcgcaaaagatg

SEQ ID NO: 168595 - DNA, 103 bp, Artificial Sequence
  Synthetic Polynucleotide
taatacgactcactataggggcgtccaaggggccactccgagccgctcggaacagaggagaccgagcatgtcggagtggaacctggcggcagcgcaaaagatg

SEQ ID NO: 168596 - DNA, 103 bp, Artificial Sequence
  Synthetic Polynucleotide
taatacgactcactatagggctcttccccggcgtccaaggggccactccgaacagaggagacggagtatgcccttggacaacctggcggcagcgcaaaagatg

SEQ ID NO: 168597 - DNA, 103 bp, Artificial Sequence
  Synthetic Polynucleotide
taatacgactcactatagggccaagctcagcaggagggtgaggtgcaggaaacagaggagatcctgcatgtcaccctccaacctggcggcagcgcaaaagatg

SEQ ID NO: 168598 - DNA, 103 bp, Artificial Sequence
  Synthetic Polynucleotide
taatacgactcactataggggtgccttctcctcttccccggcgtccaaggaacagaggagaccttggatgccggggaagaacctggcggcagcgcaaaagatg

SEQ ID NO: 168599 - DNA, 103 bp, Artificial Sequence
  Synthetic Polynucleotide
taatacgactcactatagggggttccgcgggtgccttctcctcttccccgaacagaggagacggggaatgggagaaggcaacctggcggcagcgcaaaagatg

SEQ ID NO: 168600 - DNA, 103 bp, Artificial Sequence
  Synthetic Polynucleotide
taatacgactcactatagggctgagccgtcggttccgcgggtgccttctcaacagaggagagagaagatgcccgcggaaaacctggcggcagcgcaaaagatg

SEQ ID NO: 168601 - DNA, 103 bp, Artificial Sequence
  Synthetic Polynucleotide
taatacgactcactatagggcgtccggcacctgagccgtcggttccgcggaacagaggagaccgcggatgcgacggctcaacctggcggcagcgcaaaagatg

SEQ ID NO: 168602 - DNA, 103 bp, Artificial Sequence
  Synthetic Polynucleotide
taatacgactcactatagggcatccgccagcgtccggcacctgagccgtcaacagaggagagacggcatgggtgccggaaacctggcggcagcgcaaaagatg

SEQ ID NO: 168603 - DNA, 103 bp, Artificial Sequence
  Synthetic Polynucleotide
taatacgactcactatagggctcgctcgcacatccgccagcgtccggcacaacagaggagagtgccgatggctggcggaaacctggcggcagcgcaaaagatg

SEQ ID NO: 168604 - DNA, 103 bp, Artificial Sequence
  Synthetic Polynucleotide
taatacgactcactatagggccccattctcctcgctcgcacatccgccagaacagaggagactggcgatggtgcgagcgaacctggcggcagcgcaaaagatg

SEQ ID NO: 168605 - DNA, 103 bp, Artificial Sequence
  Synthetic Polynucleotide
taatacgactcactatagggtctcttagtaccccattctcctcgctcgcaaacagaggagatgcgagatgggagaatggaacctggcggcagcgcaaaagatg

SEQ ID NO: 168606 - DNA, 103 bp, Artificial Sequence
  Synthetic Polynucleotide
taatacgactcactatagggttcgtgcttttctcttagtaccccattctcaacagaggagagagaatatggtactaagaaacctggcggcagcgcaaaagatg

SEQ ID NO: 168607 - DNA, 103 bp, Artificial Sequence
  Synthetic Polynucleotide
taatacgactcactataggggatccacagcttcgtgcttttctcttagtaaacagaggagatactaaatgaaaagcacgaacctggcggcagcgcaaaagatg

SEQ ID NO: 168608 - DNA, 103 bp, Artificial Sequence
  Synthetic Polynucleotide
taatacgactcactatagggcggagccccgccaagctcagcaggagggtgaacagaggagacaccctatggctgagcttaacctggcggcagcgcaaaagatg

SEQ ID NO: 168609 - DNA, 103 bp, Artificial Sequence
  Synthetic Polynucleotide
taatacgactcactatagggtgggaactatgatccacagcttcgtgctttaacagaggagaaaagcaatgagctgtggaaacctggcggcagcgcaaaagatg

SEQ ID NO: 168610 - DNA, 103 bp, Artificial Sequence
  Synthetic Polynucleotide
taatacgactcactatagggttcctcatgctgggaactatgatccacagcaacagaggagagctgtgatgcatagttccaacctggcggcagcgcaaaagatg

SEQ ID NO: 168611 - DNA, 103 bp, Artificial Sequence
  Synthetic Polynucleotide
taatacgactcactatagggtttcttcattttcctcatgctgggaactataacagaggagaatagttatgagcatgaggaacctggcggcagcgcaaaagatg

SEQ ID NO: 168612 - DNA, 103 bp, Artificial Sequence
  Synthetic Polynucleotide
taatacgactcactataggggctgacaccctttcttcattttcctcatgcaacagaggagagcatgaatgaaatgaagaaacctggcggcagcgcaaaagatg

SEQ ID NO: 168613 - DNA, 103 bp, Artificial Sequence
  Synthetic Polynucleotide
taatacgactcactatagggctccttctgggctgacaccctttcttcattaacagaggagaaatgaaatgagggtgtcaaacctggcggcagcgcaaaagatg

SEQ ID NO: 168614 - DNA, 103 bp, Artificial Sequence
  Synthetic Polynucleotide
taatacgactcactataggggaagtgagttctccttctgggctgacacccaacagaggagagggtgtatgcccagaaggaacctggcggcagcgcaaaagatg

SEQ ID NO: 168615 - DNA, 103 bp, Artificial Sequence
  Synthetic Polynucleotide
taatacgactcactatagggtcattctgctgaagtgagttctccttctggaacagaggagaccagaaatggaactcactaacctggcggcagcgcaaaagatg

SEQ ID NO: 168616 - DNA, 103 bp, Artificial Sequence
  Synthetic Polynucleotide
taatacgactcactatagggttcatcatcatcattctgctgaagtgagttaacagaggagaaactcaatgcagcagaataacctggcggcagcgcaaaagatg

SEQ ID NO: 168617 - DNA, 103 bp, Artificial Sequence
  Synthetic Polynucleotide
taatacgactcactatagggctattttgttttcatcatcatcattctgctaacagaggagaagcagaatgatgatgatgaacctggcggcagcgcaaaagatg

SEQ ID NO: 168618 - DNA, 103 bp, Artificial Sequence
  Synthetic Polynucleotide
taatacgactcactatagggggtttctctgctattttgttttcatcatcaaacagaggagatgatgaatgaaacaaaataacctggcggcagcgcaaaagatg

SEQ ID NO: 168619 - DNA, 103 bp, Artificial Sequence
  Synthetic Polynucleotide
taatacgactcactatagggtaggtctacgcggagccccgccaagctcagaacagaggagactgagcatggcggggctcaacctggcggcagcgcaaaagatg

SEQ ID NO: 168620 - DNA, 103 bp, Artificial Sequence
  Synthetic Polynucleotide
taatacgactcactatagggctcccagtcaggtttctctgctattttgttaacagaggagaaacaaaatggcagagaaaaacctggcggcagcgcaaaagatg

SEQ ID NO: 168621 - DNA, 103 bp, Artificial Sequence
  Synthetic Polynucleotide
taatacgactcactatagggtcttttctgcctcccagtcaggtttctctgaacagaggagacagagaatgctgactgggaacctggcggcagcgcaaaagatg

SEQ ID NO: 168622 - DNA, 103 bp, Artificial Sequence
  Synthetic Polynucleotide
taatacgactcactataggggattcagtggtcttttctgcctcccagtcaaacagaggagatgactgatgggcagaaaaaacctggcggcagcgcaaaagatg

SEQ ID NO: 168623 - DNA, 103 bp, Artificial Sequence
  Synthetic Polynucleotide
taatacgactcactatagggctcatttctagattcagtggtcttttctgcaacagaggagagcagaaatgaccactgaaaacctggcggcagcgcaaaagatg

SEQ ID NO: 168624 - DNA, 103 bp, Artificial Sequence
  Synthetic Polynucleotide
taatacgactcactatagggtcagatgtctctcatttctagattcagtggaacagaggagaccactgatgctagaaatgaacctggcggcagcgcaaaagatg

SEQ ID NO: 168625 - DNA, 103 bp, Artificial Sequence
  Synthetic Polynucleotide
taatacgactcactatagggtctgtcccattcagatgtctctcatttctaaacagaggagatagaaaatggagacatctaacctggcggcagcgcaaaagatg

SEQ ID NO: 168626 - DNA, 103 bp, Artificial Sequence
  Synthetic Polynucleotide
taatacgactcactataggggaaagaagtatctgtcccattcagatgtctaacagaggagaagacatatgaatgggacaaacctggcggcagcgcaaaagatg

SEQ ID NO: 168627 - DNA, 103 bp, Artificial Sequence
  Synthetic Polynucleotide
taatacgactcactatagggcttccagagagaaagaagtatctgtcccataacagaggagaatgggaatgatacttcttaacctggcggcagcgcaaaagatg

SEQ ID NO: 168628 - DNA, 103 bp, Artificial Sequence
  Synthetic Polynucleotide
taatacgactcactatagggtggaataagtcttccagagagaaagaagtaaacagaggagatacttcatgctctctggaaacctggcggcagcgcaaaagatg

SEQ ID NO: 168629 - DNA, 103 bp, Artificial Sequence
  Synthetic Polynucleotide
taatacgactcactatagggtgaaagcaactggaataagtcttccagagaaacagaggagatctctgatggacttattcaacctggcggcagcgcaaaagatg

SEQ ID NO: 168630 - DNA, 103 bp, Artificial Sequence
  Synthetic Polynucleotide
taatacgactcactatagggggtaaagatctaggtctacgcggagccccgaacagaggagacggggcatggcgtagaccaacctggcggcagcgcaaaagatg

SEQ ID NO: 168631 - DNA, 103 bp, Artificial Sequence
  Synthetic Polynucleotide
taatacgactcactatagggcaggctgtgatgaaagcaactggaataagtaacagaggagaacttatatgagttgctttaacctggcggcagcgcaaaagatg

SEQ ID NO: 168632 - DNA, 103 bp, Artificial Sequence
  Synthetic Polynucleotide
taatacgactcactatagggagtgaattttcaggctgtgatgaaagcaacaacagaggagagttgctatgatcacagccaacctggcggcagcgcaaaagatg

SEQ ID NO: 168633 - DNA, 103 bp, Artificial Sequence
  Synthetic Polynucleotide
taatacgactcactataggggatgccctccagtgaattttcaggctgtgaaacagaggagatcacagatggaaaattcaaacctggcggcagcgcaaaagatg

SEQ ID NO: 168634 - DNA, 103 bp, Artificial Sequence
  Synthetic Polynucleotide
taatacgactcactatagggctcccaatgagatgccctccagtgaattttaacagaggagaaaaattatgtggagggcaaacctggcggcagcgcaaaagatg

SEQ ID NO: 168635 - DNA, 103 bp, Artificial Sequence
  Synthetic Polynucleotide
taatacgactcactatagggagaggaatatctcccaatgagatgccctccaacagaggagaggagggatgctcattgggaacctggcggcagcgcaaaagatg

SEQ ID NO: 168636 - DNA, 103 bp, Artificial Sequence
  Synthetic Polynucleotide
taatacgactcactatagggactgcctggaagaggaatatctcccaatgaaacagaggagatcattgatggatattcctaacctggcggcagcgcaaaagatg

SEQ ID NO: 168637 - DNA, 103 bp, Artificial Sequence
  Synthetic Polynucleotide
taatacgactcactatagggcatcactgatactgcctggaagaggaatataacagaggagaatattcatgttccaggcaaacctggcggcagcgcaaaagatg

SEQ ID NO: 168638 - DNA, 103 bp, Artificial Sequence
  Synthetic Polynucleotide
taatacgactcactataggggaattcatgccatcactgatactgcctggaaacagaggagatccaggatgtatcagtgaaacctggcggcagcgcaaaagatg

SEQ ID NO: 168639 - DNA, 103 bp, Artificial Sequence
  Synthetic Polynucleotide
taatacgactcactatagggatgtgctgaagaattcatgccatcactgataacagaggagaatcagtatgggcatgaataacctggcggcagcgcaaaagatg

SEQ ID NO: 168640 - DNA, 103 bp, Artificial Sequence
  Synthetic Polynucleotide
taatacgactcactatagggttacatgataatgtgctgaagaattcatgcaacagaggagagcatgaatgcttcagcacaacctggcggcagcgcaaaagatg

SEQ ID NO: 168641 - DNA, 103 bp, Artificial Sequence
  Synthetic Polynucleotide
taatacgactcactatagggggcagcagcaggtaaagatctaggtctacgaacagaggagacgtagaatgagatctttaaacctggcggcagcgcaaaagatg

SEQ ID NO: 168642 - DNA, 103 bp, Artificial Sequence
  Synthetic Polynucleotide
taatacgactcactatagggtggctgaagtttacatgataatgtgctgaaaacagaggagattcagcatgttatcatgtaacctggcggcagcgcaaaagatg

SEQ ID NO: 168643 - DNA, 103 bp, Artificial Sequence
  Synthetic Polynucleotide
taatacgactcactatagggacttatagcctggctgaagtttacatgataaacagaggagatatcatatgaacttcagcaacctggcggcagcgcaaaagatg

SEQ ID NO: 168644 - DNA, 103 bp, Artificial Sequence
  Synthetic Polynucleotide
taatacgactcactatagggtcacatcctgacttatagcctggctgaagtaacagaggagaacttcaatgaggctataaaacctggcggcagcgcaaaagatg

SEQ ID NO: 168645 - DNA, 103 bp, Artificial Sequence
  Synthetic Polynucleotide
taatacgactcactatagggtcatgaagattcacatcctgacttatagccaacagaggagaggctatatgtcaggatgtaacctggcggcagcgcaaaagatg

SEQ ID NO: 168646 - DNA, 103 bp, Artificial Sequence
  Synthetic Polynucleotide
taatacgactcactatagggcaagatggcctcatgaagattcacatcctgaacagaggagacaggatatgaatcttcataacctggcggcagcgcaaaagatg

SEQ ID NO: 168647 - DNA, 103 bp, Artificial Sequence
  Synthetic Polynucleotide
taatacgactcactatagggtgggacaaagcaagatggcctcatgaagataacagaggagaatcttcatgaggccatctaacctggcggcagcgcaaaagatg

SEQ ID NO: 168648 - DNA, 103 bp, Artificial Sequence
  Synthetic Polynucleotide
taatacgactcactatagggaatgtattgttgggacaaagcaagatggccaacagaggagaggccatatggctttgtccaacctggcggcagcgcaaaagatg

SEQ ID NO: 168649 - DNA, 103 bp, Artificial Sequence
  Synthetic Polynucleotide
taatacgactcactatagggatctcttctaaatgtattgttgggacaaagaacagaggagactttgtatgaacaatacaaacctggcggcagcgcaaaagatg

SEQ ID NO: 168650 - DNA, 103 bp, Artificial Sequence
  Synthetic Polynucleotide
taatacgactcactatagggttgctgttggatctcttctaaatgtattgtaacagaggagaacaataatgttagaagagaacctggcggcagcgcaaaagatg

SEQ ID NO: 168651 - DNA, 103 bp, Artificial Sequence
  Synthetic Polynucleotide
taatacgactcactatagggtgtgaagtccttgctgttggatctcttctaaacagaggagatagaagatgtccaacagcaacctggcggcagcgcaaaagatg

SEQ ID NO: 168652 - DNA, 103 bp, Artificial Sequence
  Synthetic Polynucleotide
taatacgactcactatagggtgcttcgatgaaaggatgaaattcatccataacagaggagaatggatatgtttcatcctaacctggcggcagcgcaaaagatg

SEQ ID NO: 168653 - DNA, 103 bp, Artificial Sequence
  Synthetic Polynucleotide
taatacgactcactatagggcatacgcttttcatgttttttgaagtatttaacagaggagaaaatacatgaaaaaacataacctggcggcagcgcaaaagatg

SEQ ID NO: 168654 - DNA, 103 bp, Artificial Sequence
  Synthetic Polynucleotide
taatacgactcactatagggctgtgtgaacgccgttcccagggaggaggtaacagaggagaacctccatgctgggaacgaacctggcggcagcgcaaaagatg

SEQ ID NO: 168655 - DNA, 103 bp, Artificial Sequence
  Synthetic Polynucleotide
taatacgactcactataggggtcggtgatgctgtgtgaacgccgttcccaaacagaggagatgggaaatgcgttcacacaacctggcggcagcgcaaaagatg

SEQ ID NO: 168656 - DNA, 103 bp, Artificial Sequence
  Synthetic Polynucleotide
taatacgactcactataggggtaatgacaggtcggtgatgctgtgtgaacaacagaggagagttcacatggcatcaccgaacctggcggcagcgcaaaagatg

SEQ ID NO: 168657 - DNA, 103 bp, Artificial Sequence
  Synthetic Polynucleotide
taatacgactcactatagggtctgggtcctgtaatgacaggtcggtgatgaacagaggagacatcacatgcctgtcattaacctggcggcagcgcaaaagatg

SEQ ID NO: 168658 - DNA, 103 bp, Artificial Sequence
  Synthetic Polynucleotide
taatacgactcactataggggcggacttgctctgggtcctgtaatgacagaacagaggagactgtcaatgcaggacccaaacctggcggcagcgcaaaagatg

SEQ ID NO: 168659 - DNA, 103 bp, Artificial Sequence
  Synthetic Polynucleotide
taatacgactcactatagggggtgttgcatgcggacttgctctgggtcctaacagaggagaaggaccatgagcaagtccaacctggcggcagcgcaaaagatg

SEQ ID NO: 168660 - DNA, 103 bp, Artificial Sequence
  Synthetic Polynucleotide
taatacgactcactatagggaagagtcgatggtgttgcatgcggacttgcaacagaggagagcaagtatgcatgcaacaaacctggcggcagcgcaaaagatg

SEQ ID NO: 168661 - DNA, 103 bp, Artificial Sequence
  Synthetic Polynucleotide
taatacgactcactatagggtcgggaaatgaagagtcgatggtgttgcataacagaggagaatgcaaatgcatcgactcaacctggcggcagcgcaaaagatg

SEQ ID NO: 168662 - DNA, 103 bp, Artificial Sequence
  Synthetic Polynucleotide
taatacgactcactatagggatgggtgatgtcgggaaatgaagagtcgataacagaggagaatcgacatgtcatttcccaacctggcggcagcgcaaaagatg

SEQ ID NO: 168663 - DNA, 103 bp, Artificial Sequence
  Synthetic Polynucleotide
taatacgactcactatagggctgctggataatgggtgatgtcgggaaatgaacagaggagacatttcatgacatcacccaacctggcggcagcgcaaaagatg

SEQ ID NO: 168664 - DNA, 103 bp, Artificial Sequence
  Synthetic Polynucleotide
taatacgactcactatagggcttcttttgacatacgcttttcatgtttttaacagaggagaaaaaacatgaaaagcgtaaacctggcggcagcgcaaaagatg

SEQ ID NO: 168665 - DNA, 103 bp, Artificial Sequence
  Synthetic Polynucleotide
taatacgactcactatagggaaggcccaggctgctggataatgggtgatgaacagaggagacatcacatgttatccagcaacctggcggcagcgcaaaagatg

SEQ ID NO: 168666 - DNA, 103 bp, Artificial Sequence
  Synthetic Polynucleotide
taatacgactcactatagggtgtgagaagtaaggcccaggctgctggataaacagaggagatatccaatggcctgggccaacctggcggcagcgcaaaagatg

SEQ ID NO: 168667 - DNA, 103 bp, Artificial Sequence
  Synthetic Polynucleotide
taatacgactcactataggggatggctgggtgtgagaagtaaggcccaggaacagaggagacctgggatgtacttctcaaacctggcggcagcgcaaaagatg

SEQ ID NO: 168668 - DNA, 103 bp, Artificial Sequence
  Synthetic Polynucleotide
taatacgactcactatagggggtgatagcggatggctgggtgtgagaagtaacagaggagaacttctatgacccagccaaacctggcggcagcgcaaaagatg

SEQ ID NO: 168669 - DNA, 103 bp, Artificial Sequence
  Synthetic Polynucleotide
taatacgactcactataggggtctcctgagggtgatagcggatggctgggaacagaggagacccagcatgccgctatcaaacctggcggcagcgcaaaagatg

SEQ ID NO: 168670 - DNA, 103 bp, Artificial Sequence
  Synthetic Polynucleotide
taatacgactcactatagggttctttcagcgtctcctgagggtgatagcgaacagaggagacgctatatgcctcaggagaacctggcggcagcgcaaaagatg

SEQ ID NO: 168671 - DNA, 103 bp, Artificial Sequence
  Synthetic Polynucleotide
taatacgactcactataggggttggacaaattctttcagcgtctcctgagaacagaggagactcaggatgcgctgaaagaacctggcggcagcgcaaaagatg

SEQ ID NO: 168672 - DNA, 103 bp, Artificial Sequence
  Synthetic Polynucleotide
taatacgactcactataggggggcagacaagttggacaaattctttcagcaacagaggagagctgaaatgatttgtccaaacctggcggcagcgcaaaagatg

SEQ ID NO: 168673 - DNA, 103 bp, Artificial Sequence
  Synthetic Polynucleotide
taatacgactcactatagggaccagcatcagggcagacaagttggacaaaaacagaggagatttgtcatgcttgtctgcaacctggcggcagcgcaaaagatg

SEQ ID NO: 168674 - DNA, 103 bp, Artificial Sequence
  Synthetic Polynucleotide
taatacgactcactatagggcagcctgctgaccagcatcagggcagacaaaacagaggagattgtctatgctgatgctgaacctggcggcagcgcaaaagatg

SEQ ID NO: 168675 - DNA, 103 bp, Artificial Sequence
  Synthetic Polynucleotide
taatacgactcactataggggctctctcttcttcttttgacatacgctttaacagaggagaaaagcgatggtcaaaagaaacctggcggcagcgcaaaagatg

SEQ ID NO: 168676 - DNA, 103 bp, Artificial Sequence
  Synthetic Polynucleotide
taatacgactcactatagggcccacctgtccagcctgctgaccagcatcaaacagaggagatgatgcatgtcagcaggcaacctggcggcagcgcaaaagatg

SEQ ID NO: 168677 - DNA, 103 bp, Artificial Sequence
  Synthetic Polynucleotide
taatacgactcactatagggattgaggaaccccacctgtccagcctgctgaacagaggagacagcagatgggacaggtgaacctggcggcagcgcaaaagatg

SEQ ID NO: 168678 - DNA, 103 bp, Artificial Sequence
  Synthetic Polynucleotide
taatacgactcactatagggtcccattgggattgaggaaccccacctgtcaacagaggagagacaggatgggttcctcaaacctggcggcagcgcaaaagatg

SEQ ID NO: 168679 - DNA, 103 bp, Artificial Sequence
  Synthetic Polynucleotide
taatacgactcactatagggccttggctgctcccattgggattgaggaacaacagaggagagttcctatgtcccaatggaacctggcggcagcgcaaaagatg

SEQ ID NO: 168680 - DNA, 103 bp, Artificial Sequence
  Synthetic Polynucleotide
taatacgactcactataggggtgcaccttgccttggctgctcccattgggaacagaggagacccaatatgagcagccaaaacctggcggcagcgcaaaagatg

SEQ ID NO: 168681 - DNA, 103 bp, Artificial Sequence
  Synthetic Polynucleotide
taatacgactcactatagggggaatgggttgtgcaccttgccttggctgcaacagaggagagcagccatggcaaggtgcaacctggcggcagcgcaaaagatg

SEQ ID NO: 168682 - DNA, 103 bp, Artificial Sequence
  Synthetic Polynucleotide
taatacgactcactatagggggggtgggaaggaatgggttgtgcaccttgaacagaggagacaaggtatgcaacccattaacctggcggcagcgcaaaagatg

SEQ ID NO: 168683 - DNA, 103 bp, Artificial Sequence
  Synthetic Polynucleotide
taatacgactcactatagggtggcaacattggggtgggaaggaatgggttaacagaggagaaacccaatgcttcccaccaacctggcggcagcgcaaaagatg

SEQ ID NO: 168684 - DNA, 103 bp, Artificial Sequence
  Synthetic Polynucleotide
taatacgactcactataggggcggtggcggtggcaacattggggtgggaaaacagaggagattcccaatgcaatgttgcaacctggcggcagcgcaaaagatg

SEQ ID NO: 168685 - DNA, 103 bp, Artificial Sequence
  Synthetic Polynucleotide
taatacgactcactatagggatcggtggtggcggtggcggtggcaacattaacagaggagaaatgttatgaccgccaccaacctggcggcagcgcaaaagatg

SEQ ID NO: 168686 - DNA, 103 bp, Artificial Sequence
  Synthetic Polynucleotide
taatacgactcactatagggatccttcacggctctctcttcttcttttgaaacagaggagatcaaaaatggaagagagaaacctggcggcagcgcaaaagatg

SEQ ID NO: 168687 - DNA, 103 bp, Artificial Sequence
  Synthetic Polynucleotide
taatacgactcactatagggaggcctggccatcggtggtggcggtggcggaacagaggagaccgccaatgccaccaccgaacctggcggcagcgcaaaagatg

SEQ ID NO: 168688 - DNA, 103 bp, Artificial Sequence
  Synthetic Polynucleotide
taatacgactcactataggggcagaggcacaggcctggccatcggtggtgaacagaggagacaccacatgtggccaggcaacctggcggcagcgcaaaagatg

SEQ ID NO: 168689 - DNA, 103 bp, Artificial Sequence
  Synthetic Polynucleotide
taatacgactcactatagggtctggcaccggcagaggcacaggcctggccaacagaggagaggccagatgtgtgcctctaacctggcggcagcgcaaaagatg

SEQ ID NO: 168690 - DNA, 103 bp, Artificial Sequence
  Synthetic Polynucleotide
taatacgactcactatagggaggctttgtgtctggcaccggcagaggcacaacagaggagagtgcctatgccggtgccaaacctggcggcagcgcaaaagatg

SEQ ID NO: 168691 - DNA, 103 bp, Artificial Sequence
  Synthetic Polynucleotide
taatacgactcactatagggacgtggttggaggctttgtgtctggcaccgaacagaggagacggtgcatgacacaaagcaacctggcggcagcgcaaaagatg

SEQ ID NO: 168692 - DNA, 103 bp, Artificial Sequence
  Synthetic Polynucleotide
taatacgactcactatagggccttctgttgacgtggttggaggctttgtgaacagaggagacacaaaatgtccaaccacaacctggcggcagcgcaaaagatg

SEQ ID NO: 168693 - DNA, 103 bp, Artificial Sequence
  Synthetic Polynucleotide
taatacgactcactatagggggctgcacctccttctgttgacgtggttggaacagaggagaccaaccatgtcaacagaaaacctggcggcagcgcaaaagatg

SEQ ID NO: 168694 - DNA, 103 bp, Artificial Sequence
  Synthetic Polynucleotide
taatacgactcactatagggacgtgggggaggctgcacctccttctgttgaacagaggagacaacagatggaggtgcagaacctggcggcagcgcaaaagatg

SEQ ID NO: 168695 - DNA, 103 bp, Artificial Sequence
  Synthetic Polynucleotide
taatacgactcactatagggtaggttggtgacgtgggggaggctgcacctaacagaggagaaggtgcatgctcccccacaacctggcggcagcgcaaaagatg

SEQ ID NO: 168696 - DNA, 103 bp, Artificial Sequence
  Synthetic Polynucleotide
taatacgactcactataggggggtgtcgagtaggttggtgacgtgggggaaacagaggagatcccccatgtcaccaaccaacctggcggcagcgcaaaagatg

SEQ ID NO: 168697 - DNA, 103 bp, Artificial Sequence
  Synthetic Polynucleotide
taatacgactcactatagggttagcaattcatccttcacggctctctcttaacagaggagaaagagaatgccgtgaaggaacctggcggcagcgcaaaagatg

SEQ ID NO: 168698 - DNA, 103 bp, Artificial Sequence
  Synthetic Polynucleotide
taatacgactcactataggggggaggtgctgggtgtcgagtaggttggtgaacagaggagacaccaaatgactcgacacaacctggcggcagcgcaaaagatg

SEQ ID NO: 168699 - DNA, 103 bp, Artificial Sequence
  Synthetic Polynucleotide
taatacgactcactatagggcggtttgcgggggaggtgctgggtgtcgagaacagaggagactcgacatgcagcacctcaacctggcggcagcgcaaaagatg

SEQ ID NO: 168700 - DNA, 103 bp, Artificial Sequence
  Synthetic Polynucleotide
taatacgactcactatagggactgacgaatcggtttgcgggggaggtgctaacagaggagaagcaccatgcccgcaaacaacctggcggcagcgcaaaagatg

SEQ ID NO: 168701 - DNA, 103 bp, Artificial Sequence
  Synthetic Polynucleotide
taatacgactcactataggggtggtccaacactgacgaatcggtttgcggaacagaggagaccgcaaatggattcgtcaaacctggcggcagcgcaaaagatg

SEQ ID NO: 168702 - DNA, 103 bp, Artificial Sequence
  Synthetic Polynucleotide
taatacgactcactatagggcttggatcccgtggtccaacactgacgaataacagaggagaattcgtatgtgttggaccaacctggcggcagcgcaaaagatg

SEQ ID NO: 168703 - DNA, 103 bp, Artificial Sequence
  Synthetic Polynucleotide
taatacgactcactatagggatttacaaagcttggatcccgtggtccaacaacagaggagagttggaatgcgggatccaaacctggcggcagcgcaaaagatg

SEQ ID NO: 168704 - DNA, 103 bp, Artificial Sequence
  Synthetic Polynucleotide
taatacgactcactataggggttgagggatatttacaaagcttggatcccaacagaggagagggatcatggctttgtaaaacctggcggcagcgcaaaagatg

SEQ ID NO: 168705 - DNA, 103 bp, Artificial Sequence
  Synthetic Polynucleotide
taatacgactcactataggggactgtgtctgttgagggatatttacaaagaacagaggagactttgtatgtatccctcaaacctggcggcagcgcaaaagatg

SEQ ID NO: 168706 - DNA, 103 bp, Artificial Sequence
  Synthetic Polynucleotide
taatacgactcactatagggcaggtaccaggactgtgtctgttgagggataacagaggagaatccctatgcagacacagaacctggcggcagcgcaaaagatg

SEQ ID NO: 168707 - DNA, 103 bp, Artificial Sequence
  Synthetic Polynucleotide
taatacgactcactatagggggtttttcacttagcaattcatccttcacgaacagaggagacgtgaaatgtgaattgctaacctggcggcagcgcaaaagatg

SEQ ID NO: 168708 - DNA, 103 bp, Artificial Sequence
  Synthetic Polynucleotide
taatacgactcactatagggcttgacctctggtttttcacttagcaattcaacagaggagagaattgatgagtgaaaaaaacctggcggcagcgcaaaagatg

SEQ ID NO: 168709 - DNA, 103 bp, Artificial Sequence
  Synthetic Polynucleotide
taatacgactcactatagggcccacttctgcttgacctctggtttttcacaacagaggagagtgaaaatgcagaggtcaaacctggcggcagcgcaaaagatg

SEQ ID NO: 168710 - DNA, 103 bp, Artificial Sequence
  Synthetic Polynucleotide
taatacgactcactatagggagtcgagatgcccacttctgcttgacctctaacagaggagaagaggtatggcagaagtgaacctggcggcagcgcaaaagatg

SEQ ID NO: 168711 - DNA, 103 bp, Artificial Sequence
  Synthetic Polynucleotide
taatacgactcactatagggctttgccagaagtcgagatgcccacttctgaacagaggagacagaagatggcatctcgaaacctggcggcagcgcaaaagatg

SEQ ID NO: 168712 - DNA, 103 bp, Artificial Sequence
  Synthetic Polynucleotide
taatacgactcactatagggggggcagaagtgcttcgatgaaaggatgaaaacagaggagattcatcatgtcatcgaagaacctggcggcagcgcaaaagatg

SEQ ID NO: 168713 - DNA, 103 bp, Artificial Sequence
  Synthetic Polynucleotide
taatacgactcactatagggctttccgcaactttgccagaagtcgagatgaacagaggagacatctcatgttctggcaaaacctggcggcagcgcaaaagatg

SEQ ID NO: 168714 - DNA, 103 bp, Artificial Sequence
  Synthetic Polynucleotide
taatacgactcactatagggggtcggatatctttccgcaactttgccagaaacagaggagatctggcatggttgcggaaaacctggcggcagcgcaaaagatg

SEQ ID NO: 168715 - DNA, 103 bp, Artificial Sequence
  Synthetic Polynucleotide
taatacgactcactatagggtcgatattcgggtcggatatctttccgcaaaacagaggagattgcggatggatatccgaaacctggcggcagcgcaaaagatg

SEQ ID NO: 168716 - DNA, 103 bp, Artificial Sequence
  Synthetic Polynucleotide
taatacgactcactatagggcaaaatcctctcgatattcgggtcggatataacagaggagaatatccatgccgaatatcaacctggcggcagcgcaaaagatg

SEQ ID NO: 168717 - DNA, 103 bp, Artificial Sequence
  Synthetic Polynucleotide
taatacgactcactatagggactgtaagaacaaaatcctctcgatattcgaacagaggagacgaataatgagaggatttaacctggcggcagcgcaaaagatg

SEQ ID NO: 168718 - DNA, 103 bp, Artificial Sequence
  Synthetic Polynucleotide
taatacgactcactatagggtttccctgtaactgtaagaacaaaatcctcaacagaggagagaggatatggttcttacaaacctggcggcagcgcaaaagatg

SEQ ID NO: 168719 - DNA, 103 bp, Artificial Sequence
  Synthetic Polynucleotide
taatacgactcactatagggatggaggttttttccctgtaactgtaagaaaacagaggagattcttaatgttacagggaaacctggcggcagcgcaaaagatg

SEQ ID NO: 168720 - DNA, 103 bp, Artificial Sequence
  Synthetic Polynucleotide
taatacgactcactatagggagaacacaacatggaggttttttccctgtaaacagaggagatacaggatgaaaacctccaacctggcggcagcgcaaaagatg

SEQ ID NO: 168721 - DNA, 103 bp, Artificial Sequence
  Synthetic Polynucleotide
taatacgactcactatagggtgggttggaaagaacacaacatggaggtttaacagaggagaaaacctatgtgttgtgttaacctggcggcagcgcaaaagatg

SEQ ID NO: 168722 - DNA, 103 bp, Artificial Sequence
  Synthetic Polynucleotide
taatacgactcactatagggctttctggtctgggttggaaagaacacaacaacagaggagagttgtgatgtttccaaccaacctggcggcagcgcaaaagatg

SEQ ID NO: 168723 - DNA, 103 bp, Artificial Sequence
  Synthetic Polynucleotide
taatacgactcactataggggctcggacgtggggcagaagtgcttcgatgaacagaggagacatcgaatgacttctgccaacctggcggcagcgcaaaagatg

SEQ ID NO: 168724 - DNA, 103 bp, Artificial Sequence
  Synthetic Polynucleotide
taatacgactcactatagggcgcatcttgcctttctggtctgggttggaaaacagaggagattccaaatgagaccagaaaacctggcggcagcgcaaaagatg

SEQ ID NO: 168725 - DNA, 103 bp, Artificial Sequence
  Synthetic Polynucleotide
taatacgactcactataggggtcaattcttcgcatcttgcctttctggtcaacagaggagagaccagatgggcaagatgaacctggcggcagcgcaaaagatg

SEQ ID NO: 168726 - DNA, 103 bp, Artificial Sequence
  Synthetic Polynucleotide
taatacgactcactatagggggcggaggcagtcaattcttcgcatcttgcaacagaggagagcaagaatggaagaattgaacctggcggcagcgcaaaagatg

SEQ ID NO: 168727 - DNA, 103 bp, Artificial Sequence
  Synthetic Polynucleotide
taatacgactcactatagggttatctgcctggcggaggcagtcaattcttaacagaggagaaagaatatgctgcctccgaacctggcggcagcgcaaaagatg

SEQ ID NO: 168728 - DNA, 103 bp, Artificial Sequence
  Synthetic Polynucleotide
taatacgactcactatagggcctccagactttatctgcctggcggaggcaaacagaggagatgcctcatgcaggcagataacctggcggcagcgcaaaagatg

SEQ ID NO: 168729 - DNA, 103 bp, Artificial Sequence
  Synthetic Polynucleotide
taatacgactcactatagggcaaggtccaacctccagactttatctgcctaacagaggagaaggcagatgaagtctggaaacctggcggcagcgcaaaagatg

SEQ ID NO: 168730 - DNA, 103 bp, Artificial Sequence
  Synthetic Polynucleotide
taatacgactcactatagggatcaccataacaaggtccaacctccagactaacagaggagaagtctgatggttggacctaacctggcggcagcgcaaaagatg

SEQ ID NO: 168731 - DNA, 103 bp, Artificial Sequence
  Synthetic Polynucleotide
taatacgactcactatagggtttaaacaaaatcaccataacaaggtccaaaacagaggagattggacatggttatggtgaacctggcggcagcgcaaaagatg

SEQ ID NO: 168732 - DNA, 103 bp, Artificial Sequence
  Synthetic Polynucleotide
taatacgactcactataggggcggaatacctttaaacaaaatcaccataaaacagaggagattatggatgttttgtttaaacctggcggcagcgcaaaagatg

SEQ ID NO: 168733 - DNA, 103 bp, Artificial Sequence
  Synthetic Polynucleotide
taatacgactcactataggggtactttccagcggaatacctttaaacaaaaacagaggagatttgttatgaggtattccaacctggcggcagcgcaaaagatg

SEQ ID NO: 168734 - DNA, 103 bp, Artificial Sequence
  Synthetic Polynucleotide
taatacgactcactataggggtaggcaaaggctcggacgtggggcagaagaacagaggagacttctgatgcacgtccgaaacctggcggcagcgcaaaagatg

SEQ ID NO: 168735 - DNA, 103 bp, Artificial Sequence
  Synthetic Polynucleotide
taatacgactcactatagggctcgccatcagtactttccagcggaataccaacagaggagaggtattatgctggaaagtaacctggcggcagcgcaaaagatg

SEQ ID NO: 168736 - DNA, 103 bp, Artificial Sequence
  Synthetic Polynucleotide
taatacgactcactatagggttacaaggcgctcgccatcagtactttccaaacagaggagatggaaaatgctgatggcgaacctggcggcagcgcaaaagatg

SEQ ID NO: 168737 - DNA, 103 bp, Artificial Sequence
  Synthetic Polynucleotide
taatacgactcactatagggtgtggggactttacaaggcgctcgccatcaaacagaggagatgatggatggcgccttgtaacctggcggcagcgcaaaagatg

SEQ ID NO: 168738 - DNA, 103 bp, Artificial Sequence
  Synthetic Polynucleotide
taatacgactcactatagggattagagcattgtggggactttacaaggcgaacagaggagacgccttatgaagtccccaaacctggcggcagcgcaaaagatg

SEQ ID NO: 168739 - DNA, 103 bp, Artificial Sequence
  Synthetic Polynucleotide
taatacgactcactatagggagagccctggattagagcattgtggggactaacagaggagaagtcccatgaatgctctaaacctggcggcagcgcaaaagatg

SEQ ID NO: 168740 - DNA, 103 bp, Artificial Sequence
  Synthetic Polynucleotide
taatacgactcactatagggggttggacacagagccctggattagagcataacagaggagaatgctcatgtccagggctaacctggcggcagcgcaaaagatg

SEQ ID NO: 168741 - DNA, 103 bp, Artificial Sequence
  Synthetic Polynucleotide
taatacgactcactatagggtatgtgatggggttggacacagagccctggaacagaggagaccagggatgtgtgtccaaaacctggcggcagcgcaaaagatg

SEQ ID NO: 168742 - DNA, 103 bp, Artificial Sequence
  Synthetic Polynucleotide
taatacgactcactatagggcagaaacccctatgtgatggggttggacacaacagaggagagtgtccatgcccatcacaaacctggcggcagcgcaaaagatg

SEQ ID NO: 168743 - DNA, 103 bp, Artificial Sequence
  Synthetic Polynucleotide
taatacgactcactatagggagttccttaacagaaacccctatgtgatggaacagaggagaccatcaatgaggggtttcaacctggcggcagcgcaaaagatg

SEQ ID NO: 168744 - DNA, 103 bp, Artificial Sequence
  Synthetic Polynucleotide
taatacgactcactatagggatataaatcgagttccttaacagaaaccccaacagaggagaggggttatggttaaggaaaacctggcggcagcgcaaaagatg

SEQ ID NO: 168745 - DNA, 103 bp, Artificial Sequence
  Synthetic Polynucleotide
taatacgactcactatagggtgaaccatgtgtaggcaaaggctcggacgtaacagaggagaacgtccatgcctttgcctaacctggcggcagcgcaaaagatg

SEQ ID NO: 168746 - DNA, 103 bp, Artificial Sequence
  Synthetic Polynucleotide
taatacgactcactatagggagtatgccaaatataaatcgagttccttaaaacagaggagattaaggatgtcgatttataacctggcggcagcgcaaaagatg

SEQ ID NO: 168747 - DNA, 103 bp, Artificial Sequence
  Synthetic Polynucleotide
taatacgactcactataggggcatgcacaaagtatgccaaatataaatcgaacagaggagacgatttatgtttggcataaacctggcggcagcgcaaaagatg

SEQ ID NO: 168748 - DNA, 103 bp, Artificial Sequence
  Synthetic Polynucleotide
taatacgactcactatagggtgaatctgctgcatgcacaaagtatgccaaaacagaggagattggcaatgtttgtgcataacctggcggcagcgcaaaagatg

SEQ ID NO: 168749 - DNA, 103 bp, Artificial Sequence
  Synthetic Polynucleotide
taatacgactcactatagggcagattgacttgaatctgctgcatgcacaaaacagaggagattgtgcatgcagcagattaacctggcggcagcgcaaaagatg

SEQ ID NO: 168750 - DNA, 103 bp, Artificial Sequence
  Synthetic Polynucleotide
taatacgactcactatagggctgggactttcagattgacttgaatctgctaacagaggagaagcagaatgaagtcaatcaacctggcggcagcgcaaaagatg

SEQ ID NO: 168751 - DNA, 103 bp, Artificial Sequence
  Synthetic Polynucleotide
taatacgactcactatagggacttggctggctgggactttcagattgactaacagaggagaagtcaaatggaaagtcccaacctggcggcagcgcaaaagatg

SEQ ID NO: 168752 - DNA, 103 bp, Artificial Sequence
  Synthetic Polynucleotide
taatacgactcactatagggtgtcagcgtcacttggctggctgggactttaacagaggagaaaagtcatggccagccaaaacctggcggcagcgcaaaagatg

SEQ ID NO: 168753 - DNA, 103 bp, Artificial Sequence
  Synthetic Polynucleotide
taatacgactcactatagggtggtccttaatgtcagcgtcacttggctggaacagaggagaccagccatgtgacgctgaaacctggcggcagcgcaaaagatg

SEQ ID NO: 168754 - DNA, 103 bp, Artificial Sequence
  Synthetic Polynucleotide
taatacgactcactatagggattttctggctggtccttaatgtcagcgtcaacagaggagagacgctatgattaaggacaacctggcggcagcgcaaaagatg

SEQ ID NO: 168755 - DNA, 103 bp, Artificial Sequence
  Synthetic Polynucleotide
taatacgactcactatagggccaaatgtccattttctggctggtccttaaaacagaggagattaaggatgagccagaaaaacctggcggcagcgcaaaagatg

SEQ ID NO: 168756 - DNA, 103 bp, Artificial Sequence
  Synthetic Polynucleotide
taatacgactcactataggggcctgcaggttgaaccatgtgtaggcaaagaacagaggagactttgcatgcacatggttaacctggcggcagcgcaaaagatg

SEQ ID NO: 168757 - DNA, 103 bp, Artificial Sequence
  Synthetic Polynucleotide
taatacgactcactatagggtcctggaagcccaaatgtccattttctggcaacagaggagagccagaatgtggacatttaacctggcggcagcgcaaaagatg

SEQ ID NO: 168758 - DNA, 103 bp, Artificial Sequence
  Synthetic Polynucleotide
taatacgactcactataggggacaaaactgtcctggaagcccaaatgtccaacagaggagaggacatatgggcttccagaacctggcggcagcgcaaaagatg

SEQ ID NO: 168759 - DNA, 103 bp, Artificial Sequence
  Synthetic Polynucleotide
taatacgactcactatagggcacctgatgtgacaaaactgtcctggaagcaacagaggagagcttccatgacagttttgaacctggcggcagcgcaaaagatg

SEQ ID NO: 168760 - DNA, 103 bp, Artificial Sequence
  Synthetic Polynucleotide
taatacgactcactatagggacactaaaaacacctgatgtgacaaaactgaacagaggagacagtttatgcacatcaggaacctggcggcagcgcaaaagatg

SEQ ID NO: 168761 - DNA, 103 bp, Artificial Sequence
  Synthetic Polynucleotide
taatacgactcactatagggtagctcagtgacactaaaaacacctgatgtaacagaggagaacatcaatggtttttagtaacctggcggcagcgcaaaagatg

SEQ ID NO: 168762 - DNA, 103 bp, Artificial Sequence
  Synthetic Polynucleotide
taatacgactcactatagggacactcttactagctcagtgacactaaaaaaacagaggagatttttaatgtcactgagcaacctggcggcagcgcaaaagatg

SEQ ID NO: 168763 - DNA, 103 bp, Artificial Sequence
  Synthetic Polynucleotide
taatacgactcactatagggggtgtctgtgacactcttactagctcagtgaacagaggagacactgaatgagtaagagtaacctggcggcagcgcaaaagatg

SEQ ID NO: 168764 - DNA, 103 bp, Artificial Sequence
  Synthetic Polynucleotide
taatacgactcactatagggtgcagctattggtgtctgtgacactcttacaacagaggagagtaagaatgtcacagacaaacctggcggcagcgcaaaagatg

SEQ ID NO: 168765 - DNA, 103 bp, Artificial Sequence
  Synthetic Polynucleotide
taatacgactcactatagggggccagttcctgcagctattggtgtctgtgaacagaggagacacagaatgcaatagctgaacctggcggcagcgcaaaagatg

SEQ ID NO: 168766 - DNA, 103 bp, Artificial Sequence
  Synthetic Polynucleotide
taatacgactcactataggggaaaaatttgggccagttcctgcagctattaacagaggagaaatagcatgaggaactggaacctggcggcagcgcaaaagatg

SEQ ID NO: 168767 - DNA, 103 bp, Artificial Sequence
  Synthetic Polynucleotide
taatacgactcactatagggtcgttttcgggcctgcaggttgaaccatgtaacagaggagaacatggatgaacctgcagaacctggcggcagcgcaaaagatg

SEQ ID NO: 168768 - DNA, 103 bp, Artificial Sequence
  Synthetic Polynucleotide
taatacgactcactatagggatctgagagagaaaaatttgggccagttccaacagaggagaggaactatgccaaattttaacctggcggcagcgcaaaagatg

SEQ ID NO: 168769 - DNA, 103 bp, Artificial Sequence
  Synthetic Polynucleotide
taatacgactcactatagggaactttccaaatctgagagagaaaaatttgaacagaggagacaaattatgctctctcagaacctggcggcagcgcaaaagatg

SEQ ID NO: 168770 - DNA, 103 bp, Artificial Sequence
  Synthetic Polynucleotide
taatacgactcactatagggtagtatgaagaactttccaaatctgagagaaacagaggagatctctcatgtttggaaagaacctggcggcagcgcaaaagatg

SEQ ID NO: 168771 - DNA, 103 bp, Artificial Sequence
  Synthetic Polynucleotide
taatacgactcactatagggactcatgctgtagtatgaagaactttccaaaacagaggagattggaaatgtcttcatacaacctggcggcagcgcaaaagatg

SEQ ID NO: 168772 - DNA, 103 bp, Artificial Sequence
  Synthetic Polynucleotide
taatacgactcactatagggttgctcctggactcatgctgtagtatgaagaacagaggagacttcatatgacagcatgaaacctggcggcagcgcaaaagatg

SEQ ID NO: 168773 - DNA, 103 bp, Artificial Sequence
  Synthetic Polynucleotide
taatacgactcactataggggacctcctcattgctcctggactcatgctgaacagaggagacagcatatgtccaggagcaacctggcggcagcgcaaaagatg

SEQ ID NO: 168774 - DNA, 103 bp, Artificial Sequence
  Synthetic Polynucleotide
taatacgactcactataggggctgggtaaagacctcctcattgctcctggaacagaggagaccaggaatgatgaggaggaacctggcggcagcgcaaaagatg

SEQ ID NO: 168775 - DNA, 103 bp, Artificial Sequence
  Synthetic Polynucleotide
taatacgactcactatagggtagaggatgtgctgggtaaagacctcctcaaacagaggagatgaggaatgctttacccaaacctggcggcagcgcaaaagatg

SEQ ID NO: 168776 - DNA, 103 bp, Artificial Sequence
  Synthetic Polynucleotide
taatacgactcactataggggtggagctcgtagaggatgtgctgggtaaaaacagaggagatttaccatgcacatcctcaacctggcggcagcgcaaaagatg

SEQ ID NO: 168777 - DNA, 103 bp, Artificial Sequence
  Synthetic Polynucleotide
taatacgactcactataggggaggcgctttgtggagctcgtagaggatgtaacagaggagaacatccatgacgagctccaacctggcggcagcgcaaaagatg

SEQ ID NO: 168778 - DNA, 103 bp, Artificial Sequence
  Synthetic Polynucleotide
taatacgactcactatagggtgaagtattttcgttttcgggcctgcaggtaacagaggagaacctgcatgcccgaaaacaacctggcggcagcgcaaaagatg

SEQ ID NO: 168779 - DNA, 103 bp, Artificial Sequence
  Synthetic Polynucleotide
taatacgactcactatagggccacagacttgaggcgctttgtggagctcgaacagaggagacgagctatgcaaagcgccaacctggcggcagcgcaaaagatg

SEQ ID NO: 168780 - DNA, 103 bp, Artificial Sequence
  Synthetic Polynucleotide
taatacgactcactatagggatttcatcctccacagacttgaggcgctttaacagaggagaaaagcgatgcaagtctgtaacctggcggcagcgcaaaagatg

SEQ ID NO: 168781 - DNA, 103 bp, Artificial Sequence
  Synthetic Polynucleotide
taatacgactcactatagggaggactgtccatttcatcctccacagacttaacagaggagaaagtctatggaggatgaaaacctggcggcagcgcaaaagatg

SEQ ID NO: 168782 - DNA, 103 bp, Artificial Sequence
  Synthetic Polynucleotide
taatacgactcactataggggctcctcaccaggactgtccatttcatcctaacagaggagaaggatgatgtggacagtcaacctggcggcagcgcaaaagatg

SEQ ID NO: 168783 - DNA, 103 bp, Artificial Sequence
  Synthetic Polynucleotide
taatacgactcactataggggtataaaatggctcctcaccaggactgtccaacagaggagaggacagatgtggtgaggaaacctggcggcagcgcaaaagatg

SEQ ID NO: 168784 - DNA, 103 bp, Artificial Sequence
  Synthetic Polynucleotide
taatacgactcactatagggcccttggcctgtataaaatggctcctcaccaacagaggagaggtgagatgccattttataacctggcggcagcgcaaaagatg

SEQ ID NO: 168785 - DNA, 103 bp, Artificial Sequence
  Synthetic Polynucleotide
taatacgactcactatagggctggggagcgcccttggcctgtataaaatgaacagaggagacattttatgcaggccaagaacctggcggcagcgcaaaagatg

SEQ ID NO: 168786 - DNA, 103 bp, Artificial Sequence
  Synthetic Polynucleotide
taatacgactcactatagggctgccacttcctggggagcgcccttggcctaacagaggagaaggccaatggcgctccccaacctggcggcagcgcaaaagatg

SEQ ID NO: 168787 - DNA, 103 bp, Artificial Sequence
  Synthetic Polynucleotide
taatacgactcactatagggacttgactgactgccacttcctggggagcgaacagaggagacgctccatgggaagtggcaacctggcggcagcgcaaaagatg

SEQ ID NO: 168788 - DNA, 103 bp, Artificial Sequence
  Synthetic Polynucleotide
taatacgactcactatagggcatgccatccacttgactgactgccacttcaacagaggagagaagtgatggtcagtcaaaacctggcggcagcgcaaaagatg

SEQ ID NO: 168789 - DNA, 103 bp, Artificial Sequence
  Synthetic Polynucleotide
taatacgactcactatagggtcatgttttttgaagtattttcgttttcggaacagaggagaccgaaaatgaaaatacttaacctggcggcagcgcaaaagatg

SEQ ID NO: 168790 - DNA, 103 bp, Artificial Sequence
  Synthetic Polynucleotide
taatacgactcactatagggggctccacttcatgccatccacttgactgaaacagaggagatcagtcatgtggatggcaaacctggcggcagcgcaaaagatg

SEQ ID NO: 168791 - DNA, 103 bp, Artificial Sequence
  Synthetic Polynucleotide
taatacgactcactatagggtggcattcctggctccacttcatgccatccaacagaggagaggatggatggaagtggagaacctggcggcagcgcaaaagatg

SEQ ID NO: 168792 - DNA, 103 bp, Artificial Sequence
  Synthetic Polynucleotide
taatacgactcactatagggtggttggagatggcattcctggctccacttaacagaggagaaagtggatgcaggaatgcaacctggcggcagcgcaaaagatg

SEQ ID NO: 168793 - DNA, 103 bp, Artificial Sequence
  Synthetic Polynucleotide
taatacgactcactatagggttcttcagtgtggttggagatggcattcctaacagaggagaaggaatatgatctccaacaacctggcggcagcgcaaaagatg

SEQ ID NO: 168794 - DNA, 103 bp, Artificial Sequence
  Synthetic Polynucleotide
taatacgactcactatagggcttctccgacttcttcagtgtggttggagaaacagaggagatctccaatgacactgaagaacctggcggcagcgcaaaagatg

SEQ ID NO: 168795 - DNA, 103 bp, Artificial Sequence
  Synthetic Polynucleotide
taatacgactcactatagggtgaaaccagacttctccgacttcttcagtgaacagaggagacactgaatgagtcggagaaacctggcggcagcgcaaaagatg

SEQ ID NO: 168796 - DNA, 103 bp, Artificial Sequence
  Synthetic Polynucleotide
taatacgactcactataggggaggggctgctgaaaccagacttctccgacaacagaggagagtcggaatggtctggtttaacctggcggcagcgcaaaagatg

SEQ ID NO: 168797 - DNA, 103 bp, Artificial Sequence
  Synthetic Polynucleotide
taatacgactcactatagggctgtgaaggggaggggctgctgaaaccagaaacagaggagatctggtatgagcagccccaacctggcggcagcgcaaaagatg

SEQ ID NO: 168798 - DNA, 103 bp, Artificial Sequence
  Synthetic Polynucleotide
taatacgactcactataggggggaggaggtctgtgaaggggaggggctgcaacagaggagagcagccatgccccttcacaacctggcggcagcgcaaaagatg

SEQ ID NO: 168799 - DNA, 103 bp, Artificial Sequence
  Synthetic Polynucleotide
taatacgactcactataggggccgttcccagggaggaggtctgtgaagggaacagaggagacccttcatggacctcctcaacctggcggcagcgcaaaagatg

SEQ ID NO: 168800 - DNA, 103 bp, Artificial Sequence
  Synthetic Polynucleotide
taatacgactcactatagggctgagtgagacagatgggagaatacatcataacagaggagaatgatgatgtctcccatcaacctggcggcagcgcaaaagatg

SEQ ID NO: 168801 - DNA, 103 bp, Artificial Sequence
  Synthetic Polynucleotide
taatacgactcactatagggcttgcgttttcgagcctgcaggttgaaccaaacagaggagatggttcatgctgcaggctaacctggcggcagcgcaaaagatg

SEQ ID NO: 168802 - DNA, 103 bp, Artificial Sequence
  Synthetic Polynucleotide
taatacgactcactatagggggggaaagtgctcagtcttggggaagaatcaacagaggagagattctatgccaagactgaacctggcggcagcgcaaaagatg

SEQ ID NO: 168803 - DNA, 103 bp, Artificial Sequence
  Synthetic Polynucleotide
taatacgactcactatagggggtggtgctgggggaaagtgctcagtcttgaacagaggagacaagacatggcactttccaacctggcggcagcgcaaaagatg

SEQ ID NO: 168804 - DNA, 103 bp, Artificial Sequence
  Synthetic Polynucleotide
taatacgactcactatagggattccgggatggtggtgctgggggaaagtgaacagaggagacactttatgccagcaccaaacctggcggcagcgcaaaagatg

SEQ ID NO: 168805 - DNA, 103 bp, Artificial Sequence
  Synthetic Polynucleotide
taatacgactcactatagggaactccaggtattccgggatggtggtgctgaacagaggagacagcacatgcatcccggaaacctggcggcagcgcaaaagatg

SEQ ID NO: 168806 - DNA, 103 bp, Artificial Sequence
  Synthetic Polynucleotide
taatacgactcactatagggcactgtgtgcaactccaggtattccgggataacagaggagaatcccgatgtacctggagaacctggcggcagcgcaaaagatg

SEQ ID NO: 168807 - DNA, 103 bp, Artificial Sequence
  Synthetic Polynucleotide
taatacgactcactataggggttgagatgacactgtgtgcaactccaggtaacagaggagaacctggatgtgcacacagaacctggcggcagcgcaaaagatg

SEQ ID NO: 168808 - DNA, 103 bp, Artificial Sequence
  Synthetic Polynucleotide
taatacgactcactatagggtggagttcgagttgagatgacactgtgtgcaacagaggagagcacacatggtcatctcaaacctggcggcagcgcaaaagatg

SEQ ID NO: 168809 - DNA, 103 bp, Artificial Sequence
  Synthetic Polynucleotide
taatacgactcactatagggaaggtggaggtggagttcgagttgagatgaaacagaggagatcatctatgctcgaactcaacctggcggcagcgcaaaagatg

SEQ ID NO: 168810 - DNA, 103 bp, Artificial Sequence
  Synthetic Polynucleotide
taatacgactcactatagggggcaacggtgaaggtggaggtggagttcgaaacagaggagatcgaacatgacctccaccaacctggcggcagcgcaaaagatg

SEQ ID NO: 168811 - DNA, 103 bp, Artificial Sequence
  Synthetic Polynucleotide
taatacgactcactatagggtgttggaaatggcaacggtgaaggtggaggaacagaggagacctccaatgtcaccgttgaacctggcggcagcgcaaaagatg

SEQ ID NO: 168812 - DNA, 103 bp, Artificial Sequence
  Synthetic Polynucleotide
taatacgactcactatagggttttaaagtacttgcgttttcgagcctgcaaacagaggagatgcaggatggaaaacgcaaacctggcggcagcgcaaaagatg

SEQ ID NO: 168813 - DNA, 103 bp, Artificial Sequence
  Synthetic Polynucleotide
taatacgactcactatagggggatagcttgtgttggaaatggcaacggtgaacagaggagacaccgtatgcatttccaaaacctggcggcagcgcaaaagatg

SEQ ID NO: 168814 - DNA, 103 bp, Artificial Sequence
  Synthetic Polynucleotide
taatacgactcactataggggctggaggaaggatagcttgtgttggaaataacagaggagaatttccatgacaagctataacctggcggcagcgcaaaagatg

SEQ ID NO: 168815 - DNA, 103 bp, Artificial Sequence
  Synthetic Polynucleotide
taatacgactcactataggggctcgatggggctggaggaaggatagcttgaacagaggagacaagctatgcttcctccaaacctggcggcagcgcaaaagatg

SEQ ID NO: 168816 - DNA, 103 bp, Artificial Sequence
  Synthetic Polynucleotide
taatacgactcactataggggagaaaagtagctcgatggggctggaggaaaacagaggagattcctcatgccccatcgaaacctggcggcagcgcaaaagatg

SEQ ID NO: 168817 - DNA, 103 bp, Artificial Sequence
  Synthetic Polynucleotide
taatacgactcactatagggattgttggatgagaaaagtagctcgatgggaacagaggagacccatcatgctacttttcaacctggcggcagcgcaaaagatg

SEQ ID NO: 168818 - DNA, 103 bp, Artificial Sequence
  Synthetic Polynucleotide
taatacgactcactatagggaggatatctgattgttggatgagaaaagtaaacagaggagatactttatgcatccaacaaacctggcggcagcgcaaaagatg

SEQ ID NO: 168819 - DNA, 103 bp, Artificial Sequence
  Synthetic Polynucleotide
taatacgactcactatagggtcaggtggggaggatatctgattgttggataacagaggagaatccaaatgtcagatatcaacctggcggcagcgcaaaagatg

SEQ ID NO: 168820 - DNA, 103 bp, Artificial Sequence
  Synthetic Polynucleotide
taatacgactcactatagggtcctgaggattcaggtggggaggatatctgaacagaggagacagataatgtccccacctaacctggcggcagcgcaaaagatg

SEQ ID NO: 168821 - DNA, 103 bp, Artificial Sequence
  Synthetic Polynucleotide
taatacgactcactatagggcttcagagtatcctgaggattcaggtggggaacagaggagaccccacatgaatcctcagaacctggcggcagcgcaaaagatg

SEQ ID NO: 168822 - DNA, 103 bp, Artificial Sequence
  Synthetic Polynucleotide
taatacgactcactataggggtacatagttcttcagagtatcctgaggataacagaggagaatcctcatgatactctgaaacctggcggcagcgcaaaagatg

SEQ ID NO: 168823 - DNA, 103 bp, Artificial Sequence
  Synthetic Polynucleotide
taatacgactcactatagggttctcatgctttttaaagtacttgcgttttaacagaggagaaaaacgatggtactttaaaacctggcggcagcgcaaaagatg

SEQ ID NO: 168824 - DNA, 103 bp, Artificial Sequence
  Synthetic Polynucleotide
taatacgactcactatagggtcataagaaggtacatagttcttcagagtaaacagaggagatactctatggaactatgtaacctggcggcagcgcaaaagatg

SEQ ID NO: 168825 - DNA, 103 bp, Artificial Sequence
  Synthetic Polynucleotide
taatacgactcactatagggactggatgggtcataagaaggtacatagttaacagaggagaaactatatgccttcttataacctggcggcagcgcaaaagatg

SEQ ID NO: 168826 - DNA, 103 bp, Artificial Sequence
  Synthetic Polynucleotide
taatacgactcactatagggtggtttgtggactggatgggtcataagaagaacagaggagacttcttatgacccatccaaacctggcggcagcgcaaaagatg

SEQ ID NO: 168827 - DNA, 103 bp, Artificial Sequence
  Synthetic Polynucleotide
taatacgactcactatagggcaggactggctggtttgtggactggatgggaacagaggagacccatcatgtccacaaacaacctggcggcagcgcaaaagatg

SEQ ID NO: 168828 - DNA, 103 bp, Artificial Sequence
  Synthetic Polynucleotide
taatacgactcactataggggcccaggtaccaggactggctggtttgtggaacagaggagaccacaaatgagccagtccaacctggcggcagcgcaaaagatg

SEQ ID NO: 168829 - DNA, 103 bp, Artificial Sequence
  Synthetic Polynucleotide
taatacgactcactatagggtgacattcgcttctcatgctttttaaagtaaacagaggagatactttatgaagcatgagaacctggcggcagcgcaaaagatg

SEQ ID NO: 168830 - DNA, 103 bp, Artificial Sequence
  Synthetic Polynucleotide
taatacgactcactatagggcttcatcctttgacattcgcttctcatgctaacagaggagaagcatgatgagcgaatgtaacctggcggcagcgcaaaagatg

SEQ ID NO: 168831 - DNA, 103 bp, Artificial Sequence
  Synthetic Polynucleotide
taatacgactcactatagggactgctctttcttcatcctttgacattcgcaacagaggagagcgaatatgaaaggatgaaacctggcggcagcgcaaaagatg

SEQ ID NO: 168832 - DNA, 103 bp, Artificial Sequence
  Synthetic Polynucleotide
taatacgactcactatagggctcatctttgactgctctttcttcatccttaacagaggagaaaggatatggaaagagcaaacctggcggcagcgcaaaagatg

SEQ ID NO: 168833 - DNA, 103 bp, Artificial Sequence
  Synthetic Polynucleotide
taatacgactcactatagggcactgagaagctcatctttgactgctctttaacagaggagaaaagagatgtcaaagatgaacctggcggcagcgcaaaagatg

SEQ ID NO: 168834 - DNA, 103 bp, Artificial Sequence
  Synthetic Polynucleotide
taatacgactcactatagggtcaggcttttcactgagaagctcatctttgaacagaggagacaaagaatggcttctcagaacctggcggcagcgcaaaagatg

SEQ ID NO: 168835 - DNA, 103 bp, Artificial Sequence
  Synthetic Polynucleotide
taatacgactcactatagggctgtttgatttcaggcttttcactgagaagaacagaggagacttctcatggaaaagcctaacctggcggcagcgcaaaagatg

SEQ ID NO: 168836 - DNA, 103 bp, Artificial Sequence
  Synthetic Polynucleotide
taatacgactcactataggggaaattcatcctgagtgagacagatgggagaacagaggagactcccaatggtctcactcaacctggcggcagcgcaaaagatg

SEQ ID NO: 168837 - DNA, 103 bp, Artificial Sequence
  Synthetic Polynucleotide
taatacgactcactatagggatgcccacttctgtttgatttcaggcttttaacagaggagaaaaagcatgaaatcaaacaacctggcggcagcgcaaaagatg

SEQ ID NO: 168838 - DNA, 103 bp, Artificial Sequence
  Synthetic Polynucleotide
taatacgactcactatagggaggagcctggatgcccacttctgtttgattaacagaggagaaatcaaatggaagtgggcaacctggcggcagcgcaaaagatg

SEQ ID NO: 168839 - DNA, 103 bp, Artificial Sequence
  Synthetic Polynucleotide
taatacgactcactatagggcagtttggcaaggagcctggatgcccacttaacagaggagaaagtggatgtccaggctcaacctggcggcagcgcaaaagatg

SEQ ID NO: 168840 - DNA, 103 bp, Artificial Sequence
  Synthetic Polynucleotide
taatacgactcactatagggtatctttgcgcagtttggcaaggagcctggaacagaggagaccaggcatgttgccaaacaacctggcggcagcgcaaaagatg

SEQ ID NO: 168841 - DNA, 103 bp, Artificial Sequence
  Synthetic Polynucleotide
taatacgactcactatagggtcctggcgaatatctttgcgcagtttggcaaacagaggagatgccaaatggcgcaaagaaacctggcggcagcgcaaaagatg

SEQ ID NO: 168842 - DNA, 103 bp, Artificial Sequence
  Synthetic Polynucleotide
taatacgactcactatagggctctcgatactcctggcgaatatctttgcgaacagaggagacgcaaaatgattcgccagaacctggcggcagcgcaaaagatg

SEQ ID NO: 168843 - DNA, 103 bp, Artificial Sequence
  Synthetic Polynucleotide
taatacgactcactataggggcacaaagtcctctcgatactcctggcgaaaacagaggagattcgccatgagtatcgagaacctggcggcagcgcaaaagatg

SEQ ID NO: 168844 - DNA, 103 bp, Artificial Sequence
  Synthetic Polynucleotide
taatacgactcactataggggtcacggtgagcacaaagtcctctcgatacaacagaggagagtatcgatgggactttgtaacctggcggcagcgcaaaagatg

SEQ ID NO: 168845 - DNA, 103 bp, Artificial Sequence
  Synthetic Polynucleotide
taatacgactcactatagggcttcttgccagtcacggtgagcacaaagtcaacagaggagagactttatgctcaccgtgaacctggcggcagcgcaaaagatg

SEQ ID NO: 168846 - DNA, 103 bp, Artificial Sequence
  Synthetic Polynucleotide
taatacgactcactatagggagcacgggtgcttcttgccagtcacggtgaaacagaggagatcaccgatgctggcaagaaacctggcggcagcgcaaaagatg

SEQ ID NO: 168847 - DNA, 103 bp, Artificial Sequence
  Synthetic Polynucleotide
taatacgactcactatagggatgaatgggtgaaattcatcctgagtgagaaacagaggagatctcacatgggatgaattaacctggcggcagcgcaaaagatg

SEQ ID NO: 168848 - DNA, 103 bp, Artificial Sequence
  Synthetic Polynucleotide
taatacgactcactataggggataagacacagcacgggtgcttcttgccaaacagaggagatggcaaatggcacccgtgaacctggcggcagcgcaaaagatg

SEQ ID NO: 168849 - DNA, 103 bp, Artificial Sequence
  Synthetic Polynucleotide
taatacgactcactataggggtcgggattggataagacacagcacgggtgaacagaggagacacccgatgtgtgtcttaaacctggcggcagcgcaaaagatg

SEQ ID NO: 168850 - DNA, 103 bp, Artificial Sequence
  Synthetic Polynucleotide
taatacgactcactatagggtacccttctggtcgggattggataagacacaacagaggagagtgtctatgccaatcccgaacctggcggcagcgcaaaagatg

SEQ ID NO: 168851 - DNA, 103 bp, Artificial Sequence
  Synthetic Polynucleotide
taatacgactcactatagggctcctaatcttacccttctggtcgggattgaacagaggagacaatccatgccagaagggaacctggcggcagcgcaaaagatg

SEQ ID NO: 168852 - DNA, 103 bp, Artificial Sequence
  Synthetic Polynucleotide
taatacgactcactataggggcagtcgattctcctaatcttacccttctgaacagaggagacagaagatgaagattaggaacctggcggcagcgcaaaagatg

SEQ ID NO: 168853 - DNA, 103 bp, Artificial Sequence
  Synthetic Polynucleotide
taatacgactcactatagggcctgtcgcaggcagtcgattctcctaatctaacagaggagaagattaatggaatcgactaacctggcggcagcgcaaaagatg

SEQ ID NO: 168854 - DNA, 103 bp, Artificial Sequence
  Synthetic Polynucleotide
taatacgactcactatagggactttgtctgcctgtcgcaggcagtcgattaacagaggagaaatcgaatgcctgcgacaaacctggcggcagcgcaaaagatg

SEQ ID NO: 168855 - DNA, 103 bp, Artificial Sequence
  Synthetic Polynucleotide
taatacgactcactatagggcagacgccagactttgtctgcctgtcgcagaacagaggagactgcgaatggcagacaaaaacctggcggcagcgcaaaagatg

SEQ ID NO: 168856 - DNA, 103 bp, Artificial Sequence
  Synthetic Polynucleotide
taatacgactcactatagggtgactagatccagacgccagactttgtctgaacagaggagacagacaatgtctggcgtcaacctggcggcagcgcaaaagatg

SEQ ID NO: 168857 - DNA, 103 bp, Artificial Sequence
  Synthetic Polynucleotide
taatacgactcactatagggaggatcaccatgactagatccagacgccagaacagaggagactggcgatgggatctagtaacctggcggcagcgcaaaagatg

SEQ ID NO: 168858 - DNA, 103 bp, Artificial Sequence
  Synthetic Polynucleotide
taatacgactcactatagggaagtgcctcgatgaatgggtgaaattcatcaacagaggagagatgaaatgcacccattcaacctggcggcagcgcaaaagatg

SEQ ID NO: 168859 - DNA, 103 bp, Artificial Sequence
  Synthetic Polynucleotide
taatacgactcactataggggcctttgaacaggatcaccatgactagatcaacagaggagagatctaatgatggtgatcaacctggcggcagcgcaaaagatg

SEQ ID NO: 168860 - DNA, 103 bp, Artificial Sequence
  Synthetic Polynucleotide
taatacgactcactatagggccaaggggatgcctttgaacaggatcaccaaacagaggagatggtgaatgtgttcaaagaacctggcggcagcgcaaaagatg

SEQ ID NO: 168861 - DNA, 103 bp, Artificial Sequence
  Synthetic Polynucleotide
taatacgactcactatagggtcggtactttccaaggggatgcctttgaacaacagaggagagttcaaatgcatccccttaacctggcggcagcgcaaaagatg

SEQ ID NO: 168862 - DNA, 103 bp, Artificial Sequence
  Synthetic Polynucleotide
taatacgactcactatagggccgctctccatcggtactttccaaggggataacagaggagaatccccatggaaagtaccaacctggcggcagcgcaaaagatg

SEQ ID NO: 168863 - DNA, 103 bp, Artificial Sequence
  Synthetic Polynucleotide
taatacgactcactatagggatttcatgagccgctctccatcggtactttaacagaggagaaaagtaatgatggagagcaacctggcggcagcgcaaaagatg

SEQ ID NO: 168864 - DNA, 103 bp, Artificial Sequence
  Synthetic Polynucleotide
taatacgactcactatagggcaatgtggggatttcatgagccgctctccaaacagaggagatggagaatggctcatgaaaacctggcggcagcgcaaaagatg

SEQ ID NO: 168865 - DNA, 103 bp, Artificial Sequence
  Synthetic Polynucleotide
taatacgactcactatagggtgggtttgtgcaatgtggggatttcatgagaacagaggagactcatgatgtccccacataacctggcggcagcgcaaaagatg

SEQ ID NO: 168866 - DNA, 103 bp, Artificial Sequence
  Synthetic Polynucleotide
taatacgactcactatagggcacaaagtgctgggtttgtgcaatgtggggaacagaggagaccccacatggcacaaaccaacctggcggcagcgcaaaagatg

SEQ ID NO: 168867 - DNA, 103 bp, Artificial Sequence
  Synthetic Polynucleotide
taatacgactcactatagggtgtggctggacacaaagtgctgggtttgtgaacagaggagacacaaaatgagcactttgaacctggcggcagcgcaaaagatg

SEQ ID NO: 168868 - DNA, 103 bp, Artificial Sequence
  Synthetic Polynucleotide
taatacgactcactatagggtgtgatatgatgtggctggacacaaagtgcaacagaggagagcacttatggtccagccaaacctggcggcagcgcaaaagatg

SEQ ID NO: 168869 - DNA, 103 bp, Artificial Sequence
  Synthetic Polynucleotide
taatacgactcactatagggcatgtggaagaagtgcctcgatgaatgggtaacagaggagaacccatatgtcgaggcacaacctggcggcagcgcaaaagatg

SEQ ID NO: 168870 - DNA, 103 bp, Artificial Sequence
  Synthetic Polynucleotide
taatacgactcactatagggtaactgatactgtgatatgatgtggctggaaacagaggagatccagcatgatcatatcaaacctggcggcagcgcaaaagatg

SEQ ID NO: 168871 - DNA, 103 bp, Artificial Sequence
  Synthetic Polynucleotide
taatacgactcactatagggtcaagctccttaactgatactgtgatatgaaacagaggagatcatatatgagtatcagtaacctggcggcagcgcaaaagatg

SEQ ID NO: 168872 - DNA, 103 bp, Artificial Sequence
  Synthetic Polynucleotide
taatacgactcactatagggcaaaaacaaatcaagctccttaactgatacaacagaggagagtatcaatgaaggagcttaacctggcggcagcgcaaaagatg

SEQ ID NO: 168873 - DNA, 103 bp, Artificial Sequence
  Synthetic Polynucleotide
taatacgactcactatagggcgtagtatgccaaaaacaaatcaagctcctaacagaggagaaggagcatgatttgttttaacctggcggcagcgcaaaagatg

SEQ ID NO: 168874 - DNA, 103 bp, Artificial Sequence
  Synthetic Polynucleotide
taatacgactcactatagggtgctcctgcacgtagtatgccaaaaacaaaaacagaggagatttgttatgggcatactaaacctggcggcagcgcaaaagatg

SEQ ID NO: 168875 - DNA, 103 bp, Artificial Sequence
  Synthetic Polynucleotide
taatacgactcactatagggtccagaatcttgctcctgcacgtagtatgcaacagaggagagcatacatggtgcaggagaacctggcggcagcgcaaaagatg

SEQ ID NO: 168876 - DNA, 103 bp, Artificial Sequence
  Synthetic Polynucleotide
taatacgactcactatagggttcctgattgtccagaatcttgctcctgcaaacagaggagatgcaggatgaagattctgaacctggcggcagcgcaaaagatg

SEQ ID NO: 168877 - DNA, 103 bp, Artificial Sequence
  Synthetic Polynucleotide
taatacgactcactatagggtggcttggacttcctgattgtccagaatctaacagaggagaagattcatgacaatcaggaacctggcggcagcgcaaaagatg

SEQ ID NO: 168878 - DNA, 103 bp, Artificial Sequence
  Synthetic Polynucleotide
taatacgactcactatagggaggatcattgtggcttggacttcctgattgaacagaggagacaatcaatgagtccaagcaacctggcggcagcgcaaaagatg

SEQ ID NO: 168879 - DNA, 103 bp, Artificial Sequence
  Synthetic Polynucleotide
taatacgactcactataggggattcttggcaggatcattgtggcttggacaacagaggagagtccaaatgacaatgatcaacctggcggcagcgcaaaagatg

SEQ ID NO: 168880 - DNA, 103 bp, Artificial Sequence
  Synthetic Polynucleotide
taatacgactcactatagggattgcacggacatgtggaagaagtgcctcgaacagaggagacgaggcatgtcttccacaaacctggcggcagcgcaaaagatg

SEQ ID NO: 168881 - DNA, 103 bp, Artificial Sequence
  Synthetic Polynucleotide
taatacgactcactatagggtaacctggaggattcttggcaggatcattgaacagaggagacaatgaatgtgccaagaaaacctggcggcagcgcaaaagatg

SEQ ID NO: 168882 - DNA, 103 bp, Artificial Sequence
  Synthetic Polynucleotide
taatacgactcactatagggatcctcaaggtaacctggaggattcttggcaacagaggagagccaagatgcctccaggtaacctggcggcagcgcaaaagatg

SEQ ID NO: 168883 - DNA, 103 bp, Artificial Sequence
  Synthetic Polynucleotide
taatacgactcactatagggttacaaaactatcctcaaggtaacctggagaacagaggagactccagatgaccttgaggaacctggcggcagcgcaaaagatg

SEQ ID NO: 168884 - DNA, 103 bp, Artificial Sequence
  Synthetic Polynucleotide
taatacgactcactatagggactccagattttacaaaactatcctcaaggaacagaggagaccttgaatgtagttttgtaacctggcggcagcgcaaaagatg

SEQ ID NO: 168885 - DNA, 103 bp, Artificial Sequence
  Synthetic Polynucleotide
taatacgactcactatagggtacattgaagactccagattttacaaaactaacagaggagaagttttatgaaatctggaaacctggcggcagcgcaaaagatg

SEQ ID NO: 168886 - DNA, 103 bp, Artificial Sequence
  Synthetic Polynucleotide
taatacgactcactatagggcaagttctgatacattgaagactccagattaacagaggagaaatctgatgtcttcaatgaacctggcggcagcgcaaaagatg

SEQ ID NO: 168887 - DNA, 103 bp, Artificial Sequence
  Synthetic Polynucleotide
taatacgactcactataggggatactcttacaagttctgatacattgaagaacagaggagacttcaaatgatcagaactaacctggcggcagcgcaaaagatg

SEQ ID NO: 168888 - DNA, 103 bp, Artificial Sequence
  Synthetic Polynucleotide
taatacgactcactataggggggcgttctggatactcttacaagttctgaaacagaggagatcagaaatggtaagagtaaacctggcggcagcgcaaaagatg

SEQ ID NO: 168889 - DNA, 103 bp, Artificial Sequence
  Synthetic Polynucleotide
taatacgactcactatagggcctgggttatgggcgttctggatactcttaaacagaggagataagagatgccagaacgcaacctggcggcagcgcaaaagatg

SEQ ID NO: 168890 - DNA, 103 bp, Artificial Sequence
  Synthetic Polynucleotide
taatacgactcactatagggactccagttccctgggttatgggcgttctgaacagaggagacagaacatgcataacccaaacctggcggcagcgcaaaagatg

SEQ ID NO: 168891 - DNA, 103 bp, Artificial Sequence
  Synthetic Polynucleotide
taatacgactcactatagggagtataggcaattgcacggacatgtggaagaacagaggagacttccaatggtccgtgcaaacctggcggcagcgcaaaagatg

SEQ ID NO: 168892 - DNA, 103 bp, Artificial Sequence
  Synthetic Polynucleotide
taatacgactcactatagggtgggaagttgactccagttccctgggttataacagaggagaataaccatgggaactggaaacctggcggcagcgcaaaagatg

SEQ ID NO: 168893 - DNA, 103 bp, Artificial Sequence
  Synthetic Polynucleotide
taatacgactcactatagggtttctccaattgggaagttgactccagttcaacagaggagagaactgatgtcaacttccaacctggcggcagcgcaaaagatg

SEQ ID NO: 168894 - DNA, 103 bp, Artificial Sequence
  Synthetic Polynucleotide
taatacgactcactatagggtggcttgggatttctccaattgggaagttgaacagaggagacaacttatgaattggagaaacctggcggcagcgcaaaagatg

SEQ ID NO: 168895 - DNA, 103 bp, Artificial Sequence
  Synthetic Polynucleotide
taatacgactcactatagggatagtatggttggcttgggatttctccaataacagaggagaattggaatgatcccaagcaacctggcggcagcgcaaaagatg

SEQ ID NO: 168896 - DNA, 103 bp, Artificial Sequence
  Synthetic Polynucleotide
taatacgactcactatagggtcatgtcatgatagtatggttggcttgggaaacagaggagatcccaaatgaaccatactaacctggcggcagcgcaaaagatg

SEQ ID NO: 168897 - DNA, 103 bp, Artificial Sequence
  Synthetic Polynucleotide
taatacgactcactatagggacccccgagttcatgtcatgatagtatggtaacagaggagaaccataatgtcatgacataacctggcggcagcgcaaaagatg

SEQ ID NO: 168898 - DNA, 103 bp, Artificial Sequence
  Synthetic Polynucleotide
taatacgactcactatagggctgaagattgacccccgagttcatgtcatgaacagaggagacatgacatgaactcggggaacctggcggcagcgcaaaagatg

SEQ ID NO: 168899 - DNA, 103 bp, Artificial Sequence
  Synthetic Polynucleotide
taatacgactcactatagggacagagacctctgaagattgacccccgagtaacagaggagaactcggatgtcaatcttcaacctggcggcagcgcaaaagatg

SEQ ID NO: 168900 - DNA, 103 bp, Artificial Sequence
  Synthetic Polynucleotide
taatacgactcactatagggggtggagaagacagagacctctgaagattgaacagaggagacaatctatggaggtctctaacctggcggcagcgcaaaagatg

SEQ ID NO: 168901 - DNA, 103 bp, Artificial Sequence
  Synthetic Polynucleotide
taatacgactcactatagggtttgctgcttggtggagaagacagagacctaacagaggagaaggtctatgtcttctccaaacctggcggcagcgcaaaagatg

SEQ ID NO: 168902 - DNA, 103 bp, Artificial Sequence
  Synthetic Polynucleotide
taatacgactcactatagggggttgaaccaagtataggcaattgcacggaaacagaggagatccgtgatgttgcctataaacctggcggcagcgcaaaagatg

SEQ ID NO: 168903 - DNA, 103 bp, Artificial Sequence
  Synthetic Polynucleotide
taatacgactcactatagggttttgggtcttttgctgcttggtggagaagaacagaggagacttctcatgcaagcagcaaacctggcggcagcgcaaaagatg

SEQ ID NO: 168904 - DNA, 103 bp, Artificial Sequence
  Synthetic Polynucleotide
taatacgactcactatagggatggatatagttttgggtcttttgctgcttaacagaggagaaagcagatgaagacccaaaacctggcggcagcgcaaaagatg

SEQ ID NO: 168905 - DNA, 103 bp, Artificial Sequence
  Synthetic Polynucleotide
taatacgactcactatagggattttcatctatggatatagttttgggtctaacagaggagaagacccatgactatatccaacctggcggcagcgcaaaagatg

SEQ ID NO: 168906 - DNA, 103 bp, Artificial Sequence
  Synthetic Polynucleotide
taatacgactcactatagggttggttccatattttcatctatggatatagaacagaggagactatatatgtagatgaaaaacctggcggcagcgcaaaagatg

SEQ ID NO: 168907 - DNA, 103 bp, Artificial Sequence
  Synthetic Polynucleotide
taatacgactcactatagggcctgtaggacttggttccatattttcatctaacagaggagaagatgaatgtatggaaccaacctggcggcagcgcaaaagatg

SEQ ID NO: 168908 - DNA, 103 bp, Artificial Sequence
  Synthetic Polynucleotide
taatacgactcactataggggtaaaagtctcctgtaggacttggttccataacagaggagaatggaaatgagtcctacaaacctggcggcagcgcaaaagatg

SEQ ID NO: 168909 - DNA, 103 bp, Artificial Sequence
  Synthetic Polynucleotide
taatacgactcactatagggttggagaggggtaaaagtctcctgtaggacaacagaggagagtcctaatggagacttttaacctggcggcagcgcaaaagatg

SEQ ID NO: 168910 - DNA, 103 bp, Artificial Sequence
  Synthetic Polynucleotide
taatacgactcactataggggctggtgaacttggagaggggtaaaagtctaacagaggagaagacttatgcccctctccaacctggcggcagcgcaaaagatg

SEQ ID NO: 168911 - DNA, 103 bp, Artificial Sequence
  Synthetic Polynucleotide
taatacgactcactatagggacttccagcagctggtgaacttggagagggaacagaggagaccctctatgagttcaccaaacctggcggcagcgcaaaagatg

SEQ ID NO: 168912 - DNA, 103 bp, Artificial Sequence
  Synthetic Polynucleotide
taatacgactcactataggggccatgttcgacttccagcagctggtgaacaacagaggagagttcacatgctgctggaaaacctggcggcagcgcaaaagatg

SEQ ID NO: 168913 - DNA, 103 bp, Artificial Sequence
  Synthetic Polynucleotide
taatacgactcactatagggcgagcctgcaggttgaaccaagtataggcaaacagaggagatgcctaatgttggttcaaaacctggcggcagcgcaaaagatg

SEQ ID NO: 168914 - DNA, 103 bp, Artificial Sequence
  Synthetic Polynucleotide
taatacgactcactatagggtctctttcgtgccatgttcgacttccagcaaacagaggagatgctggatgtcgaacatgaacctggcggcagcgcaaaagatg

SEQ ID NO: 168915 - DNA, 103 bp, Artificial Sequence
  Synthetic Polynucleotide
taatacgactcactatagggcatatcttgatctctttcgtgccatgttcgaacagaggagacgaacaatgcacgaaagaaacctggcggcagcgcaaaagatg

SEQ ID NO: 168916 - DNA, 103 bp, Artificial Sequence
  Synthetic Polynucleotide
taatacgactcactatagggtcggagaagacatatcttgatctctttcgtaacagaggagaacgaaaatgatcaagataaacctggcggcagcgcaaaagatg

SEQ ID NO: 168917 - DNA, 103 bp, Artificial Sequence
  Synthetic Polynucleotide
taatacgactcactatagggttcatagtagtcggagaagacatatcttgaaacagaggagatcaagaatggtcttctccaacctggcggcagcgcaaaagatg

SEQ ID NO: 168918 - DNA, 103 bp, Artificial Sequence
  Synthetic Polynucleotide
taatacgactcactatagggttcaggcttcttcatagtagtcggagaagaaacagaggagatcttctatgactactatgaacctggcggcagcgcaaaagatg

SEQ ID NO: 168919 - DNA, 103 bp, Artificial Sequence
  Synthetic Polynucleotide
taatacgactcactatagggacaatggcttttcaggcttcttcatagtagaacagaggagactactaatgagaagcctgaacctggcggcagcgcaaaagatg

SEQ ID NO: 168920 - DNA, 103 bp, Artificial Sequence
  Synthetic Polynucleotide
taatacgactcactataggggcagagctgaacaatggcttttcaggcttcaacagaggagagaagccatgaaagccattaacctggcggcagcgcaaaagatg

SEQ ID NO: 168921 - DNA, 103 bp, Artificial Sequence
  Synthetic Polynucleotide
taatacgactcactatagggctgtggagatgcagagctgaacaatggcttaacagaggagaaagccaatgttcagctctaacctggcggcagcgcaaaagatg

SEQ ID NO: 168922 - DNA, 103 bp, Artificial Sequence
  Synthetic Polynucleotide
taatacgactcactataggggggaagaatcctgtggagatgcagagctgaaacagaggagatcagctatgcatctccacaacctggcggcagcgcaaaagatg

SEQ ID NO: 168923 - DNA, 103 bp, Artificial Sequence
  Synthetic Polynucleotide
taatacgactcactatagggctcagtcttggggaagaatcctgtggagataacagaggagaatctccatgggattcttcaacctggcggcagcgcaaaagatg

SEQ ID NO: 168924 - DNA, 103 bp, Artificial Sequence
  Synthetic Polynucleotide
taatacgactcactatagggctgggtgaggcagagcggggacgaatacataacagaggagaatgtatatgtccccgctcaacctggcggcagcgcaaaagatg

SEQ ID NO: 168925 - DNA, 103 bp, Artificial Sequence
  Synthetic Polynucleotide
taatacgactcactatagggcttgcgcttccgcgcctgcaggttgaaccaaacagaggagatggttcatgctgcaggcgaacctggcggcagcgcaaaagatg

SEQ ID NO: 168926 - DNA, 103 bp, Artificial Sequence
  Synthetic Polynucleotide
taatacgactcactataggggggggacgggctgttgaatggtgacttgtcaacagaggagagacaagatgccattcaacaacctggcggcagcgcaaaagatg

SEQ ID NO: 168927 - DNA, 103 bp, Artificial Sequence
  Synthetic Polynucleotide
taatacgactcactataggggagagtcctggggggacgggctgttgaatgaacagaggagacattcaatggcccgtcccaacctggcggcagcgcaaaagatg

SEQ ID NO: 168928 - DNA, 103 bp, Artificial Sequence
  Synthetic Polynucleotide
taatacgactcactataggggagaggcggggagagtcctggggggacgggaacagaggagacccgtcatgccaggactcaacctggcggcagcgcaaaagatg

SEQ ID NO: 168929 - DNA, 103 bp, Artificial Sequence
  Synthetic Polynucleotide
taatacgactcactatagggggtgaagctggagaggcggggagagtcctgaacagaggagacaggacatgccccgcctcaacctggcggcagcgcaaaagatg

SEQ ID NO: 168930 - DNA, 103 bp, Artificial Sequence
  Synthetic Polynucleotide
taatacgactcactatagggggtggtgctgggtgaagctggagaggcgggaacagaggagacccgccatgccagcttcaaacctggcggcagcgcaaaagatg

SEQ ID NO: 168931 - DNA, 103 bp, Artificial Sequence
  Synthetic Polynucleotide
taatacgactcactatagggatgacgggccggtggtgctgggtgaagctgaacagaggagacagcttatgccagcaccaaacctggcggcagcgcaaaagatg

SEQ ID NO: 168932 - DNA, 103 bp, Artificial Sequence
  Synthetic Polynucleotide
taatacgactcactataggggtgcacggcgatgacgggccggtggtgctgaacagaggagacagcacatgcggcccgtcaacctggcggcagcgcaaaagatg

SEQ ID NO: 168933 - DNA, 103 bp, Artificial Sequence
  Synthetic Polynucleotide
taatacgactcactatagggcgatcccgctgtgcacggcgatgacgggccaacagaggagaggcccgatgtcgccgtgcaacctggcggcagcgcaaaagatg

SEQ ID NO: 168934 - DNA, 103 bp, Artificial Sequence
  Synthetic Polynucleotide
taatacgactcactataggggggctccgggcgatcccgctgtgcacggcgaacagaggagacgccgtatgcagcgggataacctggcggcagcgcaaaagatg

SEQ ID NO: 168935 - DNA, 103 bp, Artificial Sequence
  Synthetic Polynucleotide
taatacgactcactatagggggacgggtgtgggctccgggcgatcccgctaacagaggagaagcgggatggcccggagcaacctggcggcagcgcaaaagatg

SEQ ID NO: 168936 - DNA, 103 bp, Artificial Sequence
  Synthetic Polynucleotide
taatacgactcactatagggtcttgaagtacttgcgcttccgcgcctgcaaacagaggagatgcaggatgggaagcgcaaacctggcggcagcgcaaaagatg

SEQ ID NO: 168937 - DNA, 103 bp, Artificial Sequence
  Synthetic Polynucleotide
taatacgactcactataggggcagagcggaggacgggtgtgggctccgggaacagaggagacccggaatgcacacccgtaacctggcggcagcgcaaaagatg

SEQ ID NO: 168938 - DNA, 103 bp, Artificial Sequence
  Synthetic Polynucleotide
taatacgactcactataggggtagggaaatgcagagcggaggacgggtgtaacagaggagaacacccatgctccgctctaacctggcggcagcgcaaaagatg

SEQ ID NO: 168939 - DNA, 103 bp, Artificial Sequence
  Synthetic Polynucleotide
taatacgactcactataggggatggacgtcgtagggaaatgcagagcggaaacagaggagatccgctatgcatttccctaacctggcggcagcgcaaaagatg

SEQ ID NO: 168940 - DNA, 103 bp, Artificial Sequence
  Synthetic Polynucleotide
taatacgactcactatagggtctggggtaggatggacgtcgtagggaaataacagaggagaatttccatgcgacgtccaaacctggcggcagcgcaaaagatg

SEQ ID NO: 168941 - DNA, 103 bp, Artificial Sequence
  Synthetic Polynucleotide
taatacgactcactataggggtggaggccgtctggggtaggatggacgtcaacagaggagagacgtcatgcctaccccaaacctggcggcagcgcaaaagatg

SEQ ID NO: 168942 - DNA, 103 bp, Artificial Sequence
  Synthetic Polynucleotide
taatacgactcactatagggggggaagtaggtggaggccgtctggggtagaacagaggagactacccatgacggcctccaacctggcggcagcgcaaaagatg

SEQ ID NO: 168943 - DNA, 103 bp, Artificial Sequence
  Synthetic Polynucleotide
taatacgactcactatagggtggccgtgtgggggaagtaggtggaggccgaacagaggagacggcctatgcctacttccaacctggcggcagcgcaaaagatg

SEQ ID NO: 168944 - DNA, 103 bp, Artificial Sequence
  Synthetic Polynucleotide
taatacgactcactataggggggtagcggatggccgtgtgggggaagtagaacagaggagactacttatgccacacggcaacctggcggcagcgcaaaagatg

SEQ ID NO: 168945 - DNA, 103 bp, Artificial Sequence
  Synthetic Polynucleotide
taatacgactcactataggggagatgaggtgggtagcggatggccgtgtgaacagaggagacacacgatgatccgctacaacctggcggcagcgcaaaagatg

SEQ ID NO: 168946 - DNA, 103 bp, Artificial Sequence
  Synthetic Polynucleotide
taatacgactcactatagggcctgggggttgagatgaggtgggtagcggaaacagaggagatccgctatgcacctcatcaacctggcggcagcgcaaaagatg

SEQ ID NO: 168947 - DNA, 103 bp, Artificial Sequence
  Synthetic Polynucleotide
taatacgactcactatagggttctcgtgcttcttgaagtacttgcgcttcaacagaggagagaagcgatggtacttcaaaacctggcggcagcgcaaaagatg

SEQ ID NO: 168948 - DNA, 103 bp, Artificial Sequence
  Synthetic Polynucleotide
taatacgactcactatagggttgagcgggtcctgggggttgagatgaggtaacagaggagaacctcaatgcaacccccaaacctggcggcagcgcaaaagatg

SEQ ID NO: 168949 - DNA, 103 bp, Artificial Sequence
  Synthetic Polynucleotide
taatacgactcactataggggacaagatctttgagcgggtcctgggggttaacagaggagaaaccccatggacccgctcaacctggcggcagcgcaaaagatg

SEQ ID NO: 168950 - DNA, 103 bp, Artificial Sequence
  Synthetic Polynucleotide
taatacgactcactatagggaggccagcgagacaagatctttgagcgggtaacagaggagaacccgcatgaagatcttgaacctggcggcagcgcaaaagatg

SEQ ID NO: 168951 - DNA, 103 bp, Artificial Sequence
  Synthetic Polynucleotide
taatacgactcactataggggctgggtcgcaggccagcgagacaagatctaacagaggagaagatctatgctcgctggcaacctggcggcagcgcaaaagatg

SEQ ID NO: 168952 - DNA, 103 bp, Artificial Sequence
  Synthetic Polynucleotide
taatacgactcactatagggttgctggctggctgggtcgcaggccagcgaaacagaggagatcgctgatgtgcgacccaaacctggcggcagcgcaaaagatg

SEQ ID NO: 168953 - DNA, 103 bp, Artificial Sequence
  Synthetic Polynucleotide
taatacgactcactatagggacggtccaggttgctggctggctgggtcgcaacagaggagagcgaccatgccagccagcaacctggcggcagcgcaaaagatg

SEQ ID NO: 168954 - DNA, 103 bp, Artificial Sequence
  Synthetic Polynucleotide
taatacgactcactatagggagataccaggacggtccaggttgctggctgaacagaggagacagccaatgacctggaccaacctggcggcagcgcaaaagatg

SEQ ID NO: 168955 - DNA, 103 bp, Artificial Sequence
  Synthetic Polynucleotide
taatacgactcactatagggcgacatccgcttctcgtgcttcttgaagtaaacagaggagatacttcatgaagcacgagaacctggcggcagcgcaaaagatg

SEQ ID NO: 168956 - DNA, 103 bp, Artificial Sequence
  Synthetic Polynucleotide
taatacgactcactatagggcctcgtccttcgacatccgcttctcgtgctaacagaggagaagcacgatgagcggatgtaacctggcggcagcgcaaaagatg

SEQ ID NO: 168957 - DNA, 103 bp, Artificial Sequence
  Synthetic Polynucleotide
taatacgactcactatagggaccgcacgctcctcgtccttcgacatccgcaacagaggagagcggatatggaaggacgaaacctggcggcagcgcaaaagatg

SEQ ID NO: 168958 - DNA, 103 bp, Artificial Sequence
  Synthetic Polynucleotide
taatacgactcactatagggctcgtccttgaccgcacgctcctcgtccttaacagaggagaaaggacatggagcgtgcgaacctggcggcagcgcaaaagatg

SEQ ID NO: 168959 - DNA, 103 bp, Artificial Sequence
  Synthetic Polynucleotide
taatacgactcactatagggcgcccagcagctcgtccttgaccgcacgctaacagaggagaagcgtgatgtcaaggacgaacctggcggcagcgcaaaagatg

SEQ ID NO: 168960 - DNA, 103 bp, Artificial Sequence
  Synthetic Polynucleotide
taatacgactcactatagggtcgggcttctcgcccagcagctcgtccttgaacagaggagacaaggaatggctgctgggaacctggcggcagcgcaaaagatg

SEQ ID NO: 168961 - DNA, 103 bp, Artificial Sequence
  Synthetic Polynucleotide
taatacgactcactatagggctgcttgacctcgggcttctcgcccagcagaacagaggagactgctgatggagaagcccaacctggcggcagcgcaaaagatg

SEQ ID NO: 168962 - DNA, 103 bp, Artificial Sequence
  Synthetic Polynucleotide
taatacgactcactatagggggaactcatcctgggtgaggcagagcggggaacagaggagaccccgcatggcctcacccaacctggcggcagcgcaaaagatg

SEQ ID NO: 168963 - DNA, 103 bp, Artificial Sequence
  Synthetic Polynucleotide
taatacgactcactatagggacgcccacttctgcttgacctcgggcttctaacagaggagaagaagcatgaggtcaagcaacctggcggcagcgcaaaagatg

SEQ ID NO: 168964 - DNA, 103 bp, Artificial Sequence
  Synthetic Polynucleotide
taatacgactcactatagggagcagccgcgacgcccacttctgcttgaccaacagaggagaggtcaaatggaagtgggcaacctggcggcagcgcaaaagatg

SEQ ID NO: 168965 - DNA, 103 bp, Artificial Sequence
  Synthetic Polynucleotide
taatacgactcactatagggcagcttggccagcagccgcgacgcccacttaacagaggagaaagtggatgtcgcggctgaacctggcggcagcgcaaaagatg

SEQ ID NO: 168966 - DNA, 103 bp, Artificial Sequence
  Synthetic Polynucleotide
taatacgactcactatagggtgtccttgcgcagcttggccagcagccgcgaacagaggagacgcggcatgtggccaagcaacctggcggcagcgcaaaagatg

SEQ ID NO: 168967 - DNA, 103 bp, Artificial Sequence
  Synthetic Polynucleotide
taatacgactcactatagggtcgggccggatgtccttgcgcagcttggccaacagaggagaggccaaatggcgcaaggaaacctggcggcagcgcaaaagatg

SEQ ID NO: 168968 - DNA, 103 bp, Artificial Sequence
  Synthetic Polynucleotide
taatacgactcactatagggctcgcggcactcgggccggatgtccttgcgaacagaggagacgcaagatgatccggcccaacctggcggcagcgcaaaagatg

SEQ ID NO: 168969 - DNA, 103 bp, Artificial Sequence
  Synthetic Polynucleotide
taatacgactcactataggggcacgaagtcctcgcggcactcgggccggaaacagaggagatccggcatgagtgccgcgaacctggcggcagcgcaaaagatg

SEQ ID NO: 168970 - DNA, 103 bp, Artificial Sequence
  Synthetic Polynucleotide
taatacgactcactataggggtgatgctcagcacgaagtcctcgcggcacaacagaggagagtgccgatgggacttcgtaacctggcggcagcgcaaaagatg

SEQ ID NO: 168971 - DNA, 103 bp, Artificial Sequence
  Synthetic Polynucleotide
taatacgactcactatagggcttcttgccggtgatgctcagcacgaagtcaacagaggagagacttcatgctgagcatcaacctggcggcagcgcaaaagatg

SEQ ID NO: 168972 - DNA, 103 bp, Artificial Sequence
  Synthetic Polynucleotide
taatacgactcactatagggagcccggcgccttcttgccggtgatgctcaaacagaggagatgagcaatgccggcaagaaacctggcggcagcgcaaaagatg

SEQ ID NO: 168973 - DNA, 103 bp, Artificial Sequence
  Synthetic Polynucleotide
taatacgactcactatagggatgaacgggtggaactcatcctgggtgaggaacagaggagacctcacatgggatgagttaacctggcggcagcgcaaaagatg

SEQ ID NO: 168974 - DNA, 103 bp, Artificial Sequence
  Synthetic Polynucleotide
taatacgactcactataggggagagcacgcagcccggcgccttcttgccgaacagaggagacggcaaatgggcgccgggaacctggcggcagcgcaaaagatg

SEQ ID NO: 168975 - DNA, 103 bp, Artificial Sequence
  Synthetic Polynucleotide
taatacgactcactataggggtcggggttggagagcacgcagcccggcgcaacagaggagagcgccgatgtgcgtgctcaacctggcggcagcgcaaaagatg

SEQ ID NO: 168976 - DNA, 103 bp, Artificial Sequence
  Synthetic Polynucleotide
taatacgactcactatagggtgcccttctggtcggggttggagagcacgcaacagaggagagcgtgcatgccaaccccgaacctggcggcagcgcaaaagatg

SEQ ID NO: 168977 - DNA, 103 bp, Artificial Sequence
  Synthetic Polynucleotide
taatacgactcactatagggcgccgcatcttgcccttctggtcggggttgaacagaggagacaacccatgccagaagggaacctggcggcagcgcaaaagatg

SEQ ID NO: 168978 - DNA, 103 bp, Artificial Sequence
  Synthetic Polynucleotide
taatacgactcactatagggacagtcgatgcgccgcatcttgcccttctgaacagaggagacagaagatgaagatgcggaacctggcggcagcgcaaaagatg

SEQ ID NO: 168979 - DNA, 103 bp, Artificial Sequence
  Synthetic Polynucleotide
taatacgactcactatagggcctgccggagacagtcgatgcgccgcatctaacagaggagaagatgcatggcatcgactaacctggcggcagcgcaaaagatg

SEQ ID NO: 168980 - DNA, 103 bp, Artificial Sequence
  Synthetic Polynucleotide
taatacgactcactatagggaccttgtccgcctgccggagacagtcgatgaacagaggagacatcgaatgtctccggcaaacctggcggcagcgcaaaagatg

SEQ ID NO: 168981 - DNA, 103 bp, Artificial Sequence
  Synthetic Polynucleotide
taatacgactcactatagggcagccgccacaccttgtccgcctgccggagaacagaggagactccggatggcggacaagaacctggcggcagcgcaaaagatg

SEQ ID NO: 168982 - DNA, 103 bp, Artificial Sequence
  Synthetic Polynucleotide
taatacgactcactatagggtgaccaggtccagccgccacaccttgtccgaacagaggagacggacaatgtgtggcggcaacctggcggcagcgcaaaagatg

SEQ ID NO: 168983 - DNA, 103 bp, Artificial Sequence
  Synthetic Polynucleotide
taatacgactcactatagggaggatgaccatgaccaggtccagccgccacaacagaggagagtggcgatgggacctggtaacctggcggcagcgcaaaagatg

SEQ ID NO: 168984 - DNA, 103 bp, Artificial Sequence
  Synthetic Polynucleotide
taatacgactcactatagggcagggcctcgatgaacgggtggaactcatcaacagaggagagatgagatgcacccgttcaacctggcggcagcgcaaaagatg

SEQ ID NO: 168985 - DNA, 103 bp, Artificial Sequence
  Synthetic Polynucleotide
taatacgactcactataggggcccttgaacaggatgaccatgaccaggtcaacagaggagagacctgatgatggtcatcaacctggcggcagcgcaaaagatg

SEQ ID NO: 168986 - DNA, 103 bp, Artificial Sequence
  Synthetic Polynucleotide
taatacgactcactatagggccagcgggatgcccttgaacaggatgaccaaacagaggagatggtcaatgtgttcaaggaacctggcggcagcgcaaaagatg

SEQ ID NO: 168987 - DNA, 103 bp, Artificial Sequence
  Synthetic Polynucleotide
taatacgactcactatagggtcggtgctctccagcgggatgcccttgaacaacagaggagagttcaaatgcatcccgctaacctggcggcagcgcaaaagatg

SEQ ID NO: 168988 - DNA, 103 bp, Artificial Sequence
  Synthetic Polynucleotide
taatacgactcactataggggcgctcgccgtcggtgctctccagcgggataacagaggagaatcccgatggagagcaccaacctggcggcagcgcaaaagatg

SEQ ID NO: 168989 - DNA, 103 bp, Artificial Sequence
  Synthetic Polynucleotide
taatacgactcactatagggccttgaccaggcgctcgccgtcggtgctctaacagaggagaagagcaatgacggcgagcaacctggcggcagcgcaaaagatg

SEQ ID NO: 168990 - DNA, 103 bp, Artificial Sequence
  Synthetic Polynucleotide
taatacgactcactatagggcactgcgcagccttgaccaggcgctcgccgaacagaggagacggcgaatgcctggtcaaaacctggcggcagcgcaaaagatg

SEQ ID NO: 168991 - DNA, 103 bp, Artificial Sequence
  Synthetic Polynucleotide
taatacgactcactatagggcgggtgaccgcactgcgcagccttgaccagaacagaggagactggtcatggctgcgcagaacctggcggcagcgcaaaagatg

SEQ ID NO: 168992 - DNA, 103 bp, Artificial Sequence
  Synthetic Polynucleotide
taatacgactcactatagggcgcacaggaccgggtgaccgcactgcgcagaacagaggagactgcgcatggcggtcaccaacctggcggcagcgcaaaagatg

SEQ ID NO: 168993 - DNA, 103 bp, Artificial Sequence
  Synthetic Polynucleotide
taatacgactcactatagggtgcggctgcacgcacaggaccgggtgaccgaacagaggagacggtcaatgggtcctgtgaacctggcggcagcgcaaaagatg

SEQ ID NO: 168994 - DNA, 103 bp, Artificial Sequence
  Synthetic Polynucleotide
taatacgactcactataggggccaatgtggtgcggctgcacgcacaggacaacagaggagagtcctgatggtgcagccgaacctggcggcagcgcaaaagatg

SEQ ID NO: 168995 - DNA, 103 bp, Artificial Sequence
  Synthetic Polynucleotide
taatacgactcactatagggcgtgaggcagcagggcctcgatgaacgggtaacagaggagaacccgtatgtcgaggcccaacctggcggcagcgcaaaagatg

SEQ ID NO: 168996 - DNA, 103 bp, Artificial Sequence
  Synthetic Polynucleotide
taatacgactcactatagggtgacggccacgccaatgtggtgcggctgcaaacagaggagatgcagcatgaccacattgaacctggcggcagcgcaaaagatg

SEQ ID NO: 168997 - DNA, 103 bp, Artificial Sequence
  Synthetic Polynucleotide
taatacgactcactatagggtccagctccttgacggccacgccaatgtggaacagaggagaccacatatgcgtggccgtaacctggcggcagcgcaaaagatg

SEQ ID NO: 168998 - DNA, 103 bp, Artificial Sequence
  Synthetic Polynucleotide
taatacgactcactatagggcaggtagaggtccagctccttgacggccacaacagaggagagtggccatgaaggagctgaacctggcggcagcgcaaaagatg

SEQ ID NO: 168999 - DNA, 103 bp, Artificial Sequence
  Synthetic Polynucleotide
taatacgactcactatagggcgaagtaggccaggtagaggtccagctcctaacagaggagaaggagcatgacctctaccaacctggcggcagcgcaaaagatg

SEQ ID NO: 169000 - DNA, 103 bp, Artificial Sequence
  Synthetic Polynucleotide
taatacgactcactatagggcgctcacgcacgaagtaggccaggtagaggaacagaggagacctctaatgggcctacttaacctggcggcagcgcaaaagatg

SEQ ID NO: 169001 - DNA, 103 bp, Artificial Sequence
  Synthetic Polynucleotide
taatacgactcactatagggctctgcatctcgctcacgcacgaagtaggcaacagaggagagcctacatggtgcgtgagaacctggcggcagcgcaaaagatg

SEQ ID NO: 169002 - DNA, 103 bp, Artificial Sequence
  Synthetic Polynucleotide
taatacgactcactatagggtgccgctttgctctgcatctcgctcacgcaaacagaggagatgcgtgatggagatgcagaacctggcggcagcgcaaaagatg

SEQ ID NO: 169003 - DNA, 103 bp, Artificial Sequence
  Synthetic Polynucleotide
taatacgactcactataggggtccggggactgccgctttgctctgcatctaacagaggagaagatgcatggcaaagcggaacctggcggcagcgcaaaagatg

SEQ ID NO: 169004 - DNA, 103 bp, Artificial Sequence
  Synthetic Polynucleotide
taatacgactcactataggggcccatccctgtccggggactgccgctttgaacagaggagacaaagcatgagtccccggaacctggcggcagcgcaaaagatg

SEQ ID NO: 169005 - DNA, 103 bp, Artificial Sequence
  Synthetic Polynucleotide
taatacgactcactatagggcctggtcagagcccatccctgtccggggacaacagaggagagtccccatgcagggatggaacctggcggcagcgcaaaagatg

SEQ ID NO: 169006 - DNA, 103 bp, Artificial Sequence
  Synthetic Polynucleotide
taatacgactcactatagggaaggcgcggacgtgaggcagcagggcctcgaacagaggagacgaggcatggctgcctcaaacctggcggcagcgcaaaagatg

SEQ ID NO: 169007 - DNA, 103 bp, Artificial Sequence
  Synthetic Polynucleotide
taatacgactcactatagggttgctgtcctcctggtcagagcccatccctaacagaggagaagggatatgctctgaccaaacctggcggcagcgcaaaagatg

SEQ ID NO: 169008 - DNA, 103 bp, Artificial Sequence
  Synthetic Polynucleotide
taatacgactcactatagggcgtgatgggcttgctgtcctcctggtcagaaacagaggagatctgacatggaggacagcaacctggcggcagcgcaaaagatg

SEQ ID NO: 169009 - DNA, 103 bp, Artificial Sequence
  Synthetic Polynucleotide
taatacgactcactatagggtcgtgtccagcgtgatgggcttgctgtcctaacagaggagaaggacaatgagcccatcaaacctggcggcagcgcaaaagatg

SEQ ID NO: 169010 - DNA, 103 bp, Artificial Sequence
  Synthetic Polynucleotide
taatacgactcactatagggtggaagtcggtcgtgtccagcgtgatgggcaacagaggagagcccatatggctggacacaacctggcggcagcgcaaaagatg

SEQ ID NO: 169011 - DNA, 103 bp, Artificial Sequence
  Synthetic Polynucleotide
taatacgactcactatagggaaagctctcctggaagtcggtcgtgtccagaacagaggagactggacatgaccgacttcaacctggcggcagcgcaaaagatg

SEQ ID NO: 169012 - DNA, 103 bp, Artificial Sequence
  Synthetic Polynucleotide
taatacgactcactatagggcggaggtgacaaagctctcctggaagtcggaacagaggagaccgactatgaggagagctaacctggcggcagcgcaaaagatg

SEQ ID NO: 169013 - DNA, 103 bp, Artificial Sequence
  Synthetic Polynucleotide
taatacgactcactatagggctgaacacgccggaggtgacaaagctctccaacagaggagaggagagatgtgtcacctcaacctggcggcagcgcaaaagatg

SEQ ID NO: 169014 - DNA, 103 bp, Artificial Sequence
  Synthetic Polynucleotide
taatacgactcactatagggctcagtgacgctgaacacgccggaggtgacaacagaggagagtcaccatgggcgtgttcaacctggcggcagcgcaaaagatg

SEQ ID NO: 169015 - DNA, 103 bp, Artificial Sequence
  Synthetic Polynucleotide
taatacgactcactatagggcttggatgagctcagtgacgctgaacacgcaacagaggagagcgtgtatggcgtcactgaacctggcggcagcgcaaaagatg

SEQ ID NO: 169016 - DNA, 103 bp, Artificial Sequence
  Synthetic Polynucleotide
taatacgactcactataggggtccgggacacttggatgagctcagtgacgaacagaggagacgtcacatggctcatccaaacctggcggcagcgcaaaagatg

SEQ ID NO: 169017 - DNA, 103 bp, Artificial Sequence
  Synthetic Polynucleotide
taatacgactcactatagggggtgtaggcgaaggcgcggacgtgaggcagaacagaggagactgcctatggtccgcgccaacctggcggcagcgcaaaagatg

SEQ ID NO: 169018 - DNA, 103 bp, Artificial Sequence
  Synthetic Polynucleotide
taatacgactcactatagggcaccacgggtgtccgggacacttggatgagaacagaggagactcatcatggtgtcccggaacctggcggcagcgcaaaagatg

SEQ ID NO: 169019 - DNA, 103 bp, Artificial Sequence
  Synthetic Polynucleotide
taatacgactcactatagggctgttccagtcaccacgggtgtccgggacaaacagaggagatgtcccatgcacccgtggaacctggcggcagcgcaaaagatg

SEQ ID NO: 169020 - DNA, 103 bp, Artificial Sequence
  Synthetic Polynucleotide
taatacgactcactatagggaagttgggtcctgttccagtcaccacgggtaacagaggagaacccgtatggactggaacaacctggcggcagcgcaaaagatg

SEQ ID NO: 169021 - DNA, 103 bp, Artificial Sequence
  Synthetic Polynucleotide
taatacgactcactatagggccccagggagaagttgggtcctgttccagtaacagaggagaactggaatgggacccaacaacctggcggcagcgcaaaagatg

SEQ ID NO: 169022 - DNA, 103 bp, Artificial Sequence
  Synthetic Polynucleotide
taatacgactcactatagggcctgcagctcccccagggagaagttgggtcaacagaggagagacccaatgtctccctggaacctggcggcagcgcaaaagatg

SEQ ID NO: 169023 - DNA, 103 bp, Artificial Sequence
  Synthetic Polynucleotide
taatacgactcactataggggccaggtgcccctgcagctcccccagggagaacagaggagactccctatgggagctgcaaacctggcggcagcgcaaaagatg

SEQ ID NO: 169024 - DNA, 103 bp, Artificial Sequence
  Synthetic Polynucleotide
taatacgactcactatagggcaggtcgtatgccaggtgcccctgcagctcaacagaggagagagctgatggggcacctgaacctggcggcagcgcaaaagatg

SEQ ID NO: 169025 - DNA, 103 bp, Artificial Sequence
  Synthetic Polynucleotide
taatacgactcactatagggtggctgggttcaggtcgtatgccaggtgccaacagaggagaggcaccatgcatacgaccaacctggcggcagcgcaaaagatg

SEQ ID NO: 169026 - DNA, 103 bp, Artificial Sequence
  Synthetic Polynucleotide
taatacgactcactatagggaggccagtgctggctgggttcaggtcgtataacagaggagaatacgaatggaacccagcaacctggcggcagcgcaaaagatg

SEQ ID NO: 169027 - DNA, 103 bp, Artificial Sequence
  Synthetic Polynucleotide
taatacgactcactatagggcgttcttctgaggccagtgctggctgggttaacagaggagaaacccaatgagcactggcaacctggcggcagcgcaaaagatg

SEQ ID NO: 169028 - DNA, 103 bp, Artificial Sequence
  Synthetic Polynucleotide
taatacgactcactatagggggttgaaccaggtgtaggcgaaggcgcggaaacagaggagatccgcgatgtcgcctacaaacctggcggcagcgcaaaagatg

SEQ ID NO: 169029 - DNA, 103 bp, Artificial Sequence
  Synthetic Polynucleotide
taatacgactcactatagggtgctgggcagcgttcttctgaggccagtgcaacagaggagagcactgatgtcagaagaaaacctggcggcagcgcaaaagatg

SEQ ID NO: 169030 - DNA, 103 bp, Artificial Sequence
  Synthetic Polynucleotide
taatacgactcactatagggctggaggaggtgctgggcagcgttcttctgaacagaggagacagaagatggctgcccagaacctggcggcagcgcaaaagatg

SEQ ID NO: 169031 - DNA, 103 bp, Artificial Sequence
  Synthetic Polynucleotide
taatacgactcactatagggcttgctcccactggaggaggtgctgggcagaacagaggagactgcccatgacctcctccaacctggcggcagcgcaaaagatg

SEQ ID NO: 169032 - DNA, 103 bp, Artificial Sequence
  Synthetic Polynucleotide
taatacgactcactatagggatttgtgccgcttgctcccactggaggaggaacagaggagacctcctatggtgggagcaaacctggcggcagcgcaaaagatg

SEQ ID NO: 169033 - DNA, 103 bp, Artificial Sequence
  Synthetic Polynucleotide
taatacgactcactatagggatcgagcccgatttgtgccgcttgctcccaaacagaggagatgggagatggcggcacaaaacctggcggcagcgcaaaagatg

SEQ ID NO: 169034 - DNA, 103 bp, Artificial Sequence
  Synthetic Polynucleotide
taatacgactcactataggggtcttcctccatcgagcccgatttgtgccgaacagaggagacggcacatgtcgggctcgaacctggcggcagcgcaaaagatg

SEQ ID NO: 169035 - DNA, 103 bp, Artificial Sequence
  Synthetic Polynucleotide
taatacgactcactatagggtcgtgtccacgtcttcctccatcgagcccgaacagaggagacgggctatgtggaggaagaacctggcggcagcgcaaaagatg

SEQ ID NO: 169036 - DNA, 103 bp, Artificial Sequence
  Synthetic Polynucleotide
taatacgactcactatagggccgccagggctcgtgtccacgtcttcctccaacagaggagaggaggaatgcgtggacacaacctggcggcagcgcaaaagatg

SEQ ID NO: 169037 - DNA, 103 bp, Artificial Sequence
  Synthetic Polynucleotide
taatacgactcactataggggtagtaatcgccgccagggctcgtgtccacaacagaggagagtggacatgagccctggcaacctggcggcagcgcaaaagatg

SEQ ID NO: 169038 - DNA, 103 bp, Artificial Sequence
  Synthetic Polynucleotide
taatacgactcactatagggtgggcgaagtgtagtaatcgccgccagggcaacagaggagagccctgatggcgattactaacctggcggcagcgcaaaagatg

SEQ ID NO: 169039 - DNA, 103 bp, Artificial Sequence
  Synthetic Polynucleotide
taatacgactcactatagggcgcgcctgcaggttgaaccaggtgtaggcgaacagaggagacgcctaatgctggttcaaaacctggcggcagcgcaaaagatg

SEQ ID NO: 169040 - DNA, 103 bp, Artificial Sequence
  Synthetic Polynucleotide
taatacgactcactataggggtgggcgagctgggcgaagtgtagtaatcgaacagaggagacgattaatgcacttcgccaacctggcggcagcgcaaaagatg

SEQ ID NO: 169041 - DNA, 103 bp, Artificial Sequence
  Synthetic Polynucleotide
taatacgactcactataggggctgctactcgtgggcgagctgggcgaagtaacagaggagaacttcgatgagctcgcccaacctggcggcagcgcaaaagatg

SEQ ID NO: 169042 - DNA, 103 bp, Artificial Sequence
  Synthetic Polynucleotide
taatacgactcactatagggtccagttgcggctgctactcgtgggcgagcaacagaggagagctcgcatgcgagtagcaaacctggcggcagcgcaaaagatg

SEQ ID NO: 169043 - DNA, 103 bp, Artificial Sequence
  Synthetic Polynucleotide
taatacgactcactatagggatgtcctccgtccagttgcggctgctactcaacagaggagagagtagatgccgcaactgaacctggcggcagcgcaaaagatg

SEQ ID NO: 169044 - DNA, 103 bp, Artificial Sequence
  Synthetic Polynucleotide
taatacgactcactataggggcctccttccatgtcctccgtccagttgcgaacagaggagacgcaacatgacggaggacaacctggcggcagcgcaaaagatg

SEQ ID NO: 169045 - DNA, 103 bp, Artificial Sequence
  Synthetic Polynucleotide
taatacgactcactataggggggacgagatgcctccttccatgtcctccgaacagaggagacggaggatgtggaaggagaacctggcggcagcgcaaaagatg

SEQ ID NO: 169046 - DNA, 103 bp, Artificial Sequence
  Synthetic Polynucleotide
taatacgactcactatagggttcttcaccggggacgagatgcctccttccaacagaggagaggaaggatgcatctcgtcaacctggcggcagcgcaaaagatg

SEQ ID NO: 169047 - DNA, 103 bp, Artificial Sequence
  Synthetic Polynucleotide
taatacgactcactatagggcatctctgtcttcttcaccggggacgagataacagaggagaatctcgatgccggtgaagaacctggcggcagcgcaaaagatg

SEQ ID NO: 169048 - DNA, 103 bp, Artificial Sequence
  Synthetic Polynucleotide
taatacgactcactataggggtgacttgtccatctctgtcttcttcaccgaacagaggagacggtgaatgagacagagaaacctggcggcagcgcaaaagatg

SEQ ID NO: 169049 - DNA, 103 bp, Artificial Sequence
  Synthetic Polynucleotide
taatacgactcactatagggctgttgaatggtgacttgtccatctctgtcaacagaggagagacagaatgggacaagtcaacctggcggcagcgcaaaagatg

SEQ ID NO: 169050 - DNA, 103 bp, Artificial Sequence
  Synthetic Polynucleotide
taatacgactcactatagggtttgacggtctgcatttttctcagctgcataacagaggagaatgcagatgagaaaaatgaacctggcggcagcgcaaaagatg

SEQ ID NO: 169051 - DNA, 103 bp, Artificial Sequence
  Synthetic Polynucleotide
taatacgactcactatagggtgtggagtcttctgacacttccgttaaagcaacagaggagagctttaatggaagtgtcaaacctggcggcagcgcaaaagatg

SEQ ID NO: 169052 - DNA, 103 bp, Artificial Sequence
  Synthetic Polynucleotide
taatacgactcactatagggggcttctactttgatctgcatggctttggcaacagaggagagccaaaatgatgcagatcaacctggcggcagcgcaaaagatg

SEQ ID NO: 169053 - DNA, 103 bp, Artificial Sequence
  Synthetic Polynucleotide
taatacgactcactatagggcattatcaaaggcttctactttgatctgcaaacagaggagatgcagaatgaagtagaagaacctggcggcagcgcaaaagatg

SEQ ID NO: 169054 - DNA, 103 bp, Artificial Sequence
  Synthetic Polynucleotide
taatacgactcactataggggcctcaaattcattatcaaaggcttctactaacagaggagaagtagaatgctttgataaaacctggcggcagcgcaaaagatg

SEQ ID NO: 169055 - DNA, 103 bp, Artificial Sequence
  Synthetic Polynucleotide
taatacgactcactatagggtttttgcgtggcctcaaattcattatcaaaaacagaggagatttgatatggaatttgagaacctggcggcagcgcaaaagatg

SEQ ID NO: 169056 - DNA, 103 bp, Artificial Sequence
  Synthetic Polynucleotide
taatacgactcactataggggtgaggaaagtttttgcgtggcctcaaattaacagaggagaaatttgatgccacgcaaaaacctggcggcagcgcaaaagatg

SEQ ID NO: 169057 - DNA, 103 bp, Artificial Sequence
  Synthetic Polynucleotide
taatacgactcactatagggatgtcaataggtgaggaaagtttttgcgtgaacagaggagacacgcaatgactttcctcaacctggcggcagcgcaaaagatg

SEQ ID NO: 169058 - DNA, 103 bp, Artificial Sequence
  Synthetic Polynucleotide
taatacgactcactatagggtttagatgtcatgtcaataggtgaggaaagaacagaggagactttccatgcctattgacaacctggcggcagcgcaaaagatg

SEQ ID NO: 169059 - DNA, 103 bp, Artificial Sequence
  Synthetic Polynucleotide
taatacgactcactatagggcgaaatgtcttttagatgtcatgtcaatagaacagaggagactattgatgtgacatctaaacctggcggcagcgcaaaagatg

SEQ ID NO: 169060 - DNA, 103 bp, Artificial Sequence
  Synthetic Polynucleotide
taatacgactcactatagggttttcgagttcgaaatgtcttttagatgtcaacagaggagagacatcatgaagacatttaacctggcggcagcgcaaaagatg

SEQ ID NO: 169061 - DNA, 103 bp, Artificial Sequence
  Synthetic Polynucleotide
taatacgactcactatagggggcactatgcttttcgagttcgaaatgtctaacagaggagaagacatatggaactcgaaaacctggcggcagcgcaaaagatg

SEQ ID NO: 169062 - DNA, 103 bp, Artificial Sequence
  Synthetic Polynucleotide
taatacgactcactatagggcctcacctgttgtggagtcttctgacacttaacagaggagaaagtgtatgaagactccaaacctggcggcagcgcaaaagatg

SEQ ID NO: 169063 - DNA, 103 bp, Artificial Sequence
  Synthetic Polynucleotide
taatacgactcactatagggccatacttggggcactatgcttttcgagttaacagaggagaaactcgatgagcatagtgaacctggcggcagcgcaaaagatg

SEQ ID NO: 169064 - DNA, 103 bp, Artificial Sequence
  Synthetic Polynucleotide
taatacgactcactataggggaagaatgtaccatacttggggcactatgcaacagaggagagcatagatgcccaagtataacctggcggcagcgcaaaagatg

SEQ ID NO: 169065 - DNA, 103 bp, Artificial Sequence
  Synthetic Polynucleotide
taatacgactcactatagggaggagtaagagaagaatgtaccatacttggaacagaggagaccaagtatggtacattctaacctggcggcagcgcaaaagatg

SEQ ID NO: 169066 - DNA, 103 bp, Artificial Sequence
  Synthetic Polynucleotide
taatacgactcactataggggcactgagaaaggagtaagagaagaatgtaaacagaggagatacattatgctcttactcaacctggcggcagcgcaaaagatg

SEQ ID NO: 169067 - DNA, 103 bp, Artificial Sequence
  Synthetic Polynucleotide
taatacgactcactatagggttagtcacttgcactgagaaaggagtaagaaacagaggagatcttacatgtttctcagtaacctggcggcagcgcaaaagatg

SEQ ID NO: 169068 - DNA, 103 bp, Artificial Sequence
  Synthetic Polynucleotide
taatacgactcactatagggatcttgaatgttagtcacttgcactgagaaaacagaggagattctcaatgcaagtgactaacctggcggcagcgcaaaagatg

SEQ ID NO: 169069 - DNA, 103 bp, Artificial Sequence
  Synthetic Polynucleotide
taatacgactcactatagggtgagagaccaatcttgaatgttagtcacttaacagaggagaaagtgaatgacattcaagaacctggcggcagcgcaaaagatg

SEQ ID NO: 169070 - DNA, 103 bp, Artificial Sequence
  Synthetic Polynucleotide
taatacgactcactatagggtgctccgatttgagagaccaatcttgaatgaacagaggagacattcaatgttggtctctaacctggcggcagcgcaaaagatg

SEQ ID NO: 169071 - DNA, 103 bp, Artificial Sequence
  Synthetic Polynucleotide
taatacgactcactatagggttgatgccagtgctccgatttgagagaccaaacagaggagatggtctatgaaatcggagaacctggcggcagcgcaaaagatg

SEQ ID NO: 169072 - DNA, 103 bp, Artificial Sequence
  Synthetic Polynucleotide
taatacgactcactatagggtcagttctttttgatgccagtgctccgattaacagaggagaaatcggatgactggcatcaacctggcggcagcgcaaaagatg

SEQ ID NO: 169073 - DNA, 103 bp, Artificial Sequence
  Synthetic Polynucleotide
taatacgactcactatagggagaagcagctcctcacctgttgtggagtctaacagaggagaagactcatgaacaggtgaaacctggcggcagcgcaaaagatg

SEQ ID NO: 169074 - DNA, 103 bp, Artificial Sequence
  Synthetic Polynucleotide
taatacgactcactataggggttttgccactcagttctttttgatgccagaacagaggagactggcaatgaaaagaactaacctggcggcagcgcaaaagatg

SEQ ID NO: 169075 - DNA, 103 bp, Artificial Sequence
  Synthetic Polynucleotide
taatacgactcactatagggactattctgagttttgccactcagttctttaacagaggagaaaagaaatgagtggcaaaaacctggcggcagcgcaaaagatg

SEQ ID NO: 169076 - DNA, 103 bp, Artificial Sequence
  Synthetic Polynucleotide
taatacgactcactatagggcagttttgaaactattctgagttttgccacaacagaggagagtggcaatgctcagaataaacctggcggcagcgcaaaagatg

SEQ ID NO: 169077 - DNA, 103 bp, Artificial Sequence
  Synthetic Polynucleotide
taatacgactcactatagggtcaacaactccagttttgaaactattctgaaacagaggagatcagaaatgtttcaaaacaacctggcggcagcgcaaaagatg

SEQ ID NO: 169078 - DNA, 103 bp, Artificial Sequence
  Synthetic Polynucleotide
taatacgactcactataggggtctttcatttcaacaactccagttttgaaaacagaggagattcaaaatgggagttgttaacctggcggcagcgcaaaagatg

SEQ ID NO: 169079 - DNA, 103 bp, Artificial Sequence
  Synthetic Polynucleotide
taatacgactcactatagggtgtagccactgtctttcatttcaacaactcaacagaggagagagttgatgaaatgaaagaacctggcggcagcgcaaaagatg

SEQ ID NO: 169080 - DNA, 103 bp, Artificial Sequence
  Synthetic Polynucleotide
taatacgactcactatagggtcagaaactttgtagccactgtctttcattaacagaggagaaatgaaatgcagtggctaaacctggcggcagcgcaaaagatg

SEQ ID NO: 169081 - DNA, 103 bp, Artificial Sequence
  Synthetic Polynucleotide
taatacgactcactataggggttctctgggtcagaaactttgtagccactaacagaggagaagtggcatgaaagtttctaacctggcggcagcgcaaaagatg

SEQ ID NO: 169082 - DNA, 103 bp, Artificial Sequence
  Synthetic Polynucleotide
taatacgactcactatagggtcaaatacaagttctctgggtcagaaacttaacagaggagaaagtttatgacccagagaaacctggcggcagcgcaaaagatg

SEQ ID NO: 169083 - DNA, 103 bp, Artificial Sequence
  Synthetic Polynucleotide
taatacgactcactatagggatcccctgcttcaaatacaagttctctgggaacagaggagacccagaatgcttgtatttaacctggcggcagcgcaaaagatg

SEQ ID NO: 169084 - DNA, 103 bp, Artificial Sequence
  Synthetic Polynucleotide
taatacgactcactatagggtccttcactgagaagcagctcctcacctgtaacagaggagaacaggtatggagctgcttaacctggcggcagcgcaaaagatg

SEQ ID NO: 169085 - DNA, 103 bp, Artificial Sequence
  Synthetic Polynucleotide
taatacgactcactatagggtaagtttgctatcccctgcttcaaatacaaaacagaggagattgtatatgaagcaggggaacctggcggcagcgcaaaagatg

SEQ ID NO: 169086 - DNA, 103 bp, Artificial Sequence
  Synthetic Polynucleotide
taatacgactcactatagggcctctgcagataagtttgctatcccctgctaacagaggagaagcaggatgtagcaaactaacctggcggcagcgcaaaagatg

SEQ ID NO: 169087 - DNA, 103 bp, Artificial Sequence
  Synthetic Polynucleotide
taatacgactcactatagggagtgagacaacctctgcagataagtttgctaacagaggagaagcaaaatgatctgcagaaacctggcggcagcgcaaaagatg

SEQ ID NO: 169088 - DNA, 103 bp, Artificial Sequence
  Synthetic Polynucleotide
taatacgactcactatagggaagtctcttgagtgagacaacctctgcagaaacagaggagatctgcaatggttgtctcaaacctggcggcagcgcaaaagatg

SEQ ID NO: 169089 - DNA, 103 bp, Artificial Sequence
  Synthetic Polynucleotide
taatacgactcactataggggtgtggctataagtctcttgagtgagacaaaacagaggagattgtctatgtcaagagacaacctggcggcagcgcaaaagatg

SEQ ID NO: 169090 - DNA, 103 bp, Artificial Sequence
  Synthetic Polynucleotide
taatacgactcactataggggagattggttgtgtggctataagtctcttgaacagaggagacaagagatgtatagccacaacctggcggcagcgcaaaagatg

SEQ ID NO: 169091 - DNA, 103 bp, Artificial Sequence
  Synthetic Polynucleotide
taatacgactcactataggggtctgaagcagagattggttgtgtggctataacagaggagaatagccatgcaaccaatcaacctggcggcagcgcaaaagatg

SEQ ID NO: 169092 - DNA, 103 bp, Artificial Sequence
  Synthetic Polynucleotide
taatacgactcactatagggtccccacacttccttcactgagaagcagctaacagaggagaagctgcatgtcagtgaagaacctggcggcagcgcaaaagatg

SEQ ID NO: 169093 - DNA, 103 bp, Artificial Sequence
  Synthetic Polynucleotide
taatacgactcactataggggatttgttcttccccacacttccttcactgaacagaggagacagtgaatgaagtgtgggaacctggcggcagcgcaaaagatg

SEQ ID NO: 169094 - DNA, 103 bp, Artificial Sequence
  Synthetic Polynucleotide
taatacgactcactatagggacatgcagaagatttgttcttccccacactaacagaggagaagtgtgatgaagaacaaaaacctggcggcagcgcaaaagatg

SEQ ID NO: 169095 - DNA, 103 bp, Artificial Sequence
  Synthetic Polynucleotide
taatacgactcactataggggtttcctccgacatgcagaagatttgttctaacagaggagaagaacaatgcttctgcataacctggcggcagcgcaaaagatg

SEQ ID NO: 169096 - DNA, 103 bp, Artificial Sequence
  Synthetic Polynucleotide
taatacgactcactatagggatgaattcccgtttcctccgacatgcagaaaacagaggagattctgcatgtcggaggaaaacctggcggcagcgcaaaagatg

SEQ ID NO: 169097 - DNA, 103 bp, Artificial Sequence
  Synthetic Polynucleotide
taatacgactcactatagggttcatcaggaatgaattcccgtttcctccgaacagaggagacggaggatgcgggaattcaacctggcggcagcgcaaaagatg

SEQ ID NO: 169098 - DNA, 103 bp, Artificial Sequence
  Synthetic Polynucleotide
taatacgactcactatagggcctgctcctttttgacggtctgcatttttcaacagaggagagaaaaaatgagaccgtcaaacctggcggcagcgcaaaagatg

SEQ ID NO: 169099 - DNA, 103 bp, Artificial Sequence
  Synthetic Polynucleotide
taatacgactcactatagggcatctttcttttcatcaggaatgaattcccaacagaggagagggaatatgttcctgatgaacctggcggcagcgcaaaagatg

SEQ ID NO: 169100 - DNA, 103 bp, Artificial Sequence
  Synthetic Polynucleotide
taatacgactcactatagggcaatacatagcatctttcttttcatcaggaaacagaggagatcctgaatgaaagaaagaaacctggcggcagcgcaaaagatg

SEQ ID NO: 169101 - DNA, 103 bp, Artificial Sequence
  Synthetic Polynucleotide
taatacgactcactatagggccttttttcccaatacatagcatctttcttaacagaggagaaagaaaatggctatgtataacctggcggcagcgcaaaagatg

SEQ ID NO: 169102 - DNA, 103 bp, Artificial Sequence
  Synthetic Polynucleotide
taatacgactcactatagggtatttttccgccttttttcccaatacatagaacagaggagactatgtatggggaaaaaaaacctggcggcagcgcaaaagatg

SEQ ID NO: 169103 - DNA, 103 bp, Artificial Sequence
  Synthetic Polynucleotide
taatacgactcactataggggcagcttcattatttttccgccttttttccaacagaggagaggaaaaatggcggaaaaaaacctggcggcagcgcaaaagatg

SEQ ID NO: 169104 - DNA, 103 bp, Artificial Sequence
  Synthetic Polynucleotide
taatacgactcactatagggagatcttttggcagcttcattatttttccgaacagaggagacggaaaatgaatgaagctaacctggcggcagcgcaaaagatg

SEQ ID NO: 169105 - DNA, 103 bp, Artificial Sequence
  Synthetic Polynucleotide
taatacgactcactataggggcttctcacgagatcttttggcagcttcataacagaggagaatgaagatgccaaaagataacctggcggcagcgcaaaagatg

SEQ ID NO: 169106 - DNA, 103 bp, Artificial Sequence
  Synthetic Polynucleotide
taatacgactcactatagggttcagtcgacgcttctcacgagatcttttgaacagaggagacaaaagatgtcgtgagaaaacctggcggcagcgcaaaagatg

SEQ ID NO: 169107 - DNA, 103 bp, Artificial Sequence
  Synthetic Polynucleotide
taatacgactcactatagggaaccaggtcattcagtcgacgcttctcacgaacagaggagacgtgagatgcgtcgactgaacctggcggcagcgcaaaagatg

SEQ ID NO: 169108 - DNA, 103 bp, Artificial Sequence
  Synthetic Polynucleotide
taatacgactcactatagggtgttctctaaaaccaggtcattcagtcgacaacagaggagagtcgacatgatgacctggaacctggcggcagcgcaaaagatg

SEQ ID NO: 169109 - DNA, 103 bp, Artificial Sequence
  Synthetic Polynucleotide
taatacgactcactatagggtcaagagacgcctgctcctttttgacggtcaacagaggagagaccgtatgaaaggagcaaacctggcggcagcgcaaaagatg

SEQ ID NO: 169110 - DNA, 103 bp, Artificial Sequence
  Synthetic Polynucleotide
taatacgactcactataggggcaattagtttgttctctaaaaccaggtcaaacagaggagatgacctatgtttagagaaaacctggcggcagcgcaaaagatg

SEQ ID NO: 169111 - DNA, 103 bp, Artificial Sequence
  Synthetic Polynucleotide
taatacgactcactatagggttctcccagtgcaattagtttgttctctaaaacagaggagattagagatgaaactaattaacctggcggcagcgcaaaagatg

SEQ ID NO: 169112 - DNA, 103 bp, Artificial Sequence
  Synthetic Polynucleotide
taatacgactcactatagggtggcgttttcttctcccagtgcaattagttaacagaggagaaactaaatgcactgggagaacctggcggcagcgcaaaagatg

SEQ ID NO: 169113 - DNA, 103 bp, Artificial Sequence
  Synthetic Polynucleotide
taatacgactcactataggggcttttaaagtggcgttttcttctcccagtaacagaggagaactgggatgagaaaacgcaacctggcggcagcgcaaaagatg

SEQ ID NO: 169114 - DNA, 103 bp, Artificial Sequence
  Synthetic Polynucleotide
taatacgactcactatagggaagcagctcagcttttaaagtggcgttttcaacagaggagagaaaacatgactttaaaaaacctggcggcagcgcaaaagatg

SEQ ID NO: 169115 - DNA, 103 bp, Artificial Sequence
  Synthetic Polynucleotide
taatacgactcactatagggattttagtgaaagcagctcagcttttaaagaacagaggagactttaaatgctgagctgcaacctggcggcagcgcaaaagatg

SEQ ID NO: 169116 - DNA, 103 bp, Artificial Sequence
  Synthetic Polynucleotide
taatacgactcactatagggccaaactttaattttagtgaaagcagctcaaacagaggagatgagctatgttcactaaaaacctggcggcagcgcaaaagatg

SEQ ID NO: 169117 - DNA, 103 bp, Artificial Sequence
  Synthetic Polynucleotide
taatacgactcactataggggctaattaaaccaaactttaattttagtgaaacagaggagatcactaatgttaaagtttaacctggcggcagcgcaaaagatg

SEQ ID NO: 169118 - DNA, 103 bp, Artificial Sequence
  Synthetic Polynucleotide
taatacgactcactatagggatgctgtggagctaattaaaccaaactttaaacagaggagataaagtatggtttaattaaacctggcggcagcgcaaaagatg

SEQ ID NO: 169119 - DNA, 103 bp, Artificial Sequence
  Synthetic Polynucleotide
taatacgactcactatagggtcttgagcatatgctgtggagctaattaaaaacagaggagatttaatatgctccacagcaacctggcggcagcgcaaaagatg

SEQ ID NO: 169120 - DNA, 103 bp, Artificial Sequence
  Synthetic Polynucleotide
taatacgactcactataggggctactggcatcaagagacgcctgctccttaacagaggagaaaggagatggcgtctcttaacctggcggcagcgcaaaagatg

SEQ ID NO: 169121 - DNA, 103 bp, Artificial Sequence
  Synthetic Polynucleotide
taatacgactcactatagggtttctgaatctcttgagcatatgctgtggaaacagaggagatccacaatgtatgctcaaaacctggcggcagcgcaaaagatg

SEQ ID NO: 169122 - DNA, 103 bp, Artificial Sequence
  Synthetic Polynucleotide
taatacgactcactatagggaattactgagtttctgaatctcttgagcataacagaggagaatgctcatgagattcagaaacctggcggcagcgcaaaagatg

SEQ ID NO: 169123 - DNA, 103 bp, Artificial Sequence
  Synthetic Polynucleotide
taatacgactcactatagggacagctgtagaattactgagtttctgaatcaacagaggagagattcaatgactcagtaaaacctggcggcagcgcaaaagatg

SEQ ID NO: 169124 - DNA, 103 bp, Artificial Sequence
  Synthetic Polynucleotide
taatacgactcactatagggttgaaagtacacagctgtagaattactgagaacagaggagactcagtatgtctacagctaacctggcggcagcgcaaaagatg

SEQ ID NO: 169125 - DNA, 103 bp, Artificial Sequence
  Synthetic Polynucleotide
taatacgactcactatagggtctggtaatcttgaaagtacacagctgtagaacagaggagactacagatgtgtactttcaacctggcggcagcgcaaaagatg

SEQ ID NO: 169126 - DNA, 103 bp, Artificial Sequence
  Synthetic Polynucleotide
taatacgactcactataggggatttggaagtctggtaatcttgaaagtacaacagaggagagtacttatgagattaccaaacctggcggcagcgcaaaagatg

SEQ ID NO: 169127 - DNA, 103 bp, Artificial Sequence
  Synthetic Polynucleotide
taatacgactcactatagggactcacattggatttggaagtctggtaatcaacagaggagagattacatgacttccaaaaacctggcggcagcgcaaaagatg

SEQ ID NO: 169128 - DNA, 103 bp, Artificial Sequence
  Synthetic Polynucleotide
taatacgactcactatagggccacaaatgaactcacattggatttggaagaacagaggagacttccaatgccaatgtgaaacctggcggcagcgcaaaagatg

SEQ ID NO: 169129 - DNA, 103 bp, Artificial Sequence
  Synthetic Polynucleotide
taatacgactcactatagggtcgtgctcgtccacaaatgaactcacattgaacagaggagacaatgtatgttcatttgtaacctggcggcagcgcaaaagatg

SEQ ID NO: 169130 - DNA, 103 bp, Artificial Sequence
  Synthetic Polynucleotide
taatacgactcactatagggcatcgagggttcgtgctcgtccacaaatgaaacagaggagatcatttatggacgagcacaacctggcggcagcgcaaaagatg

SEQ ID NO: 169131 - DNA, 103 bp, Artificial Sequence
  Synthetic Polynucleotide
taatacgactcactatagggtgtccacattgctactggcatcaagagacgaacagaggagacgtctcatgatgccagtaaacctggcggcagcgcaaaagatg

SEQ ID NO: 169132 - DNA, 103 bp, Artificial Sequence
  Synthetic Polynucleotide
taatacgactcactatagggtacttgacaccatcgagggttcgtgctcgtaacagaggagaacgagcatgaaccctcgaaacctggcggcagcgcaaaagatg

SEQ ID NO: 169133 - DNA, 103 bp, Artificial Sequence
  Synthetic Polynucleotide
taatacgactcactataggggaaatacaactacttgacaccatcgagggtaacagaggagaaccctcatgggtgtcaagaacctggcggcagcgcaaaagatg

SEQ ID NO: 169134 - DNA, 103 bp, Artificial Sequence
  Synthetic Polynucleotide
taatacgactcactatagggtttaatgacagaaatacaactacttgacacaacagaggagagtgtcaatgagttgtattaacctggcggcagcgcaaaagatg

SEQ ID NO: 169135 - DNA, 103 bp, Artificial Sequence
  Synthetic Polynucleotide
taatacgactcactataggggtggagagtgtttaatgacagaaatacaacaacagaggagagttgtaatgctgtcattaaacctggcggcagcgcaaaagatg

SEQ ID NO: 169136 - DNA, 103 bp, Artificial Sequence
  Synthetic Polynucleotide
taatacgactcactatagggagcgagctttgtggagagtgtttaatgacaaacagaggagatgtcatatgacactctccaacctggcggcagcgcaaaagatg

SEQ ID NO: 169137 - DNA, 103 bp, Artificial Sequence
  Synthetic Polynucleotide
taatacgactcactatagggaacatcggacagcgagctttgtggagagtgaacagaggagacactctatgcaaagctcgaacctggcggcagcgcaaaagatg

SEQ ID NO: 169138 - DNA, 103 bp, Artificial Sequence
  Synthetic Polynucleotide
taatacgactcactatagggacacttctgaaacatcggacagcgagctttaacagaggagaaaagctatgtgtccgatgaacctggcggcagcgcaaaagatg

SEQ ID NO: 169139 - DNA, 103 bp, Artificial Sequence
  Synthetic Polynucleotide
taatacgactcactatagggtctactgaggacacttctgaaacatcggacaacagaggagagtccgaatgttcagaagtaacctggcggcagcgcaaaagatg

SEQ ID NO: 169140 - DNA, 103 bp, Artificial Sequence
  Synthetic Polynucleotide
taatacgactcactatagggctgcgtgtgttctactgaggacacttctgaaacagaggagatcagaaatgtcctcagtaaacctggcggcagcgcaaaagatg

SEQ ID NO: 169141 - DNA, 103 bp, Artificial Sequence
  Synthetic Polynucleotide
taatacgactcactatagggcagagctctcctgcgtgtgttctactgaggaacagaggagacctcagatgaacacacgcaacctggcggcagcgcaaaagatg

SEQ ID NO: 169142 - DNA, 103 bp, Artificial Sequence
  Synthetic Polynucleotide
taatacgactcactatagggaccatcatcttgtccacattgctactggcaaacagaggagatgccagatgcaatgtggaaacctggcggcagcgcaaaagatg

SEQ ID NO: 169143 - DNA, 103 bp, Artificial Sequence
  Synthetic Polynucleotide
taatacgactcactatagggcttccctgcacagagctctcctgcgtgtgtaacagaggagaacacacatgggagagctcaacctggcggcagcgcaaaagatg

SEQ ID NO: 169144 - DNA, 103 bp, Artificial Sequence
  Synthetic Polynucleotide
taatacgactcactatagggacttctgcagcttccctgcacagagctctcaacagaggagagagagcatggtgcagggaaacctggcggcagcgcaaaagatg

SEQ ID NO: 169145 - DNA, 103 bp, Artificial Sequence
  Synthetic Polynucleotide
taatacgactcactatagggtgttttcaggacttctgcagcttccctgcaaacagaggagatgcaggatggctgcagaaaacctggcggcagcgcaaaagatg

SEQ ID NO: 169146 - DNA, 103 bp, Artificial Sequence
  Synthetic Polynucleotide
taatacgactcactatagggatctggaacttgttttcaggacttctgcagaacagaggagactgcagatgtcctgaaaaaacctggcggcagcgcaaaagatg

SEQ ID NO: 169147 - DNA, 103 bp, Artificial Sequence
  Synthetic Polynucleotide
taatacgactcactatagggttgcttgataatctggaacttgttttcaggaacagaggagacctgaaatgaagttccagaacctggcggcagcgcaaaagatg

SEQ ID NO: 169148 - DNA, 103 bp, Artificial Sequence
  Synthetic Polynucleotide
taatacgactcactatagggccatcggctcttgcttgataatctggaactaacagaggagaagttccatgttatcaagcaacctggcggcagcgcaaaagatg

SEQ ID NO: 169149 - DNA, 103 bp, Artificial Sequence
  Synthetic Polynucleotide
taatacgactcactatagggctctctaattccatcggctcttgcttgataaacagaggagatatcaaatgagagccgataacctggcggcagcgcaaaagatg

SEQ ID NO: 169150 - DNA, 103 bp, Artificial Sequence
  Synthetic Polynucleotide
taatacgactcactatagggccttgtgtagctctctaattccatcggctcaacagaggagagagccgatggaattagagaacctggcggcagcgcaaaagatg

SEQ ID NO: 169151 - DNA, 103 bp, Artificial Sequence
  Synthetic Polynucleotide
taatacgactcactatagggctcttggctcccttgtgtagctctctaattaacagaggagaaattagatggctacacaaaacctggcggcagcgcaaaagatg

SEQ ID NO: 169152 - DNA, 103 bp, Artificial Sequence
  Synthetic Polynucleotide
taatacgactcactatagggcctcggtcatctcttggctcccttgtgtagaacagaggagactacacatgggagccaagaacctggcggcagcgcaaaagatg

SEQ ID NO: 169153 - DNA, 103 bp, Artificial Sequence
  Synthetic Polynucleotide
taatacgactcactatagggagaattaaggaccatcatcttgtccacattaacagaggagaaatgtgatgaagatgatgaacctggcggcagcgcaaaagatg

SEQ ID NO: 169154 - DNA, 103 bp, Artificial Sequence
  Synthetic Polynucleotide
taatacgactcactatagggtgtgtaagagcctcggtcatctcttggctcaacagaggagagagccaatggatgaccgaaacctggcggcagcgcaaaagatg

SEQ ID NO: 169155 - DNA, 103 bp, Artificial Sequence
  Synthetic Polynucleotide
taatacgactcactatagggagatggacgctgtgtaagagcctcggtcataacagaggagaatgaccatggctcttacaaacctggcggcagcgcaaaagatg

SEQ ID NO: 169156 - DNA, 103 bp, Artificial Sequence
  Synthetic Polynucleotide
taatacgactcactatagggtagttttgatagatggacgctgtgtaagagaacagaggagactcttaatgagcgtccataacctggcggcagcgcaaaagatg

SEQ ID NO: 169157 - DNA, 103 bp, Artificial Sequence
  Synthetic Polynucleotide
taatacgactcactatagggattccccatatagttttgatagatggacgcaacagaggagagcgtccatgtatcaaaacaacctggcggcagcgcaaaagatg

SEQ ID NO: 169158 - DNA, 103 bp, Artificial Sequence
  Synthetic Polynucleotide
taatacgactcactatagggcagagaaagaattccccatatagttttgataacagaggagaatcaaaatgatatggggaaacctggcggcagcgcaaaagatg

SEQ ID NO: 169159 - DNA, 103 bp, Artificial Sequence
  Synthetic Polynucleotide
taatacgactcactatagggtgtgagtacccagagaaagaattccccataaacagaggagatatgggatgttctttctcaacctggcggcagcgcaaaagatg

SEQ ID NO: 169160 - DNA, 103 bp, Artificial Sequence
  Synthetic Polynucleotide
taatacgactcactatagggtgggggagagtgtgagtacccagagaaagaaacagaggagatctttcatggggtactcaaacctggcggcagcgcaaaagatg

SEQ ID NO: 169161 - DNA, 103 bp, Artificial Sequence
  Synthetic Polynucleotide
taatacgactcactatagggcttgcagtagtgggggagagtgtgagtaccaacagaggagaggtactatgactctccccaacctggcggcagcgcaaaagatg

SEQ ID NO: 169162 - DNA, 103 bp, Artificial Sequence
  Synthetic Polynucleotide
taatacgactcactataggggatcggttgacttgcagtagtgggggagagaacagaggagactctccatgactactgcaaacctggcggcagcgcaaaagatg

SEQ ID NO: 169163 - DNA, 103 bp, Artificial Sequence
  Synthetic Polynucleotide
taatacgactcactataggggttgctggaggatcggttgacttgcagtagaacagaggagactactgatggtcaaccgaaacctggcggcagcgcaaaagatg

SEQ ID NO: 169164 - DNA, 103 bp, Artificial Sequence
  Synthetic Polynucleotide
taatacgactcactatagggccgttaaagcagaattaaggaccatcatctaacagaggagaagatgaatgtccttaattaacctggcggcagcgcaaaagatg

SEQ ID NO: 169165 - DNA, 103 bp, Artificial Sequence
  Synthetic Polynucleotide
taatacgactcactatagggttctcggggagttgctggaggatcggttgaaacagaggagatcaaccatgcctccagcaaacctggcggcagcgcaaaagatg

SEQ ID NO: 169166 - DNA, 103 bp, Artificial Sequence
  Synthetic Polynucleotide
taatacgactcactataggggtttccgacgttctcggggagttgctggagaacagaggagactccagatgctccccgagaacctggcggcagcgcaaaagatg

SEQ ID NO: 169167 - DNA, 103 bp, Artificial Sequence
  Synthetic Polynucleotide
taatacgactcactatagggaccatcatcagtttccgacgttctcggggaaacagaggagatccccgatgacgtcggaaaacctggcggcagcgcaaaagatg

SEQ ID NO: 169168 - DNA, 103 bp, Artificial Sequence
  Synthetic Polynucleotide
taatacgactcactatagggttcctaccacaccatcatcagtttccgacgaacagaggagacgtcggatgctgatgatgaacctggcggcagcgcaaaagatg

SEQ ID NO: 169169 - DNA, 103 bp, Artificial Sequence
  Synthetic Polynucleotide
taatacgactcactatagggtcagatgactttcctaccacaccatcatcaaacagaggagatgatgaatgtgtggtaggaacctggcggcagcgcaaaagatg

SEQ ID NO: 169170 - DNA, 103 bp, Artificial Sequence
  Synthetic Polynucleotide
taatacgactcactataggggtcttctccatcagatgactttcctaccacaacagaggagagtggtaatgaagtcatctaacctggcggcagcgcaaaagatg

SEQ ID NO: 169171 - DNA, 103 bp, Artificial Sequence
  Synthetic Polynucleotide
taatacgactcactatagggcctgttgctcgtcttctccatcagatgactaacagaggagaagtcatatgatggagaagaacctggcggcagcgcaaaagatg

SEQ ID NO: 169172 - DNA, 103 bp, Artificial Sequence
  Synthetic Polynucleotide
taatacgactcactatagggcccttggggacctgttgctcgtcttctccaaacagaggagatggagaatgcgagcaacaaacctggcggcagcgcaaaagatg

SEQ ID NO: 169173 - DNA, 103 bp, Artificial Sequence
  Synthetic Polynucleotide
taatacgactcactatagggatggatggggcccttggggacctgttgctcaacagaggagagagcaaatggtccccaagaacctggcggcagcgcaaaagatg

SEQ ID NO: 169174 - DNA, 103 bp, Artificial Sequence
  Synthetic Polynucleotide
taatacgactcactatagggcaactggagaatggatggggcccttggggaaacagaggagatccccaatggccccatccaacctggcggcagcgcaaaagatg

SEQ ID NO: 169175 - DNA, 103 bp, Artificial Sequence
  Synthetic Polynucleotide
taatacgactcactatagggtctgacacttccgttaaagcagaattaaggaacagaggagaccttaaatgtgctttaacaacctggcggcagcgcaaaagatg

SEQ ID NO: 169176 - DNA, 103 bp, Artificial Sequence
  Synthetic Polynucleotide
taatacgactcactatagggtgcttgagttcaactggagaatggatggggaacagaggagaccccatatgttctccagtaacctggcggcagcgcaaaagatg

SEQ ID NO: 169177 - DNA, 103 bp, Artificial Sequence
  Synthetic Polynucleotide
taatacgactcactatagggtgcatgcacatgcttgagttcaactggagaaacagaggagatctccaatggaactcaagaacctggcggcagcgcaaaagatg

SEQ ID NO: 169178 - DNA, 103 bp, Artificial Sequence
  Synthetic Polynucleotide
taatacgactcactatagggtaaccacagttgcatgcacatgcttgagttaacagaggagaaactcaatgatgtgcatgaacctggcggcagcgcaaaagatg

SEQ ID NO: 169179 - DNA, 103 bp, Artificial Sequence
  Synthetic Polynucleotide
taatacgactcactatagggtctggaactttaaccacagttgcatgcacaaacagaggagatgtgcaatgaactgtggtaacctggcggcagcgcaaaagatg

SEQ ID NO: 169180 - DNA, 103 bp, Artificial Sequence
  Synthetic Polynucleotide
taatacgactcactatagggggaattcacttctggaactttaaccacagtaacagaggagaactgtgatgaaagttccaaacctggcggcagcgcaaaagatg

SEQ ID NO: 169181 - DNA, 103 bp, Artificial Sequence
  Synthetic Polynucleotide
taatacgactcactataggggcaaggcagaggaattcacttctggaacttaacagaggagaaagttcatgaagtgaattaacctggcggcagcgcaaaagatg

SEQ ID NO: 169182 - DNA, 103 bp, Artificial Sequence
  Synthetic Polynucleotide
taatacgactcactatagggagcttgtgtggcaaggcagaggaattcactaacagaggagaagtgaaatgctctgccttaacctggcggcagcgcaaaagatg

SEQ ID NO: 169183 - DNA, 103 bp, Artificial Sequence
  Synthetic Polynucleotide
taatacgactcactatagggtttgatccggagcttgtgtggcaaggcagaaacagaggagatctgccatgccacacaagaacctggcggcagcgcaaaagatg

SEQ ID NO: 169184 - DNA, 103 bp, Artificial Sequence
  Synthetic Polynucleotide
taatacgactcactatagggtggctttggctttgatccggagcttgtgtgaacagaggagacacacaatgtccggatcaaacctggcggcagcgcaaaagatg

SEQ ID NO: 169185 - DNA, 103 bp, Artificial Sequence
  Synthetic Polynucleotide
taatacgactcactatagggttgatctgcatggctttggctttgatccggaacagaggagaccggatatgagccaaagcaacctggcggcagcgcaaaagatg

SEQ ID NO: 169186 - DNA, 103 bp, Artificial Sequence
  Synthetic Polynucleotide
taatacgactcactatagggccttcccaaatatggatcatcttctgccataacagaggagaatggcaatggatgatccaaacctggcggcagcgcaaaagatg

SEQ ID NO: 169187 - DNA, 103 bp, Artificial Sequence
  Synthetic Polynucleotide
taatacgactcactatagggtgctgttggcagtgccatctgtggttgaaaaacagaggagatttcaaatgcagatggcaaacctggcggcagcgcaaaagatg

SEQ ID NO: 169188 - DNA, 103 bp, Artificial Sequence
  Synthetic Polynucleotide
taatacgactcactatagggcaagtcagatttcctccgaagctggacaaaaacagaggagatttgtcatgcttcggaggaacctggcggcagcgcaaaagatg

SEQ ID NO: 169189 - DNA, 103 bp, Artificial Sequence
  Synthetic Polynucleotide
taatacgactcactatagggcactagtttccaagtcagatttcctccgaaaacagaggagattcggaatgaatctgactaacctggcggcagcgcaaaagatg

SEQ ID NO: 169190 - DNA, 103 bp, Artificial Sequence
  Synthetic Polynucleotide
taatacgactcactatagggggttttggttcactagtttccaagtcagataacagaggagaatctgaatgggaaactagaacctggcggcagcgcaaaagatg

SEQ ID NO: 169191 - DNA, 103 bp, Artificial Sequence
  Synthetic Polynucleotide
taatacgactcactataggggtagaggaaaggttttggttcactagtttcaacagaggagagaaactatggaaccaaaaaacctggcggcagcgcaaaagatg

SEQ ID NO: 169192 - DNA, 103 bp, Artificial Sequence
  Synthetic Polynucleotide
taatacgactcactatagggtttcaggatagtagaggaaaggttttggttaacagaggagaaaccaaatgctttcctctaacctggcggcagcgcaaaagatg

SEQ ID NO: 169193 - DNA, 103 bp, Artificial Sequence
  Synthetic Polynucleotide
taatacgactcactatagggttatctttgatttcaggatagtagaggaaaaacagaggagatttcctatgctatcctgaaacctggcggcagcgcaaaagatg

SEQ ID NO: 169194 - DNA, 103 bp, Artificial Sequence
  Synthetic Polynucleotide
taatacgactcactatagggcacttcttctttatctttgatttcaggataaacagaggagatatcctatgatcaaagataacctggcggcagcgcaaaagatg

SEQ ID NO: 169195 - DNA, 103 bp, Artificial Sequence
  Synthetic Polynucleotide
taatacgactcactataggggtttcctctgcacttcttctttatctttgaaacagaggagatcaaagatgaagaagaagaacctggcggcagcgcaaaagatg

SEQ ID NO: 169196 - DNA, 103 bp, Artificial Sequence
  Synthetic Polynucleotide
taatacgactcactatagggagcttctgacgtttcctctgcacttcttctaacagaggagaagaagaatggcagaggaaaacctggcggcagcgcaaaagatg

SEQ ID NO: 169197 - DNA, 103 bp, Artificial Sequence
  Synthetic Polynucleotide
taatacgactcactatagggattgggcatgagcttctgacgtttcctctgaacagaggagacagaggatgcgtcagaagaacctggcggcagcgcaaaagatg

SEQ ID NO: 169198 - DNA, 103 bp, Artificial Sequence
  Synthetic Polynucleotide
taatacgactcactatagggatgggccatctgctgttggcagtgccatctaacagaggagaagatggatgtgccaacagaacctggcggcagcgcaaaagatg

SEQ ID NO: 169199 - DNA, 103 bp, Artificial Sequence
  Synthetic Polynucleotide
taatacgactcactatagggtatccgaaaaattgggcatgagcttctgacaacagaggagagtcagaatgtcatgcccaaacctggcggcagcgcaaaagatg

SEQ ID NO: 169200 - DNA, 103 bp, Artificial Sequence
  Synthetic Polynucleotide
taatacgactcactatagggccgccgaaactatccgaaaaattgggcatgaacagaggagacatgccatgtttttcggaaacctggcggcagcgcaaaagatg

SEQ ID NO: 169201 - DNA, 103 bp, Artificial Sequence
  Synthetic Polynucleotide
taatacgactcactatagggaccactaccaccgccgaaactatccgaaaaaacagaggagattttcgatgagtttcggcaacctggcggcagcgcaaaagatg

SEQ ID NO: 169202 - DNA, 103 bp, Artificial Sequence
  Synthetic Polynucleotide
taatacgactcactatagggcagctccagcaccactaccaccgccgaaacaacagaggagagtttcgatggtggtagtgaacctggcggcagcgcaaaagatg

SEQ ID NO: 169203 - DNA, 103 bp, Artificial Sequence
  Synthetic Polynucleotide
taatacgactcactatagggcctccgcctccagctccagcaccactaccaaacagaggagatggtagatgtgctggagcaacctggcggcagcgcaaaagatg

SEQ ID NO: 169204 - DNA, 103 bp, Artificial Sequence
  Synthetic Polynucleotide
taatacgactcactatagggaccaaacatgcctccgcctccagctccagcaacagaggagagctggaatgggaggcggaaacctggcggcagcgcaaaagatg

SEQ ID NO: 169205 - DNA, 103 bp, Artificial Sequence
  Synthetic Polynucleotide
taatacgactcactatagggcaccgccactaccaaacatgcctccgcctcaacagaggagagaggcgatggcatgtttgaacctggcggcagcgcaaaagatg

SEQ ID NO: 169206 - DNA, 103 bp, Artificial Sequence
  Synthetic Polynucleotide
taatacgactcactatagggccccctcctccaccgccactaccaaacatgaacagaggagacatgttatgtagtggcggaacctggcggcagcgcaaaagatg

SEQ ID NO: 169207 - DNA, 103 bp, Artificial Sequence
  Synthetic Polynucleotide
taatacgactcactatagggacttccagtgccccctcctccaccgccactaacagaggagaagtggcatgggaggagggaacctggcggcagcgcaaaagatg

SEQ ID NO: 169208 - DNA, 103 bp, Artificial Sequence
  Synthetic Polynucleotide
taatacgactcactatagggctggacctgtacttccagtgccccctcctcaacagaggagagaggagatggcactggaaaacctggcggcagcgcaaaagatg

SEQ ID NO: 169209 - DNA, 103 bp, Artificial Sequence
  Synthetic Polynucleotide
taatacgactcactatagggatttgaaggtatgggccatctgctgttggcaacagaggagagccaacatgagatggcccaacctggcggcagcgcaaaagatg

SEQ ID NO: 169210 - DNA, 103 bp, Artificial Sequence
  Synthetic Polynucleotide
taatacgactcactatagggaagctataccctggacctgtacttccagtgaacagaggagacactggatgtacaggtccaacctggcggcagcgcaaaagatg

SEQ ID NO: 169211 - DNA, 103 bp, Artificial Sequence
  Synthetic Polynucleotide
taatacgactcactatagggatagtgtgggaagctataccctggacctgtaacagaggagaacaggtatggggtatagcaacctggcggcagcgcaaaagatg

SEQ ID NO: 169212 - DNA, 103 bp, Artificial Sequence
  Synthetic Polynucleotide
taatacgactcactatagggtaggaaatccatagtgtgggaagctataccaacagaggagaggtataatgtcccacactaacctggcggcagcgcaaaagatg

SEQ ID NO: 169213 - DNA, 103 bp, Artificial Sequence
  Synthetic Polynucleotide
taatacgactcactatagggccaccataagtaggaaatccatagtgtgggaacagaggagacccacaatgtggatttccaacctggcggcagcgcaaaagatg

SEQ ID NO: 169214 - DNA, 103 bp, Artificial Sequence
  Synthetic Polynucleotide
taatacgactcactataggggaaagtaatcccaccataagtaggaaatccaacagaggagaggatttatgacttatggtaacctggcggcagcgcaaaagatg

SEQ ID NO: 169215 - DNA, 103 bp, Artificial Sequence
  Synthetic Polynucleotide
taatacgactcactatagggttccaggatggaaagtaatcccaccataagaacagaggagacttatgatgggattacttaacctggcggcagcgcaaaagatg

SEQ ID NO: 169216 - DNA, 103 bp, Artificial Sequence
  Synthetic Polynucleotide
taatacgactcactataggggatttagtagttccaggatggaaagtaatcaacagaggagagattacatgccatcctggaacctggcggcagcgcaaaagatg

SEQ ID NO: 169217 - DNA, 103 bp, Artificial Sequence
  Synthetic Polynucleotide
taatacgactcactatagggcccagcattagatttagtagttccaggatgaacagaggagacatcctatgactactaaaaacctggcggcagcgcaaaagatg

SEQ ID NO: 169218 - DNA, 103 bp, Artificial Sequence
  Synthetic Polynucleotide
taatacgactcactatagggcatgcttcatcccagcattagatttagtagaacagaggagactactaatgctaatgctgaacctggcggcagcgcaaaagatg

SEQ ID NO: 169219 - DNA, 103 bp, Artificial Sequence
  Synthetic Polynucleotide
taatacgactcactatagggtccatggttccatgcttcatcccagcattaaacagaggagataatgcatggatgaagcaaacctggcggcagcgcaaaagatg

SEQ ID NO: 169220 - DNA, 103 bp, Artificial Sequence
  Synthetic Polynucleotide
taatacgactcactatagggttgctctaatatttgaaggtatgggccatcaacagaggagagatggcatgtaccttcaaaacctggcggcagcgcaaaagatg

SEQ ID NO: 169221 - DNA, 103 bp, Artificial Sequence
  Synthetic Polynucleotide
taatacgactcactatagggagattcagtgtccatggttccatgcttcataacagaggagaatgaagatgggaaccatgaacctggcggcagcgcaaaagatg

SEQ ID NO: 169222 - DNA, 103 bp, Artificial Sequence
  Synthetic Polynucleotide
taatacgactcactatagggggtcctttttagattcagtgtccatggttcaacagaggagagaaccaatgacactgaataacctggcggcagcgcaaaagatg

SEQ ID NO: 169223 - DNA, 103 bp, Artificial Sequence
  Synthetic Polynucleotide
taatacgactcactatagggcaaccttcagggtcctttttagattcagtgaacagaggagacactgaatgtaaaaaggaaacctggcggcagcgcaaaagatg

SEQ ID NO: 169224 - DNA, 103 bp, Artificial Sequence
  Synthetic Polynucleotide
taatacgactcactatagggacttttgtcacaaccttcagggtcctttttaacagaggagaaaaaagatgcctgaaggtaacctggcggcagcgcaaaagatg

SEQ ID NO: 169225 - DNA, 103 bp, Artificial Sequence
  Synthetic Polynucleotide
taatacgactcactatagggttttgtcatcacttttgtcacaaccttcagaacagaggagactgaagatggtgacaaaaaacctggcggcagcgcaaaagatg

SEQ ID NO: 169226 - DNA, 103 bp, Artificial Sequence
  Synthetic Polynucleotide
taatacgactcactatagggtttacagtgtttttgtcatcacttttgtcaaacagaggagatgacaaatgtgatgacaaaacctggcggcagcgcaaaagatg

SEQ ID NO: 169227 - DNA, 103 bp, Artificial Sequence
  Synthetic Polynucleotide
taatacgactcactatagggcccaaagaggtttacagtgtttttgtcatcaacagaggagagatgacatgaacactgtaaacctggcggcagcgcaaaagatg

SEQ ID NO: 169228 - DNA, 103 bp, Artificial Sequence
  Synthetic Polynucleotide
taatacgactcactatagggcaataactttcccaaagaggtttacagtgtaacagaggagaacactgatgacctctttgaacctggcggcagcgcaaaagatg

SEQ ID NO: 169229 - DNA, 103 bp, Artificial Sequence
  Synthetic Polynucleotide
taatacgactcactatagggtctgtggtttcaataactttcccaaagaggaacagaggagacctcttatggaaagttataacctggcggcagcgcaaaagatg

SEQ ID NO: 169230 - DNA, 103 bp, Artificial Sequence
  Synthetic Polynucleotide
taatacgactcactatagggctgatcttgctctgtggtttcaataactttaacagaggagaaaagttatggaaaccacaaacctggcggcagcgcaaaagatg

SEQ ID NO: 169231 - DNA, 103 bp, Artificial Sequence
  Synthetic Polynucleotide
taatacgactcactatagggtctgtttaggttgctctaatatttgaaggtaacagaggagaaccttcatgtattagagcaacctggcggcagcgcaaaagatg

SEQ ID NO: 169232 - DNA, 103 bp, Artificial Sequence
  Synthetic Polynucleotide
taatacgactcactatagggcgctgggctcctgatcttgctctgtggtttaacagaggagaaaaccaatgagcaagatcaacctggcggcagcgcaaaagatg

SEQ ID NO: 169233 - DNA, 103 bp, Artificial Sequence
  Synthetic Polynucleotide
taatacgactcactatagggacggtggcctcgctgggctcctgatcttgcaacagaggagagcaagaatgggagcccagaacctggcggcagcgcaaaagatg

SEQ ID NO: 169234 - DNA, 103 bp, Artificial Sequence
  Synthetic Polynucleotide
taatacgactcactatagggaccattcccaacggtggcctcgctgggctcaacagaggagagagcccatggaggccaccaacctggcggcagcgcaaaagatg

SEQ ID NO: 169235 - DNA, 103 bp, Artificial Sequence
  Synthetic Polynucleotide
taatacgactcactataggggagtgacctcaccattcccaacggtggcctaacagaggagaaggccaatgttgggaatgaacctggcggcagcgcaaaagatg

SEQ ID NO: 169236 - DNA, 103 bp, Artificial Sequence
  Synthetic Polynucleotide
taatacgactcactataggggcatacgttagagtgacctcaccattcccaaacagaggagatgggaaatgtgaggtcacaacctggcggcagcgcaaaagatg

SEQ ID NO: 169237 - DNA, 103 bp, Artificial Sequence
  Synthetic Polynucleotide
taatacgactcactatagggtgttcctgttgcatacgttagagtgacctcaacagaggagagaggtcatgctaacgtataacctggcggcagcgcaaaagatg

SEQ ID NO: 169238 - DNA, 103 bp, Artificial Sequence
  Synthetic Polynucleotide
taatacgactcactatagggtctcttcttttgttcctgttgcatacgttaaacagaggagataacgtatgcaacaggaaaacctggcggcagcgcaaaagatg

SEQ ID NO: 169239 - DNA, 103 bp, Artificial Sequence
  Synthetic Polynucleotide
taatacgactcactatagggactccagcactctcttcttttgttcctgttaacagaggagaaacaggatgaaaagaagaaacctggcggcagcgcaaaagatg

SEQ ID NO: 169240 - DNA, 103 bp, Artificial Sequence
  Synthetic Polynucleotide
taatacgactcactataggggttatcctgaactccagcactctcttctttaacagaggagaaaagaaatgagtgctggaaacctggcggcagcgcaaaagatg

SEQ ID NO: 169241 - DNA, 103 bp, Artificial Sequence
  Synthetic Polynucleotide
taatacgactcactatagggctagaaagaggttatcctgaactccagcacaacagaggagagtgctgatgttcaggataaacctggcggcagcgcaaaagatg

SEQ ID NO: 169242 - DNA, 103 bp, Artificial Sequence
  Synthetic Polynucleotide
taatacgactcactatagggcgaaatcctctctgtttaggttgctctaataacagaggagaattagaatgacctaaacaaacctggcggcagcgcaaaagatg

SEQ ID NO: 169243 - DNA, 103 bp, Artificial Sequence
  Synthetic Polynucleotide
taatacgactcactatagggatagccttctctagaaagaggttatcctgaaacagaggagatcaggaatgcctctttctaacctggcggcagcgcaaaagatg

SEQ ID NO: 169244 - DNA, 103 bp, Artificial Sequence
  Synthetic Polynucleotide
taatacgactcactatagggtgcaagctgcatagccttctctagaaagagaacagaggagactctttatggagaaggctaacctggcggcagcgcaaaagatg

SEQ ID NO: 169245 - DNA, 103 bp, Artificial Sequence
  Synthetic Polynucleotide
taatacgactcactatagggcatgcctctttgcaagctgcatagccttctaacagaggagaagaaggatgtgcagcttgaacctggcggcagcgcaaaagatg

SEQ ID NO: 169246 - DNA, 103 bp, Artificial Sequence
  Synthetic Polynucleotide
taatacgactcactatagggagggcattggcatgcctctttgcaagctgcaacagaggagagcagctatgaaagaggcaaacctggcggcagcgcaaaagatg

SEQ ID NO: 169247 - DNA, 103 bp, Artificial Sequence
  Synthetic Polynucleotide
taatacgactcactataggggtagtcgaaaagggcattggcatgcctcttaacagaggagaaagaggatggccaatgccaacctggcggcagcgcaaaagatg

SEQ ID NO: 169248 - DNA, 103 bp, Artificial Sequence
  Synthetic Polynucleotide
taatacgactcactatagggctgtcaccgcgtagtcgaaaagggcattggaacagaggagaccaatgatgttttcgactaacctggcggcagcgcaaaagatg

SEQ ID NO: 169249 - DNA, 103 bp, Artificial Sequence
  Synthetic Polynucleotide
taatacgactcactatagggttcacgtctcctgtcaccgcgtagtcgaaaaacagaggagatttcgaatgcgcggtgacaacctggcggcagcgcaaaagatg

SEQ ID NO: 169250 - DNA, 103 bp, Artificial Sequence
  Synthetic Polynucleotide
taatacgactcactatagggcagcagcatcttcacgtctcctgtcaccgcaacagaggagagcggtgatgggagacgtgaacctggcggcagcgcaaaagatg

SEQ ID NO: 169251 - DNA, 103 bp, Artificial Sequence
  Synthetic Polynucleotide
taatacgactcactataggggctggacggccagcagcatcttcacgtctcaacagaggagagagacgatgagatgctgcaacctggcggcagcgcaaaagatg

SEQ ID NO: 169252 - DNA, 103 bp, Artificial Sequence
  Synthetic Polynucleotide
taatacgactcactataggggtgagatggcgctggacggccagcagcatcaacagaggagagatgctatgggccgtccaaacctggcggcagcgcaaaagatg

SEQ ID NO: 169253 - DNA, 103 bp, Artificial Sequence
  Synthetic Polynucleotide
taatacgactcactatagggataacggaaacgaaatcctctctgtttaggaacagaggagacctaaaatgagaggatttaacctggcggcagcgcaaaagatg

SEQ ID NO: 169254 - DNA, 103 bp, Artificial Sequence
  Synthetic Polynucleotide
taatacgactcactatagggctgcacagcagtgagatggcgctggacggcaacagaggagagccgtcatgcgccatctcaacctggcggcagcgcaaaagatg

SEQ ID NO: 169255 - DNA, 103 bp, Artificial Sequence
  Synthetic Polynucleotide
taatacgactcactatagggcattctcatcctgcacagcagtgagatggcaacagaggagagccatcatgctgctgtgcaacctggcggcagcgcaaaagatg

SEQ ID NO: 169256 - DNA, 103 bp, Artificial Sequence
  Synthetic Polynucleotide
taatacgactcactatagggacactgtccccattctcatcctgcacagcaaacagaggagatgctgtatgggatgagaaaacctggcggcagcgcaaaagatg

SEQ ID NO: 169257 - DNA, 103 bp, Artificial Sequence
  Synthetic Polynucleotide
taatacgactcactatagggtaagtgtaagacactgtccccattctcatcaacagaggagagatgagatgggggacagtaacctggcggcagcgcaaaagatg

SEQ ID NO: 169258 - DNA, 103 bp, Artificial Sequence
  Synthetic Polynucleotide
taatacgactcactatagggggatgattgctaagtgtaagacactgtcccaacagaggagagggacaatgtcttacactaacctggcggcagcgcaaaagatg

SEQ ID NO: 169259 - DNA, 103 bp, Artificial Sequence
  Synthetic Polynucleotide
taatacgactcactataggggaatgaaggtggatgattgctaagtgtaagaacagaggagacttacaatgagcaatcataacctggcggcagcgcaaaagatg

SEQ ID NO: 169260 - DNA, 103 bp, Artificial Sequence
  Synthetic Polynucleotide
taatacgactcactatagggcacaagttgagaatgaaggtggatgattgcaacagaggagagcaatcatgcaccttcataacctggcggcagcgcaaaagatg

SEQ ID NO: 169261 - DNA, 103 bp, Artificial Sequence
  Synthetic Polynucleotide
taatacgactcactataggggtagatccctcacaagttgagaatgaaggtaacagaggagaaccttcatgctcaacttgaacctggcggcagcgcaaaagatg

SEQ ID NO: 169262 - DNA, 103 bp, Artificial Sequence
  Synthetic Polynucleotide
taatacgactcactataggggtgacttctagtagatccctcacaagttgaaacagaggagatcaactatggagggatctaacctggcggcagcgcaaaagatg

SEQ ID NO: 169263 - DNA, 103 bp, Artificial Sequence
  Synthetic Polynucleotide
taatacgactcactatagggcaaaccagatgtgacttctagtagatccctaacagaggagaagggatatgctagaagtcaacctggcggcagcgcaaaagatg

SEQ ID NO: 169264 - DNA, 103 bp, Artificial Sequence
  Synthetic Polynucleotide
taatacgactcactatagggcttcacatacataacggaaacgaaatcctcaacagaggagagaggatatggtttccgttaacctggcggcagcgcaaaagatg

SEQ ID NO: 169265 - DNA, 103 bp, Artificial Sequence
  Synthetic Polynucleotide
taatacgactcactatagggcatcagaaatcaaaccagatgtgacttctaaacagaggagatagaagatgcatctggttaacctggcggcagcgcaaaagatg

SEQ ID NO: 169266 - DNA, 103 bp, Artificial Sequence
  Synthetic Polynucleotide
taatacgactcactatagggttgataatgtcatcagaaatcaaaccagataacagaggagaatctggatggatttctgaaacctggcggcagcgcaaaagatg

SEQ ID NO: 169267 - DNA, 103 bp, Artificial Sequence
  Synthetic Polynucleotide
taatacgactcactatagggatttctcatgttgataatgtcatcagaaataacagaggagaatttctatggacattatcaacctggcggcagcgcaaaagatg

SEQ ID NO: 169268 - DNA, 103 bp, Artificial Sequence
  Synthetic Polynucleotide
taatacgactcactatagggggtacagatcatttctcatgttgataatgtaacagaggagaacattaatgacatgagaaaacctggcggcagcgcaaaagatg

SEQ ID NO: 169269 - DNA, 103 bp, Artificial Sequence
  Synthetic Polynucleotide
taatacgactcactatagggaagggcgtctggtacagatcatttctcatgaacagaggagacatgagatgtgatctgtaaacctggcggcagcgcaaaagatg

SEQ ID NO: 169270 - DNA, 103 bp, Artificial Sequence
  Synthetic Polynucleotide
taatacgactcactatagggtgccaagtgcaagggcgtctggtacagatcaacagaggagagatctgatgcagacgcccaacctggcggcagcgcaaaagatg

SEQ ID NO: 169271 - DNA, 103 bp, Artificial Sequence
  Synthetic Polynucleotide
taatacgactcactatagggtagtgatcactgccaagtgcaagggcgtctaacagaggagaagacgcatgtgcacttggaacctggcggcagcgcaaaagatg

SEQ ID NO: 169272 - DNA, 103 bp, Artificial Sequence
  Synthetic Polynucleotide
taatacgactcactatagggtcttcctgcttagtgatcactgccaagtgcaacagaggagagcacttatgagtgatcacaacctggcggcagcgcaaaagatg

SEQ ID NO: 169273 - DNA, 103 bp, Artificial Sequence
  Synthetic Polynucleotide
taatacgactcactatagggctccaccacatcttcctgcttagtgatcacaacagaggagagtgatcatgaagcaggaaaacctggcggcagcgcaaaagatg

SEQ ID NO: 169274 - DNA, 103 bp, Artificial Sequence
  Synthetic Polynucleotide
taatacgactcactatagggtcagcaaatcctccaccacatcttcctgctaacagaggagaagcaggatgatgtggtggaacctggcggcagcgcaaaagatg

SEQ ID NO: 169275 - DNA, 103 bp, Artificial Sequence
  Synthetic Polynucleotide
taatacgactcactatagggtgggatgggccttcacatacataacggaaaaacagaggagatttccgatgtgtatgtgaaacctggcggcagcgcaaaagatg

SEQ ID NO: 169276 - DNA, 103 bp, Artificial Sequence
  Synthetic Polynucleotide
taatacgactcactataggggccccagccctcagcaaatcctccaccacaaacagaggagatgtggtatgggatttgctaacctggcggcagcgcaaaagatg

SEQ ID NO: 169277 - DNA, 103 bp, Artificial Sequence
  Synthetic Polynucleotide
taatacgactcactataggggctcaggtcggccccagccctcagcaaatcaacagaggagagatttgatgagggctgggaacctggcggcagcgcaaaagatg

SEQ ID NO: 169278 - DNA, 103 bp, Artificial Sequence
  Synthetic Polynucleotide
taatacgactcactatagggggtccagaaggctcaggtcggccccagcccaacagaggagagggctgatgccgacctgaaacctggcggcagcgcaaaagatg

SEQ ID NO: 169279 - DNA, 103 bp, Artificial Sequence
  Synthetic Polynucleotide
taatacgactcactatagggttacccaagcggtccagaaggctcaggtcgaacagaggagacgacctatgccttctggaaacctggcggcagcgcaaaagatg

SEQ ID NO: 169280 - DNA, 103 bp, Artificial Sequence
  Synthetic Polynucleotide
taatacgactcactatagggcaaaacagagttacccaagcggtccagaagaacagaggagacttctgatgcgcttgggtaacctggcggcagcgcaaaagatg

SEQ ID NO: 169281 - DNA, 103 bp, Artificial Sequence
  Synthetic Polynucleotide
taatacgactcactatagggcagctaggtgcaaaacagagttacccaagcaacagaggagagcttggatgactctgtttaacctggcggcagcgcaaaagatg

SEQ ID NO: 169282 - DNA, 103 bp, Artificial Sequence
  Synthetic Polynucleotide
taatacgactcactatagggccttctttggcagctaggtgcaaaacagagaacagaggagactctgtatggcacctagcaacctggcggcagcgcaaaagatg

SEQ ID NO: 169283 - DNA, 103 bp, Artificial Sequence
  Synthetic Polynucleotide
taatacgactcactatagggtttatcatgtccttctttggcagctaggtgaacagaggagacacctaatggccaaagaaaacctggcggcagcgcaaaagatg

SEQ ID NO: 169284 - DNA, 103 bp, Artificial Sequence
  Synthetic Polynucleotide
taatacgactcactatagggtactgagaactttatcatgtccttctttggaacagaggagaccaaagatggacatgataaacctggcggcagcgcaaaagatg

SEQ ID NO: 169285 - DNA, 103 bp, Artificial Sequence
  Synthetic Polynucleotide
taatacgactcactatagggttgagtaagatactgagaactttatcatgtaacagaggagaacatgaatgagttctcagaacctggcggcagcgcaaaagatg

SEQ ID NO: 169286 - DNA, 103 bp, Artificial Sequence
  Synthetic Polynucleotide
taatacgactcactatagggtagtccaccatgggatgggccttcacatacaacagaggagagtatgtatgggcccatccaacctggcggcagcgcaaaagatg

SEQ ID NO: 169287 - DNA, 103 bp, Artificial Sequence
  Synthetic Polynucleotide
taatacgactcactatagggctttttgtgcttgagtaagatactgagaacaacagaggagagttctcatgatcttactcaacctggcggcagcgcaaaagatg

SEQ ID NO: 169288 - DNA, 103 bp, Artificial Sequence
  Synthetic Polynucleotide
taatacgactcactataggggtagtgctgcctttttgtgcttgagtaagaaacagaggagatcttacatgagcacaaaaaacctggcggcagcgcaaaagatg

SEQ ID NO: 169289 - DNA, 103 bp, Artificial Sequence
  Synthetic Polynucleotide
taatacgactcactatagggtggtcaagaagtagtgctgcctttttgtgcaacagaggagagcacaaatgggcagcactaacctggcggcagcgcaaaagatg

SEQ ID NO: 169290 - DNA, 103 bp, Artificial Sequence
  Synthetic Polynucleotide
taatacgactcactatagggcccgttggggtggtcaagaagtagtgctgcaacagaggagagcagcaatgcttcttgacaacctggcggcagcgcaaaagatg

SEQ ID NO: 169291 - DNA, 103 bp, Artificial Sequence
  Synthetic Polynucleotide
taatacgactcactatagggtcagaccgtccccgttggggtggtcaagaaaacagaggagattcttgatgaccccaacgaacctggcggcagcgcaaaagatg

SEQ ID NO: 169292 - DNA, 103 bp, Artificial Sequence
  Synthetic Polynucleotide
taatacgactcactatagggtgaatggcattcagaccgtccccgttggggaacagaggagaccccaaatgggacggtctaacctggcggcagcgcaaaagatg

SEQ ID NO: 169293 - DNA, 103 bp, Artificial Sequence
  Synthetic Polynucleotide
taatacgactcactatagggcatggctagatgaatggcattcagaccgtcaacagaggagagacggtatgaatgccattaacctggcggcagcgcaaaagatg

SEQ ID NO: 169294 - DNA, 103 bp, Artificial Sequence
  Synthetic Polynucleotide
taatacgactcactatagggtattgctcatcatggctagatgaatggcataacagaggagaatgccaatgatctagccaaacctggcggcagcgcaaaagatg

SEQ ID NO: 169295 - DNA, 103 bp, Artificial Sequence
  Synthetic Polynucleotide
taatacgactcactatagggcatggcaggctattgctcatcatggctagaaacagaggagatctagcatggatgagcaaaacctggcggcagcgcaaaagatg

SEQ ID NO: 169296 - DNA, 103 bp, Artificial Sequence
  Synthetic Polynucleotide
taatacgactcactatagggcagcagcaaacatggcaggctattgctcataacagaggagaatgagcatgagcctgccaaacctggcggcagcgcaaaagatg

SEQ ID NO: 169297 - DNA, 103 bp, Artificial Sequence
  Synthetic Polynucleotide
taatacgactcactatagggtttgttcaggccttcccaaatatggatcataacagaggagaatgatcatgatttgggaaaacctggcggcagcgcaaaagatg

SEQ ID NO: 169298 - DNA, 103 bp, Artificial Sequence
  Synthetic Polynucleotide
taatacgactcactatagggaggcaccaggtagtccaccatgggatgggcaacagaggagagcccatatgatggtggacaacctggcggcagcgcaaaagatg

SEQ ID NO: 169299 - DNA, 103 bp, Artificial Sequence
  Synthetic Polynucleotide
taatacgactcactatagggcggccaccagcagcagcaaacatggcaggcaacagaggagagcctgcatggtttgctgcaacctggcggcagcgcaaaagatg

SEQ ID NO: 169300 - DNA, 103 bp, Artificial Sequence
  Synthetic Polynucleotide
taatacgactcactatagggtcagccccagcggccaccagcagcagcaaaaacagaggagatttgctatggctggtggcaacctggcggcagcgcaaaagatg

SEQ ID NO: 169301 - DNA, 103 bp, Artificial Sequence
  Synthetic Polynucleotide
taatacgactcactatagggagcattgacgtcagccccagcggccaccagaacagaggagactggtgatggctggggctaacctggcggcagcgcaaaagatg

SEQ ID NO: 169302 - DNA, 103 bp, Artificial Sequence
  Synthetic Polynucleotide
taatacgactcactatagggtctgctcctgagcattgacgtcagccccagaacagaggagactggggatgacgtcaatgaacctggcggcagcgcaaaagatg

SEQ ID NO: 169303 - DNA, 103 bp, Artificial Sequence
  Synthetic Polynucleotide
taatacgactcactatagggcgcccggacttctgctcctgagcattgacgaacagaggagacgtcaaatgtcaggagcaaacctggcggcagcgcaaaagatg

SEQ ID NO: 169304 - DNA, 103 bp, Artificial Sequence
  Synthetic Polynucleotide
taatacgactcactatagggcagtgctgtgcgcccggacttctgctcctgaacagaggagacaggagatgaagtccgggaacctggcggcagcgcaaaagatg

SEQ ID NO: 169305 - DNA, 103 bp, Artificial Sequence
  Synthetic Polynucleotide
taatacgactcactatagggcagccaggtgcagtgctgtgcgcccggactaacagaggagaagtccgatggcacagcacaacctggcggcagcgcaaaagatg

SEQ ID NO: 169306 - DNA, 103 bp, Artificial Sequence
  Synthetic Polynucleotide
taatacgactcactatagggtcgtgctccacagccaggtgcagtgctgtgaacagaggagacacagcatggcacctggcaacctggcggcagcgcaaaagatg

SEQ ID NO: 169307 - DNA, 103 bp, Artificial Sequence
  Synthetic Polynucleotide
taatacgactcactatagggtgagatgttgtcgtgctccacagccaggtgaacagaggagacacctgatggtggagcacaacctggcggcagcgcaaaagatg

SEQ ID NO: 169308 - DNA, 103 bp, Artificial Sequence
  Synthetic Polynucleotide
taatacgactcactatagggagcctgccaatgagatgttgtcgtgctccaaacagaggagatggagcatgacaacatctaacctggcggcagcgcaaaagatg

SEQ ID NO: 169309 - DNA, 103 bp, Artificial Sequence
  Synthetic Polynucleotide
taatacgactcactatagggttttcactagaggcaccaggtagtccaccaaacagaggagatggtggatgacctggtgcaacctggcggcagcgcaaaagatg

SEQ ID NO: 169310 - DNA, 103 bp, Artificial Sequence
  Synthetic Polynucleotide
taatacgactcactatagggaggagcaggcagcctgccaatgagatgttgaacagaggagacaacatatgattggcaggaacctggcggcagcgcaaaagatg

SEQ ID NO: 169311 - DNA, 103 bp, Artificial Sequence
  Synthetic Polynucleotide
taatacgactcactatagggatcaccctccaggagcaggcagcctgccaaaacagaggagattggcaatgtgcctgctcaacctggcggcagcgcaaaagatg

SEQ ID NO: 169312 - DNA, 103 bp, Artificial Sequence
  Synthetic Polynucleotide
taatacgactcactatagggccacatgggcatcaccctccaggagcaggcaacagaggagagcctgcatgtggagggtgaacctggcggcagcgcaaaagatg

SEQ ID NO: 169313 - DNA, 103 bp, Artificial Sequence
  Synthetic Polynucleotide
taatacgactcactataggggtagtactgtccacatgggcatcaccctccaacagaggagaggagggatgtgcccatgtaacctggcggcagcgcaaaagatg

SEQ ID NO: 169314 - DNA, 103 bp, Artificial Sequence
  Synthetic Polynucleotide
taatacgactcactatagggtccatcgtaggtagtactgtccacatgggcaacagaggagagcccatatggacagtactaacctggcggcagcgcaaaagatg

SEQ ID NO: 169315 - DNA, 103 bp, Artificial Sequence
  Synthetic Polynucleotide
taatacgactcactatagggggggtgtggttccatcgtaggtagtactgtaacagaggagaacagtaatgcctacgatgaacctggcggcagcgcaaaagatg

SEQ ID NO: 169316 - DNA, 103 bp, Artificial Sequence
  Synthetic Polynucleotide
taatacgactcactataggggctatatgcaggggtgtggttccatcgtagaacagaggagactacgaatgaaccacaccaacctggcggcagcgcaaaagatg

SEQ ID NO: 169317 - DNA, 103 bp, Artificial Sequence
  Synthetic Polynucleotide
taatacgactcactatagggtctcccagctgctatatgcaggggtgtggtaacagaggagaaccacaatgctgcatataaacctggcggcagcgcaaaagatg

SEQ ID NO: 169318 - DNA, 103 bp, Artificial Sequence
  Synthetic Polynucleotide
taatacgactcactatagggtggtggaccctctcccagctgctatatgcaaacagaggagatgcataatgcagctgggaaacctggcggcagcgcaaaagatg

SEQ ID NO: 169319 - DNA, 103 bp, Artificial Sequence
  Synthetic Polynucleotide
taatacgactcactataggggctgccagcctggtggaccctctcccagctaacagaggagaagctggatgagggtccacaacctggcggcagcgcaaaagatg

SEQ ID NO: 169320 - DNA, 103 bp, Artificial Sequence
  Synthetic Polynucleotide
taatacgactcactatagggcttcttgttcttttcactagaggcaccaggaacagaggagacctggtatgtctagtgaaaacctggcggcagcgcaaaagatg

SEQ ID NO: 169321 - DNA, 103 bp, Artificial Sequence
  Synthetic Polynucleotide
taatacgactcactatagggtttgagaagagctgccagcctggtggacccaacagaggagagggtccatgaggctggcaaacctggcggcagcgcaaaagatg

SEQ ID NO: 169322 - DNA, 103 bp, Artificial Sequence
  Synthetic Polynucleotide
taatacgactcactatagggctcctgctgctttgagaagagctgccagccaacagaggagaggctggatgctcttctcaaacctggcggcagcgcaaaagatg

SEQ ID NO: 169323 - DNA, 103 bp, Artificial Sequence
  Synthetic Polynucleotide
taatacgactcactatagggaggggatctgctcctgctgctttgagaagaaacagaggagatcttctatgagcagcaggaacctggcggcagcgcaaaagatg

SEQ ID NO: 169324 - DNA, 103 bp, Artificial Sequence
  Synthetic Polynucleotide
taatacgactcactataggggttctccaccaggggatctgctcctgctgcaacagaggagagcagcaatggcagatcccaacctggcggcagcgcaaaagatg

SEQ ID NO: 169325 - DNA, 103 bp, Artificial Sequence
  Synthetic Polynucleotide
taatacgactcactataggggaggctcaaagttctccaccaggggatctgaacagaggagacagatcatgtggtggagaaacctggcggcagcgcaaaagatg

SEQ ID NO: 169326 - DNA, 103 bp, Artificial Sequence
  Synthetic Polynucleotide
taatacgactcactatagggaggtcatagagaggctcaaagttctccaccaacagaggagaggtggaatgctttgagccaacctggcggcagcgcaaaagatg

SEQ ID NO: 169327 - DNA, 103 bp, Artificial Sequence
  Synthetic Polynucleotide
taatacgactcactatagggagagtcatccaggtcatagagaggctcaaaaacagaggagatttgagatgctctatgacaacctggcggcagcgcaaaagatg

SEQ ID NO: 169328 - DNA, 103 bp, Artificial Sequence
  Synthetic Polynucleotide
taatacgactcactatagggcattttcccaagagtcatccaggtcatagaaacagaggagatctatgatgtggatgactaacctggcggcagcgcaaaagatg

SEQ ID NO: 169329 - DNA, 103 bp, Artificial Sequence
  Synthetic Polynucleotide
taatacgactcactatagggtcctctcctgcattttcccaagagtcatccaacagaggagaggatgaatgttgggaaaaaacctggcggcagcgcaaaagatg

SEQ ID NO: 169330 - DNA, 103 bp, Artificial Sequence
  Synthetic Polynucleotide
taatacgactcactatagggaactccttcatcctctcctgcattttcccaaacagaggagatgggaaatggcaggagagaacctggcggcagcgcaaaagatg

SEQ ID NO: 169331 - DNA, 103 bp, Artificial Sequence
  Synthetic Polynucleotide
taatacgactcactataggggagggtaagacttcttgttcttttcactagaacagaggagactagtgatgagaacaagaaacctggcggcagcgcaaaagatg

SEQ ID NO: 169332 - DNA, 103 bp, Artificial Sequence
  Synthetic Polynucleotide
taatacgactcactatagggttccaggcacaactccttcatcctctcctgaacagaggagacaggagatgatgaaggagaacctggcggcagcgcaaaagatg

SEQ ID NO: 169333 - DNA, 103 bp, Artificial Sequence
  Synthetic Polynucleotide
taatacgactcactatagggagaggcgtggttccaggcacaactccttcaaacagaggagatgaaggatgtgtgcctggaacctggcggcagcgcaaaagatg

SEQ ID NO: 169334 - DNA, 103 bp, Artificial Sequence
  Synthetic Polynucleotide
taatacgactcactatagggggccatatctagaggcgtggttccaggcacaacagaggagagtgcctatgaccacgcctaacctggcggcagcgcaaaagatg

SEQ ID NO: 169335 - DNA, 103 bp, Artificial Sequence
  Synthetic Polynucleotide
taatacgactcactataggggccagctggtggccatatctagaggcgtggaacagaggagaccacgcatgtagatatggaacctggcggcagcgcaaaagatg

SEQ ID NO: 169336 - DNA, 103 bp, Artificial Sequence
  Synthetic Polynucleotide
taatacgactcactatagggtcaaatacctgccagctggtggccatatctaacagaggagaagatatatgcaccagctgaacctggcggcagcgcaaaagatg

SEQ ID NO: 169337 - DNA, 103 bp, Artificial Sequence
  Synthetic Polynucleotide
taatacgactcactatagggatttaatatgtcaaatacctgccagctggtaacagaggagaaccagcatgcaggtatttaacctggcggcagcgcaaaagatg

SEQ ID NO: 169338 - DNA, 103 bp, Artificial Sequence
  Synthetic Polynucleotide
taatacgactcactatagggatggtttcccatttaatatgtcaaatacctaacagaggagaaggtatatgacatattaaaacctggcggcagcgcaaaagatg

SEQ ID NO: 169339 - DNA, 103 bp, Artificial Sequence
  Synthetic Polynucleotide
taatacgactcactatagggtctggctcatatggtttcccatttaatatgaacagaggagacatattatgtgggaaaccaacctggcggcagcgcaaaagatg

SEQ ID NO: 169340 - DNA, 103 bp, Artificial Sequence
  Synthetic Polynucleotide
taatacgactcactatagggagatgtaaactctggctcatatggtttcccaacagaggagagggaaaatgtatgagccaaacctggcggcagcgcaaaagatg

SEQ ID NO: 169341 - DNA, 103 bp, Artificial Sequence
  Synthetic Polynucleotide
taatacgactcactataggggtaaatcatcagatgtaaactctggctcataacagaggagaatgagcatgagtttacataacctggcggcagcgcaaaagatg

SEQ ID NO: 169342 - DNA, 103 bp, Artificial Sequence
  Synthetic Polynucleotide
taatacgactcactatagggattttgacctgagggtaagacttcttgttcaacagaggagagaacaaatggtcttacccaacctggcggcagcgcaaaagatg

SEQ ID NO: 169343 - DNA, 103 bp, Artificial Sequence
  Synthetic Polynucleotide
taatacgactcactatagggccttgtgctagtaaatcatcagatgtaaacaacagaggagagtttacatgtgatgatttaacctggcggcagcgcaaaagatg

SEQ ID NO: 169344 - DNA, 103 bp, Artificial Sequence
  Synthetic Polynucleotide
taatacgactcactatagggtttcatgtctccttgtgctagtaaatcatcaacagaggagagatgatatgctagcacaaaacctggcggcagcgcaaaagatg

SEQ ID NO: 169345 - DNA, 103 bp, Artificial Sequence
  Synthetic Polynucleotide
taatacgactcactatagggcagccagctgtttcatgtctccttgtgctaaacagaggagatagcacatggagacatgaaacctggcggcagcgcaaaagatg

SEQ ID NO: 169346 - DNA, 103 bp, Artificial Sequence
  Synthetic Polynucleotide
taatacgactcactatagggttcacatcttcagccagctgtttcatgtctaacagaggagaagacatatgacagctggcaacctggcggcagcgcaaaagatg

SEQ ID NO: 169347 - DNA, 103 bp, Artificial Sequence
  Synthetic Polynucleotide
taatacgactcactatagggcagctgcagcttcacatcttcagccagctgaacagaggagacagctgatggaagatgtgaacctggcggcagcgcaaaagatg

SEQ ID NO: 169348 - DNA, 103 bp, Artificial Sequence
  Synthetic Polynucleotide
taatacgactcactataggggtaacttatacagctgcagcttcacatcttaacagaggagaaagatgatgagctgcagcaacctggcggcagcgcaaaagatg

SEQ ID NO: 169349 - DNA, 103 bp, Artificial Sequence
  Synthetic Polynucleotide
taatacgactcactatagggggaatttctagtaacttatacagctgcagcaacagaggagagctgcaatggtataagttaacctggcggcagcgcaaaagatg

SEQ ID NO: 169350 - DNA, 103 bp, Artificial Sequence
  Synthetic Polynucleotide
taatacgactcactataggggtctggatcaggaatttctagtaacttataaacagaggagatataagatgctagaaattaacctggcggcagcgcaaaagatg

SEQ ID NO: 169351 - DNA, 103 bp, Artificial Sequence
  Synthetic Polynucleotide
taatacgactcactatagggcccagtttttgtctggatcaggaatttctaaacagaggagatagaaaatgctgatccagaacctggcggcagcgcaaaagatg

SEQ ID NO: 169352 - DNA, 103 bp, Artificial Sequence
  Synthetic Polynucleotide
taatacgactcactataggggccagagtagcccagtttttgtctggatcaaacagaggagatgatccatgcaaaaactgaacctggcggcagcgcaaaagatg

SEQ ID NO: 169353 - DNA, 103 bp, Artificial Sequence
  Synthetic Polynucleotide
taatacgactcactatagggatagttgcagattttgacctgagggtaagaaacagaggagatcttacatgcaggtcaaaaacctggcggcagcgcaaaagatg

SEQ ID NO: 169354 - DNA, 103 bp, Artificial Sequence
  Synthetic Polynucleotide
taatacgactcactatagggtaatttctgcgccagagtagcccagtttttaacagaggagaaaaaacatggctactctgaacctggcggcagcgcaaaagatg

SEQ ID NO: 169355 - DNA, 103 bp, Artificial Sequence
  Synthetic Polynucleotide
taatacgactcactatagggtccccagacctaatttctgcgccagagtagaacagaggagactactcatgcgcagaaataacctggcggcagcgcaaaagatg

SEQ ID NO: 169356 - DNA, 103 bp, Artificial Sequence
  Synthetic Polynucleotide
taatacgactcactatagggttattaagtatccccagacctaatttctgcaacagaggagagcagaaatgaggtctgggaacctggcggcagcgcaaaagatg

SEQ ID NO: 169357 - DNA, 103 bp, Artificial Sequence
  Synthetic Polynucleotide
taatacgactcactatagggccggaaggcattattaagtatccccagaccaacagaggagaggtctgatgatacttaataacctggcggcagcgcaaaagatg

SEQ ID NO: 169358 - DNA, 103 bp, Artificial Sequence
  Synthetic Polynucleotide
taatacgactcactatagggcaggactcagccggaaggcattattaagtaaacagaggagatacttaatgatgccttccaacctggcggcagcgcaaaagatg

SEQ ID NO: 169359 - DNA, 103 bp, Artificial Sequence
  Synthetic Polynucleotide
taatacgactcactatagggttggaaggagcaggactcagccggaaggcaaacagaggagatgccttatggctgagtccaacctggcggcagcgcaaaagatg

SEQ ID NO: 169360 - DNA, 103 bp, Artificial Sequence
  Synthetic Polynucleotide
taatacgactcactatagggcataagtgttttggaaggagcaggactcagaacagaggagactgagtatggctccttccaacctggcggcagcgcaaaagatg

SEQ ID NO: 169361 - DNA, 103 bp, Artificial Sequence
  Synthetic Polynucleotide
taatacgactcactatagggcatagttgtccataagtgttttggaaggagaacagaggagactccttatgaaacacttaaacctggcggcagcgcaaaagatg

SEQ ID NO: 169362 - DNA, 103 bp, Artificial Sequence
  Synthetic Polynucleotide
taatacgactcactatagggccagagacctcatagttgtccataagtgttaacagaggagaaacactatgggacaactaaacctggcggcagcgcaaaagatg

SEQ ID NO: 169363 - DNA, 103 bp, Artificial Sequence
  Synthetic Polynucleotide
taatacgactcactataggggactgtacccccagagacctcatagttgtcaacagaggagagacaacatggaggtctctaacctggcggcagcgcaaaagatg

SEQ ID NO: 169364 - DNA, 103 bp, Artificial Sequence
  Synthetic Polynucleotide
taatacgactcactatagggctggtcccacatagttgcagattttgacctaacagaggagaaggtcaatgtctgcaactaacctggcggcagcgcaaaagatg

SEQ ID NO: 169365 - DNA, 103 bp, Artificial Sequence
  Synthetic Polynucleotide
taatacgactcactatagggccagctctctgactgtacccccagagacctaacagaggagaaggtctatgggggtacagaacctggcggcagcgcaaaagatg

SEQ ID NO: 169366 - DNA, 103 bp, Artificial Sequence
  Synthetic Polynucleotide
taatacgactcactatagggagggcctccaccagctctctgactgtacccaacagaggagagggtacatgcagagagctaacctggcggcagcgcaaaagatg

SEQ ID NO: 169367 - DNA, 103 bp, Artificial Sequence
  Synthetic Polynucleotide
taatacgactcactatagggcatttgtctcagggcctccaccagctctctaacagaggagaagagagatggtggaggccaacctggcggcagcgcaaaagatg

SEQ ID NO: 169368 - DNA, 103 bp, Artificial Sequence
  Synthetic Polynucleotide
taatacgactcactatagggcggtgtagcccatttgtctcagggcctccaaacagaggagatggaggatgtgagacaaaaacctggcggcagcgcaaaagatg

SEQ ID NO: 169369 - DNA, 103 bp, Artificial Sequence
  Synthetic Polynucleotide
taatacgactcactatagggtcaattgcttcggtgtagcccatttgtctcaacagaggagagagacaatggggctacacaacctggcggcagcgcaaaagatg

SEQ ID NO: 169370 - DNA, 103 bp, Artificial Sequence
  Synthetic Polynucleotide
taatacgactcactatagggctggatcacttcaattgcttcggtgtagccaacagaggagaggctacatggaagcaattaacctggcggcagcgcaaaagatg

SEQ ID NO: 169371 - DNA, 103 bp, Artificial Sequence
  Synthetic Polynucleotide
taatacgactcactatagggtggaggctgcctggatcacttcaattgcttaacagaggagaaagcaaatgaagtgatccaacctggcggcagcgcaaaagatg

SEQ ID NO: 169372 - DNA, 103 bp, Artificial Sequence
  Synthetic Polynucleotide
taatacgactcactatagggttcactgggctggaggctgcctggatcactaacagaggagaagtgatatgggcagcctcaacctggcggcagcgcaaaagatg

SEQ ID NO: 169373 - DNA, 103 bp, Artificial Sequence
  Synthetic Polynucleotide
taatacgactcactatagggagaggtggtcttcactgggctggaggctgcaacagaggagagcagccatgagcccagtgaacctggcggcagcgcaaaagatg

SEQ ID NO: 169374 - DNA, 103 bp, Artificial Sequence
  Synthetic Polynucleotide
taatacgactcactatagggagtgggcctgagaggtggtcttcactgggcaacagaggagagcccagatgagaccacctaacctggcggcagcgcaaaagatg

SEQ ID NO: 169375 - DNA, 103 bp, Artificial Sequence
  Synthetic Polynucleotide
taatacgactcactatagggataacctttgctggtcccacatagttgcagaacagaggagactgcaaatgtgtgggaccaacctggcggcagcgcaaaagatg

SEQ ID NO: 169376 - DNA, 103 bp, Artificial Sequence
  Synthetic Polynucleotide
taatacgactcactatagggagaggcagcgagtgggcctgagaggtggtcaacagaggagagaccacatgtcaggcccaaacctggcggcagcgcaaaagatg

SEQ ID NO: 169377 - DNA, 103 bp, Artificial Sequence
  Synthetic Polynucleotide
taatacgactcactatagggggcaggcgagagaggcagcgagtgggcctgaacagaggagacaggccatgtcgctgcctaacctggcggcagcgcaaaagatg

SEQ ID NO: 169378 - DNA, 103 bp, Artificial Sequence
  Synthetic Polynucleotide
taatacgactcactataggggccttgtggaggcaggcgagagaggcagcgaacagaggagacgctgcatgtctcgcctgaacctggcggcagcgcaaaagatg

SEQ ID NO: 169379 - DNA, 103 bp, Artificial Sequence
  Synthetic Polynucleotide
taatacgactcactatagggtctatttgctgccttgtggaggcaggcgagaacagaggagactcgccatgctccacaagaacctggcggcagcgcaaaagatg

SEQ ID NO: 169380 - DNA, 103 bp, Artificial Sequence
  Synthetic Polynucleotide
taatacgactcactatagggtcggagctcgtctatttgctgccttgtggaaacagaggagatccacaatgcagcaaataaacctggcggcagcgcaaaagatg

SEQ ID NO: 169381 - DNA, 103 bp, Artificial Sequence
  Synthetic Polynucleotide
taatacgactcactatagggtgtcactgtctcggagctcgtctatttgctaacagaggagaagcaaaatgacgagctccaacctggcggcagcgcaaaagatg

SEQ ID NO: 169382 - DNA, 103 bp, Artificial Sequence
  Synthetic Polynucleotide
taatacgactcactatagggtcgcagacactgtcactgtctcggagctcgaacagaggagacgagctatgagacagtgaaacctggcggcagcgcaaaagatg

SEQ ID NO: 169383 - DNA, 103 bp, Artificial Sequence
  Synthetic Polynucleotide
taatacgactcactatagggcacgccgctgtcgcagacactgtcactgtcaacagaggagagacagtatgagtgtctgcaacctggcggcagcgcaaaagatg

SEQ ID NO: 169384 - DNA, 103 bp, Artificial Sequence
  Synthetic Polynucleotide
taatacgactcactatagggaggatgtctccacgccgctgtcgcagacacaacagaggagagtgtctatgacagcggcgaacctggcggcagcgcaaaagatg

SEQ ID NO: 169385 - DNA, 103 bp, Artificial Sequence
  Synthetic Polynucleotide
taatacgactcactatagggagtttgcggaaggatgtctccacgccgctgaacagaggagacagcggatgggagacatcaacctggcggcagcgcaaaagatg

SEQ ID NO: 169386 - DNA, 103 bp, Artificial Sequence
  Synthetic Polynucleotide
taatacgactcactatagggcaactgaacaataacctttgctggtcccacaacagaggagagtgggaatggcaaaggttaacctggcggcagcgcaaaagatg

SEQ ID NO: 169387 - DNA, 103 bp, Artificial Sequence
  Synthetic Polynucleotide
taatacgactcactatagggggtaaagctgagtttgcggaaggatgtctcaacagaggagagagacaatgttccgcaaaaacctggcggcagcgcaaaagatg

SEQ ID NO: 169388 - DNA, 103 bp, Artificial Sequence
  Synthetic Polynucleotide
taatacgactcactatagggtcagagactcggtaaagctgagtttgcggaaacagaggagatccgcaatgtcagctttaaacctggcggcagcgcaaaagatg

SEQ ID NO: 169389 - DNA, 103 bp, Artificial Sequence
  Synthetic Polynucleotide
taatacgactcactataggggcaccactggtcagagactcggtaaagctgaacagaggagacagcttatgcgagtctctaacctggcggcagcgcaaaagatg

SEQ ID NO: 169390 - DNA, 103 bp, Artificial Sequence
  Synthetic Polynucleotide
taatacgactcactatagggtagcagtgaggcaccactggtcagagactcaacagaggagagagtctatgaccagtggtaacctggcggcagcgcaaaagatg

SEQ ID NO: 169391 - DNA, 103 bp, Artificial Sequence
  Synthetic Polynucleotide
taatacgactcactatagggtgttgagagttagcagtgaggcaccactggaacagaggagaccagtgatgcctcactgcaacctggcggcagcgcaaaagatg

SEQ ID NO: 169392 - DNA, 103 bp, Artificial Sequence
  Synthetic Polynucleotide
taatacgactcactatagggtggggcattttgttgagagttagcagtgagaacagaggagactcactatgaactctcaaaacctggcggcagcgcaaaagatg

SEQ ID NO: 169393 - DNA, 103 bp, Artificial Sequence
  Synthetic Polynucleotide
taatacgactcactatagggcccataatcatggggcattttgttgagagtaacagaggagaactctcatgaaaatgcccaacctggcggcagcgcaaaagatg

SEQ ID NO: 169394 - DNA, 103 bp, Artificial Sequence
  Synthetic Polynucleotide
taatacgactcactataggggtccttcctgcccataatcatggggcatttaacagaggagaaaatgcatgatgattatgaacctggcggcagcgcaaaagatg

SEQ ID NO: 169395 - DNA, 103 bp, Artificial Sequence
  Synthetic Polynucleotide
taatacgactcactatagggccttctagaggtccttcctgcccataatcaaacagaggagatgattaatggcaggaaggaacctggcggcagcgcaaaagatg

SEQ ID NO: 169396 - DNA, 103 bp, Artificial Sequence
  Synthetic Polynucleotide
taatacgactcactatagggctaaattttgccttctagaggtccttcctgaacagaggagacaggaaatgcctctagaaaacctggcggcagcgcaaaagatg

SEQ ID NO: 169397 - DNA, 103 bp, Artificial Sequence
  Synthetic Polynucleotide
taatacgactcactatagggcatttgtgaccaactgaacaataacctttgaacagaggagacaaaggatgttgttcagtaacctggcggcagcgcaaaagatg

SEQ ID NO: 169398 - DNA, 103 bp, Artificial Sequence
  Synthetic Polynucleotide
taatacgactcactatagggaaatgaaacatttgttcaggccttcccaaaaacagaggagatttgggatggcctgaacaaacctggcggcagcgcaaaagatg

SEQ ID NO: 169399 - DNA, 103 bp, Artificial Sequence
  Synthetic Polynucleotide
taatacgactcactatagggatattttttccatttgtgaccaactgaacaaacagaggagatgttcaatgggtcacaaaaacctggcggcagcgcaaaagatg

SEQ ID NO: 169400 - DNA, 103 bp, Artificial Sequence
  Synthetic Polynucleotide
taatacgactcactatagggatgcaggtggatattttttccatttgtgacaacagaggagagtcacaatgggaaaaaataacctggcggcagcgcaaaagatg

SEQ ID NO: 169401 - DNA, 103 bp, Artificial Sequence
  Synthetic Polynucleotide
taatacgactcactatagggggctgtgggcatgcaggtggatattttttcaacagaggagagaaaaaatgtccacctgcaacctggcggcagcgcaaaagatg

SEQ ID NO: 169402 - DNA, 103 bp, Artificial Sequence
  Synthetic Polynucleotide
taatacgactcactatagggtttcccaccaggctgtgggcatgcaggtggaacagaggagaccacctatgtgcccacagaacctggcggcagcgcaaaagatg

SEQ ID NO: 169403 - DNA, 103 bp, Artificial Sequence
  Synthetic Polynucleotide
taatacgactcactatagggctcacagtgttttcccaccaggctgtgggcaacagaggagagcccacatgctggtgggaaacctggcggcagcgcaaaagatg

SEQ ID NO: 169404 - DNA, 103 bp, Artificial Sequence
  Synthetic Polynucleotide
taatacgactcactatagggagatcccatcctcacagtgttttcccaccaaacagaggagatggtggatgaacactgtgaacctggcggcagcgcaaaagatg

SEQ ID NO: 169405 - DNA, 103 bp, Artificial Sequence
  Synthetic Polynucleotide
taatacgactcactataggggttacagtgcagatcccatcctcacagtgtaacagaggagaacactgatgggatgggataacctggcggcagcgcaaaagatg

SEQ ID NO: 169406 - DNA, 103 bp, Artificial Sequence
  Synthetic Polynucleotide
taatacgactcactataggggggtccagcagttacagtgcagatcccatcaacagaggagagatgggatgtgcactgtaaacctggcggcagcgcaaaagatg

SEQ ID NO: 169407 - DNA, 103 bp, Artificial Sequence
  Synthetic Polynucleotide
taatacgactcactatagggccatgtccttgggtccagcagttacagtgcaacagaggagagcactgatgctgctggacaacctggcggcagcgcaaaagatg

SEQ ID NO: 169408 - DNA, 103 bp, Artificial Sequence
  Synthetic Polynucleotide
taatacgactcactatagggaagccgaccaccatgtccttgggtccagcaaacagaggagatgctggatgcaaggacataacctggcggcagcgcaaaagatg

SEQ ID NO: 169409 - DNA, 103 bp, Artificial Sequence
  Synthetic Polynucleotide
taatacgactcactatagggagaaggatccaaatgaaacatttgttcaggaacagaggagacctgaaatgatgtttcataacctggcggcagcgcaaaagatg

SEQ ID NO: 169410 - DNA, 103 bp, Artificial Sequence
  Synthetic Polynucleotide
taatacgactcactatagggcaggtttgcgaagccgaccaccatgtccttaacagaggagaaaggacatggtggtcggcaacctggcggcagcgcaaaagatg

SEQ ID NO: 169411 - DNA, 103 bp, Artificial Sequence
  Synthetic Polynucleotide
taatacgactcactataggggaagtatacccaggtttgcgaagccgaccaaacagaggagatggtcgatgtcgcaaaccaacctggcggcagcgcaaaagatg

SEQ ID NO: 169412 - DNA, 103 bp, Artificial Sequence
  Synthetic Polynucleotide
taatacgactcactatagggtttgtcacatgaagtatacccaggtttgcgaacagaggagacgcaaaatggggtatactaacctggcggcagcgcaaaagatg

SEQ ID NO: 169413 - DNA, 103 bp, Artificial Sequence
  Synthetic Polynucleotide
taatacgactcactatagggtacttttttctttgtcacatgaagtataccaacagaggagaggtataatgcatgtgacaaacctggcggcagcgcaaaagatg

SEQ ID NO: 169414 - DNA, 103 bp, Artificial Sequence
  Synthetic Polynucleotide
taatacgactcactataggggtgtttcaaatacttttttctttgtcacataacagaggagaatgtgaatgagaaaaaagaacctggcggcagcgcaaaagatg

SEQ ID NO: 169415 - DNA, 103 bp, Artificial Sequence
  Synthetic Polynucleotide
taatacgactcactatagggcgtgcttccagtgtttcaaatacttttttcaacagaggagagaaaaaatgatttgaaacaacctggcggcagcgcaaaagatg

SEQ ID NO: 169416 - DNA, 103 bp, Artificial Sequence
  Synthetic Polynucleotide
taatacgactcactatagggctctgtcattcgtgcttccagtgtttcaaaaacagaggagatttgaaatgctggaagcaaacctggcggcagcgcaaaagatg

SEQ ID NO: 169417 - DNA, 103 bp, Artificial Sequence
  Synthetic Polynucleotide
taatacgactcactatagggttatacacgcctctgtcattcgtgcttccaaacagaggagatggaagatggaatgacagaacctggcggcagcgcaaaagatg

SEQ ID NO: 169418 - DNA, 103 bp, Artificial Sequence
  Synthetic Polynucleotide
taatacgactcactatagggttatagccccttatacacgcctctgtcattaacagaggagaaatgacatgggcgtgtataacctggcggcagcgcaaaagatg

SEQ ID NO: 169419 - DNA, 103 bp, Artificial Sequence
  Synthetic Polynucleotide
taatacgactcactataggggagtccaggattatagccccttatacacgcaacagaggagagcgtgtatgaggggctataacctggcggcagcgcaaaagatg

SEQ ID NO: 169420 - DNA, 103 bp, Artificial Sequence
  Synthetic Polynucleotide
taatacgactcactatagggtatgagtcaaagaaggatccaaatgaaacaaacagaggagatgtttcatgtggatccttaacctggcggcagcgcaaaagatg

SEQ ID NO: 169421 - DNA, 103 bp, Artificial Sequence
  Synthetic Polynucleotide
taatacgactcactatagggggtgcaccaagagtccaggattatagccccaacagaggagaggggctatgatcctggacaacctggcggcagcgcaaaagatg

SEQ ID NO: 169422 - DNA, 103 bp, Artificial Sequence
  Synthetic Polynucleotide
taatacgactcactataggggcaaggtcagggtgcaccaagagtccaggaaacagaggagatcctggatgcttggtgcaaacctggcggcagcgcaaaagatg

SEQ ID NO: 169423 - DNA, 103 bp, Artificial Sequence
  Synthetic Polynucleotide
taatacgactcactatagggttgcaaataggcaaggtcagggtgcaccaaaacagaggagattggtgatgcctgaccttaacctggcggcagcgcaaaagatg

SEQ ID NO: 169424 - DNA, 103 bp, Artificial Sequence
  Synthetic Polynucleotide
taatacgactcactatagggcaccttctgcttgcaaataggcaaggtcagaacagaggagactgaccatgcctatttgcaacctggcggcagcgcaaaagatg

SEQ ID NO: 169425 - DNA, 103 bp, Artificial Sequence
  Synthetic Polynucleotide
taatacgactcactatagggcggtcccctccaccttctgcttgcaaatagaacagaggagactatttatgagcagaaggaacctggcggcagcgcaaaagatg

SEQ ID NO: 169426 - DNA, 103 bp, Artificial Sequence
  Synthetic Polynucleotide
taatacgactcactatagggtcccagctgccggtcccctccaccttctgcaacagaggagagcagaaatgggaggggacaacctggcggcagcgcaaaagatg

SEQ ID NO: 169427 - DNA, 103 bp, Artificial Sequence
  Synthetic Polynucleotide
taatacgactcactatagggtttcccgatctcccagctgccggtcccctcaacagaggagagaggggatgggcagctggaacctggcggcagcgcaaaagatg

SEQ ID NO: 169428 - DNA, 103 bp, Artificial Sequence
  Synthetic Polynucleotide
taatacgactcactatagggattagctctttttcccgatctcccagctgcaacagaggagagcagctatgagatcgggaaacctggcggcagcgcaaaagatg

SEQ ID NO: 169429 - DNA, 103 bp, Artificial Sequence
  Synthetic Polynucleotide
taatacgactcactatagggtgcttggcggattagctctttttcccgatcaacagaggagagatcggatgaaagagctaaacctggcggcagcgcaaaagatg

SEQ ID NO: 169430 - DNA, 103 bp, Artificial Sequence
  Synthetic Polynucleotide
taatacgactcactataggggctgcagagctgcttggcggattagctcttaacagaggagaaagagcatgtccgccaagaacctggcggcagcgcaaaagatg

SEQ ID NO: 169431 - DNA, 103 bp, Artificial Sequence
  Synthetic Polynucleotide
taatacgactcactatagggttaaatattgtatgagtcaaagaaggatccaacagaggagaggatccatgtttgactcaaacctggcggcagcgcaaaagatg

SEQ ID NO: 169432 - DNA, 103 bp, Artificial Sequence
  Synthetic Polynucleotide
taatacgactcactatagggtccttggtctgctgcagagctgcttggcggaacagaggagaccgccaatgagctctgcaaacctggcggcagcgcaaaagatg

SEQ ID NO: 169433 - DNA, 103 bp, Artificial Sequence
  Synthetic Polynucleotide
taatacgactcactataggggaggtccatctccttggtctgctgcagagcaacagaggagagctctgatgcagaccaagaacctggcggcagcgcaaaagatg

SEQ ID NO: 169434 - DNA, 103 bp, Artificial Sequence
  Synthetic Polynucleotide
taatacgactcactataggggcaccacgctgaggtccatctccttggtctaacagaggagaagaccaatgagatggaccaacctggcggcagcgcaaaagatg

SEQ ID NO: 169435 - DNA, 103 bp, Artificial Sequence
  Synthetic Polynucleotide
taatacgactcactatagggaacatgagccgcaccacgctgaggtccatcaacagaggagagatggaatgcagcgtggtaacctggcggcagcgcaaaagatg

SEQ ID NO: 169436 - DNA, 103 bp, Artificial Sequence
  Synthetic Polynucleotide
taatacgactcactatagggaaaagctgtaaacatgagccgcaccacgctaacagaggagaagcgtgatgcggctcatgaacctggcggcagcgcaaaagatg

SEQ ID NO: 169437 - DNA, 103 bp, Artificial Sequence
  Synthetic Polynucleotide
taatacgactcactatagggtatccggaagaaaagctgtaaacatgagccaacagaggagaggctcaatgttacagcttaacctggcggcagcgcaaaagatg

SEQ ID NO: 169438 - DNA, 103 bp, Artificial Sequence
  Synthetic Polynucleotide
taatacgactcactatagggctgccagtgctatccggaagaaaagctgtaaacagaggagatacagcatgtcttccggaaacctggcggcagcgcaaaagatg

SEQ ID NO: 169439 - DNA, 103 bp, Artificial Sequence
  Synthetic Polynucleotide
taatacgactcactatagggccttgtgaagctgccagtgctatccggaagaacagaggagacttccgatgagcactggcaacctggcggcagcgcaaaagatg

SEQ ID NO: 169440 - DNA, 103 bp, Artificial Sequence
  Synthetic Polynucleotide
taatacgactcactataggggttccaggcgccttgtgaagctgccagtgcaacagaggagagcactgatggcttcacaaaacctggcggcagcgcaaaagatg

SEQ ID NO: 169441 - DNA, 103 bp, Artificial Sequence
  Synthetic Polynucleotide
taatacgactcactataggggataccacgggttccaggcgccttgtgaagaacagaggagacttcacatggcgcctggaaacctggcggcagcgcaaaagatg

SEQ ID NO: 169442 - DNA, 103 bp, Artificial Sequence
  Synthetic Polynucleotide
taatacgactcactatagggtacttctggattaaatattgtatgagtcaaaacagaggagattgactatgacaatatttaacctggcggcagcgcaaaagatg

SEQ ID NO: 169443 - DNA, 103 bp, Artificial Sequence
  Synthetic Polynucleotide
taatacgactcactataggggatggcgtctgataccacgggttccaggcgaacagaggagacgcctgatgcccgtggtaaacctggcggcagcgcaaaagatg

SEQ ID NO: 169444 - DNA, 103 bp, Artificial Sequence
  Synthetic Polynucleotide
taatacgactcactatagggtactgtcatagatggcgtctgataccacggaacagaggagaccgtggatgcagacgccaaacctggcggcagcgcaaaagatg

SEQ ID NO: 169445 - DNA, 103 bp, Artificial Sequence
  Synthetic Polynucleotide
taatacgactcactatagggttgggggctttactgtcatagatggcgtctaacagaggagaagacgcatgctatgacagaacctggcggcagcgcaaaagatg

SEQ ID NO: 169446 - DNA, 103 bp, Artificial Sequence
  Synthetic Polynucleotide
taatacgactcactataggggttggatgcattgggggctttactgtcataaacagaggagatatgacatgaaagcccccaacctggcggcagcgcaaaagatg

SEQ ID NO: 169447 - DNA, 103 bp, Artificial Sequence
  Synthetic Polynucleotide
taatacgactcactatagggcaattttcaagttggatgcattgggggcttaacagaggagaaagcccatgatgcatccaaacctggcggcagcgcaaaagatg

SEQ ID NO: 169448 - DNA, 103 bp, Artificial Sequence
  Synthetic Polynucleotide
taatacgactcactatagggtccattcttacaattttcaagttggatgcaaacagaggagatgcatcatgcttgaaaataacctggcggcagcgcaaaagatg

SEQ ID NO: 169449 - DNA, 103 bp, Artificial Sequence
  Synthetic Polynucleotide
taatacgactcactatagggagctgtcctgtccattcttacaattttcaaaacagaggagattgaaaatggtaagaatgaacctggcggcagcgcaaaagatg

SEQ ID NO: 169450 - DNA, 103 bp, Artificial Sequence
  Synthetic Polynucleotide
taatacgactcactatagggtcacacatccagctgtcctgtccattcttaaacagaggagataagaaatgacaggacagaacctggcggcagcgcaaaagatg

SEQ ID NO: 169451 - DNA, 103 bp, Artificial Sequence
  Synthetic Polynucleotide
taatacgactcactatagggtcccctccagtcacacatccagctgtcctgaacagaggagacaggacatgtggatgtgtaacctggcggcagcgcaaaagatg

SEQ ID NO: 169452 - DNA, 103 bp, Artificial Sequence
  Synthetic Polynucleotide
taatacgactcactatagggataaatttcctcccctccagtcacacatccaacagaggagaggatgtatgactggagggaacctggcggcagcgcaaaagatg

SEQ ID NO: 169453 - DNA, 103 bp, Artificial Sequence
  Synthetic Polynucleotide
taatacgactcactataggggtggttgaaatacttctggattaaatattgaacagaggagacaatatatgatccagaagaacctggcggcagcgcaaaagatg

SEQ ID NO: 169454 - DNA, 103 bp, Artificial Sequence
  Synthetic Polynucleotide
taatacgactcactatagggcacaaagaagataaatttcctcccctccagaacagaggagactggagatgaggaaatttaacctggcggcagcgcaaaagatg

SEQ ID NO: 169455 - DNA, 103 bp, Artificial Sequence
  Synthetic Polynucleotide
taatacgactcactatagggtgaactttgtcacaaagaagataaatttccaacagaggagaggaaatatgtcttctttgaacctggcggcagcgcaaaagatg

SEQ ID NO: 169456 - DNA, 103 bp, Artificial Sequence
  Synthetic Polynucleotide
taatacgactcactataggggtcatctttctgaactttgtcacaaagaagaacagaggagacttcttatggacaaagttaacctggcggcagcgcaaaagatg

SEQ ID NO: 169457 - DNA, 103 bp, Artificial Sequence
  Synthetic Polynucleotide
taatacgactcactataggggaatctggatgtcatctttctgaactttgtaacagaggagaacaaagatgagaaagatgaacctggcggcagcgcaaaagatg

SEQ ID NO: 169458 - DNA, 103 bp, Artificial Sequence
  Synthetic Polynucleotide
taatacgactcactatagggtcataaaatcgaatctggatgtcatctttcaacagaggagagaaagaatgcatccagataacctggcggcagcgcaaaagatg

SEQ ID NO: 169459 - DNA, 103 bp, Artificial Sequence
  Synthetic Polynucleotide
taatacgactcactatagggttcttcctcttcataaaatcgaatctggataacagaggagaatccagatgcgattttataacctggcggcagcgcaaaagatg

SEQ ID NO: 169460 - DNA, 103 bp, Artificial Sequence
  Synthetic Polynucleotide
taatacgactcactatagggctccaccattttcttcctcttcataaaatcaacagaggagagattttatgaagaggaagaacctggcggcagcgcaaaagatg

SEQ ID NO: 169461 - DNA, 103 bp, Artificial Sequence
  Synthetic Polynucleotide
taatacgactcactatagggccttcccagactccaccattttcttcctctaacagaggagaagaggaatgaaatggtggaacctggcggcagcgcaaaagatg

SEQ ID NO: 169462 - DNA, 103 bp, Artificial Sequence
  Synthetic Polynucleotide
taatacgactcactatagggatctccaaatccttcccagactccaccattaacagaggagaaatggtatggtctgggaaaacctggcggcagcgcaaaagatg

SEQ ID NO: 169463 - DNA, 103 bp, Artificial Sequence
  Synthetic Polynucleotide
taatacgactcactatagggtgggggaaaaatctccaaatccttcccagaaacagaggagatctgggatggatttggagaacctggcggcagcgcaaaagatg

SEQ ID NO: 169464 - DNA, 103 bp, Artificial Sequence
  Synthetic Polynucleotide
taatacgactcactatagggagtgccatctgtggttgaaatacttctggaaacagaggagatccagaatgatttcaaccaacctggcggcagcgcaaaagatg

SEQ ID NO: 169465 - DNA, 103 bp, Artificial Sequence
  Synthetic Polynucleotide
taatacgactcactatagggtgaacatctgtgggggaaaaatctccaaataacagaggagaatttggatgtttttccccaacctggcggcagcgcaaaagatg

SEQ ID NO: 169466 - DNA, 103 bp, Artificial Sequence
  Synthetic Polynucleotide
taatacgactcactatagggaaattgtctatgaacatctgtgggggaaaaaacagaggagattttccatgacagatgttaacctggcggcagcgcaaaagatg

SEQ ID NO: 169467 - DNA, 103 bp, Artificial Sequence
  Synthetic Polynucleotide
taatacgactcactatagggagacaatggcaaattgtctatgaacatctgaacagaggagacagatgatgatagacaataacctggcggcagcgcaaaagatg

SEQ ID NO: 169468 - DNA, 103 bp, Artificial Sequence
  Synthetic Polynucleotide
taatacgactcactatagggggagttttgaagacaatggcaaattgtctaaacagaggagatagacaatgtgccattgtaacctggcggcagcgcaaaagatg

SEQ ID NO: 169469 - DNA, 103 bp, Artificial Sequence
  Synthetic Polynucleotide
taatacgactcactatagggtttatactttggagttttgaagacaatggcaacagaggagagccattatgttcaaaactaacctggcggcagcgcaaaagatg

SEQ ID NO: 169470 - DNA, 103 bp, Artificial Sequence
  Synthetic Polynucleotide
taatacgactcactatagggtattaatatctttatactttggagttttgaaacagaggagatcaaaaatgcaaagtataaacctggcggcagcgcaaaagatg

SEQ ID NO: 169471 - DNA, 103 bp, Artificial Sequence
  Synthetic Polynucleotide
taatacgactcactatagggggttttgtaatattaatatctttatactttaacagaggagaaaagtaatgagatattaaaacctggcggcagcgcaaaagatg

SEQ ID NO: 169472 - DNA, 103 bp, Artificial Sequence
  Synthetic Polynucleotide
taatacgactcactatagggcacagaggctggttttgtaatattaatatcaacagaggagagatattatgattacaaaaaacctggcggcagcgcaaaagatg

SEQ ID NO: 169473 - DNA, 103 bp, Artificial Sequence
  Synthetic Polynucleotide
taatacgactcactataggggctggacaaacacagaggctggttttgtaaaacagaggagattacaaatgcagcctctgaacctggcggcagcgcaaaagatg

SEQ ID NO: 169474 - DNA, 103 bp, Artificial Sequence
  Synthetic Polynucleotide
taatacgactcactatagggttcctccgaagctggacaaacacagaggctaacagaggagaagcctcatggtttgtccaaacctggcggcagcgcaaaagatg

SEQ ID NO: 169475 - DNA, 103 bp, Artificial Sequence
  Synthetic Polynucleotide
taatacgactcactatagggatccagacctgggttgtagcaactctccataacagaggagaatggagatgtgctacaacaacctggcggcagcgcaaaagatg

SEQ ID NO: 169476 - DNA, 103 bp, Artificial Sequence
  Synthetic Polynucleotide
taatacgactcactatagggcaggtaggggccatcagctgtttctggggcaacagaggagagccccaatgacagctgataacctggcggcagcgcaaaagatg

SEQ ID NO: 169477 - DNA, 103 bp, Artificial Sequence
  Synthetic Polynucleotide
taatacgactcactatagggcctccgcttccgctgcacctcttccttgtcaacagaggagagacaagatggaggtgcagaacctggcggcagcgcaaaagatg

SEQ ID NO: 169478 - DNA, 103 bp, Artificial Sequence
  Synthetic Polynucleotide
taatacgactcactataggggcaaggccttcctccgcttccgctgcacctaacagaggagaaggtgcatgggaagcggaaacctggcggcagcgcaaaagatg

SEQ ID NO: 169479 - DNA, 103 bp, Artificial Sequence
  Synthetic Polynucleotide
taatacgactcactataggggagaaggtgggcaaggccttcctccgcttcaacagaggagagaagcgatggaaggccttaacctggcggcagcgcaaaagatg

SEQ ID NO: 169480 - DNA, 103 bp, Artificial Sequence
  Synthetic Polynucleotide
taatacgactcactataggggaagggctgggagaaggtgggcaaggccttaacagaggagaaaggccatgcccaccttcaacctggcggcagcgcaaaagatg

SEQ ID NO: 169481 - DNA, 103 bp, Artificial Sequence
  Synthetic Polynucleotide
taatacgactcactatagggagccacccccgaagggctgggagaaggtggaacagaggagaccacctatgcccagccctaacctggcggcagcgcaaaagatg

SEQ ID NO: 169482 - DNA, 103 bp, Artificial Sequence
  Synthetic Polynucleotide
taatacgactcactatagggcccatgtgggagccacccccgaagggctggaacagaggagaccagccatgcgggggtggaacctggcggcagcgcaaaagatg

SEQ ID NO: 169483 - DNA, 103 bp, Artificial Sequence
  Synthetic Polynucleotide
taatacgactcactatagggagagcctccacccatgtgggagccacccccaacagaggagagggggtatgtcccacatgaacctggcggcagcgcaaaagatg

SEQ ID NO: 169484 - DNA, 103 bp, Artificial Sequence
  Synthetic Polynucleotide
taatacgactcactatagggctgcacccccagagcctccacccatgtgggaacagaggagacccacaatggtggaggctaacctggcggcagcgcaaaagatg

SEQ ID NO: 169485 - DNA, 103 bp, Artificial Sequence
  Synthetic Polynucleotide
taatacgactcactatagggtagcccccggctgcacccccagagcctccaaacagaggagatggaggatgtgggggtgcaacctggcggcagcgcaaaagatg

SEQ ID NO: 169486 - DNA, 103 bp, Artificial Sequence
  Synthetic Polynucleotide
taatacgactcactatagggagctcctccgtagcccccggctgcacccccaacagaggagagggggtatggccgggggcaacctggcggcagcgcaaaagatg

SEQ ID NO: 169487 - DNA, 103 bp, Artificial Sequence
  Synthetic Polynucleotide
taatacgactcactatagggccacgatcaccaggtaggggccatcagctgaacagaggagacagctgatggcccctaccaacctggcggcagcgcaaaagatg

SEQ ID NO: 169488 - DNA, 103 bp, Artificial Sequence
  Synthetic Polynucleotide
taatacgactcactatagggcacctcctccagctcctccgtagcccccggaacagaggagaccggggatgacggaggagaacctggcggcagcgcaaaagatg

SEQ ID NO: 169489 - DNA, 103 bp, Artificial Sequence
  Synthetic Polynucleotide
taatacgactcactatagggccgaggctgccacctcctccagctcctccgaacagaggagacggaggatgtggaggaggaacctggcggcagcgcaaaagatg

SEQ ID NO: 169490 - DNA, 103 bp, Artificial Sequence
  Synthetic Polynucleotide
taatacgactcactatagggggggaagaaaccgaggctgccacctcctccaacagaggagaggaggaatgggcagcctcaacctggcggcagcgcaaaagatg

SEQ ID NO: 169491 - DNA, 103 bp, Artificial Sequence
  Synthetic Polynucleotide
taatacgactcactatagggccagggaggaggggaagaaaccgaggctgcaacagaggagagcagccatggtttcttccaacctggcggcagcgcaaaagatg

SEQ ID NO: 169492 - DNA, 103 bp, Artificial Sequence
  Synthetic Polynucleotide
taatacgactcactataggggggctgtaggccagggaggaggggaagaaaaacagaggagatttcttatgctcctccctaacctggcggcagcgcaaaagatg

SEQ ID NO: 169493 - DNA, 103 bp, Artificial Sequence
  Synthetic Polynucleotide
taatacgactcactatagggggactggtaggggctgtaggccagggaggaaacagaggagatcctccatggcctacagcaacctggcggcagcgcaaaagatg

SEQ ID NO: 169494 - DNA, 103 bp, Artificial Sequence
  Synthetic Polynucleotide
taatacgactcactatagggggcccgcgccggactggtaggggctgtaggaacagaggagacctacaatgcctaccagtaacctggcggcagcgcaaaagatg

SEQ ID NO: 169495 - DNA, 103 bp, Artificial Sequence
  Synthetic Polynucleotide
taatacgactcactatagggcagcccatggggcccgcgccggactggtagaacagaggagactaccaatgcggcgcgggaacctggcggcagcgcaaaagatg

SEQ ID NO: 169496 - DNA, 103 bp, Artificial Sequence
  Synthetic Polynucleotide
taatacgactcactatagggtcccgggtagcagcccatggggcccgcgccaacagaggagaggcgcgatgcccatgggcaacctggcggcagcgcaaaagatg

SEQ ID NO: 169497 - DNA, 103 bp, Artificial Sequence
  Synthetic Polynucleotide
taatacgactcactatagggcgcccccgcctcccgggtagcagcccatggaacagaggagaccatggatggctacccggaacctggcggcagcgcaaaagatg

SEQ ID NO: 169498 - DNA, 103 bp, Artificial Sequence
  Synthetic Polynucleotide
taatacgactcactatagggttaggctgttccacgatcaccaggtaggggaacagaggagacccctaatgggtgatcgtaacctggcggcagcgcaaaagatg

SEQ ID NO: 169499 - DNA, 103 bp, Artificial Sequence
  Synthetic Polynucleotide
taatacgactcactatagggatctgcgccccgcccccgcctcccgggtagaacagaggagactacccatgaggcgggggaacctggcggcagcgcaaaagatg

SEQ ID NO: 169500 - DNA, 103 bp, Artificial Sequence
  Synthetic Polynucleotide
taatacgactcactatagggcgtggcggccatctgcgccccgcccccgccaacagaggagaggcgggatgggggcgcagaacctggcggcagcgcaaaagatg

SEQ ID NO: 169501 - DNA, 103 bp, Artificial Sequence
  Synthetic Polynucleotide
taatacgactcactatagggtgctgggcaccgtggcggccatctgcgcccaacagaggagagggcgcatgtggccgccaaacctggcggcagcgcaaaagatg

SEQ ID NO: 169502 - DNA, 103 bp, Artificial Sequence
  Synthetic Polynucleotide
taatacgactcactatagggccggagtccctgctgggcaccgtggcggccaacagaggagaggccgcatgggtgcccagaacctggcggcagcgcaaaagatg

SEQ ID NO: 169503 - DNA, 103 bp, Artificial Sequence
  Synthetic Polynucleotide
taatacgactcactatagggggcttcctccccggagtccctgctgggcacaacagaggagagtgcccatgagggactccaacctggcggcagcgcaaaagatg

SEQ ID NO: 169504 - DNA, 103 bp, Artificial Sequence
  Synthetic Polynucleotide
taatacgactcactatagggttggctccgcggcttcctccccggagtcccaacagaggagagggactatggggaggaagaacctggcggcagcgcaaaagatg

SEQ ID NO: 169505 - DNA, 103 bp, Artificial Sequence
  Synthetic Polynucleotide
taatacgactcactataggggagggggcgcttggctccgcggcttcctccaacagaggagaggaggaatgcgcggagccaacctggcggcagcgcaaaagatg

SEQ ID NO: 169506 - DNA, 103 bp, Artificial Sequence
  Synthetic Polynucleotide
taatacgactcactataggggggggtcctggagggggcgcttggctccgcaacagaggagagcggagatgagcgcccccaacctggcggcagcgcaaaagatg

SEQ ID NO: 169507 - DNA, 103 bp, Artificial Sequence
  Synthetic Polynucleotide
taatacgactcactataggggctcgcactggggggtcctggagggggcgcaacagaggagagcgcccatgccaggacccaacctggcggcagcgcaaaagatg

SEQ ID NO: 169508 - DNA, 103 bp, Artificial Sequence
  Synthetic Polynucleotide
taatacgactcactatagggggggcctgcggctcgcactggggggtcctgaacagaggagacaggacatgccagtgcgaaacctggcggcagcgcaaaagatg

SEQ ID NO: 169509 - DNA, 103 bp, Artificial Sequence
  Synthetic Polynucleotide
taatacgactcactataggggcctctctgcttaggctgttccacgatcacaacagaggagagtgatcatggaacagcctaacctggcggcagcgcaaaagatg

SEQ ID NO: 169510 - DNA, 103 bp, Artificial Sequence
  Synthetic Polynucleotide
taatacgactcactatagggcagcatctccggggcctgcggctcgcactgaacagaggagacagtgcatgccgcaggccaacctggcggcagcgcaaaagatg

SEQ ID NO: 169511 - DNA, 103 bp, Artificial Sequence
  Synthetic Polynucleotide
taatacgactcactataggggagctcgctgcagcatctccggggcctgcgaacagaggagacgcaggatgcggagatgcaacctggcggcagcgcaaaagatg

SEQ ID NO: 169512 - DNA, 103 bp, Artificial Sequence
  Synthetic Polynucleotide
taatacgactcactatagggttgtactctcgagctcgctgcagcatctccaacagaggagaggagatatggcagcgagcaacctggcggcagcgcaaaagatg

SEQ ID NO: 169513 - DNA, 103 bp, Artificial Sequence
  Synthetic Polynucleotide
taatacgactcactatagggcaggcgcgcgttgtactctcgagctcgctgaacagaggagacagcgaatgcgagagtacaacctggcggcagcgcaaaagatg

SEQ ID NO: 169514 - DNA, 103 bp, Artificial Sequence
  Synthetic Polynucleotide
taatacgactcactatagggccaggccgaacaggcgcgcgttgtactctcaacagaggagagagagtatgacgcgcgccaacctggcggcagcgcaaaagatg

SEQ ID NO: 169515 - DNA, 103 bp, Artificial Sequence
  Synthetic Polynucleotide
taatacgactcactatagggctgcgctgcgccaggccgaacaggcgcgcgaacagaggagacgcgcgatggttcggcctaacctggcggcagcgcaaaagatg

SEQ ID NO: 169516 - DNA, 103 bp, Artificial Sequence
  Synthetic Polynucleotide
taatacgactcactatagggggctcgggcgctgcgctgcgccaggccgaaaacagaggagattcggcatggcgcagcgcaacctggcggcagcgcaaaagatg

SEQ ID NO: 169517 - DNA, 103 bp, Artificial Sequence
  Synthetic Polynucleotide
taatacgactcactatagggagtcgagtagggctcgggcgctgcgctgcgaacagaggagacgcagcatggcgcccgagaacctggcggcagcgcaaaagatg

SEQ ID NO: 169518 - DNA, 103 bp, Artificial Sequence
  Synthetic Polynucleotide
taatacgactcactataggggtgacgccgtagtcgagtagggctcgggcgaacagaggagacgcccgatgcctactcgaaacctggcggcagcgcaaaagatg

SEQ ID NO: 169519 - DNA, 103 bp, Artificial Sequence
  Synthetic Polynucleotide
taatacgactcactatagggcgcgtccgcggtgacgccgtagtcgagtagaacagaggagactactcatgtacggcgtcaacctggcggcagcgcaaaagatg

SEQ ID NO: 169520 - DNA, 103 bp, Artificial Sequence
  Synthetic Polynucleotide
taatacgactcactataggggaaatcggaagcctctctgcttaggctgttaacagaggagaaacagcatgagcagagagaacctggcggcagcgcaaaagatg

SEQ ID NO: 169521 - DNA, 103 bp, Artificial Sequence
  Synthetic Polynucleotide
taatacgactcactataggggcagcgcgcgcgcgtccgcggtgacgccgtaacagaggagaacggcgatgccgcggacgaacctggcggcagcgcaaaagatg

SEQ ID NO: 169522 - DNA, 103 bp, Artificial Sequence
  Synthetic Polynucleotide
taatacgactcactatagggtgtcccgccagcagcgcgcgcgcgtccgcgaacagaggagacgcggaatggcgcgcgctaacctggcggcagcgcaaaagatg

SEQ ID NO: 169523 - DNA, 103 bp, Artificial Sequence
  Synthetic Polynucleotide
taatacgactcactatagggcaggtggcgctgtcccgccagcagcgcgcgaacagaggagacgcgcgatgctggcgggaaacctggcggcagcgcaaaagatg

SEQ ID NO: 169524 - DNA, 103 bp, Artificial Sequence
  Synthetic Polynucleotide
taatacgactcactataggggcgccgtcagcaggtggcgctgtcccgccaaacagaggagatggcggatgagcgccaccaacctggcggcagcgcaaaagatg

SEQ ID NO: 169525 - DNA, 103 bp, Artificial Sequence
  Synthetic Polynucleotide
taatacgactcactatagggttctcgtcctgcgccgtcagcaggtggcgcaacagaggagagcgccaatggctgacggcaacctggcggcagcgcaaaagatg

SEQ ID NO: 169526 - DNA, 103 bp, Artificial Sequence
  Synthetic Polynucleotide
taatacgactcactatagggtgtgtctccgttctcgtcctgcgccgtcagaacagaggagactgacgatgcaggacgagaacctggcggcagcgcaaaagatg

SEQ ID NO: 169527 - DNA, 103 bp, Artificial Sequence
  Synthetic Polynucleotide
taatacgactcactatagggggtgcagtggtgtgtctccgttctcgtcctaacagaggagaaggacgatgacggagacaaacctggcggcagcgcaaaagatg

SEQ ID NO: 169528 - DNA, 103 bp, Artificial Sequence
  Synthetic Polynucleotide
taatacgactcactatagggatgatggctaggtgcagtggtgtgtctccgaacagaggagacggagaatgaccactgcaaacctggcggcagcgcaaaagatg

SEQ ID NO: 169529 - DNA, 103 bp, Artificial Sequence
  Synthetic Polynucleotide
taatacgactcactatagggctgcccgtggatgatggctaggtgcagtggaacagaggagaccactgatgctagccatcaacctggcggcagcgcaaaagatg

SEQ ID NO: 169530 - DNA, 103 bp, Artificial Sequence
  Synthetic Polynucleotide
taatacgactcactatagggtgacactggtctgcccgtggatgatggctaaacagaggagatagccaatgtccacgggcaacctggcggcagcgcaaaagatg

SEQ ID NO: 169531 - DNA, 103 bp, Artificial Sequence
  Synthetic Polynucleotide
taatacgactcactatagggcagccatatcgaaatcggaagcctctctgcaacagaggagagcagagatgcttccgattaacctggcggcagcgcaaaagatg

SEQ ID NO: 169532 - DNA, 103 bp, Artificial Sequence
  Synthetic Polynucleotide
taatacgactcactatagggatctgctcaatgacactggtctgcccgtggaacagaggagaccacggatggaccagtgtaacctggcggcagcgcaaaagatg

SEQ ID NO: 169533 - DNA, 103 bp, Artificial Sequence
  Synthetic Polynucleotide
taatacgactcactataggggacatagactatctgctcaatgacactggtaacagaggagaaccagtatgattgagcagaacctggcggcagcgcaaaagatg

SEQ ID NO: 169534 - DNA, 103 bp, Artificial Sequence
  Synthetic Polynucleotide
taatacgactcactatagggcgtggtggatgacatagactatctgctcaaaacagaggagattgagcatgtagtctatgaacctggcggcagcgcaaaagatg

SEQ ID NO: 169535 - DNA, 103 bp, Artificial Sequence
  Synthetic Polynucleotide
taatacgactcactatagggaggtcctgggcgtggtggatgacatagactaacagaggagaagtctaatgcatccaccaaacctggcggcagcgcaaaagatg

SEQ ID NO: 169536 - DNA, 103 bp, Artificial Sequence
  Synthetic Polynucleotide
taatacgactcactataggggacaacgccgaggtcctgggcgtggtggataacagaggagaatccacatggcccaggacaacctggcggcagcgcaaaagatg

SEQ ID NO: 169537 - DNA, 103 bp, Artificial Sequence
  Synthetic Polynucleotide
taatacgactcactatagggtggtgaggttgacaacgccgaggtcctgggaacagaggagacccaggatgtcggcgttgaacctggcggcagcgcaaaagatg

SEQ ID NO: 169538 - DNA, 103 bp, Artificial Sequence
  Synthetic Polynucleotide
taatacgactcactatagggtgcaggtggttggtgaggttgacaacgccgaacagaggagacggcgtatgcaacctcacaacctggcggcagcgcaaaagatg

SEQ ID NO: 169539 - DNA, 103 bp, Artificial Sequence
  Synthetic Polynucleotide
taatacgactcactataggggggcgtctggtgcaggtggttggtgaggttaacagaggagaaacctcatgaaccacctgaacctggcggcagcgcaaaagatg

SEQ ID NO: 169540 - DNA, 103 bp, Artificial Sequence
  Synthetic Polynucleotide
taatacgactcactatagggccaggtgcaggggcgtctggtgcaggtggtaacagaggagaaccaccatgaccagacgcaacctggcggcagcgcaaaagatg

SEQ ID NO: 169541 - DNA, 103 bp, Artificial Sequence
  Synthetic Polynucleotide
taatacgactcactataggggtgatcaccgccaggtgcaggggcgtctggaacagaggagaccagacatgcctgcacctaacctggcggcagcgcaaaagatg

SEQ ID NO: 169542 - DNA, 103 bp, Artificial Sequence
  Synthetic Polynucleotide
taatacgactcactatagggggggccttcacagccatatcgaaatcggaaaacagaggagattccgaatgcgatatggcaacctggcggcagcgcaaaagatg

SEQ ID NO: 169543 - DNA, 103 bp, Artificial Sequence
  Synthetic Polynucleotide
taatacgactcactatagggcgtctgccccgtgatcaccgccaggtgcagaacagaggagactgcacatggcggtgatcaacctggcggcagcgcaaaagatg

SEQ ID NO: 169544 - DNA, 103 bp, Artificial Sequence
  Synthetic Polynucleotide
taatacgactcactatagggtcaccacactcgtctgccccgtgatcaccgaacagaggagacggtgaatgcggggcagaaacctggcggcagcgcaaaagatg

SEQ ID NO: 169545 - DNA, 103 bp, Artificial Sequence
  Synthetic Polynucleotide
taatacgactcactatagggagcagaaagctcaccacactcgtctgccccaacagaggagaggggcaatggagtgtggtaacctggcggcagcgcaaaagatg

SEQ ID NO: 169546 - DNA, 103 bp, Artificial Sequence
  Synthetic Polynucleotide
taatacgactcactatagggacctacccgcagcagaaagctcaccacactaacagaggagaagtgtgatgagctttctgaacctggcggcagcgcaaaagatg

SEQ ID NO: 169547 - DNA, 103 bp, Artificial Sequence
  Synthetic Polynucleotide
taatacgactcactatagggctgggtctgcacctacccgcagcagaaagcaacagaggagagctttcatgtgcgggtagaacctggcggcagcgcaaaagatg

SEQ ID NO: 169548 - DNA, 103 bp, Artificial Sequence
  Synthetic Polynucleotide
taatacgactcactatagggtccagcagagctgggtctgcacctacccgcaacagaggagagcgggtatgtgcagacccaacctggcggcagcgcaaaagatg

SEQ ID NO: 169549 - DNA, 103 bp, Artificial Sequence
  Synthetic Polynucleotide
taatacgactcactatagggtccatgccgatccagcagagctgggtctgcaacagaggagagcagacatggctctgctgaacctggcggcagcgcaaaagatg

SEQ ID NO: 169550 - DNA, 103 bp, Artificial Sequence
  Synthetic Polynucleotide
taatacgactcactatagggtggctgagtctccatgccgatccagcagagaacagaggagactctgcatgatcggcatgaacctggcggcagcgcaaaagatg

SEQ ID NO: 169551 - DNA, 103 bp, Artificial Sequence
  Synthetic Polynucleotide
taatacgactcactataggggccagatgcatggctgagtctccatgccgaaacagaggagatcggcaatgagactcagcaacctggcggcagcgcaaaagatg

SEQ ID NO: 169552 - DNA, 103 bp, Artificial Sequence
  Synthetic Polynucleotide
taatacgactcactatagggtgcccgcagcgccagatgcatggctgagtcaacagaggagagactcaatgatgcatctgaacctggcggcagcgcaaaagatg

SEQ ID NO: 169553 - DNA, 103 bp, Artificial Sequence
  Synthetic Polynucleotide
taatacgactcactatagggctccatgggaggggccttcacagccatatcaacagaggagagatatgatggtgaaggccaacctggcggcagcgcaaaagatg

SEQ ID NO: 169554 - DNA, 103 bp, Artificial Sequence
  Synthetic Polynucleotide
taatacgactcactatagggcaccagcgcctgcccgcagcgccagatgcaaacagaggagatgcatcatgcgctgcgggaacctggcggcagcgcaaaagatg

SEQ ID NO: 169555 - DNA, 103 bp, Artificial Sequence
  Synthetic Polynucleotide
taatacgactcactatagggagctcaggagcaccagcgcctgcccgcagcaacagaggagagctgcgatgaggcgctggaacctggcggcagcgcaaaagatg

SEQ ID NO: 169556 - DNA, 103 bp, Artificial Sequence
  Synthetic Polynucleotide
taatacgactcactatagggtgcacgcagcagctcaggagcaccagcgccaacagaggagaggcgctatggctcctgagaacctggcggcagcgcaaaagatg

SEQ ID NO: 169557 - DNA, 103 bp, Artificial Sequence
  Synthetic Polynucleotide
taatacgactcactatagggtctgaagcagtgcacgcagcagctcaggagaacagaggagactcctgatgtgctgcgtgaacctggcggcagcgcaaaagatg

SEQ ID NO: 169558 - DNA, 103 bp, Artificial Sequence
  Synthetic Polynucleotide
taatacgactcactatagggggagctccactctgaagcagtgcacgcagcaacagaggagagctgcgatgactgcttcaaacctggcggcagcgcaaaagatg

SEQ ID NO: 169559 - DNA, 103 bp, Artificial Sequence
  Synthetic Polynucleotide
taatacgactcactataggggggcacagcaggagctccactctgaagcagaacagaggagactgcttatgagtggagctaacctggcggcagcgcaaaagatg

SEQ ID NO: 169560 - DNA, 103 bp, Artificial Sequence
  Synthetic Polynucleotide
taatacgactcactataggggcaacagctggggcacagcaggagctccacaacagaggagagtggagatgctgctgtgcaacctggcggcagcgcaaaagatg

SEQ ID NO: 169561 - DNA, 103 bp, Artificial Sequence
  Synthetic Polynucleotide
taatacgactcactatagggtcaggcatatgcaacagctggggcacagcaaacagaggagatgctgtatgccagctgttaacctggcggcagcgcaaaagatg

SEQ ID NO: 169562 - DNA, 103 bp, Artificial Sequence
  Synthetic Polynucleotide
taatacgactcactatagggtccctcaaagtcaggcatatgcaacagctgaacagaggagacagctgatgcatatgcctaacctggcggcagcgcaaaagatg

SEQ ID NO: 169563 - DNA, 103 bp, Artificial Sequence
  Synthetic Polynucleotide
taatacgactcactatagggctggatacagtccctcaaagtcaggcatataacagaggagaatatgcatgactttgaggaacctggcggcagcgcaaaagatg

SEQ ID NO: 169564 - DNA, 103 bp, Artificial Sequence
  Synthetic Polynucleotide
taatacgactcactatagggccgggcagtcctccatgggaggggccttcaaacagaggagatgaaggatgctcccatggaacctggcggcagcgcaaaagatg

SEQ ID NO: 169565 - DNA, 103 bp, Artificial Sequence
  Synthetic Polynucleotide
taatacgactcactataggggccaggtgtactggatacagtccctcaaagaacagaggagactttgaatgactgtatccaacctggcggcagcgcaaaagatg

SEQ ID NO: 169566 - DNA, 103 bp, Artificial Sequence
  Synthetic Polynucleotide
taatacgactcactatagggggctcggactgccaggtgtactggatacagaacagaggagactgtatatggtacacctgaacctggcggcagcgcaaaagatg

SEQ ID NO: 169567 - DNA, 103 bp, Artificial Sequence
  Synthetic Polynucleotide
taatacgactcactatagggcagggcttcgggctcggactgccaggtgtaaacagaggagatacaccatgcagtccgagaacctggcggcagcgcaaaagatg

SEQ ID NO: 169568 - DNA, 103 bp, Artificial Sequence
  Synthetic Polynucleotide
taatacgactcactatagggtccaggcactcagggcttcgggctcggactaacagaggagaagtccgatgccgaagcccaacctggcggcagcgcaaaagatg

SEQ ID NO: 169569 - DNA, 103 bp, Artificial Sequence
  Synthetic Polynucleotide
taatacgactcactatagggcaccagcagatccaggcactcagggcttcgaacagaggagacgaagcatggagtgcctgaacctggcggcagcgcaaaagatg

SEQ ID NO: 169570 - DNA, 103 bp, Artificial Sequence
  Synthetic Polynucleotide
taatacgactcactatagggccccactgtccaccagcagatccaggcactaacagaggagaagtgccatgatctgctggaacctggcggcagcgcaaaagatg

SEQ ID NO: 169571 - DNA, 103 bp, Artificial Sequence
  Synthetic Polynucleotide
taatacgactcactatagggtccacttcagccccactgtccaccagcagaaacagaggagatctgctatgggacagtggaacctggcggcagcgcaaaagatg

SEQ ID NO: 169572 - DNA, 103 bp, Artificial Sequence
  Synthetic Polynucleotide
taatacgactcactatagggctctgtggcctccacttcagccccactgtcaacagaggagagacagtatggctgaagtgaacctggcggcagcgcaaaagatg

SEQ ID NO: 169573 - DNA, 103 bp, Artificial Sequence
  Synthetic Polynucleotide
taatacgactcactatagggccccctgccgctctgtggcctccacttcagaacagaggagactgaagatgaggccacagaacctggcggcagcgcaaaagatg

SEQ ID NO: 169574 - DNA, 103 bp, Artificial Sequence
  Synthetic Polynucleotide
taatacgactcactataggggctgttcgtcccccctgccgctctgtggccaacagaggagaggccacatggcggcagggaacctggcggcagcgcaaaagatg

SEQ ID NO: 169575 - DNA, 103 bp, Artificial Sequence
  Synthetic Polynucleotide
taatacgactcactatagggactggaggcaccgggcagtcctccatgggaaacagaggagatcccatatgggactgcccaacctggcggcagcgcaaaagatg

SEQ ID NO: 169576 - DNA, 103 bp, Artificial Sequence
  Synthetic Polynucleotide
taatacgactcactatagggtagatgcaaggctgttcgtcccccctgccgaacagaggagacggcagatgggacgaacaaacctggcggcagcgcaaaagatg

SEQ ID NO: 169577 - DNA, 103 bp, Artificial Sequence
  Synthetic Polynucleotide
taatacgactcactatagggtctctgtggctagatgcaaggctgttcgtcaacagaggagagacgaaatgccttgcatcaacctggcggcagcgcaaaagatg

SEQ ID NO: 169578 - DNA, 103 bp, Artificial Sequence
  Synthetic Polynucleotide
taatacgactcactatagggagctcctccatctctgtggctagatgcaagaacagaggagacttgcaatgagccacagaaacctggcggcagcgcaaaagatg

SEQ ID NO: 169579 - DNA, 103 bp, Artificial Sequence
  Synthetic Polynucleotide
taatacgactcactataggggaccaaccccagctcctccatctctgtggcaacagaggagagccacaatgatggaggagaacctggcggcagcgcaaaagatg

SEQ ID NO: 169580 - DNA, 103 bp, Artificial Sequence
  Synthetic Polynucleotide
taatacgactcactatagggccagatgggtgaccaaccccagctcctccaaacagaggagatggaggatgtggggttggaacctggcggcagcgcaaaagatg

SEQ ID NO: 169581 - DNA, 103 bp, Artificial Sequence
  Synthetic Polynucleotide
taatacgactcactatagggagcttggtgaccagatgggtgaccaaccccaacagaggagaggggttatgcacccatctaacctggcggcagcgcaaaagatg

SEQ ID NO: 169582 - DNA, 103 bp, Artificial Sequence
  Synthetic Polynucleotide
taatacgactcactataggggttggcccggagcttggtgaccagatgggtaacagaggagaacccatatggtcaccaagaacctggcggcagcgcaaaagatg

SEQ ID NO: 169583 - DNA, 103 bp, Artificial Sequence
  Synthetic Polynucleotide
taatacgactcactataggggagcgttcacgttggcccggagcttggtgaaacagaggagatcaccaatgtccgggccaaacctggcggcagcgcaaaagatg

SEQ ID NO: 169584 - DNA, 103 bp, Artificial Sequence
  Synthetic Polynucleotide
taatacgactcactataggggcaaaggtgcgagcgttcacgttggcccggaacagaggagaccgggcatgcgtgaacgcaacctggcggcagcgcaaaagatg

SEQ ID NO: 169585 - DNA, 103 bp, Artificial Sequence
  Synthetic Polynucleotide
taatacgactcactatagggtgtgtttcccgcaaaggtgcgagcgttcacaacagaggagagtgaacatgcgcacctttaacctggcggcagcgcaaaagatg

SEQ ID NO: 169586 - DNA, 103 bp, Artificial Sequence
  Synthetic Polynucleotide
taatacgactcactatagggcaataataccatccagacctgggttgtagcaacagaggagagctacaatgcaggtctggaacctggcggcagcgcaaaagatg

SEQ ID NO: 169587 - DNA, 103 bp, Artificial Sequence
  Synthetic Polynucleotide
taatacgactcactatagggggcccttctcactggaggcaccgggcagtcaacagaggagagactgcatggtgcctccaaacctggcggcagcgcaaaagatg

SEQ ID NO: 169588 - DNA, 103 bp, Artificial Sequence
  Synthetic Polynucleotide
taatacgactcactatagggggtgcaggggtgtgtttcccgcaaaggtgcaacagaggagagcacctatgcgggaaacaaacctggcggcagcgcaaaagatg

SEQ ID NO: 169589 - DNA, 103 bp, Artificial Sequence
  Synthetic Polynucleotide
taatacgactcactatagggccagctgccaggtgcaggggtgtgtttcccaacagaggagagggaaaatgacccctgcaaacctggcggcagcgcaaaagatg

SEQ ID NO: 169590 - DNA, 103 bp, Artificial Sequence
  Synthetic Polynucleotide
taatacgactcactataggggtaccccagtccagctgccaggtgcaggggaacagaggagacccctgatgctggcagctaacctggcggcagcgcaaaagatg

SEQ ID NO: 169591 - DNA, 103 bp, Artificial Sequence
  Synthetic Polynucleotide
taatacgactcactatagggtgagggtcgggtaccccagtccagctgccaaacagaggagatggcagatggactggggtaacctggcggcagcgcaaaagatg

SEQ ID NO: 169592 - DNA, 103 bp, Artificial Sequence
  Synthetic Polynucleotide
taatacgactcactatagggaggaggcgggtgagggtcgggtaccccagtaacagaggagaactgggatgcccgaccctaacctggcggcagcgcaaaagatg

SEQ ID NO: 169593 - DNA, 103 bp, Artificial Sequence
  Synthetic Polynucleotide
taatacgactcactatagggagccttcagaaggaggcgggtgagggtcggaacagaggagaccgaccatgacccgcctcaacctggcggcagcgcaaaagatg

SEQ ID NO: 169594 - DNA, 103 bp, Artificial Sequence
  Synthetic Polynucleotide
taatacgactcactatagggtgtcagcaccagccttcagaaggaggcgggaacagaggagacccgccatgttctgaaggaacctggcggcagcgcaaaagatg

SEQ ID NO: 169595 - DNA, 103 bp, Artificial Sequence
  Synthetic Polynucleotide
taatacgactcactatagggtcagcatggatgtcagcaccagccttcagaaacagaggagatctgaaatgtggtgctgaaacctggcggcagcgcaaaagatg

SEQ ID NO: 169596 - DNA, 103 bp, Artificial Sequence
  Synthetic Polynucleotide
taatacgactcactatagggctcctcgttttcagcatggatgtcagcaccaacagaggagaggtgctatgatccatgctaacctggcggcagcgcaaaagatg

SEQ ID NO: 169597 - DNA, 103 bp, Artificial Sequence
  Synthetic Polynucleotide
taatacgactcactatagggggcacaggggctcctcgttttcagcatggaaacagaggagatccatgatgaaaacgaggaacctggcggcagcgcaaaagatg

SEQ ID NO: 169598 - DNA, 103 bp, Artificial Sequence
  Synthetic Polynucleotide
taatacgactcactatagggtaggtctttcggcccttctcactggaggcaaacagaggagatgcctcatgtgagaagggaacctggcggcagcgcaaaagatg

SEQ ID NO: 169599 - DNA, 103 bp, Artificial Sequence
  Synthetic Polynucleotide
taatacgactcactataggggaaggcagtgggcacaggggctcctcgtttaacagaggagaaaacgaatggcccctgtgaacctggcggcagcgcaaaagatg

SEQ ID NO: 169600 - DNA, 103 bp, Artificial Sequence
  Synthetic Polynucleotide
taatacgactcactatagggggtagggggtgaaggcagtgggcacaggggaacagaggagacccctgatgccactgcctaacctggcggcagcgcaaaagatg

SEQ ID NO: 169601 - DNA, 103 bp, Artificial Sequence
  Synthetic Polynucleotide
taatacgactcactatagggcgctatcagaggtagggggtgaaggcagtgaacagaggagacactgcatgcaccccctaaacctggcggcagcgcaaaagatg

SEQ ID NO: 169602 - DNA, 103 bp, Artificial Sequence
  Synthetic Polynucleotide
taatacgactcactataggggagtccgagtcgctatcagaggtagggggtaacagaggagaacccccatgctctgatagaacctggcggcagcgcaaaagatg

SEQ ID NO: 169603 - DNA, 103 bp, Artificial Sequence
  Synthetic Polynucleotide
taatacgactcactatagggaggcccttcagagtccgagtcgctatcagaaacagaggagatctgatatggactcggacaacctggcggcagcgcaaaagatg

SEQ ID NO: 169604 - DNA, 103 bp, Artificial Sequence
  Synthetic Polynucleotide
taatacgactcactatagggtgtccttctcaggcccttcagagtccgagtaacagaggagaactcggatgctgaagggcaacctggcggcagcgcaaaagatg

SEQ ID NO: 169605 - DNA, 103 bp, Artificial Sequence
  Synthetic Polynucleotide
taatacgactcactatagggctgcttcgggtgtccttctcaggcccttcaaacagaggagatgaaggatgtgagaaggaaacctggcggcagcgcaaaagatg

SEQ ID NO: 169606 - DNA, 103 bp, Artificial Sequence
  Synthetic Polynucleotide
taatacgactcactataggggccccggaagctgcttcgggtgtccttctcaacagaggagagagaagatgacccgaagcaacctggcggcagcgcaaaagatg

SEQ ID NO: 169607 - DNA, 103 bp, Artificial Sequence
  Synthetic Polynucleotide
taatacgactcactataggggaggcgtgtggccccggaagctgcttcgggaacagaggagacccgaaatggcttccgggaacctggcggcagcgcaaaagatg

SEQ ID NO: 169608 - DNA, 103 bp, Artificial Sequence
  Synthetic Polynucleotide
taatacgactcactataggggtgaggtcaagaggcgtgtggccccggaagaacagaggagacttccgatgccacacgccaacctggcggcagcgcaaaagatg

SEQ ID NO: 169609 - DNA, 103 bp, Artificial Sequence
  Synthetic Polynucleotide
taatacgactcactataggggacagtgggataggtctttcggcccttctcaacagaggagagagaagatgcgaaagaccaacctggcggcagcgcaaaagatg

SEQ ID NO: 169610 - DNA, 103 bp, Artificial Sequence
  Synthetic Polynucleotide
taatacgactcactatagggggtgctgcaagtgaggtcaagaggcgtgtgaacagaggagacacacgatgcttgacctcaacctggcggcagcgcaaaagatg

SEQ ID NO: 169611 - DNA, 103 bp, Artificial Sequence
  Synthetic Polynucleotide
taatacgactcactatagggtcttcaccttggtgctgcaagtgaggtcaaaacagaggagattgaccatgcttgcagcaaacctggcggcagcgcaaaagatg

SEQ ID NO: 169612 - DNA, 103 bp, Artificial Sequence
  Synthetic Polynucleotide
taatacgactcactatagggagcagcaaggtcttcaccttggtgctgcaaaacagaggagattgcagatgcaaggtgaaaacctggcggcagcgcaaaagatg

SEQ ID NO: 169613 - DNA, 103 bp, Artificial Sequence
  Synthetic Polynucleotide
taatacgactcactatagggagcagcatttagcagcaaggtcttcaccttaacagaggagaaaggtgatgaccttgctgaacctggcggcagcgcaaaagatg

SEQ ID NO: 169614 - DNA, 103 bp, Artificial Sequence
  Synthetic Polynucleotide
taatacgactcactatagggtggtgttctgagcagcatttagcagcaaggaacagaggagaccttgcatgtaaatgctgaacctggcggcagcgcaaaagatg

SEQ ID NO: 169615 - DNA, 103 bp, Artificial Sequence
  Synthetic Polynucleotide
taatacgactcactatagggggtggctccatggtgttctgagcagcatttaacagaggagaaaatgcatgtcagaacacaacctggcggcagcgcaaaagatg

SEQ ID NO: 169616 - DNA, 103 bp, Artificial Sequence
  Synthetic Polynucleotide
taatacgactcactatagggcggggtcaggggtggctccatggtgttctgaacagaggagacagaacatgatggagccaaacctggcggcagcgcaaaagatg

SEQ ID NO: 169617 - DNA, 103 bp, Artificial Sequence
  Synthetic Polynucleotide
taatacgactcactatagggctgggctgggcggggtcaggggtggctccaaacagaggagatggagcatgccctgacccaacctggcggcagcgcaaaagatg

SEQ ID NO: 169618 - DNA, 103 bp, Artificial Sequence
  Synthetic Polynucleotide
taatacgactcactatagggcccggccctgctgggctgggcggggtcaggaacagaggagacctgacatggcccagcccaacctggcggcagcgcaaaagatg

SEQ ID NO: 169619 - DNA, 103 bp, Artificial Sequence
  Synthetic Polynucleotide
taatacgactcactatagggaagtgacagtcccggccctgctgggctgggaacagaggagacccagcatggcagggccgaacctggcggcagcgcaaaagatg

SEQ ID NO: 169620 - DNA, 103 bp, Artificial Sequence
  Synthetic Polynucleotide
taatacgactcactatagggtacagatcttgacagtgggataggtctttcaacagaggagagaaagaatgatcccactgaacctggcggcagcgcaaaagatg

SEQ ID NO: 169621 - DNA, 103 bp, Artificial Sequence
  Synthetic Polynucleotide
taatacgactcactatagggctgtatcaccaagtgacagtcccggccctgaacagaggagacagggcatggactgtcacaacctggcggcagcgcaaaagatg

SEQ ID NO: 169622 - DNA, 103 bp, Artificial Sequence
  Synthetic Polynucleotide
taatacgactcactatagggttctgcagagctgtatcaccaagtgacagtaacagaggagaactgtcatgtggtgatacaacctggcggcagcgcaaaagatg

SEQ ID NO: 169623 - DNA, 103 bp, Artificial Sequence
  Synthetic Polynucleotide
taatacgactcactatagggctgctccaggttctgcagagctgtatcaccaacagaggagaggtgatatggctctgcagaacctggcggcagcgcaaaagatg

SEQ ID NO: 169624 - DNA, 103 bp, Artificial Sequence
  Synthetic Polynucleotide
taatacgactcactatagggcgtctagcagctgctccaggttctgcagagaacagaggagactctgcatgacctggagcaacctggcggcagcgcaaaagatg

SEQ ID NO: 169625 - DNA, 103 bp, Artificial Sequence
  Synthetic Polynucleotide
taatacgactcactataggggcttctggcccgtctagcagctgctccaggaacagaggagacctggaatggctgctagaaacctggcggcagcgcaaaagatg

SEQ ID NO: 169626 - DNA, 103 bp, Artificial Sequence
  Synthetic Polynucleotide
taatacgactcactataggggctgccctgggcttctggcccgtctagcagaacagaggagactgctaatggggccagaaaacctggcggcagcgcaaaagatg

SEQ ID NO: 169627 - DNA, 103 bp, Artificial Sequence
  Synthetic Polynucleotide
taatacgactcactataggggctctgcccagctgccctgggcttctggccaacagaggagaggccagatgcccagggcaaacctggcggcagcgcaaaagatg

SEQ ID NO: 169628 - DNA, 103 bp, Artificial Sequence
  Synthetic Polynucleotide
taatacgactcactatagggcgctctgccagctctgcccagctgccctggaacagaggagaccagggatgctgggcagaaacctggcggcagcgcaaaagatg

SEQ ID NO: 169629 - DNA, 103 bp, Artificial Sequence
  Synthetic Polynucleotide
taatacgactcactatagggcagccccagacgctctgccagctctgcccaaacagaggagatgggcaatgctggcagagaacctggcggcagcgcaaaagatg

SEQ ID NO: 169630 - DNA, 103 bp, Artificial Sequence
  Synthetic Polynucleotide
taatacgactcactatagggccaggctgcgcagccccagacgctctgccaaacagaggagatggcagatggtctggggcaacctggcggcagcgcaaaagatg

SEQ ID NO: 169631 - DNA, 103 bp, Artificial Sequence
  Synthetic Polynucleotide
taatacgactcactatagggccctcgtagttacagatcttgacagtgggaaacagaggagatcccacatgcaagatctgaacctggcggcagcgcaaaagatg

SEQ ID NO: 169632 - DNA, 103 bp, Artificial Sequence
  Synthetic Polynucleotide
taatacgactcactatagggtacgtgtctaccaggctgcgcagccccagaaacagaggagatctgggatggcgcagcctaacctggcggcagcgcaaaagatg

SEQ ID NO: 169633 - DNA, 103 bp, Artificial Sequence
  Synthetic Polynucleotide
taatacgactcactatagggtgtctgtcggtacgtgtctaccaggctgcgaacagaggagacgcagcatggtagacacgaacctggcggcagcgcaaaagatg

SEQ ID NO: 169634 - DNA, 103 bp, Artificial Sequence
  Synthetic Polynucleotide
taatacgactcactatagggtgggtgaggttgtctgtcggtacgtgtctaaacagaggagatagacaatgaccgacagaaacctggcggcagcgcaaaagatg

SEQ ID NO: 169635 - DNA, 103 bp, Artificial Sequence
  Synthetic Polynucleotide
taatacgactcactatagggaggctgccactgggtgaggttgtctgtcggaacagaggagaccgacaatgaacctcaccaacctggcggcagcgcaaaagatg

SEQ ID NO: 169636 - DNA, 103 bp, Artificial Sequence
  Synthetic Polynucleotide
taatacgactcactataggggctgcgcaggaggctgccactgggtgaggtaacagaggagaacctcaatgagtggcagcaacctggcggcagcgcaaaagatg

SEQ ID NO: 169637 - DNA, 103 bp, Artificial Sequence
  Synthetic Polynucleotide
taatacgactcactatagggccagctcgtagctgcgcaggaggctgccacaacagaggagagtggcaatgtcctgcgcaaacctggcggcagcgcaaaagatg

SEQ ID NO: 169638 - DNA, 103 bp, Artificial Sequence
  Synthetic Polynucleotide
taatacgactcactatagggtccccgccagccagctcgtagctgcgcaggaacagaggagacctgcgatgctacgagctaacctggcggcagcgcaaaagatg

SEQ ID NO: 169639 - DNA, 103 bp, Artificial Sequence
  Synthetic Polynucleotide
taatacgactcactatagggacctgccaggtccccgccagccagctcgtaaacagaggagatacgagatggctggcgggaacctggcggcagcgcaaaagatg

SEQ ID NO: 169640 - DNA, 103 bp, Artificial Sequence
  Synthetic Polynucleotide
taatacgactcactatagggcctccagtagacctgccaggtccccgccagaacagaggagactggcgatgacctggcagaacctggcggcagcgcaaaagatg

SEQ ID NO: 169641 - DNA, 103 bp, Artificial Sequence
  Synthetic Polynucleotide
taatacgactcactatagggtcagacagggcctccagtagacctgccaggaacagaggagacctggcatgtctactggaaacctggcggcagcgcaaaagatg

SEQ ID NO: 169642 - DNA, 103 bp, Artificial Sequence
  Synthetic Polynucleotide
taatacgactcactatagggcttggctggtccctcgtagttacagatcttaacagaggagaaagatcatgaactacgagaacctggcggcagcgcaaaagatg

SEQ ID NO: 169643 - DNA, 103 bp, Artificial Sequence
  Synthetic Polynucleotide
taatacgactcactatagggtaggcccatgtcagacagggcctccagtagaacagaggagactactgatggccctgtctaacctggcggcagcgcaaaagatg

SEQ ID NO: 169644 - DNA, 103 bp, Artificial Sequence
  Synthetic Polynucleotide
taatacgactcactatagggctccctcctctaggcccatgtcagacagggaacagaggagaccctgtatgacatgggccaacctggcggcagcgcaaaagatg

SEQ ID NO: 169645 - DNA, 103 bp, Artificial Sequence
  Synthetic Polynucleotide
taatacgactcactatagggagcagcctcactccctcctctaggcccatgaacagaggagacatgggatgagaggagggaacctggcggcagcgcaaaagatg

SEQ ID NO: 169646 - DNA, 103 bp, Artificial Sequence
  Synthetic Polynucleotide
taatacgactcactatagggtggacccctcagcagcctcactccctcctcaacagaggagagaggagatggtgaggctgaacctggcggcagcgcaaaagatg

SEQ ID NO: 169647 - DNA, 103 bp, Artificial Sequence
  Synthetic Polynucleotide
taatacgactcactatagggctcgggtttctggacccctcagcagcctcaaacagaggagatgaggcatgtgaggggtcaacctggcggcagcgcaaaagatg

SEQ ID NO: 169648 - DNA, 103 bp, Artificial Sequence
  Synthetic Polynucleotide
taatacgactcactatagggggcagcttgtctcgggtttctggacccctcaacagaggagagaggggatgagaaacccgaacctggcggcagcgcaaaagatg

SEQ ID NO: 169649 - DNA, 103 bp, Artificial Sequence
  Synthetic Polynucleotide
taatacgactcactatagggctctgtgctgggcagcttgtctcgggtttcaacagaggagagaaaccatggacaagctgaacctggcggcagcgcaaaagatg

SEQ ID NO: 169650 - DNA, 103 bp, Artificial Sequence
  Synthetic Polynucleotide
taatacgactcactatagggcttccttcacctctgtgctgggcagcttgtaacagaggagaacaagcatgccagcacagaacctggcggcagcgcaaaagatg

SEQ ID NO: 169651 - DNA, 103 bp, Artificial Sequence
  Synthetic Polynucleotide
taatacgactcactatagggtacgcactgtcttccttcacctctgtgctgaacagaggagacagcacatgggtgaaggaaacctggcggcagcgcaaaagatg

SEQ ID NO: 169652 - DNA, 103 bp, Artificial Sequence
  Synthetic Polynucleotide
taatacgactcactatagggctggctcccgtacgcactgtcttccttcacaacagaggagagtgaagatggacagtgcgaacctggcggcagcgcaaaagatg

SEQ ID NO: 169653 - DNA, 103 bp, Artificial Sequence
  Synthetic Polynucleotide
taatacgactcactatagggccacctcgatcttggctggtccctcgtagtaacagaggagaactacgatggaccagccaaacctggcggcagcgcaaaagatg

SEQ ID NO: 169654 - DNA, 103 bp, Artificial Sequence
  Synthetic Polynucleotide
taatacgactcactataggggctccactgactggctcccgtacgcactgtaacagaggagaacagtgatgacgggagccaacctggcggcagcgcaaaagatg

SEQ ID NO: 169655 - DNA, 103 bp, Artificial Sequence
  Synthetic Polynucleotide
taatacgactcactatagggtctgcctcctgctccactgactggctcccgaacagaggagacgggagatggtcagtggaaacctggcggcagcgcaaaagatg

SEQ ID NO: 169656 - DNA, 103 bp, Artificial Sequence
  Synthetic Polynucleotide
taatacgactcactataggggcccagcttctctgcctcctgctccactgaaacagaggagatcagtgatgcaggaggcaaacctggcggcagcgcaaaagatg

SEQ ID NO: 169657 - DNA, 103 bp, Artificial Sequence
  Synthetic Polynucleotide
taatacgactcactatagggcagggggtgggcccagcttctctgcctcctaacagaggagaaggaggatgagaagctggaacctggcggcagcgcaaaagatg

SEQ ID NO: 169658 - DNA, 103 bp, Artificial Sequence
  Synthetic Polynucleotide
taatacgactcactatagggcctggtggctcagggggtgggcccagcttcaacagaggagagaagctatgcccacccccaacctggcggcagcgcaaaagatg

SEQ ID NO: 169659 - DNA, 103 bp, Artificial Sequence
  Synthetic Polynucleotide
taatacgactcactataggggcagagccctcctggtggctcagggggtggaacagaggagaccacccatggagccaccaaacctggcggcagcgcaaaagatg

SEQ ID NO: 169660 - DNA, 103 bp, Artificial Sequence
  Synthetic Polynucleotide
taatacgactcactatagggggtgcccgtggcagagccctcctggtggctaacagaggagaagccacatggagggctctaacctggcggcagcgcaaaagatg

SEQ ID NO: 169661 - DNA, 103 bp, Artificial Sequence
  Synthetic Polynucleotide
taatacgactcactatagggtgaggctgggggtgcccgtggcagagccctaacagaggagaagggctatgccacgggcaaacctggcggcagcgcaaaagatg

SEQ ID NO: 169662 - DNA, 103 bp, Artificial Sequence
  Synthetic Polynucleotide
taatacgactcactatagggtcagtgcacctgaggctgggggtgcccgtgaacagaggagacacgggatgccccagcctaacctggcggcagcgcaaaagatg

SEQ ID NO: 169663 - DNA, 103 bp, Artificial Sequence
  Synthetic Polynucleotide
taatacgactcactataggggttaccaggtccacctcgatcttggctggtaacagaggagaaccagcatggatcgaggtaacctggcggcagcgcaaaagatg

SEQ ID NO: 169664 - DNA, 103 bp, Artificial Sequence
  Synthetic Polynucleotide
taatacgactcactataggggtcactgtgtgttaccaggtccacctcgataacagaggagaatcgagatggacctggtaaacctggcggcagcgcaaaagatg

SEQ ID NO: 169665 - DNA, 103 bp, Artificial Sequence
  Synthetic Polynucleotide
taatacgactcactatagggcacgaggtgggtcactgtgtgttaccaggtaacagaggagaacctggatgcacacagtgaacctggcggcagcgcaaaagatg

SEQ ID NO: 169666 - DNA, 103 bp, Artificial Sequence
  Synthetic Polynucleotide
taatacgactcactatagggtcatcatattcaataataccatccagacctaacagaggagaaggtctatgtggtattataacctggcggcagcgcaaaagatg

SEQ ID NO: 169667 - DNA, 103 bp, Artificial Sequence
  Synthetic Polynucleotide
taatacgactcactatagggtgggcatgagcacgaggtgggtcactgtgtaacagaggagaacacagatgcccacctcgaacctggcggcagcgcaaaagatg

SEQ ID NO: 169668 - DNA, 103 bp, Artificial Sequence
  Synthetic Polynucleotide
taatacgactcactatagggcaccagactgtgggcatgagcacgaggtggaacagaggagaccacctatggctcatgccaacctggcggcagcgcaaaagatg

SEQ ID NO: 169669 - DNA, 103 bp, Artificial Sequence
  Synthetic Polynucleotide
taatacgactcactatagggattgcttgcccaccagactgtgggcatgagaacagaggagactcatgatgacagtctggaacctggcggcagcgcaaaagatg

SEQ ID NO: 169670 - DNA, 103 bp, Artificial Sequence
  Synthetic Polynucleotide
taatacgactcactatagggagctccgagcattgcttgcccaccagactgaacagaggagacagtctatggggcaagcaaacctggcggcagcgcaaaagatg

SEQ ID NO: 169671 - DNA, 103 bp, Artificial Sequence
  Synthetic Polynucleotide
taatacgactcactataggggcagatccccagctccgagcattgcttgccaacagaggagaggcaagatgtgctcggagaacctggcggcagcgcaaaagatg

SEQ ID NO: 169672 - DNA, 103 bp, Artificial Sequence
  Synthetic Polynucleotide
taatacgactcactatagggcagaaacggcgcagatccccagctccgagcaacagaggagagctcggatgtggggatctaacctggcggcagcgcaaaagatg

SEQ ID NO: 169673 - DNA, 103 bp, Artificial Sequence
  Synthetic Polynucleotide
taatacgactcactatagggttgggccccacagaaacggcgcagatccccaacagaggagaggggatatgcgccgtttcaacctggcggcagcgcaaaagatg

SEQ ID NO: 169674 - DNA, 103 bp, Artificial Sequence
  Synthetic Polynucleotide
taatacgactcactatagggagtcatgtccttgggccccacagaaacggcaacagaggagagccgttatggtggggcccaacctggcggcagcgcaaaagatg

SEQ ID NO: 169675 - DNA, 103 bp, Artificial Sequence
  Synthetic Polynucleotide
taatacgactcactatagggtaaattgggcagtcatgtccttgggccccaaacagaggagatggggcatgaggacatgaaacctggcggcagcgcaaaagatg

SEQ ID NO: 169676 - DNA, 103 bp, Artificial Sequence
  Synthetic Polynucleotide
taatacgactcactatagggcccaggttgttaaattgggcagtcatgtccaacagaggagaggacatatgtgcccaattaacctggcggcagcgcaaaagatg

SEQ ID NO: 169677 - DNA, 103 bp, Artificial Sequence
  Synthetic Polynucleotide
taatacgactcactatagggcaatttgaaatcatcatattcaataataccaacagaggagaggtattatggaatatgataacctggcggcagcgcaaaagatg

SEQ ID NO: 169678 - DNA, 103 bp, Artificial Sequence
  Synthetic Polynucleotide
taatacgactcactatagggatgcaggacacccaggttgttaaattgggcaacagaggagagcccaaatgaacaacctgaacctggcggcagcgcaaaagatg

SEQ ID NO: 169679 - DNA, 103 bp, Artificial Sequence
  Synthetic Polynucleotide
taatacgactcactatagggtcttagtcacatgcaggacacccaggttgtaacagaggagaacaaccatggtgtcctgcaacctggcggcagcgcaaaagatg

SEQ ID NO: 169680 - DNA, 103 bp, Artificial Sequence
  Synthetic Polynucleotide
taatacgactcactatagggatcatgttcttcttagtcacatgcaggacaaacagaggagatgtcctatgtgtgactaaaacctggcggcagcgcaaaagatg

SEQ ID NO: 169681 - DNA, 103 bp, Artificial Sequence
  Synthetic Polynucleotide
taatacgactcactatagggcatagtccccatcatgttcttcttagtcacaacagaggagagtgactatgaagaacatgaacctggcggcagcgcaaaagatg

SEQ ID NO: 169682 - DNA, 103 bp, Artificial Sequence
  Synthetic Polynucleotide
taatacgactcactataggggtttttgtatcatagtccccatcatgttctaacagaggagaagaacaatgtggggactaaacctggcggcagcgcaaaagatg

SEQ ID NO: 169683 - DNA, 103 bp, Artificial Sequence
  Synthetic Polynucleotide
taatacgactcactatagggtgcctctgaagtttttgtatcatagtccccaacagaggagaggggacatggatacaaaaaacctggcggcagcgcaaaagatg

SEQ ID NO: 169684 - DNA, 103 bp, Artificial Sequence
  Synthetic Polynucleotide
taatacgactcactataggggcggagccgctgcctctgaagtttttgtataacagaggagaatacaaatgcttcagaggaacctggcggcagcgcaaaagatg

SEQ ID NO: 169685 - DNA, 103 bp, Artificial Sequence
  Synthetic Polynucleotide
taatacgactcactatagggggggcctagagcggagccgctgcctctgaaaacagaggagattcagaatgagcggctccaacctggcggcagcgcaaaagatg

SEQ ID NO: 169686 - DNA, 103 bp, Artificial Sequence
  Synthetic Polynucleotide
taatacgactcactataggggtaaggccctggggcctagagcggagccgcaacagaggagagcggctatgctctaggccaacctggcggcagcgcaaaagatg

SEQ ID NO: 169687 - DNA, 103 bp, Artificial Sequence
  Synthetic Polynucleotide
taatacgactcactatagggctcggcctccgtaaggccctggggcctagaaacagaggagatctaggatgcagggccttaacctggcggcagcgcaaaagatg

SEQ ID NO: 169688 - DNA, 103 bp, Artificial Sequence
  Synthetic Polynucleotide
taatacgactcactatagggtggaggagttcaatttgaaatcatcatattaacagaggagaaatatgatgatttcaaataacctggcggcagcgcaaaagatg

SEQ ID NO: 169689 - DNA, 103 bp, Artificial Sequence
  Synthetic Polynucleotide
taatacgactcactataggggctcccgctgctcggcctccgtaaggccctaacagaggagaagggccatgcggaggccgaacctggcggcagcgcaaaagatg

SEQ ID NO: 169690 - DNA, 103 bp, Artificial Sequence
  Synthetic Polynucleotide
taatacgactcactatagggtcttgctccagctcccgctgctcggcctccaacagaggagaggaggcatggcagcgggaaacctggcggcagcgcaaaagatg

SEQ ID NO: 169691 - DNA, 103 bp, Artificial Sequence
  Synthetic Polynucleotide
taatacgactcactatagggttctttggcctcttgctccagctcccgctgaacagaggagacagcggatgctggagcaaaacctggcggcagcgcaaaagatg

SEQ ID NO: 169692 - DNA, 103 bp, Artificial Sequence
  Synthetic Polynucleotide
taatacgactcactatagggccttcttcagttctttggcctcttgctccaaacagaggagatggagcatgaggccaaagaacctggcggcagcgcaaaagatg

SEQ ID NO: 169693 - DNA, 103 bp, Artificial Sequence
  Synthetic Polynucleotide
taatacgactcactatagggagatccatcaccttcttcagttctttggccaacagaggagaggccaaatgactgaagaaaacctggcggcagcgcaaaagatg

SEQ ID NO: 169694 - DNA, 103 bp, Artificial Sequence
  Synthetic Polynucleotide
taatacgactcactatagggcactatactcagatccatcaccttcttcagaacagaggagactgaagatggtgatggataacctggcggcagcgcaaaagatg

SEQ ID NO: 169695 - DNA, 103 bp, Artificial Sequence
  Synthetic Polynucleotide
taatacgactcactatagggagcgcagccgcactatactcagatccatcaaacagaggagatgatggatgtgagtatagaacctggcggcagcgcaaaagatg

SEQ ID NO: 169696 - DNA, 103 bp, Artificial Sequence
  Synthetic Polynucleotide
taatacgactcactatagggaaggcagagaagcgcagccgcactatactcaacagaggagagagtatatggcggctgcgaacctggcggcagcgcaaaagatg

SEQ ID NO: 169697 - DNA, 103 bp, Artificial Sequence
  Synthetic Polynucleotide
taatacgactcactatagggggctctaaggaaggcagagaagcgcagccgaacagaggagacggctgatgttctctgccaacctggcggcagcgcaaaagatg

SEQ ID NO: 169698 - DNA, 103 bp, Artificial Sequence
  Synthetic Polynucleotide
taatacgactcactatagggagccatcactggctctaaggaaggcagagaaacagaggagatctctgatgtccttagagaacctggcggcagcgcaaaagatg

SEQ ID NO: 169699 - DNA, 103 bp, Artificial Sequence
  Synthetic Polynucleotide
taatacgactcactatagggggttccacaatggaggagttcaatttgaaaaacagaggagatttcaaatggaactcctcaacctggcggcagcgcaaaagatg

SEQ ID NO: 169700 - DNA, 103 bp, Artificial Sequence
  Synthetic Polynucleotide
taatacgactcactatagggagggagaaggagccatcactggctctaaggaacagaggagaccttagatgcagtgatggaacctggcggcagcgcaaaagatg

SEQ ID NO: 169701 - DNA, 103 bp, Artificial Sequence
  Synthetic Polynucleotide
taatacgactcactatagggcttcaggggcagggagaaggagccatcactaacagaggagaagtgatatgtccttctccaacctggcggcagcgcaaaagatg

SEQ ID NO: 169702 - DNA, 103 bp, Artificial Sequence
  Synthetic Polynucleotide
taatacgactcactatagggagatgactggcttcaggggcagggagaaggaacagaggagaccttctatgtgcccctgaaacctggcggcagcgcaaaagatg

SEQ ID NO: 169703 - DNA, 103 bp, Artificial Sequence
  Synthetic Polynucleotide
taatacgactcactatagggatgggctgggagatgactggcttcaggggcaacagaggagagcccctatggccagtcataacctggcggcagcgcaaaagatg

SEQ ID NO: 169704 - DNA, 103 bp, Artificial Sequence
  Synthetic Polynucleotide
taatacgactcactataggggctgtcatggatgggctgggagatgactggaacagaggagaccagtcatgtcccagcccaacctggcggcagcgcaaaagatg

SEQ ID NO: 169705 - DNA, 103 bp, Artificial Sequence
  Synthetic Polynucleotide
taatacgactcactatagggccggagatttgctgtcatggatgggctgggaacagaggagacccagcatgtccatgacaaacctggcggcagcgcaaaagatg

SEQ ID NO: 169706 - DNA, 103 bp, Artificial Sequence
  Synthetic Polynucleotide
taatacgactcactatagggtttgatgcccccggagatttgctgtcatggaacagaggagaccatgaatgcaaatctccaacctggcggcagcgcaaaagatg

SEQ ID NO: 169707 - DNA, 103 bp, Artificial Sequence
  Synthetic Polynucleotide
taatacgactcactatagggaatcttcaggtttgatgcccccggagatttaacagaggagaaaatctatgggggcatcaaacctggcggcagcgcaaaagatg

SEQ ID NO: 169708 - DNA, 103 bp, Artificial Sequence
  Synthetic Polynucleotide
taatacgactcactatagggccattcgagaaatcttcaggtttgatgcccaacagaggagagggcatatgacctgaagaaacctggcggcagcgcaaaagatg

SEQ ID NO: 169709 - DNA, 103 bp, Artificial Sequence
  Synthetic Polynucleotide
taatacgactcactataggggctgtcttgtccattcgagaaatcttcaggaacagaggagacctgaaatgttctcgaataacctggcggcagcgcaaaagatg

SEQ ID NO: 169710 - DNA, 103 bp, Artificial Sequence
  Synthetic Polynucleotide
taatacgactcactatagggtggctccttgggttccacaatggaggagttaacagaggagaaactccatgattgtggaaaacctggcggcagcgcaaaagatg

SEQ ID NO: 169711 - DNA, 103 bp, Artificial Sequence
  Synthetic Polynucleotide
taatacgactcactatagggcacagagcctgctgtcttgtccattcgagaaacagaggagatctcgaatggacaagacaaacctggcggcagcgcaaaagatg

SEQ ID NO: 169712 - DNA, 103 bp, Artificial Sequence
  Synthetic Polynucleotide
taatacgactcactatagggctccaccccgcacagagcctgctgtcttgtaacagaggagaacaagaatgcaggctctgaacctggcggcagcgcaaaagatg

SEQ ID NO: 169713 - DNA, 103 bp, Artificial Sequence
  Synthetic Polynucleotide
taatacgactcactatagggtaaacttcatctccaccccgcacagagcctaacagaggagaaggctcatggcggggtggaacctggcggcagcgcaaaagatg

SEQ ID NO: 169714 - DNA, 103 bp, Artificial Sequence
  Synthetic Polynucleotide
taatacgactcactatagggacaaagcagataaacttcatctccaccccgaacagaggagacggggtatggatgaagttaacctggcggcagcgcaaaagatg

SEQ ID NO: 169715 - DNA, 103 bp, Artificial Sequence
  Synthetic Polynucleotide
taatacgactcactataggggcaccttgtcacaaagcagataaacttcataacagaggagaatgaagatgatctgctttaacctggcggcagcgcaaaagatg

SEQ ID NO: 169716 - DNA, 103 bp, Artificial Sequence
  Synthetic Polynucleotide
taatacgactcactatagggtcatctttctgcaccttgtcacaaagcagaaacagaggagatctgctatgtgacaaggtaacctggcggcagcgcaaaagatg

SEQ ID NO: 169717 - DNA, 103 bp, Artificial Sequence
  Synthetic Polynucleotide
taatacgactcactatagggaacctcaatgtcatctttctgcaccttgtcaacagaggagagacaagatgcagaaagataacctggcggcagcgcaaaagatg

SEQ ID NO: 169718 - DNA, 103 bp, Artificial Sequence
  Synthetic Polynucleotide
taatacgactcactatagggcatagaaccgaacctcaatgtcatctttctaacagaggagaagaaagatgacattgaggaacctggcggcagcgcaaaagatg

SEQ ID NO: 169719 - DNA, 103 bp, Artificial Sequence
  Synthetic Polynucleotide
taatacgactcactatagggtcatcatcctcatagaaccgaacctcaatgaacagaggagacattgaatgtcggttctaaacctggcggcagcgcaaaagatg

SEQ ID NO: 169720 - DNA, 103 bp, Artificial Sequence
  Synthetic Polynucleotide
taatacgactcactatagggccatccattctcatcatcctcatagaaccgaacagaggagacggttcatggaggatgataacctggcggcagcgcaaaagatg

SEQ ID NO: 169721 - DNA, 103 bp, Artificial Sequence
  Synthetic Polynucleotide
taatacgactcactatagggtttctggggctggctccttgggttccacaaaacagaggagattgtggatgccaaggagcaacctggcggcagcgcaaaagatg

SEQ ID NO: 169722 - DNA, 103 bp, Artificial Sequence
  Synthetic Polynucleotide
taatacgactcactatagggcaaaggcctgccatccattctcatcatcctaacagaggagaaggatgatgagaatggataacctggcggcagcgcaaaagatg

SEQ ID NO: 169723 - DNA, 103 bp, Artificial Sequence
  Synthetic Polynucleotide
taatacgactcactataggggagaagtccccaaaggcctgccatccattcaacagaggagagaatggatggcaggccttaacctggcggcagcgcaaaagatg

SEQ ID NO: 169724 - DNA, 103 bp, Artificial Sequence
  Synthetic Polynucleotide
taatacgactcactatagggatctgtgggagagaagtccccaaaggcctgaacagaggagacaggccatgggggacttcaacctggcggcagcgcaaaagatg

SEQ ID NO: 169725 - DNA, 103 bp, Artificial Sequence
  Synthetic Polynucleotide
taatacgactcactataggggtttatgcacatctgtgggagagaagtcccaacagaggagagggactatgctcccacagaacctggcggcagcgcaaaagatg

SEQ ID NO: 169726 - DNA, 103 bp, Artificial Sequence
  Synthetic Polynucleotide
taatacgactcactatagggatggcatactgtttatgcacatctgtgggaaacagaggagatcccacatgtgtgcataaaacctggcggcagcgcaaaagatg

SEQ ID NO: 169727 - DNA, 103 bp, Artificial Sequence
  Synthetic Polynucleotide
taatacgactcactatagggccggaacacaatggcatactgtttatgcacaacagaggagagtgcatatgcagtatgccaacctggcggcagcgcaaaagatg

SEQ ID NO: 169728 - DNA, 103 bp, Artificial Sequence
  Synthetic Polynucleotide
taatacgactcactatagggaggggggtgtccggaacacaatggcatactaacagaggagaagtatgatgttgtgttccaacctggcggcagcgcaaaagatg

SEQ ID NO: 169729 - DNA, 103 bp, Artificial Sequence
  Synthetic Polynucleotide
taatacgactcactatagggatcttgtgataggggggtgtccggaacacaaacagaggagatgtgttatggacacccccaacctggcggcagcgcaaaagatg

SEQ ID NO: 169730 - DNA, 103 bp, Artificial Sequence
  Synthetic Polynucleotide
taatacgactcactatagggctcaatcttcatcttgtgataggggggtgtaacagaggagaacacccatgtatcacaagaacctggcggcagcgcaaaagatg

SEQ ID NO: 169731 - DNA, 103 bp, Artificial Sequence
  Synthetic Polynucleotide
taatacgactcactatagggttacaggccgctcaatcttcatcttgtgataacagaggagaatcacaatgtgaagattgaacctggcggcagcgcaaaagatg

SEQ ID NO: 169732 - DNA, 103 bp, Artificial Sequence
  Synthetic Polynucleotide
taatacgactcactatagggccatcagctgtttctggggctggctccttgaacagaggagacaaggaatgagccccagaaacctggcggcagcgcaaaagatg

SEQ ID NO: 169733 - DNA, 103 bp, Artificial Sequence
  Synthetic Polynucleotide
taatacgactcactatagggagaaacactgttacaggccgctcaatcttcaacagaggagagaagatatggcggcctgtaacctggcggcagcgcaaaagatg

SEQ ID NO: 169734 - DNA, 103 bp, Artificial Sequence
  Synthetic Polynucleotide
taatacgactcactatagggtttcagttgcagaaacactgttacaggccgaacagaggagacggcctatgacagtgtttaacctggcggcagcgcaaaagatg

SEQ ID NO: 169735 - DNA, 103 bp, Artificial Sequence
  Synthetic Polynucleotide
taatacgactcactatagggctcgcttgcgtttcagttgcagaaacactgaacagaggagacagtgtatgtgcaactgaaacctggcggcagcgcaaaagatg

SEQ ID NO: 169736 - DNA, 103 bp, Artificial Sequence
  Synthetic Polynucleotide
taatacgactcactatagggacgtcccctcctcgcttgcgtttcagttgcaacagaggagagcaactatgacgcaagcgaacctggcggcagcgcaaaagatg

SEQ ID NO: 169737 - DNA, 103 bp, Artificial Sequence
  Synthetic Polynucleotide
taatacgactcactatagggggaatcagacacgtcccctcctcgcttgcgaacagaggagacgcaagatgggaggggacaacctggcggcagcgcaaaagatg

SEQ ID NO: 169738 - DNA, 103 bp, Artificial Sequence
  Synthetic Polynucleotide
taatacgactcactatagggtgaactgtttggaatcagacacgtcccctcaacagaggagagaggggatgtgtctgattaacctggcggcagcgcaaaagatg

SEQ ID NO: 169739 - DNA, 103 bp, Artificial Sequence
  Synthetic Polynucleotide
taatacgactcactataggggggtaataggtgaactgtttggaatcagacaacagaggagagtctgaatgcaaacagttaacctggcggcagcgcaaaagatg

SEQ ID NO: 169740 - DNA, 103 bp, Artificial Sequence
  Synthetic Polynucleotide
taatacgactcactatagggttccaccagagggtaataggtgaactgtttaacagaggagaaaacagatgacctattacaacctggcggcagcgcaaaagatg

SEQ ID NO: 169741 - DNA, 103 bp, Artificial Sequence
  Synthetic Polynucleotide
taatacgactcactatagggcttccttgtcttccaccagagggtaataggaacagaggagacctattatgctctggtggaacctggcggcagcgcaaaagatg

SEQ ID NO: 169742 - DNA, 103 bp, Artificial Sequence
  Synthetic Polynucleotide
taatacgactcactatagggcgctgcacctcttccttgtcttccaccagaaacagaggagatctggtatgagacaaggaaacctggcggcagcgcaaaagatg

SEQ ID NO: 169743 - DNA, 103 bp, Artificial Sequence
  Synthetic Polynucleotide
taatacgactcactatagggagtacctgagacaggaggcgcctccgccataacagaggagaatggcgatggcgcctcctaacctggcggcagcgcaaaagatg

SEQ ID NO: 169744 - DNA, 103 bp, Artificial Sequence
  Synthetic Polynucleotide
taatacgactcactatagggagagtctagtctcctttgagtcccacaattaacagaggagaaattgtatgactcaaaggaacctggcggcagcgcaaaagatg

SEQ ID NO: 169745 - DNA, 103 bp, Artificial Sequence
  Synthetic Polynucleotide
taatacgactcactatagggcacattctttagcacatggttctgtttgccaacagaggagaggcaaaatgaaccatgtgaacctggcggcagcgcaaaagatg

SEQ ID NO: 169746 - DNA, 103 bp, Artificial Sequence
  Synthetic Polynucleotide
taatacgactcactatagggtgtgcgtttccacattctttagcacatggtaacagaggagaaccatgatgtaaagaatgaacctggcggcagcgcaaaagatg

SEQ ID NO: 169747 - DNA, 103 bp, Artificial Sequence
  Synthetic Polynucleotide
taatacgactcactatagggagagaacctgtgtgcgtttccacattctttaacagaggagaaaagaaatgggaaacgcaaacctggcggcagcgcaaaagatg

SEQ ID NO: 169748 - DNA, 103 bp, Artificial Sequence
  Synthetic Polynucleotide
taatacgactcactatagggttgttcaattagagaacctgtgtgcgtttcaacagaggagagaaacgatgacaggttctaacctggcggcagcgcaaaagatg

SEQ ID NO: 169749 - DNA, 103 bp, Artificial Sequence
  Synthetic Polynucleotide
taatacgactcactatagggctgttgttagttgttcaattagagaacctgaacagaggagacaggttatgtaattgaacaacctggcggcagcgcaaaagatg

SEQ ID NO: 169750 - DNA, 103 bp, Artificial Sequence
  Synthetic Polynucleotide
taatacgactcactatagggtcgtatttttctgttgttagttgttcaattaacagaggagaaattgaatgactaacaacaacctggcggcagcgcaaaagatg

SEQ ID NO: 169751 - DNA, 103 bp, Artificial Sequence
  Synthetic Polynucleotide
taatacgactcactatagggcaccatgcactcgtatttttctgttgttagaacagaggagactaacaatggaaaaatacaacctggcggcagcgcaaaagatg

SEQ ID NO: 169752 - DNA, 103 bp, Artificial Sequence
  Synthetic Polynucleotide
taatacgactcactatagggattcacagcacaccatgcactcgtatttttaacagaggagaaaaaatatgagtgcatggaacctggcggcagcgcaaaagatg

SEQ ID NO: 169753 - DNA, 103 bp, Artificial Sequence
  Synthetic Polynucleotide
taatacgactcactatagggacacgaaccaattcacagcacaccatgcacaacagaggagagtgcatatggtgctgtgaaacctggcggcagcgcaaaagatg

SEQ ID NO: 169754 - DNA, 103 bp, Artificial Sequence
  Synthetic Polynucleotide
taatacgactcactatagggtggggccgtgacacgaaccaattcacagcaaacagaggagatgctgtatgttggttcgtaacctggcggcagcgcaaaagatg

SEQ ID NO: 169755 - DNA, 103 bp, Artificial Sequence
  Synthetic Polynucleotide
taatacgactcactatagggcaatcctattagagtctagtctcctttgagaacagaggagactcaaaatggactagactaacctggcggcagcgcaaaagatg

SEQ ID NO: 169756 - DNA, 103 bp, Artificial Sequence
  Synthetic Polynucleotide
taatacgactcactatagggaactccacactggggccgtgacacgaaccaaacagaggagatggttcatgtcacggcccaacctggcggcagcgcaaaagatg

SEQ ID NO: 169757 - DNA, 103 bp, Artificial Sequence
  Synthetic Polynucleotide
taatacgactcactatagggcagctctgacaactccacactggggccgtgaacagaggagacacggcatgagtgtggagaacctggcggcagcgcaaaagatg

SEQ ID NO: 169758 - DNA, 103 bp, Artificial Sequence
  Synthetic Polynucleotide
taatacgactcactatagggcacatggtaacagctctgacaactccacacaacagaggagagtgtggatgtgtcagagcaacctggcggcagcgcaaaagatg

SEQ ID NO: 169759 - DNA, 103 bp, Artificial Sequence
  Synthetic Polynucleotide
taatacgactcactatagggtcaaatgaaacacatggtaacagctctgacaacagaggagagtcagaatggttaccatgaacctggcggcagcgcaaaagatg

SEQ ID NO: 169760 - DNA, 103 bp, Artificial Sequence
  Synthetic Polynucleotide
taatacgactcactatagggtttatgcagttcaaatgaaacacatggtaaaacagaggagattaccaatggtttcatttaacctggcggcagcgcaaaagatg

SEQ ID NO: 169761 - DNA, 103 bp, Artificial Sequence
  Synthetic Polynucleotide
taatacgactcactatagggtgcccatttctttatgcagttcaaatgaaaaacagaggagatttcatatgaactgcataaacctggcggcagcgcaaaagatg

SEQ ID NO: 169762 - DNA, 103 bp, Artificial Sequence
  Synthetic Polynucleotide
taatacgactcactatagggctggagaccttgcccatttctttatgcagtaacagaggagaactgcaatgagaaatgggaacctggcggcagcgcaaaagatg

SEQ ID NO: 169763 - DNA, 103 bp, Artificial Sequence
  Synthetic Polynucleotide
taatacgactcactataggggcttgagatgctggagaccttgcccatttcaacagaggagagaaatgatgaaggtctccaacctggcggcagcgcaaaagatg

SEQ ID NO: 169764 - DNA, 103 bp, Artificial Sequence
  Synthetic Polynucleotide
taatacgactcactatagggctggccatctgcttgagatgctggagacctaacagaggagaaggtctatggcatctcaaaacctggcggcagcgcaaaagatg

SEQ ID NO: 169765 - DNA, 103 bp, Artificial Sequence
  Synthetic Polynucleotide
taatacgactcactatagggtccaaccactctggccatctgcttgagatgaacagaggagacatctcatgcagatggccaacctggcggcagcgcaaaagatg

SEQ ID NO: 169766 - DNA, 103 bp, Artificial Sequence
  Synthetic Polynucleotide
taatacgactcactatagggtttcttctaccaatcctattagagtctagtaacagaggagaactagaatgtaataggataacctggcggcagcgcaaaagatg

SEQ ID NO: 169767 - DNA, 103 bp, Artificial Sequence
  Synthetic Polynucleotide
taatacgactcactataggggcagggcacctccaaccactctggccatctaacagaggagaagatggatggagtggttgaacctggcggcagcgcaaaagatg

SEQ ID NO: 169768 - DNA, 103 bp, Artificial Sequence
  Synthetic Polynucleotide
taatacgactcactatagggattctgacaggcagggcacctccaaccactaacagaggagaagtggtatgaggtgccctaacctggcggcagcgcaaaagatg

SEQ ID NO: 169769 - DNA, 103 bp, Artificial Sequence
  Synthetic Polynucleotide
taatacgactcactataggggtgcagaaacattctgacaggcagggcaccaacagaggagaggtgccatgcctgtcagaaacctggcggcagcgcaaaagatg

SEQ ID NO: 169770 - DNA, 103 bp, Artificial Sequence
  Synthetic Polynucleotide
taatacgactcactatagggttaggaacatgtgcagaaacattctgacagaacagaggagactgtcaatgtgtttctgcaacctggcggcagcgcaaaagatg

SEQ ID NO: 169771 - DNA, 103 bp, Artificial Sequence
  Synthetic Polynucleotide
taatacgactcactatagggagtgtaggtattaggaacatgtgcagaaacaacagaggagagtttctatgcatgttcctaacctggcggcagcgcaaaagatg

SEQ ID NO: 169772 - DNA, 103 bp, Artificial Sequence
  Synthetic Polynucleotide
taatacgactcactatagggcacagaaacaagtgtaggtattaggaacataacagaggagaatgttcatgatacctacaaacctggcggcagcgcaaaagatg

SEQ ID NO: 169773 - DNA, 103 bp, Artificial Sequence
  Synthetic Polynucleotide
taatacgactcactatagggtttaccttgccacagaaacaagtgtaggtaaacagaggagatacctaatgttgtttctgaacctggcggcagcgcaaaagatg

SEQ ID NO: 169774 - DNA, 103 bp, Artificial Sequence
  Synthetic Polynucleotide
taatacgactcactatagggctcaggattctttaccttgccacagaaacaaacagaggagatgtttcatgggcaaggtaaacctggcggcagcgcaaaagatg

SEQ ID NO: 169775 - DNA, 103 bp, Artificial Sequence
  Synthetic Polynucleotide
taatacgactcactatagggttctgctccactcaggattctttaccttgcaacagaggagagcaaggatgagaatcctgaacctggcggcagcgcaaaagatg

SEQ ID NO: 169776 - DNA, 103 bp, Artificial Sequence
  Synthetic Polynucleotide
taatacgactcactatagggggaatttcatttctgctccactcaggattcaacagaggagagaatccatggtggagcagaacctggcggcagcgcaaaagatg

SEQ ID NO: 169777 - DNA, 103 bp, Artificial Sequence
  Synthetic Polynucleotide
taatacgactcactatagggtgaactgtaatttcttctaccaatcctattaacagaggagaaataggatgggtagaagaaacctggcggcagcgcaaaagatg

SEQ ID NO: 169778 - DNA, 103 bp, Artificial Sequence
  Synthetic Polynucleotide
taatacgactcactatagggacagctatgtggaatttcatttctgctccaaacagaggagatggagcatgaatgaaattaacctggcggcagcgcaaaagatg

SEQ ID NO: 169779 - DNA, 103 bp, Artificial Sequence
  Synthetic Polynucleotide
taatacgactcactatagggaaacctcaccacagctatgtggaatttcataacagaggagaatgaaaatgcacatagctaacctggcggcagcgcaaaagatg

SEQ ID NO: 169780 - DNA, 103 bp, Artificial Sequence
  Synthetic Polynucleotide
taatacgactcactatagggttctttctacaaacctcaccacagctatgtaacagaggagaacatagatgtggtgaggtaacctggcggcagcgcaaaagatg

SEQ ID NO: 169781 - DNA, 103 bp, Artificial Sequence
  Synthetic Polynucleotide
taatacgactcactataggggccaggctgtttctttctacaaacctcaccaacagaggagaggtgagatgtgtagaaagaacctggcggcagcgcaaaagatg

SEQ ID NO: 169782 - DNA, 103 bp, Artificial Sequence
  Synthetic Polynucleotide
taatacgactcactatagggggcagtcctggccaggctgtttctttctacaacagaggagagtagaaatgaacagcctgaacctggcggcagcgcaaaagatg

SEQ ID NO: 169783 - DNA, 103 bp, Artificial Sequence
  Synthetic Polynucleotide
taatacgactcactatagggcaggaatgtgggcagtcctggccaggctgtaacagaggagaacagccatgccaggactgaacctggcggcagcgcaaaagatg

SEQ ID NO: 169784 - DNA, 103 bp, Artificial Sequence
  Synthetic Polynucleotide
taatacgactcactataggggagaaggttacaggaatgtgggcagtcctgaacagaggagacaggacatgccacattccaacctggcggcagcgcaaaagatg

SEQ ID NO: 169785 - DNA, 103 bp, Artificial Sequence
  Synthetic Polynucleotide
taatacgactcactatagggctggatggcagagaaggttacaggaatgtgaacagaggagacacattatggtaaccttcaacctggcggcagcgcaaaagatg

SEQ ID NO: 169786 - DNA, 103 bp, Artificial Sequence
  Synthetic Polynucleotide
taatacgactcactataggggggcagggtcctggatggcagagaaggttaaacagaggagataacctatgctgccatccaacctggcggcagcgcaaaagatg

SEQ ID NO: 169787 - DNA, 103 bp, Artificial Sequence
  Synthetic Polynucleotide
taatacgactcactatagggagggcagggtgggcagggtcctggatggcaaacagaggagatgccatatgggaccctgcaacctggcggcagcgcaaaagatg

SEQ ID NO: 169788 - DNA, 103 bp, Artificial Sequence
  Synthetic Polynucleotide
taatacgactcactatagggagggaggtggtgaactgtaatttcttctacaacagaggagagtagaaatgattacagttaacctggcggcagcgcaaaagatg

SEQ ID NO: 169789 - DNA, 103 bp, Artificial Sequence
  Synthetic Polynucleotide
taatacgactcactatagggtcataaaggcagggcagggtgggcagggtcaacagaggagagaccctatgcaccctgccaacctggcggcagcgcaaaagatg

SEQ ID NO: 169790 - DNA, 103 bp, Artificial Sequence
  Synthetic Polynucleotide
taatacgactcactatagggcatgtttttgtcataaaggcagggcagggtaacagaggagaaccctgatgtgcctttataacctggcggcagcgcaaaagatg

SEQ ID NO: 169791 - DNA, 103 bp, Artificial Sequence
  Synthetic Polynucleotide
taatacgactcactatagggtccacattcacatgtttttgtcataaaggcaacagaggagagcctttatgacaaaaacaaacctggcggcagcgcaaaagatg

SEQ ID NO: 169792 - DNA, 103 bp, Artificial Sequence
  Synthetic Polynucleotide
taatacgactcactataggggcctggttcgtccacattcacatgtttttgaacagaggagacaaaaaatggtgaatgtgaacctggcggcagcgcaaaagatg

SEQ ID NO: 169793 - DNA, 103 bp, Artificial Sequence
  Synthetic Polynucleotide
taatacgactcactatagggcgaactgtgtgcctggttcgtccacattcaaacagaggagatgaatgatgacgaaccagaacctggcggcagcgcaaaagatg

SEQ ID NO: 169794 - DNA, 103 bp, Artificial Sequence
  Synthetic Polynucleotide
taatacgactcactatagggctgaccacagcgaactgtgtgcctggttcgaacagaggagacgaaccatgcacacagttaacctggcggcagcgcaaaagatg

SEQ ID NO: 169795 - DNA, 103 bp, Artificial Sequence
  Synthetic Polynucleotide
taatacgactcactatagggctgagacagcctgaccacagcgaactgtgtaacagaggagaacacagatggctgtggtcaacctggcggcagcgcaaaagatg

SEQ ID NO: 169796 - DNA, 103 bp, Artificial Sequence
  Synthetic Polynucleotide
taatacgactcactataggggaacagtggactgagacagcctgaccacagaacagaggagactgtggatgggctgtctcaacctggcggcagcgcaaaagatg

SEQ ID NO: 169797 - DNA, 103 bp, Artificial Sequence
  Synthetic Polynucleotide
taatacgactcactatagggacatgggttagaacagtggactgagacagcaacagaggagagctgtcatggtccactgtaacctggcggcagcgcaaaagatg

SEQ ID NO: 169798 - DNA, 103 bp, Artificial Sequence
  Synthetic Polynucleotide
taatacgactcactatagggaaatattctcacatgggttagaacagtggaaacagaggagatccactatgctaacccataacctggcggcagcgcaaaagatg

SEQ ID NO: 169799 - DNA, 103 bp, Artificial Sequence
  Synthetic Polynucleotide
taatacgactcactataggggaaaggtgacagggaggtggtgaactgtaaaacagaggagattacagatgaccacctccaacctggcggcagcgcaaaagatg

SEQ ID NO: 169800 - DNA, 103 bp, Artificial Sequence
  Synthetic Polynucleotide
taatacgactcactatagggccacagttcaaaatattctcacatgggttaaacagaggagataacccatgtgagaatataacctggcggcagcgcaaaagatg

SEQ ID NO: 169801 - DNA, 103 bp, Artificial Sequence
  Synthetic Polynucleotide
taatacgactcactatagggctggtgctgaccacagttcaaaatattctcaacagaggagagagaatatgttgaactgtaacctggcggcagcgcaaaagatg

SEQ ID NO: 169802 - DNA, 103 bp, Artificial Sequence
  Synthetic Polynucleotide
taatacgactcactataggggctcagcacactggtgctgaccacagttcaaacagaggagatgaactatggtcagcaccaacctggcggcagcgcaaaagatg

SEQ ID NO: 169803 - DNA, 103 bp, Artificial Sequence
  Synthetic Polynucleotide
taatacgactcactatagggccatggcacagctcagcacactggtgctgaaacagaggagatcagcaatggtgtgctgaaacctggcggcagcgcaaaagatg

SEQ ID NO: 169804 - DNA, 103 bp, Artificial Sequence
  Synthetic Polynucleotide
taatacgactcactataggggcactgacccccatggcacagctcagcacaaacagaggagatgtgctatgctgtgccataacctggcggcagcgcaaaagatg

SEQ ID NO: 169805 - DNA, 103 bp, Artificial Sequence
  Synthetic Polynucleotide
taatacgactcactatagggggcaaggctggcactgacccccatggcacaaacagaggagatgtgccatgggggtcagtaacctggcggcagcgcaaaagatg

SEQ ID NO: 169806 - DNA, 103 bp, Artificial Sequence
  Synthetic Polynucleotide
taatacgactcactatagggaaaatgatctggcaaggctggcactgacccaacagaggagagggtcaatgccagccttgaacctggcggcagcgcaaaagatg

SEQ ID NO: 169807 - DNA, 103 bp, Artificial Sequence
  Synthetic Polynucleotide
taatacgactcactatagggtacctggttcaaaatgatctggcaaggctgaacagaggagacagcctatgcagatcattaacctggcggcagcgcaaaagatg

SEQ ID NO: 169808 - DNA, 103 bp, Artificial Sequence
  Synthetic Polynucleotide
taatacgactcactatagggcgcaatagcatacctggttcaaaatgatctaacagaggagaagatcaatgtgaaccaggaacctggcggcagcgcaaaagatg

SEQ ID NO: 169809 - DNA, 103 bp, Artificial Sequence
  Synthetic Polynucleotide
taatacgactcactataggggaggtgctgccgcaatagcatacctggttcaacagaggagagaaccaatgatgctattgaacctggcggcagcgcaaaagatg

SEQ ID NO: 169810 - DNA, 103 bp, Artificial Sequence
  Synthetic Polynucleotide
taatacgactcactataggggacctgcctggaaaggtgacagggaggtggaacagaggagaccacctatgtgtcaccttaacctggcggcagcgcaaaagatg

SEQ ID NO: 169811 - DNA, 103 bp, Artificial Sequence
  Synthetic Polynucleotide
taatacgactcactatagggcacatctcgggaggtgctgccgcaatagcaaacagaggagatgctatatgggcagcaccaacctggcggcagcgcaaaagatg

SEQ ID NO: 169812 - DNA, 103 bp, Artificial Sequence
  Synthetic Polynucleotide
taatacgactcactatagggttccacataacacatctcgggaggtgctgcaacagaggagagcagcaatgcccgagatgaacctggcggcagcgcaaaagatg

SEQ ID NO: 169813 - DNA, 103 bp, Artificial Sequence
  Synthetic Polynucleotide
taatacgactcactatagggcctacatcggttccacataacacatctcggaacagaggagaccgagaatggttatgtggaacctggcggcagcgcaaaagatg

SEQ ID NO: 169814 - DNA, 103 bp, Artificial Sequence
  Synthetic Polynucleotide
taatacgactcactatagggatcagactttcctacatcggttccacataaaacagaggagattatgtatgaccgatgtaaacctggcggcagcgcaaaagatg

SEQ ID NO: 169815 - DNA, 103 bp, Artificial Sequence
  Synthetic Polynucleotide
taatacgactcactatagggccccaaatccatcagactttcctacatcggaacagaggagaccgatgatggaaagtctgaacctggcggcagcgcaaaagatg

SEQ ID NO: 169816 - DNA, 103 bp, Artificial Sequence
  Synthetic Polynucleotide
taatacgactcactatagggcagctgaaatccccaaatccatcagactttaacagaggagaaaagtcatgtggatttggaacctggcggcagcgcaaaagatg

SEQ ID NO: 169817 - DNA, 103 bp, Artificial Sequence
  Synthetic Polynucleotide
taatacgactcactatagggtatctttaaacagctgaaatccccaaatccaacagaggagaggatttatggatttcagcaacctggcggcagcgcaaaagatg

SEQ ID NO: 169818 - DNA, 103 bp, Artificial Sequence
  Synthetic Polynucleotide
taatacgactcactatagggccttgccacatatctttaaacagctgaaataacagaggagaatttcaatggtttaaagaaacctggcggcagcgcaaaagatg

SEQ ID NO: 169819 - DNA, 103 bp, Artificial Sequence
  Synthetic Polynucleotide
taatacgactcactatagggcatttcaagtccttgccacatatctttaaaaacagaggagatttaaaatgatgtggcaaaacctggcggcagcgcaaaagatg

SEQ ID NO: 169820 - DNA, 103 bp, Artificial Sequence
  Synthetic Polynucleotide
taatacgactcactatagggatggttaccgcatttcaagtccttgccacaaacagaggagatgtggcatggacttgaaaaacctggcggcagcgcaaaagatg

SEQ ID NO: 169821 - DNA, 103 bp, Artificial Sequence
  Synthetic Polynucleotide
taatacgactcactatagggcatcataagggacctgcctggaaaggtgacaacagaggagagtcaccatgccaggcaggaacctggcggcagcgcaaaagatg

SEQ ID NO: 169822 - DNA, 103 bp, Artificial Sequence
  Synthetic Polynucleotide
taatacgactcactataggggcgaacatgtatggttaccgcatttcaagtaacagaggagaacttgaatggcggtaaccaacctggcggcagcgcaaaagatg

SEQ ID NO: 169823 - DNA, 103 bp, Artificial Sequence
  Synthetic Polynucleotide
taatacgactcactatagggtggcacacttgcgaacatgtatggttaccgaacagaggagacggtaaatgtacatgttcaacctggcggcagcgcaaaagatg

SEQ ID NO: 169824 - DNA, 103 bp, Artificial Sequence
  Synthetic Polynucleotide
taatacgactcactataggggggctgagggtggcacacttgcgaacatgtaacagaggagaacatgtatgcaagtgtgcaacctggcggcagcgcaaaagatg

SEQ ID NO: 169825 - DNA, 103 bp, Artificial Sequence
  Synthetic Polynucleotide
taatacgactcactatagggattgctggcagggctgagggtggcacacttaacagaggagaaagtgtatgaccctcagcaacctggcggcagcgcaaaagatg

SEQ ID NO: 169826 - DNA, 103 bp, Artificial Sequence
  Synthetic Polynucleotide
taatacgactcactatagggagccgtgggcattgctggcagggctgagggaacagaggagaccctcaatgctgccagcaaacctggcggcagcgcaaaagatg

SEQ ID NO: 169827 - DNA, 103 bp, Artificial Sequence
  Synthetic Polynucleotide
taatacgactcactatagggcagctgggggagccgtgggcattgctggcaaacagaggagatgccagatgtgcccacggaacctggcggcagcgcaaaagatg

SEQ ID NO: 169828 - DNA, 103 bp, Artificial Sequence
  Synthetic Polynucleotide
taatacgactcactatagggaacagcgcaccagctgggggagccgtgggcaacagaggagagcccacatgtcccccagcaacctggcggcagcgcaaaagatg

SEQ ID NO: 169829 - DNA, 103 bp, Artificial Sequence
  Synthetic Polynucleotide
taatacgactcactatagggccacaggggcaacagcgcaccagctgggggaacagaggagacccccaatgggtgcgctgaacctggcggcagcgcaaaagatg

SEQ ID NO: 169830 - DNA, 103 bp, Artificial Sequence
  Synthetic Polynucleotide
taatacgactcactatagggaggagtttggccacaggggcaacagcgcacaacagaggagagtgcgcatgtgcccctgtaacctggcggcagcgcaaaagatg

SEQ ID NO: 169831 - DNA, 103 bp, Artificial Sequence
  Synthetic Polynucleotide
taatacgactcactatagggattggctgagaggagtttggccacaggggcaacagaggagagcccctatggccaaactcaacctggcggcagcgcaaaagatg

SEQ ID NO: 169832 - DNA, 103 bp, Artificial Sequence
  Synthetic Polynucleotide
taatacgactcactataggggcagagatttcatcataagggacctgcctgaacagaggagacaggcaatgcccttatgaaacctggcggcagcgcaaaagatg

SEQ ID NO: 169833 - DNA, 103 bp, Artificial Sequence
  Synthetic Polynucleotide
taatacgactcactatagggagttctagcaattggctgagaggagtttggaacagaggagaccaaacatgtctcagccaaacctggcggcagcgcaaaagatg

SEQ ID NO: 169834 - DNA, 103 bp, Artificial Sequence
  Synthetic Polynucleotide
taatacgactcactatagggactacttccaagttctagcaattggctgagaacagaggagactcagcatgttgctagaaaacctggcggcagcgcaaaagatg

SEQ ID NO: 169835 - DNA, 103 bp, Artificial Sequence
  Synthetic Polynucleotide
taatacgactcactatagggttttccgactactacttccaagttctagcaaacagaggagatgctagatgttggaagtaaacctggcggcagcgcaaaagatg

SEQ ID NO: 169836 - DNA, 103 bp, Artificial Sequence
  Synthetic Polynucleotide
taatacgactcactatagggtccatgcatgttttccgactactacttccaaacagaggagatggaagatgtagtcggaaaacctggcggcagcgcaaaagatg

SEQ ID NO: 169837 - DNA, 103 bp, Artificial Sequence
  Synthetic Polynucleotide
taatacgactcactatagggaggcacagggtccatgcatgttttccgactaacagaggagaagtcggatgacatgcatgaacctggcggcagcgcaaaagatg

SEQ ID NO: 169838 - DNA, 103 bp, Artificial Sequence
  Synthetic Polynucleotide
taatacgactcactatagggttccacatgaaggcacagggtccatgcatgaacagaggagacatgcaatgaccctgtgcaacctggcggcagcgcaaaagatg

SEQ ID NO: 169839 - DNA, 103 bp, Artificial Sequence
  Synthetic Polynucleotide
taatacgactcactatagggccgcacacttttccacatgaaggcacagggaacagaggagaccctgtatgttcatgtggaacctggcggcagcgcaaaagatg

SEQ ID NO: 169840 - DNA, 103 bp, Artificial Sequence
  Synthetic Polynucleotide
taatacgactcactatagggcagaggcttgccgcacacttttccacatgaaacagaggagatcatgtatgaaagtgtgcaacctggcggcagcgcaaaagatg

SEQ ID NO: 169841 - DNA, 103 bp, Artificial Sequence
  Synthetic Polynucleotide
taatacgactcactatagggaaccacaaggcagaggcttgccgcacacttaacagaggagaaagtgtatggcaagcctcaacctggcggcagcgcaaaagatg

SEQ ID NO: 169842 - DNA, 103 bp, Artificial Sequence
  Synthetic Polynucleotide
taatacgactcactatagggaaatctaaggaaccacaaggcagaggcttgaacagaggagacaagccatggccttgtggaacctggcggcagcgcaaaagatg

SEQ ID NO: 169843 - DNA, 103 bp, Artificial Sequence
  Synthetic Polynucleotide
taatacgactcactatagggctgatgaacagcagagatttcatcataaggaacagaggagaccttatatggaaatctctaacctggcggcagcgcaaaagatg

SEQ ID NO: 169844 - DNA, 103 bp, Artificial Sequence
  Synthetic Polynucleotide
taatacgactcactatagggggtatgaatgaaatctaaggaaccacaaggaacagaggagaccttgtatgtccttagataacctggcggcagcgcaaaagatg

SEQ ID NO: 169845 - DNA, 103 bp, Artificial Sequence
  Synthetic Polynucleotide
taatacgactcactataggggcttttcacaggtatgaatgaaatctaaggaacagaggagaccttagatgtcattcataaacctggcggcagcgcaaaagatg

SEQ ID NO: 169846 - DNA, 103 bp, Artificial Sequence
  Synthetic Polynucleotide
taatacgactcactatagggtcatggcagagcttttcacaggtatgaatgaacagaggagacattcaatgctgtgaaaaaacctggcggcagcgcaaaagatg

SEQ ID NO: 169847 - DNA, 103 bp, Artificial Sequence
  Synthetic Polynucleotide
taatacgactcactatagggacagtctccttcatggcagagcttttcacaaacagaggagatgtgaaatgctctgccataacctggcggcagcgcaaaagatg

SEQ ID NO: 169848 - DNA, 103 bp, Artificial Sequence
  Synthetic Polynucleotide
taatacgactcactatagggagcatggtccacagtctccttcatggcagaaacagaggagatctgccatgaaggagactaacctggcggcagcgcaaaagatg

SEQ ID NO: 169849 - DNA, 103 bp, Artificial Sequence
  Synthetic Polynucleotide
taatacgactcactataggggatgtgcgagagcatggtccacagtctcctaacagaggagaaggagaatgtggaccatgaacctggcggcagcgcaaaagatg

SEQ ID NO: 169850 - DNA, 103 bp, Artificial Sequence
  Synthetic Polynucleotide
taatacgactcactatagggggaaataactgatgtgcgagagcatggtccaacagaggagaggaccaatgtctcgcacaaacctggcggcagcgcaaaagatg

SEQ ID NO: 169851 - DNA, 103 bp, Artificial Sequence
  Synthetic Polynucleotide
taatacgactcactatagggagcatctgcaggaaataactgatgtgcgagaacagaggagactcgcaatgcagttatttaacctggcggcagcgcaaaagatg

SEQ ID NO: 169852 - DNA, 103 bp, Artificial Sequence
  Synthetic Polynucleotide
taatacgactcactataggggttctgaaagagcatctgcaggaaataactaacagaggagaagttatatgctgcagatgaacctggcggcagcgcaaaagatg

SEQ ID NO: 169853 - DNA, 103 bp, Artificial Sequence
  Synthetic Polynucleotide
taatacgactcactatagggaagctcctttgttctgaaagagcatctgcaaacagaggagatgcagaatgtctttcagaaacctggcggcagcgcaaaagatg

SEQ ID NO: 169854 - DNA, 103 bp, Artificial Sequence
  Synthetic Polynucleotide
taatacgactcactatagggtgaatttaaaagtacctgagacaggaggcgaacagaggagacgcctcatgtctcaggtaaacctggcggcagcgcaaaagatg

SEQ ID NO: 169855 - DNA, 103 bp, Artificial Sequence
  Synthetic Polynucleotide
taatacgactcactataggggataactatgctgatgaacagcagagatttaacagaggagaaaatctatgctgttcatcaacctggcggcagcgcaaaagatg

SEQ ID NO: 169856 - DNA, 103 bp, Artificial Sequence
  Synthetic Polynucleotide
taatacgactcactatagggtggtacatggaagctcctttgttctgaaagaacagaggagactttcaatgcaaaggagcaacctggcggcagcgcaaaagatg

SEQ ID NO: 169857 - DNA, 103 bp, Artificial Sequence
  Synthetic Polynucleotide
taatacgactcactatagggcttttgagactggtacatggaagctcctttaacagaggagaaaaggaatgtccatgtacaacctggcggcagcgcaaaagatg

SEQ ID NO: 169858 - DNA, 103 bp, Artificial Sequence
  Synthetic Polynucleotide
taatacgactcactatagggagcatcttcacttttgagactggtacatggaacagaggagaccatgtatgagtctcaaaaacctggcggcagcgcaaaagatg

SEQ ID NO: 169859 - DNA, 103 bp, Artificial Sequence
  Synthetic Polynucleotide
taatacgactcactatagggacataaatgtagcatcttcacttttgagacaacagaggagagtctcaatggtgaagatgaacctggcggcagcgcaaaagatg

SEQ ID NO: 169860 - DNA, 103 bp, Artificial Sequence
  Synthetic Polynucleotide
taatacgactcactatagggcgcttgtcacacataaatgtagcatcttcaaacagaggagatgaagaatgtacatttataacctggcggcagcgcaaaagatg

SEQ ID NO: 169861 - DNA, 103 bp, Artificial Sequence
  Synthetic Polynucleotide
taatacgactcactatagggcttgttacaccgcttgtcacacataaatgtaacagaggagaacatttatgtgtgacaagaacctggcggcagcgcaaaagatg

SEQ ID NO: 169862 - DNA, 103 bp, Artificial Sequence
  Synthetic Polynucleotide
taatacgactcactatagggacaaccgtttcttgttacaccgcttgtcacaacagaggagagtgacaatgggtgtaacaaacctggcggcagcgcaaaagatg

SEQ ID NO: 169863 - DNA, 103 bp, Artificial Sequence
  Synthetic Polynucleotide
taatacgactcactatagggtgccgtccacacaaccgtttcttgttacacaacagaggagagtgtaaatggaaacggttaacctggcggcagcgcaaaagatg

SEQ ID NO: 169864 - DNA, 103 bp, Artificial Sequence
  Synthetic Polynucleotide
taatacgactcactatagggattacatttatgccgtccacacaaccgtttaacagaggagaaaacggatgtgtggacggaacctggcggcagcgcaaaagatg

SEQ ID NO: 169865 - DNA, 103 bp, Artificial Sequence
  Synthetic Polynucleotide
taatacgactcactatagggagcatatctcattacatttatgccgtccacaacagaggagagtggacatgataaatgtaaacctggcggcagcgcaaaagatg

SEQ ID NO: 169866 - DNA, 103 bp, Artificial Sequence
  Synthetic Polynucleotide
taatacgactcactatagggcctgacggatgataactatgctgatgaacaaacagaggagatgttcaatggcatagttaaacctggcggcagcgcaaaagatg

SEQ ID NO: 169867 - DNA, 103 bp, Artificial Sequence
  Synthetic Polynucleotide
taatacgactcactatagggttatccacacagcatatctcattacatttaaacagaggagataaatgatgtgagatatgaacctggcggcagcgcaaaagatg

SEQ ID NO: 169868 - DNA, 103 bp, Artificial Sequence
  Synthetic Polynucleotide
taatacgactcactatagggcttgtgctccttatccacacagcatatctcaacagaggagagagataatgtgtgtggataacctggcggcagcgcaaaagatg

SEQ ID NO: 169869 - DNA, 103 bp, Artificial Sequence
  Synthetic Polynucleotide
taatacgactcactatagggtcaaaggacacttgtgctccttatccacacaacagaggagagtgtggatgaggagcacaaacctggcggcagcgcaaaagatg

SEQ ID NO: 169870 - DNA, 103 bp, Artificial Sequence
  Synthetic Polynucleotide
taatacgactcactatagggctcccacaaatcaaaggacacttgtgctccaacagaggagaggagcaatggtgtcctttaacctggcggcagcgcaaaagatg

SEQ ID NO: 169871 - DNA, 103 bp, Artificial Sequence
  Synthetic Polynucleotide
taatacgactcactatagggacggagtttcctcccacaaatcaaaggacaaacagaggagatgtcctatgatttgtgggaacctggcggcagcgcaaaagatg

SEQ ID NO: 169872 - DNA, 103 bp, Artificial Sequence
  Synthetic Polynucleotide
taatacgactcactataggggaaggccacaacggagtttcctcccacaaaaacagaggagatttgtgatgggaaactccaacctggcggcagcgcaaaagatg

SEQ ID NO: 169873 - DNA, 103 bp, Artificial Sequence
  Synthetic Polynucleotide
taatacgactcactatagggtcacacctatgaaggccacaacggagtttcaacagaggagagaaactatgttgtggcctaacctggcggcagcgcaaaagatg

SEQ ID NO: 169874 - DNA, 103 bp, Artificial Sequence
  Synthetic Polynucleotide
taatacgactcactatagggacaaggttcttcacacctatgaaggccacaaacagaggagatgtggcatgcataggtgtaacctggcggcagcgcaaaagatg

SEQ ID NO: 169875 - DNA, 103 bp, Artificial Sequence
  Synthetic Polynucleotide
taatacgactcactatagggttccacgatgacaaggttcttcacacctataacagaggagaataggtatgaagaaccttaacctggcggcagcgcaaaagatg

SEQ ID NO: 169876 - DNA, 103 bp, Artificial Sequence
  Synthetic Polynucleotide
taatacgactcactataggggtctggcagtttccacgatgacaaggttctaacagaggagaagaaccatgtcatcgtggaacctggcggcagcgcaaaagatg

SEQ ID NO: 169877 - DNA, 103 bp, Artificial Sequence
  Synthetic Polynucleotide
taatacgactcactatagggaggtttgcttcctgacggatgataactatgaacagaggagacatagtatgcatccgtcaaacctggcggcagcgcaaaagatg

SEQ ID NO: 169878 - DNA, 103 bp, Artificial Sequence
  Synthetic Polynucleotide
taatacgactcactatagggttgccagcatgtctggcagtttccacgatgaacagaggagacatcgtatgaactgccagaacctggcggcagcgcaaaagatg

SEQ ID NO: 169879 - DNA, 103 bp, Artificial Sequence
  Synthetic Polynucleotide
taatacgactcactatagggcaaaactggcttgccagcatgtctggcagtaacagaggagaactgccatgcatgctggcaacctggcggcagcgcaaaagatg

SEQ ID NO: 169880 - DNA, 103 bp, Artificial Sequence
  Synthetic Polynucleotide
taatacgactcactataggggttaattcatcaaaactggcttgccagcataacagaggagaatgctgatgagccagtttaacctggcggcagcgcaaaagatg

SEQ ID NO: 169881 - DNA, 103 bp, Artificial Sequence
  Synthetic Polynucleotide
taatacgactcactatagggacaatggcaggttaattcatcaaaactggcaacagaggagagccagtatggatgaattaaacctggcggcagcgcaaaagatg

SEQ ID NO: 169882 - DNA, 103 bp, Artificial Sequence
  Synthetic Polynucleotide
taatacgactcactatagggctgatgcaccacaatggcaggttaattcataacagaggagaatgaatatgcctgccattaacctggcggcagcgcaaaagatg

SEQ ID NO: 169883 - DNA, 103 bp, Artificial Sequence
  Synthetic Polynucleotide
taatacgactcactataggggggtaaatcactgatgcaccacaatggcagaacagaggagactgccaatgtggtgcatcaacctggcggcagcgcaaaagatg

SEQ ID NO: 169884 - DNA, 103 bp, Artificial Sequence
  Synthetic Polynucleotide
taatacgactcactataggggggaactggagggtaaatcactgatgcaccaacagaggagaggtgcaatggtgatttacaacctggcggcagcgcaaaagatg

SEQ ID NO: 169885 - DNA, 103 bp, Artificial Sequence
  Synthetic Polynucleotide
taatacgactcactatagggtagtaccacagggaactggagggtaaatcaaacagaggagatgatttatgctccagttcaacctggcggcagcgcaaaagatg

SEQ ID NO: 169886 - DNA, 103 bp, Artificial Sequence
  Synthetic Polynucleotide
taatacgactcactatagggtcagggggcctagtaccacagggaactggaaacagaggagatccagtatgctgtggtacaacctggcggcagcgcaaaagatg

SEQ ID NO: 169887 - DNA, 103 bp, Artificial Sequence
  Synthetic Polynucleotide
taatacgactcactatagggttgggtacattcagggggcctagtaccacaaacagaggagatgtggtatgaggccccctaacctggcggcagcgcaaaagatg

SEQ ID NO: 169888 - DNA, 103 bp, Artificial Sequence
  Synthetic Polynucleotide
taatacgactcactataggggctgactcttaggtttgcttcctgacggataacagaggagaatccgtatggaagcaaacaacctggcggcagcgcaaaagatg

SEQ ID NO: 169889 - DNA, 103 bp, Artificial Sequence
  Synthetic Polynucleotide
taatacgactcactatagggtagcgcaggtttgggtacattcagggggccaacagaggagaggccccatgaatgtacccaacctggcggcagcgcaaaagatg

SEQ ID NO: 169890 - DNA, 103 bp, Artificial Sequence
  Synthetic Polynucleotide
taatacgactcactatagggtcatggactctagcgcaggtttgggtacataacagaggagaatgtacatgaacctgcgcaacctggcggcagcgcaaaagatg

SEQ ID NO: 169891 - DNA, 103 bp, Artificial Sequence
  Synthetic Polynucleotide
taatacgactcactatagggatggtcacactcatggactctagcgcaggtaacagaggagaacctgcatgagagtccataacctggcggcagcgcaaaagatg

SEQ ID NO: 169892 - DNA, 103 bp, Artificial Sequence
  Synthetic Polynucleotide
taatacgactcactataggggatatactggatggtcacactcatggactcaacagaggagagagtccatgagtgtgaccaacctggcggcagcgcaaaagatg

SEQ ID NO: 169893 - DNA, 103 bp, Artificial Sequence
  Synthetic Polynucleotide
taatacgactcactatagggtgacaagaatgatatactggatggtcacacaacagaggagagtgtgaatgtccagtataaacctggcggcagcgcaaaagatg

SEQ ID NO: 169894 - DNA, 103 bp, Artificial Sequence
  Synthetic Polynucleotide
taatacgactcactatagggctcctcactatgacaagaatgatatactggaacagaggagaccagtaatgcattcttgtaacctggcggcagcgcaaaagatg

SEQ ID NO: 169895 - DNA, 103 bp, Artificial Sequence
  Synthetic Polynucleotide
taatacgactcactatagggggggacacttctcctcactatgacaagaataacagaggagaattcttatgatagtgaggaacctggcggcagcgcaaaagatg

SEQ ID NO: 169896 - DNA, 103 bp, Artificial Sequence
  Synthetic Polynucleotide
taatacgactcactatagggaaagtgcaagggggacacttctcctcactaaacagaggagatagtgaatggaagtgtccaacctggcggcagcgcaaaagatg

SEQ ID NO: 169897 - DNA, 103 bp, Artificial Sequence
  Synthetic Polynucleotide
taatacgactcactatagggctgagttaggaaagtgcaagggggacacttaacagaggagaaagtgtatgccttgcactaacctggcggcagcgcaaaagatg

SEQ ID NO: 169898 - DNA, 103 bp, Artificial Sequence
  Synthetic Polynucleotide
taatacgactcactatagggtgcaccacttctgagttaggaaagtgcaagaacagaggagacttgcaatgtcctaactcaacctggcggcagcgcaaaagatg

SEQ ID NO: 169899 - DNA, 103 bp, Artificial Sequence
  Synthetic Polynucleotide
taatacgactcactatagggaaagacgtctgctgactcttaggtttgcttaacagaggagaaagcaaatgtaagagtcaaacctggcggcagcgcaaaagatg

SEQ ID NO: 169900 - DNA, 103 bp, Artificial Sequence
  Synthetic Polynucleotide
taatacgactcactatagggtgcttgcccatgcaccacttctgagttaggaacagaggagacctaacatggaagtggtgaacctggcggcagcgcaaaagatg

SEQ ID NO: 169901 - DNA, 103 bp, Artificial Sequence
  Synthetic Polynucleotide
taatacgactcactatagggggactgctcatgcttgcccatgcaccacttaacagaggagaaagtggatgatgggcaagaacctggcggcagcgcaaaagatg

SEQ ID NO: 169902 - DNA, 103 bp, Artificial Sequence
  Synthetic Polynucleotide
taatacgactcactatagggcccagtagtgggactgctcatgcttgcccaaacagaggagatgggcaatgatgagcagtaacctggcggcagcgcaaaagatg

SEQ ID NO: 169903 - DNA, 103 bp, Artificial Sequence
  Synthetic Polynucleotide
taatacgactcactatagggtgggtagacgcccagtagtgggactgctcaaacagaggagatgagcaatgccactactgaacctggcggcagcgcaaaagatg

SEQ ID NO: 169904 - DNA, 103 bp, Artificial Sequence
  Synthetic Polynucleotide
taatacgactcactatagggtcttttcttctgggtagacgcccagtagtgaacagaggagacactacatggcgtctaccaacctggcggcagcgcaaaagatg

SEQ ID NO: 169905 - DNA, 103 bp, Artificial Sequence
  Synthetic Polynucleotide
taatacgactcactatagggtataatgacttcttttcttctgggtagacgaacagaggagacgtctaatgagaagaaaaaacctggcggcagcgcaaaagatg

SEQ ID NO: 169906 - DNA, 103 bp, Artificial Sequence
  Synthetic Polynucleotide
taatacgactcactatagggatctttttcatataatgacttcttttcttcaacagaggagagaagaaatgaagtcattaaacctggcggcagcgcaaaagatg

SEQ ID NO: 169907 - DNA, 103 bp, Artificial Sequence
  Synthetic Polynucleotide
taatacgactcactataggggtgtgcaggtatctttttcatataatgactaacagaggagaagtcatatgatgaaaaagaacctggcggcagcgcaaaagatg

SEQ ID NO: 169908 - DNA, 103 bp, Artificial Sequence
  Synthetic Polynucleotide
taatacgactcactatagggataaacatgcgtgtgcaggtatctttttcaaacagaggagatgaaaaatgtacctgcacaacctggcggcagcgcaaaagatg

SEQ ID NO: 169909 - DNA, 103 bp, Artificial Sequence
  Synthetic Polynucleotide
taatacgactcactatagggagaggactggaaagacgtctgctgactcttaacagaggagaaagagtatgcagacgtctaacctggcggcagcgcaaaagatg

SEQ ID NO: 169910 - DNA, 103 bp, Artificial Sequence
  Synthetic Polynucleotide
taatacgactcactatagggtattacaaggagaggactggaaagacgtctaacagaggagaagacgtatgtccagtcctaacctggcggcagcgcaaaagatg

SEQ ID NO: 169911 - DNA, 103 bp, Artificial Sequence
  Synthetic Polynucleotide
taatacgactcactatagggttgggcgatttattacaaggagaggactggaacagaggagaccagtcatgtccttgtaaaacctggcggcagcgcaaaagatg

SEQ ID NO: 169912 - DNA, 103 bp, Artificial Sequence
  Synthetic Polynucleotide
taatacgactcactataggggccatggctcttgggcgatttattacaaggaacagaggagaccttgtatgaaatcgcccaacctggcggcagcgcaaaagatg

SEQ ID NO: 169913 - DNA, 103 bp, Artificial Sequence
  Synthetic Polynucleotide
taatacgactcactataggggattctgaaggccatggctcttgggcgattaacagaggagaaatcgcatgagagccatgaacctggcggcagcgcaaaagatg

SEQ ID NO: 169914 - DNA, 103 bp, Artificial Sequence
  Synthetic Polynucleotide
taatacgactcactataggggcatctgtattgaatttaaaagtacctgagaacagaggagactcaggatgttttaaattaacctggcggcagcgcaaaagatg

SEQ ID NO: 169915 - DNA, 103 bp, Artificial Sequence
  Synthetic Polynucleotide
taatacgactcactatagggtgccaaggttgattctgaaggccatggctcaacagaggagagagccaatgccttcagaaaacctggcggcagcgcaaaagatg

SEQ ID NO: 169916 - DNA, 103 bp, Artificial Sequence
  Synthetic Polynucleotide
taatacgactcactatagggcctcaatttctgccaaggttgattctgaagaacagaggagacttcagatgcaaccttggaacctggcggcagcgcaaaagatg

SEQ ID NO: 169917 - DNA, 103 bp, Artificial Sequence
  Synthetic Polynucleotide
taatacgactcactataggggcttctcattcctcaatttctgccaaggttaacagaggagaaaccttatgagaaattgaaacctggcggcagcgcaaaagatg

SEQ ID NO: 169918 - DNA, 103 bp, Artificial Sequence
  Synthetic Polynucleotide
taatacgactcactatagggctgatatggtgcttctcattcctcaatttcaacagaggagagaaattatggaatgagaaaacctggcggcagcgcaaaagatg

SEQ ID NO: 169919 - DNA, 103 bp, Artificial Sequence
  Synthetic Polynucleotide
taatacgactcactatagggtttcttgactctgatatggtgcttctcattaacagaggagaaatgagatgcaccatatcaacctggcggcagcgcaaaagatg

SEQ ID NO: 169920 - DNA, 103 bp, Artificial Sequence
  Synthetic Polynucleotide
taatacgactcactataggggactctgtgctttcttgactctgatatggtaacagaggagaaccataatggagtcaagaaacctggcggcagcgcaaaagatg

SEQ ID NO: 169921 - DNA, 103 bp, Artificial Sequence
  Synthetic Polynucleotide
taatacgactcactatagggtgctcagcaagactctgtgctttcttgactaacagaggagaagtcaaatgagcacagagaacctggcggcagcgcaaaagatg

SEQ ID NO: 169922 - DNA, 103 bp, Artificial Sequence
  Synthetic Polynucleotide
taatacgactcactatagggatctgaggtctgctcagcaagactctgtgcaacagaggagagcacagatgcttgctgagaacctggcggcagcgcaaaagatg

SEQ ID NO: 169923 - DNA, 103 bp, Artificial Sequence
  Synthetic Polynucleotide
taatacgactcactatagggatccagctgtatctgaggtctgctcagcaaaacagaggagattgctgatgagacctcagaacctggcggcagcgcaaaagatg

SEQ ID NO: 169924 - DNA, 103 bp, Artificial Sequence
  Synthetic Polynucleotide
taatacgactcactataggggagctctctaatccagctgtatctgaggtcaacagaggagagacctcatgtacagctggaacctggcggcagcgcaaaagatg

SEQ ID NO: 169925 - DNA, 103 bp, Artificial Sequence
  Synthetic Polynucleotide
taatacgactcactataggggaattcagcagcatctgtattgaatttaaaaacagaggagatttaaaatgaatacagataacctggcggcagcgcaaaagatg

SEQ ID NO: 169926 - DNA, 103 bp, Artificial Sequence
  Synthetic Polynucleotide
taatacgactcactatagggtgatctggtcgagctctctaatccagctgtaacagaggagaacagctatgttagagagcaacctggcggcagcgcaaaagatg

SEQ ID NO: 169927 - DNA, 103 bp, Artificial Sequence
  Synthetic Polynucleotide
taatacgactcactatagggtcccactctctgatctggtcgagctctctaaacagaggagatagagaatgcgaccagataacctggcggcagcgcaaaagatg

SEQ ID NO: 169928 - DNA, 103 bp, Artificial Sequence
  Synthetic Polynucleotide
taatacgactcactatagggctgaggtctgtcccactctctgatctggtcaacagaggagagaccagatgagagagtggaacctggcggcagcgcaaaagatg

SEQ ID NO: 169929 - DNA, 103 bp, Artificial Sequence
  Synthetic Polynucleotide
taatacgactcactatagggactatgctctctgaggtctgtcccactctcaacagaggagagagagtatgacagacctcaacctggcggcagcgcaaaagatg

SEQ ID NO: 169930 - DNA, 103 bp, Artificial Sequence
  Synthetic Polynucleotide
taatacgactcactatagggtctcagaaggactatgctctctgaggtctgaacagaggagacagaccatggagagcataaacctggcggcagcgcaaaagatg

SEQ ID NO: 169931 - DNA, 103 bp, Artificial Sequence
  Synthetic Polynucleotide
taatacgactcactatagggtccttctcactctcagaaggactatgctctaacagaggagaagagcaatgtccttctgaaacctggcggcagcgcaaaagatg

SEQ ID NO: 169932 - DNA, 103 bp, Artificial Sequence
  Synthetic Polynucleotide
taatacgactcactatagggacccacaacttccttctcactctcagaaggaacagaggagaccttctatgagtgagaagaacctggcggcagcgcaaaagatg

SEQ ID NO: 169933 - DNA, 103 bp, Artificial Sequence
  Synthetic Polynucleotide
taatacgactcactatagggtgggatctgcacccacaacttccttctcacaacagaggagagtgagaatgaagttgtggaacctggcggcagcgcaaaagatg

SEQ ID NO: 169934 - DNA, 103 bp, Artificial Sequence
  Synthetic Polynucleotide
taatacgactcactatagggtttgctcccctgggatctgcacccacaactaacagaggagaagttgtatgtgcagatccaacctggcggcagcgcaaaagatg

SEQ ID NO: 169935 - DNA, 103 bp, Artificial Sequence
  Synthetic Polynucleotide
taatacgactcactatagggttttttgggttttgctcccctgggatctgcaacagaggagagcagatatgaggggagcaaacctggcggcagcgcaaaagatg

SEQ ID NO: 169936 - DNA, 103 bp, Artificial Sequence
  Synthetic Polynucleotide
taatacgactcactatagggcctgaggaatgaattcagcagcatctgtataacagaggagaatacagatgctgctgaataacctggcggcagcgcaaaagatg

SEQ ID NO: 169937 - DNA, 103 bp, Artificial Sequence
  Synthetic Polynucleotide
taatacgactcactatagggactgtgttgcttttttgggttttgctccccaacagaggagaggggagatgaacccaaaaaacctggcggcagcgcaaaagatg

SEQ ID NO: 169938 - DNA, 103 bp, Artificial Sequence
  Synthetic Polynucleotide
taatacgactcactatagggctgtatacaaactgtgttgcttttttgggtaacagaggagaacccaaatgagcaacacaaacctggcggcagcgcaaaagatg

SEQ ID NO: 169939 - DNA, 103 bp, Artificial Sequence
  Synthetic Polynucleotide
taatacgactcactatagggtctaccatagctgtatacaaactgtgttgcaacagaggagagcaacaatgtttgtatacaacctggcggcagcgcaaaagatg

SEQ ID NO: 169940 - DNA, 103 bp, Artificial Sequence
  Synthetic Polynucleotide
taatacgactcactatagggcttttggtcctctaccatagctgtatacaaaacagaggagattgtatatggctatggtaaacctggcggcagcgcaaaagatg

SEQ ID NO: 169941 - DNA, 103 bp, Artificial Sequence
  Synthetic Polynucleotide
taatacgactcactatagggttccccttgacttttggtcctctaccatagaacagaggagactatggatgaggaccaaaaacctggcggcagcgcaaaagatg

SEQ ID NO: 169942 - DNA, 103 bp, Artificial Sequence
  Synthetic Polynucleotide
taatacgactcactatagggacatttgagtttccccttgacttttggtccaacagaggagaggaccaatggtcaaggggaacctggcggcagcgcaaaagatg

SEQ ID NO: 169943 - DNA, 103 bp, Artificial Sequence
  Synthetic Polynucleotide
taatacgactcactatagggtactccattcacatttgagtttccccttgaaacagaggagatcaaggatgaactcaaataacctggcggcagcgcaaaagatg

SEQ ID NO: 169944 - DNA, 103 bp, Artificial Sequence
  Synthetic Polynucleotide
taatacgactcactataggggttgttcggttactccattcacatttgagtaacagaggagaactcaaatgtgaatggagaacctggcggcagcgcaaaagatg

SEQ ID NO: 169945 - DNA, 103 bp, Artificial Sequence
  Synthetic Polynucleotide
taatacgactcactatagggcggttttggagttgttcggttactccattcaacagaggagagaatggatgaaccgaacaaacctggcggcagcgcaaaagatg

SEQ ID NO: 169946 - DNA, 103 bp, Artificial Sequence
  Synthetic Polynucleotide
taatacgactcactatagggcagcatcctccggttttggagttgttcggtaacagaggagaaccgaaatgctccaaaacaacctggcggcagcgcaaaagatg

SEQ ID NO: 169947 - DNA, 103 bp, Artificial Sequence
  Synthetic Polynucleotide
taatacgactcactatagggttttttttctcctgaggaatgaattcagcaaacagaggagatgctgaatgcattcctcaaacctggcggcagcgcaaaagatg

SEQ ID NO: 169948 - DNA, 103 bp, Artificial Sequence
  Synthetic Polynucleotide
taatacgactcactatagggctttcgggtccagcatcctccggttttggaaacagaggagatccaaaatgggaggatgcaacctggcggcagcgcaaaagatg

SEQ ID NO: 169949 - DNA, 103 bp, Artificial Sequence
  Synthetic Polynucleotide
taatacgactcactatagggaggtttggtactttcgggtccagcatcctcaacagaggagagaggatatgggacccgaaaacctggcggcagcgcaaaagatg

SEQ ID NO: 169950 - DNA, 103 bp, Artificial Sequence
  Synthetic Polynucleotide
taatacgactcactatagggaaacccccacaggtttggtactttcgggtcaacagaggagagacccgatggtaccaaacaacctggcggcagcgcaaaagatg

SEQ ID NO: 169951 - DNA, 103 bp, Artificial Sequence
  Synthetic Polynucleotide
taatacgactcactatagggtcagggtggaaaacccccacaggtttggtaaacagaggagataccaaatgtgtgggggtaacctggcggcagcgcaaaagatg

SEQ ID NO: 169952 - DNA, 103 bp, Artificial Sequence
  Synthetic Polynucleotide
taatacgactcactatagggctctgaagagtcagggtggaaaacccccacaacagaggagagtggggatgttccaccctaacctggcggcagcgcaaaagatg

SEQ ID NO: 169953 - DNA, 103 bp, Artificial Sequence
  Synthetic Polynucleotide
taatacgactcactatagggtagaggatgcctctgaagagtcagggtggaaacagaggagatccaccatgactcttcagaacctggcggcagcgcaaaagatg

SEQ ID NO: 169954 - DNA, 103 bp, Artificial Sequence
  Synthetic Polynucleotide
taatacgactcactatagggactccttttctagaggatgcctctgaagagaacagaggagactcttcatgggcatcctcaacctggcggcagcgcaaaagatg

SEQ ID NO: 169955 - DNA, 103 bp, Artificial Sequence
  Synthetic Polynucleotide
taatacgactcactatagggcccatccaatactccttttctagaggatgcaacagaggagagcatccatgagaaaaggaaacctggcggcagcgcaaaagatg

SEQ ID NO: 169956 - DNA, 103 bp, Artificial Sequence
  Synthetic Polynucleotide
taatacgactcactatagggtggctccatacccatccaatactccttttcaacagaggagagaaaagatgtattggatgaacctggcggcagcgcaaaagatg

SEQ ID NO: 169957 - DNA, 103 bp, Artificial Sequence
  Synthetic Polynucleotide
taatacgactcactatagggtcatttcgtctggctccatacccatccaataacagaggagaattggaatggtatggagcaacctggcggcagcgcaaaagatg

SEQ ID NO: 169958 - DNA, 103 bp, Artificial Sequence
  Synthetic Polynucleotide
taatacgactcactatagggtagaccagaattttttttctcctgaggaataacagaggagaattcctatggagaaaaaaaacctggcggcagcgcaaaagatg

SEQ ID NO: 169959 - DNA, 103 bp, Artificial Sequence
  Synthetic Polynucleotide
taatacgactcactatagggtcttctctgctcatttcgtctggctccataaacagaggagatatggaatgagacgaaataacctggcggcagcgcaaaagatg

SEQ ID NO: 169960 - DNA, 103 bp, Artificial Sequence
  Synthetic Polynucleotide
taatacgactcactatagggtctgtgggtatcttctctgctcatttcgtcaacagaggagagacgaaatgagcagagaaaacctggcggcagcgcaaaagatg

SEQ ID NO: 169961 - DNA, 103 bp, Artificial Sequence
  Synthetic Polynucleotide
taatacgactcactatagggggaggccttttctgtgggtatcttctctgcaacagaggagagcagagatgatacccacaaacctggcggcagcgcaaaagatg

SEQ ID NO: 169962 - DNA, 103 bp, Artificial Sequence
  Synthetic Polynucleotide
taatacgactcactatagggcacttcccagggaggccttttctgtgggtaaacagaggagatacccaatgaaaaggcctaacctggcggcagcgcaaaagatg

SEQ ID NO: 169963 - DNA, 103 bp, Artificial Sequence
  Synthetic Polynucleotide
taatacgactcactatagggtggccccctccacttcccagggaggcctttaacagaggagaaaaggcatgcctgggaagaacctggcggcagcgcaaaagatg

SEQ ID NO: 169964 - DNA, 103 bp, Artificial Sequence
  Synthetic Polynucleotide
taatacgactcactatagggggtcgtggcctggccccctccacttcccagaacagaggagactgggaatgggagggggcaacctggcggcagcgcaaaagatg

SEQ ID NO: 169965 - DNA, 103 bp, Artificial Sequence
  Synthetic Polynucleotide
taatacgactcactatagggatttctgcctggtcgtggcctggccccctcaacagaggagagaggggatgaggccacgaaacctggcggcagcgcaaaagatg

SEQ ID NO: 169966 - DNA, 103 bp, Artificial Sequence
  Synthetic Polynucleotide
taatacgactcactataggggttttggtggatttctgcctggtcgtggccaacagaggagaggccacatgcaggcagaaaacctggcggcagcgcaaaagatg

SEQ ID NO: 169967 - DNA, 103 bp, Artificial Sequence
  Synthetic Polynucleotide
taatacgactcactatagggtggccctcctgttttggtggatttctgcctaacagaggagaaggcagatgtccaccaaaaacctggcggcagcgcaaaagatg

SEQ ID NO: 169968 - DNA, 103 bp, Artificial Sequence
  Synthetic Polynucleotide
taatacgactcactatagggtgtatgtcggtggccctcctgttttggtggaacagaggagaccaccaatgcaggagggcaacctggcggcagcgcaaaagatg

SEQ ID NO: 169969 - DNA, 103 bp, Artificial Sequence
  Synthetic Polynucleotide
taatacgactcactatagggtcccacaatttagaccagaattttttttctaacagaggagaagaaaaatgattctggtcaacctggcggcagcgcaaaagatg

SEQ ID NO: 169970 - DNA, 103 bp, Artificial Sequence
  Synthetic Polynucleotide
taatacgactcactataggggtcctgcgtttgtatgtcggtggccctcctaacagaggagaaggaggatgaccgacataaacctggcggcagcgcaaaagatg

SEQ ID NO: 169971 - DNA, 103 bp, Artificial Sequence
  Synthetic Polynucleotide
taatacgactcactatagggttgtttctgtgtcctgcgtttgtatgtcggaacagaggagaccgacaatgaaacgcaggaacctggcggcagcgcaaaagatg

SEQ ID NO: 169972 - DNA, 103 bp, Artificial Sequence
  Synthetic Polynucleotide
taatacgactcactatagggggggcccatgttgtttctgtgtcctgcgttaacagaggagaaacgcaatgcacagaaacaacctggcggcagcgcaaaagatg

SEQ ID NO: 169973 - DNA, 103 bp, Artificial Sequence
  Synthetic Polynucleotide
taatacgactcactatagggcctttggaatggggcccatgttgtttctgtaacagaggagaacagaaatgacatgggccaacctggcggcagcgcaaaagatg

SEQ ID NO: 169974 - DNA, 103 bp, Artificial Sequence
  Synthetic Polynucleotide
taatacgactcactatagggttgaggtcatcctttggaatggggcccatgaacagaggagacatgggatgcattccaaaaacctggcggcagcgcaaaagatg

SEQ ID NO: 169975 - DNA, 103 bp, Artificial Sequence
  Synthetic Polynucleotide
taatacgactcactatagggtggtctttcattgaggtcatcctttggaataacagaggagaattccaatggatgacctcaacctggcggcagcgcaaaagatg

SEQ ID NO: 169976 - DNA, 103 bp, Artificial Sequence
  Synthetic Polynucleotide
taatacgactcactatagggtagattttgctggtctttcattgaggtcataacagaggagaatgaccatgatgaaagacaacctggcggcagcgcaaaagatg

SEQ ID NO: 169977 - DNA, 103 bp, Artificial Sequence
  Synthetic Polynucleotide
taatacgactcactatagggctgtcacaggtagattttgctggtctttcaaacagaggagatgaaagatgagcaaaatcaacctggcggcagcgcaaaagatg

SEQ ID NO: 169978 - DNA, 103 bp, Artificial Sequence
  Synthetic Polynucleotide
taatacgactcactatagggcaagttctcactgtcacaggtagattttgcaacagaggagagcaaaaatgacctgtgacaacctggcggcagcgcaaaagatg

SEQ ID NO: 169979 - DNA, 103 bp, Artificial Sequence
  Synthetic Polynucleotide
taatacgactcactatagggtgatgactgccaagttctcactgtcacaggaacagaggagacctgtgatggtgagaactaacctggcggcagcgcaaaagatg

SEQ ID NO: 169980 - DNA, 103 bp, Artificial Sequence
  Synthetic Polynucleotide
taatacgactcactatagggctcctttgagtcccacaatttagaccagaaaacagaggagattctggatgaaattgtggaacctggcggcagcgcaaaagatg

SEQ ID NO: 169981 - DNA, 103 bp, Artificial Sequence
  Synthetic Polynucleotide
taatacgactcactataggggaagacttgttgatgactgccaagttctcaaacagaggagatgagaaatgggcagtcataacctggcggcagcgcaaaagatg

SEQ ID NO: 169982 - DNA, 103 bp, Artificial Sequence
  Synthetic Polynucleotide
taatacgactcactatagggaaccctcctggaagacttgttgatgactgcaacagaggagagcagtcatgaacaagtctaacctggcggcagcgcaaaagatg

SEQ ID NO: 169983 - DNA, 103 bp, Artificial Sequence
  Synthetic Polynucleotide
taatacgactcactatagggtctcttggtcaaccctcctggaagacttgtaacagaggagaacaagtatgccaggagggaacctggcggcagcgcaaaagatg

SEQ ID NO: 169984 - DNA, 103 bp, Artificial Sequence
  Synthetic Polynucleotide
taatacgactcactatagggacagtgcatttctcttggtcaaccctcctgaacagaggagacaggagatgtgaccaagaaacctggcggcagcgcaaaagatg

SEQ ID NO: 169985 - DNA, 103 bp, Artificial Sequence
  Synthetic Polynucleotide
taatacgactcactatagggctgcctccgtacagtgcatttctcttggtcaacagaggagagaccaaatgaaatgcactaacctggcggcagcgcaaaagatg

SEQ ID NO: 169986 - DNA, 103 bp, Artificial Sequence
  Synthetic Polynucleotide
taatacgactcactatagggcttgaggatcctgcctccgtacagtgcattaacagaggagaaatgcaatgtacggaggcaacctggcggcagcgcaaaagatg

SEQ ID NO: 169987 - DNA, 103 bp, Artificial Sequence
  Synthetic Polynucleotide
taatacgactcactatagggggagatactacttgaggatcctgcctccgtaacagaggagaacggagatgggatcctcaaacctggcggcagcgcaaaagatg

SEQ ID NO: 169988 - DNA, 103 bp, Artificial Sequence
  Synthetic Polynucleotide
taatacgactcactatagggtcgggagaaaggagatactacttgaggatcaacagaggagagatcctatggtagtatctaacctggcggcagcgcaaaagatg

SEQ ID NO: 169989 - DNA, 103 bp, Artificial Sequence
  Synthetic Polynucleotide
taatacgactcactatagggtctgtttgcctcgggagaaaggagatactaaacagaggagatagtatatgctttctcccaacctggcggcagcgcaaaagatg

SEQ ID NO: 169990 - DNA, 103 bp, Artificial Sequence
  Synthetic Polynucleotide
taatacgactcactatagggagcacatggttctgtttgcctcgggagaaaaacagaggagatttctcatgaggcaaacaaacctggcggcagcgcaaaagatg

SEQ ID NO: 169991 - DNA, 103 bp, Artificial Sequence
  Synthetic Polynucleotide
taatacgactcactatagggaccggccacctggcgccaggaagcttccataacagaggagaatggaaatgtcctggcgcaacctggcggcagcgcaaaagatg

SEQ ID NO: 169992 - DNA, 103 bp, Artificial Sequence
  Synthetic Polynucleotide
taatacgactcactatagggccccttctctcgccctcctccggcgccgcgaacagaggagacgcggcatgggaggagggaacctggcggcagcgcaaaagatg

SEQ ID NO: 169993 - DNA, 103 bp, Artificial Sequence
  Synthetic Polynucleotide
taatacgactcactatagggtctactaactcttggacaaggctgacagctaacagaggagaagctgtatgccttgtccaaacctggcggcagcgcaaaagatg

SEQ ID NO: 169994 - DNA, 103 bp, Artificial Sequence
  Synthetic Polynucleotide
taatacgactcactatagggcacacttttgtctactaactcttggacaagaacagaggagacttgtcatggagttagtaaacctggcggcagcgcaaaagatg

SEQ ID NO: 169995 - DNA, 103 bp, Artificial Sequence
  Synthetic Polynucleotide
taatacgactcactatagggttgccacagacacacttttgtctactaactaacagaggagaagttagatgacaaaagtgaacctggcggcagcgcaaaagatg

SEQ ID NO: 169996 - DNA, 103 bp, Artificial Sequence
  Synthetic Polynucleotide
taatacgactcactatagggagctacttttttgccacagacacacttttgaacagaggagacaaaagatggtctgtggcaacctggcggcagcgcaaaagatg

SEQ ID NO: 169997 - DNA, 103 bp, Artificial Sequence
  Synthetic Polynucleotide
taatacgactcactatagggaacttctttcagctacttttttgccacagaaacagaggagatctgtgatgaaaaagtagaacctggcggcagcgcaaaagatg

SEQ ID NO: 169998 - DNA, 103 bp, Artificial Sequence
  Synthetic Polynucleotide
taatacgactcactatagggggacttgcacaacttctttcagctacttttaacagaggagaaaaagtatgtgaaagaagaacctggcggcagcgcaaaagatg

SEQ ID NO: 169999 - DNA, 103 bp, Artificial Sequence
  Synthetic Polynucleotide
taatacgactcactataggggtgccatagtggacttgcacaacttctttcaacagaggagagaaagaatgtgtgcaagtaacctggcggcagcgcaaaagatg

SEQ ID NO: 170000 - DNA, 103 bp, Artificial Sequence
  Synthetic Polynucleotide
taatacgactcactatagggcttgatcacagtgccatagtggacttgcacaacagaggagagtgcaaatgcactatggcaacctggcggcagcgcaaaagatg

SEQ ID NO: 170001 - DNA, 103 bp, Artificial Sequence
  Synthetic Polynucleotide
taatacgactcactatagggtttccacatacttgatcacagtgccatagtaacagaggagaactatgatgctgtgatcaaacctggcggcagcgcaaaagatg

SEQ ID NO: 170002 - DNA, 103 bp, Artificial Sequence
  Synthetic Polynucleotide
taatacgactcactatagggtggcagtgtttttccacatacttgatcacaaacagaggagatgtgatatggtatgtggaaacctggcggcagcgcaaaagatg

SEQ ID NO: 170003 - DNA, 103 bp, Artificial Sequence
  Synthetic Polynucleotide
taatacgactcactatagggcgcccaccgaccccttctctcgccctcctcaacagaggagagaggagatggagagaaggaacctggcggcagcgcaaaagatg

SEQ ID NO: 170004 - DNA, 103 bp, Artificial Sequence
  Synthetic Polynucleotide
taatacgactcactataggggattaccacatggcagtgtttttccacataaacagaggagatatgtgatgaaacactgcaacctggcggcagcgcaaaagatg

SEQ ID NO: 170005 - DNA, 103 bp, Artificial Sequence
  Synthetic Polynucleotide
taatacgactcactatagggtcacatgtgtgattaccacatggcagtgttaacagaggagaaacactatgatgtggtaaaacctggcggcagcgcaaaagatg

SEQ ID NO: 170006 - DNA, 103 bp, Artificial Sequence
  Synthetic Polynucleotide
taatacgactcactataggggcaaacttgctcacatgtgtgattaccacaaacagaggagatgtggtatgcacacatgtaacctggcggcagcgcaaaagatg

SEQ ID NO: 170007 - DNA, 103 bp, Artificial Sequence
  Synthetic Polynucleotide
taatacgactcactatagggcaccaacatggcaaacttgctcacatgtgtaacagaggagaacacatatgagcaagtttaacctggcggcagcgcaaaagatg

SEQ ID NO: 170008 - DNA, 103 bp, Artificial Sequence
  Synthetic Polynucleotide
taatacgactcactatagggtctccacaagcaccaacatggcaaacttgcaacagaggagagcaagtatgccatgttggaacctggcggcagcgcaaaagatg

SEQ ID NO: 170009 - DNA, 103 bp, Artificial Sequence
  Synthetic Polynucleotide
taatacgactcactatagggtcgaggacattctccacaagcaccaacatgaacagaggagacatgttatggcttgtggaaacctggcggcagcgcaaaagatg

SEQ ID NO: 170010 - DNA, 103 bp, Artificial Sequence
  Synthetic Polynucleotide
taatacgactcactatagggttttcccagatcgaggacattctccacaagaacagaggagacttgtgatgaatgtcctcaacctggcggcagcgcaaaagatg

SEQ ID NO: 170011 - DNA, 103 bp, Artificial Sequence
  Synthetic Polynucleotide
taatacgactcactatagggggacagaaccttttcccagatcgaggacataacagaggagaatgtccatgatctgggaaaacctggcggcagcgcaaaagatg

SEQ ID NO: 170012 - DNA, 103 bp, Artificial Sequence
  Synthetic Polynucleotide
taatacgactcactatagggtttctgacatggacagaaccttttcccagaaacagaggagatctgggatgaggttctgtaacctggcggcagcgcaaaagatg

SEQ ID NO: 170013 - DNA, 103 bp, Artificial Sequence
  Synthetic Polynucleotide
taatacgactcactatagggaaaactttgatttctgacatggacagaaccaacagaggagaggttctatgcatgtcagaaacctggcggcagcgcaaaagatg

SEQ ID NO: 170014 - DNA, 103 bp, Artificial Sequence
  Synthetic Polynucleotide
taatacgactcactataggggaaggaactgcgcccaccgaccccttctctaacagaggagaagagaaatggtcggtgggaacctggcggcagcgcaaaagatg

SEQ ID NO: 170015 - DNA, 103 bp, Artificial Sequence
  Synthetic Polynucleotide
taatacgactcactatagggcaaggcaaagaaaactttgatttctgacataacagaggagaatgtcaatgatcaaagttaacctggcggcagcgcaaaagatg

SEQ ID NO: 170016 - DNA, 103 bp, Artificial Sequence
  Synthetic Polynucleotide
taatacgactcactatagggatcttctgtacaaggcaaagaaaactttgaaacagaggagatcaaagatgtctttgcctaacctggcggcagcgcaaaagatg

SEQ ID NO: 170017 - DNA, 103 bp, Artificial Sequence
  Synthetic Polynucleotide
taatacgactcactatagggaagttggtacatcttctgtacaaggcaaagaacagaggagactttgcatggtacagaagaacctggcggcagcgcaaaagatg

SEQ ID NO: 170018 - DNA, 103 bp, Artificial Sequence
  Synthetic Polynucleotide
taatacgactcactatagggctgtctccacaagttggtacatcttctgtaaacagaggagatacagaatgtgtaccaacaacctggcggcagcgcaaaagatg

SEQ ID NO: 170019 - DNA, 103 bp, Artificial Sequence
  Synthetic Polynucleotide
taatacgactcactatagggtttgtcacaactgtctccacaagttggtacaacagaggagagtaccaatgtgtggagacaacctggcggcagcgcaaaagatg

SEQ ID NO: 170020 - DNA, 103 bp, Artificial Sequence
  Synthetic Polynucleotide
taatacgactcactatagggattcaagtactttgtcacaactgtctccacaacagaggagagtggagatggttgtgacaaacctggcggcagcgcaaaagatg

SEQ ID NO: 170021 - DNA, 103 bp, Artificial Sequence
  Synthetic Polynucleotide
taatacgactcactatagggtggattccgcattcaagtactttgtcacaaaacagaggagattgtgaatgagtacttgaaacctggcggcagcgcaaaagatg

SEQ ID NO: 170022 - DNA, 103 bp, Artificial Sequence
  Synthetic Polynucleotide
taatacgactcactatagggtgaacatctatggattccgcattcaagtacaacagaggagagtacttatgtgcggaatcaacctggcggcagcgcaaaagatg

SEQ ID NO: 170023 - DNA, 103 bp, Artificial Sequence
  Synthetic Polynucleotide
taatacgactcactataggggacaacgctgtgaacatctatggattccgcaacagaggagagcggaaatgatagatgttaacctggcggcagcgcaaaagatg

SEQ ID NO: 170024 - DNA, 103 bp, Artificial Sequence
  Synthetic Polynucleotide
taatacgactcactatagggggacctcggtgacaacgctgtgaacatctaaacagaggagatagatgatgacagcgttgaacctggcggcagcgcaaaagatg

SEQ ID NO: 170025 - DNA, 103 bp, Artificial Sequence
  Synthetic Polynucleotide
taatacgactcactatagggactggtgccagaaggaactgcgcccaccgaaacagaggagatcggtgatggcagttcctaacctggcggcagcgcaaaagatg

SEQ ID NO: 170026 - DNA, 103 bp, Artificial Sequence
  Synthetic Polynucleotide
taatacgactcactatagggtgtttcacagggacctcggtgacaacgctgaacagaggagacagcgtatgcaccgaggtaacctggcggcagcgcaaaagatg

SEQ ID NO: 170027 - DNA, 103 bp, Artificial Sequence
  Synthetic Polynucleotide
taatacgactcactatagggcttgtctacatgtttcacagggacctcggtaacagaggagaaccgagatgcctgtgaaaaacctggcggcagcgcaaaagatg

SEQ ID NO: 170028 - DNA, 103 bp, Artificial Sequence
  Synthetic Polynucleotide
taatacgactcactatagggttttccacttcttgtctacatgtttcacagaacagaggagactgtgaatgatgtagacaaacctggcggcagcgcaaaagatg

SEQ ID NO: 170029 - DNA, 103 bp, Artificial Sequence
  Synthetic Polynucleotide
taatacgactcactataggggcgacaatgcttttccacttcttgtctacaaacagaggagatgtagaatggaagtggaaaacctggcggcagcgcaaaagatg

SEQ ID NO: 170030 - DNA, 103 bp, Artificial Sequence
  Synthetic Polynucleotide
taatacgactcactataggggctttccacagcgacaatgcttttccacttaacagaggagaaagtggatgagcattgtcaacctggcggcagcgcaaaagatg

SEQ ID NO: 170031 - DNA, 103 bp, Artificial Sequence
  Synthetic Polynucleotide
taatacgactcactatagggcgttttgtatgctttccacagcgacaatgcaacagaggagagcattgatgctgtggaaaaacctggcggcagcgcaaaagatg

SEQ ID NO: 170032 - DNA, 103 bp, Artificial Sequence
  Synthetic Polynucleotide
taatacgactcactatagggacaaggcattcgttttgtatgctttccacaaacagaggagatgtggaatgcatacaaaaaacctggcggcagcgcaaaagatg

SEQ ID NO: 170033 - DNA, 103 bp, Artificial Sequence
  Synthetic Polynucleotide
taatacgactcactatagggaaggtttatgacaaggcattcgttttgtataacagaggagaatacaaatggaatgccttaacctggcggcagcgcaaaagatg

SEQ ID NO: 170034 - DNA, 103 bp, Artificial Sequence
  Synthetic Polynucleotide
taatacgactcactatagggtcacacagataaggtttatgacaaggcattaacagaggagaaatgccatgtcataaaccaacctggcggcagcgcaaaagatg

SEQ ID NO: 170035 - DNA, 103 bp, Artificial Sequence
  Synthetic Polynucleotide
taatacgactcactatagggacacttagtttcacacagataaggtttatgaacagaggagacataaaatgtatctgtgtaacctggcggcagcgcaaaagatg

SEQ ID NO: 170036 - DNA, 103 bp, Artificial Sequence
  Synthetic Polynucleotide
taatacgactcactatagggctcctccgggactggtgccagaaggaactgaacagaggagacagttcatgctggcaccaaacctggcggcagcgcaaaagatg

SEQ ID NO: 170037 - DNA, 103 bp, Artificial Sequence
  Synthetic Polynucleotide
taatacgactcactataggggcatcttaacacacttagtttcacacagataacagaggagaatctgtatgaaactaagtaacctggcggcagcgcaaaagatg

SEQ ID NO: 170038 - DNA, 103 bp, Artificial Sequence
  Synthetic Polynucleotide
taatacgactcactatagggtgacagtcacgcatcttaacacacttagttaacagaggagaaactaaatgtgttaagataacctggcggcagcgcaaaagatg

SEQ ID NO: 170039 - DNA, 103 bp, Artificial Sequence
  Synthetic Polynucleotide
taatacgactcactatagggttgatgcttctgacagtcacgcatcttaacaacagaggagagttaagatgcgtgactgtaacctggcggcagcgcaaaagatg

SEQ ID NO: 170040 - DNA, 103 bp, Artificial Sequence
  Synthetic Polynucleotide
taatacgactcactatagggttcttctacattgatgcttctgacagtcacaacagaggagagtgactatgagaagcatcaacctggcggcagcgcaaaagatg

SEQ ID NO: 170041 - DNA, 103 bp, Artificial Sequence
  Synthetic Polynucleotide
taatacgactcactataggggggcaacactttcttctacattgatgcttcaacagaggagagaagcaatgatgtagaagaacctggcggcagcgcaaaagatg

SEQ ID NO: 170042 - DNA, 103 bp, Artificial Sequence
  Synthetic Polynucleotide
taatacgactcactatagggacagtttccagggcaacactttcttctacaaacagaggagatgtagaatgaagtgttgcaacctggcggcagcgcaaaagatg

SEQ ID NO: 170043 - DNA, 103 bp, Artificial Sequence
  Synthetic Polynucleotide
taatacgactcactatagggcacaaggtggacagtttccagggcaacactaacagaggagaagtgttatgctggaaactaacctggcggcagcgcaaaagatg

SEQ ID NO: 170044 - DNA, 103 bp, Artificial Sequence
  Synthetic Polynucleotide
taatacgactcactatagggcagttttgatcacaaggtggacagtttccaaacagaggagatggaaaatgtccaccttgaacctggcggcagcgcaaaagatg

SEQ ID NO: 170045 - DNA, 103 bp, Artificial Sequence
  Synthetic Polynucleotide
taatacgactcactatagggagtccgtccacagttttgatcacaaggtggaacagaggagaccacctatggatcaaaacaacctggcggcagcgcaaaagatg

SEQ ID NO: 170046 - DNA, 103 bp, Artificial Sequence
  Synthetic Polynucleotide
taatacgactcactatagggtacatcctaaagtccgtccacagttttgataacagaggagaatcaaaatggtggacggaaacctggcggcagcgcaaaagatg

SEQ ID NO: 170047 - DNA, 103 bp, Artificial Sequence
  Synthetic Polynucleotide
taatacgactcactataggggtggtcgcgactcctccgggactggtgccaaacagaggagatggcacatgtcccggaggaacctggcggcagcgcaaaagatg

SEQ ID NO: 170048 - DNA, 103 bp, Artificial Sequence
  Synthetic Polynucleotide
taatacgactcactatagggttatggtttctacatcctaaagtccgtccaaacagaggagatggacgatgtttaggatgaacctggcggcagcgcaaaagatg

SEQ ID NO: 170049 - DNA, 103 bp, Artificial Sequence
  Synthetic Polynucleotide
taatacgactcactatagggagatggacacttatggtttctacatcctaaaacagaggagattaggaatgagaaaccataacctggcggcagcgcaaaagatg

SEQ ID NO: 170050 - DNA, 103 bp, Artificial Sequence
  Synthetic Polynucleotide
taatacgactcactatagggtgtgacagacagatggacacttatggtttcaacagaggagagaaaccatgagtgtccataacctggcggcagcgcaaaagatg

SEQ ID NO: 170051 - DNA, 103 bp, Artificial Sequence
  Synthetic Polynucleotide
taatacgactcactatagggcaactgcctctgtgacagacagatggacacaacagaggagagtgtccatgtgtctgtcaaacctggcggcagcgcaaaagatg

SEQ ID NO: 170052 - DNA, 103 bp, Artificial Sequence
  Synthetic Polynucleotide
taatacgactcactataggggcagggatagcaactgcctctgtgacagacaacagaggagagtctgtatgagaggcagtaacctggcggcagcgcaaaagatg

SEQ ID NO: 170053 - DNA, 103 bp, Artificial Sequence
  Synthetic Polynucleotide
taatacgactcactatagggcggtttctgggcagggatagcaactgcctcaacagaggagagaggcaatggctatccctaacctggcggcagcgcaaaagatg

SEQ ID NO: 170054 - DNA, 103 bp, Artificial Sequence
  Synthetic Polynucleotide
taatacgactcactatagggttcacatctacggtttctgggcagggatagaacagaggagactatccatgcccagaaacaacctggcggcagcgcaaaagatg

SEQ ID NO: 170055 - DNA, 103 bp, Artificial Sequence
  Synthetic Polynucleotide
taatacgactcactatagggacaattacacttcacatctacggtttctggaacagaggagaccagaaatggtagatgtgaacctggcggcagcgcaaaagatg

SEQ ID NO: 170056 - DNA, 103 bp, Artificial Sequence
  Synthetic Polynucleotide
taatacgactcactatagggttgtattgccacaattacacttcacatctaaacagaggagatagatgatgagtgtaattaacctggcggcagcgcaaaagatg

SEQ ID NO: 170057 - DNA, 103 bp, Artificial Sequence
  Synthetic Polynucleotide
taatacgactcactatagggactgtcacctttgtattgccacaattacacaacagaggagagtgtaaatgtggcaatacaacctggcggcagcgcaaaagatg

SEQ ID NO: 170058 - DNA, 103 bp, Artificial Sequence
  Synthetic Polynucleotide
taatacgactcactatagggtgcagccgccgtggtcgcgactcctccgggaacagaggagacccggaatggtcgcgaccaacctggcggcagcgcaaaagatg

SEQ ID NO: 170059 - DNA, 103 bp, Artificial Sequence
  Synthetic Polynucleotide
taatacgactcactataggggccacagggcactgtcacctttgtattgccaacagaggagaggcaatatgaaggtgacaaacctggcggcagcgcaaaagatg

SEQ ID NO: 170060 - DNA, 103 bp, Artificial Sequence
  Synthetic Polynucleotide
taatacgactcactatagggtacgttctcggccacagggcactgtcacctaacagaggagaaggtgaatgtgccctgtgaacctggcggcagcgcaaaagatg

SEQ ID NO: 170061 - DNA, 103 bp, Artificial Sequence
  Synthetic Polynucleotide
taatacgactcactatagggggtcttgtggtacgttctcggccacagggcaacagaggagagccctgatgccgagaacgaacctggcggcagcgcaaaagatg

SEQ ID NO: 170062 - DNA, 103 bp, Artificial Sequence
  Synthetic Polynucleotide
taatacgactcactataggggcacttgggtggtcttgtggtacgttctcgaacagaggagacgagaaatgaccacaagaaacctggcggcagcgcaaaagatg

SEQ ID NO: 170063 - DNA, 103 bp, Artificial Sequence
  Synthetic Polynucleotide
taatacgactcactatagggattgctccttgcacttgggtggtcttgtggaacagaggagaccacaaatgcacccaagtaacctggcggcagcgcaaaagatg

SEQ ID NO: 170064 - DNA, 103 bp, Artificial Sequence
  Synthetic Polynucleotide
taatacgactcactatagggggtcgactgcattgctccttgcacttgggtaacagaggagaacccaaatgcaaggagcaaacctggcggcagcgcaaaagatg

SEQ ID NO: 170065 - DNA, 103 bp, Artificial Sequence
  Synthetic Polynucleotide
taatacgactcactatagggacaagttggtggtcgactgcattgctccttaacagaggagaaaggagatgtgcagtcgaaacctggcggcagcgcaaaagatg

SEQ ID NO: 170066 - DNA, 103 bp, Artificial Sequence
  Synthetic Polynucleotide
taatacgactcactatagggttgtatgatgacaagttggtggtcgactgcaacagaggagagcagtcatgcaccaacttaacctggcggcagcgcaaaagatg

SEQ ID NO: 170067 - DNA, 103 bp, Artificial Sequence
  Synthetic Polynucleotide
taatacgactcactatagggttttcttgacttgtatgatgacaagttggtaacagaggagaaccaacatgtcatcatacaacctggcggcagcgcaaaagatg

SEQ ID NO: 170068 - DNA, 103 bp, Artificial Sequence
  Synthetic Polynucleotide
taatacgactcactatagggacagcgatgtttttcttgacttgtatgatgaacagaggagacatcatatgagtcaagaaaacctggcggcagcgcaaaagatg

SEQ ID NO: 170069 - DNA, 103 bp, Artificial Sequence
  Synthetic Polynucleotide
taatacgactcactataggggcctgctccctgcagccgccgtggtcgcgaaacagaggagatcgcgaatgcggcggctgaacctggcggcagcgcaaaagatg

SEQ ID NO: 170070 - DNA, 103 bp, Artificial Sequence
  Synthetic Polynucleotide
taatacgactcactatagggaaccaaagtgacagcgatgtttttcttgacaacagaggagagtcaagatgaacatcgctaacctggcggcagcgcaaaagatg

SEQ ID NO: 170071 - DNA, 103 bp, Artificial Sequence
  Synthetic Polynucleotide
taatacgactcactatagggggtggacaagaaccaaagtgacagcgatgtaacagaggagaacatcgatgtcactttggaacctggcggcagcgcaaaagatg

SEQ ID NO: 170072 - DNA, 103 bp, Artificial Sequence
  Synthetic Polynucleotide
taatacgactcactatagggttgatgacatggtggacaagaaccaaagtgaacagaggagacactttatgtcttgtccaaacctggcggcagcgcaaaagatg

SEQ ID NO: 170073 - DNA, 103 bp, Artificial Sequence
  Synthetic Polynucleotide
taatacgactcactatagggtttggcaaggttgatgacatggtggacaagaacagaggagacttgtcatgcatgtcatcaacctggcggcagcgcaaaagatg

SEQ ID NO: 170074 - DNA, 103 bp, Artificial Sequence
  Synthetic Polynucleotide
taatacgactcactatagggtccaaaactttttggcaaggttgatgacataacagaggagaatgtcaatgaccttgccaaacctggcggcagcgcaaaagatg

SEQ ID NO: 170075 - DNA, 103 bp, Artificial Sequence
  Synthetic Polynucleotide
taatacgactcactatagggaccacatttctccaaaactttttggcaaggaacagaggagaccttgcatgaaagttttgaacctggcggcagcgcaaaagatg

SEQ ID NO: 170076 - DNA, 103 bp, Artificial Sequence
  Synthetic Polynucleotide
taatacgactcactataggggacacaagtgaccacatttctccaaaacttaacagaggagaaagtttatgagaaatgtgaacctggcggcagcgcaaaagatg

SEQ ID NO: 170077 - DNA, 103 bp, Artificial Sequence
  Synthetic Polynucleotide
taatacgactcactatagggcacggagcaggacacaagtgaccacatttcaacagaggagagaaatgatgtcacttgtgaacctggcggcagcgcaaaagatg

SEQ ID NO: 170078 - DNA, 103 bp, Artificial Sequence
  Synthetic Polynucleotide
taatacgactcactatagggttgatcatgacacggagcaggacacaagtgaacagaggagacacttgatgcctgctccgaacctggcggcagcgcaaaagatg

SEQ ID NO: 170079 - DNA, 103 bp, Artificial Sequence
  Synthetic Polynucleotide
taatacgactcactatagggttattaatgcttgatcatgacacggagcagaacagaggagactgctcatggtcatgatcaacctggcggcagcgcaaaagatg

SEQ ID NO: 170080 - DNA, 103 bp, Artificial Sequence
  Synthetic Polynucleotide
taatacgactcactataggggcggggctgtgcctgctccctgcagccgccaacagaggagaggcggcatgagggagcagaacctggcggcagcgcaaaagatg

SEQ ID NO: 170081 - DNA, 103 bp, Artificial Sequence
  Synthetic Polynucleotide
taatacgactcactatagggccagtctgctttattaatgcttgatcatgaaacagaggagatcatgaatgagcattaataacctggcggcagcgcaaaagatg

SEQ ID NO: 170082 - DNA, 103 bp, Artificial Sequence
  Synthetic Polynucleotide
taatacgactcactatagggctggtgcctgccagtctgctttattaatgcaacagaggagagcattaatgaagcagactaacctggcggcagcgcaaaagatg

SEQ ID NO: 170083 - DNA, 103 bp, Artificial Sequence
  Synthetic Polynucleotide
taatacgactcactatagggggcctgtaggctggtgcctgccagtctgctaacagaggagaagcagaatggcaggcaccaacctggcggcagcgcaaaagatg

SEQ ID NO: 170084 - DNA, 103 bp, Artificial Sequence
  Synthetic Polynucleotide
taatacgactcactatagggtgttcccaagggcctgtaggctggtgcctgaacagaggagacaggcaatggcctacaggaacctggcggcagcgcaaaagatg

SEQ ID NO: 170085 - DNA, 103 bp, Artificial Sequence
  Synthetic Polynucleotide
taatacgactcactatagggctcagaaggctgttcccaagggcctgtaggaacagaggagacctacaatgccttgggaaaacctggcggcagcgcaaaagatg

SEQ ID NO: 170086 - DNA, 103 bp, Artificial Sequence
  Synthetic Polynucleotide
taatacgactcactatagggtaaatgctggctcagaaggctgttcccaagaacagaggagacttgggatgagccttctgaacctggcggcagcgcaaaagatg

SEQ ID NO: 170087 - DNA, 103 bp, Artificial Sequence
  Synthetic Polynucleotide
taatacgactcactataggggcagtctgaataaatgctggctcagaaggcaacagaggagagccttcatggccagcattaacctggcggcagcgcaaaagatg

SEQ ID NO: 170088 - DNA, 103 bp, Artificial Sequence
  Synthetic Polynucleotide
taatacgactcactatagggacacggtaatgcagtctgaataaatgctggaacagaggagaccagcaatgattcagactaacctggcggcagcgcaaaagatg

SEQ ID NO: 170089 - DNA, 103 bp, Artificial Sequence
  Synthetic Polynucleotide
taatacgactcactataggggacatggaggacacggtaatgcagtctgaaaacagaggagattcagaatgcattaccgtaacctggcggcagcgcaaaagatg

SEQ ID NO: 170090 - DNA, 103 bp, Artificial Sequence
  Synthetic Polynucleotide
taatacgactcactatagggataggaacttgacatggaggacacggtaataacagaggagaattaccatgtcctccatgaacctggcggcagcgcaaaagatg

SEQ ID NO: 170091 - DNA, 103 bp, Artificial Sequence
  Synthetic Polynucleotide
taatacgactcactatagggttgggatcctgcggggctgtgcctgctcccaacagaggagagggagcatgcacagccccaacctggcggcagcgcaaaagatg

SEQ ID NO: 170092 - DNA, 103 bp, Artificial Sequence
  Synthetic Polynucleotide
taatacgactcactatagggttccataggaataggaacttgacatggaggaacagaggagacctccaatgcaagttcctaacctggcggcagcgcaaaagatg

SEQ ID NO: 170093 - DNA, 103 bp, Artificial Sequence
  Synthetic Polynucleotide
taatacgactcactatagggtcccaagacattccataggaataggaacttaacagaggagaaagttcatgttcctatggaacctggcggcagcgcaaaagatg

SEQ ID NO: 170094 - DNA, 103 bp, Artificial Sequence
  Synthetic Polynucleotide
taatacgactcactatagggacctcatgtttcccaagacattccataggaaacagaggagatcctatatgatgtcttggaacctggcggcagcgcaaaagatg

SEQ ID NO: 170095 - DNA, 103 bp, Artificial Sequence
  Synthetic Polynucleotide
taatacgactcactatagggtagtggactcacctcatgtttcccaagacaaacagaggagatgtcttatgaaacatgagaacctggcggcagcgcaaaagatg

SEQ ID NO: 170096 - DNA, 103 bp, Artificial Sequence
  Synthetic Polynucleotide
taatacgactcactatagggcatggcatggtagtggactcacctcatgttaacagaggagaaacatgatgtgagtccacaacctggcggcagcgcaaaagatg

SEQ ID NO: 170097 - DNA, 103 bp, Artificial Sequence
  Synthetic Polynucleotide
taatacgactcactatagggggtcctacagcatggcatggtagtggactcaacagaggagagagtccatgaccatgccaaacctggcggcagcgcaaaagatg

SEQ ID NO: 170098 - DNA, 103 bp, Artificial Sequence
  Synthetic Polynucleotide
taatacgactcactatagggacaagagtagggtcctacagcatggcatggaacagaggagaccatgcatggctgtaggaaacctggcggcagcgcaaaagatg

SEQ ID NO: 170099 - DNA, 103 bp, Artificial Sequence
  Synthetic Polynucleotide
taatacgactcactatagggaaactcttttacaagagtagggtcctacagaacagaggagactgtagatgcctactcttaacctggcggcagcgcaaaagatg

SEQ ID NO: 170100 - DNA, 103 bp, Artificial Sequence
  Synthetic Polynucleotide
taatacgactcactatagggattcttccacaaactcttttacaagagtagaacagaggagactactcatgtaaaagagtaacctggcggcagcgcaaaagatg

SEQ ID NO: 170101 - DNA, 103 bp, Artificial Sequence
  Synthetic Polynucleotide
taatacgactcactatagggacaatccaagattcttccacaaactcttttaacagaggagaaaaagaatgtgtggaagaaacctggcggcagcgcaaaagatg

SEQ ID NO: 170102 - DNA, 103 bp, Artificial Sequence
  Synthetic Polynucleotide
taatacgactcactatagggggcctcggccaccggccacctggcgccaggaacagaggagacctggcatgaggtggccgaacctggcggcagcgcaaaagatg

SEQ ID NO: 170103 - DNA, 103 bp, Artificial Sequence
  Synthetic Polynucleotide
taatacgactcactatagggtctgcagggcttgggatcctgcggggctgtaacagaggagaacagccatgcaggatcccaacctggcggcagcgcaaaagatg

SEQ ID NO: 170104 - DNA, 103 bp, Artificial Sequence
  Synthetic Polynucleotide
taatacgactcactatagggtgtgattctgacaatccaagattcttccacaacagaggagagtggaaatgtcttggattaacctggcggcagcgcaaaagatg

SEQ ID NO: 170105 - DNA, 103 bp, Artificial Sequence
  Synthetic Polynucleotide
taatacgactcactatagggttcatacatgtgtgattctgacaatccaagaacagaggagacttggaatgtcagaatcaaacctggcggcagcgcaaaagatg

SEQ ID NO: 170106 - DNA, 103 bp, Artificial Sequence
  Synthetic Polynucleotide
taatacgactcactataggggtggcattctttcatacatgtgtgattctgaacagaggagacagaatatgacatgtatgaacctggcggcagcgcaaaagatg

SEQ ID NO: 170107 - DNA, 103 bp, Artificial Sequence
  Synthetic Polynucleotide
taatacgactcactatagggtggttactttgtggcattctttcatacatgaacagaggagacatgtaatgaagaatgccaacctggcggcagcgcaaaagatg

SEQ ID NO: 170108 - DNA, 103 bp, Artificial Sequence
  Synthetic Polynucleotide
taatacgactcactatagggccatcagttttggttactttgtggcattctaacagaggagaagaatgatgcaaagtaacaacctggcggcagcgcaaaagatg

SEQ ID NO: 170109 - DNA, 103 bp, Artificial Sequence
  Synthetic Polynucleotide
taatacgactcactatagggtccagtgcagccatcagttttggttactttaacagaggagaaaagtaatgaaaactgataacctggcggcagcgcaaaagatg

SEQ ID NO: 170110 - DNA, 103 bp, Artificial Sequence
  Synthetic Polynucleotide
taatacgactcactatagggccttgttttttccagtgcagccatcagtttaacagaggagaaaactgatggctgcactgaacctggcggcagcgcaaaagatg

SEQ ID NO: 170111 - DNA, 103 bp, Artificial Sequence
  Synthetic Polynucleotide
taatacgactcactatagggtctgggccagccttgttttttccagtgcagaacagaggagactgcacatgaaaaaacaaaacctggcggcagcgcaaaagatg

SEQ ID NO: 170112 - DNA, 103 bp, Artificial Sequence
  Synthetic Polynucleotide
taatacgactcactatagggatgaaggcattctgggccagccttgtttttaacagaggagaaaaaacatggctggcccaaacctggcggcagcgcaaaagatg

SEQ ID NO: 170113 - DNA, 103 bp, Artificial Sequence
  Synthetic Polynucleotide
taatacgactcactatagggcttcctcacaatgaaggcattctgggccagaacagaggagactggccatgaatgccttcaacctggcggcagcgcaaaagatg

SEQ ID NO: 170114 - DNA, 103 bp, Artificial Sequence
  Synthetic Polynucleotide
taatacgactcactataggggctgcggtagtctgcagggcttgggatcctaacagaggagaaggatcatgagccctgcaaacctggcggcagcgcaaaagatg

SEQ ID NO: 170115 - DNA, 103 bp, Artificial Sequence
  Synthetic Polynucleotide
taatacgactcactatagggttggagcacccttcctcacaatgaaggcataacagaggagaatgcctatgttgtgaggaaacctggcggcagcgcaaaagatg

SEQ ID NO: 170116 - DNA, 103 bp, Artificial Sequence
  Synthetic Polynucleotide
taatacgactcactatagggtggccgtgacttggagcacccttcctcacaaacagaggagatgtgagatggggtgctccaacctggcggcagcgcaaaagatg

SEQ ID NO: 170117 - DNA, 103 bp, Artificial Sequence
  Synthetic Polynucleotide
taatacgactcactataggggacaacctagtggccgtgacttggagcaccaacagaggagaggtgctatgagtcacggcaacctggcggcagcgcaaaagatg

SEQ ID NO: 170118 - DNA, 103 bp, Artificial Sequence
  Synthetic Polynucleotide
taatacgactcactatagggcatgggtgaagacaacctagtggccgtgacaacagaggagagtcacgatgactaggttgaacctggcggcagcgcaaaagatg

SEQ ID NO: 170119 - DNA, 103 bp, Artificial Sequence
  Synthetic Polynucleotide
taatacgactcactatagggtcgcaaaatacatgggtgaagacaacctagaacagaggagactaggtatgcttcacccaaacctggcggcagcgcaaaagatg

SEQ ID NO: 170120 - DNA, 103 bp, Artificial Sequence
  Synthetic Polynucleotide
taatacgactcactatagggcagggtgacatcgcaaaatacatgggtgaaaacagaggagattcaccatggtattttgcaacctggcggcagcgcaaaagatg

SEQ ID NO: 170121 - DNA, 103 bp, Artificial Sequence
  Synthetic Polynucleotide
taatacgactcactatagggggacattctccagggtgacatcgcaaaataaacagaggagatattttatgatgtcacccaacctggcggcagcgcaaaagatg

SEQ ID NO: 170122 - DNA, 103 bp, Artificial Sequence
  Synthetic Polynucleotide
taatacgactcactatagggaacacaaggtggacattctccagggtgacaaacagaggagatgtcacatgggagaatgtaacctggcggcagcgcaaaagatg

SEQ ID NO: 170123 - DNA, 103 bp, Artificial Sequence
  Synthetic Polynucleotide
taatacgactcactatagggtaagcatctgaacacaaggtggacattctcaacagaggagagagaatatgcaccttgtgaacctggcggcagcgcaaaagatg

SEQ ID NO: 170124 - DNA, 103 bp, Artificial Sequence
  Synthetic Polynucleotide
taatacgactcactatagggcattttattctaagcatctgaacacaaggtaacagaggagaaccttgatgtcagatgctaacctggcggcagcgcaaaagatg

SEQ ID NO: 170125 - DNA, 103 bp, Artificial Sequence
  Synthetic Polynucleotide
taatacgactcactatagggtagctcgctggctgcggtagtctgcagggcaacagaggagagccctgatgactaccgcaaacctggcggcagcgcaaaagatg

SEQ ID NO: 170126 - DNA, 103 bp, Artificial Sequence
  Synthetic Polynucleotide
taatacgactcactatagggcttacagtgacattttattctaagcatctgaacagaggagacagatgatgagaataaaaaacctggcggcagcgcaaaagatg

SEQ ID NO: 170127 - DNA, 103 bp, Artificial Sequence
  Synthetic Polynucleotide
taatacgactcactatagggggcttgtgatcttacagtgacattttattcaacagaggagagaataaatggtcactgtaaacctggcggcagcgcaaaagatg

SEQ ID NO: 170128 - DNA, 103 bp, Artificial Sequence
  Synthetic Polynucleotide
taatacgactcactatagggtccacatacaggcttgtgatcttacagtgaaacagaggagatcactgatggatcacaagaacctggcggcagcgcaaaagatg

SEQ ID NO: 170129 - DNA, 103 bp, Artificial Sequence
  Synthetic Polynucleotide
taatacgactcactatagggttttctacattccacatacaggcttgtgataacagaggagaatcacaatgctgtatgtgaacctggcggcagcgcaaaagatg

SEQ ID NO: 170130 - DNA, 103 bp, Artificial Sequence
  Synthetic Polynucleotide
taatacgactcactatagggctgtggttatttttctacattccacatacaaacagaggagatgtatgatgaatgtagaaaacctggcggcagcgcaaaagatg

SEQ ID NO: 170131 - DNA, 103 bp, Artificial Sequence
  Synthetic Polynucleotide
taatacgactcactatagggtttacatcagctgtggttatttttctacataacagaggagaatgtagatgaataaccacaacctggcggcagcgcaaaagatg

SEQ ID NO: 170132 - DNA, 103 bp, Artificial Sequence
  Synthetic Polynucleotide
taatacgactcactataggggttcttttcatttacatcagctgtggttataacagaggagaataaccatggctgatgtaaacctggcggcagcgcaaaagatg

SEQ ID NO: 170133 - DNA, 103 bp, Artificial Sequence
  Synthetic Polynucleotide
taatacgactcactatagggaactgaggaggttcttttcatttacatcagaacagaggagactgatgatgatgaaaagaaacctggcggcagcgcaaaagatg

SEQ ID NO: 170134 - DNA, 103 bp, Artificial Sequence
  Synthetic Polynucleotide
taatacgactcactatagggtttttgcaacaactgaggaggttcttttcaaacagaggagatgaaaaatgcctcctcagaacctggcggcagcgcaaaagatg

SEQ ID NO: 170135 - DNA, 103 bp, Artificial Sequence
  Synthetic Polynucleotide
taatacgactcactatagggagggcactgatttttgcaacaactgaggagaacagaggagactcctcatgtgttgcaaaaacctggcggcagcgcaaaagatg

SEQ ID NO: 170136 - DNA, 103 bp, Artificial Sequence
  Synthetic Polynucleotide
taatacgactcactatagggtctgagacattagctcgctggctgcggtagaacagaggagactaccgatgccagcgagcaacctggcggcagcgcaaaagatg

SEQ ID NO: 170137 - DNA, 103 bp, Artificial Sequence
  Synthetic Polynucleotide
taatacgactcactataggggaagctctttagggcactgatttttgcaacaacagaggagagttgcaatgatcagtgccaacctggcggcagcgcaaaagatg

SEQ ID NO: 170138 - DNA, 103 bp, Artificial Sequence
  Synthetic Polynucleotide
taatacgactcactatagggtgaccacaaggaagctctttagggcactgaaacagaggagatcagtgatgtaaagagctaacctggcggcagcgcaaaagatg

SEQ ID NO: 170139 - DNA, 103 bp, Artificial Sequence
  Synthetic Polynucleotide
taatacgactcactatagggtttgcatctatgaccacaaggaagctctttaacagaggagaaaagagatgccttgtggtaacctggcggcagcgcaaaagatg

SEQ ID NO: 170140 - DNA, 103 bp, Artificial Sequence
  Synthetic Polynucleotide
taatacgactcactataggggacacatctctttgcatctatgaccacaagaacagaggagacttgtgatgatagatgcaaacctggcggcagcgcaaaagatg

SEQ ID NO: 170141 - DNA, 103 bp, Artificial Sequence
  Synthetic Polynucleotide
taatacgactcactatagggtcaccaggatgacacatctctttgcatctaaacagaggagatagatgatgagagatgtgaacctggcggcagcgcaaaagatg

SEQ ID NO: 170142 - DNA, 103 bp, Artificial Sequence
  Synthetic Polynucleotide
taatacgactcactatagggaaagggacattcaccaggatgacacatctcaacagaggagagagatgatgcatcctggtaacctggcggcagcgcaaaagatg

SEQ ID NO: 170143 - DNA, 103 bp, Artificial Sequence
  Synthetic Polynucleotide
taatacgactcactatagggggttgcagttaaagggacattcaccaggataacagaggagaatcctgatgaatgtccctaacctggcggcagcgcaaaagatg

SEQ ID NO: 170144 - DNA, 103 bp, Artificial Sequence
  Synthetic Polynucleotide
taatacgactcactatagggtttaccttctggttgcagttaaagggacataacagaggagaatgtccatgtaactgcaaaacctggcggcagcgcaaaagatg

SEQ ID NO: 170145 - DNA, 103 bp, Artificial Sequence
  Synthetic Polynucleotide
taatacgactcactatagggacatctaagttttaccttctggttgcagttaacagaggagaaactgcatgcagaaggtaaacctggcggcagcgcaaaagatg

SEQ ID NO: 170146 - DNA, 103 bp, Artificial Sequence
  Synthetic Polynucleotide
taatacgactcactatagggttttacaaggacatctaagttttaccttctaacagaggagaagaaggatgaacttagataacctggcggcagcgcaaaagatg

SEQ ID NO: 170147 - DNA, 103 bp, Artificial Sequence
  Synthetic Polynucleotide
taatacgactcactatagggtcaaattttttctgagacattagctcgctgaacagaggagacagcgaatgaatgtctcaaacctggcggcagcgcaaaagatg

SEQ ID NO: 170148 - DNA, 103 bp, Artificial Sequence
  Synthetic Polynucleotide
taatacgactcactatagggttttttattcttttacaaggacatctaagtaacagaggagaacttagatgtccttgtaaaacctggcggcagcgcaaaagatg

SEQ ID NO: 170149 - DNA, 103 bp, Artificial Sequence
  Synthetic Polynucleotide
taatacgactcactatagggctgcaattccttttttattcttttacaaggaacagaggagaccttgtatgagaataaaaaacctggcggcagcgcaaaagatg

SEQ ID NO: 170150 - DNA, 103 bp, Artificial Sequence
  Synthetic Polynucleotide
taatacgactcactatagggctttgttgcactgcaattccttttttattcaacagaggagagaataaatgaggaattgcaacctggcggcagcgcaaaagatg

SEQ ID NO: 170151 - DNA, 103 bp, Artificial Sequence
  Synthetic Polynucleotide
taatacgactcactatagggttttcacgtactttgttgcactgcaattccaacagaggagaggaattatggtgcaacaaaacctggcggcagcgcaaaagatg

SEQ ID NO: 170152 - DNA, 103 bp, Artificial Sequence
  Synthetic Polynucleotide
taatacgactcactatagggtgaaacctgattttcacgtactttgttgcaaacagaggagatgcaacatggtacgtgaaaacctggcggcagcgcaaaagatg

SEQ ID NO: 170153 - DNA, 103 bp, Artificial Sequence
  Synthetic Polynucleotide
taatacgactcactatagggcacattctattgaaacctgattttcacgtaaacagaggagatacgtgatgatcaggtttaacctggcggcagcgcaaaagatg

SEQ ID NO: 170154 - DNA, 103 bp, Artificial Sequence
  Synthetic Polynucleotide
taatacgactcactatagggcacgttgtgtcacattctattgaaacctgaaacagaggagatcaggtatgaatagaatgaacctggcggcagcgcaaaagatg

SEQ ID NO: 170155 - DNA, 103 bp, Artificial Sequence
  Synthetic Polynucleotide
taatacgactcactatagggcatttccttgcacgttgtgtcacattctataacagaggagaatagaaatggacacaacgaacctggcggcagcgcaaaagatg

SEQ ID NO: 170156 - DNA, 103 bp, Artificial Sequence
  Synthetic Polynucleotide
taatacgactcactatagggctttccgcttcatttccttgcacgttgtgtaacagaggagaacacaaatggcaaggaaaaacctggcggcagcgcaaaagatg

SEQ ID NO: 170157 - DNA, 103 bp, Artificial Sequence
  Synthetic Polynucleotide
taatacgactcactatagggatctcagatgctttccgcttcatttccttgaacagaggagacaaggaatggaagcggaaaacctggcggcagcgcaaaagatg

SEQ ID NO: 170158 - DNA, 103 bp, Artificial Sequence
  Synthetic Polynucleotide
taatacgactcactatagggcttgatttcttcaaattttttctgagacataacagaggagaatgtctatgaaaaaatttaacctggcggcagcgcaaaagatg

SEQ ID NO: 170159 - DNA, 103 bp, Artificial Sequence
  Synthetic Polynucleotide
taatacgactcactatagggtgcttcttttatctcagatgctttccgcttaacagaggagaaagcggatggcatctgagaacctggcggcagcgcaaaagatg

SEQ ID NO: 170160 - DNA, 103 bp, Artificial Sequence
  Synthetic Polynucleotide
taatacgactcactatagggctttggcttctgcttcttttatctcagatgaacagaggagacatctgatgtaaaagaagaacctggcggcagcgcaaaagatg

SEQ ID NO: 170161 - DNA, 103 bp, Artificial Sequence
  Synthetic Polynucleotide
taatacgactcactatagggtcaagagcagctttggcttctgcttcttttaacagaggagaaaaagaatgagaagccaaaacctggcggcagcgcaaaagatg

SEQ ID NO: 170162 - DNA, 103 bp, Artificial Sequence
  Synthetic Polynucleotide
taatacgactcactatagggtttttcttcttcaagagcagctttggcttcaacagaggagagaagccatggctgctcttaacctggcggcagcgcaaaagatg

SEQ ID NO: 170163 - DNA, 103 bp, Artificial Sequence
  Synthetic Polynucleotide
taatacgactcactataggggttgtcttcgtttttcttcttcaagagcagaacagaggagactgctcatgaagaagaaaaacctggcggcagcgcaaaagatg

SEQ ID NO: 170164 - DNA, 103 bp, Artificial Sequence
  Synthetic Polynucleotide
taatacgactcactatagggagttcagcctgttgtcttcgtttttcttctaacagaggagaagaagaatgacgaagacaaacctggcggcagcgcaaaagatg

SEQ ID NO: 170165 - DNA, 103 bp, Artificial Sequence
  Synthetic Polynucleotide
taatacgactcactatagggaaaagcttctagttcagcctgttgtcttcgaacagaggagacgaagaatgcaggctgaaaacctggcggcagcgcaaaagatg

SEQ ID NO: 170166 - DNA, 103 bp, Artificial Sequence
  Synthetic Polynucleotide
taatacgactcactataggggtctgttttcaaaagcttctagttcagcctaacagaggagaaggctgatgtagaagcttaacctggcggcagcgcaaaagatg

SEQ ID NO: 170167 - DNA, 103 bp, Artificial Sequence
  Synthetic Polynucleotide
taatacgactcactatagggcgacccttcagtctgttttcaaaagcttctaacagaggagaagaagcatgtgaaaacagaacctggcggcagcgcaaaagatg

SEQ ID NO: 170168 - DNA, 103 bp, Artificial Sequence
  Synthetic Polynucleotide
taatacgactcactatagggcttcttccgacgacccttcagtctgttttcaacagaggagagaaaacatgctgaagggtaacctggcggcagcgcaaaagatg

SEQ ID NO: 170169 - DNA, 103 bp, Artificial Sequence
  Synthetic Polynucleotide
taatacgactcactatagggggttagctttcttgatttcttcaaatttttaacagaggagaaaaaatatgaagaaatcaaacctggcggcagcgcaaaagatg

SEQ ID NO: 170170 - DNA, 103 bp, Artificial Sequence
  Synthetic Polynucleotide
taatacgactcactatagggttttcctgttcttcttccgacgacccttcaaacagaggagatgaaggatggtcggaagaaacctggcggcagcgcaaaagatg

SEQ ID NO: 170171 - DNA, 103 bp, Artificial Sequence
  Synthetic Polynucleotide
taatacgactcactatagggacttcatctcttttcctgttcttcttccgaaacagaggagatcggaaatggaacaggaaaacctggcggcagcgcaaaagatg

SEQ ID NO: 170172 - DNA, 103 bp, Artificial Sequence
  Synthetic Polynucleotide
taatacgactcactatagggctcaactgccacttcatctcttttcctgttaacagaggagaaacaggatgagagatgaaaacctggcggcagcgcaaaagatg

SEQ ID NO: 170173 - DNA, 103 bp, Artificial Sequence
  Synthetic Polynucleotide
taatacgactcactatagggatagtgatagctcaactgccacttcatctcaacagaggagagagatgatgtggcagttgaacctggcggcagcgcaaaagatg

SEQ ID NO: 170174 - DNA, 103 bp, Artificial Sequence
  Synthetic Polynucleotide
taatacgactcactatagggtgtttttgccatagtgatagctcaactgccaacagaggagaggcagtatggctatcactaacctggcggcagcgcaaaagatg

SEQ ID NO: 170175 - DNA, 103 bp, Artificial Sequence
  Synthetic Polynucleotide
taatacgactcactatagggataatatttatgtttttgccatagtgatagaacagaggagactatcaatgtggcaaaaaaacctggcggcagcgcaaaagatg

SEQ ID NO: 170176 - DNA, 103 bp, Artificial Sequence
  Synthetic Polynucleotide
taatacgactcactatagggctgaaatgagataatatttatgtttttgccaacagaggagaggcaaaatgataaatattaacctggcggcagcgcaaaagatg

SEQ ID NO: 170177 - DNA, 103 bp, Artificial Sequence
  Synthetic Polynucleotide
taatacgactcactatagggactccacacactgaaatgagataatatttaaacagaggagataaataatgtctcatttcaacctggcggcagcgcaaaagatg

SEQ ID NO: 170178 - DNA, 103 bp, Artificial Sequence
  Synthetic Polynucleotide
taatacgactcactatagggtacaaccacaactccacacactgaaatgagaacagaggagactcattatggtgtgtggaaacctggcggcagcgcaaaagatg

SEQ ID NO: 170179 - DNA, 103 bp, Artificial Sequence
  Synthetic Polynucleotide
taatacgactcactatagggaggcaaacactacaaccacaactccacacaaacagaggagatgtgtgatgttgtggttgaacctggcggcagcgcaaaagatg

SEQ ID NO: 170180 - DNA, 103 bp, Artificial Sequence
  Synthetic Polynucleotide
taatacgactcactataggggctgcagcttggttagctttcttgatttctaacagaggagaagaaatatggaaagctaaaacctggcggcagcgcaaaagatg

SEQ ID NO: 170181 - DNA, 103 bp, Artificial Sequence
  Synthetic Polynucleotide
taatacgactcactataggggtgatgtaccaggcaaacactacaaccacaaacagaggagatgtggtatgagtgtttgcaacctggcggcagcgcaaaagatg

SEQ ID NO: 170182 - DNA, 103 bp, Artificial Sequence
  Synthetic Polynucleotide
taatacgactcactataggggacatcatgggtgatgtaccaggcaaacacaacagaggagagtgtttatgtggtacatcaacctggcggcagcgcaaaagatg

SEQ ID NO: 170183 - DNA, 103 bp, Artificial Sequence
  Synthetic Polynucleotide
taatacgactcactatagggaagttttctggctgcagcttggttagctttaacagaggagaaaagctatgcaagctgcaaacctggcggcagcgcaaaagatg

SEQ ID NO: 170184 - DNA, 103 bp, Artificial Sequence
  Synthetic Polynucleotide
taatacgactcactataggggttcttcaacaagttttctggctgcagcttaacagaggagaaagctgatgccagaaaacaacctggcggcagcgcaaaagatg

SEQ ID NO: 170185 - DNA, 103 bp, Artificial Sequence
  Synthetic Polynucleotide
taatacgactcactatagggccccgggatcggcctcggccaccggccaccaacagaggagaggtggcatgtggccgaggaacctggcggcagcgcaaaagatg

SEQ ID NO: 170186 - DNA, 103 bp, Artificial Sequence
  Synthetic Polynucleotide
taatacgactcactataggggagctaaactgttcttcaacaagttttctgaacagaggagacagaaaatgtgttgaagaaacctggcggcagcgcaaaagatg

SEQ ID NO: 170187 - DNA, 103 bp, Artificial Sequence
  Synthetic Polynucleotide
taatacgactcactatagggttcagatgaagagctaaactgttcttcaacaacagaggagagttgaaatgcagtttagcaacctggcggcagcgcaaaagatg

SEQ ID NO: 170188 - DNA, 103 bp, Artificial Sequence
  Synthetic Polynucleotide
taatacgactcactatagggcatctccttcttcagatgaagagctaaactaacagaggagaagtttaatgcttcatctgaacctggcggcagcgcaaaagatg

SEQ ID NO: 170189 - DNA, 103 bp, Artificial Sequence
  Synthetic Polynucleotide
taatacgactcactatagggtcaaaatcttcatctccttcttcagatgaaaacagaggagattcatcatgagaaggagaaacctggcggcagcgcaaaagatg

SEQ ID NO: 170190 - DNA, 103 bp, Artificial Sequence
  Synthetic Polynucleotide
taatacgactcactatagggctgttttccttcaaaatcttcatctccttcaacagaggagagaaggaatggaagattttaacctggcggcagcgcaaaagatg

SEQ ID NO: 170191 - DNA, 103 bp, Artificial Sequence
  Synthetic Polynucleotide
taatacgactcactataggggtatttttccctgttttccttcaaaatcttaacagaggagaaagattatgaaggaaaacaacctggcggcagcgcaaaagatg

SEQ ID NO: 170192 - DNA, 103 bp, Artificial Sequence
  Synthetic Polynucleotide
taatacgactcactataggggtatttgcaagtatttttccctgttttcctaacagaggagaaggaaaatggggaaaaataacctggcggcagcgcaaaagatg

SEQ ID NO: 170193 - DNA, 103 bp, Artificial Sequence
  Synthetic Polynucleotide
taatacgactcactatagggtgttataaacgtatttgcaagtatttttccaacagaggagaggaaaaatgcttgcaaataacctggcggcagcgcaaaagatg

SEQ ID NO: 170194 - DNA, 103 bp, Artificial Sequence
  Synthetic Polynucleotide
taatacgactcactataggggagtagtgtatgttataaacgtatttgcaaaacagaggagattgcaaatgcgtttataaaacctggcggcagcgcaaaagatg

SEQ ID NO: 170195 - DNA, 103 bp, Artificial Sequence
  Synthetic Polynucleotide
taatacgactcactatagggccatctgtctgagtagtgtatgttataaacaacagaggagagtttatatgatacactacaacctggcggcagcgcaaaagatg

SEQ ID NO: 170196 - DNA, 103 bp, Artificial Sequence
  Synthetic Polynucleotide
taatacgactcactatagggagtggcccgtccccgggatcggcctcggccaacagaggagaggccgaatgcgatcccggaacctggcggcagcgcaaaagatg

SEQ ID NO: 170197 - DNA, 103 bp, Artificial Sequence
  Synthetic Polynucleotide
taatacgactcactatagggacgtgtatctccatctgtctgagtagtgtaaacagaggagatacactatgcagacagataacctggcggcagcgcaaaagatg

SEQ ID NO: 170198 - DNA, 103 bp, Artificial Sequence
  Synthetic Polynucleotide
taatacgactcactataggggctctaattcacgtgtatctccatctgtctaacagaggagaagacagatggagatacacaacctggcggcagcgcaaaagatg

SEQ ID NO: 170199 - DNA, 103 bp, Artificial Sequence
  Synthetic Polynucleotide
taatacgactcactatagggtgttttgttcgctctaattcacgtgtatctaacagaggagaagatacatgtgaattagaaacctggcggcagcgcaaaagatg

SEQ ID NO: 170200 - DNA, 103 bp, Artificial Sequence
  Synthetic Polynucleotide
taatacgactcactatagggatttacatattgttttgttcgctctaattcaacagaggagagaattaatgcgaacaaaaaacctggcggcagcgcaaaagatg

SEQ ID NO: 170201 - DNA, 103 bp, Artificial Sequence
  Synthetic Polynucleotide
taatacgactcactataggggaaaagcttcatttacatattgttttgttcaacagaggagagaacaaatgaatatgtaaaacctggcggcagcgcaaaagatg

SEQ ID NO: 170202 - DNA, 103 bp, Artificial Sequence
  Synthetic Polynucleotide
taatacgactcactataggggcccctgcttgaaaagcttcatttacatataacagaggagaatatgtatgtgaagctttaacctggcggcagcgcaaaagatg

SEQ ID NO: 170203 - DNA, 103 bp, Artificial Sequence
  Synthetic Polynucleotide
taatacgactcactataggggcatgtcatagcccctgcttgaaaagcttcaacagaggagagaagctatgcaagcagggaacctggcggcagcgcaaaagatg

SEQ ID NO: 170204 - DNA, 103 bp, Artificial Sequence
  Synthetic Polynucleotide
taatacgactcactatagggtacaaattaggcatgtcatagcccctgcttaacagaggagaaagcagatgctatgacataacctggcggcagcgcaaaagatg

SEQ ID NO: 170205 - DNA, 103 bp, Artificial Sequence
  Synthetic Polynucleotide
taatacgactcactatagggaccgaagcaatacaaattaggcatgtcataaacagaggagatatgacatgcctaatttgaacctggcggcagcgcaaaagatg

SEQ ID NO: 170206 - DNA, 103 bp, Artificial Sequence
  Synthetic Polynucleotide
taatacgactcactataggggtttctcttcaccgaagcaatacaaattagaacagaggagactaattatgattgcttcgaacctggcggcagcgcaaaagatg

SEQ ID NO: 170207 - DNA, 103 bp, Artificial Sequence
  Synthetic Polynucleotide
taatacgactcactatagggagggggcggcagtggcccgtccccgggatcaacagaggagagatcccatggacgggccaaacctggcggcagcgcaaaagatg

SEQ ID NO: 170208 - DNA, 103 bp, Artificial Sequence
  Synthetic Polynucleotide
taatacgactcactatagggaaactgcttggtttctcttcaccgaagcaaaacagaggagattgcttatgtgaagagaaaacctggcggcagcgcaaaagatg

SEQ ID NO: 170209 - DNA, 103 bp, Artificial Sequence
  Synthetic Polynucleotide
taatacgactcactataggggaacagctccaaactgcttggtttctcttcaacagaggagagaagagatgccaagcagtaacctggcggcagcgcaaaagatg

SEQ ID NO: 170210 - DNA, 103 bp, Artificial Sequence
  Synthetic Polynucleotide
taatacgactcactataggggaaacatcccgaacagctccaaactgcttgaacagaggagacaagcaatgtggagctgtaacctggcggcagcgcaaaagatg

SEQ ID NO: 170211 - DNA, 103 bp, Artificial Sequence
  Synthetic Polynucleotide
taatacgactcactataggggaaatatacagaaacatcccgaacagctccaacagaggagaggagctatgcgggatgttaacctggcggcagcgcaaaagatg

SEQ ID NO: 170212 - DNA, 103 bp, Artificial Sequence
  Synthetic Polynucleotide
taatacgactcactatagggcagggcatgtgaaatatacagaaacatcccaacagaggagagggatgatgctgtatattaacctggcggcagcgcaaaagatg

SEQ ID NO: 170213 - DNA, 103 bp, Artificial Sequence
  Synthetic Polynucleotide
taatacgactcactatagggcttctggatacagggcatgtgaaatatacaaacagaggagatgtataatgcacatgcccaacctggcggcagcgcaaaagatg

SEQ ID NO: 170214 - DNA, 103 bp, Artificial Sequence
  Synthetic Polynucleotide
taatacgactcactatagggctttagcccacttctggatacagggcatgtaacagaggagaacatgcatggtatccagaaacctggcggcagcgcaaaagatg

SEQ ID NO: 170215 - DNA, 103 bp, Artificial Sequence
  Synthetic Polynucleotide
taatacgactcactatagggaactggctgtctttagcccacttctggataaacagaggagatatccaatggtgggctaaaacctggcggcagcgcaaaagatg

SEQ ID NO: 170216 - DNA, 103 bp, Artificial Sequence
  Synthetic Polynucleotide
taatacgactcactatagggagatacaagaaactggctgtctttagcccaaacagaggagatgggctatggacagccagaacctggcggcagcgcaaaagatg

SEQ ID NO: 170217 - DNA, 103 bp, Artificial Sequence
  Synthetic Polynucleotide
taatacgactcactatagggcagtcacagaagatacaagaaactggctgtaacagaggagaacagccatgttcttgtataacctggcggcagcgcaaaagatg

SEQ ID NO: 170218 - DNA, 103 bp, Artificial Sequence
  Synthetic Polynucleotide
taatacgactcactatagggccatttcctgagggggcggcagtggcccgtaacagaggagaacgggcatgtgccgccccaacctggcggcagcgcaaaagatg

SEQ ID NO: 170219 - DNA, 103 bp, Artificial Sequence
  Synthetic Polynucleotide
taatacgactcactatagggaaatcatcatcagtcacagaagatacaagaaacagaggagatcttgtatgttctgtgacaacctggcggcagcgcaaaagatg

SEQ ID NO: 170220 - DNA, 103 bp, Artificial Sequence
  Synthetic Polynucleotide
taatacgactcactatagggtttctttccaaaatcatcatcagtcacagaaacagaggagatctgtgatggatgatgataacctggcggcagcgcaaaagatg

SEQ ID NO: 170221 - DNA, 103 bp, Artificial Sequence
  Synthetic Polynucleotide
taatacgactcactatagggagggacaatctttctttccaaaatcatcataacagaggagaatgatgatgttggaaagaaacctggcggcagcgcaaaagatg

SEQ ID NO: 170222 - DNA, 103 bp, Artificial Sequence
  Synthetic Polynucleotide
taatacgactcactatagggggacaaggccagggacaatctttctttccaaacagaggagatggaaaatgagattgtccaacctggcggcagcgcaaaagatg

SEQ ID NO: 170223 - DNA, 103 bp, Artificial Sequence
  Synthetic Polynucleotide
taatacgactcactatagggcctacattttggacaaggccagggacaatcaacagaggagagattgtatgtggccttgtaacctggcggcagcgcaaaagatg

SEQ ID NO: 170224 - DNA, 103 bp, Artificial Sequence
  Synthetic Polynucleotide
taatacgactcactatagggtgtattcaaacctacattttggacaaggccaacagaggagaggccttatgcaaaatgtaaacctggcggcagcgcaaaagatg

SEQ ID NO: 170225 - DNA, 103 bp, Artificial Sequence
  Synthetic Polynucleotide
taatacgactcactatagggtcagatcgtttgtattcaaacctacattttaacagaggagaaaaatgatggtttgaataaacctggcggcagcgcaaaagatg

SEQ ID NO: 170226 - DNA, 103 bp, Artificial Sequence
  Synthetic Polynucleotide
taatacgactcactatagggactaggtgtttcagatcgtttgtattcaaaaacagaggagatttgaaatgaaacgatctaacctggcggcagcgcaaaagatg

SEQ ID NO: 170227 - DNA, 103 bp, Artificial Sequence
  Synthetic Polynucleotide
taatacgactcactatagggaatagtacctactaggtgtttcagatcgttaacagaggagaaacgatatgaaacacctaaacctggcggcagcgcaaaagatg

SEQ ID NO: 170228 - DNA, 103 bp, Artificial Sequence
  Synthetic Polynucleotide
taatacgactcactatagggccacaatagcaatagtacctactaggtgttaacagaggagaaacaccatgtaggtactaaacctggcggcagcgcaaaagatg

SEQ ID NO: 170229 - DNA, 103 bp, Artificial Sequence
  Synthetic Polynucleotide
taatacgactcactataggggagatggactccatttcctgagggggcggcaacagaggagagccgccatgtcaggaaataacctggcggcagcgcaaaagatg

SEQ ID NO: 170230 - DNA, 103 bp, Artificial Sequence
  Synthetic Polynucleotide
taatacgactcactatagggttctacttttccacaatagcaatagtacctaacagaggagaaggtacatgtgctattgtaacctggcggcagcgcaaaagatg

SEQ ID NO: 170231 - DNA, 103 bp, Artificial Sequence
  Synthetic Polynucleotide
taatacgactcactatagggaaggtggatcttctacttttccacaatagcaacagaggagagctattatggaaaagtagaacctggcggcagcgcaaaagatg

SEQ ID NO: 170232 - DNA, 103 bp, Artificial Sequence
  Synthetic Polynucleotide
taatacgactcactatagggcacggatctaaaggtggatcttctacttttaacagaggagaaaaagtatgagatccaccaacctggcggcagcgcaaaagatg

SEQ ID NO: 170233 - DNA, 103 bp, Artificial Sequence
  Synthetic Polynucleotide
taatacgactcactatagggaggcacaagccacggatctaaaggtggatcaacagaggagagatccaatgttagatccgaacctggcggcagcgcaaaagatg

SEQ ID NO: 170234 - DNA, 103 bp, Artificial Sequence
  Synthetic Polynucleotide
taatacgactcactatagggcacatgaatgaggcacaagccacggatctaaacagaggagatagatcatgggcttgtgcaacctggcggcagcgcaaaagatg

SEQ ID NO: 170235 - DNA, 103 bp, Artificial Sequence
  Synthetic Polynucleotide
taatacgactcactatagggcatacttggccacatgaatgaggcacaagcaacagaggagagcttgtatgtcattcatgaacctggcggcagcgcaaaagatg

SEQ ID NO: 170236 - DNA, 103 bp, Artificial Sequence
  Synthetic Polynucleotide
taatacgactcactatagggttcacgctcacatacttggccacatgaatgaacagaggagacattcaatgggccaagtaaacctggcggcagcgcaaaagatg

SEQ ID NO: 170237 - DNA, 103 bp, Artificial Sequence
  Synthetic Polynucleotide
taatacgactcactataggggaggtttaaattcacgctcacatacttggcaacagaggagagccaagatggtgagcgtgaacctggcggcagcgcaaaagatg

SEQ ID NO: 170238 - DNA, 103 bp, Artificial Sequence
  Synthetic Polynucleotide
taatacgactcactatagggtggccacaaggaggtttaaattcacgctcaaacagaggagatgagcgatgatttaaaccaacctggcggcagcgcaaaagatg

SEQ ID NO: 170239 - DNA, 103 bp, Artificial Sequence
  Synthetic Polynucleotide
taatacgactcactatagggtaaacatttatggccacaaggaggtttaaaaacagaggagatttaaaatgccttgtggcaacctggcggcagcgcaaaagatg

SEQ ID NO: 170240 - DNA, 103 bp, Artificial Sequence
  Synthetic Polynucleotide
taatacgactcactatagggcggcgccgcggagatggactccatttcctgaacagaggagacaggaaatggagtccatcaacctggcggcagcgcaaaagatg

SEQ ID NO: 170241 - DNA, 103 bp, Artificial Sequence
  Synthetic Polynucleotide
taatacgactcactataggggacagaggagtaaacatttatggccacaagaacagaggagacttgtgatgataaatgttaacctggcggcagcgcaaaagatg

SEQ ID NO: 170242 - DNA, 103 bp, Artificial Sequence
  Synthetic Polynucleotide
taatacgactcactatagggggacctggatgacagaggagtaaacatttaaacagaggagataaatgatgactcctctgaacctggcggcagcgcaaaagatg

SEQ ID NO: 170243 - DNA, 103 bp, Artificial Sequence
  Synthetic Polynucleotide
taatacgactcactatagggaggagggcagggacctggatgacagaggagaacagaggagactcctcatgcatccaggtaacctggcggcagcgcaaaagatg

SEQ ID NO: 170244 - DNA, 103 bp, Artificial Sequence
  Synthetic Polynucleotide
taatacgactcactatagggtctttggacaaggagggcagggacctggataacagaggagaatccagatgcctgccctcaacctggcggcagcgcaaaagatg

SEQ ID NO: 170245 - DNA, 103 bp, Artificial Sequence
  Synthetic Polynucleotide
taatacgactcactataggggttgtgaccatctttggacaaggagggcagaacagaggagactgcccatgttgtccaaaaacctggcggcagcgcaaaagatg

SEQ ID NO: 170246 - DNA, 103 bp, Artificial Sequence
  Synthetic Polynucleotide
taatacgactcactataggggtaacaagtagttgtgaccatctttggacaaacagaggagatgtccaatgatggtcacaaacctggcggcagcgcaaaagatg

SEQ ID NO: 170247 - DNA, 103 bp, Artificial Sequence
  Synthetic Polynucleotide
taatacgactcactatagggctttcttacagtaacaagtagttgtgaccaaacagaggagatggtcaatgctacttgttaacctggcggcagcgcaaaagatg

SEQ ID NO: 170248 - DNA, 103 bp, Artificial Sequence
  Synthetic Polynucleotide
taatacgactcactatagggataggttttgctttcttacagtaacaagtaaacagaggagatacttgatgctgtaagaaaacctggcggcagcgcaaaagatg

SEQ ID NO: 170249 - DNA, 103 bp, Artificial Sequence
  Synthetic Polynucleotide
taatacgactcactatagggcctacgagggataggttttgctttcttacaaacagaggagatgtaagatggcaaaacctaacctggcggcagcgcaaaagatg

SEQ ID NO: 170250 - DNA, 103 bp, Artificial Sequence
  Synthetic Polynucleotide
taatacgactcactatagggtggcactgcacctacgagggataggttttgaacagaggagacaaaacatgtccctcgtaaacctggcggcagcgcaaaagatg

SEQ ID NO: 170251 - DNA, 103 bp, Artificial Sequence
  Synthetic Polynucleotide
taatacgactcactatagggcgccctcctccggcgccgcggagatggactaacagaggagaagtccaatgccgcggcgcaacctggcggcagcgcaaaagatg

SEQ ID NO: 170252 - DNA, 103 bp, Artificial Sequence
  Synthetic Polynucleotide
taatacgactcactataggggaccattccttggcactgcacctacgagggaacagaggagaccctcgatggtgcagtgcaacctggcggcagcgcaaaagatg

SEQ ID NO: 170253 - DNA, 103 bp, Artificial Sequence
  Synthetic Polynucleotide
taatacgactcactatagggcagctgacaagaccattccttggcactgcaaacagaggagatgcagtatgaaggaatggaacctggcggcagcgcaaaagatg

SEQ ID NO: 170254 - DNA, 103 bp, Artificial Sequence
  Synthetic Polynucleotide
taatacgactcactataggggtccacatggcagctgacaagaccattcctaacagaggagaaggaatatgcttgtcagcaacctggcggcagcgcaaaagatg

SEQ ID NO: 170255 - DNA, 103 bp, Artificial Sequence
  Synthetic Polynucleotide
taatacgactcactatagggagcaacttctgtccacatggcagctgacaaaacagaggagattgtcaatggccatgtggaacctggcggcagcgcaaaagatg

SEQ ID NO: 170256 - DNA, 103 bp, Artificial Sequence
  Synthetic Polynucleotide
taatacgactcactatagggttgcccacaaagcaacttctgtccacatggaacagaggagaccatgtatgcagaagttgaacctggcggcagcgcaaaagatg

SEQ ID NO: 170257 - DNA, 103 bp, Artificial Sequence
  Synthetic Polynucleotide
taatacgactcactatagggcacacttatgttgcccacaaagcaacttctaacagaggagaagaagtatgtttgtgggcaacctggcggcagcgcaaaagatg

SEQ ID NO: 170258 - DNA, 103 bp, Artificial Sequence
  Synthetic Polynucleotide
taatacgactcactatagggcaaggattttcacacttatgttgcccacaaaacagaggagattgtggatgacataagtgaacctggcggcagcgcaaaagatg

SEQ ID NO: 170259 - DNA, 103 bp, Artificial Sequence
  Synthetic Polynucleotide
taatacgactcactatagggtcctgcatgacaaggattttcacacttatgaacagaggagacataagatggaaaatcctaacctggcggcagcgcaaaagatg

SEQ ID NO: 170260 - DNA, 103 bp, Artificial Sequence
  Synthetic Polynucleotide
taatacgactcactataggggctgacagcttcctgcatgacaaggattttaacagaggagaaaaatcatggtcatgcagaacctggcggcagcgcaaaagatg

SEQ ID NO: 170261 - DNA, 103 bp, Artificial Sequence
  Synthetic Polynucleotide
taatacgactcactatagggcttggacaaggctgacagcttcctgcatgaaacagaggagatcatgcatgaagctgtcaaacctggcggcagcgcaaaagatg

SEQ ID NO: 170262 - DNA, 103 bp, Artificial Sequence
  Synthetic Polynucleotide
taatacgactcactatagggactattgctgtttgctgtatactgctccataacagaggagaatggagatgtatacagcaaacctggcggcagcgcaaaagatg

SEQ ID NO: 170263 - DNA, 103 bp, Artificial Sequence
  Synthetic Polynucleotide
taatacgactcactatagggtagctggcctccactgacctgcaccattaaaacagaggagattaatgatgcaggtcagtaacctggcggcagcgcaaaagatg

SEQ ID NO: 170264 - DNA, 103 bp, Artificial Sequence
  Synthetic Polynucleotide
taatacgactcactatagggttgatgtgattagctggcctccactgacctaacagaggagaaggtcaatggaggccagcaacctggcggcagcgcaaaagatg

SEQ ID NO: 170265 - DNA, 103 bp, Artificial Sequence
  Synthetic Polynucleotide
taatacgactcactatagggggttggccagttgatgtgattagctggcctaacagaggagaaggccaatgaatcacatcaacctggcggcagcgcaaaagatg

SEQ ID NO: 170266 - DNA, 103 bp, Artificial Sequence
  Synthetic Polynucleotide
taatacgactcactataggggaccatgatgggttggccagttgatgtgataacagaggagaatcacaatgactggccaaaacctggcggcagcgcaaaagatg

SEQ ID NO: 170267 - DNA, 103 bp, Artificial Sequence
  Synthetic Polynucleotide
taatacgactcactatagggggacagcctggaccatgatgggttggccagaacagaggagactggccatgccatcatggaacctggcggcagcgcaaaagatg

SEQ ID NO: 170268 - DNA, 103 bp, Artificial Sequence
  Synthetic Polynucleotide
taatacgactcactatagggtgtccaccagggacagcctggaccatgatgaacagaggagacatcatatgccaggctgtaacctggcggcagcgcaaaagatg

SEQ ID NO: 170269 - DNA, 103 bp, Artificial Sequence
  Synthetic Polynucleotide
taatacgactcactatagggggtttgaccttgtccaccagggacagcctgaacagaggagacaggctatgcctggtggaaacctggcggcagcgcaaaagatg

SEQ ID NO: 170270 - DNA, 103 bp, Artificial Sequence
  Synthetic Polynucleotide
taatacgactcactatagggcttgcatgatggtttgaccttgtccaccagaacagaggagactggtgatgaaggtcaaaaacctggcggcagcgcaaaagatg

SEQ ID NO: 170271 - DNA, 103 bp, Artificial Sequence
  Synthetic Polynucleotide
taatacgactcactataggggaaacaggtacttgcatgatggtttgacctaacagaggagaaggtcaatgcatcatgcaaacctggcggcagcgcaaaagatg

SEQ ID NO: 170272 - DNA, 103 bp, Artificial Sequence
  Synthetic Polynucleotide
taatacgactcactatagggctgtgttccagaaacaggtacttgcatgataacagaggagaatcatgatggtacctgttaacctggcggcagcgcaaaagatg

SEQ ID NO: 170273 - DNA, 103 bp, Artificial Sequence
  Synthetic Polynucleotide
taatacgactcactataggggctctgtcgaactattgctgtttgctgtataacagaggagaatacagatgacagcaataaacctggcggcagcgcaaaagatg

SEQ ID NO: 170274 - DNA, 103 bp, Artificial Sequence
  Synthetic Polynucleotide
taatacgactcactataggggctgcaaaccctgtgttccagaaacaggtaaacagaggagatacctgatgctggaacacaacctggcggcagcgcaaaagatg

SEQ ID NO: 170275 - DNA, 103 bp, Artificial Sequence
  Synthetic Polynucleotide
taatacgactcactatagggaactgtatttgctgcaaaccctgtgttccaaacagaggagatggaacatggggtttgcaaacctggcggcagcgcaaaagatg

SEQ ID NO: 170276 - DNA, 103 bp, Artificial Sequence
  Synthetic Polynucleotide
taatacgactcactatagggaggtgggaccaactgtatttgctgcaaaccaacagaggagaggtttgatgcaaatacagaacctggcggcagcgcaaaagatg

SEQ ID NO: 170277 - DNA, 103 bp, Artificial Sequence
  Synthetic Polynucleotide
taatacgactcactatagggggatctgtccaggtgggaccaactgtatttaacagaggagaaaatacatgtggtcccacaacctggcggcagcgcaaaagatg

SEQ ID NO: 170278 - DNA, 103 bp, Artificial Sequence
  Synthetic Polynucleotide
taatacgactcactatagggccctggatctggatctgtccaggtgggaccaacagaggagaggtcccatgtggacagataacctggcggcagcgcaaaagatg

SEQ ID NO: 170279 - DNA, 103 bp, Artificial Sequence
  Synthetic Polynucleotide
taatacgactcactatagggagcctgtccaccctggatctggatctgtccaacagaggagaggacagatgcagatccagaacctggcggcagcgcaaaagatg

SEQ ID NO: 170280 - DNA, 103 bp, Artificial Sequence
  Synthetic Polynucleotide
taatacgactcactataggggcacctgcacagcctgtccaccctggatctaacagaggagaagatccatggtggacaggaacctggcggcagcgcaaaagatg

SEQ ID NO: 170281 - DNA, 103 bp, Artificial Sequence
  Synthetic Polynucleotide
taatacgactcactatagggtgctggccctgcacctgcacagcctgtccaaacagaggagatggacaatgtgtgcaggtaacctggcggcagcgcaaaagatg

SEQ ID NO: 170282 - DNA, 103 bp, Artificial Sequence
  Synthetic Polynucleotide
taatacgactcactatagggggtctggccctgctggccctgcacctgcacaacagaggagagtgcagatgcagggccagaacctggcggcagcgcaaaagatg

SEQ ID NO: 170283 - DNA, 103 bp, Artificial Sequence
  Synthetic Polynucleotide
taatacgactcactatagggtgatctgctgggtctggccctgctggccctaacagaggagaagggccatgagggccagaaacctggcggcagcgcaaaagatg

SEQ ID NO: 170284 - DNA, 103 bp, Artificial Sequence
  Synthetic Polynucleotide
taatacgactcactatagggacaacaatctgctctgtcgaactattgctgaacagaggagacagcaaatgttcgacagaaacctggcggcagcgcaaaagatg

SEQ ID NO: 170285 - DNA, 103 bp, Artificial Sequence
  Synthetic Polynucleotide
taatacgactcactatagggtgctggatgatgatctgctgggtctggcccaacagaggagagggccaatgccagcagataacctggcggcagcgcaaaagatg

SEQ ID NO: 170286 - DNA, 103 bp, Artificial Sequence
  Synthetic Polynucleotide
taatacgactcactatagggcgtctggggctgctggatgatgatctgctgaacagaggagacagcagatgatcatccagaacctggcggcagcgcaaaagatg

SEQ ID NO: 170287 - DNA, 103 bp, Artificial Sequence
  Synthetic Polynucleotide
taatacgactcactatagggcagtgacagccgtctggggctgctggatgaaacagaggagatcatccatgagccccagaaacctggcggcagcgcaaaagatg

SEQ ID NO: 170288 - DNA, 103 bp, Artificial Sequence
  Synthetic Polynucleotide
taatacgactcactataggggtctggccagcagtgacagccgtctggggcaacagaggagagccccaatgggctgtcacaacctggcggcagcgcaaaagatg

SEQ ID NO: 170289 - DNA, 103 bp, Artificial Sequence
  Synthetic Polynucleotide
taatacgactcactatagggctgtgtctgagtctggccagcagtgacagcaacagaggagagctgtcatggctggccagaacctggcggcagcgcaaaagatg

SEQ ID NO: 170290 - DNA, 103 bp, Artificial Sequence
  Synthetic Polynucleotide
taatacgactcactatagggcaatctgctgctgtgtctgagtctggccagaacagaggagactggccatgctcagacacaacctggcggcagcgcaaaagatg

SEQ ID NO: 170291 - DNA, 103 bp, Artificial Sequence
  Synthetic Polynucleotide
taatacgactcactatagggccctggacagcaatctgctgctgtgtctgaaacagaggagatcagacatggcagcagataacctggcggcagcgcaaaagatg

SEQ ID NO: 170292 - DNA, 103 bp, Artificial Sequence
  Synthetic Polynucleotide
taatacgactcactatagggcacttgctgtccctggacagcaatctgctgaacagaggagacagcagatggctgtccagaacctggcggcagcgcaaaagatg

SEQ ID NO: 170293 - DNA, 103 bp, Artificial Sequence
  Synthetic Polynucleotide
taatacgactcactatagggcagtctgtgccacttgctgtccctggacagaacagaggagactgtccatggacagcaagaacctggcggcagcgcaaaagatg

SEQ ID NO: 170294 - DNA, 103 bp, Artificial Sequence
  Synthetic Polynucleotide
taatacgactcactatagggtgcccttcagcagtctgtgccacttgctgtaacagaggagaacagcaatgggcacagacaacctggcggcagcgcaaaagatg

SEQ ID NO: 170295 - DNA, 103 bp, Artificial Sequence
  Synthetic Polynucleotide
taatacgactcactatagggtcctgcctggacaacaatctgctctgtcgaaacagaggagatcgacaatgcagattgttaacctggcggcagcgcaaaagatg

SEQ ID NO: 170296 - DNA, 103 bp, Artificial Sequence
  Synthetic Polynucleotide
taatacgactcactataggggacgatggtctgcccttcagcagtctgtgcaacagaggagagcacagatggctgaagggaacctggcggcagcgcaaaagatg

SEQ ID NO: 170297 - DNA, 103 bp, Artificial Sequence
  Synthetic Polynucleotide
taatacgactcactatagggctggttgatagacgatggtctgcccttcagaacagaggagactgaagatgagaccatcgaacctggcggcagcgcaaaagatg

SEQ ID NO: 170298 - DNA, 103 bp, Artificial Sequence
  Synthetic Polynucleotide
taatacgactcactatagggtctgcattaactggttgatagacgatggtcaacagaggagagaccatatgctatcaaccaacctggcggcagcgcaaaagatg

SEQ ID NO: 170299 - DNA, 103 bp, Artificial Sequence
  Synthetic Polynucleotide
taatacgactcactatagggaatggtgccatctgcattaactggttgataaacagaggagatatcaaatggttaatgcaaacctggcggcagcgcaaaagatg

SEQ ID NO: 170300 - DNA, 103 bp, Artificial Sequence
  Synthetic Polynucleotide
taatacgactcactatagggcttgctggagaatggtgccatctgcattaaaacagaggagattaatgatgatggcaccaaacctggcggcagcgcaaaagatg

SEQ ID NO: 170301 - DNA, 103 bp, Artificial Sequence
  Synthetic Polynucleotide
taatacgactcactataggggggactgtaacttgctggagaatggtgccaaacagaggagatggcacatgtctccagcaaacctggcggcagcgcaaaagatg

SEQ ID NO: 170302 - DNA, 103 bp, Artificial Sequence
  Synthetic Polynucleotide
taatacgactcactataggggcctgaaacagggactgtaacttgctggagaacagaggagactccagatggttacagtcaacctggcggcagcgcaaaagatg

SEQ ID NO: 170303 - DNA, 103 bp, Artificial Sequence
  Synthetic Polynucleotide
taatacgactcactatagggtagtgatcatgcctgaaacagggactgtaaaacagaggagattacagatgctgtttcagaacctggcggcagcgcaaaagatg

SEQ ID NO: 170304 - DNA, 103 bp, Artificial Sequence
  Synthetic Polynucleotide
taatacgactcactataggggctgctgggatagtgatcatgcctgaaacaaacagaggagatgtttcatgcatgatcacaacctggcggcagcgcaaaagatg

SEQ ID NO: 170305 - DNA, 103 bp, Artificial Sequence
  Synthetic Polynucleotide
taatacgactcactatagggtgccaaactggctgctgggatagtgatcataacagaggagaatgatcatgatcccagcaaacctggcggcagcgcaaaagatg

SEQ ID NO: 170306 - DNA, 103 bp, Artificial Sequence
  Synthetic Polynucleotide
taatacgactcactataggggctgaatctgtcctgcctggacaacaatctaacagaggagaagattgatgtccaggcagaacctggcggcagcgcaaaagatg

SEQ ID NO: 170307 - DNA, 103 bp, Artificial Sequence
  Synthetic Polynucleotide
taatacgactcactatagggtctgtgctcctgccaaactggctgctgggaaacagaggagatcccagatgccagtttggaacctggcggcagcgcaaaagatg

SEQ ID NO: 170308 - DNA, 103 bp, Artificial Sequence
  Synthetic Polynucleotide
taatacgactcactataggggtttgaacaatctgtgctcctgccaaactgaacagaggagacagtttatgaggagcacaaacctggcggcagcgcaaaagatg

SEQ ID NO: 170309 - DNA, 103 bp, Artificial Sequence
  Synthetic Polynucleotide
taatacgactcactatagggattggctcctgtttgaacaatctgtgctccaacagaggagaggagcaatgattgttcaaaacctggcggcagcgcaaaagatg

SEQ ID NO: 170310 - DNA, 103 bp, Artificial Sequence
  Synthetic Polynucleotide
taatacgactcactatagggttgtgttggtattggctcctgtttgaacaaaacagaggagattgttcatgcaggagccaaacctggcggcagcgcaaaagatg

SEQ ID NO: 170311 - DNA, 103 bp, Artificial Sequence
  Synthetic Polynucleotide
taatacgactcactatagggccactgctggttgtgttggtattggctcctaacagaggagaaggagcatgtaccaacacaacctggcggcagcgcaaaagatg

SEQ ID NO: 170312 - DNA, 103 bp, Artificial Sequence
  Synthetic Polynucleotide
taatacgactcactatagggagtcccttgcccactgctggttgtgttggtaacagaggagaaccaacatgaccagcagtaacctggcggcagcgcaaaagatg

SEQ ID NO: 170313 - DNA, 103 bp, Artificial Sequence
  Synthetic Polynucleotide
taatacgactcactatagggtcacagtgacagtcccttgcccactgctggaacagaggagaccagcaatgggcaagggaaacctggcggcagcgcaaaagatg

SEQ ID NO: 170314 - DNA, 103 bp, Artificial Sequence
  Synthetic Polynucleotide
taatacgactcactatagggactggtagtgtcacagtgacagtcccttgcaacagaggagagcaaggatgtgtcactgtaacctggcggcagcgcaaaagatg

SEQ ID NO: 170315 - DNA, 103 bp, Artificial Sequence
  Synthetic Polynucleotide
taatacgactcactatagggattgcctgccactggtagtgtcacagtgacaacagaggagagtcactatgacactaccaaacctggcggcagcgcaaaagatg

SEQ ID NO: 170316 - DNA, 103 bp, Artificial Sequence
  Synthetic Polynucleotide
taatacgactcactatagggaattgaccacattgcctgccactggtagtgaacagaggagacactacatgtggcaggcaaacctggcggcagcgcaaaagatg

SEQ ID NO: 170317 - DNA, 103 bp, Artificial Sequence
  Synthetic Polynucleotide
taatacgactcactatagggtggacctgctgctgaatctgtcctgcctggaacagaggagaccaggcatgacagattcaaacctggcggcagcgcaaaagatg

SEQ ID NO: 170318 - DNA, 103 bp, Artificial Sequence
  Synthetic Polynucleotide
taatacgactcactatagggatccctcctgaattgaccacattgcctgccaacagaggagaggcaggatgtgtggtcaaaacctggcggcagcgcaaaagatg

SEQ ID NO: 170319 - DNA, 103 bp, Artificial Sequence
  Synthetic Polynucleotide
taatacgactcactatagggcatcatgaccatccctcctgaattgaccacaacagaggagagtggtcatgtcaggagggaacctggcggcagcgcaaaagatg

SEQ ID NO: 170320 - DNA, 103 bp, Artificial Sequence
  Synthetic Polynucleotide
taatacgactcactatagggccccaggaaccatcatgaccatccctcctgaacagaggagacaggagatgtggtcatgaaacctggcggcagcgcaaaagatg

SEQ ID NO: 170321 - DNA, 103 bp, Artificial Sequence
  Synthetic Polynucleotide
taatacgactcactatagggacagagccagccccaggaaccatcatgaccaacagaggagaggtcatatgggttcctggaacctggcggcagcgcaaaagatg

SEQ ID NO: 170322 - DNA, 103 bp, Artificial Sequence
  Synthetic Polynucleotide
taatacgactcactataggggatagcaggcacagagccagccccaggaacaacagaggagagttcctatggctggctctaacctggcggcagcgcaaaagatg

SEQ ID NO: 170323 - DNA, 103 bp, Artificial Sequence
  Synthetic Polynucleotide
taatacgactcactatagggggattctttggatagcaggcacagagccagaacagaggagactggctatgtgcctgctaaacctggcggcagcgcaaaagatg

SEQ ID NO: 170324 - DNA, 103 bp, Artificial Sequence
  Synthetic Polynucleotide
taatacgactcactatagggccaggtagagggattctttggatagcaggcaacagaggagagcctgcatgccaaagaataacctggcggcagcgcaaaagatg

SEQ ID NO: 170325 - DNA, 103 bp, Artificial Sequence
  Synthetic Polynucleotide
taatacgactcactatagggcatctctgctccaggtagagggattctttgaacagaggagacaaagaatgcctctacctaacctggcggcagcgcaaaagatg

SEQ ID NO: 170326 - DNA, 103 bp, Artificial Sequence
  Synthetic Polynucleotide
taatacgactcactatagggcttcttcaagcatctctgctccaggtagagaacagaggagactctacatggagcagagaaacctggcggcagcgcaaaagatg

SEQ ID NO: 170327 - DNA, 103 bp, Artificial Sequence
  Synthetic Polynucleotide
taatacgactcactatagggtagagaggctcttcttcaagcatctctgctaacagaggagaagcagaatggcttgaagaaacctggcggcagcgcaaaagatg

SEQ ID NO: 170328 - DNA, 103 bp, Artificial Sequence
  Synthetic Polynucleotide
taatacgactcactatagggtggctgcccttggacctgctgctgaatctgaacagaggagacagattatgcagcaggtcaacctggcggcagcgcaaaagatg

SEQ ID NO: 170329 - DNA, 103 bp, Artificial Sequence
  Synthetic Polynucleotide
taatacgactcactatagggggcattcacgtagagaggctcttcttcaagaacagaggagacttgaaatggagcctctcaacctggcggcagcgcaaaagatg

SEQ ID NO: 170330 - DNA, 103 bp, Artificial Sequence
  Synthetic Polynucleotide
taatacgactcactatagggggtattgtttggcattcacgtagagaggctaacagaggagaagcctcatgacgtgaatgaacctggcggcagcgcaaaagatg

SEQ ID NO: 170331 - DNA, 103 bp, Artificial Sequence
  Synthetic Polynucleotide
taatacgactcactatagggagaatacggtggtattgtttggcattcacgaacagaggagacgtgaaatgcaaacaataaacctggcggcagcgcaaaagatg

SEQ ID NO: 170332 - DNA, 103 bp, Artificial Sequence
  Synthetic Polynucleotide
taatacgactcactatagggcctcctcttaagaatacggtggtattgtttaacagaggagaaaacaaatgcaccgtattaacctggcggcagcgcaaaagatg

SEQ ID NO: 170333 - DNA, 103 bp, Artificial Sequence
  Synthetic Polynucleotide
taatacgactcactatagggctcgggcttgcctcctcttaagaatacggtaacagaggagaaccgtaatgttaagaggaaacctggcggcagcgcaaaagatg

SEQ ID NO: 170334 - DNA, 103 bp, Artificial Sequence
  Synthetic Polynucleotide
taatacgactcactatagggtctagtttagctcgggcttgcctcctcttaaacagaggagataagagatggcaagcccgaacctggcggcagcgcaaaagatg

SEQ ID NO: 170335 - DNA, 103 bp, Artificial Sequence
  Synthetic Polynucleotide
taatacgactcactatagggcccttctgcctctagtttagctcgggcttgaacagaggagacaagccatggctaaactaaacctggcggcagcgcaaaagatg

SEQ ID NO: 170336 - DNA, 103 bp, Artificial Sequence
  Synthetic Polynucleotide
taatacgactcactatagggttggaattttcccttctgcctctagtttagaacagaggagactaaacatgaggcagaagaacctggcggcagcgcaaaagatg

SEQ ID NO: 170337 - DNA, 103 bp, Artificial Sequence
  Synthetic Polynucleotide
taatacgactcactatagggcttctctcctttggaattttcccttctgccaacagaggagaggcagaatggaaaattccaacctggcggcagcgcaaaagatg

SEQ ID NO: 170338 - DNA, 103 bp, Artificial Sequence
  Synthetic Polynucleotide
taatacgactcactatagggcaggtatttccttctctcctttggaattttaacagaggagaaaaattatgaaggagagaaacctggcggcagcgcaaaagatg

SEQ ID NO: 170339 - DNA, 103 bp, Artificial Sequence
  Synthetic Polynucleotide
taatacgactcactataggggcaccattaatggctgcccttggacctgctaacagaggagaagcaggatgaagggcagcaacctggcggcagcgcaaaagatg

SEQ ID NO: 170340 - DNA, 103 bp, Artificial Sequence
  Synthetic Polynucleotide
taatacgactcactataggggagactcatgcaggtatttccttctctcctaacagaggagaaggagaatgggaaataccaacctggcggcagcgcaaaagatg

SEQ ID NO: 170341 - DNA, 103 bp, Artificial Sequence
  Synthetic Polynucleotide
taatacgactcactatagggtgacggtgccgagactcatgcaggtatttcaacagaggagagaaataatggcatgagtcaacctggcggcagcgcaaaagatg

SEQ ID NO: 170342 - DNA, 103 bp, Artificial Sequence
  Synthetic Polynucleotide
taatacgactcactatagggtgccatggcatgacggtgccgagactcatgaacagaggagacatgagatgcggcaccgtaacctggcggcagcgcaaaagatg

SEQ ID NO: 170343 - DNA, 103 bp, Artificial Sequence
  Synthetic Polynucleotide
taatacgactcactatagggcacgcttccgtgccatggcatgacggtgccaacagaggagaggcaccatgatgccatggaacctggcggcagcgcaaaagatg

SEQ ID NO: 170344 - DNA, 103 bp, Artificial Sequence
  Synthetic Polynucleotide
taatacgactcactatagggccaccttcaccacgcttccgtgccatggcaaacagaggagatgccatatgacggaagcgaacctggcggcagcgcaaaagatg

SEQ ID NO: 170345 - DNA, 103 bp, Artificial Sequence
  Synthetic Polynucleotide
taatacgactcactataggggaaaaatcgtccaccttcaccacgcttccgaacagaggagacggaagatgggtgaaggtaacctggcggcagcgcaaaagatg

SEQ ID NO: 170346 - DNA, 103 bp, Artificial Sequence
  Synthetic Polynucleotide
taatacgactcactatagggcctttggagagaaaaatcgtccaccttcacaacagaggagagtgaagatggacgattttaacctggcggcagcgcaaaagatg

SEQ ID NO: 170347 - DNA, 103 bp, Artificial Sequence
  Synthetic Polynucleotide
taatacgactcactatagggctatccttttcctttggagagaaaaatcgtaacagaggagaacgattatgctctccaaaaacctggcggcagcgcaaaagatg

SEQ ID NO: 170348 - DNA, 103 bp, Artificial Sequence
  Synthetic Polynucleotide
taatacgactcactatagggcatatggggactatccttttcctttggagaaacagaggagatctccaatggaaaaggataacctggcggcagcgcaaaagatg

SEQ ID NO: 170349 - DNA, 103 bp, Artificial Sequence
  Synthetic Polynucleotide
taatacgactcactatagggttggatcctgcatatggggactatccttttaacagaggagaaaaaggatggtccccataaacctggcggcagcgcaaaagatg

SEQ ID NO: 170350 - DNA, 103 bp, Artificial Sequence
  Synthetic Polynucleotide
taatacgactcactatagggccactgacctgcaccattaatggctgccctaacagaggagaagggcaatgattaatggtaacctggcggcagcgcaaaagatg

SEQ ID NO: 170351 - DNA, 103 bp, Artificial Sequence
  Synthetic Polynucleotide
taatacgactcactatagggtcggcttggtttggatcctgcatatggggaaacagaggagatccccaatggcaggatccaacctggcggcagcgcaaaagatg

SEQ ID NO: 170352 - DNA, 103 bp, Artificial Sequence
  Synthetic Polynucleotide
taatacgactcactatagggtgcttcttcatcggcttggtttggatcctgaacagaggagacaggatatgaaccaagccaacctggcggcagcgcaaaagatg

SEQ ID NO: 170353 - DNA, 103 bp, Artificial Sequence
  Synthetic Polynucleotide
taatacgactcactatagggtctgtgtcattgcttcttcatcggcttggtaacagaggagaaccaagatgatgaagaagaacctggcggcagcgcaaaagatg

SEQ ID NO: 170354 - DNA, 103 bp, Artificial Sequence
  Synthetic Polynucleotide
taatacgactcactatagggactcggatgatctgtgtcattgcttcttcaaacagaggagatgaagaatgaatgacacaaacctggcggcagcgcaaaagatg

SEQ ID NO: 170355 - DNA, 103 bp, Artificial Sequence
  Synthetic Polynucleotide
taatacgactcactatagggtgttgtagaactgtcaccatccattgtcataacagaggagaatgacaatggatggtgacaacctggcggcagcgcaaaagatg

SEQ ID NO: 170356 - DNA, 103 bp, Artificial Sequence
  Synthetic Polynucleotide
taatacgactcactatagggattcatgctgtcctcagtatcatcatgaggaacagaggagacctcatatggatactgagaacctggcggcagcgcaaaagatg

SEQ ID NO: 170357 - DNA, 103 bp, Artificial Sequence
  Synthetic Polynucleotide
taatacgactcactatagggcttcatgatcattcatgctgtcctcagtataacagaggagaatactgatgacagcatgaaacctggcggcagcgcaaaagatg

SEQ ID NO: 170358 - DNA, 103 bp, Artificial Sequence
  Synthetic Polynucleotide
taatacgactcactatagggccatttgtgtcttcatgatcattcatgctgaacagaggagacagcatatgtgatcatgaaacctggcggcagcgcaaaagatg

SEQ ID NO: 170359 - DNA, 103 bp, Artificial Sequence
  Synthetic Polynucleotide
taatacgactcactatagggttcttttgaaccatttgtgtcttcatgatcaacagaggagagatcatatggacacaaataacctggcggcagcgcaaaagatg

SEQ ID NO: 170360 - DNA, 103 bp, Artificial Sequence
  Synthetic Polynucleotide
taatacgactcactatagggctctgaaactttcttttgaaccatttgtgtaacagaggagaacacaaatggttcaaaagaacctggcggcagcgcaaaagatg

SEQ ID NO: 170361 - DNA, 103 bp, Artificial Sequence
  Synthetic Polynucleotide
taatacgactcactatagggatatcttgttctctgaaactttcttttgaaaacagaggagattcaaaatgaagtttcagaacctggcggcagcgcaaaagatg

SEQ ID NO: 170362 - DNA, 103 bp, Artificial Sequence
  Synthetic Polynucleotide
taatacgactcactatagggtggaagatatatatcttgttctctgaaactaacagaggagaagtttcatggaacaagataacctggcggcagcgcaaaagatg

SEQ ID NO: 170363 - DNA, 103 bp, Artificial Sequence
  Synthetic Polynucleotide
taatacgactcactatagggcgtttgctattggaagatatatatcttgttaacagaggagaaacaagatgtatatcttcaacctggcggcagcgcaaaagatg

SEQ ID NO: 170364 - DNA, 103 bp, Artificial Sequence
  Synthetic Polynucleotide
taatacgactcactatagggatcctagccacgtttgctattggaagatataacagaggagaatatctatgaatagcaaaaacctggcggcagcgcaaaagatg

SEQ ID NO: 170365 - DNA, 103 bp, Artificial Sequence
  Synthetic Polynucleotide
taatacgactcactatagggatttttcattatcctagccacgtttgctataacagaggagaatagcaatggtggctaggaacctggcggcagcgcaaaagatg

SEQ ID NO: 170366 - DNA, 103 bp, Artificial Sequence
  Synthetic Polynucleotide
taatacgactcactataggggagaagcatctgttgtagaactgtcaccataacagaggagaatggtgatggttctacaaaacctggcggcagcgcaaaagatg

SEQ ID NO: 170367 - DNA, 103 bp, Artificial Sequence
  Synthetic Polynucleotide
taatacgactcactataggggaggtatggcatttttcattatcctagccaaacagaggagatggctaatgtaatgaaaaaacctggcggcagcgcaaaagatg

SEQ ID NO: 170368 - DNA, 103 bp, Artificial Sequence
  Synthetic Polynucleotide
taatacgactcactatagggtttcccgtttgaggtatggcatttttcattaacagaggagaaatgaaatgtgccataccaacctggcggcagcgcaaaagatg

SEQ ID NO: 170369 - DNA, 103 bp, Artificial Sequence
  Synthetic Polynucleotide
taatacgactcactatagggttttgcaatctttcccgtttgaggtatggcaacagaggagagccataatgcaaacgggaaacctggcggcagcgcaaaagatg

SEQ ID NO: 170370 - DNA, 103 bp, Artificial Sequence
  Synthetic Polynucleotide
taatacgactcactatagggctttggcatcttttgcaatctttcccgtttaacagaggagaaaacggatgagattgcaaaacctggcggcagcgcaaaagatg

SEQ ID NO: 170371 - DNA, 103 bp, Artificial Sequence
  Synthetic Polynucleotide
taatacgactcactatagggtgaacacattctttggcatcttttgcaatcaacagaggagagattgcatgagatgccaaaacctggcggcagcgcaaaagatg

SEQ ID NO: 170372 - DNA, 103 bp, Artificial Sequence
  Synthetic Polynucleotide
taatacgactcactatagggtacacattcttgaacacattctttggcatcaacagaggagagatgccatggaatgtgttaacctggcggcagcgcaaaagatg

SEQ ID NO: 170373 - DNA, 103 bp, Artificial Sequence
  Synthetic Polynucleotide
taatacgactcactatagggtgaactcacttacacattcttgaacacattaacagaggagaaatgtgatgaagaatgtgaacctggcggcagcgcaaaagatg

SEQ ID NO: 170374 - DNA, 103 bp, Artificial Sequence
  Synthetic Polynucleotide
taatacgactcactatagggataaaactgatgaactcacttacacattctaacagaggagaagaatgatgaagtgagttaacctggcggcagcgcaaaagatg

SEQ ID NO: 170375 - DNA, 103 bp, Artificial Sequence
  Synthetic Polynucleotide
taatacgactcactatagggttcagatgttataaaactgatgaactcactaacagaggagaagtgagatgatcagttttaacctggcggcagcgcaaaagatg

SEQ ID NO: 170376 - DNA, 103 bp, Artificial Sequence
  Synthetic Polynucleotide
taatacgactcactatagggtttcacttgcttcagatgttataaaactgaaacagaggagatcagttatgtaacatctgaacctggcggcagcgcaaaagatg

SEQ ID NO: 170377 - DNA, 103 bp, Artificial Sequence
  Synthetic Polynucleotide
taatacgactcactatagggattcctagttgagaagcatctgttgtagaaaacagaggagattctacatgagatgcttcaacctggcggcagcgcaaaagatg

SEQ ID NO: 170378 - DNA, 103 bp, Artificial Sequence
  Synthetic Polynucleotide
taatacgactcactatagggtgatggcacctttcacttgcttcagatgttaacagaggagaaacatcatgagcaagtgaaacctggcggcagcgcaaaagatg

SEQ ID NO: 170379 - DNA, 103 bp, Artificial Sequence
  Synthetic Polynucleotide
taatacgactcactatagggccgtttctcttgatggcacctttcacttgcaacagaggagagcaagtatgaggtgccataacctggcggcagcgcaaaagatg

SEQ ID NO: 170380 - DNA, 103 bp, Artificial Sequence
  Synthetic Polynucleotide
taatacgactcactatagggtgattgttttccgtttctcttgatggcaccaacagaggagaggtgccatgaagagaaacaacctggcggcagcgcaaaagatg

SEQ ID NO: 170381 - DNA, 103 bp, Artificial Sequence
  Synthetic Polynucleotide
taatacgactcactatagggtcttctccattgattgttttccgtttctctaacagaggagaagagaaatggaaaacaataacctggcggcagcgcaaaagatg

SEQ ID NO: 170382 - DNA, 103 bp, Artificial Sequence
  Synthetic Polynucleotide
taatacgactcactatagggaaagagaatatcttctccattgattgttttaacagaggagaaaaacaatgaatggagaaaacctggcggcagcgcaaaagatg

SEQ ID NO: 170383 - DNA, 103 bp, Artificial Sequence
  Synthetic Polynucleotide
taatacgactcactatagggtagacatagcaaagagaatatcttctccataacagaggagaatggagatgatattctctaacctggcggcagcgcaaaagatg

SEQ ID NO: 170384 - DNA, 103 bp, Artificial Sequence
  Synthetic Polynucleotide
taatacgactcactatagggaagcctaaagtagacatagcaaagagaataaacagaggagatattctatgtgctatgtcaacctggcggcagcgcaaaagatg

SEQ ID NO: 170385 - DNA, 103 bp, Artificial Sequence
  Synthetic Polynucleotide
taatacgactcactatagggataactgtcaaagcctaaagtagacatagcaacagaggagagctatgatgactttaggcaacctggcggcagcgcaaaagatg

SEQ ID NO: 170386 - DNA, 103 bp, Artificial Sequence
  Synthetic Polynucleotide
taatacgactcactataggggaggttccacataactgtcaaagcctaaagaacagaggagactttagatgttgacagttaacctggcggcagcgcaaaagatg

SEQ ID NO: 170387 - DNA, 103 bp, Artificial Sequence
  Synthetic Polynucleotide
taatacgactcactatagggtataatttcagaggttccacataactgtcaaacagaggagatgacagatgtgtggaaccaacctggcggcagcgcaaaagatg

SEQ ID NO: 170388 - DNA, 103 bp, Artificial Sequence
  Synthetic Polynucleotide
taatacgactcactataggggtctgcagagattcctagttgagaagcatcaacagaggagagatgctatgcaactaggaaacctggcggcagcgcaaaagatg

SEQ ID NO: 170389 - DNA, 103 bp, Artificial Sequence
  Synthetic Polynucleotide
taatacgactcactatagggtttctgaaggtataatttcagaggttccacaacagaggagagtggaaatgctgaaattaaacctggcggcagcgcaaaagatg

SEQ ID NO: 170390 - DNA, 103 bp, Artificial Sequence
  Synthetic Polynucleotide
taatacgactcactatagggcctctctgaatttctgaaggtataatttcaaacagaggagatgaaatatgaccttcagaaacctggcggcagcgcaaaagatg

SEQ ID NO: 170391 - DNA, 103 bp, Artificial Sequence
  Synthetic Polynucleotide
taatacgactcactatagggcctttcatagcctctctgaatttctgaaggaacagaggagaccttcaatgattcagagaaacctggcggcagcgcaaaagatg

SEQ ID NO: 170392 - DNA, 103 bp, Artificial Sequence
  Synthetic Polynucleotide
taatacgactcactatagggtcccttttctcctttcatagcctctctgaaaacagaggagattcagaatggctatgaaaaacctggcggcagcgcaaaagatg

SEQ ID NO: 170393 - DNA, 103 bp, Artificial Sequence
  Synthetic Polynucleotide
taatacgactcactatagggctccaccaattcccttttctcctttcatagaacagaggagactatgaatggagaaaaggaacctggcggcagcgcaaaagatg

SEQ ID NO: 170394 - DNA, 103 bp, Artificial Sequence
  Synthetic Polynucleotide
taatacgactcactataggggctgtgactgctccaccaattcccttttctaacagaggagaagaaaaatgaattggtggaacctggcggcagcgcaaaagatg

SEQ ID NO: 170395 - DNA, 103 bp, Artificial Sequence
  Synthetic Polynucleotide
taatacgactcactatagggtccatctgtagctgtgactgctccaccaataacagaggagaattggtatggcagtcacaaacctggcggcagcgcaaaagatg

SEQ ID NO: 170396 - DNA, 103 bp, Artificial Sequence
  Synthetic Polynucleotide
taatacgactcactatagggcttcacttagtccatctgtagctgtgactgaacagaggagacagtcaatgctacagatgaacctggcggcagcgcaaaagatg

SEQ ID NO: 170397 - DNA, 103 bp, Artificial Sequence
  Synthetic Polynucleotide
taatacgactcactatagggtctgtaagctcttcacttagtccatctgtaaacagaggagatacagaatgactaagtgaaacctggcggcagcgcaaaagatg

SEQ ID NO: 170398 - DNA, 103 bp, Artificial Sequence
  Synthetic Polynucleotide
taatacgactcactatagggaaatgcctcctctgtaagctcttcacttagaacagaggagactaagtatggagcttacaaacctggcggcagcgcaaaagatg

SEQ ID NO: 170399 - DNA, 103 bp, Artificial Sequence
  Synthetic Polynucleotide
taatacgactcactatagggctccaatatagtctgcagagattcctagttaacagaggagaaactagatgtctctgcagaacctggcggcagcgcaaaagatg

SEQ ID NO: 170400 - DNA, 103 bp, Artificial Sequence
  Synthetic Polynucleotide
taatacgactcactatagggactggttagtaaatgcctcctctgtaagctaacagaggagaagcttaatgaggaggcataacctggcggcagcgcaaaagatg

SEQ ID NO: 170401 - DNA, 103 bp, Artificial Sequence
  Synthetic Polynucleotide
taatacgactcactatagggccagctggtaactggttagtaaatgcctccaacagaggagaggaggcatgtactaaccaaacctggcggcagcgcaaaagatg

SEQ ID NO: 170402 - DNA, 103 bp, Artificial Sequence
  Synthetic Polynucleotide
taatacgactcactatagggggttattaagccagctggtaactggttagtaacagaggagaactaacatgttaccagctaacctggcggcagcgcaaaagatg

SEQ ID NO: 170403 - DNA, 103 bp, Artificial Sequence
  Synthetic Polynucleotide
taatacgactcactataggggaccgtctgtggttattaagccagctggtaaacagaggagataccagatggcttaataaaacctggcggcagcgcaaaagatg

SEQ ID NO: 170404 - DNA, 103 bp, Artificial Sequence
  Synthetic Polynucleotide
taatacgactcactatagggttttgttgttgaccgtctgtggttattaagaacagaggagacttaatatgcacagacggaacctggcggcagcgcaaaagatg

SEQ ID NO: 170405 - DNA, 103 bp, Artificial Sequence
  Synthetic Polynucleotide
taatacgactcactatagggaaccataacattttgttgttgaccgtctgtaacagaggagaacagacatgcaacaacaaaacctggcggcagcgcaaaagatg

SEQ ID NO: 170406 - DNA, 103 bp, Artificial Sequence
  Synthetic Polynucleotide
taatacgactcactatagggatgttgtgtaaaccataacattttgttgttaacagaggagaaacaacatgatgttatggaacctggcggcagcgcaaaagatg

SEQ ID NO: 170407 - DNA, 103 bp, Artificial Sequence
  Synthetic Polynucleotide
taatacgactcactatagggtgttgatatgatgttgtgtaaaccataacaaacagaggagatgttatatgttacacaacaacctggcggcagcgcaaaagatg

SEQ ID NO: 170408 - DNA, 103 bp, Artificial Sequence
  Synthetic Polynucleotide
taatacgactcactatagggaccagaaatctgttgatatgatgttgtgtaaacagaggagatacacaatgtcatatcaaaacctggcggcagcgcaaaagatg

SEQ ID NO: 170409 - DNA, 103 bp, Artificial Sequence
  Synthetic Polynucleotide
taatacgactcactatagggtttgctgaacaccagaaatctgttgatatgaacagaggagacatatcatgagatttctgaacctggcggcagcgcaaaagatg

SEQ ID NO: 170410 - DNA, 103 bp, Artificial Sequence
  Synthetic Polynucleotide
taatacgactcactatagggtaatgacttcctccaatatagtctgcagagaacagaggagactctgcatgctatattggaacctggcggcagcgcaaaagatg

SEQ ID NO: 170411 - DNA, 103 bp, Artificial Sequence
  Synthetic Polynucleotide
taatacgactcactataggggaaaactgaatttgctgaacaccagaaatcaacagaggagagatttcatgtgttcagcaaacctggcggcagcgcaaaagatg

SEQ ID NO: 170412 - DNA, 103 bp, Artificial Sequence
  Synthetic Polynucleotide
taatacgactcactatagggctgtataacataatgacttcctccaatataaacagaggagatatattatgggaagtcataacctggcggcagcgcaaaagatg

SEQ ID NO: 170413 - DNA, 103 bp, Artificial Sequence
  Synthetic Polynucleotide
taatacgactcactatagggcatcatgaggctgtataacataatgacttcaacagaggagagaagtcatgatgttatacaacctggcggcagcgcaaaagatg

SEQ ID NO: 170414 - DNA, 103 bp, Artificial Sequence
  Synthetic Polynucleotide
taatacgactcactatagggtcctcagtatcatcatgaggctgtataacaaacagaggagatgttatatggcctcatgaaacctggcggcagcgcaaaagatg

SEQ ID NO: 170415 - DNA, 103 bp, Artificial Sequence
  Synthetic Polynucleotide
taatacgactcactatagggagtaccaccaaatcctccttctgtggacataacagaggagaatgtccatggaaggaggaaacctggcggcagcgcaaaagatg

SEQ ID NO: 170416 - DNA, 103 bp, Artificial Sequence
  Synthetic Polynucleotide
taatacgactcactatagggcactcggaagtctttcactgttaaattccgaacagaggagacggaatatgacagtgaaaaacctggcggcagcgcaaaagatg

SEQ ID NO: 170417 - DNA, 103 bp, Artificial Sequence
  Synthetic Polynucleotide
taatacgactcactatagggtcctgtggctttcacttctctgggctctgcaacagaggagagcagagatgagagaagtgaacctggcggcagcgcaaaagatg

SEQ ID NO: 170418 - DNA, 103 bp, Artificial Sequence
  Synthetic Polynucleotide
taatacgactcactataggggagttgaatttcctgtggctttcacttctcaacagaggagagagaagatgaagccacagaacctggcggcagcgcaaaagatg

SEQ ID NO: 170419 - DNA, 103 bp, Artificial Sequence
  Synthetic Polynucleotide
taatacgactcactataggggaggtgcagggagttgaatttcctgtggctaacagaggagaagccacatgaaattcaacaacctggcggcagcgcaaaagatg

SEQ ID NO: 170420 - DNA, 103 bp, Artificial Sequence
  Synthetic Polynucleotide
taatacgactcactataggggggcagggaagaggtgcagggagttgaattaacagaggagaaattcaatgccctgcaccaacctggcggcagcgcaaaagatg

SEQ ID NO: 170421 - DNA, 103 bp, Artificial Sequence
  Synthetic Polynucleotide
taatacgactcactatagggggtgtgtggtgggcagggaagaggtgcaggaacagaggagacctgcaatgcttccctgcaacctggcggcagcgcaaaagatg

SEQ ID NO: 170422 - DNA, 103 bp, Artificial Sequence
  Synthetic Polynucleotide
taatacgactcactatagggtgtgagggggggtgtgtggtgggcagggaaaacagaggagattccctatgcaccacacaaacctggcggcagcgcaaaagatg

SEQ ID NO: 170423 - DNA, 103 bp, Artificial Sequence
  Synthetic Polynucleotide
taatacgactcactatagggaccagcccggtgtgagggggggtgtgtggtaacagaggagaaccacaatgcccccctcaaacctggcggcagcgcaaaagatg

SEQ ID NO: 170424 - DNA, 103 bp, Artificial Sequence
  Synthetic Polynucleotide
taatacgactcactatagggcacaggaggcaccagcccggtgtgagggggaacagaggagaccccctatgaccgggctgaacctggcggcagcgcaaaagatg

SEQ ID NO: 170425 - DNA, 103 bp, Artificial Sequence
  Synthetic Polynucleotide
taatacgactcactataggggagcagcagacacaggaggcaccagcccggaacagaggagaccgggcatgtgcctcctgaacctggcggcagcgcaaaagatg

SEQ ID NO: 170426 - DNA, 103 bp, Artificial Sequence
  Synthetic Polynucleotide
taatacgactcactatagggctggggttgggagcagcagacacaggaggcaacagaggagagcctccatggtctgctgcaacctggcggcagcgcaaaagatg

SEQ ID NO: 170427 - DNA, 103 bp, Artificial Sequence
  Synthetic Polynucleotide
taatacgactcactatagggggagttcctgcactcggaagtctttcactgaacagaggagacagtgaatgacttccgagaacctggcggcagcgcaaaagatg

SEQ ID NO: 170428 - DNA, 103 bp, Artificial Sequence
  Synthetic Polynucleotide
taatacgactcactatagggtggagctctgctggggttgggagcagcagaaacagaggagatctgctatgcccaaccccaacctggcggcagcgcaaaagatg

SEQ ID NO: 170429 - DNA, 103 bp, Artificial Sequence
  Synthetic Polynucleotide
taatacgactcactatagggggaggggaagtggagctctgctggggttggaacagaggagaccaaccatggcagagctcaacctggcggcagcgcaaaagatg

SEQ ID NO: 170430 - DNA, 103 bp, Artificial Sequence
  Synthetic Polynucleotide
taatacgactcactataggggtcagaaggaggaggggaagtggagctctgaacagaggagacagagcatgacttcccctaacctggcggcagcgcaaaagatg

SEQ ID NO: 170431 - DNA, 103 bp, Artificial Sequence
  Synthetic Polynucleotide
taatacgactcactatagggactgcaaggcgtcagaaggaggaggggaagaacagaggagacttcccatgctccttctgaacctggcggcagcgcaaaagatg

SEQ ID NO: 170432 - DNA, 103 bp, Artificial Sequence
  Synthetic Polynucleotide
taatacgactcactatagggaccaccacccactgcaaggcgtcagaaggaaacagaggagatccttcatgcgccttgcaaacctggcggcagcgcaaaagatg

SEQ ID NO: 170433 - DNA, 103 bp, Artificial Sequence
  Synthetic Polynucleotide
taatacgactcactatagggagatacctcaaccaccacccactgcaaggcaacagaggagagccttgatgtgggtggtgaacctggcggcagcgcaaaagatg

SEQ ID NO: 170434 - DNA, 103 bp, Artificial Sequence
  Synthetic Polynucleotide
taatacgactcactatagggtgggggtcccagatacctcaaccaccacccaacagaggagagggtggatgttgaggtataacctggcggcagcgcaaaagatg

SEQ ID NO: 170435 - DNA, 103 bp, Artificial Sequence
  Synthetic Polynucleotide
taatacgactcactatagggtcgagctggttgggggtcccagatacctcaaacagaggagatgaggtatgtgggaccccaacctggcggcagcgcaaaagatg

SEQ ID NO: 170436 - DNA, 103 bp, Artificial Sequence
  Synthetic Polynucleotide
taatacgactcactatagggcctatgggtctcgagctggttgggggtcccaacagaggagagggaccatgaaccagctcaacctggcggcagcgcaaaagatg

SEQ ID NO: 170437 - DNA, 103 bp, Artificial Sequence
  Synthetic Polynucleotide
taatacgactcactatagggcatgcagctccctatgggtctcgagctggtaacagaggagaaccagcatgagacccataaacctggcggcagcgcaaaagatg

SEQ ID NO: 170438 - DNA, 103 bp, Artificial Sequence
  Synthetic Polynucleotide
taatacgactcactatagggcgagccagtgggagttcctgcactcggaagaacagaggagacttccgatggcaggaactaacctggcggcagcgcaaaagatg

SEQ ID NO: 170439 - DNA, 103 bp, Artificial Sequence
  Synthetic Polynucleotide
taatacgactcactataggggggagaggggcatgcagctccctatgggtcaacagaggagagacccaatgggagctgcaaacctggcggcagcgcaaaagatg

SEQ ID NO: 170440 - DNA, 103 bp, Artificial Sequence
  Synthetic Polynucleotide
taatacgactcactatagggggtcatccctgggagaggggcatgcagctcaacagaggagagagctgatggcccctctcaacctggcggcagcgcaaaagatg

SEQ ID NO: 170441 - DNA, 103 bp, Artificial Sequence
  Synthetic Polynucleotide
taatacgactcactataggggagagagtgaggtcatccctgggagaggggaacagaggagacccctcatgcagggatgaaacctggcggcagcgcaaaagatg

SEQ ID NO: 170442 - DNA, 103 bp, Artificial Sequence
  Synthetic Polynucleotide
taatacgactcactataggggggtggagaggagagagtgaggtcatccctaacagaggagaagggatatgctcactctcaacctggcggcagcgcaaaagatg

SEQ ID NO: 170443 - DNA, 103 bp, Artificial Sequence
  Synthetic Polynucleotide
taatacgactcactatagggctgctgcgaggggtggagaggagagagtgaaacagaggagatcactcatgcctctccacaacctggcggcagcgcaaaagatg

SEQ ID NO: 170444 - DNA, 103 bp, Artificial Sequence
  Synthetic Polynucleotide
taatacgactcactatagggtctggtagagctgctgcgaggggtggagagaacagaggagactctccatgcctcgcagcaacctggcggcagcgcaaaagatg

SEQ ID NO: 170445 - DNA, 103 bp, Artificial Sequence
  Synthetic Polynucleotide
taatacgactcactatagggacttgctggatctggtagagctgctgcgagaacagaggagactcgcaatggctctaccaaacctggcggcagcgcaaaagatg

SEQ ID NO: 170446 - DNA, 103 bp, Artificial Sequence
  Synthetic Polynucleotide
taatacgactcactatagggaggcatggtgacttgctggatctggtagagaacagaggagactctacatgatccagcaaaacctggcggcagcgcaaaagatg

SEQ ID NO: 170447 - DNA, 103 bp, Artificial Sequence
  Synthetic Polynucleotide
taatacgactcactatagggcctggcccgcaggcatggtgacttgctggaaacagaggagatccagcatgtcaccatgcaacctggcggcagcgcaaaagatg

SEQ ID NO: 170448 - DNA, 103 bp, Artificial Sequence
  Synthetic Polynucleotide
taatacgactcactatagggtgggcgaggtcctggcccgcaggcatggtgaacagaggagacaccatatgtgcgggccaaacctggcggcagcgcaaaagatg

SEQ ID NO: 170449 - DNA, 103 bp, Artificial Sequence
  Synthetic Polynucleotide
taatacgactcactatagggcttcttaatacgagccagtgggagttcctgaacagaggagacaggaaatgccactggctaacctggcggcagcgcaaaagatg

SEQ ID NO: 170450 - DNA, 103 bp, Artificial Sequence
  Synthetic Polynucleotide
taatacgactcactataggggaacatgggctgggcgaggtcctggcccgcaacagaggagagcgggcatggacctcgccaacctggcggcagcgcaaaagatg

SEQ ID NO: 170451 - DNA, 103 bp, Artificial Sequence
  Synthetic Polynucleotide
taatacgactcactatagggctgactggatgaacatgggctgggcgaggtaacagaggagaacctcgatgagcccatgtaacctggcggcagcgcaaaagatg

SEQ ID NO: 170452 - DNA, 103 bp, Artificial Sequence
  Synthetic Polynucleotide
taatacgactcactatagggggctggttggctgactggatgaacatgggcaacagaggagagcccatatgcatccagtcaacctggcggcagcgcaaaagatg

SEQ ID NO: 170453 - DNA, 103 bp, Artificial Sequence
  Synthetic Polynucleotide
taatacgactcactatagggcccgtcggagggctggttggctgactggataacagaggagaatccagatggccaaccagaacctggcggcagcgcaaaagatg

SEQ ID NO: 170454 - DNA, 103 bp, Artificial Sequence
  Synthetic Polynucleotide
taatacgactcactatagggggggggcctgcccgtcggagggctggttggaacagaggagaccaaccatgcctccgacgaacctggcggcagcgcaaaagatg

SEQ ID NO: 170455 - DNA, 103 bp, Artificial Sequence
  Synthetic Polynucleotide
taatacgactcactatagggccggtcacctggggggcctgcccgtcggagaacagaggagactccgaatggcaggccccaacctggcggcagcgcaaaagatg

SEQ ID NO: 170456 - DNA, 103 bp, Artificial Sequence
  Synthetic Polynucleotide
taatacgactcactataggggtttcataatcttcttaatacgagccagtgaacagaggagacactggatggtattaagaaacctggcggcagcgcaaaagatg

SEQ ID NO: 170457 - DNA, 103 bp, Artificial Sequence
  Synthetic Polynucleotide
taatacgactcactatagggtcttcatccagtttcataatcttcttaataaacagaggagatattaaatggattatgaaaacctggcggcagcgcaaaagatg

SEQ ID NO: 170458 - DNA, 103 bp, Artificial Sequence
  Synthetic Polynucleotide
taatacgactcactatagggcatcttcacatcttcatccagtttcataataacagaggagaattatgatgctggatgaaaacctggcggcagcgcaaaagatg

SEQ ID NO: 170459 - DNA, 103 bp, Artificial Sequence
  Synthetic Polynucleotide
taatacgactcactatagggctgcactgatcatcttcacatcttcatccaaacagaggagatggatgatgatgtgaagaaacctggcggcagcgcaaaagatg

SEQ ID NO: 170460 - DNA, 103 bp, Artificial Sequence
  Synthetic Polynucleotide
taatacgactcactatagggacaggcgcttctgcactgatcatcttcacaaacagaggagatgtgaaatggatcagtgcaacctggcggcagcgcaaaagatg

SEQ ID NO: 170461 - DNA, 103 bp, Artificial Sequence
  Synthetic Polynucleotide
taatacgactcactatagggggcaaagagtacaggcgcttctgcactgataacagaggagaatcagtatggaagcgcctaacctggcggcagcgcaaaagatg

SEQ ID NO: 170462 - DNA, 103 bp, Artificial Sequence
  Synthetic Polynucleotide
taatacgactcactatagggcactgctgctagtaccaccaaatcctccttaacagaggagaaaggagatgttggtggtaaacctggcggcagcgcaaaagatg

SEQ ID NO: 170463 - DNA, 103 bp, Artificial Sequence
  Synthetic Polynucleotide
taatacgactcactataggggggctgccttggcaaagagtacaggcgcttaacagaggagaaagcgcatgtactctttgaacctggcggcagcgcaaaagatg

SEQ ID NO: 170464 - DNA, 103 bp, Artificial Sequence
  Synthetic Polynucleotide
taatacgactcactatagggataaaaatctgggctgccttggcaaagagtaacagaggagaactcttatgcaaggcagcaacctggcggcagcgcaaaagatg

SEQ ID NO: 170465 - DNA, 103 bp, Artificial Sequence
  Synthetic Polynucleotide
taatacgactcactatagggcaactctgtgataaaaatctgggctgccttaacagaggagaaaggcaatgcagatttttaacctggcggcagcgcaaaagatg

SEQ ID NO: 170466 - DNA, 103 bp, Artificial Sequence
  Synthetic Polynucleotide
taatacgactcactatagggctcgaagagtcaactctgtgataaaaatctaacagaggagaagatttatgtcacagagtaacctggcggcagcgcaaaagatg

SEQ ID NO: 170467 - DNA, 103 bp, Artificial Sequence
  Synthetic Polynucleotide
taatacgactcactatagggtgaatccaggctcgaagagtcaactctgtgaacagaggagacacagaatggactcttcgaacctggcggcagcgcaaaagatg

SEQ ID NO: 170468 - DNA, 103 bp, Artificial Sequence
  Synthetic Polynucleotide
taatacgactcactatagggatcttctgtgtgaatccaggctcgaagagtaacagaggagaactcttatggcctggattaacctggcggcagcgcaaaagatg

SEQ ID NO: 170469 - DNA, 103 bp, Artificial Sequence
  Synthetic Polynucleotide
taatacgactcactatagggggcgcttgttatcttctgtgtgaatccaggaacagaggagacctggaatgacacagaagaacctggcggcagcgcaaaagatg

SEQ ID NO: 170470 - DNA, 103 bp, Artificial Sequence
  Synthetic Polynucleotide
taatacgactcactatagggtgtagagtccggcgcttgttatcttctgtgaacagaggagacacagaatgtaacaagcgaacctggcggcagcgcaaaagatg

SEQ ID NO: 170471 - DNA, 103 bp, Artificial Sequence
  Synthetic Polynucleotide
taatacgactcactatagggatcatttctctgtagagtccggcgcttgttaacagaggagaaacaagatgcggactctaaacctggcggcagcgcaaaagatg

SEQ ID NO: 170472 - DNA, 103 bp, Artificial Sequence
  Synthetic Polynucleotide
taatacgactcactatagggccatggcgatatcatttctctgtagagtccaacagaggagaggactcatgagagaaatgaacctggcggcagcgcaaaagatg

SEQ ID NO: 170473 - DNA, 103 bp, Artificial Sequence
  Synthetic Polynucleotide
taatacgactcactatagggtgctgggcatcactgctgctagtaccaccaaacagaggagatggtggatgtagcagcagaacctggcggcagcgcaaaagatg

SEQ ID NO: 170474 - DNA, 103 bp, Artificial Sequence
  Synthetic Polynucleotide
taatacgactcactatagggtttgtaattgccatggcgatatcatttctcaacagaggagagagaaaatgtatcgccataacctggcggcagcgcaaaagatg

SEQ ID NO: 170475 - DNA, 103 bp, Artificial Sequence
  Synthetic Polynucleotide
taatacgactcactatagggctgatcaaattttgtaattgccatggcgataacagaggagaatcgccatggcaattacaaacctggcggcagcgcaaaagatg

SEQ ID NO: 170476 - DNA, 103 bp, Artificial Sequence
  Synthetic Polynucleotide
taatacgactcactataggggaaaatcaaactgatcaaattttgtaattgaacagaggagacaattaatgaatttgatcaacctggcggcagcgcaaaagatg

SEQ ID NO: 170477 - DNA, 103 bp, Artificial Sequence
  Synthetic Polynucleotide
taatacgactcactatagggatatcgatgagaaaatcaaactgatcaaataacagaggagaatttgaatggtttgatttaacctggcggcagcgcaaaagatg

SEQ ID NO: 170478 - DNA, 103 bp, Artificial Sequence
  Synthetic Polynucleotide
taatacgactcactatagggtcttggaacaatatcgatgagaaaatcaaaaacagaggagatttgatatgctcatcgataacctggcggcagcgcaaaagatg

SEQ ID NO: 170479 - DNA, 103 bp, Artificial Sequence
  Synthetic Polynucleotide
taatacgactcactatagggtcagttcatctcttggaacaatatcgatgaaacagaggagatcatcgatgttgttccaaaacctggcggcagcgcaaaagatg

SEQ ID NO: 170480 - DNA, 103 bp, Artificial Sequence
  Synthetic Polynucleotide
taatacgactcactatagggtttggaggtttcagttcatctcttggaacaaacagaggagatgttccatgagatgaactaacctggcggcagcgcaaaagatg

SEQ ID NO: 170481 - DNA, 103 bp, Artificial Sequence
  Synthetic Polynucleotide
taatacgactcactatagggctcctgacgctttggaggtttcagttcatcaacagaggagagatgaaatgaaacctccaaacctggcggcagcgcaaaagatg

SEQ ID NO: 170482 - DNA, 103 bp, Artificial Sequence
  Synthetic Polynucleotide
taatacgactcactatagggggcgcacctcctcctgacgctttggaggttaacagaggagaaacctcatgagcgtcaggaacctggcggcagcgcaaaagatg

SEQ ID NO: 170483 - DNA, 103 bp, Artificial Sequence
  Synthetic Polynucleotide
taatacgactcactataggggttacagactggcgcacctcctcctgacgcaacagaggagagcgtcaatgggaggtgcgaacctggcggcagcgcaaaagatg

SEQ ID NO: 170484 - DNA, 103 bp, Artificial Sequence
  Synthetic Polynucleotide
taatacgactcactatagggctgtaggctttgctgggcatcactgctgctaacagaggagaagcagcatggatgcccagaacctggcggcagcgcaaaagatg

SEQ ID NO: 170485 - DNA, 103 bp, Artificial Sequence
  Synthetic Polynucleotide
taatacgactcactatagggctcggcaggagttacagactggcgcacctcaacagaggagagaggtgatgcagtctgtaaacctggcggcagcgcaaaagatg

SEQ ID NO: 170486 - DNA, 103 bp, Artificial Sequence
  Synthetic Polynucleotide
taatacgactcactatagggactggactggctcggcaggagttacagactaacagaggagaagtctgatgctcctgccgaacctggcggcagcgcaaaagatg

SEQ ID NO: 170487 - DNA, 103 bp, Artificial Sequence
  Synthetic Polynucleotide
taatacgactcactataggggtgaaatagtactggactggctcggcaggaaacagaggagatcctgcatggccagtccaaacctggcggcagcgcaaaagatg

SEQ ID NO: 170488 - DNA, 103 bp, Artificial Sequence
  Synthetic Polynucleotide
taatacgactcactatagggctgagccagcgtgaaatagtactggactggaacagaggagaccagtcatgtactatttcaacctggcggcagcgcaaaagatg

SEQ ID NO: 170489 - DNA, 103 bp, Artificial Sequence
  Synthetic Polynucleotide
taatacgactcactatagggcggtgggttgctgagccagcgtgaaatagtaacagaggagaactattatgcgctggctcaacctggcggcagcgcaaaagatg

SEQ ID NO: 170490 - DNA, 103 bp, Artificial Sequence
  Synthetic Polynucleotide
taatacgactcactatagggacttggacagcggtgggttgctgagccagcaacagaggagagctggcatggcaacccacaacctggcggcagcgcaaaagatg

SEQ ID NO: 170491 - DNA, 103 bp, Artificial Sequence
  Synthetic Polynucleotide
taatacgactcactatagggctggccctggacttggacagcggtgggttgaacagaggagacaacccatggctgtccaaaacctggcggcagcgcaaaagatg

SEQ ID NO: 170492 - DNA, 103 bp, Artificial Sequence
  Synthetic Polynucleotide
taatacgactcactatagggggccttgctgctggccctggacttggacagaacagaggagactgtccatgtccagggccaacctggcggcagcgcaaaagatg

SEQ ID NO: 170493 - DNA, 103 bp, Artificial Sequence
  Synthetic Polynucleotide
taatacgactcactataggggtggtctgctggccttgctgctggccctggaacagaggagaccagggatggcagcaaggaacctggcggcagcgcaaaagatg

SEQ ID NO: 170494 - DNA, 103 bp, Artificial Sequence
  Synthetic Polynucleotide
taatacgactcactatagggcgtggagctggtggtctgctggccttgctgaacagaggagacagcaaatgcagcagaccaacctggcggcagcgcaaaagatg

SEQ ID NO: 170495 - DNA, 103 bp, Artificial Sequence
  Synthetic Polynucleotide
taatacgactcactataggggccagaacgactgtaggctttgctgggcataacagaggagaatgcccatgaaagcctacaacctggcggcagcgcaaaagatg

SEQ ID NO: 170496 - DNA, 103 bp, Artificial Sequence
  Synthetic Polynucleotide
taatacgactcactatagggggatggtggtcgtggagctggtggtctgctaacagaggagaagcagaatgccagctccaaacctggcggcagcgcaaaagatg

SEQ ID NO: 170497 - DNA, 103 bp, Artificial Sequence
  Synthetic Polynucleotide
taatacgactcactatagggtgcccaggctggatggtggtcgtggagctgaacagaggagacagctcatggaccaccataacctggcggcagcgcaaaagatg

SEQ ID NO: 170498 - DNA, 103 bp, Artificial Sequence
  Synthetic Polynucleotide
taatacgactcactataggggatgatgatctgcccaggctggatggtggtaacagaggagaaccaccatgcagcctgggaacctggcggcagcgcaaaagatg

SEQ ID NO: 170499 - DNA, 103 bp, Artificial Sequence
  Synthetic Polynucleotide
taatacgactcactataggggaggctgtgcgatgatgatctgcccaggctaacagaggagaagcctgatgagatcatcaaacctggcggcagcgcaaaagatg

SEQ ID NO: 170500 - DNA, 103 bp, Artificial Sequence
  Synthetic Polynucleotide
taatacgactcactatagggtggccctgctgaggctgtgcgatgatgatcaacagaggagagatcatatgcgcacagccaacctggcggcagcgcaaaagatg

SEQ ID NO: 170501 - DNA, 103 bp, Artificial Sequence
  Synthetic Polynucleotide
taatacgactcactatagggaggtgtggtctggccctgctgaggctgtgcaacagaggagagcacagatgcagcagggcaacctggcggcagcgcaaaagatg

SEQ ID NO: 170502 - DNA, 103 bp, Artificial Sequence
  Synthetic Polynucleotide
taatacgactcactataggggcattgtcacaggtgtggtctggccctgctaacagaggagaagcaggatgagaccacacaacctggcggcagcgcaaaagatg

SEQ ID NO: 170503 - DNA, 103 bp, Artificial Sequence
  Synthetic Polynucleotide
taatacgactcactatagggtctccaacctgcattgtcacaggtgtggtcaacagaggagagaccacatgtgtgacaataacctggcggcagcgcaaaagatg

SEQ ID NO: 170504 - DNA, 103 bp, Artificial Sequence
  Synthetic Polynucleotide
taatacgactcactatagggctgctgaccttctccaacctgcattgtcacaacagaggagagtgacaatgcaggttggaaacctggcggcagcgcaaaagatg

SEQ ID NO: 170505 - DNA, 103 bp, Artificial Sequence
  Synthetic Polynucleotide
taatacgactcactatagggcaatctgcacctgctgaccttctccaacctaacagaggagaaggttgatgaaggtcagcaacctggcggcagcgcaaaagatg

SEQ ID NO: 170506 - DNA, 103 bp, Artificial Sequence
  Synthetic Polynucleotide
taatacgactcactatagggatgacccgaggccagaacgactgtaggcttaacagaggagaaagcctatggtcgttctgaacctggcggcagcgcaaaagatg

SEQ ID NO: 170507 - DNA, 103 bp, Artificial Sequence
  Synthetic Polynucleotide
taatacgactcactatagggtgagcctggacaatctgcacctgctgacctaacagaggagaaggtcaatgggtgcagataacctggcggcagcgcaaaagatg

SEQ ID NO: 170508 - DNA, 103 bp, Artificial Sequence
  Synthetic Polynucleotide
taatacgactcactatagggaccctgtggctgagcctggacaatctgcacaacagaggagagtgcagatggtccaggctaacctggcggcagcgcaaaagatg

SEQ ID NO: 170509 - DNA, 103 bp, Artificial Sequence
  Synthetic Polynucleotide
taatacgactcactataggggttgggcttgaccctgtggctgagcctggaaacagaggagatccaggatgagccacaggaacctggcggcagcgcaaaagatg

SEQ ID NO: 170510 - DNA, 103 bp, Artificial Sequence
  Synthetic Polynucleotide
taatacgactcactatagggctctgggcctgttgggcttgaccctgtggcaacagaggagagccacaatgtcaagcccaaacctggcggcagcgcaaaagatg

SEQ ID NO: 170511 - DNA, 103 bp, Artificial Sequence
  Synthetic Polynucleotide
taatacgactcactatagggtccagtgccactctgggcctgttgggcttgaacagaggagacaagccatgcaggcccagaacctggcggcagcgcaaaagatg

SEQ ID NO: 170512 - DNA, 103 bp, Artificial Sequence
  Synthetic Polynucleotide
taatacgactcactataggggcatggtctgtccagtgccactctgggcctaacagaggagaaggcccatggtggcactgaacctggcggcagcgcaaaagatg

SEQ ID NO: 170513 - DNA, 103 bp, Artificial Sequence
  Synthetic Polynucleotide
taatacgactcactatagggtgcatcacctgcatggtctgtccagtgccaaacagaggagatggcacatgacagaccataacctggcggcagcgcaaaagatg

SEQ ID NO: 170514 - DNA, 103 bp, Artificial Sequence
  Synthetic Polynucleotide
taatacgactcactataggggatgatctgctgcatcacctgcatggtctgaacagaggagacagaccatgcaggtgatgaacctggcggcagcgcaaaagatg

SEQ ID NO: 170515 - DNA, 103 bp, Artificial Sequence
  Synthetic Polynucleotide
taatacgactcactatagggctgtgttagtgatgatctgctgcatcacctaacagaggagaaggtgaatgagcagatcaaacctggcggcagcgcaaaagatg

SEQ ID NO: 170516 - DNA, 103 bp, Artificial Sequence
  Synthetic Polynucleotide
taatacgactcactatagggtggatctctcctgtgttagtgatgatctgcaacagaggagagcagatatgcactaacacaacctggcggcagcgcaaaagatg

SEQ ID NO: 170517 - DNA, 103 bp, Artificial Sequence
  Synthetic Polynucleotide
taatacgactcactataggggatttcttccatgacccgaggccagaacgaaacagaggagatcgttcatgcctcgggtcaacctggcggcagcgcaaaagatg

SEQ ID NO: 170518 - DNA, 103 bp, Artificial Sequence
  Synthetic Polynucleotide
taatacgactcactatagggcgggatctgctggatctctcctgtgttagtaacagaggagaactaacatgggagagatcaacctggcggcagcgcaaaagatg

SEQ ID NO: 170519 - DNA, 103 bp, Artificial Sequence
  Synthetic Polynucleotide
taatacgactcactatagggtcagctgcaccgggatctgctggatctctcaacagaggagagagagaatgagcagatccaacctggcggcagcgcaaaagatg

SEQ ID NO: 170520 - DNA, 103 bp, Artificial Sequence
  Synthetic Polynucleotide
taatacgactcactatagggtggccggcattcagctgcaccgggatctgcaacagaggagagcagatatgggtgcagctaacctggcggcagcgcaaaagatg

SEQ ID NO: 170521 - DNA, 103 bp, Artificial Sequence
  Synthetic Polynucleotide
taatacgactcactatagggatactgcagctggccggcattcagctgcacaacagaggagagtgcagatgaatgccggcaacctggcggcagcgcaaaagatg

SEQ ID NO: 170522 - DNA, 103 bp, Artificial Sequence
  Synthetic Polynucleotide
taatacgactcactatagggctaagcggatatactgcagctggccggcataacagaggagaatgccgatgagctgcagtaacctggcggcagcgcaaaagatg

SEQ ID NO: 170523 - DNA, 103 bp, Artificial Sequence
  Synthetic Polynucleotide
taatacgactcactatagggacaggctgggctaagcggatatactgcagcaacagaggagagctgcaatgtatccgcttaacctggcggcagcgcaaaagatg

SEQ ID NO: 170524 - DNA, 103 bp, Artificial Sequence
  Synthetic Polynucleotide
taatacgactcactatagggagtgcctgatacaggctgggctaagcggataacagaggagaatccgcatggcccagcctaacctggcggcagcgcaaaagatg

SEQ ID NO: 170525 - DNA, 103 bp, Artificial Sequence
  Synthetic Polynucleotide
taatacgactcactataggggcacaacttgagtgcctgatacaggctgggaacagaggagacccagcatgtatcaggcaaacctggcggcagcgcaaaagatg

SEQ ID NO: 170526 - DNA, 103 bp, Artificial Sequence
  Synthetic Polynucleotide
taatacgactcactatagggatctgtccctgcacaacttgagtgcctgataacagaggagaatcaggatgtcaagttgtaacctggcggcagcgcaaaagatg

SEQ ID NO: 170527 - DNA, 103 bp, Artificial Sequence
  Synthetic Polynucleotide
taatacgactcactatagggaagtgtctggatctgtccctgcacaacttgaacagaggagacaagttatgcagggacagaacctggcggcagcgcaaaagatg

SEQ ID NO: 170528 - DNA, 103 bp, Artificial Sequence
  Synthetic Polynucleotide
taatacgactcactatagggttaaattccggatttcttccatgacccgagaacagaggagactcgggatgtggaagaaaaacctggcggcagcgcaaaagatg

SEQ ID NO: 170529 - DNA, 103 bp, Artificial Sequence
  Synthetic Polynucleotide
taatacgactcactatagggcattggtggcaagtgtctggatctgtccctaacagaggagaagggacatgtccagacacaacctggcggcagcgcaaaagatg

SEQ ID NO: 170530 - DNA, 103 bp, Artificial Sequence
  Synthetic Polynucleotide
taatacgactcactatagggccctgttgagcattggtggcaagtgtctggaacagaggagaccagacatgtgccaccaaaacctggcggcagcgcaaaagatg

SEQ ID NO: 170531 - DNA, 103 bp, Artificial Sequence
  Synthetic Polynucleotide
taatacgactcactatagggatttctttgcccctgttgagcattggtggcaacagaggagagccaccatggctcaacagaacctggcggcagcgcaaaagatg

SEQ ID NO: 170532 - DNA, 103 bp, Artificial Sequence
  Synthetic Polynucleotide
taatacgactcactatagggcctgacttgcatttctttgcccctgttgagaacagaggagactcaacatgggcaaagaaaacctggcggcagcgcaaaagatg

SEQ ID NO: 170533 - DNA, 103 bp, Artificial Sequence
  Synthetic Polynucleotide
taatacgactcactatagggcgaggcttcccctgacttgcatttctttgcaacagaggagagcaaagatgtgcaagtcaaacctggcggcagcgcaaaagatg

SEQ ID NO: 170534 - DNA, 103 bp, Artificial Sequence
  Synthetic Polynucleotide
taatacgactcactatagggcaggcaccttcgaggcttcccctgacttgcaacagaggagagcaagtatggggaagcctaacctggcggcagcgcaaaagatg

SEQ ID NO: 170535 - DNA, 103 bp, Artificial Sequence
  Synthetic Polynucleotide
taatacgactcactatagggaggtttctttcaggcaccttcgaggcttccaacagaggagaggaagcatggaaggtgccaacctggcggcagcgcaaaagatg

SEQ ID NO: 170536 - DNA, 103 bp, Artificial Sequence
  Synthetic Polynucleotide
taatacgactcactataggggtaatctgtaaggtttctttcaggcaccttaacagaggagaaaggtgatggaaagaaacaacctggcggcagcgcaaaagatg

SEQ ID NO: 170537 - DNA, 103 bp, Artificial Sequence
  Synthetic Polynucleotide
taatacgactcactatagggctctgtctgtgtaatctgtaaggtttctttaacagaggagaaaagaaatgttacagattaacctggcggcagcgcaaaagatg

SEQ ID NO: 170538 - DNA, 103 bp, Artificial Sequence
  Synthetic Polynucleotide
taatacgactcactatagggcttgctggacctctgtctgtgtaatctgtaaacagaggagatacagaatgcacagacagaacctggcggcagcgcaaaagatg

SEQ ID NO: 170539 - DNA, 103 bp, Artificial Sequence
  Synthetic Polynucleotide
taatacgactcactatagggtctttcactgttaaattccggatttcttccaacagaggagaggaagaatgccggaatttaacctggcggcagcgcaaaagatg

SEQ ID NO: 170540 - DNA, 103 bp, Artificial Sequence
  Synthetic Polynucleotide
taatacgactcactatagggtgctgctgtccttgctggacctctgtctgtaacagaggagaacagacatgggtccagcaaacctggcggcagcgcaaaagatg

SEQ ID NO: 170541 - DNA, 103 bp, Artificial Sequence
  Synthetic Polynucleotide
taatacgactcactatagggctggctgaactgctgctgtccttgctggacaacagaggagagtccagatgggacagcagaacctggcggcagcgcaaaagatg

SEQ ID NO: 170542 - DNA, 103 bp, Artificial Sequence
  Synthetic Polynucleotide
taatacgactcactatagggcatctgtgaactggctgaactgctgctgtcaacagaggagagacagcatgagttcagccaacctggcggcagcgcaaaagatg

SEQ ID NO: 170543 - DNA, 103 bp, Artificial Sequence
  Synthetic Polynucleotide
taatacgactcactatagggttcctctgtccatctgtgaactggctgaacaacagaggagagttcagatggttcacagaaacctggcggcagcgcaaaagatg

SEQ ID NO: 170544 - DNA, 103 bp, Artificial Sequence
  Synthetic Polynucleotide
taatacgactcactatagggctgcacgctgttcctctgtccatctgtgaaaacagaggagattcacaatgggacagaggaacctggcggcagcgcaaaagatg

SEQ ID NO: 170545 - DNA, 103 bp, Artificial Sequence
  Synthetic Polynucleotide
taatacgactcactatagggctcgagcttgctgcacgctgttcctctgtcaacagaggagagacagaatgacagcgtgcaacctggcggcagcgcaaaagatg

SEQ ID NO: 170546 - DNA, 103 bp, Artificial Sequence
  Synthetic Polynucleotide
taatacgactcactatagggagctcagagactcgagcttgctgcacgctgaacagaggagacagcgtatggcaagctcgaacctggcggcagcgcaaaagatg

SEQ ID NO: 170547 - DNA, 103 bp, Artificial Sequence
  Synthetic Polynucleotide
taatacgactcactatagggctctcccgttagctcagagactcgagcttgaacagaggagacaagctatggtctctgagaacctggcggcagcgcaaaagatg

SEQ ID NO: 170548 - DNA, 103 bp, Artificial Sequence
  Synthetic Polynucleotide
taatacgactcactatagggtgggctctgcctctcccgttagctcagagaaacagaggagatctctgatgtaacgggagaacctggcggcagcgcaaaagatg

SEQ ID NO: 170549 - DNA, 103 bp, Artificial Sequence
  Synthetic Polynucleotide
taatacgactcactatagggttcacttctctgggctctgcctctcccgttaacagaggagaaacgggatgggcagagccaacctggcggcagcgcaaaagatg

SEQ ID NO: 170550 - DNA, 103 bp, Artificial Sequence
  Synthetic Polynucleotide
taatacgactcactatagggcagctccatggtgtctgagttgagcatcataacagaggagaatgatgatgaactcagacaacctggcggcagcgcaaaagatg

SEQ ID NO: 170551 - DNA, 103 bp, Artificial Sequence
  Synthetic Polynucleotide
taatacgactcactatagggcggacccccaggcccggcaccatcagggccaacagaggagaggccctatgggtgccgggaacctggcggcagcgcaaaagatg

SEQ ID NO: 170552 - DNA, 103 bp, Artificial Sequence
  Synthetic Polynucleotide
taatacgactcactatagggggccccctcccggacccccaggcccggcacaacagaggagagtgccgatgctgggggtcaacctggcggcagcgcaaaagatg

SEQ ID NO: 170553 - DNA, 103 bp, Artificial Sequence
  Synthetic Polynucleotide
taatacgactcactatagggcctcgggcctggccccctcccggacccccaaacagaggagatgggggatggggagggggaacctggcggcagcgcaaaagatg

SEQ ID NO: 170554 - DNA, 103 bp, Artificial Sequence
  Synthetic Polynucleotide
taatacgactcactatagggcggctctgggcctcgggcctggccccctccaacagaggagaggagggatgcaggcccgaaacctggcggcagcgcaaaagatg

SEQ ID NO: 170555 - DNA, 103 bp, Artificial Sequence
  Synthetic Polynucleotide
taatacgactcactatagggcaggctctcccggctctgggcctcgggcctaacagaggagaaggcccatggcccagagcaacctggcggcagcgcaaaagatg

SEQ ID NO: 170556 - DNA, 103 bp, Artificial Sequence
  Synthetic Polynucleotide
taatacgactcactatagggtctttccggccaggctctcccggctctgggaacagaggagacccagaatggggagagccaacctggcggcagcgcaaaagatg

SEQ ID NO: 170557 - DNA, 103 bp, Artificial Sequence
  Synthetic Polynucleotide
taatacgactcactatagggatgctgcaggtctttccggccaggctctccaacagaggagaggagagatgggccggaaaaacctggcggcagcgcaaaagatg

SEQ ID NO: 170558 - DNA, 103 bp, Artificial Sequence
  Synthetic Polynucleotide
taatacgactcactatagggcgcggctcagatgctgcaggtctttccggcaacagaggagagccggaatgacctgcagcaacctggcggcagcgcaaaagatg

SEQ ID NO: 170559 - DNA, 103 bp, Artificial Sequence
  Synthetic Polynucleotide
taatacgactcactatagggcggcgctcctcgcggctcagatgctgcaggaacagaggagacctgcaatgtctgagccgaacctggcggcagcgcaaaagatg

SEQ ID NO: 170560 - DNA, 103 bp, Artificial Sequence
  Synthetic Polynucleotide
taatacgactcactataggggcgccggcgccggcgctcctcgcggctcagaacagaggagactgagcatggaggagcgcaacctggcggcagcgcaaaagatg

SEQ ID NO: 170561 - DNA, 103 bp, Artificial Sequence
  Synthetic Polynucleotide
taatacgactcactataggggcggcaggtccagctccatggtgtctgagtaacagaggagaactcagatgccatggagcaacctggcggcagcgcaaaagatg

SEQ ID NO: 170562 - DNA, 103 bp, Artificial Sequence
  Synthetic Polynucleotide
taatacgactcactatagggctgtggcgcggcgccggcgccggcgctcctaacagaggagaaggagcatgggcgccggcaacctggcggcagcgcaaaagatg

SEQ ID NO: 170563 - DNA, 103 bp, Artificial Sequence
  Synthetic Polynucleotide
taatacgactcactatagggcggtacttggctgtggcgcggcgccggcgcaacagaggagagcgccgatgccgcgccacaacctggcggcagcgcaaaagatg

SEQ ID NO: 170564 - DNA, 103 bp, Artificial Sequence
  Synthetic Polynucleotide
taatacgactcactataggggtgggccgtgcggtacttggctgtggcgcgaacagaggagacgcgccatggccaagtacaacctggcggcagcgcaaaagatg

SEQ ID NO: 170565 - DNA, 103 bp, Artificial Sequence
  Synthetic Polynucleotide
taatacgactcactatagggctcgcgtggcgtgggccgtgcggtacttggaacagaggagaccaagtatggcacggcccaacctggcggcagcgcaaaagatg

SEQ ID NO: 170566 - DNA, 103 bp, Artificial Sequence
  Synthetic Polynucleotide
taatacgactcactatagggcggatgcgttctcgcgtggcgtgggccgtgaacagaggagacacggcatgcgccacgcgaacctggcggcagcgcaaaagatg

SEQ ID NO: 170567 - DNA, 103 bp, Artificial Sequence
  Synthetic Polynucleotide
taatacgactcactatagggggcttccacgcggatgcgttctcgcgtggcaacagaggagagccacgatggaacgcatcaacctggcggcagcgcaaaagatg

SEQ ID NO: 170568 - DNA, 103 bp, Artificial Sequence
  Synthetic Polynucleotide
taatacgactcactatagggccaggttgaaggcttccacgcggatgcgttaacagaggagaaacgcaatggcgtggaagaacctggcggcagcgcaaaagatg

SEQ ID NO: 170569 - DNA, 103 bp, Artificial Sequence
  Synthetic Polynucleotide
taatacgactcactatagggtcggcgaaggccaggttgaaggcttccacgaacagaggagacgtggaatgcttcaacctaacctggcggcagcgcaaaagatg

SEQ ID NO: 170570 - DNA, 103 bp, Artificial Sequence
  Synthetic Polynucleotide
taatacgactcactatagggcttgcgcagctcggcgaaggccaggttgaaaacagaggagattcaacatggccttcgccaacctggcggcagcgcaaaagatg

SEQ ID NO: 170571 - DNA, 103 bp, Artificial Sequence
  Synthetic Polynucleotide
taatacgactcactatagggtaggcagcagcttgcgcagctcggcgaaggaacagaggagaccttcgatgagctgcgcaaacctggcggcagcgcaaaagatg

SEQ ID NO: 170572 - DNA, 103 bp, Artificial Sequence
  Synthetic Polynucleotide
taatacgactcactataggggagtgggtgggcggcaggtccagctccatgaacagaggagacatggaatgggacctgccaacctggcggcagcgcaaaagatg

SEQ ID NO: 170573 - DNA, 103 bp, Artificial Sequence
  Synthetic Polynucleotide
taatacgactcactataggggggggcagcgtaggcagcagcttgcgcagcaacagaggagagctgcgatggctgctgccaacctggcggcagcgcaaaagatg

SEQ ID NO: 170574 - DNA, 103 bp, Artificial Sequence
  Synthetic Polynucleotide
taatacgactcactatagggcttcttgtcggggggcagcgtaggcagcagaacagaggagactgctgatgacgctgcccaacctggcggcagcgcaaaagatg

SEQ ID NO: 170575 - DNA, 103 bp, Artificial Sequence
  Synthetic Polynucleotide
taatacgactcactatagggtcttggagagcttcttgtcggggggcagcgaacagaggagacgctgcatgccgacaagaaacctggcggcagcgcaaaagatg

SEQ ID NO: 170576 - DNA, 103 bp, Artificial Sequence
  Synthetic Polynucleotide
taatacgactcactatagggagaatctcaatcttggagagcttcttgtcgaacagaggagacgacaaatggctctccaaaacctggcggcagcgcaaaagatg

SEQ ID NO: 170577 - DNA, 103 bp, Artificial Sequence
  Synthetic Polynucleotide
taatacgactcactatagggggccaggcgcagaatctcaatcttggagagaacagaggagactctccatgattgagattaacctggcggcagcgcaaaagatg

SEQ ID NO: 170578 - DNA, 103 bp, Artificial Sequence
  Synthetic Polynucleotide
taatacgactcactatagggtatagcagatggccaggcgcagaatctcaaaacagaggagattgagaatgtgcgcctggaacctggcggcagcgcaaaagatg

SEQ ID NO: 170579 - DNA, 103 bp, Artificial Sequence
  Synthetic Polynucleotide
taatacgactcactatagggaggtaggagatatagcagatggccaggcgcaacagaggagagcgcctatgcatctgctaaacctggcggcagcgcaaaagatg

SEQ ID NO: 170580 - DNA, 103 bp, Artificial Sequence
  Synthetic Polynucleotide
taatacgactcactatagggcacgtggttcaggtaggagatatagcagataacagaggagaatctgcatgatctcctacaacctggcggcagcgcaaaagatg

SEQ ID NO: 170581 - DNA, 103 bp, Artificial Sequence
  Synthetic Polynucleotide
taatacgactcactatagggagacgtccagcacgtggttcaggtaggagaaacagaggagatctcctatgtgaaccacgaacctggcggcagcgcaaaagatg

SEQ ID NO: 170582 - DNA, 103 bp, Artificial Sequence
  Synthetic Polynucleotide
taatacgactcactatagggctcagtctctgagtgggtgggcggcaggtcaacagaggagagacctgatgcccacccacaacctggcggcagcgcaaaagatg

SEQ ID NO: 170583 - DNA, 103 bp, Artificial Sequence
  Synthetic Polynucleotide
taatacgactcactatagggtgaagcccgactcagtctctgagtgggtggaacagaggagaccacccatgcagagactgaacctggcggcagcgcaaaagatg

SEQ ID NO: 170584 - DNA, 103 bp, Artificial Sequence
  Synthetic Polynucleotide
taatacgactcactatagggccacagtcactgaagcccgactcagtctctaacagaggagaagagacatggtcgggcttaacctggcggcagcgcaaaagatg

SEQ ID NO: 170585 - DNA, 103 bp, Artificial Sequence
  Synthetic Polynucleotide
taatacgactcactatagggcgccccgcccccacagtcactgaagcccgaaacagaggagatcgggcatgagtgactgtaacctggcggcagcgcaaaagatg

SEQ ID NO: 170586 - DNA, 103 bp, Artificial Sequence
  Synthetic Polynucleotide
taatacgactcactatagggcatcagggcccgccccgcccccacagtcacaacagaggagagtgactatgggggcggggaacctggcggcagcgcaaaagatg

SEQ ID NO: 170587 - DNA, 103 bp, Artificial Sequence
  Synthetic Polynucleotide
taatacgactcactatagggggcccggcaccatcagggcccgccccgcccaacagaggagagggcggatggggccctgaaacctggcggcagcgcaaaagatg

SEQ ID NO: 170588 - DNA, 103 bp, Artificial Sequence
  Synthetic Polynucleotide
taatacgactcactatagggatctgctgcttggtccggactcagcatcataacagaggagaatgatgatgagtccggacaacctggcggcagcgcaaaagatg

SEQ ID NO: 170589 - DNA, 103 bp, Artificial Sequence
  Synthetic Polynucleotide
taatacgactcactatagggcggctccaggtccgacacgctgccgagcacaacagaggagagtgctcatgagcgtgtcgaacctggcggcagcgcaaaagatg

SEQ ID NO: 170590 - DNA, 103 bp, Artificial Sequence
  Synthetic Polynucleotide
taatacgactcactatagggcctcctccaccggctccaggtccgacacgcaacagaggagagcgtgtatgacctggagcaacctggcggcagcgcaaaagatg

SEQ ID NO: 170591 - DNA, 103 bp, Artificial Sequence
  Synthetic Polynucleotide
taatacgactcactatagggtcgccctcggcctcctccaccggctccaggaacagaggagacctggaatgggtggaggaaacctggcggcagcgcaaaagatg

SEQ ID NO: 170592 - DNA, 103 bp, Artificial Sequence
  Synthetic Polynucleotide
taatacgactcactataggggcccttgccgtcgccctcggcctcctccacaacagaggagagtggagatggccgagggcaacctggcggcagcgcaaaagatg

SEQ ID NO: 170593 - DNA, 103 bp, Artificial Sequence
  Synthetic Polynucleotide
taatacgactcactatagggctcggctgccgcccttgccgtcgccctcggaacagaggagaccgaggatgacggcaaggaacctggcggcagcgcaaaagatg

SEQ ID NO: 170594 - DNA, 103 bp, Artificial Sequence
  Synthetic Polynucleotide
taatacgactcactatagggtagagcgcggctcggctgccgcccttgccgaacagaggagacggcaaatgcggcagccgaacctggcggcagcgcaaaagatg

SEQ ID NO: 170595 - DNA, 103 bp, Artificial Sequence
  Synthetic Polynucleotide
taatacgactcactatagggcgggtgcgggtagagcgcggctcggctgccaacagaggagaggcagcatggccgcgctcaacctggcggcagcgcaaaagatg

SEQ ID NO: 170596 - DNA, 103 bp, Artificial Sequence
  Synthetic Polynucleotide
taatacgactcactatagggtcagctgctgcgggtgcgggtagagcgcggaacagaggagaccgcgcatgacccgcaccaacctggcggcagcgcaaaagatg

SEQ ID NO: 170597 - DNA, 103 bp, Artificial Sequence
  Synthetic Polynucleotide
taatacgactcactatagggtcctcgcggctcagctgctgcgggtgcgggaacagaggagacccgcaatggcagcagctaacctggcggcagcgcaaaagatg

SEQ ID NO: 170598 - DNA, 103 bp, Artificial Sequence
  Synthetic Polynucleotide
taatacgactcactataggggcggcgcttctcctcgcggctcagctgctgaacagaggagacagcagatgagccgcgagaacctggcggcagcgcaaaagatg

SEQ ID NO: 170599 - DNA, 103 bp, Artificial Sequence
  Synthetic Polynucleotide
taatacgactcactataggggatggtccgaatctgctgcttggtccggacaacagaggagagtccggatgaagcagcagaacctggcggcagcgcaaaagatg

SEQ ID NO: 170600 - DNA, 103 bp, Artificial Sequence
  Synthetic Polynucleotide
taatacgactcactatagggcgcgccggcggcggcgcttctcctcgcggcaacagaggagagccgcgatgagaagcgccaacctggcggcagcgcaaaagatg

SEQ ID NO: 170601 - DNA, 103 bp, Artificial Sequence
  Synthetic Polynucleotide
taatacgactcactatagggttggccgtggcgcgccggcggcggcgcttcaacagaggagagaagcgatgccgccggcgaacctggcggcagcgcaaaagatg

SEQ ID NO: 170602 - DNA, 103 bp, Artificial Sequence
  Synthetic Polynucleotide
taatacgactcactatagggcgagcggtacttggccgtggcgcgccggcgaacagaggagacgccggatggccacggccaacctggcggcagcgcaaaagatg

SEQ ID NO: 170603 - DNA, 103 bp, Artificial Sequence
  Synthetic Polynucleotide
taatacgactcactatagggtggcgtgggccgagcggtacttggccgtggaacagaggagaccacggatgagtaccgctaacctggcggcagcgcaaaagatg

SEQ ID NO: 170604 - DNA, 103 bp, Artificial Sequence
  Synthetic Polynucleotide
taatacgactcactatagggcgctcgcgggtggcgtgggccgagcggtacaacagaggagagtaccgatgggcccacgcaacctggcggcagcgcaaaagatg

SEQ ID NO: 170605 - DNA, 103 bp, Artificial Sequence
  Synthetic Polynucleotide
taatacgactcactatagggcacgcggatgcgctcgcgggtggcgtgggcaacagaggagagcccacatgacccgcgagaacctggcggcagcgcaaaagatg

SEQ ID NO: 170606 - DNA, 103 bp, Artificial Sequence
  Synthetic Polynucleotide
taatacgactcactatagggtgaaggcttccacgcggatgcgctcgcgggaacagaggagacccgcgatggcatccgcgaacctggcggcagcgcaaaagatg

SEQ ID NO: 170607 - DNA, 103 bp, Artificial Sequence
  Synthetic Polynucleotide
taatacgactcactatagggaaggccaagttgaaggcttccacgcggatgaacagaggagacatccgatgggaagccttaacctggcggcagcgcaaaagatg

SEQ ID NO: 170608 - DNA, 103 bp, Artificial Sequence
  Synthetic Polynucleotide
taatacgactcactataggggagctcggcgaaggccaagttgaaggcttcaacagaggagagaagccatgaacttggccaacctggcggcagcgcaaaagatg

SEQ ID NO: 170609 - DNA, 103 bp, Artificial Sequence
  Synthetic Polynucleotide
taatacgactcactataggggcaatttgcggagctcggcgaaggccaagtaacagaggagaacttggatgtcgccgagcaacctggcggcagcgcaaaagatg

SEQ ID NO: 170610 - DNA, 103 bp, Artificial Sequence
  Synthetic Polynucleotide
taatacgactcactataggggccgagctgggatggtccgaatctgctgctaacagaggagaagcagcatgttcggaccaaacctggcggcagcgcaaaagatg

SEQ ID NO: 170611 - DNA, 103 bp, Artificial Sequence
  Synthetic Polynucleotide
taatacgactcactatagggagcgtgggcagcaatttgcggagctcggcgaacagaggagacgccgaatgccgcaaattaacctggcggcagcgcaaaagatg

SEQ ID NO: 170612 - DNA, 103 bp, Artificial Sequence
  Synthetic Polynucleotide
taatacgactcactataggggtccgggggcagcgtgggcagcaatttgcgaacagaggagacgcaaaatgctgcccacgaacctggcggcagcgcaaaagatg

SEQ ID NO: 170613 - DNA, 103 bp, Artificial Sequence
  Synthetic Polynucleotide
taatacgactcactatagggagagcttcttgtccgggggcagcgtgggcaaacagaggagatgcccaatgtgcccccggaacctggcggcagcgcaaaagatg

SEQ ID NO: 170614 - DNA, 103 bp, Artificial Sequence
  Synthetic Polynucleotide
taatacgactcactatagggtcgatcttggagagcttcttgtccgggggcaacagaggagagcccccatgcaagaagctaacctggcggcagcgcaaaagatg

SEQ ID NO: 170615 - DNA, 103 bp, Artificial Sequence
  Synthetic Polynucleotide
taatacgactcactataggggcgcaggatctcgatcttggagagcttcttaacagaggagaaagaagatgtccaagatcaacctggcggcagcgcaaaagatg

SEQ ID NO: 170616 - DNA, 103 bp, Artificial Sequence
  Synthetic Polynucleotide
taatacgactcactatagggagatggccaggcgcaggatctcgatcttggaacagaggagaccaagaatgagatcctgcaacctggcggcagcgcaaaagatg

SEQ ID NO: 170617 - DNA, 103 bp, Artificial Sequence
  Synthetic Polynucleotide
taatacgactcactataggggagatgtagcagatggccaggcgcaggatcaacagaggagagatcctatgcctggccataacctggcggcagcgcaaaagatg

SEQ ID NO: 170618 - DNA, 103 bp, Artificial Sequence
  Synthetic Polynucleotide
taatacgactcactataggggttgagataggagatgtagcagatggccagaacagaggagactggccatgtgctacatcaacctggcggcagcgcaaaagatg

SEQ ID NO: 170619 - DNA, 103 bp, Artificial Sequence
  Synthetic Polynucleotide
taatacgactcactatagggccaggacgtggttgagataggagatgtagcaacagaggagagctacaatgcctatctcaaacctggcggcagcgcaaaagatg

SEQ ID NO: 170620 - DNA, 103 bp, Artificial Sequence
  Synthetic Polynucleotide
taatacgactcactatagggatccgagtgcgccgagctgggatggtccgaaacagaggagatcggacatgcccagctcgaacctggcggcagcgcaaaagatg

SEQ ID NO: 170621 - DNA, 103 bp, Artificial Sequence
  Synthetic Polynucleotide
taatacgactcactataggggggactccggatccgagtgcgccgagctggaacagaggagaccagctatgcgcactcggaacctggcggcagcgcaaaagatg

SEQ ID NO: 170622 - DNA, 103 bp, Artificial Sequence
  Synthetic Polynucleotide
taatacgactcactataggggtgccgcccagggactccggatccgagtgcaacagaggagagcactcatgtccggagtcaacctggcggcagcgcaaaagatg

SEQ ID NO: 170623 - DNA, 103 bp, Artificial Sequence
  Synthetic Polynucleotide
taatacgactcactatagggcttggtgtccgtgccgcccagggactccggaacagaggagaccggagatgctgggcggcaacctggcggcagcgcaaaagatg

SEQ ID NO: 170624 - DNA, 103 bp, Artificial Sequence
  Synthetic Polynucleotide
taatacgactcactatagggtgccgagcaccttggtgtccgtgccgcccaaacagaggagatgggcgatgcggacaccaaacctggcggcagcgcaaaagatg

SEQ ID NO: 170625 - DNA, 103 bp, Artificial Sequence
  Synthetic Polynucleotide
taatacgactcactatagggtccgacacgctgccgagcaccttggtgtccaacagaggagaggacacatgggtgctcggaacctggcggcagcgcaaaagatg

SEQ ID NO: 170626 - DNA, 103 bp, Artificial Sequence
  Synthetic Polynucleotide
taatacgactcactatagggaccttcagccatttggagaattttttccataacagaggagaatggaaatgattctccaaaacctggcggcagcgcaaaagatg

SEQ ID NO: 170627 - DNA, 103 bp, Artificial Sequence
  Synthetic Polynucleotide
taatacgactcactatagggttgaccatcacatgttgagaggtggcgtttaacagaggagaaaacgcatgctctcaacaaacctggcggcagcgcaaaagatg

SEQ ID NO: 170628 - DNA, 103 bp, Artificial Sequence
  Synthetic Polynucleotide
taatacgactcactatagggaaaattggtccagtgtttggcagaagcattaacagaggagaaatgctatggccaaacacaacctggcggcagcgcaaaagatg

SEQ ID NO: 170629 - DNA, 103 bp, Artificial Sequence
  Synthetic Polynucleotide
taatacgactcactatagggctgtaatgacaaaattggtccagtgtttggaacagaggagaccaaacatgggaccaattaacctggcggcagcgcaaaagatg

SEQ ID NO: 170630 - DNA, 103 bp, Artificial Sequence
  Synthetic Polynucleotide
taatacgactcactatagggtttgcattttctgtaatgacaaaattggtcaacagaggagagaccaaatgtgtcattacaacctggcggcagcgcaaaagatg

SEQ ID NO: 170631 - DNA, 103 bp, Artificial Sequence
  Synthetic Polynucleotide
taatacgactcactatagggaattgcatcatttgcattttctgtaatgacaacagaggagagtcattatggaaaatgcaaacctggcggcagcgcaaaagatg

SEQ ID NO: 170632 - DNA, 103 bp, Artificial Sequence
  Synthetic Polynucleotide
taatacgactcactatagggtaaggataccaattgcatcatttgcattttaacagaggagaaaaatgatgatgatgcaaaacctggcggcagcgcaaaagatg

SEQ ID NO: 170633 - DNA, 103 bp, Artificial Sequence
  Synthetic Polynucleotide
taatacgactcactataggggcagaattgttaaggataccaattgcatcaaacagaggagatgatgcatgtggtatcctaacctggcggcagcgcaaaagatg

SEQ ID NO: 170634 - DNA, 103 bp, Artificial Sequence
  Synthetic Polynucleotide
taatacgactcactataggggttgaatgaggcagaattgttaaggataccaacagaggagaggtatcatgaacaattctaacctggcggcagcgcaaaagatg

SEQ ID NO: 170635 - DNA, 103 bp, Artificial Sequence
  Synthetic Polynucleotide
taatacgactcactatagggttgacatcttgttgaatgaggcagaattgtaacagaggagaacaattatgcctcattcaaacctggcggcagcgcaaaagatg

SEQ ID NO: 170636 - DNA, 103 bp, Artificial Sequence
  Synthetic Polynucleotide
taatacgactcactatagggttgtattcaattgacatcttgttgaatgagaacagaggagactcattatgcaagatgtcaacctggcggcagcgcaaaagatg

SEQ ID NO: 170637 - DNA, 103 bp, Artificial Sequence
  Synthetic Polynucleotide
taatacgactcactatagggcatctcatatttgtattcaattgacatcttaacagaggagaaagatgatgattgaatacaacctggcggcagcgcaaaagatg

SEQ ID NO: 170638 - DNA, 103 bp, Artificial Sequence
  Synthetic Polynucleotide
taatacgactcactatagggtaggaggattttgaccatcacatgttgagaaacagaggagatctcaaatggtgatggtcaacctggcggcagcgcaaaagatg

SEQ ID NO: 170639 - DNA, 103 bp, Artificial Sequence
  Synthetic Polynucleotide
taatacgactcactataggggatttggcatcatctcatatttgtattcaaaacagaggagattgaatatgaatatgagaaacctggcggcagcgcaaaagatg

SEQ ID NO: 170640 - DNA, 103 bp, Artificial Sequence
  Synthetic Polynucleotide
taatacgactcactatagggcgccatgtgcgatttggcatcatctcatataacagaggagaatatgaatggatgccaaaaacctggcggcagcgcaaaagatg

SEQ ID NO: 170641 - DNA, 103 bp, Artificial Sequence
  Synthetic Polynucleotide
taatacgactcactatagggcactcgacaacgccatgtgcgatttggcataacagaggagaatgccaatgcgcacatggaacctggcggcagcgcaaaagatg

SEQ ID NO: 170642 - DNA, 103 bp, Artificial Sequence
  Synthetic Polynucleotide
taatacgactcactatagggcttgtaaaaacactcgacaacgccatgtgcaacagaggagagcacatatggttgtcgagaacctggcggcagcgcaaaagatg

SEQ ID NO: 170643 - DNA, 103 bp, Artificial Sequence
  Synthetic Polynucleotide
taatacgactcactatagggaagcagtgatcttgtaaaaacactcgacaaaacagaggagattgtcgatggtttttacaaacctggcggcagcgcaaaagatg

SEQ ID NO: 170644 - DNA, 103 bp, Artificial Sequence
  Synthetic Polynucleotide
taatacgactcactatagggaccttcagctaagcagtgatcttgtaaaaaaacagaggagatttttaatggatcactgcaacctggcggcagcgcaaaagatg

SEQ ID NO: 170645 - DNA, 103 bp, Artificial Sequence
  Synthetic Polynucleotide
taatacgactcactatagggtggttccataaccttcagctaagcagtgataacagaggagaatcactatgtagctgaagaacctggcggcagcgcaaaagatg

SEQ ID NO: 170646 - DNA, 103 bp, Artificial Sequence
  Synthetic Polynucleotide
taatacgactcactatagggcttgttttcttggttccataaccttcagctaacagaggagaagctgaatgttatggaacaacctggcggcagcgcaaaagatg

SEQ ID NO: 170647 - DNA, 103 bp, Artificial Sequence
  Synthetic Polynucleotide
taatacgactcactatagggtgcatgtttacttgttttcttggttccataaacagaggagatatggaatgaagaaaacaaacctggcggcagcgcaaaagatg

SEQ ID NO: 170648 - DNA, 103 bp, Artificial Sequence
  Synthetic Polynucleotide
taatacgactcactatagggcgtcggcagctgcatgtttacttgttttctaacagaggagaagaaaaatggtaaacatgaacctggcggcagcgcaaaagatg

SEQ ID NO: 170649 - DNA, 103 bp, Artificial Sequence
  Synthetic Polynucleotide
taatacgactcactataggggcttgctttttaggaggattttgaccatcaaacagaggagatgatggatgaaatcctccaacctggcggcagcgcaaaagatg

SEQ ID NO: 170650 - DNA, 103 bp, Artificial Sequence
  Synthetic Polynucleotide
taatacgactcactatagggttcaaagcctcgtcggcagctgcatgtttaaacagaggagataaacaatgagctgccgaaacctggcggcagcgcaaaagatg

SEQ ID NO: 170651 - DNA, 103 bp, Artificial Sequence
  Synthetic Polynucleotide
taatacgactcactatagggttgaagaattttcaaagcctcgtcggcagcaacagaggagagctgccatggaggctttgaacctggcggcagcgcaaaagatg

SEQ ID NO: 170652 - DNA, 103 bp, Artificial Sequence
  Synthetic Polynucleotide
taatacgactcactataggggctgtgttttttgaagaattttcaaagcctaacagaggagaaggcttatgaaattcttcaacctggcggcagcgcaaaagatg

SEQ ID NO: 170653 - DNA, 103 bp, Artificial Sequence
  Synthetic Polynucleotide
taatacgactcactatagggggataagtgggctgtgttttttgaagaattaacagaggagaaattctatgaaaaacacaaacctggcggcagcgcaaaagatg

SEQ ID NO: 170654 - DNA, 103 bp, Artificial Sequence
  Synthetic Polynucleotide
taatacgactcactatagggtttgacagatggataagtgggctgtgttttaacagaggagaaaaacaatgcccacttataacctggcggcagcgcaaaagatg

SEQ ID NO: 170655 - DNA, 103 bp, Artificial Sequence
  Synthetic Polynucleotide
taatacgactcactatagggattgtgaacttttgacagatggataagtggaacagaggagaccacttatgcatctgtcaaacctggcggcagcgcaaaagatg

SEQ ID NO: 170656 - DNA, 103 bp, Artificial Sequence
  Synthetic Polynucleotide
taatacgactcactatagggcctgtatggcattgtgaacttttgacagataacagaggagaatctgtatgaagttcacaaacctggcggcagcgcaaaagatg

SEQ ID NO: 170657 - DNA, 103 bp, Artificial Sequence
  Synthetic Polynucleotide
taatacgactcactataggggggtgaagagcctgtatggcattgtgaactaacagaggagaagttcaatgtgccatacaaacctggcggcagcgcaaaagatg

SEQ ID NO: 170658 - DNA, 103 bp, Artificial Sequence
  Synthetic Polynucleotide
taatacgactcactatagggcagatcctctgggtgaagagcctgtatggcaacagaggagagccataatggctcttcacaacctggcggcagcgcaaaagatg

SEQ ID NO: 170659 - DNA, 103 bp, Artificial Sequence
  Synthetic Polynucleotide
taatacgactcactatagggttcttctttccagatcctctgggtgaagagaacagaggagactcttcatgcagaggatcaacctggcggcagcgcaaaagatg

SEQ ID NO: 170660 - DNA, 103 bp, Artificial Sequence
  Synthetic Polynucleotide
taatacgactcactatagggtttggaaccggcttgctttttaggaggattaacagaggagaaatcctatgaaaaagcaaaacctggcggcagcgcaaaagatg

SEQ ID NO: 170661 - DNA, 103 bp, Artificial Sequence
  Synthetic Polynucleotide
taatacgactcactatagggctttatatctttcttctttccagatcctctaacagaggagaagaggaatgggaaagaagaacctggcggcagcgcaaaagatg

SEQ ID NO: 170662 - DNA, 103 bp, Artificial Sequence
  Synthetic Polynucleotide
taatacgactcactatagggctacaagatcctttatatctttcttctttcaacagaggagagaaagaatgaagatataaaacctggcggcagcgcaaaagatg

SEQ ID NO: 170663 - DNA, 103 bp, Artificial Sequence
  Synthetic Polynucleotide
taatacgactcactatagggttctcataaactacaagatcctttatatctaacagaggagaagatatatgggatcttgtaacctggcggcagcgcaaaagatg

SEQ ID NO: 170664 - DNA, 103 bp, Artificial Sequence
  Synthetic Polynucleotide
taatacgactcactatagggatttgaagaattctcataaactacaagatcaacagaggagagatcttatggtttatgagaacctggcggcagcgcaaaagatg

SEQ ID NO: 170665 - DNA, 103 bp, Artificial Sequence
  Synthetic Polynucleotide
taatacgactcactatagggtgcacacgggatttgaagaattctcataaaaacagaggagatttatgatgattcttcaaaacctggcggcagcgcaaaagatg

SEQ ID NO: 170666 - DNA, 103 bp, Artificial Sequence
  Synthetic Polynucleotide
taatacgactcactatagggtcgttcagcgtgcacacgggatttgaagaaaacagaggagattcttcatgtcccgtgtgaacctggcggcagcgcaaaagatg

SEQ ID NO: 170667 - DNA, 103 bp, Artificial Sequence
  Synthetic Polynucleotide
taatacgactcactatagggctgagctgtgtcgttcagcgtgcacacgggaacagaggagacccgtgatgacgctgaacaacctggcggcagcgcaaaagatg

SEQ ID NO: 170668 - DNA, 103 bp, Artificial Sequence
  Synthetic Polynucleotide
taatacgactcactatagggttcggttaaactgagctgtgtcgttcagcgaacagaggagacgctgaatgacacagctcaacctggcggcagcgcaaaagatg

SEQ ID NO: 170669 - DNA, 103 bp, Artificial Sequence
  Synthetic Polynucleotide
taatacgactcactatagggtcaactgtcattcggttaaactgagctgtgaacagaggagacacagcatggtttaaccgaacctggcggcagcgcaaaagatg

SEQ ID NO: 170670 - DNA, 103 bp, Artificial Sequence
  Synthetic Polynucleotide
taatacgactcactatagggatagacatactcaactgtcattcggttaaaaacagaggagatttaacatgatgacagttaacctggcggcagcgcaaaagatg

SEQ ID NO: 170671 - DNA, 103 bp, Artificial Sequence
  Synthetic Polynucleotide
taatacgactcactatagggtcgcatggaatttggaaccggcttgcttttaacagaggagaaaaagcatgccggttccaaacctggcggcagcgcaaaagatg

SEQ ID NO: 170672 - DNA, 103 bp, Artificial Sequence
  Synthetic Polynucleotide
taatacgactcactatagggtcatcctttcatagacatactcaactgtcaaacagaggagatgacagatgagtatgtctaacctggcggcagcgcaaaagatg

SEQ ID NO: 170673 - DNA, 103 bp, Artificial Sequence
  Synthetic Polynucleotide
taatacgactcactatagggcggaggcctgtcatcctttcatagacatacaacagaggagagtatgtatgtgaaaggataacctggcggcagcgcaaaagatg

SEQ ID NO: 170674 - DNA, 103 bp, Artificial Sequence
  Synthetic Polynucleotide
taatacgactcactataggggcatttccagcggaggcctgtcatcctttcaacagaggagagaaaggatgacaggcctcaacctggcggcagcgcaaaagatg

SEQ ID NO: 170675 - DNA, 103 bp, Artificial Sequence
  Synthetic Polynucleotide
taatacgactcactataggggaatcactttgcatttccagcggaggcctgaacagaggagacaggccatggctggaaataacctggcggcagcgcaaaagatg

SEQ ID NO: 170676 - DNA, 103 bp, Artificial Sequence
  Synthetic Polynucleotide
taatacgactcactatagggtcactctctagaatcactttgcatttccagaacagaggagactggaaatgcaaagtgataacctggcggcagcgcaaaagatg

SEQ ID NO: 170677 - DNA, 103 bp, Artificial Sequence
  Synthetic Polynucleotide
taatacgactcactatagggtgcaattacttcactctctagaatcactttaacagaggagaaaagtgatgctagagagtaacctggcggcagcgcaaaagatg

SEQ ID NO: 170678 - DNA, 103 bp, Artificial Sequence
  Synthetic Polynucleotide
taatacgactcactatagggcaactgcttctgcaattacttcactctctaaacagaggagatagagaatgaagtaattgaacctggcggcagcgcaaaagatg

SEQ ID NO: 170679 - DNA, 103 bp, Artificial Sequence
  Synthetic Polynucleotide
taatacgactcactatagggttcttcaccccaactgcttctgcaattactaacagaggagaagtaatatgagaagcagtaacctggcggcagcgcaaaagatg

SEQ ID NO: 170680 - DNA, 103 bp, Artificial Sequence
  Synthetic Polynucleotide
taatacgactcactatagggtttgacagttttcttcaccccaactgcttcaacagaggagagaagcaatgggggtgaagaacctggcggcagcgcaaaagatg

SEQ ID NO: 170681 - DNA, 103 bp, Artificial Sequence
  Synthetic Polynucleotide
taatacgactcactatagggcagcttcatatttgacagttttcttcacccaacagaggagagggtgaatgaaactgtcaaacctggcggcagcgcaaaagatg

SEQ ID NO: 170682 - DNA, 103 bp, Artificial Sequence
  Synthetic Polynucleotide
taatacgactcactatagggaaacgaggtctcgcatggaatttggaaccgaacagaggagacggttcatgattccatgcaacctggcggcagcgcaaaagatg

SEQ ID NO: 170683 - DNA, 103 bp, Artificial Sequence
  Synthetic Polynucleotide
taatacgactcactataggggcttccccagcagcttcatatttgacagttaacagaggagaaactgtatgatatgaagcaacctggcggcagcgcaaaagatg

SEQ ID NO: 170684 - DNA, 103 bp, Artificial Sequence
  Synthetic Polynucleotide
taatacgactcactatagggggttttcacagcttccccagcagcttcataaacagaggagatatgaaatggctggggaaaacctggcggcagcgcaaaagatg

SEQ ID NO: 170685 - DNA, 103 bp, Artificial Sequence
  Synthetic Polynucleotide
taatacgactcactatagggtctttttgagggttttcacagcttccccagaacagaggagactggggatgctgtgaaaaaacctggcggcagcgcaaaagatg

SEQ ID NO: 170686 - DNA, 103 bp, Artificial Sequence
  Synthetic Polynucleotide
taatacgactcactataggggttggctgggtctttttgagggttttcacaaacagaggagatgtgaaatgcctcaaaaaaacctggcggcagcgcaaaagatg

SEQ ID NO: 170687 - DNA, 103 bp, Artificial Sequence
  Synthetic Polynucleotide
taatacgactcactataggggttaatgacagttggctgggtctttttgagaacagaggagactcaaaatgacccagccaaacctggcggcagcgcaaaagatg

SEQ ID NO: 170688 - DNA, 103 bp, Artificial Sequence
  Synthetic Polynucleotide
taatacgactcactatagggtcttcaagttgttaatgacagttggctgggaacagaggagacccagcatgctgtcattaaacctggcggcagcgcaaaagatg

SEQ ID NO: 170689 - DNA, 103 bp, Artificial Sequence
  Synthetic Polynucleotide
taatacgactcactatagggacagctcctttcttcaagttgttaatgacaaacagaggagatgtcatatgcaacttgaaaacctggcggcagcgcaaaagatg

SEQ ID NO: 170690 - DNA, 103 bp, Artificial Sequence
  Synthetic Polynucleotide
taatacgactcactatagggcacatcttcaacagctcctttcttcaagttaacagaggagaaacttgatgaaaggagctaacctggcggcagcgcaaaagatg

SEQ ID NO: 170691 - DNA, 103 bp, Artificial Sequence
  Synthetic Polynucleotide
taatacgactcactatagggttcttgaaatcacatcttcaacagctccttaacagaggagaaaggagatgttgaagatgaacctggcggcagcgcaaaagatg

SEQ ID NO: 170692 - DNA, 103 bp, Artificial Sequence
  Synthetic Polynucleotide
taatacgactcactatagggtgaatttcatttcttgaaatcacatcttcaaacagaggagatgaagaatggatttcaagaacctggcggcagcgcaaaagatg

SEQ ID NO: 170693 - DNA, 103 bp, Artificial Sequence
  Synthetic Polynucleotide
taatacgactcactatagggtacaggctcaaaacgaggtctcgcatggaaaacagaggagattccatatgagacctcgtaacctggcggcagcgcaaaagatg

SEQ ID NO: 170694 - DNA, 103 bp, Artificial Sequence
  Synthetic Polynucleotide
taatacgactcactatagggtgagcggccctgaatttcatttcttgaaataacagaggagaatttcaatgaatgaaattaacctggcggcagcgcaaaagatg

SEQ ID NO: 170695 - DNA, 103 bp, Artificial Sequence
  Synthetic Polynucleotide
taatacgactcactatagggcctcctctgctgagcggccctgaatttcataacagaggagaatgaaaatgagggccgctaacctggcggcagcgcaaaagatg

SEQ ID NO: 170696 - DNA, 103 bp, Artificial Sequence
  Synthetic Polynucleotide
taatacgactcactatagggtgtttgtaagcctcctctgctgagcggcccaacagaggagagggccgatgagcagaggaaacctggcggcagcgcaaaagatg

SEQ ID NO: 170697 - DNA, 103 bp, Artificial Sequence
  Synthetic Polynucleotide
taatacgactcactatagggtttgatttgctgtttgtaagcctcctctgcaacagaggagagcagagatggcttacaaaaacctggcggcagcgcaaaagatg

SEQ ID NO: 170698 - DNA, 103 bp, Artificial Sequence
  Synthetic Polynucleotide
taatacgactcactatagggtattatcttctttgatttgctgtttgtaagaacagaggagacttacaatgagcaaatcaaacctggcggcagcgcaaaagatg

SEQ ID NO: 170699 - DNA, 103 bp, Artificial Sequence
  Synthetic Polynucleotide
taatacgactcactatagggtgatttccaatattatcttctttgatttgcaacagaggagagcaaatatgagaagataaaacctggcggcagcgcaaaagatg

SEQ ID NO: 170700 - DNA, 103 bp, Artificial Sequence
  Synthetic Polynucleotide
taatacgactcactatagggtctcagcagctgatttccaatattatcttcaacagaggagagaagatatgattggaaataacctggcggcagcgcaaaagatg

SEQ ID NO: 170701 - DNA, 103 bp, Artificial Sequence
  Synthetic Polynucleotide
taatacgactcactatagggaacccatctttctcagcagctgatttccaaaacagaggagattggaaatgagctgctgaaacctggcggcagcgcaaaagatg

SEQ ID NO: 170702 - DNA, 103 bp, Artificial Sequence
  Synthetic Polynucleotide
taatacgactcactatagggccaccagtccaacccatctttctcagcagcaacagaggagagctgctatgaaagatgggaacctggcggcagcgcaaaagatg

SEQ ID NO: 170703 - DNA, 103 bp, Artificial Sequence
  Synthetic Polynucleotide
taatacgactcactatagggacctaaaccaccaccagtccaacccatcttaacagaggagaaagatgatgtggactggtaacctggcggcagcgcaaaagatg

SEQ ID NO: 170704 - DNA, 103 bp, Artificial Sequence
  Synthetic Polynucleotide
taatacgactcactatagggctacaaaatgtacaggctcaaaacgaggtcaacagaggagagacctcatgttgagcctgaacctggcggcagcgcaaaagatg

SEQ ID NO: 170705 - DNA, 103 bp, Artificial Sequence
  Synthetic Polynucleotide
taatacgactcactatagggcaccagatttacctaaaccaccaccagtccaacagaggagaggactgatggtggtttagaacctggcggcagcgcaaaagatg

SEQ ID NO: 170706 - DNA, 103 bp, Artificial Sequence
  Synthetic Polynucleotide
taatacgactcactatagggcgtatgccctcaccagatttacctaaaccaaacagaggagatggtttatgtaaatctggaacctggcggcagcgcaaaagatg

SEQ ID NO: 170707 - DNA, 103 bp, Artificial Sequence
  Synthetic Polynucleotide
taatacgactcactataggggataggctcccgtatgccctcaccagatttaacagaggagaaaatctatggagggcataaacctggcggcagcgcaaaagatg

SEQ ID NO: 170708 - DNA, 103 bp, Artificial Sequence
  Synthetic Polynucleotide
taatacgactcactatagggctttcactgagataggctcccgtatgccctaacagaggagaagggcaatggggagcctaaacctggcggcagcgcaaaagatg

SEQ ID NO: 170709 - DNA, 103 bp, Artificial Sequence
  Synthetic Polynucleotide
taatacgactcactatagggttatgctgctctttcactgagataggctccaacagaggagaggagccatgctcagtgaaaacctggcggcagcgcaaaagatg

SEQ ID NO: 170710 - DNA, 103 bp, Artificial Sequence
  Synthetic Polynucleotide
taatacgactcactatagggcccttcccgcttatgctgctctttcactgaaacagaggagatcagtgatggagcagcataacctggcggcagcgcaaaagatg

SEQ ID NO: 170711 - DNA, 103 bp, Artificial Sequence
  Synthetic Polynucleotide
taatacgactcactatagggccagaccaagcccttcccgcttatgctgctaacagaggagaagcagcatgagcgggaagaacctggcggcagcgcaaaagatg

SEQ ID NO: 170712 - DNA, 103 bp, Artificial Sequence
  Synthetic Polynucleotide
taatacgactcactatagggctctctacatccagaccaagcccttcccgcaacagaggagagcgggaatggcttggtctaacctggcggcagcgcaaaagatg

SEQ ID NO: 170713 - DNA, 103 bp, Artificial Sequence
  Synthetic Polynucleotide
taatacgactcactatagggtttattcaccctctctacatccagaccaagaacagaggagacttggtatggatgtagagaacctggcggcagcgcaaaagatg

SEQ ID NO: 170714 - DNA, 103 bp, Artificial Sequence
  Synthetic Polynucleotide
taatacgactcactatagggtcttggcaattttattcaccctctctacataacagaggagaatgtagatggggtgaataaacctggcggcagcgcaaaagatg

SEQ ID NO: 170715 - DNA, 103 bp, Artificial Sequence
  Synthetic Polynucleotide
taatacgactcactataggggaactactagctacaaaatgtacaggctcaaacagaggagatgagccatgacattttgtaacctggcggcagcgcaaaagatg

SEQ ID NO: 170716 - DNA, 103 bp, Artificial Sequence
  Synthetic Polynucleotide
taatacgactcactatagggtcaatatctctcttggcaattttattcaccaacagaggagaggtgaaatgaattgccaaaacctggcggcagcgcaaaagatg

SEQ ID NO: 170717 - DNA, 103 bp, Artificial Sequence
  Synthetic Polynucleotide
taatacgactcactataggggatgatctgttcaatatctctcttggcaataacagaggagaattgccatgagagatattaacctggcggcagcgcaaaagatg

SEQ ID NO: 170718 - DNA, 103 bp, Artificial Sequence
  Synthetic Polynucleotide
taatacgactcactatagggcgtagtttctgatgatctgttcaatatctcaacagaggagagagataatgaacagatcaaacctggcggcagcgcaaaagatg

SEQ ID NO: 170719 - DNA, 103 bp, Artificial Sequence
  Synthetic Polynucleotide
taatacgactcactatagggtcggagcgggcgtagtttctgatgatctgtaacagaggagaacagatatgcagaaactaaacctggcggcagcgcaaaagatg

SEQ ID NO: 170720 - DNA, 103 bp, Artificial Sequence
  Synthetic Polynucleotide
taatacgactcactatagggtgtgtggctctcggagcgggcgtagtttctaacagaggagaagaaacatggcccgctccaacctggcggcagcgcaaaagatg

SEQ ID NO: 170721 - DNA, 103 bp, Artificial Sequence
  Synthetic Polynucleotide
taatacgactcactatagggaagtcaaatctgtgtggctctcggagcgggaacagaggagacccgctatgagagccacaaacctggcggcagcgcaaaagatg

SEQ ID NO: 170722 - DNA, 103 bp, Artificial Sequence
  Synthetic Polynucleotide
taatacgactcactatagggtctctagagaaagtcaaatctgtgtggctcaacagaggagagagccaatgagatttgacaacctggcggcagcgcaaaagatg

SEQ ID NO: 170723 - DNA, 103 bp, Artificial Sequence
  Synthetic Polynucleotide
taatacgactcactatagggattagtcagctctctagagaaagtcaaatcaacagaggagagatttgatgttctctagaaacctggcggcagcgcaaaagatg

SEQ ID NO: 170724 - DNA, 103 bp, Artificial Sequence
  Synthetic Polynucleotide
taatacgactcactatagggtccgttcatcattagtcagctctctagagaaacagaggagatctctaatgagctgactaaacctggcggcagcgcaaaagatg

SEQ ID NO: 170725 - DNA, 103 bp, Artificial Sequence
  Synthetic Polynucleotide
taatacgactcactatagggtgtatttgcttccgttcatcattagtcagcaacagaggagagctgacatgtgatgaacgaacctggcggcagcgcaaaagatg

SEQ ID NO: 170726 - DNA, 103 bp, Artificial Sequence
  Synthetic Polynucleotide
taatacgactcactatagggttcatcttttgaactactagctacaaaatgaacagaggagacattttatggctagtagtaacctggcggcagcgcaaaagatg

SEQ ID NO: 170727 - DNA, 103 bp, Artificial Sequence
  Synthetic Polynucleotide
taatacgactcactatagggggcaatctgatgtatttgcttccgttcatcaacagaggagagatgaaatgaagcaaataaacctggcggcagcgcaaaagatg

SEQ ID NO: 170728 - DNA, 103 bp, Artificial Sequence
  Synthetic Polynucleotide
taatacgactcactatagggcatacttctgggcaatctgatgtatttgctaacagaggagaagcaaaatgatcagattgaacctggcggcagcgcaaaagatg

SEQ ID NO: 170729 - DNA, 103 bp, Artificial Sequence
  Synthetic Polynucleotide
taatacgactcactatagggctcttaagaccatacttctgggcaatctgaaacagaggagatcagatatgccagaagtaaacctggcggcagcgcaaaagatg

SEQ ID NO: 170730 - DNA, 103 bp, Artificial Sequence
  Synthetic Polynucleotide
taatacgactcactatagggatgagacttactcttaagaccatacttctgaacagaggagacagaagatgggtcttaagaacctggcggcagcgcaaaagatg

SEQ ID NO: 170731 - DNA, 103 bp, Artificial Sequence
  Synthetic Polynucleotide
taatacgactcactatagggggcccaccccatgagacttactcttaagacaacagaggagagtcttaatggtaagtctcaacctggcggcagcgcaaaagatg

SEQ ID NO: 170732 - DNA, 103 bp, Artificial Sequence
  Synthetic Polynucleotide
taatacgactcactatagggtacctatcatggcccaccccatgagacttaaacagaggagataagtcatgtggggtgggaacctggcggcagcgcaaaagatg

SEQ ID NO: 170733 - DNA, 103 bp, Artificial Sequence
  Synthetic Polynucleotide
taatacgactcactatagggtaccactaggtacctatcatggcccaccccaacagaggagaggggtgatgcatgataggaacctggcggcagcgcaaaagatg

SEQ ID NO: 170734 - DNA, 103 bp, Artificial Sequence
  Synthetic Polynucleotide
taatacgactcactatagggtttttctacctaccactaggtacctatcataacagaggagaatgataatgacctagtggaacctggcggcagcgcaaaagatg

SEQ ID NO: 170735 - DNA, 103 bp, Artificial Sequence
  Synthetic Polynucleotide
taatacgactcactatagggtccttccgtctttttctacctaccactaggaacagaggagacctagtatgaggtagaaaaacctggcggcagcgcaaaagatg

SEQ ID NO: 170736 - DNA, 103 bp, Artificial Sequence
  Synthetic Polynucleotide
taatacgactcactatagggtagtaggtcttccttccgtctttttctaccaacagaggagaggtagaatgagacggaagaacctggcggcagcgcaaaagatg

SEQ ID NO: 170737 - DNA, 103 bp, Artificial Sequence
  Synthetic Polynucleotide
taatacgactcactatagggcaatatcaataccttcagccatttggagaaaacagaggagattctccatgtggctgaagaacctggcggcagcgcaaaagatg

SEQ ID NO: 170738 - DNA, 103 bp, Artificial Sequence
  Synthetic Polynucleotide
taatacgactcactatagggcttcctgtctttcatcttttgaactactagaacagaggagactagtaatgcaaaagatgaacctggcggcagcgcaaaagatg

SEQ ID NO: 170739 - DNA, 103 bp, Artificial Sequence
  Synthetic Polynucleotide
taatacgactcactatagggtgagctgatctagtaggtcttccttccgtcaacagaggagagacggaatgaagacctacaacctggcggcagcgcaaaagatg

SEQ ID NO: 170740 - DNA, 103 bp, Artificial Sequence
  Synthetic Polynucleotide
taatacgactcactatagggccttcctgtttgagctgatctagtaggtctaacagaggagaagacctatgagatcagctaacctggcggcagcgcaaaagatg

SEQ ID NO: 170741 - DNA, 103 bp, Artificial Sequence
  Synthetic Polynucleotide
taatacgactcactataggggcccacttggccttcctgtttgagctgatcaacagaggagagatcagatgaaacaggaaaacctggcggcagcgcaaaagatg

SEQ ID NO: 170742 - DNA, 103 bp, Artificial Sequence
  Synthetic Polynucleotide
taatacgactcactataggggctcgtaatggcccacttggccttcctgttaacagaggagaaacaggatggccaagtggaacctggcggcagcgcaaaagatg

SEQ ID NO: 170743 - DNA, 103 bp, Artificial Sequence
  Synthetic Polynucleotide
taatacgactcactatagggggcataacaagctcgtaatggcccacttggaacagaggagaccaagtatgccattacgaaacctggcggcagcgcaaaagatg

SEQ ID NO: 170744 - DNA, 103 bp, Artificial Sequence
  Synthetic Polynucleotide
taatacgactcactatagggatttgcttgaggcataacaagctcgtaatgaacagaggagacattacatgcttgttatgaacctggcggcagcgcaaaagatg

SEQ ID NO: 170745 - DNA, 103 bp, Artificial Sequence
  Synthetic Polynucleotide
taatacgactcactatagggccataaggatcttcctgtctttcatcttttaacagaggagaaaaagaatgaagacaggaaacctggcggcagcgcaaaagatg

SEQ ID NO: 170746 - DNA, 103 bp, Artificial Sequence
  Synthetic Polynucleotide
taatacgactcactatagggtgtttgagggccataaggatcttcctgtctaacagaggagaagacagatggatccttataacctggcggcagcgcaaaagatg

SEQ ID NO: 170747 - DNA, 103 bp, Artificial Sequence
  Synthetic Polynucleotide
taatacgactcactatagggttacctcttttgtttgagggccataaggataacagaggagaatccttatggccctcaaaaacctggcggcagcgcaaaagatg

SEQ ID NO: 170748 - DNA, 103 bp, Artificial Sequence
  Synthetic Polynucleotide
taatacgactcactataggggtttgttcatttacctcttttgtttgagggaacagaggagaccctcaatgaaaagaggtaacctggcggcagcgcaaaagatg

SEQ ID NO: 170749 - DNA, 103 bp, Artificial Sequence
  Synthetic Polynucleotide
taatacgactcactatagggggcaaaatgtgtttgttcatttacctctttaacagaggagaaaagagatgaatgaacaaaacctggcggcagcgcaaaagatg

SEQ ID NO: 170750 - DNA, 103 bp, Artificial Sequence
  Synthetic Polynucleotide
taatacgactcactatagggttggcatgctggcaaaatgtgtttgttcataacagaggagaatgaacatgcacattttgaacctggcggcagcgcaaaagatg

SEQ ID NO: 170751 - DNA, 103 bp, Artificial Sequence
  Synthetic Polynucleotide
taatacgactcactatagggtagatgtctcttggcatgctggcaaaatgtaacagaggagaacatttatgcagcatgccaacctggcggcagcgcaaaagatg

SEQ ID NO: 170752 - DNA, 103 bp, Artificial Sequence
  Synthetic Polynucleotide
taatacgactcactatagggataatcttggtagatgtctcttggcatgctaacagaggagaagcatgatgagagacatcaacctggcggcagcgcaaaagatg

SEQ ID NO: 170753 - DNA, 103 bp, Artificial Sequence
  Synthetic Polynucleotide
taatacgactcactatagggagtcttgagtataatcttggtagatgtctcaacagaggagagagacaatgaccaagattaacctggcggcagcgcaaaagatg

SEQ ID NO: 170754 - DNA, 103 bp, Artificial Sequence
  Synthetic Polynucleotide
taatacgactcactatagggggcatctccccaatatcaataccttcagccaacagaggagaggctgaatgtattgatataacctggcggcagcgcaaaagatg

SEQ ID NO: 170755 - DNA, 103 bp, Artificial Sequence
  Synthetic Polynucleotide
taatacgactcactatagggatactgaaagagtcttgagtataatcttggaacagaggagaccaagaatgtactcaagaaacctggcggcagcgcaaaagatg

SEQ ID NO: 170756 - DNA, 103 bp, Artificial Sequence
  Synthetic Polynucleotide
taatacgactcactatagggcccatcttgtatactgaaagagtcttgagtaacagaggagaactcaaatgtctttcagtaacctggcggcagcgcaaaagatg

SEQ ID NO: 170757 - DNA, 103 bp, Artificial Sequence
  Synthetic Polynucleotide
taatacgactcactatagggactgagaattcccatcttgtatactgaaagaacagaggagactttcaatgtacaagatgaacctggcggcagcgcaaaagatg

SEQ ID NO: 170758 - DNA, 103 bp, Artificial Sequence
  Synthetic Polynucleotide
taatacgactcactataggggaatcacaatactgagaattcccatcttgtaacagaggagaacaagaatggaattctcaaacctggcggcagcgcaaaagatg

SEQ ID NO: 170759 - DNA, 103 bp, Artificial Sequence
  Synthetic Polynucleotide
taatacgactcactataggggaatcctgatgaatcacaatactgagaattaacagaggagaaattctatgtattgtgataacctggcggcagcgcaaaagatg

SEQ ID NO: 170760 - DNA, 103 bp, Artificial Sequence
  Synthetic Polynucleotide
taatacgactcactatagggttgtgagaatgaatcctgatgaatcacaataacagaggagaattgtgatgcatcaggataacctggcggcagcgcaaaagatg

SEQ ID NO: 170761 - DNA, 103 bp, Artificial Sequence
  Synthetic Polynucleotide
taatacgactcactatagggggctggtcttttgtgagaatgaatcctgataacagaggagaatcaggatgcattctcacaacctggcggcagcgcaaaagatg

SEQ ID NO: 170762 - DNA, 103 bp, Artificial Sequence
  Synthetic Polynucleotide
taatacgactcactatagggggctgttacaggctggtcttttgtgagaataacagaggagaattctcatgaaagaccagaacctggcggcagcgcaaaagatg

SEQ ID NO: 170763 - DNA, 103 bp, Artificial Sequence
  Synthetic Polynucleotide
taatacgactcactatagggaatacatgttggctgttacaggctggtcttaacagaggagaaagaccatgctgtaacagaacctggcggcagcgcaaaagatg

SEQ ID NO: 170764 - DNA, 103 bp, Artificial Sequence
  Synthetic Polynucleotide
taatacgactcactatagggccactgtcaaaatacatgttggctgttacaaacagaggagatgtaacatgcaacatgtaaacctggcggcagcgcaaaagatg

SEQ ID NO: 170765 - DNA, 103 bp, Artificial Sequence
  Synthetic Polynucleotide
taatacgactcactatagggatcatatgaaggcatctccccaatatcaataacagaggagaattgatatgggggagatgaacctggcggcagcgcaaaagatg

SEQ ID NO: 170766 - DNA, 103 bp, Artificial Sequence
  Synthetic Polynucleotide
taatacgactcactatagggggcagggttcccactgtcaaaatacatgttaacagaggagaaacatgatgtttgacagtaacctggcggcagcgcaaaagatg

SEQ ID NO: 170767 - DNA, 103 bp, Artificial Sequence
  Synthetic Polynucleotide
taatacgactcactatagggtggtgcttggggcagggttcccactgtcaaaacagaggagattgacaatgggaaccctgaacctggcggcagcgcaaaagatg

SEQ ID NO: 170768 - DNA, 103 bp, Artificial Sequence
  Synthetic Polynucleotide
taatacgactcactatagggtgctgtgatgtggtgcttggggcagggttcaacagaggagagaacccatgcccaagcacaacctggcggcagcgcaaaagatg

SEQ ID NO: 170769 - DNA, 103 bp, Artificial Sequence
  Synthetic Polynucleotide
taatacgactcactatagggagagtttgcctgctgtgatgtggtgcttggaacagaggagaccaagcatgacatcacagaacctggcggcagcgcaaaagatg

SEQ ID NO: 170770 - DNA, 103 bp, Artificial Sequence
  Synthetic Polynucleotide
taatacgactcactataggggagttgactgagagtttgcctgctgtgatgaacagaggagacatcacatgaggcaaactaacctggcggcagcgcaaaagatg

SEQ ID NO: 170771 - DNA, 103 bp, Artificial Sequence
  Synthetic Polynucleotide
taatacgactcactataggggaaggctcaggagttgactgagagtttgccaacagaggagaggcaaaatgtcagtcaacaacctggcggcagcgcaaaagatg

SEQ ID NO: 170772 - DNA, 103 bp, Artificial Sequence
  Synthetic Polynucleotide
taatacgactcactatagggctgtgatggtgaaggctcaggagttgactgaacagaggagacagtcaatgcctgagcctaacctggcggcagcgcaaaagatg

SEQ ID NO: 170773 - DNA, 103 bp, Artificial Sequence
  Synthetic Polynucleotide
taatacgactcactatagggcgggaaatgtctgtgatggtgaaggctcagaacagaggagactgagcatgcaccatcacaacctggcggcagcgcaaaagatg

SEQ ID NO: 170774 - DNA, 103 bp, Artificial Sequence
  Synthetic Polynucleotide
taatacgactcactatagggaccacagactcgggaaatgtctgtgatggtaacagaggagaaccatcatggacatttccaacctggcggcagcgcaaaagatg

SEQ ID NO: 170775 - DNA, 103 bp, Artificial Sequence
  Synthetic Polynucleotide
taatacgactcactatagggcttctcggctaccacagactcgggaaatgtaacagaggagaacatttatggagtctgtgaacctggcggcagcgcaaaagatg

SEQ ID NO: 170776 - DNA, 103 bp, Artificial Sequence
  Synthetic Polynucleotide
taatacgactcactatagggacagcaccagatcatatgaaggcatctcccaacagaggagagggagaatgcttcatatgaacctggcggcagcgcaaaagatg

SEQ ID NO: 170777 - DNA, 103 bp, Artificial Sequence
  Synthetic Polynucleotide
taatacgactcactatagggtaaaatactgcttctcggctaccacagactaacagaggagaagtctgatgtagccgagaaacctggcggcagcgcaaaagatg

SEQ ID NO: 170778 - DNA, 103 bp, Artificial Sequence
  Synthetic Polynucleotide
taatacgactcactatagggaatttttcaataaaatactgcttctcggctaacagaggagaagccgaatggcagtatttaacctggcggcagcgcaaaagatg

SEQ ID NO: 170779 - DNA, 103 bp, Artificial Sequence
  Synthetic Polynucleotide
taatacgactcactatagggtgtcgccgttaatttttcaataaaatactgaacagaggagacagtatatgattgaaaaaaacctggcggcagcgcaaaagatg

SEQ ID NO: 170780 - DNA, 103 bp, Artificial Sequence
  Synthetic Polynucleotide
taatacgactcactatagggtcttccagattgtcgccgttaatttttcaaaacagaggagattgaaaatgtaacggcgaaacctggcggcagcgcaaaagatg

SEQ ID NO: 170781 - DNA, 103 bp, Artificial Sequence
  Synthetic Polynucleotide
taatacgactcactatagggttagaaaggttcttccagattgtcgccgttaacagaggagaaacggcatgaatctggaaaacctggcggcagcgcaaaagatg

SEQ ID NO: 170782 - DNA, 103 bp, Artificial Sequence
  Synthetic Polynucleotide
taatacgactcactatagggcatttctggattagaaaggttcttccagataacagaggagaatctggatgaacctttctaacctggcggcagcgcaaaagatg

SEQ ID NO: 170783 - DNA, 103 bp, Artificial Sequence
  Synthetic Polynucleotide
taatacgactcactatagggatccagaagtcatttctggattagaaaggtaacagaggagaacctttatgatccagaaaaacctggcggcagcgcaaaagatg

SEQ ID NO: 170784 - DNA, 103 bp, Artificial Sequence
  Synthetic Polynucleotide
taatacgactcactatagggattttatcagatccagaagtcatttctggaaacagaggagatccagaatggacttctggaacctggcggcagcgcaaaagatg

SEQ ID NO: 170785 - DNA, 103 bp, Artificial Sequence
  Synthetic Polynucleotide
taatacgactcactatagggtgtataattaattttatcagatccagaagtaacagaggagaacttctatgtctgataaaaacctggcggcagcgcaaaagatg

SEQ ID NO: 170786 - DNA, 103 bp, Artificial Sequence
  Synthetic Polynucleotide
taatacgactcactatagggttaacatatatgtataattaattttatcagaacagaggagactgataatgttaattataaacctggcggcagcgcaaaagatg

SEQ ID NO: 170787 - DNA, 103 bp, Artificial Sequence
  Synthetic Polynucleotide
taatacgactcactataggggaaggtttggacagcaccagatcatatgaaaacagaggagattcataatgtctggtgctaacctggcggcagcgcaaaagatg

SEQ ID NO: 170788 - DNA, 103 bp, Artificial Sequence
  Synthetic Polynucleotide
taatacgactcactatagggatacaacgagttaacatatatgtataattaaacagaggagataattaatgatatatgttaacctggcggcagcgcaaaagatg

SEQ ID NO: 170789 - DNA, 103 bp, Artificial Sequence
  Synthetic Polynucleotide
taatacgactcactatagggacacgcctgaatacaacgagttaacatataaacagaggagatatatgatgactcgttgtaacctggcggcagcgcaaaagatg

SEQ ID NO: 170790 - DNA, 103 bp, Artificial Sequence
  Synthetic Polynucleotide
taatacgactcactataggggatttgtcttacacgcctgaatacaacgagaacagaggagactcgttatgttcaggcgtaacctggcggcagcgcaaaagatg

SEQ ID NO: 170791 - DNA, 103 bp, Artificial Sequence
  Synthetic Polynucleotide
taatacgactcactatagggatatactcaggatttgtcttacacgcctgaaacagaggagatcaggcatgtaagacaaaaacctggcggcagcgcaaaagatg

SEQ ID NO: 170792 - DNA, 103 bp, Artificial Sequence
  Synthetic Polynucleotide
taatacgactcactatagggaggagcatatatatactcaggatttgtcttaacagaggagaaagacaatgcctgagtataacctggcggcagcgcaaaagatg

SEQ ID NO: 170793 - DNA, 103 bp, Artificial Sequence
  Synthetic Polynucleotide
taatacgactcactatagggtttcctttaaaggagcatatatatactcagaacagaggagactgagtatgtatatgctcaacctggcggcagcgcaaaagatg

SEQ ID NO: 170794 - DNA, 103 bp, Artificial Sequence
  Synthetic Polynucleotide
taatacgactcactataggggcaggaggaatttcctttaaaggagcatataacagaggagaatatgcatgtttaaaggaaacctggcggcagcgcaaaagatg

SEQ ID NO: 170795 - DNA, 103 bp, Artificial Sequence
  Synthetic Polynucleotide
taatacgactcactatagggggggatgtcggcaggaggaatttcctttaaaacagaggagattaaagatgattcctcctaacctggcggcagcgcaaaagatg

SEQ ID NO: 170796 - DNA, 103 bp, Artificial Sequence
  Synthetic Polynucleotide
taatacgactcactatagggttttatttttggggatgtcggcaggaggaaaacagaggagattcctcatgccgacatccaacctggcggcagcgcaaaagatg

SEQ ID NO: 170797 - DNA, 103 bp, Artificial Sequence
  Synthetic Polynucleotide
taatacgactcactataggggttagaagttttttatttttggggatgtcgaacagaggagacgacatatgcaaaaataaaacctggcggcagcgcaaaagatg

SEQ ID NO: 170798 - DNA, 103 bp, Artificial Sequence
  Synthetic Polynucleotide
taatacgactcactatagggttgacctttggaaggtttggacagcaccagaacagaggagactggtgatgtccaaacctaacctggcggcagcgcaaaagatg

SEQ ID NO: 170799 - DNA, 103 bp, Artificial Sequence
  Synthetic Polynucleotide
taatacgactcactatagggatagccatcagttagaagttttttatttttaacagaggagaaaaaatatgaaacttctaaacctggcggcagcgcaaaagatg

SEQ ID NO: 170800 - DNA, 103 bp, Artificial Sequence
  Synthetic Polynucleotide
taatacgactcactatagggcttcacaagcatagccatcagttagaagttaacagaggagaaacttcatgctgatggctaacctggcggcagcgcaaaagatg

SEQ ID NO: 170801 - DNA, 103 bp, Artificial Sequence
  Synthetic Polynucleotide
taatacgactcactatagggtggcatctaacttcacaagcatagccatcaaacagaggagatgatggatgtgcttgtgaaacctggcggcagcgcaaaagatg

SEQ ID NO: 170802 - DNA, 103 bp, Artificial Sequence
  Synthetic Polynucleotide
taatacgactcactataggggtagatattttggcatctaacttcacaagcaacagaggagagcttgtatggttagatgcaacctggcggcagcgcaaaagatg

SEQ ID NO: 170803 - DNA, 103 bp, Artificial Sequence
  Synthetic Polynucleotide
taatacgactcactatagggctgtagttaagtagatattttggcatctaaaacagaggagattagatatgaaaatatctaacctggcggcagcgcaaaagatg

SEQ ID NO: 170804 - DNA, 103 bp, Artificial Sequence
  Synthetic Polynucleotide
taatacgactcactatagggccagcataacctgtagttaagtagatatttaacagaggagaaaatatatgcttaactacaacctggcggcagcgcaaaagatg

SEQ ID NO: 170805 - DNA, 103 bp, Artificial Sequence
  Synthetic Polynucleotide
taatacgactcactatagggattcttgctgccagcataacctgtagttaaaacagaggagattaactatgggttatgctaacctggcggcagcgcaaaagatg

SEQ ID NO: 170806 - DNA, 103 bp, Artificial Sequence
  Synthetic Polynucleotide
taatacgactcactatagggccctggacccattcttgctgccagcataacaacagaggagagttatgatggcagcaagaaacctggcggcagcgcaaaagatg

SEQ ID NO: 170807 - DNA, 103 bp, Artificial Sequence
  Synthetic Polynucleotide
taatacgactcactataggggtagctcgatccctggacccattcttgctgaacagaggagacagcaaatgtgggtccagaacctggcggcagcgcaaaagatg

SEQ ID NO: 170808 - DNA, 103 bp, Artificial Sequence
  Synthetic Polynucleotide
taatacgactcactatagggagctagctctgtagctcgatccctggacccaacagaggagagggtccatggatcgagctaacctggcggcagcgcaaaagatg

SEQ ID NO: 170809 - DNA, 103 bp, Artificial Sequence
  Synthetic Polynucleotide
taatacgactcactatagggggtggcgtttttgacctttggaaggtttggaacagaggagaccaaacatgccaaaggtcaacctggcggcagcgcaaaagatg

SEQ ID NO: 170810 - DNA, 103 bp, Artificial Sequence
  Synthetic Polynucleotide
taatacgactcactatagggagagttttacagctagctctgtagctcgataacagaggagaatcgagatgcagagctagaacctggcggcagcgcaaaagatg

SEQ ID NO: 170811 - DNA, 103 bp, Artificial Sequence
  Synthetic Polynucleotide
taatacgactcactatagggcgtttctgcaagagttttacagctagctctaacagaggagaagagctatgtgtaaaactaacctggcggcagcgcaaaagatg

SEQ ID NO: 170812 - DNA, 103 bp, Artificial Sequence
  Synthetic Polynucleotide
taatacgactcactatagggaacttcaatacgtttctgcaagagttttacaacagaggagagtaaaaatgttgcagaaaaacctggcggcagcgcaaaagatg

SEQ ID NO: 170813 - DNA, 103 bp, Artificial Sequence
  Synthetic Polynucleotide
taatacgactcactatagggggacaactctaacttcaatacgtttctgcaaacagaggagatgcagaatggtattgaagaacctggcggcagcgcaaaagatg

SEQ ID NO: 170814 - DNA, 103 bp, Artificial Sequence
  Synthetic Polynucleotide
taatacgactcactatagggaatttccgccggacaactctaacttcaataaacagaggagatattgaatgtagagttgtaacctggcggcagcgcaaaagatg

SEQ ID NO: 170815 - DNA, 103 bp, Artificial Sequence
  Synthetic Polynucleotide
taatacgactcactatagggtgtatgcttgaatttccgccggacaactctaacagaggagaagagttatgcggcggaaaaacctggcggcagcgcaaaagatg

SEQ ID NO: 170816 - DNA, 103 bp, Artificial Sequence
  Synthetic Polynucleotide
taatacgactcactatagggcctctccaaatgtatgcttgaatttccgccaacagaggagaggcggaatgtcaagcataaacctggcggcagcgcaaaagatg

SEQ ID NO: 170817 - DNA, 103 bp, Artificial Sequence
  Synthetic Polynucleotide
taatacgactcactatagggaccacgaggtcctctccaaatgtatgcttgaacagaggagacaagcaatgatttggagaaacctggcggcagcgcaaaagatg

SEQ ID NO: 170818 - DNA, 103 bp, Artificial Sequence
  Synthetic Polynucleotide
taatacgactcactatagggaatctgacacaccacgaggtcctctccaaaaacagaggagatttggaatggacctcgtgaacctggcggcagcgcaaaagatg

SEQ ID NO: 170819 - DNA, 103 bp, Artificial Sequence
  Synthetic Polynucleotide
taatacgactcactatagggaggacatgccaatctgacacaccacgaggtaacagaggagaacctcgatgtgtgtcagaaacctggcggcagcgcaaaagatg

SEQ ID NO: 170820 - DNA, 103 bp, Artificial Sequence
  Synthetic Polynucleotide
taatacgactcactatagggcatgttgagaggtggcgtttttgacctttgaacagaggagacaaaggatgaaaacgccaaacctggcggcagcgcaaaagatg

SEQ ID NO: 170821 - DNA, 103 bp, Artificial Sequence
  Synthetic Polynucleotide
taatacgactcactatagggaattcataggaggacatgccaatctgacacaacagaggagagtgtcaatgtggcatgtcaacctggcggcagcgcaaaagatg

SEQ ID NO: 170822 - DNA, 103 bp, Artificial Sequence
  Synthetic Polynucleotide
taatacgactcactatagggagctggaggaaattcataggaggacatgccaacagaggagaggcatgatgtcctatgaaaacctggcggcagcgcaaaagatg

SEQ ID NO: 170823 - DNA, 103 bp, Artificial Sequence
  Synthetic Polynucleotide
taatacgactcactataggggtggcttcagagctggaggaaattcataggaacagaggagacctatgatgttcctccagaacctggcggcagcgcaaaagatg

SEQ ID NO: 170824 - DNA, 103 bp, Artificial Sequence
  Synthetic Polynucleotide
taatacgactcactatagggaggtcttctggtggcttcagagctggaggaaacagaggagatcctccatgtctgaagccaacctggcggcagcgcaaaagatg

SEQ ID NO: 170825 - DNA, 103 bp, Artificial Sequence
  Synthetic Polynucleotide
taatacgactcactatagggcagcaccaccaggtcttctggtggcttcagaacagaggagactgaagatgccagaagacaacctggcggcagcgcaaaagatg

SEQ ID NO: 170826 - DNA, 103 bp, Artificial Sequence
  Synthetic Polynucleotide
taatacgactcactatagggcatctttacccagcaccaccaggtcttctgaacagaggagacagaagatgtggtggtgcaacctggcggcagcgcaaaagatg

SEQ ID NO: 170827 - DNA, 103 bp, Artificial Sequence
  Synthetic Polynucleotide
taatacgactcactatagggtgcccggaagcatctttacccagcaccaccaacagaggagaggtggtatggggtaaagaaacctggcggcagcgcaaaagatg

SEQ ID NO: 170828 - DNA, 103 bp, Artificial Sequence
  Synthetic Polynucleotide
taatacgactcactatagggaaaaattggctgcccggaagcatctttaccaacagaggagaggtaaaatggcttccgggaacctggcggcagcgcaaaagatg

SEQ ID NO: 170829 - DNA, 103 bp, Artificial Sequence
  Synthetic Polynucleotide
taatacgactcactatagggcagaagcattaaaaattggctgcccggaagaacagaggagacttccgatgagccaatttaacctggcggcagcgcaaaagatg

SEQ ID NO: 170830 - DNA, 103 bp, Artificial Sequence
  Synthetic Polynucleotide
taatacgactcactatagggcagtgtttggcagaagcattaaaaattggcaacagaggagagccaatatgtaatgcttcaacctggcggcagcgcaaaagatg

SEQ ID NO: 170831 - DNA, 103 bp, Artificial Sequence
  Synthetic Polynucleotide
taatacgactcactatagggccgcgccttcccactgcctccggaccacataacagaggagaatgtggatgggaggcagtaacctggcggcagcgcaaaagatg

SEQ ID NO: 170832 - DNA, 103 bp, Artificial Sequence
  Synthetic Polynucleotide
taatacgactcactatagggcggagtcgtgtgctttggactcatcgacataacagaggagaatgtcgatgagtccaaagaacctggcggcagcgcaaaagatg

SEQ ID NO: 170833 - DNA, 103 bp, Artificial Sequence
  Synthetic Polynucleotide
taatacgactcactataggggccaccgctgcccacggagatggccgctgcaacagaggagagcagcgatgatctccgtgaacctggcggcagcgcaaaagatg

SEQ ID NO: 170834 - DNA, 103 bp, Artificial Sequence
  Synthetic Polynucleotide
taatacgactcactatagggcaaggccggcgccaccgctgcccacggagaaacagaggagatctccgatggcagcggtgaacctggcggcagcgcaaaagatg

SEQ ID NO: 170835 - DNA, 103 bp, Artificial Sequence
  Synthetic Polynucleotide
taatacgactcactataggggggtgtgcgccaaggccggcgccaccgctgaacagaggagacagcggatgcgccggcctaacctggcggcagcgcaaaagatg

SEQ ID NO: 170836 - DNA, 103 bp, Artificial Sequence
  Synthetic Polynucleotide
taatacgactcactatagggctggtggcccgggtgtgcgccaaggccggcaacagaggagagccggcatgggcgcacacaacctggcggcagcgcaaaagatg

SEQ ID NO: 170837 - DNA, 103 bp, Artificial Sequence
  Synthetic Polynucleotide
taatacgactcactatagggcgctgcctggctggtggcccgggtgtgcgcaacagaggagagcgcacatgcgggccaccaacctggcggcagcgcaaaagatg

SEQ ID NO: 170838 - DNA, 103 bp, Artificial Sequence
  Synthetic Polynucleotide
taatacgactcactataggggactggcctgcgctgcctggctggtggcccaacagaggagagggccaatggccaggcagaacctggcggcagcgcaaaagatg

SEQ ID NO: 170839 - DNA, 103 bp, Artificial Sequence
  Synthetic Polynucleotide
taatacgactcactatagggcaggtccggagactggcctgcgctgcctggaacagaggagaccaggcatggcaggccagaacctggcggcagcgcaaaagatg

SEQ ID NO: 170840 - DNA, 103 bp, Artificial Sequence
  Synthetic Polynucleotide
taatacgactcactatagggcgtggtgcgccaggtccggagactggcctgaacagaggagacaggccatgctccggaccaacctggcggcagcgcaaaagatg

SEQ ID NO: 170841 - DNA, 103 bp, Artificial Sequence
  Synthetic Polynucleotide
taatacgactcactataggggggctggcggcgtggtgcgccaggtccggaaacagaggagatccggaatgggcgcaccaaacctggcggcagcgcaaaagatg

SEQ ID NO: 170842 - DNA, 103 bp, Artificial Sequence
  Synthetic Polynucleotide
taatacgactcactatagggcagcgccgcggggctggcggcgtggtgcgcaacagaggagagcgcacatggccgccagcaacctggcggcagcgcaaaagatg

SEQ ID NO: 170843 - DNA, 103 bp, Artificial Sequence
  Synthetic Polynucleotide
taatacgactcactatagggacactgagaacggagtcgtgtgctttggacaacagaggagagtccaaatgacacgactcaacctggcggcagcgcaaaagatg

SEQ ID NO: 170844 - DNA, 103 bp, Artificial Sequence
  Synthetic Polynucleotide
taatacgactcactatagggcctggccctgcagcgccgcggggctggcggaacagaggagaccgccaatgccgcggcgcaacctggcggcagcgcaaaagatg

SEQ ID NO: 170845 - DNA, 103 bp, Artificial Sequence
  Synthetic Polynucleotide
taatacgactcactatagggaggctggatacctggccctgcagcgccgcgaacagaggagacgcggcatggcagggccaaacctggcggcagcgcaaaagatg

SEQ ID NO: 170846 - DNA, 103 bp, Artificial Sequence
  Synthetic Polynucleotide
taatacgactcactatagggcaggtgggacaggctggatacctggccctgaacagaggagacagggcatggtatccagcaacctggcggcagcgcaaaagatg

SEQ ID NO: 170847 - DNA, 103 bp, Artificial Sequence
  Synthetic Polynucleotide
taatacgactcactatagggccgaggagttcaggtgggacaggctggataaacagaggagatatccaatgtgtcccaccaacctggcggcagcgcaaaagatg

SEQ ID NO: 170848 - DNA, 103 bp, Artificial Sequence
  Synthetic Polynucleotide
taatacgactcactatagggtagtccgagcccgaggagttcaggtgggacaacagaggagagtcccaatggaactcctcaacctggcggcagcgcaaaagatg

SEQ ID NO: 170849 - DNA, 103 bp, Artificial Sequence
  Synthetic Polynucleotide
taatacgactcactatagggcatggtgccgtagtccgagcccgaggagttaacagaggagaaactccatgggctcggacaacctggcggcagcgcaaaagatg

SEQ ID NO: 170850 - DNA, 103 bp, Artificial Sequence
  Synthetic Polynucleotide
taatacgactcactatagggtggagcaggacatggtgccgtagtccgagcaacagaggagagctcggatgacggcaccaaacctggcggcagcgcaaaagatg

SEQ ID NO: 170851 - DNA, 103 bp, Artificial Sequence
  Synthetic Polynucleotide
taatacgactcactatagggtatagcaaggtggagcaggacatggtgccgaacagaggagacggcacatggtcctgctcaacctggcggcagcgcaaaagatg

SEQ ID NO: 170852 - DNA, 103 bp, Artificial Sequence
  Synthetic Polynucleotide
taatacgactcactatagggggtccgaccgtatagcaaggtggagcaggaaacagaggagatcctgcatgaccttgctaaacctggcggcagcgcaaaagatg

SEQ ID NO: 170853 - DNA, 103 bp, Artificial Sequence
  Synthetic Polynucleotide
taatacgactcactatagggaagatgtcagacactgagaacggagtcgtgaacagaggagacacgacatggttctcagtaacctggcggcagcgcaaaagatg

SEQ ID NO: 170854 - DNA, 103 bp, Artificial Sequence
  Synthetic Polynucleotide
taatacgactcactatagggcaggggactcaagatgtcagacactgagaaaacagaggagattctcaatgtctgacatcaacctggcggcagcgcaaaagatg

SEQ ID NO: 170855 - DNA, 103 bp, Artificial Sequence
  Synthetic Polynucleotide
taatacgactcactatagggagctttcctccaggggactcaagatgtcagaacagaggagactgacaatgtgagtccccaacctggcggcagcgcaaaagatg

SEQ ID NO: 170856 - DNA, 103 bp, Artificial Sequence
  Synthetic Polynucleotide
taatacgactcactatagggactttcttgtagctttcctccaggggactcaacagaggagagagtccatgggaggaaagaacctggcggcagcgcaaaagatg

SEQ ID NO: 170857 - DNA, 103 bp, Artificial Sequence
  Synthetic Polynucleotide
taatacgactcactatagggctccatgcccactttcttgtagctttcctcaacagaggagagaggaaatgtacaagaaaaacctggcggcagcgcaaaagatg

SEQ ID NO: 170858 - DNA, 103 bp, Artificial Sequence
  Synthetic Polynucleotide
taatacgactcactatagggggccgccgccctccatgcccactttcttgtaacagaggagaacaagaatgtgggcatggaacctggcggcagcgcaaaagatg

SEQ ID NO: 170859 - DNA, 103 bp, Artificial Sequence
  Synthetic Polynucleotide
taatacgactcactatagggggagccccgaggccgccgccctccatgcccaacagaggagagggcatatggggcggcggaacctggcggcagcgcaaaagatg

SEQ ID NO: 170860 - DNA, 103 bp, Artificial Sequence
  Synthetic Polynucleotide
taatacgactcactatagggcgccgccagcggagccccgaggccgccgccaacagaggagaggcggcatgctcggggctaacctggcggcagcgcaaaagatg

SEQ ID NO: 170861 - DNA, 103 bp, Artificial Sequence
  Synthetic Polynucleotide
taatacgactcactatagggcctcccagccccgcgccttcccactgcctcaacagaggagagaggcaatgggaaggcgcaacctggcggcagcgcaaaagatg

SEQ ID NO: 170862 - DNA, 103 bp, Artificial Sequence
  Synthetic Polynucleotide
taatacgactcactatagggcctgcctgtacgccgccagcggagccccgaaacagaggagatcggggatgcgctggcggaacctggcggcagcgcaaaagatg

SEQ ID NO: 170863 - DNA, 103 bp, Artificial Sequence
  Synthetic Polynucleotide
taatacgactcactataggggccgcctggccctgcctgtacgccgccagcaacagaggagagctggcatggtacaggcaaacctggcggcagcgcaaaagatg

SEQ ID NO: 170864 - DNA, 103 bp, Artificial Sequence
  Synthetic Polynucleotide
taatacgactcactatagggtgttggcggtgccgcctggccctgcctgtaaacagaggagatacaggatgggccaggcgaacctggcggcagcgcaaaagatg

SEQ ID NO: 170865 - DNA, 103 bp, Artificial Sequence
  Synthetic Polynucleotide
taatacgactcactataggggcatggccgctgttggcggtgccgcctggcaacagaggagagccaggatgcaccgccaaaacctggcggcagcgcaaaagatg

SEQ ID NO: 170866 - DNA, 103 bp, Artificial Sequence
  Synthetic Polynucleotide
taatacgactcactataggggcgtgctgctgcatggccgctgttggcggtaacagaggagaaccgccatgagcggccataacctggcggcagcgcaaaagatg

SEQ ID NO: 170867 - DNA, 103 bp, Artificial Sequence
  Synthetic Polynucleotide
taatacgactcactataggggtgccccacggcgtgctgctgcatggccgcaacagaggagagcggccatgcagcagcacaacctggcggcagcgcaaaagatg

SEQ ID NO: 170868 - DNA, 103 bp, Artificial Sequence
  Synthetic Polynucleotide
taatacgactcactatagggcggcgccgtggtgccccacggcgtgctgctaacagaggagaagcagcatgccgtggggcaacctggcggcagcgcaaaagatg

SEQ ID NO: 170869 - DNA, 103 bp, Artificial Sequence
  Synthetic Polynucleotide
taatacgactcactataggggcggcggtgacggcgccgtggtgccccacgaacagaggagacgtgggatgccacggcgcaacctggcggcagcgcaaaagatg

SEQ ID NO: 170870 - DNA, 103 bp, Artificial Sequence
  Synthetic Polynucleotide
taatacgactcactatagggcatgtggtaggcggcggtgacggcgccgtgaacagaggagacacggcatggtcaccgccaacctggcggcagcgcaaaagatg

SEQ ID NO: 170871 - DNA, 103 bp, Artificial Sequence
  Synthetic Polynucleotide
taatacgactcactatagggccgccgccgtcatgtggtaggcggcggtgaaacagaggagatcaccgatgcctaccacaaacctggcggcagcgcaaaagatg

SEQ ID NO: 170872 - DNA, 103 bp, Artificial Sequence
  Synthetic Polynucleotide
taatacgactcactatagggcccgccgcggcctcccagccccgcgccttcaacagaggagagaaggcatggggctgggaaacctggcggcagcgcaaaagatg

SEQ ID NO: 170873 - DNA, 103 bp, Artificial Sequence
  Synthetic Polynucleotide
taatacgactcactatagggtggggcacccccgccgccgtcatgtggtagaacagaggagactaccaatggacggcggcaacctggcggcagcgcaaaagatg

SEQ ID NO: 170874 - DNA, 103 bp, Artificial Sequence
  Synthetic Polynucleotide
taatacgactcactataggggtgcgagagctggggcacccccgccgccgtaacagaggagaacggcgatgggggtgcccaacctggcggcagcgcaaaagatg

SEQ ID NO: 170875 - DNA, 103 bp, Artificial Sequence
  Synthetic Polynucleotide
taatacgactcactatagggccacggcggagtgcgagagctggggcacccaacagaggagagggtgcatgagctctcgcaacctggcggcagcgcaaaagatg

SEQ ID NO: 170876 - DNA, 103 bp, Artificial Sequence
  Synthetic Polynucleotide
taatacgactcactatagggcagtagccccccacggcggagtgcgagagcaacagaggagagctctcatgctccgccgtaacctggcggcagcgcaaaagatg

SEQ ID NO: 170877 - DNA, 103 bp, Artificial Sequence
  Synthetic Polynucleotide
taatacgactcactataggggttgccgttgcagtagccccccacggcggaaacagaggagatccgccatggggggctacaacctggcggcagcgcaaaagatg

SEQ ID NO: 170878 - DNA, 103 bp, Artificial Sequence
  Synthetic Polynucleotide
taatacgactcactatagggtgttgcccaggttgccgttgcagtagccccaacagaggagaggggctatggcaacggcaaacctggcggcagcgcaaaagatg

SEQ ID NO: 170879 - DNA, 103 bp, Artificial Sequence
  Synthetic Polynucleotide
taatacgactcactatagggagctcgctcatgttgcccaggttgccgttgaacagaggagacaacggatgcctgggcaaaacctggcggcagcgcaaaagatg

SEQ ID NO: 170880 - DNA, 103 bp, Artificial Sequence
  Synthetic Polynucleotide
taatacgactcactataggggtacggcggcagctcgctcatgttgcccagaacagaggagactgggcatgatgagcgagaacctggcggcagcgcaaaagatg

SEQ ID NO: 170881 - DNA, 103 bp, Artificial Sequence
  Synthetic Polynucleotide
taatacgactcactatagggtggtgtcctggtacggcggcagctcgctcaaacagaggagatgagcgatgtgccgccgtaacctggcggcagcgcaaaagatg

SEQ ID NO: 170882 - DNA, 103 bp, Artificial Sequence
  Synthetic Polynucleotide
taatacgactcactatagggctgttcctcatggtgtcctggtacggcggcaacagaggagagccgccatgccaggacacaacctggcggcagcgcaaaagatg

SEQ ID NO: 170883 - DNA, 103 bp, Artificial Sequence
  Synthetic Polynucleotide
taatacgactcactataggggctcctccctcccgccgcggcctcccagccaacagaggagaggctggatggccgcggcgaacctggcggcagcgcaaaagatg

SEQ ID NO: 170884 - DNA, 103 bp, Artificial Sequence
  Synthetic Polynucleotide
taatacgactcactataggggccagaggcgctgttcctcatggtgtcctgaacagaggagacaggacatgatgaggaacaacctggcggcagcgcaaaagatg

SEQ ID NO: 170885 - DNA, 103 bp, Artificial Sequence
  Synthetic Polynucleotide
taatacgactcactatagggaccatccggggccagaggcgctgttcctcaaacagaggagatgaggaatggcgcctctgaacctggcggcagcgcaaaagatg

SEQ ID NO: 170886 - DNA, 103 bp, Artificial Sequence
  Synthetic Polynucleotide
taatacgactcactatagggttggcgccgtaccatccggggccagaggcgaacagaggagacgcctcatgccccggatgaacctggcggcagcgcaaaagatg

SEQ ID NO: 170887 - DNA, 103 bp, Artificial Sequence
  Synthetic Polynucleotide
taatacgactcactatagggcgggtctgggttggcgccgtaccatccgggaacagaggagacccggaatgtacggcgccaacctggcggcagcgcaaaagatg

SEQ ID NO: 170888 - DNA, 103 bp, Artificial Sequence
  Synthetic Polynucleotide
taatacgactcactatagggcggggaagcgcgggtctgggttggcgccgtaacagaggagaacggcgatgacccagaccaacctggcggcagcgcaaaagatg

SEQ ID NO: 170889 - DNA, 103 bp, Artificial Sequence
  Synthetic Polynucleotide
taatacgactcactatagggcgggagatggcggggaagcgcgggtctgggaacagaggagacccagaatggcgcttcccaacctggcggcagcgcaaaagatg

SEQ ID NO: 170890 - DNA, 103 bp, Artificial Sequence
  Synthetic Polynucleotide
taatacgactcactataggggcccatgaagcgggagatggcggggaagcgaacagaggagacgcttcatggccatctccaacctggcggcagcgcaaaagatg

SEQ ID NO: 170891 - DNA, 103 bp, Artificial Sequence
  Synthetic Polynucleotide
taatacgactcactatagggcgctcgccgggcccatgaagcgggagatggaacagaggagaccatctatggcttcatggaacctggcggcagcgcaaaagatg

SEQ ID NO: 170892 - DNA, 103 bp, Artificial Sequence
  Synthetic Polynucleotide
taatacgactcactatagggatgttcatgccgctcgccgggcccatgaagaacagaggagacttcatatgcccggcgagaacctggcggcagcgcaaaagatg

SEQ ID NO: 170893 - DNA, 103 bp, Artificial Sequence
  Synthetic Polynucleotide
taatacgactcactatagggcatgccgctcatgttcatgccgctcgccggaacagaggagaccggcgatgggcatgaacaacctggcggcagcgcaaaagatg

SEQ ID NO: 170894 - DNA, 103 bp, Artificial Sequence
  Synthetic Polynucleotide
taatacgactcactatagggtgccggggctgctcctccctcccgccgcggaacagaggagaccgcggatggagggaggaaacctggcggcagcgcaaaagatg

SEQ ID NO: 170895 - DNA, 103 bp, Artificial Sequence
  Synthetic Polynucleotide
taatacgactcactatagggccaggccgcccatgccgctcatgttcatgcaacagaggagagcatgaatgtgagcggcaaacctggcggcagcgcaaaagatg

SEQ ID NO: 170896 - DNA, 103 bp, Artificial Sequence
  Synthetic Polynucleotide
taatacgactcactatagggcccagcgagcccaggccgcccatgccgctcaacagaggagagagcggatggggcggcctaacctggcggcagcgcaaaagatg

SEQ ID NO: 170897 - DNA, 103 bp, Artificial Sequence
  Synthetic Polynucleotide
taatacgactcactataggggctcacgtcccccagcgagcccaggccgccaacagaggagaggcggcatgggctcgctgaacctggcggcagcgcaaaagatg

SEQ ID NO: 170898 - DNA, 103 bp, Artificial Sequence
  Synthetic Polynucleotide
taatacgactcactatagggccatgttcttgctcacgtcccccagcgagcaacagaggagagctcgcatggggacgtgaaacctggcggcagcgcaaaagatg

SEQ ID NO: 170899 - DNA, 103 bp, Artificial Sequence
  Synthetic Polynucleotide
taatacgactcactatagggggcagcggggccatgttcttgctcacgtccaacagaggagaggacgtatgcaagaacataacctggcggcagcgcaaaagatg

SEQ ID NO: 170900 - DNA, 103 bp, Artificial Sequence
  Synthetic Polynucleotide
taatacgactcactatagggcggcgcgcttggcagcggggccatgttcttaacagaggagaaagaacatggccccgctgaacctggcggcagcgcaaaagatg

SEQ ID NO: 170901 - DNA, 103 bp, Artificial Sequence
  Synthetic Polynucleotide
taatacgactcactataggggcttcctgcgcggcgcgcttggcagcggggaacagaggagaccccgcatgcaagcgcgcaacctggcggcagcgcaaaagatg

SEQ ID NO: 170902 - DNA, 103 bp, Artificial Sequence
  Synthetic Polynucleotide
taatacgactcactatagggagcacccggcgcttcctgcgcggcgcgcttaacagaggagaaagcgcatggcgcaggaaaacctggcggcagcgcaaaagatg

SEQ ID NO: 170903 - DNA, 103 bp, Artificial Sequence
  Synthetic Polynucleotide
taatacgactcactatagggctgcgagaagagcacccggcgcttcctgcgaacagaggagacgcaggatgcgccgggtgaacctggcggcagcgcaaaagatg

SEQ ID NO: 170904 - DNA, 103 bp, Artificial Sequence
  Synthetic Polynucleotide
taatacgactcactatagggacacctgcgcctgcgagaagagcacccggcaacagaggagagccgggatgtcttctcgcaacctggcggcagcgcaaaagatg

SEQ ID NO: 170905 - DNA, 103 bp, Artificial Sequence
  Synthetic Polynucleotide
taatacgactcactatagggcggctgagcctgccggggctgctcctccctaacagaggagaagggagatgcagccccggaacctggcggcagcgcaaaagatg

SEQ ID NO: 170906 - DNA, 103 bp, Artificial Sequence
  Synthetic Polynucleotide
taatacgactcactatagggtccagctcgtacacctgcgcctgcgagaagaacagaggagacttctcatgggcgcaggtaacctggcggcagcgcaaaagatg

SEQ ID NO: 170907 - DNA, 103 bp, Artificial Sequence
  Synthetic Polynucleotide
taatacgactcactataggggaagcgtcgctccagctcgtacacctgcgcaacagaggagagcgcagatgtacgagctgaacctggcggcagcgcaaaagatg

SEQ ID NO: 170908 - DNA, 103 bp, Artificial Sequence
  Synthetic Polynucleotide
taatacgactcactatagggtctgttgcttgaagcgtcgctccagctcgtaacagaggagaacgagcatgagcgacgctaacctggcggcagcgcaaaagatg

SEQ ID NO: 170909 - DNA, 103 bp, Artificial Sequence
  Synthetic Polynucleotide
taatacgactcactataggggacaggtacttctgttgcttgaagcgtcgcaacagaggagagcgacgatgcaagcaacaaacctggcggcagcgcaaaagatg

SEQ ID NO: 170910 - DNA, 103 bp, Artificial Sequence
  Synthetic Polynucleotide
taatacgactcactatagggctccggcgccgacaggtacttctgttgcttaacagaggagaaagcaaatgaagtacctgaacctggcggcagcgcaaaagatg

SEQ ID NO: 170911 - DNA, 103 bp, Artificial Sequence
  Synthetic Polynucleotide
taatacgactcactatagggggtgctcgcgctccggcgccgacaggtactaacagaggagaagtaccatgcggcgccggaacctggcggcagcgcaaaagatg

SEQ ID NO: 170912 - DNA, 103 bp, Artificial Sequence
  Synthetic Polynucleotide
taatacgactcactatagggatgctggccaggtgctcgcgctccggcgccaacagaggagaggcgccatggcgcgagcaaacctggcggcagcgcaaaagatg

SEQ ID NO: 170913 - DNA, 103 bp, Artificial Sequence
  Synthetic Polynucleotide
taatacgactcactatagggcaggtggatcatgctggccaggtgctcgcgaacagaggagacgcgagatgctggccagcaacctggcggcagcgcaaaagatg

SEQ ID NO: 170914 - DNA, 103 bp, Artificial Sequence
  Synthetic Polynucleotide
taatacgactcactataggggcgtgggcgtcaggtggatcatgctggccaaacagaggagatggccaatgtgatccaccaacctggcggcagcgcaaaagatg

SEQ ID NO: 170915 - DNA, 103 bp, Artificial Sequence
  Synthetic Polynucleotide
taatacgactcactatagggatcttgacctgcgtgggcgtcaggtggatcaacagaggagagatccaatggacgcccacaacctggcggcagcgcaaaagatg

SEQ ID NO: 170916 - DNA, 103 bp, Artificial Sequence
  Synthetic Polynucleotide
taatacgactcactataggggattcggcggcggctgagcctgccggggctaacagaggagaagccccatgaggctcagcaacctggcggcagcgcaaaagatg

SEQ ID NO: 170917 - DNA, 103 bp, Artificial Sequence
  Synthetic Polynucleotide
taatacgactcactatagggctggaaccagatcttgacctgcgtgggcgtaacagaggagaacgcccatgcaggtcaagaacctggcggcagcgcaaaagatg

SEQ ID NO: 170918 - DNA, 103 bp, Artificial Sequence
  Synthetic Polynucleotide
taatacgactcactatagggagcggtggttctggaaccagatcttgacctaacagaggagaaggtcaatgtctggttccaacctggcggcagcgcaaaagatg

SEQ ID NO: 170919 - DNA, 103 bp, Artificial Sequence
  Synthetic Polynucleotide
taatacgactcactatagggttcattttgtagcggtggttctggaaccagaacagaggagactggttatggaaccaccgaacctggcggcagcgcaaaagatg

SEQ ID NO: 170920 - DNA, 103 bp, Artificial Sequence
  Synthetic Polynucleotide
taatacgactcactatagggggcctggcgcttcattttgtagcggtggttaacagaggagaaaccacatgtacaaaatgaacctggcggcagcgcaaaagatg

SEQ ID NO: 170921 - DNA, 103 bp, Artificial Sequence
  Synthetic Polynucleotide
taatacgactcactatagggccttgtccttggcctggcgcttcattttgtaacagaggagaacaaaaatgagcgccaggaacctggcggcagcgcaaaagatg

SEQ ID NO: 170922 - DNA, 103 bp, Artificial Sequence
  Synthetic Polynucleotide
taatacgactcactatagggtgctgcgccgccttgtccttggcctggcgcaacagaggagagcgccaatgcaaggacaaaacctggcggcagcgcaaaagatg

SEQ ID NO: 170923 - DNA, 103 bp, Artificial Sequence
  Synthetic Polynucleotide
taatacgactcactatagggctgcagttgctgctgcgccgccttgtccttaacagaggagaaaggacatggcggcgcagaacctggcggcagcgcaaaagatg

SEQ ID NO: 170924 - DNA, 103 bp, Artificial Sequence
  Synthetic Polynucleotide
taatacgactcactatagggcgctgtcctgctgcagttgctgctgcgccgaacagaggagacggcgcatgagcaactgcaacctggcggcagcgcaaaagatg

SEQ ID NO: 170925 - DNA, 103 bp, Artificial Sequence
  Synthetic Polynucleotide
taatacgactcactatagggccgccgccgccgctgtcctgctgcagttgcaacagaggagagcaactatggcaggacagaacctggcggcagcgcaaaagatg

SEQ ID NO: 170926 - DNA, 103 bp, Artificial Sequence
  Synthetic Polynucleotide
taatacgactcactatagggcccgccgcccccgccgccgccgctgtcctgaacagaggagacaggacatgggcggcggcaacctggcggcagcgcaaaagatg

SEQ ID NO: 170927 - DNA, 103 bp, Artificial Sequence
  Synthetic Polynucleotide
taatacgactcactatagggtcatcgacatgattcggcggcggctgagccaacagaggagaggctcaatggccgccgaaaacctggcggcagcgcaaaagatg

SEQ ID NO: 170928 - DNA, 103 bp, Artificial Sequence
  Synthetic Polynucleotide
taatacgactcactatagggacccggtgcccccgccgcccccgccgccgcaacagaggagagcggcgatgggggcggcgaacctggcggcagcgcaaaagatg

SEQ ID NO: 170929 - DNA, 103 bp, Artificial Sequence
  Synthetic Polynucleotide
taatacgactcactatagggtgctgcgggcacccggtgcccccgccgcccaacagaggagagggcggatggggcaccggaacctggcggcagcgcaaaagatg

SEQ ID NO: 170930 - DNA, 103 bp, Artificial Sequence
  Synthetic Polynucleotide
taatacgactcactatagggagcctgttgctgctgcgggcacccggtgccaacagaggagaggcaccatgtgcccgcagaacctggcggcagcgcaaaagatg

SEQ ID NO: 170931 - DNA, 103 bp, Artificial Sequence
  Synthetic Polynucleotide
taatacgactcactatagggactgctgctgagcctgttgctgctgcgggcaacagaggagagcccgcatgagcaacaggaacctggcggcagcgcaaaagatg

SEQ ID NO: 170932 - DNA, 103 bp, Artificial Sequence
  Synthetic Polynucleotide
taatacgactcactatagggcgtcgcggcgactgctgctgagcctgttgcaacagaggagagcaacaatgtcagcagcaaacctggcggcagcgcaaaagatg

SEQ ID NO: 170933 - DNA, 103 bp, Artificial Sequence
  Synthetic Polynucleotide
taatacgactcactatagggcaccgccacgcgtcgcggcgactgctgctgaacagaggagacagcagatgtcgccgcgaaacctggcggcagcgcaaaagatg

SEQ ID NO: 170934 - DNA, 103 bp, Artificial Sequence
  Synthetic Polynucleotide
taatacgactcactatagggccaggaccggcaccgccacgcgtcgcggcgaacagaggagacgccgcatggcgtggcggaacctggcggcagcgcaaaagatg

SEQ ID NO: 170935 - DNA, 103 bp, Artificial Sequence
  Synthetic Polynucleotide
taatacgactcactatagggccgtctttcaccaggaccggcaccgccacgaacagaggagacgtggcatggccggtcctaacctggcggcagcgcaaaagatg

SEQ ID NO: 170936 - DNA, 103 bp, Artificial Sequence
  Synthetic Polynucleotide
taatacgactcactataggggcacggtttgccgtctttcaccaggaccggaacagaggagaccggtcatggtgaaagacaacctggcggcagcgcaaaagatg

SEQ ID NO: 170937 - DNA, 103 bp, Artificial Sequence
  Synthetic Polynucleotide
taatacgactcactatagggcacccgcctggcacggtttgccgtctttcaaacagaggagatgaaagatggcaaaccgtaacctggcggcagcgcaaaagatg

SEQ ID NO: 170938 - DNA, 103 bp, Artificial Sequence
  Synthetic Polynucleotide
taatacgactcactatagggtgctttggactcatcgacatgattcggcggaacagaggagaccgccgatgcatgtcgataacctggcggcagcgcaaaagatg

SEQ ID NO: 170939 - DNA, 103 bp, Artificial Sequence
  Synthetic Polynucleotide
taatacgactcactatagggggcgcgggggcacccgcctggcacggtttgaacagaggagacaaaccatgccaggcgggaacctggcggcagcgcaaaagatg

SEQ ID NO: 170940 - DNA, 103 bp, Artificial Sequence
  Synthetic Polynucleotide
taatacgactcactatagggggcggcgcccggcgcgggggcacccgcctgaacagaggagacaggcgatggcccccgcgaacctggcggcagcgcaaaagatg

SEQ ID NO: 170941 - DNA, 103 bp, Artificial Sequence
  Synthetic Polynucleotide
taatacgactcactatagggcttgtaggctggcggcgcccggcgcgggggaacagaggagacccccgatgcgggcgccgaacctggcggcagcgcaaaagatg

SEQ ID NO: 170942 - DNA, 103 bp, Artificial Sequence
  Synthetic Polynucleotide
taatacgactcactatagggtgcgcgtggccttgtaggctggcggcgcccaacagaggagagggcgcatgcagcctacaaacctggcggcagcgcaaaagatg

SEQ ID NO: 170943 - DNA, 103 bp, Artificial Sequence
  Synthetic Polynucleotide
taatacgactcactatagggcgcctgctgctgcgcgtggccttgtaggctaacagaggagaagcctaatgggccacgcgaacctggcggcagcgcaaaagatg

SEQ ID NO: 170944 - DNA, 103 bp, Artificial Sequence
  Synthetic Polynucleotide
taatacgactcactatagggcctggtgctgcgcctgctgctgcgcgtggcaacagaggagagccacgatgagcagcaggaacctggcggcagcgcaaaagatg

SEQ ID NO: 170945 - DNA, 103 bp, Artificial Sequence
  Synthetic Polynucleotide
taatacgactcactataggggcggcctgcgcctggtgctgcgcctgctgcaacagaggagagcagcaatggcagcaccaaacctggcggcagcgcaaaagatg

SEQ ID NO: 170946 - DNA, 103 bp, Artificial Sequence
  Synthetic Polynucleotide
taatacgactcactatagggcgccgcctgcgcggcctgcgcctggtgctgaacagaggagacagcacatggcgcaggccaacctggcggcagcgcaaaagatg

SEQ ID NO: 170947 - DNA, 103 bp, Artificial Sequence
  Synthetic Polynucleotide
taatacgactcactatagggtggccgctgccgccgcctgcgcggcctgcgaacagaggagacgcaggatgcgcaggcggaacctggcggcagcgcaaaagatg

SEQ ID NO: 170948 - DNA, 103 bp, Artificial Sequence
  Synthetic Polynucleotide
taatacgactcactatagggcccacggagatggccgctgccgccgcctgcaacagaggagagcaggcatgggcagcggcaacctggcggcagcgcaaaagatg

SEQ ID NO: 170949 - DNA, 103 bp, Artificial Sequence
  Synthetic Polynucleotide
taatacgactcactatagggaaaccccgtctttgtgttggtcagcgacataacagaggagaatgtcgatgaccaacacaaacctggcggcagcgcaaaagatg

SEQ ID NO: 170950 - DNA, 103 bp, Artificial Sequence
  Synthetic Polynucleotide
taatacgactcactatagggctcgggcccctcgttctcttcctccggaccaacagaggagaggtccgatggaagagaacaacctggcggcagcgcaaaagatg

SEQ ID NO: 170951 - DNA, 103 bp, Artificial Sequence
  Synthetic Polynucleotide
taatacgactcactatagggtcttggctggctcgggcccctcgttctcttaacagaggagaaagagaatgaggggcccgaacctggcggcagcgcaaaagatg

SEQ ID NO: 170952 - DNA, 103 bp, Artificial Sequence
  Synthetic Polynucleotide
taatacgactcactatagggggcccggccctcttggctggctcgggccccaacagaggagaggggccatggccagccaaaacctggcggcagcgcaaaagatg

SEQ ID NO: 170953 - DNA, 103 bp, Artificial Sequence
  Synthetic Polynucleotide
taatacgactcactatagggctgccccagcggcccggccctcttggctggaacagaggagaccagccatgagggccgggaacctggcggcagcgcaaaagatg

SEQ ID NO: 170954 - DNA, 103 bp, Artificial Sequence
  Synthetic Polynucleotide
taatacgactcactatagggccagggcgccctgccccagcggcccggcccaacagaggagagggccgatgcgctggggcaacctggcggcagcgcaaaagatg

SEQ ID NO: 170955 - DNA, 103 bp, Artificial Sequence
  Synthetic Polynucleotide
taatacgactcactatagggtgcaccgcgtccagggcgccctgccccagcaacagaggagagctgggatggggcgccctaacctggcggcagcgcaaaagatg

SEQ ID NO: 170956 - DNA, 103 bp, Artificial Sequence
  Synthetic Polynucleotide
taatacgactcactataggggggcaggctctgcaccgcgtccagggcgccaacagaggagaggcgccatggacgcggtgaacctggcggcagcgcaaaagatg

SEQ ID NO: 170957 - DNA, 103 bp, Artificial Sequence
  Synthetic Polynucleotide
taatacgactcactatagggggttcttcaggggcaggctctgcaccgcgtaacagaggagaacgcggatgagagcctgcaacctggcggcagcgcaaaagatg

SEQ ID NO: 170958 - DNA, 103 bp, Artificial Sequence
  Synthetic Polynucleotide
taatacgactcactatagggtcgtagaaggggttcttcaggggcaggctcaacagaggagagagcctatgcctgaagaaaacctggcggcagcgcaaaagatg

SEQ ID NO: 170959 - DNA, 103 bp, Artificial Sequence
  Synthetic Polynucleotide
taatacgactcactataggggtcgctgctgtcgtagaaggggttcttcagaacagaggagactgaagatgcccttctacaacctggcggcagcgcaaaagatg

SEQ ID NO: 170960 - DNA, 103 bp, Artificial Sequence
  Synthetic Polynucleotide
taatacgactcactatagggccttgaccgaaaaccccgtctttgtgttggaacagaggagaccaacaatgagacggggtaacctggcggcagcgcaaaagatg

SEQ ID NO: 170961 - DNA, 103 bp, Artificial Sequence
  Synthetic Polynucleotide
taatacgactcactatagggtgtacgggttgtcgctgctgtcgtagaaggaacagaggagaccttctatgacagcagcgaacctggcggcagcgcaaaagatg

SEQ ID NO: 170962 - DNA, 103 bp, Artificial Sequence
  Synthetic Polynucleotide
taatacgactcactatagggagccagcgcgtgtacgggttgtcgctgctgaacagaggagacagcagatgcaacccgtaaacctggcggcagcgcaaaagatg

SEQ ID NO: 170963 - DNA, 103 bp, Artificial Sequence
  Synthetic Polynucleotide
taatacgactcactatagggggtgctggccagccagcgcgtgtacgggttaacagaggagaaacccgatgacgcgctggaacctggcggcagcgcaaaagatg

SEQ ID NO: 170964 - DNA, 103 bp, Artificial Sequence
  Synthetic Polynucleotide
taatacgactcactataggggaaggccctcggtgctggccagccagcgcgaacagaggagacgcgctatgtggccagcaaacctggcggcagcgcaaaagatg

SEQ ID NO: 170965 - DNA, 103 bp, Artificial Sequence
  Synthetic Polynucleotide
taatacgactcactatagggagggagtactgaaggccctcggtgctggccaacagaggagaggccagatgcgagggcctaacctggcggcagcgcaaaagatg

SEQ ID NO: 170966 - DNA, 103 bp, Artificial Sequence
  Synthetic Polynucleotide
taatacgactcactatagggcagaccgtgcagggagtactgaaggccctcaacagaggagagagggcatgcagtactccaacctggcggcagcgcaaaagatg

SEQ ID NO: 170967 - DNA, 103 bp, Artificial Sequence
  Synthetic Polynucleotide
taatacgactcactatagggccccggcagccagaccgtgcagggagtactaacagaggagaagtactatgtgcacggtcaacctggcggcagcgcaaaagatg

SEQ ID NO: 170968 - DNA, 103 bp, Artificial Sequence
  Synthetic Polynucleotide
taatacgactcactatagggtgagggggcgccccggcagccagaccgtgcaacagaggagagcacggatgggctgccggaacctggcggcagcgcaaaagatg

SEQ ID NO: 170969 - DNA, 103 bp, Artificial Sequence
  Synthetic Polynucleotide
taatacgactcactataggggcttgagtcctgagggggcgccccggcagcaacagaggagagctgccatggcgccccctaacctggcggcagcgcaaaagatg

SEQ ID NO: 170970 - DNA, 103 bp, Artificial Sequence
  Synthetic Polynucleotide
taatacgactcactataggggggacttggagcttgagtcctgagggggcgaacagaggagacgccccatgaggactcaaaacctggcggcagcgcaaaagatg

SEQ ID NO: 170971 - DNA, 103 bp, Artificial Sequence
  Synthetic Polynucleotide
taatacgactcactatagggtctaagatgtccttgaccgaaaaccccgtcaacagaggagagacgggatgttcggtcaaaacctggcggcagcgcaaaagatg

SEQ ID NO: 170972 - DNA, 103 bp, Artificial Sequence
  Synthetic Polynucleotide
taatacgactcactataggggagggctccggggacttggagcttgagtccaacagaggagaggactcatgctccaagtcaacctggcggcagcgcaaaagatg

SEQ ID NO: 170973 - DNA, 103 bp, Artificial Sequence
  Synthetic Polynucleotide
taatacgactcactatagggctcgtcggccgagggctccggggacttggaaacagaggagatccaagatgccggagcccaacctggcggcagcgcaaaagatg

SEQ ID NO: 170974 - DNA, 103 bp, Artificial Sequence
  Synthetic Polynucleotide
taatacgactcactatagggtgtccggtgactcgtcggccgagggctccgaacagaggagacggagcatgcggccgacgaacctggcggcagcgcaaaagatg

SEQ ID NO: 170975 - DNA, 103 bp, Artificial Sequence
  Synthetic Polynucleotide
taatacgactcactatagggtccttgtcattgtccggtgactcgtcggccaacagaggagaggccgaatggtcaccggaaacctggcggcagcgcaaaagatg

SEQ ID NO: 170976 - DNA, 103 bp, Artificial Sequence
  Synthetic Polynucleotide
taatacgactcactataggggcccggggtctccttgtcattgtccggtgaaacagaggagatcaccgatgaatgacaagaacctggcggcagcgcaaaagatg

SEQ ID NO: 170977 - DNA, 103 bp, Artificial Sequence
  Synthetic Polynucleotide
taatacgactcactatagggcccccccgccgcccggggtctccttgtcataacagaggagaatgacaatgagaccccggaacctggcggcagcgcaaaagatg

SEQ ID NO: 170978 - DNA, 103 bp, Artificial Sequence
  Synthetic Polynucleotide
taatacgactcactatagggttgccggcgtcccccccgccgcccggggtcaacagaggagagaccccatgcggcgggggaacctggcggcagcgcaaaagatg

SEQ ID NO: 170979 - DNA, 103 bp, Artificial Sequence
  Synthetic Polynucleotide
taatacgactcactatagggctttcgcttcttgccggcgtcccccccgccaacagaggagaggcgggatggacgccggcaacctggcggcagcgcaaaagatg

SEQ ID NO: 170980 - DNA, 103 bp, Artificial Sequence
  Synthetic Polynucleotide
taatacgactcactataggggcactcgccgctttcgcttcttgccggcgtaacagaggagaacgccgatgagaagcgaaaacctggcggcagcgcaaaagatg

SEQ ID NO: 170981 - DNA, 103 bp, Artificial Sequence
  Synthetic Polynucleotide
taatacgactcactatagggttggagaaaagcactcgccgctttcgcttcaacagaggagagaagcgatggcggcgagtaacctggcggcagcgcaaaagatg

SEQ ID NO: 170982 - DNA, 103 bp, Artificial Sequence
  Synthetic Polynucleotide
taatacgactcactataggggtccggcaggtctaagatgtccttgaccgaaacagaggagatcggtcatggacatcttaaacctggcggcagcgcaaaagatg

SEQ ID NO: 170983 - DNA, 103 bp, Artificial Sequence
  Synthetic Polynucleotide
taatacgactcactatagggggtctgcgccttggagaaaagcactcgccgaacagaggagacggcgaatgcttttctccaacctggcggcagcgcaaaagatg

SEQ ID NO: 170984 - DNA, 103 bp, Artificial Sequence
  Synthetic Polynucleotide
taatacgactcactatagggccagctcgtaggtctgcgccttggagaaaaaacagaggagattttctatgaggcgcagaaacctggcggcagcgcaaaagatg

SEQ ID NO: 170985 - DNA, 103 bp, Artificial Sequence
  Synthetic Polynucleotide
taatacgactcactatagggaagcgccgctccagctcgtaggtctgcgccaacagaggagaggcgcaatgctacgagctaacctggcggcagcgcaaaagatg

SEQ ID NO: 170986 - DNA, 103 bp, Artificial Sequence
  Synthetic Polynucleotide
taatacgactcactatagggctgctgccgaaagcgccgctccagctcgtaaacagaggagatacgagatggagcggcgcaacctggcggcagcgcaaaagatg

SEQ ID NO: 170987 - DNA, 103 bp, Artificial Sequence
  Synthetic Polynucleotide
taatacgactcactatagggacaggtaccgctgctgccgaaagcgccgctaacagaggagaagcggcatgttcggcagcaacctggcggcagcgcaaaagatg

SEQ ID NO: 170988 - DNA, 103 bp, Artificial Sequence
  Synthetic Polynucleotide
taatacgactcactatagggtcgggcgccgacaggtaccgctgctgccgaaacagaggagatcggcaatggcggtacctaacctggcggcagcgcaaaagatg

SEQ ID NO: 170989 - DNA, 103 bp, Artificial Sequence
  Synthetic Polynucleotide
taatacgactcactataggggtgttcgcgctcgggcgccgacaggtaccgaacagaggagacggtacatgtcggcgcccaacctggcggcagcgcaaaagatg

SEQ ID NO: 170990 - DNA, 103 bp, Artificial Sequence
  Synthetic Polynucleotide
taatacgactcactatagggggctggccaggtgttcgcgctcgggcgccgaacagaggagacggcgcatgagcgcgaacaacctggcggcagcgcaaaagatg

SEQ ID NO: 170991 - DNA, 103 bp, Artificial Sequence
  Synthetic Polynucleotide
taatacgactcactatagggaggcggatgaggctggccaggtgttcgcgcaacagaggagagcgcgaatgcctggccagaacctggcggcagcgcaaaagatg

SEQ ID NO: 170992 - DNA, 103 bp, Artificial Sequence
  Synthetic Polynucleotide
taatacgactcactatagggcgtgggcgtgaggcggatgaggctggccagaacagaggagactggccatgctcatccgcaacctggcggcagcgcaaaagatg

SEQ ID NO: 170993 - DNA, 103 bp, Artificial Sequence
  Synthetic Polynucleotide
taatacgactcactatagggcatcgttggtgtccggcaggtctaagatgtaacagaggagaacatctatgacctgccggaacctggcggcagcgcaaaagatg

SEQ ID NO: 170994 - DNA, 103 bp, Artificial Sequence
  Synthetic Polynucleotide
taatacgactcactatagggtcttgacctgcgtgggcgtgaggcggatgaaacagaggagatcatccatgtcacgcccaaacctggcggcagcgcaaaagatg

SEQ ID NO: 170995 - DNA, 103 bp, Artificial Sequence
  Synthetic Polynucleotide
taatacgactcactatagggtggaaccagatcttgacctgcgtgggcgtgaacagaggagacacgccatggcaggtcaaaacctggcggcagcgcaaaagatg

SEQ ID NO: 170996 - DNA, 103 bp, Artificial Sequence
  Synthetic Polynucleotide
taatacgactcactataggggcggtggttctggaaccagatcttgacctgaacagaggagacaggtcatgatctggttcaacctggcggcagcgcaaaagatg

SEQ ID NO: 170997 - DNA, 103 bp, Artificial Sequence
  Synthetic Polynucleotide
taatacgactcactatagggtcatcttgtagcggtggttctggaaccagaaacagaggagatctggtatgagaaccaccaacctggcggcagcgcaaaagatg

SEQ ID NO: 170998 - DNA, 103 bp, Artificial Sequence
  Synthetic Polynucleotide
taatacgactcactatagggcgggcgcgcttcatcttgtagcggtggttcaacagaggagagaaccaatgctacaagataacctggcggcagcgcaaaagatg

SEQ ID NO: 170999 - DNA, 103 bp, Artificial Sequence
  Synthetic Polynucleotide
taatacgactcactatagggtttctcggcccgggcgcgcttcatcttgtaaacagaggagatacaagatgaagcgcgccaacctggcggcagcgcaaaagatg

SEQ ID NO: 171000 - DNA, 103 bp, Artificial Sequence
  Synthetic Polynucleotide
taatacgactcactatagggcctccatacctttctcggcccgggcgcgctaacagaggagaagcgcgatggggccgagaaacctggcggcagcgcaaaagatg

SEQ ID NO: 171001 - DNA, 103 bp, Artificial Sequence
  Synthetic Polynucleotide
taatacgactcactatagggaggggcgtcacctccatacctttctcggccaacagaggagaggccgaatgaggtatggaaacctggcggcagcgcaaaagatg

SEQ ID NO: 171002 - DNA, 103 bp, Artificial Sequence
  Synthetic Polynucleotide
taatacgactcactatagggcggcgagggcaggggcgtcacctccataccaacagaggagaggtatgatggtgacgcccaacctggcggcagcgcaaaagatg

SEQ ID NO: 171003 - DNA, 103 bp, Artificial Sequence
  Synthetic Polynucleotide
taatacgactcactatagggccacccggcgcggcgagggcaggggcgtcaaacagaggagatgacgcatgtgccctcgcaacctggcggcagcgcaaaagatg

SEQ ID NO: 171004 - DNA, 103 bp, Artificial Sequence
  Synthetic Polynucleotide
taatacgactcactataggggagccctcctcatcgttggtgtccggcaggaacagaggagacctgccatgcaccaacgaaacctggcggcagcgcaaaagatg

SEQ ID NO: 171005 - DNA, 103 bp, Artificial Sequence
  Synthetic Polynucleotide
taatacgactcactatagggacgggcacggccacccggcgcggcgagggcaacagaggagagccctcatggcgccgggtaacctggcggcagcgcaaaagatg

SEQ ID NO: 171006 - DNA, 103 bp, Artificial Sequence
  Synthetic Polynucleotide
taatacgactcactatagggcctgaccaagacgggcacggccacccggcgaacagaggagacgccggatggccgtgcccaacctggcggcagcgcaaaagatg

SEQ ID NO: 171007 - DNA, 103 bp, Artificial Sequence
  Synthetic Polynucleotide
taatacgactcactataggggtttgccgtccctgaccaagacgggcacggaacagaggagaccgtgcatgtcttggtcaaacctggcggcagcgcaaaagatg

SEQ ID NO: 171008 - DNA, 103 bp, Artificial Sequence
  Synthetic Polynucleotide
taatacgactcactataggggcgtgacatggtttgccgtccctgaccaagaacagaggagacttggtatgggacggcaaaacctggcggcagcgcaaaagatg

SEQ ID NO: 171009 - DNA, 103 bp, Artificial Sequence
  Synthetic Polynucleotide
taatacgactcactatagggggctttgagcgcgtgacatggtttgccgtcaacagaggagagacggcatgccatgtcacaacctggcggcagcgcaaaagatg

SEQ ID NO: 171010 - DNA, 103 bp, Artificial Sequence
  Synthetic Polynucleotide
taatacgactcactatagggccaggtcctgggctttgagcgcgtgacatgaacagaggagacatgtcatgcgctcaaagaacctggcggcagcgcaaaagatg

SEQ ID NO: 171011 - DNA, 103 bp, Artificial Sequence
  Synthetic Polynucleotide
taatacgactcactataggggtggcggctgccaggtcctgggctttgagcaacagaggagagctcaaatgccaggacctaacctggcggcagcgcaaaagatg

SEQ ID NO: 171012 - DNA, 103 bp, Artificial Sequence
  Synthetic Polynucleotide
taatacgactcactatagggcgcctggaaggtggcggctgccaggtcctgaacagaggagacaggacatggcagccgccaacctggcggcagcgcaaaagatg

SEQ ID NO: 171013 - DNA, 103 bp, Artificial Sequence
  Synthetic Polynucleotide
taatacgactcactatagggagggaatgcccgcctggaaggtggcggctgaacagaggagacagccgatgccttccaggaacctggcggcagcgcaaaagatg

SEQ ID NO: 171014 - DNA, 103 bp, Artificial Sequence
  Synthetic Polynucleotide
taatacgactcactatagggtaggcagaaaagggaatgcccgcctggaagaacagaggagacttccaatggggcattccaacctggcggcagcgcaaaagatg

SEQ ID NO: 171015 - DNA, 103 bp, Artificial Sequence
  Synthetic Polynucleotide
taatacgactcactatagggttcggccacagagccctcctcatcgttggtaacagaggagaaccaacatggaggagggcaacctggcggcagcgcaaaagatg

SEQ ID NO: 171016 - DNA, 103 bp, Artificial Sequence
  Synthetic Polynucleotide
taatacgactcactatagggctgcgcgctgtaggcagaaaagggaatgccaacagaggagaggcattatgttttctgccaacctggcggcagcgcaaaagatg

SEQ ID NO: 171017 - DNA, 103 bp, Artificial Sequence
  Synthetic Polynucleotide
taatacgactcactataggggctgcagcgactgcgcgctgtaggcagaaaaacagaggagatttctgatgacagcgcgcaacctggcggcagcgcaaaagatg

SEQ ID NO: 171018 - DNA, 103 bp, Artificial Sequence
  Synthetic Polynucleotide
taatacgactcactatagggtactgcatgtgctgcagcgactgcgcgctgaacagaggagacagcgcatggtcgctgcaaacctggcggcagcgcaaaagatg

SEQ ID NO: 171019 - DNA, 103 bp, Artificial Sequence
  Synthetic Polynucleotide
taatacgactcactatagggctgggcgttgtactgcatgtgctgcagcgaaacagaggagatcgctgatgcacatgcagaacctggcggcagcgcaaaagatg

SEQ ID NO: 171020 - DNA, 103 bp, Artificial Sequence
  Synthetic Polynucleotide
taatacgactcactatagggccgagctgtactgggcgttgtactgcatgtaacagaggagaacatgcatgacaacgcccaacctggcggcagcgcaaaagatg

SEQ ID NO: 171021 - DNA, 103 bp, Artificial Sequence
  Synthetic Polynucleotide
taatacgactcactatagggggggtgctggccgagctgtactgggcgttgaacagaggagacaacgcatggtacagctcaacctggcggcagcgcaaaagatg

SEQ ID NO: 171022 - DNA, 103 bp, Artificial Sequence
  Synthetic Polynucleotide
taatacgactcactatagggcgggtactggggggtgctggccgagctgtaaacagaggagatacagcatggccagcaccaacctggcggcagcgcaaaagatg

SEQ ID NO: 171023 - DNA, 103 bp, Artificial Sequence
  Synthetic Polynucleotide
taatacgactcactatagggggtgtgctgtcgggtactggggggtgctggaacagaggagaccagcaatgcccagtaccaacctggcggcagcgcaaaagatg

SEQ ID NO: 171024 - DNA, 103 bp, Artificial Sequence
  Synthetic Polynucleotide
taatacgactcactatagggtggaccagggggtgtgctgtcgggtactggaacagaggagaccagtaatggacagcacaaacctggcggcagcgcaaaagatg

SEQ ID NO: 171025 - DNA, 103 bp, Artificial Sequence
  Synthetic Polynucleotide
taatacgactcactatagggctgctgggcctggaccagggggtgtgctgtaacagaggagaacagcaatgcccctggtcaacctggcggcagcgcaaaagatg

SEQ ID NO: 171026 - DNA, 103 bp, Artificial Sequence
  Synthetic Polynucleotide
taatacgactcactatagggcctccggaccttcggccacagagccctcctaacagaggagaaggaggatgctgtggccgaacctggcggcagcgcaaaagatg

SEQ ID NO: 171027 - DNA, 103 bp, Artificial Sequence
  Synthetic Polynucleotide
taatacgactcactatagggaccaagtccactgctgggcctggaccagggaacagaggagaccctggatgaggcccagcaacctggcggcagcgcaaaagatg

SEQ ID NO: 171028 - DNA, 103 bp, Artificial Sequence
  Synthetic Polynucleotide
taatacgactcactatagggtcgttctcttcctccggaccttcggccacaaacagaggagatgtggcatgaggtccggaaacctggcggcagcgcaaaagatg

SEQ ID NO: 171029 - DNA, 103 bp, Artificial Sequence
  Synthetic Polynucleotide
taatacgactcactatagggcgtgggcgtgagagcagggctggggaacataacagaggagaatgttcatgagccctgctaacctggcggcagcgcaaaagatg

SEQ ID NO: 171030 - DNA, 103 bp, Artificial Sequence
  Synthetic Polynucleotide
taatacgactcactatagggggtcgcctccaggcgggcagagagctctccaacagaggagaggagagatgtctgcccgcaacctggcggcagcgcaaaagatg

SEQ ID NO: 171031 - DNA, 103 bp, Artificial Sequence
  Synthetic Polynucleotide
taatacgactcactatagggagggcgccagggtcgcctccaggcgggcagaacagaggagactgcccatgtggaggcgaaacctggcggcagcgcaaaagatg

SEQ ID NO: 171032 - DNA, 103 bp, Artificial Sequence
  Synthetic Polynucleotide
taatacgactcactatagggatgcaggaggagggcgccagggtcgcctccaacagaggagaggaggcatgcctggcgccaacctggcggcagcgcaaaagatg

SEQ ID NO: 171033 - DNA, 103 bp, Artificial Sequence
  Synthetic Polynucleotide
taatacgactcactatagggggcggccagcatgcaggaggagggcgccagaacagaggagactggcgatgtcctcctgcaacctggcggcagcgcaaaagatg

SEQ ID NO: 171034 - DNA, 103 bp, Artificial Sequence
  Synthetic Polynucleotide
taatacgactcactatagggctggcttgaaggcggccagcatgcaggaggaacagaggagacctcctatgtgctggccgaacctggcggcagcgcaaaagatg

SEQ ID NO: 171035 - DNA, 103 bp, Artificial Sequence
  Synthetic Polynucleotide
taatacgactcactataggggcgtaggcctctggcttgaaggcggccagcaacagaggagagctggcatgcttcaagccaacctggcggcagcgcaaaagatg

SEQ ID NO: 171036 - DNA, 103 bp, Artificial Sequence
  Synthetic Polynucleotide
taatacgactcactatagggctcgggcccagcgtaggcctctggcttgaaaacagaggagattcaagatggaggcctacaacctggcggcagcgcaaaagatg

SEQ ID NO: 171037 - DNA, 103 bp, Artificial Sequence
  Synthetic Polynucleotide
taatacgactcactataggggcgcagccgcctcgggcccagcgtaggcctaacagaggagaaggcctatgctgggcccgaacctggcggcagcgcaaaagatg

SEQ ID NO: 171038 - DNA, 103 bp, Artificial Sequence
  Synthetic Polynucleotide
taatacgactcactataggggggaggcccggcgcagccgcctcgggcccaaacagaggagatgggccatgggcggctgcaacctggcggcagcgcaaaagatg

SEQ ID NO: 171039 - DNA, 103 bp, Artificial Sequence
  Synthetic Polynucleotide
taatacgactcactataggggcgcagctctgggaggcccggcgcagccgcaacagaggagagcggctatgccgggcctcaacctggcggcagcgcaaaagatg

SEQ ID NO: 171040 - DNA, 103 bp, Artificial Sequence
  Synthetic Polynucleotide
taatacgactcactatagggctgagaagggcgtgggcgtgagagcagggcaacagaggagagccctgatgtcacgcccaaacctggcggcagcgcaaaagatg

SEQ ID NO: 171041 - DNA, 103 bp, Artificial Sequence
  Synthetic Polynucleotide
taatacgactcactatagggccagctctgcgcgcagctctgggaggcccgaacagaggagacgggccatgcagagctgcaacctggcggcagcgcaaaagatg

SEQ ID NO: 171042 - DNA, 103 bp, Artificial Sequence
  Synthetic Polynucleotide
taatacgactcactatagggggcgcgcggcccagctctgcgcgcagctctaacagaggagaagagctatgcgcagagctaacctggcggcagcgcaaaagatg

SEQ ID NO: 171043 - DNA, 103 bp, Artificial Sequence
  Synthetic Polynucleotide
taatacgactcactatagggggccggtgaaggcgcgcggcccagctctgcaacagaggagagcagagatgggccgcgcgaacctggcggcagcgcaaaagatg

SEQ ID NO: 171044 - DNA, 103 bp, Artificial Sequence
  Synthetic Polynucleotide
taatacgactcactatagggacgcacacttggccggtgaaggcgcgcggcaacagaggagagccgcgatgcttcaccggaacctggcggcagcgcaaaagatg

SEQ ID NO: 171045 - DNA, 103 bp, Artificial Sequence
  Synthetic Polynucleotide
taatacgactcactatagggggaaaggcagacgcacacttggccggtgaaaacagaggagattcaccatgcaagtgtgcaacctggcggcagcgcaaaagatg

SEQ ID NO: 171046 - DNA, 103 bp, Artificial Sequence
  Synthetic Polynucleotide
taatacgactcactataggggggggcggcgggaaaggcagacgcacacttaacagaggagaaagtgtatgtctgcctttaacctggcggcagcgcaaaagatg

SEQ ID NO: 171047 - DNA, 103 bp, Artificial Sequence
  Synthetic Polynucleotide
taatacgactcactataggggatagaaggcgggggcggcgggaaaggcagaacagaggagactgcctatgccgccgcccaacctggcggcagcgcaaaagatg

SEQ ID NO: 171048 - DNA, 103 bp, Artificial Sequence
  Synthetic Polynucleotide
taatacgactcactatagggtaggcacgtggatagaaggcgggggcggcgaacagaggagacgccgcatgcgccttctaaacctggcggcagcgcaaaagatg

SEQ ID NO: 171049 - DNA, 103 bp, Artificial Sequence
  Synthetic Polynucleotide
taatacgactcactatagggggggtcgctgtaggcacgtggatagaaggcaacagaggagagccttcatgccacgtgccaacctggcggcagcgcaaaagatg

SEQ ID NO: 171050 - DNA, 103 bp, Artificial Sequence
  Synthetic Polynucleotide
taatacgactcactatagggtggctgggtcggggtcgctgtaggcacgtgaacagaggagacacgtgatgacagcgaccaacctggcggcagcgcaaaagatg

SEQ ID NO: 171051 - DNA, 103 bp, Artificial Sequence
  Synthetic Polynucleotide
taatacgactcactatagggatgtctttgactgagaagggcgtgggcgtgaacagaggagacacgccatggcccttctcaacctggcggcagcgcaaaagatg

SEQ ID NO: 171052 - DNA, 103 bp, Artificial Sequence
  Synthetic Polynucleotide
taatacgactcactatagggctagggtccttggctgggtcggggtcgctgaacagaggagacagcgaatgcgacccagcaacctggcggcagcgcaaaagatg

SEQ ID NO: 171053 - DNA, 103 bp, Artificial Sequence
  Synthetic Polynucleotide
taatacgactcactatagggcttttcggctctagggtccttggctgggtcaacagaggagagacccaatgaaggaccctaacctggcggcagcgcaaaagatg

SEQ ID NO: 171054 - DNA, 103 bp, Artificial Sequence
  Synthetic Polynucleotide
taatacgactcactatagggacagctctttcttttcggctctagggtcctaacagaggagaaggaccatggagccgaaaaacctggcggcagcgcaaaagatg

SEQ ID NO: 171055 - DNA, 103 bp, Artificial Sequence
  Synthetic Polynucleotide
taatacgactcactatagggtgcagcgcgcacagctctttcttttcggctaacagaggagaagccgaatggaaagagctaacctggcggcagcgcaaaagatg
